United States Patent 8,461,315 (MICRORNAS AND USES THEREOF) - sequence listing, part 21

SEQ ID NO: 593173 - RNA, 64 nt, Homo Sapiens; identical to SEQ ID NO: 70826

SEQ ID NO: 593174 - RNA, 64 nt, Homo Sapiens; identical to SEQ ID NO: 70827

SEQ ID NO: 593175 - RNA, 64 nt, Homo Sapiens; identical to SEQ ID NO: 70828

SEQ ID NO: 593176 - RNA, 64 nt, Homo Sapiens; identical to SEQ ID NO: 70829

SEQ ID NO: 593177 - RNA, 64 nt, Homo Sapiens
gcagccucauuccuucacaauggcuucagcauccugcagguagacaauaaagggauggcccucc

SEQ ID NO: 593178 - RNA, 64 nt, Homo Sapiens
auuggcacagaguuaagguuccuguccccuugcuugcagguagaugucuugagcaggcaccauc

SEQ ID NO: 593179 - RNA, 64 nt, Homo Sapiens
uugcucucuaggccugugugaugcagcaggugugugcagguaucuuagugauguguuacccagg

SEQ ID NO: 593180 - RNA, 64 nt, Homo Sapiens
uuuuucuggaugauaggacaguuacccuccucucugcagguaggacugccccagucuuugacug

SEQ ID NO: 593181 - RNA, 64 nt, Homo Sapiens
gugaccagucagaauaaugucaaagugcuuacagugcagguagugauaugugcaucuacugcag

SEQ ID NO: 593182 - RNA, 64 nt, Homo Sapiens
ugugacagcuucuguagcacuaaagugcuuauagugcagguaguguuuaguuaucuacugcauu

SEQ ID NO: 593183 - RNA, 64 nt, Homo Sapiens
gcacccuuguacagagauggauugaauccucggcugcagguagaggcagcuucuacuuucugga

SEQ ID NO: 593184 - RNA, 64 nt, Homo Sapiens
ccaacucuucccuggagcggauaguggcucaaacugcagguaucgggauaagauugcaucuucc

SEQ ID NO: 593185 - RNA, 64 nt, Homo Sapiens; identical to SEQ ID NO: 212929

SEQ ID NO: 593186 - RNA, 64 nt, Homo Sapiens; identical to SEQ ID NO: 212930

SEQ ID NO: 593187 - RNA, 64 nt, Homo Sapiens; identical to SEQ ID NO: 212931

SEQ ID NO: 593188 - RNA, 64 nt, Homo Sapiens; identical to SEQ ID NO: 212932

SEQ ID NO: 593189 - RNA, 64 nt, Homo Sapiens; identical to SEQ ID NO: 212933

SEQ ID NO: 593190 - RNA, 64 nt, Homo Sapiens; identical to SEQ ID NO: 212934

SEQ ID NO: 593191 - RNA, 64 nt, Homo Sapiens; identical to SEQ ID NO: 212935

SEQ ID NO: 593192 - RNA, 64 nt, Homo Sapiens; identical to SEQ ID NO: 212936

SEQ ID NO: 593193 - RNA, 64 nt, Homo Sapiens; identical to SEQ ID NO: 212937

SEQ ID NO: 593194 - RNA, 64 nt, Homo Sapiens; identical to SEQ ID NO: 212938

SEQ ID NO: 593195 - RNA, 64 nt, Homo Sapiens; identical to SEQ ID NO: 212939

SEQ ID NO: 593196 - RNA, 64 nt, Homo Sapiens; identical to SEQ ID NO: 212940

SEQ ID NO: 593197 - RNA, 64 nt, Homo Sapiens; identical to SEQ ID NO: 212941

SEQ ID NO: 593198 - RNA, 64 nt, Homo Sapiens; identical to SEQ ID NO: 212942

SEQ ID NO: 593199 - RNA, 64 nt, Homo Sapiens; identical to SEQ ID NO: 212943

SEQ ID NO: 593200 - RNA, 64 nt, Homo Sapiens; identical to SEQ ID NO: 212944

SEQ ID NO: 593201 - RNA, 64 nt, Homo Sapiens; identical to SEQ ID NO: 212945

SEQ ID NO: 593202 - RNA, 64 nt, Homo Sapiens; identical to SEQ ID NO: 212946

SEQ ID NO: 593203 - RNA, 64 nt, Homo Sapiens; identical to SEQ ID NO: 212947

SEQ ID NO: 593204 - RNA, 64 nt, Homo Sapiens; identical to SEQ ID NO: 212948

SEQ ID NO: 593205 - RNA, 64 nt, Homo Sapiens; identical to SEQ ID NO: 212949

SEQ ID NO: 593206 - RNA, 64 nt, Homo Sapiens; identical to SEQ ID NO: 212950

SEQ ID NO: 593207 - RNA, 64 nt, Homo Sapiens; identical to SEQ ID NO: 212951

SEQ ID NO: 593208 - RNA, 64 nt, Homo Sapiens; identical to SEQ ID NO: 212952

SEQ ID NO: 593209 - RNA, 64 nt, Homo Sapiens; identical to SEQ ID NO: 212953

SEQ ID NO: 593210 - RNA, 64 nt, Homo Sapiens; identical to SEQ ID NO: 212954

SEQ ID NO: 593211 - RNA, 64 nt, Homo Sapiens; identical to SEQ ID NO: 212955

SEQ ID NO: 593212 - RNA, 64 nt, Homo Sapiens; identical to SEQ ID NO: 212956

SEQ ID NO: 593213 - RNA, 64 nt, Homo Sapiens; identical to SEQ ID NO: 212957

SEQ ID NO: 593214 - RNA, 64 nt, Homo Sapiens
aaaacaaacaagcuacauucuaccuggucaucuucaaggcuaaguuggucucacucugucucuc

SEQ ID NO: 593215 - RNA, 64 nt, Homo Sapiens
cuaacguaguugggaaaggucagguuuaacaucccaaggcuaacgagccuugggaauaguuugg

SEQ ID NO: 593216 - RNA, 64 nt, Homo Sapiens
gucaucgccacucaaguaggacaaggguccuacccaaggcuaggaccgcccugcggaaacagaa

SEQ ID NO: 593217 - RNA, 64 nt, Homo Sapiens
ugugggguauuuguuucuacuccagccuggcaggcaaggcuaaaaccugagauuaucgaucuau

SEQ ID NO: 593218 - RNA, 64 nt, Homo Sapiens
ucugcuuauaagaagugagagagaagaaaaaucaugucccaaguucugagaauuguucacacuu

SEQ ID NO: 593219 - RNA, 64 nt, Homo Sapiens
cuccuuuuuccuuccuugaagaaaaauucuuggcugucccaaggauucuucauguauauugcaa

SEQ ID NO: 593220 - RNA, 64 nt, Homo Sapiens
ugcuaagugaacagaacuauaaacccugugucacugucccaaguuggaaaagaaaguacagaac

SEQ ID NO: 593221 - RNA, 64 nt, Homo Sapiens
guucccucacagcaaagcaaacaaacacuuuuucugucccaaccaauugaaguuucagagcuac

SEQ ID NO: 593222 - RNA, 64 nt, Homo Sapiens
uacccacuaugucuguauguuaaauaaauuuuaaugucccaaaaaggaugucucaaauuuccag

SEQ ID NO: 593223 - RNA, 64 nt, Homo Sapiens
aguauaugccuuuuaucagggugaaagcauuaucugucccaaacauuuguuugaaccuuauccu

SEQ ID NO: 593224 - RNA, 64 nt, Homo Sapiens
cuuggucagugaaaagaugcuacuauauugcuuuugucccaaagugaguaaaauccccuagagc

SEQ ID NO: 593225 - RNA, 64 nt, Homo Sapiens
uuuacauuggauacucuguaaguaggagguacuuugucccaaaaagauguauaagaauguacua

SEQ ID NO: 593226 - RNA, 64 nt, Homo Sapiens
cucucuucuagugucuaucuuuaucauaaccugaugucccaaacuugugacaaguucuuuuggc

SEQ ID NO: 593227 - RNA, 64 nt, Homo Sapiens
acugggaaaucuuacaaggaguugaaaagauuaaugucccaaccugaugagauuacggccuuga

SEQ ID NO: 593228 - RNA, 64 nt, Homo Sapiens
aucauccugcagacagacaauaauucuggagauacugguggaaguuccaaguccaauaagacac

SEQ ID NO: 593229 - RNA, 64 nt, Homo Sapiens
uaugagcuugcucauuaauuuugaaaagauguaccugguggauaucuagcuaguaauauauucu

SEQ ID NO: 593230 - RNA, 64 nt, Homo Sapiens
ucuuuuuugccaugaguaggagccccuaguggggcugguggacagcuuuggaagagguguccug

SEQ ID NO: 593231 - RNA, 64 nt, Homo Sapiens
ggggcacugcgccugcugcccuuuccuggcagggcugguggagucuucccucaaagcaugccuu

SEQ ID NO: 593232 - RNA, 64 nt, Homo Sapiens
agcugaugucguguuuacaggaugcuguggggugcugguggagccugccuuaugaccuaggacu

SEQ ID NO: 593233 - RNA, 64 nt, Homo Sapiens
uguguguuuauuauguggagucauaccgccccuccugguggaugacuuccucaugggggcuugc

SEQ ID NO: 593234 - RNA, 64 nt, Homo Sapiens
cuguaaaauguuaguuuugguaauuuuuuuucugcugguggauuuacauauuaaauuuuuucug

SEQ ID NO: 593235 - RNA, 64 nt, Homo Sapiens
ucugcugguggauuuacauauuaaauuuuuucugcugguggauaaacauuaaaauuaaucaugu

SEQ ID NO: 593236 - RNA, 64 nt, Homo Sapiens
cuugcaguggugcuccaagggucgcugccgcucccugguggagcugacccccauagcagcagug

SEQ ID NO: 593237 - RNA, 64 nt, Homo Sapiens
ugggaggugucagagcccagcucaugcacaucagcugguggagcaggccuggccuuggagaacg

SEQ ID NO: 593238 - RNA, 64 nt, Homo Sapiens
uucuccccacuccccaagucaacuucgggagggucugguggacuccaccugagcgaguaauguc

SEQ ID NO: 593239 - RNA, 64 nt, Homo Sapiens
cguuaggauaagcaagaauuuacaugcugaaucacugguggaaaggugaugugacuuuucuucu

SEQ ID NO: 593240 - RNA, 64 nt, Homo Sapiens
uuguucacccuaggaagggguuaacacacucaaacugguggagcauacaugaaaauuccaguua

SEQ ID NO: 593241 - RNA, 64 nt, Homo Sapiens
gauuuuuuucauuauggagcgucccagcacuuggcugguggagauaacaaugguggccaccugg

SEQ ID NO: 593242 - RNA, 64 nt, Homo Sapiens
cuuuuccuuauagugaauuuguagcuaccuacuacugguggauuaggacacucagcaaaaauaa

SEQ ID NO: 593243 - RNA, 64 nt, Homo Sapiens
ugaaaaccaagagcuacaagaaaugaaaccuguucugguggaaagcaaaagagggacaggagga

SEQ ID NO: 593244 - RNA, 64 nt, Homo Sapiens
cuggcacugauaccccucuuggugggcagcugcucugguggaguugggaagggauaggaccugg

SEQ ID NO: 593245 - RNA, 64 nt, Homo Sapiens
gugccuccagggagccuuccuggucccaggaccucugguggagggccauggcguggaccuucac

SEQ ID NO: 593246 - RNA, 64 nt, Homo Sapiens
auccagccugggagccccugcccccaagacugcucugguggaaagcauuucuaacaggcuccug

SEQ ID NO: 593247 - RNA, 64 nt, Homo Sapiens
gccugucugugucacacacucuguggguuuccuccugguggaguaaagcgaugguugacgucug

SEQ ID NO: 593248 - RNA, 64 nt, Homo Sapiens
gugcccggcagacgugugagcacgaggcuuggaccugguggagggugguaugagagggauggcu

SEQ ID NO: 593249 - RNA, 64 nt, Homo Sapiens
gugcccagcagacguggugucacgagacuuggaccugguggaggguggugugagaggaacggcu

SEQ ID NO: 593250 - RNA, 64 nt, Homo Sapiens
aaaguccuaaccccugcucggggccccacggaugcugguggacugugugccccugguggaggug

SEQ ID NO: 593251 - RNA, 64 nt, Homo Sapiens
cccucccugcaggaugcugguggacugugugccccugguggagguggacgacaugaugaucaug

SEQ ID NO: 593252 - RNA, 64 nt, Homo Sapiens
ccaggguggcuuccagcuaccccugacuuagagccugguggaggugugguucuucagaagucag

SEQ ID NO: 593253 - RNA, 64 nt, Homo Sapiens
acgccuguaaucccagcacuuugggaggccgaggcugguggaucacgaggucaagaguucaaga

SEQ ID NO: 593254 - RNA, 64 nt, Homo Sapiens
ggacuuuguccaagucucacacuaaacaugcccgggcuucgaugugccuggaggauuuccccac

SEQ ID NO: 593255 - RNA, 64 nt, Homo Sapiens
gcuggccaccccaguguuuggaaaaaaaucucugggcuucgacugcugccagggaggagcugcu

SEQ ID NO: 593256 - RNA, 64 nt, Homo Sapiens
cagccaggacucuuccuaccugccuaggagaaggggcuucgaagcucuuagaacaagguggggc

SEQ ID NO: 593257 - RNA, 64 nt, Homo Sapiens
cacaggccuggccucauaugaugcccagcucaggggcuucgagcuggucccagacucucaggac

SEQ ID NO: 593258 - RNA, 64 nt, Homo Sapiens
cguaucuccuuucgcugcccaaccccgcagccugggcuucgaaggcgacccgcccaccauccug

SEQ ID NO: 593259 - RNA, 64 nt, Homo Sapiens
ugagcugcauugauguggacuucauagacacaaaggcuucgaagcacaagccaaauaugucaau

SEQ ID NO: 593260 - RNA, 64 nt, Homo Sapiens
gucaggggagccgcguucccagagaggccucccuggcuucgaguaccgggcccagcaggcaaag

SEQ ID NO: 593261 - RNA, 64 nt, Homo Sapiens
cugugguuucuaaagcauauugaggacgaugacaggcuucgacuuguggcuacucauuggucua

SEQ ID NO: 593262 - RNA, 64 nt, Homo Sapiens
gggaggcugaggcaggagaaucgcuugagccccaggcuucgaggcugcagugagcuaugauuac

SEQ ID NO: 593263 - RNA, 64 nt, Homo Sapiens
caacaaaguucauuaaccuggcagugucccaucuggcuucgaccacccguguuuuguuugaaca

SEQ ID NO: 593264 - RNA, 64 nt, Homo Sapiens
gccaaaacgccuggcgccgccaccgucgggggcuggcuucgaggacgcccgccugccucgcggg

SEQ ID NO: 593265 - RNA, 64 nt, Homo Sapiens
aaugcugcaggaaacgauugccaacuauacgaauggcuucgaggagauaaacugaaauuugcua

SEQ ID NO: 593266 - RNA, 64 nt, Homo Sapiens
cugcccuaauuuggguuuguaucaggaccgcuggggcuucgagugaaagaacaaugucagccac

SEQ ID NO: 593267 - RNA, 64 nt, Homo Sapiens
guggcaaaggacucacccccgcacaggcccgccuggcuucgaguuggaacccggacacuugccc

SEQ ID NO: 593268 - RNA, 64 nt, Homo Sapiens
ugucuuucaauaaauguuucaauacaaacacgauggcuucgaaauuuuauugucaugaacauga

SEQ ID NO: 593269 - RNA, 64 nt, Homo Sapiens
gccugagcaggucucugugggccgaccagaggggggcuucgagguggucccugguacuggggug

SEQ ID NO: 593270 - RNA, 64 nt, Homo Sapiens
acgcuccaugccaggaggcacaggggaaacaaggggcuucgagcacagcagaaagccaugagag

SEQ ID NO: 593271 - RNA, 64 nt, Homo Sapiens
ccauugcuuagcuaacuuuuucauucugucacuuggcuucgauuuuuauauuuuccuauuauau

SEQ ID NO: 593272 - RNA, 64 nt, Homo Sapiens
aauacgggggaccaagcuuuguccaagugaagcaggcuucgacuccuucugagaggucuggugu

SEQ ID NO: 593273 - RNA, 64 nt, Homo Sapiens
cuuccuucuggaaucuguuacuguuaacugagauggcuucgagucuagugggaaauguguagaa

SEQ ID NO: 593274 - RNA, 64 nt, Homo Sapiens
uccugugacacucugaagacuguaauucaugauaggcuucgauuccgggacucuaaaaaaaaau

SEQ ID NO: 593275 - RNA, 64 nt, Homo Sapiens
acagcugaacaugccgcuguccgaggucugcgagggcuucgacgaggagggccgcaacauuagc

SEQ ID NO: 593276 - RNA, 64 nt, Homo Sapiens
aacacaacagggcacagcaaauacgacuucauuuggcuucgaguuccccaggcgcuguagacac

SEQ ID NO: 593277 - RNA, 64 nt, Homo Sapiens
auauugccaaagugguuuccagaaaggcacugcuggcuucgacuccuauaagcagcacgugggc

SEQ ID NO: 593278 - RNA, 64 nt, Homo Sapiens
ccucagcccgcgcagaaugugcucgcugccccgcggcuucgagccccaagcucccgaggacuug

SEQ ID NO: 593279 - RNA, 64 nt, Homo Sapiens
agcccuguacgagcagcgggccgagccacgcagcggcuucgaggagcuggugcguugccccacc

SEQ ID NO: 593280 - RNA, 64 nt, Homo Sapiens
cugagucccgcagggcugcggaggggcgcgcuggggcuucgaccuggcugcacuaacccaggcu

SEQ ID NO: 593281 - RNA, 64 nt, Homo Sapiens
gagcccuugggcaggcauguuuggagaugagagaggcuucgagagggugggugcugggccacag

SEQ ID NO: 593282 - RNA, 64 nt, Homo Sapiens
gucuuguucagagcugcauauuucucucacccucggcuucgaugucuuuggauguugaugugug

SEQ ID NO: 593283 - RNA, 64 nt, Homo Sapiens
agugauacgcaugaacaaagcaccaacgagucccggcuucgaguggagccagacuagccccgcc

SEQ ID NO: 593284 - RNA, 64 nt, Homo Sapiens
cuugggugcaggcagggcugcacuaugugucuggggcuucgauccccauccucccucugccagg

SEQ ID NO: 593285 - RNA, 64 nt, Homo Sapiens
cguggguaaggggccccccugggauggggagaagggcuucgaagauaaacugagcuccauuccc

SEQ ID NO: 593286 - RNA, 64 nt, Homo Sapiens
cauagucgcaugcucgcaucuuuguuuuuaaucuggcuucgaacauagcacaaguaacuugaau

SEQ ID NO: 593287 - RNA, 64 nt, Homo Sapiens
agaggacccucugccaccacgguucucaggcccaggcuucgaccggucuccacguguaugaugg

SEQ ID NO: 593288 - RNA, 64 nt, Homo Sapiens
aaccuccaggagagaagugcacggcccgccagcuggcuucgaggugaugggcugggcccuccgc

SEQ ID NO: 593289 - RNA, 64 nt, Homo Sapiens
aagacaaacuugucuggaaaauucccccaggaugggcuucgagacuuagcuuggggcuggcugc

SEQ ID NO: 593290 - RNA, 64 nt, Homo Sapiens; identical to SEQ ID NO: 267307

SEQ ID NO: 593291 - RNA, 64 nt, Homo Sapiens; identical to SEQ ID NO: 267308

SEQ ID NO: 593292 - RNA, 64 nt, Homo Sapiens; identical to SEQ ID NO: 267309

SEQ ID NO: 593293 - RNA, 64 nt, Homo Sapiens; identical to SEQ ID NO: 267310

SEQ ID NO: 593294 - RNA, 64 nt, Homo Sapiens; identical to SEQ ID NO: 267311

SEQ ID NO: 593295 - RNA, 64 nt, Homo Sapiens; identical to SEQ ID NO: 267312

SEQ ID NO: 593296 - RNA, 64 nt, Homo Sapiens; identical to SEQ ID NO: 267313

SEQ ID NO: 593297 - RNA, 64 nt, Homo Sapiens; identical to SEQ ID NO: 267314

SEQ ID NO: 593298 - RNA, 64 nt, Homo Sapiens; identical to SEQ ID NO: 267315

SEQ ID NO: 593299 - RNA, 64 nt, Homo Sapiens; identical to SEQ ID NO: 267316

SEQ ID NO: 593300 - RNA, 64 nt, Homo Sapiens; identical to SEQ ID NO: 267317

SEQ ID NO: 593301 - RNA, 64 nt, Homo Sapiens; identical to SEQ ID NO: 267318

SEQ ID NO: 593302 - RNA, 64 nt, Homo Sapiens; identical to SEQ ID NO: 267319

SEQ ID NO: 593303 - RNA, 64 nt, Homo Sapiens; identical to SEQ ID NO: 267320

SEQ ID NO: 593304 - RNA, 64 nt, Homo Sapiens; identical to SEQ ID NO: 267321

SEQ ID NO: 593305 - RNA, 64 nt, Homo Sapiens; identical to SEQ ID NO: 267322

SEQ ID NO: 593306 - RNA, 64 nt, Homo Sapiens; identical to SEQ ID NO: 267323

SEQ ID NO: 593307 - RNA, 64 nt, Homo Sapiens; identical to SEQ ID NO: 267324

SEQ ID NO: 593308 - RNA, 64 nt, Homo Sapiens; identical to SEQ ID NO: 267325

SEQ ID NO: 593309 - RNA, 64 nt, Homo Sapiens; identical to SEQ ID NO: 267326

SEQ ID NO: 593310 - RNA, 64 nt, Homo Sapiens; identical to SEQ ID NO: 267327

SEQ ID NO: 593311 - RNA, 64 nt, Homo Sapiens; identical to SEQ ID NO: 267328

SEQ ID NO: 593312 - RNA, 64 nt, Homo Sapiens; identical to SEQ ID NO: 267329

SEQ ID NO: 593313 - RNA, 64 nt, Homo Sapiens; identical to SEQ ID NO: 267330

SEQ ID NO: 593314 - RNA, 64 nt, Homo Sapiens; identical to SEQ ID NO: 267331

SEQ ID NO: 593315 - RNA, 64 nt, Homo Sapiens; identical to SEQ ID NO: 267332

SEQ ID NO: 593316 - RNA, 64 nt, Homo Sapiens; identical to SEQ ID NO: 267333

SEQ ID NO: 593317 - RNA, 64 nt, Homo Sapiens; identical to SEQ ID NO: 267334

SEQ ID NO: 593318 - RNA, 64 nt, Homo Sapiens; identical to SEQ ID NO: 267335

SEQ ID NO: 593319 - RNA, 64 nt, Homo Sapiens; identical to SEQ ID NO: 267336

SEQ ID NO: 593320 - RNA, 64 nt, Homo Sapiens; identical to SEQ ID NO: 267337

SEQ ID NO: 593321 - RNA, 64 nt, Homo Sapiens; identical to SEQ ID NO: 267338

SEQ ID NO: 593322 - RNA, 64 nt, Homo Sapiens; identical to SEQ ID NO: 267339

SEQ ID NO: 593323 - RNA, 64 nt, Homo Sapiens; identical to SEQ ID NO: 267340

SEQ ID NO: 593324 - RNA, 64 nt, Homo Sapiens; identical to SEQ ID NO: 267341

SEQ ID NO: 593325 - RNA, 64 nt, Homo Sapiens; identical to SEQ ID NO: 267342

SEQ ID NO: 593326 - RNA, 64 nt, Homo Sapiens; identical to SEQ ID NO: 267343

SEQ ID NO: 593327 - RNA, 64 nt, Homo Sapiens; identical to SEQ ID NO: 267344

SEQ ID NO: 593328 - RNA, 64 nt, Homo Sapiens; identical to SEQ ID NO: 267345

SEQ ID NO: 593329 - RNA, 64 nt, Homo Sapiens; identical to SEQ ID NO: 267346

SEQ ID NO: 593330 - RNA, 64 nt, Homo Sapiens; identical to SEQ ID NO: 267347

SEQ ID NO: 593331 - RNA, 64 nt, Homo Sapiens; identical to SEQ ID NO: 267348

SEQ ID NO: 593332 - RNA, 64 nt, Homo Sapiens; identical to SEQ ID NO: 267349

SEQ ID NO: 593333 - RNA, 64 nt, Homo Sapiens; identical to SEQ ID NO: 267350

SEQ ID NO: 593334 - RNA, 64 nt, Homo Sapiens; identical to SEQ ID NO: 267351

SEQ ID NO: 593335 - RNA, 64 nt, Homo Sapiens; identical to SEQ ID NO: 267352

SEQ ID NO: 593336 - RNA, 64 nt, Homo Sapiens; identical to SEQ ID NO: 267353

SEQ ID NO: 593337 - RNA, 64 nt, Homo Sapiens; identical to SEQ ID NO: 267354

SEQ ID NO: 593338 - RNA, 64 nt, Homo Sapiens; identical to SEQ ID NO: 267355

SEQ ID NO: 593339 - RNA, 64 nt, Homo Sapiens; identical to SEQ ID NO: 267356

SEQ ID NO: 593340 - RNA, 64 nt, Homo Sapiens; identical to SEQ ID NO: 267357

SEQ ID NO: 593341 - RNA, 64 nt, Homo Sapiens; identical to SEQ ID NO: 267358

SEQ ID NO: 593342 - RNA, 64 nt, Homo Sapiens; identical to SEQ ID NO: 267359

SEQ ID NO: 593343 - RNA, 64 nt, Homo Sapiens; identical to SEQ ID NO: 267360

SEQ ID NO: 593344 - RNA, 64 nt, Homo Sapiens; identical to SEQ ID NO: 267361

SEQ ID NO: 593345 - RNA, 63 nt, Homo Sapiens; identical to SEQ ID NO: 267362

SEQ ID NO: 593346 - RNA, 64 nt, Homo Sapiens; identical to SEQ ID NO: 267363

SEQ ID NO: 593347 - RNA, 64 nt, Homo Sapiens; identical to SEQ ID NO: 267364

SEQ ID NO: 593348 - RNA, 64 nt, Homo Sapiens; identical to SEQ ID NO: 267365

SEQ ID NO: 593349 - RNA, 64 nt, Homo Sapiens; identical to SEQ ID NO: 267366

SEQ ID NO: 593350 - RNA, 64 nt, Homo Sapiens; identical to SEQ ID NO: 267367

SEQ ID NO: 593351 - RNA, 64 nt, Homo Sapiens; identical to SEQ ID NO: 267368

SEQ ID NO: 593352 - RNA, 64 nt, Homo Sapiens; identical to SEQ ID NO: 267369

SEQ ID NO: 593353 - RNA, 64 nt, Homo Sapiens; identical to SEQ ID NO: 267370

SEQ ID NO: 593354 - RNA, 64 nt, Homo Sapiens; identical to SEQ ID NO: 267371

SEQ ID NO: 593355 - RNA, 64 nt, Homo Sapiens; identical to SEQ ID NO: 267372

SEQ ID NO: 593356 - RNA, 64 nt, Homo Sapiens; identical to SEQ ID NO: 267373

SEQ ID NO: 593357 - RNA, 64 nt, Homo Sapiens; identical to SEQ ID NO: 267374

SEQ ID NO: 593358 - RNA, 64 nt, Homo Sapiens; identical to SEQ ID NO: 267375

SEQ ID NO: 593359 - RNA, 64 nt, Homo Sapiens; identical to SEQ ID NO: 267376

SEQ ID NO: 593360 - RNA, 64 nt, Homo Sapiens; identical to SEQ ID NO: 267377

SEQ ID NO: 593361 - RNA, 64 nt, Homo Sapiens; identical to SEQ ID NO: 267378

SEQ ID NO: 593362 - RNA, 64 nt, Homo Sapiens; identical to SEQ ID NO: 267379

SEQ ID NO: 593363 - RNA, 64 nt, Homo Sapiens; identical to SEQ ID NO: 267380

SEQ ID NO: 593364 - RNA, 64 nt, Homo Sapiens; identical to SEQ ID NO: 267381

SEQ ID NO: 593365 - RNA, 64 nt, Homo Sapiens; identical to SEQ ID NO: 267382

SEQ ID NO: 593366 - RNA, 64 nt, Homo Sapiens; identical to SEQ ID NO: 267383

SEQ ID NO: 593367 - RNA, 64 nt, Homo Sapiens; identical to SEQ ID NO: 267384

SEQ ID NO: 593368 - RNA, 64 nt, Homo Sapiens; identical to SEQ ID NO: 267385

SEQ ID NO: 593369 - RNA, 64 nt, Homo Sapiens; identical to SEQ ID NO: 267386

SEQ ID NO: 593370 - RNA, 64 nt, Homo Sapiens; identical to SEQ ID NO: 267387

SEQ ID NO: 593371 - RNA, 64 nt, Homo Sapiens; identical to SEQ ID NO: 267388

SEQ ID NO: 593372 - RNA, 64 nt, Homo Sapiens; identical to SEQ ID NO: 267389

SEQ ID NO: 593373 - RNA, 64 nt, Homo Sapiens; identical to SEQ ID NO: 267390

SEQ ID NO: 593374 - RNA, 64 nt, Homo Sapiens; identical to SEQ ID NO: 267391

SEQ ID NO: 593375 - RNA, 64 nt, Homo Sapiens; identical to SEQ ID NO: 267392

SEQ ID NO: 593376 - RNA, 64 nt, Homo Sapiens; identical to SEQ ID NO: 267393

SEQ ID NO: 593377 - RNA, 64 nt, Homo Sapiens; identical to SEQ ID NO: 267394

SEQ ID NO: 593378 - RNA, 64 nt, Homo Sapiens; identical to SEQ ID NO: 267395

SEQ ID NO: 593379 - RNA, 64 nt, Homo Sapiens; identical to SEQ ID NO: 267396

SEQ ID NO: 593380 - RNA, 64 nt, Homo Sapiens; identical to SEQ ID NO: 267397

SEQ ID NO: 593381 - RNA, 64 nt, Homo Sapiens; identical to SEQ ID NO: 267398

SEQ ID NO: 593382 - RNA, 64 nt, Homo Sapiens; identical to SEQ ID NO: 267399

SEQ ID NO: 593383 - RNA, 64 nt, Homo Sapiens; identical to SEQ ID NO: 267400

SEQ ID NO: 593384 - RNA, 64 nt, Homo Sapiens; identical to SEQ ID NO: 267401

SEQ ID NO: 593385 - RNA, 64 nt, Homo Sapiens; identical to SEQ ID NO: 267402

SEQ ID NO: 593386 - RNA, 64 nt, Homo Sapiens; identical to SEQ ID NO: 267403

SEQ ID NO: 593387 - RNA, 64 nt, Homo Sapiens; identical to SEQ ID NO: 267404

SEQ ID NO: 593388 - RNA, 64 nt, Homo Sapiens; identical to SEQ ID NO: 267405

SEQ ID NO: 593389 - RNA, 64 nt, Homo Sapiens; identical to SEQ ID NO: 267406

SEQ ID NO: 593390 - RNA, 64 nt, Homo Sapiens; identical to SEQ ID NO: 267407

SEQ ID NO: 593391 - RNA, 64 nt, Homo Sapiens; identical to SEQ ID NO: 267408

SEQ ID NO: 593392 - RNA, 64 nt, Homo Sapiens; identical to SEQ ID NO: 267409

SEQ ID NO: 593393 - RNA, 64 nt, Homo Sapiens; identical to SEQ ID NO: 267410

SEQ ID NO: 593394 - RNA, 64 nt, Homo Sapiens; identical to SEQ ID NO: 267411

SEQ ID NO: 593395 - RNA, 64 nt, Homo Sapiens; identical to SEQ ID NO: 267412

SEQ ID NO: 593396 - RNA, 64 nt, Homo Sapiens; identical to SEQ ID NO: 267413

SEQ ID NO: 593397 - RNA, 64 nt, Homo Sapiens; identical to SEQ ID NO: 267414

SEQ ID NO: 593398 - RNA, 64 nt, Homo Sapiens; identical to SEQ ID NO: 267415

SEQ ID NO: 593399 - RNA, 64 nt, Homo Sapiens; identical to SEQ ID NO: 267416

SEQ ID NO: 593400 - RNA, 64 nt, Homo Sapiens; identical to SEQ ID NO: 267417

SEQ ID NO: 593401 - RNA, 64 nt, Homo Sapiens; identical to SEQ ID NO: 267418

SEQ ID NO: 593402 - RNA, 64 nt, Homo Sapiens; identical to SEQ ID NO: 267419

SEQ ID NO: 593403 - RNA, 64 nt, Homo Sapiens; identical to SEQ ID NO: 267420

SEQ ID NO: 593404 - RNA, 64 nt, Homo Sapiens; identical to SEQ ID NO: 267421

SEQ ID NO: 593405 - RNA, 64 nt, Homo Sapiens; identical to SEQ ID NO: 267422

SEQ ID NO: 593406 - RNA, 64 nt, Homo Sapiens; identical to SEQ ID NO: 267423

SEQ ID NO: 593407 - RNA, 64 nt, Homo Sapiens; identical to SEQ ID NO: 267424

SEQ ID NO: 593408 - RNA, 64 nt, Homo Sapiens; identical to SEQ ID NO: 267425

SEQ ID NO: 593409 - RNA, 64 nt, Homo Sapiens; identical to SEQ ID NO: 267426

SEQ ID NO: 593410 - RNA, 64 nt, Homo Sapiens; identical to SEQ ID NO: 267427

SEQ ID NO: 593411 - RNA, 64 nt, Homo Sapiens; identical to SEQ ID NO: 267428

SEQ ID NO: 593412 - RNA, 64 nt, Homo Sapiens; identical to SEQ ID NO: 267429

SEQ ID NO: 593413 - RNA, 64 nt, Homo Sapiens; identical to SEQ ID NO: 267430

SEQ ID NO: 593414 - RNA, 64 nt, Homo Sapiens; identical to SEQ ID NO: 267431

SEQ ID NO: 593415 - RNA, 64 nt, Homo Sapiens; identical to SEQ ID NO: 267432

SEQ ID NO: 593416 - RNA, 64 nt, Homo Sapiens; identical to SEQ ID NO: 267433

SEQ ID NO: 593417 - RNA, 64 nt, Homo Sapiens; identical to SEQ ID NO: 267434

SEQ ID NO: 593418 - RNA, 64 nt, Homo Sapiens; identical to SEQ ID NO: 267435

SEQ ID NO: 593419 - RNA, 64 nt, Homo Sapiens; identical to SEQ ID NO: 267436

SEQ ID NO: 593420 - RNA, 64 nt, Homo Sapiens; identical to SEQ ID NO: 267437

SEQ ID NO: 593421 - RNA, 64 nt, Homo Sapiens; identical to SEQ ID NO: 267438

SEQ ID NO: 593422 - RNA, 64 nt, Homo Sapiens; identical to SEQ ID NO: 267439

SEQ ID NO: 593423 - RNA, 64 nt, Homo Sapiens; identical to SEQ ID NO: 267440

SEQ ID NO: 593424 - RNA, 64 nt, Homo Sapiens; identical to SEQ ID NO: 267441

SEQ ID NO: 593425 - RNA, 64 nt, Homo Sapiens; identical to SEQ ID NO: 267442

SEQ ID NO: 593426 - RNA, 64 nt, Homo Sapiens; identical to SEQ ID NO: 267443

SEQ ID NO: 593427 - RNA, 64 nt, Homo Sapiens; identical to SEQ ID NO: 267444

SEQ ID NO: 593428 - RNA, 64 nt, Homo Sapiens; identical to SEQ ID NO: 267445

SEQ ID NO: 593429 - RNA, 64 nt, Homo Sapiens; identical to SEQ ID NO: 267446

SEQ ID NO: 593430 - RNA, 64 nt, Homo Sapiens; identical to SEQ ID NO: 267447

SEQ ID NO: 593431 - RNA, 64 nt, Homo Sapiens; identical to SEQ ID NO: 267448

SEQ ID NO: 593432 - RNA, 64 nt, Homo Sapiens; identical to SEQ ID NO: 267449

SEQ ID NO: 593433 - RNA, 64 nt, Homo Sapiens; identical to SEQ ID NO: 267450

SEQ ID NO: 593434 - RNA, 64 nt, Homo Sapiens; identical to SEQ ID NO: 267451

SEQ ID NO: 593435 - RNA, 64 nt, Homo Sapiens; identical to SEQ ID NO: 267452

SEQ ID NO: 593436 - RNA, 64 nt, Homo Sapiens; identical to SEQ ID NO: 267453

SEQ ID NO: 593437 - RNA, 64 nt, Homo Sapiens; identical to SEQ ID NO: 267454

SEQ ID NO: 593438 - RNA, 64 nt, Homo Sapiens; identical to SEQ ID NO: 267455

SEQ ID NO: 593439 - RNA, 64 nt, Homo Sapiens; identical to SEQ ID NO: 267456

SEQ ID NO: 593440 - RNA, 64 nt, Homo Sapiens; identical to SEQ ID NO: 267457

SEQ ID NO: 593441 - RNA, 64 nt, Homo Sapiens; identical to SEQ ID NO: 267458

SEQ ID NO: 593442 - RNA, 64 nt, Homo Sapiens; identical to SEQ ID NO: 267459

SEQ ID NO: 593443 - RNA, 64 nt, Homo Sapiens; identical to SEQ ID NO: 267460

SEQ ID NO: 593444 - RNA, 64 nt, Homo Sapiens; identical to SEQ ID NO: 267461

SEQ ID NO: 593445 - RNA, 64 nt, Homo Sapiens; identical to SEQ ID NO: 267462

SEQ ID NO: 593446 - RNA, 64 nt, Homo Sapiens; identical to SEQ ID NO: 267463

SEQ ID NO: 593447 - RNA, 64 nt, Homo Sapiens; identical to SEQ ID NO: 267464

SEQ ID NO: 593448 - RNA, 64 nt, Homo Sapiens; identical to SEQ ID NO: 267465

SEQ ID NO: 593449 - RNA, 64 nt, Homo Sapiens; identical to SEQ ID NO: 267466

SEQ ID NO: 593450 - RNA, 64 nt, Homo Sapiens; identical to SEQ ID NO: 267467

SEQ ID NO: 593451 - RNA, 64 nt, Homo Sapiens; identical to SEQ ID NO: 267468

SEQ ID NO: 593452 - RNA, 64 nt, Homo Sapiens; identical to SEQ ID NO: 267469

SEQ ID NO: 593453 - RNA, 64 nt, Homo Sapiens; identical to SEQ ID NO: 267470

SEQ ID NO: 593454 - RNA, 64 nt, Homo Sapiens; identical to SEQ ID NO: 267471

SEQ ID NO: 593455 - RNA, 64 nt, Homo Sapiens; identical to SEQ ID NO: 267472

SEQ ID NO: 593456 - RNA, 64 nt, Homo Sapiens; identical to SEQ ID NO: 267473

SEQ ID NO: 593457 - RNA, 64 nt, Homo Sapiens; identical to SEQ ID NO: 267474

SEQ ID NO: 593458 - RNA, 64 nt, Homo Sapiens; identical to SEQ ID NO: 267475

SEQ ID NO: 593459 - RNA, 64 nt, Homo Sapiens; identical to SEQ ID NO: 267476

SEQ ID NO: 593460 - RNA, 64 nt, Homo Sapiens; identical to SEQ ID NO: 267477

SEQ ID NO: 593461 - RNA, 64 nt, Homo Sapiens; identical to SEQ ID NO: 267478

SEQ ID NO: 593462 - RNA, 64 nt, Homo Sapiens; identical to SEQ ID NO: 267479

SEQ ID NO: 593463 - RNA, 64 nt, Homo Sapiens; identical to SEQ ID NO: 267480

SEQ ID NO: 593464 - RNA, 64 nt, Homo Sapiens; identical to SEQ ID NO: 267481

SEQ ID NO: 593465 - RNA, 64 nt, Homo Sapiens; identical to SEQ ID NO: 267482

SEQ ID NO: 593466 - RNA, 64 nt, Homo Sapiens; identical to SEQ ID NO: 267483

SEQ ID NO: 593467 - RNA, 64 nt, Homo Sapiens; identical to SEQ ID NO: 267484

SEQ ID NO: 593468 - RNA, 64 nt, Homo Sapiens; identical to SEQ ID NO: 267485

SEQ ID NO: 593469 - RNA, 64 nt, Homo Sapiens; identical to SEQ ID NO: 267486

SEQ ID NO: 593470 - RNA, 64 nt, Homo Sapiens; identical to SEQ ID NO: 267487

SEQ ID NO: 593471 - RNA, 64 nt, Homo Sapiens; identical to SEQ ID NO: 267488

SEQ ID NO: 593472 - RNA, 64 nt, Homo Sapiens; identical to SEQ ID NO: 267489

SEQ ID NO: 593473 - RNA, 64 nt, Homo Sapiens; identical to SEQ ID NO: 267490

SEQ ID NO: 593474 - RNA, 64 nt, Homo Sapiens; identical to SEQ ID NO: 267491

SEQ ID NO: 593475 - RNA, 64 nt, Homo Sapiens; identical to SEQ ID NO: 267492

SEQ ID NO: 593476 - RNA, 64 nt, Homo Sapiens; identical to SEQ ID NO: 267493

SEQ ID NO: 593477 - RNA, 64 nt, Homo Sapiens; identical to SEQ ID NO: 267494

SEQ ID NO: 593478 - RNA, 64 nt, Homo Sapiens; identical to SEQ ID NO: 267495

SEQ ID NO: 593479 - RNA, 64 nt, Homo Sapiens; identical to SEQ ID NO: 267496

SEQ ID NO: 593480 - RNA, 64 nt, Homo Sapiens; identical to SEQ ID NO: 267497

SEQ ID NO: 593481 - RNA, 64 nt, Homo Sapiens; identical to SEQ ID NO: 267498

SEQ ID NO: 593482 - RNA, 64 nt, Homo Sapiens; identical to SEQ ID NO: 267499

SEQ ID NO: 593483 - RNA, 64 nt, Homo Sapiens; identical to SEQ ID NO: 267500

SEQ ID NO: 593484 - RNA, 64 nt, Homo Sapiens; identical to SEQ ID NO: 267501

SEQ ID NO: 593485 - RNA, 64 nt, Homo Sapiens; identical to SEQ ID NO: 267502

SEQ ID NO: 593486 - RNA, 64 nt, Homo Sapiens; identical to SEQ ID NO: 267503

SEQ ID NO: 593487 - RNA, 64 nt, Homo Sapiens; identical to SEQ ID NO: 267504

SEQ ID NO: 593488 - RNA, 64 nt, Homo Sapiens; identical to SEQ ID NO: 267505

SEQ ID NO: 593489 - RNA, 64 nt, Homo Sapiens; identical to SEQ ID NO: 267506

SEQ ID NO: 593490 - RNA, 64 nt, Homo Sapiens; identical to SEQ ID NO: 267507

SEQ ID NO: 593491 - RNA, 64 nt, Homo Sapiens; identical to SEQ ID NO: 267508

SEQ ID NO: 593492 - RNA, 64 nt, Homo Sapiens; identical to SEQ ID NO: 267509

SEQ ID NO: 593493 - RNA, 64 nt, Homo Sapiens; identical to SEQ ID NO: 267510

SEQ ID NO: 593494 - RNA, 64 nt, Homo Sapiens; identical to SEQ ID NO: 267511

SEQ ID NO: 593495 - RNA, 64 nt, Homo Sapiens; identical to SEQ ID NO: 267512

SEQ ID NO: 593496 - RNA, 64 nt, Homo Sapiens; identical to SEQ ID NO: 267513

SEQ ID NO: 593497 - RNA, 64 nt, Homo Sapiens; identical to SEQ ID NO: 267514

SEQ ID NO: 593498 - RNA, 64 nt, Homo Sapiens; identical to SEQ ID NO: 267515

SEQ ID NO: 593499 - RNA, 64 nt, Homo Sapiens; identical to SEQ ID NO: 267516

SEQ ID NO: 593500 - RNA, 64 nt, Homo Sapiens; identical to SEQ ID NO: 267517

SEQ ID NO: 593501 - RNA, 64 nt, Homo Sapiens; identical to SEQ ID NO: 267518

SEQ ID NO: 593502 - RNA, 64 nt, Homo Sapiens; identical to SEQ ID NO: 267519

SEQ ID NO: 593503 - RNA, 64 nt, Homo Sapiens; identical to SEQ ID NO: 267520

SEQ ID NO: 593504 - RNA, 64 nt, Homo Sapiens; identical to SEQ ID NO: 267521

SEQ ID NO: 593505 - RNA, 64 nt, Homo Sapiens; identical to SEQ ID NO: 267522

SEQ ID NO: 593506 - RNA, 64 nt, Homo Sapiens; identical to SEQ ID NO: 267523

SEQ ID NO: 593507 - RNA, 64 nt, Homo Sapiens; identical to SEQ ID NO: 267524

SEQ ID NO: 593508 - RNA, 64 nt, Homo Sapiens; identical to SEQ ID NO: 267525

SEQ ID NO: 593509 - RNA, 64 nt, Homo Sapiens; identical to SEQ ID NO: 267526

SEQ ID NO: 593510 - RNA, 64 nt, Homo Sapiens; identical to SEQ ID NO: 267527

SEQ ID NO: 593511 - RNA, 64 nt, Homo Sapiens; identical to SEQ ID NO: 267528

SEQ ID NO: 593512 - RNA, 64 nt, Homo Sapiens; identical to SEQ ID NO: 267529

SEQ ID NO: 593513 - RNA, 64 nt, Homo Sapiens; identical to SEQ ID NO: 267530

SEQ ID NO: 593514 - RNA, 64 nt, Homo Sapiens; identical to SEQ ID NO: 267531

SEQ ID NO: 593515 - RNA, 64 nt, Homo Sapiens; identical to SEQ ID NO: 267532

SEQ ID NO: 593516 - RNA, 64 nt, Homo Sapiens; identical to SEQ ID NO: 267533

SEQ ID NO: 593517 - RNA, 64 nt, Homo Sapiens; identical to SEQ ID NO: 267534

SEQ ID NO: 593518 - RNA, 64 nt, Homo Sapiens; identical to SEQ ID NO: 267535

SEQ ID NO: 593519 - RNA, 64 nt, Homo Sapiens; identical to SEQ ID NO: 267536

SEQ ID NO: 593520 - RNA, 64 nt, Homo Sapiens; identical to SEQ ID NO: 267537

SEQ ID NO: 593521 - RNA, 64 nt, Homo Sapiens; identical to SEQ ID NO: 267538

SEQ ID NO: 593522 - RNA, 64 nt, Homo Sapiens; identical to SEQ ID NO: 267539

SEQ ID NO: 593523 - RNA, 64 nt, Homo Sapiens; identical to SEQ ID NO: 267540

SEQ ID NO: 593524 - RNA, 64 nt, Homo Sapiens; identical to SEQ ID NO: 267541

SEQ ID NO: 593525 - RNA, 64 nt, Homo Sapiens; identical to SEQ ID NO: 267542

SEQ ID NO: 593526 - RNA, 64 nt, Homo Sapiens; identical to SEQ ID NO: 267543

SEQ ID NO: 593527 - RNA, 64 nt, Homo Sapiens; identical to SEQ ID NO: 267544

SEQ ID NO: 593528 - RNA, 64 nt, Homo Sapiens; identical to SEQ ID NO: 267545

SEQ ID NO: 593529 - RNA, 64 nt, Homo Sapiens; identical to SEQ ID NO: 267546

SEQ ID NO: 593530 - RNA, 64 nt, Homo Sapiens; identical to SEQ ID NO: 267547

SEQ ID NO: 593531 - RNA, 64 nt, Homo Sapiens; identical to SEQ ID NO: 267548

SEQ ID NO: 593532 - RNA, 64 nt, Homo Sapiens; identical to SEQ ID NO: 267549

SEQ ID NO: 593533 - RNA, 64 nt, Homo Sapiens; identical to SEQ ID NO: 267550

SEQ ID NO: 593534 - RNA, 64 nt, Homo Sapiens; identical to SEQ ID NO: 267551

SEQ ID NO: 593535 - RNA, 64 nt, Homo Sapiens; identical to SEQ ID NO: 267552

SEQ ID NO: 593536 - RNA, 64 nt, Homo Sapiens; identical to SEQ ID NO: 267553

SEQ ID NO: 593537 - RNA, 64 nt, Homo Sapiens; identical to SEQ ID NO: 267554

SEQ ID NO: 593538 - RNA, 64 nt, Homo Sapiens; identical to SEQ ID NO: 267555

SEQ ID NO: 593539 - RNA, 64 nt, Homo Sapiens; identical to SEQ ID NO: 267556

SEQ ID NO: 593540 - RNA, 64 nt, Homo Sapiens; identical to SEQ ID NO: 267557

SEQ ID NO: 593541 - RNA, 64 nt, Homo Sapiens; identical to SEQ ID NO: 267558

SEQ ID NO: 593542 - RNA, 64 nt, Homo Sapiens; identical to SEQ ID NO: 267559

SEQ ID NO: 593543 - RNA, 64 nt, Homo Sapiens; identical to SEQ ID NO: 267560

SEQ ID NO: 593544 - RNA, 64 nt, Homo Sapiens; identical to SEQ ID NO: 267561

SEQ ID NO: 593545 - RNA, 64 nt, Homo Sapiens; identical to SEQ ID NO: 267562

SEQ ID NO: 593546 - RNA, 64 nt, Homo Sapiens; identical to SEQ ID NO: 267563

SEQ ID NO: 593547 - RNA, 64 nt, Homo Sapiens; identical to SEQ ID NO: 267564

SEQ ID NO: 593548 - RNA, 64 nt, Homo Sapiens; identical to SEQ ID NO: 267565

SEQ ID NO: 593549 - RNA, 64 nt, Homo Sapiens; identical to SEQ ID NO: 267566

SEQ ID NO: 593550 - RNA, 64 nt, Homo Sapiens; identical to SEQ ID NO: 267567

SEQ ID NO: 593551 - RNA, 64 nt, Homo Sapiens; identical to SEQ ID NO: 267568

SEQ ID NO: 593552 - RNA, 64 nt, Homo Sapiens; identical to SEQ ID NO: 267569

SEQ ID NO: 593553 - RNA, 64 nt, Homo Sapiens; identical to SEQ ID NO: 267570

SEQ ID NO: 593554 - RNA, 64 nt, Homo Sapiens; identical to SEQ ID NO: 267571

SEQ ID NO: 593555 - RNA, 64 nt, Homo Sapiens; identical to SEQ ID NO: 267572

SEQ ID NO: 593556 - RNA, 64 nt, Homo Sapiens; identical to SEQ ID NO: 267573

SEQ ID NO: 593557 - RNA, 64 nt, Homo Sapiens; identical to SEQ ID NO: 267574

SEQ ID NO: 593558 - RNA, 64 nt, Homo Sapiens; identical to SEQ ID NO: 267575

SEQ ID NO: 593559 - RNA, 64 nt, Homo Sapiens; identical to SEQ ID NO: 267576

SEQ ID NO: 593560 - RNA, 64 nt, Homo Sapiens; identical to SEQ ID NO: 267577

SEQ ID NO: 593561 - RNA, 64 nt, Homo Sapiens; identical to SEQ ID NO: 267578

SEQ ID NO: 593562 - RNA, 64 nt, Homo Sapiens; identical to SEQ ID NO: 267579

SEQ ID NO: 593563 - RNA, 64 nt, Homo Sapiens; identical to SEQ ID NO: 267580

SEQ ID NO: 593564 - RNA, 64 nt, Homo Sapiens; identical to SEQ ID NO: 267581

SEQ ID NO: 593565 - RNA, 64 nt, Homo Sapiens; identical to SEQ ID NO: 267582

SEQ ID NO: 593566 - RNA, 64 nt, Homo Sapiens; identical to SEQ ID NO: 267583

SEQ ID NO: 593567 - RNA, 64 nt, Homo Sapiens; identical to SEQ ID NO: 267584

SEQ ID NO: 593568 - RNA, 64 nt, Homo Sapiens; identical to SEQ ID NO: 267585

SEQ ID NO: 593569 - RNA, 64 nt, Homo Sapiens; identical to SEQ ID NO: 267586

SEQ ID NO: 593570 - RNA, 64 nt, Homo Sapiens; identical to SEQ ID NO: 267587

SEQ ID NO: 593571 - RNA, 64 nt, Homo Sapiens; identical to SEQ ID NO: 267588

SEQ ID NO: 593572 - RNA, 64 nt, Homo Sapiens; identical to SEQ ID NO: 267589

SEQ ID NO: 593573 - RNA, 64 nt, Homo Sapiens; identical to SEQ ID NO: 267590

SEQ ID NO: 593574 - RNA, 64 nt, Homo Sapiens; identical to SEQ ID NO: 267591

SEQ ID NO: 593575 - RNA, 64 nt, Homo Sapiens; identical to SEQ ID NO: 267592

SEQ ID NO: 593576 - RNA, 64 nt, Homo Sapiens; identical to SEQ ID NO: 267593

SEQ ID NO: 593577 - RNA, 64 nt, Homo Sapiens; identical to SEQ ID NO: 267594

SEQ ID NO: 593578 - RNA, 64 nt, Homo Sapiens; identical to SEQ ID NO: 267595

SEQ ID NO: 593579 - RNA, 64 nt, Homo Sapiens; identical to SEQ ID NO: 267596

SEQ ID NO: 593580 - RNA, 64 nt, Homo Sapiens; identical to SEQ ID NO: 267597

SEQ ID NO: 593581 - RNA, 64 nt, Homo Sapiens; identical to SEQ ID NO: 267598

SEQ ID NO: 593582 - RNA, 64 nt, Homo Sapiens; identical to SEQ ID NO: 267599

SEQ ID NO: 593583 - RNA, 64 nt, Homo Sapiens; identical to SEQ ID NO: 267600

SEQ ID NO: 593584 - RNA, 64 nt, Homo Sapiens; identical to SEQ ID NO: 267601

SEQ ID NO: 593585 - RNA, 64 nt, Homo Sapiens; identical to SEQ ID NO: 267602

SEQ ID NO: 593586 - RNA, 64 nt, Homo Sapiens; identical to SEQ ID NO: 267603

SEQ ID NO: 593587 - RNA, 64 nt, Homo Sapiens; identical to SEQ ID NO: 267604

SEQ ID NO: 593588 - RNA, 64 nt, Homo Sapiens; identical to SEQ ID NO: 267605

SEQ ID NO: 593589 - RNA, 64 nt, Homo Sapiens; identical to SEQ ID NO: 267606

SEQ ID NO: 593590 - RNA, 64 nt, Homo Sapiens; identical to SEQ ID NO: 267607

SEQ ID NO: 593591 - RNA, 64 nt, Homo Sapiens; identical to SEQ ID NO: 267608

SEQ ID NO: 593592 - RNA, 64 nt, Homo Sapiens; identical to SEQ ID NO: 267609

SEQ ID NO: 593593 - RNA, 64 nt, Homo Sapiens; identical to SEQ ID NO: 267610

SEQ ID NO: 593594 - RNA, 64 nt, Homo Sapiens; identical to SEQ ID NO: 267611

SEQ ID NO: 593595 - RNA, 64 nt, Homo Sapiens; identical to SEQ ID NO: 267612

SEQ ID NO: 593596 - RNA, 64 nt, Homo Sapiens; identical to SEQ ID NO: 267613

SEQ ID NO: 593597 - RNA, 64 nt, Homo Sapiens; identical to SEQ ID NO: 267614

SEQ ID NO: 593598 - RNA, 64 nt, Homo Sapiens; identical to SEQ ID NO: 267615

SEQ ID NO: 593599 - RNA, 64 nt, Homo Sapiens; identical to SEQ ID NO: 267616

SEQ ID NO: 593600 - RNA, 64 nt, Homo Sapiens; identical to SEQ ID NO: 267617

SEQ ID NO: 593601 - RNA, 64 nt, Homo Sapiens; identical to SEQ ID NO: 267618

SEQ ID NO: 593602 - RNA, 64 nt, Homo Sapiens; identical to SEQ ID NO: 267619

SEQ ID NO: 593603 - RNA, 64 nt, Homo Sapiens; identical to SEQ ID NO: 267620

SEQ ID NO: 593604 - RNA, 64 nt, Homo Sapiens; identical to SEQ ID NO: 267621

SEQ ID NO: 593605 - RNA, 64 nt, Homo Sapiens; identical to SEQ ID NO: 267622

SEQ ID NO: 593606 - RNA, 64 nt, Homo Sapiens; identical to SEQ ID NO: 267623

SEQ ID NO: 593607 - RNA, 64 nt, Homo Sapiens; identical to SEQ ID NO: 267624

SEQ ID NO: 593608 - RNA, 64 nt, Homo Sapiens; identical to SEQ ID NO: 267625

SEQ ID NO: 593609 - RNA, 64 nt, Homo Sapiens; identical to SEQ ID NO: 267626

SEQ ID NO: 593610 - RNA, 64 nt, Homo Sapiens; identical to SEQ ID NO: 267627

SEQ ID NO: 593611 - RNA, 64 nt, Homo Sapiens; identical to SEQ ID NO: 267628

SEQ ID NO: 593612 - RNA, 64 nt, Homo Sapiens; identical to SEQ ID NO: 267629

SEQ ID NO: 593613 - RNA, 64 nt, Homo Sapiens; identical to SEQ ID NO: 267630

SEQ ID NO: 593614 - RNA, 64 nt, Homo Sapiens; identical to SEQ ID NO: 267631

SEQ ID NO: 593615 - RNA, 64 nt, Homo Sapiens; identical to SEQ ID NO: 267632

SEQ ID NO: 593616 - RNA, 64 nt, Homo Sapiens; identical to SEQ ID NO: 267633

SEQ ID NO: 593617 - RNA, 64 nt, Homo Sapiens; identical to SEQ ID NO: 267634

SEQ ID NO: 593618 - RNA, 64 nt, Homo Sapiens; identical to SEQ ID NO: 267635

SEQ ID NO: 593619 - RNA, 64 nt, Homo Sapiens; identical to SEQ ID NO: 267636

SEQ ID NO: 593620 - RNA, 64 nt, Homo Sapiens; identical to SEQ ID NO: 267637

SEQ ID NO: 593621 - RNA, 64 nt, Homo Sapiens; identical to SEQ ID NO: 267638

SEQ ID NO: 593622 - RNA, 64 nt, Homo Sapiens; identical to SEQ ID NO: 267639

SEQ ID NO: 593623 - RNA, 64 nt, Homo Sapiens; identical to SEQ ID NO: 267640

SEQ ID NO: 593624 - RNA, 64 nt, Homo Sapiens; identical to SEQ ID NO: 267641

SEQ ID NO: 593625 - RNA, 64 nt, Homo Sapiens; identical to SEQ ID NO: 267642

SEQ ID NO: 593626 - RNA, 64 nt, Homo Sapiens; identical to SEQ ID NO: 267643

SEQ ID NO: 593627 - RNA, 64 nt, Homo Sapiens; identical to SEQ ID NO: 267644

SEQ ID NO: 593628 - RNA, 64 nt, Homo Sapiens; identical to SEQ ID NO: 267645

SEQ ID NO: 593629 - RNA, 64 nt, Homo Sapiens; identical to SEQ ID NO: 267646

SEQ ID NO: 593630 - RNA, 64 nt, Homo Sapiens; identical to SEQ ID NO: 267647

SEQ ID NO: 593631 - RNA, 64 nt, Homo Sapiens; identical to SEQ ID NO: 267648

SEQ ID NO: 593632 - RNA, 64 nt, Homo Sapiens; identical to SEQ ID NO: 267649

SEQ ID NO: 593633 - RNA, 64 nt, Homo Sapiens; identical to SEQ ID NO: 267650

SEQ ID NO: 593634 - RNA, 64 nt, Homo Sapiens; identical to SEQ ID NO: 267651

SEQ ID NO: 593635 - RNA, 64 nt, Homo Sapiens; identical to SEQ ID NO: 267652

SEQ ID NO: 593636 - RNA, 64 nt, Homo Sapiens; identical to SEQ ID NO: 267653

SEQ ID NO: 593637 - RNA, 64 nt, Homo Sapiens; identical to SEQ ID NO: 267654

SEQ ID NO: 593638 - RNA, 64 nt, Homo Sapiens; identical to SEQ ID NO: 267655

SEQ ID NO: 593639 - RNA, 64 nt, Homo Sapiens; identical to SEQ ID NO: 267656

SEQ ID NO: 593640 - RNA, 64 nt, Homo Sapiens; identical to SEQ ID NO: 267657

SEQ ID NO: 593641 - RNA, 64 nt, Homo Sapiens; identical to SEQ ID NO: 267658

SEQ ID NO: 593642 - RNA, 64 nt, Homo Sapiens; identical to SEQ ID NO: 267659

SEQ ID NO: 593643 - RNA, 64 nt, Homo Sapiens; identical to SEQ ID NO: 267660

SEQ ID NO: 593644 - RNA, 64 nt, Homo Sapiens; identical to SEQ ID NO: 267661

SEQ ID NO: 593645 - RNA, 64 nt, Homo Sapiens; identical to SEQ ID NO: 267662

SEQ ID NO: 593646 - RNA, 64 nt, Homo Sapiens; identical to SEQ ID NO: 267663

SEQ ID NO: 593647 - RNA, 64 nt, Homo Sapiens; identical to SEQ ID NO: 267664

SEQ ID NO: 593648 - RNA, 64 nt, Homo Sapiens; identical to SEQ ID NO: 267665

SEQ ID NO: 593649 - RNA, 64 nt, Homo Sapiens; identical to SEQ ID NO: 267666

SEQ ID NO: 593650 - RNA, 64 nt, Homo Sapiens; identical to SEQ ID NO: 267667

SEQ ID NO: 593651 - RNA, 64 nt, Homo Sapiens; identical to SEQ ID NO: 267668

SEQ ID NO: 593652 - RNA, 64 nt, Homo Sapiens; identical to SEQ ID NO: 267669

SEQ ID NO: 593653 - RNA, 64 nt, Homo Sapiens; identical to SEQ ID NO: 267670

SEQ ID NO: 593654 - RNA, 64 nt, Homo Sapiens; identical to SEQ ID NO: 267671

SEQ ID NO: 593655 - RNA, 64 nt, Homo Sapiens; identical to SEQ ID NO: 267672

SEQ ID NO: 593656 - RNA, 64 nt, Homo Sapiens; identical to SEQ ID NO: 267673

SEQ ID NO: 593657 - RNA, 64 nt, Homo Sapiens; identical to SEQ ID NO: 267674

SEQ ID NO: 593658 - RNA, 64 nt, Homo Sapiens; identical to SEQ ID NO: 267675

SEQ ID NO: 593659 - RNA, 64 nt, Homo Sapiens; identical to SEQ ID NO: 267676

SEQ ID NO: 593660 - RNA, 64 nt, Homo Sapiens; identical to SEQ ID NO: 267677

SEQ ID NO: 593661 - RNA, 64 nt, Homo Sapiens; identical to SEQ ID NO: 267678

SEQ ID NO: 593662 - RNA, 64 nt, Homo Sapiens; identical to SEQ ID NO: 267679

SEQ ID NO: 593663 - RNA, 64 nt, Homo Sapiens; identical to SEQ ID NO: 267680

SEQ ID NO: 593664 - RNA, 64 nt, Homo Sapiens; identical to SEQ ID NO: 267681

SEQ ID NO: 593665 - RNA, 64 nt, Homo Sapiens; identical to SEQ ID NO: 267682

SEQ ID NO: 593666 - RNA, 64 nt, Homo Sapiens; identical to SEQ ID NO: 267683

SEQ ID NO: 593667 - RNA, 64 nt, Homo Sapiens; identical to SEQ ID NO: 267684

SEQ ID NO: 593668 - RNA, 64 nt, Homo Sapiens; identical to SEQ ID NO: 267685

SEQ ID NO: 593669 - RNA, 64 nt, Homo Sapiens; identical to SEQ ID NO: 267686

SEQ ID NO: 593670 - RNA, 64 nt, Homo Sapiens; identical to SEQ ID NO: 267687

SEQ ID NO: 593671 - RNA, 64 nt, Homo Sapiens; identical to SEQ ID NO: 267688

SEQ ID NO: 593672 - RNA, 64 nt, Homo Sapiens; identical to SEQ ID NO: 267689

SEQ ID NO: 593673 - RNA, 64 nt, Homo Sapiens; identical to SEQ ID NO: 267690

SEQ ID NO: 593674 - RNA, 64 nt, Homo Sapiens; identical to SEQ ID NO: 267691

SEQ ID NO: 593675 - RNA, 64 nt, Homo Sapiens; identical to SEQ ID NO: 267692

SEQ ID NO: 593676 - RNA, 64 nt, Homo Sapiens; identical to SEQ ID NO: 267693

SEQ ID NO: 593677 - RNA, 64 nt, Homo Sapiens; identical to SEQ ID NO: 267694

SEQ ID NO: 593678 - RNA, 64 nt, Homo Sapiens; identical to SEQ ID NO: 267695

SEQ ID NO: 593679 - RNA, 64 nt, Homo Sapiens; identical to SEQ ID NO: 267696

SEQ ID NO: 593680 - RNA, 64 nt, Homo Sapiens; identical to SEQ ID NO: 267697

SEQ ID NO: 593681 - RNA, 64 nt, Homo Sapiens; identical to SEQ ID NO: 267698

SEQ ID NO: 593682 - RNA, 64 nt, Homo Sapiens; identical to SEQ ID NO: 267699

SEQ ID NO: 593683 - RNA, 64 nt, Homo Sapiens; identical to SEQ ID NO: 267700

SEQ ID NO: 593684 - RNA, 64 nt, Homo Sapiens; identical to SEQ ID NO: 267701

SEQ ID NO: 593685 - RNA, 64 nt, Homo Sapiens; identical to SEQ ID NO: 267702

SEQ ID NO: 593686 - RNA, 64 nt, Homo Sapiens; identical to SEQ ID NO: 267703

SEQ ID NO: 593687 - RNA, 64 nt, Homo Sapiens; identical to SEQ ID NO: 267704

SEQ ID NO: 593688 - RNA, 64 nt, Homo Sapiens; identical to SEQ ID NO: 267705

SEQ ID NO: 593689 - RNA, 64 nt, Homo Sapiens; identical to SEQ ID NO: 267706

SEQ ID NO: 593690 - RNA, 64 nt, Homo Sapiens; identical to SEQ ID NO: 267707

SEQ ID NO: 593691 - RNA, 64 nt, Homo Sapiens; identical to SEQ ID NO: 267708

SEQ ID NO: 593692 - RNA, 64 nt, Homo Sapiens; identical to SEQ ID NO: 267709

SEQ ID NO: 593693 - RNA, 64 nt, Homo Sapiens; identical to SEQ ID NO: 267710

SEQ ID NO: 593694 - RNA, 64 nt, Homo Sapiens; identical to SEQ ID NO: 267711

SEQ ID NO: 593695 - RNA, 64 nt, Homo Sapiens; identical to SEQ ID NO: 267712

SEQ ID NO: 593696 - RNA, 64 nt, Homo Sapiens; identical to SEQ ID NO: 267713

SEQ ID NO: 593697 - RNA, 64 nt, Homo Sapiens; identical to SEQ ID NO: 267714

SEQ ID NO: 593698 - RNA, 64 nt, Homo Sapiens; identical to SEQ ID NO: 267715

SEQ ID NO: 593699 - RNA, 64 nt, Homo Sapiens; identical to SEQ ID NO: 267716

SEQ ID NO: 593700 - RNA, 64 nt, Homo Sapiens; identical to SEQ ID NO: 267717

SEQ ID NO: 593701 - RNA, 64 nt, Homo Sapiens; identical to SEQ ID NO: 267718

SEQ ID NO: 593702 - RNA, 64 nt, Homo Sapiens; identical to SEQ ID NO: 267719

SEQ ID NO: 593703 - RNA, 64 nt, Homo Sapiens; identical to SEQ ID NO: 267720

SEQ ID NO: 593704 - RNA, 64 nt, Homo Sapiens; identical to SEQ ID NO: 267721

SEQ ID NO: 593705 - RNA, 64 nt, Homo Sapiens; identical to SEQ ID NO: 267722

SEQ ID NO: 593706 - RNA, 64 nt, Homo Sapiens; identical to SEQ ID NO: 267723

SEQ ID NO: 593707 - RNA, 64 nt, Homo Sapiens; identical to SEQ ID NO: 267724

SEQ ID NO: 593708 - RNA, 64 nt, Homo Sapiens; identical to SEQ ID NO: 267725

SEQ ID NO: 593709 - RNA, 64 nt, Homo Sapiens; identical to SEQ ID NO: 267726

SEQ ID NO: 593710 - RNA, 64 nt, Homo Sapiens; identical to SEQ ID NO: 267727

SEQ ID NO: 593711 - RNA, 64 nt, Homo Sapiens; identical to SEQ ID NO: 267728

SEQ ID NO: 593712 - RNA, 64 nt, Homo Sapiens; identical to SEQ ID NO: 267729

SEQ ID NO: 593713 - RNA, 64 nt, Homo Sapiens; identical to SEQ ID NO: 267730

SEQ ID NO: 593714 - RNA, 64 nt, Homo Sapiens; identical to SEQ ID NO: 267731

SEQ ID NO: 593715 - RNA, 64 nt, Homo Sapiens; identical to SEQ ID NO: 267732

SEQ ID NO: 593716 - RNA, 64 nt, Homo Sapiens; identical to SEQ ID NO: 267733

SEQ ID NO: 593717 - RNA, 64 nt, Homo Sapiens; identical to SEQ ID NO: 267734

SEQ ID NO: 593718 - RNA, 64 nt, Homo Sapiens; identical to SEQ ID NO: 267735

SEQ ID NO: 593719 - RNA, 64 nt, Homo Sapiens; identical to SEQ ID NO: 267736

SEQ ID NO: 593720 - RNA, 64 nt, Homo Sapiens; identical to SEQ ID NO: 267737

SEQ ID NO: 593721 - RNA, 64 nt, Homo Sapiens; identical to SEQ ID NO: 267738

SEQ ID NO: 593722 - RNA, 64 nt, Homo Sapiens; identical to SEQ ID NO: 267739

SEQ ID NO: 593723 - RNA, 64 nt, Homo Sapiens; identical to SEQ ID NO: 267740

SEQ ID NO: 593724 - RNA, 64 nt, Homo Sapiens; identical to SEQ ID NO: 267741

SEQ ID NO: 593725 - RNA, 64 nt, Homo Sapiens; identical to SEQ ID NO: 267742

SEQ ID NO: 593726 - RNA, 64 nt, Homo Sapiens; identical to SEQ ID NO: 267743

SEQ ID NO: 593727 - RNA, 64 nt, Homo Sapiens; identical to SEQ ID NO: 267744

SEQ ID NO: 593728 - RNA, 64 nt, Homo Sapiens; identical to SEQ ID NO: 267745

SEQ ID NO: 593729 - RNA, 64 nt, Homo Sapiens; identical to SEQ ID NO: 267746

SEQ ID NO: 593730 - RNA, 64 nt, Homo Sapiens; identical to SEQ ID NO: 267747

SEQ ID NO: 593731 - RNA, 64 nt, Homo Sapiens; identical to SEQ ID NO: 267748

SEQ ID NO: 593732 - RNA, 64 nt, Homo Sapiens; identical to SEQ ID NO: 267749

SEQ ID NO: 593733 - RNA, 64 nt, Homo Sapiens; identical to SEQ ID NO: 267750

SEQ ID NO: 593734 - RNA, 64 nt, Homo Sapiens; identical to SEQ ID NO: 267751

SEQ ID NO: 593735 - RNA, 64 nt, Homo Sapiens; identical to SEQ ID NO: 267752

SEQ ID NO: 593736 - RNA, 64 nt, Homo Sapiens; identical to SEQ ID NO: 267753

SEQ ID NO: 593737 - RNA, 64 nt, Homo Sapiens; identical to SEQ ID NO: 267754

SEQ ID NO: 593738 - RNA, 64 nt, Homo Sapiens; identical to SEQ ID NO: 267755

SEQ ID NO: 593739 - RNA, 64 nt, Homo Sapiens; identical to SEQ ID NO: 267756

SEQ ID NO: 593740 - RNA, 64 nt, Homo Sapiens; identical to SEQ ID NO: 267757

SEQ ID NO: 593741 - RNA, 64 nt, Homo Sapiens; identical to SEQ ID NO: 267758

SEQ ID NO: 593742 - RNA, 64 nt, Homo Sapiens; identical to SEQ ID NO: 267759

SEQ ID NO: 593743 - RNA, 64 nt, Homo Sapiens; identical to SEQ ID NO: 267760

SEQ ID NO: 593744 - RNA, 64 nt, Homo Sapiens; identical to SEQ ID NO: 267761

SEQ ID NO: 593745 - RNA, 64 nt, Homo Sapiens; identical to SEQ ID NO: 267762

SEQ ID NO: 593746 - RNA, 64 nt, Homo Sapiens; identical to SEQ ID NO: 267763

SEQ ID NO: 593747 - RNA, 64 nt, Homo Sapiens; identical to SEQ ID NO: 267764

SEQ ID NO: 593748 - RNA, 64 nt, Homo Sapiens; identical to SEQ ID NO: 267765

SEQ ID NO: 593749 - RNA, 64 nt, Homo Sapiens; identical to SEQ ID NO: 267766

SEQ ID NO: 593750 - RNA, 64 nt, Homo Sapiens; identical to SEQ ID NO: 267767

SEQ ID NO: 593751 - RNA, 64 nt, Homo Sapiens; identical to SEQ ID NO: 267768

SEQ ID NO: 593752 - RNA, 64 nt, Homo Sapiens; identical to SEQ ID NO: 267769

SEQ ID NO: 593753 - RNA, 64 nt, Homo Sapiens; identical to SEQ ID NO: 267770

SEQ ID NO: 593754 - RNA, 64 nt, Homo Sapiens; identical to SEQ ID NO: 267771

SEQ ID NO: 593755 - RNA, 64 nt, Homo Sapiens; identical to SEQ ID NO: 267772

SEQ ID NO: 593756 - RNA, 64 nt, Homo Sapiens; identical to SEQ ID NO: 267773

SEQ ID NO: 593757 - RNA, 64 nt, Homo Sapiens; identical to SEQ ID NO: 267774

SEQ ID NO: 593758 - RNA, 64 nt, Homo Sapiens; identical to SEQ ID NO: 267775

SEQ ID NO: 593759 - RNA, 64 nt, Homo Sapiens; identical to SEQ ID NO: 267776

SEQ ID NO: 593760 - RNA, 64 nt, Homo Sapiens; identical to SEQ ID NO: 267777

SEQ ID NO: 593761 - RNA, 64 nt, Homo Sapiens; identical to SEQ ID NO: 267778

SEQ ID NO: 593762 - RNA, 64 nt, Homo Sapiens; identical to SEQ ID NO: 267779

SEQ ID NO: 593763 - RNA, 64 nt, Homo Sapiens; identical to SEQ ID NO: 267780

SEQ ID NO: 593764 - RNA, 64 nt, Homo Sapiens; identical to SEQ ID NO: 267781

SEQ ID NO: 593765 - RNA, 64 nt, Homo Sapiens; identical to SEQ ID NO: 267782

SEQ ID NO: 593766 - RNA, 64 nt, Homo Sapiens; identical to SEQ ID NO: 267783

SEQ ID NO: 593767 - RNA, 64 nt, Homo Sapiens; identical to SEQ ID NO: 267784

SEQ ID NO: 593768 - RNA, 64 nt, Homo Sapiens; identical to SEQ ID NO: 267785

SEQ ID NO: 593769 - RNA, 64 nt, Homo Sapiens; identical to SEQ ID NO: 267786

SEQ ID NO: 593770 - RNA, 64 nt, Homo Sapiens; identical to SEQ ID NO: 267787

SEQ ID NO: 593771 - RNA, 64 nt, Homo Sapiens; identical to SEQ ID NO: 267788

SEQ ID NO: 593772 - RNA, 64 nt, Homo Sapiens; identical to SEQ ID NO: 267789

SEQ ID NO: 593773 - RNA, 64 nt, Homo Sapiens; identical to SEQ ID NO: 267790

SEQ ID NO: 593774 - RNA, 64 nt, Homo Sapiens; identical to SEQ ID NO: 267791

SEQ ID NO: 593775 - RNA, 64 nt, Homo Sapiens; identical to SEQ ID NO: 267792

SEQ ID NO: 593776 - RNA, 64 nt, Homo Sapiens; identical to SEQ ID NO: 267793

SEQ ID NO: 593777 - RNA, 64 nt, Homo Sapiens; identical to SEQ ID NO: 267794

SEQ ID NO: 593778 - RNA, 64 nt, Homo Sapiens; identical to SEQ ID NO: 267795

SEQ ID NO: 593779 - RNA, 64 nt, Homo Sapiens; identical to SEQ ID NO: 267796

SEQ ID NO: 593780 - RNA, 64 nt, Homo Sapiens; identical to SEQ ID NO: 267797

SEQ ID NO: 593781 - RNA, 64 nt, Homo Sapiens; identical to SEQ ID NO: 267798

SEQ ID NO: 593782 - RNA, 64 nt, Homo Sapiens; identical to SEQ ID NO: 267799

SEQ ID NO: 593783 - RNA, 64 nt, Homo Sapiens; identical to SEQ ID NO: 267800

SEQ ID NO: 593784 - RNA, 64 nt, Homo Sapiens; identical to SEQ ID NO: 267801

SEQ ID NO: 593785 - RNA, 64 nt, Homo Sapiens; identical to SEQ ID NO: 267802

SEQ ID NO: 593786 - RNA, 64 nt, Homo Sapiens; identical to SEQ ID NO: 267803

SEQ ID NO: 593787 - RNA, 64 nt, Homo Sapiens; identical to SEQ ID NO: 267804

SEQ ID NO: 593788 - RNA, 64 nt, Homo Sapiens; identical to SEQ ID NO: 267805

SEQ ID NO: 593789 - RNA, 64 nt, Homo Sapiens; identical to SEQ ID NO: 267806

SEQ ID NO: 593790 - RNA, 64 nt, Homo Sapiens; identical to SEQ ID NO: 267807

SEQ ID NO: 593791 - RNA, 64 nt, Homo Sapiens; identical to SEQ ID NO: 267808

SEQ ID NO: 593792 - RNA, 64 nt, Homo Sapiens; identical to SEQ ID NO: 267809

SEQ ID NO: 593793 - RNA, 64 nt, Homo Sapiens; identical to SEQ ID NO: 267810

SEQ ID NO: 593794 - RNA, 64 nt, Homo Sapiens; identical to SEQ ID NO: 267811

SEQ ID NO: 593795 - RNA, 64 nt, Homo Sapiens; identical to SEQ ID NO: 267812

SEQ ID NO: 593796 - RNA, 64 nt, Homo Sapiens; identical to SEQ ID NO: 267813

SEQ ID NO: 593797 - RNA, 64 nt, Homo Sapiens; identical to SEQ ID NO: 267814

SEQ ID NO: 593798 - RNA, 64 nt, Homo Sapiens; identical to SEQ ID NO: 267815

SEQ ID NO: 593799 - RNA, 64 nt, Homo Sapiens; identical to SEQ ID NO: 267816

SEQ ID NO: 593800 - RNA, 64 nt, Homo Sapiens; identical to SEQ ID NO: 267817

SEQ ID NO: 593801 - RNA, 64 nt, Homo Sapiens; identical to SEQ ID NO: 267818

SEQ ID NO: 593802 - RNA, 64 nt, Homo Sapiens; identical to SEQ ID NO: 267819

SEQ ID NO: 593803 - RNA, 64 nt, Homo Sapiens; identical to SEQ ID NO: 267820

SEQ ID NO: 593804 - RNA, 64 nt, Homo Sapiens; identical to SEQ ID NO: 267821

SEQ ID NO: 593805 - RNA, 64 nt, Homo Sapiens; identical to SEQ ID NO: 267822

SEQ ID NO: 593806 - RNA, 64 nt, Homo Sapiens; identical to SEQ ID NO: 267823

SEQ ID NO: 593807 - RNA, 64 nt, Homo Sapiens; identical to SEQ ID NO: 267824

SEQ ID NO: 593808 - RNA, 64 nt, Homo Sapiens; identical to SEQ ID NO: 267825

SEQ ID NO: 593809 - RNA, 64 nt, Homo Sapiens; identical to SEQ ID NO: 267826

SEQ ID NO: 593810 - RNA, 64 nt, Homo Sapiens; identical to SEQ ID NO: 267827

SEQ ID NO: 593811 - RNA, 64 nt, Homo Sapiens; identical to SEQ ID NO: 267828

SEQ ID NO: 593812 - RNA, 64 nt, Homo Sapiens; identical to SEQ ID NO: 267829

SEQ ID NO: 593813 - RNA, 64 nt, Homo Sapiens; identical to SEQ ID NO: 267830

SEQ ID NO: 593814 - RNA, 64 nt, Homo Sapiens; identical to SEQ ID NO: 267831

SEQ ID NO: 593815 - RNA, 64 nt, Homo Sapiens; identical to SEQ ID NO: 267832

SEQ ID NO: 593816 - RNA, 64 nt, Homo Sapiens; identical to SEQ ID NO: 267833

SEQ ID NO: 593817 - RNA, 64 nt, Homo Sapiens; identical to SEQ ID NO: 267834

SEQ ID NO: 593818 - RNA, 64 nt, Homo Sapiens; identical to SEQ ID NO: 267835

SEQ ID NO: 593819 - RNA, 64 nt, Homo Sapiens; identical to SEQ ID NO: 267836

SEQ ID NO: 593820 - RNA, 64 nt, Homo Sapiens; identical to SEQ ID NO: 267837

SEQ ID NO: 593821 - RNA, 64 nt, Homo Sapiens; identical to SEQ ID NO: 267838

SEQ ID NO: 593822 - RNA, 64 nt, Homo Sapiens; identical to SEQ ID NO: 267839

SEQ ID NO: 593823 - RNA, 64 nt, Homo Sapiens; identical to SEQ ID NO: 267840

SEQ ID NO: 593824 - RNA, 64 nt, Homo Sapiens; identical to SEQ ID NO: 267841

SEQ ID NO: 593825 - RNA, 64 nt, Homo Sapiens; identical to SEQ ID NO: 267842

SEQ ID NO: 593826 - RNA, 64 nt, Homo Sapiens; identical to SEQ ID NO: 267843

SEQ ID NO: 593827 - RNA, 64 nt, Homo Sapiens; identical to SEQ ID NO: 267844

SEQ ID NO: 593828 - RNA, 64 nt, Homo Sapiens; identical to SEQ ID NO: 267845

SEQ ID NO: 593829 - RNA, 64 nt, Homo Sapiens; identical to SEQ ID NO: 267846

SEQ ID NO: 593830 - RNA, 64 nt, Homo Sapiens; identical to SEQ ID NO: 267847

SEQ ID NO: 593831 - RNA, 64 nt, Homo Sapiens; identical to SEQ ID NO: 267848

SEQ ID NO: 593832 - RNA, 64 nt, Homo Sapiens; identical to SEQ ID NO: 267849

SEQ ID NO: 593833 - RNA, 64 nt, Homo Sapiens; identical to SEQ ID NO: 267850

SEQ ID NO: 593834 - RNA, 64 nt, Homo Sapiens; identical to SEQ ID NO: 267851

SEQ ID NO: 593835 - RNA, 64 nt, Homo Sapiens; identical to SEQ ID NO: 267852

SEQ ID NO: 593836 - RNA, 64 nt, Homo Sapiens; identical to SEQ ID NO: 267853

SEQ ID NO: 593837 - RNA, 64 nt, Homo Sapiens; identical to SEQ ID NO: 267854

SEQ ID NO: 593838 - RNA, 64 nt, Homo Sapiens; identical to SEQ ID NO: 267855

SEQ ID NO: 593839 - RNA, 64 nt, Homo Sapiens; identical to SEQ ID NO: 267856

SEQ ID NO: 593840 - RNA, 64 nt, Homo Sapiens; identical to SEQ ID NO: 267857

SEQ ID NO: 593841 - RNA, 64 nt, Homo Sapiens; identical to SEQ ID NO: 267858

SEQ ID NO: 593842 - RNA, 64 nt, Homo Sapiens; identical to SEQ ID NO: 267859

SEQ ID NO: 593843 - RNA, 64 nt, Homo Sapiens; identical to SEQ ID NO: 267860

SEQ ID NO: 593844 - RNA, 64 nt, Homo Sapiens; identical to SEQ ID NO: 267861

SEQ ID NO: 593845 - RNA, 64 nt, Homo Sapiens; identical to SEQ ID NO: 267862

SEQ ID NO: 593846 - RNA, 64 nt, Homo Sapiens; identical to SEQ ID NO: 267863

SEQ ID NO: 593847 - RNA, 64 nt, Homo Sapiens; identical to SEQ ID NO: 267864

SEQ ID NO: 593848 - RNA, 64 nt, Homo Sapiens; identical to SEQ ID NO: 267865

SEQ ID NO: 593849 - RNA, 64 nt, Homo Sapiens; identical to SEQ ID NO: 267866

SEQ ID NO: 593850 - RNA, 64 nt, Homo Sapiens; identical to SEQ ID NO: 267867

SEQ ID NO: 593851 - RNA, 64 nt, Homo Sapiens; identical to SEQ ID NO: 267868

SEQ ID NO: 593852 - RNA, 64 nt, Homo Sapiens; identical to SEQ ID NO: 267869

SEQ ID NO: 593853 - RNA, 64 nt, Homo Sapiens; identical to SEQ ID NO: 267870

SEQ ID NO: 593854 - RNA, 64 nt, Homo Sapiens; identical to SEQ ID NO: 267871

SEQ ID NO: 593855 - RNA, 64 nt, Homo Sapiens; identical to SEQ ID NO: 267872

SEQ ID NO: 593856 - RNA, 64 nt, Homo Sapiens; identical to SEQ ID NO: 267873

SEQ ID NO: 593857 - RNA, 64 nt, Homo Sapiens; identical to SEQ ID NO: 267874

SEQ ID NO: 593858 - RNA, 64 nt, Homo Sapiens; identical to SEQ ID NO: 267875

SEQ ID NO: 593859 - RNA, 64 nt, Homo Sapiens; identical to SEQ ID NO: 267876

SEQ ID NO: 593860 - RNA, 64 nt, Homo Sapiens; identical to SEQ ID NO: 267877

SEQ ID NO: 593861 - RNA, 64 nt, Homo Sapiens; identical to SEQ ID NO: 267878

SEQ ID NO: 593862 - RNA, 64 nt, Homo Sapiens; identical to SEQ ID NO: 267879

SEQ ID NO: 593863 - RNA, 64 nt, Homo Sapiens; identical to SEQ ID NO: 267880

SEQ ID NO: 593864 - RNA, 64 nt, Homo Sapiens; identical to SEQ ID NO: 267881

SEQ ID NO: 593865 - RNA, 64 nt, Homo Sapiens; identical to SEQ ID NO: 267882

SEQ ID NO: 593866 - RNA, 64 nt, Homo Sapiens; identical to SEQ ID NO: 267883

SEQ ID NO: 593867 - RNA, 64 nt, Homo Sapiens; identical to SEQ ID NO: 267884

SEQ ID NO: 593868 - RNA, 64 nt, Homo Sapiens; identical to SEQ ID NO: 267885

SEQ ID NO: 593869 - RNA, 64 nt, Homo Sapiens; identical to SEQ ID NO: 267886

SEQ ID NO: 593870 - RNA, 64 nt, Homo Sapiens; identical to SEQ ID NO: 267887

SEQ ID NO: 593871 - RNA, 64 nt, Homo Sapiens; identical to SEQ ID NO: 267888

SEQ ID NO: 593872 - RNA, 64 nt, Homo Sapiens; identical to SEQ ID NO: 267889

SEQ ID NO: 593873 - RNA, 64 nt, Homo Sapiens; identical to SEQ ID NO: 267890

SEQ ID NO: 593874 - RNA, 64 nt, Homo Sapiens; identical to SEQ ID NO: 267891

SEQ ID NO: 593875 - RNA, 64 nt, Homo Sapiens; identical to SEQ ID NO: 267892

SEQ ID NO: 593876 - RNA, 64 nt, Homo Sapiens; identical to SEQ ID NO: 267893

SEQ ID NO: 593877 - RNA, 64 nt, Homo Sapiens; identical to SEQ ID NO: 267894

SEQ ID NO: 593878 - RNA, 64 nt, Homo Sapiens; identical to SEQ ID NO: 267895

SEQ ID NO: 593879 - RNA, 64 nt, Homo Sapiens; identical to SEQ ID NO: 267896

SEQ ID NO: 593880 - RNA, 64 nt, Homo Sapiens; identical to SEQ ID NO: 267897

SEQ ID NO: 593881 - RNA, 64 nt, Homo Sapiens; identical to SEQ ID NO: 267898

SEQ ID NO: 593882 - RNA, 64 nt, Homo Sapiens; identical to SEQ ID NO: 267899

SEQ ID NO: 593883 - RNA, 64 nt, Homo Sapiens; identical to SEQ ID NO: 267900

SEQ ID NO: 593884 - RNA, 64 nt, Homo Sapiens; identical to SEQ ID NO: 267901

SEQ ID NO: 593885 - RNA, 64 nt, Homo Sapiens; identical to SEQ ID NO: 267902

SEQ ID NO: 593886 - RNA, 64 nt, Homo Sapiens; identical to SEQ ID NO: 267903

SEQ ID NO: 593887 - RNA, 64 nt, Homo Sapiens; identical to SEQ ID NO: 267904

SEQ ID NO: 593888 - RNA, 64 nt, Homo Sapiens; identical to SEQ ID NO: 267905

SEQ ID NO: 593889 - RNA, 64 nt, Homo Sapiens; identical to SEQ ID NO: 267906

SEQ ID NO: 593890 - RNA, 64 nt, Homo Sapiens; identical to SEQ ID NO: 267907

SEQ ID NO: 593891 - RNA, 64 nt, Homo Sapiens; identical to SEQ ID NO: 267908

SEQ ID NO: 593892 - RNA, 64 nt, Homo Sapiens; identical to SEQ ID NO: 267909

SEQ ID NO: 593893 - RNA, 64 nt, Homo Sapiens; identical to SEQ ID NO: 267910

SEQ ID NO: 593894 - RNA, 64 nt, Homo Sapiens; identical to SEQ ID NO: 267911

SEQ ID NO: 593895 - RNA, 64 nt, Homo Sapiens; identical to SEQ ID NO: 267912

SEQ ID NO: 593896 - RNA, 64 nt, Homo Sapiens; identical to SEQ ID NO: 267913

SEQ ID NO: 593897 - RNA, 64 nt, Homo Sapiens; identical to SEQ ID NO: 267914

SEQ ID NO: 593898 - RNA, 64 nt, Homo Sapiens; identical to SEQ ID NO: 267915

SEQ ID NO: 593899 - RNA, 64 nt, Homo Sapiens; identical to SEQ ID NO: 267916

SEQ ID NO: 593900 - RNA, 64 nt, Homo Sapiens; identical to SEQ ID NO: 267917

SEQ ID NO: 593901 - RNA, 64 nt, Homo Sapiens; identical to SEQ ID NO: 267918

SEQ ID NO: 593902 - RNA, 64 nt, Homo Sapiens; identical to SEQ ID NO: 267919

SEQ ID NO: 593903 - RNA, 64 nt, Homo Sapiens; identical to SEQ ID NO: 267920

SEQ ID NO: 593904 - RNA, 64 nt, Homo Sapiens; identical to SEQ ID NO: 267921

SEQ ID NO: 593905 - RNA, 64 nt, Homo Sapiens; identical to SEQ ID NO: 267922

SEQ ID NO: 593906 - RNA, 64 nt, Homo Sapiens; identical to SEQ ID NO: 267923

SEQ ID NO: 593907 - RNA, 64 nt, Homo Sapiens; identical to SEQ ID NO: 267924

SEQ ID NO: 593908 - RNA, 64 nt, Homo Sapiens; identical to SEQ ID NO: 267925

SEQ ID NO: 593909 - RNA, 64 nt, Homo Sapiens; identical to SEQ ID NO: 267926

SEQ ID NO: 593910 - RNA, 64 nt, Homo Sapiens; identical to SEQ ID NO: 267927

SEQ ID NO: 593911 - RNA, 64 nt, Homo Sapiens; identical to SEQ ID NO: 267928

SEQ ID NO: 593912 - RNA, 64 nt, Homo Sapiens; identical to SEQ ID NO: 267929

SEQ ID NO: 593913 - RNA, 64 nt, Homo Sapiens; identical to SEQ ID NO: 267930

SEQ ID NO: 593914 - RNA, 64 nt, Homo Sapiens; identical to SEQ ID NO: 267931

SEQ ID NO: 593915 - RNA, 64 nt, Homo Sapiens; identical to SEQ ID NO: 267932

SEQ ID NO: 593916 - RNA, 64 nt, Homo Sapiens; identical to SEQ ID NO: 267933

SEQ ID NO: 593917 - RNA, 64 nt, Homo Sapiens; identical to SEQ ID NO: 267934

SEQ ID NO: 593918 - RNA, 64 nt, Homo Sapiens; identical to SEQ ID NO: 267935

SEQ ID NO: 593919 - RNA, 64 nt, Homo Sapiens; identical to SEQ ID NO: 267936

SEQ ID NO: 593920 - RNA, 64 nt, Homo Sapiens; identical to SEQ ID NO: 267937

SEQ ID NO: 593921 - RNA, 64 nt, Homo Sapiens; identical to SEQ ID NO: 267938

SEQ ID NO: 593922 - RNA, 64 nt, Homo Sapiens; identical to SEQ ID NO: 267939

SEQ ID NO: 593923 - RNA, 64 nt, Homo Sapiens; identical to SEQ ID NO: 267940

SEQ ID NO: 593924 - RNA, 64 nt, Homo Sapiens; identical to SEQ ID NO: 267941

SEQ ID NO: 593925 - RNA, 64 nt, Homo Sapiens; identical to SEQ ID NO: 267942

SEQ ID NO: 593926 - RNA, 64 nt, Homo Sapiens; identical to SEQ ID NO: 267943

SEQ ID NO: 593927 - RNA, 64 nt, Homo Sapiens; identical to SEQ ID NO: 267944

SEQ ID NO: 593928 - RNA, 64 nt, Homo Sapiens; identical to SEQ ID NO: 267945

SEQ ID NO: 593929 - RNA, 64 nt, Homo Sapiens; identical to SEQ ID NO: 267946

SEQ ID NO: 593930 - RNA, 64 nt, Homo Sapiens; identical to SEQ ID NO: 267947

SEQ ID NO: 593931 - RNA, 64 nt, Homo Sapiens; identical to SEQ ID NO: 267948

SEQ ID NO: 593932 - RNA, 64 nt, Homo Sapiens; identical to SEQ ID NO: 267949

SEQ ID NO: 593933 - RNA, 64 nt, Homo Sapiens; identical to SEQ ID NO: 267950

SEQ ID NO: 593934 - RNA, 64 nt, Homo Sapiens; identical to SEQ ID NO: 267951

SEQ ID NO: 593935 - RNA, 64 nt, Homo Sapiens; identical to SEQ ID NO: 267952

SEQ ID NO: 593936 - RNA, 64 nt, Homo Sapiens; identical to SEQ ID NO: 267953

SEQ ID NO: 593937 - RNA, 64 nt, Homo Sapiens; identical to SEQ ID NO: 267954

SEQ ID NO: 593938 - RNA, 64 nt, Homo Sapiens; identical to SEQ ID NO: 267955

SEQ ID NO: 593939 - RNA, 64 nt, Homo Sapiens; identical to SEQ ID NO: 267956

SEQ ID NO: 593940 - RNA, 64 nt, Homo Sapiens; identical to SEQ ID NO: 267957

SEQ ID NO: 593941 - RNA, 64 nt, Homo Sapiens; identical to SEQ ID NO: 267958

SEQ ID NO: 593942 - RNA, 64 nt, Homo Sapiens; identical to SEQ ID NO: 267959

SEQ ID NO: 593943 - RNA, 64 nt, Homo Sapiens; identical to SEQ ID NO: 267960

SEQ ID NO: 593944 - RNA, 64 nt, Homo Sapiens; identical to SEQ ID NO: 267961

SEQ ID NO: 593945 - RNA, 64 nt, Homo Sapiens; identical to SEQ ID NO: 267962

SEQ ID NO: 593946 - RNA, 64 nt, Homo Sapiens; identical to SEQ ID NO: 267963

SEQ ID NO: 593947 - RNA, 64 nt, Homo Sapiens; identical to SEQ ID NO: 267964

SEQ ID NO: 593948 - RNA, 64 nt, Homo Sapiens; identical to SEQ ID NO: 267965

SEQ ID NO: 593949 - RNA, 64 nt, Homo Sapiens; identical to SEQ ID NO: 267966

SEQ ID NO: 593950 - RNA, 64 nt, Homo Sapiens; identical to SEQ ID NO: 267967

SEQ ID NO: 593951 - RNA, 64 nt, Homo Sapiens; identical to SEQ ID NO: 267968

SEQ ID NO: 593952 - RNA, 64 nt, Homo Sapiens; identical to SEQ ID NO: 267969

SEQ ID NO: 593953 - RNA, 64 nt, Homo Sapiens; identical to SEQ ID NO: 267970

SEQ ID NO: 593954 - RNA, 64 nt, Homo Sapiens; identical to SEQ ID NO: 267971

SEQ ID NO: 593955 - RNA, 64 nt, Homo Sapiens; identical to SEQ ID NO: 267972

SEQ ID NO: 593956 - RNA, 64 nt, Homo Sapiens; identical to SEQ ID NO: 267973

SEQ ID NO: 593957 - RNA, 64 nt, Homo Sapiens; identical to SEQ ID NO: 267974

SEQ ID NO: 593958 - RNA, 64 nt, Homo Sapiens; identical to SEQ ID NO: 267975

SEQ ID NO: 593959 - RNA, 64 nt, Homo Sapiens; identical to SEQ ID NO: 267976

SEQ ID NO: 593960 - RNA, 64 nt, Homo Sapiens; identical to SEQ ID NO: 267977

SEQ ID NO: 593961 - RNA, 64 nt, Homo Sapiens; identical to SEQ ID NO: 267978

SEQ ID NO: 593962 - RNA, 64 nt, Homo Sapiens; identical to SEQ ID NO: 267979

SEQ ID NO: 593963 - RNA, 64 nt, Homo Sapiens; identical to SEQ ID NO: 267980

SEQ ID NO: 593964 - RNA, 64 nt, Homo Sapiens; identical to SEQ ID NO: 267981

SEQ ID NO: 593965 - RNA, 64 nt, Homo Sapiens; identical to SEQ ID NO: 267982

SEQ ID NO: 593966 - RNA, 64 nt, Homo Sapiens; identical to SEQ ID NO: 267983

SEQ ID NO: 593967 - RNA, 64 nt, Homo Sapiens; identical to SEQ ID NO: 267984

SEQ ID NO: 593968 - RNA, 64 nt, Homo Sapiens; identical to SEQ ID NO: 267985

SEQ ID NO: 593969 - RNA, 63 nt, Homo Sapiens; identical to SEQ ID NO: 267986

SEQ ID NO: 593970 - RNA, 64 nt, Homo Sapiens; identical to SEQ ID NO: 267987

SEQ ID NO: 593971 - RNA, 64 nt, Homo Sapiens; identical to SEQ ID NO: 267988

SEQ ID NO: 593972 - RNA, 64 nt, Homo Sapiens; identical to SEQ ID NO: 267989

SEQ ID NO: 593973 - RNA, 64 nt, Homo Sapiens; identical to SEQ ID NO: 267990

SEQ ID NO: 593974 - RNA, 64 nt, Homo Sapiens; identical to SEQ ID NO: 267991

SEQ ID NO: 593975 - RNA, 64 nt, Homo Sapiens; identical to SEQ ID NO: 267992

SEQ ID NO: 593976 - RNA, 64 nt, Homo Sapiens; identical to SEQ ID NO: 267993

SEQ ID NO: 593977 - RNA, 64 nt, Homo Sapiens; identical to SEQ ID NO: 267994

SEQ ID NO: 593978 - RNA, 64 nt, Homo Sapiens; identical to SEQ ID NO: 267995

SEQ ID NO: 593979 - RNA, 64 nt, Homo Sapiens; identical to SEQ ID NO: 267996

SEQ ID NO: 593980 - RNA, 64 nt, Homo Sapiens; identical to SEQ ID NO: 267997

SEQ ID NO: 593981 - RNA, 64 nt, Homo Sapiens; identical to SEQ ID NO: 267998

SEQ ID NO: 593982 - RNA, 64 nt, Homo Sapiens; identical to SEQ ID NO: 267999

SEQ ID NO: 593983 - RNA, 64 nt, Homo Sapiens; identical to SEQ ID NO: 268000

SEQ ID NO: 593984 - RNA, 64 nt, Homo Sapiens; identical to SEQ ID NO: 268001

SEQ ID NO: 593985 - RNA, 64 nt, Homo Sapiens; identical to SEQ ID NO: 268002

SEQ ID NO: 593986 - RNA, 64 nt, Homo Sapiens; identical to SEQ ID NO: 268003

SEQ ID NO: 593987 - RNA, 64 nt, Homo Sapiens; identical to SEQ ID NO: 268004

SEQ ID NO: 593988 - RNA, 64 nt, Homo Sapiens; identical to SEQ ID NO: 268005

SEQ ID NO: 593989 - RNA, 64 nt, Homo Sapiens; identical to SEQ ID NO: 268006

SEQ ID NO: 593990 - RNA, 64 nt, Homo Sapiens; identical to SEQ ID NO: 268007

SEQ ID NO: 593991 - RNA, 64 nt, Homo Sapiens; identical to SEQ ID NO: 268008

SEQ ID NO: 593992 - RNA, 64 nt, Homo Sapiens; identical to SEQ ID NO: 268009

SEQ ID NO: 593993 - RNA, 64 nt, Homo Sapiens; identical to SEQ ID NO: 268010

SEQ ID NO: 593994 - RNA, 64 nt, Homo Sapiens; identical to SEQ ID NO: 268011

SEQ ID NO: 593995 - RNA, 64 nt, Homo Sapiens; identical to SEQ ID NO: 268012

SEQ ID NO: 593996 - RNA, 64 nt, Homo Sapiens; identical to SEQ ID NO: 268013

SEQ ID NO: 593997 - RNA, 64 nt, Homo Sapiens; identical to SEQ ID NO: 268014

SEQ ID NO: 593998 - RNA, 64 nt, Homo Sapiens; identical to SEQ ID NO: 268015

SEQ ID NO: 593999 - RNA, 64 nt, Homo Sapiens; identical to SEQ ID NO: 268016

SEQ ID NO: 594000 - RNA, 64 nt, Homo Sapiens; identical to SEQ ID NO: 268017

SEQ ID NO: 594001 - RNA, 64 nt, Homo Sapiens; identical to SEQ ID NO: 268018

SEQ ID NO: 594002 - RNA, 64 nt, Homo Sapiens; identical to SEQ ID NO: 268019

SEQ ID NO: 594003 - RNA, 64 nt, Homo Sapiens; identical to SEQ ID NO: 268020

SEQ ID NO: 594004 - RNA, 64 nt, Homo Sapiens; identical to SEQ ID NO: 268021

SEQ ID NO: 594005 - RNA, 64 nt, Homo Sapiens; identical to SEQ ID NO: 268022

SEQ ID NO: 594006 - RNA, 64 nt, Homo Sapiens; identical to SEQ ID NO: 268023

SEQ ID NO: 594007 - RNA, 64 nt, Homo Sapiens; identical to SEQ ID NO: 268024

SEQ ID NO: 594008 - RNA, 64 nt, Homo Sapiens; identical to SEQ ID NO: 268025

SEQ ID NO: 594009 - RNA, 64 nt, Homo Sapiens; identical to SEQ ID NO: 268026

SEQ ID NO: 594010 - RNA, 64 nt, Homo Sapiens; identical to SEQ ID NO: 268027

SEQ ID NO: 594011 - RNA, 64 nt, Homo Sapiens; identical to SEQ ID NO: 268028

SEQ ID NO: 594012 - RNA, 64 nt, Homo Sapiens; identical to SEQ ID NO: 268029

SEQ ID NO: 594013 - RNA, 64 nt, Homo Sapiens; identical to SEQ ID NO: 268030

SEQ ID NO: 594014 - RNA, 64 nt, Homo Sapiens; identical to SEQ ID NO: 268031

SEQ ID NO: 594015 - RNA, 64 nt, Homo Sapiens; identical to SEQ ID NO: 268032

SEQ ID NO: 594016 - RNA, 64 nt, Homo Sapiens; identical to SEQ ID NO: 268033

SEQ ID NO: 594017 - RNA, 64 nt, Homo Sapiens; identical to SEQ ID NO: 268034

SEQ ID NO: 594018 - RNA, 64 nt, Homo Sapiens; identical to SEQ ID NO: 268035

SEQ ID NO: 594019 - RNA, 64 nt, Homo Sapiens; identical to SEQ ID NO: 268036

SEQ ID NO: 594020 - RNA, 64 nt, Homo Sapiens; identical to SEQ ID NO: 268037

SEQ ID NO: 594021 - RNA, 64 nt, Homo Sapiens; identical to SEQ ID NO: 268038

SEQ ID NO: 594022 - RNA, 64 nt, Homo Sapiens; identical to SEQ ID NO: 268039

SEQ ID NO: 594023 - RNA, 64 nt, Homo Sapiens; identical to SEQ ID NO: 268040

SEQ ID NO: 594024 - RNA, 64 nt, Homo Sapiens; identical to SEQ ID NO: 268041

SEQ ID NO: 594025 - RNA, 64 nt, Homo Sapiens; identical to SEQ ID NO: 268042

SEQ ID NO: 594026 - RNA, 64 nt, Homo Sapiens; identical to SEQ ID NO: 268043

SEQ ID NO: 594027 - RNA, 64 nt, Homo Sapiens; identical to SEQ ID NO: 268044

SEQ ID NO: 594028 - RNA, 64 nt, Homo Sapiens; identical to SEQ ID NO: 268045

SEQ ID NO: 594029 - RNA, 64 nt, Homo Sapiens; identical to SEQ ID NO: 268046

SEQ ID NO: 594030 - RNA, 64 nt, Homo Sapiens; identical to SEQ ID NO: 268047

SEQ ID NO: 594031 - RNA, 64 nt, Homo Sapiens; identical to SEQ ID NO: 268048

SEQ ID NO: 594032 - RNA, 64 nt, Homo Sapiens; identical to SEQ ID NO: 268049

SEQ ID NO: 594033 - RNA, 64 nt, Homo Sapiens; identical to SEQ ID NO: 268050

SEQ ID NO: 594034 - RNA, 64 nt, Homo Sapiens; identical to SEQ ID NO: 268051

SEQ ID NO: 594035 - RNA, 64 nt, Homo Sapiens; identical to SEQ ID NO: 268052

SEQ ID NO: 594036 - RNA, 64 nt, Homo Sapiens; identical to SEQ ID NO: 268053

SEQ ID NO: 594037 - RNA, 64 nt, Homo Sapiens; identical to SEQ ID NO: 268054

SEQ ID NO: 594038 - RNA, 64 nt, Homo Sapiens; identical to SEQ ID NO: 268055

SEQ ID NO: 594039 - RNA, 64 nt, Homo Sapiens; identical to SEQ ID NO: 268056

SEQ ID NO: 594040 - RNA, 64 nt, Homo Sapiens; identical to SEQ ID NO: 268057

SEQ ID NO: 594041 - RNA, 64 nt, Homo Sapiens; identical to SEQ ID NO: 268058

SEQ ID NO: 594042 - RNA, 64 nt, Homo Sapiens; identical to SEQ ID NO: 268059

SEQ ID NO: 594043 - RNA, 64 nt, Homo Sapiens; identical to SEQ ID NO: 268060

SEQ ID NO: 594044 - RNA, 64 nt, Homo Sapiens; identical to SEQ ID NO: 268061

SEQ ID NO: 594045 - RNA, 64 nt, Homo Sapiens; identical to SEQ ID NO: 268062

SEQ ID NO: 594046 - RNA, 64 nt, Homo Sapiens; identical to SEQ ID NO: 268063

SEQ ID NO: 594047 - RNA, 64 nt, Homo Sapiens; identical to SEQ ID NO: 268064

SEQ ID NO: 594048 - RNA, 64 nt, Homo Sapiens; identical to SEQ ID NO: 268065

SEQ ID NO: 594049 - RNA, 64 nt, Homo Sapiens; identical to SEQ ID NO: 268066

SEQ ID NO: 594050 - RNA, 64 nt, Homo Sapiens; identical to SEQ ID NO: 268067

SEQ ID NO: 594051 - RNA, 64 nt, Homo Sapiens; identical to SEQ ID NO: 268068

SEQ ID NO: 594052 - RNA, 64 nt, Homo Sapiens; identical to SEQ ID NO: 268069

SEQ ID NO: 594053 - RNA, 64 nt, Homo Sapiens; identical to SEQ ID NO: 268070

SEQ ID NO: 594054 - RNA, 64 nt, Homo Sapiens; identical to SEQ ID NO: 268071

SEQ ID NO: 594055 - RNA, 64 nt, Homo Sapiens; identical to SEQ ID NO: 268072

SEQ ID NO: 594056 - RNA, 64 nt, Homo Sapiens; identical to SEQ ID NO: 268073

SEQ ID NO: 594057 - RNA, 64 nt, Homo Sapiens; identical to SEQ ID NO: 268074

SEQ ID NO: 594058 - RNA, 64 nt, Homo Sapiens; identical to SEQ ID NO: 268075

SEQ ID NO: 594059 - RNA, 64 nt, Homo Sapiens; identical to SEQ ID NO: 268076

SEQ ID NO: 594060 - RNA, 64 nt, Homo Sapiens; identical to SEQ ID NO: 268077

SEQ ID NO: 594061 - RNA, 64 nt, Homo Sapiens; identical to SEQ ID NO: 268078

SEQ ID NO: 594062 - RNA, 64 nt, Homo Sapiens; identical to SEQ ID NO: 268079

SEQ ID NO: 594063 - RNA, 64 nt, Homo Sapiens; identical to SEQ ID NO: 268080

SEQ ID NO: 594064 - RNA, 64 nt, Homo Sapiens; identical to SEQ ID NO: 268081

SEQ ID NO: 594065 - RNA, 64 nt, Homo Sapiens; identical to SEQ ID NO: 268082

SEQ ID NO: 594066 - RNA, 64 nt, Homo Sapiens; identical to SEQ ID NO: 268083

SEQ ID NO: 594067 - RNA, 64 nt, Homo Sapiens; identical to SEQ ID NO: 268084

SEQ ID NO: 594068 - RNA, 64 nt, Homo Sapiens; identical to SEQ ID NO: 268085

SEQ ID NO: 594069 - RNA, 64 nt, Homo Sapiens; identical to SEQ ID NO: 268086

SEQ ID NO: 594070 - RNA, 64 nt, Homo Sapiens; identical to SEQ ID NO: 268087

SEQ ID NO: 594071 - RNA, 64 nt, Homo Sapiens; identical to SEQ ID NO: 268088

SEQ ID NO: 594072 - RNA, 64 nt, Homo Sapiens; identical to SEQ ID NO: 268089

SEQ ID NO: 594073 - RNA, 64 nt, Homo Sapiens; identical to SEQ ID NO: 268090

SEQ ID NO: 594074 - RNA, 64 nt, Homo Sapiens; identical to SEQ ID NO: 268091

SEQ ID NO: 594075 - RNA, 64 nt, Homo Sapiens; identical to SEQ ID NO: 268092

SEQ ID NO: 594076 - RNA, 64 nt, Homo Sapiens; identical to SEQ ID NO: 268093

SEQ ID NO: 594077 - RNA, 64 nt, Homo Sapiens; identical to SEQ ID NO: 268094

SEQ ID NO: 594078 - RNA, 64 nt, Homo Sapiens; identical to SEQ ID NO: 268095

SEQ ID NO: 594079 - RNA, 64 nt, Homo Sapiens; identical to SEQ ID NO: 268096

SEQ ID NO: 594080 - RNA, 64 nt, Homo Sapiens; identical to SEQ ID NO: 268097

SEQ ID NO: 594081 - RNA, 64 nt, Homo Sapiens; identical to SEQ ID NO: 268098

SEQ ID NO: 594082 - RNA, 64 nt, Homo Sapiens; identical to SEQ ID NO: 268099

SEQ ID NO: 594083 - RNA, 64 nt, Homo Sapiens; identical to SEQ ID NO: 268100

SEQ ID NO: 594084 - RNA, 64 nt, Homo Sapiens; identical to SEQ ID NO: 268101

SEQ ID NO: 594085 - RNA, 64 nt, Homo Sapiens; identical to SEQ ID NO: 268102

SEQ ID NO: 594086 - RNA, 64 nt, Homo Sapiens; identical to SEQ ID NO: 268103

SEQ ID NO: 594087 - RNA, 64 nt, Homo Sapiens; identical to SEQ ID NO: 268104

SEQ ID NO: 594088 - RNA, 64 nt, Homo Sapiens; identical to SEQ ID NO: 268105

SEQ ID NO: 594089 - RNA, 64 nt, Homo Sapiens; identical to SEQ ID NO: 268106

SEQ ID NO: 594090 - RNA, 64 nt, Homo Sapiens; identical to SEQ ID NO: 268107

SEQ ID NO: 594091 - RNA, 64 nt, Homo Sapiens; identical to SEQ ID NO: 268108

SEQ ID NO: 594092 - RNA, 64 nt, Homo Sapiens; identical to SEQ ID NO: 268109

SEQ ID NO: 594093 - RNA, 64 nt, Homo Sapiens; identical to SEQ ID NO: 268110

SEQ ID NO: 594094 - RNA, 64 nt, Homo Sapiens; identical to SEQ ID NO: 268111

SEQ ID NO: 594095 - RNA, 64 nt, Homo Sapiens; identical to SEQ ID NO: 268112

SEQ ID NO: 594096 - RNA, 64 nt, Homo Sapiens; identical to SEQ ID NO: 268113

SEQ ID NO: 594097 - RNA, 64 nt, Homo Sapiens; identical to SEQ ID NO: 268114

SEQ ID NO: 594098 - RNA, 64 nt, Homo Sapiens; identical to SEQ ID NO: 268115

SEQ ID NO: 594099 - RNA, 64 nt, Homo Sapiens; identical to SEQ ID NO: 268116

SEQ ID NO: 594100 - RNA, 64 nt, Homo Sapiens; identical to SEQ ID NO: 268117

SEQ ID NO: 594101 - RNA, 64 nt, Homo Sapiens; identical to SEQ ID NO: 268118

SEQ ID NO: 594102 - RNA, 64 nt, Homo Sapiens; identical to SEQ ID NO: 268119

SEQ ID NO: 594103 - RNA, 64 nt, Homo Sapiens; identical to SEQ ID NO: 268120

SEQ ID NO: 594104 - RNA, 64 nt, Homo Sapiens; identical to SEQ ID NO: 268121

SEQ ID NO: 594105 - RNA, 64 nt, Homo Sapiens; identical to SEQ ID NO: 268122

SEQ ID NO: 594106 - RNA, 64 nt, Homo Sapiens; identical to SEQ ID NO: 268123

SEQ ID NO: 594107 - RNA, 64 nt, Homo Sapiens; identical to SEQ ID NO: 268124

SEQ ID NO: 594108 - RNA, 64 nt, Homo Sapiens; identical to SEQ ID NO: 268125

SEQ ID NO: 594109 - RNA, 64 nt, Homo Sapiens; identical to SEQ ID NO: 268126

SEQ ID NO: 594110 - RNA, 64 nt, Homo Sapiens; identical to SEQ ID NO: 268127

SEQ ID NO: 594111 - RNA, 64 nt, Homo Sapiens; identical to SEQ ID NO: 268128

SEQ ID NO: 594112 - RNA, 64 nt, Homo Sapiens; identical to SEQ ID NO: 268129

SEQ ID NO: 594113 - RNA, 64 nt, Homo Sapiens; identical to SEQ ID NO: 268130

SEQ ID NO: 594114 - RNA, 64 nt, Homo Sapiens; identical to SEQ ID NO: 268131

SEQ ID NO: 594115 - RNA, 64 nt, Homo Sapiens; identical to SEQ ID NO: 268132

SEQ ID NO: 594116 - RNA, 64 nt, Homo Sapiens; identical to SEQ ID NO: 268133

SEQ ID NO: 594117 - RNA, 64 nt, Homo Sapiens; identical to SEQ ID NO: 268134

SEQ ID NO: 594118 - RNA, 64 nt, Homo Sapiens; identical to SEQ ID NO: 268135

SEQ ID NO: 594119 - RNA, 64 nt, Homo Sapiens; identical to SEQ ID NO: 268136

SEQ ID NO: 594120 - RNA, 64 nt, Homo Sapiens; identical to SEQ ID NO: 268137

SEQ ID NO: 594121 - RNA, 64 nt, Homo Sapiens; identical to SEQ ID NO: 268138

SEQ ID NO: 594122 - RNA, 64 nt, Homo Sapiens; identical to SEQ ID NO: 268139

SEQ ID NO: 594123 - RNA, 64 nt, Homo Sapiens; identical to SEQ ID NO: 268140

SEQ ID NO: 594124 - RNA, 64 nt, Homo Sapiens; identical to SEQ ID NO: 268141

SEQ ID NO: 594125 - RNA, 64 nt, Homo Sapiens; identical to SEQ ID NO: 268142

SEQ ID NO: 594126 - RNA, 64 nt, Homo Sapiens; identical to SEQ ID NO: 268143

SEQ ID NO: 594127 - RNA, 64 nt, Homo Sapiens; identical to SEQ ID NO: 268144

SEQ ID NO: 594128 - RNA, 64 nt, Homo Sapiens; identical to SEQ ID NO: 268145

SEQ ID NO: 594129 - RNA, 64 nt, Homo Sapiens; identical to SEQ ID NO: 268146

SEQ ID NO: 594130 - RNA, 64 nt, Homo Sapiens; identical to SEQ ID NO: 268147

SEQ ID NO: 594131 - RNA, 64 nt, Homo Sapiens; identical to SEQ ID NO: 268148

SEQ ID NO: 594132 - RNA, 64 nt, Homo Sapiens; identical to SEQ ID NO: 268149

SEQ ID NO: 594133 - RNA, 64 nt, Homo Sapiens; identical to SEQ ID NO: 268150

SEQ ID NO: 594134 - RNA, 64 nt, Homo Sapiens; identical to SEQ ID NO: 268151

SEQ ID NO: 594135 - RNA, 64 nt, Homo Sapiens; identical to SEQ ID NO: 268152

SEQ ID NO: 594136 - RNA, 64 nt, Homo Sapiens; identical to SEQ ID NO: 268153

SEQ ID NO: 594137 - RNA, 64 nt, Homo Sapiens; identical to SEQ ID NO: 268154

SEQ ID NO: 594138 - RNA, 64 nt, Homo Sapiens; identical to SEQ ID NO: 268155

SEQ ID NO: 594139 - RNA, 64 nt, Homo Sapiens; identical to SEQ ID NO: 268156

SEQ ID NO: 594140 - RNA, 64 nt, Homo Sapiens; identical to SEQ ID NO: 268157

SEQ ID NO: 594141 - RNA, 64 nt, Homo Sapiens; identical to SEQ ID NO: 268158

SEQ ID NO: 594142 - RNA, 64 nt, Homo Sapiens; identical to SEQ ID NO: 268159

SEQ ID NO: 594143 - RNA, 64 nt, Homo Sapiens; identical to SEQ ID NO: 268160

SEQ ID NO: 594144 - RNA, 64 nt, Homo Sapiens; identical to SEQ ID NO: 268161

SEQ ID NO: 594145 - RNA, 64 nt, Homo Sapiens; identical to SEQ ID NO: 268162

SEQ ID NO: 594146 - RNA, 64 nt, Homo Sapiens; identical to SEQ ID NO: 268163

SEQ ID NO: 594147 - RNA, 64 nt, Homo Sapiens; identical to SEQ ID NO: 268164

SEQ ID NO: 594148 - RNA, 64 nt, Homo Sapiens; identical to SEQ ID NO: 268165

SEQ ID NO: 594149 - RNA, 64 nt, Homo Sapiens; identical to SEQ ID NO: 268166

SEQ ID NO: 594150 - RNA, 64 nt, Homo Sapiens; identical to SEQ ID NO: 268167

SEQ ID NO: 594151 - RNA, 64 nt, Homo Sapiens; identical to SEQ ID NO: 268168

SEQ ID NO: 594152 - RNA, 64 nt, Homo Sapiens; identical to SEQ ID NO: 268169

SEQ ID NO: 594153 - RNA, 64 nt, Homo Sapiens; identical to SEQ ID NO: 268170

SEQ ID NO: 594154 - RNA, 64 nt, Homo Sapiens; identical to SEQ ID NO: 268171

SEQ ID NO: 594155 - RNA, 64 nt, Homo Sapiens; identical to SEQ ID NO: 268172

SEQ ID NO: 594156 - RNA, 64 nt, Homo Sapiens; identical to SEQ ID NO: 268173

SEQ ID NO: 594157 - RNA, 64 nt, Homo Sapiens; identical to SEQ ID NO: 268174

SEQ ID NO: 594158 - RNA, 64 nt, Homo Sapiens; identical to SEQ ID NO: 268175

SEQ ID NO: 594159 - RNA, 64 nt, Homo Sapiens; identical to SEQ ID NO: 268176

SEQ ID NO: 594160 - RNA, 64 nt, Homo Sapiens; identical to SEQ ID NO: 268177

SEQ ID NO: 594161 - RNA, 64 nt, Homo Sapiens; identical to SEQ ID NO: 268178

SEQ ID NO: 594162 - RNA, 64 nt, Homo Sapiens; identical to SEQ ID NO: 268179

SEQ ID NO: 594163 - RNA, 64 nt, Homo Sapiens; identical to SEQ ID NO: 268180

SEQ ID NO: 594164 - RNA, 64 nt, Homo Sapiens; identical to SEQ ID NO: 268181

SEQ ID NO: 594165 - RNA, 64 nt, Homo Sapiens; identical to SEQ ID NO: 268182

SEQ ID NO: 594166 - RNA, 64 nt, Homo Sapiens; identical to SEQ ID NO: 268183

SEQ ID NO: 594167 - RNA, 64 nt, Homo Sapiens; identical to SEQ ID NO: 268184

SEQ ID NO: 594168 - RNA, 64 nt, Homo Sapiens; identical to SEQ ID NO: 268185

SEQ ID NO: 594169 - RNA, 64 nt, Homo Sapiens; identical to SEQ ID NO: 268186

SEQ ID NO: 594170 - RNA, 64 nt, Homo Sapiens; identical to SEQ ID NO: 268187

SEQ ID NO: 594171 - RNA, 64 nt, Homo Sapiens; identical to SEQ ID NO: 268188

SEQ ID NO: 594172 - RNA, 64 nt, Homo Sapiens; identical to SEQ ID NO: 268189

SEQ ID NO: 594173 - RNA, 64 nt, Homo Sapiens; identical to SEQ ID NO: 268190

SEQ ID NO: 594174 - RNA, 64 nt, Homo Sapiens; identical to SEQ ID NO: 268191

SEQ ID NO: 594175 - RNA, 64 nt, Homo Sapiens; identical to SEQ ID NO: 268192

SEQ ID NO: 594176 - RNA, 64 nt, Homo Sapiens; identical to SEQ ID NO: 268193

SEQ ID NO: 594177 - RNA, 64 nt, Homo Sapiens; identical to SEQ ID NO: 268194

SEQ ID NO: 594178 - RNA, 64 nt, Homo Sapiens; identical to SEQ ID NO: 268195

SEQ ID NO: 594179 - RNA, 64 nt, Homo Sapiens; identical to SEQ ID NO: 268196

SEQ ID NO: 594180 - RNA, 64 nt, Homo Sapiens; identical to SEQ ID NO: 268197

SEQ ID NO: 594181 - RNA, 64 nt, Homo Sapiens; identical to SEQ ID NO: 268198

SEQ ID NO: 594182 - RNA, 64 nt, Homo Sapiens; identical to SEQ ID NO: 268199

SEQ ID NO: 594183 - RNA, 64 nt, Homo Sapiens; identical to SEQ ID NO: 268200

SEQ ID NO: 594184 - RNA, 64 nt, Homo Sapiens; identical to SEQ ID NO: 268201

SEQ ID NO: 594185 - RNA, 64 nt, Homo Sapiens; identical to SEQ ID NO: 268202

SEQ ID NO: 594186 - RNA, 64 nt, Homo Sapiens; identical to SEQ ID NO: 268203

SEQ ID NO: 594187 - RNA, 64 nt, Homo Sapiens; identical to SEQ ID NO: 268204

SEQ ID NO: 594188 - RNA, 64 nt, Homo Sapiens; identical to SEQ ID NO: 268205

SEQ ID NO: 594189 - RNA, 64 nt, Homo Sapiens; identical to SEQ ID NO: 268206

SEQ ID NO: 594190 - RNA, 64 nt, Homo Sapiens; identical to SEQ ID NO: 268207

SEQ ID NO: 594191 - RNA, 64 nt, Homo Sapiens; identical to SEQ ID NO: 268208

SEQ ID NO: 594192 - RNA, 64 nt, Homo Sapiens; identical to SEQ ID NO: 268209

SEQ ID NO: 594193 - RNA, 64 nt, Homo Sapiens; identical to SEQ ID NO: 268210

SEQ ID NO: 594194 - RNA, 64 nt, Homo Sapiens; identical to SEQ ID NO: 268211

SEQ ID NO: 594195 - RNA, 64 nt, Homo Sapiens; identical to SEQ ID NO: 268212

SEQ ID NO: 594196 - RNA, 64 nt, Homo Sapiens; identical to SEQ ID NO: 268213

SEQ ID NO: 594197 - RNA, 64 nt, Homo Sapiens; identical to SEQ ID NO: 268214

SEQ ID NO: 594198 - RNA, 64 nt, Homo Sapiens; identical to SEQ ID NO: 268215

SEQ ID NO: 594199 - RNA, 64 nt, Homo Sapiens; identical to SEQ ID NO: 268216

SEQ ID NO: 594200 - RNA, 64 nt, Homo Sapiens; identical to SEQ ID NO: 268217

SEQ ID NO: 594201 - RNA, 64 nt, Homo Sapiens; identical to SEQ ID NO: 268218

SEQ ID NO: 594202 - RNA, 64 nt, Homo Sapiens; identical to SEQ ID NO: 268219

SEQ ID NO: 594203 - RNA, 64 nt, Homo Sapiens; identical to SEQ ID NO: 268220

SEQ ID NO: 594204 - RNA, 64 nt, Homo Sapiens; identical to SEQ ID NO: 268221

SEQ ID NO: 594205 - RNA, 64 nt, Homo Sapiens; identical to SEQ ID NO: 268222

SEQ ID NO: 594206 - RNA, 64 nt, Homo Sapiens; identical to SEQ ID NO: 268223

SEQ ID NO: 594207 - RNA, 64 nt, Homo Sapiens; identical to SEQ ID NO: 268224

SEQ ID NO: 594208 - RNA, 64 nt, Homo Sapiens; identical to SEQ ID NO: 268225

SEQ ID NO: 594209 - RNA, 64 nt, Homo Sapiens; identical to SEQ ID NO: 268226

SEQ ID NO: 594210 - RNA, 64 nt, Homo Sapiens; identical to SEQ ID NO: 268227

SEQ ID NO: 594211 - RNA, 64 nt, Homo Sapiens; identical to SEQ ID NO: 268228

SEQ ID NO: 594212 - RNA, 64 nt, Homo Sapiens; identical to SEQ ID NO: 268229

SEQ ID NO: 594213 - RNA, 64 nt, Homo Sapiens; identical to SEQ ID NO: 268230

SEQ ID NO: 594214 - RNA, 64 nt, Homo Sapiens; identical to SEQ ID NO: 268231

SEQ ID NO: 594215 - RNA, 64 nt, Homo Sapiens; identical to SEQ ID NO: 268232

SEQ ID NO: 594216 - RNA, 64 nt, Homo Sapiens; identical to SEQ ID NO: 268233

SEQ ID NO: 594217 - RNA, 64 nt, Homo Sapiens; identical to SEQ ID NO: 268234

SEQ ID NO: 594218 - RNA, 64 nt, Homo Sapiens; identical to SEQ ID NO: 268235

SEQ ID NO: 594219 - RNA, 64 nt, Homo Sapiens; identical to SEQ ID NO: 268236

SEQ ID NO: 594220 - RNA, 64 nt, Homo Sapiens; identical to SEQ ID NO: 268237

SEQ ID NO: 594221 - RNA, 64 nt, Homo Sapiens; identical to SEQ ID NO: 268238

SEQ ID NO: 594222 - RNA, 64 nt, Homo Sapiens; identical to SEQ ID NO: 268239

SEQ ID NO: 594223 - RNA, 64 nt, Homo Sapiens; identical to SEQ ID NO: 268240

SEQ ID NO: 594224 - RNA, 64 nt, Homo Sapiens; identical to SEQ ID NO: 268241

SEQ ID NO: 594225 - RNA, 64 nt, Homo Sapiens; identical to SEQ ID NO: 268242

SEQ ID NO: 594226 - RNA, 64 nt, Homo Sapiens; identical to SEQ ID NO: 268243

SEQ ID NO: 594227 - RNA, 64 nt, Homo Sapiens; identical to SEQ ID NO: 268244

SEQ ID NO: 594228 - RNA, 64 nt, Homo Sapiens; identical to SEQ ID NO: 268245

SEQ ID NO: 594229 - RNA, 64 nt, Homo Sapiens; identical to SEQ ID NO: 268246

SEQ ID NO: 594230 - RNA, 64 nt, Homo Sapiens; identical to SEQ ID NO: 268247

SEQ ID NO: 594231 - RNA, 64 nt, Homo Sapiens; identical to SEQ ID NO: 268248

SEQ ID NO: 594232 - RNA, 64 nt, Homo Sapiens; identical to SEQ ID NO: 268249

SEQ ID NO: 594233 - RNA, 64 nt, Homo Sapiens; identical to SEQ ID NO: 268250

SEQ ID NO: 594234 - RNA, 64 nt, Homo Sapiens; identical to SEQ ID NO: 268251

SEQ ID NO: 594235 - RNA, 64 nt, Homo Sapiens; identical to SEQ ID NO: 268252

SEQ ID NO: 594236 - RNA, 64 nt, Homo Sapiens; identical to SEQ ID NO: 268253

SEQ ID NO: 594237 - RNA, 64 nt, Homo Sapiens; identical to SEQ ID NO: 268254

SEQ ID NO: 594238 - RNA, 64 nt, Homo Sapiens; identical to SEQ ID NO: 268255

SEQ ID NO: 594239 - RNA, 64 nt, Homo Sapiens; identical to SEQ ID NO: 268256

SEQ ID NO: 594240 - RNA, 64 nt, Homo Sapiens; identical to SEQ ID NO: 268257

SEQ ID NO: 594241 - RNA, 64 nt, Homo Sapiens; identical to SEQ ID NO: 268258

SEQ ID NO: 594242 - RNA, 64 nt, Homo Sapiens; identical to SEQ ID NO: 268259

SEQ ID NO: 594243 - RNA, 64 nt, Homo Sapiens; identical to SEQ ID NO: 268260

SEQ ID NO: 594244 - RNA, 64 nt, Homo Sapiens; identical to SEQ ID NO: 268261

SEQ ID NO: 594245 - RNA, 64 nt, Homo Sapiens; identical to SEQ ID NO: 268262

SEQ ID NO: 594246 - RNA, 64 nt, Homo Sapiens; identical to SEQ ID NO: 268263

SEQ ID NO: 594247 - RNA, 64 nt, Homo Sapiens; identical to SEQ ID NO: 268264

SEQ ID NO: 594248 - RNA, 64 nt, Homo Sapiens; identical to SEQ ID NO: 268265

SEQ ID NO: 594249 - RNA, 64 nt, Homo Sapiens; identical to SEQ ID NO: 268266

SEQ ID NO: 594250 - RNA, 64 nt, Homo Sapiens; identical to SEQ ID NO: 268267

SEQ ID NO: 594251 - RNA, 64 nt, Homo Sapiens; identical to SEQ ID NO: 268268

SEQ ID NO: 594252 - RNA, 64 nt, Homo Sapiens; identical to SEQ ID NO: 268269

SEQ ID NO: 594253 - RNA, 64 nt, Homo Sapiens; identical to SEQ ID NO: 268270

SEQ ID NO: 594254 - RNA, 64 nt, Homo Sapiens; identical to SEQ ID NO: 268271

SEQ ID NO: 594255 - RNA, 64 nt, Homo Sapiens; identical to SEQ ID NO: 268272

SEQ ID NO: 594256 - RNA, 64 nt, Homo Sapiens; identical to SEQ ID NO: 268273

SEQ ID NO: 594257 - RNA, 64 nt, Homo Sapiens; identical to SEQ ID NO: 268274

SEQ ID NO: 594258 - RNA, 64 nt, Homo Sapiens; identical to SEQ ID NO: 268275

SEQ ID NO: 594259 - RNA, 64 nt, Homo Sapiens; identical to SEQ ID NO: 268276

SEQ ID NO: 594260 - RNA, 64 nt, Homo Sapiens; identical to SEQ ID NO: 268277

SEQ ID NO: 594261 - RNA, 64 nt, Homo Sapiens; identical to SEQ ID NO: 268278

SEQ ID NO: 594262 - RNA, 64 nt, Homo Sapiens; identical to SEQ ID NO: 268279

SEQ ID NO: 594263 - RNA, 64 nt, Homo Sapiens; identical to SEQ ID NO: 268280

SEQ ID NO: 594264 - RNA, 64 nt, Homo Sapiens; identical to SEQ ID NO: 268281

SEQ ID NO: 594265 - RNA, 64 nt, Homo Sapiens; identical to SEQ ID NO: 268282

SEQ ID NO: 594266 - RNA, 64 nt, Homo Sapiens; identical to SEQ ID NO: 268283

SEQ ID NO: 594267 - RNA, 64 nt, Homo Sapiens; identical to SEQ ID NO: 268284

SEQ ID NO: 594268 - RNA, 64 nt, Homo Sapiens; identical to SEQ ID NO: 268285

SEQ ID NO: 594269 - RNA, 64 nt, Homo Sapiens; identical to SEQ ID NO: 268286

SEQ ID NO: 594270 - RNA, 64 nt, Homo Sapiens; identical to SEQ ID NO: 268287

SEQ ID NO: 594271 - RNA, 64 nt, Homo Sapiens; identical to SEQ ID NO: 268288

SEQ ID NO: 594272 - RNA, 64 nt, Homo Sapiens; identical to SEQ ID NO: 268289

SEQ ID NO: 594273 - RNA, 64 nt, Homo Sapiens; identical to SEQ ID NO: 268290

SEQ ID NO: 594274 - RNA, 64 nt, Homo Sapiens; identical to SEQ ID NO: 268291

SEQ ID NO: 594275 - RNA, 64 nt, Homo Sapiens; identical to SEQ ID NO: 268292

SEQ ID NO: 594276 - RNA, 64 nt, Homo Sapiens; identical to SEQ ID NO: 268293

SEQ ID NO: 594277 - RNA, 64 nt, Homo Sapiens; identical to SEQ ID NO: 268294

SEQ ID NO: 594278 - RNA, 64 nt, Homo Sapiens; identical to SEQ ID NO: 268295

SEQ ID NO: 594279 - RNA, 64 nt, Homo Sapiens; identical to SEQ ID NO: 268296

SEQ ID NO: 594280 - RNA, 64 nt, Homo Sapiens; identical to SEQ ID NO: 268297

SEQ ID NO: 594281 - RNA, 64 nt, Homo Sapiens; identical to SEQ ID NO: 268298

SEQ ID NO: 594282 - RNA, 64 nt, Homo Sapiens; identical to SEQ ID NO: 268299

SEQ ID NO: 594283 - RNA, 64 nt, Homo Sapiens; identical to SEQ ID NO: 268300

SEQ ID NO: 594284 - RNA, 64 nt, Homo Sapiens; identical to SEQ ID NO: 268301

SEQ ID NO: 594285 - RNA, 64 nt, Homo Sapiens; identical to SEQ ID NO: 268302

SEQ ID NO: 594286 - RNA, 64 nt, Homo Sapiens; identical to SEQ ID NO: 268303

SEQ ID NO: 594287 - RNA, 64 nt, Homo Sapiens; identical to SEQ ID NO: 268304

SEQ ID NO: 594288 - RNA, 64 nt, Homo Sapiens; identical to SEQ ID NO: 268305

SEQ ID NO: 594289 - RNA, 64 nt, Homo Sapiens; identical to SEQ ID NO: 268306

SEQ ID NO: 594290 - RNA, 64 nt, Homo Sapiens; identical to SEQ ID NO: 268307

SEQ ID NO: 594291 - RNA, 64 nt, Homo Sapiens; identical to SEQ ID NO: 268308

SEQ ID NO: 594292 - RNA, 64 nt, Homo Sapiens; identical to SEQ ID NO: 268309

SEQ ID NO: 594293 - RNA, 64 nt, Homo Sapiens; identical to SEQ ID NO: 268310

SEQ ID NO: 594294 - RNA, 64 nt, Homo Sapiens; identical to SEQ ID NO: 268311

SEQ ID NO: 594295 - RNA, 64 nt, Homo Sapiens; identical to SEQ ID NO: 268312

SEQ ID NO: 594296 - RNA, 64 nt, Homo Sapiens; identical to SEQ ID NO: 268313

SEQ ID NO: 594297 - RNA, 64 nt, Homo Sapiens; identical to SEQ ID NO: 268314

SEQ ID NO: 594298 - RNA, 64 nt, Homo Sapiens; identical to SEQ ID NO: 268315

SEQ ID NO: 594299 - RNA, 64 nt, Homo Sapiens; identical to SEQ ID NO: 268316

SEQ ID NO: 594300 - RNA, 64 nt, Homo Sapiens; identical to SEQ ID NO: 268317

SEQ ID NO: 594301 - RNA, 64 nt, Homo Sapiens; identical to SEQ ID NO: 268318

SEQ ID NO: 594302 - RNA, 64 nt, Homo Sapiens; identical to SEQ ID NO: 268319

SEQ ID NO: 594303 - RNA, 64 nt, Homo Sapiens; identical to SEQ ID NO: 268320

SEQ ID NO: 594304 - RNA, 64 nt, Homo Sapiens; identical to SEQ ID NO: 268321

SEQ ID NO: 594305 - RNA, 64 nt, Homo Sapiens; identical to SEQ ID NO: 268322

SEQ ID NO: 594306 - RNA, 64 nt, Homo Sapiens; identical to SEQ ID NO: 268323

SEQ ID NO: 594307 - RNA, 64 nt, Homo Sapiens; identical to SEQ ID NO: 268324

SEQ ID NO: 594308 - RNA, 64 nt, Homo Sapiens; identical to SEQ ID NO: 268325

SEQ ID NO: 594309 - RNA, 64 nt, Homo Sapiens; identical to SEQ ID NO: 268326

SEQ ID NO: 594310 - RNA, 64 nt, Homo Sapiens; identical to SEQ ID NO: 268327

SEQ ID NO: 594311 - RNA, 64 nt, Homo Sapiens; identical to SEQ ID NO: 268328

SEQ ID NO: 594312 - RNA, 64 nt, Homo Sapiens; identical to SEQ ID NO: 268329

SEQ ID NO: 594313 - RNA, 64 nt, Homo Sapiens; identical to SEQ ID NO: 268330

SEQ ID NO: 594314 - RNA, 64 nt, Homo Sapiens; identical to SEQ ID NO: 268331

SEQ ID NO: 594315 - RNA, 64 nt, Homo Sapiens; identical to SEQ ID NO: 268332

SEQ ID NO: 594316 - RNA, 64 nt, Homo Sapiens; identical to SEQ ID NO: 268333

SEQ ID NO: 594317 - RNA, 64 nt, Homo Sapiens; identical to SEQ ID NO: 268334

SEQ ID NO: 594318 - RNA, 64 nt, Homo Sapiens; identical to SEQ ID NO: 268335

SEQ ID NO: 594319 - RNA, 64 nt, Homo Sapiens; identical to SEQ ID NO: 268336

SEQ ID NO: 594320 - RNA, 64 nt, Homo Sapiens; identical to SEQ ID NO: 268337

SEQ ID NO: 594321 - RNA, 64 nt, Homo Sapiens; identical to SEQ ID NO: 268338

SEQ ID NO: 594322 - RNA, 64 nt, Homo Sapiens; identical to SEQ ID NO: 268339

SEQ ID NO: 594323 - RNA, 64 nt, Homo Sapiens; identical to SEQ ID NO: 268340

SEQ ID NO: 594324 - RNA, 64 nt, Homo Sapiens; identical to SEQ ID NO: 268341

SEQ ID NO: 594325 - RNA, 64 nt, Homo Sapiens; identical to SEQ ID NO: 268342

SEQ ID NO: 594326 - RNA, 64 nt, Homo Sapiens; identical to SEQ ID NO: 268343

SEQ ID NO: 594327 - RNA, 64 nt, Homo Sapiens; identical to SEQ ID NO: 268344

SEQ ID NO: 594328 - RNA, 64 nt, Homo Sapiens; identical to SEQ ID NO: 268345

SEQ ID NO: 594329 - RNA, 64 nt, Homo Sapiens; identical to SEQ ID NO: 268346

SEQ ID NO: 594330 - RNA, 64 nt, Homo Sapiens; identical to SEQ ID NO: 268347

SEQ ID NO: 594331 - RNA, 64 nt, Homo Sapiens; identical to SEQ ID NO: 268348

SEQ ID NO: 594332 - RNA, 64 nt, Homo Sapiens; identical to SEQ ID NO: 268349

SEQ ID NO: 594333 - RNA, 64 nt, Homo Sapiens; identical to SEQ ID NO: 268350

SEQ ID NO: 594334 - RNA, 64 nt, Homo Sapiens; identical to SEQ ID NO: 268351

SEQ ID NO: 594335 - RNA, 64 nt, Homo Sapiens; identical to SEQ ID NO: 268352

SEQ ID NO: 594336 - RNA, 64 nt, Homo Sapiens; identical to SEQ ID NO: 268353

SEQ ID NO: 594337 - RNA, 64 nt, Homo Sapiens; identical to SEQ ID NO: 268354

SEQ ID NO: 594338 - RNA, 64 nt, Homo Sapiens; identical to SEQ ID NO: 268355

SEQ ID NO: 594339 - RNA, 64 nt, Homo Sapiens; identical to SEQ ID NO: 268356

SEQ ID NO: 594340 - RNA, 64 nt, Homo Sapiens; identical to SEQ ID NO: 268357

SEQ ID NO: 594341 - RNA, 64 nt, Homo Sapiens; identical to SEQ ID NO: 268358

SEQ ID NO: 594342 - RNA, 64 nt, Homo Sapiens; identical to SEQ ID NO: 268359

SEQ ID NO: 594343 - RNA, 64 nt, Homo Sapiens; identical to SEQ ID NO: 268360

SEQ ID NO: 594344 - RNA, 64 nt, Homo Sapiens; identical to SEQ ID NO: 268361

SEQ ID NO: 594345 - RNA, 64 nt, Homo Sapiens; identical to SEQ ID NO: 268362

SEQ ID NO: 594346 - RNA, 64 nt, Homo Sapiens; identical to SEQ ID NO: 268363

SEQ ID NO: 594347 - RNA, 64 nt, Homo Sapiens; identical to SEQ ID NO: 268364

SEQ ID NO: 594348 - RNA, 64 nt, Homo Sapiens; identical to SEQ ID NO: 268365

SEQ ID NO: 594349 - RNA, 64 nt, Homo Sapiens; identical to SEQ ID NO: 268366

SEQ ID NO: 594350 - RNA, 64 nt, Homo Sapiens; identical to SEQ ID NO: 268367

SEQ ID NO: 594351 - RNA, 64 nt, Homo Sapiens; identical to SEQ ID NO: 268368

SEQ ID NO: 594352 - RNA, 64 nt, Homo Sapiens; identical to SEQ ID NO: 268369

SEQ ID NO: 594353 - RNA, 64 nt, Homo Sapiens; identical to SEQ ID NO: 268370

SEQ ID NO: 594354 - RNA, 64 nt, Homo Sapiens; identical to SEQ ID NO: 268371

SEQ ID NO: 594355 - RNA, 64 nt, Homo Sapiens; identical to SEQ ID NO: 268372

SEQ ID NO: 594356 - RNA, 64 nt, Homo Sapiens; identical to SEQ ID NO: 268373

SEQ ID NO: 594357 - RNA, 64 nt, Homo Sapiens; identical to SEQ ID NO: 268374

SEQ ID NO: 594358 - RNA, 64 nt, Homo Sapiens; identical to SEQ ID NO: 268375

SEQ ID NO: 594359 - RNA, 64 nt, Homo Sapiens; identical to SEQ ID NO: 268376

SEQ ID NO: 594360 - RNA, 64 nt, Homo Sapiens; identical to SEQ ID NO: 268377

SEQ ID NO: 594361 - RNA, 64 nt, Homo Sapiens; identical to SEQ ID NO: 268378

SEQ ID NO: 594362 - RNA, 64 nt, Homo Sapiens; identical to SEQ ID NO: 268379

SEQ ID NO: 594363 - RNA, 64 nt, Homo Sapiens; identical to SEQ ID NO: 268380

SEQ ID NO: 594364 - RNA, 64 nt, Homo Sapiens; identical to SEQ ID NO: 268381

SEQ ID NO: 594365 - RNA, 64 nt, Homo Sapiens; identical to SEQ ID NO: 268382

SEQ ID NO: 594366 - RNA, 64 nt, Homo Sapiens; identical to SEQ ID NO: 268383

SEQ ID NO: 594367 - RNA, 64 nt, Homo Sapiens; identical to SEQ ID NO: 268384

SEQ ID NO: 594368 - RNA, 64 nt, Homo Sapiens; identical to SEQ ID NO: 268385

SEQ ID NO: 594369 - RNA, 64 nt, Homo Sapiens; identical to SEQ ID NO: 268386

SEQ ID NO: 594370 - RNA, 64 nt, Homo Sapiens; identical to SEQ ID NO: 268387

SEQ ID NO: 594371 - RNA, 64 nt, Homo Sapiens; identical to SEQ ID NO: 268388

SEQ ID NO: 594372 - RNA, 64 nt, Homo Sapiens; identical to SEQ ID NO: 268389

SEQ ID NO: 594373 - RNA, 64 nt, Homo Sapiens; identical to SEQ ID NO: 268390

SEQ ID NO: 594374 - RNA, 64 nt, Homo Sapiens; identical to SEQ ID NO: 268391

SEQ ID NO: 594375 - RNA, 64 nt, Homo Sapiens; identical to SEQ ID NO: 268392

SEQ ID NO: 594376 - RNA, 64 nt, Homo Sapiens; identical to SEQ ID NO: 268393

SEQ ID NO: 594377 - RNA, 64 nt, Homo Sapiens; identical to SEQ ID NO: 268394

SEQ ID NO: 594378 - RNA, 64 nt, Homo Sapiens; identical to SEQ ID NO: 268395

SEQ ID NO: 594379 - RNA, 64 nt, Homo Sapiens; identical to SEQ ID NO: 268396

SEQ ID NO: 594380 - RNA, 64 nt, Homo Sapiens; identical to SEQ ID NO: 268397

SEQ ID NO: 594381 - RNA, 64 nt, Homo Sapiens; identical to SEQ ID NO: 268398

SEQ ID NO: 594382 - RNA, 64 nt, Homo Sapiens; identical to SEQ ID NO: 268399

SEQ ID NO: 594383 - RNA, 64 nt, Homo Sapiens; identical to SEQ ID NO: 268400

SEQ ID NO: 594384 - RNA, 64 nt, Homo Sapiens; identical to SEQ ID NO: 268401

SEQ ID NO: 594385 - RNA, 64 nt, Homo Sapiens; identical to SEQ ID NO: 268402

SEQ ID NO: 594386 - RNA, 64 nt, Homo Sapiens; identical to SEQ ID NO: 268403

SEQ ID NO: 594387 - RNA, 64 nt, Homo Sapiens; identical to SEQ ID NO: 268404

SEQ ID NO: 594388 - RNA, 64 nt, Homo Sapiens; identical to SEQ ID NO: 268405

SEQ ID NO: 594389 - RNA, 64 nt, Homo Sapiens; identical to SEQ ID NO: 268406

SEQ ID NO: 594390 - RNA, 64 nt, Homo Sapiens; identical to SEQ ID NO: 268407

SEQ ID NO: 594391 - RNA, 64 nt, Homo Sapiens; identical to SEQ ID NO: 268408

SEQ ID NO: 594392 - RNA, 64 nt, Homo Sapiens; identical to SEQ ID NO: 268409

SEQ ID NO: 594393 - RNA, 64 nt, Homo Sapiens; identical to SEQ ID NO: 268410

SEQ ID NO: 594394 - RNA, 64 nt, Homo Sapiens; identical to SEQ ID NO: 268411

SEQ ID NO: 594395 - RNA, 64 nt, Homo Sapiens; identical to SEQ ID NO: 268412

SEQ ID NO: 594396 - RNA, 64 nt, Homo Sapiens; identical to SEQ ID NO: 268413

SEQ ID NO: 594397 - RNA, 64 nt, Homo Sapiens; identical to SEQ ID NO: 268414

SEQ ID NO: 594398 - RNA, 64 nt, Homo Sapiens; identical to SEQ ID NO: 268415

SEQ ID NO: 594399 - RNA, 64 nt, Homo Sapiens; identical to SEQ ID NO: 268416

SEQ ID NO: 594400 - RNA, 64 nt, Homo Sapiens; identical to SEQ ID NO: 268417

SEQ ID NO: 594401 - RNA, 64 nt, Homo Sapiens; identical to SEQ ID NO: 268418

SEQ ID NO: 594402 - RNA, 64 nt, Homo Sapiens; identical to SEQ ID NO: 268419

SEQ ID NO: 594403 - RNA, 64 nt, Homo Sapiens; identical to SEQ ID NO: 268420

SEQ ID NO: 594404 - RNA, 64 nt, Homo Sapiens; identical to SEQ ID NO: 268421

SEQ ID NO: 594405 - RNA, 64 nt, Homo Sapiens; identical to SEQ ID NO: 268422

SEQ ID NO: 594406 - RNA, 64 nt, Homo Sapiens; identical to SEQ ID NO: 268423

SEQ ID NO: 594407 - RNA, 64 nt, Homo Sapiens; identical to SEQ ID NO: 268424

SEQ ID NO: 594408 - RNA, 64 nt, Homo Sapiens; identical to SEQ ID NO: 268425

SEQ ID NO: 594409 - RNA, 64 nt, Homo Sapiens; identical to SEQ ID NO: 268426

SEQ ID NO: 594410 - RNA, 64 nt, Homo Sapiens; identical to SEQ ID NO: 268427

SEQ ID NO: 594411 - RNA, 64 nt, Homo Sapiens; identical to SEQ ID NO: 268428

SEQ ID NO: 594412 - RNA, 64 nt, Homo Sapiens; identical to SEQ ID NO: 268429

SEQ ID NO: 594413 - RNA, 64 nt, Homo Sapiens; identical to SEQ ID NO: 268430

SEQ ID NO: 594414 - RNA, 64 nt, Homo Sapiens; identical to SEQ ID NO: 268431

SEQ ID NO: 594415 - RNA, 64 nt, Homo Sapiens; identical to SEQ ID NO: 268432

SEQ ID NO: 594416 - RNA, 64 nt, Homo Sapiens; identical to SEQ ID NO: 268433

SEQ ID NO: 594417 - RNA, 64 nt, Homo Sapiens; identical to SEQ ID NO: 268434

SEQ ID NO: 594418 - RNA, 64 nt, Homo Sapiens; identical to SEQ ID NO: 268435

SEQ ID NO: 594419 - RNA, 64 nt, Homo Sapiens; identical to SEQ ID NO: 268436

SEQ ID NO: 594420 - RNA, 64 nt, Homo Sapiens; identical to SEQ ID NO: 268437

SEQ ID NO: 594421 - RNA, 64 nt, Homo Sapiens; identical to SEQ ID NO: 268438

SEQ ID NO: 594422 - RNA, 64 nt, Homo Sapiens; identical to SEQ ID NO: 268439

SEQ ID NO: 594423 - RNA, 64 nt, Homo Sapiens; identical to SEQ ID NO: 268440

SEQ ID NO: 594424 - RNA, 64 nt, Homo Sapiens; identical to SEQ ID NO: 268441

SEQ ID NO: 594425 - RNA, 64 nt, Homo Sapiens; identical to SEQ ID NO: 268442

SEQ ID NO: 594426 - RNA, 64 nt, Homo Sapiens; identical to SEQ ID NO: 268443

SEQ ID NO: 594427 - RNA, 64 nt, Homo Sapiens; identical to SEQ ID NO: 268444

SEQ ID NO: 594428 - RNA, 64 nt, Homo Sapiens; identical to SEQ ID NO: 268445

SEQ ID NO: 594429 - RNA, 64 nt, Homo Sapiens; identical to SEQ ID NO: 268446

SEQ ID NO: 594430 - RNA, 64 nt, Homo Sapiens; identical to SEQ ID NO: 268447

SEQ ID NO: 594431 - RNA, 64 nt, Homo Sapiens; identical to SEQ ID NO: 268448

SEQ ID NO: 594432 - RNA, 64 nt, Homo Sapiens; identical to SEQ ID NO: 268449

SEQ ID NO: 594433 - RNA, 64 nt, Homo Sapiens; identical to SEQ ID NO: 268450

SEQ ID NO: 594434 - RNA, 64 nt, Homo Sapiens; identical to SEQ ID NO: 268451

SEQ ID NO: 594435 - RNA, 64 nt, Homo Sapiens; identical to SEQ ID NO: 268452

SEQ ID NO: 594436 - RNA, 64 nt, Homo Sapiens; identical to SEQ ID NO: 268453

SEQ ID NO: 594437 - RNA, 64 nt, Homo Sapiens; identical to SEQ ID NO: 268454

SEQ ID NO: 594438 - RNA, 64 nt, Homo Sapiens; identical to SEQ ID NO: 268455

SEQ ID NO: 594439 - RNA, 64 nt, Homo Sapiens; identical to SEQ ID NO: 268456

SEQ ID NO: 594440 - RNA, 64 nt, Homo Sapiens; identical to SEQ ID NO: 268457

SEQ ID NO: 594441 - RNA, 64 nt, Homo Sapiens; identical to SEQ ID NO: 268458

SEQ ID NO: 594442 - RNA, 64 nt, Homo Sapiens; identical to SEQ ID NO: 268459

SEQ ID NO: 594443 - RNA, 64 nt, Homo Sapiens; identical to SEQ ID NO: 268460

SEQ ID NO: 594444 - RNA, 64 nt, Homo Sapiens; identical to SEQ ID NO: 268461

SEQ ID NO: 594445 - RNA, 64 nt, Homo Sapiens; identical to SEQ ID NO: 268462

SEQ ID NO: 594446 - RNA, 64 nt, Homo Sapiens; identical to SEQ ID NO: 268463

SEQ ID NO: 594447 - RNA, 64 nt, Homo Sapiens; identical to SEQ ID NO: 268464

SEQ ID NO: 594448 - RNA, 64 nt, Homo Sapiens; identical to SEQ ID NO: 268465

SEQ ID NO: 594449 - RNA, 64 nt, Homo Sapiens; identical to SEQ ID NO: 268466

SEQ ID NO: 594450 - RNA, 64 nt, Homo Sapiens; identical to SEQ ID NO: 268467

SEQ ID NO: 594451 - RNA, 64 nt, Homo Sapiens; identical to SEQ ID NO: 268468

SEQ ID NO: 594452 - RNA, 64 nt, Homo Sapiens; identical to SEQ ID NO: 268469

SEQ ID NO: 594453 - RNA, 64 nt, Homo Sapiens; identical to SEQ ID NO: 268470

SEQ ID NO: 594454 - RNA, 64 nt, Homo Sapiens; identical to SEQ ID NO: 268471

SEQ ID NO: 594455 - RNA, 64 nt, Homo Sapiens; identical to SEQ ID NO: 268472

SEQ ID NO: 594456 - RNA, 64 nt, Homo Sapiens; identical to SEQ ID NO: 268473

SEQ ID NO: 594457 - RNA, 64 nt, Homo Sapiens; identical to SEQ ID NO: 268474

SEQ ID NO: 594458 - RNA, 64 nt, Homo Sapiens; identical to SEQ ID NO: 268475

SEQ ID NO: 594459 - RNA, 64 nt, Homo Sapiens; identical to SEQ ID NO: 268476

SEQ ID NO: 594460 - RNA, 64 nt, Homo Sapiens; identical to SEQ ID NO: 268477

SEQ ID NO: 594461 - RNA, 64 nt, Homo Sapiens; identical to SEQ ID NO: 268478

SEQ ID NO: 594462 - RNA, 64 nt, Homo Sapiens; identical to SEQ ID NO: 268479

SEQ ID NO: 594463 - RNA, 64 nt, Homo Sapiens; identical to SEQ ID NO: 268480

SEQ ID NO: 594464 - RNA, 64 nt, Homo Sapiens; identical to SEQ ID NO: 268481

SEQ ID NO: 594465 - RNA, 64 nt, Homo Sapiens; identical to SEQ ID NO: 268482

SEQ ID NO: 594466 - RNA, 64 nt, Homo Sapiens; identical to SEQ ID NO: 268483

SEQ ID NO: 594467 - RNA, 64 nt, Homo Sapiens; identical to SEQ ID NO: 268484

SEQ ID NO: 594468 - RNA, 64 nt, Homo Sapiens; identical to SEQ ID NO: 268485

SEQ ID NO: 594469 - RNA, 64 nt, Homo Sapiens; identical to SEQ ID NO: 268486

SEQ ID NO: 594470 - RNA, 64 nt, Homo Sapiens; identical to SEQ ID NO: 268487

SEQ ID NO: 594471 - RNA, 64 nt, Homo Sapiens; identical to SEQ ID NO: 268488

SEQ ID NO: 594472 - RNA, 64 nt, Homo Sapiens; identical to SEQ ID NO: 268489

SEQ ID NO: 594473 - RNA, 64 nt, Homo Sapiens; identical to SEQ ID NO: 268490

SEQ ID NO: 594474 - RNA, 64 nt, Homo Sapiens; identical to SEQ ID NO: 268491

SEQ ID NO: 594475 - RNA, 64 nt, Homo Sapiens; identical to SEQ ID NO: 268492

SEQ ID NO: 594476 - RNA, 64 nt, Homo Sapiens; identical to SEQ ID NO: 268493

SEQ ID NO: 594477 - RNA, 64 nt, Homo Sapiens; identical to SEQ ID NO: 268494

SEQ ID NO: 594478 - RNA, 64 nt, Homo Sapiens; identical to SEQ ID NO: 268495

SEQ ID NO: 594479 - RNA, 64 nt, Homo Sapiens; identical to SEQ ID NO: 268496

SEQ ID NO: 594480 - RNA, 64 nt, Homo Sapiens; identical to SEQ ID NO: 268497

SEQ ID NO: 594481 - RNA, 64 nt, Homo Sapiens; identical to SEQ ID NO: 268498

SEQ ID NO: 594482 - RNA, 64 nt, Homo Sapiens; identical to SEQ ID NO: 268499

SEQ ID NO: 594483 - RNA, 64 nt, Homo Sapiens; identical to SEQ ID NO: 268500

SEQ ID NO: 594484 - RNA, 64 nt, Homo Sapiens; identical to SEQ ID NO: 268501

SEQ ID NO: 594485 - RNA, 64 nt, Homo Sapiens; identical to SEQ ID NO: 268502

SEQ ID NO: 594486 - RNA, 64 nt, Homo Sapiens; identical to SEQ ID NO: 268503

SEQ ID NO: 594487 - RNA, 64 nt, Homo Sapiens; identical to SEQ ID NO: 268504

SEQ ID NO: 594488 - RNA, 64 nt, Homo Sapiens; identical to SEQ ID NO: 268505

SEQ ID NO: 594489 - RNA, 64 nt, Homo Sapiens; identical to SEQ ID NO: 268506

SEQ ID NO: 594490 - RNA, 64 nt, Homo Sapiens; identical to SEQ ID NO: 268507

SEQ ID NO: 594491 - RNA, 64 nt, Homo Sapiens; identical to SEQ ID NO: 268508

SEQ ID NO: 594492 - RNA, 64 nt, Homo Sapiens; identical to SEQ ID NO: 268509

SEQ ID NO: 594493 - RNA, 64 nt, Homo Sapiens; identical to SEQ ID NO: 268510

SEQ ID NO: 594494 - RNA, 64 nt, Homo Sapiens; identical to SEQ ID NO: 268511

SEQ ID NO: 594495 - RNA, 64 nt, Homo Sapiens; identical to SEQ ID NO: 268512

SEQ ID NO: 594496 - RNA, 64 nt, Homo Sapiens; identical to SEQ ID NO: 268513

SEQ ID NO: 594497 - RNA, 64 nt, Homo Sapiens; identical to SEQ ID NO: 268514

SEQ ID NO: 594498 - RNA, 64 nt, Homo Sapiens; identical to SEQ ID NO: 268515

SEQ ID NO: 594499 - RNA, 54 nt, Homo Sapiens; identical to SEQ ID NO: 268516

SEQ ID NO: 594500 - RNA, 64 nt, Homo Sapiens; identical to SEQ ID NO: 268517

SEQ ID NO: 594501 - RNA, 64 nt, Homo Sapiens; identical to SEQ ID NO: 268518

SEQ ID NO: 594502 - RNA, 64 nt, Homo Sapiens; identical to SEQ ID NO: 268519

SEQ ID NO: 594503 - RNA, 64 nt, Homo Sapiens; identical to SEQ ID NO: 268520

SEQ ID NO: 594504 - RNA, 64 nt, Homo Sapiens; identical to SEQ ID NO: 268521

SEQ ID NO: 594505 - RNA, 64 nt, Homo Sapiens; identical to SEQ ID NO: 268522

SEQ ID NO: 594506 - RNA, 64 nt, Homo Sapiens; identical to SEQ ID NO: 268523

SEQ ID NO: 594507 - RNA, 64 nt, Homo Sapiens; identical to SEQ ID NO: 268524

SEQ ID NO: 594508 - RNA, 64 nt, Homo Sapiens; identical to SEQ ID NO: 268525

SEQ ID NO: 594509 - RNA, 64 nt, Homo Sapiens; identical to SEQ ID NO: 268526

SEQ ID NO: 594510 - RNA, 64 nt, Homo Sapiens; identical to SEQ ID NO: 268527

SEQ ID NO: 594511 - RNA, 64 nt, Homo Sapiens; identical to SEQ ID NO: 268528

SEQ ID NO: 594512 - RNA, 64 nt, Homo Sapiens; identical to SEQ ID NO: 268529

SEQ ID NO: 594513 - RNA, 64 nt, Homo Sapiens; identical to SEQ ID NO: 268530

SEQ ID NO: 594514 - RNA, 64 nt, Homo Sapiens; identical to SEQ ID NO: 268531

SEQ ID NO: 594515 - RNA, 57 nt, Homo Sapiens; identical to SEQ ID NO: 268532

SEQ ID NO: 594516 - RNA, 64 nt, Homo Sapiens; identical to SEQ ID NO: 268533

SEQ ID NO: 594517 - RNA, 64 nt, Homo Sapiens; identical to SEQ ID NO: 268534

SEQ ID NO: 594518 - RNA, 64 nt, Homo Sapiens; identical to SEQ ID NO: 268535

SEQ ID NO: 594519 - RNA, 64 nt, Homo Sapiens; identical to SEQ ID NO: 268536

SEQ ID NO: 594520 - RNA, 64 nt, Homo Sapiens; identical to SEQ ID NO: 268537

SEQ ID NO: 594521 - RNA, 64 nt, Homo Sapiens; identical to SEQ ID NO: 268538

SEQ ID NO: 594522 - RNA, 64 nt, Homo Sapiens; identical to SEQ ID NO: 268539

SEQ ID NO: 594523 - RNA, 64 nt, Homo Sapiens; identical to SEQ ID NO: 268540

SEQ ID NO: 594524 - RNA, 64 nt, Homo Sapiens; identical to SEQ ID NO: 268541

SEQ ID NO: 594525 - RNA, 64 nt, Homo Sapiens; identical to SEQ ID NO: 268542

SEQ ID NO: 594526 - RNA, 64 nt, Homo Sapiens; identical to SEQ ID NO: 268543

SEQ ID NO: 594527 - RNA, 64 nt, Homo Sapiens; identical to SEQ ID NO: 268544

SEQ ID NO: 594528 - RNA, 64 nt, Homo Sapiens; identical to SEQ ID NO: 268545

SEQ ID NO: 594529 - RNA, 64 nt, Homo Sapiens; identical to SEQ ID NO: 268546

SEQ ID NO: 594530 - RNA, 64 nt, Homo Sapiens; identical to SEQ ID NO: 268547

SEQ ID NO: 594531 - RNA, 64 nt, Homo Sapiens; identical to SEQ ID NO: 268548

SEQ ID NO: 594532 - RNA, 64 nt, Homo Sapiens; identical to SEQ ID NO: 268549

SEQ ID NO: 594533 - RNA, 64 nt, Homo Sapiens; identical to SEQ ID NO: 268550

SEQ ID NO: 594534 - RNA, 64 nt, Homo Sapiens; identical to SEQ ID NO: 268551

SEQ ID NO: 594535 - RNA, 64 nt, Homo Sapiens; identical to SEQ ID NO: 268552

SEQ ID NO: 594536 - RNA, 64 nt, Homo Sapiens; identical to SEQ ID NO: 268553

SEQ ID NO: 594537 - RNA, 64 nt, Homo Sapiens; identical to SEQ ID NO: 268554

SEQ ID NO: 594538 - RNA, 64 nt, Homo Sapiens; identical to SEQ ID NO: 268555

SEQ ID NO: 594539 - RNA, 64 nt, Homo Sapiens; identical to SEQ ID NO: 268556

SEQ ID NO: 594540 - RNA, 64 nt, Homo Sapiens; identical to SEQ ID NO: 268557

SEQ ID NO: 594541 - RNA, 64 nt, Homo Sapiens; identical to SEQ ID NO: 268558

SEQ ID NO: 594542 - RNA, 64 nt, Homo Sapiens; identical to SEQ ID NO: 268559

SEQ ID NO: 594543 - RNA, 64 nt, Homo Sapiens; identical to SEQ ID NO: 268560

SEQ ID NO: 594544 - RNA, 64 nt, Homo Sapiens; identical to SEQ ID NO: 268561

SEQ ID NO: 594545 - RNA, 64 nt, Homo Sapiens; identical to SEQ ID NO: 268562

SEQ ID NO: 594546 - RNA, 64 nt, Homo Sapiens; identical to SEQ ID NO: 268563

SEQ ID NO: 594547 - RNA, 64 nt, Homo Sapiens; identical to SEQ ID NO: 268564

SEQ ID NO: 594548 - RNA, 64 nt, Homo Sapiens; identical to SEQ ID NO: 268565

SEQ ID NO: 594549 - RNA, 64 nt, Homo Sapiens; identical to SEQ ID NO: 268566

SEQ ID NO: 594550 - RNA, 64 nt, Homo Sapiens; identical to SEQ ID NO: 268567

SEQ ID NO: 594551 - RNA, 64 nt, Homo Sapiens; identical to SEQ ID NO: 268568

SEQ ID NO: 594552 - RNA, 64 nt, Homo Sapiens; identical to SEQ ID NO: 268569

SEQ ID NO: 594553 - RNA, 64 nt, Homo Sapiens; identical to SEQ ID NO: 268570

SEQ ID NO: 594554 - RNA, 64 nt, Homo Sapiens; identical to SEQ ID NO: 268571

SEQ ID NO: 594555 - RNA, 64 nt, Homo Sapiens; identical to SEQ ID NO: 268572

SEQ ID NO: 594556 - RNA, 64 nt, Homo Sapiens; identical to SEQ ID NO: 268573

SEQ ID NO: 594557 - RNA, 64 nt, Homo Sapiens; identical to SEQ ID NO: 268574

SEQ ID NO: 594558 - RNA, 64 nt, Homo Sapiens; identical to SEQ ID NO: 268575

SEQ ID NO: 594559 - RNA, 64 nt, Homo Sapiens; identical to SEQ ID NO: 268576

SEQ ID NO: 594560 - RNA, 64 nt, Homo Sapiens; identical to SEQ ID NO: 268577

SEQ ID NO: 594561 - RNA, 64 nt, Homo Sapiens; identical to SEQ ID NO: 268578

SEQ ID NO: 594562 - RNA, 64 nt, Homo Sapiens; identical to SEQ ID NO: 268579

SEQ ID NO: 594563 - RNA, 64 nt, Homo Sapiens; identical to SEQ ID NO: 268580

SEQ ID NO: 594564 - RNA, 64 nt, Homo Sapiens; identical to SEQ ID NO: 268581

SEQ ID NO: 594565 - RNA, 64 nt, Homo Sapiens; identical to SEQ ID NO: 268582

SEQ ID NO: 594566 - RNA, 64 nt, Homo Sapiens; identical to SEQ ID NO: 268583

SEQ ID NO: 594567 - RNA, 64 nt, Homo Sapiens; identical to SEQ ID NO: 268584

SEQ ID NO: 594568 - RNA, 64 nt, Homo Sapiens; identical to SEQ ID NO: 268585

SEQ ID NO: 594569 - RNA, 64 nt, Homo Sapiens; identical to SEQ ID NO: 268586

SEQ ID NO: 594570 - RNA, 64 nt, Homo Sapiens; identical to SEQ ID NO: 268587

SEQ ID NO: 594571 - RNA, 64 nt, Homo Sapiens; identical to SEQ ID NO: 268588

SEQ ID NO: 594572 - RNA, 64 nt, Homo Sapiens; identical to SEQ ID NO: 268589

SEQ ID NO: 594573 - RNA, 64 nt, Homo Sapiens; identical to SEQ ID NO: 268590

SEQ ID NO: 594574 - RNA, 64 nt, Homo Sapiens; identical to SEQ ID NO: 268591

SEQ ID NO: 594575 - RNA, 64 nt, Homo Sapiens; identical to SEQ ID NO: 268592

SEQ ID NO: 594576 - RNA, 64 nt, Homo Sapiens; identical to SEQ ID NO: 268593

SEQ ID NO: 594577 - RNA, 64 nt, Homo Sapiens; identical to SEQ ID NO: 268594

SEQ ID NO: 594578 - RNA, 64 nt, Homo Sapiens; identical to SEQ ID NO: 268595

SEQ ID NO: 594579 - RNA, 64 nt, Homo Sapiens; identical to SEQ ID NO: 268596

SEQ ID NO: 594580 - RNA, 64 nt, Homo Sapiens; identical to SEQ ID NO: 268597

SEQ ID NO: 594581 - RNA, 64 nt, Homo Sapiens; identical to SEQ ID NO: 268598

SEQ ID NO: 594582 - RNA, 64 nt, Homo Sapiens; identical to SEQ ID NO: 268599

SEQ ID NO: 594583 - RNA, 64 nt, Homo Sapiens; identical to SEQ ID NO: 268600

SEQ ID NO: 594584 - RNA, 64 nt, Homo Sapiens; identical to SEQ ID NO: 268601

SEQ ID NO: 594585 - RNA, 64 nt, Homo Sapiens; identical to SEQ ID NO: 268602

SEQ ID NO: 594586 - RNA, 64 nt, Homo Sapiens; identical to SEQ ID NO: 268603

SEQ ID NO: 594587 - RNA, 64 nt, Homo Sapiens; identical to SEQ ID NO: 268604

SEQ ID NO: 594588 - RNA, 64 nt, Homo Sapiens; identical to SEQ ID NO: 268605

SEQ ID NO: 594589 - RNA, 64 nt, Homo Sapiens; identical to SEQ ID NO: 268606

SEQ ID NO: 594590 - RNA, 64 nt, Homo Sapiens; identical to SEQ ID NO: 268607

SEQ ID NO: 594591 - RNA, 64 nt, Homo Sapiens; identical to SEQ ID NO: 268608

SEQ ID NO: 594592 - RNA, 64 nt, Homo Sapiens; identical to SEQ ID NO: 268609

SEQ ID NO: 594593 - RNA, 64 nt, Homo Sapiens; identical to SEQ ID NO: 268610

SEQ ID NO: 594594 - RNA, 64 nt, Homo Sapiens; identical to SEQ ID NO: 268611

SEQ ID NO: 594595 - RNA, 64 nt, Homo Sapiens; identical to SEQ ID NO: 268612

SEQ ID NO: 594596 - RNA, 64 nt, Homo Sapiens; identical to SEQ ID NO: 268613

SEQ ID NO: 594597 - RNA, 64 nt, Homo Sapiens; identical to SEQ ID NO: 268614

SEQ ID NO: 594598 - RNA, 64 nt, Homo Sapiens; identical to SEQ ID NO: 268615

SEQ ID NO: 594599 - RNA, 64 nt, Homo Sapiens; identical to SEQ ID NO: 268616

SEQ ID NO: 594600 - RNA, 64 nt, Homo Sapiens; identical to SEQ ID NO: 268617

SEQ ID NO: 594601 - RNA, 64 nt, Homo Sapiens; identical to SEQ ID NO: 268618

SEQ ID NO: 594602 - RNA, 64 nt, Homo Sapiens; identical to SEQ ID NO: 268619

SEQ ID NO: 594603 - RNA, 64 nt, Homo Sapiens; identical to SEQ ID NO: 268620

SEQ ID NO: 594604 - RNA, 64 nt, Homo Sapiens; identical to SEQ ID NO: 268621

SEQ ID NO: 594605 - RNA, 64 nt, Homo Sapiens; identical to SEQ ID NO: 268622

SEQ ID NO: 594606 - RNA, 64 nt, Homo Sapiens; identical to SEQ ID NO: 268623

SEQ ID NO: 594607 - RNA, 64 nt, Homo Sapiens; identical to SEQ ID NO: 268624

SEQ ID NO: 594608 - RNA, 64 nt, Homo Sapiens; identical to SEQ ID NO: 268625

SEQ ID NO: 594609 - RNA, 64 nt, Homo Sapiens; identical to SEQ ID NO: 268626

SEQ ID NO: 594610 - RNA, 64 nt, Homo Sapiens; identical to SEQ ID NO: 268627

SEQ ID NO: 594611 - RNA, 64 nt, Homo Sapiens; identical to SEQ ID NO: 268628

SEQ ID NO: 594612 - RNA, 64 nt, Homo Sapiens; identical to SEQ ID NO: 268629

SEQ ID NO: 594613 - RNA, 64 nt, Homo Sapiens; identical to SEQ ID NO: 268630

SEQ ID NO: 594614 - RNA, 64 nt, Homo Sapiens; identical to SEQ ID NO: 268631

SEQ ID NO: 594615 - RNA, 64 nt, Homo Sapiens; identical to SEQ ID NO: 268632

SEQ ID NO: 594616 - RNA, 64 nt, Homo Sapiens; identical to SEQ ID NO: 268633

SEQ ID NO: 594617 - RNA, 64 nt, Homo Sapiens; identical to SEQ ID NO: 268634

SEQ ID NO: 594618 - RNA, 64 nt, Homo Sapiens; identical to SEQ ID NO: 268635

SEQ ID NO: 594619 - RNA, 64 nt, Homo Sapiens; identical to SEQ ID NO: 268636

SEQ ID NO: 594620 - RNA, 64 nt, Homo Sapiens; identical to SEQ ID NO: 268637

SEQ ID NO: 594621 - RNA, 64 nt, Homo Sapiens; identical to SEQ ID NO: 268638

SEQ ID NO: 594622 - RNA, 64 nt, Homo Sapiens; identical to SEQ ID NO: 268639

SEQ ID NO: 594623 - RNA, 64 nt, Homo Sapiens; identical to SEQ ID NO: 268640

SEQ ID NO: 594624 - RNA, 64 nt, Homo Sapiens; identical to SEQ ID NO: 268641

SEQ ID NO: 594625 - RNA, 64 nt, Homo Sapiens; identical to SEQ ID NO: 268642

SEQ ID NO: 594626 - RNA, 64 nt, Homo Sapiens; identical to SEQ ID NO: 268643

SEQ ID NO: 594627 - RNA, 64 nt, Homo Sapiens; identical to SEQ ID NO: 268644

SEQ ID NO: 594628 - RNA, 64 nt, Homo Sapiens; identical to SEQ ID NO: 268645

SEQ ID NO: 594629 - RNA, 64 nt, Homo Sapiens; identical to SEQ ID NO: 268646

SEQ ID NO: 594630 - RNA, 64 nt, Homo Sapiens; identical to SEQ ID NO: 268647

SEQ ID NO: 594631 - RNA, 64 nt, Homo Sapiens; identical to SEQ ID NO: 268648

SEQ ID NO: 594632 - RNA, 64 nt, Homo Sapiens; identical to SEQ ID NO: 268649

SEQ ID NO: 594633 - RNA, 64 nt, Homo Sapiens; identical to SEQ ID NO: 268650

SEQ ID NO: 594634 - RNA, 64 nt, Homo Sapiens; identical to SEQ ID NO: 268651

SEQ ID NO: 594635 - RNA, 64 nt, Homo Sapiens; identical to SEQ ID NO: 268652

SEQ ID NO: 594636 - RNA, 64 nt, Homo Sapiens; identical to SEQ ID NO: 268653

SEQ ID NO: 594637 - RNA, 64 nt, Homo Sapiens; identical to SEQ ID NO: 268654

SEQ ID NO: 594638 - RNA, 64 nt, Homo Sapiens; identical to SEQ ID NO: 268655

SEQ ID NO: 594639 - RNA, 64 nt, Homo Sapiens; identical to SEQ ID NO: 268656

SEQ ID NO: 594640 - RNA, 64 nt, Homo Sapiens; identical to SEQ ID NO: 268657

SEQ ID NO: 594641 - RNA, 64 nt, Homo Sapiens; identical to SEQ ID NO: 268658

SEQ ID NO: 594642 - RNA, 64 nt, Homo Sapiens; identical to SEQ ID NO: 268659

SEQ ID NO: 594643 - RNA, 64 nt, Homo Sapiens; identical to SEQ ID NO: 268660

SEQ ID NO: 594644 - RNA, 64 nt, Homo Sapiens; identical to SEQ ID NO: 268661

SEQ ID NO: 594645 - RNA, 64 nt, Homo Sapiens; identical to SEQ ID NO: 268662

SEQ ID NO: 594646 - RNA, 64 nt, Homo Sapiens; identical to SEQ ID NO: 268663

SEQ ID NO: 594647 - RNA, 64 nt, Homo Sapiens; identical to SEQ ID NO: 268664

SEQ ID NO: 594648 - RNA, 64 nt, Homo Sapiens; identical to SEQ ID NO: 268665

SEQ ID NO: 594649 - RNA, 64 nt, Homo Sapiens; identical to SEQ ID NO: 268666

SEQ ID NO: 594650 - RNA, 64 nt, Homo Sapiens; identical to SEQ ID NO: 268667

SEQ ID NO: 594651 - RNA, 64 nt, Homo Sapiens; identical to SEQ ID NO: 268668

SEQ ID NO: 594652 - RNA, 64 nt, Homo Sapiens; identical to SEQ ID NO: 268669

SEQ ID NO: 594653 - RNA, 64 nt, Homo Sapiens; identical to SEQ ID NO: 268670

SEQ ID NO: 594654 - RNA, 64 nt, Homo Sapiens; identical to SEQ ID NO: 268671

SEQ ID NO: 594655 - RNA, 64 nt, Homo Sapiens; identical to SEQ ID NO: 268672

SEQ ID NO: 594656 - RNA, 64 nt, Homo Sapiens; identical to SEQ ID NO: 268673

SEQ ID NO: 594657 - RNA, 64 nt, Homo Sapiens; identical to SEQ ID NO: 268674

SEQ ID NO: 594658 - RNA, 64 nt, Homo Sapiens; identical to SEQ ID NO: 268675

SEQ ID NO: 594659 - RNA, 64 nt, Homo Sapiens; identical to SEQ ID NO: 268676

SEQ ID NO: 594660 - RNA, 64 nt, Homo Sapiens; identical to SEQ ID NO: 268677

SEQ ID NO: 594661 - RNA, 64 nt, Homo Sapiens; identical to SEQ ID NO: 268678

SEQ ID NO: 594662 - RNA, 64 nt, Homo Sapiens; identical to SEQ ID NO: 268679

SEQ ID NO: 594663 - RNA, 64 nt, Homo Sapiens; identical to SEQ ID NO: 268680

SEQ ID NO: 594664 - RNA, 64 nt, Homo Sapiens; identical to SEQ ID NO: 268681

SEQ ID NO: 594665 - RNA, 64 nt, Homo Sapiens; identical to SEQ ID NO: 268682

SEQ ID NO: 594666 - RNA, 64 nt, Homo Sapiens; identical to SEQ ID NO: 268683

SEQ ID NO: 594667 - RNA, 64 nt, Homo Sapiens; identical to SEQ ID NO: 268684

SEQ ID NO: 594668 - RNA, 64 nt, Homo Sapiens; identical to SEQ ID NO: 268685

SEQ ID NO: 594669 - RNA, 64 nt, Homo Sapiens; identical to SEQ ID NO: 268686

SEQ ID NO: 594670 - RNA, 64 nt, Homo Sapiens; identical to SEQ ID NO: 268687

SEQ ID NO: 594671 - RNA, 64 nt, Homo Sapiens; identical to SEQ ID NO: 268688

SEQ ID NO: 594672 - RNA, 64 nt, Homo Sapiens; identical to SEQ ID NO: 268689

SEQ ID NO: 594673 - RNA, 64 nt, Homo Sapiens; identical to SEQ ID NO: 268690

SEQ ID NO: 594674 - RNA, 64 nt, Homo Sapiens; identical to SEQ ID NO: 268691

SEQ ID NO: 594675 - RNA, 64 nt, Homo Sapiens; identical to SEQ ID NO: 268692

SEQ ID NO: 594676 - RNA, 64 nt, Homo Sapiens; identical to SEQ ID NO: 268693

SEQ ID NO: 594677 - RNA, 64 nt, Homo Sapiens; identical to SEQ ID NO: 268694

SEQ ID NO: 594678 - RNA, 64 nt, Homo Sapiens; identical to SEQ ID NO: 268695

SEQ ID NO: 594679 - RNA, 64 nt, Homo Sapiens; identical to SEQ ID NO: 268696

SEQ ID NO: 594680 - RNA, 64 nt, Homo Sapiens; identical to SEQ ID NO: 268697

SEQ ID NO: 594681 - RNA, 64 nt, Homo Sapiens; identical to SEQ ID NO: 268698

SEQ ID NO: 594682 - RNA, 64 nt, Homo Sapiens; identical to SEQ ID NO: 268699

SEQ ID NO: 594683 - RNA, 64 nt, Homo Sapiens; identical to SEQ ID NO: 268700

SEQ ID NO: 594684 - RNA, 64 nt, Homo Sapiens; identical to SEQ ID NO: 268701

SEQ ID NO: 594685 - RNA, 64 nt, Homo Sapiens; identical to SEQ ID NO: 268702

SEQ ID NO: 594686 - RNA, 64 nt, Homo Sapiens; identical to SEQ ID NO: 268703

SEQ ID NO: 594687 - RNA, 64 nt, Homo Sapiens; identical to SEQ ID NO: 268704

SEQ ID NO: 594688 - RNA, 64 nt, Homo Sapiens; identical to SEQ ID NO: 268705

SEQ ID NO: 594689 - RNA, 64 nt, Homo Sapiens; identical to SEQ ID NO: 268706

SEQ ID NO: 594690 - RNA, 64 nt, Homo Sapiens; identical to SEQ ID NO: 268707

SEQ ID NO: 594691 - RNA, 64 nt, Homo Sapiens; identical to SEQ ID NO: 268708

SEQ ID NO: 594692 - RNA, 64 nt, Homo Sapiens; identical to SEQ ID NO: 268709

SEQ ID NO: 594693 - RNA, 64 nt, Homo Sapiens; identical to SEQ ID NO: 268710

SEQ ID NO: 594694 - RNA, 64 nt, Homo Sapiens; identical to SEQ ID NO: 268711

SEQ ID NO: 594695 - RNA, 64 nt, Homo Sapiens; identical to SEQ ID NO: 268712

SEQ ID NO: 594696 - RNA, 64 nt, Homo Sapiens; identical to SEQ ID NO: 268713

SEQ ID NO: 594697 - RNA, 64 nt, Homo Sapiens; identical to SEQ ID NO: 268714

SEQ ID NO: 594698 - RNA, 64 nt, Homo Sapiens; identical to SEQ ID NO: 268715

SEQ ID NO: 594699 - RNA, 64 nt, Homo Sapiens; identical to SEQ ID NO: 268716

SEQ ID NO: 594700 - RNA, 64 nt, Homo Sapiens; identical to SEQ ID NO: 268717

SEQ ID NO: 594701 - RNA, 64 nt, Homo Sapiens; identical to SEQ ID NO: 268718

SEQ ID NO: 594702 - RNA, 64 nt, Homo Sapiens; identical to SEQ ID NO: 268719

SEQ ID NO: 594703 - RNA, 64 nt, Homo Sapiens; identical to SEQ ID NO: 268720

SEQ ID NO: 594704 - RNA, 64 nt, Homo Sapiens; identical to SEQ ID NO: 268721

SEQ ID NO: 594705 - RNA, 64 nt, Homo Sapiens; identical to SEQ ID NO: 268722

SEQ ID NO: 594706 - RNA, 64 nt, Homo Sapiens; identical to SEQ ID NO: 268723

SEQ ID NO: 594707 - RNA, 64 nt, Homo Sapiens; identical to SEQ ID NO: 268724

SEQ ID NO: 594708 - RNA, 64 nt, Homo Sapiens; identical to SEQ ID NO: 268725

SEQ ID NO: 594709 - RNA, 64 nt, Homo Sapiens; identical to SEQ ID NO: 268726

SEQ ID NO: 594710 - RNA, 64 nt, Homo Sapiens; identical to SEQ ID NO: 268727

SEQ ID NO: 594711 - RNA, 64 nt, Homo Sapiens; identical to SEQ ID NO: 268728

SEQ ID NO: 594712 - RNA, 64 nt, Homo Sapiens; identical to SEQ ID NO: 268729

SEQ ID NO: 594713 - RNA, 64 nt, Homo Sapiens; identical to SEQ ID NO: 268730

SEQ ID NO: 594714 - RNA, 64 nt, Homo Sapiens; identical to SEQ ID NO: 268731

SEQ ID NO: 594715 - RNA, 64 nt, Homo Sapiens; identical to SEQ ID NO: 268732

SEQ ID NO: 594716 - RNA, 64 nt, Homo Sapiens; identical to SEQ ID NO: 268733

SEQ ID NO: 594717 - RNA, 64 nt, Homo Sapiens; identical to SEQ ID NO: 268734

SEQ ID NO: 594718 - RNA, 64 nt, Homo Sapiens; identical to SEQ ID NO: 268735

SEQ ID NO: 594719 - RNA, 64 nt, Homo Sapiens; identical to SEQ ID NO: 268736

SEQ ID NO: 594720 - RNA, 64 nt, Homo Sapiens; identical to SEQ ID NO: 268737

SEQ ID NO: 594721 - RNA, 64 nt, Homo Sapiens; identical to SEQ ID NO: 268738

SEQ ID NO: 594722 - RNA, 64 nt, Homo Sapiens; identical to SEQ ID NO: 268739

SEQ ID NO: 594723 - RNA, 64 nt, Homo Sapiens; identical to SEQ ID NO: 268740

SEQ ID NO: 594724 - RNA, 64 nt, Homo Sapiens; identical to SEQ ID NO: 268741

SEQ ID NO: 594725 - RNA, 64 nt, Homo Sapiens; identical to SEQ ID NO: 268742

SEQ ID NO: 594726 - RNA, 64 nt, Homo Sapiens; identical to SEQ ID NO: 268743

SEQ ID NO: 594727 - RNA, 64 nt, Homo Sapiens; identical to SEQ ID NO: 268744

SEQ ID NO: 594728 - RNA, 64 nt, Homo Sapiens; identical to SEQ ID NO: 268745

SEQ ID NO: 594729 - RNA, 64 nt, Homo Sapiens; identical to SEQ ID NO: 268746

SEQ ID NO: 594730 - RNA, 64 nt, Homo Sapiens; identical to SEQ ID NO: 268747

SEQ ID NO: 594731 - RNA, 64 nt, Homo Sapiens; identical to SEQ ID NO: 268748

SEQ ID NO: 594732 - RNA, 64 nt, Homo Sapiens; identical to SEQ ID NO: 268749

SEQ ID NO: 594733 - RNA, 64 nt, Homo Sapiens; identical to SEQ ID NO: 268750

SEQ ID NO: 594734 - RNA, 64 nt, Homo Sapiens; identical to SEQ ID NO: 268751

SEQ ID NO: 594735 - RNA, 64 nt, Homo Sapiens; identical to SEQ ID NO: 268752

SEQ ID NO: 594736 - RNA, 64 nt, Homo Sapiens; identical to SEQ ID NO: 268753

SEQ ID NO: 594737 - RNA, 64 nt, Homo Sapiens; identical to SEQ ID NO: 268754

SEQ ID NO: 594738 - RNA, 64 nt, Homo Sapiens; identical to SEQ ID NO: 268755

SEQ ID NO: 594739 - RNA, 64 nt, Homo Sapiens; identical to SEQ ID NO: 268756

SEQ ID NO: 594740 - RNA, 64 nt, Homo Sapiens; identical to SEQ ID NO: 268757

SEQ ID NO: 594741 - RNA, 64 nt, Homo Sapiens; identical to SEQ ID NO: 268758

SEQ ID NO: 594742 - RNA, 64 nt, Homo Sapiens; identical to SEQ ID NO: 268759

SEQ ID NO: 594743 - RNA, 64 nt, Homo Sapiens; identical to SEQ ID NO: 268760

SEQ ID NO: 594744 - RNA, 64 nt, Homo Sapiens; identical to SEQ ID NO: 268761

SEQ ID NO: 594745 - RNA, 64 nt, Homo Sapiens; identical to SEQ ID NO: 268762

SEQ ID NO: 594746 - RNA, 64 nt, Homo Sapiens; identical to SEQ ID NO: 268763

SEQ ID NO: 594747 - RNA, 64 nt, Homo Sapiens; identical to SEQ ID NO: 268764

SEQ ID NO: 594748 - RNA, 64 nt, Homo Sapiens; identical to SEQ ID NO: 268765

SEQ ID NO: 594749 - RNA, 64 nt, Homo Sapiens; identical to SEQ ID NO: 268766

SEQ ID NO: 594750 - RNA, 64 nt, Homo Sapiens; identical to SEQ ID NO: 268767

SEQ ID NO: 594751 - RNA, 64 nt, Homo Sapiens; identical to SEQ ID NO: 268768

SEQ ID NO: 594752 - RNA, 64 nt, Homo Sapiens; identical to SEQ ID NO: 268769

SEQ ID NO: 594753 - RNA, 64 nt, Homo Sapiens; identical to SEQ ID NO: 268770

SEQ ID NO: 594754 - RNA, 64 nt, Homo Sapiens; identical to SEQ ID NO: 268771

SEQ ID NO: 594755 - RNA, 64 nt, Homo Sapiens; identical to SEQ ID NO: 268772

SEQ ID NO: 594756 - RNA, 64 nt, Homo Sapiens; identical to SEQ ID NO: 268773

SEQ ID NO: 594757 - RNA, 64 nt, Homo Sapiens; identical to SEQ ID NO: 268774

SEQ ID NO: 594758 - RNA, 64 nt, Homo Sapiens; identical to SEQ ID NO: 268775

SEQ ID NO: 594759 - RNA, 64 nt, Homo Sapiens; identical to SEQ ID NO: 268776

SEQ ID NO: 594760 - RNA, 64 nt, Homo Sapiens; identical to SEQ ID NO: 268777

SEQ ID NO: 594761 - RNA, 64 nt, Homo Sapiens; identical to SEQ ID NO: 268778

SEQ ID NO: 594762 - RNA, 64 nt, Homo Sapiens; identical to SEQ ID NO: 268779

SEQ ID NO: 594763 - RNA, 64 nt, Homo Sapiens; identical to SEQ ID NO: 268780

SEQ ID NO: 594764 - RNA, 64 nt, Homo Sapiens; identical to SEQ ID NO: 268781

SEQ ID NO: 594765 - RNA, 64 nt, Homo Sapiens; identical to SEQ ID NO: 268782

SEQ ID NO: 594766 - RNA, 64 nt, Homo Sapiens; identical to SEQ ID NO: 268783

SEQ ID NO: 594767 - RNA, 64 nt, Homo Sapiens; identical to SEQ ID NO: 268784

SEQ ID NO: 594768 - RNA, 64 nt, Homo Sapiens; identical to SEQ ID NO: 268785

SEQ ID NO: 594769 - RNA, 64 nt, Homo Sapiens; identical to SEQ ID NO: 268786

SEQ ID NO: 594770 - RNA, 64 nt, Homo Sapiens; identical to SEQ ID NO: 268787

SEQ ID NO: 594771 - RNA, 64 nt, Homo Sapiens; identical to SEQ ID NO: 268788

SEQ ID NO: 594772 - RNA, 64 nt, Homo Sapiens; identical to SEQ ID NO: 268789

SEQ ID NO: 594773 - RNA, 64 nt, Homo Sapiens; identical to SEQ ID NO: 268790

SEQ ID NO: 594774 - RNA, 64 nt, Homo Sapiens; identical to SEQ ID NO: 268791

SEQ ID NO: 594775 - RNA, 64 nt, Homo Sapiens; identical to SEQ ID NO: 268792

SEQ ID NO: 594776 - RNA, 64 nt, Homo Sapiens; identical to SEQ ID NO: 268793

SEQ ID NO: 594777 - RNA, 64 nt, Homo Sapiens; identical to SEQ ID NO: 268794

SEQ ID NO: 594778 - RNA, 64 nt, Homo Sapiens; identical to SEQ ID NO: 268795

SEQ ID NO: 594779 - RNA, 64 nt, Homo Sapiens; identical to SEQ ID NO: 268796

SEQ ID NO: 594780 - RNA, 64 nt, Homo Sapiens; identical to SEQ ID NO: 268797

SEQ ID NO: 594781 - RNA, 64 nt, Homo Sapiens; identical to SEQ ID NO: 268798

SEQ ID NO: 594782 - RNA, 64 nt, Homo Sapiens; identical to SEQ ID NO: 268799

SEQ ID NO: 594783 - RNA, 64 nt, Homo Sapiens; identical to SEQ ID NO: 268800

SEQ ID NO: 594784 - RNA, 64 nt, Homo Sapiens; identical to SEQ ID NO: 268801

SEQ ID NO: 594785 - RNA, 64 nt, Homo Sapiens; identical to SEQ ID NO: 268802

SEQ ID NO: 594786 - RNA, 64 nt, Homo Sapiens; identical to SEQ ID NO: 268803

SEQ ID NO: 594787 - RNA, 64 nt, Homo Sapiens; identical to SEQ ID NO: 268804

SEQ ID NO: 594788 - RNA, 64 nt, Homo Sapiens; identical to SEQ ID NO: 268805

SEQ ID NO: 594789 - RNA, 64 nt, Homo Sapiens; identical to SEQ ID NO: 268806

SEQ ID NO: 594790 - RNA, 64 nt, Homo Sapiens; identical to SEQ ID NO: 268807

SEQ ID NO: 594791 - RNA, 64 nt, Homo Sapiens; identical to SEQ ID NO: 268808

SEQ ID NO: 594792 - RNA, 64 nt, Homo Sapiens; identical to SEQ ID NO: 268809

SEQ ID NO: 594793 - RNA, 64 nt, Homo Sapiens; identical to SEQ ID NO: 268810

SEQ ID NO: 594794 - RNA, 64 nt, Homo Sapiens; identical to SEQ ID NO: 268811

SEQ ID NO: 594795 - RNA, 64 nt, Homo Sapiens; identical to SEQ ID NO: 268812

SEQ ID NO: 594796 - RNA, 64 nt, Homo Sapiens; identical to SEQ ID NO: 268813

SEQ ID NO: 594797 - RNA, 64 nt, Homo Sapiens; identical to SEQ ID NO: 268814

SEQ ID NO: 594798 - RNA, 64 nt, Homo Sapiens; identical to SEQ ID NO: 268815

SEQ ID NO: 594799 - RNA, 64 nt, Homo Sapiens; identical to SEQ ID NO: 268816

SEQ ID NO: 594800 - RNA, 64 nt, Homo Sapiens; identical to SEQ ID NO: 268817

SEQ ID NO: 594801 - RNA, 64 nt, Homo Sapiens; identical to SEQ ID NO: 268818

SEQ ID NO: 594802 - RNA, 64 nt, Homo Sapiens; identical to SEQ ID NO: 268819

SEQ ID NO: 594803 - RNA, 64 nt, Homo Sapiens; identical to SEQ ID NO: 268820

SEQ ID NO: 594804 - RNA, 64 nt, Homo Sapiens; identical to SEQ ID NO: 268821

SEQ ID NO: 594805 - RNA, 64 nt, Homo Sapiens; identical to SEQ ID NO: 268822

SEQ ID NO: 594806 - RNA, 64 nt, Homo Sapiens; identical to SEQ ID NO: 268823

SEQ ID NO: 594807 - RNA, 64 nt, Homo Sapiens; identical to SEQ ID NO: 268824

SEQ ID NO: 594808 - RNA, 64 nt, Homo Sapiens; identical to SEQ ID NO: 268825

SEQ ID NO: 594809 - RNA, 64 nt, Homo Sapiens; identical to SEQ ID NO: 268826

SEQ ID NO: 594810 - RNA, 64 nt, Homo Sapiens; identical to SEQ ID NO: 268827

SEQ ID NO: 594811 - RNA, 64 nt, Homo Sapiens; identical to SEQ ID NO: 268828

SEQ ID NO: 594812 - RNA, 64 nt, Homo Sapiens; identical to SEQ ID NO: 268829

SEQ ID NO: 594813 - RNA, 64 nt, Homo Sapiens; identical to SEQ ID NO: 268830

SEQ ID NO: 594814 - RNA, 64 nt, Homo Sapiens; identical to SEQ ID NO: 268831

SEQ ID NO: 594815 - RNA, 64 nt, Homo Sapiens; identical to SEQ ID NO: 268832

SEQ ID NO: 594816 - RNA, 64 nt, Homo Sapiens; identical to SEQ ID NO: 268833

SEQ ID NO: 594817 - RNA, 64 nt, Homo Sapiens; identical to SEQ ID NO: 268834

SEQ ID NO: 594818 - RNA, 64 nt, Homo Sapiens; identical to SEQ ID NO: 268835

SEQ ID NO: 594819 - RNA, 64 nt, Homo Sapiens; identical to SEQ ID NO: 268836

SEQ ID NO: 594820 - RNA, 64 nt, Homo Sapiens; identical to SEQ ID NO: 268837

SEQ ID NO: 594821 - RNA, 64 nt, Homo Sapiens; identical to SEQ ID NO: 268838

SEQ ID NO: 594822 - RNA, 64 nt, Homo Sapiens; identical to SEQ ID NO: 268839

SEQ ID NO: 594823 - RNA, 64 nt, Homo Sapiens; identical to SEQ ID NO: 268840

SEQ ID NO: 594824 - RNA, 64 nt, Homo Sapiens; identical to SEQ ID NO: 268841

SEQ ID NO: 594825 - RNA, 64 nt, Homo Sapiens; identical to SEQ ID NO: 268842

SEQ ID NO: 594826 - RNA, 64 nt, Homo Sapiens; identical to SEQ ID NO: 268843

SEQ ID NO: 594827 - RNA, 64 nt, Homo Sapiens; identical to SEQ ID NO: 268844

SEQ ID NO: 594828 - RNA, 64 nt, Homo Sapiens; identical to SEQ ID NO: 268845

SEQ ID NO: 594829 - RNA, 64 nt, Homo Sapiens; identical to SEQ ID NO: 268846

SEQ ID NO: 594830 - RNA, 64 nt, Homo Sapiens; identical to SEQ ID NO: 268847

SEQ ID NO: 594831 - RNA, 64 nt, Homo Sapiens; identical to SEQ ID NO: 268848

SEQ ID NO: 594832 - RNA, 64 nt, Homo Sapiens; identical to SEQ ID NO: 268849

SEQ ID NO: 594833 - RNA, 64 nt, Homo Sapiens; identical to SEQ ID NO: 268457

SEQ ID NO: 594834 - RNA, 64 nt, Homo Sapiens; identical to SEQ ID NO: 268458

SEQ ID NO: 594835 - RNA, 64 nt, Homo Sapiens; identical to SEQ ID NO: 268852

SEQ ID NO: 594836 - RNA, 64 nt, Homo Sapiens; identical to SEQ ID NO: 268853

SEQ ID NO: 594837 - RNA, 64 nt, Homo Sapiens; identical to SEQ ID NO: 268854

SEQ ID NO: 594838 - RNA, 64 nt, Homo Sapiens; identical to SEQ ID NO: 268855

SEQ ID NO: 594839 - RNA, 64 nt, Homo Sapiens; identical to SEQ ID NO: 268856

SEQ ID NO: 594840 - RNA, 64 nt, Homo Sapiens; identical to SEQ ID NO: 268857

SEQ ID NO: 594841 - RNA, 64 nt, Homo Sapiens; identical to SEQ ID NO: 268858

SEQ ID NO: 594842 - RNA, 64 nt, Homo Sapiens; identical to SEQ ID NO: 268859

SEQ ID NO: 594843 - RNA, 64 nt, Homo Sapiens; identical to SEQ ID NO: 268860

SEQ ID NO: 594844 - RNA, 64 nt, Homo Sapiens; identical to SEQ ID NO: 268861

SEQ ID NO: 594845 - RNA, 64 nt, Homo Sapiens; identical to SEQ ID NO: 268862

SEQ ID NO: 594846 - RNA, 64 nt, Homo Sapiens; identical to SEQ ID NO: 268863

SEQ ID NO: 594847 - RNA, 64 nt, Homo Sapiens; identical to SEQ ID NO: 268864

SEQ ID NO: 594848 - RNA, 64 nt, Homo Sapiens; identical to SEQ ID NO: 268865

SEQ ID NO: 594849 - RNA, 64 nt, Homo Sapiens; identical to SEQ ID NO: 268866

SEQ ID NO: 594850 - RNA, 64 nt, Homo Sapiens; identical to SEQ ID NO: 268867

SEQ ID NO: 594851 - RNA, 64 nt, Homo Sapiens; identical to SEQ ID NO: 268868

SEQ ID NO: 594852 - RNA, 64 nt, Homo Sapiens; identical to SEQ ID NO: 268869

SEQ ID NO: 594853 - RNA, 64 nt, Homo Sapiens; identical to SEQ ID NO: 268870

SEQ ID NO: 594854 - RNA, 64 nt, Homo Sapiens; identical to SEQ ID NO: 268871

SEQ ID NO: 594855 - RNA, 64 nt, Homo Sapiens; identical to SEQ ID NO: 268872

SEQ ID NO: 594856 - RNA, 64 nt, Homo Sapiens; identical to SEQ ID NO: 268873

SEQ ID NO: 594857 - RNA, 64 nt, Homo Sapiens; identical to SEQ ID NO: 268874

SEQ ID NO: 594858 - RNA, 64 nt, Homo Sapiens; identical to SEQ ID NO: 268875

SEQ ID NO: 594859 - RNA, 64 nt, Homo Sapiens; identical to SEQ ID NO: 268876

SEQ ID NO: 594860 - RNA, 64 nt, Homo Sapiens; identical to SEQ ID NO: 268877

SEQ ID NO: 594861 - RNA, 64 nt, Homo Sapiens; identical to SEQ ID NO: 268878

SEQ ID NO: 594862 - RNA, 64 nt, Homo Sapiens; identical to SEQ ID NO: 268879

SEQ ID NO: 594863 - RNA, 64 nt, Homo Sapiens; identical to SEQ ID NO: 268880

SEQ ID NO: 594864 - RNA, 64 nt, Homo Sapiens; identical to SEQ ID NO: 268881

SEQ ID NO: 594865 - RNA, 64 nt, Homo Sapiens; identical to SEQ ID NO: 268882

SEQ ID NO: 594866 - RNA, 64 nt, Homo Sapiens; identical to SEQ ID NO: 268883

SEQ ID NO: 594867 - RNA, 64 nt, Homo Sapiens; identical to SEQ ID NO: 268884

SEQ ID NO: 594868 - RNA, 64 nt, Homo Sapiens; identical to SEQ ID NO: 268885

SEQ ID NO: 594869 - RNA, 64 nt, Homo Sapiens; identical to SEQ ID NO: 268886

SEQ ID NO: 594870 - RNA, 64 nt, Homo Sapiens; identical to SEQ ID NO: 268887

SEQ ID NO: 594871 - RNA, 64 nt, Homo Sapiens; identical to SEQ ID NO: 268888

SEQ ID NO: 594872 - RNA, 64 nt, Homo Sapiens; identical to SEQ ID NO: 268889

SEQ ID NO: 594873 - RNA, 64 nt, Homo Sapiens; identical to SEQ ID NO: 268890

SEQ ID NO: 594874 - RNA, 64 nt, Homo Sapiens; identical to SEQ ID NO: 268891

SEQ ID NO: 594875 - RNA, 64 nt, Homo Sapiens; identical to SEQ ID NO: 268892

SEQ ID NO: 594876 - RNA, 64 nt, Homo Sapiens; identical to SEQ ID NO: 268893

SEQ ID NO: 594877 - RNA, 64 nt, Homo Sapiens; identical to SEQ ID NO: 268894

SEQ ID NO: 594878 - RNA, 64 nt, Homo Sapiens; identical to SEQ ID NO: 268895

SEQ ID NO: 594879 - RNA, 64 nt, Homo Sapiens; identical to SEQ ID NO: 268896

SEQ ID NO: 594880 - RNA, 64 nt, Homo Sapiens; identical to SEQ ID NO: 268897

SEQ ID NO: 594881 - RNA, 64 nt, Homo Sapiens; identical to SEQ ID NO: 268898

SEQ ID NO: 594882 - RNA, 64 nt, Homo Sapiens; identical to SEQ ID NO: 268899

SEQ ID NO: 594883 - RNA, 64 nt, Homo Sapiens; identical to SEQ ID NO: 268900

SEQ ID NO: 594884 - RNA, 64 nt, Homo Sapiens; identical to SEQ ID NO: 268901

SEQ ID NO: 594885 - RNA, 64 nt, Homo Sapiens; identical to SEQ ID NO: 268902

SEQ ID NO: 594886 - RNA, 64 nt, Homo Sapiens; identical to SEQ ID NO: 268903

SEQ ID NO: 594887 - RNA, 64 nt, Homo Sapiens; identical to SEQ ID NO: 268904

SEQ ID NO: 594888 - RNA, 64 nt, Homo Sapiens; identical to SEQ ID NO: 268905

SEQ ID NO: 594889 - RNA, 64 nt, Homo Sapiens; identical to SEQ ID NO: 268906

SEQ ID NO: 594890 - RNA, 64 nt, Homo Sapiens; identical to SEQ ID NO: 268907

SEQ ID NO: 594891 - RNA, 64 nt, Homo Sapiens; identical to SEQ ID NO: 268908

SEQ ID NO: 594892 - RNA, 64 nt, Homo Sapiens; identical to SEQ ID NO: 268909

SEQ ID NO: 594893 - RNA, 64 nt, Homo Sapiens; identical to SEQ ID NO: 268910

SEQ ID NO: 594894 - RNA, 64 nt, Homo Sapiens; identical to SEQ ID NO: 268911

SEQ ID NO: 594895 - RNA, 64 nt, Homo Sapiens; identical to SEQ ID NO: 268912

SEQ ID NO: 594896 - RNA, 64 nt, Homo Sapiens; identical to SEQ ID NO: 268913

SEQ ID NO: 594897 - RNA, 64 nt, Homo Sapiens; identical to SEQ ID NO: 268914

SEQ ID NO: 594898 - RNA, 64 nt, Homo Sapiens; identical to SEQ ID NO: 268915

SEQ ID NO: 594899 - RNA, 64 nt, Homo Sapiens; identical to SEQ ID NO: 268916

SEQ ID NO: 594900 - RNA, 64 nt, Homo Sapiens; identical to SEQ ID NO: 268917

SEQ ID NO: 594901 - RNA, 64 nt, Homo Sapiens; identical to SEQ ID NO: 268918

SEQ ID NO: 594902 - RNA, 64 nt, Homo Sapiens; identical to SEQ ID NO: 268919

SEQ ID NO: 594903 - RNA, 64 nt, Homo Sapiens; identical to SEQ ID NO: 268920

SEQ ID NO: 594904 - RNA, 64 nt, Homo Sapiens; identical to SEQ ID NO: 268921

SEQ ID NO: 594905 - RNA, 64 nt, Homo Sapiens; identical to SEQ ID NO: 268922

SEQ ID NO: 594906 - RNA, 64 nt, Homo Sapiens; identical to SEQ ID NO: 268923

SEQ ID NO: 594907 - RNA, 64 nt, Homo Sapiens; identical to SEQ ID NO: 268924

SEQ ID NO: 594908 - RNA, 64 nt, Homo Sapiens; identical to SEQ ID NO: 268925

SEQ ID NO: 594909 - RNA, 64 nt, Homo Sapiens; identical to SEQ ID NO: 268926

SEQ ID NO: 594910 - RNA, 64 nt, Homo Sapiens; identical to SEQ ID NO: 268927

SEQ ID NO: 594911 - RNA, 64 nt, Homo Sapiens; identical to SEQ ID NO: 268928

SEQ ID NO: 594912 - RNA, 64 nt, Homo Sapiens; identical to SEQ ID NO: 268929

SEQ ID NO: 594913 - RNA, 64 nt, Homo Sapiens; identical to SEQ ID NO: 268930

SEQ ID NO: 594914 - RNA, 64 nt, Homo Sapiens; identical to SEQ ID NO: 268931

SEQ ID NO: 594915 - RNA, 64 nt, Homo Sapiens; identical to SEQ ID NO: 268932

SEQ ID NO: 594916 - RNA, 64 nt, Homo Sapiens; identical to SEQ ID NO: 268933

SEQ ID NO: 594917 - RNA, 64 nt, Homo Sapiens; identical to SEQ ID NO: 268934

SEQ ID NO: 594918 - RNA, 64 nt, Homo Sapiens; identical to SEQ ID NO: 268935

SEQ ID NO: 594919 - RNA, 64 nt, Homo Sapiens; identical to SEQ ID NO: 268936

SEQ ID NO: 594920 - RNA, 64 nt, Homo Sapiens; identical to SEQ ID NO: 268937

SEQ ID NO: 594921 - RNA, 64 nt, Homo Sapiens; identical to SEQ ID NO: 268938

SEQ ID NO: 594922 - RNA, 64 nt, Homo Sapiens; identical to SEQ ID NO: 268939

SEQ ID NO: 594923 - RNA, 64 nt, Homo Sapiens; identical to SEQ ID NO: 268940

SEQ ID NO: 594924 - RNA, 64 nt, Homo Sapiens; identical to SEQ ID NO: 268941

SEQ ID NO: 594925 - RNA, 64 nt, Homo Sapiens; identical to SEQ ID NO: 268942

SEQ ID NO: 594926 - RNA, 64 nt, Homo Sapiens; identical to SEQ ID NO: 268943

SEQ ID NO: 594927 - RNA, 64 nt, Homo Sapiens; identical to SEQ ID NO: 268944

SEQ ID NO: 594928 - RNA, 64 nt, Homo Sapiens; identical to SEQ ID NO: 268945

SEQ ID NO: 594929 - RNA, 64 nt, Homo Sapiens; identical to SEQ ID NO: 268946

SEQ ID NO: 594930 - RNA, 64 nt, Homo Sapiens; identical to SEQ ID NO: 268947

SEQ ID NO: 594931 - RNA, 64 nt, Homo Sapiens; identical to SEQ ID NO: 268948

SEQ ID NO: 594932 - RNA, 64 nt, Homo Sapiens; identical to SEQ ID NO: 268949

SEQ ID NO: 594933 - RNA, 64 nt, Homo Sapiens; identical to SEQ ID NO: 268950

SEQ ID NO: 594934 - RNA, 64 nt, Homo Sapiens; identical to SEQ ID NO: 268951

SEQ ID NO: 594935 - RNA, 64 nt, Homo Sapiens; identical to SEQ ID NO: 268952

SEQ ID NO: 594936 - RNA, 64 nt, Homo Sapiens; identical to SEQ ID NO: 268953

SEQ ID NO: 594937 - RNA, 64 nt, Homo Sapiens; identical to SEQ ID NO: 268954

SEQ ID NO: 594938 - RNA, 64 nt, Homo Sapiens; identical to SEQ ID NO: 268955

SEQ ID NO: 594939 - RNA, 64 nt, Homo Sapiens; identical to SEQ ID NO: 268956

SEQ ID NO: 594940 - RNA, 64 nt, Homo Sapiens; identical to SEQ ID NO: 268957

SEQ ID NO: 594941 - RNA, 64 nt, Homo Sapiens; identical to SEQ ID NO: 268958

SEQ ID NO: 594942 - RNA, 64 nt, Homo Sapiens; identical to SEQ ID NO: 268959

SEQ ID NO: 594943 - RNA, 64 nt, Homo Sapiens; identical to SEQ ID NO: 268960

SEQ ID NO: 594944 - RNA, 64 nt, Homo Sapiens; identical to SEQ ID NO: 268961

SEQ ID NO: 594945 - RNA, 64 nt, Homo Sapiens; identical to SEQ ID NO: 268962

SEQ ID NO: 594946 - RNA, 64 nt, Homo Sapiens; identical to SEQ ID NO: 268963

SEQ ID NO: 594947 - RNA, 64 nt, Homo Sapiens; identical to SEQ ID NO: 268964

SEQ ID NO: 594948 - RNA, 64 nt, Homo Sapiens; identical to SEQ ID NO: 268965

SEQ ID NO: 594949 - RNA, 64 nt, Homo Sapiens; identical to SEQ ID NO: 268966

SEQ ID NO: 594950 - RNA, 64 nt, Homo Sapiens; identical to SEQ ID NO: 268967

SEQ ID NO: 594951 - RNA, 64 nt, Homo Sapiens; identical to SEQ ID NO: 268968

SEQ ID NO: 594952 - RNA, 64 nt, Homo Sapiens; identical to SEQ ID NO: 268969

SEQ ID NO: 594953 - RNA, 64 nt, Homo Sapiens; identical to SEQ ID NO: 268970

SEQ ID NO: 594954 - RNA, 64 nt, Homo Sapiens; identical to SEQ ID NO: 268971

SEQ ID NO: 594955 - RNA, 64 nt, Homo Sapiens; identical to SEQ ID NO: 268972

SEQ ID NO: 594956 - RNA, 64 nt, Homo Sapiens; identical to SEQ ID NO: 268973

SEQ ID NO: 594957 - RNA, 64 nt, Homo Sapiens; identical to SEQ ID NO: 268974

SEQ ID NO: 594958 - RNA, 64 nt, Homo Sapiens; identical to SEQ ID NO: 268975

SEQ ID NO: 594959 - RNA, 64 nt, Homo Sapiens; identical to SEQ ID NO: 268976

SEQ ID NO: 594960 - RNA, 64 nt, Homo Sapiens; identical to SEQ ID NO: 268977

SEQ ID NO: 594961 - RNA, 64 nt, Homo Sapiens; identical to SEQ ID NO: 268978

SEQ ID NO: 594962 - RNA, 64 nt, Homo Sapiens; identical to SEQ ID NO: 268979

SEQ ID NO: 594963 - RNA, 64 nt, Homo Sapiens; identical to SEQ ID NO: 268980

SEQ ID NO: 594964 - RNA, 64 nt, Homo Sapiens; identical to SEQ ID NO: 268981

SEQ ID NO: 594965 - RNA, 64 nt, Homo Sapiens; identical to SEQ ID NO: 268982

SEQ ID NO: 594966 - RNA, 64 nt, Homo Sapiens; identical to SEQ ID NO: 268983

SEQ ID NO: 594967 - RNA, 64 nt, Homo Sapiens; identical to SEQ ID NO: 268984

SEQ ID NO: 594968 - RNA, 64 nt, Homo Sapiens; identical to SEQ ID NO: 268985

SEQ ID NO: 594969 - RNA, 64 nt, Homo Sapiens; identical to SEQ ID NO: 268986

SEQ ID NO: 594970 - RNA, 64 nt, Homo Sapiens; identical to SEQ ID NO: 268987

SEQ ID NO: 594971 - RNA, 64 nt, Homo Sapiens; identical to SEQ ID NO: 268988

SEQ ID NO: 594972 - RNA, 64 nt, Homo Sapiens; identical to SEQ ID NO: 268989

SEQ ID NO: 594973 - RNA, 64 nt, Homo Sapiens; identical to SEQ ID NO: 268990

SEQ ID NO: 594974 - RNA, 64 nt, Homo Sapiens; identical to SEQ ID NO: 268991

SEQ ID NO: 594975 - RNA, 64 nt, Homo Sapiens; identical to SEQ ID NO: 268992

SEQ ID NO: 594976 - RNA, 64 nt, Homo Sapiens; identical to SEQ ID NO: 268993

SEQ ID NO: 594977 - RNA, 64 nt, Homo Sapiens; identical to SEQ ID NO: 268994

SEQ ID NO: 594978 - RNA, 64 nt, Homo Sapiens; identical to SEQ ID NO: 268995

SEQ ID NO: 594979 - RNA, 64 nt, Homo Sapiens; identical to SEQ ID NO: 268996

SEQ ID NO: 594980 - RNA, 64 nt, Homo Sapiens; identical to SEQ ID NO: 268997

SEQ ID NO: 594981 - RNA, 64 nt, Homo Sapiens; identical to SEQ ID NO: 268998

SEQ ID NO: 594982 - RNA, 64 nt, Homo Sapiens; identical to SEQ ID NO: 268999

SEQ ID NO: 594983 - RNA, 64 nt, Homo Sapiens; identical to SEQ ID NO: 269000

SEQ ID NO: 594984 - RNA, 64 nt, Homo Sapiens; identical to SEQ ID NO: 269001

SEQ ID NO: 594985 - RNA, 64 nt, Homo Sapiens; identical to SEQ ID NO: 269002

SEQ ID NO: 594986 - RNA, 64 nt, Homo Sapiens; identical to SEQ ID NO: 269003

SEQ ID NO: 594987 - RNA, 64 nt, Homo Sapiens; identical to SEQ ID NO: 269004

SEQ ID NO: 594988 - RNA, 64 nt, Homo Sapiens; identical to SEQ ID NO: 269005

SEQ ID NO: 594989 - RNA, 64 nt, Homo Sapiens; identical to SEQ ID NO: 269006

SEQ ID NO: 594990 - RNA, 64 nt, Homo Sapiens; identical to SEQ ID NO: 269007

SEQ ID NO: 594991 - RNA, 64 nt, Homo Sapiens; identical to SEQ ID NO: 269008

SEQ ID NO: 594992 - RNA, 64 nt, Homo Sapiens; identical to SEQ ID NO: 269009

SEQ ID NO: 594993 - RNA, 64 nt, Homo Sapiens; identical to SEQ ID NO: 269010

SEQ ID NO: 594994 - RNA, 64 nt, Homo Sapiens; identical to SEQ ID NO: 269011

SEQ ID NO: 594995 - RNA, 64 nt, Homo Sapiens; identical to SEQ ID NO: 269012

SEQ ID NO: 594996 - RNA, 64 nt, Homo Sapiens; identical to SEQ ID NO: 269013

SEQ ID NO: 594997 - RNA, 64 nt, Homo Sapiens; identical to SEQ ID NO: 269014

SEQ ID NO: 594998 - RNA, 64 nt, Homo Sapiens; identical to SEQ ID NO: 269015

SEQ ID NO: 594999 - RNA, 64 nt, Homo Sapiens; identical to SEQ ID NO: 269016

SEQ ID NO: 595000 - RNA, 64 nt, Homo Sapiens; identical to SEQ ID NO: 269017

SEQ ID NO: 595001 - RNA, 64 nt, Homo Sapiens; identical to SEQ ID NO: 269018

SEQ ID NO: 595002 - RNA, 64 nt, Homo Sapiens; identical to SEQ ID NO: 269019

SEQ ID NO: 595003 - RNA, 64 nt, Homo Sapiens; identical to SEQ ID NO: 269020

SEQ ID NO: 595004 - RNA, 64 nt, Homo Sapiens; identical to SEQ ID NO: 269021

SEQ ID NO: 595005 - RNA, 64 nt, Homo Sapiens; identical to SEQ ID NO: 269022

SEQ ID NO: 595006 - RNA, 64 nt, Homo Sapiens; identical to SEQ ID NO: 269023

SEQ ID NO: 595007 - RNA, 64 nt, Homo Sapiens; identical to SEQ ID NO: 269024

SEQ ID NO: 595008 - RNA, 64 nt, Homo Sapiens; identical to SEQ ID NO: 269025

SEQ ID NO: 595009 - RNA, 64 nt, Homo Sapiens; identical to SEQ ID NO: 269026

SEQ ID NO: 595010 - RNA, 64 nt, Homo Sapiens; identical to SEQ ID NO: 269027

SEQ ID NO: 595011 - RNA, 64 nt, Homo Sapiens; identical to SEQ ID NO: 269028

SEQ ID NO: 595012 - RNA, 64 nt, Homo Sapiens; identical to SEQ ID NO: 269029

SEQ ID NO: 595013 - RNA, 64 nt, Homo Sapiens; identical to SEQ ID NO: 269030

SEQ ID NO: 595014 - RNA, 64 nt, Homo Sapiens; identical to SEQ ID NO: 269031

SEQ ID NO: 595015 - RNA, 64 nt, Homo Sapiens; identical to SEQ ID NO: 269032

SEQ ID NO: 595016 - RNA, 64 nt, Homo Sapiens; identical to SEQ ID NO: 269033

SEQ ID NO: 595017 - RNA, 64 nt, Homo Sapiens; identical to SEQ ID NO: 269034

SEQ ID NO: 595018 - RNA, 64 nt, Homo Sapiens; identical to SEQ ID NO: 269035

SEQ ID NO: 595019 - RNA, 64 nt, Homo Sapiens; identical to SEQ ID NO: 269036

SEQ ID NO: 595020 - RNA, 64 nt, Homo Sapiens; identical to SEQ ID NO: 269037

SEQ ID NO: 595021 - RNA, 64 nt, Homo Sapiens; identical to SEQ ID NO: 269038

SEQ ID NO: 595022 - RNA, 64 nt, Homo Sapiens; identical to SEQ ID NO: 269039

SEQ ID NO: 595023 - RNA, 64 nt, Homo Sapiens; identical to SEQ ID NO: 269040

SEQ ID NO: 595024 - RNA, 64 nt, Homo Sapiens; identical to SEQ ID NO: 269041

SEQ ID NO: 595025 - RNA, 64 nt, Homo Sapiens; identical to SEQ ID NO: 269042

SEQ ID NO: 595026 - RNA, 64 nt, Homo Sapiens; identical to SEQ ID NO: 269043

SEQ ID NO: 595027 - RNA, 64 nt, Homo Sapiens; identical to SEQ ID NO: 269044

SEQ ID NO: 595028 - RNA, 64 nt, Homo Sapiens; identical to SEQ ID NO: 269045

SEQ ID NO: 595029 - RNA, 64 nt, Homo Sapiens; identical to SEQ ID NO: 269046

SEQ ID NO: 595030 - RNA, 64 nt, Homo Sapiens; identical to SEQ ID NO: 269047

SEQ ID NO: 595031 - RNA, 64 nt, Homo Sapiens; identical to SEQ ID NO: 269048

SEQ ID NO: 595032 - RNA, 64 nt, Homo Sapiens; identical to SEQ ID NO: 269049

SEQ ID NO: 595033 - RNA, 64 nt, Homo Sapiens; identical to SEQ ID NO: 269050

SEQ ID NO: 595034 - RNA, 64 nt, Homo Sapiens; identical to SEQ ID NO: 269051

SEQ ID NO: 595035 - RNA, 64 nt, Homo Sapiens; identical to SEQ ID NO: 269052

SEQ ID NO: 595036 - RNA, 64 nt, Homo Sapiens; identical to SEQ ID NO: 269053

SEQ ID NO: 595037 - RNA, 64 nt, Homo Sapiens; identical to SEQ ID NO: 269054

SEQ ID NO: 595038 - RNA, 64 nt, Homo Sapiens; identical to SEQ ID NO: 269055

SEQ ID NO: 595039 - RNA, 64 nt, Homo Sapiens; identical to SEQ ID NO: 269056

SEQ ID NO: 595040 - RNA, 64 nt, Homo Sapiens; identical to SEQ ID NO: 269057

SEQ ID NO: 595041 - RNA, 64 nt, Homo Sapiens; identical to SEQ ID NO: 269058

SEQ ID NO: 595042 - RNA, 64 nt, Homo Sapiens; identical to SEQ ID NO: 269059

SEQ ID NO: 595043 - RNA, 64 nt, Homo Sapiens; identical to SEQ ID NO: 269060

SEQ ID NO: 595044 - RNA, 64 nt, Homo Sapiens; identical to SEQ ID NO: 269061

SEQ ID NO: 595045 - RNA, 64 nt, Homo Sapiens; identical to SEQ ID NO: 269062

SEQ ID NO: 595046 - RNA, 64 nt, Homo Sapiens; identical to SEQ ID NO: 269063

SEQ ID NO: 595047 - RNA, 64 nt, Homo Sapiens; identical to SEQ ID NO: 269064

SEQ ID NO: 595048 - RNA, 64 nt, Homo Sapiens; identical to SEQ ID NO: 269065

SEQ ID NO: 595049 - RNA, 64 nt, Homo Sapiens; identical to SEQ ID NO: 269066

SEQ ID NO: 595050 - RNA, 64 nt, Homo Sapiens; identical to SEQ ID NO: 269067

SEQ ID NO: 595051 - RNA, 64 nt, Homo Sapiens; identical to SEQ ID NO: 269068

SEQ ID NO: 595052 - RNA, 64 nt, Homo Sapiens; identical to SEQ ID NO: 269069

SEQ ID NO: 595053 - RNA, 64 nt, Homo Sapiens; identical to SEQ ID NO: 269070

SEQ ID NO: 595054 - RNA, 64 nt, Homo Sapiens; identical to SEQ ID NO: 269071

SEQ ID NO: 595055 - RNA, 64 nt, Homo Sapiens; identical to SEQ ID NO: 269072

SEQ ID NO: 595056 - RNA, 64 nt, Homo Sapiens; identical to SEQ ID NO: 269073

SEQ ID NO: 595057 - RNA, 64 nt, Homo Sapiens; identical to SEQ ID NO: 269074

SEQ ID NO: 595058 - RNA, 64 nt, Homo Sapiens; identical to SEQ ID NO: 269075

SEQ ID NO: 595059 - RNA, 64 nt, Homo Sapiens; identical to SEQ ID NO: 269076

SEQ ID NO: 595060 - RNA, 64 nt, Homo Sapiens; identical to SEQ ID NO: 269077

SEQ ID NO: 595061 - RNA, 64 nt, Homo Sapiens; identical to SEQ ID NO: 269078

SEQ ID NO: 595062 - RNA, 64 nt, Homo Sapiens; identical to SEQ ID NO: 269079

SEQ ID NO: 595063 - RNA, 64 nt, Homo Sapiens; identical to SEQ ID NO: 269080

SEQ ID NO: 595064 - RNA, 64 nt, Homo Sapiens; identical to SEQ ID NO: 269081

SEQ ID NO: 595065 - RNA, 64 nt, Homo Sapiens; identical to SEQ ID NO: 269082

SEQ ID NO: 595066 - RNA, 64 nt, Homo Sapiens; identical to SEQ ID NO: 269083

SEQ ID NO: 595067 - RNA, 64 nt, Homo Sapiens; identical to SEQ ID NO: 269084

SEQ ID NO: 595068 - RNA, 64 nt, Homo Sapiens; identical to SEQ ID NO: 269085

SEQ ID NO: 595069 - RNA, 64 nt, Homo Sapiens; identical to SEQ ID NO: 269086

SEQ ID NO: 595070 - RNA, 64 nt, Homo Sapiens; identical to SEQ ID NO: 269087

SEQ ID NO: 595071 - RNA, 64 nt, Homo Sapiens; identical to SEQ ID NO: 269088

SEQ ID NO: 595072 - RNA, 64 nt, Homo Sapiens; identical to SEQ ID NO: 269089

SEQ ID NO: 595073 - RNA, 64 nt, Homo Sapiens; identical to SEQ ID NO: 269090

SEQ ID NO: 595074 - RNA, 64 nt, Homo Sapiens; identical to SEQ ID NO: 269091

SEQ ID NO: 595075 - RNA, 64 nt, Homo Sapiens; identical to SEQ ID NO: 269092

SEQ ID NO: 595076 - RNA, 64 nt, Homo Sapiens; identical to SEQ ID NO: 269093

SEQ ID NO: 595077 - RNA, 64 nt, Homo Sapiens; identical to SEQ ID NO: 269094

SEQ ID NO: 595078 - RNA, 64 nt, Homo Sapiens; identical to SEQ ID NO: 269095

SEQ ID NO: 595079 - RNA, 64 nt, Homo Sapiens; identical to SEQ ID NO: 269096

SEQ ID NO: 595080 - RNA, 64 nt, Homo Sapiens; identical to SEQ ID NO: 269097

SEQ ID NO: 595081 - RNA, 64 nt, Homo Sapiens; identical to SEQ ID NO: 269098

SEQ ID NO: 595082 - RNA, 64 nt, Homo Sapiens; identical to SEQ ID NO: 269099

SEQ ID NO: 595083 - RNA, 64 nt, Homo Sapiens; identical to SEQ ID NO: 269100

SEQ ID NO: 595084 - RNA, 64 nt, Homo Sapiens; identical to SEQ ID NO: 269101

SEQ ID NO: 595085 - RNA, 64 nt, Homo Sapiens; identical to SEQ ID NO: 269102

SEQ ID NO: 595086 - RNA, 64 nt, Homo Sapiens; identical to SEQ ID NO: 269103

SEQ ID NO: 595087 - RNA, 55 nt, Homo Sapiens; identical to SEQ ID NO: 269104

SEQ ID NO: 595088 - RNA, 64 nt, Homo Sapiens; identical to SEQ ID NO: 269105

SEQ ID NO: 595089 - RNA, 64 nt, Homo Sapiens; identical to SEQ ID NO: 269106

SEQ ID NO: 595090 - RNA, 64 nt, Homo Sapiens; identical to SEQ ID NO: 269107

SEQ ID NO: 595091 - RNA, 64 nt, Homo Sapiens; identical to SEQ ID NO: 269108

SEQ ID NO: 595092 - RNA, 64 nt, Homo Sapiens; identical to SEQ ID NO: 269109

SEQ ID NO: 595093 - RNA, 64 nt, Homo Sapiens; identical to SEQ ID NO: 269110

SEQ ID NO: 595094 - RNA, 64 nt, Homo Sapiens; identical to SEQ ID NO: 269111

SEQ ID NO: 595095 - RNA, 64 nt, Homo Sapiens; identical to SEQ ID NO: 269112

SEQ ID NO: 595096 - RNA, 64 nt, Homo Sapiens; identical to SEQ ID NO: 269113

SEQ ID NO: 595097 - RNA, 64 nt, Homo Sapiens; identical to SEQ ID NO: 269114

SEQ ID NO: 595098 - RNA, 64 nt, Homo Sapiens; identical to SEQ ID NO: 269115

SEQ ID NO: 595099 - RNA, 64 nt, Homo Sapiens; identical to SEQ ID NO: 269116

SEQ ID NO: 595100 - RNA, 64 nt, Homo Sapiens; identical to SEQ ID NO: 269117

SEQ ID NO: 595101 - RNA, 64 nt, Homo Sapiens; identical to SEQ ID NO: 269118

SEQ ID NO: 595102 - RNA, 64 nt, Homo Sapiens; identical to SEQ ID NO: 269119

SEQ ID NO: 595103 - RNA, 64 nt, Homo Sapiens; identical to SEQ ID NO: 269120

SEQ ID NO: 595104 - RNA, 64 nt, Homo Sapiens; identical to SEQ ID NO: 269121

SEQ ID NO: 595105 - RNA, 64 nt, Homo Sapiens; identical to SEQ ID NO: 269122

SEQ ID NO: 595106 - RNA, 64 nt, Homo Sapiens; identical to SEQ ID NO: 269123

SEQ ID NO: 595107 - RNA, 64 nt, Homo Sapiens; identical to SEQ ID NO: 269124

SEQ ID NO: 595108 - RNA, 64 nt, Homo Sapiens; identical to SEQ ID NO: 269125

SEQ ID NO: 595109 - RNA, 64 nt, Homo Sapiens; identical to SEQ ID NO: 269126

SEQ ID NO: 595110 - RNA, 64 nt, Homo Sapiens; identical to SEQ ID NO: 269127

SEQ ID NO: 595111 - RNA, 64 nt, Homo Sapiens; identical to SEQ ID NO: 269128

SEQ ID NO: 595112 - RNA, 64 nt, Homo Sapiens; identical to SEQ ID NO: 269129

SEQ ID NO: 595113 - RNA, 64 nt, Homo Sapiens; identical to SEQ ID NO: 269130

SEQ ID NO: 595114 - RNA, 64 nt, Homo Sapiens; identical to SEQ ID NO: 269131

SEQ ID NO: 595115 - RNA, 64 nt, Homo Sapiens; identical to SEQ ID NO: 269132

SEQ ID NO: 595116 - RNA, 64 nt, Homo Sapiens; identical to SEQ ID NO: 269133

SEQ ID NO: 595117 - RNA, 64 nt, Homo Sapiens; identical to SEQ ID NO: 269134

SEQ ID NO: 595118 - RNA, 64 nt, Homo Sapiens; identical to SEQ ID NO: 269135

SEQ ID NO: 595119 - RNA, 64 nt, Homo Sapiens; identical to SEQ ID NO: 269136

SEQ ID NO: 595120 - RNA, 64 nt, Homo Sapiens; identical to SEQ ID NO: 269137

SEQ ID NO: 595121 - RNA, 64 nt, Homo Sapiens; identical to SEQ ID NO: 269138

SEQ ID NO: 595122 - RNA, 64 nt, Homo Sapiens; identical to SEQ ID NO: 269139

SEQ ID NO: 595123 - RNA, 64 nt, Homo Sapiens; identical to SEQ ID NO: 269140

SEQ ID NO: 595124 - RNA, 64 nt, Homo Sapiens; identical to SEQ ID NO: 269141

SEQ ID NO: 595125 - RNA, 64 nt, Homo Sapiens; identical to SEQ ID NO: 269142

SEQ ID NO: 595126 - RNA, 64 nt, Homo Sapiens; identical to SEQ ID NO: 269143

SEQ ID NO: 595127 - RNA, 64 nt, Homo Sapiens; identical to SEQ ID NO: 269144

SEQ ID NO: 595128 - RNA, 64 nt, Homo Sapiens; identical to SEQ ID NO: 269145

SEQ ID NO: 595129 - RNA, 64 nt, Homo Sapiens; identical to SEQ ID NO: 269146

SEQ ID NO: 595130 - RNA, 64 nt, Homo Sapiens; identical to SEQ ID NO: 269147

SEQ ID NO: 595131 - RNA, 64 nt, Homo Sapiens; identical to SEQ ID NO: 269148

SEQ ID NO: 595132 - RNA, 64 nt, Homo Sapiens; identical to SEQ ID NO: 269149

SEQ ID NO: 595133 - RNA, 64 nt, Homo Sapiens; identical to SEQ ID NO: 269150

SEQ ID NO: 595134 - RNA, 64 nt, Homo Sapiens; identical to SEQ ID NO: 269151

SEQ ID NO: 595135 - RNA, 64 nt, Homo Sapiens; identical to SEQ ID NO: 269152

SEQ ID NO: 595136 - RNA, 64 nt, Homo Sapiens; identical to SEQ ID NO: 269153

SEQ ID NO: 595137 - RNA, 64 nt, Homo Sapiens; identical to SEQ ID NO: 269154

SEQ ID NO: 595138 - RNA, 64 nt, Homo Sapiens; identical to SEQ ID NO: 269155

SEQ ID NO: 595139 - RNA, 64 nt, Homo Sapiens; identical to SEQ ID NO: 269156

SEQ ID NO: 595140 - RNA, 64 nt, Homo Sapiens; identical to SEQ ID NO: 269157

SEQ ID NO: 595141 - RNA, 64 nt, Homo Sapiens; identical to SEQ ID NO: 269158

SEQ ID NO: 595142 - RNA, 64 nt, Homo Sapiens; identical to SEQ ID NO: 269159

SEQ ID NO: 595143 - RNA, 64 nt, Homo Sapiens; identical to SEQ ID NO: 269160

SEQ ID NO: 595144 - RNA, 64 nt, Homo Sapiens; identical to SEQ ID NO: 269161

SEQ ID NO: 595145 - RNA, 64 nt, Homo Sapiens; identical to SEQ ID NO: 269162

SEQ ID NO: 595146 - RNA, 64 nt, Homo Sapiens; identical to SEQ ID NO: 269163

SEQ ID NO: 595147 - RNA, 64 nt, Homo Sapiens; identical to SEQ ID NO: 269164

SEQ ID NO: 595148 - RNA, 64 nt, Homo Sapiens; identical to SEQ ID NO: 269165

SEQ ID NO: 595149 - RNA, 64 nt, Homo Sapiens; identical to SEQ ID NO: 269166

SEQ ID NO: 595150 - RNA, 64 nt, Homo Sapiens; identical to SEQ ID NO: 269167

SEQ ID NO: 595151 - RNA, 64 nt, Homo Sapiens; identical to SEQ ID NO: 269168

SEQ ID NO: 595152 - RNA, 64 nt, Homo Sapiens; identical to SEQ ID NO: 269169

SEQ ID NO: 595153 - RNA, 64 nt, Homo Sapiens; identical to SEQ ID NO: 269170

SEQ ID NO: 595154 - RNA, 64 nt, Homo Sapiens; identical to SEQ ID NO: 269171

SEQ ID NO: 595155 - RNA, 64 nt, Homo Sapiens; identical to SEQ ID NO: 269172

SEQ ID NO: 595156 - RNA, 64 nt, Homo Sapiens; identical to SEQ ID NO: 269173

SEQ ID NO: 595157 - RNA, 64 nt, Homo Sapiens; identical to SEQ ID NO: 269174

SEQ ID NO: 595158 - RNA, 64 nt, Homo Sapiens; identical to SEQ ID NO: 269175

SEQ ID NO: 595159 - RNA, 64 nt, Homo Sapiens; identical to SEQ ID NO: 269176

SEQ ID NO: 595160 - RNA, 64 nt, Homo Sapiens; identical to SEQ ID NO: 269177

SEQ ID NO: 595161 - RNA, 64 nt, Homo Sapiens; identical to SEQ ID NO: 269178

SEQ ID NO: 595162 - RNA, 64 nt, Homo Sapiens; identical to SEQ ID NO: 269179

SEQ ID NO: 595163 - RNA, 64 nt, Homo Sapiens; identical to SEQ ID NO: 269180

SEQ ID NO: 595164 - RNA, 64 nt, Homo Sapiens; identical to SEQ ID NO: 269181

SEQ ID NO: 595165 - RNA, 64 nt, Homo Sapiens; identical to SEQ ID NO: 269182

SEQ ID NO: 595166 - RNA, 64 nt, Homo Sapiens; identical to SEQ ID NO: 269183

SEQ ID NO: 595167 - RNA, 64 nt, Homo Sapiens; identical to SEQ ID NO: 269184

SEQ ID NO: 595168 - RNA, 64 nt, Homo Sapiens; identical to SEQ ID NO: 269185

SEQ ID NO: 595169 - RNA, 64 nt, Homo Sapiens; identical to SEQ ID NO: 269186

SEQ ID NO: 595170 - RNA, 64 nt, Homo Sapiens; identical to SEQ ID NO: 269187

SEQ ID NO: 595171 - RNA, 64 nt, Homo Sapiens; identical to SEQ ID NO: 269188

SEQ ID NO: 595172 - RNA, 64 nt, Homo Sapiens; identical to SEQ ID NO: 269189

SEQ ID NO: 595173 - RNA, 64 nt, Homo Sapiens; identical to SEQ ID NO: 269190

SEQ ID NO: 595174 - RNA, 64 nt, Homo Sapiens; identical to SEQ ID NO: 269191

SEQ ID NO: 595175 - RNA, 64 nt, Homo Sapiens; identical to SEQ ID NO: 269192

SEQ ID NO: 595176 - RNA, 64 nt, Homo Sapiens; identical to SEQ ID NO: 269193

SEQ ID NO: 595177 - RNA, 64 nt, Homo Sapiens; identical to SEQ ID NO: 269194

SEQ ID NO: 595178 - RNA, 64 nt, Homo Sapiens; identical to SEQ ID NO: 269195

SEQ ID NO: 595179 - RNA, 64 nt, Homo Sapiens; identical to SEQ ID NO: 269196

SEQ ID NO: 595180 - RNA, 64 nt, Homo Sapiens; identical to SEQ ID NO: 269197

SEQ ID NO: 595181 - RNA, 64 nt, Homo Sapiens; identical to SEQ ID NO: 269198

SEQ ID NO: 595182 - RNA, 64 nt, Homo Sapiens; identical to SEQ ID NO: 269199

SEQ ID NO: 595183 - RNA, 64 nt, Homo Sapiens; identical to SEQ ID NO: 269200

SEQ ID NO: 595184 - RNA, 64 nt, Homo Sapiens; identical to SEQ ID NO: 269201

SEQ ID NO: 595185 - RNA, 64 nt, Homo Sapiens; identical to SEQ ID NO: 269202

SEQ ID NO: 595186 - RNA, 64 nt, Homo Sapiens; identical to SEQ ID NO: 269203

SEQ ID NO: 595187 - RNA, 64 nt, Homo Sapiens; identical to SEQ ID NO: 269204

SEQ ID NO: 595188 - RNA, 64 nt, Homo Sapiens; identical to SEQ ID NO: 269205

SEQ ID NO: 595189 - RNA, 64 nt, Homo Sapiens; identical to SEQ ID NO: 269206

SEQ ID NO: 595190 - RNA, 64 nt, Homo Sapiens; identical to SEQ ID NO: 269207

SEQ ID NO: 595191 - RNA, 64 nt, Homo Sapiens; identical to SEQ ID NO: 269208

SEQ ID NO: 595192 - RNA, 64 nt, Homo Sapiens; identical to SEQ ID NO: 269209

SEQ ID NO: 595193 - RNA, 64 nt, Homo Sapiens; identical to SEQ ID NO: 269210

SEQ ID NO: 595194 - RNA, 64 nt, Homo Sapiens; identical to SEQ ID NO: 269211

SEQ ID NO: 595195 - RNA, 64 nt, Homo Sapiens; identical to SEQ ID NO: 269212

SEQ ID NO: 595196 - RNA, 64 nt, Homo Sapiens; identical to SEQ ID NO: 269213

SEQ ID NO: 595197 - RNA, 64 nt, Homo Sapiens; identical to SEQ ID NO: 269214

SEQ ID NO: 595198 - RNA, 64 nt, Homo Sapiens; identical to SEQ ID NO: 269215

SEQ ID NO: 595199 - RNA, 64 nt, Homo Sapiens; identical to SEQ ID NO: 269216

SEQ ID NO: 595200 - RNA, 64 nt, Homo Sapiens; identical to SEQ ID NO: 269217

SEQ ID NO: 595201 - RNA, 64 nt, Homo Sapiens; identical to SEQ ID NO: 269218

SEQ ID NO: 595202 - RNA, 64 nt, Homo Sapiens; identical to SEQ ID NO: 269219

SEQ ID NO: 595203 - RNA, 64 nt, Homo Sapiens; identical to SEQ ID NO: 269220

SEQ ID NO: 595204 - RNA, 64 nt, Homo Sapiens; identical to SEQ ID NO: 269221

SEQ ID NO: 595205 - RNA, 64 nt, Homo Sapiens; identical to SEQ ID NO: 269222

SEQ ID NO: 595206 - RNA, 64 nt, Homo Sapiens; identical to SEQ ID NO: 269223

SEQ ID NO: 595207 - RNA, 64 nt, Homo Sapiens; identical to SEQ ID NO: 269224

SEQ ID NO: 595208 - RNA, 64 nt, Homo Sapiens; identical to SEQ ID NO: 269225

SEQ ID NO: 595209 - RNA, 64 nt, Homo Sapiens; identical to SEQ ID NO: 269226

SEQ ID NO: 595210 - RNA, 64 nt, Homo Sapiens; identical to SEQ ID NO: 269227

SEQ ID NO: 595211 - RNA, 64 nt, Homo Sapiens; identical to SEQ ID NO: 269228

SEQ ID NO: 595212 - RNA, 64 nt, Homo Sapiens; identical to SEQ ID NO: 269229

SEQ ID NO: 595213 - RNA, 64 nt, Homo Sapiens; identical to SEQ ID NO: 269230

SEQ ID NO: 595214 - RNA, 64 nt, Homo Sapiens; identical to SEQ ID NO: 269231

SEQ ID NO: 595215 - RNA, 64 nt, Homo Sapiens; identical to SEQ ID NO: 269232

SEQ ID NO: 595216 - RNA, 64 nt, Homo Sapiens; identical to SEQ ID NO: 269233

SEQ ID NO: 595217 - RNA, 64 nt, Homo Sapiens; identical to SEQ ID NO: 269234

SEQ ID NO: 595218 - RNA, 64 nt, Homo Sapiens; identical to SEQ ID NO: 269235

SEQ ID NO: 595219 - RNA, 64 nt, Homo Sapiens; identical to SEQ ID NO: 269236

SEQ ID NO: 595220 - RNA, 64 nt, Homo Sapiens; identical to SEQ ID NO: 269237

SEQ ID NO: 595221 - RNA, 64 nt, Homo Sapiens; identical to SEQ ID NO: 269238

SEQ ID NO: 595222 - RNA, 64 nt, Homo Sapiens; identical to SEQ ID NO: 269239

SEQ ID NO: 595223 - RNA, 64 nt, Homo Sapiens; identical to SEQ ID NO: 269240

SEQ ID NO: 595224 - RNA, 64 nt, Homo Sapiens; identical to SEQ ID NO: 269241

SEQ ID NO: 595225 - RNA, 64 nt, Homo Sapiens; identical to SEQ ID NO: 269242

SEQ ID NO: 595226 - RNA, 64 nt, Homo Sapiens; identical to SEQ ID NO: 269243

SEQ ID NO: 595227 - RNA, 64 nt, Homo Sapiens; identical to SEQ ID NO: 269244

SEQ ID NO: 595228 - RNA, 64 nt, Homo Sapiens; identical to SEQ ID NO: 269245

SEQ ID NO: 595229 - RNA, 64 nt, Homo Sapiens; identical to SEQ ID NO: 269246

SEQ ID NO: 595230 - RNA, 64 nt, Homo Sapiens; identical to SEQ ID NO: 269247

SEQ ID NO: 595231 - RNA, 64 nt, Homo Sapiens; identical to SEQ ID NO: 269248

SEQ ID NO: 595232 - RNA, 64 nt, Homo Sapiens; identical to SEQ ID NO: 269249

SEQ ID NO: 595233 - RNA, 64 nt, Homo Sapiens; identical to SEQ ID NO: 269250

SEQ ID NO: 595234 - RNA, 64 nt, Homo Sapiens; identical to SEQ ID NO: 269251

SEQ ID NO: 595235 - RNA, 64 nt, Homo Sapiens; identical to SEQ ID NO: 269252

SEQ ID NO: 595236 - RNA, 64 nt, Homo Sapiens; identical to SEQ ID NO: 269253

SEQ ID NO: 595237 - RNA, 64 nt, Homo Sapiens; identical to SEQ ID NO: 269254

SEQ ID NO: 595238 - RNA, 64 nt, Homo Sapiens; identical to SEQ ID NO: 269255

SEQ ID NO: 595239 - RNA, 64 nt, Homo Sapiens; identical to SEQ ID NO: 269256

SEQ ID NO: 595240 - RNA, 64 nt, Homo Sapiens; identical to SEQ ID NO: 269257

SEQ ID NO: 595241 - RNA, 64 nt, Homo Sapiens; identical to SEQ ID NO: 269258

SEQ ID NO: 595242 - RNA, 64 nt, Homo Sapiens; identical to SEQ ID NO: 269259

SEQ ID NO: 595243 - RNA, 64 nt, Homo Sapiens; identical to SEQ ID NO: 269260

SEQ ID NO: 595244 - RNA, 64 nt, Homo Sapiens; identical to SEQ ID NO: 269261

SEQ ID NO: 595245 - RNA, 64 nt, Homo Sapiens; identical to SEQ ID NO: 269262

SEQ ID NO: 595246 - RNA, 64 nt, Homo Sapiens; identical to SEQ ID NO: 269263

SEQ ID NO: 595247 - RNA, 64 nt, Homo Sapiens; identical to SEQ ID NO: 269264

SEQ ID NO: 595248 - RNA, 64 nt, Homo Sapiens; identical to SEQ ID NO: 269265

SEQ ID NO: 595249 - RNA, 64 nt, Homo Sapiens; identical to SEQ ID NO: 269266

SEQ ID NO: 595250 - RNA, 64 nt, Homo Sapiens; identical to SEQ ID NO: 269267

SEQ ID NO: 595251 - RNA, 64 nt, Homo Sapiens; identical to SEQ ID NO: 269268

SEQ ID NO: 595252 - RNA, 64 nt, Homo Sapiens; identical to SEQ ID NO: 269269

SEQ ID NO: 595253 - RNA, 64 nt, Homo Sapiens; identical to SEQ ID NO: 269270

SEQ ID NO: 595254 - RNA, 64 nt, Homo Sapiens; identical to SEQ ID NO: 269271

SEQ ID NO: 595255 - RNA, 64 nt, Homo Sapiens; identical to SEQ ID NO: 269272

SEQ ID NO: 595256 - RNA, 64 nt, Homo Sapiens; identical to SEQ ID NO: 269273

SEQ ID NO: 595257 - RNA, 64 nt, Homo Sapiens; identical to SEQ ID NO: 269274

SEQ ID NO: 595258 - RNA, 64 nt, Homo Sapiens; identical to SEQ ID NO: 269275

SEQ ID NO: 595259 - RNA, 64 nt, Homo Sapiens; identical to SEQ ID NO: 269276

SEQ ID NO: 595260 - RNA, 64 nt, Homo Sapiens; identical to SEQ ID NO: 269277

SEQ ID NO: 595261 - RNA, 64 nt, Homo Sapiens; identical to SEQ ID NO: 269278

SEQ ID NO: 595262 - RNA, 64 nt, Homo Sapiens; identical to SEQ ID NO: 269279

SEQ ID NO: 595263 - RNA, 64 nt, Homo Sapiens; identical to SEQ ID NO: 269280

SEQ ID NO: 595264 - RNA, 64 nt, Homo Sapiens; identical to SEQ ID NO: 269281

SEQ ID NO: 595265 - RNA, 64 nt, Homo Sapiens; identical to SEQ ID NO: 269282

SEQ ID NO: 595266 - RNA, 64 nt, Homo Sapiens; identical to SEQ ID NO: 269283

SEQ ID NO: 595267 - RNA, 64 nt, Homo Sapiens; identical to SEQ ID NO: 269284

SEQ ID NO: 595268 - RNA, 64 nt, Homo Sapiens; identical to SEQ ID NO: 269285

SEQ ID NO: 595269 - RNA, 64 nt, Homo Sapiens; identical to SEQ ID NO: 269286

SEQ ID NO: 595270 - RNA, 64 nt, Homo Sapiens; identical to SEQ ID NO: 269287

SEQ ID NO: 595271 - RNA, 64 nt, Homo Sapiens; identical to SEQ ID NO: 269288

SEQ ID NO: 595272 - RNA, 64 nt, Homo Sapiens; identical to SEQ ID NO: 269289

SEQ ID NO: 595273 - RNA, 64 nt, Homo Sapiens; identical to SEQ ID NO: 269290

SEQ ID NO: 595274 - RNA, 64 nt, Homo Sapiens; identical to SEQ ID NO: 269291

SEQ ID NO: 595275 - RNA, 64 nt, Homo Sapiens; identical to SEQ ID NO: 269292

SEQ ID NO: 595276 - RNA, 64 nt, Homo Sapiens; identical to SEQ ID NO: 269293

SEQ ID NO: 595277 - RNA, 64 nt, Homo Sapiens; identical to SEQ ID NO: 269294

SEQ ID NO: 595278 - RNA, 64 nt, Homo Sapiens; identical to SEQ ID NO: 269295

SEQ ID NO: 595279 - RNA, 64 nt, Homo Sapiens; identical to SEQ ID NO: 269296

SEQ ID NO: 595280 - RNA, 64 nt, Homo Sapiens; identical to SEQ ID NO: 269297

SEQ ID NO: 595281 - RNA, 64 nt, Homo Sapiens; identical to SEQ ID NO: 269298

SEQ ID NO: 595282 - RNA, 64 nt, Homo Sapiens; identical to SEQ ID NO: 269299

SEQ ID NO: 595283 - RNA, 64 nt, Homo Sapiens; identical to SEQ ID NO: 269300

SEQ ID NO: 595284 - RNA, 64 nt, Homo Sapiens; identical to SEQ ID NO: 269301

SEQ ID NO: 595285 - RNA, 64 nt, Homo Sapiens; identical to SEQ ID NO: 269302

SEQ ID NO: 595286 - RNA, 64 nt, Homo Sapiens; identical to SEQ ID NO: 269303

SEQ ID NO: 595287 - RNA, 64 nt, Homo Sapiens; identical to SEQ ID NO: 269304

SEQ ID NO: 595288 - RNA, 64 nt, Homo Sapiens; identical to SEQ ID NO: 269305

SEQ ID NO: 595289 - RNA, 64 nt, Homo Sapiens; identical to SEQ ID NO: 269306

SEQ ID NO: 595290 - RNA, 64 nt, Homo Sapiens; identical to SEQ ID NO: 269307

SEQ ID NO: 595291 - RNA, 64 nt, Homo Sapiens; identical to SEQ ID NO: 269308

SEQ ID NO: 595292 - RNA, 64 nt, Homo Sapiens; identical to SEQ ID NO: 269309

SEQ ID NO: 595293 - RNA, 64 nt, Homo Sapiens; identical to SEQ ID NO: 269310

SEQ ID NO: 595294 - RNA, 64 nt, Homo Sapiens; identical to SEQ ID NO: 269311

SEQ ID NO: 595295 - RNA, 64 nt, Homo Sapiens; identical to SEQ ID NO: 269312

SEQ ID NO: 595296 - RNA, 64 nt, Homo Sapiens; identical to SEQ ID NO: 269313

SEQ ID NO: 595297 - RNA, 64 nt, Homo Sapiens; identical to SEQ ID NO: 269314

SEQ ID NO: 595298 - RNA, 64 nt, Homo Sapiens; identical to SEQ ID NO: 269315

SEQ ID NO: 595299 - RNA, 64 nt, Homo Sapiens; identical to SEQ ID NO: 269316

SEQ ID NO: 595300 - RNA, 64 nt, Homo Sapiens; identical to SEQ ID NO: 269317

SEQ ID NO: 595301 - RNA, 64 nt, Homo Sapiens; identical to SEQ ID NO: 269318

SEQ ID NO: 595302 - RNA, 64 nt, Homo Sapiens; identical to SEQ ID NO: 269319

SEQ ID NO: 595303 - RNA, 64 nt, Homo Sapiens; identical to SEQ ID NO: 269320

SEQ ID NO: 595304 - RNA, 64 nt, Homo Sapiens; identical to SEQ ID NO: 269321

SEQ ID NO: 595305 - RNA, 64 nt, Homo Sapiens; identical to SEQ ID NO: 269322

SEQ ID NO: 595306 - RNA, 64 nt, Homo Sapiens; identical to SEQ ID NO: 269323

SEQ ID NO: 595307 - RNA, 64 nt, Homo Sapiens; identical to SEQ ID NO: 269324

SEQ ID NO: 595308 - RNA, 64 nt, Homo Sapiens; identical to SEQ ID NO: 269325

SEQ ID NO: 595309 - RNA, 64 nt, Homo Sapiens; identical to SEQ ID NO: 269326

SEQ ID NO: 595310 - RNA, 64 nt, Homo Sapiens; identical to SEQ ID NO: 269327

SEQ ID NO: 595311 - RNA, 64 nt, Homo Sapiens; identical to SEQ ID NO: 269328

SEQ ID NO: 595312 - RNA, 64 nt, Homo Sapiens; identical to SEQ ID NO: 269329

SEQ ID NO: 595313 - RNA, 64 nt, Homo Sapiens; identical to SEQ ID NO: 269330

SEQ ID NO: 595314 - RNA, 64 nt, Homo Sapiens; identical to SEQ ID NO: 269331

SEQ ID NO: 595315 - RNA, 64 nt, Homo Sapiens; identical to SEQ ID NO: 269332

SEQ ID NO: 595316 - RNA, 64 nt, Homo Sapiens; identical to SEQ ID NO: 269333

SEQ ID NO: 595317 - RNA, 64 nt, Homo Sapiens; identical to SEQ ID NO: 269334

SEQ ID NO: 595318 - RNA, 64 nt, Homo Sapiens; identical to SEQ ID NO: 269335

SEQ ID NO: 595319 - RNA, 64 nt, Homo Sapiens; identical to SEQ ID NO: 269336

SEQ ID NO: 595320 - RNA, 64 nt, Homo Sapiens; identical to SEQ ID NO: 269337

SEQ ID NO: 595321 - RNA, 64 nt, Homo Sapiens; identical to SEQ ID NO: 269338

SEQ ID NO: 595322 - RNA, 64 nt, Homo Sapiens; identical to SEQ ID NO: 269339

SEQ ID NO: 595323 - RNA, 64 nt, Homo Sapiens; identical to SEQ ID NO: 269340

SEQ ID NO: 595324 - RNA, 64 nt, Homo Sapiens; identical to SEQ ID NO: 269341

SEQ ID NO: 595325 - RNA, 64 nt, Homo Sapiens; identical to SEQ ID NO: 269342

SEQ ID NO: 595326 - RNA, 64 nt, Homo Sapiens; identical to SEQ ID NO: 269343

SEQ ID NO: 595327 - RNA, 64 nt, Homo Sapiens; identical to SEQ ID NO: 269344

SEQ ID NO: 595328 - RNA, 64 nt, Homo Sapiens; identical to SEQ ID NO: 269345

SEQ ID NO: 595329 - RNA, 64 nt, Homo Sapiens; identical to SEQ ID NO: 269346

SEQ ID NO: 595330 - RNA, 64 nt, Homo Sapiens; identical to SEQ ID NO: 269347

SEQ ID NO: 595331 - RNA, 64 nt, Homo Sapiens; identical to SEQ ID NO: 269348

SEQ ID NO: 595332 - RNA, 64 nt, Homo Sapiens; identical to SEQ ID NO: 269349

SEQ ID NO: 595333 - RNA, 64 nt, Homo Sapiens; identical to SEQ ID NO: 269350

SEQ ID NO: 595334 - RNA, 64 nt, Homo Sapiens; identical to SEQ ID NO: 269351

SEQ ID NO: 595335 - RNA, 64 nt, Homo Sapiens; identical to SEQ ID NO: 269352

SEQ ID NO: 595336 - RNA, 64 nt, Homo Sapiens; identical to SEQ ID NO: 269353

SEQ ID NO: 595337 - RNA, 64 nt, Homo Sapiens; identical to SEQ ID NO: 269354

SEQ ID NO: 595338 - RNA, 64 nt, Homo Sapiens; identical to SEQ ID NO: 269355

SEQ ID NO: 595339 - RNA, 64 nt, Homo Sapiens; identical to SEQ ID NO: 269356

SEQ ID NO: 595340 - RNA, 64 nt, Homo Sapiens; identical to SEQ ID NO: 269357

SEQ ID NO: 595341 - RNA, 64 nt, Homo Sapiens; identical to SEQ ID NO: 269358

SEQ ID NO: 595342 - RNA, 64 nt, Homo Sapiens; identical to SEQ ID NO: 269359

SEQ ID NO: 595343 - RNA, 64 nt, Homo Sapiens; identical to SEQ ID NO: 269360

SEQ ID NO: 595344 - RNA, 64 nt, Homo Sapiens; identical to SEQ ID NO: 269361

SEQ ID NO: 595345 - RNA, 64 nt, Homo Sapiens; identical to SEQ ID NO: 269362

SEQ ID NO: 595346 - RNA, 64 nt, Homo Sapiens; identical to SEQ ID NO: 269363

SEQ ID NO: 595347 - RNA, 64 nt, Homo Sapiens; identical to SEQ ID NO: 269364

SEQ ID NO: 595348 - RNA, 64 nt, Homo Sapiens; identical to SEQ ID NO: 269365

SEQ ID NO: 595349 - RNA, 64 nt, Homo Sapiens; identical to SEQ ID NO: 269366

SEQ ID NO: 595350 - RNA, 64 nt, Homo Sapiens; identical to SEQ ID NO: 269367

SEQ ID NO: 595351 - RNA, 64 nt, Homo Sapiens; identical to SEQ ID NO: 269368

SEQ ID NO: 595352 - RNA, 64 nt, Homo Sapiens; identical to SEQ ID NO: 269369

SEQ ID NO: 595353 - RNA, 64 nt, Homo Sapiens; identical to SEQ ID NO: 269370

SEQ ID NO: 595354 - RNA, 64 nt, Homo Sapiens; identical to SEQ ID NO: 269371

SEQ ID NO: 595355 - RNA, 64 nt, Homo Sapiens; identical to SEQ ID NO: 269372

SEQ ID NO: 595356 - RNA, 64 nt, Homo Sapiens; identical to SEQ ID NO: 269373

SEQ ID NO: 595357 - RNA, 64 nt, Homo Sapiens; identical to SEQ ID NO: 269374

SEQ ID NO: 595358 - RNA, 64 nt, Homo Sapiens; identical to SEQ ID NO: 269375

SEQ ID NO: 595359 - RNA, 64 nt, Homo Sapiens; identical to SEQ ID NO: 269376

SEQ ID NO: 595360 - RNA, 64 nt, Homo Sapiens; identical to SEQ ID NO: 269377

SEQ ID NO: 595361 - RNA, 64 nt, Homo Sapiens; identical to SEQ ID NO: 269378

SEQ ID NO: 595362 - RNA, 64 nt, Homo Sapiens; identical to SEQ ID NO: 269379

SEQ ID NO: 595363 - RNA, 64 nt, Homo Sapiens; identical to SEQ ID NO: 269380

SEQ ID NO: 595364 - RNA, 64 nt, Homo Sapiens; identical to SEQ ID NO: 269381

SEQ ID NO: 595365 - RNA, 64 nt, Homo Sapiens; identical to SEQ ID NO: 269382

SEQ ID NO: 595366 - RNA, 64 nt, Homo Sapiens; identical to SEQ ID NO: 269383

SEQ ID NO: 595367 - RNA, 64 nt, Homo Sapiens; identical to SEQ ID NO: 269384

SEQ ID NO: 595368 - RNA, 64 nt, Homo Sapiens; identical to SEQ ID NO: 269385

SEQ ID NO: 595369 - RNA, 64 nt, Homo Sapiens; identical to SEQ ID NO: 269386

SEQ ID NO: 595370 - RNA, 64 nt, Homo Sapiens; identical to SEQ ID NO: 269387

SEQ ID NO: 595371 - RNA, 64 nt, Homo Sapiens; identical to SEQ ID NO: 269388

SEQ ID NO: 595372 - RNA, 64 nt, Homo Sapiens; identical to SEQ ID NO: 269389

SEQ ID NO: 595373 - RNA, 64 nt, Homo Sapiens; identical to SEQ ID NO: 269390

SEQ ID NO: 595374 - RNA, 64 nt, Homo Sapiens; identical to SEQ ID NO: 269391

SEQ ID NO: 595375 - RNA, 64 nt, Homo Sapiens; identical to SEQ ID NO: 269392

SEQ ID NO: 595376 - RNA, 64 nt, Homo Sapiens; identical to SEQ ID NO: 269393

SEQ ID NO: 595377 - RNA, 64 nt, Homo Sapiens; identical to SEQ ID NO: 269394

SEQ ID NO: 595378 - RNA, 64 nt, Homo Sapiens; identical to SEQ ID NO: 269395

SEQ ID NO: 595379 - RNA, 64 nt, Homo Sapiens; identical to SEQ ID NO: 269396

SEQ ID NO: 595380 - RNA, 64 nt, Homo Sapiens; identical to SEQ ID NO: 269397

SEQ ID NO: 595381 - RNA, 64 nt, Homo Sapiens; identical to SEQ ID NO: 269398

SEQ ID NO: 595382 - RNA, 64 nt, Homo Sapiens; identical to SEQ ID NO: 269399

SEQ ID NO: 595383 - RNA, 64 nt, Homo Sapiens; identical to SEQ ID NO: 269400

SEQ ID NO: 595384 - RNA, 64 nt, Homo Sapiens; identical to SEQ ID NO: 269401

SEQ ID NO: 595385 - RNA, 64 nt, Homo Sapiens; identical to SEQ ID NO: 269402

SEQ ID NO: 595386 - RNA, 64 nt, Homo Sapiens; identical to SEQ ID NO: 269403

SEQ ID NO: 595387 - RNA, 64 nt, Homo Sapiens; identical to SEQ ID NO: 269404

SEQ ID NO: 595388 - RNA, 64 nt, Homo Sapiens; identical to SEQ ID NO: 269405

SEQ ID NO: 595389 - RNA, 64 nt, Homo Sapiens; identical to SEQ ID NO: 269406

SEQ ID NO: 595390 - RNA, 64 nt, Homo Sapiens; identical to SEQ ID NO: 269407

SEQ ID NO: 595391 - RNA, 64 nt, Homo Sapiens; identical to SEQ ID NO: 269408

SEQ ID NO: 595392 - RNA, 64 nt, Homo Sapiens; identical to SEQ ID NO: 269409

SEQ ID NO: 595393 - RNA, 64 nt, Homo Sapiens; identical to SEQ ID NO: 269410

SEQ ID NO: 595394 - RNA, 64 nt, Homo Sapiens; identical to SEQ ID NO: 269411

SEQ ID NO: 595395 - RNA, 64 nt, Homo Sapiens; identical to SEQ ID NO: 269412

SEQ ID NO: 595396 - RNA, 64 nt, Homo Sapiens; identical to SEQ ID NO: 269413

SEQ ID NO: 595397 - RNA, 64 nt, Homo Sapiens; identical to SEQ ID NO: 269414

SEQ ID NO: 595398 - RNA, 64 nt, Homo Sapiens; identical to SEQ ID NO: 269415

SEQ ID NO: 595399 - RNA, 64 nt, Homo Sapiens; identical to SEQ ID NO: 269416

SEQ ID NO: 595400 - RNA, 64 nt, Homo Sapiens; identical to SEQ ID NO: 269417

SEQ ID NO: 595401 - RNA, 64 nt, Homo Sapiens; identical to SEQ ID NO: 269418

SEQ ID NO: 595402 - RNA, 64 nt, Homo Sapiens; identical to SEQ ID NO: 269419

SEQ ID NO: 595403 - RNA, 64 nt, Homo Sapiens; identical to SEQ ID NO: 269420

SEQ ID NO: 595404 - RNA, 64 nt, Homo Sapiens; identical to SEQ ID NO: 269421

SEQ ID NO: 595405 - RNA, 64 nt, Homo Sapiens; identical to SEQ ID NO: 269422

SEQ ID NO: 595406 - RNA, 64 nt, Homo Sapiens; identical to SEQ ID NO: 269423

SEQ ID NO: 595407 - RNA, 64 nt, Homo Sapiens; identical to SEQ ID NO: 269424

SEQ ID NO: 595408 - RNA, 64 nt, Homo Sapiens; identical to SEQ ID NO: 269425

SEQ ID NO: 595409 - RNA, 64 nt, Homo Sapiens; identical to SEQ ID NO: 269426

SEQ ID NO: 595410 - RNA, 64 nt, Homo Sapiens; identical to SEQ ID NO: 269427

SEQ ID NO: 595411 - RNA, 64 nt, Homo Sapiens; identical to SEQ ID NO: 269428

SEQ ID NO: 595412 - RNA, 64 nt, Homo Sapiens; identical to SEQ ID NO: 269429

SEQ ID NO: 595413 - RNA, 56 nt, Homo Sapiens; identical to SEQ ID NO: 269430

SEQ ID NO: 595414 - RNA, 64 nt, Homo Sapiens; identical to SEQ ID NO: 269431

SEQ ID NO: 595415 - RNA, 64 nt, Homo Sapiens; identical to SEQ ID NO: 269432

SEQ ID NO: 595416 - RNA, 64 nt, Homo Sapiens; identical to SEQ ID NO: 269433

SEQ ID NO: 595417 - RNA, 64 nt, Homo Sapiens; identical to SEQ ID NO: 269434

SEQ ID NO: 595418 - RNA, 64 nt, Homo Sapiens; identical to SEQ ID NO: 269435

SEQ ID NO: 595419 - RNA, 64 nt, Homo Sapiens; identical to SEQ ID NO: 269436

SEQ ID NO: 595420 - RNA, 64 nt, Homo Sapiens; identical to SEQ ID NO: 269437

SEQ ID NO: 595421 - RNA, 64 nt, Homo Sapiens; identical to SEQ ID NO: 269438

SEQ ID NO: 595422 - RNA, 64 nt, Homo Sapiens; identical to SEQ ID NO: 269439

SEQ ID NO: 595423 - RNA, 64 nt, Homo Sapiens; identical to SEQ ID NO: 269440

SEQ ID NO: 595424 - RNA, 64 nt, Homo Sapiens; identical to SEQ ID NO: 269441

SEQ ID NO: 595425 - RNA, 64 nt, Homo Sapiens; identical to SEQ ID NO: 269442

SEQ ID NO: 595426 - RNA, 64 nt, Homo Sapiens; identical to SEQ ID NO: 269443

SEQ ID NO: 595427 - RNA, 64 nt, Homo Sapiens; identical to SEQ ID NO: 269444

SEQ ID NO: 595428 - RNA, 64 nt, Homo Sapiens; identical to SEQ ID NO: 269445

SEQ ID NO: 595429 - RNA, 64 nt, Homo Sapiens; identical to SEQ ID NO: 269446

SEQ ID NO: 595430 - RNA, 64 nt, Homo Sapiens; identical to SEQ ID NO: 269447

SEQ ID NO: 595431 - RNA, 64 nt, Homo Sapiens; identical to SEQ ID NO: 269448

SEQ ID NO: 595432 - RNA, 64 nt, Homo Sapiens; identical to SEQ ID NO: 269449

SEQ ID NO: 595433 - RNA, 64 nt, Homo Sapiens; identical to SEQ ID NO: 269450

SEQ ID NO: 595434 - RNA, 64 nt, Homo Sapiens; identical to SEQ ID NO: 269451

SEQ ID NO: 595435 - RNA, 64 nt, Homo Sapiens; identical to SEQ ID NO: 269452

SEQ ID NO: 595436 - RNA, 64 nt, Homo Sapiens; identical to SEQ ID NO: 269453

SEQ ID NO: 595437 - RNA, 64 nt, Homo Sapiens; identical to SEQ ID NO: 269454

SEQ ID NO: 595438 - RNA, 64 nt, Homo Sapiens; identical to SEQ ID NO: 269455

SEQ ID NO: 595439 - RNA, 64 nt, Homo Sapiens; identical to SEQ ID NO: 269456

SEQ ID NO: 595440 - RNA, 64 nt, Homo Sapiens; identical to SEQ ID NO: 269457

SEQ ID NO: 595441 - RNA, 64 nt, Homo Sapiens; identical to SEQ ID NO: 269458

SEQ ID NO: 595442 - RNA, 64 nt, Homo Sapiens; identical to SEQ ID NO: 269459

SEQ ID NO: 595443 - RNA, 64 nt, Homo Sapiens; identical to SEQ ID NO: 269460

SEQ ID NO: 595444 - RNA, 64 nt, Homo Sapiens; identical to SEQ ID NO: 269461

SEQ ID NO: 595445 - RNA, 64 nt, Homo Sapiens; identical to SEQ ID NO: 269462

SEQ ID NO: 595446 - RNA, 64 nt, Homo Sapiens; identical to SEQ ID NO: 269463

SEQ ID NO: 595447 - RNA, 64 nt, Homo Sapiens; identical to SEQ ID NO: 269464

SEQ ID NO: 595448 - RNA, 64 nt, Homo Sapiens; identical to SEQ ID NO: 269465

SEQ ID NO: 595449 - RNA, 64 nt, Homo Sapiens; identical to SEQ ID NO: 269466

SEQ ID NO: 595450 - RNA, 64 nt, Homo Sapiens; identical to SEQ ID NO: 269467

SEQ ID NO: 595451 - RNA, 64 nt, Homo Sapiens; identical to SEQ ID NO: 269468

SEQ ID NO: 595452 - RNA, 64 nt, Homo Sapiens; identical to SEQ ID NO: 269469

SEQ ID NO: 595453 - RNA, 64 nt, Homo Sapiens; identical to SEQ ID NO: 269470

SEQ ID NO: 595454 - RNA, 56 nt, Homo Sapiens; identical to SEQ ID NO: 269471

SEQ ID NO: 595455 - RNA, 64 nt, Homo Sapiens; identical to SEQ ID NO: 269472

SEQ ID NO: 595456 - RNA, 64 nt, Homo Sapiens; identical to SEQ ID NO: 269473

SEQ ID NO: 595457 - RNA, 64 nt, Homo Sapiens; identical to SEQ ID NO: 269474

SEQ ID NO: 595458 - RNA, 64 nt, Homo Sapiens; identical to SEQ ID NO: 269475

SEQ ID NO: 595459 - RNA, 64 nt, Homo Sapiens; identical to SEQ ID NO: 269476

SEQ ID NO: 595460 - RNA, 64 nt, Homo Sapiens; identical to SEQ ID NO: 269477

SEQ ID NO: 595461 - RNA, 64 nt, Homo Sapiens; identical to SEQ ID NO: 269478

SEQ ID NO: 595462 - RNA, 64 nt, Homo Sapiens; identical to SEQ ID NO: 269479

SEQ ID NO: 595463 - RNA, 64 nt, Homo Sapiens; identical to SEQ ID NO: 269480

SEQ ID NO: 595464 - RNA, 64 nt, Homo Sapiens; identical to SEQ ID NO: 269481

SEQ ID NO: 595465 - RNA, 64 nt, Homo Sapiens; identical to SEQ ID NO: 269482

SEQ ID NO: 595466 - RNA, 64 nt, Homo Sapiens; identical to SEQ ID NO: 269483

SEQ ID NO: 595467 - RNA, 64 nt, Homo Sapiens; identical to SEQ ID NO: 269484

SEQ ID NO: 595468 - RNA, 64 nt, Homo Sapiens; identical to SEQ ID NO: 269485

SEQ ID NO: 595469 - RNA, 64 nt, Homo Sapiens; identical to SEQ ID NO: 269486

SEQ ID NO: 595470 - RNA, 64 nt, Homo Sapiens; identical to SEQ ID NO: 269487

SEQ ID NO: 595471 - RNA, 64 nt, Homo Sapiens; identical to SEQ ID NO: 269488

SEQ ID NO: 595472 - RNA, 64 nt, Homo Sapiens; identical to SEQ ID NO: 269489

SEQ ID NO: 595473 - RNA, 64 nt, Homo Sapiens; identical to SEQ ID NO: 269490

SEQ ID NO: 595474 - RNA, 64 nt, Homo Sapiens; identical to SEQ ID NO: 269491

SEQ ID NO: 595475 - RNA, 64 nt, Homo Sapiens; identical to SEQ ID NO: 269492

SEQ ID NO: 595476 - RNA, 64 nt, Homo Sapiens; identical to SEQ ID NO: 269493

SEQ ID NO: 595477 - RNA, 64 nt, Homo Sapiens; identical to SEQ ID NO: 269494

SEQ ID NO: 595478 - RNA, 64 nt, Homo Sapiens; identical to SEQ ID NO: 269495

SEQ ID NO: 595479 - RNA, 64 nt, Homo Sapiens; identical to SEQ ID NO: 269496

SEQ ID NO: 595480 - RNA, 64 nt, Homo Sapiens; identical to SEQ ID NO: 269497

SEQ ID NO: 595481 - RNA, 64 nt, Homo Sapiens; identical to SEQ ID NO: 269498

SEQ ID NO: 595482 - RNA, 64 nt, Homo Sapiens; identical to SEQ ID NO: 269499

SEQ ID NO: 595483 - RNA, 64 nt, Homo Sapiens; identical to SEQ ID NO: 269500

SEQ ID NO: 595484 - RNA, 64 nt, Homo Sapiens; identical to SEQ ID NO: 269501

SEQ ID NO: 595485 - RNA, 64 nt, Homo Sapiens; identical to SEQ ID NO: 269502

SEQ ID NO: 595486 - RNA, 64 nt, Homo Sapiens; identical to SEQ ID NO: 269503

SEQ ID NO: 595487 - RNA, 64 nt, Homo Sapiens; identical to SEQ ID NO: 269504

SEQ ID NO: 595488 - RNA, 64 nt, Homo Sapiens; identical to SEQ ID NO: 269505

SEQ ID NO: 595489 - RNA, 64 nt, Homo Sapiens; identical to SEQ ID NO: 269506

SEQ ID NO: 595490 - RNA, 64 nt, Homo Sapiens; identical to SEQ ID NO: 269507

SEQ ID NO: 595491 - RNA, 64 nt, Homo Sapiens; identical to SEQ ID NO: 269508

SEQ ID NO: 595492 - RNA, 64 nt, Homo Sapiens; identical to SEQ ID NO: 269509

SEQ ID NO: 595493 - RNA, 64 nt, Homo Sapiens; identical to SEQ ID NO: 269510

SEQ ID NO: 595494 - RNA, 64 nt, Homo Sapiens; identical to SEQ ID NO: 269511

SEQ ID NO: 595495 - RNA, 64 nt, Homo Sapiens; identical to SEQ ID NO: 269512

SEQ ID NO: 595496 - RNA, 64 nt, Homo Sapiens; identical to SEQ ID NO: 269513

SEQ ID NO: 595497 - RNA, 64 nt, Homo Sapiens; identical to SEQ ID NO: 269514

SEQ ID NO: 595498 - RNA, 64 nt, Homo Sapiens; identical to SEQ ID NO: 269515

SEQ ID NO: 595499 - RNA, 64 nt, Homo Sapiens; identical to SEQ ID NO: 269516

SEQ ID NO: 595500 - RNA, 64 nt, Homo Sapiens; identical to SEQ ID NO: 269517

SEQ ID NO: 595501 - RNA, 64 nt, Homo Sapiens; identical to SEQ ID NO: 269518

SEQ ID NO: 595502 - RNA, 64 nt, Homo Sapiens; identical to SEQ ID NO: 269519

SEQ ID NO: 595503 - RNA, 64 nt, Homo Sapiens; identical to SEQ ID NO: 269520

SEQ ID NO: 595504 - RNA, 64 nt, Homo Sapiens; identical to SEQ ID NO: 269521

SEQ ID NO: 595505 - RNA, 64 nt, Homo Sapiens; identical to SEQ ID NO: 269522

SEQ ID NO: 595506 - RNA, 64 nt, Homo Sapiens; identical to SEQ ID NO: 269523

SEQ ID NO: 595507 - RNA, 64 nt, Homo Sapiens; identical to SEQ ID NO: 269524

SEQ ID NO: 595508 - RNA, 64 nt, Homo Sapiens; identical to SEQ ID NO: 269525

SEQ ID NO: 595509 - RNA, 64 nt, Homo Sapiens; identical to SEQ ID NO: 269526

SEQ ID NO: 595510 - RNA, 64 nt, Homo Sapiens; identical to SEQ ID NO: 269527

SEQ ID NO: 595511 - RNA, 64 nt, Homo Sapiens; identical to SEQ ID NO: 269528

SEQ ID NO: 595512 - RNA, 64 nt, Homo Sapiens; identical to SEQ ID NO: 269529

SEQ ID NO: 595513 - RNA, 64 nt, Homo Sapiens; identical to SEQ ID NO: 269530

SEQ ID NO: 595514 - RNA, 64 nt, Homo Sapiens; identical to SEQ ID NO: 269531

SEQ ID NO: 595515 - RNA, 64 nt, Homo Sapiens; identical to SEQ ID NO: 269532

SEQ ID NO: 595516 - RNA, 64 nt, Homo Sapiens; identical to SEQ ID NO: 269533

SEQ ID NO: 595517 - RNA, 64 nt, Homo Sapiens; identical to SEQ ID NO: 269534

SEQ ID NO: 595518 - RNA, 64 nt, Homo Sapiens; identical to SEQ ID NO: 269535

SEQ ID NO: 595519 - RNA, 64 nt, Homo Sapiens; identical to SEQ ID NO: 269536

SEQ ID NO: 595520 - RNA, 64 nt, Homo Sapiens; identical to SEQ ID NO: 269537

SEQ ID NO: 595521 - RNA, 64 nt, Homo Sapiens; identical to SEQ ID NO: 269538

SEQ ID NO: 595522 - RNA, 64 nt, Homo Sapiens; identical to SEQ ID NO: 269539

SEQ ID NO: 595523 - RNA, 64 nt, Homo Sapiens; identical to SEQ ID NO: 269540

SEQ ID NO: 595524 - RNA, 64 nt, Homo Sapiens; identical to SEQ ID NO: 269541

SEQ ID NO: 595525 - RNA, 64 nt, Homo Sapiens; identical to SEQ ID NO: 269542

SEQ ID NO: 595526 - RNA, 64 nt, Homo Sapiens; identical to SEQ ID NO: 269543

SEQ ID NO: 595527 - RNA, 64 nt, Homo Sapiens; identical to SEQ ID NO: 269544

SEQ ID NO: 595528 - RNA, 64 nt, Homo Sapiens; identical to SEQ ID NO: 269545

SEQ ID NO: 595529 - RNA, 64 nt, Homo Sapiens; identical to SEQ ID NO: 269546

SEQ ID NO: 595530 - RNA, 64 nt, Homo Sapiens; identical to SEQ ID NO: 269547

SEQ ID NO: 595531 - RNA, 64 nt, Homo Sapiens; identical to SEQ ID NO: 269548

SEQ ID NO: 595532 - RNA, 64 nt, Homo Sapiens; identical to SEQ ID NO: 269549

SEQ ID NO: 595533 - RNA, 64 nt, Homo Sapiens; identical to SEQ ID NO: 269550

SEQ ID NO: 595534 - RNA, 64 nt, Homo Sapiens; identical to SEQ ID NO: 269551

SEQ ID NO: 595535 - RNA, 64 nt, Homo Sapiens; identical to SEQ ID NO: 269552

SEQ ID NO: 595536 - RNA, 64 nt, Homo Sapiens; identical to SEQ ID NO: 269553

SEQ ID NO: 595537 - RNA, 64 nt, Homo Sapiens; identical to SEQ ID NO: 269554

SEQ ID NO: 595538 - RNA, 64 nt, Homo Sapiens; identical to SEQ ID NO: 269555

SEQ ID NO: 595539 - RNA, 64 nt, Homo Sapiens; identical to SEQ ID NO: 269556

SEQ ID NO: 595540 - RNA, 64 nt, Homo Sapiens; identical to SEQ ID NO: 269557

SEQ ID NO: 595541 - RNA, 64 nt, Homo Sapiens; identical to SEQ ID NO: 269558

SEQ ID NO: 595542 - RNA, 64 nt, Homo Sapiens; identical to SEQ ID NO: 269559

SEQ ID NO: 595543 - RNA, 64 nt, Homo Sapiens; identical to SEQ ID NO: 269560

SEQ ID NO: 595544 - RNA, 64 nt, Homo Sapiens; identical to SEQ ID NO: 269561

SEQ ID NO: 595545 - RNA, 64 nt, Homo Sapiens; identical to SEQ ID NO: 269562

SEQ ID NO: 595546 - RNA, 64 nt, Homo Sapiens; identical to SEQ ID NO: 269563

SEQ ID NO: 595547 - RNA, 64 nt, Homo Sapiens; identical to SEQ ID NO: 269564

SEQ ID NO: 595548 - RNA, 64 nt, Homo Sapiens; identical to SEQ ID NO: 269565

SEQ ID NO: 595549 - RNA, 64 nt, Homo Sapiens; identical to SEQ ID NO: 269566

SEQ ID NO: 595550 - RNA, 64 nt, Homo Sapiens; identical to SEQ ID NO: 269567

SEQ ID NO: 595551 - RNA, 64 nt, Homo Sapiens; identical to SEQ ID NO: 269568

SEQ ID NO: 595552 - RNA, 64 nt, Homo Sapiens; identical to SEQ ID NO: 269569

SEQ ID NO: 595553 - RNA, 64 nt, Homo Sapiens; identical to SEQ ID NO: 269570

SEQ ID NO: 595554 - RNA, 64 nt, Homo Sapiens; identical to SEQ ID NO: 269571

SEQ ID NO: 595555 - RNA, 64 nt, Homo Sapiens; identical to SEQ ID NO: 269572

SEQ ID NO: 595556 - RNA, 64 nt, Homo Sapiens; identical to SEQ ID NO: 269573

SEQ ID NO: 595557 - RNA, 64 nt, Homo Sapiens; identical to SEQ ID NO: 269574

SEQ ID NO: 595558 - RNA, 64 nt, Homo Sapiens; identical to SEQ ID NO: 269575

SEQ ID NO: 595559 - RNA, 64 nt, Homo Sapiens; identical to SEQ ID NO: 269576

SEQ ID NO: 595560 - RNA, 64 nt, Homo Sapiens; identical to SEQ ID NO: 269577

SEQ ID NO: 595561 - RNA, 64 nt, Homo Sapiens; identical to SEQ ID NO: 269578

SEQ ID NO: 595562 - RNA, 64 nt, Homo Sapiens; identical to SEQ ID NO: 269579

SEQ ID NO: 595563 - RNA, 64 nt, Homo Sapiens; identical to SEQ ID NO: 269580

SEQ ID NO: 595564 - RNA, 64 nt, Homo Sapiens; identical to SEQ ID NO: 269581

SEQ ID NO: 595565 - RNA, 64 nt, Homo Sapiens; identical to SEQ ID NO: 269582

SEQ ID NO: 595566 - RNA, 64 nt, Homo Sapiens; identical to SEQ ID NO: 269583

SEQ ID NO: 595567 - RNA, 64 nt, Homo Sapiens; identical to SEQ ID NO: 269584

SEQ ID NO: 595568 - RNA, 64 nt, Homo Sapiens; identical to SEQ ID NO: 269585

SEQ ID NO: 595569 - RNA, 64 nt, Homo Sapiens; identical to SEQ ID NO: 269586

SEQ ID NO: 595570 - RNA, 64 nt, Homo Sapiens; identical to SEQ ID NO: 269587

SEQ ID NO: 595571 - RNA, 64 nt, Homo Sapiens; identical to SEQ ID NO: 269588

SEQ ID NO: 595572 - RNA, 64 nt, Homo Sapiens; identical to SEQ ID NO: 269589

SEQ ID NO: 595573 - RNA, 64 nt, Homo Sapiens; identical to SEQ ID NO: 269590

SEQ ID NO: 595574 - RNA, 64 nt, Homo Sapiens; identical to SEQ ID NO: 269591

SEQ ID NO: 595575 - RNA, 64 nt, Homo Sapiens; identical to SEQ ID NO: 269592

SEQ ID NO: 595576 - RNA, 64 nt, Homo Sapiens; identical to SEQ ID NO: 269593

SEQ ID NO: 595577 - RNA, 64 nt, Homo Sapiens; identical to SEQ ID NO: 269594

SEQ ID NO: 595578 - RNA, 64 nt, Homo Sapiens; identical to SEQ ID NO: 269595

SEQ ID NO: 595579 - RNA, 64 nt, Homo Sapiens; identical to SEQ ID NO: 269596

SEQ ID NO: 595580 - RNA, 64 nt, Homo Sapiens; identical to SEQ ID NO: 269597

SEQ ID NO: 595581 - RNA, 64 nt, Homo Sapiens; identical to SEQ ID NO: 269598

SEQ ID NO: 595582 - RNA, 64 nt, Homo Sapiens; identical to SEQ ID NO: 269599

SEQ ID NO: 595583 - RNA, 64 nt, Homo Sapiens; identical to SEQ ID NO: 269600

SEQ ID NO: 595584 - RNA, 64 nt, Homo Sapiens; identical to SEQ ID NO: 269601

SEQ ID NO: 595585 - RNA, 64 nt, Homo Sapiens; identical to SEQ ID NO: 269602

SEQ ID NO: 595586 - RNA, 64 nt, Homo Sapiens; identical to SEQ ID NO: 269603

SEQ ID NO: 595587 - RNA, 64 nt, Homo Sapiens; identical to SEQ ID NO: 269604

SEQ ID NO: 595588 - RNA, 64 nt, Homo Sapiens; identical to SEQ ID NO: 269605

SEQ ID NO: 595589 - RNA, 64 nt, Homo Sapiens; identical to SEQ ID NO: 269606

SEQ ID NO: 595590 - RNA, 64 nt, Homo Sapiens; identical to SEQ ID NO: 269607

SEQ ID NO: 595591 - RNA, 64 nt, Homo Sapiens; identical to SEQ ID NO: 269608

SEQ ID NO: 595592 - RNA, 64 nt, Homo Sapiens; identical to SEQ ID NO: 269609

SEQ ID NO: 595593 - RNA, 64 nt, Homo Sapiens; identical to SEQ ID NO: 269610

SEQ ID NO: 595594 - RNA, 64 nt, Homo Sapiens; identical to SEQ ID NO: 269611

SEQ ID NO: 595595 - RNA, 64 nt, Homo Sapiens; identical to SEQ ID NO: 269612

SEQ ID NO: 595596 - RNA, 64 nt, Homo Sapiens; identical to SEQ ID NO: 269613

SEQ ID NO: 595597 - RNA, 64 nt, Homo Sapiens; identical to SEQ ID NO: 269614

SEQ ID NO: 595598 - RNA, 64 nt, Homo Sapiens; identical to SEQ ID NO: 269615

SEQ ID NO: 595599 - RNA, 64 nt, Homo Sapiens; identical to SEQ ID NO: 269616

SEQ ID NO: 595600 - RNA, 64 nt, Homo Sapiens; identical to SEQ ID NO: 269617

SEQ ID NO: 595601 - RNA, 64 nt, Homo Sapiens; identical to SEQ ID NO: 269618

SEQ ID NO: 595602 - RNA, 64 nt, Homo Sapiens; identical to SEQ ID NO: 269619

SEQ ID NO: 595603 - RNA, 64 nt, Homo Sapiens; identical to SEQ ID NO: 269620

SEQ ID NO: 595604 - RNA, 64 nt, Homo Sapiens; identical to SEQ ID NO: 269621

SEQ ID NO: 595605 - RNA, 64 nt, Homo Sapiens; identical to SEQ ID NO: 269622

SEQ ID NO: 595606 - RNA, 64 nt, Homo Sapiens; identical to SEQ ID NO: 269623

SEQ ID NO: 595607 - RNA, 64 nt, Homo Sapiens; identical to SEQ ID NO: 269624

SEQ ID NO: 595608 - RNA, 64 nt, Homo Sapiens; identical to SEQ ID NO: 269625

SEQ ID NO: 595609 - RNA, 64 nt, Homo Sapiens; identical to SEQ ID NO: 269626

SEQ ID NO: 595610 - RNA, 64 nt, Homo Sapiens; identical to SEQ ID NO: 269627

SEQ ID NO: 595611 - RNA, 64 nt, Homo Sapiens; identical to SEQ ID NO: 269628

SEQ ID NO: 595612 - RNA, 64 nt, Homo Sapiens; identical to SEQ ID NO: 269629

SEQ ID NO: 595613 - RNA, 64 nt, Homo Sapiens; identical to SEQ ID NO: 269630

SEQ ID NO: 595614 - RNA, 64 nt, Homo Sapiens; identical to SEQ ID NO: 269631

SEQ ID NO: 595615 - RNA, 64 nt, Homo Sapiens; identical to SEQ ID NO: 269632

SEQ ID NO: 595616 - RNA, 64 nt, Homo Sapiens; identical to SEQ ID NO: 269633

SEQ ID NO: 595617 - RNA, 64 nt, Homo Sapiens; identical to SEQ ID NO: 269634

SEQ ID NO: 595618 - RNA, 64 nt, Homo Sapiens; identical to SEQ ID NO: 269635

SEQ ID NO: 595619 - RNA, 64 nt, Homo Sapiens; identical to SEQ ID NO: 269636

SEQ ID NO: 595620 - RNA, 64 nt, Homo Sapiens; identical to SEQ ID NO: 269637

SEQ ID NO: 595621 - RNA, 64 nt, Homo Sapiens; identical to SEQ ID NO: 269638

SEQ ID NO: 595622 - RNA, 64 nt, Homo Sapiens; identical to SEQ ID NO: 269639

SEQ ID NO: 595623 - RNA, 64 nt, Homo Sapiens; identical to SEQ ID NO: 269640

SEQ ID NO: 595624 - RNA, 64 nt, Homo Sapiens; identical to SEQ ID NO: 269641

SEQ ID NO: 595625 - RNA, 64 nt, Homo Sapiens; identical to SEQ ID NO: 269642

SEQ ID NO: 595626 - RNA, 64 nt, Homo Sapiens; identical to SEQ ID NO: 269643

SEQ ID NO: 595627 - RNA, 64 nt, Homo Sapiens; identical to SEQ ID NO: 269644

SEQ ID NO: 595628 - RNA, 64 nt, Homo Sapiens; identical to SEQ ID NO: 269645

SEQ ID NO: 595629 - RNA, 64 nt, Homo Sapiens; identical to SEQ ID NO: 269646

SEQ ID NO: 595630 - RNA, 64 nt, Homo Sapiens; identical to SEQ ID NO: 269647

SEQ ID NO: 595631 - RNA, 64 nt, Homo Sapiens; identical to SEQ ID NO: 269648

SEQ ID NO: 595632 - RNA, 64 nt, Homo Sapiens; identical to SEQ ID NO: 269649

SEQ ID NO: 595633 - RNA, 64 nt, Homo Sapiens; identical to SEQ ID NO: 269650

SEQ ID NO: 595634 - RNA, 64 nt, Homo Sapiens; identical to SEQ ID NO: 269651

SEQ ID NO: 595635 - RNA, 64 nt, Homo Sapiens; identical to SEQ ID NO: 269652

SEQ ID NO: 595636 - RNA, 64 nt, Homo Sapiens; identical to SEQ ID NO: 269653

SEQ ID NO: 595637 - RNA, 64 nt, Homo Sapiens; identical to SEQ ID NO: 269654

SEQ ID NO: 595638 - RNA, 64 nt, Homo Sapiens; identical to SEQ ID NO: 269655

SEQ ID NO: 595639 - RNA, 64 nt, Homo Sapiens; identical to SEQ ID NO: 269656

SEQ ID NO: 595640 - RNA, 64 nt, Homo Sapiens; identical to SEQ ID NO: 269657

SEQ ID NO: 595641 - RNA, 64 nt, Homo Sapiens; identical to SEQ ID NO: 269658

SEQ ID NO: 595642 - RNA, 64 nt, Homo Sapiens; identical to SEQ ID NO: 269659

SEQ ID NO: 595643 - RNA, 64 nt, Homo Sapiens; identical to SEQ ID NO: 269660

SEQ ID NO: 595644 - RNA, 64 nt, Homo Sapiens; identical to SEQ ID NO: 269661

SEQ ID NO: 595645 - RNA, 64 nt, Homo Sapiens; identical to SEQ ID NO: 269662

SEQ ID NO: 595646 - RNA, 64 nt, Homo Sapiens; identical to SEQ ID NO: 269663

SEQ ID NO: 595647 - RNA, 64 nt, Homo Sapiens; identical to SEQ ID NO: 269664

SEQ ID NO: 595648 - RNA, 64 nt, Homo Sapiens; identical to SEQ ID NO: 269665

SEQ ID NO: 595649 - RNA, 64 nt, Homo Sapiens; identical to SEQ ID NO: 269666

SEQ ID NO: 595650 - RNA, 64 nt, Homo Sapiens; identical to SEQ ID NO: 269667

SEQ ID NO: 595651 - RNA, 64 nt, Homo Sapiens; identical to SEQ ID NO: 269668

SEQ ID NO: 595652 - RNA, 64 nt, Homo Sapiens; identical to SEQ ID NO: 269669

SEQ ID NO: 595653 - RNA, 64 nt, Homo Sapiens; identical to SEQ ID NO: 269670

SEQ ID NO: 595654 - RNA, 64 nt, Homo Sapiens; identical to SEQ ID NO: 269671

SEQ ID NO: 595655 - RNA, 64 nt, Homo Sapiens; identical to SEQ ID NO: 269672

SEQ ID NO: 595656 - RNA, 64 nt, Homo Sapiens; identical to SEQ ID NO: 269673

SEQ ID NO: 595657 - RNA, 64 nt, Homo Sapiens; identical to SEQ ID NO: 269674

SEQ ID NO: 595658 - RNA, 64 nt, Homo Sapiens; identical to SEQ ID NO: 269675

SEQ ID NO: 595659 - RNA, 64 nt, Homo Sapiens; identical to SEQ ID NO: 269676

SEQ ID NO: 595660 - RNA, 64 nt, Homo Sapiens; identical to SEQ ID NO: 269677

SEQ ID NO: 595661 - RNA, 64 nt, Homo Sapiens; identical to SEQ ID NO: 269678

SEQ ID NO: 595662 - RNA, 64 nt, Homo Sapiens; identical to SEQ ID NO: 269679

SEQ ID NO: 595663 - RNA, 64 nt, Homo Sapiens; identical to SEQ ID NO: 269680

SEQ ID NO: 595664 - RNA, 64 nt, Homo Sapiens; identical to SEQ ID NO: 269681

SEQ ID NO: 595665 - RNA, 64 nt, Homo Sapiens; identical to SEQ ID NO: 269682

SEQ ID NO: 595666 - RNA, 64 nt, Homo Sapiens; identical to SEQ ID NO: 269683

SEQ ID NO: 595667 - RNA, 64 nt, Homo Sapiens; identical to SEQ ID NO: 269684

SEQ ID NO: 595668 - RNA, 64 nt, Homo Sapiens; identical to SEQ ID NO: 269685

SEQ ID NO: 595669 - RNA, 64 nt, Homo Sapiens; identical to SEQ ID NO: 269686

SEQ ID NO: 595670 - RNA, 64 nt, Homo Sapiens; identical to SEQ ID NO: 269687

SEQ ID NO: 595671 - RNA, 64 nt, Homo Sapiens; identical to SEQ ID NO: 269688

SEQ ID NO: 595672 - RNA, 64 nt, Homo Sapiens; identical to SEQ ID NO: 269689

SEQ ID NO: 595673 - RNA, 64 nt, Homo Sapiens; identical to SEQ ID NO: 269690

SEQ ID NO: 595674 - RNA, 64 nt, Homo Sapiens; identical to SEQ ID NO: 269691

SEQ ID NO: 595675 - RNA, 64 nt, Homo Sapiens; identical to SEQ ID NO: 269692

SEQ ID NO: 595676 - RNA, 64 nt, Homo Sapiens; identical to SEQ ID NO: 269693

SEQ ID NO: 595677 - RNA, 64 nt, Homo Sapiens; identical to SEQ ID NO: 269694

SEQ ID NO: 595678 - RNA, 64 nt, Homo Sapiens; identical to SEQ ID NO: 269695

SEQ ID NO: 595679 - RNA, 64 nt, Homo Sapiens; identical to SEQ ID NO: 269696

SEQ ID NO: 595680 - RNA, 64 nt, Homo Sapiens; identical to SEQ ID NO: 269697

SEQ ID NO: 595681 - RNA, 64 nt, Homo Sapiens; identical to SEQ ID NO: 269698

SEQ ID NO: 595682 - RNA, 64 nt, Homo Sapiens; identical to SEQ ID NO: 269699

SEQ ID NO: 595683 - RNA, 64 nt, Homo Sapiens; identical to SEQ ID NO: 269700

SEQ ID NO: 595684 - RNA, 64 nt, Homo Sapiens; identical to SEQ ID NO: 269701

SEQ ID NO: 595685 - RNA, 64 nt, Homo Sapiens; identical to SEQ ID NO: 269702

SEQ ID NO: 595686 - RNA, 64 nt, Homo Sapiens; identical to SEQ ID NO: 269703

SEQ ID NO: 595687 - RNA, 64 nt, Homo Sapiens; identical to SEQ ID NO: 269704

SEQ ID NO: 595688 - RNA, 64 nt, Homo Sapiens; identical to SEQ ID NO: 269705

SEQ ID NO: 595689 - RNA, 64 nt, Homo Sapiens; identical to SEQ ID NO: 269706

SEQ ID NO: 595690 - RNA, 64 nt, Homo Sapiens; identical to SEQ ID NO: 269707

SEQ ID NO: 595691 - RNA, 64 nt, Homo Sapiens; identical to SEQ ID NO: 269708

SEQ ID NO: 595692 - RNA, 64 nt, Homo Sapiens; identical to SEQ ID NO: 269709

SEQ ID NO: 595693 - RNA, 64 nt, Homo Sapiens; identical to SEQ ID NO: 269710

SEQ ID NO: 595694 - RNA, 64 nt, Homo Sapiens; identical to SEQ ID NO: 269711

SEQ ID NO: 595695 - RNA, 64 nt, Homo Sapiens; identical to SEQ ID NO: 269712

SEQ ID NO: 595696 - RNA, 64 nt, Homo Sapiens; identical to SEQ ID NO: 269713

SEQ ID NO: 595697 - RNA, 64 nt, Homo Sapiens; identical to SEQ ID NO: 269714

SEQ ID NO: 595698 - RNA, 64 nt, Homo Sapiens; identical to SEQ ID NO: 269715

SEQ ID NO: 595699 - RNA, 64 nt, Homo Sapiens; identical to SEQ ID NO: 269716

SEQ ID NO: 595700 - RNA, 64 nt, Homo Sapiens; identical to SEQ ID NO: 269717

SEQ ID NO: 595701 - RNA, 64 nt, Homo Sapiens; identical to SEQ ID NO: 269718

SEQ ID NO: 595702 - RNA, 64 nt, Homo Sapiens; identical to SEQ ID NO: 269719

SEQ ID NO: 595703 - RNA, 64 nt, Homo Sapiens; identical to SEQ ID NO: 269720

SEQ ID NO: 595704 - RNA, 64 nt, Homo Sapiens; identical to SEQ ID NO: 269721

SEQ ID NO: 595705 - RNA, 64 nt, Homo Sapiens; identical to SEQ ID NO: 269722

SEQ ID NO: 595706 - RNA, 64 nt, Homo Sapiens; identical to SEQ ID NO: 269723

SEQ ID NO: 595707 - RNA, 64 nt, Homo Sapiens; identical to SEQ ID NO: 269724

SEQ ID NO: 595708 - RNA, 64 nt, Homo Sapiens; identical to SEQ ID NO: 269725

SEQ ID NO: 595709 - RNA, 64 nt, Homo Sapiens; identical to SEQ ID NO: 269726

SEQ ID NO: 595710 - RNA, 64 nt, Homo Sapiens; identical to SEQ ID NO: 269727

SEQ ID NO: 595711 - RNA, 64 nt, Homo Sapiens; identical to SEQ ID NO: 269728

SEQ ID NO: 595712 - RNA, 64 nt, Homo Sapiens; identical to SEQ ID NO: 269729

SEQ ID NO: 595713 - RNA, 64 nt, Homo Sapiens; identical to SEQ ID NO: 269730

SEQ ID NO: 595714 - RNA, 64 nt, Homo Sapiens; identical to SEQ ID NO: 269731

SEQ ID NO: 595715 - RNA, 64 nt, Homo Sapiens; identical to SEQ ID NO: 269732

SEQ ID NO: 595716 - RNA, 64 nt, Homo Sapiens; identical to SEQ ID NO: 269733

SEQ ID NO: 595717 - RNA, 64 nt, Homo Sapiens; identical to SEQ ID NO: 269734

SEQ ID NO: 595718 - RNA, 64 nt, Homo Sapiens; identical to SEQ ID NO: 269735

SEQ ID NO: 595719 - RNA, 64 nt, Homo Sapiens; identical to SEQ ID NO: 269736

SEQ ID NO: 595720 - RNA, 64 nt, Homo Sapiens; identical to SEQ ID NO: 269737

SEQ ID NO: 595721 - RNA, 64 nt, Homo Sapiens; identical to SEQ ID NO: 269738

SEQ ID NO: 595722 - RNA, 64 nt, Homo Sapiens; identical to SEQ ID NO: 269739

SEQ ID NO: 595723 - RNA, 64 nt, Homo Sapiens; identical to SEQ ID NO: 269740

SEQ ID NO: 595724 - RNA, 64 nt, Homo Sapiens; identical to SEQ ID NO: 269741

SEQ ID NO: 595725 - RNA, 64 nt, Homo Sapiens; identical to SEQ ID NO: 269742

SEQ ID NO: 595726 - RNA, 64 nt, Homo Sapiens; identical to SEQ ID NO: 269743

SEQ ID NO: 595727 - RNA, 64 nt, Homo Sapiens; identical to SEQ ID NO: 269744

SEQ ID NO: 595728 - RNA, 64 nt, Homo Sapiens; identical to SEQ ID NO: 269745

SEQ ID NO: 595729 - RNA, 64 nt, Homo Sapiens; identical to SEQ ID NO: 269746

SEQ ID NO: 595730 - RNA, 64 nt, Homo Sapiens; identical to SEQ ID NO: 269747

SEQ ID NO: 595731 - RNA, 64 nt, Homo Sapiens; identical to SEQ ID NO: 269748

SEQ ID NO: 595732 - RNA, 64 nt, Homo Sapiens; identical to SEQ ID NO: 269749

SEQ ID NO: 595733 - RNA, 64 nt, Homo Sapiens; identical to SEQ ID NO: 269750

SEQ ID NO: 595734 - RNA, 64 nt, Homo Sapiens; identical to SEQ ID NO: 269751

SEQ ID NO: 595735 - RNA, 64 nt, Homo Sapiens; identical to SEQ ID NO: 269752

SEQ ID NO: 595736 - RNA, 64 nt, Homo Sapiens; identical to SEQ ID NO: 269753

SEQ ID NO: 595737 - RNA, 64 nt, Homo Sapiens; identical to SEQ ID NO: 269754

SEQ ID NO: 595738 - RNA, 64 nt, Homo Sapiens; identical to SEQ ID NO: 269755

SEQ ID NO: 595739 - RNA, 64 nt, Homo Sapiens; identical to SEQ ID NO: 269756

SEQ ID NO: 595740 - RNA, 64 nt, Homo Sapiens; identical to SEQ ID NO: 269757

SEQ ID NO: 595741 - RNA, 64 nt, Homo Sapiens; identical to SEQ ID NO: 269758

SEQ ID NO: 595742 - RNA, 64 nt, Homo Sapiens; identical to SEQ ID NO: 269759

SEQ ID NO: 595743 - RNA, 64 nt, Homo Sapiens; identical to SEQ ID NO: 269760

SEQ ID NO: 595744 - RNA, 64 nt, Homo Sapiens; identical to SEQ ID NO: 269761

SEQ ID NO: 595745 - RNA, 64 nt, Homo Sapiens; identical to SEQ ID NO: 269762

SEQ ID NO: 595746 - RNA, 64 nt, Homo Sapiens; identical to SEQ ID NO: 269763

SEQ ID NO: 595747 - RNA, 64 nt, Homo Sapiens; identical to SEQ ID NO: 269764

SEQ ID NO: 595748 - RNA, 64 nt, Homo Sapiens; identical to SEQ ID NO: 269765

SEQ ID NO: 595749 - RNA, 64 nt, Homo Sapiens; identical to SEQ ID NO: 269766

SEQ ID NO: 595750 - RNA, 64 nt, Homo Sapiens; identical to SEQ ID NO: 269767

SEQ ID NO: 595751 - RNA, 64 nt, Homo Sapiens; identical to SEQ ID NO: 269768

SEQ ID NO: 595752 - RNA, 64 nt, Homo Sapiens; identical to SEQ ID NO: 269769

SEQ ID NO: 595753 - RNA, 64 nt, Homo Sapiens; identical to SEQ ID NO: 269770

SEQ ID NO: 595754 - RNA, 64 nt, Homo Sapiens; identical to SEQ ID NO: 269771

SEQ ID NO: 595755 - RNA, 64 nt, Homo Sapiens; identical to SEQ ID NO: 269772

SEQ ID NO: 595756 - RNA, 64 nt, Homo Sapiens; identical to SEQ ID NO: 269773

SEQ ID NO: 595757 - RNA, 64 nt, Homo Sapiens; identical to SEQ ID NO: 269774

SEQ ID NO: 595758 - RNA, 64 nt, Homo Sapiens; identical to SEQ ID NO: 269775

SEQ ID NO: 595759 - RNA, 64 nt, Homo Sapiens; identical to SEQ ID NO: 269776

SEQ ID NO: 595760 - RNA, 64 nt, Homo Sapiens; identical to SEQ ID NO: 269777

SEQ ID NO: 595761 - RNA, 64 nt, Homo Sapiens; identical to SEQ ID NO: 269778

SEQ ID NO: 595762 - RNA, 64 nt, Homo Sapiens; identical to SEQ ID NO: 269779

SEQ ID NO: 595763 - RNA, 64 nt, Homo Sapiens; identical to SEQ ID NO: 269780

SEQ ID NO: 595764 - RNA, 64 nt, Homo Sapiens; identical to SEQ ID NO: 269781

SEQ ID NO: 595765 - RNA, 64 nt, Homo Sapiens; identical to SEQ ID NO: 269782

SEQ ID NO: 595766 - RNA, 64 nt, Homo Sapiens; identical to SEQ ID NO: 269783

SEQ ID NO: 595767 - RNA, 64 nt, Homo Sapiens; identical to SEQ ID NO: 269784

SEQ ID NO: 595768 - RNA, 64 nt, Homo Sapiens; identical to SEQ ID NO: 269785

SEQ ID NO: 595769 - RNA, 64 nt, Homo Sapiens; identical to SEQ ID NO: 269786

SEQ ID NO: 595770 - RNA, 64 nt, Homo Sapiens; identical to SEQ ID NO: 269787

SEQ ID NO: 595771 - RNA, 64 nt, Homo Sapiens; identical to SEQ ID NO: 269788

SEQ ID NO: 595772 - RNA, 64 nt, Homo Sapiens; identical to SEQ ID NO: 269789

SEQ ID NO: 595773 - RNA, 64 nt, Homo Sapiens; identical to SEQ ID NO: 269790

SEQ ID NO: 595774 - RNA, 64 nt, Homo Sapiens; identical to SEQ ID NO: 269791

SEQ ID NO: 595775 - RNA, 64 nt, Homo Sapiens; identical to SEQ ID NO: 269792

SEQ ID NO: 595776 - RNA, 64 nt, Homo Sapiens; identical to SEQ ID NO: 269793

SEQ ID NO: 595777 - RNA, 64 nt, Homo Sapiens; identical to SEQ ID NO: 269794

SEQ ID NO: 595778 - RNA, 64 nt, Homo Sapiens; identical to SEQ ID NO: 269795

SEQ ID NO: 595779 - RNA, 64 nt, Homo Sapiens; identical to SEQ ID NO: 269796

SEQ ID NO: 595780 - RNA, 64 nt, Homo Sapiens; identical to SEQ ID NO: 269797

SEQ ID NO: 595781 - RNA, 64 nt, Homo Sapiens; identical to SEQ ID NO: 269798

SEQ ID NO: 595782 - RNA, 64 nt, Homo Sapiens; identical to SEQ ID NO: 269799

SEQ ID NO: 595783 - RNA, 64 nt, Homo Sapiens; identical to SEQ ID NO: 269800

SEQ ID NO: 595784 - RNA, 64 nt, Homo Sapiens; identical to SEQ ID NO: 269801

SEQ ID NO: 595785 - RNA, 64 nt, Homo Sapiens; identical to SEQ ID NO: 269802

SEQ ID NO: 595786 - RNA, 64 nt, Homo Sapiens; identical to SEQ ID NO: 269803

SEQ ID NO: 595787 - RNA, 64 nt, Homo Sapiens; identical to SEQ ID NO: 269804

SEQ ID NO: 595788 - RNA, 64 nt, Homo Sapiens; identical to SEQ ID NO: 269805

SEQ ID NO: 595789 - RNA, 64 nt, Homo Sapiens; identical to SEQ ID NO: 269806

SEQ ID NO: 595790 - RNA, 64 nt, Homo Sapiens; identical to SEQ ID NO: 269807

SEQ ID NO: 595791 - RNA, 64 nt, Homo Sapiens; identical to SEQ ID NO: 269808

SEQ ID NO: 595792 - RNA, 64 nt, Homo Sapiens; identical to SEQ ID NO: 269809

SEQ ID NO: 595793 - RNA, 64 nt, Homo Sapiens; identical to SEQ ID NO: 269810

SEQ ID NO: 595794 - RNA, 64 nt, Homo Sapiens; identical to SEQ ID NO: 269811

SEQ ID NO: 595795 - RNA, 64 nt, Homo Sapiens; identical to SEQ ID NO: 269812

SEQ ID NO: 595796 - RNA, 64 nt, Homo Sapiens; identical to SEQ ID NO: 269813

SEQ ID NO: 595797 - RNA, 64 nt, Homo Sapiens; identical to SEQ ID NO: 269814

SEQ ID NO: 595798 - RNA, 64 nt, Homo Sapiens; identical to SEQ ID NO: 269815

SEQ ID NO: 595799 - RNA, 64 nt, Homo Sapiens; identical to SEQ ID NO: 269816

SEQ ID NO: 595800 - RNA, 64 nt, Homo Sapiens; identical to SEQ ID NO: 269817

SEQ ID NO: 595801 - RNA, 64 nt, Homo Sapiens; identical to SEQ ID NO: 269818

SEQ ID NO: 595802 - RNA, 64 nt, Homo Sapiens; identical to SEQ ID NO: 269819

SEQ ID NO: 595803 - RNA, 64 nt, Homo Sapiens; identical to SEQ ID NO: 269820

SEQ ID NO: 595804 - RNA, 64 nt, Homo Sapiens; identical to SEQ ID NO: 269821

SEQ ID NO: 595805 - RNA, 64 nt, Homo Sapiens; identical to SEQ ID NO: 269822

SEQ ID NO: 595806 - RNA, 52 nt, Homo Sapiens; identical to SEQ ID NO: 269823

SEQ ID NO: 595807 - RNA, 64 nt, Homo Sapiens; identical to SEQ ID NO: 269824

SEQ ID NO: 595808 - RNA, 64 nt, Homo Sapiens; identical to SEQ ID NO: 269825

SEQ ID NO: 595809 - RNA, 64 nt, Homo Sapiens; identical to SEQ ID NO: 269826

SEQ ID NO: 595810 - RNA, 64 nt, Homo Sapiens; identical to SEQ ID NO: 269827

SEQ ID NO: 595811 - RNA, 64 nt, Homo Sapiens; identical to SEQ ID NO: 269828

SEQ ID NO: 595812 - RNA, 64 nt, Homo Sapiens; identical to SEQ ID NO: 269829

SEQ ID NO: 595813 - RNA, 64 nt, Homo Sapiens; identical to SEQ ID NO: 269830

SEQ ID NO: 595814 - RNA, 64 nt, Homo Sapiens; identical to SEQ ID NO: 269831

SEQ ID NO: 595815 - RNA, 64 nt, Homo Sapiens; identical to SEQ ID NO: 269832

SEQ ID NO: 595816 - RNA, 64 nt, Homo Sapiens; identical to SEQ ID NO: 269833

SEQ ID NO: 595817 - RNA, 64 nt, Homo Sapiens; identical to SEQ ID NO: 269834

SEQ ID NO: 595818 - RNA, 64 nt, Homo Sapiens; identical to SEQ ID NO: 269835

SEQ ID NO: 595819 - RNA, 64 nt, Homo Sapiens; identical to SEQ ID NO: 269836

SEQ ID NO: 595820 - RNA, 64 nt, Homo Sapiens; identical to SEQ ID NO: 269837

SEQ ID NO: 595821 - RNA, 64 nt, Homo Sapiens; identical to SEQ ID NO: 269838

SEQ ID NO: 595822 - RNA, 64 nt, Homo Sapiens; identical to SEQ ID NO: 269839

SEQ ID NO: 595823 - RNA, 64 nt, Homo Sapiens; identical to SEQ ID NO: 269840

SEQ ID NO: 595824 - RNA, 64 nt, Homo Sapiens; identical to SEQ ID NO: 269841

SEQ ID NO: 595825 - RNA, 64 nt, Homo Sapiens; identical to SEQ ID NO: 269842

SEQ ID NO: 595826 - RNA, 64 nt, Homo Sapiens; identical to SEQ ID NO: 269843

SEQ ID NO: 595827 - RNA, 64 nt, Homo Sapiens; identical to SEQ ID NO: 269844

SEQ ID NO: 595828 - RNA, 64 nt, Homo Sapiens; identical to SEQ ID NO: 269845

SEQ ID NO: 595829 - RNA, 64 nt, Homo Sapiens; identical to SEQ ID NO: 269846

SEQ ID NO: 595830 - RNA, 64 nt, Homo Sapiens; identical to SEQ ID NO: 269847

SEQ ID NO: 595831 - RNA, 64 nt, Homo Sapiens; identical to SEQ ID NO: 269848

SEQ ID NO: 595832 - RNA, 64 nt, Homo Sapiens; identical to SEQ ID NO: 269849

SEQ ID NO: 595833 - RNA, 64 nt, Homo Sapiens; identical to SEQ ID NO: 269850

SEQ ID NO: 595834 - RNA, 64 nt, Homo Sapiens; identical to SEQ ID NO: 269851

SEQ ID NO: 595835 - RNA, 64 nt, Homo Sapiens; identical to SEQ ID NO: 269852

SEQ ID NO: 595836 - RNA, 64 nt, Homo Sapiens; identical to SEQ ID NO: 269853

SEQ ID NO: 595837 - RNA, 64 nt, Homo Sapiens; identical to SEQ ID NO: 269854

SEQ ID NO: 595838 - RNA, 64 nt, Homo Sapiens; identical to SEQ ID NO: 269855

SEQ ID NO: 595839 - RNA, 64 nt, Homo Sapiens; identical to SEQ ID NO: 269856

SEQ ID NO: 595840 - RNA, 64 nt, Homo Sapiens; identical to SEQ ID NO: 269857

SEQ ID NO: 595841 - RNA, 64 nt, Homo Sapiens; identical to SEQ ID NO: 269858

SEQ ID NO: 595842 - RNA, 64 nt, Homo Sapiens; identical to SEQ ID NO: 269859

SEQ ID NO: 595843 - RNA, 64 nt, Homo Sapiens; identical to SEQ ID NO: 269860

SEQ ID NO: 595844 - RNA, 64 nt, Homo Sapiens; identical to SEQ ID NO: 269861

SEQ ID NO: 595845 - RNA, 64 nt, Homo Sapiens; identical to SEQ ID NO: 269862

SEQ ID NO: 595846 - RNA, 64 nt, Homo Sapiens; identical to SEQ ID NO: 269863

SEQ ID NO: 595847 - RNA, 64 nt, Homo Sapiens; identical to SEQ ID NO: 269864

SEQ ID NO: 595848 - RNA, 64 nt, Homo Sapiens; identical to SEQ ID NO: 269865

SEQ ID NO: 595849 - RNA, 64 nt, Homo Sapiens; identical to SEQ ID NO: 269866

SEQ ID NO: 595850 - RNA, 64 nt, Homo Sapiens; identical to SEQ ID NO: 269867

SEQ ID NO: 595851 - RNA, 64 nt, Homo Sapiens; identical to SEQ ID NO: 269868

SEQ ID NO: 595852 - RNA, 64 nt, Homo Sapiens; identical to SEQ ID NO: 269869

SEQ ID NO: 595853 - RNA, 64 nt, Homo Sapiens; identical to SEQ ID NO: 269870

SEQ ID NO: 595854 - RNA, 64 nt, Homo Sapiens; identical to SEQ ID NO: 269871

SEQ ID NO: 595855 - RNA, 64 nt, Homo Sapiens; identical to SEQ ID NO: 269872

SEQ ID NO: 595856 - RNA, 64 nt, Homo Sapiens; identical to SEQ ID NO: 269873

SEQ ID NO: 595857 - RNA, 64 nt, Homo Sapiens; identical to SEQ ID NO: 269874

SEQ ID NO: 595858 - RNA, 64 nt, Homo Sapiens; identical to SEQ ID NO: 269875

SEQ ID NO: 595859 - RNA, 64 nt, Homo Sapiens; identical to SEQ ID NO: 269876

SEQ ID NO: 595860 - RNA, 64 nt, Homo Sapiens; identical to SEQ ID NO: 269877

SEQ ID NO: 595861 - RNA, 64 nt, Homo Sapiens; identical to SEQ ID NO: 269878

SEQ ID NO: 595862 - RNA, 64 nt, Homo Sapiens; identical to SEQ ID NO: 269879

SEQ ID NO: 595863 - RNA, 64 nt, Homo Sapiens; identical to SEQ ID NO: 269880

SEQ ID NO: 595864 - RNA, 64 nt, Homo Sapiens; identical to SEQ ID NO: 269881

SEQ ID NO: 595865 - RNA, 64 nt, Homo Sapiens; identical to SEQ ID NO: 269882

SEQ ID NO: 595866 - RNA, 64 nt, Homo Sapiens; identical to SEQ ID NO: 269883

SEQ ID NO: 595867 - RNA, 64 nt, Homo Sapiens; identical to SEQ ID NO: 269884

SEQ ID NO: 595868 - RNA, 64 nt, Homo Sapiens; identical to SEQ ID NO: 269885

SEQ ID NO: 595869 - RNA, 64 nt, Homo Sapiens; identical to SEQ ID NO: 269886

SEQ ID NO: 595870 - RNA, 64 nt, Homo Sapiens; identical to SEQ ID NO: 269887

SEQ ID NO: 595871 - RNA, 64 nt, Homo Sapiens; identical to SEQ ID NO: 269888

SEQ ID NO: 595872 - RNA, 64 nt, Homo Sapiens; identical to SEQ ID NO: 269889

SEQ ID NO: 595873 - RNA, 64 nt, Homo Sapiens; identical to SEQ ID NO: 269890

SEQ ID NO: 595874 - RNA, 64 nt, Homo Sapiens; identical to SEQ ID NO: 269891

SEQ ID NO: 595875 - RNA, 64 nt, Homo Sapiens; identical to SEQ ID NO: 269892

SEQ ID NO: 595876 - RNA, 64 nt, Homo Sapiens; identical to SEQ ID NO: 269893

SEQ ID NO: 595877 - RNA, 64 nt, Homo Sapiens; identical to SEQ ID NO: 269894

SEQ ID NO: 595878 - RNA, 64 nt, Homo Sapiens; identical to SEQ ID NO: 269895

SEQ ID NO: 595879 - RNA, 64 nt, Homo Sapiens; identical to SEQ ID NO: 269896

SEQ ID NO: 595880 - RNA, 64 nt, Homo Sapiens; identical to SEQ ID NO: 269897

SEQ ID NO: 595881 - RNA, 64 nt, Homo Sapiens; identical to SEQ ID NO: 269898

SEQ ID NO: 595882 - RNA, 64 nt, Homo Sapiens; identical to SEQ ID NO: 269899

SEQ ID NO: 595883 - RNA, 64 nt, Homo Sapiens; identical to SEQ ID NO: 269900

SEQ ID NO: 595884 - RNA, 64 nt, Homo Sapiens; identical to SEQ ID NO: 269901

SEQ ID NO: 595885 - RNA, 64 nt, Homo Sapiens; identical to SEQ ID NO: 269902

SEQ ID NO: 595886 - RNA, 64 nt, Homo Sapiens; identical to SEQ ID NO: 269903

SEQ ID NO: 595887 - RNA, 64 nt, Homo Sapiens; identical to SEQ ID NO: 269904

SEQ ID NO: 595888 - RNA, 64 nt, Homo Sapiens; identical to SEQ ID NO: 269905

SEQ ID NO: 595889 - RNA, 64 nt, Homo Sapiens; identical to SEQ ID NO: 269906

SEQ ID NO: 595890 - RNA, 64 nt, Homo Sapiens; identical to SEQ ID NO: 269907

SEQ ID NO: 595891 - RNA, 64 nt, Homo Sapiens; identical to SEQ ID NO: 269908

SEQ ID NO: 595892 - RNA, 64 nt, Homo Sapiens; identical to SEQ ID NO: 269909

SEQ ID NO: 595893 - RNA, 64 nt, Homo Sapiens; identical to SEQ ID NO: 269910

SEQ ID NO: 595894 - RNA, 64 nt, Homo Sapiens; identical to SEQ ID NO: 269911

SEQ ID NO: 595895 - RNA, 64 nt, Homo Sapiens; identical to SEQ ID NO: 269912

SEQ ID NO: 595896 - RNA, 64 nt, Homo Sapiens; identical to SEQ ID NO: 269913

SEQ ID NO: 595897 - RNA, 64 nt, Homo Sapiens; identical to SEQ ID NO: 269914

SEQ ID NO: 595898 - RNA, 64 nt, Homo Sapiens; identical to SEQ ID NO: 269915

SEQ ID NO: 595899 - RNA, 64 nt, Homo Sapiens; identical to SEQ ID NO: 269916

SEQ ID NO: 595900 - RNA, 64 nt, Homo Sapiens; identical to SEQ ID NO: 269917

SEQ ID NO: 595901 - RNA, 64 nt, Homo Sapiens; identical to SEQ ID NO: 269918

SEQ ID NO: 595902 - RNA, 64 nt, Homo Sapiens; identical to SEQ ID NO: 269919

SEQ ID NO: 595903 - RNA, 64 nt, Homo Sapiens; identical to SEQ ID NO: 269920

SEQ ID NO: 595904 - RNA, 64 nt, Homo Sapiens; identical to SEQ ID NO: 269921

SEQ ID NO: 595905 - RNA, 64 nt, Homo Sapiens; identical to SEQ ID NO: 269922

SEQ ID NO: 595906 - RNA, 64 nt, Homo Sapiens; identical to SEQ ID NO: 269923

SEQ ID NO: 595907 - RNA, 64 nt, Homo Sapiens; identical to SEQ ID NO: 269924

SEQ ID NO: 595908 - RNA, 64 nt, Homo Sapiens; identical to SEQ ID NO: 269925

SEQ ID NO: 595909 - RNA, 64 nt, Homo Sapiens; identical to SEQ ID NO: 269926

SEQ ID NO: 595910 - RNA, 64 nt, Homo Sapiens; identical to SEQ ID NO: 269927

SEQ ID NO: 595911 - RNA, 64 nt, Homo Sapiens; identical to SEQ ID NO: 269928

SEQ ID NO: 595912 - RNA, 64 nt, Homo Sapiens; identical to SEQ ID NO: 269929

SEQ ID NO: 595913 - RNA, 64 nt, Homo Sapiens; identical to SEQ ID NO: 269930

SEQ ID NO: 595914 - RNA, 64 nt, Homo Sapiens; identical to SEQ ID NO: 269931

SEQ ID NO: 595915 - RNA, 64 nt, Homo Sapiens; identical to SEQ ID NO: 269932

SEQ ID NO: 595916 - RNA, 64 nt, Homo Sapiens; identical to SEQ ID NO: 269933

SEQ ID NO: 595917 - RNA, 64 nt, Homo Sapiens; identical to SEQ ID NO: 269934

SEQ ID NO: 595918 - RNA, 64 nt, Homo Sapiens; identical to SEQ ID NO: 269935

SEQ ID NO: 595919 - RNA, 64 nt, Homo Sapiens; identical to SEQ ID NO: 269936

SEQ ID NO: 595920 - RNA, 64 nt, Homo Sapiens; identical to SEQ ID NO: 269937

SEQ ID NO: 595921 - RNA, 64 nt, Homo Sapiens; identical to SEQ ID NO: 269938

SEQ ID NO: 595922 - RNA, 64 nt, Homo Sapiens; identical to SEQ ID NO: 269939

SEQ ID NO: 595923 - RNA, 64 nt, Homo Sapiens; identical to SEQ ID NO: 269940

SEQ ID NO: 595924 - RNA, 64 nt, Homo Sapiens; identical to SEQ ID NO: 269941

SEQ ID NO: 595925 - RNA, 64 nt, Homo Sapiens; identical to SEQ ID NO: 269942

SEQ ID NO: 595926 - RNA, 64 nt, Homo Sapiens; identical to SEQ ID NO: 269943

SEQ ID NO: 595927 - RNA, 64 nt, Homo Sapiens; identical to SEQ ID NO: 269944

SEQ ID NO: 595928 - RNA, 64 nt, Homo Sapiens; identical to SEQ ID NO: 269945

SEQ ID NO: 595929 - RNA, 64 nt, Homo Sapiens; identical to SEQ ID NO: 269946

SEQ ID NO: 595930 - RNA, 64 nt, Homo Sapiens; identical to SEQ ID NO: 269947

SEQ ID NO: 595931 - RNA, 64 nt, Homo Sapiens; identical to SEQ ID NO: 269948

SEQ ID NO: 595932 - RNA, 64 nt, Homo Sapiens; identical to SEQ ID NO: 269949

SEQ ID NO: 595933 - RNA, 64 nt, Homo Sapiens; identical to SEQ ID NO: 269950

SEQ ID NO: 595934 - RNA, 64 nt, Homo Sapiens; identical to SEQ ID NO: 269951

SEQ ID NO: 595935 - RNA, 64 nt, Homo Sapiens; identical to SEQ ID NO: 269952

SEQ ID NO: 595936 - RNA, 64 nt, Homo Sapiens; identical to SEQ ID NO: 269953

SEQ ID NO: 595937 - RNA, 64 nt, Homo Sapiens; identical to SEQ ID NO: 269954

SEQ ID NO: 595938 - RNA, 64 nt, Homo Sapiens; identical to SEQ ID NO: 269955

SEQ ID NO: 595939 - RNA, 64 nt, Homo Sapiens; identical to SEQ ID NO: 269956

SEQ ID NO: 595940 - RNA, 64 nt, Homo Sapiens; identical to SEQ ID NO: 269957

SEQ ID NO: 595941 - RNA, 64 nt, Homo Sapiens; identical to SEQ ID NO: 269958

SEQ ID NO: 595942 - RNA, 64 nt, Homo Sapiens; identical to SEQ ID NO: 269959

SEQ ID NO: 595943 - RNA, 64 nt, Homo Sapiens; identical to SEQ ID NO: 269960

SEQ ID NO: 595944 - RNA, 64 nt, Homo Sapiens; identical to SEQ ID NO: 269961

SEQ ID NO: 595945 - RNA, 64 nt, Homo Sapiens; identical to SEQ ID NO: 269962

SEQ ID NO: 595946 - RNA, 64 nt, Homo Sapiens; identical to SEQ ID NO: 269963

SEQ ID NO: 595947 - RNA, 64 nt, Homo Sapiens; identical to SEQ ID NO: 269964

SEQ ID NO: 595948 - RNA, 64 nt, Homo Sapiens; identical to SEQ ID NO: 269965

SEQ ID NO: 595949 - RNA, 64 nt, Homo Sapiens; identical to SEQ ID NO: 269966

SEQ ID NO: 595950 - RNA, 64 nt, Homo Sapiens; identical to SEQ ID NO: 269967

SEQ ID NO: 595951 - RNA, 64 nt, Homo Sapiens; identical to SEQ ID NO: 269968

SEQ ID NO: 595952 - RNA, 64 nt, Homo Sapiens; identical to SEQ ID NO: 269969

SEQ ID NO: 595953 - RNA, 64 nt, Homo Sapiens; identical to SEQ ID NO: 269970

SEQ ID NO: 595954 - RNA, 64 nt, Homo Sapiens; identical to SEQ ID NO: 269971

SEQ ID NO: 595955 - RNA, 64 nt, Homo Sapiens; identical to SEQ ID NO: 269972

SEQ ID NO: 595956 - RNA, 64 nt, Homo Sapiens; identical to SEQ ID NO: 269973

SEQ ID NO: 595957 - RNA, 64 nt, Homo Sapiens; identical to SEQ ID NO: 269974

SEQ ID NO: 595958 - RNA, 64 nt, Homo Sapiens; identical to SEQ ID NO: 269975

SEQ ID NO: 595959 - RNA, 64 nt, Homo Sapiens; identical to SEQ ID NO: 269976

SEQ ID NO: 595960 - RNA, 64 nt, Homo Sapiens; identical to SEQ ID NO: 269977

SEQ ID NO: 595961 - RNA, 64 nt, Homo Sapiens; identical to SEQ ID NO: 269978

SEQ ID NO: 595962 - RNA, 64 nt, Homo Sapiens; identical to SEQ ID NO: 269979

SEQ ID NO: 595963 - RNA, 64 nt, Homo Sapiens; identical to SEQ ID NO: 269980

SEQ ID NO: 595964 - RNA, 64 nt, Homo Sapiens; identical to SEQ ID NO: 269981

SEQ ID NO: 595965 - RNA, 64 nt, Homo Sapiens; identical to SEQ ID NO: 269982

SEQ ID NO: 595966 - RNA, 64 nt, Homo Sapiens; identical to SEQ ID NO: 269983

SEQ ID NO: 595967 - RNA, 64 nt, Homo Sapiens; identical to SEQ ID NO: 269984

SEQ ID NO: 595968 - RNA, 64 nt, Homo Sapiens; identical to SEQ ID NO: 269985

SEQ ID NO: 595969 - RNA, 64 nt, Homo Sapiens; identical to SEQ ID NO: 269986

SEQ ID NO: 595970 - RNA, 64 nt, Homo Sapiens; identical to SEQ ID NO: 269987

SEQ ID NO: 595971 - RNA, 64 nt, Homo Sapiens; identical to SEQ ID NO: 269988

SEQ ID NO: 595972 - RNA, 64 nt, Homo Sapiens; identical to SEQ ID NO: 269989

SEQ ID NO: 595973 - RNA, 64 nt, Homo Sapiens; identical to SEQ ID NO: 269990

SEQ ID NO: 595974 - RNA, 64 nt, Homo Sapiens; identical to SEQ ID NO: 269991

SEQ ID NO: 595975 - RNA, 64 nt, Homo Sapiens; identical to SEQ ID NO: 269992

SEQ ID NO: 595976 - RNA, 64 nt, Homo Sapiens; identical to SEQ ID NO: 269993

SEQ ID NO: 595977 - RNA, 64 nt, Homo Sapiens; identical to SEQ ID NO: 269994

SEQ ID NO: 595978 - RNA, 64 nt, Homo Sapiens; identical to SEQ ID NO: 269995

SEQ ID NO: 595979 - RNA, 64 nt, Homo Sapiens; identical to SEQ ID NO: 269996

SEQ ID NO: 595980 - RNA, 64 nt, Homo Sapiens; identical to SEQ ID NO: 269997

SEQ ID NO: 595981 - RNA, 64 nt, Homo Sapiens; identical to SEQ ID NO: 269998

SEQ ID NO: 595982 - RNA, 64 nt, Homo Sapiens; identical to SEQ ID NO: 269999

SEQ ID NO: 595983 - RNA, 64 nt, Homo Sapiens; identical to SEQ ID NO: 270000

SEQ ID NO: 595984 - RNA, 64 nt, Homo Sapiens; identical to SEQ ID NO: 270001

SEQ ID NO: 595985 - RNA, 64 nt, Homo Sapiens; identical to SEQ ID NO: 270002

SEQ ID NO: 595986 - RNA, 59 nt, Homo Sapiens; identical to SEQ ID NO: 270003

SEQ ID NO: 595987 - RNA, 64 nt, Homo Sapiens; identical to SEQ ID NO: 270004

SEQ ID NO: 595988 - RNA, 64 nt, Homo Sapiens; identical to SEQ ID NO: 270005

SEQ ID NO: 595989 - RNA, 64 nt, Homo Sapiens; identical to SEQ ID NO: 270006

SEQ ID NO: 595990 - RNA, 64 nt, Homo Sapiens; identical to SEQ ID NO: 270007

SEQ ID NO: 595991 - RNA, 64 nt, Homo Sapiens; identical to SEQ ID NO: 270008

SEQ ID NO: 595992 - RNA, 64 nt, Homo Sapiens; identical to SEQ ID NO: 270009

SEQ ID NO: 595993 - RNA, 64 nt, Homo Sapiens; identical to SEQ ID NO: 270010

SEQ ID NO: 595994 - RNA, 64 nt, Homo Sapiens; identical to SEQ ID NO: 270011

SEQ ID NO: 595995 - RNA, 64 nt, Homo Sapiens; identical to SEQ ID NO: 270012

SEQ ID NO: 595996 - RNA, 64 nt, Homo Sapiens; identical to SEQ ID NO: 270013

SEQ ID NO: 595997 - RNA, 64 nt, Homo Sapiens; identical to SEQ ID NO: 270014

SEQ ID NO: 595998 - RNA, 64 nt, Homo Sapiens; identical to SEQ ID NO: 270015

SEQ ID NO: 595999 - RNA, 64 nt, Homo Sapiens; identical to SEQ ID NO: 270016

SEQ ID NO: 596000 - RNA, 64 nt, Homo Sapiens; identical to SEQ ID NO: 270017

SEQ ID NO: 596001 - RNA, 64 nt, Homo Sapiens; identical to SEQ ID NO: 270018

SEQ ID NO: 596002 - RNA, 64 nt, Homo Sapiens; identical to SEQ ID NO: 270019

SEQ ID NO: 596003 - RNA, 64 nt, Homo Sapiens; identical to SEQ ID NO: 270020

SEQ ID NO: 596004 - RNA, 64 nt, Homo Sapiens; identical to SEQ ID NO: 270021

SEQ ID NO: 596005 - RNA, 64 nt, Homo Sapiens; identical to SEQ ID NO: 270022

SEQ ID NO: 596006 - RNA, 64 nt, Homo Sapiens; identical to SEQ ID NO: 270023

SEQ ID NO: 596007 - RNA, 64 nt, Homo Sapiens; identical to SEQ ID NO: 270024

SEQ ID NO: 596008 - RNA, 64 nt, Homo Sapiens; identical to SEQ ID NO: 270025

SEQ ID NO: 596009 - RNA, 64 nt, Homo Sapiens; identical to SEQ ID NO: 270026

SEQ ID NO: 596010 - RNA, 64 nt, Homo Sapiens; identical to SEQ ID NO: 270027

SEQ ID NO: 596011 - RNA, 64 nt, Homo Sapiens; identical to SEQ ID NO: 270028

SEQ ID NO: 596012 - RNA, 64 nt, Homo Sapiens; identical to SEQ ID NO: 270029

SEQ ID NO: 596013 - RNA, 64 nt, Homo Sapiens; identical to SEQ ID NO: 270030

SEQ ID NO: 596014 - RNA, 64 nt, Homo Sapiens; identical to SEQ ID NO: 270031

SEQ ID NO: 596015 - RNA, 64 nt, Homo Sapiens; identical to SEQ ID NO: 270032

SEQ ID NO: 596016 - RNA, 64 nt, Homo Sapiens; identical to SEQ ID NO: 270033

SEQ ID NO: 596017 - RNA, 64 nt, Homo Sapiens; identical to SEQ ID NO: 270034

SEQ ID NO: 596018 - RNA, 64 nt, Homo Sapiens; identical to SEQ ID NO: 270035

SEQ ID NO: 596019 - RNA, 64 nt, Homo Sapiens; identical to SEQ ID NO: 270036

SEQ ID NO: 596020 - RNA, 64 nt, Homo Sapiens; identical to SEQ ID NO: 269952

SEQ ID NO: 596021 - RNA, 64 nt, Homo Sapiens; identical to SEQ ID NO: 270038

SEQ ID NO: 596022 - RNA, 64 nt, Homo Sapiens; identical to SEQ ID NO: 270039

SEQ ID NO: 596023 - RNA, 64 nt, Homo Sapiens; identical to SEQ ID NO: 270040

SEQ ID NO: 596024 - RNA, 64 nt, Homo Sapiens; identical to SEQ ID NO: 270041

SEQ ID NO: 596025 - RNA, 64 nt, Homo Sapiens; identical to SEQ ID NO: 270042

SEQ ID NO: 596026 - RNA, 64 nt, Homo Sapiens; identical to SEQ ID NO: 270043

SEQ ID NO: 596027 - RNA, 64 nt, Homo Sapiens; identical to SEQ ID NO: 270044

SEQ ID NO: 596028 - RNA, 64 nt, Homo Sapiens; identical to SEQ ID NO: 270045

SEQ ID NO: 596029 - RNA, 64 nt, Homo Sapiens; identical to SEQ ID NO: 270042

SEQ ID NO: 596030 - RNA, 64 nt, Homo Sapiens; identical to SEQ ID NO: 270043

SEQ ID NO: 596031 - RNA, 64 nt, Homo Sapiens; identical to SEQ ID NO: 270044

SEQ ID NO: 596032 - RNA, 64 nt, Homo Sapiens; identical to SEQ ID NO: 270045

SEQ ID NO: 596033 - RNA, 64 nt, Homo Sapiens; identical to SEQ ID NO: 270050

SEQ ID NO: 596034 - RNA, 64 nt, Homo Sapiens; identical to SEQ ID NO: 270051

SEQ ID NO: 596035 - RNA, 64 nt, Homo Sapiens; identical to SEQ ID NO: 270052

SEQ ID NO: 596036 - RNA, 64 nt, Homo Sapiens; identical to SEQ ID NO: 270053

SEQ ID NO: 596037 - RNA, 64 nt, Homo Sapiens; identical to SEQ ID NO: 270054

SEQ ID NO: 596038 - RNA, 64 nt, Homo Sapiens; identical to SEQ ID NO: 270055

SEQ ID NO: 596039 - RNA, 64 nt, Homo Sapiens; identical to SEQ ID NO: 593254

SEQ ID NO: 596040 - RNA, 64 nt, Homo Sapiens; identical to SEQ ID NO: 593255

SEQ ID NO: 596041 - RNA, 64 nt, Homo Sapiens; identical to SEQ ID NO: 593256

SEQ ID NO: 596042 - RNA, 64 nt, Homo Sapiens; identical to SEQ ID NO: 593257

SEQ ID NO: 596043 - RNA, 64 nt, Homo Sapiens; identical to SEQ ID NO: 593258

SEQ ID NO: 596044 - RNA, 64 nt, Homo Sapiens; identical to SEQ ID NO: 593259

SEQ ID NO: 596045 - RNA, 64 nt, Homo Sapiens; identical to SEQ ID NO: 593260

SEQ ID NO: 596046 - RNA, 64 nt, Homo Sapiens; identical to SEQ ID NO: 593261

SEQ ID NO: 596047 - RNA, 64 nt, Homo Sapiens; identical to SEQ ID NO: 593262

SEQ ID NO: 596048 - RNA, 64 nt, Homo Sapiens; identical to SEQ ID NO: 593263

SEQ ID NO: 596049 - RNA, 64 nt, Homo Sapiens; identical to SEQ ID NO: 593264

SEQ ID NO: 596050 - RNA, 64 nt, Homo Sapiens; identical to SEQ ID NO: 593265

SEQ ID NO: 596051 - RNA, 64 nt, Homo Sapiens; identical to SEQ ID NO: 593266

SEQ ID NO: 596052 - RNA, 64 nt, Homo Sapiens; identical to SEQ ID NO: 593267

SEQ ID NO: 596053 - RNA, 64 nt, Homo Sapiens; identical to SEQ ID NO: 593268

SEQ ID NO: 596054 - RNA, 64 nt, Homo Sapiens; identical to SEQ ID NO: 593269

SEQ ID NO: 596055 - RNA, 64 nt, Homo Sapiens; identical to SEQ ID NO: 593270

SEQ ID NO: 596056 - RNA, 64 nt, Homo Sapiens; identical to SEQ ID NO: 593271

SEQ ID NO: 596057 - RNA, 64 nt, Homo Sapiens; identical to SEQ ID NO: 593272

SEQ ID NO: 596058 - RNA, 64 nt, Homo Sapiens; identical to SEQ ID NO: 593273

SEQ ID NO: 596059 - RNA, 64 nt, Homo Sapiens; identical to SEQ ID NO: 593274

SEQ ID NO: 596060 - RNA, 64 nt, Homo Sapiens; identical to SEQ ID NO: 593275

SEQ ID NO: 596061 - RNA, 64 nt, Homo Sapiens; identical to SEQ ID NO: 593276

SEQ ID NO: 596062 - RNA, 64 nt, Homo Sapiens; identical to SEQ ID NO: 593277

SEQ ID NO: 596063 - RNA, 64 nt, Homo Sapiens; identical to SEQ ID NO: 593278

SEQ ID NO: 596064 - RNA, 64 nt, Homo Sapiens; identical to SEQ ID NO: 593279

SEQ ID NO: 596065 - RNA, 64 nt, Homo Sapiens; identical to SEQ ID NO: 593280

SEQ ID NO: 596066 - RNA, 64 nt, Homo Sapiens; identical to SEQ ID NO: 593281

SEQ ID NO: 596067 - RNA, 64 nt, Homo Sapiens; identical to SEQ ID NO: 593282

SEQ ID NO: 596068 - RNA, 64 nt, Homo Sapiens; identical to SEQ ID NO: 593283

SEQ ID NO: 596069 - RNA, 64 nt, Homo Sapiens; identical to SEQ ID NO: 593284

SEQ ID NO: 596070 - RNA, 64 nt, Homo Sapiens; identical to SEQ ID NO: 593285

SEQ ID NO: 596071 - RNA, 64 nt, Homo Sapiens; identical to SEQ ID NO: 593286

SEQ ID NO: 596072 - RNA, 64 nt, Homo Sapiens; identical to SEQ ID NO: 593287

SEQ ID NO: 596073 - RNA, 64 nt, Homo Sapiens; identical to SEQ ID NO: 593288

SEQ ID NO: 596074 - RNA, 64 nt, Homo Sapiens; identical to SEQ ID NO: 593289

SEQ ID NO: 596075 - RNA, 64 nt, Homo Sapiens; identical to SEQ ID NO: 267307

SEQ ID NO: 596076 - RNA, 64 nt, Homo Sapiens; identical to SEQ ID NO: 267308

SEQ ID NO: 596077 - RNA, 64 nt, Homo Sapiens; identical to SEQ ID NO: 267309

SEQ ID NO: 596078 - RNA, 64 nt, Homo Sapiens; identical to SEQ ID NO: 267310

SEQ ID NO: 596079 - RNA, 64 nt, Homo Sapiens; identical to SEQ ID NO: 267311

SEQ ID NO: 596080 - RNA, 64 nt, Homo Sapiens; identical to SEQ ID NO: 267312

SEQ ID NO: 596081 - RNA, 64 nt, Homo Sapiens; identical to SEQ ID NO: 267313

SEQ ID NO: 596082 - RNA, 64 nt, Homo Sapiens; identical to SEQ ID NO: 267314

SEQ ID NO: 596083 - RNA, 64 nt, Homo Sapiens; identical to SEQ ID NO: 267315

SEQ ID NO: 596084 - RNA, 64 nt, Homo Sapiens; identical to SEQ ID NO: 267316

SEQ ID NO: 596085 - RNA, 64 nt, Homo Sapiens; identical to SEQ ID NO: 267317

SEQ ID NO: 596086 - RNA, 64 nt, Homo Sapiens; identical to SEQ ID NO: 267318

SEQ ID NO: 596087 - RNA, 64 nt, Homo Sapiens; identical to SEQ ID NO: 267319

SEQ ID NO: 596088 - RNA, 64 nt, Homo Sapiens; identical to SEQ ID NO: 267320

SEQ ID NO: 596089 - RNA, 64 nt, Homo Sapiens; identical to SEQ ID NO: 267321

SEQ ID NO: 596090 - RNA, 64 nt, Homo Sapiens; identical to SEQ ID NO: 267322

SEQ ID NO: 596091 - RNA, 64 nt, Homo Sapiens; identical to SEQ ID NO: 267323

SEQ ID NO: 596092 - RNA, 64 nt, Homo Sapiens; identical to SEQ ID NO: 267324

SEQ ID NO: 596093 - RNA, 64 nt, Homo Sapiens; identical to SEQ ID NO: 267325

SEQ ID NO: 596094 - RNA, 64 nt, Homo Sapiens; identical to SEQ ID NO: 267326

SEQ ID NO: 596095 - RNA, 64 nt, Homo Sapiens; identical to SEQ ID NO: 267327

SEQ ID NO: 596096 - RNA, 64 nt, Homo Sapiens; identical to SEQ ID NO: 267328

SEQ ID NO: 596097 - RNA, 64 nt, Homo Sapiens; identical to SEQ ID NO: 267329

SEQ ID NO: 596098 - RNA, 64 nt, Homo Sapiens; identical to SEQ ID NO: 267330

SEQ ID NO: 596099 - RNA, 64 nt, Homo Sapiens; identical to SEQ ID NO: 267331

SEQ ID NO: 596100 - RNA, 64 nt, Homo Sapiens; identical to SEQ ID NO: 267332

SEQ ID NO: 596101 - RNA, 64 nt, Homo Sapiens; identical to SEQ ID NO: 267333

SEQ ID NO: 596102 - RNA, 64 nt, Homo Sapiens; identical to SEQ ID NO: 267334

SEQ ID NO: 596103 - RNA, 64 nt, Homo Sapiens; identical to SEQ ID NO: 267335

SEQ ID NO: 596104 - RNA, 64 nt, Homo Sapiens; identical to SEQ ID NO: 267336

SEQ ID NO: 596105 - RNA, 64 nt, Homo Sapiens; identical to SEQ ID NO: 267337

SEQ ID NO: 596106 - RNA, 64 nt, Homo Sapiens; identical to SEQ ID NO: 267338

SEQ ID NO: 596107 - RNA, 64 nt, Homo Sapiens; identical to SEQ ID NO: 267339

SEQ ID NO: 596108 - RNA, 64 nt, Homo Sapiens; identical to SEQ ID NO: 267340

SEQ ID NO: 596109 - RNA, 64 nt, Homo Sapiens; identical to SEQ ID NO: 267341

SEQ ID NO: 596110 - RNA, 64 nt, Homo Sapiens; identical to SEQ ID NO: 267342

SEQ ID NO: 596111 - RNA, 64 nt, Homo Sapiens; identical to SEQ ID NO: 267343

SEQ ID NO: 596112 - RNA, 64 nt, Homo Sapiens; identical to SEQ ID NO: 267344

SEQ ID NO: 596113 - RNA, 64 nt, Homo Sapiens; identical to SEQ ID NO: 267345

SEQ ID NO: 596114 - RNA, 64 nt, Homo Sapiens; identical to SEQ ID NO: 267346

SEQ ID NO: 596115 - RNA, 64 nt, Homo Sapiens; identical to SEQ ID NO: 267347

SEQ ID NO: 596116 - RNA, 64 nt, Homo Sapiens; identical to SEQ ID NO: 267348

SEQ ID NO: 596117 - RNA, 64 nt, Homo Sapiens; identical to SEQ ID NO: 267349

SEQ ID NO: 596118 - RNA, 64 nt, Homo Sapiens; identical to SEQ ID NO: 267350

SEQ ID NO: 596119 - RNA, 64 nt, Homo Sapiens; identical to SEQ ID NO: 267351

SEQ ID NO: 596120 - RNA, 64 nt, Homo Sapiens; identical to SEQ ID NO: 267352

SEQ ID NO: 596121 - RNA, 64 nt, Homo Sapiens; identical to SEQ ID NO: 267353

SEQ ID NO: 596122 - RNA, 64 nt, Homo Sapiens; identical to SEQ ID NO: 267354

SEQ ID NO: 596123 - RNA, 64 nt, Homo Sapiens; identical to SEQ ID NO: 267355

SEQ ID NO: 596124 - RNA, 64 nt, Homo Sapiens; identical to SEQ ID NO: 267356

SEQ ID NO: 596125 - RNA, 64 nt, Homo Sapiens; identical to SEQ ID NO: 267357

SEQ ID NO: 596126 - RNA, 64 nt, Homo Sapiens; identical to SEQ ID NO: 267358

SEQ ID NO: 596127 - RNA, 64 nt, Homo Sapiens; identical to SEQ ID NO: 267359

SEQ ID NO: 596128 - RNA, 64 nt, Homo Sapiens; identical to SEQ ID NO: 267360

SEQ ID NO: 596129 - RNA, 64 nt, Homo Sapiens; identical to SEQ ID NO: 267361

SEQ ID NO: 596130 - RNA, 63 nt, Homo Sapiens; identical to SEQ ID NO: 267362

SEQ ID NO: 596131 - RNA, 64 nt, Homo Sapiens; identical to SEQ ID NO: 267363

SEQ ID NO: 596132 - RNA, 64 nt, Homo Sapiens; identical to SEQ ID NO: 267364

SEQ ID NO: 596133 - RNA, 64 nt, Homo Sapiens; identical to SEQ ID NO: 267365

SEQ ID NO: 596134 - RNA, 64 nt, Homo Sapiens; identical to SEQ ID NO: 267366

SEQ ID NO: 596135 - RNA, 64 nt, Homo Sapiens; identical to SEQ ID NO: 267367

SEQ ID NO: 596136 - RNA, 64 nt, Homo Sapiens; identical to SEQ ID NO: 267368

SEQ ID NO: 596137 - RNA, 64 nt, Homo Sapiens; identical to SEQ ID NO: 267369

SEQ ID NO: 596138 - RNA, 64 nt, Homo Sapiens; identical to SEQ ID NO: 267370

SEQ ID NO: 596139 - RNA, 64 nt, Homo Sapiens; identical to SEQ ID NO: 267371

SEQ ID NO: 596140 - RNA, 64 nt, Homo Sapiens; identical to SEQ ID NO: 267372

SEQ ID NO: 596141 - RNA, 64 nt, Homo Sapiens; identical to SEQ ID NO: 267373

SEQ ID NO: 596142 - RNA, 64 nt, Homo Sapiens; identical to SEQ ID NO: 267374

SEQ ID NO: 596143 - RNA, 64 nt, Homo Sapiens; identical to SEQ ID NO: 267375

SEQ ID NO: 596144 - RNA, 64 nt, Homo Sapiens; identical to SEQ ID NO: 267376

SEQ ID NO: 596145 - RNA, 64 nt, Homo Sapiens; identical to SEQ ID NO: 267377

SEQ ID NO: 596146 - RNA, 64 nt, Homo Sapiens; identical to SEQ ID NO: 267378

SEQ ID NO: 596147 - RNA, 64 nt, Homo Sapiens; identical to SEQ ID NO: 267379

SEQ ID NO: 596148 - RNA, 64 nt, Homo Sapiens; identical to SEQ ID NO: 267380

SEQ ID NO: 596149 - RNA, 64 nt, Homo Sapiens; identical to SEQ ID NO: 267381

SEQ ID NO: 596150 - RNA, 64 nt, Homo Sapiens; identical to SEQ ID NO: 267382

SEQ ID NO: 596151 - RNA, 64 nt, Homo Sapiens; identical to SEQ ID NO: 267383

SEQ ID NO: 596152 - RNA, 64 nt, Homo Sapiens; identical to SEQ ID NO: 267384

SEQ ID NO: 596153 - RNA, 64 nt, Homo Sapiens; identical to SEQ ID NO: 267385

SEQ ID NO: 596154 - RNA, 64 nt, Homo Sapiens; identical to SEQ ID NO: 267386

SEQ ID NO: 596155 - RNA, 64 nt, Homo Sapiens; identical to SEQ ID NO: 267387

SEQ ID NO: 596156 - RNA, 64 nt, Homo Sapiens; identical to SEQ ID NO: 267388

SEQ ID NO: 596157 - RNA, 64 nt, Homo Sapiens; identical to SEQ ID NO: 267389

SEQ ID NO: 596158 - RNA, 64 nt, Homo Sapiens; identical to SEQ ID NO: 267390

SEQ ID NO: 596159 - RNA, 64 nt, Homo Sapiens; identical to SEQ ID NO: 267391

SEQ ID NO: 596160 - RNA, 64 nt, Homo Sapiens; identical to SEQ ID NO: 267392

SEQ ID NO: 596161 - RNA, 64 nt, Homo Sapiens; identical to SEQ ID NO: 267393

SEQ ID NO: 596162 - RNA, 64 nt, Homo Sapiens; identical to SEQ ID NO: 267394

SEQ ID NO: 596163 - RNA, 64 nt, Homo Sapiens; identical to SEQ ID NO: 267395

SEQ ID NO: 596164 - RNA, 64 nt, Homo Sapiens; identical to SEQ ID NO: 267396

SEQ ID NO: 596165 - RNA, 64 nt, Homo Sapiens; identical to SEQ ID NO: 267397

SEQ ID NO: 596166 - RNA, 64 nt, Homo Sapiens; identical to SEQ ID NO: 267398

SEQ ID NO: 596167 - RNA, 64 nt, Homo Sapiens; identical to SEQ ID NO: 267399

SEQ ID NO: 596168 - RNA, 64 nt, Homo Sapiens; identical to SEQ ID NO: 267400

SEQ ID NO: 596169 - RNA, 64 nt, Homo Sapiens; identical to SEQ ID NO: 267401

SEQ ID NO: 596170 - RNA, 64 nt, Homo Sapiens; identical to SEQ ID NO: 267402

SEQ ID NO: 596171 - RNA, 64 nt, Homo Sapiens; identical to SEQ ID NO: 267403

SEQ ID NO: 596172 - RNA, 64 nt, Homo Sapiens; identical to SEQ ID NO: 267404

SEQ ID NO: 596173 - RNA, 64 nt, Homo Sapiens; identical to SEQ ID NO: 267405

SEQ ID NO: 596174 - RNA, 64 nt, Homo Sapiens; identical to SEQ ID NO: 267406

SEQ ID NO: 596175 - RNA, 64 nt, Homo Sapiens; identical to SEQ ID NO: 267407

SEQ ID NO: 596176 - RNA, 64 nt, Homo Sapiens; identical to SEQ ID NO: 267408

SEQ ID NO: 596177 - RNA, 64 nt, Homo Sapiens; identical to SEQ ID NO: 267409

SEQ ID NO: 596178 - RNA, 64 nt, Homo Sapiens; identical to SEQ ID NO: 267410

SEQ ID NO: 596179 - RNA, 64 nt, Homo Sapiens; identical to SEQ ID NO: 267411

SEQ ID NO: 596180 - RNA, 64 nt, Homo Sapiens; identical to SEQ ID NO: 267412

SEQ ID NO: 596181 - RNA, 64 nt, Homo Sapiens; identical to SEQ ID NO: 267413

SEQ ID NO: 596182 - RNA, 64 nt, Homo Sapiens; identical to SEQ ID NO: 267414

SEQ ID NO: 596183 - RNA, 64 nt, Homo Sapiens; identical to SEQ ID NO: 267415

SEQ ID NO: 596184 - RNA, 64 nt, Homo Sapiens; identical to SEQ ID NO: 267416

SEQ ID NO: 596185 - RNA, 64 nt, Homo Sapiens; identical to SEQ ID NO: 267417

SEQ ID NO: 596186 - RNA, 64 nt, Homo Sapiens; identical to SEQ ID NO: 267418

SEQ ID NO: 596187 - RNA, 64 nt, Homo Sapiens; identical to SEQ ID NO: 267419

SEQ ID NO: 596188 - RNA, 64 nt, Homo Sapiens; identical to SEQ ID NO: 267420

SEQ ID NO: 596189 - RNA, 64 nt, Homo Sapiens; identical to SEQ ID NO: 267421

SEQ ID NO: 596190 - RNA, 64 nt, Homo Sapiens; identical to SEQ ID NO: 267422

SEQ ID NO: 596191 - RNA, 64 nt, Homo Sapiens; identical to SEQ ID NO: 267423

SEQ ID NO: 596192 - RNA, 64 nt, Homo Sapiens; identical to SEQ ID NO: 267424

SEQ ID NO: 596193 - RNA, 64 nt, Homo Sapiens; identical to SEQ ID NO: 267425

SEQ ID NO: 596194 - RNA, 64 nt, Homo Sapiens; identical to SEQ ID NO: 267426

SEQ ID NO: 596195 - RNA, 64 nt, Homo Sapiens; identical to SEQ ID NO: 267427

SEQ ID NO: 596196 - RNA, 64 nt, Homo Sapiens; identical to SEQ ID NO: 267428

SEQ ID NO: 596197 - RNA, 64 nt, Homo Sapiens; identical to SEQ ID NO: 267429

SEQ ID NO: 596198 - RNA, 64 nt, Homo Sapiens; identical to SEQ ID NO: 267430

SEQ ID NO: 596199 - RNA, 64 nt, Homo Sapiens; identical to SEQ ID NO: 267431

SEQ ID NO: 596200 - RNA, 64 nt, Homo Sapiens; identical to SEQ ID NO: 267432

SEQ ID NO: 596201 - RNA, 64 nt, Homo Sapiens; identical to SEQ ID NO: 267433

SEQ ID NO: 596202 - RNA, 64 nt, Homo Sapiens; identical to SEQ ID NO: 267434

SEQ ID NO: 596203 - RNA, 64 nt, Homo Sapiens; identical to SEQ ID NO: 267435

SEQ ID NO: 596204 - RNA, 64 nt, Homo Sapiens; identical to SEQ ID NO: 267436

SEQ ID NO: 596205 - RNA, 64 nt, Homo Sapiens; identical to SEQ ID NO: 267437

SEQ ID NO: 596206 - RNA, 64 nt, Homo Sapiens; identical to SEQ ID NO: 267438

SEQ ID NO: 596207 - RNA, 64 nt, Homo Sapiens; identical to SEQ ID NO: 267439

SEQ ID NO: 596208 - RNA, 64 nt, Homo Sapiens; identical to SEQ ID NO: 267440

SEQ ID NO: 596209 - RNA, 64 nt, Homo Sapiens; identical to SEQ ID NO: 267441

SEQ ID NO: 596210 - RNA, 64 nt, Homo Sapiens; identical to SEQ ID NO: 267442

SEQ ID NO: 596211 - RNA, 64 nt, Homo Sapiens; identical to SEQ ID NO: 267443

SEQ ID NO: 596212 - RNA, 64 nt, Homo Sapiens; identical to SEQ ID NO: 267444

SEQ ID NO: 596213 - RNA, 64 nt, Homo Sapiens; identical to SEQ ID NO: 267445

SEQ ID NO: 596214 - RNA, 64 nt, Homo Sapiens; identical to SEQ ID NO: 267446

SEQ ID NO: 596215 - RNA, 64 nt, Homo Sapiens; identical to SEQ ID NO: 267447

SEQ ID NO: 596216 - RNA, 64 nt, Homo Sapiens; identical to SEQ ID NO: 267448

SEQ ID NO: 596217 - RNA, 64 nt, Homo Sapiens; identical to SEQ ID NO: 267449

SEQ ID NO: 596218 - RNA, 64 nt, Homo Sapiens; identical to SEQ ID NO: 267450

SEQ ID NO: 596219 - RNA, 64 nt, Homo Sapiens; identical to SEQ ID NO: 267451

SEQ ID NO: 596220 - RNA, 64 nt, Homo Sapiens; identical to SEQ ID NO: 267452

SEQ ID NO: 596221 - RNA, 64 nt, Homo Sapiens; identical to SEQ ID NO: 267453

SEQ ID NO: 596222 - RNA, 64 nt, Homo Sapiens; identical to SEQ ID NO: 267454

SEQ ID NO: 596223 - RNA, 64 nt, Homo Sapiens; identical to SEQ ID NO: 267455

SEQ ID NO: 596224 - RNA, 64 nt, Homo Sapiens; identical to SEQ ID NO: 267456

SEQ ID NO: 596225 - RNA, 64 nt, Homo Sapiens; identical to SEQ ID NO: 267457

SEQ ID NO: 596226 - RNA, 64 nt, Homo Sapiens; identical to SEQ ID NO: 267458

SEQ ID NO: 596227 - RNA, 64 nt, Homo Sapiens; identical to SEQ ID NO: 267459

SEQ ID NO: 596228 - RNA, 64 nt, Homo Sapiens; identical to SEQ ID NO: 267460

SEQ ID NO: 596229 - RNA, 64 nt, Homo Sapiens; identical to SEQ ID NO: 267461

SEQ ID NO: 596230 - RNA, 64 nt, Homo Sapiens; identical to SEQ ID NO: 267462

SEQ ID NO: 596231 - RNA, 64 nt, Homo Sapiens; identical to SEQ ID NO: 267463

SEQ ID NO: 596232 - RNA, 64 nt, Homo Sapiens; identical to SEQ ID NO: 267464

SEQ ID NO: 596233 - RNA, 64 nt, Homo Sapiens; identical to SEQ ID NO: 267465

SEQ ID NO: 596234 - RNA, 64 nt, Homo Sapiens; identical to SEQ ID NO: 267466

SEQ ID NO: 596235 - RNA, 64 nt, Homo Sapiens; identical to SEQ ID NO: 267467

SEQ ID NO: 596236 - RNA, 64 nt, Homo Sapiens; identical to SEQ ID NO: 267468

SEQ ID NO: 596237 - RNA, 64 nt, Homo Sapiens; identical to SEQ ID NO: 267469

SEQ ID NO: 596238 - RNA, 64 nt, Homo Sapiens; identical to SEQ ID NO: 267470

SEQ ID NO: 596239 - RNA, 64 nt, Homo Sapiens; identical to SEQ ID NO: 267471

SEQ ID NO: 596240 - RNA, 64 nt, Homo Sapiens; identical to SEQ ID NO: 267472

SEQ ID NO: 596241 - RNA, 64 nt, Homo Sapiens; identical to SEQ ID NO: 267473

SEQ ID NO: 596242 - RNA, 64 nt, Homo Sapiens; identical to SEQ ID NO: 267474

SEQ ID NO: 596243 - RNA, 64 nt, Homo Sapiens; identical to SEQ ID NO: 267475

SEQ ID NO: 596244 - RNA, 64 nt, Homo Sapiens; identical to SEQ ID NO: 267476

SEQ ID NO: 596245 - RNA, 64 nt, Homo Sapiens; identical to SEQ ID NO: 267477

SEQ ID NO: 596246 - RNA, 64 nt, Homo Sapiens; identical to SEQ ID NO: 267478

SEQ ID NO: 596247 - RNA, 64 nt, Homo Sapiens; identical to SEQ ID NO: 267479

SEQ ID NO: 596248 - RNA, 64 nt, Homo Sapiens; identical to SEQ ID NO: 267480

SEQ ID NO: 596249 - RNA, 64 nt, Homo Sapiens; identical to SEQ ID NO: 267481

SEQ ID NO: 596250 - RNA, 64 nt, Homo Sapiens; identical to SEQ ID NO: 267482

SEQ ID NO: 596251 - RNA, 64 nt, Homo Sapiens; identical to SEQ ID NO: 267483

SEQ ID NO: 596252 - RNA, 64 nt, Homo Sapiens; identical to SEQ ID NO: 267484

SEQ ID NO: 596253 - RNA, 64 nt, Homo Sapiens; identical to SEQ ID NO: 267485

SEQ ID NO: 596254 - RNA, 64 nt, Homo Sapiens; identical to SEQ ID NO: 267486

SEQ ID NO: 596255 - RNA, 64 nt, Homo Sapiens; identical to SEQ ID NO: 267487

SEQ ID NO: 596256 - RNA, 64 nt, Homo Sapiens; identical to SEQ ID NO: 267488

SEQ ID NO: 596257 - RNA, 64 nt, Homo Sapiens; identical to SEQ ID NO: 267489

SEQ ID NO: 596258 - RNA, 64 nt, Homo Sapiens; identical to SEQ ID NO: 267490

SEQ ID NO: 596259 - RNA, 64 nt, Homo Sapiens; identical to SEQ ID NO: 267491

SEQ ID NO: 596260 - RNA, 64 nt, Homo Sapiens; identical to SEQ ID NO: 267492

SEQ ID NO: 596261 - RNA, 64 nt, Homo Sapiens; identical to SEQ ID NO: 267493

SEQ ID NO: 596262 - RNA, 64 nt, Homo Sapiens; identical to SEQ ID NO: 267494

SEQ ID NO: 596263 - RNA, 64 nt, Homo Sapiens; identical to SEQ ID NO: 267495

SEQ ID NO: 596264 - RNA, 64 nt, Homo Sapiens; identical to SEQ ID NO: 267496

SEQ ID NO: 596265 - RNA, 64 nt, Homo Sapiens; identical to SEQ ID NO: 267497

SEQ ID NO: 596266 - RNA, 64 nt, Homo Sapiens; identical to SEQ ID NO: 267498

SEQ ID NO: 596267 - RNA, 64 nt, Homo Sapiens; identical to SEQ ID NO: 267499

SEQ ID NO: 596268 - RNA, 64 nt, Homo Sapiens; identical to SEQ ID NO: 267500

SEQ ID NO: 596269 - RNA, 64 nt, Homo Sapiens; identical to SEQ ID NO: 267501

SEQ ID NO: 596270 - RNA, 64 nt, Homo Sapiens; identical to SEQ ID NO: 267502

SEQ ID NO: 596271 - RNA, 64 nt, Homo Sapiens; identical to SEQ ID NO: 267503

SEQ ID NO: 596272 - RNA, 64 nt, Homo Sapiens; identical to SEQ ID NO: 267504

SEQ ID NO: 596273 - RNA, 64 nt, Homo Sapiens; identical to SEQ ID NO: 267505

SEQ ID NO: 596274 - RNA, 64 nt, Homo Sapiens; identical to SEQ ID NO: 267506

SEQ ID NO: 596275 - RNA, 64 nt, Homo Sapiens; identical to SEQ ID NO: 267507

SEQ ID NO: 596276 - RNA, 64 nt, Homo Sapiens; identical to SEQ ID NO: 267508

SEQ ID NO: 596277 - RNA, 64 nt, Homo Sapiens; identical to SEQ ID NO: 267509

SEQ ID NO: 596278 - RNA, 64 nt, Homo Sapiens; identical to SEQ ID NO: 267510

SEQ ID NO: 596279 - RNA, 64 nt, Homo Sapiens; identical to SEQ ID NO: 267511

SEQ ID NO: 596280 - RNA, 64 nt, Homo Sapiens; identical to SEQ ID NO: 267512

SEQ ID NO: 596281 - RNA, 64 nt, Homo Sapiens; identical to SEQ ID NO: 267513

SEQ ID NO: 596282 - RNA, 64 nt, Homo Sapiens; identical to SEQ ID NO: 267514

SEQ ID NO: 596283 - RNA, 64 nt, Homo Sapiens; identical to SEQ ID NO: 267515

SEQ ID NO: 596284 - RNA, 64 nt, Homo Sapiens; identical to SEQ ID NO: 267516

SEQ ID NO: 596285 - RNA, 64 nt, Homo Sapiens; identical to SEQ ID NO: 267517

SEQ ID NO: 596286 - RNA, 64 nt, Homo Sapiens; identical to SEQ ID NO: 267518

SEQ ID NO: 596287 - RNA, 64 nt, Homo Sapiens; identical to SEQ ID NO: 267519

SEQ ID NO: 596288 - RNA, 64 nt, Homo Sapiens; identical to SEQ ID NO: 267520

SEQ ID NO: 596289 - RNA, 64 nt, Homo Sapiens; identical to SEQ ID NO: 267521

SEQ ID NO: 596290 - RNA, 64 nt, Homo Sapiens; identical to SEQ ID NO: 267522

SEQ ID NO: 596291 - RNA, 64 nt, Homo Sapiens; identical to SEQ ID NO: 267523

SEQ ID NO: 596292 - RNA, 64 nt, Homo Sapiens; identical to SEQ ID NO: 267524

SEQ ID NO: 596293 - RNA, 64 nt, Homo Sapiens; identical to SEQ ID NO: 267525

SEQ ID NO: 596294 - RNA, 64 nt, Homo Sapiens; identical to SEQ ID NO: 267526

SEQ ID NO: 596295 - RNA, 64 nt, Homo Sapiens; identical to SEQ ID NO: 267527

SEQ ID NO: 596296 - RNA, 64 nt, Homo Sapiens; identical to SEQ ID NO: 267528

SEQ ID NO: 596297 - RNA, 64 nt, Homo Sapiens; identical to SEQ ID NO: 267529

SEQ ID NO: 596298 - RNA, 64 nt, Homo Sapiens; identical to SEQ ID NO: 267530

SEQ ID NO: 596299 - RNA, 64 nt, Homo Sapiens; identical to SEQ ID NO: 267531

SEQ ID NO: 596300 - RNA, 64 nt, Homo Sapiens; identical to SEQ ID NO: 267532

SEQ ID NO: 596301 - RNA, 64 nt, Homo Sapiens; identical to SEQ ID NO: 267533

SEQ ID NO: 596302 - RNA, 64 nt, Homo Sapiens; identical to SEQ ID NO: 267534

SEQ ID NO: 596303 - RNA, 64 nt, Homo Sapiens; identical to SEQ ID NO: 267535

SEQ ID NO: 596304 - RNA, 64 nt, Homo Sapiens; identical to SEQ ID NO: 267536

SEQ ID NO: 596305 - RNA, 64 nt, Homo Sapiens; identical to SEQ ID NO: 267537

SEQ ID NO: 596306 - RNA, 64 nt, Homo Sapiens; identical to SEQ ID NO: 267538

SEQ ID NO: 596307 - RNA, 64 nt, Homo Sapiens; identical to SEQ ID NO: 267539

SEQ ID NO: 596308 - RNA, 64 nt, Homo Sapiens; identical to SEQ ID NO: 267540

SEQ ID NO: 596309 - RNA, 64 nt, Homo Sapiens; identical to SEQ ID NO: 267541

SEQ ID NO: 596310 - RNA, 64 nt, Homo Sapiens; identical to SEQ ID NO: 267542

SEQ ID NO: 596311 - RNA, 64 nt, Homo Sapiens; identical to SEQ ID NO: 267543

SEQ ID NO: 596312 - RNA, 64 nt, Homo Sapiens; identical to SEQ ID NO: 267544

SEQ ID NO: 596313 - RNA, 64 nt, Homo Sapiens; identical to SEQ ID NO: 267545

SEQ ID NO: 596314 - RNA, 64 nt, Homo Sapiens; identical to SEQ ID NO: 267546

SEQ ID NO: 596315 - RNA, 64 nt, Homo Sapiens; identical to SEQ ID NO: 267547

SEQ ID NO: 596316 - RNA, 64 nt, Homo Sapiens; identical to SEQ ID NO: 267548

SEQ ID NO: 596317 - RNA, 64 nt, Homo Sapiens; identical to SEQ ID NO: 267549

SEQ ID NO: 596318 - RNA, 64 nt, Homo Sapiens; identical to SEQ ID NO: 267550

SEQ ID NO: 596319 - RNA, 64 nt, Homo Sapiens; identical to SEQ ID NO: 267551

SEQ ID NO: 596320 - RNA, 64 nt, Homo Sapiens; identical to SEQ ID NO: 267552

SEQ ID NO: 596321 - RNA, 64 nt, Homo Sapiens; identical to SEQ ID NO: 267553

SEQ ID NO: 596322 - RNA, 64 nt, Homo Sapiens; identical to SEQ ID NO: 267554

SEQ ID NO: 596323 - RNA, 64 nt, Homo Sapiens; identical to SEQ ID NO: 267555

SEQ ID NO: 596324 - RNA, 64 nt, Homo Sapiens; identical to SEQ ID NO: 267556

SEQ ID NO: 596325 - RNA, 64 nt, Homo Sapiens; identical to SEQ ID NO: 267557

SEQ ID NO: 596326 - RNA, 64 nt, Homo Sapiens; identical to SEQ ID NO: 267558

SEQ ID NO: 596327 - RNA, 64 nt, Homo Sapiens; identical to SEQ ID NO: 267559

SEQ ID NO: 596328 - RNA, 64 nt, Homo Sapiens; identical to SEQ ID NO: 267560

SEQ ID NO: 596329 - RNA, 64 nt, Homo Sapiens; identical to SEQ ID NO: 267561

SEQ ID NO: 596330 - RNA, 64 nt, Homo Sapiens; identical to SEQ ID NO: 267562

SEQ ID NO: 596331 - RNA, 64 nt, Homo Sapiens; identical to SEQ ID NO: 267563

SEQ ID NO: 596332 - RNA, 64 nt, Homo Sapiens; identical to SEQ ID NO: 267564

SEQ ID NO: 596333 - RNA, 64 nt, Homo Sapiens; identical to SEQ ID NO: 267565

SEQ ID NO: 596334 - RNA, 64 nt, Homo Sapiens; identical to SEQ ID NO: 267566

SEQ ID NO: 596335 - RNA, 64 nt, Homo Sapiens; identical to SEQ ID NO: 267567

SEQ ID NO: 596336 - RNA, 64 nt, Homo Sapiens; identical to SEQ ID NO: 267568

SEQ ID NO: 596337 - RNA, 64 nt, Homo Sapiens; identical to SEQ ID NO: 267569

SEQ ID NO: 596338 - RNA, 64 nt, Homo Sapiens; identical to SEQ ID NO: 267570

SEQ ID NO: 596339 - RNA, 64 nt, Homo Sapiens; identical to SEQ ID NO: 267571

SEQ ID NO: 596340 - RNA, 64 nt, Homo Sapiens; identical to SEQ ID NO: 267572

SEQ ID NO: 596341 - RNA, 64 nt, Homo Sapiens; identical to SEQ ID NO: 267573

SEQ ID NO: 596342 - RNA, 64 nt, Homo Sapiens; identical to SEQ ID NO: 267574

SEQ ID NO: 596343 - RNA, 64 nt, Homo Sapiens; identical to SEQ ID NO: 267575

SEQ ID NO: 596344 - RNA, 64 nt, Homo Sapiens; identical to SEQ ID NO: 267576

SEQ ID NO: 596345 - RNA, 64 nt, Homo Sapiens; identical to SEQ ID NO: 267577

SEQ ID NO: 596346 - RNA, 64 nt, Homo Sapiens; identical to SEQ ID NO: 267578

SEQ ID NO: 596347 - RNA, 64 nt, Homo Sapiens; identical to SEQ ID NO: 267579

SEQ ID NO: 596348 - RNA, 64 nt, Homo Sapiens; identical to SEQ ID NO: 267580

SEQ ID NO: 596349 - RNA, 64 nt, Homo Sapiens; identical to SEQ ID NO: 267581

SEQ ID NO: 596350 - RNA, 64 nt, Homo Sapiens; identical to SEQ ID NO: 267582

SEQ ID NO: 596351 - RNA, 64 nt, Homo Sapiens; identical to SEQ ID NO: 267583

SEQ ID NO: 596352 - RNA, 64 nt, Homo Sapiens; identical to SEQ ID NO: 267584

SEQ ID NO: 596353 - RNA, 64 nt, Homo Sapiens; identical to SEQ ID NO: 267585

SEQ ID NO: 596354 - RNA, 64 nt, Homo Sapiens; identical to SEQ ID NO: 267586

SEQ ID NO: 596355 - RNA, 64 nt, Homo Sapiens; identical to SEQ ID NO: 267587

SEQ ID NO: 596356 - RNA, 64 nt, Homo Sapiens; identical to SEQ ID NO: 267588

SEQ ID NO: 596357 - RNA, 64 nt, Homo Sapiens; identical to SEQ ID NO: 267589

SEQ ID NO: 596358 - RNA, 64 nt, Homo Sapiens; identical to SEQ ID NO: 267590

SEQ ID NO: 596359 - RNA, 64 nt, Homo Sapiens; identical to SEQ ID NO: 267591

SEQ ID NO: 596360 - RNA, 64 nt, Homo Sapiens; identical to SEQ ID NO: 267592

SEQ ID NO: 596361 - RNA, 64 nt, Homo Sapiens; identical to SEQ ID NO: 267593

SEQ ID NO: 596362 - RNA, 64 nt, Homo Sapiens; identical to SEQ ID NO: 267594

SEQ ID NO: 596363 - RNA, 64 nt, Homo Sapiens; identical to SEQ ID NO: 267595

SEQ ID NO: 596364 - RNA, 64 nt, Homo Sapiens; identical to SEQ ID NO: 267596

SEQ ID NO: 596365 - RNA, 64 nt, Homo Sapiens; identical to SEQ ID NO: 267597

SEQ ID NO: 596366 - RNA, 64 nt, Homo Sapiens; identical to SEQ ID NO: 267598

SEQ ID NO: 596367 - RNA, 64 nt, Homo Sapiens; identical to SEQ ID NO: 267599

SEQ ID NO: 596368 - RNA, 64 nt, Homo Sapiens; identical to SEQ ID NO: 267600

SEQ ID NO: 596369 - RNA, 64 nt, Homo Sapiens; identical to SEQ ID NO: 267601

SEQ ID NO: 596370 - RNA, 64 nt, Homo Sapiens; identical to SEQ ID NO: 267602

SEQ ID NO: 596371 - RNA, 64 nt, Homo Sapiens; identical to SEQ ID NO: 267603

SEQ ID NO: 596372 - RNA, 64 nt, Homo Sapiens; identical to SEQ ID NO: 267604

SEQ ID NO: 596373 - RNA, 64 nt, Homo Sapiens; identical to SEQ ID NO: 267605

SEQ ID NO: 596374 - RNA, 64 nt, Homo Sapiens; identical to SEQ ID NO: 267606

SEQ ID NO: 596375 - RNA, 64 nt, Homo Sapiens; identical to SEQ ID NO: 267607

SEQ ID NO: 596376 - RNA, 64 nt, Homo Sapiens; identical to SEQ ID NO: 267608

SEQ ID NO: 596377 - RNA, 64 nt, Homo Sapiens; identical to SEQ ID NO: 267609

SEQ ID NO: 596378 - RNA, 64 nt, Homo Sapiens; identical to SEQ ID NO: 267610

SEQ ID NO: 596379 - RNA, 64 nt, Homo Sapiens; identical to SEQ ID NO: 267611

SEQ ID NO: 596380 - RNA, 64 nt, Homo Sapiens; identical to SEQ ID NO: 267612

SEQ ID NO: 596381 - RNA, 64 nt, Homo Sapiens; identical to SEQ ID NO: 267613

SEQ ID NO: 596382 - RNA, 64 nt, Homo Sapiens; identical to SEQ ID NO: 267614

SEQ ID NO: 596383 - RNA, 64 nt, Homo Sapiens; identical to SEQ ID NO: 267615

SEQ ID NO: 596384 - RNA, 64 nt, Homo Sapiens; identical to SEQ ID NO: 267616

SEQ ID NO: 596385 - RNA, 64 nt, Homo Sapiens; identical to SEQ ID NO: 267617

SEQ ID NO: 596386 - RNA, 64 nt, Homo Sapiens; identical to SEQ ID NO: 267618

SEQ ID NO: 596387 - RNA, 64 nt, Homo Sapiens; identical to SEQ ID NO: 267619

SEQ ID NO: 596388 - RNA, 64 nt, Homo Sapiens; identical to SEQ ID NO: 267620

SEQ ID NO: 596389 - RNA, 64 nt, Homo Sapiens; identical to SEQ ID NO: 267621

SEQ ID NO: 596390 - RNA, 64 nt, Homo Sapiens; identical to SEQ ID NO: 267622

SEQ ID NO: 596391 - RNA, 64 nt, Homo Sapiens; identical to SEQ ID NO: 267623

SEQ ID NO: 596392 - RNA, 64 nt, Homo Sapiens; identical to SEQ ID NO: 267624

SEQ ID NO: 596393 - RNA, 64 nt, Homo Sapiens; identical to SEQ ID NO: 267625

SEQ ID NO: 596394 - RNA, 64 nt, Homo Sapiens; identical to SEQ ID NO: 267626

SEQ ID NO: 596395 - RNA, 64 nt, Homo Sapiens; identical to SEQ ID NO: 267627

SEQ ID NO: 596396 - RNA, 64 nt, Homo Sapiens; identical to SEQ ID NO: 267628

SEQ ID NO: 596397 - RNA, 64 nt, Homo Sapiens; identical to SEQ ID NO: 267629

SEQ ID NO: 596398 - RNA, 64 nt, Homo Sapiens; identical to SEQ ID NO: 267630

SEQ ID NO: 596399 - RNA, 64 nt, Homo Sapiens; identical to SEQ ID NO: 267631

SEQ ID NO: 596400 - RNA, 64 nt, Homo Sapiens; identical to SEQ ID NO: 267632

SEQ ID NO: 596401 - RNA, 64 nt, Homo Sapiens; identical to SEQ ID NO: 267633

SEQ ID NO: 596402 - RNA, 64 nt, Homo Sapiens; identical to SEQ ID NO: 267634

SEQ ID NO: 596403 - RNA, 64 nt, Homo Sapiens; identical to SEQ ID NO: 267635

SEQ ID NO: 596404 - RNA, 64 nt, Homo Sapiens; identical to SEQ ID NO: 267636

SEQ ID NO: 596405 - RNA, 64 nt, Homo Sapiens; identical to SEQ ID NO: 267637

SEQ ID NO: 596406 - RNA, 64 nt, Homo Sapiens; identical to SEQ ID NO: 267638

SEQ ID NO: 596407 - RNA, 64 nt, Homo Sapiens; identical to SEQ ID NO: 267639

SEQ ID NO: 596408 - RNA, 64 nt, Homo Sapiens; identical to SEQ ID NO: 267640

SEQ ID NO: 596409 - RNA, 64 nt, Homo Sapiens; identical to SEQ ID NO: 267641

SEQ ID NO: 596410 - RNA, 64 nt, Homo Sapiens; identical to SEQ ID NO: 267642

SEQ ID NO: 596411 - RNA, 64 nt, Homo Sapiens; identical to SEQ ID NO: 267643

SEQ ID NO: 596412 - RNA, 64 nt, Homo Sapiens; identical to SEQ ID NO: 267644

SEQ ID NO: 596413 - RNA, 64 nt, Homo Sapiens; identical to SEQ ID NO: 267645

SEQ ID NO: 596414 - RNA, 64 nt, Homo Sapiens; identical to SEQ ID NO: 267646

SEQ ID NO: 596415 - RNA, 64 nt, Homo Sapiens; identical to SEQ ID NO: 267647

SEQ ID NO: 596416 - RNA, 64 nt, Homo Sapiens; identical to SEQ ID NO: 267648

SEQ ID NO: 596417 - RNA, 64 nt, Homo Sapiens; identical to SEQ ID NO: 267649

SEQ ID NO: 596418 - RNA, 64 nt, Homo Sapiens; identical to SEQ ID NO: 267650

SEQ ID NO: 596419 - RNA, 64 nt, Homo Sapiens; identical to SEQ ID NO: 267651

SEQ ID NO: 596420 - RNA, 64 nt, Homo Sapiens; identical to SEQ ID NO: 267652

SEQ ID NO: 596421 - RNA, 64 nt, Homo Sapiens; identical to SEQ ID NO: 267653

SEQ ID NO: 596422 - RNA, 64 nt, Homo Sapiens; identical to SEQ ID NO: 267654

SEQ ID NO: 596423 - RNA, 64 nt, Homo Sapiens; identical to SEQ ID NO: 267655

SEQ ID NO: 596424 - RNA, 64 nt, Homo Sapiens; identical to SEQ ID NO: 267656

SEQ ID NO: 596425 - RNA, 64 nt, Homo Sapiens; identical to SEQ ID NO: 267657

SEQ ID NO: 596426 - RNA, 64 nt, Homo Sapiens; identical to SEQ ID NO: 267658

SEQ ID NO: 596427 - RNA, 64 nt, Homo Sapiens; identical to SEQ ID NO: 267659

SEQ ID NO: 596428 - RNA, 64 nt, Homo Sapiens; identical to SEQ ID NO: 267660

SEQ ID NO: 596429 - RNA, 64 nt, Homo Sapiens; identical to SEQ ID NO: 267661

SEQ ID NO: 596430 - RNA, 64 nt, Homo Sapiens; identical to SEQ ID NO: 267662

SEQ ID NO: 596431 - RNA, 64 nt, Homo Sapiens; identical to SEQ ID NO: 267663

SEQ ID NO: 596432 - RNA, 64 nt, Homo Sapiens; identical to SEQ ID NO: 267664

SEQ ID NO: 596433 - RNA, 64 nt, Homo Sapiens; identical to SEQ ID NO: 267665

SEQ ID NO: 596434 - RNA, 64 nt, Homo Sapiens; identical to SEQ ID NO: 267666

SEQ ID NO: 596435 - RNA, 64 nt, Homo Sapiens; identical to SEQ ID NO: 267667

SEQ ID NO: 596436 - RNA, 64 nt, Homo Sapiens; identical to SEQ ID NO: 267668

SEQ ID NO: 596437 - RNA, 64 nt, Homo Sapiens; identical to SEQ ID NO: 267669

SEQ ID NO: 596438 - RNA, 64 nt, Homo Sapiens; identical to SEQ ID NO: 267670

SEQ ID NO: 596439 - RNA, 64 nt, Homo Sapiens; identical to SEQ ID NO: 267671

SEQ ID NO: 596440 - RNA, 64 nt, Homo Sapiens; identical to SEQ ID NO: 267672

SEQ ID NO: 596441 - RNA, 64 nt, Homo Sapiens; identical to SEQ ID NO: 267673

SEQ ID NO: 596442 - RNA, 64 nt, Homo Sapiens; identical to SEQ ID NO: 267674

SEQ ID NO: 596443 - RNA, 64 nt, Homo Sapiens; identical to SEQ ID NO: 267675

SEQ ID NO: 596444 - RNA, 64 nt, Homo Sapiens; identical to SEQ ID NO: 267676

SEQ ID NO: 596445 - RNA, 64 nt, Homo Sapiens; identical to SEQ ID NO: 267677

SEQ ID NO: 596446 - RNA, 64 nt, Homo Sapiens; identical to SEQ ID NO: 267678

SEQ ID NO: 596447 - RNA, 64 nt, Homo Sapiens; identical to SEQ ID NO: 267679

SEQ ID NO: 596448 - RNA, 64 nt, Homo Sapiens; identical to SEQ ID NO: 267680

SEQ ID NO: 596449 - RNA, 64 nt, Homo Sapiens; identical to SEQ ID NO: 267681

SEQ ID NO: 596450 - RNA, 64 nt, Homo Sapiens; identical to SEQ ID NO: 267682

SEQ ID NO: 596451 - RNA, 64 nt, Homo Sapiens; identical to SEQ ID NO: 267683

SEQ ID NO: 596452 - RNA, 64 nt, Homo Sapiens; identical to SEQ ID NO: 267684

SEQ ID NO: 596453 - RNA, 64 nt, Homo Sapiens; identical to SEQ ID NO: 267685

SEQ ID NO: 596454 - RNA, 64 nt, Homo Sapiens; identical to SEQ ID NO: 267686

SEQ ID NO: 596455 - RNA, 64 nt, Homo Sapiens; identical to SEQ ID NO: 267687

SEQ ID NO: 596456 - RNA, 64 nt, Homo Sapiens; identical to SEQ ID NO: 267688

SEQ ID NO: 596457 - RNA, 64 nt, Homo Sapiens; identical to SEQ ID NO: 267689

SEQ ID NO: 596458 - RNA, 64 nt, Homo Sapiens; identical to SEQ ID NO: 267690

SEQ ID NO: 596459 - RNA, 64 nt, Homo Sapiens; identical to SEQ ID NO: 267691

SEQ ID NO: 596460 - RNA, 64 nt, Homo Sapiens; identical to SEQ ID NO: 267692

SEQ ID NO: 596461 - RNA, 64 nt, Homo Sapiens; identical to SEQ ID NO: 267693

SEQ ID NO: 596462 - RNA, 64 nt, Homo Sapiens; identical to SEQ ID NO: 267694

SEQ ID NO: 596463 - RNA, 64 nt, Homo Sapiens; identical to SEQ ID NO: 267695

SEQ ID NO: 596464 - RNA, 64 nt, Homo Sapiens; identical to SEQ ID NO: 267696

SEQ ID NO: 596465 - RNA, 64 nt, Homo Sapiens; identical to SEQ ID NO: 267697

SEQ ID NO: 596466 - RNA, 64 nt, Homo Sapiens; identical to SEQ ID NO: 267698

SEQ ID NO: 596467 - RNA, 64 nt, Homo Sapiens; identical to SEQ ID NO: 267699

SEQ ID NO: 596468 - RNA, 64 nt, Homo Sapiens; identical to SEQ ID NO: 267700

SEQ ID NO: 596469 - RNA, 64 nt, Homo Sapiens; identical to SEQ ID NO: 267701

SEQ ID NO: 596470 - RNA, 64 nt, Homo Sapiens; identical to SEQ ID NO: 267702

SEQ ID NO: 596471 - RNA, 64 nt, Homo Sapiens; identical to SEQ ID NO: 267703

SEQ ID NO: 596472 - RNA, 64 nt, Homo Sapiens; identical to SEQ ID NO: 267704

SEQ ID NO: 596473 - RNA, 64 nt, Homo Sapiens; identical to SEQ ID NO: 267705

SEQ ID NO: 596474 - RNA, 64 nt, Homo Sapiens; identical to SEQ ID NO: 267706

SEQ ID NO: 596475 - RNA, 64 nt, Homo Sapiens; identical to SEQ ID NO: 267707

SEQ ID NO: 596476 - RNA, 64 nt, Homo Sapiens; identical to SEQ ID NO: 267708

SEQ ID NO: 596477 - RNA, 64 nt, Homo Sapiens; identical to SEQ ID NO: 267709

SEQ ID NO: 596478 - RNA, 64 nt, Homo Sapiens; identical to SEQ ID NO: 267710

SEQ ID NO: 596479 - RNA, 64 nt, Homo Sapiens; identical to SEQ ID NO: 267711

SEQ ID NO: 596480 - RNA, 64 nt, Homo Sapiens; identical to SEQ ID NO: 267712

SEQ ID NO: 596481 - RNA, 64 nt, Homo Sapiens; identical to SEQ ID NO: 267713

SEQ ID NO: 596482 - RNA, 64 nt, Homo Sapiens; identical to SEQ ID NO: 267714

SEQ ID NO: 596483 - RNA, 64 nt, Homo Sapiens; identical to SEQ ID NO: 267715

SEQ ID NO: 596484 - RNA, 64 nt, Homo Sapiens; identical to SEQ ID NO: 267716

SEQ ID NO: 596485 - RNA, 64 nt, Homo Sapiens; identical to SEQ ID NO: 267717

SEQ ID NO: 596486 - RNA, 64 nt, Homo Sapiens; identical to SEQ ID NO: 267718

SEQ ID NO: 596487 - RNA, 64 nt, Homo Sapiens; identical to SEQ ID NO: 267719

SEQ ID NO: 596488 - RNA, 64 nt, Homo Sapiens; identical to SEQ ID NO: 267720

SEQ ID NO: 596489 - RNA, 64 nt, Homo Sapiens; identical to SEQ ID NO: 267721

SEQ ID NO: 596490 - RNA, 64 nt, Homo Sapiens; identical to SEQ ID NO: 267722

SEQ ID NO: 596491 - RNA, 64 nt, Homo Sapiens; identical to SEQ ID NO: 267723

SEQ ID NO: 596492 - RNA, 64 nt, Homo Sapiens; identical to SEQ ID NO: 267724

SEQ ID NO: 596493 - RNA, 64 nt, Homo Sapiens; identical to SEQ ID NO: 267725

SEQ ID NO: 596494 - RNA, 64 nt, Homo Sapiens; identical to SEQ ID NO: 267726

SEQ ID NO: 596495 - RNA, 64 nt, Homo Sapiens; identical to SEQ ID NO: 267727

SEQ ID NO: 596496 - RNA, 64 nt, Homo Sapiens; identical to SEQ ID NO: 267728

SEQ ID NO: 596497 - RNA, 64 nt, Homo Sapiens; identical to SEQ ID NO: 267729

SEQ ID NO: 596498 - RNA, 64 nt, Homo Sapiens; identical to SEQ ID NO: 267730

SEQ ID NO: 596499 - RNA, 64 nt, Homo Sapiens; identical to SEQ ID NO: 267731

SEQ ID NO: 596500 - RNA, 64 nt, Homo Sapiens; identical to SEQ ID NO: 267732

SEQ ID NO: 596501 - RNA, 64 nt, Homo Sapiens; identical to SEQ ID NO: 267733

SEQ ID NO: 596502 - RNA, 64 nt, Homo Sapiens; identical to SEQ ID NO: 267734

SEQ ID NO: 596503 - RNA, 64 nt, Homo Sapiens; identical to SEQ ID NO: 267735

SEQ ID NO: 596504 - RNA, 64 nt, Homo Sapiens; identical to SEQ ID NO: 267736

SEQ ID NO: 596505 - RNA, 64 nt, Homo Sapiens; identical to SEQ ID NO: 267737

SEQ ID NO: 596506 - RNA, 64 nt, Homo Sapiens; identical to SEQ ID NO: 267738

SEQ ID NO: 596507 - RNA, 64 nt, Homo Sapiens; identical to SEQ ID NO: 267739

SEQ ID NO: 596508 - RNA, 64 nt, Homo Sapiens; identical to SEQ ID NO: 267740

SEQ ID NO: 596509 - RNA, 64 nt, Homo Sapiens; identical to SEQ ID NO: 267741

SEQ ID NO: 596510 - RNA, 64 nt, Homo Sapiens; identical to SEQ ID NO: 267742

SEQ ID NO: 596511 - RNA, 64 nt, Homo Sapiens; identical to SEQ ID NO: 267743

SEQ ID NO: 596512 - RNA, 64 nt, Homo Sapiens; identical to SEQ ID NO: 267744

SEQ ID NO: 596513 - RNA, 64 nt, Homo Sapiens; identical to SEQ ID NO: 267745

SEQ ID NO: 596514 - RNA, 64 nt, Homo Sapiens; identical to SEQ ID NO: 267746

SEQ ID NO: 596515 - RNA, 64 nt, Homo Sapiens; identical to SEQ ID NO: 267747

SEQ ID NO: 596516 - RNA, 64 nt, Homo Sapiens; identical to SEQ ID NO: 267748

SEQ ID NO: 596517 - RNA, 64 nt, Homo Sapiens; identical to SEQ ID NO: 267749

SEQ ID NO: 596518 - RNA, 64 nt, Homo Sapiens; identical to SEQ ID NO: 267750

SEQ ID NO: 596519 - RNA, 64 nt, Homo Sapiens; identical to SEQ ID NO: 267751

SEQ ID NO: 596520 - RNA, 64 nt, Homo Sapiens; identical to SEQ ID NO: 267752

SEQ ID NO: 596521 - RNA, 64 nt, Homo Sapiens; identical to SEQ ID NO: 267753

SEQ ID NO: 596522 - RNA, 64 nt, Homo Sapiens; identical to SEQ ID NO: 267754

SEQ ID NO: 596523 - RNA, 64 nt, Homo Sapiens; identical to SEQ ID NO: 267755

SEQ ID NO: 596524 - RNA, 64 nt, Homo Sapiens; identical to SEQ ID NO: 267756

SEQ ID NO: 596525 - RNA, 64 nt, Homo Sapiens; identical to SEQ ID NO: 267757

SEQ ID NO: 596526 - RNA, 64 nt, Homo Sapiens; identical to SEQ ID NO: 267758

SEQ ID NO: 596527 - RNA, 64 nt, Homo Sapiens; identical to SEQ ID NO: 267759

SEQ ID NO: 596528 - RNA, 64 nt, Homo Sapiens; identical to SEQ ID NO: 267760

SEQ ID NO: 596529 - RNA, 64 nt, Homo Sapiens; identical to SEQ ID NO: 267761

SEQ ID NO: 596530 - RNA, 64 nt, Homo Sapiens; identical to SEQ ID NO: 267762

SEQ ID NO: 596531 - RNA, 64 nt, Homo Sapiens; identical to SEQ ID NO: 267763

SEQ ID NO: 596532 - RNA, 64 nt, Homo Sapiens; identical to SEQ ID NO: 267764

SEQ ID NO: 596533 - RNA, 64 nt, Homo Sapiens; identical to SEQ ID NO: 267765

SEQ ID NO: 596534 - RNA, 64 nt, Homo Sapiens; identical to SEQ ID NO: 267766

SEQ ID NO: 596535 - RNA, 64 nt, Homo Sapiens; identical to SEQ ID NO: 267767

SEQ ID NO: 596536 - RNA, 64 nt, Homo Sapiens; identical to SEQ ID NO: 267768

SEQ ID NO: 596537 - RNA, 64 nt, Homo Sapiens; identical to SEQ ID NO: 267769

SEQ ID NO: 596538 - RNA, 64 nt, Homo Sapiens; identical to SEQ ID NO: 267770

SEQ ID NO: 596539 - RNA, 64 nt, Homo Sapiens; identical to SEQ ID NO: 267771

SEQ ID NO: 596540 - RNA, 64 nt, Homo Sapiens; identical to SEQ ID NO: 267772

SEQ ID NO: 596541 - RNA, 64 nt, Homo Sapiens; identical to SEQ ID NO: 267773

SEQ ID NO: 596542 - RNA, 64 nt, Homo Sapiens; identical to SEQ ID NO: 267774

SEQ ID NO: 596543 - RNA, 64 nt, Homo Sapiens; identical to SEQ ID NO: 267775

SEQ ID NO: 596544 - RNA, 64 nt, Homo Sapiens; identical to SEQ ID NO: 267776

SEQ ID NO: 596545 - RNA, 64 nt, Homo Sapiens; identical to SEQ ID NO: 267777

SEQ ID NO: 596546 - RNA, 64 nt, Homo Sapiens; identical to SEQ ID NO: 267778

SEQ ID NO: 596547 - RNA, 64 nt, Homo Sapiens; identical to SEQ ID NO: 267779

SEQ ID NO: 596548 - RNA, 64 nt, Homo Sapiens; identical to SEQ ID NO: 267780

SEQ ID NO: 596549 - RNA, 64 nt, Homo Sapiens; identical to SEQ ID NO: 267781

SEQ ID NO: 596550 - RNA, 64 nt, Homo Sapiens; identical to SEQ ID NO: 267782

SEQ ID NO: 596551 - RNA, 64 nt, Homo Sapiens; identical to SEQ ID NO: 267783

SEQ ID NO: 596552 - RNA, 64 nt, Homo Sapiens; identical to SEQ ID NO: 267784

SEQ ID NO: 596553 - RNA, 64 nt, Homo Sapiens; identical to SEQ ID NO: 267785

SEQ ID NO: 596554 - RNA, 64 nt, Homo Sapiens; identical to SEQ ID NO: 267786

SEQ ID NO: 596555 - RNA, 64 nt, Homo Sapiens; identical to SEQ ID NO: 267787

SEQ ID NO: 596556 - RNA, 64 nt, Homo Sapiens; identical to SEQ ID NO: 267788

SEQ ID NO: 596557 - RNA, 64 nt, Homo Sapiens; identical to SEQ ID NO: 267789

SEQ ID NO: 596558 - RNA, 64 nt, Homo Sapiens; identical to SEQ ID NO: 267790

SEQ ID NO: 596559 - RNA, 64 nt, Homo Sapiens; identical to SEQ ID NO: 267791

SEQ ID NO: 596560 - RNA, 64 nt, Homo Sapiens; identical to SEQ ID NO: 267792

SEQ ID NO: 596561 - RNA, 64 nt, Homo Sapiens; identical to SEQ ID NO: 267793

SEQ ID NO: 596562 - RNA, 64 nt, Homo Sapiens; identical to SEQ ID NO: 267794

SEQ ID NO: 596563 - RNA, 64 nt, Homo Sapiens; identical to SEQ ID NO: 267795

SEQ ID NO: 596564 - RNA, 64 nt, Homo Sapiens; identical to SEQ ID NO: 267796

SEQ ID NO: 596565 - RNA, 64 nt, Homo Sapiens; identical to SEQ ID NO: 267797

SEQ ID NO: 596566 - RNA, 64 nt, Homo Sapiens; identical to SEQ ID NO: 267798

SEQ ID NO: 596567 - RNA, 64 nt, Homo Sapiens; identical to SEQ ID NO: 267799

SEQ ID NO: 596568 - RNA, 64 nt, Homo Sapiens; identical to SEQ ID NO: 267800

SEQ ID NO: 596569 - RNA, 64 nt, Homo Sapiens; identical to SEQ ID NO: 267801

SEQ ID NO: 596570 - RNA, 64 nt, Homo Sapiens; identical to SEQ ID NO: 267802

SEQ ID NO: 596571 - RNA, 64 nt, Homo Sapiens; identical to SEQ ID NO: 267803

SEQ ID NO: 596572 - RNA, 64 nt, Homo Sapiens; identical to SEQ ID NO: 267804

SEQ ID NO: 596573 - RNA, 64 nt, Homo Sapiens; identical to SEQ ID NO: 267805

SEQ ID NO: 596574 - RNA, 64 nt, Homo Sapiens; identical to SEQ ID NO: 267806

SEQ ID NO: 596575 - RNA, 64 nt, Homo Sapiens; identical to SEQ ID NO: 267807

SEQ ID NO: 596576 - RNA, 64 nt, Homo Sapiens; identical to SEQ ID NO: 267808

SEQ ID NO: 596577 - RNA, 64 nt, Homo Sapiens; identical to SEQ ID NO: 267809

SEQ ID NO: 596578 - RNA, 64 nt, Homo Sapiens; identical to SEQ ID NO: 267810

SEQ ID NO: 596579 - RNA, 64 nt, Homo Sapiens; identical to SEQ ID NO: 267811

SEQ ID NO: 596580 - RNA, 64 nt, Homo Sapiens; identical to SEQ ID NO: 267812

SEQ ID NO: 596581 - RNA, 64 nt, Homo Sapiens; identical to SEQ ID NO: 267813

SEQ ID NO: 596582 - RNA, 64 nt, Homo Sapiens; identical to SEQ ID NO: 267814

SEQ ID NO: 596583 - RNA, 64 nt, Homo Sapiens; identical to SEQ ID NO: 267815

SEQ ID NO: 596584 - RNA, 64 nt, Homo Sapiens; identical to SEQ ID NO: 267816

SEQ ID NO: 596585 - RNA, 64 nt, Homo Sapiens; identical to SEQ ID NO: 267817

SEQ ID NO: 596586 - RNA, 64 nt, Homo Sapiens; identical to SEQ ID NO: 267818

SEQ ID NO: 596587 - RNA, 64 nt, Homo Sapiens; identical to SEQ ID NO: 267819

SEQ ID NO: 596588 - RNA, 64 nt, Homo Sapiens; identical to SEQ ID NO: 267820

SEQ ID NO: 596589 - RNA, 64 nt, Homo Sapiens; identical to SEQ ID NO: 267821

SEQ ID NO: 596590 - RNA, 64 nt, Homo Sapiens; identical to SEQ ID NO: 267822

SEQ ID NO: 596591 - RNA, 64 nt, Homo Sapiens; identical to SEQ ID NO: 267823

SEQ ID NO: 596592 - RNA, 64 nt, Homo Sapiens; identical to SEQ ID NO: 267824

SEQ ID NO: 596593 - RNA, 64 nt, Homo Sapiens; identical to SEQ ID NO: 267825

SEQ ID NO: 596594 - RNA, 64 nt, Homo Sapiens; identical to SEQ ID NO: 267826

SEQ ID NO: 596595 - RNA, 64 nt, Homo Sapiens; identical to SEQ ID NO: 267827

SEQ ID NO: 596596 - RNA, 64 nt, Homo Sapiens; identical to SEQ ID NO: 267828

SEQ ID NO: 596597 - RNA, 64 nt, Homo Sapiens; identical to SEQ ID NO: 267829

SEQ ID NO: 596598 - RNA, 64 nt, Homo Sapiens; identical to SEQ ID NO: 267830

SEQ ID NO: 596599 - RNA, 64 nt, Homo Sapiens; identical to SEQ ID NO: 267831

SEQ ID NO: 596600 - RNA, 64 nt, Homo Sapiens; identical to SEQ ID NO: 267832

SEQ ID NO: 596601 - RNA, 64 nt, Homo Sapiens; identical to SEQ ID NO: 267833

SEQ ID NO: 596602 - RNA, 64 nt, Homo Sapiens; identical to SEQ ID NO: 267834

SEQ ID NO: 596603 - RNA, 64 nt, Homo Sapiens; identical to SEQ ID NO: 267835

SEQ ID NO: 596604 - RNA, 64 nt, Homo Sapiens; identical to SEQ ID NO: 267836

SEQ ID NO: 596605 - RNA, 64 nt, Homo Sapiens; identical to SEQ ID NO: 267837

SEQ ID NO: 596606 - RNA, 64 nt, Homo Sapiens; identical to SEQ ID NO: 267838

SEQ ID NO: 596607 - RNA, 64 nt, Homo Sapiens; identical to SEQ ID NO: 267839

SEQ ID NO: 596608 - RNA, 64 nt, Homo Sapiens; identical to SEQ ID NO: 267840

SEQ ID NO: 596609 - RNA, 64 nt, Homo Sapiens; identical to SEQ ID NO: 267841

SEQ ID NO: 596610 - RNA, 64 nt, Homo Sapiens; identical to SEQ ID NO: 267842

SEQ ID NO: 596611 - RNA, 64 nt, Homo Sapiens; identical to SEQ ID NO: 267843

SEQ ID NO: 596612 - RNA, 64 nt, Homo Sapiens; identical to SEQ ID NO: 267844

SEQ ID NO: 596613 - RNA, 64 nt, Homo Sapiens; identical to SEQ ID NO: 267845

SEQ ID NO: 596614 - RNA, 64 nt, Homo Sapiens; identical to SEQ ID NO: 267846

SEQ ID NO: 596615 - RNA, 64 nt, Homo Sapiens; identical to SEQ ID NO: 267847

SEQ ID NO: 596616 - RNA, 64 nt, Homo Sapiens; identical to SEQ ID NO: 267848

SEQ ID NO: 596617 - RNA, 64 nt, Homo Sapiens; identical to SEQ ID NO: 267849

SEQ ID NO: 596618 - RNA, 64 nt, Homo Sapiens; identical to SEQ ID NO: 267850

SEQ ID NO: 596619 - RNA, 64 nt, Homo Sapiens; identical to SEQ ID NO: 267851

SEQ ID NO: 596620 - RNA, 64 nt, Homo Sapiens; identical to SEQ ID NO: 267852

SEQ ID NO: 596621 - RNA, 64 nt, Homo Sapiens; identical to SEQ ID NO: 267853

SEQ ID NO: 596622 - RNA, 64 nt, Homo Sapiens; identical to SEQ ID NO: 267854

SEQ ID NO: 596623 - RNA, 64 nt, Homo Sapiens; identical to SEQ ID NO: 267855

SEQ ID NO: 596624 - RNA, 64 nt, Homo Sapiens; identical to SEQ ID NO: 267856

SEQ ID NO: 596625 - RNA, 64 nt, Homo Sapiens; identical to SEQ ID NO: 267857

SEQ ID NO: 596626 - RNA, 64 nt, Homo Sapiens; identical to SEQ ID NO: 267858

SEQ ID NO: 596627 - RNA, 64 nt, Homo Sapiens; identical to SEQ ID NO: 267859

SEQ ID NO: 596628 - RNA, 64 nt, Homo Sapiens; identical to SEQ ID NO: 267860

SEQ ID NO: 596629 - RNA, 64 nt, Homo Sapiens; identical to SEQ ID NO: 267861

SEQ ID NO: 596630 - RNA, 64 nt, Homo Sapiens; identical to SEQ ID NO: 267862

SEQ ID NO: 596631 - RNA, 64 nt, Homo Sapiens; identical to SEQ ID NO: 267863

SEQ ID NO: 596632 - RNA, 64 nt, Homo Sapiens; identical to SEQ ID NO: 267864

SEQ ID NO: 596633 - RNA, 64 nt, Homo Sapiens; identical to SEQ ID NO: 267865

SEQ ID NO: 596634 - RNA, 64 nt, Homo Sapiens; identical to SEQ ID NO: 267866

SEQ ID NO: 596635 - RNA, 64 nt, Homo Sapiens; identical to SEQ ID NO: 267867

SEQ ID NO: 596636 - RNA, 64 nt, Homo Sapiens; identical to SEQ ID NO: 267868

SEQ ID NO: 596637 - RNA, 64 nt, Homo Sapiens; identical to SEQ ID NO: 267869

SEQ ID NO: 596638 - RNA, 64 nt, Homo Sapiens; identical to SEQ ID NO: 267870

SEQ ID NO: 596639 - RNA, 64 nt, Homo Sapiens; identical to SEQ ID NO: 267871

SEQ ID NO: 596640 - RNA, 64 nt, Homo Sapiens; identical to SEQ ID NO: 267872

SEQ ID NO: 596641 - RNA, 64 nt, Homo Sapiens; identical to SEQ ID NO: 267873

SEQ ID NO: 596642 - RNA, 64 nt, Homo Sapiens; identical to SEQ ID NO: 267874

SEQ ID NO: 596643 - RNA, 64 nt, Homo Sapiens; identical to SEQ ID NO: 267875

SEQ ID NO: 596644 - RNA, 64 nt, Homo Sapiens; identical to SEQ ID NO: 267876

SEQ ID NO: 596645 - RNA, 64 nt, Homo Sapiens; identical to SEQ ID NO: 267877

SEQ ID NO: 596646 - RNA, 64 nt, Homo Sapiens; identical to SEQ ID NO: 267878

SEQ ID NO: 596647 - RNA, 64 nt, Homo Sapiens; identical to SEQ ID NO: 267879

SEQ ID NO: 596648 - RNA, 64 nt, Homo Sapiens; identical to SEQ ID NO: 267880

SEQ ID NO: 596649 - RNA, 64 nt, Homo Sapiens; identical to SEQ ID NO: 267881

SEQ ID NO: 596650 - RNA, 64 nt, Homo Sapiens; identical to SEQ ID NO: 267882

SEQ ID NO: 596651 - RNA, 64 nt, Homo Sapiens; identical to SEQ ID NO: 267883

SEQ ID NO: 596652 - RNA, 64 nt, Homo Sapiens; identical to SEQ ID NO: 267884

SEQ ID NO: 596653 - RNA, 64 nt, Homo Sapiens; identical to SEQ ID NO: 267885

SEQ ID NO: 596654 - RNA, 64 nt, Homo Sapiens; identical to SEQ ID NO: 267886

SEQ ID NO: 596655 - RNA, 64 nt, Homo Sapiens; identical to SEQ ID NO: 267887

SEQ ID NO: 596656 - RNA, 64 nt, Homo Sapiens; identical to SEQ ID NO: 267888

SEQ ID NO: 596657 - RNA, 64 nt, Homo Sapiens; identical to SEQ ID NO: 267889

SEQ ID NO: 596658 - RNA, 64 nt, Homo Sapiens; identical to SEQ ID NO: 267890

SEQ ID NO: 596659 - RNA, 64 nt, Homo Sapiens; identical to SEQ ID NO: 267891

SEQ ID NO: 596660 - RNA, 64 nt, Homo Sapiens; identical to SEQ ID NO: 267892

SEQ ID NO: 596661 - RNA, 64 nt, Homo Sapiens; identical to SEQ ID NO: 267893

SEQ ID NO: 596662 - RNA, 64 nt, Homo Sapiens; identical to SEQ ID NO: 267894

SEQ ID NO: 596663 - RNA, 64 nt, Homo Sapiens; identical to SEQ ID NO: 267895

SEQ ID NO: 596664 - RNA, 64 nt, Homo Sapiens; identical to SEQ ID NO: 267896

SEQ ID NO: 596665 - RNA, 64 nt, Homo Sapiens; identical to SEQ ID NO: 267897

SEQ ID NO: 596666 - RNA, 64 nt, Homo Sapiens; identical to SEQ ID NO: 267898

SEQ ID NO: 596667 - RNA, 64 nt, Homo Sapiens; identical to SEQ ID NO: 267899

SEQ ID NO: 596668 - RNA, 64 nt, Homo Sapiens; identical to SEQ ID NO: 267900

SEQ ID NO: 596669 - RNA, 64 nt, Homo Sapiens; identical to SEQ ID NO: 267901

SEQ ID NO: 596670 - RNA, 64 nt, Homo Sapiens; identical to SEQ ID NO: 267902

SEQ ID NO: 596671 - RNA, 64 nt, Homo Sapiens; identical to SEQ ID NO: 267903

SEQ ID NO: 596672 - RNA, 64 nt, Homo Sapiens; identical to SEQ ID NO: 267904

SEQ ID NO: 596673 - RNA, 64 nt, Homo Sapiens; identical to SEQ ID NO: 267905

SEQ ID NO: 596674 - RNA, 64 nt, Homo Sapiens; identical to SEQ ID NO: 267906

SEQ ID NO: 596675 - RNA, 64 nt, Homo Sapiens; identical to SEQ ID NO: 267907

SEQ ID NO: 596676 - RNA, 64 nt, Homo Sapiens; identical to SEQ ID NO: 267908

SEQ ID NO: 596677 - RNA, 64 nt, Homo Sapiens; identical to SEQ ID NO: 267909

SEQ ID NO: 596678 - RNA, 64 nt, Homo Sapiens; identical to SEQ ID NO: 267910

SEQ ID NO: 596679 - RNA, 64 nt, Homo Sapiens; identical to SEQ ID NO: 267911

SEQ ID NO: 596680 - RNA, 64 nt, Homo Sapiens; identical to SEQ ID NO: 267912

SEQ ID NO: 596681 - RNA, 64 nt, Homo Sapiens; identical to SEQ ID NO: 267913

SEQ ID NO: 596682 - RNA, 64 nt, Homo Sapiens; identical to SEQ ID NO: 267914

SEQ ID NO: 596683 - RNA, 64 nt, Homo Sapiens; identical to SEQ ID NO: 267915

SEQ ID NO: 596684 - RNA, 64 nt, Homo Sapiens; identical to SEQ ID NO: 267916

SEQ ID NO: 596685 - RNA, 64 nt, Homo Sapiens; identical to SEQ ID NO: 267917

SEQ ID NO: 596686 - RNA, 64 nt, Homo Sapiens; identical to SEQ ID NO: 267918

SEQ ID NO: 596687 - RNA, 64 nt, Homo Sapiens; identical to SEQ ID NO: 267919

SEQ ID NO: 596688 - RNA, 64 nt, Homo Sapiens; identical to SEQ ID NO: 267920

SEQ ID NO: 596689 - RNA, 64 nt, Homo Sapiens; identical to SEQ ID NO: 267921

SEQ ID NO: 596690 - RNA, 64 nt, Homo Sapiens; identical to SEQ ID NO: 267922

SEQ ID NO: 596691 - RNA, 64 nt, Homo Sapiens; identical to SEQ ID NO: 267923

SEQ ID NO: 596692 - RNA, 64 nt, Homo Sapiens; identical to SEQ ID NO: 267924

SEQ ID NO: 596693 - RNA, 64 nt, Homo Sapiens; identical to SEQ ID NO: 267925

SEQ ID NO: 596694 - RNA, 64 nt, Homo Sapiens; identical to SEQ ID NO: 267926

SEQ ID NO: 596695 - RNA, 64 nt, Homo Sapiens; identical to SEQ ID NO: 267927

SEQ ID NO: 596696 - RNA, 64 nt, Homo Sapiens; identical to SEQ ID NO: 267928

SEQ ID NO: 596697 - RNA, 64 nt, Homo Sapiens; identical to SEQ ID NO: 267929

SEQ ID NO: 596698 - RNA, 64 nt, Homo Sapiens; identical to SEQ ID NO: 267930

SEQ ID NO: 596699 - RNA, 64 nt, Homo Sapiens; identical to SEQ ID NO: 267931

SEQ ID NO: 596700 - RNA, 64 nt, Homo Sapiens; identical to SEQ ID NO: 267932

SEQ ID NO: 596701 - RNA, 64 nt, Homo Sapiens; identical to SEQ ID NO: 267933

SEQ ID NO: 596702 - RNA, 64 nt, Homo Sapiens; identical to SEQ ID NO: 267934

SEQ ID NO: 596703 - RNA, 64 nt, Homo Sapiens; identical to SEQ ID NO: 267935

SEQ ID NO: 596704 - RNA, 64 nt, Homo Sapiens; identical to SEQ ID NO: 267936

SEQ ID NO: 596705 - RNA, 64 nt, Homo Sapiens; identical to SEQ ID NO: 267937

SEQ ID NO: 596706 - RNA, 64 nt, Homo Sapiens; identical to SEQ ID NO: 267938

SEQ ID NO: 596707 - RNA, 64 nt, Homo Sapiens; identical to SEQ ID NO: 267939

SEQ ID NO: 596708 - RNA, 64 nt, Homo Sapiens; identical to SEQ ID NO: 267940

SEQ ID NO: 596709 - RNA, 64 nt, Homo Sapiens; identical to SEQ ID NO: 267941

SEQ ID NO: 596710 - RNA, 64 nt, Homo Sapiens; identical to SEQ ID NO: 267942

SEQ ID NO: 596711 - RNA, 64 nt, Homo Sapiens; identical to SEQ ID NO: 267943

SEQ ID NO: 596712 - RNA, 64 nt, Homo Sapiens; identical to SEQ ID NO: 267944

SEQ ID NO: 596713 - RNA, 64 nt, Homo Sapiens; identical to SEQ ID NO: 267945

SEQ ID NO: 596714 - RNA, 64 nt, Homo Sapiens; identical to SEQ ID NO: 267946

SEQ ID NO: 596715 - RNA, 64 nt, Homo Sapiens; identical to SEQ ID NO: 267947

SEQ ID NO: 596716 - RNA, 64 nt, Homo Sapiens; identical to SEQ ID NO: 267948

SEQ ID NO: 596717 - RNA, 64 nt, Homo Sapiens; identical to SEQ ID NO: 267949

SEQ ID NO: 596718 - RNA, 64 nt, Homo Sapiens; identical to SEQ ID NO: 267950

SEQ ID NO: 596719 - RNA, 64 nt, Homo Sapiens; identical to SEQ ID NO: 267951

SEQ ID NO: 596720 - RNA, 64 nt, Homo Sapiens; identical to SEQ ID NO: 267952

SEQ ID NO: 596721 - RNA, 64 nt, Homo Sapiens; identical to SEQ ID NO: 267953

SEQ ID NO: 596722 - RNA, 64 nt, Homo Sapiens; identical to SEQ ID NO: 267954

SEQ ID NO: 596723 - RNA, 64 nt, Homo Sapiens; identical to SEQ ID NO: 267955

SEQ ID NO: 596724 - RNA, 64 nt, Homo Sapiens; identical to SEQ ID NO: 267956

SEQ ID NO: 596725 - RNA, 64 nt, Homo Sapiens; identical to SEQ ID NO: 267957

SEQ ID NO: 596726 - RNA, 64 nt, Homo Sapiens; identical to SEQ ID NO: 267958

SEQ ID NO: 596727 - RNA, 64 nt, Homo Sapiens; identical to SEQ ID NO: 267959

SEQ ID NO: 596728 - RNA, 64 nt, Homo Sapiens; identical to SEQ ID NO: 267960

SEQ ID NO: 596729 - RNA, 64 nt, Homo Sapiens; identical to SEQ ID NO: 267961

SEQ ID NO: 596730 - RNA, 64 nt, Homo Sapiens; identical to SEQ ID NO: 267962

SEQ ID NO: 596731 - RNA, 64 nt, Homo Sapiens; identical to SEQ ID NO: 267963

SEQ ID NO: 596732 - RNA, 64 nt, Homo Sapiens; identical to SEQ ID NO: 267964

SEQ ID NO: 596733 - RNA, 64 nt, Homo Sapiens; identical to SEQ ID NO: 267965

SEQ ID NO: 596734 - RNA, 64 nt, Homo Sapiens; identical to SEQ ID NO: 267966

SEQ ID NO: 596735 - RNA, 64 nt, Homo Sapiens; identical to SEQ ID NO: 267967

SEQ ID NO: 596736 - RNA, 64 nt, Homo Sapiens; identical to SEQ ID NO: 267968

SEQ ID NO: 596737 - RNA, 64 nt, Homo Sapiens; identical to SEQ ID NO: 267969

SEQ ID NO: 596738 - RNA, 64 nt, Homo Sapiens; identical to SEQ ID NO: 267970

SEQ ID NO: 596739 - RNA, 64 nt, Homo Sapiens; identical to SEQ ID NO: 267971

SEQ ID NO: 596740 - RNA, 64 nt, Homo Sapiens; identical to SEQ ID NO: 267972

SEQ ID NO: 596741 - RNA, 64 nt, Homo Sapiens; identical to SEQ ID NO: 267973

SEQ ID NO: 596742 - RNA, 64 nt, Homo Sapiens; identical to SEQ ID NO: 267974

SEQ ID NO: 596743 - RNA, 64 nt, Homo Sapiens; identical to SEQ ID NO: 267975

SEQ ID NO: 596744 - RNA, 64 nt, Homo Sapiens; identical to SEQ ID NO: 267976

SEQ ID NO: 596745 - RNA, 64 nt, Homo Sapiens; identical to SEQ ID NO: 267977

SEQ ID NO: 596746 - RNA, 64 nt, Homo Sapiens; identical to SEQ ID NO: 267978

SEQ ID NO: 596747 - RNA, 64 nt, Homo Sapiens; identical to SEQ ID NO: 267979

SEQ ID NO: 596748 - RNA, 64 nt, Homo Sapiens; identical to SEQ ID NO: 267980

SEQ ID NO: 596749 - RNA, 64 nt, Homo Sapiens; identical to SEQ ID NO: 267981

SEQ ID NO: 596750 - RNA, 64 nt, Homo Sapiens; identical to SEQ ID NO: 267982

SEQ ID NO: 596751 - RNA, 64 nt, Homo Sapiens; identical to SEQ ID NO: 267983

SEQ ID NO: 596752 - RNA, 64 nt, Homo Sapiens; identical to SEQ ID NO: 267984

SEQ ID NO: 596753 - RNA, 64 nt, Homo Sapiens; identical to SEQ ID NO: 267985

SEQ ID NO: 596754 - RNA, 63 nt, Homo Sapiens; identical to SEQ ID NO: 267986

SEQ ID NO: 596755 - RNA, 64 nt, Homo Sapiens; identical to SEQ ID NO: 267987

SEQ ID NO: 596756 - RNA, 64 nt, Homo Sapiens; identical to SEQ ID NO: 267988

SEQ ID NO: 596757 - RNA, 64 nt, Homo Sapiens; identical to SEQ ID NO: 267989

SEQ ID NO: 596758 - RNA, 64 nt, Homo Sapiens; identical to SEQ ID NO: 267990

SEQ ID NO: 596759 - RNA, 64 nt, Homo Sapiens; identical to SEQ ID NO: 267991

SEQ ID NO: 596760 - RNA, 64 nt, Homo Sapiens; identical to SEQ ID NO: 267992

SEQ ID NO: 596761 - RNA, 64 nt, Homo Sapiens; identical to SEQ ID NO: 267993

SEQ ID NO: 596762 - RNA, 64 nt, Homo Sapiens; identical to SEQ ID NO: 267994

SEQ ID NO: 596763 - RNA, 64 nt, Homo Sapiens; identical to SEQ ID NO: 267995

SEQ ID NO: 596764 - RNA, 64 nt, Homo Sapiens; identical to SEQ ID NO: 267996

SEQ ID NO: 596765 - RNA, 64 nt, Homo Sapiens; identical to SEQ ID NO: 267997

SEQ ID NO: 596766 - RNA, 64 nt, Homo Sapiens; identical to SEQ ID NO: 267998

SEQ ID NO: 596767 - RNA, 64 nt, Homo Sapiens; identical to SEQ ID NO: 267999

SEQ ID NO: 596768 - RNA, 64 nt, Homo Sapiens; identical to SEQ ID NO: 268000

SEQ ID NO: 596769 - RNA, 64 nt, Homo Sapiens; identical to SEQ ID NO: 268001

SEQ ID NO: 596770 - RNA, 64 nt, Homo Sapiens; identical to SEQ ID NO: 268002

SEQ ID NO: 596771 - RNA, 64 nt, Homo Sapiens; identical to SEQ ID NO: 268003

SEQ ID NO: 596772 - RNA, 64 nt, Homo Sapiens; identical to SEQ ID NO: 268004

SEQ ID NO: 596773 - RNA, 64 nt, Homo Sapiens; identical to SEQ ID NO: 268005

SEQ ID NO: 596774 - RNA, 64 nt, Homo Sapiens; identical to SEQ ID NO: 268006

SEQ ID NO: 596775 - RNA, 64 nt, Homo Sapiens; identical to SEQ ID NO: 268007

SEQ ID NO: 596776 - RNA, 64 nt, Homo Sapiens; identical to SEQ ID NO: 268008

SEQ ID NO: 596777 - RNA, 64 nt, Homo Sapiens; identical to SEQ ID NO: 268009

SEQ ID NO: 596778 - RNA, 64 nt, Homo Sapiens; identical to SEQ ID NO: 268010

SEQ ID NO: 596779 - RNA, 64 nt, Homo Sapiens; identical to SEQ ID NO: 268011

SEQ ID NO: 596780 - RNA, 64 nt, Homo Sapiens; identical to SEQ ID NO: 268012

SEQ ID NO: 596781 - RNA, 64 nt, Homo Sapiens; identical to SEQ ID NO: 268013

SEQ ID NO: 596782 - RNA, 64 nt, Homo Sapiens; identical to SEQ ID NO: 268014

SEQ ID NO: 596783 - RNA, 64 nt, Homo Sapiens; identical to SEQ ID NO: 268015

SEQ ID NO: 596784 - RNA, 64 nt, Homo Sapiens; identical to SEQ ID NO: 268016

SEQ ID NO: 596785 - RNA, 64 nt, Homo Sapiens; identical to SEQ ID NO: 268017

SEQ ID NO: 596786 - RNA, 64 nt, Homo Sapiens; identical to SEQ ID NO: 268018

SEQ ID NO: 596787 - RNA, 64 nt, Homo Sapiens; identical to SEQ ID NO: 268019

SEQ ID NO: 596788 - RNA, 64 nt, Homo Sapiens; identical to SEQ ID NO: 268020

SEQ ID NO: 596789 - RNA, 64 nt, Homo Sapiens; identical to SEQ ID NO: 268021

SEQ ID NO: 596790 - RNA, 64 nt, Homo Sapiens; identical to SEQ ID NO: 268022

SEQ ID NO: 596791 - RNA, 64 nt, Homo Sapiens; identical to SEQ ID NO: 268023

SEQ ID NO: 596792 - RNA, 64 nt, Homo Sapiens; identical to SEQ ID NO: 268024

SEQ ID NO: 596793 - RNA, 64 nt, Homo Sapiens; identical to SEQ ID NO: 268025

SEQ ID NO: 596794 - RNA, 64 nt, Homo Sapiens; identical to SEQ ID NO: 268026

SEQ ID NO: 596795 - RNA, 64 nt, Homo Sapiens; identical to SEQ ID NO: 268027

SEQ ID NO: 596796 - RNA, 64 nt, Homo Sapiens; identical to SEQ ID NO: 268028

SEQ ID NO: 596797 - RNA, 64 nt, Homo Sapiens; identical to SEQ ID NO: 268029

SEQ ID NO: 596798 - RNA, 64 nt, Homo Sapiens; identical to SEQ ID NO: 268030

SEQ ID NO: 596799 - RNA, 64 nt, Homo Sapiens; identical to SEQ ID NO: 268031

SEQ ID NO: 596800 - RNA, 64 nt, Homo Sapiens; identical to SEQ ID NO: 268032

SEQ ID NO: 596801 - RNA, 64 nt, Homo Sapiens; identical to SEQ ID NO: 268033

SEQ ID NO: 596802 - RNA, 64 nt, Homo Sapiens; identical to SEQ ID NO: 268034

SEQ ID NO: 596803 - RNA, 64 nt, Homo Sapiens; identical to SEQ ID NO: 268035

SEQ ID NO: 596804 - RNA, 64 nt, Homo Sapiens; identical to SEQ ID NO: 268036

SEQ ID NO: 596805 - RNA, 64 nt, Homo Sapiens; identical to SEQ ID NO: 268037

SEQ ID NO: 596806 - RNA, 64 nt, Homo Sapiens; identical to SEQ ID NO: 268038

SEQ ID NO: 596807 - RNA, 64 nt, Homo Sapiens; identical to SEQ ID NO: 268039

SEQ ID NO: 596808 - RNA, 64 nt, Homo Sapiens; identical to SEQ ID NO: 268040

SEQ ID NO: 596809 - RNA, 64 nt, Homo Sapiens; identical to SEQ ID NO: 268041

SEQ ID NO: 596810 - RNA, 64 nt, Homo Sapiens; identical to SEQ ID NO: 268042

SEQ ID NO: 596811 - RNA, 64 nt, Homo Sapiens; identical to SEQ ID NO: 268043

SEQ ID NO: 596812 - RNA, 64 nt, Homo Sapiens; identical to SEQ ID NO: 268044

SEQ ID NO: 596813 - RNA, 64 nt, Homo Sapiens; identical to SEQ ID NO: 268045

SEQ ID NO: 596814 - RNA, 64 nt, Homo Sapiens; identical to SEQ ID NO: 268046

SEQ ID NO: 596815 - RNA, 64 nt, Homo Sapiens; identical to SEQ ID NO: 268047

SEQ ID NO: 596816 - RNA, 64 nt, Homo Sapiens; identical to SEQ ID NO: 268048

SEQ ID NO: 596817 - RNA, 64 nt, Homo Sapiens; identical to SEQ ID NO: 268049

SEQ ID NO: 596818 - RNA, 64 nt, Homo Sapiens; identical to SEQ ID NO: 268050

SEQ ID NO: 596819 - RNA, 64 nt, Homo Sapiens; identical to SEQ ID NO: 268051

SEQ ID NO: 596820 - RNA, 64 nt, Homo Sapiens; identical to SEQ ID NO: 268052

SEQ ID NO: 596821 - RNA, 64 nt, Homo Sapiens; identical to SEQ ID NO: 268053

SEQ ID NO: 596822 - RNA, 64 nt, Homo Sapiens; identical to SEQ ID NO: 268054

SEQ ID NO: 596823 - RNA, 64 nt, Homo Sapiens; identical to SEQ ID NO: 268055

SEQ ID NO: 596824 - RNA, 64 nt, Homo Sapiens; identical to SEQ ID NO: 268056

SEQ ID NO: 596825 - RNA, 64 nt, Homo Sapiens; identical to SEQ ID NO: 268057

SEQ ID NO: 596826 - RNA, 64 nt, Homo Sapiens; identical to SEQ ID NO: 268058

SEQ ID NO: 596827 - RNA, 64 nt, Homo Sapiens; identical to SEQ ID NO: 268059

SEQ ID NO: 596828 - RNA, 64 nt, Homo Sapiens; identical to SEQ ID NO: 268060

SEQ ID NO: 596829 - RNA, 64 nt, Homo Sapiens; identical to SEQ ID NO: 268061

SEQ ID NO: 596830 - RNA, 64 nt, Homo Sapiens; identical to SEQ ID NO: 268062

SEQ ID NO: 596831 - RNA, 64 nt, Homo Sapiens; identical to SEQ ID NO: 268063

SEQ ID NO: 596832 - RNA, 64 nt, Homo Sapiens; identical to SEQ ID NO: 268064

SEQ ID NO: 596833 - RNA, 64 nt, Homo Sapiens; identical to SEQ ID NO: 268065

SEQ ID NO: 596834 - RNA, 64 nt, Homo Sapiens; identical to SEQ ID NO: 268066

SEQ ID NO: 596835 - RNA, 64 nt, Homo Sapiens; identical to SEQ ID NO: 268067

SEQ ID NO: 596836 - RNA, 64 nt, Homo Sapiens; identical to SEQ ID NO: 268068

SEQ ID NO: 596837 - RNA, 64 nt, Homo Sapiens; identical to SEQ ID NO: 268069

SEQ ID NO: 596838 - RNA, 64 nt, Homo Sapiens; identical to SEQ ID NO: 268070

SEQ ID NO: 596839 - RNA, 64 nt, Homo Sapiens; identical to SEQ ID NO: 268071

SEQ ID NO: 596840 - RNA, 64 nt, Homo Sapiens; identical to SEQ ID NO: 268072

SEQ ID NO: 596841 - RNA, 64 nt, Homo Sapiens; identical to SEQ ID NO: 268073

SEQ ID NO: 596842 - RNA, 64 nt, Homo Sapiens; identical to SEQ ID NO: 268074

SEQ ID NO: 596843 - RNA, 64 nt, Homo Sapiens; identical to SEQ ID NO: 268075

SEQ ID NO: 596844 - RNA, 64 nt, Homo Sapiens; identical to SEQ ID NO: 268076

SEQ ID NO: 596845 - RNA, 64 nt, Homo Sapiens; identical to SEQ ID NO: 268077

SEQ ID NO: 596846 - RNA, 64 nt, Homo Sapiens; identical to SEQ ID NO: 268078

SEQ ID NO: 596847 - RNA, 64 nt, Homo Sapiens; identical to SEQ ID NO: 268079

SEQ ID NO: 596848 - RNA, 64 nt, Homo Sapiens; identical to SEQ ID NO: 268080

SEQ ID NO: 596849 - RNA, 64 nt, Homo Sapiens; identical to SEQ ID NO: 268081

SEQ ID NO: 596850 - RNA, 64 nt, Homo Sapiens; identical to SEQ ID NO: 268082

SEQ ID NO: 596851 - RNA, 64 nt, Homo Sapiens; identical to SEQ ID NO: 268083

SEQ ID NO: 596852 - RNA, 64 nt, Homo Sapiens; identical to SEQ ID NO: 268084

SEQ ID NO: 596853 - RNA, 64 nt, Homo Sapiens; identical to SEQ ID NO: 268085

SEQ ID NO: 596854 - RNA, 64 nt, Homo Sapiens; identical to SEQ ID NO: 268086

SEQ ID NO: 596855 - RNA, 64 nt, Homo Sapiens; identical to SEQ ID NO: 268087

SEQ ID NO: 596856 - RNA, 64 nt, Homo Sapiens; identical to SEQ ID NO: 268088

SEQ ID NO: 596857 - RNA, 64 nt, Homo Sapiens; identical to SEQ ID NO: 268089

SEQ ID NO: 596858 - RNA, 64 nt, Homo Sapiens; identical to SEQ ID NO: 268090

SEQ ID NO: 596859 - RNA, 64 nt, Homo Sapiens; identical to SEQ ID NO: 268091

SEQ ID NO: 596860 - RNA, 64 nt, Homo Sapiens; identical to SEQ ID NO: 268092

SEQ ID NO: 596861 - RNA, 64 nt, Homo Sapiens; identical to SEQ ID NO: 268093

SEQ ID NO: 596862 - RNA, 64 nt, Homo Sapiens; identical to SEQ ID NO: 268094

SEQ ID NO: 596863 - RNA, 64 nt, Homo Sapiens; identical to SEQ ID NO: 268095

SEQ ID NO: 596864 - RNA, 64 nt, Homo Sapiens; identical to SEQ ID NO: 268096

SEQ ID NO: 596865 - RNA, 64 nt, Homo Sapiens; identical to SEQ ID NO: 268097

SEQ ID NO: 596866 - RNA, 64 nt, Homo Sapiens; identical to SEQ ID NO: 268098

SEQ ID NO: 596867 - RNA, 64 nt, Homo Sapiens; identical to SEQ ID NO: 268099

SEQ ID NO: 596868 - RNA, 64 nt, Homo Sapiens; identical to SEQ ID NO: 268100

SEQ ID NO: 596869 - RNA, 64 nt, Homo Sapiens; identical to SEQ ID NO: 268101

SEQ ID NO: 596870 - RNA, 64 nt, Homo Sapiens; identical to SEQ ID NO: 268102

SEQ ID NO: 596871 - RNA, 64 nt, Homo Sapiens; identical to SEQ ID NO: 268103

SEQ ID NO: 596872 - RNA, 64 nt, Homo Sapiens; identical to SEQ ID NO: 268104

SEQ ID NO: 596873 - RNA, 64 nt, Homo Sapiens; identical to SEQ ID NO: 268105

SEQ ID NO: 596874 - RNA, 64 nt, Homo Sapiens; identical to SEQ ID NO: 268106

SEQ ID NO: 596875 - RNA, 64 nt, Homo Sapiens; identical to SEQ ID NO: 268107

SEQ ID NO: 596876 - RNA, 64 nt, Homo Sapiens; identical to SEQ ID NO: 268108

SEQ ID NO: 596877 - RNA, 64 nt, Homo Sapiens; identical to SEQ ID NO: 268109

SEQ ID NO: 596878 - RNA, 64 nt, Homo Sapiens; identical to SEQ ID NO: 268110

SEQ ID NO: 596879 - RNA, 64 nt, Homo Sapiens; identical to SEQ ID NO: 268111

SEQ ID NO: 596880 - RNA, 64 nt, Homo Sapiens; identical to SEQ ID NO: 268112

SEQ ID NO: 596881 - RNA, 64 nt, Homo Sapiens; identical to SEQ ID NO: 268113

SEQ ID NO: 596882 - RNA, 64 nt, Homo Sapiens; identical to SEQ ID NO: 268114

SEQ ID NO: 596883 - RNA, 64 nt, Homo Sapiens; identical to SEQ ID NO: 268115

SEQ ID NO: 596884 - RNA, 64 nt, Homo Sapiens; identical to SEQ ID NO: 268116

SEQ ID NO: 596885 - RNA, 64 nt, Homo Sapiens; identical to SEQ ID NO: 268117

SEQ ID NO: 596886 - RNA, 64 nt, Homo Sapiens; identical to SEQ ID NO: 268118

SEQ ID NO: 596887 - RNA, 64 nt, Homo Sapiens; identical to SEQ ID NO: 268119

SEQ ID NO: 596888 - RNA, 64 nt, Homo Sapiens; identical to SEQ ID NO: 268120

SEQ ID NO: 596889 - RNA, 64 nt, Homo Sapiens; identical to SEQ ID NO: 268121

SEQ ID NO: 596890 - RNA, 64 nt, Homo Sapiens; identical to SEQ ID NO: 268122

SEQ ID NO: 596891 - RNA, 64 nt, Homo Sapiens; identical to SEQ ID NO: 268123

SEQ ID NO: 596892 - RNA, 64 nt, Homo Sapiens; identical to SEQ ID NO: 268124

SEQ ID NO: 596893 - RNA, 64 nt, Homo Sapiens; identical to SEQ ID NO: 268125

SEQ ID NO: 596894 - RNA, 64 nt, Homo Sapiens; identical to SEQ ID NO: 268126

SEQ ID NO: 596895 - RNA, 64 nt, Homo Sapiens; identical to SEQ ID NO: 268127

SEQ ID NO: 596896 - RNA, 64 nt, Homo Sapiens; identical to SEQ ID NO: 268128

SEQ ID NO: 596897 - RNA, 64 nt, Homo Sapiens; identical to SEQ ID NO: 268129

SEQ ID NO: 596898 - RNA, 64 nt, Homo Sapiens; identical to SEQ ID NO: 268130

SEQ ID NO: 596899 - RNA, 64 nt, Homo Sapiens; identical to SEQ ID NO: 268131

SEQ ID NO: 596900 - RNA, 64 nt, Homo Sapiens; identical to SEQ ID NO: 268132

SEQ ID NO: 596901 - RNA, 64 nt, Homo Sapiens; identical to SEQ ID NO: 268133

SEQ ID NO: 596902 - RNA, 64 nt, Homo Sapiens; identical to SEQ ID NO: 268134

SEQ ID NO: 596903 - RNA, 64 nt, Homo Sapiens; identical to SEQ ID NO: 268135

SEQ ID NO: 596904 - RNA, 64 nt, Homo Sapiens; identical to SEQ ID NO: 268136

SEQ ID NO: 596905 - RNA, 64 nt, Homo Sapiens; identical to SEQ ID NO: 268137

SEQ ID NO: 596906 - RNA, 64 nt, Homo Sapiens; identical to SEQ ID NO: 268138

SEQ ID NO: 596907 - RNA, 64 nt, Homo Sapiens; identical to SEQ ID NO: 268139

SEQ ID NO: 596908 - RNA, 64 nt, Homo Sapiens; identical to SEQ ID NO: 268140

SEQ ID NO: 596909 - RNA, 64 nt, Homo Sapiens; identical to SEQ ID NO: 268141

SEQ ID NO: 596910 - RNA, 64 nt, Homo Sapiens; identical to SEQ ID NO: 268142

SEQ ID NO: 596911 - RNA, 64 nt, Homo Sapiens; identical to SEQ ID NO: 268143

SEQ ID NO: 596912 - RNA, 64 nt, Homo Sapiens; identical to SEQ ID NO: 268144

SEQ ID NO: 596913 - RNA, 64 nt, Homo Sapiens; identical to SEQ ID NO: 268145

SEQ ID NO: 596914 - RNA, 64 nt, Homo Sapiens; identical to SEQ ID NO: 268146

SEQ ID NO: 596915 - RNA, 64 nt, Homo Sapiens; identical to SEQ ID NO: 268147

SEQ ID NO: 596916 - RNA, 64 nt, Homo Sapiens; identical to SEQ ID NO: 268148

SEQ ID NO: 596917 - RNA, 64 nt, Homo Sapiens; identical to SEQ ID NO: 268149

SEQ ID NO: 596918 - RNA, 64 nt, Homo Sapiens; identical to SEQ ID NO: 268150

SEQ ID NO: 596919 - RNA, 64 nt, Homo Sapiens; identical to SEQ ID NO: 268151

SEQ ID NO: 596920 - RNA, 64 nt, Homo Sapiens; identical to SEQ ID NO: 268152

SEQ ID NO: 596921 - RNA, 64 nt, Homo Sapiens; identical to SEQ ID NO: 268153

SEQ ID NO: 596922 - RNA, 64 nt, Homo Sapiens; identical to SEQ ID NO: 268154

SEQ ID NO: 596923 - RNA, 64 nt, Homo Sapiens; identical to SEQ ID NO: 268155

SEQ ID NO: 596924 - RNA, 64 nt, Homo Sapiens; identical to SEQ ID NO: 268156

SEQ ID NO: 596925 - RNA, 64 nt, Homo Sapiens; identical to SEQ ID NO: 268157

SEQ ID NO: 596926 - RNA, 64 nt, Homo Sapiens; identical to SEQ ID NO: 268158

SEQ ID NO: 596927 - RNA, 64 nt, Homo Sapiens; identical to SEQ ID NO: 268159

SEQ ID NO: 596928 - RNA, 64 nt, Homo Sapiens; identical to SEQ ID NO: 268160

SEQ ID NO: 596929 - RNA, 64 nt, Homo Sapiens; identical to SEQ ID NO: 268161

SEQ ID NO: 596930 - RNA, 64 nt, Homo Sapiens; identical to SEQ ID NO: 268162

SEQ ID NO: 596931 - RNA, 64 nt, Homo Sapiens; identical to SEQ ID NO: 268163

SEQ ID NO: 596932 - RNA, 64 nt, Homo Sapiens; identical to SEQ ID NO: 268164

SEQ ID NO: 596933 - RNA, 64 nt, Homo Sapiens; identical to SEQ ID NO: 268165

SEQ ID NO: 596934 - RNA, 64 nt, Homo Sapiens; identical to SEQ ID NO: 268166

SEQ ID NO: 596935 - RNA, 64 nt, Homo Sapiens; identical to SEQ ID NO: 268167

SEQ ID NO: 596936 - RNA, 64 nt, Homo Sapiens; identical to SEQ ID NO: 268168

SEQ ID NO: 596937 - RNA, 64 nt, Homo Sapiens; identical to SEQ ID NO: 268169

SEQ ID NO: 596938 - RNA, 64 nt, Homo Sapiens; identical to SEQ ID NO: 268170

SEQ ID NO: 596939 - RNA, 64 nt, Homo Sapiens; identical to SEQ ID NO: 268171

SEQ ID NO: 596940 - RNA, 64 nt, Homo Sapiens; identical to SEQ ID NO: 268172

SEQ ID NO: 596941 - RNA, 64 nt, Homo Sapiens; identical to SEQ ID NO: 268173

SEQ ID NO: 596942 - RNA, 64 nt, Homo Sapiens; identical to SEQ ID NO: 268174

SEQ ID NO: 596943 - RNA, 64 nt, Homo Sapiens; identical to SEQ ID NO: 268175

SEQ ID NO: 596944 - RNA, 64 nt, Homo Sapiens; identical to SEQ ID NO: 268176

SEQ ID NO: 596945 - RNA, 64 nt, Homo Sapiens; identical to SEQ ID NO: 268177

SEQ ID NO: 596946 - RNA, 64 nt, Homo Sapiens; identical to SEQ ID NO: 268178

SEQ ID NO: 596947 - RNA, 64 nt, Homo Sapiens; identical to SEQ ID NO: 268179

SEQ ID NO: 596948 - RNA, 64 nt, Homo Sapiens; identical to SEQ ID NO: 268180

SEQ ID NO: 596949 - RNA, 64 nt, Homo Sapiens; identical to SEQ ID NO: 268181

SEQ ID NO: 596950 - RNA, 64 nt, Homo Sapiens; identical to SEQ ID NO: 268182

SEQ ID NO: 596951 - RNA, 64 nt, Homo Sapiens; identical to SEQ ID NO: 268183

SEQ ID NO: 596952 - RNA, 64 nt, Homo Sapiens; identical to SEQ ID NO: 268184

SEQ ID NO: 596953 - RNA, 64 nt, Homo Sapiens; identical to SEQ ID NO: 268185

SEQ ID NO: 596954 - RNA, 64 nt, Homo Sapiens; identical to SEQ ID NO: 268186

SEQ ID NO: 596955 - RNA, 64 nt, Homo Sapiens; identical to SEQ ID NO: 268187

SEQ ID NO: 596956 - RNA, 64 nt, Homo Sapiens; identical to SEQ ID NO: 268188

SEQ ID NO: 596957 - RNA, 64 nt, Homo Sapiens; identical to SEQ ID NO: 268189

SEQ ID NO: 596958 - RNA, 64 nt, Homo Sapiens; identical to SEQ ID NO: 268190

SEQ ID NO: 596959 - RNA, 64 nt, Homo Sapiens; identical to SEQ ID NO: 268191

SEQ ID NO: 596960 - RNA, 64 nt, Homo Sapiens; identical to SEQ ID NO: 268192

SEQ ID NO: 596961 - RNA, 64 nt, Homo Sapiens; identical to SEQ ID NO: 268193

SEQ ID NO: 596962 - RNA, 64 nt, Homo Sapiens; identical to SEQ ID NO: 268194

SEQ ID NO: 596963 - RNA, 64 nt, Homo Sapiens; identical to SEQ ID NO: 268195

SEQ ID NO: 596964 - RNA, 64 nt, Homo Sapiens; identical to SEQ ID NO: 268196

SEQ ID NO: 596965 - RNA, 64 nt, Homo Sapiens; identical to SEQ ID NO: 268197

SEQ ID NO: 596966 - RNA, 64 nt, Homo Sapiens; identical to SEQ ID NO: 268198

SEQ ID NO: 596967 - RNA, 64 nt, Homo Sapiens; identical to SEQ ID NO: 268199

SEQ ID NO: 596968 - RNA, 64 nt, Homo Sapiens; identical to SEQ ID NO: 268200

SEQ ID NO: 596969 - RNA, 64 nt, Homo Sapiens; identical to SEQ ID NO: 268201

SEQ ID NO: 596970 - RNA, 64 nt, Homo Sapiens; identical to SEQ ID NO: 268202

SEQ ID NO: 596971 - RNA, 64 nt, Homo Sapiens; identical to SEQ ID NO: 268203

SEQ ID NO: 596972 - RNA, 64 nt, Homo Sapiens; identical to SEQ ID NO: 268204

SEQ ID NO: 596973 - RNA, 64 nt, Homo Sapiens; identical to SEQ ID NO: 268205

SEQ ID NO: 596974 - RNA, 64 nt, Homo Sapiens; identical to SEQ ID NO: 268206

SEQ ID NO: 596975 - RNA, 64 nt, Homo Sapiens; identical to SEQ ID NO: 268207

SEQ ID NO: 596976 - RNA, 64 nt, Homo Sapiens; identical to SEQ ID NO: 268208

SEQ ID NO: 596977 - RNA, 64 nt, Homo Sapiens; identical to SEQ ID NO: 268209

SEQ ID NO: 596978 - RNA, 64 nt, Homo Sapiens; identical to SEQ ID NO: 268210

SEQ ID NO: 596979 - RNA, 64 nt, Homo Sapiens; identical to SEQ ID NO: 268211

SEQ ID NO: 596980 - RNA, 64 nt, Homo Sapiens; identical to SEQ ID NO: 268212

SEQ ID NO: 596981 - RNA, 64 nt, Homo Sapiens; identical to SEQ ID NO: 268213

SEQ ID NO: 596982 - RNA, 64 nt, Homo Sapiens; identical to SEQ ID NO: 268214

SEQ ID NO: 596983 - RNA, 64 nt, Homo Sapiens; identical to SEQ ID NO: 268215

SEQ ID NO: 596984 - RNA, 64 nt, Homo Sapiens; identical to SEQ ID NO: 268216

SEQ ID NO: 596985 - RNA, 64 nt, Homo Sapiens; identical to SEQ ID NO: 268217

SEQ ID NO: 596986 - RNA, 64 nt, Homo Sapiens; identical to SEQ ID NO: 268218

SEQ ID NO: 596987 - RNA, 64 nt, Homo Sapiens; identical to SEQ ID NO: 268219

SEQ ID NO: 596988 - RNA, 64 nt, Homo Sapiens; identical to SEQ ID NO: 268220

SEQ ID NO: 596989 - RNA, 64 nt, Homo Sapiens; identical to SEQ ID NO: 268221

SEQ ID NO: 596990 - RNA, 64 nt, Homo Sapiens; identical to SEQ ID NO: 268222

SEQ ID NO: 596991 - RNA, 64 nt, Homo Sapiens; identical to SEQ ID NO: 268223

SEQ ID NO: 596992 - RNA, 64 nt, Homo Sapiens; identical to SEQ ID NO: 268224

SEQ ID NO: 596993 - RNA, 64 nt, Homo Sapiens; identical to SEQ ID NO: 268225

SEQ ID NO: 596994 - RNA, 64 nt, Homo Sapiens; identical to SEQ ID NO: 268226

SEQ ID NO: 596995 - RNA, 64 nt, Homo Sapiens; identical to SEQ ID NO: 268227

SEQ ID NO: 596996 - RNA, 64 nt, Homo Sapiens; identical to SEQ ID NO: 268228

SEQ ID NO: 596997 - RNA, 64 nt, Homo Sapiens; identical to SEQ ID NO: 268229

SEQ ID NO: 596998 - RNA, 64 nt, Homo Sapiens; identical to SEQ ID NO: 268230

SEQ ID NO: 596999 - RNA, 64 nt, Homo Sapiens; identical to SEQ ID NO: 268231

SEQ ID NO: 597000 - RNA, 64 nt, Homo Sapiens; identical to SEQ ID NO: 268232

SEQ ID NO: 597001 - RNA, 64 nt, Homo Sapiens; identical to SEQ ID NO: 268233

SEQ ID NO: 597002 - RNA, 64 nt, Homo Sapiens; identical to SEQ ID NO: 268234

SEQ ID NO: 597003 - RNA, 64 nt, Homo Sapiens; identical to SEQ ID NO: 268235

SEQ ID NO: 597004 - RNA, 64 nt, Homo Sapiens; identical to SEQ ID NO: 268236

SEQ ID NO: 597005 - RNA, 64 nt, Homo Sapiens; identical to SEQ ID NO: 268237

SEQ ID NO: 597006 - RNA, 64 nt, Homo Sapiens; identical to SEQ ID NO: 268238

SEQ ID NO: 597007 - RNA, 64 nt, Homo Sapiens; identical to SEQ ID NO: 268239

SEQ ID NO: 597008 - RNA, 64 nt, Homo Sapiens; identical to SEQ ID NO: 268240

SEQ ID NO: 597009 - RNA, 64 nt, Homo Sapiens; identical to SEQ ID NO: 268241

SEQ ID NO: 597010 - RNA, 64 nt, Homo Sapiens; identical to SEQ ID NO: 268242

SEQ ID NO: 597011 - RNA, 64 nt, Homo Sapiens; identical to SEQ ID NO: 268243

SEQ ID NO: 597012 - RNA, 64 nt, Homo Sapiens; identical to SEQ ID NO: 268244

SEQ ID NO: 597013 - RNA, 64 nt, Homo Sapiens; identical to SEQ ID NO: 268245

SEQ ID NO: 597014 - RNA, 64 nt, Homo Sapiens; identical to SEQ ID NO: 268246

SEQ ID NO: 597015 - RNA, 64 nt, Homo Sapiens; identical to SEQ ID NO: 268247

SEQ ID NO: 597016 - RNA, 64 nt, Homo Sapiens; identical to SEQ ID NO: 268248

SEQ ID NO: 597017 - RNA, 64 nt, Homo Sapiens; identical to SEQ ID NO: 268249

SEQ ID NO: 597018 - RNA, 64 nt, Homo Sapiens; identical to SEQ ID NO: 268250

SEQ ID NO: 597019 - RNA, 64 nt, Homo Sapiens; identical to SEQ ID NO: 268251

SEQ ID NO: 597020 - RNA, 64 nt, Homo Sapiens; identical to SEQ ID NO: 268252

SEQ ID NO: 597021 - RNA, 64 nt, Homo Sapiens; identical to SEQ ID NO: 268253

SEQ ID NO: 597022 - RNA, 64 nt, Homo Sapiens; identical to SEQ ID NO: 268254

SEQ ID NO: 597023 - RNA, 64 nt, Homo Sapiens; identical to SEQ ID NO: 268255

SEQ ID NO: 597024 - RNA, 64 nt, Homo Sapiens; identical to SEQ ID NO: 268256

SEQ ID NO: 597025 - RNA, 64 nt, Homo Sapiens; identical to SEQ ID NO: 268257

SEQ ID NO: 597026 - RNA, 64 nt, Homo Sapiens; identical to SEQ ID NO: 268258

SEQ ID NO: 597027 - RNA, 64 nt, Homo Sapiens; identical to SEQ ID NO: 268259

SEQ ID NO: 597028 - RNA, 64 nt, Homo Sapiens; identical to SEQ ID NO: 268260

SEQ ID NO: 597029 - RNA, 64 nt, Homo Sapiens; identical to SEQ ID NO: 268261

SEQ ID NO: 597030 - RNA, 64 nt, Homo Sapiens; identical to SEQ ID NO: 268262

SEQ ID NO: 597031 - RNA, 64 nt, Homo Sapiens; identical to SEQ ID NO: 268263

SEQ ID NO: 597032 - RNA, 64 nt, Homo Sapiens; identical to SEQ ID NO: 268264

SEQ ID NO: 597033 - RNA, 64 nt, Homo Sapiens; identical to SEQ ID NO: 268265

SEQ ID NO: 597034 - RNA, 64 nt, Homo Sapiens; identical to SEQ ID NO: 268266

SEQ ID NO: 597035 - RNA, 64 nt, Homo Sapiens; identical to SEQ ID NO: 268267

SEQ ID NO: 597036 - RNA, 64 nt, Homo Sapiens; identical to SEQ ID NO: 268268

SEQ ID NO: 597037 - RNA, 64 nt, Homo Sapiens; identical to SEQ ID NO: 268269

SEQ ID NO: 597038 - RNA, 64 nt, Homo Sapiens; identical to SEQ ID NO: 268270

SEQ ID NO: 597039 - RNA, 64 nt, Homo Sapiens; identical to SEQ ID NO: 268271

SEQ ID NO: 597040 - RNA, 64 nt, Homo Sapiens; identical to SEQ ID NO: 268272

SEQ ID NO: 597041 - RNA, 64 nt, Homo Sapiens; identical to SEQ ID NO: 268273

SEQ ID NO: 597042 - RNA, 64 nt, Homo Sapiens; identical to SEQ ID NO: 268274

SEQ ID NO: 597043 - RNA, 64 nt, Homo Sapiens; identical to SEQ ID NO: 268275

SEQ ID NO: 597044 - RNA, 64 nt, Homo Sapiens; identical to SEQ ID NO: 268276

SEQ ID NO: 597045 - RNA, 64 nt, Homo Sapiens; identical to SEQ ID NO: 268277

SEQ ID NO: 597046 - RNA, 64 nt, Homo Sapiens; identical to SEQ ID NO: 268278

SEQ ID NO: 597047 - RNA, 64 nt, Homo Sapiens; identical to SEQ ID NO: 268279

SEQ ID NO: 597048 - RNA, 64 nt, Homo Sapiens; identical to SEQ ID NO: 268280

SEQ ID NO: 597049 - RNA, 64 nt, Homo Sapiens; identical to SEQ ID NO: 268281

SEQ ID NO: 597050 - RNA, 64 nt, Homo Sapiens; identical to SEQ ID NO: 268282

SEQ ID NO: 597051 - RNA, 64 nt, Homo Sapiens; identical to SEQ ID NO: 268283

SEQ ID NO: 597052 - RNA, 64 nt, Homo Sapiens; identical to SEQ ID NO: 268284

SEQ ID NO: 597053 - RNA, 64 nt, Homo Sapiens; identical to SEQ ID NO: 268285

SEQ ID NO: 597054 - RNA, 64 nt, Homo Sapiens; identical to SEQ ID NO: 268286

SEQ ID NO: 597055 - RNA, 64 nt, Homo Sapiens; identical to SEQ ID NO: 268287

SEQ ID NO: 597056 - RNA, 64 nt, Homo Sapiens; identical to SEQ ID NO: 268288

SEQ ID NO: 597057 - RNA, 64 nt, Homo Sapiens; identical to SEQ ID NO: 268289

SEQ ID NO: 597058 - RNA, 64 nt, Homo Sapiens; identical to SEQ ID NO: 268290

SEQ ID NO: 597059 - RNA, 64 nt, Homo Sapiens; identical to SEQ ID NO: 268291

SEQ ID NO: 597060 - RNA, 64 nt, Homo Sapiens; identical to SEQ ID NO: 268292

SEQ ID NO: 597061 - RNA, 64 nt, Homo Sapiens; identical to SEQ ID NO: 268293

SEQ ID NO: 597062 - RNA, 64 nt, Homo Sapiens; identical to SEQ ID NO: 268294

SEQ ID NO: 597063 - RNA, 64 nt, Homo Sapiens; identical to SEQ ID NO: 268295

SEQ ID NO: 597064 - RNA, 64 nt, Homo Sapiens; identical to SEQ ID NO: 268296

SEQ ID NO: 597065 - RNA, 64 nt, Homo Sapiens; identical to SEQ ID NO: 268297

SEQ ID NO: 597066 - RNA, 64 nt, Homo Sapiens; identical to SEQ ID NO: 268298

SEQ ID NO: 597067 - RNA, 64 nt, Homo Sapiens; identical to SEQ ID NO: 268299

SEQ ID NO: 597068 - RNA, 64 nt, Homo Sapiens; identical to SEQ ID NO: 268300

SEQ ID NO: 597069 - RNA, 64 nt, Homo Sapiens; identical to SEQ ID NO: 268301

SEQ ID NO: 597070 - RNA, 64 nt, Homo Sapiens; identical to SEQ ID NO: 268302

SEQ ID NO: 597071 - RNA, 64 nt, Homo Sapiens; identical to SEQ ID NO: 268303

SEQ ID NO: 597072 - RNA, 64 nt, Homo Sapiens; identical to SEQ ID NO: 268304

SEQ ID NO: 597073 - RNA, 64 nt, Homo Sapiens; identical to SEQ ID NO: 268305

SEQ ID NO: 597074 - RNA, 64 nt, Homo Sapiens; identical to SEQ ID NO: 268306

SEQ ID NO: 597075 - RNA, 64 nt, Homo Sapiens; identical to SEQ ID NO: 268307

SEQ ID NO: 597076 - RNA, 64 nt, Homo Sapiens; identical to SEQ ID NO: 268308

SEQ ID NO: 597077 - RNA, 64 nt, Homo Sapiens; identical to SEQ ID NO: 268309

SEQ ID NO: 597078 - RNA, 64 nt, Homo Sapiens; identical to SEQ ID NO: 268310

SEQ ID NO: 597079 - RNA, 64 nt, Homo Sapiens; identical to SEQ ID NO: 268311

SEQ ID NO: 597080 - RNA, 64 nt, Homo Sapiens; identical to SEQ ID NO: 268312

SEQ ID NO: 597081 - RNA, 64 nt, Homo Sapiens; identical to SEQ ID NO: 268313

SEQ ID NO: 597082 - RNA, 64 nt, Homo Sapiens; identical to SEQ ID NO: 268314

SEQ ID NO: 597083 - RNA, 64 nt, Homo Sapiens; identical to SEQ ID NO: 268315

SEQ ID NO: 597084 - RNA, 64 nt, Homo Sapiens; identical to SEQ ID NO: 268316

SEQ ID NO: 597085 - RNA, 64 nt, Homo Sapiens; identical to SEQ ID NO: 268317

SEQ ID NO: 597086 - RNA, 64 nt, Homo Sapiens; identical to SEQ ID NO: 268318

SEQ ID NO: 597087 - RNA, 64 nt, Homo Sapiens; identical to SEQ ID NO: 268319

SEQ ID NO: 597088 - RNA, 64 nt, Homo Sapiens; identical to SEQ ID NO: 268320

SEQ ID NO: 597089 - RNA, 64 nt, Homo Sapiens; identical to SEQ ID NO: 268321

SEQ ID NO: 597090 - RNA, 64 nt, Homo Sapiens; identical to SEQ ID NO: 268322

SEQ ID NO: 597091 - RNA, 64 nt, Homo Sapiens; identical to SEQ ID NO: 268323

SEQ ID NO: 597092 - RNA, 64 nt, Homo Sapiens; identical to SEQ ID NO: 268324

SEQ ID NO: 597093 - RNA, 64 nt, Homo Sapiens; identical to SEQ ID NO: 268325

SEQ ID NO: 597094 - RNA, 64 nt, Homo Sapiens; identical to SEQ ID NO: 268326

SEQ ID NO: 597095 - RNA, 64 nt, Homo Sapiens; identical to SEQ ID NO: 268327

SEQ ID NO: 597096 - RNA, 64 nt, Homo Sapiens; identical to SEQ ID NO: 268328

SEQ ID NO: 597097 - RNA, 64 nt, Homo Sapiens; identical to SEQ ID NO: 268329

SEQ ID NO: 597098 - RNA, 64 nt, Homo Sapiens; identical to SEQ ID NO: 268330

SEQ ID NO: 597099 - RNA, 64 nt, Homo Sapiens; identical to SEQ ID NO: 268331

SEQ ID NO: 597100 - RNA, 64 nt, Homo Sapiens; identical to SEQ ID NO: 268332

SEQ ID NO: 597101 - RNA, 64 nt, Homo Sapiens; identical to SEQ ID NO: 268333

SEQ ID NO: 597102 - RNA, 64 nt, Homo Sapiens; identical to SEQ ID NO: 268334

SEQ ID NO: 597103 - RNA, 64 nt, Homo Sapiens; identical to SEQ ID NO: 268335

SEQ ID NO: 597104 - RNA, 64 nt, Homo Sapiens; identical to SEQ ID NO: 268336

SEQ ID NO: 597105 - RNA, 64 nt, Homo Sapiens; identical to SEQ ID NO: 268337

SEQ ID NO: 597106 - RNA, 64 nt, Homo Sapiens; identical to SEQ ID NO: 268338

SEQ ID NO: 597107 - RNA, 64 nt, Homo Sapiens; identical to SEQ ID NO: 268339

SEQ ID NO: 597108 - RNA, 64 nt, Homo Sapiens; identical to SEQ ID NO: 268340

SEQ ID NO: 597109 - RNA, 64 nt, Homo Sapiens; identical to SEQ ID NO: 268341

SEQ ID NO: 597110 - RNA, 64 nt, Homo Sapiens; identical to SEQ ID NO: 268342

SEQ ID NO: 597111 - RNA, 64 nt, Homo Sapiens; identical to SEQ ID NO: 268343

SEQ ID NO: 597112 - RNA, 64 nt, Homo Sapiens; identical to SEQ ID NO: 268344

SEQ ID NO: 597113 - RNA, 64 nt, Homo Sapiens; identical to SEQ ID NO: 268345

SEQ ID NO: 597114 - RNA, 64 nt, Homo Sapiens; identical to SEQ ID NO: 268346

SEQ ID NO: 597115 - RNA, 64 nt, Homo Sapiens; identical to SEQ ID NO: 268347

SEQ ID NO: 597116 - RNA, 64 nt, Homo Sapiens; identical to SEQ ID NO: 268348

SEQ ID NO: 597117 - RNA, 64 nt, Homo Sapiens; identical to SEQ ID NO: 268349

SEQ ID NO: 597118 - RNA, 64 nt, Homo Sapiens; identical to SEQ ID NO: 268350

SEQ ID NO: 597119 - RNA, 64 nt, Homo Sapiens; identical to SEQ ID NO: 268351

SEQ ID NO: 597120 - RNA, 64 nt, Homo Sapiens; identical to SEQ ID NO: 268352

SEQ ID NO: 597121 - RNA, 64 nt, Homo Sapiens; identical to SEQ ID NO: 268353

SEQ ID NO: 597122 - RNA, 64 nt, Homo Sapiens; identical to SEQ ID NO: 268354

SEQ ID NO: 597123 - RNA, 64 nt, Homo Sapiens; identical to SEQ ID NO: 268355

SEQ ID NO: 597124 - RNA, 64 nt, Homo Sapiens; identical to SEQ ID NO: 268356

SEQ ID NO: 597125 - RNA, 64 nt, Homo Sapiens; identical to SEQ ID NO: 268357

SEQ ID NO: 597126 - RNA, 64 nt, Homo Sapiens; identical to SEQ ID NO: 268358

SEQ ID NO: 597127 - RNA, 64 nt, Homo Sapiens; identical to SEQ ID NO: 268359

SEQ ID NO: 597128 - RNA, 64 nt, Homo Sapiens; identical to SEQ ID NO: 268360

SEQ ID NO: 597129 - RNA, 64 nt, Homo Sapiens; identical to SEQ ID NO: 268361

SEQ ID NO: 597130 - RNA, 64 nt, Homo Sapiens; identical to SEQ ID NO: 268362

SEQ ID NO: 597131 - RNA, 64 nt, Homo Sapiens; identical to SEQ ID NO: 268363

SEQ ID NO: 597132 - RNA, 64 nt, Homo Sapiens; identical to SEQ ID NO: 268364

SEQ ID NO: 597133 - RNA, 64 nt, Homo Sapiens; identical to SEQ ID NO: 268365

SEQ ID NO: 597134 - RNA, 64 nt, Homo Sapiens; identical to SEQ ID NO: 268366

SEQ ID NO: 597135 - RNA, 64 nt, Homo Sapiens; identical to SEQ ID NO: 268367

SEQ ID NO: 597136 - RNA, 64 nt, Homo Sapiens; identical to SEQ ID NO: 268368

SEQ ID NO: 597137 - RNA, 64 nt, Homo Sapiens; identical to SEQ ID NO: 268369

SEQ ID NO: 597138 - RNA, 64 nt, Homo Sapiens; identical to SEQ ID NO: 268370

SEQ ID NO: 597139 - RNA, 64 nt, Homo Sapiens; identical to SEQ ID NO: 268371

SEQ ID NO: 597140 - RNA, 64 nt, Homo Sapiens; identical to SEQ ID NO: 268372

SEQ ID NO: 597141 - RNA, 64 nt, Homo Sapiens; identical to SEQ ID NO: 268373

SEQ ID NO: 597142 - RNA, 64 nt, Homo Sapiens; identical to SEQ ID NO: 268374

SEQ ID NO: 597143 - RNA, 64 nt, Homo Sapiens; identical to SEQ ID NO: 268375

SEQ ID NO: 597144 - RNA, 64 nt, Homo Sapiens; identical to SEQ ID NO: 268376

SEQ ID NO: 597145 - RNA, 64 nt, Homo Sapiens; identical to SEQ ID NO: 268377

SEQ ID NO: 597146 - RNA, 64 nt, Homo Sapiens; identical to SEQ ID NO: 268378

SEQ ID NO: 597147 - RNA, 64 nt, Homo Sapiens; identical to SEQ ID NO: 268379

SEQ ID NO: 597148 - RNA, 64 nt, Homo Sapiens; identical to SEQ ID NO: 268380

SEQ ID NO: 597149 - RNA, 64 nt, Homo Sapiens; identical to SEQ ID NO: 268381

SEQ ID NO: 597150 - RNA, 64 nt, Homo Sapiens; identical to SEQ ID NO: 268382

SEQ ID NO: 597151 - RNA, 64 nt, Homo Sapiens; identical to SEQ ID NO: 268383

SEQ ID NO: 597152 - RNA, 64 nt, Homo Sapiens; identical to SEQ ID NO: 268384

SEQ ID NO: 597153 - RNA, 64 nt, Homo Sapiens; identical to SEQ ID NO: 268385

SEQ ID NO: 597154 - RNA, 64 nt, Homo Sapiens; identical to SEQ ID NO: 268386

SEQ ID NO: 597155 - RNA, 64 nt, Homo Sapiens; identical to SEQ ID NO: 268387

SEQ ID NO: 597156 - RNA, 64 nt, Homo Sapiens; identical to SEQ ID NO: 268388

SEQ ID NO: 597157 - RNA, 64 nt, Homo Sapiens; identical to SEQ ID NO: 268389

SEQ ID NO: 597158 - RNA, 64 nt, Homo Sapiens; identical to SEQ ID NO: 268390

SEQ ID NO: 597159 - RNA, 64 nt, Homo Sapiens; identical to SEQ ID NO: 268391

SEQ ID NO: 597160 - RNA, 64 nt, Homo Sapiens; identical to SEQ ID NO: 268392

SEQ ID NO: 597161 - RNA, 64 nt, Homo Sapiens; identical to SEQ ID NO: 268393

SEQ ID NO: 597162 - RNA, 64 nt, Homo Sapiens; identical to SEQ ID NO: 268394

SEQ ID NO: 597163 - RNA, 64 nt, Homo Sapiens; identical to SEQ ID NO: 268395

SEQ ID NO: 597164 - RNA, 64 nt, Homo Sapiens; identical to SEQ ID NO: 268396

SEQ ID NO: 597165 - RNA, 64 nt, Homo Sapiens; identical to SEQ ID NO: 268397

SEQ ID NO: 597166 - RNA, 64 nt, Homo Sapiens; identical to SEQ ID NO: 268398

SEQ ID NO: 597167 - RNA, 64 nt, Homo Sapiens; identical to SEQ ID NO: 268399

SEQ ID NO: 597168 - RNA, 64 nt, Homo Sapiens; identical to SEQ ID NO: 268400

SEQ ID NO: 597169 - RNA, 64 nt, Homo Sapiens; identical to SEQ ID NO: 268401

SEQ ID NO: 597170 - RNA, 64 nt, Homo Sapiens; identical to SEQ ID NO: 268402

SEQ ID NO: 597171 - RNA, 64 nt, Homo Sapiens; identical to SEQ ID NO: 268403

SEQ ID NO: 597172 - RNA, 64 nt, Homo Sapiens; identical to SEQ ID NO: 268404

SEQ ID NO: 597173 - RNA, 64 nt, Homo Sapiens; identical to SEQ ID NO: 268405

SEQ ID NO: 597174 - RNA, 64 nt, Homo Sapiens; identical to SEQ ID NO: 268406

SEQ ID NO: 597175 - RNA, 64 nt, Homo Sapiens; identical to SEQ ID NO: 268407

SEQ ID NO: 597176 - RNA, 64 nt, Homo Sapiens; identical to SEQ ID NO: 268408

SEQ ID NO: 597177 - RNA, 64 nt, Homo Sapiens; identical to SEQ ID NO: 268409

SEQ ID NO: 597178 - RNA, 64 nt, Homo Sapiens; identical to SEQ ID NO: 268410

SEQ ID NO: 597179 - RNA, 64 nt, Homo Sapiens; identical to SEQ ID NO: 268411

SEQ ID NO: 597180 - RNA, 64 nt, Homo Sapiens; identical to SEQ ID NO: 268412

SEQ ID NO: 597181 - RNA, 64 nt, Homo Sapiens; identical to SEQ ID NO: 268413

SEQ ID NO: 597182 - RNA, 64 nt, Homo Sapiens; identical to SEQ ID NO: 268414

SEQ ID NO: 597183 - RNA, 64 nt, Homo Sapiens; identical to SEQ ID NO: 268415

SEQ ID NO: 597184 - RNA, 64 nt, Homo Sapiens; identical to SEQ ID NO: 268416

SEQ ID NO: 597185 - RNA, 64 nt, Homo Sapiens; identical to SEQ ID NO: 268417

SEQ ID NO: 597186 - RNA, 64 nt, Homo Sapiens; identical to SEQ ID NO: 268418

SEQ ID NO: 597187 - RNA, 64 nt, Homo Sapiens; identical to SEQ ID NO: 268419

SEQ ID NO: 597188 - RNA, 64 nt, Homo Sapiens; identical to SEQ ID NO: 268420

SEQ ID NO: 597189 - RNA, 64 nt, Homo Sapiens; identical to SEQ ID NO: 268421

SEQ ID NO: 597190 - RNA, 64 nt, Homo Sapiens; identical to SEQ ID NO: 268422

SEQ ID NO: 597191 - RNA, 64 nt, Homo Sapiens; identical to SEQ ID NO: 268423

SEQ ID NO: 597192 - RNA, 64 nt, Homo Sapiens; identical to SEQ ID NO: 268424

SEQ ID NO: 597193 - RNA, 64 nt, Homo Sapiens; identical to SEQ ID NO: 268425

SEQ ID NO: 597194 - RNA, 64 nt, Homo Sapiens; identical to SEQ ID NO: 268426

SEQ ID NO: 597195 - RNA, 64 nt, Homo Sapiens; identical to SEQ ID NO: 268427

SEQ ID NO: 597196 - RNA, 64 nt, Homo Sapiens; identical to SEQ ID NO: 268428

SEQ ID NO: 597197 - RNA, 64 nt, Homo Sapiens; identical to SEQ ID NO: 268429

SEQ ID NO: 597198 - RNA, 64 nt, Homo Sapiens; identical to SEQ ID NO: 268430

SEQ ID NO: 597199 - RNA, 64 nt, Homo Sapiens; identical to SEQ ID NO: 268431

SEQ ID NO: 597200 - RNA, 64 nt, Homo Sapiens; identical to SEQ ID NO: 268432

SEQ ID NO: 597201 - RNA, 64 nt, Homo Sapiens; identical to SEQ ID NO: 268433

SEQ ID NO: 597202 - RNA, 64 nt, Homo Sapiens; identical to SEQ ID NO: 268434

SEQ ID NO: 597203 - RNA, 64 nt, Homo Sapiens; identical to SEQ ID NO: 268435

SEQ ID NO: 597204 - RNA, 64 nt, Homo Sapiens; identical to SEQ ID NO: 268436

SEQ ID NO: 597205 - RNA, 64 nt, Homo Sapiens; identical to SEQ ID NO: 268437

SEQ ID NO: 597206 - RNA, 64 nt, Homo Sapiens; identical to SEQ ID NO: 268438

SEQ ID NO: 597207 - RNA, 64 nt, Homo Sapiens; identical to SEQ ID NO: 268439

SEQ ID NO: 597208 - RNA, 64 nt, Homo Sapiens; identical to SEQ ID NO: 268440

SEQ ID NO: 597209 - RNA, 64 nt, Homo Sapiens; identical to SEQ ID NO: 268441

SEQ ID NO: 597210 - RNA, 64 nt, Homo Sapiens; identical to SEQ ID NO: 268442

SEQ ID NO: 597211 - RNA, 64 nt, Homo Sapiens; identical to SEQ ID NO: 268443

SEQ ID NO: 597212 - RNA, 64 nt, Homo Sapiens; identical to SEQ ID NO: 268444

SEQ ID NO: 597213 - RNA, 64 nt, Homo Sapiens; identical to SEQ ID NO: 268445

SEQ ID NO: 597214 - RNA, 64 nt, Homo Sapiens; identical to SEQ ID NO: 268446

SEQ ID NO: 597215 - RNA, 64 nt, Homo Sapiens; identical to SEQ ID NO: 268447

SEQ ID NO: 597216 - RNA, 64 nt, Homo Sapiens; identical to SEQ ID NO: 268448

SEQ ID NO: 597217 - RNA, 64 nt, Homo Sapiens; identical to SEQ ID NO: 268449

SEQ ID NO: 597218 - RNA, 64 nt, Homo Sapiens; identical to SEQ ID NO: 268450

SEQ ID NO: 597219 - RNA, 64 nt, Homo Sapiens; identical to SEQ ID NO: 268451

SEQ ID NO: 597220 - RNA, 64 nt, Homo Sapiens; identical to SEQ ID NO: 268452

SEQ ID NO: 597221 - RNA, 64 nt, Homo Sapiens; identical to SEQ ID NO: 268453

SEQ ID NO: 597222 - RNA, 64 nt, Homo Sapiens; identical to SEQ ID NO: 268454

SEQ ID NO: 597223 - RNA, 64 nt, Homo Sapiens; identical to SEQ ID NO: 268455

SEQ ID NO: 597224 - RNA, 64 nt, Homo Sapiens; identical to SEQ ID NO: 268456

SEQ ID NO: 597225 - RNA, 64 nt, Homo Sapiens; identical to SEQ ID NO: 268457

SEQ ID NO: 597226 - RNA, 64 nt, Homo Sapiens; identical to SEQ ID NO: 268458

SEQ ID NO: 597227 - RNA, 64 nt, Homo Sapiens; identical to SEQ ID NO: 268459

SEQ ID NO: 597228 - RNA, 64 nt, Homo Sapiens; identical to SEQ ID NO: 268460

SEQ ID NO: 597229 - RNA, 64 nt, Homo Sapiens; identical to SEQ ID NO: 268461

SEQ ID NO: 597230 - RNA, 64 nt, Homo Sapiens; identical to SEQ ID NO: 268462

SEQ ID NO: 597231 - RNA, 64 nt, Homo Sapiens; identical to SEQ ID NO: 268463

SEQ ID NO: 597232 - RNA, 64 nt, Homo Sapiens; identical to SEQ ID NO: 268464

SEQ ID NO: 597233 - RNA, 64 nt, Homo Sapiens; identical to SEQ ID NO: 268465

SEQ ID NO: 597234 - RNA, 64 nt, Homo Sapiens; identical to SEQ ID NO: 268466

SEQ ID NO: 597235 - RNA, 64 nt, Homo Sapiens; identical to SEQ ID NO: 268467

SEQ ID NO: 597236 - RNA, 64 nt, Homo Sapiens; identical to SEQ ID NO: 268468

SEQ ID NO: 597237 - RNA, 64 nt, Homo Sapiens; identical to SEQ ID NO: 268469

SEQ ID NO: 597238 - RNA, 64 nt, Homo Sapiens; identical to SEQ ID NO: 268470

SEQ ID NO: 597239 - RNA, 64 nt, Homo Sapiens; identical to SEQ ID NO: 268471

SEQ ID NO: 597240 - RNA, 64 nt, Homo Sapiens; identical to SEQ ID NO: 268472

SEQ ID NO: 597241 - RNA, 64 nt, Homo Sapiens; identical to SEQ ID NO: 268473

SEQ ID NO: 597242 - RNA, 64 nt, Homo Sapiens; identical to SEQ ID NO: 268474

SEQ ID NO: 597243 - RNA, 64 nt, Homo Sapiens; identical to SEQ ID NO: 268475

SEQ ID NO: 597244 - RNA, 64 nt, Homo Sapiens; identical to SEQ ID NO: 268476

SEQ ID NO: 597245 - RNA, 64 nt, Homo Sapiens; identical to SEQ ID NO: 268477

SEQ ID NO: 597246 - RNA, 64 nt, Homo Sapiens; identical to SEQ ID NO: 268478

SEQ ID NO: 597247 - RNA, 64 nt, Homo Sapiens; identical to SEQ ID NO: 268479

SEQ ID NO: 597248 - RNA, 64 nt, Homo Sapiens; identical to SEQ ID NO: 268480

SEQ ID NO: 597249 - RNA, 64 nt, Homo Sapiens; identical to SEQ ID NO: 268481

SEQ ID NO: 597250 - RNA, 64 nt, Homo Sapiens; identical to SEQ ID NO: 268482

SEQ ID NO: 597251 - RNA, 64 nt, Homo Sapiens; identical to SEQ ID NO: 268483

SEQ ID NO: 597252 - RNA, 64 nt, Homo Sapiens; identical to SEQ ID NO: 268484

SEQ ID NO: 597253 - RNA, 64 nt, Homo Sapiens; identical to SEQ ID NO: 268485

SEQ ID NO: 597254 - RNA, 64 nt, Homo Sapiens; identical to SEQ ID NO: 268486

SEQ ID NO: 597255 - RNA, 64 nt, Homo Sapiens; identical to SEQ ID NO: 268487

SEQ ID NO: 597256 - RNA, 64 nt, Homo Sapiens; identical to SEQ ID NO: 268488

SEQ ID NO: 597257 - RNA, 64 nt, Homo Sapiens; identical to SEQ ID NO: 268489

SEQ ID NO: 597258 - RNA, 64 nt, Homo Sapiens; identical to SEQ ID NO: 268490

SEQ ID NO: 597259 - RNA, 64 nt, Homo Sapiens; identical to SEQ ID NO: 268491

SEQ ID NO: 597260 - RNA, 64 nt, Homo Sapiens; identical to SEQ ID NO: 268492

SEQ ID NO: 597261 - RNA, 64 nt, Homo Sapiens; identical to SEQ ID NO: 268493

SEQ ID NO: 597262 - RNA, 64 nt, Homo Sapiens; identical to SEQ ID NO: 268494

SEQ ID NO: 597263 - RNA, 64 nt, Homo Sapiens; identical to SEQ ID NO: 268495

SEQ ID NO: 597264 - RNA, 64 nt, Homo Sapiens; identical to SEQ ID NO: 268496

SEQ ID NO: 597265 - RNA, 64 nt, Homo Sapiens; identical to SEQ ID NO: 268497

SEQ ID NO: 597266 - RNA, 64 nt, Homo Sapiens; identical to SEQ ID NO: 268498

SEQ ID NO: 597267 - RNA, 64 nt, Homo Sapiens; identical to SEQ ID NO: 268499

SEQ ID NO: 597268 - RNA, 64 nt, Homo Sapiens; identical to SEQ ID NO: 268500

SEQ ID NO: 597269 - RNA, 64 nt, Homo Sapiens; identical to SEQ ID NO: 268501

SEQ ID NO: 597270 - RNA, 64 nt, Homo Sapiens; identical to SEQ ID NO: 268502

SEQ ID NO: 597271 - RNA, 64 nt, Homo Sapiens; identical to SEQ ID NO: 268503

SEQ ID NO: 597272 - RNA, 64 nt, Homo Sapiens; identical to SEQ ID NO: 268504

SEQ ID NO: 597273 - RNA, 64 nt, Homo Sapiens; identical to SEQ ID NO: 268505

SEQ ID NO: 597274 - RNA, 64 nt, Homo Sapiens; identical to SEQ ID NO: 268506

SEQ ID NO: 597275 - RNA, 64 nt, Homo Sapiens; identical to SEQ ID NO: 268507

SEQ ID NO: 597276 - RNA, 64 nt, Homo Sapiens; identical to SEQ ID NO: 268508

SEQ ID NO: 597277 - RNA, 64 nt, Homo Sapiens; identical to SEQ ID NO: 268509

SEQ ID NO: 597278 - RNA, 64 nt, Homo Sapiens; identical to SEQ ID NO: 268510

SEQ ID NO: 597279 - RNA, 64 nt, Homo Sapiens; identical to SEQ ID NO: 268511

SEQ ID NO: 597280 - RNA, 64 nt, Homo Sapiens; identical to SEQ ID NO: 268512

SEQ ID NO: 597281 - RNA, 64 nt, Homo Sapiens; identical to SEQ ID NO: 268513

SEQ ID NO: 597282 - RNA, 64 nt, Homo Sapiens; identical to SEQ ID NO: 268514

SEQ ID NO: 597283 - RNA, 64 nt, Homo Sapiens; identical to SEQ ID NO: 268515

SEQ ID NO: 597284 - RNA, 54 nt, Homo Sapiens; identical to SEQ ID NO: 268516

SEQ ID NO: 597285 - RNA, 64 nt, Homo Sapiens; identical to SEQ ID NO: 268517

SEQ ID NO: 597286 - RNA, 64 nt, Homo Sapiens; identical to SEQ ID NO: 268518

SEQ ID NO: 597287 - RNA, 64 nt, Homo Sapiens; identical to SEQ ID NO: 268519

SEQ ID NO: 597288 - RNA, 64 nt, Homo Sapiens; identical to SEQ ID NO: 268520

SEQ ID NO: 597289 - RNA, 64 nt, Homo Sapiens; identical to SEQ ID NO: 268521

SEQ ID NO: 597290 - RNA, 64 nt, Homo Sapiens; identical to SEQ ID NO: 268522

SEQ ID NO: 597291 - RNA, 64 nt, Homo Sapiens; identical to SEQ ID NO: 268523

SEQ ID NO: 597292 - RNA, 64 nt, Homo Sapiens; identical to SEQ ID NO: 268524

SEQ ID NO: 597293 - RNA, 64 nt, Homo Sapiens; identical to SEQ ID NO: 268525

SEQ ID NO: 597294 - RNA, 64 nt, Homo Sapiens; identical to SEQ ID NO: 268526

SEQ ID NO: 597295 - RNA, 64 nt, Homo Sapiens; identical to SEQ ID NO: 268527

SEQ ID NO: 597296 - RNA, 64 nt, Homo Sapiens; identical to SEQ ID NO: 268528

SEQ ID NO: 597297 - RNA, 64 nt, Homo Sapiens; identical to SEQ ID NO: 268529

SEQ ID NO: 597298 - RNA, 64 nt, Homo Sapiens; identical to SEQ ID NO: 268530

SEQ ID NO: 597299 - RNA, 64 nt, Homo Sapiens; identical to SEQ ID NO: 268531

SEQ ID NO: 597300 - RNA, 57 nt, Homo Sapiens; identical to SEQ ID NO: 268532

SEQ ID NO: 597301 - RNA, 64 nt, Homo Sapiens; identical to SEQ ID NO: 268533

SEQ ID NO: 597302 - RNA, 64 nt, Homo Sapiens; identical to SEQ ID NO: 268534

SEQ ID NO: 597303 - RNA, 64 nt, Homo Sapiens; identical to SEQ ID NO: 268535

SEQ ID NO: 597304 - RNA, 64 nt, Homo Sapiens; identical to SEQ ID NO: 268536

SEQ ID NO: 597305 - RNA, 64 nt, Homo Sapiens; identical to SEQ ID NO: 268537

SEQ ID NO: 597306 - RNA, 64 nt, Homo Sapiens; identical to SEQ ID NO: 268538

SEQ ID NO: 597307 - RNA, 64 nt, Homo Sapiens; identical to SEQ ID NO: 268539

SEQ ID NO: 597308 - RNA, 64 nt, Homo Sapiens; identical to SEQ ID NO: 268540

SEQ ID NO: 597309 - RNA, 64 nt, Homo Sapiens; identical to SEQ ID NO: 268541

SEQ ID NO: 597310 - RNA, 64 nt, Homo Sapiens; identical to SEQ ID NO: 268542

SEQ ID NO: 597311 - RNA, 64 nt, Homo Sapiens; identical to SEQ ID NO: 268543

SEQ ID NO: 597312 - RNA, 64 nt, Homo Sapiens; identical to SEQ ID NO: 268544

SEQ ID NO: 597313 - RNA, 64 nt, Homo Sapiens; identical to SEQ ID NO: 268545

SEQ ID NO: 597314 - RNA, 64 nt, Homo Sapiens; identical to SEQ ID NO: 268546

SEQ ID NO: 597315 - RNA, 64 nt, Homo Sapiens; identical to SEQ ID NO: 268547

SEQ ID NO: 597316 - RNA, 64 nt, Homo Sapiens; identical to SEQ ID NO: 268548

SEQ ID NO: 597317 - RNA, 64 nt, Homo Sapiens; identical to SEQ ID NO: 268549

SEQ ID NO: 597318 - RNA, 64 nt, Homo Sapiens; identical to SEQ ID NO: 268550

SEQ ID NO: 597319 - RNA, 64 nt, Homo Sapiens; identical to SEQ ID NO: 268551

SEQ ID NO: 597320 - RNA, 64 nt, Homo Sapiens; identical to SEQ ID NO: 268552

SEQ ID NO: 597321 - RNA, 64 nt, Homo Sapiens; identical to SEQ ID NO: 268553

SEQ ID NO: 597322 - RNA, 64 nt, Homo Sapiens; identical to SEQ ID NO: 268554

SEQ ID NO: 597323 - RNA, 64 nt, Homo Sapiens; identical to SEQ ID NO: 268555

SEQ ID NO: 597324 - RNA, 64 nt, Homo Sapiens; identical to SEQ ID NO: 268556

SEQ ID NO: 597325 - RNA, 64 nt, Homo Sapiens; identical to SEQ ID NO: 268557

SEQ ID NO: 597326 - RNA, 64 nt, Homo Sapiens; identical to SEQ ID NO: 268558

SEQ ID NO: 597327 - RNA, 64 nt, Homo Sapiens; identical to SEQ ID NO: 268559

SEQ ID NO: 597328 - RNA, 64 nt, Homo Sapiens; identical to SEQ ID NO: 268560

SEQ ID NO: 597329 - RNA, 64 nt, Homo Sapiens; identical to SEQ ID NO: 268561

SEQ ID NO: 597330 - RNA, 64 nt, Homo Sapiens; identical to SEQ ID NO: 268562

SEQ ID NO: 597331 - RNA, 64 nt, Homo Sapiens; identical to SEQ ID NO: 268563

SEQ ID NO: 597332 - RNA, 64 nt, Homo Sapiens; identical to SEQ ID NO: 268564

SEQ ID NO: 597333 - RNA, 64 nt, Homo Sapiens; identical to SEQ ID NO: 268565

SEQ ID NO: 597334 - RNA, 64 nt, Homo Sapiens; identical to SEQ ID NO: 268566

SEQ ID NO: 597335 - RNA, 64 nt, Homo Sapiens; identical to SEQ ID NO: 268567

SEQ ID NO: 597336 - RNA, 64 nt, Homo Sapiens; identical to SEQ ID NO: 268568

SEQ ID NO: 597337 - RNA, 64 nt, Homo Sapiens; identical to SEQ ID NO: 268569

SEQ ID NO: 597338 - RNA, 64 nt, Homo Sapiens; identical to SEQ ID NO: 268570

SEQ ID NO: 597339 - RNA, 64 nt, Homo Sapiens; identical to SEQ ID NO: 268571

SEQ ID NO: 597340 - RNA, 64 nt, Homo Sapiens; identical to SEQ ID NO: 268572

SEQ ID NO: 597341 - RNA, 64 nt, Homo Sapiens; identical to SEQ ID NO: 268573

SEQ ID NO: 597342 - RNA, 64 nt, Homo Sapiens; identical to SEQ ID NO: 268574

SEQ ID NO: 597343 - RNA, 64 nt, Homo Sapiens; identical to SEQ ID NO: 268575

SEQ ID NO: 597344 - RNA, 64 nt, Homo Sapiens; identical to SEQ ID NO: 268576

SEQ ID NO: 597345 - RNA, 64 nt, Homo Sapiens; identical to SEQ ID NO: 268577

SEQ ID NO: 597346 - RNA, 64 nt, Homo Sapiens; identical to SEQ ID NO: 268578

SEQ ID NO: 597347 - RNA, 64 nt, Homo Sapiens; identical to SEQ ID NO: 268579

SEQ ID NO: 597348 - RNA, 64 nt, Homo Sapiens; identical to SEQ ID NO: 268580

SEQ ID NO: 597349 - RNA, 64 nt, Homo Sapiens; identical to SEQ ID NO: 268581

SEQ ID NO: 597350 - RNA, 64 nt, Homo Sapiens; identical to SEQ ID NO: 268582

SEQ ID NO: 597351 - RNA, 64 nt, Homo Sapiens; identical to SEQ ID NO: 268583

SEQ ID NO: 597352 - RNA, 64 nt, Homo Sapiens; identical to SEQ ID NO: 268584

SEQ ID NO: 597353 - RNA, 64 nt, Homo Sapiens; identical to SEQ ID NO: 268585

SEQ ID NO: 597354 - RNA, 64 nt, Homo Sapiens; identical to SEQ ID NO: 268586

SEQ ID NO: 597355 - RNA, 64 nt, Homo Sapiens; identical to SEQ ID NO: 268587

SEQ ID NO: 597356 - RNA, 64 nt, Homo Sapiens; identical to SEQ ID NO: 268588

SEQ ID NO: 597357 - RNA, 64 nt, Homo Sapiens; identical to SEQ ID NO: 268589

SEQ ID NO: 597358 - RNA, 64 nt, Homo Sapiens; identical to SEQ ID NO: 268590

SEQ ID NO: 597359 - RNA, 64 nt, Homo Sapiens; identical to SEQ ID NO: 268591

SEQ ID NO: 597360 - RNA, 64 nt, Homo Sapiens; identical to SEQ ID NO: 268592

SEQ ID NO: 597361 - RNA, 64 nt, Homo Sapiens; identical to SEQ ID NO: 268593

SEQ ID NO: 597362 - RNA, 64 nt, Homo Sapiens; identical to SEQ ID NO: 268594

SEQ ID NO: 597363 - RNA, 64 nt, Homo Sapiens; identical to SEQ ID NO: 268595

SEQ ID NO: 597364 - RNA, 64 nt, Homo Sapiens; identical to SEQ ID NO: 268596

SEQ ID NO: 597365 - RNA, 64 nt, Homo Sapiens; identical to SEQ ID NO: 268597

SEQ ID NO: 597366 - RNA, 64 nt, Homo Sapiens; identical to SEQ ID NO: 268598

SEQ ID NO: 597367 - RNA, 64 nt, Homo Sapiens; identical to SEQ ID NO: 268599

SEQ ID NO: 597368 - RNA, 64 nt, Homo Sapiens; identical to SEQ ID NO: 268600

SEQ ID NO: 597369 - RNA, 64 nt, Homo Sapiens; identical to SEQ ID NO: 268601

SEQ ID NO: 597370 - RNA, 64 nt, Homo Sapiens; identical to SEQ ID NO: 268602

SEQ ID NO: 597371 - RNA, 64 nt, Homo Sapiens; identical to SEQ ID NO: 268603

SEQ ID NO: 597372 - RNA, 64 nt, Homo Sapiens; identical to SEQ ID NO: 268604

SEQ ID NO: 597373 - RNA, 64 nt, Homo Sapiens; identical to SEQ ID NO: 268605

SEQ ID NO: 597374 - RNA, 64 nt, Homo Sapiens; identical to SEQ ID NO: 268606

SEQ ID NO: 597375 - RNA, 64 nt, Homo Sapiens; identical to SEQ ID NO: 268607

SEQ ID NO: 597376 - RNA, 64 nt, Homo Sapiens; identical to SEQ ID NO: 268608

SEQ ID NO: 597377 - RNA, 64 nt, Homo Sapiens; identical to SEQ ID NO: 268609

SEQ ID NO: 597378 - RNA, 64 nt, Homo Sapiens; identical to SEQ ID NO: 268610

SEQ ID NO: 597379 - RNA, 64 nt, Homo Sapiens; identical to SEQ ID NO: 268611

SEQ ID NO: 597380 - RNA, 64 nt, Homo Sapiens; identical to SEQ ID NO: 268612

SEQ ID NO: 597381 - RNA, 64 nt, Homo Sapiens; identical to SEQ ID NO: 268613

SEQ ID NO: 597382 - RNA, 64 nt, Homo Sapiens; identical to SEQ ID NO: 268614

SEQ ID NO: 597383 - RNA, 64 nt, Homo Sapiens; identical to SEQ ID NO: 268615

SEQ ID NO: 597384 - RNA, 64 nt, Homo Sapiens; identical to SEQ ID NO: 268616

SEQ ID NO: 597385 - RNA, 64 nt, Homo Sapiens; identical to SEQ ID NO: 268617

SEQ ID NO: 597386 - RNA, 64 nt, Homo Sapiens; identical to SEQ ID NO: 268618

SEQ ID NO: 597387 - RNA, 64 nt, Homo Sapiens; identical to SEQ ID NO: 268619

SEQ ID NO: 597388 - RNA, 64 nt, Homo Sapiens; identical to SEQ ID NO: 268620

SEQ ID NO: 597389 - RNA, 64 nt, Homo Sapiens; identical to SEQ ID NO: 268621

SEQ ID NO: 597390 - RNA, 64 nt, Homo Sapiens; identical to SEQ ID NO: 268622

SEQ ID NO: 597391 - RNA, 64 nt, Homo Sapiens; identical to SEQ ID NO: 268623

SEQ ID NO: 597392 - RNA, 64 nt, Homo Sapiens; identical to SEQ ID NO: 268624

SEQ ID NO: 597393 - RNA, 64 nt, Homo Sapiens; identical to SEQ ID NO: 268625

SEQ ID NO: 597394 - RNA, 64 nt, Homo Sapiens; identical to SEQ ID NO: 268626

SEQ ID NO: 597395 - RNA, 64 nt, Homo Sapiens; identical to SEQ ID NO: 268627

SEQ ID NO: 597396 - RNA, 64 nt, Homo Sapiens; identical to SEQ ID NO: 268628

SEQ ID NO: 597397 - RNA, 64 nt, Homo Sapiens; identical to SEQ ID NO: 268629

SEQ ID NO: 597398 - RNA, 64 nt, Homo Sapiens; identical to SEQ ID NO: 268630

SEQ ID NO: 597399 - RNA, 64 nt, Homo Sapiens; identical to SEQ ID NO: 268631

SEQ ID NO: 597400 - RNA, 64 nt, Homo Sapiens; identical to SEQ ID NO: 268632

SEQ ID NO: 597401 - RNA, 64 nt, Homo Sapiens; identical to SEQ ID NO: 268633

SEQ ID NO: 597402 - RNA, 64 nt, Homo Sapiens; identical to SEQ ID NO: 268634

SEQ ID NO: 597403 - RNA, 64 nt, Homo Sapiens; identical to SEQ ID NO: 268635

SEQ ID NO: 597404 - RNA, 64 nt, Homo Sapiens; identical to SEQ ID NO: 268636

SEQ ID NO: 597405 - RNA, 64 nt, Homo Sapiens; identical to SEQ ID NO: 268637

SEQ ID NO: 597406 - RNA, 64 nt, Homo Sapiens; identical to SEQ ID NO: 268638

SEQ ID NO: 597407 - RNA, 64 nt, Homo Sapiens; identical to SEQ ID NO: 268639

SEQ ID NO: 597408 - RNA, 64 nt, Homo Sapiens; identical to SEQ ID NO: 268640

SEQ ID NO: 597409 - RNA, 64 nt, Homo Sapiens; identical to SEQ ID NO: 268641

SEQ ID NO: 597410 - RNA, 64 nt, Homo Sapiens; identical to SEQ ID NO: 268642

SEQ ID NO: 597411 - RNA, 64 nt, Homo Sapiens; identical to SEQ ID NO: 268643

SEQ ID NO: 597412 - RNA, 64 nt, Homo Sapiens; identical to SEQ ID NO: 268644

SEQ ID NO: 597413 - RNA, 64 nt, Homo Sapiens; identical to SEQ ID NO: 268645

SEQ ID NO: 597414 - RNA, 64 nt, Homo Sapiens; identical to SEQ ID NO: 268646

SEQ ID NO: 597415 - RNA, 64 nt, Homo Sapiens; identical to SEQ ID NO: 268647

SEQ ID NO: 597416 - RNA, 64 nt, Homo Sapiens; identical to SEQ ID NO: 268648

SEQ ID NO: 597417 - RNA, 64 nt, Homo Sapiens; identical to SEQ ID NO: 268649

SEQ ID NO: 597418 - RNA, 64 nt, Homo Sapiens; identical to SEQ ID NO: 268650

SEQ ID NO: 597419 - RNA, 64 nt, Homo Sapiens; identical to SEQ ID NO: 268651

SEQ ID NO: 597420 - RNA, 64 nt, Homo Sapiens; identical to SEQ ID NO: 268652

SEQ ID NO: 597421 - RNA, 64 nt, Homo Sapiens; identical to SEQ ID NO: 268653

SEQ ID NO: 597422 - RNA, 64 nt, Homo Sapiens; identical to SEQ ID NO: 268654

SEQ ID NO: 597423 - RNA, 64 nt, Homo Sapiens; identical to SEQ ID NO: 268655

SEQ ID NO: 597424 - RNA, 64 nt, Homo Sapiens; identical to SEQ ID NO: 268656

SEQ ID NO: 597425 - RNA, 64 nt, Homo Sapiens; identical to SEQ ID NO: 268657

SEQ ID NO: 597426 - RNA, 64 nt, Homo Sapiens; identical to SEQ ID NO: 268658

SEQ ID NO: 597427 - RNA, 64 nt, Homo Sapiens; identical to SEQ ID NO: 268659

SEQ ID NO: 597428 - RNA, 64 nt, Homo Sapiens; identical to SEQ ID NO: 268660

SEQ ID NO: 597429 - RNA, 64 nt, Homo Sapiens; identical to SEQ ID NO: 268661

SEQ ID NO: 597430 - RNA, 64 nt, Homo Sapiens; identical to SEQ ID NO: 268662

SEQ ID NO: 597431 - RNA, 64 nt, Homo Sapiens; identical to SEQ ID NO: 268663

SEQ ID NO: 597432 - RNA, 64 nt, Homo Sapiens; identical to SEQ ID NO: 268664

SEQ ID NO: 597433 - RNA, 64 nt, Homo Sapiens; identical to SEQ ID NO: 268665

SEQ ID NO: 597434 - RNA, 64 nt, Homo Sapiens; identical to SEQ ID NO: 268666

SEQ ID NO: 597435 - RNA, 64 nt, Homo Sapiens; identical to SEQ ID NO: 268667

SEQ ID NO: 597436 - RNA, 64 nt, Homo Sapiens; identical to SEQ ID NO: 268668

SEQ ID NO: 597437 - RNA, 64 nt, Homo Sapiens; identical to SEQ ID NO: 268669

SEQ ID NO: 597438 - RNA, 64 nt, Homo Sapiens; identical to SEQ ID NO: 268670

SEQ ID NO: 597439 - RNA, 64 nt, Homo Sapiens; identical to SEQ ID NO: 268671

SEQ ID NO: 597440 - RNA, 64 nt, Homo Sapiens; identical to SEQ ID NO: 268672

SEQ ID NO: 597441 - RNA, 64 nt, Homo Sapiens; identical to SEQ ID NO: 268673

SEQ ID NO: 597442 - RNA, 64 nt, Homo Sapiens; identical to SEQ ID NO: 268674

SEQ ID NO: 597443 - RNA, 64 nt, Homo Sapiens; identical to SEQ ID NO: 268675

SEQ ID NO: 597444 - RNA, 64 nt, Homo Sapiens; identical to SEQ ID NO: 268676

SEQ ID NO: 597445 - RNA, 64 nt, Homo Sapiens; identical to SEQ ID NO: 268677

SEQ ID NO: 597446 - RNA, 64 nt, Homo Sapiens; identical to SEQ ID NO: 268678

SEQ ID NO: 597447 - RNA, 64 nt, Homo Sapiens; identical to SEQ ID NO: 268679

SEQ ID NO: 597448 - RNA, 64 nt, Homo Sapiens; identical to SEQ ID NO: 268680

SEQ ID NO: 597449 - RNA, 64 nt, Homo Sapiens; identical to SEQ ID NO: 268681

SEQ ID NO: 597450 - RNA, 64 nt, Homo Sapiens; identical to SEQ ID NO: 268682

SEQ ID NO: 597451 - RNA, 64 nt, Homo Sapiens; identical to SEQ ID NO: 268683

SEQ ID NO: 597452 - RNA, 64 nt, Homo Sapiens; identical to SEQ ID NO: 268684

SEQ ID NO: 597453 - RNA, 64 nt, Homo Sapiens; identical to SEQ ID NO: 268685

SEQ ID NO: 597454 - RNA, 64 nt, Homo Sapiens; identical to SEQ ID NO: 268686

SEQ ID NO: 597455 - RNA, 64 nt, Homo Sapiens; identical to SEQ ID NO: 268687

SEQ ID NO: 597456 - RNA, 64 nt, Homo Sapiens; identical to SEQ ID NO: 268688

SEQ ID NO: 597457 - RNA, 64 nt, Homo Sapiens; identical to SEQ ID NO: 268689

SEQ ID NO: 597458 - RNA, 64 nt, Homo Sapiens; identical to SEQ ID NO: 268690

SEQ ID NO: 597459 - RNA, 64 nt, Homo Sapiens; identical to SEQ ID NO: 268691

SEQ ID NO: 597460 - RNA, 64 nt, Homo Sapiens; identical to SEQ ID NO: 268692

SEQ ID NO: 597461 - RNA, 64 nt, Homo Sapiens; identical to SEQ ID NO: 268693

SEQ ID NO: 597462 - RNA, 64 nt, Homo Sapiens; identical to SEQ ID NO: 268694

SEQ ID NO: 597463 - RNA, 64 nt, Homo Sapiens; identical to SEQ ID NO: 268695

SEQ ID NO: 597464 - RNA, 64 nt, Homo Sapiens; identical to SEQ ID NO: 268696

SEQ ID NO: 597465 - RNA, 64 nt, Homo Sapiens; identical to SEQ ID NO: 268697

SEQ ID NO: 597466 - RNA, 64 nt, Homo Sapiens; identical to SEQ ID NO: 268698

SEQ ID NO: 597467 - RNA, 64 nt, Homo Sapiens; identical to SEQ ID NO: 268699

SEQ ID NO: 597468 - RNA, 64 nt, Homo Sapiens; identical to SEQ ID NO: 268700

SEQ ID NO: 597469 - RNA, 64 nt, Homo Sapiens; identical to SEQ ID NO: 268701

SEQ ID NO: 597470 - RNA, 64 nt, Homo Sapiens; identical to SEQ ID NO: 268702

SEQ ID NO: 597471 - RNA, 64 nt, Homo Sapiens; identical to SEQ ID NO: 268703

SEQ ID NO: 597472 - RNA, 64 nt, Homo Sapiens; identical to SEQ ID NO: 268704

SEQ ID NO: 597473 - RNA, 64 nt, Homo Sapiens; identical to SEQ ID NO: 268705

SEQ ID NO: 597474 - RNA, 64 nt, Homo Sapiens; identical to SEQ ID NO: 268706

SEQ ID NO: 597475 - RNA, 64 nt, Homo Sapiens; identical to SEQ ID NO: 268707

SEQ ID NO: 597476 - RNA, 64 nt, Homo Sapiens; identical to SEQ ID NO: 268708

SEQ ID NO: 597477 - RNA, 64 nt, Homo Sapiens; identical to SEQ ID NO: 268709

SEQ ID NO: 597478 - RNA, 64 nt, Homo Sapiens; identical to SEQ ID NO: 268710

SEQ ID NO: 597479 - RNA, 64 nt, Homo Sapiens; identical to SEQ ID NO: 268711

SEQ ID NO: 597480 - RNA, 64 nt, Homo Sapiens; identical to SEQ ID NO: 268712

SEQ ID NO: 597481 - RNA, 64 nt, Homo Sapiens; identical to SEQ ID NO: 268713

SEQ ID NO: 597482 - RNA, 64 nt, Homo Sapiens; identical to SEQ ID NO: 268714

SEQ ID NO: 597483 - RNA, 64 nt, Homo Sapiens; identical to SEQ ID NO: 268715

SEQ ID NO: 597484 - RNA, 64 nt, Homo Sapiens; identical to SEQ ID NO: 268716

SEQ ID NO: 597485 - RNA, 64 nt, Homo Sapiens; identical to SEQ ID NO: 268717

SEQ ID NO: 597486 - RNA, 64 nt, Homo Sapiens; identical to SEQ ID NO: 268718

SEQ ID NO: 597487 - RNA, 64 nt, Homo Sapiens; identical to SEQ ID NO: 268719

SEQ ID NO: 597488 - RNA, 64 nt, Homo Sapiens; identical to SEQ ID NO: 268720

SEQ ID NO: 597489 - RNA, 64 nt, Homo Sapiens; identical to SEQ ID NO: 268721

SEQ ID NO: 597490 - RNA, 64 nt, Homo Sapiens; identical to SEQ ID NO: 268722

SEQ ID NO: 597491 - RNA, 64 nt, Homo Sapiens; identical to SEQ ID NO: 268723

SEQ ID NO: 597492 - RNA, 64 nt, Homo Sapiens; identical to SEQ ID NO: 268724

SEQ ID NO: 597493 - RNA, 64 nt, Homo Sapiens; identical to SEQ ID NO: 268725

SEQ ID NO: 597494 - RNA, 64 nt, Homo Sapiens; identical to SEQ ID NO: 268726

SEQ ID NO: 597495 - RNA, 64 nt, Homo Sapiens; identical to SEQ ID NO: 268727

SEQ ID NO: 597496 - RNA, 64 nt, Homo Sapiens; identical to SEQ ID NO: 268728

SEQ ID NO: 597497 - RNA, 64 nt, Homo Sapiens; identical to SEQ ID NO: 268729

SEQ ID NO: 597498 - RNA, 64 nt, Homo Sapiens; identical to SEQ ID NO: 268730

SEQ ID NO: 597499 - RNA, 64 nt, Homo Sapiens; identical to SEQ ID NO: 268731

SEQ ID NO: 597500 - RNA, 64 nt, Homo Sapiens; identical to SEQ ID NO: 268732

SEQ ID NO: 597501 - RNA, 64 nt, Homo Sapiens; identical to SEQ ID NO: 268733

SEQ ID NO: 597502 - RNA, 64 nt, Homo Sapiens; identical to SEQ ID NO: 268734

SEQ ID NO: 597503 - RNA, 64 nt, Homo Sapiens; identical to SEQ ID NO: 268735

SEQ ID NO: 597504 - RNA, 64 nt, Homo Sapiens; identical to SEQ ID NO: 268736

SEQ ID NO: 597505 - RNA, 64 nt, Homo Sapiens; identical to SEQ ID NO: 268737

SEQ ID NO: 597506 - RNA, 64 nt, Homo Sapiens; identical to SEQ ID NO: 268738

SEQ ID NO: 597507 - RNA, 64 nt, Homo Sapiens; identical to SEQ ID NO: 268739

SEQ ID NO: 597508 - RNA, 64 nt, Homo Sapiens; identical to SEQ ID NO: 268740

SEQ ID NO: 597509 - RNA, 64 nt, Homo Sapiens; identical to SEQ ID NO: 268741

SEQ ID NO: 597510 - RNA, 64 nt, Homo Sapiens; identical to SEQ ID NO: 268742

SEQ ID NO: 597511 - RNA, 64 nt, Homo Sapiens; identical to SEQ ID NO: 268743

SEQ ID NO: 597512 - RNA, 64 nt, Homo Sapiens; identical to SEQ ID NO: 268744

SEQ ID NO: 597513 - RNA, 64 nt, Homo Sapiens; identical to SEQ ID NO: 268745

SEQ ID NO: 597514 - RNA, 64 nt, Homo Sapiens; identical to SEQ ID NO: 268746

SEQ ID NO: 597515 - RNA, 64 nt, Homo Sapiens; identical to SEQ ID NO: 268747

SEQ ID NO: 597516 - RNA, 64 nt, Homo Sapiens; identical to SEQ ID NO: 268748

SEQ ID NO: 597517 - RNA, 64 nt, Homo Sapiens; identical to SEQ ID NO: 268749

SEQ ID NO: 597518 - RNA, 64 nt, Homo Sapiens; identical to SEQ ID NO: 268750

SEQ ID NO: 597519 - RNA, 64 nt, Homo Sapiens; identical to SEQ ID NO: 268751

SEQ ID NO: 597520 - RNA, 64 nt, Homo Sapiens; identical to SEQ ID NO: 268752

SEQ ID NO: 597521 - RNA, 64 nt, Homo Sapiens; identical to SEQ ID NO: 268753

SEQ ID NO: 597522 - RNA, 64 nt, Homo Sapiens; identical to SEQ ID NO: 268754

SEQ ID NO: 597523 - RNA, 64 nt, Homo Sapiens; identical to SEQ ID NO: 268755

SEQ ID NO: 597524 - RNA, 64 nt, Homo Sapiens; identical to SEQ ID NO: 268756

SEQ ID NO: 597525 - RNA, 64 nt, Homo Sapiens; identical to SEQ ID NO: 268757

SEQ ID NO: 597526 - RNA, 64 nt, Homo Sapiens; identical to SEQ ID NO: 268758

SEQ ID NO: 597527 - RNA, 64 nt, Homo Sapiens; identical to SEQ ID NO: 268759

SEQ ID NO: 597528 - RNA, 64 nt, Homo Sapiens; identical to SEQ ID NO: 268760

SEQ ID NO: 597529 - RNA, 64 nt, Homo Sapiens; identical to SEQ ID NO: 268761

SEQ ID NO: 597530 - RNA, 64 nt, Homo Sapiens; identical to SEQ ID NO: 268762

SEQ ID NO: 597531 - RNA, 64 nt, Homo Sapiens; identical to SEQ ID NO: 268763

SEQ ID NO: 597532 - RNA, 64 nt, Homo Sapiens; identical to SEQ ID NO: 268764

SEQ ID NO: 597533 - RNA, 64 nt, Homo Sapiens; identical to SEQ ID NO: 268765

SEQ ID NO: 597534 - RNA, 64 nt, Homo Sapiens; identical to SEQ ID NO: 268766

SEQ ID NO: 597535 - RNA, 64 nt, Homo Sapiens; identical to SEQ ID NO: 268767

SEQ ID NO: 597536 - RNA, 64 nt, Homo Sapiens; identical to SEQ ID NO: 268768

SEQ ID NO: 597537 - RNA, 64 nt, Homo Sapiens; identical to SEQ ID NO: 268769

SEQ ID NO: 597538 - RNA, 64 nt, Homo Sapiens; identical to SEQ ID NO: 268770

SEQ ID NO: 597539 - RNA, 64 nt, Homo Sapiens; identical to SEQ ID NO: 268771

SEQ ID NO: 597540 - RNA, 64 nt, Homo Sapiens; identical to SEQ ID NO: 268772

SEQ ID NO: 597541 - RNA, 64 nt, Homo Sapiens; identical to SEQ ID NO: 268773

SEQ ID NO: 597542 - RNA, 64 nt, Homo Sapiens; identical to SEQ ID NO: 268774

SEQ ID NO: 597543 - RNA, 64 nt, Homo Sapiens; identical to SEQ ID NO: 268775

SEQ ID NO: 597544 - RNA, 64 nt, Homo Sapiens; identical to SEQ ID NO: 268776

SEQ ID NO: 597545 - RNA, 64 nt, Homo Sapiens; identical to SEQ ID NO: 268777

SEQ ID NO: 597546 - RNA, 64 nt, Homo Sapiens; identical to SEQ ID NO: 268778

SEQ ID NO: 597547 - RNA, 64 nt, Homo Sapiens; identical to SEQ ID NO: 268779

SEQ ID NO: 597548 - RNA, 64 nt, Homo Sapiens; identical to SEQ ID NO: 268780

SEQ ID NO: 597549 - RNA, 64 nt, Homo Sapiens; identical to SEQ ID NO: 268781

SEQ ID NO: 597550 - RNA, 64 nt, Homo Sapiens; identical to SEQ ID NO: 268782

SEQ ID NO: 597551 - RNA, 64 nt, Homo Sapiens; identical to SEQ ID NO: 268783

SEQ ID NO: 597552 - RNA, 64 nt, Homo Sapiens; identical to SEQ ID NO: 268784

SEQ ID NO: 597553 - RNA, 64 nt, Homo Sapiens; identical to SEQ ID NO: 268785

SEQ ID NO: 597554 - RNA, 64 nt, Homo Sapiens; identical to SEQ ID NO: 268786

SEQ ID NO: 597555 - RNA, 64 nt, Homo Sapiens; identical to SEQ ID NO: 268787

SEQ ID NO: 597556 - RNA, 64 nt, Homo Sapiens; identical to SEQ ID NO: 268788

SEQ ID NO: 597557 - RNA, 64 nt, Homo Sapiens; identical to SEQ ID NO: 268789

SEQ ID NO: 597558 - RNA, 64 nt, Homo Sapiens; identical to SEQ ID NO: 268790

SEQ ID NO: 597559 - RNA, 64 nt, Homo Sapiens; identical to SEQ ID NO: 268791

SEQ ID NO: 597560 - RNA, 64 nt, Homo Sapiens; identical to SEQ ID NO: 268792

SEQ ID NO: 597561 - RNA, 64 nt, Homo Sapiens; identical to SEQ ID NO: 268793

SEQ ID NO: 597562 - RNA, 64 nt, Homo Sapiens; identical to SEQ ID NO: 268794

SEQ ID NO: 597563 - RNA, 64 nt, Homo Sapiens; identical to SEQ ID NO: 268795

SEQ ID NO: 597564 - RNA, 64 nt, Homo Sapiens; identical to SEQ ID NO: 268796

SEQ ID NO: 597565 - RNA, 64 nt, Homo Sapiens; identical to SEQ ID NO: 268797

SEQ ID NO: 597566 - RNA, 64 nt, Homo Sapiens; identical to SEQ ID NO: 268798

SEQ ID NO: 597567 - RNA, 64 nt, Homo Sapiens; identical to SEQ ID NO: 268799

SEQ ID NO: 597568 - RNA, 64 nt, Homo Sapiens; identical to SEQ ID NO: 268800

SEQ ID NO: 597569 - RNA, 64 nt, Homo Sapiens; identical to SEQ ID NO: 268801

SEQ ID NO: 597570 - RNA, 64 nt, Homo Sapiens; identical to SEQ ID NO: 268802

SEQ ID NO: 597571 - RNA, 64 nt, Homo Sapiens; identical to SEQ ID NO: 268803

SEQ ID NO: 597572 - RNA, 64 nt, Homo Sapiens; identical to SEQ ID NO: 268804

SEQ ID NO: 597573 - RNA, 64 nt, Homo Sapiens; identical to SEQ ID NO: 268805

SEQ ID NO: 597574 - RNA, 64 nt, Homo Sapiens; identical to SEQ ID NO: 268806

SEQ ID NO: 597575 - RNA, 64 nt, Homo Sapiens; identical to SEQ ID NO: 268807

SEQ ID NO: 597576 - RNA, 64 nt, Homo Sapiens; identical to SEQ ID NO: 268808

SEQ ID NO: 597577 - RNA, 64 nt, Homo Sapiens; identical to SEQ ID NO: 268809

SEQ ID NO: 597578 - RNA, 64 nt, Homo Sapiens; identical to SEQ ID NO: 268810

SEQ ID NO: 597579 - RNA, 64 nt, Homo Sapiens; identical to SEQ ID NO: 268811

SEQ ID NO: 597580 - RNA, 64 nt, Homo Sapiens; identical to SEQ ID NO: 268812

SEQ ID NO: 597581 - RNA, 64 nt, Homo Sapiens; identical to SEQ ID NO: 268813

SEQ ID NO: 597582 - RNA, 64 nt, Homo Sapiens; identical to SEQ ID NO: 268814

SEQ ID NO: 597583 - RNA, 64 nt, Homo Sapiens; identical to SEQ ID NO: 268815

SEQ ID NO: 597584 - RNA, 64 nt, Homo Sapiens; identical to SEQ ID NO: 268816

SEQ ID NO: 597585 - RNA, 64 nt, Homo Sapiens; identical to SEQ ID NO: 268817

SEQ ID NO: 597586 - RNA, 64 nt, Homo Sapiens; identical to SEQ ID NO: 268818

SEQ ID NO: 597587 - RNA, 64 nt, Homo Sapiens; identical to SEQ ID NO: 268819

SEQ ID NO: 597588 - RNA, 64 nt, Homo Sapiens; identical to SEQ ID NO: 268820

SEQ ID NO: 597589 - RNA, 64 nt, Homo Sapiens; identical to SEQ ID NO: 268821

SEQ ID NO: 597590 - RNA, 64 nt, Homo Sapiens; identical to SEQ ID NO: 268822

SEQ ID NO: 597591 - RNA, 64 nt, Homo Sapiens; identical to SEQ ID NO: 268823

SEQ ID NO: 597592 - RNA, 64 nt, Homo Sapiens; identical to SEQ ID NO: 268824

SEQ ID NO: 597593 - RNA, 64 nt, Homo Sapiens; identical to SEQ ID NO: 268825

SEQ ID NO: 597594 - RNA, 64 nt, Homo Sapiens; identical to SEQ ID NO: 268826

SEQ ID NO: 597595 - RNA, 64 nt, Homo Sapiens; identical to SEQ ID NO: 268827

SEQ ID NO: 597596 - RNA, 64 nt, Homo Sapiens; identical to SEQ ID NO: 268828

SEQ ID NO: 597597 - RNA, 64 nt, Homo Sapiens; identical to SEQ ID NO: 268829

SEQ ID NO: 597598 - RNA, 64 nt, Homo Sapiens; identical to SEQ ID NO: 268830

SEQ ID NO: 597599 - RNA, 64 nt, Homo Sapiens; identical to SEQ ID NO: 268831

SEQ ID NO: 597600 - RNA, 64 nt, Homo Sapiens; identical to SEQ ID NO: 268832

SEQ ID NO: 597601 - RNA, 64 nt, Homo Sapiens; identical to SEQ ID NO: 268833

SEQ ID NO: 597602 - RNA, 64 nt, Homo Sapiens; identical to SEQ ID NO: 268834

SEQ ID NO: 597603 - RNA, 64 nt, Homo Sapiens; identical to SEQ ID NO: 268835

SEQ ID NO: 597604 - RNA, 64 nt, Homo Sapiens; identical to SEQ ID NO: 268836

SEQ ID NO: 597605 - RNA, 64 nt, Homo Sapiens; identical to SEQ ID NO: 268837

SEQ ID NO: 597606 - RNA, 64 nt, Homo Sapiens; identical to SEQ ID NO: 268838

SEQ ID NO: 597607 - RNA, 64 nt, Homo Sapiens; identical to SEQ ID NO: 268839

SEQ ID NO: 597608 - RNA, 64 nt, Homo Sapiens; identical to SEQ ID NO: 268840

SEQ ID NO: 597609 - RNA, 64 nt, Homo Sapiens; identical to SEQ ID NO: 268841

SEQ ID NO: 597610 - RNA, 64 nt, Homo Sapiens; identical to SEQ ID NO: 268842

SEQ ID NO: 597611 - RNA, 64 nt, Homo Sapiens; identical to SEQ ID NO: 268843

SEQ ID NO: 597612 - RNA, 64 nt, Homo Sapiens; identical to SEQ ID NO: 268844

SEQ ID NO: 597613 - RNA, 64 nt, Homo Sapiens; identical to SEQ ID NO: 268845

SEQ ID NO: 597614 - RNA, 64 nt, Homo Sapiens; identical to SEQ ID NO: 268846

SEQ ID NO: 597615 - RNA, 64 nt, Homo Sapiens; identical to SEQ ID NO: 268847

SEQ ID NO: 597616 - RNA, 64 nt, Homo Sapiens; identical to SEQ ID NO: 268848

SEQ ID NO: 597617 - RNA, 64 nt, Homo Sapiens; identical to SEQ ID NO: 268849

SEQ ID NO: 597618 - RNA, 64 nt, Homo Sapiens; identical to SEQ ID NO: 268457

SEQ ID NO: 597619 - RNA, 64 nt, Homo Sapiens; identical to SEQ ID NO: 268458

SEQ ID NO: 597620 - RNA, 64 nt, Homo Sapiens; identical to SEQ ID NO: 268852

SEQ ID NO: 597621 - RNA, 64 nt, Homo Sapiens; identical to SEQ ID NO: 268853

SEQ ID NO: 597622 - RNA, 64 nt, Homo Sapiens; identical to SEQ ID NO: 268854

SEQ ID NO: 597623 - RNA, 64 nt, Homo Sapiens; identical to SEQ ID NO: 268855

SEQ ID NO: 597624 - RNA, 64 nt, Homo Sapiens; identical to SEQ ID NO: 268856

SEQ ID NO: 597625 - RNA, 64 nt, Homo Sapiens; identical to SEQ ID NO: 268857

SEQ ID NO: 597626 - RNA, 64 nt, Homo Sapiens; identical to SEQ ID NO: 268858

SEQ ID NO: 597627 - RNA, 64 nt, Homo Sapiens; identical to SEQ ID NO: 268859

SEQ ID NO: 597628 - RNA, 64 nt, Homo Sapiens; identical to SEQ ID NO: 268860

SEQ ID NO: 597629 - RNA, 64 nt, Homo Sapiens; identical to SEQ ID NO: 268861

SEQ ID NO: 597630 - RNA, 64 nt, Homo Sapiens; identical to SEQ ID NO: 268862

SEQ ID NO: 597631 - RNA, 64 nt, Homo Sapiens; identical to SEQ ID NO: 268863

SEQ ID NO: 597632 - RNA, 64 nt, Homo Sapiens; identical to SEQ ID NO: 268864

SEQ ID NO: 597633 - RNA, 64 nt, Homo Sapiens; identical to SEQ ID NO: 268865

SEQ ID NO: 597634 - RNA, 64 nt, Homo Sapiens; identical to SEQ ID NO: 268866

SEQ ID NO: 597635 - RNA, 64 nt, Homo Sapiens; identical to SEQ ID NO: 268867

SEQ ID NO: 597636 - RNA, 64 nt, Homo Sapiens; identical to SEQ ID NO: 268868

SEQ ID NO: 597637 - RNA, 64 nt, Homo Sapiens; identical to SEQ ID NO: 268869

SEQ ID NO: 597638 - RNA, 64 nt, Homo Sapiens; identical to SEQ ID NO: 268870

SEQ ID NO: 597639 - RNA, 64 nt, Homo Sapiens; identical to SEQ ID NO: 268871

SEQ ID NO: 597640 - RNA, 64 nt, Homo Sapiens; identical to SEQ ID NO: 268872

SEQ ID NO: 597641 - RNA, 64 nt, Homo Sapiens; identical to SEQ ID NO: 268873

SEQ ID NO: 597642 - RNA, 64 nt, Homo Sapiens; identical to SEQ ID NO: 268874

SEQ ID NO: 597643 - RNA, 64 nt, Homo Sapiens; identical to SEQ ID NO: 268875

SEQ ID NO: 597644 - RNA, 64 nt, Homo Sapiens; identical to SEQ ID NO: 268876

SEQ ID NO: 597645 - RNA, 64 nt, Homo Sapiens; identical to SEQ ID NO: 268877

SEQ ID NO: 597646 - RNA, 64 nt, Homo Sapiens; identical to SEQ ID NO: 268878

SEQ ID NO: 597647 - RNA, 64 nt, Homo Sapiens; identical to SEQ ID NO: 268879

SEQ ID NO: 597648 - RNA, 64 nt, Homo Sapiens; identical to SEQ ID NO: 268880

SEQ ID NO: 597649 - RNA, 64 nt, Homo Sapiens; identical to SEQ ID NO: 268881

SEQ ID NO: 597650 - RNA, 64 nt, Homo Sapiens; identical to SEQ ID NO: 268882

SEQ ID NO: 597651 - RNA, 64 nt, Homo Sapiens; identical to SEQ ID NO: 268883

SEQ ID NO: 597652 - RNA, 64 nt, Homo Sapiens; identical to SEQ ID NO: 268884

SEQ ID NO: 597653 - RNA, 64 nt, Homo Sapiens; identical to SEQ ID NO: 268885

SEQ ID NO: 597654 - RNA, 64 nt, Homo Sapiens; identical to SEQ ID NO: 268886

SEQ ID NO: 597655 - RNA, 64 nt, Homo Sapiens; identical to SEQ ID NO: 268887

SEQ ID NO: 597656 - RNA, 64 nt, Homo Sapiens; identical to SEQ ID NO: 268888

SEQ ID NO: 597657 - RNA, 64 nt, Homo Sapiens; identical to SEQ ID NO: 268889

SEQ ID NO: 597658 - RNA, 64 nt, Homo Sapiens; identical to SEQ ID NO: 268890

SEQ ID NO: 597659 - RNA, 64 nt, Homo Sapiens; identical to SEQ ID NO: 268891

SEQ ID NO: 597660 - RNA, 64 nt, Homo Sapiens; identical to SEQ ID NO: 268892

SEQ ID NO: 597661 - RNA, 64 nt, Homo Sapiens; identical to SEQ ID NO: 268893

SEQ ID NO: 597662 - RNA, 64 nt, Homo Sapiens; identical to SEQ ID NO: 268894

SEQ ID NO: 597663 - RNA, 64 nt, Homo Sapiens; identical to SEQ ID NO: 268895

SEQ ID NO: 597664 - RNA, 64 nt, Homo Sapiens; identical to SEQ ID NO: 268896

SEQ ID NO: 597665 - RNA, 64 nt, Homo Sapiens; identical to SEQ ID NO: 268897

SEQ ID NO: 597666 - RNA, 64 nt, Homo Sapiens; identical to SEQ ID NO: 268898

SEQ ID NO: 597667 - RNA, 64 nt, Homo Sapiens; identical to SEQ ID NO: 268899

SEQ ID NO: 597668 - RNA, 64 nt, Homo Sapiens; identical to SEQ ID NO: 268900

SEQ ID NO: 597669 - RNA, 64 nt, Homo Sapiens; identical to SEQ ID NO: 268901

SEQ ID NO: 597670 - RNA, 64 nt, Homo Sapiens; identical to SEQ ID NO: 268902

SEQ ID NO: 597671 - RNA, 64 nt, Homo Sapiens; identical to SEQ ID NO: 268903

SEQ ID NO: 597672 - RNA, 64 nt, Homo Sapiens; identical to SEQ ID NO: 268904

SEQ ID NO: 597673 - RNA, 64 nt, Homo Sapiens; identical to SEQ ID NO: 268905

SEQ ID NO: 597674 - RNA, 64 nt, Homo Sapiens; identical to SEQ ID NO: 268906

SEQ ID NO: 597675 - RNA, 64 nt, Homo Sapiens; identical to SEQ ID NO: 268907

SEQ ID NO: 597676 - RNA, 64 nt, Homo Sapiens; identical to SEQ ID NO: 268908

SEQ ID NO: 597677 - RNA, 64 nt, Homo Sapiens; identical to SEQ ID NO: 268909

SEQ ID NO: 597678 - RNA, 64 nt, Homo Sapiens; identical to SEQ ID NO: 268910

SEQ ID NO: 597679 - RNA, 64 nt, Homo Sapiens; identical to SEQ ID NO: 268911

SEQ ID NO: 597680 - RNA, 64 nt, Homo Sapiens; identical to SEQ ID NO: 268912

SEQ ID NO: 597681 - RNA, 64 nt, Homo Sapiens; identical to SEQ ID NO: 268913

SEQ ID NO: 597682 - RNA, 64 nt, Homo Sapiens; identical to SEQ ID NO: 268914

SEQ ID NO: 597683 - RNA, 64 nt, Homo Sapiens; identical to SEQ ID NO: 268915

SEQ ID NO: 597684 - RNA, 64 nt, Homo Sapiens; identical to SEQ ID NO: 268916

SEQ ID NO: 597685 - RNA, 64 nt, Homo Sapiens; identical to SEQ ID NO: 268917

SEQ ID NO: 597686 - RNA, 64 nt, Homo Sapiens; identical to SEQ ID NO: 268918

SEQ ID NO: 597687 - RNA, 64 nt, Homo Sapiens; identical to SEQ ID NO: 268919

SEQ ID NO: 597688 - RNA, 64 nt, Homo Sapiens; identical to SEQ ID NO: 268920

SEQ ID NO: 597689 - RNA, 64 nt, Homo Sapiens; identical to SEQ ID NO: 268921

SEQ ID NO: 597690 - RNA, 64 nt, Homo Sapiens; identical to SEQ ID NO: 268922

SEQ ID NO: 597691 - RNA, 64 nt, Homo Sapiens; identical to SEQ ID NO: 268923

SEQ ID NO: 597692 - RNA, 64 nt, Homo Sapiens; identical to SEQ ID NO: 268924

SEQ ID NO: 597693 - RNA, 64 nt, Homo Sapiens; identical to SEQ ID NO: 268925

SEQ ID NO: 597694 - RNA, 64 nt, Homo Sapiens; identical to SEQ ID NO: 268926

SEQ ID NO: 597695 - RNA, 64 nt, Homo Sapiens; identical to SEQ ID NO: 268927

SEQ ID NO: 597696 - RNA, 64 nt, Homo Sapiens; identical to SEQ ID NO: 268928

SEQ ID NO: 597697 - RNA, 64 nt, Homo Sapiens; identical to SEQ ID NO: 268929

SEQ ID NO: 597698 - RNA, 64 nt, Homo Sapiens; identical to SEQ ID NO: 268930

SEQ ID NO: 597699 - RNA, 64 nt, Homo Sapiens; identical to SEQ ID NO: 268931

SEQ ID NO: 597700 - RNA, 64 nt, Homo Sapiens; identical to SEQ ID NO: 268932

SEQ ID NO: 597701 - RNA, 64 nt, Homo Sapiens; identical to SEQ ID NO: 268933

SEQ ID NO: 597702 - RNA, 64 nt, Homo Sapiens; identical to SEQ ID NO: 268934

SEQ ID NO: 597703 - RNA, 64 nt, Homo Sapiens; identical to SEQ ID NO: 268935

SEQ ID NO: 597704 - RNA, 64 nt, Homo Sapiens; identical to SEQ ID NO: 268936

SEQ ID NO: 597705 - RNA, 64 nt, Homo Sapiens; identical to SEQ ID NO: 268937

SEQ ID NO: 597706 - RNA, 64 nt, Homo Sapiens; identical to SEQ ID NO: 268938

SEQ ID NO: 597707 - RNA, 64 nt, Homo Sapiens; identical to SEQ ID NO: 268939

SEQ ID NO: 597708 - RNA, 64 nt, Homo Sapiens; identical to SEQ ID NO: 268940

SEQ ID NO: 597709 - RNA, 64 nt, Homo Sapiens; identical to SEQ ID NO: 268941

SEQ ID NO: 597710 - RNA, 64 nt, Homo Sapiens; identical to SEQ ID NO: 268942

SEQ ID NO: 597711 - RNA, 64 nt, Homo Sapiens; identical to SEQ ID NO: 268943

SEQ ID NO: 597712 - RNA, 64 nt, Homo Sapiens; identical to SEQ ID NO: 268944

SEQ ID NO: 597713 - RNA, 64 nt, Homo Sapiens; identical to SEQ ID NO: 268945

SEQ ID NO: 597714 - RNA, 64 nt, Homo Sapiens; identical to SEQ ID NO: 268946

SEQ ID NO: 597715 - RNA, 64 nt, Homo Sapiens; identical to SEQ ID NO: 268947

SEQ ID NO: 597716 - RNA, 64 nt, Homo Sapiens; identical to SEQ ID NO: 268948

SEQ ID NO: 597717 - RNA, 64 nt, Homo Sapiens; identical to SEQ ID NO: 268949

SEQ ID NO: 597718 - RNA, 64 nt, Homo Sapiens; identical to SEQ ID NO: 268950

SEQ ID NO: 597719 - RNA, 64 nt, Homo Sapiens; identical to SEQ ID NO: 268951

SEQ ID NO: 597720 - RNA, 64 nt, Homo Sapiens; identical to SEQ ID NO: 268952

SEQ ID NO: 597721 - RNA, 64 nt, Homo Sapiens; identical to SEQ ID NO: 268953

SEQ ID NO: 597722 - RNA, 64 nt, Homo Sapiens; identical to SEQ ID NO: 268954

SEQ ID NO: 597723 - RNA, 64 nt, Homo Sapiens; identical to SEQ ID NO: 268955

SEQ ID NO: 597724 - RNA, 64 nt, Homo Sapiens; identical to SEQ ID NO: 268956

SEQ ID NO: 597725 - RNA, 64 nt, Homo Sapiens; identical to SEQ ID NO: 268957

SEQ ID NO: 597726 - RNA, 64 nt, Homo Sapiens; identical to SEQ ID NO: 268958

SEQ ID NO: 597727 - RNA, 64 nt, Homo Sapiens; identical to SEQ ID NO: 268959

SEQ ID NO: 597728 - RNA, 64 nt, Homo Sapiens; identical to SEQ ID NO: 268960

SEQ ID NO: 597729 - RNA, 64 nt, Homo Sapiens; identical to SEQ ID NO: 268961

SEQ ID NO: 597730 - RNA, 64 nt, Homo Sapiens; identical to SEQ ID NO: 268962

SEQ ID NO: 597731 - RNA, 64 nt, Homo Sapiens; identical to SEQ ID NO: 268963

SEQ ID NO: 597732 - RNA, 64 nt, Homo Sapiens; identical to SEQ ID NO: 268964

SEQ ID NO: 597733 - RNA, 64 nt, Homo Sapiens; identical to SEQ ID NO: 268965

SEQ ID NO: 597734 - RNA, 64 nt, Homo Sapiens; identical to SEQ ID NO: 268966

SEQ ID NO: 597735 - RNA, 64 nt, Homo Sapiens; identical to SEQ ID NO: 268967

SEQ ID NO: 597736 - RNA, 64 nt, Homo Sapiens; identical to SEQ ID NO: 268968

SEQ ID NO: 597737 - RNA, 64 nt, Homo Sapiens; identical to SEQ ID NO: 268969

SEQ ID NO: 597738 - RNA, 64 nt, Homo Sapiens; identical to SEQ ID NO: 268970

SEQ ID NO: 597739 - RNA, 64 nt, Homo Sapiens; identical to SEQ ID NO: 268971

SEQ ID NO: 597740 - RNA, 64 nt, Homo Sapiens; identical to SEQ ID NO: 268972

SEQ ID NO: 597741 - RNA, 64 nt, Homo Sapiens; identical to SEQ ID NO: 268973

SEQ ID NO: 597742 - RNA, 64 nt, Homo Sapiens; identical to SEQ ID NO: 268974

SEQ ID NO: 597743 - RNA, 64 nt, Homo Sapiens; identical to SEQ ID NO: 268975

SEQ ID NO: 597744 - RNA, 64 nt, Homo Sapiens; identical to SEQ ID NO: 268976

SEQ ID NO: 597745 - RNA, 64 nt, Homo Sapiens; identical to SEQ ID NO: 268977

SEQ ID NO: 597746 - RNA, 64 nt, Homo Sapiens; identical to SEQ ID NO: 268978

SEQ ID NO: 597747 - RNA, 64 nt, Homo Sapiens; identical to SEQ ID NO: 268979

SEQ ID NO: 597748 - RNA, 64 nt, Homo Sapiens; identical to SEQ ID NO: 268980

SEQ ID NO: 597749 - RNA, 64 nt, Homo Sapiens; identical to SEQ ID NO: 268981

SEQ ID NO: 597750 - RNA, 64 nt, Homo Sapiens; identical to SEQ ID NO: 268982

SEQ ID NO: 597751 - RNA, 64 nt, Homo Sapiens; identical to SEQ ID NO: 268983

SEQ ID NO: 597752 - RNA, 64 nt, Homo Sapiens; identical to SEQ ID NO: 268984

SEQ ID NO: 597753 - RNA, 64 nt, Homo Sapiens; identical to SEQ ID NO: 268985

SEQ ID NO: 597754 - RNA, 64 nt, Homo Sapiens; identical to SEQ ID NO: 268986

SEQ ID NO: 597755 - RNA, 64 nt, Homo Sapiens; identical to SEQ ID NO: 268987

SEQ ID NO: 597756 - RNA, 64 nt, Homo Sapiens; identical to SEQ ID NO: 268988

SEQ ID NO: 597757 - RNA, 64 nt, Homo Sapiens; identical to SEQ ID NO: 268989

SEQ ID NO: 597758 - RNA, 64 nt, Homo Sapiens; identical to SEQ ID NO: 268990

SEQ ID NO: 597759 - RNA, 64 nt, Homo Sapiens; identical to SEQ ID NO: 268991

SEQ ID NO: 597760 - RNA, 64 nt, Homo Sapiens; identical to SEQ ID NO: 268992

SEQ ID NO: 597761 - RNA, 64 nt, Homo Sapiens; identical to SEQ ID NO: 268993

SEQ ID NO: 597762 - RNA, 64 nt, Homo Sapiens; identical to SEQ ID NO: 268994

SEQ ID NO: 597763 - RNA, 64 nt, Homo Sapiens; identical to SEQ ID NO: 268995

SEQ ID NO: 597764 - RNA, 64 nt, Homo Sapiens; identical to SEQ ID NO: 268996

SEQ ID NO: 597765 - RNA, 64 nt, Homo Sapiens; identical to SEQ ID NO: 268997

SEQ ID NO: 597766 - RNA, 64 nt, Homo Sapiens; identical to SEQ ID NO: 268998

SEQ ID NO: 597767 - RNA, 64 nt, Homo Sapiens; identical to SEQ ID NO: 268999

SEQ ID NO: 597768 - RNA, 64 nt, Homo Sapiens; identical to SEQ ID NO: 269000

SEQ ID NO: 597769 - RNA, 64 nt, Homo Sapiens; identical to SEQ ID NO: 269001

SEQ ID NO: 597770 - RNA, 64 nt, Homo Sapiens; identical to SEQ ID NO: 269002

SEQ ID NO: 597771 - RNA, 64 nt, Homo Sapiens; identical to SEQ ID NO: 269003

SEQ ID NO: 597772 - RNA, 64 nt, Homo Sapiens; identical to SEQ ID NO: 269004

SEQ ID NO: 597773 - RNA, 64 nt, Homo Sapiens; identical to SEQ ID NO: 269005

SEQ ID NO: 597774 - RNA, 64 nt, Homo Sapiens; identical to SEQ ID NO: 269006

SEQ ID NO: 597775 - RNA, 64 nt, Homo Sapiens; identical to SEQ ID NO: 269007

SEQ ID NO: 597776 - RNA, 64 nt, Homo Sapiens; identical to SEQ ID NO: 269008

SEQ ID NO: 597777 - RNA, 64 nt, Homo Sapiens; identical to SEQ ID NO: 269009

SEQ ID NO: 597778 - RNA, 64 nt, Homo Sapiens; identical to SEQ ID NO: 269010

SEQ ID NO: 597779 - RNA, 64 nt, Homo Sapiens; identical to SEQ ID NO: 269011

SEQ ID NO: 597780 - RNA, 64 nt, Homo Sapiens; identical to SEQ ID NO: 269012

SEQ ID NO: 597781 - RNA, 64 nt, Homo Sapiens; identical to SEQ ID NO: 269013

SEQ ID NO: 597782 - RNA, 64 nt, Homo Sapiens; identical to SEQ ID NO: 269014

SEQ ID NO: 597783 - RNA, 64 nt, Homo Sapiens; identical to SEQ ID NO: 269015

SEQ ID NO: 597784 - RNA, 64 nt, Homo Sapiens; identical to SEQ ID NO: 269016

SEQ ID NO: 597785 - RNA, 64 nt, Homo Sapiens; identical to SEQ ID NO: 269017

SEQ ID NO: 597786 - RNA, 64 nt, Homo Sapiens; identical to SEQ ID NO: 269018

SEQ ID NO: 597787 - RNA, 64 nt, Homo Sapiens; identical to SEQ ID NO: 269019

SEQ ID NO: 597788 - RNA, 64 nt, Homo Sapiens; identical to SEQ ID NO: 269020

SEQ ID NO: 597789 - RNA, 64 nt, Homo Sapiens; identical to SEQ ID NO: 269021

SEQ ID NO: 597790 - RNA, 64 nt, Homo Sapiens; identical to SEQ ID NO: 269022

SEQ ID NO: 597791 - RNA, 64 nt, Homo Sapiens; identical to SEQ ID NO: 269023

SEQ ID NO: 597792 - RNA, 64 nt, Homo Sapiens; identical to SEQ ID NO: 269024

SEQ ID NO: 597793 - RNA, 64 nt, Homo Sapiens; identical to SEQ ID NO: 269025

SEQ ID NO: 597794 - RNA, 64 nt, Homo Sapiens; identical to SEQ ID NO: 269026

SEQ ID NO: 597795 - RNA, 64 nt, Homo Sapiens; identical to SEQ ID NO: 269027

SEQ ID NO: 597796 - RNA, 64 nt, Homo Sapiens; identical to SEQ ID NO: 269028

SEQ ID NO: 597797 - RNA, 64 nt, Homo Sapiens; identical to SEQ ID NO: 269029

SEQ ID NO: 597798 - RNA, 64 nt, Homo Sapiens; identical to SEQ ID NO: 269030

SEQ ID NO: 597799 - RNA, 64 nt, Homo Sapiens; identical to SEQ ID NO: 269031

SEQ ID NO: 597800 - RNA, 64 nt, Homo Sapiens; identical to SEQ ID NO: 269032

SEQ ID NO: 597801 - RNA, 64 nt, Homo Sapiens; identical to SEQ ID NO: 269033

SEQ ID NO: 597802 - RNA, 64 nt, Homo Sapiens; identical to SEQ ID NO: 269034

SEQ ID NO: 597803 - RNA, 64 nt, Homo Sapiens; identical to SEQ ID NO: 269035

SEQ ID NO: 597804 - RNA, 64 nt, Homo Sapiens; identical to SEQ ID NO: 269036

SEQ ID NO: 597805 - RNA, 64 nt, Homo Sapiens; identical to SEQ ID NO: 269037

SEQ ID NO: 597806 - RNA, 64 nt, Homo Sapiens; identical to SEQ ID NO: 269038

SEQ ID NO: 597807 - RNA, 64 nt, Homo Sapiens; identical to SEQ ID NO: 269039

SEQ ID NO: 597808 - RNA, 64 nt, Homo Sapiens; identical to SEQ ID NO: 269040

SEQ ID NO: 597809 - RNA, 64 nt, Homo Sapiens; identical to SEQ ID NO: 269041

SEQ ID NO: 597810 - RNA, 64 nt, Homo Sapiens; identical to SEQ ID NO: 269042

SEQ ID NO: 597811 - RNA, 64 nt, Homo Sapiens; identical to SEQ ID NO: 269043

SEQ ID NO: 597812 - RNA, 64 nt, Homo Sapiens; identical to SEQ ID NO: 269044

SEQ ID NO: 597813 - RNA, 64 nt, Homo Sapiens; identical to SEQ ID NO: 269045

SEQ ID NO: 597814 - RNA, 64 nt, Homo Sapiens; identical to SEQ ID NO: 269046

SEQ ID NO: 597815 - RNA, 64 nt, Homo Sapiens; identical to SEQ ID NO: 269047

SEQ ID NO: 597816 - RNA, 64 nt, Homo Sapiens; identical to SEQ ID NO: 269048

SEQ ID NO: 597817 - RNA, 64 nt, Homo Sapiens; identical to SEQ ID NO: 269049

SEQ ID NO: 597818 - RNA, 64 nt, Homo Sapiens; identical to SEQ ID NO: 269050

SEQ ID NO: 597819 - RNA, 64 nt, Homo Sapiens; identical to SEQ ID NO: 269051

SEQ ID NO: 597820 - RNA, 64 nt, Homo Sapiens; identical to SEQ ID NO: 269052

SEQ ID NO: 597821 - RNA, 64 nt, Homo Sapiens; identical to SEQ ID NO: 269053

SEQ ID NO: 597822 - RNA, 64 nt, Homo Sapiens; identical to SEQ ID NO: 269054

SEQ ID NO: 597823 - RNA, 64 nt, Homo Sapiens; identical to SEQ ID NO: 269055

SEQ ID NO: 597824 - RNA, 64 nt, Homo Sapiens; identical to SEQ ID NO: 269056

SEQ ID NO: 597825 - RNA, 64 nt, Homo Sapiens; identical to SEQ ID NO: 269057

SEQ ID NO: 597826 - RNA, 64 nt, Homo Sapiens; identical to SEQ ID NO: 269058

SEQ ID NO: 597827 - RNA, 64 nt, Homo Sapiens; identical to SEQ ID NO: 269059

SEQ ID NO: 597828 - RNA, 64 nt, Homo Sapiens; identical to SEQ ID NO: 269060

SEQ ID NO: 597829 - RNA, 64 nt, Homo Sapiens; identical to SEQ ID NO: 269061

SEQ ID NO: 597830 - RNA, 64 nt, Homo Sapiens; identical to SEQ ID NO: 269062

SEQ ID NO: 597831 - RNA, 64 nt, Homo Sapiens; identical to SEQ ID NO: 269063

SEQ ID NO: 597832 - RNA, 64 nt, Homo Sapiens; identical to SEQ ID NO: 269064

SEQ ID NO: 597833 - RNA, 64 nt, Homo Sapiens; identical to SEQ ID NO: 269065

SEQ ID NO: 597834 - RNA, 64 nt, Homo Sapiens; identical to SEQ ID NO: 269066

SEQ ID NO: 597835 - RNA, 64 nt, Homo Sapiens; identical to SEQ ID NO: 269067

SEQ ID NO: 597836 - RNA, 64 nt, Homo Sapiens; identical to SEQ ID NO: 269068

SEQ ID NO: 597837 - RNA, 64 nt, Homo Sapiens; identical to SEQ ID NO: 269069

SEQ ID NO: 597838 - RNA, 64 nt, Homo Sapiens; identical to SEQ ID NO: 269070

SEQ ID NO: 597839 - RNA, 64 nt, Homo Sapiens; identical to SEQ ID NO: 269071

SEQ ID NO: 597840 - RNA, 64 nt, Homo Sapiens; identical to SEQ ID NO: 269072

SEQ ID NO: 597841 - RNA, 64 nt, Homo Sapiens; identical to SEQ ID NO: 269073

SEQ ID NO: 597842 - RNA, 64 nt, Homo Sapiens; identical to SEQ ID NO: 269074

SEQ ID NO: 597843 - RNA, 64 nt, Homo Sapiens; identical to SEQ ID NO: 269075

SEQ ID NO: 597844 - RNA, 64 nt, Homo Sapiens; identical to SEQ ID NO: 269076

SEQ ID NO: 597845 - RNA, 64 nt, Homo Sapiens; identical to SEQ ID NO: 269077

SEQ ID NO: 597846 - RNA, 64 nt, Homo Sapiens; identical to SEQ ID NO: 269078

SEQ ID NO: 597847 - RNA, 64 nt, Homo Sapiens; identical to SEQ ID NO: 269079

SEQ ID NO: 597848 - RNA, 64 nt, Homo Sapiens; identical to SEQ ID NO: 269080

SEQ ID NO: 597849 - RNA, 64 nt, Homo Sapiens; identical to SEQ ID NO: 269081

SEQ ID NO: 597850 - RNA, 64 nt, Homo Sapiens; identical to SEQ ID NO: 269082

SEQ ID NO: 597851 - RNA, 64 nt, Homo Sapiens; identical to SEQ ID NO: 269083

SEQ ID NO: 597852 - RNA, 64 nt, Homo Sapiens; identical to SEQ ID NO: 269084

SEQ ID NO: 597853 - RNA, 64 nt, Homo Sapiens; identical to SEQ ID NO: 269085

SEQ ID NO: 597854 - RNA, 64 nt, Homo Sapiens; identical to SEQ ID NO: 269086

SEQ ID NO: 597855 - RNA, 64 nt, Homo Sapiens; identical to SEQ ID NO: 269087

SEQ ID NO: 597856 - RNA, 64 nt, Homo Sapiens; identical to SEQ ID NO: 269088

SEQ ID NO: 597857 - RNA, 64 nt, Homo Sapiens; identical to SEQ ID NO: 269089

SEQ ID NO: 597858 - RNA, 64 nt, Homo Sapiens; identical to SEQ ID NO: 269090

SEQ ID NO: 597859 - RNA, 64 nt, Homo Sapiens; identical to SEQ ID NO: 269091

SEQ ID NO: 597860 - RNA, 64 nt, Homo Sapiens; identical to SEQ ID NO: 269092

SEQ ID NO: 597861 - RNA, 64 nt, Homo Sapiens; identical to SEQ ID NO: 269093

SEQ ID NO: 597862 - RNA, 64 nt, Homo Sapiens; identical to SEQ ID NO: 269094

SEQ ID NO: 597863 - RNA, 64 nt, Homo Sapiens; identical to SEQ ID NO: 269095

SEQ ID NO: 597864 - RNA, 64 nt, Homo Sapiens; identical to SEQ ID NO: 269096

SEQ ID NO: 597865 - RNA, 64 nt, Homo Sapiens; identical to SEQ ID NO: 269097

SEQ ID NO: 597866 - RNA, 64 nt, Homo Sapiens; identical to SEQ ID NO: 269098

SEQ ID NO: 597867 - RNA, 64 nt, Homo Sapiens; identical to SEQ ID NO: 269099

SEQ ID NO: 597868 - RNA, 64 nt, Homo Sapiens; identical to SEQ ID NO: 269100

SEQ ID NO: 597869 - RNA, 64 nt, Homo Sapiens; identical to SEQ ID NO: 269101

SEQ ID NO: 597870 - RNA, 64 nt, Homo Sapiens; identical to SEQ ID NO: 269102

SEQ ID NO: 597871 - RNA, 64 nt, Homo Sapiens; identical to SEQ ID NO: 269103

SEQ ID NO: 597872 - RNA, 55 nt, Homo Sapiens; identical to SEQ ID NO: 269104

SEQ ID NO: 597873 - RNA, 64 nt, Homo Sapiens; identical to SEQ ID NO: 269105

SEQ ID NO: 597874 - RNA, 64 nt, Homo Sapiens; identical to SEQ ID NO: 269106

SEQ ID NO: 597875 - RNA, 64 nt, Homo Sapiens; identical to SEQ ID NO: 269107

SEQ ID NO: 597876 - RNA, 64 nt, Homo Sapiens; identical to SEQ ID NO: 269108

SEQ ID NO: 597877 - RNA, 64 nt, Homo Sapiens; identical to SEQ ID NO: 269109

SEQ ID NO: 597878 - RNA, 64 nt, Homo Sapiens; identical to SEQ ID NO: 269110

SEQ ID NO: 597879 - RNA, 64 nt, Homo Sapiens; identical to SEQ ID NO: 269111

SEQ ID NO: 597880 - RNA, 64 nt, Homo Sapiens; identical to SEQ ID NO: 269112

SEQ ID NO: 597881 - RNA, 64 nt, Homo Sapiens; identical to SEQ ID NO: 269113

SEQ ID NO: 597882 - RNA, 64 nt, Homo Sapiens; identical to SEQ ID NO: 269114

SEQ ID NO: 597883 - RNA, 64 nt, Homo Sapiens; identical to SEQ ID NO: 269115

SEQ ID NO: 597884 - RNA, 64 nt, Homo Sapiens; identical to SEQ ID NO: 269116

SEQ ID NO: 597885 - RNA, 64 nt, Homo Sapiens; identical to SEQ ID NO: 269117

SEQ ID NO: 597886 - RNA, 64 nt, Homo Sapiens; identical to SEQ ID NO: 269118

SEQ ID NO: 597887 - RNA, 64 nt, Homo Sapiens; identical to SEQ ID NO: 269119

SEQ ID NO: 597888 - RNA, 64 nt, Homo Sapiens; identical to SEQ ID NO: 269120

SEQ ID NO: 597889 - RNA, 64 nt, Homo Sapiens; identical to SEQ ID NO: 269121

SEQ ID NO: 597890 - RNA, 64 nt, Homo Sapiens; identical to SEQ ID NO: 269122

SEQ ID NO: 597891 - RNA, 64 nt, Homo Sapiens; identical to SEQ ID NO: 269123

SEQ ID NO: 597892 - RNA, 64 nt, Homo Sapiens; identical to SEQ ID NO: 269124

SEQ ID NO: 597893 - RNA, 64 nt, Homo Sapiens; identical to SEQ ID NO: 269125

SEQ ID NO: 597894 - RNA, 64 nt, Homo Sapiens; identical to SEQ ID NO: 269126

SEQ ID NO: 597895 - RNA, 64 nt, Homo Sapiens; identical to SEQ ID NO: 269127

SEQ ID NO: 597896 - RNA, 64 nt, Homo Sapiens; identical to SEQ ID NO: 269128

SEQ ID NO: 597897 - RNA, 64 nt, Homo Sapiens; identical to SEQ ID NO: 269129

SEQ ID NO: 597898 - RNA, 64 nt, Homo Sapiens; identical to SEQ ID NO: 269130

SEQ ID NO: 597899 - RNA, 64 nt, Homo Sapiens; identical to SEQ ID NO: 269131

SEQ ID NO: 597900 - RNA, 64 nt, Homo Sapiens; identical to SEQ ID NO: 269132

SEQ ID NO: 597901 - RNA, 64 nt, Homo Sapiens; identical to SEQ ID NO: 269133

SEQ ID NO: 597902 - RNA, 64 nt, Homo Sapiens; identical to SEQ ID NO: 269134

SEQ ID NO: 597903 - RNA, 64 nt, Homo Sapiens; identical to SEQ ID NO: 269135

SEQ ID NO: 597904 - RNA, 64 nt, Homo Sapiens; identical to SEQ ID NO: 269136

SEQ ID NO: 597905 - RNA, 64 nt, Homo Sapiens; identical to SEQ ID NO: 269137

SEQ ID NO: 597906 - RNA, 64 nt, Homo Sapiens; identical to SEQ ID NO: 269138

SEQ ID NO: 597907 - RNA, 64 nt, Homo Sapiens; identical to SEQ ID NO: 269139

SEQ ID NO: 597908 - RNA, 64 nt, Homo Sapiens; identical to SEQ ID NO: 269140

SEQ ID NO: 597909 - RNA, 64 nt, Homo Sapiens; identical to SEQ ID NO: 269141

SEQ ID NO: 597910 - RNA, 64 nt, Homo Sapiens; identical to SEQ ID NO: 269142

SEQ ID NO: 597911 - RNA, 64 nt, Homo Sapiens; identical to SEQ ID NO: 269143

SEQ ID NO: 597912 - RNA, 64 nt, Homo Sapiens; identical to SEQ ID NO: 269144

SEQ ID NO: 597913 - RNA, 64 nt, Homo Sapiens; identical to SEQ ID NO: 269145

SEQ ID NO: 597914 - RNA, 64 nt, Homo Sapiens; identical to SEQ ID NO: 269146

SEQ ID NO: 597915 - RNA, 64 nt, Homo Sapiens; identical to SEQ ID NO: 269147

SEQ ID NO: 597916 - RNA, 64 nt, Homo Sapiens; identical to SEQ ID NO: 269148

SEQ ID NO: 597917 - RNA, 64 nt, Homo Sapiens; identical to SEQ ID NO: 269149

SEQ ID NO: 597918 - RNA, 64 nt, Homo Sapiens; identical to SEQ ID NO: 269150

SEQ ID NO: 597919 - RNA, 64 nt, Homo Sapiens; identical to SEQ ID NO: 269151

SEQ ID NO: 597920 - RNA, 64 nt, Homo Sapiens; identical to SEQ ID NO: 269152

SEQ ID NO: 597921 - RNA, 64 nt, Homo Sapiens; identical to SEQ ID NO: 269153

SEQ ID NO: 597922 - RNA, 64 nt, Homo Sapiens; identical to SEQ ID NO: 269154

SEQ ID NO: 597923 - RNA, 64 nt, Homo Sapiens; identical to SEQ ID NO: 269155

SEQ ID NO: 597924 - RNA, 64 nt, Homo Sapiens; identical to SEQ ID NO: 269156

SEQ ID NO: 597925 - RNA, 64 nt, Homo Sapiens; identical to SEQ ID NO: 269157

SEQ ID NO: 597926 - RNA, 64 nt, Homo Sapiens; identical to SEQ ID NO: 269158

SEQ ID NO: 597927 - RNA, 64 nt, Homo Sapiens; identical to SEQ ID NO: 269159

SEQ ID NO: 597928 - RNA, 64 nt, Homo Sapiens; identical to SEQ ID NO: 269160

SEQ ID NO: 597929 - RNA, 64 nt, Homo Sapiens; identical to SEQ ID NO: 269161

SEQ ID NO: 597930 - RNA, 64 nt, Homo Sapiens; identical to SEQ ID NO: 269162

SEQ ID NO: 597931 - RNA, 64 nt, Homo Sapiens; identical to SEQ ID NO: 269163

SEQ ID NO: 597932 - RNA, 64 nt, Homo Sapiens; identical to SEQ ID NO: 269164

SEQ ID NO: 597933 - RNA, 64 nt, Homo Sapiens; identical to SEQ ID NO: 269165

SEQ ID NO: 597934 - RNA, 64 nt, Homo Sapiens; identical to SEQ ID NO: 269166

SEQ ID NO: 597935 - RNA, 64 nt, Homo Sapiens; identical to SEQ ID NO: 269167

SEQ ID NO: 597936 - RNA, 64 nt, Homo Sapiens; identical to SEQ ID NO: 269168

SEQ ID NO: 597937 - RNA, 64 nt, Homo Sapiens; identical to SEQ ID NO: 269169

SEQ ID NO: 597938 - RNA, 64 nt, Homo Sapiens; identical to SEQ ID NO: 269170

SEQ ID NO: 597939 - RNA, 64 nt, Homo Sapiens; identical to SEQ ID NO: 269171

SEQ ID NO: 597940 - RNA, 64 nt, Homo Sapiens; identical to SEQ ID NO: 269172

SEQ ID NO: 597941 - RNA, 64 nt, Homo Sapiens; identical to SEQ ID NO: 269173

SEQ ID NO: 597942 - RNA, 64 nt, Homo Sapiens; identical to SEQ ID NO: 269174

SEQ ID NO: 597943 - RNA, 64 nt, Homo Sapiens; identical to SEQ ID NO: 269175

SEQ ID NO: 597944 - RNA, 64 nt, Homo Sapiens; identical to SEQ ID NO: 269176

SEQ ID NO: 597945 - RNA, 64 nt, Homo Sapiens; identical to SEQ ID NO: 269177

SEQ ID NO: 597946 - RNA, 64 nt, Homo Sapiens; identical to SEQ ID NO: 269178

SEQ ID NO: 597947 - RNA, 64 nt, Homo Sapiens; identical to SEQ ID NO: 269179

SEQ ID NO: 597948 - RNA, 64 nt, Homo Sapiens; identical to SEQ ID NO: 269180

SEQ ID NO: 597949 - RNA, 64 nt, Homo Sapiens; identical to SEQ ID NO: 269181

SEQ ID NO: 597950 - RNA, 64 nt, Homo Sapiens; identical to SEQ ID NO: 269182

SEQ ID NO: 597951 - RNA, 64 nt, Homo Sapiens; identical to SEQ ID NO: 269183

SEQ ID NO: 597952 - RNA, 64 nt, Homo Sapiens; identical to SEQ ID NO: 269184

SEQ ID NO: 597953 - RNA, 64 nt, Homo Sapiens; identical to SEQ ID NO: 269185

SEQ ID NO: 597954 - RNA, 64 nt, Homo Sapiens; identical to SEQ ID NO: 269186

SEQ ID NO: 597955 - RNA, 64 nt, Homo Sapiens; identical to SEQ ID NO: 269187

SEQ ID NO: 597956 - RNA, 64 nt, Homo Sapiens; identical to SEQ ID NO: 269188

SEQ ID NO: 597957 - RNA, 64 nt, Homo Sapiens; identical to SEQ ID NO: 269189

SEQ ID NO: 597958 - RNA, 64 nt, Homo Sapiens; identical to SEQ ID NO: 269190

SEQ ID NO: 597959 - RNA, 64 nt, Homo Sapiens; identical to SEQ ID NO: 269191

SEQ ID NO: 597960 - RNA, 64 nt, Homo Sapiens; identical to SEQ ID NO: 269192

SEQ ID NO: 597961 - RNA, 64 nt, Homo Sapiens; identical to SEQ ID NO: 269193

SEQ ID NO: 597962 - RNA, 64 nt, Homo Sapiens; identical to SEQ ID NO: 269194

SEQ ID NO: 597963 - RNA, 64 nt, Homo Sapiens; identical to SEQ ID NO: 269195

SEQ ID NO: 597964 - RNA, 64 nt, Homo Sapiens; identical to SEQ ID NO: 269196

SEQ ID NO: 597965 - RNA, 64 nt, Homo Sapiens; identical to SEQ ID NO: 269197

SEQ ID NO: 597966 - RNA, 64 nt, Homo Sapiens; identical to SEQ ID NO: 269198

SEQ ID NO: 597967 - RNA, 64 nt, Homo Sapiens; identical to SEQ ID NO: 269199

SEQ ID NO: 597968 - RNA, 64 nt, Homo Sapiens; identical to SEQ ID NO: 269200

SEQ ID NO: 597969 - RNA, 64 nt, Homo Sapiens; identical to SEQ ID NO: 269201

SEQ ID NO: 597970 - RNA, 64 nt, Homo Sapiens; identical to SEQ ID NO: 269202

SEQ ID NO: 597971 - RNA, 64 nt, Homo Sapiens; identical to SEQ ID NO: 269203

SEQ ID NO: 597972 - RNA, 64 nt, Homo Sapiens; identical to SEQ ID NO: 269204

SEQ ID NO: 597973 - RNA, 64 nt, Homo Sapiens; identical to SEQ ID NO: 269205

SEQ ID NO: 597974 - RNA, 64 nt, Homo Sapiens; identical to SEQ ID NO: 269206

SEQ ID NO: 597975 - RNA, 64 nt, Homo Sapiens; identical to SEQ ID NO: 269207

SEQ ID NO: 597976 - RNA, 64 nt, Homo Sapiens; identical to SEQ ID NO: 269208

SEQ ID NO: 597977 - RNA, 64 nt, Homo Sapiens; identical to SEQ ID NO: 269209

SEQ ID NO: 597978 - RNA, 64 nt, Homo Sapiens; identical to SEQ ID NO: 269210

SEQ ID NO: 597979 - RNA, 64 nt, Homo Sapiens; identical to SEQ ID NO: 269211

SEQ ID NO: 597980 - RNA, 64 nt, Homo Sapiens; identical to SEQ ID NO: 269212

SEQ ID NO: 597981 - RNA, 64 nt, Homo Sapiens; identical to SEQ ID NO: 269213

SEQ ID NO: 597982 - RNA, 64 nt, Homo Sapiens; identical to SEQ ID NO: 269214

SEQ ID NO: 597983 - RNA, 64 nt, Homo Sapiens; identical to SEQ ID NO: 269215

SEQ ID NO: 597984 - RNA, 64 nt, Homo Sapiens; identical to SEQ ID NO: 269216

SEQ ID NO: 597985 - RNA, 64 nt, Homo Sapiens; identical to SEQ ID NO: 269217

SEQ ID NO: 597986 - RNA, 64 nt, Homo Sapiens; identical to SEQ ID NO: 269218

SEQ ID NO: 597987 - RNA, 64 nt, Homo Sapiens; identical to SEQ ID NO: 269219

SEQ ID NO: 597988 - RNA, 64 nt, Homo Sapiens; identical to SEQ ID NO: 269220

SEQ ID NO: 597989 - RNA, 64 nt, Homo Sapiens; identical to SEQ ID NO: 269221

SEQ ID NO: 597990 - RNA, 64 nt, Homo Sapiens; identical to SEQ ID NO: 269222

SEQ ID NO: 597991 - RNA, 64 nt, Homo Sapiens; identical to SEQ ID NO: 269223

SEQ ID NO: 597992 - RNA, 64 nt, Homo Sapiens; identical to SEQ ID NO: 269224

SEQ ID NO: 597993 - RNA, 64 nt, Homo Sapiens; identical to SEQ ID NO: 269225

SEQ ID NO: 597994 - RNA, 64 nt, Homo Sapiens; identical to SEQ ID NO: 269226

SEQ ID NO: 597995 - RNA, 64 nt, Homo Sapiens; identical to SEQ ID NO: 269227

SEQ ID NO: 597996 - RNA, 64 nt, Homo Sapiens; identical to SEQ ID NO: 269228

SEQ ID NO: 597997 - RNA, 64 nt, Homo Sapiens; identical to SEQ ID NO: 269229

SEQ ID NO: 597998 - RNA, 64 nt, Homo Sapiens; identical to SEQ ID NO: 269230

SEQ ID NO: 597999 - RNA, 64 nt, Homo Sapiens; identical to SEQ ID NO: 269231

SEQ ID NO: 598000 - RNA, 64 nt, Homo Sapiens; identical to SEQ ID NO: 269232

SEQ ID NO: 598001 - RNA, 64 nt, Homo Sapiens; identical to SEQ ID NO: 269233

SEQ ID NO: 598002 - RNA, 64 nt, Homo Sapiens; identical to SEQ ID NO: 269234

SEQ ID NO: 598003 - RNA, 64 nt, Homo Sapiens; identical to SEQ ID NO: 269235

SEQ ID NO: 598004 - RNA, 64 nt, Homo Sapiens; identical to SEQ ID NO: 269236

SEQ ID NO: 598005 - RNA, 64 nt, Homo Sapiens; identical to SEQ ID NO: 269237

SEQ ID NO: 598006 - RNA, 64 nt, Homo Sapiens; identical to SEQ ID NO: 269238

SEQ ID NO: 598007 - RNA, 64 nt, Homo Sapiens; identical to SEQ ID NO: 269239

SEQ ID NO: 598008 - RNA, 64 nt, Homo Sapiens; identical to SEQ ID NO: 269240

SEQ ID NO: 598009 - RNA, 64 nt, Homo Sapiens; identical to SEQ ID NO: 269241

SEQ ID NO: 598010 - RNA, 64 nt, Homo Sapiens; identical to SEQ ID NO: 269242

SEQ ID NO: 598011 - RNA, 64 nt, Homo Sapiens; identical to SEQ ID NO: 269243

SEQ ID NO: 598012 - RNA, 64 nt, Homo Sapiens; identical to SEQ ID NO: 269244

SEQ ID NO: 598013 - RNA, 64 nt, Homo Sapiens; identical to SEQ ID NO: 269245

SEQ ID NO: 598014 - RNA, 64 nt, Homo Sapiens; identical to SEQ ID NO: 269246

SEQ ID NO: 598015 - RNA, 64 nt, Homo Sapiens; identical to SEQ ID NO: 269247

SEQ ID NO: 598016 - RNA, 64 nt, Homo Sapiens; identical to SEQ ID NO: 269248

SEQ ID NO: 598017 - RNA, 64 nt, Homo Sapiens; identical to SEQ ID NO: 269249

SEQ ID NO: 598018 - RNA, 64 nt, Homo Sapiens; identical to SEQ ID NO: 269250

SEQ ID NO: 598019 - RNA, 64 nt, Homo Sapiens; identical to SEQ ID NO: 269251

SEQ ID NO: 598020 - RNA, 64 nt, Homo Sapiens; identical to SEQ ID NO: 269252

SEQ ID NO: 598021 - RNA, 64 nt, Homo Sapiens; identical to SEQ ID NO: 269253

SEQ ID NO: 598022 - RNA, 64 nt, Homo Sapiens; identical to SEQ ID NO: 269254

SEQ ID NO: 598023 - RNA, 64 nt, Homo Sapiens; identical to SEQ ID NO: 269255

SEQ ID NO: 598024 - RNA, 64 nt, Homo Sapiens; identical to SEQ ID NO: 269256

SEQ ID NO: 598025 - RNA, 64 nt, Homo Sapiens; identical to SEQ ID NO: 269257

SEQ ID NO: 598026 - RNA, 64 nt, Homo Sapiens; identical to SEQ ID NO: 269258

SEQ ID NO: 598027 - RNA, 64 nt, Homo Sapiens; identical to SEQ ID NO: 269259

SEQ ID NO: 598028 - RNA, 64 nt, Homo Sapiens; identical to SEQ ID NO: 269260

SEQ ID NO: 598029 - RNA, 64 nt, Homo Sapiens; identical to SEQ ID NO: 269261

SEQ ID NO: 598030 - RNA, 64 nt, Homo Sapiens; identical to SEQ ID NO: 269262

SEQ ID NO: 598031 - RNA, 64 nt, Homo Sapiens; identical to SEQ ID NO: 269263

SEQ ID NO: 598032 - RNA, 64 nt, Homo Sapiens; identical to SEQ ID NO: 269264

SEQ ID NO: 598033 - RNA, 64 nt, Homo Sapiens; identical to SEQ ID NO: 269265

SEQ ID NO: 598034 - RNA, 64 nt, Homo Sapiens; identical to SEQ ID NO: 269266

SEQ ID NO: 598035 - RNA, 64 nt, Homo Sapiens; identical to SEQ ID NO: 269267

SEQ ID NO: 598036 - RNA, 64 nt, Homo Sapiens; identical to SEQ ID NO: 269268

SEQ ID NO: 598037 - RNA, 64 nt, Homo Sapiens; identical to SEQ ID NO: 269269

SEQ ID NO: 598038 - RNA, 64 nt, Homo Sapiens; identical to SEQ ID NO: 269270

SEQ ID NO: 598039 - RNA, 64 nt, Homo Sapiens; identical to SEQ ID NO: 269271

SEQ ID NO: 598040 - RNA, 64 nt, Homo Sapiens; identical to SEQ ID NO: 269272

SEQ ID NO: 598041 - RNA, 64 nt, Homo Sapiens; identical to SEQ ID NO: 269273

SEQ ID NO: 598042 - RNA, 64 nt, Homo Sapiens; identical to SEQ ID NO: 269274

SEQ ID NO: 598043 - RNA, 64 nt, Homo Sapiens; identical to SEQ ID NO: 269275

SEQ ID NO: 598044 - RNA, 64 nt, Homo Sapiens; identical to SEQ ID NO: 269276

SEQ ID NO: 598045 - RNA, 64 nt, Homo Sapiens; identical to SEQ ID NO: 269277

SEQ ID NO: 598046 - RNA, 64 nt, Homo Sapiens; identical to SEQ ID NO: 269278

SEQ ID NO: 598047 - RNA, 64 nt, Homo Sapiens; identical to SEQ ID NO: 269279

SEQ ID NO: 598048 - RNA, 64 nt, Homo Sapiens; identical to SEQ ID NO: 269280

SEQ ID NO: 598049 - RNA, 64 nt, Homo Sapiens; identical to SEQ ID NO: 269281

SEQ ID NO: 598050 - RNA, 64 nt, Homo Sapiens; identical to SEQ ID NO: 269282

SEQ ID NO: 598051 - RNA, 64 nt, Homo Sapiens; identical to SEQ ID NO: 269283

SEQ ID NO: 598052 - RNA, 64 nt, Homo Sapiens; identical to SEQ ID NO: 269284

SEQ ID NO: 598053 - RNA, 64 nt, Homo Sapiens; identical to SEQ ID NO: 269285

SEQ ID NO: 598054 - RNA, 64 nt, Homo Sapiens; identical to SEQ ID NO: 269286

SEQ ID NO: 598055 - RNA, 64 nt, Homo Sapiens; identical to SEQ ID NO: 269287

SEQ ID NO: 598056 - RNA, 64 nt, Homo Sapiens; identical to SEQ ID NO: 269288

SEQ ID NO: 598057 - RNA, 64 nt, Homo Sapiens; identical to SEQ ID NO: 269289

SEQ ID NO: 598058 - RNA, 64 nt, Homo Sapiens; identical to SEQ ID NO: 269290

SEQ ID NO: 598059 - RNA, 64 nt, Homo Sapiens; identical to SEQ ID NO: 269291

SEQ ID NO: 598060 - RNA, 64 nt, Homo Sapiens; identical to SEQ ID NO: 269292

SEQ ID NO: 598061 - RNA, 64 nt, Homo Sapiens; identical to SEQ ID NO: 269293

SEQ ID NO: 598062 - RNA, 64 nt, Homo Sapiens; identical to SEQ ID NO: 269294

SEQ ID NO: 598063 - RNA, 64 nt, Homo Sapiens; identical to SEQ ID NO: 269295

SEQ ID NO: 598064 - RNA, 64 nt, Homo Sapiens; identical to SEQ ID NO: 269296

SEQ ID NO: 598065 - RNA, 64 nt, Homo Sapiens; identical to SEQ ID NO: 269297

SEQ ID NO: 598066 - RNA, 64 nt, Homo Sapiens; identical to SEQ ID NO: 269298

SEQ ID NO: 598067 - RNA, 64 nt, Homo Sapiens; identical to SEQ ID NO: 269299

SEQ ID NO: 598068 - RNA, 64 nt, Homo Sapiens; identical to SEQ ID NO: 269300

SEQ ID NO: 598069 - RNA, 64 nt, Homo Sapiens; identical to SEQ ID NO: 269301

SEQ ID NO: 598070 - RNA, 64 nt, Homo Sapiens; identical to SEQ ID NO: 269302

SEQ ID NO: 598071 - RNA, 64 nt, Homo Sapiens; identical to SEQ ID NO: 269303

SEQ ID NO: 598072 - RNA, 64 nt, Homo Sapiens; identical to SEQ ID NO: 269304

SEQ ID NO: 598073 - RNA, 64 nt, Homo Sapiens; identical to SEQ ID NO: 269305

SEQ ID NO: 598074 - RNA, 64 nt, Homo Sapiens; identical to SEQ ID NO: 269306

SEQ ID NO: 598075 - RNA, 64 nt, Homo Sapiens; identical to SEQ ID NO: 269307

SEQ ID NO: 598076 - RNA, 64 nt, Homo Sapiens; identical to SEQ ID NO: 269308

SEQ ID NO: 598077 - RNA, 64 nt, Homo Sapiens; identical to SEQ ID NO: 269309

SEQ ID NO: 598078 - RNA, 64 nt, Homo Sapiens; identical to SEQ ID NO: 269310

SEQ ID NO: 598079 - RNA, 64 nt, Homo Sapiens; identical to SEQ ID NO: 269311

SEQ ID NO: 598080 - RNA, 64 nt, Homo Sapiens; identical to SEQ ID NO: 269312

SEQ ID NO: 598081 - RNA, 64 nt, Homo Sapiens; identical to SEQ ID NO: 269313

SEQ ID NO: 598082 - RNA, 64 nt, Homo Sapiens; identical to SEQ ID NO: 269314

SEQ ID NO: 598083 - RNA, 64 nt, Homo Sapiens; identical to SEQ ID NO: 269315

SEQ ID NO: 598084 - RNA, 64 nt, Homo Sapiens; identical to SEQ ID NO: 269316

SEQ ID NO: 598085 - RNA, 64 nt, Homo Sapiens; identical to SEQ ID NO: 269317

SEQ ID NO: 598086 - RNA, 64 nt, Homo Sapiens; identical to SEQ ID NO: 269318

SEQ ID NO: 598087 - RNA, 64 nt, Homo Sapiens; identical to SEQ ID NO: 269319

SEQ ID NO: 598088 - RNA, 64 nt, Homo Sapiens; identical to SEQ ID NO: 269320

SEQ ID NO: 598089 - RNA, 64 nt, Homo Sapiens; identical to SEQ ID NO: 269321

SEQ ID NO: 598090 - RNA, 64 nt, Homo Sapiens; identical to SEQ ID NO: 269322

SEQ ID NO: 598091 - RNA, 64 nt, Homo Sapiens; identical to SEQ ID NO: 269323

SEQ ID NO: 598092 - RNA, 64 nt, Homo Sapiens; identical to SEQ ID NO: 269324

SEQ ID NO: 598093 - RNA, 64 nt, Homo Sapiens; identical to SEQ ID NO: 269325

SEQ ID NO: 598094 - RNA, 64 nt, Homo Sapiens; identical to SEQ ID NO: 269326

SEQ ID NO: 598095 - RNA, 64 nt, Homo Sapiens; identical to SEQ ID NO: 269327

SEQ ID NO: 598096 - RNA, 64 nt, Homo Sapiens; identical to SEQ ID NO: 269328

SEQ ID NO: 598097 - RNA, 64 nt, Homo Sapiens; identical to SEQ ID NO: 269329

SEQ ID NO: 598098 - RNA, 64 nt, Homo Sapiens; identical to SEQ ID NO: 269330

SEQ ID NO: 598099 - RNA, 64 nt, Homo Sapiens; identical to SEQ ID NO: 269331

SEQ ID NO: 598100 - RNA, 64 nt, Homo Sapiens; identical to SEQ ID NO: 269332

SEQ ID NO: 598101 - RNA, 64 nt, Homo Sapiens; identical to SEQ ID NO: 269333

SEQ ID NO: 598102 - RNA, 64 nt, Homo Sapiens; identical to SEQ ID NO: 269334

SEQ ID NO: 598103 - RNA, 64 nt, Homo Sapiens; identical to SEQ ID NO: 269335

SEQ ID NO: 598104 - RNA, 64 nt, Homo Sapiens; identical to SEQ ID NO: 269336

SEQ ID NO: 598105 - RNA, 64 nt, Homo Sapiens; identical to SEQ ID NO: 269337

SEQ ID NO: 598106 - RNA, 64 nt, Homo Sapiens; identical to SEQ ID NO: 269338

SEQ ID NO: 598107 - RNA, 64 nt, Homo Sapiens; identical to SEQ ID NO: 269339

SEQ ID NO: 598108 - RNA, 64 nt, Homo Sapiens; identical to SEQ ID NO: 269340

SEQ ID NO: 598109 - RNA, 64 nt, Homo Sapiens; identical to SEQ ID NO: 269341

SEQ ID NO: 598110 - RNA, 64 nt, Homo Sapiens; identical to SEQ ID NO: 269342

SEQ ID NO: 598111 - RNA, 64 nt, Homo Sapiens; identical to SEQ ID NO: 269343

SEQ ID NO: 598112 - RNA, 64 nt, Homo Sapiens; identical to SEQ ID NO: 269344

SEQ ID NO: 598113 - RNA, 64 nt, Homo Sapiens; identical to SEQ ID NO: 269345

SEQ ID NO: 598114 - RNA, 64 nt, Homo Sapiens; identical to SEQ ID NO: 269346

SEQ ID NO: 598115 - RNA, 64 nt, Homo Sapiens; identical to SEQ ID NO: 269347

SEQ ID NO: 598116 - RNA, 64 nt, Homo Sapiens; identical to SEQ ID NO: 269348

SEQ ID NO: 598117 - RNA, 64 nt, Homo Sapiens; identical to SEQ ID NO: 269349

SEQ ID NO: 598118 - RNA, 64 nt, Homo Sapiens; identical to SEQ ID NO: 269350

SEQ ID NO: 598119 - RNA, 64 nt, Homo Sapiens; identical to SEQ ID NO: 269351

SEQ ID NO: 598120 - RNA, 64 nt, Homo Sapiens; identical to SEQ ID NO: 269352

SEQ ID NO: 598121 - RNA, 64 nt, Homo Sapiens; identical to SEQ ID NO: 269353

SEQ ID NO: 598122 - RNA, 64 nt, Homo Sapiens; identical to SEQ ID NO: 269354

SEQ ID NO: 598123 - RNA, 64 nt, Homo Sapiens; identical to SEQ ID NO: 269355

SEQ ID NO: 598124 - RNA, 64 nt, Homo Sapiens; identical to SEQ ID NO: 269356

SEQ ID NO: 598125 - RNA, 64 nt, Homo Sapiens; identical to SEQ ID NO: 269357

SEQ ID NO: 598126 - RNA, 64 nt, Homo Sapiens; identical to SEQ ID NO: 269358

SEQ ID NO: 598127 - RNA, 64 nt, Homo Sapiens; identical to SEQ ID NO: 269359

SEQ ID NO: 598128 - RNA, 64 nt, Homo Sapiens; identical to SEQ ID NO: 269360

SEQ ID NO: 598129 - RNA, 64 nt, Homo Sapiens; identical to SEQ ID NO: 269361

SEQ ID NO: 598130 - RNA, 64 nt, Homo Sapiens; identical to SEQ ID NO: 269362

SEQ ID NO: 598131 - RNA, 64 nt, Homo Sapiens; identical to SEQ ID NO: 269363

SEQ ID NO: 598132 - RNA, 64 nt, Homo Sapiens; identical to SEQ ID NO: 269364

SEQ ID NO: 598133 - RNA, 64 nt, Homo Sapiens; identical to SEQ ID NO: 269365

SEQ ID NO: 598134 - RNA, 64 nt, Homo Sapiens; identical to SEQ ID NO: 269366

SEQ ID NO: 598135 - RNA, 64 nt, Homo Sapiens; identical to SEQ ID NO: 269367

SEQ ID NO: 598136 - RNA, 64 nt, Homo Sapiens; identical to SEQ ID NO: 269368

SEQ ID NO: 598137 - RNA, 64 nt, Homo Sapiens; identical to SEQ ID NO: 269369

SEQ ID NO: 598138 - RNA, 64 nt, Homo Sapiens; identical to SEQ ID NO: 269370

SEQ ID NO: 598139 - RNA, 64 nt, Homo Sapiens; identical to SEQ ID NO: 269371

SEQ ID NO: 598140 - RNA, 64 nt, Homo Sapiens; identical to SEQ ID NO: 269372

SEQ ID NO: 598141 - RNA, 64 nt, Homo Sapiens; identical to SEQ ID NO: 269373

SEQ ID NO: 598142 - RNA, 64 nt, Homo Sapiens; identical to SEQ ID NO: 269374

SEQ ID NO: 598143 - RNA, 64 nt, Homo Sapiens; identical to SEQ ID NO: 269375

SEQ ID NO: 598144 - RNA, 64 nt, Homo Sapiens; identical to SEQ ID NO: 269376

SEQ ID NO: 598145 - RNA, 64 nt, Homo Sapiens; identical to SEQ ID NO: 269377

SEQ ID NO: 598146 - RNA, 64 nt, Homo Sapiens; identical to SEQ ID NO: 269378

SEQ ID NO: 598147 - RNA, 64 nt, Homo Sapiens; identical to SEQ ID NO: 269379

SEQ ID NO: 598148 - RNA, 64 nt, Homo Sapiens; identical to SEQ ID NO: 269380

SEQ ID NO: 598149 - RNA, 64 nt, Homo Sapiens; identical to SEQ ID NO: 269381

SEQ ID NO: 598150 - RNA, 64 nt, Homo Sapiens; identical to SEQ ID NO: 269382

SEQ ID NO: 598151 - RNA, 64 nt, Homo Sapiens; identical to SEQ ID NO: 269383

SEQ ID NO: 598152 - RNA, 64 nt, Homo Sapiens; identical to SEQ ID NO: 269384

SEQ ID NO: 598153 - RNA, 64 nt, Homo Sapiens; identical to SEQ ID NO: 269385

SEQ ID NO: 598154 - RNA, 64 nt, Homo Sapiens; identical to SEQ ID NO: 269386

SEQ ID NO: 598155 - RNA, 64 nt, Homo Sapiens; identical to SEQ ID NO: 269387

SEQ ID NO: 598156 - RNA, 64 nt, Homo Sapiens; identical to SEQ ID NO: 269388

SEQ ID NO: 598157 - RNA, 64 nt, Homo Sapiens; identical to SEQ ID NO: 269389

SEQ ID NO: 598158 - RNA, 64 nt, Homo Sapiens; identical to SEQ ID NO: 269390

SEQ ID NO: 598159 - RNA, 64 nt, Homo Sapiens; identical to SEQ ID NO: 269391

SEQ ID NO: 598160 - RNA, 64 nt, Homo Sapiens; identical to SEQ ID NO: 269392

SEQ ID NO: 598161 - RNA, 64 nt, Homo Sapiens; identical to SEQ ID NO: 269393

SEQ ID NO: 598162 - RNA, 64 nt, Homo Sapiens; identical to SEQ ID NO: 269394

SEQ ID NO: 598163 - RNA, 64 nt, Homo Sapiens; identical to SEQ ID NO: 269395

SEQ ID NO: 598164 - RNA, 64 nt, Homo Sapiens; identical to SEQ ID NO: 269396

SEQ ID NO: 598165 - RNA, 64 nt, Homo Sapiens; identical to SEQ ID NO: 269397

SEQ ID NO: 598166 - RNA, 64 nt, Homo Sapiens; identical to SEQ ID NO: 269398

SEQ ID NO: 598167 - RNA, 64 nt, Homo Sapiens; identical to SEQ ID NO: 269399

SEQ ID NO: 598168 - RNA, 64 nt, Homo Sapiens; identical to SEQ ID NO: 269400

SEQ ID NO: 598169 - RNA, 64 nt, Homo Sapiens; identical to SEQ ID NO: 269401

SEQ ID NO: 598170 - RNA, 64 nt, Homo Sapiens; identical to SEQ ID NO: 269402

SEQ ID NO: 598171 - RNA, 64 nt, Homo Sapiens; identical to SEQ ID NO: 269403

SEQ ID NO: 598172 - RNA, 64 nt, Homo Sapiens; identical to SEQ ID NO: 269404

SEQ ID NO: 598173 - RNA, 64 nt, Homo Sapiens; identical to SEQ ID NO: 269405

SEQ ID NO: 598174 - RNA, 64 nt, Homo Sapiens; identical to SEQ ID NO: 269406

SEQ ID NO: 598175 - RNA, 64 nt, Homo Sapiens; identical to SEQ ID NO: 269407

SEQ ID NO: 598176 - RNA, 64 nt, Homo Sapiens; identical to SEQ ID NO: 269408

SEQ ID NO: 598177 - RNA, 64 nt, Homo Sapiens; identical to SEQ ID NO: 269409

SEQ ID NO: 598178 - RNA, 64 nt, Homo Sapiens; identical to SEQ ID NO: 269410

SEQ ID NO: 598179 - RNA, 64 nt, Homo Sapiens; identical to SEQ ID NO: 269411

SEQ ID NO: 598180 - RNA, 64 nt, Homo Sapiens; identical to SEQ ID NO: 269412

SEQ ID NO: 598181 - RNA, 64 nt, Homo Sapiens; identical to SEQ ID NO: 269413

SEQ ID NO: 598182 - RNA, 64 nt, Homo Sapiens; identical to SEQ ID NO: 269414

SEQ ID NO: 598183 - RNA, 64 nt, Homo Sapiens; identical to SEQ ID NO: 269415

SEQ ID NO: 598184 - RNA, 64 nt, Homo Sapiens; identical to SEQ ID NO: 269416

SEQ ID NO: 598185 - RNA, 64 nt, Homo Sapiens; identical to SEQ ID NO: 269417

SEQ ID NO: 598186 - RNA, 64 nt, Homo Sapiens; identical to SEQ ID NO: 269418

SEQ ID NO: 598187 - RNA, 64 nt, Homo Sapiens; identical to SEQ ID NO: 269419

SEQ ID NO: 598188 - RNA, 64 nt, Homo Sapiens; identical to SEQ ID NO: 269420

SEQ ID NO: 598189 - RNA, 64 nt, Homo Sapiens; identical to SEQ ID NO: 269421

SEQ ID NO: 598190 - RNA, 64 nt, Homo Sapiens; identical to SEQ ID NO: 269422

SEQ ID NO: 598191 - RNA, 64 nt, Homo Sapiens; identical to SEQ ID NO: 269423

SEQ ID NO: 598192 - RNA, 64 nt, Homo Sapiens; identical to SEQ ID NO: 269424

SEQ ID NO: 598193 - RNA, 64 nt, Homo Sapiens; identical to SEQ ID NO: 269425

SEQ ID NO: 598194 - RNA, 64 nt, Homo Sapiens; identical to SEQ ID NO: 269426

SEQ ID NO: 598195 - RNA, 64 nt, Homo Sapiens; identical to SEQ ID NO: 269427

SEQ ID NO: 598196 - RNA, 64 nt, Homo Sapiens; identical to SEQ ID NO: 269428

SEQ ID NO: 598197 - RNA, 64 nt, Homo Sapiens; identical to SEQ ID NO: 269429

SEQ ID NO: 598198 - RNA, 56 nt, Homo Sapiens; identical to SEQ ID NO: 269430

SEQ ID NO: 598199 - RNA, 64 nt, Homo Sapiens; identical to SEQ ID NO: 269431

SEQ ID NO: 598200 - RNA, 64 nt, Homo Sapiens; identical to SEQ ID NO: 269432

SEQ ID NO: 598201 - RNA, 64 nt, Homo Sapiens; identical to SEQ ID NO: 269433

SEQ ID NO: 598202 - RNA, 64 nt, Homo Sapiens; identical to SEQ ID NO: 269434

SEQ ID NO: 598203 - RNA, 64 nt, Homo Sapiens; identical to SEQ ID NO: 269435

SEQ ID NO: 598204 - RNA, 64 nt, Homo Sapiens; identical to SEQ ID NO: 269436

SEQ ID NO: 598205 - RNA, 64 nt, Homo Sapiens; identical to SEQ ID NO: 269437

SEQ ID NO: 598206 - RNA, 64 nt, Homo Sapiens; identical to SEQ ID NO: 269438

SEQ ID NO: 598207 - RNA, 64 nt, Homo Sapiens; identical to SEQ ID NO: 269439

SEQ ID NO: 598208 - RNA, 64 nt, Homo Sapiens; identical to SEQ ID NO: 269440

SEQ ID NO: 598209 - RNA, 64 nt, Homo Sapiens; identical to SEQ ID NO: 269441

SEQ ID NO: 598210 - RNA, 64 nt, Homo Sapiens; identical to SEQ ID NO: 269442

SEQ ID NO: 598211 - RNA, 64 nt, Homo Sapiens; identical to SEQ ID NO: 269443

SEQ ID NO: 598212 - RNA, 64 nt, Homo Sapiens; identical to SEQ ID NO: 269444

SEQ ID NO: 598213 - RNA, 64 nt, Homo Sapiens; identical to SEQ ID NO: 269445

SEQ ID NO: 598214 - RNA, 64 nt, Homo Sapiens; identical to SEQ ID NO: 269446

SEQ ID NO: 598215 - RNA, 64 nt, Homo Sapiens; identical to SEQ ID NO: 269447

SEQ ID NO: 598216 - RNA, 64 nt, Homo Sapiens; identical to SEQ ID NO: 269448

SEQ ID NO: 598217 - RNA, 64 nt, Homo Sapiens; identical to SEQ ID NO: 269449

SEQ ID NO: 598218 - RNA, 64 nt, Homo Sapiens; identical to SEQ ID NO: 269450

SEQ ID NO: 598219 - RNA, 64 nt, Homo Sapiens; identical to SEQ ID NO: 269451

SEQ ID NO: 598220 - RNA, 64 nt, Homo Sapiens; identical to SEQ ID NO: 269452

SEQ ID NO: 598221 - RNA, 64 nt, Homo Sapiens; identical to SEQ ID NO: 269453

SEQ ID NO: 598222 - RNA, 64 nt, Homo Sapiens; identical to SEQ ID NO: 269454

SEQ ID NO: 598223 - RNA, 64 nt, Homo Sapiens; identical to SEQ ID NO: 269455

SEQ ID NO: 598224 - RNA, 64 nt, Homo Sapiens; identical to SEQ ID NO: 269456

SEQ ID NO: 598225 - RNA, 64 nt, Homo Sapiens; identical to SEQ ID NO: 269457

SEQ ID NO: 598226 - RNA, 64 nt, Homo Sapiens; identical to SEQ ID NO: 269458

SEQ ID NO: 598227 - RNA, 64 nt, Homo Sapiens; identical to SEQ ID NO: 269459

SEQ ID NO: 598228 - RNA, 64 nt, Homo Sapiens; identical to SEQ ID NO: 269460

SEQ ID NO: 598229 - RNA, 64 nt, Homo Sapiens; identical to SEQ ID NO: 269461

SEQ ID NO: 598230 - RNA, 64 nt, Homo Sapiens; identical to SEQ ID NO: 269462

SEQ ID NO: 598231 - RNA, 64 nt, Homo Sapiens; identical to SEQ ID NO: 269463

SEQ ID NO: 598232 - RNA, 64 nt, Homo Sapiens; identical to SEQ ID NO: 269464

SEQ ID NO: 598233 - RNA, 64 nt, Homo Sapiens; identical to SEQ ID NO: 269465

SEQ ID NO: 598234 - RNA, 64 nt, Homo Sapiens; identical to SEQ ID NO: 269466

SEQ ID NO: 598235 - RNA, 64 nt, Homo Sapiens; identical to SEQ ID NO: 269467

SEQ ID NO: 598236 - RNA, 64 nt, Homo Sapiens; identical to SEQ ID NO: 269468

SEQ ID NO: 598237 - RNA, 64 nt, Homo Sapiens; identical to SEQ ID NO: 269469

SEQ ID NO: 598238 - RNA, 64 nt, Homo Sapiens; identical to SEQ ID NO: 269470

SEQ ID NO: 598239 - RNA, 56 nt, Homo Sapiens; identical to SEQ ID NO: 269471

SEQ ID NO: 598240 - RNA, 64 nt, Homo Sapiens; identical to SEQ ID NO: 269472

SEQ ID NO: 598241 - RNA, 64 nt, Homo Sapiens; identical to SEQ ID NO: 269473

SEQ ID NO: 598242 - RNA, 64 nt, Homo Sapiens; identical to SEQ ID NO: 269474

SEQ ID NO: 598243 - RNA, 64 nt, Homo Sapiens; identical to SEQ ID NO: 269475

SEQ ID NO: 598244 - RNA, 64 nt, Homo Sapiens; identical to SEQ ID NO: 269476

SEQ ID NO: 598245 - RNA, 64 nt, Homo Sapiens; identical to SEQ ID NO: 269477

SEQ ID NO: 598246 - RNA, 64 nt, Homo Sapiens; identical to SEQ ID NO: 269478

SEQ ID NO: 598247 - RNA, 64 nt, Homo Sapiens; identical to SEQ ID NO: 269479

SEQ ID NO: 598248 - RNA, 64 nt, Homo Sapiens; identical to SEQ ID NO: 269480

SEQ ID NO: 598249 - RNA, 64 nt, Homo Sapiens; identical to SEQ ID NO: 269481

SEQ ID NO: 598250 - RNA, 64 nt, Homo Sapiens; identical to SEQ ID NO: 269482

SEQ ID NO: 598251 - RNA, 64 nt, Homo Sapiens; identical to SEQ ID NO: 269483

SEQ ID NO: 598252 - RNA, 64 nt, Homo Sapiens; identical to SEQ ID NO: 269484

SEQ ID NO: 598253 - RNA, 64 nt, Homo Sapiens; identical to SEQ ID NO: 269485

SEQ ID NO: 598254 - RNA, 64 nt, Homo Sapiens; identical to SEQ ID NO: 269486

SEQ ID NO: 598255 - RNA, 64 nt, Homo Sapiens; identical to SEQ ID NO: 269487

SEQ ID NO: 598256 - RNA, 64 nt, Homo Sapiens; identical to SEQ ID NO: 269488

SEQ ID NO: 598257 - RNA, 64 nt, Homo Sapiens; identical to SEQ ID NO: 269489

SEQ ID NO: 598258 - RNA, 64 nt, Homo Sapiens; identical to SEQ ID NO: 269490

SEQ ID NO: 598259 - RNA, 64 nt, Homo Sapiens; identical to SEQ ID NO: 269491

SEQ ID NO: 598260 - RNA, 64 nt, Homo Sapiens; identical to SEQ ID NO: 269492

SEQ ID NO: 598261 - RNA, 64 nt, Homo Sapiens; identical to SEQ ID NO: 269493

SEQ ID NO: 598262 - RNA, 64 nt, Homo Sapiens; identical to SEQ ID NO: 269494

SEQ ID NO: 598263 - RNA, 64 nt, Homo Sapiens; identical to SEQ ID NO: 269495

SEQ ID NO: 598264 - RNA, 64 nt, Homo Sapiens; identical to SEQ ID NO: 269496

SEQ ID NO: 598265 - RNA, 64 nt, Homo Sapiens; identical to SEQ ID NO: 269497

SEQ ID NO: 598266 - RNA, 64 nt, Homo Sapiens; identical to SEQ ID NO: 269498

SEQ ID NO: 598267 - RNA, 64 nt, Homo Sapiens; identical to SEQ ID NO: 269499

SEQ ID NO: 598268 - RNA, 64 nt, Homo Sapiens; identical to SEQ ID NO: 269500

SEQ ID NO: 598269 - RNA, 64 nt, Homo Sapiens; identical to SEQ ID NO: 269501

SEQ ID NO: 598270 - RNA, 64 nt, Homo Sapiens; identical to SEQ ID NO: 269502

SEQ ID NO: 598271 - RNA, 64 nt, Homo Sapiens; identical to SEQ ID NO: 269503

SEQ ID NO: 598272 - RNA, 64 nt, Homo Sapiens; identical to SEQ ID NO: 269504

SEQ ID NO: 598273 - RNA, 64 nt, Homo Sapiens; identical to SEQ ID NO: 269505

SEQ ID NO: 598274 - RNA, 64 nt, Homo Sapiens; identical to SEQ ID NO: 269506

SEQ ID NO: 598275 - RNA, 64 nt, Homo Sapiens; identical to SEQ ID NO: 269507

SEQ ID NO: 598276 - RNA, 64 nt, Homo Sapiens; identical to SEQ ID NO: 269508

SEQ ID NO: 598277 - RNA, 64 nt, Homo Sapiens; identical to SEQ ID NO: 269509

SEQ ID NO: 598278 - RNA, 64 nt, Homo Sapiens; identical to SEQ ID NO: 269510

SEQ ID NO: 598279 - RNA, 64 nt, Homo Sapiens; identical to SEQ ID NO: 269511

SEQ ID NO: 598280 - RNA, 64 nt, Homo Sapiens; identical to SEQ ID NO: 269512

SEQ ID NO: 598281 - RNA, 64 nt, Homo Sapiens; identical to SEQ ID NO: 269513

SEQ ID NO: 598282 - RNA, 64 nt, Homo Sapiens; identical to SEQ ID NO: 269514

SEQ ID NO: 598283 - RNA, 64 nt, Homo Sapiens; identical to SEQ ID NO: 269515

SEQ ID NO: 598284 - RNA, 64 nt, Homo Sapiens; identical to SEQ ID NO: 269516

SEQ ID NO: 598285 - RNA, 64 nt, Homo Sapiens; identical to SEQ ID NO: 269517

SEQ ID NO: 598286 - RNA, 64 nt, Homo Sapiens; identical to SEQ ID NO: 269518

SEQ ID NO: 598287 - RNA, 64 nt, Homo Sapiens; identical to SEQ ID NO: 269519

SEQ ID NO: 598288 - RNA, 64 nt, Homo Sapiens; identical to SEQ ID NO: 269520

SEQ ID NO: 598289 - RNA, 64 nt, Homo Sapiens; identical to SEQ ID NO: 269521

SEQ ID NO: 598290 - RNA, 64 nt, Homo Sapiens; identical to SEQ ID NO: 269522

SEQ ID NO: 598291 - RNA, 64 nt, Homo Sapiens; identical to SEQ ID NO: 269523

SEQ ID NO: 598292 - RNA, 64 nt, Homo Sapiens; identical to SEQ ID NO: 269524

SEQ ID NO: 598293 - RNA, 64 nt, Homo Sapiens; identical to SEQ ID NO: 269525

SEQ ID NO: 598294 - RNA, 64 nt, Homo Sapiens; identical to SEQ ID NO: 269526

SEQ ID NO: 598295 - RNA, 64 nt, Homo Sapiens; identical to SEQ ID NO: 269527

SEQ ID NO: 598296 - RNA, 64 nt, Homo Sapiens; identical to SEQ ID NO: 269528

SEQ ID NO: 598297 - RNA, 64 nt, Homo Sapiens; identical to SEQ ID NO: 269529

SEQ ID NO: 598298 - RNA, 64 nt, Homo Sapiens; identical to SEQ ID NO: 269530

SEQ ID NO: 598299 - RNA, 64 nt, Homo Sapiens; identical to SEQ ID NO: 269531

SEQ ID NO: 598300 - RNA, 64 nt, Homo Sapiens; identical to SEQ ID NO: 269532

SEQ ID NO: 598301 - RNA, 64 nt, Homo Sapiens; identical to SEQ ID NO: 269533

SEQ ID NO: 598302 - RNA, 64 nt, Homo Sapiens; identical to SEQ ID NO: 269534

SEQ ID NO: 598303 - RNA, 64 nt, Homo Sapiens; identical to SEQ ID NO: 269535

SEQ ID NO: 598304 - RNA, 64 nt, Homo Sapiens; identical to SEQ ID NO: 269536

SEQ ID NO: 598305 - RNA, 64 nt, Homo Sapiens; identical to SEQ ID NO: 269537

SEQ ID NO: 598306 - RNA, 64 nt, Homo Sapiens; identical to SEQ ID NO: 269538

SEQ ID NO: 598307 - RNA, 64 nt, Homo Sapiens; identical to SEQ ID NO: 269539

SEQ ID NO: 598308 - RNA, 64 nt, Homo Sapiens; identical to SEQ ID NO: 269540

SEQ ID NO: 598309 - RNA, 64 nt, Homo Sapiens; identical to SEQ ID NO: 269541

SEQ ID NO: 598310 - RNA, 64 nt, Homo Sapiens; identical to SEQ ID NO: 269542

SEQ ID NO: 598311 - RNA, 64 nt, Homo Sapiens; identical to SEQ ID NO: 269543

SEQ ID NO: 598312 - RNA, 64 nt, Homo Sapiens; identical to SEQ ID NO: 269544

SEQ ID NO: 598313 - RNA, 64 nt, Homo Sapiens; identical to SEQ ID NO: 269545

SEQ ID NO: 598314 - RNA, 64 nt, Homo Sapiens; identical to SEQ ID NO: 269546

SEQ ID NO: 598315 - RNA, 64 nt, Homo Sapiens; identical to SEQ ID NO: 269547

SEQ ID NO: 598316 - RNA, 64 nt, Homo Sapiens; identical to SEQ ID NO: 269548

SEQ ID NO: 598317 - RNA, 64 nt, Homo Sapiens; identical to SEQ ID NO: 269549

SEQ ID NO: 598318 - RNA, 64 nt, Homo Sapiens; identical to SEQ ID NO: 269550

SEQ ID NO: 598319 - RNA, 64 nt, Homo Sapiens; identical to SEQ ID NO: 269551

SEQ ID NO: 598320 - RNA, 64 nt, Homo Sapiens; identical to SEQ ID NO: 269552

SEQ ID NO: 598321 - RNA, 64 nt, Homo Sapiens; identical to SEQ ID NO: 269553

SEQ ID NO: 598322 - RNA, 64 nt, Homo Sapiens; identical to SEQ ID NO: 269554

SEQ ID NO: 598323 - RNA, 64 nt, Homo Sapiens; identical to SEQ ID NO: 269555

SEQ ID NO: 598324 - RNA, 64 nt, Homo Sapiens; identical to SEQ ID NO: 269556

SEQ ID NO: 598325 - RNA, 64 nt, Homo Sapiens; identical to SEQ ID NO: 269557

SEQ ID NO: 598326 - RNA, 64 nt, Homo Sapiens; identical to SEQ ID NO: 269558

SEQ ID NO: 598327 - RNA, 64 nt, Homo Sapiens; identical to SEQ ID NO: 269559

SEQ ID NO: 598328 - RNA, 64 nt, Homo Sapiens; identical to SEQ ID NO: 269560

SEQ ID NO: 598329 - RNA, 64 nt, Homo Sapiens; identical to SEQ ID NO: 269561

SEQ ID NO: 598330 - RNA, 64 nt, Homo Sapiens; identical to SEQ ID NO: 269562

SEQ ID NO: 598331 - RNA, 64 nt, Homo Sapiens; identical to SEQ ID NO: 269563

SEQ ID NO: 598332 - RNA, 64 nt, Homo Sapiens; identical to SEQ ID NO: 269564

SEQ ID NO: 598333 - RNA, 64 nt, Homo Sapiens; identical to SEQ ID NO: 269565

SEQ ID NO: 598334 - RNA, 64 nt, Homo Sapiens; identical to SEQ ID NO: 269566

SEQ ID NO: 598335 - RNA, 64 nt, Homo Sapiens; identical to SEQ ID NO: 269567

SEQ ID NO: 598336 - RNA, 64 nt, Homo Sapiens; identical to SEQ ID NO: 269568

SEQ ID NO: 598337 - RNA, 64 nt, Homo Sapiens; identical to SEQ ID NO: 269569

SEQ ID NO: 598338 - RNA, 64 nt, Homo Sapiens; identical to SEQ ID NO: 269570

SEQ ID NO: 598339 - RNA, 64 nt, Homo Sapiens; identical to SEQ ID NO: 269571

SEQ ID NO: 598340 - RNA, 64 nt, Homo Sapiens; identical to SEQ ID NO: 269572

SEQ ID NO: 598341 - RNA, 64 nt, Homo Sapiens; identical to SEQ ID NO: 269573

SEQ ID NO: 598342 - RNA, 64 nt, Homo Sapiens; identical to SEQ ID NO: 269574

SEQ ID NO: 598343 - RNA, 64 nt, Homo Sapiens; identical to SEQ ID NO: 269575

SEQ ID NO: 598344 - RNA, 64 nt, Homo Sapiens; identical to SEQ ID NO: 269576

SEQ ID NO: 598345 - RNA, 64 nt, Homo Sapiens; identical to SEQ ID NO: 269577

SEQ ID NO: 598346 - RNA, 64 nt, Homo Sapiens; identical to SEQ ID NO: 269578

SEQ ID NO: 598347 - RNA, 64 nt, Homo Sapiens; identical to SEQ ID NO: 269579

SEQ ID NO: 598348 - RNA, 64 nt, Homo Sapiens; identical to SEQ ID NO: 269580

SEQ ID NO: 598349 - RNA, 64 nt, Homo Sapiens; identical to SEQ ID NO: 269581

SEQ ID NO: 598350 - RNA, 64 nt, Homo Sapiens; identical to SEQ ID NO: 269582

SEQ ID NO: 598351 - RNA, 64 nt, Homo Sapiens; identical to SEQ ID NO: 269583

SEQ ID NO: 598352 - RNA, 64 nt, Homo Sapiens; identical to SEQ ID NO: 269584

SEQ ID NO: 598353 - RNA, 64 nt, Homo Sapiens; identical to SEQ ID NO: 269585

SEQ ID NO: 598354 - RNA, 64 nt, Homo Sapiens; identical to SEQ ID NO: 269586

SEQ ID NO: 598355 - RNA, 64 nt, Homo Sapiens; identical to SEQ ID NO: 269587

SEQ ID NO: 598356 - RNA, 64 nt, Homo Sapiens; identical to SEQ ID NO: 269588

SEQ ID NO: 598357 - RNA, 64 nt, Homo Sapiens; identical to SEQ ID NO: 269589

SEQ ID NO: 598358 - RNA, 64 nt, Homo Sapiens; identical to SEQ ID NO: 269590

SEQ ID NO: 598359 - RNA, 64 nt, Homo Sapiens; identical to SEQ ID NO: 269591

SEQ ID NO: 598360 - RNA, 64 nt, Homo Sapiens; identical to SEQ ID NO: 269592

SEQ ID NO: 598361 - RNA, 64 nt, Homo Sapiens; identical to SEQ ID NO: 269593

SEQ ID NO: 598362 - RNA, 64 nt, Homo Sapiens; identical to SEQ ID NO: 269594

SEQ ID NO: 598363 - RNA, 64 nt, Homo Sapiens; identical to SEQ ID NO: 269595

SEQ ID NO: 598364 - RNA, 64 nt, Homo Sapiens; identical to SEQ ID NO: 269596

SEQ ID NO: 598365 - RNA, 64 nt, Homo Sapiens; identical to SEQ ID NO: 269597

SEQ ID NO: 598366 - RNA, 64 nt, Homo Sapiens; identical to SEQ ID NO: 269598

SEQ ID NO: 598367 - RNA, 64 nt, Homo Sapiens; identical to SEQ ID NO: 269599

SEQ ID NO: 598368 - RNA, 64 nt, Homo Sapiens; identical to SEQ ID NO: 269600

SEQ ID NO: 598369 - RNA, 64 nt, Homo Sapiens; identical to SEQ ID NO: 269601

SEQ ID NO: 598370 - RNA, 64 nt, Homo Sapiens; identical to SEQ ID NO: 269602

SEQ ID NO: 598371 - RNA, 64 nt, Homo Sapiens; identical to SEQ ID NO: 269603

SEQ ID NO: 598372 - RNA, 64 nt, Homo Sapiens; identical to SEQ ID NO: 269604

SEQ ID NO: 598373 - RNA, 64 nt, Homo Sapiens; identical to SEQ ID NO: 269605

SEQ ID NO: 598374 - RNA, 64 nt, Homo Sapiens; identical to SEQ ID NO: 269606

SEQ ID NO: 598375 - RNA, 64 nt, Homo Sapiens; identical to SEQ ID NO: 269607

SEQ ID NO: 598376 - RNA, 64 nt, Homo Sapiens; identical to SEQ ID NO: 269608

SEQ ID NO: 598377 - RNA, 64 nt, Homo Sapiens; identical to SEQ ID NO: 269609

SEQ ID NO: 598378 - RNA, 64 nt, Homo Sapiens; identical to SEQ ID NO: 269610

SEQ ID NO: 598379 - RNA, 64 nt, Homo Sapiens; identical to SEQ ID NO: 269611

SEQ ID NO: 598380 - RNA, 64 nt, Homo Sapiens; identical to SEQ ID NO: 269612

SEQ ID NO: 598381 - RNA, 64 nt, Homo Sapiens; identical to SEQ ID NO: 269613

SEQ ID NO: 598382 - RNA, 64 nt, Homo Sapiens; identical to SEQ ID NO: 269614

SEQ ID NO: 598383 - RNA, 64 nt, Homo Sapiens; identical to SEQ ID NO: 269615

SEQ ID NO: 598384 - RNA, 64 nt, Homo Sapiens; identical to SEQ ID NO: 269616

SEQ ID NO: 598385 - RNA, 64 nt, Homo Sapiens; identical to SEQ ID NO: 269617

SEQ ID NO: 598386 - RNA, 64 nt, Homo Sapiens; identical to SEQ ID NO: 269618

SEQ ID NO: 598387 - RNA, 64 nt, Homo Sapiens; identical to SEQ ID NO: 269619

SEQ ID NO: 598388 - RNA, 64 nt, Homo Sapiens; identical to SEQ ID NO: 269620

SEQ ID NO: 598389 - RNA, 64 nt, Homo Sapiens; identical to SEQ ID NO: 269621

SEQ ID NO: 598390 - RNA, 64 nt, Homo Sapiens; identical to SEQ ID NO: 269622

SEQ ID NO: 598391 - RNA, 64 nt, Homo Sapiens; identical to SEQ ID NO: 269623

SEQ ID NO: 598392 - RNA, 64 nt, Homo Sapiens; identical to SEQ ID NO: 269624

SEQ ID NO: 598393 - RNA, 64 nt, Homo Sapiens; identical to SEQ ID NO: 269625

SEQ ID NO: 598394 - RNA, 64 nt, Homo Sapiens; identical to SEQ ID NO: 269626

SEQ ID NO: 598395 - RNA, 64 nt, Homo Sapiens; identical to SEQ ID NO: 269627

SEQ ID NO: 598396 - RNA, 64 nt, Homo Sapiens; identical to SEQ ID NO: 269628

SEQ ID NO: 598397 - RNA, 64 nt, Homo Sapiens; identical to SEQ ID NO: 269629

SEQ ID NO: 598398 - RNA, 64 nt, Homo Sapiens; identical to SEQ ID NO: 269630

SEQ ID NO: 598399 - RNA, 64 nt, Homo Sapiens; identical to SEQ ID NO: 269631

SEQ ID NO: 598400 - RNA, 64 nt, Homo Sapiens; identical to SEQ ID NO: 269632

SEQ ID NO: 598401 - RNA, 64 nt, Homo Sapiens; identical to SEQ ID NO: 269633

SEQ ID NO: 598402 - RNA, 64 nt, Homo Sapiens; identical to SEQ ID NO: 269634

SEQ ID NO: 598403 - RNA, 64 nt, Homo Sapiens; identical to SEQ ID NO: 269635

SEQ ID NO: 598404 - RNA, 64 nt, Homo Sapiens; identical to SEQ ID NO: 269636

SEQ ID NO: 598405 - RNA, 64 nt, Homo Sapiens; identical to SEQ ID NO: 269637

SEQ ID NO: 598406 - RNA, 64 nt, Homo Sapiens; identical to SEQ ID NO: 269638

SEQ ID NO: 598407 - RNA, 64 nt, Homo Sapiens; identical to SEQ ID NO: 269639

SEQ ID NO: 598408 - RNA, 64 nt, Homo Sapiens; identical to SEQ ID NO: 269640

SEQ ID NO: 598409 - RNA, 64 nt, Homo Sapiens; identical to SEQ ID NO: 269641

SEQ ID NO: 598410 - RNA, 64 nt, Homo Sapiens; identical to SEQ ID NO: 269642

SEQ ID NO: 598411 - RNA, 64 nt, Homo Sapiens; identical to SEQ ID NO: 269643

SEQ ID NO: 598412 - RNA, 64 nt, Homo Sapiens; identical to SEQ ID NO: 269644

SEQ ID NO: 598413 - RNA, 64 nt, Homo Sapiens; identical to SEQ ID NO: 269645

SEQ ID NO: 598414 - RNA, 64 nt, Homo Sapiens; identical to SEQ ID NO: 269646

SEQ ID NO: 598415 - RNA, 64 nt, Homo Sapiens; identical to SEQ ID NO: 269647

SEQ ID NO: 598416 - RNA, 64 nt, Homo Sapiens; identical to SEQ ID NO: 269648

SEQ ID NO: 598417 - RNA, 64 nt, Homo Sapiens; identical to SEQ ID NO: 269649

SEQ ID NO: 598418 - RNA, 64 nt, Homo Sapiens; identical to SEQ ID NO: 269650

SEQ ID NO: 598419 - RNA, 64 nt, Homo Sapiens; identical to SEQ ID NO: 269651

SEQ ID NO: 598420 - RNA, 64 nt, Homo Sapiens; identical to SEQ ID NO: 269652

SEQ ID NO: 598421 - RNA, 64 nt, Homo Sapiens; identical to SEQ ID NO: 269653

SEQ ID NO: 598422 - RNA, 64 nt, Homo Sapiens; identical to SEQ ID NO: 269654

SEQ ID NO: 598423 - RNA, 64 nt, Homo Sapiens; identical to SEQ ID NO: 269655

SEQ ID NO: 598424 - RNA, 64 nt, Homo Sapiens; identical to SEQ ID NO: 269656

SEQ ID NO: 598425 - RNA, 64 nt, Homo Sapiens; identical to SEQ ID NO: 269657

SEQ ID NO: 598426 - RNA, 64 nt, Homo Sapiens; identical to SEQ ID NO: 269658

SEQ ID NO: 598427 - RNA, 64 nt, Homo Sapiens; identical to SEQ ID NO: 269659

SEQ ID NO: 598428 - RNA, 64 nt, Homo Sapiens; identical to SEQ ID NO: 269660

SEQ ID NO: 598429 - RNA, 64 nt, Homo Sapiens; identical to SEQ ID NO: 269661

SEQ ID NO: 598430 - RNA, 64 nt, Homo Sapiens; identical to SEQ ID NO: 269662

SEQ ID NO: 598431 - RNA, 64 nt, Homo Sapiens; identical to SEQ ID NO: 269663

SEQ ID NO: 598432 - RNA, 64 nt, Homo Sapiens; identical to SEQ ID NO: 269664

SEQ ID NO: 598433 - RNA, 64 nt, Homo Sapiens; identical to SEQ ID NO: 269665

SEQ ID NO: 598434 - RNA, 64 nt, Homo Sapiens; identical to SEQ ID NO: 269666

SEQ ID NO: 598435 - RNA, 64 nt, Homo Sapiens; identical to SEQ ID NO: 269667

SEQ ID NO: 598436 - RNA, 64 nt, Homo Sapiens; identical to SEQ ID NO: 269668

SEQ ID NO: 598437 - RNA, 64 nt, Homo Sapiens; identical to SEQ ID NO: 269669

SEQ ID NO: 598438 - RNA, 64 nt, Homo Sapiens; identical to SEQ ID NO: 269670

SEQ ID NO: 598439 - RNA, 64 nt, Homo Sapiens; identical to SEQ ID NO: 269671

SEQ ID NO: 598440 - RNA, 64 nt, Homo Sapiens; identical to SEQ ID NO: 269672

SEQ ID NO: 598441 - RNA, 64 nt, Homo Sapiens; identical to SEQ ID NO: 269673

SEQ ID NO: 598442 - RNA, 64 nt, Homo Sapiens; identical to SEQ ID NO: 269674

SEQ ID NO: 598443 - RNA, 64 nt, Homo Sapiens; identical to SEQ ID NO: 269675

SEQ ID NO: 598444 - RNA, 64 nt, Homo Sapiens; identical to SEQ ID NO: 269676

SEQ ID NO: 598445 - RNA, 64 nt, Homo Sapiens; identical to SEQ ID NO: 269677

SEQ ID NO: 598446 - RNA, 64 nt, Homo Sapiens; identical to SEQ ID NO: 269678

SEQ ID NO: 598447 - RNA, 64 nt, Homo Sapiens; identical to SEQ ID NO: 269679

SEQ ID NO: 598448 - RNA, 64 nt, Homo Sapiens; identical to SEQ ID NO: 269680

SEQ ID NO: 598449 - RNA, 64 nt, Homo Sapiens; identical to SEQ ID NO: 269681

SEQ ID NO: 598450 - RNA, 64 nt, Homo Sapiens; identical to SEQ ID NO: 269682

SEQ ID NO: 598451 - RNA, 64 nt, Homo Sapiens; identical to SEQ ID NO: 269683

SEQ ID NO: 598452 - RNA, 64 nt, Homo Sapiens; identical to SEQ ID NO: 269684

SEQ ID NO: 598453 - RNA, 64 nt, Homo Sapiens; identical to SEQ ID NO: 269685

SEQ ID NO: 598454 - RNA, 64 nt, Homo Sapiens; identical to SEQ ID NO: 269686

SEQ ID NO: 598455 - RNA, 64 nt, Homo Sapiens; identical to SEQ ID NO: 269687

SEQ ID NO: 598456 - RNA, 64 nt, Homo Sapiens; identical to SEQ ID NO: 269688

SEQ ID NO: 598457 - RNA, 64 nt, Homo Sapiens; identical to SEQ ID NO: 269689

SEQ ID NO: 598458 - RNA, 64 nt, Homo Sapiens; identical to SEQ ID NO: 269690

SEQ ID NO: 598459 - RNA, 64 nt, Homo Sapiens; identical to SEQ ID NO: 269691

SEQ ID NO: 598460 - RNA, 64 nt, Homo Sapiens; identical to SEQ ID NO: 269692

SEQ ID NO: 598461 - RNA, 64 nt, Homo Sapiens; identical to SEQ ID NO: 269693

SEQ ID NO: 598462 - RNA, 64 nt, Homo Sapiens; identical to SEQ ID NO: 269694

SEQ ID NO: 598463 - RNA, 64 nt, Homo Sapiens; identical to SEQ ID NO: 269695

SEQ ID NO: 598464 - RNA, 64 nt, Homo Sapiens; identical to SEQ ID NO: 269696

SEQ ID NO: 598465 - RNA, 64 nt, Homo Sapiens; identical to SEQ ID NO: 269697

SEQ ID NO: 598466 - RNA, 64 nt, Homo Sapiens; identical to SEQ ID NO: 269698

SEQ ID NO: 598467 - RNA, 64 nt, Homo Sapiens; identical to SEQ ID NO: 269699

SEQ ID NO: 598468 - RNA, 64 nt, Homo Sapiens; identical to SEQ ID NO: 269700

SEQ ID NO: 598469 - RNA, 64 nt, Homo Sapiens; identical to SEQ ID NO: 269701

SEQ ID NO: 598470 - RNA, 64 nt, Homo Sapiens; identical to SEQ ID NO: 269702

SEQ ID NO: 598471 - RNA, 64 nt, Homo Sapiens; identical to SEQ ID NO: 269703

SEQ ID NO: 598472 - RNA, 64 nt, Homo Sapiens; identical to SEQ ID NO: 269704

SEQ ID NO: 598473 - RNA, 64 nt, Homo Sapiens; identical to SEQ ID NO: 269705

SEQ ID NO: 598474 - RNA, 64 nt, Homo Sapiens; identical to SEQ ID NO: 269706

SEQ ID NO: 598475 - RNA, 64 nt, Homo Sapiens; identical to SEQ ID NO: 269707

SEQ ID NO: 598476 - RNA, 64 nt, Homo Sapiens; identical to SEQ ID NO: 269708

SEQ ID NO: 598477 - RNA, 64 nt, Homo Sapiens; identical to SEQ ID NO: 269709

SEQ ID NO: 598478 - RNA, 64 nt, Homo Sapiens; identical to SEQ ID NO: 269710

SEQ ID NO: 598479 - RNA, 64 nt, Homo Sapiens; identical to SEQ ID NO: 269711

SEQ ID NO: 598480 - RNA, 64 nt, Homo Sapiens; identical to SEQ ID NO: 269712

SEQ ID NO: 598481 - RNA, 64 nt, Homo Sapiens; identical to SEQ ID NO: 269713

SEQ ID NO: 598482 - RNA, 64 nt, Homo Sapiens; identical to SEQ ID NO: 269714

SEQ ID NO: 598483 - RNA, 64 nt, Homo Sapiens; identical to SEQ ID NO: 269715

SEQ ID NO: 598484 - RNA, 64 nt, Homo Sapiens; identical to SEQ ID NO: 269716

SEQ ID NO: 598485 - RNA, 64 nt, Homo Sapiens; identical to SEQ ID NO: 269717

SEQ ID NO: 598486 - RNA, 64 nt, Homo Sapiens; identical to SEQ ID NO: 269718

SEQ ID NO: 598487 - RNA, 64 nt, Homo Sapiens; identical to SEQ ID NO: 269719

SEQ ID NO: 598488 - RNA, 64 nt, Homo Sapiens; identical to SEQ ID NO: 269720

SEQ ID NO: 598489 - RNA, 64 nt, Homo Sapiens; identical to SEQ ID NO: 269721

SEQ ID NO: 598490 - RNA, 64 nt, Homo Sapiens; identical to SEQ ID NO: 269722

SEQ ID NO: 598491 - RNA, 64 nt, Homo Sapiens; identical to SEQ ID NO: 269723

SEQ ID NO: 598492 - RNA, 64 nt, Homo Sapiens; identical to SEQ ID NO: 269724

SEQ ID NO: 598493 - RNA, 64 nt, Homo Sapiens; identical to SEQ ID NO: 269725

SEQ ID NO: 598494 - RNA, 64 nt, Homo Sapiens; identical to SEQ ID NO: 269726

SEQ ID NO: 598495 - RNA, 64 nt, Homo Sapiens; identical to SEQ ID NO: 269727

SEQ ID NO: 598496 - RNA, 64 nt, Homo Sapiens; identical to SEQ ID NO: 269728

SEQ ID NO: 598497 - RNA, 64 nt, Homo Sapiens; identical to SEQ ID NO: 269729

SEQ ID NO: 598498 - RNA, 64 nt, Homo Sapiens; identical to SEQ ID NO: 269730

SEQ ID NO: 598499 - RNA, 64 nt, Homo Sapiens; identical to SEQ ID NO: 269731

SEQ ID NO: 598500 - RNA, 64 nt, Homo Sapiens; identical to SEQ ID NO: 269732

SEQ ID NO: 598501 - RNA, 64 nt, Homo Sapiens; identical to SEQ ID NO: 269733

SEQ ID NO: 598502 - RNA, 64 nt, Homo Sapiens; identical to SEQ ID NO: 269734

SEQ ID NO: 598503 - RNA, 64 nt, Homo Sapiens; identical to SEQ ID NO: 269735

SEQ ID NO: 598504 - RNA, 64 nt, Homo Sapiens; identical to SEQ ID NO: 269736

SEQ ID NO: 598505 - RNA, 64 nt, Homo Sapiens; identical to SEQ ID NO: 269737

SEQ ID NO: 598506 - RNA, 64 nt, Homo Sapiens; identical to SEQ ID NO: 269738

SEQ ID NO: 598507 - RNA, 64 nt, Homo Sapiens; identical to SEQ ID NO: 269739

SEQ ID NO: 598508 - RNA, 64 nt, Homo Sapiens; identical to SEQ ID NO: 269740

SEQ ID NO: 598509 - RNA, 64 nt, Homo Sapiens; identical to SEQ ID NO: 269741

SEQ ID NO: 598510 - RNA, 64 nt, Homo Sapiens; identical to SEQ ID NO: 269742

SEQ ID NO: 598511 - RNA, 64 nt, Homo Sapiens; identical to SEQ ID NO: 269743

SEQ ID NO: 598512 - RNA, 64 nt, Homo Sapiens; identical to SEQ ID NO: 269744

SEQ ID NO: 598513 - RNA, 64 nt, Homo Sapiens; identical to SEQ ID NO: 269745

SEQ ID NO: 598514 - RNA, 64 nt, Homo Sapiens; identical to SEQ ID NO: 269746

SEQ ID NO: 598515 - RNA, 64 nt, Homo Sapiens; identical to SEQ ID NO: 269747

SEQ ID NO: 598516 - RNA, 64 nt, Homo Sapiens; identical to SEQ ID NO: 269748

SEQ ID NO: 598517 - RNA, 64 nt, Homo Sapiens; identical to SEQ ID NO: 269749

SEQ ID NO: 598518 - RNA, 64 nt, Homo Sapiens; identical to SEQ ID NO: 269750

SEQ ID NO: 598519 - RNA, 64 nt, Homo Sapiens; identical to SEQ ID NO: 269751

SEQ ID NO: 598520 - RNA, 64 nt, Homo Sapiens; identical to SEQ ID NO: 269752

SEQ ID NO: 598521 - RNA, 64 nt, Homo Sapiens; identical to SEQ ID NO: 269753

SEQ ID NO: 598522 - RNA, 64 nt, Homo Sapiens; identical to SEQ ID NO: 269754

SEQ ID NO: 598523 - RNA, 64 nt, Homo Sapiens; identical to SEQ ID NO: 269755

SEQ ID NO: 598524 - RNA, 64 nt, Homo Sapiens; identical to SEQ ID NO: 269756

SEQ ID NO: 598525 - RNA, 64 nt, Homo Sapiens; identical to SEQ ID NO: 269757

SEQ ID NO: 598526 - RNA, 64 nt, Homo Sapiens; identical to SEQ ID NO: 269758

SEQ ID NO: 598527 - RNA, 64 nt, Homo Sapiens; identical to SEQ ID NO: 269759

SEQ ID NO: 598528 - RNA, 64 nt, Homo Sapiens; identical to SEQ ID NO: 269760

SEQ ID NO: 598529 - RNA, 64 nt, Homo Sapiens; identical to SEQ ID NO: 269761

SEQ ID NO: 598530 - RNA, 64 nt, Homo Sapiens; identical to SEQ ID NO: 269762

SEQ ID NO: 598531 - RNA, 64 nt, Homo Sapiens; identical to SEQ ID NO: 269763

SEQ ID NO: 598532 - RNA, 64 nt, Homo Sapiens; identical to SEQ ID NO: 269764

SEQ ID NO: 598533 - RNA, 64 nt, Homo Sapiens; identical to SEQ ID NO: 269765

SEQ ID NO: 598534 - RNA, 64 nt, Homo Sapiens; identical to SEQ ID NO: 269766

SEQ ID NO: 598535 - RNA, 64 nt, Homo Sapiens; identical to SEQ ID NO: 269767

SEQ ID NO: 598536 - RNA, 64 nt, Homo Sapiens; identical to SEQ ID NO: 269768

SEQ ID NO: 598537 - RNA, 64 nt, Homo Sapiens; identical to SEQ ID NO: 269769

SEQ ID NO: 598538 - RNA, 64 nt, Homo Sapiens; identical to SEQ ID NO: 269770

SEQ ID NO: 598539 - RNA, 64 nt, Homo Sapiens; identical to SEQ ID NO: 269771

SEQ ID NO: 598540 - RNA, 64 nt, Homo Sapiens; identical to SEQ ID NO: 269772

SEQ ID NO: 598541 - RNA, 64 nt, Homo Sapiens; identical to SEQ ID NO: 269773

SEQ ID NO: 598542 - RNA, 64 nt, Homo Sapiens; identical to SEQ ID NO: 269774

SEQ ID NO: 598543 - RNA, 64 nt, Homo Sapiens; identical to SEQ ID NO: 269775

SEQ ID NO: 598544 - RNA, 64 nt, Homo Sapiens; identical to SEQ ID NO: 269776

SEQ ID NO: 598545 - RNA, 64 nt, Homo Sapiens; identical to SEQ ID NO: 269777

SEQ ID NO: 598546 - RNA, 64 nt, Homo Sapiens; identical to SEQ ID NO: 269778

SEQ ID NO: 598547 - RNA, 64 nt, Homo Sapiens; identical to SEQ ID NO: 269779

SEQ ID NO: 598548 - RNA, 64 nt, Homo Sapiens; identical to SEQ ID NO: 269780

SEQ ID NO: 598549 - RNA, 64 nt, Homo Sapiens; identical to SEQ ID NO: 269781

SEQ ID NO: 598550 - RNA, 64 nt, Homo Sapiens; identical to SEQ ID NO: 269782

SEQ ID NO: 598551 - RNA, 64 nt, Homo Sapiens; identical to SEQ ID NO: 269783

SEQ ID NO: 598552 - RNA, 64 nt, Homo Sapiens; identical to SEQ ID NO: 269784

SEQ ID NO: 598553 - RNA, 64 nt, Homo Sapiens; identical to SEQ ID NO: 269785

SEQ ID NO: 598554 - RNA, 64 nt, Homo Sapiens; identical to SEQ ID NO: 269786

SEQ ID NO: 598555 - RNA, 64 nt, Homo Sapiens; identical to SEQ ID NO: 269787

SEQ ID NO: 598556 - RNA, 64 nt, Homo Sapiens; identical to SEQ ID NO: 269788

SEQ ID NO: 598557 - RNA, 64 nt, Homo Sapiens; identical to SEQ ID NO: 269789

SEQ ID NO: 598558 - RNA, 64 nt, Homo Sapiens; identical to SEQ ID NO: 269790

SEQ ID NO: 598559 - RNA, 64 nt, Homo Sapiens; identical to SEQ ID NO: 269791

SEQ ID NO: 598560 - RNA, 64 nt, Homo Sapiens; identical to SEQ ID NO: 269792

SEQ ID NO: 598561 - RNA, 64 nt, Homo Sapiens; identical to SEQ ID NO: 269793

SEQ ID NO: 598562 - RNA, 64 nt, Homo Sapiens; identical to SEQ ID NO: 269794

SEQ ID NO: 598563 - RNA, 64 nt, Homo Sapiens; identical to SEQ ID NO: 269795

SEQ ID NO: 598564 - RNA, 64 nt, Homo Sapiens; identical to SEQ ID NO: 269796

SEQ ID NO: 598565 - RNA, 64 nt, Homo Sapiens; identical to SEQ ID NO: 269797

SEQ ID NO: 598566 - RNA, 64 nt, Homo Sapiens; identical to SEQ ID NO: 269798

SEQ ID NO: 598567 - RNA, 64 nt, Homo Sapiens; identical to SEQ ID NO: 269799

SEQ ID NO: 598568 - RNA, 64 nt, Homo Sapiens; identical to SEQ ID NO: 269800

SEQ ID NO: 598569 - RNA, 64 nt, Homo Sapiens; identical to SEQ ID NO: 269801

SEQ ID NO: 598570 - RNA, 64 nt, Homo Sapiens; identical to SEQ ID NO: 269802

SEQ ID NO: 598571 - RNA, 64 nt, Homo Sapiens; identical to SEQ ID NO: 269803

SEQ ID NO: 598572 - RNA, 64 nt, Homo Sapiens; identical to SEQ ID NO: 269804

SEQ ID NO: 598573 - RNA, 64 nt, Homo Sapiens; identical to SEQ ID NO: 269805

SEQ ID NO: 598574 - RNA, 64 nt, Homo Sapiens; identical to SEQ ID NO: 269806

SEQ ID NO: 598575 - RNA, 64 nt, Homo Sapiens; identical to SEQ ID NO: 269807

SEQ ID NO: 598576 - RNA, 64 nt, Homo Sapiens; identical to SEQ ID NO: 269808

SEQ ID NO: 598577 - RNA, 64 nt, Homo Sapiens; identical to SEQ ID NO: 269809

SEQ ID NO: 598578 - RNA, 64 nt, Homo Sapiens; identical to SEQ ID NO: 269810

SEQ ID NO: 598579 - RNA, 64 nt, Homo Sapiens; identical to SEQ ID NO: 269811

SEQ ID NO: 598580 - RNA, 64 nt, Homo Sapiens; identical to SEQ ID NO: 269812

SEQ ID NO: 598581 - RNA, 64 nt, Homo Sapiens; identical to SEQ ID NO: 269813

SEQ ID NO: 598582 - RNA, 64 nt, Homo Sapiens; identical to SEQ ID NO: 269814

SEQ ID NO: 598583 - RNA, 64 nt, Homo Sapiens; identical to SEQ ID NO: 269815

SEQ ID NO: 598584 - RNA, 64 nt, Homo Sapiens; identical to SEQ ID NO: 269816

SEQ ID NO: 598585 - RNA, 64 nt, Homo Sapiens; identical to SEQ ID NO: 269817

SEQ ID NO: 598586 - RNA, 64 nt, Homo Sapiens; identical to SEQ ID NO: 269818

SEQ ID NO: 598587 - RNA, 64 nt, Homo Sapiens; identical to SEQ ID NO: 269819

SEQ ID NO: 598588 - RNA, 64 nt, Homo Sapiens; identical to SEQ ID NO: 269820

SEQ ID NO: 598589 - RNA, 64 nt, Homo Sapiens; identical to SEQ ID NO: 269821

SEQ ID NO: 598590 - RNA, 64 nt, Homo Sapiens; identical to SEQ ID NO: 269822

SEQ ID NO: 598591 - RNA, 52 nt, Homo Sapiens; identical to SEQ ID NO: 269823

SEQ ID NO: 598592 - RNA, 64 nt, Homo Sapiens; identical to SEQ ID NO: 269824

SEQ ID NO: 598593 - RNA, 64 nt, Homo Sapiens; identical to SEQ ID NO: 269825

SEQ ID NO: 598594 - RNA, 64 nt, Homo Sapiens; identical to SEQ ID NO: 269826

SEQ ID NO: 598595 - RNA, 64 nt, Homo Sapiens; identical to SEQ ID NO: 269827

SEQ ID NO: 598596 - RNA, 64 nt, Homo Sapiens; identical to SEQ ID NO: 269828

SEQ ID NO: 598597 - RNA, 64 nt, Homo Sapiens; identical to SEQ ID NO: 269829

SEQ ID NO: 598598 - RNA, 64 nt, Homo Sapiens; identical to SEQ ID NO: 269830

SEQ ID NO: 598599 - RNA, 64 nt, Homo Sapiens; identical to SEQ ID NO: 269831

SEQ ID NO: 598600 - RNA, 64 nt, Homo Sapiens; identical to SEQ ID NO: 269832

SEQ ID NO: 598601 - RNA, 64 nt, Homo Sapiens; identical to SEQ ID NO: 269833

SEQ ID NO: 598602 - RNA, 64 nt, Homo Sapiens; identical to SEQ ID NO: 269834

SEQ ID NO: 598603 - RNA, 64 nt, Homo Sapiens; identical to SEQ ID NO: 269835

SEQ ID NO: 598604 - RNA, 64 nt, Homo Sapiens; identical to SEQ ID NO: 269836

SEQ ID NO: 598605 - RNA, 64 nt, Homo Sapiens; identical to SEQ ID NO: 269837

SEQ ID NO: 598606 - RNA, 64 nt, Homo Sapiens; identical to SEQ ID NO: 269838

SEQ ID NO: 598607 - RNA, 64 nt, Homo Sapiens; identical to SEQ ID NO: 269839

SEQ ID NO: 598608 - RNA, 64 nt, Homo Sapiens; identical to SEQ ID NO: 269840

SEQ ID NO: 598609 - RNA, 64 nt, Homo Sapiens; identical to SEQ ID NO: 269841

SEQ ID NO: 598610 - RNA, 64 nt, Homo Sapiens; identical to SEQ ID NO: 269842

SEQ ID NO: 598611 - RNA, 64 nt, Homo Sapiens; identical to SEQ ID NO: 269843

SEQ ID NO: 598612 - RNA, 64 nt, Homo Sapiens; identical to SEQ ID NO: 269844

SEQ ID NO: 598613 - RNA, 64 nt, Homo Sapiens; identical to SEQ ID NO: 269845

SEQ ID NO: 598614 - RNA, 64 nt, Homo Sapiens; identical to SEQ ID NO: 269846

SEQ ID NO: 598615 - RNA, 64 nt, Homo Sapiens; identical to SEQ ID NO: 269847

SEQ ID NO: 598616 - RNA, 64 nt, Homo Sapiens; identical to SEQ ID NO: 269848

SEQ ID NO: 598617 - RNA, 64 nt, Homo Sapiens; identical to SEQ ID NO: 269849

SEQ ID NO: 598618 - RNA, 64 nt, Homo Sapiens; identical to SEQ ID NO: 269850

SEQ ID NO: 598619 - RNA, 64 nt, Homo Sapiens; identical to SEQ ID NO: 269851

SEQ ID NO: 598620 - RNA, 64 nt, Homo Sapiens; identical to SEQ ID NO: 269852

SEQ ID NO: 598621 - RNA, 64 nt, Homo Sapiens; identical to SEQ ID NO: 269853

SEQ ID NO: 598622 - RNA, 64 nt, Homo Sapiens; identical to SEQ ID NO: 269854

SEQ ID NO: 598623 - RNA, 64 nt, Homo Sapiens; identical to SEQ ID NO: 269855

SEQ ID NO: 598624 - RNA, 64 nt, Homo Sapiens; identical to SEQ ID NO: 269856

SEQ ID NO: 598625 - RNA, 64 nt, Homo Sapiens; identical to SEQ ID NO: 269857

SEQ ID NO: 598626 - RNA, 64 nt, Homo Sapiens; identical to SEQ ID NO: 269858

SEQ ID NO: 598627 - RNA, 64 nt, Homo Sapiens; identical to SEQ ID NO: 269859

SEQ ID NO: 598628 - RNA, 64 nt, Homo Sapiens; identical to SEQ ID NO: 269860

SEQ ID NO: 598629 - RNA, 64 nt, Homo Sapiens; identical to SEQ ID NO: 269861

SEQ ID NO: 598630 - RNA, 64 nt, Homo Sapiens; identical to SEQ ID NO: 269862

SEQ ID NO: 598631 - RNA, 64 nt, Homo Sapiens; identical to SEQ ID NO: 269863

SEQ ID NO: 598632 - RNA, 64 nt, Homo Sapiens; identical to SEQ ID NO: 269864

SEQ ID NO: 598633 - RNA, 64 nt, Homo Sapiens; identical to SEQ ID NO: 269865

SEQ ID NO: 598634 - RNA, 64 nt, Homo Sapiens; identical to SEQ ID NO: 269866

SEQ ID NO: 598635 - RNA, 64 nt, Homo Sapiens; identical to SEQ ID NO: 269867

SEQ ID NO: 598636 - RNA, 64 nt, Homo Sapiens; identical to SEQ ID NO: 269868

SEQ ID NO: 598637 - RNA, 64 nt, Homo Sapiens; identical to SEQ ID NO: 269869

SEQ ID NO: 598638 - RNA, 64 nt, Homo Sapiens; identical to SEQ ID NO: 269870

SEQ ID NO: 598639 - RNA, 64 nt, Homo Sapiens; identical to SEQ ID NO: 269871

SEQ ID NO: 598640 - RNA, 64 nt, Homo Sapiens; identical to SEQ ID NO: 269872

SEQ ID NO: 598641 - RNA, 64 nt, Homo Sapiens; identical to SEQ ID NO: 269873

SEQ ID NO: 598642 - RNA, 64 nt, Homo Sapiens; identical to SEQ ID NO: 269874

SEQ ID NO: 598643 - RNA, 64 nt, Homo Sapiens; identical to SEQ ID NO: 269875

SEQ ID NO: 598644 - RNA, 64 nt, Homo Sapiens; identical to SEQ ID NO: 269876

SEQ ID NO: 598645 - RNA, 64 nt, Homo Sapiens; identical to SEQ ID NO: 269877

SEQ ID NO: 598646 - RNA, 64 nt, Homo Sapiens; identical to SEQ ID NO: 269878

SEQ ID NO: 598647 - RNA, 64 nt, Homo Sapiens; identical to SEQ ID NO: 269879

SEQ ID NO: 598648 - RNA, 64 nt, Homo Sapiens; identical to SEQ ID NO: 269880

SEQ ID NO: 598649 - RNA, 64 nt, Homo Sapiens; identical to SEQ ID NO: 269881

SEQ ID NO: 598650 - RNA, 64 nt, Homo Sapiens; identical to SEQ ID NO: 269882

SEQ ID NO: 598651 - RNA, 64 nt, Homo Sapiens; identical to SEQ ID NO: 269883

SEQ ID NO: 598652 - RNA, 64 nt, Homo Sapiens; identical to SEQ ID NO: 269884

SEQ ID NO: 598653 - RNA, 64 nt, Homo Sapiens; identical to SEQ ID NO: 269885

SEQ ID NO: 598654 - RNA, 64 nt, Homo Sapiens; identical to SEQ ID NO: 269886

SEQ ID NO: 598655 - RNA, 64 nt, Homo Sapiens; identical to SEQ ID NO: 269887

SEQ ID NO: 598656 - RNA, 64 nt, Homo Sapiens; identical to SEQ ID NO: 269888

SEQ ID NO: 598657 - RNA, 64 nt, Homo Sapiens; identical to SEQ ID NO: 269889

SEQ ID NO: 598658 - RNA, 64 nt, Homo Sapiens; identical to SEQ ID NO: 269890

SEQ ID NO: 598659 - RNA, 64 nt, Homo Sapiens; identical to SEQ ID NO: 269891

SEQ ID NO: 598660 - RNA, 64 nt, Homo Sapiens; identical to SEQ ID NO: 269892

SEQ ID NO: 598661 - RNA, 64 nt, Homo Sapiens; identical to SEQ ID NO: 269893

SEQ ID NO: 598662 - RNA, 64 nt, Homo Sapiens; identical to SEQ ID NO: 269894

SEQ ID NO: 598663 - RNA, 64 nt, Homo Sapiens; identical to SEQ ID NO: 269895

SEQ ID NO: 598664 - RNA, 64 nt, Homo Sapiens; identical to SEQ ID NO: 269896

SEQ ID NO: 598665 - RNA, 64 nt, Homo Sapiens; identical to SEQ ID NO: 269897

SEQ ID NO: 598666 - RNA, 64 nt, Homo Sapiens; identical to SEQ ID NO: 269898

SEQ ID NO: 598667 - RNA, 64 nt, Homo Sapiens; identical to SEQ ID NO: 269899

SEQ ID NO: 598668 - RNA, 64 nt, Homo Sapiens; identical to SEQ ID NO: 269900

SEQ ID NO: 598669 - RNA, 64 nt, Homo Sapiens; identical to SEQ ID NO: 269901

SEQ ID NO: 598670 - RNA, 64 nt, Homo Sapiens; identical to SEQ ID NO: 269902

SEQ ID NO: 598671 - RNA, 64 nt, Homo Sapiens; identical to SEQ ID NO: 269903

SEQ ID NO: 598672 - RNA, 64 nt, Homo Sapiens; identical to SEQ ID NO: 269904

SEQ ID NO: 598673 - RNA, 64 nt, Homo Sapiens; identical to SEQ ID NO: 269905

SEQ ID NO: 598674 - RNA, 64 nt, Homo Sapiens; identical to SEQ ID NO: 269906

SEQ ID NO: 598675 - RNA, 64 nt, Homo Sapiens; identical to SEQ ID NO: 269907

SEQ ID NO: 598676 - RNA, 64 nt, Homo Sapiens; identical to SEQ ID NO: 269908

SEQ ID NO: 598677 - RNA, 64 nt, Homo Sapiens; identical to SEQ ID NO: 269909

SEQ ID NO: 598678 - RNA, 64 nt, Homo Sapiens; identical to SEQ ID NO: 269910

SEQ ID NO: 598679 - RNA, 64 nt, Homo Sapiens; identical to SEQ ID NO: 269911

SEQ ID NO: 598680 - RNA, 64 nt, Homo Sapiens; identical to SEQ ID NO: 269912

SEQ ID NO: 598681 - RNA, 64 nt, Homo Sapiens; identical to SEQ ID NO: 269913

SEQ ID NO: 598682 - RNA, 64 nt, Homo Sapiens; identical to SEQ ID NO: 269914

SEQ ID NO: 598683 - RNA, 64 nt, Homo Sapiens; identical to SEQ ID NO: 269915

SEQ ID NO: 598684 - RNA, 64 nt, Homo Sapiens; identical to SEQ ID NO: 269916

SEQ ID NO: 598685 - RNA, 64 nt, Homo Sapiens; identical to SEQ ID NO: 269917

SEQ ID NO: 598686 - RNA, 64 nt, Homo Sapiens; identical to SEQ ID NO: 269918

SEQ ID NO: 598687 - RNA, 64 nt, Homo Sapiens; identical to SEQ ID NO: 269919

SEQ ID NO: 598688 - RNA, 64 nt, Homo Sapiens; identical to SEQ ID NO: 269920

SEQ ID NO: 598689 - RNA, 64 nt, Homo Sapiens; identical to SEQ ID NO: 269921

SEQ ID NO: 598690 - RNA, 64 nt, Homo Sapiens; identical to SEQ ID NO: 269922

SEQ ID NO: 598691 - RNA, 64 nt, Homo Sapiens; identical to SEQ ID NO: 269923

SEQ ID NO: 598692 - RNA, 64 nt, Homo Sapiens; identical to SEQ ID NO: 269924

SEQ ID NO: 598693 - RNA, 64 nt, Homo Sapiens; identical to SEQ ID NO: 269925

SEQ ID NO: 598694 - RNA, 64 nt, Homo Sapiens; identical to SEQ ID NO: 269926

SEQ ID NO: 598695 - RNA, 64 nt, Homo Sapiens; identical to SEQ ID NO: 269927

SEQ ID NO: 598696 - RNA, 64 nt, Homo Sapiens; identical to SEQ ID NO: 269928

SEQ ID NO: 598697 - RNA, 64 nt, Homo Sapiens; identical to SEQ ID NO: 269929

SEQ ID NO: 598698 - RNA, 64 nt, Homo Sapiens; identical to SEQ ID NO: 269930

SEQ ID NO: 598699 - RNA, 64 nt, Homo Sapiens; identical to SEQ ID NO: 269931

SEQ ID NO: 598700 - RNA, 64 nt, Homo Sapiens; identical to SEQ ID NO: 269932

SEQ ID NO: 598701 - RNA, 64 nt, Homo Sapiens; identical to SEQ ID NO: 269933

SEQ ID NO: 598702 - RNA, 64 nt, Homo Sapiens; identical to SEQ ID NO: 269934

SEQ ID NO: 598703 - RNA, 64 nt, Homo Sapiens; identical to SEQ ID NO: 269935

SEQ ID NO: 598704 - RNA, 64 nt, Homo Sapiens; identical to SEQ ID NO: 269936

SEQ ID NO: 598705 - RNA, 64 nt, Homo Sapiens; identical to SEQ ID NO: 269937

SEQ ID NO: 598706 - RNA, 64 nt, Homo Sapiens; identical to SEQ ID NO: 269938

SEQ ID NO: 598707 - RNA, 64 nt, Homo Sapiens; identical to SEQ ID NO: 269939

SEQ ID NO: 598708 - RNA, 64 nt, Homo Sapiens; identical to SEQ ID NO: 269940

SEQ ID NO: 598709 - RNA, 64 nt, Homo Sapiens; identical to SEQ ID NO: 269941

SEQ ID NO: 598710 - RNA, 64 nt, Homo Sapiens; identical to SEQ ID NO: 269942

SEQ ID NO: 598711 - RNA, 64 nt, Homo Sapiens; identical to SEQ ID NO: 269943

SEQ ID NO: 598712 - RNA, 64 nt, Homo Sapiens; identical to SEQ ID NO: 269944

SEQ ID NO: 598713 - RNA, 64 nt, Homo Sapiens; identical to SEQ ID NO: 269945

SEQ ID NO: 598714 - RNA, 64 nt, Homo Sapiens; identical to SEQ ID NO: 269946

SEQ ID NO: 598715 - RNA, 64 nt, Homo Sapiens; identical to SEQ ID NO: 269947

SEQ ID NO: 598716 - RNA, 64 nt, Homo Sapiens; identical to SEQ ID NO: 269948

SEQ ID NO: 598717 - RNA, 64 nt, Homo Sapiens; identical to SEQ ID NO: 269949

SEQ ID NO: 598718 - RNA, 64 nt, Homo Sapiens; identical to SEQ ID NO: 269950

SEQ ID NO: 598719 - RNA, 64 nt, Homo Sapiens; identical to SEQ ID NO: 269951

SEQ ID NO: 598720 - RNA, 64 nt, Homo Sapiens; identical to SEQ ID NO: 269952

SEQ ID NO: 598721 - RNA, 64 nt, Homo Sapiens; identical to SEQ ID NO: 269953

SEQ ID NO: 598722 - RNA, 64 nt, Homo Sapiens; identical to SEQ ID NO: 269954

SEQ ID NO: 598723 - RNA, 64 nt, Homo Sapiens; identical to SEQ ID NO: 269955

SEQ ID NO: 598724 - RNA, 64 nt, Homo Sapiens; identical to SEQ ID NO: 269956

SEQ ID NO: 598725 - RNA, 64 nt, Homo Sapiens; identical to SEQ ID NO: 269957

SEQ ID NO: 598726 - RNA, 64 nt, Homo Sapiens; identical to SEQ ID NO: 269958

SEQ ID NO: 598727 - RNA, 64 nt, Homo Sapiens; identical to SEQ ID NO: 269959

SEQ ID NO: 598728 - RNA, 64 nt, Homo Sapiens; identical to SEQ ID NO: 269960

SEQ ID NO: 598729 - RNA, 64 nt, Homo Sapiens; identical to SEQ ID NO: 269961

SEQ ID NO: 598730 - RNA, 64 nt, Homo Sapiens; identical to SEQ ID NO: 269962

SEQ ID NO: 598731 - RNA, 64 nt, Homo Sapiens; identical to SEQ ID NO: 269963

SEQ ID NO: 598732 - RNA, 64 nt, Homo Sapiens; identical to SEQ ID NO: 269964

SEQ ID NO: 598733 - RNA, 64 nt, Homo Sapiens; identical to SEQ ID NO: 269965

SEQ ID NO: 598734 - RNA, 64 nt, Homo Sapiens; identical to SEQ ID NO: 269966

SEQ ID NO: 598735 - RNA, 64 nt, Homo Sapiens; identical to SEQ ID NO: 269967

SEQ ID NO: 598736 - RNA, 64 nt, Homo Sapiens; identical to SEQ ID NO: 269968

SEQ ID NO: 598737 - RNA, 64 nt, Homo Sapiens; identical to SEQ ID NO: 269969

SEQ ID NO: 598738 - RNA, 64 nt, Homo Sapiens; identical to SEQ ID NO: 269970

SEQ ID NO: 598739 - RNA, 64 nt, Homo Sapiens; identical to SEQ ID NO: 269971

SEQ ID NO: 598740 - RNA, 64 nt, Homo Sapiens; identical to SEQ ID NO: 269972

SEQ ID NO: 598741 - RNA, 64 nt, Homo Sapiens; identical to SEQ ID NO: 269973

SEQ ID NO: 598742 - RNA, 64 nt, Homo Sapiens; identical to SEQ ID NO: 269974

SEQ ID NO: 598743 - RNA, 64 nt, Homo Sapiens; identical to SEQ ID NO: 269975

SEQ ID NO: 598744 - RNA, 64 nt, Homo Sapiens; identical to SEQ ID NO: 269976

SEQ ID NO: 598745 - RNA, 64 nt, Homo Sapiens; identical to SEQ ID NO: 269977

SEQ ID NO: 598746 - RNA, 64 nt, Homo Sapiens; identical to SEQ ID NO: 269978

SEQ ID NO: 598747 - RNA, 64 nt, Homo Sapiens; identical to SEQ ID NO: 269979

SEQ ID NO: 598748 - RNA, 64 nt, Homo Sapiens; identical to SEQ ID NO: 269980

SEQ ID NO: 598749 - RNA, 64 nt, Homo Sapiens; identical to SEQ ID NO: 269981

SEQ ID NO: 598750 - RNA, 64 nt, Homo Sapiens; identical to SEQ ID NO: 269982

SEQ ID NO: 598751 - RNA, 64 nt, Homo Sapiens; identical to SEQ ID NO: 269983

SEQ ID NO: 598752 - RNA, 64 nt, Homo Sapiens; identical to SEQ ID NO: 269984

SEQ ID NO: 598753 - RNA, 64 nt, Homo Sapiens; identical to SEQ ID NO: 269985

SEQ ID NO: 598754 - RNA, 64 nt, Homo Sapiens; identical to SEQ ID NO: 269986

SEQ ID NO: 598755 - RNA, 64 nt, Homo Sapiens; identical to SEQ ID NO: 269987

SEQ ID NO: 598756 - RNA, 64 nt, Homo Sapiens; identical to SEQ ID NO: 269988

SEQ ID NO: 598757 - RNA, 64 nt, Homo Sapiens; identical to SEQ ID NO: 269989

SEQ ID NO: 598758 - RNA, 64 nt, Homo Sapiens; identical to SEQ ID NO: 269990

SEQ ID NO: 598759 - RNA, 64 nt, Homo Sapiens; identical to SEQ ID NO: 269991

SEQ ID NO: 598760 - RNA, 64 nt, Homo Sapiens; identical to SEQ ID NO: 269992

SEQ ID NO: 598761 - RNA, 64 nt, Homo Sapiens; identical to SEQ ID NO: 269993

SEQ ID NO: 598762 - RNA, 64 nt, Homo Sapiens; identical to SEQ ID NO: 269994

SEQ ID NO: 598763 - RNA, 64 nt, Homo Sapiens; identical to SEQ ID NO: 269995

SEQ ID NO: 598764 - RNA, 64 nt, Homo Sapiens; identical to SEQ ID NO: 269996

SEQ ID NO: 598765 - RNA, 64 nt, Homo Sapiens; identical to SEQ ID NO: 269997

SEQ ID NO: 598766 - RNA, 64 nt, Homo Sapiens; identical to SEQ ID NO: 269998

SEQ ID NO: 598767 - RNA, 64 nt, Homo Sapiens; identical to SEQ ID NO: 269999

SEQ ID NO: 598768 - RNA, 64 nt, Homo Sapiens; identical to SEQ ID NO: 270000

SEQ ID NO: 598769 - RNA, 64 nt, Homo Sapiens; identical to SEQ ID NO: 270001

SEQ ID NO: 598770 - RNA, 64 nt, Homo Sapiens; identical to SEQ ID NO: 270002

SEQ ID NO: 598771 - RNA, 59 nt, Homo Sapiens; identical to SEQ ID NO: 270003

SEQ ID NO: 598772 - RNA, 64 nt, Homo Sapiens; identical to SEQ ID NO: 270004

SEQ ID NO: 598773 - RNA, 64 nt, Homo Sapiens; identical to SEQ ID NO: 270005

SEQ ID NO: 598774 - RNA, 64 nt, Homo Sapiens; identical to SEQ ID NO: 270006

SEQ ID NO: 598775 - RNA, 64 nt, Homo Sapiens; identical to SEQ ID NO: 270007

SEQ ID NO: 598776 - RNA, 64 nt, Homo Sapiens; identical to SEQ ID NO: 270008

SEQ ID NO: 598777 - RNA, 64 nt, Homo Sapiens; identical to SEQ ID NO: 270009

SEQ ID NO: 598778 - RNA, 64 nt, Homo Sapiens; identical to SEQ ID NO: 270010

SEQ ID NO: 598779 - RNA, 64 nt, Homo Sapiens; identical to SEQ ID NO: 270011

SEQ ID NO: 598780 - RNA, 64 nt, Homo Sapiens; identical to SEQ ID NO: 270012

SEQ ID NO: 598781 - RNA, 64 nt, Homo Sapiens; identical to SEQ ID NO: 270013

SEQ ID NO: 598782 - RNA, 64 nt, Homo Sapiens; identical to SEQ ID NO: 270014

SEQ ID NO: 598783 - RNA, 64 nt, Homo Sapiens; identical to SEQ ID NO: 270015

SEQ ID NO: 598784 - RNA, 64 nt, Homo Sapiens; identical to SEQ ID NO: 270016

SEQ ID NO: 598785 - RNA, 64 nt, Homo Sapiens; identical to SEQ ID NO: 270017

SEQ ID NO: 598786 - RNA, 64 nt, Homo Sapiens; identical to SEQ ID NO: 270018

SEQ ID NO: 598787 - RNA, 64 nt, Homo Sapiens; identical to SEQ ID NO: 270019

SEQ ID NO: 598788 - RNA, 64 nt, Homo Sapiens; identical to SEQ ID NO: 270020

SEQ ID NO: 598789 - RNA, 64 nt, Homo Sapiens; identical to SEQ ID NO: 270021

SEQ ID NO: 598790 - RNA, 64 nt, Homo Sapiens; identical to SEQ ID NO: 270022

SEQ ID NO: 598791 - RNA, 64 nt, Homo Sapiens; identical to SEQ ID NO: 270023

SEQ ID NO: 598792 - RNA, 64 nt, Homo Sapiens; identical to SEQ ID NO: 270024

SEQ ID NO: 598793 - RNA, 64 nt, Homo Sapiens; identical to SEQ ID NO: 270025

SEQ ID NO: 598794 - RNA, 64 nt, Homo Sapiens; identical to SEQ ID NO: 270026

SEQ ID NO: 598795 - RNA, 64 nt, Homo Sapiens; identical to SEQ ID NO: 270027

SEQ ID NO: 598796 - RNA, 64 nt, Homo Sapiens; identical to SEQ ID NO: 270028

SEQ ID NO: 598797 - RNA, 64 nt, Homo Sapiens; identical to SEQ ID NO: 270029

SEQ ID NO: 598798 - RNA, 64 nt, Homo Sapiens; identical to SEQ ID NO: 270030

SEQ ID NO: 598799 - RNA, 64 nt, Homo Sapiens; identical to SEQ ID NO: 270031

SEQ ID NO: 598800 - RNA, 64 nt, Homo Sapiens; identical to SEQ ID NO: 270032

SEQ ID NO: 598801 - RNA, 64 nt, Homo Sapiens; identical to SEQ ID NO: 270033

SEQ ID NO: 598802 - RNA, 64 nt, Homo Sapiens; identical to SEQ ID NO: 270034

SEQ ID NO: 598803 - RNA, 64 nt, Homo Sapiens; identical to SEQ ID NO: 270035

SEQ ID NO: 598804 - RNA, 64 nt, Homo Sapiens; identical to SEQ ID NO: 270036

SEQ ID NO: 598805 - RNA, 64 nt, Homo Sapiens; identical to SEQ ID NO: 269952

SEQ ID NO: 598806 - RNA, 64 nt, Homo Sapiens; identical to SEQ ID NO: 270038

SEQ ID NO: 598807 - RNA, 64 nt, Homo Sapiens; identical to SEQ ID NO: 270039

SEQ ID NO: 598808 - RNA, 64 nt, Homo Sapiens; identical to SEQ ID NO: 270040

SEQ ID NO: 598809 - RNA, 64 nt, Homo Sapiens; identical to SEQ ID NO: 270041

SEQ ID NO: 598810 - RNA, 64 nt, Homo Sapiens; identical to SEQ ID NO: 270042

SEQ ID NO: 598811 - RNA, 64 nt, Homo Sapiens; identical to SEQ ID NO: 270043

SEQ ID NO: 598812 - RNA, 64 nt, Homo Sapiens; identical to SEQ ID NO: 270044

SEQ ID NO: 598813 - RNA, 64 nt, Homo Sapiens; identical to SEQ ID NO: 270045

SEQ ID NO: 598814 - RNA, 64 nt, Homo Sapiens; identical to SEQ ID NO: 270042

SEQ ID NO: 598815 - RNA, 64 nt, Homo Sapiens; identical to SEQ ID NO: 270043

SEQ ID NO: 598816 - RNA, 64 nt, Homo Sapiens; identical to SEQ ID NO: 270044

SEQ ID NO: 598817 - RNA, 64 nt, Homo Sapiens; identical to SEQ ID NO: 270045

SEQ ID NO: 598818 - RNA, 64 nt, Homo Sapiens; identical to SEQ ID NO: 270050

SEQ ID NO: 598819 - RNA, 64 nt, Homo Sapiens; identical to SEQ ID NO: 270051

SEQ ID NO: 598820 - RNA, 64 nt, Homo Sapiens; identical to SEQ ID NO: 270052

SEQ ID NO: 598821 - RNA, 64 nt, Homo Sapiens; identical to SEQ ID NO: 270053

SEQ ID NO: 598822 - RNA, 64 nt, Homo Sapiens; identical to SEQ ID NO: 270054

SEQ ID NO: 598823 - RNA, 64 nt, Homo Sapiens; identical to SEQ ID NO: 270055

SEQ ID NO: 598824 - RNA, 64 nt, Homo Sapiens; identical to SEQ ID NO: 125569

SEQ ID NO: 598825 - RNA, 64 nt, Homo Sapiens; identical to SEQ ID NO: 125570

SEQ ID NO: 598826 - RNA, 64 nt, Homo Sapiens; identical to SEQ ID NO: 125571

SEQ ID NO: 598827 - RNA, 64 nt, Homo Sapiens; identical to SEQ ID NO: 125572

SEQ ID NO: 598828 - RNA, 64 nt, Homo Sapiens; identical to SEQ ID NO: 125573

SEQ ID NO: 598829 - RNA, 64 nt, Homo Sapiens; identical to SEQ ID NO: 125574

SEQ ID NO: 598830 - RNA, 64 nt, Homo Sapiens; identical to SEQ ID NO: 125575

SEQ ID NO: 598831 - RNA, 64 nt, Homo Sapiens; identical to SEQ ID NO: 125576

SEQ ID NO: 598832 - RNA, 64 nt, Homo Sapiens; identical to SEQ ID NO: 125577

SEQ ID NO: 598833 - RNA, 64 nt, Homo Sapiens; identical to SEQ ID NO: 125578

SEQ ID NO: 598834 - RNA, 64 nt, Homo Sapiens; identical to SEQ ID NO: 125579

SEQ ID NO: 598835 - RNA, 64 nt, Homo Sapiens; identical to SEQ ID NO: 125580

SEQ ID NO: 598836 - RNA, 64 nt, Homo Sapiens; identical to SEQ ID NO: 125581

SEQ ID NO: 598837 - RNA, 64 nt, Homo Sapiens; identical to SEQ ID NO: 125582

SEQ ID NO: 598838 - RNA, 64 nt, Homo Sapiens; identical to SEQ ID NO: 125583

SEQ ID NO: 598839 - RNA, 64 nt, Homo Sapiens; identical to SEQ ID NO: 125584

SEQ ID NO: 598840 - RNA, 64 nt, Homo Sapiens; identical to SEQ ID NO: 125585

SEQ ID NO: 598841 - RNA, 64 nt, Homo Sapiens; identical to SEQ ID NO: 125586

SEQ ID NO: 598842 - RNA, 64 nt, Homo Sapiens; identical to SEQ ID NO: 125587

SEQ ID NO: 598843 - RNA, 64 nt, Homo Sapiens; identical to SEQ ID NO: 125588

SEQ ID NO: 598844 - RNA, 64 nt, Homo Sapiens; identical to SEQ ID NO: 125589

SEQ ID NO: 598845 - RNA, 64 nt, Homo Sapiens; identical to SEQ ID NO: 125590

SEQ ID NO: 598846 - RNA, 64 nt, Homo Sapiens; identical to SEQ ID NO: 125591

SEQ ID NO: 598847 - RNA, 64 nt, Homo Sapiens; identical to SEQ ID NO: 125592

SEQ ID NO: 598848 - RNA, 64 nt, Homo Sapiens; identical to SEQ ID NO: 125593

SEQ ID NO: 598849 - RNA, 64 nt, Homo Sapiens; identical to SEQ ID NO: 125594

SEQ ID NO: 598850 - RNA, 64 nt, Homo Sapiens; identical to SEQ ID NO: 125595

SEQ ID NO: 598851 - RNA, 64 nt, Homo Sapiens; identical to SEQ ID NO: 125596

SEQ ID NO: 598852 - RNA, 64 nt, Homo Sapiens; identical to SEQ ID NO: 125597

SEQ ID NO: 598853 - RNA, 64 nt, Homo Sapiens; identical to SEQ ID NO: 125598

SEQ ID NO: 598854 - RNA, 64 nt, Homo Sapiens; identical to SEQ ID NO: 125599

SEQ ID NO: 598855 - RNA, 64 nt, Homo Sapiens; identical to SEQ ID NO: 125600

SEQ ID NO: 598856 - RNA, 64 nt, Homo Sapiens; identical to SEQ ID NO: 125601

SEQ ID NO: 598857 - RNA, 64 nt, Homo Sapiens; identical to SEQ ID NO: 125602

SEQ ID NO: 598858 - RNA, 64 nt, Homo Sapiens; identical to SEQ ID NO: 125603

SEQ ID NO: 598859 - RNA, 64 nt, Homo Sapiens; identical to SEQ ID NO: 125604

SEQ ID NO: 598860 - RNA, 64 nt, Homo Sapiens; identical to SEQ ID NO: 125605

SEQ ID NO: 598861 - RNA, 64 nt, Homo Sapiens; identical to SEQ ID NO: 125606

SEQ ID NO: 598862 - RNA, 64 nt, Homo Sapiens; identical to SEQ ID NO: 125607

SEQ ID NO: 598863 - RNA, 64 nt, Homo Sapiens; identical to SEQ ID NO: 125608

SEQ ID NO: 598864 - RNA, 64 nt, Homo Sapiens; identical to SEQ ID NO: 125609

SEQ ID NO: 598865 - RNA, 64 nt, Homo Sapiens; identical to SEQ ID NO: 125610

SEQ ID NO: 598866 - RNA, 64 nt, Homo Sapiens; identical to SEQ ID NO: 125611

SEQ ID NO: 598867 - RNA, 64 nt, Homo Sapiens; identical to SEQ ID NO: 125612

SEQ ID NO: 598868 - RNA, 64 nt, Homo Sapiens; identical to SEQ ID NO: 125613

SEQ ID NO: 598869 - RNA, 64 nt, Homo Sapiens; identical to SEQ ID NO: 125614

SEQ ID NO: 598870 - RNA, 64 nt, Homo Sapiens; identical to SEQ ID NO: 125615

SEQ ID NO: 598871 - RNA, 64 nt, Homo Sapiens; identical to SEQ ID NO: 125616

SEQ ID NO: 598872 - RNA, 64 nt, Homo Sapiens; identical to SEQ ID NO: 125617

SEQ ID NO: 598873 - RNA, 64 nt, Homo Sapiens; identical to SEQ ID NO: 125618

SEQ ID NO: 598874 - RNA, 64 nt, Homo Sapiens; identical to SEQ ID NO: 125619

SEQ ID NO: 598875 - RNA, 64 nt, Homo Sapiens; identical to SEQ ID NO: 125620

SEQ ID NO: 598876 - RNA, 64 nt, Homo Sapiens; identical to SEQ ID NO: 125621

SEQ ID NO: 598877 - RNA, 64 nt, Homo Sapiens; identical to SEQ ID NO: 125622

SEQ ID NO: 598878 - RNA, 64 nt, Homo Sapiens; identical to SEQ ID NO: 125623

SEQ ID NO: 598879 - RNA, 64 nt, Homo Sapiens; identical to SEQ ID NO: 125624

SEQ ID NO: 598880 - RNA, 64 nt, Homo Sapiens; identical to SEQ ID NO: 125625

SEQ ID NO: 598881 - RNA, 64 nt, Homo Sapiens; identical to SEQ ID NO: 125626

SEQ ID NO: 598882 - RNA, 64 nt, Homo Sapiens; identical to SEQ ID NO: 125627

SEQ ID NO: 598883 - RNA, 64 nt, Homo Sapiens; identical to SEQ ID NO: 125628

SEQ ID NO: 598884 - RNA, 64 nt, Homo Sapiens; identical to SEQ ID NO: 125629

SEQ ID NO: 598885 - RNA, 64 nt, Homo Sapiens; identical to SEQ ID NO: 125630

SEQ ID NO: 598886 - RNA, 64 nt, Homo Sapiens; identical to SEQ ID NO: 125631

SEQ ID NO: 598887 - RNA, 64 nt, Homo Sapiens; identical to SEQ ID NO: 125632

SEQ ID NO: 598888 - RNA, 64 nt, Homo Sapiens; identical to SEQ ID NO: 125633

SEQ ID NO: 598889 - RNA, 64 nt, Homo Sapiens; identical to SEQ ID NO: 125634

SEQ ID NO: 598890 - RNA, 64 nt, Homo Sapiens; identical to SEQ ID NO: 125635

SEQ ID NO: 598891 - RNA, 64 nt, Homo Sapiens; identical to SEQ ID NO: 125636

SEQ ID NO: 598892 - RNA, 64 nt, Homo Sapiens; identical to SEQ ID NO: 125637

SEQ ID NO: 598893 - RNA, 64 nt, Homo Sapiens; identical to SEQ ID NO: 125638

SEQ ID NO: 598894 - RNA, 64 nt, Homo Sapiens; identical to SEQ ID NO: 125639

SEQ ID NO: 598895 - RNA, 64 nt, Homo Sapiens; identical to SEQ ID NO: 125640

SEQ ID NO: 598896 - RNA, 64 nt, Homo Sapiens; identical to SEQ ID NO: 125641

SEQ ID NO: 598897 - RNA, 64 nt, Homo Sapiens; identical to SEQ ID NO: 125642

SEQ ID NO: 598898 - RNA, 64 nt, Homo Sapiens; identical to SEQ ID NO: 124007

SEQ ID NO: 598899 - RNA, 64 nt, Homo Sapiens; identical to SEQ ID NO: 124008

SEQ ID NO: 598900 - RNA, 64 nt, Homo Sapiens; identical to SEQ ID NO: 124009

SEQ ID NO: 598901 - RNA, 64 nt, Homo Sapiens; identical to SEQ ID NO: 124010

SEQ ID NO: 598902 - RNA, 64 nt, Homo Sapiens; identical to SEQ ID NO: 124011

SEQ ID NO: 598903 - RNA, 64 nt, Homo Sapiens; identical to SEQ ID NO: 124012

SEQ ID NO: 598904 - RNA, 64 nt, Homo Sapiens; identical to SEQ ID NO: 124013

SEQ ID NO: 598905 - RNA, 64 nt, Homo Sapiens; identical to SEQ ID NO: 124014

SEQ ID NO: 598906 - RNA, 64 nt, Homo Sapiens; identical to SEQ ID NO: 124015

SEQ ID NO: 598907 - RNA, 64 nt, Homo Sapiens; identical to SEQ ID NO: 124016

SEQ ID NO: 598908 - RNA, 64 nt, Homo Sapiens
uccugucuucuguuuuauaguccaagggaucagaagcuccaagugagcuccaagauauaagccc

SEQ ID NO: 598909 - RNA, 64 nt, Homo Sapiens
uauaagcccuccaagggaucuuuaugcccuccagagcuccaagacucaggaagcuucuagagac

SEQ ID NO: 598910 - RNA, 64 nt, Homo Sapiens
ggcgccaucuaugguguggaugggaaacugcuccagcuccaagagguuuuucagcucuuugaca

SEQ ID NO: 598911 - RNA, 64 nt, Homo Sapiens
cuggagggcaguggcacgaucucagcucacugcaagcuccaacucccggguucacgccauucuc

SEQ ID NO: 598912 - RNA, 64 nt, Homo Sapiens
ggaaucagaacucaaaugggagggcccagagcccagcuccaaggacaaggauagaugcuggccc

SEQ ID NO: 598913 - RNA, 64 nt, Homo Sapiens
ugcaaagaucuguccucagcaggacuuccuguccagcuccaaccuuugggccagacaugccaca

SEQ ID NO: 598914 - RNA, 64 nt, Homo Sapiens
uucccacuccucugagcccggaggggacaccccaagcuccaagcuccaagcuccaggccaaagg

SEQ ID NO: 598915 - RNA, 64 nt, Homo Sapiens
uccucugagcccggaggggacaccccaagcuccaagcuccaagcuccaggccaaaggcugaaag

SEQ ID NO: 598916 - RNA, 64 nt, Homo Sapiens
cuuccguccaggcagccgugcugcagacagaccuagugccgagggauggacaggcgagguggca

SEQ ID NO: 598917 - RNA, 64 nt, Homo Sapiens
uugaccucgugaucugcccgccucggccucccaaagugccgagauuacaggugugagccaccgc

SEQ ID NO: 598918 - RNA, 64 nt, Homo Sapiens
guggacauuucaagccaacugagccuuuuccucaagugccgacaccucccucaucucucuuaua

SEQ ID NO: 598919 - RNA, 64 nt, Homo Sapiens
ggugguuauggagaggguguccggucccugucccagugccgagaaggaagccucccacgacugc

SEQ ID NO: 598920 - RNA, 64 nt, Homo Sapiens
caaggccagugcugugccaagcccgguaaggccaagugccgaggcccagccuucccugccacuc

SEQ ID NO: 598921 - RNA, 64 nt, Homo Sapiens
auauagagugacuuggagagaagacaguauuugcagugccgaugcccaguuguccgugaagaga

SEQ ID NO: 598922 - RNA, 64 nt, Homo Sapiens
ccugccuuccacccagcgucccuuaguacacuggagugccgagcccucccuucuccuuccacuc

SEQ ID NO: 598923 - RNA, 64 nt, Homo Sapiens
uaaacauacgugugcauguguugcuauugugaauagugccgaaauuuggguugguuccaagucu

SEQ ID NO: 598924 - RNA, 64 nt, Homo Sapiens
caauguauagccaaauuguacgugcuuaaaaaacagugccgagaguauguucaguucgcaguaa

SEQ ID NO: 598925 - RNA, 64 nt, Homo Sapiens
uucccuccaacggggaaagccaacuccaucucuaagugccgaacucaucccuguuccucaaggc

SEQ ID NO: 598926 - RNA, 64 nt, Homo Sapiens
aacagcaaagaaucauccaccccaaaauaucaguagugccgagauugagaaacccugauuuauc

SEQ ID NO: 598927 - RNA, 64 nt, Homo Sapiens
cacuccucgccucaccgcguggcaagagacacgaagugccgagacggucccugugguguugcca

SEQ ID NO: 598928 - RNA, 64 nt, Homo Sapiens
gugcaggccacagcagcaugcccuugguguagucagugccgaaaggggucuguuccuucuugag

SEQ ID NO: 598929 - RNA, 64 nt, Homo Sapiens
ucgugacuuuguguuauuuuccguguuguuugaaagugccgaacaguuuagaccagcucaccaa

SEQ ID NO: 598930 - RNA, 64 nt, Homo Sapiens
cuacuuuccuuuaaccauugaacugugaugucauagugccgagaguaccugagagcacaggugu

SEQ ID NO: 598931 - RNA, 64 nt, Homo Sapiens
ugaauguggaaaguagcaccacuugacggcuacaagugccgacuccugaauuuucccauggugu

SEQ ID NO: 598932 - RNA, 64 nt, Homo Sapiens
accacguuuuaaaggagaaaugugaccggagaugagugccgaugcucuucacagaccucacgga

SEQ ID NO: 598933 - RNA, 64 nt, Homo Sapiens
uggcgggaaaagcaaauucuaaggcaggcuucacagugccgaguuagaguucaucaagccuuga

SEQ ID NO: 598934 - RNA, 64 nt, Homo Sapiens
acaugcaugacacuuccaaacacugccauuacccagugccgaggagucccaggggcagccacac

SEQ ID NO: 598935 - RNA, 64 nt, Homo Sapiens
ugggccagcacuucucccagucuccccgagucacagugccgaucccacccacccaccguagggu

SEQ ID NO: 598936 - RNA, 64 nt, Homo Sapiens
guuauuagaaucaacauugcuggugauucuuucaagugccgaauccgcuuuuuaaaaaaacacu

SEQ ID NO: 598937 - RNA, 64 nt, Homo Sapiens
cguggaccauguuuuaauaauccaaaauaauuccagugccgaacccugaauuuaacauauggua

SEQ ID NO: 598938 - RNA, 64 nt, Homo Sapiens
cauuguacauaacaaaacagcccccaaacagcccagugccgacaccauuguuccuuucacacuu

SEQ ID NO: 598939 - RNA, 64 nt, Homo Sapiens
uagauagccaugucugccuuuagcuuggugagacagugccgagagggauucugaaugaucaaua

SEQ ID NO: 598940 - RNA, 64 nt, Homo Sapiens
ccgucauauaacuagaggaaguggaaugcagauaagugccgaauucaaacccuucauuuuaugu

SEQ ID NO: 598941 - RNA, 64 nt, Homo Sapiens
aguauuagcucccguucccacggagucacacugcagugccgaacccaagcccuacuuguaugug

SEQ ID NO: 598942 - RNA, 64 nt, Homo Sapiens
gucaccuuggugcacuuucugccccugggagggcagugccgaggccuugccucagccucgggaa

SEQ ID NO: 598943 - RNA, 64 nt, Homo Sapiens
guaguaaagcccugaaauaguauuuuauuuauugagugccgacuuauuuguuaaaaaaaucagu

SEQ ID NO: 598944 - RNA, 52 nt, Homo Sapiens
ucccaggccugcucucuugaacagugccgaaaacuucacugugcucaucaag

SEQ ID NO: 598945 - RNA, 64 nt, Homo Sapiens
auaucccauagcacucaauaaacucagcugcuagagugccgaugucaggagggcugugucgggu

SEQ ID NO: 598946 - RNA, 64 nt, Homo Sapiens
gugcuaaaauauuuagugcgaauaaaagugguguagugccgaaaacuguuuuuuuucuuccucc

SEQ ID NO: 598947 - RNA, 64 nt, Homo Sapiens
uggaagccacugcuaccgucuacccagcaccaguagugccgaugugccacacugcccaguugag

SEQ ID NO: 598948 - RNA, 64 nt, Homo Sapiens
caagaauaucuggucuccccuaauuuuuauucccagugccgauguucaaaauaaacuuucucca

SEQ ID NO: 598949 - RNA, 64 nt, Homo Sapiens
aggagcaggcacagcuacauacuuggcuuuagccagugccgaagcccgcagguggcauuuuaaa

SEQ ID NO: 598950 - RNA, 64 nt, Homo Sapiens
cccgggagcugugugucuccgccagagucacagcagugccgagguguccgcggcagaccacaca

SEQ ID NO: 598951 - RNA, 64 nt, Homo Sapiens
cuccaccucccagccaccugccuuggccucccaaagugccgagauugcagccucugcccggccg

SEQ ID NO: 598952 - RNA, 64 nt, Homo Sapiens
ugccccgcccuuuguuugcacuauuggacuuaggagugccgaggguggggagauggagcugccc

SEQ ID NO: 598953 - RNA, 64 nt, Homo Sapiens
gagaggcuagaaguagcuuuucugucuuuuggccagugccgaguggaaugccugguuuggggga

SEQ ID NO: 598954 - RNA, 64 nt, Homo Sapiens
uguccacuuacccuagguagccccccaccccaucagugccgaguccuugucccuaccuccagcu

SEQ ID NO: 598955 - RNA, 64 nt, Homo Sapiens
gacuauguccagauuggugagggccugcaaaucuagugccgaauucccugucccccagcaucgg

SEQ ID NO: 598956 - RNA, 64 nt, Homo Sapiens
augauucucccuccagagccuagucuugcccuggagugccgaugcauuuuucuuuugauggguu

SEQ ID NO: 598957 - RNA, 64 nt, Homo Sapiens
aggaggaagaaaaacaggccgcgcgucucagcucagugccgaggaaaggagagcaaacugcuca

SEQ ID NO: 598958 - RNA, 64 nt, Homo Sapiens
uguuucucccagagccccaguggggccacccccaagugccgacucuguucucugggccugagcc

SEQ ID NO: 598959 - RNA, 64 nt, Homo Sapiens
uuggguggcggggccugggugagagccagcccugagugccgaccgcaaggcagagaggacacag

SEQ ID NO: 598960 - RNA, 64 nt, Homo Sapiens
gucuuuacacugcaugcagaaguuuaaacacugaagugccgaaguggcccgugccgccgcacag

SEQ ID NO: 598961 - RNA, 64 nt, Homo Sapiens
aacuuucucaaagagcaacccccaagacuuuacuagugccgauacgaucaaaaccugcuaccuc

SEQ ID NO: 598962 - RNA, 64 nt, Homo Sapiens
guucccgacgugcaucuucccugccggaaaugcaagugccgaagcgaaagugucagagauucgg

SEQ ID NO: 598963 - RNA, 64 nt, Homo Sapiens
cucagagaaacaauggcuaagauaccaaaaccacagugccgacagcucuccaauacucagguua

SEQ ID NO: 598964 - RNA, 64 nt, Homo Sapiens
gcuguguuuccagguguucacccguggugcccacagugccgacccguggcugggucggagcucc

SEQ ID NO: 598965 - RNA, 64 nt, Homo Sapiens
ggcauggccccagccaugaaggaacuuaaccgcuagugccgaggacacguuaaacgaacaggau

SEQ ID NO: 598966 - RNA, 64 nt, Homo Sapiens
aacccccaggauggcggaaguguuccugaguuugagugccgaccugagguucaggagaccggcc

SEQ ID NO: 598967 - RNA, 64 nt, Homo Sapiens; identical to SEQ ID NO: 73896

SEQ ID NO: 598968 - RNA, 64 nt, Homo Sapiens; identical to SEQ ID NO: 73897

SEQ ID NO: 598969 - RNA, 64 nt, Homo Sapiens; identical to SEQ ID NO: 73898

SEQ ID NO: 598970 - RNA, 64 nt, Homo Sapiens; identical to SEQ ID NO: 73899

SEQ ID NO: 598971 - RNA, 64 nt, Homo Sapiens; identical to SEQ ID NO: 73900

SEQ ID NO: 598972 - RNA, 64 nt, Homo Sapiens; identical to SEQ ID NO: 73901

SEQ ID NO: 598973 - RNA, 64 nt, Homo Sapiens; identical to SEQ ID NO: 73902

SEQ ID NO: 598974 - RNA, 64 nt, Homo Sapiens; identical to SEQ ID NO: 73903

SEQ ID NO: 598975 - RNA, 64 nt, Homo Sapiens; identical to SEQ ID NO: 73904

SEQ ID NO: 598976 - RNA, 64 nt, Homo Sapiens; identical to SEQ ID NO: 73905

SEQ ID NO: 598977 - RNA, 64 nt, Homo Sapiens; identical to SEQ ID NO: 73906

SEQ ID NO: 598978 - RNA, 64 nt, Homo Sapiens; identical to SEQ ID NO: 73907

SEQ ID NO: 598979 - RNA, 64 nt, Homo Sapiens; identical to SEQ ID NO: 73908

SEQ ID NO: 598980 - RNA, 64 nt, Homo Sapiens; identical to SEQ ID NO: 73909

SEQ ID NO: 598981 - RNA, 64 nt, Homo Sapiens; identical to SEQ ID NO: 73910

SEQ ID NO: 598982 - RNA, 64 nt, Homo Sapiens; identical to SEQ ID NO: 73911

SEQ ID NO: 598983 - RNA, 64 nt, Homo Sapiens; identical to SEQ ID NO: 73912

SEQ ID NO: 598984 - RNA, 64 nt, Homo Sapiens
agcauaacuuaucauauggcccagccauuucacuacuagaaauugacgcaagugaacugaaaac

SEQ ID NO: 598985 - RNA, 64 nt, Homo Sapiens
cuguuuauagcagcuucauucauaauuaccaaaaacuagaaauaacccagauauccuucaacag

SEQ ID NO: 598986 - RNA, 62 nt, Homo Sapiens
uaaaauaaguuucacuaguuuagaaauaaacuaaacuagaaaauuacagauuauuuuugaac

SEQ ID NO: 598987 - RNA, 64 nt, Homo Sapiens
aacuaaacuagaaauaaaaucagauuauuuuugaacuagaaauagacauuucuuacagcaauua

SEQ ID NO: 598988 - RNA, 64 nt, Homo Sapiens
gacuuuuuuuccuuucuuuuaaaauacauauaaaacuagaaaggguuuaauucagcaacaacaa

SEQ ID NO: 598989 - RNA, 64 nt, Homo Sapiens
uucuuuuaaaauugacagaaauauaguaaauuucacuagaaaaaucuuuccuauucauauaucu

SEQ ID NO: 598990 - RNA, 64 nt, Homo Sapiens
aaaaaguggcauaaaauauuacaaaacauccaacacuagaaagcaaugacuaacauuuaauuug

SEQ ID NO: 598991 - RNA, 64 nt, Homo Sapiens
cagcaaauccccuugaugcuaccuuugaaauauaacuagaaaagaaugacuugccaccauaucc

SEQ ID NO: 598992 - RNA, 64 nt, Homo Sapiens
ucuaauggaaagaggccucuacugcugucugagcacuagaaauuauauagcccuuguuuggauu

SEQ ID NO: 598993 - RNA, 54 nt, Homo Sapiens
gauacacuguaaaggaggggugagacuagaaagaccugccuugucguucgguaa

SEQ ID NO: 598994 - RNA, 64 nt, Homo Sapiens
aaacccuaacuugugaaguuucuuucacaguagaacuagaaacauuuaagcuaaagagugauua

SEQ ID NO: 598995 - RNA, 64 nt, Homo Sapiens
auaaagccuuuucuaaauuuugggugacuuggggacuagaaagaguggccaacuugcuaucugg

SEQ ID NO: 598996 - RNA, 64 nt, Homo Sapiens
aagcauguggcauaaauuuggagaaaauaauaugacuagaaaaauuaguguuauauugggugug

SEQ ID NO: 598997 - RNA, 64 nt, Homo Sapiens
aauagaaaaaggcuguggauucuuugaggacaucacuagaaaucauucuuugucucaaguucac

SEQ ID NO: 598998 - RNA, 64 nt, Homo Sapiens
aagcuuauucucauauaauacuaaucuaaacaguacuagaaauuacagugccaagagccaccag

SEQ ID NO: 598999 - RNA, 64 nt, Homo Sapiens
uacguuguuaguagaaggucaauuuaaaauagggacuagaaauuauuugaaguuuucuuuauua

SEQ ID NO: 599000 - RNA, 64 nt, Homo Sapiens
ucauuuuaauuucacuaaaauuauuuuuugauugacuagaaaaaguguuauuugauauuuuaau

SEQ ID NO: 599001 - RNA, 64 nt, Homo Sapiens
auuuaauaaacucgaaguuuuauagagugauuuuacuagaaagaggcacuuuuaacagauuguu

SEQ ID NO: 599002 - RNA, 64 nt, Homo Sapiens
cagccgaaaagaagagaaauucuucaaaguuuuuacuagaaauuugaaaaguaagaacagcuca

SEQ ID NO: 599003 - RNA, 64 nt, Homo Sapiens
uguccuguggcaugcaaaagacccuuguuuugaaacuagaaaucgauuuuuuuguucuuguugu

SEQ ID NO: 599004 - RNA, 64 nt, Homo Sapiens
gccaguauuucucuaguaagauuauguuucucuuacuagaaaacuauuuucuaaauauuaacac

SEQ ID NO: 599005 - RNA, 64 nt, Homo Sapiens
auagucccguuaggguuuaaaaccauauugaucaacuagaaagaaaaauaugaaaagagaaaaa

SEQ ID NO: 599006 - RNA, 64 nt, Homo Sapiens
auugucauuucugaugugcccauacaacuacuauacuagaaaaacugaauugcaauuacagaug

SEQ ID NO: 599007 - RNA, 64 nt, Homo Sapiens
aaaugggcaagggucaaagaaaauggucauauguacuagaaaggagcaaaaauaaaauaauuau

SEQ ID NO: 599008 - RNA, 64 nt, Homo Sapiens; identical to SEQ ID NO: 168067

SEQ ID NO: 599009 - RNA, 64 nt, Homo Sapiens; identical to SEQ ID NO: 168068

SEQ ID NO: 599010 - RNA, 64 nt, Homo Sapiens; identical to SEQ ID NO: 168069

SEQ ID NO: 599011 - RNA, 64 nt, Homo Sapiens; identical to SEQ ID NO: 168070

SEQ ID NO: 599012 - RNA, 64 nt, Homo Sapiens; identical to SEQ ID NO: 168071

SEQ ID NO: 599013 - RNA, 64 nt, Homo Sapiens; identical to SEQ ID NO: 168072

SEQ ID NO: 599014 - RNA, 64 nt, Homo Sapiens; identical to SEQ ID NO: 168073

SEQ ID NO: 599015 - RNA, 64 nt, Homo Sapiens; identical to SEQ ID NO: 168074

SEQ ID NO: 599016 - RNA, 64 nt, Homo Sapiens; identical to SEQ ID NO: 168075

SEQ ID NO: 599017 - RNA, 64 nt, Homo Sapiens; identical to SEQ ID NO: 168076

SEQ ID NO: 599018 - RNA, 64 nt, Homo Sapiens; identical to SEQ ID NO: 168077

SEQ ID NO: 599019 - RNA, 64 nt, Homo Sapiens; identical to SEQ ID NO: 168078

SEQ ID NO: 599020 - RNA, 64 nt, Homo Sapiens; identical to SEQ ID NO: 168079

SEQ ID NO: 599021 - RNA, 64 nt, Homo Sapiens; identical to SEQ ID NO: 168080

SEQ ID NO: 599022 - RNA, 64 nt, Homo Sapiens; identical to SEQ ID NO: 275005

SEQ ID NO: 599023 - RNA, 64 nt, Homo Sapiens; identical to SEQ ID NO: 275006

SEQ ID NO: 599024 - RNA, 64 nt, Homo Sapiens; identical to SEQ ID NO: 275007

SEQ ID NO: 599025 - RNA, 64 nt, Homo Sapiens; identical to SEQ ID NO: 275008

SEQ ID NO: 599026 - RNA, 64 nt, Homo Sapiens; identical to SEQ ID NO: 275009

SEQ ID NO: 599027 - RNA, 64 nt, Homo Sapiens; identical to SEQ ID NO: 275010

SEQ ID NO: 599028 - RNA, 64 nt, Homo Sapiens; identical to SEQ ID NO: 275011

SEQ ID NO: 599029 - RNA, 64 nt, Homo Sapiens; identical to SEQ ID NO: 275012

SEQ ID NO: 599030 - RNA, 64 nt, Homo Sapiens; identical to SEQ ID NO: 275013

SEQ ID NO: 599031 - RNA, 64 nt, Homo Sapiens; identical to SEQ ID NO: 275014

SEQ ID NO: 599032 - RNA, 64 nt, Homo Sapiens; identical to SEQ ID NO: 275015

SEQ ID NO: 599033 - RNA, 64 nt, Homo Sapiens; identical to SEQ ID NO: 275016

SEQ ID NO: 599034 - RNA, 51 nt, Homo Sapiens; identical to SEQ ID NO: 275017

SEQ ID NO: 599035 - RNA, 64 nt, Homo Sapiens; identical to SEQ ID NO: 275018

SEQ ID NO: 599036 - RNA, 64 nt, Homo Sapiens; identical to SEQ ID NO: 275019

SEQ ID NO: 599037 - RNA, 64 nt, Homo Sapiens; identical to SEQ ID NO: 275020

SEQ ID NO: 599038 - RNA, 64 nt, Homo Sapiens; identical to SEQ ID NO: 275021

SEQ ID NO: 599039 - RNA, 64 nt, Homo Sapiens; identical to SEQ ID NO: 275022

SEQ ID NO: 599040 - RNA, 64 nt, Homo Sapiens; identical to SEQ ID NO: 275023

SEQ ID NO: 599041 - RNA, 64 nt, Homo Sapiens; identical to SEQ ID NO: 275024

SEQ ID NO: 599042 - RNA, 64 nt, Homo Sapiens; identical to SEQ ID NO: 275025

SEQ ID NO: 599043 - RNA, 64 nt, Homo Sapiens; identical to SEQ ID NO: 275026

SEQ ID NO: 599044 - RNA, 64 nt, Homo Sapiens; identical to SEQ ID NO: 275027

SEQ ID NO: 599045 - RNA, 64 nt, Homo Sapiens; identical to SEQ ID NO: 275028

SEQ ID NO: 599046 - RNA, 64 nt, Homo Sapiens; identical to SEQ ID NO: 275029

SEQ ID NO: 599047 - RNA, 64 nt, Homo Sapiens; identical to SEQ ID NO: 275030

SEQ ID NO: 599048 - RNA, 64 nt, Homo Sapiens; identical to SEQ ID NO: 275031

SEQ ID NO: 599049 - RNA, 64 nt, Homo Sapiens; identical to SEQ ID NO: 275032

SEQ ID NO: 599050 - RNA, 64 nt, Homo Sapiens; identical to SEQ ID NO: 275033

SEQ ID NO: 599051 - RNA, 64 nt, Homo Sapiens; identical to SEQ ID NO: 275034

SEQ ID NO: 599052 - RNA, 64 nt, Homo Sapiens; identical to SEQ ID NO: 275035

SEQ ID NO: 599053 - RNA, 64 nt, Homo Sapiens; identical to SEQ ID NO: 275036

SEQ ID NO: 599054 - RNA, 64 nt, Homo Sapiens; identical to SEQ ID NO: 275037

SEQ ID NO: 599055 - RNA, 64 nt, Homo Sapiens; identical to SEQ ID NO: 275038

SEQ ID NO: 599056 - RNA, 64 nt, Homo Sapiens; identical to SEQ ID NO: 275038

SEQ ID NO: 599057 - RNA, 64 nt, Homo Sapiens; identical to SEQ ID NO: 275040

SEQ ID NO: 599058 - RNA, 64 nt, Homo Sapiens; identical to SEQ ID NO: 275041

SEQ ID NO: 599059 - RNA, 64 nt, Homo Sapiens; identical to SEQ ID NO: 275042

SEQ ID NO: 599060 - RNA, 64 nt, Homo Sapiens; identical to SEQ ID NO: 275043

SEQ ID NO: 599061 - RNA, 64 nt, Homo Sapiens; identical to SEQ ID NO: 275044

SEQ ID NO: 599062 - RNA, 64 nt, Homo Sapiens; identical to SEQ ID NO: 275045

SEQ ID NO: 599063 - RNA, 64 nt, Homo Sapiens; identical to SEQ ID NO: 275046

SEQ ID NO: 599064 - RNA, 64 nt, Homo Sapiens; identical to SEQ ID NO: 275047

SEQ ID NO: 599065 - RNA, 64 nt, Homo Sapiens; identical to SEQ ID NO: 275048

SEQ ID NO: 599066 - RNA, 64 nt, Homo Sapiens; identical to SEQ ID NO: 275049

SEQ ID NO: 599067 - RNA, 64 nt, Homo Sapiens; identical to SEQ ID NO: 275050

SEQ ID NO: 599068 - RNA, 64 nt, Homo Sapiens; identical to SEQ ID NO: 275051

SEQ ID NO: 599069 - RNA, 64 nt, Homo Sapiens; identical to SEQ ID NO: 124017

SEQ ID NO: 599070 - RNA, 64 nt, Homo Sapiens; identical to SEQ ID NO: 124018

SEQ ID NO: 599071 - RNA, 64 nt, Homo Sapiens; identical to SEQ ID NO: 124019

SEQ ID NO: 599072 - RNA, 64 nt, Homo Sapiens; identical to SEQ ID NO: 124020

SEQ ID NO: 599073 - RNA, 64 nt, Homo Sapiens; identical to SEQ ID NO: 124021

SEQ ID NO: 599074 - RNA, 64 nt, Homo Sapiens; identical to SEQ ID NO: 124022

SEQ ID NO: 599075 - RNA, 64 nt, Homo Sapiens; identical to SEQ ID NO: 124023

SEQ ID NO: 599076 - RNA, 64 nt, Homo Sapiens; identical to SEQ ID NO: 124024

SEQ ID NO: 599077 - RNA, 64 nt, Homo Sapiens; identical to SEQ ID NO: 124025

SEQ ID NO: 599078 - RNA, 64 nt, Homo Sapiens; identical to SEQ ID NO: 124026

SEQ ID NO: 599079 - RNA, 64 nt, Homo Sapiens; identical to SEQ ID NO: 124027

SEQ ID NO: 599080 - RNA, 64 nt, Homo Sapiens; identical to SEQ ID NO: 124028

SEQ ID NO: 599081 - RNA, 64 nt, Homo Sapiens; identical to SEQ ID NO: 259212

SEQ ID NO: 599082 - RNA, 64 nt, Homo Sapiens; identical to SEQ ID NO: 259213

SEQ ID NO: 599083 - RNA, 64 nt, Homo Sapiens; identical to SEQ ID NO: 259214

SEQ ID NO: 599084 - RNA, 64 nt, Homo Sapiens; identical to SEQ ID NO: 259215

SEQ ID NO: 599085 - RNA, 64 nt, Homo Sapiens; identical to SEQ ID NO: 259216

SEQ ID NO: 599086 - RNA, 64 nt, Homo Sapiens; identical to SEQ ID NO: 259217

SEQ ID NO: 599087 - RNA, 64 nt, Homo Sapiens; identical to SEQ ID NO: 259218

SEQ ID NO: 599088 - RNA, 64 nt, Homo Sapiens; identical to SEQ ID NO: 259219

SEQ ID NO: 599089 - RNA, 64 nt, Homo Sapiens; identical to SEQ ID NO: 259220

SEQ ID NO: 599090 - RNA, 64 nt, Homo Sapiens; identical to SEQ ID NO: 259221

SEQ ID NO: 599091 - RNA, 64 nt, Homo Sapiens; identical to SEQ ID NO: 259222

SEQ ID NO: 599092 - RNA, 64 nt, Homo Sapiens; identical to SEQ ID NO: 259223

SEQ ID NO: 599093 - RNA, 64 nt, Homo Sapiens; identical to SEQ ID NO: 259224

SEQ ID NO: 599094 - RNA, 64 nt, Homo Sapiens; identical to SEQ ID NO: 259225

SEQ ID NO: 599095 - RNA, 64 nt, Homo Sapiens
uuuuuuguuaggcuguaaagaauuuaagcuguaaauuacauaaguuagaacaagcccaaauuua

SEQ ID NO: 599096 - RNA, 64 nt, Homo Sapiens
guuucauuauucucauaauccuucugcaacugaaauuacauauugcaggagacauuuucauauc

SEQ ID NO: 599097 - RNA, 64 nt, Homo Sapiens
aaaauuuugcagaauuccuccuuucuacccauaaauuacauauauuuuucuucuuuagucaugg

SEQ ID NO: 599098 - RNA, 64 nt, Homo Sapiens
aucuuucccuguguacugguauuauuaaaaagacauuacauacgcaagucuuucucgacaauca

SEQ ID NO: 599099 - RNA, 64 nt, Homo Sapiens
auagaacaucuuuuuuagugaaagaaugugccauauuacauauugcaaccuaauuuguuaaaac

SEQ ID NO: 599100 - RNA, 64 nt, Homo Sapiens
auaaucagaauuuugccuuuuuucuucucaaauuauuacauauguauguauuauauauccacau

SEQ ID NO: 599101 - RNA, 64 nt, Homo Sapiens
gucagcagccgcuauuaccguaucuuacaauuuaauuacauacacagugaauugaaaccauugu

SEQ ID NO: 599102 - RNA, 64 nt, Homo Sapiens
cauuauucuaaacuauucauucagcaugccuauaauuacauaaauuguaugagacuuuuuguug

SEQ ID NO: 599103 - RNA, 64 nt, Homo Sapiens
agguuuuccugauuuauauuuuuuuggcccaauuauuacauaucacuguguuuugugauuuuca

SEQ ID NO: 599104 - RNA, 64 nt, Homo Sapiens
gcugaguguucugucaccccaaccuucguaacuaauuacauauccaaagcaaugccuuagcguu

SEQ ID NO: 599105 - RNA, 64 nt, Homo Sapiens
uuuaaauuaauacucuuauuuuuuauuuaauuuaauuacauaaauuaaaccuuaccaugaccaa

SEQ ID NO: 599106 - RNA, 64 nt, Homo Sapiens
uuuauaacuauaguaaaaaauuaauauauauccuauuacauaaauguuauuucuuagguguucc

SEQ ID NO: 599107 - RNA, 64 nt, Homo Sapiens
cuuuuagaaaagggaguuuaaaaaugguaucaaaauuacauauacuacagucaagauagaaagg

SEQ ID NO: 599108 - RNA, 64 nt, Homo Sapiens
aaagggcaaauaaugaucgaaaaaauaauuauuuauuacauaauuuaguuguuucuagacuaua

SEQ ID NO: 599109 - RNA, 64 nt, Homo Sapiens
guuaaaaccaugaacauuggcuaugaugaagauuauuacauaugaaaaaaaaacucacacaaca

SEQ ID NO: 599110 - RNA, 64 nt, Homo Sapiens
ucccaaugagaaguucuauuuucauguucuuaauauuacauacaagaaaaugcaguuagguuau

SEQ ID NO: 599111 - RNA, 64 nt, Homo Sapiens
cagacacacacagaaagacacacagagacacaccauuacauacacacacgcagccccuccccgc

SEQ ID NO: 599112 - RNA, 64 nt, Homo Sapiens
cagacacgcaaucgcagauacacagagacacaccauuacauacacacacacacacccuccccgc

SEQ ID NO: 599113 - RNA, 64 nt, Homo Sapiens
cagacacacacagaaagacagccacagagacaccauuacauacaaucacacacacacccucccc

SEQ ID NO: 599114 - RNA, 64 nt, Homo Sapiens
cagacacacacagaaagacaaccacagagacaccauuacauacaaucacacacacccccucccc

SEQ ID NO: 599115 - RNA, 64 nt, Homo Sapiens
auccacaaaacuaacaggauaauugggcaaauaaauuacauauaaacacacacaaucuauauau

SEQ ID NO: 599116 - RNA, 64 nt, Homo Sapiens
acacuucauauauaauuaaucacuauuuuguauaauuacauauugcugcuuguguguuuuuuuu

SEQ ID NO: 599117 - RNA, 64 nt, Homo Sapiens
aguaugcuuaggcuuuacuauuauguauuauaauauuacauagucucuaacuaaagucuccaag

SEQ ID NO: 599118 - RNA, 64 nt, Homo Sapiens
ucuacuggacaucacagaauuaugcaauguuuuuauuacauacuaagacaucacacuagaaaca

SEQ ID NO: 599119 - RNA, 64 nt, Homo Sapiens
uauguauuucacuguuauguuuuguuuuauccacauuacauauugagucuuuaauuguaaugac

SEQ ID NO: 599120 - RNA, 64 nt, Homo Sapiens
gauuagaccaacuggagaauauugugacauggucauuacauaugggauccuagcaugacuauac

SEQ ID NO: 599121 - RNA, 64 nt, Homo Sapiens
uauguauuucacugucauguuuaagccuuuucucauuacauauuugacuuuguuuuauccacag

SEQ ID NO: 599122 - RNA, 64 nt, Homo Sapiens; identical to SEQ ID NO: 599120

SEQ ID NO: 599123 - RNA, 64 nt, Homo Sapiens
aaaaguuuauugguagguaauuagugaguuaaaaauuacauacuauuaaacuagacuuacuauu

SEQ ID NO: 599124 - RNA, 64 nt, Homo Sapiens
gacuauagaaacacaacagugaauccaauagucaauuacauaaucaugugucccauggcaaugu

SEQ ID NO: 599125 - RNA, 64 nt, Homo Sapiens
gauuaacaaauacauugcaaucauuguauuaauuauuacauaaaagagcugugcccguuuaucu

SEQ ID NO: 599126 - RNA, 64 nt, Homo Sapiens
uuuuaaagucaaugaaagagcauuuucuguuucuauuacauaguacuucauuuguguauuaguu

SEQ ID NO: 599127 - RNA, 64 nt, Homo Sapiens
uuguuacaaauuaucauuauuuaguucuaccuugauuacauauggucaggaaaagaaaagaaac

SEQ ID NO: 599128 - RNA, 64 nt, Homo Sapiens
aauggcuuugcaagaagauguuuaaauggaacuuauuacauaccaaaauggcaaaaugccauua

SEQ ID NO: 599129 - RNA, 64 nt, Homo Sapiens
uguuaaaguaaaugaaauuguuauuuuuccuagagucaaccaaagaucagcauggucccuguug

SEQ ID NO: 599130 - RNA, 64 nt, Homo Sapiens
uugucuaggaaaugacaugaauucaauaucuaaugucaaccaauggggagagccacaacuccag

SEQ ID NO: 599131 - RNA, 64 nt, Homo Sapiens
gggcuacuuaaugcacagugcauuauguacacaggucaaccaugguaacaauaguucuuagcuu

SEQ ID NO: 599132 - RNA, 64 nt, Homo Sapiens
cagagucccuuucuuuucugcuuagagucuguuugucaaccaggcugggaagugccacuugcuc

SEQ ID NO: 599133 - RNA, 64 nt, Homo Sapiens
aaaguggggaaagggucucugcugcuuagccuuugucaaccaucaagccagcucagccuuccaa

SEQ ID NO: 599134 - RNA, 64 nt, Homo Sapiens
ugggggagaaguugcucacucacuugagggauuagucaaccauccuggaugaaaugaaauuguu

SEQ ID NO: 599135 - RNA, 64 nt, Homo Sapiens
gcuuuuuuccuucccgucuuagccucacccccuugucaaccagauugaguugcuauagcuugau

SEQ ID NO: 599136 - RNA, 64 nt, Homo Sapiens
uuaacuccauauguguuccucuuguucuaaucuugucaaccagugcaagugaccgacaaaauuc

SEQ ID NO: 599137 - RNA, 64 nt, Homo Sapiens
uccagaugugcuauaaucugggaugccucauuaugucaaccaggaaauaaucaugaaccaaucu

SEQ ID NO: 599138 - RNA, 62 nt, Homo Sapiens
ggcauuuaagucagccaaagucuuuucuaagagucaaccacauggggccauuuucauuuuag

SEQ ID NO: 599139 - RNA, 64 nt, Homo Sapiens
accaucuuugagccuuccuaugauaagagugcuugucaaccaugauaagcuauccauguguuug

SEQ ID NO: 599140 - RNA, 64 nt, Homo Sapiens
uauccuguaguaacauagacccaaaguuacuauagucaaccaagucuuucaaaggauaaaagau

SEQ ID NO: 599141 - RNA, 64 nt, Homo Sapiens
uuauacuaaaugggcuccuucauggugacgccccgucaaccacaaucaagaacugaggccugag

SEQ ID NO: 599142 - RNA, 64 nt, Homo Sapiens
agcaaaaacauaguaauuacacaauuucagugcagucaaccaaaauguugagucaauuggaaug

SEQ ID NO: 599143 - RNA, 64 nt, Homo Sapiens
uguuugguauuuuugaggcauuguuaacaugaaagucaaccacuggcuuugugaaaaaugcuau

SEQ ID NO: 599144 - RNA, 64 nt, Homo Sapiens
ggccauggcuuacauguuugagcugugcagugaagucaaccaguuucagggggucaagguggua

SEQ ID NO: 599145 - RNA, 64 nt, Homo Sapiens
aaauguuuaaauuuaccuacaagcucaaccaauugucaaccagauugaucccaggucuucagcu

SEQ ID NO: 599146 - RNA, 64 nt, Homo Sapiens
ugaaaacauuuggauugguaggauuuuguaacacgucaaccauuugaugcuucugaaaaguacu

SEQ ID NO: 599147 - RNA, 64 nt, Homo Sapiens
agagccauaaguagcccuuuggaggacugauggugucaaccaaaggcaugugauugauuaauga

SEQ ID NO: 599148 - RNA, 64 nt, Homo Sapiens
gacguuugccuucauguguaccaguguaauuucugucaaccacgauggggacuggggauucugg

SEQ ID NO: 599149 - RNA, 64 nt, Homo Sapiens
uaaaaaaaaaaagaccuuugucaaggagagugcagucaaccaguaaauugcagauucucagaau

SEQ ID NO: 599150 - RNA, 64 nt, Homo Sapiens
uccugaguaguaaucucacacuucauccuauagagucaaccaccacagauaggaauuccuuauu

SEQ ID NO: 599151 - RNA, 64 nt, Homo Sapiens
aaaaaaaaaaaagaccuuugucaaggagagugcagucaaccaguaaacugcagauucucagaau

SEQ ID NO: 599152 - RNA, 64 nt, Homo Sapiens
ugggaaacaagcaagaacuaaauaaucaaauguugucaaccaaaaguaauaguuggguauugga

SEQ ID NO: 599153 - RNA, 64 nt, Homo Sapiens
cuucuguuguagaaagcaguacaguaucuuaagugucaaccaguuauauaccuaaucugguuuu

SEQ ID NO: 599154 - RNA, 64 nt, Homo Sapiens
aucauguggacacaagcauaaguaaagaaaauuugucaaccaggcaaaaugugguucuuuaaca

SEQ ID NO: 599155 - RNA, 64 nt, Homo Sapiens
caacaccagggaaugccaaaaaaacaaagggcaagucaaccaaggcauuuugagaacaugaaau

SEQ ID NO: 599156 - RNA, 64 nt, Homo Sapiens
gagggagcuaggcaaagcuguuacguggagacaggucaaccaaaaaaaugcaauuuagguaauc

SEQ ID NO: 599157 - RNA, 64 nt, Homo Sapiens
uuuauaguacauaaauuauacaauuuuuaaaugugucaaccaacuuaaguuuuauguuuuauua

SEQ ID NO: 599158 - RNA, 64 nt, Homo Sapiens
uucauuuuuauggcuuuuuacaguuucucauucugucaaccauauugaagugaaguggcauagu

SEQ ID NO: 599159 - RNA, 64 nt, Homo Sapiens
ccaggaagagucauuacuaccaguaaucauuuuugucaaccacuaaacaagccugaagauuaaa

SEQ ID NO: 599160 - RNA, 64 nt, Homo Sapiens
uguaugacuuuaaacaaggcucuugaaccagccugucaaccaguugaagucagaagaccugggu

SEQ ID NO: 599161 - RNA, 64 nt, Homo Sapiens
ucugaauccccaccaggcgcagguacuucacccugucaaccaccccagcgugaaggaggcuucc

SEQ ID NO: 599162 - RNA, 64 nt, Homo Sapiens
uuucaucagcauuacuugggaaaacguguugcaagucaaccagucacuaggauauuucuaccca

SEQ ID NO: 599163 - RNA, 64 nt, Homo Sapiens
ugcaucgugcggggcaaaauaagccacauccuuagucaaccagucaaggaagacgccaucaggg

SEQ ID NO: 599164 - RNA, 64 nt, Homo Sapiens
ucugucucuucuuuuuccccuuggggcuauaacggucaaccauuggacgggguagcacccccca

SEQ ID NO: 599165 - RNA, 64 nt, Homo Sapiens
uuuuaccccugaaauuucaaaaggugaaguuccagucaaccacuuuaacauuguuugguuaaaa

SEQ ID NO: 599166 - RNA, 64 nt, Homo Sapiens
ugauucccucuugcuauuggaaugugguccagacgucaaccaggaacauguaacuuggagaggg

SEQ ID NO: 599167 - RNA, 64 nt, Homo Sapiens
gauagaauuucugaaagagaaagagaaguagauggucaaccagucacuaguugguuggcaugag

SEQ ID NO: 599168 - RNA, 64 nt, Homo Sapiens
ggggaggcuggguuuagccugugggccauaguuugucaaccacugguguaaaaccuuaguuaua

SEQ ID NO: 599169 - RNA, 64 nt, Homo Sapiens
aaggcacaccacuguauuagaacgcauuucaaaugucaaccaggagcgcauucaugccuuucua

SEQ ID NO: 599170 - RNA, 64 nt, Homo Sapiens
uguggaucuuguccaaauuuagugaaauguggaagucaaccagaccaaugauggaauuaaaugu

SEQ ID NO: 599171 - RNA, 64 nt, Homo Sapiens
ugugcacguguguguggcuaaauuaagucauacugucaaccacacgugaucucgucugaaacag

SEQ ID NO: 599172 - RNA, 64 nt, Homo Sapiens
ccccagagccacacaugggcaucuaugggagagugucaaccagacagagggucacaguguuuac

SEQ ID NO: 599173 - RNA, 64 nt, Homo Sapiens
acugcacuaguguuuaauaccagcaagccacguggucaaccaccuuucugacuuuuuauuuuug

SEQ ID NO: 599174 - RNA, 64 nt, Homo Sapiens
uuuaccuguucauaucuagugccccacagugugugucaaccaaagguggcaguggcuacaucug

SEQ ID NO: 599175 - RNA, 64 nt, Homo Sapiens
aaaccugaaaauauggauggucugccagggacaugucaaccaagcuggaaucauuuucuuucuc

SEQ ID NO: 599176 - RNA, 64 nt, Homo Sapiens
cuucucuuacagagucucccucccuuuauagaaugucaaccaaagagugcccuccuccccucuc

SEQ ID NO: 599177 - RNA, 64 nt, Homo Sapiens
gaaacagugcucuggugacaugauaaauauaugugucaaccaccauuucagcuauuaaaaacuc

SEQ ID NO: 599178 - RNA, 64 nt, Homo Sapiens
cagaugguuugccuugccuuuccacccccuaauugucaaccacaaaaaugagaaauuccucuuc

SEQ ID NO: 599179 - RNA, 64 nt, Homo Sapiens
ccaagggucagguuguuguacacuuacaguacgugucaaccauaauggaacauccacaaaugca

SEQ ID NO: 599180 - RNA, 64 nt, Homo Sapiens
uguaccacuauaccacugggggugcugugugugagucaaccacuaauggccaaaacauagugga

SEQ ID NO: 599181 - RNA, 64 nt, Homo Sapiens
aucaguguuuauagagugaauaaccguuucccccgucaaccaaaagacugaacuacugugugug

SEQ ID NO: 599182 - RNA, 64 nt, Homo Sapiens
cacauaucaacacauuuauuuauacuaaauaacugucaaccauuuucuaacaaaaaguaagacu

SEQ ID NO: 599183 - RNA, 64 nt, Homo Sapiens
gaaggcucugguggagaaccugugcaugaaggccgucaaccaguccauaggugagccuggcugc

SEQ ID NO: 599184 - RNA, 64 nt, Homo Sapiens
aaaaggaaaaaaaaaaaagaacugcugugggauugucaaccagcuuaucugcaggauguuucag

SEQ ID NO: 599185 - RNA, 64 nt, Homo Sapiens
gcuugccaagacucauugcuggagguagagaggugucaaccagagaacagcuccccuagacaug

SEQ ID NO: 599186 - RNA, 64 nt, Homo Sapiens
uguauuugacauguaaaauauguacaguauuaacgucaaccaucucuuuaaaguuagccuauaa

SEQ ID NO: 599187 - RNA, 64 nt, Homo Sapiens
aagaagaaaagagaagaagaaaaaaacgaaaacagucaaccaaccccaucgccaacuaagcgag

SEQ ID NO: 599188 - RNA, 64 nt, Homo Sapiens
cauuaaggaccuugguagcugugcuucagcaaacgucaaccaugguagcaaauuggugaggcug

SEQ ID NO: 599189 - RNA, 64 nt, Homo Sapiens
caaagcagaggcugugggcugucacagaugcugugucaaccagggcccuagggcuaagggccug

SEQ ID NO: 599190 - RNA, 64 nt, Homo Sapiens
ugcaaugcaggcccuggaggacugugcgucacccgucaaccagagcgugccuccgggccagcuu

SEQ ID NO: 599191 - RNA, 64 nt, Homo Sapiens
gagaaagccagagauuagcccucauuccgcaucugucaaccaggacagaaagcauggacaaggg

SEQ ID NO: 599192 - RNA, 64 nt, Homo Sapiens
guagaaagcuuugcuuauggcagaaguuugucaagucaaccaaucaaagagaaaaaaaguuugc

SEQ ID NO: 599193 - RNA, 64 nt, Homo Sapiens
uuuuuccucaaguucccuggauagaugcauaagggucaaccacaccacucucugcuuggcauca

SEQ ID NO: 599194 - RNA, 64 nt, Homo Sapiens
gauaggccacauuccaguaauccauuucagauuugucaaccagcgcacugccauuuggagacau

SEQ ID NO: 599195 - RNA, 64 nt, Homo Sapiens
accaauaucucuaucucagcuaauuggcuccucagucaaccaugcacuaggcauaaacagguuu

SEQ ID NO: 599196 - RNA, 64 nt, Homo Sapiens
gaggcugcccugaacaaaaauaaaauguuauuaugucaaccaguaaaaaacguauuaucuuuaa

SEQ ID NO: 599197 - RNA, 64 nt, Homo Sapiens
gcaaaagguuauuaagaauaagguuauuaaaugggucaaccagaagcaacacuuuuuuucuucc

SEQ ID NO: 599198 - RNA, 64 nt, Homo Sapiens
guagaugaaguguccuuauguguugaaaaugacagucaaccagacuaccuuauguaaauuauga

SEQ ID NO: 599199 - RNA, 64 nt, Homo Sapiens
aaaguauagagaaaaguguauuugagucacuugugucaaccacuuuccuuguacucuuaggaua

SEQ ID NO: 599200 - RNA, 64 nt, Homo Sapiens
uuuaagguauugugcaucgacauaaguucuuaaugucaaccaucuuggucauuauuucagugug

SEQ ID NO: 599201 - RNA, 64 nt, Homo Sapiens
ccucccucucauucccauccuuccugguacugcagucaaccaaagauggcaugacuuaccugcg

SEQ ID NO: 599202 - RNA, 64 nt, Homo Sapiens
acaaagcuucucucaagagcucucguaguggccugucaaccacuuucggagaaugagccagguc

SEQ ID NO: 599203 - RNA, 64 nt, Homo Sapiens
guagucaccuaugucugugcaaggcuguaagauagucaaccacaugauagugucccaguacaaa

SEQ ID NO: 599204 - RNA, 64 nt, Homo Sapiens
agucaaggaugagcaccagguugucuucaccauugucaaccagcagauuaauguacccugcguu

SEQ ID NO: 599205 - RNA, 64 nt, Homo Sapiens
uguggcuuccugugccuagaagaagcccugaucagucaaccagcucaaccaacauccaguccug

SEQ ID NO: 599206 - RNA, 64 nt, Homo Sapiens
uacaccuggcacacuggggucugcacaaggcuuugucaaccaaagacagcuucccccuuuugau

SEQ ID NO: 599207 - RNA, 64 nt, Homo Sapiens
augucacuuauaaggggagaaguguucuuaaaaagucaaccagaaaacuguuaugccuuuuauu

SEQ ID NO: 599208 - RNA, 64 nt, Homo Sapiens
accaucuucaucucuagcaccuccccugccaagagucaaccacuaagcaaucccacccaagccu

SEQ ID NO: 599209 - RNA, 64 nt, Homo Sapiens
gcugccugauggcaucaccguggaggucauuguggucaaccaggucaaugccgggcaccuguuc

SEQ ID NO: 599210 - RNA, 64 nt, Homo Sapiens
gucugacaauauuaaauggauucaguuaucugcggucaaccacgacggugucacuuuccauggg

SEQ ID NO: 599211 - RNA, 64 nt, Homo Sapiens
aggcuggcagggugugauccugaaaaccgagccagucaaccacaaagguucugugcugucucau

SEQ ID NO: 599212 - RNA, 64 nt, Homo Sapiens
ugauguggucacucggcuagcaggcccuucuguggucaaccacaugaugccugcuaguuaugau

SEQ ID NO: 599213 - RNA, 64 nt, Homo Sapiens
gaugcagagcagccaaggauauguugacccagaugucaaccaggcuauuuuuauacuuaaaaca

SEQ ID NO: 599214 - RNA, 64 nt, Homo Sapiens
uagaugcaugugaugcaugucucagguuuucucagucaaccagcuauccuuuuuagugcuauuu

SEQ ID NO: 599215 - RNA, 64 nt, Homo Sapiens
uuuuuuuuuuuucuuaacccguucagugcugccagucaaccaagggucugugagugucagcgug

SEQ ID NO: 599216 - RNA, 64 nt, Homo Sapiens
cagucuuuguuguuagcacugaauuauugaaaaugucaaccagauucuagaaacugcggucauc

SEQ ID NO: 599217 - RNA, 64 nt, Homo Sapiens
ucuuucuuucuuuuuuuugagauggucuuguucugucaaccaggcuagaaugcagcggugcaau

SEQ ID NO: 599218 - RNA, 64 nt, Homo Sapiens
gcaggcuggaagcaccagggaauuaauucccccagucaaccaauggcauccagagagggcaugg

SEQ ID NO: 599219 - RNA, 64 nt, Homo Sapiens
ucugcugucccauagggacugcgacugggaccaggucaaccacgccaggggggugucaccagcc

SEQ ID NO: 599220 - RNA, 64 nt, Homo Sapiens
augcagggggccuuccucuacaguucugcugcaagucaaccagcugggaagaagaagcuccagc

SEQ ID NO: 599221 - RNA, 64 nt, Homo Sapiens
ggcacccagagagggcauggaauuaauucccccagucaaccaaugcaggcuggaagcaccaggg

SEQ ID NO: 599222 - RNA, 64 nt, Homo Sapiens
cagaacacaagguaggaugucucaauagugaagugucaaccaucugaaaagaaaacuuuccucc

SEQ ID NO: 599223 - RNA, 64 nt, Homo Sapiens
uucucucuugucacugaauaggaagaaguaccaagucaaccaagcugaggaguugaaagaacaa

SEQ ID NO: 599224 - RNA, 64 nt, Homo Sapiens
ucaaauuccuacacugucucgugaccuugauccagucaaccacugugugugugugugugugugu

SEQ ID NO: 599225 - RNA, 64 nt, Homo Sapiens
acucaagacuguucuggaaugaggguccaggccugucaaccauggggcuucugaccugagcacc

SEQ ID NO: 599226 - RNA, 64 nt, Homo Sapiens
aagcaagagaagucacagcagcaagacacgcacagucaaccauuuuccgagaaaaaaagaaaau

SEQ ID NO: 599227 - RNA, 64 nt, Homo Sapiens
ggguggauucgggagcugggaguaaccaggcaaagucaaccagaugccuagcuccugcugagac

SEQ ID NO: 599228 - RNA, 64 nt, Homo Sapiens
aagucaagaccacuguccccuauguuuuuaaaccgucaaccaaguuuaaaauauaaaauucuuu

SEQ ID NO: 599229 - RNA, 64 nt, Homo Sapiens
cuuuaguaguuuaccauaagggaauuuccuuuaagucaaccaugauuucuccuugauuucuaca

SEQ ID NO: 599230 - RNA, 64 nt, Homo Sapiens
ugcugcaguuuuaccccagcagucagcugucuuugucaaccauacguuuuuggagauugggucu

SEQ ID NO: 599231 - RNA, 64 nt, Homo Sapiens
uuuaaacauaaagaauucacgaauuuuuuuaaucgucaaccacuuugauucgaagggucuuaaa

SEQ ID NO: 599232 - RNA, 64 nt, Homo Sapiens
ugcauggcugggcuccaggggccaucggcagcaugucaaccauucccagcgauucugcagagcg

SEQ ID NO: 599233 - RNA, 64 nt, Homo Sapiens
ucucugccccucagguccuggcccuuggguccuugucaaccagaggucuagggaaccacaaccc

SEQ ID NO: 599234 - RNA, 64 nt, Homo Sapiens
gugugcucagagggucagucuuuuacacaugugggucaaccacuguucagccccagucacccuc

SEQ ID NO: 599235 - RNA, 64 nt, Homo Sapiens
aauccugcucccucucuucauaaauacccucuuugucaaccagauguacccaguaaacccuaaa

SEQ ID NO: 599236 - RNA, 64 nt, Homo Sapiens
aaacugugucuaugcaaccuuccaagugcggagugucaaccaacuggacgggagagaguacugc

SEQ ID NO: 599237 - RNA, 64 nt, Homo Sapiens
cuacguuccuugucuuuuuccaaaggccagaauugucaaccaauuucuuuaauugaacauugua

SEQ ID NO: 599238 - RNA, 64 nt, Homo Sapiens
augcacagcuuggccuguuaaguuaaaugugggugucaaccaguggaaaagaucaaaggaccuu

SEQ ID NO: 599239 - RNA, 64 nt, Homo Sapiens
uuuaaaauuaggcugaauguacuucaugugauuugucaaccauaguuuaucagagauuauggac

SEQ ID NO: 599240 - RNA, 64 nt, Homo Sapiens
accagagggguaguuuucuuuaauacauacuucugucaaccagaaagccucacagggaaucuga

SEQ ID NO: 599241 - RNA, 64 nt, Homo Sapiens
ucccaucucuuuuuaagaagaaaagcggguuugggucaaccauuuucacaugcaguguacucca

SEQ ID NO: 599242 - RNA, 64 nt, Homo Sapiens
acagaacaugagcccuuuuuauuacaauaauuuugucaaccaaucuccuuagcccccccaaaaa

SEQ ID NO: 599243 - RNA, 64 nt, Homo Sapiens
agagccaaguguuaucucaacuacaucccacugugucaaccagaguuaucaaacagagcauggu

SEQ ID NO: 599244 - RNA, 63 nt, Homo Sapiens
uugccuuaguggcuugccugugccucuggguggauuacauaugauaguaaagcccaccuguuu

SEQ ID NO: 599245 - RNA, 63 nt, Homo Sapiens
uaauacagcugugaagggcuaaaguuagaguugauuacauaaguaaguauuccccauauaauc

SEQ ID NO: 599246 - RNA, 63 nt, Homo Sapiens
uaaaacauuaagaaaauuauggcuguugcugucauuacauaucuauuaaaugucaucaaauau

SEQ ID NO: 599247 - RNA, 63 nt, Homo Sapiens
aaguaaguagcauaaaucaguauuuaaccuaaaauuacauauuugaaacagaagauauuaugu

SEQ ID NO: 599248 - RNA, 63 nt, Homo Sapiens
cgaagaacuggagacccugucaaauaugacaggauuacauaagggacacugauauacugaaag

SEQ ID NO: 599249 - RNA, 63 nt, Homo Sapiens
cuaaaugaaggauugcuaaauguuuuugguucaauuacauaaaaauuaauauucugggucuga

SEQ ID NO: 599250 - RNA, 63 nt, Homo Sapiens
cccauauucaacauuuuguguacuguuuuucuaauuacauauauuacaaugaacaaccuuaug

SEQ ID NO: 599251 - RNA, 63 nt, Homo Sapiens
aaacuuacaagucaagccuagccugauaauccuauuacauaguuugaaaaauaguauuuuauu

SEQ ID NO: 599252 - RNA, 63 nt, Homo Sapiens
uccccagaggggcccuagugccucuguuccugaauuacauaagaauguaccaugccgggaagc

SEQ ID NO: 599253 - RNA, 63 nt, Homo Sapiens
ugccuccagccugaguccuaggcucuaaaagauauuacauauuugaacuaauagaggaacucu

SEQ ID NO: 599254 - RNA, 63 nt, Homo Sapiens
agaaccaaaaauaccuagauuuuuggagaacuuauuacauacauagaaacaugaauaugguuu

SEQ ID NO: 599255 - RNA, 63 nt, Homo Sapiens
agguucacuuggaccuagugcugccuccuguuuauuacauagcauggcccuuaugucuugagu

SEQ ID NO: 599256 - RNA, 63 nt, Homo Sapiens
uuugagaaaucuacaccaaagugguuuuuuaaaauuacauaacuaaaaauaaaccacacugug

SEQ ID NO: 599257 - RNA, 63 nt, Homo Sapiens
ggauuuccugcuggaccacaagguucuguugauauuacauagaacggguauuccagacacuuc

SEQ ID NO: 599258 - RNA, 63 nt, Homo Sapiens
ucuugaugucuuccuucaaauuaaugaccuuggauuacauaaggauuucuaugcauucauuau

SEQ ID NO: 599259 - RNA, 63 nt, Homo Sapiens
uaauuaauauuaauauuaacaauauugauguuaauuacauagcauacuauuucaauaaauuau

SEQ ID NO: 599260 - RNA, 63 nt, Homo Sapiens
ccagugguccaacuauaauuuaguuuaaauucaauuacauaguuugaaauccaaagaaaauua

SEQ ID NO: 599261 - RNA, 63 nt, Homo Sapiens
uauauauaaacuugugguauuauauaugcauacauuacauaccgggaggauggggaagcuuuu

SEQ ID NO: 599262 - RNA, 63 nt, Homo Sapiens
auguucucuguucaaaaguacccgccuccucuaauuacauauguauagcugcaccaacaauau

SEQ ID NO: 599263 - RNA, 63 nt, Homo Sapiens
aguauggaguaugcuguaaaggauuugggauagauuacauagguuggacaguuucauuuuuuu

SEQ ID NO: 599264 - RNA, 63 nt, Homo Sapiens
uuuuuaucuuuuguuaaaauuauguuuaacuggauuacauagaaaauguauccuaaucuuaug

SEQ ID NO: 599265 - RNA, 63 nt, Homo Sapiens
guacaccagauuuugauuucuccaauauucuguauuacauacuuuuuaaaaaaggaauuaaca

SEQ ID NO: 599266 - RNA, 63 nt, Homo Sapiens
ugcuaaagcauuuugcauaugguuguugugaggauuacauauacaguaaccccuaccucacag

SEQ ID NO: 599267 - RNA, 63 nt, Homo Sapiens
augccagauuacaaaauacuccuaacaauucucauuacauacuugaaauucccuguucuaguu

SEQ ID NO: 599268 - RNA, 63 nt, Homo Sapiens
cuucacucucuucucuucauuauuuugcacuugauuacauaucauucucuguacuuaccacag

SEQ ID NO: 599269 - RNA, 63 nt, Homo Sapiens
uuagaacauggauuuugcacacuccuggcaauuauuacauaugaagaucaacaagagcacugu

SEQ ID NO: 599270 - RNA, 63 nt, Homo Sapiens
uagcagagauuuuagucaguagccacaaaguagauuacauaaucaaaguauccaauauuuuaa

SEQ ID NO: 599271 - RNA, 63 nt, Homo Sapiens
aguuguccuuuaaugaaaauuguaaagaaaaaaauuacauaucccuucuugcuuuuucauauc

SEQ ID NO: 599272 - RNA, 63 nt, Homo Sapiens
cuggaagacugagaaggguaacagcacugaaguauuacauaacugauugugagugaaccuaga

SEQ ID NO: 599273 - RNA, 63 nt, Homo Sapiens
ggucauuguuaacaaacaaaaacaaauaacauuauuacauauauuguguugugugaauuuauu

SEQ ID NO: 599274 - RNA, 63 nt, Homo Sapiens
cccgcuaauaaauuuauguuuucccacauauauauuacauauaauuugcucauuccccuguau

SEQ ID NO: 599275 - RNA, 63 nt, Homo Sapiens
uguucauguuuugcuaaugcucguaucuccuugauuacauaauguuaguagcacugagacccc

SEQ ID NO: 599276 - RNA, 63 nt, Homo Sapiens
uagaggaaaagcagauacuagaauucuaauuuaauuacauauacagccgucuuuguuuauagu

SEQ ID NO: 599277 - RNA, 63 nt, Homo Sapiens
ugagccuuaaucauguaacaaaauauuuuguagauuacauauugauuuuucaaaaauuaaaaa

SEQ ID NO: 599278 - RNA, 63 nt, Homo Sapiens
guugcauaguuaccagggaagauuaguccagugauuacauaagaguugggcaccauaaauucu

SEQ ID NO: 599279 - RNA, 63 nt, Homo Sapiens
aauuacacaagaaaacaguauugcaaugacaccauuacauaaggaacauugaacuguuagagg

SEQ ID NO: 599280 - RNA, 63 nt, Homo Sapiens
aaaaacugauaguuacuugcuuguuuuuuaaaaauuacauauuaaaaaugcccuuggcauaag

SEQ ID NO: 599281 - RNA, 63 nt, Homo Sapiens
uagucacacaucauuugauaaguuggauguuccauuacauagaggaacacaaaauuccagggu

SEQ ID NO: 599282 - RNA, 63 nt, Homo Sapiens
uuuuuacucuguuauugugguaauggacagaauauuacauacaaaaauauucugggagagcuu

SEQ ID NO: 599283 - RNA, 63 nt, Homo Sapiens
uuuucuaauuuuaugccuuaaaauagguuucugauuacauaaaauuugaauagaacacucaag

SEQ ID NO: 599284 - RNA, 63 nt, Homo Sapiens
uaagugccugggggaaggauacaauuuuuagaaauuacauauugggucaguuuuguuuuguuu

SEQ ID NO: 599285 - RNA, 63 nt, Homo Sapiens
uuauuuuuucuguggucuuacugaucuuuguauauuacauacaugcuuugaaguuucuggaaa

SEQ ID NO: 599286 - RNA, 63 nt, Homo Sapiens
cagauagcucuuuuugcuuugcauuuaagcaugauuacauauuaaagugaauuugauagcuca

SEQ ID NO: 599287 - RNA, 63 nt, Homo Sapiens
uacuucaagcaacacaauaaaguacauacuugcauuacauaggaaauauagguauuuuaguac

SEQ ID NO: 599288 - RNA, 63 nt, Homo Sapiens
uuuauauaaaauccaucucucgcuuauuauguuauuacauaugcauugggaaauuuucaugca

SEQ ID NO: 599289 - RNA, 63 nt, Homo Sapiens
uuuguuuuuacaauucugaacaucuuagaaaaaauuacauaguuuaaaaguaagucauuuaua

SEQ ID NO: 599290 - RNA, 63 nt, Homo Sapiens
uguuuaaacucugucuuccaaggaaaacuuuucauuacauacuaguguaucacagcuuucauu

SEQ ID NO: 599291 - RNA, 63 nt, Homo Sapiens
uuuuauuguuuauaauaaaauuguaguugagacauuacauauaacccuuucaacaugaaaggu

SEQ ID NO: 599292 - RNA, 63 nt, Homo Sapiens
ucuuuuuuucuuguuuuuauauuuuucuucucuauuacauaucaguguauauaaaaacgguuu

SEQ ID NO: 599293 - RNA, 63 nt, Homo Sapiens
ccucccacagcaaguccguauuugaguggccugauuacauauucagccucaagugcaggcauu

SEQ ID NO: 599294 - RNA, 63 nt, Homo Sapiens
ugcagaugcagaaagcagccagagaaccaugaaauuacauagauuucuguaaaugaaauuggu

SEQ ID NO: 599295 - RNA, 63 nt, Homo Sapiens
uguagacaauugguauaugauuagguagguguuauuacauaucaccuucuuaaaauaugugcu

SEQ ID NO: 599296 - RNA, 63 nt, Homo Sapiens
ucuuauccuaagagaaagcucuuguguaacaugauuacauaauuuguuuccaucacuguauua

SEQ ID NO: 599297 - RNA, 63 nt, Homo Sapiens
guaauuaaaaauaugaauuaagacugugauauuauuacauaauauacauuuaacuuguaaaau

SEQ ID NO: 599298 - RNA, 63 nt, Homo Sapiens
uuuggaauucacuuuuuucauuauuuuagauuuauuacauagacagaagacagugaugcugua

SEQ ID NO: 599299 - RNA, 63 nt, Homo Sapiens
ucuguaauaauagagcccuucuuuugaaucaaaauuacauauggacuuuggaagauugcuccu

SEQ ID NO: 599300 - RNA, 63 nt, Homo Sapiens
uuguaccguugucuucaucacugggaaaugauuauuacauaguacagaagauucuuuguuuuu

SEQ ID NO: 599301 - RNA, 63 nt, Homo Sapiens
auucuugguuuuuaaacuuuaccaugugucugaauuacauagugugcuuguaaaaagaagagu

SEQ ID NO: 599302 - RNA, 63 nt, Homo Sapiens
agaaauuucucaucacagggauuuagacuuacuauuacauaaaggcuaacuaugagcuugcuc

SEQ ID NO: 599303 - RNA, 63 nt, Homo Sapiens
uauuucacuagaaaaaauuuaauaucaaggacuauuacauacuucauuacuaggaaguucuuu

SEQ ID NO: 599304 - RNA, 63 nt, Homo Sapiens
uuuuuguuaggcuguaaagaauuuaagcuguaaauuacauaaguuagaacaagcccaaauuua

SEQ ID NO: 599305 - RNA, 63 nt, Homo Sapiens
uuucauuauucucauaauccuucugcaacugaaauuacauauugcaggagacauuuucauauc

SEQ ID NO: 599306 - RNA, 63 nt, Homo Sapiens
acaaauuauauauauacauauccacacacauacauuacauauaucuguguauauaaauccaca

SEQ ID NO: 599307 - RNA, 63 nt, Homo Sapiens
gaguaugucagcuuuucucauugaaguaaagcgauuacauauugcgugacuguaaacacaucg

SEQ ID NO: 599308 - RNA, 63 nt, Homo Sapiens
aauuaauaaacauuuucaauuaggauuagaagaauuacauaaagagcaauguuuucagucuuu

SEQ ID NO: 599309 - RNA, 63 nt, Homo Sapiens
aguauuucuagaaaaagagaauaauugaacuagauuacauaaugucaggacagaaaagcuucc

SEQ ID NO: 599310 - RNA, 63 nt, Homo Sapiens
ugucacugaagugguuggggauauauagaauguauuacauaacuuuaauuauuagugguagua

SEQ ID NO: 599311 - RNA, 63 nt, Homo Sapiens
ucauucccaauuugugugugaaagauggcuauaauuacauauuguuguuuggauauuucauau

SEQ ID NO: 599312 - RNA, 63 nt, Homo Sapiens
cugaaagaggauuccgaaagaaauacuuauaaaauuacauauuuguucucucaguagaaaaaa

SEQ ID NO: 599313 - RNA, 63 nt, Homo Sapiens
agaaaucaauaagauaugugguugucaucuucaauuacauaacaagaaagaccacgugugcau

SEQ ID NO: 599314 - RNA, 63 nt, Homo Sapiens
guuacccuaaguuuuuuacauuuuuaaacucuaauuacauaugugaauguuauuacucucagu

SEQ ID NO: 599315 - RNA, 63 nt, Homo Sapiens
aucaggaaauagagaugauguggauauuuauauauuacauauauaaccaccagacuccauuuu

SEQ ID NO: 599316 - RNA, 63 nt, Homo Sapiens
ugguauuuaaagguaauauuuuuaauaugauacauuacauauugugaauguauacuaaaaaaa

SEQ ID NO: 599317 - RNA, 63 nt, Homo Sapiens
uaauaaauaaauauauuuuugacacaauuaaauauuacauagaguauguuuacaacaaauauc

SEQ ID NO: 599318 - RNA, 63 nt, Homo Sapiens
uucuggagaaaaauacuuauagacaguuuaacuauuacauagauauauaagugaucucaguuu

SEQ ID NO: 599319 - RNA, 63 nt, Homo Sapiens
aguuauuuccaaguuuguguauauauuauaaaaauuacauauauaaaacuaaggcuuuuauuu

SEQ ID NO: 599320 - RNA, 63 nt, Homo Sapiens
ucuaucucucuguguccaggauagcugggaggcauuacauagucaugugcgaggucaaaacug

SEQ ID NO: 599321 - RNA, 63 nt, Homo Sapiens
aaauuuugcagaauuccuccuuucuacccauaaauuacauauauuuuucuucuuuagucaugg

SEQ ID NO: 599322 - RNA, 63 nt, Homo Sapiens
ucuuucccuguguacugguauuauuaaaaagacauuacauacgcaagucuuucucgacaauca

SEQ ID NO: 599323 - RNA, 63 nt, Homo Sapiens
gaaauacauggauuuaacuuguuaaacauacaaauuacauagcugccauuugcauacauuuug

SEQ ID NO: 599324 - RNA, 63 nt, Homo Sapiens
uagaugguauuaucacagauuuaaaaagguuguauuacauauuguuuaaacuuuguaaguaga

SEQ ID NO: 599325 - RNA, 63 nt, Homo Sapiens
uaaaacauucuccaucaacaucuacagaugaaaauuacauaaaaagaugaggacagaagcauc

SEQ ID NO: 599326 - RNA, 63 nt, Homo Sapiens
uugguaaacuagagagacauuacacuaauaucaauuacauauuauuuuuauguacuaaauauu

SEQ ID NO: 599327 - RNA, 63 nt, Homo Sapiens
uauuacauucacuauauuaauuuguuaugaguaauuacauauacuuuuaaagguuuugaccau

SEQ ID NO: 599328 - RNA, 63 nt, Homo Sapiens
aaaauugauuaaaacacuuccagucuauuuaugauuacauaucuuuaccuggguuugagccua

SEQ ID NO: 599329 - RNA, 63 nt, Homo Sapiens
aaacaauggacccaagagaaaacuguacuggcuauuacauaagaaagcuaacacaggaaaagg

SEQ ID NO: 599330 - RNA, 63 nt, Homo Sapiens
auauaaacagagaaauaccuuagccaaaagcugauuacauaugauuuacuaccacuuguucuu

SEQ ID NO: 599331 - RNA, 63 nt, Homo Sapiens
gauuuuaccuauccacaauaagaauuaccauuaauuacauacaccacucuguaauaguucagu

SEQ ID NO: 599332 - RNA, 63 nt, Homo Sapiens
uuggugaaacugaaaaaguaauuaagaaucaucauuacauaacgacgggcacauuuuucaacg

SEQ ID NO: 599333 - RNA, 63 nt, Homo Sapiens
uuuuguauauuuguuuuauguuuuuagaggacuauuacauauuuugagaguauagcaugaaug

SEQ ID NO: 599334 - RNA, 63 nt, Homo Sapiens
ggaucuaagagauuaauaccauaaaaguggcacauuacauaucaccucaucuuugaauuuaga

SEQ ID NO: 599335 - RNA, 63 nt, Homo Sapiens
uauaagugccauauuuaaaaauuaauaugaaauauuacauauaucaacacaaaagguuuuccc

SEQ ID NO: 599336 - RNA, 63 nt, Homo Sapiens
aacuucaaaaaaguggguuaaaauaauuggcuuauuacauauauuuauucuuaaaaagcucau

SEQ ID NO: 599337 - RNA, 63 nt, Homo Sapiens
auauuuaaaucaaacaucauucauagaaagcauauuacauacauguuuauacauaagcauuac

SEQ ID NO: 599338 - RNA, 63 nt, Homo Sapiens
uuguggguauuuuuuugguagcacauguaugcuauuacauacaaauuuuuauuucuaaaauau

SEQ ID NO: 599339 - RNA, 63 nt, Homo Sapiens
uagaacaucuuuuuuagugaaagaaugugccauauuacauauugcaaccuaauuuguuaaaac

SEQ ID NO: 599340 - RNA, 63 nt, Homo Sapiens
uaaucagaauuuugccuuuuuucuucucaaauuauuacauauguauguauuauauauccacau

SEQ ID NO: 599341 - RNA, 63 nt, Homo Sapiens
ucagcagccgcuauuaccguaucuuacaauuuaauuacauacacagugaauugaaaccauugu

SEQ ID NO: 599342 - RNA, 63 nt, Homo Sapiens
auuauucuaaacuauucauucagcaugccuauaauuacauaaauuguaugagacuuuuuguug

SEQ ID NO: 599343 - RNA, 63 nt, Homo Sapiens
uuccuuuuacauucuuuuuauaugcauucugacauuacauauuuuuuaagacuauggaaauaa

SEQ ID NO: 599344 - RNA, 63 nt, Homo Sapiens
cauugaucuauccguaccaaaugauguugaauaauuacauaucuuucuugacuauacugauuu

SEQ ID NO: 599345 - RNA, 63 nt, Homo Sapiens
cacuagcauguuuuucagaccaaauauuaucagauuacauauaauuuaaucaaauuaauuuau

SEQ ID NO: 599346 - RNA, 63 nt, Homo Sapiens
auuaaucuguguaauaaacugguuacuacagucauuacauauaauuuugugugaauaggcuuu

SEQ ID NO: 599347 - RNA, 63 nt, Homo Sapiens
ccagaaaaaagauuaaugguccugaguaggaauauuacauaauuuugauugcaucauuaguua

SEQ ID NO: 599348 - RNA, 63 nt, Homo Sapiens
uuggagcacacccuaguaaccucuugagauuaaauuacauagucuuaauauuucuguuccucc

SEQ ID NO: 599349 - RNA, 63 nt, Homo Sapiens
auuuccuaagcaucugccuuuucaacaagauuuauuacauaucuugaauagaguaucaccuuu

SEQ ID NO: 599350 - RNA, 63 nt, Homo Sapiens
cuuauauuuacuuuaaaaaacauuuagaugguaauuacauaucucucuuuaaauuuaaaucuu

SEQ ID NO: 599351 - RNA, 63 nt, Homo Sapiens
aagaacaaucacaucaguaaugauuauguauagauuacauaggacaugagaaaucacucacuu

SEQ ID NO: 599352 - RNA, 63 nt, Homo Sapiens
aauuuuguggaagcauuuugucacaccuuuugcauuacauaauauuuucauuugaaauguuuu

SEQ ID NO: 599353 - RNA, 63 nt, Homo Sapiens
guguauggguauugaugaggcaccuccauuuguauuacauauguccacuuuuuuuaaucguaa

SEQ ID NO: 599354 - RNA, 63 nt, Homo Sapiens
agguuuuccugauuuauauuuuuuggcccaauuauuacauauccuguguuuugugauuuucau

SEQ ID NO: 599355 - RNA, 63 nt, Homo Sapiens
gcugaguguucugucaccccaccuucguaacuaauuacauaucaaagcaaugccuuagcguua

SEQ ID NO: 599356 - RNA, 63 nt, Homo Sapiens
ugacucuuucaaagaaauccuuucaauucuguaauuacauauucuuugugaauuaacacagug

SEQ ID NO: 599357 - RNA, 63 nt, Homo Sapiens
aagcacaugaaguaguuugagacuucuggcacuauuacauaguugagggaagcaugaaccuca

SEQ ID NO: 599358 - RNA, 63 nt, Homo Sapiens
uauguagaaauauauguaauauauauauauaaaauuacauauauucuguguuagaaagguuuu

SEQ ID NO: 599359 - RNA, 63 nt, Homo Sapiens
ugaguaaugguuacuaggcuuaauaccugggugauuacauaaucuguacaaugaacccccaug

SEQ ID NO: 599360 - RNA, 63 nt, Homo Sapiens
uuuuaauuuauuaccuuuacaacauuuauuuacauuacauacauacauuuacaacauuuauua

SEQ ID NO: 599361 - RNA, 63 nt, Homo Sapiens
cggcgagagggcuugagucucaaggacucacugauuacauacccaaaggcucuuuucagagcc

SEQ ID NO: 599362 - RNA, 63 nt, Homo Sapiens
cuuccuggggccaguauuaccuuguaugcaaauauuacauaugaugggugcauugucagaggg

SEQ ID NO: 599363 - RNA, 63 nt, Homo Sapiens
uauucacugaauugucaguuuccuucauuugguauuacauauuuaauucuuaaauauugaggc

SEQ ID NO: 599364 - RNA, 63 nt, Homo Sapiens
cugagccucaguuuucuccuuugcaaauuaauaauuacauaccuuuauagauuuugaaauuaa

SEQ ID NO: 599365 - RNA, 63 nt, Homo Sapiens
gcaacauacaauugcaaaagaugaguuuaaaaaauuacauacaaacagcuuguauuauauuuu

SEQ ID NO: 599366 - RNA, 63 nt, Homo Sapiens
uuaaauuaauacucuuauuuuuuauuuaauuuaauuacauaaauuaaaccuuaccaugaccaa

SEQ ID NO: 599367 - RNA, 63 nt, Homo Sapiens
uuauaacuauaguaaaaaauuaauauauauccuauuacauaaauguuauuucuuagguguucc

SEQ ID NO: 599368 - RNA, 63 nt, Homo Sapiens
cuuuugagcgcauggaacuccauaaacuaacaaauuacauaaacuaaagggggauuuucuuuc

SEQ ID NO: 599369 - RNA, 63 nt, Homo Sapiens
gauaucaaccuauuuucacaucauaaaacaucuauuacauaaaauaaagguccaggcauagug

SEQ ID NO: 599370 - RNA, 63 nt, Homo Sapiens
uaguaauagcuauuuuauugauauuauuacuuuauuacauaucuuuuauagggaaacauucug

SEQ ID NO: 599371 - RNA, 63 nt, Homo Sapiens
gcuaaaauuguguugaugcuguuuacucaccuaauuacauaguuuuaaucauuuguacauaau

SEQ ID NO: 599372 - RNA, 63 nt, Homo Sapiens
auaaaaauuauuuaacauuuauauuuuuacuugauuacauaugcacauguauguaaauguaaa

SEQ ID NO: 599373 - RNA, 63 nt, Homo Sapiens
ugguaagcuauaauugaaacuuuuugucagcuaauuacauaaucuauucuacaucagacuuga

SEQ ID NO: 599374 - RNA, 63 nt, Homo Sapiens
ccuccaguaaguaauacugacuugaccuagaauauuacauauuuaggaugagccucuccuaga

SEQ ID NO: 599375 - RNA, 63 nt, Homo Sapiens
ucaaaaauccaguggaaagauaccuagagggaaauuacauacauuuauuuccaucccauggau

SEQ ID NO: 599376 - RNA, 63 nt, Homo Sapiens
uuauaaugcccugcaacucuagucuuaacuaaaauuacauauuugcacaaaaauauuauuauu

SEQ ID NO: 599377 - RNA, 63 nt, Homo Sapiens
caggaauuaaauaguuuggaaaauaaaugcuuaauuacauauagaaaguguuaaaauuucuga

SEQ ID NO: 599378 - RNA, 63 nt, Homo Sapiens
gauucuggaacaaaacaguuaaaaucgaacuuuauuacauacuuaccugggggugccuugauu

SEQ ID NO: 599379 - RNA, 63 nt, Homo Sapiens
accgauaacagccaugcacugugaugauggacaauuacauaguagcacuaauaucauagugcu

SEQ ID NO: 599380 - RNA, 63 nt, Homo Sapiens
ggggcuguggacgucuuugguugauuggaccucauuacauaagcuagcauggcuaauugauca

SEQ ID NO: 599381 - RNA, 63 nt, Homo Sapiens
uauaaaaaaaccuaucuguauuuguaaaaucaaauuacauauaacaauuugauaugcuucaau

SEQ ID NO: 599382 - RNA, 63 nt, Homo Sapiens
aaaaacccucuaaaccauggacagaauaaaagaauuacauauguguauauuuuguuaccuuuu

SEQ ID NO: 599383 - RNA, 63 nt, Homo Sapiens
aauuuguuauauauguuucuugaucacaguauaauuacauaagucauaaaauuauaugauuaa

SEQ ID NO: 599384 - RNA, 63 nt, Homo Sapiens
uuuuagaaaagggaguuuaaaaaugguaucaaaauuacauauacuacagucaagauagaaagg

SEQ ID NO: 599385 - RNA, 63 nt, Homo Sapiens
aagggcaaauaaugaucgaaaaaauaauuauuuauuacauaauuuaguuguuucuagacuaua

SEQ ID NO: 599386 - RNA, 63 nt, Homo Sapiens
uaauaucagaaugcaguccaaagagcaaaucauauuacauaauuacauuuuaauuaaauauag

SEQ ID NO: 599387 - RNA, 63 nt, Homo Sapiens
gauguacauguguagggaaaguuaaaaguguugauuacauaaucaaagcuaccuguggugaug

SEQ ID NO: 599388 - RNA, 63 nt, Homo Sapiens
ucuaccugccuuauacuacacuuaggaaaaaguauuacauaugguuuauuuugaaacuucaag

SEQ ID NO: 599389 - RNA, 63 nt, Homo Sapiens
gggcuaacuaccucugauccucuuugaccuuccauuacauaccuaauccuagcugucuccuca

SEQ ID NO: 599390 - RNA, 63 nt, Homo Sapiens
auaaaauauuuuguaauuaccuguagcuaauacauuacauagaaaaaaacuauguuaacagug

SEQ ID NO: 599391 - RNA, 63 nt, Homo Sapiens
ucuccuuaauaauggugguguuuagcaaauuguauuacauaaauaaauauuuauuucauggau

SEQ ID NO: 599392 - RNA, 63 nt, Homo Sapiens
gcaaauuugcuuaguaucuaauaaugaaguguuauuacauauagccggaauugaggaucucuu

SEQ ID NO: 599393 - RNA, 63 nt, Homo Sapiens
auucuuaacugguuguaaauuagaaaagcugggauuacauauggugugcgguuacagucuaaa

SEQ ID NO: 599394 - RNA, 63 nt, Homo Sapiens
uuaaaaccaugaacauuggcuaugaugaagauuauuacauaugaaaaaaaaacucacacaaca

SEQ ID NO: 599395 - RNA, 63 nt, Homo Sapiens
cccaaugagaaguucuauuuucauguucuuaauauuacauacaagaaaaugcaguuagguuau

SEQ ID NO: 599396 - RNA, 63 nt, Homo Sapiens
uuagucccuuccaaaaccauuuaguaggguucuauuacauaaacaguaggguuuuuccucucc

SEQ ID NO: 599397 - RNA, 63 nt, Homo Sapiens
uguacuuuugaacaagagcuccuccugaucacuauuacauauuuuucuagaaaaucuaaaguu

SEQ ID NO: 599398 - RNA, 63 nt, Homo Sapiens
ccuauuuagaguuggaaguugaacagcuguugcauuacauacuuuugcuuuuuuauugaaauu

SEQ ID NO: 599399 - RNA, 63 nt, Homo Sapiens
uacugaauauaaugaaaauggcaauaaaauaauauuacauaaacuguaaaguuccuuugauca

SEQ ID NO: 599400 - RNA, 63 nt, Homo Sapiens
uguucauggugaacuuuaucuuuuagucuccuuauuacauauaguagauauguaaaaugaaua

SEQ ID NO: 599401 - RNA, 63 nt, Homo Sapiens
gaauuauuucaugcauagucguaacaguguauaauuacauacuuggucauaguuuugugaugu

SEQ ID NO: 599402 - RNA, 63 nt, Homo Sapiens
aaguugugucugauuaauauuuuuuaguugaagauuacauauaugaaaagugagcucaaauuu

SEQ ID NO: 599403 - RNA, 63 nt, Homo Sapiens
uauuuaccugauaaauauguuaauuacuaaauaauuacauauuacugcucauguaucuugauc

SEQ ID NO: 599404 - RNA, 63 nt, Homo Sapiens
uauguaggaaaaaacauauuuuaaagagccuugauuacauaaauaccuaccaccugucuuugc

SEQ ID NO: 599405 - RNA, 63 nt, Homo Sapiens
cucuagugaucaugcaucuaauuuuaaccauuuauuacauaauaccugcaagauguggcuuga

SEQ ID NO: 599406 - RNA, 63 nt, Homo Sapiens
gugugacaacuucaaaauguuuauaaaucaugcauuacauaaaauaauauauuuuuguugcuu

SEQ ID NO: 599407 - RNA, 63 nt, Homo Sapiens
gaagaaaaaauggagcgauuuaggugaccaaauauuacauacauaaauagccacaugaaguuu

SEQ ID NO: 599408 - RNA, 63 nt, Homo Sapiens
uccuccuuuugacuuauuugguauguuguauauauuacauaaaauaacuuuucaaauauaguu

SEQ ID NO: 599409 - RNA, 63 nt, Homo Sapiens
cacauacauaguaaauuauaaucaaucaugggaauuacauaaggauaaugaggcccaacugaa

SEQ ID NO: 599410 - RNA, 63 nt, Homo Sapiens
aguuaucuuuuuaacaucuuauuuuuuucauuaauuacauaucaacauuaauuuuguaucuug

SEQ ID NO: 599411 - RNA, 63 nt, Homo Sapiens
gcuauauuuucuuagcaguuauuucuacaguuaauuacauagucaugauuguucuacguuuca

SEQ ID NO: 599412 - RNA, 63 nt, Homo Sapiens
gcuccauaccacacaccuaaaccuguauuaugaauuacauauuacaaagucauaaaugugcca

SEQ ID NO: 599413 - RNA, 63 nt, Homo Sapiens
auccaccuuacguagccgugugagcuccgguaaauuacauaacccaucaaauuucuuuaucua

SEQ ID NO: 599414 - RNA, 63 nt, Homo Sapiens
ugaaauucccaguauccaauugcacauauauacauuacauaaaugcaggaccuggauaugaac

SEQ ID NO: 599415 - RNA, 63 nt, Homo Sapiens
auuagagggaugagacagacgcgauauaauuuuauuacauauguaucuuugcuguuauugaca

SEQ ID NO: 599416 - RNA, 63 nt, Homo Sapiens
aauuucuccuucccaccaucgugucuucucucaauuacauagccaaccagccacuccagcuuu

SEQ ID NO: 599417 - RNA, 63 nt, Homo Sapiens
uguaaugcuuuauuaaauuuuagauaagugcuaauuacauauaauacacauauguuuuuuugg

SEQ ID NO: 599418 - RNA, 63 nt, Homo Sapiens
augugaugcucuagaaaauauuccugcuuguuaauuacauaauaugcaaaugucaguacugaa

SEQ ID NO: 599419 - RNA, 63 nt, Homo Sapiens
uaggcaacuaaaaacaaacauagcaccuggcccauuacauaucuuuauucuucaguguucaua

SEQ ID NO: 599420 - RNA, 63 nt, Homo Sapiens
gauagaggaauaggucaauaagguuaauguaauauuacauauugugaugucaggacauaaaug

SEQ ID NO: 599421 - RNA, 63 nt, Homo Sapiens
uacucaguaaacaaaagagagaaagagauacccauuacauaguaccuguauuacugaauauag

SEQ ID NO: 599422 - RNA, 63 nt, Homo Sapiens
aaaguuuuauauuucacauugcuguggacuauuauuacauauaucauuauuauauaaaucaug

SEQ ID NO: 599423 - RNA, 63 nt, Homo Sapiens
uuucuuggauuacuuugacuauucuaauguuuaauuacauaugguaacccuaaggccugggga

SEQ ID NO: 599424 - RNA, 63 nt, Homo Sapiens
caguacuucaaauggcacauagauaggcaggauauuacauagguaagcaggaauuuauacauu

SEQ ID NO: 599425 - RNA, 63 nt, Homo Sapiens
ugaucuauuuauuaucgcauaacacacugccuuauuacauaaccacaggacgaaugcauauuc

SEQ ID NO: 599426 - RNA, 63 nt, Homo Sapiens
guuaaguaauugcauguuaauccaacguaaauuauuacauaugucaugggaaggcuaauauau

SEQ ID NO: 599427 - RNA, 63 nt, Homo Sapiens
uucauaaguuguacaaccauuacaguucaguauauuacauaugugucauaacuauuuuaagug

SEQ ID NO: 599428 - RNA, 63 nt, Homo Sapiens
auaaggaauucacaguauauuacaaacccauucauuacauaguacacugugaaauauguugau

SEQ ID NO: 599429 - RNA, 63 nt, Homo Sapiens
cugugauguaucuuuacuggaguucucaucauuauuacauagauguguguguguuuuuuuuua

SEQ ID NO: 599430 - RNA, 63 nt, Homo Sapiens
cagacacacacagaaagacaacagagacacaccauuacauacaacacgcagccccuccccgcc

SEQ ID NO: 599431 - RNA, 63 nt, Homo Sapiens
cagacacgcaaucgcagauaacagagacacaccauuacauacaacacacacacccuccccgcc

SEQ ID NO: 599432 - RNA, 63 nt, Homo Sapiens
cagacacacacagaaagacaccacagagacaccauuacauacaucacacacacacccuccccg

SEQ ID NO: 599433 - RNA, 63 nt, Homo Sapiens
cagacacacacagaaagacaccacagagacaccauuacauacaucacacacacccccucccca

SEQ ID NO: 599434 - RNA, 63 nt, Homo Sapiens
auuauaaaaauucaaucauaaaagucaaaauauauuacauaauauaguuuaaugaaucauuac

SEQ ID NO: 599435 - RNA, 63 nt, Homo Sapiens
auuuaauuguucagacuuguaagagguucuucaauuacauaggcagguuuuucuuaaaaauga

SEQ ID NO: 599436 - RNA, 63 nt, Homo Sapiens
gugguuuuuaauuugaagaccccagagaauuccauuacauaaugauuuugcccuuguuauaaa

SEQ ID NO: 599437 - RNA, 63 nt, Homo Sapiens
uacuaugaggauuuuucucacugacauaauuugauuacauacuaaauaagaggauauguuaau

SEQ ID NO: 599438 - RNA, 63 nt, Homo Sapiens
agcuccguauuuacucaggagcagucaggguacauuacauaaaacaauggaggaugccucauu

SEQ ID NO: 599439 - RNA, 63 nt, Homo Sapiens
uccacaaaacuaacaggauaauugggcaaauaaauuacauauaaacacacacaaucuauauau

SEQ ID NO: 599440 - RNA, 63 nt, Homo Sapiens
cacuucauauauaauuaaucacuauuuuguauaauuacauauugcugcuuguguguuuuuuuu

SEQ ID NO: 599441 - RNA, 63 nt, Homo Sapiens
uuuaugauucuguaauaaucaagggagaaacccauuacauaguggacaauuuuuuuucuuuuu

SEQ ID NO: 599442 - RNA, 63 nt, Homo Sapiens
cuauuaagcaauaaguuuauuuacauuuguaagauuacauaaucuauuuugugaauucuaaag

SEQ ID NO: 599443 - RNA, 63 nt, Homo Sapiens
uuggcuagagcauaauaauuagaaaaagaaaacauuacauaaucagccugggugacagagaaa

SEQ ID NO: 599444 - RNA, 63 nt, Homo Sapiens
ccaaagaguuucuuacuucuucugagguccccaauuacauauccauuagcagcugggaaggug

SEQ ID NO: 599445 - RNA, 63 nt, Homo Sapiens
aauuuagaaaauuccuguguaauaugauuuuaaauuacauauuuaaaguuuuuaguuacuuaa

SEQ ID NO: 599446 - RNA, 63 nt, Homo Sapiens
cuccuuuauugugaagaguaacuaucagguuucauuacauauuuuguuacugaaagagacuac

SEQ ID NO: 599447 - RNA, 63 nt, Homo Sapiens
aaguucaguuagaaaagauggagacccaugaugauuacauauauagcauuuacaguacagcug

SEQ ID NO: 599448 - RNA, 63 nt, Homo Sapiens
ucuguauuauuuucacacucauauugcuuaaauauuacauauuagggauuguaagaaaacuuu

SEQ ID NO: 599449 - RNA, 63 nt, Homo Sapiens
aauucuaccuagaaugcaaaauuggguauaugaauuacauagcauguuguugggauuuuuuuu

SEQ ID NO: 599450 - RNA, 63 nt, Homo Sapiens
guuugugcuggagaaagguuuauuuggacuuugauuacauaaauauuaaaaucucugccuuac

SEQ ID NO: 599451 - RNA, 63 nt, Homo Sapiens
cauugaagcuauuaagauguuuugauuauccuaauuacauaaugaccgauuugagauagaggc

SEQ ID NO: 599452 - RNA, 63 nt, Homo Sapiens
uuuaguuauauggcaauggauuauaaauaaaugauuacauaauauucauaaauuuuuguuauu

SEQ ID NO: 599453 - RNA, 63 nt, Homo Sapiens
uaaucuuauuuaaucuucacucuccauauguucauuacauacauuauuauucuguuauuuuag

SEQ ID NO: 599454 - RNA, 63 nt, Homo Sapiens
aaauaaaugauacaucuugguuacuaaacuuguauuacauaucgguuauacauggcauaauug

SEQ ID NO: 599455 - RNA, 63 nt, Homo Sapiens
gucuuguauugucuguguacuuuaccuuauaauauuacauagaaaacuuacugugcuggacuc

SEQ ID NO: 599456 - RNA, 63 nt, Homo Sapiens
ccuuguaaccaucaguccaaagccugaaagcucauuacauacuggucaggauuuaggacucau

SEQ ID NO: 599457 - RNA, 63 nt, Homo Sapiens
guucaguugggauggaaauccuguuuccaggaaauuacauaaccguuugccuccacgagccug

SEQ ID NO: 599458 - RNA, 63 nt, Homo Sapiens
ugucucauucugccuuuuauaguucugaaauucauuacauaucaugauuuacauaugaaccuc

SEQ ID NO: 599459 - RNA, 63 nt, Homo Sapiens
uggguguuuuuaugucuucuaaaugugaauuaaauuacauagaggaaggugaugcaggggaga

SEQ ID NO: 599460 - RNA, 63 nt, Homo Sapiens
uauauuucacaagaaaucaguugcauauuauccauuacauauuuaguuuuaaaaggaggaguc

SEQ ID NO: 599461 - RNA, 63 nt, Homo Sapiens
uguagaauugaauuuccagugaccuguaauuucauuacauauauuuuaaaaucuauuuauuuu

SEQ ID NO: 599462 - RNA, 63 nt, Homo Sapiens
uguaauaguaagaacugucccauauguuaguaaauuacauauguacaaauugaaacuguaaau

SEQ ID NO: 599463 - RNA, 63 nt, Homo Sapiens
acacuaguuagauguuuguucaccauggggaccauuacauaugaccauacaaugcacugaauu

SEQ ID NO: 599464 - RNA, 63 nt, Homo Sapiens
uccuguaugcugagcugguaaaauacauuguaaauuacauauuaaauauuuuaucugcuuuua

SEQ ID NO: 599465 - RNA, 63 nt, Homo Sapiens
gauagcuggacacacaaggaaacguaaaauaucauuacauaguugaugauauguauuacugag

SEQ ID NO: 599466 - RNA, 63 nt, Homo Sapiens
uauuuauuuuuuaaguguaaauccucugguuuaauuacauaaaacuugaguuuuauuuaucuu

SEQ ID NO: 599467 - RNA, 63 nt, Homo Sapiens
uuuuuuuuuuuaacuuuaagauccucugguuuaauuacauaauacuugaguuuuauuuauuuu

SEQ ID NO: 599468 - RNA, 63 nt, Homo Sapiens
cuuaggcauuaacauguuuguaaaaaaagcuaaauuacauagaaauccuuguugaaguuuuuu

SEQ ID NO: 599469 - RNA, 63 nt, Homo Sapiens
uaaaacuguaucuguaagggaugccacauuucaauuacauauuuguauugaauacucaagaaa

SEQ ID NO: 599470 - RNA, 63 nt, Homo Sapiens
uauaauauauuuauaaaggacuaaucuagccaaauuacauauguaguggcaacagagucagug

SEQ ID NO: 599471 - RNA, 63 nt, Homo Sapiens
caggaguaccccuugaggcuauagccacugcauauuacauagcggugggaaguuguaucuugu

SEQ ID NO: 599472 - RNA, 63 nt, Homo Sapiens
aauugauuggcuuaucacaauuuaaauuaguuaauuacauacacaauuugaucuuuuuuaugg

SEQ ID NO: 599473 - RNA, 63 nt, Homo Sapiens
auuuguauuucuuuuuuagccauugcuauuuugauuacauagacaugaaugugcaguuugagc

SEQ ID NO: 599474 - RNA, 63 nt, Homo Sapiens
auucuuuuagaaaaugcaaaaguuuucuauuuuauuacauaaagcacaucucuauaaaucauu

SEQ ID NO: 599475 - RNA, 63 nt, Homo Sapiens
augugugauuuuguguuuugaauuacugucagaauuacauacacaauuacaacaaacuuuuuu

SEQ ID NO: 599476 - RNA, 63 nt, Homo Sapiens
aggacgaccagcugaggguguauuauaugcagaauuacauaaacgaagcucucaaagguaagg

SEQ ID NO: 599477 - RNA, 63 nt, Homo Sapiens
acacauauacacauaacaaguguagaaguauauauuacauacauacacucacucugucuggua

SEQ ID NO: 599478 - RNA, 63 nt, Homo Sapiens
uaaaaaaaagaauaacuuuuuuugccucuuuagauuacauagaagcauuguagucuugguaga

SEQ ID NO: 599479 - RNA, 63 nt, Homo Sapiens
uuauacaaaacaagccagcaucugaucaaaaguauuacauaaaauauuuucuuaaacuauuga

SEQ ID NO: 599480 - RNA, 63 nt, Homo Sapiens
acuaaaucugaaauggaauagaaaauagaauggauuacauacagaugguuuccuuguuagcag

SEQ ID NO: 599481 - RNA, 63 nt, Homo Sapiens
uauaaguggauuuagaagcgauuuugguuuuguauuacauacgguaguccucugcgucaggga

SEQ ID NO: 599482 - RNA, 63 nt, Homo Sapiens
uauguaaguaaaauuuuuaauuucuauuuuggaauuacauaguuuagugauggcucacucacu

SEQ ID NO: 599483 - RNA, 63 nt, Homo Sapiens
aguaugcuuaggcuuuacuauauguauuauaauauuacauaguucuaacuaaagucuccaagu

SEQ ID NO: 599484 - RNA, 63 nt, Homo Sapiens
ucuacuggacaucacagaauaugcaauguuuuuauuacauacuagacaucacacuagaaacau

SEQ ID NO: 599485 - RNA, 63 nt, Homo Sapiens
ggaaaacaauaauuuuaacuccuaaaaaguaucauuacauauauuguaucuuaaaaaucuaug

SEQ ID NO: 599486 - RNA, 63 nt, Homo Sapiens
auuuuaaaucaauguguauucuuuacuggaaagauuacauacauuugagaauaagaaauuacu

SEQ ID NO: 599487 - RNA, 63 nt, Homo Sapiens
uaauaguugauaucaccagugacuuuaacuuucauuacauaucaucuguaacagaaaagccaa

SEQ ID NO: 599488 - RNA, 63 nt, Homo Sapiens
ucggcuaccgugucuggccgcagaguaucugggauuacauaugugauccucugccucagccuc

SEQ ID NO: 599489 - RNA, 63 nt, Homo Sapiens
cacugcuucuuacaggaaacuacaaagaccucuauuacauaaacaugggauacagcacccauc

SEQ ID NO: 599490 - RNA, 63 nt, Homo Sapiens
cuaaguuacagaggaugcaugucuaucuguaguauuacauauaaggcagcaaauguugagaaa

SEQ ID NO: 599491 - RNA, 63 nt, Homo Sapiens
auugaagaauauauuucacuuuuuuaguccaaaauuacauagcgacaugugccuuaaacagac

SEQ ID NO: 599492 - RNA, 63 nt, Homo Sapiens
ggaaaccuugaguggugguguuucggcuuucauauuacauaagagcggccuuuucuguguuga

SEQ ID NO: 599493 - RNA, 63 nt, Homo Sapiens
uguuuauauuuaacuaaauguaagguacgaauuauuacauauuaaacuuuucuuccccuuccu

SEQ ID NO: 599494 - RNA, 63 nt, Homo Sapiens
uauuauuuaauauccaacuggucuccaaucuccauuacauagggacuguacagagccugugaa

SEQ ID NO: 599495 - RNA, 63 nt, Homo Sapiens
ugcucuuugucuauggaguuauacuuccaucaaauuacauagcaaugcugaauuaggcaaaac

SEQ ID NO: 599496 - RNA, 63 nt, Homo Sapiens
augcuuugaaaauguaucauucaguguaaauuaauuacauacauauuuuucuauauauuuguu

SEQ ID NO: 599497 - RNA, 63 nt, Homo Sapiens
aucaauacacuauguguccuuuuuagaauaaagauuacauaucaucauuccuuuggggaaaau

SEQ ID NO: 599498 - RNA, 63 nt, Homo Sapiens
cuuuuuuuaacuggugcagugggaaaauaggacauuacauacugaauuggguccuugucauuu

SEQ ID NO: 599499 - RNA, 63 nt, Homo Sapiens
cagauugauugauagucaugcauugcaauuauaauuacauaugaauuauauucauauguauug

SEQ ID NO: 599500 - RNA, 63 nt, Homo Sapiens
augccuguuugcuauuugguuaauuaguuuuuaauuacauaaguuccauugguggaauugaaa

SEQ ID NO: 599501 - RNA, 63 nt, Homo Sapiens
uguaauuuauuaaaaaccuuuggauaaaaaccuauuacauauuuugaguaguuaggaagaaga

SEQ ID NO: 599502 - RNA, 63 nt, Homo Sapiens
uuacgucagccuacuguggcacccugacccuacauuacauaggcuggcucaucccucaggccc

SEQ ID NO: 599503 - RNA, 63 nt, Homo Sapiens
cccugugaugggcccuuaggccuggcugggcccauuacauaucccugugguggcucugguggc

SEQ ID NO: 599504 - RNA, 63 nt, Homo Sapiens
ggcuuuauuaguguuuuuauauagaaaacaguuauuacauauguguuaagucauuucuuaaga

SEQ ID NO: 599505 - RNA, 63 nt, Homo Sapiens
acgaggauggcuggacaaggacuuuuacuuuuuauuacauaaaaauauuaaaaaauaaauaaa

SEQ ID NO: 599506 - RNA, 63 nt, Homo Sapiens
guggguaguaauucuucaucaugaaaaugauauauuacauauuuaguaucuucccuuugcagu

SEQ ID NO: 599507 - RNA, 63 nt, Homo Sapiens
uauuuuugaauuuucugaacuuuuuucuaagagauuacauaggagacuaaagaaaucuaucug

SEQ ID NO: 599508 - RNA, 63 nt, Homo Sapiens
uauguauuucacuguuauguuuguuuuauccacauuacauauuagucuuuaauuguaaugacu

SEQ ID NO: 599509 - RNA, 63 nt, Homo Sapiens
gauuagaccaacuggagaauuugugacauggucauuacauauggauccuagcaugacuauaca

SEQ ID NO: 599510 - RNA, 63 nt, Homo Sapiens
uauguauuucacugucauguuaagccuuuucucauuacauauugacuuuguuuuauccacagu

SEQ ID NO: 599511 - RNA, 63 nt, Homo Sapiens; identical to SEQ ID NO: 599509

SEQ ID NO: 599512 - RNA, 63 nt, Homo Sapiens
uguguuuucucagauuaguguuaacuuuuaaauauuacauauaugaaguuucacuggauuuca

SEQ ID NO: 599513 - RNA, 62 nt, Homo Sapiens
ggaauggcuguucacuugaucuugccuuuaauauuacauaauuucauuuugaugcuauguga

SEQ ID NO: 599514 - RNA, 63 nt, Homo Sapiens
ucaaagauaacauuguuauuacuaguuauaaaaauuacauaauugaaauuauccaugguaaaa

SEQ ID NO: 599515 - RNA, 63 nt, Homo Sapiens
guuuuugguguuuuuuagggaugugcaaugugcauuacauaaugacagaaauacugagaaggu

SEQ ID NO: 599516 - RNA, 63 nt, Homo Sapiens
uuuuucccauaccaacugcuucuacccuccccuauuacauacaucuuucaauguccaaaaagu

SEQ ID NO: 599517 - RNA, 63 nt, Homo Sapiens
aauucggaaugaaaaauuauaauguaauuuuacauuacauaaguuccuuuuacaauuaaaaaa

SEQ ID NO: 599518 - RNA, 63 nt, Homo Sapiens
gaugucccuauggaagcauauuguuauuauauaauuacauauuugcauauguaugacucccaa

SEQ ID NO: 599519 - RNA, 63 nt, Homo Sapiens
cucccacuuugucuguacauacuggccucugugauuacauagaucagccauuaaaauaaaaca

SEQ ID NO: 599520 - RNA, 63 nt, Homo Sapiens
gacucaaaaugacaguuucagagagucaaugucauuacauagaacacuucagacacaggaaaa

SEQ ID NO: 599521 - RNA, 63 nt, Homo Sapiens
caugaaaauuaaaacacacaagugaaugaaguaauuacauaguccaagauuagaaauacaagu

SEQ ID NO: 599522 - RNA, 63 nt, Homo Sapiens
gcuaucccuuuccauuucuuuaauuagcguaucauuacauacuuuugggagcguccagcaugu

SEQ ID NO: 599523 - RNA, 63 nt, Homo Sapiens
aacuguucuucaauaaauauuuugaccuucaaaauuacauauuuuucugacuguuaugcuuga

SEQ ID NO: 599524 - RNA, 63 nt, Homo Sapiens
aaaaguuuauugguagguaauagugaguuaaaaauuacauacuuuaaacuagacuuacuauuu

SEQ ID NO: 599525 - RNA, 63 nt, Homo Sapiens
gacuauagaaacacaacaguaauccaauagucaauuacauaauaugugucccauggcaaugug

SEQ ID NO: 599526 - RNA, 63 nt, Homo Sapiens
uagagagagacucuuuuagcguauuucuuguauauuacauacuuaggaacaucucuuugaauu

SEQ ID NO: 599527 - RNA, 63 nt, Homo Sapiens
uguguugcacauguccacaguauuggcgagauaauuacauaauucagauaccuuuaaucaucu

SEQ ID NO: 599528 - RNA, 63 nt, Homo Sapiens
gcuguuuggaggacaggaaaauuuaucgggaaaauuacauaaucccucugauuccacuaucca

SEQ ID NO: 599529 - RNA, 63 nt, Homo Sapiens
ugagaaugccagaucuguggcugucuucauucuauuacauagucaaacauagguuuaugugaa

SEQ ID NO: 599530 - RNA, 63 nt, Homo Sapiens
uaguaggugauauucauucguauccagcucuuuauuacauagcucugaaguuaaaaugauuua

SEQ ID NO: 599531 - RNA, 63 nt, Homo Sapiens
ggacuuuuugccugcauucucuuggagauaaaaauuacauaagcugauuuuuaaauguuguug

SEQ ID NO: 599532 - RNA, 63 nt, Homo Sapiens
gacaaaccuuguuaaaugcugauuuuaaucaccauuacauaauaaaaaugcccuagaaauaua

SEQ ID NO: 599533 - RNA, 63 nt, Homo Sapiens
gauuaacaaauacauugcaacauuguauuaauuauuacauaaagagcugugcccguuuaucuu

SEQ ID NO: 599534 - RNA, 63 nt, Homo Sapiens
uuuuaaagucaaugaaagagauuuucuguuucuauuacauagucuucauuuguguauuaguuc

SEQ ID NO: 599535 - RNA, 63 nt, Homo Sapiens
uuguuacaaauuaucauuauuaguucuaccuugauuacauaugucaggaaaagaaaagaaacu

SEQ ID NO: 599536 - RNA, 63 nt, Homo Sapiens
aauggcuuugcaagaagauguuaaauggaacuuauuacauaccaaauggcaaaaugccauuau

SEQ ID NO: 599537 - RNA, 63 nt, Homo Sapiens
gaugaaugguagagcaaccugaaggauuuagaaauuacauauaaaucuuugcaguuaugcuau

SEQ ID NO: 599538 - RNA, 63 nt, Homo Sapiens
uauuuugggagagagauacguucacauaauuuuauuacauauauuguuacaauuguucuauuu

SEQ ID NO: 599539 - RNA, 63 nt, Homo Sapiens
aucaggguacauggcagccagucacagauuggaauuacauaugacaaaguaucaguguacuau

SEQ ID NO: 599540 - RNA, 63 nt, Homo Sapiens
ugcauguuaucuacccacauuuucuuuuauaaaauuacauauucuaaauccacacaugccaag

SEQ ID NO: 599541 - RNA, 63 nt, Homo Sapiens
ugaugggugcaugggauucuauaucugccuuuuauuacauacacugguucaagagaccacaua

SEQ ID NO: 599542 - RNA, 63 nt, Homo Sapiens
guuagagaacucaaauggugugccauuaucaucauuacauacuauauuuguuguuaaaaugau

SEQ ID NO: 599543 - RNA, 63 nt, Homo Sapiens
gucuuuauauuuuuccagagaaauagaauuuauauuacauaaacauaaaguucagaagagugu

SEQ ID NO: 599544 - RNA, 63 nt, Homo Sapiens
gaagagcucccacugcagaagaagucuuguuuuauuacauacacgugggauauucuuuaugca

SEQ ID NO: 599545 - RNA, 63 nt, Homo Sapiens
uauaagcagguccgcccaggugugaggcuggcgauuacauaagcaccuaccuccccugguuau

SEQ ID NO: 599546 - RNA, 63 nt, Homo Sapiens
ggcauacagacaaauacauaaaccaaugaauauauuacauauucuguguuccaauaaaacuuu

SEQ ID NO: 599547 - RNA, 63 nt, Homo Sapiens
ugucuuuaugauuucaugauuagacaauguggaauuacauaacaggcauugcacuaaaaguga

SEQ ID NO: 599548 - RNA, 63 nt, Homo Sapiens
agguuuguacggaugugcuuugaaguuauguauauuacauauaacaggaaaaaauauuaaaau

SEQ ID NO: 599549 - RNA, 63 nt, Homo Sapiens
aagucauuguuucuugcucaugguggcucauuuauuacauaguccccucaccccacuaaugga

SEQ ID NO: 599550 - RNA, 63 nt, Homo Sapiens
ugcuugcuaucugucucauguuacagagcuuccauuacauauuaaacgugaaaucuaugacuc

SEQ ID NO: 599551 - RNA, 63 nt, Homo Sapiens
ucaucaaauuuaucucaacccugagcgaagcacauuacauauagauuuuugacgugccuggcc

SEQ ID NO: 599552 - RNA, 63 nt, Homo Sapiens
auguguuuuugaaucaaugcuguaaaauguauuauuacauaaauaauaaauuaaauuuuauug

SEQ ID NO: 599553 - RNA, 63 nt, Homo Sapiens
aauguaacuaggaagaaaaacccaauuuaagaaauuacauaaugcuuuccaaaggcaccuaca

SEQ ID NO: 599554 - RNA, 63 nt, Homo Sapiens
cagcaggaagaaaacaauuuuuuaaaaauucucauuacauagacgcacaagaauaugucacau

SEQ ID NO: 599555 - RNA, 63 nt, Homo Sapiens
uauagauaaaaugucaguguucuucauaaaucuauuacauauauuauauauguuuauauaugu

SEQ ID NO: 599556 - RNA, 63 nt, Homo Sapiens
uaaauuaaauaaaauaaccccuuucuacacuguauuacauaaacauugcuuaugacaugaucg

SEQ ID NO: 599557 - RNA, 63 nt, Homo Sapiens
ugagagaaaauauuucuauuuuuacaaaagaauauuacauauuuaaauguuuggaaacuuucu

SEQ ID NO: 599558 - RNA, 63 nt, Homo Sapiens
auuaccuagacauagacaguguaugaagauaaaauuacauaguguuuuuuaucuccacacgca

SEQ ID NO: 599559 - RNA, 63 nt, Homo Sapiens
aaaguaaauuguuuauuuuacaauaagaaagugauuacauauuuuuuuuuuuacaauggugga

SEQ ID NO: 599560 - RNA, 63 nt, Homo Sapiens
cauugaguaaauguaugugccaguaaaggcugaauuacauaaauuuuguuguuuccuuuuuua

SEQ ID NO: 599561 - RNA, 63 nt, Homo Sapiens
ucccuaauaaucuggaauauucuacauggcuugauuacauagcaaacaagaccaagauuuagg

SEQ ID NO: 599562 - RNA, 63 nt, Homo Sapiens
uguaaucacauaugugcauagauacacaaucguauuacauaaaacacccuugaaaauauauga

SEQ ID NO: 599563 - RNA, 63 nt, Homo Sapiens
auaaguuuuauacauuuuguuucuuuaaaagguauuacauauucuuuugagcuggagcugcaa

SEQ ID NO: 599564 - RNA, 63 nt, Homo Sapiens
ucauucgugaagccgaaacguuuuuaaacaugaauuacauaugaauuauuaagcauaugugcu

SEQ ID NO: 599565 - RNA, 63 nt, Homo Sapiens
cauauuuuugaaagguaaaaaguacauuuguauauuacauauauggacauaacuugugaagga

SEQ ID NO: 599566 - RNA, 63 nt, Homo Sapiens
agugauucucaaccucuuugaauuuuacuuauaauuacauacacacacacacugcuacuuaua

SEQ ID NO: 599567 - RNA, 63 nt, Homo Sapiens
uuuaauuuuauaaaauuuaaauauuauuaaauuauuacauaaaagucucugcauagauacaaa

SEQ ID NO: 599568 - RNA, 63 nt, Homo Sapiens
uuuuuuuuuuuuuuuuaaagacuuguauuggaaauuacauaccaaagcaaauuuacuccaaag

SEQ ID NO: 599569 - RNA, 63 nt, Homo Sapiens
caauuguagguucaaccuguccauuaggauucuauuacauaugcugccucgcucuuugucccc

SEQ ID NO: 599570 - RNA, 63 nt, Homo Sapiens
aaaauaucucuucuuuauauaagaaaggacacuauuacauaugauaauacaacuauuucugua

SEQ ID NO: 599571 - RNA, 63 nt, Homo Sapiens
uauaaagacuuagggaauaaauaucauugaaauauuacauagauuucauagugguaugcaaac

SEQ ID NO: 599572 - RNA, 63 nt, Homo Sapiens
agugcagaaagccagaggacgaugaacuugaagauuacauaaaggacauaugauucuuuccaa

SEQ ID NO: 599573 - RNA, 63 nt, Homo Sapiens
caucagccaucaacuaaaguauugcucacaguuauuacauacaacauuuuuauaccuguuuaa

SEQ ID NO: 599574 - RNA, 63 nt, Homo Sapiens
uaguguguagcccagaaaagcugaguccuagagauuacauaaagaccugaaacaacucuaggu

SEQ ID NO: 599575 - RNA, 63 nt, Homo Sapiens
cuaagaucacuauagguccauugaaugaguugaauuacauaagagagacugcagacuacugcu

SEQ ID NO: 599576 - RNA, 63 nt, Homo Sapiens
acucuaaaucuuguauaugcaucuuuguugcuuauuacauauuuacacacacaaccacaaauu

SEQ ID NO: 599577 - RNA, 64 nt, Homo Sapiens; identical to SEQ ID NO: 105625

SEQ ID NO: 599578 - RNA, 64 nt, Homo Sapiens; identical to SEQ ID NO: 105626

SEQ ID NO: 599579 - RNA, 64 nt, Homo Sapiens; identical to SEQ ID NO: 105627

SEQ ID NO: 599580 - RNA, 64 nt, Homo Sapiens; identical to SEQ ID NO: 105628

SEQ ID NO: 599581 - RNA, 64 nt, Homo Sapiens; identical to SEQ ID NO: 105629

SEQ ID NO: 599582 - RNA, 64 nt, Homo Sapiens; identical to SEQ ID NO: 105630

SEQ ID NO: 599583 - RNA, 64 nt, Homo Sapiens; identical to SEQ ID NO: 105631

SEQ ID NO: 599584 - RNA, 56 nt, Homo Sapiens; identical to SEQ ID NO: 105632

SEQ ID NO: 599585 - RNA, 64 nt, Homo Sapiens; identical to SEQ ID NO: 105633

SEQ ID NO: 599586 - RNA, 64 nt, Homo Sapiens; identical to SEQ ID NO: 105634

SEQ ID NO: 599587 - RNA, 64 nt, Homo Sapiens; identical to SEQ ID NO: 105635

SEQ ID NO: 599588 - RNA, 64 nt, Homo Sapiens; identical to SEQ ID NO: 105636

SEQ ID NO: 599589 - RNA, 64 nt, Homo Sapiens; identical to SEQ ID NO: 105637

SEQ ID NO: 599590 - RNA, 64 nt, Homo Sapiens; identical to SEQ ID NO: 105638

SEQ ID NO: 599591 - RNA, 64 nt, Homo Sapiens; identical to SEQ ID NO: 105639

SEQ ID NO: 599592 - RNA, 64 nt, Homo Sapiens; identical to SEQ ID NO: 105640

SEQ ID NO: 599593 - RNA, 64 nt, Homo Sapiens; identical to SEQ ID NO: 105641

SEQ ID NO: 599594 - RNA, 64 nt, Homo Sapiens; identical to SEQ ID NO: 105642

SEQ ID NO: 599595 - RNA, 64 nt, Homo Sapiens; identical to SEQ ID NO: 105643

SEQ ID NO: 599596 - RNA, 64 nt, Homo Sapiens; identical to SEQ ID NO: 105644

SEQ ID NO: 599597 - RNA, 64 nt, Homo Sapiens; identical to SEQ ID NO: 105645

SEQ ID NO: 599598 - RNA, 64 nt, Homo Sapiens; identical to SEQ ID NO: 105646

SEQ ID NO: 599599 - RNA, 64 nt, Homo Sapiens; identical to SEQ ID NO: 105647

SEQ ID NO: 599600 - RNA, 64 nt, Homo Sapiens; identical to SEQ ID NO: 105648

SEQ ID NO: 599601 - RNA, 64 nt, Homo Sapiens; identical to SEQ ID NO: 96929

SEQ ID NO: 599602 - RNA, 64 nt, Homo Sapiens; identical to SEQ ID NO: 96930

SEQ ID NO: 599603 - RNA, 64 nt, Homo Sapiens; identical to SEQ ID NO: 96931

SEQ ID NO: 599604 - RNA, 64 nt, Homo Sapiens; identical to SEQ ID NO: 96932

SEQ ID NO: 599605 - RNA, 64 nt, Homo Sapiens; identical to SEQ ID NO: 96933

SEQ ID NO: 599606 - RNA, 64 nt, Homo Sapiens; identical to SEQ ID NO: 96934

SEQ ID NO: 599607 - RNA, 64 nt, Homo Sapiens; identical to SEQ ID NO: 96935

SEQ ID NO: 599608 - RNA, 64 nt, Homo Sapiens; identical to SEQ ID NO: 96936

SEQ ID NO: 599609 - RNA, 64 nt, Homo Sapiens
cuccagaccccuguggcagaccgggggccagacacagauacauggggaacugcauaucggaggu

SEQ ID NO: 599610 - RNA, 64 nt, Homo Sapiens
ggaugggaagaugguagcagauaaagacagcugacagauacauagauggaccaguagacaacug

SEQ ID NO: 599611 - RNA, 64 nt, Homo Sapiens
ugcaaauuuuaaaaaggaacccuuuuccuccagacagauacagccccaaaccagggugcauggc

SEQ ID NO: 599612 - RNA, 56 nt, Homo Sapiens
ugaguagacuugguguuugagugcuucagauacauuuuucagauacaaugugaaga

SEQ ID NO: 599613 - RNA, 64 nt, Homo Sapiens
agacuugguguuugagugcuucagauacauuuuucagauacaaugugaagacauugaagauaug

SEQ ID NO: 599614 - RNA, 64 nt, Homo Sapiens
gugaugguuagcauaugguguucuuuuuugcccccagauacauggagggaaugguaguuaaggc

SEQ ID NO: 599615 - RNA, 64 nt, Homo Sapiens
aaaguuacaaacagaccaccguuacuuacagucccagauacacuugggaagagcguagacaggu

SEQ ID NO: 599616 - RNA, 64 nt, Homo Sapiens
gccaaaaucaucacagaugcugcugugcugcagacagauacaugcuaguccagagagccgcccc

SEQ ID NO: 599617 - RNA, 64 nt, Homo Sapiens
ggcgcucauuccaauauagucuuuauuucccauucagauacagguugagcaucccuaaucugaa

SEQ ID NO: 599618 - RNA, 64 nt, Homo Sapiens
aaauaucagugaaugcuuuacuguuaguccuauucagauacaucugaaagcaccuacaauuagc

SEQ ID NO: 599619 - RNA, 64 nt, Homo Sapiens
acaguagaagaacuuacuucggagagcuauguaacagauacacuuucagaaauggacugaaaau

SEQ ID NO: 599620 - RNA, 64 nt, Homo Sapiens
agaagccacccacguggggugugccaggcacccccagauacaaaugcagccacgcacagacgua

SEQ ID NO: 599621 - RNA, 64 nt, Homo Sapiens
ugcuccuggaggcuggcuggcugucucucucacacagauacacgugcgcucccugggauccggg

SEQ ID NO: 599622 - RNA, 64 nt, Homo Sapiens
cauagugaacucaucagaauuagcuuugugaucgcagauacauuauuaaaauguguccacgaag

SEQ ID NO: 599623 - RNA, 64 nt, Homo Sapiens
auguauacauuuguauaauuuggugugucucuaacagauacaguuugagauuccuguucauucu

SEQ ID NO: 599624 - RNA, 62 nt, Homo Sapiens
aggguuugcuaacucugcuucaacauccaacaacacaaaacuauaugauuuuuaaaaucaug

SEQ ID NO: 599625 - RNA, 62 nt, Homo Sapiens
gaucucugugccaaauacauuauaucaggauuacacaaaaaguaucacaaaggauggucuug

SEQ ID NO: 599626 - RNA, 62 nt, Homo Sapiens
agaggcugagaugagcagugaacuaagaggccacacaaaagcagagguuugggaauuccaga

SEQ ID NO: 599627 - RNA, 62 nt, Homo Sapiens
aauugacgcaagugaacugaaaacuuauguucacacaaaaacucgcacaugacuguuuauag

SEQ ID NO: 599628 - RNA, 62 nt, Homo Sapiens
guauugaagcaacaaauauuuaaauauuuuuuacacaaaaaugcaggguaguaagcugacac

SEQ ID NO: 599629 - RNA, 62 nt, Homo Sapiens
auacagacaaucaaaacauuugacuugcacagacacaaaaauggcuggcagagauuuaugua

SEQ ID NO: 599630 - RNA, 62 nt, Homo Sapiens
agcaaaguaauaaaaucacaaauguuuggaaaacacaaaaguaacuuguuuaucucagucug

SEQ ID NO: 599631 - RNA, 62 nt, Homo Sapiens
ggccagcuuaaccuggucugaggugagacuaaacacaaaaacaguagauaaaucucucccua

SEQ ID NO: 599632 - RNA, 62 nt, Homo Sapiens
ucaaaacaaaaacaagagggaggcacguuuucacacaaaauuuuucaaaaaugugaaauaua

SEQ ID NO: 599633 - RNA, 62 nt, Homo Sapiens
gaagcuaccuaugauccuggacacaaaacauaacacaaaaaaaaggcacaacacaaaaacca

SEQ ID NO: 599634 - RNA, 62 nt, Homo Sapiens
uaacacaaaaaagaagcuacacacaaaaaccaacacaaaacauacuacagcaucaaggcaca

SEQ ID NO: 599635 - RNA, 62 nt, Homo Sapiens
caacacaaaacauaacacaacaucaaggcacaacacaaaaacaaagcaaaggaguacuacag

SEQ ID NO: 599636 - RNA, 62 nt, Homo Sapiens
gcagagcaccuaagccugucaugaaaaacagaacacaaaagaccugcagggccccuguucca

SEQ ID NO: 599637 - RNA, 62 nt, Homo Sapiens
aagauaaauguauggcaucaguuuaaaucuggacacaaaaaucaugcaaaggaauucuucaa

SEQ ID NO: 599638 - RNA, 62 nt, Homo Sapiens
uuaguuguuucccuucacuuucagucuuccacacacaaaaaauaccucacagagcuucacca

SEQ ID NO: 599639 - RNA, 62 nt, Homo Sapiens
aucaguuguuuuucucuucgcuucaggcccuuacacaaaagccaugaagagauguucaccua

SEQ ID NO: 599640 - RNA, 62 nt, Homo Sapiens
aaugccacacaucacccuuaacuauucugauuacacaaaacaaagaaguuggaugggugggu

SEQ ID NO: 599641 - RNA, 62 nt, Homo Sapiens
acccuagaguguuguugagauggacccaaugcacacaaaacauucuuacaggcacaaaauga

SEQ ID NO: 599642 - RNA, 62 nt, Homo Sapiens
uuaacaacuccacucauagucauuguauuugaacacaaaacagagcuuccuuauguuucaca

SEQ ID NO: 599643 - RNA, 62 nt, Homo Sapiens
uacugagcuuccuuauguuuaaaaguuaccccacacaaaagugaaauuuauuauucuaaucc

SEQ ID NO: 599644 - RNA, 62 nt, Homo Sapiens
ugcagauacuucauauagccgcagggaaaaauacacaaaaacaggaauauucacuuuaccua

SEQ ID NO: 599645 - RNA, 62 nt, Homo Sapiens
cguuuuccauacagcagugccaauuuguagaaacacaaaaugucaaaaggcauuuccgcuua

SEQ ID NO: 599646 - RNA, 62 nt, Homo Sapiens
aaugaaguaguauauaugaaaaugcuuuuuaaacacaaaagcuuuauacaaaauauuguuga

SEQ ID NO: 599647 - RNA, 62 nt, Homo Sapiens
uuugcaaaugggaaggauuucuuuaaagcaagacacaaaagcauacacaggaaaaaaugaug

SEQ ID NO: 599648 - RNA, 62 nt, Homo Sapiens
ugaaauucauauaaugacuucuacagugaaauacacaaaaaagucauuuuguugucacagca

SEQ ID NO: 599649 - RNA, 62 nt, Homo Sapiens
uuauccugccauucgagugcugaaggauuacaacacaaaaagagaguuuguuuuucuauaug

SEQ ID NO: 599650 - RNA, 62 nt, Homo Sapiens
aaaaggaaaaaaaauccaccaaaccaugauaaacacaaaaugcagcuuccugaugcuuagag

SEQ ID NO: 599651 - RNA, 62 nt, Homo Sapiens
accuuaucuuaauggaaaacgguuaacuccaaacacaaaagacucuacuggaaaguguaggu

SEQ ID NO: 599652 - RNA, 62 nt, Homo Sapiens
accaauauggagaaacccugucucuacuaagaacacaaaauuagcugggcaugguggugcau

SEQ ID NO: 599653 - RNA, 62 nt, Homo Sapiens
aagauaucuaugaaauauggugguuuuuuaaaacacaaaaauuauagaauaugggaucccgu

SEQ ID NO: 599654 - RNA, 62 nt, Homo Sapiens
caaugcauccaaaaaaucuuuuuaaacagauuacacaaaaauuauuuccagaaaggcuacca

SEQ ID NO: 599655 - RNA, 62 nt, Homo Sapiens
aagucaaacaggauuccauccccugugaaauaacacaaaauuucacucucuaaaagcaacag

SEQ ID NO: 599656 - RNA, 62 nt, Homo Sapiens
accucagcagaaaugaauauaaaauggcuuagacacaaaaacauuuacuaauccuaucugcc

SEQ ID NO: 599657 - RNA, 62 nt, Homo Sapiens
uuuucuuaauccuaguacauaucccacucaagacacaaaacagugaguuaaauauaacucac

SEQ ID NO: 599658 - RNA, 62 nt, Homo Sapiens
agaauguucaugucaggcacaagcuuagugaaacacaaaauuauagaagaaauauauuuaua

SEQ ID NO: 599659 - RNA, 62 nt, Homo Sapiens
ggcauugguuucuuaggaguugaacaacagcaacacaaaacgaaaaugcagcagcauaggag

SEQ ID NO: 599660 - RNA, 62 nt, Homo Sapiens
acacacacacccuccccgccagaaagacacagacacaaaaucuuacauacacagacacacac

SEQ ID NO: 599661 - RNA, 62 nt, Homo Sapiens
acacacacacccuccccgccagacacacacagacacaaaaucauacacagacacacacagaa

SEQ ID NO: 599662 - RNA, 62 nt, Homo Sapiens
auacagccauuccaaaugggagaaauuggccaacacaaaaggguaacagggcccaugcaagu

SEQ ID NO: 599663 - RNA, 62 nt, Homo Sapiens
caaguuaguauuguuagagauuucauuuuacaacacaaaaauaagccugugucaaagauuuu

SEQ ID NO: 599664 - RNA, 62 nt, Homo Sapiens
aguguggauuuaucuaaaugauaagcagcccaacacaaaacgagucaagccgagcaaccugu

SEQ ID NO: 599665 - RNA, 62 nt, Homo Sapiens
agacaguuaaaaggucaguaagauaccaugagacacaaaauggacagaauuuuggcugaucu

SEQ ID NO: 599666 - RNA, 62 nt, Homo Sapiens
uuguggaaggcaguuuuaacugugccauauacacacaaaauuacacuuuuuggcugucaccu

SEQ ID NO: 599667 - RNA, 62 nt, Homo Sapiens
caggaauugguggcuuaauuucuaugaacugaacacaaaacuuuuaguuguaugagucucuu

SEQ ID NO: 599668 - RNA, 62 nt, Homo Sapiens
guguuuacugaaagccgaaaacaccaaugccaacacaaaacuucgccaaagaaaccacgccc

SEQ ID NO: 599669 - RNA, 62 nt, Homo Sapiens
augagucccaccccccacuauuaaaaaaacaaacacaaaaaguucuuguuuugucucaaaac

SEQ ID NO: 599670 - RNA, 62 nt, Homo Sapiens
acaaauaaaugaauaaagcugcugugacacacacacaaaaggaauuuaauaguauaauauau

SEQ ID NO: 599671 - RNA, 62 nt, Homo Sapiens
gaaaagcaagagacaaagcaagacaaauauucacacaaaaaugaaguguguccucuggaggg

SEQ ID NO: 599672 - RNA, 62 nt, Homo Sapiens
cagcccagccaggcccccucucuuuuucuaaaacacaaaacucccaagacugggaggggacu

SEQ ID NO: 599673 - RNA, 62 nt, Homo Sapiens
agacaaaaaaaaaaaaagaaugaaaaaaaaaaacacaaaaaauuacuggggauucuugaacu

SEQ ID NO: 599674 - RNA, 62 nt, Homo Sapiens
ucauucuucuuuuuauuuguaucagucaugugacacaaaauaacugagcuugaacuucauau

SEQ ID NO: 599675 - RNA, 62 nt, Homo Sapiens
uggcuugaugguuaagacagaagaggaaagaaacacaaaaaggucaguguaagaauuaaaga

SEQ ID NO: 599676 - RNA, 62 nt, Homo Sapiens
gucauuuaccuguauuugcaaaauauauauauacacaaaacuauauacaacuauauauacac

SEQ ID NO: 599677 - RNA, 62 nt, Homo Sapiens
acugaucugugauugcucucacaacaaaacaaacacaaaaccuaaauaacaaugacacacac

SEQ ID NO: 599678 - RNA, 64 nt, Homo Sapiens; identical to SEQ ID NO: 276332

SEQ ID NO: 599679 - RNA, 64 nt, Homo Sapiens; identical to SEQ ID NO: 276333

SEQ ID NO: 599680 - RNA, 64 nt, Homo Sapiens; identical to SEQ ID NO: 276334

SEQ ID NO: 599681 - RNA, 64 nt, Homo Sapiens; identical to SEQ ID NO: 276335

SEQ ID NO: 599682 - RNA, 64 nt, Homo Sapiens; identical to SEQ ID NO: 276336

SEQ ID NO: 599683 - RNA, 64 nt, Homo Sapiens; identical to SEQ ID NO: 276337

SEQ ID NO: 599684 - RNA, 64 nt, Homo Sapiens; identical to SEQ ID NO: 276338

SEQ ID NO: 599685 - RNA, 64 nt, Homo Sapiens; identical to SEQ ID NO: 276339

SEQ ID NO: 599686 - RNA, 64 nt, Homo Sapiens; identical to SEQ ID NO: 276340

SEQ ID NO: 599687 - RNA, 64 nt, Homo Sapiens; identical to SEQ ID NO: 276341

SEQ ID NO: 599688 - RNA, 64 nt, Homo Sapiens; identical to SEQ ID NO: 276342

SEQ ID NO: 599689 - RNA, 64 nt, Homo Sapiens; identical to SEQ ID NO: 276343

SEQ ID NO: 599690 - RNA, 64 nt, Homo Sapiens; identical to SEQ ID NO: 276344

SEQ ID NO: 599691 - RNA, 64 nt, Homo Sapiens; identical to SEQ ID NO: 276345

SEQ ID NO: 599692 - RNA, 64 nt, Homo Sapiens; identical to SEQ ID NO: 276346

SEQ ID NO: 599693 - RNA, 64 nt, Homo Sapiens; identical to SEQ ID NO: 276347

SEQ ID NO: 599694 - RNA, 64 nt, Homo Sapiens; identical to SEQ ID NO: 276348

SEQ ID NO: 599695 - RNA, 64 nt, Homo Sapiens; identical to SEQ ID NO: 276349

SEQ ID NO: 599696 - RNA, 64 nt, Homo Sapiens; identical to SEQ ID NO: 276350

SEQ ID NO: 599697 - RNA, 64 nt, Homo Sapiens; identical to SEQ ID NO: 276351

SEQ ID NO: 599698 - RNA, 64 nt, Homo Sapiens; identical to SEQ ID NO: 276352

SEQ ID NO: 599699 - RNA, 64 nt, Homo Sapiens; identical to SEQ ID NO: 276353

SEQ ID NO: 599700 - RNA, 64 nt, Homo Sapiens; identical to SEQ ID NO: 276354

SEQ ID NO: 599701 - RNA, 64 nt, Homo Sapiens; identical to SEQ ID NO: 276355

SEQ ID NO: 599702 - RNA, 64 nt, Homo Sapiens; identical to SEQ ID NO: 276356

SEQ ID NO: 599703 - RNA, 64 nt, Homo Sapiens; identical to SEQ ID NO: 276357

SEQ ID NO: 599704 - RNA, 64 nt, Homo Sapiens; identical to SEQ ID NO: 276358

SEQ ID NO: 599705 - RNA, 64 nt, Homo Sapiens; identical to SEQ ID NO: 276359

SEQ ID NO: 599706 - RNA, 64 nt, Homo Sapiens
acacucugcuaguuuugaauaaguaaccaucaaaguuacuaaaacauggccaggcgcaguggcu

SEQ ID NO: 599707 - RNA, 64 nt, Homo Sapiens
agcgagaaccugucucaaaaaaaacaaaaacaaaguuacuaaaaugucaccuucacagaacagg

SEQ ID NO: 599708 - RNA, 64 nt, Homo Sapiens
guagaauguucucccucucuaugcauaaauaaauguuacuaaauacuuauguacuugauacuga

SEQ ID NO: 599709 - RNA, 64 nt, Homo Sapiens
aguaccagcauguuaacuuugauuuacauguaugguuacuaaaauuguaugggauuggugggcu

SEQ ID NO: 599710 - RNA, 59 nt, Homo Sapiens
uguggguugucucuucaugaagaaccagcggaacucaaaacugcuguucaagaaaccuc

SEQ ID NO: 599711 - RNA, 64 nt, Homo Sapiens
auuccugacaguuaaauucagaaacgugccaaauggaacucaaggugccccuucagaauuaaaa

SEQ ID NO: 599712 - RNA, 64 nt, Homo Sapiens
cagaugaagcaccacuguuauaguuuuugcucauggaacucaaagaagaguuacuucuacggaa

SEQ ID NO: 599713 - RNA, 64 nt, Homo Sapiens
ggccagcgccggugcggguccaauaaauacugagggaacucagaaagacaguaaaaauaaugau

SEQ ID NO: 599714 - RNA, 64 nt, Homo Sapiens
auaacgagaccgcccuagagaaaaagauucugaaggaacucacuuccaacuauaucccuucuua

SEQ ID NO: 599715 - RNA, 64 nt, Homo Sapiens
ccaccucguuuaaccacgaggagaguuugggccuggaacucauucaugaggaaucugaugcucc

SEQ ID NO: 599716 - RNA, 64 nt, Homo Sapiens
aacauuauucauaguuuaagguuauagcuuaaauggaacucaccuuguuuaguucugggaaauu

SEQ ID NO: 599717 - RNA, 64 nt, Homo Sapiens
uggugcuccccaugagagugaaagaacugcggcuggaacucaucugaggcacuuaaagcuuaua

SEQ ID NO: 599718 - RNA, 64 nt, Homo Sapiens
cacugucuuaagugagccagcuuaugcaaagccaggaacucacuucugacugcacugucuccau

SEQ ID NO: 599719 - RNA, 64 nt, Homo Sapiens
uaagaaaucgagaguggauugugguuuuuccagaggaacucaguuguucucugggaaguggacu

SEQ ID NO: 599720 - RNA, 59 nt, Homo Sapiens
caccugaccuagaaugccuguccaggugccggauccagacaacaaauagaggccuggcc

SEQ ID NO: 599721 - RNA, 59 nt, Homo Sapiens
gaauguuucuucucugccuucaacagcaccggauccacaaccacgugagugagaugagc

SEQ ID NO: 599722 - RNA, 59 nt, Homo Sapiens
aaggugaaggaucuguccgacagucaagacggauccacaguaaucuuucggucuccuua

SEQ ID NO: 599723 - RNA, 59 nt, Homo Sapiens
cacauaggaaaggaggcugucugaagaagcggauccaguucacugaugcacugauggcc

SEQ ID NO: 599724 - RNA, 59 nt, Homo Sapiens
aacaugccagccacugugauagaggcuggcggauccaagcaaauggccaaugagaucau

SEQ ID NO: 599725 - RNA, 59 nt, Homo Sapiens
uuuuuaaugaaaaaaaaaaacaaaaaaaacggauccaagaagaaaagagaauuuauuuc

SEQ ID NO: 599726 - RNA, 59 nt, Homo Sapiens
uacacacacgugcauguaucugagcugcucggauccagaggucauuuuuguuacagugu

SEQ ID NO: 599727 - RNA, 59 nt, Homo Sapiens
uuugucuucuuauccaucacucuuaaguucggauccaaguuuuuuacuucuuuccuuuu

SEQ ID NO: 599728 - RNA, 59 nt, Homo Sapiens
auaaagacgucccaaaugguaagaguggacggauccauaagaagggcuacugcuccugg

SEQ ID NO: 599729 - RNA, 59 nt, Homo Sapiens
auuaccggcccagcaaagucugcaucuggcggauccaggugucugagggcuuccacgug

SEQ ID NO: 599730 - RNA, 59 nt, Homo Sapiens
gaaaaggcaguuagcucaaggacuugugacggauccacuuugguguucaaggaccugcu

SEQ ID NO: 599731 - RNA, 59 nt, Homo Sapiens
uuguuuccuuagcuugguaugagacagaucggauccaguuucccaugcaccaacccacu

SEQ ID NO: 599732 - RNA, 59 nt, Homo Sapiens
guggccuuacucuuaacuugccucuauugcggauccacauaaagcccccuccucacauc

SEQ ID NO: 599733 - RNA, 59 nt, Homo Sapiens
auaugccucagcacauggaaagugucuuucggauccacuuaauaaauguacuuccugga

SEQ ID NO: 599734 - RNA, 59 nt, Homo Sapiens
aaugcagucagaaggacccucuucgagaacggauccagacucugagcagcagcaggcaa

SEQ ID NO: 599735 - RNA, 59 nt, Homo Sapiens
gaggcugguccuauggccucuggcccuuucggauccagggugcauuuggagggagugag

SEQ ID NO: 599736 - RNA, 59 nt, Homo Sapiens
uccacaaacacuccguggcugagaggcagcggauccaggcagcgaugcugagccaccuc

SEQ ID NO: 599737 - RNA, 59 nt, Homo Sapiens
cagggaagggaugggggcagcagcugcuucggauccacacuguaucugugucaucccca

SEQ ID NO: 599738 - RNA, 59 nt, Homo Sapiens
cucggggggccucagcccuucagggagcucggauccauauucaagaaagcaccaaagac

SEQ ID NO: 599739 - RNA, 59 nt, Homo Sapiens
uuucucucugcgagucuccuaaagcugaucggauccauguuuccaguuuauaaaaagga

SEQ ID NO: 599740 - RNA, 59 nt, Homo Sapiens
caggagugccucucacagcuauaugacuacggauccauuagugaggagcgacacacaca

SEQ ID NO: 599741 - RNA, 59 nt, Homo Sapiens
ugcaagaccguguaaaugaguacacggugcggauccagccugucaggugggaagaggag

SEQ ID NO: 599742 - RNA, 59 nt, Homo Sapiens
uagcaggacugaauuguccccuccuuccacggauccauggguugguugagguggaagcc

SEQ ID NO: 599743 - RNA, 59 nt, Homo Sapiens
ggcagggccauagggagggagauucgcuacggauccaggccauuccugggugagcccuu

SEQ ID NO: 599744 - RNA, 59 nt, Homo Sapiens
uccucccguaggccagugugucucugaaacggauccagcaauuccugagccaagaggaa

SEQ ID NO: 599745 - RNA, 59 nt, Homo Sapiens
gcacggcacucagaggcgagagucugccacggauccagaaggcugaacuucacacaggu

SEQ ID NO: 599746 - RNA, 59 nt, Homo Sapiens
cacagaagaacaaagacccauugugaagacggauccagaugcuucuguuauuucuguca

SEQ ID NO: 599747 - RNA, 59 nt, Homo Sapiens
cuugcuagggguccugaaccccccaccaucggauccaggcacccaccucggagaggcgu

SEQ ID NO: 599748 - RNA, 59 nt, Homo Sapiens
auucugggaggcuucaguuacuaggggcccggauccaggggucccugggaaagagggua

SEQ ID NO: 599749 - RNA, 59 nt, Homo Sapiens
gccaaagccgaaugagaacgcgcagucuccggauccaaagcccuggccucugcagcagc

SEQ ID NO: 599750 - RNA, 59 nt, Homo Sapiens
gcaguucuguuggagaaacgcuugguuuccggauccagagccacagaaagaaauguagg

SEQ ID NO: 599751 - RNA, 59 nt, Homo Sapiens
acccuucccccacugacucucuagguccccggauccaccagcgccuacuucugguggcu

SEQ ID NO: 599752 - RNA, 59 nt, Homo Sapiens
ugugagcucuggcucagacagcagcaagccggauccaccaacaccgcagcgccuuauga

SEQ ID NO: 599753 - RNA, 59 nt, Homo Sapiens
gacccaggaaugacaggugaauuaaaaagcggauccaaauggggaacuuggcauucaac

SEQ ID NO: 599754 - RNA, 64 nt, Homo Sapiens; identical to SEQ ID NO: 296855

SEQ ID NO: 599755 - RNA, 64 nt, Homo Sapiens; identical to SEQ ID NO: 296856

SEQ ID NO: 599756 - RNA, 64 nt, Homo Sapiens; identical to SEQ ID NO: 296857

SEQ ID NO: 599757 - RNA, 64 nt, Homo Sapiens; identical to SEQ ID NO: 296858

SEQ ID NO: 599758 - RNA, 64 nt, Homo Sapiens; identical to SEQ ID NO: 296859

SEQ ID NO: 599759 - RNA, 64 nt, Homo Sapiens; identical to SEQ ID NO: 296860

SEQ ID NO: 599760 - RNA, 64 nt, Homo Sapiens; identical to SEQ ID NO: 296861

SEQ ID NO: 599761 - RNA, 64 nt, Homo Sapiens; identical to SEQ ID NO: 296862

SEQ ID NO: 599762 - RNA, 64 nt, Homo Sapiens; identical to SEQ ID NO: 296863

SEQ ID NO: 599763 - RNA, 64 nt, Homo Sapiens; identical to SEQ ID NO: 296864

SEQ ID NO: 599764 - RNA, 64 nt, Homo Sapiens; identical to SEQ ID NO: 296865

SEQ ID NO: 599765 - RNA, 64 nt, Homo Sapiens; identical to SEQ ID NO: 296866

SEQ ID NO: 599766 - RNA, 64 nt, Homo Sapiens; identical to SEQ ID NO: 296867

SEQ ID NO: 599767 - RNA, 64 nt, Homo Sapiens; identical to SEQ ID NO: 296868

SEQ ID NO: 599768 - RNA, 64 nt, Homo Sapiens; identical to SEQ ID NO: 296869

SEQ ID NO: 599769 - RNA, 64 nt, Homo Sapiens; identical to SEQ ID NO: 296870

SEQ ID NO: 599770 - RNA, 64 nt, Homo Sapiens; identical to SEQ ID NO: 296871

SEQ ID NO: 599771 - RNA, 64 nt, Homo Sapiens; identical to SEQ ID NO: 296872

SEQ ID NO: 599772 - RNA, 64 nt, Homo Sapiens; identical to SEQ ID NO: 296873

SEQ ID NO: 599773 - RNA, 64 nt, Homo Sapiens; identical to SEQ ID NO: 296874

SEQ ID NO: 599774 - RNA, 64 nt, Homo Sapiens; identical to SEQ ID NO: 296875

SEQ ID NO: 599775 - RNA, 64 nt, Homo Sapiens; identical to SEQ ID NO: 296876

SEQ ID NO: 599776 - RNA, 64 nt, Homo Sapiens; identical to SEQ ID NO: 296877

SEQ ID NO: 599777 - RNA, 64 nt, Homo Sapiens; identical to SEQ ID NO: 296878

SEQ ID NO: 599778 - RNA, 64 nt, Homo Sapiens; identical to SEQ ID NO: 296879

SEQ ID NO: 599779 - RNA, 64 nt, Homo Sapiens; identical to SEQ ID NO: 296880

SEQ ID NO: 599780 - RNA, 64 nt, Homo Sapiens; identical to SEQ ID NO: 296881

SEQ ID NO: 599781 - RNA, 64 nt, Homo Sapiens; identical to SEQ ID NO: 296882

SEQ ID NO: 599782 - RNA, 64 nt, Homo Sapiens; identical to SEQ ID NO: 296883

SEQ ID NO: 599783 - RNA, 64 nt, Homo Sapiens; identical to SEQ ID NO: 296884

SEQ ID NO: 599784 - RNA, 64 nt, Homo Sapiens; identical to SEQ ID NO: 296885

SEQ ID NO: 599785 - RNA, 64 nt, Homo Sapiens; identical to SEQ ID NO: 296886

SEQ ID NO: 599786 - RNA, 64 nt, Homo Sapiens; identical to SEQ ID NO: 296887

SEQ ID NO: 599787 - RNA, 64 nt, Homo Sapiens; identical to SEQ ID NO: 296888

SEQ ID NO: 599788 - RNA, 64 nt, Homo Sapiens; identical to SEQ ID NO: 296889

SEQ ID NO: 599789 - RNA, 64 nt, Homo Sapiens; identical to SEQ ID NO: 296890

SEQ ID NO: 599790 - RNA, 64 nt, Homo Sapiens; identical to SEQ ID NO: 296891

SEQ ID NO: 599791 - RNA, 64 nt, Homo Sapiens; identical to SEQ ID NO: 296892

SEQ ID NO: 599792 - RNA, 64 nt, Homo Sapiens; identical to SEQ ID NO: 296893

SEQ ID NO: 599793 - RNA, 64 nt, Homo Sapiens; identical to SEQ ID NO: 296894

SEQ ID NO: 599794 - RNA, 64 nt, Homo Sapiens; identical to SEQ ID NO: 296895

SEQ ID NO: 599795 - RNA, 64 nt, Homo Sapiens; identical to SEQ ID NO: 296896

SEQ ID NO: 599796 - RNA, 64 nt, Homo Sapiens; identical to SEQ ID NO: 296897

SEQ ID NO: 599797 - RNA, 64 nt, Homo Sapiens; identical to SEQ ID NO: 296898

SEQ ID NO: 599798 - RNA, 64 nt, Homo Sapiens; identical to SEQ ID NO: 296899

SEQ ID NO: 599799 - RNA, 64 nt, Homo Sapiens; identical to SEQ ID NO: 296900

SEQ ID NO: 599800 - RNA, 64 nt, Homo Sapiens; identical to SEQ ID NO: 296901

SEQ ID NO: 599801 - RNA, 59 nt, Homo Sapiens; identical to SEQ ID NO: 296902

SEQ ID NO: 599802 - RNA, 64 nt, Homo Sapiens; identical to SEQ ID NO: 296903

SEQ ID NO: 599803 - RNA, 64 nt, Homo Sapiens; identical to SEQ ID NO: 296904

SEQ ID NO: 599804 - RNA, 64 nt, Homo Sapiens; identical to SEQ ID NO: 296905

SEQ ID NO: 599805 - RNA, 64 nt, Homo Sapiens; identical to SEQ ID NO: 296906

SEQ ID NO: 599806 - RNA, 64 nt, Homo Sapiens; identical to SEQ ID NO: 296907

SEQ ID NO: 599807 - RNA, 64 nt, Homo Sapiens; identical to SEQ ID NO: 296908

SEQ ID NO: 599808 - RNA, 64 nt, Homo Sapiens; identical to SEQ ID NO: 296909

SEQ ID NO: 599809 - RNA, 64 nt, Homo Sapiens; identical to SEQ ID NO: 296910

SEQ ID NO: 599810 - RNA, 64 nt, Homo Sapiens; identical to SEQ ID NO: 296911

SEQ ID NO: 599811 - RNA, 64 nt, Homo Sapiens; identical to SEQ ID NO: 296912

SEQ ID NO: 599812 - RNA, 64 nt, Homo Sapiens; identical to SEQ ID NO: 296913

SEQ ID NO: 599813 - RNA, 64 nt, Homo Sapiens; identical to SEQ ID NO: 296914

SEQ ID NO: 599814 - RNA, 64 nt, Homo Sapiens; identical to SEQ ID NO: 296915

SEQ ID NO: 599815 - RNA, 64 nt, Homo Sapiens; identical to SEQ ID NO: 296916

SEQ ID NO: 599816 - RNA, 64 nt, Homo Sapiens; identical to SEQ ID NO: 296917

SEQ ID NO: 599817 - RNA, 64 nt, Homo Sapiens; identical to SEQ ID NO: 296918

SEQ ID NO: 599818 - RNA, 64 nt, Homo Sapiens; identical to SEQ ID NO: 296919

SEQ ID NO: 599819 - RNA, 64 nt, Homo Sapiens; identical to SEQ ID NO: 296920

SEQ ID NO: 599820 - RNA, 64 nt, Homo Sapiens; identical to SEQ ID NO: 296921

SEQ ID NO: 599821 - RNA, 64 nt, Homo Sapiens; identical to SEQ ID NO: 296922

SEQ ID NO: 599822 - RNA, 64 nt, Homo Sapiens; identical to SEQ ID NO: 296923

SEQ ID NO: 599823 - RNA, 64 nt, Homo Sapiens; identical to SEQ ID NO: 38140

SEQ ID NO: 599824 - RNA, 64 nt, Homo Sapiens; identical to SEQ ID NO: 38141

SEQ ID NO: 599825 - RNA, 64 nt, Homo Sapiens; identical to SEQ ID NO: 38142

SEQ ID NO: 599826 - RNA, 64 nt, Homo Sapiens; identical to SEQ ID NO: 38143

SEQ ID NO: 599827 - RNA, 64 nt, Homo Sapiens; identical to SEQ ID NO: 38144

SEQ ID NO: 599828 - RNA, 64 nt, Homo Sapiens; identical to SEQ ID NO: 38145

SEQ ID NO: 599829 - RNA, 64 nt, Homo Sapiens; identical to SEQ ID NO: 38146

SEQ ID NO: 599830 - RNA, 64 nt, Homo Sapiens; identical to SEQ ID NO: 38147

SEQ ID NO: 599831 - RNA, 64 nt, Homo Sapiens; identical to SEQ ID NO: 38148

SEQ ID NO: 599832 - RNA, 64 nt, Homo Sapiens; identical to SEQ ID NO: 38149

SEQ ID NO: 599833 - RNA, 64 nt, Homo Sapiens; identical to SEQ ID NO: 38150

SEQ ID NO: 599834 - RNA, 64 nt, Homo Sapiens; identical to SEQ ID NO: 38151

SEQ ID NO: 599835 - RNA, 64 nt, Homo Sapiens; identical to SEQ ID NO: 38152

SEQ ID NO: 599836 - RNA, 64 nt, Homo Sapiens; identical to SEQ ID NO: 38153

SEQ ID NO: 599837 - RNA, 64 nt, Homo Sapiens; identical to SEQ ID NO: 38154

SEQ ID NO: 599838 - RNA, 64 nt, Homo Sapiens; identical to SEQ ID NO: 38155

SEQ ID NO: 599839 - RNA, 64 nt, Homo Sapiens; identical to SEQ ID NO: 38156

SEQ ID NO: 599840 - RNA, 64 nt, Homo Sapiens; identical to SEQ ID NO: 38157

SEQ ID NO: 599841 - RNA, 64 nt, Homo Sapiens; identical to SEQ ID NO: 38158

SEQ ID NO: 599842 - RNA, 64 nt, Homo Sapiens; identical to SEQ ID NO: 38159

SEQ ID NO: 599843 - RNA, 64 nt, Homo Sapiens; identical to SEQ ID NO: 38160

SEQ ID NO: 599844 - RNA, 64 nt, Homo Sapiens; identical to SEQ ID NO: 38161

SEQ ID NO: 599845 - RNA, 64 nt, Homo Sapiens; identical to SEQ ID NO: 73762

SEQ ID NO: 599846 - RNA, 64 nt, Homo Sapiens; identical to SEQ ID NO: 73763

SEQ ID NO: 599847 - RNA, 64 nt, Homo Sapiens; identical to SEQ ID NO: 73764

SEQ ID NO: 599848 - RNA, 64 nt, Homo Sapiens; identical to SEQ ID NO: 73765

SEQ ID NO: 599849 - RNA, 64 nt, Homo Sapiens; identical to SEQ ID NO: 73766

SEQ ID NO: 599850 - RNA, 64 nt, Homo Sapiens; identical to SEQ ID NO: 73767

SEQ ID NO: 599851 - RNA, 64 nt, Homo Sapiens; identical to SEQ ID NO: 73768

SEQ ID NO: 599852 - RNA, 64 nt, Homo Sapiens; identical to SEQ ID NO: 73769

SEQ ID NO: 599853 - RNA, 64 nt, Homo Sapiens; identical to SEQ ID NO: 73770

SEQ ID NO: 599854 - RNA, 64 nt, Homo Sapiens; identical to SEQ ID NO: 73771

SEQ ID NO: 599855 - RNA, 64 nt, Homo Sapiens
augaccgcauauuccugacuaugagaaacccaguaaccaauaaagugauauuauaucuguuugu

SEQ ID NO: 599856 - RNA, 64 nt, Homo Sapiens
uugaauguaugaugacuauugggauuuuggcccuaaccaauacauuuuguugagaggugguuua

SEQ ID NO: 599857 - RNA, 64 nt, Homo Sapiens
gucauugcuaaucugaacuacagucauauucacaaaccaauacuaaaauuuuauugaaagucca

SEQ ID NO: 599858 - RNA, 64 nt, Homo Sapiens
uucuuuucuuuauuuuacaaauuaucccagucaaaaccaauacuaaugacaauuguacugcuau

SEQ ID NO: 599859 - RNA, 64 nt, Homo Sapiens
uacauguuugcaauuaugcuagauuucucgugggaaccaauaugcaucccgaaaugucaccugc

SEQ ID NO: 599860 - RNA, 64 nt, Homo Sapiens
gguggccuguagcugcuaagacagaguuaauggcaaccaauaauugggaagacgauuucagcug

SEQ ID NO: 599861 - RNA, 64 nt, Homo Sapiens
ugaaaauuuuaaacuuggggaagauuaagaaaagaaccaauagugacaaaaaucagugcuucca

SEQ ID NO: 599862 - RNA, 64 nt, Homo Sapiens
uuuugacaccuuuccuauagaugauauaggaaugaaccaauacgcuuuuauuacccuuucuaac

SEQ ID NO: 599863 - RNA, 64 nt, Homo Sapiens
aucacaucucgagucuuaucgcaguguacuguuaaaccaauaucucuugguccuaguagaggau

SEQ ID NO: 599864 - RNA, 50 nt, Homo Sapiens
cucaaaguaaaaacaaccacaaccaauaguacuaugaagacuacuacuag

SEQ ID NO: 599865 - RNA, 64 nt, Homo Sapiens
ugaaaauuguaaacuuggggaagauuaagaaaagaaccaauagugacaaaaaucagugcuucca

SEQ ID NO: 599866 - RNA, 64 nt, Homo Sapiens
aaguuuugacaccuuuccuauagauauaggaaugaaccaauacgcuuuuauuacccuuucuaac

SEQ ID NO: 599867 - RNA, 64 nt, Homo Sapiens
caguguuucugucagucuuuccugcucagccaggggggaugauaccggggacucuccagagcca

SEQ ID NO: 599868 - RNA, 64 nt, Homo Sapiens
gucaacggauguguagcuuuucagaaacuuaauuggggaugaauagaaaaccuguaagcuuuga

SEQ ID NO: 599869 - RNA, 64 nt, Homo Sapiens
cagcccaccagcaggagcuuggaguuuggggaguggggaugaguccgucaagcacaacuguucu

SEQ ID NO: 599870 - RNA, 64 nt, Homo Sapiens
gagaggagggcuguaacgccuucagucagucucuggggaugaaacucuuaaaugcuuuguauau

SEQ ID NO: 599871 - RNA, 64 nt, Homo Sapiens
cugggguugggaucugauguugugucugugugauggggaugaggaauuuugagacuuguuucgg

SEQ ID NO: 599872 - RNA, 64 nt, Homo Sapiens
guggcuucauaacucuaccuucucacuaugaaguggggaugacuguuuuaguugagugcucugg

SEQ ID NO: 599873 - RNA, 64 nt, Homo Sapiens
uuuuguggugucuugaucaacccuaaggggaugaggggaugauccuuaagaaauccuuucuucu

SEQ ID NO: 599874 - RNA, 64 nt, Homo Sapiens
ggaugaucuuuuguggugucuuucuucucccuaaggggaugaggcagaaacucuuaagaaaucc

SEQ ID NO: 599875 - RNA, 64 nt, Homo Sapiens
cuuaaccaguuuaauuuuuuuuuuccucauuguuggggaugaugagaagaaaugauuugggaaa

SEQ ID NO: 599876 - RNA, 64 nt, Homo Sapiens
acugaaaccaaggucuuuucaaauguggcuaaauggggaugaggagacacggguaggacuuucu

SEQ ID NO: 599877 - RNA, 64 nt, Homo Sapiens
ccccagcucggccuugggagguggucguguccagggggaugauggagagcuguccaaccaagag

SEQ ID NO: 599878 - RNA, 64 nt, Homo Sapiens
gguguuaaugguggccuggguugugucuuccccuggggaugaggguuggguguccauggugccc

SEQ ID NO: 599879 - RNA, 64 nt, Homo Sapiens
gguguccaagaugcccugggcuguguccuucccuggggaugaggguuggauguccaagaugccc

SEQ ID NO: 599880 - RNA, 64 nt, Homo Sapiens
gguguccaagauacccugggcuguguccuccccuggggaugaggguuggguguccauggugccc

SEQ ID NO: 599881 - RNA, 64 nt, Homo Sapiens
gguguccauggugcccugggcuguguccuccccuggggaugacgguuggguguccauggugccc

SEQ ID NO: 599882 - RNA, 64 nt, Homo Sapiens
uggguguccauggugcccugggcuguguuuccuuggggaugaggguugggugcuauggcauccu

SEQ ID NO: 599883 - RNA, 64 nt, Homo Sapiens
ggaaccaggggcaagcuggggcugagcuggagguggggaugagagcagguguggggacagcaau

SEQ ID NO: 599884 - RNA, 64 nt, Homo Sapiens
cuuccucgagcgcgggguggggcuucgggaccccggggaugagccgggccaggucccgccccuc

SEQ ID NO: 599885 - RNA, 64 nt, Homo Sapiens
gaagcuggcagugcucaccccaggcuucccugacggggaugacucagcacuaccccucaacaga

SEQ ID NO: 599886 - RNA, 64 nt, Homo Sapiens
ugacucagcagggaugauucagcagagauaacucggggaugacucugauuguccuucagcaggg

SEQ ID NO: 599887 - RNA, 64 nt, Homo Sapiens
caggagguauugaaggacaggagagaugucagguggggaugaagaagaggggcaggucggggga

SEQ ID NO: 599888 - RNA, 64 nt, Homo Sapiens
gguguucaggagcggggagcacugaugaggugcuggggaugacaggaaggaaggaacacugggc

SEQ ID NO: 599889 - RNA, 64 nt, Homo Sapiens
gcacaggcgucuccaaccuccaggaagcauggauggggaugaaguuagucagaggccccacccc

SEQ ID NO: 599890 - RNA, 64 nt, Homo Sapiens
aacucagcagagaaauucgaugggauccaagcagggggaugaaacuuucaagagguaacagcac

SEQ ID NO: 599891 - RNA, 60 nt, Homo Sapiens
aauaaccagcaauuaaacuuuuguauuucaagauucaaacccaguaucaucagugaagaa

SEQ ID NO: 599892 - RNA, 60 nt, Homo Sapiens
augacucauuuuuaccaauaauuuuaauagagauucaaaaagauuuguuuauguguucag

SEQ ID NO: 599893 - RNA, 60 nt, Homo Sapiens
aguguucauucauccuauauuuuuauucucagauucaaagaaagagcaacuacuuuggac

SEQ ID NO: 599894 - RNA, 60 nt, Homo Sapiens
ugcuuuauaacacuaagacauccuuucuaaagauucaaguggacuugacuaagcugaggg

SEQ ID NO: 599895 - RNA, 60 nt, Homo Sapiens
ggcagaggggauucaaaugugugagaggcuagauucaaagacccucaguguucuauguua

SEQ ID NO: 599896 - RNA, 60 nt, Homo Sapiens
uaaaguaauaagggucaaagacuacaucagagauucaaauagguuuuuaaagaaaagcua

SEQ ID NO: 599897 - RNA, 64 nt, Homo Sapiens; identical to SEQ ID NO: 95478

SEQ ID NO: 599898 - RNA, 64 nt, Homo Sapiens; identical to SEQ ID NO: 95479

SEQ ID NO: 599899 - RNA, 64 nt, Homo Sapiens; identical to SEQ ID NO: 95480

SEQ ID NO: 599900 - RNA, 64 nt, Homo Sapiens; identical to SEQ ID NO: 95481

SEQ ID NO: 599901 - RNA, 64 nt, Homo Sapiens; identical to SEQ ID NO: 95482

SEQ ID NO: 599902 - RNA, 64 nt, Homo Sapiens; identical to SEQ ID NO: 95483

SEQ ID NO: 599903 - RNA, 64 nt, Homo Sapiens; identical to SEQ ID NO: 95484

SEQ ID NO: 599904 - RNA, 64 nt, Homo Sapiens; identical to SEQ ID NO: 95485

SEQ ID NO: 599905 - RNA, 64 nt, Homo Sapiens; identical to SEQ ID NO: 95486

SEQ ID NO: 599906 - RNA, 64 nt, Homo Sapiens; identical to SEQ ID NO: 95487

SEQ ID NO: 599907 - RNA, 64 nt, Homo Sapiens; identical to SEQ ID NO: 95488

SEQ ID NO: 599908 - RNA, 64 nt, Homo Sapiens; identical to SEQ ID NO: 95489

SEQ ID NO: 599909 - RNA, 64 nt, Homo Sapiens; identical to SEQ ID NO: 95490

SEQ ID NO: 599910 - RNA, 64 nt, Homo Sapiens; identical to SEQ ID NO: 95491

SEQ ID NO: 599911 - RNA, 64 nt, Homo Sapiens; identical to SEQ ID NO: 95492

SEQ ID NO: 599912 - RNA, 64 nt, Homo Sapiens; identical to SEQ ID NO: 95493

SEQ ID NO: 599913 - RNA, 64 nt, Homo Sapiens; identical to SEQ ID NO: 95494

SEQ ID NO: 599914 - RNA, 64 nt, Homo Sapiens; identical to SEQ ID NO: 95495

SEQ ID NO: 599915 - RNA, 64 nt, Homo Sapiens; identical to SEQ ID NO: 95496

SEQ ID NO: 599916 - RNA, 64 nt, Homo Sapiens; identical to SEQ ID NO: 95497

SEQ ID NO: 599917 - RNA, 64 nt, Homo Sapiens; identical to SEQ ID NO: 95498

SEQ ID NO: 599918 - RNA, 64 nt, Homo Sapiens; identical to SEQ ID NO: 95499

SEQ ID NO: 599919 - RNA, 64 nt, Homo Sapiens; identical to SEQ ID NO: 95500

SEQ ID NO: 599920 - RNA, 64 nt, Homo Sapiens; identical to SEQ ID NO: 95501

SEQ ID NO: 599921 - RNA, 64 nt, Homo Sapiens; identical to SEQ ID NO: 95502

SEQ ID NO: 599922 - RNA, 64 nt, Homo Sapiens; identical to SEQ ID NO: 95503

SEQ ID NO: 599923 - RNA, 64 nt, Homo Sapiens; identical to SEQ ID NO: 95504

SEQ ID NO: 599924 - RNA, 64 nt, Homo Sapiens; identical to SEQ ID NO: 95505

SEQ ID NO: 599925 - RNA, 64 nt, Homo Sapiens; identical to SEQ ID NO: 95506

SEQ ID NO: 599926 - RNA, 64 nt, Homo Sapiens; identical to SEQ ID NO: 95507

SEQ ID NO: 599927 - RNA, 64 nt, Homo Sapiens; identical to SEQ ID NO: 95508

SEQ ID NO: 599928 - RNA, 64 nt, Homo Sapiens; identical to SEQ ID NO: 95509

SEQ ID NO: 599929 - RNA, 64 nt, Homo Sapiens; identical to SEQ ID NO: 95510

SEQ ID NO: 599930 - RNA, 64 nt, Homo Sapiens; identical to SEQ ID NO: 95511

SEQ ID NO: 599931 - RNA, 64 nt, Homo Sapiens; identical to SEQ ID NO: 95512

SEQ ID NO: 599932 - RNA, 64 nt, Homo Sapiens; identical to SEQ ID NO: 95513

SEQ ID NO: 599933 - RNA, 64 nt, Homo Sapiens; identical to SEQ ID NO: 95514

SEQ ID NO: 599934 - RNA, 64 nt, Homo Sapiens; identical to SEQ ID NO: 95515

SEQ ID NO: 599935 - RNA, 64 nt, Homo Sapiens; identical to SEQ ID NO: 95516

SEQ ID NO: 599936 - RNA, 64 nt, Homo Sapiens; identical to SEQ ID NO: 95517

SEQ ID NO: 599937 - RNA, 64 nt, Homo Sapiens; identical to SEQ ID NO: 95518

SEQ ID NO: 599938 - RNA, 64 nt, Homo Sapiens; identical to SEQ ID NO: 95519

SEQ ID NO: 599939 - RNA, 64 nt, Homo Sapiens; identical to SEQ ID NO: 95520

SEQ ID NO: 599940 - RNA, 64 nt, Homo Sapiens; identical to SEQ ID NO: 95521

SEQ ID NO: 599941 - RNA, 64 nt, Homo Sapiens; identical to SEQ ID NO: 95522

SEQ ID NO: 599942 - RNA, 64 nt, Homo Sapiens; identical to SEQ ID NO: 95523

SEQ ID NO: 599943 - RNA, 64 nt, Homo Sapiens; identical to SEQ ID NO: 95524

SEQ ID NO: 599944 - RNA, 64 nt, Homo Sapiens; identical to SEQ ID NO: 95525

SEQ ID NO: 599945 - RNA, 64 nt, Homo Sapiens; identical to SEQ ID NO: 115857

SEQ ID NO: 599946 - RNA, 64 nt, Homo Sapiens; identical to SEQ ID NO: 115858

SEQ ID NO: 599947 - RNA, 64 nt, Homo Sapiens; identical to SEQ ID NO: 115859

SEQ ID NO: 599948 - RNA, 64 nt, Homo Sapiens; identical to SEQ ID NO: 115860

SEQ ID NO: 599949 - RNA, 64 nt, Homo Sapiens; identical to SEQ ID NO: 527879

SEQ ID NO: 599950 - RNA, 64 nt, Homo Sapiens; identical to SEQ ID NO: 527880

SEQ ID NO: 599951 - RNA, 64 nt, Homo Sapiens; identical to SEQ ID NO: 527881

SEQ ID NO: 599952 - RNA, 64 nt, Homo Sapiens; identical to SEQ ID NO: 527882

SEQ ID NO: 599953 - RNA, 64 nt, Homo Sapiens; identical to SEQ ID NO: 527883

SEQ ID NO: 599954 - RNA, 64 nt, Homo Sapiens; identical to SEQ ID NO: 527884

SEQ ID NO: 599955 - RNA, 64 nt, Homo Sapiens; identical to SEQ ID NO: 527885

SEQ ID NO: 599956 - RNA, 64 nt, Homo Sapiens; identical to SEQ ID NO: 527886

SEQ ID NO: 599957 - RNA, 64 nt, Homo Sapiens; identical to SEQ ID NO: 527887

SEQ ID NO: 599958 - RNA, 64 nt, Homo Sapiens; identical to SEQ ID NO: 527888

SEQ ID NO: 599959 - RNA, 64 nt, Homo Sapiens; identical to SEQ ID NO: 527889

SEQ ID NO: 599960 - RNA, 64 nt, Homo Sapiens; identical to SEQ ID NO: 527890

SEQ ID NO: 599961 - RNA, 64 nt, Homo Sapiens; identical to SEQ ID NO: 527891

SEQ ID NO: 599962 - RNA, 64 nt, Homo Sapiens; identical to SEQ ID NO: 527892

SEQ ID NO: 599963 - RNA, 64 nt, Homo Sapiens; identical to SEQ ID NO: 527893

SEQ ID NO: 599964 - RNA, 64 nt, Homo Sapiens; identical to SEQ ID NO: 119338

SEQ ID NO: 599965 - RNA, 64 nt, Homo Sapiens; identical to SEQ ID NO: 119339

SEQ ID NO: 599966 - RNA, 64 nt, Homo Sapiens; identical to SEQ ID NO: 119340

SEQ ID NO: 599967 - RNA, 64 nt, Homo Sapiens; identical to SEQ ID NO: 119341

SEQ ID NO: 599968 - RNA, 64 nt, Homo Sapiens; identical to SEQ ID NO: 119342

SEQ ID NO: 599969 - RNA, 64 nt, Homo Sapiens; identical to SEQ ID NO: 119343

SEQ ID NO: 599970 - RNA, 64 nt, Homo Sapiens; identical to SEQ ID NO: 119344

SEQ ID NO: 599971 - RNA, 64 nt, Homo Sapiens; identical to SEQ ID NO: 119345

SEQ ID NO: 599972 - RNA, 64 nt, Homo Sapiens; identical to SEQ ID NO: 119346

SEQ ID NO: 599973 - RNA, 64 nt, Homo Sapiens; identical to SEQ ID NO: 119347

SEQ ID NO: 599974 - RNA, 64 nt, Homo Sapiens; identical to SEQ ID NO: 119348

SEQ ID NO: 599975 - RNA, 64 nt, Homo Sapiens; identical to SEQ ID NO: 119349

SEQ ID NO: 599976 - RNA, 64 nt, Homo Sapiens; identical to SEQ ID NO: 119350

SEQ ID NO: 599977 - RNA, 64 nt, Homo Sapiens; identical to SEQ ID NO: 119351

SEQ ID NO: 599978 - RNA, 64 nt, Homo Sapiens; identical to SEQ ID NO: 119352

SEQ ID NO: 599979 - RNA, 64 nt, Homo Sapiens; identical to SEQ ID NO: 119353

SEQ ID NO: 599980 - RNA, 64 nt, Homo Sapiens; identical to SEQ ID NO: 119354

SEQ ID NO: 599981 - RNA, 64 nt, Homo Sapiens; identical to SEQ ID NO: 119355

SEQ ID NO: 599982 - RNA, 64 nt, Homo Sapiens; identical to SEQ ID NO: 119356

SEQ ID NO: 599983 - RNA, 64 nt, Homo Sapiens; identical to SEQ ID NO: 119357

SEQ ID NO: 599984 - RNA, 64 nt, Homo Sapiens; identical to SEQ ID NO: 119358

SEQ ID NO: 599985 - RNA, 64 nt, Homo Sapiens; identical to SEQ ID NO: 119359

SEQ ID NO: 599986 - RNA, 64 nt, Homo Sapiens; identical to SEQ ID NO: 119360

SEQ ID NO: 599987 - RNA, 64 nt, Homo Sapiens; identical to SEQ ID NO: 119361

SEQ ID NO: 599988 - RNA, 64 nt, Homo Sapiens; identical to SEQ ID NO: 95478

SEQ ID NO: 599989 - RNA, 64 nt, Homo Sapiens; identical to SEQ ID NO: 95479

SEQ ID NO: 599990 - RNA, 64 nt, Homo Sapiens; identical to SEQ ID NO: 95480

SEQ ID NO: 599991 - RNA, 64 nt, Homo Sapiens; identical to SEQ ID NO: 95481

SEQ ID NO: 599992 - RNA, 64 nt, Homo Sapiens; identical to SEQ ID NO: 95482

SEQ ID NO: 599993 - RNA, 64 nt, Homo Sapiens; identical to SEQ ID NO: 95483

SEQ ID NO: 599994 - RNA, 64 nt, Homo Sapiens; identical to SEQ ID NO: 95484

SEQ ID NO: 599995 - RNA, 64 nt, Homo Sapiens; identical to SEQ ID NO: 95485

SEQ ID NO: 599996 - RNA, 64 nt, Homo Sapiens; identical to SEQ ID NO: 95486

SEQ ID NO: 599997 - RNA, 64 nt, Homo Sapiens; identical to SEQ ID NO: 95487

SEQ ID NO: 599998 - RNA, 64 nt, Homo Sapiens; identical to SEQ ID NO: 95488

SEQ ID NO: 599999 - RNA, 64 nt, Homo Sapiens; identical to SEQ ID NO: 95489

SEQ ID NO: 600000 - RNA, 64 nt, Homo Sapiens; identical to SEQ ID NO: 95490

SEQ ID NO: 600001 - RNA, 64 nt, Homo Sapiens; identical to SEQ ID NO: 95491

SEQ ID NO: 600002 - RNA, 64 nt, Homo Sapiens; identical to SEQ ID NO: 95492

SEQ ID NO: 600003 - RNA, 64 nt, Homo Sapiens; identical to SEQ ID NO: 95493

SEQ ID NO: 600004 - RNA, 64 nt, Homo Sapiens; identical to SEQ ID NO: 95494

SEQ ID NO: 600005 - RNA, 64 nt, Homo Sapiens; identical to SEQ ID NO: 95495

SEQ ID NO: 600006 - RNA, 64 nt, Homo Sapiens; identical to SEQ ID NO: 95496

SEQ ID NO: 600007 - RNA, 64 nt, Homo Sapiens; identical to SEQ ID NO: 95497

SEQ ID NO: 600008 - RNA, 64 nt, Homo Sapiens; identical to SEQ ID NO: 95498

SEQ ID NO: 600009 - RNA, 64 nt, Homo Sapiens; identical to SEQ ID NO: 95499

SEQ ID NO: 600010 - RNA, 64 nt, Homo Sapiens; identical to SEQ ID NO: 95500

SEQ ID NO: 600011 - RNA, 64 nt, Homo Sapiens; identical to SEQ ID NO: 95501

SEQ ID NO: 600012 - RNA, 64 nt, Homo Sapiens; identical to SEQ ID NO: 95502

SEQ ID NO: 600013 - RNA, 64 nt, Homo Sapiens; identical to SEQ ID NO: 95503

SEQ ID NO: 600014 - RNA, 64 nt, Homo Sapiens; identical to SEQ ID NO: 95504

SEQ ID NO: 600015 - RNA, 64 nt, Homo Sapiens; identical to SEQ ID NO: 95505

SEQ ID NO: 600016 - RNA, 64 nt, Homo Sapiens; identical to SEQ ID NO: 95506

SEQ ID NO: 600017 - RNA, 64 nt, Homo Sapiens; identical to SEQ ID NO: 95507

SEQ ID NO: 600018 - RNA, 64 nt, Homo Sapiens; identical to SEQ ID NO: 95508

SEQ ID NO: 600019 - RNA, 64 nt, Homo Sapiens; identical to SEQ ID NO: 95509

SEQ ID NO: 600020 - RNA, 64 nt, Homo Sapiens; identical to SEQ ID NO: 95510

SEQ ID NO: 600021 - RNA, 64 nt, Homo Sapiens; identical to SEQ ID NO: 95511

SEQ ID NO: 600022 - RNA, 64 nt, Homo Sapiens; identical to SEQ ID NO: 95512

SEQ ID NO: 600023 - RNA, 64 nt, Homo Sapiens; identical to SEQ ID NO: 95513

SEQ ID NO: 600024 - RNA, 64 nt, Homo Sapiens; identical to SEQ ID NO: 95514

SEQ ID NO: 600025 - RNA, 64 nt, Homo Sapiens; identical to SEQ ID NO: 95515

SEQ ID NO: 600026 - RNA, 64 nt, Homo Sapiens; identical to SEQ ID NO: 95516

SEQ ID NO: 600027 - RNA, 64 nt, Homo Sapiens; identical to SEQ ID NO: 95517

SEQ ID NO: 600028 - RNA, 64 nt, Homo Sapiens; identical to SEQ ID NO: 95518

SEQ ID NO: 600029 - RNA, 64 nt, Homo Sapiens; identical to SEQ ID NO: 95519

SEQ ID NO: 600030 - RNA, 64 nt, Homo Sapiens; identical to SEQ ID NO: 95520

SEQ ID NO: 600031 - RNA, 64 nt, Homo Sapiens; identical to SEQ ID NO: 95521

SEQ ID NO: 600032 - RNA, 64 nt, Homo Sapiens; identical to SEQ ID NO: 95522

SEQ ID NO: 600033 - RNA, 64 nt, Homo Sapiens; identical to SEQ ID NO: 95523

SEQ ID NO: 600034 - RNA, 64 nt, Homo Sapiens; identical to SEQ ID NO: 95524

SEQ ID NO: 600035 - RNA, 64 nt, Homo Sapiens; identical to SEQ ID NO: 95525

SEQ ID NO: 600036 - RNA, 64 nt, Homo Sapiens; identical to SEQ ID NO: 91216

SEQ ID NO: 600037 - RNA, 64 nt, Homo Sapiens; identical to SEQ ID NO: 91217

SEQ ID NO: 600038 - RNA, 64 nt, Homo Sapiens; identical to SEQ ID NO: 91218

SEQ ID NO: 600039 - RNA, 64 nt, Homo Sapiens; identical to SEQ ID NO: 91219

SEQ ID NO: 600040 - RNA, 64 nt, Homo Sapiens; identical to SEQ ID NO: 91220

SEQ ID NO: 600041 - RNA, 64 nt, Homo Sapiens; identical to SEQ ID NO: 91221

SEQ ID NO: 600042 - RNA, 64 nt, Homo Sapiens; identical to SEQ ID NO: 91222

SEQ ID NO: 600043 - RNA, 64 nt, Homo Sapiens; identical to SEQ ID NO: 91223

SEQ ID NO: 600044 - RNA, 64 nt, Homo Sapiens; identical to SEQ ID NO: 91224

SEQ ID NO: 600045 - RNA, 55 nt, Homo Sapiens; identical to SEQ ID NO: 91225

SEQ ID NO: 600046 - RNA, 64 nt, Homo Sapiens; identical to SEQ ID NO: 91226

SEQ ID NO: 600047 - RNA, 64 nt, Homo Sapiens; identical to SEQ ID NO: 91227

SEQ ID NO: 600048 - RNA, 64 nt, Homo Sapiens; identical to SEQ ID NO: 91228

SEQ ID NO: 600049 - RNA, 64 nt, Homo Sapiens; identical to SEQ ID NO: 91229

SEQ ID NO: 600050 - RNA, 64 nt, Homo Sapiens; identical to SEQ ID NO: 91230

SEQ ID NO: 600051 - RNA, 64 nt, Homo Sapiens; identical to SEQ ID NO: 91231

SEQ ID NO: 600052 - RNA, 64 nt, Homo Sapiens; identical to SEQ ID NO: 91232

SEQ ID NO: 600053 - RNA, 64 nt, Homo Sapiens; identical to SEQ ID NO: 91233

SEQ ID NO: 600054 - RNA, 64 nt, Homo Sapiens; identical to SEQ ID NO: 91234

SEQ ID NO: 600055 - RNA, 64 nt, Homo Sapiens; identical to SEQ ID NO: 91235

SEQ ID NO: 600056 - RNA, 64 nt, Homo Sapiens; identical to SEQ ID NO: 91236

SEQ ID NO: 600057 - RNA, 64 nt, Homo Sapiens; identical to SEQ ID NO: 91237

SEQ ID NO: 600058 - RNA, 64 nt, Homo Sapiens; identical to SEQ ID NO: 91238

SEQ ID NO: 600059 - RNA, 55 nt, Homo Sapiens; identical to SEQ ID NO: 91239

SEQ ID NO: 600060 - RNA, 64 nt, Homo Sapiens; identical to SEQ ID NO: 91240

SEQ ID NO: 600061 - RNA, 64 nt, Homo Sapiens; identical to SEQ ID NO: 91241

SEQ ID NO: 600062 - RNA, 64 nt, Homo Sapiens; identical to SEQ ID NO: 91242

SEQ ID NO: 600063 - RNA, 64 nt, Homo Sapiens; identical to SEQ ID NO: 91243

SEQ ID NO: 600064 - RNA, 64 nt, Homo Sapiens; identical to SEQ ID NO: 91244

SEQ ID NO: 600065 - RNA, 64 nt, Homo Sapiens; identical to SEQ ID NO: 91245

SEQ ID NO: 600066 - RNA, 64 nt, Homo Sapiens; identical to SEQ ID NO: 91246

SEQ ID NO: 600067 - RNA, 64 nt, Homo Sapiens; identical to SEQ ID NO: 91247

SEQ ID NO: 600068 - RNA, 64 nt, Homo Sapiens; identical to SEQ ID NO: 91248

SEQ ID NO: 600069 - RNA, 64 nt, Homo Sapiens; identical to SEQ ID NO: 91249

SEQ ID NO: 600070 - RNA, 64 nt, Homo Sapiens; identical to SEQ ID NO: 91250

SEQ ID NO: 600071 - RNA, 64 nt, Homo Sapiens; identical to SEQ ID NO: 91251

SEQ ID NO: 600072 - RNA, 64 nt, Homo Sapiens; identical to SEQ ID NO: 91252

SEQ ID NO: 600073 - RNA, 64 nt, Homo Sapiens; identical to SEQ ID NO: 91253

SEQ ID NO: 600074 - RNA, 64 nt, Homo Sapiens; identical to SEQ ID NO: 91254

SEQ ID NO: 600075 - RNA, 64 nt, Homo Sapiens; identical to SEQ ID NO: 91255

SEQ ID NO: 600076 - RNA, 64 nt, Homo Sapiens; identical to SEQ ID NO: 91256

SEQ ID NO: 600077 - RNA, 64 nt, Homo Sapiens; identical to SEQ ID NO: 91257

SEQ ID NO: 600078 - RNA, 64 nt, Homo Sapiens; identical to SEQ ID NO: 91258

SEQ ID NO: 600079 - RNA, 64 nt, Homo Sapiens; identical to SEQ ID NO: 91259

SEQ ID NO: 600080 - RNA, 64 nt, Homo Sapiens; identical to SEQ ID NO: 91260

SEQ ID NO: 600081 - RNA, 64 nt, Homo Sapiens; identical to SEQ ID NO: 91261

SEQ ID NO: 600082 - RNA, 64 nt, Homo Sapiens
gcccaccaaccuuccccaccgaugagaauggcugauggcugagagcugaguuuuucacguguaa

SEQ ID NO: 600083 - RNA, 64 nt, Homo Sapiens
gcugagagcccaccaaccuucguguaagaugagaauggcugaugucucucagcugaguuuuuca

SEQ ID NO: 600084 - RNA, 64 nt, Homo Sapiens
uuuguguguguggcgcuuuagggugcuggacuguauggcugagggcugguuggguuccucuauu

SEQ ID NO: 600085 - RNA, 64 nt, Homo Sapiens
ugaaaggguugccuuggcagcagaggcuccucugauggcugacaucagucacugcgucugggcc

SEQ ID NO: 600086 - RNA, 64 nt, Homo Sapiens
uguuuuccauuacauuuagauucauagaaucugaauggcugauuaaauggccaucugauggcug

SEQ ID NO: 600087 - RNA, 64 nt, Homo Sapiens
auagaaucugaauggcugauuaaauggccaucugauggcugaaagaggggcguauuuuucacuc

SEQ ID NO: 600088 - RNA, 64 nt, Homo Sapiens
cuuggucauuuuuuuuauauugccuuauuucccuauggcugagccuuguugugacacaucaagc

SEQ ID NO: 600089 - RNA, 64 nt, Homo Sapiens
aggggaggguuggagacaaaagcuguaaauuacuauggcugauuuauuucuacuauauacauau

SEQ ID NO: 600090 - RNA, 64 nt, Homo Sapiens
agcacaguaauuuaagauugcaugaaugcgagaaauggcugauaucuccaugguuuuuccuaca

SEQ ID NO: 600091 - RNA, 64 nt, Homo Sapiens
uuaacuuauuuaggcauucacugaacacacuggaauggcugaguaucuggguuucuagaccuca

SEQ ID NO: 600092 - RNA, 64 nt, Homo Sapiens
gaaggugcuggaagccgaggugcuggcacugaagauggcugaggagucagagaggaggugaggg

SEQ ID NO: 600093 - RNA, 64 nt, Homo Sapiens
ugcacccagccccuucuugcccuuucuuuucuccauggcugaugcugcuguggccagccagggc

SEQ ID NO: 600094 - RNA, 64 nt, Homo Sapiens
uuuuguuguauaaggcuguggaaguuguacuccaauggcugaagccauguuguuaauauggcug

SEQ ID NO: 600095 - RNA, 64 nt, Homo Sapiens
guuguacuccaauggcugaagccauguuguuaauauggcugaugggagcaucccugcagcugaa

SEQ ID NO: 600096 - RNA, 64 nt, Homo Sapiens; identical to SEQ ID NO: 50645

SEQ ID NO: 600097 - RNA, 64 nt, Homo Sapiens; identical to SEQ ID NO: 50646

SEQ ID NO: 600098 - RNA, 64 nt, Homo Sapiens; identical to SEQ ID NO: 50647

SEQ ID NO: 600099 - RNA, 64 nt, Homo Sapiens; identical to SEQ ID NO: 50648

SEQ ID NO: 600100 - RNA, 64 nt, Homo Sapiens; identical to SEQ ID NO: 50649

SEQ ID NO: 600101 - RNA, 64 nt, Homo Sapiens; identical to SEQ ID NO: 50650

SEQ ID NO: 600102 - RNA, 64 nt, Homo Sapiens; identical to SEQ ID NO: 50651

SEQ ID NO: 600103 - RNA, 64 nt, Homo Sapiens; identical to SEQ ID NO: 50652

SEQ ID NO: 600104 - RNA, 64 nt, Homo Sapiens; identical to SEQ ID NO: 50653

SEQ ID NO: 600105 - RNA, 64 nt, Homo Sapiens; identical to SEQ ID NO: 50654

SEQ ID NO: 600106 - RNA, 64 nt, Homo Sapiens; identical to SEQ ID NO: 50653

SEQ ID NO: 600107 - RNA, 64 nt, Homo Sapiens; identical to SEQ ID NO: 50656

SEQ ID NO: 600108 - RNA, 64 nt, Homo Sapiens; identical to SEQ ID NO: 50657

SEQ ID NO: 600109 - RNA, 64 nt, Homo Sapiens; identical to SEQ ID NO: 50658

SEQ ID NO: 600110 - RNA, 64 nt, Homo Sapiens; identical to SEQ ID NO: 50659

SEQ ID NO: 600111 - RNA, 64 nt, Homo Sapiens; identical to SEQ ID NO: 50660

SEQ ID NO: 600112 - RNA, 64 nt, Homo Sapiens; identical to SEQ ID NO: 50661

SEQ ID NO: 600113 - RNA, 64 nt, Homo Sapiens; identical to SEQ ID NO: 50662

SEQ ID NO: 600114 - RNA, 64 nt, Homo Sapiens; identical to SEQ ID NO: 50663

SEQ ID NO: 600115 - RNA, 64 nt, Homo Sapiens; identical to SEQ ID NO: 50664

SEQ ID NO: 600116 - RNA, 64 nt, Homo Sapiens; identical to SEQ ID NO: 50665

SEQ ID NO: 600117 - RNA, 64 nt, Homo Sapiens; identical to SEQ ID NO: 50666

SEQ ID NO: 600118 - RNA, 64 nt, Homo Sapiens; identical to SEQ ID NO: 50667

SEQ ID NO: 600119 - RNA, 64 nt, Homo Sapiens; identical to SEQ ID NO: 50668

SEQ ID NO: 600120 - RNA, 64 nt, Homo Sapiens; identical to SEQ ID NO: 50669

SEQ ID NO: 600121 - RNA, 64 nt, Homo Sapiens; identical to SEQ ID NO: 50670

SEQ ID NO: 600122 - RNA, 64 nt, Homo Sapiens; identical to SEQ ID NO: 50671

SEQ ID NO: 600123 - RNA, 64 nt, Homo Sapiens; identical to SEQ ID NO: 50672

SEQ ID NO: 600124 - RNA, 53 nt, Homo Sapiens; identical to SEQ ID NO: 50673

SEQ ID NO: 600125 - RNA, 64 nt, Homo Sapiens; identical to SEQ ID NO: 50674

SEQ ID NO: 600126 - RNA, 64 nt, Homo Sapiens; identical to SEQ ID NO: 50675

SEQ ID NO: 600127 - RNA, 64 nt, Homo Sapiens; identical to SEQ ID NO: 50676

SEQ ID NO: 600128 - RNA, 64 nt, Homo Sapiens; identical to SEQ ID NO: 50677

SEQ ID NO: 600129 - RNA, 64 nt, Homo Sapiens; identical to SEQ ID NO: 50678

SEQ ID NO: 600130 - RNA, 64 nt, Homo Sapiens; identical to SEQ ID NO: 50679

SEQ ID NO: 600131 - RNA, 64 nt, Homo Sapiens; identical to SEQ ID NO: 393047

SEQ ID NO: 600132 - RNA, 64 nt, Homo Sapiens; identical to SEQ ID NO: 393048

SEQ ID NO: 600133 - RNA, 64 nt, Homo Sapiens; identical to SEQ ID NO: 393049

SEQ ID NO: 600134 - RNA, 64 nt, Homo Sapiens; identical to SEQ ID NO: 393050

SEQ ID NO: 600135 - RNA, 64 nt, Homo Sapiens; identical to SEQ ID NO: 393051

SEQ ID NO: 600136 - RNA, 64 nt, Homo Sapiens; identical to SEQ ID NO: 393052

SEQ ID NO: 600137 - RNA, 64 nt, Homo Sapiens; identical to SEQ ID NO: 393053

SEQ ID NO: 600138 - RNA, 64 nt, Homo Sapiens; identical to SEQ ID NO: 393054

SEQ ID NO: 600139 - RNA, 64 nt, Homo Sapiens; identical to SEQ ID NO: 393055

SEQ ID NO: 600140 - RNA, 64 nt, Homo Sapiens; identical to SEQ ID NO: 393056

SEQ ID NO: 600141 - RNA, 64 nt, Homo Sapiens; identical to SEQ ID NO: 393057

SEQ ID NO: 600142 - RNA, 64 nt, Homo Sapiens; identical to SEQ ID NO: 393058

SEQ ID NO: 600143 - RNA, 64 nt, Homo Sapiens; identical to SEQ ID NO: 393059

SEQ ID NO: 600144 - RNA, 64 nt, Homo Sapiens; identical to SEQ ID NO: 393060

SEQ ID NO: 600145 - RNA, 64 nt, Homo Sapiens; identical to SEQ ID NO: 393061

SEQ ID NO: 600146 - RNA, 64 nt, Homo Sapiens; identical to SEQ ID NO: 393062

SEQ ID NO: 600147 - RNA, 64 nt, Homo Sapiens; identical to SEQ ID NO: 393063

SEQ ID NO: 600148 - RNA, 64 nt, Homo Sapiens; identical to SEQ ID NO: 393064

SEQ ID NO: 600149 - RNA, 64 nt, Homo Sapiens; identical to SEQ ID NO: 393065

SEQ ID NO: 600150 - RNA, 64 nt, Homo Sapiens; identical to SEQ ID NO: 393066

SEQ ID NO: 600151 - RNA, 64 nt, Homo Sapiens; identical to SEQ ID NO: 393067

SEQ ID NO: 600152 - RNA, 64 nt, Homo Sapiens; identical to SEQ ID NO: 393068

SEQ ID NO: 600153 - RNA, 64 nt, Homo Sapiens; identical to SEQ ID NO: 393069

SEQ ID NO: 600154 - RNA, 64 nt, Homo Sapiens; identical to SEQ ID NO: 393070

SEQ ID NO: 600155 - RNA, 64 nt, Homo Sapiens; identical to SEQ ID NO: 393071

SEQ ID NO: 600156 - RNA, 64 nt, Homo Sapiens; identical to SEQ ID NO: 393072

SEQ ID NO: 600157 - RNA, 64 nt, Homo Sapiens; identical to SEQ ID NO: 393073

SEQ ID NO: 600158 - RNA, 64 nt, Homo Sapiens; identical to SEQ ID NO: 393074

SEQ ID NO: 600159 - RNA, 64 nt, Homo Sapiens; identical to SEQ ID NO: 393075

SEQ ID NO: 600160 - RNA, 64 nt, Homo Sapiens; identical to SEQ ID NO: 393076

SEQ ID NO: 600161 - RNA, 64 nt, Homo Sapiens; identical to SEQ ID NO: 393077

SEQ ID NO: 600162 - RNA, 64 nt, Homo Sapiens; identical to SEQ ID NO: 393078

SEQ ID NO: 600163 - RNA, 64 nt, Homo Sapiens; identical to SEQ ID NO: 393079

SEQ ID NO: 600164 - RNA, 64 nt, Homo Sapiens; identical to SEQ ID NO: 393080

SEQ ID NO: 600165 - RNA, 64 nt, Homo Sapiens; identical to SEQ ID NO: 393081

SEQ ID NO: 600166 - RNA, 64 nt, Homo Sapiens; identical to SEQ ID NO: 393082

SEQ ID NO: 600167 - RNA, 64 nt, Homo Sapiens; identical to SEQ ID NO: 393083

SEQ ID NO: 600168 - RNA, 64 nt, Homo Sapiens; identical to SEQ ID NO: 393084

SEQ ID NO: 600169 - RNA, 64 nt, Homo Sapiens; identical to SEQ ID NO: 393085

SEQ ID NO: 600170 - RNA, 64 nt, Homo Sapiens; identical to SEQ ID NO: 393086

SEQ ID NO: 600171 - RNA, 64 nt, Homo Sapiens; identical to SEQ ID NO: 393087

SEQ ID NO: 600172 - RNA, 64 nt, Homo Sapiens; identical to SEQ ID NO: 393088

SEQ ID NO: 600173 - RNA, 64 nt, Homo Sapiens; identical to SEQ ID NO: 393089

SEQ ID NO: 600174 - RNA, 64 nt, Homo Sapiens; identical to SEQ ID NO: 393090

SEQ ID NO: 600175 - RNA, 64 nt, Homo Sapiens; identical to SEQ ID NO: 393091

SEQ ID NO: 600176 - RNA, 64 nt, Homo Sapiens; identical to SEQ ID NO: 393092

SEQ ID NO: 600177 - RNA, 64 nt, Homo Sapiens; identical to SEQ ID NO: 393093

SEQ ID NO: 600178 - RNA, 64 nt, Homo Sapiens; identical to SEQ ID NO: 393094

SEQ ID NO: 600179 - RNA, 64 nt, Homo Sapiens; identical to SEQ ID NO: 393095

SEQ ID NO: 600180 - RNA, 64 nt, Homo Sapiens; identical to SEQ ID NO: 393096

SEQ ID NO: 600181 - RNA, 64 nt, Homo Sapiens; identical to SEQ ID NO: 393097

SEQ ID NO: 600182 - RNA, 64 nt, Homo Sapiens; identical to SEQ ID NO: 393098

SEQ ID NO: 600183 - RNA, 64 nt, Homo Sapiens; identical to SEQ ID NO: 393099

SEQ ID NO: 600184 - RNA, 64 nt, Homo Sapiens; identical to SEQ ID NO: 393100

SEQ ID NO: 600185 - RNA, 64 nt, Homo Sapiens; identical to SEQ ID NO: 393101

SEQ ID NO: 600186 - RNA, 64 nt, Homo Sapiens; identical to SEQ ID NO: 393102

SEQ ID NO: 600187 - RNA, 64 nt, Homo Sapiens; identical to SEQ ID NO: 393103

SEQ ID NO: 600188 - RNA, 64 nt, Homo Sapiens; identical to SEQ ID NO: 393104

SEQ ID NO: 600189 - RNA, 64 nt, Homo Sapiens; identical to SEQ ID NO: 393105

SEQ ID NO: 600190 - RNA, 64 nt, Homo Sapiens; identical to SEQ ID NO: 393106

SEQ ID NO: 600191 - RNA, 64 nt, Homo Sapiens; identical to SEQ ID NO: 393107

SEQ ID NO: 600192 - RNA, 64 nt, Homo Sapiens; identical to SEQ ID NO: 393108

SEQ ID NO: 600193 - RNA, 64 nt, Homo Sapiens; identical to SEQ ID NO: 393109

SEQ ID NO: 600194 - RNA, 64 nt, Homo Sapiens; identical to SEQ ID NO: 393110

SEQ ID NO: 600195 - RNA, 64 nt, Homo Sapiens; identical to SEQ ID NO: 393111

SEQ ID NO: 600196 - RNA, 64 nt, Homo Sapiens; identical to SEQ ID NO: 393112

SEQ ID NO: 600197 - RNA, 64 nt, Homo Sapiens; identical to SEQ ID NO: 393113

SEQ ID NO: 600198 - RNA, 64 nt, Homo Sapiens; identical to SEQ ID NO: 393114

SEQ ID NO: 600199 - RNA, 64 nt, Homo Sapiens; identical to SEQ ID NO: 393115

SEQ ID NO: 600200 - RNA, 64 nt, Homo Sapiens; identical to SEQ ID NO: 393116

SEQ ID NO: 600201 - RNA, 64 nt, Homo Sapiens; identical to SEQ ID NO: 393117

SEQ ID NO: 600202 - RNA, 64 nt, Homo Sapiens; identical to SEQ ID NO: 393118

SEQ ID NO: 600203 - RNA, 64 nt, Homo Sapiens; identical to SEQ ID NO: 393119

SEQ ID NO: 600204 - RNA, 64 nt, Homo Sapiens; identical to SEQ ID NO: 393120

SEQ ID NO: 600205 - RNA, 64 nt, Homo Sapiens; identical to SEQ ID NO: 393121

SEQ ID NO: 600206 - RNA, 64 nt, Homo Sapiens; identical to SEQ ID NO: 393122

SEQ ID NO: 600207 - RNA, 64 nt, Homo Sapiens; identical to SEQ ID NO: 393123

SEQ ID NO: 600208 - RNA, 64 nt, Homo Sapiens; identical to SEQ ID NO: 393124

SEQ ID NO: 600209 - RNA, 64 nt, Homo Sapiens; identical to SEQ ID NO: 393125

SEQ ID NO: 600210 - RNA, 64 nt, Homo Sapiens; identical to SEQ ID NO: 393126

SEQ ID NO: 600211 - RNA, 64 nt, Homo Sapiens; identical to SEQ ID NO: 393127

SEQ ID NO: 600212 - RNA, 64 nt, Homo Sapiens; identical to SEQ ID NO: 393128

SEQ ID NO: 600213 - RNA, 64 nt, Homo Sapiens; identical to SEQ ID NO: 393129

SEQ ID NO: 600214 - RNA, 64 nt, Homo Sapiens; identical to SEQ ID NO: 393130

SEQ ID NO: 600215 - RNA, 64 nt, Homo Sapiens; identical to SEQ ID NO: 393131

SEQ ID NO: 600216 - RNA, 64 nt, Homo Sapiens; identical to SEQ ID NO: 393132

SEQ ID NO: 600217 - RNA, 64 nt, Homo Sapiens; identical to SEQ ID NO: 393133

SEQ ID NO: 600218 - RNA, 64 nt, Homo Sapiens; identical to SEQ ID NO: 393134

SEQ ID NO: 600219 - RNA, 64 nt, Homo Sapiens; identical to SEQ ID NO: 393135

SEQ ID NO: 600220 - RNA, 64 nt, Homo Sapiens; identical to SEQ ID NO: 393136

SEQ ID NO: 600221 - RNA, 64 nt, Homo Sapiens; identical to SEQ ID NO: 393137

SEQ ID NO: 600222 - RNA, 64 nt, Homo Sapiens; identical to SEQ ID NO: 393138

SEQ ID NO: 600223 - RNA, 64 nt, Homo Sapiens; identical to SEQ ID NO: 393139

SEQ ID NO: 600224 - RNA, 64 nt, Homo Sapiens; identical to SEQ ID NO: 393140

SEQ ID NO: 600225 - RNA, 64 nt, Homo Sapiens; identical to SEQ ID NO: 393141

SEQ ID NO: 600226 - RNA, 64 nt, Homo Sapiens; identical to SEQ ID NO: 393142

SEQ ID NO: 600227 - RNA, 64 nt, Homo Sapiens; identical to SEQ ID NO: 393143

SEQ ID NO: 600228 - RNA, 64 nt, Homo Sapiens; identical to SEQ ID NO: 393144

SEQ ID NO: 600229 - RNA, 64 nt, Homo Sapiens; identical to SEQ ID NO: 393145

SEQ ID NO: 600230 - RNA, 64 nt, Homo Sapiens; identical to SEQ ID NO: 393146

SEQ ID NO: 600231 - RNA, 64 nt, Homo Sapiens; identical to SEQ ID NO: 393147

SEQ ID NO: 600232 - RNA, 64 nt, Homo Sapiens; identical to SEQ ID NO: 393148

SEQ ID NO: 600233 - RNA, 64 nt, Homo Sapiens; identical to SEQ ID NO: 393149

SEQ ID NO: 600234 - RNA, 64 nt, Homo Sapiens; identical to SEQ ID NO: 393150

SEQ ID NO: 600235 - RNA, 64 nt, Homo Sapiens; identical to SEQ ID NO: 393151

SEQ ID NO: 600236 - RNA, 64 nt, Homo Sapiens; identical to SEQ ID NO: 393152

SEQ ID NO: 600237 - RNA, 64 nt, Homo Sapiens; identical to SEQ ID NO: 393153

SEQ ID NO: 600238 - RNA, 64 nt, Homo Sapiens; identical to SEQ ID NO: 393154

SEQ ID NO: 600239 - RNA, 64 nt, Homo Sapiens; identical to SEQ ID NO: 393155

SEQ ID NO: 600240 - RNA, 64 nt, Homo Sapiens; identical to SEQ ID NO: 393156

SEQ ID NO: 600241 - RNA, 64 nt, Homo Sapiens; identical to SEQ ID NO: 393157

SEQ ID NO: 600242 - RNA, 64 nt, Homo Sapiens; identical to SEQ ID NO: 393158

SEQ ID NO: 600243 - RNA, 64 nt, Homo Sapiens; identical to SEQ ID NO: 393159

SEQ ID NO: 600244 - RNA, 64 nt, Homo Sapiens; identical to SEQ ID NO: 393160

SEQ ID NO: 600245 - RNA, 64 nt, Homo Sapiens; identical to SEQ ID NO: 393161

SEQ ID NO: 600246 - RNA, 64 nt, Homo Sapiens; identical to SEQ ID NO: 393162

SEQ ID NO: 600247 - RNA, 64 nt, Homo Sapiens; identical to SEQ ID NO: 393163

SEQ ID NO: 600248 - RNA, 64 nt, Homo Sapiens; identical to SEQ ID NO: 393164

SEQ ID NO: 600249 - RNA, 64 nt, Homo Sapiens; identical to SEQ ID NO: 393165

SEQ ID NO: 600250 - RNA, 64 nt, Homo Sapiens; identical to SEQ ID NO: 393166

SEQ ID NO: 600251 - RNA, 64 nt, Homo Sapiens; identical to SEQ ID NO: 393167

SEQ ID NO: 600252 - RNA, 64 nt, Homo Sapiens; identical to SEQ ID NO: 393168

SEQ ID NO: 600253 - RNA, 64 nt, Homo Sapiens; identical to SEQ ID NO: 393169

SEQ ID NO: 600254 - RNA, 64 nt, Homo Sapiens; identical to SEQ ID NO: 393170

SEQ ID NO: 600255 - RNA, 64 nt, Homo Sapiens; identical to SEQ ID NO: 393171

SEQ ID NO: 600256 - RNA, 64 nt, Homo Sapiens; identical to SEQ ID NO: 393172

SEQ ID NO: 600257 - RNA, 64 nt, Homo Sapiens; identical to SEQ ID NO: 393173

SEQ ID NO: 600258 - RNA, 64 nt, Homo Sapiens; identical to SEQ ID NO: 393174

SEQ ID NO: 600259 - RNA, 64 nt, Homo Sapiens; identical to SEQ ID NO: 393175

SEQ ID NO: 600260 - RNA, 64 nt, Homo Sapiens; identical to SEQ ID NO: 393176

SEQ ID NO: 600261 - RNA, 64 nt, Homo Sapiens; identical to SEQ ID NO: 492885

SEQ ID NO: 600262 - RNA, 64 nt, Homo Sapiens; identical to SEQ ID NO: 492886

SEQ ID NO: 600263 - RNA, 64 nt, Homo Sapiens; identical to SEQ ID NO: 492887

SEQ ID NO: 600264 - RNA, 64 nt, Homo Sapiens; identical to SEQ ID NO: 492888

SEQ ID NO: 600265 - RNA, 64 nt, Homo Sapiens; identical to SEQ ID NO: 492889

SEQ ID NO: 600266 - RNA, 64 nt, Homo Sapiens; identical to SEQ ID NO: 492890

SEQ ID NO: 600267 - RNA, 64 nt, Homo Sapiens; identical to SEQ ID NO: 492891

SEQ ID NO: 600268 - RNA, 64 nt, Homo Sapiens; identical to SEQ ID NO: 492892

SEQ ID NO: 600269 - RNA, 64 nt, Homo Sapiens; identical to SEQ ID NO: 492893

SEQ ID NO: 600270 - RNA, 64 nt, Homo Sapiens; identical to SEQ ID NO: 492894

SEQ ID NO: 600271 - RNA, 64 nt, Homo Sapiens; identical to SEQ ID NO: 492895

SEQ ID NO: 600272 - RNA, 64 nt, Homo Sapiens; identical to SEQ ID NO: 492896

SEQ ID NO: 600273 - RNA, 64 nt, Homo Sapiens; identical to SEQ ID NO: 492897

SEQ ID NO: 600274 - RNA, 64 nt, Homo Sapiens; identical to SEQ ID NO: 47001

SEQ ID NO: 600275 - RNA, 64 nt, Homo Sapiens; identical to SEQ ID NO: 47002

SEQ ID NO: 600276 - RNA, 64 nt, Homo Sapiens; identical to SEQ ID NO: 47003

SEQ ID NO: 600277 - RNA, 64 nt, Homo Sapiens; identical to SEQ ID NO: 47004

SEQ ID NO: 600278 - RNA, 64 nt, Homo Sapiens; identical to SEQ ID NO: 47005

SEQ ID NO: 600279 - RNA, 64 nt, Homo Sapiens; identical to SEQ ID NO: 47006

SEQ ID NO: 600280 - RNA, 58 nt, Homo Sapiens; identical to SEQ ID NO: 47007

SEQ ID NO: 600281 - RNA, 64 nt, Homo Sapiens; identical to SEQ ID NO: 47008

SEQ ID NO: 600282 - RNA, 64 nt, Homo Sapiens; identical to SEQ ID NO: 47009

SEQ ID NO: 600283 - RNA, 64 nt, Homo Sapiens; identical to SEQ ID NO: 47010

SEQ ID NO: 600284 - RNA, 64 nt, Homo Sapiens; identical to SEQ ID NO: 47011

SEQ ID NO: 600285 - RNA, 64 nt, Homo Sapiens; identical to SEQ ID NO: 47012

SEQ ID NO: 600286 - RNA, 64 nt, Homo Sapiens; identical to SEQ ID NO: 47013

SEQ ID NO: 600287 - RNA, 64 nt, Homo Sapiens; identical to SEQ ID NO: 47014

SEQ ID NO: 600288 - RNA, 64 nt, Homo Sapiens; identical to SEQ ID NO: 47015

SEQ ID NO: 600289 - RNA, 64 nt, Homo Sapiens
uuccaauacugauuccaaaauuccccagucuuugacucuuuaaauugauuauucaccaaaagug

SEQ ID NO: 600290 - RNA, 64 nt, Homo Sapiens
ugaauaagaaccaauuccauugauaauuagguuuacucuuuaucaaguuuaaguuuacuuggau

SEQ ID NO: 600291 - RNA, 64 nt, Homo Sapiens
aucaacuguucccccuuuugguguacacuuguaaacucuuuaugugugccuuacaccuugaguu

SEQ ID NO: 600292 - RNA, 64 nt, Homo Sapiens
uauuguucacccuuuuuuuccguuaacgcaaguaacucuuuauuuuuuaaugaaauaacgugac

SEQ ID NO: 600293 - RNA, 64 nt, Homo Sapiens
ucucuaguaaaugcagcuagcaugccugggcuaaacucuuuaagggauuacaggugugagccac

SEQ ID NO: 600294 - RNA, 64 nt, Homo Sapiens
uuuuuaauuauuauuaguauaaaauguguuuuaaacucuuuauuuuucuagcagugccaucucc

SEQ ID NO: 600295 - RNA, 64 nt, Homo Sapiens
ggugggauuacauugcacccuaugucccaggaugacucuuuaugaggagggggcuggcugccuu

SEQ ID NO: 600296 - RNA, 64 nt, Homo Sapiens
uuaugaggcuguauuccucaugagcuuugggaaaacucuuuaucucuuucccucuuuuucacuu

SEQ ID NO: 600297 - RNA, 64 nt, Homo Sapiens
cucauguuccacauggucuauagagagcuuucaaacucuuuauugauggcauugggagaaauuu

SEQ ID NO: 600298 - RNA, 64 nt, Homo Sapiens
auuuuagguuaagugaugucccucaugcauauuaacucuuuagagugcuuccuauauuaccauc

SEQ ID NO: 600299 - RNA, 64 nt, Homo Sapiens
auagaacuuguggaaguuaaaggaaaauuuguagacucuuuauaggguuuuuuuuuuuaaauaa

SEQ ID NO: 600300 - RNA, 64 nt, Homo Sapiens
agggauaucauguaccagguuaaagguacuguguacucuuuaauguucuguuuaaugaccucuu

SEQ ID NO: 600301 - RNA, 64 nt, Homo Sapiens
accuucacucagcuguggauuuuacauucauuuaacucuuuaugagacgaaugauagggccugg

SEQ ID NO: 600302 - RNA, 64 nt, Homo Sapiens
cuuaaaucuguauacagaauaucauugauauaauacucuuuaggcaggagcacucuugccuucc

SEQ ID NO: 600303 - RNA, 64 nt, Homo Sapiens
aaagcaguguguguuucuuauuuuuauauuuuuaacucuuuauucuuggauguauaaagugaac

SEQ ID NO: 600304 - RNA, 64 nt, Homo Sapiens; identical to SEQ ID NO: 98813

SEQ ID NO: 600305 - RNA, 64 nt, Homo Sapiens; identical to SEQ ID NO: 98814

SEQ ID NO: 600306 - RNA, 64 nt, Homo Sapiens; identical to SEQ ID NO: 98815

SEQ ID NO: 600307 - RNA, 64 nt, Homo Sapiens; identical to SEQ ID NO: 98816

SEQ ID NO: 600308 - RNA, 64 nt, Homo Sapiens; identical to SEQ ID NO: 98817

SEQ ID NO: 600309 - RNA, 64 nt, Homo Sapiens; identical to SEQ ID NO: 98818

SEQ ID NO: 600310 - RNA, 64 nt, Homo Sapiens; identical to SEQ ID NO: 98819

SEQ ID NO: 600311 - RNA, 64 nt, Homo Sapiens; identical to SEQ ID NO: 98820

SEQ ID NO: 600312 - RNA, 64 nt, Homo Sapiens; identical to SEQ ID NO: 98821

SEQ ID NO: 600313 - RNA, 64 nt, Homo Sapiens; identical to SEQ ID NO: 98822

SEQ ID NO: 600314 - RNA, 64 nt, Homo Sapiens; identical to SEQ ID NO: 98823

SEQ ID NO: 600315 - RNA, 64 nt, Homo Sapiens; identical to SEQ ID NO: 98824

SEQ ID NO: 600316 - RNA, 64 nt, Homo Sapiens; identical to SEQ ID NO: 98825

SEQ ID NO: 600317 - RNA, 64 nt, Homo Sapiens; identical to SEQ ID NO: 98826

SEQ ID NO: 600318 - RNA, 64 nt, Homo Sapiens; identical to SEQ ID NO: 98827

SEQ ID NO: 600319 - RNA, 64 nt, Homo Sapiens; identical to SEQ ID NO: 98828

SEQ ID NO: 600320 - RNA, 64 nt, Homo Sapiens; identical to SEQ ID NO: 98829

SEQ ID NO: 600321 - RNA, 64 nt, Homo Sapiens; identical to SEQ ID NO: 98830

SEQ ID NO: 600322 - RNA, 64 nt, Homo Sapiens; identical to SEQ ID NO: 98831

SEQ ID NO: 600323 - RNA, 64 nt, Homo Sapiens; identical to SEQ ID NO: 98832

SEQ ID NO: 600324 - RNA, 64 nt, Homo Sapiens; identical to SEQ ID NO: 98833

SEQ ID NO: 600325 - RNA, 64 nt, Homo Sapiens; identical to SEQ ID NO: 98834

SEQ ID NO: 600326 - RNA, 64 nt, Homo Sapiens; identical to SEQ ID NO: 98835

SEQ ID NO: 600327 - RNA, 64 nt, Homo Sapiens; identical to SEQ ID NO: 98836

SEQ ID NO: 600328 - RNA, 64 nt, Homo Sapiens; identical to SEQ ID NO: 98837

SEQ ID NO: 600329 - RNA, 64 nt, Homo Sapiens; identical to SEQ ID NO: 98838

SEQ ID NO: 600330 - RNA, 64 nt, Homo Sapiens; identical to SEQ ID NO: 98839

SEQ ID NO: 600331 - RNA, 64 nt, Homo Sapiens; identical to SEQ ID NO: 98840

SEQ ID NO: 600332 - RNA, 64 nt, Homo Sapiens; identical to SEQ ID NO: 98841

SEQ ID NO: 600333 - RNA, 64 nt, Homo Sapiens; identical to SEQ ID NO: 98842

SEQ ID NO: 600334 - RNA, 64 nt, Homo Sapiens; identical to SEQ ID NO: 98843

SEQ ID NO: 600335 - RNA, 64 nt, Homo Sapiens; identical to SEQ ID NO: 98844

SEQ ID NO: 600336 - RNA, 64 nt, Homo Sapiens; identical to SEQ ID NO: 98845

SEQ ID NO: 600337 - RNA, 64 nt, Homo Sapiens; identical to SEQ ID NO: 98846

SEQ ID NO: 600338 - RNA, 64 nt, Homo Sapiens; identical to SEQ ID NO: 98847

SEQ ID NO: 600339 - RNA, 64 nt, Homo Sapiens; identical to SEQ ID NO: 98848

SEQ ID NO: 600340 - RNA, 64 nt, Homo Sapiens; identical to SEQ ID NO: 98849

SEQ ID NO: 600341 - RNA, 64 nt, Homo Sapiens; identical to SEQ ID NO: 98850

SEQ ID NO: 600342 - RNA, 64 nt, Homo Sapiens; identical to SEQ ID NO: 98851

SEQ ID NO: 600343 - RNA, 64 nt, Homo Sapiens; identical to SEQ ID NO: 98852

SEQ ID NO: 600344 - RNA, 64 nt, Homo Sapiens; identical to SEQ ID NO: 98853

SEQ ID NO: 600345 - RNA, 64 nt, Homo Sapiens; identical to SEQ ID NO: 98854

SEQ ID NO: 600346 - RNA, 64 nt, Homo Sapiens; identical to SEQ ID NO: 98855

SEQ ID NO: 600347 - RNA, 64 nt, Homo Sapiens; identical to SEQ ID NO: 98856

SEQ ID NO: 600348 - RNA, 64 nt, Homo Sapiens; identical to SEQ ID NO: 98857

SEQ ID NO: 600349 - RNA, 64 nt, Homo Sapiens; identical to SEQ ID NO: 98858

SEQ ID NO: 600350 - RNA, 64 nt, Homo Sapiens; identical to SEQ ID NO: 98859

SEQ ID NO: 600351 - RNA, 64 nt, Homo Sapiens; identical to SEQ ID NO: 98860

SEQ ID NO: 600352 - RNA, 64 nt, Homo Sapiens; identical to SEQ ID NO: 98861

SEQ ID NO: 600353 - RNA, 64 nt, Homo Sapiens; identical to SEQ ID NO: 98862

SEQ ID NO: 600354 - RNA, 64 nt, Homo Sapiens; identical to SEQ ID NO: 98863

SEQ ID NO: 600355 - RNA, 64 nt, Homo Sapiens; identical to SEQ ID NO: 98864

SEQ ID NO: 600356 - RNA, 64 nt, Homo Sapiens; identical to SEQ ID NO: 98865

SEQ ID NO: 600357 - RNA, 64 nt, Homo Sapiens; identical to SEQ ID NO: 98866

SEQ ID NO: 600358 - RNA, 64 nt, Homo Sapiens; identical to SEQ ID NO: 98867

SEQ ID NO: 600359 - RNA, 64 nt, Homo Sapiens; identical to SEQ ID NO: 98868

SEQ ID NO: 600360 - RNA, 64 nt, Homo Sapiens; identical to SEQ ID NO: 98869

SEQ ID NO: 600361 - RNA, 64 nt, Homo Sapiens; identical to SEQ ID NO: 98870

SEQ ID NO: 600362 - RNA, 64 nt, Homo Sapiens; identical to SEQ ID NO: 98871

SEQ ID NO: 600363 - RNA, 64 nt, Homo Sapiens; identical to SEQ ID NO: 98872

SEQ ID NO: 600364 - RNA, 64 nt, Homo Sapiens; identical to SEQ ID NO: 98873

SEQ ID NO: 600365 - RNA, 64 nt, Homo Sapiens; identical to SEQ ID NO: 98874

SEQ ID NO: 600366 - RNA, 64 nt, Homo Sapiens; identical to SEQ ID NO: 98875

SEQ ID NO: 600367 - RNA, 64 nt, Homo Sapiens; identical to SEQ ID NO: 98876

SEQ ID NO: 600368 - RNA, 64 nt, Homo Sapiens; identical to SEQ ID NO: 98877

SEQ ID NO: 600369 - RNA, 64 nt, Homo Sapiens; identical to SEQ ID NO: 98878

SEQ ID NO: 600370 - RNA, 64 nt, Homo Sapiens; identical to SEQ ID NO: 98879

SEQ ID NO: 600371 - RNA, 64 nt, Homo Sapiens; identical to SEQ ID NO: 98880

SEQ ID NO: 600372 - RNA, 64 nt, Homo Sapiens; identical to SEQ ID NO: 98881

SEQ ID NO: 600373 - RNA, 64 nt, Homo Sapiens; identical to SEQ ID NO: 98882

SEQ ID NO: 600374 - RNA, 64 nt, Homo Sapiens; identical to SEQ ID NO: 98883

SEQ ID NO: 600375 - RNA, 64 nt, Homo Sapiens; identical to SEQ ID NO: 98884

SEQ ID NO: 600376 - RNA, 64 nt, Homo Sapiens; identical to SEQ ID NO: 98885

SEQ ID NO: 600377 - RNA, 64 nt, Homo Sapiens; identical to SEQ ID NO: 98886

SEQ ID NO: 600378 - RNA, 64 nt, Homo Sapiens; identical to SEQ ID NO: 98887

SEQ ID NO: 600379 - RNA, 64 nt, Homo Sapiens; identical to SEQ ID NO: 98888

SEQ ID NO: 600380 - RNA, 64 nt, Homo Sapiens; identical to SEQ ID NO: 98889

SEQ ID NO: 600381 - RNA, 64 nt, Homo Sapiens; identical to SEQ ID NO: 98890

SEQ ID NO: 600382 - RNA, 64 nt, Homo Sapiens; identical to SEQ ID NO: 98891

SEQ ID NO: 600383 - RNA, 64 nt, Homo Sapiens; identical to SEQ ID NO: 98892

SEQ ID NO: 600384 - RNA, 64 nt, Homo Sapiens; identical to SEQ ID NO: 98893

SEQ ID NO: 600385 - RNA, 64 nt, Homo Sapiens; identical to SEQ ID NO: 98894

SEQ ID NO: 600386 - RNA, 64 nt, Homo Sapiens; identical to SEQ ID NO: 98895

SEQ ID NO: 600387 - RNA, 64 nt, Homo Sapiens; identical to SEQ ID NO: 98896

SEQ ID NO: 600388 - RNA, 64 nt, Homo Sapiens; identical to SEQ ID NO: 98897

SEQ ID NO: 600389 - RNA, 64 nt, Homo Sapiens; identical to SEQ ID NO: 98898

SEQ ID NO: 600390 - RNA, 64 nt, Homo Sapiens; identical to SEQ ID NO: 98899

SEQ ID NO: 600391 - RNA, 64 nt, Homo Sapiens; identical to SEQ ID NO: 98900

SEQ ID NO: 600392 - RNA, 64 nt, Homo Sapiens; identical to SEQ ID NO: 98901

SEQ ID NO: 600393 - RNA, 64 nt, Homo Sapiens; identical to SEQ ID NO: 98902

SEQ ID NO: 600394 - RNA, 64 nt, Homo Sapiens; identical to SEQ ID NO: 98903

SEQ ID NO: 600395 - RNA, 64 nt, Homo Sapiens; identical to SEQ ID NO: 98904

SEQ ID NO: 600396 - RNA, 64 nt, Homo Sapiens; identical to SEQ ID NO: 98905

SEQ ID NO: 600397 - RNA, 64 nt, Homo Sapiens; identical to SEQ ID NO: 98906

SEQ ID NO: 600398 - RNA, 64 nt, Homo Sapiens; identical to SEQ ID NO: 98907

SEQ ID NO: 600399 - RNA, 64 nt, Homo Sapiens; identical to SEQ ID NO: 98908

SEQ ID NO: 600400 - RNA, 64 nt, Homo Sapiens; identical to SEQ ID NO: 98909

SEQ ID NO: 600401 - RNA, 64 nt, Homo Sapiens; identical to SEQ ID NO: 98910

SEQ ID NO: 600402 - RNA, 64 nt, Homo Sapiens; identical to SEQ ID NO: 98911

SEQ ID NO: 600403 - RNA, 64 nt, Homo Sapiens; identical to SEQ ID NO: 98912

SEQ ID NO: 600404 - RNA, 64 nt, Homo Sapiens; identical to SEQ ID NO: 562343

SEQ ID NO: 600405 - RNA, 64 nt, Homo Sapiens; identical to SEQ ID NO: 562344

SEQ ID NO: 600406 - RNA, 64 nt, Homo Sapiens; identical to SEQ ID NO: 562345

SEQ ID NO: 600407 - RNA, 64 nt, Homo Sapiens; identical to SEQ ID NO: 562346

SEQ ID NO: 600408 - RNA, 64 nt, Homo Sapiens; identical to SEQ ID NO: 562347

SEQ ID NO: 600409 - RNA, 64 nt, Homo Sapiens; identical to SEQ ID NO: 562348

SEQ ID NO: 600410 - RNA, 64 nt, Homo Sapiens; identical to SEQ ID NO: 562348

SEQ ID NO: 600411 - RNA, 64 nt, Homo Sapiens; identical to SEQ ID NO: 562350

SEQ ID NO: 600412 - RNA, 64 nt, Homo Sapiens; identical to SEQ ID NO: 562351

SEQ ID NO: 600413 - RNA, 64 nt, Homo Sapiens; identical to SEQ ID NO: 137985

SEQ ID NO: 600414 - RNA, 64 nt, Homo Sapiens; identical to SEQ ID NO: 137986

SEQ ID NO: 600415 - RNA, 64 nt, Homo Sapiens; identical to SEQ ID NO: 137987

SEQ ID NO: 600416 - RNA, 64 nt, Homo Sapiens; identical to SEQ ID NO: 137988

SEQ ID NO: 600417 - RNA, 64 nt, Homo Sapiens; identical to SEQ ID NO: 137989

SEQ ID NO: 600418 - RNA, 64 nt, Homo Sapiens; identical to SEQ ID NO: 137990

SEQ ID NO: 600419 - RNA, 64 nt, Homo Sapiens; identical to SEQ ID NO: 137991

SEQ ID NO: 600420 - RNA, 64 nt, Homo Sapiens; identical to SEQ ID NO: 137992

SEQ ID NO: 600421 - RNA, 64 nt, Homo Sapiens; identical to SEQ ID NO: 137993

SEQ ID NO: 600422 - RNA, 64 nt, Homo Sapiens; identical to SEQ ID NO: 137994

SEQ ID NO: 600423 - RNA, 64 nt, Homo Sapiens; identical to SEQ ID NO: 137995

SEQ ID NO: 600424 - RNA, 64 nt, Homo Sapiens; identical to SEQ ID NO: 137996

SEQ ID NO: 600425 - RNA, 64 nt, Homo Sapiens; identical to SEQ ID NO: 137997

SEQ ID NO: 600426 - RNA, 64 nt, Homo Sapiens; identical to SEQ ID NO: 137998

SEQ ID NO: 600427 - RNA, 64 nt, Homo Sapiens; identical to SEQ ID NO: 137999

SEQ ID NO: 600428 - RNA, 64 nt, Homo Sapiens; identical to SEQ ID NO: 138000

SEQ ID NO: 600429 - RNA, 64 nt, Homo Sapiens; identical to SEQ ID NO: 138001

SEQ ID NO: 600430 - RNA, 64 nt, Homo Sapiens; identical to SEQ ID NO: 138002

SEQ ID NO: 600431 - RNA, 64 nt, Homo Sapiens; identical to SEQ ID NO: 138003

SEQ ID NO: 600432 - RNA, 64 nt, Homo Sapiens; identical to SEQ ID NO: 138004

SEQ ID NO: 600433 - RNA, 64 nt, Homo Sapiens; identical to SEQ ID NO: 138005

SEQ ID NO: 600434 - RNA, 64 nt, Homo Sapiens; identical to SEQ ID NO: 138006

SEQ ID NO: 600435 - RNA, 64 nt, Homo Sapiens; identical to SEQ ID NO: 138007

SEQ ID NO: 600436 - RNA, 64 nt, Homo Sapiens; identical to SEQ ID NO: 138008

SEQ ID NO: 600437 - RNA, 64 nt, Homo Sapiens; identical to SEQ ID NO: 138009

SEQ ID NO: 600438 - RNA, 64 nt, Homo Sapiens; identical to SEQ ID NO: 138010

SEQ ID NO: 600439 - RNA, 64 nt, Homo Sapiens; identical to SEQ ID NO: 426993

SEQ ID NO: 600440 - RNA, 64 nt, Homo Sapiens; identical to SEQ ID NO: 426994

SEQ ID NO: 600441 - RNA, 64 nt, Homo Sapiens; identical to SEQ ID NO: 426995

SEQ ID NO: 600442 - RNA, 64 nt, Homo Sapiens; identical to SEQ ID NO: 426996

SEQ ID NO: 600443 - RNA, 64 nt, Homo Sapiens; identical to SEQ ID NO: 426997

SEQ ID NO: 600444 - RNA, 64 nt, Homo Sapiens; identical to SEQ ID NO: 426998

SEQ ID NO: 600445 - RNA, 64 nt, Homo Sapiens; identical to SEQ ID NO: 463735

SEQ ID NO: 600446 - RNA, 64 nt, Homo Sapiens; identical to SEQ ID NO: 463736

SEQ ID NO: 600447 - RNA, 64 nt, Homo Sapiens; identical to SEQ ID NO: 463737

SEQ ID NO: 600448 - RNA, 64 nt, Homo Sapiens; identical to SEQ ID NO: 463738

SEQ ID NO: 600449 - RNA, 64 nt, Homo Sapiens; identical to SEQ ID NO: 463739

SEQ ID NO: 600450 - RNA, 64 nt, Homo Sapiens; identical to SEQ ID NO: 463740

SEQ ID NO: 600451 - RNA, 64 nt, Homo Sapiens
uggccugcaaaccuucaacucccaucuuuccccaagaagucagagaugcuguuacuugaaugau

SEQ ID NO: 600452 - RNA, 64 nt, Homo Sapiens
accugugguuuuaacaaaccaauacacauauugaagaagucauuuuaauucagugaaacgaaga

SEQ ID NO: 600453 - RNA, 64 nt, Homo Sapiens
ucccccucuucaagcuaggaacuggcaaugcuguagaagucagccguaggaauucaaaauggcu

SEQ ID NO: 600454 - RNA, 64 nt, Homo Sapiens
uguucaacauuuacuucuauuugauaucugcucaagaagucauagaagucuugggaaacuauuc

SEQ ID NO: 600455 - RNA, 64 nt, Homo Sapiens
gacgguagcgucauaugagaguggucuccuaguaagaagucaccaaaccuugauucagugcuca

SEQ ID NO: 600456 - RNA, 64 nt, Homo Sapiens
guuccuugucucacuauuugugcuuaaagggacuagaagucaaaugugucuagcaguuacgucc

SEQ ID NO: 600457 - RNA, 64 nt, Homo Sapiens
aaaaaugaaccguaguuuuuguuuuuuuaaauacagaagucauguuguuucugcacuuuauaau

SEQ ID NO: 600458 - RNA, 64 nt, Homo Sapiens
ccuaagccaaaggaaggaaagccaugaagaaugcagaagucaaacccucaugacaaaguaggca

SEQ ID NO: 600459 - RNA, 64 nt, Homo Sapiens
agccccagggaggucaauaaugucuuuuaaagccagaagucacauuuuaccaauaugcauuuau

SEQ ID NO: 600460 - RNA, 64 nt, Homo Sapiens
ucugggaaucccagaaugucaagccaaaggucuaagaagucaucuccuucaaauacuuuaauaa

SEQ ID NO: 600461 - RNA, 64 nt, Homo Sapiens
caggagaaaaauccuguaaguuguuuugcaacauagaagucacaaccuuucagaagucauacuu

SEQ ID NO: 600462 - RNA, 64 nt, Homo Sapiens
cuuuuguuuugcaacauagagaaggaaaccuuucagaagucauaucaugcaaauuguaaaacag

SEQ ID NO: 600463 - RNA, 64 nt, Homo Sapiens
caaauuguaaaacaggaaggauaauauagauggcagaagucauguaggcuuuucuaaauauuag

SEQ ID NO: 600464 - RNA, 64 nt, Homo Sapiens
ucaaacucuuaguuuuuuuuuucuucauguuaaaagaagucaucggacaucacuuacuauccau

SEQ ID NO: 600465 - RNA, 64 nt, Homo Sapiens
gacaaaguguguaauuauguuaaaaagaagaaaaagaagucaaagaaaagaugagcaaagaugg

SEQ ID NO: 600466 - RNA, 64 nt, Homo Sapiens
cccacugggaguuaggaaguauaaguaagccaagagaagucagccccugcccagaagaucugaa

SEQ ID NO: 600467 - RNA, 64 nt, Homo Sapiens
cagaagaucugaaacuaauaguaggaguuuccccagaagucauuuucagccuuaauucucauca

SEQ ID NO: 600468 - RNA, 64 nt, Homo Sapiens
uuguagagguccuggcggcuauguuacuagcagcagaagucagaagccagauucugcauuugcg

SEQ ID NO: 600469 - RNA, 64 nt, Homo Sapiens
gaaaauggagaaaacuucucgaaaaauuacaggcagaagucacauguagauaaugaaacuccca

SEQ ID NO: 600470 - RNA, 64 nt, Homo Sapiens
cuucucucgaaucucaucccucacucuucaugugagaagucacacaggggagaaacccuaugaa

SEQ ID NO: 600471 - RNA, 64 nt, Homo Sapiens
cuuuucucagugcucauuacuuauuauacauaugagaagucauacuggugagaaacccuuugaa

SEQ ID NO: 600472 - RNA, 64 nt, Homo Sapiens
uucagacuugauaagaucucagaguccacaggaaagaagucacuguugcaauaaaagcacccgu

SEQ ID NO: 600473 - RNA, 64 nt, Homo Sapiens
ccuucugcuguguuaauucuggucaguuucacacagaagucacgagggccucugcccaggaccu

SEQ ID NO: 600474 - RNA, 64 nt, Homo Sapiens
ugugguccaggaaagugagccucaugguuuucagagaagucauuguucuguuuacauuuucaua

SEQ ID NO: 600475 - RNA, 64 nt, Homo Sapiens
cucaagguacaaaugagagauuugcuauaccgugagaagucaacaacuuagccaccacuucccc

SEQ ID NO: 600476 - RNA, 64 nt, Homo Sapiens; identical to SEQ ID NO: 75353

SEQ ID NO: 600477 - RNA, 64 nt, Homo Sapiens; identical to SEQ ID NO: 75354

SEQ ID NO: 600478 - RNA, 64 nt, Homo Sapiens; identical to SEQ ID NO: 75355

SEQ ID NO: 600479 - RNA, 64 nt, Homo Sapiens; identical to SEQ ID NO: 75356

SEQ ID NO: 600480 - RNA, 64 nt, Homo Sapiens; identical to SEQ ID NO: 75357

SEQ ID NO: 600481 - RNA, 64 nt, Homo Sapiens; identical to SEQ ID NO: 75358

SEQ ID NO: 600482 - RNA, 64 nt, Homo Sapiens; identical to SEQ ID NO: 75359

SEQ ID NO: 600483 - RNA, 64 nt, Homo Sapiens; identical to SEQ ID NO: 75360

SEQ ID NO: 600484 - RNA, 64 nt, Homo Sapiens; identical to SEQ ID NO: 75361

SEQ ID NO: 600485 - RNA, 64 nt, Homo Sapiens; identical to SEQ ID NO: 75362

SEQ ID NO: 600486 - RNA, 64 nt, Homo Sapiens; identical to SEQ ID NO: 426082

SEQ ID NO: 600487 - RNA, 64 nt, Homo Sapiens; identical to SEQ ID NO: 426083

SEQ ID NO: 600488 - RNA, 64 nt, Homo Sapiens; identical to SEQ ID NO: 426084

SEQ ID NO: 600489 - RNA, 64 nt, Homo Sapiens; identical to SEQ ID NO: 426085

SEQ ID NO: 600490 - RNA, 64 nt, Homo Sapiens; identical to SEQ ID NO: 426086

SEQ ID NO: 600491 - RNA, 64 nt, Homo Sapiens; identical to SEQ ID NO: 426087

SEQ ID NO: 600492 - RNA, 64 nt, Homo Sapiens; identical to SEQ ID NO: 426088

SEQ ID NO: 600493 - RNA, 64 nt, Homo Sapiens; identical to SEQ ID NO: 426089

SEQ ID NO: 600494 - RNA, 64 nt, Homo Sapiens; identical to SEQ ID NO: 426090

SEQ ID NO: 600495 - RNA, 64 nt, Homo Sapiens; identical to SEQ ID NO: 426091

SEQ ID NO: 600496 - RNA, 64 nt, Homo Sapiens; identical to SEQ ID NO: 426092

SEQ ID NO: 600497 - RNA, 64 nt, Homo Sapiens; identical to SEQ ID NO: 426093

SEQ ID NO: 600498 - RNA, 64 nt, Homo Sapiens; identical to SEQ ID NO: 426094

SEQ ID NO: 600499 - RNA, 64 nt, Homo Sapiens; identical to SEQ ID NO: 426095

SEQ ID NO: 600500 - RNA, 64 nt, Homo Sapiens; identical to SEQ ID NO: 426096

SEQ ID NO: 600501 - RNA, 64 nt, Homo Sapiens; identical to SEQ ID NO: 426097

SEQ ID NO: 600502 - RNA, 64 nt, Homo Sapiens; identical to SEQ ID NO: 426098

SEQ ID NO: 600503 - RNA, 64 nt, Homo Sapiens; identical to SEQ ID NO: 426099

SEQ ID NO: 600504 - RNA, 59 nt, Homo Sapiens; identical to SEQ ID NO: 426100

SEQ ID NO: 600505 - RNA, 64 nt, Homo Sapiens; identical to SEQ ID NO: 426101

SEQ ID NO: 600506 - RNA, 64 nt, Homo Sapiens; identical to SEQ ID NO: 426102

SEQ ID NO: 600507 - RNA, 64 nt, Homo Sapiens; identical to SEQ ID NO: 426103

SEQ ID NO: 600508 - RNA, 64 nt, Homo Sapiens; identical to SEQ ID NO: 426104

SEQ ID NO: 600509 - RNA, 64 nt, Homo Sapiens; identical to SEQ ID NO: 426105

SEQ ID NO: 600510 - RNA, 64 nt, Homo Sapiens; identical to SEQ ID NO: 426106

SEQ ID NO: 600511 - RNA, 64 nt, Homo Sapiens; identical to SEQ ID NO: 426107

SEQ ID NO: 600512 - RNA, 64 nt, Homo Sapiens; identical to SEQ ID NO: 426108

SEQ ID NO: 600513 - RNA, 64 nt, Homo Sapiens; identical to SEQ ID NO: 426109

SEQ ID NO: 600514 - RNA, 64 nt, Homo Sapiens; identical to SEQ ID NO: 426110

SEQ ID NO: 600515 - RNA, 64 nt, Homo Sapiens; identical to SEQ ID NO: 426111

SEQ ID NO: 600516 - RNA, 64 nt, Homo Sapiens; identical to SEQ ID NO: 426112

SEQ ID NO: 600517 - RNA, 64 nt, Homo Sapiens; identical to SEQ ID NO: 426113

SEQ ID NO: 600518 - RNA, 64 nt, Homo Sapiens; identical to SEQ ID NO: 426114

SEQ ID NO: 600519 - RNA, 64 nt, Homo Sapiens; identical to SEQ ID NO: 426115

SEQ ID NO: 600520 - RNA, 64 nt, Homo Sapiens; identical to SEQ ID NO: 426116

SEQ ID NO: 600521 - RNA, 64 nt, Homo Sapiens; identical to SEQ ID NO: 426117

SEQ ID NO: 600522 - RNA, 64 nt, Homo Sapiens; identical to SEQ ID NO: 426118

SEQ ID NO: 600523 - RNA, 64 nt, Homo Sapiens; identical to SEQ ID NO: 426119

SEQ ID NO: 600524 - RNA, 64 nt, Homo Sapiens; identical to SEQ ID NO: 426120

SEQ ID NO: 600525 - RNA, 64 nt, Homo Sapiens; identical to SEQ ID NO: 426121

SEQ ID NO: 600526 - RNA, 64 nt, Homo Sapiens; identical to SEQ ID NO: 426122

SEQ ID NO: 600527 - RNA, 64 nt, Homo Sapiens; identical to SEQ ID NO: 426123

SEQ ID NO: 600528 - RNA, 64 nt, Homo Sapiens; identical to SEQ ID NO: 426124

SEQ ID NO: 600529 - RNA, 64 nt, Homo Sapiens; identical to SEQ ID NO: 332827

SEQ ID NO: 600530 - RNA, 64 nt, Homo Sapiens; identical to SEQ ID NO: 332828

SEQ ID NO: 600531 - RNA, 64 nt, Homo Sapiens; identical to SEQ ID NO: 332829

SEQ ID NO: 600532 - RNA, 64 nt, Homo Sapiens; identical to SEQ ID NO: 332830

SEQ ID NO: 600533 - RNA, 64 nt, Homo Sapiens; identical to SEQ ID NO: 332831

SEQ ID NO: 600534 - RNA, 64 nt, Homo Sapiens; identical to SEQ ID NO: 332832

SEQ ID NO: 600535 - RNA, 64 nt, Homo Sapiens
ugagcccaggaguucaaagcggaagcugagacaagaggaucaauccuauagucccagcuacuca

SEQ ID NO: 600536 - RNA, 64 nt, Homo Sapiens
ugaggccaggaguuugagacggaggcugaagcaggaggaucacuacuguaaucccaguuauagg

SEQ ID NO: 600537 - RNA, 64 nt, Homo Sapiens
ugagcccaggaauuugaagcggaggcugaggugggaggaucacuugcauagucccagcuaccca

SEQ ID NO: 600538 - RNA, 64 nt, Homo Sapiens
ugaggccaggaguuuaagacagaggcugaggugagaggaucagugcuguaauaacaacaccuuc

SEQ ID NO: 600539 - RNA, 64 nt, Homo Sapiens
gccuauagucccacuacuuguggggcuaaggcaggaggaucacuugagccccggaggucgaggc

SEQ ID NO: 600540 - RNA, 64 nt, Homo Sapiens
ccuguaauccuugcauuuuggaaggcugaggcaggaggaucacuuuaggccugguguguucaag

SEQ ID NO: 600541 - RNA, 64 nt, Homo Sapiens
ugguguuuccccccucuuucugguuuuacaucaugaggaucaguuagcugcugacaagaaaagu

SEQ ID NO: 600542 - RNA, 64 nt, Homo Sapiens
aggcaaauucacaaauacggaauccaugaauaacgaggaucaacuguacuuaacuauauuuuaa

SEQ ID NO: 600543 - RNA, 64 nt, Homo Sapiens
ccuauaaucccaauauuuugggaggccgaggagagaggaucacuuaagcccaggagucugagac

SEQ ID NO: 600544 - RNA, 64 nt, Homo Sapiens
ccuguagucccagcuacaugggaggcugaggugggaggaucacuugagcccaggaaguccagaa

SEQ ID NO: 600545 - RNA, 64 nt, Homo Sapiens
gugaccuauaaugagccguuggaggcugaggcaggaggaucacaugugcagucccagcuacuca

SEQ ID NO: 600546 - RNA, 63 nt, Homo Sapiens
uggagccaggaguuugagacgaggccaaggcaggaggaucacucuguaaucccagcauuuuag

SEQ ID NO: 600547 - RNA, 64 nt, Homo Sapiens
ggaaccugggagguugccaccggggcugaggcaggaggaucacucaccuguagucccggccacu

SEQ ID NO: 600548 - RNA, 64 nt, Homo Sapiens
ugaguccagaaauucaagacggaggccaaggcaggaggaucacuccuauaaucccaggacuuug

SEQ ID NO: 600549 - RNA, 64 nt, Homo Sapiens
cuuugaugcauggcuauaaucccagccgaggugggaggaucacuugaguccagguucaagacua

SEQ ID NO: 600550 - RNA, 64 nt, Homo Sapiens
ccugcagucccagcuacuugggaggcugaguugggaggaucacuugagccugggagguugaggc

SEQ ID NO: 600551 - RNA, 64 nt, Homo Sapiens
cuguagucuuugggucuuugggaggccagggugggaggaucacuugagcucaggaguuugagac

SEQ ID NO: 600552 - RNA, 64 nt, Homo Sapiens
uagucccagcuacucgggaggcugagugaggcaggaggaucacuugagaccaggagguuguggc

SEQ ID NO: 600553 - RNA, 64 nt, Homo Sapiens
cuugcaaucccagugcuuugggagacugaggcaggaggaucacuuaaggccaggaguucgagac

SEQ ID NO: 600554 - RNA, 64 nt, Homo Sapiens
ccuguaauccgagugcuuugggaggcugaggcaggaggaucacucgagcucaagaauucaagac

SEQ ID NO: 600555 - RNA, 64 nt, Homo Sapiens
ugugcccagguugaggcuauggaggcugaagugggaggaucauuccuguaguccaagcuacuug

SEQ ID NO: 600556 - RNA, 64 nt, Homo Sapiens
ugagccccagaguucaagacggaggccaaggugggaggaucaguccuguaaucccugcacuuug

SEQ ID NO: 600557 - RNA, 64 nt, Homo Sapiens
ugagccugaguucaacacugggaggcugaagcaggaggaucacuccuguaggccuagcugcuca

SEQ ID NO: 600558 - RNA, 64 nt, Homo Sapiens
agaggccagcagguccacacggaagccgggguaggaggaucaccccuauaaucccagcacuuug

SEQ ID NO: 600559 - RNA, 64 nt, Homo Sapiens
acagagacacacacacauacuacuuuaagggggugaggaucauuaauucagauaauuuuuaagu

SEQ ID NO: 600560 - RNA, 64 nt, Homo Sapiens
acauauguauauacacauaucauuuuaagaagcugaggaucacuaauucagauaauguauaagu

SEQ ID NO: 600561 - RNA, 64 nt, Homo Sapiens; identical to SEQ ID NO: 286385

SEQ ID NO: 600562 - RNA, 64 nt, Homo Sapiens; identical to SEQ ID NO: 286386

SEQ ID NO: 600563 - RNA, 64 nt, Homo Sapiens; identical to SEQ ID NO: 286387

SEQ ID NO: 600564 - RNA, 63 nt, Homo Sapiens; identical to SEQ ID NO: 286388

SEQ ID NO: 600565 - RNA, 64 nt, Homo Sapiens; identical to SEQ ID NO: 286389

SEQ ID NO: 600566 - RNA, 64 nt, Homo Sapiens; identical to SEQ ID NO: 286390

SEQ ID NO: 600567 - RNA, 64 nt, Homo Sapiens; identical to SEQ ID NO: 286391

SEQ ID NO: 600568 - RNA, 64 nt, Homo Sapiens; identical to SEQ ID NO: 286392

SEQ ID NO: 600569 - RNA, 64 nt, Homo Sapiens; identical to SEQ ID NO: 286393

SEQ ID NO: 600570 - RNA, 64 nt, Homo Sapiens; identical to SEQ ID NO: 286394

SEQ ID NO: 600571 - RNA, 64 nt, Homo Sapiens; identical to SEQ ID NO: 286395

SEQ ID NO: 600572 - RNA, 64 nt, Homo Sapiens; identical to SEQ ID NO: 286396

SEQ ID NO: 600573 - RNA, 64 nt, Homo Sapiens; identical to SEQ ID NO: 286397

SEQ ID NO: 600574 - RNA, 64 nt, Homo Sapiens; identical to SEQ ID NO: 286398

SEQ ID NO: 600575 - RNA, 64 nt, Homo Sapiens; identical to SEQ ID NO: 286399

SEQ ID NO: 600576 - RNA, 64 nt, Homo Sapiens; identical to SEQ ID NO: 286400

SEQ ID NO: 600577 - RNA, 64 nt, Homo Sapiens; identical to SEQ ID NO: 286401

SEQ ID NO: 600578 - RNA, 64 nt, Homo Sapiens; identical to SEQ ID NO: 286402

SEQ ID NO: 600579 - RNA, 64 nt, Homo Sapiens; identical to SEQ ID NO: 286403

SEQ ID NO: 600580 - RNA, 64 nt, Homo Sapiens; identical to SEQ ID NO: 286404

SEQ ID NO: 600581 - RNA, 64 nt, Homo Sapiens; identical to SEQ ID NO: 286405

SEQ ID NO: 600582 - RNA, 64 nt, Homo Sapiens; identical to SEQ ID NO: 286406

SEQ ID NO: 600583 - RNA, 64 nt, Homo Sapiens; identical to SEQ ID NO: 286407

SEQ ID NO: 600584 - RNA, 64 nt, Homo Sapiens; identical to SEQ ID NO: 286408

SEQ ID NO: 600585 - RNA, 64 nt, Homo Sapiens; identical to SEQ ID NO: 286409

SEQ ID NO: 600586 - RNA, 64 nt, Homo Sapiens; identical to SEQ ID NO: 286410

SEQ ID NO: 600587 - RNA, 64 nt, Homo Sapiens; identical to SEQ ID NO: 286411

SEQ ID NO: 600588 - RNA, 64 nt, Homo Sapiens; identical to SEQ ID NO: 286412

SEQ ID NO: 600589 - RNA, 64 nt, Homo Sapiens; identical to SEQ ID NO: 286413

SEQ ID NO: 600590 - RNA, 64 nt, Homo Sapiens; identical to SEQ ID NO: 286414

SEQ ID NO: 600591 - RNA, 64 nt, Homo Sapiens; identical to SEQ ID NO: 286415

SEQ ID NO: 600592 - RNA, 64 nt, Homo Sapiens; identical to SEQ ID NO: 286416

SEQ ID NO: 600593 - RNA, 64 nt, Homo Sapiens; identical to SEQ ID NO: 286417

SEQ ID NO: 600594 - RNA, 64 nt, Homo Sapiens; identical to SEQ ID NO: 286418

SEQ ID NO: 600595 - RNA, 64 nt, Homo Sapiens; identical to SEQ ID NO: 286419

SEQ ID NO: 600596 - RNA, 64 nt, Homo Sapiens; identical to SEQ ID NO: 286420

SEQ ID NO: 600597 - RNA, 64 nt, Homo Sapiens; identical to SEQ ID NO: 286421

SEQ ID NO: 600598 - RNA, 64 nt, Homo Sapiens; identical to SEQ ID NO: 286422

SEQ ID NO: 600599 - RNA, 64 nt, Homo Sapiens; identical to SEQ ID NO: 286423

SEQ ID NO: 600600 - RNA, 64 nt, Homo Sapiens; identical to SEQ ID NO: 286424

SEQ ID NO: 600601 - RNA, 64 nt, Homo Sapiens; identical to SEQ ID NO: 286425

SEQ ID NO: 600602 - RNA, 64 nt, Homo Sapiens; identical to SEQ ID NO: 286426

SEQ ID NO: 600603 - RNA, 62 nt, Homo Sapiens; identical to SEQ ID NO: 286427

SEQ ID NO: 600604 - RNA, 64 nt, Homo Sapiens; identical to SEQ ID NO: 286428

SEQ ID NO: 600605 - RNA, 64 nt, Homo Sapiens; identical to SEQ ID NO: 286429

SEQ ID NO: 600606 - RNA, 64 nt, Homo Sapiens; identical to SEQ ID NO: 286430

SEQ ID NO: 600607 - RNA, 64 nt, Homo Sapiens; identical to SEQ ID NO: 286431

SEQ ID NO: 600608 - RNA, 64 nt, Homo Sapiens; identical to SEQ ID NO: 286432

SEQ ID NO: 600609 - RNA, 64 nt, Homo Sapiens; identical to SEQ ID NO: 286433

SEQ ID NO: 600610 - RNA, 64 nt, Homo Sapiens; identical to SEQ ID NO: 286434

SEQ ID NO: 600611 - RNA, 64 nt, Homo Sapiens; identical to SEQ ID NO: 286435

SEQ ID NO: 600612 - RNA, 64 nt, Homo Sapiens; identical to SEQ ID NO: 286436

SEQ ID NO: 600613 - RNA, 64 nt, Homo Sapiens; identical to SEQ ID NO: 286437

SEQ ID NO: 600614 - RNA, 64 nt, Homo Sapiens; identical to SEQ ID NO: 286438

SEQ ID NO: 600615 - RNA, 64 nt, Homo Sapiens; identical to SEQ ID NO: 286439

SEQ ID NO: 600616 - RNA, 51 nt, Homo Sapiens; identical to SEQ ID NO: 286440

SEQ ID NO: 600617 - RNA, 64 nt, Homo Sapiens; identical to SEQ ID NO: 286441

SEQ ID NO: 600618 - RNA, 64 nt, Homo Sapiens; identical to SEQ ID NO: 286442

SEQ ID NO: 600619 - RNA, 64 nt, Homo Sapiens; identical to SEQ ID NO: 286443

SEQ ID NO: 600620 - RNA, 64 nt, Homo Sapiens; identical to SEQ ID NO: 286444

SEQ ID NO: 600621 - RNA, 64 nt, Homo Sapiens; identical to SEQ ID NO: 286445

SEQ ID NO: 600622 - RNA, 64 nt, Homo Sapiens; identical to SEQ ID NO: 286446

SEQ ID NO: 600623 - RNA, 64 nt, Homo Sapiens; identical to SEQ ID NO: 286447

SEQ ID NO: 600624 - RNA, 64 nt, Homo Sapiens; identical to SEQ ID NO: 286448

SEQ ID NO: 600625 - RNA, 64 nt, Homo Sapiens; identical to SEQ ID NO: 286449

SEQ ID NO: 600626 - RNA, 64 nt, Homo Sapiens; identical to SEQ ID NO: 286450

SEQ ID NO: 600627 - RNA, 64 nt, Homo Sapiens; identical to SEQ ID NO: 286451

SEQ ID NO: 600628 - RNA, 64 nt, Homo Sapiens; identical to SEQ ID NO: 286452

SEQ ID NO: 600629 - RNA, 64 nt, Homo Sapiens; identical to SEQ ID NO: 286453

SEQ ID NO: 600630 - RNA, 64 nt, Homo Sapiens; identical to SEQ ID NO: 286454

SEQ ID NO: 600631 - RNA, 64 nt, Homo Sapiens; identical to SEQ ID NO: 286455

SEQ ID NO: 600632 - RNA, 64 nt, Homo Sapiens; identical to SEQ ID NO: 286456

SEQ ID NO: 600633 - RNA, 64 nt, Homo Sapiens; identical to SEQ ID NO: 286457

SEQ ID NO: 600634 - RNA, 64 nt, Homo Sapiens; identical to SEQ ID NO: 286458

SEQ ID NO: 600635 - RNA, 64 nt, Homo Sapiens; identical to SEQ ID NO: 286459

SEQ ID NO: 600636 - RNA, 64 nt, Homo Sapiens; identical to SEQ ID NO: 286460

SEQ ID NO: 600637 - RNA, 64 nt, Homo Sapiens; identical to SEQ ID NO: 286461

SEQ ID NO: 600638 - RNA, 64 nt, Homo Sapiens; identical to SEQ ID NO: 286462

SEQ ID NO: 600639 - RNA, 64 nt, Homo Sapiens; identical to SEQ ID NO: 286463

SEQ ID NO: 600640 - RNA, 64 nt, Homo Sapiens; identical to SEQ ID NO: 286464

SEQ ID NO: 600641 - RNA, 64 nt, Homo Sapiens; identical to SEQ ID NO: 286465

SEQ ID NO: 600642 - RNA, 64 nt, Homo Sapiens; identical to SEQ ID NO: 286466

SEQ ID NO: 600643 - RNA, 64 nt, Homo Sapiens; identical to SEQ ID NO: 286467

SEQ ID NO: 600644 - RNA, 64 nt, Homo Sapiens; identical to SEQ ID NO: 286468

SEQ ID NO: 600645 - RNA, 64 nt, Homo Sapiens; identical to SEQ ID NO: 286469

SEQ ID NO: 600646 - RNA, 64 nt, Homo Sapiens; identical to SEQ ID NO: 286470

SEQ ID NO: 600647 - RNA, 64 nt, Homo Sapiens; identical to SEQ ID NO: 286471

SEQ ID NO: 600648 - RNA, 64 nt, Homo Sapiens; identical to SEQ ID NO: 286472

SEQ ID NO: 600649 - RNA, 64 nt, Homo Sapiens; identical to SEQ ID NO: 286473

SEQ ID NO: 600650 - RNA, 64 nt, Homo Sapiens; identical to SEQ ID NO: 286474

SEQ ID NO: 600651 - RNA, 64 nt, Homo Sapiens; identical to SEQ ID NO: 286475

SEQ ID NO: 600652 - RNA, 64 nt, Homo Sapiens; identical to SEQ ID NO: 286476

SEQ ID NO: 600653 - RNA, 64 nt, Homo Sapiens; identical to SEQ ID NO: 286477

SEQ ID NO: 600654 - RNA, 64 nt, Homo Sapiens; identical to SEQ ID NO: 286478

SEQ ID NO: 600655 - RNA, 64 nt, Homo Sapiens; identical to SEQ ID NO: 286479

SEQ ID NO: 600656 - RNA, 64 nt, Homo Sapiens; identical to SEQ ID NO: 286480

SEQ ID NO: 600657 - RNA, 64 nt, Homo Sapiens; identical to SEQ ID NO: 286481

SEQ ID NO: 600658 - RNA, 64 nt, Homo Sapiens; identical to SEQ ID NO: 286482

SEQ ID NO: 600659 - RNA, 64 nt, Homo Sapiens; identical to SEQ ID NO: 286483

SEQ ID NO: 600660 - RNA, 64 nt, Homo Sapiens; identical to SEQ ID NO: 286484

SEQ ID NO: 600661 - RNA, 64 nt, Homo Sapiens; identical to SEQ ID NO: 286485

SEQ ID NO: 600662 - RNA, 64 nt, Homo Sapiens; identical to SEQ ID NO: 286486

SEQ ID NO: 600663 - RNA, 64 nt, Homo Sapiens; identical to SEQ ID NO: 286487

SEQ ID NO: 600664 - RNA, 64 nt, Homo Sapiens; identical to SEQ ID NO: 286488

SEQ ID NO: 600665 - RNA, 64 nt, Homo Sapiens; identical to SEQ ID NO: 286489

SEQ ID NO: 600666 - RNA, 64 nt, Homo Sapiens; identical to SEQ ID NO: 286490

SEQ ID NO: 600667 - RNA, 64 nt, Homo Sapiens; identical to SEQ ID NO: 286491

SEQ ID NO: 600668 - RNA, 64 nt, Homo Sapiens; identical to SEQ ID NO: 286492

SEQ ID NO: 600669 - RNA, 64 nt, Homo Sapiens; identical to SEQ ID NO: 286493

SEQ ID NO: 600670 - RNA, 64 nt, Homo Sapiens; identical to SEQ ID NO: 286494

SEQ ID NO: 600671 - RNA, 64 nt, Homo Sapiens; identical to SEQ ID NO: 286495

SEQ ID NO: 600672 - RNA, 64 nt, Homo Sapiens; identical to SEQ ID NO: 286496

SEQ ID NO: 600673 - RNA, 64 nt, Homo Sapiens; identical to SEQ ID NO: 286497

SEQ ID NO: 600674 - RNA, 64 nt, Homo Sapiens; identical to SEQ ID NO: 286498

SEQ ID NO: 600675 - RNA, 64 nt, Homo Sapiens; identical to SEQ ID NO: 286499

SEQ ID NO: 600676 - RNA, 64 nt, Homo Sapiens; identical to SEQ ID NO: 286500

SEQ ID NO: 600677 - RNA, 64 nt, Homo Sapiens; identical to SEQ ID NO: 286501

SEQ ID NO: 600678 - RNA, 64 nt, Homo Sapiens; identical to SEQ ID NO: 286502

SEQ ID NO: 600679 - RNA, 64 nt, Homo Sapiens; identical to SEQ ID NO: 286503

SEQ ID NO: 600680 - RNA, 64 nt, Homo Sapiens; identical to SEQ ID NO: 286504

SEQ ID NO: 600681 - RNA, 64 nt, Homo Sapiens; identical to SEQ ID NO: 286505

SEQ ID NO: 600682 - RNA, 64 nt, Homo Sapiens; identical to SEQ ID NO: 286506

SEQ ID NO: 600683 - RNA, 64 nt, Homo Sapiens; identical to SEQ ID NO: 286507

SEQ ID NO: 600684 - RNA, 64 nt, Homo Sapiens; identical to SEQ ID NO: 286508

SEQ ID NO: 600685 - RNA, 64 nt, Homo Sapiens; identical to SEQ ID NO: 286509

SEQ ID NO: 600686 - RNA, 64 nt, Homo Sapiens; identical to SEQ ID NO: 286510

SEQ ID NO: 600687 - RNA, 64 nt, Homo Sapiens; identical to SEQ ID NO: 286511

SEQ ID NO: 600688 - RNA, 64 nt, Homo Sapiens; identical to SEQ ID NO: 286512

SEQ ID NO: 600689 - RNA, 64 nt, Homo Sapiens; identical to SEQ ID NO: 286513

SEQ ID NO: 600690 - RNA, 64 nt, Homo Sapiens; identical to SEQ ID NO: 286514

SEQ ID NO: 600691 - RNA, 64 nt, Homo Sapiens; identical to SEQ ID NO: 286515

SEQ ID NO: 600692 - RNA, 64 nt, Homo Sapiens; identical to SEQ ID NO: 286516

SEQ ID NO: 600693 - RNA, 64 nt, Homo Sapiens; identical to SEQ ID NO: 286517

SEQ ID NO: 600694 - RNA, 64 nt, Homo Sapiens; identical to SEQ ID NO: 286518

SEQ ID NO: 600695 - RNA, 64 nt, Homo Sapiens; identical to SEQ ID NO: 286519

SEQ ID NO: 600696 - RNA, 64 nt, Homo Sapiens; identical to SEQ ID NO: 286520

SEQ ID NO: 600697 - RNA, 64 nt, Homo Sapiens; identical to SEQ ID NO: 286521

SEQ ID NO: 600698 - RNA, 64 nt, Homo Sapiens; identical to SEQ ID NO: 286522

SEQ ID NO: 600699 - RNA, 64 nt, Homo Sapiens; identical to SEQ ID NO: 286523

SEQ ID NO: 600700 - RNA, 64 nt, Homo Sapiens; identical to SEQ ID NO: 286524

SEQ ID NO: 600701 - RNA, 64 nt, Homo Sapiens; identical to SEQ ID NO: 286525

SEQ ID NO: 600702 - RNA, 64 nt, Homo Sapiens; identical to SEQ ID NO: 286526

SEQ ID NO: 600703 - RNA, 64 nt, Homo Sapiens; identical to SEQ ID NO: 286527

SEQ ID NO: 600704 - RNA, 64 nt, Homo Sapiens; identical to SEQ ID NO: 286528

SEQ ID NO: 600705 - RNA, 64 nt, Homo Sapiens; identical to SEQ ID NO: 286529

SEQ ID NO: 600706 - RNA, 64 nt, Homo Sapiens; identical to SEQ ID NO: 286530

SEQ ID NO: 600707 - RNA, 64 nt, Homo Sapiens; identical to SEQ ID NO: 286531

SEQ ID NO: 600708 - RNA, 64 nt, Homo Sapiens; identical to SEQ ID NO: 286532

SEQ ID NO: 600709 - RNA, 64 nt, Homo Sapiens; identical to SEQ ID NO: 286533

SEQ ID NO: 600710 - RNA, 64 nt, Homo Sapiens; identical to SEQ ID NO: 286534

SEQ ID NO: 600711 - RNA, 64 nt, Homo Sapiens; identical to SEQ ID NO: 286535

SEQ ID NO: 600712 - RNA, 64 nt, Homo Sapiens; identical to SEQ ID NO: 286536

SEQ ID NO: 600713 - RNA, 64 nt, Homo Sapiens; identical to SEQ ID NO: 286537

SEQ ID NO: 600714 - RNA, 64 nt, Homo Sapiens; identical to SEQ ID NO: 286538

SEQ ID NO: 600715 - RNA, 64 nt, Homo Sapiens; identical to SEQ ID NO: 286539

SEQ ID NO: 600716 - RNA, 64 nt, Homo Sapiens; identical to SEQ ID NO: 286540

SEQ ID NO: 600717 - RNA, 64 nt, Homo Sapiens; identical to SEQ ID NO: 286541

SEQ ID NO: 600718 - RNA, 64 nt, Homo Sapiens; identical to SEQ ID NO: 286542

SEQ ID NO: 600719 - RNA, 64 nt, Homo Sapiens; identical to SEQ ID NO: 286543

SEQ ID NO: 600720 - RNA, 63 nt, Homo Sapiens; identical to SEQ ID NO: 286544

SEQ ID NO: 600721 - RNA, 64 nt, Homo Sapiens; identical to SEQ ID NO: 286545

SEQ ID NO: 600722 - RNA, 64 nt, Homo Sapiens; identical to SEQ ID NO: 286546

SEQ ID NO: 600723 - RNA, 64 nt, Homo Sapiens; identical to SEQ ID NO: 286547

SEQ ID NO: 600724 - RNA, 64 nt, Homo Sapiens; identical to SEQ ID NO: 286548

SEQ ID NO: 600725 - RNA, 64 nt, Homo Sapiens; identical to SEQ ID NO: 286549

SEQ ID NO: 600726 - RNA, 64 nt, Homo Sapiens; identical to SEQ ID NO: 286550

SEQ ID NO: 600727 - RNA, 64 nt, Homo Sapiens; identical to SEQ ID NO: 286551

SEQ ID NO: 600728 - RNA, 64 nt, Homo Sapiens; identical to SEQ ID NO: 286552

SEQ ID NO: 600729 - RNA, 64 nt, Homo Sapiens; identical to SEQ ID NO: 286553

SEQ ID NO: 600730 - RNA, 64 nt, Homo Sapiens; identical to SEQ ID NO: 286554

SEQ ID NO: 600731 - RNA, 64 nt, Homo Sapiens; identical to SEQ ID NO: 286554

SEQ ID NO: 600732 - RNA, 64 nt, Homo Sapiens; identical to SEQ ID NO: 286556

SEQ ID NO: 600733 - RNA, 64 nt, Homo Sapiens; identical to SEQ ID NO: 286557

SEQ ID NO: 600734 - RNA, 64 nt, Homo Sapiens; identical to SEQ ID NO: 286558

SEQ ID NO: 600735 - RNA, 64 nt, Homo Sapiens; identical to SEQ ID NO: 286559

SEQ ID NO: 600736 - RNA, 64 nt, Homo Sapiens; identical to SEQ ID NO: 286560

SEQ ID NO: 600737 - RNA, 64 nt, Homo Sapiens; identical to SEQ ID NO: 286561

SEQ ID NO: 600738 - RNA, 64 nt, Homo Sapiens; identical to SEQ ID NO: 286562

SEQ ID NO: 600739 - RNA, 64 nt, Homo Sapiens; identical to SEQ ID NO: 286563

SEQ ID NO: 600740 - RNA, 64 nt, Homo Sapiens; identical to SEQ ID NO: 286564

SEQ ID NO: 600741 - RNA, 64 nt, Homo Sapiens; identical to SEQ ID NO: 286565

SEQ ID NO: 600742 - RNA, 64 nt, Homo Sapiens; identical to SEQ ID NO: 286566

SEQ ID NO: 600743 - RNA, 64 nt, Homo Sapiens; identical to SEQ ID NO: 286567

SEQ ID NO: 600744 - RNA, 64 nt, Homo Sapiens; identical to SEQ ID NO: 286568

SEQ ID NO: 600745 - RNA, 64 nt, Homo Sapiens; identical to SEQ ID NO: 286569

SEQ ID NO: 600746 - RNA, 64 nt, Homo Sapiens; identical to SEQ ID NO: 286570

SEQ ID NO: 600747 - RNA, 64 nt, Homo Sapiens; identical to SEQ ID NO: 286571

SEQ ID NO: 600748 - RNA, 64 nt, Homo Sapiens; identical to SEQ ID NO: 286572

SEQ ID NO: 600749 - RNA, 64 nt, Homo Sapiens; identical to SEQ ID NO: 286573

SEQ ID NO: 600750 - RNA, 64 nt, Homo Sapiens; identical to SEQ ID NO: 286574

SEQ ID NO: 600751 - RNA, 64 nt, Homo Sapiens; identical to SEQ ID NO: 286575

SEQ ID NO: 600752 - RNA, 64 nt, Homo Sapiens; identical to SEQ ID NO: 286576

SEQ ID NO: 600753 - RNA, 64 nt, Homo Sapiens; identical to SEQ ID NO: 286577

SEQ ID NO: 600754 - RNA, 64 nt, Homo Sapiens; identical to SEQ ID NO: 286578

SEQ ID NO: 600755 - RNA, 64 nt, Homo Sapiens; identical to SEQ ID NO: 286579

SEQ ID NO: 600756 - RNA, 64 nt, Homo Sapiens; identical to SEQ ID NO: 286580

SEQ ID NO: 600757 - RNA, 64 nt, Homo Sapiens; identical to SEQ ID NO: 286581

SEQ ID NO: 600758 - RNA, 64 nt, Homo Sapiens; identical to SEQ ID NO: 286582

SEQ ID NO: 600759 - RNA, 64 nt, Homo Sapiens; identical to SEQ ID NO: 286583

SEQ ID NO: 600760 - RNA, 64 nt, Homo Sapiens; identical to SEQ ID NO: 286584

SEQ ID NO: 600761 - RNA, 64 nt, Homo Sapiens; identical to SEQ ID NO: 286585

SEQ ID NO: 600762 - RNA, 64 nt, Homo Sapiens; identical to SEQ ID NO: 286586

SEQ ID NO: 600763 - RNA, 64 nt, Homo Sapiens; identical to SEQ ID NO: 286587

SEQ ID NO: 600764 - RNA, 64 nt, Homo Sapiens
guacacucucagauguggauggugacucugcuaguaauuuaaacuuggcauuucauggaggaug

SEQ ID NO: 600765 - RNA, 64 nt, Homo Sapiens
uuucuggagguucaacacuacguaccgcacuuuauaauuuaacuggaauugagaugaaggccag

SEQ ID NO: 600766 - RNA, 64 nt, Homo Sapiens
ccugaugauuggauuuaagcuauugaaaauuggauaauuuaaacuuaaugauuuuuauaauuuu

SEQ ID NO: 600767 - RNA, 64 nt, Homo Sapiens
uaaaagcugguucccaaaugcauagcuggcauuuuaauuuaaauucaaaucuacauagagaaca

SEQ ID NO: 600768 - RNA, 64 nt, Homo Sapiens
auuuguguguaauugccauuaaauuuucaaaauguaauuuaaaaggauuaaauacucauuuaau

SEQ ID NO: 600769 - RNA, 64 nt, Homo Sapiens
aaauguaauuuaaaaggauuaaauacucauuuaauaauuuaaaauaauuauuguauaauaucua

SEQ ID NO: 600770 - RNA, 64 nt, Homo Sapiens
ugaacuaaaauagaaagaaaauguugcugucauguaauuuaaacaauguaaauauuuuauggaa

SEQ ID NO: 600771 - RNA, 64 nt, Homo Sapiens
uguuuaugauuauuacuggauuugucauuuuugauaauuuaaauauugcugcugcuuuguagau

SEQ ID NO: 600772 - RNA, 64 nt, Homo Sapiens
caaauguuuuuauuaaauguuucauugacccaaguaauuuaaaaguaauauguuaccuaugucu

SEQ ID NO: 600773 - RNA, 64 nt, Homo Sapiens
gcugaucuguaaaugacuuuaaaagcuauuuuaguaauuuaaauaaauuuacuuucuugguuua

SEQ ID NO: 600774 - RNA, 64 nt, Homo Sapiens
guuuggagugauaauuuuuaguggaagcaauuuguaauuuaaguugguaguuauauuauauaua

SEQ ID NO: 600775 - RNA, 64 nt, Homo Sapiens
aacaagaauuaaaaaugaauaagcuaucaauauauaauuuaaguacaaguuuaggcugggcgug

SEQ ID NO: 600776 - RNA, 64 nt, Homo Sapiens
cuagcauuuaaauuuaaauuuuauuaaaauuaaauaauuuaaaucuagcauuuaaauuuaaaua

SEQ ID NO: 600777 - RNA, 64 nt, Homo Sapiens
auuaaauaauuuaaaucuagcauuuaaauuuaaauaauuuaagucuagcauuuacuuuuaaaua

SEQ ID NO: 600778 - RNA, 64 nt, Homo Sapiens
gaauuugauuuaaauguuuccuuuuuugacaacauaauuuaaauccacaccuggcaauucccug

SEQ ID NO: 600779 - RNA, 64 nt, Homo Sapiens
aaugggcuaagguccaagaauauucuacugaauauaauuuaagccacauauuaguuagugcuaa

SEQ ID NO: 600780 - RNA, 64 nt, Homo Sapiens
uauauaaaugcuagaaauauuauacccugacacauaauuuaaauuaauuuaaaugggaaagaac

SEQ ID NO: 600781 - RNA, 64 nt, Homo Sapiens
gggaaagaacuauacccugacuaaagauuccacauaauuuaaauacucuuaggcuuuuuuacua

SEQ ID NO: 600782 - RNA, 64 nt, Homo Sapiens
auuuguaaagugauguuccuuuuguuuauuuguuuaauuuaauggguugguucuuuggguucug

SEQ ID NO: 600783 - RNA, 64 nt, Homo Sapiens
aaagacuaaaaucaaccauuauauuuuaauuuuuuaauuuaagcuacaguauauauauguauau

SEQ ID NO: 600784 - RNA, 64 nt, Homo Sapiens
guaacuaguugggauuuuaucuucuacagaucaauaauuuaaauacuagaagacucuaaauugg

SEQ ID NO: 600785 - RNA, 64 nt, Homo Sapiens
aagguaaaguuaggggacuaauuuuauuuuuguauaauuuaaggcuugaaaucaaaacuaucag

SEQ ID NO: 600786 - RNA, 64 nt, Homo Sapiens
auuaauguucucuguucuguuuccauguuaaauuuaauuuaaccuggauagccacauuaaugaa

SEQ ID NO: 600787 - RNA, 64 nt, Homo Sapiens
agagguuacacaauauuuuacaguuucuuaaacauaauuuaaugcaucaccuuccacuugcuaa

SEQ ID NO: 600788 - RNA, 64 nt, Homo Sapiens
auuuaagaggauucacacucaacagguuuuaggauaauuuaaauaucaaaaauugauuguuaua

SEQ ID NO: 600789 - RNA, 64 nt, Homo Sapiens
ucauacaaauuuauaaacauuucuuuauaaauuguaauuuaauagauuaucucagaaaaaccuc

SEQ ID NO: 600790 - RNA, 64 nt, Homo Sapiens
cccuguucaaaguacuaaaacuagauaacuuaaauaauuuaagccaauaaauaauauuauauug

SEQ ID NO: 600791 - RNA, 64 nt, Homo Sapiens
auacuuuugauaugauuguaacauauuucuugaguaauuuaaaugcuuuguuuucccacacaua

SEQ ID NO: 600792 - RNA, 64 nt, Homo Sapiens
aaaacuguuggaauggauuuuucuuuaacugccguaauuuaacuuucuggguugccuuuauuuu

SEQ ID NO: 600793 - RNA, 64 nt, Homo Sapiens
ccccuaucuguauucccaaaaauuacuuuggggcuaauuuaacaagaacuuuaaauuguguuuu

SEQ ID NO: 600794 - RNA, 64 nt, Homo Sapiens
aaucauuuauuaagacagaaauucauuucuaaguuaauuuaaguuauuauaacuuauuguucau

SEQ ID NO: 600795 - RNA, 64 nt, Homo Sapiens
acauuuauuuccccuuuucauuuaagcuaaaagauaauuuaagacagaauuuguguguuuucga

SEQ ID NO: 600796 - RNA, 64 nt, Homo Sapiens
auccagacuugggggucauuuuuucuuagccuguuaauuuaaaacuauaucaauguguccuuag

SEQ ID NO: 600797 - RNA, 64 nt, Homo Sapiens
ucuuggugcaaaugugugcuagacaucuaugcauuaauuuaaauaacuucaugcagaauuucac

SEQ ID NO: 600798 - RNA, 64 nt, Homo Sapiens
gaucacuuacaggaucaugugguuucugauuauuuaauuuaaaaauaagaauaaauuuggaccc

SEQ ID NO: 600799 - RNA, 64 nt, Homo Sapiens
auaaagugaguuuaccaaaagaagagggccagcuuaauuuaaaagacuguuguaauggaguaaa

SEQ ID NO: 600800 - RNA, 64 nt, Homo Sapiens
uguaaaacuucugcucguuugauuuuuaagaaaguaauuuaauuguauguaacgauguuguauu

SEQ ID NO: 600801 - RNA, 64 nt, Homo Sapiens
acacaaaaaaaauuuuagcuauguuuuuaacuuuuaauuuaaaagauacuuugaagugcagcuc

SEQ ID NO: 600802 - RNA, 64 nt, Homo Sapiens
cagcagaaaagugcuuagaacaaaauaauuuaacuaauuuaaacagaauuauaucuaauuuaua

SEQ ID NO: 600803 - RNA, 64 nt, Homo Sapiens
aauuuaaaccagcagaaaaguaauuuauacaaaauaauuuaacucagaaaaguagaauuauauc

SEQ ID NO: 600804 - RNA, 64 nt, Homo Sapiens
aaauuuuucguugguguaauuaacuggugaucuauaauuuaauauuuucccguguauuuuuaaa

SEQ ID NO: 600805 - RNA, 64 nt, Homo Sapiens
gugucugcuuauuugguugauaaaaaauauaugguaauuuaaagauuaauuucuuucaagcaac

SEQ ID NO: 600806 - RNA, 64 nt, Homo Sapiens
acauuuuuaaaaaaagagcuaccagcaaauuaacuaauuuaaguaaucaagcaauauggaagca

SEQ ID NO: 600807 - RNA, 64 nt, Homo Sapiens
aucuccauuaaaguuauaaccaacucaacuuucauaauuuaaaauccuagcaaguaagaauggc

SEQ ID NO: 600808 - RNA, 64 nt, Homo Sapiens
gaccccccgagguggucuuuuuggagggccuuuuuaauuuaauuaguuaucccauuuagggugg

SEQ ID NO: 600809 - RNA, 64 nt, Homo Sapiens
cuaugagaagauagacuguuaauagccaugacuauaauuuaagcuggaugcuguuaauuucuuu

SEQ ID NO: 600810 - RNA, 64 nt, Homo Sapiens
gcguuguucuuuaaguguacaucguaauuugaccuaauuuaaaaauaauauauuuucgaaguag

SEQ ID NO: 600811 - RNA, 64 nt, Homo Sapiens
acuuuuauaaauaaauaauuccaaaauaauuucuuaauuuaaaaugauagcacuucucuugcac

SEQ ID NO: 600812 - RNA, 64 nt, Homo Sapiens
aguuuuuaauuauuauuaauauaaaggaucaaauuaauuuaaauaugauucugaagucuacaga

SEQ ID NO: 600813 - RNA, 64 nt, Homo Sapiens
uuggucuggugagauguuucauauuugugacaguuaauuuaaaaauuaugaguuaaugcugccu

SEQ ID NO: 600814 - RNA, 64 nt, Homo Sapiens
caggccugcugcugaguuauaugcagcuuugguuuaauuuaauuguacauugauggccaucaca

SEQ ID NO: 600815 - RNA, 64 nt, Homo Sapiens
gagaaagaaagccuuuuucacuuuaagacuuaucuaauuuaacuuguuuuuaguaguuucccaa

SEQ ID NO: 600816 - RNA, 64 nt, Homo Sapiens
aaaggauuauuggcuuguuuaauaaauuguuuuuuaauuuaaaaauaaagcauuacucuuuuuc

SEQ ID NO: 600817 - RNA, 64 nt, Homo Sapiens
agugcuauacuaagggaaaguaagugugguuuuguaauuuaaaaccagugagauagaauacaug

SEQ ID NO: 600818 - RNA, 64 nt, Homo Sapiens
acauuuaaugccaucuagcuagcaauugcgaccuuaauuuaacuuuccagucuuagcugaggcu

SEQ ID NO: 600819 - RNA, 64 nt, Homo Sapiens
aaaugaagaucuuuauauuucaauaaaugauauauaauuuaaaguuauacuaagguuucagcau

SEQ ID NO: 600820 - RNA, 64 nt, Homo Sapiens
ggaaaacuccugacugguauuacuggguuugguauaauuuaauuuaaaauucucauuuauagag

SEQ ID NO: 600821 - RNA, 64 nt, Homo Sapiens
acuccugacugguauuacuggguuugguauaauuuaauuuaaaauucucauuuauagaguauuu

SEQ ID NO: 600822 - RNA, 64 nt, Homo Sapiens
caggucaaaauaaaaguugaacuugaguuacauuuaauuuaaauauaaaugcauuuugagaaau

SEQ ID NO: 600823 - RNA, 64 nt, Homo Sapiens
aaaagggaggaguauuuuuaguuugacaauuuaauaauuuaaaaacaagacaucuccagguagg

SEQ ID NO: 600824 - RNA, 64 nt, Homo Sapiens
cuuuuauuguucaaucuguucauuauuuugacaauaauuuaauucauuuaaauuacuugaaucu

SEQ ID NO: 600825 - RNA, 64 nt, Homo Sapiens
aguaucugauuuuuaaaguacaaaaaauaaaauuuaauuuaaaauguucaauucuuaugucgcu

SEQ ID NO: 600826 - RNA, 64 nt, Homo Sapiens
uacgugcuucuguuauucaguugugcaaagaggauaauuuaauuauuaguuuuggggggaauaa

SEQ ID NO: 600827 - RNA, 64 nt, Homo Sapiens
cuuaccuucuauuucugaaaccuaguagaauuuguaauuuaauaaauccgcccacucccacuga

SEQ ID NO: 600828 - RNA, 64 nt, Homo Sapiens
uuuugagccuucaagauacaguuccugaauauucuaauuuaaauuguuauaauuggauuaccua

SEQ ID NO: 600829 - RNA, 64 nt, Homo Sapiens
acuauaacauuuacauuguguuagguauuuuaaguaauuuaaagguuacaguauacaggcgguu

SEQ ID NO: 600830 - RNA, 64 nt, Homo Sapiens
uaauuucacugaaauaaacuuaauauaucauaucuaauuuaaaagguuggggcauaugggagcu

SEQ ID NO: 600831 - RNA, 64 nt, Homo Sapiens
uucauuuuagcuuuacaaguucagauaucagaccuaauuuaaauguaguguaugguaagucaua

SEQ ID NO: 600832 - RNA, 64 nt, Homo Sapiens
uaacccuaagcaaaaugcaguuggggccacaaaauaauuuaauagcccugacaucugucaagcu

SEQ ID NO: 600833 - RNA, 64 nt, Homo Sapiens
ucccacuuuuaauuccaagccuuucaauuacugguaauuuaauuaagcacauuuuaaaggucaa

SEQ ID NO: 600834 - RNA, 64 nt, Homo Sapiens
cauuggcuuuauuucauuuucagauuuacauauuuaauuuaaaagauauuaaauaagucccagg

SEQ ID NO: 600835 - RNA, 64 nt, Homo Sapiens
gugaucucaauaccacacccauuuucuaauuuaauaauuuaauauaauuugaccaguguuaaga

SEQ ID NO: 600836 - RNA, 64 nt, Homo Sapiens
auuuaauagugaucucaauauguuaagaauuuucuaauuuaauacacucgucuaauuugaccag

SEQ ID NO: 600837 - RNA, 64 nt, Homo Sapiens
cacuacaaugggggcaaauggaaauauuacagaauaauuuaagaaucagacuuuguaacaggua

SEQ ID NO: 600838 - RNA, 64 nt, Homo Sapiens
cagcuaugcuauuuuuucauguuuuugggguuuauaauuuaaacuuagaaaaugucagacuuuu

SEQ ID NO: 600839 - RNA, 64 nt, Homo Sapiens
uacuguauucgcauguagaugugugcuugccuccuaauuuaaaaguagaguaacaccuuuauac

SEQ ID NO: 600840 - RNA, 64 nt, Homo Sapiens
aacuauaagucaguuauauuguaccaauuucuuuuaauuuaaagugggauuauacuuccuuucu

SEQ ID NO: 600841 - RNA, 64 nt, Homo Sapiens
gucuuuaaugucuucagacaaaaaagccuuacauuaauuuaauguuugcacucugaggugcaac

SEQ ID NO: 600842 - RNA, 64 nt, Homo Sapiens
auuaauaauuacauaccuuuauagauuuugaaauuaauuuaaauauuaguauuugguacaugaa

SEQ ID NO: 600843 - RNA, 64 nt, Homo Sapiens
agcugugaacagaguugugucugaggaaugugccuaauuuaaggcaggguuuguuccaaugcau

SEQ ID NO: 600844 - RNA, 64 nt, Homo Sapiens
uauuaauagguuguuuaucuuuuugccuguuugcuaauuuaaaaauauuuauuuuaucauuuua

SEQ ID NO: 600845 - RNA, 64 nt, Homo Sapiens
gcaacaaagggcagcaagaaaugcuggguccaccuaauuuaacacaaaaugaaguugagauucg

SEQ ID NO: 600846 - RNA, 64 nt, Homo Sapiens
gauaauguacaugcuucaugucaugucuuuaaaauaauuuaaucaacuuuauugucuuaguauu

SEQ ID NO: 600847 - RNA, 64 nt, Homo Sapiens
aaauggcuuuaaauuaauacucuuauuuuuuauuuaauuuaauuacauaaauuaaaccuuacca

SEQ ID NO: 600848 - RNA, 64 nt, Homo Sapiens
ccugugagauguuugauauuaugaacaggaaacauaauuuaauguaugaauagaugugaauuug

SEQ ID NO: 600849 - RNA, 64 nt, Homo Sapiens
uggucugcauuuuucuuuuugauuacaaaauuuauaauuuaauaaauacuagaguuuaucaaaa

SEQ ID NO: 600850 - RNA, 64 nt, Homo Sapiens
ucacauuuguuuuucagguauaaaauuucagauguaauuuaacauggauuuuuaaauacauuuu

SEQ ID NO: 600851 - RNA, 64 nt, Homo Sapiens
aucacuggauugcuuuauuacuuuauuucauaaguaauuuaaaaauuuuacaucuuauuuuugc

SEQ ID NO: 600852 - RNA, 64 nt, Homo Sapiens
auuugagggagauuuuauauaccuuuaaaaacuguaauuuaauugggaugccagguuuauagca

SEQ ID NO: 600853 - RNA, 64 nt, Homo Sapiens
uuaucagugaauaggugguguacuuuacuugguauaauuuaaaguugcacaguaaguacuguuu

SEQ ID NO: 600854 - RNA, 64 nt, Homo Sapiens
auugaacauguuguauaaauacaccagguguuuuuaauuuaauaagguggcaugcagauacauu

SEQ ID NO: 600855 - RNA, 64 nt, Homo Sapiens
uaugaugaaauuuugauuucucugaaucucagaguaauuuaagaugggcaaauccaaugaguug

SEQ ID NO: 600856 - RNA, 64 nt, Homo Sapiens
cuugggacuccacaacaacaacaacaacaaaauuuaauuuaauuuaaaaauagccccagucguc

SEQ ID NO: 600857 - RNA, 64 nt, Homo Sapiens
gacuccacaacaacaacaacaacaaaauuuaauuuaauuuaaaaauagccccagucgucaucac

SEQ ID NO: 600858 - RNA, 64 nt, Homo Sapiens
aaauauauuuuugcaagugaaguaaauauaaaaauaauuuaauccaaaauuaagucuauauaaa

SEQ ID NO: 600859 - RNA, 64 nt, Homo Sapiens
cugaguauagaaucagaaugcugaguauagaaaauaauuuaaaacuaaaguugguagguaaaua

SEQ ID NO: 600860 - RNA, 64 nt, Homo Sapiens
gggaaaugauuaccuuuccaguaaaaaguauagauaauuuaauuaacuuagugacaccaccaag

SEQ ID NO: 600861 - RNA, 64 nt, Homo Sapiens
auauuuucuguucacaguauaugaaaauauggaguaauuuaaacaguaaauaaacauucugugg

SEQ ID NO: 600862 - RNA, 64 nt, Homo Sapiens
gaggccaggucucaguccgcgcuaaacaaugcaauaauuuaaaaucauaaagggccaguguaua

SEQ ID NO: 600863 - RNA, 64 nt, Homo Sapiens
cuuuuuaaaaaggaaaguauaaaaacaaaaguuguaauuuaaaagucugaauaaccaucugcug

SEQ ID NO: 600864 - RNA, 64 nt, Homo Sapiens
uuuccuuuuggggguaaaguagguuuuuuuuuuuuaauuuaauuuaagucuucaaauuuuuuaa

SEQ ID NO: 600865 - RNA, 64 nt, Homo Sapiens
uauugcuagauaauaggguugagcugucugucucuaauuuaacuucuguagauucaugcaagug

SEQ ID NO: 600866 - RNA, 64 nt, Homo Sapiens
cugguauugugagugguuagccuaguuaaucauguaauuuaauugggcaaaaugugucagaugc

SEQ ID NO: 600867 - RNA, 64 nt, Homo Sapiens
aaaauuuccaaauauuugugagugggaacauuuuuaauuuaaaauagcgagcucaaagcaauua

SEQ ID NO: 600868 - RNA, 64 nt, Homo Sapiens
auaaauaagccugcuacauguaguauuguuuuuguaauuuaacagaguuaaucuguuguaauug

SEQ ID NO: 600869 - RNA, 59 nt, Homo Sapiens
aaaagaauuccuuaccuauauuuucuacuuaauuuaaagcuagagcuguagccacguag

SEQ ID NO: 600870 - RNA, 64 nt, Homo Sapiens
acaugggaaagauucuagaccuuucuugcaagaguaauuuaagcaguuauucaaagaauguuau

SEQ ID NO: 600871 - RNA, 64 nt, Homo Sapiens
gguuuuguugcugaaagcagguuaucauaagaaauaauuuaaaacucuagugaucaugcaucua

SEQ ID NO: 600872 - RNA, 64 nt, Homo Sapiens
aaaguguuugguaaaucauuauuuauuuaauuaguaauuuaaguuuuggcucggugcauuuuuc

SEQ ID NO: 600873 - RNA, 64 nt, Homo Sapiens
aaucuuauucucuuaauucuccaguguggaaaaauaauuuaaacaagcuugucuggucaacauu

SEQ ID NO: 600874 - RNA, 64 nt, Homo Sapiens
uuaugugaaauguuuuaaaucaguguauacccaauaauuuaaaacacuuuugaaacucagacuu

SEQ ID NO: 600875 - RNA, 64 nt, Homo Sapiens
gaagaaaaauacauccaaauuauccaguuuccuguaauuuaauuagcguugcaacgaaauccua

SEQ ID NO: 600876 - RNA, 64 nt, Homo Sapiens
cuaugguguaagucuuugacaaugccugacaguuuaauuuaaaaaaggaaaaccugucugagaa

SEQ ID NO: 600877 - RNA, 64 nt, Homo Sapiens
agguggacuuagccauaggaaaauauuacuaauguaauuuaacaaauugcugcauguauuccau

SEQ ID NO: 600878 - RNA, 64 nt, Homo Sapiens
auaguaagacccuaucucuaccccccuaauaaauuaauuuaaaaagccccccaaucugugguau

SEQ ID NO: 600879 - RNA, 64 nt, Homo Sapiens
ggagccuuucauuauuuucaccaaaaaaccacauuaauuuaaauaaaacaaaaugaacacuuga

SEQ ID NO: 600880 - RNA, 64 nt, Homo Sapiens
uguguuaaauaugaaccauagagagacugucuaguaauuuaaaagcauuaaaauuucuuuuggg

SEQ ID NO: 600881 - RNA, 64 nt, Homo Sapiens
ccauuucuacgucgggaaauacauuaugcuauuguaauuuaacaaguuuagaauuucuuggacc

SEQ ID NO: 600882 - RNA, 64 nt, Homo Sapiens
acauuuauagaaaauucauuaagaauugcaauuuuaauuuaaaagagccucuucugcauagaaa

SEQ ID NO: 600883 - RNA, 64 nt, Homo Sapiens
agaacuuuuuuggaacuucuaauuuugggucauuuaauuuaagaaugagagucaugauguuuug

SEQ ID NO: 600884 - RNA, 64 nt, Homo Sapiens
aaggugccuaugccauuguuaaauuuucuuuaaguaauuuaacaacagauuugcuaauuuaaaa

SEQ ID NO: 600885 - RNA, 64 nt, Homo Sapiens
aaauuuucuuuaaguaauuuaacaacagauuugcuaauuuaaaaaaaaaugaaaaaaaaaaucu

SEQ ID NO: 600886 - RNA, 64 nt, Homo Sapiens
gugagcuuuuuaugucugucauaaaaucuaccaguaauuuaaauuuucuuuuuucuuuuuuuua

SEQ ID NO: 600887 - RNA, 64 nt, Homo Sapiens
guaaaauuauuagagguauuuagaaguauggacuuaauuuaauuauguugagaccaaaguagua

SEQ ID NO: 600888 - RNA, 64 nt, Homo Sapiens
uggcaaauuaagugagacuuuucacuguuauuuuuaauuuaaccgcaaugaauaauuuuccugc

SEQ ID NO: 600889 - RNA, 64 nt, Homo Sapiens
agucaauuugcagauagcuauccugcauuuaccauaauuuaaucgugaacagaaaaaacagugu

SEQ ID NO: 600890 - RNA, 64 nt, Homo Sapiens
auauauauuaauagaguaugauuuacugaauuguuaauuuaaggagugaguagccuauaugugc

SEQ ID NO: 600891 - RNA, 64 nt, Homo Sapiens
uuggggaauccagaauacuuaauuauacugaauauaauuuaaccacaaaauauauuuuaccaaa

SEQ ID NO: 600892 - RNA, 64 nt, Homo Sapiens
uucucuauuauauauuucccauauuucaggugaauaauuuaauuuaaaugacaaaacccuaucu

SEQ ID NO: 600893 - RNA, 64 nt, Homo Sapiens
uauuauauauuucccauauuucaggugaauaauuuaauuuaaaugacaaaacccuaucuaguca

SEQ ID NO: 600894 - RNA, 64 nt, Homo Sapiens
accuuuaaaaauuuucucauuaagacaauguuuuuaauuuaauuugccucauuacaucuaauag

SEQ ID NO: 600895 - RNA, 64 nt, Homo Sapiens
auuuuuuauauuuccuuacaauuuugguggccauuaauuuaacuuuaggcuuuugggcauaugc

SEQ ID NO: 600896 - RNA, 64 nt, Homo Sapiens
augguuuggguagacuuuuuuuuuauaucaaguauaauuuaaaacaucagauuaaauaauuaca

SEQ ID NO: 600897 - RNA, 64 nt, Homo Sapiens
cauuaacauuaauuuuauuuuuucagacauacuguaauuuaaaaauuaaugugagcguuuguuu

SEQ ID NO: 600898 - RNA, 64 nt, Homo Sapiens
ccauuuguaaacagaugaaauagcuugugcugauuaauuuaacccagggcagacauacauauga

SEQ ID NO: 600899 - RNA, 64 nt, Homo Sapiens
uugaaaccuaaguuauauaucaaaugucuggggauaauuuaaaucauucauauguaucugucua

SEQ ID NO: 600900 - RNA, 64 nt, Homo Sapiens
uacuaucauuuaugauugcaucaaugugaaggacuaauuuaaauaggacuaauuuaaacacaua

SEQ ID NO: 600901 - RNA, 64 nt, Homo Sapiens
acauaucaaugugaaggacugcauaccuaaggacuaauuuaaaccagaacaaaaggcagaaaag

SEQ ID NO: 600902 - RNA, 64 nt, Homo Sapiens
cauuauuuuucuuaauaucuauuuacuaaguauguaauuuaauauacauuaauuauuuuuugaa

SEQ ID NO: 600903 - RNA, 64 nt, Homo Sapiens
aaccaaaaacacaacagucauuaucugugaaccauaauuuaaaaaucuuucuagaauaacaaca

SEQ ID NO: 600904 - RNA, 64 nt, Homo Sapiens
gaagaaaaugacaauaucuguuggauauuugauauaauuuaaugguguuauaaaaccuuuaaga

SEQ ID NO: 600905 - RNA, 64 nt, Homo Sapiens
uacuguguaacaguaacucuuuuuugcuuuucaguaauuuaauauguucacuuaacaaaauacg

SEQ ID NO: 600906 - RNA, 64 nt, Homo Sapiens
uuaaaaauuaauaacuuuuaguaauuacuuuuauuaauuuaaaauagaacgcuugagaggcacu

SEQ ID NO: 600907 - RNA, 64 nt, Homo Sapiens
uagguuuuuuaaaauuaauauuaauaacuuuuauuaauuuaaaauagaaugcuuaaaauaaaau

SEQ ID NO: 600908 - RNA, 64 nt, Homo Sapiens
agauacuuuugagacaacaccuucagaaaacacauaauuuaaucuuugccauccuuagauagag

SEQ ID NO: 600909 - RNA, 64 nt, Homo Sapiens
ugugcagucaguagagcugaacuuagcuaugaauuaauuuaaauuaauucuaaagugacucugg

SEQ ID NO: 600910 - RNA, 64 nt, Homo Sapiens
auguugaaccucacacuuuuauguggugacaguguaauuuaauuaaaagguguaaauguuuuca

SEQ ID NO: 600911 - RNA, 64 nt, Homo Sapiens
ucccuacguguugugggagggacccagugggcaguaauuuaaucaugguggugguuacccucau

SEQ ID NO: 600912 - RNA, 64 nt, Homo Sapiens
aucaaucaguagauugauucgguucacagugaaauaauuuaauuuuucuaaauacuagccuucu

SEQ ID NO: 600913 - RNA, 64 nt, Homo Sapiens
uagguuaauuuauauuacauguuaaauuaaaaucuaauuuaaauuuaaaaaacuaucaaaguag

SEQ ID NO: 600914 - RNA, 64 nt, Homo Sapiens
guguuaacauuaaugcucaacguaagugaauacuuaauuuaaaagauaggacagugacaaaauu

SEQ ID NO: 600915 - RNA, 64 nt, Homo Sapiens
ucaaaaaaacuauuaugaaagucaauaaaauagauaauuuaacaaaaguacaggauuagaacau

SEQ ID NO: 600916 - RNA, 64 nt, Homo Sapiens
uuauauguucaccaaugggaggucaauauuuaucuaauuuaaaagguaugcuaaccacuguggu

SEQ ID NO: 600917 - RNA, 64 nt, Homo Sapiens
uuucacauaaaauugagacaguguauauuuaaucuaauuuaaauuuuaaagagauacugguauu

SEQ ID NO: 600918 - RNA, 64 nt, Homo Sapiens
gcuuuagaguaaggaugagaaacuugaguguuuuuaauuuaaagauaaaagccuguguuuuaca

SEQ ID NO: 600919 - RNA, 64 nt, Homo Sapiens
gggaaggcgauguggugaccccacccccacccguuaauuuaaagcuguuucuaaacaguugagu

SEQ ID NO: 600920 - RNA, 64 nt, Homo Sapiens
uaaucugacaaagucaugaagcucaguuuggcuguaauuuaauuccccuucccuuauuuuuauu

SEQ ID NO: 600921 - RNA, 64 nt, Homo Sapiens
uuauuauaacauccacaaagagauuauuuuuaaauaauuuaaagcauaauauuucuuaaaaagu

SEQ ID NO: 600922 - RNA, 64 nt, Homo Sapiens
uugaaaaaaaauuucaaaaagaaaaaaauauauauaauuuaaaacuacuuagucuuauucuucu

SEQ ID NO: 600923 - RNA, 64 nt, Homo Sapiens
cuguuauugaucccuucuccugcccuuucccagguaauuuaaauuggucaugguagauuuuuuu

SEQ ID NO: 600924 - RNA, 64 nt, Homo Sapiens
uuaaugguaggucaaguaauaaaaagagaugaaauaauuuaaauucuuaaaugaaucaguuuuu

SEQ ID NO: 600925 - RNA, 64 nt, Homo Sapiens
ugacauugacuauaagaaggauuuacucggauucuaauuuaaugaucagcuauuuuuaaacauu

SEQ ID NO: 600926 - RNA, 64 nt, Homo Sapiens
aucauacaauauuagguugguuugugcuuaaaaauaauuuaaaacauccccaacaugggucuau

SEQ ID NO: 600927 - RNA, 64 nt, Homo Sapiens
gcauugucuuaaaauacgugaguaucuaaaagcauaauuuaauauuauaaugucuucuauaugu

SEQ ID NO: 600928 - RNA, 64 nt, Homo Sapiens
gaauuaucuuaaaauacaugucuuucuaaaaguauaauuuaauagguguuaauuacuaaaauuu

SEQ ID NO: 600929 - RNA, 64 nt, Homo Sapiens
caagagaaugcuuuuauuucuauacuaaaaucuauaauuuaauucccuccgaagagaaaauuuu

SEQ ID NO: 600930 - RNA, 64 nt, Homo Sapiens
uaauauuuccauuaauaaccuuagaaccagauuuuaauuuaaaucagagaugacuaauuuaaau

SEQ ID NO: 600931 - RNA, 64 nt, Homo Sapiens
uuagaaccagauuuuaauuuuagccagagaugacuaauuuaaauugacuucuuuuucucuucau

SEQ ID NO: 600932 - RNA, 64 nt, Homo Sapiens
uuuuauugucaguagaaaaaaguuaaacuccuacuaauuuaaacuaagacaguuuaaaaaggaa

SEQ ID NO: 600933 - RNA, 64 nt, Homo Sapiens
aaaaaggaagccugaaaaagacucauacuacaaauaauuuaauugauggcauauaagaauaugc

SEQ ID NO: 600934 - RNA, 64 nt, Homo Sapiens
gaaaugcuaugauucacauguaacauuuaaacauuaauuuaaaaagggaaccuuggagaauucu

SEQ ID NO: 600935 - RNA, 64 nt, Homo Sapiens
uaggugauuauccaaacaaguaaauuugaguguauaauuuaauuuuuaaccuguuaaauaaacc

SEQ ID NO: 600936 - RNA, 64 nt, Homo Sapiens
uaaaaggaaaaaaaacuuagccuagaauuagaauuaauuuaauugaauucaucuaaagaugucu

SEQ ID NO: 600937 - RNA, 64 nt, Homo Sapiens
gcagccugggaucucccuacuccauuuuuuccuuuaauuuaaguggccacauguauaugucuuc

SEQ ID NO: 600938 - RNA, 64 nt, Homo Sapiens
uaauguuaaguaaucauuucuuguauaugcuguuuaauuuaaguuuucaaaagcaauauaacgu

SEQ ID NO: 600939 - RNA, 64 nt, Homo Sapiens
guggcaacaguuucauuugaauacagcgguuguguaauuuaagaugagucaguggaacacugaa

SEQ ID NO: 600940 - RNA, 64 nt, Homo Sapiens
gggauuucugcauucuggaaagcccaagacugccuaauuuaacagaggcaggcacacguccucc

SEQ ID NO: 600941 - RNA, 64 nt, Homo Sapiens
aaaaaauuauauagauagggccaccaagcuuggcuaauuuaaaagcugggacuacaggcaugca

SEQ ID NO: 600942 - RNA, 64 nt, Homo Sapiens
caugagauuuaguaacuuauaaaaugagguuuaguaauuuaauuuaaauggauaggaccaauaa

SEQ ID NO: 600943 - RNA, 64 nt, Homo Sapiens
gauuuaguaacuuauaaaaugagguuuaguaauuuaauuuaaauggauaggaccaauaaguuaa

SEQ ID NO: 600944 - RNA, 64 nt, Homo Sapiens
gaaaacuaccuggugaugcaaucuuuuuuuuuuuuaauuuaauuuaauuuuaaaauaaaugcug

SEQ ID NO: 600945 - RNA, 64 nt, Homo Sapiens
cuaccuggugaugcaaucuuuuuuuuuuuuaauuuaauuuaauuuuaaaauaaaugcugcauug

SEQ ID NO: 600946 - RNA, 64 nt, Homo Sapiens
uuaauccuauuuaaauguucuuucaaaucucuaauaauuuaaacuuuccucagugcuccaugau

SEQ ID NO: 600947 - RNA, 64 nt, Homo Sapiens
aacaacucaggaauauaacauauaagggagauguuaauuuaaaaauuuccacuacacuuauuau

SEQ ID NO: 600948 - RNA, 64 nt, Homo Sapiens
aagaaaaauaaaacaccuuguacuuuauuuucuauaauuuaaauauaugcuaagucuuauauau

SEQ ID NO: 600949 - RNA, 64 nt, Homo Sapiens
aaauccacagaccaaccuggaguugaaaaucuuauaauuuaaaauaugcucuaaacauguuuau

SEQ ID NO: 600950 - RNA, 64 nt, Homo Sapiens
uuuauugguguuauuggaaguuaauauaaauaaauaauuuaaaugcucuuaugggcuucuaauu

SEQ ID NO: 600951 - RNA, 64 nt, Homo Sapiens
cuguuuuuuuucuugaaggaaacgcagagaaguuuaauuuaauauguauauuguaacaaccuaa

SEQ ID NO: 600952 - RNA, 64 nt, Homo Sapiens
acaggcuaccuggaaacugcccauggcggggucauaauuuaaaugucccaaugucauauagagg

SEQ ID NO: 600953 - RNA, 64 nt, Homo Sapiens
ucauaauuuaaaugucccaaugucauauagagguuaauuuaaucaaaaugagcuaaaacaugga

SEQ ID NO: 600954 - RNA, 64 nt, Homo Sapiens
ucaaaaugagcuaaaacauggaacaaucacugaauaauuuaaaaagaguuuaccuggcagagug

SEQ ID NO: 600955 - RNA, 64 nt, Homo Sapiens
accaauuaauauuuuugaaagagcucuuuuagguuaauuuaaguacagcaauuucucauguaau

SEQ ID NO: 600956 - RNA, 64 nt, Homo Sapiens
acgguuuaaacaggaaggauugugcagcaggcuuuaauuuaauguagauucauacugcucuguu

SEQ ID NO: 600957 - RNA, 62 nt, Homo Sapiens
ugagcauaaggguuauuugaaauauuuuuucuguaccuaacuauucuauugacuuucuuaaa

SEQ ID NO: 600958 - RNA, 62 nt, Homo Sapiens
guuugaacagauauguuuuuaaaugauuagaaguaccuaauaccaaugcuucuuauaagacu

SEQ ID NO: 600959 - RNA, 62 nt, Homo Sapiens
gaaauaugucuaucacaaauaauguuaaguuuguaccuaauaauaaguggucaugaaauuuu

SEQ ID NO: 600960 - RNA, 62 nt, Homo Sapiens
uaguggcuaaggcaugcuuguaaaguggucaaguaccuaaggugaaaugccacaaaaccccu

SEQ ID NO: 600961 - RNA, 64 nt, Homo Sapiens; identical to SEQ ID NO: 390817

SEQ ID NO: 600962 - RNA, 64 nt, Homo Sapiens; identical to SEQ ID NO: 390818

SEQ ID NO: 600963 - RNA, 64 nt, Homo Sapiens
acuggcuggagcugggcaccggcucacauucucaccuagcaacaagaagaucuggccaugcugg

SEQ ID NO: 600964 - RNA, 64 nt, Homo Sapiens
agagaaauuuccucaaguuucauuguccuauaguccuagcaauauggaaauucaucuugaaucc

SEQ ID NO: 600965 - RNA, 64 nt, Homo Sapiens
auaucccaagagccauuuauagcaacaacauuguccuagcaaccgugauccuuggaauuauccu

SEQ ID NO: 600966 - RNA, 64 nt, Homo Sapiens
acauuguccuagcaaccauaauccuuggaauuauccuagcaacaguguaauuguuuugcuugug

SEQ ID NO: 600967 - RNA, 64 nt, Homo Sapiens
augugugaucuuugugucuccuuuuugccaagcacauucugauuuucuuguuggaacacagguc

SEQ ID NO: 600968 - RNA, 64 nt, Homo Sapiens
caggaauaagaacuccauuucaaacaguucuggccauucugagccugcuuuugugauugcucau

SEQ ID NO: 600969 - RNA, 64 nt, Homo Sapiens
uuuuuuucugaauuuuuuuuuuugagugggacaccauucugaauaccccccacccaccgcaagc

SEQ ID NO: 600970 - RNA, 64 nt, Homo Sapiens
uugaaacccaugaucacccccugcgccaucuucacauucugaaguuccuucuuccccaauaugc

SEQ ID NO: 600971 - RNA, 64 nt, Homo Sapiens
uugaagguggguguuggaacuuuuagacucuaaacauucugauuaaaugcugaaaggcagcguu

SEQ ID NO: 600972 - RNA, 64 nt, Homo Sapiens
acggcagcuuuccuaaaaagccuugcacuccaugcauucugauaaucacagcaaggcuuuugug

SEQ ID NO: 600973 - RNA, 64 nt, Homo Sapiens
uaauuaauuuggagcacaaaaacauuuucccacucauucugaauaaaagaaggaaagaugguua

SEQ ID NO: 600974 - RNA, 64 nt, Homo Sapiens
auugaguuccaguugaaguucuaaauuuuaaagccauucugauuauggcaugcuuaaauuuuaa

SEQ ID NO: 600975 - RNA, 64 nt, Homo Sapiens
ccucuuguauucaaucugugacugcuggugugugcauucugagaagaaagguugugcucgcuac

SEQ ID NO: 600976 - RNA, 64 nt, Homo Sapiens
ggguguguggcauuguguucauaaauauuuauuacauucugacaauaaguagagaaaaucauca

SEQ ID NO: 600977 - RNA, 64 nt, Homo Sapiens
cauaucauucugugauuaaauuuuggugcuauaacauucugacauuaaaaaugaucuguaguuu

SEQ ID NO: 600978 - RNA, 64 nt, Homo Sapiens
cugaaggagagagucuuuuauuccuuaaaauuuucauucugaaugugcccccuagggucuauaa

SEQ ID NO: 600979 - RNA, 64 nt, Homo Sapiens
caaauaacaaagcaaaccaauauaauuauauggucauucugaccccagcucuuauacaaauuau

SEQ ID NO: 600980 - RNA, 64 nt, Homo Sapiens
ucugccuccuguuuauugagaacuaugcauugaacauucugaaucauucuaagccucuggagag

SEQ ID NO: 600981 - RNA, 64 nt, Homo Sapiens
aguggugaucacaugccagacuucucuagugaggcauucugagcuauaucggauuuaccuuaag

SEQ ID NO: 600982 - RNA, 64 nt, Homo Sapiens
ggggagcagguaagagcagauagauuuauuccuacauucugaauuuugauacaacuccccgauc

SEQ ID NO: 600983 - RNA, 64 nt, Homo Sapiens
ggguucaaaugccaaauagugauuagaagacgaccauucugaucugugugugaucuggucacua

SEQ ID NO: 600984 - RNA, 64 nt, Homo Sapiens
aacucuuuguauaugcaaauugcaagauuuaaaccauucugaugcaaggauaaaccuuuacuuu

SEQ ID NO: 600985 - RNA, 64 nt, Homo Sapiens
caccuuugcauagcuggguugcagcugcgaaccucauucugacugugaacuaagcaagcuuuga

SEQ ID NO: 600986 - RNA, 64 nt, Homo Sapiens
guacacgucugugcccugaaggaacacuggccuccauucugacaucugggcuggggccucagga

SEQ ID NO: 600987 - RNA, 64 nt, Homo Sapiens
ggagcagaccccugagaucugggcauaggcaccgcauucugaucuggacaaagucgggacagca

SEQ ID NO: 600988 - RNA, 64 nt, Homo Sapiens
gaaaucaaaacaccgcaccagccagcagaauggacauucugacaucgccagccgacgcccugaa

SEQ ID NO: 600989 - RNA, 64 nt, Homo Sapiens
aguuugguccacuuggcucuauguucccccaaagcauucugacaggggaucauuuugauguuga

SEQ ID NO: 600990 - RNA, 64 nt, Homo Sapiens
aaggauccuaaauuucccuuuaccugcaaauaggcauucugagccugguuuuguaggcaggcug

SEQ ID NO: 600991 - RNA, 64 nt, Homo Sapiens; identical to SEQ ID NO: 124927

SEQ ID NO: 600992 - RNA, 64 nt, Homo Sapiens; identical to SEQ ID NO: 124928

SEQ ID NO: 600993 - RNA, 64 nt, Homo Sapiens; identical to SEQ ID NO: 124929

SEQ ID NO: 600994 - RNA, 64 nt, Homo Sapiens; identical to SEQ ID NO: 124930

SEQ ID NO: 600995 - RNA, 64 nt, Homo Sapiens; identical to SEQ ID NO: 124931

SEQ ID NO: 600996 - RNA, 64 nt, Homo Sapiens; identical to SEQ ID NO: 124932

SEQ ID NO: 600997 - RNA, 64 nt, Homo Sapiens; identical to SEQ ID NO: 124933

SEQ ID NO: 600998 - RNA, 64 nt, Homo Sapiens; identical to SEQ ID NO: 124934

SEQ ID NO: 600999 - RNA, 64 nt, Homo Sapiens; identical to SEQ ID NO: 124935

SEQ ID NO: 601000 - RNA, 64 nt, Homo Sapiens; identical to SEQ ID NO: 124936

SEQ ID NO: 601001 - RNA, 64 nt, Homo Sapiens; identical to SEQ ID NO: 124937

SEQ ID NO: 601002 - RNA, 64 nt, Homo Sapiens; identical to SEQ ID NO: 124938

SEQ ID NO: 601003 - RNA, 64 nt, Homo Sapiens; identical to SEQ ID NO: 124939

SEQ ID NO: 601004 - RNA, 64 nt, Homo Sapiens; identical to SEQ ID NO: 124940

SEQ ID NO: 601005 - RNA, 64 nt, Homo Sapiens; identical to SEQ ID NO: 124941

SEQ ID NO: 601006 - RNA, 64 nt, Homo Sapiens; identical to SEQ ID NO: 124942

SEQ ID NO: 601007 - RNA, 64 nt, Homo Sapiens; identical to SEQ ID NO: 124943

SEQ ID NO: 601008 - RNA, 64 nt, Homo Sapiens; identical to SEQ ID NO: 124944

SEQ ID NO: 601009 - RNA, 64 nt, Homo Sapiens; identical to SEQ ID NO: 124945

SEQ ID NO: 601010 - RNA, 64 nt, Homo Sapiens; identical to SEQ ID NO: 124946

SEQ ID NO: 601011 - RNA, 64 nt, Homo Sapiens; identical to SEQ ID NO: 124947

SEQ ID NO: 601012 - RNA, 64 nt, Homo Sapiens; identical to SEQ ID NO: 124948

SEQ ID NO: 601013 - RNA, 64 nt, Homo Sapiens; identical to SEQ ID NO: 124949

SEQ ID NO: 601014 - RNA, 64 nt, Homo Sapiens; identical to SEQ ID NO: 124950

SEQ ID NO: 601015 - RNA, 64 nt, Homo Sapiens; identical to SEQ ID NO: 124951

SEQ ID NO: 601016 - RNA, 64 nt, Homo Sapiens; identical to SEQ ID NO: 124952

SEQ ID NO: 601017 - RNA, 64 nt, Homo Sapiens; identical to SEQ ID NO: 124953

SEQ ID NO: 601018 - RNA, 64 nt, Homo Sapiens; identical to SEQ ID NO: 124954

SEQ ID NO: 601019 - RNA, 64 nt, Homo Sapiens; identical to SEQ ID NO: 124955

SEQ ID NO: 601020 - RNA, 64 nt, Homo Sapiens; identical to SEQ ID NO: 124956

SEQ ID NO: 601021 - RNA, 64 nt, Homo Sapiens; identical to SEQ ID NO: 124957

SEQ ID NO: 601022 - RNA, 64 nt, Homo Sapiens; identical to SEQ ID NO: 124958

SEQ ID NO: 601023 - RNA, 64 nt, Homo Sapiens; identical to SEQ ID NO: 124959

SEQ ID NO: 601024 - RNA, 64 nt, Homo Sapiens; identical to SEQ ID NO: 124960

SEQ ID NO: 601025 - RNA, 64 nt, Homo Sapiens; identical to SEQ ID NO: 124961

SEQ ID NO: 601026 - RNA, 64 nt, Homo Sapiens; identical to SEQ ID NO: 124962

SEQ ID NO: 601027 - RNA, 64 nt, Homo Sapiens; identical to SEQ ID NO: 124963

SEQ ID NO: 601028 - RNA, 64 nt, Homo Sapiens; identical to SEQ ID NO: 124964

SEQ ID NO: 601029 - RNA, 64 nt, Homo Sapiens; identical to SEQ ID NO: 124965

SEQ ID NO: 601030 - RNA, 64 nt, Homo Sapiens; identical to SEQ ID NO: 124966

SEQ ID NO: 601031 - RNA, 64 nt, Homo Sapiens; identical to SEQ ID NO: 124967

SEQ ID NO: 601032 - RNA, 63 nt, Homo Sapiens; identical to SEQ ID NO: 124968

SEQ ID NO: 601033 - RNA, 64 nt, Homo Sapiens; identical to SEQ ID NO: 124969

SEQ ID NO: 601034 - RNA, 64 nt, Homo Sapiens; identical to SEQ ID NO: 124970

SEQ ID NO: 601035 - RNA, 64 nt, Homo Sapiens; identical to SEQ ID NO: 124971

SEQ ID NO: 601036 - RNA, 64 nt, Homo Sapiens; identical to SEQ ID NO: 124972

SEQ ID NO: 601037 - RNA, 64 nt, Homo Sapiens; identical to SEQ ID NO: 124973

SEQ ID NO: 601038 - RNA, 64 nt, Homo Sapiens; identical to SEQ ID NO: 124974

SEQ ID NO: 601039 - RNA, 64 nt, Homo Sapiens; identical to SEQ ID NO: 124975

SEQ ID NO: 601040 - RNA, 64 nt, Homo Sapiens; identical to SEQ ID NO: 124976

SEQ ID NO: 601041 - RNA, 64 nt, Homo Sapiens; identical to SEQ ID NO: 124977

SEQ ID NO: 601042 - RNA, 64 nt, Homo Sapiens; identical to SEQ ID NO: 124977

SEQ ID NO: 601043 - RNA, 64 nt, Homo Sapiens; identical to SEQ ID NO: 124979

SEQ ID NO: 601044 - RNA, 64 nt, Homo Sapiens; identical to SEQ ID NO: 124980

SEQ ID NO: 601045 - RNA, 64 nt, Homo Sapiens; identical to SEQ ID NO: 124981

SEQ ID NO: 601046 - RNA, 64 nt, Homo Sapiens; identical to SEQ ID NO: 124982

SEQ ID NO: 601047 - RNA, 64 nt, Homo Sapiens; identical to SEQ ID NO: 124983

SEQ ID NO: 601048 - RNA, 64 nt, Homo Sapiens; identical to SEQ ID NO: 124984

SEQ ID NO: 601049 - RNA, 64 nt, Homo Sapiens; identical to SEQ ID NO: 124985

SEQ ID NO: 601050 - RNA, 64 nt, Homo Sapiens; identical to SEQ ID NO: 124986

SEQ ID NO: 601051 - RNA, 64 nt, Homo Sapiens; identical to SEQ ID NO: 124987

SEQ ID NO: 601052 - RNA, 64 nt, Homo Sapiens; identical to SEQ ID NO: 124988

SEQ ID NO: 601053 - RNA, 64 nt, Homo Sapiens; identical to SEQ ID NO: 124989

SEQ ID NO: 601054 - RNA, 64 nt, Homo Sapiens; identical to SEQ ID NO: 124990

SEQ ID NO: 601055 - RNA, 64 nt, Homo Sapiens; identical to SEQ ID NO: 124991

SEQ ID NO: 601056 - RNA, 64 nt, Homo Sapiens; identical to SEQ ID NO: 124992

SEQ ID NO: 601057 - RNA, 64 nt, Homo Sapiens; identical to SEQ ID NO: 124993

SEQ ID NO: 601058 - RNA, 64 nt, Homo Sapiens; identical to SEQ ID NO: 124994

SEQ ID NO: 601059 - RNA, 64 nt, Homo Sapiens; identical to SEQ ID NO: 124995

SEQ ID NO: 601060 - RNA, 64 nt, Homo Sapiens; identical to SEQ ID NO: 124996

SEQ ID NO: 601061 - RNA, 64 nt, Homo Sapiens; identical to SEQ ID NO: 124997

SEQ ID NO: 601062 - RNA, 64 nt, Homo Sapiens; identical to SEQ ID NO: 124998

SEQ ID NO: 601063 - RNA, 64 nt, Homo Sapiens; identical to SEQ ID NO: 124999

SEQ ID NO: 601064 - RNA, 64 nt, Homo Sapiens; identical to SEQ ID NO: 125000

SEQ ID NO: 601065 - RNA, 64 nt, Homo Sapiens; identical to SEQ ID NO: 125001

SEQ ID NO: 601066 - RNA, 64 nt, Homo Sapiens; identical to SEQ ID NO: 125002

SEQ ID NO: 601067 - RNA, 64 nt, Homo Sapiens; identical to SEQ ID NO: 103765

SEQ ID NO: 601068 - RNA, 64 nt, Homo Sapiens; identical to SEQ ID NO: 103766

SEQ ID NO: 601069 - RNA, 53 nt, Homo Sapiens; identical to SEQ ID NO: 103767

SEQ ID NO: 601070 - RNA, 64 nt, Homo Sapiens; identical to SEQ ID NO: 103768

SEQ ID NO: 601071 - RNA, 64 nt, Homo Sapiens; identical to SEQ ID NO: 103769

SEQ ID NO: 601072 - RNA, 64 nt, Homo Sapiens; identical to SEQ ID NO: 103770

SEQ ID NO: 601073 - RNA, 53 nt, Homo Sapiens; identical to SEQ ID NO: 103771

SEQ ID NO: 601074 - RNA, 64 nt, Homo Sapiens; identical to SEQ ID NO: 103772

SEQ ID NO: 601075 - RNA, 64 nt, Homo Sapiens; identical to SEQ ID NO: 103773

SEQ ID NO: 601076 - RNA, 64 nt, Homo Sapiens; identical to SEQ ID NO: 103774

SEQ ID NO: 601077 - RNA, 64 nt, Homo Sapiens; identical to SEQ ID NO: 103775

SEQ ID NO: 601078 - RNA, 64 nt, Homo Sapiens; identical to SEQ ID NO: 103776

SEQ ID NO: 601079 - RNA, 64 nt, Homo Sapiens
uagcuccauagggaagccugugucuccugcccccagggcgcacccucagugcaggcaccucugu

SEQ ID NO: 601080 - RNA, 64 nt, Homo Sapiens
ggugcaaucuuggcucacugcaaccuccgccuccagggcgcagccuccugaguagcugggagga

SEQ ID NO: 601081 - RNA, 64 nt, Homo Sapiens
cccacccuugcccaccccacccccacccccaccaagggcgcaagaguagcgguccaagccugca

SEQ ID NO: 601082 - RNA, 64 nt, Homo Sapiens
gggccuccuuggccuccucuugaagggggcgcccagggcgcaugggcacugagcugccgccugg

SEQ ID NO: 601083 - RNA, 64 nt, Homo Sapiens
gugggggguaucaaagaaggcacuuaaccggaggagggcgcaggaggggcagaaguuuugaaug

SEQ ID NO: 601084 - RNA, 64 nt, Homo Sapiens
ccugaucuuuauaggguugaguaggcucgugggcagggcgcagauuuuccagauggcuucagaa

SEQ ID NO: 601085 - RNA, 64 nt, Homo Sapiens
ggacgugaugcaaaauaaccgaugcccuacaaaaagggcgcaucuuuaagaguuuuaaugccag

SEQ ID NO: 601086 - RNA, 64 nt, Homo Sapiens
acuuuggaagcugcuacuuaagaagagggcgauuagggcgcagagaacucagcagaaaguggca

SEQ ID NO: 601087 - RNA, 64 nt, Homo Sapiens
gguugaugcauauuuccccguuuaaguagccguuagggcgcaguaucggcagcuugacacccac

SEQ ID NO: 601088 - RNA, 64 nt, Homo Sapiens
gaauggggcuaaggugggaggaugaguaaggguaagggcgcauggggaguuauuuugauacugc

SEQ ID NO: 601089 - RNA, 64 nt, Homo Sapiens
gcuuucccagagacccggggauggauuggccuccagggcgcaggggagggugcggcagggcagg

SEQ ID NO: 601090 - RNA, 64 nt, Homo Sapiens
caagcgggggccacuugagaagcccacucucccgagggcgcaucuggugcucuaggcugugcug

SEQ ID NO: 601091 - RNA, 64 nt, Homo Sapiens
cucacggaauguaaguguugagguuucugcaaagagggcgcaggcccugcagugacgguucaga

SEQ ID NO: 601092 - RNA, 64 nt, Homo Sapiens
gaaucacaucaaugcgaacgucacagcgccuucgagggcgcagauuuuaacugccacguauuuu

SEQ ID NO: 601093 - RNA, 64 nt, Homo Sapiens
ggaacguucacucacaggguacgcucauggagagagggcgcagagcaaaccaugucacgccauc

SEQ ID NO: 601094 - RNA, 64 nt, Homo Sapiens
cacaucccugcacccgguggugcggucuggucucagggcgcaaacucagaggaacacccagcgc

SEQ ID NO: 601095 - RNA, 64 nt, Homo Sapiens
agcccaggagauggccucagcuccuggccggcagagggcgcaggcugucccgcgugcggguccc

SEQ ID NO: 601096 - RNA, 64 nt, Homo Sapiens
gcuggcugcuccccggauacgccuccuccuccccagggcgcagccccggagccaguaacccggc

SEQ ID NO: 601097 - RNA, 64 nt, Homo Sapiens
cauuggugguugcagggcccaaaguggcagugcgagggcgcagccgucccagguacccgguggg

SEQ ID NO: 601098 - RNA, 64 nt, Homo Sapiens
gaaccaugccccauauaacgcuugggugcgugggagggcgcacaucagggcagaggccaaguuc

SEQ ID NO: 601099 - RNA, 64 nt, Homo Sapiens
gcugcuggaauauuucuggcuuuagaaguacaggagggcgcagauggcuaacugaguaacauuc

SEQ ID NO: 601100 - RNA, 64 nt, Homo Sapiens
ggcugccgagugcugugcacgcggaggcaggcugagggcgcaggcugcccgguucccagcugcu

SEQ ID NO: 601101 - RNA, 64 nt, Homo Sapiens
ugcaggucugccauccacggcagccacucccuccagggcgcacccgcugugggaggccggucgg

SEQ ID NO: 601102 - RNA, 64 nt, Homo Sapiens
agagaacccagccagaggggggggcagcggcugcagggcgcaccugaaggacagaguccugggu

SEQ ID NO: 601103 - RNA, 64 nt, Homo Sapiens
ggcgccccccuccauccuccccggcccggccuccagggcgcagacgucuccgccagaggccacc

SEQ ID NO: 601104 - RNA, 64 nt, Homo Sapiens
gggcucggcguggccccuuccgcccgccuuucugagggcgcagguucgacgcccuuucccggga

SEQ ID NO: 601105 - RNA, 64 nt, Homo Sapiens
ggcugagcggauaggggcgguggggugggggaggagggcgcacgaagaacuucccaugguagaa

SEQ ID NO: 601106 - RNA, 64 nt, Homo Sapiens
cccaggacaucugugccaggcccugcagcagagcagggcgcaaagagagggaaccugcucacgg

SEQ ID NO: 601107 - RNA, 64 nt, Homo Sapiens
guccccuccuucagaggaggggcagcaggaaggaagggcgcagcgacccgguaggggcagucug

SEQ ID NO: 601108 - RNA, 64 nt, Homo Sapiens
cguaacugguucccugaccaggucaccgacgaugagggcgcaccugcuguccuggagcuuccga

SEQ ID NO: 601109 - RNA, 64 nt, Homo Sapiens
cacaaacugauuucucacggcgugucaccccaccagggcgcaagccucacuauuacuugaacuu

SEQ ID NO: 601110 - RNA, 62 nt, Homo Sapiens
guggcucagaugaggaaugagccgagaugcggagggcgcagaugucccacugcacagcugga

SEQ ID NO: 601111 - RNA, 64 nt, Homo Sapiens
auccuaugaccaggcuuuuagaggaccuucccuaagggcgcagcuucggagcaggaucugucca

SEQ ID NO: 601112 - RNA, 64 nt, Homo Sapiens
auuguauagaauauauaauaggguccugccguuaagggcgcaggacaggacugaagcacugaaa

SEQ ID NO: 601113 - RNA, 64 nt, Homo Sapiens
gugauauuuuaggaauacaggggaggcugaagcaagggcgcaguacacccaaaccagucuauca

SEQ ID NO: 601114 - RNA, 64 nt, Homo Sapiens
cacuucagugcagugugguguagguguuacgcgaagggcgcacagugucuagaaauacuugauc

SEQ ID NO: 601115 - RNA, 64 nt, Homo Sapiens
gcacacccgcugggccagcacagaggggcagcgcagggcgcagaguagccacggagccgggacc

SEQ ID NO: 601116 - RNA, 64 nt, Homo Sapiens
gaacacggggagcagaggccaaagcacuaaggggagggcgcauacccgagacgauuguaugaag

SEQ ID NO: 601117 - RNA, 64 nt, Homo Sapiens
uggaggggacaggucugccgggcuggcuuuuugcagggcgcaggcaggccugggcccagcuccg

SEQ ID NO: 601118 - RNA, 64 nt, Homo Sapiens
gagaaguccccuuccaucccagagggugggcuucagggcgcacagcaugagaggcucugugccc

SEQ ID NO: 601119 - RNA, 64 nt, Homo Sapiens
auuugcugagcgccuccuaguugccaggcacuggagggcgcaucaaagaagaguccuacccagg

SEQ ID NO: 601120 - RNA, 64 nt, Homo Sapiens
uggcgguguccugcggaccccagagcccccgggaagggcgcaagucaaagagcacuggaggcac

SEQ ID NO: 601121 - RNA, 64 nt, Homo Sapiens
gguugaaacaucaggacacucgagacaggaaggcagggcgcaguggaguuggaacccugggcgu

SEQ ID NO: 601122 - RNA, 64 nt, Homo Sapiens
ggaagagggagggucagugccaagucucaggaggagggcgcauguguguaucacccucagcugg

SEQ ID NO: 601123 - RNA, 64 nt, Homo Sapiens
cauguggauauaggaaaagcuuuccauuggcuucagggcgcaucgggagaacauugaguccugu

SEQ ID NO: 601124 - RNA, 57 nt, Homo Sapiens
gggcaugggucgggagaggggggguaaagggcgcaaaaguacgaugccccgcuuuaa

SEQ ID NO: 601125 - RNA, 64 nt, Homo Sapiens
ccugaggaggcagguggagggaccagggcggugcagggcgcagccgccccuccacaggacccug

SEQ ID NO: 601126 - RNA, 64 nt, Homo Sapiens
cacaucuguugguucucaggcagcugcacaggccagggcgcaggccuggggacacaucugccca

SEQ ID NO: 601127 - RNA, 64 nt, Homo Sapiens
ggaggaagggggcagagagaguuaugaccccgagagggcgcacagaccaagcgugagcuccacg

SEQ ID NO: 601128 - RNA, 64 nt, Homo Sapiens
cggagcccagagcgcgcgucgaaccgucggcccgagggcgcagaccugaggcgaggccaccccc

SEQ ID NO: 601129 - RNA, 64 nt, Homo Sapiens
cucuuaguccaguagcugcauggugagugagcguagggcgcacccuggaaggcugccaagccca

SEQ ID NO: 601130 - RNA, 64 nt, Homo Sapiens
uuacucaacaucaaagaauuaggccuuuaggcagagggcgcaucugaaugucaggaauguagga

SEQ ID NO: 601131 - RNA, 64 nt, Homo Sapiens
aaccgaggacuccaggggcuugccgcgggcgagaagggcgcaggccaguggacucgcgagaggg

SEQ ID NO: 601132 - RNA, 64 nt, Homo Sapiens
ggcucaccccuguaaucucaagaaccuccaagucagggcgcagugaaaaaauaccaaauguaag

SEQ ID NO: 601133 - RNA, 64 nt, Homo Sapiens
cuguagacuggucuggccugcuggccugggcgucagggcgcaucaauaaaguacuuggaccagu

SEQ ID NO: 601134 - RNA, 64 nt, Homo Sapiens
uuggccucaugaagucucagguccguguucccgcagggcgcacaugcuuggagaguccucagca

SEQ ID NO: 601135 - RNA, 64 nt, Homo Sapiens
ggcggccuuucgaggcccuuggcagccuuuccacagggcgcagcgcuggcccaggcccugcagc

SEQ ID NO: 601136 - RNA, 64 nt, Homo Sapiens
agguggggccggggacuggccacugaauuaugccagggcgcacuuuccacuggaguucacuuuc

SEQ ID NO: 601137 - RNA, 64 nt, Homo Sapiens
cuuugagcucagaaaauaucccuccuguugggagagggcgcaggccgugacgucuggguggccc

SEQ ID NO: 601138 - RNA, 64 nt, Homo Sapiens
gucugcgggcugggaacucucguccucgguccccagggcgcagcuguuggggcugcgggggagu

SEQ ID NO: 601139 - RNA, 64 nt, Homo Sapiens; identical to SEQ ID NO: 430360

SEQ ID NO: 601140 - RNA, 64 nt, Homo Sapiens; identical to SEQ ID NO: 430361

SEQ ID NO: 601141 - RNA, 64 nt, Homo Sapiens; identical to SEQ ID NO: 430362

SEQ ID NO: 601142 - RNA, 64 nt, Homo Sapiens; identical to SEQ ID NO: 430363

SEQ ID NO: 601143 - RNA, 64 nt, Homo Sapiens; identical to SEQ ID NO: 430364

SEQ ID NO: 601144 - RNA, 64 nt, Homo Sapiens; identical to SEQ ID NO: 430365

SEQ ID NO: 601145 - RNA, 64 nt, Homo Sapiens; identical to SEQ ID NO: 430366

SEQ ID NO: 601146 - RNA, 64 nt, Homo Sapiens; identical to SEQ ID NO: 430367

SEQ ID NO: 601147 - RNA, 64 nt, Homo Sapiens; identical to SEQ ID NO: 430368

SEQ ID NO: 601148 - RNA, 64 nt, Homo Sapiens; identical to SEQ ID NO: 430369

SEQ ID NO: 601149 - RNA, 64 nt, Homo Sapiens; identical to SEQ ID NO: 430370

SEQ ID NO: 601150 - RNA, 64 nt, Homo Sapiens; identical to SEQ ID NO: 430371

SEQ ID NO: 601151 - RNA, 64 nt, Homo Sapiens; identical to SEQ ID NO: 430372

SEQ ID NO: 601152 - RNA, 64 nt, Homo Sapiens; identical to SEQ ID NO: 279869

SEQ ID NO: 601153 - RNA, 64 nt, Homo Sapiens; identical to SEQ ID NO: 279870

SEQ ID NO: 601154 - RNA, 64 nt, Homo Sapiens; identical to SEQ ID NO: 279871

SEQ ID NO: 601155 - RNA, 64 nt, Homo Sapiens; identical to SEQ ID NO: 279871

SEQ ID NO: 601156 - RNA, 64 nt, Homo Sapiens; identical to SEQ ID NO: 279873

SEQ ID NO: 601157 - RNA, 64 nt, Homo Sapiens; identical to SEQ ID NO: 279874

SEQ ID NO: 601158 - RNA, 64 nt, Homo Sapiens; identical to SEQ ID NO: 279875

SEQ ID NO: 601159 - RNA, 64 nt, Homo Sapiens; identical to SEQ ID NO: 279876

SEQ ID NO: 601160 - RNA, 64 nt, Homo Sapiens; identical to SEQ ID NO: 279877

SEQ ID NO: 601161 - RNA, 64 nt, Homo Sapiens; identical to SEQ ID NO: 279878

SEQ ID NO: 601162 - RNA, 64 nt, Homo Sapiens; identical to SEQ ID NO: 279879

SEQ ID NO: 601163 - RNA, 64 nt, Homo Sapiens; identical to SEQ ID NO: 279880

SEQ ID NO: 601164 - RNA, 64 nt, Homo Sapiens; identical to SEQ ID NO: 279881

SEQ ID NO: 601165 - RNA, 64 nt, Homo Sapiens; identical to SEQ ID NO: 279882

SEQ ID NO: 601166 - RNA, 64 nt, Homo Sapiens; identical to SEQ ID NO: 279883

SEQ ID NO: 601167 - RNA, 64 nt, Homo Sapiens; identical to SEQ ID NO: 279884

SEQ ID NO: 601168 - RNA, 64 nt, Homo Sapiens; identical to SEQ ID NO: 279885

SEQ ID NO: 601169 - RNA, 64 nt, Homo Sapiens; identical to SEQ ID NO: 279886

SEQ ID NO: 601170 - RNA, 64 nt, Homo Sapiens; identical to SEQ ID NO: 279887

SEQ ID NO: 601171 - RNA, 64 nt, Homo Sapiens; identical to SEQ ID NO: 279888

SEQ ID NO: 601172 - RNA, 64 nt, Homo Sapiens; identical to SEQ ID NO: 279889

SEQ ID NO: 601173 - RNA, 64 nt, Homo Sapiens; identical to SEQ ID NO: 279890

SEQ ID NO: 601174 - RNA, 64 nt, Homo Sapiens; identical to SEQ ID NO: 279891

SEQ ID NO: 601175 - RNA, 64 nt, Homo Sapiens; identical to SEQ ID NO: 279892

SEQ ID NO: 601176 - RNA, 64 nt, Homo Sapiens; identical to SEQ ID NO: 279893

SEQ ID NO: 601177 - RNA, 64 nt, Homo Sapiens; identical to SEQ ID NO: 279894

SEQ ID NO: 601178 - RNA, 64 nt, Homo Sapiens; identical to SEQ ID NO: 279895

SEQ ID NO: 601179 - RNA, 64 nt, Homo Sapiens; identical to SEQ ID NO: 279896

SEQ ID NO: 601180 - RNA, 64 nt, Homo Sapiens; identical to SEQ ID NO: 279897

SEQ ID NO: 601181 - RNA, 64 nt, Homo Sapiens; identical to SEQ ID NO: 279898

SEQ ID NO: 601182 - RNA, 64 nt, Homo Sapiens; identical to SEQ ID NO: 279898

SEQ ID NO: 601183 - RNA, 64 nt, Homo Sapiens
uuucaauagucugaauauuuuagaaauauaauuugaaugugaucuucauauauggcucuauucu

SEQ ID NO: 601184 - RNA, 64 nt, Homo Sapiens
cuuguuaugccucugucucuaagagauauuucuggaaugugagaccagaguuggggcauugagg

SEQ ID NO: 601185 - RNA, 64 nt, Homo Sapiens
aauccauacuagagagaagcccuacaaauguaaagaaugugaaaagucuuucagucagagcuca

SEQ ID NO: 601186 - RNA, 64 nt, Homo Sapiens
gcaucagauaauucacaccagagagaaacccucugaaugugacgaaugaagaaaagguauuagu

SEQ ID NO: 601187 - RNA, 64 nt, Homo Sapiens
aauucacaugggaauaaaauuccauugcugcaaugaaugugaaaaagccaucagucaaagaaac

SEQ ID NO: 601188 - RNA, 64 nt, Homo Sapiens
aggaaaucaacuugcuuaucuguugagcaucacagaaugugauauuaaacacuugcaaccuacc

SEQ ID NO: 601189 - RNA, 64 nt, Homo Sapiens
uucauggguauaguucauguaacuacaaccaauggaaugugaugagacucuuuaugcuugcaaa

SEQ ID NO: 601190 - RNA, 64 nt, Homo Sapiens
gcauaagauaauucauacuggagagaaacccuaugaaugugaugaaugugggaaagccuuuaac

SEQ ID NO: 601191 - RNA, 64 nt, Homo Sapiens
aguuuauauggaacacaaacccuacaaauauaaagaaugugacaaagcuuuuuaaggaaguucu

SEQ ID NO: 601192 - RNA, 64 nt, Homo Sapiens
aauucauaccauagagaaauccuacaaauaugaagaaugugacaaagcuuuuaaccacuucuca

SEQ ID NO: 601193 - RNA, 64 nt, Homo Sapiens
aauucauacaggagagaaacccuacaaaugugaagaaugugacaaagccuuuaaccaguccuca

SEQ ID NO: 601194 - RNA, 64 nt, Homo Sapiens
aagccuuuaaauggcugucaccuagaaaugugaagaaugugacaaaaucauaugaaugagaaau

SEQ ID NO: 601195 - RNA, 64 nt, Homo Sapiens
aagacuucaacuguuccucaccuacaaaugcgaagaaugugauaaauucauacuggagagaaac

SEQ ID NO: 601196 - RNA, 64 nt, Homo Sapiens
aaggcuucaaccgguccucaacuacaaacgugaagaaugugacaaauucaugcuggagagaaac

SEQ ID NO: 601197 - RNA, 64 nt, Homo Sapiens
ugguuuuuaaucaacaaucacuuacaagcacaaugaaugugacaaauucauaguggagagaaac

SEQ ID NO: 601198 - RNA, 64 nt, Homo Sapiens
aaaguuuucaguuguaaauccuuacaaaugggaggaaugugacaacuucauacuggagagaaac

SEQ ID NO: 601199 - RNA, 64 nt, Homo Sapiens
ugauccagaaauaagugcugaaggguuauaauuugaaugugaacguauucuugagaaaaagaua

SEQ ID NO: 601200 - RNA, 64 nt, Homo Sapiens
aaaucaugacuguuauuuuucuaugaaaaguuaugaaugugacugggaauauauuuauauuuuu

SEQ ID NO: 601201 - RNA, 64 nt, Homo Sapiens; identical to SEQ ID NO: 411023

SEQ ID NO: 601202 - RNA, 64 nt, Homo Sapiens; identical to SEQ ID NO: 411024

SEQ ID NO: 601203 - RNA, 64 nt, Homo Sapiens; identical to SEQ ID NO: 411025

SEQ ID NO: 601204 - RNA, 64 nt, Homo Sapiens; identical to SEQ ID NO: 411026

SEQ ID NO: 601205 - RNA, 64 nt, Homo Sapiens; identical to SEQ ID NO: 411027

SEQ ID NO: 601206 - RNA, 64 nt, Homo Sapiens; identical to SEQ ID NO: 411028

SEQ ID NO: 601207 - RNA, 64 nt, Homo Sapiens; identical to SEQ ID NO: 411029

SEQ ID NO: 601208 - RNA, 64 nt, Homo Sapiens; identical to SEQ ID NO: 411030

SEQ ID NO: 601209 - RNA, 64 nt, Homo Sapiens; identical to SEQ ID NO: 411031

SEQ ID NO: 601210 - RNA, 64 nt, Homo Sapiens; identical to SEQ ID NO: 411032

SEQ ID NO: 601211 - RNA, 64 nt, Homo Sapiens; identical to SEQ ID NO: 411033

SEQ ID NO: 601212 - RNA, 64 nt, Homo Sapiens; identical to SEQ ID NO: 411034

SEQ ID NO: 601213 - RNA, 64 nt, Homo Sapiens; identical to SEQ ID NO: 411035

SEQ ID NO: 601214 - RNA, 64 nt, Homo Sapiens; identical to SEQ ID NO: 411036

SEQ ID NO: 601215 - RNA, 64 nt, Homo Sapiens
ugcaaagaucguaaaaggacaaaacauuuuauggcagucuuaugucucuguuuaccugccuagg

SEQ ID NO: 601216 - RNA, 64 nt, Homo Sapiens
cuauguacacagauguaauucuguauuaugugaacagucuuauuccaguguuaguagcugcucc

SEQ ID NO: 601217 - RNA, 64 nt, Homo Sapiens
uuuaguuacagugcccauuuugaaauugccuauacagucuuagugaccauuuaaaccggacgaa

SEQ ID NO: 601218 - RNA, 64 nt, Homo Sapiens
ucagccagguuuugccacuacccuauaauuagugcagucuuauguuauaaaagaaagaaguuaa

SEQ ID NO: 601219 - RNA, 64 nt, Homo Sapiens
acaaaguuaaaauuaaaaaggaaaucaugacaagcagucuuagaauuauauaauuuucuaauuu

SEQ ID NO: 601220 - RNA, 64 nt, Homo Sapiens
uucauuuuccuuuguuuauaccuggccucuguugcagucuuaucuacaggcgugagccacugca

SEQ ID NO: 601221 - RNA, 64 nt, Homo Sapiens
ugaccuucacagucauucuguugaagcucuuucacagucuuauuuguguaguguuuuacaauuu

SEQ ID NO: 601222 - RNA, 64 nt, Homo Sapiens
cacagauugcaguaauucuggaaauauuuaaaagcagucuuauuuguaagauagcacacaagua

SEQ ID NO: 601223 - RNA, 64 nt, Homo Sapiens
uggguuaccgucucaugugaaccuggagauucaccagucuuaacuuuugggucauuguguuuuc

SEQ ID NO: 601224 - RNA, 64 nt, Homo Sapiens
cuacagagaacauacagcagccuucuuuggaccacagucuuauccgaggggucugugguuguau

SEQ ID NO: 601225 - RNA, 64 nt, Homo Sapiens
ccaaauauaugaaauuacuaucccuuccaucuaucagucuuacucaacaauuuaguugaaugac

SEQ ID NO: 601226 - RNA, 64 nt, Homo Sapiens
ccuugcccugccucaguuuauuauaaaaugguagcagucuuagugaagugaaggcuuuugaggu

SEQ ID NO: 601227 - RNA, 64 nt, Homo Sapiens
aaaauauauauuuuaaguuuauggagaauauaaacauauacagaguaguguagucaggugcuca

SEQ ID NO: 601228 - RNA, 64 nt, Homo Sapiens
uggaacauugaggauggaaauucagacacuaccccauauacaccgauagucacagugauaccag

SEQ ID NO: 601229 - RNA, 64 nt, Homo Sapiens
aauaaacagacaaaaacaaguaaauauauauggucauauacauauuguauauauauucauauac

SEQ ID NO: 601230 - RNA, 64 nt, Homo Sapiens
auauauauggucauauacauauuguauauauauucauauacaaacauguauguauacaugaccu

SEQ ID NO: 601231 - RNA, 64 nt, Homo Sapiens
uuggagauaucuuccaucaagcaguacucgugcccauauacaaucucuuaguggcuaggagaaa

SEQ ID NO: 601232 - RNA, 64 nt, Homo Sapiens
gagagaaaacaaaccuaaguuuacuuuacuuguacauauacacuacaauggauaguauauuugc

SEQ ID NO: 601233 - RNA, 64 nt, Homo Sapiens
caugauuuucuagauacacagucuaugcauuauucauauacauuuauuuuagccuaaagugguu

SEQ ID NO: 601234 - RNA, 64 nt, Homo Sapiens
uugaauauucuugaacaccaccacugaagaguuucauauacaccaaauaaugucucaucucuau

SEQ ID NO: 601235 - RNA, 64 nt, Homo Sapiens
ucucuguccaaaauuuccucuauguguguauacacauauacacauauacacaucuauguaugga

SEQ ID NO: 601236 - RNA, 64 nt, Homo Sapiens
ucuauguauggauauguguguguacauauauacacauauacacaucuguacauauacaugugag

SEQ ID NO: 601237 - RNA, 64 nt, Homo Sapiens
ugaguguacauauauacacacacacauaucuguacauauacauguauguguguggauauagaug

SEQ ID NO: 601238 - RNA, 64 nt, Homo Sapiens
acauacacacaauauguauugaugcacaugcguacauauacauauaugcaugcauguguauaaa

SEQ ID NO: 601239 - RNA, 64 nt, Homo Sapiens
guagaaagguugaacugguuuuucagcuauaaugcauauacaacuauaguguguacguauacca

SEQ ID NO: 601240 - RNA, 64 nt, Homo Sapiens
aaugcauauacaacuauaguguguacguauaccacauauacauauacuuguaugaagauaugug

SEQ ID NO: 601241 - RNA, 64 nt, Homo Sapiens
auaaauacucauuugauucuuauauacacacacacauauacagucagauuaauuuauauauaua

SEQ ID NO: 601242 - RNA, 64 nt, Homo Sapiens
caccucuauauguuaaauaaaaucaagcuuuuaacauauacaucagucauauucauagacacag

SEQ ID NO: 601243 - RNA, 64 nt, Homo Sapiens
aauauaccuugagcaugaaucacacagacacaugcauauacauguguacauauacauguauaua

SEQ ID NO: 601244 - RNA, 64 nt, Homo Sapiens
uauauacacacagacacaugugcaaauauauguacauauacauguaaaugcauguguauauaua

SEQ ID NO: 601245 - RNA, 64 nt, Homo Sapiens
uuauauacauagccuaaaggauucauuuaugcuucauauacaccgacucaagacuaaacaugaa

SEQ ID NO: 601246 - RNA, 64 nt, Homo Sapiens
cgauaucuuggggaugagacuuuuggaauauuugcauauacauggaaguguuuugaauuucaga

SEQ ID NO: 601247 - RNA, 64 nt, Homo Sapiens; identical to SEQ ID NO: 380943

SEQ ID NO: 601248 - RNA, 64 nt, Homo Sapiens; identical to SEQ ID NO: 380944

SEQ ID NO: 601249 - RNA, 64 nt, Homo Sapiens; identical to SEQ ID NO: 380945

SEQ ID NO: 601250 - RNA, 64 nt, Homo Sapiens; identical to SEQ ID NO: 380946

SEQ ID NO: 601251 - RNA, 64 nt, Homo Sapiens; identical to SEQ ID NO: 380947

SEQ ID NO: 601252 - RNA, 64 nt, Homo Sapiens; identical to SEQ ID NO: 380948

SEQ ID NO: 601253 - RNA, 64 nt, Homo Sapiens; identical to SEQ ID NO: 380949

SEQ ID NO: 601254 - RNA, 64 nt, Homo Sapiens; identical to SEQ ID NO: 380950

SEQ ID NO: 601255 - RNA, 64 nt, Homo Sapiens; identical to SEQ ID NO: 380951

SEQ ID NO: 601256 - RNA, 64 nt, Homo Sapiens; identical to SEQ ID NO: 380952

SEQ ID NO: 601257 - RNA, 64 nt, Homo Sapiens; identical to SEQ ID NO: 380953

SEQ ID NO: 601258 - RNA, 64 nt, Homo Sapiens; identical to SEQ ID NO: 380954

SEQ ID NO: 601259 - RNA, 64 nt, Homo Sapiens; identical to SEQ ID NO: 380955

SEQ ID NO: 601260 - RNA, 64 nt, Homo Sapiens; identical to SEQ ID NO: 380956

SEQ ID NO: 601261 - RNA, 64 nt, Homo Sapiens; identical to SEQ ID NO: 380957

SEQ ID NO: 601262 - RNA, 64 nt, Homo Sapiens; identical to SEQ ID NO: 380958

SEQ ID NO: 601263 - RNA, 64 nt, Homo Sapiens; identical to SEQ ID NO: 380959

SEQ ID NO: 601264 - RNA, 64 nt, Homo Sapiens; identical to SEQ ID NO: 380960

SEQ ID NO: 601265 - RNA, 64 nt, Homo Sapiens; identical to SEQ ID NO: 380961

SEQ ID NO: 601266 - RNA, 64 nt, Homo Sapiens; identical to SEQ ID NO: 380962

SEQ ID NO: 601267 - RNA, 64 nt, Homo Sapiens; identical to SEQ ID NO: 380963

SEQ ID NO: 601268 - RNA, 64 nt, Homo Sapiens; identical to SEQ ID NO: 380964

SEQ ID NO: 601269 - RNA, 64 nt, Homo Sapiens; identical to SEQ ID NO: 380965

SEQ ID NO: 601270 - RNA, 64 nt, Homo Sapiens; identical to SEQ ID NO: 380966

SEQ ID NO: 601271 - RNA, 64 nt, Homo Sapiens; identical to SEQ ID NO: 380967

SEQ ID NO: 601272 - RNA, 64 nt, Homo Sapiens; identical to SEQ ID NO: 380968

SEQ ID NO: 601273 - RNA, 64 nt, Homo Sapiens; identical to SEQ ID NO: 380969

SEQ ID NO: 601274 - RNA, 64 nt, Homo Sapiens; identical to SEQ ID NO: 380970

SEQ ID NO: 601275 - RNA, 64 nt, Homo Sapiens; identical to SEQ ID NO: 380971

SEQ ID NO: 601276 - RNA, 64 nt, Homo Sapiens; identical to SEQ ID NO: 484813

SEQ ID NO: 601277 - RNA, 64 nt, Homo Sapiens; identical to SEQ ID NO: 484814

SEQ ID NO: 601278 - RNA, 64 nt, Homo Sapiens; identical to SEQ ID NO: 484815

SEQ ID NO: 601279 - RNA, 64 nt, Homo Sapiens; identical to SEQ ID NO: 484816

SEQ ID NO: 601280 - RNA, 64 nt, Homo Sapiens; identical to SEQ ID NO: 484817

SEQ ID NO: 601281 - RNA, 64 nt, Homo Sapiens; identical to SEQ ID NO: 484818

SEQ ID NO: 601282 - RNA, 64 nt, Homo Sapiens; identical to SEQ ID NO: 484819

SEQ ID NO: 601283 - RNA, 64 nt, Homo Sapiens; identical to SEQ ID NO: 484820

SEQ ID NO: 601284 - RNA, 64 nt, Homo Sapiens; identical to SEQ ID NO: 484821

SEQ ID NO: 601285 - RNA, 64 nt, Homo Sapiens; identical to SEQ ID NO: 484822

SEQ ID NO: 601286 - RNA, 64 nt, Homo Sapiens; identical to SEQ ID NO: 484823

SEQ ID NO: 601287 - RNA, 64 nt, Homo Sapiens; identical to SEQ ID NO: 484824

SEQ ID NO: 601288 - RNA, 64 nt, Homo Sapiens; identical to SEQ ID NO: 484825

SEQ ID NO: 601289 - RNA, 64 nt, Homo Sapiens; identical to SEQ ID NO: 484826

SEQ ID NO: 601290 - RNA, 64 nt, Homo Sapiens
ccuuugcgcuuucgcaguccaguguuugccgcgguucccgcacggucaggccccaggacuggcu

SEQ ID NO: 601291 - RNA, 64 nt, Homo Sapiens
caugccauugcaccuucuuuagucuugauugcccuucccgcauuuauugguguauuaaaaugac

SEQ ID NO: 601292 - RNA, 64 nt, Homo Sapiens
aagggaaguuauuuuuaaaaagguacucugcauguucccgcaguaauguucugcacaacaguau

SEQ ID NO: 601293 - RNA, 64 nt, Homo Sapiens
cgccuggcccagccugggcaugcccgugaggagcuucccgcagcaggcacaagacguucuccuc

SEQ ID NO: 601294 - RNA, 64 nt, Homo Sapiens
uuuaggaaaauuuauuuauuugguucaugccuucuucccgcaacagcuacaccacagaugccag

SEQ ID NO: 601295 - RNA, 64 nt, Homo Sapiens
ucaacacuuucugcacuuaucccuccuugggcucuucccgcaaaauauugcuucccugcuauuu

SEQ ID NO: 601296 - RNA, 64 nt, Homo Sapiens
caugggacaugaggggcagcuagacuucacccccuucccgcagaccugccuccagagcaaggag

SEQ ID NO: 601297 - RNA, 64 nt, Homo Sapiens
auacuggcuucauuacacuuguacagccgaguucuucccgcauuacugcuguuuaauagaacgu

SEQ ID NO: 601298 - RNA, 64 nt, Homo Sapiens
uuccaauucacuuuuaaaaaccugcuguuuaaauuucccgcauaaggcauuaaauagaagaauc

SEQ ID NO: 601299 - RNA, 64 nt, Homo Sapiens
ccccugcagguccucugcgauggcauugucucgguucccgcagugcugcaguguggaagggagu

SEQ ID NO: 601300 - RNA, 64 nt, Homo Sapiens
cuauaaagagcaauguuuucuagggcauuaaaaauucccgcaaaaggcuguuggaguuucuguu

SEQ ID NO: 601301 - RNA, 64 nt, Homo Sapiens
cccccuuugugcuguggggcugugguuugguguguucccgcaaaccucagguugcugguugcug

SEQ ID NO: 601302 - RNA, 64 nt, Homo Sapiens
caagcuucacauaaagccuggcaagccaaggauguucccgcauucaccugcuuuugcaguaaua

SEQ ID NO: 601303 - RNA, 64 nt, Homo Sapiens
uaaguguucgggggacaucagcaugugugguucuuucccgcacugauccccuccauuuuuuguu

SEQ ID NO: 601304 - RNA, 64 nt, Homo Sapiens
cugguuccuacaguauccacuccauccucaaggcuucccgcagggccuuggggcacugccuugc

SEQ ID NO: 601305 - RNA, 64 nt, Homo Sapiens
cucugcccagggaguccuugcgucccaugaggucuucccgcaaggccucucagacccagaugug

SEQ ID NO: 601306 - RNA, 64 nt, Homo Sapiens
cgacuuucacacucugccaucauagaguccuggcuucccgcagaccccagugugaaguuucugg

SEQ ID NO: 601307 - RNA, 64 nt, Homo Sapiens
aucaggggagcgcuccacuggauaagcauuuuauuucccgcauggcauaauguuuuugcacuaa

SEQ ID NO: 601308 - RNA, 64 nt, Homo Sapiens
ugcagagaggaggaagacuauuggccaguccucuuucccgcagcacugaccccaccugaaauuc

SEQ ID NO: 601309 - RNA, 64 nt, Homo Sapiens
cuguuguuuagcuuaccuuucugcuaggauuggcuucccgcagagggcagggcccauccuaagc

SEQ ID NO: 601310 - RNA, 64 nt, Homo Sapiens
ccaaagagagugugacucccccuugaugggugcguucccgcagacuccccaggugccccccuca

SEQ ID NO: 601311 - RNA, 64 nt, Homo Sapiens
gucugcguccgcacagcauaggacaccuguuuccuucccgcaguccgaagguuuggccgccgcg

SEQ ID NO: 601312 - RNA, 64 nt, Homo Sapiens
ucagaaacucacugugauucugcuuuagagcaacuucccgcaaacaggcaaaguccucagccag

SEQ ID NO: 601313 - RNA, 64 nt, Homo Sapiens
gugccucugggggaccccccacccuggucccaguuucccgcaaacgcaagccccccagccuccc

SEQ ID NO: 601314 - RNA, 64 nt, Homo Sapiens
aauuccacauagaggccuucuuccuauuuauuucuucccgcacacacuauucucugccuuuuuu

SEQ ID NO: 601315 - RNA, 64 nt, Homo Sapiens
aggcagggugacccccugaacuguggacauugacuucccgcauauaugagaaaugaauguaaca

SEQ ID NO: 601316 - RNA, 64 nt, Homo Sapiens
gcagaugaaugugucauguggcacaccuugucccuucccgcagcauuuccugguuccccccaga

SEQ ID NO: 601317 - RNA, 64 nt, Homo Sapiens
cagccuuacccaccgcucuacgugucccgggcacuucccgcagccuucccgucccuuucucauc

SEQ ID NO: 601318 - RNA, 64 nt, Homo Sapiens
ggaggggcuuggagcagagacggcagccccauccuucccgcagcaccagccugagccacagugg

SEQ ID NO: 601319 - RNA, 56 nt, Homo Sapiens
caccagcgugagcucucugauccuccuucccgcagcgcaacagccccugugcguga

SEQ ID NO: 601320 - RNA, 64 nt, Homo Sapiens
ccaugcagcgcugccgugacgcuacuuugugcaguucccgcagggcucuuccgccaacccagca

SEQ ID NO: 601321 - RNA, 64 nt, Homo Sapiens
ccaggggggcugcagcccucagcccccgccaggauucccgcaggcuccuggacuggaagcuccc

SEQ ID NO: 601322 - RNA, 64 nt, Homo Sapiens
guugaggaauuccuuacucuucguuucuccaggauucccgcagugaaaaccuuugugaauuacu

SEQ ID NO: 601323 - RNA, 64 nt, Homo Sapiens
gaauauuaaauuauguuucgaaguccaguugucauucccgcauucagauuucauuugcuguugc

SEQ ID NO: 601324 - RNA, 64 nt, Homo Sapiens
cccaaucuuccuucuuuugcuucucgcccaccucuucccgcacccagcaugcagcucugccucc

SEQ ID NO: 601325 - RNA, 64 nt, Homo Sapiens
acugaguuggguuccuaaucuguuucuggccugauucccgcaugaguauuagggugaucuuaaa

SEQ ID NO: 601326 - RNA, 64 nt, Homo Sapiens
cagcagucuguucuuggcugggucaacucugcuuuucccgcaaccugggguugucgggggagcg

SEQ ID NO: 601327 - RNA, 64 nt, Homo Sapiens
acaggccagaguugggcucuagcuccuggugcuguucccgcauucacccacuggccuuucccac

SEQ ID NO: 601328 - RNA, 64 nt, Homo Sapiens
aguuuacuucuaaucaugucccucucaauuuuauuucccgcaguccaggaguguuauguuuugc

SEQ ID NO: 601329 - RNA, 64 nt, Homo Sapiens
agcgugcccucagccaagugcuuuggcccggugcuucccgcagcugcacagagaccuuggccac

SEQ ID NO: 601330 - RNA, 64 nt, Homo Sapiens
gccgccagcgcccgcagacacugggccucggcccuucccgcaccggagccaggcuggcccaguc

SEQ ID NO: 601331 - RNA, 64 nt, Homo Sapiens
augcagguaaggugaaccagcugcacggaccagguucccgcaaaacauugccagcuagugaggc

SEQ ID NO: 601332 - RNA, 64 nt, Homo Sapiens
guccuagucccaguuguauucaugaagaauaugcuucccgcauuaagccuuuugguuaccgccu

SEQ ID NO: 601333 - RNA, 64 nt, Homo Sapiens
aguucucugagccgcggacaugcccucgcauugcuucccgcagagugcagagacaggaagcugg

SEQ ID NO: 601334 - RNA, 64 nt, Homo Sapiens
gccagaggcuaaaaccccaggaccccugcuguccuucccgcagcuucuucuuggagucucaggg

SEQ ID NO: 601335 - RNA, 64 nt, Homo Sapiens
uggacaaggaggcuguuucugcacaucagcucauuucccgcaccccauuucuugcuugauugcu

SEQ ID NO: 601336 - RNA, 64 nt, Homo Sapiens
gccucagccagagcugccagagaaaggaaaccucuucccgcagccuggcuccuguguucccucu

SEQ ID NO: 601337 - RNA, 64 nt, Homo Sapiens
uagccuuccucugcucugggaccagugguuuauuuucccgcaaacgcugagugacucggggccg

SEQ ID NO: 601338 - RNA, 64 nt, Homo Sapiens
uggggggugugcggaggcgcuccuucaaggaggguucccgcagcggcagcccuccccgccccuc

SEQ ID NO: 601339 - RNA, 58 nt, Homo Sapiens
caaauuggaugggcgucuggagagcgaguucccgcaggaguuugugaagaaaagguga

SEQ ID NO: 601340 - RNA, 64 nt, Homo Sapiens
cugggcuggcuggugguuuuuugaagcggugggguucccgcaccgccgugggaccgcgugagaa

SEQ ID NO: 601341 - RNA, 64 nt, Homo Sapiens
gauccccuccauuuuuugugacaugugugguuguuucccgcacuuaaguguucgggggacguca

SEQ ID NO: 601342 - RNA, 64 nt, Homo Sapiens
agggaacggguuguaaauggucuccguggcuggcuucccgcacuccugccgucaguucuuccuu

SEQ ID NO: 601343 - RNA, 64 nt, Homo Sapiens
ugguguggggggcugggggaucagacccccccauuucccgcacauuucucuuccccuuccuguu

SEQ ID NO: 601344 - RNA, 64 nt, Homo Sapiens
ugcauggacugccccgguucggguccgacauguguucccgcaccuggcguguuccuugcucccu

SEQ ID NO: 601345 - RNA, 64 nt, Homo Sapiens
cuuaaaggaaugcagugcucaaaaccuacccaaauucccgcaggauucuaccaaacccuucccc

SEQ ID NO: 601346 - RNA, 64 nt, Homo Sapiens
caucugagcucugugccggggguggaggggccgcuucccgcagggcaucgucuucccuuccgca

SEQ ID NO: 601347 - RNA, 64 nt, Homo Sapiens
aaggacuuccacuucaacacuuccacuucaacaguucccgcacggccugaacgcuucuuaggcc

SEQ ID NO: 601348 - RNA, 64 nt, Homo Sapiens
ccccagagcccaggcucggccugcccccaccccauucccgcagugggagcaaacugcaugccca

SEQ ID NO: 601349 - RNA, 64 nt, Homo Sapiens
uucaagccugugcaaugcauuagggaugccuccuuucccgcaggggauggacgaucucccaccu

SEQ ID NO: 601350 - RNA, 64 nt, Homo Sapiens
ucaguuccugacugugcaaguauuugggggaguuuucccgcaguguuucucggaccguugacuu

SEQ ID NO: 601351 - RNA, 64 nt, Homo Sapiens
gcagaagccgccagggcaggcccacggagggcccuucccgcaaagcacagggacacagccagag

SEQ ID NO: 601352 - RNA, 64 nt, Homo Sapiens
cguggacgauucuccaggacggaaaccgagaugcuucccgcagcgagaggacuuaaaagcagaa

SEQ ID NO: 601353 - RNA, 64 nt, Homo Sapiens
gaagacgaagccaggugccacccuauccuccaccuucccgcaggcaaaggugagagaucaccuu

SEQ ID NO: 601354 - RNA, 64 nt, Homo Sapiens
acccuugccugcgcuggccccuaacguggccuucuucccgcaccuuuggacauggccuauguac

SEQ ID NO: 601355 - RNA, 64 nt, Homo Sapiens
cgucagaagcucagagccuuugccugugagagccuucccgcaccgagucccauuagcugugaga

SEQ ID NO: 601356 - RNA, 62 nt, Homo Sapiens
cguauuuauacagcugcuuccccggagggacuuucccgcaccucagcaaacucuccaaguga

SEQ ID NO: 601357 - RNA, 64 nt, Homo Sapiens
cccauagacagccugggggcaaguuagcacuuuauucccgcagcaguuccugaaugggguggcc

SEQ ID NO: 601358 - RNA, 64 nt, Homo Sapiens
gcagggcuuggccucaugaagucucagguccguguucccgcagggcgcacaugcuuggagaguc

SEQ ID NO: 601359 - RNA, 64 nt, Homo Sapiens
cuauucccccagccucuuucgugucugcgaugucuucccgcacucaguuucugaggucagacga

SEQ ID NO: 601360 - RNA, 64 nt, Homo Sapiens
aggugcaggacugccagggaggugcagagaacuuuucccgcaacacauggauagacggagcugu

SEQ ID NO: 601361 - RNA, 64 nt, Homo Sapiens
uaagagagcaguuuuugggcuuuauauucucaauuucccgcacagugccuagcacauagcaagg

SEQ ID NO: 601362 - RNA, 64 nt, Homo Sapiens
uaucuuuacugucauucugaccauagccucuuuguucccgcauucgaacuuuugguucuuacuu

SEQ ID NO: 601363 - RNA, 64 nt, Homo Sapiens
ggggaugcagcuguuggacauagagaauugguguuucccgcagucccugcucacuccagucaca

SEQ ID NO: 601364 - RNA, 64 nt, Homo Sapiens
acggcucccacguccaggcuuaagguggaugcacuucccgcaccuccagucuucuguguagcag

SEQ ID NO: 601365 - RNA, 64 nt, Homo Sapiens
guuuuuauaauauucauacauuuacaacuccugauucccgcaugagaaggagcagaauaaaugu

SEQ ID NO: 601366 - RNA, 64 nt, Homo Sapiens
gcugagggauguggucagcaaaucucaugccauuuucccgcagaagauuccugaccauccucag

SEQ ID NO: 601367 - RNA, 64 nt, Homo Sapiens; identical to SEQ ID NO: 282773

SEQ ID NO: 601368 - RNA, 64 nt, Homo Sapiens; identical to SEQ ID NO: 282774

SEQ ID NO: 601369 - RNA, 64 nt, Homo Sapiens; identical to SEQ ID NO: 282775

SEQ ID NO: 601370 - RNA, 64 nt, Homo Sapiens; identical to SEQ ID NO: 282776

SEQ ID NO: 601371 - RNA, 64 nt, Homo Sapiens; identical to SEQ ID NO: 282777

SEQ ID NO: 601372 - RNA, 64 nt, Homo Sapiens; identical to SEQ ID NO: 282778

SEQ ID NO: 601373 - RNA, 64 nt, Homo Sapiens; identical to SEQ ID NO: 282779

SEQ ID NO: 601374 - RNA, 64 nt, Homo Sapiens; identical to SEQ ID NO: 282780

SEQ ID NO: 601375 - RNA, 64 nt, Homo Sapiens; identical to SEQ ID NO: 282781

SEQ ID NO: 601376 - RNA, 64 nt, Homo Sapiens; identical to SEQ ID NO: 282782

SEQ ID NO: 601377 - RNA, 64 nt, Homo Sapiens; identical to SEQ ID NO: 282783

SEQ ID NO: 601378 - RNA, 54 nt, Homo Sapiens; identical to SEQ ID NO: 282784

SEQ ID NO: 601379 - RNA, 64 nt, Homo Sapiens; identical to SEQ ID NO: 282785

SEQ ID NO: 601380 - RNA, 64 nt, Homo Sapiens; identical to SEQ ID NO: 282786

SEQ ID NO: 601381 - RNA, 64 nt, Homo Sapiens; identical to SEQ ID NO: 282787

SEQ ID NO: 601382 - RNA, 64 nt, Homo Sapiens; identical to SEQ ID NO: 282788

SEQ ID NO: 601383 - RNA, 64 nt, Homo Sapiens; identical to SEQ ID NO: 282789

SEQ ID NO: 601384 - RNA, 64 nt, Homo Sapiens; identical to SEQ ID NO: 282790

SEQ ID NO: 601385 - RNA, 64 nt, Homo Sapiens; identical to SEQ ID NO: 282791

SEQ ID NO: 601386 - RNA, 64 nt, Homo Sapiens; identical to SEQ ID NO: 282792

SEQ ID NO: 601387 - RNA, 64 nt, Homo Sapiens; identical to SEQ ID NO: 282793

SEQ ID NO: 601388 - RNA, 64 nt, Homo Sapiens; identical to SEQ ID NO: 282794

SEQ ID NO: 601389 - RNA, 64 nt, Homo Sapiens; identical to SEQ ID NO: 282795

SEQ ID NO: 601390 - RNA, 64 nt, Homo Sapiens; identical to SEQ ID NO: 282796

SEQ ID NO: 601391 - RNA, 64 nt, Homo Sapiens; identical to SEQ ID NO: 282797

SEQ ID NO: 601392 - RNA, 64 nt, Homo Sapiens; identical to SEQ ID NO: 282798

SEQ ID NO: 601393 - RNA, 64 nt, Homo Sapiens; identical to SEQ ID NO: 282799

SEQ ID NO: 601394 - RNA, 64 nt, Homo Sapiens; identical to SEQ ID NO: 282800

SEQ ID NO: 601395 - RNA, 64 nt, Homo Sapiens; identical to SEQ ID NO: 282801

SEQ ID NO: 601396 - RNA, 64 nt, Homo Sapiens; identical to SEQ ID NO: 282802

SEQ ID NO: 601397 - RNA, 64 nt, Homo Sapiens; identical to SEQ ID NO: 282803

SEQ ID NO: 601398 - RNA, 64 nt, Homo Sapiens; identical to SEQ ID NO: 282804

SEQ ID NO: 601399 - RNA, 64 nt, Homo Sapiens; identical to SEQ ID NO: 282805

SEQ ID NO: 601400 - RNA, 64 nt, Homo Sapiens; identical to SEQ ID NO: 282806

SEQ ID NO: 601401 - RNA, 64 nt, Homo Sapiens; identical to SEQ ID NO: 282807

SEQ ID NO: 601402 - RNA, 64 nt, Homo Sapiens; identical to SEQ ID NO: 282808

SEQ ID NO: 601403 - RNA, 64 nt, Homo Sapiens; identical to SEQ ID NO: 282809

SEQ ID NO: 601404 - RNA, 64 nt, Homo Sapiens; identical to SEQ ID NO: 282810

SEQ ID NO: 601405 - RNA, 64 nt, Homo Sapiens; identical to SEQ ID NO: 282811

SEQ ID NO: 601406 - RNA, 64 nt, Homo Sapiens; identical to SEQ ID NO: 282812

SEQ ID NO: 601407 - RNA, 64 nt, Homo Sapiens; identical to SEQ ID NO: 282813

SEQ ID NO: 601408 - RNA, 64 nt, Homo Sapiens; identical to SEQ ID NO: 282814

SEQ ID NO: 601409 - RNA, 64 nt, Homo Sapiens; identical to SEQ ID NO: 282815

SEQ ID NO: 601410 - RNA, 64 nt, Homo Sapiens; identical to SEQ ID NO: 282816

SEQ ID NO: 601411 - RNA, 64 nt, Homo Sapiens; identical to SEQ ID NO: 282817

SEQ ID NO: 601412 - RNA, 64 nt, Homo Sapiens; identical to SEQ ID NO: 282818

SEQ ID NO: 601413 - RNA, 64 nt, Homo Sapiens; identical to SEQ ID NO: 282819

SEQ ID NO: 601414 - RNA, 64 nt, Homo Sapiens; identical to SEQ ID NO: 282820

SEQ ID NO: 601415 - RNA, 64 nt, Homo Sapiens; identical to SEQ ID NO: 282821

SEQ ID NO: 601416 - RNA, 64 nt, Homo Sapiens; identical to SEQ ID NO: 282822

SEQ ID NO: 601417 - RNA, 64 nt, Homo Sapiens; identical to SEQ ID NO: 282823

SEQ ID NO: 601418 - RNA, 64 nt, Homo Sapiens; identical to SEQ ID NO: 282824

SEQ ID NO: 601419 - RNA, 64 nt, Homo Sapiens; identical to SEQ ID NO: 282825

SEQ ID NO: 601420 - RNA, 64 nt, Homo Sapiens; identical to SEQ ID NO: 282826

SEQ ID NO: 601421 - RNA, 64 nt, Homo Sapiens; identical to SEQ ID NO: 282827

SEQ ID NO: 601422 - RNA, 64 nt, Homo Sapiens; identical to SEQ ID NO: 282828

SEQ ID NO: 601423 - RNA, 64 nt, Homo Sapiens; identical to SEQ ID NO: 282829

SEQ ID NO: 601424 - RNA, 64 nt, Homo Sapiens; identical to SEQ ID NO: 282830

SEQ ID NO: 601425 - RNA, 64 nt, Homo Sapiens; identical to SEQ ID NO: 282831

SEQ ID NO: 601426 - RNA, 64 nt, Homo Sapiens; identical to SEQ ID NO: 282832

SEQ ID NO: 601427 - RNA, 64 nt, Homo Sapiens; identical to SEQ ID NO: 282833

SEQ ID NO: 601428 - RNA, 53 nt, Homo Sapiens; identical to SEQ ID NO: 282834

SEQ ID NO: 601429 - RNA, 64 nt, Homo Sapiens; identical to SEQ ID NO: 282835

SEQ ID NO: 601430 - RNA, 64 nt, Homo Sapiens; identical to SEQ ID NO: 282836

SEQ ID NO: 601431 - RNA, 64 nt, Homo Sapiens; identical to SEQ ID NO: 282837

SEQ ID NO: 601432 - RNA, 64 nt, Homo Sapiens; identical to SEQ ID NO: 282838

SEQ ID NO: 601433 - RNA, 64 nt, Homo Sapiens; identical to SEQ ID NO: 282839

SEQ ID NO: 601434 - RNA, 64 nt, Homo Sapiens; identical to SEQ ID NO: 282840

SEQ ID NO: 601435 - RNA, 64 nt, Homo Sapiens; identical to SEQ ID NO: 282841

SEQ ID NO: 601436 - RNA, 64 nt, Homo Sapiens; identical to SEQ ID NO: 282842

SEQ ID NO: 601437 - RNA, 64 nt, Homo Sapiens; identical to SEQ ID NO: 282843

SEQ ID NO: 601438 - RNA, 64 nt, Homo Sapiens; identical to SEQ ID NO: 282844

SEQ ID NO: 601439 - RNA, 64 nt, Homo Sapiens; identical to SEQ ID NO: 282845

SEQ ID NO: 601440 - RNA, 64 nt, Homo Sapiens; identical to SEQ ID NO: 282846

SEQ ID NO: 601441 - RNA, 53 nt, Homo Sapiens; identical to SEQ ID NO: 282847

SEQ ID NO: 601442 - RNA, 64 nt, Homo Sapiens; identical to SEQ ID NO: 282848

SEQ ID NO: 601443 - RNA, 64 nt, Homo Sapiens; identical to SEQ ID NO: 282849

SEQ ID NO: 601444 - RNA, 64 nt, Homo Sapiens; identical to SEQ ID NO: 282850

SEQ ID NO: 601445 - RNA, 64 nt, Homo Sapiens; identical to SEQ ID NO: 282851

SEQ ID NO: 601446 - RNA, 64 nt, Homo Sapiens; identical to SEQ ID NO: 282852

SEQ ID NO: 601447 - RNA, 64 nt, Homo Sapiens; identical to SEQ ID NO: 282853

SEQ ID NO: 601448 - RNA, 64 nt, Homo Sapiens; identical to SEQ ID NO: 282854

SEQ ID NO: 601449 - RNA, 64 nt, Homo Sapiens; identical to SEQ ID NO: 282855

SEQ ID NO: 601450 - RNA, 64 nt, Homo Sapiens; identical to SEQ ID NO: 282856

SEQ ID NO: 601451 - RNA, 64 nt, Homo Sapiens; identical to SEQ ID NO: 282857

SEQ ID NO: 601452 - RNA, 64 nt, Homo Sapiens; identical to SEQ ID NO: 282858

SEQ ID NO: 601453 - RNA, 64 nt, Homo Sapiens; identical to SEQ ID NO: 282859

SEQ ID NO: 601454 - RNA, 64 nt, Homo Sapiens; identical to SEQ ID NO: 282860

SEQ ID NO: 601455 - RNA, 64 nt, Homo Sapiens; identical to SEQ ID NO: 282861

SEQ ID NO: 601456 - RNA, 64 nt, Homo Sapiens; identical to SEQ ID NO: 282862

SEQ ID NO: 601457 - RNA, 64 nt, Homo Sapiens; identical to SEQ ID NO: 282863

SEQ ID NO: 601458 - RNA, 64 nt, Homo Sapiens; identical to SEQ ID NO: 282864

SEQ ID NO: 601459 - RNA, 64 nt, Homo Sapiens; identical to SEQ ID NO: 282865

SEQ ID NO: 601460 - RNA, 64 nt, Homo Sapiens; identical to SEQ ID NO: 282866

SEQ ID NO: 601461 - RNA, 64 nt, Homo Sapiens; identical to SEQ ID NO: 282867

SEQ ID NO: 601462 - RNA, 64 nt, Homo Sapiens; identical to SEQ ID NO: 282868

SEQ ID NO: 601463 - RNA, 64 nt, Homo Sapiens; identical to SEQ ID NO: 282869

SEQ ID NO: 601464 - RNA, 64 nt, Homo Sapiens; identical to SEQ ID NO: 282870

SEQ ID NO: 601465 - RNA, 64 nt, Homo Sapiens; identical to SEQ ID NO: 282871

SEQ ID NO: 601466 - RNA, 64 nt, Homo Sapiens; identical to SEQ ID NO: 282872

SEQ ID NO: 601467 - RNA, 64 nt, Homo Sapiens; identical to SEQ ID NO: 282873

SEQ ID NO: 601468 - RNA, 64 nt, Homo Sapiens; identical to SEQ ID NO: 282874

SEQ ID NO: 601469 - RNA, 64 nt, Homo Sapiens; identical to SEQ ID NO: 282875

SEQ ID NO: 601470 - RNA, 64 nt, Homo Sapiens; identical to SEQ ID NO: 282876

SEQ ID NO: 601471 - RNA, 64 nt, Homo Sapiens; identical to SEQ ID NO: 282877

SEQ ID NO: 601472 - RNA, 64 nt, Homo Sapiens; identical to SEQ ID NO: 282878

SEQ ID NO: 601473 - RNA, 64 nt, Homo Sapiens; identical to SEQ ID NO: 282879

SEQ ID NO: 601474 - RNA, 64 nt, Homo Sapiens; identical to SEQ ID NO: 282880

SEQ ID NO: 601475 - RNA, 64 nt, Homo Sapiens; identical to SEQ ID NO: 282881

SEQ ID NO: 601476 - RNA, 64 nt, Homo Sapiens; identical to SEQ ID NO: 282882

SEQ ID NO: 601477 - RNA, 64 nt, Homo Sapiens; identical to SEQ ID NO: 282883

SEQ ID NO: 601478 - RNA, 64 nt, Homo Sapiens; identical to SEQ ID NO: 282884

SEQ ID NO: 601479 - RNA, 64 nt, Homo Sapiens; identical to SEQ ID NO: 282885

SEQ ID NO: 601480 - RNA, 64 nt, Homo Sapiens; identical to SEQ ID NO: 282886

SEQ ID NO: 601481 - RNA, 64 nt, Homo Sapiens; identical to SEQ ID NO: 282887

SEQ ID NO: 601482 - RNA, 64 nt, Homo Sapiens; identical to SEQ ID NO: 282888

SEQ ID NO: 601483 - RNA, 64 nt, Homo Sapiens; identical to SEQ ID NO: 282889

SEQ ID NO: 601484 - RNA, 64 nt, Homo Sapiens; identical to SEQ ID NO: 282890

SEQ ID NO: 601485 - RNA, 64 nt, Homo Sapiens; identical to SEQ ID NO: 282891

SEQ ID NO: 601486 - RNA, 64 nt, Homo Sapiens; identical to SEQ ID NO: 282892

SEQ ID NO: 601487 - RNA, 64 nt, Homo Sapiens; identical to SEQ ID NO: 282893

SEQ ID NO: 601488 - RNA, 64 nt, Homo Sapiens; identical to SEQ ID NO: 282894

SEQ ID NO: 601489 - RNA, 64 nt, Homo Sapiens; identical to SEQ ID NO: 282895

SEQ ID NO: 601490 - RNA, 64 nt, Homo Sapiens; identical to SEQ ID NO: 282896

SEQ ID NO: 601491 - RNA, 64 nt, Homo Sapiens; identical to SEQ ID NO: 282897

SEQ ID NO: 601492 - RNA, 64 nt, Homo Sapiens; identical to SEQ ID NO: 282898

SEQ ID NO: 601493 - RNA, 64 nt, Homo Sapiens; identical to SEQ ID NO: 282899

SEQ ID NO: 601494 - RNA, 64 nt, Homo Sapiens; identical to SEQ ID NO: 282900

SEQ ID NO: 601495 - RNA, 64 nt, Homo Sapiens; identical to SEQ ID NO: 282901

SEQ ID NO: 601496 - RNA, 64 nt, Homo Sapiens; identical to SEQ ID NO: 282902

SEQ ID NO: 601497 - RNA, 64 nt, Homo Sapiens; identical to SEQ ID NO: 282903

SEQ ID NO: 601498 - RNA, 64 nt, Homo Sapiens; identical to SEQ ID NO: 282904

SEQ ID NO: 601499 - RNA, 64 nt, Homo Sapiens; identical to SEQ ID NO: 282905

SEQ ID NO: 601500 - RNA, 64 nt, Homo Sapiens; identical to SEQ ID NO: 282906

SEQ ID NO: 601501 - RNA, 64 nt, Homo Sapiens; identical to SEQ ID NO: 282907

SEQ ID NO: 601502 - RNA, 64 nt, Homo Sapiens; identical to SEQ ID NO: 282908

SEQ ID NO: 601503 - RNA, 64 nt, Homo Sapiens; identical to SEQ ID NO: 282909

SEQ ID NO: 601504 - RNA, 64 nt, Homo Sapiens; identical to SEQ ID NO: 282910

SEQ ID NO: 601505 - RNA, 64 nt, Homo Sapiens; identical to SEQ ID NO: 282911

SEQ ID NO: 601506 - RNA, 64 nt, Homo Sapiens; identical to SEQ ID NO: 147168

SEQ ID NO: 601507 - RNA, 64 nt, Homo Sapiens; identical to SEQ ID NO: 147169

SEQ ID NO: 601508 - RNA, 64 nt, Homo Sapiens; identical to SEQ ID NO: 147170

SEQ ID NO: 601509 - RNA, 64 nt, Homo Sapiens; identical to SEQ ID NO: 147171

SEQ ID NO: 601510 - RNA, 64 nt, Homo Sapiens; identical to SEQ ID NO: 147172

SEQ ID NO: 601511 - RNA, 64 nt, Homo Sapiens; identical to SEQ ID NO: 147173

SEQ ID NO: 601512 - RNA, 64 nt, Homo Sapiens; identical to SEQ ID NO: 147174

SEQ ID NO: 601513 - RNA, 64 nt, Homo Sapiens; identical to SEQ ID NO: 147175

SEQ ID NO: 601514 - RNA, 64 nt, Homo Sapiens; identical to SEQ ID NO: 147176

SEQ ID NO: 601515 - RNA, 64 nt, Homo Sapiens; identical to SEQ ID NO: 147177

SEQ ID NO: 601516 - RNA, 64 nt, Homo Sapiens; identical to SEQ ID NO: 147178

SEQ ID NO: 601517 - RNA, 64 nt, Homo Sapiens; identical to SEQ ID NO: 147179

SEQ ID NO: 601518 - RNA, 64 nt, Homo Sapiens; identical to SEQ ID NO: 155629

SEQ ID NO: 601519 - RNA, 64 nt, Homo Sapiens; identical to SEQ ID NO: 155630

SEQ ID NO: 601520 - RNA, 64 nt, Homo Sapiens; identical to SEQ ID NO: 155631

SEQ ID NO: 601521 - RNA, 64 nt, Homo Sapiens; identical to SEQ ID NO: 155632

SEQ ID NO: 601522 - RNA, 64 nt, Homo Sapiens; identical to SEQ ID NO: 155633

SEQ ID NO: 601523 - RNA, 64 nt, Homo Sapiens; identical to SEQ ID NO: 155634

SEQ ID NO: 601524 - RNA, 64 nt, Homo Sapiens; identical to SEQ ID NO: 155635

SEQ ID NO: 601525 - RNA, 64 nt, Homo Sapiens; identical to SEQ ID NO: 155636

SEQ ID NO: 601526 - RNA, 64 nt, Homo Sapiens; identical to SEQ ID NO: 155637

SEQ ID NO: 601527 - RNA, 64 nt, Homo Sapiens; identical to SEQ ID NO: 155638

SEQ ID NO: 601528 - RNA, 64 nt, Homo Sapiens; identical to SEQ ID NO: 155639

SEQ ID NO: 601529 - RNA, 64 nt, Homo Sapiens; identical to SEQ ID NO: 155640

SEQ ID NO: 601530 - RNA, 64 nt, Homo Sapiens; identical to SEQ ID NO: 155641

SEQ ID NO: 601531 - RNA, 64 nt, Homo Sapiens; identical to SEQ ID NO: 155642

SEQ ID NO: 601532 - RNA, 64 nt, Homo Sapiens; identical to SEQ ID NO: 155643

SEQ ID NO: 601533 - RNA, 64 nt, Homo Sapiens; identical to SEQ ID NO: 155644

SEQ ID NO: 601534 - RNA, 64 nt, Homo Sapiens; identical to SEQ ID NO: 155645

SEQ ID NO: 601535 - RNA, 64 nt, Homo Sapiens; identical to SEQ ID NO: 155646

SEQ ID NO: 601536 - RNA, 64 nt, Homo Sapiens; identical to SEQ ID NO: 155647

SEQ ID NO: 601537 - RNA, 64 nt, Homo Sapiens; identical to SEQ ID NO: 155648

SEQ ID NO: 601538 - RNA, 64 nt, Homo Sapiens; identical to SEQ ID NO: 155649

SEQ ID NO: 601539 - RNA, 64 nt, Homo Sapiens; identical to SEQ ID NO: 155650

SEQ ID NO: 601540 - RNA, 64 nt, Homo Sapiens; identical to SEQ ID NO: 155651

SEQ ID NO: 601541 - RNA, 64 nt, Homo Sapiens; identical to SEQ ID NO: 155652

SEQ ID NO: 601542 - RNA, 64 nt, Homo Sapiens; identical to SEQ ID NO: 155653

SEQ ID NO: 601543 - RNA, 64 nt, Homo Sapiens; identical to SEQ ID NO: 155654

SEQ ID NO: 601544 - RNA, 64 nt, Homo Sapiens; identical to SEQ ID NO: 155655

SEQ ID NO: 601545 - RNA, 64 nt, Homo Sapiens; identical to SEQ ID NO: 155656

SEQ ID NO: 601546 - RNA, 64 nt, Homo Sapiens; identical to SEQ ID NO: 155657

SEQ ID NO: 601547 - RNA, 64 nt, Homo Sapiens; identical to SEQ ID NO: 155658

SEQ ID NO: 601548 - RNA, 64 nt, Homo Sapiens; identical to SEQ ID NO: 155659

SEQ ID NO: 601549 - RNA, 64 nt, Homo Sapiens; identical to SEQ ID NO: 155660

SEQ ID NO: 601550 - RNA, 64 nt, Homo Sapiens; identical to SEQ ID NO: 155661

SEQ ID NO: 601551 - RNA, 64 nt, Homo Sapiens; identical to SEQ ID NO: 155662

SEQ ID NO: 601552 - RNA, 64 nt, Homo Sapiens; identical to SEQ ID NO: 155663

SEQ ID NO: 601553 - RNA, 64 nt, Homo Sapiens; identical to SEQ ID NO: 155664

SEQ ID NO: 601554 - RNA, 64 nt, Homo Sapiens; identical to SEQ ID NO: 155665

SEQ ID NO: 601555 - RNA, 64 nt, Homo Sapiens; identical to SEQ ID NO: 155666

SEQ ID NO: 601556 - RNA, 64 nt, Homo Sapiens; identical to SEQ ID NO: 155667

SEQ ID NO: 601557 - RNA, 64 nt, Homo Sapiens; identical to SEQ ID NO: 155668

SEQ ID NO: 601558 - RNA, 64 nt, Homo Sapiens; identical to SEQ ID NO: 155669

SEQ ID NO: 601559 - RNA, 64 nt, Homo Sapiens; identical to SEQ ID NO: 155670

SEQ ID NO: 601560 - RNA, 64 nt, Homo Sapiens; identical to SEQ ID NO: 155671

SEQ ID NO: 601561 - RNA, 64 nt, Homo Sapiens; identical to SEQ ID NO: 155672

SEQ ID NO: 601562 - RNA, 64 nt, Homo Sapiens; identical to SEQ ID NO: 155673

SEQ ID NO: 601563 - RNA, 64 nt, Homo Sapiens; identical to SEQ ID NO: 155674

SEQ ID NO: 601564 - RNA, 64 nt, Homo Sapiens; identical to SEQ ID NO: 155675

SEQ ID NO: 601565 - RNA, 64 nt, Homo Sapiens; identical to SEQ ID NO: 155676

SEQ ID NO: 601566 - RNA, 64 nt, Homo Sapiens; identical to SEQ ID NO: 155677

SEQ ID NO: 601567 - RNA, 64 nt, Homo Sapiens; identical to SEQ ID NO: 155678

SEQ ID NO: 601568 - RNA, 64 nt, Homo Sapiens; identical to SEQ ID NO: 155679

SEQ ID NO: 601569 - RNA, 64 nt, Homo Sapiens; identical to SEQ ID NO: 155680

SEQ ID NO: 601570 - RNA, 64 nt, Homo Sapiens; identical to SEQ ID NO: 155681

SEQ ID NO: 601571 - RNA, 64 nt, Homo Sapiens; identical to SEQ ID NO: 155682

SEQ ID NO: 601572 - RNA, 64 nt, Homo Sapiens; identical to SEQ ID NO: 155683

SEQ ID NO: 601573 - RNA, 64 nt, Homo Sapiens; identical to SEQ ID NO: 155684

SEQ ID NO: 601574 - RNA, 64 nt, Homo Sapiens; identical to SEQ ID NO: 155685

SEQ ID NO: 601575 - RNA, 64 nt, Homo Sapiens; identical to SEQ ID NO: 155686

SEQ ID NO: 601576 - RNA, 64 nt, Homo Sapiens; identical to SEQ ID NO: 155687

SEQ ID NO: 601577 - RNA, 64 nt, Homo Sapiens; identical to SEQ ID NO: 155688

SEQ ID NO: 601578 - RNA, 64 nt, Homo Sapiens; identical to SEQ ID NO: 155689

SEQ ID NO: 601579 - RNA, 64 nt, Homo Sapiens; identical to SEQ ID NO: 155690

SEQ ID NO: 601580 - RNA, 64 nt, Homo Sapiens; identical to SEQ ID NO: 155691

SEQ ID NO: 601581 - RNA, 64 nt, Homo Sapiens; identical to SEQ ID NO: 155692

SEQ ID NO: 601582 - RNA, 64 nt, Homo Sapiens; identical to SEQ ID NO: 155693

SEQ ID NO: 601583 - RNA, 64 nt, Homo Sapiens; identical to SEQ ID NO: 155694

SEQ ID NO: 601584 - RNA, 64 nt, Homo Sapiens; identical to SEQ ID NO: 155695

SEQ ID NO: 601585 - RNA, 64 nt, Homo Sapiens; identical to SEQ ID NO: 155696

SEQ ID NO: 601586 - RNA, 64 nt, Homo Sapiens; identical to SEQ ID NO: 155697

SEQ ID NO: 601587 - RNA, 64 nt, Homo Sapiens; identical to SEQ ID NO: 155698

SEQ ID NO: 601588 - RNA, 64 nt, Homo Sapiens; identical to SEQ ID NO: 155699

SEQ ID NO: 601589 - RNA, 64 nt, Homo Sapiens; identical to SEQ ID NO: 155700

SEQ ID NO: 601590 - RNA, 64 nt, Homo Sapiens; identical to SEQ ID NO: 155701

SEQ ID NO: 601591 - RNA, 64 nt, Homo Sapiens; identical to SEQ ID NO: 155702

SEQ ID NO: 601592 - RNA, 64 nt, Homo Sapiens; identical to SEQ ID NO: 155703

SEQ ID NO: 601593 - RNA, 64 nt, Homo Sapiens; identical to SEQ ID NO: 155704

SEQ ID NO: 601594 - RNA, 64 nt, Homo Sapiens; identical to SEQ ID NO: 155705

SEQ ID NO: 601595 - RNA, 64 nt, Homo Sapiens; identical to SEQ ID NO: 155706

SEQ ID NO: 601596 - RNA, 64 nt, Homo Sapiens; identical to SEQ ID NO: 155707

SEQ ID NO: 601597 - RNA, 64 nt, Homo Sapiens; identical to SEQ ID NO: 155708

SEQ ID NO: 601598 - RNA, 64 nt, Homo Sapiens; identical to SEQ ID NO: 155709

SEQ ID NO: 601599 - RNA, 64 nt, Homo Sapiens; identical to SEQ ID NO: 155710

SEQ ID NO: 601600 - RNA, 64 nt, Homo Sapiens; identical to SEQ ID NO: 155711

SEQ ID NO: 601601 - RNA, 64 nt, Homo Sapiens; identical to SEQ ID NO: 155712

SEQ ID NO: 601602 - RNA, 64 nt, Homo Sapiens; identical to SEQ ID NO: 155713

SEQ ID NO: 601603 - RNA, 64 nt, Homo Sapiens; identical to SEQ ID NO: 155714

SEQ ID NO: 601604 - RNA, 64 nt, Homo Sapiens; identical to SEQ ID NO: 155715

SEQ ID NO: 601605 - RNA, 64 nt, Homo Sapiens; identical to SEQ ID NO: 155716

SEQ ID NO: 601606 - RNA, 64 nt, Homo Sapiens; identical to SEQ ID NO: 155717

SEQ ID NO: 601607 - RNA, 64 nt, Homo Sapiens; identical to SEQ ID NO: 155718

SEQ ID NO: 601608 - RNA, 64 nt, Homo Sapiens; identical to SEQ ID NO: 155719

SEQ ID NO: 601609 - RNA, 64 nt, Homo Sapiens; identical to SEQ ID NO: 155720

SEQ ID NO: 601610 - RNA, 64 nt, Homo Sapiens; identical to SEQ ID NO: 155721

SEQ ID NO: 601611 - RNA, 64 nt, Homo Sapiens; identical to SEQ ID NO: 155722

SEQ ID NO: 601612 - RNA, 64 nt, Homo Sapiens; identical to SEQ ID NO: 155723

SEQ ID NO: 601613 - RNA, 64 nt, Homo Sapiens; identical to SEQ ID NO: 155724

SEQ ID NO: 601614 - RNA, 64 nt, Homo Sapiens; identical to SEQ ID NO: 155725

SEQ ID NO: 601615 - RNA, 64 nt, Homo Sapiens; identical to SEQ ID NO: 155726

SEQ ID NO: 601616 - RNA, 64 nt, Homo Sapiens; identical to SEQ ID NO: 155727

SEQ ID NO: 601617 - RNA, 64 nt, Homo Sapiens; identical to SEQ ID NO: 155728

SEQ ID NO: 601618 - RNA, 64 nt, Homo Sapiens; identical to SEQ ID NO: 155729

SEQ ID NO: 601619 - RNA, 58 nt, Homo Sapiens; identical to SEQ ID NO: 155730

SEQ ID NO: 601620 - RNA, 64 nt, Homo Sapiens; identical to SEQ ID NO: 155731

SEQ ID NO: 601621 - RNA, 64 nt, Homo Sapiens; identical to SEQ ID NO: 155732

SEQ ID NO: 601622 - RNA, 64 nt, Homo Sapiens; identical to SEQ ID NO: 155733

SEQ ID NO: 601623 - RNA, 64 nt, Homo Sapiens; identical to SEQ ID NO: 155734

SEQ ID NO: 601624 - RNA, 64 nt, Homo Sapiens; identical to SEQ ID NO: 155735

SEQ ID NO: 601625 - RNA, 64 nt, Homo Sapiens; identical to SEQ ID NO: 155736

SEQ ID NO: 601626 - RNA, 64 nt, Homo Sapiens; identical to SEQ ID NO: 155737

SEQ ID NO: 601627 - RNA, 64 nt, Homo Sapiens; identical to SEQ ID NO: 155738

SEQ ID NO: 601628 - RNA, 64 nt, Homo Sapiens; identical to SEQ ID NO: 155739

SEQ ID NO: 601629 - RNA, 64 nt, Homo Sapiens; identical to SEQ ID NO: 155740

SEQ ID NO: 601630 - RNA, 64 nt, Homo Sapiens; identical to SEQ ID NO: 155741

SEQ ID NO: 601631 - RNA, 64 nt, Homo Sapiens; identical to SEQ ID NO: 155742

SEQ ID NO: 601632 - RNA, 64 nt, Homo Sapiens; identical to SEQ ID NO: 155743

SEQ ID NO: 601633 - RNA, 64 nt, Homo Sapiens; identical to SEQ ID NO: 155744

SEQ ID NO: 601634 - RNA, 64 nt, Homo Sapiens; identical to SEQ ID NO: 155745

SEQ ID NO: 601635 - RNA, 64 nt, Homo Sapiens; identical to SEQ ID NO: 155746

SEQ ID NO: 601636 - RNA, 64 nt, Homo Sapiens; identical to SEQ ID NO: 155747

SEQ ID NO: 601637 - RNA, 64 nt, Homo Sapiens; identical to SEQ ID NO: 155748

SEQ ID NO: 601638 - RNA, 64 nt, Homo Sapiens; identical to SEQ ID NO: 155749

SEQ ID NO: 601639 - RNA, 64 nt, Homo Sapiens; identical to SEQ ID NO: 155750

SEQ ID NO: 601640 - RNA, 64 nt, Homo Sapiens; identical to SEQ ID NO: 155751

SEQ ID NO: 601641 - RNA, 64 nt, Homo Sapiens; identical to SEQ ID NO: 155752

SEQ ID NO: 601642 - RNA, 64 nt, Homo Sapiens; identical to SEQ ID NO: 155753

SEQ ID NO: 601643 - RNA, 63 nt, Homo Sapiens; identical to SEQ ID NO: 155754

SEQ ID NO: 601644 - RNA, 64 nt, Homo Sapiens; identical to SEQ ID NO: 155755

SEQ ID NO: 601645 - RNA, 64 nt, Homo Sapiens; identical to SEQ ID NO: 155756

SEQ ID NO: 601646 - RNA, 64 nt, Homo Sapiens; identical to SEQ ID NO: 155757

SEQ ID NO: 601647 - RNA, 64 nt, Homo Sapiens; identical to SEQ ID NO: 155758

SEQ ID NO: 601648 - RNA, 64 nt, Homo Sapiens; identical to SEQ ID NO: 155759

SEQ ID NO: 601649 - RNA, 64 nt, Homo Sapiens; identical to SEQ ID NO: 155760

SEQ ID NO: 601650 - RNA, 64 nt, Homo Sapiens; identical to SEQ ID NO: 155761

SEQ ID NO: 601651 - RNA, 64 nt, Homo Sapiens; identical to SEQ ID NO: 155762

SEQ ID NO: 601652 - RNA, 64 nt, Homo Sapiens; identical to SEQ ID NO: 155763

SEQ ID NO: 601653 - RNA, 64 nt, Homo Sapiens; identical to SEQ ID NO: 155764

SEQ ID NO: 601654 - RNA, 64 nt, Homo Sapiens; identical to SEQ ID NO: 155765

SEQ ID NO: 601655 - RNA, 64 nt, Homo Sapiens; identical to SEQ ID NO: 155766

SEQ ID NO: 601656 - RNA, 64 nt, Homo Sapiens; identical to SEQ ID NO: 155767

SEQ ID NO: 601657 - RNA, 64 nt, Homo Sapiens; identical to SEQ ID NO: 155768

SEQ ID NO: 601658 - RNA, 64 nt, Homo Sapiens; identical to SEQ ID NO: 155769

SEQ ID NO: 601659 - RNA, 64 nt, Homo Sapiens; identical to SEQ ID NO: 155770

SEQ ID NO: 601660 - RNA, 64 nt, Homo Sapiens; identical to SEQ ID NO: 155771

SEQ ID NO: 601661 - RNA, 64 nt, Homo Sapiens; identical to SEQ ID NO: 155772

SEQ ID NO: 601662 - RNA, 64 nt, Homo Sapiens; identical to SEQ ID NO: 155773

SEQ ID NO: 601663 - RNA, 64 nt, Homo Sapiens; identical to SEQ ID NO: 155774

SEQ ID NO: 601664 - RNA, 64 nt, Homo Sapiens; identical to SEQ ID NO: 155775

SEQ ID NO: 601665 - RNA, 64 nt, Homo Sapiens; identical to SEQ ID NO: 155776

SEQ ID NO: 601666 - RNA, 64 nt, Homo Sapiens; identical to SEQ ID NO: 155777

SEQ ID NO: 601667 - RNA, 64 nt, Homo Sapiens; identical to SEQ ID NO: 155778

SEQ ID NO: 601668 - RNA, 64 nt, Homo Sapiens; identical to SEQ ID NO: 155779

SEQ ID NO: 601669 - RNA, 64 nt, Homo Sapiens; identical to SEQ ID NO: 155780

SEQ ID NO: 601670 - RNA, 64 nt, Homo Sapiens; identical to SEQ ID NO: 155781

SEQ ID NO: 601671 - RNA, 64 nt, Homo Sapiens; identical to SEQ ID NO: 155782

SEQ ID NO: 601672 - RNA, 64 nt, Homo Sapiens; identical to SEQ ID NO: 155783

SEQ ID NO: 601673 - RNA, 64 nt, Homo Sapiens; identical to SEQ ID NO: 155784

SEQ ID NO: 601674 - RNA, 64 nt, Homo Sapiens; identical to SEQ ID NO: 155785

SEQ ID NO: 601675 - RNA, 64 nt, Homo Sapiens; identical to SEQ ID NO: 155786

SEQ ID NO: 601676 - RNA, 53 nt, Homo Sapiens; identical to SEQ ID NO: 155787

SEQ ID NO: 601677 - RNA, 64 nt, Homo Sapiens; identical to SEQ ID NO: 155788

SEQ ID NO: 601678 - RNA, 64 nt, Homo Sapiens; identical to SEQ ID NO: 155789

SEQ ID NO: 601679 - RNA, 64 nt, Homo Sapiens; identical to SEQ ID NO: 155790

SEQ ID NO: 601680 - RNA, 64 nt, Homo Sapiens; identical to SEQ ID NO: 155791

SEQ ID NO: 601681 - RNA, 64 nt, Homo Sapiens; identical to SEQ ID NO: 155792

SEQ ID NO: 601682 - RNA, 64 nt, Homo Sapiens; identical to SEQ ID NO: 155793

SEQ ID NO: 601683 - RNA, 64 nt, Homo Sapiens; identical to SEQ ID NO: 155794

SEQ ID NO: 601684 - RNA, 64 nt, Homo Sapiens; identical to SEQ ID NO: 155795

SEQ ID NO: 601685 - RNA, 64 nt, Homo Sapiens; identical to SEQ ID NO: 155796

SEQ ID NO: 601686 - RNA, 64 nt, Homo Sapiens; identical to SEQ ID NO: 155797

SEQ ID NO: 601687 - RNA, 64 nt, Homo Sapiens; identical to SEQ ID NO: 155798

SEQ ID NO: 601688 - RNA, 64 nt, Homo Sapiens; identical to SEQ ID NO: 155799

SEQ ID NO: 601689 - RNA, 64 nt, Homo Sapiens; identical to SEQ ID NO: 155800

SEQ ID NO: 601690 - RNA, 64 nt, Homo Sapiens; identical to SEQ ID NO: 155801

SEQ ID NO: 601691 - RNA, 64 nt, Homo Sapiens; identical to SEQ ID NO: 155802

SEQ ID NO: 601692 - RNA, 64 nt, Homo Sapiens; identical to SEQ ID NO: 155803

SEQ ID NO: 601693 - RNA, 64 nt, Homo Sapiens; identical to SEQ ID NO: 155804

SEQ ID NO: 601694 - RNA, 64 nt, Homo Sapiens; identical to SEQ ID NO: 155805

SEQ ID NO: 601695 - RNA, 64 nt, Homo Sapiens; identical to SEQ ID NO: 155806

SEQ ID NO: 601696 - RNA, 64 nt, Homo Sapiens; identical to SEQ ID NO: 155807

SEQ ID NO: 601697 - RNA, 64 nt, Homo Sapiens; identical to SEQ ID NO: 155808

SEQ ID NO: 601698 - RNA, 64 nt, Homo Sapiens; identical to SEQ ID NO: 147168

SEQ ID NO: 601699 - RNA, 64 nt, Homo Sapiens; identical to SEQ ID NO: 147169

SEQ ID NO: 601700 - RNA, 64 nt, Homo Sapiens; identical to SEQ ID NO: 147170

SEQ ID NO: 601701 - RNA, 64 nt, Homo Sapiens; identical to SEQ ID NO: 147171

SEQ ID NO: 601702 - RNA, 64 nt, Homo Sapiens; identical to SEQ ID NO: 147172

SEQ ID NO: 601703 - RNA, 64 nt, Homo Sapiens; identical to SEQ ID NO: 147173

SEQ ID NO: 601704 - RNA, 64 nt, Homo Sapiens; identical to SEQ ID NO: 147174

SEQ ID NO: 601705 - RNA, 64 nt, Homo Sapiens; identical to SEQ ID NO: 147175

SEQ ID NO: 601706 - RNA, 64 nt, Homo Sapiens; identical to SEQ ID NO: 147176

SEQ ID NO: 601707 - RNA, 64 nt, Homo Sapiens; identical to SEQ ID NO: 147177

SEQ ID NO: 601708 - RNA, 64 nt, Homo Sapiens; identical to SEQ ID NO: 147178

SEQ ID NO: 601709 - RNA, 64 nt, Homo Sapiens; identical to SEQ ID NO: 147179

SEQ ID NO: 601710 - RNA, 64 nt, Homo Sapiens; identical to SEQ ID NO: 155629

SEQ ID NO: 601711 - RNA, 64 nt, Homo Sapiens; identical to SEQ ID NO: 155630

SEQ ID NO: 601712 - RNA, 64 nt, Homo Sapiens; identical to SEQ ID NO: 155631

SEQ ID NO: 601713 - RNA, 64 nt, Homo Sapiens; identical to SEQ ID NO: 155632

SEQ ID NO: 601714 - RNA, 64 nt, Homo Sapiens; identical to SEQ ID NO: 155633

SEQ ID NO: 601715 - RNA, 64 nt, Homo Sapiens; identical to SEQ ID NO: 155634

SEQ ID NO: 601716 - RNA, 64 nt, Homo Sapiens; identical to SEQ ID NO: 155635

SEQ ID NO: 601717 - RNA, 64 nt, Homo Sapiens; identical to SEQ ID NO: 155636

SEQ ID NO: 601718 - RNA, 64 nt, Homo Sapiens; identical to SEQ ID NO: 155637

SEQ ID NO: 601719 - RNA, 64 nt, Homo Sapiens; identical to SEQ ID NO: 155638

SEQ ID NO: 601720 - RNA, 64 nt, Homo Sapiens; identical to SEQ ID NO: 155639

SEQ ID NO: 601721 - RNA, 64 nt, Homo Sapiens; identical to SEQ ID NO: 155640

SEQ ID NO: 601722 - RNA, 64 nt, Homo Sapiens; identical to SEQ ID NO: 155641

SEQ ID NO: 601723 - RNA, 64 nt, Homo Sapiens; identical to SEQ ID NO: 155642

SEQ ID NO: 601724 - RNA, 64 nt, Homo Sapiens; identical to SEQ ID NO: 155643

SEQ ID NO: 601725 - RNA, 64 nt, Homo Sapiens; identical to SEQ ID NO: 155644

SEQ ID NO: 601726 - RNA, 64 nt, Homo Sapiens; identical to SEQ ID NO: 155645

SEQ ID NO: 601727 - RNA, 64 nt, Homo Sapiens; identical to SEQ ID NO: 155646

SEQ ID NO: 601728 - RNA, 64 nt, Homo Sapiens; identical to SEQ ID NO: 155647

SEQ ID NO: 601729 - RNA, 64 nt, Homo Sapiens; identical to SEQ ID NO: 155648

SEQ ID NO: 601730 - RNA, 64 nt, Homo Sapiens; identical to SEQ ID NO: 155649

SEQ ID NO: 601731 - RNA, 64 nt, Homo Sapiens; identical to SEQ ID NO: 155650

SEQ ID NO: 601732 - RNA, 64 nt, Homo Sapiens; identical to SEQ ID NO: 155651

SEQ ID NO: 601733 - RNA, 64 nt, Homo Sapiens; identical to SEQ ID NO: 155652

SEQ ID NO: 601734 - RNA, 64 nt, Homo Sapiens; identical to SEQ ID NO: 155653

SEQ ID NO: 601735 - RNA, 64 nt, Homo Sapiens; identical to SEQ ID NO: 155654

SEQ ID NO: 601736 - RNA, 64 nt, Homo Sapiens; identical to SEQ ID NO: 155655

SEQ ID NO: 601737 - RNA, 64 nt, Homo Sapiens; identical to SEQ ID NO: 155656

SEQ ID NO: 601738 - RNA, 64 nt, Homo Sapiens; identical to SEQ ID NO: 155657

SEQ ID NO: 601739 - RNA, 64 nt, Homo Sapiens; identical to SEQ ID NO: 155658

SEQ ID NO: 601740 - RNA, 64 nt, Homo Sapiens; identical to SEQ ID NO: 155659

SEQ ID NO: 601741 - RNA, 64 nt, Homo Sapiens; identical to SEQ ID NO: 155660

SEQ ID NO: 601742 - RNA, 64 nt, Homo Sapiens; identical to SEQ ID NO: 155661

SEQ ID NO: 601743 - RNA, 64 nt, Homo Sapiens; identical to SEQ ID NO: 155662

SEQ ID NO: 601744 - RNA, 64 nt, Homo Sapiens; identical to SEQ ID NO: 155663

SEQ ID NO: 601745 - RNA, 64 nt, Homo Sapiens; identical to SEQ ID NO: 155664

SEQ ID NO: 601746 - RNA, 64 nt, Homo Sapiens; identical to SEQ ID NO: 155665

SEQ ID NO: 601747 - RNA, 64 nt, Homo Sapiens; identical to SEQ ID NO: 155666

SEQ ID NO: 601748 - RNA, 64 nt, Homo Sapiens; identical to SEQ ID NO: 155667

SEQ ID NO: 601749 - RNA, 64 nt, Homo Sapiens; identical to SEQ ID NO: 155668

SEQ ID NO: 601750 - RNA, 64 nt, Homo Sapiens; identical to SEQ ID NO: 155669

SEQ ID NO: 601751 - RNA, 64 nt, Homo Sapiens; identical to SEQ ID NO: 155670

SEQ ID NO: 601752 - RNA, 64 nt, Homo Sapiens; identical to SEQ ID NO: 155671

SEQ ID NO: 601753 - RNA, 64 nt, Homo Sapiens; identical to SEQ ID NO: 155672

SEQ ID NO: 601754 - RNA, 64 nt, Homo Sapiens; identical to SEQ ID NO: 155673

SEQ ID NO: 601755 - RNA, 64 nt, Homo Sapiens; identical to SEQ ID NO: 155674

SEQ ID NO: 601756 - RNA, 64 nt, Homo Sapiens; identical to SEQ ID NO: 155675

SEQ ID NO: 601757 - RNA, 64 nt, Homo Sapiens; identical to SEQ ID NO: 155676

SEQ ID NO: 601758 - RNA, 64 nt, Homo Sapiens; identical to SEQ ID NO: 155677

SEQ ID NO: 601759 - RNA, 64 nt, Homo Sapiens; identical to SEQ ID NO: 155678

SEQ ID NO: 601760 - RNA, 64 nt, Homo Sapiens; identical to SEQ ID NO: 155679

SEQ ID NO: 601761 - RNA, 64 nt, Homo Sapiens; identical to SEQ ID NO: 155680

SEQ ID NO: 601762 - RNA, 64 nt, Homo Sapiens; identical to SEQ ID NO: 155681

SEQ ID NO: 601763 - RNA, 64 nt, Homo Sapiens; identical to SEQ ID NO: 155682

SEQ ID NO: 601764 - RNA, 64 nt, Homo Sapiens; identical to SEQ ID NO: 155683

SEQ ID NO: 601765 - RNA, 64 nt, Homo Sapiens; identical to SEQ ID NO: 155684

SEQ ID NO: 601766 - RNA, 64 nt, Homo Sapiens; identical to SEQ ID NO: 155685

SEQ ID NO: 601767 - RNA, 64 nt, Homo Sapiens; identical to SEQ ID NO: 155686

SEQ ID NO: 601768 - RNA, 64 nt, Homo Sapiens; identical to SEQ ID NO: 155687

SEQ ID NO: 601769 - RNA, 64 nt, Homo Sapiens; identical to SEQ ID NO: 155688

SEQ ID NO: 601770 - RNA, 64 nt, Homo Sapiens; identical to SEQ ID NO: 155689

SEQ ID NO: 601771 - RNA, 64 nt, Homo Sapiens; identical to SEQ ID NO: 155690

SEQ ID NO: 601772 - RNA, 64 nt, Homo Sapiens; identical to SEQ ID NO: 155691

SEQ ID NO: 601773 - RNA, 64 nt, Homo Sapiens; identical to SEQ ID NO: 155692

SEQ ID NO: 601774 - RNA, 64 nt, Homo Sapiens; identical to SEQ ID NO: 155693

SEQ ID NO: 601775 - RNA, 64 nt, Homo Sapiens; identical to SEQ ID NO: 155694

SEQ ID NO: 601776 - RNA, 64 nt, Homo Sapiens; identical to SEQ ID NO: 155695

SEQ ID NO: 601777 - RNA, 64 nt, Homo Sapiens; identical to SEQ ID NO: 155696

SEQ ID NO: 601778 - RNA, 64 nt, Homo Sapiens; identical to SEQ ID NO: 155697

SEQ ID NO: 601779 - RNA, 64 nt, Homo Sapiens; identical to SEQ ID NO: 155698

SEQ ID NO: 601780 - RNA, 64 nt, Homo Sapiens; identical to SEQ ID NO: 155699

SEQ ID NO: 601781 - RNA, 64 nt, Homo Sapiens; identical to SEQ ID NO: 155700

SEQ ID NO: 601782 - RNA, 64 nt, Homo Sapiens; identical to SEQ ID NO: 155701

SEQ ID NO: 601783 - RNA, 64 nt, Homo Sapiens; identical to SEQ ID NO: 155702

SEQ ID NO: 601784 - RNA, 64 nt, Homo Sapiens; identical to SEQ ID NO: 155703

SEQ ID NO: 601785 - RNA, 64 nt, Homo Sapiens; identical to SEQ ID NO: 155704

SEQ ID NO: 601786 - RNA, 64 nt, Homo Sapiens; identical to SEQ ID NO: 155705

SEQ ID NO: 601787 - RNA, 64 nt, Homo Sapiens; identical to SEQ ID NO: 155706

SEQ ID NO: 601788 - RNA, 64 nt, Homo Sapiens; identical to SEQ ID NO: 155707

SEQ ID NO: 601789 - RNA, 64 nt, Homo Sapiens; identical to SEQ ID NO: 155708

SEQ ID NO: 601790 - RNA, 64 nt, Homo Sapiens; identical to SEQ ID NO: 155709

SEQ ID NO: 601791 - RNA, 64 nt, Homo Sapiens; identical to SEQ ID NO: 155710

SEQ ID NO: 601792 - RNA, 64 nt, Homo Sapiens; identical to SEQ ID NO: 155711

SEQ ID NO: 601793 - RNA, 64 nt, Homo Sapiens; identical to SEQ ID NO: 155712

SEQ ID NO: 601794 - RNA, 64 nt, Homo Sapiens; identical to SEQ ID NO: 155713

SEQ ID NO: 601795 - RNA, 64 nt, Homo Sapiens; identical to SEQ ID NO: 155714

SEQ ID NO: 601796 - RNA, 64 nt, Homo Sapiens; identical to SEQ ID NO: 155715

SEQ ID NO: 601797 - RNA, 64 nt, Homo Sapiens; identical to SEQ ID NO: 155716

SEQ ID NO: 601798 - RNA, 64 nt, Homo Sapiens; identical to SEQ ID NO: 155717

SEQ ID NO: 601799 - RNA, 64 nt, Homo Sapiens; identical to SEQ ID NO: 155718

SEQ ID NO: 601800 - RNA, 64 nt, Homo Sapiens; identical to SEQ ID NO: 155719

SEQ ID NO: 601801 - RNA, 64 nt, Homo Sapiens; identical to SEQ ID NO: 155720

SEQ ID NO: 601802 - RNA, 64 nt, Homo Sapiens; identical to SEQ ID NO: 155721

SEQ ID NO: 601803 - RNA, 64 nt, Homo Sapiens; identical to SEQ ID NO: 155722

SEQ ID NO: 601804 - RNA, 64 nt, Homo Sapiens; identical to SEQ ID NO: 155723

SEQ ID NO: 601805 - RNA, 64 nt, Homo Sapiens; identical to SEQ ID NO: 155724

SEQ ID NO: 601806 - RNA, 64 nt, Homo Sapiens; identical to SEQ ID NO: 155725

SEQ ID NO: 601807 - RNA, 64 nt, Homo Sapiens; identical to SEQ ID NO: 155726

SEQ ID NO: 601808 - RNA, 64 nt, Homo Sapiens; identical to SEQ ID NO: 155727

SEQ ID NO: 601809 - RNA, 64 nt, Homo Sapiens; identical to SEQ ID NO: 155728

SEQ ID NO: 601810 - RNA, 64 nt, Homo Sapiens; identical to SEQ ID NO: 155729

SEQ ID NO: 601811 - RNA, 58 nt, Homo Sapiens; identical to SEQ ID NO: 155730

SEQ ID NO: 601812 - RNA, 64 nt, Homo Sapiens; identical to SEQ ID NO: 155731

SEQ ID NO: 601813 - RNA, 64 nt, Homo Sapiens; identical to SEQ ID NO: 155732

SEQ ID NO: 601814 - RNA, 64 nt, Homo Sapiens; identical to SEQ ID NO: 155733

SEQ ID NO: 601815 - RNA, 64 nt, Homo Sapiens; identical to SEQ ID NO: 155734

SEQ ID NO: 601816 - RNA, 64 nt, Homo Sapiens; identical to SEQ ID NO: 155735

SEQ ID NO: 601817 - RNA, 64 nt, Homo Sapiens; identical to SEQ ID NO: 155736

SEQ ID NO: 601818 - RNA, 64 nt, Homo Sapiens; identical to SEQ ID NO: 155737

SEQ ID NO: 601819 - RNA, 64 nt, Homo Sapiens; identical to SEQ ID NO: 155738

SEQ ID NO: 601820 - RNA, 64 nt, Homo Sapiens; identical to SEQ ID NO: 155739

SEQ ID NO: 601821 - RNA, 64 nt, Homo Sapiens; identical to SEQ ID NO: 155740

SEQ ID NO: 601822 - RNA, 64 nt, Homo Sapiens; identical to SEQ ID NO: 155741

SEQ ID NO: 601823 - RNA, 64 nt, Homo Sapiens; identical to SEQ ID NO: 155742

SEQ ID NO: 601824 - RNA, 64 nt, Homo Sapiens; identical to SEQ ID NO: 155743

SEQ ID NO: 601825 - RNA, 64 nt, Homo Sapiens; identical to SEQ ID NO: 155744

SEQ ID NO: 601826 - RNA, 64 nt, Homo Sapiens; identical to SEQ ID NO: 155745

SEQ ID NO: 601827 - RNA, 64 nt, Homo Sapiens; identical to SEQ ID NO: 155746

SEQ ID NO: 601828 - RNA, 64 nt, Homo Sapiens; identical to SEQ ID NO: 155747

SEQ ID NO: 601829 - RNA, 64 nt, Homo Sapiens; identical to SEQ ID NO: 155748

SEQ ID NO: 601830 - RNA, 64 nt, Homo Sapiens; identical to SEQ ID NO: 155749

SEQ ID NO: 601831 - RNA, 64 nt, Homo Sapiens; identical to SEQ ID NO: 155750

SEQ ID NO: 601832 - RNA, 64 nt, Homo Sapiens; identical to SEQ ID NO: 155751

SEQ ID NO: 601833 - RNA, 64 nt, Homo Sapiens; identical to SEQ ID NO: 155752

SEQ ID NO: 601834 - RNA, 64 nt, Homo Sapiens; identical to SEQ ID NO: 155753

SEQ ID NO: 601835 - RNA, 63 nt, Homo Sapiens; identical to SEQ ID NO: 155754

SEQ ID NO: 601836 - RNA, 64 nt, Homo Sapiens; identical to SEQ ID NO: 155755

SEQ ID NO: 601837 - RNA, 64 nt, Homo Sapiens; identical to SEQ ID NO: 155756

SEQ ID NO: 601838 - RNA, 64 nt, Homo Sapiens; identical to SEQ ID NO: 155757

SEQ ID NO: 601839 - RNA, 64 nt, Homo Sapiens; identical to SEQ ID NO: 155758

SEQ ID NO: 601840 - RNA, 64 nt, Homo Sapiens; identical to SEQ ID NO: 155759

SEQ ID NO: 601841 - RNA, 64 nt, Homo Sapiens; identical to SEQ ID NO: 155760

SEQ ID NO: 601842 - RNA, 64 nt, Homo Sapiens; identical to SEQ ID NO: 155761

SEQ ID NO: 601843 - RNA, 64 nt, Homo Sapiens; identical to SEQ ID NO: 155762

SEQ ID NO: 601844 - RNA, 64 nt, Homo Sapiens; identical to SEQ ID NO: 155763

SEQ ID NO: 601845 - RNA, 64 nt, Homo Sapiens; identical to SEQ ID NO: 155764

SEQ ID NO: 601846 - RNA, 64 nt, Homo Sapiens; identical to SEQ ID NO: 155765

SEQ ID NO: 601847 - RNA, 64 nt, Homo Sapiens; identical to SEQ ID NO: 155766

SEQ ID NO: 601848 - RNA, 64 nt, Homo Sapiens; identical to SEQ ID NO: 155767

SEQ ID NO: 601849 - RNA, 64 nt, Homo Sapiens; identical to SEQ ID NO: 155768

SEQ ID NO: 601850 - RNA, 64 nt, Homo Sapiens; identical to SEQ ID NO: 155769

SEQ ID NO: 601851 - RNA, 64 nt, Homo Sapiens; identical to SEQ ID NO: 155770

SEQ ID NO: 601852 - RNA, 64 nt, Homo Sapiens; identical to SEQ ID NO: 155771

SEQ ID NO: 601853 - RNA, 64 nt, Homo Sapiens; identical to SEQ ID NO: 155772

SEQ ID NO: 601854 - RNA, 64 nt, Homo Sapiens; identical to SEQ ID NO: 155773

SEQ ID NO: 601855 - RNA, 64 nt, Homo Sapiens; identical to SEQ ID NO: 155774

SEQ ID NO: 601856 - RNA, 64 nt, Homo Sapiens; identical to SEQ ID NO: 155775

SEQ ID NO: 601857 - RNA, 64 nt, Homo Sapiens; identical to SEQ ID NO: 155776

SEQ ID NO: 601858 - RNA, 64 nt, Homo Sapiens; identical to SEQ ID NO: 155777

SEQ ID NO: 601859 - RNA, 64 nt, Homo Sapiens; identical to SEQ ID NO: 155778

SEQ ID NO: 601860 - RNA, 64 nt, Homo Sapiens; identical to SEQ ID NO: 155779

SEQ ID NO: 601861 - RNA, 64 nt, Homo Sapiens; identical to SEQ ID NO: 155780

SEQ ID NO: 601862 - RNA, 64 nt, Homo Sapiens; identical to SEQ ID NO: 155781

SEQ ID NO: 601863 - RNA, 64 nt, Homo Sapiens; identical to SEQ ID NO: 155782

SEQ ID NO: 601864 - RNA, 64 nt, Homo Sapiens; identical to SEQ ID NO: 155783

SEQ ID NO: 601865 - RNA, 64 nt, Homo Sapiens; identical to SEQ ID NO: 155784

SEQ ID NO: 601866 - RNA, 64 nt, Homo Sapiens; identical to SEQ ID NO: 155785

SEQ ID NO: 601867 - RNA, 64 nt, Homo Sapiens; identical to SEQ ID NO: 155786

SEQ ID NO: 601868 - RNA, 53 nt, Homo Sapiens; identical to SEQ ID NO: 155787

SEQ ID NO: 601869 - RNA, 64 nt, Homo Sapiens; identical to SEQ ID NO: 155788

SEQ ID NO: 601870 - RNA, 64 nt, Homo Sapiens; identical to SEQ ID NO: 155789

SEQ ID NO: 601871 - RNA, 64 nt, Homo Sapiens; identical to SEQ ID NO: 155790

SEQ ID NO: 601872 - RNA, 64 nt, Homo Sapiens; identical to SEQ ID NO: 155791

SEQ ID NO: 601873 - RNA, 64 nt, Homo Sapiens; identical to SEQ ID NO: 155792

SEQ ID NO: 601874 - RNA, 64 nt, Homo Sapiens; identical to SEQ ID NO: 155793

SEQ ID NO: 601875 - RNA, 64 nt, Homo Sapiens; identical to SEQ ID NO: 155794

SEQ ID NO: 601876 - RNA, 64 nt, Homo Sapiens; identical to SEQ ID NO: 155795

SEQ ID NO: 601877 - RNA, 64 nt, Homo Sapiens; identical to SEQ ID NO: 155796

SEQ ID NO: 601878 - RNA, 64 nt, Homo Sapiens; identical to SEQ ID NO: 155797

SEQ ID NO: 601879 - RNA, 64 nt, Homo Sapiens; identical to SEQ ID NO: 155798

SEQ ID NO: 601880 - RNA, 64 nt, Homo Sapiens; identical to SEQ ID NO: 155799

SEQ ID NO: 601881 - RNA, 64 nt, Homo Sapiens; identical to SEQ ID NO: 155800

SEQ ID NO: 601882 - RNA, 64 nt, Homo Sapiens; identical to SEQ ID NO: 155801

SEQ ID NO: 601883 - RNA, 64 nt, Homo Sapiens; identical to SEQ ID NO: 155802

SEQ ID NO: 601884 - RNA, 64 nt, Homo Sapiens; identical to SEQ ID NO: 155803

SEQ ID NO: 601885 - RNA, 64 nt, Homo Sapiens; identical to SEQ ID NO: 155804

SEQ ID NO: 601886 - RNA, 64 nt, Homo Sapiens; identical to SEQ ID NO: 155805

SEQ ID NO: 601887 - RNA, 64 nt, Homo Sapiens; identical to SEQ ID NO: 155806

SEQ ID NO: 601888 - RNA, 64 nt, Homo Sapiens; identical to SEQ ID NO: 155807

SEQ ID NO: 601889 - RNA, 64 nt, Homo Sapiens; identical to SEQ ID NO: 155808

SEQ ID NO: 601890 - RNA, 64 nt, Homo Sapiens; identical to SEQ ID NO: 556943

SEQ ID NO: 601891 - RNA, 64 nt, Homo Sapiens; identical to SEQ ID NO: 556944

SEQ ID NO: 601892 - RNA, 64 nt, Homo Sapiens; identical to SEQ ID NO: 556945

SEQ ID NO: 601893 - RNA, 64 nt, Homo Sapiens; identical to SEQ ID NO: 556946

SEQ ID NO: 601894 - RNA, 64 nt, Homo Sapiens; identical to SEQ ID NO: 556947

SEQ ID NO: 601895 - RNA, 64 nt, Homo Sapiens; identical to SEQ ID NO: 556948

SEQ ID NO: 601896 - RNA, 64 nt, Homo Sapiens; identical to SEQ ID NO: 556949

SEQ ID NO: 601897 - RNA, 64 nt, Homo Sapiens; identical to SEQ ID NO: 556950

SEQ ID NO: 601898 - RNA, 64 nt, Homo Sapiens; identical to SEQ ID NO: 556951

SEQ ID NO: 601899 - RNA, 64 nt, Homo Sapiens; identical to SEQ ID NO: 556952

SEQ ID NO: 601900 - RNA, 64 nt, Homo Sapiens; identical to SEQ ID NO: 556953

SEQ ID NO: 601901 - RNA, 64 nt, Homo Sapiens; identical to SEQ ID NO: 556954

SEQ ID NO: 601902 - RNA, 64 nt, Homo Sapiens; identical to SEQ ID NO: 556955

SEQ ID NO: 601903 - RNA, 64 nt, Homo Sapiens; identical to SEQ ID NO: 556956

SEQ ID NO: 601904 - RNA, 64 nt, Homo Sapiens; identical to SEQ ID NO: 556957

SEQ ID NO: 601905 - RNA, 64 nt, Homo Sapiens; identical to SEQ ID NO: 556958

SEQ ID NO: 601906 - RNA, 64 nt, Homo Sapiens; identical to SEQ ID NO: 556959

SEQ ID NO: 601907 - RNA, 58 nt, Homo Sapiens; identical to SEQ ID NO: 556960

SEQ ID NO: 601908 - RNA, 64 nt, Homo Sapiens; identical to SEQ ID NO: 556961

SEQ ID NO: 601909 - RNA, 64 nt, Homo Sapiens; identical to SEQ ID NO: 556962

SEQ ID NO: 601910 - RNA, 64 nt, Homo Sapiens; identical to SEQ ID NO: 556963

SEQ ID NO: 601911 - RNA, 64 nt, Homo Sapiens; identical to SEQ ID NO: 556964

SEQ ID NO: 601912 - RNA, 64 nt, Homo Sapiens; identical to SEQ ID NO: 556965

SEQ ID NO: 601913 - RNA, 64 nt, Homo Sapiens; identical to SEQ ID NO: 556966

SEQ ID NO: 601914 - RNA, 64 nt, Homo Sapiens; identical to SEQ ID NO: 556967

SEQ ID NO: 601915 - RNA, 64 nt, Homo Sapiens; identical to SEQ ID NO: 556968

SEQ ID NO: 601916 - RNA, 64 nt, Homo Sapiens; identical to SEQ ID NO: 556969

SEQ ID NO: 601917 - RNA, 64 nt, Homo Sapiens; identical to SEQ ID NO: 556970

SEQ ID NO: 601918 - RNA, 64 nt, Homo Sapiens; identical to SEQ ID NO: 556971

SEQ ID NO: 601919 - RNA, 64 nt, Homo Sapiens; identical to SEQ ID NO: 556972

SEQ ID NO: 601920 - RNA, 64 nt, Homo Sapiens; identical to SEQ ID NO: 556973

SEQ ID NO: 601921 - RNA, 64 nt, Homo Sapiens; identical to SEQ ID NO: 556974

SEQ ID NO: 601922 - RNA, 64 nt, Homo Sapiens; identical to SEQ ID NO: 556975

SEQ ID NO: 601923 - RNA, 64 nt, Homo Sapiens; identical to SEQ ID NO: 556976

SEQ ID NO: 601924 - RNA, 64 nt, Homo Sapiens; identical to SEQ ID NO: 556977

SEQ ID NO: 601925 - RNA, 64 nt, Homo Sapiens; identical to SEQ ID NO: 556978

SEQ ID NO: 601926 - RNA, 64 nt, Homo Sapiens; identical to SEQ ID NO: 556979

SEQ ID NO: 601927 - RNA, 64 nt, Homo Sapiens; identical to SEQ ID NO: 556980

SEQ ID NO: 601928 - RNA, 64 nt, Homo Sapiens; identical to SEQ ID NO: 556981

SEQ ID NO: 601929 - RNA, 64 nt, Homo Sapiens; identical to SEQ ID NO: 556982

SEQ ID NO: 601930 - RNA, 64 nt, Homo Sapiens; identical to SEQ ID NO: 556983

SEQ ID NO: 601931 - RNA, 64 nt, Homo Sapiens; identical to SEQ ID NO: 556984

SEQ ID NO: 601932 - RNA, 64 nt, Homo Sapiens; identical to SEQ ID NO: 556985

SEQ ID NO: 601933 - RNA, 64 nt, Homo Sapiens; identical to SEQ ID NO: 556986

SEQ ID NO: 601934 - RNA, 64 nt, Homo Sapiens; identical to SEQ ID NO: 556987

SEQ ID NO: 601935 - RNA, 64 nt, Homo Sapiens; identical to SEQ ID NO: 556988

SEQ ID NO: 601936 - RNA, 64 nt, Homo Sapiens; identical to SEQ ID NO: 556989

SEQ ID NO: 601937 - RNA, 64 nt, Homo Sapiens; identical to SEQ ID NO: 556990

SEQ ID NO: 601938 - RNA, 64 nt, Homo Sapiens; identical to SEQ ID NO: 556991

SEQ ID NO: 601939 - RNA, 64 nt, Homo Sapiens; identical to SEQ ID NO: 556992

SEQ ID NO: 601940 - RNA, 64 nt, Homo Sapiens; identical to SEQ ID NO: 556993

SEQ ID NO: 601941 - RNA, 64 nt, Homo Sapiens; identical to SEQ ID NO: 556994

SEQ ID NO: 601942 - RNA, 64 nt, Homo Sapiens; identical to SEQ ID NO: 556995

SEQ ID NO: 601943 - RNA, 64 nt, Homo Sapiens; identical to SEQ ID NO: 556996

SEQ ID NO: 601944 - RNA, 64 nt, Homo Sapiens; identical to SEQ ID NO: 556997

SEQ ID NO: 601945 - RNA, 64 nt, Homo Sapiens; identical to SEQ ID NO: 556998

SEQ ID NO: 601946 - RNA, 64 nt, Homo Sapiens; identical to SEQ ID NO: 556999

SEQ ID NO: 601947 - RNA, 64 nt, Homo Sapiens; identical to SEQ ID NO: 557000

SEQ ID NO: 601948 - RNA, 64 nt, Homo Sapiens; identical to SEQ ID NO: 557001

SEQ ID NO: 601949 - RNA, 64 nt, Homo Sapiens; identical to SEQ ID NO: 557002

SEQ ID NO: 601950 - RNA, 64 nt, Homo Sapiens; identical to SEQ ID NO: 557003

SEQ ID NO: 601951 - RNA, 64 nt, Homo Sapiens; identical to SEQ ID NO: 557004

SEQ ID NO: 601952 - RNA, 64 nt, Homo Sapiens; identical to SEQ ID NO: 557005

SEQ ID NO: 601953 - RNA, 64 nt, Homo Sapiens; identical to SEQ ID NO: 557006

SEQ ID NO: 601954 - RNA, 64 nt, Homo Sapiens; identical to SEQ ID NO: 557007

SEQ ID NO: 601955 - RNA, 64 nt, Homo Sapiens; identical to SEQ ID NO: 557008

SEQ ID NO: 601956 - RNA, 64 nt, Homo Sapiens; identical to SEQ ID NO: 557009

SEQ ID NO: 601957 - RNA, 64 nt, Homo Sapiens; identical to SEQ ID NO: 557010

SEQ ID NO: 601958 - RNA, 64 nt, Homo Sapiens; identical to SEQ ID NO: 557011

SEQ ID NO: 601959 - RNA, 64 nt, Homo Sapiens; identical to SEQ ID NO: 557012

SEQ ID NO: 601960 - RNA, 64 nt, Homo Sapiens; identical to SEQ ID NO: 557013

SEQ ID NO: 601961 - RNA, 64 nt, Homo Sapiens; identical to SEQ ID NO: 557014

SEQ ID NO: 601962 - RNA, 64 nt, Homo Sapiens; identical to SEQ ID NO: 557015

SEQ ID NO: 601963 - RNA, 64 nt, Homo Sapiens; identical to SEQ ID NO: 557016

SEQ ID NO: 601964 - RNA, 64 nt, Homo Sapiens; identical to SEQ ID NO: 557017

SEQ ID NO: 601965 - RNA, 64 nt, Homo Sapiens; identical to SEQ ID NO: 557018

SEQ ID NO: 601966 - RNA, 64 nt, Homo Sapiens; identical to SEQ ID NO: 557019

SEQ ID NO: 601967 - RNA, 64 nt, Homo Sapiens; identical to SEQ ID NO: 557020

SEQ ID NO: 601968 - RNA, 64 nt, Homo Sapiens; identical to SEQ ID NO: 557021

SEQ ID NO: 601969 - RNA, 64 nt, Homo Sapiens; identical to SEQ ID NO: 557022

SEQ ID NO: 601970 - RNA, 64 nt, Homo Sapiens; identical to SEQ ID NO: 557023

SEQ ID NO: 601971 - RNA, 64 nt, Homo Sapiens; identical to SEQ ID NO: 557024

SEQ ID NO: 601972 - RNA, 64 nt, Homo Sapiens; identical to SEQ ID NO: 557025

SEQ ID NO: 601973 - RNA, 64 nt, Homo Sapiens; identical to SEQ ID NO: 99218

SEQ ID NO: 601974 - RNA, 64 nt, Homo Sapiens; identical to SEQ ID NO: 99219

SEQ ID NO: 601975 - RNA, 64 nt, Homo Sapiens; identical to SEQ ID NO: 99220

SEQ ID NO: 601976 - RNA, 64 nt, Homo Sapiens; identical to SEQ ID NO: 99221

SEQ ID NO: 601977 - RNA, 64 nt, Homo Sapiens; identical to SEQ ID NO: 99222

SEQ ID NO: 601978 - RNA, 64 nt, Homo Sapiens; identical to SEQ ID NO: 99223

SEQ ID NO: 601979 - RNA, 64 nt, Homo Sapiens; identical to SEQ ID NO: 99224

SEQ ID NO: 601980 - RNA, 64 nt, Homo Sapiens; identical to SEQ ID NO: 99225

SEQ ID NO: 601981 - RNA, 64 nt, Homo Sapiens; identical to SEQ ID NO: 99226

SEQ ID NO: 601982 - RNA, 64 nt, Homo Sapiens; identical to SEQ ID NO: 99227

SEQ ID NO: 601983 - RNA, 64 nt, Homo Sapiens; identical to SEQ ID NO: 99228

SEQ ID NO: 601984 - RNA, 64 nt, Homo Sapiens; identical to SEQ ID NO: 99229

SEQ ID NO: 601985 - RNA, 64 nt, Homo Sapiens; identical to SEQ ID NO: 99230

SEQ ID NO: 601986 - RNA, 64 nt, Homo Sapiens; identical to SEQ ID NO: 99231

SEQ ID NO: 601987 - RNA, 64 nt, Homo Sapiens; identical to SEQ ID NO: 99232

SEQ ID NO: 601988 - RNA, 64 nt, Homo Sapiens; identical to SEQ ID NO: 99233

SEQ ID NO: 601989 - RNA, 64 nt, Homo Sapiens; identical to SEQ ID NO: 99234

SEQ ID NO: 601990 - RNA, 64 nt, Homo Sapiens; identical to SEQ ID NO: 99235

SEQ ID NO: 601991 - RNA, 64 nt, Homo Sapiens; identical to SEQ ID NO: 99236

SEQ ID NO: 601992 - RNA, 64 nt, Homo Sapiens; identical to SEQ ID NO: 99237

SEQ ID NO: 601993 - RNA, 64 nt, Homo Sapiens; identical to SEQ ID NO: 99238

SEQ ID NO: 601994 - RNA, 64 nt, Homo Sapiens; identical to SEQ ID NO: 99239

SEQ ID NO: 601995 - RNA, 64 nt, Homo Sapiens; identical to SEQ ID NO: 99240

SEQ ID NO: 601996 - RNA, 64 nt, Homo Sapiens; identical to SEQ ID NO: 99241

SEQ ID NO: 601997 - RNA, 64 nt, Homo Sapiens; identical to SEQ ID NO: 144505

SEQ ID NO: 601998 - RNA, 64 nt, Homo Sapiens; identical to SEQ ID NO: 144505

SEQ ID NO: 601999 - RNA, 64 nt, Homo Sapiens; identical to SEQ ID NO: 144507

SEQ ID NO: 602000 - RNA, 64 nt, Homo Sapiens; identical to SEQ ID NO: 144508

SEQ ID NO: 602001 - RNA, 64 nt, Homo Sapiens
caguggccauugagcugggagcauucuucccucuaccgcuuaagccacugauggcugcgagcuu

SEQ ID NO: 602002 - RNA, 64 nt, Homo Sapiens
ugcugcuuuacuaacugacguguuggaccaccccaccgcuuaauggggcacgcacggugcauca

SEQ ID NO: 602003 - RNA, 64 nt, Homo Sapiens
cagcaucccccucuauuuccaaugcuccucuccaaccgcuuaguuucugaauuucuuuuaaauu

SEQ ID NO: 602004 - RNA, 64 nt, Homo Sapiens
accuuguauauauuuaauuucucuaucuagccaaaccgcuuacgaaacugcgaacuccuuaaag

SEQ ID NO: 602005 - RNA, 64 nt, Homo Sapiens
gauagcaucuucuuuggcacaagacuaguggcuuaccgcuuaccuuagaguuuuguuuuuuuuu

SEQ ID NO: 602006 - RNA, 64 nt, Homo Sapiens
uggccacuggcacuccagggagacaugaggcugcaccgcuuaccuacgagcacauccagaaaga

SEQ ID NO: 602007 - RNA, 64 nt, Homo Sapiens
uaaucccagcuacuugggaggcugaggcaggagaaccgcuuaaaccugggagguggagguugca

SEQ ID NO: 602008 - RNA, 64 nt, Homo Sapiens
ccauuuuuuucuuaacaucguaguuguugaagguaccgcuuaagugucaccuucuuaacuagaa

SEQ ID NO: 602009 - RNA, 64 nt, Homo Sapiens
auagcuaauagcucuuauuuuucuuauguuuuuaaccgcuuaggucuauuuggauguaagggug

SEQ ID NO: 602010 - RNA, 54 nt, Homo Sapiens
uuuacggcuucggcggcuaaugcuaccgcuuaaacgacucagcaucucgacuuc

SEQ ID NO: 602011 - RNA, 64 nt, Homo Sapiens
cuuuuugucuuuuuaacaaacccuaggauuuuucaccgcuuauuauugucuaggucacaguaau

SEQ ID NO: 602012 - RNA, 64 nt, Homo Sapiens
accauccuagagagggcccuaccuaugcaaucacaccgcuuaugcuaauuagugccuggggaug

SEQ ID NO: 602013 - RNA, 64 nt, Homo Sapiens
ucugucccagaaaagcggcccugcaaguuugaggaccgcuuauuccacuuuaaggacagccuuc

SEQ ID NO: 602014 - RNA, 64 nt, Homo Sapiens
ccagcccuccccugggagcaagggagucucacccaccgcuuaccaucagggccaacugagagug

SEQ ID NO: 602015 - RNA, 64 nt, Homo Sapiens
ugcugcuccaguaacuacaguggcauuaggacuuaccgcuuagaugacaauagugcucuuuaca

SEQ ID NO: 602016 - RNA, 64 nt, Homo Sapiens
cccagguguucaaggcugcugcugagguggaaggaccgcuuaaguccucccagcacuuugcagg

SEQ ID NO: 602017 - RNA, 64 nt, Homo Sapiens
accaaugcucccaagcugaauaguaaucuucuagaccgcuuaaauuuguauuucuggaagaaug

SEQ ID NO: 602018 - RNA, 64 nt, Homo Sapiens
cauccaggaauacagucugcagugcagcaacagaaccgcuuaccaagaacugugcuuacauacc

SEQ ID NO: 602019 - RNA, 64 nt, Homo Sapiens
auugauauaaauuacugaggauuguauauaaaguaccgcuuaaauaugcauguguuuuuucccc

SEQ ID NO: 602020 - RNA, 64 nt, Homo Sapiens
uuguucacacucagaacccaggacagccacagccaccgcuuaggggaagccacugcagaugccc

SEQ ID NO: 602021 - RNA, 64 nt, Homo Sapiens
auuugcgggucuaaucuaauauuagaauauauuaaccgcuuaaggcauugaagccauaugggau

SEQ ID NO: 602022 - RNA, 64 nt, Homo Sapiens
ccucgccauaaggcacuuaucccugguuccuagcaccgcuuauccccucagaauccacaacuug

SEQ ID NO: 602023 - RNA, 64 nt, Homo Sapiens
agcccaguggcaccuggaaugccagugaaacagaaccgcuuacucccuuguuaagggggcugaa

SEQ ID NO: 602024 - RNA, 64 nt, Homo Sapiens
gggguuccugaaccacaaacacccagggcggaaaaccgcuuaaagggcgaggaacaccuggccc

SEQ ID NO: 602025 - RNA, 64 nt, Homo Sapiens
aaggaggccagaggcugcaaggagcggggucgugaccgcuuacaccccuucuccacagcccggc

SEQ ID NO: 602026 - RNA, 64 nt, Homo Sapiens
acuuuuccucaagaggaaaucuggauuuccaccuaccgcuuaccugaaaugcaggaucaccuac

SEQ ID NO: 602027 - RNA, 64 nt, Homo Sapiens
aaguucuguuugguuaguauacagcuuugggaugaccgcuuacagcacagcccagugugggauu

SEQ ID NO: 602028 - RNA, 64 nt, Homo Sapiens; identical to SEQ ID NO: 45231

SEQ ID NO: 602029 - RNA, 64 nt, Homo Sapiens; identical to SEQ ID NO: 45232

SEQ ID NO: 602030 - RNA, 64 nt, Homo Sapiens; identical to SEQ ID NO: 45233

SEQ ID NO: 602031 - RNA, 64 nt, Homo Sapiens; identical to SEQ ID NO: 45234

SEQ ID NO: 602032 - RNA, 64 nt, Homo Sapiens; identical to SEQ ID NO: 45235

SEQ ID NO: 602033 - RNA, 64 nt, Homo Sapiens; identical to SEQ ID NO: 45236

SEQ ID NO: 602034 - RNA, 64 nt, Homo Sapiens; identical to SEQ ID NO: 45237

SEQ ID NO: 602035 - RNA, 64 nt, Homo Sapiens; identical to SEQ ID NO: 45238

SEQ ID NO: 602036 - RNA, 64 nt, Homo Sapiens; identical to SEQ ID NO: 45239

SEQ ID NO: 602037 - RNA, 64 nt, Homo Sapiens; identical to SEQ ID NO: 45240

SEQ ID NO: 602038 - RNA, 64 nt, Homo Sapiens; identical to SEQ ID NO: 45241

SEQ ID NO: 602039 - RNA, 64 nt, Homo Sapiens; identical to SEQ ID NO: 45242

SEQ ID NO: 602040 - RNA, 64 nt, Homo Sapiens; identical to SEQ ID NO: 45243

SEQ ID NO: 602041 - RNA, 64 nt, Homo Sapiens; identical to SEQ ID NO: 45244

SEQ ID NO: 602042 - RNA, 64 nt, Homo Sapiens; identical to SEQ ID NO: 45245

SEQ ID NO: 602043 - RNA, 64 nt, Homo Sapiens; identical to SEQ ID NO: 45246

SEQ ID NO: 602044 - RNA, 64 nt, Homo Sapiens; identical to SEQ ID NO: 45247

SEQ ID NO: 602045 - RNA, 64 nt, Homo Sapiens; identical to SEQ ID NO: 45248

SEQ ID NO: 602046 - RNA, 64 nt, Homo Sapiens; identical to SEQ ID NO: 45249

SEQ ID NO: 602047 - RNA, 64 nt, Homo Sapiens; identical to SEQ ID NO: 45250

SEQ ID NO: 602048 - RNA, 64 nt, Homo Sapiens; identical to SEQ ID NO: 45251

SEQ ID NO: 602049 - RNA, 64 nt, Homo Sapiens; identical to SEQ ID NO: 45252

SEQ ID NO: 602050 - RNA, 64 nt, Homo Sapiens; identical to SEQ ID NO: 45253

SEQ ID NO: 602051 - RNA, 64 nt, Homo Sapiens; identical to SEQ ID NO: 45254

SEQ ID NO: 602052 - RNA, 64 nt, Homo Sapiens; identical to SEQ ID NO: 45255

SEQ ID NO: 602053 - RNA, 64 nt, Homo Sapiens; identical to SEQ ID NO: 45256

SEQ ID NO: 602054 - RNA, 64 nt, Homo Sapiens; identical to SEQ ID NO: 45257

SEQ ID NO: 602055 - RNA, 64 nt, Homo Sapiens; identical to SEQ ID NO: 45258

SEQ ID NO: 602056 - RNA, 64 nt, Homo Sapiens; identical to SEQ ID NO: 45259

SEQ ID NO: 602057 - RNA, 64 nt, Homo Sapiens; identical to SEQ ID NO: 45260

SEQ ID NO: 602058 - RNA, 64 nt, Homo Sapiens; identical to SEQ ID NO: 45261

SEQ ID NO: 602059 - RNA, 64 nt, Homo Sapiens; identical to SEQ ID NO: 45262

SEQ ID NO: 602060 - RNA, 64 nt, Homo Sapiens; identical to SEQ ID NO: 45263

SEQ ID NO: 602061 - RNA, 64 nt, Homo Sapiens; identical to SEQ ID NO: 45264

SEQ ID NO: 602062 - RNA, 64 nt, Homo Sapiens; identical to SEQ ID NO: 45265

SEQ ID NO: 602063 - RNA, 64 nt, Homo Sapiens; identical to SEQ ID NO: 45266

SEQ ID NO: 602064 - RNA, 64 nt, Homo Sapiens; identical to SEQ ID NO: 45267

SEQ ID NO: 602065 - RNA, 64 nt, Homo Sapiens; identical to SEQ ID NO: 45268

SEQ ID NO: 602066 - RNA, 64 nt, Homo Sapiens; identical to SEQ ID NO: 45269

SEQ ID NO: 602067 - RNA, 64 nt, Homo Sapiens; identical to SEQ ID NO: 45270

SEQ ID NO: 602068 - RNA, 64 nt, Homo Sapiens; identical to SEQ ID NO: 45271

SEQ ID NO: 602069 - RNA, 64 nt, Homo Sapiens; identical to SEQ ID NO: 45272

SEQ ID NO: 602070 - RNA, 64 nt, Homo Sapiens; identical to SEQ ID NO: 45273

SEQ ID NO: 602071 - RNA, 64 nt, Homo Sapiens; identical to SEQ ID NO: 45274

SEQ ID NO: 602072 - RNA, 64 nt, Homo Sapiens; identical to SEQ ID NO: 45275

SEQ ID NO: 602073 - RNA, 64 nt, Homo Sapiens; identical to SEQ ID NO: 45276

SEQ ID NO: 602074 - RNA, 64 nt, Homo Sapiens; identical to SEQ ID NO: 45277

SEQ ID NO: 602075 - RNA, 64 nt, Homo Sapiens; identical to SEQ ID NO: 45278

SEQ ID NO: 602076 - RNA, 64 nt, Homo Sapiens; identical to SEQ ID NO: 45279

SEQ ID NO: 602077 - RNA, 64 nt, Homo Sapiens; identical to SEQ ID NO: 45280

SEQ ID NO: 602078 - RNA, 64 nt, Homo Sapiens; identical to SEQ ID NO: 468621

SEQ ID NO: 602079 - RNA, 64 nt, Homo Sapiens; identical to SEQ ID NO: 468622

SEQ ID NO: 602080 - RNA, 64 nt, Homo Sapiens; identical to SEQ ID NO: 468623

SEQ ID NO: 602081 - RNA, 64 nt, Homo Sapiens; identical to SEQ ID NO: 468624

SEQ ID NO: 602082 - RNA, 64 nt, Homo Sapiens; identical to SEQ ID NO: 468625

SEQ ID NO: 602083 - RNA, 64 nt, Homo Sapiens; identical to SEQ ID NO: 468626

SEQ ID NO: 602084 - RNA, 64 nt, Homo Sapiens; identical to SEQ ID NO: 468627

SEQ ID NO: 602085 - RNA, 64 nt, Homo Sapiens; identical to SEQ ID NO: 468628

SEQ ID NO: 602086 - RNA, 64 nt, Homo Sapiens; identical to SEQ ID NO: 468629

SEQ ID NO: 602087 - RNA, 64 nt, Homo Sapiens; identical to SEQ ID NO: 468630

SEQ ID NO: 602088 - RNA, 64 nt, Homo Sapiens; identical to SEQ ID NO: 468631

SEQ ID NO: 602089 - RNA, 64 nt, Homo Sapiens; identical to SEQ ID NO: 468632

SEQ ID NO: 602090 - RNA, 64 nt, Homo Sapiens; identical to SEQ ID NO: 468633

SEQ ID NO: 602091 - RNA, 64 nt, Homo Sapiens; identical to SEQ ID NO: 468634

SEQ ID NO: 602092 - RNA, 64 nt, Homo Sapiens; identical to SEQ ID NO: 468635

SEQ ID NO: 602093 - RNA, 64 nt, Homo Sapiens; identical to SEQ ID NO: 468636

SEQ ID NO: 602094 - RNA, 64 nt, Homo Sapiens; identical to SEQ ID NO: 468637

SEQ ID NO: 602095 - RNA, 64 nt, Homo Sapiens; identical to SEQ ID NO: 468638

SEQ ID NO: 602096 - RNA, 64 nt, Homo Sapiens; identical to SEQ ID NO: 468639

SEQ ID NO: 602097 - RNA, 64 nt, Homo Sapiens; identical to SEQ ID NO: 468640

SEQ ID NO: 602098 - RNA, 64 nt, Homo Sapiens; identical to SEQ ID NO: 468641

SEQ ID NO: 602099 - RNA, 64 nt, Homo Sapiens; identical to SEQ ID NO: 468642

SEQ ID NO: 602100 - RNA, 64 nt, Homo Sapiens; identical to SEQ ID NO: 468643

SEQ ID NO: 602101 - RNA, 64 nt, Homo Sapiens; identical to SEQ ID NO: 468644

SEQ ID NO: 602102 - RNA, 64 nt, Homo Sapiens; identical to SEQ ID NO: 468645

SEQ ID NO: 602103 - RNA, 64 nt, Homo Sapiens; identical to SEQ ID NO: 468646

SEQ ID NO: 602104 - RNA, 64 nt, Homo Sapiens; identical to SEQ ID NO: 468647

SEQ ID NO: 602105 - RNA, 64 nt, Homo Sapiens; identical to SEQ ID NO: 468648

SEQ ID NO: 602106 - RNA, 64 nt, Homo Sapiens; identical to SEQ ID NO: 468649

SEQ ID NO: 602107 - RNA, 64 nt, Homo Sapiens; identical to SEQ ID NO: 468650

SEQ ID NO: 602108 - RNA, 64 nt, Homo Sapiens; identical to SEQ ID NO: 468651

SEQ ID NO: 602109 - RNA, 64 nt, Homo Sapiens; identical to SEQ ID NO: 468652

SEQ ID NO: 602110 - RNA, 64 nt, Homo Sapiens; identical to SEQ ID NO: 468653

SEQ ID NO: 602111 - RNA, 64 nt, Homo Sapiens; identical to SEQ ID NO: 468654

SEQ ID NO: 602112 - RNA, 64 nt, Homo Sapiens; identical to SEQ ID NO: 468655

SEQ ID NO: 602113 - RNA, 64 nt, Homo Sapiens; identical to SEQ ID NO: 468656

SEQ ID NO: 602114 - RNA, 64 nt, Homo Sapiens; identical to SEQ ID NO: 468657

SEQ ID NO: 602115 - RNA, 64 nt, Homo Sapiens; identical to SEQ ID NO: 468658

SEQ ID NO: 602116 - RNA, 64 nt, Homo Sapiens; identical to SEQ ID NO: 468659

SEQ ID NO: 602117 - RNA, 64 nt, Homo Sapiens; identical to SEQ ID NO: 468660

SEQ ID NO: 602118 - RNA, 64 nt, Homo Sapiens; identical to SEQ ID NO: 468661

SEQ ID NO: 602119 - RNA, 64 nt, Homo Sapiens; identical to SEQ ID NO: 468662

SEQ ID NO: 602120 - RNA, 64 nt, Homo Sapiens; identical to SEQ ID NO: 468663

SEQ ID NO: 602121 - RNA, 64 nt, Homo Sapiens; identical to SEQ ID NO: 468664

SEQ ID NO: 602122 - RNA, 64 nt, Homo Sapiens; identical to SEQ ID NO: 468665

SEQ ID NO: 602123 - RNA, 64 nt, Homo Sapiens; identical to SEQ ID NO: 468666

SEQ ID NO: 602124 - RNA, 64 nt, Homo Sapiens; identical to SEQ ID NO: 468667

SEQ ID NO: 602125 - RNA, 64 nt, Homo Sapiens; identical to SEQ ID NO: 468668

SEQ ID NO: 602126 - RNA, 64 nt, Homo Sapiens; identical to SEQ ID NO: 468669

SEQ ID NO: 602127 - RNA, 64 nt, Homo Sapiens; identical to SEQ ID NO: 468670

SEQ ID NO: 602128 - RNA, 64 nt, Homo Sapiens; identical to SEQ ID NO: 468671

SEQ ID NO: 602129 - RNA, 64 nt, Homo Sapiens; identical to SEQ ID NO: 468672

SEQ ID NO: 602130 - RNA, 64 nt, Homo Sapiens; identical to SEQ ID NO: 468673

SEQ ID NO: 602131 - RNA, 64 nt, Homo Sapiens; identical to SEQ ID NO: 468674

SEQ ID NO: 602132 - RNA, 64 nt, Homo Sapiens; identical to SEQ ID NO: 468675

SEQ ID NO: 602133 - RNA, 64 nt, Homo Sapiens; identical to SEQ ID NO: 468676

SEQ ID NO: 602134 - RNA, 64 nt, Homo Sapiens; identical to SEQ ID NO: 468677

SEQ ID NO: 602135 - RNA, 64 nt, Homo Sapiens; identical to SEQ ID NO: 468678

SEQ ID NO: 602136 - RNA, 64 nt, Homo Sapiens; identical to SEQ ID NO: 468679

SEQ ID NO: 602137 - RNA, 64 nt, Homo Sapiens; identical to SEQ ID NO: 468680

SEQ ID NO: 602138 - RNA, 64 nt, Homo Sapiens; identical to SEQ ID NO: 468681

SEQ ID NO: 602139 - RNA, 64 nt, Homo Sapiens; identical to SEQ ID NO: 468682

SEQ ID NO: 602140 - RNA, 64 nt, Homo Sapiens; identical to SEQ ID NO: 468683

SEQ ID NO: 602141 - RNA, 64 nt, Homo Sapiens; identical to SEQ ID NO: 468684

SEQ ID NO: 602142 - RNA, 64 nt, Homo Sapiens; identical to SEQ ID NO: 468685

SEQ ID NO: 602143 - RNA, 64 nt, Homo Sapiens; identical to SEQ ID NO: 468686

SEQ ID NO: 602144 - RNA, 64 nt, Homo Sapiens; identical to SEQ ID NO: 468687

SEQ ID NO: 602145 - RNA, 64 nt, Homo Sapiens; identical to SEQ ID NO: 468688

SEQ ID NO: 602146 - RNA, 64 nt, Homo Sapiens; identical to SEQ ID NO: 468689

SEQ ID NO: 602147 - RNA, 64 nt, Homo Sapiens; identical to SEQ ID NO: 468690

SEQ ID NO: 602148 - RNA, 64 nt, Homo Sapiens; identical to SEQ ID NO: 468691

SEQ ID NO: 602149 - RNA, 64 nt, Homo Sapiens
ucuuccaaaauagcugcuuuugauacuuucuaccuaauggcagccaacuuucuuuuguacauuu

SEQ ID NO: 602150 - RNA, 64 nt, Homo Sapiens
aucauuaaugagacaugaguacacucaucacaauuaauggcacuauugaccacaugaaucgaaa

SEQ ID NO: 602151 - RNA, 64 nt, Homo Sapiens
aaaguuccagcuuguguagucucacuagcuugacuaauggcaacgagauagauagauauacuau

SEQ ID NO: 602152 - RNA, 64 nt, Homo Sapiens
ccauugacuuaaagguaucauuugaaaaauaccauaauggcauuugagacugaauuucuaaaaa

SEQ ID NO: 602153 - RNA, 64 nt, Homo Sapiens
caucugccacaggucuauuuugaagcuuuucuucuaauggcaauguuuguccuuaccaggauuu

SEQ ID NO: 602154 - RNA, 64 nt, Homo Sapiens
accaauauuuucuauauugucuggcauuaaaauguaauggcaaagcuuucaacagguuuuaaac

SEQ ID NO: 602155 - RNA, 64 nt, Homo Sapiens
ugaauguuccagcagccuaauuaaggccugucuguaauggcaucuagagaauaagcuugccaau

SEQ ID NO: 602156 - RNA, 64 nt, Homo Sapiens
aauucauggcuagugauguaauuuguauaguaacuaauggcaaaggauaauggcacuaggcagc

SEQ ID NO: 602157 - RNA, 64 nt, Homo Sapiens
aggcagcauuuguauaguaauugugcuauuuggauaauggcacugaauuguggacguaaaaugg

SEQ ID NO: 602158 - RNA, 64 nt, Homo Sapiens
cuccagaaaauauccaucuucuuuuuguggcugcuaauggcagaagugccugugcuagaguucc

SEQ ID NO: 602159 - RNA, 64 nt, Homo Sapiens
agacgggaugcuaagcagugcaccugcagugguuuaauggcagauaagcuccgucugcaguucc

SEQ ID NO: 602160 - RNA, 64 nt, Homo Sapiens; identical to SEQ ID NO: 584690

SEQ ID NO: 602161 - RNA, 64 nt, Homo Sapiens; identical to SEQ ID NO: 584691

SEQ ID NO: 602162 - RNA, 64 nt, Homo Sapiens; identical to SEQ ID NO: 412166

SEQ ID NO: 602163 - RNA, 64 nt, Homo Sapiens; identical to SEQ ID NO: 412167

SEQ ID NO: 602164 - RNA, 64 nt, Homo Sapiens; identical to SEQ ID NO: 412168

SEQ ID NO: 602165 - RNA, 64 nt, Homo Sapiens; identical to SEQ ID NO: 412169

SEQ ID NO: 602166 - RNA, 64 nt, Homo Sapiens; identical to SEQ ID NO: 412170

SEQ ID NO: 602167 - RNA, 64 nt, Homo Sapiens; identical to SEQ ID NO: 412171

SEQ ID NO: 602168 - RNA, 64 nt, Homo Sapiens; identical to SEQ ID NO: 412172

SEQ ID NO: 602169 - RNA, 64 nt, Homo Sapiens; identical to SEQ ID NO: 412173

SEQ ID NO: 602170 - RNA, 64 nt, Homo Sapiens; identical to SEQ ID NO: 412174

SEQ ID NO: 602171 - RNA, 64 nt, Homo Sapiens; identical to SEQ ID NO: 412175

SEQ ID NO: 602172 - RNA, 64 nt, Homo Sapiens; identical to SEQ ID NO: 412176

SEQ ID NO: 602173 - RNA, 64 nt, Homo Sapiens; identical to SEQ ID NO: 412177

SEQ ID NO: 602174 - RNA, 64 nt, Homo Sapiens; identical to SEQ ID NO: 412178

SEQ ID NO: 602175 - RNA, 64 nt, Homo Sapiens; identical to SEQ ID NO: 412179

SEQ ID NO: 602176 - RNA, 64 nt, Homo Sapiens; identical to SEQ ID NO: 412180

SEQ ID NO: 602177 - RNA, 64 nt, Homo Sapiens; identical to SEQ ID NO: 412181

SEQ ID NO: 602178 - RNA, 64 nt, Homo Sapiens; identical to SEQ ID NO: 412182

SEQ ID NO: 602179 - RNA, 64 nt, Homo Sapiens; identical to SEQ ID NO: 412183

SEQ ID NO: 602180 - RNA, 64 nt, Homo Sapiens; identical to SEQ ID NO: 412184

SEQ ID NO: 602181 - RNA, 64 nt, Homo Sapiens; identical to SEQ ID NO: 412185

SEQ ID NO: 602182 - RNA, 64 nt, Homo Sapiens; identical to SEQ ID NO: 412186

SEQ ID NO: 602183 - RNA, 64 nt, Homo Sapiens; identical to SEQ ID NO: 412187

SEQ ID NO: 602184 - RNA, 64 nt, Homo Sapiens; identical to SEQ ID NO: 412188

SEQ ID NO: 602185 - RNA, 64 nt, Homo Sapiens; identical to SEQ ID NO: 412189

SEQ ID NO: 602186 - RNA, 64 nt, Homo Sapiens; identical to SEQ ID NO: 412190

SEQ ID NO: 602187 - RNA, 64 nt, Homo Sapiens; identical to SEQ ID NO: 412191

SEQ ID NO: 602188 - RNA, 64 nt, Homo Sapiens; identical to SEQ ID NO: 173459

SEQ ID NO: 602189 - RNA, 64 nt, Homo Sapiens; identical to SEQ ID NO: 173460

SEQ ID NO: 602190 - RNA, 64 nt, Homo Sapiens; identical to SEQ ID NO: 173461

SEQ ID NO: 602191 - RNA, 64 nt, Homo Sapiens; identical to SEQ ID NO: 173462

SEQ ID NO: 602192 - RNA, 64 nt, Homo Sapiens; identical to SEQ ID NO: 173463

SEQ ID NO: 602193 - RNA, 64 nt, Homo Sapiens; identical to SEQ ID NO: 173464

SEQ ID NO: 602194 - RNA, 64 nt, Homo Sapiens; identical to SEQ ID NO: 173465

SEQ ID NO: 602195 - RNA, 64 nt, Homo Sapiens; identical to SEQ ID NO: 173466

SEQ ID NO: 602196 - RNA, 64 nt, Homo Sapiens
uccuugagcuguugugagcuuugaaguagguggcuugagcuagagauaaaacagaaucuucugg

SEQ ID NO: 602197 - RNA, 64 nt, Homo Sapiens
agggguuagccuggacuaaaggcauccuugucuuuugagcuauucaccucaguagaaaaggauc

SEQ ID NO: 602198 - RNA, 64 nt, Homo Sapiens
uuagaguucuuuaauucuuggcacaacgugacuguugagcuaacaccaaauaguguguuggcaa

SEQ ID NO: 602199 - RNA, 64 nt, Homo Sapiens
cuggcaggauuuuaaaacucaaucagucuuuccuuugagcuagugacuugaaaagaaagagaga

SEQ ID NO: 602200 - RNA, 64 nt, Homo Sapiens
cuugcugcugcuuagaucacaaacaaaaaaaaugaaugcacaaaauuuaaacauauuuaaacaa

SEQ ID NO: 602201 - RNA, 64 nt, Homo Sapiens
ugcagccuggaaaaacuuaaaaaccauuuuaaauaaugcacaguaaaaauaaauaaauuuaaga

SEQ ID NO: 602202 - RNA, 64 nt, Homo Sapiens
uauuuuuuucccaaggaguaccacuagacguuguaaugcacacuaaucuauccuuuaaacucuu

SEQ ID NO: 602203 - RNA, 64 nt, Homo Sapiens
uuauaauuacaauauguauucaacuuauaauuacaaugcacaaugaccuuuguaguagaauuua

SEQ ID NO: 602204 - RNA, 64 nt, Homo Sapiens
guccucaggauaugcuaaacugcuaauagaaaauaaugcacagugcagagugcucacuuugaau

SEQ ID NO: 602205 - RNA, 64 nt, Homo Sapiens
ucacacacauauacuuauuaacacacacacacagaaugcacauuuaugugcacauacacacauu

SEQ ID NO: 602206 - RNA, 64 nt, Homo Sapiens
ucucagauguguugaagcaucauauuguguuaugaaugcacaucuucucaagaguauggauuga

SEQ ID NO: 602207 - RNA, 64 nt, Homo Sapiens
gccucaugcaaguuuagacauuauggcauuuuacaaugcacacaauucacugacccaaaacucu

SEQ ID NO: 602208 - RNA, 64 nt, Homo Sapiens
uuacuuuuaaaucauuaggaaaaugcacaugguuaaugcacaugauacuucuaaauagugguaa

SEQ ID NO: 602209 - RNA, 64 nt, Homo Sapiens
guuaaugcacauguuacuuuuaaauagugguaaaaaugcacaugcagugcaucagaaauacuuc

SEQ ID NO: 602210 - RNA, 64 nt, Homo Sapiens
ugugcauuuuauauaaagaugcauuuuauauaaaaaugcacaccuuuaaucucuauauggcagc

SEQ ID NO: 602211 - RNA, 64 nt, Homo Sapiens
cucuauauggcagcauauacauauauauauauaaaaugcacacuuuuaaucucuauauggcagc

SEQ ID NO: 602212 - RNA, 64 nt, Homo Sapiens
auuuugugagauagaauucaauuaaagcgauuugaaugcacaguaaguggauaaucugaguaca

SEQ ID NO: 602213 - RNA, 64 nt, Homo Sapiens
acccaaguaagauuguuuuuagucuugcuugaggaaugcacacuccauuuaaaaaauugugcgc

SEQ ID NO: 602214 - RNA, 64 nt, Homo Sapiens
ggaggccgagcauaaccaggcuuacggacacagaaaugcacaggacagaaaugcacaggggaca

SEQ ID NO: 602215 - RNA, 64 nt, Homo Sapiens
ggacacuuacggacacagaacuuguggacacagaaaugcacaggucuacaggguuuauaguagu

SEQ ID NO: 602216 - RNA, 64 nt, Homo Sapiens
ugaaaaacccuuugugaaaguaacuuuucaaguaaaugcacaacuuuagaauuucuacaaauaa

SEQ ID NO: 602217 - RNA, 64 nt, Homo Sapiens
guguagaaguagaguuaccuaaaccuuuaucgccaaugcacagcuuggccuguuaaguuaaaug

SEQ ID NO: 602218 - RNA, 64 nt, Homo Sapiens
uguuuuuagcagagacaugcaacaacaacacacacgcacacacgcacacacacacacguacaca

SEQ ID NO: 602219 - RNA, 64 nt, Homo Sapiens
gcagagacaugcaacaacaacacacacgcacacacgcacacacacacacguacacacacauaca

SEQ ID NO: 602220 - RNA, 64 nt, Homo Sapiens
cgugugcacccgcgcacgcacacacacacacacacgcacacaugucuucagcaccacacacacg

SEQ ID NO: 602221 - RNA, 64 nt, Homo Sapiens
cacacacgcacacaugcgugcagcaccacacacacgcacacacaccaagcaaccuccacuucuu

SEQ ID NO: 602222 - RNA, 64 nt, Homo Sapiens
augcgcgcacacgugcucccugaaggcacacguacgcacacacgcacaugcacagauaugccgc

SEQ ID NO: 602223 - RNA, 64 nt, Homo Sapiens
ggacacacacacacacacggauaugcugucuggacgcacacacgugcagauaugguauccggac

SEQ ID NO: 602224 - RNA, 64 nt, Homo Sapiens
acacacacgugugcacagauaugcugucuggacacgcacacacaugcagauaugcugccuggac

SEQ ID NO: 602225 - RNA, 64 nt, Homo Sapiens
acacgugcagauaugcuguccggauacacacgcacgcacacaugcagauaugcugccugggcac

SEQ ID NO: 602226 - RNA, 64 nt, Homo Sapiens
aguugugugugcaaugcacacccagacacacgcacgcacacacacgcgcgcgcacacacaugcu

SEQ ID NO: 602227 - RNA, 64 nt, Homo Sapiens
cacacccagacacacgcacgcacacacacgcgcgcgcacacacaugcuuuuuucuguuccccuc

SEQ ID NO: 602228 - RNA, 64 nt, Homo Sapiens
uacacaggcauacaugcaugcacacacacaugcacgcacacacacaugcacacauacacgugca

SEQ ID NO: 602229 - RNA, 64 nt, Homo Sapiens
caugcacacauauaugcacaggcacacacauguacgcacacacacaugcacugcacacauaucc

SEQ ID NO: 602230 - RNA, 64 nt, Homo Sapiens
gauauacacauggaugcacgcacaugccaaugcacgcacacaucagugcacacggaugcacaga

SEQ ID NO: 602231 - RNA, 64 nt, Homo Sapiens
cacggaugcacagagauaugcacacaccgaugugcgcacacacagauaugcacacacauggaug

SEQ ID NO: 602232 - RNA, 64 nt, Homo Sapiens
ugcacacacauggaugagcacacacacaccaaugcgcacacacaccgauguacacacacagaug

SEQ ID NO: 602233 - RNA, 64 nt, Homo Sapiens
ucuuccccaucaagcccauuuccgcaaaguucuccgcacacacucugucucgcucagaacaugc

SEQ ID NO: 602234 - RNA, 64 nt, Homo Sapiens
cuugcauucaugaaucugauuguaagcacacaugcgcacacacaucuacgacccgaccucucua

SEQ ID NO: 602235 - RNA, 64 nt, Homo Sapiens
acaccgccacauggcuuccuccugcgcgcaugugcgcacacacacacacacacgcacacacaca

SEQ ID NO: 602236 - RNA, 64 nt, Homo Sapiens
cuccugcgcgcaugugcgcacacacacacacacacgcacacacacacacacacacucacugcgg

SEQ ID NO: 602237 - RNA, 64 nt, Homo Sapiens
ugugugugugugugugugcgcgcgcgcgcgcacgcgcacacacucacgcacacacaagcagaga

SEQ ID NO: 602238 - RNA, 64 nt, Homo Sapiens
ugugugcgcgcgcgcgcgcacgcgcacacacucacgcacacacaagcagagaaggcgcugaucu

SEQ ID NO: 602239 - RNA, 64 nt, Homo Sapiens
cgcacacgcacacucggacucacacgaagucacacgcacacaugcacgcacacacacauauggg

SEQ ID NO: 602240 - RNA, 64 nt, Homo Sapiens
cucggacucacacgaagucacacgcacacaugcacgcacacacacauauggggaccugcacacc

SEQ ID NO: 602241 - RNA, 64 nt, Homo Sapiens
cacccagugcucucuccaccugcuugcacgugcacgcacacacaaucccccaugcucuugcgug

SEQ ID NO: 602242 - RNA, 64 nt, Homo Sapiens
uccucgucugggugugcgcagcucgcugugcgcacgcacacaucgugugugugcgcgcgcgcgu

SEQ ID NO: 602243 - RNA, 64 nt, Homo Sapiens; identical to SEQ ID NO: 360996

SEQ ID NO: 602244 - RNA, 64 nt, Homo Sapiens; identical to SEQ ID NO: 360997

SEQ ID NO: 602245 - RNA, 64 nt, Homo Sapiens; identical to SEQ ID NO: 360998

SEQ ID NO: 602246 - RNA, 64 nt, Homo Sapiens; identical to SEQ ID NO: 360999

SEQ ID NO: 602247 - RNA, 64 nt, Homo Sapiens; identical to SEQ ID NO: 361000

SEQ ID NO: 602248 - RNA, 64 nt, Homo Sapiens; identical to SEQ ID NO: 361001

SEQ ID NO: 602249 - RNA, 64 nt, Homo Sapiens; identical to SEQ ID NO: 361002

SEQ ID NO: 602250 - RNA, 64 nt, Homo Sapiens; identical to SEQ ID NO: 361003

SEQ ID NO: 602251 - RNA, 64 nt, Homo Sapiens; identical to SEQ ID NO: 361004

SEQ ID NO: 602252 - RNA, 64 nt, Homo Sapiens; identical to SEQ ID NO: 361005

SEQ ID NO: 602253 - RNA, 64 nt, Homo Sapiens; identical to SEQ ID NO: 361006

SEQ ID NO: 602254 - RNA, 64 nt, Homo Sapiens; identical to SEQ ID NO: 361007

SEQ ID NO: 602255 - RNA, 64 nt, Homo Sapiens; identical to SEQ ID NO: 361008

SEQ ID NO: 602256 - RNA, 64 nt, Homo Sapiens; identical to SEQ ID NO: 361009

SEQ ID NO: 602257 - RNA, 64 nt, Homo Sapiens; identical to SEQ ID NO: 361010

SEQ ID NO: 602258 - RNA, 64 nt, Homo Sapiens; identical to SEQ ID NO: 361011

SEQ ID NO: 602259 - RNA, 64 nt, Homo Sapiens; identical to SEQ ID NO: 361012

SEQ ID NO: 602260 - RNA, 64 nt, Homo Sapiens; identical to SEQ ID NO: 361013

SEQ ID NO: 602261 - RNA, 64 nt, Homo Sapiens; identical to SEQ ID NO: 376668

SEQ ID NO: 602262 - RNA, 64 nt, Homo Sapiens; identical to SEQ ID NO: 376669

SEQ ID NO: 602263 - RNA, 64 nt, Homo Sapiens; identical to SEQ ID NO: 376670

SEQ ID NO: 602264 - RNA, 64 nt, Homo Sapiens; identical to SEQ ID NO: 376671

SEQ ID NO: 602265 - RNA, 64 nt, Homo Sapiens; identical to SEQ ID NO: 376672

SEQ ID NO: 602266 - RNA, 64 nt, Homo Sapiens; identical to SEQ ID NO: 376673

SEQ ID NO: 602267 - RNA, 64 nt, Homo Sapiens; identical to SEQ ID NO: 107696

SEQ ID NO: 602268 - RNA, 64 nt, Homo Sapiens; identical to SEQ ID NO: 107697

SEQ ID NO: 602269 - RNA, 64 nt, Homo Sapiens; identical to SEQ ID NO: 107698

SEQ ID NO: 602270 - RNA, 64 nt, Homo Sapiens; identical to SEQ ID NO: 107699

SEQ ID NO: 602271 - RNA, 64 nt, Homo Sapiens; identical to SEQ ID NO: 107700

SEQ ID NO: 602272 - RNA, 64 nt, Homo Sapiens; identical to SEQ ID NO: 107701

SEQ ID NO: 602273 - RNA, 64 nt, Homo Sapiens; identical to SEQ ID NO: 107702

SEQ ID NO: 602274 - RNA, 64 nt, Homo Sapiens; identical to SEQ ID NO: 107703

SEQ ID NO: 602275 - RNA, 64 nt, Homo Sapiens
acccugcuccaucggcacuggcgcccugcuccaucggcacuaaugcuccacucggcgccccacu

SEQ ID NO: 602276 - RNA, 64 nt, Homo Sapiens
cacucggcgccccacuccaucggccccgcuccaucggcacuaaugccccacucggcgccccacu

SEQ ID NO: 602277 - RNA, 64 nt, Homo Sapiens
cuccacuccauuggcacuaacgccccaacuccagcggcacuaaugacccgcuccuuugacauug

SEQ ID NO: 602278 - RNA, 64 nt, Homo Sapiens
gucccacuccauugucacuaacguccggcuccaucggcacuaccaccccgcuccaucaucacua

SEQ ID NO: 602279 - RNA, 64 nt, Homo Sapiens
caccccgcuccaucaucacuauguccagcuccgucggcacuaccacccugcuccaucaucacua

SEQ ID NO: 602280 - RNA, 64 nt, Homo Sapiens
guccagcuccaacggcacuggugccccauuccaucggcacuaacgccccgcuccaccggcacca

SEQ ID NO: 602281 - RNA, 64 nt, Homo Sapiens
gcccagcuccaccgguacuggcucccugcuccaucggcacuaacgcccugcuucauuggcacuu

SEQ ID NO: 602282 - RNA, 64 nt, Homo Sapiens
gccucuccuuuucacuucuugccuucuguggauuuugucugauacuaauccaggcacacugcug

SEQ ID NO: 602283 - RNA, 64 nt, Homo Sapiens
gcuuugacuggccguaaguucucucagcuuuuguuugucugaaaauaaauuuaguucgccuuua

SEQ ID NO: 602284 - RNA, 64 nt, Homo Sapiens
ucuuuuccaaauuagggccacagaacagcaacauuugucugacaguaguauaaagaauaaugau

SEQ ID NO: 602285 - RNA, 64 nt, Homo Sapiens
uugaaacagaugugaaaaacagaaaaagaaaaaauugucugaaauguuuauuuugcaaaacagu

SEQ ID NO: 602286 - RNA, 64 nt, Homo Sapiens
aaucaccauagaucauggcugaaauaguuuguaauugucugagucugugcacguacuuuuagau

SEQ ID NO: 602287 - RNA, 64 nt, Homo Sapiens
cuuuagcuaaaaauuuccagcauaaacuguauccuugucugacauuucaggagucaaauguagc

SEQ ID NO: 602288 - RNA, 64 nt, Homo Sapiens
ccuaauuaauaacauguuuuaugcuuuuuugagcuugucugacugcaaagagcugugauaaacc

SEQ ID NO: 602289 - RNA, 64 nt, Homo Sapiens
cugguuuugaguuacucuuuaaagcauuggcgauuugucugauuuuugucuuuuagcuaaagga

SEQ ID NO: 602290 - RNA, 64 nt, Homo Sapiens
gcuugguggcaggcacccuguccugguuacccccuugucugacuauguuuuucuggcugggagc

SEQ ID NO: 602291 - RNA, 64 nt, Homo Sapiens
cauagauuggaaggcgcucugaaaauuuaccaccuugucugauauauugcuuuugugaaacaaa

SEQ ID NO: 602292 - RNA, 64 nt, Homo Sapiens
uaugaguccucucagaagcaauuuuuccccacaauugucugaugauuccucucauuaaggaaau

SEQ ID NO: 602293 - RNA, 64 nt, Homo Sapiens; identical to SEQ ID NO: 65415

SEQ ID NO: 602294 - RNA, 64 nt, Homo Sapiens; identical to SEQ ID NO: 65416

SEQ ID NO: 602295 - RNA, 64 nt, Homo Sapiens; identical to SEQ ID NO: 65417

SEQ ID NO: 602296 - RNA, 64 nt, Homo Sapiens; identical to SEQ ID NO: 65418

SEQ ID NO: 602297 - RNA, 64 nt, Homo Sapiens; identical to SEQ ID NO: 61352

SEQ ID NO: 602298 - RNA, 64 nt, Homo Sapiens; identical to SEQ ID NO: 61353

SEQ ID NO: 602299 - RNA, 64 nt, Homo Sapiens; identical to SEQ ID NO: 65421

SEQ ID NO: 602300 - RNA, 64 nt, Homo Sapiens; identical to SEQ ID NO: 65422

SEQ ID NO: 602301 - RNA, 64 nt, Homo Sapiens; identical to SEQ ID NO: 65423

SEQ ID NO: 602302 - RNA, 64 nt, Homo Sapiens; identical to SEQ ID NO: 65424

SEQ ID NO: 602303 - RNA, 64 nt, Homo Sapiens; identical to SEQ ID NO: 65425

SEQ ID NO: 602304 - RNA, 64 nt, Homo Sapiens; identical to SEQ ID NO: 65426

SEQ ID NO: 602305 - RNA, 64 nt, Homo Sapiens; identical to SEQ ID NO: 61354

SEQ ID NO: 602306 - RNA, 64 nt, Homo Sapiens; identical to SEQ ID NO: 61355

SEQ ID NO: 602307 - RNA, 64 nt, Homo Sapiens; identical to SEQ ID NO: 65429

SEQ ID NO: 602308 - RNA, 64 nt, Homo Sapiens; identical to SEQ ID NO: 65430

SEQ ID NO: 602309 - RNA, 64 nt, Homo Sapiens; identical to SEQ ID NO: 65431

SEQ ID NO: 602310 - RNA, 64 nt, Homo Sapiens; identical to SEQ ID NO: 65432

SEQ ID NO: 602311 - RNA, 64 nt, Homo Sapiens; identical to SEQ ID NO: 65433

SEQ ID NO: 602312 - RNA, 64 nt, Homo Sapiens; identical to SEQ ID NO: 65434

SEQ ID NO: 602313 - RNA, 64 nt, Homo Sapiens; identical to SEQ ID NO: 65435

SEQ ID NO: 602314 - RNA, 64 nt, Homo Sapiens; identical to SEQ ID NO: 65436

SEQ ID NO: 602315 - RNA, 64 nt, Homo Sapiens; identical to SEQ ID NO: 65437

SEQ ID NO: 602316 - RNA, 64 nt, Homo Sapiens; identical to SEQ ID NO: 65438

SEQ ID NO: 602317 - RNA, 64 nt, Homo Sapiens; identical to SEQ ID NO: 65439

SEQ ID NO: 602318 - RNA, 64 nt, Homo Sapiens; identical to SEQ ID NO: 65440

SEQ ID NO: 602319 - RNA, 64 nt, Homo Sapiens; identical to SEQ ID NO: 61356

SEQ ID NO: 602320 - RNA, 64 nt, Homo Sapiens; identical to SEQ ID NO: 61357

SEQ ID NO: 602321 - RNA, 64 nt, Homo Sapiens; identical to SEQ ID NO: 65443

SEQ ID NO: 602322 - RNA, 64 nt, Homo Sapiens; identical to SEQ ID NO: 65444

SEQ ID NO: 602323 - RNA, 64 nt, Homo Sapiens; identical to SEQ ID NO: 65445

SEQ ID NO: 602324 - RNA, 64 nt, Homo Sapiens; identical to SEQ ID NO: 65446

SEQ ID NO: 602325 - RNA, 64 nt, Homo Sapiens; identical to SEQ ID NO: 65447

SEQ ID NO: 602326 - RNA, 64 nt, Homo Sapiens; identical to SEQ ID NO: 65448

SEQ ID NO: 602327 - RNA, 64 nt, Homo Sapiens; identical to SEQ ID NO: 65449

SEQ ID NO: 602328 - RNA, 64 nt, Homo Sapiens; identical to SEQ ID NO: 65450

SEQ ID NO: 602329 - RNA, 64 nt, Homo Sapiens; identical to SEQ ID NO: 65451

SEQ ID NO: 602330 - RNA, 64 nt, Homo Sapiens; identical to SEQ ID NO: 65452

SEQ ID NO: 602331 - RNA, 64 nt, Homo Sapiens; identical to SEQ ID NO: 65453

SEQ ID NO: 602332 - RNA, 64 nt, Homo Sapiens; identical to SEQ ID NO: 65454

SEQ ID NO: 602333 - RNA, 64 nt, Homo Sapiens; identical to SEQ ID NO: 65455

SEQ ID NO: 602334 - RNA, 64 nt, Homo Sapiens; identical to SEQ ID NO: 65456

SEQ ID NO: 602335 - RNA, 64 nt, Homo Sapiens; identical to SEQ ID NO: 65457

SEQ ID NO: 602336 - RNA, 64 nt, Homo Sapiens; identical to SEQ ID NO: 65458

SEQ ID NO: 602337 - RNA, 64 nt, Homo Sapiens; identical to SEQ ID NO: 65459

SEQ ID NO: 602338 - RNA, 64 nt, Homo Sapiens; identical to SEQ ID NO: 65460

SEQ ID NO: 602339 - RNA, 64 nt, Homo Sapiens; identical to SEQ ID NO: 65461

SEQ ID NO: 602340 - RNA, 64 nt, Homo Sapiens; identical to SEQ ID NO: 65462

SEQ ID NO: 602341 - RNA, 64 nt, Homo Sapiens; identical to SEQ ID NO: 65463

SEQ ID NO: 602342 - RNA, 64 nt, Homo Sapiens; identical to SEQ ID NO: 65464

SEQ ID NO: 602343 - RNA, 64 nt, Homo Sapiens; identical to SEQ ID NO: 61358

SEQ ID NO: 602344 - RNA, 64 nt, Homo Sapiens; identical to SEQ ID NO: 61359

SEQ ID NO: 602345 - RNA, 64 nt, Homo Sapiens; identical to SEQ ID NO: 65467

SEQ ID NO: 602346 - RNA, 64 nt, Homo Sapiens; identical to SEQ ID NO: 65468

SEQ ID NO: 602347 - RNA, 64 nt, Homo Sapiens; identical to SEQ ID NO: 65469

SEQ ID NO: 602348 - RNA, 64 nt, Homo Sapiens; identical to SEQ ID NO: 65470

SEQ ID NO: 602349 - RNA, 64 nt, Homo Sapiens; identical to SEQ ID NO: 65471

SEQ ID NO: 602350 - RNA, 64 nt, Homo Sapiens; identical to SEQ ID NO: 65472

SEQ ID NO: 602351 - RNA, 64 nt, Homo Sapiens; identical to SEQ ID NO: 65473

SEQ ID NO: 602352 - RNA, 64 nt, Homo Sapiens; identical to SEQ ID NO: 65474

SEQ ID NO: 602353 - RNA, 64 nt, Homo Sapiens; identical to SEQ ID NO: 65475

SEQ ID NO: 602354 - RNA, 64 nt, Homo Sapiens; identical to SEQ ID NO: 65476

SEQ ID NO: 602355 - RNA, 64 nt, Homo Sapiens; identical to SEQ ID NO: 65477

SEQ ID NO: 602356 - RNA, 64 nt, Homo Sapiens; identical to SEQ ID NO: 65478

SEQ ID NO: 602357 - RNA, 64 nt, Homo Sapiens; identical to SEQ ID NO: 65479

SEQ ID NO: 602358 - RNA, 64 nt, Homo Sapiens; identical to SEQ ID NO: 65480

SEQ ID NO: 602359 - RNA, 64 nt, Homo Sapiens; identical to SEQ ID NO: 65481

SEQ ID NO: 602360 - RNA, 64 nt, Homo Sapiens; identical to SEQ ID NO: 65482

SEQ ID NO: 602361 - RNA, 64 nt, Homo Sapiens; identical to SEQ ID NO: 65483

SEQ ID NO: 602362 - RNA, 64 nt, Homo Sapiens; identical to SEQ ID NO: 65484

SEQ ID NO: 602363 - RNA, 64 nt, Homo Sapiens; identical to SEQ ID NO: 65485

SEQ ID NO: 602364 - RNA, 64 nt, Homo Sapiens; identical to SEQ ID NO: 65486

SEQ ID NO: 602365 - RNA, 64 nt, Homo Sapiens; identical to SEQ ID NO: 65487

SEQ ID NO: 602366 - RNA, 64 nt, Homo Sapiens; identical to SEQ ID NO: 65488

SEQ ID NO: 602367 - RNA, 64 nt, Homo Sapiens; identical to SEQ ID NO: 65489

SEQ ID NO: 602368 - RNA, 64 nt, Homo Sapiens; identical to SEQ ID NO: 65490

SEQ ID NO: 602369 - RNA, 64 nt, Homo Sapiens; identical to SEQ ID NO: 65491

SEQ ID NO: 602370 - RNA, 64 nt, Homo Sapiens; identical to SEQ ID NO: 65492

SEQ ID NO: 602371 - RNA, 64 nt, Homo Sapiens; identical to SEQ ID NO: 65493

SEQ ID NO: 602372 - RNA, 64 nt, Homo Sapiens; identical to SEQ ID NO: 65494

SEQ ID NO: 602373 - RNA, 64 nt, Homo Sapiens; identical to SEQ ID NO: 65495

SEQ ID NO: 602374 - RNA, 64 nt, Homo Sapiens; identical to SEQ ID NO: 65496

SEQ ID NO: 602375 - RNA, 64 nt, Homo Sapiens; identical to SEQ ID NO: 65497

SEQ ID NO: 602376 - RNA, 64 nt, Homo Sapiens; identical to SEQ ID NO: 65498

SEQ ID NO: 602377 - RNA, 64 nt, Homo Sapiens; identical to SEQ ID NO: 65499

SEQ ID NO: 602378 - RNA, 64 nt, Homo Sapiens; identical to SEQ ID NO: 65500

SEQ ID NO: 602379 - RNA, 64 nt, Homo Sapiens; identical to SEQ ID NO: 65501

SEQ ID NO: 602380 - RNA, 64 nt, Homo Sapiens; identical to SEQ ID NO: 65502

SEQ ID NO: 602381 - RNA, 64 nt, Homo Sapiens; identical to SEQ ID NO: 65503

SEQ ID NO: 602382 - RNA, 64 nt, Homo Sapiens; identical to SEQ ID NO: 65504

SEQ ID NO: 602383 - RNA, 64 nt, Homo Sapiens; identical to SEQ ID NO: 65505

SEQ ID NO: 602384 - RNA, 64 nt, Homo Sapiens; identical to SEQ ID NO: 65506

SEQ ID NO: 602385 - RNA, 64 nt, Homo Sapiens; identical to SEQ ID NO: 65507

SEQ ID NO: 602386 - RNA, 64 nt, Homo Sapiens; identical to SEQ ID NO: 65508

SEQ ID NO: 602387 - RNA, 64 nt, Homo Sapiens; identical to SEQ ID NO: 61360

SEQ ID NO: 602388 - RNA, 64 nt, Homo Sapiens; identical to SEQ ID NO: 61361

SEQ ID NO: 602389 - RNA, 64 nt, Homo Sapiens; identical to SEQ ID NO: 65511

SEQ ID NO: 602390 - RNA, 64 nt, Homo Sapiens; identical to SEQ ID NO: 65512

SEQ ID NO: 602391 - RNA, 64 nt, Homo Sapiens; identical to SEQ ID NO: 65513

SEQ ID NO: 602392 - RNA, 64 nt, Homo Sapiens; identical to SEQ ID NO: 65514

SEQ ID NO: 602393 - RNA, 64 nt, Homo Sapiens; identical to SEQ ID NO: 65515

SEQ ID NO: 602394 - RNA, 64 nt, Homo Sapiens; identical to SEQ ID NO: 65516

SEQ ID NO: 602395 - RNA, 64 nt, Homo Sapiens; identical to SEQ ID NO: 65517

SEQ ID NO: 602396 - RNA, 64 nt, Homo Sapiens; identical to SEQ ID NO: 65518

SEQ ID NO: 602397 - RNA, 64 nt, Homo Sapiens; identical to SEQ ID NO: 65519

SEQ ID NO: 602398 - RNA, 64 nt, Homo Sapiens; identical to SEQ ID NO: 65520

SEQ ID NO: 602399 - RNA, 64 nt, Homo Sapiens; identical to SEQ ID NO: 65521

SEQ ID NO: 602400 - RNA, 64 nt, Homo Sapiens; identical to SEQ ID NO: 65522

SEQ ID NO: 602401 - RNA, 64 nt, Homo Sapiens; identical to SEQ ID NO: 65523

SEQ ID NO: 602402 - RNA, 64 nt, Homo Sapiens; identical to SEQ ID NO: 65524

SEQ ID NO: 602403 - RNA, 64 nt, Homo Sapiens; identical to SEQ ID NO: 65525

SEQ ID NO: 602404 - RNA, 64 nt, Homo Sapiens; identical to SEQ ID NO: 65526

SEQ ID NO: 602405 - RNA, 64 nt, Homo Sapiens; identical to SEQ ID NO: 65527

SEQ ID NO: 602406 - RNA, 64 nt, Homo Sapiens; identical to SEQ ID NO: 65528

SEQ ID NO: 602407 - RNA, 64 nt, Homo Sapiens; identical to SEQ ID NO: 61362

SEQ ID NO: 602408 - RNA, 64 nt, Homo Sapiens; identical to SEQ ID NO: 61363

SEQ ID NO: 602409 - RNA, 64 nt, Homo Sapiens; identical to SEQ ID NO: 61364

SEQ ID NO: 602410 - RNA, 64 nt, Homo Sapiens; identical to SEQ ID NO: 61365

SEQ ID NO: 602411 - RNA, 64 nt, Homo Sapiens; identical to SEQ ID NO: 65533

SEQ ID NO: 602412 - RNA, 64 nt, Homo Sapiens; identical to SEQ ID NO: 65534

SEQ ID NO: 602413 - RNA, 64 nt, Homo Sapiens; identical to SEQ ID NO: 65535

SEQ ID NO: 602414 - RNA, 64 nt, Homo Sapiens; identical to SEQ ID NO: 65536

SEQ ID NO: 602415 - RNA, 64 nt, Homo Sapiens; identical to SEQ ID NO: 65537

SEQ ID NO: 602416 - RNA, 64 nt, Homo Sapiens; identical to SEQ ID NO: 65538

SEQ ID NO: 602417 - RNA, 64 nt, Homo Sapiens; identical to SEQ ID NO: 65539

SEQ ID NO: 602418 - RNA, 64 nt, Homo Sapiens; identical to SEQ ID NO: 65540

SEQ ID NO: 602419 - RNA, 64 nt, Homo Sapiens; identical to SEQ ID NO: 65541

SEQ ID NO: 602420 - RNA, 64 nt, Homo Sapiens; identical to SEQ ID NO: 65542

SEQ ID NO: 602421 - RNA, 64 nt, Homo Sapiens; identical to SEQ ID NO: 65543

SEQ ID NO: 602422 - RNA, 64 nt, Homo Sapiens; identical to SEQ ID NO: 65544

SEQ ID NO: 602423 - RNA, 64 nt, Homo Sapiens; identical to SEQ ID NO: 65545

SEQ ID NO: 602424 - RNA, 64 nt, Homo Sapiens; identical to SEQ ID NO: 65546

SEQ ID NO: 602425 - RNA, 64 nt, Homo Sapiens; identical to SEQ ID NO: 65547

SEQ ID NO: 602426 - RNA, 64 nt, Homo Sapiens; identical to SEQ ID NO: 61366

SEQ ID NO: 602427 - RNA, 64 nt, Homo Sapiens; identical to SEQ ID NO: 61367

SEQ ID NO: 602428 - RNA, 64 nt, Homo Sapiens; identical to SEQ ID NO: 65550

SEQ ID NO: 602429 - RNA, 64 nt, Homo Sapiens; identical to SEQ ID NO: 65551

SEQ ID NO: 602430 - RNA, 64 nt, Homo Sapiens; identical to SEQ ID NO: 61368

SEQ ID NO: 602431 - RNA, 56 nt, Homo Sapiens; identical to SEQ ID NO: 61369

SEQ ID NO: 602432 - RNA, 64 nt, Homo Sapiens; identical to SEQ ID NO: 65554

SEQ ID NO: 602433 - RNA, 64 nt, Homo Sapiens; identical to SEQ ID NO: 65555

SEQ ID NO: 602434 - RNA, 64 nt, Homo Sapiens; identical to SEQ ID NO: 65556

SEQ ID NO: 602435 - RNA, 64 nt, Homo Sapiens; identical to SEQ ID NO: 65557

SEQ ID NO: 602436 - RNA, 64 nt, Homo Sapiens; identical to SEQ ID NO: 65558

SEQ ID NO: 602437 - RNA, 64 nt, Homo Sapiens; identical to SEQ ID NO: 65559

SEQ ID NO: 602438 - RNA, 64 nt, Homo Sapiens; identical to SEQ ID NO: 65560

SEQ ID NO: 602439 - RNA, 64 nt, Homo Sapiens; identical to SEQ ID NO: 65561

SEQ ID NO: 602440 - RNA, 64 nt, Homo Sapiens; identical to SEQ ID NO: 65562

SEQ ID NO: 602441 - RNA, 64 nt, Homo Sapiens; identical to SEQ ID NO: 65563

SEQ ID NO: 602442 - RNA, 64 nt, Homo Sapiens; identical to SEQ ID NO: 65564

SEQ ID NO: 602443 - RNA, 64 nt, Homo Sapiens; identical to SEQ ID NO: 65565

SEQ ID NO: 602444 - RNA, 64 nt, Homo Sapiens; identical to SEQ ID NO: 65566

SEQ ID NO: 602445 - RNA, 64 nt, Homo Sapiens; identical to SEQ ID NO: 65567

SEQ ID NO: 602446 - RNA, 64 nt, Homo Sapiens; identical to SEQ ID NO: 65568

SEQ ID NO: 602447 - RNA, 64 nt, Homo Sapiens; identical to SEQ ID NO: 65569

SEQ ID NO: 602448 - RNA, 64 nt, Homo Sapiens; identical to SEQ ID NO: 65570

SEQ ID NO: 602449 - RNA, 64 nt, Homo Sapiens; identical to SEQ ID NO: 65571

SEQ ID NO: 602450 - RNA, 64 nt, Homo Sapiens; identical to SEQ ID NO: 65572

SEQ ID NO: 602451 - RNA, 64 nt, Homo Sapiens; identical to SEQ ID NO: 65573

SEQ ID NO: 602452 - RNA, 64 nt, Homo Sapiens; identical to SEQ ID NO: 61370

SEQ ID NO: 602453 - RNA, 64 nt, Homo Sapiens; identical to SEQ ID NO: 61371

SEQ ID NO: 602454 - RNA, 64 nt, Homo Sapiens; identical to SEQ ID NO: 65576

SEQ ID NO: 602455 - RNA, 64 nt, Homo Sapiens; identical to SEQ ID NO: 65577

SEQ ID NO: 602456 - RNA, 64 nt, Homo Sapiens; identical to SEQ ID NO: 65578

SEQ ID NO: 602457 - RNA, 64 nt, Homo Sapiens; identical to SEQ ID NO: 65579

SEQ ID NO: 602458 - RNA, 64 nt, Homo Sapiens; identical to SEQ ID NO: 65580

SEQ ID NO: 602459 - RNA, 64 nt, Homo Sapiens; identical to SEQ ID NO: 65581

SEQ ID NO: 602460 - RNA, 64 nt, Homo Sapiens; identical to SEQ ID NO: 65582

SEQ ID NO: 602461 - RNA, 64 nt, Homo Sapiens; identical to SEQ ID NO: 65583

SEQ ID NO: 602462 - RNA, 64 nt, Homo Sapiens; identical to SEQ ID NO: 65584

SEQ ID NO: 602463 - RNA, 64 nt, Homo Sapiens; identical to SEQ ID NO: 65585

SEQ ID NO: 602464 - RNA, 64 nt, Homo Sapiens; identical to SEQ ID NO: 65586

SEQ ID NO: 602465 - RNA, 64 nt, Homo Sapiens; identical to SEQ ID NO: 65587

SEQ ID NO: 602466 - RNA, 64 nt, Homo Sapiens; identical to SEQ ID NO: 65588

SEQ ID NO: 602467 - RNA, 64 nt, Homo Sapiens; identical to SEQ ID NO: 65589

SEQ ID NO: 602468 - RNA, 64 nt, Homo Sapiens; identical to SEQ ID NO: 65590

SEQ ID NO: 602469 - RNA, 64 nt, Homo Sapiens; identical to SEQ ID NO: 65591

SEQ ID NO: 602470 - RNA, 64 nt, Homo Sapiens; identical to SEQ ID NO: 65592

SEQ ID NO: 602471 - RNA, 64 nt, Homo Sapiens; identical to SEQ ID NO: 65593

SEQ ID NO: 602472 - RNA, 64 nt, Homo Sapiens; identical to SEQ ID NO: 65594

SEQ ID NO: 602473 - RNA, 64 nt, Homo Sapiens; identical to SEQ ID NO: 65595

SEQ ID NO: 602474 - RNA, 64 nt, Homo Sapiens; identical to SEQ ID NO: 65596

SEQ ID NO: 602475 - RNA, 64 nt, Homo Sapiens; identical to SEQ ID NO: 65597

SEQ ID NO: 602476 - RNA, 64 nt, Homo Sapiens; identical to SEQ ID NO: 65598

SEQ ID NO: 602477 - RNA, 64 nt, Homo Sapiens; identical to SEQ ID NO: 65599

SEQ ID NO: 602478 - RNA, 64 nt, Homo Sapiens; identical to SEQ ID NO: 65600

SEQ ID NO: 602479 - RNA, 64 nt, Homo Sapiens; identical to SEQ ID NO: 65601

SEQ ID NO: 602480 - RNA, 64 nt, Homo Sapiens; identical to SEQ ID NO: 65602

SEQ ID NO: 602481 - RNA, 64 nt, Homo Sapiens; identical to SEQ ID NO: 65603

SEQ ID NO: 602482 - RNA, 64 nt, Homo Sapiens; identical to SEQ ID NO: 65604

SEQ ID NO: 602483 - RNA, 64 nt, Homo Sapiens; identical to SEQ ID NO: 65605

SEQ ID NO: 602484 - RNA, 64 nt, Homo Sapiens; identical to SEQ ID NO: 65606

SEQ ID NO: 602485 - RNA, 64 nt, Homo Sapiens; identical to SEQ ID NO: 65607

SEQ ID NO: 602486 - RNA, 64 nt, Homo Sapiens; identical to SEQ ID NO: 65608

SEQ ID NO: 602487 - RNA, 64 nt, Homo Sapiens; identical to SEQ ID NO: 65609

SEQ ID NO: 602488 - RNA, 64 nt, Homo Sapiens; identical to SEQ ID NO: 65610

SEQ ID NO: 602489 - RNA, 64 nt, Homo Sapiens; identical to SEQ ID NO: 65611

SEQ ID NO: 602490 - RNA, 64 nt, Homo Sapiens; identical to SEQ ID NO: 61372

SEQ ID NO: 602491 - RNA, 64 nt, Homo Sapiens; identical to SEQ ID NO: 61373

SEQ ID NO: 602492 - RNA, 64 nt, Homo Sapiens; identical to SEQ ID NO: 65614

SEQ ID NO: 602493 - RNA, 64 nt, Homo Sapiens; identical to SEQ ID NO: 65615

SEQ ID NO: 602494 - RNA, 64 nt, Homo Sapiens; identical to SEQ ID NO: 65616

SEQ ID NO: 602495 - RNA, 64 nt, Homo Sapiens; identical to SEQ ID NO: 61374

SEQ ID NO: 602496 - RNA, 64 nt, Homo Sapiens; identical to SEQ ID NO: 61375

SEQ ID NO: 602497 - RNA, 64 nt, Homo Sapiens; identical to SEQ ID NO: 65619

SEQ ID NO: 602498 - RNA, 64 nt, Homo Sapiens; identical to SEQ ID NO: 65620

SEQ ID NO: 602499 - RNA, 64 nt, Homo Sapiens; identical to SEQ ID NO: 65621

SEQ ID NO: 602500 - RNA, 64 nt, Homo Sapiens; identical to SEQ ID NO: 65622

SEQ ID NO: 602501 - RNA, 64 nt, Homo Sapiens; identical to SEQ ID NO: 65623

SEQ ID NO: 602502 - RNA, 64 nt, Homo Sapiens; identical to SEQ ID NO: 65624

SEQ ID NO: 602503 - RNA, 64 nt, Homo Sapiens; identical to SEQ ID NO: 65625

SEQ ID NO: 602504 - RNA, 64 nt, Homo Sapiens; identical to SEQ ID NO: 65626

SEQ ID NO: 602505 - RNA, 64 nt, Homo Sapiens; identical to SEQ ID NO: 65627

SEQ ID NO: 602506 - RNA, 64 nt, Homo Sapiens; identical to SEQ ID NO: 65628

SEQ ID NO: 602507 - RNA, 64 nt, Homo Sapiens; identical to SEQ ID NO: 65629

SEQ ID NO: 602508 - RNA, 64 nt, Homo Sapiens; identical to SEQ ID NO: 65630

SEQ ID NO: 602509 - RNA, 64 nt, Homo Sapiens; identical to SEQ ID NO: 65631

SEQ ID NO: 602510 - RNA, 64 nt, Homo Sapiens; identical to SEQ ID NO: 65632

SEQ ID NO: 602511 - RNA, 64 nt, Homo Sapiens; identical to SEQ ID NO: 65633

SEQ ID NO: 602512 - RNA, 64 nt, Homo Sapiens; identical to SEQ ID NO: 65634

SEQ ID NO: 602513 - RNA, 64 nt, Homo Sapiens; identical to SEQ ID NO: 65635

SEQ ID NO: 602514 - RNA, 64 nt, Homo Sapiens; identical to SEQ ID NO: 65636

SEQ ID NO: 602515 - RNA, 64 nt, Homo Sapiens; identical to SEQ ID NO: 65637

SEQ ID NO: 602516 - RNA, 64 nt, Homo Sapiens; identical to SEQ ID NO: 65638

SEQ ID NO: 602517 - RNA, 64 nt, Homo Sapiens; identical to SEQ ID NO: 65639

SEQ ID NO: 602518 - RNA, 64 nt, Homo Sapiens; identical to SEQ ID NO: 65640

SEQ ID NO: 602519 - RNA, 64 nt, Homo Sapiens; identical to SEQ ID NO: 65641

SEQ ID NO: 602520 - RNA, 64 nt, Homo Sapiens; identical to SEQ ID NO: 65642

SEQ ID NO: 602521 - RNA, 64 nt, Homo Sapiens; identical to SEQ ID NO: 65643

SEQ ID NO: 602522 - RNA, 64 nt, Homo Sapiens; identical to SEQ ID NO: 65644

SEQ ID NO: 602523 - RNA, 60 nt, Homo Sapiens; identical to SEQ ID NO: 65087

SEQ ID NO: 602524 - RNA, 64 nt, Homo Sapiens; identical to SEQ ID NO: 65646

SEQ ID NO: 602525 - RNA, 64 nt, Homo Sapiens; identical to SEQ ID NO: 65647

SEQ ID NO: 602526 - RNA, 64 nt, Homo Sapiens; identical to SEQ ID NO: 65648

SEQ ID NO: 602527 - RNA, 64 nt, Homo Sapiens; identical to SEQ ID NO: 65649

SEQ ID NO: 602528 - RNA, 64 nt, Homo Sapiens; identical to SEQ ID NO: 65650

SEQ ID NO: 602529 - RNA, 64 nt, Homo Sapiens; identical to SEQ ID NO: 65651

SEQ ID NO: 602530 - RNA, 51 nt, Homo Sapiens; identical to SEQ ID NO: 65094

SEQ ID NO: 602531 - RNA, 64 nt, Homo Sapiens; identical to SEQ ID NO: 65653

SEQ ID NO: 602532 - RNA, 64 nt, Homo Sapiens; identical to SEQ ID NO: 65654

SEQ ID NO: 602533 - RNA, 64 nt, Homo Sapiens; identical to SEQ ID NO: 65655

SEQ ID NO: 602534 - RNA, 64 nt, Homo Sapiens; identical to SEQ ID NO: 65656

SEQ ID NO: 602535 - RNA, 64 nt, Homo Sapiens; identical to SEQ ID NO: 65657

SEQ ID NO: 602536 - RNA, 64 nt, Homo Sapiens; identical to SEQ ID NO: 65658

SEQ ID NO: 602537 - RNA, 64 nt, Homo Sapiens; identical to SEQ ID NO: 65659

SEQ ID NO: 602538 - RNA, 64 nt, Homo Sapiens; identical to SEQ ID NO: 65660

SEQ ID NO: 602539 - RNA, 64 nt, Homo Sapiens; identical to SEQ ID NO: 65661

SEQ ID NO: 602540 - RNA, 64 nt, Homo Sapiens; identical to SEQ ID NO: 65662

SEQ ID NO: 602541 - RNA, 64 nt, Homo Sapiens; identical to SEQ ID NO: 65663

SEQ ID NO: 602542 - RNA, 64 nt, Homo Sapiens; identical to SEQ ID NO: 65664

SEQ ID NO: 602543 - RNA, 64 nt, Homo Sapiens; identical to SEQ ID NO: 65665

SEQ ID NO: 602544 - RNA, 64 nt, Homo Sapiens; identical to SEQ ID NO: 65666

SEQ ID NO: 602545 - RNA, 64 nt, Homo Sapiens; identical to SEQ ID NO: 65667

SEQ ID NO: 602546 - RNA, 64 nt, Homo Sapiens; identical to SEQ ID NO: 65668

SEQ ID NO: 602547 - RNA, 64 nt, Homo Sapiens; identical to SEQ ID NO: 65669

SEQ ID NO: 602548 - RNA, 64 nt, Homo Sapiens; identical to SEQ ID NO: 65670

SEQ ID NO: 602549 - RNA, 64 nt, Homo Sapiens; identical to SEQ ID NO: 65671

SEQ ID NO: 602550 - RNA, 64 nt, Homo Sapiens; identical to SEQ ID NO: 65672

SEQ ID NO: 602551 - RNA, 64 nt, Homo Sapiens; identical to SEQ ID NO: 65673

SEQ ID NO: 602552 - RNA, 64 nt, Homo Sapiens; identical to SEQ ID NO: 65674

SEQ ID NO: 602553 - RNA, 64 nt, Homo Sapiens; identical to SEQ ID NO: 65675

SEQ ID NO: 602554 - RNA, 64 nt, Homo Sapiens; identical to SEQ ID NO: 65676

SEQ ID NO: 602555 - RNA, 64 nt, Homo Sapiens; identical to SEQ ID NO: 65677

SEQ ID NO: 602556 - RNA, 64 nt, Homo Sapiens; identical to SEQ ID NO: 65678

SEQ ID NO: 602557 - RNA, 64 nt, Homo Sapiens; identical to SEQ ID NO: 65679

SEQ ID NO: 602558 - RNA, 64 nt, Homo Sapiens; identical to SEQ ID NO: 65680

SEQ ID NO: 602559 - RNA, 64 nt, Homo Sapiens; identical to SEQ ID NO: 65681

SEQ ID NO: 602560 - RNA, 64 nt, Homo Sapiens; identical to SEQ ID NO: 65682

SEQ ID NO: 602561 - RNA, 64 nt, Homo Sapiens; identical to SEQ ID NO: 65683

SEQ ID NO: 602562 - RNA, 64 nt, Homo Sapiens; identical to SEQ ID NO: 65684

SEQ ID NO: 602563 - RNA, 64 nt, Homo Sapiens; identical to SEQ ID NO: 65685

SEQ ID NO: 602564 - RNA, 64 nt, Homo Sapiens; identical to SEQ ID NO: 65686

SEQ ID NO: 602565 - RNA, 64 nt, Homo Sapiens; identical to SEQ ID NO: 65687

SEQ ID NO: 602566 - RNA, 64 nt, Homo Sapiens; identical to SEQ ID NO: 65688

SEQ ID NO: 602567 - RNA, 64 nt, Homo Sapiens; identical to SEQ ID NO: 65689

SEQ ID NO: 602568 - RNA, 64 nt, Homo Sapiens; identical to SEQ ID NO: 65690

SEQ ID NO: 602569 - RNA, 64 nt, Homo Sapiens; identical to SEQ ID NO: 65691

SEQ ID NO: 602570 - RNA, 64 nt, Homo Sapiens; identical to SEQ ID NO: 65692

SEQ ID NO: 602571 - RNA, 64 nt, Homo Sapiens; identical to SEQ ID NO: 65693

SEQ ID NO: 602572 - RNA, 64 nt, Homo Sapiens; identical to SEQ ID NO: 197374

SEQ ID NO: 602573 - RNA, 64 nt, Homo Sapiens; identical to SEQ ID NO: 197375

SEQ ID NO: 602574 - RNA, 63 nt, Homo Sapiens; identical to SEQ ID NO: 197376

SEQ ID NO: 602575 - RNA, 64 nt, Homo Sapiens; identical to SEQ ID NO: 197377

SEQ ID NO: 602576 - RNA, 64 nt, Homo Sapiens; identical to SEQ ID NO: 197378

SEQ ID NO: 602577 - RNA, 64 nt, Homo Sapiens; identical to SEQ ID NO: 197379

SEQ ID NO: 602578 - RNA, 64 nt, Homo Sapiens; identical to SEQ ID NO: 197380

SEQ ID NO: 602579 - RNA, 64 nt, Homo Sapiens; identical to SEQ ID NO: 197381

SEQ ID NO: 602580 - RNA, 64 nt, Homo Sapiens; identical to SEQ ID NO: 197382

SEQ ID NO: 602581 - RNA, 64 nt, Homo Sapiens; identical to SEQ ID NO: 197383

SEQ ID NO: 602582 - RNA, 64 nt, Homo Sapiens; identical to SEQ ID NO: 197384

SEQ ID NO: 602583 - RNA, 64 nt, Homo Sapiens; identical to SEQ ID NO: 197385

SEQ ID NO: 602584 - RNA, 64 nt, Homo Sapiens; identical to SEQ ID NO: 197386

SEQ ID NO: 602585 - RNA, 64 nt, Homo Sapiens; identical to SEQ ID NO: 197387

SEQ ID NO: 602586 - RNA, 64 nt, Homo Sapiens; identical to SEQ ID NO: 197388

SEQ ID NO: 602587 - RNA, 64 nt, Homo Sapiens; identical to SEQ ID NO: 197389

SEQ ID NO: 602588 - RNA, 64 nt, Homo Sapiens; identical to SEQ ID NO: 197390

SEQ ID NO: 602589 - RNA, 64 nt, Homo Sapiens; identical to SEQ ID NO: 197391

SEQ ID NO: 602590 - RNA, 64 nt, Homo Sapiens; identical to SEQ ID NO: 197392

SEQ ID NO: 602591 - RNA, 64 nt, Homo Sapiens; identical to SEQ ID NO: 197393

SEQ ID NO: 602592 - RNA, 64 nt, Homo Sapiens; identical to SEQ ID NO: 197394

SEQ ID NO: 602593 - RNA, 64 nt, Homo Sapiens; identical to SEQ ID NO: 197395

SEQ ID NO: 602594 - RNA, 64 nt, Homo Sapiens; identical to SEQ ID NO: 197396

SEQ ID NO: 602595 - RNA, 64 nt, Homo Sapiens; identical to SEQ ID NO: 197397

SEQ ID NO: 602596 - RNA, 64 nt, Homo Sapiens; identical to SEQ ID NO: 197398

SEQ ID NO: 602597 - RNA, 64 nt, Homo Sapiens; identical to SEQ ID NO: 197399

SEQ ID NO: 602598 - RNA, 64 nt, Homo Sapiens; identical to SEQ ID NO: 197400

SEQ ID NO: 602599 - RNA, 64 nt, Homo Sapiens; identical to SEQ ID NO: 197401

SEQ ID NO: 602600 - RNA, 64 nt, Homo Sapiens; identical to SEQ ID NO: 197402

SEQ ID NO: 602601 - RNA, 64 nt, Homo Sapiens; identical to SEQ ID NO: 197403

SEQ ID NO: 602602 - RNA, 64 nt, Homo Sapiens; identical to SEQ ID NO: 197404

SEQ ID NO: 602603 - RNA, 64 nt, Homo Sapiens; identical to SEQ ID NO: 197405

SEQ ID NO: 602604 - RNA, 64 nt, Homo Sapiens; identical to SEQ ID NO: 197406

SEQ ID NO: 602605 - RNA, 64 nt, Homo Sapiens; identical to SEQ ID NO: 197407

SEQ ID NO: 602606 - RNA, 64 nt, Homo Sapiens; identical to SEQ ID NO: 197408

SEQ ID NO: 602607 - RNA, 64 nt, Homo Sapiens; identical to SEQ ID NO: 197409

SEQ ID NO: 602608 - RNA, 64 nt, Homo Sapiens; identical to SEQ ID NO: 197410

SEQ ID NO: 602609 - RNA, 64 nt, Homo Sapiens; identical to SEQ ID NO: 197411

SEQ ID NO: 602610 - RNA, 64 nt, Homo Sapiens; identical to SEQ ID NO: 197412

SEQ ID NO: 602611 - RNA, 64 nt, Homo Sapiens; identical to SEQ ID NO: 197413

SEQ ID NO: 602612 - RNA, 64 nt, Homo Sapiens; identical to SEQ ID NO: 197414

SEQ ID NO: 602613 - RNA, 64 nt, Homo Sapiens; identical to SEQ ID NO: 197415

SEQ ID NO: 602614 - RNA, 64 nt, Homo Sapiens; identical to SEQ ID NO: 197416

SEQ ID NO: 602615 - RNA, 64 nt, Homo Sapiens; identical to SEQ ID NO: 197417

SEQ ID NO: 602616 - RNA, 64 nt, Homo Sapiens; identical to SEQ ID NO: 197418

SEQ ID NO: 602617 - RNA, 64 nt, Homo Sapiens; identical to SEQ ID NO: 197419

SEQ ID NO: 602618 - RNA, 64 nt, Homo Sapiens; identical to SEQ ID NO: 197420

SEQ ID NO: 602619 - RNA, 64 nt, Homo Sapiens; identical to SEQ ID NO: 197421

SEQ ID NO: 602620 - RNA, 64 nt, Homo Sapiens; identical to SEQ ID NO: 197422

SEQ ID NO: 602621 - RNA, 64 nt, Homo Sapiens; identical to SEQ ID NO: 197423

SEQ ID NO: 602622 - RNA, 64 nt, Homo Sapiens; identical to SEQ ID NO: 197424

SEQ ID NO: 602623 - RNA, 64 nt, Homo Sapiens; identical to SEQ ID NO: 197425

SEQ ID NO: 602624 - RNA, 64 nt, Homo Sapiens; identical to SEQ ID NO: 197426

SEQ ID NO: 602625 - RNA, 64 nt, Homo Sapiens; identical to SEQ ID NO: 197427

SEQ ID NO: 602626 - RNA, 64 nt, Homo Sapiens; identical to SEQ ID NO: 197428

SEQ ID NO: 602627 - RNA, 64 nt, Homo Sapiens; identical to SEQ ID NO: 197429

SEQ ID NO: 602628 - RNA, 64 nt, Homo Sapiens; identical to SEQ ID NO: 197430

SEQ ID NO: 602629 - RNA, 64 nt, Homo Sapiens; identical to SEQ ID NO: 197431

SEQ ID NO: 602630 - RNA, 64 nt, Homo Sapiens; identical to SEQ ID NO: 197431

SEQ ID NO: 602631 - RNA, 64 nt, Homo Sapiens; identical to SEQ ID NO: 197433

SEQ ID NO: 602632 - RNA, 64 nt, Homo Sapiens; identical to SEQ ID NO: 197434

SEQ ID NO: 602633 - RNA, 64 nt, Homo Sapiens; identical to SEQ ID NO: 197435

SEQ ID NO: 602634 - RNA, 64 nt, Homo Sapiens; identical to SEQ ID NO: 197436

SEQ ID NO: 602635 - RNA, 64 nt, Homo Sapiens; identical to SEQ ID NO: 197437

SEQ ID NO: 602636 - RNA, 64 nt, Homo Sapiens; identical to SEQ ID NO: 197438

SEQ ID NO: 602637 - RNA, 64 nt, Homo Sapiens; identical to SEQ ID NO: 197439

SEQ ID NO: 602638 - RNA, 64 nt, Homo Sapiens; identical to SEQ ID NO: 197440

SEQ ID NO: 602639 - RNA, 64 nt, Homo Sapiens; identical to SEQ ID NO: 197441

SEQ ID NO: 602640 - RNA, 64 nt, Homo Sapiens; identical to SEQ ID NO: 197442

SEQ ID NO: 602641 - RNA, 64 nt, Homo Sapiens; identical to SEQ ID NO: 197443

SEQ ID NO: 602642 - RNA, 64 nt, Homo Sapiens; identical to SEQ ID NO: 197444

SEQ ID NO: 602643 - RNA, 64 nt, Homo Sapiens; identical to SEQ ID NO: 197445

SEQ ID NO: 602644 - RNA, 64 nt, Homo Sapiens; identical to SEQ ID NO: 197446

SEQ ID NO: 602645 - RNA, 64 nt, Homo Sapiens; identical to SEQ ID NO: 197447

SEQ ID NO: 602646 - RNA, 64 nt, Homo Sapiens; identical to SEQ ID NO: 197448

SEQ ID NO: 602647 - RNA, 64 nt, Homo Sapiens; identical to SEQ ID NO: 197449

SEQ ID NO: 602648 - RNA, 64 nt, Homo Sapiens; identical to SEQ ID NO: 197450

SEQ ID NO: 602649 - RNA, 64 nt, Homo Sapiens; identical to SEQ ID NO: 197451

SEQ ID NO: 602650 - RNA, 64 nt, Homo Sapiens; identical to SEQ ID NO: 197452

SEQ ID NO: 602651 - RNA, 64 nt, Homo Sapiens; identical to SEQ ID NO: 197453

SEQ ID NO: 602652 - RNA, 64 nt, Homo Sapiens; identical to SEQ ID NO: 197454

SEQ ID NO: 602653 - RNA, 64 nt, Homo Sapiens; identical to SEQ ID NO: 197455

SEQ ID NO: 602654 - RNA, 53 nt, Homo Sapiens; identical to SEQ ID NO: 197456

SEQ ID NO: 602655 - RNA, 64 nt, Homo Sapiens; identical to SEQ ID NO: 197457

SEQ ID NO: 602656 - RNA, 64 nt, Homo Sapiens; identical to SEQ ID NO: 197458

SEQ ID NO: 602657 - RNA, 64 nt, Homo Sapiens; identical to SEQ ID NO: 197459

SEQ ID NO: 602658 - RNA, 64 nt, Homo Sapiens; identical to SEQ ID NO: 197460

SEQ ID NO: 602659 - RNA, 64 nt, Homo Sapiens; identical to SEQ ID NO: 197461

SEQ ID NO: 602660 - RNA, 64 nt, Homo Sapiens; identical to SEQ ID NO: 197462

SEQ ID NO: 602661 - RNA, 64 nt, Homo Sapiens; identical to SEQ ID NO: 197463

SEQ ID NO: 602662 - RNA, 64 nt, Homo Sapiens; identical to SEQ ID NO: 197464

SEQ ID NO: 602663 - RNA, 64 nt, Homo Sapiens; identical to SEQ ID NO: 197465

SEQ ID NO: 602664 - RNA, 64 nt, Homo Sapiens; identical to SEQ ID NO: 197466

SEQ ID NO: 602665 - RNA, 64 nt, Homo Sapiens; identical to SEQ ID NO: 197467

SEQ ID NO: 602666 - RNA, 64 nt, Homo Sapiens; identical to SEQ ID NO: 197468

SEQ ID NO: 602667 - RNA, 64 nt, Homo Sapiens; identical to SEQ ID NO: 197469

SEQ ID NO: 602668 - RNA, 64 nt, Homo Sapiens; identical to SEQ ID NO: 197470

SEQ ID NO: 602669 - RNA, 64 nt, Homo Sapiens; identical to SEQ ID NO: 197471

SEQ ID NO: 602670 - RNA, 64 nt, Homo Sapiens; identical to SEQ ID NO: 197472

SEQ ID NO: 602671 - RNA, 64 nt, Homo Sapiens; identical to SEQ ID NO: 197473

SEQ ID NO: 602672 - RNA, 64 nt, Homo Sapiens; identical to SEQ ID NO: 197474

SEQ ID NO: 602673 - RNA, 64 nt, Homo Sapiens; identical to SEQ ID NO: 197475

SEQ ID NO: 602674 - RNA, 64 nt, Homo Sapiens; identical to SEQ ID NO: 197476

SEQ ID NO: 602675 - RNA, 64 nt, Homo Sapiens; identical to SEQ ID NO: 197477

SEQ ID NO: 602676 - RNA, 64 nt, Homo Sapiens; identical to SEQ ID NO: 197478

SEQ ID NO: 602677 - RNA, 64 nt, Homo Sapiens; identical to SEQ ID NO: 197479

SEQ ID NO: 602678 - RNA, 64 nt, Homo Sapiens; identical to SEQ ID NO: 197480

SEQ ID NO: 602679 - RNA, 64 nt, Homo Sapiens; identical to SEQ ID NO: 197481

SEQ ID NO: 602680 - RNA, 64 nt, Homo Sapiens; identical to SEQ ID NO: 197482

SEQ ID NO: 602681 - RNA, 64 nt, Homo Sapiens; identical to SEQ ID NO: 197483

SEQ ID NO: 602682 - RNA, 64 nt, Homo Sapiens; identical to SEQ ID NO: 197484

SEQ ID NO: 602683 - RNA, 64 nt, Homo Sapiens; identical to SEQ ID NO: 197485

SEQ ID NO: 602684 - RNA, 64 nt, Homo Sapiens; identical to SEQ ID NO: 197486

SEQ ID NO: 602685 - RNA, 64 nt, Homo Sapiens; identical to SEQ ID NO: 197487

SEQ ID NO: 602686 - RNA, 64 nt, Homo Sapiens; identical to SEQ ID NO: 197488

SEQ ID NO: 602687 - RNA, 64 nt, Homo Sapiens; identical to SEQ ID NO: 197489

SEQ ID NO: 602688 - RNA, 64 nt, Homo Sapiens; identical to SEQ ID NO: 197490

SEQ ID NO: 602689 - RNA, 64 nt, Homo Sapiens; identical to SEQ ID NO: 197491

SEQ ID NO: 602690 - RNA, 64 nt, Homo Sapiens; identical to SEQ ID NO: 197492

SEQ ID NO: 602691 - RNA, 64 nt, Homo Sapiens; identical to SEQ ID NO: 197493

SEQ ID NO: 602692 - RNA, 64 nt, Homo Sapiens; identical to SEQ ID NO: 197494

SEQ ID NO: 602693 - RNA, 64 nt, Homo Sapiens; identical to SEQ ID NO: 197495

SEQ ID NO: 602694 - RNA, 64 nt, Homo Sapiens; identical to SEQ ID NO: 197496

SEQ ID NO: 602695 - RNA, 64 nt, Homo Sapiens; identical to SEQ ID NO: 197497

SEQ ID NO: 602696 - RNA, 64 nt, Homo Sapiens; identical to SEQ ID NO: 197498

SEQ ID NO: 602697 - RNA, 64 nt, Homo Sapiens; identical to SEQ ID NO: 197499

SEQ ID NO: 602698 - RNA, 64 nt, Homo Sapiens; identical to SEQ ID NO: 197500

SEQ ID NO: 602699 - RNA, 64 nt, Homo Sapiens; identical to SEQ ID NO: 197501

SEQ ID NO: 602700 - RNA, 64 nt, Homo Sapiens; identical to SEQ ID NO: 197502

SEQ ID NO: 602701 - RNA, 64 nt, Homo Sapiens; identical to SEQ ID NO: 197503

SEQ ID NO: 602702 - RNA, 64 nt, Homo Sapiens; identical to SEQ ID NO: 197504

SEQ ID NO: 602703 - RNA, 64 nt, Homo Sapiens; identical to SEQ ID NO: 197505

SEQ ID NO: 602704 - RNA, 64 nt, Homo Sapiens; identical to SEQ ID NO: 197506

SEQ ID NO: 602705 - RNA, 64 nt, Homo Sapiens; identical to SEQ ID NO: 197507

SEQ ID NO: 602706 - RNA, 64 nt, Homo Sapiens; identical to SEQ ID NO: 197508

SEQ ID NO: 602707 - RNA, 64 nt, Homo Sapiens; identical to SEQ ID NO: 197509

SEQ ID NO: 602708 - RNA, 64 nt, Homo Sapiens; identical to SEQ ID NO: 197510

SEQ ID NO: 602709 - RNA, 64 nt, Homo Sapiens; identical to SEQ ID NO: 197511

SEQ ID NO: 602710 - RNA, 64 nt, Homo Sapiens; identical to SEQ ID NO: 197512

SEQ ID NO: 602711 - RNA, 64 nt, Homo Sapiens; identical to SEQ ID NO: 197513

SEQ ID NO: 602712 - RNA, 64 nt, Homo Sapiens; identical to SEQ ID NO: 197514

SEQ ID NO: 602713 - RNA, 64 nt, Homo Sapiens; identical to SEQ ID NO: 197515

SEQ ID NO: 602714 - RNA, 64 nt, Homo Sapiens; identical to SEQ ID NO: 197516

SEQ ID NO: 602715 - RNA, 64 nt, Homo Sapiens; identical to SEQ ID NO: 197517

SEQ ID NO: 602716 - RNA, 64 nt, Homo Sapiens; identical to SEQ ID NO: 197518

SEQ ID NO: 602717 - RNA, 64 nt, Homo Sapiens; identical to SEQ ID NO: 197519

SEQ ID NO: 602718 - RNA, 64 nt, Homo Sapiens; identical to SEQ ID NO: 197520

SEQ ID NO: 602719 - RNA, 64 nt, Homo Sapiens; identical to SEQ ID NO: 197521

SEQ ID NO: 602720 - RNA, 64 nt, Homo Sapiens; identical to SEQ ID NO: 197522

SEQ ID NO: 602721 - RNA, 64 nt, Homo Sapiens; identical to SEQ ID NO: 197523

SEQ ID NO: 602722 - RNA, 64 nt, Homo Sapiens; identical to SEQ ID NO: 197524

SEQ ID NO: 602723 - RNA, 64 nt, Homo Sapiens; identical to SEQ ID NO: 197525

SEQ ID NO: 602724 - RNA, 64 nt, Homo Sapiens; identical to SEQ ID NO: 197526

SEQ ID NO: 602725 - RNA, 64 nt, Homo Sapiens; identical to SEQ ID NO: 197527

SEQ ID NO: 602726 - RNA, 64 nt, Homo Sapiens; identical to SEQ ID NO: 197528

SEQ ID NO: 602727 - RNA, 64 nt, Homo Sapiens; identical to SEQ ID NO: 197529

SEQ ID NO: 602728 - RNA, 64 nt, Homo Sapiens; identical to SEQ ID NO: 197530

SEQ ID NO: 602729 - RNA, 64 nt, Homo Sapiens; identical to SEQ ID NO: 197531

SEQ ID NO: 602730 - RNA, 64 nt, Homo Sapiens; identical to SEQ ID NO: 197532

SEQ ID NO: 602731 - RNA, 64 nt, Homo Sapiens; identical to SEQ ID NO: 197533

SEQ ID NO: 602732 - RNA, 64 nt, Homo Sapiens; identical to SEQ ID NO: 197534

SEQ ID NO: 602733 - RNA, 64 nt, Homo Sapiens; identical to SEQ ID NO: 197535

SEQ ID NO: 602734 - RNA, 64 nt, Homo Sapiens; identical to SEQ ID NO: 197536

SEQ ID NO: 602735 - RNA, 64 nt, Homo Sapiens; identical to SEQ ID NO: 197537

SEQ ID NO: 602736 - RNA, 64 nt, Homo Sapiens; identical to SEQ ID NO: 197538

SEQ ID NO: 602737 - RNA, 64 nt, Homo Sapiens; identical to SEQ ID NO: 197539

SEQ ID NO: 602738 - RNA, 64 nt, Homo Sapiens; identical to SEQ ID NO: 197540

SEQ ID NO: 602739 - RNA, 64 nt, Homo Sapiens; identical to SEQ ID NO: 197541

SEQ ID NO: 602740 - RNA, 64 nt, Homo Sapiens; identical to SEQ ID NO: 197542

SEQ ID NO: 602741 - RNA, 64 nt, Homo Sapiens; identical to SEQ ID NO: 197543

SEQ ID NO: 602742 - RNA, 64 nt, Homo Sapiens; identical to SEQ ID NO: 197544

SEQ ID NO: 602743 - RNA, 64 nt, Homo Sapiens; identical to SEQ ID NO: 197545

SEQ ID NO: 602744 - RNA, 64 nt, Homo Sapiens; identical to SEQ ID NO: 197546

SEQ ID NO: 602745 - RNA, 64 nt, Homo Sapiens; identical to SEQ ID NO: 197547

SEQ ID NO: 602746 - RNA, 64 nt, Homo Sapiens; identical to SEQ ID NO: 197548

SEQ ID NO: 602747 - RNA, 64 nt, Homo Sapiens; identical to SEQ ID NO: 197549

SEQ ID NO: 602748 - RNA, 64 nt, Homo Sapiens; identical to SEQ ID NO: 197550

SEQ ID NO: 602749 - RNA, 64 nt, Homo Sapiens; identical to SEQ ID NO: 197551

SEQ ID NO: 602750 - RNA, 64 nt, Homo Sapiens; identical to SEQ ID NO: 197552

SEQ ID NO: 602751 - RNA, 64 nt, Homo Sapiens; identical to SEQ ID NO: 197553

SEQ ID NO: 602752 - RNA, 52 nt, Homo Sapiens; identical to SEQ ID NO: 197554

SEQ ID NO: 602753 - RNA, 64 nt, Homo Sapiens; identical to SEQ ID NO: 197555

SEQ ID NO: 602754 - RNA, 64 nt, Homo Sapiens; identical to SEQ ID NO: 197556

SEQ ID NO: 602755 - RNA, 64 nt, Homo Sapiens; identical to SEQ ID NO: 197557

SEQ ID NO: 602756 - RNA, 64 nt, Homo Sapiens; identical to SEQ ID NO: 197558

SEQ ID NO: 602757 - RNA, 64 nt, Homo Sapiens; identical to SEQ ID NO: 197559

SEQ ID NO: 602758 - RNA, 64 nt, Homo Sapiens; identical to SEQ ID NO: 197560

SEQ ID NO: 602759 - RNA, 64 nt, Homo Sapiens; identical to SEQ ID NO: 197561

SEQ ID NO: 602760 - RNA, 64 nt, Homo Sapiens; identical to SEQ ID NO: 197562

SEQ ID NO: 602761 - RNA, 64 nt, Homo Sapiens; identical to SEQ ID NO: 197563

SEQ ID NO: 602762 - RNA, 64 nt, Homo Sapiens; identical to SEQ ID NO: 197564

SEQ ID NO: 602763 - RNA, 64 nt, Homo Sapiens; identical to SEQ ID NO: 197565

SEQ ID NO: 602764 - RNA, 64 nt, Homo Sapiens; identical to SEQ ID NO: 197566

SEQ ID NO: 602765 - RNA, 64 nt, Homo Sapiens; identical to SEQ ID NO: 197567

SEQ ID NO: 602766 - RNA, 64 nt, Homo Sapiens; identical to SEQ ID NO: 197568

SEQ ID NO: 602767 - RNA, 64 nt, Homo Sapiens; identical to SEQ ID NO: 197569

SEQ ID NO: 602768 - RNA, 64 nt, Homo Sapiens; identical to SEQ ID NO: 197570

SEQ ID NO: 602769 - RNA, 64 nt, Homo Sapiens; identical to SEQ ID NO: 197571

SEQ ID NO: 602770 - RNA, 64 nt, Homo Sapiens; identical to SEQ ID NO: 197572

SEQ ID NO: 602771 - RNA, 64 nt, Homo Sapiens; identical to SEQ ID NO: 197573

SEQ ID NO: 602772 - RNA, 64 nt, Homo Sapiens; identical to SEQ ID NO: 197574

SEQ ID NO: 602773 - RNA, 64 nt, Homo Sapiens; identical to SEQ ID NO: 197575

SEQ ID NO: 602774 - RNA, 64 nt, Homo Sapiens; identical to SEQ ID NO: 197576

SEQ ID NO: 602775 - RNA, 64 nt, Homo Sapiens; identical to SEQ ID NO: 197577

SEQ ID NO: 602776 - RNA, 64 nt, Homo Sapiens; identical to SEQ ID NO: 197578

SEQ ID NO: 602777 - RNA, 64 nt, Homo Sapiens; identical to SEQ ID NO: 197579

SEQ ID NO: 602778 - RNA, 64 nt, Homo Sapiens; identical to SEQ ID NO: 197580

SEQ ID NO: 602779 - RNA, 64 nt, Homo Sapiens; identical to SEQ ID NO: 197581

SEQ ID NO: 602780 - RNA, 64 nt, Homo Sapiens; identical to SEQ ID NO: 197582

SEQ ID NO: 602781 - RNA, 64 nt, Homo Sapiens; identical to SEQ ID NO: 197583

SEQ ID NO: 602782 - RNA, 64 nt, Homo Sapiens; identical to SEQ ID NO: 197584

SEQ ID NO: 602783 - RNA, 64 nt, Homo Sapiens; identical to SEQ ID NO: 197585

SEQ ID NO: 602784 - RNA, 64 nt, Homo Sapiens; identical to SEQ ID NO: 197586

SEQ ID NO: 602785 - RNA, 64 nt, Homo Sapiens; identical to SEQ ID NO: 197587

SEQ ID NO: 602786 - RNA, 64 nt, Homo Sapiens; identical to SEQ ID NO: 197588

SEQ ID NO: 602787 - RNA, 64 nt, Homo Sapiens; identical to SEQ ID NO: 197589

SEQ ID NO: 602788 - RNA, 64 nt, Homo Sapiens; identical to SEQ ID NO: 197590

SEQ ID NO: 602789 - RNA, 64 nt, Homo Sapiens; identical to SEQ ID NO: 197591

SEQ ID NO: 602790 - RNA, 64 nt, Homo Sapiens; identical to SEQ ID NO: 197592

SEQ ID NO: 602791 - RNA, 64 nt, Homo Sapiens; identical to SEQ ID NO: 197593

SEQ ID NO: 602792 - RNA, 64 nt, Homo Sapiens; identical to SEQ ID NO: 197593

SEQ ID NO: 602793 - RNA, 64 nt, Homo Sapiens; identical to SEQ ID NO: 197595

SEQ ID NO: 602794 - RNA, 64 nt, Homo Sapiens; identical to SEQ ID NO: 197596

SEQ ID NO: 602795 - RNA, 64 nt, Homo Sapiens; identical to SEQ ID NO: 197597

SEQ ID NO: 602796 - RNA, 64 nt, Homo Sapiens; identical to SEQ ID NO: 197598

SEQ ID NO: 602797 - RNA, 64 nt, Homo Sapiens; identical to SEQ ID NO: 197599

SEQ ID NO: 602798 - RNA, 64 nt, Homo Sapiens; identical to SEQ ID NO: 197600

SEQ ID NO: 602799 - RNA, 64 nt, Homo Sapiens; identical to SEQ ID NO: 197601

SEQ ID NO: 602800 - RNA, 64 nt, Homo Sapiens; identical to SEQ ID NO: 197602

SEQ ID NO: 602801 - RNA, 64 nt, Homo Sapiens; identical to SEQ ID NO: 197603

SEQ ID NO: 602802 - RNA, 64 nt, Homo Sapiens; identical to SEQ ID NO: 197604

SEQ ID NO: 602803 - RNA, 64 nt, Homo Sapiens; identical to SEQ ID NO: 197605

SEQ ID NO: 602804 - RNA, 64 nt, Homo Sapiens; identical to SEQ ID NO: 197606

SEQ ID NO: 602805 - RNA, 64 nt, Homo Sapiens; identical to SEQ ID NO: 197607

SEQ ID NO: 602806 - RNA, 64 nt, Homo Sapiens; identical to SEQ ID NO: 197608

SEQ ID NO: 602807 - RNA, 64 nt, Homo Sapiens; identical to SEQ ID NO: 197609

SEQ ID NO: 602808 - RNA, 64 nt, Homo Sapiens; identical to SEQ ID NO: 197610

SEQ ID NO: 602809 - RNA, 64 nt, Homo Sapiens; identical to SEQ ID NO: 197611

SEQ ID NO: 602810 - RNA, 64 nt, Homo Sapiens; identical to SEQ ID NO: 64824

SEQ ID NO: 602811 - RNA, 64 nt, Homo Sapiens; identical to SEQ ID NO: 64825

SEQ ID NO: 602812 - RNA, 64 nt, Homo Sapiens; identical to SEQ ID NO: 64826

SEQ ID NO: 602813 - RNA, 64 nt, Homo Sapiens; identical to SEQ ID NO: 64827

SEQ ID NO: 602814 - RNA, 64 nt, Homo Sapiens; identical to SEQ ID NO: 197616

SEQ ID NO: 602815 - RNA, 64 nt, Homo Sapiens; identical to SEQ ID NO: 197617

SEQ ID NO: 602816 - RNA, 64 nt, Homo Sapiens; identical to SEQ ID NO: 64828

SEQ ID NO: 602817 - RNA, 64 nt, Homo Sapiens; identical to SEQ ID NO: 64829

SEQ ID NO: 602818 - RNA, 64 nt, Homo Sapiens; identical to SEQ ID NO: 64830

SEQ ID NO: 602819 - RNA, 64 nt, Homo Sapiens; identical to SEQ ID NO: 197621

SEQ ID NO: 602820 - RNA, 64 nt, Homo Sapiens; identical to SEQ ID NO: 197622

SEQ ID NO: 602821 - RNA, 64 nt, Homo Sapiens; identical to SEQ ID NO: 197623

SEQ ID NO: 602822 - RNA, 64 nt, Homo Sapiens; identical to SEQ ID NO: 197624

SEQ ID NO: 602823 - RNA, 64 nt, Homo Sapiens; identical to SEQ ID NO: 197625

SEQ ID NO: 602824 - RNA, 64 nt, Homo Sapiens; identical to SEQ ID NO: 197626

SEQ ID NO: 602825 - RNA, 64 nt, Homo Sapiens; identical to SEQ ID NO: 197627

SEQ ID NO: 602826 - RNA, 64 nt, Homo Sapiens; identical to SEQ ID NO: 197628

SEQ ID NO: 602827 - RNA, 64 nt, Homo Sapiens; identical to SEQ ID NO: 197629

SEQ ID NO: 602828 - RNA, 64 nt, Homo Sapiens; identical to SEQ ID NO: 197630

SEQ ID NO: 602829 - RNA, 64 nt, Homo Sapiens; identical to SEQ ID NO: 197631

SEQ ID NO: 602830 - RNA, 64 nt, Homo Sapiens; identical to SEQ ID NO: 197632

SEQ ID NO: 602831 - RNA, 64 nt, Homo Sapiens; identical to SEQ ID NO: 197633

SEQ ID NO: 602832 - RNA, 64 nt, Homo Sapiens; identical to SEQ ID NO: 197634

SEQ ID NO: 602833 - RNA, 64 nt, Homo Sapiens; identical to SEQ ID NO: 197635

SEQ ID NO: 602834 - RNA, 64 nt, Homo Sapiens; identical to SEQ ID NO: 197636

SEQ ID NO: 602835 - RNA, 64 nt, Homo Sapiens; identical to SEQ ID NO: 197637

SEQ ID NO: 602836 - RNA, 64 nt, Homo Sapiens; identical to SEQ ID NO: 197638

SEQ ID NO: 602837 - RNA, 64 nt, Homo Sapiens; identical to SEQ ID NO: 197639

SEQ ID NO: 602838 - RNA, 64 nt, Homo Sapiens; identical to SEQ ID NO: 197640

SEQ ID NO: 602839 - RNA, 64 nt, Homo Sapiens; identical to SEQ ID NO: 197641

SEQ ID NO: 602840 - RNA, 64 nt, Homo Sapiens; identical to SEQ ID NO: 197642

SEQ ID NO: 602841 - RNA, 64 nt, Homo Sapiens; identical to SEQ ID NO: 197643

SEQ ID NO: 602842 - RNA, 64 nt, Homo Sapiens; identical to SEQ ID NO: 197644

SEQ ID NO: 602843 - RNA, 64 nt, Homo Sapiens; identical to SEQ ID NO: 197645

SEQ ID NO: 602844 - RNA, 64 nt, Homo Sapiens; identical to SEQ ID NO: 197646

SEQ ID NO: 602845 - RNA, 64 nt, Homo Sapiens; identical to SEQ ID NO: 197647

SEQ ID NO: 602846 - RNA, 64 nt, Homo Sapiens; identical to SEQ ID NO: 197648

SEQ ID NO: 602847 - RNA, 64 nt, Homo Sapiens; identical to SEQ ID NO: 197649

SEQ ID NO: 602848 - RNA, 64 nt, Homo Sapiens; identical to SEQ ID NO: 197650

SEQ ID NO: 602849 - RNA, 64 nt, Homo Sapiens; identical to SEQ ID NO: 197651

SEQ ID NO: 602850 - RNA, 64 nt, Homo Sapiens; identical to SEQ ID NO: 197652

SEQ ID NO: 602851 - RNA, 64 nt, Homo Sapiens; identical to SEQ ID NO: 197653

SEQ ID NO: 602852 - RNA, 64 nt, Homo Sapiens; identical to SEQ ID NO: 197654

SEQ ID NO: 602853 - RNA, 64 nt, Homo Sapiens; identical to SEQ ID NO: 197655

SEQ ID NO: 602854 - RNA, 64 nt, Homo Sapiens; identical to SEQ ID NO: 64831

SEQ ID NO: 602855 - RNA, 64 nt, Homo Sapiens; identical to SEQ ID NO: 64832

SEQ ID NO: 602856 - RNA, 64 nt, Homo Sapiens; identical to SEQ ID NO: 197658

SEQ ID NO: 602857 - RNA, 64 nt, Homo Sapiens; identical to SEQ ID NO: 197659

SEQ ID NO: 602858 - RNA, 64 nt, Homo Sapiens; identical to SEQ ID NO: 197660

SEQ ID NO: 602859 - RNA, 64 nt, Homo Sapiens; identical to SEQ ID NO: 197661

SEQ ID NO: 602860 - RNA, 64 nt, Homo Sapiens; identical to SEQ ID NO: 197662

SEQ ID NO: 602861 - RNA, 64 nt, Homo Sapiens; identical to SEQ ID NO: 197663

SEQ ID NO: 602862 - RNA, 64 nt, Homo Sapiens; identical to SEQ ID NO: 197664

SEQ ID NO: 602863 - RNA, 64 nt, Homo Sapiens; identical to SEQ ID NO: 197665

SEQ ID NO: 602864 - RNA, 64 nt, Homo Sapiens; identical to SEQ ID NO: 197666

SEQ ID NO: 602865 - RNA, 64 nt, Homo Sapiens; identical to SEQ ID NO: 197667

SEQ ID NO: 602866 - RNA, 64 nt, Homo Sapiens; identical to SEQ ID NO: 197668

SEQ ID NO: 602867 - RNA, 64 nt, Homo Sapiens; identical to SEQ ID NO: 197669

SEQ ID NO: 602868 - RNA, 64 nt, Homo Sapiens; identical to SEQ ID NO: 197670

SEQ ID NO: 602869 - RNA, 54 nt, Homo Sapiens; identical to SEQ ID NO: 197671

SEQ ID NO: 602870 - RNA, 64 nt, Homo Sapiens; identical to SEQ ID NO: 197672

SEQ ID NO: 602871 - RNA, 64 nt, Homo Sapiens; identical to SEQ ID NO: 197673

SEQ ID NO: 602872 - RNA, 64 nt, Homo Sapiens; identical to SEQ ID NO: 197674

SEQ ID NO: 602873 - RNA, 64 nt, Homo Sapiens; identical to SEQ ID NO: 197675

SEQ ID NO: 602874 - RNA, 64 nt, Homo Sapiens; identical to SEQ ID NO: 197676

SEQ ID NO: 602875 - RNA, 64 nt, Homo Sapiens; identical to SEQ ID NO: 197677

SEQ ID NO: 602876 - RNA, 64 nt, Homo Sapiens; identical to SEQ ID NO: 197678

SEQ ID NO: 602877 - RNA, 64 nt, Homo Sapiens; identical to SEQ ID NO: 197679

SEQ ID NO: 602878 - RNA, 64 nt, Homo Sapiens; identical to SEQ ID NO: 197680

SEQ ID NO: 602879 - RNA, 64 nt, Homo Sapiens; identical to SEQ ID NO: 197681

SEQ ID NO: 602880 - RNA, 64 nt, Homo Sapiens; identical to SEQ ID NO: 197682

SEQ ID NO: 602881 - RNA, 64 nt, Homo Sapiens; identical to SEQ ID NO: 197683

SEQ ID NO: 602882 - RNA, 64 nt, Homo Sapiens; identical to SEQ ID NO: 64833

SEQ ID NO: 602883 - RNA, 64 nt, Homo Sapiens; identical to SEQ ID NO: 64834

SEQ ID NO: 602884 - RNA, 64 nt, Homo Sapiens; identical to SEQ ID NO: 197686

SEQ ID NO: 602885 - RNA, 59 nt, Homo Sapiens; identical to SEQ ID NO: 197687

SEQ ID NO: 602886 - RNA, 64 nt, Homo Sapiens; identical to SEQ ID NO: 197688

SEQ ID NO: 602887 - RNA, 64 nt, Homo Sapiens; identical to SEQ ID NO: 197689

SEQ ID NO: 602888 - RNA, 64 nt, Homo Sapiens; identical to SEQ ID NO: 197690

SEQ ID NO: 602889 - RNA, 64 nt, Homo Sapiens; identical to SEQ ID NO: 197691

SEQ ID NO: 602890 - RNA, 64 nt, Homo Sapiens; identical to SEQ ID NO: 197692

SEQ ID NO: 602891 - RNA, 57 nt, Homo Sapiens; identical to SEQ ID NO: 197693

SEQ ID NO: 602892 - RNA, 64 nt, Homo Sapiens; identical to SEQ ID NO: 197694

SEQ ID NO: 602893 - RNA, 64 nt, Homo Sapiens; identical to SEQ ID NO: 197695

SEQ ID NO: 602894 - RNA, 64 nt, Homo Sapiens; identical to SEQ ID NO: 197696

SEQ ID NO: 602895 - RNA, 64 nt, Homo Sapiens; identical to SEQ ID NO: 197697

SEQ ID NO: 602896 - RNA, 64 nt, Homo Sapiens; identical to SEQ ID NO: 197698

SEQ ID NO: 602897 - RNA, 64 nt, Homo Sapiens; identical to SEQ ID NO: 197699

SEQ ID NO: 602898 - RNA, 64 nt, Homo Sapiens; identical to SEQ ID NO: 197700

SEQ ID NO: 602899 - RNA, 64 nt, Homo Sapiens; identical to SEQ ID NO: 197701

SEQ ID NO: 602900 - RNA, 64 nt, Homo Sapiens; identical to SEQ ID NO: 197702

SEQ ID NO: 602901 - RNA, 64 nt, Homo Sapiens; identical to SEQ ID NO: 197703

SEQ ID NO: 602902 - RNA, 64 nt, Homo Sapiens; identical to SEQ ID NO: 197704

SEQ ID NO: 602903 - RNA, 64 nt, Homo Sapiens; identical to SEQ ID NO: 197705

SEQ ID NO: 602904 - RNA, 64 nt, Homo Sapiens; identical to SEQ ID NO: 197706

SEQ ID NO: 602905 - RNA, 64 nt, Homo Sapiens; identical to SEQ ID NO: 197707

SEQ ID NO: 602906 - RNA, 64 nt, Homo Sapiens; identical to SEQ ID NO: 197708

SEQ ID NO: 602907 - RNA, 64 nt, Homo Sapiens; identical to SEQ ID NO: 197709

SEQ ID NO: 602908 - RNA, 64 nt, Homo Sapiens; identical to SEQ ID NO: 197710

SEQ ID NO: 602909 - RNA, 64 nt, Homo Sapiens; identical to SEQ ID NO: 197711

SEQ ID NO: 602910 - RNA, 64 nt, Homo Sapiens; identical to SEQ ID NO: 197712

SEQ ID NO: 602911 - RNA, 64 nt, Homo Sapiens; identical to SEQ ID NO: 197713

SEQ ID NO: 602912 - RNA, 64 nt, Homo Sapiens; identical to SEQ ID NO: 197714

SEQ ID NO: 602913 - RNA, 64 nt, Homo Sapiens; identical to SEQ ID NO: 197715

SEQ ID NO: 602914 - RNA, 64 nt, Homo Sapiens; identical to SEQ ID NO: 197716

SEQ ID NO: 602915 - RNA, 64 nt, Homo Sapiens; identical to SEQ ID NO: 197717

SEQ ID NO: 602916 - RNA, 64 nt, Homo Sapiens; identical to SEQ ID NO: 197718

SEQ ID NO: 602917 - RNA, 64 nt, Homo Sapiens; identical to SEQ ID NO: 197719

SEQ ID NO: 602918 - RNA, 64 nt, Homo Sapiens; identical to SEQ ID NO: 197720

SEQ ID NO: 602919 - RNA, 64 nt, Homo Sapiens; identical to SEQ ID NO: 197721

SEQ ID NO: 602920 - RNA, 64 nt, Homo Sapiens; identical to SEQ ID NO: 197722

SEQ ID NO: 602921 - RNA, 64 nt, Homo Sapiens; identical to SEQ ID NO: 197723

SEQ ID NO: 602922 - RNA, 64 nt, Homo Sapiens; identical to SEQ ID NO: 197724

SEQ ID NO: 602923 - RNA, 64 nt, Homo Sapiens; identical to SEQ ID NO: 197725

SEQ ID NO: 602924 - RNA, 64 nt, Homo Sapiens; identical to SEQ ID NO: 197726

SEQ ID NO: 602925 - RNA, 64 nt, Homo Sapiens; identical to SEQ ID NO: 197727

SEQ ID NO: 602926 - RNA, 64 nt, Homo Sapiens; identical to SEQ ID NO: 197728

SEQ ID NO: 602927 - RNA, 50 nt, Homo Sapiens; identical to SEQ ID NO: 197729

SEQ ID NO: 602928 - RNA, 64 nt, Homo Sapiens; identical to SEQ ID NO: 197730

SEQ ID NO: 602929 - RNA, 64 nt, Homo Sapiens; identical to SEQ ID NO: 197731

SEQ ID NO: 602930 - RNA, 64 nt, Homo Sapiens; identical to SEQ ID NO: 197732

SEQ ID NO: 602931 - RNA, 64 nt, Homo Sapiens; identical to SEQ ID NO: 197733

SEQ ID NO: 602932 - RNA, 64 nt, Homo Sapiens; identical to SEQ ID NO: 197734

SEQ ID NO: 602933 - RNA, 64 nt, Homo Sapiens; identical to SEQ ID NO: 197735

SEQ ID NO: 602934 - RNA, 64 nt, Homo Sapiens; identical to SEQ ID NO: 197736

SEQ ID NO: 602935 - RNA, 64 nt, Homo Sapiens; identical to SEQ ID NO: 197737

SEQ ID NO: 602936 - RNA, 64 nt, Homo Sapiens; identical to SEQ ID NO: 197738

SEQ ID NO: 602937 - RNA, 64 nt, Homo Sapiens; identical to SEQ ID NO: 197739

SEQ ID NO: 602938 - RNA, 64 nt, Homo Sapiens; identical to SEQ ID NO: 197740

SEQ ID NO: 602939 - RNA, 64 nt, Homo Sapiens; identical to SEQ ID NO: 197741

SEQ ID NO: 602940 - RNA, 64 nt, Homo Sapiens; identical to SEQ ID NO: 197742

SEQ ID NO: 602941 - RNA, 64 nt, Homo Sapiens; identical to SEQ ID NO: 197743

SEQ ID NO: 602942 - RNA, 64 nt, Homo Sapiens; identical to SEQ ID NO: 197744

SEQ ID NO: 602943 - RNA, 64 nt, Homo Sapiens; identical to SEQ ID NO: 197745

SEQ ID NO: 602944 - RNA, 64 nt, Homo Sapiens; identical to SEQ ID NO: 197746

SEQ ID NO: 602945 - RNA, 64 nt, Homo Sapiens; identical to SEQ ID NO: 197747

SEQ ID NO: 602946 - RNA, 64 nt, Homo Sapiens; identical to SEQ ID NO: 197748

SEQ ID NO: 602947 - RNA, 64 nt, Homo Sapiens; identical to SEQ ID NO: 197749

SEQ ID NO: 602948 - RNA, 64 nt, Homo Sapiens; identical to SEQ ID NO: 197750

SEQ ID NO: 602949 - RNA, 57 nt, Homo Sapiens; identical to SEQ ID NO: 197751

SEQ ID NO: 602950 - RNA, 64 nt, Homo Sapiens; identical to SEQ ID NO: 197752

SEQ ID NO: 602951 - RNA, 64 nt, Homo Sapiens; identical to SEQ ID NO: 197753

SEQ ID NO: 602952 - RNA, 64 nt, Homo Sapiens; identical to SEQ ID NO: 197754

SEQ ID NO: 602953 - RNA, 64 nt, Homo Sapiens; identical to SEQ ID NO: 197755

SEQ ID NO: 602954 - RNA, 64 nt, Homo Sapiens; identical to SEQ ID NO: 197756

SEQ ID NO: 602955 - RNA, 64 nt, Homo Sapiens; identical to SEQ ID NO: 197757

SEQ ID NO: 602956 - RNA, 64 nt, Homo Sapiens; identical to SEQ ID NO: 64835

SEQ ID NO: 602957 - RNA, 64 nt, Homo Sapiens; identical to SEQ ID NO: 64836

SEQ ID NO: 602958 - RNA, 64 nt, Homo Sapiens; identical to SEQ ID NO: 197760

SEQ ID NO: 602959 - RNA, 64 nt, Homo Sapiens; identical to SEQ ID NO: 197761

SEQ ID NO: 602960 - RNA, 64 nt, Homo Sapiens; identical to SEQ ID NO: 197762

SEQ ID NO: 602961 - RNA, 64 nt, Homo Sapiens; identical to SEQ ID NO: 197763

SEQ ID NO: 602962 - RNA, 64 nt, Homo Sapiens; identical to SEQ ID NO: 197764

SEQ ID NO: 602963 - RNA, 64 nt, Homo Sapiens; identical to SEQ ID NO: 197765

SEQ ID NO: 602964 - RNA, 64 nt, Homo Sapiens; identical to SEQ ID NO: 197766

SEQ ID NO: 602965 - RNA, 64 nt, Homo Sapiens; identical to SEQ ID NO: 197767

SEQ ID NO: 602966 - RNA, 64 nt, Homo Sapiens; identical to SEQ ID NO: 197768

SEQ ID NO: 602967 - RNA, 64 nt, Homo Sapiens; identical to SEQ ID NO: 197769

SEQ ID NO: 602968 - RNA, 64 nt, Homo Sapiens; identical to SEQ ID NO: 197770

SEQ ID NO: 602969 - RNA, 64 nt, Homo Sapiens; identical to SEQ ID NO: 197771

SEQ ID NO: 602970 - RNA, 64 nt, Homo Sapiens; identical to SEQ ID NO: 197772

SEQ ID NO: 602971 - RNA, 64 nt, Homo Sapiens; identical to SEQ ID NO: 197773

SEQ ID NO: 602972 - RNA, 64 nt, Homo Sapiens; identical to SEQ ID NO: 197774

SEQ ID NO: 602973 - RNA, 64 nt, Homo Sapiens; identical to SEQ ID NO: 197775

SEQ ID NO: 602974 - RNA, 64 nt, Homo Sapiens; identical to SEQ ID NO: 197776

SEQ ID NO: 602975 - RNA, 64 nt, Homo Sapiens; identical to SEQ ID NO: 197777

SEQ ID NO: 602976 - RNA, 64 nt, Homo Sapiens; identical to SEQ ID NO: 197778

SEQ ID NO: 602977 - RNA, 64 nt, Homo Sapiens; identical to SEQ ID NO: 197779

SEQ ID NO: 602978 - RNA, 64 nt, Homo Sapiens; identical to SEQ ID NO: 197780

SEQ ID NO: 602979 - RNA, 64 nt, Homo Sapiens; identical to SEQ ID NO: 197781

SEQ ID NO: 602980 - RNA, 64 nt, Homo Sapiens; identical to SEQ ID NO: 197782

SEQ ID NO: 602981 - RNA, 64 nt, Homo Sapiens; identical to SEQ ID NO: 197783

SEQ ID NO: 602982 - RNA, 64 nt, Homo Sapiens; identical to SEQ ID NO: 197784

SEQ ID NO: 602983 - RNA, 64 nt, Homo Sapiens; identical to SEQ ID NO: 197785

SEQ ID NO: 602984 - RNA, 64 nt, Homo Sapiens; identical to SEQ ID NO: 197786

SEQ ID NO: 602985 - RNA, 64 nt, Homo Sapiens; identical to SEQ ID NO: 197787

SEQ ID NO: 602986 - RNA, 64 nt, Homo Sapiens; identical to SEQ ID NO: 197788

SEQ ID NO: 602987 - RNA, 64 nt, Homo Sapiens; identical to SEQ ID NO: 197789

SEQ ID NO: 602988 - RNA, 64 nt, Homo Sapiens; identical to SEQ ID NO: 197790

SEQ ID NO: 602989 - RNA, 64 nt, Homo Sapiens; identical to SEQ ID NO: 197791

SEQ ID NO: 602990 - RNA, 64 nt, Homo Sapiens; identical to SEQ ID NO: 197792

SEQ ID NO: 602991 - RNA, 64 nt, Homo Sapiens; identical to SEQ ID NO: 197793

SEQ ID NO: 602992 - RNA, 64 nt, Homo Sapiens; identical to SEQ ID NO: 197794

SEQ ID NO: 602993 - RNA, 64 nt, Homo Sapiens; identical to SEQ ID NO: 197795

SEQ ID NO: 602994 - RNA, 64 nt, Homo Sapiens; identical to SEQ ID NO: 197796

SEQ ID NO: 602995 - RNA, 64 nt, Homo Sapiens; identical to SEQ ID NO: 64837

SEQ ID NO: 602996 - RNA, 64 nt, Homo Sapiens; identical to SEQ ID NO: 64838

SEQ ID NO: 602997 - RNA, 64 nt, Homo Sapiens; identical to SEQ ID NO: 64839

SEQ ID NO: 602998 - RNA, 64 nt, Homo Sapiens; identical to SEQ ID NO: 64840

SEQ ID NO: 602999 - RNA, 64 nt, Homo Sapiens; identical to SEQ ID NO: 197801

SEQ ID NO: 603000 - RNA, 64 nt, Homo Sapiens; identical to SEQ ID NO: 64841

SEQ ID NO: 603001 - RNA, 64 nt, Homo Sapiens; identical to SEQ ID NO: 64842

SEQ ID NO: 603002 - RNA, 64 nt, Homo Sapiens; identical to SEQ ID NO: 197804

SEQ ID NO: 603003 - RNA, 64 nt, Homo Sapiens; identical to SEQ ID NO: 197805

SEQ ID NO: 603004 - RNA, 64 nt, Homo Sapiens; identical to SEQ ID NO: 197806

SEQ ID NO: 603005 - RNA, 64 nt, Homo Sapiens; identical to SEQ ID NO: 197807

SEQ ID NO: 603006 - RNA, 64 nt, Homo Sapiens; identical to SEQ ID NO: 197808

SEQ ID NO: 603007 - RNA, 64 nt, Homo Sapiens; identical to SEQ ID NO: 197809

SEQ ID NO: 603008 - RNA, 64 nt, Homo Sapiens; identical to SEQ ID NO: 197810

SEQ ID NO: 603009 - RNA, 64 nt, Homo Sapiens; identical to SEQ ID NO: 197811

SEQ ID NO: 603010 - RNA, 64 nt, Homo Sapiens; identical to SEQ ID NO: 197812

SEQ ID NO: 603011 - RNA, 64 nt, Homo Sapiens; identical to SEQ ID NO: 197813

SEQ ID NO: 603012 - RNA, 64 nt, Homo Sapiens; identical to SEQ ID NO: 197814

SEQ ID NO: 603013 - RNA, 64 nt, Homo Sapiens; identical to SEQ ID NO: 197815

SEQ ID NO: 603014 - RNA, 64 nt, Homo Sapiens; identical to SEQ ID NO: 197816

SEQ ID NO: 603015 - RNA, 64 nt, Homo Sapiens; identical to SEQ ID NO: 197817

SEQ ID NO: 603016 - RNA, 64 nt, Homo Sapiens; identical to SEQ ID NO: 197818

SEQ ID NO: 603017 - RNA, 64 nt, Homo Sapiens; identical to SEQ ID NO: 197819

SEQ ID NO: 603018 - RNA, 64 nt, Homo Sapiens; identical to SEQ ID NO: 197820

SEQ ID NO: 603019 - RNA, 64 nt, Homo Sapiens; identical to SEQ ID NO: 197821

SEQ ID NO: 603020 - RNA, 64 nt, Homo Sapiens; identical to SEQ ID NO: 197822

SEQ ID NO: 603021 - RNA, 64 nt, Homo Sapiens; identical to SEQ ID NO: 197823

SEQ ID NO: 603022 - RNA, 64 nt, Homo Sapiens; identical to SEQ ID NO: 197824

SEQ ID NO: 603023 - RNA, 64 nt, Homo Sapiens; identical to SEQ ID NO: 197825

SEQ ID NO: 603024 - RNA, 64 nt, Homo Sapiens; identical to SEQ ID NO: 197826

SEQ ID NO: 603025 - RNA, 64 nt, Homo Sapiens; identical to SEQ ID NO: 197827

SEQ ID NO: 603026 - RNA, 64 nt, Homo Sapiens; identical to SEQ ID NO: 197828

SEQ ID NO: 603027 - RNA, 64 nt, Homo Sapiens; identical to SEQ ID NO: 64843

SEQ ID NO: 603028 - RNA, 64 nt, Homo Sapiens; identical to SEQ ID NO: 64844

SEQ ID NO: 603029 - RNA, 64 nt, Homo Sapiens; identical to SEQ ID NO: 197831

SEQ ID NO: 603030 - RNA, 64 nt, Homo Sapiens; identical to SEQ ID NO: 197832

SEQ ID NO: 603031 - RNA, 64 nt, Homo Sapiens; identical to SEQ ID NO: 197833

SEQ ID NO: 603032 - RNA, 64 nt, Homo Sapiens; identical to SEQ ID NO: 197834

SEQ ID NO: 603033 - RNA, 64 nt, Homo Sapiens; identical to SEQ ID NO: 197835

SEQ ID NO: 603034 - RNA, 64 nt, Homo Sapiens; identical to SEQ ID NO: 64845

SEQ ID NO: 603035 - RNA, 64 nt, Homo Sapiens; identical to SEQ ID NO: 64846

SEQ ID NO: 603036 - RNA, 64 nt, Homo Sapiens; identical to SEQ ID NO: 197838

SEQ ID NO: 603037 - RNA, 64 nt, Homo Sapiens; identical to SEQ ID NO: 197839

SEQ ID NO: 603038 - RNA, 64 nt, Homo Sapiens; identical to SEQ ID NO: 197840

SEQ ID NO: 603039 - RNA, 64 nt, Homo Sapiens; identical to SEQ ID NO: 197841

SEQ ID NO: 603040 - RNA, 64 nt, Homo Sapiens; identical to SEQ ID NO: 197842

SEQ ID NO: 603041 - RNA, 64 nt, Homo Sapiens; identical to SEQ ID NO: 197843

SEQ ID NO: 603042 - RNA, 64 nt, Homo Sapiens; identical to SEQ ID NO: 197844

SEQ ID NO: 603043 - RNA, 64 nt, Homo Sapiens; identical to SEQ ID NO: 197845

SEQ ID NO: 603044 - RNA, 64 nt, Homo Sapiens; identical to SEQ ID NO: 197846

SEQ ID NO: 603045 - RNA, 64 nt, Homo Sapiens; identical to SEQ ID NO: 197847

SEQ ID NO: 603046 - RNA, 64 nt, Homo Sapiens; identical to SEQ ID NO: 197848

SEQ ID NO: 603047 - RNA, 64 nt, Homo Sapiens; identical to SEQ ID NO: 197849

SEQ ID NO: 603048 - RNA, 64 nt, Homo Sapiens; identical to SEQ ID NO: 197850

SEQ ID NO: 603049 - RNA, 54 nt, Homo Sapiens; identical to SEQ ID NO: 197851

SEQ ID NO: 603050 - RNA, 64 nt, Homo Sapiens; identical to SEQ ID NO: 197852

SEQ ID NO: 603051 - RNA, 64 nt, Homo Sapiens; identical to SEQ ID NO: 197853

SEQ ID NO: 603052 - RNA, 62 nt, Homo Sapiens; identical to SEQ ID NO: 197854

SEQ ID NO: 603053 - RNA, 64 nt, Homo Sapiens; identical to SEQ ID NO: 197855

SEQ ID NO: 603054 - RNA, 64 nt, Homo Sapiens; identical to SEQ ID NO: 197856

SEQ ID NO: 603055 - RNA, 64 nt, Homo Sapiens; identical to SEQ ID NO: 197857

SEQ ID NO: 603056 - RNA, 64 nt, Homo Sapiens; identical to SEQ ID NO: 197858

SEQ ID NO: 603057 - RNA, 64 nt, Homo Sapiens; identical to SEQ ID NO: 197859

SEQ ID NO: 603058 - RNA, 64 nt, Homo Sapiens; identical to SEQ ID NO: 197860

SEQ ID NO: 603059 - RNA, 64 nt, Homo Sapiens; identical to SEQ ID NO: 197861

SEQ ID NO: 603060 - RNA, 64 nt, Homo Sapiens; identical to SEQ ID NO: 197862

SEQ ID NO: 603061 - RNA, 64 nt, Homo Sapiens; identical to SEQ ID NO: 197863

SEQ ID NO: 603062 - RNA, 64 nt, Homo Sapiens; identical to SEQ ID NO: 197864

SEQ ID NO: 603063 - RNA, 64 nt, Homo Sapiens; identical to SEQ ID NO: 197865

SEQ ID NO: 603064 - RNA, 64 nt, Homo Sapiens; identical to SEQ ID NO: 197866

SEQ ID NO: 603065 - RNA, 64 nt, Homo Sapiens; identical to SEQ ID NO: 197867

SEQ ID NO: 603066 - RNA, 64 nt, Homo Sapiens; identical to SEQ ID NO: 64847

SEQ ID NO: 603067 - RNA, 64 nt, Homo Sapiens; identical to SEQ ID NO: 64848

SEQ ID NO: 603068 - RNA, 64 nt, Homo Sapiens; identical to SEQ ID NO: 197870

SEQ ID NO: 603069 - RNA, 64 nt, Homo Sapiens; identical to SEQ ID NO: 197871

SEQ ID NO: 603070 - RNA, 64 nt, Homo Sapiens; identical to SEQ ID NO: 197872

SEQ ID NO: 603071 - RNA, 64 nt, Homo Sapiens; identical to SEQ ID NO: 197873

SEQ ID NO: 603072 - RNA, 64 nt, Homo Sapiens; identical to SEQ ID NO: 197874

SEQ ID NO: 603073 - RNA, 64 nt, Homo Sapiens; identical to SEQ ID NO: 197875

SEQ ID NO: 603074 - RNA, 64 nt, Homo Sapiens; identical to SEQ ID NO: 197876

SEQ ID NO: 603075 - RNA, 64 nt, Homo Sapiens; identical to SEQ ID NO: 197877

SEQ ID NO: 603076 - RNA, 64 nt, Homo Sapiens; identical to SEQ ID NO: 197878

SEQ ID NO: 603077 - RNA, 64 nt, Homo Sapiens; identical to SEQ ID NO: 197879

SEQ ID NO: 603078 - RNA, 64 nt, Homo Sapiens; identical to SEQ ID NO: 197880

SEQ ID NO: 603079 - RNA, 64 nt, Homo Sapiens; identical to SEQ ID NO: 197881

SEQ ID NO: 603080 - RNA, 64 nt, Homo Sapiens; identical to SEQ ID NO: 197882

SEQ ID NO: 603081 - RNA, 64 nt, Homo Sapiens; identical to SEQ ID NO: 197883

SEQ ID NO: 603082 - RNA, 64 nt, Homo Sapiens; identical to SEQ ID NO: 197884

SEQ ID NO: 603083 - RNA, 64 nt, Homo Sapiens; identical to SEQ ID NO: 197885

SEQ ID NO: 603084 - RNA, 64 nt, Homo Sapiens; identical to SEQ ID NO: 64849

SEQ ID NO: 603085 - RNA, 64 nt, Homo Sapiens; identical to SEQ ID NO: 64850

SEQ ID NO: 603086 - RNA, 64 nt, Homo Sapiens; identical to SEQ ID NO: 197888

SEQ ID NO: 603087 - RNA, 64 nt, Homo Sapiens; identical to SEQ ID NO: 197889

SEQ ID NO: 603088 - RNA, 64 nt, Homo Sapiens; identical to SEQ ID NO: 197890

SEQ ID NO: 603089 - RNA, 64 nt, Homo Sapiens; identical to SEQ ID NO: 197891

SEQ ID NO: 603090 - RNA, 64 nt, Homo Sapiens; identical to SEQ ID NO: 197892

SEQ ID NO: 603091 - RNA, 64 nt, Homo Sapiens; identical to SEQ ID NO: 197893

SEQ ID NO: 603092 - RNA, 64 nt, Homo Sapiens; identical to SEQ ID NO: 197894

SEQ ID NO: 603093 - RNA, 64 nt, Homo Sapiens; identical to SEQ ID NO: 197895

SEQ ID NO: 603094 - RNA, 64 nt, Homo Sapiens; identical to SEQ ID NO: 197896

SEQ ID NO: 603095 - RNA, 64 nt, Homo Sapiens; identical to SEQ ID NO: 197897

SEQ ID NO: 603096 - RNA, 64 nt, Homo Sapiens; identical to SEQ ID NO: 197898

SEQ ID NO: 603097 - RNA, 64 nt, Homo Sapiens; identical to SEQ ID NO: 197899

SEQ ID NO: 603098 - RNA, 64 nt, Homo Sapiens; identical to SEQ ID NO: 197900

SEQ ID NO: 603099 - RNA, 64 nt, Homo Sapiens; identical to SEQ ID NO: 197901

SEQ ID NO: 603100 - RNA, 64 nt, Homo Sapiens; identical to SEQ ID NO: 197902

SEQ ID NO: 603101 - RNA, 64 nt, Homo Sapiens; identical to SEQ ID NO: 197903

SEQ ID NO: 603102 - RNA, 64 nt, Homo Sapiens; identical to SEQ ID NO: 64851

SEQ ID NO: 603103 - RNA, 64 nt, Homo Sapiens; identical to SEQ ID NO: 64852

SEQ ID NO: 603104 - RNA, 64 nt, Homo Sapiens; identical to SEQ ID NO: 197906

SEQ ID NO: 603105 - RNA, 64 nt, Homo Sapiens; identical to SEQ ID NO: 197907

SEQ ID NO: 603106 - RNA, 64 nt, Homo Sapiens; identical to SEQ ID NO: 197908

SEQ ID NO: 603107 - RNA, 64 nt, Homo Sapiens; identical to SEQ ID NO: 197909

SEQ ID NO: 603108 - RNA, 64 nt, Homo Sapiens; identical to SEQ ID NO: 197910

SEQ ID NO: 603109 - RNA, 64 nt, Homo Sapiens; identical to SEQ ID NO: 197911

SEQ ID NO: 603110 - RNA, 64 nt, Homo Sapiens; identical to SEQ ID NO: 197912

SEQ ID NO: 603111 - RNA, 64 nt, Homo Sapiens; identical to SEQ ID NO: 197913

SEQ ID NO: 603112 - RNA, 64 nt, Homo Sapiens; identical to SEQ ID NO: 197914

SEQ ID NO: 603113 - RNA, 64 nt, Homo Sapiens; identical to SEQ ID NO: 197915

SEQ ID NO: 603114 - RNA, 64 nt, Homo Sapiens; identical to SEQ ID NO: 197916

SEQ ID NO: 603115 - RNA, 64 nt, Homo Sapiens; identical to SEQ ID NO: 197917

SEQ ID NO: 603116 - RNA, 64 nt, Homo Sapiens; identical to SEQ ID NO: 197918

SEQ ID NO: 603117 - RNA, 64 nt, Homo Sapiens; identical to SEQ ID NO: 197919

SEQ ID NO: 603118 - RNA, 64 nt, Homo Sapiens; identical to SEQ ID NO: 197920

SEQ ID NO: 603119 - RNA, 64 nt, Homo Sapiens; identical to SEQ ID NO: 197921

SEQ ID NO: 603120 - RNA, 64 nt, Homo Sapiens; identical to SEQ ID NO: 197922

SEQ ID NO: 603121 - RNA, 64 nt, Homo Sapiens; identical to SEQ ID NO: 197923

SEQ ID NO: 603122 - RNA, 64 nt, Homo Sapiens; identical to SEQ ID NO: 197924

SEQ ID NO: 603123 - RNA, 50 nt, Homo Sapiens; identical to SEQ ID NO: 197925

SEQ ID NO: 603124 - RNA, 64 nt, Homo Sapiens; identical to SEQ ID NO: 197926

SEQ ID NO: 603125 - RNA, 64 nt, Homo Sapiens; identical to SEQ ID NO: 197927

SEQ ID NO: 603126 - RNA, 64 nt, Homo Sapiens; identical to SEQ ID NO: 197928

SEQ ID NO: 603127 - RNA, 64 nt, Homo Sapiens; identical to SEQ ID NO: 197929

SEQ ID NO: 603128 - RNA, 64 nt, Homo Sapiens; identical to SEQ ID NO: 197930

SEQ ID NO: 603129 - RNA, 64 nt, Homo Sapiens; identical to SEQ ID NO: 197931

SEQ ID NO: 603130 - RNA, 63 nt, Homo Sapiens; identical to SEQ ID NO: 197932

SEQ ID NO: 603131 - RNA, 64 nt, Homo Sapiens; identical to SEQ ID NO: 197933

SEQ ID NO: 603132 - RNA, 64 nt, Homo Sapiens; identical to SEQ ID NO: 197934

SEQ ID NO: 603133 - RNA, 64 nt, Homo Sapiens; identical to SEQ ID NO: 197935

SEQ ID NO: 603134 - RNA, 64 nt, Homo Sapiens; identical to SEQ ID NO: 197936

SEQ ID NO: 603135 - RNA, 64 nt, Homo Sapiens; identical to SEQ ID NO: 197937

SEQ ID NO: 603136 - RNA, 64 nt, Homo Sapiens; identical to SEQ ID NO: 197938

SEQ ID NO: 603137 - RNA, 64 nt, Homo Sapiens; identical to SEQ ID NO: 197939

SEQ ID NO: 603138 - RNA, 64 nt, Homo Sapiens; identical to SEQ ID NO: 197940

SEQ ID NO: 603139 - RNA, 64 nt, Homo Sapiens; identical to SEQ ID NO: 197941

SEQ ID NO: 603140 - RNA, 64 nt, Homo Sapiens; identical to SEQ ID NO: 197942

SEQ ID NO: 603141 - RNA, 64 nt, Homo Sapiens; identical to SEQ ID NO: 197943

SEQ ID NO: 603142 - RNA, 64 nt, Homo Sapiens; identical to SEQ ID NO: 197944

SEQ ID NO: 603143 - RNA, 64 nt, Homo Sapiens; identical to SEQ ID NO: 197945

SEQ ID NO: 603144 - RNA, 64 nt, Homo Sapiens; identical to SEQ ID NO: 197946

SEQ ID NO: 603145 - RNA, 64 nt, Homo Sapiens; identical to SEQ ID NO: 197947

SEQ ID NO: 603146 - RNA, 63 nt, Homo Sapiens; identical to SEQ ID NO: 197948

SEQ ID NO: 603147 - RNA, 64 nt, Homo Sapiens; identical to SEQ ID NO: 197949

SEQ ID NO: 603148 - RNA, 64 nt, Homo Sapiens; identical to SEQ ID NO: 64853

SEQ ID NO: 603149 - RNA, 64 nt, Homo Sapiens; identical to SEQ ID NO: 64854

SEQ ID NO: 603150 - RNA, 64 nt, Homo Sapiens; identical to SEQ ID NO: 197952

SEQ ID NO: 603151 - RNA, 64 nt, Homo Sapiens; identical to SEQ ID NO: 197953

SEQ ID NO: 603152 - RNA, 64 nt, Homo Sapiens; identical to SEQ ID NO: 197954

SEQ ID NO: 603153 - RNA, 64 nt, Homo Sapiens; identical to SEQ ID NO: 197955

SEQ ID NO: 603154 - RNA, 64 nt, Homo Sapiens; identical to SEQ ID NO: 197956

SEQ ID NO: 603155 - RNA, 64 nt, Homo Sapiens; identical to SEQ ID NO: 197957

SEQ ID NO: 603156 - RNA, 64 nt, Homo Sapiens; identical to SEQ ID NO: 197958

SEQ ID NO: 603157 - RNA, 64 nt, Homo Sapiens; identical to SEQ ID NO: 197959

SEQ ID NO: 603158 - RNA, 64 nt, Homo Sapiens; identical to SEQ ID NO: 197960

SEQ ID NO: 603159 - RNA, 64 nt, Homo Sapiens; identical to SEQ ID NO: 197961

SEQ ID NO: 603160 - RNA, 64 nt, Homo Sapiens; identical to SEQ ID NO: 197962

SEQ ID NO: 603161 - RNA, 64 nt, Homo Sapiens; identical to SEQ ID NO: 197963

SEQ ID NO: 603162 - RNA, 64 nt, Homo Sapiens; identical to SEQ ID NO: 197964

SEQ ID NO: 603163 - RNA, 64 nt, Homo Sapiens; identical to SEQ ID NO: 197965

SEQ ID NO: 603164 - RNA, 64 nt, Homo Sapiens; identical to SEQ ID NO: 197966

SEQ ID NO: 603165 - RNA, 64 nt, Homo Sapiens; identical to SEQ ID NO: 197967

SEQ ID NO: 603166 - RNA, 64 nt, Homo Sapiens; identical to SEQ ID NO: 197968

SEQ ID NO: 603167 - RNA, 64 nt, Homo Sapiens; identical to SEQ ID NO: 197969

SEQ ID NO: 603168 - RNA, 64 nt, Homo Sapiens; identical to SEQ ID NO: 197970

SEQ ID NO: 603169 - RNA, 64 nt, Homo Sapiens; identical to SEQ ID NO: 197971

SEQ ID NO: 603170 - RNA, 64 nt, Homo Sapiens; identical to SEQ ID NO: 197972

SEQ ID NO: 603171 - RNA, 64 nt, Homo Sapiens; identical to SEQ ID NO: 197973

SEQ ID NO: 603172 - RNA, 64 nt, Homo Sapiens; identical to SEQ ID NO: 197974

SEQ ID NO: 603173 - RNA, 64 nt, Homo Sapiens; identical to SEQ ID NO: 197975

SEQ ID NO: 603174 - RNA, 64 nt, Homo Sapiens; identical to SEQ ID NO: 197976

SEQ ID NO: 603175 - RNA, 64 nt, Homo Sapiens; identical to SEQ ID NO: 197977

SEQ ID NO: 603176 - RNA, 64 nt, Homo Sapiens; identical to SEQ ID NO: 197978

SEQ ID NO: 603177 - RNA, 64 nt, Homo Sapiens; identical to SEQ ID NO: 197979

SEQ ID NO: 603178 - RNA, 64 nt, Homo Sapiens; identical to SEQ ID NO: 197980

SEQ ID NO: 603179 - RNA, 64 nt, Homo Sapiens; identical to SEQ ID NO: 197981

SEQ ID NO: 603180 - RNA, 50 nt, Homo Sapiens; identical to SEQ ID NO: 197982

SEQ ID NO: 603181 - RNA, 64 nt, Homo Sapiens; identical to SEQ ID NO: 197983

SEQ ID NO: 603182 - RNA, 64 nt, Homo Sapiens; identical to SEQ ID NO: 197984

SEQ ID NO: 603183 - RNA, 64 nt, Homo Sapiens; identical to SEQ ID NO: 197985

SEQ ID NO: 603184 - RNA, 64 nt, Homo Sapiens; identical to SEQ ID NO: 197986

SEQ ID NO: 603185 - RNA, 64 nt, Homo Sapiens; identical to SEQ ID NO: 197987

SEQ ID NO: 603186 - RNA, 64 nt, Homo Sapiens; identical to SEQ ID NO: 197988

SEQ ID NO: 603187 - RNA, 64 nt, Homo Sapiens; identical to SEQ ID NO: 197989

SEQ ID NO: 603188 - RNA, 64 nt, Homo Sapiens; identical to SEQ ID NO: 197990

SEQ ID NO: 603189 - RNA, 64 nt, Homo Sapiens; identical to SEQ ID NO: 197991

SEQ ID NO: 603190 - RNA, 64 nt, Homo Sapiens; identical to SEQ ID NO: 197992

SEQ ID NO: 603191 - RNA, 64 nt, Homo Sapiens; identical to SEQ ID NO: 197993

SEQ ID NO: 603192 - RNA, 64 nt, Homo Sapiens; identical to SEQ ID NO: 197994

SEQ ID NO: 603193 - RNA, 64 nt, Homo Sapiens; identical to SEQ ID NO: 197995

SEQ ID NO: 603194 - RNA, 64 nt, Homo Sapiens; identical to SEQ ID NO: 197996

SEQ ID NO: 603195 - RNA, 64 nt, Homo Sapiens; identical to SEQ ID NO: 197997

SEQ ID NO: 603196 - RNA, 64 nt, Homo Sapiens; identical to SEQ ID NO: 197998

SEQ ID NO: 603197 - RNA, 64 nt, Homo Sapiens; identical to SEQ ID NO: 197999

SEQ ID NO: 603198 - RNA, 64 nt, Homo Sapiens; identical to SEQ ID NO: 198000

SEQ ID NO: 603199 - RNA, 64 nt, Homo Sapiens; identical to SEQ ID NO: 198001

SEQ ID NO: 603200 - RNA, 64 nt, Homo Sapiens; identical to SEQ ID NO: 198002

SEQ ID NO: 603201 - RNA, 64 nt, Homo Sapiens; identical to SEQ ID NO: 198003

SEQ ID NO: 603202 - RNA, 64 nt, Homo Sapiens; identical to SEQ ID NO: 198004

SEQ ID NO: 603203 - RNA, 64 nt, Homo Sapiens; identical to SEQ ID NO: 198005

SEQ ID NO: 603204 - RNA, 64 nt, Homo Sapiens; identical to SEQ ID NO: 198006

SEQ ID NO: 603205 - RNA, 64 nt, Homo Sapiens; identical to SEQ ID NO: 198007

SEQ ID NO: 603206 - RNA, 64 nt, Homo Sapiens; identical to SEQ ID NO: 198008

SEQ ID NO: 603207 - RNA, 64 nt, Homo Sapiens; identical to SEQ ID NO: 198009

SEQ ID NO: 603208 - RNA, 64 nt, Homo Sapiens; identical to SEQ ID NO: 198010

SEQ ID NO: 603209 - RNA, 64 nt, Homo Sapiens; identical to SEQ ID NO: 198011

SEQ ID NO: 603210 - RNA, 64 nt, Homo Sapiens; identical to SEQ ID NO: 198012

SEQ ID NO: 603211 - RNA, 64 nt, Homo Sapiens; identical to SEQ ID NO: 198013

SEQ ID NO: 603212 - RNA, 64 nt, Homo Sapiens; identical to SEQ ID NO: 198014

SEQ ID NO: 603213 - RNA, 64 nt, Homo Sapiens; identical to SEQ ID NO: 198015

SEQ ID NO: 603214 - RNA, 64 nt, Homo Sapiens; identical to SEQ ID NO: 198016

SEQ ID NO: 603215 - RNA, 64 nt, Homo Sapiens; identical to SEQ ID NO: 198017

SEQ ID NO: 603216 - RNA, 64 nt, Homo Sapiens; identical to SEQ ID NO: 198018

SEQ ID NO: 603217 - RNA, 64 nt, Homo Sapiens; identical to SEQ ID NO: 198019

SEQ ID NO: 603218 - RNA, 64 nt, Homo Sapiens; identical to SEQ ID NO: 198020

SEQ ID NO: 603219 - RNA, 64 nt, Homo Sapiens; identical to SEQ ID NO: 198021

SEQ ID NO: 603220 - RNA, 64 nt, Homo Sapiens; identical to SEQ ID NO: 198022

SEQ ID NO: 603221 - RNA, 64 nt, Homo Sapiens; identical to SEQ ID NO: 198023

SEQ ID NO: 603222 - RNA, 64 nt, Homo Sapiens; identical to SEQ ID NO: 198024

SEQ ID NO: 603223 - RNA, 64 nt, Homo Sapiens; identical to SEQ ID NO: 198025

SEQ ID NO: 603224 - RNA, 64 nt, Homo Sapiens; identical to SEQ ID NO: 198026

SEQ ID NO: 603225 - RNA, 64 nt, Homo Sapiens; identical to SEQ ID NO: 198027

SEQ ID NO: 603226 - RNA, 64 nt, Homo Sapiens; identical to SEQ ID NO: 198028

SEQ ID NO: 603227 - RNA, 64 nt, Homo Sapiens; identical to SEQ ID NO: 198029

SEQ ID NO: 603228 - RNA, 64 nt, Homo Sapiens; identical to SEQ ID NO: 64855

SEQ ID NO: 603229 - RNA, 64 nt, Homo Sapiens; identical to SEQ ID NO: 64856

SEQ ID NO: 603230 - RNA, 64 nt, Homo Sapiens; identical to SEQ ID NO: 198032

SEQ ID NO: 603231 - RNA, 64 nt, Homo Sapiens; identical to SEQ ID NO: 198033

SEQ ID NO: 603232 - RNA, 64 nt, Homo Sapiens; identical to SEQ ID NO: 198034

SEQ ID NO: 603233 - RNA, 64 nt, Homo Sapiens; identical to SEQ ID NO: 198035

SEQ ID NO: 603234 - RNA, 64 nt, Homo Sapiens; identical to SEQ ID NO: 198036

SEQ ID NO: 603235 - RNA, 64 nt, Homo Sapiens; identical to SEQ ID NO: 198037

SEQ ID NO: 603236 - RNA, 64 nt, Homo Sapiens; identical to SEQ ID NO: 198038

SEQ ID NO: 603237 - RNA, 64 nt, Homo Sapiens; identical to SEQ ID NO: 198039

SEQ ID NO: 603238 - RNA, 64 nt, Homo Sapiens; identical to SEQ ID NO: 198040

SEQ ID NO: 603239 - RNA, 64 nt, Homo Sapiens; identical to SEQ ID NO: 198041

SEQ ID NO: 603240 - RNA, 64 nt, Homo Sapiens; identical to SEQ ID NO: 198042

SEQ ID NO: 603241 - RNA, 64 nt, Homo Sapiens; identical to SEQ ID NO: 198043

SEQ ID NO: 603242 - RNA, 64 nt, Homo Sapiens; identical to SEQ ID NO: 198044

SEQ ID NO: 603243 - RNA, 64 nt, Homo Sapiens; identical to SEQ ID NO: 198045

SEQ ID NO: 603244 - RNA, 64 nt, Homo Sapiens; identical to SEQ ID NO: 198046

SEQ ID NO: 603245 - RNA, 64 nt, Homo Sapiens; identical to SEQ ID NO: 198047

SEQ ID NO: 603246 - RNA, 64 nt, Homo Sapiens; identical to SEQ ID NO: 198048

SEQ ID NO: 603247 - RNA, 64 nt, Homo Sapiens; identical to SEQ ID NO: 198049

SEQ ID NO: 603248 - RNA, 64 nt, Homo Sapiens; identical to SEQ ID NO: 198050

SEQ ID NO: 603249 - RNA, 64 nt, Homo Sapiens; identical to SEQ ID NO: 198051

SEQ ID NO: 603250 - RNA, 64 nt, Homo Sapiens; identical to SEQ ID NO: 198052

SEQ ID NO: 603251 - RNA, 64 nt, Homo Sapiens; identical to SEQ ID NO: 198046

SEQ ID NO: 603252 - RNA, 64 nt, Homo Sapiens; identical to SEQ ID NO: 198054

SEQ ID NO: 603253 - RNA, 65 nt, Homo Sapiens; identical to SEQ ID NO: 198055

SEQ ID NO: 603254 - RNA, 65 nt, Homo Sapiens; identical to SEQ ID NO: 198056

SEQ ID NO: 603255 - RNA, 65 nt, Homo Sapiens; identical to SEQ ID NO: 198057

SEQ ID NO: 603256 - RNA, 65 nt, Homo Sapiens; identical to SEQ ID NO: 198058

SEQ ID NO: 603257 - RNA, 65 nt, Homo Sapiens; identical to SEQ ID NO: 198059

SEQ ID NO: 603258 - RNA, 65 nt, Homo Sapiens; identical to SEQ ID NO: 198060

SEQ ID NO: 603259 - RNA, 50 nt, Homo Sapiens; identical to SEQ ID NO: 198061

SEQ ID NO: 603260 - RNA, 65 nt, Homo Sapiens; identical to SEQ ID NO: 198062

SEQ ID NO: 603261 - RNA, 65 nt, Homo Sapiens; identical to SEQ ID NO: 198063

SEQ ID NO: 603262 - RNA, 65 nt, Homo Sapiens; identical to SEQ ID NO: 198064

SEQ ID NO: 603263 - RNA, 65 nt, Homo Sapiens; identical to SEQ ID NO: 198065

SEQ ID NO: 603264 - RNA, 65 nt, Homo Sapiens; identical to SEQ ID NO: 198066

SEQ ID NO: 603265 - RNA, 65 nt, Homo Sapiens; identical to SEQ ID NO: 198067

SEQ ID NO: 603266 - RNA, 65 nt, Homo Sapiens; identical to SEQ ID NO: 198068

SEQ ID NO: 603267 - RNA, 65 nt, Homo Sapiens; identical to SEQ ID NO: 198069

SEQ ID NO: 603268 - RNA, 65 nt, Homo Sapiens; identical to SEQ ID NO: 198070

SEQ ID NO: 603269 - RNA, 65 nt, Homo Sapiens; identical to SEQ ID NO: 198071

SEQ ID NO: 603270 - RNA, 65 nt, Homo Sapiens; identical to SEQ ID NO: 198072

SEQ ID NO: 603271 - RNA, 65 nt, Homo Sapiens; identical to SEQ ID NO: 198073

SEQ ID NO: 603272 - RNA, 65 nt, Homo Sapiens; identical to SEQ ID NO: 198074

SEQ ID NO: 603273 - RNA, 65 nt, Homo Sapiens; identical to SEQ ID NO: 198075

SEQ ID NO: 603274 - RNA, 65 nt, Homo Sapiens; identical to SEQ ID NO: 198076

SEQ ID NO: 603275 - RNA, 65 nt, Homo Sapiens; identical to SEQ ID NO: 198077

SEQ ID NO: 603276 - RNA, 65 nt, Homo Sapiens; identical to SEQ ID NO: 198078

SEQ ID NO: 603277 - RNA, 65 nt, Homo Sapiens; identical to SEQ ID NO: 198079

SEQ ID NO: 603278 - RNA, 65 nt, Homo Sapiens; identical to SEQ ID NO: 198080

SEQ ID NO: 603279 - RNA, 65 nt, Homo Sapiens; identical to SEQ ID NO: 198081

SEQ ID NO: 603280 - RNA, 65 nt, Homo Sapiens; identical to SEQ ID NO: 198082

SEQ ID NO: 603281 - RNA, 65 nt, Homo Sapiens; identical to SEQ ID NO: 198083

SEQ ID NO: 603282 - RNA, 65 nt, Homo Sapiens; identical to SEQ ID NO: 198084

SEQ ID NO: 603283 - RNA, 65 nt, Homo Sapiens; identical to SEQ ID NO: 198085

SEQ ID NO: 603284 - RNA, 65 nt, Homo Sapiens; identical to SEQ ID NO: 198086

SEQ ID NO: 603285 - RNA, 65 nt, Homo Sapiens; identical to SEQ ID NO: 198087

SEQ ID NO: 603286 - RNA, 65 nt, Homo Sapiens; identical to SEQ ID NO: 198088

SEQ ID NO: 603287 - RNA, 65 nt, Homo Sapiens; identical to SEQ ID NO: 198089

SEQ ID NO: 603288 - RNA, 65 nt, Homo Sapiens; identical to SEQ ID NO: 198090

SEQ ID NO: 603289 - RNA, 65 nt, Homo Sapiens; identical to SEQ ID NO: 198091

SEQ ID NO: 603290 - RNA, 65 nt, Homo Sapiens; identical to SEQ ID NO: 198092

SEQ ID NO: 603291 - RNA, 65 nt, Homo Sapiens; identical to SEQ ID NO: 198093

SEQ ID NO: 603292 - RNA, 65 nt, Homo Sapiens; identical to SEQ ID NO: 198094

SEQ ID NO: 603293 - RNA, 65 nt, Homo Sapiens; identical to SEQ ID NO: 198095

SEQ ID NO: 603294 - RNA, 65 nt, Homo Sapiens; identical to SEQ ID NO: 198096

SEQ ID NO: 603295 - RNA, 65 nt, Homo Sapiens; identical to SEQ ID NO: 198097

SEQ ID NO: 603296 - RNA, 65 nt, Homo Sapiens; identical to SEQ ID NO: 198098

SEQ ID NO: 603297 - RNA, 65 nt, Homo Sapiens; identical to SEQ ID NO: 198099

SEQ ID NO: 603298 - RNA, 65 nt, Homo Sapiens; identical to SEQ ID NO: 198100

SEQ ID NO: 603299 - RNA, 65 nt, Homo Sapiens; identical to SEQ ID NO: 198101

SEQ ID NO: 603300 - RNA, 65 nt, Homo Sapiens; identical to SEQ ID NO: 198102

SEQ ID NO: 603301 - RNA, 65 nt, Homo Sapiens; identical to SEQ ID NO: 198103

SEQ ID NO: 603302 - RNA, 65 nt, Homo Sapiens; identical to SEQ ID NO: 198104

SEQ ID NO: 603303 - RNA, 65 nt, Homo Sapiens; identical to SEQ ID NO: 198105

SEQ ID NO: 603304 - RNA, 65 nt, Homo Sapiens; identical to SEQ ID NO: 198106

SEQ ID NO: 603305 - RNA, 65 nt, Homo Sapiens; identical to SEQ ID NO: 198107

SEQ ID NO: 603306 - RNA, 65 nt, Homo Sapiens; identical to SEQ ID NO: 198108

SEQ ID NO: 603307 - RNA, 65 nt, Homo Sapiens; identical to SEQ ID NO: 198109

SEQ ID NO: 603308 - RNA, 65 nt, Homo Sapiens; identical to SEQ ID NO: 198110

SEQ ID NO: 603309 - RNA, 65 nt, Homo Sapiens; identical to SEQ ID NO: 198111

SEQ ID NO: 603310 - RNA, 65 nt, Homo Sapiens; identical to SEQ ID NO: 198112

SEQ ID NO: 603311 - RNA, 65 nt, Homo Sapiens; identical to SEQ ID NO: 198113

SEQ ID NO: 603312 - RNA, 65 nt, Homo Sapiens; identical to SEQ ID NO: 198114

SEQ ID NO: 603313 - RNA, 64 nt, Homo Sapiens; identical to SEQ ID NO: 198115

SEQ ID NO: 603314 - RNA, 65 nt, Homo Sapiens; identical to SEQ ID NO: 198116

SEQ ID NO: 603315 - RNA, 65 nt, Homo Sapiens; identical to SEQ ID NO: 198117

SEQ ID NO: 603316 - RNA, 65 nt, Homo Sapiens; identical to SEQ ID NO: 198118

SEQ ID NO: 603317 - RNA, 65 nt, Homo Sapiens; identical to SEQ ID NO: 198119

SEQ ID NO: 603318 - RNA, 65 nt, Homo Sapiens; identical to SEQ ID NO: 198120

SEQ ID NO: 603319 - RNA, 65 nt, Homo Sapiens; identical to SEQ ID NO: 198121

SEQ ID NO: 603320 - RNA, 65 nt, Homo Sapiens; identical to SEQ ID NO: 198122

SEQ ID NO: 603321 - RNA, 65 nt, Homo Sapiens; identical to SEQ ID NO: 198123

SEQ ID NO: 603322 - RNA, 65 nt, Homo Sapiens; identical to SEQ ID NO: 198124

SEQ ID NO: 603323 - RNA, 65 nt, Homo Sapiens; identical to SEQ ID NO: 198125

SEQ ID NO: 603324 - RNA, 65 nt, Homo Sapiens; identical to SEQ ID NO: 198126

SEQ ID NO: 603325 - RNA, 65 nt, Homo Sapiens; identical to SEQ ID NO: 198127

SEQ ID NO: 603326 - RNA, 65 nt, Homo Sapiens; identical to SEQ ID NO: 198128

SEQ ID NO: 603327 - RNA, 65 nt, Homo Sapiens; identical to SEQ ID NO: 198129

SEQ ID NO: 603328 - RNA, 65 nt, Homo Sapiens; identical to SEQ ID NO: 198130

SEQ ID NO: 603329 - RNA, 65 nt, Homo Sapiens; identical to SEQ ID NO: 198131

SEQ ID NO: 603330 - RNA, 65 nt, Homo Sapiens; identical to SEQ ID NO: 198132

SEQ ID NO: 603331 - RNA, 65 nt, Homo Sapiens; identical to SEQ ID NO: 198133

SEQ ID NO: 603332 - RNA, 65 nt, Homo Sapiens; identical to SEQ ID NO: 198134

SEQ ID NO: 603333 - RNA, 65 nt, Homo Sapiens; identical to SEQ ID NO: 198135

SEQ ID NO: 603334 - RNA, 65 nt, Homo Sapiens; identical to SEQ ID NO: 198136

SEQ ID NO: 603335 - RNA, 65 nt, Homo Sapiens; identical to SEQ ID NO: 198137

SEQ ID NO: 603336 - RNA, 65 nt, Homo Sapiens; identical to SEQ ID NO: 198138

SEQ ID NO: 603337 - RNA, 65 nt, Homo Sapiens; identical to SEQ ID NO: 198139

SEQ ID NO: 603338 - RNA, 65 nt, Homo Sapiens; identical to SEQ ID NO: 198140

SEQ ID NO: 603339 - RNA, 65 nt, Homo Sapiens; identical to SEQ ID NO: 198141

SEQ ID NO: 603340 - RNA, 65 nt, Homo Sapiens; identical to SEQ ID NO: 198142

SEQ ID NO: 603341 - RNA, 65 nt, Homo Sapiens; identical to SEQ ID NO: 198143

SEQ ID NO: 603342 - RNA, 65 nt, Homo Sapiens; identical to SEQ ID NO: 198144

SEQ ID NO: 603343 - RNA, 65 nt, Homo Sapiens; identical to SEQ ID NO: 198145

SEQ ID NO: 603344 - RNA, 65 nt, Homo Sapiens; identical to SEQ ID NO: 198146

SEQ ID NO: 603345 - RNA, 65 nt, Homo Sapiens; identical to SEQ ID NO: 198147

SEQ ID NO: 603346 - RNA, 65 nt, Homo Sapiens; identical to SEQ ID NO: 198148

SEQ ID NO: 603347 - RNA, 65 nt, Homo Sapiens; identical to SEQ ID NO: 198149

SEQ ID NO: 603348 - RNA, 65 nt, Homo Sapiens; identical to SEQ ID NO: 198150

SEQ ID NO: 603349 - RNA, 65 nt, Homo Sapiens; identical to SEQ ID NO: 198151

SEQ ID NO: 603350 - RNA, 65 nt, Homo Sapiens; identical to SEQ ID NO: 198152

SEQ ID NO: 603351 - RNA, 65 nt, Homo Sapiens; identical to SEQ ID NO: 198153

SEQ ID NO: 603352 - RNA, 65 nt, Homo Sapiens; identical to SEQ ID NO: 198154

SEQ ID NO: 603353 - RNA, 65 nt, Homo Sapiens; identical to SEQ ID NO: 198155

SEQ ID NO: 603354 - RNA, 65 nt, Homo Sapiens; identical to SEQ ID NO: 198156

SEQ ID NO: 603355 - RNA, 65 nt, Homo Sapiens; identical to SEQ ID NO: 198157

SEQ ID NO: 603356 - RNA, 65 nt, Homo Sapiens; identical to SEQ ID NO: 198158

SEQ ID NO: 603357 - RNA, 65 nt, Homo Sapiens; identical to SEQ ID NO: 198159

SEQ ID NO: 603358 - RNA, 65 nt, Homo Sapiens; identical to SEQ ID NO: 198160

SEQ ID NO: 603359 - RNA, 65 nt, Homo Sapiens; identical to SEQ ID NO: 198161

SEQ ID NO: 603360 - RNA, 65 nt, Homo Sapiens; identical to SEQ ID NO: 198162

SEQ ID NO: 603361 - RNA, 65 nt, Homo Sapiens; identical to SEQ ID NO: 198163

SEQ ID NO: 603362 - RNA, 65 nt, Homo Sapiens; identical to SEQ ID NO: 198164

SEQ ID NO: 603363 - RNA, 65 nt, Homo Sapiens; identical to SEQ ID NO: 198165

SEQ ID NO: 603364 - RNA, 65 nt, Homo Sapiens; identical to SEQ ID NO: 198166

SEQ ID NO: 603365 - RNA, 65 nt, Homo Sapiens; identical to SEQ ID NO: 198167

SEQ ID NO: 603366 - RNA, 65 nt, Homo Sapiens; identical to SEQ ID NO: 198168

SEQ ID NO: 603367 - RNA, 65 nt, Homo Sapiens; identical to SEQ ID NO: 198169

SEQ ID NO: 603368 - RNA, 65 nt, Homo Sapiens; identical to SEQ ID NO: 198170

SEQ ID NO: 603369 - RNA, 65 nt, Homo Sapiens; identical to SEQ ID NO: 198171

SEQ ID NO: 603370 - RNA, 65 nt, Homo Sapiens; identical to SEQ ID NO: 198172

SEQ ID NO: 603371 - RNA, 65 nt, Homo Sapiens; identical to SEQ ID NO: 198173

SEQ ID NO: 603372 - RNA, 65 nt, Homo Sapiens; identical to SEQ ID NO: 198174

SEQ ID NO: 603373 - RNA, 65 nt, Homo Sapiens; identical to SEQ ID NO: 198175

SEQ ID NO: 603374 - RNA, 65 nt, Homo Sapiens; identical to SEQ ID NO: 198176

SEQ ID NO: 603375 - RNA, 65 nt, Homo Sapiens; identical to SEQ ID NO: 198177

SEQ ID NO: 603376 - RNA, 65 nt, Homo Sapiens; identical to SEQ ID NO: 198178

SEQ ID NO: 603377 - RNA, 65 nt, Homo Sapiens; identical to SEQ ID NO: 198179

SEQ ID NO: 603378 - RNA, 65 nt, Homo Sapiens; identical to SEQ ID NO: 198180

SEQ ID NO: 603379 - RNA, 65 nt, Homo Sapiens; identical to SEQ ID NO: 198181

SEQ ID NO: 603380 - RNA, 65 nt, Homo Sapiens; identical to SEQ ID NO: 198182

SEQ ID NO: 603381 - RNA, 65 nt, Homo Sapiens; identical to SEQ ID NO: 198183

SEQ ID NO: 603382 - RNA, 65 nt, Homo Sapiens; identical to SEQ ID NO: 198184

SEQ ID NO: 603383 - RNA, 65 nt, Homo Sapiens; identical to SEQ ID NO: 198185

SEQ ID NO: 603384 - RNA, 65 nt, Homo Sapiens; identical to SEQ ID NO: 198186

SEQ ID NO: 603385 - RNA, 65 nt, Homo Sapiens; identical to SEQ ID NO: 198187

SEQ ID NO: 603386 - RNA, 65 nt, Homo Sapiens; identical to SEQ ID NO: 198188

SEQ ID NO: 603387 - RNA, 65 nt, Homo Sapiens; identical to SEQ ID NO: 198189

SEQ ID NO: 603388 - RNA, 65 nt, Homo Sapiens; identical to SEQ ID NO: 198190

SEQ ID NO: 603389 - RNA, 65 nt, Homo Sapiens; identical to SEQ ID NO: 198191

SEQ ID NO: 603390 - RNA, 65 nt, Homo Sapiens; identical to SEQ ID NO: 198192

SEQ ID NO: 603391 - RNA, 65 nt, Homo Sapiens; identical to SEQ ID NO: 198193

SEQ ID NO: 603392 - RNA, 65 nt, Homo Sapiens; identical to SEQ ID NO: 198194

SEQ ID NO: 603393 - RNA, 65 nt, Homo Sapiens; identical to SEQ ID NO: 198195

SEQ ID NO: 603394 - RNA, 65 nt, Homo Sapiens; identical to SEQ ID NO: 198196

SEQ ID NO: 603395 - RNA, 65 nt, Homo Sapiens; identical to SEQ ID NO: 198197

SEQ ID NO: 603396 - RNA, 65 nt, Homo Sapiens; identical to SEQ ID NO: 198198

SEQ ID NO: 603397 - RNA, 65 nt, Homo Sapiens; identical to SEQ ID NO: 198199

SEQ ID NO: 603398 - RNA, 65 nt, Homo Sapiens; identical to SEQ ID NO: 198200

SEQ ID NO: 603399 - RNA, 65 nt, Homo Sapiens; identical to SEQ ID NO: 198201

SEQ ID NO: 603400 - RNA, 65 nt, Homo Sapiens; identical to SEQ ID NO: 198202

SEQ ID NO: 603401 - RNA, 65 nt, Homo Sapiens; identical to SEQ ID NO: 198203

SEQ ID NO: 603402 - RNA, 65 nt, Homo Sapiens; identical to SEQ ID NO: 198204

SEQ ID NO: 603403 - RNA, 65 nt, Homo Sapiens; identical to SEQ ID NO: 198205

SEQ ID NO: 603404 - RNA, 65 nt, Homo Sapiens; identical to SEQ ID NO: 198206

SEQ ID NO: 603405 - RNA, 65 nt, Homo Sapiens; identical to SEQ ID NO: 198207

SEQ ID NO: 603406 - RNA, 65 nt, Homo Sapiens; identical to SEQ ID NO: 198208

SEQ ID NO: 603407 - RNA, 65 nt, Homo Sapiens; identical to SEQ ID NO: 198209

SEQ ID NO: 603408 - RNA, 65 nt, Homo Sapiens; identical to SEQ ID NO: 198210

SEQ ID NO: 603409 - RNA, 65 nt, Homo Sapiens; identical to SEQ ID NO: 198211

SEQ ID NO: 603410 - RNA, 65 nt, Homo Sapiens; identical to SEQ ID NO: 198212

SEQ ID NO: 603411 - RNA, 65 nt, Homo Sapiens; identical to SEQ ID NO: 198213

SEQ ID NO: 603412 - RNA, 64 nt, Homo Sapiens
uaaaguuuuugccacuguaaauaaaaacaguauccguagcuaucaggaucauugcgcacucaua

SEQ ID NO: 603413 - RNA, 64 nt, Homo Sapiens
caggugugagcuggcaaauccgagaccuguuuugcguagcuaauuaccagcaaugacaaacucc

SEQ ID NO: 603414 - RNA, 64 nt, Homo Sapiens
ccacuugcggaaccugacucaggcugcuggcaagcguagcuauguguuggcccuggggcggccc

SEQ ID NO: 603415 - RNA, 64 nt, Homo Sapiens
cucccugcccucugaggagcacgugagcggccuccguagcuaacuugguucacuggacauuucc

SEQ ID NO: 603416 - RNA, 64 nt, Homo Sapiens
cggacagagcacguuugcagaccuguccaauaggcguagcuaucgcuuccauuuaauggggugc

SEQ ID NO: 603417 - RNA, 64 nt, Homo Sapiens
aagcauuugaguuugcaaaccagaacuggaacuacguagcuagucagagcccacauuuccacac

SEQ ID NO: 603418 - RNA, 64 nt, Homo Sapiens
aauauauauaggguggucccuuuuugcuuacagccguagcuauguuuugccuuuuuaccuggaa

SEQ ID NO: 603419 - RNA, 64 nt, Homo Sapiens
guacacacacaucaaucacuuaagcugauaaaaacguagcuacccuauuuaauggaaguuagug

SEQ ID NO: 603420 - RNA, 64 nt, Homo Sapiens
uucuuuuugguuugccuuuuauguaaauuuuuuacguagcuauuuuuauacacuguaagcuuug

SEQ ID NO: 603421 - RNA, 64 nt, Homo Sapiens
ugaaaaggucauagcugagaggacugacauuuagcguagcuaaguuaaucuccucuuuuaucuu

SEQ ID NO: 603422 - RNA, 64 nt, Homo Sapiens
auaauuauuuucccccuugcucucuauauuaauacguagcuauaaagcaacaguugguuuucuu

SEQ ID NO: 603423 - RNA, 64 nt, Homo Sapiens
cucucacucuuccuucagguuacuaacaaaauuucguagcuaaagaaugccauggccgggugca

SEQ ID NO: 603424 - RNA, 64 nt, Homo Sapiens
uuguauugucuugucaauuguguagcuagcagaucguagcuagugcuauguuaauguccuaaug

SEQ ID NO: 603425 - RNA, 64 nt, Homo Sapiens
cuguucuuuguuucauaauuggauucaucaaucccguagcuacccauauugcacugagcuugcc

SEQ ID NO: 603426 - RNA, 64 nt, Homo Sapiens
aaauuagcugcguguaguagcauaugccuuucaacguagcuacucaggaggcugaggugggagg

SEQ ID NO: 603427 - RNA, 64 nt, Homo Sapiens
ugggaggcugaggcaggggacgcaaaccuguagucguagcuacuaaauuagcuggguguggugg

SEQ ID NO: 603428 - RNA, 64 nt, Homo Sapiens
uaagugauacauaccucuagcacggugugaguuucguagcuauuaugugugucagaagggagau

SEQ ID NO: 603429 - RNA, 64 nt, Homo Sapiens
cauuccuaaaaugcuucacuguacguaguuaagucguagcuauaacuucaaauuuuuuaaaaga

SEQ ID NO: 603430 - RNA, 64 nt, Homo Sapiens
guuccccacuccguacuguauuuugccauucugccguagcuagauguucugugggguuuguuaa

SEQ ID NO: 603431 - RNA, 64 nt, Homo Sapiens
gcauuuucauguuuugaaucugauuaguggaucacguagcuacuuucccugucgcguccaauuc

SEQ ID NO: 603432 - RNA, 64 nt, Homo Sapiens
aauuguaugaaggccuuaaaaaagcuacauuaagcguagcuaaaauuauuuauuggacuaaaaa

SEQ ID NO: 603433 - RNA, 64 nt, Homo Sapiens
ggcuucuauuugggauucacaucaguauuaguaucguagcuacaccaaguucaggcuucucuuu

SEQ ID NO: 603434 - RNA, 64 nt, Homo Sapiens
acaaaaaacaacacuuugguguggugguaugguacguagcuauuuuccuaagcaugucugucaa

SEQ ID NO: 603435 - RNA, 64 nt, Homo Sapiens
uuauuuccaucacuacguguacgauggcauugagcguagcuagcauuguauccacucaccauug

SEQ ID NO: 603436 - RNA, 64 nt, Homo Sapiens
uuuuaaggggucuucaaguaaguaaaacauacaucguagcuagaagaaaaauguaccuuaaauu

SEQ ID NO: 603437 - RNA, 64 nt, Homo Sapiens
ucacuagaaggcugaguuugacauguugauauuacguagcuauaguuugcaguuucugggaagc

SEQ ID NO: 603438 - RNA, 64 nt, Homo Sapiens
gagauagguauuuuuuguaggcuguuucacugaacucaguuaaugaaaacuguauuaacauaau

SEQ ID NO: 603439 - RNA, 64 nt, Homo Sapiens
cauuccauaggaaaacacacauaugcacacaaaacucaguuaucuguggggaaagugguaguaa

SEQ ID NO: 603440 - RNA, 64 nt, Homo Sapiens
aaauugguaaacuagaaguaacuuguccacaacccucaguuaugauacuuaugugcguguuuuu

SEQ ID NO: 603441 - RNA, 64 nt, Homo Sapiens
ugcagucuaaugucaagagggcugccccccaccccucaguuaauacguacuugcaguuuaugaa

SEQ ID NO: 603442 - RNA, 58 nt, Homo Sapiens
caauuaccuuuucccggauugggaggaccucaguuaacucgagggaccgagcugcuga

SEQ ID NO: 603443 - RNA, 64 nt, Homo Sapiens; identical to SEQ ID NO: 572336

SEQ ID NO: 603444 - RNA, 64 nt, Homo Sapiens; identical to SEQ ID NO: 572337

SEQ ID NO: 603445 - RNA, 64 nt, Homo Sapiens; identical to SEQ ID NO: 76900

SEQ ID NO: 603446 - RNA, 64 nt, Homo Sapiens; identical to SEQ ID NO: 76901

SEQ ID NO: 603447 - RNA, 64 nt, Homo Sapiens; identical to SEQ ID NO: 76902

SEQ ID NO: 603448 - RNA, 64 nt, Homo Sapiens; identical to SEQ ID NO: 76903

SEQ ID NO: 603449 - RNA, 64 nt, Homo Sapiens; identical to SEQ ID NO: 76904

SEQ ID NO: 603450 - RNA, 64 nt, Homo Sapiens; identical to SEQ ID NO: 76905

SEQ ID NO: 603451 - RNA, 64 nt, Homo Sapiens; identical to SEQ ID NO: 76906

SEQ ID NO: 603452 - RNA, 64 nt, Homo Sapiens; identical to SEQ ID NO: 76907

SEQ ID NO: 603453 - RNA, 64 nt, Homo Sapiens; identical to SEQ ID NO: 570140

SEQ ID NO: 603454 - RNA, 64 nt, Homo Sapiens; identical to SEQ ID NO: 570141

SEQ ID NO: 603455 - RNA, 64 nt, Homo Sapiens; identical to SEQ ID NO: 570142

SEQ ID NO: 603456 - RNA, 64 nt, Homo Sapiens; identical to SEQ ID NO: 570143

SEQ ID NO: 603457 - RNA, 64 nt, Homo Sapiens; identical to SEQ ID NO: 570144

SEQ ID NO: 603458 - RNA, 64 nt, Homo Sapiens; identical to SEQ ID NO: 570145

SEQ ID NO: 603459 - RNA, 64 nt, Homo Sapiens; identical to SEQ ID NO: 570146

SEQ ID NO: 603460 - RNA, 64 nt, Homo Sapiens; identical to SEQ ID NO: 570147

SEQ ID NO: 603461 - RNA, 64 nt, Homo Sapiens; identical to SEQ ID NO: 570148

SEQ ID NO: 603462 - RNA, 64 nt, Homo Sapiens; identical to SEQ ID NO: 570149

SEQ ID NO: 603463 - RNA, 64 nt, Homo Sapiens; identical to SEQ ID NO: 570150

SEQ ID NO: 603464 - RNA, 64 nt, Homo Sapiens; identical to SEQ ID NO: 570151

SEQ ID NO: 603465 - RNA, 64 nt, Homo Sapiens
gcaaaaacaaagcaaacugcagugcuugugagaucacugacacuuaggacuguguggccaacca

SEQ ID NO: 603466 - RNA, 64 nt, Homo Sapiens
gcggcaggaacugaagcugccgggaaucaaucugcacugacaccgaguucguucaguaacgcag

SEQ ID NO: 603467 - RNA, 64 nt, Homo Sapiens
cagggaaaccuaaacugaggucagcacuugggcccacugacagugacugacugggggagaaggu

SEQ ID NO: 603468 - RNA, 64 nt, Homo Sapiens
uuauagauagggaaacugaggcuuugggaggacucacugacauaccuaccuucaagaugaguuc

SEQ ID NO: 603469 - RNA, 64 nt, Homo Sapiens
ccuuccucagcacagggaacccggaagcccguugcacugacagaggcucacacccucuggguuu

SEQ ID NO: 603470 - RNA, 64 nt, Homo Sapiens
cugaaacacugaaucuccuuuuguaacugguguucacugacaccuugauggcucuugauggcuc

SEQ ID NO: 603471 - RNA, 64 nt, Homo Sapiens
auaacaggaugugauugccugcuuuugccucucacacugacaacuaggaacuuaguacuuugga

SEQ ID NO: 603472 - RNA, 64 nt, Homo Sapiens
guuggcuggaauuucuuucuaugcugacuacagccacugacaugaggagucaguuuugucuuaa

SEQ ID NO: 603473 - RNA, 64 nt, Homo Sapiens
aucagcagcuugacgcguggucacaggacgauuucacugacacugcgaacucucaggacuaccg

SEQ ID NO: 603474 - RNA, 64 nt, Homo Sapiens
auguagauugccuuuggcaauucuucuucucaagcacugacacucauuaccgucugugauugcc

SEQ ID NO: 603475 - RNA, 64 nt, Homo Sapiens
cuaugggucagccaggcuuguccacuccccaugccacugacaucgccaucugccgccaaauaca

SEQ ID NO: 603476 - RNA, 64 nt, Homo Sapiens
aaacgcaaaaacaggaaucaggauaacuuuagagcacugacauacuauuccugcaccuaggcua

SEQ ID NO: 603477 - RNA, 64 nt, Homo Sapiens; identical to SEQ ID NO: 438442

SEQ ID NO: 603478 - RNA, 64 nt, Homo Sapiens; identical to SEQ ID NO: 438443

SEQ ID NO: 603479 - RNA, 64 nt, Homo Sapiens; identical to SEQ ID NO: 438444

SEQ ID NO: 603480 - RNA, 64 nt, Homo Sapiens; identical to SEQ ID NO: 438445

SEQ ID NO: 603481 - RNA, 64 nt, Homo Sapiens; identical to SEQ ID NO: 438446

SEQ ID NO: 603482 - RNA, 64 nt, Homo Sapiens; identical to SEQ ID NO: 438447

SEQ ID NO: 603483 - RNA, 64 nt, Homo Sapiens; identical to SEQ ID NO: 438448

SEQ ID NO: 603484 - RNA, 64 nt, Homo Sapiens; identical to SEQ ID NO: 438449

SEQ ID NO: 603485 - RNA, 64 nt, Homo Sapiens; identical to SEQ ID NO: 302252

SEQ ID NO: 603486 - RNA, 64 nt, Homo Sapiens; identical to SEQ ID NO: 302253

SEQ ID NO: 603487 - RNA, 64 nt, Homo Sapiens; identical to SEQ ID NO: 302254

SEQ ID NO: 603488 - RNA, 64 nt, Homo Sapiens; identical to SEQ ID NO: 302255

SEQ ID NO: 603489 - RNA, 64 nt, Homo Sapiens; identical to SEQ ID NO: 302256

SEQ ID NO: 603490 - RNA, 64 nt, Homo Sapiens; identical to SEQ ID NO: 302257

SEQ ID NO: 603491 - RNA, 64 nt, Homo Sapiens; identical to SEQ ID NO: 302258

SEQ ID NO: 603492 - RNA, 64 nt, Homo Sapiens; identical to SEQ ID NO: 302259

SEQ ID NO: 603493 - RNA, 64 nt, Homo Sapiens; identical to SEQ ID NO: 302260

SEQ ID NO: 603494 - RNA, 64 nt, Homo Sapiens; identical to SEQ ID NO: 302261

SEQ ID NO: 603495 - RNA, 64 nt, Homo Sapiens; identical to SEQ ID NO: 302262

SEQ ID NO: 603496 - RNA, 64 nt, Homo Sapiens; identical to SEQ ID NO: 302263

SEQ ID NO: 603497 - RNA, 64 nt, Homo Sapiens; identical to SEQ ID NO: 302264

SEQ ID NO: 603498 - RNA, 64 nt, Homo Sapiens; identical to SEQ ID NO: 302265

SEQ ID NO: 603499 - RNA, 64 nt, Homo Sapiens; identical to SEQ ID NO: 302266

SEQ ID NO: 603500 - RNA, 64 nt, Homo Sapiens; identical to SEQ ID NO: 302267

SEQ ID NO: 603501 - RNA, 64 nt, Homo Sapiens; identical to SEQ ID NO: 302268

SEQ ID NO: 603502 - RNA, 64 nt, Homo Sapiens; identical to SEQ ID NO: 302269

SEQ ID NO: 603503 - RNA, 64 nt, Homo Sapiens; identical to SEQ ID NO: 302270

SEQ ID NO: 603504 - RNA, 64 nt, Homo Sapiens; identical to SEQ ID NO: 302271

SEQ ID NO: 603505 - RNA, 64 nt, Homo Sapiens; identical to SEQ ID NO: 302272

SEQ ID NO: 603506 - RNA, 64 nt, Homo Sapiens; identical to SEQ ID NO: 302273

SEQ ID NO: 603507 - RNA, 64 nt, Homo Sapiens
agaugauuguuugcuagauuuuccuuugugaaguacuauguaacuuuauaagucuuagcauuau

SEQ ID NO: 603508 - RNA, 64 nt, Homo Sapiens
ucugaaauauuuuguacuuccuuucuuguuuaucacuauguaaaguaaguccuccugauaagug

SEQ ID NO: 603509 - RNA, 64 nt, Homo Sapiens
ucuuuggaguugcauagcagauucacuauacguaacuauguaaccccaccuauuuguguugucc

SEQ ID NO: 603510 - RNA, 64 nt, Homo Sapiens
cacaccauacauacauacauggguaauuuuuaagacuauguaccugaugucaaaucacauuacu

SEQ ID NO: 603511 - RNA, 64 nt, Homo Sapiens
uguaggaaagaugggaggaaaacagguuaagaaaacuauguaaaaaaaaaaauaggugacaggg

SEQ ID NO: 603512 - RNA, 64 nt, Homo Sapiens
caagagcacauccauaaaaugaaaaccuguuacaacuauguacagaaggguuugacguuuuauu

SEQ ID NO: 603513 - RNA, 64 nt, Homo Sapiens
uaagcaucgauagguaaguugauggauaaaaguuacuauguaagccuauuuuuuugaguccuua

SEQ ID NO: 603514 - RNA, 64 nt, Homo Sapiens
auaaauagcaucuuaugcuaauuagcccugcuaaacuauguacagaggaaacuguucaaguauu

SEQ ID NO: 603515 - RNA, 64 nt, Homo Sapiens
uguauuaugaaaagcuaaauuauacaucauuguaacuauguagaaaguguagacuaauguauaa

SEQ ID NO: 603516 - RNA, 64 nt, Homo Sapiens
uauacguuaagaccucuauguuuauaggauauuuacuauguauuacgaugagauugccuaccau

SEQ ID NO: 603517 - RNA, 64 nt, Homo Sapiens
aaagucuacaaucuaauuaaaagcuauuuuguuuacuauguauauacuaugccgcauucauuua

SEQ ID NO: 603518 - RNA, 64 nt, Homo Sapiens
aagcccugaaaauaugguaagucauuuugugaauacuauguaucaaucucuccagcuaauucag

SEQ ID NO: 603519 - RNA, 64 nt, Homo Sapiens
uuuuuuuccaaugcuucuuaauucacuguuuguuacuauguauguuaugcgaaccuaugucuaa

SEQ ID NO: 603520 - RNA, 64 nt, Homo Sapiens
aauuguugauuuuuaauuauaucaauguuauauaacuauguaauacauccacauaucuaacagu

SEQ ID NO: 603521 - RNA, 64 nt, Homo Sapiens
agauguuuuaaacuuuuuaucuauuuaacugugaacuauguagcuagaaagacugaaaccaaga

SEQ ID NO: 603522 - RNA, 64 nt, Homo Sapiens
ccugggaagauuugaaaucuaaacuaauuuauaaacuauguacuuauauauuuuuuuccauuua

SEQ ID NO: 603523 - RNA, 64 nt, Homo Sapiens
uccugaaggggaagaacuaauuuaaucacuguauacuauguaauuuucuuuauuuucuucagca

SEQ ID NO: 603524 - RNA, 64 nt, Homo Sapiens
aaugaaugacagugagaugcaaccaaaauuauagacuauguagaaauaaaauguuuaaaaucaa

SEQ ID NO: 603525 - RNA, 64 nt, Homo Sapiens
uaguuguuauacuguauuuuaucacaauguaaauacuauguaaaucuuuagaucacuuauaccu

SEQ ID NO: 603526 - RNA, 64 nt, Homo Sapiens
ggaucccccagucccaucccgccguuuucggcugucuuccuaaccguccugucuucucuuggcg

SEQ ID NO: 603527 - RNA, 64 nt, Homo Sapiens
aaugagugauacugugacaaaaccauccuugcauucuuccuagaagaguuccucugcuccuucc

SEQ ID NO: 603528 - RNA, 64 nt, Homo Sapiens
auaucacucucauauaucagauaagcuugaguuuucuuccuaccacaguuaaacuaauauguuu

SEQ ID NO: 603529 - RNA, 64 nt, Homo Sapiens
ccuucuuacaaacaaguuugauuccucuccuucuucuuccuagcuuuuauucuucuuuagucuc

SEQ ID NO: 603530 - RNA, 64 nt, Homo Sapiens
gagucuaggcuggccgucguucaugugaagaccaucuuccuacaggguucagcuggucaucuug

SEQ ID NO: 603531 - RNA, 64 nt, Homo Sapiens
gacuugcugccucaacagauauauauugauauucucuuccuauuuguuuggugaccagagcugu

SEQ ID NO: 603532 - RNA, 64 nt, Homo Sapiens
ucuggaggcugggaaggcgaaaagaaauuuauuuucuuccuagugacuggguaauuuaaaaaga

SEQ ID NO: 603533 - RNA, 64 nt, Homo Sapiens
guaaacuuuugagucugguuugaaguuuagauuuucuuccuauuaaaggcuugaaauaccuaga

SEQ ID NO: 603534 - RNA, 64 nt, Homo Sapiens
cacuuucauauugagaggaauaugggcuugauccucuuccuaucuaaaugggugggccauuuga

SEQ ID NO: 603535 - RNA, 64 nt, Homo Sapiens
cuccuguggauuuaggaaugugugcuaauagcaaucuuccuaauuuucauguuuauauggaacu

SEQ ID NO: 603536 - RNA, 64 nt, Homo Sapiens
aauggaagaagguaauuuuuugcauagaaaagggucuuccuauuuugaguuuaagccaaauaca

SEQ ID NO: 603537 - RNA, 64 nt, Homo Sapiens
aucaggcgccuacuuaaccuagaugaauuauugaucuuccuaauugcuguuucauacagcacuu

SEQ ID NO: 603538 - RNA, 64 nt, Homo Sapiens
aagaagccuagauugcaggccucaccauggauggucuuccuaguugccuggggaaacccuggaa

SEQ ID NO: 603539 - RNA, 64 nt, Homo Sapiens
uuguagauuuugaaaaaacagauauuuuuaugagucuuccuauucauaaaaauaguaugucucc

SEQ ID NO: 603540 - RNA, 64 nt, Homo Sapiens
uggaccaucgagggcaaccuccagaguuggcugcucuuccuacuccugagucuacacccgugcu

SEQ ID NO: 603541 - RNA, 64 nt, Homo Sapiens
ucuccagacagagcagcuacaccaguaauggcacucuuccuaggacgggacuaaagaggacgcc

SEQ ID NO: 603542 - RNA, 64 nt, Homo Sapiens
gcaccugaaagcccucggcucgguccuuagaccaucuuccuacauuaccuggaagggagcugcc

SEQ ID NO: 603543 - RNA, 64 nt, Homo Sapiens
ugcuguaauuucugacaacauccaaaaaauaaaaucuuccuaaauuauguuaagaggaaaaucu

SEQ ID NO: 603544 - RNA, 64 nt, Homo Sapiens
uaauaacaaauagcauuuggcaagucuauaggauucuuccuaucuggaaauucuauuuuguuag

SEQ ID NO: 603545 - RNA, 64 nt, Homo Sapiens
ugugacaccgaccgaagccuuuguucuggaucuuucuuccuauugaagguggcugcugguggcu

SEQ ID NO: 603546 - RNA, 64 nt, Homo Sapiens
acuuagcagcucacagagcacagagauccugccuucuuccuacuaucaggcugaccuaaugggg

SEQ ID NO: 603547 - RNA, 64 nt, Homo Sapiens
ccuagagcguaaguauggauguuguggcccugugucuuccuagugugacccagccaggagcgga

SEQ ID NO: 603548 - RNA, 64 nt, Homo Sapiens; identical to SEQ ID NO: 115857

SEQ ID NO: 603549 - RNA, 64 nt, Homo Sapiens; identical to SEQ ID NO: 115858

SEQ ID NO: 603550 - RNA, 64 nt, Homo Sapiens; identical to SEQ ID NO: 115859

SEQ ID NO: 603551 - RNA, 64 nt, Homo Sapiens; identical to SEQ ID NO: 115860

SEQ ID NO: 603552 - RNA, 64 nt, Homo Sapiens; identical to SEQ ID NO: 58780

SEQ ID NO: 603553 - RNA, 64 nt, Homo Sapiens; identical to SEQ ID NO: 58781

SEQ ID NO: 603554 - RNA, 64 nt, Homo Sapiens; identical to SEQ ID NO: 58782

SEQ ID NO: 603555 - RNA, 54 nt, Homo Sapiens; identical to SEQ ID NO: 58783

SEQ ID NO: 603556 - RNA, 64 nt, Homo Sapiens; identical to SEQ ID NO: 58784

SEQ ID NO: 603557 - RNA, 64 nt, Homo Sapiens; identical to SEQ ID NO: 58785

SEQ ID NO: 603558 - RNA, 64 nt, Homo Sapiens; identical to SEQ ID NO: 58786

SEQ ID NO: 603559 - RNA, 64 nt, Homo Sapiens; identical to SEQ ID NO: 58787

SEQ ID NO: 603560 - RNA, 64 nt, Homo Sapiens; identical to SEQ ID NO: 58788

SEQ ID NO: 603561 - RNA, 64 nt, Homo Sapiens; identical to SEQ ID NO: 58788

SEQ ID NO: 603562 - RNA, 64 nt, Homo Sapiens; identical to SEQ ID NO: 58790

SEQ ID NO: 603563 - RNA, 64 nt, Homo Sapiens; identical to SEQ ID NO: 58791

SEQ ID NO: 603564 - RNA, 64 nt, Homo Sapiens; identical to SEQ ID NO: 58792

SEQ ID NO: 603565 - RNA, 64 nt, Homo Sapiens; identical to SEQ ID NO: 58793

SEQ ID NO: 603566 - RNA, 64 nt, Homo Sapiens; identical to SEQ ID NO: 58794

SEQ ID NO: 603567 - RNA, 64 nt, Homo Sapiens; identical to SEQ ID NO: 58795

SEQ ID NO: 603568 - RNA, 64 nt, Homo Sapiens; identical to SEQ ID NO: 58796

SEQ ID NO: 603569 - RNA, 64 nt, Homo Sapiens; identical to SEQ ID NO: 496488

SEQ ID NO: 603570 - RNA, 64 nt, Homo Sapiens; identical to SEQ ID NO: 496489

SEQ ID NO: 603571 - RNA, 64 nt, Homo Sapiens; identical to SEQ ID NO: 496490

SEQ ID NO: 603572 - RNA, 64 nt, Homo Sapiens; identical to SEQ ID NO: 496491

SEQ ID NO: 603573 - RNA, 64 nt, Homo Sapiens; identical to SEQ ID NO: 496492

SEQ ID NO: 603574 - RNA, 64 nt, Homo Sapiens; identical to SEQ ID NO: 496493

SEQ ID NO: 603575 - RNA, 64 nt, Homo Sapiens; identical to SEQ ID NO: 496494

SEQ ID NO: 603576 - RNA, 64 nt, Homo Sapiens; identical to SEQ ID NO: 496495

SEQ ID NO: 603577 - RNA, 64 nt, Homo Sapiens
ucacuuccacauuuuggguaucugccuguuacccaguuccaaagcccuccaaacuguuccagcc

SEQ ID NO: 603578 - RNA, 64 nt, Homo Sapiens
uuucccacauuuuccuguuuacaagucuguaggaaguuccaaacauuuggggcaaagccauuca

SEQ ID NO: 603579 - RNA, 64 nt, Homo Sapiens
uauagcuagugucugaacgacacuccuuaaaguaaguuccaaauguaaaacacuccuuaaguuc

SEQ ID NO: 603580 - RNA, 64 nt, Homo Sapiens
cuuaaaguaaguuccaaauguaaaacacuccuuaaguuccaaauguuuuccgcuaauagucugu

SEQ ID NO: 603581 - RNA, 64 nt, Homo Sapiens
auuuugggcaaagccauucagcaaguaucuaggaaguuccaaacuuucccacauuuuccugucu

SEQ ID NO: 603582 - RNA, 64 nt, Homo Sapiens
cccuucaaacuguuccaaccucugccuguuacccaguuccaaacuugcuuucauauuuuuggcu

SEQ ID NO: 603583 - RNA, 64 nt, Homo Sapiens
ggugaaguuuuaaaaaaaaaguuguggaaaggaaaguuccaaagaggugguuucugaggaaguc

SEQ ID NO: 603584 - RNA, 64 nt, Homo Sapiens
uuguugaaaucuuuuuuccuucuuccucuugaaaaguuccaaaauauaguuuauuguaucuuuc

SEQ ID NO: 603585 - RNA, 64 nt, Homo Sapiens
uaggaacauuuuauacuuuuucauuuuguacuuaaguuccaaaggaagugaucaaaugccagug

SEQ ID NO: 603586 - RNA, 64 nt, Homo Sapiens
aguccuuuccgugaaagcaguggacaggucccaaaguuccaagcgaggcacagcacaugagccc

SEQ ID NO: 603587 - RNA, 64 nt, Homo Sapiens
ccuuuuguguagagcuuuuaauaucauuugaggaaguuccaaauuuguagccaguuccaaacaa

SEQ ID NO: 603588 - RNA, 64 nt, Homo Sapiens
uaauaucauuugaggaaguuccaaauuuguagccaguuccaaacaaauuuaaauauugaguuga

SEQ ID NO: 603589 - RNA, 64 nt, Homo Sapiens
ugcaccacugcucucuagccugggcaaaaaaacuaguuccaaaaaagacacuuguacacgcaug

SEQ ID NO: 603590 - RNA, 64 nt, Homo Sapiens
uaaaauauaaaaagaaagagaaagaaaagaaaauaguuccaauuuaucaugccaaauuguuuga

SEQ ID NO: 603591 - RNA, 64 nt, Homo Sapiens
auuaaaaaaaaaaaccuuucagggucuuucaugaaguuccaauaguugagugaguuaaaagguu

SEQ ID NO: 603592 - RNA, 64 nt, Homo Sapiens
guccaaaauuucauucaaauaucaucgguucaaaaguuccaaagcuuaucauuuagaucaucua

SEQ ID NO: 603593 - RNA, 64 nt, Homo Sapiens
cuccauggaaacagccccuagaaucugaaaggccgggauaaaccuaaucacuguucccaaacau

SEQ ID NO: 603594 - RNA, 64 nt, Homo Sapiens
uuuccucccuucucuagcccuggauguccacuuagggauaaaaagaauaugguuuugguuccca

SEQ ID NO: 603595 - RNA, 64 nt, Homo Sapiens
agcuguuucacaaacaguuugucacucugccauggggauaaaaugguuagugcaucuuucaggg

SEQ ID NO: 603596 - RNA, 64 nt, Homo Sapiens
uauauauauaaaucuauuuuggaauuaaaagggagggauaaauaaugauggggaaagggugggg

SEQ ID NO: 603597 - RNA, 64 nt, Homo Sapiens
ugggcgcgcugggagugugguuguguuucugaaggggauaaaagagggcacgguggugccaaga

SEQ ID NO: 603598 - RNA, 64 nt, Homo Sapiens
cuaacuucugauuuagauacuucucccugagguggggauaaaagaaaaaaaaaaacaacuucuu

SEQ ID NO: 603599 - RNA, 64 nt, Homo Sapiens; identical to SEQ ID NO: 210736

SEQ ID NO: 603600 - RNA, 64 nt, Homo Sapiens; identical to SEQ ID NO: 210737

SEQ ID NO: 603601 - RNA, 64 nt, Homo Sapiens; identical to SEQ ID NO: 210738

SEQ ID NO: 603602 - RNA, 64 nt, Homo Sapiens; identical to SEQ ID NO: 210739

SEQ ID NO: 603603 - RNA, 64 nt, Homo Sapiens; identical to SEQ ID NO: 210740

SEQ ID NO: 603604 - RNA, 64 nt, Homo Sapiens; identical to SEQ ID NO: 210741

SEQ ID NO: 603605 - RNA, 64 nt, Homo Sapiens; identical to SEQ ID NO: 210742

SEQ ID NO: 603606 - RNA, 64 nt, Homo Sapiens; identical to SEQ ID NO: 210743

SEQ ID NO: 603607 - RNA, 64 nt, Homo Sapiens; identical to SEQ ID NO: 210744

SEQ ID NO: 603608 - RNA, 64 nt, Homo Sapiens; identical to SEQ ID NO: 210745

SEQ ID NO: 603609 - RNA, 64 nt, Homo Sapiens; identical to SEQ ID NO: 210746

SEQ ID NO: 603610 - RNA, 64 nt, Homo Sapiens; identical to SEQ ID NO: 210747

SEQ ID NO: 603611 - RNA, 64 nt, Homo Sapiens; identical to SEQ ID NO: 210748

SEQ ID NO: 603612 - RNA, 64 nt, Homo Sapiens; identical to SEQ ID NO: 210749

SEQ ID NO: 603613 - RNA, 64 nt, Homo Sapiens; identical to SEQ ID NO: 210750

SEQ ID NO: 603614 - RNA, 64 nt, Homo Sapiens; identical to SEQ ID NO: 210751

SEQ ID NO: 603615 - RNA, 64 nt, Homo Sapiens; identical to SEQ ID NO: 210752

SEQ ID NO: 603616 - RNA, 64 nt, Homo Sapiens; identical to SEQ ID NO: 210753

SEQ ID NO: 603617 - RNA, 64 nt, Homo Sapiens; identical to SEQ ID NO: 210754

SEQ ID NO: 603618 - RNA, 64 nt, Homo Sapiens; identical to SEQ ID NO: 210755

SEQ ID NO: 603619 - RNA, 64 nt, Homo Sapiens; identical to SEQ ID NO: 210756

SEQ ID NO: 603620 - RNA, 64 nt, Homo Sapiens; identical to SEQ ID NO: 210757

SEQ ID NO: 603621 - RNA, 64 nt, Homo Sapiens; identical to SEQ ID NO: 210758

SEQ ID NO: 603622 - RNA, 64 nt, Homo Sapiens; identical to SEQ ID NO: 210759

SEQ ID NO: 603623 - RNA, 64 nt, Homo Sapiens; identical to SEQ ID NO: 210760

SEQ ID NO: 603624 - RNA, 64 nt, Homo Sapiens; identical to SEQ ID NO: 210761

SEQ ID NO: 603625 - RNA, 64 nt, Homo Sapiens; identical to SEQ ID NO: 210762

SEQ ID NO: 603626 - RNA, 64 nt, Homo Sapiens; identical to SEQ ID NO: 210763

SEQ ID NO: 603627 - RNA, 64 nt, Homo Sapiens; identical to SEQ ID NO: 210764

SEQ ID NO: 603628 - RNA, 64 nt, Homo Sapiens; identical to SEQ ID NO: 210765

SEQ ID NO: 603629 - RNA, 64 nt, Homo Sapiens; identical to SEQ ID NO: 210766

SEQ ID NO: 603630 - RNA, 64 nt, Homo Sapiens; identical to SEQ ID NO: 210767

SEQ ID NO: 603631 - RNA, 64 nt, Homo Sapiens; identical to SEQ ID NO: 210728

SEQ ID NO: 603632 - RNA, 64 nt, Homo Sapiens; identical to SEQ ID NO: 210729

SEQ ID NO: 603633 - RNA, 64 nt, Homo Sapiens; identical to SEQ ID NO: 210730

SEQ ID NO: 603634 - RNA, 64 nt, Homo Sapiens; identical to SEQ ID NO: 210731

SEQ ID NO: 603635 - RNA, 64 nt, Homo Sapiens; identical to SEQ ID NO: 210732

SEQ ID NO: 603636 - RNA, 64 nt, Homo Sapiens; identical to SEQ ID NO: 210733

SEQ ID NO: 603637 - RNA, 64 nt, Homo Sapiens; identical to SEQ ID NO: 210734

SEQ ID NO: 603638 - RNA, 64 nt, Homo Sapiens; identical to SEQ ID NO: 210735

SEQ ID NO: 603639 - RNA, 60 nt, Homo Sapiens
caugguuaauauauauacuuauggaaaggagagacaaaagaaaauaauaaaaggcagcua

SEQ ID NO: 603640 - RNA, 60 nt, Homo Sapiens
cuuaacaaagaaauaacaguauggaaucuugagacaaaacucagugcuauccaguuauaa

SEQ ID NO: 603641 - RNA, 60 nt, Homo Sapiens
uguauauaagagcacguuguaaacuugaaagagacaaaggcacaaauguggcuguugauu

SEQ ID NO: 603642 - RNA, 60 nt, Homo Sapiens
gacuaggacuccagugcccuccucucccaagagacaaaggccauugcauugaaggaggug

SEQ ID NO: 603643 - RNA, 60 nt, Homo Sapiens
gacucuuuaaaaaaagaaauuaaaagaguugagacaaacguuuccuacauucuuuuccau

SEQ ID NO: 603644 - RNA, 60 nt, Homo Sapiens
accguuccgacagggaccagugaaagaaaagagacaaaguuagaacgugcuggggagcgg

SEQ ID NO: 603645 - RNA, 64 nt, Homo Sapiens
caggcuggucuugaacuccugagacgggguuuugccauguuagucuaauuuuguauuuuugguc

SEQ ID NO: 603646 - RNA, 64 nt, Homo Sapiens
gaaggggaugguucauuaaggaggaauuuuuucaccauguuauuaucauucucugcuucccugg

SEQ ID NO: 603647 - RNA, 64 nt, Homo Sapiens
uuauuuuuguuuuuauaagauaaagguguaccuuccauguuauacuuucuguaacagccucaaa

SEQ ID NO: 603648 - RNA, 64 nt, Homo Sapiens
ugccauuuaguuauuauacccagggaucucacacccauguuacuguuuuaaugaaagcaugcaa

SEQ ID NO: 603649 - RNA, 64 nt, Homo Sapiens
gcagaccuaacaaauauuugaggucagaacccuaccauguuaaaacaaacaaaaacuuaccaug

SEQ ID NO: 603650 - RNA, 64 nt, Homo Sapiens
agaacccuaccauguuaaaacaaacaaaaacuuaccauguuaauaaaaguauucauuugcuuga

SEQ ID NO: 603651 - RNA, 64 nt, Homo Sapiens
aauguucuguauuuuuaauagggacgggguuuugccauguuagcuaggcuggucucaaacucac

SEQ ID NO: 603652 - RNA, 64 nt, Homo Sapiens
uaauuuuuguauuuuuaguagagaugggguuucgccauguuagccagacuggucucgaacuccu

SEQ ID NO: 603653 - RNA, 63 nt, Homo Sapiens; identical to SEQ ID NO: 266651

SEQ ID NO: 603654 - RNA, 63 nt, Homo Sapiens; identical to SEQ ID NO: 266652

SEQ ID NO: 603655 - RNA, 63 nt, Homo Sapiens; identical to SEQ ID NO: 266653

SEQ ID NO: 603656 - RNA, 63 nt, Homo Sapiens; identical to SEQ ID NO: 266654

SEQ ID NO: 603657 - RNA, 63 nt, Homo Sapiens; identical to SEQ ID NO: 266655

SEQ ID NO: 603658 - RNA, 63 nt, Homo Sapiens; identical to SEQ ID NO: 266656

SEQ ID NO: 603659 - RNA, 63 nt, Homo Sapiens; identical to SEQ ID NO: 266657

SEQ ID NO: 603660 - RNA, 63 nt, Homo Sapiens; identical to SEQ ID NO: 266658

SEQ ID NO: 603661 - RNA, 63 nt, Homo Sapiens; identical to SEQ ID NO: 266659

SEQ ID NO: 603662 - RNA, 63 nt, Homo Sapiens; identical to SEQ ID NO: 266660

SEQ ID NO: 603663 - RNA, 63 nt, Homo Sapiens; identical to SEQ ID NO: 266661

SEQ ID NO: 603664 - RNA, 63 nt, Homo Sapiens; identical to SEQ ID NO: 266662

SEQ ID NO: 603665 - RNA, 63 nt, Homo Sapiens; identical to SEQ ID NO: 266663

SEQ ID NO: 603666 - RNA, 60 nt, Homo Sapiens; identical to SEQ ID NO: 266664

SEQ ID NO: 603667 - RNA, 63 nt, Homo Sapiens; identical to SEQ ID NO: 266665

SEQ ID NO: 603668 - RNA, 63 nt, Homo Sapiens; identical to SEQ ID NO: 266666

SEQ ID NO: 603669 - RNA, 63 nt, Homo Sapiens; identical to SEQ ID NO: 266667

SEQ ID NO: 603670 - RNA, 63 nt, Homo Sapiens; identical to SEQ ID NO: 266668

SEQ ID NO: 603671 - RNA, 63 nt, Homo Sapiens; identical to SEQ ID NO: 266669

SEQ ID NO: 603672 - RNA, 63 nt, Homo Sapiens; identical to SEQ ID NO: 266670

SEQ ID NO: 603673 - RNA, 63 nt, Homo Sapiens; identical to SEQ ID NO: 266671

SEQ ID NO: 603674 - RNA, 63 nt, Homo Sapiens; identical to SEQ ID NO: 266672

SEQ ID NO: 603675 - RNA, 63 nt, Homo Sapiens; identical to SEQ ID NO: 266673

SEQ ID NO: 603676 - RNA, 63 nt, Homo Sapiens; identical to SEQ ID NO: 266674

SEQ ID NO: 603677 - RNA, 63 nt, Homo Sapiens; identical to SEQ ID NO: 266675

SEQ ID NO: 603678 - RNA, 63 nt, Homo Sapiens; identical to SEQ ID NO: 266676

SEQ ID NO: 603679 - RNA, 63 nt, Homo Sapiens; identical to SEQ ID NO: 266677

SEQ ID NO: 603680 - RNA, 63 nt, Homo Sapiens; identical to SEQ ID NO: 266678

SEQ ID NO: 603681 - RNA, 63 nt, Homo Sapiens; identical to SEQ ID NO: 266679

SEQ ID NO: 603682 - RNA, 63 nt, Homo Sapiens; identical to SEQ ID NO: 266680

SEQ ID NO: 603683 - RNA, 63 nt, Homo Sapiens; identical to SEQ ID NO: 266681

SEQ ID NO: 603684 - RNA, 63 nt, Homo Sapiens; identical to SEQ ID NO: 266682

SEQ ID NO: 603685 - RNA, 63 nt, Homo Sapiens; identical to SEQ ID NO: 266683

SEQ ID NO: 603686 - RNA, 63 nt, Homo Sapiens; identical to SEQ ID NO: 266684

SEQ ID NO: 603687 - RNA, 63 nt, Homo Sapiens; identical to SEQ ID NO: 266685

SEQ ID NO: 603688 - RNA, 63 nt, Homo Sapiens; identical to SEQ ID NO: 266686

SEQ ID NO: 603689 - RNA, 63 nt, Homo Sapiens; identical to SEQ ID NO: 266687

SEQ ID NO: 603690 - RNA, 63 nt, Homo Sapiens; identical to SEQ ID NO: 266688

SEQ ID NO: 603691 - RNA, 63 nt, Homo Sapiens; identical to SEQ ID NO: 266689

SEQ ID NO: 603692 - RNA, 63 nt, Homo Sapiens; identical to SEQ ID NO: 266690

SEQ ID NO: 603693 - RNA, 63 nt, Homo Sapiens; identical to SEQ ID NO: 266691

SEQ ID NO: 603694 - RNA, 63 nt, Homo Sapiens; identical to SEQ ID NO: 266692

SEQ ID NO: 603695 - RNA, 63 nt, Homo Sapiens; identical to SEQ ID NO: 266693

SEQ ID NO: 603696 - RNA, 64 nt, Homo Sapiens; identical to SEQ ID NO: 293103

SEQ ID NO: 603697 - RNA, 64 nt, Homo Sapiens; identical to SEQ ID NO: 293104

SEQ ID NO: 603698 - RNA, 64 nt, Homo Sapiens; identical to SEQ ID NO: 293105

SEQ ID NO: 603699 - RNA, 64 nt, Homo Sapiens; identical to SEQ ID NO: 293106

SEQ ID NO: 603700 - RNA, 64 nt, Homo Sapiens; identical to SEQ ID NO: 293107

SEQ ID NO: 603701 - RNA, 64 nt, Homo Sapiens; identical to SEQ ID NO: 293108

SEQ ID NO: 603702 - RNA, 64 nt, Homo Sapiens; identical to SEQ ID NO: 293109

SEQ ID NO: 603703 - RNA, 64 nt, Homo Sapiens; identical to SEQ ID NO: 293110

SEQ ID NO: 603704 - RNA, 64 nt, Homo Sapiens; identical to SEQ ID NO: 293111

SEQ ID NO: 603705 - RNA, 64 nt, Homo Sapiens; identical to SEQ ID NO: 293112

SEQ ID NO: 603706 - RNA, 64 nt, Homo Sapiens; identical to SEQ ID NO: 293113

SEQ ID NO: 603707 - RNA, 64 nt, Homo Sapiens; identical to SEQ ID NO: 293114

SEQ ID NO: 603708 - RNA, 64 nt, Homo Sapiens; identical to SEQ ID NO: 293115

SEQ ID NO: 603709 - RNA, 64 nt, Homo Sapiens; identical to SEQ ID NO: 293116

SEQ ID NO: 603710 - RNA, 64 nt, Homo Sapiens; identical to SEQ ID NO: 293117

SEQ ID NO: 603711 - RNA, 64 nt, Homo Sapiens; identical to SEQ ID NO: 293118

SEQ ID NO: 603712 - RNA, 64 nt, Homo Sapiens; identical to SEQ ID NO: 293119

SEQ ID NO: 603713 - RNA, 64 nt, Homo Sapiens; identical to SEQ ID NO: 293120

SEQ ID NO: 603714 - RNA, 64 nt, Homo Sapiens; identical to SEQ ID NO: 293121

SEQ ID NO: 603715 - RNA, 64 nt, Homo Sapiens; identical to SEQ ID NO: 293122

SEQ ID NO: 603716 - RNA, 64 nt, Homo Sapiens; identical to SEQ ID NO: 293123

SEQ ID NO: 603717 - RNA, 64 nt, Homo Sapiens; identical to SEQ ID NO: 293124

SEQ ID NO: 603718 - RNA, 64 nt, Homo Sapiens; identical to SEQ ID NO: 293125

SEQ ID NO: 603719 - RNA, 64 nt, Homo Sapiens; identical to SEQ ID NO: 293126

SEQ ID NO: 603720 - RNA, 64 nt, Homo Sapiens; identical to SEQ ID NO: 293127

SEQ ID NO: 603721 - RNA, 64 nt, Homo Sapiens; identical to SEQ ID NO: 293128

SEQ ID NO: 603722 - RNA, 64 nt, Homo Sapiens; identical to SEQ ID NO: 293129

SEQ ID NO: 603723 - RNA, 64 nt, Homo Sapiens; identical to SEQ ID NO: 293130

SEQ ID NO: 603724 - RNA, 64 nt, Homo Sapiens; identical to SEQ ID NO: 293131

SEQ ID NO: 603725 - RNA, 64 nt, Homo Sapiens; identical to SEQ ID NO: 293132

SEQ ID NO: 603726 - RNA, 64 nt, Homo Sapiens; identical to SEQ ID NO: 293133

SEQ ID NO: 603727 - RNA, 64 nt, Homo Sapiens; identical to SEQ ID NO: 293134

SEQ ID NO: 603728 - RNA, 64 nt, Homo Sapiens; identical to SEQ ID NO: 293135

SEQ ID NO: 603729 - RNA, 64 nt, Homo Sapiens; identical to SEQ ID NO: 293136

SEQ ID NO: 603730 - RNA, 64 nt, Homo Sapiens; identical to SEQ ID NO: 293137

SEQ ID NO: 603731 - RNA, 64 nt, Homo Sapiens; identical to SEQ ID NO: 293138

SEQ ID NO: 603732 - RNA, 64 nt, Homo Sapiens; identical to SEQ ID NO: 293139

SEQ ID NO: 603733 - RNA, 64 nt, Homo Sapiens; identical to SEQ ID NO: 293140

SEQ ID NO: 603734 - RNA, 64 nt, Homo Sapiens; identical to SEQ ID NO: 293141

SEQ ID NO: 603735 - RNA, 64 nt, Homo Sapiens; identical to SEQ ID NO: 293142

SEQ ID NO: 603736 - RNA, 64 nt, Homo Sapiens
cugcccuccucucaggugcuggaggagcugaaggcuucgccacaggaccuggaguuaucagggg

SEQ ID NO: 603737 - RNA, 64 nt, Homo Sapiens
cccuccacggcccaggucuccucacucaaagucccuucgccaaccuuucaaugcccagcccuga

SEQ ID NO: 603738 - RNA, 64 nt, Homo Sapiens
aagagagaguuucagcgucaccagaucacagaucccaugugagacucugcugaguugugagggc

SEQ ID NO: 603739 - RNA, 64 nt, Homo Sapiens
gggacacaguggugcucugcagaccucggccucuccaugugaggcucugucccaggaucuccac

SEQ ID NO: 603740 - RNA, 64 nt, Homo Sapiens
gcauuuaucccaaaacgaggcuccugcuuuucagaggcccgaguuccucucagggaccaggggc

SEQ ID NO: 603741 - RNA, 64 nt, Homo Sapiens
gagcuuuugacaagccuggcgaagcugcaggguuaggcccgagaagggagcuguacggaggcug

SEQ ID NO: 603742 - RNA, 64 nt, Homo Sapiens
gaacauggcuaacaaucuucaaauacccaaauugugauagcauaaauaaaguauuuauuuuaug

SEQ ID NO: 603743 - RNA, 64 nt, Homo Sapiens
uuccuuucuuaaaccuaccagcaaacuaggauugugauagcaaugaaugguaugaugaagaaag

SEQ ID NO: 603744 - RNA, 64 nt, Homo Sapiens
gauugagguuaacaucauccaugauaagcccuuuugauagcauguauccuugauagcaucacau

SEQ ID NO: 603745 - RNA, 64 nt, Homo Sapiens
auccaugauaagcccuuuugauagcauguauccuugauagcaucacaucauacagaaugugaua

SEQ ID NO: 603746 - RNA, 64 nt, Homo Sapiens; identical to SEQ ID NO: 452530

SEQ ID NO: 603747 - RNA, 64 nt, Homo Sapiens; identical to SEQ ID NO: 452531

SEQ ID NO: 603748 - RNA, 64 nt, Homo Sapiens; identical to SEQ ID NO: 452532

SEQ ID NO: 603749 - RNA, 64 nt, Homo Sapiens; identical to SEQ ID NO: 452533

SEQ ID NO: 603750 - RNA, 64 nt, Homo Sapiens
auacuuuuauuucucuugagacuauagaucuuaccaaucucagcucacacauagguuuguucuu

SEQ ID NO: 603751 - RNA, 64 nt, Homo Sapiens
cauagguuuguucuuacuauuuuuuccuucuuuacaaucucacaauauacuaugcaugaauuuc

SEQ ID NO: 603752 - RNA, 64 nt, Homo Sapiens
acccaaauggggagguauacuuugucugauuagccaaucucaccuuaaacauguaaauuaauug

SEQ ID NO: 603753 - RNA, 64 nt, Homo Sapiens
ggaacaugucacaaaaaguuaauuauaaaugugacaaucucauuaauacugugccagaauccca

SEQ ID NO: 603754 - RNA, 64 nt, Homo Sapiens
uucuaccuuguguaagcugcgagaaggggagaaccaaucucaacaaacuuauuuaaaugggaga

SEQ ID NO: 603755 - RNA, 64 nt, Homo Sapiens
ucacagcaaccucugccuccggagugcaauggcacaaucucagcucacucuuguuguccagucu

SEQ ID NO: 603756 - RNA, 64 nt, Homo Sapiens
cuuugucucagaaaaaaaaauccagccuggguggcagagcaacacagagaucacaccacugcac

SEQ ID NO: 603757 - RNA, 64 nt, Homo Sapiens
cgccaucucaaaaacaaaaauccagccugggcgacagagcaagacugagaucgugcuauugcac

SEQ ID NO: 603758 - RNA, 64 nt, Homo Sapiens
gcugaaguauacauaugcuauuucucuuaaaccucagagcaaccauaugagcauuguaauuaau

SEQ ID NO: 603759 - RNA, 64 nt, Homo Sapiens
cugagaucgcgccacugcacugcagccuaggcgacagagcaagacugccucaaaaaaaaaacau

SEQ ID NO: 603760 - RNA, 64 nt, Homo Sapiens
cccugucucaaaaacaaaaauucaaccugggugacagagcaagaccaagaucacaucacugcac

SEQ ID NO: 603761 - RNA, 64 nt, Homo Sapiens
cucuaucucaaaaauaaaauuccagccugagcaacagagcaagaccgagaucgugccacugcac

SEQ ID NO: 603762 - RNA, 64 nt, Homo Sapiens
cccaagccucauuuggaagggccucugguggcugcagagcaauaauguuaugcagagacacucu

SEQ ID NO: 603763 - RNA, 64 nt, Homo Sapiens
uagaaucuuugagugcuuggaacaaaagagaacccagagcaaucuucacuguuagaaagaaacu

SEQ ID NO: 603764 - RNA, 64 nt, Homo Sapiens
uucacucacaggguacgcucauggagagagggcgcagagcaaaccaugucacgccauccaauga

SEQ ID NO: 603765 - RNA, 64 nt, Homo Sapiens
uuuaaauuccccuaaauagcgccccauuugggaacagagcaagaguguugaacugaagaccaaa

SEQ ID NO: 603766 - RNA, 64 nt, Homo Sapiens
ccaggaucacaccauugcuguccagccugggugacagagcaagacugcguuucaaaaaaaaaaa

SEQ ID NO: 603767 - RNA, 64 nt, Homo Sapiens
ccgaaauggcgccacuguacuccaaccugggcgacagagcaagacuccaucucauaaauuaaaa

SEQ ID NO: 603768 - RNA, 64 nt, Homo Sapiens
cugagauccugccacugcacuccagucugggugacagagcaagacuccaucucaaaaaauaaau

SEQ ID NO: 603769 - RNA, 64 nt, Homo Sapiens
uuccguucccaagaaaaaaauccagccugggcgacagagcaagacugagauuaagccaccgcac

SEQ ID NO: 603770 - RNA, 64 nt, Homo Sapiens
ucuaaacuucuggcuucuagaaucagagaggccacagagcaaggggaaacagacuucgcauuuc

SEQ ID NO: 603771 - RNA, 64 nt, Homo Sapiens
gagcugagauugcaccacugcaccagccuggcaacagagcaagacuccgucucacaaaaaugaa

SEQ ID NO: 603772 - RNA, 64 nt, Homo Sapiens
caggaauugugccacugcacuccaaccugagugacagagcaacacucugucuuaaaagaaaaaa

SEQ ID NO: 603773 - RNA, 64 nt, Homo Sapiens
gaggauugcuugagcccaggaguucgagaccagccagagcaacauagugagaccacaucucuac

SEQ ID NO: 603774 - RNA, 64 nt, Homo Sapiens
ccaugauugcaccacugcaccccagccugggugacagagcaagacccugucucaaaaaaaauaa

SEQ ID NO: 603775 - RNA, 64 nt, Homo Sapiens
aauuuuugaacugaagcuacaagcuguugggacccagagcaauguaagauguagacuuggaaca

SEQ ID NO: 603776 - RNA, 64 nt, Homo Sapiens
uauggauaaugaaaguguugcacauuuggaauagcagagcaaaacagguuauucuuagagacua

SEQ ID NO: 603777 - RNA, 64 nt, Homo Sapiens
caggaucaaggguacaguaacacgaaugagcauacagagcaacaccuguugagccagggaguag

SEQ ID NO: 603778 - RNA, 64 nt, Homo Sapiens
ccugcuguuugcuuucugaaagaauuucagaaaucagagcaaaugugucuuuaggcagauucag

SEQ ID NO: 603779 - RNA, 64 nt, Homo Sapiens
gcuguuuucugaaggugagaagccauuuuuagcucagagcaacccuuaagagaacuuuuggcag

SEQ ID NO: 603780 - RNA, 64 nt, Homo Sapiens
cauccuguaugcauuaacguacuuuccccugaaacagagcaacccagucaacaccacagaaccu

SEQ ID NO: 603781 - RNA, 64 nt, Homo Sapiens
cugagaucacgccauugcacuccagccugggcgacagagcaagacucugucucaagaagaaaaa

SEQ ID NO: 603782 - RNA, 64 nt, Homo Sapiens
gucugucaaaaaaaaaaaaauccagccuggguaacagagcaagauugagaucgcgccacugcac

SEQ ID NO: 603783 - RNA, 64 nt, Homo Sapiens
uaccugauuucuucaacuaaugugugaaauucuacagagcaaaugaagccaaacagauccagaa

SEQ ID NO: 603784 - RNA, 64 nt, Homo Sapiens
cugugucucaaaaaaaaaaauccagcccgggugacagagcaagaccaagauuguaccacuguau

SEQ ID NO: 603785 - RNA, 64 nt, Homo Sapiens
caccgucuuaaaaccaaaagccuagccugggcaacagagcaagaccaagauggcaccauugcac

SEQ ID NO: 603786 - RNA, 64 nt, Homo Sapiens
auguuugagauucuuuuuuaguacuaagcaaaauucucaucacagaauguagcccaggccaauu

SEQ ID NO: 603787 - RNA, 64 nt, Homo Sapiens
auuuguguaggaaguauauacauuucccuauuacucucaucagcugaagaauauguacuauugu

SEQ ID NO: 603788 - RNA, 64 nt, Homo Sapiens
uucgaaaggaacaccuuguggccugugugaaguaucucaucauuuaucaaauuauaguaacuga

SEQ ID NO: 603789 - RNA, 64 nt, Homo Sapiens
cucuuguuucuuagaaauaaggcugggauggcucucucaucauaagugacagauguguuugcaa

SEQ ID NO: 603790 - RNA, 64 nt, Homo Sapiens
uuuuguuuuguuuuguucagauuaacugcuuauagccuuagaaagccuuuuacaaaauuaaaaa

SEQ ID NO: 603791 - RNA, 64 nt, Homo Sapiens
uugauuuuacugauuguacuguacaucuauuaaagccuuagauuauuacauuacggguuggaac

SEQ ID NO: 603792 - RNA, 64 nt, Homo Sapiens
gcaagggccaggcccuggaggucugcugcgaguugccuuagagcucucucauugacucacaggg

SEQ ID NO: 603793 - RNA, 64 nt, Homo Sapiens
cuauaguuccuucugcugcucacugcaaauagaagccuuagaugugggcugugaccccaugaaa

SEQ ID NO: 603794 - RNA, 64 nt, Homo Sapiens
gguuucuguacacacccacgauauuuggaauacagccuuagaacggcuuaaaacuugagaauau

SEQ ID NO: 603795 - RNA, 64 nt, Homo Sapiens
guacuggggucuggucuuccacgucgggguuagugccuuagaggcuuuccagccagugucucug

SEQ ID NO: 603796 - RNA, 64 nt, Homo Sapiens
aagaagcuggcuaguccuuuugaucaccauguuagccuuagacgccuuucuagccuuagacaaa

SEQ ID NO: 603797 - RNA, 64 nt, Homo Sapiens
aaugaucaccauguuagccuuugguaccuuucuagccuuagacaucuccucaguuuacaucuug

SEQ ID NO: 603798 - RNA, 64 nt, Homo Sapiens
uuuuuuaacaccaagauccuaaguaauuccaaaugccuuagauaucaaugaaagcuacacacca

SEQ ID NO: 603799 - RNA, 64 nt, Homo Sapiens
caucagagugaaaugaaggcuauuugccaucccugccuuagacagaggagugaaagaauuaagu

SEQ ID NO: 603800 - RNA, 64 nt, Homo Sapiens
auugccaaucaggacaaggccuugaaggaacgcagccuuagacaucaggugaggaugauggagg

SEQ ID NO: 603801 - RNA, 64 nt, Homo Sapiens
ucuacccagacaggcccugcuuuucuaggauguggccuuagagcaagaacagacccaacagcca

SEQ ID NO: 603802 - RNA, 64 nt, Homo Sapiens
uuucccuccuuccuuuccacgggcccaccgugcggccuuagaggcgcccacgugcuagcuccgu

SEQ ID NO: 603803 - RNA, 64 nt, Homo Sapiens
caucucuaguuccccaccucguacagauguuccugccuuagaguguagcauuucccugcagaug

SEQ ID NO: 603804 - RNA, 64 nt, Homo Sapiens
uucuugugaccggggcaggaugugucuucugcuggaccggcaccuuuuguuugucccauuggug

SEQ ID NO: 603805 - RNA, 64 nt, Homo Sapiens
gagagggcaggacaagccuugucccgaugccuuugaccggcagcucuguguauugguggauaga

SEQ ID NO: 603806 - RNA, 64 nt, Homo Sapiens
gccugccgcuggggccgccgcacccugcaccuuggaccggcauccguagccauggacagagguc

SEQ ID NO: 603807 - RNA, 64 nt, Homo Sapiens
ugugcugagagaccaugugcccgagcaucugguugaccggcaugaaguacaucagccugucuua

SEQ ID NO: 603808 - RNA, 64 nt, Homo Sapiens
gggguguugaccucgccucaccuuucacagaccagaccggcacaggcuuugagcucauuauaac

SEQ ID NO: 603809 - RNA, 64 nt, Homo Sapiens
acuuuauauuguauacagauugcauggacuguacgaccggcaugaguuuccuacaccuggaggu

SEQ ID NO: 603810 - RNA, 64 nt, Homo Sapiens
cugugaugcccgcaauucucaaaggaggacuaaggaccggcacuguggagcacccuggcuuugc

SEQ ID NO: 603811 - RNA, 58 nt, Homo Sapiens
gccacucagacacaaguccaaggaccccgaccggcaugcguaccaguauguggucuga

SEQ ID NO: 603812 - RNA, 64 nt, Homo Sapiens
caucauggcaguuucagcguucagagucuccccagaccggcagucagugccaagcaugcgauau

SEQ ID NO: 603813 - RNA, 64 nt, Homo Sapiens
cggugggaccuccuaggacucacagggagaggcggaccggcaccggcaggcgggauguguuggc

SEQ ID NO: 603814 - RNA, 61 nt, Homo Sapiens
cgggagaagaacuguccuaagggccuguagugaccggcagggcuggggugagaccccuccc

SEQ ID NO: 603815 - RNA, 64 nt, Homo Sapiens
agaggcuccuggauuauagccugcacaaggagaggaccggcagcaaucgauuugccaagguugg

SEQ ID NO: 603816 - RNA, 64 nt, Homo Sapiens
gggccugagugaccuccuucugcaaaguggcagggaccggcagagcucuacaggccugcagccc

SEQ ID NO: 603817 - RNA, 64 nt, Homo Sapiens
uccccgcagcagcgccuccucccggcgcccgagagaccggcacgccacggccccucccccaagg

SEQ ID NO: 603818 - RNA, 64 nt, Homo Sapiens
gggcaugccagcuccuugaggcuuuugcaaagaugaccggcauacuugucuguccacgggggug

SEQ ID NO: 603819 - RNA, 64 nt, Homo Sapiens
ccuggaaggggcacuugauaucgcgcugggcagggaccggcagcucgggccgcugcccccaugc

SEQ ID NO: 603820 - RNA, 64 nt, Homo Sapiens
cuuucccaugguccucacuggccucagucucccugaccggcagugugaggggauguagcuauag

SEQ ID NO: 603821 - RNA, 64 nt, Homo Sapiens
uaaaucucauagcaguuaauccuccguauuacgugaccggcaaacuuguguuguucccugcugu

SEQ ID NO: 603822 - RNA, 64 nt, Homo Sapiens
gcuacaucugggaccgccacccagcggggcggaggaccggcacgcgucagcagggacuucgugg

SEQ ID NO: 603823 - RNA, 64 nt, Homo Sapiens
uaauuuuuaugcaugcuuuaaaaguauauaucgggaccggcagaaauggaaguauccauacauu

SEQ ID NO: 603824 - RNA, 64 nt, Homo Sapiens
gcacgguggucggccuggugugaggccccccggggaccggcaguguguccagggaggggauggc

SEQ ID NO: 603825 - RNA, 60 nt, Homo Sapiens
cuggccauccccaagccuucucuugccccagaccggcagcucauccuggagaucgaguga

SEQ ID NO: 603826 - RNA, 64 nt, Homo Sapiens
acuccgucccugcccaccugcgacgggaucccccgaccggcacgggccacgccgagcucccggc

SEQ ID NO: 603827 - RNA, 64 nt, Homo Sapiens
cguaucauaccaccuguuccuguggagagggaaugaccggcacugaagguaccuuacaacuggc

SEQ ID NO: 603828 - RNA, 64 nt, Homo Sapiens
cagaggcaguucuuuguucaagcguuccucuggggaccggcagcagaggcaccguguucucuca

SEQ ID NO: 603829 - RNA, 64 nt, Homo Sapiens
caguggguggagaggaagcaggggaggugguauugaccggcacuccuagaggaccagcugucca

SEQ ID NO: 603830 - RNA, 64 nt, Homo Sapiens
auguucugccguuuucugcuaaacugcugaacuugaccggcagaguucucgcagauguuaccua

SEQ ID NO: 603831 - RNA, 64 nt, Homo Sapiens
gggugagcagagugggaggccggagacugcccuugaccggcaaaugcccugcaacgguggcucc

SEQ ID NO: 603832 - RNA, 64 nt, Homo Sapiens
aaugaagagaaugccgauacucagacugcagcuggaccggcaagcuggcuguguacaggaaaau

SEQ ID NO: 603833 - RNA, 64 nt, Homo Sapiens
gugcuggggccaguggggcuggggaccggcgggggaccggcagagcccaccugggggccccacc

SEQ ID NO: 603834 - RNA, 64 nt, Homo Sapiens
uccuggugcaggcaggcgggucacagggacccuggaccggcacaagaaacugcuuucuucucga

SEQ ID NO: 603835 - RNA, 64 nt, Homo Sapiens
gagugcaccgaggagggaaggauggcuaagcugggaccggcaguccucacagggugccugugag

SEQ ID NO: 603836 - RNA, 64 nt, Homo Sapiens
ucaggucaggugcacauugcagggauaagcccaggaccggcagagagugguugccuuuccauuu

SEQ ID NO: 603837 - RNA, 64 nt, Homo Sapiens
ucuuaauguuuguggcuuucccucccuuauucaggaccggcacuuccuucaagcucaaacacca

SEQ ID NO: 603838 - RNA, 64 nt, Homo Sapiens
ugcacggccgcaagucuccuggaaaggcuggagugaccggcaugccgggauugggagauuagga

SEQ ID NO: 603839 - RNA, 64 nt, Homo Sapiens
ccugcggcuccgugcccgcugggaaagugcccuggaccggcagcuggcgcaccaggcccagcag

SEQ ID NO: 603840 - RNA, 64 nt, Homo Sapiens
guucaacagaccagggcaucugggacagcgugaugaccggcaggauucuagaccagccaauugg

SEQ ID NO: 603841 - RNA, 64 nt, Homo Sapiens
cccucgccgcgugcugcgcuaggggcacgugcuagaccggcacgggauagcggguggugaggga

SEQ ID NO: 603842 - RNA, 64 nt, Homo Sapiens; identical to SEQ ID NO: 287400

SEQ ID NO: 603843 - RNA, 64 nt, Homo Sapiens; identical to SEQ ID NO: 287401

SEQ ID NO: 603844 - RNA, 64 nt, Homo Sapiens; identical to SEQ ID NO: 287402

SEQ ID NO: 603845 - RNA, 64 nt, Homo Sapiens; identical to SEQ ID NO: 287403

SEQ ID NO: 603846 - RNA, 64 nt, Homo Sapiens; identical to SEQ ID NO: 287404

SEQ ID NO: 603847 - RNA, 64 nt, Homo Sapiens; identical to SEQ ID NO: 287405

SEQ ID NO: 603848 - RNA, 64 nt, Homo Sapiens; identical to SEQ ID NO: 287406

SEQ ID NO: 603849 - RNA, 64 nt, Homo Sapiens; identical to SEQ ID NO: 287407

SEQ ID NO: 603850 - RNA, 64 nt, Homo Sapiens; identical to SEQ ID NO: 71724

SEQ ID NO: 603851 - RNA, 64 nt, Homo Sapiens; identical to SEQ ID NO: 71725

SEQ ID NO: 603852 - RNA, 64 nt, Homo Sapiens; identical to SEQ ID NO: 71726

SEQ ID NO: 603853 - RNA, 64 nt, Homo Sapiens; identical to SEQ ID NO: 71727

SEQ ID NO: 603854 - RNA, 64 nt, Homo Sapiens; identical to SEQ ID NO: 71728

SEQ ID NO: 603855 - RNA, 64 nt, Homo Sapiens; identical to SEQ ID NO: 71729

SEQ ID NO: 603856 - RNA, 64 nt, Homo Sapiens; identical to SEQ ID NO: 71730

SEQ ID NO: 603857 - RNA, 64 nt, Homo Sapiens; identical to SEQ ID NO: 71731

SEQ ID NO: 603858 - RNA, 64 nt, Homo Sapiens; identical to SEQ ID NO: 71732

SEQ ID NO: 603859 - RNA, 64 nt, Homo Sapiens; identical to SEQ ID NO: 71733

SEQ ID NO: 603860 - RNA, 64 nt, Homo Sapiens; identical to SEQ ID NO: 71734

SEQ ID NO: 603861 - RNA, 64 nt, Homo Sapiens; identical to SEQ ID NO: 71735

SEQ ID NO: 603862 - RNA, 64 nt, Homo Sapiens; identical to SEQ ID NO: 71736

SEQ ID NO: 603863 - RNA, 64 nt, Homo Sapiens; identical to SEQ ID NO: 71737

SEQ ID NO: 603864 - RNA, 64 nt, Homo Sapiens; identical to SEQ ID NO: 71738

SEQ ID NO: 603865 - RNA, 64 nt, Homo Sapiens; identical to SEQ ID NO: 71739

SEQ ID NO: 603866 - RNA, 64 nt, Homo Sapiens; identical to SEQ ID NO: 71740

SEQ ID NO: 603867 - RNA, 64 nt, Homo Sapiens; identical to SEQ ID NO: 71741

SEQ ID NO: 603868 - RNA, 64 nt, Homo Sapiens; identical to SEQ ID NO: 71742

SEQ ID NO: 603869 - RNA, 64 nt, Homo Sapiens; identical to SEQ ID NO: 71743

SEQ ID NO: 603870 - RNA, 64 nt, Homo Sapiens; identical to SEQ ID NO: 71744

SEQ ID NO: 603871 - RNA, 64 nt, Homo Sapiens; identical to SEQ ID NO: 71745

SEQ ID NO: 603872 - RNA, 64 nt, Homo Sapiens; identical to SEQ ID NO: 71746

SEQ ID NO: 603873 - RNA, 64 nt, Homo Sapiens; identical to SEQ ID NO: 71747

SEQ ID NO: 603874 - RNA, 64 nt, Homo Sapiens; identical to SEQ ID NO: 71748

SEQ ID NO: 603875 - RNA, 64 nt, Homo Sapiens; identical to SEQ ID NO: 71749

SEQ ID NO: 603876 - RNA, 64 nt, Homo Sapiens; identical to SEQ ID NO: 71750

SEQ ID NO: 603877 - RNA, 64 nt, Homo Sapiens; identical to SEQ ID NO: 71751

SEQ ID NO: 603878 - RNA, 64 nt, Homo Sapiens; identical to SEQ ID NO: 71752

SEQ ID NO: 603879 - RNA, 64 nt, Homo Sapiens; identical to SEQ ID NO: 71753

SEQ ID NO: 603880 - RNA, 64 nt, Homo Sapiens
gguuucaccaacugaaaugucucccuuugaaaguagcaaacaugauuuguauguuaacuuaacu

SEQ ID NO: 603881 - RNA, 64 nt, Homo Sapiens
uaaaauagugucucagcuaaauggaaaacuguuaagcaaacauccauaguaaaacaaauaaucu

SEQ ID NO: 603882 - RNA, 64 nt, Homo Sapiens
uucacugagaauuccaaaaguaauauuuugggcaagcaaacaaaaaaaauuacagaauggaaaa

SEQ ID NO: 603883 - RNA, 64 nt, Homo Sapiens
acauuuggagaagaggaaaucuaucacauauuuaagcaaacaucauguuuuaaaaagauacacu

SEQ ID NO: 603884 - RNA, 64 nt, Homo Sapiens
cauacugggcgugugcaucugaauccugcuggagagcaaacacgaacuucuguucccugcaaaa

SEQ ID NO: 603885 - RNA, 64 nt, Homo Sapiens
guauuuuguucuggcauuagaagaaaaacaagcaagcaaacaaaaacacagccuccgaugccaa

SEQ ID NO: 603886 - RNA, 64 nt, Homo Sapiens
gaguaccaauuauuugcuaguaguucauucauccagcaaacauuaaaguggccguaugggaauu

SEQ ID NO: 603887 - RNA, 64 nt, Homo Sapiens
uacuguccaaggacagccuuuccuuugugagcaaagcaaacaagcaauuguuucuuuccuuuuc

SEQ ID NO: 603888 - RNA, 64 nt, Homo Sapiens
augcaguacuccuguguucucuugaaagaauaguagcaaacagucugucuagacuaaaaauauc

SEQ ID NO: 603889 - RNA, 64 nt, Homo Sapiens
auccuuuuuucuccuuccccuacaguuacuguauagcaaacaguagugcagggucaguuaaugc

SEQ ID NO: 603890 - RNA, 64 nt, Homo Sapiens
aacuuuuaaagggauccuuucaaaaggaucacuuagcaaacacauguugacuuuuaacugaugu

SEQ ID NO: 603891 - RNA, 64 nt, Homo Sapiens
uagagaagucaggugauagaugauauuaaaaauuagcaaacaaaagugacuugcucagggucau

SEQ ID NO: 603892 - RNA, 64 nt, Homo Sapiens
gaacuuccaguauaguggggacaaucaguuaauaagcaaacaaacacauuucuauuuauaaaug

SEQ ID NO: 603893 - RNA, 64 nt, Homo Sapiens
ugugcauuugcuaugcuuuaccugucuggcaucuagcaaacauucuucacauguuugcuguuau

SEQ ID NO: 603894 - RNA, 64 nt, Homo Sapiens
gcaacagaggccaaagaaacgaagcaagacaaacagcaaacaggcauuuuggucaggucauuug

SEQ ID NO: 603895 - RNA, 64 nt, Homo Sapiens
aauacuuuucaggccuuuuuaaaaaauucauuacagcaaacagcuggggaaggacaugcagucc

SEQ ID NO: 603896 - RNA, 64 nt, Homo Sapiens
uuuaaucaauaaaguaugucuguugaagcaagcaagcaaacaaauccauaacaaccacaacaag

SEQ ID NO: 603897 - RNA, 64 nt, Homo Sapiens
ccacuuagacauaauccauuccacucauuauuccagcaaacacuuacugacaaaucggguccug

SEQ ID NO: 603898 - RNA, 64 nt, Homo Sapiens
cauacugggcgugugcaucugaaucccgcuggagagcaaacacgaacuucuguucgcugcaaaa

SEQ ID NO: 603899 - RNA, 64 nt, Homo Sapiens
guauuuuguucuggcauuaaaagaaaaacaagcaagcaaacaaaaacacagccuccgaugccaa

SEQ ID NO: 603900 - RNA, 64 nt, Homo Sapiens
cuuaacugacccuaacguguaggcuaucacccaaagcaaacaucauaaauaagagaccaaaagu

SEQ ID NO: 603901 - RNA, 64 nt, Homo Sapiens
gcccauuacagguucagaacagcuagcccugguaagcaaacauacacacgaccaagucagcgag

SEQ ID NO: 603902 - RNA, 64 nt, Homo Sapiens
ccguccauuucugaagaggcguucuuuuauaugcagcaaacacaucuagcuacuuaaugguucu

SEQ ID NO: 603903 - RNA, 64 nt, Homo Sapiens
auaaagaaagauugugcacugaaugucuguucccagcaaacacggaccacccgagcuaaucaug

SEQ ID NO: 603904 - RNA, 64 nt, Homo Sapiens
gggaaagucagcaaaagaaagaaugcauuucgaaagcaaacagaagaaaaaaguauauucucac

SEQ ID NO: 603905 - RNA, 64 nt, Homo Sapiens
ucuuaaaccaguuuuuacuugucaguuuucucucagcaaacagucuuacuauuauguggaauuu

SEQ ID NO: 603906 - RNA, 64 nt, Homo Sapiens
agugaggcucuauugagccaggcugcccaaucugagcaaacaccgccaaguagcuuugggcaua

SEQ ID NO: 603907 - RNA, 64 nt, Homo Sapiens
ggaauaugacucaggagccuccaucucuccagagagcaaacauauaaaagauaaacaguuuagc

SEQ ID NO: 603908 - RNA, 64 nt, Homo Sapiens
guugaagagguaaaaaauaaauaaauacauaaaaagcaaacaagcggggacaccugcagucuua

SEQ ID NO: 603909 - RNA, 64 nt, Homo Sapiens
ccacauuuucauggaaugguacugugggagacugagcaaacacucuuuuggcaacuuaguagaa

SEQ ID NO: 603910 - RNA, 64 nt, Homo Sapiens
aacucugauaagaaaaguguucaauuuguauuuaagcaaacagugaacgacguuugcaaucaac

SEQ ID NO: 603911 - RNA, 64 nt, Homo Sapiens
acucuguggaguuuguucagugguacgguguccaagcaaacagcagaaugcaacuuucuaaaca

SEQ ID NO: 603912 - RNA, 64 nt, Homo Sapiens
caaacagcagaaugcaacuuucuaaacagccccaagcaaacagcagaauucaacuuuuuaaaca

SEQ ID NO: 603913 - RNA, 64 nt, Homo Sapiens
auaaucuggaauauucuacauggcuugauuacauagcaaacaagaccaagauuuagggcugucu

SEQ ID NO: 603914 - RNA, 64 nt, Homo Sapiens
guuuuuggcuaaguagaggacauggacuaguuguagcaaacagaacaugcuguuugcucuugcc

SEQ ID NO: 603915 - RNA, 64 nt, Homo Sapiens
uuucacuuuguagggugggggauuacugagagucaggcuagaccuguguuuagagaagcaguuu

SEQ ID NO: 603916 - RNA, 64 nt, Homo Sapiens
agggaggccuccaucuggaaaugggaggaugaagaggcuagaaucaucuuuccuagugauccug

SEQ ID NO: 603917 - RNA, 64 nt, Homo Sapiens
augagaguccugggugugaggaacaccucccaccaggcuagaggcaacugcccaggaaggacug

SEQ ID NO: 603918 - RNA, 64 nt, Homo Sapiens
uguuguuuuuaagauggaguuucccucuguugccaggcuagagugcaguggcaugaucucggcu

SEQ ID NO: 603919 - RNA, 64 nt, Homo Sapiens
auuuugccacguacuaacguucugcacaaaagacaggcuagacucuugucuagauuguuuaaaa

SEQ ID NO: 603920 - RNA, 64 nt, Homo Sapiens
uacaaucuaaccagccaucauaucauauccuaucaggcuagauaucucaauaguagacugaaua

SEQ ID NO: 603921 - RNA, 64 nt, Homo Sapiens
gcaguggugcaaucucagcuucacucugucucccaggcuagaguuauuuuuuugagacagauuc

SEQ ID NO: 603922 - RNA, 64 nt, Homo Sapiens
gcaguggugugaucucggcuucacucugucaccuaggcuagaguuuuuuguuugagauggaguc

SEQ ID NO: 603923 - RNA, 64 nt, Homo Sapiens
gucucuacuuuguauucuugugaggcacaaauauaggcuagaauccaggccccacaaauauagg

SEQ ID NO: 603924 - RNA, 64 nt, Homo Sapiens
caaauauaggcuagaauccaggccccacaaauauaggcuagaauccggaauguuuucuugauuu

SEQ ID NO: 603925 - RNA, 64 nt, Homo Sapiens
uggagaacuagaaccuggagggcuagaacuggagaggcuagaaccaagaagggcuagaaccugg

SEQ ID NO: 603926 - RNA, 64 nt, Homo Sapiens
uguagagcuagaacauggagagcuagaacccggcaggcuagaaccuggcaagcuagaaccugga

SEQ ID NO: 603927 - RNA, 62 nt, Homo Sapiens
gcuugauauguucaacuggagacacuauuuaucugugcaaauccuugauacugcucaucauu

SEQ ID NO: 603928 - RNA, 62 nt, Homo Sapiens
gagauguuucacgaaguuuguucaucagacuccugugcaacuuucccaauguggccuaaaaa

SEQ ID NO: 603929 - RNA, 62 nt, Homo Sapiens
aaauggggcugaggccccugaggaaccccuggcugugcaaaucgaaaacugcuguuuguggc

SEQ ID NO: 603930 - RNA, 62 nt, Homo Sapiens
gguuuuacuuaaacuucacugaaaggaacagucugugcaaugaccuucuuugugucugugau

SEQ ID NO: 603931 - RNA, 62 nt, Homo Sapiens
ccagccucuaggcuagcggcugcauucguggucugugcaaacacuucgugguucuauauauc

SEQ ID NO: 603932 - RNA, 62 nt, Homo Sapiens
cuugccuguguaauuuuaaaaaauuaauagagcugugcaaacccuguuauuuuuguaaaaaa

SEQ ID NO: 603933 - RNA, 62 nt, Homo Sapiens
acauuuuuguuacaaaccugcauugugaggaacugugcaaagugcuuuagcuauuaaugggg

SEQ ID NO: 603934 - RNA, 62 nt, Homo Sapiens
aguaguaccacguguagcauauuuugaucaaacugugcaaacuugacucaaaguagaucguu

SEQ ID NO: 603935 - RNA, 62 nt, Homo Sapiens
uuuucccauggaaugcagcaggcuucggccaccugugcaauauuuacuuuugucagaaucaa

SEQ ID NO: 603936 - RNA, 62 nt, Homo Sapiens
cccuauaaaagugauauuccgaaaacaaacaucugugcaaaacuucucaguagaaaggaaca

SEQ ID NO: 603937 - RNA, 62 nt, Homo Sapiens
uacuuuuggacauugagaaccauauugauuuacugugcaauuacuauauggacucuucauuu

SEQ ID NO: 603938 - RNA, 62 nt, Homo Sapiens
aauuaaagaacaaugaguguagcugcuccuuucugugcaaccagcaagcuaaauggcauccc

SEQ ID NO: 603939 - RNA, 62 nt, Homo Sapiens
uggugaaaccucaucucuacaacaagaucagccugugcaacacgcuucccuucacauuagaa

SEQ ID NO: 603940 - RNA, 62 nt, Homo Sapiens
uccucccgugcuucccuuugcuguuccauccucugugcaaaacccagcucucaggguugacu

SEQ ID NO: 603941 - RNA, 62 nt, Homo Sapiens
caaaugguucaauaaugaauuaucagagagcacugugcaagcgugguuuuuauggaccacau

SEQ ID NO: 603942 - RNA, 62 nt, Homo Sapiens
gcaaugcaacguggcccugcauccuuacaauacugugcaacugguuaggacaucgcugcuug

SEQ ID NO: 603943 - RNA, 64 nt, Homo Sapiens; identical to SEQ ID NO: 106478

SEQ ID NO: 603944 - RNA, 64 nt, Homo Sapiens; identical to SEQ ID NO: 106479

SEQ ID NO: 603945 - RNA, 64 nt, Homo Sapiens; identical to SEQ ID NO: 106480

SEQ ID NO: 603946 - RNA, 64 nt, Homo Sapiens; identical to SEQ ID NO: 106481

SEQ ID NO: 603947 - RNA, 64 nt, Homo Sapiens; identical to SEQ ID NO: 106482

SEQ ID NO: 603948 - RNA, 64 nt, Homo Sapiens; identical to SEQ ID NO: 106483

SEQ ID NO: 603949 - RNA, 64 nt, Homo Sapiens; identical to SEQ ID NO: 106484

SEQ ID NO: 603950 - RNA, 64 nt, Homo Sapiens; identical to SEQ ID NO: 106485

SEQ ID NO: 603951 - RNA, 64 nt, Homo Sapiens; identical to SEQ ID NO: 106486

SEQ ID NO: 603952 - RNA, 64 nt, Homo Sapiens; identical to SEQ ID NO: 106487

SEQ ID NO: 603953 - RNA, 64 nt, Homo Sapiens; identical to SEQ ID NO: 106488

SEQ ID NO: 603954 - RNA, 64 nt, Homo Sapiens; identical to SEQ ID NO: 106489

SEQ ID NO: 603955 - RNA, 64 nt, Homo Sapiens; identical to SEQ ID NO: 106490

SEQ ID NO: 603956 - RNA, 64 nt, Homo Sapiens; identical to SEQ ID NO: 106491

SEQ ID NO: 603957 - RNA, 64 nt, Homo Sapiens; identical to SEQ ID NO: 106492

SEQ ID NO: 603958 - RNA, 64 nt, Homo Sapiens; identical to SEQ ID NO: 106493

SEQ ID NO: 603959 - RNA, 64 nt, Homo Sapiens; identical to SEQ ID NO: 106494

SEQ ID NO: 603960 - RNA, 64 nt, Homo Sapiens; identical to SEQ ID NO: 311847

SEQ ID NO: 603961 - RNA, 64 nt, Homo Sapiens; identical to SEQ ID NO: 311848

SEQ ID NO: 603962 - RNA, 64 nt, Homo Sapiens; identical to SEQ ID NO: 311849

SEQ ID NO: 603963 - RNA, 64 nt, Homo Sapiens; identical to SEQ ID NO: 311850

SEQ ID NO: 603964 - RNA, 64 nt, Homo Sapiens; identical to SEQ ID NO: 311851

SEQ ID NO: 603965 - RNA, 64 nt, Homo Sapiens; identical to SEQ ID NO: 311852

SEQ ID NO: 603966 - RNA, 64 nt, Homo Sapiens; identical to SEQ ID NO: 311853

SEQ ID NO: 603967 - RNA, 64 nt, Homo Sapiens; identical to SEQ ID NO: 311854

SEQ ID NO: 603968 - RNA, 64 nt, Homo Sapiens; identical to SEQ ID NO: 311855

SEQ ID NO: 603969 - RNA, 64 nt, Homo Sapiens; identical to SEQ ID NO: 311856

SEQ ID NO: 603970 - RNA, 64 nt, Homo Sapiens; identical to SEQ ID NO: 311857

SEQ ID NO: 603971 - RNA, 64 nt, Homo Sapiens; identical to SEQ ID NO: 311858

SEQ ID NO: 603972 - RNA, 64 nt, Homo Sapiens; identical to SEQ ID NO: 311859

SEQ ID NO: 603973 - RNA, 64 nt, Homo Sapiens; identical to SEQ ID NO: 311860

SEQ ID NO: 603974 - RNA, 64 nt, Homo Sapiens; identical to SEQ ID NO: 311861

SEQ ID NO: 603975 - RNA, 64 nt, Homo Sapiens; identical to SEQ ID NO: 311862

SEQ ID NO: 603976 - RNA, 64 nt, Homo Sapiens; identical to SEQ ID NO: 311863

SEQ ID NO: 603977 - RNA, 64 nt, Homo Sapiens; identical to SEQ ID NO: 311864

SEQ ID NO: 603978 - RNA, 64 nt, Homo Sapiens; identical to SEQ ID NO: 311865

SEQ ID NO: 603979 - RNA, 64 nt, Homo Sapiens; identical to SEQ ID NO: 311866

SEQ ID NO: 603980 - RNA, 64 nt, Homo Sapiens; identical to SEQ ID NO: 311867

SEQ ID NO: 603981 - RNA, 64 nt, Homo Sapiens; identical to SEQ ID NO: 311868

SEQ ID NO: 603982 - RNA, 64 nt, Homo Sapiens; identical to SEQ ID NO: 311869

SEQ ID NO: 603983 - RNA, 64 nt, Homo Sapiens; identical to SEQ ID NO: 311870

SEQ ID NO: 603984 - RNA, 64 nt, Homo Sapiens; identical to SEQ ID NO: 311871

SEQ ID NO: 603985 - RNA, 64 nt, Homo Sapiens; identical to SEQ ID NO: 311872

SEQ ID NO: 603986 - RNA, 64 nt, Homo Sapiens; identical to SEQ ID NO: 311873

SEQ ID NO: 603987 - RNA, 64 nt, Homo Sapiens; identical to SEQ ID NO: 311874

SEQ ID NO: 603988 - RNA, 64 nt, Homo Sapiens; identical to SEQ ID NO: 311875

SEQ ID NO: 603989 - RNA, 64 nt, Homo Sapiens
gguccagaucuugcgcucagcacacucuagggaauaauuccacuccagagauggggcugcuuca

SEQ ID NO: 603990 - RNA, 64 nt, Homo Sapiens
uucuguuugcacuguuuguuuguaugauguuagcuaauuccacuguguauauaaauuguauuuu

SEQ ID NO: 603991 - RNA, 64 nt, Homo Sapiens
aguguucuuggcacauguauauuacuaaaguagauaauuccaaugagaaauacuaccagauuau

SEQ ID NO: 603992 - RNA, 64 nt, Homo Sapiens
acagagauuauuaauaugguagaacccuguuauguaauuccaaaacuuaagaaccauauuuaca

SEQ ID NO: 603993 - RNA, 64 nt, Homo Sapiens
uggauaucaguuaccaaacaaugaugugugaguguaauuccaugugccacauacauagaucuuc

SEQ ID NO: 603994 - RNA, 64 nt, Homo Sapiens
uugaugaagauguuuauugguagguaaauguauuuaauuccauauacuuaaaauaucucuaaaa

SEQ ID NO: 603995 - RNA, 64 nt, Homo Sapiens
uaauaacugaauucuugugauuccagauauuauuuaauuccauauagccaccuaaacauuuuaa

SEQ ID NO: 603996 - RNA, 64 nt, Homo Sapiens
uauuauuuaauuccauauaaccaccuaaacauuuuaauuccagaucaaauaauauagucauuag

SEQ ID NO: 603997 - RNA, 64 nt, Homo Sapiens
uagauaacugcauuuuguaguagccccucucuuauaauuccaggaaagaggagaugacuacauu

SEQ ID NO: 603998 - RNA, 64 nt, Homo Sapiens
uguucauucugugacccuagcaucacuggcucucuaauuccacucacagcuguuuccucacguc

SEQ ID NO: 603999 - RNA, 64 nt, Homo Sapiens
ccagaaaagccugugauccccauaauuaucuuacuaauuccaucucccucugcguaggaauaac

SEQ ID NO: 604000 - RNA, 64 nt, Homo Sapiens
cuguuacagaaaagcauuucggucagcuacaguuuaauuccacaaagggaucaugaaaaggucu

SEQ ID NO: 604001 - RNA, 64 nt, Homo Sapiens
uuucuaagaaaugugaaauagaacaauuuucaucuaauuccauuuacuuuuagaugaauggcau

SEQ ID NO: 604002 - RNA, 64 nt, Homo Sapiens
aaugaauuucaagagaauucucugguuuucuguguaauuccagaugagucacuguaacucuaga

SEQ ID NO: 604003 - RNA, 64 nt, Homo Sapiens
cuuugugcauuugucaucugucccucccuaccuguaauuccagugcauagcuaucaccuguagc

SEQ ID NO: 604004 - RNA, 64 nt, Homo Sapiens
cuagggcuuucaugacucaauauguaauuuucuuuaauuccaaauuccggacaacugccaaauc

SEQ ID NO: 604005 - RNA, 64 nt, Homo Sapiens
gagaauaacauuuuuuccuucuucaggguggcuguaauuccagguggccgugauuucuuucuuc

SEQ ID NO: 604006 - RNA, 64 nt, Homo Sapiens
aagcuaauggcacaggagacaucagggcagcuguuaauuccaaauauuuguucccaaguagcua

SEQ ID NO: 604007 - RNA, 64 nt, Homo Sapiens
ucugccuggcaacugugucucccugugcuauauuuaauuccaccagcaaagcuggcgaggcagg

SEQ ID NO: 604008 - RNA, 64 nt, Homo Sapiens
uauauaggugaaugccuucaagaaauguguaauuuaauuccaaauaguuccccccaaaauacac

SEQ ID NO: 604009 - RNA, 64 nt, Homo Sapiens
uagauuucuguauaaauuguaaaguaauuagguauaauuccaaauauuugaaguuucuuaguaa

SEQ ID NO: 604010 - RNA, 64 nt, Homo Sapiens
auacagaguaucuuggcauuguaucuaucggugauaauuccaugucaccuacauggccauuaga

SEQ ID NO: 604011 - RNA, 64 nt, Homo Sapiens; identical to SEQ ID NO: 176114

SEQ ID NO: 604012 - RNA, 64 nt, Homo Sapiens; identical to SEQ ID NO: 176115

SEQ ID NO: 604013 - RNA, 64 nt, Homo Sapiens; identical to SEQ ID NO: 176116

SEQ ID NO: 604014 - RNA, 64 nt, Homo Sapiens; identical to SEQ ID NO: 176117

SEQ ID NO: 604015 - RNA, 64 nt, Homo Sapiens; identical to SEQ ID NO: 176118

SEQ ID NO: 604016 - RNA, 64 nt, Homo Sapiens; identical to SEQ ID NO: 176119

SEQ ID NO: 604017 - RNA, 64 nt, Homo Sapiens; identical to SEQ ID NO: 176120

SEQ ID NO: 604018 - RNA, 64 nt, Homo Sapiens; identical to SEQ ID NO: 176121

SEQ ID NO: 604019 - RNA, 64 nt, Homo Sapiens; identical to SEQ ID NO: 176122

SEQ ID NO: 604020 - RNA, 64 nt, Homo Sapiens; identical to SEQ ID NO: 176123

SEQ ID NO: 604021 - RNA, 64 nt, Homo Sapiens; identical to SEQ ID NO: 176124

SEQ ID NO: 604022 - RNA, 64 nt, Homo Sapiens; identical to SEQ ID NO: 176125

SEQ ID NO: 604023 - RNA, 64 nt, Homo Sapiens; identical to SEQ ID NO: 176126

SEQ ID NO: 604024 - RNA, 64 nt, Homo Sapiens; identical to SEQ ID NO: 176127

SEQ ID NO: 604025 - RNA, 64 nt, Homo Sapiens; identical to SEQ ID NO: 176128

SEQ ID NO: 604026 - RNA, 64 nt, Homo Sapiens; identical to SEQ ID NO: 176129

SEQ ID NO: 604027 - RNA, 64 nt, Homo Sapiens; identical to SEQ ID NO: 176130

SEQ ID NO: 604028 - RNA, 64 nt, Homo Sapiens; identical to SEQ ID NO: 176131

SEQ ID NO: 604029 - RNA, 64 nt, Homo Sapiens; identical to SEQ ID NO: 176132

SEQ ID NO: 604030 - RNA, 64 nt, Homo Sapiens; identical to SEQ ID NO: 176133

SEQ ID NO: 604031 - RNA, 64 nt, Homo Sapiens; identical to SEQ ID NO: 176134

SEQ ID NO: 604032 - RNA, 64 nt, Homo Sapiens; identical to SEQ ID NO: 176135

SEQ ID NO: 604033 - RNA, 64 nt, Homo Sapiens; identical to SEQ ID NO: 176136

SEQ ID NO: 604034 - RNA, 64 nt, Homo Sapiens; identical to SEQ ID NO: 176137

SEQ ID NO: 604035 - RNA, 64 nt, Homo Sapiens; identical to SEQ ID NO: 176138

SEQ ID NO: 604036 - RNA, 64 nt, Homo Sapiens; identical to SEQ ID NO: 176139

SEQ ID NO: 604037 - RNA, 64 nt, Homo Sapiens; identical to SEQ ID NO: 176140

SEQ ID NO: 604038 - RNA, 64 nt, Homo Sapiens; identical to SEQ ID NO: 176141

SEQ ID NO: 604039 - RNA, 64 nt, Homo Sapiens; identical to SEQ ID NO: 176142

SEQ ID NO: 604040 - RNA, 64 nt, Homo Sapiens; identical to SEQ ID NO: 176143

SEQ ID NO: 604041 - RNA, 64 nt, Homo Sapiens; identical to SEQ ID NO: 176144

SEQ ID NO: 604042 - RNA, 64 nt, Homo Sapiens; identical to SEQ ID NO: 176145

SEQ ID NO: 604043 - RNA, 64 nt, Homo Sapiens; identical to SEQ ID NO: 176146

SEQ ID NO: 604044 - RNA, 64 nt, Homo Sapiens; identical to SEQ ID NO: 176147

SEQ ID NO: 604045 - RNA, 64 nt, Homo Sapiens; identical to SEQ ID NO: 176148

SEQ ID NO: 604046 - RNA, 64 nt, Homo Sapiens; identical to SEQ ID NO: 176149

SEQ ID NO: 604047 - RNA, 64 nt, Homo Sapiens; identical to SEQ ID NO: 176150

SEQ ID NO: 604048 - RNA, 64 nt, Homo Sapiens; identical to SEQ ID NO: 176151

SEQ ID NO: 604049 - RNA, 64 nt, Homo Sapiens; identical to SEQ ID NO: 176152

SEQ ID NO: 604050 - RNA, 64 nt, Homo Sapiens; identical to SEQ ID NO: 176153

SEQ ID NO: 604051 - RNA, 64 nt, Homo Sapiens; identical to SEQ ID NO: 176154

SEQ ID NO: 604052 - RNA, 64 nt, Homo Sapiens; identical to SEQ ID NO: 176155

SEQ ID NO: 604053 - RNA, 64 nt, Homo Sapiens; identical to SEQ ID NO: 176156

SEQ ID NO: 604054 - RNA, 57 nt, Homo Sapiens; identical to SEQ ID NO: 176157

SEQ ID NO: 604055 - RNA, 64 nt, Homo Sapiens; identical to SEQ ID NO: 176158

SEQ ID NO: 604056 - RNA, 64 nt, Homo Sapiens; identical to SEQ ID NO: 176159

SEQ ID NO: 604057 - RNA, 64 nt, Homo Sapiens; identical to SEQ ID NO: 176160

SEQ ID NO: 604058 - RNA, 64 nt, Homo Sapiens; identical to SEQ ID NO: 176161

SEQ ID NO: 604059 - RNA, 64 nt, Homo Sapiens; identical to SEQ ID NO: 176162

SEQ ID NO: 604060 - RNA, 64 nt, Homo Sapiens; identical to SEQ ID NO: 176163

SEQ ID NO: 604061 - RNA, 64 nt, Homo Sapiens; identical to SEQ ID NO: 176164

SEQ ID NO: 604062 - RNA, 64 nt, Homo Sapiens; identical to SEQ ID NO: 176165

SEQ ID NO: 604063 - RNA, 64 nt, Homo Sapiens; identical to SEQ ID NO: 176166

SEQ ID NO: 604064 - RNA, 64 nt, Homo Sapiens; identical to SEQ ID NO: 176167

SEQ ID NO: 604065 - RNA, 64 nt, Homo Sapiens; identical to SEQ ID NO: 176168

SEQ ID NO: 604066 - RNA, 64 nt, Homo Sapiens; identical to SEQ ID NO: 176169

SEQ ID NO: 604067 - RNA, 64 nt, Homo Sapiens; identical to SEQ ID NO: 176170

SEQ ID NO: 604068 - RNA, 64 nt, Homo Sapiens; identical to SEQ ID NO: 176171

SEQ ID NO: 604069 - RNA, 64 nt, Homo Sapiens; identical to SEQ ID NO: 176172

SEQ ID NO: 604070 - RNA, 64 nt, Homo Sapiens; identical to SEQ ID NO: 176173

SEQ ID NO: 604071 - RNA, 64 nt, Homo Sapiens; identical to SEQ ID NO: 176174

SEQ ID NO: 604072 - RNA, 64 nt, Homo Sapiens; identical to SEQ ID NO: 176175

SEQ ID NO: 604073 - RNA, 64 nt, Homo Sapiens; identical to SEQ ID NO: 176176

SEQ ID NO: 604074 - RNA, 64 nt, Homo Sapiens; identical to SEQ ID NO: 176177

SEQ ID NO: 604075 - RNA, 64 nt, Homo Sapiens; identical to SEQ ID NO: 176178

SEQ ID NO: 604076 - RNA, 64 nt, Homo Sapiens; identical to SEQ ID NO: 176179

SEQ ID NO: 604077 - RNA, 64 nt, Homo Sapiens; identical to SEQ ID NO: 176180

SEQ ID NO: 604078 - RNA, 64 nt, Homo Sapiens; identical to SEQ ID NO: 176181

SEQ ID NO: 604079 - RNA, 64 nt, Homo Sapiens; identical to SEQ ID NO: 176182

SEQ ID NO: 604080 - RNA, 64 nt, Homo Sapiens; identical to SEQ ID NO: 176183

SEQ ID NO: 604081 - RNA, 64 nt, Homo Sapiens; identical to SEQ ID NO: 176184

SEQ ID NO: 604082 - RNA, 64 nt, Homo Sapiens; identical to SEQ ID NO: 176185

SEQ ID NO: 604083 - RNA, 64 nt, Homo Sapiens; identical to SEQ ID NO: 176186

SEQ ID NO: 604084 - RNA, 64 nt, Homo Sapiens; identical to SEQ ID NO: 176187

SEQ ID NO: 604085 - RNA, 64 nt, Homo Sapiens; identical to SEQ ID NO: 176188

SEQ ID NO: 604086 - RNA, 64 nt, Homo Sapiens; identical to SEQ ID NO: 176189

SEQ ID NO: 604087 - RNA, 64 nt, Homo Sapiens; identical to SEQ ID NO: 176190

SEQ ID NO: 604088 - RNA, 64 nt, Homo Sapiens; identical to SEQ ID NO: 176191

SEQ ID NO: 604089 - RNA, 64 nt, Homo Sapiens; identical to SEQ ID NO: 176192

SEQ ID NO: 604090 - RNA, 64 nt, Homo Sapiens; identical to SEQ ID NO: 176193

SEQ ID NO: 604091 - RNA, 53 nt, Homo Sapiens; identical to SEQ ID NO: 176194

SEQ ID NO: 604092 - RNA, 64 nt, Homo Sapiens; identical to SEQ ID NO: 176195

SEQ ID NO: 604093 - RNA, 64 nt, Homo Sapiens; identical to SEQ ID NO: 176196

SEQ ID NO: 604094 - RNA, 64 nt, Homo Sapiens; identical to SEQ ID NO: 176197

SEQ ID NO: 604095 - RNA, 64 nt, Homo Sapiens; identical to SEQ ID NO: 176198

SEQ ID NO: 604096 - RNA, 64 nt, Homo Sapiens; identical to SEQ ID NO: 176199

SEQ ID NO: 604097 - RNA, 64 nt, Homo Sapiens; identical to SEQ ID NO: 176200

SEQ ID NO: 604098 - RNA, 64 nt, Homo Sapiens; identical to SEQ ID NO: 176201

SEQ ID NO: 604099 - RNA, 64 nt, Homo Sapiens; identical to SEQ ID NO: 176202

SEQ ID NO: 604100 - RNA, 64 nt, Homo Sapiens; identical to SEQ ID NO: 176203

SEQ ID NO: 604101 - RNA, 64 nt, Homo Sapiens; identical to SEQ ID NO: 176204

SEQ ID NO: 604102 - RNA, 64 nt, Homo Sapiens; identical to SEQ ID NO: 176205

SEQ ID NO: 604103 - RNA, 64 nt, Homo Sapiens; identical to SEQ ID NO: 176206

SEQ ID NO: 604104 - RNA, 64 nt, Homo Sapiens; identical to SEQ ID NO: 176207

SEQ ID NO: 604105 - RNA, 64 nt, Homo Sapiens; identical to SEQ ID NO: 176208

SEQ ID NO: 604106 - RNA, 64 nt, Homo Sapiens; identical to SEQ ID NO: 176209

SEQ ID NO: 604107 - RNA, 64 nt, Homo Sapiens; identical to SEQ ID NO: 176210

SEQ ID NO: 604108 - RNA, 64 nt, Homo Sapiens; identical to SEQ ID NO: 176211

SEQ ID NO: 604109 - RNA, 64 nt, Homo Sapiens; identical to SEQ ID NO: 176212

SEQ ID NO: 604110 - RNA, 64 nt, Homo Sapiens; identical to SEQ ID NO: 176213

SEQ ID NO: 604111 - RNA, 64 nt, Homo Sapiens; identical to SEQ ID NO: 176214

SEQ ID NO: 604112 - RNA, 64 nt, Homo Sapiens; identical to SEQ ID NO: 176215

SEQ ID NO: 604113 - RNA, 64 nt, Homo Sapiens; identical to SEQ ID NO: 176216

SEQ ID NO: 604114 - RNA, 64 nt, Homo Sapiens; identical to SEQ ID NO: 176217

SEQ ID NO: 604115 - RNA, 64 nt, Homo Sapiens; identical to SEQ ID NO: 176218

SEQ ID NO: 604116 - RNA, 64 nt, Homo Sapiens; identical to SEQ ID NO: 176219

SEQ ID NO: 604117 - RNA, 64 nt, Homo Sapiens; identical to SEQ ID NO: 176220

SEQ ID NO: 604118 - RNA, 64 nt, Homo Sapiens; identical to SEQ ID NO: 176221

SEQ ID NO: 604119 - RNA, 64 nt, Homo Sapiens; identical to SEQ ID NO: 176222

SEQ ID NO: 604120 - RNA, 64 nt, Homo Sapiens; identical to SEQ ID NO: 176223

SEQ ID NO: 604121 - RNA, 64 nt, Homo Sapiens; identical to SEQ ID NO: 176224

SEQ ID NO: 604122 - RNA, 64 nt, Homo Sapiens; identical to SEQ ID NO: 176225

SEQ ID NO: 604123 - RNA, 64 nt, Homo Sapiens; identical to SEQ ID NO: 176226

SEQ ID NO: 604124 - RNA, 64 nt, Homo Sapiens; identical to SEQ ID NO: 176227

SEQ ID NO: 604125 - RNA, 64 nt, Homo Sapiens; identical to SEQ ID NO: 176228

SEQ ID NO: 604126 - RNA, 64 nt, Homo Sapiens; identical to SEQ ID NO: 176229

SEQ ID NO: 604127 - RNA, 64 nt, Homo Sapiens; identical to SEQ ID NO: 176230

SEQ ID NO: 604128 - RNA, 64 nt, Homo Sapiens; identical to SEQ ID NO: 176231

SEQ ID NO: 604129 - RNA, 64 nt, Homo Sapiens; identical to SEQ ID NO: 176232

SEQ ID NO: 604130 - RNA, 64 nt, Homo Sapiens; identical to SEQ ID NO: 176233

SEQ ID NO: 604131 - RNA, 64 nt, Homo Sapiens; identical to SEQ ID NO: 176234

SEQ ID NO: 604132 - RNA, 64 nt, Homo Sapiens; identical to SEQ ID NO: 176235

SEQ ID NO: 604133 - RNA, 64 nt, Homo Sapiens; identical to SEQ ID NO: 176236

SEQ ID NO: 604134 - RNA, 64 nt, Homo Sapiens; identical to SEQ ID NO: 176237

SEQ ID NO: 604135 - RNA, 64 nt, Homo Sapiens; identical to SEQ ID NO: 176238

SEQ ID NO: 604136 - RNA, 51 nt, Homo Sapiens; identical to SEQ ID NO: 176239

SEQ ID NO: 604137 - RNA, 64 nt, Homo Sapiens; identical to SEQ ID NO: 176240

SEQ ID NO: 604138 - RNA, 64 nt, Homo Sapiens; identical to SEQ ID NO: 176241

SEQ ID NO: 604139 - RNA, 64 nt, Homo Sapiens; identical to SEQ ID NO: 176242

SEQ ID NO: 604140 - RNA, 64 nt, Homo Sapiens; identical to SEQ ID NO: 176243

SEQ ID NO: 604141 - RNA, 64 nt, Homo Sapiens; identical to SEQ ID NO: 176244

SEQ ID NO: 604142 - RNA, 64 nt, Homo Sapiens; identical to SEQ ID NO: 176245

SEQ ID NO: 604143 - RNA, 64 nt, Homo Sapiens; identical to SEQ ID NO: 176246

SEQ ID NO: 604144 - RNA, 64 nt, Homo Sapiens; identical to SEQ ID NO: 176247

SEQ ID NO: 604145 - RNA, 64 nt, Homo Sapiens; identical to SEQ ID NO: 176248

SEQ ID NO: 604146 - RNA, 64 nt, Homo Sapiens; identical to SEQ ID NO: 176249

SEQ ID NO: 604147 - RNA, 64 nt, Homo Sapiens; identical to SEQ ID NO: 176250

SEQ ID NO: 604148 - RNA, 64 nt, Homo Sapiens; identical to SEQ ID NO: 176251

SEQ ID NO: 604149 - RNA, 64 nt, Homo Sapiens; identical to SEQ ID NO: 176252

SEQ ID NO: 604150 - RNA, 64 nt, Homo Sapiens; identical to SEQ ID NO: 176253

SEQ ID NO: 604151 - RNA, 64 nt, Homo Sapiens; identical to SEQ ID NO: 176254

SEQ ID NO: 604152 - RNA, 64 nt, Homo Sapiens; identical to SEQ ID NO: 176255

SEQ ID NO: 604153 - RNA, 64 nt, Homo Sapiens; identical to SEQ ID NO: 176256

SEQ ID NO: 604154 - RNA, 64 nt, Homo Sapiens; identical to SEQ ID NO: 176257

SEQ ID NO: 604155 - RNA, 64 nt, Homo Sapiens; identical to SEQ ID NO: 176258

SEQ ID NO: 604156 - RNA, 64 nt, Homo Sapiens; identical to SEQ ID NO: 176259

SEQ ID NO: 604157 - RNA, 64 nt, Homo Sapiens; identical to SEQ ID NO: 176260

SEQ ID NO: 604158 - RNA, 64 nt, Homo Sapiens; identical to SEQ ID NO: 176261

SEQ ID NO: 604159 - RNA, 64 nt, Homo Sapiens; identical to SEQ ID NO: 176262

SEQ ID NO: 604160 - RNA, 64 nt, Homo Sapiens; identical to SEQ ID NO: 176263

SEQ ID NO: 604161 - RNA, 64 nt, Homo Sapiens; identical to SEQ ID NO: 176264

SEQ ID NO: 604162 - RNA, 64 nt, Homo Sapiens; identical to SEQ ID NO: 176265

SEQ ID NO: 604163 - RNA, 64 nt, Homo Sapiens; identical to SEQ ID NO: 176266

SEQ ID NO: 604164 - RNA, 64 nt, Homo Sapiens; identical to SEQ ID NO: 176267

SEQ ID NO: 604165 - RNA, 64 nt, Homo Sapiens; identical to SEQ ID NO: 176268

SEQ ID NO: 604166 - RNA, 64 nt, Homo Sapiens; identical to SEQ ID NO: 176269

SEQ ID NO: 604167 - RNA, 53 nt, Homo Sapiens; identical to SEQ ID NO: 176270

SEQ ID NO: 604168 - RNA, 64 nt, Homo Sapiens; identical to SEQ ID NO: 176271

SEQ ID NO: 604169 - RNA, 64 nt, Homo Sapiens; identical to SEQ ID NO: 176272

SEQ ID NO: 604170 - RNA, 64 nt, Homo Sapiens; identical to SEQ ID NO: 48305

SEQ ID NO: 604171 - RNA, 64 nt, Homo Sapiens; identical to SEQ ID NO: 48306

SEQ ID NO: 604172 - RNA, 64 nt, Homo Sapiens; identical to SEQ ID NO: 48307

SEQ ID NO: 604173 - RNA, 64 nt, Homo Sapiens; identical to SEQ ID NO: 48308

SEQ ID NO: 604174 - RNA, 64 nt, Homo Sapiens; identical to SEQ ID NO: 48309

SEQ ID NO: 604175 - RNA, 64 nt, Homo Sapiens; identical to SEQ ID NO: 48310

SEQ ID NO: 604176 - RNA, 64 nt, Homo Sapiens; identical to SEQ ID NO: 48311

SEQ ID NO: 604177 - RNA, 64 nt, Homo Sapiens; identical to SEQ ID NO: 48312

SEQ ID NO: 604178 - RNA, 64 nt, Homo Sapiens; identical to SEQ ID NO: 48313

SEQ ID NO: 604179 - RNA, 64 nt, Homo Sapiens; identical to SEQ ID NO: 48314

SEQ ID NO: 604180 - RNA, 64 nt, Homo Sapiens; identical to SEQ ID NO: 48315

SEQ ID NO: 604181 - RNA, 64 nt, Homo Sapiens; identical to SEQ ID NO: 48316

SEQ ID NO: 604182 - RNA, 64 nt, Homo Sapiens; identical to SEQ ID NO: 48317

SEQ ID NO: 604183 - RNA, 64 nt, Homo Sapiens; identical to SEQ ID NO: 48318

SEQ ID NO: 604184 - RNA, 64 nt, Homo Sapiens; identical to SEQ ID NO: 48319

SEQ ID NO: 604185 - RNA, 64 nt, Homo Sapiens; identical to SEQ ID NO: 48320

SEQ ID NO: 604186 - RNA, 64 nt, Homo Sapiens; identical to SEQ ID NO: 48321

SEQ ID NO: 604187 - RNA, 64 nt, Homo Sapiens; identical to SEQ ID NO: 48322

SEQ ID NO: 604188 - RNA, 64 nt, Homo Sapiens; identical to SEQ ID NO: 48323

SEQ ID NO: 604189 - RNA, 64 nt, Homo Sapiens; identical to SEQ ID NO: 48324

SEQ ID NO: 604190 - RNA, 64 nt, Homo Sapiens; identical to SEQ ID NO: 48325

SEQ ID NO: 604191 - RNA, 64 nt, Homo Sapiens; identical to SEQ ID NO: 48326

SEQ ID NO: 604192 - RNA, 64 nt, Homo Sapiens; identical to SEQ ID NO: 48327

SEQ ID NO: 604193 - RNA, 64 nt, Homo Sapiens; identical to SEQ ID NO: 48328

SEQ ID NO: 604194 - RNA, 64 nt, Homo Sapiens; identical to SEQ ID NO: 48329

SEQ ID NO: 604195 - RNA, 51 nt, Homo Sapiens; identical to SEQ ID NO: 48330

SEQ ID NO: 604196 - RNA, 64 nt, Homo Sapiens; identical to SEQ ID NO: 48331

SEQ ID NO: 604197 - RNA, 64 nt, Homo Sapiens; identical to SEQ ID NO: 48332

SEQ ID NO: 604198 - RNA, 64 nt, Homo Sapiens; identical to SEQ ID NO: 48333

SEQ ID NO: 604199 - RNA, 64 nt, Homo Sapiens; identical to SEQ ID NO: 48334

SEQ ID NO: 604200 - RNA, 64 nt, Homo Sapiens; identical to SEQ ID NO: 48335

SEQ ID NO: 604201 - RNA, 64 nt, Homo Sapiens; identical to SEQ ID NO: 48336

SEQ ID NO: 604202 - RNA, 64 nt, Homo Sapiens; identical to SEQ ID NO: 48337

SEQ ID NO: 604203 - RNA, 64 nt, Homo Sapiens; identical to SEQ ID NO: 48338

SEQ ID NO: 604204 - RNA, 64 nt, Homo Sapiens; identical to SEQ ID NO: 48339

SEQ ID NO: 604205 - RNA, 64 nt, Homo Sapiens; identical to SEQ ID NO: 48340

SEQ ID NO: 604206 - RNA, 64 nt, Homo Sapiens; identical to SEQ ID NO: 48341

SEQ ID NO: 604207 - RNA, 64 nt, Homo Sapiens; identical to SEQ ID NO: 48342

SEQ ID NO: 604208 - RNA, 64 nt, Homo Sapiens; identical to SEQ ID NO: 48343

SEQ ID NO: 604209 - RNA, 64 nt, Homo Sapiens; identical to SEQ ID NO: 48344

SEQ ID NO: 604210 - RNA, 64 nt, Homo Sapiens; identical to SEQ ID NO: 48345

SEQ ID NO: 604211 - RNA, 64 nt, Homo Sapiens; identical to SEQ ID NO: 48346

SEQ ID NO: 604212 - RNA, 64 nt, Homo Sapiens; identical to SEQ ID NO: 48347

SEQ ID NO: 604213 - RNA, 64 nt, Homo Sapiens; identical to SEQ ID NO: 48348

SEQ ID NO: 604214 - RNA, 64 nt, Homo Sapiens; identical to SEQ ID NO: 48349

SEQ ID NO: 604215 - RNA, 64 nt, Homo Sapiens; identical to SEQ ID NO: 123549

SEQ ID NO: 604216 - RNA, 64 nt, Homo Sapiens; identical to SEQ ID NO: 123550

SEQ ID NO: 604217 - RNA, 64 nt, Homo Sapiens; identical to SEQ ID NO: 123551

SEQ ID NO: 604218 - RNA, 64 nt, Homo Sapiens; identical to SEQ ID NO: 123552

SEQ ID NO: 604219 - RNA, 64 nt, Homo Sapiens; identical to SEQ ID NO: 123553

SEQ ID NO: 604220 - RNA, 64 nt, Homo Sapiens; identical to SEQ ID NO: 123554

SEQ ID NO: 604221 - RNA, 64 nt, Homo Sapiens; identical to SEQ ID NO: 123555

SEQ ID NO: 604222 - RNA, 64 nt, Homo Sapiens; identical to SEQ ID NO: 123556

SEQ ID NO: 604223 - RNA, 64 nt, Homo Sapiens; identical to SEQ ID NO: 123557

SEQ ID NO: 604224 - RNA, 64 nt, Homo Sapiens; identical to SEQ ID NO: 123558

SEQ ID NO: 604225 - RNA, 64 nt, Homo Sapiens; identical to SEQ ID NO: 123559

SEQ ID NO: 604226 - RNA, 64 nt, Homo Sapiens; identical to SEQ ID NO: 123560

SEQ ID NO: 604227 - RNA, 64 nt, Homo Sapiens; identical to SEQ ID NO: 123561

SEQ ID NO: 604228 - RNA, 64 nt, Homo Sapiens; identical to SEQ ID NO: 123562

SEQ ID NO: 604229 - RNA, 64 nt, Homo Sapiens; identical to SEQ ID NO: 123563

SEQ ID NO: 604230 - RNA, 64 nt, Homo Sapiens; identical to SEQ ID NO: 123564

SEQ ID NO: 604231 - RNA, 64 nt, Homo Sapiens; identical to SEQ ID NO: 123565

SEQ ID NO: 604232 - RNA, 64 nt, Homo Sapiens; identical to SEQ ID NO: 123566

SEQ ID NO: 604233 - RNA, 64 nt, Homo Sapiens; identical to SEQ ID NO: 123567

SEQ ID NO: 604234 - RNA, 64 nt, Homo Sapiens; identical to SEQ ID NO: 123568

SEQ ID NO: 604235 - RNA, 64 nt, Homo Sapiens; identical to SEQ ID NO: 123569

SEQ ID NO: 604236 - RNA, 64 nt, Homo Sapiens; identical to SEQ ID NO: 123570

SEQ ID NO: 604237 - RNA, 64 nt, Homo Sapiens; identical to SEQ ID NO: 123571

SEQ ID NO: 604238 - RNA, 64 nt, Homo Sapiens; identical to SEQ ID NO: 123572

SEQ ID NO: 604239 - RNA, 64 nt, Homo Sapiens; identical to SEQ ID NO: 123573

SEQ ID NO: 604240 - RNA, 64 nt, Homo Sapiens; identical to SEQ ID NO: 123574

SEQ ID NO: 604241 - RNA, 64 nt, Homo Sapiens; identical to SEQ ID NO: 123575

SEQ ID NO: 604242 - RNA, 64 nt, Homo Sapiens; identical to SEQ ID NO: 123576

SEQ ID NO: 604243 - RNA, 64 nt, Homo Sapiens; identical to SEQ ID NO: 123577

SEQ ID NO: 604244 - RNA, 64 nt, Homo Sapiens; identical to SEQ ID NO: 123578

SEQ ID NO: 604245 - RNA, 64 nt, Homo Sapiens; identical to SEQ ID NO: 123579

SEQ ID NO: 604246 - RNA, 64 nt, Homo Sapiens; identical to SEQ ID NO: 123580

SEQ ID NO: 604247 - RNA, 64 nt, Homo Sapiens; identical to SEQ ID NO: 123581

SEQ ID NO: 604248 - RNA, 64 nt, Homo Sapiens; identical to SEQ ID NO: 123582

SEQ ID NO: 604249 - RNA, 64 nt, Homo Sapiens; identical to SEQ ID NO: 123583

SEQ ID NO: 604250 - RNA, 64 nt, Homo Sapiens; identical to SEQ ID NO: 123584

SEQ ID NO: 604251 - RNA, 64 nt, Homo Sapiens; identical to SEQ ID NO: 123585

SEQ ID NO: 604252 - RNA, 64 nt, Homo Sapiens; identical to SEQ ID NO: 123586

SEQ ID NO: 604253 - RNA, 64 nt, Homo Sapiens; identical to SEQ ID NO: 123587

SEQ ID NO: 604254 - RNA, 64 nt, Homo Sapiens; identical to SEQ ID NO: 123588

SEQ ID NO: 604255 - RNA, 64 nt, Homo Sapiens; identical to SEQ ID NO: 123589

SEQ ID NO: 604256 - RNA, 64 nt, Homo Sapiens; identical to SEQ ID NO: 123590

SEQ ID NO: 604257 - RNA, 64 nt, Homo Sapiens; identical to SEQ ID NO: 123591

SEQ ID NO: 604258 - RNA, 64 nt, Homo Sapiens; identical to SEQ ID NO: 123592

SEQ ID NO: 604259 - RNA, 64 nt, Homo Sapiens; identical to SEQ ID NO: 123593

SEQ ID NO: 604260 - RNA, 64 nt, Homo Sapiens; identical to SEQ ID NO: 123594

SEQ ID NO: 604261 - RNA, 64 nt, Homo Sapiens; identical to SEQ ID NO: 123595

SEQ ID NO: 604262 - RNA, 64 nt, Homo Sapiens; identical to SEQ ID NO: 123596

SEQ ID NO: 604263 - RNA, 64 nt, Homo Sapiens; identical to SEQ ID NO: 123597

SEQ ID NO: 604264 - RNA, 64 nt, Homo Sapiens; identical to SEQ ID NO: 123598

SEQ ID NO: 604265 - RNA, 64 nt, Homo Sapiens; identical to SEQ ID NO: 123599

SEQ ID NO: 604266 - RNA, 64 nt, Homo Sapiens; identical to SEQ ID NO: 123600

SEQ ID NO: 604267 - RNA, 64 nt, Homo Sapiens; identical to SEQ ID NO: 123601

SEQ ID NO: 604268 - RNA, 64 nt, Homo Sapiens
gauucaccgcgugcucugcgcggccgaggccggagcaccacauccaccucgccccagagaggcu

SEQ ID NO: 604269 - RNA, 64 nt, Homo Sapiens
gggugguggggacggcaguggugaugaagggggugcaccacaggccucaugaagcaguucccac

SEQ ID NO: 604270 - RNA, 64 nt, Homo Sapiens
acacuuauuuccacauugacauacauucuucucagcaccacaucccaccccaaaucaacagaau

SEQ ID NO: 604271 - RNA, 64 nt, Homo Sapiens
gaggugggugaagcacuucgcuuuuucuguagaggcaccacagguucggaaugccugcuuaccu

SEQ ID NO: 604272 - RNA, 64 nt, Homo Sapiens
uacuaccuuuuaaaauauuuuagauaaaugcacagcaccacagcaccacaucuaagcauuagug

SEQ ID NO: 604273 - RNA, 64 nt, Homo Sapiens
uuuaaaauauuuuagauaaaugcacagcaccacagcaccacaucuaagcauuagugauggguag

SEQ ID NO: 604274 - RNA, 64 nt, Homo Sapiens
gcucacaaacucuuuccaaaacccuuugucuagagcaccacaccacucucucuucuccuuccua

SEQ ID NO: 604275 - RNA, 64 nt, Homo Sapiens
ccccacuuccagcagagucccccacccucagugggcaccacacacucacaggaacuguucaguu

SEQ ID NO: 604276 - RNA, 64 nt, Homo Sapiens
gauccuuccgguggagugucggagaagagagcuugccgacgaugccuuccugugcagagcuugg

SEQ ID NO: 604277 - RNA, 64 nt, Homo Sapiens
accagaaccaccaccuggagagaugaucgccgucgccgacgagacgcgcugaacgaggccaagc

SEQ ID NO: 604278 - RNA, 64 nt, Homo Sapiens
cccagaauccagaacuuugugauuacaagcaugcgccgacgaugugucucaaccucccaaguag

SEQ ID NO: 604279 - RNA, 64 nt, Homo Sapiens
acaaggucaucaugcuccacugguggacgagggugccgacgagugcugcucacccugcggcacg

SEQ ID NO: 604280 - RNA, 64 nt, Homo Sapiens
ccgccgccagccugaccucacggccccggucgcagccgacgacggaugcagggacgcgcgacgc

SEQ ID NO: 604281 - RNA, 64 nt, Homo Sapiens
uugucucugcagccccagguccucacccugcccugccgacgagccugccauuccacccaugguc

SEQ ID NO: 604282 - RNA, 64 nt, Homo Sapiens
aguaggaaaagagaagggcucuagaacugguccagccgacgaagcugauuggcaucacauugau

SEQ ID NO: 604283 - RNA, 64 nt, Homo Sapiens
agaugaagcagcucacagagagaagcaacuucuggccgacgagacauggccgaggagacaaggc

SEQ ID NO: 604284 - RNA, 64 nt, Homo Sapiens
cuaccaguuugcuaaguacagaucauucaagguggccgacgaggcggagaaguacaaucugguc

SEQ ID NO: 604285 - RNA, 64 nt, Homo Sapiens
gacuaacuccugcaacuggaaagcgggggcgcccgccgacgaggaggccaccgugccaagccgg

SEQ ID NO: 604286 - RNA, 64 nt, Homo Sapiens
cgacacgcggcagagucaaugacuggaguugaaagccgacgaacccuacacaggggcauugaca

SEQ ID NO: 604287 - RNA, 64 nt, Homo Sapiens
ccguggcccucggccuccagauggccacaccucugccgacgacggaccagcucccucucccuuc

SEQ ID NO: 604288 - RNA, 64 nt, Homo Sapiens
ggaaaagcagaggaagguggaggucuacgcagaugccgacgaaauccuccaggaggagaucaag

SEQ ID NO: 604289 - RNA, 64 nt, Homo Sapiens
ccauggaagagccaucuguccucugagucucagcgccgacgagaugcaagcauugaagcccacg

SEQ ID NO: 604290 - RNA, 64 nt, Homo Sapiens
guccagcaacgaggaugagggcagcagcuccgaggccgacgagauggccaaggcgcuggaggcg

SEQ ID NO: 604291 - RNA, 64 nt, Homo Sapiens
ggggcugugacccucuucccccaggcccuccccagccgacgacagccaccggagaggagaucgg

SEQ ID NO: 604292 - RNA, 64 nt, Homo Sapiens
cgugacuggggcaacgccucguccugcagagggagccgacgaccucuuuucugcagaaaagcuc

SEQ ID NO: 604293 - RNA, 64 nt, Homo Sapiens
ucagaaaacccagauggguguuacugaacgugccgccgacgaccuaucgccagccguugcuuug

SEQ ID NO: 604294 - RNA, 64 nt, Homo Sapiens
uagagaauccaugucgcucugacaccccaaggaagccgacgauccaaaugccgugugucaccaa

SEQ ID NO: 604295 - RNA, 64 nt, Homo Sapiens
aaaaugugugaaauggaaaguugauggcagcagggccgacgaugucaccuggugccucgcgggc

SEQ ID NO: 604296 - RNA, 64 nt, Homo Sapiens
cuuugaaaauucuucaaaaaguaaacaugcagcugccgacgagguuauggaaccaagaaaacaa

SEQ ID NO: 604297 - RNA, 64 nt, Homo Sapiens
ccuagggcccuccuaccugccccugcacaauggggccgacgaggaucucuuuggacaguggcca

SEQ ID NO: 604298 - RNA, 64 nt, Homo Sapiens; identical to SEQ ID NO: 333540

SEQ ID NO: 604299 - RNA, 64 nt, Homo Sapiens; identical to SEQ ID NO: 333541

SEQ ID NO: 604300 - RNA, 64 nt, Homo Sapiens; identical to SEQ ID NO: 333542

SEQ ID NO: 604301 - RNA, 64 nt, Homo Sapiens; identical to SEQ ID NO: 333543

SEQ ID NO: 604302 - RNA, 64 nt, Homo Sapiens; identical to SEQ ID NO: 333544

SEQ ID NO: 604303 - RNA, 64 nt, Homo Sapiens; identical to SEQ ID NO: 333545

SEQ ID NO: 604304 - RNA, 54 nt, Homo Sapiens; identical to SEQ ID NO: 333546

SEQ ID NO: 604305 - RNA, 64 nt, Homo Sapiens; identical to SEQ ID NO: 333547

SEQ ID NO: 604306 - RNA, 60 nt, Homo Sapiens; identical to SEQ ID NO: 333548

SEQ ID NO: 604307 - RNA, 64 nt, Homo Sapiens; identical to SEQ ID NO: 333549

SEQ ID NO: 604308 - RNA, 64 nt, Homo Sapiens; identical to SEQ ID NO: 333550

SEQ ID NO: 604309 - RNA, 64 nt, Homo Sapiens; identical to SEQ ID NO: 333551

SEQ ID NO: 604310 - RNA, 64 nt, Homo Sapiens; identical to SEQ ID NO: 333552

SEQ ID NO: 604311 - RNA, 64 nt, Homo Sapiens; identical to SEQ ID NO: 333553

SEQ ID NO: 604312 - RNA, 64 nt, Homo Sapiens; identical to SEQ ID NO: 333554

SEQ ID NO: 604313 - RNA, 64 nt, Homo Sapiens; identical to SEQ ID NO: 333555

SEQ ID NO: 604314 - RNA, 64 nt, Homo Sapiens; identical to SEQ ID NO: 333556

SEQ ID NO: 604315 - RNA, 64 nt, Homo Sapiens; identical to SEQ ID NO: 333557

SEQ ID NO: 604316 - RNA, 64 nt, Homo Sapiens; identical to SEQ ID NO: 333558

SEQ ID NO: 604317 - RNA, 64 nt, Homo Sapiens; identical to SEQ ID NO: 333559

SEQ ID NO: 604318 - RNA, 64 nt, Homo Sapiens; identical to SEQ ID NO: 333560

SEQ ID NO: 604319 - RNA, 64 nt, Homo Sapiens; identical to SEQ ID NO: 333561

SEQ ID NO: 604320 - RNA, 64 nt, Homo Sapiens; identical to SEQ ID NO: 333562

SEQ ID NO: 604321 - RNA, 64 nt, Homo Sapiens; identical to SEQ ID NO: 333563

SEQ ID NO: 604322 - RNA, 64 nt, Homo Sapiens; identical to SEQ ID NO: 333564

SEQ ID NO: 604323 - RNA, 64 nt, Homo Sapiens; identical to SEQ ID NO: 333565

SEQ ID NO: 604324 - RNA, 64 nt, Homo Sapiens; identical to SEQ ID NO: 333566

SEQ ID NO: 604325 - RNA, 64 nt, Homo Sapiens; identical to SEQ ID NO: 333567

SEQ ID NO: 604326 - RNA, 64 nt, Homo Sapiens; identical to SEQ ID NO: 333568

SEQ ID NO: 604327 - RNA, 64 nt, Homo Sapiens; identical to SEQ ID NO: 333569

SEQ ID NO: 604328 - RNA, 64 nt, Homo Sapiens; identical to SEQ ID NO: 333570

SEQ ID NO: 604329 - RNA, 64 nt, Homo Sapiens; identical to SEQ ID NO: 333571

SEQ ID NO: 604330 - RNA, 64 nt, Homo Sapiens; identical to SEQ ID NO: 333572

SEQ ID NO: 604331 - RNA, 64 nt, Homo Sapiens; identical to SEQ ID NO: 333573

SEQ ID NO: 604332 - RNA, 64 nt, Homo Sapiens; identical to SEQ ID NO: 333574

SEQ ID NO: 604333 - RNA, 64 nt, Homo Sapiens; identical to SEQ ID NO: 333575

SEQ ID NO: 604334 - RNA, 64 nt, Homo Sapiens; identical to SEQ ID NO: 333576

SEQ ID NO: 604335 - RNA, 64 nt, Homo Sapiens; identical to SEQ ID NO: 333577

SEQ ID NO: 604336 - RNA, 64 nt, Homo Sapiens; identical to SEQ ID NO: 333578

SEQ ID NO: 604337 - RNA, 64 nt, Homo Sapiens; identical to SEQ ID NO: 333579

SEQ ID NO: 604338 - RNA, 64 nt, Homo Sapiens; identical to SEQ ID NO: 333580

SEQ ID NO: 604339 - RNA, 64 nt, Homo Sapiens; identical to SEQ ID NO: 333581

SEQ ID NO: 604340 - RNA, 64 nt, Homo Sapiens; identical to SEQ ID NO: 333582

SEQ ID NO: 604341 - RNA, 64 nt, Homo Sapiens; identical to SEQ ID NO: 333583

SEQ ID NO: 604342 - RNA, 64 nt, Homo Sapiens; identical to SEQ ID NO: 333584

SEQ ID NO: 604343 - RNA, 64 nt, Homo Sapiens; identical to SEQ ID NO: 333585

SEQ ID NO: 604344 - RNA, 64 nt, Homo Sapiens; identical to SEQ ID NO: 333586

SEQ ID NO: 604345 - RNA, 64 nt, Homo Sapiens; identical to SEQ ID NO: 333587

SEQ ID NO: 604346 - RNA, 64 nt, Homo Sapiens; identical to SEQ ID NO: 333588

SEQ ID NO: 604347 - RNA, 64 nt, Homo Sapiens; identical to SEQ ID NO: 333589

SEQ ID NO: 604348 - RNA, 64 nt, Homo Sapiens; identical to SEQ ID NO: 333590

SEQ ID NO: 604349 - RNA, 64 nt, Homo Sapiens; identical to SEQ ID NO: 52979

SEQ ID NO: 604350 - RNA, 64 nt, Homo Sapiens; identical to SEQ ID NO: 52980

SEQ ID NO: 604351 - RNA, 64 nt, Homo Sapiens; identical to SEQ ID NO: 52981

SEQ ID NO: 604352 - RNA, 64 nt, Homo Sapiens; identical to SEQ ID NO: 52982

SEQ ID NO: 604353 - RNA, 64 nt, Homo Sapiens; identical to SEQ ID NO: 52983

SEQ ID NO: 604354 - RNA, 64 nt, Homo Sapiens; identical to SEQ ID NO: 52984

SEQ ID NO: 604355 - RNA, 64 nt, Homo Sapiens; identical to SEQ ID NO: 52985

SEQ ID NO: 604356 - RNA, 64 nt, Homo Sapiens; identical to SEQ ID NO: 52986

SEQ ID NO: 604357 - RNA, 64 nt, Homo Sapiens; identical to SEQ ID NO: 52987

SEQ ID NO: 604358 - RNA, 64 nt, Homo Sapiens; identical to SEQ ID NO: 52988

SEQ ID NO: 604359 - RNA, 64 nt, Homo Sapiens; identical to SEQ ID NO: 52989

SEQ ID NO: 604360 - RNA, 64 nt, Homo Sapiens; identical to SEQ ID NO: 52990

SEQ ID NO: 604361 - RNA, 64 nt, Homo Sapiens; identical to SEQ ID NO: 52991

SEQ ID NO: 604362 - RNA, 64 nt, Homo Sapiens; identical to SEQ ID NO: 52992

SEQ ID NO: 604363 - RNA, 64 nt, Homo Sapiens; identical to SEQ ID NO: 52993

SEQ ID NO: 604364 - RNA, 64 nt, Homo Sapiens; identical to SEQ ID NO: 52994

SEQ ID NO: 604365 - RNA, 64 nt, Homo Sapiens; identical to SEQ ID NO: 52995

SEQ ID NO: 604366 - RNA, 64 nt, Homo Sapiens; identical to SEQ ID NO: 52996

SEQ ID NO: 604367 - RNA, 64 nt, Homo Sapiens; identical to SEQ ID NO: 52997

SEQ ID NO: 604368 - RNA, 64 nt, Homo Sapiens; identical to SEQ ID NO: 52998

SEQ ID NO: 604369 - RNA, 64 nt, Homo Sapiens; identical to SEQ ID NO: 52999

SEQ ID NO: 604370 - RNA, 64 nt, Homo Sapiens; identical to SEQ ID NO: 53000

SEQ ID NO: 604371 - RNA, 64 nt, Homo Sapiens; identical to SEQ ID NO: 53001

SEQ ID NO: 604372 - RNA, 64 nt, Homo Sapiens; identical to SEQ ID NO: 53002

SEQ ID NO: 604373 - RNA, 64 nt, Homo Sapiens; identical to SEQ ID NO: 53003

SEQ ID NO: 604374 - RNA, 64 nt, Homo Sapiens; identical to SEQ ID NO: 53004

SEQ ID NO: 604375 - RNA, 59 nt, Homo Sapiens; identical to SEQ ID NO: 53005

SEQ ID NO: 604376 - RNA, 64 nt, Homo Sapiens; identical to SEQ ID NO: 53006

SEQ ID NO: 604377 - RNA, 64 nt, Homo Sapiens; identical to SEQ ID NO: 53007

SEQ ID NO: 604378 - RNA, 64 nt, Homo Sapiens; identical to SEQ ID NO: 53008

SEQ ID NO: 604379 - RNA, 64 nt, Homo Sapiens; identical to SEQ ID NO: 53009

SEQ ID NO: 604380 - RNA, 64 nt, Homo Sapiens; identical to SEQ ID NO: 53010

SEQ ID NO: 604381 - RNA, 64 nt, Homo Sapiens; identical to SEQ ID NO: 53011

SEQ ID NO: 604382 - RNA, 64 nt, Homo Sapiens; identical to SEQ ID NO: 53012

SEQ ID NO: 604383 - RNA, 64 nt, Homo Sapiens; identical to SEQ ID NO: 53013

SEQ ID NO: 604384 - RNA, 64 nt, Homo Sapiens; identical to SEQ ID NO: 53014

SEQ ID NO: 604385 - RNA, 64 nt, Homo Sapiens; identical to SEQ ID NO: 53015

SEQ ID NO: 604386 - RNA, 64 nt, Homo Sapiens; identical to SEQ ID NO: 53016

SEQ ID NO: 604387 - RNA, 64 nt, Homo Sapiens; identical to SEQ ID NO: 53017

SEQ ID NO: 604388 - RNA, 64 nt, Homo Sapiens; identical to SEQ ID NO: 217679

SEQ ID NO: 604389 - RNA, 64 nt, Homo Sapiens; identical to SEQ ID NO: 217680

SEQ ID NO: 604390 - RNA, 64 nt, Homo Sapiens; identical to SEQ ID NO: 217681

SEQ ID NO: 604391 - RNA, 64 nt, Homo Sapiens; identical to SEQ ID NO: 217682

SEQ ID NO: 604392 - RNA, 64 nt, Homo Sapiens; identical to SEQ ID NO: 217683

SEQ ID NO: 604393 - RNA, 64 nt, Homo Sapiens; identical to SEQ ID NO: 217684

SEQ ID NO: 604394 - RNA, 64 nt, Homo Sapiens; identical to SEQ ID NO: 217685

SEQ ID NO: 604395 - RNA, 64 nt, Homo Sapiens; identical to SEQ ID NO: 217686

SEQ ID NO: 604396 - RNA, 64 nt, Homo Sapiens; identical to SEQ ID NO: 217687

SEQ ID NO: 604397 - RNA, 64 nt, Homo Sapiens; identical to SEQ ID NO: 217688

SEQ ID NO: 604398 - RNA, 64 nt, Homo Sapiens; identical to SEQ ID NO: 217689

SEQ ID NO: 604399 - RNA, 64 nt, Homo Sapiens; identical to SEQ ID NO: 217690

SEQ ID NO: 604400 - RNA, 64 nt, Homo Sapiens; identical to SEQ ID NO: 217691

SEQ ID NO: 604401 - RNA, 64 nt, Homo Sapiens; identical to SEQ ID NO: 217692

SEQ ID NO: 604402 - RNA, 64 nt, Homo Sapiens; identical to SEQ ID NO: 217693

SEQ ID NO: 604403 - RNA, 64 nt, Homo Sapiens; identical to SEQ ID NO: 217694

SEQ ID NO: 604404 - RNA, 64 nt, Homo Sapiens; identical to SEQ ID NO: 217695

SEQ ID NO: 604405 - RNA, 64 nt, Homo Sapiens; identical to SEQ ID NO: 217696

SEQ ID NO: 604406 - RNA, 64 nt, Homo Sapiens; identical to SEQ ID NO: 217697

SEQ ID NO: 604407 - RNA, 64 nt, Homo Sapiens; identical to SEQ ID NO: 217698

SEQ ID NO: 604408 - RNA, 64 nt, Homo Sapiens; identical to SEQ ID NO: 217699

SEQ ID NO: 604409 - RNA, 64 nt, Homo Sapiens; identical to SEQ ID NO: 217700

SEQ ID NO: 604410 - RNA, 64 nt, Homo Sapiens; identical to SEQ ID NO: 217701

SEQ ID NO: 604411 - RNA, 64 nt, Homo Sapiens; identical to SEQ ID NO: 217702

SEQ ID NO: 604412 - RNA, 64 nt, Homo Sapiens; identical to SEQ ID NO: 217703

SEQ ID NO: 604413 - RNA, 64 nt, Homo Sapiens; identical to SEQ ID NO: 217704

SEQ ID NO: 604414 - RNA, 64 nt, Homo Sapiens; identical to SEQ ID NO: 217705

SEQ ID NO: 604415 - RNA, 64 nt, Homo Sapiens; identical to SEQ ID NO: 217706

SEQ ID NO: 604416 - RNA, 64 nt, Homo Sapiens; identical to SEQ ID NO: 217707

SEQ ID NO: 604417 - RNA, 64 nt, Homo Sapiens; identical to SEQ ID NO: 217708

SEQ ID NO: 604418 - RNA, 64 nt, Homo Sapiens; identical to SEQ ID NO: 217709

SEQ ID NO: 604419 - RNA, 64 nt, Homo Sapiens; identical to SEQ ID NO: 217710

SEQ ID NO: 604420 - RNA, 64 nt, Homo Sapiens; identical to SEQ ID NO: 217711

SEQ ID NO: 604421 - RNA, 64 nt, Homo Sapiens; identical to SEQ ID NO: 217712

SEQ ID NO: 604422 - RNA, 64 nt, Homo Sapiens; identical to SEQ ID NO: 217713

SEQ ID NO: 604423 - RNA, 58 nt, Homo Sapiens; identical to SEQ ID NO: 217714

SEQ ID NO: 604424 - RNA, 64 nt, Homo Sapiens; identical to SEQ ID NO: 217715

SEQ ID NO: 604425 - RNA, 64 nt, Homo Sapiens; identical to SEQ ID NO: 217716

SEQ ID NO: 604426 - RNA, 64 nt, Homo Sapiens; identical to SEQ ID NO: 217717

SEQ ID NO: 604427 - RNA, 64 nt, Homo Sapiens; identical to SEQ ID NO: 217718

SEQ ID NO: 604428 - RNA, 64 nt, Homo Sapiens; identical to SEQ ID NO: 217719

SEQ ID NO: 604429 - RNA, 64 nt, Homo Sapiens; identical to SEQ ID NO: 217720

SEQ ID NO: 604430 - RNA, 64 nt, Homo Sapiens; identical to SEQ ID NO: 217721

SEQ ID NO: 604431 - RNA, 64 nt, Homo Sapiens; identical to SEQ ID NO: 217722

SEQ ID NO: 604432 - RNA, 64 nt, Homo Sapiens; identical to SEQ ID NO: 217723

SEQ ID NO: 604433 - RNA, 64 nt, Homo Sapiens; identical to SEQ ID NO: 217724

SEQ ID NO: 604434 - RNA, 64 nt, Homo Sapiens; identical to SEQ ID NO: 217725

SEQ ID NO: 604435 - RNA, 64 nt, Homo Sapiens; identical to SEQ ID NO: 217726

SEQ ID NO: 604436 - RNA, 64 nt, Homo Sapiens; identical to SEQ ID NO: 217727

SEQ ID NO: 604437 - RNA, 64 nt, Homo Sapiens; identical to SEQ ID NO: 217728

SEQ ID NO: 604438 - RNA, 64 nt, Homo Sapiens; identical to SEQ ID NO: 217729

SEQ ID NO: 604439 - RNA, 64 nt, Homo Sapiens; identical to SEQ ID NO: 217730

SEQ ID NO: 604440 - RNA, 64 nt, Homo Sapiens; identical to SEQ ID NO: 217731

SEQ ID NO: 604441 - RNA, 64 nt, Homo Sapiens; identical to SEQ ID NO: 217732

SEQ ID NO: 604442 - RNA, 64 nt, Homo Sapiens; identical to SEQ ID NO: 217733

SEQ ID NO: 604443 - RNA, 64 nt, Homo Sapiens; identical to SEQ ID NO: 217734

SEQ ID NO: 604444 - RNA, 64 nt, Homo Sapiens; identical to SEQ ID NO: 217735

SEQ ID NO: 604445 - RNA, 64 nt, Homo Sapiens; identical to SEQ ID NO: 217736

SEQ ID NO: 604446 - RNA, 64 nt, Homo Sapiens; identical to SEQ ID NO: 217737

SEQ ID NO: 604447 - RNA, 64 nt, Homo Sapiens; identical to SEQ ID NO: 217738

SEQ ID NO: 604448 - RNA, 64 nt, Homo Sapiens; identical to SEQ ID NO: 217739

SEQ ID NO: 604449 - RNA, 64 nt, Homo Sapiens; identical to SEQ ID NO: 217740

SEQ ID NO: 604450 - RNA, 64 nt, Homo Sapiens; identical to SEQ ID NO: 217741

SEQ ID NO: 604451 - RNA, 64 nt, Homo Sapiens; identical to SEQ ID NO: 217742

SEQ ID NO: 604452 - RNA, 64 nt, Homo Sapiens; identical to SEQ ID NO: 217743

SEQ ID NO: 604453 - RNA, 64 nt, Homo Sapiens; identical to SEQ ID NO: 217744

SEQ ID NO: 604454 - RNA, 64 nt, Homo Sapiens; identical to SEQ ID NO: 217745

SEQ ID NO: 604455 - RNA, 64 nt, Homo Sapiens; identical to SEQ ID NO: 217746

SEQ ID NO: 604456 - RNA, 64 nt, Homo Sapiens; identical to SEQ ID NO: 217747

SEQ ID NO: 604457 - RNA, 64 nt, Homo Sapiens; identical to SEQ ID NO: 217748

SEQ ID NO: 604458 - RNA, 64 nt, Homo Sapiens; identical to SEQ ID NO: 217749

SEQ ID NO: 604459 - RNA, 64 nt, Homo Sapiens; identical to SEQ ID NO: 217750

SEQ ID NO: 604460 - RNA, 64 nt, Homo Sapiens; identical to SEQ ID NO: 217751

SEQ ID NO: 604461 - RNA, 64 nt, Homo Sapiens; identical to SEQ ID NO: 217752

SEQ ID NO: 604462 - RNA, 64 nt, Homo Sapiens; identical to SEQ ID NO: 217753

SEQ ID NO: 604463 - RNA, 64 nt, Homo Sapiens; identical to SEQ ID NO: 217754

SEQ ID NO: 604464 - RNA, 64 nt, Homo Sapiens; identical to SEQ ID NO: 217755

SEQ ID NO: 604465 - RNA, 64 nt, Homo Sapiens; identical to SEQ ID NO: 217756

SEQ ID NO: 604466 - RNA, 64 nt, Homo Sapiens; identical to SEQ ID NO: 217757

SEQ ID NO: 604467 - RNA, 64 nt, Homo Sapiens; identical to SEQ ID NO: 217758

SEQ ID NO: 604468 - RNA, 64 nt, Homo Sapiens; identical to SEQ ID NO: 217759

SEQ ID NO: 604469 - RNA, 64 nt, Homo Sapiens; identical to SEQ ID NO: 217760

SEQ ID NO: 604470 - RNA, 64 nt, Homo Sapiens; identical to SEQ ID NO: 217761

SEQ ID NO: 604471 - RNA, 64 nt, Homo Sapiens; identical to SEQ ID NO: 217762

SEQ ID NO: 604472 - RNA, 64 nt, Homo Sapiens; identical to SEQ ID NO: 217763

SEQ ID NO: 604473 - RNA, 64 nt, Homo Sapiens; identical to SEQ ID NO: 217764

SEQ ID NO: 604474 - RNA, 64 nt, Homo Sapiens; identical to SEQ ID NO: 217765

SEQ ID NO: 604475 - RNA, 64 nt, Homo Sapiens; identical to SEQ ID NO: 217766

SEQ ID NO: 604476 - RNA, 64 nt, Homo Sapiens; identical to SEQ ID NO: 217767

SEQ ID NO: 604477 - RNA, 64 nt, Homo Sapiens; identical to SEQ ID NO: 217768

SEQ ID NO: 604478 - RNA, 64 nt, Homo Sapiens; identical to SEQ ID NO: 217769

SEQ ID NO: 604479 - RNA, 64 nt, Homo Sapiens; identical to SEQ ID NO: 217770

SEQ ID NO: 604480 - RNA, 64 nt, Homo Sapiens; identical to SEQ ID NO: 217771

SEQ ID NO: 604481 - RNA, 64 nt, Homo Sapiens; identical to SEQ ID NO: 217772

SEQ ID NO: 604482 - RNA, 64 nt, Homo Sapiens; identical to SEQ ID NO: 217773

SEQ ID NO: 604483 - RNA, 64 nt, Homo Sapiens; identical to SEQ ID NO: 217774

SEQ ID NO: 604484 - RNA, 64 nt, Homo Sapiens; identical to SEQ ID NO: 217775

SEQ ID NO: 604485 - RNA, 64 nt, Homo Sapiens; identical to SEQ ID NO: 217776

SEQ ID NO: 604486 - RNA, 64 nt, Homo Sapiens; identical to SEQ ID NO: 217777

SEQ ID NO: 604487 - RNA, 64 nt, Homo Sapiens; identical to SEQ ID NO: 217778

SEQ ID NO: 604488 - RNA, 64 nt, Homo Sapiens; identical to SEQ ID NO: 217779

SEQ ID NO: 604489 - RNA, 64 nt, Homo Sapiens; identical to SEQ ID NO: 217780

SEQ ID NO: 604490 - RNA, 64 nt, Homo Sapiens; identical to SEQ ID NO: 217781

SEQ ID NO: 604491 - RNA, 64 nt, Homo Sapiens; identical to SEQ ID NO: 217782

SEQ ID NO: 604492 - RNA, 64 nt, Homo Sapiens; identical to SEQ ID NO: 217783

SEQ ID NO: 604493 - RNA, 64 nt, Homo Sapiens; identical to SEQ ID NO: 217784

SEQ ID NO: 604494 - RNA, 64 nt, Homo Sapiens; identical to SEQ ID NO: 217785

SEQ ID NO: 604495 - RNA, 64 nt, Homo Sapiens; identical to SEQ ID NO: 217786

SEQ ID NO: 604496 - RNA, 64 nt, Homo Sapiens; identical to SEQ ID NO: 217787

SEQ ID NO: 604497 - RNA, 64 nt, Homo Sapiens; identical to SEQ ID NO: 217788

SEQ ID NO: 604498 - RNA, 64 nt, Homo Sapiens; identical to SEQ ID NO: 217789

SEQ ID NO: 604499 - RNA, 64 nt, Homo Sapiens; identical to SEQ ID NO: 217790

SEQ ID NO: 604500 - RNA, 64 nt, Homo Sapiens; identical to SEQ ID NO: 217791

SEQ ID NO: 604501 - RNA, 64 nt, Homo Sapiens; identical to SEQ ID NO: 217792

SEQ ID NO: 604502 - RNA, 64 nt, Homo Sapiens; identical to SEQ ID NO: 217793

SEQ ID NO: 604503 - RNA, 64 nt, Homo Sapiens; identical to SEQ ID NO: 217794

SEQ ID NO: 604504 - RNA, 64 nt, Homo Sapiens; identical to SEQ ID NO: 50725

SEQ ID NO: 604505 - RNA, 64 nt, Homo Sapiens; identical to SEQ ID NO: 50726

SEQ ID NO: 604506 - RNA, 64 nt, Homo Sapiens; identical to SEQ ID NO: 50727

SEQ ID NO: 604507 - RNA, 64 nt, Homo Sapiens; identical to SEQ ID NO: 50728

SEQ ID NO: 604508 - RNA, 64 nt, Homo Sapiens; identical to SEQ ID NO: 50729

SEQ ID NO: 604509 - RNA, 64 nt, Homo Sapiens; identical to SEQ ID NO: 50730

SEQ ID NO: 604510 - RNA, 64 nt, Homo Sapiens; identical to SEQ ID NO: 50731

SEQ ID NO: 604511 - RNA, 64 nt, Homo Sapiens; identical to SEQ ID NO: 50732

SEQ ID NO: 604512 - RNA, 64 nt, Homo Sapiens; identical to SEQ ID NO: 50733

SEQ ID NO: 604513 - RNA, 64 nt, Homo Sapiens; identical to SEQ ID NO: 50734

SEQ ID NO: 604514 - RNA, 51 nt, Homo Sapiens; identical to SEQ ID NO: 50735

SEQ ID NO: 604515 - RNA, 64 nt, Homo Sapiens; identical to SEQ ID NO: 50736

SEQ ID NO: 604516 - RNA, 64 nt, Homo Sapiens; identical to SEQ ID NO: 50737

SEQ ID NO: 604517 - RNA, 64 nt, Homo Sapiens; identical to SEQ ID NO: 50738

SEQ ID NO: 604518 - RNA, 64 nt, Homo Sapiens; identical to SEQ ID NO: 217679

SEQ ID NO: 604519 - RNA, 64 nt, Homo Sapiens; identical to SEQ ID NO: 217680

SEQ ID NO: 604520 - RNA, 64 nt, Homo Sapiens; identical to SEQ ID NO: 217681

SEQ ID NO: 604521 - RNA, 64 nt, Homo Sapiens; identical to SEQ ID NO: 217682

SEQ ID NO: 604522 - RNA, 64 nt, Homo Sapiens; identical to SEQ ID NO: 217683

SEQ ID NO: 604523 - RNA, 64 nt, Homo Sapiens; identical to SEQ ID NO: 217684

SEQ ID NO: 604524 - RNA, 64 nt, Homo Sapiens; identical to SEQ ID NO: 217685

SEQ ID NO: 604525 - RNA, 64 nt, Homo Sapiens; identical to SEQ ID NO: 217686

SEQ ID NO: 604526 - RNA, 64 nt, Homo Sapiens; identical to SEQ ID NO: 217687

SEQ ID NO: 604527 - RNA, 64 nt, Homo Sapiens; identical to SEQ ID NO: 217688

SEQ ID NO: 604528 - RNA, 64 nt, Homo Sapiens; identical to SEQ ID NO: 217689

SEQ ID NO: 604529 - RNA, 64 nt, Homo Sapiens; identical to SEQ ID NO: 217690

SEQ ID NO: 604530 - RNA, 64 nt, Homo Sapiens; identical to SEQ ID NO: 217691

SEQ ID NO: 604531 - RNA, 64 nt, Homo Sapiens; identical to SEQ ID NO: 217692

SEQ ID NO: 604532 - RNA, 64 nt, Homo Sapiens; identical to SEQ ID NO: 217693

SEQ ID NO: 604533 - RNA, 64 nt, Homo Sapiens; identical to SEQ ID NO: 217694

SEQ ID NO: 604534 - RNA, 64 nt, Homo Sapiens; identical to SEQ ID NO: 217695

SEQ ID NO: 604535 - RNA, 64 nt, Homo Sapiens; identical to SEQ ID NO: 217696

SEQ ID NO: 604536 - RNA, 64 nt, Homo Sapiens; identical to SEQ ID NO: 217697

SEQ ID NO: 604537 - RNA, 64 nt, Homo Sapiens; identical to SEQ ID NO: 217698

SEQ ID NO: 604538 - RNA, 64 nt, Homo Sapiens; identical to SEQ ID NO: 217699

SEQ ID NO: 604539 - RNA, 64 nt, Homo Sapiens; identical to SEQ ID NO: 217700

SEQ ID NO: 604540 - RNA, 64 nt, Homo Sapiens; identical to SEQ ID NO: 217701

SEQ ID NO: 604541 - RNA, 64 nt, Homo Sapiens; identical to SEQ ID NO: 217702

SEQ ID NO: 604542 - RNA, 64 nt, Homo Sapiens; identical to SEQ ID NO: 217703

SEQ ID NO: 604543 - RNA, 64 nt, Homo Sapiens; identical to SEQ ID NO: 217704

SEQ ID NO: 604544 - RNA, 64 nt, Homo Sapiens; identical to SEQ ID NO: 217705

SEQ ID NO: 604545 - RNA, 64 nt, Homo Sapiens; identical to SEQ ID NO: 217706

SEQ ID NO: 604546 - RNA, 64 nt, Homo Sapiens; identical to SEQ ID NO: 217707

SEQ ID NO: 604547 - RNA, 64 nt, Homo Sapiens; identical to SEQ ID NO: 217708

SEQ ID NO: 604548 - RNA, 64 nt, Homo Sapiens; identical to SEQ ID NO: 217709

SEQ ID NO: 604549 - RNA, 64 nt, Homo Sapiens; identical to SEQ ID NO: 217710

SEQ ID NO: 604550 - RNA, 64 nt, Homo Sapiens; identical to SEQ ID NO: 217711

SEQ ID NO: 604551 - RNA, 64 nt, Homo Sapiens; identical to SEQ ID NO: 217712

SEQ ID NO: 604552 - RNA, 64 nt, Homo Sapiens; identical to SEQ ID NO: 217713

SEQ ID NO: 604553 - RNA, 58 nt, Homo Sapiens; identical to SEQ ID NO: 217714

SEQ ID NO: 604554 - RNA, 64 nt, Homo Sapiens; identical to SEQ ID NO: 217715

SEQ ID NO: 604555 - RNA, 64 nt, Homo Sapiens; identical to SEQ ID NO: 217716

SEQ ID NO: 604556 - RNA, 64 nt, Homo Sapiens; identical to SEQ ID NO: 217717

SEQ ID NO: 604557 - RNA, 64 nt, Homo Sapiens; identical to SEQ ID NO: 217718

SEQ ID NO: 604558 - RNA, 64 nt, Homo Sapiens; identical to SEQ ID NO: 217719

SEQ ID NO: 604559 - RNA, 64 nt, Homo Sapiens; identical to SEQ ID NO: 217720

SEQ ID NO: 604560 - RNA, 64 nt, Homo Sapiens; identical to SEQ ID NO: 217721

SEQ ID NO: 604561 - RNA, 64 nt, Homo Sapiens; identical to SEQ ID NO: 217722

SEQ ID NO: 604562 - RNA, 64 nt, Homo Sapiens; identical to SEQ ID NO: 217723

SEQ ID NO: 604563 - RNA, 64 nt, Homo Sapiens; identical to SEQ ID NO: 217724

SEQ ID NO: 604564 - RNA, 64 nt, Homo Sapiens; identical to SEQ ID NO: 217725

SEQ ID NO: 604565 - RNA, 64 nt, Homo Sapiens; identical to SEQ ID NO: 217726

SEQ ID NO: 604566 - RNA, 64 nt, Homo Sapiens; identical to SEQ ID NO: 217727

SEQ ID NO: 604567 - RNA, 64 nt, Homo Sapiens; identical to SEQ ID NO: 217728

SEQ ID NO: 604568 - RNA, 64 nt, Homo Sapiens; identical to SEQ ID NO: 217729

SEQ ID NO: 604569 - RNA, 64 nt, Homo Sapiens; identical to SEQ ID NO: 217730

SEQ ID NO: 604570 - RNA, 64 nt, Homo Sapiens; identical to SEQ ID NO: 217731

SEQ ID NO: 604571 - RNA, 64 nt, Homo Sapiens; identical to SEQ ID NO: 217732

SEQ ID NO: 604572 - RNA, 64 nt, Homo Sapiens; identical to SEQ ID NO: 217733

SEQ ID NO: 604573 - RNA, 64 nt, Homo Sapiens; identical to SEQ ID NO: 217734

SEQ ID NO: 604574 - RNA, 64 nt, Homo Sapiens; identical to SEQ ID NO: 217735

SEQ ID NO: 604575 - RNA, 64 nt, Homo Sapiens; identical to SEQ ID NO: 217736

SEQ ID NO: 604576 - RNA, 64 nt, Homo Sapiens; identical to SEQ ID NO: 217737

SEQ ID NO: 604577 - RNA, 64 nt, Homo Sapiens; identical to SEQ ID NO: 217738

SEQ ID NO: 604578 - RNA, 64 nt, Homo Sapiens; identical to SEQ ID NO: 217739

SEQ ID NO: 604579 - RNA, 64 nt, Homo Sapiens; identical to SEQ ID NO: 217740

SEQ ID NO: 604580 - RNA, 64 nt, Homo Sapiens; identical to SEQ ID NO: 217741

SEQ ID NO: 604581 - RNA, 64 nt, Homo Sapiens; identical to SEQ ID NO: 217742

SEQ ID NO: 604582 - RNA, 64 nt, Homo Sapiens; identical to SEQ ID NO: 217743

SEQ ID NO: 604583 - RNA, 64 nt, Homo Sapiens; identical to SEQ ID NO: 217744

SEQ ID NO: 604584 - RNA, 64 nt, Homo Sapiens; identical to SEQ ID NO: 217745

SEQ ID NO: 604585 - RNA, 64 nt, Homo Sapiens; identical to SEQ ID NO: 217746

SEQ ID NO: 604586 - RNA, 64 nt, Homo Sapiens; identical to SEQ ID NO: 217747

SEQ ID NO: 604587 - RNA, 64 nt, Homo Sapiens; identical to SEQ ID NO: 217748

SEQ ID NO: 604588 - RNA, 64 nt, Homo Sapiens; identical to SEQ ID NO: 217749

SEQ ID NO: 604589 - RNA, 64 nt, Homo Sapiens; identical to SEQ ID NO: 217750

SEQ ID NO: 604590 - RNA, 64 nt, Homo Sapiens; identical to SEQ ID NO: 217751

SEQ ID NO: 604591 - RNA, 64 nt, Homo Sapiens; identical to SEQ ID NO: 217752

SEQ ID NO: 604592 - RNA, 64 nt, Homo Sapiens; identical to SEQ ID NO: 217753

SEQ ID NO: 604593 - RNA, 64 nt, Homo Sapiens; identical to SEQ ID NO: 217754

SEQ ID NO: 604594 - RNA, 64 nt, Homo Sapiens; identical to SEQ ID NO: 217755

SEQ ID NO: 604595 - RNA, 64 nt, Homo Sapiens; identical to SEQ ID NO: 217756

SEQ ID NO: 604596 - RNA, 64 nt, Homo Sapiens; identical to SEQ ID NO: 217757

SEQ ID NO: 604597 - RNA, 64 nt, Homo Sapiens; identical to SEQ ID NO: 217758

SEQ ID NO: 604598 - RNA, 64 nt, Homo Sapiens; identical to SEQ ID NO: 217759

SEQ ID NO: 604599 - RNA, 64 nt, Homo Sapiens; identical to SEQ ID NO: 217760

SEQ ID NO: 604600 - RNA, 64 nt, Homo Sapiens; identical to SEQ ID NO: 217761

SEQ ID NO: 604601 - RNA, 64 nt, Homo Sapiens; identical to SEQ ID NO: 217762

SEQ ID NO: 604602 - RNA, 64 nt, Homo Sapiens; identical to SEQ ID NO: 217763

SEQ ID NO: 604603 - RNA, 64 nt, Homo Sapiens; identical to SEQ ID NO: 217764

SEQ ID NO: 604604 - RNA, 64 nt, Homo Sapiens; identical to SEQ ID NO: 217765

SEQ ID NO: 604605 - RNA, 64 nt, Homo Sapiens; identical to SEQ ID NO: 217766

SEQ ID NO: 604606 - RNA, 64 nt, Homo Sapiens; identical to SEQ ID NO: 217767

SEQ ID NO: 604607 - RNA, 64 nt, Homo Sapiens; identical to SEQ ID NO: 217768

SEQ ID NO: 604608 - RNA, 64 nt, Homo Sapiens; identical to SEQ ID NO: 217769

SEQ ID NO: 604609 - RNA, 64 nt, Homo Sapiens; identical to SEQ ID NO: 217770

SEQ ID NO: 604610 - RNA, 64 nt, Homo Sapiens; identical to SEQ ID NO: 217771

SEQ ID NO: 604611 - RNA, 64 nt, Homo Sapiens; identical to SEQ ID NO: 217772

SEQ ID NO: 604612 - RNA, 64 nt, Homo Sapiens; identical to SEQ ID NO: 217773

SEQ ID NO: 604613 - RNA, 64 nt, Homo Sapiens; identical to SEQ ID NO: 217774

SEQ ID NO: 604614 - RNA, 64 nt, Homo Sapiens; identical to SEQ ID NO: 217775

SEQ ID NO: 604615 - RNA, 64 nt, Homo Sapiens; identical to SEQ ID NO: 217776

SEQ ID NO: 604616 - RNA, 64 nt, Homo Sapiens; identical to SEQ ID NO: 217777

SEQ ID NO: 604617 - RNA, 64 nt, Homo Sapiens; identical to SEQ ID NO: 217778

SEQ ID NO: 604618 - RNA, 64 nt, Homo Sapiens; identical to SEQ ID NO: 217779

SEQ ID NO: 604619 - RNA, 64 nt, Homo Sapiens; identical to SEQ ID NO: 217780

SEQ ID NO: 604620 - RNA, 64 nt, Homo Sapiens; identical to SEQ ID NO: 217781

SEQ ID NO: 604621 - RNA, 64 nt, Homo Sapiens; identical to SEQ ID NO: 217782

SEQ ID NO: 604622 - RNA, 64 nt, Homo Sapiens; identical to SEQ ID NO: 217783

SEQ ID NO: 604623 - RNA, 64 nt, Homo Sapiens; identical to SEQ ID NO: 217784

SEQ ID NO: 604624 - RNA, 64 nt, Homo Sapiens; identical to SEQ ID NO: 217785

SEQ ID NO: 604625 - RNA, 64 nt, Homo Sapiens; identical to SEQ ID NO: 217786

SEQ ID NO: 604626 - RNA, 64 nt, Homo Sapiens; identical to SEQ ID NO: 217787

SEQ ID NO: 604627 - RNA, 64 nt, Homo Sapiens; identical to SEQ ID NO: 217788

SEQ ID NO: 604628 - RNA, 64 nt, Homo Sapiens; identical to SEQ ID NO: 217789

SEQ ID NO: 604629 - RNA, 64 nt, Homo Sapiens; identical to SEQ ID NO: 217790

SEQ ID NO: 604630 - RNA, 64 nt, Homo Sapiens; identical to SEQ ID NO: 217791

SEQ ID NO: 604631 - RNA, 64 nt, Homo Sapiens; identical to SEQ ID NO: 217792

SEQ ID NO: 604632 - RNA, 64 nt, Homo Sapiens; identical to SEQ ID NO: 217793

SEQ ID NO: 604633 - RNA, 64 nt, Homo Sapiens; identical to SEQ ID NO: 217794

SEQ ID NO: 604634 - RNA, 64 nt, Homo Sapiens; identical to SEQ ID NO: 50725

SEQ ID NO: 604635 - RNA, 64 nt, Homo Sapiens; identical to SEQ ID NO: 50726

SEQ ID NO: 604636 - RNA, 64 nt, Homo Sapiens; identical to SEQ ID NO: 50727

SEQ ID NO: 604637 - RNA, 64 nt, Homo Sapiens; identical to SEQ ID NO: 50728

SEQ ID NO: 604638 - RNA, 64 nt, Homo Sapiens; identical to SEQ ID NO: 50729

SEQ ID NO: 604639 - RNA, 64 nt, Homo Sapiens; identical to SEQ ID NO: 50730

SEQ ID NO: 604640 - RNA, 64 nt, Homo Sapiens; identical to SEQ ID NO: 50731

SEQ ID NO: 604641 - RNA, 64 nt, Homo Sapiens; identical to SEQ ID NO: 50732

SEQ ID NO: 604642 - RNA, 64 nt, Homo Sapiens; identical to SEQ ID NO: 50733

SEQ ID NO: 604643 - RNA, 64 nt, Homo Sapiens; identical to SEQ ID NO: 50734

SEQ ID NO: 604644 - RNA, 51 nt, Homo Sapiens; identical to SEQ ID NO: 50735

SEQ ID NO: 604645 - RNA, 64 nt, Homo Sapiens; identical to SEQ ID NO: 50736

SEQ ID NO: 604646 - RNA, 64 nt, Homo Sapiens; identical to SEQ ID NO: 50737

SEQ ID NO: 604647 - RNA, 64 nt, Homo Sapiens; identical to SEQ ID NO: 50738

SEQ ID NO: 604648 - RNA, 64 nt, Homo Sapiens
gcagugguuuuagugggugaaaaugucccaucugcaccaguacacaggcaggcauuaucauucu

SEQ ID NO: 604649 - RNA, 64 nt, Homo Sapiens
augcauguauuuucuuuuaucuuuggaacaucagcaccaguauauugcuggcagcuauuguauu

SEQ ID NO: 604650 - RNA, 64 nt, Homo Sapiens
aaaaauacaaaaauuagccgggugugguggcacacaccaguaaucccagcuacucaggaggcug

SEQ ID NO: 604651 - RNA, 64 nt, Homo Sapiens
ccaaagauguggguggcaaaugccccuauagaaacaccaguaccugaaagcacuguagcccugg

SEQ ID NO: 604652 - RNA, 64 nt, Homo Sapiens
ccaaccuuccagaaagccgauuuguuugguaaagcaccaguacuagaaaaggagagaaaguaac

SEQ ID NO: 604653 - RNA, 64 nt, Homo Sapiens
gaaaugcacuuuugcacuacaucuucuccccugacaccaguagaguacuuccuaaaaaaaccca

SEQ ID NO: 604654 - RNA, 64 nt, Homo Sapiens; identical to SEQ ID NO: 94836

SEQ ID NO: 604655 - RNA, 64 nt, Homo Sapiens; identical to SEQ ID NO: 94837

SEQ ID NO: 604656 - RNA, 64 nt, Homo Sapiens; identical to SEQ ID NO: 94838

SEQ ID NO: 604657 - RNA, 64 nt, Homo Sapiens; identical to SEQ ID NO: 94839

SEQ ID NO: 604658 - RNA, 64 nt, Homo Sapiens; identical to SEQ ID NO: 94840

SEQ ID NO: 604659 - RNA, 64 nt, Homo Sapiens; identical to SEQ ID NO: 94841

SEQ ID NO: 604660 - RNA, 64 nt, Homo Sapiens; identical to SEQ ID NO: 94842

SEQ ID NO: 604661 - RNA, 52 nt, Homo Sapiens; identical to SEQ ID NO: 94843

SEQ ID NO: 604662 - RNA, 64 nt, Homo Sapiens; identical to SEQ ID NO: 94844

SEQ ID NO: 604663 - RNA, 64 nt, Homo Sapiens; identical to SEQ ID NO: 94845

SEQ ID NO: 604664 - RNA, 64 nt, Homo Sapiens; identical to SEQ ID NO: 94846

SEQ ID NO: 604665 - RNA, 64 nt, Homo Sapiens; identical to SEQ ID NO: 94847

SEQ ID NO: 604666 - RNA, 64 nt, Homo Sapiens; identical to SEQ ID NO: 94848

SEQ ID NO: 604667 - RNA, 64 nt, Homo Sapiens; identical to SEQ ID NO: 94849

SEQ ID NO: 604668 - RNA, 64 nt, Homo Sapiens; identical to SEQ ID NO: 109251

SEQ ID NO: 604669 - RNA, 64 nt, Homo Sapiens; identical to SEQ ID NO: 109252

SEQ ID NO: 604670 - RNA, 64 nt, Homo Sapiens; identical to SEQ ID NO: 109253

SEQ ID NO: 604671 - RNA, 64 nt, Homo Sapiens; identical to SEQ ID NO: 109254

SEQ ID NO: 604672 - RNA, 64 nt, Homo Sapiens; identical to SEQ ID NO: 109255

SEQ ID NO: 604673 - RNA, 64 nt, Homo Sapiens; identical to SEQ ID NO: 109256

SEQ ID NO: 604674 - RNA, 64 nt, Homo Sapiens; identical to SEQ ID NO: 179815

SEQ ID NO: 604675 - RNA, 64 nt, Homo Sapiens; identical to SEQ ID NO: 179816

SEQ ID NO: 604676 - RNA, 64 nt, Homo Sapiens; identical to SEQ ID NO: 179817

SEQ ID NO: 604677 - RNA, 64 nt, Homo Sapiens; identical to SEQ ID NO: 179818

SEQ ID NO: 604678 - RNA, 64 nt, Homo Sapiens; identical to SEQ ID NO: 179819

SEQ ID NO: 604679 - RNA, 64 nt, Homo Sapiens; identical to SEQ ID NO: 179820

SEQ ID NO: 604680 - RNA, 64 nt, Homo Sapiens; identical to SEQ ID NO: 179821

SEQ ID NO: 604681 - RNA, 64 nt, Homo Sapiens; identical to SEQ ID NO: 179822

SEQ ID NO: 604682 - RNA, 64 nt, Homo Sapiens; identical to SEQ ID NO: 179823

SEQ ID NO: 604683 - RNA, 64 nt, Homo Sapiens; identical to SEQ ID NO: 179824

SEQ ID NO: 604684 - RNA, 64 nt, Homo Sapiens; identical to SEQ ID NO: 179825

SEQ ID NO: 604685 - RNA, 64 nt, Homo Sapiens; identical to SEQ ID NO: 179826

SEQ ID NO: 604686 - RNA, 64 nt, Homo Sapiens; identical to SEQ ID NO: 179827

SEQ ID NO: 604687 - RNA, 64 nt, Homo Sapiens; identical to SEQ ID NO: 179828

SEQ ID NO: 604688 - RNA, 64 nt, Homo Sapiens; identical to SEQ ID NO: 179829

SEQ ID NO: 604689 - RNA, 64 nt, Homo Sapiens; identical to SEQ ID NO: 179830

SEQ ID NO: 604690 - RNA, 64 nt, Homo Sapiens; identical to SEQ ID NO: 179831

SEQ ID NO: 604691 - RNA, 64 nt, Homo Sapiens; identical to SEQ ID NO: 179832

SEQ ID NO: 604692 - RNA, 64 nt, Homo Sapiens; identical to SEQ ID NO: 179833

SEQ ID NO: 604693 - RNA, 64 nt, Homo Sapiens; identical to SEQ ID NO: 179834

SEQ ID NO: 604694 - RNA, 64 nt, Homo Sapiens; identical to SEQ ID NO: 179835

SEQ ID NO: 604695 - RNA, 64 nt, Homo Sapiens; identical to SEQ ID NO: 179836

SEQ ID NO: 604696 - RNA, 64 nt, Homo Sapiens; identical to SEQ ID NO: 179837

SEQ ID NO: 604697 - RNA, 53 nt, Homo Sapiens; identical to SEQ ID NO: 86549

SEQ ID NO: 604698 - RNA, 64 nt, Homo Sapiens; identical to SEQ ID NO: 179839

SEQ ID NO: 604699 - RNA, 64 nt, Homo Sapiens; identical to SEQ ID NO: 179840

SEQ ID NO: 604700 - RNA, 64 nt, Homo Sapiens; identical to SEQ ID NO: 179841

SEQ ID NO: 604701 - RNA, 64 nt, Homo Sapiens; identical to SEQ ID NO: 179842

SEQ ID NO: 604702 - RNA, 64 nt, Homo Sapiens; identical to SEQ ID NO: 179843

SEQ ID NO: 604703 - RNA, 64 nt, Homo Sapiens; identical to SEQ ID NO: 179844

SEQ ID NO: 604704 - RNA, 64 nt, Homo Sapiens; identical to SEQ ID NO: 179845

SEQ ID NO: 604705 - RNA, 64 nt, Homo Sapiens; identical to SEQ ID NO: 179846

SEQ ID NO: 604706 - RNA, 64 nt, Homo Sapiens; identical to SEQ ID NO: 179847

SEQ ID NO: 604707 - RNA, 64 nt, Homo Sapiens; identical to SEQ ID NO: 179848

SEQ ID NO: 604708 - RNA, 64 nt, Homo Sapiens; identical to SEQ ID NO: 179849

SEQ ID NO: 604709 - RNA, 64 nt, Homo Sapiens; identical to SEQ ID NO: 179850

SEQ ID NO: 604710 - RNA, 64 nt, Homo Sapiens; identical to SEQ ID NO: 179851

SEQ ID NO: 604711 - RNA, 64 nt, Homo Sapiens; identical to SEQ ID NO: 179852

SEQ ID NO: 604712 - RNA, 64 nt, Homo Sapiens; identical to SEQ ID NO: 179853

SEQ ID NO: 604713 - RNA, 64 nt, Homo Sapiens; identical to SEQ ID NO: 179854

SEQ ID NO: 604714 - RNA, 64 nt, Homo Sapiens; identical to SEQ ID NO: 179855

SEQ ID NO: 604715 - RNA, 64 nt, Homo Sapiens; identical to SEQ ID NO: 179856

SEQ ID NO: 604716 - RNA, 64 nt, Homo Sapiens; identical to SEQ ID NO: 179857

SEQ ID NO: 604717 - RNA, 64 nt, Homo Sapiens; identical to SEQ ID NO: 179858

SEQ ID NO: 604718 - RNA, 64 nt, Homo Sapiens; identical to SEQ ID NO: 179859

SEQ ID NO: 604719 - RNA, 64 nt, Homo Sapiens; identical to SEQ ID NO: 179860

SEQ ID NO: 604720 - RNA, 64 nt, Homo Sapiens; identical to SEQ ID NO: 179861

SEQ ID NO: 604721 - RNA, 64 nt, Homo Sapiens; identical to SEQ ID NO: 179862

SEQ ID NO: 604722 - RNA, 64 nt, Homo Sapiens; identical to SEQ ID NO: 179863

SEQ ID NO: 604723 - RNA, 64 nt, Homo Sapiens; identical to SEQ ID NO: 179864

SEQ ID NO: 604724 - RNA, 64 nt, Homo Sapiens; identical to SEQ ID NO: 179865

SEQ ID NO: 604725 - RNA, 64 nt, Homo Sapiens; identical to SEQ ID NO: 179866

SEQ ID NO: 604726 - RNA, 64 nt, Homo Sapiens; identical to SEQ ID NO: 179867

SEQ ID NO: 604727 - RNA, 64 nt, Homo Sapiens; identical to SEQ ID NO: 179868

SEQ ID NO: 604728 - RNA, 64 nt, Homo Sapiens; identical to SEQ ID NO: 179869

SEQ ID NO: 604729 - RNA, 64 nt, Homo Sapiens; identical to SEQ ID NO: 119443

SEQ ID NO: 604730 - RNA, 64 nt, Homo Sapiens; identical to SEQ ID NO: 119444

SEQ ID NO: 604731 - RNA, 64 nt, Homo Sapiens; identical to SEQ ID NO: 119445

SEQ ID NO: 604732 - RNA, 64 nt, Homo Sapiens; identical to SEQ ID NO: 119446

SEQ ID NO: 604733 - RNA, 64 nt, Homo Sapiens; identical to SEQ ID NO: 119447

SEQ ID NO: 604734 - RNA, 64 nt, Homo Sapiens; identical to SEQ ID NO: 119448

SEQ ID NO: 604735 - RNA, 64 nt, Homo Sapiens; identical to SEQ ID NO: 119449

SEQ ID NO: 604736 - RNA, 64 nt, Homo Sapiens; identical to SEQ ID NO: 119450

SEQ ID NO: 604737 - RNA, 64 nt, Homo Sapiens; identical to SEQ ID NO: 119451

SEQ ID NO: 604738 - RNA, 64 nt, Homo Sapiens; identical to SEQ ID NO: 119452

SEQ ID NO: 604739 - RNA, 64 nt, Homo Sapiens; identical to SEQ ID NO: 119453

SEQ ID NO: 604740 - RNA, 64 nt, Homo Sapiens; identical to SEQ ID NO: 119454

SEQ ID NO: 604741 - RNA, 64 nt, Homo Sapiens; identical to SEQ ID NO: 119455

SEQ ID NO: 604742 - RNA, 64 nt, Homo Sapiens; identical to SEQ ID NO: 119456

SEQ ID NO: 604743 - RNA, 64 nt, Homo Sapiens; identical to SEQ ID NO: 119457

SEQ ID NO: 604744 - RNA, 64 nt, Homo Sapiens; identical to SEQ ID NO: 119458

SEQ ID NO: 604745 - RNA, 64 nt, Homo Sapiens; identical to SEQ ID NO: 119459

SEQ ID NO: 604746 - RNA, 64 nt, Homo Sapiens; identical to SEQ ID NO: 119460

SEQ ID NO: 604747 - RNA, 51 nt, Homo Sapiens; identical to SEQ ID NO: 119461

SEQ ID NO: 604748 - RNA, 64 nt, Homo Sapiens; identical to SEQ ID NO: 119462

SEQ ID NO: 604749 - RNA, 64 nt, Homo Sapiens; identical to SEQ ID NO: 119463

SEQ ID NO: 604750 - RNA, 64 nt, Homo Sapiens; identical to SEQ ID NO: 119464

SEQ ID NO: 604751 - RNA, 64 nt, Homo Sapiens; identical to SEQ ID NO: 119465

SEQ ID NO: 604752 - RNA, 64 nt, Homo Sapiens; identical to SEQ ID NO: 119466

SEQ ID NO: 604753 - RNA, 64 nt, Homo Sapiens; identical to SEQ ID NO: 119467

SEQ ID NO: 604754 - RNA, 64 nt, Homo Sapiens; identical to SEQ ID NO: 119468

SEQ ID NO: 604755 - RNA, 64 nt, Homo Sapiens; identical to SEQ ID NO: 119469

SEQ ID NO: 604756 - RNA, 64 nt, Homo Sapiens; identical to SEQ ID NO: 119470

SEQ ID NO: 604757 - RNA, 64 nt, Homo Sapiens; identical to SEQ ID NO: 119471

SEQ ID NO: 604758 - RNA, 64 nt, Homo Sapiens; identical to SEQ ID NO: 119472

SEQ ID NO: 604759 - RNA, 64 nt, Homo Sapiens; identical to SEQ ID NO: 119473

SEQ ID NO: 604760 - RNA, 64 nt, Homo Sapiens; identical to SEQ ID NO: 119474

SEQ ID NO: 604761 - RNA, 64 nt, Homo Sapiens; identical to SEQ ID NO: 119475

SEQ ID NO: 604762 - RNA, 64 nt, Homo Sapiens; identical to SEQ ID NO: 119476

SEQ ID NO: 604763 - RNA, 64 nt, Homo Sapiens; identical to SEQ ID NO: 119477

SEQ ID NO: 604764 - RNA, 64 nt, Homo Sapiens; identical to SEQ ID NO: 119478

SEQ ID NO: 604765 - RNA, 64 nt, Homo Sapiens; identical to SEQ ID NO: 119479

SEQ ID NO: 604766 - RNA, 64 nt, Homo Sapiens; identical to SEQ ID NO: 119480

SEQ ID NO: 604767 - RNA, 64 nt, Homo Sapiens; identical to SEQ ID NO: 119481

SEQ ID NO: 604768 - RNA, 64 nt, Homo Sapiens; identical to SEQ ID NO: 443640

SEQ ID NO: 604769 - RNA, 64 nt, Homo Sapiens; identical to SEQ ID NO: 443641

SEQ ID NO: 604770 - RNA, 64 nt, Homo Sapiens; identical to SEQ ID NO: 443642

SEQ ID NO: 604771 - RNA, 64 nt, Homo Sapiens; identical to SEQ ID NO: 443643

SEQ ID NO: 604772 - RNA, 64 nt, Homo Sapiens; identical to SEQ ID NO: 443644

SEQ ID NO: 604773 - RNA, 64 nt, Homo Sapiens; identical to SEQ ID NO: 443645

SEQ ID NO: 604774 - RNA, 64 nt, Homo Sapiens; identical to SEQ ID NO: 443646

SEQ ID NO: 604775 - RNA, 64 nt, Homo Sapiens; identical to SEQ ID NO: 443647

SEQ ID NO: 604776 - RNA, 56 nt, Homo Sapiens; identical to SEQ ID NO: 443648

SEQ ID NO: 604777 - RNA, 64 nt, Homo Sapiens; identical to SEQ ID NO: 443649

SEQ ID NO: 604778 - RNA, 64 nt, Homo Sapiens; identical to SEQ ID NO: 443650

SEQ ID NO: 604779 - RNA, 64 nt, Homo Sapiens; identical to SEQ ID NO: 443651

SEQ ID NO: 604780 - RNA, 64 nt, Homo Sapiens; identical to SEQ ID NO: 443652

SEQ ID NO: 604781 - RNA, 64 nt, Homo Sapiens; identical to SEQ ID NO: 443653

SEQ ID NO: 604782 - RNA, 64 nt, Homo Sapiens; identical to SEQ ID NO: 443654

SEQ ID NO: 604783 - RNA, 64 nt, Homo Sapiens; identical to SEQ ID NO: 443655

SEQ ID NO: 604784 - RNA, 64 nt, Homo Sapiens; identical to SEQ ID NO: 443656

SEQ ID NO: 604785 - RNA, 64 nt, Homo Sapiens; identical to SEQ ID NO: 443657

SEQ ID NO: 604786 - RNA, 64 nt, Homo Sapiens; identical to SEQ ID NO: 443658

SEQ ID NO: 604787 - RNA, 64 nt, Homo Sapiens; identical to SEQ ID NO: 443659

SEQ ID NO: 604788 - RNA, 64 nt, Homo Sapiens; identical to SEQ ID NO: 443660

SEQ ID NO: 604789 - RNA, 64 nt, Homo Sapiens; identical to SEQ ID NO: 443661

SEQ ID NO: 604790 - RNA, 64 nt, Homo Sapiens; identical to SEQ ID NO: 443662

SEQ ID NO: 604791 - RNA, 64 nt, Homo Sapiens; identical to SEQ ID NO: 443663

SEQ ID NO: 604792 - RNA, 64 nt, Homo Sapiens; identical to SEQ ID NO: 443664

SEQ ID NO: 604793 - RNA, 64 nt, Homo Sapiens; identical to SEQ ID NO: 443665

SEQ ID NO: 604794 - RNA, 64 nt, Homo Sapiens; identical to SEQ ID NO: 443666

SEQ ID NO: 604795 - RNA, 64 nt, Homo Sapiens; identical to SEQ ID NO: 443667

SEQ ID NO: 604796 - RNA, 64 nt, Homo Sapiens; identical to SEQ ID NO: 443668

SEQ ID NO: 604797 - RNA, 64 nt, Homo Sapiens; identical to SEQ ID NO: 443669

SEQ ID NO: 604798 - RNA, 64 nt, Homo Sapiens; identical to SEQ ID NO: 443670

SEQ ID NO: 604799 - RNA, 64 nt, Homo Sapiens; identical to SEQ ID NO: 443671

SEQ ID NO: 604800 - RNA, 64 nt, Homo Sapiens; identical to SEQ ID NO: 443672

SEQ ID NO: 604801 - RNA, 64 nt, Homo Sapiens; identical to SEQ ID NO: 443673

SEQ ID NO: 604802 - RNA, 64 nt, Homo Sapiens; identical to SEQ ID NO: 443674

SEQ ID NO: 604803 - RNA, 64 nt, Homo Sapiens; identical to SEQ ID NO: 443675

SEQ ID NO: 604804 - RNA, 64 nt, Homo Sapiens; identical to SEQ ID NO: 443676

SEQ ID NO: 604805 - RNA, 64 nt, Homo Sapiens; identical to SEQ ID NO: 443677

SEQ ID NO: 604806 - RNA, 64 nt, Homo Sapiens; identical to SEQ ID NO: 443678

SEQ ID NO: 604807 - RNA, 64 nt, Homo Sapiens; identical to SEQ ID NO: 443679

SEQ ID NO: 604808 - RNA, 64 nt, Homo Sapiens; identical to SEQ ID NO: 443680

SEQ ID NO: 604809 - RNA, 64 nt, Homo Sapiens; identical to SEQ ID NO: 443681

SEQ ID NO: 604810 - RNA, 64 nt, Homo Sapiens; identical to SEQ ID NO: 443682

SEQ ID NO: 604811 - RNA, 64 nt, Homo Sapiens; identical to SEQ ID NO: 443683

SEQ ID NO: 604812 - RNA, 64 nt, Homo Sapiens; identical to SEQ ID NO: 443684

SEQ ID NO: 604813 - RNA, 64 nt, Homo Sapiens; identical to SEQ ID NO: 443685

SEQ ID NO: 604814 - RNA, 64 nt, Homo Sapiens; identical to SEQ ID NO: 443686

SEQ ID NO: 604815 - RNA, 64 nt, Homo Sapiens; identical to SEQ ID NO: 443687

SEQ ID NO: 604816 - RNA, 64 nt, Homo Sapiens; identical to SEQ ID NO: 443688

SEQ ID NO: 604817 - RNA, 64 nt, Homo Sapiens; identical to SEQ ID NO: 443689

SEQ ID NO: 604818 - RNA, 64 nt, Homo Sapiens; identical to SEQ ID NO: 443690

SEQ ID NO: 604819 - RNA, 64 nt, Homo Sapiens; identical to SEQ ID NO: 443691

SEQ ID NO: 604820 - RNA, 64 nt, Homo Sapiens; identical to SEQ ID NO: 443692

SEQ ID NO: 604821 - RNA, 64 nt, Homo Sapiens; identical to SEQ ID NO: 443693

SEQ ID NO: 604822 - RNA, 64 nt, Homo Sapiens; identical to SEQ ID NO: 443694

SEQ ID NO: 604823 - RNA, 64 nt, Homo Sapiens; identical to SEQ ID NO: 443695

SEQ ID NO: 604824 - RNA, 64 nt, Homo Sapiens; identical to SEQ ID NO: 443696

SEQ ID NO: 604825 - RNA, 64 nt, Homo Sapiens; identical to SEQ ID NO: 443697

SEQ ID NO: 604826 - RNA, 64 nt, Homo Sapiens; identical to SEQ ID NO: 443698

SEQ ID NO: 604827 - RNA, 64 nt, Homo Sapiens; identical to SEQ ID NO: 443699

SEQ ID NO: 604828 - RNA, 64 nt, Homo Sapiens; identical to SEQ ID NO: 443700

SEQ ID NO: 604829 - RNA, 64 nt, Homo Sapiens; identical to SEQ ID NO: 443701

SEQ ID NO: 604830 - RNA, 64 nt, Homo Sapiens; identical to SEQ ID NO: 443702

SEQ ID NO: 604831 - RNA, 64 nt, Homo Sapiens; identical to SEQ ID NO: 443703

SEQ ID NO: 604832 - RNA, 64 nt, Homo Sapiens; identical to SEQ ID NO: 443704

SEQ ID NO: 604833 - RNA, 64 nt, Homo Sapiens; identical to SEQ ID NO: 443705

SEQ ID NO: 604834 - RNA, 64 nt, Homo Sapiens; identical to SEQ ID NO: 443706

SEQ ID NO: 604835 - RNA, 64 nt, Homo Sapiens; identical to SEQ ID NO: 443707

SEQ ID NO: 604836 - RNA, 64 nt, Homo Sapiens; identical to SEQ ID NO: 443708

SEQ ID NO: 604837 - RNA, 64 nt, Homo Sapiens; identical to SEQ ID NO: 443709

SEQ ID NO: 604838 - RNA, 64 nt, Homo Sapiens; identical to SEQ ID NO: 443710

SEQ ID NO: 604839 - RNA, 64 nt, Homo Sapiens; identical to SEQ ID NO: 443711

SEQ ID NO: 604840 - RNA, 64 nt, Homo Sapiens; identical to SEQ ID NO: 443712

SEQ ID NO: 604841 - RNA, 64 nt, Homo Sapiens; identical to SEQ ID NO: 443713

SEQ ID NO: 604842 - RNA, 64 nt, Homo Sapiens; identical to SEQ ID NO: 443714

SEQ ID NO: 604843 - RNA, 64 nt, Homo Sapiens; identical to SEQ ID NO: 443715

SEQ ID NO: 604844 - RNA, 64 nt, Homo Sapiens; identical to SEQ ID NO: 443716

SEQ ID NO: 604845 - RNA, 64 nt, Homo Sapiens; identical to SEQ ID NO: 443717

SEQ ID NO: 604846 - RNA, 64 nt, Homo Sapiens; identical to SEQ ID NO: 443718

SEQ ID NO: 604847 - RNA, 64 nt, Homo Sapiens; identical to SEQ ID NO: 443719

SEQ ID NO: 604848 - RNA, 64 nt, Homo Sapiens; identical to SEQ ID NO: 443720

SEQ ID NO: 604849 - RNA, 64 nt, Homo Sapiens; identical to SEQ ID NO: 443721

SEQ ID NO: 604850 - RNA, 64 nt, Homo Sapiens; identical to SEQ ID NO: 443722

SEQ ID NO: 604851 - RNA, 64 nt, Homo Sapiens; identical to SEQ ID NO: 443723

SEQ ID NO: 604852 - RNA, 64 nt, Homo Sapiens; identical to SEQ ID NO: 443724

SEQ ID NO: 604853 - RNA, 64 nt, Homo Sapiens; identical to SEQ ID NO: 443725

SEQ ID NO: 604854 - RNA, 64 nt, Homo Sapiens; identical to SEQ ID NO: 443726

SEQ ID NO: 604855 - RNA, 64 nt, Homo Sapiens; identical to SEQ ID NO: 443727

SEQ ID NO: 604856 - RNA, 64 nt, Homo Sapiens; identical to SEQ ID NO: 443728

SEQ ID NO: 604857 - RNA, 64 nt, Homo Sapiens; identical to SEQ ID NO: 443729

SEQ ID NO: 604858 - RNA, 64 nt, Homo Sapiens; identical to SEQ ID NO: 443730

SEQ ID NO: 604859 - RNA, 64 nt, Homo Sapiens; identical to SEQ ID NO: 443731

SEQ ID NO: 604860 - RNA, 64 nt, Homo Sapiens; identical to SEQ ID NO: 443732

SEQ ID NO: 604861 - RNA, 64 nt, Homo Sapiens; identical to SEQ ID NO: 443733

SEQ ID NO: 604862 - RNA, 64 nt, Homo Sapiens; identical to SEQ ID NO: 443734

SEQ ID NO: 604863 - RNA, 64 nt, Homo Sapiens; identical to SEQ ID NO: 443735

SEQ ID NO: 604864 - RNA, 64 nt, Homo Sapiens; identical to SEQ ID NO: 443736

SEQ ID NO: 604865 - RNA, 64 nt, Homo Sapiens; identical to SEQ ID NO: 443737

SEQ ID NO: 604866 - RNA, 64 nt, Homo Sapiens; identical to SEQ ID NO: 443738

SEQ ID NO: 604867 - RNA, 64 nt, Homo Sapiens; identical to SEQ ID NO: 443739

SEQ ID NO: 604868 - RNA, 64 nt, Homo Sapiens; identical to SEQ ID NO: 531886

SEQ ID NO: 604869 - RNA, 64 nt, Homo Sapiens; identical to SEQ ID NO: 531887

SEQ ID NO: 604870 - RNA, 64 nt, Homo Sapiens; identical to SEQ ID NO: 531888

SEQ ID NO: 604871 - RNA, 64 nt, Homo Sapiens; identical to SEQ ID NO: 531889

SEQ ID NO: 604872 - RNA, 64 nt, Homo Sapiens; identical to SEQ ID NO: 531890

SEQ ID NO: 604873 - RNA, 64 nt, Homo Sapiens; identical to SEQ ID NO: 531891

SEQ ID NO: 604874 - RNA, 64 nt, Homo Sapiens; identical to SEQ ID NO: 531892

SEQ ID NO: 604875 - RNA, 64 nt, Homo Sapiens; identical to SEQ ID NO: 531893

SEQ ID NO: 604876 - RNA, 64 nt, Homo Sapiens; identical to SEQ ID NO: 531894

SEQ ID NO: 604877 - RNA, 64 nt, Homo Sapiens; identical to SEQ ID NO: 531895

SEQ ID NO: 604878 - RNA, 64 nt, Homo Sapiens; identical to SEQ ID NO: 531896

SEQ ID NO: 604879 - RNA, 64 nt, Homo Sapiens; identical to SEQ ID NO: 531897

SEQ ID NO: 604880 - RNA, 64 nt, Homo Sapiens; identical to SEQ ID NO: 531898

SEQ ID NO: 604881 - RNA, 64 nt, Homo Sapiens; identical to SEQ ID NO: 531899

SEQ ID NO: 604882 - RNA, 64 nt, Homo Sapiens; identical to SEQ ID NO: 531900

SEQ ID NO: 604883 - RNA, 64 nt, Homo Sapiens; identical to SEQ ID NO: 531901

SEQ ID NO: 604884 - RNA, 64 nt, Homo Sapiens; identical to SEQ ID NO: 531902

SEQ ID NO: 604885 - RNA, 64 nt, Homo Sapiens; identical to SEQ ID NO: 531903

SEQ ID NO: 604886 - RNA, 64 nt, Homo Sapiens; identical to SEQ ID NO: 531904

SEQ ID NO: 604887 - RNA, 64 nt, Homo Sapiens; identical to SEQ ID NO: 531905

SEQ ID NO: 604888 - RNA, 64 nt, Homo Sapiens; identical to SEQ ID NO: 531906

SEQ ID NO: 604889 - RNA, 64 nt, Homo Sapiens; identical to SEQ ID NO: 531907

SEQ ID NO: 604890 - RNA, 64 nt, Homo Sapiens; identical to SEQ ID NO: 531908

SEQ ID NO: 604891 - RNA, 64 nt, Homo Sapiens; identical to SEQ ID NO: 531909

SEQ ID NO: 604892 - RNA, 64 nt, Homo Sapiens; identical to SEQ ID NO: 531910

SEQ ID NO: 604893 - RNA, 64 nt, Homo Sapiens; identical to SEQ ID NO: 531911

SEQ ID NO: 604894 - RNA, 64 nt, Homo Sapiens; identical to SEQ ID NO: 531912

SEQ ID NO: 604895 - RNA, 64 nt, Homo Sapiens; identical to SEQ ID NO: 531913

SEQ ID NO: 604896 - RNA, 64 nt, Homo Sapiens; identical to SEQ ID NO: 531914

SEQ ID NO: 604897 - RNA, 64 nt, Homo Sapiens; identical to SEQ ID NO: 531915

SEQ ID NO: 604898 - RNA, 64 nt, Homo Sapiens; identical to SEQ ID NO: 531916

SEQ ID NO: 604899 - RNA, 64 nt, Homo Sapiens; identical to SEQ ID NO: 531917

SEQ ID NO: 604900 - RNA, 64 nt, Homo Sapiens; identical to SEQ ID NO: 531918

SEQ ID NO: 604901 - RNA, 64 nt, Homo Sapiens; identical to SEQ ID NO: 531919

SEQ ID NO: 604902 - RNA, 64 nt, Homo Sapiens; identical to SEQ ID NO: 531920

SEQ ID NO: 604903 - RNA, 64 nt, Homo Sapiens; identical to SEQ ID NO: 531921

SEQ ID NO: 604904 - RNA, 64 nt, Homo Sapiens; identical to SEQ ID NO: 531922

SEQ ID NO: 604905 - RNA, 64 nt, Homo Sapiens; identical to SEQ ID NO: 211201

SEQ ID NO: 604906 - RNA, 64 nt, Homo Sapiens; identical to SEQ ID NO: 211202

SEQ ID NO: 604907 - RNA, 64 nt, Homo Sapiens; identical to SEQ ID NO: 211203

SEQ ID NO: 604908 - RNA, 64 nt, Homo Sapiens; identical to SEQ ID NO: 211204

SEQ ID NO: 604909 - RNA, 64 nt, Homo Sapiens; identical to SEQ ID NO: 211205

SEQ ID NO: 604910 - RNA, 64 nt, Homo Sapiens; identical to SEQ ID NO: 211206

SEQ ID NO: 604911 - RNA, 64 nt, Homo Sapiens; identical to SEQ ID NO: 531886

SEQ ID NO: 604912 - RNA, 64 nt, Homo Sapiens; identical to SEQ ID NO: 531887

SEQ ID NO: 604913 - RNA, 64 nt, Homo Sapiens; identical to SEQ ID NO: 531888

SEQ ID NO: 604914 - RNA, 64 nt, Homo Sapiens; identical to SEQ ID NO: 531889

SEQ ID NO: 604915 - RNA, 64 nt, Homo Sapiens; identical to SEQ ID NO: 531890

SEQ ID NO: 604916 - RNA, 64 nt, Homo Sapiens; identical to SEQ ID NO: 531891

SEQ ID NO: 604917 - RNA, 64 nt, Homo Sapiens; identical to SEQ ID NO: 531892

SEQ ID NO: 604918 - RNA, 64 nt, Homo Sapiens; identical to SEQ ID NO: 531893

SEQ ID NO: 604919 - RNA, 64 nt, Homo Sapiens; identical to SEQ ID NO: 531894

SEQ ID NO: 604920 - RNA, 64 nt, Homo Sapiens; identical to SEQ ID NO: 531895

SEQ ID NO: 604921 - RNA, 64 nt, Homo Sapiens; identical to SEQ ID NO: 531896

SEQ ID NO: 604922 - RNA, 64 nt, Homo Sapiens; identical to SEQ ID NO: 531897

SEQ ID NO: 604923 - RNA, 64 nt, Homo Sapiens; identical to SEQ ID NO: 531898

SEQ ID NO: 604924 - RNA, 64 nt, Homo Sapiens; identical to SEQ ID NO: 531899

SEQ ID NO: 604925 - RNA, 64 nt, Homo Sapiens; identical to SEQ ID NO: 531900

SEQ ID NO: 604926 - RNA, 64 nt, Homo Sapiens; identical to SEQ ID NO: 531901

SEQ ID NO: 604927 - RNA, 64 nt, Homo Sapiens; identical to SEQ ID NO: 531902

SEQ ID NO: 604928 - RNA, 64 nt, Homo Sapiens; identical to SEQ ID NO: 531903

SEQ ID NO: 604929 - RNA, 64 nt, Homo Sapiens; identical to SEQ ID NO: 531904

SEQ ID NO: 604930 - RNA, 64 nt, Homo Sapiens; identical to SEQ ID NO: 531905

SEQ ID NO: 604931 - RNA, 64 nt, Homo Sapiens; identical to SEQ ID NO: 531906

SEQ ID NO: 604932 - RNA, 64 nt, Homo Sapiens; identical to SEQ ID NO: 531907

SEQ ID NO: 604933 - RNA, 64 nt, Homo Sapiens; identical to SEQ ID NO: 531908

SEQ ID NO: 604934 - RNA, 64 nt, Homo Sapiens; identical to SEQ ID NO: 531909

SEQ ID NO: 604935 - RNA, 64 nt, Homo Sapiens; identical to SEQ ID NO: 531910

SEQ ID NO: 604936 - RNA, 64 nt, Homo Sapiens; identical to SEQ ID NO: 531911

SEQ ID NO: 604937 - RNA, 64 nt, Homo Sapiens; identical to SEQ ID NO: 531912

SEQ ID NO: 604938 - RNA, 64 nt, Homo Sapiens; identical to SEQ ID NO: 531913

SEQ ID NO: 604939 - RNA, 64 nt, Homo Sapiens; identical to SEQ ID NO: 531914

SEQ ID NO: 604940 - RNA, 64 nt, Homo Sapiens; identical to SEQ ID NO: 531915

SEQ ID NO: 604941 - RNA, 64 nt, Homo Sapiens; identical to SEQ ID NO: 531916

SEQ ID NO: 604942 - RNA, 64 nt, Homo Sapiens; identical to SEQ ID NO: 531917

SEQ ID NO: 604943 - RNA, 64 nt, Homo Sapiens; identical to SEQ ID NO: 531918

SEQ ID NO: 604944 - RNA, 64 nt, Homo Sapiens; identical to SEQ ID NO: 531919

SEQ ID NO: 604945 - RNA, 64 nt, Homo Sapiens; identical to SEQ ID NO: 531920

SEQ ID NO: 604946 - RNA, 64 nt, Homo Sapiens; identical to SEQ ID NO: 531921

SEQ ID NO: 604947 - RNA, 64 nt, Homo Sapiens; identical to SEQ ID NO: 531922

SEQ ID NO: 604948 - RNA, 64 nt, Homo Sapiens; identical to SEQ ID NO: 211201

SEQ ID NO: 604949 - RNA, 64 nt, Homo Sapiens; identical to SEQ ID NO: 211202

SEQ ID NO: 604950 - RNA, 64 nt, Homo Sapiens; identical to SEQ ID NO: 211203

SEQ ID NO: 604951 - RNA, 64 nt, Homo Sapiens; identical to SEQ ID NO: 211204

SEQ ID NO: 604952 - RNA, 64 nt, Homo Sapiens; identical to SEQ ID NO: 211205

SEQ ID NO: 604953 - RNA, 64 nt, Homo Sapiens; identical to SEQ ID NO: 211206

SEQ ID NO: 604954 - RNA, 64 nt, Homo Sapiens; identical to SEQ ID NO: 531886

SEQ ID NO: 604955 - RNA, 64 nt, Homo Sapiens; identical to SEQ ID NO: 531887

SEQ ID NO: 604956 - RNA, 64 nt, Homo Sapiens; identical to SEQ ID NO: 531888

SEQ ID NO: 604957 - RNA, 64 nt, Homo Sapiens; identical to SEQ ID NO: 531889

SEQ ID NO: 604958 - RNA, 64 nt, Homo Sapiens; identical to SEQ ID NO: 531890

SEQ ID NO: 604959 - RNA, 64 nt, Homo Sapiens; identical to SEQ ID NO: 531891

SEQ ID NO: 604960 - RNA, 64 nt, Homo Sapiens; identical to SEQ ID NO: 531892

SEQ ID NO: 604961 - RNA, 64 nt, Homo Sapiens; identical to SEQ ID NO: 531893

SEQ ID NO: 604962 - RNA, 64 nt, Homo Sapiens; identical to SEQ ID NO: 531894

SEQ ID NO: 604963 - RNA, 64 nt, Homo Sapiens; identical to SEQ ID NO: 531895

SEQ ID NO: 604964 - RNA, 64 nt, Homo Sapiens; identical to SEQ ID NO: 531896

SEQ ID NO: 604965 - RNA, 64 nt, Homo Sapiens; identical to SEQ ID NO: 531897

SEQ ID NO: 604966 - RNA, 64 nt, Homo Sapiens; identical to SEQ ID NO: 531898

SEQ ID NO: 604967 - RNA, 64 nt, Homo Sapiens; identical to SEQ ID NO: 531899

SEQ ID NO: 604968 - RNA, 64 nt, Homo Sapiens; identical to SEQ ID NO: 531900

SEQ ID NO: 604969 - RNA, 64 nt, Homo Sapiens; identical to SEQ ID NO: 531901

SEQ ID NO: 604970 - RNA, 64 nt, Homo Sapiens; identical to SEQ ID NO: 531902

SEQ ID NO: 604971 - RNA, 64 nt, Homo Sapiens; identical to SEQ ID NO: 531903

SEQ ID NO: 604972 - RNA, 64 nt, Homo Sapiens; identical to SEQ ID NO: 531904

SEQ ID NO: 604973 - RNA, 64 nt, Homo Sapiens; identical to SEQ ID NO: 531905

SEQ ID NO: 604974 - RNA, 64 nt, Homo Sapiens; identical to SEQ ID NO: 531906

SEQ ID NO: 604975 - RNA, 64 nt, Homo Sapiens; identical to SEQ ID NO: 531907

SEQ ID NO: 604976 - RNA, 64 nt, Homo Sapiens; identical to SEQ ID NO: 531908

SEQ ID NO: 604977 - RNA, 64 nt, Homo Sapiens; identical to SEQ ID NO: 531909

SEQ ID NO: 604978 - RNA, 64 nt, Homo Sapiens; identical to SEQ ID NO: 531910

SEQ ID NO: 604979 - RNA, 64 nt, Homo Sapiens; identical to SEQ ID NO: 531911

SEQ ID NO: 604980 - RNA, 64 nt, Homo Sapiens; identical to SEQ ID NO: 531912

SEQ ID NO: 604981 - RNA, 64 nt, Homo Sapiens; identical to SEQ ID NO: 531913

SEQ ID NO: 604982 - RNA, 64 nt, Homo Sapiens; identical to SEQ ID NO: 531914

SEQ ID NO: 604983 - RNA, 64 nt, Homo Sapiens; identical to SEQ ID NO: 531915

SEQ ID NO: 604984 - RNA, 64 nt, Homo Sapiens; identical to SEQ ID NO: 531916

SEQ ID NO: 604985 - RNA, 64 nt, Homo Sapiens; identical to SEQ ID NO: 531917

SEQ ID NO: 604986 - RNA, 64 nt, Homo Sapiens; identical to SEQ ID NO: 531918

SEQ ID NO: 604987 - RNA, 64 nt, Homo Sapiens; identical to SEQ ID NO: 531919

SEQ ID NO: 604988 - RNA, 64 nt, Homo Sapiens; identical to SEQ ID NO: 531920

SEQ ID NO: 604989 - RNA, 64 nt, Homo Sapiens; identical to SEQ ID NO: 531921

SEQ ID NO: 604990 - RNA, 64 nt, Homo Sapiens; identical to SEQ ID NO: 531922

SEQ ID NO: 604991 - RNA, 64 nt, Homo Sapiens; identical to SEQ ID NO: 211201

SEQ ID NO: 604992 - RNA, 64 nt, Homo Sapiens; identical to SEQ ID NO: 211202

SEQ ID NO: 604993 - RNA, 64 nt, Homo Sapiens; identical to SEQ ID NO: 211203

SEQ ID NO: 604994 - RNA, 64 nt, Homo Sapiens; identical to SEQ ID NO: 211204

SEQ ID NO: 604995 - RNA, 64 nt, Homo Sapiens; identical to SEQ ID NO: 211205

SEQ ID NO: 604996 - RNA, 64 nt, Homo Sapiens; identical to SEQ ID NO: 211206

SEQ ID NO: 604997 - RNA, 64 nt, Homo Sapiens; identical to SEQ ID NO: 132924

SEQ ID NO: 604998 - RNA, 64 nt, Homo Sapiens; identical to SEQ ID NO: 132925

SEQ ID NO: 604999 - RNA, 64 nt, Homo Sapiens; identical to SEQ ID NO: 132926

SEQ ID NO: 605000 - RNA, 64 nt, Homo Sapiens; identical to SEQ ID NO: 132927

SEQ ID NO: 605001 - RNA, 64 nt, Homo Sapiens; identical to SEQ ID NO: 132928

SEQ ID NO: 605002 - RNA, 64 nt, Homo Sapiens; identical to SEQ ID NO: 132929

SEQ ID NO: 605003 - RNA, 64 nt, Homo Sapiens; identical to SEQ ID NO: 132930

SEQ ID NO: 605004 - RNA, 64 nt, Homo Sapiens; identical to SEQ ID NO: 132931

SEQ ID NO: 605005 - RNA, 64 nt, Homo Sapiens; identical to SEQ ID NO: 132932

SEQ ID NO: 605006 - RNA, 64 nt, Homo Sapiens; identical to SEQ ID NO: 132933

SEQ ID NO: 605007 - RNA, 64 nt, Homo Sapiens; identical to SEQ ID NO: 132934

SEQ ID NO: 605008 - RNA, 64 nt, Homo Sapiens; identical to SEQ ID NO: 132935

SEQ ID NO: 605009 - RNA, 64 nt, Homo Sapiens; identical to SEQ ID NO: 132936

SEQ ID NO: 605010 - RNA, 64 nt, Homo Sapiens; identical to SEQ ID NO: 132937

SEQ ID NO: 605011 - RNA, 64 nt, Homo Sapiens; identical to SEQ ID NO: 132938

SEQ ID NO: 605012 - RNA, 64 nt, Homo Sapiens; identical to SEQ ID NO: 132939

SEQ ID NO: 605013 - RNA, 64 nt, Homo Sapiens; identical to SEQ ID NO: 132940

SEQ ID NO: 605014 - RNA, 64 nt, Homo Sapiens; identical to SEQ ID NO: 132941

SEQ ID NO: 605015 - RNA, 64 nt, Homo Sapiens; identical to SEQ ID NO: 132942

SEQ ID NO: 605016 - RNA, 64 nt, Homo Sapiens; identical to SEQ ID NO: 132943

SEQ ID NO: 605017 - RNA, 64 nt, Homo Sapiens; identical to SEQ ID NO: 132944

SEQ ID NO: 605018 - RNA, 64 nt, Homo Sapiens; identical to SEQ ID NO: 132945

SEQ ID NO: 605019 - RNA, 64 nt, Homo Sapiens; identical to SEQ ID NO: 132946

SEQ ID NO: 605020 - RNA, 64 nt, Homo Sapiens; identical to SEQ ID NO: 132947

SEQ ID NO: 605021 - RNA, 64 nt, Homo Sapiens; identical to SEQ ID NO: 132948

SEQ ID NO: 605022 - RNA, 64 nt, Homo Sapiens; identical to SEQ ID NO: 132949

SEQ ID NO: 605023 - RNA, 64 nt, Homo Sapiens; identical to SEQ ID NO: 132950

SEQ ID NO: 605024 - RNA, 64 nt, Homo Sapiens; identical to SEQ ID NO: 132951

SEQ ID NO: 605025 - RNA, 64 nt, Homo Sapiens; identical to SEQ ID NO: 132952

SEQ ID NO: 605026 - RNA, 64 nt, Homo Sapiens; identical to SEQ ID NO: 132953

SEQ ID NO: 605027 - RNA, 64 nt, Homo Sapiens; identical to SEQ ID NO: 132954

SEQ ID NO: 605028 - RNA, 64 nt, Homo Sapiens; identical to SEQ ID NO: 132955

SEQ ID NO: 605029 - RNA, 64 nt, Homo Sapiens; identical to SEQ ID NO: 132956

SEQ ID NO: 605030 - RNA, 64 nt, Homo Sapiens; identical to SEQ ID NO: 132957

SEQ ID NO: 605031 - RNA, 64 nt, Homo Sapiens; identical to SEQ ID NO: 132958

SEQ ID NO: 605032 - RNA, 64 nt, Homo Sapiens; identical to SEQ ID NO: 132959

SEQ ID NO: 605033 - RNA, 64 nt, Homo Sapiens; identical to SEQ ID NO: 132960

SEQ ID NO: 605034 - RNA, 64 nt, Homo Sapiens; identical to SEQ ID NO: 132961

SEQ ID NO: 605035 - RNA, 64 nt, Homo Sapiens; identical to SEQ ID NO: 132962

SEQ ID NO: 605036 - RNA, 64 nt, Homo Sapiens; identical to SEQ ID NO: 132963

SEQ ID NO: 605037 - RNA, 64 nt, Homo Sapiens; identical to SEQ ID NO: 132964

SEQ ID NO: 605038 - RNA, 64 nt, Homo Sapiens; identical to SEQ ID NO: 132965

SEQ ID NO: 605039 - RNA, 64 nt, Homo Sapiens; identical to SEQ ID NO: 132966

SEQ ID NO: 605040 - RNA, 58 nt, Homo Sapiens; identical to SEQ ID NO: 132967

SEQ ID NO: 605041 - RNA, 64 nt, Homo Sapiens; identical to SEQ ID NO: 132968

SEQ ID NO: 605042 - RNA, 64 nt, Homo Sapiens; identical to SEQ ID NO: 132969

SEQ ID NO: 605043 - RNA, 64 nt, Homo Sapiens; identical to SEQ ID NO: 132970

SEQ ID NO: 605044 - RNA, 64 nt, Homo Sapiens; identical to SEQ ID NO: 132971

SEQ ID NO: 605045 - RNA, 64 nt, Homo Sapiens; identical to SEQ ID NO: 132972

SEQ ID NO: 605046 - RNA, 64 nt, Homo Sapiens; identical to SEQ ID NO: 132973

SEQ ID NO: 605047 - RNA, 64 nt, Homo Sapiens; identical to SEQ ID NO: 132974

SEQ ID NO: 605048 - RNA, 64 nt, Homo Sapiens; identical to SEQ ID NO: 132975

SEQ ID NO: 605049 - RNA, 64 nt, Homo Sapiens; identical to SEQ ID NO: 132976

SEQ ID NO: 605050 - RNA, 64 nt, Homo Sapiens; identical to SEQ ID NO: 132977

SEQ ID NO: 605051 - RNA, 64 nt, Homo Sapiens; identical to SEQ ID NO: 132978

SEQ ID NO: 605052 - RNA, 64 nt, Homo Sapiens; identical to SEQ ID NO: 132979

SEQ ID NO: 605053 - RNA, 64 nt, Homo Sapiens; identical to SEQ ID NO: 132980

SEQ ID NO: 605054 - RNA, 64 nt, Homo Sapiens; identical to SEQ ID NO: 132981

SEQ ID NO: 605055 - RNA, 64 nt, Homo Sapiens; identical to SEQ ID NO: 132982

SEQ ID NO: 605056 - RNA, 64 nt, Homo Sapiens; identical to SEQ ID NO: 132983

SEQ ID NO: 605057 - RNA, 64 nt, Homo Sapiens; identical to SEQ ID NO: 132984

SEQ ID NO: 605058 - RNA, 64 nt, Homo Sapiens; identical to SEQ ID NO: 132985

SEQ ID NO: 605059 - RNA, 64 nt, Homo Sapiens; identical to SEQ ID NO: 132986

SEQ ID NO: 605060 - RNA, 64 nt, Homo Sapiens; identical to SEQ ID NO: 132987

SEQ ID NO: 605061 - RNA, 64 nt, Homo Sapiens; identical to SEQ ID NO: 132988

SEQ ID NO: 605062 - RNA, 64 nt, Homo Sapiens; identical to SEQ ID NO: 132989

SEQ ID NO: 605063 - RNA, 64 nt, Homo Sapiens; identical to SEQ ID NO: 132990

SEQ ID NO: 605064 - RNA, 64 nt, Homo Sapiens; identical to SEQ ID NO: 132991

SEQ ID NO: 605065 - RNA, 64 nt, Homo Sapiens; identical to SEQ ID NO: 132992

SEQ ID NO: 605066 - RNA, 64 nt, Homo Sapiens; identical to SEQ ID NO: 132993

SEQ ID NO: 605067 - RNA, 64 nt, Homo Sapiens; identical to SEQ ID NO: 132994

SEQ ID NO: 605068 - RNA, 64 nt, Homo Sapiens; identical to SEQ ID NO: 132995

SEQ ID NO: 605069 - RNA, 64 nt, Homo Sapiens; identical to SEQ ID NO: 132996

SEQ ID NO: 605070 - RNA, 64 nt, Homo Sapiens; identical to SEQ ID NO: 132997

SEQ ID NO: 605071 - RNA, 64 nt, Homo Sapiens; identical to SEQ ID NO: 132998

SEQ ID NO: 605072 - RNA, 64 nt, Homo Sapiens; identical to SEQ ID NO: 132999

SEQ ID NO: 605073 - RNA, 64 nt, Homo Sapiens; identical to SEQ ID NO: 133000

SEQ ID NO: 605074 - RNA, 64 nt, Homo Sapiens; identical to SEQ ID NO: 133001

SEQ ID NO: 605075 - RNA, 64 nt, Homo Sapiens; identical to SEQ ID NO: 133002

SEQ ID NO: 605076 - RNA, 64 nt, Homo Sapiens; identical to SEQ ID NO: 133003

SEQ ID NO: 605077 - RNA, 64 nt, Homo Sapiens; identical to SEQ ID NO: 133004

SEQ ID NO: 605078 - RNA, 64 nt, Homo Sapiens; identical to SEQ ID NO: 133005

SEQ ID NO: 605079 - RNA, 64 nt, Homo Sapiens; identical to SEQ ID NO: 133006

SEQ ID NO: 605080 - RNA, 64 nt, Homo Sapiens; identical to SEQ ID NO: 133007

SEQ ID NO: 605081 - RNA, 64 nt, Homo Sapiens; identical to SEQ ID NO: 133008

SEQ ID NO: 605082 - RNA, 64 nt, Homo Sapiens; identical to SEQ ID NO: 133009

SEQ ID NO: 605083 - RNA, 64 nt, Homo Sapiens; identical to SEQ ID NO: 133010

SEQ ID NO: 605084 - RNA, 64 nt, Homo Sapiens; identical to SEQ ID NO: 133011

SEQ ID NO: 605085 - RNA, 64 nt, Homo Sapiens; identical to SEQ ID NO: 133012

SEQ ID NO: 605086 - RNA, 64 nt, Homo Sapiens; identical to SEQ ID NO: 133013

SEQ ID NO: 605087 - RNA, 64 nt, Homo Sapiens; identical to SEQ ID NO: 133014

SEQ ID NO: 605088 - RNA, 64 nt, Homo Sapiens; identical to SEQ ID NO: 133015

SEQ ID NO: 605089 - RNA, 64 nt, Homo Sapiens; identical to SEQ ID NO: 133016

SEQ ID NO: 605090 - RNA, 64 nt, Homo Sapiens; identical to SEQ ID NO: 133017

SEQ ID NO: 605091 - RNA, 64 nt, Homo Sapiens; identical to SEQ ID NO: 133018

SEQ ID NO: 605092 - RNA, 64 nt, Homo Sapiens; identical to SEQ ID NO: 133019

SEQ ID NO: 605093 - RNA, 64 nt, Homo Sapiens; identical to SEQ ID NO: 133020

SEQ ID NO: 605094 - RNA, 64 nt, Homo Sapiens; identical to SEQ ID NO: 133021

SEQ ID NO: 605095 - RNA, 64 nt, Homo Sapiens; identical to SEQ ID NO: 133022

SEQ ID NO: 605096 - RNA, 64 nt, Homo Sapiens; identical to SEQ ID NO: 133023

SEQ ID NO: 605097 - RNA, 64 nt, Homo Sapiens; identical to SEQ ID NO: 133024

SEQ ID NO: 605098 - RNA, 64 nt, Homo Sapiens; identical to SEQ ID NO: 133025

SEQ ID NO: 605099 - RNA, 64 nt, Homo Sapiens; identical to SEQ ID NO: 133026

SEQ ID NO: 605100 - RNA, 64 nt, Homo Sapiens; identical to SEQ ID NO: 133027

SEQ ID NO: 605101 - RNA, 64 nt, Homo Sapiens; identical to SEQ ID NO: 133028

SEQ ID NO: 605102 - RNA, 64 nt, Homo Sapiens; identical to SEQ ID NO: 133029

SEQ ID NO: 605103 - RNA, 64 nt, Homo Sapiens; identical to SEQ ID NO: 133030

SEQ ID NO: 605104 - RNA, 64 nt, Homo Sapiens; identical to SEQ ID NO: 133031

SEQ ID NO: 605105 - RNA, 64 nt, Homo Sapiens; identical to SEQ ID NO: 133032

SEQ ID NO: 605106 - RNA, 64 nt, Homo Sapiens; identical to SEQ ID NO: 133033

SEQ ID NO: 605107 - RNA, 64 nt, Homo Sapiens; identical to SEQ ID NO: 133034

SEQ ID NO: 605108 - RNA, 64 nt, Homo Sapiens; identical to SEQ ID NO: 133035

SEQ ID NO: 605109 - RNA, 64 nt, Homo Sapiens; identical to SEQ ID NO: 133036

SEQ ID NO: 605110 - RNA, 64 nt, Homo Sapiens; identical to SEQ ID NO: 133037

SEQ ID NO: 605111 - RNA, 64 nt, Homo Sapiens; identical to SEQ ID NO: 133038

SEQ ID NO: 605112 - RNA, 64 nt, Homo Sapiens; identical to SEQ ID NO: 133039

SEQ ID NO: 605113 - RNA, 64 nt, Homo Sapiens; identical to SEQ ID NO: 133040

SEQ ID NO: 605114 - RNA, 64 nt, Homo Sapiens; identical to SEQ ID NO: 133041

SEQ ID NO: 605115 - RNA, 64 nt, Homo Sapiens; identical to SEQ ID NO: 133042

SEQ ID NO: 605116 - RNA, 64 nt, Homo Sapiens; identical to SEQ ID NO: 133043

SEQ ID NO: 605117 - RNA, 64 nt, Homo Sapiens; identical to SEQ ID NO: 133044

SEQ ID NO: 605118 - RNA, 64 nt, Homo Sapiens; identical to SEQ ID NO: 133045

SEQ ID NO: 605119 - RNA, 64 nt, Homo Sapiens; identical to SEQ ID NO: 133046

SEQ ID NO: 605120 - RNA, 64 nt, Homo Sapiens; identical to SEQ ID NO: 133047

SEQ ID NO: 605121 - RNA, 64 nt, Homo Sapiens; identical to SEQ ID NO: 133048

SEQ ID NO: 605122 - RNA, 64 nt, Homo Sapiens; identical to SEQ ID NO: 133049

SEQ ID NO: 605123 - RNA, 64 nt, Homo Sapiens; identical to SEQ ID NO: 132958

SEQ ID NO: 605124 - RNA, 64 nt, Homo Sapiens; identical to SEQ ID NO: 132959

SEQ ID NO: 605125 - RNA, 64 nt, Homo Sapiens; identical to SEQ ID NO: 133052

SEQ ID NO: 605126 - RNA, 64 nt, Homo Sapiens; identical to SEQ ID NO: 133053

SEQ ID NO: 605127 - RNA, 64 nt, Homo Sapiens; identical to SEQ ID NO: 133054

SEQ ID NO: 605128 - RNA, 64 nt, Homo Sapiens; identical to SEQ ID NO: 133055

SEQ ID NO: 605129 - RNA, 64 nt, Homo Sapiens; identical to SEQ ID NO: 133056

SEQ ID NO: 605130 - RNA, 64 nt, Homo Sapiens; identical to SEQ ID NO: 133057

SEQ ID NO: 605131 - RNA, 64 nt, Homo Sapiens; identical to SEQ ID NO: 133058

SEQ ID NO: 605132 - RNA, 64 nt, Homo Sapiens; identical to SEQ ID NO: 133059

SEQ ID NO: 605133 - RNA, 64 nt, Homo Sapiens; identical to SEQ ID NO: 133060

SEQ ID NO: 605134 - RNA, 64 nt, Homo Sapiens; identical to SEQ ID NO: 133061

SEQ ID NO: 605135 - RNA, 64 nt, Homo Sapiens; identical to SEQ ID NO: 133062

SEQ ID NO: 605136 - RNA, 64 nt, Homo Sapiens; identical to SEQ ID NO: 133063

SEQ ID NO: 605137 - RNA, 64 nt, Homo Sapiens; identical to SEQ ID NO: 133064

SEQ ID NO: 605138 - RNA, 64 nt, Homo Sapiens; identical to SEQ ID NO: 133065

SEQ ID NO: 605139 - RNA, 64 nt, Homo Sapiens; identical to SEQ ID NO: 133066

SEQ ID NO: 605140 - RNA, 64 nt, Homo Sapiens; identical to SEQ ID NO: 133067

SEQ ID NO: 605141 - RNA, 64 nt, Homo Sapiens; identical to SEQ ID NO: 133068

SEQ ID NO: 605142 - RNA, 64 nt, Homo Sapiens; identical to SEQ ID NO: 133069

SEQ ID NO: 605143 - RNA, 64 nt, Homo Sapiens; identical to SEQ ID NO: 133070

SEQ ID NO: 605144 - RNA, 64 nt, Homo Sapiens; identical to SEQ ID NO: 133071

SEQ ID NO: 605145 - RNA, 64 nt, Homo Sapiens; identical to SEQ ID NO: 133072

SEQ ID NO: 605146 - RNA, 64 nt, Homo Sapiens; identical to SEQ ID NO: 133073

SEQ ID NO: 605147 - RNA, 64 nt, Homo Sapiens; identical to SEQ ID NO: 133074

SEQ ID NO: 605148 - RNA, 64 nt, Homo Sapiens; identical to SEQ ID NO: 133075

SEQ ID NO: 605149 - RNA, 64 nt, Homo Sapiens; identical to SEQ ID NO: 133076

SEQ ID NO: 605150 - RNA, 64 nt, Homo Sapiens; identical to SEQ ID NO: 133077

SEQ ID NO: 605151 - RNA, 64 nt, Homo Sapiens; identical to SEQ ID NO: 133078

SEQ ID NO: 605152 - RNA, 64 nt, Homo Sapiens; identical to SEQ ID NO: 133079

SEQ ID NO: 605153 - RNA, 64 nt, Homo Sapiens; identical to SEQ ID NO: 133080

SEQ ID NO: 605154 - RNA, 64 nt, Homo Sapiens; identical to SEQ ID NO: 133081

SEQ ID NO: 605155 - RNA, 64 nt, Homo Sapiens; identical to SEQ ID NO: 133082

SEQ ID NO: 605156 - RNA, 64 nt, Homo Sapiens; identical to SEQ ID NO: 133083

SEQ ID NO: 605157 - RNA, 64 nt, Homo Sapiens; identical to SEQ ID NO: 133084

SEQ ID NO: 605158 - RNA, 64 nt, Homo Sapiens; identical to SEQ ID NO: 133085

SEQ ID NO: 605159 - RNA, 64 nt, Homo Sapiens; identical to SEQ ID NO: 133086

SEQ ID NO: 605160 - RNA, 64 nt, Homo Sapiens; identical to SEQ ID NO: 133087

SEQ ID NO: 605161 - RNA, 64 nt, Homo Sapiens; identical to SEQ ID NO: 133088

SEQ ID NO: 605162 - RNA, 64 nt, Homo Sapiens; identical to SEQ ID NO: 133089

SEQ ID NO: 605163 - RNA, 64 nt, Homo Sapiens; identical to SEQ ID NO: 133090

SEQ ID NO: 605164 - RNA, 64 nt, Homo Sapiens; identical to SEQ ID NO: 133091

SEQ ID NO: 605165 - RNA, 64 nt, Homo Sapiens; identical to SEQ ID NO: 133092

SEQ ID NO: 605166 - RNA, 64 nt, Homo Sapiens; identical to SEQ ID NO: 133093

SEQ ID NO: 605167 - RNA, 64 nt, Homo Sapiens; identical to SEQ ID NO: 133094

SEQ ID NO: 605168 - RNA, 64 nt, Homo Sapiens; identical to SEQ ID NO: 133095

SEQ ID NO: 605169 - RNA, 64 nt, Homo Sapiens; identical to SEQ ID NO: 133096

SEQ ID NO: 605170 - RNA, 64 nt, Homo Sapiens; identical to SEQ ID NO: 133097

SEQ ID NO: 605171 - RNA, 64 nt, Homo Sapiens; identical to SEQ ID NO: 133098

SEQ ID NO: 605172 - RNA, 64 nt, Homo Sapiens; identical to SEQ ID NO: 133099

SEQ ID NO: 605173 - RNA, 64 nt, Homo Sapiens; identical to SEQ ID NO: 133100

SEQ ID NO: 605174 - RNA, 64 nt, Homo Sapiens; identical to SEQ ID NO: 133101

SEQ ID NO: 605175 - RNA, 64 nt, Homo Sapiens; identical to SEQ ID NO: 133102

SEQ ID NO: 605176 - RNA, 64 nt, Homo Sapiens; identical to SEQ ID NO: 133103

SEQ ID NO: 605177 - RNA, 64 nt, Homo Sapiens; identical to SEQ ID NO: 133104

SEQ ID NO: 605178 - RNA, 64 nt, Homo Sapiens; identical to SEQ ID NO: 133105

SEQ ID NO: 605179 - RNA, 64 nt, Homo Sapiens; identical to SEQ ID NO: 133106

SEQ ID NO: 605180 - RNA, 64 nt, Homo Sapiens; identical to SEQ ID NO: 133107

SEQ ID NO: 605181 - RNA, 64 nt, Homo Sapiens; identical to SEQ ID NO: 133108

SEQ ID NO: 605182 - RNA, 64 nt, Homo Sapiens; identical to SEQ ID NO: 133109

SEQ ID NO: 605183 - RNA, 64 nt, Homo Sapiens; identical to SEQ ID NO: 133110

SEQ ID NO: 605184 - RNA, 64 nt, Homo Sapiens; identical to SEQ ID NO: 133111

SEQ ID NO: 605185 - RNA, 64 nt, Homo Sapiens; identical to SEQ ID NO: 133112

SEQ ID NO: 605186 - RNA, 64 nt, Homo Sapiens; identical to SEQ ID NO: 133113

SEQ ID NO: 605187 - RNA, 64 nt, Homo Sapiens; identical to SEQ ID NO: 133114

SEQ ID NO: 605188 - RNA, 64 nt, Homo Sapiens; identical to SEQ ID NO: 133115

SEQ ID NO: 605189 - RNA, 64 nt, Homo Sapiens; identical to SEQ ID NO: 133116

SEQ ID NO: 605190 - RNA, 64 nt, Homo Sapiens; identical to SEQ ID NO: 133117

SEQ ID NO: 605191 - RNA, 64 nt, Homo Sapiens; identical to SEQ ID NO: 133118

SEQ ID NO: 605192 - RNA, 64 nt, Homo Sapiens; identical to SEQ ID NO: 133119

SEQ ID NO: 605193 - RNA, 64 nt, Homo Sapiens; identical to SEQ ID NO: 133120

SEQ ID NO: 605194 - RNA, 64 nt, Homo Sapiens; identical to SEQ ID NO: 133121

SEQ ID NO: 605195 - RNA, 64 nt, Homo Sapiens; identical to SEQ ID NO: 133122

SEQ ID NO: 605196 - RNA, 64 nt, Homo Sapiens; identical to SEQ ID NO: 133123

SEQ ID NO: 605197 - RNA, 64 nt, Homo Sapiens; identical to SEQ ID NO: 133124

SEQ ID NO: 605198 - RNA, 64 nt, Homo Sapiens; identical to SEQ ID NO: 133125

SEQ ID NO: 605199 - RNA, 64 nt, Homo Sapiens; identical to SEQ ID NO: 133126

SEQ ID NO: 605200 - RNA, 64 nt, Homo Sapiens; identical to SEQ ID NO: 133127

SEQ ID NO: 605201 - RNA, 64 nt, Homo Sapiens; identical to SEQ ID NO: 133128

SEQ ID NO: 605202 - RNA, 64 nt, Homo Sapiens; identical to SEQ ID NO: 133129

SEQ ID NO: 605203 - RNA, 64 nt, Homo Sapiens; identical to SEQ ID NO: 133130

SEQ ID NO: 605204 - RNA, 64 nt, Homo Sapiens; identical to SEQ ID NO: 133131

SEQ ID NO: 605205 - RNA, 64 nt, Homo Sapiens; identical to SEQ ID NO: 133132

SEQ ID NO: 605206 - RNA, 64 nt, Homo Sapiens; identical to SEQ ID NO: 133133

SEQ ID NO: 605207 - RNA, 64 nt, Homo Sapiens; identical to SEQ ID NO: 133134

SEQ ID NO: 605208 - RNA, 64 nt, Homo Sapiens; identical to SEQ ID NO: 133135

SEQ ID NO: 605209 - RNA, 64 nt, Homo Sapiens; identical to SEQ ID NO: 133136

SEQ ID NO: 605210 - RNA, 64 nt, Homo Sapiens; identical to SEQ ID NO: 133137

SEQ ID NO: 605211 - RNA, 64 nt, Homo Sapiens; identical to SEQ ID NO: 133138

SEQ ID NO: 605212 - RNA, 64 nt, Homo Sapiens; identical to SEQ ID NO: 133139

SEQ ID NO: 605213 - RNA, 64 nt, Homo Sapiens; identical to SEQ ID NO: 133140

SEQ ID NO: 605214 - RNA, 64 nt, Homo Sapiens; identical to SEQ ID NO: 133141

SEQ ID NO: 605215 - RNA, 64 nt, Homo Sapiens; identical to SEQ ID NO: 133142

SEQ ID NO: 605216 - RNA, 64 nt, Homo Sapiens; identical to SEQ ID NO: 133143

SEQ ID NO: 605217 - RNA, 64 nt, Homo Sapiens; identical to SEQ ID NO: 133144

SEQ ID NO: 605218 - RNA, 64 nt, Homo Sapiens; identical to SEQ ID NO: 133145

SEQ ID NO: 605219 - RNA, 64 nt, Homo Sapiens; identical to SEQ ID NO: 133146

SEQ ID NO: 605220 - RNA, 64 nt, Homo Sapiens; identical to SEQ ID NO: 133147

SEQ ID NO: 605221 - RNA, 64 nt, Homo Sapiens; identical to SEQ ID NO: 133148

SEQ ID NO: 605222 - RNA, 64 nt, Homo Sapiens; identical to SEQ ID NO: 133149

SEQ ID NO: 605223 - RNA, 64 nt, Homo Sapiens; identical to SEQ ID NO: 133150

SEQ ID NO: 605224 - RNA, 64 nt, Homo Sapiens; identical to SEQ ID NO: 133151

SEQ ID NO: 605225 - RNA, 64 nt, Homo Sapiens; identical to SEQ ID NO: 133152

SEQ ID NO: 605226 - RNA, 64 nt, Homo Sapiens; identical to SEQ ID NO: 133153

SEQ ID NO: 605227 - RNA, 64 nt, Homo Sapiens; identical to SEQ ID NO: 133154

SEQ ID NO: 605228 - RNA, 64 nt, Homo Sapiens; identical to SEQ ID NO: 133155

SEQ ID NO: 605229 - RNA, 64 nt, Homo Sapiens; identical to SEQ ID NO: 133156

SEQ ID NO: 605230 - RNA, 64 nt, Homo Sapiens; identical to SEQ ID NO: 133157

SEQ ID NO: 605231 - RNA, 64 nt, Homo Sapiens; identical to SEQ ID NO: 133158

SEQ ID NO: 605232 - RNA, 64 nt, Homo Sapiens
agaagagagggucacuucggaagguaucuugacuuuaucaaaguaggaaucuccuauggccaau

SEQ ID NO: 605233 - RNA, 64 nt, Homo Sapiens
uauuuucuuaugaaaacguccuuuguguauacacuuaucaaagcuuguguguauauauauaugc

SEQ ID NO: 605234 - RNA, 64 nt, Homo Sapiens
caaucugaugucaaauagcaaugaggugauccuauuaucaaauuaacauugcugguuucaagaa

SEQ ID NO: 605235 - RNA, 64 nt, Homo Sapiens
gaagaggagcaaggagugaaacauguguguggcauuaucaaaauuaccauuugcuggaaauuug

SEQ ID NO: 605236 - RNA, 64 nt, Homo Sapiens
aaguauuauuuuguggacugcucuuuacuuuagcuuaucaaaugagaguuaauccauaaaauug

SEQ ID NO: 605237 - RNA, 64 nt, Homo Sapiens
auaaugauaguauaauuaucagcagauauagacauuaucaaauuggauauuaugugcccuaauu

SEQ ID NO: 605238 - RNA, 64 nt, Homo Sapiens
ugugaauaaauacauaaagauaacugugacauuuuuaucaaaugcauuguaaugauuucacucc

SEQ ID NO: 605239 - RNA, 64 nt, Homo Sapiens
agaagaaggcuacauuugugagcccuuauugcucuuaucaaaacugaugucccauuucauucag

SEQ ID NO: 605240 - RNA, 64 nt, Homo Sapiens
cccuauuuaauuuuccuggaucagcuucagacuuuuaucaaaauuucugaaacuucauaaaugu

SEQ ID NO: 605241 - RNA, 64 nt, Homo Sapiens
cuuucagcacucagaaaagacauuuuugguaggcuuaucaaaauugucuauagagaaaaacuuu

SEQ ID NO: 605242 - RNA, 64 nt, Homo Sapiens
aacuugcucuugcuuguaaauccuaaucuuagaguuaucaaaagaagaaaaaacugaagguacu

SEQ ID NO: 605243 - RNA, 64 nt, Homo Sapiens
ggaagaaaagagaugacuaagucaagugucugccuuaucaaaagagcaaaaaugccucugguuu

SEQ ID NO: 605244 - RNA, 64 nt, Homo Sapiens
ugaucagcaaugaagaacuguguuggaucugucauuaucaaaagcauuugcuucaggaguuuca

SEQ ID NO: 605245 - RNA, 64 nt, Homo Sapiens
uuggccauguuccacuuggaucaucuauuauacuuuaucaaagauauucuucacgcagagauuu

SEQ ID NO: 605246 - RNA, 64 nt, Homo Sapiens
cuuuccuucuucuauuaaauuuaagaauguuuauuuaucaaaguuauaaaaaacaauuguauuu

SEQ ID NO: 605247 - RNA, 64 nt, Homo Sapiens
acaacuguagcuguuauuuuguuucucauuauguuuaucaaaaaaauaaaugcauugcuuaaug

SEQ ID NO: 605248 - RNA, 64 nt, Homo Sapiens
cucugcuaguaauuaugaauuuaagaccauauuauuaucaaaaaccuagagaccaaucauauau

SEQ ID NO: 605249 - RNA, 64 nt, Homo Sapiens
aucaauugauugaauacaguuuuuacuaauuaguuuaucaaaccaaauacugugaacguaccag

SEQ ID NO: 605250 - RNA, 64 nt, Homo Sapiens
uuuuauuacagaaaaaaaucuagaauugugucauuuaucaaaccguaguuaaggaucuucauau

SEQ ID NO: 605251 - RNA, 64 nt, Homo Sapiens
ucucagugccuucucaggguuauuggcuuuguucuuaucaaauuaacaauaguggcaacacucc

SEQ ID NO: 605252 - RNA, 64 nt, Homo Sapiens
acuaauacuggugaaaauuuaccuaaaaccuugguuaucaaauacaucuccaguacauuccguu

SEQ ID NO: 605253 - RNA, 64 nt, Homo Sapiens
ggcgugagccacugcgcccggccacauucaguucuuaucaaagaaauaacccagacuuaaucuu

SEQ ID NO: 605254 - RNA, 64 nt, Homo Sapiens
auuguccagauuccacgugcagcagccuuaaaguuuaucaaaaaacaguuucuguaaauuauuu

SEQ ID NO: 605255 - RNA, 64 nt, Homo Sapiens
ccaccuagcagucaucuguggauuguauuuuauuuuaucaaaaggccuuaagagccucagugaa

SEQ ID NO: 605256 - RNA, 64 nt, Homo Sapiens
caagugaauuuauuuguguggccaauguuccaaauuaucaaauucaacaggcacuguauucauu

SEQ ID NO: 605257 - RNA, 64 nt, Homo Sapiens
ggcuuauuuuucaggcacuauuuuuauacucuuguuaucaaaauuacuuugcagaucauaaggc

SEQ ID NO: 605258 - RNA, 64 nt, Homo Sapiens
gaaaaugugugugaucccugcuauggagcagagguuaucaaacuaaagcccauggaccaaaucc

SEQ ID NO: 605259 - RNA, 64 nt, Homo Sapiens
auccuaucugcugcuuguuuuuguaaauagaguuuuaucaaaccacagccaugcuuacuuguuu

SEQ ID NO: 605260 - RNA, 64 nt, Homo Sapiens
cagaaaaacaacauugguagcuauauaaccauaauuaucaaaaccaauuucuaguaaaaauauc

SEQ ID NO: 605261 - RNA, 64 nt, Homo Sapiens
ugaguagggcagugggaacuagcccuguagcaaauuaucaaacccuguuuucuugaguuuugug

SEQ ID NO: 605262 - RNA, 64 nt, Homo Sapiens; identical to SEQ ID NO: 484797

SEQ ID NO: 605263 - RNA, 64 nt, Homo Sapiens; identical to SEQ ID NO: 484798

SEQ ID NO: 605264 - RNA, 64 nt, Homo Sapiens; identical to SEQ ID NO: 484799

SEQ ID NO: 605265 - RNA, 64 nt, Homo Sapiens; identical to SEQ ID NO: 484800

SEQ ID NO: 605266 - RNA, 64 nt, Homo Sapiens; identical to SEQ ID NO: 484801

SEQ ID NO: 605267 - RNA, 64 nt, Homo Sapiens; identical to SEQ ID NO: 484802

SEQ ID NO: 605268 - RNA, 64 nt, Homo Sapiens; identical to SEQ ID NO: 484803

SEQ ID NO: 605269 - RNA, 64 nt, Homo Sapiens; identical to SEQ ID NO: 484804

SEQ ID NO: 605270 - RNA, 64 nt, Homo Sapiens; identical to SEQ ID NO: 484805

SEQ ID NO: 605271 - RNA, 64 nt, Homo Sapiens; identical to SEQ ID NO: 484806

SEQ ID NO: 605272 - RNA, 64 nt, Homo Sapiens; identical to SEQ ID NO: 484807

SEQ ID NO: 605273 - RNA, 64 nt, Homo Sapiens; identical to SEQ ID NO: 484808

SEQ ID NO: 605274 - RNA, 64 nt, Homo Sapiens; identical to SEQ ID NO: 484809

SEQ ID NO: 605275 - RNA, 64 nt, Homo Sapiens; identical to SEQ ID NO: 484810

SEQ ID NO: 605276 - RNA, 64 nt, Homo Sapiens; identical to SEQ ID NO: 484811

SEQ ID NO: 605277 - RNA, 64 nt, Homo Sapiens; identical to SEQ ID NO: 484812

SEQ ID NO: 605278 - RNA, 64 nt, Homo Sapiens; identical to SEQ ID NO: 117329

SEQ ID NO: 605279 - RNA, 64 nt, Homo Sapiens; identical to SEQ ID NO: 117330

SEQ ID NO: 605280 - RNA, 64 nt, Homo Sapiens; identical to SEQ ID NO: 117331

SEQ ID NO: 605281 - RNA, 64 nt, Homo Sapiens; identical to SEQ ID NO: 117332

SEQ ID NO: 605282 - RNA, 64 nt, Homo Sapiens; identical to SEQ ID NO: 117333

SEQ ID NO: 605283 - RNA, 64 nt, Homo Sapiens; identical to SEQ ID NO: 117334

SEQ ID NO: 605284 - RNA, 64 nt, Homo Sapiens; identical to SEQ ID NO: 117335

SEQ ID NO: 605285 - RNA, 64 nt, Homo Sapiens; identical to SEQ ID NO: 117336

SEQ ID NO: 605286 - RNA, 64 nt, Homo Sapiens; identical to SEQ ID NO: 117337

SEQ ID NO: 605287 - RNA, 64 nt, Homo Sapiens; identical to SEQ ID NO: 117338

SEQ ID NO: 605288 - RNA, 64 nt, Homo Sapiens; identical to SEQ ID NO: 117339

SEQ ID NO: 605289 - RNA, 64 nt, Homo Sapiens; identical to SEQ ID NO: 117340

SEQ ID NO: 605290 - RNA, 64 nt, Homo Sapiens; identical to SEQ ID NO: 117341

SEQ ID NO: 605291 - RNA, 64 nt, Homo Sapiens; identical to SEQ ID NO: 117342

SEQ ID NO: 605292 - RNA, 64 nt, Homo Sapiens; identical to SEQ ID NO: 117343

SEQ ID NO: 605293 - RNA, 64 nt, Homo Sapiens; identical to SEQ ID NO: 117344

SEQ ID NO: 605294 - RNA, 64 nt, Homo Sapiens; identical to SEQ ID NO: 117345

SEQ ID NO: 605295 - RNA, 64 nt, Homo Sapiens; identical to SEQ ID NO: 117346

SEQ ID NO: 605296 - RNA, 64 nt, Homo Sapiens; identical to SEQ ID NO: 117347

SEQ ID NO: 605297 - RNA, 64 nt, Homo Sapiens; identical to SEQ ID NO: 117348

SEQ ID NO: 605298 - RNA, 64 nt, Homo Sapiens; identical to SEQ ID NO: 117349

SEQ ID NO: 605299 - RNA, 64 nt, Homo Sapiens; identical to SEQ ID NO: 117350

SEQ ID NO: 605300 - RNA, 64 nt, Homo Sapiens; identical to SEQ ID NO: 117351

SEQ ID NO: 605301 - RNA, 64 nt, Homo Sapiens; identical to SEQ ID NO: 117352

SEQ ID NO: 605302 - RNA, 64 nt, Homo Sapiens; identical to SEQ ID NO: 117353

SEQ ID NO: 605303 - RNA, 64 nt, Homo Sapiens; identical to SEQ ID NO: 117354

SEQ ID NO: 605304 - RNA, 64 nt, Homo Sapiens; identical to SEQ ID NO: 117355

SEQ ID NO: 605305 - RNA, 64 nt, Homo Sapiens; identical to SEQ ID NO: 117356

SEQ ID NO: 605306 - RNA, 64 nt, Homo Sapiens; identical to SEQ ID NO: 117357

SEQ ID NO: 605307 - RNA, 64 nt, Homo Sapiens; identical to SEQ ID NO: 117358

SEQ ID NO: 605308 - RNA, 64 nt, Homo Sapiens; identical to SEQ ID NO: 117359

SEQ ID NO: 605309 - RNA, 64 nt, Homo Sapiens; identical to SEQ ID NO: 117360

SEQ ID NO: 605310 - RNA, 64 nt, Homo Sapiens; identical to SEQ ID NO: 117361

SEQ ID NO: 605311 - RNA, 64 nt, Homo Sapiens; identical to SEQ ID NO: 117362

SEQ ID NO: 605312 - RNA, 64 nt, Homo Sapiens; identical to SEQ ID NO: 257521

SEQ ID NO: 605313 - RNA, 64 nt, Homo Sapiens; identical to SEQ ID NO: 257522

SEQ ID NO: 605314 - RNA, 64 nt, Homo Sapiens; identical to SEQ ID NO: 257523

SEQ ID NO: 605315 - RNA, 64 nt, Homo Sapiens; identical to SEQ ID NO: 257524

SEQ ID NO: 605316 - RNA, 64 nt, Homo Sapiens; identical to SEQ ID NO: 147779

SEQ ID NO: 605317 - RNA, 64 nt, Homo Sapiens; identical to SEQ ID NO: 147780

SEQ ID NO: 605318 - RNA, 64 nt, Homo Sapiens; identical to SEQ ID NO: 334556

SEQ ID NO: 605319 - RNA, 64 nt, Homo Sapiens; identical to SEQ ID NO: 334557

SEQ ID NO: 605320 - RNA, 64 nt, Homo Sapiens; identical to SEQ ID NO: 325832

SEQ ID NO: 605321 - RNA, 64 nt, Homo Sapiens; identical to SEQ ID NO: 325833

SEQ ID NO: 605322 - RNA, 64 nt, Homo Sapiens; identical to SEQ ID NO: 325834

SEQ ID NO: 605323 - RNA, 64 nt, Homo Sapiens; identical to SEQ ID NO: 325835

SEQ ID NO: 605324 - RNA, 64 nt, Homo Sapiens; identical to SEQ ID NO: 325836

SEQ ID NO: 605325 - RNA, 64 nt, Homo Sapiens; identical to SEQ ID NO: 325837

SEQ ID NO: 605326 - RNA, 64 nt, Homo Sapiens; identical to SEQ ID NO: 325838

SEQ ID NO: 605327 - RNA, 64 nt, Homo Sapiens; identical to SEQ ID NO: 325839

SEQ ID NO: 605328 - RNA, 64 nt, Homo Sapiens; identical to SEQ ID NO: 325840

SEQ ID NO: 605329 - RNA, 64 nt, Homo Sapiens; identical to SEQ ID NO: 325841

SEQ ID NO: 605330 - RNA, 64 nt, Homo Sapiens; identical to SEQ ID NO: 325842

SEQ ID NO: 605331 - RNA, 64 nt, Homo Sapiens; identical to SEQ ID NO: 325843

SEQ ID NO: 605332 - RNA, 64 nt, Homo Sapiens; identical to SEQ ID NO: 325844

SEQ ID NO: 605333 - RNA, 64 nt, Homo Sapiens; identical to SEQ ID NO: 325845

SEQ ID NO: 605334 - RNA, 64 nt, Homo Sapiens; identical to SEQ ID NO: 325846

SEQ ID NO: 605335 - RNA, 64 nt, Homo Sapiens; identical to SEQ ID NO: 325847

SEQ ID NO: 605336 - RNA, 64 nt, Homo Sapiens; identical to SEQ ID NO: 325848

SEQ ID NO: 605337 - RNA, 64 nt, Homo Sapiens; identical to SEQ ID NO: 325849

SEQ ID NO: 605338 - RNA, 64 nt, Homo Sapiens; identical to SEQ ID NO: 325850

SEQ ID NO: 605339 - RNA, 64 nt, Homo Sapiens; identical to SEQ ID NO: 325851

SEQ ID NO: 605340 - RNA, 64 nt, Homo Sapiens; identical to SEQ ID NO: 325852

SEQ ID NO: 605341 - RNA, 64 nt, Homo Sapiens; identical to SEQ ID NO: 325853

SEQ ID NO: 605342 - RNA, 64 nt, Homo Sapiens; identical to SEQ ID NO: 325854

SEQ ID NO: 605343 - RNA, 64 nt, Homo Sapiens; identical to SEQ ID NO: 325855

SEQ ID NO: 605344 - RNA, 64 nt, Homo Sapiens; identical to SEQ ID NO: 325856

SEQ ID NO: 605345 - RNA, 64 nt, Homo Sapiens; identical to SEQ ID NO: 325857

SEQ ID NO: 605346 - RNA, 64 nt, Homo Sapiens; identical to SEQ ID NO: 325858

SEQ ID NO: 605347 - RNA, 64 nt, Homo Sapiens; identical to SEQ ID NO: 325859

SEQ ID NO: 605348 - RNA, 64 nt, Homo Sapiens; identical to SEQ ID NO: 325860

SEQ ID NO: 605349 - RNA, 64 nt, Homo Sapiens; identical to SEQ ID NO: 325861

SEQ ID NO: 605350 - RNA, 64 nt, Homo Sapiens; identical to SEQ ID NO: 325862

SEQ ID NO: 605351 - RNA, 64 nt, Homo Sapiens; identical to SEQ ID NO: 325863

SEQ ID NO: 605352 - RNA, 64 nt, Homo Sapiens; identical to SEQ ID NO: 325864

SEQ ID NO: 605353 - RNA, 64 nt, Homo Sapiens; identical to SEQ ID NO: 325865

SEQ ID NO: 605354 - RNA, 64 nt, Homo Sapiens; identical to SEQ ID NO: 325866

SEQ ID NO: 605355 - RNA, 64 nt, Homo Sapiens; identical to SEQ ID NO: 325867

SEQ ID NO: 605356 - RNA, 64 nt, Homo Sapiens; identical to SEQ ID NO: 325868

SEQ ID NO: 605357 - RNA, 64 nt, Homo Sapiens; identical to SEQ ID NO: 325869

SEQ ID NO: 605358 - RNA, 64 nt, Homo Sapiens; identical to SEQ ID NO: 325870

SEQ ID NO: 605359 - RNA, 64 nt, Homo Sapiens; identical to SEQ ID NO: 325871

SEQ ID NO: 605360 - RNA, 64 nt, Homo Sapiens; identical to SEQ ID NO: 325872

SEQ ID NO: 605361 - RNA, 64 nt, Homo Sapiens; identical to SEQ ID NO: 325873

SEQ ID NO: 605362 - RNA, 64 nt, Homo Sapiens; identical to SEQ ID NO: 325874

SEQ ID NO: 605363 - RNA, 64 nt, Homo Sapiens; identical to SEQ ID NO: 325875

SEQ ID NO: 605364 - RNA, 64 nt, Homo Sapiens
uccuggacuuuuaaaugaccaugaaguuaucauugaauguuaagauuuuuucuucuugauuuuu

SEQ ID NO: 605365 - RNA, 64 nt, Homo Sapiens
uaaaaauuuauauuauaggcuucaauguuuucaugaauguuacccaaaaagcuguguuuucuuu

SEQ ID NO: 605366 - RNA, 64 nt, Homo Sapiens
aaacuaugauagaaucugugugaaugguuaagaugaauguuaaauacuaugcuuuuuuguaagu

SEQ ID NO: 605367 - RNA, 64 nt, Homo Sapiens
gacauuacauacgcaagucuuucucgacaaucaagaauguuauuaauguguaauacugagcacu

SEQ ID NO: 605368 - RNA, 64 nt, Homo Sapiens
uaugaccuuaugauaaaucuuuaaguauuggugugaauguuauuuaaauucuauauuuuucuua

SEQ ID NO: 605369 - RNA, 64 nt, Homo Sapiens
uuauguguuuuauuucuccaagugcgguguuccugaauguuauguaugcuuuuuuuucuguacc

SEQ ID NO: 605370 - RNA, 64 nt, Homo Sapiens
uccaauauagauguggucauguuugacuuguacagaauguuaaucauacagagaauccuugaug

SEQ ID NO: 605371 - RNA, 64 nt, Homo Sapiens
ccuugauggaauuauauauguguguuuuacuuuugaauguuacaaaaggaaauaacuuuaaaac

SEQ ID NO: 605372 - RNA, 64 nt, Homo Sapiens
guaagguacauuugauuuuuuucuguagucaucagaauguuaauuguuuauguauauaaucuua

SEQ ID NO: 605373 - RNA, 64 nt, Homo Sapiens
cauaggaaauaacaggaagaaauuaucuugauuggaauguuauuuauacuccaaaagauauuug

SEQ ID NO: 605374 - RNA, 64 nt, Homo Sapiens
gaugugaccuuuucugacucugcccagucucuaugaauguuauggccuagggaagaaucaugaa

SEQ ID NO: 605375 - RNA, 64 nt, Homo Sapiens
uaacccauccuuuacuacagaggcauauggguuugaauguuaccugggguucucucuauugagu

SEQ ID NO: 605376 - RNA, 64 nt, Homo Sapiens
guuucuucacgagcagacucgcaucacaaagcaugaauguuaacccacagaauccaaggagcau

SEQ ID NO: 605377 - RNA, 64 nt, Homo Sapiens
uuuauugacauauguacuguauguuacugagauugaauguuaggggaagccuuaagguagaggu

SEQ ID NO: 605378 - RNA, 64 nt, Homo Sapiens
aguacuaccacagaacuauaccuaagaaugacuugaauguuaucucauauacguaagacuggug

SEQ ID NO: 605379 - RNA, 64 nt, Homo Sapiens
uucauggaauacuugaagucuaugaucccagcaugaauguuauucugucccagaaauguaauuu

SEQ ID NO: 605380 - RNA, 64 nt, Homo Sapiens
auuuguugaucaauguggagaugaaagagauugagaauguuaacuuacauaguuuuuaaaguca

SEQ ID NO: 605381 - RNA, 64 nt, Homo Sapiens
uucauucaaacuauauuuuguggaggggacccuugaauguuagucagacauagaauuucacuuu

SEQ ID NO: 605382 - RNA, 64 nt, Homo Sapiens; identical to SEQ ID NO: 169421

SEQ ID NO: 605383 - RNA, 64 nt, Homo Sapiens; identical to SEQ ID NO: 169422

SEQ ID NO: 605384 - RNA, 64 nt, Homo Sapiens; identical to SEQ ID NO: 169423

SEQ ID NO: 605385 - RNA, 64 nt, Homo Sapiens; identical to SEQ ID NO: 169424

SEQ ID NO: 605386 - RNA, 64 nt, Homo Sapiens; identical to SEQ ID NO: 169425

SEQ ID NO: 605387 - RNA, 64 nt, Homo Sapiens; identical to SEQ ID NO: 169426

SEQ ID NO: 605388 - RNA, 64 nt, Homo Sapiens; identical to SEQ ID NO: 169427

SEQ ID NO: 605389 - RNA, 64 nt, Homo Sapiens; identical to SEQ ID NO: 169428

SEQ ID NO: 605390 - RNA, 64 nt, Homo Sapiens; identical to SEQ ID NO: 169429

SEQ ID NO: 605391 - RNA, 64 nt, Homo Sapiens; identical to SEQ ID NO: 169430

SEQ ID NO: 605392 - RNA, 64 nt, Homo Sapiens; identical to SEQ ID NO: 169431

SEQ ID NO: 605393 - RNA, 64 nt, Homo Sapiens; identical to SEQ ID NO: 169432

SEQ ID NO: 605394 - RNA, 64 nt, Homo Sapiens; identical to SEQ ID NO: 169433

SEQ ID NO: 605395 - RNA, 64 nt, Homo Sapiens; identical to SEQ ID NO: 169434

SEQ ID NO: 605396 - RNA, 64 nt, Homo Sapiens; identical to SEQ ID NO: 169435

SEQ ID NO: 605397 - RNA, 64 nt, Homo Sapiens; identical to SEQ ID NO: 169436

SEQ ID NO: 605398 - RNA, 64 nt, Homo Sapiens; identical to SEQ ID NO: 169437

SEQ ID NO: 605399 - RNA, 64 nt, Homo Sapiens; identical to SEQ ID NO: 169438

SEQ ID NO: 605400 - RNA, 64 nt, Homo Sapiens; identical to SEQ ID NO: 169439

SEQ ID NO: 605401 - RNA, 64 nt, Homo Sapiens; identical to SEQ ID NO: 169440

SEQ ID NO: 605402 - RNA, 64 nt, Homo Sapiens; identical to SEQ ID NO: 169441

SEQ ID NO: 605403 - RNA, 64 nt, Homo Sapiens; identical to SEQ ID NO: 169442

SEQ ID NO: 605404 - RNA, 64 nt, Homo Sapiens; identical to SEQ ID NO: 169443

SEQ ID NO: 605405 - RNA, 64 nt, Homo Sapiens; identical to SEQ ID NO: 169442

SEQ ID NO: 605406 - RNA, 64 nt, Homo Sapiens; identical to SEQ ID NO: 169443

SEQ ID NO: 605407 - RNA, 64 nt, Homo Sapiens
gacaagggauuugcucgcaccaacuccuuuguuuuccgccuagcguucuaagcucuaaaugggu

SEQ ID NO: 605408 - RNA, 64 nt, Homo Sapiens
gacagauuccuucuauuaaggucugucgucucucuccgccuagccugucccguuucccgauugg

SEQ ID NO: 605409 - RNA, 64 nt, Homo Sapiens; identical to SEQ ID NO: 76340

SEQ ID NO: 605410 - RNA, 64 nt, Homo Sapiens; identical to SEQ ID NO: 76341

SEQ ID NO: 605411 - RNA, 64 nt, Homo Sapiens; identical to SEQ ID NO: 76342

SEQ ID NO: 605412 - RNA, 64 nt, Homo Sapiens; identical to SEQ ID NO: 76343

SEQ ID NO: 605413 - RNA, 64 nt, Homo Sapiens; identical to SEQ ID NO: 76344

SEQ ID NO: 605414 - RNA, 64 nt, Homo Sapiens; identical to SEQ ID NO: 76345

SEQ ID NO: 605415 - RNA, 64 nt, Homo Sapiens; identical to SEQ ID NO: 76346

SEQ ID NO: 605416 - RNA, 64 nt, Homo Sapiens; identical to SEQ ID NO: 76347

SEQ ID NO: 605417 - RNA, 64 nt, Homo Sapiens; identical to SEQ ID NO: 76348

SEQ ID NO: 605418 - RNA, 64 nt, Homo Sapiens; identical to SEQ ID NO: 76349

SEQ ID NO: 605419 - RNA, 64 nt, Homo Sapiens; identical to SEQ ID NO: 76350

SEQ ID NO: 605420 - RNA, 64 nt, Homo Sapiens; identical to SEQ ID NO: 76351

SEQ ID NO: 605421 - RNA, 64 nt, Homo Sapiens; identical to SEQ ID NO: 76352

SEQ ID NO: 605422 - RNA, 64 nt, Homo Sapiens; identical to SEQ ID NO: 76353

SEQ ID NO: 605423 - RNA, 64 nt, Homo Sapiens; identical to SEQ ID NO: 76354

SEQ ID NO: 605424 - RNA, 64 nt, Homo Sapiens; identical to SEQ ID NO: 76355

SEQ ID NO: 605425 - RNA, 64 nt, Homo Sapiens; identical to SEQ ID NO: 76356

SEQ ID NO: 605426 - RNA, 64 nt, Homo Sapiens; identical to SEQ ID NO: 76357

SEQ ID NO: 605427 - RNA, 64 nt, Homo Sapiens; identical to SEQ ID NO: 76358

SEQ ID NO: 605428 - RNA, 64 nt, Homo Sapiens; identical to SEQ ID NO: 76359

SEQ ID NO: 605429 - RNA, 64 nt, Homo Sapiens; identical to SEQ ID NO: 76360

SEQ ID NO: 605430 - RNA, 64 nt, Homo Sapiens; identical to SEQ ID NO: 76361

SEQ ID NO: 605431 - RNA, 64 nt, Homo Sapiens; identical to SEQ ID NO: 76362

SEQ ID NO: 605432 - RNA, 64 nt, Homo Sapiens; identical to SEQ ID NO: 76363

SEQ ID NO: 605433 - RNA, 64 nt, Homo Sapiens; identical to SEQ ID NO: 76364

SEQ ID NO: 605434 - RNA, 64 nt, Homo Sapiens; identical to SEQ ID NO: 76365

SEQ ID NO: 605435 - RNA, 64 nt, Homo Sapiens; identical to SEQ ID NO: 76366

SEQ ID NO: 605436 - RNA, 64 nt, Homo Sapiens; identical to SEQ ID NO: 76367

SEQ ID NO: 605437 - RNA, 64 nt, Homo Sapiens; identical to SEQ ID NO: 76368

SEQ ID NO: 605438 - RNA, 64 nt, Homo Sapiens; identical to SEQ ID NO: 76369

SEQ ID NO: 605439 - RNA, 64 nt, Homo Sapiens; identical to SEQ ID NO: 76370

SEQ ID NO: 605440 - RNA, 64 nt, Homo Sapiens; identical to SEQ ID NO: 76371

SEQ ID NO: 605441 - RNA, 64 nt, Homo Sapiens; identical to SEQ ID NO: 76372

SEQ ID NO: 605442 - RNA, 64 nt, Homo Sapiens; identical to SEQ ID NO: 76373

SEQ ID NO: 605443 - RNA, 64 nt, Homo Sapiens; identical to SEQ ID NO: 76374

SEQ ID NO: 605444 - RNA, 64 nt, Homo Sapiens; identical to SEQ ID NO: 76375

SEQ ID NO: 605445 - RNA, 64 nt, Homo Sapiens; identical to SEQ ID NO: 76376

SEQ ID NO: 605446 - RNA, 64 nt, Homo Sapiens; identical to SEQ ID NO: 76377

SEQ ID NO: 605447 - RNA, 64 nt, Homo Sapiens; identical to SEQ ID NO: 76378

SEQ ID NO: 605448 - RNA, 64 nt, Homo Sapiens; identical to SEQ ID NO: 76379

SEQ ID NO: 605449 - RNA, 64 nt, Homo Sapiens; identical to SEQ ID NO: 76380

SEQ ID NO: 605450 - RNA, 64 nt, Homo Sapiens; identical to SEQ ID NO: 76381

SEQ ID NO: 605451 - RNA, 64 nt, Homo Sapiens
uauuuuauauugaguugaauauugaacucuaacaguuuucuacauacaaaacacagugucauga

SEQ ID NO: 605452 - RNA, 64 nt, Homo Sapiens
aauauuuucugauaauugcuuuuuuuauucuuguguuuucuacuuaaacauaaugucuguguca

SEQ ID NO: 605453 - RNA, 64 nt, Homo Sapiens
ucuagaacuuuaaagaaaaaagaauguuauauuaguuuucuaaaacucaacuaucuuuagucau

SEQ ID NO: 605454 - RNA, 64 nt, Homo Sapiens
ucaaaaaucuauugcuagaucauaguagauacugguuuucuauuaacucaaaaccuacauugac

SEQ ID NO: 605455 - RNA, 64 nt, Homo Sapiens
gcagcuguaccauuuuacaugaaacugccagacuguuuucuauauccguguuuuaacuuuuuga

SEQ ID NO: 605456 - RNA, 64 nt, Homo Sapiens
gccguccaaguugaggauguuucuuccacugaauguuuucuaggauaucucuuuugugacuggc

SEQ ID NO: 605457 - RNA, 64 nt, Homo Sapiens
aacuauauauuuauuaaggugacauuccaauaagguuuucuaugucuuuuaauugaauauaagg

SEQ ID NO: 605458 - RNA, 64 nt, Homo Sapiens
uuguauaauaauucaaaauuuuucuaaauguuuaguuuucuaaaauaugaugucauuaauacuu

SEQ ID NO: 605459 - RNA, 64 nt, Homo Sapiens
uauuauuuuacggagcugcaaccuccaauuuuguguuuucuaagugauuuacuuaagucaauaa

SEQ ID NO: 605460 - RNA, 64 nt, Homo Sapiens
aacagauggaauccuguggacuaaugugccaccaguuuucuaacaaggguguacauaaaaugga

SEQ ID NO: 605461 - RNA, 64 nt, Homo Sapiens
aaggacaaaguuuuaaaagcguauuuaacuugauguuuucuaucagcauaaauaaaauggucau

SEQ ID NO: 605462 - RNA, 64 nt, Homo Sapiens
cagauugucucuucuauauugaaagcauuuuuauguuuucuaauuuaaaaauuaauauuuucuu

SEQ ID NO: 605463 - RNA, 64 nt, Homo Sapiens
auucaauuuaaagcuauuuuuccucagaguuuuuguuuucuauauauuaagucuaaauuaaguu

SEQ ID NO: 605464 - RNA, 64 nt, Homo Sapiens
aguuuuuguuuucuauauauuaagucuaaauuaaguuuucuacucauuaagacuaacaucuccc

SEQ ID NO: 605465 - RNA, 64 nt, Homo Sapiens
acuguugaaaacugcaaguaagggcagguuuuggguuuucuaguaugguaagggugagggucau

SEQ ID NO: 605466 - RNA, 64 nt, Homo Sapiens
ccauaccacagugccuugcaaugagucauuccaaguuuucuaguugucauuccaagguuucuuc

SEQ ID NO: 605467 - RNA, 64 nt, Homo Sapiens
ggcuuaacuggguaauuuguggucuaggccuuuuguuuucuaagcuuacuaucuuguguuuguu

SEQ ID NO: 605468 - RNA, 64 nt, Homo Sapiens
aaacacuaguaauuaaaaugugccuuuugaagauguuuucuaagagaaaggaaauacguugcag

SEQ ID NO: 605469 - RNA, 64 nt, Homo Sapiens
guaacugguaguguucaguaaaagcaaaaugauaguuuucuagaugacauaaaauuuacauuua

SEQ ID NO: 605470 - RNA, 64 nt, Homo Sapiens
aaacuaguggaaauuagagaguuguuuuauugguguuuucuacugugaguuaauuaaaaauugu

SEQ ID NO: 605471 - RNA, 64 nt, Homo Sapiens
agauguccuuaauaagggaagucauguauaagauguuuucuaaaagacuuuucaguauuacaac

SEQ ID NO: 605472 - RNA, 64 nt, Homo Sapiens
accuggccucuguccucuuuuagucuagugucugguuuucuagcaaacaguaaauuuaaacaag

SEQ ID NO: 605473 - RNA, 64 nt, Homo Sapiens
accugcuguuaauguuuuuuccccccuugugaauguuuucuaacuuugucuugguaauugcaau

SEQ ID NO: 605474 - RNA, 64 nt, Homo Sapiens
aggaaugguauuuucgguuuauugacauugaauuguuuucuaaguuuuuccaucacaagauagg

SEQ ID NO: 605475 - RNA, 64 nt, Homo Sapiens
uaaaaauuacaaaaaugaacgagaugccuaaaauguuuucuauucugcuuuauuucuucuucaa

SEQ ID NO: 605476 - RNA, 64 nt, Homo Sapiens
uuuaaaugccugcuuuauuuauuuggaauuacuuguuuucuagcaaaacuuuuguaaaaauuaa

SEQ ID NO: 605477 - RNA, 64 nt, Homo Sapiens
uuaaauaacuauaauuuauaacacuaaaguuauuguuuucuaagaugccaucuacuuucuagaa

SEQ ID NO: 605478 - RNA, 64 nt, Homo Sapiens
uaacacugguugacaguauauagcugauuugaagguuuucuauuugcuauuuguugucaauuua

SEQ ID NO: 605479 - RNA, 64 nt, Homo Sapiens
uucguugugacaacauugauugggccauacaaauguuuucuacugagcaagauaauaaaggaga

SEQ ID NO: 605480 - RNA, 64 nt, Homo Sapiens
gcaagauaauaaaggagaugggaacaggaacauuguuuucuagaguucuaauucaguagcuuga

SEQ ID NO: 605481 - RNA, 64 nt, Homo Sapiens
uuacaggcagagugggacuguggggguaggggcuguuuucuaagguauuaacucgcagacccuc

SEQ ID NO: 605482 - RNA, 64 nt, Homo Sapiens
ucagacaaacuaugaaaaacuuuuacagguacaaguuuucuagcguccucaaugcuguccuuug

SEQ ID NO: 605483 - RNA, 64 nt, Homo Sapiens
aguacguucagaugcuuuggcuuuugguugguuuguuuucuagacuucucuugcauuauuuucc

SEQ ID NO: 605484 - RNA, 64 nt, Homo Sapiens
aguuuacuguugcuuaucucuguaauguuaaaacguuuucuaacuggugauuuuuuaaauauca

SEQ ID NO: 605485 - RNA, 64 nt, Homo Sapiens
uuuuuaaaccaccgauuccaagaggaugaggaguguuuucuaaaaugcaguaggcuuggggagu

SEQ ID NO: 605486 - RNA, 64 nt, Homo Sapiens
gucacaagagggaaggacuuggagaggagaauuaguuuucuaggcucauuggcauuuaguuucc

SEQ ID NO: 605487 - RNA, 64 nt, Homo Sapiens
ccuauuuuuguagugaccuguuuaugagaugcugguuuucuacccaacggcccugcagccagcu

SEQ ID NO: 605488 - RNA, 64 nt, Homo Sapiens
uagcgcuguuuuuguugugugugcagggagggcaguuuucuaauggaaugguuugggaauaucc

SEQ ID NO: 605489 - RNA, 64 nt, Homo Sapiens
uuacaucuugccuugauacccagguauggagagaguuuucuauuuuuuuagacuuuuuuuccuc

SEQ ID NO: 605490 - RNA, 64 nt, Homo Sapiens
auauuugcuuggggaacuaagugcugacuaguuuguuuucuaugucaaggggcaauauuaaaaa

SEQ ID NO: 605491 - RNA, 64 nt, Homo Sapiens
acuggcucguuuccgugcccaaauccaaggcgaaguuuucuagaggguucuugggcucuuggca

SEQ ID NO: 605492 - RNA, 64 nt, Homo Sapiens
cuuuccuuguggauuuucuuauucucguugucaaguuuucuaggguugaauuuuuuucuuuuuu

SEQ ID NO: 605493 - RNA, 64 nt, Homo Sapiens
guuucugggcuuuggcugcugugccuuuuggcuuguuuucuagaggugcuguucauuaauucuu

SEQ ID NO: 605494 - RNA, 64 nt, Homo Sapiens
auaauuggaucagguuuucuuuucaauuuuauauguuuucuaagcuagauauccuuaaaugaug

SEQ ID NO: 605495 - RNA, 64 nt, Homo Sapiens
caauuuucaacuauuuaaccuauuauuuuugcauguuuucuaaccuuuuuaaaagaaaacucag

SEQ ID NO: 605496 - RNA, 64 nt, Homo Sapiens
cuuuauaaaguccaauuucagcaccgccuccucuguuuucuaggcaacaacugacaagggcagg

SEQ ID NO: 605497 - RNA, 64 nt, Homo Sapiens
auuaaaauguccaaauuaggauuuuuaaaaauugguuuucuaaaugaaaacacugcauuuaaga

SEQ ID NO: 605498 - RNA, 64 nt, Homo Sapiens
accagagaauaaggaacugauaagguuuguuuguguuuucuaaagaaggaaccucgguacuucu

SEQ ID NO: 605499 - RNA, 64 nt, Homo Sapiens
aaugauaaaagguuauuacgucuauauauuuaaaguuuucuaaaaugaaaauugucuauuuuua

SEQ ID NO: 605500 - RNA, 64 nt, Homo Sapiens
cauaguucuuccauaaccacuuuguagaaacuugguuuucuaagaaaguauugcuaguaaauga

SEQ ID NO: 605501 - RNA, 64 nt, Homo Sapiens
uuugucaucauuaaaagcaaggcucaagggacauguuuucuagccuuaguuccccaucuacaaa

SEQ ID NO: 605502 - RNA, 64 nt, Homo Sapiens
ggcgugagccaccacgcccggucaccuuuguccuguuuucuacagguuagaagcaaggcacaag

SEQ ID NO: 605503 - RNA, 64 nt, Homo Sapiens
uaaggcuuauuuuugauuagaaguuucaguuucuguuuucuagguuuuucugucucuguguuug

SEQ ID NO: 605504 - RNA, 64 nt, Homo Sapiens
ccuacugaugucaguauguuucguaucugagcagguuuucuauguaucuugucugagacugcau

SEQ ID NO: 605505 - RNA, 64 nt, Homo Sapiens
uucuuuucaugaaaacacuggggagaaaugacauguuuucuauuaaugaagaaaggucacuaaa

SEQ ID NO: 605506 - RNA, 64 nt, Homo Sapiens
uuuuucaccuuuuaguuuuuauagcuaguauuggguuuucuaguuuuaguuuuaguuuucugga

SEQ ID NO: 605507 - RNA, 64 nt, Homo Sapiens
ucuguucccaaggaagcuccuuccuguuuguuuuguuuucuaagauguucauuuuuaaagccug

SEQ ID NO: 605508 - RNA, 64 nt, Homo Sapiens
cccugccuuuaaaugaaacaagucuagucuucugguuuucuagccccucuggauucccuuuuga

SEQ ID NO: 605509 - RNA, 64 nt, Homo Sapiens
ugggcugacguugccuugucggagggacucuuaaguuuucuaccagcacaucacugguuuucua

SEQ ID NO: 605510 - RNA, 64 nt, Homo Sapiens
agggacucuuaaguuuucuaccagcacaucacugguuuucuaggggccugugucccugaaaggg

SEQ ID NO: 605511 - RNA, 64 nt, Homo Sapiens; identical to SEQ ID NO: 217880

SEQ ID NO: 605512 - RNA, 64 nt, Homo Sapiens; identical to SEQ ID NO: 217881

SEQ ID NO: 605513 - RNA, 64 nt, Homo Sapiens; identical to SEQ ID NO: 217882

SEQ ID NO: 605514 - RNA, 64 nt, Homo Sapiens; identical to SEQ ID NO: 217883

SEQ ID NO: 605515 - RNA, 64 nt, Homo Sapiens; identical to SEQ ID NO: 217884

SEQ ID NO: 605516 - RNA, 64 nt, Homo Sapiens; identical to SEQ ID NO: 217885

SEQ ID NO: 605517 - RNA, 64 nt, Homo Sapiens; identical to SEQ ID NO: 217886

SEQ ID NO: 605518 - RNA, 64 nt, Homo Sapiens; identical to SEQ ID NO: 217887

SEQ ID NO: 605519 - RNA, 64 nt, Homo Sapiens; identical to SEQ ID NO: 217888

SEQ ID NO: 605520 - RNA, 64 nt, Homo Sapiens; identical to SEQ ID NO: 217889

SEQ ID NO: 605521 - RNA, 64 nt, Homo Sapiens; identical to SEQ ID NO: 217890

SEQ ID NO: 605522 - RNA, 64 nt, Homo Sapiens; identical to SEQ ID NO: 217891

SEQ ID NO: 605523 - RNA, 64 nt, Homo Sapiens; identical to SEQ ID NO: 217892

SEQ ID NO: 605524 - RNA, 64 nt, Homo Sapiens; identical to SEQ ID NO: 217893

SEQ ID NO: 605525 - RNA, 64 nt, Homo Sapiens; identical to SEQ ID NO: 217894

SEQ ID NO: 605526 - RNA, 64 nt, Homo Sapiens; identical to SEQ ID NO: 217895

SEQ ID NO: 605527 - RNA, 64 nt, Homo Sapiens; identical to SEQ ID NO: 217896

SEQ ID NO: 605528 - RNA, 64 nt, Homo Sapiens; identical to SEQ ID NO: 217897

SEQ ID NO: 605529 - RNA, 64 nt, Homo Sapiens; identical to SEQ ID NO: 217898

SEQ ID NO: 605530 - RNA, 64 nt, Homo Sapiens; identical to SEQ ID NO: 217899

SEQ ID NO: 605531 - RNA, 64 nt, Homo Sapiens; identical to SEQ ID NO: 217900

SEQ ID NO: 605532 - RNA, 64 nt, Homo Sapiens; identical to SEQ ID NO: 217901

SEQ ID NO: 605533 - RNA, 64 nt, Homo Sapiens; identical to SEQ ID NO: 217902

SEQ ID NO: 605534 - RNA, 64 nt, Homo Sapiens; identical to SEQ ID NO: 217903

SEQ ID NO: 605535 - RNA, 64 nt, Homo Sapiens; identical to SEQ ID NO: 217904

SEQ ID NO: 605536 - RNA, 64 nt, Homo Sapiens; identical to SEQ ID NO: 217905

SEQ ID NO: 605537 - RNA, 64 nt, Homo Sapiens; identical to SEQ ID NO: 217906

SEQ ID NO: 605538 - RNA, 64 nt, Homo Sapiens; identical to SEQ ID NO: 217907

SEQ ID NO: 605539 - RNA, 64 nt, Homo Sapiens; identical to SEQ ID NO: 217908

SEQ ID NO: 605540 - RNA, 64 nt, Homo Sapiens; identical to SEQ ID NO: 217909

SEQ ID NO: 605541 - RNA, 64 nt, Homo Sapiens; identical to SEQ ID NO: 217910

SEQ ID NO: 605542 - RNA, 64 nt, Homo Sapiens; identical to SEQ ID NO: 217911

SEQ ID NO: 605543 - RNA, 64 nt, Homo Sapiens
aaaaguuuagcguuaagcacacaauccaaaucuaagcuuagaaguggggguauucguuucuuaa

SEQ ID NO: 605544 - RNA, 64 nt, Homo Sapiens
ggcugugacacaaaaaauucaauaccuaaaaggaagcuuagauguucucuuggacauacuaaaa

SEQ ID NO: 605545 - RNA, 64 nt, Homo Sapiens
cgauacacuugcuuuggucaccagaggaggacagagcuuagagcagcuguggagaaucugaagc

SEQ ID NO: 605546 - RNA, 64 nt, Homo Sapiens
aagcaucuuaaagcuguuuggugauaaagaaggcagcuuagauucugugguuggaaacagugua

SEQ ID NO: 605547 - RNA, 64 nt, Homo Sapiens
cuacuauccagaccugccuuugaaauggggaccacccuccuaaugagccucucaucaccgccug

SEQ ID NO: 605548 - RNA, 64 nt, Homo Sapiens
uagcagggucucggcacucuuucggugaaaggugcccuccuacccgaguguggacuggcccggc

SEQ ID NO: 605549 - RNA, 64 nt, Homo Sapiens
cucucacuuugccuaagagacagacacacagaaacccuccuagcagcuguccuugcacgcagag

SEQ ID NO: 605550 - RNA, 64 nt, Homo Sapiens
gacccggccaauaaggacccugugcgucuucucccccuccuaagcccuuguguccuuaaaaaua

SEQ ID NO: 605551 - RNA, 64 nt, Homo Sapiens
gugcucucccucccugggcacuccagaccucucucccuccuacaugaaacugacagagccuggg

SEQ ID NO: 605552 - RNA, 64 nt, Homo Sapiens
uccagcacugcccccguggcucccuccccaccugcccuccuagcagcagcugugaccagguucc

SEQ ID NO: 605553 - RNA, 64 nt, Homo Sapiens; identical to SEQ ID NO: 53437

SEQ ID NO: 605554 - RNA, 64 nt, Homo Sapiens; identical to SEQ ID NO: 53438

SEQ ID NO: 605555 - RNA, 64 nt, Homo Sapiens; identical to SEQ ID NO: 53439

SEQ ID NO: 605556 - RNA, 64 nt, Homo Sapiens; identical to SEQ ID NO: 53440

SEQ ID NO: 605557 - RNA, 64 nt, Homo Sapiens; identical to SEQ ID NO: 53441

SEQ ID NO: 605558 - RNA, 64 nt, Homo Sapiens; identical to SEQ ID NO: 53442

SEQ ID NO: 605559 - RNA, 64 nt, Homo Sapiens; identical to SEQ ID NO: 53443

SEQ ID NO: 605560 - RNA, 64 nt, Homo Sapiens; identical to SEQ ID NO: 53444

SEQ ID NO: 605561 - RNA, 64 nt, Homo Sapiens; identical to SEQ ID NO: 53445

SEQ ID NO: 605562 - RNA, 64 nt, Homo Sapiens; identical to SEQ ID NO: 53446

SEQ ID NO: 605563 - RNA, 64 nt, Homo Sapiens; identical to SEQ ID NO: 53447

SEQ ID NO: 605564 - RNA, 64 nt, Homo Sapiens; identical to SEQ ID NO: 53448

SEQ ID NO: 605565 - RNA, 64 nt, Homo Sapiens; identical to SEQ ID NO: 53449

SEQ ID NO: 605566 - RNA, 64 nt, Homo Sapiens; identical to SEQ ID NO: 53450

SEQ ID NO: 605567 - RNA, 64 nt, Homo Sapiens; identical to SEQ ID NO: 53451

SEQ ID NO: 605568 - RNA, 64 nt, Homo Sapiens; identical to SEQ ID NO: 53452

SEQ ID NO: 605569 - RNA, 64 nt, Homo Sapiens; identical to SEQ ID NO: 53453

SEQ ID NO: 605570 - RNA, 64 nt, Homo Sapiens; identical to SEQ ID NO: 53454

SEQ ID NO: 605571 - RNA, 64 nt, Homo Sapiens
ccaguuuaagauaggaggaaggagagcaauuucuaaguuucaauccugcgcuguacaguugaag

SEQ ID NO: 605572 - RNA, 64 nt, Homo Sapiens
cuggcugcuggggcuacuucauucccccuccauaaaguuucagccauuaugggcacugguuuua

SEQ ID NO: 605573 - RNA, 64 nt, Homo Sapiens
caaccauaaguauaguauuugcuuuaagauuuaaaaguuucacaacacaugauuauguuaagag

SEQ ID NO: 605574 - RNA, 64 nt, Homo Sapiens
ucuaaguugaaacaggguguuuaauguguucaucaaguuucacaguggacuggaauuuuuuuca

SEQ ID NO: 605575 - RNA, 64 nt, Homo Sapiens
uacuuagcuaggagaaagacccaaaaaguacuuaaaguuucauugaaaaaaaaaaaacaaaaac

SEQ ID NO: 605576 - RNA, 64 nt, Homo Sapiens
uggccgggcgcgguggcucauguuccuuaaaggaaaguuucauugaaucuauuaaaaaugcacu

SEQ ID NO: 605577 - RNA, 64 nt, Homo Sapiens
uuuuaaaguucauugcaauuagaaaagugaauugaaguuucaagaaauguaugcauucacauuu

SEQ ID NO: 605578 - RNA, 64 nt, Homo Sapiens
guauauuguugaagagacagaaguauauuaaacaaaguuucagacauaugcagaaauagacaaa

SEQ ID NO: 605579 - RNA, 64 nt, Homo Sapiens
auguucccuucuuguagagaguaguauuuaaacuaaguuucagaacaaaagauucuaaggccua

SEQ ID NO: 605580 - RNA, 64 nt, Homo Sapiens
aacuaccuacaaaagauucuuauuauucaacuucaaguuucagcuguaacauaguacuucaaag

SEQ ID NO: 605581 - RNA, 64 nt, Homo Sapiens
ugagcuauuuccauuccagaacaaaaaugaacugaaguuucacaaugaucauuugcccuuaagg

SEQ ID NO: 605582 - RNA, 64 nt, Homo Sapiens
agucaaugaggaagauuuugugaaaggucaaagcaaguuucaucaguccagauauuucacauuu

SEQ ID NO: 605583 - RNA, 64 nt, Homo Sapiens
caauaaaauauuuuugaaaguccugagaauaagaaaguuucaccuauuaaagaaccaaaaguuu

SEQ ID NO: 605584 - RNA, 64 nt, Homo Sapiens
uauuguuugauaugaagugucacucuguccuuggaaguuucauauccuaaaagacuugcggaau

SEQ ID NO: 605585 - RNA, 64 nt, Homo Sapiens
uaaacccuuauaauaaaauccuucuguaauaauaaaguuucaaaagaaaauguuuauuuguucu

SEQ ID NO: 605586 - RNA, 64 nt, Homo Sapiens
aaaacucaaucacauucaauuccagaguaguuucaaguuucacaucguaaccauuuucgccccc

SEQ ID NO: 605587 - RNA, 64 nt, Homo Sapiens
uuugccuagcaugucccuguggcgucucaaaaaaaaguuucaucgucccgucauuguuucugau

SEQ ID NO: 605588 - RNA, 64 nt, Homo Sapiens
uagcauuagaauuuugucuuaaaauaacagcgguaaguuucacuuuuuauucuguauugugcag

SEQ ID NO: 605589 - RNA, 64 nt, Homo Sapiens
auuuauauuaucauucuaguuucagaguauacagaaguuucaucccaucauuuggaaaaauaaa

SEQ ID NO: 605590 - RNA, 64 nt, Homo Sapiens
ucauuucagcauuaacccaaaaguccgcaguccaaaguuucaucugagacaaggcaagucccuu

SEQ ID NO: 605591 - RNA, 64 nt, Homo Sapiens
cuuuucauugccauguagggugucauguguacaaaaguuucaucaagucugugagauucauuca

SEQ ID NO: 605592 - RNA, 64 nt, Homo Sapiens
uauuaagaaaaucuauuuugcacagcuuuuuaccaaguuucaggacaucaccacaguuuaauac

SEQ ID NO: 605593 - RNA, 64 nt, Homo Sapiens
ugguaggacagagaacggcaagaaggccgaauccaaguuucaugcauguaguaggacagagaac

SEQ ID NO: 605594 - RNA, 64 nt, Homo Sapiens
uaguaggacagagaacagaaugaaggcugaauccaaguuucauguauguuucuaaaagcuuuag

SEQ ID NO: 605595 - RNA, 64 nt, Homo Sapiens
acaaagaugagacuguguuugguuacauuuuccaaaguuucauugcauucucccuuggggaggc

SEQ ID NO: 605596 - RNA, 64 nt, Homo Sapiens
cuucaauauuucagcaggguacacaggcguuuccaaguuucagugacaccguccugccuaacca

SEQ ID NO: 605597 - RNA, 64 nt, Homo Sapiens
guauuuaucauuggucuuuacugaccuuuuaauaaaguuucaguccuuuuguuuucuauauacc

SEQ ID NO: 605598 - RNA, 64 nt, Homo Sapiens
uggggagcuggucuucuaagcuucuuucucuuaaaaguuucauucuugcuuuaaacagccuuuu

SEQ ID NO: 605599 - RNA, 64 nt, Homo Sapiens
uuuagaauuauuaauauuucuaauauuuuaacacaaguuucaggaaacuugguuuugauuguuc

SEQ ID NO: 605600 - RNA, 64 nt, Homo Sapiens
gccuagcuaauuuuuuguauuuuuaguagagaugaaguuucaccguguuggccaggauggucuu

SEQ ID NO: 605601 - RNA, 64 nt, Homo Sapiens
cccagaggacgaagaggucaggcagccucucagaaaguuucaccaaggaagcacagaagucgca

SEQ ID NO: 605602 - RNA, 64 nt, Homo Sapiens
cccagagggagccgagacucugacagccuccuuaaaguuucaccugugaguugaaccccaguac

SEQ ID NO: 605603 - RNA, 64 nt, Homo Sapiens
ccugucugaggggagcccagaggcacauccggacaaguuucagauaacccguggggauaguuuu

SEQ ID NO: 605604 - RNA, 64 nt, Homo Sapiens
guccauguuaucggcucgguacucaacacaacccaaguuucauccgaggaaauguccccgcagu

SEQ ID NO: 605605 - RNA, 64 nt, Homo Sapiens
gaacuaccaacucucuaguuauaaaauuuauacaaaguuucagauuuaguauuuacaguaauaa

SEQ ID NO: 605606 - RNA, 64 nt, Homo Sapiens
acaaaucaugucuuuugccuagcauuugaauaguaaguuucaucauuaaagcuugaaaacauuu

SEQ ID NO: 605607 - RNA, 64 nt, Homo Sapiens
uuaggauaguguuugauauagauccucaaaacagaaguuucaucauugagaauuuauagccaag

SEQ ID NO: 605608 - RNA, 64 nt, Homo Sapiens
uucuacagccuagucagcagugauaguagcauuuaaguuucagaacuuuucugccuucuaucac

SEQ ID NO: 605609 - RNA, 63 nt, Homo Sapiens
acauagucuuuuuuaaauggaaggagaaaaugucagccacauuacugucuguguagugccagg

SEQ ID NO: 605610 - RNA, 63 nt, Homo Sapiens
cagaggcuaguggucacagacagcugggaauggcagccacagaggguccccucugggagaaac

SEQ ID NO: 605611 - RNA, 63 nt, Homo Sapiens
agccuggugccacagucacgugggggaagaccucagccacagcuguaagcagcucucugccag

SEQ ID NO: 605612 - RNA, 63 nt, Homo Sapiens
agaccucagccacagcuguaagcagcucucugccagccacauggccggggaccgaaaaacucc

SEQ ID NO: 605613 - RNA, 63 nt, Homo Sapiens
cacuuggaguaugaacaaugggcacgggguuuucagccacaguucccucgaggccaguguuca

SEQ ID NO: 605614 - RNA, 63 nt, Homo Sapiens
uauguaaagaugaaggcagagaucggaguuuugcagccacaagcuaagaaacaccaaggauug

SEQ ID NO: 605615 - RNA, 63 nt, Homo Sapiens
acuuacgugguaaaaaaugaagucuccugcccacagccacauuagugaaccuagaagcagaga

SEQ ID NO: 605616 - RNA, 63 nt, Homo Sapiens
cauacacacacgcucgcacagcccacacugcagcagccacaucgacucuccacucccccugcc

SEQ ID NO: 605617 - RNA, 63 nt, Homo Sapiens
ggaacucgucucuuacauaccucccuccauccgcagccacaggugacucaguuucccucccuu

SEQ ID NO: 605618 - RNA, 63 nt, Homo Sapiens
ugagucccuggcaguagccugcucuggaaagcccagccacaccugaggggaggguugagggag

SEQ ID NO: 605619 - RNA, 63 nt, Homo Sapiens
auuucucucucauugacucacuguggcaaggggcagccacacccuggugguagaacuccaguu

SEQ ID NO: 605620 - RNA, 63 nt, Homo Sapiens
ugugaccugcugggccguggacgcacacagccacagccacacgcacugccacugucccuuggc

SEQ ID NO: 605621 - RNA, 63 nt, Homo Sapiens
cacacgugugaccugcugggcuuggcacgcacacagccacagcauggcacacugccacugucc

SEQ ID NO: 605622 - RNA, 63 nt, Homo Sapiens
guuuacauuggccuuugguuuuuuuuuuucuuucagccacaacuauaugcugauauaacucag

SEQ ID NO: 605623 - RNA, 63 nt, Homo Sapiens
uuggauagcugccacuaggguugcuucgaucuucagccacaugcuguccuugaagcagcuauu

SEQ ID NO: 605624 - RNA, 63 nt, Homo Sapiens
ccccaggcucucgcugcccucuccaacuccuuucagccacaugagaaaggacagagccagcgg

SEQ ID NO: 605625 - RNA, 63 nt, Homo Sapiens
acugccauuacccagugccgggagucccaggggcagccacacccagccacaggccaaauccuu

SEQ ID NO: 605626 - RNA, 63 nt, Homo Sapiens
ccaaauccuuggagucccaguguguuauuuccccagccacagguccuuguuaccuaucucgug

SEQ ID NO: 605627 - RNA, 63 nt, Homo Sapiens
agagccaaucacagacccacuaccacaccagcucagccacagcucugcauccccugcacccgc

SEQ ID NO: 605628 - RNA, 63 nt, Homo Sapiens
ccaaacacaucaaacuugcuugugucuguccaccagccacagcacgaccauugaaaauaucuc

SEQ ID NO: 605629 - RNA, 63 nt, Homo Sapiens
cauggacguuucauccaacacaugugacagccacagccacacggccgaccauccucgcaguug

SEQ ID NO: 605630 - RNA, 63 nt, Homo Sapiens
cacacgcauggacguuucaucaguugcaugugacagccacagcuugggagccgaccauccucg

SEQ ID NO: 605631 - RNA, 63 nt, Homo Sapiens
cggugggggcacagcacagaaccucccaccaaccagccacacccccccaguaugggaaccagc

SEQ ID NO: 605632 - RNA, 63 nt, Homo Sapiens
cagugggggcacagcacagaaccucccaccaaccagccacacccccccggugugggaaccagc

SEQ ID NO: 605633 - RNA, 63 nt, Homo Sapiens
gccaccgccacacuagugcuagaauguggaacccagccacacuguugcaggacacuccggggg

SEQ ID NO: 605634 - RNA, 63 nt, Homo Sapiens
caagccaggggggcuccccgggacagaggaaaacagccacaaaggcaccagaugccagggaag

SEQ ID NO: 605635 - RNA, 63 nt, Homo Sapiens
ugcccuauucuccaugcuuucacaccucauacgcagccacaucaagaccccccgccagcuucc

SEQ ID NO: 605636 - RNA, 63 nt, Homo Sapiens
agaggcaaggggugccaggagacaggugugacacagccacagccccagaacaacaguuggcag

SEQ ID NO: 605637 - RNA, 63 nt, Homo Sapiens
gcccauguccccucuggaaggcacugagcccaccagccacagugccagcaaugugguuccugu

SEQ ID NO: 605638 - RNA, 63 nt, Homo Sapiens
aucaaauuacugaagaucucaucaugcaugugucagccacagcgaaucccaugucuugguuau

SEQ ID NO: 605639 - RNA, 63 nt, Homo Sapiens
caaccaaaauuauuaagcucugugcgaggcugucagccacacuagguaucagggaucccgaga

SEQ ID NO: 605640 - RNA, 63 nt, Homo Sapiens
agucagggcauggcuccaaucaagcucuuuccacagccacaucccucuucccccagggcuucc

SEQ ID NO: 605641 - RNA, 63 nt, Homo Sapiens
cguggaacaggcaaggauggaaccccaucaaaccagccacagcauaugugagcauuggccauc

SEQ ID NO: 605642 - RNA, 63 nt, Homo Sapiens
uuucccaugaccugugggcucaaacucucccugcagccacaugcagccauacuugacuguccc

SEQ ID NO: 605643 - RNA, 63 nt, Homo Sapiens
ugaggaguggccgggcaggcaugcccacagccacagccacagcagugugcacgccguccggcc

SEQ ID NO: 605644 - RNA, 63 nt, Homo Sapiens
cacagcugaggaguggccggccggccaugcccacagccacagccggcccagugugcacgccgu

SEQ ID NO: 605645 - RNA, 63 nt, Homo Sapiens
gauuuucccuacacuucucccuggcccaggcuccagccacaggcaccucuccugcccccgccc

SEQ ID NO: 605646 - RNA, 63 nt, Homo Sapiens
agccagagucaaugccuucaugggaagggcucccagccacacccagaguggcccaaagcuguu

SEQ ID NO: 605647 - RNA, 63 nt, Homo Sapiens
acacacacgcuuguucacacucagaacccaggacagccacagccaccgcuuaggggaagccac

SEQ ID NO: 605648 - RNA, 63 nt, Homo Sapiens
agaacugcucagggacauuaaaggucaaaaguccagccacacucauucauccuuuccccaggc

SEQ ID NO: 605649 - RNA, 63 nt, Homo Sapiens
gaaaaagucagcgggucaagcuagccuguggcccagccacaacuagcugacaaagcuuccugg

SEQ ID NO: 605650 - RNA, 63 nt, Homo Sapiens
gaaagagacuuugccucacugaccuaacagccacagccacacguuauucauccaucccuuuca

SEQ ID NO: 605651 - RNA, 63 nt, Homo Sapiens
cacacggaaagagacuuugccuuucagaccuaacagccacagcgcuuaguuauucauccaucc

SEQ ID NO: 605652 - RNA, 63 nt, Homo Sapiens
cucuggggagccagucauuugucauuugagagccagccacagccacagagaaagccagcuguc

SEQ ID NO: 605653 - RNA, 63 nt, Homo Sapiens
ggcagguguccucccaggaagaagaagaagcaccagccacaggaggaagauguccuuccuggg

SEQ ID NO: 605654 - RNA, 63 nt, Homo Sapiens
ucccccaagggggcuuuggguauuggcccccagcagccacaguacgaucaaguuacacagcuu

SEQ ID NO: 605655 - RNA, 63 nt, Homo Sapiens
cacgaucaaguuacacagcuagaacgcugcgcccagccacacccccagaccccacauccccuc

SEQ ID NO: 605656 - RNA, 63 nt, Homo Sapiens
ccuccaauaaagacagcaugccaaggacccugccagccacagagauccaggagggagccaccc

SEQ ID NO: 605657 - RNA, 63 nt, Homo Sapiens
ccacaaccacccccaagccuaggagggcagacccagccacauaugauccaggguuccaccacc

SEQ ID NO: 605658 - RNA, 63 nt, Homo Sapiens
accuugcggcaagucugaugauuaacaaaauaacagccacauaugaauguaagagccuuggaa

SEQ ID NO: 605659 - RNA, 63 nt, Homo Sapiens
ucugucuguguuuagagaggaagugccagggagcagccacacgaaggaaagauuucuccucuc

SEQ ID NO: 605660 - RNA, 63 nt, Homo Sapiens
gugcacagguagccccgacccucucaggcauuccagccacagaacaucaaagugagcgaguac

SEQ ID NO: 605661 - RNA, 63 nt, Homo Sapiens
gaagcaccuccgguuggaggcacccaggcuugccagccacagagcgccccaaagucaccguca

SEQ ID NO: 605662 - RNA, 63 nt, Homo Sapiens
gaguggccuuggcucccuggagagcccacgucucagccacaguucuccacucgccucggacuu

SEQ ID NO: 605663 - RNA, 63 nt, Homo Sapiens
ccucagaggaggaggaggaggaggcagcuccggcagccacagaaggcugcagcccagcccgcc

SEQ ID NO: 605664 - RNA, 63 nt, Homo Sapiens
gccaccugagggagccgccugcaagcggcccugcagccacaaagcaacccgcccucugcaaaa

SEQ ID NO: 605665 - RNA, 63 nt, Homo Sapiens
ggagcugguggugggagaaugacggcagggacgcagccacaguucagacccuguccccucagc

SEQ ID NO: 605666 - RNA, 63 nt, Homo Sapiens
agcagcuugaccugguauuccauauggugagagcagccacagcaugcagacacaaacugguuu

SEQ ID NO: 605667 - RNA, 63 nt, Homo Sapiens
cugaguauuguuuguucaccguuaacacaaauucagccacauuuauaucauucccaguuauua

SEQ ID NO: 605668 - RNA, 64 nt, Homo Sapiens; identical to SEQ ID NO: 480897

SEQ ID NO: 605669 - RNA, 64 nt, Homo Sapiens; identical to SEQ ID NO: 480898

SEQ ID NO: 605670 - RNA, 64 nt, Homo Sapiens; identical to SEQ ID NO: 480899

SEQ ID NO: 605671 - RNA, 64 nt, Homo Sapiens; identical to SEQ ID NO: 480900

SEQ ID NO: 605672 - RNA, 64 nt, Homo Sapiens; identical to SEQ ID NO: 480901

SEQ ID NO: 605673 - RNA, 64 nt, Homo Sapiens; identical to SEQ ID NO: 480902

SEQ ID NO: 605674 - RNA, 64 nt, Homo Sapiens; identical to SEQ ID NO: 480903

SEQ ID NO: 605675 - RNA, 64 nt, Homo Sapiens; identical to SEQ ID NO: 480904

SEQ ID NO: 605676 - RNA, 64 nt, Homo Sapiens; identical to SEQ ID NO: 480905

SEQ ID NO: 605677 - RNA, 64 nt, Homo Sapiens; identical to SEQ ID NO: 480906

SEQ ID NO: 605678 - RNA, 64 nt, Homo Sapiens; identical to SEQ ID NO: 480907

SEQ ID NO: 605679 - RNA, 64 nt, Homo Sapiens; identical to SEQ ID NO: 480908

SEQ ID NO: 605680 - RNA, 64 nt, Homo Sapiens; identical to SEQ ID NO: 480909

SEQ ID NO: 605681 - RNA, 64 nt, Homo Sapiens; identical to SEQ ID NO: 480910

SEQ ID NO: 605682 - RNA, 64 nt, Homo Sapiens; identical to SEQ ID NO: 480911

SEQ ID NO: 605683 - RNA, 64 nt, Homo Sapiens; identical to SEQ ID NO: 480912

SEQ ID NO: 605684 - RNA, 64 nt, Homo Sapiens; identical to SEQ ID NO: 480913

SEQ ID NO: 605685 - RNA, 64 nt, Homo Sapiens; identical to SEQ ID NO: 480914

SEQ ID NO: 605686 - RNA, 64 nt, Homo Sapiens; identical to SEQ ID NO: 480915

SEQ ID NO: 605687 - RNA, 64 nt, Homo Sapiens; identical to SEQ ID NO: 480916

SEQ ID NO: 605688 - RNA, 64 nt, Homo Sapiens; identical to SEQ ID NO: 480917

SEQ ID NO: 605689 - RNA, 64 nt, Homo Sapiens; identical to SEQ ID NO: 480918

SEQ ID NO: 605690 - RNA, 64 nt, Homo Sapiens; identical to SEQ ID NO: 480919

SEQ ID NO: 605691 - RNA, 64 nt, Homo Sapiens; identical to SEQ ID NO: 480920

SEQ ID NO: 605692 - RNA, 64 nt, Homo Sapiens; identical to SEQ ID NO: 480921

SEQ ID NO: 605693 - RNA, 64 nt, Homo Sapiens; identical to SEQ ID NO: 480922

SEQ ID NO: 605694 - RNA, 64 nt, Homo Sapiens; identical to SEQ ID NO: 480923

SEQ ID NO: 605695 - RNA, 64 nt, Homo Sapiens; identical to SEQ ID NO: 480924

SEQ ID NO: 605696 - RNA, 64 nt, Homo Sapiens; identical to SEQ ID NO: 480925

SEQ ID NO: 605697 - RNA, 64 nt, Homo Sapiens; identical to SEQ ID NO: 480926

SEQ ID NO: 605698 - RNA, 64 nt, Homo Sapiens; identical to SEQ ID NO: 480927

SEQ ID NO: 605699 - RNA, 64 nt, Homo Sapiens; identical to SEQ ID NO: 126995

SEQ ID NO: 605700 - RNA, 64 nt, Homo Sapiens; identical to SEQ ID NO: 126996

SEQ ID NO: 605701 - RNA, 64 nt, Homo Sapiens; identical to SEQ ID NO: 126997

SEQ ID NO: 605702 - RNA, 64 nt, Homo Sapiens; identical to SEQ ID NO: 126998

SEQ ID NO: 605703 - RNA, 64 nt, Homo Sapiens; identical to SEQ ID NO: 126999

SEQ ID NO: 605704 - RNA, 64 nt, Homo Sapiens; identical to SEQ ID NO: 127000

SEQ ID NO: 605705 - RNA, 64 nt, Homo Sapiens; identical to SEQ ID NO: 127001

SEQ ID NO: 605706 - RNA, 64 nt, Homo Sapiens; identical to SEQ ID NO: 127002

SEQ ID NO: 605707 - RNA, 64 nt, Homo Sapiens; identical to SEQ ID NO: 127003

SEQ ID NO: 605708 - RNA, 64 nt, Homo Sapiens; identical to SEQ ID NO: 127004

SEQ ID NO: 605709 - RNA, 64 nt, Homo Sapiens; identical to SEQ ID NO: 127005

SEQ ID NO: 605710 - RNA, 64 nt, Homo Sapiens; identical to SEQ ID NO: 127006

SEQ ID NO: 605711 - RNA, 64 nt, Homo Sapiens; identical to SEQ ID NO: 127007

SEQ ID NO: 605712 - RNA, 64 nt, Homo Sapiens; identical to SEQ ID NO: 127008

SEQ ID NO: 605713 - RNA, 64 nt, Homo Sapiens; identical to SEQ ID NO: 127009

SEQ ID NO: 605714 - RNA, 62 nt, Homo Sapiens; identical to SEQ ID NO: 127010

SEQ ID NO: 605715 - RNA, 64 nt, Homo Sapiens; identical to SEQ ID NO: 127011

SEQ ID NO: 605716 - RNA, 64 nt, Homo Sapiens; identical to SEQ ID NO: 127012

SEQ ID NO: 605717 - RNA, 64 nt, Homo Sapiens; identical to SEQ ID NO: 127013

SEQ ID NO: 605718 - RNA, 64 nt, Homo Sapiens; identical to SEQ ID NO: 127014

SEQ ID NO: 605719 - RNA, 64 nt, Homo Sapiens; identical to SEQ ID NO: 127015

SEQ ID NO: 605720 - RNA, 64 nt, Homo Sapiens; identical to SEQ ID NO: 127016

SEQ ID NO: 605721 - RNA, 64 nt, Homo Sapiens; identical to SEQ ID NO: 127017

SEQ ID NO: 605722 - RNA, 64 nt, Homo Sapiens; identical to SEQ ID NO: 127018

SEQ ID NO: 605723 - RNA, 64 nt, Homo Sapiens; identical to SEQ ID NO: 127019

SEQ ID NO: 605724 - RNA, 64 nt, Homo Sapiens; identical to SEQ ID NO: 127020

SEQ ID NO: 605725 - RNA, 64 nt, Homo Sapiens; identical to SEQ ID NO: 127021

SEQ ID NO: 605726 - RNA, 64 nt, Homo Sapiens; identical to SEQ ID NO: 127022

SEQ ID NO: 605727 - RNA, 64 nt, Homo Sapiens; identical to SEQ ID NO: 127023

SEQ ID NO: 605728 - RNA, 64 nt, Homo Sapiens; identical to SEQ ID NO: 127024

SEQ ID NO: 605729 - RNA, 64 nt, Homo Sapiens; identical to SEQ ID NO: 127025

SEQ ID NO: 605730 - RNA, 64 nt, Homo Sapiens; identical to SEQ ID NO: 127026

SEQ ID NO: 605731 - RNA, 64 nt, Homo Sapiens; identical to SEQ ID NO: 127027

SEQ ID NO: 605732 - RNA, 64 nt, Homo Sapiens; identical to SEQ ID NO: 127028

SEQ ID NO: 605733 - RNA, 64 nt, Homo Sapiens; identical to SEQ ID NO: 127029

SEQ ID NO: 605734 - RNA, 64 nt, Homo Sapiens; identical to SEQ ID NO: 127030

SEQ ID NO: 605735 - RNA, 64 nt, Homo Sapiens; identical to SEQ ID NO: 127031

SEQ ID NO: 605736 - RNA, 64 nt, Homo Sapiens; identical to SEQ ID NO: 127032

SEQ ID NO: 605737 - RNA, 64 nt, Homo Sapiens; identical to SEQ ID NO: 127033

SEQ ID NO: 605738 - RNA, 64 nt, Homo Sapiens; identical to SEQ ID NO: 127034

SEQ ID NO: 605739 - RNA, 64 nt, Homo Sapiens; identical to SEQ ID NO: 127035

SEQ ID NO: 605740 - RNA, 64 nt, Homo Sapiens; identical to SEQ ID NO: 127036

SEQ ID NO: 605741 - RNA, 64 nt, Homo Sapiens; identical to SEQ ID NO: 127037

SEQ ID NO: 605742 - RNA, 64 nt, Homo Sapiens; identical to SEQ ID NO: 127038

SEQ ID NO: 605743 - RNA, 64 nt, Homo Sapiens; identical to SEQ ID NO: 45744

SEQ ID NO: 605744 - RNA, 64 nt, Homo Sapiens; identical to SEQ ID NO: 45745

SEQ ID NO: 605745 - RNA, 64 nt, Homo Sapiens; identical to SEQ ID NO: 45746

SEQ ID NO: 605746 - RNA, 64 nt, Homo Sapiens; identical to SEQ ID NO: 45747

SEQ ID NO: 605747 - RNA, 64 nt, Homo Sapiens; identical to SEQ ID NO: 45748

SEQ ID NO: 605748 - RNA, 64 nt, Homo Sapiens; identical to SEQ ID NO: 45749

SEQ ID NO: 605749 - RNA, 64 nt, Homo Sapiens; identical to SEQ ID NO: 45750

SEQ ID NO: 605750 - RNA, 64 nt, Homo Sapiens; identical to SEQ ID NO: 45751

SEQ ID NO: 605751 - RNA, 64 nt, Homo Sapiens; identical to SEQ ID NO: 45752

SEQ ID NO: 605752 - RNA, 64 nt, Homo Sapiens; identical to SEQ ID NO: 45753

SEQ ID NO: 605753 - RNA, 64 nt, Homo Sapiens; identical to SEQ ID NO: 45754

SEQ ID NO: 605754 - RNA, 64 nt, Homo Sapiens; identical to SEQ ID NO: 45755

SEQ ID NO: 605755 - RNA, 64 nt, Homo Sapiens; identical to SEQ ID NO: 45756

SEQ ID NO: 605756 - RNA, 64 nt, Homo Sapiens; identical to SEQ ID NO: 45757

SEQ ID NO: 605757 - RNA, 64 nt, Homo Sapiens; identical to SEQ ID NO: 45758

SEQ ID NO: 605758 - RNA, 64 nt, Homo Sapiens; identical to SEQ ID NO: 45759

SEQ ID NO: 605759 - RNA, 64 nt, Homo Sapiens; identical to SEQ ID NO: 45760

SEQ ID NO: 605760 - RNA, 64 nt, Homo Sapiens; identical to SEQ ID NO: 45761

SEQ ID NO: 605761 - RNA, 64 nt, Homo Sapiens; identical to SEQ ID NO: 45762

SEQ ID NO: 605762 - RNA, 64 nt, Homo Sapiens; identical to SEQ ID NO: 45763

SEQ ID NO: 605763 - RNA, 64 nt, Homo Sapiens; identical to SEQ ID NO: 45764

SEQ ID NO: 605764 - RNA, 64 nt, Homo Sapiens; identical to SEQ ID NO: 45765

SEQ ID NO: 605765 - RNA, 64 nt, Homo Sapiens; identical to SEQ ID NO: 45766

SEQ ID NO: 605766 - RNA, 64 nt, Homo Sapiens; identical to SEQ ID NO: 45767

SEQ ID NO: 605767 - RNA, 64 nt, Homo Sapiens; identical to SEQ ID NO: 45768

SEQ ID NO: 605768 - RNA, 64 nt, Homo Sapiens; identical to SEQ ID NO: 45769

SEQ ID NO: 605769 - RNA, 64 nt, Homo Sapiens; identical to SEQ ID NO: 45770

SEQ ID NO: 605770 - RNA, 64 nt, Homo Sapiens; identical to SEQ ID NO: 45771

SEQ ID NO: 605771 - RNA, 64 nt, Homo Sapiens; identical to SEQ ID NO: 45772

SEQ ID NO: 605772 - RNA, 64 nt, Homo Sapiens; identical to SEQ ID NO: 45773

SEQ ID NO: 605773 - RNA, 64 nt, Homo Sapiens; identical to SEQ ID NO: 45774

SEQ ID NO: 605774 - RNA, 64 nt, Homo Sapiens; identical to SEQ ID NO: 45775

SEQ ID NO: 605775 - RNA, 64 nt, Homo Sapiens; identical to SEQ ID NO: 45776

SEQ ID NO: 605776 - RNA, 64 nt, Homo Sapiens; identical to SEQ ID NO: 45777

SEQ ID NO: 605777 - RNA, 64 nt, Homo Sapiens; identical to SEQ ID NO: 45778

SEQ ID NO: 605778 - RNA, 64 nt, Homo Sapiens; identical to SEQ ID NO: 45779

SEQ ID NO: 605779 - RNA, 64 nt, Homo Sapiens
accaaaugaagcuuuuucuauccauuuuuaauauuguccuuacauaauauuguccuuagauuuu

SEQ ID NO: 605780 - RNA, 64 nt, Homo Sapiens
ucuauccauuuuuaauauuguccuuacauaauauuguccuuagauuuugaucaauucuaugucu

SEQ ID NO: 605781 - RNA, 64 nt, Homo Sapiens
acuuggacaggcuuuaucaucugccuacucuaauuguccuuaguuaauacuuuguacaggucac

SEQ ID NO: 605782 - RNA, 64 nt, Homo Sapiens
uuuaaacaugauggaauuuggaaauguuuauuuuuguccuuauauguggguuuuuuuuaaauaa

SEQ ID NO: 605783 - RNA, 64 nt, Homo Sapiens
cauuccaagugcucugccagugaucucccagucuuguccuuacccuccccugcuccagccaaau

SEQ ID NO: 605784 - RNA, 64 nt, Homo Sapiens
ccccccagguuccuucuugcuaagaucauuuugcuguccuuaaaaaaaaccagucaauuacgcc

SEQ ID NO: 605785 - RNA, 64 nt, Homo Sapiens
ggguagaggcugcaugugggggccccugucugccuguccuuaggguguggauuaggcucuggcu

SEQ ID NO: 605786 - RNA, 64 nt, Homo Sapiens
cuccugugcuuuccucucuucaggacaaaugguuuguccuuaugguccccuuuccacuaggauu

SEQ ID NO: 605787 - RNA, 64 nt, Homo Sapiens
agcuuuucuuaaaacgucaauuucuuugggguaguguccuuacaauacauucguaaagaguuca

SEQ ID NO: 605788 - RNA, 64 nt, Homo Sapiens
ccacuagccaccccacguggccauccgagaccucuguccuuacagccuguccacaucccucugc

SEQ ID NO: 605789 - RNA, 64 nt, Homo Sapiens
auuuuuuguaagaagaaauucaacaaauaccauauguccuuaucuagaagugcugauuuagauu

SEQ ID NO: 605790 - RNA, 64 nt, Homo Sapiens
uacuuguagggaugagguuaccaaguaucaaagguguccuuaaaaacugaauucuccugcagug

SEQ ID NO: 605791 - RNA, 64 nt, Homo Sapiens
ugggccugagggagggcuggagucgcacgcgcuuuguccuuagcgccugucugcucuccucuaa

SEQ ID NO: 605792 - RNA, 64 nt, Homo Sapiens
cuuccgcuccaccagccuggucugaggcgugcucuguccuuagagaaggcgcgguggccggguu

SEQ ID NO: 605793 - RNA, 64 nt, Homo Sapiens; identical to SEQ ID NO: 107849

SEQ ID NO: 605794 - RNA, 64 nt, Homo Sapiens; identical to SEQ ID NO: 107850

SEQ ID NO: 605795 - RNA, 64 nt, Homo Sapiens; identical to SEQ ID NO: 107851

SEQ ID NO: 605796 - RNA, 64 nt, Homo Sapiens; identical to SEQ ID NO: 107852

SEQ ID NO: 605797 - RNA, 64 nt, Homo Sapiens; identical to SEQ ID NO: 107853

SEQ ID NO: 605798 - RNA, 64 nt, Homo Sapiens; identical to SEQ ID NO: 107854

SEQ ID NO: 605799 - RNA, 64 nt, Homo Sapiens; identical to SEQ ID NO: 107855

SEQ ID NO: 605800 - RNA, 64 nt, Homo Sapiens; identical to SEQ ID NO: 107856

SEQ ID NO: 605801 - RNA, 64 nt, Homo Sapiens; identical to SEQ ID NO: 107857

SEQ ID NO: 605802 - RNA, 64 nt, Homo Sapiens; identical to SEQ ID NO: 107858

SEQ ID NO: 605803 - RNA, 64 nt, Homo Sapiens; identical to SEQ ID NO: 107859

SEQ ID NO: 605804 - RNA, 64 nt, Homo Sapiens; identical to SEQ ID NO: 107860

SEQ ID NO: 605805 - RNA, 64 nt, Homo Sapiens; identical to SEQ ID NO: 107861

SEQ ID NO: 605806 - RNA, 64 nt, Homo Sapiens; identical to SEQ ID NO: 107862

SEQ ID NO: 605807 - RNA, 64 nt, Homo Sapiens; identical to SEQ ID NO: 107863

SEQ ID NO: 605808 - RNA, 63 nt, Homo Sapiens; identical to SEQ ID NO: 107864

SEQ ID NO: 605809 - RNA, 64 nt, Homo Sapiens; identical to SEQ ID NO: 107865

SEQ ID NO: 605810 - RNA, 64 nt, Homo Sapiens; identical to SEQ ID NO: 107866

SEQ ID NO: 605811 - RNA, 64 nt, Homo Sapiens; identical to SEQ ID NO: 107867

SEQ ID NO: 605812 - RNA, 64 nt, Homo Sapiens; identical to SEQ ID NO: 107868

SEQ ID NO: 605813 - RNA, 64 nt, Homo Sapiens; identical to SEQ ID NO: 107869

SEQ ID NO: 605814 - RNA, 64 nt, Homo Sapiens; identical to SEQ ID NO: 107870

SEQ ID NO: 605815 - RNA, 64 nt, Homo Sapiens; identical to SEQ ID NO: 107871

SEQ ID NO: 605816 - RNA, 64 nt, Homo Sapiens; identical to SEQ ID NO: 107872

SEQ ID NO: 605817 - RNA, 64 nt, Homo Sapiens; identical to SEQ ID NO: 107873

SEQ ID NO: 605818 - RNA, 64 nt, Homo Sapiens; identical to SEQ ID NO: 107874

SEQ ID NO: 605819 - RNA, 64 nt, Homo Sapiens; identical to SEQ ID NO: 107875

SEQ ID NO: 605820 - RNA, 64 nt, Homo Sapiens; identical to SEQ ID NO: 107876

SEQ ID NO: 605821 - RNA, 64 nt, Homo Sapiens; identical to SEQ ID NO: 107877

SEQ ID NO: 605822 - RNA, 64 nt, Homo Sapiens; identical to SEQ ID NO: 107878

SEQ ID NO: 605823 - RNA, 64 nt, Homo Sapiens; identical to SEQ ID NO: 107879

SEQ ID NO: 605824 - RNA, 64 nt, Homo Sapiens; identical to SEQ ID NO: 107880

SEQ ID NO: 605825 - RNA, 64 nt, Homo Sapiens; identical to SEQ ID NO: 107881

SEQ ID NO: 605826 - RNA, 64 nt, Homo Sapiens; identical to SEQ ID NO: 107882

SEQ ID NO: 605827 - RNA, 64 nt, Homo Sapiens; identical to SEQ ID NO: 107883

SEQ ID NO: 605828 - RNA, 64 nt, Homo Sapiens; identical to SEQ ID NO: 107884

SEQ ID NO: 605829 - RNA, 64 nt, Homo Sapiens; identical to SEQ ID NO: 107885

SEQ ID NO: 605830 - RNA, 64 nt, Homo Sapiens; identical to SEQ ID NO: 107886

SEQ ID NO: 605831 - RNA, 64 nt, Homo Sapiens; identical to SEQ ID NO: 107887

SEQ ID NO: 605832 - RNA, 64 nt, Homo Sapiens; identical to SEQ ID NO: 107888

SEQ ID NO: 605833 - RNA, 64 nt, Homo Sapiens; identical to SEQ ID NO: 107889

SEQ ID NO: 605834 - RNA, 64 nt, Homo Sapiens; identical to SEQ ID NO: 107890

SEQ ID NO: 605835 - RNA, 64 nt, Homo Sapiens; identical to SEQ ID NO: 107891

SEQ ID NO: 605836 - RNA, 64 nt, Homo Sapiens; identical to SEQ ID NO: 107892

SEQ ID NO: 605837 - RNA, 64 nt, Homo Sapiens; identical to SEQ ID NO: 107893

SEQ ID NO: 605838 - RNA, 64 nt, Homo Sapiens; identical to SEQ ID NO: 107894

SEQ ID NO: 605839 - RNA, 64 nt, Homo Sapiens; identical to SEQ ID NO: 107895

SEQ ID NO: 605840 - RNA, 64 nt, Homo Sapiens; identical to SEQ ID NO: 107896

SEQ ID NO: 605841 - RNA, 64 nt, Homo Sapiens; identical to SEQ ID NO: 107897

SEQ ID NO: 605842 - RNA, 64 nt, Homo Sapiens; identical to SEQ ID NO: 107898

SEQ ID NO: 605843 - RNA, 64 nt, Homo Sapiens; identical to SEQ ID NO: 107899

SEQ ID NO: 605844 - RNA, 64 nt, Homo Sapiens; identical to SEQ ID NO: 107900

SEQ ID NO: 605845 - RNA, 64 nt, Homo Sapiens; identical to SEQ ID NO: 107901

SEQ ID NO: 605846 - RNA, 64 nt, Homo Sapiens; identical to SEQ ID NO: 107902

SEQ ID NO: 605847 - RNA, 64 nt, Homo Sapiens; identical to SEQ ID NO: 107903

SEQ ID NO: 605848 - RNA, 64 nt, Homo Sapiens; identical to SEQ ID NO: 107904

SEQ ID NO: 605849 - RNA, 64 nt, Homo Sapiens; identical to SEQ ID NO: 107905

SEQ ID NO: 605850 - RNA, 64 nt, Homo Sapiens; identical to SEQ ID NO: 107906

SEQ ID NO: 605851 - RNA, 64 nt, Homo Sapiens; identical to SEQ ID NO: 107907

SEQ ID NO: 605852 - RNA, 64 nt, Homo Sapiens; identical to SEQ ID NO: 107908

SEQ ID NO: 605853 - RNA, 64 nt, Homo Sapiens; identical to SEQ ID NO: 107909

SEQ ID NO: 605854 - RNA, 64 nt, Homo Sapiens; identical to SEQ ID NO: 107910

SEQ ID NO: 605855 - RNA, 64 nt, Homo Sapiens; identical to SEQ ID NO: 107911

SEQ ID NO: 605856 - RNA, 64 nt, Homo Sapiens; identical to SEQ ID NO: 107912

SEQ ID NO: 605857 - RNA, 64 nt, Homo Sapiens; identical to SEQ ID NO: 107913

SEQ ID NO: 605858 - RNA, 64 nt, Homo Sapiens; identical to SEQ ID NO: 107914

SEQ ID NO: 605859 - RNA, 64 nt, Homo Sapiens; identical to SEQ ID NO: 107915

SEQ ID NO: 605860 - RNA, 64 nt, Homo Sapiens; identical to SEQ ID NO: 107916

SEQ ID NO: 605861 - RNA, 64 nt, Homo Sapiens; identical to SEQ ID NO: 107917

SEQ ID NO: 605862 - RNA, 64 nt, Homo Sapiens; identical to SEQ ID NO: 107918

SEQ ID NO: 605863 - RNA, 64 nt, Homo Sapiens; identical to SEQ ID NO: 107919

SEQ ID NO: 605864 - RNA, 64 nt, Homo Sapiens; identical to SEQ ID NO: 107920

SEQ ID NO: 605865 - RNA, 64 nt, Homo Sapiens; identical to SEQ ID NO: 107921

SEQ ID NO: 605866 - RNA, 64 nt, Homo Sapiens; identical to SEQ ID NO: 107922

SEQ ID NO: 605867 - RNA, 64 nt, Homo Sapiens; identical to SEQ ID NO: 107923

SEQ ID NO: 605868 - RNA, 64 nt, Homo Sapiens; identical to SEQ ID NO: 107924

SEQ ID NO: 605869 - RNA, 64 nt, Homo Sapiens; identical to SEQ ID NO: 107925

SEQ ID NO: 605870 - RNA, 64 nt, Homo Sapiens; identical to SEQ ID NO: 107926

SEQ ID NO: 605871 - RNA, 64 nt, Homo Sapiens; identical to SEQ ID NO: 107927

SEQ ID NO: 605872 - RNA, 64 nt, Homo Sapiens; identical to SEQ ID NO: 107928

SEQ ID NO: 605873 - RNA, 64 nt, Homo Sapiens; identical to SEQ ID NO: 107929

SEQ ID NO: 605874 - RNA, 64 nt, Homo Sapiens; identical to SEQ ID NO: 107930

SEQ ID NO: 605875 - RNA, 64 nt, Homo Sapiens; identical to SEQ ID NO: 107931

SEQ ID NO: 605876 - RNA, 64 nt, Homo Sapiens; identical to SEQ ID NO: 107932

SEQ ID NO: 605877 - RNA, 64 nt, Homo Sapiens; identical to SEQ ID NO: 107933

SEQ ID NO: 605878 - RNA, 64 nt, Homo Sapiens
ucuuccuaaagccucccccauaaaaagggagcuguggauccacuuagaucagggcggaaccauc

SEQ ID NO: 605879 - RNA, 64 nt, Homo Sapiens
uccugcucugcugcaggagagggggcuaaggggcuggauccaccaaggcagcucacagcgggaa

SEQ ID NO: 605880 - RNA, 64 nt, Homo Sapiens
uuucaaauggauuuuuaugacccacuacuggguuuggauccacaguuugaaaaauauugcuaca

SEQ ID NO: 605881 - RNA, 64 nt, Homo Sapiens
uggauauuucagcccucuccauccuagucaacacuggauccaccuagugccucugggccauaag

SEQ ID NO: 605882 - RNA, 64 nt, Homo Sapiens
cccgucucccagggcacaagcucccuagccucuuuggauccauugccccugagcucccagaguc

SEQ ID NO: 605883 - RNA, 64 nt, Homo Sapiens
uuccagacagaugagagagggcaggacuucaggcuggauccaccacugggcucucccuccccca

SEQ ID NO: 605884 - RNA, 64 nt, Homo Sapiens
cacaugcugcaggcaugcaguggauccacucccauggauccacuuaacaccccacaugugcugg

SEQ ID NO: 605885 - RNA, 64 nt, Homo Sapiens
cccauggauccacucacaugcccacaugugcugguggauccacuggaucaucucaugcuaacac

SEQ ID NO: 605886 - RNA, 64 nt, Homo Sapiens
auuuuacugguauggcaaaaugacgguugcuaccuggauccaucagcuuucuccauccagauug

SEQ ID NO: 605887 - RNA, 64 nt, Homo Sapiens
aauaaacaauuccuacauuuuuaaaguuauuaaauggauccagauaaccauggucaacuguacu

SEQ ID NO: 605888 - RNA, 64 nt, Homo Sapiens
agggauuucuguaaagaugggaaaggcugauagauugaaauaagcuucugugaaagucuggauu

SEQ ID NO: 605889 - RNA, 64 nt, Homo Sapiens
uuagaaggagccucuuuucccucuauuuuuuaaauugaaauauaauagcugcaucagcccugaa

SEQ ID NO: 605890 - RNA, 64 nt, Homo Sapiens
aaauaugaauuuucucuaaacuuagcugcaucuuuugaaauaucuaugucugucaccaugaaaa

SEQ ID NO: 605891 - RNA, 64 nt, Homo Sapiens
uacauuaacauaggcaaaaacuggaugguaagauuugaaauauuuuggagauuuuuuuuuuuuc

SEQ ID NO: 605892 - RNA, 64 nt, Homo Sapiens
uuaagugauuucauauuaaaaagacuucuuaauguugaaauauuucaugccaaggcacugaauu

SEQ ID NO: 605893 - RNA, 64 nt, Homo Sapiens
cucucucccauggagaaccaaaagauaugacugcuugaaauagucucacaaaacauuuugcuaa

SEQ ID NO: 605894 - RNA, 64 nt, Homo Sapiens
uucugccagucuacaauagcauugcagaaauacuuugaaauaggaaguucucuccucuacgcuc

SEQ ID NO: 605895 - RNA, 64 nt, Homo Sapiens
acaguguuccaaaucccaucauugcuuuguagcuuugaaauacgauuggcuuuauuugaugaau

SEQ ID NO: 605896 - RNA, 64 nt, Homo Sapiens
aauuggcauguagccaauguugcaacauuacucuuugaaauaaaacaaugauaacuauuauuug

SEQ ID NO: 605897 - RNA, 64 nt, Homo Sapiens
aaauaacucuuuuacuagugagauaagacuucauuugaaauaaguuacagccuaauuaauaccu

SEQ ID NO: 605898 - RNA, 64 nt, Homo Sapiens
uguuggguguucccucuucuugucuacuuuuuguuugaaauaacaaaagaaauaugugaugaug

SEQ ID NO: 605899 - RNA, 64 nt, Homo Sapiens
auugcaguauauauauguugcuucguuugugcgauugaaauaaauuaaguuuccuacacgcuaa

SEQ ID NO: 605900 - RNA, 64 nt, Homo Sapiens
ucacuuucaucugcuuucuaguuuuacuaaaacuuugaaauaauuugaacucugauuaucagaa

SEQ ID NO: 605901 - RNA, 64 nt, Homo Sapiens
uucauaucaagauaaagucgaagaucaccacgcauugaaauauuaauacuaaaacccaucaggc

SEQ ID NO: 605902 - RNA, 64 nt, Homo Sapiens
agaacauucugucauuccagucagaaacugucuuuugaaauauuucuuuacaaccuaccaaaaa

SEQ ID NO: 605903 - RNA, 64 nt, Homo Sapiens
aagugugguuuauuuauggcaugaaccauguaacuugaaauaugaacuuacaaggaggggcacu

SEQ ID NO: 605904 - RNA, 64 nt, Homo Sapiens
uucaagggaaauaccagcuuccacuugagucacuuugaaauaguuaauucaacagcaccauguu

SEQ ID NO: 605905 - RNA, 52 nt, Homo Sapiens
aaaagaacaagagucgauaguuuugaaauagcugguuggcgacuguucuuuc

SEQ ID NO: 605906 - RNA, 64 nt, Homo Sapiens
ggaccuaguaaacuagucaguguuggaaacggccuugaaauauuuaaaacauauuuguaaccag

SEQ ID NO: 605907 - RNA, 64 nt, Homo Sapiens
cuuucuaucaaaagcauuggauccaagccauauauugaaauacaagcgugauuaaucaguaauu

SEQ ID NO: 605908 - RNA, 64 nt, Homo Sapiens
ucugugaacaauggguuuacggucuauuucauaauugaaauauuuauuuuaaaaaugaauauua

SEQ ID NO: 605909 - RNA, 64 nt, Homo Sapiens
auugcccuaugaaaacuuuaaaucucuaaaacauuugaaauacuaccauauuugugauuuauug

SEQ ID NO: 605910 - RNA, 64 nt, Homo Sapiens
gaaaugaauuauucuuuaccaguuuugaaacacuuugaaauauccuaagguaacuuggaagcug

SEQ ID NO: 605911 - RNA, 64 nt, Homo Sapiens
ugguacaaaaauaagugguacacuaaacaggcaauugaaauacauuuuuuuaauuuuuauuuuu

SEQ ID NO: 605912 - RNA, 64 nt, Homo Sapiens
agccaaaacauucuucacgcguuguuuccuuagguugaaauagcuaaggugacugaggucaaac

SEQ ID NO: 605913 - RNA, 64 nt, Homo Sapiens
uucauugaucaacauuucauuucucuaaaaccauuugaaauagcuagcccguuaucucugaucc

SEQ ID NO: 605914 - RNA, 64 nt, Homo Sapiens
gaagagaggcccugugugcucagugccuaucaguuugaaauauauacacauauauauauuuuuu

SEQ ID NO: 605915 - RNA, 64 nt, Homo Sapiens
auguucuguggcaauccacaggucuagccaaauauugaaauaggaguuuaggguauaauuugcc

SEQ ID NO: 605916 - RNA, 64 nt, Homo Sapiens
cuucuaauuugaaucuauaguuacuuuguaccauuugaaauauauguauauauauauauauaau

SEQ ID NO: 605917 - RNA, 64 nt, Homo Sapiens
uuugaaauauauguauauauauauauauaauauuuugaaauauuaucuauucucuucaagaaau

SEQ ID NO: 605918 - RNA, 64 nt, Homo Sapiens
uuuuguaaugauuuuuauucucuguuacaaagacuugaaauacguauuaaaugcacguuaaugu

SEQ ID NO: 605919 - RNA, 64 nt, Homo Sapiens
uugcuuugcauuuuagguucagauuaugacuugauugaaauaaaugugccuauacauucauuug

SEQ ID NO: 605920 - RNA, 64 nt, Homo Sapiens
ugcauaacuugcaaugaaauuaaugagauauauauugaaauaaagaauuauguaaaagccauuc

SEQ ID NO: 605921 - RNA, 64 nt, Homo Sapiens
gcaaauguaggcugaucuccuucacaggauacacuugaaauauagaaguuauguuuuaaauauc

SEQ ID NO: 605922 - RNA, 64 nt, Homo Sapiens
ucuucagucacagugagagcaucuugcuuugugguugaaauagguaguguaugucagucuuugc

SEQ ID NO: 605923 - RNA, 64 nt, Homo Sapiens
caauuuucaaaccauauggccuagguaacuuuaauugaaauaauauagauuuaguugaauacua

SEQ ID NO: 605924 - RNA, 64 nt, Homo Sapiens
uguucagauaaaaaaaaccaugaaauuacuguguuugaaauauuuucuuaugguuuguaauauu

SEQ ID NO: 605925 - RNA, 64 nt, Homo Sapiens
acuccauuaugcacaguuugagauaaauaaauuuuugaaauauggacacugaaauuauucuuga

SEQ ID NO: 605926 - RNA, 64 nt, Homo Sapiens
aguuacuugcuauaaauagauuuuuauaaaaacauugaaauauuagaguaucugaagggaauug

SEQ ID NO: 605927 - RNA, 64 nt, Homo Sapiens
guugaaaguaaaaaaauaauaaacugguucuguguugaaauauauucauuagauguuuauuuag

SEQ ID NO: 605928 - RNA, 64 nt, Homo Sapiens
acuuuuuaaaaaguuauucaaaaaaacaaaguucuugaaauaaacguuuuuuugaaauaccagu

SEQ ID NO: 605929 - RNA, 64 nt, Homo Sapiens
aguaaaaaacaaaguucuugugacccacguuuuuuugaaauaccacugacuuuuuuuuguacuu

SEQ ID NO: 605930 - RNA, 64 nt, Homo Sapiens
uauuggaaauaaaaaugguugaaacaaacauguauugaaauacaguguggcacugggaaaagug

SEQ ID NO: 605931 - RNA, 64 nt, Homo Sapiens
uaauggcuugaaauucuagugcacgguacuguucuugaaauaccuaagccugacuggcaauaac

SEQ ID NO: 605932 - RNA, 64 nt, Homo Sapiens
augaauuuaugagaaacuuuuaaucuuuuugcuguugaaauaaacccaaucagagggauggagc

SEQ ID NO: 605933 - RNA, 64 nt, Homo Sapiens
cacuuagcacuuugguuccauucagaacagaugcuugaaauauguuacuguggcuuuaaacaua

SEQ ID NO: 605934 - RNA, 64 nt, Homo Sapiens
uaauagcacuggagauuuuccaaacaaguaauguuugaaauauacucaguguuugguuauuaug

SEQ ID NO: 605935 - RNA, 64 nt, Homo Sapiens
ugauaguaccugguugugaaagccacugugauguuugaaauaugguuccugcccuguugcuucc

SEQ ID NO: 605936 - RNA, 64 nt, Homo Sapiens
uucuuagguuuaaauguuauaccaaugcauguguuugaaauauccauuaagaugauuuaaaauu

SEQ ID NO: 605937 - RNA, 64 nt, Homo Sapiens
cauuuccacuucuguuuaucacaaaagacuguauuugaaauaugcauacggaaaauugaaauua

SEQ ID NO: 605938 - RNA, 64 nt, Homo Sapiens
uucaaggaagacucuacaagcuuuuguucacagcuugaaauagaugccucacaauucagacagu

SEQ ID NO: 605939 - RNA, 64 nt, Homo Sapiens
aaaauguaugugccaaguucuacuagaauuccauuugaaauagcaccuuccuuagguuucaugg

SEQ ID NO: 605940 - RNA, 64 nt, Homo Sapiens
uaaccaguauuuaaguaaauaugauuuuaguagauugaaauaaaagagaggagcuuuaaauaag

SEQ ID NO: 605941 - RNA, 64 nt, Homo Sapiens
guuaguugauaacauaaagcuuugauuacccugcuugaaauacauuguuuuuucuugcuuuuca

SEQ ID NO: 605942 - RNA, 64 nt, Homo Sapiens
aaacauggguaguggcgcauacauuuuguuauccuugaaauagccuaaguaauguuauugaaga

SEQ ID NO: 605943 - RNA, 64 nt, Homo Sapiens
augagguauuuagauaugaacaacugaauacauauugaaauagugugcuggcuuuuguaguuuu

SEQ ID NO: 605944 - RNA, 64 nt, Homo Sapiens
uuugagagcucuguacuuauagugacucuacuguuugaaauacuauuuuuuuaaaucaaguuuu

SEQ ID NO: 605945 - RNA, 64 nt, Homo Sapiens
aguaccacuaauaggguguaucucagaaacugaauugaaauaagggaaaauaggauuuucuguc

SEQ ID NO: 605946 - RNA, 64 nt, Homo Sapiens
ugaauaugguacagcucuucauuuacuuaggccuuugaaauaucuuucaauaaaguuuauaauu

SEQ ID NO: 605947 - RNA, 64 nt, Homo Sapiens
acccacuucucuuuaagcugccuggauugcaccuuugaaauaugucugccaaguuguuagaauc

SEQ ID NO: 605948 - RNA, 64 nt, Homo Sapiens
agaacuaaguuacugggaugacaauaauugcuauuugaaauauaugcuucuuuauuucuugcaa

SEQ ID NO: 605949 - RNA, 64 nt, Homo Sapiens
uagauuauuguaaccuuucauuacugccauguaauugaaauauauguuuaaaaugcuuuuguau

SEQ ID NO: 605950 - RNA, 64 nt, Homo Sapiens
ugauguguugccuggcaggauguauggcugccuuuugaaauauuuuagcaagcauuaaagcaaa

SEQ ID NO: 605951 - RNA, 64 nt, Homo Sapiens
auaggaaccuaugaaacuaucauuacucaugaccuugaaauaaagauucaacugcaucuccaaa

SEQ ID NO: 605952 - RNA, 64 nt, Homo Sapiens
uguauuucucugaauucaguaaauuuuaaaagauuugaaauaaucauuuuuaauaugacaaaac

SEQ ID NO: 605953 - RNA, 64 nt, Homo Sapiens
gaagaaaccguauuuuuccaugauaaaucacuguuugaaauauuugguucaugguaugaucgaa

SEQ ID NO: 605954 - RNA, 64 nt, Homo Sapiens
aaaagaaaaaguaacaaaaggaaauuauuuguuuuugaaauaccaguucaacuuuguggauuau

SEQ ID NO: 605955 - RNA, 64 nt, Homo Sapiens
aacggcacuacauaaaugugaaaaguuguugaucuugaaauaucucaggauagcacuuuuggca

SEQ ID NO: 605956 - RNA, 64 nt, Homo Sapiens
uuuuuuuaaaaagaggaucccaaacuguaaaagauugaaauaaucuuucucaggauuuuuuaaa

SEQ ID NO: 605957 - RNA, 64 nt, Homo Sapiens
uaccccaguaaaaccauucaguuggcugaaagguuugaaauacggggcuuaaaacugaaagcca

SEQ ID NO: 605958 - RNA, 64 nt, Homo Sapiens
cugcagugaauauaugaaucuuguugcacucuuuuugaaauaucuuauuuuuacuaaugccuua

SEQ ID NO: 605959 - RNA, 64 nt, Homo Sapiens
cuaugguaucuucaucauuuuuuggcuuaguauguugaaauaaaauuaguuguuuucuuauuuu

SEQ ID NO: 605960 - RNA, 64 nt, Homo Sapiens
acagauggaaagaaugaggccagagcaacuguuauugaaauauuuugaucucaaaacagcuuga

SEQ ID NO: 605961 - RNA, 64 nt, Homo Sapiens
aucaucuaccuucaggauugcugacagacagaauuugaaauaaaauaugcaaguuagcuaauac

SEQ ID NO: 605962 - RNA, 64 nt, Homo Sapiens
auaugcagccuuuccucuguacuuuucuccaugguugaaauaaaacagggugacugggaguuac

SEQ ID NO: 605963 - RNA, 64 nt, Homo Sapiens
aacuuaucaaugccauguaaaccaccugguuguauugaaauaguaacauuauuggguaucaauu

SEQ ID NO: 605964 - RNA, 64 nt, Homo Sapiens
uaugaaacauguuacuucauugaaaaauuaucccuugaaauagaaguugcauuauacuggguca

SEQ ID NO: 605965 - RNA, 64 nt, Homo Sapiens
agaaacauuagugccugccuggauccccuuaguuuugaaauauuugccauuguuguuuaaauac

SEQ ID NO: 605966 - RNA, 64 nt, Homo Sapiens
cuguugcuuuaguauuuauuacaauaaaaaggguuugaaauauagcuguucuuuaugcauaaaa

SEQ ID NO: 605967 - RNA, 64 nt, Homo Sapiens
gacuguuuaaugacuggauaucuuccuucaacuuuugaaauacaaaaccaguguuuuuuacuug

SEQ ID NO: 605968 - RNA, 64 nt, Homo Sapiens
cuuccaaucauugcuagaaaauuggcauauuccuuugaaauaaacuuaugaaauguuuucucuc

SEQ ID NO: 605969 - RNA, 64 nt, Homo Sapiens
uauuuuaaaagcacuuucuauuuuuaaaaguaacuugaaauaauauaguauaagaauccuauug

SEQ ID NO: 605970 - RNA, 64 nt, Homo Sapiens
agucugauacagaauuagaaaaaaaaaauucuuguugaaauauuuugaaaacaaauucccuacu

SEQ ID NO: 605971 - RNA, 64 nt, Homo Sapiens
uauuugguuaucaacugccccaguguagcccaguuugaaauauuuguuauuguuuacacacuug

SEQ ID NO: 605972 - RNA, 64 nt, Homo Sapiens
gcuuguaaucaggaaaguaacaaugaaaacugacuugaaauaauuagcacauuuauaagaaccg

SEQ ID NO: 605973 - RNA, 64 nt, Homo Sapiens
gccuguuucuguugugauguauucacuugucugguugaaauaaaaaguugauguuaauugaaga

SEQ ID NO: 605974 - RNA, 64 nt, Homo Sapiens
cugugauuaaauguccucauuagguuauauuaaguugaaauaguucauuggauuuauuuuaugc

SEQ ID NO: 605975 - RNA, 64 nt, Homo Sapiens
cuacuuggaaauguaucacagccaucucugggauuugaaauauccagacuuguagggaagaaaa

SEQ ID NO: 605976 - RNA, 64 nt, Homo Sapiens
caaaaaucuaagauuccaaaaagaacagcauucauugaaauaauauuccauugcauuggcuacu

SEQ ID NO: 605977 - RNA, 64 nt, Homo Sapiens
auugagcuaaucaaaauaauucagccaagucuauuugaaauagaaaacugucuauuuaauauag

SEQ ID NO: 605978 - RNA, 64 nt, Homo Sapiens
cagaauuaggaaaaaaaucuggagaacaauaugguugaaauagaaacaagagaaugcaccuagg

SEQ ID NO: 605979 - RNA, 64 nt, Homo Sapiens
guuauuuuucuauaucugaauacuuacucugacuuugaaauaguggaaaaaauauacuucuguu

SEQ ID NO: 605980 - RNA, 64 nt, Homo Sapiens
gauaguagguauguauuaugaaauaauaaugauguugaaauaaugggaagauguacuccguauc

SEQ ID NO: 605981 - RNA, 64 nt, Homo Sapiens
uguuaguccagcucuaaaaauuuaaagguuguaauugaaauacaagaaaagagccuucuuuuag

SEQ ID NO: 605982 - RNA, 64 nt, Homo Sapiens
gguuuuauuuucaguuuugcagcacagaacacuguugaaauauccauaucaacuugauuuuuuu

SEQ ID NO: 605983 - RNA, 64 nt, Homo Sapiens
agaugaccacuaauugauagaugucucagggagguugaaauaggaaguagaauagugguugcca

SEQ ID NO: 605984 - RNA, 64 nt, Homo Sapiens
augcacacaauuacuaaaguuucuaaaucaauuauugaaauagguauuugcucugauacaaaaa

SEQ ID NO: 605985 - RNA, 64 nt, Homo Sapiens
uuuauauaccugaguuuuagguguauauaaaucuuugaaauaucaggccuuucuuaggaauuau

SEQ ID NO: 605986 - RNA, 64 nt, Homo Sapiens
aauaguucuuuaaaaauauuuucauuguaacuauuugaaauagauuuuaagcacuaaaacuuac

SEQ ID NO: 605987 - RNA, 64 nt, Homo Sapiens
guuuaaccacagugaaugaauuuuagcuuugcuuuugaaauacauuguaagauuugacuugagg

SEQ ID NO: 605988 - RNA, 64 nt, Homo Sapiens
uguuuuuucauacuuugacccaaaauaugccauuuugaaauaaaauuuaagcuuugauacacuc

SEQ ID NO: 605989 - RNA, 64 nt, Homo Sapiens
caggccuuugcaaauggccuaaaugguguucccuuugaaauaacgcuugccacaaguauauaau

SEQ ID NO: 605990 - RNA, 64 nt, Homo Sapiens
uuguuuuauauuaaaaaaaaccuguuauguacaguugaaauaaauuuugcauuugcuagcccgu

SEQ ID NO: 605991 - RNA, 64 nt, Homo Sapiens
gaaauuuaaaauguuaaagaaaaacauuucuauauugaaauauauauaauuuauaaugaaaauu

SEQ ID NO: 605992 - RNA, 64 nt, Homo Sapiens
guacuguauuuuggauguguaaagcuucuauguauugaaauauuuuuuuacguuuuauuuauug

SEQ ID NO: 605993 - RNA, 64 nt, Homo Sapiens
aaaguuccaaaacaugacauuuuuaagaauaaauuugaaauagaguauaacugaaugcagagaa

SEQ ID NO: 605994 - RNA, 64 nt, Homo Sapiens
uauuguuuuuacuuuuugaaaaaaguguuaacucuugaaauaaaauauucugauaaaauaugua

SEQ ID NO: 605995 - RNA, 64 nt, Homo Sapiens
auuggggcaauuaccuuuugacaaauggcaaaucuugaaauagauauggucgcacuaauggaag

SEQ ID NO: 605996 - RNA, 64 nt, Homo Sapiens
uaaucuuucugaauaaauauuucauuuuuuaccuuugaaauacuccuaaucuucaaauguuagc

SEQ ID NO: 605997 - RNA, 64 nt, Homo Sapiens
aaaagauuuuuuuuuaauucauaagaagcaaucuuugaaauaaagcuuuaauaugagcuucaau

SEQ ID NO: 605998 - RNA, 64 nt, Homo Sapiens
uaauauucagccagcuuaaagugcauuuuuaaacuugaaauauacucuggacacucuauaugua

SEQ ID NO: 605999 - RNA, 64 nt, Homo Sapiens
auugcgccgcuccuggagaccugauaacuuaggcuugaaauaauugacuugucuaaaaggacaa

SEQ ID NO: 606000 - RNA, 64 nt, Homo Sapiens
aacagacucugcaguacauuaaucagguugagaauugaaauauuuucuugcaucaguauuggcu

SEQ ID NO: 606001 - RNA, 64 nt, Homo Sapiens
acuaguuuaucugaugauuuucuuacaugagcuuuugaaauaccuggaaaugcaguuuuaauau

SEQ ID NO: 606002 - RNA, 64 nt, Homo Sapiens
gucaaaccaaugacaaaaccgccuuccacaaaaguugaaauaagaaacaagaguauuacuuuuc

SEQ ID NO: 606003 - RNA, 64 nt, Homo Sapiens
uuuaaaauguaaauacaucaguucauguucuguauugaaauaggucugguugaucgaugucagu

SEQ ID NO: 606004 - RNA, 64 nt, Homo Sapiens
ucagcugccaauagcaaaugaaguuaugggugacuugaaauaccaaaaccugaggagugggcaa

SEQ ID NO: 606005 - RNA, 64 nt, Homo Sapiens
agcacagaucuucuuaaaaacugugaacuauguuuugaaauacucguuacuaaagcuguuuaua

SEQ ID NO: 606006 - RNA, 64 nt, Homo Sapiens
auuuuuaauuaugacuacugcaauuugacaccauuugaaauaaucaauucagagacacuaaaga

SEQ ID NO: 606007 - RNA, 64 nt, Homo Sapiens
gucauugcuuaaauauagucuugaagggcuuguuuugaaauauuguauauauuuuuucaaaugu

SEQ ID NO: 606008 - RNA, 64 nt, Homo Sapiens
uacauguuaugagaguucuggaggaaguaauauguugaaauaguaaaacauuuuaguuuuugag

SEQ ID NO: 606009 - RNA, 64 nt, Homo Sapiens
ggucacaaauauuguggacacauuaucuuauguuuugaaauaccugugaauuguuggcauugag

SEQ ID NO: 606010 - RNA, 64 nt, Homo Sapiens
gaaugaagaaacagucuuuaacagaaaaaagguauugaaauauuaaauggccaccaaguuuacu

SEQ ID NO: 606011 - RNA, 64 nt, Homo Sapiens
guucuguguuuucccugcccgaaccuaaugacuguugaaauaaaggugucccuguuguguggug

SEQ ID NO: 606012 - RNA, 64 nt, Homo Sapiens
ggauggucuaugaggcauacaggaauuucuauuuuugaaauaagcacacgggcggcauuuaaau

SEQ ID NO: 606013 - RNA, 64 nt, Homo Sapiens
accuggcaagaaaucuggaaauucuauaauuuuguugaaauauugaaaaaagaugaccugcauc

SEQ ID NO: 606014 - RNA, 64 nt, Homo Sapiens
auuuuauugucuuaguuuguauauuuucugugacuugaaauaaacuuugaacacaauuuuagua

SEQ ID NO: 606015 - RNA, 56 nt, Homo Sapiens
uaauaccagagucuuacuaaacuccuuugaaauacuagaaaguuuuguuuuggaug

SEQ ID NO: 606016 - RNA, 64 nt, Homo Sapiens
auauugcguagaaucuccacuaggaagucuuuauuugaaauaguugaaucagugaucuaguauu

SEQ ID NO: 606017 - RNA, 64 nt, Homo Sapiens
uaaauuaccuguaaauauucuggauaggaacuacuugaaauaguaauuuguuaaaagauaugac

SEQ ID NO: 606018 - RNA, 64 nt, Homo Sapiens
aauauaacuucuugauuuauaguuguuacauaauuugaaauaaaaauguauugauugugucccc

SEQ ID NO: 606019 - RNA, 64 nt, Homo Sapiens
guuggcaucacugaagguucaucugagacacuacuugaaauauguuacucuuugcauauucugc

SEQ ID NO: 606020 - RNA, 64 nt, Homo Sapiens
acauagauauaaagacuuagaugcaaacauaucauugaaauauuguaaguuuuuucauaguggu

SEQ ID NO: 606021 - RNA, 64 nt, Homo Sapiens
uaaguccacuaaauuauacauggaauaauaucuuuugaaauaacaauuucauuuagcagggaag

SEQ ID NO: 606022 - RNA, 64 nt, Homo Sapiens
aaguagcuugagcuuucuuuuuaacagucuuuuuuugaaauaaauacuugauaugaaacuccua

SEQ ID NO: 606023 - RNA, 64 nt, Homo Sapiens
uuguuuuguuugucaaauucuucuggugacuacuuugaaauaacacagguugaaugcuuugaau

SEQ ID NO: 606024 - RNA, 64 nt, Homo Sapiens
aaggaggucagaagaaaauuuccuacuuacauaguugaaauaucaccgugacugaaaacuagag

SEQ ID NO: 606025 - RNA, 64 nt, Homo Sapiens
auaacaaugucuucuugaaaaauuguugaaagcuuugaaauaaaaaaauaagucaggaggaugc

SEQ ID NO: 606026 - RNA, 64 nt, Homo Sapiens; identical to SEQ ID NO: 188672

SEQ ID NO: 606027 - RNA, 64 nt, Homo Sapiens; identical to SEQ ID NO: 188673

SEQ ID NO: 606028 - RNA, 64 nt, Homo Sapiens; identical to SEQ ID NO: 188674

SEQ ID NO: 606029 - RNA, 64 nt, Homo Sapiens; identical to SEQ ID NO: 188675

SEQ ID NO: 606030 - RNA, 64 nt, Homo Sapiens; identical to SEQ ID NO: 188676

SEQ ID NO: 606031 - RNA, 64 nt, Homo Sapiens; identical to SEQ ID NO: 188677

SEQ ID NO: 606032 - RNA, 64 nt, Homo Sapiens; identical to SEQ ID NO: 188678

SEQ ID NO: 606033 - RNA, 64 nt, Homo Sapiens; identical to SEQ ID NO: 188679

SEQ ID NO: 606034 - RNA, 58 nt, Homo Sapiens; identical to SEQ ID NO: 225639

SEQ ID NO: 606035 - RNA, 64 nt, Homo Sapiens; identical to SEQ ID NO: 225640

SEQ ID NO: 606036 - RNA, 64 nt, Homo Sapiens; identical to SEQ ID NO: 225641

SEQ ID NO: 606037 - RNA, 64 nt, Homo Sapiens; identical to SEQ ID NO: 225642

SEQ ID NO: 606038 - RNA, 64 nt, Homo Sapiens; identical to SEQ ID NO: 225643

SEQ ID NO: 606039 - RNA, 64 nt, Homo Sapiens; identical to SEQ ID NO: 225644

SEQ ID NO: 606040 - RNA, 64 nt, Homo Sapiens; identical to SEQ ID NO: 225645

SEQ ID NO: 606041 - RNA, 64 nt, Homo Sapiens; identical to SEQ ID NO: 225646

SEQ ID NO: 606042 - RNA, 64 nt, Homo Sapiens; identical to SEQ ID NO: 225647

SEQ ID NO: 606043 - RNA, 64 nt, Homo Sapiens; identical to SEQ ID NO: 225648

SEQ ID NO: 606044 - RNA, 64 nt, Homo Sapiens; identical to SEQ ID NO: 225649

SEQ ID NO: 606045 - RNA, 64 nt, Homo Sapiens; identical to SEQ ID NO: 225650

SEQ ID NO: 606046 - RNA, 64 nt, Homo Sapiens; identical to SEQ ID NO: 225651

SEQ ID NO: 606047 - RNA, 64 nt, Homo Sapiens; identical to SEQ ID NO: 225652

SEQ ID NO: 606048 - RNA, 64 nt, Homo Sapiens; identical to SEQ ID NO: 225653

SEQ ID NO: 606049 - RNA, 64 nt, Homo Sapiens; identical to SEQ ID NO: 536781

SEQ ID NO: 606050 - RNA, 64 nt, Homo Sapiens; identical to SEQ ID NO: 536782

SEQ ID NO: 606051 - RNA, 64 nt, Homo Sapiens; identical to SEQ ID NO: 536783

SEQ ID NO: 606052 - RNA, 64 nt, Homo Sapiens; identical to SEQ ID NO: 536784

SEQ ID NO: 606053 - RNA, 64 nt, Homo Sapiens; identical to SEQ ID NO: 536785

SEQ ID NO: 606054 - RNA, 64 nt, Homo Sapiens; identical to SEQ ID NO: 536786

SEQ ID NO: 606055 - RNA, 64 nt, Homo Sapiens; identical to SEQ ID NO: 536787

SEQ ID NO: 606056 - RNA, 64 nt, Homo Sapiens; identical to SEQ ID NO: 536788

SEQ ID NO: 606057 - RNA, 64 nt, Homo Sapiens; identical to SEQ ID NO: 536789

SEQ ID NO: 606058 - RNA, 64 nt, Homo Sapiens; identical to SEQ ID NO: 536790

SEQ ID NO: 606059 - RNA, 64 nt, Homo Sapiens; identical to SEQ ID NO: 536791

SEQ ID NO: 606060 - RNA, 64 nt, Homo Sapiens; identical to SEQ ID NO: 536792

SEQ ID NO: 606061 - RNA, 64 nt, Homo Sapiens; identical to SEQ ID NO: 536793

SEQ ID NO: 606062 - RNA, 64 nt, Homo Sapiens; identical to SEQ ID NO: 536794

SEQ ID NO: 606063 - RNA, 64 nt, Homo Sapiens; identical to SEQ ID NO: 536795

SEQ ID NO: 606064 - RNA, 64 nt, Homo Sapiens; identical to SEQ ID NO: 536796

SEQ ID NO: 606065 - RNA, 64 nt, Homo Sapiens; identical to SEQ ID NO: 536797

SEQ ID NO: 606066 - RNA, 64 nt, Homo Sapiens; identical to SEQ ID NO: 536798

SEQ ID NO: 606067 - RNA, 64 nt, Homo Sapiens; identical to SEQ ID NO: 536799

SEQ ID NO: 606068 - RNA, 64 nt, Homo Sapiens; identical to SEQ ID NO: 536800

SEQ ID NO: 606069 - RNA, 64 nt, Homo Sapiens; identical to SEQ ID NO: 536801

SEQ ID NO: 606070 - RNA, 64 nt, Homo Sapiens; identical to SEQ ID NO: 536802

SEQ ID NO: 606071 - RNA, 64 nt, Homo Sapiens; identical to SEQ ID NO: 536803

SEQ ID NO: 606072 - RNA, 64 nt, Homo Sapiens; identical to SEQ ID NO: 536804

SEQ ID NO: 606073 - RNA, 64 nt, Homo Sapiens; identical to SEQ ID NO: 536805

SEQ ID NO: 606074 - RNA, 64 nt, Homo Sapiens; identical to SEQ ID NO: 536806

SEQ ID NO: 606075 - RNA, 64 nt, Homo Sapiens; identical to SEQ ID NO: 536807

SEQ ID NO: 606076 - RNA, 64 nt, Homo Sapiens; identical to SEQ ID NO: 536808

SEQ ID NO: 606077 - RNA, 64 nt, Homo Sapiens; identical to SEQ ID NO: 536809

SEQ ID NO: 606078 - RNA, 64 nt, Homo Sapiens; identical to SEQ ID NO: 536810

SEQ ID NO: 606079 - RNA, 64 nt, Homo Sapiens; identical to SEQ ID NO: 536811

SEQ ID NO: 606080 - RNA, 64 nt, Homo Sapiens; identical to SEQ ID NO: 536812

SEQ ID NO: 606081 - RNA, 64 nt, Homo Sapiens; identical to SEQ ID NO: 536813

SEQ ID NO: 606082 - RNA, 64 nt, Homo Sapiens; identical to SEQ ID NO: 536814

SEQ ID NO: 606083 - RNA, 64 nt, Homo Sapiens; identical to SEQ ID NO: 536815

SEQ ID NO: 606084 - RNA, 64 nt, Homo Sapiens; identical to SEQ ID NO: 536816

SEQ ID NO: 606085 - RNA, 64 nt, Homo Sapiens; identical to SEQ ID NO: 536817

SEQ ID NO: 606086 - RNA, 64 nt, Homo Sapiens; identical to SEQ ID NO: 536818

SEQ ID NO: 606087 - RNA, 64 nt, Homo Sapiens; identical to SEQ ID NO: 536819

SEQ ID NO: 606088 - RNA, 64 nt, Homo Sapiens; identical to SEQ ID NO: 536820

SEQ ID NO: 606089 - RNA, 64 nt, Homo Sapiens; identical to SEQ ID NO: 536821

SEQ ID NO: 606090 - RNA, 64 nt, Homo Sapiens; identical to SEQ ID NO: 536822

SEQ ID NO: 606091 - RNA, 64 nt, Homo Sapiens; identical to SEQ ID NO: 536823

SEQ ID NO: 606092 - RNA, 64 nt, Homo Sapiens; identical to SEQ ID NO: 536824

SEQ ID NO: 606093 - RNA, 64 nt, Homo Sapiens; identical to SEQ ID NO: 536825

SEQ ID NO: 606094 - RNA, 64 nt, Homo Sapiens
ucuacuucuuccugugugggagcccauagcuguugucuaacagguaagaaaugaaauugaacua

SEQ ID NO: 606095 - RNA, 64 nt, Homo Sapiens
aagcagucuaacuagaauggauuuuacugaaccagucuaacauuuacuuuccaagaaacauuca

SEQ ID NO: 606096 - RNA, 64 nt, Homo Sapiens
uuuugcaaaccaagggagauuucuuagcaaaugagucuaacaaauaugacaucugucuuuggca

SEQ ID NO: 606097 - RNA, 64 nt, Homo Sapiens
caaggcuaaagucagaucuagaguucugccacaggucuaacaaucaagucuuuagauggaagga

SEQ ID NO: 606098 - RNA, 64 nt, Homo Sapiens
uauugauuuuuguauaaaaauguaacuucuacgugucuaacacguauuaaauauuuugaagcaa

SEQ ID NO: 606099 - RNA, 64 nt, Homo Sapiens
caugauaagagcaaggcuguguuuugaaaaugaugucuaacaacuuguucuuguucuauauuuu

SEQ ID NO: 606100 - RNA, 64 nt, Homo Sapiens
caauagucacaauacuuuuuaaaauauugacucugucuaacacaaaggucuuugugaccccagg

SEQ ID NO: 606101 - RNA, 64 nt, Homo Sapiens
cacaaaauuauuugaguacugugaaggauuauuugucuaacaguucauuccaaucagaccaggu

SEQ ID NO: 606102 - RNA, 64 nt, Homo Sapiens
aaagacauggaaaauuagcacccugauacucaaagucuaacaagcugacaccguugccauaaau

SEQ ID NO: 606103 - RNA, 64 nt, Homo Sapiens
caaaacugaggguugggaaauuuuuucuacaaaugucuaacaucaauccuacagcuuuguaauu

SEQ ID NO: 606104 - RNA, 64 nt, Homo Sapiens
aaggucaugugauuuguaauugauguauuaaaaugucuaacauaaaugaaacgugaccuccuau

SEQ ID NO: 606105 - RNA, 64 nt, Homo Sapiens
aucauggaaugagaaaaugagaaaggaaugaguugucuaacaucacagugggaucuguuuuuug

SEQ ID NO: 606106 - RNA, 64 nt, Homo Sapiens
ugaugucuuaacucuacuuagagaguguaugucugucuaacagaacaaaaagaugcucugugua

SEQ ID NO: 606107 - RNA, 64 nt, Homo Sapiens
aaggcacaauggguacuacagaauuaaaauguaggucuaacauaaugccaguuccacuuuaacu

SEQ ID NO: 606108 - RNA, 64 nt, Homo Sapiens
ggcaaaaccugaaccaccuucugcacuuaaagaagucuaacaguacaaauacacuaucuaucuu

SEQ ID NO: 606109 - RNA, 64 nt, Homo Sapiens
cacugguauagcacccuuauguuacuaaagccuagucuaacacugaacucauguucuugaugag

SEQ ID NO: 606110 - RNA, 64 nt, Homo Sapiens
acuaggugaacagaaauuaccugacuaauaauuugucuaacaucauauaucagaauuuuauugu

SEQ ID NO: 606111 - RNA, 64 nt, Homo Sapiens
aauagcuucaggaaaguuaaagguaucaucuuaggucuaacacucuagucuuugagaguuacgg

SEQ ID NO: 606112 - RNA, 64 nt, Homo Sapiens
ucuuuuuagucaucuuuuaucugagcuuuuuaaagucuaacaaaguguauuaguuuuugcuuuu

SEQ ID NO: 606113 - RNA, 64 nt, Homo Sapiens
uggcauugaagugucuuuaauaaaauauugaagugucuaacaaaaguguacauugaaaaccaug

SEQ ID NO: 606114 - RNA, 64 nt, Homo Sapiens
aacauaagguacuagcaguguguagggcagagaggucuaacaccguguaaaacuauauucucag

SEQ ID NO: 606115 - RNA, 64 nt, Homo Sapiens
uuuuggcuuagauucugagaaacugcaagucugagucuaacaguagguuuccagcugacuuggg

SEQ ID NO: 606116 - RNA, 64 nt, Homo Sapiens
ccuuuuuucuuguguauacagacauaauauuuacgucuaacagacguccaggcuuuucauuaag

SEQ ID NO: 606117 - RNA, 64 nt, Homo Sapiens
cccauuuucaugccccagcuaguugaaucagcuugucuaacaagccuccucuuuuuuccccccu

SEQ ID NO: 606118 - RNA, 64 nt, Homo Sapiens
acccguuguacagacggaggagcgagcaacacacgucuaacagccuagacaaucucgucagaug

SEQ ID NO: 606119 - RNA, 64 nt, Homo Sapiens
cugauguaaugaauauauaauuacaacaaaagaggucuaacacuauaguagaaaaguuuggggc

SEQ ID NO: 606120 - RNA, 64 nt, Homo Sapiens
gguucacucauugaauuuuuauugcuauuauuuagucuaacagcuacuaaaaguaaaacaucag

SEQ ID NO: 606121 - RNA, 64 nt, Homo Sapiens
uuuucauaguacaugaccugcauuccacaucucagucuaacaguuuaguagugauguaaagaga

SEQ ID NO: 606122 - RNA, 64 nt, Homo Sapiens
aagcuacuuuuagauuuggaaauugcuguuuacagucuaacaacauuaaaaugagagguagauu

SEQ ID NO: 606123 - RNA, 64 nt, Homo Sapiens
aaggagagagaaggaaaggagugagguauuucccgucuaacagaaagcagcguaucaacuccua

SEQ ID NO: 606124 - RNA, 64 nt, Homo Sapiens
aauuuuuccuugaucccacugaucuugacaucaagucuaacaaagaaaaaguuuugaguuuugu

SEQ ID NO: 606125 - RNA, 64 nt, Homo Sapiens
agaacugugucggagcacucauuuaaaauaauuugucuaacaguuacauauauauaagugccau

SEQ ID NO: 606126 - RNA, 64 nt, Homo Sapiens
gcuguuaacgaaugauaaacaaagcagagccacugucuaacacauuguuuaucacguuuugcac

SEQ ID NO: 606127 - RNA, 64 nt, Homo Sapiens
aaguuauugugauauccuucuagaucauacacaagucuaacaguuaauuaguuaacaguuuuua

SEQ ID NO: 606128 - RNA, 64 nt, Homo Sapiens
ccaagguaugaagcagaugagggaccagcacucagucuaacauguaaacaucauacguaauaaa

SEQ ID NO: 606129 - RNA, 64 nt, Homo Sapiens
gggauucacugcaucauagcuaugccuguauggagucuaacauaugaccaauaccaacccauaa

SEQ ID NO: 606130 - RNA, 64 nt, Homo Sapiens
uguugcauuuuaaguaugagaacacauucuaauugucuaacauuacacccacccagccuguuug

SEQ ID NO: 606131 - RNA, 64 nt, Homo Sapiens
uuuuuucuaggauccauuccguuugaccguacaugucuaacauuuauuuuuaauaaaucauugu

SEQ ID NO: 606132 - RNA, 64 nt, Homo Sapiens
agauaggagagagucacucagcauagacuuacaagucuaacaggccuuuuaggaaaaguagaaa

SEQ ID NO: 606133 - RNA, 64 nt, Homo Sapiens
agggguaugggaaggauagacucauaauuaaaaugucuaacaugucucuguugagaaauuuauu

SEQ ID NO: 606134 - RNA, 64 nt, Homo Sapiens
cuuaugaaagugcuugagcuuuuaaccagguacugucuaacaacagucaucuuuugguucuguu

SEQ ID NO: 606135 - RNA, 64 nt, Homo Sapiens
cauuuuuuuaaagauuuuccacagcuacuugagugucuaacauacaguaacaucuaacucagcu

SEQ ID NO: 606136 - RNA, 64 nt, Homo Sapiens
gcauccaucuuccuccuucuccaccugcaggaaugucuaacaaaagaaauaacuacccugucuc

SEQ ID NO: 606137 - RNA, 64 nt, Homo Sapiens
ucauuaggucacucgggaaguguuauaggcaucagucuaacaagcaugcagccacuuuggguuu

SEQ ID NO: 606138 - RNA, 64 nt, Homo Sapiens
uccaaaagcuggagugugagguuguuauuauuaagucuaacaagccuuaaaaggauuggcuugu

SEQ ID NO: 606139 - RNA, 64 nt, Homo Sapiens
ucuguaugcuagagaggggugaggaauggauacugucuaacagucucugauuucaacacuaaca

SEQ ID NO: 606140 - RNA, 64 nt, Homo Sapiens
ccauucagugcagcauauacaauaauguaauuuagucuaacacaguugacccuauuuuuugaca

SEQ ID NO: 606141 - RNA, 64 nt, Homo Sapiens
aaaugauguguaugcagaguuuuaaaauaaauucgucuaacaauaacuuccuuugguaguuuug

SEQ ID NO: 606142 - RNA, 64 nt, Homo Sapiens
uuuugccaaacagauauauauuuuguacaaaagagucuaacauuuuuuuuuuuuuuugcuuugu

SEQ ID NO: 606143 - RNA, 64 nt, Homo Sapiens
caaaucuaggaauauuaugcggcccccuguccuggucuaacauaaauccgacuggagaugauuu

SEQ ID NO: 606144 - RNA, 64 nt, Homo Sapiens
aagggcuaccucugaguaccgaacauccuuaaaugucuaacaacgagguuccucuuggagucua

SEQ ID NO: 606145 - RNA, 64 nt, Homo Sapiens
uuuacugcauuuuucaauccagauucuugaaauugucuaacauguggguacugugucaucacaa

SEQ ID NO: 606146 - RNA, 64 nt, Homo Sapiens
ccccuugcucauuguauguugaugaguugauuaagucuaacagauucaucaagacuccauugcu

SEQ ID NO: 606147 - RNA, 64 nt, Homo Sapiens
uuguagagucugaggguuagaaggaagucauugugucuaacauaacaacagagcaguuuguguc

SEQ ID NO: 606148 - RNA, 64 nt, Homo Sapiens
aguaaacuucaguugcuuaaucaaacuaaugauagucuaacaacugagcaagauccucaucuga

SEQ ID NO: 606149 - RNA, 64 nt, Homo Sapiens
uugccugcuguauuuauaguuauguucuaggucagucuaacagugagacugaaauuuaguacac

SEQ ID NO: 606150 - RNA, 64 nt, Homo Sapiens
uuccaaauucucacagaagauggaaauggacacagucuaacaaagaacuacuagaaaauugugc

SEQ ID NO: 606151 - RNA, 64 nt, Homo Sapiens
acugauaauaggaaguaaaaaucuuguuuuuuaagucuaacaaccagcuuugggacuagucugu

SEQ ID NO: 606152 - RNA, 64 nt, Homo Sapiens
aaaucauaaacaguaguuuucuguuuaccuguuggucuaacagcugacacugacuuauaguuca

SEQ ID NO: 606153 - RNA, 64 nt, Homo Sapiens
guuuuauagacaccccuccacagcaaaauuauaggucuaacaauuaccaccucccaauaaucaa

SEQ ID NO: 606154 - RNA, 64 nt, Homo Sapiens
ccacuuucugcuuucccgaaaauuuaaucuuugagucuaacacaaccugugcaauaugaggcca

SEQ ID NO: 606155 - RNA, 64 nt, Homo Sapiens
uaccuaaaaucaauaccuaaauacagaagccuuggucuaacacgggacuuuuaguuugcgaagg

SEQ ID NO: 606156 - RNA, 64 nt, Homo Sapiens
gguccagauuucuggugguuucugcccugcagaugucuaacacauaagccaggacauucugcug

SEQ ID NO: 606157 - RNA, 64 nt, Homo Sapiens
cucucguggucaugccaagaacacaggagggugagucuaacaagcacaccucaagccucugcuu

SEQ ID NO: 606158 - RNA, 64 nt, Homo Sapiens
uauuaagauuuuaucuuaaugaugaguagccaaggucuaacauagggccucuccucaaggagag

SEQ ID NO: 606159 - RNA, 64 nt, Homo Sapiens
aaagugcccaucuggugcucaagagagccugggggucuaacagggagcccggcugccucaccug

SEQ ID NO: 606160 - RNA, 64 nt, Homo Sapiens
auuccugggcugcaugauaucacaguccuucccagucuaacacugagacagugacuguuccugc

SEQ ID NO: 606161 - RNA, 64 nt, Homo Sapiens
acgucccuuuucuuuuugggccuguauugaguaagucuaacauuuuuguuuggcaaauguuacu

SEQ ID NO: 606162 - RNA, 64 nt, Homo Sapiens
uggugacaacggaggaaauauccaacagaaauacgucuaacagggaaauugggaucauaguuua

SEQ ID NO: 606163 - RNA, 64 nt, Homo Sapiens
cccgaggucagccaggcugccgggggugaaucuugucuaacauuuaaaucagagagcaaggcau

SEQ ID NO: 606164 - RNA, 64 nt, Homo Sapiens
uguuagcuccagcugguugugggagcggcaugcugucuaacagccuggguguaaggcaguagcg

SEQ ID NO: 606165 - RNA, 64 nt, Homo Sapiens
ccuuucuauucucucccuaccuaucaauguaauugucuaacacuucuauuuacuguuuaucaau

SEQ ID NO: 606166 - RNA, 64 nt, Homo Sapiens
ugaaguagaggugcaguuaaguggggggccacuagucuaacagacggucacaaccagugccaug

SEQ ID NO: 606167 - RNA, 64 nt, Homo Sapiens
uuuaaauuguacaaucucuguauuauagcuauuugucuaacauuaccccacauguaauaaauaa

SEQ ID NO: 606168 - RNA, 64 nt, Homo Sapiens
aacaacaaaacaaaacaauuccagucuuggaguagucuaacagaagaaaauguaaaauuauuug

SEQ ID NO: 606169 - RNA, 64 nt, Homo Sapiens
ccagaacucauuuugugccaaaagagaagcaucagucuaacaagguuuguucaaaaccugcagc

SEQ ID NO: 606170 - RNA, 64 nt, Homo Sapiens
aauuguacguaaugauacauaagggaugguacaagucuaacacauucaaaauccuaguaugcua

SEQ ID NO: 606171 - RNA, 64 nt, Homo Sapiens
gucuauuuaucuuuuauuuuuuuaagucaguauggucuaacacuggcauguucaaagccacauu

SEQ ID NO: 606172 - RNA, 64 nt, Homo Sapiens
aucuagaaaucagcuuuuaaaaauauugucugaagucuaacaaaaguuuucaccucuaaugugu

SEQ ID NO: 606173 - RNA, 64 nt, Homo Sapiens
auaaccugaccuuuucuuugcauuuguuuugaaugucuaacaccauuagcuuuugugaucuggu

SEQ ID NO: 606174 - RNA, 64 nt, Homo Sapiens
ugaaagucaaagucaguggcuuugcuaaugaucagucuaacagcggcacuuggcccagaaguug

SEQ ID NO: 606175 - RNA, 64 nt, Homo Sapiens
uguagggugcugccacuccacagcagggaugggggucuaacagcgaucccugugggaccuuuga

SEQ ID NO: 606176 - RNA, 64 nt, Homo Sapiens
auauauauccuaggguaugauacuacugugacgggucuaacagcccccggcuacucuuguucug

SEQ ID NO: 606177 - RNA, 64 nt, Homo Sapiens
ggcuuagcuacagugaaguuaggaauuuguaagagucuaacauauugaacuaauucuacuauuu

SEQ ID NO: 606178 - RNA, 64 nt, Homo Sapiens
aagaauuuuuggaucaagcggaaagaguuuaagugucuaacaaacuuaaagcuacuguaguacc

SEQ ID NO: 606179 - RNA, 64 nt, Homo Sapiens
gugucuaccuggccaguggagugguccaugcuaagucuaacacuccugggagcucaggaggcuu

SEQ ID NO: 606180 - RNA, 64 nt, Homo Sapiens
gcaagccauuuacagaaacccacucggcaccccagucuaacaccacaacuaauuucacccaagg

SEQ ID NO: 606181 - RNA, 64 nt, Homo Sapiens
uggucccaauuuauuaauacuguuuucuacuugagucuaacauaucucugaggaaaacaaaacc

SEQ ID NO: 606182 - RNA, 64 nt, Homo Sapiens
aucacaaauagguucaugguuguuagaaacuucugucuaacaccuuucaaucuuacaaagcaac

SEQ ID NO: 606183 - RNA, 64 nt, Homo Sapiens
cacauggcgugagcugaaacaauguagaguugaugucuaacaccagacuuaaaggacugcaaua

SEQ ID NO: 606184 - RNA, 64 nt, Homo Sapiens
ggccggaggcgacucuuccucugucugccccaaugucuaacaaagaacccugaagcgcaccgca

SEQ ID NO: 606185 - RNA, 64 nt, Homo Sapiens
uuucaaggauagaaaauacuccccucaggaauuugucuaacacauuauugaaugugugggguuu

SEQ ID NO: 606186 - RNA, 64 nt, Homo Sapiens
gcggaucacaaggucaggaguucgagaccauccugucuaacacggugaaaccccaucucuacua

SEQ ID NO: 606187 - RNA, 64 nt, Homo Sapiens
gagagaaaaguagaaaaccagagugcacguaggugucuaacacagaggagaguaggaacagggc

SEQ ID NO: 606188 - RNA, 64 nt, Homo Sapiens
ugguccccuuugucccuagcgacugugugccugggucuaacaugcuggaaacugggcacagaag

SEQ ID NO: 606189 - RNA, 64 nt, Homo Sapiens
uccaucagagcugauagccuguuaauaagcacuggucuaacacagccaacccuccuccacagcg

SEQ ID NO: 606190 - RNA, 64 nt, Homo Sapiens
gaugccgaugucagcacagcuccuacgagaaucagucuaacagaaggcaaaaaaaaaaagcuuc

SEQ ID NO: 606191 - RNA, 64 nt, Homo Sapiens
cguuucauucaaugucuccauaaccucuaagacugucuaacacgggugaaccugaagcaugcuu

SEQ ID NO: 606192 - RNA, 64 nt, Homo Sapiens
ucuccuuucgucucucagaacaucucccacugcggucuaacaaaagaaacucucacccucacuc

SEQ ID NO: 606193 - RNA, 64 nt, Homo Sapiens
caugccggcagcagcuagcaaagccagaaagcaagucuaacaggaucuaagaugaccaucagga

SEQ ID NO: 606194 - RNA, 64 nt, Homo Sapiens
uuuacuguauuauacuuuuccuuuuuuauauaaugucuaacaaaaaauacagcugcaacauuuu

SEQ ID NO: 606195 - RNA, 64 nt, Homo Sapiens
gcauccucccaacugggcauucggacaagaccccgucuaacacuauaacccccuaaggaaucca

SEQ ID NO: 606196 - RNA, 64 nt, Homo Sapiens
ggaccaacagaagguaguauaagaaagguauguugucuaacaggauuugacauuuuacauuuca

SEQ ID NO: 606197 - RNA, 64 nt, Homo Sapiens
acuugaauucaaagcaugucaaagcuguucccaugucuaacagggugaaucauauguuguagga

SEQ ID NO: 606198 - RNA, 64 nt, Homo Sapiens
gaacacuugcucaacaaccuugcuguuggcccaagucuaacacauucuuuaugacugugagcau

SEQ ID NO: 606199 - RNA, 64 nt, Homo Sapiens
aaguguucuuucuuuuucuuaaggugacuaaauugucuaacauguaauucugucaaaaccuaug

SEQ ID NO: 606200 - RNA, 64 nt, Homo Sapiens
aauuuauccuauaagaugacaauguuuacucaaagucuaacauauucaaugcaaguaagacuuu

SEQ ID NO: 606201 - RNA, 64 nt, Homo Sapiens
aaaauaacagcaauaaaccuaaccuuuuaacagggucuaacaugagaguuggagucaaagccau

SEQ ID NO: 606202 - RNA, 64 nt, Homo Sapiens
uaagucaugguuaauaacaaaugaauccagacuugucuaacagauuuuccaucaacaaauauug

SEQ ID NO: 606203 - RNA, 64 nt, Homo Sapiens
uauggccuuguuggagggggccaggcucuagaacgucuaacacaguggagaaccgaaacccccc

SEQ ID NO: 606204 - RNA, 64 nt, Homo Sapiens
uauaaaacagauauauaauaaauagccuagcuuagucuaacaucucuuuagaauuacacagcua

SEQ ID NO: 606205 - RNA, 64 nt, Homo Sapiens
guuauccuauaucauuuucagagguugaucugaggucuaacauuauuuacucaguauuuuucuu

SEQ ID NO: 606206 - RNA, 64 nt, Homo Sapiens
ugcccaguuuccagucgggguucaaaaucauuuagucuaacaacgcccuugauuggaagggcuu

SEQ ID NO: 606207 - RNA, 64 nt, Homo Sapiens
ccacaugauuacaugaacuguccucuagaaggcugucuaacauaagggacuucauauaccugau

SEQ ID NO: 606208 - RNA, 64 nt, Homo Sapiens; identical to SEQ ID NO: 382199

SEQ ID NO: 606209 - RNA, 64 nt, Homo Sapiens; identical to SEQ ID NO: 382200

SEQ ID NO: 606210 - RNA, 64 nt, Homo Sapiens; identical to SEQ ID NO: 382201

SEQ ID NO: 606211 - RNA, 57 nt, Homo Sapiens; identical to SEQ ID NO: 382202

SEQ ID NO: 606212 - RNA, 64 nt, Homo Sapiens; identical to SEQ ID NO: 382203

SEQ ID NO: 606213 - RNA, 64 nt, Homo Sapiens; identical to SEQ ID NO: 382204

SEQ ID NO: 606214 - RNA, 64 nt, Homo Sapiens; identical to SEQ ID NO: 382205

SEQ ID NO: 606215 - RNA, 64 nt, Homo Sapiens; identical to SEQ ID NO: 382206

SEQ ID NO: 606216 - RNA, 64 nt, Homo Sapiens; identical to SEQ ID NO: 382207

SEQ ID NO: 606217 - RNA, 64 nt, Homo Sapiens; identical to SEQ ID NO: 382208

SEQ ID NO: 606218 - RNA, 64 nt, Homo Sapiens; identical to SEQ ID NO: 382209

SEQ ID NO: 606219 - RNA, 64 nt, Homo Sapiens; identical to SEQ ID NO: 382210

SEQ ID NO: 606220 - RNA, 64 nt, Homo Sapiens; identical to SEQ ID NO: 382211

SEQ ID NO: 606221 - RNA, 64 nt, Homo Sapiens; identical to SEQ ID NO: 382212

SEQ ID NO: 606222 - RNA, 64 nt, Homo Sapiens; identical to SEQ ID NO: 382213

SEQ ID NO: 606223 - RNA, 64 nt, Homo Sapiens; identical to SEQ ID NO: 382214

SEQ ID NO: 606224 - RNA, 64 nt, Homo Sapiens; identical to SEQ ID NO: 382215

SEQ ID NO: 606225 - RNA, 64 nt, Homo Sapiens; identical to SEQ ID NO: 382216

SEQ ID NO: 606226 - RNA, 64 nt, Homo Sapiens; identical to SEQ ID NO: 382217

SEQ ID NO: 606227 - RNA, 64 nt, Homo Sapiens; identical to SEQ ID NO: 382218

SEQ ID NO: 606228 - RNA, 64 nt, Homo Sapiens; identical to SEQ ID NO: 382219

SEQ ID NO: 606229 - RNA, 64 nt, Homo Sapiens; identical to SEQ ID NO: 382220

SEQ ID NO: 606230 - RNA, 64 nt, Homo Sapiens; identical to SEQ ID NO: 382221

SEQ ID NO: 606231 - RNA, 64 nt, Homo Sapiens; identical to SEQ ID NO: 382222

SEQ ID NO: 606232 - RNA, 63 nt, Homo Sapiens; identical to SEQ ID NO: 382223

SEQ ID NO: 606233 - RNA, 64 nt, Homo Sapiens; identical to SEQ ID NO: 382224

SEQ ID NO: 606234 - RNA, 64 nt, Homo Sapiens; identical to SEQ ID NO: 382225

SEQ ID NO: 606235 - RNA, 64 nt, Homo Sapiens; identical to SEQ ID NO: 382226

SEQ ID NO: 606236 - RNA, 64 nt, Homo Sapiens; identical to SEQ ID NO: 382227

SEQ ID NO: 606237 - RNA, 64 nt, Homo Sapiens; identical to SEQ ID NO: 382228

SEQ ID NO: 606238 - RNA, 64 nt, Homo Sapiens; identical to SEQ ID NO: 382229

SEQ ID NO: 606239 - RNA, 64 nt, Homo Sapiens; identical to SEQ ID NO: 382230

SEQ ID NO: 606240 - RNA, 64 nt, Homo Sapiens; identical to SEQ ID NO: 382231

SEQ ID NO: 606241 - RNA, 64 nt, Homo Sapiens; identical to SEQ ID NO: 382232

SEQ ID NO: 606242 - RNA, 64 nt, Homo Sapiens; identical to SEQ ID NO: 382233

SEQ ID NO: 606243 - RNA, 64 nt, Homo Sapiens; identical to SEQ ID NO: 382234

SEQ ID NO: 606244 - RNA, 64 nt, Homo Sapiens; identical to SEQ ID NO: 382235

SEQ ID NO: 606245 - RNA, 64 nt, Homo Sapiens; identical to SEQ ID NO: 382236

SEQ ID NO: 606246 - RNA, 64 nt, Homo Sapiens; identical to SEQ ID NO: 382237

SEQ ID NO: 606247 - RNA, 64 nt, Homo Sapiens; identical to SEQ ID NO: 259689

SEQ ID NO: 606248 - RNA, 64 nt, Homo Sapiens; identical to SEQ ID NO: 259690

SEQ ID NO: 606249 - RNA, 64 nt, Homo Sapiens; identical to SEQ ID NO: 259691

SEQ ID NO: 606250 - RNA, 64 nt, Homo Sapiens; identical to SEQ ID NO: 259692

SEQ ID NO: 606251 - RNA, 64 nt, Homo Sapiens; identical to SEQ ID NO: 259693

SEQ ID NO: 606252 - RNA, 64 nt, Homo Sapiens; identical to SEQ ID NO: 259694

SEQ ID NO: 606253 - RNA, 64 nt, Homo Sapiens; identical to SEQ ID NO: 259695

SEQ ID NO: 606254 - RNA, 64 nt, Homo Sapiens; identical to SEQ ID NO: 259696

SEQ ID NO: 606255 - RNA, 64 nt, Homo Sapiens; identical to SEQ ID NO: 193272

SEQ ID NO: 606256 - RNA, 64 nt, Homo Sapiens; identical to SEQ ID NO: 193273

SEQ ID NO: 606257 - RNA, 64 nt, Homo Sapiens; identical to SEQ ID NO: 193274

SEQ ID NO: 606258 - RNA, 64 nt, Homo Sapiens; identical to SEQ ID NO: 193275

SEQ ID NO: 606259 - RNA, 64 nt, Homo Sapiens; identical to SEQ ID NO: 193276

SEQ ID NO: 606260 - RNA, 64 nt, Homo Sapiens; identical to SEQ ID NO: 193277

SEQ ID NO: 606261 - RNA, 64 nt, Homo Sapiens; identical to SEQ ID NO: 193278

SEQ ID NO: 606262 - RNA, 64 nt, Homo Sapiens; identical to SEQ ID NO: 193279

SEQ ID NO: 606263 - RNA, 64 nt, Homo Sapiens; identical to SEQ ID NO: 193280

SEQ ID NO: 606264 - RNA, 64 nt, Homo Sapiens; identical to SEQ ID NO: 193281

SEQ ID NO: 606265 - RNA, 64 nt, Homo Sapiens; identical to SEQ ID NO: 193282

SEQ ID NO: 606266 - RNA, 64 nt, Homo Sapiens; identical to SEQ ID NO: 193283

SEQ ID NO: 606267 - RNA, 64 nt, Homo Sapiens; identical to SEQ ID NO: 87097

SEQ ID NO: 606268 - RNA, 64 nt, Homo Sapiens; identical to SEQ ID NO: 87098

SEQ ID NO: 606269 - RNA, 64 nt, Homo Sapiens; identical to SEQ ID NO: 87099

SEQ ID NO: 606270 - RNA, 64 nt, Homo Sapiens; identical to SEQ ID NO: 87100

SEQ ID NO: 606271 - RNA, 64 nt, Homo Sapiens; identical to SEQ ID NO: 87101

SEQ ID NO: 606272 - RNA, 64 nt, Homo Sapiens; identical to SEQ ID NO: 87102

SEQ ID NO: 606273 - RNA, 64 nt, Homo Sapiens; identical to SEQ ID NO: 87103

SEQ ID NO: 606274 - RNA, 64 nt, Homo Sapiens; identical to SEQ ID NO: 87104

SEQ ID NO: 606275 - RNA, 64 nt, Homo Sapiens; identical to SEQ ID NO: 87105

SEQ ID NO: 606276 - RNA, 64 nt, Homo Sapiens; identical to SEQ ID NO: 87106

SEQ ID NO: 606277 - RNA, 64 nt, Homo Sapiens; identical to SEQ ID NO: 87107

SEQ ID NO: 606278 - RNA, 64 nt, Homo Sapiens; identical to SEQ ID NO: 87108

SEQ ID NO: 606279 - RNA, 64 nt, Homo Sapiens; identical to SEQ ID NO: 87109

SEQ ID NO: 606280 - RNA, 64 nt, Homo Sapiens; identical to SEQ ID NO: 87110

SEQ ID NO: 606281 - RNA, 64 nt, Homo Sapiens; identical to SEQ ID NO: 87111

SEQ ID NO: 606282 - RNA, 64 nt, Homo Sapiens; identical to SEQ ID NO: 87112

SEQ ID NO: 606283 - RNA, 64 nt, Homo Sapiens; identical to SEQ ID NO: 87113

SEQ ID NO: 606284 - RNA, 64 nt, Homo Sapiens; identical to SEQ ID NO: 87114

SEQ ID NO: 606285 - RNA, 64 nt, Homo Sapiens; identical to SEQ ID NO: 87115

SEQ ID NO: 606286 - RNA, 64 nt, Homo Sapiens; identical to SEQ ID NO: 87116

SEQ ID NO: 606287 - RNA, 64 nt, Homo Sapiens; identical to SEQ ID NO: 87117

SEQ ID NO: 606288 - RNA, 64 nt, Homo Sapiens; identical to SEQ ID NO: 87118

SEQ ID NO: 606289 - RNA, 64 nt, Homo Sapiens; identical to SEQ ID NO: 87119

SEQ ID NO: 606290 - RNA, 64 nt, Homo Sapiens; identical to SEQ ID NO: 87120

SEQ ID NO: 606291 - RNA, 64 nt, Homo Sapiens; identical to SEQ ID NO: 87121

SEQ ID NO: 606292 - RNA, 64 nt, Homo Sapiens; identical to SEQ ID NO: 87122

SEQ ID NO: 606293 - RNA, 64 nt, Homo Sapiens; identical to SEQ ID NO: 87123

SEQ ID NO: 606294 - RNA, 64 nt, Homo Sapiens; identical to SEQ ID NO: 87124

SEQ ID NO: 606295 - RNA, 64 nt, Homo Sapiens; identical to SEQ ID NO: 87125

SEQ ID NO: 606296 - RNA, 64 nt, Homo Sapiens; identical to SEQ ID NO: 87126

SEQ ID NO: 606297 - RNA, 64 nt, Homo Sapiens; identical to SEQ ID NO: 87127

SEQ ID NO: 606298 - RNA, 64 nt, Homo Sapiens; identical to SEQ ID NO: 87128

SEQ ID NO: 606299 - RNA, 64 nt, Homo Sapiens; identical to SEQ ID NO: 87129

SEQ ID NO: 606300 - RNA, 64 nt, Homo Sapiens; identical to SEQ ID NO: 87130

SEQ ID NO: 606301 - RNA, 64 nt, Homo Sapiens; identical to SEQ ID NO: 87131

SEQ ID NO: 606302 - RNA, 64 nt, Homo Sapiens; identical to SEQ ID NO: 87132

SEQ ID NO: 606303 - RNA, 64 nt, Homo Sapiens; identical to SEQ ID NO: 87133

SEQ ID NO: 606304 - RNA, 64 nt, Homo Sapiens; identical to SEQ ID NO: 87134

SEQ ID NO: 606305 - RNA, 64 nt, Homo Sapiens; identical to SEQ ID NO: 87135

SEQ ID NO: 606306 - RNA, 64 nt, Homo Sapiens; identical to SEQ ID NO: 87136

SEQ ID NO: 606307 - RNA, 64 nt, Homo Sapiens; identical to SEQ ID NO: 245916

SEQ ID NO: 606308 - RNA, 64 nt, Homo Sapiens; identical to SEQ ID NO: 245917

SEQ ID NO: 606309 - RNA, 64 nt, Homo Sapiens; identical to SEQ ID NO: 245918

SEQ ID NO: 606310 - RNA, 64 nt, Homo Sapiens; identical to SEQ ID NO: 245919

SEQ ID NO: 606311 - RNA, 64 nt, Homo Sapiens; identical to SEQ ID NO: 245920

SEQ ID NO: 606312 - RNA, 64 nt, Homo Sapiens; identical to SEQ ID NO: 245921

SEQ ID NO: 606313 - RNA, 64 nt, Homo Sapiens; identical to SEQ ID NO: 245922

SEQ ID NO: 606314 - RNA, 64 nt, Homo Sapiens; identical to SEQ ID NO: 245923

SEQ ID NO: 606315 - RNA, 64 nt, Homo Sapiens; identical to SEQ ID NO: 245924

SEQ ID NO: 606316 - RNA, 64 nt, Homo Sapiens; identical to SEQ ID NO: 245925

SEQ ID NO: 606317 - RNA, 64 nt, Homo Sapiens; identical to SEQ ID NO: 245926

SEQ ID NO: 606318 - RNA, 64 nt, Homo Sapiens; identical to SEQ ID NO: 245927

SEQ ID NO: 606319 - RNA, 64 nt, Homo Sapiens; identical to SEQ ID NO: 245928

SEQ ID NO: 606320 - RNA, 64 nt, Homo Sapiens; identical to SEQ ID NO: 245929

SEQ ID NO: 606321 - RNA, 64 nt, Homo Sapiens; identical to SEQ ID NO: 245930

SEQ ID NO: 606322 - RNA, 64 nt, Homo Sapiens; identical to SEQ ID NO: 245931

SEQ ID NO: 606323 - RNA, 64 nt, Homo Sapiens; identical to SEQ ID NO: 245932

SEQ ID NO: 606324 - RNA, 64 nt, Homo Sapiens; identical to SEQ ID NO: 245933

SEQ ID NO: 606325 - RNA, 64 nt, Homo Sapiens; identical to SEQ ID NO: 245934

SEQ ID NO: 606326 - RNA, 64 nt, Homo Sapiens; identical to SEQ ID NO: 245935

SEQ ID NO: 606327 - RNA, 64 nt, Homo Sapiens; identical to SEQ ID NO: 245936

SEQ ID NO: 606328 - RNA, 64 nt, Homo Sapiens; identical to SEQ ID NO: 145091

SEQ ID NO: 606329 - RNA, 64 nt, Homo Sapiens; identical to SEQ ID NO: 145092

SEQ ID NO: 606330 - RNA, 64 nt, Homo Sapiens; identical to SEQ ID NO: 145093

SEQ ID NO: 606331 - RNA, 64 nt, Homo Sapiens; identical to SEQ ID NO: 145094

SEQ ID NO: 606332 - RNA, 64 nt, Homo Sapiens; identical to SEQ ID NO: 145095

SEQ ID NO: 606333 - RNA, 64 nt, Homo Sapiens; identical to SEQ ID NO: 145096

SEQ ID NO: 606334 - RNA, 64 nt, Homo Sapiens; identical to SEQ ID NO: 145097

SEQ ID NO: 606335 - RNA, 64 nt, Homo Sapiens; identical to SEQ ID NO: 145098

SEQ ID NO: 606336 - RNA, 64 nt, Homo Sapiens; identical to SEQ ID NO: 145099

SEQ ID NO: 606337 - RNA, 64 nt, Homo Sapiens; identical to SEQ ID NO: 145100

SEQ ID NO: 606338 - RNA, 64 nt, Homo Sapiens; identical to SEQ ID NO: 145101

SEQ ID NO: 606339 - RNA, 64 nt, Homo Sapiens; identical to SEQ ID NO: 145102

SEQ ID NO: 606340 - RNA, 64 nt, Homo Sapiens; identical to SEQ ID NO: 145103

SEQ ID NO: 606341 - RNA, 64 nt, Homo Sapiens; identical to SEQ ID NO: 145104

SEQ ID NO: 606342 - RNA, 64 nt, Homo Sapiens; identical to SEQ ID NO: 145105

SEQ ID NO: 606343 - RNA, 64 nt, Homo Sapiens; identical to SEQ ID NO: 145106

SEQ ID NO: 606344 - RNA, 64 nt, Homo Sapiens; identical to SEQ ID NO: 145107

SEQ ID NO: 606345 - RNA, 64 nt, Homo Sapiens; identical to SEQ ID NO: 145108

SEQ ID NO: 606346 - RNA, 64 nt, Homo Sapiens; identical to SEQ ID NO: 145109

SEQ ID NO: 606347 - RNA, 64 nt, Homo Sapiens; identical to SEQ ID NO: 145110

SEQ ID NO: 606348 - RNA, 64 nt, Homo Sapiens; identical to SEQ ID NO: 145111

SEQ ID NO: 606349 - RNA, 64 nt, Homo Sapiens; identical to SEQ ID NO: 145112

SEQ ID NO: 606350 - RNA, 64 nt, Homo Sapiens; identical to SEQ ID NO: 145113

SEQ ID NO: 606351 - RNA, 64 nt, Homo Sapiens; identical to SEQ ID NO: 145114

SEQ ID NO: 606352 - RNA, 64 nt, Homo Sapiens; identical to SEQ ID NO: 145115

SEQ ID NO: 606353 - RNA, 64 nt, Homo Sapiens; identical to SEQ ID NO: 145116

SEQ ID NO: 606354 - RNA, 64 nt, Homo Sapiens; identical to SEQ ID NO: 145117

SEQ ID NO: 606355 - RNA, 64 nt, Homo Sapiens; identical to SEQ ID NO: 145118

SEQ ID NO: 606356 - RNA, 64 nt, Homo Sapiens; identical to SEQ ID NO: 145119

SEQ ID NO: 606357 - RNA, 64 nt, Homo Sapiens; identical to SEQ ID NO: 145120

SEQ ID NO: 606358 - RNA, 64 nt, Homo Sapiens; identical to SEQ ID NO: 145121

SEQ ID NO: 606359 - RNA, 64 nt, Homo Sapiens; identical to SEQ ID NO: 145122

SEQ ID NO: 606360 - RNA, 64 nt, Homo Sapiens; identical to SEQ ID NO: 145123

SEQ ID NO: 606361 - RNA, 64 nt, Homo Sapiens; identical to SEQ ID NO: 145124

SEQ ID NO: 606362 - RNA, 64 nt, Homo Sapiens; identical to SEQ ID NO: 145125

SEQ ID NO: 606363 - RNA, 64 nt, Homo Sapiens; identical to SEQ ID NO: 145126

SEQ ID NO: 606364 - RNA, 64 nt, Homo Sapiens
ugagagucagaggucacccgugauucugccugcaccuuaucauugaucugcagugauuucugca

SEQ ID NO: 606365 - RNA, 64 nt, Homo Sapiens
uguagauacugagaggugguggcaguaauuguggccuuaucagccgcucaguuccaggcuuuug

SEQ ID NO: 606366 - RNA, 64 nt, Homo Sapiens
ggggauauggggacgugacugggacagguuccugccuuaucauuuucucccuaggacauucccu

SEQ ID NO: 606367 - RNA, 64 nt, Homo Sapiens
uagcccuuuucuacuuuccuccccuccucccaguccuuaucaaucuuuuuuccuuuuuccugac

SEQ ID NO: 606368 - RNA, 64 nt, Homo Sapiens
aaaaaagccugaaaggacccgauuuucagcacccuacucucauggagucaacaaacuggcucuu

SEQ ID NO: 606369 - RNA, 64 nt, Homo Sapiens
uggguuguucuucaaagaagggauuaccuggacauacucucauuuaaugauuauacaugucuau

SEQ ID NO: 606370 - RNA, 64 nt, Homo Sapiens
ggucagaggcuguguuggacacaaguaucucuccuacucucagugucagcuggagugcugcuua

SEQ ID NO: 606371 - RNA, 64 nt, Homo Sapiens
ccuuuuauuaguagccuugcccuacccauacucguacucucagaggcuuucaguggucaugcua

SEQ ID NO: 606372 - RNA, 64 nt, Homo Sapiens; identical to SEQ ID NO: 420116

SEQ ID NO: 606373 - RNA, 64 nt, Homo Sapiens; identical to SEQ ID NO: 420117

SEQ ID NO: 606374 - RNA, 64 nt, Homo Sapiens; identical to SEQ ID NO: 420118

SEQ ID NO: 606375 - RNA, 64 nt, Homo Sapiens; identical to SEQ ID NO: 420119

SEQ ID NO: 606376 - RNA, 64 nt, Homo Sapiens; identical to SEQ ID NO: 420120

SEQ ID NO: 606377 - RNA, 64 nt, Homo Sapiens; identical to SEQ ID NO: 420121

SEQ ID NO: 606378 - RNA, 64 nt, Homo Sapiens; identical to SEQ ID NO: 420122

SEQ ID NO: 606379 - RNA, 64 nt, Homo Sapiens; identical to SEQ ID NO: 420123

SEQ ID NO: 606380 - RNA, 64 nt, Homo Sapiens; identical to SEQ ID NO: 420124

SEQ ID NO: 606381 - RNA, 64 nt, Homo Sapiens; identical to SEQ ID NO: 420125

SEQ ID NO: 606382 - RNA, 64 nt, Homo Sapiens; identical to SEQ ID NO: 420126

SEQ ID NO: 606383 - RNA, 64 nt, Homo Sapiens; identical to SEQ ID NO: 420127

SEQ ID NO: 606384 - RNA, 64 nt, Homo Sapiens; identical to SEQ ID NO: 420128

SEQ ID NO: 606385 - RNA, 64 nt, Homo Sapiens; identical to SEQ ID NO: 420129

SEQ ID NO: 606386 - RNA, 64 nt, Homo Sapiens; identical to SEQ ID NO: 420130

SEQ ID NO: 606387 - RNA, 64 nt, Homo Sapiens; identical to SEQ ID NO: 420131

SEQ ID NO: 606388 - RNA, 64 nt, Homo Sapiens; identical to SEQ ID NO: 420132

SEQ ID NO: 606389 - RNA, 64 nt, Homo Sapiens; identical to SEQ ID NO: 420133

SEQ ID NO: 606390 - RNA, 64 nt, Homo Sapiens; identical to SEQ ID NO: 420134

SEQ ID NO: 606391 - RNA, 64 nt, Homo Sapiens; identical to SEQ ID NO: 420135

SEQ ID NO: 606392 - RNA, 64 nt, Homo Sapiens; identical to SEQ ID NO: 420136

SEQ ID NO: 606393 - RNA, 64 nt, Homo Sapiens; identical to SEQ ID NO: 420137

SEQ ID NO: 606394 - RNA, 64 nt, Homo Sapiens; identical to SEQ ID NO: 420138

SEQ ID NO: 606395 - RNA, 64 nt, Homo Sapiens; identical to SEQ ID NO: 420139

SEQ ID NO: 606396 - RNA, 64 nt, Homo Sapiens; identical to SEQ ID NO: 420140

SEQ ID NO: 606397 - RNA, 64 nt, Homo Sapiens
uaugauucuauaucuagaaaaccccaugaucuuggcccaaaagcuccuagaucugauaaacaac

SEQ ID NO: 606398 - RNA, 64 nt, Homo Sapiens
aaaagcauuaaaauuuauuugaaaccaaaaaagagcccaaaaagccaaagcaauccuaagcaaa

SEQ ID NO: 606399 - RNA, 64 nt, Homo Sapiens; identical to SEQ ID NO: 100733

SEQ ID NO: 606400 - RNA, 64 nt, Homo Sapiens; identical to SEQ ID NO: 100734

SEQ ID NO: 606401 - RNA, 64 nt, Homo Sapiens; identical to SEQ ID NO: 100735

SEQ ID NO: 606402 - RNA, 64 nt, Homo Sapiens; identical to SEQ ID NO: 100736

SEQ ID NO: 606403 - RNA, 64 nt, Homo Sapiens; identical to SEQ ID NO: 100737

SEQ ID NO: 606404 - RNA, 64 nt, Homo Sapiens; identical to SEQ ID NO: 100738

SEQ ID NO: 606405 - RNA, 64 nt, Homo Sapiens; identical to SEQ ID NO: 100739

SEQ ID NO: 606406 - RNA, 64 nt, Homo Sapiens; identical to SEQ ID NO: 100740

SEQ ID NO: 606407 - RNA, 64 nt, Homo Sapiens; identical to SEQ ID NO: 100741

SEQ ID NO: 606408 - RNA, 64 nt, Homo Sapiens; identical to SEQ ID NO: 100742

SEQ ID NO: 606409 - RNA, 64 nt, Homo Sapiens; identical to SEQ ID NO: 100743

SEQ ID NO: 606410 - RNA, 64 nt, Homo Sapiens; identical to SEQ ID NO: 100744

SEQ ID NO: 606411 - RNA, 64 nt, Homo Sapiens; identical to SEQ ID NO: 100745

SEQ ID NO: 606412 - RNA, 64 nt, Homo Sapiens; identical to SEQ ID NO: 100746

SEQ ID NO: 606413 - RNA, 64 nt, Homo Sapiens; identical to SEQ ID NO: 100747

SEQ ID NO: 606414 - RNA, 64 nt, Homo Sapiens; identical to SEQ ID NO: 100748

SEQ ID NO: 606415 - RNA, 64 nt, Homo Sapiens; identical to SEQ ID NO: 100749

SEQ ID NO: 606416 - RNA, 64 nt, Homo Sapiens; identical to SEQ ID NO: 100750

SEQ ID NO: 606417 - RNA, 64 nt, Homo Sapiens; identical to SEQ ID NO: 100751

SEQ ID NO: 606418 - RNA, 64 nt, Homo Sapiens; identical to SEQ ID NO: 100752

SEQ ID NO: 606419 - RNA, 64 nt, Homo Sapiens; identical to SEQ ID NO: 100753

SEQ ID NO: 606420 - RNA, 64 nt, Homo Sapiens; identical to SEQ ID NO: 100754

SEQ ID NO: 606421 - RNA, 64 nt, Homo Sapiens; identical to SEQ ID NO: 100755

SEQ ID NO: 606422 - RNA, 64 nt, Homo Sapiens; identical to SEQ ID NO: 100756

SEQ ID NO: 606423 - RNA, 64 nt, Homo Sapiens; identical to SEQ ID NO: 100757

SEQ ID NO: 606424 - RNA, 64 nt, Homo Sapiens; identical to SEQ ID NO: 100758

SEQ ID NO: 606425 - RNA, 64 nt, Homo Sapiens; identical to SEQ ID NO: 100759

SEQ ID NO: 606426 - RNA, 64 nt, Homo Sapiens; identical to SEQ ID NO: 100760

SEQ ID NO: 606427 - RNA, 64 nt, Homo Sapiens; identical to SEQ ID NO: 100761

SEQ ID NO: 606428 - RNA, 64 nt, Homo Sapiens; identical to SEQ ID NO: 100762

SEQ ID NO: 606429 - RNA, 64 nt, Homo Sapiens; identical to SEQ ID NO: 100763

SEQ ID NO: 606430 - RNA, 64 nt, Homo Sapiens; identical to SEQ ID NO: 100764

SEQ ID NO: 606431 - RNA, 64 nt, Homo Sapiens; identical to SEQ ID NO: 100765

SEQ ID NO: 606432 - RNA, 64 nt, Homo Sapiens; identical to SEQ ID NO: 100766

SEQ ID NO: 606433 - RNA, 64 nt, Homo Sapiens; identical to SEQ ID NO: 100767

SEQ ID NO: 606434 - RNA, 64 nt, Homo Sapiens; identical to SEQ ID NO: 100768

SEQ ID NO: 606435 - RNA, 64 nt, Homo Sapiens; identical to SEQ ID NO: 100769

SEQ ID NO: 606436 - RNA, 64 nt, Homo Sapiens; identical to SEQ ID NO: 100770

SEQ ID NO: 606437 - RNA, 64 nt, Homo Sapiens; identical to SEQ ID NO: 100771

SEQ ID NO: 606438 - RNA, 64 nt, Homo Sapiens; identical to SEQ ID NO: 100772

SEQ ID NO: 606439 - RNA, 64 nt, Homo Sapiens; identical to SEQ ID NO: 100773

SEQ ID NO: 606440 - RNA, 64 nt, Homo Sapiens; identical to SEQ ID NO: 100774

SEQ ID NO: 606441 - RNA, 64 nt, Homo Sapiens; identical to SEQ ID NO: 100775

SEQ ID NO: 606442 - RNA, 64 nt, Homo Sapiens; identical to SEQ ID NO: 100776

SEQ ID NO: 606443 - RNA, 64 nt, Homo Sapiens; identical to SEQ ID NO: 100777

SEQ ID NO: 606444 - RNA, 64 nt, Homo Sapiens
caccaucagugaagauguaaugaggcugaaacauugcuuccacccccugucaaaccucagaacu

SEQ ID NO: 606445 - RNA, 64 nt, Homo Sapiens
gcaagaaucuuucucagugacaagaagauuggaaugcuuccaaaaccugcuugggaagaaacuc

SEQ ID NO: 606446 - RNA, 64 nt, Homo Sapiens
gucauuucccaccacaugcaguagcucugagacuugcuuccaaacuagaucugaaauucagagu

SEQ ID NO: 606447 - RNA, 64 nt, Homo Sapiens
gaaagguuugcccccaaaacuggacgauggauauugcuuccaauccccaaaggaguucuugauc

SEQ ID NO: 606448 - RNA, 64 nt, Homo Sapiens
agugccuucccuuuaugaaauugagugugggaugugcuuccagcugggaucuccaagucccagu

SEQ ID NO: 606449 - RNA, 64 nt, Homo Sapiens
gucaguaugccuguuaauuuaggguuguaguagaugcuuccagugggaccauguaacugaggug

SEQ ID NO: 606450 - RNA, 64 nt, Homo Sapiens
aauaaaccaucgggagcuaauuaaauagaaucuaugcuuccaccagaaaauugucucguuuauu

SEQ ID NO: 606451 - RNA, 64 nt, Homo Sapiens
gaugucauguaaaaaaguuauuucuuccauuaacugcuuccagagacuucaaaggcaaaguuca

SEQ ID NO: 606452 - RNA, 64 nt, Homo Sapiens
uuuuguuuuuacuguagaagucuugguaucauguugcuuccaaaccuuaugagcuugcuguauu

SEQ ID NO: 606453 - RNA, 64 nt, Homo Sapiens
uaacuagagcacuucaaucucccaaauugcuuuaugcuuccacauuagggcauaggacagauuc

SEQ ID NO: 606454 - RNA, 64 nt, Homo Sapiens
cugcuucuacuacccaaaauaugaauuccaacacugcuuccaagagacauuuacauaaaauugc

SEQ ID NO: 606455 - RNA, 64 nt, Homo Sapiens
ccaacacugcuuccaagagacauuuacauaaaauugcuuccauuuuuggaugagaaugaaaaau

SEQ ID NO: 606456 - RNA, 64 nt, Homo Sapiens
gugcaggugacuaugccuccucuucugcacagaaugcuuccaccagcauccugagaagaaauga

SEQ ID NO: 606457 - RNA, 64 nt, Homo Sapiens
caucaggauggaaacagucaggcacugacuggggugcuuccaagaggcaugagagugccuacuc

SEQ ID NO: 606458 - RNA, 64 nt, Homo Sapiens
uuuaucagccucugcaaggagcuuugucccaucgugcuuccauucccaggagggggagcuugga

SEQ ID NO: 606459 - RNA, 64 nt, Homo Sapiens
uuucccauauuuaucucaucugguuagcugccucugcuuccagcuuuguguaauucucuuugcc

SEQ ID NO: 606460 - RNA, 64 nt, Homo Sapiens
uaaaaacagauauuguaccauuaagacauuuucaugcuuccagguuugcuuuuuuauuuaccuu

SEQ ID NO: 606461 - RNA, 64 nt, Homo Sapiens
aacaaaugcucugucuucaauuaugugggucuuaugcuuccauugccagagucauaauauuuuc

SEQ ID NO: 606462 - RNA, 64 nt, Homo Sapiens
ucacuuuuugguuuuuaagaaacuguaaguuuugugcuuccaaaucaugacauuggguagcauu

SEQ ID NO: 606463 - RNA, 64 nt, Homo Sapiens
ucuaagcaaagaaaacugccggccaguguaaaacugcuuccaugguacauuguggcuucaaaag

SEQ ID NO: 606464 - RNA, 64 nt, Homo Sapiens
acuuuaaaaucaacuuauaacugugagauguuauugcuuccauuuuauuagaagagaaacaaau

SEQ ID NO: 606465 - RNA, 64 nt, Homo Sapiens
aucuaggaacauuacaaagcaaagacuauuuuuaugcuuccauaaccuagaauuaaaaccaaau

SEQ ID NO: 606466 - RNA, 64 nt, Homo Sapiens
ucuguuccuaugggugcuauucaucuggaaggccugcuuccaggccucuuugcugucagcccuu

SEQ ID NO: 606467 - RNA, 64 nt, Homo Sapiens
auucaaaauguuuagucuucucacuaauugagucugcuuccacguccucucccaggaacauucu

SEQ ID NO: 606468 - RNA, 64 nt, Homo Sapiens
ucguaggcauuguccugcagagccaauauagucgugcuuccaccccucuguccacucccugcag

SEQ ID NO: 606469 - RNA, 64 nt, Homo Sapiens
uauuuuggaaaagaaaaugaucugccuugaauauugcuuccauguagacagaucuuucucuuug

SEQ ID NO: 606470 - RNA, 64 nt, Homo Sapiens
gagcacaccuaguugguuucauguauguuacacaugcuuccacuccacaguaccuaauuucucu

SEQ ID NO: 606471 - RNA, 64 nt, Homo Sapiens
cuguuccuacgcccauuucacccucauuaccuucugcuuccaaggaauaugacagaucaccagg

SEQ ID NO: 606472 - RNA, 64 nt, Homo Sapiens
gugcuagggaaguuucagggccaugaccuccacuugcuuccaagcacguugccgaguggaagaa

SEQ ID NO: 606473 - RNA, 64 nt, Homo Sapiens
uacauuacauggcuuaagauagggugaaauccuaugcuuccaugugucaaauuacgaaaacuuc

SEQ ID NO: 606474 - RNA, 64 nt, Homo Sapiens
cagagugggugggggcccaccaugcugcggguggugcuuccaggcuugaucccugagguguuuc

SEQ ID NO: 606475 - RNA, 64 nt, Homo Sapiens
cccaccaccucuggccuuggggggcgccccacgcugcuuccacaaggugaaacuggggucccuu

SEQ ID NO: 606476 - RNA, 64 nt, Homo Sapiens
uuugaguccauguggcuaaagggaugccaaaugcugcuuccaagccccauuugagugcucuccg

SEQ ID NO: 606477 - RNA, 64 nt, Homo Sapiens
caaagaacaccgccaacacgccagaacggccuuuugcuuccagcagcagacggccccgaucccg

SEQ ID NO: 606478 - RNA, 64 nt, Homo Sapiens
gauuaagaaaagaaccaauagugacaaaaaucagugcuuccaguagauuuuagaacauucuuug

SEQ ID NO: 606479 - RNA, 64 nt, Homo Sapiens
acuuuuuauuaugaccauuagaaacuauuuugaaugcuuccaacuggcucaauuggccgggaaa

SEQ ID NO: 606480 - RNA, 64 nt, Homo Sapiens; identical to SEQ ID NO: 251941

SEQ ID NO: 606481 - RNA, 64 nt, Homo Sapiens; identical to SEQ ID NO: 251942

SEQ ID NO: 606482 - RNA, 64 nt, Homo Sapiens; identical to SEQ ID NO: 93186

SEQ ID NO: 606483 - RNA, 64 nt, Homo Sapiens; identical to SEQ ID NO: 93187

SEQ ID NO: 606484 - RNA, 64 nt, Homo Sapiens; identical to SEQ ID NO: 93188

SEQ ID NO: 606485 - RNA, 64 nt, Homo Sapiens; identical to SEQ ID NO: 93189

SEQ ID NO: 606486 - RNA, 64 nt, Homo Sapiens; identical to SEQ ID NO: 93190

SEQ ID NO: 606487 - RNA, 64 nt, Homo Sapiens; identical to SEQ ID NO: 93191

SEQ ID NO: 606488 - RNA, 64 nt, Homo Sapiens; identical to SEQ ID NO: 93192

SEQ ID NO: 606489 - RNA, 64 nt, Homo Sapiens; identical to SEQ ID NO: 93193

SEQ ID NO: 606490 - RNA, 64 nt, Homo Sapiens; identical to SEQ ID NO: 93194

SEQ ID NO: 606491 - RNA, 64 nt, Homo Sapiens; identical to SEQ ID NO: 93195

SEQ ID NO: 606492 - RNA, 64 nt, Homo Sapiens; identical to SEQ ID NO: 93196

SEQ ID NO: 606493 - RNA, 64 nt, Homo Sapiens; identical to SEQ ID NO: 93197

SEQ ID NO: 606494 - RNA, 64 nt, Homo Sapiens; identical to SEQ ID NO: 93198

SEQ ID NO: 606495 - RNA, 64 nt, Homo Sapiens; identical to SEQ ID NO: 93199

SEQ ID NO: 606496 - RNA, 64 nt, Homo Sapiens
aaugaaguggggcagaucuugugccauagaaguagauuucuaggugaauuaagacaaagaacag

SEQ ID NO: 606497 - RNA, 64 nt, Homo Sapiens
cuucccaagccuuacccuggccaggugcccauaugauuucuacaccauuuccucauguugcuga

SEQ ID NO: 606498 - RNA, 64 nt, Homo Sapiens
aaauaacuuccugauuggaguguguaagcugagcgauuucuaauaaaauuuuaguuguacacuu

SEQ ID NO: 606499 - RNA, 64 nt, Homo Sapiens
uguaucacauggauuauaaagcaaaguuauggucgauuucuauucuugaaagaaucaacuacag

SEQ ID NO: 606500 - RNA, 64 nt, Homo Sapiens
ucagaguggauagaagaacuauggaaugaaaggugauuucuaguuuaaaggacuacagagcugu

SEQ ID NO: 606501 - RNA, 64 nt, Homo Sapiens
ugugucuaagaaccuauucagcuccuccuacuuggauuucuagcuucccaggaccucuggucug

SEQ ID NO: 606502 - RNA, 64 nt, Homo Sapiens
uauuaacucuuaagugcaccucugaaaagugaaagauuucuauggugaggaaaugcuacuaaua

SEQ ID NO: 606503 - RNA, 64 nt, Homo Sapiens
guuauuguuuucugucauuuugcccaacacaggagauuucuauaaccuccccacaacagaauuc

SEQ ID NO: 606504 - RNA, 64 nt, Homo Sapiens
ugggcuggucccaucaucugacagcauauccacugauuucuaaaagauuucaguuuacauaucg

SEQ ID NO: 606505 - RNA, 64 nt, Homo Sapiens
uugguucauuguggccuaucuggugacauguucagauuucuaauauauuccuuuaugcugcaag

SEQ ID NO: 606506 - RNA, 64 nt, Homo Sapiens
aagucagagguaaaccggucaguuacagaagcaggauuucuaggauuucuaacuccagcuguuc

SEQ ID NO: 606507 - RNA, 64 nt, Homo Sapiens
guaaaccggucaguuacagaagcaggauuucuaggauuucuaacuccagcuguucccauacugu

SEQ ID NO: 606508 - RNA, 64 nt, Homo Sapiens
gucugccgaagaggacuagggggcgccaacguucgauuucuaccucagcagcaguuggaucuuu

SEQ ID NO: 606509 - RNA, 64 nt, Homo Sapiens
aauuuuuaaaauacuuguuucagcuucucugcuagauuucuacauuaacuugaaaauuuuuuaa

SEQ ID NO: 606510 - RNA, 64 nt, Homo Sapiens
cagcaguuaagcuacaaaaaucauauuccucugggauuucuaaacaauguaacucuggccucaa

SEQ ID NO: 606511 - RNA, 64 nt, Homo Sapiens
auaguaucaguguaauuauuaaauaaguacccaugauuucuauuaugccuuccaucugaaugua

SEQ ID NO: 606512 - RNA, 64 nt, Homo Sapiens
uagggagauauguaugugugcucccugggguggggauuucuaguuacuagaccaucuccauuuu

SEQ ID NO: 606513 - RNA, 64 nt, Homo Sapiens
uagaccaaauaaugcggcuaguuaacagugguacgauuucuagcccguggcuuuaaaaugcacu

SEQ ID NO: 606514 - RNA, 64 nt, Homo Sapiens
gagccuacagaccuguccucaccaacuguuuugugauuucuacucaacuacaaagauuuauuua

SEQ ID NO: 606515 - RNA, 64 nt, Homo Sapiens
gggugcagaggccugagguuucuaaaagaagguagauuucuacagagcugaguguugguuccuu

SEQ ID NO: 606516 - RNA, 64 nt, Homo Sapiens
auauacucagaaaugguggugcuggaucauauaggauuucuauuuuuuuuuuuuguuuguuuuu

SEQ ID NO: 606517 - RNA, 64 nt, Homo Sapiens
gggauuacgggcgugagccaccgcgccuggccaggauuucuauuuuuaauauuuuugggaaaau

SEQ ID NO: 606518 - RNA, 64 nt, Homo Sapiens
caaauaucuaugugcuuggagccacaguuuccuaagcgcauaguuuuugguccugccucaugua

SEQ ID NO: 606519 - RNA, 64 nt, Homo Sapiens
ugaugugaauuugcauuuguuacauuacauugccagcgcauaucauuuagcaaguuggcauuaa

SEQ ID NO: 606520 - RNA, 54 nt, Homo Sapiens
ggagcuggggaagggggccuuagcagcgcauacacucgggcagcagggcccuag

SEQ ID NO: 606521 - RNA, 64 nt, Homo Sapiens
agcccauaacugauagaugcauuagaagucagccagcgcauaggugcucccucuauauuaugga

SEQ ID NO: 606522 - RNA, 64 nt, Homo Sapiens
uguuccuucuuuaugaugcccuuuuggacuauggagcgcauaucauagacuuaauaauucauuu

SEQ ID NO: 606523 - RNA, 64 nt, Homo Sapiens
uucgauauuuuugugaauucaaaccccacaguauagcgcauauucacucauaacuuuccaaaug

SEQ ID NO: 606524 - RNA, 64 nt, Homo Sapiens
uguccaccucuucuccccugcccaccagcugcucagcgcauaagaccuucccgacaggcucugc

SEQ ID NO: 606525 - RNA, 64 nt, Homo Sapiens
augagagaaucaaauaauagauguccguacaaguagcgcauauauuuaaccauuuaguuugggg

SEQ ID NO: 606526 - RNA, 64 nt, Homo Sapiens
aacaaaggcucuuuucagagagaccgaguugaaaagcgcauaaagccaccacaagacuaaguaa

SEQ ID NO: 606527 - RNA, 64 nt, Homo Sapiens
aucucaugggguccagagugaagccuggaguaccagcgcauaucgaggcuucccaggccauuua

SEQ ID NO: 606528 - RNA, 64 nt, Homo Sapiens
aacagagcacaagcaucuuuguuuucuuucugguagcgcauaauaucaaauuggauaaaacaau

SEQ ID NO: 606529 - RNA, 64 nt, Homo Sapiens
ggacaggacgcuagguuguugagucaucugguagagcgcauauauggauggauggaauauaauu

SEQ ID NO: 606530 - RNA, 64 nt, Homo Sapiens
uacagcagagcucacagugacucccucuccagggagcgcauagagacuguaccuuagcaaguug

SEQ ID NO: 606531 - RNA, 64 nt, Homo Sapiens
uuggcaugaauuuugugaauggcuucagccuaucagcgcauacaguucugaaguuucacagcuu

SEQ ID NO: 606532 - RNA, 64 nt, Homo Sapiens
ugacuggaagggguuuuuguauaacuaaaaccucagcgcauaaaggagauuuaaaaggagcaca

SEQ ID NO: 606533 - RNA, 64 nt, Homo Sapiens
ucacggcagccaggagaccccaggugaguuucugagcgcauacguaguugguucuuacccccag

SEQ ID NO: 606534 - RNA, 64 nt, Homo Sapiens
cgcaggccggugugacuucuugggacccuccgccagcgcauagccagccgggccuucuucucuc

SEQ ID NO: 606535 - RNA, 64 nt, Homo Sapiens
uuugcaguaugaacuauugcagguggaggaagauagcgcauauagggccuuagguuugacaugg

SEQ ID NO: 606536 - RNA, 64 nt, Homo Sapiens
agaccaguggggauuuguaagacuuagaugagauagcgcauaauaaggggaagacuuuaaagua

SEQ ID NO: 606537 - RNA, 64 nt, Homo Sapiens
uguuccucuucucauucucugccccaucuuccccagcgcauaccucaccgugugugucccagcu

SEQ ID NO: 606538 - RNA, 64 nt, Homo Sapiens; identical to SEQ ID NO: 281120

SEQ ID NO: 606539 - RNA, 64 nt, Homo Sapiens; identical to SEQ ID NO: 281120

SEQ ID NO: 606540 - RNA, 64 nt, Homo Sapiens; identical to SEQ ID NO: 281122

SEQ ID NO: 606541 - RNA, 64 nt, Homo Sapiens; identical to SEQ ID NO: 281123

SEQ ID NO: 606542 - RNA, 64 nt, Homo Sapiens; identical to SEQ ID NO: 281124

SEQ ID NO: 606543 - RNA, 64 nt, Homo Sapiens; identical to SEQ ID NO: 281125

SEQ ID NO: 606544 - RNA, 64 nt, Homo Sapiens; identical to SEQ ID NO: 281126

SEQ ID NO: 606545 - RNA, 64 nt, Homo Sapiens; identical to SEQ ID NO: 281127

SEQ ID NO: 606546 - RNA, 64 nt, Homo Sapiens; identical to SEQ ID NO: 281128

SEQ ID NO: 606547 - RNA, 64 nt, Homo Sapiens; identical to SEQ ID NO: 281129

SEQ ID NO: 606548 - RNA, 64 nt, Homo Sapiens; identical to SEQ ID NO: 281130

SEQ ID NO: 606549 - RNA, 64 nt, Homo Sapiens; identical to SEQ ID NO: 281131

SEQ ID NO: 606550 - RNA, 64 nt, Homo Sapiens; identical to SEQ ID NO: 606518

SEQ ID NO: 606551 - RNA, 64 nt, Homo Sapiens; identical to SEQ ID NO: 606519

SEQ ID NO: 606552 - RNA, 54 nt, Homo Sapiens; identical to SEQ ID NO: 606520

SEQ ID NO: 606553 - RNA, 64 nt, Homo Sapiens; identical to SEQ ID NO: 606521

SEQ ID NO: 606554 - RNA, 64 nt, Homo Sapiens; identical to SEQ ID NO: 606522

SEQ ID NO: 606555 - RNA, 64 nt, Homo Sapiens; identical to SEQ ID NO: 606523

SEQ ID NO: 606556 - RNA, 64 nt, Homo Sapiens; identical to SEQ ID NO: 606524

SEQ ID NO: 606557 - RNA, 64 nt, Homo Sapiens; identical to SEQ ID NO: 606525

SEQ ID NO: 606558 - RNA, 64 nt, Homo Sapiens; identical to SEQ ID NO: 606526

SEQ ID NO: 606559 - RNA, 64 nt, Homo Sapiens; identical to SEQ ID NO: 606527

SEQ ID NO: 606560 - RNA, 64 nt, Homo Sapiens; identical to SEQ ID NO: 606528

SEQ ID NO: 606561 - RNA, 64 nt, Homo Sapiens; identical to SEQ ID NO: 606529

SEQ ID NO: 606562 - RNA, 64 nt, Homo Sapiens; identical to SEQ ID NO: 606530

SEQ ID NO: 606563 - RNA, 64 nt, Homo Sapiens; identical to SEQ ID NO: 606531

SEQ ID NO: 606564 - RNA, 64 nt, Homo Sapiens; identical to SEQ ID NO: 606532

SEQ ID NO: 606565 - RNA, 64 nt, Homo Sapiens; identical to SEQ ID NO: 606533

SEQ ID NO: 606566 - RNA, 64 nt, Homo Sapiens; identical to SEQ ID NO: 606534

SEQ ID NO: 606567 - RNA, 64 nt, Homo Sapiens; identical to SEQ ID NO: 606535

SEQ ID NO: 606568 - RNA, 64 nt, Homo Sapiens; identical to SEQ ID NO: 606536

SEQ ID NO: 606569 - RNA, 64 nt, Homo Sapiens; identical to SEQ ID NO: 606537

SEQ ID NO: 606570 - RNA, 64 nt, Homo Sapiens; identical to SEQ ID NO: 281120

SEQ ID NO: 606571 - RNA, 64 nt, Homo Sapiens; identical to SEQ ID NO: 281120

SEQ ID NO: 606572 - RNA, 64 nt, Homo Sapiens; identical to SEQ ID NO: 281122

SEQ ID NO: 606573 - RNA, 64 nt, Homo Sapiens; identical to SEQ ID NO: 281123

SEQ ID NO: 606574 - RNA, 64 nt, Homo Sapiens; identical to SEQ ID NO: 281124

SEQ ID NO: 606575 - RNA, 64 nt, Homo Sapiens; identical to SEQ ID NO: 281125

SEQ ID NO: 606576 - RNA, 64 nt, Homo Sapiens; identical to SEQ ID NO: 281126

SEQ ID NO: 606577 - RNA, 64 nt, Homo Sapiens; identical to SEQ ID NO: 281127

SEQ ID NO: 606578 - RNA, 64 nt, Homo Sapiens; identical to SEQ ID NO: 281128

SEQ ID NO: 606579 - RNA, 64 nt, Homo Sapiens; identical to SEQ ID NO: 281129

SEQ ID NO: 606580 - RNA, 64 nt, Homo Sapiens; identical to SEQ ID NO: 281130

SEQ ID NO: 606581 - RNA, 64 nt, Homo Sapiens; identical to SEQ ID NO: 281131

SEQ ID NO: 606582 - RNA, 64 nt, Homo Sapiens; identical to SEQ ID NO: 606518

SEQ ID NO: 606583 - RNA, 64 nt, Homo Sapiens; identical to SEQ ID NO: 606519

SEQ ID NO: 606584 - RNA, 54 nt, Homo Sapiens; identical to SEQ ID NO: 606520

SEQ ID NO: 606585 - RNA, 64 nt, Homo Sapiens; identical to SEQ ID NO: 606521

SEQ ID NO: 606586 - RNA, 64 nt, Homo Sapiens; identical to SEQ ID NO: 606522

SEQ ID NO: 606587 - RNA, 64 nt, Homo Sapiens; identical to SEQ ID NO: 606523

SEQ ID NO: 606588 - RNA, 64 nt, Homo Sapiens; identical to SEQ ID NO: 606524

SEQ ID NO: 606589 - RNA, 64 nt, Homo Sapiens; identical to SEQ ID NO: 606525

SEQ ID NO: 606590 - RNA, 64 nt, Homo Sapiens; identical to SEQ ID NO: 606526

SEQ ID NO: 606591 - RNA, 64 nt, Homo Sapiens; identical to SEQ ID NO: 606527

SEQ ID NO: 606592 - RNA, 64 nt, Homo Sapiens; identical to SEQ ID NO: 606528

SEQ ID NO: 606593 - RNA, 64 nt, Homo Sapiens; identical to SEQ ID NO: 606529

SEQ ID NO: 606594 - RNA, 64 nt, Homo Sapiens; identical to SEQ ID NO: 606530

SEQ ID NO: 606595 - RNA, 64 nt, Homo Sapiens; identical to SEQ ID NO: 606531

SEQ ID NO: 606596 - RNA, 64 nt, Homo Sapiens; identical to SEQ ID NO: 606532

SEQ ID NO: 606597 - RNA, 64 nt, Homo Sapiens; identical to SEQ ID NO: 606533

SEQ ID NO: 606598 - RNA, 64 nt, Homo Sapiens; identical to SEQ ID NO: 606534

SEQ ID NO: 606599 - RNA, 64 nt, Homo Sapiens; identical to SEQ ID NO: 606535

SEQ ID NO: 606600 - RNA, 64 nt, Homo Sapiens; identical to SEQ ID NO: 606536

SEQ ID NO: 606601 - RNA, 64 nt, Homo Sapiens; identical to SEQ ID NO: 606537

SEQ ID NO: 606602 - RNA, 64 nt, Homo Sapiens; identical to SEQ ID NO: 281120

SEQ ID NO: 606603 - RNA, 64 nt, Homo Sapiens; identical to SEQ ID NO: 281120

SEQ ID NO: 606604 - RNA, 64 nt, Homo Sapiens; identical to SEQ ID NO: 281122

SEQ ID NO: 606605 - RNA, 64 nt, Homo Sapiens; identical to SEQ ID NO: 281123

SEQ ID NO: 606606 - RNA, 64 nt, Homo Sapiens; identical to SEQ ID NO: 281124

SEQ ID NO: 606607 - RNA, 64 nt, Homo Sapiens; identical to SEQ ID NO: 281125

SEQ ID NO: 606608 - RNA, 64 nt, Homo Sapiens; identical to SEQ ID NO: 281126

SEQ ID NO: 606609 - RNA, 64 nt, Homo Sapiens; identical to SEQ ID NO: 281127

SEQ ID NO: 606610 - RNA, 64 nt, Homo Sapiens; identical to SEQ ID NO: 281128

SEQ ID NO: 606611 - RNA, 64 nt, Homo Sapiens; identical to SEQ ID NO: 281129

SEQ ID NO: 606612 - RNA, 64 nt, Homo Sapiens; identical to SEQ ID NO: 281130

SEQ ID NO: 606613 - RNA, 64 nt, Homo Sapiens; identical to SEQ ID NO: 281131

SEQ ID NO: 606614 - RNA, 64 nt, Homo Sapiens; identical to SEQ ID NO: 606518

SEQ ID NO: 606615 - RNA, 64 nt, Homo Sapiens; identical to SEQ ID NO: 606519

SEQ ID NO: 606616 - RNA, 54 nt, Homo Sapiens; identical to SEQ ID NO: 606520

SEQ ID NO: 606617 - RNA, 64 nt, Homo Sapiens; identical to SEQ ID NO: 606521

SEQ ID NO: 606618 - RNA, 64 nt, Homo Sapiens; identical to SEQ ID NO: 606522

SEQ ID NO: 606619 - RNA, 64 nt, Homo Sapiens; identical to SEQ ID NO: 606523

SEQ ID NO: 606620 - RNA, 64 nt, Homo Sapiens; identical to SEQ ID NO: 606524

SEQ ID NO: 606621 - RNA, 64 nt, Homo Sapiens; identical to SEQ ID NO: 606525

SEQ ID NO: 606622 - RNA, 64 nt, Homo Sapiens; identical to SEQ ID NO: 606526

SEQ ID NO: 606623 - RNA, 64 nt, Homo Sapiens; identical to SEQ ID NO: 606527

SEQ ID NO: 606624 - RNA, 64 nt, Homo Sapiens; identical to SEQ ID NO: 606528

SEQ ID NO: 606625 - RNA, 64 nt, Homo Sapiens; identical to SEQ ID NO: 606529

SEQ ID NO: 606626 - RNA, 64 nt, Homo Sapiens; identical to SEQ ID NO: 606530

SEQ ID NO: 606627 - RNA, 64 nt, Homo Sapiens; identical to SEQ ID NO: 606531

SEQ ID NO: 606628 - RNA, 64 nt, Homo Sapiens; identical to SEQ ID NO: 606532

SEQ ID NO: 606629 - RNA, 64 nt, Homo Sapiens; identical to SEQ ID NO: 606533

SEQ ID NO: 606630 - RNA, 64 nt, Homo Sapiens; identical to SEQ ID NO: 606534

SEQ ID NO: 606631 - RNA, 64 nt, Homo Sapiens; identical to SEQ ID NO: 606535

SEQ ID NO: 606632 - RNA, 64 nt, Homo Sapiens; identical to SEQ ID NO: 606536

SEQ ID NO: 606633 - RNA, 64 nt, Homo Sapiens; identical to SEQ ID NO: 606537

SEQ ID NO: 606634 - RNA, 64 nt, Homo Sapiens; identical to SEQ ID NO: 281120

SEQ ID NO: 606635 - RNA, 64 nt, Homo Sapiens; identical to SEQ ID NO: 281120

SEQ ID NO: 606636 - RNA, 64 nt, Homo Sapiens; identical to SEQ ID NO: 281122

SEQ ID NO: 606637 - RNA, 64 nt, Homo Sapiens; identical to SEQ ID NO: 281123

SEQ ID NO: 606638 - RNA, 64 nt, Homo Sapiens; identical to SEQ ID NO: 281124

SEQ ID NO: 606639 - RNA, 64 nt, Homo Sapiens; identical to SEQ ID NO: 281125

SEQ ID NO: 606640 - RNA, 64 nt, Homo Sapiens; identical to SEQ ID NO: 281126

SEQ ID NO: 606641 - RNA, 64 nt, Homo Sapiens; identical to SEQ ID NO: 281127

SEQ ID NO: 606642 - RNA, 64 nt, Homo Sapiens; identical to SEQ ID NO: 281128

SEQ ID NO: 606643 - RNA, 64 nt, Homo Sapiens; identical to SEQ ID NO: 281129

SEQ ID NO: 606644 - RNA, 64 nt, Homo Sapiens; identical to SEQ ID NO: 281130

SEQ ID NO: 606645 - RNA, 64 nt, Homo Sapiens; identical to SEQ ID NO: 281131

SEQ ID NO: 606646 - RNA, 64 nt, Homo Sapiens; identical to SEQ ID NO: 215308

SEQ ID NO: 606647 - RNA, 64 nt, Homo Sapiens; identical to SEQ ID NO: 215309

SEQ ID NO: 606648 - RNA, 64 nt, Homo Sapiens; identical to SEQ ID NO: 215310

SEQ ID NO: 606649 - RNA, 64 nt, Homo Sapiens; identical to SEQ ID NO: 215311

SEQ ID NO: 606650 - RNA, 64 nt, Homo Sapiens; identical to SEQ ID NO: 215312

SEQ ID NO: 606651 - RNA, 64 nt, Homo Sapiens; identical to SEQ ID NO: 215313

SEQ ID NO: 606652 - RNA, 64 nt, Homo Sapiens; identical to SEQ ID NO: 215314

SEQ ID NO: 606653 - RNA, 64 nt, Homo Sapiens; identical to SEQ ID NO: 215315

SEQ ID NO: 606654 - RNA, 64 nt, Homo Sapiens; identical to SEQ ID NO: 215316

SEQ ID NO: 606655 - RNA, 64 nt, Homo Sapiens; identical to SEQ ID NO: 215317

SEQ ID NO: 606656 - RNA, 64 nt, Homo Sapiens; identical to SEQ ID NO: 215318

SEQ ID NO: 606657 - RNA, 64 nt, Homo Sapiens; identical to SEQ ID NO: 215319

SEQ ID NO: 606658 - RNA, 64 nt, Homo Sapiens; identical to SEQ ID NO: 215320

SEQ ID NO: 606659 - RNA, 64 nt, Homo Sapiens; identical to SEQ ID NO: 215321

SEQ ID NO: 606660 - RNA, 64 nt, Homo Sapiens; identical to SEQ ID NO: 215322

SEQ ID NO: 606661 - RNA, 64 nt, Homo Sapiens; identical to SEQ ID NO: 215323

SEQ ID NO: 606662 - RNA, 64 nt, Homo Sapiens; identical to SEQ ID NO: 215324

SEQ ID NO: 606663 - RNA, 58 nt, Homo Sapiens; identical to SEQ ID NO: 215325

SEQ ID NO: 606664 - RNA, 64 nt, Homo Sapiens; identical to SEQ ID NO: 215326

SEQ ID NO: 606665 - RNA, 64 nt, Homo Sapiens; identical to SEQ ID NO: 215327

SEQ ID NO: 606666 - RNA, 64 nt, Homo Sapiens; identical to SEQ ID NO: 531886

SEQ ID NO: 606667 - RNA, 64 nt, Homo Sapiens; identical to SEQ ID NO: 531887

SEQ ID NO: 606668 - RNA, 64 nt, Homo Sapiens; identical to SEQ ID NO: 531888

SEQ ID NO: 606669 - RNA, 64 nt, Homo Sapiens; identical to SEQ ID NO: 531889

SEQ ID NO: 606670 - RNA, 64 nt, Homo Sapiens; identical to SEQ ID NO: 531890

SEQ ID NO: 606671 - RNA, 64 nt, Homo Sapiens; identical to SEQ ID NO: 531891

SEQ ID NO: 606672 - RNA, 64 nt, Homo Sapiens; identical to SEQ ID NO: 531892

SEQ ID NO: 606673 - RNA, 64 nt, Homo Sapiens; identical to SEQ ID NO: 531893

SEQ ID NO: 606674 - RNA, 64 nt, Homo Sapiens; identical to SEQ ID NO: 531894

SEQ ID NO: 606675 - RNA, 64 nt, Homo Sapiens; identical to SEQ ID NO: 531895

SEQ ID NO: 606676 - RNA, 64 nt, Homo Sapiens; identical to SEQ ID NO: 531896

SEQ ID NO: 606677 - RNA, 64 nt, Homo Sapiens; identical to SEQ ID NO: 531897

SEQ ID NO: 606678 - RNA, 64 nt, Homo Sapiens; identical to SEQ ID NO: 531898

SEQ ID NO: 606679 - RNA, 64 nt, Homo Sapiens; identical to SEQ ID NO: 531899

SEQ ID NO: 606680 - RNA, 64 nt, Homo Sapiens; identical to SEQ ID NO: 531900

SEQ ID NO: 606681 - RNA, 64 nt, Homo Sapiens; identical to SEQ ID NO: 531901

SEQ ID NO: 606682 - RNA, 64 nt, Homo Sapiens; identical to SEQ ID NO: 531902

SEQ ID NO: 606683 - RNA, 64 nt, Homo Sapiens; identical to SEQ ID NO: 531903

SEQ ID NO: 606684 - RNA, 64 nt, Homo Sapiens; identical to SEQ ID NO: 531904

SEQ ID NO: 606685 - RNA, 64 nt, Homo Sapiens; identical to SEQ ID NO: 531905

SEQ ID NO: 606686 - RNA, 64 nt, Homo Sapiens; identical to SEQ ID NO: 531906

SEQ ID NO: 606687 - RNA, 64 nt, Homo Sapiens; identical to SEQ ID NO: 531907

SEQ ID NO: 606688 - RNA, 64 nt, Homo Sapiens; identical to SEQ ID NO: 531908

SEQ ID NO: 606689 - RNA, 64 nt, Homo Sapiens; identical to SEQ ID NO: 531909

SEQ ID NO: 606690 - RNA, 64 nt, Homo Sapiens; identical to SEQ ID NO: 531910

SEQ ID NO: 606691 - RNA, 64 nt, Homo Sapiens; identical to SEQ ID NO: 531911

SEQ ID NO: 606692 - RNA, 64 nt, Homo Sapiens; identical to SEQ ID NO: 531912

SEQ ID NO: 606693 - RNA, 64 nt, Homo Sapiens; identical to SEQ ID NO: 531913

SEQ ID NO: 606694 - RNA, 64 nt, Homo Sapiens; identical to SEQ ID NO: 531914

SEQ ID NO: 606695 - RNA, 64 nt, Homo Sapiens; identical to SEQ ID NO: 531915

SEQ ID NO: 606696 - RNA, 64 nt, Homo Sapiens; identical to SEQ ID NO: 531916

SEQ ID NO: 606697 - RNA, 64 nt, Homo Sapiens; identical to SEQ ID NO: 531917

SEQ ID NO: 606698 - RNA, 64 nt, Homo Sapiens; identical to SEQ ID NO: 531918

SEQ ID NO: 606699 - RNA, 64 nt, Homo Sapiens; identical to SEQ ID NO: 531919

SEQ ID NO: 606700 - RNA, 64 nt, Homo Sapiens; identical to SEQ ID NO: 531920

SEQ ID NO: 606701 - RNA, 64 nt, Homo Sapiens; identical to SEQ ID NO: 531921

SEQ ID NO: 606702 - RNA, 64 nt, Homo Sapiens; identical to SEQ ID NO: 531922

SEQ ID NO: 606703 - RNA, 64 nt, Homo Sapiens; identical to SEQ ID NO: 307734

SEQ ID NO: 606704 - RNA, 64 nt, Homo Sapiens; identical to SEQ ID NO: 307735

SEQ ID NO: 606705 - RNA, 64 nt, Homo Sapiens; identical to SEQ ID NO: 307736

SEQ ID NO: 606706 - RNA, 64 nt, Homo Sapiens; identical to SEQ ID NO: 307737

SEQ ID NO: 606707 - RNA, 64 nt, Homo Sapiens; identical to SEQ ID NO: 307738

SEQ ID NO: 606708 - RNA, 64 nt, Homo Sapiens; identical to SEQ ID NO: 307739

SEQ ID NO: 606709 - RNA, 64 nt, Homo Sapiens; identical to SEQ ID NO: 307740

SEQ ID NO: 606710 - RNA, 64 nt, Homo Sapiens; identical to SEQ ID NO: 307741

SEQ ID NO: 606711 - RNA, 59 nt, Homo Sapiens; identical to SEQ ID NO: 307742

SEQ ID NO: 606712 - RNA, 64 nt, Homo Sapiens; identical to SEQ ID NO: 307743

SEQ ID NO: 606713 - RNA, 64 nt, Homo Sapiens; identical to SEQ ID NO: 307744

SEQ ID NO: 606714 - RNA, 64 nt, Homo Sapiens; identical to SEQ ID NO: 307745

SEQ ID NO: 606715 - RNA, 64 nt, Homo Sapiens; identical to SEQ ID NO: 307746

SEQ ID NO: 606716 - RNA, 64 nt, Homo Sapiens; identical to SEQ ID NO: 307747

SEQ ID NO: 606717 - RNA, 64 nt, Homo Sapiens; identical to SEQ ID NO: 307748

SEQ ID NO: 606718 - RNA, 64 nt, Homo Sapiens; identical to SEQ ID NO: 307749

SEQ ID NO: 606719 - RNA, 64 nt, Homo Sapiens; identical to SEQ ID NO: 307750

SEQ ID NO: 606720 - RNA, 64 nt, Homo Sapiens; identical to SEQ ID NO: 307751

SEQ ID NO: 606721 - RNA, 64 nt, Homo Sapiens; identical to SEQ ID NO: 307752

SEQ ID NO: 606722 - RNA, 64 nt, Homo Sapiens; identical to SEQ ID NO: 307753

SEQ ID NO: 606723 - RNA, 64 nt, Homo Sapiens; identical to SEQ ID NO: 307754

SEQ ID NO: 606724 - RNA, 64 nt, Homo Sapiens; identical to SEQ ID NO: 307755

SEQ ID NO: 606725 - RNA, 64 nt, Homo Sapiens; identical to SEQ ID NO: 307756

SEQ ID NO: 606726 - RNA, 64 nt, Homo Sapiens; identical to SEQ ID NO: 307757

SEQ ID NO: 606727 - RNA, 64 nt, Homo Sapiens; identical to SEQ ID NO: 307758

SEQ ID NO: 606728 - RNA, 64 nt, Homo Sapiens; identical to SEQ ID NO: 307759

SEQ ID NO: 606729 - RNA, 64 nt, Homo Sapiens; identical to SEQ ID NO: 307760

SEQ ID NO: 606730 - RNA, 64 nt, Homo Sapiens; identical to SEQ ID NO: 307761

SEQ ID NO: 606731 - RNA, 64 nt, Homo Sapiens; identical to SEQ ID NO: 307762

SEQ ID NO: 606732 - RNA, 64 nt, Homo Sapiens; identical to SEQ ID NO: 307763

SEQ ID NO: 606733 - RNA, 64 nt, Homo Sapiens; identical to SEQ ID NO: 307764

SEQ ID NO: 606734 - RNA, 64 nt, Homo Sapiens; identical to SEQ ID NO: 307765

SEQ ID NO: 606735 - RNA, 64 nt, Homo Sapiens; identical to SEQ ID NO: 307766

SEQ ID NO: 606736 - RNA, 64 nt, Homo Sapiens; identical to SEQ ID NO: 307767

SEQ ID NO: 606737 - RNA, 64 nt, Homo Sapiens; identical to SEQ ID NO: 307768

SEQ ID NO: 606738 - RNA, 64 nt, Homo Sapiens; identical to SEQ ID NO: 307769

SEQ ID NO: 606739 - RNA, 64 nt, Homo Sapiens; identical to SEQ ID NO: 307770

SEQ ID NO: 606740 - RNA, 64 nt, Homo Sapiens; identical to SEQ ID NO: 307771

SEQ ID NO: 606741 - RNA, 64 nt, Homo Sapiens; identical to SEQ ID NO: 307772

SEQ ID NO: 606742 - RNA, 64 nt, Homo Sapiens; identical to SEQ ID NO: 307773

SEQ ID NO: 606743 - RNA, 64 nt, Homo Sapiens; identical to SEQ ID NO: 307774

SEQ ID NO: 606744 - RNA, 64 nt, Homo Sapiens; identical to SEQ ID NO: 307775

SEQ ID NO: 606745 - RNA, 64 nt, Homo Sapiens; identical to SEQ ID NO: 307776

SEQ ID NO: 606746 - RNA, 64 nt, Homo Sapiens; identical to SEQ ID NO: 307777

SEQ ID NO: 606747 - RNA, 64 nt, Homo Sapiens; identical to SEQ ID NO: 307778

SEQ ID NO: 606748 - RNA, 64 nt, Homo Sapiens; identical to SEQ ID NO: 307779

SEQ ID NO: 606749 - RNA, 64 nt, Homo Sapiens; identical to SEQ ID NO: 307780

SEQ ID NO: 606750 - RNA, 64 nt, Homo Sapiens; identical to SEQ ID NO: 307781

SEQ ID NO: 606751 - RNA, 64 nt, Homo Sapiens; identical to SEQ ID NO: 307782

SEQ ID NO: 606752 - RNA, 64 nt, Homo Sapiens; identical to SEQ ID NO: 307783

SEQ ID NO: 606753 - RNA, 64 nt, Homo Sapiens; identical to SEQ ID NO: 307784

SEQ ID NO: 606754 - RNA, 64 nt, Homo Sapiens; identical to SEQ ID NO: 307785

SEQ ID NO: 606755 - RNA, 64 nt, Homo Sapiens; identical to SEQ ID NO: 307786

SEQ ID NO: 606756 - RNA, 64 nt, Homo Sapiens; identical to SEQ ID NO: 307787

SEQ ID NO: 606757 - RNA, 64 nt, Homo Sapiens; identical to SEQ ID NO: 307788

SEQ ID NO: 606758 - RNA, 64 nt, Homo Sapiens; identical to SEQ ID NO: 307789

SEQ ID NO: 606759 - RNA, 64 nt, Homo Sapiens; identical to SEQ ID NO: 307790

SEQ ID NO: 606760 - RNA, 64 nt, Homo Sapiens; identical to SEQ ID NO: 307791

SEQ ID NO: 606761 - RNA, 64 nt, Homo Sapiens; identical to SEQ ID NO: 307792

SEQ ID NO: 606762 - RNA, 64 nt, Homo Sapiens; identical to SEQ ID NO: 307793

SEQ ID NO: 606763 - RNA, 64 nt, Homo Sapiens; identical to SEQ ID NO: 307794

SEQ ID NO: 606764 - RNA, 64 nt, Homo Sapiens; identical to SEQ ID NO: 307795

SEQ ID NO: 606765 - RNA, 64 nt, Homo Sapiens; identical to SEQ ID NO: 307796

SEQ ID NO: 606766 - RNA, 62 nt, Homo Sapiens; identical to SEQ ID NO: 307797

SEQ ID NO: 606767 - RNA, 64 nt, Homo Sapiens; identical to SEQ ID NO: 307798

SEQ ID NO: 606768 - RNA, 64 nt, Homo Sapiens; identical to SEQ ID NO: 307799

SEQ ID NO: 606769 - RNA, 64 nt, Homo Sapiens; identical to SEQ ID NO: 307800

SEQ ID NO: 606770 - RNA, 64 nt, Homo Sapiens; identical to SEQ ID NO: 307801

SEQ ID NO: 606771 - RNA, 64 nt, Homo Sapiens; identical to SEQ ID NO: 307802

SEQ ID NO: 606772 - RNA, 64 nt, Homo Sapiens; identical to SEQ ID NO: 307803

SEQ ID NO: 606773 - RNA, 64 nt, Homo Sapiens; identical to SEQ ID NO: 307804

SEQ ID NO: 606774 - RNA, 64 nt, Homo Sapiens; identical to SEQ ID NO: 307805

SEQ ID NO: 606775 - RNA, 64 nt, Homo Sapiens; identical to SEQ ID NO: 307806

SEQ ID NO: 606776 - RNA, 64 nt, Homo Sapiens; identical to SEQ ID NO: 307807

SEQ ID NO: 606777 - RNA, 64 nt, Homo Sapiens; identical to SEQ ID NO: 307808

SEQ ID NO: 606778 - RNA, 64 nt, Homo Sapiens; identical to SEQ ID NO: 307809

SEQ ID NO: 606779 - RNA, 64 nt, Homo Sapiens
acaaaggcucaccugguauucaggggguuuaaauggagaucagaugcaacugcucuaggcugug

SEQ ID NO: 606780 - RNA, 64 nt, Homo Sapiens
gaaagccaaguggccaagucaaagaacuacauugggagaucagagggucacauuuacaacugga

SEQ ID NO: 606781 - RNA, 64 nt, Homo Sapiens
gcgaccugcacgcacugcguucccucccgggagaggagaucaggcggagagggcugcgagcauu

SEQ ID NO: 606782 - RNA, 64 nt, Homo Sapiens
gcaacucggagagggcugcgcuccugggagagaaggagaucaggcccagagaggggacauuucc

SEQ ID NO: 606783 - RNA, 64 nt, Homo Sapiens; identical to SEQ ID NO: 112922

SEQ ID NO: 606784 - RNA, 64 nt, Homo Sapiens; identical to SEQ ID NO: 112923

SEQ ID NO: 606785 - RNA, 64 nt, Homo Sapiens; identical to SEQ ID NO: 112924

SEQ ID NO: 606786 - RNA, 64 nt, Homo Sapiens; identical to SEQ ID NO: 112925

SEQ ID NO: 606787 - RNA, 64 nt, Homo Sapiens; identical to SEQ ID NO: 112926

SEQ ID NO: 606788 - RNA, 64 nt, Homo Sapiens; identical to SEQ ID NO: 112927

SEQ ID NO: 606789 - RNA, 64 nt, Homo Sapiens; identical to SEQ ID NO: 112928

SEQ ID NO: 606790 - RNA, 64 nt, Homo Sapiens; identical to SEQ ID NO: 112929

SEQ ID NO: 606791 - RNA, 64 nt, Homo Sapiens; identical to SEQ ID NO: 112930

SEQ ID NO: 606792 - RNA, 64 nt, Homo Sapiens; identical to SEQ ID NO: 112931

SEQ ID NO: 606793 - RNA, 64 nt, Homo Sapiens; identical to SEQ ID NO: 112932

SEQ ID NO: 606794 - RNA, 64 nt, Homo Sapiens; identical to SEQ ID NO: 112933

SEQ ID NO: 606795 - RNA, 64 nt, Homo Sapiens; identical to SEQ ID NO: 112934

SEQ ID NO: 606796 - RNA, 64 nt, Homo Sapiens; identical to SEQ ID NO: 112935

SEQ ID NO: 606797 - RNA, 64 nt, Homo Sapiens; identical to SEQ ID NO: 112936

SEQ ID NO: 606798 - RNA, 64 nt, Homo Sapiens; identical to SEQ ID NO: 112937

SEQ ID NO: 606799 - RNA, 64 nt, Homo Sapiens; identical to SEQ ID NO: 112938

SEQ ID NO: 606800 - RNA, 64 nt, Homo Sapiens; identical to SEQ ID NO: 112939

SEQ ID NO: 606801 - RNA, 64 nt, Homo Sapiens; identical to SEQ ID NO: 112940

SEQ ID NO: 606802 - RNA, 64 nt, Homo Sapiens; identical to SEQ ID NO: 112941

SEQ ID NO: 606803 - RNA, 64 nt, Homo Sapiens; identical to SEQ ID NO: 112942

SEQ ID NO: 606804 - RNA, 64 nt, Homo Sapiens; identical to SEQ ID NO: 112943

SEQ ID NO: 606805 - RNA, 64 nt, Homo Sapiens; identical to SEQ ID NO: 112944

SEQ ID NO: 606806 - RNA, 64 nt, Homo Sapiens; identical to SEQ ID NO: 112945

SEQ ID NO: 606807 - RNA, 64 nt, Homo Sapiens; identical to SEQ ID NO: 112946

SEQ ID NO: 606808 - RNA, 64 nt, Homo Sapiens; identical to SEQ ID NO: 112947

SEQ ID NO: 606809 - RNA, 64 nt, Homo Sapiens; identical to SEQ ID NO: 112948

SEQ ID NO: 606810 - RNA, 64 nt, Homo Sapiens; identical to SEQ ID NO: 112949

SEQ ID NO: 606811 - RNA, 64 nt, Homo Sapiens; identical to SEQ ID NO: 112950

SEQ ID NO: 606812 - RNA, 64 nt, Homo Sapiens; identical to SEQ ID NO: 112951

SEQ ID NO: 606813 - RNA, 64 nt, Homo Sapiens; identical to SEQ ID NO: 112952

SEQ ID NO: 606814 - RNA, 64 nt, Homo Sapiens; identical to SEQ ID NO: 112953

SEQ ID NO: 606815 - RNA, 64 nt, Homo Sapiens; identical to SEQ ID NO: 112954

SEQ ID NO: 606816 - RNA, 50 nt, Homo Sapiens; identical to SEQ ID NO: 112955

SEQ ID NO: 606817 - RNA, 64 nt, Homo Sapiens; identical to SEQ ID NO: 112956

SEQ ID NO: 606818 - RNA, 64 nt, Homo Sapiens; identical to SEQ ID NO: 112957

SEQ ID NO: 606819 - RNA, 64 nt, Homo Sapiens; identical to SEQ ID NO: 112958

SEQ ID NO: 606820 - RNA, 64 nt, Homo Sapiens; identical to SEQ ID NO: 112959

SEQ ID NO: 606821 - RNA, 64 nt, Homo Sapiens; identical to SEQ ID NO: 112960

SEQ ID NO: 606822 - RNA, 64 nt, Homo Sapiens; identical to SEQ ID NO: 112961

SEQ ID NO: 606823 - RNA, 64 nt, Homo Sapiens; identical to SEQ ID NO: 218966

SEQ ID NO: 606824 - RNA, 64 nt, Homo Sapiens; identical to SEQ ID NO: 218967

SEQ ID NO: 606825 - RNA, 64 nt, Homo Sapiens; identical to SEQ ID NO: 218968

SEQ ID NO: 606826 - RNA, 64 nt, Homo Sapiens; identical to SEQ ID NO: 218969

SEQ ID NO: 606827 - RNA, 64 nt, Homo Sapiens; identical to SEQ ID NO: 218970

SEQ ID NO: 606828 - RNA, 64 nt, Homo Sapiens; identical to SEQ ID NO: 218971

SEQ ID NO: 606829 - RNA, 64 nt, Homo Sapiens; identical to SEQ ID NO: 218972

SEQ ID NO: 606830 - RNA, 64 nt, Homo Sapiens; identical to SEQ ID NO: 218973

SEQ ID NO: 606831 - RNA, 64 nt, Homo Sapiens; identical to SEQ ID NO: 218974

SEQ ID NO: 606832 - RNA, 64 nt, Homo Sapiens; identical to SEQ ID NO: 218975

SEQ ID NO: 606833 - RNA, 64 nt, Homo Sapiens; identical to SEQ ID NO: 218976

SEQ ID NO: 606834 - RNA, 64 nt, Homo Sapiens; identical to SEQ ID NO: 218977

SEQ ID NO: 606835 - RNA, 64 nt, Homo Sapiens; identical to SEQ ID NO: 218978

SEQ ID NO: 606836 - RNA, 64 nt, Homo Sapiens; identical to SEQ ID NO: 218979

SEQ ID NO: 606837 - RNA, 64 nt, Homo Sapiens; identical to SEQ ID NO: 218980

SEQ ID NO: 606838 - RNA, 64 nt, Homo Sapiens; identical to SEQ ID NO: 218981

SEQ ID NO: 606839 - RNA, 64 nt, Homo Sapiens; identical to SEQ ID NO: 218982

SEQ ID NO: 606840 - RNA, 64 nt, Homo Sapiens; identical to SEQ ID NO: 218983

SEQ ID NO: 606841 - RNA, 64 nt, Homo Sapiens; identical to SEQ ID NO: 218984

SEQ ID NO: 606842 - RNA, 64 nt, Homo Sapiens; identical to SEQ ID NO: 218985

SEQ ID NO: 606843 - RNA, 64 nt, Homo Sapiens; identical to SEQ ID NO: 218986

SEQ ID NO: 606844 - RNA, 64 nt, Homo Sapiens; identical to SEQ ID NO: 218987

SEQ ID NO: 606845 - RNA, 64 nt, Homo Sapiens; identical to SEQ ID NO: 218988

SEQ ID NO: 606846 - RNA, 64 nt, Homo Sapiens; identical to SEQ ID NO: 218989

SEQ ID NO: 606847 - RNA, 64 nt, Homo Sapiens; identical to SEQ ID NO: 218990

SEQ ID NO: 606848 - RNA, 64 nt, Homo Sapiens; identical to SEQ ID NO: 218991

SEQ ID NO: 606849 - RNA, 64 nt, Homo Sapiens; identical to SEQ ID NO: 218992

SEQ ID NO: 606850 - RNA, 64 nt, Homo Sapiens; identical to SEQ ID NO: 218993

SEQ ID NO: 606851 - RNA, 64 nt, Homo Sapiens; identical to SEQ ID NO: 218994

SEQ ID NO: 606852 - RNA, 64 nt, Homo Sapiens; identical to SEQ ID NO: 218995

SEQ ID NO: 606853 - RNA, 64 nt, Homo Sapiens; identical to SEQ ID NO: 218996

SEQ ID NO: 606854 - RNA, 64 nt, Homo Sapiens; identical to SEQ ID NO: 59958

SEQ ID NO: 606855 - RNA, 64 nt, Homo Sapiens; identical to SEQ ID NO: 59959

SEQ ID NO: 606856 - RNA, 64 nt, Homo Sapiens; identical to SEQ ID NO: 59960

SEQ ID NO: 606857 - RNA, 64 nt, Homo Sapiens; identical to SEQ ID NO: 59961

SEQ ID NO: 606858 - RNA, 64 nt, Homo Sapiens; identical to SEQ ID NO: 59962

SEQ ID NO: 606859 - RNA, 64 nt, Homo Sapiens; identical to SEQ ID NO: 59963

SEQ ID NO: 606860 - RNA, 64 nt, Homo Sapiens; identical to SEQ ID NO: 59964

SEQ ID NO: 606861 - RNA, 64 nt, Homo Sapiens; identical to SEQ ID NO: 59965

SEQ ID NO: 606862 - RNA, 64 nt, Homo Sapiens; identical to SEQ ID NO: 59966

SEQ ID NO: 606863 - RNA, 64 nt, Homo Sapiens; identical to SEQ ID NO: 59967

SEQ ID NO: 606864 - RNA, 64 nt, Homo Sapiens; identical to SEQ ID NO: 59968

SEQ ID NO: 606865 - RNA, 64 nt, Homo Sapiens; identical to SEQ ID NO: 59969

SEQ ID NO: 606866 - RNA, 64 nt, Homo Sapiens; identical to SEQ ID NO: 59970

SEQ ID NO: 606867 - RNA, 64 nt, Homo Sapiens; identical to SEQ ID NO: 59971

SEQ ID NO: 606868 - RNA, 64 nt, Homo Sapiens; identical to SEQ ID NO: 59972

SEQ ID NO: 606869 - RNA, 64 nt, Homo Sapiens; identical to SEQ ID NO: 59973

SEQ ID NO: 606870 - RNA, 64 nt, Homo Sapiens; identical to SEQ ID NO: 59974

SEQ ID NO: 606871 - RNA, 64 nt, Homo Sapiens; identical to SEQ ID NO: 59975

SEQ ID NO: 606872 - RNA, 64 nt, Homo Sapiens; identical to SEQ ID NO: 59976

SEQ ID NO: 606873 - RNA, 64 nt, Homo Sapiens; identical to SEQ ID NO: 59977

SEQ ID NO: 606874 - RNA, 64 nt, Homo Sapiens; identical to SEQ ID NO: 59978

SEQ ID NO: 606875 - RNA, 64 nt, Homo Sapiens; identical to SEQ ID NO: 59979

SEQ ID NO: 606876 - RNA, 64 nt, Homo Sapiens; identical to SEQ ID NO: 59980

SEQ ID NO: 606877 - RNA, 64 nt, Homo Sapiens; identical to SEQ ID NO: 59981

SEQ ID NO: 606878 - RNA, 64 nt, Homo Sapiens; identical to SEQ ID NO: 59982

SEQ ID NO: 606879 - RNA, 64 nt, Homo Sapiens; identical to SEQ ID NO: 59983

SEQ ID NO: 606880 - RNA, 64 nt, Homo Sapiens; identical to SEQ ID NO: 59984

SEQ ID NO: 606881 - RNA, 64 nt, Homo Sapiens; identical to SEQ ID NO: 59985

SEQ ID NO: 606882 - RNA, 64 nt, Homo Sapiens; identical to SEQ ID NO: 59986

SEQ ID NO: 606883 - RNA, 64 nt, Homo Sapiens; identical to SEQ ID NO: 59987

SEQ ID NO: 606884 - RNA, 64 nt, Homo Sapiens; identical to SEQ ID NO: 59988

SEQ ID NO: 606885 - RNA, 64 nt, Homo Sapiens; identical to SEQ ID NO: 59989

SEQ ID NO: 606886 - RNA, 64 nt, Homo Sapiens; identical to SEQ ID NO: 59990

SEQ ID NO: 606887 - RNA, 64 nt, Homo Sapiens; identical to SEQ ID NO: 59991

SEQ ID NO: 606888 - RNA, 64 nt, Homo Sapiens; identical to SEQ ID NO: 59992

SEQ ID NO: 606889 - RNA, 64 nt, Homo Sapiens; identical to SEQ ID NO: 59993

SEQ ID NO: 606890 - RNA, 64 nt, Homo Sapiens; identical to SEQ ID NO: 59994

SEQ ID NO: 606891 - RNA, 64 nt, Homo Sapiens; identical to SEQ ID NO: 59995

SEQ ID NO: 606892 - RNA, 64 nt, Homo Sapiens; identical to SEQ ID NO: 59996

SEQ ID NO: 606893 - RNA, 64 nt, Homo Sapiens; identical to SEQ ID NO: 59997

SEQ ID NO: 606894 - RNA, 64 nt, Homo Sapiens; identical to SEQ ID NO: 59998

SEQ ID NO: 606895 - RNA, 64 nt, Homo Sapiens; identical to SEQ ID NO: 59999

SEQ ID NO: 606896 - RNA, 64 nt, Homo Sapiens; identical to SEQ ID NO: 60000

SEQ ID NO: 606897 - RNA, 64 nt, Homo Sapiens; identical to SEQ ID NO: 60001

SEQ ID NO: 606898 - RNA, 64 nt, Homo Sapiens; identical to SEQ ID NO: 60002

SEQ ID NO: 606899 - RNA, 64 nt, Homo Sapiens; identical to SEQ ID NO: 60003

SEQ ID NO: 606900 - RNA, 64 nt, Homo Sapiens; identical to SEQ ID NO: 60004

SEQ ID NO: 606901 - RNA, 64 nt, Homo Sapiens; identical to SEQ ID NO: 60005

SEQ ID NO: 606902 - RNA, 64 nt, Homo Sapiens; identical to SEQ ID NO: 60006

SEQ ID NO: 606903 - RNA, 64 nt, Homo Sapiens; identical to SEQ ID NO: 60007

SEQ ID NO: 606904 - RNA, 64 nt, Homo Sapiens; identical to SEQ ID NO: 60008

SEQ ID NO: 606905 - RNA, 64 nt, Homo Sapiens; identical to SEQ ID NO: 60009

SEQ ID NO: 606906 - RNA, 64 nt, Homo Sapiens; identical to SEQ ID NO: 60010

SEQ ID NO: 606907 - RNA, 64 nt, Homo Sapiens; identical to SEQ ID NO: 60011

SEQ ID NO: 606908 - RNA, 64 nt, Homo Sapiens; identical to SEQ ID NO: 79907

SEQ ID NO: 606909 - RNA, 64 nt, Homo Sapiens; identical to SEQ ID NO: 79908

SEQ ID NO: 606910 - RNA, 64 nt, Homo Sapiens; identical to SEQ ID NO: 82601

SEQ ID NO: 606911 - RNA, 64 nt, Homo Sapiens; identical to SEQ ID NO: 82602

SEQ ID NO: 606912 - RNA, 64 nt, Homo Sapiens; identical to SEQ ID NO: 82603

SEQ ID NO: 606913 - RNA, 64 nt, Homo Sapiens; identical to SEQ ID NO: 82604

SEQ ID NO: 606914 - RNA, 64 nt, Homo Sapiens; identical to SEQ ID NO: 82605

SEQ ID NO: 606915 - RNA, 64 nt, Homo Sapiens; identical to SEQ ID NO: 82606

SEQ ID NO: 606916 - RNA, 64 nt, Homo Sapiens; identical to SEQ ID NO: 82607

SEQ ID NO: 606917 - RNA, 64 nt, Homo Sapiens; identical to SEQ ID NO: 82608

SEQ ID NO: 606918 - RNA, 64 nt, Homo Sapiens; identical to SEQ ID NO: 82609

SEQ ID NO: 606919 - RNA, 64 nt, Homo Sapiens; identical to SEQ ID NO: 82610

SEQ ID NO: 606920 - RNA, 64 nt, Homo Sapiens; identical to SEQ ID NO: 82611

SEQ ID NO: 606921 - RNA, 64 nt, Homo Sapiens; identical to SEQ ID NO: 82612

SEQ ID NO: 606922 - RNA, 64 nt, Homo Sapiens; identical to SEQ ID NO: 82613

SEQ ID NO: 606923 - RNA, 64 nt, Homo Sapiens; identical to SEQ ID NO: 82614

SEQ ID NO: 606924 - RNA, 64 nt, Homo Sapiens; identical to SEQ ID NO: 82615

SEQ ID NO: 606925 - RNA, 64 nt, Homo Sapiens; identical to SEQ ID NO: 82616

SEQ ID NO: 606926 - RNA, 64 nt, Homo Sapiens; identical to SEQ ID NO: 82617

SEQ ID NO: 606927 - RNA, 64 nt, Homo Sapiens; identical to SEQ ID NO: 82618

SEQ ID NO: 606928 - RNA, 64 nt, Homo Sapiens; identical to SEQ ID NO: 82619

SEQ ID NO: 606929 - RNA, 64 nt, Homo Sapiens; identical to SEQ ID NO: 82620

SEQ ID NO: 606930 - RNA, 64 nt, Homo Sapiens; identical to SEQ ID NO: 82621

SEQ ID NO: 606931 - RNA, 64 nt, Homo Sapiens; identical to SEQ ID NO: 82622

SEQ ID NO: 606932 - RNA, 64 nt, Homo Sapiens; identical to SEQ ID NO: 82623

SEQ ID NO: 606933 - RNA, 64 nt, Homo Sapiens; identical to SEQ ID NO: 82624

SEQ ID NO: 606934 - RNA, 64 nt, Homo Sapiens; identical to SEQ ID NO: 82625

SEQ ID NO: 606935 - RNA, 64 nt, Homo Sapiens; identical to SEQ ID NO: 82626

SEQ ID NO: 606936 - RNA, 64 nt, Homo Sapiens; identical to SEQ ID NO: 82627

SEQ ID NO: 606937 - RNA, 64 nt, Homo Sapiens; identical to SEQ ID NO: 82628

SEQ ID NO: 606938 - RNA, 64 nt, Homo Sapiens; identical to SEQ ID NO: 82629

SEQ ID NO: 606939 - RNA, 64 nt, Homo Sapiens; identical to SEQ ID NO: 82630

SEQ ID NO: 606940 - RNA, 64 nt, Homo Sapiens; identical to SEQ ID NO: 82631

SEQ ID NO: 606941 - RNA, 64 nt, Homo Sapiens; identical to SEQ ID NO: 82632

SEQ ID NO: 606942 - RNA, 64 nt, Homo Sapiens; identical to SEQ ID NO: 82633

SEQ ID NO: 606943 - RNA, 64 nt, Homo Sapiens; identical to SEQ ID NO: 82634

SEQ ID NO: 606944 - RNA, 64 nt, Homo Sapiens; identical to SEQ ID NO: 82635

SEQ ID NO: 606945 - RNA, 64 nt, Homo Sapiens; identical to SEQ ID NO: 82636

SEQ ID NO: 606946 - RNA, 64 nt, Homo Sapiens; identical to SEQ ID NO: 82637

SEQ ID NO: 606947 - RNA, 64 nt, Homo Sapiens; identical to SEQ ID NO: 82638

SEQ ID NO: 606948 - RNA, 64 nt, Homo Sapiens; identical to SEQ ID NO: 82639

SEQ ID NO: 606949 - RNA, 64 nt, Homo Sapiens; identical to SEQ ID NO: 82640

SEQ ID NO: 606950 - RNA, 64 nt, Homo Sapiens; identical to SEQ ID NO: 82641

SEQ ID NO: 606951 - RNA, 64 nt, Homo Sapiens; identical to SEQ ID NO: 82642

SEQ ID NO: 606952 - RNA, 64 nt, Homo Sapiens; identical to SEQ ID NO: 82643

SEQ ID NO: 606953 - RNA, 64 nt, Homo Sapiens; identical to SEQ ID NO: 82644

SEQ ID NO: 606954 - RNA, 64 nt, Homo Sapiens; identical to SEQ ID NO: 82645

SEQ ID NO: 606955 - RNA, 64 nt, Homo Sapiens; identical to SEQ ID NO: 82646

SEQ ID NO: 606956 - RNA, 64 nt, Homo Sapiens; identical to SEQ ID NO: 82647

SEQ ID NO: 606957 - RNA, 64 nt, Homo Sapiens; identical to SEQ ID NO: 82648

SEQ ID NO: 606958 - RNA, 64 nt, Homo Sapiens; identical to SEQ ID NO: 82649

SEQ ID NO: 606959 - RNA, 64 nt, Homo Sapiens; identical to SEQ ID NO: 82650

SEQ ID NO: 606960 - RNA, 64 nt, Homo Sapiens; identical to SEQ ID NO: 82651

SEQ ID NO: 606961 - RNA, 64 nt, Homo Sapiens; identical to SEQ ID NO: 82652

SEQ ID NO: 606962 - RNA, 64 nt, Homo Sapiens; identical to SEQ ID NO: 82653

SEQ ID NO: 606963 - RNA, 64 nt, Homo Sapiens; identical to SEQ ID NO: 82654

SEQ ID NO: 606964 - RNA, 64 nt, Homo Sapiens; identical to SEQ ID NO: 82655

SEQ ID NO: 606965 - RNA, 64 nt, Homo Sapiens; identical to SEQ ID NO: 82656

SEQ ID NO: 606966 - RNA, 64 nt, Homo Sapiens; identical to SEQ ID NO: 82657

SEQ ID NO: 606967 - RNA, 64 nt, Homo Sapiens; identical to SEQ ID NO: 82658

SEQ ID NO: 606968 - RNA, 64 nt, Homo Sapiens; identical to SEQ ID NO: 82659

SEQ ID NO: 606969 - RNA, 64 nt, Homo Sapiens; identical to SEQ ID NO: 82660

SEQ ID NO: 606970 - RNA, 64 nt, Homo Sapiens; identical to SEQ ID NO: 82661

SEQ ID NO: 606971 - RNA, 64 nt, Homo Sapiens; identical to SEQ ID NO: 82662

SEQ ID NO: 606972 - RNA, 64 nt, Homo Sapiens; identical to SEQ ID NO: 82663

SEQ ID NO: 606973 - RNA, 64 nt, Homo Sapiens; identical to SEQ ID NO: 82664

SEQ ID NO: 606974 - RNA, 64 nt, Homo Sapiens; identical to SEQ ID NO: 82665

SEQ ID NO: 606975 - RNA, 64 nt, Homo Sapiens; identical to SEQ ID NO: 82666

SEQ ID NO: 606976 - RNA, 64 nt, Homo Sapiens; identical to SEQ ID NO: 82667

SEQ ID NO: 606977 - RNA, 64 nt, Homo Sapiens; identical to SEQ ID NO: 82668

SEQ ID NO: 606978 - RNA, 64 nt, Homo Sapiens; identical to SEQ ID NO: 82669

SEQ ID NO: 606979 - RNA, 64 nt, Homo Sapiens; identical to SEQ ID NO: 82670

SEQ ID NO: 606980 - RNA, 64 nt, Homo Sapiens; identical to SEQ ID NO: 82671

SEQ ID NO: 606981 - RNA, 64 nt, Homo Sapiens; identical to SEQ ID NO: 82672

SEQ ID NO: 606982 - RNA, 64 nt, Homo Sapiens; identical to SEQ ID NO: 82673

SEQ ID NO: 606983 - RNA, 64 nt, Homo Sapiens; identical to SEQ ID NO: 82674

SEQ ID NO: 606984 - RNA, 64 nt, Homo Sapiens; identical to SEQ ID NO: 82675

SEQ ID NO: 606985 - RNA, 64 nt, Homo Sapiens; identical to SEQ ID NO: 82676

SEQ ID NO: 606986 - RNA, 64 nt, Homo Sapiens; identical to SEQ ID NO: 82677

SEQ ID NO: 606987 - RNA, 64 nt, Homo Sapiens; identical to SEQ ID NO: 155383

SEQ ID NO: 606988 - RNA, 64 nt, Homo Sapiens; identical to SEQ ID NO: 155384

SEQ ID NO: 606989 - RNA, 64 nt, Homo Sapiens; identical to SEQ ID NO: 155385

SEQ ID NO: 606990 - RNA, 64 nt, Homo Sapiens; identical to SEQ ID NO: 155386

SEQ ID NO: 606991 - RNA, 64 nt, Homo Sapiens; identical to SEQ ID NO: 155387

SEQ ID NO: 606992 - RNA, 64 nt, Homo Sapiens; identical to SEQ ID NO: 155388

SEQ ID NO: 606993 - RNA, 64 nt, Homo Sapiens; identical to SEQ ID NO: 155389

SEQ ID NO: 606994 - RNA, 64 nt, Homo Sapiens; identical to SEQ ID NO: 155390

SEQ ID NO: 606995 - RNA, 64 nt, Homo Sapiens; identical to SEQ ID NO: 155391

SEQ ID NO: 606996 - RNA, 64 nt, Homo Sapiens; identical to SEQ ID NO: 155392

SEQ ID NO: 606997 - RNA, 64 nt, Homo Sapiens; identical to SEQ ID NO: 155393

SEQ ID NO: 606998 - RNA, 64 nt, Homo Sapiens; identical to SEQ ID NO: 155394

SEQ ID NO: 606999 - RNA, 64 nt, Homo Sapiens; identical to SEQ ID NO: 155395

SEQ ID NO: 607000 - RNA, 64 nt, Homo Sapiens; identical to SEQ ID NO: 155396

SEQ ID NO: 607001 - RNA, 64 nt, Homo Sapiens; identical to SEQ ID NO: 155397

SEQ ID NO: 607002 - RNA, 64 nt, Homo Sapiens; identical to SEQ ID NO: 155398

SEQ ID NO: 607003 - RNA, 64 nt, Homo Sapiens; identical to SEQ ID NO: 155399

SEQ ID NO: 607004 - RNA, 64 nt, Homo Sapiens; identical to SEQ ID NO: 155400

SEQ ID NO: 607005 - RNA, 64 nt, Homo Sapiens; identical to SEQ ID NO: 155401

SEQ ID NO: 607006 - RNA, 64 nt, Homo Sapiens; identical to SEQ ID NO: 155402

SEQ ID NO: 607007 - RNA, 64 nt, Homo Sapiens; identical to SEQ ID NO: 155403

SEQ ID NO: 607008 - RNA, 64 nt, Homo Sapiens; identical to SEQ ID NO: 155404

SEQ ID NO: 607009 - RNA, 64 nt, Homo Sapiens; identical to SEQ ID NO: 155405

SEQ ID NO: 607010 - RNA, 64 nt, Homo Sapiens; identical to SEQ ID NO: 155406

SEQ ID NO: 607011 - RNA, 64 nt, Homo Sapiens; identical to SEQ ID NO: 155407

SEQ ID NO: 607012 - RNA, 64 nt, Homo Sapiens; identical to SEQ ID NO: 155408

SEQ ID NO: 607013 - RNA, 64 nt, Homo Sapiens; identical to SEQ ID NO: 155409

SEQ ID NO: 607014 - RNA, 64 nt, Homo Sapiens; identical to SEQ ID NO: 155410

SEQ ID NO: 607015 - RNA, 64 nt, Homo Sapiens; identical to SEQ ID NO: 155411

SEQ ID NO: 607016 - RNA, 64 nt, Homo Sapiens; identical to SEQ ID NO: 155412

SEQ ID NO: 607017 - RNA, 64 nt, Homo Sapiens; identical to SEQ ID NO: 155413

SEQ ID NO: 607018 - RNA, 64 nt, Homo Sapiens; identical to SEQ ID NO: 155414

SEQ ID NO: 607019 - RNA, 64 nt, Homo Sapiens; identical to SEQ ID NO: 155415

SEQ ID NO: 607020 - RNA, 64 nt, Homo Sapiens; identical to SEQ ID NO: 155416

SEQ ID NO: 607021 - RNA, 64 nt, Homo Sapiens; identical to SEQ ID NO: 155417

SEQ ID NO: 607022 - RNA, 64 nt, Homo Sapiens; identical to SEQ ID NO: 155418

SEQ ID NO: 607023 - RNA, 64 nt, Homo Sapiens; identical to SEQ ID NO: 155419

SEQ ID NO: 607024 - RNA, 64 nt, Homo Sapiens; identical to SEQ ID NO: 155420

SEQ ID NO: 607025 - RNA, 64 nt, Homo Sapiens; identical to SEQ ID NO: 155421

SEQ ID NO: 607026 - RNA, 64 nt, Homo Sapiens; identical to SEQ ID NO: 155422

SEQ ID NO: 607027 - RNA, 64 nt, Homo Sapiens; identical to SEQ ID NO: 155423

SEQ ID NO: 607028 - RNA, 64 nt, Homo Sapiens; identical to SEQ ID NO: 155424

SEQ ID NO: 607029 - RNA, 64 nt, Homo Sapiens; identical to SEQ ID NO: 155425

SEQ ID NO: 607030 - RNA, 64 nt, Homo Sapiens; identical to SEQ ID NO: 155426

SEQ ID NO: 607031 - RNA, 64 nt, Homo Sapiens; identical to SEQ ID NO: 155427

SEQ ID NO: 607032 - RNA, 64 nt, Homo Sapiens; identical to SEQ ID NO: 155428

SEQ ID NO: 607033 - RNA, 64 nt, Homo Sapiens; identical to SEQ ID NO: 155429

SEQ ID NO: 607034 - RNA, 64 nt, Homo Sapiens; identical to SEQ ID NO: 155430

SEQ ID NO: 607035 - RNA, 64 nt, Homo Sapiens; identical to SEQ ID NO: 155431

SEQ ID NO: 607036 - RNA, 64 nt, Homo Sapiens; identical to SEQ ID NO: 155432

SEQ ID NO: 607037 - RNA, 64 nt, Homo Sapiens; identical to SEQ ID NO: 155433

SEQ ID NO: 607038 - RNA, 64 nt, Homo Sapiens; identical to SEQ ID NO: 155434

SEQ ID NO: 607039 - RNA, 64 nt, Homo Sapiens; identical to SEQ ID NO: 155435

SEQ ID NO: 607040 - RNA, 64 nt, Homo Sapiens; identical to SEQ ID NO: 155436

SEQ ID NO: 607041 - RNA, 64 nt, Homo Sapiens; identical to SEQ ID NO: 155437

SEQ ID NO: 607042 - RNA, 64 nt, Homo Sapiens; identical to SEQ ID NO: 155438

SEQ ID NO: 607043 - RNA, 64 nt, Homo Sapiens; identical to SEQ ID NO: 155439

SEQ ID NO: 607044 - RNA, 64 nt, Homo Sapiens; identical to SEQ ID NO: 155440

SEQ ID NO: 607045 - RNA, 64 nt, Homo Sapiens; identical to SEQ ID NO: 155441

SEQ ID NO: 607046 - RNA, 64 nt, Homo Sapiens; identical to SEQ ID NO: 155442

SEQ ID NO: 607047 - RNA, 64 nt, Homo Sapiens; identical to SEQ ID NO: 155443

SEQ ID NO: 607048 - RNA, 64 nt, Homo Sapiens; identical to SEQ ID NO: 155444

SEQ ID NO: 607049 - RNA, 64 nt, Homo Sapiens; identical to SEQ ID NO: 155445

SEQ ID NO: 607050 - RNA, 64 nt, Homo Sapiens; identical to SEQ ID NO: 155446

SEQ ID NO: 607051 - RNA, 64 nt, Homo Sapiens; identical to SEQ ID NO: 155447

SEQ ID NO: 607052 - RNA, 64 nt, Homo Sapiens; identical to SEQ ID NO: 155448

SEQ ID NO: 607053 - RNA, 64 nt, Homo Sapiens; identical to SEQ ID NO: 155449

SEQ ID NO: 607054 - RNA, 64 nt, Homo Sapiens; identical to SEQ ID NO: 155450

SEQ ID NO: 607055 - RNA, 64 nt, Homo Sapiens; identical to SEQ ID NO: 155451

SEQ ID NO: 607056 - RNA, 64 nt, Homo Sapiens; identical to SEQ ID NO: 155452

SEQ ID NO: 607057 - RNA, 64 nt, Homo Sapiens; identical to SEQ ID NO: 155453

SEQ ID NO: 607058 - RNA, 64 nt, Homo Sapiens; identical to SEQ ID NO: 155454

SEQ ID NO: 607059 - RNA, 64 nt, Homo Sapiens; identical to SEQ ID NO: 155455

SEQ ID NO: 607060 - RNA, 64 nt, Homo Sapiens; identical to SEQ ID NO: 155456

SEQ ID NO: 607061 - RNA, 64 nt, Homo Sapiens; identical to SEQ ID NO: 155457

SEQ ID NO: 607062 - RNA, 64 nt, Homo Sapiens; identical to SEQ ID NO: 155458

SEQ ID NO: 607063 - RNA, 64 nt, Homo Sapiens; identical to SEQ ID NO: 155459

SEQ ID NO: 607064 - RNA, 64 nt, Homo Sapiens; identical to SEQ ID NO: 155460

SEQ ID NO: 607065 - RNA, 64 nt, Homo Sapiens; identical to SEQ ID NO: 155461

SEQ ID NO: 607066 - RNA, 64 nt, Homo Sapiens; identical to SEQ ID NO: 155462

SEQ ID NO: 607067 - RNA, 64 nt, Homo Sapiens; identical to SEQ ID NO: 155463

SEQ ID NO: 607068 - RNA, 64 nt, Homo Sapiens; identical to SEQ ID NO: 155464

SEQ ID NO: 607069 - RNA, 64 nt, Homo Sapiens; identical to SEQ ID NO: 155465

SEQ ID NO: 607070 - RNA, 64 nt, Homo Sapiens; identical to SEQ ID NO: 155466

SEQ ID NO: 607071 - RNA, 64 nt, Homo Sapiens; identical to SEQ ID NO: 155467

SEQ ID NO: 607072 - RNA, 64 nt, Homo Sapiens; identical to SEQ ID NO: 155468

SEQ ID NO: 607073 - RNA, 64 nt, Homo Sapiens; identical to SEQ ID NO: 155469

SEQ ID NO: 607074 - RNA, 64 nt, Homo Sapiens; identical to SEQ ID NO: 155470

SEQ ID NO: 607075 - RNA, 64 nt, Homo Sapiens; identical to SEQ ID NO: 155471

SEQ ID NO: 607076 - RNA, 64 nt, Homo Sapiens; identical to SEQ ID NO: 155472

SEQ ID NO: 607077 - RNA, 64 nt, Homo Sapiens; identical to SEQ ID NO: 155473

SEQ ID NO: 607078 - RNA, 64 nt, Homo Sapiens; identical to SEQ ID NO: 155474

SEQ ID NO: 607079 - RNA, 64 nt, Homo Sapiens; identical to SEQ ID NO: 155475

SEQ ID NO: 607080 - RNA, 64 nt, Homo Sapiens; identical to SEQ ID NO: 155476

SEQ ID NO: 607081 - RNA, 64 nt, Homo Sapiens; identical to SEQ ID NO: 155477

SEQ ID NO: 607082 - RNA, 64 nt, Homo Sapiens; identical to SEQ ID NO: 155478

SEQ ID NO: 607083 - RNA, 64 nt, Homo Sapiens; identical to SEQ ID NO: 155479

SEQ ID NO: 607084 - RNA, 64 nt, Homo Sapiens; identical to SEQ ID NO: 155480

SEQ ID NO: 607085 - RNA, 64 nt, Homo Sapiens; identical to SEQ ID NO: 155481

SEQ ID NO: 607086 - RNA, 64 nt, Homo Sapiens; identical to SEQ ID NO: 155482

SEQ ID NO: 607087 - RNA, 64 nt, Homo Sapiens; identical to SEQ ID NO: 155483

SEQ ID NO: 607088 - RNA, 64 nt, Homo Sapiens; identical to SEQ ID NO: 155484

SEQ ID NO: 607089 - RNA, 64 nt, Homo Sapiens; identical to SEQ ID NO: 155485

SEQ ID NO: 607090 - RNA, 64 nt, Homo Sapiens; identical to SEQ ID NO: 155486

SEQ ID NO: 607091 - RNA, 64 nt, Homo Sapiens; identical to SEQ ID NO: 155487

SEQ ID NO: 607092 - RNA, 64 nt, Homo Sapiens; identical to SEQ ID NO: 155488

SEQ ID NO: 607093 - RNA, 64 nt, Homo Sapiens; identical to SEQ ID NO: 82601

SEQ ID NO: 607094 - RNA, 64 nt, Homo Sapiens; identical to SEQ ID NO: 82602

SEQ ID NO: 607095 - RNA, 64 nt, Homo Sapiens; identical to SEQ ID NO: 82603

SEQ ID NO: 607096 - RNA, 64 nt, Homo Sapiens; identical to SEQ ID NO: 82604

SEQ ID NO: 607097 - RNA, 64 nt, Homo Sapiens; identical to SEQ ID NO: 82605

SEQ ID NO: 607098 - RNA, 64 nt, Homo Sapiens; identical to SEQ ID NO: 82606

SEQ ID NO: 607099 - RNA, 64 nt, Homo Sapiens; identical to SEQ ID NO: 82607

SEQ ID NO: 607100 - RNA, 64 nt, Homo Sapiens; identical to SEQ ID NO: 82608

SEQ ID NO: 607101 - RNA, 64 nt, Homo Sapiens; identical to SEQ ID NO: 82609

SEQ ID NO: 607102 - RNA, 64 nt, Homo Sapiens; identical to SEQ ID NO: 82610

SEQ ID NO: 607103 - RNA, 64 nt, Homo Sapiens; identical to SEQ ID NO: 82611

SEQ ID NO: 607104 - RNA, 64 nt, Homo Sapiens; identical to SEQ ID NO: 82612

SEQ ID NO: 607105 - RNA, 64 nt, Homo Sapiens; identical to SEQ ID NO: 82613

SEQ ID NO: 607106 - RNA, 64 nt, Homo Sapiens; identical to SEQ ID NO: 82614

SEQ ID NO: 607107 - RNA, 64 nt, Homo Sapiens; identical to SEQ ID NO: 82615

SEQ ID NO: 607108 - RNA, 64 nt, Homo Sapiens; identical to SEQ ID NO: 82616

SEQ ID NO: 607109 - RNA, 64 nt, Homo Sapiens; identical to SEQ ID NO: 82617

SEQ ID NO: 607110 - RNA, 64 nt, Homo Sapiens; identical to SEQ ID NO: 82618

SEQ ID NO: 607111 - RNA, 64 nt, Homo Sapiens; identical to SEQ ID NO: 82619

SEQ ID NO: 607112 - RNA, 64 nt, Homo Sapiens; identical to SEQ ID NO: 82620

SEQ ID NO: 607113 - RNA, 64 nt, Homo Sapiens; identical to SEQ ID NO: 82621

SEQ ID NO: 607114 - RNA, 64 nt, Homo Sapiens; identical to SEQ ID NO: 82622

SEQ ID NO: 607115 - RNA, 64 nt, Homo Sapiens; identical to SEQ ID NO: 82623

SEQ ID NO: 607116 - RNA, 64 nt, Homo Sapiens; identical to SEQ ID NO: 82624

SEQ ID NO: 607117 - RNA, 64 nt, Homo Sapiens; identical to SEQ ID NO: 82625

SEQ ID NO: 607118 - RNA, 64 nt, Homo Sapiens; identical to SEQ ID NO: 82626

SEQ ID NO: 607119 - RNA, 64 nt, Homo Sapiens; identical to SEQ ID NO: 82627

SEQ ID NO: 607120 - RNA, 64 nt, Homo Sapiens; identical to SEQ ID NO: 82628

SEQ ID NO: 607121 - RNA, 64 nt, Homo Sapiens; identical to SEQ ID NO: 82629

SEQ ID NO: 607122 - RNA, 64 nt, Homo Sapiens; identical to SEQ ID NO: 82630

SEQ ID NO: 607123 - RNA, 64 nt, Homo Sapiens; identical to SEQ ID NO: 82631

SEQ ID NO: 607124 - RNA, 64 nt, Homo Sapiens; identical to SEQ ID NO: 82632

SEQ ID NO: 607125 - RNA, 64 nt, Homo Sapiens; identical to SEQ ID NO: 82633

SEQ ID NO: 607126 - RNA, 64 nt, Homo Sapiens; identical to SEQ ID NO: 82634

SEQ ID NO: 607127 - RNA, 64 nt, Homo Sapiens; identical to SEQ ID NO: 82635

SEQ ID NO: 607128 - RNA, 64 nt, Homo Sapiens; identical to SEQ ID NO: 82636

SEQ ID NO: 607129 - RNA, 64 nt, Homo Sapiens; identical to SEQ ID NO: 82637

SEQ ID NO: 607130 - RNA, 64 nt, Homo Sapiens; identical to SEQ ID NO: 82638

SEQ ID NO: 607131 - RNA, 64 nt, Homo Sapiens; identical to SEQ ID NO: 82639

SEQ ID NO: 607132 - RNA, 64 nt, Homo Sapiens; identical to SEQ ID NO: 82640

SEQ ID NO: 607133 - RNA, 64 nt, Homo Sapiens; identical to SEQ ID NO: 82641

SEQ ID NO: 607134 - RNA, 64 nt, Homo Sapiens; identical to SEQ ID NO: 82642

SEQ ID NO: 607135 - RNA, 64 nt, Homo Sapiens; identical to SEQ ID NO: 82643

SEQ ID NO: 607136 - RNA, 64 nt, Homo Sapiens; identical to SEQ ID NO: 82644

SEQ ID NO: 607137 - RNA, 64 nt, Homo Sapiens; identical to SEQ ID NO: 82645

SEQ ID NO: 607138 - RNA, 64 nt, Homo Sapiens; identical to SEQ ID NO: 82646

SEQ ID NO: 607139 - RNA, 64 nt, Homo Sapiens; identical to SEQ ID NO: 82647

SEQ ID NO: 607140 - RNA, 64 nt, Homo Sapiens; identical to SEQ ID NO: 82648

SEQ ID NO: 607141 - RNA, 64 nt, Homo Sapiens; identical to SEQ ID NO: 82649

SEQ ID NO: 607142 - RNA, 64 nt, Homo Sapiens; identical to SEQ ID NO: 82650

SEQ ID NO: 607143 - RNA, 64 nt, Homo Sapiens; identical to SEQ ID NO: 82651

SEQ ID NO: 607144 - RNA, 64 nt, Homo Sapiens; identical to SEQ ID NO: 82652

SEQ ID NO: 607145 - RNA, 64 nt, Homo Sapiens; identical to SEQ ID NO: 82653

SEQ ID NO: 607146 - RNA, 64 nt, Homo Sapiens; identical to SEQ ID NO: 82654

SEQ ID NO: 607147 - RNA, 64 nt, Homo Sapiens; identical to SEQ ID NO: 82655

SEQ ID NO: 607148 - RNA, 64 nt, Homo Sapiens; identical to SEQ ID NO: 82656

SEQ ID NO: 607149 - RNA, 64 nt, Homo Sapiens; identical to SEQ ID NO: 82657

SEQ ID NO: 607150 - RNA, 64 nt, Homo Sapiens; identical to SEQ ID NO: 82658

SEQ ID NO: 607151 - RNA, 64 nt, Homo Sapiens; identical to SEQ ID NO: 82659

SEQ ID NO: 607152 - RNA, 64 nt, Homo Sapiens; identical to SEQ ID NO: 82660

SEQ ID NO: 607153 - RNA, 64 nt, Homo Sapiens; identical to SEQ ID NO: 82661

SEQ ID NO: 607154 - RNA, 64 nt, Homo Sapiens; identical to SEQ ID NO: 82662

SEQ ID NO: 607155 - RNA, 64 nt, Homo Sapiens; identical to SEQ ID NO: 82663

SEQ ID NO: 607156 - RNA, 64 nt, Homo Sapiens; identical to SEQ ID NO: 82664

SEQ ID NO: 607157 - RNA, 64 nt, Homo Sapiens; identical to SEQ ID NO: 82665

SEQ ID NO: 607158 - RNA, 64 nt, Homo Sapiens; identical to SEQ ID NO: 82666

SEQ ID NO: 607159 - RNA, 64 nt, Homo Sapiens; identical to SEQ ID NO: 82667

SEQ ID NO: 607160 - RNA, 64 nt, Homo Sapiens; identical to SEQ ID NO: 82668

SEQ ID NO: 607161 - RNA, 64 nt, Homo Sapiens; identical to SEQ ID NO: 82669

SEQ ID NO: 607162 - RNA, 64 nt, Homo Sapiens; identical to SEQ ID NO: 82670

SEQ ID NO: 607163 - RNA, 64 nt, Homo Sapiens; identical to SEQ ID NO: 82671

SEQ ID NO: 607164 - RNA, 64 nt, Homo Sapiens; identical to SEQ ID NO: 82672

SEQ ID NO: 607165 - RNA, 64 nt, Homo Sapiens; identical to SEQ ID NO: 82673

SEQ ID NO: 607166 - RNA, 64 nt, Homo Sapiens; identical to SEQ ID NO: 82674

SEQ ID NO: 607167 - RNA, 64 nt, Homo Sapiens; identical to SEQ ID NO: 82675

SEQ ID NO: 607168 - RNA, 64 nt, Homo Sapiens; identical to SEQ ID NO: 82676

SEQ ID NO: 607169 - RNA, 64 nt, Homo Sapiens; identical to SEQ ID NO: 82677

SEQ ID NO: 607170 - RNA, 64 nt, Homo Sapiens; identical to SEQ ID NO: 155383

SEQ ID NO: 607171 - RNA, 64 nt, Homo Sapiens; identical to SEQ ID NO: 155384

SEQ ID NO: 607172 - RNA, 64 nt, Homo Sapiens; identical to SEQ ID NO: 155385

SEQ ID NO: 607173 - RNA, 64 nt, Homo Sapiens; identical to SEQ ID NO: 155386

SEQ ID NO: 607174 - RNA, 64 nt, Homo Sapiens; identical to SEQ ID NO: 155387

SEQ ID NO: 607175 - RNA, 64 nt, Homo Sapiens; identical to SEQ ID NO: 155388

SEQ ID NO: 607176 - RNA, 64 nt, Homo Sapiens; identical to SEQ ID NO: 155389

SEQ ID NO: 607177 - RNA, 64 nt, Homo Sapiens; identical to SEQ ID NO: 155390

SEQ ID NO: 607178 - RNA, 64 nt, Homo Sapiens; identical to SEQ ID NO: 155391

SEQ ID NO: 607179 - RNA, 64 nt, Homo Sapiens; identical to SEQ ID NO: 155392

SEQ ID NO: 607180 - RNA, 64 nt, Homo Sapiens; identical to SEQ ID NO: 155393

SEQ ID NO: 607181 - RNA, 64 nt, Homo Sapiens; identical to SEQ ID NO: 155394

SEQ ID NO: 607182 - RNA, 64 nt, Homo Sapiens; identical to SEQ ID NO: 155395

SEQ ID NO: 607183 - RNA, 64 nt, Homo Sapiens; identical to SEQ ID NO: 155396

SEQ ID NO: 607184 - RNA, 64 nt, Homo Sapiens; identical to SEQ ID NO: 155397

SEQ ID NO: 607185 - RNA, 64 nt, Homo Sapiens; identical to SEQ ID NO: 155398

SEQ ID NO: 607186 - RNA, 64 nt, Homo Sapiens; identical to SEQ ID NO: 155399

SEQ ID NO: 607187 - RNA, 64 nt, Homo Sapiens; identical to SEQ ID NO: 155400

SEQ ID NO: 607188 - RNA, 64 nt, Homo Sapiens; identical to SEQ ID NO: 155401

SEQ ID NO: 607189 - RNA, 64 nt, Homo Sapiens; identical to SEQ ID NO: 155402

SEQ ID NO: 607190 - RNA, 64 nt, Homo Sapiens; identical to SEQ ID NO: 155403

SEQ ID NO: 607191 - RNA, 64 nt, Homo Sapiens; identical to SEQ ID NO: 155404

SEQ ID NO: 607192 - RNA, 64 nt, Homo Sapiens; identical to SEQ ID NO: 155405

SEQ ID NO: 607193 - RNA, 64 nt, Homo Sapiens; identical to SEQ ID NO: 155406

SEQ ID NO: 607194 - RNA, 64 nt, Homo Sapiens; identical to SEQ ID NO: 155407

SEQ ID NO: 607195 - RNA, 64 nt, Homo Sapiens; identical to SEQ ID NO: 155408

SEQ ID NO: 607196 - RNA, 64 nt, Homo Sapiens; identical to SEQ ID NO: 155409

SEQ ID NO: 607197 - RNA, 64 nt, Homo Sapiens; identical to SEQ ID NO: 155410

SEQ ID NO: 607198 - RNA, 64 nt, Homo Sapiens; identical to SEQ ID NO: 155411

SEQ ID NO: 607199 - RNA, 64 nt, Homo Sapiens; identical to SEQ ID NO: 155412

SEQ ID NO: 607200 - RNA, 64 nt, Homo Sapiens; identical to SEQ ID NO: 155413

SEQ ID NO: 607201 - RNA, 64 nt, Homo Sapiens; identical to SEQ ID NO: 155414

SEQ ID NO: 607202 - RNA, 64 nt, Homo Sapiens; identical to SEQ ID NO: 155415

SEQ ID NO: 607203 - RNA, 64 nt, Homo Sapiens; identical to SEQ ID NO: 155416

SEQ ID NO: 607204 - RNA, 64 nt, Homo Sapiens; identical to SEQ ID NO: 155417

SEQ ID NO: 607205 - RNA, 64 nt, Homo Sapiens; identical to SEQ ID NO: 155418

SEQ ID NO: 607206 - RNA, 64 nt, Homo Sapiens; identical to SEQ ID NO: 155419

SEQ ID NO: 607207 - RNA, 64 nt, Homo Sapiens; identical to SEQ ID NO: 155420

SEQ ID NO: 607208 - RNA, 64 nt, Homo Sapiens; identical to SEQ ID NO: 155421

SEQ ID NO: 607209 - RNA, 64 nt, Homo Sapiens; identical to SEQ ID NO: 155422

SEQ ID NO: 607210 - RNA, 64 nt, Homo Sapiens; identical to SEQ ID NO: 155423

SEQ ID NO: 607211 - RNA, 64 nt, Homo Sapiens; identical to SEQ ID NO: 155424

SEQ ID NO: 607212 - RNA, 64 nt, Homo Sapiens; identical to SEQ ID NO: 155425

SEQ ID NO: 607213 - RNA, 64 nt, Homo Sapiens; identical to SEQ ID NO: 155426

SEQ ID NO: 607214 - RNA, 64 nt, Homo Sapiens; identical to SEQ ID NO: 155427

SEQ ID NO: 607215 - RNA, 64 nt, Homo Sapiens; identical to SEQ ID NO: 155428

SEQ ID NO: 607216 - RNA, 64 nt, Homo Sapiens; identical to SEQ ID NO: 155429

SEQ ID NO: 607217 - RNA, 64 nt, Homo Sapiens; identical to SEQ ID NO: 155430

SEQ ID NO: 607218 - RNA, 64 nt, Homo Sapiens; identical to SEQ ID NO: 155431

SEQ ID NO: 607219 - RNA, 64 nt, Homo Sapiens; identical to SEQ ID NO: 155432

SEQ ID NO: 607220 - RNA, 64 nt, Homo Sapiens; identical to SEQ ID NO: 155433

SEQ ID NO: 607221 - RNA, 64 nt, Homo Sapiens; identical to SEQ ID NO: 155434

SEQ ID NO: 607222 - RNA, 64 nt, Homo Sapiens; identical to SEQ ID NO: 155435

SEQ ID NO: 607223 - RNA, 64 nt, Homo Sapiens; identical to SEQ ID NO: 155436

SEQ ID NO: 607224 - RNA, 64 nt, Homo Sapiens; identical to SEQ ID NO: 155437

SEQ ID NO: 607225 - RNA, 64 nt, Homo Sapiens; identical to SEQ ID NO: 155438

SEQ ID NO: 607226 - RNA, 64 nt, Homo Sapiens; identical to SEQ ID NO: 155439

SEQ ID NO: 607227 - RNA, 64 nt, Homo Sapiens; identical to SEQ ID NO: 155440

SEQ ID NO: 607228 - RNA, 64 nt, Homo Sapiens; identical to SEQ ID NO: 155441

SEQ ID NO: 607229 - RNA, 64 nt, Homo Sapiens; identical to SEQ ID NO: 155442

SEQ ID NO: 607230 - RNA, 64 nt, Homo Sapiens; identical to SEQ ID NO: 155443

SEQ ID NO: 607231 - RNA, 64 nt, Homo Sapiens; identical to SEQ ID NO: 155444

SEQ ID NO: 607232 - RNA, 64 nt, Homo Sapiens; identical to SEQ ID NO: 155445

SEQ ID NO: 607233 - RNA, 64 nt, Homo Sapiens; identical to SEQ ID NO: 155446

SEQ ID NO: 607234 - RNA, 64 nt, Homo Sapiens; identical to SEQ ID NO: 155447

SEQ ID NO: 607235 - RNA, 64 nt, Homo Sapiens; identical to SEQ ID NO: 155448

SEQ ID NO: 607236 - RNA, 64 nt, Homo Sapiens; identical to SEQ ID NO: 155449

SEQ ID NO: 607237 - RNA, 64 nt, Homo Sapiens; identical to SEQ ID NO: 155450

SEQ ID NO: 607238 - RNA, 64 nt, Homo Sapiens; identical to SEQ ID NO: 155451

SEQ ID NO: 607239 - RNA, 64 nt, Homo Sapiens; identical to SEQ ID NO: 155452

SEQ ID NO: 607240 - RNA, 64 nt, Homo Sapiens; identical to SEQ ID NO: 155453

SEQ ID NO: 607241 - RNA, 64 nt, Homo Sapiens; identical to SEQ ID NO: 155454

SEQ ID NO: 607242 - RNA, 64 nt, Homo Sapiens; identical to SEQ ID NO: 155455

SEQ ID NO: 607243 - RNA, 64 nt, Homo Sapiens; identical to SEQ ID NO: 155456

SEQ ID NO: 607244 - RNA, 64 nt, Homo Sapiens; identical to SEQ ID NO: 155457

SEQ ID NO: 607245 - RNA, 64 nt, Homo Sapiens; identical to SEQ ID NO: 155458

SEQ ID NO: 607246 - RNA, 64 nt, Homo Sapiens; identical to SEQ ID NO: 155459

SEQ ID NO: 607247 - RNA, 64 nt, Homo Sapiens; identical to SEQ ID NO: 155460

SEQ ID NO: 607248 - RNA, 64 nt, Homo Sapiens; identical to SEQ ID NO: 155461

SEQ ID NO: 607249 - RNA, 64 nt, Homo Sapiens; identical to SEQ ID NO: 155462

SEQ ID NO: 607250 - RNA, 64 nt, Homo Sapiens; identical to SEQ ID NO: 155463

SEQ ID NO: 607251 - RNA, 64 nt, Homo Sapiens; identical to SEQ ID NO: 155464

SEQ ID NO: 607252 - RNA, 64 nt, Homo Sapiens; identical to SEQ ID NO: 155465

SEQ ID NO: 607253 - RNA, 64 nt, Homo Sapiens; identical to SEQ ID NO: 155466

SEQ ID NO: 607254 - RNA, 64 nt, Homo Sapiens; identical to SEQ ID NO: 155467

SEQ ID NO: 607255 - RNA, 64 nt, Homo Sapiens; identical to SEQ ID NO: 155468

SEQ ID NO: 607256 - RNA, 64 nt, Homo Sapiens; identical to SEQ ID NO: 155469

SEQ ID NO: 607257 - RNA, 64 nt, Homo Sapiens; identical to SEQ ID NO: 155470

SEQ ID NO: 607258 - RNA, 64 nt, Homo Sapiens; identical to SEQ ID NO: 155471

SEQ ID NO: 607259 - RNA, 64 nt, Homo Sapiens; identical to SEQ ID NO: 155472

SEQ ID NO: 607260 - RNA, 64 nt, Homo Sapiens; identical to SEQ ID NO: 155473

SEQ ID NO: 607261 - RNA, 64 nt, Homo Sapiens; identical to SEQ ID NO: 155474

SEQ ID NO: 607262 - RNA, 64 nt, Homo Sapiens; identical to SEQ ID NO: 155475

SEQ ID NO: 607263 - RNA, 64 nt, Homo Sapiens; identical to SEQ ID NO: 155476

SEQ ID NO: 607264 - RNA, 64 nt, Homo Sapiens; identical to SEQ ID NO: 155477

SEQ ID NO: 607265 - RNA, 64 nt, Homo Sapiens; identical to SEQ ID NO: 155478

SEQ ID NO: 607266 - RNA, 64 nt, Homo Sapiens; identical to SEQ ID NO: 155479

SEQ ID NO: 607267 - RNA, 64 nt, Homo Sapiens; identical to SEQ ID NO: 155480

SEQ ID NO: 607268 - RNA, 64 nt, Homo Sapiens; identical to SEQ ID NO: 155481

SEQ ID NO: 607269 - RNA, 64 nt, Homo Sapiens; identical to SEQ ID NO: 155482

SEQ ID NO: 607270 - RNA, 64 nt, Homo Sapiens; identical to SEQ ID NO: 155483

SEQ ID NO: 607271 - RNA, 64 nt, Homo Sapiens; identical to SEQ ID NO: 155484

SEQ ID NO: 607272 - RNA, 64 nt, Homo Sapiens; identical to SEQ ID NO: 155485

SEQ ID NO: 607273 - RNA, 64 nt, Homo Sapiens; identical to SEQ ID NO: 155486

SEQ ID NO: 607274 - RNA, 64 nt, Homo Sapiens; identical to SEQ ID NO: 155487

SEQ ID NO: 607275 - RNA, 64 nt, Homo Sapiens; identical to SEQ ID NO: 155488

SEQ ID NO: 607276 - RNA, 64 nt, Homo Sapiens
acuguuuucugcuuuuacagcagcuucucucccacaccacaacuuuauuaagguauaguggaua

SEQ ID NO: 607277 - RNA, 64 nt, Homo Sapiens
uacaacuugauauguguauauacaguaaaguguucaccacaagcaagccaauuaacauauccuc

SEQ ID NO: 607278 - RNA, 64 nt, Homo Sapiens
ggccugaaauucuuaaaggauuacaggcaugagccaccacaacuggccucccaaacuggugaga

SEQ ID NO: 607279 - RNA, 64 nt, Homo Sapiens
cucagcuaauuuuuaaaauugggccacaggugugcaccacaacucucagccucccaaauaacug

SEQ ID NO: 607280 - RNA, 64 nt, Homo Sapiens
aagcaaccucagcaguucccaucaaggccaccuccaccacaaccgaaaguaucaucucagggaa

SEQ ID NO: 607281 - RNA, 64 nt, Homo Sapiens
agccuuucuguugcaacuaugaaugaaaacaaaacaccacaaaacagacuucacuaacacagaa

SEQ ID NO: 607282 - RNA, 64 nt, Homo Sapiens
ugcacacaggaucacucacauauguacauguacccaccacaaacgugcaagcuccugcacacau

SEQ ID NO: 607283 - RNA, 64 nt, Homo Sapiens
ugcagccuccugcacacgugcacauucauguguacaccacaaaugaguucccagacguguaaac

SEQ ID NO: 607284 - RNA, 64 nt, Homo Sapiens
cgcacaggcuccuacacacaugcacacacguguacaccacaaacgagcucccagacauguaaac

SEQ ID NO: 607285 - RNA, 64 nt, Homo Sapiens
cgugagcucccacacguacacaugcacauguacgcaccacaaacacaugcgcaggcuccugcag

SEQ ID NO: 607286 - RNA, 64 nt, Homo Sapiens; identical to SEQ ID NO: 124148

SEQ ID NO: 607287 - RNA, 64 nt, Homo Sapiens; identical to SEQ ID NO: 124149

SEQ ID NO: 607288 - RNA, 64 nt, Homo Sapiens; identical to SEQ ID NO: 124150

SEQ ID NO: 607289 - RNA, 64 nt, Homo Sapiens; identical to SEQ ID NO: 124151

SEQ ID NO: 607290 - RNA, 64 nt, Homo Sapiens; identical to SEQ ID NO: 124152

SEQ ID NO: 607291 - RNA, 64 nt, Homo Sapiens; identical to SEQ ID NO: 124153

SEQ ID NO: 607292 - RNA, 64 nt, Homo Sapiens; identical to SEQ ID NO: 124154

SEQ ID NO: 607293 - RNA, 64 nt, Homo Sapiens; identical to SEQ ID NO: 124155

SEQ ID NO: 607294 - RNA, 64 nt, Homo Sapiens; identical to SEQ ID NO: 124156

SEQ ID NO: 607295 - RNA, 64 nt, Homo Sapiens; identical to SEQ ID NO: 124157

SEQ ID NO: 607296 - RNA, 64 nt, Homo Sapiens; identical to SEQ ID NO: 124158

SEQ ID NO: 607297 - RNA, 64 nt, Homo Sapiens; identical to SEQ ID NO: 124159

SEQ ID NO: 607298 - RNA, 64 nt, Homo Sapiens; identical to SEQ ID NO: 124160

SEQ ID NO: 607299 - RNA, 64 nt, Homo Sapiens; identical to SEQ ID NO: 124161

SEQ ID NO: 607300 - RNA, 64 nt, Homo Sapiens; identical to SEQ ID NO: 124162

SEQ ID NO: 607301 - RNA, 64 nt, Homo Sapiens; identical to SEQ ID NO: 124163

SEQ ID NO: 607302 - RNA, 64 nt, Homo Sapiens; identical to SEQ ID NO: 124164

SEQ ID NO: 607303 - RNA, 64 nt, Homo Sapiens; identical to SEQ ID NO: 124165

SEQ ID NO: 607304 - RNA, 64 nt, Homo Sapiens; identical to SEQ ID NO: 124166

SEQ ID NO: 607305 - RNA, 64 nt, Homo Sapiens; identical to SEQ ID NO: 124167

SEQ ID NO: 607306 - RNA, 64 nt, Homo Sapiens; identical to SEQ ID NO: 124168

SEQ ID NO: 607307 - RNA, 64 nt, Homo Sapiens; identical to SEQ ID NO: 124169

SEQ ID NO: 607308 - RNA, 64 nt, Homo Sapiens; identical to SEQ ID NO: 124170

SEQ ID NO: 607309 - RNA, 64 nt, Homo Sapiens; identical to SEQ ID NO: 124171

SEQ ID NO: 607310 - RNA, 64 nt, Homo Sapiens; identical to SEQ ID NO: 124172

SEQ ID NO: 607311 - RNA, 64 nt, Homo Sapiens; identical to SEQ ID NO: 124173

SEQ ID NO: 607312 - RNA, 64 nt, Homo Sapiens; identical to SEQ ID NO: 124174

SEQ ID NO: 607313 - RNA, 64 nt, Homo Sapiens; identical to SEQ ID NO: 124175

SEQ ID NO: 607314 - RNA, 64 nt, Homo Sapiens; identical to SEQ ID NO: 124176

SEQ ID NO: 607315 - RNA, 64 nt, Homo Sapiens; identical to SEQ ID NO: 124177

SEQ ID NO: 607316 - RNA, 62 nt, Homo Sapiens; identical to SEQ ID NO: 124178

SEQ ID NO: 607317 - RNA, 64 nt, Homo Sapiens; identical to SEQ ID NO: 124179

SEQ ID NO: 607318 - RNA, 64 nt, Homo Sapiens; identical to SEQ ID NO: 124180

SEQ ID NO: 607319 - RNA, 64 nt, Homo Sapiens; identical to SEQ ID NO: 124181

SEQ ID NO: 607320 - RNA, 64 nt, Homo Sapiens; identical to SEQ ID NO: 124182

SEQ ID NO: 607321 - RNA, 64 nt, Homo Sapiens; identical to SEQ ID NO: 124183

SEQ ID NO: 607322 - RNA, 64 nt, Homo Sapiens; identical to SEQ ID NO: 124184

SEQ ID NO: 607323 - RNA, 64 nt, Homo Sapiens; identical to SEQ ID NO: 124185

SEQ ID NO: 607324 - RNA, 64 nt, Homo Sapiens; identical to SEQ ID NO: 124186

SEQ ID NO: 607325 - RNA, 64 nt, Homo Sapiens; identical to SEQ ID NO: 124187

SEQ ID NO: 607326 - RNA, 60 nt, Homo Sapiens; identical to SEQ ID NO: 124188

SEQ ID NO: 607327 - RNA, 64 nt, Homo Sapiens; identical to SEQ ID NO: 124189

SEQ ID NO: 607328 - RNA, 64 nt, Homo Sapiens; identical to SEQ ID NO: 124190

SEQ ID NO: 607329 - RNA, 64 nt, Homo Sapiens; identical to SEQ ID NO: 124191

SEQ ID NO: 607330 - RNA, 64 nt, Homo Sapiens; identical to SEQ ID NO: 124192

SEQ ID NO: 607331 - RNA, 64 nt, Homo Sapiens; identical to SEQ ID NO: 124193

SEQ ID NO: 607332 - RNA, 64 nt, Homo Sapiens; identical to SEQ ID NO: 124194

SEQ ID NO: 607333 - RNA, 64 nt, Homo Sapiens; identical to SEQ ID NO: 124195

SEQ ID NO: 607334 - RNA, 64 nt, Homo Sapiens; identical to SEQ ID NO: 124196

SEQ ID NO: 607335 - RNA, 64 nt, Homo Sapiens; identical to SEQ ID NO: 124197

SEQ ID NO: 607336 - RNA, 64 nt, Homo Sapiens; identical to SEQ ID NO: 124198

SEQ ID NO: 607337 - RNA, 64 nt, Homo Sapiens; identical to SEQ ID NO: 124199

SEQ ID NO: 607338 - RNA, 64 nt, Homo Sapiens; identical to SEQ ID NO: 124200

SEQ ID NO: 607339 - RNA, 64 nt, Homo Sapiens; identical to SEQ ID NO: 124201

SEQ ID NO: 607340 - RNA, 64 nt, Homo Sapiens; identical to SEQ ID NO: 124202

SEQ ID NO: 607341 - RNA, 64 nt, Homo Sapiens; identical to SEQ ID NO: 124203

SEQ ID NO: 607342 - RNA, 64 nt, Homo Sapiens; identical to SEQ ID NO: 124204

SEQ ID NO: 607343 - RNA, 64 nt, Homo Sapiens; identical to SEQ ID NO: 124205

SEQ ID NO: 607344 - RNA, 64 nt, Homo Sapiens; identical to SEQ ID NO: 124206

SEQ ID NO: 607345 - RNA, 64 nt, Homo Sapiens; identical to SEQ ID NO: 124207

SEQ ID NO: 607346 - RNA, 64 nt, Homo Sapiens; identical to SEQ ID NO: 124208

SEQ ID NO: 607347 - RNA, 64 nt, Homo Sapiens; identical to SEQ ID NO: 124209

SEQ ID NO: 607348 - RNA, 64 nt, Homo Sapiens; identical to SEQ ID NO: 124210

SEQ ID NO: 607349 - RNA, 64 nt, Homo Sapiens; identical to SEQ ID NO: 124211

SEQ ID NO: 607350 - RNA, 64 nt, Homo Sapiens; identical to SEQ ID NO: 124212

SEQ ID NO: 607351 - RNA, 64 nt, Homo Sapiens; identical to SEQ ID NO: 124213

SEQ ID NO: 607352 - RNA, 64 nt, Homo Sapiens; identical to SEQ ID NO: 124214

SEQ ID NO: 607353 - RNA, 64 nt, Homo Sapiens; identical to SEQ ID NO: 124215

SEQ ID NO: 607354 - RNA, 64 nt, Homo Sapiens; identical to SEQ ID NO: 124216

SEQ ID NO: 607355 - RNA, 64 nt, Homo Sapiens; identical to SEQ ID NO: 87818

SEQ ID NO: 607356 - RNA, 64 nt, Homo Sapiens; identical to SEQ ID NO: 87819

SEQ ID NO: 607357 - RNA, 64 nt, Homo Sapiens; identical to SEQ ID NO: 87820

SEQ ID NO: 607358 - RNA, 64 nt, Homo Sapiens; identical to SEQ ID NO: 87821

SEQ ID NO: 607359 - RNA, 64 nt, Homo Sapiens; identical to SEQ ID NO: 87822

SEQ ID NO: 607360 - RNA, 64 nt, Homo Sapiens; identical to SEQ ID NO: 87823

SEQ ID NO: 607361 - RNA, 64 nt, Homo Sapiens; identical to SEQ ID NO: 87824

SEQ ID NO: 607362 - RNA, 64 nt, Homo Sapiens; identical to SEQ ID NO: 87825

SEQ ID NO: 607363 - RNA, 64 nt, Homo Sapiens; identical to SEQ ID NO: 87826

SEQ ID NO: 607364 - RNA, 64 nt, Homo Sapiens; identical to SEQ ID NO: 87827

SEQ ID NO: 607365 - RNA, 64 nt, Homo Sapiens; identical to SEQ ID NO: 87828

SEQ ID NO: 607366 - RNA, 64 nt, Homo Sapiens; identical to SEQ ID NO: 87829

SEQ ID NO: 607367 - RNA, 64 nt, Homo Sapiens; identical to SEQ ID NO: 87830

SEQ ID NO: 607368 - RNA, 64 nt, Homo Sapiens; identical to SEQ ID NO: 87831

SEQ ID NO: 607369 - RNA, 64 nt, Homo Sapiens; identical to SEQ ID NO: 87832

SEQ ID NO: 607370 - RNA, 64 nt, Homo Sapiens; identical to SEQ ID NO: 87833

SEQ ID NO: 607371 - RNA, 64 nt, Homo Sapiens; identical to SEQ ID NO: 87834

SEQ ID NO: 607372 - RNA, 64 nt, Homo Sapiens; identical to SEQ ID NO: 87835

SEQ ID NO: 607373 - RNA, 64 nt, Homo Sapiens; identical to SEQ ID NO: 87836

SEQ ID NO: 607374 - RNA, 64 nt, Homo Sapiens; identical to SEQ ID NO: 87837

SEQ ID NO: 607375 - RNA, 64 nt, Homo Sapiens; identical to SEQ ID NO: 87838

SEQ ID NO: 607376 - RNA, 64 nt, Homo Sapiens; identical to SEQ ID NO: 87839

SEQ ID NO: 607377 - RNA, 64 nt, Homo Sapiens; identical to SEQ ID NO: 87840

SEQ ID NO: 607378 - RNA, 64 nt, Homo Sapiens; identical to SEQ ID NO: 87841

SEQ ID NO: 607379 - RNA, 64 nt, Homo Sapiens; identical to SEQ ID NO: 87842

SEQ ID NO: 607380 - RNA, 64 nt, Homo Sapiens; identical to SEQ ID NO: 87843

SEQ ID NO: 607381 - RNA, 64 nt, Homo Sapiens; identical to SEQ ID NO: 87844

SEQ ID NO: 607382 - RNA, 64 nt, Homo Sapiens; identical to SEQ ID NO: 87845

SEQ ID NO: 607383 - RNA, 64 nt, Homo Sapiens; identical to SEQ ID NO: 87846

SEQ ID NO: 607384 - RNA, 64 nt, Homo Sapiens; identical to SEQ ID NO: 87847

SEQ ID NO: 607385 - RNA, 64 nt, Homo Sapiens; identical to SEQ ID NO: 87848

SEQ ID NO: 607386 - RNA, 64 nt, Homo Sapiens; identical to SEQ ID NO: 87849

SEQ ID NO: 607387 - RNA, 64 nt, Homo Sapiens; identical to SEQ ID NO: 87850

SEQ ID NO: 607388 - RNA, 64 nt, Homo Sapiens; identical to SEQ ID NO: 87851

SEQ ID NO: 607389 - RNA, 64 nt, Homo Sapiens; identical to SEQ ID NO: 246998

SEQ ID NO: 607390 - RNA, 64 nt, Homo Sapiens; identical to SEQ ID NO: 246999

SEQ ID NO: 607391 - RNA, 64 nt, Homo Sapiens; identical to SEQ ID NO: 247000

SEQ ID NO: 607392 - RNA, 64 nt, Homo Sapiens; identical to SEQ ID NO: 247001

SEQ ID NO: 607393 - RNA, 64 nt, Homo Sapiens; identical to SEQ ID NO: 247002

SEQ ID NO: 607394 - RNA, 64 nt, Homo Sapiens; identical to SEQ ID NO: 247003

SEQ ID NO: 607395 - RNA, 64 nt, Homo Sapiens; identical to SEQ ID NO: 247004

SEQ ID NO: 607396 - RNA, 64 nt, Homo Sapiens; identical to SEQ ID NO: 247005

SEQ ID NO: 607397 - RNA, 64 nt, Homo Sapiens; identical to SEQ ID NO: 247006

SEQ ID NO: 607398 - RNA, 64 nt, Homo Sapiens; identical to SEQ ID NO: 247007

SEQ ID NO: 607399 - RNA, 64 nt, Homo Sapiens; identical to SEQ ID NO: 247008

SEQ ID NO: 607400 - RNA, 64 nt, Homo Sapiens; identical to SEQ ID NO: 247009

SEQ ID NO: 607401 - RNA, 64 nt, Homo Sapiens; identical to SEQ ID NO: 247010

SEQ ID NO: 607402 - RNA, 64 nt, Homo Sapiens; identical to SEQ ID NO: 247011

SEQ ID NO: 607403 - RNA, 64 nt, Homo Sapiens; identical to SEQ ID NO: 283135

SEQ ID NO: 607404 - RNA, 64 nt, Homo Sapiens; identical to SEQ ID NO: 283136

SEQ ID NO: 607405 - RNA, 64 nt, Homo Sapiens; identical to SEQ ID NO: 283137

SEQ ID NO: 607406 - RNA, 64 nt, Homo Sapiens; identical to SEQ ID NO: 283138

SEQ ID NO: 607407 - RNA, 64 nt, Homo Sapiens; identical to SEQ ID NO: 283139

SEQ ID NO: 607408 - RNA, 64 nt, Homo Sapiens; identical to SEQ ID NO: 283140

SEQ ID NO: 607409 - RNA, 64 nt, Homo Sapiens; identical to SEQ ID NO: 283141

SEQ ID NO: 607410 - RNA, 64 nt, Homo Sapiens; identical to SEQ ID NO: 283142

SEQ ID NO: 607411 - RNA, 64 nt, Homo Sapiens; identical to SEQ ID NO: 283143

SEQ ID NO: 607412 - RNA, 64 nt, Homo Sapiens; identical to SEQ ID NO: 283144

SEQ ID NO: 607413 - RNA, 64 nt, Homo Sapiens; identical to SEQ ID NO: 283145

SEQ ID NO: 607414 - RNA, 64 nt, Homo Sapiens; identical to SEQ ID NO: 283146

SEQ ID NO: 607415 - RNA, 64 nt, Homo Sapiens; identical to SEQ ID NO: 283147

SEQ ID NO: 607416 - RNA, 64 nt, Homo Sapiens; identical to SEQ ID NO: 283148

SEQ ID NO: 607417 - RNA, 64 nt, Homo Sapiens; identical to SEQ ID NO: 283149

SEQ ID NO: 607418 - RNA, 64 nt, Homo Sapiens; identical to SEQ ID NO: 283150

SEQ ID NO: 607419 - RNA, 64 nt, Homo Sapiens; identical to SEQ ID NO: 283151

SEQ ID NO: 607420 - RNA, 64 nt, Homo Sapiens; identical to SEQ ID NO: 283152

SEQ ID NO: 607421 - RNA, 64 nt, Homo Sapiens; identical to SEQ ID NO: 283153

SEQ ID NO: 607422 - RNA, 64 nt, Homo Sapiens; identical to SEQ ID NO: 283154

SEQ ID NO: 607423 - RNA, 64 nt, Homo Sapiens; identical to SEQ ID NO: 283155

SEQ ID NO: 607424 - RNA, 64 nt, Homo Sapiens; identical to SEQ ID NO: 283156

SEQ ID NO: 607425 - RNA, 64 nt, Homo Sapiens; identical to SEQ ID NO: 283157

SEQ ID NO: 607426 - RNA, 64 nt, Homo Sapiens; identical to SEQ ID NO: 283158

SEQ ID NO: 607427 - RNA, 64 nt, Homo Sapiens; identical to SEQ ID NO: 283159

SEQ ID NO: 607428 - RNA, 64 nt, Homo Sapiens; identical to SEQ ID NO: 283160

SEQ ID NO: 607429 - RNA, 64 nt, Homo Sapiens; identical to SEQ ID NO: 283161

SEQ ID NO: 607430 - RNA, 64 nt, Homo Sapiens; identical to SEQ ID NO: 283162

SEQ ID NO: 607431 - RNA, 64 nt, Homo Sapiens; identical to SEQ ID NO: 283163

SEQ ID NO: 607432 - RNA, 64 nt, Homo Sapiens; identical to SEQ ID NO: 283164

SEQ ID NO: 607433 - RNA, 64 nt, Homo Sapiens; identical to SEQ ID NO: 283165

SEQ ID NO: 607434 - RNA, 64 nt, Homo Sapiens; identical to SEQ ID NO: 283166

SEQ ID NO: 607435 - RNA, 64 nt, Homo Sapiens; identical to SEQ ID NO: 283167

SEQ ID NO: 607436 - RNA, 64 nt, Homo Sapiens
cacuccagcgugggcgacagcaagagacuucauuucgauaaauaaguaaauaaauaaauaaagu

SEQ ID NO: 607437 - RNA, 64 nt, Homo Sapiens
auucaacuuucauggacugccccuggcaagguccucgauaaaggaagagguaaguuugacauua

SEQ ID NO: 607438 - RNA, 64 nt, Homo Sapiens
gauggacagguuucuuuucuguggcuuuuuccuuucgauaaaccaucagauuucaguaguacau

SEQ ID NO: 607439 - RNA, 64 nt, Homo Sapiens
gcuucagaaguccauagcccagcucugaacuuucucgauaaaaugccaucaguucaccuuuaaa

SEQ ID NO: 607440 - RNA, 64 nt, Homo Sapiens
ucuguuaauaugucagaauguaagauuuggcaacucgauaaauuuuuuucauuuucuuuuccaa

SEQ ID NO: 607441 - RNA, 64 nt, Homo Sapiens
cacuuuuaauuguuacucauuuuauucacuaagcucgauaaaucuaacaguuacucuuaaaaaa

SEQ ID NO: 607442 - RNA, 53 nt, Homo Sapiens
auuguugcaucacagaagggguuucgauaaauaaagauggaaauggacaguaa

SEQ ID NO: 607443 - RNA, 64 nt, Homo Sapiens
ccuuuuuagaaauccaguuuuaguuuugucauuuucgauaaaucuuucuucaguuagaaauaua

SEQ ID NO: 607444 - RNA, 64 nt, Homo Sapiens
ugaauuuagaaucacuuaaagcuuuuauaaagaaucgauaaauucaccuguauuuguuguuaga

SEQ ID NO: 607445 - RNA, 64 nt, Homo Sapiens
ccauuaaagauauguaucucauaguuuugagaguucgauaaaagcauuguuacgucacuuuucu

SEQ ID NO: 607446 - RNA, 64 nt, Homo Sapiens
uugguaguauuaauuuuguggucauuguuucucuucgauaaauuuauuuucauuaaauacuugu

SEQ ID NO: 607447 - RNA, 64 nt, Homo Sapiens
gauauguaauaguugcagaaaaaaaaguuuggauucgauaaagugaccacaaaagggaacaagc

SEQ ID NO: 607448 - RNA, 64 nt, Homo Sapiens
aagacacacgaugcuaauccgucugcauuuucuuucgauaaaggucagaauuauuaauuaucgu

SEQ ID NO: 607449 - RNA, 64 nt, Homo Sapiens
acuggcaaaaacaaaacucuaauuuaggcagaguucgauaaauuuuuaacauacaaucauguga

SEQ ID NO: 607450 - RNA, 64 nt, Homo Sapiens
cguuaaccaauauaucuauagcuuuagauuauauucgauaaaaguaauuggacuuuuuuucuuu

SEQ ID NO: 607451 - RNA, 64 nt, Homo Sapiens
gaauuuuaaaaaaguuacauacaaaauguaucauucgauaaaguacuguguaaacuuuuuuuua

SEQ ID NO: 607452 - RNA, 64 nt, Homo Sapiens
uagaguaaaaaucauugaaauugaaaagagaaaaucgauaaaacccaaaacugguuccuugaaa

SEQ ID NO: 607453 - RNA, 64 nt, Homo Sapiens
auauaccuguugaguuuugagugcacccaaacacucgauaaaccaggugaagaaauuuagcuuc

SEQ ID NO: 607454 - RNA, 64 nt, Homo Sapiens
uuguccuacucaccgguggucccucuaacaugagucgauaaauguuaaucuacuuaaccuggcc

SEQ ID NO: 607455 - RNA, 64 nt, Homo Sapiens
gugaugaugccaguauuuggcgcugggaucgacuucgauaaaauacuuuugccuaaucaaaauu

SEQ ID NO: 607456 - RNA, 64 nt, Homo Sapiens
cagguaacgacauaggguuugauuugauguccucucgauaaaucgggccgugauagaauuaagu

SEQ ID NO: 607457 - RNA, 64 nt, Homo Sapiens
acuugucauucaguaauauuagcagauagcugcuucgauaaaggaauuuggaguuuaaaaauca

SEQ ID NO: 607458 - RNA, 64 nt, Homo Sapiens
cuugugucgggagucggugaugccaguaaagccuucgauaaacgacuuccccacauuuccugcu

SEQ ID NO: 607459 - RNA, 64 nt, Homo Sapiens
uacaccuuuucaauuguggcaauaauugaaagaaucgauaaaaguucaucuuuggacagaaagc

SEQ ID NO: 607460 - RNA, 64 nt, Homo Sapiens
ucuccccgggaaucucuaacaugcucuguuuacaucgauaaaugcacuuaaggaaaacaaacaa

SEQ ID NO: 607461 - RNA, 64 nt, Homo Sapiens
uuuaaauuguacagcaaggugcucuaaguaauauucgauaaaauauauuuaauagaaauuugcg

SEQ ID NO: 607462 - RNA, 64 nt, Homo Sapiens
gcuuagaauugugccugacauaaaugaauuaagaucgauaaaguucauaaugcuuugugaggau

SEQ ID NO: 607463 - RNA, 64 nt, Homo Sapiens
cugagugugaggcaccugaaguuucccugcggagucgauaaauuagcagaaccacauccccauc

SEQ ID NO: 607464 - RNA, 64 nt, Homo Sapiens
uuuggagagucagaucuuucuccuugaauaucuuucgauaaacaacaagguggugugaucuuaa

SEQ ID NO: 607465 - RNA, 64 nt, Homo Sapiens
gguggcaaaugaauuuaucauuuuaguauaguuuucgauaaaggauauagcaacaucuuuugau

SEQ ID NO: 607466 - RNA, 64 nt, Homo Sapiens
cuuggguguuagugaggcugauaugucaugucaaucgauaaacccuacuuuccaaauuaucuaa

SEQ ID NO: 607467 - RNA, 64 nt, Homo Sapiens
cuuggacuccauuuuaguguauaaagcaauugcaucgauaaaaguugauuuuuucuuuuauauu

SEQ ID NO: 607468 - RNA, 64 nt, Homo Sapiens
aacuacuguagaagaagugaaagagagaacuuuuucgauaaacuucugucccauccuucccaag

SEQ ID NO: 607469 - RNA, 64 nt, Homo Sapiens
gaaccacuuucuuauuuuuucccuguggucuuccucgauaaaggacaugugcugcccuacagca

SEQ ID NO: 607470 - RNA, 64 nt, Homo Sapiens; identical to SEQ ID NO: 68768

SEQ ID NO: 607471 - RNA, 64 nt, Homo Sapiens; identical to SEQ ID NO: 68769

SEQ ID NO: 607472 - RNA, 64 nt, Homo Sapiens; identical to SEQ ID NO: 68770

SEQ ID NO: 607473 - RNA, 64 nt, Homo Sapiens; identical to SEQ ID NO: 68771

SEQ ID NO: 607474 - RNA, 64 nt, Homo Sapiens; identical to SEQ ID NO: 68772

SEQ ID NO: 607475 - RNA, 64 nt, Homo Sapiens; identical to SEQ ID NO: 68773

SEQ ID NO: 607476 - RNA, 64 nt, Homo Sapiens; identical to SEQ ID NO: 68774

SEQ ID NO: 607477 - RNA, 64 nt, Homo Sapiens; identical to SEQ ID NO: 68775

SEQ ID NO: 607478 - RNA, 64 nt, Homo Sapiens; identical to SEQ ID NO: 68776

SEQ ID NO: 607479 - RNA, 64 nt, Homo Sapiens; identical to SEQ ID NO: 68777

SEQ ID NO: 607480 - RNA, 64 nt, Homo Sapiens; identical to SEQ ID NO: 68778

SEQ ID NO: 607481 - RNA, 64 nt, Homo Sapiens; identical to SEQ ID NO: 68779

SEQ ID NO: 607482 - RNA, 64 nt, Homo Sapiens; identical to SEQ ID NO: 68780

SEQ ID NO: 607483 - RNA, 64 nt, Homo Sapiens; identical to SEQ ID NO: 68781

SEQ ID NO: 607484 - RNA, 64 nt, Homo Sapiens; identical to SEQ ID NO: 68782

SEQ ID NO: 607485 - RNA, 64 nt, Homo Sapiens; identical to SEQ ID NO: 68783

SEQ ID NO: 607486 - RNA, 64 nt, Homo Sapiens; identical to SEQ ID NO: 68784

SEQ ID NO: 607487 - RNA, 64 nt, Homo Sapiens; identical to SEQ ID NO: 68785

SEQ ID NO: 607488 - RNA, 64 nt, Homo Sapiens; identical to SEQ ID NO: 68786

SEQ ID NO: 607489 - RNA, 64 nt, Homo Sapiens; identical to SEQ ID NO: 68787

SEQ ID NO: 607490 - RNA, 64 nt, Homo Sapiens; identical to SEQ ID NO: 68788

SEQ ID NO: 607491 - RNA, 64 nt, Homo Sapiens; identical to SEQ ID NO: 68789

SEQ ID NO: 607492 - RNA, 64 nt, Homo Sapiens; identical to SEQ ID NO: 68790

SEQ ID NO: 607493 - RNA, 64 nt, Homo Sapiens; identical to SEQ ID NO: 68791

SEQ ID NO: 607494 - RNA, 64 nt, Homo Sapiens; identical to SEQ ID NO: 68792

SEQ ID NO: 607495 - RNA, 64 nt, Homo Sapiens; identical to SEQ ID NO: 68793

SEQ ID NO: 607496 - RNA, 64 nt, Homo Sapiens; identical to SEQ ID NO: 68794

SEQ ID NO: 607497 - RNA, 64 nt, Homo Sapiens; identical to SEQ ID NO: 68795

SEQ ID NO: 607498 - RNA, 64 nt, Homo Sapiens; identical to SEQ ID NO: 68796

SEQ ID NO: 607499 - RNA, 64 nt, Homo Sapiens; identical to SEQ ID NO: 68797

SEQ ID NO: 607500 - RNA, 64 nt, Homo Sapiens; identical to SEQ ID NO: 68798

SEQ ID NO: 607501 - RNA, 64 nt, Homo Sapiens; identical to SEQ ID NO: 68799

SEQ ID NO: 607502 - RNA, 64 nt, Homo Sapiens; identical to SEQ ID NO: 68800

SEQ ID NO: 607503 - RNA, 64 nt, Homo Sapiens; identical to SEQ ID NO: 68801

SEQ ID NO: 607504 - RNA, 59 nt, Homo Sapiens; identical to SEQ ID NO: 68802

SEQ ID NO: 607505 - RNA, 64 nt, Homo Sapiens; identical to SEQ ID NO: 68803

SEQ ID NO: 607506 - RNA, 64 nt, Homo Sapiens; identical to SEQ ID NO: 68804

SEQ ID NO: 607507 - RNA, 64 nt, Homo Sapiens; identical to SEQ ID NO: 68805

SEQ ID NO: 607508 - RNA, 64 nt, Homo Sapiens; identical to SEQ ID NO: 68806

SEQ ID NO: 607509 - RNA, 64 nt, Homo Sapiens; identical to SEQ ID NO: 68807

SEQ ID NO: 607510 - RNA, 64 nt, Homo Sapiens; identical to SEQ ID NO: 68808

SEQ ID NO: 607511 - RNA, 64 nt, Homo Sapiens; identical to SEQ ID NO: 68809

SEQ ID NO: 607512 - RNA, 64 nt, Homo Sapiens; identical to SEQ ID NO: 68810

SEQ ID NO: 607513 - RNA, 64 nt, Homo Sapiens; identical to SEQ ID NO: 68811

SEQ ID NO: 607514 - RNA, 64 nt, Homo Sapiens; identical to SEQ ID NO: 68812

SEQ ID NO: 607515 - RNA, 64 nt, Homo Sapiens; identical to SEQ ID NO: 200816

SEQ ID NO: 607516 - RNA, 64 nt, Homo Sapiens; identical to SEQ ID NO: 200817

SEQ ID NO: 607517 - RNA, 64 nt, Homo Sapiens; identical to SEQ ID NO: 200818

SEQ ID NO: 607518 - RNA, 64 nt, Homo Sapiens; identical to SEQ ID NO: 200819

SEQ ID NO: 607519 - RNA, 64 nt, Homo Sapiens; identical to SEQ ID NO: 200820

SEQ ID NO: 607520 - RNA, 64 nt, Homo Sapiens; identical to SEQ ID NO: 200821

SEQ ID NO: 607521 - RNA, 64 nt, Homo Sapiens; identical to SEQ ID NO: 200822

SEQ ID NO: 607522 - RNA, 64 nt, Homo Sapiens; identical to SEQ ID NO: 200823

SEQ ID NO: 607523 - RNA, 64 nt, Homo Sapiens; identical to SEQ ID NO: 200824

SEQ ID NO: 607524 - RNA, 64 nt, Homo Sapiens; identical to SEQ ID NO: 200825

SEQ ID NO: 607525 - RNA, 64 nt, Homo Sapiens; identical to SEQ ID NO: 200826

SEQ ID NO: 607526 - RNA, 64 nt, Homo Sapiens; identical to SEQ ID NO: 200827

SEQ ID NO: 607527 - RNA, 64 nt, Homo Sapiens; identical to SEQ ID NO: 583005

SEQ ID NO: 607528 - RNA, 64 nt, Homo Sapiens; identical to SEQ ID NO: 583006

SEQ ID NO: 607529 - RNA, 64 nt, Homo Sapiens; identical to SEQ ID NO: 583007

SEQ ID NO: 607530 - RNA, 64 nt, Homo Sapiens; identical to SEQ ID NO: 583008

SEQ ID NO: 607531 - RNA, 64 nt, Homo Sapiens; identical to SEQ ID NO: 583009

SEQ ID NO: 607532 - RNA, 64 nt, Homo Sapiens; identical to SEQ ID NO: 583010

SEQ ID NO: 607533 - RNA, 64 nt, Homo Sapiens; identical to SEQ ID NO: 583011

SEQ ID NO: 607534 - RNA, 64 nt, Homo Sapiens; identical to SEQ ID NO: 583012

SEQ ID NO: 607535 - RNA, 64 nt, Homo Sapiens; identical to SEQ ID NO: 583013

SEQ ID NO: 607536 - RNA, 64 nt, Homo Sapiens; identical to SEQ ID NO: 583014

SEQ ID NO: 607537 - RNA, 64 nt, Homo Sapiens; identical to SEQ ID NO: 583015

SEQ ID NO: 607538 - RNA, 64 nt, Homo Sapiens; identical to SEQ ID NO: 583016

SEQ ID NO: 607539 - RNA, 64 nt, Homo Sapiens; identical to SEQ ID NO: 583017

SEQ ID NO: 607540 - RNA, 64 nt, Homo Sapiens; identical to SEQ ID NO: 583018

SEQ ID NO: 607541 - RNA, 64 nt, Homo Sapiens; identical to SEQ ID NO: 583019

SEQ ID NO: 607542 - RNA, 64 nt, Homo Sapiens; identical to SEQ ID NO: 583020

SEQ ID NO: 607543 - RNA, 64 nt, Homo Sapiens; identical to SEQ ID NO: 583021

SEQ ID NO: 607544 - RNA, 64 nt, Homo Sapiens; identical to SEQ ID NO: 583022

SEQ ID NO: 607545 - RNA, 64 nt, Homo Sapiens; identical to SEQ ID NO: 583023

SEQ ID NO: 607546 - RNA, 64 nt, Homo Sapiens; identical to SEQ ID NO: 583024

SEQ ID NO: 607547 - RNA, 64 nt, Homo Sapiens; identical to SEQ ID NO: 583025

SEQ ID NO: 607548 - RNA, 64 nt, Homo Sapiens; identical to SEQ ID NO: 583026

SEQ ID NO: 607549 - RNA, 64 nt, Homo Sapiens; identical to SEQ ID NO: 583027

SEQ ID NO: 607550 - RNA, 64 nt, Homo Sapiens; identical to SEQ ID NO: 583028

SEQ ID NO: 607551 - RNA, 64 nt, Homo Sapiens; identical to SEQ ID NO: 583029

SEQ ID NO: 607552 - RNA, 64 nt, Homo Sapiens; identical to SEQ ID NO: 583030

SEQ ID NO: 607553 - RNA, 64 nt, Homo Sapiens; identical to SEQ ID NO: 583031

SEQ ID NO: 607554 - RNA, 64 nt, Homo Sapiens; identical to SEQ ID NO: 583032

SEQ ID NO: 607555 - RNA, 64 nt, Homo Sapiens; identical to SEQ ID NO: 583033

SEQ ID NO: 607556 - RNA, 64 nt, Homo Sapiens; identical to SEQ ID NO: 583034

SEQ ID NO: 607557 - RNA, 64 nt, Homo Sapiens; identical to SEQ ID NO: 583035

SEQ ID NO: 607558 - RNA, 64 nt, Homo Sapiens; identical to SEQ ID NO: 583036

SEQ ID NO: 607559 - RNA, 64 nt, Homo Sapiens; identical to SEQ ID NO: 583037

SEQ ID NO: 607560 - RNA, 64 nt, Homo Sapiens; identical to SEQ ID NO: 583038

SEQ ID NO: 607561 - RNA, 64 nt, Homo Sapiens; identical to SEQ ID NO: 583039

SEQ ID NO: 607562 - RNA, 64 nt, Homo Sapiens; identical to SEQ ID NO: 583040

SEQ ID NO: 607563 - RNA, 64 nt, Homo Sapiens; identical to SEQ ID NO: 583041

SEQ ID NO: 607564 - RNA, 64 nt, Homo Sapiens; identical to SEQ ID NO: 583042

SEQ ID NO: 607565 - RNA, 64 nt, Homo Sapiens; identical to SEQ ID NO: 583043

SEQ ID NO: 607566 - RNA, 64 nt, Homo Sapiens; identical to SEQ ID NO: 583044

SEQ ID NO: 607567 - RNA, 64 nt, Homo Sapiens; identical to SEQ ID NO: 583045

SEQ ID NO: 607568 - RNA, 64 nt, Homo Sapiens; identical to SEQ ID NO: 583046

SEQ ID NO: 607569 - RNA, 64 nt, Homo Sapiens; identical to SEQ ID NO: 583047

SEQ ID NO: 607570 - RNA, 64 nt, Homo Sapiens; identical to SEQ ID NO: 583048

SEQ ID NO: 607571 - RNA, 64 nt, Homo Sapiens; identical to SEQ ID NO: 583049

SEQ ID NO: 607572 - RNA, 64 nt, Homo Sapiens; identical to SEQ ID NO: 583050

SEQ ID NO: 607573 - RNA, 64 nt, Homo Sapiens; identical to SEQ ID NO: 583051

SEQ ID NO: 607574 - RNA, 64 nt, Homo Sapiens; identical to SEQ ID NO: 583052

SEQ ID NO: 607575 - RNA, 64 nt, Homo Sapiens; identical to SEQ ID NO: 583053

SEQ ID NO: 607576 - RNA, 64 nt, Homo Sapiens; identical to SEQ ID NO: 583054

SEQ ID NO: 607577 - RNA, 64 nt, Homo Sapiens; identical to SEQ ID NO: 583055

SEQ ID NO: 607578 - RNA, 64 nt, Homo Sapiens; identical to SEQ ID NO: 583056

SEQ ID NO: 607579 - RNA, 64 nt, Homo Sapiens; identical to SEQ ID NO: 583057

SEQ ID NO: 607580 - RNA, 64 nt, Homo Sapiens; identical to SEQ ID NO: 583058

SEQ ID NO: 607581 - RNA, 64 nt, Homo Sapiens; identical to SEQ ID NO: 583059

SEQ ID NO: 607582 - RNA, 64 nt, Homo Sapiens; identical to SEQ ID NO: 583060

SEQ ID NO: 607583 - RNA, 64 nt, Homo Sapiens; identical to SEQ ID NO: 583061

SEQ ID NO: 607584 - RNA, 64 nt, Homo Sapiens; identical to SEQ ID NO: 583062

SEQ ID NO: 607585 - RNA, 64 nt, Homo Sapiens; identical to SEQ ID NO: 583063

SEQ ID NO: 607586 - RNA, 64 nt, Homo Sapiens; identical to SEQ ID NO: 583064

SEQ ID NO: 607587 - RNA, 64 nt, Homo Sapiens; identical to SEQ ID NO: 583065

SEQ ID NO: 607588 - RNA, 62 nt, Homo Sapiens
cuuucuagauagauuuuauuuuuuguuucuuuaaucugcacaguaacaguuauuucaggaua

SEQ ID NO: 607589 - RNA, 62 nt, Homo Sapiens
gugugaagggauuagaugggggccuguuucccaaucugcaaagagcucagagaagcuccgug

SEQ ID NO: 607590 - RNA, 62 nt, Homo Sapiens
gggucucagugaaugaacgucccauuuacaggaaucugcacuccuguggccucugagaccgc

SEQ ID NO: 607591 - RNA, 62 nt, Homo Sapiens
gucucugaagagaacucucucuuaguccugagaaucugcaaaugauucauuccugagaaugg

SEQ ID NO: 607592 - RNA, 62 nt, Homo Sapiens
caugccaauucagcauaaaagaauaaaauugaaaucugcauuuguuuuugucucaagaacaa

SEQ ID NO: 607593 - RNA, 62 nt, Homo Sapiens
ugcacauuaaugcaaauuaacugaaauauuaaaaucugcaaaaauguaugaugagguuaaca

SEQ ID NO: 607594 - RNA, 62 nt, Homo Sapiens
cuaucuacaugagcccucuuagagaccucagaaaucugcagaaaguucccugugucugucua

SEQ ID NO: 607595 - RNA, 62 nt, Homo Sapiens
aagucuguuggcugugacgucauuauaccuaaaaucugcaucauaccugcaagccaacaguu

SEQ ID NO: 607596 - RNA, 62 nt, Homo Sapiens
aauaaucagcagaaacggaauggaaugccaagaaucugcauugagaauaacuaaacauuguu

SEQ ID NO: 607597 - RNA, 62 nt, Homo Sapiens
accguaucauuauuuguuugaggaaaaaaagaaaucugcauuuuaauucauguuggucaaag

SEQ ID NO: 607598 - RNA, 62 nt, Homo Sapiens
uuacaacucggggacaaauggacaaaaccuuuaaucugcacccucugauuuccuucugcuau

SEQ ID NO: 607599 - RNA, 62 nt, Homo Sapiens
caugccaggccucagggaucucucuguagcucaaucugcaaacuugcgacaccucaaggugu

SEQ ID NO: 607600 - RNA, 62 nt, Homo Sapiens
aguugcuuuuguacccuuuacaaacagaaagaaaucugcauggaucucuguuuuuccugggg

SEQ ID NO: 607601 - RNA, 62 nt, Homo Sapiens
aauuaagagagcugauuagaauccauuuuagaaaucugcacaacaucauaaccagcuuuuac

SEQ ID NO: 607602 - RNA, 64 nt, Homo Sapiens
guaaagcaaguuauugaaauaggacuuaagaauuaccuauuaaaaagaaaucugauauauaaaa

SEQ ID NO: 607603 - RNA, 64 nt, Homo Sapiens
caacuauuauuauucccccaaacccuaaaauucuaccuauuaggugucagguuaaaguucuaau

SEQ ID NO: 607604 - RNA, 64 nt, Homo Sapiens
cacccaagauucagcagucagauguuuacugcacaccuauuaccuauuauuugcuguucuugca

SEQ ID NO: 607605 - RNA, 64 nt, Homo Sapiens
gauucagcagucagauguuuacugcacaccuauuaccuauuauuugcuguucuugcaugguuca

SEQ ID NO: 607606 - RNA, 64 nt, Homo Sapiens
gcccggaucacaugcuguuacuggacugcccaggucaccucauugaggugagcgcugucccucc

SEQ ID NO: 607607 - RNA, 64 nt, Homo Sapiens
gccucaggaauucucccuuccacaccugcccaccucaccucacugcaccgcaccgcaccagagc

SEQ ID NO: 607608 - RNA, 64 nt, Homo Sapiens
cugaaggccgugcaccuccaccuccagccuccagucaccucaccuagcucacugcucucucucc

SEQ ID NO: 607609 - RNA, 64 nt, Homo Sapiens
aaucccagcacuuugggaggcugaggcagguggaucaccucaagucaggaguucgagaccagcc

SEQ ID NO: 607610 - RNA, 64 nt, Homo Sapiens
gcugcacucaacuauggaaaggaacaauugguacucaccucagucuauucuacaagucaguaaa

SEQ ID NO: 607611 - RNA, 64 nt, Homo Sapiens
cacagauuguauuuaugucuccuacuacuauuugucaccucaccuauguaugcagacuggaccc

SEQ ID NO: 607612 - RNA, 64 nt, Homo Sapiens
gucaagggacugcuuuggcauccagggccuccagucaccucacugccauacauuagaaaugaga

SEQ ID NO: 607613 - RNA, 64 nt, Homo Sapiens
gugaccuacagagcaugcuccacaagccccugccucaccucacugucaucacuaauaaacauca

SEQ ID NO: 607614 - RNA, 64 nt, Homo Sapiens
caccuaggauaaagugcagugaugcaaucacagcucaccucagugcggccuugaacuccuggac

SEQ ID NO: 607615 - RNA, 64 nt, Homo Sapiens
uagagguggggaagugcagugaugcaaucacagcucaccucagugcggccuugaacuccuggac

SEQ ID NO: 607616 - RNA, 64 nt, Homo Sapiens; identical to SEQ ID NO: 377431

SEQ ID NO: 607617 - RNA, 64 nt, Homo Sapiens; identical to SEQ ID NO: 377432

SEQ ID NO: 607618 - RNA, 64 nt, Homo Sapiens; identical to SEQ ID NO: 377433

SEQ ID NO: 607619 - RNA, 64 nt, Homo Sapiens; identical to SEQ ID NO: 377434

SEQ ID NO: 607620 - RNA, 64 nt, Homo Sapiens; identical to SEQ ID NO: 377435

SEQ ID NO: 607621 - RNA, 64 nt, Homo Sapiens; identical to SEQ ID NO: 377436

SEQ ID NO: 607622 - RNA, 64 nt, Homo Sapiens; identical to SEQ ID NO: 377437

SEQ ID NO: 607623 - RNA, 64 nt, Homo Sapiens; identical to SEQ ID NO: 377438

SEQ ID NO: 607624 - RNA, 64 nt, Homo Sapiens; identical to SEQ ID NO: 377439

SEQ ID NO: 607625 - RNA, 64 nt, Homo Sapiens; identical to SEQ ID NO: 377440

SEQ ID NO: 607626 - RNA, 64 nt, Homo Sapiens; identical to SEQ ID NO: 377441

SEQ ID NO: 607627 - RNA, 64 nt, Homo Sapiens; identical to SEQ ID NO: 377442

SEQ ID NO: 607628 - RNA, 64 nt, Homo Sapiens; identical to SEQ ID NO: 377443

SEQ ID NO: 607629 - RNA, 64 nt, Homo Sapiens; identical to SEQ ID NO: 377444

SEQ ID NO: 607630 - RNA, 64 nt, Homo Sapiens; identical to SEQ ID NO: 377445

SEQ ID NO: 607631 - RNA, 64 nt, Homo Sapiens; identical to SEQ ID NO: 377446

SEQ ID NO: 607632 - RNA, 64 nt, Homo Sapiens; identical to SEQ ID NO: 377447

SEQ ID NO: 607633 - RNA, 64 nt, Homo Sapiens; identical to SEQ ID NO: 377448

SEQ ID NO: 607634 - RNA, 64 nt, Homo Sapiens; identical to SEQ ID NO: 377449

SEQ ID NO: 607635 - RNA, 64 nt, Homo Sapiens; identical to SEQ ID NO: 377450

SEQ ID NO: 607636 - RNA, 64 nt, Homo Sapiens; identical to SEQ ID NO: 377451

SEQ ID NO: 607637 - RNA, 64 nt, Homo Sapiens; identical to SEQ ID NO: 377452

SEQ ID NO: 607638 - RNA, 64 nt, Homo Sapiens; identical to SEQ ID NO: 377453

SEQ ID NO: 607639 - RNA, 64 nt, Homo Sapiens; identical to SEQ ID NO: 377454

SEQ ID NO: 607640 - RNA, 64 nt, Homo Sapiens; identical to SEQ ID NO: 377455

SEQ ID NO: 607641 - RNA, 64 nt, Homo Sapiens; identical to SEQ ID NO: 377456

SEQ ID NO: 607642 - RNA, 64 nt, Homo Sapiens; identical to SEQ ID NO: 377457

SEQ ID NO: 607643 - RNA, 64 nt, Homo Sapiens; identical to SEQ ID NO: 377458

SEQ ID NO: 607644 - RNA, 64 nt, Homo Sapiens; identical to SEQ ID NO: 377459

SEQ ID NO: 607645 - RNA, 64 nt, Homo Sapiens; identical to SEQ ID NO: 377460

SEQ ID NO: 607646 - RNA, 64 nt, Homo Sapiens; identical to SEQ ID NO: 377461

SEQ ID NO: 607647 - RNA, 64 nt, Homo Sapiens; identical to SEQ ID NO: 377462

SEQ ID NO: 607648 - RNA, 64 nt, Homo Sapiens; identical to SEQ ID NO: 377463

SEQ ID NO: 607649 - RNA, 64 nt, Homo Sapiens; identical to SEQ ID NO: 377464

SEQ ID NO: 607650 - RNA, 64 nt, Homo Sapiens; identical to SEQ ID NO: 377465

SEQ ID NO: 607651 - RNA, 64 nt, Homo Sapiens; identical to SEQ ID NO: 377466

SEQ ID NO: 607652 - RNA, 64 nt, Homo Sapiens; identical to SEQ ID NO: 377467

SEQ ID NO: 607653 - RNA, 64 nt, Homo Sapiens; identical to SEQ ID NO: 377468

SEQ ID NO: 607654 - RNA, 64 nt, Homo Sapiens; identical to SEQ ID NO: 377469

SEQ ID NO: 607655 - RNA, 64 nt, Homo Sapiens; identical to SEQ ID NO: 377470

SEQ ID NO: 607656 - RNA, 64 nt, Homo Sapiens; identical to SEQ ID NO: 377471

SEQ ID NO: 607657 - RNA, 64 nt, Homo Sapiens; identical to SEQ ID NO: 377472

SEQ ID NO: 607658 - RNA, 64 nt, Homo Sapiens; identical to SEQ ID NO: 377473

SEQ ID NO: 607659 - RNA, 64 nt, Homo Sapiens; identical to SEQ ID NO: 377474

SEQ ID NO: 607660 - RNA, 64 nt, Homo Sapiens; identical to SEQ ID NO: 377475

SEQ ID NO: 607661 - RNA, 64 nt, Homo Sapiens; identical to SEQ ID NO: 377476

SEQ ID NO: 607662 - RNA, 64 nt, Homo Sapiens; identical to SEQ ID NO: 377477

SEQ ID NO: 607663 - RNA, 64 nt, Homo Sapiens; identical to SEQ ID NO: 377478

SEQ ID NO: 607664 - RNA, 64 nt, Homo Sapiens; identical to SEQ ID NO: 377479

SEQ ID NO: 607665 - RNA, 64 nt, Homo Sapiens; identical to SEQ ID NO: 377480

SEQ ID NO: 607666 - RNA, 64 nt, Homo Sapiens; identical to SEQ ID NO: 377481

SEQ ID NO: 607667 - RNA, 64 nt, Homo Sapiens; identical to SEQ ID NO: 377482

SEQ ID NO: 607668 - RNA, 64 nt, Homo Sapiens; identical to SEQ ID NO: 377483

SEQ ID NO: 607669 - RNA, 64 nt, Homo Sapiens; identical to SEQ ID NO: 377484

SEQ ID NO: 607670 - RNA, 64 nt, Homo Sapiens; identical to SEQ ID NO: 377485

SEQ ID NO: 607671 - RNA, 64 nt, Homo Sapiens; identical to SEQ ID NO: 377486

SEQ ID NO: 607672 - RNA, 64 nt, Homo Sapiens; identical to SEQ ID NO: 377487

SEQ ID NO: 607673 - RNA, 64 nt, Homo Sapiens; identical to SEQ ID NO: 377488

SEQ ID NO: 607674 - RNA, 64 nt, Homo Sapiens; identical to SEQ ID NO: 377489

SEQ ID NO: 607675 - RNA, 64 nt, Homo Sapiens; identical to SEQ ID NO: 377490

SEQ ID NO: 607676 - RNA, 64 nt, Homo Sapiens; identical to SEQ ID NO: 377491

SEQ ID NO: 607677 - RNA, 64 nt, Homo Sapiens; identical to SEQ ID NO: 377492

SEQ ID NO: 607678 - RNA, 64 nt, Homo Sapiens; identical to SEQ ID NO: 377493

SEQ ID NO: 607679 - RNA, 64 nt, Homo Sapiens; identical to SEQ ID NO: 377494

SEQ ID NO: 607680 - RNA, 64 nt, Homo Sapiens; identical to SEQ ID NO: 377495

SEQ ID NO: 607681 - RNA, 64 nt, Homo Sapiens; identical to SEQ ID NO: 377496

SEQ ID NO: 607682 - RNA, 64 nt, Homo Sapiens; identical to SEQ ID NO: 377497

SEQ ID NO: 607683 - RNA, 64 nt, Homo Sapiens; identical to SEQ ID NO: 377498

SEQ ID NO: 607684 - RNA, 64 nt, Homo Sapiens; identical to SEQ ID NO: 377499

SEQ ID NO: 607685 - RNA, 64 nt, Homo Sapiens; identical to SEQ ID NO: 377500

SEQ ID NO: 607686 - RNA, 64 nt, Homo Sapiens; identical to SEQ ID NO: 377501

SEQ ID NO: 607687 - RNA, 64 nt, Homo Sapiens; identical to SEQ ID NO: 377502

SEQ ID NO: 607688 - RNA, 64 nt, Homo Sapiens; identical to SEQ ID NO: 377503

SEQ ID NO: 607689 - RNA, 64 nt, Homo Sapiens; identical to SEQ ID NO: 377504

SEQ ID NO: 607690 - RNA, 64 nt, Homo Sapiens; identical to SEQ ID NO: 377505

SEQ ID NO: 607691 - RNA, 64 nt, Homo Sapiens; identical to SEQ ID NO: 377506

SEQ ID NO: 607692 - RNA, 64 nt, Homo Sapiens; identical to SEQ ID NO: 377507

SEQ ID NO: 607693 - RNA, 64 nt, Homo Sapiens; identical to SEQ ID NO: 377508

SEQ ID NO: 607694 - RNA, 64 nt, Homo Sapiens; identical to SEQ ID NO: 377509

SEQ ID NO: 607695 - RNA, 64 nt, Homo Sapiens
aucuccuuucacuuucccaagugacagagcagugcuggaauagcuccuaaacccaucaucuaag

SEQ ID NO: 607696 - RNA, 64 nt, Homo Sapiens
aacagugguuugaagaccccuuuucaguaggcuucuggaauagaggaaagcaaauauacaauga

SEQ ID NO: 607697 - RNA, 64 nt, Homo Sapiens
aaugugggaaagacucccuauucgaaaauuagugcuggaauaucuggccaaccauaugcagaag

SEQ ID NO: 607698 - RNA, 64 nt, Homo Sapiens
agauuuaaauauaaguacuaaaacuguaaaaauccuggaauauaaccuaagaaauaccaaugug

SEQ ID NO: 607699 - RNA, 64 nt, Homo Sapiens
ugacuaccccugaauccaccagguucaguuuaaccuggaauaucaagaaggagauugaugcauc

SEQ ID NO: 607700 - RNA, 64 nt, Homo Sapiens
ugguacucuuggauguguuugacugguguauccacuggaauaguuuauuugcaguguguugagg

SEQ ID NO: 607701 - RNA, 64 nt, Homo Sapiens
uaagacugugcaaaaaaaaauucauagaccuugacuggaauaugcuguuuguugagggucugua

SEQ ID NO: 607702 - RNA, 64 nt, Homo Sapiens
ugguguacacaagcagugcuuacuuggaaaaagucuggaauaugaaacuguuaacauagaaugu

SEQ ID NO: 607703 - RNA, 64 nt, Homo Sapiens
auacugugguuucugccuaagauuaccacaccaccuggaauaucgggcuuuuuuucaagguugg

SEQ ID NO: 607704 - RNA, 64 nt, Homo Sapiens
guggcuuacgaccugaaggaugauguucaagggacuggaauaaaucccaaauaaaaccagccug

SEQ ID NO: 607705 - RNA, 64 nt, Homo Sapiens
caguuucccugccccuguuauuagggagccaggucuggaauauugguuuaaucuaugugcaugg

SEQ ID NO: 607706 - RNA, 64 nt, Homo Sapiens
guguuaaauaucuguauauugacuggagccaccucuggaauaauaccaucucucaagccccaag

SEQ ID NO: 607707 - RNA, 64 nt, Homo Sapiens
cagaguuacauucuuggaagauuguucuauagggcuggaauauuuuggaacaccugugagagag

SEQ ID NO: 607708 - RNA, 63 nt, Homo Sapiens
gagagccggauccggaguuaccugagggaggugagcuccuaccccuccacggugggugcggag

SEQ ID NO: 607709 - RNA, 63 nt, Homo Sapiens
gaagguaccuagaaauuugaaacuucccuaaaaagcuccuaaugcccaccugcuagauagcuu

SEQ ID NO: 607710 - RNA, 63 nt, Homo Sapiens
accugggauggacauccaggugcccuucauccaagcuccuaugugaggggaauggacauuauu

SEQ ID NO: 607711 - RNA, 63 nt, Homo Sapiens
cuagaugccuaaaagaguuuauauacuucuaaaagcuccuaacuuauauccaaagaauugcuu

SEQ ID NO: 607712 - RNA, 63 nt, Homo Sapiens
auuuugcacugagccaaaggucuagcauugucaagcuccuaaaggguucauuuggccccuccu

SEQ ID NO: 607713 - RNA, 63 nt, Homo Sapiens
uuacuugcucagcacugguuauguagcacaaauagcuccuaggaaaauguuucuggggcaacc

SEQ ID NO: 607714 - RNA, 63 nt, Homo Sapiens
ugacccgaagucucugggcuagcuacuccccccagcuccuaguugauagaaauggggguucug

SEQ ID NO: 607715 - RNA, 63 nt, Homo Sapiens
cccuugagcugguuuucucugauggcacuuuugagcuccuaagcugccagccuucccuucuuu

SEQ ID NO: 607716 - RNA, 63 nt, Homo Sapiens
accagguuuaccaucucacucccaguaauacccagcuccuaucuaaagccccauucugcauga

SEQ ID NO: 607717 - RNA, 63 nt, Homo Sapiens
uggagcuauuuuuuuuucuuaaucccauaauacagcuccuaaaaguugugugggauuugcguu

SEQ ID NO: 607718 - RNA, 63 nt, Homo Sapiens
aaccacaggcagaucugaaaaagaaccaaauagagcuccuaaaaaugagaaauauuuauugaa

SEQ ID NO: 607719 - RNA, 63 nt, Homo Sapiens
cugaccccucuugcucguuccccuuccuuccgcagcuccuagucucguccgugacuuuccggu

SEQ ID NO: 607720 - RNA, 63 nt, Homo Sapiens
cuugaguugagguuaucaucucaaugaggcuuaagcuccuagaguacaggaccauuuuguuga

SEQ ID NO: 607721 - RNA, 63 nt, Homo Sapiens
aaaugcaaaacacauuuuauucuucuaauuaacagcuccuaggaaaauguagacuuuugcuuu

SEQ ID NO: 607722 - RNA, 63 nt, Homo Sapiens
aagggcccacaccugguggagcccccucuuuguagcuccuauaucgaggccacauugcuggcu

SEQ ID NO: 607723 - RNA, 63 nt, Homo Sapiens
aagaagugaucaacgugaccaagggcacccaugagcuccuaucuuuucauuugggagcuaccc

SEQ ID NO: 607724 - RNA, 63 nt, Homo Sapiens
caggcuucucuugagcccagccucuugaccuucagcuccuaugcauaugagauaagccugcaa

SEQ ID NO: 607725 - RNA, 63 nt, Homo Sapiens
uguugugugauuuggacggcagcugcccuauguagcuccuaacuacauguuugucucccugcc

SEQ ID NO: 607726 - RNA, 63 nt, Homo Sapiens
cuaacaaaguuuaaguuuacaauacagcaaauuagcuccuaacccauuauucaaauauugcuc

SEQ ID NO: 607727 - RNA, 63 nt, Homo Sapiens
gcugucgaauagaggaggagcaggagggcccucagcuccuaggaguggagacacguggcaagg

SEQ ID NO: 607728 - RNA, 63 nt, Homo Sapiens
ccuuaucaccagcugccucucauagcccagaucagcuccuaacgcucugcacccccauauggu

SEQ ID NO: 607729 - RNA, 63 nt, Homo Sapiens
ggggggacccagcugcucuuggacaaguggcugagcuccuaucuggccuccucuuuuuuuuuu

SEQ ID NO: 607730 - RNA, 63 nt, Homo Sapiens
cccacaaccuuacucuaaauuugaguagagaaaagcuccuaaagugaccuuccgggugggaag

SEQ ID NO: 607731 - RNA, 63 nt, Homo Sapiens
cgggguuucgcuguguuggccgggcuggucuccagcuccuaaccgcgagugauccgccagccu

SEQ ID NO: 607732 - RNA, 63 nt, Homo Sapiens
ucauccucugaguagggcugccagaaggcccccagcuccuacccacuccccuugaggcugcug

SEQ ID NO: 607733 - RNA, 63 nt, Homo Sapiens
ucucaguucuuugguuggaaggagcaggaaaucagcuccuauucuccaguggagagaucuggc

SEQ ID NO: 607734 - RNA, 63 nt, Homo Sapiens
agccauaauuuacuuuuaaagaauaaaguuauaagcuccuauaaucccugauugaugcuaucu

SEQ ID NO: 607735 - RNA, 63 nt, Homo Sapiens
uuugcacaggcaccagcuacgcgugggagguguagcuccuacuccccaccgcgucggcgggaa

SEQ ID NO: 607736 - RNA, 63 nt, Homo Sapiens
guuuuugagaaauuagacuguauuauauguaggagcuccuagucagauuuaaaacuuucuaca

SEQ ID NO: 607737 - RNA, 63 nt, Homo Sapiens
gugaugugaaaugcucauaccuauuauacuaaaagcuccuacuucugagcuaguuuuuuugua

SEQ ID NO: 607738 - RNA, 63 nt, Homo Sapiens
caagagaauaaaaaugggccacaaucucagagcagcuccuaaaauuggacuauuaggaauaaa

SEQ ID NO: 607739 - RNA, 63 nt, Homo Sapiens
agucuuaggugaacaaucaacuaguauuuguugagcuccuauuugcccagagauggucauauu

SEQ ID NO: 607740 - RNA, 63 nt, Homo Sapiens
aauccugagcuuuccuguccauucccagcauccagcuccuauucuagugccucuucccugcag

SEQ ID NO: 607741 - RNA, 63 nt, Homo Sapiens
ugguccacaugaacacaggcuccauccaggcccagcuccuacccaccgccucucugugggcca

SEQ ID NO: 607742 - RNA, 63 nt, Homo Sapiens
aagauuacaacugugauuuccuuuuccucagcaagcuccuauguguauauuuuccugaauuuc

SEQ ID NO: 607743 - RNA, 63 nt, Homo Sapiens
aggcccacugcaguuccuauggcgccagucaccagcuccuagacagcacuuggguaccccauu

SEQ ID NO: 607744 - RNA, 63 nt, Homo Sapiens
ggagacuaaggcaaauugggccauuaaaagcucagcuccuauguugguauuaacggugguggg

SEQ ID NO: 607745 - RNA, 63 nt, Homo Sapiens
aauuucuuauugcccuguuagaaaaauuaacugagcuccuagagaagaacaauccucauguaa

SEQ ID NO: 607746 - RNA, 63 nt, Homo Sapiens
ggcuccugggccaucuucaugugcugcuugaagagcuccuauuuuguacuccuggcuagaaug

SEQ ID NO: 607747 - RNA, 63 nt, Homo Sapiens
cugcucccagugcugcugcugaccuucacugacagcuccuaguggaagcccaagggccucuga

SEQ ID NO: 607748 - RNA, 63 nt, Homo Sapiens
ccaugggagacacugauguauccauucaaagugagcuccuaagcaguaguggugacugugggc

SEQ ID NO: 607749 - RNA, 63 nt, Homo Sapiens
cacacaugacugccccgccaggaaugagugcagagcuccuaccauguuguuccuauggaaucu

SEQ ID NO: 607750 - RNA, 63 nt, Homo Sapiens
ucucagagaacucccccacccuccguacaccccagcuccuaggggcuccccagggccccgcuu

SEQ ID NO: 607751 - RNA, 63 nt, Homo Sapiens
uuuuccuuccaagcacccaggcuggggccccuaagcuccuaggggccuggcucucccugggag

SEQ ID NO: 607752 - RNA, 63 nt, Homo Sapiens
agaaaagguaugaaaaucuuugaaaaagauccaagcuccuauugagggaaaagcagauggacu

SEQ ID NO: 607753 - RNA, 63 nt, Homo Sapiens
gggagacaugaaacauauguuauaccuucuaggagcuccuauuuagaugaagagaguaucauu

SEQ ID NO: 607754 - RNA, 63 nt, Homo Sapiens
uuuaauucuuauaauuugcaccuauauaaacaaagcuccuacuguauucuucucuucaucaac

SEQ ID NO: 607755 - RNA, 63 nt, Homo Sapiens
uuacuuuguggauauauuuaaaauucauauuauagcuccuauuaaauuccuuccaugauagau

SEQ ID NO: 607756 - RNA, 63 nt, Homo Sapiens
acagcuaaaguuugccuaugcugaguuuuuaugagcuccuaguagucugaaucacuaauauuc

SEQ ID NO: 607757 - RNA, 63 nt, Homo Sapiens
gauuuuuaacuuguacuuuuguugauagugauaagcuccuaagggguggggcaauacccauga

SEQ ID NO: 607758 - RNA, 53 nt, Homo Sapiens
gaggcucucacaguucaacaagaagcuccuacgcagguauccaggaaucguga

SEQ ID NO: 607759 - RNA, 63 nt, Homo Sapiens
acagagacugaaaggccacccauacacuucagaagcuccuaaacacuccuauguccauguaga

SEQ ID NO: 607760 - RNA, 63 nt, Homo Sapiens
cagccuuuuuuuugaaauuugaucuuuucuacaagcuccuaucuauuaaauugauguaaauca

SEQ ID NO: 607761 - RNA, 63 nt, Homo Sapiens
aaaguuauucauauuauauuuggaaagaaauaaagcuccuaguucuuauguuuucuuuuggau

SEQ ID NO: 607762 - RNA, 63 nt, Homo Sapiens
acuauuugugguuguauuauaauauuuuucucaagcuccuauugugugauucauuuuuaaaga

SEQ ID NO: 607763 - RNA, 63 nt, Homo Sapiens
aaauaugcuucaaaggucaaagcuccauuuccgagcuccuaagaacauaagcauagugcaagg

SEQ ID NO: 607764 - RNA, 63 nt, Homo Sapiens
cuuugaaaacuuaagaauccguaucugugaaagagcuccuacacagcccccuacaccaagagu

SEQ ID NO: 607765 - RNA, 63 nt, Homo Sapiens
aaaucaaacuguauucuggucuaaaacaauaaaagcuccuaaauuuaaguuauguuaagauua

SEQ ID NO: 607766 - RNA, 63 nt, Homo Sapiens
gaaauguguucaucaaaucuggucaagggacuaagcuccuagcugaccauucauucugaagau

SEQ ID NO: 607767 - RNA, 63 nt, Homo Sapiens
cuggaagcauucaggagagcuguuggugggcugagcuccuagcugaccgaccccaaaccagac

SEQ ID NO: 607768 - RNA, 63 nt, Homo Sapiens
aguggcuggccgcggauugggucccgugacucgagcuccuaccgauggugugaacucgguugg

SEQ ID NO: 607769 - RNA, 63 nt, Homo Sapiens
gaaauuucuuagguagggaagauaggcaacaguagcuccuacuauuuucaugcucauaaaucu

SEQ ID NO: 607770 - RNA, 63 nt, Homo Sapiens
ugugcauucuccaccccuccgccaauggcuuccagcuccuaaaacaccuggacauuccccauc

SEQ ID NO: 607771 - RNA, 63 nt, Homo Sapiens
aggggagcuugagaagaauaaaagggauaaacgagcuccuaguuuuaaaaucucugccauugc

SEQ ID NO: 607772 - RNA, 63 nt, Homo Sapiens
gcugcauuucacacaacugugaaccgaauaaauagcuccuauuuggucuaugacuucugccac

SEQ ID NO: 607773 - RNA, 63 nt, Homo Sapiens
uugauggcuguguguuuggcuugguuuuuuaauagcuccuauuuuuucuuguuuugguuuggu

SEQ ID NO: 607774 - RNA, 63 nt, Homo Sapiens
cucuccuuguuuuauuaaacaagcacgagugacagcuccuaacuggauuuagaagcgucauga

SEQ ID NO: 607775 - RNA, 63 nt, Homo Sapiens
gaugcaccaaaccaagugcccauuccacuuuuuagcuccuauugugugugaaagcagguggac

SEQ ID NO: 607776 - RNA, 63 nt, Homo Sapiens
acaugagaaucaagccucuuccaaggggacugcagcuccuagacuguaccuauuuaaagucca

SEQ ID NO: 607777 - RNA, 63 nt, Homo Sapiens
uugggcccucaggggcugcaaggaggggccuacagcuccuaccuccccaagaagagggaaggc

SEQ ID NO: 607778 - RNA, 63 nt, Homo Sapiens
uggugcacuggaagaaccagguuccaccgcuggagcuccuacagagcgccaguggaaggccga

SEQ ID NO: 607779 - RNA, 63 nt, Homo Sapiens
aaugguagaauacacaugaauuuauauuuacugagcuccuaaagguuuuguauugaaacaaug

SEQ ID NO: 607780 - RNA, 63 nt, Homo Sapiens
uuagcagcuucgaccucauuuuccagaugcaccagcuccuauuaauaaguuagcaaggaaagu

SEQ ID NO: 607781 - RNA, 63 nt, Homo Sapiens
aucuuucugggagcugcgccggacagaguggggagcuccuaguuuguggggggaagcuuugau

SEQ ID NO: 607782 - RNA, 63 nt, Homo Sapiens
agcaguauuauuaaauggauucauuuuaaaaauagcuccuauauuuuguaacaugucucaaac

SEQ ID NO: 607783 - RNA, 63 nt, Homo Sapiens
caagauugccccaacuuaaacgccacauaaaacagcuccuaauugacaugggcaaaguacagc

SEQ ID NO: 607784 - RNA, 63 nt, Homo Sapiens
gggugauugggcagggccugagcuggacaggggagcuccuaguaggggaggggaggggaugcu

SEQ ID NO: 607785 - RNA, 63 nt, Homo Sapiens
ccugcccagcagcccugagcaggcuggggccacagcuccuaccagaggcuuucaugagcccca

SEQ ID NO: 607786 - RNA, 63 nt, Homo Sapiens
acugccugaagacacacagcaauaagugauuacagcuccuagacuaccuuccaaaaccuguuu

SEQ ID NO: 607787 - RNA, 63 nt, Homo Sapiens
gagaccggaauaaacucaaucuuuucuuucccaagcuccuagccaacacuauccuugggagaa

SEQ ID NO: 607788 - RNA, 63 nt, Homo Sapiens
aacuuauucauaguccuauuggacagcaggagcagcuccuacagugaacuauuggcaccaccg

SEQ ID NO: 607789 - RNA, 63 nt, Homo Sapiens
guggcuuuucuuucucuaacgaucucccuuguaagcuccuaagaaaaagcagaaauacacaau

SEQ ID NO: 607790 - RNA, 63 nt, Homo Sapiens
uguuuucuccuucugucucuugauuuugaguaaagcuccuaucaaugaaaaauagugucuuug

SEQ ID NO: 607791 - RNA, 63 nt, Homo Sapiens
acucuucuuagagacucucccuuauccucaccuagcuccuaccgucuagucugcccaaaauua

SEQ ID NO: 607792 - RNA, 63 nt, Homo Sapiens
aaguauaggacacaaauguuguugucuugaccaagcuccuacuuuaguuuuguuaauauuugu

SEQ ID NO: 607793 - RNA, 63 nt, Homo Sapiens
aucagaggauuaacacuagcuuaugcuggaaagagcuccuagcgcuggcaguguuuggggaca

SEQ ID NO: 607794 - RNA, 63 nt, Homo Sapiens
ugcaaacuguguucacccuuucugggaacaggcagcuccuaucccuccugccccagcccaacc

SEQ ID NO: 607795 - RNA, 63 nt, Homo Sapiens
ucaccauguacuaggagcucugauagccagcucagcuccuaauccuugaggcaacauucuuuu

SEQ ID NO: 607796 - RNA, 63 nt, Homo Sapiens
ugcaaagggcagaggcugggaguuuggacgcuuagcuccuaccccuguccuaccucaccgggg

SEQ ID NO: 607797 - RNA, 63 nt, Homo Sapiens
uuggaauuuucaucauguuugcuuauuaaacaaagcuccuacugccaucauacuaaucaugca

SEQ ID NO: 607798 - RNA, 63 nt, Homo Sapiens
uaaagucaccuuccuaccauuagagcagaagacagcuccuauaguuuuguauuuuggcagcua

SEQ ID NO: 607799 - RNA, 63 nt, Homo Sapiens
auauuauaucaggugccaggaaucccuugggucagcuccuauccucuggacggggagcaucau

SEQ ID NO: 607800 - RNA, 63 nt, Homo Sapiens
ccucuggcuuccugguagagaauauggauggcgagcuccuaggccuuuugaccuuuucaaaua

SEQ ID NO: 607801 - RNA, 63 nt, Homo Sapiens
ggauagagcuggacagauuccuguuuuauuuguagcuccuagaucaauugcuuaucuacaauu

SEQ ID NO: 607802 - RNA, 63 nt, Homo Sapiens
ucuguuauccagcuccaaguaugucugucauccagcuccuaugaaaaauaaaagaauaaaagu

SEQ ID NO: 607803 - RNA, 63 nt, Homo Sapiens
cagagccugcuuggccccacuguuaguccagcgagcuccuauaucaaaaugccguaggccggg

SEQ ID NO: 607804 - RNA, 63 nt, Homo Sapiens
guaccccagccccacucagcacugacaguccccagcuccuaguagugagcugggaggcgcuuc

SEQ ID NO: 607805 - RNA, 63 nt, Homo Sapiens
cccgcagggagcugguggcuccagccccacuagagcuccuaaagaucacacagcagcugcucc

SEQ ID NO: 607806 - RNA, 63 nt, Homo Sapiens
ugaacagauuuaaaauggcugguguuaaauaucagcuccuaauaagauguggacugaaaacac

SEQ ID NO: 607807 - RNA, 63 nt, Homo Sapiens
gucuaggggguuccauucuggccaugcgagcccagcuccuaccaacgucgguaacuugagcag

SEQ ID NO: 607808 - RNA, 63 nt, Homo Sapiens
agcgugaccccuccugcugggaccuguguuguaagcuccuauuugcuuaucuuguuuauuuca

SEQ ID NO: 607809 - RNA, 63 nt, Homo Sapiens
caguucccagaaucaaagcaaugcauuuuggaaagcuccuagcagagagacuuucagcccuaa

SEQ ID NO: 607810 - RNA, 63 nt, Homo Sapiens
ggaaaaagcuuucuucugacuucacucugcugaagcuccuaaucuguuugcuguguugaacuc

SEQ ID NO: 607811 - RNA, 63 nt, Homo Sapiens
ucugugccagggcagcauuuagcaguguugcucagcuccuaccuuacauguguuuauucaucc

SEQ ID NO: 607812 - RNA, 63 nt, Homo Sapiens
uggggccuauuucuacuuucaggccaggccuguagcuccuaccgcuggagcaggggucaugug

SEQ ID NO: 607813 - RNA, 63 nt, Homo Sapiens
ccaggaaaaaagauccaaugccuauccucuccaagcuccuauugaaauaucaacugaugauau

SEQ ID NO: 607814 - RNA, 63 nt, Homo Sapiens
uuugccacaagguggugcuuucuguaauuuaaaagcuccuacucuggguaacaagcccuaacu

SEQ ID NO: 607815 - RNA, 63 nt, Homo Sapiens
uccugccuucagacaaacagcuuagacuccguuagcuccuauuuuuaaaagauaaccuuuggc

SEQ ID NO: 607816 - RNA, 63 nt, Homo Sapiens
accuagaagcauuaugaagcgcaaagucucuaaagcuccuaguggcuuuucaacgggaguaaa

SEQ ID NO: 607817 - RNA, 63 nt, Homo Sapiens
ccagcgagaauucuucauccuccacgguucacuagcuccuaccugaagaggaaagggggccau

SEQ ID NO: 607818 - RNA, 63 nt, Homo Sapiens
caugcauuugaauaaagugccucccuuagccugagcuccuaaagaccucuuguacuugguugc

SEQ ID NO: 607819 - RNA, 63 nt, Homo Sapiens
ucaagccuccaaguaguggcauaucagucuuggagcuccuagcuggugauacggagagggcuu

SEQ ID NO: 607820 - RNA, 63 nt, Homo Sapiens
cuuuccuucccuggagagaaccgucuuuaccucagcuccuagggccuccagccccccagcucc

SEQ ID NO: 607821 - RNA, 63 nt, Homo Sapiens
cacuauuuuagcauaauaaaagaaaguccaaagagcuccuauauagacuacuccagauaacuu

SEQ ID NO: 607822 - RNA, 63 nt, Homo Sapiens
uaaucucuagccauaaaaacauaaguaauaguaagcuccuaagcuuggacaaaggcuggauuc

SEQ ID NO: 607823 - RNA, 63 nt, Homo Sapiens
gguacaggcuaggcagaaugugccuagaugaucagcuccuaguaaaaaccuugagaacuaagu

SEQ ID NO: 607824 - RNA, 63 nt, Homo Sapiens
auuucuuauaucccucgucagcaaagccaaaauagcuccuacacaucagggguuuucuuuaug

SEQ ID NO: 607825 - RNA, 63 nt, Homo Sapiens
gaccacuggccauuagcucugcagggcuaaagcagcuccuaagagaaacucccugucuuuggg

SEQ ID NO: 607826 - RNA, 63 nt, Homo Sapiens
uacugguugauguguuuuuuaugacuuagaucuagcuccuaccccguguccguagcugucagu

SEQ ID NO: 607827 - RNA, 63 nt, Homo Sapiens
ucuugauguuuucuugucauuguuguuaucucaagcuccuaucuuacauguucuguuauuuaa

SEQ ID NO: 607828 - RNA, 63 nt, Homo Sapiens
agcuuuccucccaaaggcuucaaacccauuuccagcuccuagucauucuaaacuccuuuccug

SEQ ID NO: 607829 - RNA, 63 nt, Homo Sapiens
acaugcaugcacacaaacguguacacaagugugagcuccuacacgcauacacacacacacgug

SEQ ID NO: 607830 - RNA, 63 nt, Homo Sapiens
acacaugcauguacagguaagcacacauguacaagcuccuacaggcuugcucucacacacgug

SEQ ID NO: 607831 - RNA, 63 nt, Homo Sapiens
aguucuuaauuuauaacuaaauucuuacauucaagcuccuaagaaccccagccccaacuuaaa

SEQ ID NO: 607832 - RNA, 63 nt, Homo Sapiens
acucuugguugggccugguugacuuugccagucagcuccuacagugaucaguuggccaccucu

SEQ ID NO: 607833 - RNA, 63 nt, Homo Sapiens
gagcauucuaucuuuuggcuuucagagugauagagcuccuaacagguguacaggcccaagagu

SEQ ID NO: 607834 - RNA, 63 nt, Homo Sapiens
uaucagguuaagagcaaggggaaaugaaggacuagcuccuauguccacaaaggggagcauuug

SEQ ID NO: 607835 - RNA, 63 nt, Homo Sapiens
ucccugccccucccuaaucaauaauauaccauaagcuccuacucauagauuuuucccagccuu

SEQ ID NO: 607836 - RNA, 63 nt, Homo Sapiens
uucuguguauaucauuaacaccuucuuuauuccagcuccuaugcuugcuauaaccuaagcaug

SEQ ID NO: 607837 - RNA, 63 nt, Homo Sapiens
aaagguugggauaggcgcagcagcuauaagacaagcuccuacgcucacuguucccugaucauu

SEQ ID NO: 607838 - RNA, 63 nt, Homo Sapiens
cagcuggccugcugcucuccagucaaguagcgaagcuccuaccacccagacacccaaacagcc

SEQ ID NO: 607839 - RNA, 63 nt, Homo Sapiens
agcaaccacugaugugauuucuucgucuccccuagcuccuagauccccuuguacccccuucca

SEQ ID NO: 607840 - RNA, 63 nt, Homo Sapiens
gugauaaguguaucccagaugauugauuugagcagcuccuacucccagauugcguagcauuca

SEQ ID NO: 607841 - RNA, 63 nt, Homo Sapiens
cgcuccaacuuccuucccugccuuuucccuccaagcuccuauuuuacugugucagcuggaagg

SEQ ID NO: 607842 - RNA, 63 nt, Homo Sapiens
aguggaucagagagacuaggacaguuacugcagagcuccuaagucaccacucaaccaguggcu

SEQ ID NO: 607843 - RNA, 63 nt, Homo Sapiens
uugucuucuggucacaccucacuauguccccucagcuccuaucucuguauggccugguuuuuc

SEQ ID NO: 607844 - RNA, 63 nt, Homo Sapiens
ugagcagaggcugggcauugccacuaggaccugagcuccuagagaacaaggaccuggguggcc

SEQ ID NO: 607845 - RNA, 63 nt, Homo Sapiens
uccuccagggcgacggccggggacugccuggagagcuccuauuucaaggagaagccccuacgu

SEQ ID NO: 607846 - RNA, 63 nt, Homo Sapiens
ucuucauucacuuaacaaguccacuuagagcccagcuccuacccuaaucagcaaguccagugg

SEQ ID NO: 607847 - RNA, 63 nt, Homo Sapiens
ugccucccacgccucaggugcccgcccucccccagcuccuaccacacagaaaccccucuucuc

SEQ ID NO: 607848 - RNA, 63 nt, Homo Sapiens
ucgugggccugguuucagcucugugugcucuccagcuccuaagaccaacucgaguguucagcc

SEQ ID NO: 607849 - RNA, 63 nt, Homo Sapiens
aucagaagaagcugauacaucaugagaaguggaagcuccuaguggagaccacuuuuauuuacu

SEQ ID NO: 607850 - RNA, 63 nt, Homo Sapiens
gaguaggguugugccuuauucaacugcauacauagcuccuagcacagugccuuauucgguagg

SEQ ID NO: 607851 - RNA, 63 nt, Homo Sapiens
uauaucuagaaaaccccaugaucuuggcccaaaagcuccuagaucugauaaacaacuucagcu

SEQ ID NO: 607852 - RNA, 63 nt, Homo Sapiens
agaaccuuguguccuuugaauucucgcccugccagcuccuagaaauaguuucaaucuuggaau

SEQ ID NO: 607853 - RNA, 63 nt, Homo Sapiens
cuucucucagccuccccaccagugauggauaacagcuccuauucucagcugaccugacugagc

SEQ ID NO: 607854 - RNA, 63 nt, Homo Sapiens
uggucccuuccauuccccugaaaccugcaugagagcuccuaacauguuucuccaaugcaauca

SEQ ID NO: 607855 - RNA, 63 nt, Homo Sapiens
uuuacucuagggaaaacacugacgaauggucagagcuccuauccugaucuuuucaucaaggcg

SEQ ID NO: 607856 - RNA, 63 nt, Homo Sapiens
uuuccuggggcaugccugaucagcgugggcuggagcuccuagaccaaccccagcuuucucacc

SEQ ID NO: 607857 - RNA, 63 nt, Homo Sapiens
uaccuuaucuuacugaauucaagaagaucugacagcuccuauaaaaugguuauacgugggcaa

SEQ ID NO: 607858 - RNA, 63 nt, Homo Sapiens
agaggcugaaggccacagggugcccagaguggaagcuccuagugccaggaaguauaugugagu

SEQ ID NO: 607859 - RNA, 63 nt, Homo Sapiens
augaaaaauaaaauguuuguuauacucugcuacagcuccuaucggggcuggcagaggccccca

SEQ ID NO: 607860 - RNA, 63 nt, Homo Sapiens
augcccuguaauuuuucugggagaccccagucaagcuccuaguugaugggccacaaggaaaga

SEQ ID NO: 607861 - RNA, 63 nt, Homo Sapiens
aaacagaguccagugggauuguguggacaggcaagcuccuaauugacagaggagaagucaagu

SEQ ID NO: 607862 - RNA, 63 nt, Homo Sapiens
aaaggaugcaauauaaugacggucgugauaaugagcuccuauggguaaaguagguaucuuuca

SEQ ID NO: 607863 - RNA, 63 nt, Homo Sapiens
uucggucaaaugcuguuuuucuucccugguccaagcuccuaucuucuuugaauuuggauauuc

SEQ ID NO: 607864 - RNA, 63 nt, Homo Sapiens
auaugucaggcccuaugccuugaauaucccuagagcuccuaccuccuauguucuuuuguucag

SEQ ID NO: 607865 - RNA, 63 nt, Homo Sapiens
gagcagacugccccccgagcagaggggucuuggagcuccuauggcccguggaagcagcgucaa

SEQ ID NO: 607866 - RNA, 63 nt, Homo Sapiens
gauguagucuuguuucauagucuauuaagaaauagcuccuaaggcuacuaaacugcuuuguau

SEQ ID NO: 607867 - RNA, 63 nt, Homo Sapiens
cuuggccauucccaggaggcccaaacaggcugaagcuccuaaaaggcgcuggagccuccaggc

SEQ ID NO: 607868 - RNA, 63 nt, Homo Sapiens
agaacuauaggauuucuucuaggaaauggugaaagcuccuaucaauguucagugauaucacug

SEQ ID NO: 607869 - RNA, 63 nt, Homo Sapiens
ccaaacuggaacucuacauuuuguaucuuuuaaagcuccuauaaguaaaauaacuauuggcuu

SEQ ID NO: 607870 - RNA, 63 nt, Homo Sapiens
cgagauaugacaccuaaggaauuccccugcuucagcuccuagcucagccacugacugccccuc

SEQ ID NO: 607871 - RNA, 63 nt, Homo Sapiens
ucucuuaguccccuuuagcugucuucuauccccagcuccuaacugggacucugugucuaugca

SEQ ID NO: 607872 - RNA, 63 nt, Homo Sapiens
ucugaccccagcuucucucucccccacagcgucagcuccuaccccucaccuuucaccccccac

SEQ ID NO: 607873 - RNA, 63 nt, Homo Sapiens
ucugaccccaacuucucuuuccaccugagccccagcuccuacccuugccucaccuuuaacccc

SEQ ID NO: 607874 - RNA, 63 nt, Homo Sapiens
guggccucagcuagguaaccgauuuucggccucagcuccuagaacuggauuucuuuuucuccu

SEQ ID NO: 607875 - RNA, 63 nt, Homo Sapiens
gggggaagaggagagaccccccucagcucccucagcuccuagaucccugucccucaugccgcu

SEQ ID NO: 607876 - RNA, 63 nt, Homo Sapiens
caauguauuaaguaaggaaaaacacaacacuugagcuccuagcguaucuuccaucagcauaac

SEQ ID NO: 607877 - RNA, 63 nt, Homo Sapiens
acgcuuagaauuucaugaguguuccuggcauagagcuccuaaaacauuuggucuuuguuccug

SEQ ID NO: 607878 - RNA, 63 nt, Homo Sapiens
gcgguuaggaguucugggugaccauccuggcucagcuccuaacucaccaugugacaucaggcu

SEQ ID NO: 607879 - RNA, 63 nt, Homo Sapiens
uuuucaaaggcaaauuuaaacuauuuaagaaauagcuccuaauacuugggaucuuguuuagag

SEQ ID NO: 607880 - RNA, 63 nt, Homo Sapiens
ggauuuugcuuccuccccggugcuaaauuagcaagcuccuagagaagccaugugauucccaga

SEQ ID NO: 607881 - RNA, 55 nt, Homo Sapiens
augaacagauuuaaagacaggagguagcuccuaaacaagauccugccucugguga

SEQ ID NO: 607882 - RNA, 63 nt, Homo Sapiens
auuuccugcuccucuugguuggucaggcacugaagcuccuacacaggucacuguugaaacuca

SEQ ID NO: 607883 - RNA, 63 nt, Homo Sapiens
ccccaccucacuuucuagagcccugucuguccuagcuccuaucugaccuuguguguaaauacg

SEQ ID NO: 607884 - RNA, 63 nt, Homo Sapiens
accaguaagagacuaaaucugcaauauauaaagagcuccuacaaaucaguaacaugaagaaca

SEQ ID NO: 607885 - RNA, 63 nt, Homo Sapiens
agccugccucacagaguuuagacaugacuagccagcuccuacaaucacugaagucaauuccuu

SEQ ID NO: 607886 - RNA, 63 nt, Homo Sapiens
aggcccggggugggaccagaggcucuugcucccagcuccuauucaccaaagagaagauggacc

SEQ ID NO: 607887 - RNA, 63 nt, Homo Sapiens
cauagagcuuccuuuccagaaagaggccuuggcagcuccuagcuaaccugugaugucacacuc

SEQ ID NO: 607888 - RNA, 63 nt, Homo Sapiens
cccuggacccuuggcugggaccucucugaccucagcuccuagaugccucccccaccuccuggg

SEQ ID NO: 607889 - RNA, 63 nt, Homo Sapiens
aggcugcgugcaggugcgugccuucagcagggcagcuccuaaggugacugagagggaugaccu

SEQ ID NO: 607890 - RNA, 63 nt, Homo Sapiens
aauauuuauagaguucauagaaauacaucaauaagcuccuaaauuauagagccucaauuuugg

SEQ ID NO: 607891 - RNA, 63 nt, Homo Sapiens
cuaauugguaauuuauagaacaaauauuugauaagcuccuauuaauugucaccccaccaagcg

SEQ ID NO: 607892 - RNA, 63 nt, Homo Sapiens
ugacaacaacuucaguauggucuggagcuuaccagcuccuaccaguccagugugcuuauaagu

SEQ ID NO: 607893 - RNA, 63 nt, Homo Sapiens
gacuggacaugccuggaagagcccaccgguggcagcuccuagugccuagagccuggcacucaa

SEQ ID NO: 607894 - RNA, 65 nt, Homo Sapiens
gugagagccggauccggaguuaccugagggaggugagcuccuaccccuccacggugggugcggag

SEQ ID NO: 607895 - RNA, 65 nt, Homo Sapiens
aagaagguaccuagaaauuugaaacuucccuaaaaagcuccuaaugcccaccugcuagauagcuu

SEQ ID NO: 607896 - RNA, 65 nt, Homo Sapiens
auaccugggauggacauccaggugcccuucauccaagcuccuaugugaggggaauggacauuauu

SEQ ID NO: 607897 - RNA, 65 nt, Homo Sapiens
cucuagaugccuaaaagaguuuauauacuucuaaaagcuccuaacuuauauccaaagaauugcuu

SEQ ID NO: 607898 - RNA, 65 nt, Homo Sapiens
ugauuuugcacugagccaaaggucuagcauugucaagcuccuaaaggguucauuuggccccuccu

SEQ ID NO: 607899 - RNA, 65 nt, Homo Sapiens
ccuuacuugcucagcacugguuauguagcacaaauagcuccuaggaaaauguuucuggggcaacc

SEQ ID NO: 607900 - RNA, 65 nt, Homo Sapiens
ccugacccgaagucucugggcuagcuacuccccccagcuccuaguugauagaaauggggguucug

SEQ ID NO: 607901 - RNA, 65 nt, Homo Sapiens
cucccuugagcugguuuucucugauggcacuuuugagcuccuaagcugccagccuucccuucuuu

SEQ ID NO: 607902 - RNA, 65 nt, Homo Sapiens
uaaccagguuuaccaucucacucccaguaauacccagcuccuaucuaaagccccauucugcauga

SEQ ID NO: 607903 - RNA, 65 nt, Homo Sapiens
cauggagcuauuuuuuuuucuuaaucccauaauacagcuccuaaaaguugugugggauuugcguu

SEQ ID NO: 607904 - RNA, 65 nt, Homo Sapiens
ggaaccacaggcagaucugaaaaagaaccaaauagagcuccuaaaaaugagaaauauuuauugaa

SEQ ID NO: 607905 - RNA, 65 nt, Homo Sapiens
cccugaccccucuugcucguuccccuuccuuccgcagcuccuagucucguccgugacuuuccggu

SEQ ID NO: 607906 - RNA, 65 nt, Homo Sapiens
gucuugaguugagguuaucaucucaaugaggcuuaagcuccuagaguacaggaccauuuuguuga

SEQ ID NO: 607907 - RNA, 65 nt, Homo Sapiens
aaaaaugcaaaacacauuuuauucuucuaauuaacagcuccuaggaaaauguagacuuuugcuuu

SEQ ID NO: 607908 - RNA, 65 nt, Homo Sapiens
aagggcccacaccugguggacugcccccucuuuguagcuccuauaugucgaggccacauugcugg

SEQ ID NO: 607909 - RNA, 65 nt, Homo Sapiens
aagaagugaucaacgugaccccaagggcacccaugagcuccuaucaguuuucauuugggagcuac

SEQ ID NO: 607910 - RNA, 65 nt, Homo Sapiens
caggcuucucuugagcccagaaccucuugaccuucagcuccuaugugcauaugagauaagccugc

SEQ ID NO: 607911 - RNA, 65 nt, Homo Sapiens
uguugugugauuuggacggcccagcugcccuauguagcuccuaacacuacauguuugucucccug

SEQ ID NO: 607912 - RNA, 65 nt, Homo Sapiens
cuaacaaaguuuaaguuuacucaauacagcaaauuagcuccuaacuaccauuauucaaauauugc

SEQ ID NO: 607913 - RNA, 65 nt, Homo Sapiens
gcugucgaauagaggaggagggcaggagggcccucagcuccuaggacaguggagacacguggcaa

SEQ ID NO: 607914 - RNA, 65 nt, Homo Sapiens
ccuuaucaccagcugccucugucauagcccagaucagcuccuaacuugcucugcacccccauaug

SEQ ID NO: 607915 - RNA, 65 nt, Homo Sapiens
cuggggggacccagcugcucuuggacaaguggcugagcuccuaucuggccuccucuuuuuuuuuu

SEQ ID NO: 607916 - RNA, 65 nt, Homo Sapiens
gccccacaaccuuacucuaaauuugaguagagaaaagcuccuaaagugaccuuccgggugggaag

SEQ ID NO: 607917 - RNA, 65 nt, Homo Sapiens
gacgggguuucgcuguguuggccgggcuggucuccagcuccuaaccgcgagugauccgccagccu

SEQ ID NO: 607918 - RNA, 65 nt, Homo Sapiens
gaucauccucugaguagggcugccagaaggcccccagcuccuacccacuccccuugaggcugcug

SEQ ID NO: 607919 - RNA, 65 nt, Homo Sapiens
cuucucaguucuuugguuggaaggagcaggaaaucagcuccuauucuccaguggagagaucuggc

SEQ ID NO: 607920 - RNA, 65 nt, Homo Sapiens
agccauaauuuacuuuuaaacugaauaaaguuauaagcuccuauaucaucccugauugaugcuau

SEQ ID NO: 607921 - RNA, 65 nt, Homo Sapiens
uuugcacaggcaccagcuacaagcgugggagguguagcuccuacuacccccaccgcgucggcggg

SEQ ID NO: 607922 - RNA, 65 nt, Homo Sapiens
guuuuugagaaauuagacugcauauuauauguaggagcuccuaguuacagauuuaaaacuuucua

SEQ ID NO: 607923 - RNA, 65 nt, Homo Sapiens
gugaugugaaaugcucauacuacuauuauacuaaaagcuccuacuuuucugagcuaguuuuuuug

SEQ ID NO: 607924 - RNA, 65 nt, Homo Sapiens
caagagaauaaaaaugggccaaacaaucucagagcagcuccuaaaaaauuggacuauuaggaaua

SEQ ID NO: 607925 - RNA, 65 nt, Homo Sapiens
aaagucuuaggugaacaaucaacuaguauuuguugagcuccuauuugcccagagauggucauauu

SEQ ID NO: 607926 - RNA, 65 nt, Homo Sapiens
aaaauccugagcuuuccuguccauucccagcauccagcuccuauucuagugccucuucccugcag

SEQ ID NO: 607927 - RNA, 65 nt, Homo Sapiens
ucugguccacaugaacacaggcuccauccaggcccagcuccuacccaccgccucucugugggcca

SEQ ID NO: 607928 - RNA, 65 nt, Homo Sapiens
ugaagauuacaacugugauuuccuuuuccucagcaagcuccuauguguauauuuuccugaauuuc

SEQ ID NO: 607929 - RNA, 65 nt, Homo Sapiens
caaggcccacugcaguuccuauggcgccagucaccagcuccuagacagcacuuggguaccccauu

SEQ ID NO: 607930 - RNA, 65 nt, Homo Sapiens
cuggagacuaaggcaaauugggccauuaaaagcucagcuccuauguugguauuaacggugguggg

SEQ ID NO: 607931 - RNA, 65 nt, Homo Sapiens
agaauuucuuauugcccuguuagaaaaauuaacugagcuccuagagaagaacaauccucauguaa

SEQ ID NO: 607932 - RNA, 65 nt, Homo Sapiens
aaggcuccugggccaucuucaugugcugcuugaagagcuccuauuuuguacuccuggcuagaaug

SEQ ID NO: 607933 - RNA, 65 nt, Homo Sapiens
cacugcucccagugcugcugcugaccuucacugacagcuccuaguggaagcccaagggccucuga

SEQ ID NO: 607934 - RNA, 65 nt, Homo Sapiens
ccaugggagacacugauguagcuccauucaaagugagcuccuaagcccaguaguggugacugugg

SEQ ID NO: 607935 - RNA, 65 nt, Homo Sapiens
cacacaugacugccccgccacuggaaugagugcagagcuccuaccuuauguuguuccuauggaau

SEQ ID NO: 607936 - RNA, 65 nt, Homo Sapiens
ucucagagaacucccccaccuucuccguacaccccagcuccuagggaggcuccccagggccccgc

SEQ ID NO: 607937 - RNA, 65 nt, Homo Sapiens
uuuuccuuccaagcacccagaggcuggggccccuaagcuccuaggagggccuggcucucccuggg

SEQ ID NO: 607938 - RNA, 65 nt, Homo Sapiens
agaaaagguaugaaaaucuucuugaaaaagauccaagcuccuauuaggagggaaaagcagaugga

SEQ ID NO: 607939 - RNA, 65 nt, Homo Sapiens
gggagacaugaaacauauguuuuauaccuucuaggagcuccuauuccuagaugaagagaguauca

SEQ ID NO: 607940 - RNA, 65 nt, Homo Sapiens
auuuuaauucuuauaauuugcaccuauauaaacaaagcuccuacuguauucuucucuucaucaac

SEQ ID NO: 607941 - RNA, 65 nt, Homo Sapiens
cuuuacuuuguggauauauuuaaaauucauauuauagcuccuauuaaauuccuuccaugauagau

SEQ ID NO: 607942 - RNA, 65 nt, Homo Sapiens
acagcuaaaguuugccuauguccugaguuuuuaugagcuccuaguguagucugaaucacuaauau

SEQ ID NO: 607943 - RNA, 65 nt, Homo Sapiens
gauuuuuaacuuguacuuuugaguugauagugauaagcuccuaaguuggguggggcaauacccau

SEQ ID NO: 607944 - RNA, 53 nt, Homo Sapiens; identical to SEQ ID NO: 607758

SEQ ID NO: 607945 - RNA, 65 nt, Homo Sapiens
acagagacugaaaggccaccgacauacacuucagaagcuccuaaauccacuccuauguccaugua

SEQ ID NO: 607946 - RNA, 65 nt, Homo Sapiens
cagccuuuuuuuugaaauuucagaucuuuucuacaagcuccuaucuuuauuaaauugauguaaau

SEQ ID NO: 607947 - RNA, 65 nt, Homo Sapiens
aaaguuauucauauuauauuauuggaaagaaauaaagcuccuaguuaucuuauguuuucuuuugg

SEQ ID NO: 607948 - RNA, 65 nt, Homo Sapiens
acuauuugugguuguauuaugaaauauuuuucucaagcuccuauugugugugauucauuuuuaaa

SEQ ID NO: 607949 - RNA, 65 nt, Homo Sapiens
aaauaugcuucaaaggucaaggagcuccauuuccgagcuccuaagacaacauaagcauagugcaa

SEQ ID NO: 607950 - RNA, 65 nt, Homo Sapiens
cuuugaaaacuuaagaauccguguaucugugaaagagcuccuacauacagcccccuacaccaaga

SEQ ID NO: 607951 - RNA, 65 nt, Homo Sapiens
aaaucaaacuguauucugguuacuaaaacaauaaaagcuccuaaaauuuuaaguuauguuaagau

SEQ ID NO: 607952 - RNA, 65 nt, Homo Sapiens
cagaaauguguucaucaaaucuggucaagggacuaagcuccuagcugaccauucauucugaagau

SEQ ID NO: 607953 - RNA, 65 nt, Homo Sapiens
cuggaagcauucaggagagcacuguuggugggcugagcuccuagcggugaccgaccccaaaccag

SEQ ID NO: 607954 - RNA, 65 nt, Homo Sapiens
aguggcuggccgcggauugggggucccgugacucgagcuccuaccaggauggugugaacucgguu

SEQ ID NO: 607955 - RNA, 65 nt, Homo Sapiens
gaaauuucuuagguagggaacugauaggcaacaguagcuccuacugcauuuucaugcucauaaau

SEQ ID NO: 607956 - RNA, 65 nt, Homo Sapiens
ccugugcauucuccaccccuccgccaauggcuuccagcuccuaaaacaccuggacauuccccauc

SEQ ID NO: 607957 - RNA, 65 nt, Homo Sapiens
caaggggagcuugagaagaauaaaagggauaaacgagcuccuaguuuuaaaaucucugccauugc

SEQ ID NO: 607958 - RNA, 65 nt, Homo Sapiens
uugcugcauuucacacaacugugaaccgaauaaauagcuccuauuuggucuaugacuucugccac

SEQ ID NO: 607959 - RNA, 65 nt, Homo Sapiens
uugauggcuguguguuuggcguuugguuuuuuaauagcuccuauuguuuuucuuguuuugguuug

SEQ ID NO: 607960 - RNA, 65 nt, Homo Sapiens
cucuccuuguuuuauuaaacgaaagcacgagugacagcuccuaacuuuggauuuagaagcgucau

SEQ ID NO: 607961 - RNA, 65 nt, Homo Sapiens
gaugcaccaaaccaagugccaccauuccacuuuuuagcuccuauugcgugugugaaagcaggugg

SEQ ID NO: 607962 - RNA, 65 nt, Homo Sapiens
acaugagaaucaagccucuucaccaaggggacugcagcuccuagauucuguaccuauuuaaaguc

SEQ ID NO: 607963 - RNA, 65 nt, Homo Sapiens
uugggcccucaggggcugcagcaggaggggccuacagcuccuaccgauccccaagaagagggaag

SEQ ID NO: 607964 - RNA, 65 nt, Homo Sapiens
uggugcacuggaagaaccaggaguuccaccgcuggagcuccuacacggagcgccaguggaaggcc

SEQ ID NO: 607965 - RNA, 65 nt, Homo Sapiens
aaugguagaauacacaugaauguuuauauuuacugagcuccuaaaaagguuuuguauugaaacaa

SEQ ID NO: 607966 - RNA, 65 nt, Homo Sapiens
cauuagcagcuucgaccucauuuuccagaugcaccagcuccuauuaauaaguuagcaaggaaagu

SEQ ID NO: 607967 - RNA, 65 nt, Homo Sapiens
ggaucuuucugggagcugcgccggacagaguggggagcuccuaguuuguggggggaagcuuugau

SEQ ID NO: 607968 - RNA, 65 nt, Homo Sapiens
cuagcaguauuauuaaauggauucauuuuaaaaauagcuccuauauuuuguaacaugucucaaac

SEQ ID NO: 607969 - RNA, 65 nt, Homo Sapiens
ugcaagauugccccaacuuaaacgccacauaaaacagcuccuaauugacaugggcaaaguacagc

SEQ ID NO: 607970 - RNA, 65 nt, Homo Sapiens
gugggugauugggcagggccugagcuggacaggggagcuccuaguaggggaggggaggggaugcu

SEQ ID NO: 607971 - RNA, 65 nt, Homo Sapiens
ccugcccagcagcccugagccaaggcuggggccacagcuccuaccccagaggcuuucaugagccc

SEQ ID NO: 607972 - RNA, 65 nt, Homo Sapiens
acacugccugaagacacacagcaauaagugauuacagcuccuagacuaccuuccaaaaccuguuu

SEQ ID NO: 607973 - RNA, 65 nt, Homo Sapiens
gagagaccggaauaaacucaaucuuuucuuucccaagcuccuagccaacacuauccuugggagaa

SEQ ID NO: 607974 - RNA, 65 nt, Homo Sapiens
uuaacuuauucauaguccuauuggacagcaggagcagcuccuacagugaacuauuggcaccaccg

SEQ ID NO: 607975 - RNA, 65 nt, Homo Sapiens
guggcuuuucuuucucuaacaugaucucccuuguaagcuccuaagaaaaaaagcagaaauacaca

SEQ ID NO: 607976 - RNA, 65 nt, Homo Sapiens
uguuuucuccuucugucucuugugauuuugaguaaagcuccuaucucaaugaaaaauagugucuu

SEQ ID NO: 607977 - RNA, 65 nt, Homo Sapiens
acucuucuuagagacucuccuacuuauccucaccuagcuccuaccuugucuagucugcccaaaau

SEQ ID NO: 607978 - RNA, 65 nt, Homo Sapiens
aaguauaggacacaaauguuguguugucuugaccaagcuccuacucauuaguuuuguuaauauuu

SEQ ID NO: 607979 - RNA, 65 nt, Homo Sapiens
aucagaggauuaacacuagccauuaugcuggaaagagcuccuagcgugcuggcaguguuugggga

SEQ ID NO: 607980 - RNA, 65 nt, Homo Sapiens
ugcaaacuguguucacccuuccucugggaacaggcagcuccuaucuuccuccugccccagcccaa

SEQ ID NO: 607981 - RNA, 65 nt, Homo Sapiens
gaucaccauguacuaggagcucugauagccagcucagcuccuaauccuugaggcaacauucuuuu

SEQ ID NO: 607982 - RNA, 65 nt, Homo Sapiens
uaugcaaagggcagaggcugggaguuuggacgcuuagcuccuaccccuguccuaccucaccgggg

SEQ ID NO: 607983 - RNA, 65 nt, Homo Sapiens
uuuuggaauuuucaucauguuugcuuauuaaacaaagcuccuacugccaucauacuaaucaugca

SEQ ID NO: 607984 - RNA, 65 nt, Homo Sapiens
auuaaagucaccuuccuaccauuagagcagaagacagcuccuauaguuuuguauuuuggcagcua

SEQ ID NO: 607985 - RNA, 65 nt, Homo Sapiens
ggauauuauaucaggugccaggaaucccuugggucagcuccuauccucuggacggggagcaucau

SEQ ID NO: 607986 - RNA, 65 nt, Homo Sapiens
ccucuggcuuccugguagaguaaauauggauggcgagcuccuaggcuccuuuugaccuuuucaaa

SEQ ID NO: 607987 - RNA, 65 nt, Homo Sapiens
ggauagagcuggacagauucuucuguuuuauuuguagcuccuagauuucaauugcuuaucuacaa

SEQ ID NO: 607988 - RNA, 65 nt, Homo Sapiens
ucuguuauccagcuccaaguguaugucugucauccagcuccuaugucaaaaauaaaagaauaaaa

SEQ ID NO: 607989 - RNA, 65 nt, Homo Sapiens
gacagagccugcuuggccccacuguuaguccagcgagcuccuauaucaaaaugccguaggccggg

SEQ ID NO: 607990 - RNA, 65 nt, Homo Sapiens
cuguaccccagccccacucagcacugacaguccccagcuccuaguagugagcugggaggcgcuuc

SEQ ID NO: 607991 - RNA, 65 nt, Homo Sapiens
gccccgcagggagcugguggcuccagccccacuagagcuccuaaagaucacacagcagcugcucc

SEQ ID NO: 607992 - RNA, 65 nt, Homo Sapiens
caugaacagauuuaaaauggcugguguuaaauaucagcuccuaauaagauguggacugaaaacac

SEQ ID NO: 607993 - RNA, 65 nt, Homo Sapiens
aagucuaggggguuccauucuggccaugcgagcccagcuccuaccaacgucgguaacuugagcag

SEQ ID NO: 607994 - RNA, 65 nt, Homo Sapiens
agagcgugaccccuccugcugggaccuguguuguaagcuccuauuugcuuaucuuguuuauuuca

SEQ ID NO: 607995 - RNA, 65 nt, Homo Sapiens
uucaguucccagaaucaaagcaaugcauuuuggaaagcuccuagcagagagacuuucagcccuaa

SEQ ID NO: 607996 - RNA, 65 nt, Homo Sapiens
ggaaaaagcuuucuucugacucuucacucugcugaagcuccuaaugccuguuugcuguguugaac

SEQ ID NO: 607997 - RNA, 65 nt, Homo Sapiens
ucugugccagggcagcauuuccagcaguguugcucagcuccuacccauuacauguguuuauucau

SEQ ID NO: 607998 - RNA, 65 nt, Homo Sapiens
uggggccuauuucuacuuucugaggccaggccuguagcuccuaccuugcuggagcaggggucaug

SEQ ID NO: 607999 - RNA, 65 nt, Homo Sapiens
ccaggaaaaaagauccaaugauccuauccucuccaagcuccuauuaagaaauaucaacugaugau

SEQ ID NO: 608000 - RNA, 65 nt, Homo Sapiens
uuugccacaagguggugcuucuucuguaauuuaaaagcuccuacuuucuggguaacaagcccuaa

SEQ ID NO: 608001 - RNA, 65 nt, Homo Sapiens
uccugccuucagacaaacaggccuuagacuccguuagcuccuauuuauuuaaaagauaaccuuug

SEQ ID NO: 608002 - RNA, 65 nt, Homo Sapiens
accuagaagcauuaugaagcaagcaaagucucuaaagcuccuaguguggcuuuucaacgggagua

SEQ ID NO: 608003 - RNA, 65 nt, Homo Sapiens
uuccagcgagaauucuucauccuccacgguucacuagcuccuaccugaagaggaaagggggccau

SEQ ID NO: 608004 - RNA, 65 nt, Homo Sapiens
gccaugcauuugaauaaagugccucccuuagccugagcuccuaaagaccucuuguacuugguugc

SEQ ID NO: 608005 - RNA, 65 nt, Homo Sapiens
acucaagccuccaaguaguggcauaucagucuuggagcuccuagcuggugauacggagagggcuu

SEQ ID NO: 608006 - RNA, 65 nt, Homo Sapiens
agcuuuccuucccuggagagaaccgucuuuaccucagcuccuagggccuccagccccccagcucc

SEQ ID NO: 608007 - RNA, 65 nt, Homo Sapiens
accacuauuuuagcauaauaaaagaaaguccaaagagcuccuauauagacuacuccagauaacuu

SEQ ID NO: 608008 - RNA, 65 nt, Homo Sapiens
uuuaaucucuagccauaaaaacauaaguaauaguaagcuccuaagcuuggacaaaggcuggauuc

SEQ ID NO: 608009 - RNA, 65 nt, Homo Sapiens
uugguacaggcuaggcagaaugugccuagaugaucagcuccuaguaaaaaccuugagaacuaagu

SEQ ID NO: 608010 - RNA, 65 nt, Homo Sapiens
auuucuuauaucccucgucauggcaaagccaaaauagcuccuacaaccaucagggguuuucuuua

SEQ ID NO: 608011 - RNA, 65 nt, Homo Sapiens
gaccacuggccauuagcucugggcagggcuaaagcagcuccuaagccagaaacucccugucuuug

SEQ ID NO: 608012 - RNA, 65 nt, Homo Sapiens
uacugguugauguguuuuuuguaugacuuagaucuagcuccuaccggccguguccguagcuguca

SEQ ID NO: 608013 - RNA, 65 nt, Homo Sapiens
ucuugauguuuucuugucauaauguuguuaucucaagcuccuaucuguuacauguucuguuauuu

SEQ ID NO: 608014 - RNA, 65 nt, Homo Sapiens
agcuuuccucccaaaggcuuugcaaacccauuuccagcuccuagucccauucuaaacuccuuucc

SEQ ID NO: 608015 - RNA, 65 nt, Homo Sapiens
acacaugcaugcacacaaacguguacacaagugugagcuccuacacgcauacacacacacacgug

SEQ ID NO: 608016 - RNA, 65 nt, Homo Sapiens
acacacaugcauguacagguaagcacacauguacaagcuccuacaggcuugcucucacacacgug

SEQ ID NO: 608017 - RNA, 65 nt, Homo Sapiens
aguucuuaauuuauaacuaaaaauucuuacauucaagcuccuaagauaaccccagccccaacuua

SEQ ID NO: 608018 - RNA, 65 nt, Homo Sapiens
ucacucuugguugggccugguugacuuugccagucagcuccuacagugaucaguuggccaccucu

SEQ ID NO: 608019 - RNA, 65 nt, Homo Sapiens
augagcauucuaucuuuuggcuuucagagugauagagcuccuaacagguguacaggcccaagagu

SEQ ID NO: 608020 - RNA, 65 nt, Homo Sapiens
uaucagguuaagagcaaggguggaaaugaaggacuagcuccuaugacuccacaaaggggagcauu

SEQ ID NO: 608021 - RNA, 65 nt, Homo Sapiens
ucccugccccucccuaaucauuauaauauaccauaagcuccuacuaucauagauuuuucccagcc

SEQ ID NO: 608022 - RNA, 65 nt, Homo Sapiens
uucuguguauaucauuaacaugccuucuuuauuccagcuccuaugaccuugcuauaaccuaagca

SEQ ID NO: 608023 - RNA, 65 nt, Homo Sapiens
gcaaagguugggauaggcgcagcagcuauaagacaagcuccuacgcucacuguucccugaucauu

SEQ ID NO: 608024 - RNA, 65 nt, Homo Sapiens
gccagcuggccugcugcucuccagucaaguagcgaagcuccuaccacccagacacccaaacagcc

SEQ ID NO: 608025 - RNA, 65 nt, Homo Sapiens
agcaaccacugaugugauuucacuucgucuccccuagcuccuagaacuccccuuguacccccuuc

SEQ ID NO: 608026 - RNA, 65 nt, Homo Sapiens
gugauaaguguaucccagaucagauugauuugagcagcuccuacuuucccagauugcguagcauu

SEQ ID NO: 608027 - RNA, 65 nt, Homo Sapiens
ggcgcuccaacuuccuucccugccuuuucccuccaagcuccuauuuuacugugucagcuggaagg

SEQ ID NO: 608028 - RNA, 65 nt, Homo Sapiens
agaguggaucagagagacuaggacaguuacugcagagcuccuaagucaccacucaaccaguggcu

SEQ ID NO: 608029 - RNA, 65 nt, Homo Sapiens
ucuugucuucuggucacaccucacuauguccccucagcuccuaucucuguauggccugguuuuuc

SEQ ID NO: 608030 - RNA, 65 nt, Homo Sapiens
ccugagcagaggcugggcauugccacuaggaccugagcuccuagagaacaaggaccuggguggcc

SEQ ID NO: 608031 - RNA, 65 nt, Homo Sapiens
ccuccuccagggcgacggccggggacugccuggagagcuccuauuucaaggagaagccccuacgu

SEQ ID NO: 608032 - RNA, 65 nt, Homo Sapiens
ucuucauucacuuaacaaguggccacuuagagcccagcuccuaccuucuaaucagcaaguccagu

SEQ ID NO: 608033 - RNA, 65 nt, Homo Sapiens
ugccucccacgccucagguguccccgcccucccccagcuccuaccacacacagaaaccccucuuc

SEQ ID NO: 608034 - RNA, 65 nt, Homo Sapiens
ucgugggccugguuucagcucccugugugcucuccagcuccuaagucaccaacucgaguguucag

SEQ ID NO: 608035 - RNA, 65 nt, Homo Sapiens
aucagaagaagcugauacaucucaugagaaguggaagcuccuaguuuggagaccacuuuuauuua

SEQ ID NO: 608036 - RNA, 65 nt, Homo Sapiens
aagaguaggguugugccuuauucaacugcauacauagcuccuagcacagugccuuauucgguagg

SEQ ID NO: 608037 - RNA, 65 nt, Homo Sapiens
ucuauaucuagaaaaccccaugaucuuggcccaaaagcuccuagaucugauaaacaacuucagcu

SEQ ID NO: 608038 - RNA, 65 nt, Homo Sapiens
cuagaaccuuguguccuuugaauucucgcccugccagcuccuagaaauaguuucaaucuuggaau

SEQ ID NO: 608039 - RNA, 65 nt, Homo Sapiens
ggcuucucucagccuccccaccagugauggauaacagcuccuauucucagcugaccugacugagc

SEQ ID NO: 608040 - RNA, 65 nt, Homo Sapiens
gauggucccuuccauuccccugaaaccugcaugagagcuccuaacauguuucuccaaugcaauca

SEQ ID NO: 608041 - RNA, 65 nt, Homo Sapiens
uuuuuacucuagggaaaacacugacgaauggucagagcuccuauccugaucuuuucaucaaggcg

SEQ ID NO: 608042 - RNA, 65 nt, Homo Sapiens
gcuuuccuggggcaugccugaucagcgugggcuggagcuccuagaccaaccccagcuuucucacc

SEQ ID NO: 608043 - RNA, 65 nt, Homo Sapiens
uaccuuaucuuacugaauucaaaagaagaucugacagcuccuauaagaaaugguuauacgugggc

SEQ ID NO: 608044 - RNA, 65 nt, Homo Sapiens
agaggcugaaggccacagggguugcccagaguggaagcuccuagucagccaggaaguauauguga

SEQ ID NO: 608045 - RNA, 65 nt, Homo Sapiens
augaaaaauaaaauguuugucauauacucugcuacagcuccuaucugggggcuggcagaggcccc

SEQ ID NO: 608046 - RNA, 65 nt, Homo Sapiens
augcccuguaauuuuucugggagagaccccagucaagcuccuaguugugaugggccacaaggaaa

SEQ ID NO: 608047 - RNA, 65 nt, Homo Sapiens
aaacagaguccagugggauuguguguggacaggcaagcuccuaauacugacagaggagaagucaa

SEQ ID NO: 608048 - RNA, 65 nt, Homo Sapiens
aaaggaugcaauauaaugaccaggucgugauaaugagcuccuaugaagguaaaguagguaucuuu

SEQ ID NO: 608049 - RNA, 65 nt, Homo Sapiens
uucggucaaaugcuguuuuuuccuucccugguccaagcuccuaucucuucuuugaauuuggauau

SEQ ID NO: 608050 - RNA, 65 nt, Homo Sapiens
auaugucaggcccuaugccuagugaauaucccuagagcuccuaccuuuccuauguucuuuuguuc

SEQ ID NO: 608051 - RNA, 65 nt, Homo Sapiens
gagcagacugccccccgagcaaagaggggucuuggagcuccuauggggcccguggaagcagcguc

SEQ ID NO: 608052 - RNA, 65 nt, Homo Sapiens
gauguagucuuguuucauagauucuauuaagaaauagcuccuaagaagcuacuaaacugcuuugu

SEQ ID NO: 608053 - RNA, 65 nt, Homo Sapiens
cuuggccauucccaggaggcgcccaaacaggcugaagcuccuaaagcaggcgcuggagccuccag

SEQ ID NO: 608054 - RNA, 65 nt, Homo Sapiens
agaacuauaggauuucuucuugaggaaauggugaaagcuccuaucuuaauguucagugauaucac

SEQ ID NO: 608055 - RNA, 65 nt, Homo Sapiens
uuccaaacuggaacucuacauuuuguaucuuuuaaagcuccuauaaguaaaauaacuauuggcuu

SEQ ID NO: 608056 - RNA, 65 nt, Homo Sapiens
gacgagauaugacaccuaaggaauuccccugcuucagcuccuagcucagccacugacugccccuc

SEQ ID NO: 608057 - RNA, 65 nt, Homo Sapiens
ucucucuuaguccccuuuagcugucuucuauccccagcuccuaacugggacucugugucuaugca

SEQ ID NO: 608058 - RNA, 65 nt, Homo Sapiens
ucugaccccagcuucucucuaccccccacagcgucagcuccuaccugccucaccuuucacccccc

SEQ ID NO: 608059 - RNA, 65 nt, Homo Sapiens
ucugaccccaacuucucuuuccccaccugagccccagcuccuaccaccuugccucaccuuuaacc

SEQ ID NO: 608060 - RNA, 65 nt, Homo Sapiens
guggccucagcuagguaacccugauuuucggccucagcuccuagauuacuggauuucuuuuucuc

SEQ ID NO: 608061 - RNA, 65 nt, Homo Sapiens
gggggaagaggagagacccccuccucagcucccucagcuccuagaccucccugucccucaugccg

SEQ ID NO: 608062 - RNA, 65 nt, Homo Sapiens
caauguauuaaguaaggaaaacaacacaacacuugagcuccuagcagguaucuuccaucagcaua

SEQ ID NO: 608063 - RNA, 65 nt, Homo Sapiens
acgcuuagaauuucaugaguugguuccuggcauagagcuccuaaaauacauuuggucuuuguucc

SEQ ID NO: 608064 - RNA, 65 nt, Homo Sapiens
gggcgguuaggaguucugggugaccauccuggcucagcuccuaacucaccaugugacaucaggcu

SEQ ID NO: 608065 - RNA, 65 nt, Homo Sapiens
uuuuuucaaaggcaaauuuaaacuauuuaagaaauagcuccuaauacuugggaucuuguuuagag

SEQ ID NO: 608066 - RNA, 65 nt, Homo Sapiens
uaggauuuugcuuccuccccggugcuaaauuagcaagcuccuagagaagccaugugauucccaga

SEQ ID NO: 608067 - RNA, 55 nt, Homo Sapiens; identical to SEQ ID NO: 607881

SEQ ID NO: 608068 - RNA, 65 nt, Homo Sapiens
caauuuccugcuccucuugguuggucaggcacugaagcuccuacacaggucacuguugaaacuca

SEQ ID NO: 608069 - RNA, 65 nt, Homo Sapiens
cgccccaccucacuuucuagagcccugucuguccuagcuccuaucugaccuuguguguaaauacg

SEQ ID NO: 608070 - RNA, 65 nt, Homo Sapiens
uaaccaguaagagacuaaaucugcaauauauaaagagcuccuacaaaucaguaacaugaagaaca

SEQ ID NO: 608071 - RNA, 65 nt, Homo Sapiens
auagccugccucacagaguuuagacaugacuagccagcuccuacaaucacugaagucaauuccuu

SEQ ID NO: 608072 - RNA, 65 nt, Homo Sapiens
aggcccggggugggaccagaccggcucuugcucccagcuccuauucucaccaaagagaagaugga

SEQ ID NO: 608073 - RNA, 65 nt, Homo Sapiens
cauagagcuuccuuuccagaucaagaggccuuggcagcuccuagcucuaaccugugaugucacac

SEQ ID NO: 608074 - RNA, 65 nt, Homo Sapiens
cccuggacccuuggcugggaggccucucugaccucagcuccuagaccugccucccccaccuccug

SEQ ID NO: 608075 - RNA, 65 nt, Homo Sapiens
aggcugcgugcaggugcgugcuccuucagcagggcagcuccuaagaugugacugagagggaugac

SEQ ID NO: 608076 - RNA, 65 nt, Homo Sapiens
uuaauauuuauagaguucauagaaauacaucaauaagcuccuaaauuauagagccucaauuuugg

SEQ ID NO: 608077 - RNA, 65 nt, Homo Sapiens
aucuaauugguaauuuauagaacaaauauuugauaagcuccuauuaauugucaccccaccaagcg

SEQ ID NO: 608078 - RNA, 65 nt, Homo Sapiens
acugacaacaacuucaguauggucuggagcuuaccagcuccuaccaguccagugugcuuauaagu

SEQ ID NO: 608079 - RNA, 65 nt, Homo Sapiens
gacuggacaugccuggaagaaagcccaccgguggcagcuccuaguaagccuagagccuggcacuc

SEQ ID NO: 608080 - RNA, 64 nt, Homo Sapiens
ugucauuuuuuuuuuucacacauuaucaggaaguuuuaguuaucaugucagauguuuuuucauu

SEQ ID NO: 608081 - RNA, 64 nt, Homo Sapiens
acucuauguaguuauagaaauaauuucuaagaaauuuaguuauaauauuuuagcauauucgaac

SEQ ID NO: 608082 - RNA, 64 nt, Homo Sapiens
auuuuguggcuauuucauguauaaaaugaaaggcuuuaguuauuucuagaggagucccauccaa

SEQ ID NO: 608083 - RNA, 64 nt, Homo Sapiens
ucaacuucagauucauuaaauuuuaacagcuguauuuaguuauaauuuuuguaucuuacaacag

SEQ ID NO: 608084 - RNA, 64 nt, Homo Sapiens
cguuaccaucaaacucacaaauagguugaaauccuuuaguuauaacucagccuuuaggaacacc

SEQ ID NO: 608085 - RNA, 64 nt, Homo Sapiens
uagaaaucuuuucguguuccccauugagaaaugcuuuaguuagcaucuucaugcuuggaaaucu

SEQ ID NO: 608086 - RNA, 64 nt, Homo Sapiens
ugcgugauuuauauucagaagaaauuauaucccauuuaguuaaguucacuuuuaacacaaguua

SEQ ID NO: 608087 - RNA, 64 nt, Homo Sapiens
uuuuaaaucagaaguauggguuuuauugagagaauuuaguuauaaaaacuuaaaauuaguacug

SEQ ID NO: 608088 - RNA, 64 nt, Homo Sapiens
uucugcuaggaaggcagaaaguuucuacacauaauuuaguuaucucacauguuugagucuauuu

SEQ ID NO: 608089 - RNA, 64 nt, Homo Sapiens
agaucaccugucaggguaugcacuuacuugacauuuuaguuaucuacacuaucugccaguuagu

SEQ ID NO: 608090 - RNA, 64 nt, Homo Sapiens
aaucauuuuaugaaaauaauccucacucuuuuuuuuuaguuacuauccaucuaauccaggauuc

SEQ ID NO: 608091 - RNA, 64 nt, Homo Sapiens
ccuuucuuuacccaccuaaauacuaucuauacuguuuaguuauuucuaggcauuaauacuacuu

SEQ ID NO: 608092 - RNA, 64 nt, Homo Sapiens
uguuggaauaugcaaaggucauucuuuacuaacuuuuaguuacuaaauuauagcuaaguuuugu

SEQ ID NO: 608093 - RNA, 64 nt, Homo Sapiens
augucuacaaaaauagauuacagcuuauuuuauuuuuaguuaaaucucuuaauacacagagaac

SEQ ID NO: 608094 - RNA, 64 nt, Homo Sapiens
aucgggcacucuauauucauguuuaaaggauccauuuaguuaaauaguauaaucaccauuaucu

SEQ ID NO: 608095 - RNA, 64 nt, Homo Sapiens
uauaguauaaucaccauuauaggaaucaggaaacuuuaguuauuacuagguuacuuauaaugca

SEQ ID NO: 608096 - RNA, 64 nt, Homo Sapiens
cucugcauuauuaugaaugaaaagcauucuuaauuuuaguuaaaauuaaguuagucauauguua

SEQ ID NO: 608097 - RNA, 64 nt, Homo Sapiens
auucuuuuuauuacaagcaauucaauuguacacuuuuaguuauuuuuaaauuuacaauguuauu

SEQ ID NO: 608098 - RNA, 64 nt, Homo Sapiens
uuucuuuucacuuuuuauaggaacucuauagcccuuuaguuauuucauuuuguuuuuaguugga

SEQ ID NO: 608099 - RNA, 64 nt, Homo Sapiens
acacuucauuuuguuuuuaguaaguuacauuuuauuuaguuagauaauuccacaauuaguguau

SEQ ID NO: 608100 - RNA, 64 nt, Homo Sapiens
uuaaaauguaaaauuaaauucccaguuuuauacuuuuaguuauuauccuuuguauuacaagcaa

SEQ ID NO: 608101 - RNA, 64 nt, Homo Sapiens
ucuuguauaaauuaguauauaccacaugacaguguuuaguuaaucauaacuugagcuacacuaa

SEQ ID NO: 608102 - RNA, 64 nt, Homo Sapiens
uaggaaguaggcaaauguaaguuguuucaagaguuuuaguuaaauggaugucuuuuuuacuugu

SEQ ID NO: 608103 - RNA, 64 nt, Homo Sapiens
uuggucaucugauuuuauauaagcucaaaacuacuuuaguuaacacuuuguuuuaguuagaaca

SEQ ID NO: 608104 - RNA, 64 nt, Homo Sapiens
acaaagcucaaaacuacuuuaacuacuacuuuguuuuaguuagaguauauuauaaaaauuguaa

SEQ ID NO: 608105 - RNA, 64 nt, Homo Sapiens
ucucaagaagcauguucguauaucacaauugcuuuuuaguuauuuuguuaaaguuuucuugcac

SEQ ID NO: 608106 - RNA, 64 nt, Homo Sapiens
accuauuuagcaaugccuuuugugaaguucuaaauuuaguuaugggcaguaacauuuuccuuuc

SEQ ID NO: 608107 - RNA, 64 nt, Homo Sapiens
acugaagauggaauauuauauucuuaauuagauaaaaguucauugauuuuauaaacugggggau

SEQ ID NO: 608108 - RNA, 64 nt, Homo Sapiens
ggaaauugcccucagauuuuuccucuauccugacaaaguucacuaauaccuguggucauuuggu

SEQ ID NO: 608109 - RNA, 64 nt, Homo Sapiens
aggacauauagaaauguggauuucagcaccuuccaaaguucagccaguuaucaguagauacaau

SEQ ID NO: 608110 - RNA, 64 nt, Homo Sapiens
auuagaaaugaaauauuuuuuauucauuggccaaaaaguucacagacagcaguguuugcuauuu

SEQ ID NO: 608111 - RNA, 64 nt, Homo Sapiens
gaaaccagaauuuuagacagaaguucuugaucaaaaaguucaaaaagcaaagaaggguugauaa

SEQ ID NO: 608112 - RNA, 64 nt, Homo Sapiens
uuagcuggauuucugaacuaucaauauuuaaaacaaaguucaauaaaaagcauugaauggaaaa

SEQ ID NO: 608113 - RNA, 64 nt, Homo Sapiens
uugcaguacuuuuuaauuuugauaaaaaagauacaaaguucauaauaucaaaauauguguucaa

SEQ ID NO: 608114 - RNA, 64 nt, Homo Sapiens
aaauuggcaucaguguagacggugcugauugggaaaaguucaugauuaggaaauucauguaaga

SEQ ID NO: 608115 - RNA, 64 nt, Homo Sapiens
ggggccaccugaccaguaaacuguggacuaguagaaaguucauauucuaccucuaaaaacaggu

SEQ ID NO: 608116 - RNA, 64 nt, Homo Sapiens
gaugaaagugugaauuagagggacuccuuccaauaaaguucaaacuuaaaaaaaaucauuuuaa

SEQ ID NO: 608117 - RNA, 64 nt, Homo Sapiens
aaacuuuguacuuuuuaauauugcagucuuguugaaaguucaugaccuaccuggcauauuuauu

SEQ ID NO: 608118 - RNA, 64 nt, Homo Sapiens
ucccuguuugggggauaccagcugaaaacauucaaaaguucacagacgaccauacugccucuga

SEQ ID NO: 608119 - RNA, 64 nt, Homo Sapiens
ugcacugaggugucggaacggaaccauagccucuaaaguucaaguuuuuccuugaaggacaacc

SEQ ID NO: 608120 - RNA, 64 nt, Homo Sapiens
aaugaccauuacuguagaguuacaacaagaggguaaaguucauacauggcgaccugugucaaau

SEQ ID NO: 608121 - RNA, 64 nt, Homo Sapiens
gguaccuagacauagcggaacagaaaacccuucaaaaguucagucuagucuggaaaacaaacau

SEQ ID NO: 608122 - RNA, 64 nt, Homo Sapiens
agcucauuguucucuagagcugagcucuucugcuaaaguucaaaguucacaucaguguagccag

SEQ ID NO: 608123 - RNA, 64 nt, Homo Sapiens
uguucucuagagcugagcucuucugcuaaaguucaaaguucacaucaguguagccagagugaag

SEQ ID NO: 608124 - RNA, 64 nt, Homo Sapiens
ucauccauuguuuuucaagcucuuccagugaaacaaaguucauaucaguaggauacauagcuuu

SEQ ID NO: 608125 - RNA, 64 nt, Homo Sapiens
ugucacaugaaaaugaucauacaaguguaaugagaaaguucaugucaaagaauacauguggcua

SEQ ID NO: 608126 - RNA, 64 nt, Homo Sapiens
caucgcuacaauaaaugugcuaacacauaggaaaaaaguucagacagcggucacuauuuucucu

SEQ ID NO: 608127 - RNA, 64 nt, Homo Sapiens
gagcgguaccuuuccuacuggaauuauuuuguacaaaguucagaaccuuuuuuccuuuuuauau

SEQ ID NO: 608128 - RNA, 64 nt, Homo Sapiens
uuuuagccaaaauucccaccucauucggcaccaaaaaguucacacuagggaaagaacuuacaaa

SEQ ID NO: 608129 - RNA, 64 nt, Homo Sapiens
cuuuaaccaaaauucucaucucauucagcaccagaaaguucacaccagauaaagaauguauaua

SEQ ID NO: 608130 - RNA, 64 nt, Homo Sapiens
aagacacuugaccuguuugggcuguugccacuuaaaaguucaugaccacaaauguccacagugu

SEQ ID NO: 608131 - RNA, 64 nt, Homo Sapiens
cuuuguggcagauaacuggcuuaugacaccuugaaaaguucaagugcucauauaacacaccaca

SEQ ID NO: 608132 - RNA, 64 nt, Homo Sapiens
gcugaauguaaucauugaaccucgagucacuguaaaaguucaguaauugcuuauuguauuaguu

SEQ ID NO: 608133 - RNA, 64 nt, Homo Sapiens
augugcucuguuuauucugauuuuacuaaaauaaaaaguucaaaagucuuccugcugucacuug

SEQ ID NO: 608134 - RNA, 64 nt, Homo Sapiens; identical to SEQ ID NO: 517561

SEQ ID NO: 608135 - RNA, 64 nt, Homo Sapiens; identical to SEQ ID NO: 517562

SEQ ID NO: 608136 - RNA, 64 nt, Homo Sapiens; identical to SEQ ID NO: 517563

SEQ ID NO: 608137 - RNA, 64 nt, Homo Sapiens; identical to SEQ ID NO: 517564

SEQ ID NO: 608138 - RNA, 64 nt, Homo Sapiens; identical to SEQ ID NO: 517565

SEQ ID NO: 608139 - RNA, 64 nt, Homo Sapiens; identical to SEQ ID NO: 517566

SEQ ID NO: 608140 - RNA, 64 nt, Homo Sapiens; identical to SEQ ID NO: 517567

SEQ ID NO: 608141 - RNA, 64 nt, Homo Sapiens; identical to SEQ ID NO: 517568

SEQ ID NO: 608142 - RNA, 64 nt, Homo Sapiens; identical to SEQ ID NO: 517569

SEQ ID NO: 608143 - RNA, 64 nt, Homo Sapiens; identical to SEQ ID NO: 517570

SEQ ID NO: 608144 - RNA, 61 nt, Homo Sapiens; identical to SEQ ID NO: 517571

SEQ ID NO: 608145 - RNA, 64 nt, Homo Sapiens; identical to SEQ ID NO: 517572

SEQ ID NO: 608146 - RNA, 64 nt, Homo Sapiens; identical to SEQ ID NO: 517573

SEQ ID NO: 608147 - RNA, 64 nt, Homo Sapiens; identical to SEQ ID NO: 517574

SEQ ID NO: 608148 - RNA, 64 nt, Homo Sapiens; identical to SEQ ID NO: 517575

SEQ ID NO: 608149 - RNA, 59 nt, Homo Sapiens; identical to SEQ ID NO: 517576

SEQ ID NO: 608150 - RNA, 64 nt, Homo Sapiens; identical to SEQ ID NO: 517577

SEQ ID NO: 608151 - RNA, 64 nt, Homo Sapiens; identical to SEQ ID NO: 517578

SEQ ID NO: 608152 - RNA, 64 nt, Homo Sapiens; identical to SEQ ID NO: 517579

SEQ ID NO: 608153 - RNA, 64 nt, Homo Sapiens; identical to SEQ ID NO: 517580

SEQ ID NO: 608154 - RNA, 64 nt, Homo Sapiens; identical to SEQ ID NO: 517581

SEQ ID NO: 608155 - RNA, 64 nt, Homo Sapiens; identical to SEQ ID NO: 517582

SEQ ID NO: 608156 - RNA, 64 nt, Homo Sapiens; identical to SEQ ID NO: 517583

SEQ ID NO: 608157 - RNA, 64 nt, Homo Sapiens; identical to SEQ ID NO: 517584

SEQ ID NO: 608158 - RNA, 64 nt, Homo Sapiens; identical to SEQ ID NO: 517585

SEQ ID NO: 608159 - RNA, 64 nt, Homo Sapiens; identical to SEQ ID NO: 517586

SEQ ID NO: 608160 - RNA, 64 nt, Homo Sapiens; identical to SEQ ID NO: 517587

SEQ ID NO: 608161 - RNA, 64 nt, Homo Sapiens; identical to SEQ ID NO: 517588

SEQ ID NO: 608162 - RNA, 64 nt, Homo Sapiens; identical to SEQ ID NO: 517589

SEQ ID NO: 608163 - RNA, 64 nt, Homo Sapiens; identical to SEQ ID NO: 517590

SEQ ID NO: 608164 - RNA, 64 nt, Homo Sapiens; identical to SEQ ID NO: 517591

SEQ ID NO: 608165 - RNA, 64 nt, Homo Sapiens; identical to SEQ ID NO: 517592

SEQ ID NO: 608166 - RNA, 64 nt, Homo Sapiens; identical to SEQ ID NO: 517593

SEQ ID NO: 608167 - RNA, 64 nt, Homo Sapiens; identical to SEQ ID NO: 517594

SEQ ID NO: 608168 - RNA, 64 nt, Homo Sapiens; identical to SEQ ID NO: 517595

SEQ ID NO: 608169 - RNA, 64 nt, Homo Sapiens; identical to SEQ ID NO: 517596

SEQ ID NO: 608170 - RNA, 64 nt, Homo Sapiens; identical to SEQ ID NO: 517597

SEQ ID NO: 608171 - RNA, 64 nt, Homo Sapiens; identical to SEQ ID NO: 517598

SEQ ID NO: 608172 - RNA, 64 nt, Homo Sapiens; identical to SEQ ID NO: 517599

SEQ ID NO: 608173 - RNA, 64 nt, Homo Sapiens; identical to SEQ ID NO: 517600

SEQ ID NO: 608174 - RNA, 64 nt, Homo Sapiens; identical to SEQ ID NO: 517601

SEQ ID NO: 608175 - RNA, 64 nt, Homo Sapiens; identical to SEQ ID NO: 517602

SEQ ID NO: 608176 - RNA, 64 nt, Homo Sapiens; identical to SEQ ID NO: 517603

SEQ ID NO: 608177 - RNA, 64 nt, Homo Sapiens; identical to SEQ ID NO: 517604

SEQ ID NO: 608178 - RNA, 64 nt, Homo Sapiens; identical to SEQ ID NO: 517605

SEQ ID NO: 608179 - RNA, 64 nt, Homo Sapiens; identical to SEQ ID NO: 517606

SEQ ID NO: 608180 - RNA, 64 nt, Homo Sapiens; identical to SEQ ID NO: 517607

SEQ ID NO: 608181 - RNA, 64 nt, Homo Sapiens; identical to SEQ ID NO: 517608

SEQ ID NO: 608182 - RNA, 64 nt, Homo Sapiens; identical to SEQ ID NO: 517609

SEQ ID NO: 608183 - RNA, 64 nt, Homo Sapiens; identical to SEQ ID NO: 517610

SEQ ID NO: 608184 - RNA, 64 nt, Homo Sapiens; identical to SEQ ID NO: 517611

SEQ ID NO: 608185 - RNA, 64 nt, Homo Sapiens; identical to SEQ ID NO: 517612

SEQ ID NO: 608186 - RNA, 64 nt, Homo Sapiens; identical to SEQ ID NO: 517613

SEQ ID NO: 608187 - RNA, 64 nt, Homo Sapiens; identical to SEQ ID NO: 517614

SEQ ID NO: 608188 - RNA, 64 nt, Homo Sapiens; identical to SEQ ID NO: 517615

SEQ ID NO: 608189 - RNA, 64 nt, Homo Sapiens; identical to SEQ ID NO: 289985

SEQ ID NO: 608190 - RNA, 64 nt, Homo Sapiens; identical to SEQ ID NO: 289986

SEQ ID NO: 608191 - RNA, 64 nt, Homo Sapiens; identical to SEQ ID NO: 289987

SEQ ID NO: 608192 - RNA, 64 nt, Homo Sapiens; identical to SEQ ID NO: 289988

SEQ ID NO: 608193 - RNA, 58 nt, Homo Sapiens; identical to SEQ ID NO: 289989

SEQ ID NO: 608194 - RNA, 64 nt, Homo Sapiens; identical to SEQ ID NO: 289990

SEQ ID NO: 608195 - RNA, 64 nt, Homo Sapiens; identical to SEQ ID NO: 289991

SEQ ID NO: 608196 - RNA, 64 nt, Homo Sapiens; identical to SEQ ID NO: 289992

SEQ ID NO: 608197 - RNA, 64 nt, Homo Sapiens; identical to SEQ ID NO: 289993

SEQ ID NO: 608198 - RNA, 64 nt, Homo Sapiens; identical to SEQ ID NO: 289994

SEQ ID NO: 608199 - RNA, 64 nt, Homo Sapiens; identical to SEQ ID NO: 289995

SEQ ID NO: 608200 - RNA, 64 nt, Homo Sapiens; identical to SEQ ID NO: 289996

SEQ ID NO: 608201 - RNA, 64 nt, Homo Sapiens; identical to SEQ ID NO: 289997

SEQ ID NO: 608202 - RNA, 64 nt, Homo Sapiens; identical to SEQ ID NO: 289998

SEQ ID NO: 608203 - RNA, 64 nt, Homo Sapiens; identical to SEQ ID NO: 289999

SEQ ID NO: 608204 - RNA, 64 nt, Homo Sapiens
uugguucuuuuuaaauuguuuguaacuuggaugcugccgcuacugaauguuuacaaauugcuug

SEQ ID NO: 608205 - RNA, 64 nt, Homo Sapiens
gugcuacuggcauccaguaaauagaagccaggggugccgcuaaacauccuauaaugcacagggc

SEQ ID NO: 608206 - RNA, 64 nt, Homo Sapiens
gugugauuccuuaauggccaacugaagauugaauugccgcuaacaaccauaucguguuagugaa

SEQ ID NO: 608207 - RNA, 64 nt, Homo Sapiens
uuuuaaugcaccugaauguuagauaguuacuauaugccgcuacaaaaagguaaaacuuuuuaua

SEQ ID NO: 608208 - RNA, 64 nt, Homo Sapiens
ucaccugagggccgugaggaucgacuccacgcccugccgcuacuaugcacccaguacugcuaca

SEQ ID NO: 608209 - RNA, 64 nt, Homo Sapiens
ccuuaccaggagacucucauauguaguacgcacuugccgcuaagggcugcuccuuguaauacag

SEQ ID NO: 608210 - RNA, 64 nt, Homo Sapiens
uucauaacuagaguauaaaguaauuguaugugcuugccgcuauuuuuuucuuccuuuuaggaug

SEQ ID NO: 608211 - RNA, 64 nt, Homo Sapiens
auauaaauauauaacuguccuuuucaucccauguugccgcuaagugauauuucauauguguggu

SEQ ID NO: 608212 - RNA, 64 nt, Homo Sapiens
gaggcugaggggugccagcgggacuggacugggaugccgcuaguugagaugaggccccacacca

SEQ ID NO: 608213 - RNA, 64 nt, Homo Sapiens
ccucgucgggaggacaggagaccgcugcugcugcugccgcuacugcugcugcugccuuaaguag

SEQ ID NO: 608214 - RNA, 64 nt, Homo Sapiens
auuugugacaucuggcaagauaaaucugaacgggugccgcuauagguugaucagaaacucaccc

SEQ ID NO: 608215 - RNA, 64 nt, Homo Sapiens
acaacuuacaacuaauugaaucucauguaaaauaugccgcuauuauauuauccuuuucuaauag

SEQ ID NO: 608216 - RNA, 64 nt, Homo Sapiens
cuccagccugaugacagacccagugagcagagcgugccgcuacaagcccaggagguugaggcug

SEQ ID NO: 608217 - RNA, 54 nt, Homo Sapiens
ccgagaccuggagaagaccugugcugccgcuacauauuggaugagcugguguga

SEQ ID NO: 608218 - RNA, 64 nt, Homo Sapiens
augccacuccucccuccggcuugaccuguuucucugccgcuaccucccuccccgucucauuccg

SEQ ID NO: 608219 - RNA, 64 nt, Homo Sapiens
uacaugcuuuuuaaugagauaauacacacaguuaugccgcuagagauacuauauuuuaggucuu

SEQ ID NO: 608220 - RNA, 64 nt, Homo Sapiens
ucucuggagcccaccagggaaggcccucauccccugccgcuacuucucuggggaauguggguuc

SEQ ID NO: 608221 - RNA, 64 nt, Homo Sapiens
cuuauuguuuacagauguaguucuuguuagaggaugccgcuagcuccugcccggggucccuaug

SEQ ID NO: 608222 - RNA, 64 nt, Homo Sapiens
accaccccccccaugggggguaugauuguguaugugccgcuaccuuuuucuucugccaauuuac

SEQ ID NO: 608223 - RNA, 64 nt, Homo Sapiens
aguuagagucuaucaguguucauccacuacuuauugccgcuaugcacacagagcauuuuaguga

SEQ ID NO: 608224 - RNA, 64 nt, Homo Sapiens
auauuuacucauuuuaucauucagugguuagcauugccgcuauuaaauaguguaucucguggaa

SEQ ID NO: 608225 - RNA, 64 nt, Homo Sapiens
aaccugaaauuauuagggauuuacucagcccugcugccgcuaacaguggaguuaugucacugau

SEQ ID NO: 608226 - RNA, 64 nt, Homo Sapiens
ccggggcgggcagggacgcguggacgagugcggcugccgcuaacgcaguaugaggacauggugg

SEQ ID NO: 608227 - RNA, 64 nt, Homo Sapiens
uggacuggaucaagaagaucucuauaccaacaucugccgcuaccgagguccgacaaaccuggcg

SEQ ID NO: 608228 - RNA, 64 nt, Homo Sapiens
guuuuuauuuagcauggggacuauauaugguaggugccgcuacaugagguuuagcaauagcuag

SEQ ID NO: 608229 - RNA, 64 nt, Homo Sapiens
cucggccugcccaccaccaagacagcccagagccugccgcuaccgagcuuccagaauccucgca

SEQ ID NO: 608230 - RNA, 64 nt, Homo Sapiens
uauuccuggcaggcuucaagaacagcugcacaugugccgcuaacugaccgcguugccauuggcg

SEQ ID NO: 608231 - RNA, 64 nt, Homo Sapiens
uugcuguggacaccccugcucgaguacuucccaaugccgcuacuaaaagguuguuucugaagcu

SEQ ID NO: 608232 - RNA, 64 nt, Homo Sapiens
ccaggaagugggggcuacccgugauacccagaccagcagucaccuguggauguagcacugagug

SEQ ID NO: 608233 - RNA, 64 nt, Homo Sapiens
gucaggguguugcgaaaauaauauucaccucuagagcagucacuuuuaaucuccuguuuaugau

SEQ ID NO: 608234 - RNA, 64 nt, Homo Sapiens
aauacugguuauccugugcuacagagaaaaucaaagcagucauaagcuccaguuuucguauugc

SEQ ID NO: 608235 - RNA, 64 nt, Homo Sapiens
cccuuuuugaguaauuuucugaugggaggaaaguagcagucaucaucuuuuugugugcaggcug

SEQ ID NO: 608236 - RNA, 64 nt, Homo Sapiens
acauaccaguuucugauguuaauuuuaugcuuggagcagucaguaaguauggcaaagcuuaucc

SEQ ID NO: 608237 - RNA, 64 nt, Homo Sapiens
uucuauaaauggcaaguaagagugacauuuuaaaagcagucagaucaacuugacguacauuuuu

SEQ ID NO: 608238 - RNA, 64 nt, Homo Sapiens
ugaugauaaucauagcagcacuuuucacagcaucagcagucaucucacuaguuauguucaaaaa

SEQ ID NO: 608239 - RNA, 64 nt, Homo Sapiens
ucaugaaaucauagucauaaaauggucuucacacagcagucauccgugucauuuaucauuuugu

SEQ ID NO: 608240 - RNA, 64 nt, Homo Sapiens
ggaaucacccgaucacagaccccgaucacagacgagcagucaucacgagcggucaccagaaucg

SEQ ID NO: 608241 - RNA, 64 nt, Homo Sapiens
ggacucacccgaucacagaccccgaucacagacgagcagucaucacgagcagucaucggaauca

SEQ ID NO: 608242 - RNA, 64 nt, Homo Sapiens
ggaaucacccgaucacagaccccgaucacagacgagcagucaucacgagcggucaccagacucg

SEQ ID NO: 608243 - RNA, 64 nt, Homo Sapiens
ggacucacccgaucacagaccccgaucacagacgagcagucaucacaagcagucaucggaauca

SEQ ID NO: 608244 - RNA, 64 nt, Homo Sapiens
ggaaucacccgaucacagaccccaaucacagacaagcagucaucacgagcggccaccggaaucg

SEQ ID NO: 608245 - RNA, 64 nt, Homo Sapiens
ggacucacccgaucacagaccccggucacagacgagcagucaucacgagcggucaccggaaucg

SEQ ID NO: 608246 - RNA, 64 nt, Homo Sapiens
gauuuuauugauuuaaugacuaaaggagaccuguagcagucaaaaggaguuaaauauauauugu

SEQ ID NO: 608247 - RNA, 64 nt, Homo Sapiens
auuuacaauuugcagugauuuucuguuuguuuuuagcagucauuuuccuuuaaaagaaaaaaac

SEQ ID NO: 608248 - RNA, 64 nt, Homo Sapiens
uccuuccccuguccuuucauuucucuauccaaguagcagucagguucuuggugugaugggacug

SEQ ID NO: 608249 - RNA, 64 nt, Homo Sapiens
gggagacagcaggauuagcuucagcuugggcuggagcagucaauauaggaucucaggccaggcc

SEQ ID NO: 608250 - RNA, 64 nt, Homo Sapiens
cugugaagcaaaaccaggagcccuggcugaagcaagcagucaguacuugcccacugacagucaa

SEQ ID NO: 608251 - RNA, 64 nt, Homo Sapiens
cagggucauaauuugugaucugugguggauuucuagcagucaucacaggcuucuacugaaaguc

SEQ ID NO: 608252 - RNA, 64 nt, Homo Sapiens
aacuaagaccccgaaaacuccagaccuucaggagagcagucagcagagccccucugugaaguga

SEQ ID NO: 608253 - RNA, 64 nt, Homo Sapiens
ccacacuuucucuccgagcaugugggucucgcugagcagucauggaaugcgguagagccagggg

SEQ ID NO: 608254 - RNA, 64 nt, Homo Sapiens
gcccucugcggaggggaccacuugcccccagaggagcagucauucccggggaggagcagcuauc

SEQ ID NO: 608255 - RNA, 64 nt, Homo Sapiens
aucauccauggaguggcugcguggcccgcggagaagcagucauccagccuauggagguggagcu

SEQ ID NO: 608256 - RNA, 64 nt, Homo Sapiens; identical to SEQ ID NO: 212887

SEQ ID NO: 608257 - RNA, 64 nt, Homo Sapiens; identical to SEQ ID NO: 212888

SEQ ID NO: 608258 - RNA, 64 nt, Homo Sapiens; identical to SEQ ID NO: 212889

SEQ ID NO: 608259 - RNA, 64 nt, Homo Sapiens; identical to SEQ ID NO: 212890

SEQ ID NO: 608260 - RNA, 64 nt, Homo Sapiens; identical to SEQ ID NO: 212891

SEQ ID NO: 608261 - RNA, 64 nt, Homo Sapiens; identical to SEQ ID NO: 212892

SEQ ID NO: 608262 - RNA, 64 nt, Homo Sapiens; identical to SEQ ID NO: 212893

SEQ ID NO: 608263 - RNA, 64 nt, Homo Sapiens; identical to SEQ ID NO: 212894

SEQ ID NO: 608264 - RNA, 64 nt, Homo Sapiens; identical to SEQ ID NO: 212895

SEQ ID NO: 608265 - RNA, 64 nt, Homo Sapiens; identical to SEQ ID NO: 212896

SEQ ID NO: 608266 - RNA, 64 nt, Homo Sapiens; identical to SEQ ID NO: 212897

SEQ ID NO: 608267 - RNA, 64 nt, Homo Sapiens; identical to SEQ ID NO: 212898

SEQ ID NO: 608268 - RNA, 64 nt, Homo Sapiens; identical to SEQ ID NO: 212899

SEQ ID NO: 608269 - RNA, 64 nt, Homo Sapiens; identical to SEQ ID NO: 212900

SEQ ID NO: 608270 - RNA, 64 nt, Homo Sapiens; identical to SEQ ID NO: 212901

SEQ ID NO: 608271 - RNA, 64 nt, Homo Sapiens; identical to SEQ ID NO: 212902

SEQ ID NO: 608272 - RNA, 64 nt, Homo Sapiens; identical to SEQ ID NO: 212903

SEQ ID NO: 608273 - RNA, 64 nt, Homo Sapiens; identical to SEQ ID NO: 212904

SEQ ID NO: 608274 - RNA, 64 nt, Homo Sapiens; identical to SEQ ID NO: 212905

SEQ ID NO: 608275 - RNA, 64 nt, Homo Sapiens; identical to SEQ ID NO: 212906

SEQ ID NO: 608276 - RNA, 64 nt, Homo Sapiens; identical to SEQ ID NO: 212907

SEQ ID NO: 608277 - RNA, 64 nt, Homo Sapiens; identical to SEQ ID NO: 212908

SEQ ID NO: 608278 - RNA, 64 nt, Homo Sapiens; identical to SEQ ID NO: 212909

SEQ ID NO: 608279 - RNA, 64 nt, Homo Sapiens; identical to SEQ ID NO: 212910

SEQ ID NO: 608280 - RNA, 64 nt, Homo Sapiens; identical to SEQ ID NO: 212911

SEQ ID NO: 608281 - RNA, 64 nt, Homo Sapiens; identical to SEQ ID NO: 101831

SEQ ID NO: 608282 - RNA, 64 nt, Homo Sapiens; identical to SEQ ID NO: 101832

SEQ ID NO: 608283 - RNA, 64 nt, Homo Sapiens; identical to SEQ ID NO: 101833

SEQ ID NO: 608284 - RNA, 64 nt, Homo Sapiens; identical to SEQ ID NO: 101834

SEQ ID NO: 608285 - RNA, 61 nt, Homo Sapiens; identical to SEQ ID NO: 101835

SEQ ID NO: 608286 - RNA, 64 nt, Homo Sapiens; identical to SEQ ID NO: 101836

SEQ ID NO: 608287 - RNA, 64 nt, Homo Sapiens; identical to SEQ ID NO: 101837

SEQ ID NO: 608288 - RNA, 64 nt, Homo Sapiens; identical to SEQ ID NO: 101838

SEQ ID NO: 608289 - RNA, 64 nt, Homo Sapiens; identical to SEQ ID NO: 101839

SEQ ID NO: 608290 - RNA, 64 nt, Homo Sapiens; identical to SEQ ID NO: 101840

SEQ ID NO: 608291 - RNA, 64 nt, Homo Sapiens; identical to SEQ ID NO: 101841

SEQ ID NO: 608292 - RNA, 64 nt, Homo Sapiens; identical to SEQ ID NO: 101842

SEQ ID NO: 608293 - RNA, 64 nt, Homo Sapiens; identical to SEQ ID NO: 101843

SEQ ID NO: 608294 - RNA, 64 nt, Homo Sapiens; identical to SEQ ID NO: 101844

SEQ ID NO: 608295 - RNA, 64 nt, Homo Sapiens; identical to SEQ ID NO: 101845

SEQ ID NO: 608296 - RNA, 64 nt, Homo Sapiens; identical to SEQ ID NO: 101846

SEQ ID NO: 608297 - RNA, 64 nt, Homo Sapiens; identical to SEQ ID NO: 101847

SEQ ID NO: 608298 - RNA, 64 nt, Homo Sapiens; identical to SEQ ID NO: 101848

SEQ ID NO: 608299 - RNA, 64 nt, Homo Sapiens; identical to SEQ ID NO: 101849

SEQ ID NO: 608300 - RNA, 64 nt, Homo Sapiens; identical to SEQ ID NO: 101850

SEQ ID NO: 608301 - RNA, 64 nt, Homo Sapiens; identical to SEQ ID NO: 101851

SEQ ID NO: 608302 - RNA, 64 nt, Homo Sapiens; identical to SEQ ID NO: 101852

SEQ ID NO: 608303 - RNA, 64 nt, Homo Sapiens; identical to SEQ ID NO: 101853

SEQ ID NO: 608304 - RNA, 64 nt, Homo Sapiens; identical to SEQ ID NO: 101854

SEQ ID NO: 608305 - RNA, 64 nt, Homo Sapiens
ugcagucccccagauaccuauuauuuuacacaauuugaccuauaggaggacacugaguaauuua

SEQ ID NO: 608306 - RNA, 64 nt, Homo Sapiens
ccgagaccucaucuuccggugagugccuucaguguugaccuaaguccucgccgggccauggcuc

SEQ ID NO: 608307 - RNA, 64 nt, Homo Sapiens
auggagaggaaaguaucuaauauuagucaugguuuugaccuaaauugcuagacagucgugccau

SEQ ID NO: 608308 - RNA, 64 nt, Homo Sapiens
ccauucugguaggaaaaucugaguuuucuuaucuuugaccuagaagagauucuuuuuggaccaa

SEQ ID NO: 608309 - RNA, 64 nt, Homo Sapiens
auuuguaaauggucuguuugauguuagcaguuuauugaccuaauagaaagcuaucuuuuuaugg

SEQ ID NO: 608310 - RNA, 64 nt, Homo Sapiens
ccagauauuuguguggaagauucccuccccccucuugaccuaccaggaaugcccuucagguuuc

SEQ ID NO: 608311 - RNA, 64 nt, Homo Sapiens
caucuccuccuccuuggacagaauucugccugaauugaccuacgcuguugggaauuaugcccug

SEQ ID NO: 608312 - RNA, 64 nt, Homo Sapiens
uuaacuggugaaauuuaaagugaguuccuuccauuugaccuaaucugauugggcaauacucauu

SEQ ID NO: 608313 - RNA, 64 nt, Homo Sapiens
uuaggguucuaaaugcaauaaaaggauaaauuuuuugaccuauuaggaaacuuuuuaauugugc

SEQ ID NO: 608314 - RNA, 64 nt, Homo Sapiens
gaguuaauuuccuuuguauuuucccugaguuguauugaccuacagaaauuccauuuuucccucu

SEQ ID NO: 608315 - RNA, 64 nt, Homo Sapiens
agccggggccugacuaggaaguccugucagcuccuugaccuaugcucgcuuugagguacccacc

SEQ ID NO: 608316 - RNA, 64 nt, Homo Sapiens
ggaguuggcggggaggaaauaaggcuaacagagguugaccuaaaauuagccuuacaaaggagaa

SEQ ID NO: 608317 - RNA, 64 nt, Homo Sapiens
agccaagacuucaugaacuacauaggucuuaccauugaccuaagaucaaucugaacuaucuuag

SEQ ID NO: 608318 - RNA, 64 nt, Homo Sapiens
ccuagagguuuuuuuuuugcuuguuacucaucuguugaccuaccugggggaaguagcacccuug

SEQ ID NO: 608319 - RNA, 64 nt, Homo Sapiens
gauagaacaaauagcaaugguuaacuauuaaauguugaccuagccagcgcaguggcucaugccu

SEQ ID NO: 608320 - RNA, 64 nt, Homo Sapiens
auaauauuuuuauaacuuuaagagacuguaguaauugaccuaaaaacuuauguuagcuucagua

SEQ ID NO: 608321 - RNA, 64 nt, Homo Sapiens
uaauuuuugucuuuaaaaaaagcaaaaaagcacauugaccuaaguugaaaauuaaguaaguuua

SEQ ID NO: 608322 - RNA, 64 nt, Homo Sapiens
aucaaucagaauuagagcaugggaggucaucacuuugaccuaaauuauuuacugcaaaaagaaa

SEQ ID NO: 608323 - RNA, 64 nt, Homo Sapiens
ugagcaauagaguagaaaauauaucuuaaacuaguugaccuagauuguauuaauagcuacuuaa

SEQ ID NO: 608324 - RNA, 64 nt, Homo Sapiens
uggucaugugggacucaguggugguguugugacuuugaccuaggguccgagugucacagcugau

SEQ ID NO: 608325 - RNA, 64 nt, Homo Sapiens
caugcuuugaaguuucuggaaaguagaucuuuucuugaccuaguauaucagugacaguugcagc

SEQ ID NO: 608326 - RNA, 64 nt, Homo Sapiens
auauacauauacugccucuucuaugauguuucauuugaccuacaccaucagcaucuucaggaaa

SEQ ID NO: 608327 - RNA, 64 nt, Homo Sapiens
uauggaacuuacuuuuacuugacuucaccuuuguuugaccuauggggagggggcaaagccuucu

SEQ ID NO: 608328 - RNA, 64 nt, Homo Sapiens
aaucaaucacagcuuguauuauauuuuuauagauuugaccuacauucugacuuaagugugcaaa

SEQ ID NO: 608329 - RNA, 64 nt, Homo Sapiens
uuguagagaugugaggauuuagaagaaucauacuuugaccuaccccauuuaucuuguacaacug

SEQ ID NO: 608330 - RNA, 64 nt, Homo Sapiens
aauauaauacauuugcuaguucuuuucauaauuguugaccuaaguucaaaaauauucauuucaa

SEQ ID NO: 608331 - RNA, 64 nt, Homo Sapiens
aauagcccguuucgucucuggauuucuguaauguuugaccuaauacuaguuaagagucucaguu

SEQ ID NO: 608332 - RNA, 64 nt, Homo Sapiens
gugugacucuguggggacugcauagguuuguuaauugaccuauagcuaaaccuuaauguguuug

SEQ ID NO: 608333 - RNA, 56 nt, Homo Sapiens
cuauacaaagcuacuauuaaucgacauugaccuauuuccagaaauacaauuuuaga

SEQ ID NO: 608334 - RNA, 64 nt, Homo Sapiens
agaaaguauuaauaucucuuuagauaagcuuguauugaccuaauuugguuuaugaugugucaga

SEQ ID NO: 608335 - RNA, 64 nt, Homo Sapiens
guaauagcguuguucuuuaaguguacaucguaauuugaccuaauuuaaaaauaauauauuuucg

SEQ ID NO: 608336 - RNA, 64 nt, Homo Sapiens
augaagaauucaaguauucugacugagugauugguugaccuaaaccacuuugaauguuucuauu

SEQ ID NO: 608337 - RNA, 64 nt, Homo Sapiens
ccauguccaucuucuauuacuucugguccaaguuuugaccuaaacuguuucaaaggaaguuggu

SEQ ID NO: 608338 - RNA, 64 nt, Homo Sapiens
gauggacaccuggguuguuuaauagauuuguucauugaccuaucugcugaguacugcuucauug

SEQ ID NO: 608339 - RNA, 64 nt, Homo Sapiens
uuauggguuccauauuuuucacucuccaaagaacuugaccuaccaauacaucuucauucucaac

SEQ ID NO: 608340 - RNA, 64 nt, Homo Sapiens
gguguguguguguguguauuugagaccuaagaaauugaccuaggaaagugaauuuaaccacaac

SEQ ID NO: 608341 - RNA, 64 nt, Homo Sapiens
guuuguauauacauuugugauagagggcuagaguuugaccuagagagaguuuaaggaagugaaa

SEQ ID NO: 608342 - RNA, 64 nt, Homo Sapiens
ugauuuuguuuuaaauaauuuuaaauuauggagcuugaccuagauuugccaauaaacuuucuag

SEQ ID NO: 608343 - RNA, 64 nt, Homo Sapiens
gaaccgauaaauuuuaaaaaggagaaaaaauaauuugaccuaguaguauaaaacaugaggcuuu

SEQ ID NO: 608344 - RNA, 64 nt, Homo Sapiens
cucaugcugcagaggguacuauuucccucucauuuugaccuacugaugguauauuugguacugu

SEQ ID NO: 608345 - RNA, 64 nt, Homo Sapiens
agugcucuccagaccuccucucuaaacugcuucauugaccuaagucacucucuucaaucccaca

SEQ ID NO: 608346 - RNA, 64 nt, Homo Sapiens
gaaauguaacauucuaaguauuggaucucuuuucuugaccuaguauaaugacaacugcagugac

SEQ ID NO: 608347 - RNA, 64 nt, Homo Sapiens
gucugaauaggucaaccugcaggcguaacuauuuuugaccuagucaguuuuuaaacaaugugca

SEQ ID NO: 608348 - RNA, 64 nt, Homo Sapiens
agugcaacaugaaaaaaaucuaugaaaagauuauuugaccuaauuauucacugauaguacauac

SEQ ID NO: 608349 - RNA, 64 nt, Homo Sapiens
uuccaggcucaccuuuagaacaggagacuugagcuugaccuaaggauaugcauuaaccacucua

SEQ ID NO: 608350 - RNA, 64 nt, Homo Sapiens
uuucugaaguacuuaaacuuccacaagagugaauuugaccuaggcaaguuuguucaaaagguag

SEQ ID NO: 608351 - RNA, 64 nt, Homo Sapiens
gaugaaaaauaugaaugaugcauuguuuuugcaauugaccuaugacaaacugugaaccugcaga

SEQ ID NO: 608352 - RNA, 64 nt, Homo Sapiens
ugccuuugaagacagaugcuucuauagagguucuuugaccuaaauaguucagcauuuguauuuu

SEQ ID NO: 608353 - RNA, 64 nt, Homo Sapiens
uuuggggagcagggccucgacagcuccagcucccuugaccuaccuuccuccccgcaccccgccc

SEQ ID NO: 608354 - RNA, 64 nt, Homo Sapiens
uaacuuaauaguuuauuaaauuuaguuauucuuuuugaccuaaaguugaaauuuguagcaucca

SEQ ID NO: 608355 - RNA, 64 nt, Homo Sapiens
cccugucucacauugaguugggcccauugguuauuugaccuaaaaccuaaucaccgcuaccaua

SEQ ID NO: 608356 - RNA, 64 nt, Homo Sapiens
aaccugcuuuauauuguuguucugaagcuuacaauugaccuauacauugcauucagcaagcucc

SEQ ID NO: 608357 - RNA, 64 nt, Homo Sapiens
accauaacaugcuuaagaaaacuuucccaaaauguugaccuaguuaaaugaggcuauauaaauu

SEQ ID NO: 608358 - RNA, 64 nt, Homo Sapiens
uccacuccugccagcucauuuccuucaauuuccuuugaccuauaggcuaaaaaagaaaggcuca

SEQ ID NO: 608359 - RNA, 64 nt, Homo Sapiens
aucucagcaauuugaacacuuuuucuguagcuuuuugaccuaagguguuuuucaaagugauuuc

SEQ ID NO: 608360 - RNA, 64 nt, Homo Sapiens
auauuacauauuccuccaguagccucuccuagacuugaccuagagcaauuuuuuuuuuaggaug

SEQ ID NO: 608361 - RNA, 64 nt, Homo Sapiens
ucugggacaccauauuucccucaccccagauuccuugaccuauuuggaugguggagaccauagg

SEQ ID NO: 608362 - RNA, 64 nt, Homo Sapiens
uauucauucuugauuaaaugguuuugcaucuaaauugaccuauuauuuuaauuauauuugacag

SEQ ID NO: 608363 - RNA, 64 nt, Homo Sapiens
uuggguuuucaaaaccauuuuuuaauuuagaacuuugaccuaauauugauacacaacugcuauu

SEQ ID NO: 608364 - RNA, 64 nt, Homo Sapiens
cuuuuuuuuuuuuuuuuuuucaggcaguugauauuugaccuaagaguaacuuaauuggguuuuu

SEQ ID NO: 608365 - RNA, 64 nt, Homo Sapiens
gggggagaaaagauuuagauccccuccuucaauauugaccuaacaggguggcccaaggcuauag

SEQ ID NO: 608366 - RNA, 64 nt, Homo Sapiens
agguacccaguggcagucuccaguggugacuggauugaccuacuugacuuuuugucguggcagc

SEQ ID NO: 608367 - RNA, 64 nt, Homo Sapiens
gaagccgggcccccacacccuggcugaagucagcuugaccuaggucuugacccucauccagcaa

SEQ ID NO: 608368 - RNA, 64 nt, Homo Sapiens
uguauuaagaccccuuuaauauggauaauccaaauugaccuagaaucuuugugagguuuuuucu

SEQ ID NO: 608369 - RNA, 64 nt, Homo Sapiens
cccucugcauugaccuggaggggagaggucagccuugaccuaaugagguagcuauaguugcagc

SEQ ID NO: 608370 - RNA, 64 nt, Homo Sapiens
auauggauuacaguuucccuguuauuccugcccauugaccuaacauauaaaaaaauuuuuccaa

SEQ ID NO: 608371 - RNA, 64 nt, Homo Sapiens
ccuucccuccuuuaaguguuuuuuuauuuucuucuugaccuaccucuuuuauuugggaguuuau

SEQ ID NO: 608372 - RNA, 64 nt, Homo Sapiens
uccaggaggcucaggggcucagacucugccuuccuugaccuagaggggcucuuuuuauagcacc

SEQ ID NO: 608373 - RNA, 64 nt, Homo Sapiens
ucagauacagggugcuccuugaaaaacaaugaaauugaccuaguaaugcaagcaaaguaucaaa

SEQ ID NO: 608374 - RNA, 64 nt, Homo Sapiens
aaugaaccuuggcucugcuucucuuuuguguaguuugaccuaaauuuuuuuggagaagagcauc

SEQ ID NO: 608375 - RNA, 64 nt, Homo Sapiens
cggacagagaaaugcacauguggaccaguuggcauugaccuaaaccgguggacauguucacugg

SEQ ID NO: 608376 - RNA, 64 nt, Homo Sapiens
uguuaaauuuaaaaauagguuaaaucaagaaucauugaccuaaugucuuugguauugucuuaaa

SEQ ID NO: 608377 - RNA, 64 nt, Homo Sapiens
uaacaaaauucagaaaauucaccugaaacguauuuugaccuaaaagaaacauauuuuuguauca

SEQ ID NO: 608378 - RNA, 64 nt, Homo Sapiens
ugaacuaauaaaauuuuauuucuuaaauauaaauuugaccuaaaauauuuucucaaacuaauuc

SEQ ID NO: 608379 - RNA, 64 nt, Homo Sapiens
auccuggggucuuucuaggacugugccucccugcuugaccuaugcuccaggacccugcccucaa

SEQ ID NO: 608380 - RNA, 64 nt, Homo Sapiens
aucccuuccuuaaaugccuuguuagacuuuguuuuugaccuaacaaauuuuuaaagcaacuugg

SEQ ID NO: 608381 - RNA, 64 nt, Homo Sapiens
cuucuauuuucuuaaggaagauaaagcuuaacacuugaccuaaaauaaggacagugucaaagug

SEQ ID NO: 608382 - RNA, 64 nt, Homo Sapiens
guaacccuuguaugauugcacaucauaguauuuguugaccuaauguuuaauaaauguaaaauug

SEQ ID NO: 608383 - RNA, 64 nt, Homo Sapiens
uuaaaagaugaauaggucuaaauauugucgcauguugaccuacgucucaggauaauuaauccua

SEQ ID NO: 608384 - RNA, 64 nt, Homo Sapiens
aaugcgagcugugguuaggcccauguuucagauuuugaccuagaauuuagucuucucucauugg

SEQ ID NO: 608385 - RNA, 64 nt, Homo Sapiens
aaaaagguguuaccaguaaaacuguacaguuacuuugaccuauuucucaggaagaauauaauga

SEQ ID NO: 608386 - RNA, 64 nt, Homo Sapiens
ggcaccgagcugaugcaguauuuguaauauuaaguugaccuaacaagguauuugcaugagucac

SEQ ID NO: 608387 - RNA, 64 nt, Homo Sapiens
uccccugcauggcugagagggugugggugcccuguugaccuacccuggaccgaguggaccacga

SEQ ID NO: 608388 - RNA, 64 nt, Homo Sapiens
aaugauugucgcaugaagugguucguucuuguguuugaccuaaggaggaauugauuucaaaaua

SEQ ID NO: 608389 - RNA, 64 nt, Homo Sapiens
caagcagccugaaccuugcuaguggcauucucuguugaccuaacagggcugucucuguggguac

SEQ ID NO: 608390 - RNA, 64 nt, Homo Sapiens
aacccuagcaggagaauacacccgagccuggcuuuugaccuaaggaacuuagagacgggaggga

SEQ ID NO: 608391 - RNA, 64 nt, Homo Sapiens
auuggccauuuguugguguguucauugcuuccauuugaccuaagugcuaauuuuucauucauag

SEQ ID NO: 608392 - RNA, 64 nt, Homo Sapiens
uuccaucugggcaaccugguuuuccaaauaucauuugaccuaagugaauguugauacuagcuaa

SEQ ID NO: 608393 - RNA, 64 nt, Homo Sapiens
ccuuaacuuacagaccugugaaauaaagggcauuuugaccuaauacaauuaauuuucuggauaa

SEQ ID NO: 608394 - RNA, 64 nt, Homo Sapiens
uuuuaugaagucacaagauacauauauuuuuauuuugaccuaaauuuguacagucccauuguaa

SEQ ID NO: 608395 - RNA, 64 nt, Homo Sapiens
ugugggagggaugaaaggcuuccuuuuuuuacuguugaccuauuagcuagaauguuaaacuuca

SEQ ID NO: 608396 - RNA, 64 nt, Homo Sapiens
augaacuggugucugcccaggcaguggcauggcuuugaccuaguguucacuuguguuggauaga

SEQ ID NO: 608397 - RNA, 64 nt, Homo Sapiens
uggagcuuccaccuggccagggaggacggagacuuugaccuacuccacauggagaggcaaccau

SEQ ID NO: 608398 - RNA, 64 nt, Homo Sapiens
ucugaugucagaguaguagguuaaggguggaagguugaccuacuuggaucuuggcaugcaccca

SEQ ID NO: 608399 - RNA, 64 nt, Homo Sapiens
auucacuuuuuaaaugaagaaauuagugaaaaaauugaccuaaugaaggaaacauuugugcuuu

SEQ ID NO: 608400 - RNA, 64 nt, Homo Sapiens
aaacacaagaguaggacacaucuguucuggguucuugaccuaucugucuccaauucaucucccc

SEQ ID NO: 608401 - RNA, 64 nt, Homo Sapiens
gcaaaagaaaaugauggguugaauuuacugauuauugaccuaauggauggcuuuuuaaaauguu

SEQ ID NO: 608402 - RNA, 64 nt, Homo Sapiens
cacugcgaaaauucauuccgugauguaacugcauuugaccuaacugcaaaacauacuguugcua

SEQ ID NO: 608403 - RNA, 64 nt, Homo Sapiens
ugguucagagaacaccccacgagagagcuguccauugaccuacaagcacaucacaccucccagu

SEQ ID NO: 608404 - RNA, 64 nt, Homo Sapiens
auuuauuuuguuaaaaucuccuugaugguuuauguugaccuaagagauacaucacagucacaug

SEQ ID NO: 608405 - RNA, 64 nt, Homo Sapiens
ucuuugggccucuccugcccggggagccagcugcuugaccuagcgucucccggcuccccuccca

SEQ ID NO: 608406 - RNA, 64 nt, Homo Sapiens
gaagcauggcauuaauuuguauuugcccuguucuuugaccuaaaguugaaggguuuagaguuuu

SEQ ID NO: 608407 - RNA, 64 nt, Homo Sapiens
gcuucagucucagcagagaauuuccuaaaugcguuugaccuaaugaaacugaucauggcuuccc

SEQ ID NO: 608408 - RNA, 64 nt, Homo Sapiens
cucaauucacauagauuucuucucuuuaguauaauugaccuacuuugguaguggaauagugaau

SEQ ID NO: 608409 - RNA, 64 nt, Homo Sapiens
uuuuugugaacuugagucaguccuauugaacauuuugaccuauauucuugcaaauuauguuaau

SEQ ID NO: 608410 - RNA, 64 nt, Homo Sapiens
aaaguccauaauuguuaucuucagaaaauauuauuugaccuacaguauguccaaaucaauuuaa

SEQ ID NO: 608411 - RNA, 64 nt, Homo Sapiens
cacuaauuuucagguggugguaccauaaagggauuugaccuaaugcucaagagaaucugacaga

SEQ ID NO: 608412 - RNA, 64 nt, Homo Sapiens
gugacuuuuauaagcaugaauucuuugucccaaguugaccuagguauuucuacuguacauuguu

SEQ ID NO: 608413 - RNA, 64 nt, Homo Sapiens
aacuuucuccuaacuaaauaaauguuuauaugcuuugaccuacuuaggccacagugaccugcgc

SEQ ID NO: 608414 - RNA, 64 nt, Homo Sapiens
gucaaaggaccuguguagcauuugauauguaagcuugaccuaaaacaaacacacagacacaccu

SEQ ID NO: 608415 - RNA, 64 nt, Homo Sapiens
uugcacguuaaagaccucuaaucgcaugcaagcauugaccuaccacaccuacaucccacugugc

SEQ ID NO: 608416 - RNA, 64 nt, Homo Sapiens
auaaugaaauaaaaucugaaaaguggauuucuuauugaccuauauucaugaaagcauauaaauu

SEQ ID NO: 608417 - RNA, 64 nt, Homo Sapiens
uuaucuaaccagcuauuuucuuaauugcuacagcuugaccuaccaguauuccggaguaaccagc

SEQ ID NO: 608418 - RNA, 64 nt, Homo Sapiens
uuuaaugaaugauggucucacaauucaguugacuuugaccuaauauuuaagaauauaaauauau

SEQ ID NO: 608419 - RNA, 64 nt, Homo Sapiens
acaaaaacaauagauucauuuaauuuuccugugguugaccuauacgaccaggauguagaaaacu

SEQ ID NO: 608420 - RNA, 64 nt, Homo Sapiens
ucaaaauguauugaggaucuuacauaauuaauauuugaccuacccuugaguuuuguuuguaaaa

SEQ ID NO: 608421 - RNA, 64 nt, Homo Sapiens
uagaugugguguuuauucaaaacucgguaguuguuugaccuaguacuuccauaucaauuauuug

SEQ ID NO: 608422 - RNA, 64 nt, Homo Sapiens
cagcuuacaguuugaaaaccccuaccagagcaucuugaccuaaucucagcagcugaagaauguc

SEQ ID NO: 608423 - RNA, 64 nt, Homo Sapiens
uccuaggauaguuaguaaaagacuuuuuagcauuuugaccuagggccuuuggcuuucacuaaaa

SEQ ID NO: 608424 - RNA, 64 nt, Homo Sapiens
ucccaucucuuaucuccuugauauaauuuugaacuugaccuacuuuaaacuuuuuugcucugca

SEQ ID NO: 608425 - RNA, 64 nt, Homo Sapiens
uggauaaaaucagugcuuuuaaucuugccucaaauugaccuacucauuuuaaaaugaguuuuug

SEQ ID NO: 608426 - RNA, 64 nt, Homo Sapiens
gucacccaaauagcugcuacccagaggggcgggguugaccuaggcugaauauccacuuuguuuu

SEQ ID NO: 608427 - RNA, 64 nt, Homo Sapiens
ccagauguuuuuagucaggcuauccugacaagacuugaccuaaacuucguuuuuauuggucaua

SEQ ID NO: 608428 - RNA, 64 nt, Homo Sapiens
aauucuaucuuugggaauuuagccuccaugucauuugaccuacguaugugucauguggccuaaa

SEQ ID NO: 608429 - RNA, 64 nt, Homo Sapiens
cauggcaggacaacuaguggcacuguggccucacuugaccuaguggcuuuaagaaucacugaau

SEQ ID NO: 608430 - RNA, 64 nt, Homo Sapiens
cucacuggacagacuccaggagacugcacaccuguugaccuaaaguggcucagccucgaaggac

SEQ ID NO: 608431 - RNA, 64 nt, Homo Sapiens
uugguuuaccagugauggaauuugggacauauacuugaccuagcuacucugaauucagugcugc

SEQ ID NO: 608432 - RNA, 64 nt, Homo Sapiens
uuuuuagcauuugaguuguuuuaaagcauguuauuugaccuaauuuaaguaacauuuaaaaaua

SEQ ID NO: 608433 - RNA, 64 nt, Homo Sapiens
uauauugauuaccaccaugguuuaaucaaucauuuugaccuaagaccaucauguuuuccaucac

SEQ ID NO: 608434 - RNA, 64 nt, Homo Sapiens
cacaaauuucuuaucacauuuucgacuucuucacuugaccuaacugauuaugcgaaauacccaa

SEQ ID NO: 608435 - RNA, 64 nt, Homo Sapiens
ucuagaaauaagugugaaggauaaauuuucuuuguugaccuaugaagauuuuagaguuuaccuu

SEQ ID NO: 608436 - RNA, 64 nt, Homo Sapiens
ugcgugcucccgaugcugcuauggaaggugcuacuugaccuaagggacucccacaacaacaaaa

SEQ ID NO: 608437 - RNA, 64 nt, Homo Sapiens
ugugggaaagccuuugucaguauuaaucccuuaauugaccuaaguauacucacacuaggaaaaa

SEQ ID NO: 608438 - RNA, 64 nt, Homo Sapiens
ccaaaggauggcagaaaacuguucucagucuaguuugaccuaauuuacacuauugcccuaggcu

SEQ ID NO: 608439 - RNA, 64 nt, Homo Sapiens
ugcugggguacaguugcuuccuuugacccugaauuugaccuacuugcgcccggccuugcaugcu

SEQ ID NO: 608440 - RNA, 64 nt, Homo Sapiens
ucauuucaaagacaggacucgauuaagccuucaguugaccuaauaguaugaauguaaacauugu

SEQ ID NO: 608441 - RNA, 64 nt, Homo Sapiens
ggauccuuuauucugcccagucaaacccaaauauuugaccuaagggaugugucaugucaucaug

SEQ ID NO: 608442 - RNA, 64 nt, Homo Sapiens
ggagcuagaaauaugucugucucuuuccuuuccuuugaccuaaugucuccuuucuacccuuguc

SEQ ID NO: 608443 - RNA, 64 nt, Homo Sapiens
cgugagccacugugccuggccuuauguaaagcucuugaccuagcaucugacuggaaacaagcgg

SEQ ID NO: 608444 - RNA, 64 nt, Homo Sapiens
auaccguuuauaaugccauugaaacaacacaguuuugaccuaacgggaugaaacuaaagcaaua

SEQ ID NO: 608445 - RNA, 64 nt, Homo Sapiens
aggaggcagggaucacuguggaccaucuuagcaguugaccuaacacaucuucuuuucaauaucu

SEQ ID NO: 608446 - RNA, 64 nt, Homo Sapiens
gaguugaacaacuuuguuccucuggugugguaaauugaccuaaaggugaccucugacgauuucc

SEQ ID NO: 608447 - RNA, 64 nt, Homo Sapiens
gacagcuguuuuuuaacccucuucugcaaguuuguugaccuacaugggcuaauauggauacuaa

SEQ ID NO: 608448 - RNA, 64 nt, Homo Sapiens
uacuuuaggcaucccuccuguugcuagcagccuuuugaccuaucugcaaugcaguguucucagu

SEQ ID NO: 608449 - RNA, 64 nt, Homo Sapiens
ccaaacaauguuacuuugaaaauugaguuuauguuugaccuaaaugggcuaaaauuacauuaga

SEQ ID NO: 608450 - RNA, 64 nt, Homo Sapiens
uggccucuaauucuuuggaccgccauuucuguguuugaccuacaugagugguuugggauguguu

SEQ ID NO: 608451 - RNA, 64 nt, Homo Sapiens
uauuacauggguguagugugauuguuuccuaaauuugaccuacauuucaguuccuguuuuugcu

SEQ ID NO: 608452 - RNA, 64 nt, Homo Sapiens
uaccuccccuggccgcgcucacagaaccauccacuugaccuaacaccuuugcuguguccuuggu

SEQ ID NO: 608453 - RNA, 63 nt, Homo Sapiens
acaguuuagacacugugguuuacaaaacagcaugcacucaacuugggacuuuaugaaaaguac

SEQ ID NO: 608454 - RNA, 63 nt, Homo Sapiens
acaauuucuaaauuaucaguuuucacaguuucagcacucaaccucaucauacgcugauuuaau

SEQ ID NO: 608455 - RNA, 63 nt, Homo Sapiens
auggaaacuucugggacugaugcccaacucagugcacucaagacgcaucuccaguuuucgggg

SEQ ID NO: 608456 - RNA, 63 nt, Homo Sapiens
cuaauacaaaacacggacauauuuuuacucguagcacucaauuuaguaacuucuagaugcuac

SEQ ID NO: 608457 - RNA, 64 nt, Homo Sapiens
uuuguuuuaagaaacaaaguuuuccacaauaauccugugcuauauuaugaaauggucuuuaaua

SEQ ID NO: 608458 - RNA, 64 nt, Homo Sapiens
aaacaagaagccuaugaaaacaaaggccuuuggccugugcuacuaggacccugcaagacgacga

SEQ ID NO: 608459 - RNA, 64 nt, Homo Sapiens
cauguugcugccaaccauaccuuccuucccugggcugugcuaccuggguccuuuucagaaguga

SEQ ID NO: 608460 - RNA, 64 nt, Homo Sapiens
augauucugcuuuuaccaugccccugagcaaugucugugcuagggaaacuucccgucccauauc

SEQ ID NO: 608461 - RNA, 64 nt, Homo Sapiens
aagaggacaggcuauuagguucuuggacuuuuuucugugcuaccgcugcugcuugguggaagua

SEQ ID NO: 608462 - RNA, 64 nt, Homo Sapiens
caucugugucuggaggggcagcuguguucaugcccugugcuacuggacauuucacaauucuggc

SEQ ID NO: 608463 - RNA, 64 nt, Homo Sapiens
aauaaaaagaugaaagcaacuuugguagcucuggcugugcuaucgcuagaauccaguaaaucau

SEQ ID NO: 608464 - RNA, 64 nt, Homo Sapiens
uucucuucuauccaaguagaguccaguucuccuccugugcuauccaacaaucuauaccuggacu

SEQ ID NO: 608465 - RNA, 64 nt, Homo Sapiens
cguggugggcaguauaaagaccgugugccaggcacugugcuaggagcauucccuugcuagaagc

SEQ ID NO: 608466 - RNA, 64 nt, Homo Sapiens
guuguguuguaggaauuaguaagugccaccuucgcugugcuagaccaaagcccccaaggguggc

SEQ ID NO: 608467 - RNA, 64 nt, Homo Sapiens; identical to SEQ ID NO: 261649

SEQ ID NO: 608468 - RNA, 64 nt, Homo Sapiens; identical to SEQ ID NO: 261650

SEQ ID NO: 608469 - RNA, 64 nt, Homo Sapiens; identical to SEQ ID NO: 261651

SEQ ID NO: 608470 - RNA, 64 nt, Homo Sapiens; identical to SEQ ID NO: 261652

SEQ ID NO: 608471 - RNA, 64 nt, Homo Sapiens; identical to SEQ ID NO: 261653

SEQ ID NO: 608472 - RNA, 64 nt, Homo Sapiens; identical to SEQ ID NO: 261654

SEQ ID NO: 608473 - RNA, 64 nt, Homo Sapiens; identical to SEQ ID NO: 261655

SEQ ID NO: 608474 - RNA, 64 nt, Homo Sapiens; identical to SEQ ID NO: 261656

SEQ ID NO: 608475 - RNA, 64 nt, Homo Sapiens; identical to SEQ ID NO: 261657

SEQ ID NO: 608476 - RNA, 64 nt, Homo Sapiens; identical to SEQ ID NO: 261658

SEQ ID NO: 608477 - RNA, 64 nt, Homo Sapiens
gcccaaacccacauuccaaagugguaggcucauuuguuucuagagauuucaucaugucgcuuuu

SEQ ID NO: 608478 - RNA, 64 nt, Homo Sapiens
ggcguagacacaguaagaaccuaguaaauauuacuguuucuagccaucagggagauuguggaac

SEQ ID NO: 608479 - RNA, 64 nt, Homo Sapiens
agagcauguacaaaaguggcucuuuucagagugguguuucuaaacucuuaccuagcgaacaaga

SEQ ID NO: 608480 - RNA, 64 nt, Homo Sapiens
guauuguuugcuaauuuuuaaauuuacauaucaauguuucuacauuaagaugcagcauuuuaga

SEQ ID NO: 608481 - RNA, 64 nt, Homo Sapiens
aacacugcaccuuaucccaguuaggcaaugauccuguuucuaccgcccaccuccaagggaaggc

SEQ ID NO: 608482 - RNA, 64 nt, Homo Sapiens
uuucucugccuagcacaaaaggacaucaucugguuguuucuacuggauuuagaacuagcagggu

SEQ ID NO: 608483 - RNA, 62 nt, Homo Sapiens
auugcugagguuuagcuguccauuaaaacaauauuguuucuacuaaaaaacaaagaagacaa

SEQ ID NO: 608484 - RNA, 64 nt, Homo Sapiens
gaaaugaaagaaaggccagcuccuucacauccuguguuucuaggauucccuccugcuacucugu

SEQ ID NO: 608485 - RNA, 64 nt, Homo Sapiens
agaacuaugguuuuuggcauguugggucaagacguguuucuauaggaaaugcuugcacguggca

SEQ ID NO: 608486 - RNA, 64 nt, Homo Sapiens
guuugagaccagccugggcaacauggcgagacccuguuucuacaaaaagaaaaagggaaaaaaa

SEQ ID NO: 608487 - RNA, 64 nt, Homo Sapiens
uuauguggauaauguuauauacagccaaaguggauguuucuauuuggcaaggaagguaggauuu

SEQ ID NO: 608488 - RNA, 64 nt, Homo Sapiens
uuugccaccuauuucuuguuguaaaacagauguuuguuucuaaaauauaaugaauuaaugauua

SEQ ID NO: 608489 - RNA, 64 nt, Homo Sapiens
ucauuauauguguuuuggugauuagugacuuuuauguuucuauuguaauuguuuuggggugcca

SEQ ID NO: 608490 - RNA, 64 nt, Homo Sapiens
uaagccagaaggcaagaucagauuaaaaacaccauguuucuaagcauccauuuuucccuuucuu

SEQ ID NO: 608491 - RNA, 64 nt, Homo Sapiens
uugacuaagaaugaaccagauuugguggugguuuuguuucuaugcaaacuggacacaaauuaca

SEQ ID NO: 608492 - RNA, 64 nt, Homo Sapiens
guccacuauuucuuaugucauucguuagucuacauguuucuaaacauauaaaugugaauuuaau

SEQ ID NO: 608493 - RNA, 64 nt, Homo Sapiens
aucaaaaguucggcauguagcucaugaucuaugcuguuucuaugucguggaagcacuggauggg

SEQ ID NO: 608494 - RNA, 64 nt, Homo Sapiens
gaccaagcaggagagccagcguucagcugugcuguguuucuacuuagaguccuaagccccucau

SEQ ID NO: 608495 - RNA, 64 nt, Homo Sapiens
gggacaauacagacccuggagggcuuuguuuugguguuucuacacauccccaggcagcaccuuu

SEQ ID NO: 608496 - RNA, 64 nt, Homo Sapiens
aggaagaauuugccaucaagccauuucccccuuuuguuucuaaaauuauuucagagaugugugc

SEQ ID NO: 608497 - RNA, 64 nt, Homo Sapiens
gaagagaaguaaaauccucagguugugggguauuuguuucuacuccagccuggcaggcaaggcu

SEQ ID NO: 608498 - RNA, 64 nt, Homo Sapiens
uuagaacuuuuuuauuuuauaaauucuuuuucuguguuucuagguucugaaacuuaaaaacaau

SEQ ID NO: 608499 - RNA, 64 nt, Homo Sapiens
acuuaaauguuuuaauuggaaaaaacauguagauuguuucuauucagguauauuuaccugguag

SEQ ID NO: 608500 - RNA, 64 nt, Homo Sapiens
uggacucuuaauaugaacuucagguaguuguuaguguuucuaauugauucuuucaaacuauugc

SEQ ID NO: 608501 - RNA, 64 nt, Homo Sapiens
uucacaagacagcacuuugauucuauguugaguuuguuucuauauuagaaaagcagcaagucag

SEQ ID NO: 608502 - RNA, 64 nt, Homo Sapiens
guuugugaccagccuggccaacauagugaaauccuguuucuacuaaaaauacaaaaauuagcug

SEQ ID NO: 608503 - RNA, 64 nt, Homo Sapiens
agccagguccaccgcccaccacccuuucaggccauguuucuacucagugugcuuuucccaaaug

SEQ ID NO: 608504 - RNA, 64 nt, Homo Sapiens
uacucagugugcuuuucccaaaugaugugugugguguuucuaagagaaacagggcccauaacca

SEQ ID NO: 608505 - RNA, 64 nt, Homo Sapiens
caagccaaggacaggagcaagugugcccucauuuuguuucuacuuuuaauuucuguguguuggc

SEQ ID NO: 608506 - RNA, 63 nt, Homo Sapiens
guauucaaaauaacaaaaauaaagccugauucuuuguuucuagaaaucucuuguaccuugcuu

SEQ ID NO: 608507 - RNA, 64 nt, Homo Sapiens
cccagaaucagcuuaggcuucuaugaauucagccuguuucuaaaagcugaaaaucucaguuuaa

SEQ ID NO: 608508 - RNA, 64 nt, Homo Sapiens
aauacuauaaugagagccacaucuguaauuuaaauguuucuaguaaccacauuuuuuuaaaagu

SEQ ID NO: 608509 - RNA, 64 nt, Homo Sapiens
gacuuuuuuuuuuuuuuuugggaauaccaagaguuguuucuacauuguaucuaagaccugccag

SEQ ID NO: 608510 - RNA, 64 nt, Homo Sapiens
aagauaaaauaauugggggcgguccauuuuugucuguuucuaugcuacauugggugaaaccguu

SEQ ID NO: 608511 - RNA, 64 nt, Homo Sapiens
gaccugaauguguuggaucuaaaauguuuugguuuguuucuacuuguugcaaguuugugagggg

SEQ ID NO: 608512 - RNA, 64 nt, Homo Sapiens
uuuugaaacaaagguauguauuauuuucgucguauguuucuauaguuagucuuauguauagaca

SEQ ID NO: 608513 - RNA, 64 nt, Homo Sapiens
ggaaaaacaaauucguuuuuuauguccucuucucuguuucuaccuuucagaauggacuuaaauc

SEQ ID NO: 608514 - RNA, 64 nt, Homo Sapiens
aucuggacuuugcccucaaaagagcagugguuccuguuucuagguuguggaucuucagauaaau

SEQ ID NO: 608515 - RNA, 64 nt, Homo Sapiens
guguagcuggguacauauuauaaaacugacaaaguguuucuaggaaauguauauuaagguaaaa

SEQ ID NO: 608516 - RNA, 64 nt, Homo Sapiens
ucucauuuguaacugcaugcggucuuuaauacaguguuucuaccauaugacguuuguauuuuua

SEQ ID NO: 608517 - RNA, 64 nt, Homo Sapiens
uuuucuccuucugauuuugcgcuuuuugguuuaguguuucuaaaaaacaucacguucucuauug

SEQ ID NO: 608518 - RNA, 64 nt, Homo Sapiens
augaaauguauuucaauaagcuucuuugguagucuguuucuaaauuuuagaguuuuuguauaga

SEQ ID NO: 608519 - RNA, 64 nt, Homo Sapiens
gaaagauacaaggcauaggucuacuaguagauuguguuucuagaaaaauuucaaauugguuuuu

SEQ ID NO: 608520 - RNA, 64 nt, Homo Sapiens
aauauagaaauaaugucagauuaugagugaaaaguguuucuaaaaugccauugucaccuuggau

SEQ ID NO: 608521 - RNA, 64 nt, Homo Sapiens
gugcagauucccaacaguggauuuuaccuucuuuuguuucuauuaauguucaccuagaacucua

SEQ ID NO: 608522 - RNA, 64 nt, Homo Sapiens
guucaccuagaacucuaauuacagacauugaaguuguuucuaauauuuugggccauuaccuacu

SEQ ID NO: 608523 - RNA, 64 nt, Homo Sapiens
ucaaugguagcuuuauugacuguucugauugugcuguuucuaauuuauugaaucugcuagguuu

SEQ ID NO: 608524 - RNA, 64 nt, Homo Sapiens
aucacuuuguggcagggguacuuuuaaacauaaauguuucuacaaaaguagguugaguucauug

SEQ ID NO: 608525 - RNA, 64 nt, Homo Sapiens
ggcucuuuuggccucuuacuaggggggauagucuuguuucuagcuuaaacaauuuuuuuuuugc

SEQ ID NO: 608526 - RNA, 64 nt, Homo Sapiens
auaauuuuuuuuucuuugccacacuggagcacaauguuucuauguaaagaauuauuuucauucu

SEQ ID NO: 608527 - RNA, 64 nt, Homo Sapiens
caagggccuaauguuuguuagugagagagagcuauguuucuaacgagaugaucgaugugugugu

SEQ ID NO: 608528 - RNA, 64 nt, Homo Sapiens
aaacauuuccagaaacguauaaagaaaagaaaucuguuucuaccacuccauugacccaccgaaa

SEQ ID NO: 608529 - RNA, 64 nt, Homo Sapiens
ugcaucucagccugagacgcuuccaguuuuagaaaacagaaaucucaauacacgucaaggucgc

SEQ ID NO: 608530 - RNA, 64 nt, Homo Sapiens
ugucccuggcugcgcuuucuccacccugggagagaacagaaagccauguaagauacuaaccuag

SEQ ID NO: 608531 - RNA, 64 nt, Homo Sapiens
cuuauaaaccaaauaaaaauuccagaggucauggaacagaaagcuagacugccucgcaagcuau

SEQ ID NO: 608532 - RNA, 64 nt, Homo Sapiens
uccauuuuguaguuauagcuaugaagauaacuuaaacagaaauaaaaacuugccucuauuuaua

SEQ ID NO: 608533 - RNA, 64 nt, Homo Sapiens
agaauuuugcuuuuucaaccaacuaaauuuuagcaacagaaauuaaaagugaugauuguuuagu

SEQ ID NO: 608534 - RNA, 64 nt, Homo Sapiens
uacuauuuuccaaauguuuuuuugaacauuuuaaaacagaaaggcauuuuuaaaaaauacauua

SEQ ID NO: 608535 - RNA, 64 nt, Homo Sapiens
gaggggccaggugugguggucugaguuuuuaaaaaacagaaaauucuauucugugugcugcagc

SEQ ID NO: 608536 - RNA, 64 nt, Homo Sapiens
gugacauuuagagguuuuaauuuccuuucuaguuaacagaaauagguacuuuuauucagacuug

SEQ ID NO: 608537 - RNA, 64 nt, Homo Sapiens
cagagaauugcugauucuugaguuuagugaucugaacagaaauaccaaaauuauuucagaaaug

SEQ ID NO: 608538 - RNA, 64 nt, Homo Sapiens
uauuccagaugccuucuccagacaaaccagaagcaacagaaaaaaucgucucucccucccuuug

SEQ ID NO: 608539 - RNA, 64 nt, Homo Sapiens
augacucaggauuuuaucuccuagauauauauucaacagaaaugcaugaguaugugcaccaaca

SEQ ID NO: 608540 - RNA, 64 nt, Homo Sapiens
ccaaacuggaaacccaaguguccaucuccaucggaacagaaaacuauacuuuggucugcuucua

SEQ ID NO: 608541 - RNA, 64 nt, Homo Sapiens
gggcggaguuuguuguaaggcaaucaccugucaaaacagaaauugggugggaaaggagucuuua

SEQ ID NO: 608542 - RNA, 64 nt, Homo Sapiens
ucauauucuaguauuucucacaggggguaugagaaacagaaagcuauauguagcagcuggucuu

SEQ ID NO: 608543 - RNA, 64 nt, Homo Sapiens
auuuuauccugaaguaagcuugcccggccaaaagaacagaaauuauuacaggugugagccacug

SEQ ID NO: 608544 - RNA, 64 nt, Homo Sapiens
ugcugagcacucccauacaccgguccaucuguuuaacagaaaugcaggccugcauaggcagcag

SEQ ID NO: 608545 - RNA, 64 nt, Homo Sapiens
agugccaagcaugcgauauucgcuccccagaaccaacagaaauccuagcucuccugagcaggga

SEQ ID NO: 608546 - RNA, 64 nt, Homo Sapiens
uauggauucccuggaugaaacuccauguccuguuaacagaaagccuucaaaugcagccagucua

SEQ ID NO: 608547 - RNA, 64 nt, Homo Sapiens
aaaaaaaccucuaugcaaucacaaacaaacagaaaacagaaaacuuucaaaaaaucugaccaaa

SEQ ID NO: 608548 - RNA, 64 nt, Homo Sapiens
agaaaacaaaaaaaccucuagaccaaaacaaacaaacagaaaacgaagauguuucaaaaaaucu

SEQ ID NO: 608549 - RNA, 64 nt, Homo Sapiens
aauuggagauguugaaaaucauuuucccuucuuaaacagaaauaaauauuuggaaugaagggga

SEQ ID NO: 608550 - RNA, 64 nt, Homo Sapiens
guacuagaacacccuuuuugccacggguaaaaauaacagaaauguaugguuuguuuuaccuuca

SEQ ID NO: 608551 - RNA, 64 nt, Homo Sapiens
uauucucuuaacaguuccagggguggcuuuaaacaacagaaauuagaacaaauuaccacaaacu

SEQ ID NO: 608552 - RNA, 64 nt, Homo Sapiens
uuauuggauuuaguacugauacauauauauacacaacagaaaguacuauauauguuacauacua

SEQ ID NO: 608553 - RNA, 64 nt, Homo Sapiens
uaccuuuuaauaaauuaaaauuuucaggcaugguaacagaaauuaauguuuucuauuuugcaua

SEQ ID NO: 608554 - RNA, 64 nt, Homo Sapiens
caacucuaaauucaacaagacgaccuuucuuuauaacagaaacucggagaaggaaaagaacuua

SEQ ID NO: 608555 - RNA, 64 nt, Homo Sapiens
acugguaggggccaaggccaugcuccccuugggaaacagaaacaagugcccagucagcaccuac

SEQ ID NO: 608556 - RNA, 64 nt, Homo Sapiens
uggggaggcagggagcuagggcagggaccaaaugaacagaaagucucagcccaggauggggcuu

SEQ ID NO: 608557 - RNA, 64 nt, Homo Sapiens
ucugugguccccucacucagucucucauuugguaaacagaaagcuguuuucccuacaaggugcu

SEQ ID NO: 608558 - RNA, 64 nt, Homo Sapiens
uuaaaacaauuuguucagaagaacugagcaaacuaacagaaauacaaggcuacgaacaguuuag

SEQ ID NO: 608559 - RNA, 64 nt, Homo Sapiens
ucaugaagaagacacuaaaaacaauugcaacaaaaacagaaauugacaaauggggccucauuaa

SEQ ID NO: 608560 - RNA, 64 nt, Homo Sapiens
cuagaggcuauuauccuaagcaaccuaaugcaagaacagaaaaccacauacugcaucuucccau

SEQ ID NO: 608561 - RNA, 64 nt, Homo Sapiens
uaaaugauuuaaaaucaaaucugacguauuacaaaacagaaaaaaagaauaagaaugaaaacug

SEQ ID NO: 608562 - RNA, 64 nt, Homo Sapiens
uuacagauaagaauuuauuuugaauauacuaaauaacagaaaagacuaauuccaaaauuauggc

SEQ ID NO: 608563 - RNA, 64 nt, Homo Sapiens
uugauggugacacuuggguuaaaaucuuaaauaaaacagaaaaccuuucuucagaauuaaaacu

SEQ ID NO: 608564 - RNA, 64 nt, Homo Sapiens
ugguuauaaccugacgcuaaacaggagaaaagaaaacagaaaccguuugugcaguauugaaaag

SEQ ID NO: 608565 - RNA, 64 nt, Homo Sapiens
auuuuagcaucaguuuacaaacaacuuuauuaucaacagaaauuuuagcucuuuucuuugcaag

SEQ ID NO: 608566 - RNA, 64 nt, Homo Sapiens
accuuuuaauuugaaaacaaggaaauuaaauuuuaacagaaaucuuuuaaguauguuauaacca

SEQ ID NO: 608567 - RNA, 64 nt, Homo Sapiens
ugucaacaaggaaaagaggaaaaguggacuguccaacagaaagaggaacuuagccuggaaagcg

SEQ ID NO: 608568 - RNA, 64 nt, Homo Sapiens
uagaugaaucagugcccaagggcuuucaguguagaacagaaaguauucagaccuuugaaaaucu

SEQ ID NO: 608569 - RNA, 64 nt, Homo Sapiens
cuuagcuaguagaauggcaguuuaaaaaggacugaacagaaaucaaaggccccagucgggggua

SEQ ID NO: 608570 - RNA, 64 nt, Homo Sapiens
uagaauaaaauguugauaagacuguauaaauucuaacagaaaaaguuuugcuguaaauaauaac

SEQ ID NO: 608571 - RNA, 64 nt, Homo Sapiens
cugaugcuggggacacagcagggagaagagggaaaacagaaaacauggacaaggaaggaauaaa

SEQ ID NO: 608572 - RNA, 64 nt, Homo Sapiens
gaagguugagggcaauggacaccaggccagagcaaacagaaaaaucauggauauguuauacuga

SEQ ID NO: 608573 - RNA, 64 nt, Homo Sapiens
aacaaaaaauaaccccaaaaugauuuuuuuuuagaacagaaaaccguauaagcauggagaacag

SEQ ID NO: 608574 - RNA, 64 nt, Homo Sapiens
aaacacacacacacacaacaguccucuuucagaaaacagaaaaauugugaauugauaauaaacu

SEQ ID NO: 608575 - RNA, 64 nt, Homo Sapiens
cagcaguggccagguggagagggccuaagccagaaacagaaagacucacgccaggcaggccagu

SEQ ID NO: 608576 - RNA, 64 nt, Homo Sapiens
uauuggcucagagcucuggagguaaguuauaauaaacagaaauguagcaagaucccugagacgg

SEQ ID NO: 608577 - RNA, 64 nt, Homo Sapiens
acaguguuccugcauuuacccagggucuggugugaacagaaaaacaaauuucucagugccuucu

SEQ ID NO: 608578 - RNA, 64 nt, Homo Sapiens
ucacaauucaaaagugaguuauuguccuuccguuaacagaaacauaaaaguauuauaguaacgu

SEQ ID NO: 608579 - RNA, 64 nt, Homo Sapiens
auugacccugcauugcaaaaugacaaagauauucaacagaaaaucugaaaauggacucucuuug

SEQ ID NO: 608580 - RNA, 64 nt, Homo Sapiens
ccuuacuucauuucaaaugaauuuauuacuccagaacagaaagaaauaauuauugcauaguaga

SEQ ID NO: 608581 - RNA, 64 nt, Homo Sapiens
gcuaauuuccaauguauuguuucuuuuuuuuuuuaacagaaacaugucuucucuaaaucuuucu

SEQ ID NO: 608582 - RNA, 64 nt, Homo Sapiens
auuguuuaaaugcuugaagcguuguugcaugagcaacagaaaaaaaaccaaaacuguaaauaug

SEQ ID NO: 608583 - RNA, 64 nt, Homo Sapiens
uugagguccagccuugguguagagaagcggcagaaacagaaaucccaaaaggugucaugcuugg

SEQ ID NO: 608584 - RNA, 64 nt, Homo Sapiens
cucuuccuuuaugucagguaccuagacauagcggaacagaaaacccuucaaaaguucagucuag

SEQ ID NO: 608585 - RNA, 64 nt, Homo Sapiens
uccuguuauaaacuaguauuuguuguuuagccaaaacagaaaaugauuuccacuggacaguaga

SEQ ID NO: 608586 - RNA, 64 nt, Homo Sapiens
cgguuuaaaccaugguuuaagaauuugcccaaauaacagaaauuuuguucgggaagggauaaac

SEQ ID NO: 608587 - RNA, 64 nt, Homo Sapiens
caccaccaaaacagauacccacgcuguagucuccaacagaaaaagcuaaaagccuuugaacacc

SEQ ID NO: 608588 - RNA, 64 nt, Homo Sapiens
ggaagcugaagucagugucuaugaugcugagacaaacagaaacuucagccuauuggucccaucc

SEQ ID NO: 608589 - RNA, 64 nt, Homo Sapiens
aguauacugcuaucgagacauguuuguucggaaaaacagaaagauccauaaagaugcagagucc

SEQ ID NO: 608590 - RNA, 64 nt, Homo Sapiens
aagaaagacauaugaaaggaauuguaauuggcuuaacagaaacagucuguaaaaaccuaacagu

SEQ ID NO: 608591 - RNA, 64 nt, Homo Sapiens
cagaauuucuggggcugcuccuuaagaauacaaaaacagaaauggguuuacgagauuuggcugc

SEQ ID NO: 608592 - RNA, 64 nt, Homo Sapiens
uguaacacuuaugacaacaagagaagcagcaaugaacagaaagcagaugaagccagugcuagcu

SEQ ID NO: 608593 - RNA, 64 nt, Homo Sapiens
agggaauaucuuugucacauaggaauuguucagcaacagaaagauacuuuguaaugagaaggua

SEQ ID NO: 608594 - RNA, 64 nt, Homo Sapiens
auguuguuuuaugcuuauaaagcauuuucauaugaacagaaaguuuauauuuuucuguuuuuga

SEQ ID NO: 608595 - RNA, 64 nt, Homo Sapiens
gccgcugcccgaaccucugugacccagugcauccaacagaaacaaaagcccuuuucuggugggu

SEQ ID NO: 608596 - RNA, 64 nt, Homo Sapiens
aguggagguggggguugcugcucaaaccaaaccaaacagaaagcagcuagcccaaaaucccaaa

SEQ ID NO: 608597 - RNA, 64 nt, Homo Sapiens
agacaaagaaaaaagagcuaagggaggaagggaaaacagaaagcgcucugagcguacauaggga

SEQ ID NO: 608598 - RNA, 64 nt, Homo Sapiens
auaagaacagccacugcucugaugaagauauucaaacagaaagacagaagaacccauagaugaa

SEQ ID NO: 608599 - RNA, 64 nt, Homo Sapiens
guacugauggccucucauacuagaugacuuugaaaacagaaaugucaaaauauacuuuuggaag

SEQ ID NO: 608600 - RNA, 64 nt, Homo Sapiens
aaagaaaagcuuguauauacgaugcuaaauuaaaaacagaaaacucauuacucaucacaucccc

SEQ ID NO: 608601 - RNA, 64 nt, Homo Sapiens
gauggaguagccagugguaauacaaagcagggagaacagaaagguagaguuacuaaggccuuca

SEQ ID NO: 608602 - RNA, 64 nt, Homo Sapiens
gaacagaaagguagaguuacuaaggccuucagugaacagaaaggagcagagagcaagauuagau

SEQ ID NO: 608603 - RNA, 64 nt, Homo Sapiens
gugaaaguuuaggcacauuuucacuaaaagugggaacagaaaauggaggccuguuuuuuauugc

SEQ ID NO: 608604 - RNA, 64 nt, Homo Sapiens
ugaacuauacacaaaagugaauccagagauuaaaaacagaaauauggaaaagcuauguacuaaa

SEQ ID NO: 608605 - RNA, 64 nt, Homo Sapiens
cuguaaaaugcaacaaaugaaauccacauguauuaacagaaagaucccagaauuguugaggggg

SEQ ID NO: 608606 - RNA, 64 nt, Homo Sapiens
ugaaagaaaacugucagcaauucuaugcugacauaacagaaaauguagaugagauagaugaaau

SEQ ID NO: 608607 - RNA, 64 nt, Homo Sapiens
uguguccuaugcccagcugcacagcuuacccucaaacagaaaauaaugaagccuucuuccuccc

SEQ ID NO: 608608 - RNA, 64 nt, Homo Sapiens
agacauuaaauuaagccaaauucaccuuuauagcaacagaaaacuuauaauaucaaacugcaua

SEQ ID NO: 608609 - RNA, 64 nt, Homo Sapiens
cuaagaguucagaaauguccaaagugagccacuaaacagaaaguuucccucccuuucacuuuuc

SEQ ID NO: 608610 - RNA, 64 nt, Homo Sapiens
ugaaugaauuucuaaauacaguaugugcuggguaaacagaaagugguuuagacauucuugauua

SEQ ID NO: 608611 - RNA, 64 nt, Homo Sapiens
ucugugcugaugagauucaugcuaccuaaaaauuaacagaaaugacacugugaacaauguaguu

SEQ ID NO: 608612 - RNA, 64 nt, Homo Sapiens
acaaauuaccaccaauaauaugauggcuuaacacaacagaaacuuauuugcuuacauuuuugaa

SEQ ID NO: 608613 - RNA, 64 nt, Homo Sapiens
gaggccaaauuccucuuccucugagaaccagugaaacagaaaaguuaaucugcuuucaaauuac

SEQ ID NO: 608614 - RNA, 64 nt, Homo Sapiens
gagaccugagcuucacauuguacuuuaaaaaauaaacagaaaugacauuguaaagaacagaaau

SEQ ID NO: 608615 - RNA, 64 nt, Homo Sapiens
acuuuaaaaaauaaacagaaaacacauuguaaagaacagaaauuugcacauguguguguguaau

SEQ ID NO: 608616 - RNA, 64 nt, Homo Sapiens
cguuuuccaacauguagaaccagucauucagggaaacagaaagaggauuccugcgaguugcuuu

SEQ ID NO: 608617 - RNA, 64 nt, Homo Sapiens
aaaguguggaauguguuguacuuaacaaaaagcaaacagaaaaaugaguacaaaaaugcagaca

SEQ ID NO: 608618 - RNA, 64 nt, Homo Sapiens
uggauuguuuaaaaacuacuuugugaauacaauguauguccaaugaauuaguucuauaaaagua

SEQ ID NO: 608619 - RNA, 64 nt, Homo Sapiens
aaguacuccaauuaccagcgucaucaugaagacauauguccacuaucagagcaaagcaaugaga

SEQ ID NO: 608620 - RNA, 64 nt, Homo Sapiens
cuuaaccuuuaaagauguacuccaccuaaauuccuauguccacauauauaaagaguuguauaug

SEQ ID NO: 608621 - RNA, 64 nt, Homo Sapiens
uaaauuccuauguccacacuuauaaagaguuguauauguccaccuuacauuaacauuccuuuua

SEQ ID NO: 608622 - RNA, 64 nt, Homo Sapiens
aaguauuuuaucuuuuaucuagaauccacauauguauguccaauuugauugggauaguaguuag

SEQ ID NO: 608623 - RNA, 64 nt, Homo Sapiens
uuuagccuguuauauuuccuucuguaaaauaaaauauguccagaagaggcauguuguuucuaga

SEQ ID NO: 608624 - RNA, 64 nt, Homo Sapiens; identical to SEQ ID NO: 608622

SEQ ID NO: 608625 - RNA, 64 nt, Homo Sapiens; identical to SEQ ID NO: 608623

SEQ ID NO: 608626 - RNA, 64 nt, Homo Sapiens; identical to SEQ ID NO: 214864

SEQ ID NO: 608627 - RNA, 64 nt, Homo Sapiens; identical to SEQ ID NO: 214865

SEQ ID NO: 608628 - RNA, 64 nt, Homo Sapiens; identical to SEQ ID NO: 214866

SEQ ID NO: 608629 - RNA, 64 nt, Homo Sapiens; identical to SEQ ID NO: 214867

SEQ ID NO: 608630 - RNA, 64 nt, Homo Sapiens; identical to SEQ ID NO: 214868

SEQ ID NO: 608631 - RNA, 64 nt, Homo Sapiens; identical to SEQ ID NO: 214869

SEQ ID NO: 608632 - RNA, 64 nt, Homo Sapiens; identical to SEQ ID NO: 214870

SEQ ID NO: 608633 - RNA, 64 nt, Homo Sapiens; identical to SEQ ID NO: 214871

SEQ ID NO: 608634 - RNA, 64 nt, Homo Sapiens; identical to SEQ ID NO: 214872

SEQ ID NO: 608635 - RNA, 64 nt, Homo Sapiens; identical to SEQ ID NO: 214873

SEQ ID NO: 608636 - RNA, 64 nt, Homo Sapiens; identical to SEQ ID NO: 214874

SEQ ID NO: 608637 - RNA, 64 nt, Homo Sapiens; identical to SEQ ID NO: 214875

SEQ ID NO: 608638 - RNA, 64 nt, Homo Sapiens; identical to SEQ ID NO: 214876

SEQ ID NO: 608639 - RNA, 64 nt, Homo Sapiens; identical to SEQ ID NO: 214877

SEQ ID NO: 608640 - RNA, 64 nt, Homo Sapiens; identical to SEQ ID NO: 214878

SEQ ID NO: 608641 - RNA, 64 nt, Homo Sapiens; identical to SEQ ID NO: 214879

SEQ ID NO: 608642 - RNA, 64 nt, Homo Sapiens; identical to SEQ ID NO: 214880

SEQ ID NO: 608643 - RNA, 64 nt, Homo Sapiens; identical to SEQ ID NO: 214881

SEQ ID NO: 608644 - RNA, 64 nt, Homo Sapiens; identical to SEQ ID NO: 214882

SEQ ID NO: 608645 - RNA, 64 nt, Homo Sapiens; identical to SEQ ID NO: 214883

SEQ ID NO: 608646 - RNA, 64 nt, Homo Sapiens; identical to SEQ ID NO: 214884

SEQ ID NO: 608647 - RNA, 64 nt, Homo Sapiens; identical to SEQ ID NO: 214885

SEQ ID NO: 608648 - RNA, 64 nt, Homo Sapiens; identical to SEQ ID NO: 214886

SEQ ID NO: 608649 - RNA, 64 nt, Homo Sapiens; identical to SEQ ID NO: 214887

SEQ ID NO: 608650 - RNA, 64 nt, Homo Sapiens; identical to SEQ ID NO: 214888

SEQ ID NO: 608651 - RNA, 64 nt, Homo Sapiens; identical to SEQ ID NO: 214889

SEQ ID NO: 608652 - RNA, 64 nt, Homo Sapiens; identical to SEQ ID NO: 214890

SEQ ID NO: 608653 - RNA, 64 nt, Homo Sapiens; identical to SEQ ID NO: 214891

SEQ ID NO: 608654 - RNA, 64 nt, Homo Sapiens; identical to SEQ ID NO: 214892

SEQ ID NO: 608655 - RNA, 64 nt, Homo Sapiens; identical to SEQ ID NO: 214893

SEQ ID NO: 608656 - RNA, 64 nt, Homo Sapiens; identical to SEQ ID NO: 214894

SEQ ID NO: 608657 - RNA, 64 nt, Homo Sapiens; identical to SEQ ID NO: 214895

SEQ ID NO: 608658 - RNA, 64 nt, Homo Sapiens; identical to SEQ ID NO: 214896

SEQ ID NO: 608659 - RNA, 64 nt, Homo Sapiens; identical to SEQ ID NO: 214897

SEQ ID NO: 608660 - RNA, 64 nt, Homo Sapiens
ucaguggccuguuucaucacuaaagucacauauugacauugagcaauaugaagagauuguuguc

SEQ ID NO: 608661 - RNA, 64 nt, Homo Sapiens
aaaguauagcagcauccucuaaucaaugucaguagacauugauaacaaaagauuuccacuuuca

SEQ ID NO: 608662 - RNA, 64 nt, Homo Sapiens
gaccuauuacuguaugcgcauuuuuaugccuuuugacauugaauugugaagauuuugcucaucu

SEQ ID NO: 608663 - RNA, 64 nt, Homo Sapiens
auaaagaggaacauugaccuaacucaugauuuaugacauugaaaaggugaugaaacucaguggu

SEQ ID NO: 608664 - RNA, 64 nt, Homo Sapiens
uuguccuuuucccugaucaauuaggugacgaguugacauugagacuguaaguucaaauuuauga

SEQ ID NO: 608665 - RNA, 64 nt, Homo Sapiens
auuggucuucuguugaucuaccaucuugcaggacgacauugaagggaggagauguuaaaguaac

SEQ ID NO: 608666 - RNA, 64 nt, Homo Sapiens
cugaaucaauuuuauuuaaauuugugauuaaagugacauugaauuucugaugcuaugcugccau

SEQ ID NO: 608667 - RNA, 64 nt, Homo Sapiens
aggaggcugaggcgagagaaucgcuugagccugggacauugaggcugcagugaacugugauggc

SEQ ID NO: 608668 - RNA, 64 nt, Homo Sapiens
acuguuccaggaaauugaucaacucuuccaaugggacauugaugaucacauucugcccuuuacu

SEQ ID NO: 608669 - RNA, 64 nt, Homo Sapiens
cucuuucagucaggaccuauuucagacuguugaugacauugacauuucauggauucggaugaug

SEQ ID NO: 608670 - RNA, 64 nt, Homo Sapiens
cagcacacacacaaguuggcccccagcugcgccugacauugagccaguggacucugugucugaa

SEQ ID NO: 608671 - RNA, 64 nt, Homo Sapiens
cccaaacaggguuuccguggccuguuugcagcuagacauugaccuccgccauugagcuccacgg

SEQ ID NO: 608672 - RNA, 64 nt, Homo Sapiens; identical to SEQ ID NO: 187826

SEQ ID NO: 608673 - RNA, 64 nt, Homo Sapiens; identical to SEQ ID NO: 187827

SEQ ID NO: 608674 - RNA, 64 nt, Homo Sapiens; identical to SEQ ID NO: 187967

SEQ ID NO: 608675 - RNA, 64 nt, Homo Sapiens; identical to SEQ ID NO: 187968

SEQ ID NO: 608676 - RNA, 64 nt, Homo Sapiens; identical to SEQ ID NO: 153638

SEQ ID NO: 608677 - RNA, 64 nt, Homo Sapiens; identical to SEQ ID NO: 153639

SEQ ID NO: 608678 - RNA, 64 nt, Homo Sapiens; identical to SEQ ID NO: 153640

SEQ ID NO: 608679 - RNA, 64 nt, Homo Sapiens; identical to SEQ ID NO: 153641

SEQ ID NO: 608680 - RNA, 64 nt, Homo Sapiens; identical to SEQ ID NO: 153642

SEQ ID NO: 608681 - RNA, 64 nt, Homo Sapiens; identical to SEQ ID NO: 153643

SEQ ID NO: 608682 - RNA, 64 nt, Homo Sapiens; identical to SEQ ID NO: 153644

SEQ ID NO: 608683 - RNA, 64 nt, Homo Sapiens; identical to SEQ ID NO: 153645

SEQ ID NO: 608684 - RNA, 64 nt, Homo Sapiens; identical to SEQ ID NO: 153646

SEQ ID NO: 608685 - RNA, 64 nt, Homo Sapiens; identical to SEQ ID NO: 153647

SEQ ID NO: 608686 - RNA, 64 nt, Homo Sapiens; identical to SEQ ID NO: 153648

SEQ ID NO: 608687 - RNA, 64 nt, Homo Sapiens; identical to SEQ ID NO: 153649

SEQ ID NO: 608688 - RNA, 64 nt, Homo Sapiens; identical to SEQ ID NO: 153650

SEQ ID NO: 608689 - RNA, 64 nt, Homo Sapiens; identical to SEQ ID NO: 153651

SEQ ID NO: 608690 - RNA, 64 nt, Homo Sapiens; identical to SEQ ID NO: 153652

SEQ ID NO: 608691 - RNA, 64 nt, Homo Sapiens; identical to SEQ ID NO: 153653

SEQ ID NO: 608692 - RNA, 64 nt, Homo Sapiens; identical to SEQ ID NO: 153654

SEQ ID NO: 608693 - RNA, 64 nt, Homo Sapiens; identical to SEQ ID NO: 153655

SEQ ID NO: 608694 - RNA, 64 nt, Homo Sapiens; identical to SEQ ID NO: 153656

SEQ ID NO: 608695 - RNA, 64 nt, Homo Sapiens; identical to SEQ ID NO: 153657

SEQ ID NO: 608696 - RNA, 64 nt, Homo Sapiens; identical to SEQ ID NO: 153658

SEQ ID NO: 608697 - RNA, 64 nt, Homo Sapiens; identical to SEQ ID NO: 153659

SEQ ID NO: 608698 - RNA, 64 nt, Homo Sapiens; identical to SEQ ID NO: 153660

SEQ ID NO: 608699 - RNA, 64 nt, Homo Sapiens; identical to SEQ ID NO: 153661

SEQ ID NO: 608700 - RNA, 64 nt, Homo Sapiens; identical to SEQ ID NO: 153662

SEQ ID NO: 608701 - RNA, 64 nt, Homo Sapiens; identical to SEQ ID NO: 153663

SEQ ID NO: 608702 - RNA, 64 nt, Homo Sapiens; identical to SEQ ID NO: 153664

SEQ ID NO: 608703 - RNA, 64 nt, Homo Sapiens; identical to SEQ ID NO: 153665

SEQ ID NO: 608704 - RNA, 64 nt, Homo Sapiens; identical to SEQ ID NO: 153666

SEQ ID NO: 608705 - RNA, 64 nt, Homo Sapiens; identical to SEQ ID NO: 153667

SEQ ID NO: 608706 - RNA, 64 nt, Homo Sapiens; identical to SEQ ID NO: 153668

SEQ ID NO: 608707 - RNA, 64 nt, Homo Sapiens; identical to SEQ ID NO: 153669

SEQ ID NO: 608708 - RNA, 64 nt, Homo Sapiens; identical to SEQ ID NO: 153670

SEQ ID NO: 608709 - RNA, 64 nt, Homo Sapiens; identical to SEQ ID NO: 153671

SEQ ID NO: 608710 - RNA, 64 nt, Homo Sapiens; identical to SEQ ID NO: 153672

SEQ ID NO: 608711 - RNA, 64 nt, Homo Sapiens; identical to SEQ ID NO: 153673

SEQ ID NO: 608712 - RNA, 64 nt, Homo Sapiens; identical to SEQ ID NO: 125643

SEQ ID NO: 608713 - RNA, 64 nt, Homo Sapiens; identical to SEQ ID NO: 125644

SEQ ID NO: 608714 - RNA, 64 nt, Homo Sapiens; identical to SEQ ID NO: 125645

SEQ ID NO: 608715 - RNA, 64 nt, Homo Sapiens; identical to SEQ ID NO: 125646

SEQ ID NO: 608716 - RNA, 64 nt, Homo Sapiens; identical to SEQ ID NO: 125647

SEQ ID NO: 608717 - RNA, 64 nt, Homo Sapiens; identical to SEQ ID NO: 125648

SEQ ID NO: 608718 - RNA, 64 nt, Homo Sapiens; identical to SEQ ID NO: 125649

SEQ ID NO: 608719 - RNA, 64 nt, Homo Sapiens; identical to SEQ ID NO: 125650

SEQ ID NO: 608720 - RNA, 64 nt, Homo Sapiens; identical to SEQ ID NO: 125651

SEQ ID NO: 608721 - RNA, 64 nt, Homo Sapiens; identical to SEQ ID NO: 125652

SEQ ID NO: 608722 - RNA, 64 nt, Homo Sapiens; identical to SEQ ID NO: 125653

SEQ ID NO: 608723 - RNA, 64 nt, Homo Sapiens; identical to SEQ ID NO: 125654

SEQ ID NO: 608724 - RNA, 64 nt, Homo Sapiens; identical to SEQ ID NO: 125655

SEQ ID NO: 608725 - RNA, 64 nt, Homo Sapiens; identical to SEQ ID NO: 125656

SEQ ID NO: 608726 - RNA, 64 nt, Homo Sapiens; identical to SEQ ID NO: 77858

SEQ ID NO: 608727 - RNA, 64 nt, Homo Sapiens; identical to SEQ ID NO: 77859

SEQ ID NO: 608728 - RNA, 64 nt, Homo Sapiens; identical to SEQ ID NO: 77860

SEQ ID NO: 608729 - RNA, 64 nt, Homo Sapiens; identical to SEQ ID NO: 77861

SEQ ID NO: 608730 - RNA, 64 nt, Homo Sapiens; identical to SEQ ID NO: 77862

SEQ ID NO: 608731 - RNA, 64 nt, Homo Sapiens; identical to SEQ ID NO: 77863

SEQ ID NO: 608732 - RNA, 64 nt, Homo Sapiens; identical to SEQ ID NO: 77864

SEQ ID NO: 608733 - RNA, 64 nt, Homo Sapiens; identical to SEQ ID NO: 77865

SEQ ID NO: 608734 - RNA, 64 nt, Homo Sapiens; identical to SEQ ID NO: 77866

SEQ ID NO: 608735 - RNA, 62 nt, Homo Sapiens; identical to SEQ ID NO: 77867

SEQ ID NO: 608736 - RNA, 64 nt, Homo Sapiens; identical to SEQ ID NO: 77868

SEQ ID NO: 608737 - RNA, 64 nt, Homo Sapiens; identical to SEQ ID NO: 77869

SEQ ID NO: 608738 - RNA, 64 nt, Homo Sapiens; identical to SEQ ID NO: 77870

SEQ ID NO: 608739 - RNA, 64 nt, Homo Sapiens; identical to SEQ ID NO: 77871

SEQ ID NO: 608740 - RNA, 64 nt, Homo Sapiens; identical to SEQ ID NO: 77872

SEQ ID NO: 608741 - RNA, 64 nt, Homo Sapiens; identical to SEQ ID NO: 77873

SEQ ID NO: 608742 - RNA, 64 nt, Homo Sapiens; identical to SEQ ID NO: 77874

SEQ ID NO: 608743 - RNA, 64 nt, Homo Sapiens; identical to SEQ ID NO: 77875

SEQ ID NO: 608744 - RNA, 64 nt, Homo Sapiens; identical to SEQ ID NO: 77876

SEQ ID NO: 608745 - RNA, 64 nt, Homo Sapiens
agagacuuccauagaauuaagaggguucucauggaggggauaggaaguagguuuaaagccuacc

SEQ ID NO: 608746 - RNA, 64 nt, Homo Sapiens
cucuauccaggacaucaggagugagggauggaaaaggggauaaaaggccuggagccacacucua

SEQ ID NO: 608747 - RNA, 64 nt, Homo Sapiens
cuggcugguuccuuagcccugggaaggaguugucaggggauauaagaaacugagcaagcucccu

SEQ ID NO: 608748 - RNA, 64 nt, Homo Sapiens
aauguuuaauuagaauugugguggugguaguggaaggggauaauuguaaauaggaaacaugaau

SEQ ID NO: 608749 - RNA, 64 nt, Homo Sapiens
gagcaagucagaauagagagguguuuuuccuuugaggggauaggggaaguaagccaauaagaac

SEQ ID NO: 608750 - RNA, 64 nt, Homo Sapiens
cagcuuugacaggugcugcuuagugagagaaggaaggggauaggccucucugggggaccagaag

SEQ ID NO: 608751 - RNA, 64 nt, Homo Sapiens
cuggaguugcccugccaucgggcuggaaugaugaaggggauacgggucaccugugcacagccau

SEQ ID NO: 608752 - RNA, 64 nt, Homo Sapiens
uguaagcuuguuaaaguaagaccaacccaauuacaggggauaaaggaauugaaaagaaagcaug

SEQ ID NO: 608753 - RNA, 64 nt, Homo Sapiens
agauugguuucccccgguggggagggagauggaaaggggauaucauuggcaagucaagcaggaa

SEQ ID NO: 608754 - RNA, 64 nt, Homo Sapiens
aagaugccagcacaaaaauuaguauccuaaggacaggggauaucuauugccacccugcacauca

SEQ ID NO: 608755 - RNA, 64 nt, Homo Sapiens
guaacccaguauaauuuucugcauuuaaaaauuuaggggauauuagaaguuauaccaauaaaaa

SEQ ID NO: 608756 - RNA, 64 nt, Homo Sapiens
uugguaauagcauaaugacagugggagggguacaaggggauaagaaaaaugucaugauuuuuuu

SEQ ID NO: 608757 - RNA, 64 nt, Homo Sapiens
uagcuagggucuuuccugauuuuuauggaauuuuaggggauauuuugagcuuuggguucucagu

SEQ ID NO: 608758 - RNA, 64 nt, Homo Sapiens
auuuguaaauauuuagggaaagccggguggggggaggggauacagauguagaagguggguaggg

SEQ ID NO: 608759 - RNA, 64 nt, Homo Sapiens
cuuuugucuuggucgcugcuucuagaaucuaugcaggggauagcagugaggucagaagucuuuc

SEQ ID NO: 608760 - RNA, 64 nt, Homo Sapiens
cauuugauuauacgggggaggaguucaucuuuaaaggggauauuacgcccaaaauaauuaguag

SEQ ID NO: 608761 - RNA, 64 nt, Homo Sapiens
ggcagccugcaucauccuccaggauagacaaggcaggggauacuccuuuucuccuaugcacacc

SEQ ID NO: 608762 - RNA, 64 nt, Homo Sapiens
agucugguggagguggaguggcugggaacagcagaggggauagauccugcugcaggaauugggg

SEQ ID NO: 608763 - RNA, 64 nt, Homo Sapiens
aguuuuccauuuuucuauuuuugaaacaggguguaggggauauuaaucuugguagugccugccu

SEQ ID NO: 608764 - RNA, 64 nt, Homo Sapiens
guggcagaaggaaccugagcgcacugacagugggaggggauaagcuuggcccuaagaauguuuu

SEQ ID NO: 608765 - RNA, 64 nt, Homo Sapiens
gugauggggcucagauggacgggaacugagggcaaggggauauaucccagccugggggccagug

SEQ ID NO: 608766 - RNA, 64 nt, Homo Sapiens
caucacaauaaucugaauucaggacugaccuguuaggggauaaaaaacaauuagcuuuuucuuu

SEQ ID NO: 608767 - RNA, 64 nt, Homo Sapiens
gguauuucaacuaguuaucauuaaagguguuacaaggggauaauaugccuuaaaaggcuguuuc

SEQ ID NO: 608768 - RNA, 64 nt, Homo Sapiens
ccauuuaacccuuuugauccaaggccccggaccaaggggauacuguaaucagguuauguacacc

SEQ ID NO: 608769 - RNA, 64 nt, Homo Sapiens
aguuuuauuuuuguucaucuccuuaucuauaaaaaggggauauucuuaggauaaauacaugaaa

SEQ ID NO: 608770 - RNA, 64 nt, Homo Sapiens
uaagucugcagaauucccuucuacuuugaagagaaggggauaggaauguauauuuggcuggggg

SEQ ID NO: 608771 - RNA, 64 nt, Homo Sapiens
guuuuccaauauuuuaauaaaguaguuauuuuauaggggauacuugaaaccaguauuuaagcuu

SEQ ID NO: 608772 - RNA, 64 nt, Homo Sapiens
cuagacugccacagcagcccaaaacacaaucuuaaggggauagaguauuauuuugugcauuuaa

SEQ ID NO: 608773 - RNA, 64 nt, Homo Sapiens
auaaaugugcuaaguuauuucuuaaaaauuguaaaggggauacuacacacuuuccaaaaugagc

SEQ ID NO: 608774 - RNA, 64 nt, Homo Sapiens
auuucuacuaaaaauacaaaaauuagcuggggcgaggggauaggccgaguuccggguguaaggg

SEQ ID NO: 608775 - RNA, 64 nt, Homo Sapiens
gugcgugcgcgcgcguguguaccugugugggugaaggggauagggcgaggcugugccugugccc

SEQ ID NO: 608776 - RNA, 64 nt, Homo Sapiens
ugugcaauaaauacacauguaaccucccaguucuaggggauauuauguacacuuguauuauaau

SEQ ID NO: 608777 - RNA, 64 nt, Homo Sapiens
ccucugggguggccacucccugccuaaaggcucaaggggauauucuguccugcccugcagcaug

SEQ ID NO: 608778 - RNA, 64 nt, Homo Sapiens
auaaaaagaggaugauuucaagggaaacuggcugaggggauaccgugggagugcagagaaagaa

SEQ ID NO: 608779 - RNA, 64 nt, Homo Sapiens
guggauaucuaaaaccagacacccccuuauccacaggggauacauacuaaaagauacagcaguu

SEQ ID NO: 608780 - RNA, 64 nt, Homo Sapiens
cagagcgagacuuugucccaaaacaaaauaggugaggggauagcgaaugcacucagggucagca

SEQ ID NO: 608781 - RNA, 64 nt, Homo Sapiens
gcugugugccaaaaacucccacccaaggucccucaggggauauuucacugaagaaccaguuaga

SEQ ID NO: 608782 - RNA, 50 nt, Homo Sapiens
uguuggcuggaaucuucugaaggggauaccacucaaaggcaaggccuggu

SEQ ID NO: 608783 - RNA, 64 nt, Homo Sapiens
acuggggguguaugggguagauggguggagagggaggggauaagagaggugcauguugguauuu

SEQ ID NO: 608784 - RNA, 64 nt, Homo Sapiens
acaagaagaacagguucacagaaggagauaccaaaggggauagaaaaaugggaaaaaugguaag

SEQ ID NO: 608785 - RNA, 64 nt, Homo Sapiens
agauuucuuacaugcauguaauuuguauagauuuaggggauacaauuuguauuuauaguuuuuu

SEQ ID NO: 608786 - RNA, 64 nt, Homo Sapiens
agggcuuuuaauuuauuucucgaacccuggcuggaggggauagguggggaguuggggaaaggaa

SEQ ID NO: 608787 - RNA, 64 nt, Homo Sapiens
uuuugagaugauuuaaauguugaaugauacaugcaggggauauuuuauggaaacucugagaagc

SEQ ID NO: 608788 - RNA, 64 nt, Homo Sapiens
gggaugugcagcaucuguguuccagccuccuuguaggggauaagagccugcauuguggaagauc

SEQ ID NO: 608789 - RNA, 64 nt, Homo Sapiens
ugccauuugguggugagaauggaacacaggguaaaggggauaggaguuauggcaaaaagcaaaa

SEQ ID NO: 608790 - RNA, 64 nt, Homo Sapiens
ggaaagauaauggucauuauaucgacuuucuuucaggggauauugcauuauaaaccuggaaugu

SEQ ID NO: 608791 - RNA, 55 nt, Homo Sapiens
cucucuaggacaagcacugauccugaggggauacuguggagcagcccaguccaca

SEQ ID NO: 608792 - RNA, 64 nt, Homo Sapiens
ccuccccucaucugcucuaguggugaccuggccaaggggauacagacccugcaguccgcucagg

SEQ ID NO: 608793 - RNA, 64 nt, Homo Sapiens
gacaaguaaguaacacgcauacuuaacuuuguaaaggggauaugucuuccuucuuccuucugug

SEQ ID NO: 608794 - RNA, 64 nt, Homo Sapiens
ggccccuggguuucuuuuuuugcuguguuuaaucaggggauacacaugucugccuggagugcug

SEQ ID NO: 608795 - RNA, 64 nt, Homo Sapiens
uuuguuuuggcucaguuguuaaagucaaguccuuaggggauaauucacauuuauguggaagucc

SEQ ID NO: 608796 - RNA, 64 nt, Homo Sapiens
uuucaaccucuugcuuuauaauuugcauucgguuaggggauauugcaauuuugagggauaccua

SEQ ID NO: 608797 - RNA, 64 nt, Homo Sapiens
aucauggugucugucacugguuagggguaagaugaggggauaaggaaagagacuuuucaauaag

SEQ ID NO: 608798 - RNA, 64 nt, Homo Sapiens
uucaaccauaaaaacaaagggcucugauugcuuuaggggauaagugauuuaauauccacaaacg

SEQ ID NO: 608799 - RNA, 64 nt, Homo Sapiens
ccauccacccuggcucuuguauaacaauuacuucaggggauacgcuugaaaauaacacuagggc

SEQ ID NO: 608800 - RNA, 64 nt, Homo Sapiens
uaggcaacacucagagcagaucucccuuacugucaggggauauggaacuucaaaggcccacaug

SEQ ID NO: 608801 - RNA, 64 nt, Homo Sapiens
auccauggagauggaacauagauuagugguugccaggggauagaggaguaauuguuagugggca

SEQ ID NO: 608802 - RNA, 64 nt, Homo Sapiens
ugccaugcaaagguggacaccauucuccagcuucaggggauaugcucgucccgggcaccggugg

SEQ ID NO: 608803 - RNA, 64 nt, Homo Sapiens
accaguaugaaagucauucauuuagugcuaccaaaggggauacacaagcccuuuaggaagcagu

SEQ ID NO: 608804 - RNA, 64 nt, Homo Sapiens
acaaacucaccuuauguuacuccaaaguaauaguaggggauaaacccauagacuacaacaauua

SEQ ID NO: 608805 - RNA, 64 nt, Homo Sapiens
caauaacaacuuagugcuuagcccaugauguaucaggggauaugaugugaugauuuucaaggug

SEQ ID NO: 608806 - RNA, 64 nt, Homo Sapiens
acuaucacuuaguaccuguuugaccaagguguuaaggggauaguaccucccaauucaagcagag

SEQ ID NO: 608807 - RNA, 64 nt, Homo Sapiens
aaaaagaaucccaauguuugacaaaacacagccaaggggauauuuacugcucuuuauugcagaa

SEQ ID NO: 608808 - RNA, 64 nt, Homo Sapiens
cccauagacuacaacaacuauccaaaguaacaguaggggauaaaacaaacucgccuuauguuac

SEQ ID NO: 608809 - RNA, 64 nt, Homo Sapiens
accccucagcccaccucacuauggugcuggguagaggggauaccuggguucuaaccucuaaaua

SEQ ID NO: 608810 - RNA, 64 nt, Homo Sapiens
ggaggagggagguggguguuggagccccugagacaggggauacagaaacuagggcuaaaggacu

SEQ ID NO: 608811 - RNA, 64 nt, Homo Sapiens
cuacagcuaaugagggaaacuguggugggaggagaggggauaguguaacucaucauagaaacau

SEQ ID NO: 608812 - RNA, 64 nt, Homo Sapiens
uucccacucagcacugcuuccugagccuacggaaaggggauaccuccugggggccuggagagga

SEQ ID NO: 608813 - RNA, 64 nt, Homo Sapiens
gaaaaauacggcagguggccauuucuaaauuugcaggggauacuaugcuuuacacucauuuuca

SEQ ID NO: 608814 - RNA, 64 nt, Homo Sapiens
guuaugaaaaaauagacgucaacaaaaauguguaaggggauauuagguuugcuaaauucuuuca

SEQ ID NO: 608815 - RNA, 64 nt, Homo Sapiens
gggacuugcccaagucccacggaaacugaggcucaggggauaaauaucuaugugugacaaauga

SEQ ID NO: 608816 - RNA, 64 nt, Homo Sapiens
ggagaggaaaaguaaggugcgauauugccgcacuaggggauauacuuuuccucccuuggguucu

SEQ ID NO: 608817 - RNA, 64 nt, Homo Sapiens
uaggccucuugaauuuuugacugcagugcuuaugaggggauauuaaauggccauacuucaggaa

SEQ ID NO: 608818 - RNA, 64 nt, Homo Sapiens
cccaacucacugccugcuggggucaugcagcaccaggggauaugagcccugagcugggggaagg

SEQ ID NO: 608819 - RNA, 64 nt, Homo Sapiens
gaggaggaggcuucagccaucaccugaaagaccaaggggauaggauccuggaggggcuuuggac

SEQ ID NO: 608820 - RNA, 64 nt, Homo Sapiens
cugggaaagacaccaaaucauuguguugucgcaaaggggauaauaccuuuguaaauauuuuugc

SEQ ID NO: 608821 - RNA, 64 nt, Homo Sapiens
gauuaacuuauuuagagaugcuguaacuuaaaauaggggauauuuaagguagcuucagcuagcu

SEQ ID NO: 608822 - RNA, 64 nt, Homo Sapiens
ccguuuguucacucguacaugccuagccuacagaaggggauauauauuaugaaauggucauuuu

SEQ ID NO: 608823 - RNA, 64 nt, Homo Sapiens
uguuggguagcaagaacuuugagucauuuauuacaggggauaaauacuuguucuuauuauucaa

SEQ ID NO: 608824 - RNA, 64 nt, Homo Sapiens
cggcaaaugcccugcaacgguggcuccugacaccaggggauagggagaugugccagaguccuuc

SEQ ID NO: 608825 - RNA, 64 nt, Homo Sapiens
aaggagaaaauuucagaacuaaguugaguaauauaggggauauauauuugugaaaaauaauuuu

SEQ ID NO: 608826 - RNA, 64 nt, Homo Sapiens
uucacaacaggcauuccagaauuaugaggcauugaggggauagaugaauacuaaaugguugucu

SEQ ID NO: 608827 - RNA, 64 nt, Homo Sapiens
cgacuguauaaccauauggauuacugauaaaugaaggggauauugaagggacagggaaagauaa

SEQ ID NO: 608828 - RNA, 64 nt, Homo Sapiens
auauauuuaggggaaagacuaauggagcaggaggaggggauaucugcucaucaagugccaauuc

SEQ ID NO: 608829 - RNA, 64 nt, Homo Sapiens
aagugguagaugggacagguaaguggcagaggugaggggauaaguuagaauguaaaagggcagu

SEQ ID NO: 608830 - RNA, 64 nt, Homo Sapiens
ucucuaaaaaauaaaauauaagaaaauaaaacuuaggggauauacagauuuaaauauucaaauc

SEQ ID NO: 608831 - RNA, 64 nt, Homo Sapiens
gcggcuucgcccgggcuccuagcggggaaaaggaaggggauaacucagaggaacagacacucaa

SEQ ID NO: 608832 - RNA, 64 nt, Homo Sapiens
ggaaaaagcugagcucauagacuuuugagucuugaggggauagccagccugagggcuggugggg

SEQ ID NO: 608833 - RNA, 64 nt, Homo Sapiens
uaggggcuccccuuacaaucgcacagaccaggggaggggauauuauggggcagaggagcuccag

SEQ ID NO: 608834 - RNA, 64 nt, Homo Sapiens
cucagcaccuggccccaggacugagguccugagaaggggauagcacugcccaggacgugugucc

SEQ ID NO: 608835 - RNA, 64 nt, Homo Sapiens
gauauuaagacuuaauucacuaaaauuuauucuaaggggauauuuauacuuuuauacuuuuuua

SEQ ID NO: 608836 - RNA, 64 nt, Homo Sapiens
guggcuggguuggagggugucccaaaaagaaaggaggggauagagagagaccacuuuucauaac

SEQ ID NO: 608837 - RNA, 64 nt, Homo Sapiens
ugugcauagaaaaauaauuaucuguaaaaaaugaaggggauaauauaugauaaauuauguucug

SEQ ID NO: 608838 - RNA, 64 nt, Homo Sapiens
acaaccugagauggagaggccaggagagaguauaaggggauagcagcaaaccaccuaucuggcc

SEQ ID NO: 608839 - RNA, 64 nt, Homo Sapiens
gaggcagagagagccagcccccugucccucuuguaggggauaggaucccaauguucuaccucuc

SEQ ID NO: 608840 - RNA, 64 nt, Homo Sapiens
ucuguaaguguucgggggacaguugaggaagaacaggggauaguuccgccacuuucaugacuag

SEQ ID NO: 608841 - RNA, 64 nt, Homo Sapiens
accgacucugccuacauucuuuucuaugagcagcaggggauagacuacgcacaauuucugccaa

SEQ ID NO: 608842 - RNA, 64 nt, Homo Sapiens
uaauccccacuucccugcagaaucaaucugagggaggggauaaagaggaagcaauaaaaaaaaa

SEQ ID NO: 608843 - RNA, 64 nt, Homo Sapiens
acuacacuuugcugguuccuguccccucugagaaaggggauagaaagcuccuuccucuaugucc

SEQ ID NO: 608844 - RNA, 64 nt, Homo Sapiens
uucuagaggggcccacucccagcugggagaguguaggggauaugcucacaccacauuagcagca

SEQ ID NO: 608845 - RNA, 64 nt, Homo Sapiens
uucucuucuauccugcaauuucucccgaauccugaggggauaucccuaugucccagccccuggu

SEQ ID NO: 608846 - RNA, 64 nt, Homo Sapiens
ucuugauuuaggguggcugguggcaaggaggggcaggggauauggggacgugacugggacaggu

SEQ ID NO: 608847 - RNA, 64 nt, Homo Sapiens
agggccaguguagagauuaaggaucaggacuggcaggggauaugccaagcugcuuaaaguagaa

SEQ ID NO: 608848 - RNA, 64 nt, Homo Sapiens
auugcaucuuccauaguggcgccaugugggcuuuaggggauaaguuuuagguccuccaagccag

SEQ ID NO: 608849 - RNA, 64 nt, Homo Sapiens
uaagcccucaucacuucaaaagcucugauacuccaggggauacuaccguggaucaccugcaaca

SEQ ID NO: 608850 - RNA, 64 nt, Homo Sapiens
uguuucaaggcaaccuuuucccaguggaggggaaaggggauaagguauaguuugcacacccauc

SEQ ID NO: 608851 - RNA, 64 nt, Homo Sapiens
ccugguuuccuuuguacuaaacuucuccucaaagaggggauaggugcuugcuuuuauaucccag

SEQ ID NO: 608852 - RNA, 64 nt, Homo Sapiens
ccgcuacacuaaggaggucuguaugcccuggaagaggggauaguguugggaagaauaaaugucu

SEQ ID NO: 608853 - RNA, 64 nt, Homo Sapiens
agcccaugacuucagacagaggcuuuggugggagaggggauagauaacccuuuagcccuaggau

SEQ ID NO: 608854 - RNA, 64 nt, Homo Sapiens
aaaagaagagguaauuuuacaugggaaaggaagaaggggauagggccuugccagagggcucagg

SEQ ID NO: 608855 - RNA, 64 nt, Homo Sapiens
gagaagcuccccgucucugccuguccugccuguaaggggauacaugcuucugcaccccagcccc

SEQ ID NO: 608856 - RNA, 64 nt, Homo Sapiens
acugacauuguuuuguuacugcuccuacccaccaaggggauaaagaaggcgaguucugaguguu

SEQ ID NO: 608857 - RNA, 64 nt, Homo Sapiens
aaaaaaaaaaaaagacaaaauugucuuuuaagaaaggggauauuucuuuuuccaguauacuagc

SEQ ID NO: 608858 - RNA, 64 nt, Homo Sapiens
agccgggcgaaguggcccaucagagaccaagagcaggggauagaagaaauccagaguggggaga

SEQ ID NO: 608859 - RNA, 64 nt, Homo Sapiens
aguuagggacugauugugcagguauuucaaacagaggggauauaaggaaauagaaaccacacua

SEQ ID NO: 608860 - RNA, 64 nt, Homo Sapiens
uuucauaucuggcucaacaucaaaaauuggguggaggggauaacguucagaacacuuuuuauga

SEQ ID NO: 608861 - RNA, 64 nt, Homo Sapiens
uugaggcagauggugcccaggagugacacuggccaggggauaggagauaaauuuucugcccugu

SEQ ID NO: 608862 - RNA, 64 nt, Homo Sapiens
ugaauuaauuuuagacauauuuuggauccuauugaggggauaagaggaugucaaaaaaguuaaa

SEQ ID NO: 608863 - RNA, 64 nt, Homo Sapiens
cuacauuuguaucaaaguauguccugauccccuuaggggauagcucauuguuuuuauucagauu

SEQ ID NO: 608864 - RNA, 64 nt, Homo Sapiens
gggcuuaauugaaacaacauuauuuuaaaaucaaaggggauauauguuuguggaauggauuuuc

SEQ ID NO: 608865 - RNA, 64 nt, Homo Sapiens
gguggccaagccucaguuucccccaaaugagcaaaggggauaaagaggggcccgacuuuugcca

SEQ ID NO: 608866 - RNA, 64 nt, Homo Sapiens
aaacaaucuguagauugguuucagcuuacucuucaggggauauguuugcuaucaccaguaccuc

SEQ ID NO: 608867 - RNA, 64 nt, Homo Sapiens
guugaccuuuuacuuuuuaaagauuucauggaugaggggauaugguuuuuuguuuuucguuacu

SEQ ID NO: 608868 - RNA, 64 nt, Homo Sapiens
ucgauugggcauccagaguggagaggcagggugaaggggauagcaggacaaagggcaguuuagg

SEQ ID NO: 608869 - RNA, 64 nt, Homo Sapiens
ccugggcgcgcugggagugugguuguguuucugaaggggauaaaagagggcacgguggugccaa

SEQ ID NO: 608870 - RNA, 64 nt, Homo Sapiens; identical to SEQ ID NO: 246823

SEQ ID NO: 608871 - RNA, 64 nt, Homo Sapiens; identical to SEQ ID NO: 246824

SEQ ID NO: 608872 - RNA, 64 nt, Homo Sapiens; identical to SEQ ID NO: 246825

SEQ ID NO: 608873 - RNA, 64 nt, Homo Sapiens; identical to SEQ ID NO: 246826

SEQ ID NO: 608874 - RNA, 64 nt, Homo Sapiens; identical to SEQ ID NO: 246827

SEQ ID NO: 608875 - RNA, 64 nt, Homo Sapiens; identical to SEQ ID NO: 246828

SEQ ID NO: 608876 - RNA, 64 nt, Homo Sapiens; identical to SEQ ID NO: 246829

SEQ ID NO: 608877 - RNA, 50 nt, Homo Sapiens; identical to SEQ ID NO: 246830

SEQ ID NO: 608878 - RNA, 64 nt, Homo Sapiens; identical to SEQ ID NO: 246831

SEQ ID NO: 608879 - RNA, 64 nt, Homo Sapiens; identical to SEQ ID NO: 246832

SEQ ID NO: 608880 - RNA, 64 nt, Homo Sapiens; identical to SEQ ID NO: 246833

SEQ ID NO: 608881 - RNA, 64 nt, Homo Sapiens; identical to SEQ ID NO: 246834

SEQ ID NO: 608882 - RNA, 64 nt, Homo Sapiens; identical to SEQ ID NO: 246835

SEQ ID NO: 608883 - RNA, 64 nt, Homo Sapiens; identical to SEQ ID NO: 246836

SEQ ID NO: 608884 - RNA, 64 nt, Homo Sapiens; identical to SEQ ID NO: 246837

SEQ ID NO: 608885 - RNA, 64 nt, Homo Sapiens; identical to SEQ ID NO: 246838

SEQ ID NO: 608886 - RNA, 64 nt, Homo Sapiens; identical to SEQ ID NO: 246839

SEQ ID NO: 608887 - RNA, 64 nt, Homo Sapiens; identical to SEQ ID NO: 246840

SEQ ID NO: 608888 - RNA, 64 nt, Homo Sapiens; identical to SEQ ID NO: 246841

SEQ ID NO: 608889 - RNA, 64 nt, Homo Sapiens; identical to SEQ ID NO: 246842

SEQ ID NO: 608890 - RNA, 64 nt, Homo Sapiens; identical to SEQ ID NO: 246843

SEQ ID NO: 608891 - RNA, 64 nt, Homo Sapiens; identical to SEQ ID NO: 246844

SEQ ID NO: 608892 - RNA, 64 nt, Homo Sapiens; identical to SEQ ID NO: 246845

SEQ ID NO: 608893 - RNA, 64 nt, Homo Sapiens; identical to SEQ ID NO: 246846

SEQ ID NO: 608894 - RNA, 64 nt, Homo Sapiens; identical to SEQ ID NO: 246847

SEQ ID NO: 608895 - RNA, 64 nt, Homo Sapiens; identical to SEQ ID NO: 246848

SEQ ID NO: 608896 - RNA, 64 nt, Homo Sapiens; identical to SEQ ID NO: 246849

SEQ ID NO: 608897 - RNA, 64 nt, Homo Sapiens; identical to SEQ ID NO: 246850

SEQ ID NO: 608898 - RNA, 64 nt, Homo Sapiens; identical to SEQ ID NO: 246851

SEQ ID NO: 608899 - RNA, 64 nt, Homo Sapiens; identical to SEQ ID NO: 246852

SEQ ID NO: 608900 - RNA, 64 nt, Homo Sapiens; identical to SEQ ID NO: 246853

SEQ ID NO: 608901 - RNA, 64 nt, Homo Sapiens; identical to SEQ ID NO: 246854

SEQ ID NO: 608902 - RNA, 64 nt, Homo Sapiens; identical to SEQ ID NO: 246855

SEQ ID NO: 608903 - RNA, 64 nt, Homo Sapiens; identical to SEQ ID NO: 246856

SEQ ID NO: 608904 - RNA, 64 nt, Homo Sapiens; identical to SEQ ID NO: 246857

SEQ ID NO: 608905 - RNA, 64 nt, Homo Sapiens; identical to SEQ ID NO: 246858

SEQ ID NO: 608906 - RNA, 64 nt, Homo Sapiens; identical to SEQ ID NO: 246859

SEQ ID NO: 608907 - RNA, 64 nt, Homo Sapiens; identical to SEQ ID NO: 246860

SEQ ID NO: 608908 - RNA, 64 nt, Homo Sapiens; identical to SEQ ID NO: 246861

SEQ ID NO: 608909 - RNA, 64 nt, Homo Sapiens; identical to SEQ ID NO: 246862

SEQ ID NO: 608910 - RNA, 64 nt, Homo Sapiens; identical to SEQ ID NO: 246863

SEQ ID NO: 608911 - RNA, 64 nt, Homo Sapiens; identical to SEQ ID NO: 246864

SEQ ID NO: 608912 - RNA, 64 nt, Homo Sapiens; identical to SEQ ID NO: 246865

SEQ ID NO: 608913 - RNA, 64 nt, Homo Sapiens; identical to SEQ ID NO: 246866

SEQ ID NO: 608914 - RNA, 64 nt, Homo Sapiens; identical to SEQ ID NO: 246867

SEQ ID NO: 608915 - RNA, 64 nt, Homo Sapiens; identical to SEQ ID NO: 246868

SEQ ID NO: 608916 - RNA, 64 nt, Homo Sapiens; identical to SEQ ID NO: 246869

SEQ ID NO: 608917 - RNA, 64 nt, Homo Sapiens; identical to SEQ ID NO: 246870

SEQ ID NO: 608918 - RNA, 64 nt, Homo Sapiens; identical to SEQ ID NO: 246871

SEQ ID NO: 608919 - RNA, 64 nt, Homo Sapiens; identical to SEQ ID NO: 246872

SEQ ID NO: 608920 - RNA, 64 nt, Homo Sapiens; identical to SEQ ID NO: 246873

SEQ ID NO: 608921 - RNA, 64 nt, Homo Sapiens; identical to SEQ ID NO: 246874

SEQ ID NO: 608922 - RNA, 64 nt, Homo Sapiens; identical to SEQ ID NO: 246875

SEQ ID NO: 608923 - RNA, 64 nt, Homo Sapiens; identical to SEQ ID NO: 246876

SEQ ID NO: 608924 - RNA, 52 nt, Homo Sapiens; identical to SEQ ID NO: 246877

SEQ ID NO: 608925 - RNA, 64 nt, Homo Sapiens; identical to SEQ ID NO: 246878

SEQ ID NO: 608926 - RNA, 64 nt, Homo Sapiens; identical to SEQ ID NO: 246879

SEQ ID NO: 608927 - RNA, 64 nt, Homo Sapiens; identical to SEQ ID NO: 246880

SEQ ID NO: 608928 - RNA, 64 nt, Homo Sapiens; identical to SEQ ID NO: 246881

SEQ ID NO: 608929 - RNA, 64 nt, Homo Sapiens; identical to SEQ ID NO: 246882

SEQ ID NO: 608930 - RNA, 64 nt, Homo Sapiens; identical to SEQ ID NO: 246883

SEQ ID NO: 608931 - RNA, 64 nt, Homo Sapiens; identical to SEQ ID NO: 246884

SEQ ID NO: 608932 - RNA, 64 nt, Homo Sapiens; identical to SEQ ID NO: 246885

SEQ ID NO: 608933 - RNA, 64 nt, Homo Sapiens; identical to SEQ ID NO: 246886

SEQ ID NO: 608934 - RNA, 64 nt, Homo Sapiens; identical to SEQ ID NO: 246887

SEQ ID NO: 608935 - RNA, 64 nt, Homo Sapiens; identical to SEQ ID NO: 246888

SEQ ID NO: 608936 - RNA, 64 nt, Homo Sapiens; identical to SEQ ID NO: 246889

SEQ ID NO: 608937 - RNA, 64 nt, Homo Sapiens; identical to SEQ ID NO: 246890

SEQ ID NO: 608938 - RNA, 64 nt, Homo Sapiens; identical to SEQ ID NO: 246891

SEQ ID NO: 608939 - RNA, 64 nt, Homo Sapiens; identical to SEQ ID NO: 246892

SEQ ID NO: 608940 - RNA, 64 nt, Homo Sapiens; identical to SEQ ID NO: 246893

SEQ ID NO: 608941 - RNA, 64 nt, Homo Sapiens; identical to SEQ ID NO: 246894

SEQ ID NO: 608942 - RNA, 64 nt, Homo Sapiens; identical to SEQ ID NO: 246895

SEQ ID NO: 608943 - RNA, 64 nt, Homo Sapiens; identical to SEQ ID NO: 246896

SEQ ID NO: 608944 - RNA, 64 nt, Homo Sapiens; identical to SEQ ID NO: 246897

SEQ ID NO: 608945 - RNA, 57 nt, Homo Sapiens; identical to SEQ ID NO: 246898

SEQ ID NO: 608946 - RNA, 64 nt, Homo Sapiens; identical to SEQ ID NO: 246899

SEQ ID NO: 608947 - RNA, 54 nt, Homo Sapiens; identical to SEQ ID NO: 246900

SEQ ID NO: 608948 - RNA, 64 nt, Homo Sapiens; identical to SEQ ID NO: 246901

SEQ ID NO: 608949 - RNA, 64 nt, Homo Sapiens; identical to SEQ ID NO: 246823

SEQ ID NO: 608950 - RNA, 64 nt, Homo Sapiens; identical to SEQ ID NO: 246824

SEQ ID NO: 608951 - RNA, 64 nt, Homo Sapiens; identical to SEQ ID NO: 246825

SEQ ID NO: 608952 - RNA, 64 nt, Homo Sapiens; identical to SEQ ID NO: 246826

SEQ ID NO: 608953 - RNA, 64 nt, Homo Sapiens; identical to SEQ ID NO: 246827

SEQ ID NO: 608954 - RNA, 64 nt, Homo Sapiens; identical to SEQ ID NO: 246828

SEQ ID NO: 608955 - RNA, 64 nt, Homo Sapiens; identical to SEQ ID NO: 246829

SEQ ID NO: 608956 - RNA, 50 nt, Homo Sapiens; identical to SEQ ID NO: 246830

SEQ ID NO: 608957 - RNA, 64 nt, Homo Sapiens; identical to SEQ ID NO: 246831

SEQ ID NO: 608958 - RNA, 64 nt, Homo Sapiens; identical to SEQ ID NO: 246832

SEQ ID NO: 608959 - RNA, 64 nt, Homo Sapiens; identical to SEQ ID NO: 246833

SEQ ID NO: 608960 - RNA, 64 nt, Homo Sapiens; identical to SEQ ID NO: 246834

SEQ ID NO: 608961 - RNA, 64 nt, Homo Sapiens; identical to SEQ ID NO: 246835

SEQ ID NO: 608962 - RNA, 64 nt, Homo Sapiens; identical to SEQ ID NO: 246836

SEQ ID NO: 608963 - RNA, 64 nt, Homo Sapiens; identical to SEQ ID NO: 246837

SEQ ID NO: 608964 - RNA, 64 nt, Homo Sapiens; identical to SEQ ID NO: 246838

SEQ ID NO: 608965 - RNA, 64 nt, Homo Sapiens; identical to SEQ ID NO: 246839

SEQ ID NO: 608966 - RNA, 64 nt, Homo Sapiens; identical to SEQ ID NO: 246840

SEQ ID NO: 608967 - RNA, 64 nt, Homo Sapiens; identical to SEQ ID NO: 246841

SEQ ID NO: 608968 - RNA, 64 nt, Homo Sapiens; identical to SEQ ID NO: 246842

SEQ ID NO: 608969 - RNA, 64 nt, Homo Sapiens; identical to SEQ ID NO: 246843

SEQ ID NO: 608970 - RNA, 64 nt, Homo Sapiens; identical to SEQ ID NO: 246844

SEQ ID NO: 608971 - RNA, 64 nt, Homo Sapiens; identical to SEQ ID NO: 246845

SEQ ID NO: 608972 - RNA, 64 nt, Homo Sapiens; identical to SEQ ID NO: 246846

SEQ ID NO: 608973 - RNA, 64 nt, Homo Sapiens; identical to SEQ ID NO: 246847

SEQ ID NO: 608974 - RNA, 64 nt, Homo Sapiens; identical to SEQ ID NO: 246848

SEQ ID NO: 608975 - RNA, 64 nt, Homo Sapiens; identical to SEQ ID NO: 246849

SEQ ID NO: 608976 - RNA, 64 nt, Homo Sapiens; identical to SEQ ID NO: 246850

SEQ ID NO: 608977 - RNA, 64 nt, Homo Sapiens; identical to SEQ ID NO: 246851

SEQ ID NO: 608978 - RNA, 64 nt, Homo Sapiens; identical to SEQ ID NO: 246852

SEQ ID NO: 608979 - RNA, 64 nt, Homo Sapiens; identical to SEQ ID NO: 246853

SEQ ID NO: 608980 - RNA, 64 nt, Homo Sapiens; identical to SEQ ID NO: 246854

SEQ ID NO: 608981 - RNA, 64 nt, Homo Sapiens; identical to SEQ ID NO: 246855

SEQ ID NO: 608982 - RNA, 64 nt, Homo Sapiens; identical to SEQ ID NO: 246856

SEQ ID NO: 608983 - RNA, 64 nt, Homo Sapiens; identical to SEQ ID NO: 246857

SEQ ID NO: 608984 - RNA, 64 nt, Homo Sapiens; identical to SEQ ID NO: 246858

SEQ ID NO: 608985 - RNA, 64 nt, Homo Sapiens; identical to SEQ ID NO: 246859

SEQ ID NO: 608986 - RNA, 64 nt, Homo Sapiens; identical to SEQ ID NO: 246860

SEQ ID NO: 608987 - RNA, 64 nt, Homo Sapiens; identical to SEQ ID NO: 246861

SEQ ID NO: 608988 - RNA, 64 nt, Homo Sapiens; identical to SEQ ID NO: 246862

SEQ ID NO: 608989 - RNA, 64 nt, Homo Sapiens; identical to SEQ ID NO: 246863

SEQ ID NO: 608990 - RNA, 64 nt, Homo Sapiens; identical to SEQ ID NO: 246864

SEQ ID NO: 608991 - RNA, 64 nt, Homo Sapiens; identical to SEQ ID NO: 246865

SEQ ID NO: 608992 - RNA, 64 nt, Homo Sapiens; identical to SEQ ID NO: 246866

SEQ ID NO: 608993 - RNA, 64 nt, Homo Sapiens; identical to SEQ ID NO: 246867

SEQ ID NO: 608994 - RNA, 64 nt, Homo Sapiens; identical to SEQ ID NO: 246868

SEQ ID NO: 608995 - RNA, 64 nt, Homo Sapiens; identical to SEQ ID NO: 246869

SEQ ID NO: 608996 - RNA, 64 nt, Homo Sapiens; identical to SEQ ID NO: 246870

SEQ ID NO: 608997 - RNA, 64 nt, Homo Sapiens; identical to SEQ ID NO: 246871

SEQ ID NO: 608998 - RNA, 64 nt, Homo Sapiens; identical to SEQ ID NO: 246872

SEQ ID NO: 608999 - RNA, 64 nt, Homo Sapiens; identical to SEQ ID NO: 246873

SEQ ID NO: 609000 - RNA, 64 nt, Homo Sapiens; identical to SEQ ID NO: 246874

SEQ ID NO: 609001 - RNA, 64 nt, Homo Sapiens; identical to SEQ ID NO: 246875

SEQ ID NO: 609002 - RNA, 64 nt, Homo Sapiens; identical to SEQ ID NO: 246876

SEQ ID NO: 609003 - RNA, 52 nt, Homo Sapiens; identical to SEQ ID NO: 246877

SEQ ID NO: 609004 - RNA, 64 nt, Homo Sapiens; identical to SEQ ID NO: 246878

SEQ ID NO: 609005 - RNA, 64 nt, Homo Sapiens; identical to SEQ ID NO: 246879

SEQ ID NO: 609006 - RNA, 64 nt, Homo Sapiens; identical to SEQ ID NO: 246880

SEQ ID NO: 609007 - RNA, 64 nt, Homo Sapiens; identical to SEQ ID NO: 246881

SEQ ID NO: 609008 - RNA, 64 nt, Homo Sapiens; identical to SEQ ID NO: 246882

SEQ ID NO: 609009 - RNA, 64 nt, Homo Sapiens; identical to SEQ ID NO: 246883

SEQ ID NO: 609010 - RNA, 64 nt, Homo Sapiens; identical to SEQ ID NO: 246884

SEQ ID NO: 609011 - RNA, 64 nt, Homo Sapiens; identical to SEQ ID NO: 246885

SEQ ID NO: 609012 - RNA, 64 nt, Homo Sapiens; identical to SEQ ID NO: 246886

SEQ ID NO: 609013 - RNA, 64 nt, Homo Sapiens; identical to SEQ ID NO: 246887

SEQ ID NO: 609014 - RNA, 64 nt, Homo Sapiens; identical to SEQ ID NO: 246888

SEQ ID NO: 609015 - RNA, 64 nt, Homo Sapiens; identical to SEQ ID NO: 246889

SEQ ID NO: 609016 - RNA, 64 nt, Homo Sapiens; identical to SEQ ID NO: 246890

SEQ ID NO: 609017 - RNA, 64 nt, Homo Sapiens; identical to SEQ ID NO: 246891

SEQ ID NO: 609018 - RNA, 64 nt, Homo Sapiens; identical to SEQ ID NO: 246892

SEQ ID NO: 609019 - RNA, 64 nt, Homo Sapiens; identical to SEQ ID NO: 246893

SEQ ID NO: 609020 - RNA, 64 nt, Homo Sapiens; identical to SEQ ID NO: 246894

SEQ ID NO: 609021 - RNA, 64 nt, Homo Sapiens; identical to SEQ ID NO: 246895

SEQ ID NO: 609022 - RNA, 64 nt, Homo Sapiens; identical to SEQ ID NO: 246896

SEQ ID NO: 609023 - RNA, 64 nt, Homo Sapiens; identical to SEQ ID NO: 246897

SEQ ID NO: 609024 - RNA, 57 nt, Homo Sapiens; identical to SEQ ID NO: 246898

SEQ ID NO: 609025 - RNA, 64 nt, Homo Sapiens; identical to SEQ ID NO: 246899

SEQ ID NO: 609026 - RNA, 54 nt, Homo Sapiens; identical to SEQ ID NO: 246900

SEQ ID NO: 609027 - RNA, 64 nt, Homo Sapiens; identical to SEQ ID NO: 246901

SEQ ID NO: 609028 - RNA, 64 nt, Homo Sapiens; identical to SEQ ID NO: 76580

SEQ ID NO: 609029 - RNA, 64 nt, Homo Sapiens; identical to SEQ ID NO: 76581

SEQ ID NO: 609030 - RNA, 64 nt, Homo Sapiens; identical to SEQ ID NO: 76582

SEQ ID NO: 609031 - RNA, 64 nt, Homo Sapiens; identical to SEQ ID NO: 76583

SEQ ID NO: 609032 - RNA, 64 nt, Homo Sapiens; identical to SEQ ID NO: 76584

SEQ ID NO: 609033 - RNA, 64 nt, Homo Sapiens; identical to SEQ ID NO: 76585

SEQ ID NO: 609034 - RNA, 64 nt, Homo Sapiens; identical to SEQ ID NO: 76586

SEQ ID NO: 609035 - RNA, 64 nt, Homo Sapiens; identical to SEQ ID NO: 76587

SEQ ID NO: 609036 - RNA, 64 nt, Homo Sapiens; identical to SEQ ID NO: 76588

SEQ ID NO: 609037 - RNA, 64 nt, Homo Sapiens; identical to SEQ ID NO: 76589

SEQ ID NO: 609038 - RNA, 64 nt, Homo Sapiens; identical to SEQ ID NO: 76590

SEQ ID NO: 609039 - RNA, 64 nt, Homo Sapiens; identical to SEQ ID NO: 76591

SEQ ID NO: 609040 - RNA, 64 nt, Homo Sapiens; identical to SEQ ID NO: 76592

SEQ ID NO: 609041 - RNA, 64 nt, Homo Sapiens; identical to SEQ ID NO: 76593

SEQ ID NO: 609042 - RNA, 51 nt, Homo Sapiens; identical to SEQ ID NO: 516816

SEQ ID NO: 609043 - RNA, 64 nt, Homo Sapiens; identical to SEQ ID NO: 516817

SEQ ID NO: 609044 - RNA, 64 nt, Homo Sapiens; identical to SEQ ID NO: 516818

SEQ ID NO: 609045 - RNA, 64 nt, Homo Sapiens; identical to SEQ ID NO: 516819

SEQ ID NO: 609046 - RNA, 64 nt, Homo Sapiens; identical to SEQ ID NO: 516820

SEQ ID NO: 609047 - RNA, 64 nt, Homo Sapiens; identical to SEQ ID NO: 516821

SEQ ID NO: 609048 - RNA, 64 nt, Homo Sapiens; identical to SEQ ID NO: 516822

SEQ ID NO: 609049 - RNA, 64 nt, Homo Sapiens; identical to SEQ ID NO: 516823

SEQ ID NO: 609050 - RNA, 64 nt, Homo Sapiens; identical to SEQ ID NO: 516824

SEQ ID NO: 609051 - RNA, 64 nt, Homo Sapiens; identical to SEQ ID NO: 516825

SEQ ID NO: 609052 - RNA, 64 nt, Homo Sapiens; identical to SEQ ID NO: 516826

SEQ ID NO: 609053 - RNA, 64 nt, Homo Sapiens; identical to SEQ ID NO: 516827

SEQ ID NO: 609054 - RNA, 64 nt, Homo Sapiens; identical to SEQ ID NO: 516828

SEQ ID NO: 609055 - RNA, 64 nt, Homo Sapiens; identical to SEQ ID NO: 516829

SEQ ID NO: 609056 - RNA, 64 nt, Homo Sapiens; identical to SEQ ID NO: 516830

SEQ ID NO: 609057 - RNA, 64 nt, Homo Sapiens; identical to SEQ ID NO: 516831

SEQ ID NO: 609058 - RNA, 64 nt, Homo Sapiens; identical to SEQ ID NO: 516832

SEQ ID NO: 609059 - RNA, 64 nt, Homo Sapiens; identical to SEQ ID NO: 516833

SEQ ID NO: 609060 - RNA, 64 nt, Homo Sapiens; identical to SEQ ID NO: 516834

SEQ ID NO: 609061 - RNA, 64 nt, Homo Sapiens; identical to SEQ ID NO: 516835

SEQ ID NO: 609062 - RNA, 64 nt, Homo Sapiens; identical to SEQ ID NO: 516836

SEQ ID NO: 609063 - RNA, 64 nt, Homo Sapiens; identical to SEQ ID NO: 516837

SEQ ID NO: 609064 - RNA, 64 nt, Homo Sapiens; identical to SEQ ID NO: 516838

SEQ ID NO: 609065 - RNA, 64 nt, Homo Sapiens; identical to SEQ ID NO: 516839

SEQ ID NO: 609066 - RNA, 64 nt, Homo Sapiens; identical to SEQ ID NO: 516840

SEQ ID NO: 609067 - RNA, 64 nt, Homo Sapiens; identical to SEQ ID NO: 516841

SEQ ID NO: 609068 - RNA, 64 nt, Homo Sapiens; identical to SEQ ID NO: 516842

SEQ ID NO: 609069 - RNA, 64 nt, Homo Sapiens; identical to SEQ ID NO: 516843

SEQ ID NO: 609070 - RNA, 64 nt, Homo Sapiens; identical to SEQ ID NO: 516844

SEQ ID NO: 609071 - RNA, 64 nt, Homo Sapiens; identical to SEQ ID NO: 516845

SEQ ID NO: 609072 - RNA, 64 nt, Homo Sapiens; identical to SEQ ID NO: 516846

SEQ ID NO: 609073 - RNA, 64 nt, Homo Sapiens; identical to SEQ ID NO: 516847

SEQ ID NO: 609074 - RNA, 64 nt, Homo Sapiens; identical to SEQ ID NO: 516848

SEQ ID NO: 609075 - RNA, 64 nt, Homo Sapiens; identical to SEQ ID NO: 516849

SEQ ID NO: 609076 - RNA, 64 nt, Homo Sapiens; identical to SEQ ID NO: 516850

SEQ ID NO: 609077 - RNA, 64 nt, Homo Sapiens; identical to SEQ ID NO: 516851

SEQ ID NO: 609078 - RNA, 64 nt, Homo Sapiens; identical to SEQ ID NO: 516852

SEQ ID NO: 609079 - RNA, 64 nt, Homo Sapiens; identical to SEQ ID NO: 516853

SEQ ID NO: 609080 - RNA, 64 nt, Homo Sapiens; identical to SEQ ID NO: 516854

SEQ ID NO: 609081 - RNA, 64 nt, Homo Sapiens; identical to SEQ ID NO: 516855

SEQ ID NO: 609082 - RNA, 64 nt, Homo Sapiens; identical to SEQ ID NO: 516856

SEQ ID NO: 609083 - RNA, 64 nt, Homo Sapiens; identical to SEQ ID NO: 516857

SEQ ID NO: 609084 - RNA, 64 nt, Homo Sapiens; identical to SEQ ID NO: 516858

SEQ ID NO: 609085 - RNA, 64 nt, Homo Sapiens; identical to SEQ ID NO: 516859

SEQ ID NO: 609086 - RNA, 64 nt, Homo Sapiens; identical to SEQ ID NO: 516860

SEQ ID NO: 609087 - RNA, 64 nt, Homo Sapiens; identical to SEQ ID NO: 516861

SEQ ID NO: 609088 - RNA, 64 nt, Homo Sapiens; identical to SEQ ID NO: 516862

SEQ ID NO: 609089 - RNA, 64 nt, Homo Sapiens; identical to SEQ ID NO: 516863

SEQ ID NO: 609090 - RNA, 64 nt, Homo Sapiens; identical to SEQ ID NO: 516864

SEQ ID NO: 609091 - RNA, 64 nt, Homo Sapiens; identical to SEQ ID NO: 516865

SEQ ID NO: 609092 - RNA, 64 nt, Homo Sapiens; identical to SEQ ID NO: 516866

SEQ ID NO: 609093 - RNA, 64 nt, Homo Sapiens
gaagguucuuuggaaggaggacgaauagaauggaguaaugaaauucuugccaugugcugaggag

SEQ ID NO: 609094 - RNA, 64 nt, Homo Sapiens
caucauuuuccuguuucuugaaauaguuuaucuuguaaugaaauauaaggcaccucccacuuuu

SEQ ID NO: 609095 - RNA, 64 nt, Homo Sapiens
aguaaaugaacaaaaacaucaacauggaguccaaguaaugaauuuauagaggaaaauguaugcu

SEQ ID NO: 609096 - RNA, 64 nt, Homo Sapiens
aaggauuuaaaguagcuucuaauaaaggacauguguaaugaaacuuaaaauaugauauuuucuu

SEQ ID NO: 609097 - RNA, 64 nt, Homo Sapiens
cauagugugauugccucagaucuuaauauaccgaguaaugaaacucugaucaauaaaaucaaac

SEQ ID NO: 609098 - RNA, 64 nt, Homo Sapiens
cugucuuggucuccccugugugauuagcauguguguaaugaaugauuguucacaucccaucuga

SEQ ID NO: 609099 - RNA, 64 nt, Homo Sapiens
caaagaauucacacaggagagaaagcacaugaauguaaugaauguggaaaagcuuucagucaaa

SEQ ID NO: 609100 - RNA, 64 nt, Homo Sapiens
aucagagcauucauaccaaagagaacucaugaauguaaugaagaugggaagauauuuaucaaau

SEQ ID NO: 609101 - RNA, 64 nt, Homo Sapiens
aauucugcuagugguauaugcagcuuaauauuugguaaugaauacagacauagugcuggucuca

SEQ ID NO: 609102 - RNA, 64 nt, Homo Sapiens
gacaagcugguugaagcuggcuaauugacaaaguguaaugaaauaaauguggaaugucucuuga

SEQ ID NO: 609103 - RNA, 64 nt, Homo Sapiens
cugcgccacccaccaucaaaggaauauaagaaaaguaaugaagaaucacgauuucauccuugaa

SEQ ID NO: 609104 - RNA, 64 nt, Homo Sapiens
uuaguuuuacacuaggaaacguguuguaucuacaguaaugaaauguuuacuaaguggacuggug

SEQ ID NO: 609105 - RNA, 64 nt, Homo Sapiens
ccugagaagacacacuuggagaaaccuuuuggguguaaugaaugugggaaaaccuuucaucaga

SEQ ID NO: 609106 - RNA, 64 nt, Homo Sapiens
cacagaacucauauaagacagaaacccuauggguguaaugaauguggaaaaucauucuguguga

SEQ ID NO: 609107 - RNA, 64 nt, Homo Sapiens
uuuggaaguaaauucuaguuuguaguucucauuuguaaugaacacauuaacgacuagauuaaaa

SEQ ID NO: 609108 - RNA, 64 nt, Homo Sapiens
gggaaauggccacugcagauggaguuuuagaguaguaaugaaauucuaccuagaaugcaaaauu

SEQ ID NO: 609109 - RNA, 64 nt, Homo Sapiens
aaaaugugaucuaguguaauaaaugugaucuaguguaaugaaauuuuucaaaaugcaguaauca

SEQ ID NO: 609110 - RNA, 64 nt, Homo Sapiens
auuguaccaugaauuaggaguuagagaaaaugauguaaugaaaauuuuuuacccaaaauaauuu

SEQ ID NO: 609111 - RNA, 64 nt, Homo Sapiens
cucuacaaauuggguuagcuauaggguuucucuuguaaugaaguuaucaucagaaucucaguug

SEQ ID NO: 609112 - RNA, 64 nt, Homo Sapiens
guaauaauucuauuuauguaccuauguaccaggaguaaugaauaccaggccuguauauuuaacc

SEQ ID NO: 609113 - RNA, 64 nt, Homo Sapiens
uauguauuguagugaauaccuauucuugguuuguguaaugaauugucaauauaaguuagaagcu

SEQ ID NO: 609114 - RNA, 64 nt, Homo Sapiens
ugcugcacuucaacugguaucuguuugacuaucuguaaugaaaauguguauuguauagcucuag

SEQ ID NO: 609115 - RNA, 64 nt, Homo Sapiens
gauacugccuuccagauccuauaaucuggucaauguaaugaaugaguguuccauuauguccugg

SEQ ID NO: 609116 - RNA, 64 nt, Homo Sapiens
ugguaaugaccuuaacagcuaugcugagauugagguaaugaagauguguuugccggccagugcu

SEQ ID NO: 609117 - RNA, 64 nt, Homo Sapiens
gaaaaaauucauacuggagagaaaccauucaaauguaaugaaugugguaaagccuucucucgaa

SEQ ID NO: 609118 - RNA, 64 nt, Homo Sapiens
augagaagucauacuggugagaaacccuuugaauguaaugaaugugggaaagcauucucucaaa

SEQ ID NO: 609119 - RNA, 64 nt, Homo Sapiens
ugagaaggccucuucuugucgaaacccuaugaauguaaugaaugcaaagaauuccuacugguga

SEQ ID NO: 609120 - RNA, 64 nt, Homo Sapiens
ugggaaugccuucauuuguugaaacccuaugaauguaaugaaugcagagaauucacagugggga

SEQ ID NO: 609121 - RNA, 64 nt, Homo Sapiens
uggcauaguuuuuaaucaacgaaacccuacaaguguaaugaaugaaggcaauucguauuggaga

SEQ ID NO: 609122 - RNA, 64 nt, Homo Sapiens
uggcaagguuuuuaaucaaagaaacuuuacaaguguaaugaaugaaagccauucauacuggaga

SEQ ID NO: 609123 - RNA, 64 nt, Homo Sapiens
aggaagccuucuaaauuaaacucugggaaauauaguaaugaaaauauccuuuagcuaacuuucc

SEQ ID NO: 609124 - RNA, 64 nt, Homo Sapiens
accucacugggcuauaaauguuccuucuaacucuguaaugaaaguucagugacaaacuagauag

SEQ ID NO: 609125 - RNA, 64 nt, Homo Sapiens; identical to SEQ ID NO: 73453

SEQ ID NO: 609126 - RNA, 64 nt, Homo Sapiens; identical to SEQ ID NO: 73454

SEQ ID NO: 609127 - RNA, 64 nt, Homo Sapiens; identical to SEQ ID NO: 73455

SEQ ID NO: 609128 - RNA, 64 nt, Homo Sapiens; identical to SEQ ID NO: 73456

SEQ ID NO: 609129 - RNA, 64 nt, Homo Sapiens; identical to SEQ ID NO: 73457

SEQ ID NO: 609130 - RNA, 64 nt, Homo Sapiens; identical to SEQ ID NO: 73458

SEQ ID NO: 609131 - RNA, 64 nt, Homo Sapiens; identical to SEQ ID NO: 73459

SEQ ID NO: 609132 - RNA, 64 nt, Homo Sapiens; identical to SEQ ID NO: 73460

SEQ ID NO: 609133 - RNA, 64 nt, Homo Sapiens; identical to SEQ ID NO: 73461

SEQ ID NO: 609134 - RNA, 64 nt, Homo Sapiens; identical to SEQ ID NO: 73462

SEQ ID NO: 609135 - RNA, 64 nt, Homo Sapiens; identical to SEQ ID NO: 73463

SEQ ID NO: 609136 - RNA, 64 nt, Homo Sapiens; identical to SEQ ID NO: 73464

SEQ ID NO: 609137 - RNA, 64 nt, Homo Sapiens; identical to SEQ ID NO: 73465

SEQ ID NO: 609138 - RNA, 64 nt, Homo Sapiens; identical to SEQ ID NO: 73466

SEQ ID NO: 609139 - RNA, 64 nt, Homo Sapiens; identical to SEQ ID NO: 73467

SEQ ID NO: 609140 - RNA, 64 nt, Homo Sapiens; identical to SEQ ID NO: 73468

SEQ ID NO: 609141 - RNA, 64 nt, Homo Sapiens; identical to SEQ ID NO: 73469

SEQ ID NO: 609142 - RNA, 64 nt, Homo Sapiens; identical to SEQ ID NO: 73470

SEQ ID NO: 609143 - RNA, 64 nt, Homo Sapiens; identical to SEQ ID NO: 73471

SEQ ID NO: 609144 - RNA, 64 nt, Homo Sapiens; identical to SEQ ID NO: 73472

SEQ ID NO: 609145 - RNA, 64 nt, Homo Sapiens; identical to SEQ ID NO: 73473

SEQ ID NO: 609146 - RNA, 64 nt, Homo Sapiens; identical to SEQ ID NO: 73474

SEQ ID NO: 609147 - RNA, 64 nt, Homo Sapiens; identical to SEQ ID NO: 73475

SEQ ID NO: 609148 - RNA, 64 nt, Homo Sapiens; identical to SEQ ID NO: 73476

SEQ ID NO: 609149 - RNA, 64 nt, Homo Sapiens; identical to SEQ ID NO: 73477

SEQ ID NO: 609150 - RNA, 64 nt, Homo Sapiens; identical to SEQ ID NO: 73478

SEQ ID NO: 609151 - RNA, 64 nt, Homo Sapiens; identical to SEQ ID NO: 73479

SEQ ID NO: 609152 - RNA, 64 nt, Homo Sapiens; identical to SEQ ID NO: 73480

SEQ ID NO: 609153 - RNA, 64 nt, Homo Sapiens; identical to SEQ ID NO: 73481

SEQ ID NO: 609154 - RNA, 64 nt, Homo Sapiens; identical to SEQ ID NO: 73482

SEQ ID NO: 609155 - RNA, 64 nt, Homo Sapiens; identical to SEQ ID NO: 73483

SEQ ID NO: 609156 - RNA, 64 nt, Homo Sapiens; identical to SEQ ID NO: 73484

SEQ ID NO: 609157 - RNA, 64 nt, Homo Sapiens; identical to SEQ ID NO: 73485

SEQ ID NO: 609158 - RNA, 64 nt, Homo Sapiens; identical to SEQ ID NO: 73486

SEQ ID NO: 609159 - RNA, 64 nt, Homo Sapiens; identical to SEQ ID NO: 73487

SEQ ID NO: 609160 - RNA, 64 nt, Homo Sapiens; identical to SEQ ID NO: 73488

SEQ ID NO: 609161 - RNA, 64 nt, Homo Sapiens; identical to SEQ ID NO: 73489

SEQ ID NO: 609162 - RNA, 64 nt, Homo Sapiens; identical to SEQ ID NO: 73490

SEQ ID NO: 609163 - RNA, 64 nt, Homo Sapiens; identical to SEQ ID NO: 73491

SEQ ID NO: 609164 - RNA, 64 nt, Homo Sapiens; identical to SEQ ID NO: 73492

SEQ ID NO: 609165 - RNA, 64 nt, Homo Sapiens; identical to SEQ ID NO: 73493

SEQ ID NO: 609166 - RNA, 64 nt, Homo Sapiens; identical to SEQ ID NO: 73494

SEQ ID NO: 609167 - RNA, 64 nt, Homo Sapiens; identical to SEQ ID NO: 73495

SEQ ID NO: 609168 - RNA, 64 nt, Homo Sapiens; identical to SEQ ID NO: 73496

SEQ ID NO: 609169 - RNA, 64 nt, Homo Sapiens; identical to SEQ ID NO: 73497

SEQ ID NO: 609170 - RNA, 64 nt, Homo Sapiens; identical to SEQ ID NO: 73498

SEQ ID NO: 609171 - RNA, 64 nt, Homo Sapiens; identical to SEQ ID NO: 73499

SEQ ID NO: 609172 - RNA, 64 nt, Homo Sapiens; identical to SEQ ID NO: 73500

SEQ ID NO: 609173 - RNA, 64 nt, Homo Sapiens; identical to SEQ ID NO: 73501

SEQ ID NO: 609174 - RNA, 64 nt, Homo Sapiens; identical to SEQ ID NO: 73502

SEQ ID NO: 609175 - RNA, 64 nt, Homo Sapiens; identical to SEQ ID NO: 73503

SEQ ID NO: 609176 - RNA, 64 nt, Homo Sapiens; identical to SEQ ID NO: 73504

SEQ ID NO: 609177 - RNA, 64 nt, Homo Sapiens; identical to SEQ ID NO: 73505

SEQ ID NO: 609178 - RNA, 64 nt, Homo Sapiens; identical to SEQ ID NO: 73506

SEQ ID NO: 609179 - RNA, 64 nt, Homo Sapiens; identical to SEQ ID NO: 73507

SEQ ID NO: 609180 - RNA, 64 nt, Homo Sapiens; identical to SEQ ID NO: 73508

SEQ ID NO: 609181 - RNA, 64 nt, Homo Sapiens; identical to SEQ ID NO: 73509

SEQ ID NO: 609182 - RNA, 64 nt, Homo Sapiens; identical to SEQ ID NO: 73510

SEQ ID NO: 609183 - RNA, 64 nt, Homo Sapiens; identical to SEQ ID NO: 73511

SEQ ID NO: 609184 - RNA, 64 nt, Homo Sapiens; identical to SEQ ID NO: 73512

SEQ ID NO: 609185 - RNA, 64 nt, Homo Sapiens; identical to SEQ ID NO: 73513

SEQ ID NO: 609186 - RNA, 64 nt, Homo Sapiens
uuaguaucauuguuucauuuaguauuugguacaaucuaauaaauacuaauccaguccaauacua

SEQ ID NO: 609187 - RNA, 64 nt, Homo Sapiens
aauacuaauaauacuaacaguaguauugauacaaucuaauaaauaauguguuugacaguguagc

SEQ ID NO: 609188 - RNA, 64 nt, Homo Sapiens
gggaagguaagauggauaauugaauugugugguaucuaauaaaaucuuagauuuuaagaacucu

SEQ ID NO: 609189 - RNA, 64 nt, Homo Sapiens
caaguuuguggaaaugcaagauugauuauucuaaucuaauaagaacuggguaucugcaaggcuu

SEQ ID NO: 609190 - RNA, 64 nt, Homo Sapiens
uaugaaguuacugauuugaauaauaaaugggaugucuaauaaauagcaaaagaacuuagaguuc

SEQ ID NO: 609191 - RNA, 64 nt, Homo Sapiens
gggaugucuaauaaauuaugaaagaacuuagaguucuaauaaauguuucauuuauauaaaagca

SEQ ID NO: 609192 - RNA, 64 nt, Homo Sapiens
ccacguaugauauguguguuucaguauguguguuucuaauaagugaggaaguggcuguccugaa

SEQ ID NO: 609193 - RNA, 64 nt, Homo Sapiens
caaaacuagaauuuguaaugcaaauggagcucagucuaauaaaaaagagguuuugguauuaaaa

SEQ ID NO: 609194 - RNA, 64 nt, Homo Sapiens
cacacauuucaugcucauuucacacauuucaugcucuaauaaucugcaugucuuucuaauaauc

SEQ ID NO: 609195 - RNA, 64 nt, Homo Sapiens
cacacauuucaugcucuaaucaagugcaugucuuucuaauaaucgucacuagauguucauuuca

SEQ ID NO: 609196 - RNA, 64 nt, Homo Sapiens
gacaucauguuggaaagaugcacaaaaccauuuuucuaauaagacuuccuucacaguuuuaucu

SEQ ID NO: 609197 - RNA, 64 nt, Homo Sapiens
cucauuccucaagugauauuauuauuuaauaauuucuaauaacacuaagaacuaagcuuugagu

SEQ ID NO: 609198 - RNA, 64 nt, Homo Sapiens
cagaauuccauauugcuauaauuaagauuaggaaucuaauaacauuuuuuuuugguauuugaua

SEQ ID NO: 609199 - RNA, 64 nt, Homo Sapiens
cagaauaaauacauguugcccacaacugagcaguucuaauaaugcauuaaugguaccagccugu

SEQ ID NO: 609200 - RNA, 64 nt, Homo Sapiens
uacacaauacagaaaugaaugagugugguuauguucuaauaaaacuuauuuauaaaaacaaggg

SEQ ID NO: 609201 - RNA, 64 nt, Homo Sapiens
gcaugauccgugcuuaaugaucaaguguuacuuaucuaauaauccucuagaaagaacccuguua

SEQ ID NO: 609202 - RNA, 64 nt, Homo Sapiens
gaugaaaagaaauuuauuuuauacguguuaugucucuaauaaaguauucauuugauaaucuuug

SEQ ID NO: 609203 - RNA, 64 nt, Homo Sapiens
acaggucuugugcuugugcuacgaauccucugugucuaauaaaguuucagauaaaacuggguga

SEQ ID NO: 609204 - RNA, 64 nt, Homo Sapiens
uaaacggcauuguaguaaggugccaugagucagcucuaauaaguuggccuggagcgaggacagc

SEQ ID NO: 609205 - RNA, 64 nt, Homo Sapiens
gagccgcguuugcuccuccgucucuuuugcauauucuaauaaauguauuuguggaggaaagucc

SEQ ID NO: 609206 - RNA, 64 nt, Homo Sapiens
uuuaaaugucacaaacuguauuuggugcuuaucuucuaauaagacuauuuuuuauuuuaauagg

SEQ ID NO: 609207 - RNA, 64 nt, Homo Sapiens
cuuaaauacuaauguauuaaguauuuaaguacuuucuaauaaaaucuuuaacaauaauaaugua

SEQ ID NO: 609208 - RNA, 64 nt, Homo Sapiens
gagaccaucgugacuaacacagugaaaccccgucucuaauaaaaauacgaaaaauuagccaggc

SEQ ID NO: 609209 - RNA, 64 nt, Homo Sapiens
uuuuguguuccagauugaauauguguauuuuuauucuaauaaacaauuuuaguguugauaccgu

SEQ ID NO: 609210 - RNA, 64 nt, Homo Sapiens
aauuuggguaauuuuuaauuuaauugucucuuuuucuaauaaggagauccuaaguagaaccagg

SEQ ID NO: 609211 - RNA, 64 nt, Homo Sapiens
auuuaauguuugaaucuaaaucauugggcaaacuucuaauaauaacaauuaauaauagguuaca

SEQ ID NO: 609212 - RNA, 64 nt, Homo Sapiens
uccuuuguuuuggcucgggauuacuuccuggcugucuaauaauugaaccauaaccauguaauau

SEQ ID NO: 609213 - RNA, 64 nt, Homo Sapiens
auacaauuucguuuucacuugcuucucaaccuagucuaauaaacuaaggugaugagauauacau

SEQ ID NO: 609214 - RNA, 64 nt, Homo Sapiens
guuucuugauccuuaaaaugaccuucgagcauauucuaauaaagugcauugccaguuuucuguc

SEQ ID NO: 609215 - RNA, 64 nt, Homo Sapiens
cugcuugacccuuaucugacaugcuggaguauuuucuaauaaucaagaauggcuacuuuuuucu

SEQ ID NO: 609216 - RNA, 64 nt, Homo Sapiens
cacucaguuuacucucucccacaaacuuuguaauucuaauaauggguuaucugagauaggagau

SEQ ID NO: 609217 - RNA, 64 nt, Homo Sapiens
aguauguaauuuugucuuugaugucaaaauaacauacuuggagaugguguuuguuuuuaucaaa

SEQ ID NO: 609218 - RNA, 64 nt, Homo Sapiens
aacugcauuaucuuaaaaggucaauucuguagcauacuuggagaauuuuucuagagguuggcuu

SEQ ID NO: 609219 - RNA, 64 nt, Homo Sapiens
ccaugccugaaauuuggaaguuuucuaugaaaucuacuuggaucuugauaaccuggcuacagcg

SEQ ID NO: 609220 - RNA, 64 nt, Homo Sapiens
uuggucguuuuuauacuagcuauuuuuuuauuauuacuuggaccuuacagucauugauggacuc

SEQ ID NO: 609221 - RNA, 64 nt, Homo Sapiens
uugaacaaaagucaacuguuauggccucucucuuuacuuggacuaaaggauucucacuccaaac

SEQ ID NO: 609222 - RNA, 64 nt, Homo Sapiens
uuccucuguuauauagcuuuacacuguuugauuuuacuuggaauguguuuagaguuaagaguga

SEQ ID NO: 609223 - RNA, 64 nt, Homo Sapiens
aaagaaccaaguccuuggauaguagaaccaagucuacuuggagagggcuguaucuacucugugg

SEQ ID NO: 609224 - RNA, 64 nt, Homo Sapiens
ggaaagaugccaagcugcuuaacccaggguuuuguacuuggagaggcacuggaacaggguugaa

SEQ ID NO: 609225 - RNA, 64 nt, Homo Sapiens
auaaugaaauaaaacuguuuuaucuuuucaaagguacuuggauaaugacacuuguacaauuaau

SEQ ID NO: 609226 - RNA, 64 nt, Homo Sapiens
gcccagcccaagugaggcagacuccucauagcaauacuuggaggccaaggaggcagccuggacc

SEQ ID NO: 609227 - RNA, 64 nt, Homo Sapiens
ugguuugaacaaaacauaaacaguauguuggcauuacuuggaccagagacauaucaacuaaauu

SEQ ID NO: 609228 - RNA, 64 nt, Homo Sapiens
aaucacagucauauagcauggaguaaguaguuaauacuuggagguggaauaggauuguugcaag

SEQ ID NO: 609229 - RNA, 64 nt, Homo Sapiens
gccucaagcucaagauacuuauugaaaacauccucaauugcaauaaaaacauuauaacaugaaa

SEQ ID NO: 609230 - RNA, 64 nt, Homo Sapiens
agaguuauaacaaaggagagccucaaauauuagacaauugcagugcggcuuucugggcacaggu

SEQ ID NO: 609231 - RNA, 64 nt, Homo Sapiens
cacccaagguggcaguucucaguauuuggcagaacaauugcaauugcacuggguauauuauaua

SEQ ID NO: 609232 - RNA, 64 nt, Homo Sapiens
agguggcaguucucaguauuuggcagaacaauugcaauugcacuggguauauuauauauauaua

SEQ ID NO: 609233 - RNA, 64 nt, Homo Sapiens
uugcuuugaccugccauguggcacuccacaaugucaauugcaguuuacacacauugccuaaagu

SEQ ID NO: 609234 - RNA, 64 nt, Homo Sapiens
guuuauucucaggaguugcuuguacauucuugggcaauugcagauaauuccaagaaugcauauu

SEQ ID NO: 609235 - RNA, 64 nt, Homo Sapiens
gacagggacgcauucugauaaaugugucauuaggcaauugcauuguagugugauuaucacagau

SEQ ID NO: 609236 - RNA, 64 nt, Homo Sapiens
accuguacagcaugugacuacugaauacuauaggcaauugcagcacaaugggaaauauuugugu

SEQ ID NO: 609237 - RNA, 64 nt, Homo Sapiens; identical to SEQ ID NO: 328547

SEQ ID NO: 609238 - RNA, 64 nt, Homo Sapiens; identical to SEQ ID NO: 328548

SEQ ID NO: 609239 - RNA, 64 nt, Homo Sapiens; identical to SEQ ID NO: 328549

SEQ ID NO: 609240 - RNA, 64 nt, Homo Sapiens; identical to SEQ ID NO: 328550

SEQ ID NO: 609241 - RNA, 64 nt, Homo Sapiens; identical to SEQ ID NO: 328551

SEQ ID NO: 609242 - RNA, 64 nt, Homo Sapiens; identical to SEQ ID NO: 328552

SEQ ID NO: 609243 - RNA, 64 nt, Homo Sapiens; identical to SEQ ID NO: 328553

SEQ ID NO: 609244 - RNA, 64 nt, Homo Sapiens; identical to SEQ ID NO: 328554

SEQ ID NO: 609245 - RNA, 64 nt, Homo Sapiens; identical to SEQ ID NO: 328555

SEQ ID NO: 609246 - RNA, 64 nt, Homo Sapiens; identical to SEQ ID NO: 328556

SEQ ID NO: 609247 - RNA, 64 nt, Homo Sapiens; identical to SEQ ID NO: 328557

SEQ ID NO: 609248 - RNA, 64 nt, Homo Sapiens; identical to SEQ ID NO: 328558

SEQ ID NO: 609249 - RNA, 64 nt, Homo Sapiens; identical to SEQ ID NO: 328559

SEQ ID NO: 609250 - RNA, 64 nt, Homo Sapiens; identical to SEQ ID NO: 328560

SEQ ID NO: 609251 - RNA, 64 nt, Homo Sapiens; identical to SEQ ID NO: 328561

SEQ ID NO: 609252 - RNA, 64 nt, Homo Sapiens; identical to SEQ ID NO: 328562

SEQ ID NO: 609253 - RNA, 64 nt, Homo Sapiens; identical to SEQ ID NO: 328563

SEQ ID NO: 609254 - RNA, 64 nt, Homo Sapiens; identical to SEQ ID NO: 328564

SEQ ID NO: 609255 - RNA, 64 nt, Homo Sapiens; identical to SEQ ID NO: 328565

SEQ ID NO: 609256 - RNA, 64 nt, Homo Sapiens; identical to SEQ ID NO: 328566

SEQ ID NO: 609257 - RNA, 64 nt, Homo Sapiens; identical to SEQ ID NO: 328567

SEQ ID NO: 609258 - RNA, 64 nt, Homo Sapiens; identical to SEQ ID NO: 328568

SEQ ID NO: 609259 - RNA, 64 nt, Homo Sapiens; identical to SEQ ID NO: 328569

SEQ ID NO: 609260 - RNA, 64 nt, Homo Sapiens; identical to SEQ ID NO: 328570

SEQ ID NO: 609261 - RNA, 64 nt, Homo Sapiens; identical to SEQ ID NO: 328571

SEQ ID NO: 609262 - RNA, 64 nt, Homo Sapiens; identical to SEQ ID NO: 328572

SEQ ID NO: 609263 - RNA, 64 nt, Homo Sapiens; identical to SEQ ID NO: 328573

SEQ ID NO: 609264 - RNA, 64 nt, Homo Sapiens; identical to SEQ ID NO: 328574

SEQ ID NO: 609265 - RNA, 64 nt, Homo Sapiens; identical to SEQ ID NO: 328575

SEQ ID NO: 609266 - RNA, 64 nt, Homo Sapiens; identical to SEQ ID NO: 328576

SEQ ID NO: 609267 - RNA, 64 nt, Homo Sapiens; identical to SEQ ID NO: 328577

SEQ ID NO: 609268 - RNA, 64 nt, Homo Sapiens; identical to SEQ ID NO: 328578

SEQ ID NO: 609269 - RNA, 64 nt, Homo Sapiens; identical to SEQ ID NO: 328579

SEQ ID NO: 609270 - RNA, 64 nt, Homo Sapiens; identical to SEQ ID NO: 328580

SEQ ID NO: 609271 - RNA, 64 nt, Homo Sapiens; identical to SEQ ID NO: 328581

SEQ ID NO: 609272 - RNA, 64 nt, Homo Sapiens; identical to SEQ ID NO: 328582

SEQ ID NO: 609273 - RNA, 64 nt, Homo Sapiens; identical to SEQ ID NO: 328583

SEQ ID NO: 609274 - RNA, 64 nt, Homo Sapiens; identical to SEQ ID NO: 328584

SEQ ID NO: 609275 - RNA, 64 nt, Homo Sapiens; identical to SEQ ID NO: 328585

SEQ ID NO: 609276 - RNA, 64 nt, Homo Sapiens; identical to SEQ ID NO: 328586

SEQ ID NO: 609277 - RNA, 64 nt, Homo Sapiens; identical to SEQ ID NO: 328587

SEQ ID NO: 609278 - RNA, 64 nt, Homo Sapiens; identical to SEQ ID NO: 328588

SEQ ID NO: 609279 - RNA, 64 nt, Homo Sapiens; identical to SEQ ID NO: 328589

SEQ ID NO: 609280 - RNA, 64 nt, Homo Sapiens; identical to SEQ ID NO: 328590

SEQ ID NO: 609281 - RNA, 64 nt, Homo Sapiens; identical to SEQ ID NO: 328591

SEQ ID NO: 609282 - RNA, 64 nt, Homo Sapiens; identical to SEQ ID NO: 328592

SEQ ID NO: 609283 - RNA, 64 nt, Homo Sapiens; identical to SEQ ID NO: 328593

SEQ ID NO: 609284 - RNA, 64 nt, Homo Sapiens; identical to SEQ ID NO: 328594

SEQ ID NO: 609285 - RNA, 64 nt, Homo Sapiens; identical to SEQ ID NO: 328595

SEQ ID NO: 609286 - RNA, 64 nt, Homo Sapiens; identical to SEQ ID NO: 328596

SEQ ID NO: 609287 - RNA, 64 nt, Homo Sapiens; identical to SEQ ID NO: 328597

SEQ ID NO: 609288 - RNA, 64 nt, Homo Sapiens; identical to SEQ ID NO: 328598

SEQ ID NO: 609289 - RNA, 64 nt, Homo Sapiens; identical to SEQ ID NO: 328599

SEQ ID NO: 609290 - RNA, 55 nt, Homo Sapiens; identical to SEQ ID NO: 328600

SEQ ID NO: 609291 - RNA, 64 nt, Homo Sapiens; identical to SEQ ID NO: 328601

SEQ ID NO: 609292 - RNA, 64 nt, Homo Sapiens; identical to SEQ ID NO: 328602

SEQ ID NO: 609293 - RNA, 64 nt, Homo Sapiens; identical to SEQ ID NO: 328603

SEQ ID NO: 609294 - RNA, 64 nt, Homo Sapiens; identical to SEQ ID NO: 328604

SEQ ID NO: 609295 - RNA, 64 nt, Homo Sapiens; identical to SEQ ID NO: 328605

SEQ ID NO: 609296 - RNA, 64 nt, Homo Sapiens; identical to SEQ ID NO: 328606

SEQ ID NO: 609297 - RNA, 64 nt, Homo Sapiens; identical to SEQ ID NO: 328607

SEQ ID NO: 609298 - RNA, 64 nt, Homo Sapiens; identical to SEQ ID NO: 328608

SEQ ID NO: 609299 - RNA, 64 nt, Homo Sapiens; identical to SEQ ID NO: 328609

SEQ ID NO: 609300 - RNA, 64 nt, Homo Sapiens; identical to SEQ ID NO: 328610

SEQ ID NO: 609301 - RNA, 64 nt, Homo Sapiens; identical to SEQ ID NO: 328611

SEQ ID NO: 609302 - RNA, 64 nt, Homo Sapiens; identical to SEQ ID NO: 328612

SEQ ID NO: 609303 - RNA, 64 nt, Homo Sapiens; identical to SEQ ID NO: 328613

SEQ ID NO: 609304 - RNA, 64 nt, Homo Sapiens; identical to SEQ ID NO: 328614

SEQ ID NO: 609305 - RNA, 64 nt, Homo Sapiens; identical to SEQ ID NO: 328615

SEQ ID NO: 609306 - RNA, 64 nt, Homo Sapiens; identical to SEQ ID NO: 328616

SEQ ID NO: 609307 - RNA, 64 nt, Homo Sapiens; identical to SEQ ID NO: 328617

SEQ ID NO: 609308 - RNA, 64 nt, Homo Sapiens; identical to SEQ ID NO: 328618

SEQ ID NO: 609309 - RNA, 64 nt, Homo Sapiens; identical to SEQ ID NO: 328619

SEQ ID NO: 609310 - RNA, 64 nt, Homo Sapiens; identical to SEQ ID NO: 328620

SEQ ID NO: 609311 - RNA, 64 nt, Homo Sapiens; identical to SEQ ID NO: 328621

SEQ ID NO: 609312 - RNA, 64 nt, Homo Sapiens; identical to SEQ ID NO: 328622

SEQ ID NO: 609313 - RNA, 64 nt, Homo Sapiens; identical to SEQ ID NO: 328623

SEQ ID NO: 609314 - RNA, 64 nt, Homo Sapiens; identical to SEQ ID NO: 328624

SEQ ID NO: 609315 - RNA, 64 nt, Homo Sapiens; identical to SEQ ID NO: 328625

SEQ ID NO: 609316 - RNA, 64 nt, Homo Sapiens; identical to SEQ ID NO: 328626

SEQ ID NO: 609317 - RNA, 64 nt, Homo Sapiens; identical to SEQ ID NO: 328627

SEQ ID NO: 609318 - RNA, 64 nt, Homo Sapiens; identical to SEQ ID NO: 328628

SEQ ID NO: 609319 - RNA, 57 nt, Homo Sapiens; identical to SEQ ID NO: 328629

SEQ ID NO: 609320 - RNA, 64 nt, Homo Sapiens; identical to SEQ ID NO: 328630

SEQ ID NO: 609321 - RNA, 64 nt, Homo Sapiens; identical to SEQ ID NO: 328631

SEQ ID NO: 609322 - RNA, 64 nt, Homo Sapiens; identical to SEQ ID NO: 328632

SEQ ID NO: 609323 - RNA, 64 nt, Homo Sapiens; identical to SEQ ID NO: 328633

SEQ ID NO: 609324 - RNA, 64 nt, Homo Sapiens; identical to SEQ ID NO: 328634

SEQ ID NO: 609325 - RNA, 64 nt, Homo Sapiens; identical to SEQ ID NO: 328635

SEQ ID NO: 609326 - RNA, 64 nt, Homo Sapiens; identical to SEQ ID NO: 328636

SEQ ID NO: 609327 - RNA, 64 nt, Homo Sapiens; identical to SEQ ID NO: 328637

SEQ ID NO: 609328 - RNA, 64 nt, Homo Sapiens; identical to SEQ ID NO: 328638

SEQ ID NO: 609329 - RNA, 64 nt, Homo Sapiens; identical to SEQ ID NO: 328639

SEQ ID NO: 609330 - RNA, 64 nt, Homo Sapiens; identical to SEQ ID NO: 328640

SEQ ID NO: 609331 - RNA, 64 nt, Homo Sapiens; identical to SEQ ID NO: 328641

SEQ ID NO: 609332 - RNA, 64 nt, Homo Sapiens; identical to SEQ ID NO: 328642

SEQ ID NO: 609333 - RNA, 64 nt, Homo Sapiens; identical to SEQ ID NO: 328643

SEQ ID NO: 609334 - RNA, 64 nt, Homo Sapiens; identical to SEQ ID NO: 328644

SEQ ID NO: 609335 - RNA, 64 nt, Homo Sapiens; identical to SEQ ID NO: 328645

SEQ ID NO: 609336 - RNA, 64 nt, Homo Sapiens; identical to SEQ ID NO: 328646

SEQ ID NO: 609337 - RNA, 64 nt, Homo Sapiens; identical to SEQ ID NO: 328647

SEQ ID NO: 609338 - RNA, 64 nt, Homo Sapiens; identical to SEQ ID NO: 328648

SEQ ID NO: 609339 - RNA, 64 nt, Homo Sapiens; identical to SEQ ID NO: 328649

SEQ ID NO: 609340 - RNA, 64 nt, Homo Sapiens; identical to SEQ ID NO: 328650

SEQ ID NO: 609341 - RNA, 64 nt, Homo Sapiens; identical to SEQ ID NO: 328651

SEQ ID NO: 609342 - RNA, 64 nt, Homo Sapiens; identical to SEQ ID NO: 328652

SEQ ID NO: 609343 - RNA, 64 nt, Homo Sapiens; identical to SEQ ID NO: 328653

SEQ ID NO: 609344 - RNA, 64 nt, Homo Sapiens; identical to SEQ ID NO: 328654

SEQ ID NO: 609345 - RNA, 64 nt, Homo Sapiens; identical to SEQ ID NO: 328655

SEQ ID NO: 609346 - RNA, 64 nt, Homo Sapiens; identical to SEQ ID NO: 328656

SEQ ID NO: 609347 - RNA, 64 nt, Homo Sapiens; identical to SEQ ID NO: 328657

SEQ ID NO: 609348 - RNA, 64 nt, Homo Sapiens; identical to SEQ ID NO: 328658

SEQ ID NO: 609349 - RNA, 64 nt, Homo Sapiens; identical to SEQ ID NO: 328659

SEQ ID NO: 609350 - RNA, 64 nt, Homo Sapiens; identical to SEQ ID NO: 328660

SEQ ID NO: 609351 - RNA, 64 nt, Homo Sapiens; identical to SEQ ID NO: 328661

SEQ ID NO: 609352 - RNA, 64 nt, Homo Sapiens; identical to SEQ ID NO: 328662

SEQ ID NO: 609353 - RNA, 64 nt, Homo Sapiens; identical to SEQ ID NO: 328663

SEQ ID NO: 609354 - RNA, 64 nt, Homo Sapiens; identical to SEQ ID NO: 328664

SEQ ID NO: 609355 - RNA, 64 nt, Homo Sapiens; identical to SEQ ID NO: 328665

SEQ ID NO: 609356 - RNA, 64 nt, Homo Sapiens; identical to SEQ ID NO: 328664

SEQ ID NO: 609357 - RNA, 64 nt, Homo Sapiens; identical to SEQ ID NO: 328665

SEQ ID NO: 609358 - RNA, 64 nt, Homo Sapiens; identical to SEQ ID NO: 214386

SEQ ID NO: 609359 - RNA, 64 nt, Homo Sapiens; identical to SEQ ID NO: 214387

SEQ ID NO: 609360 - RNA, 64 nt, Homo Sapiens; identical to SEQ ID NO: 214444

SEQ ID NO: 609361 - RNA, 64 nt, Homo Sapiens; identical to SEQ ID NO: 214445

SEQ ID NO: 609362 - RNA, 64 nt, Homo Sapiens; identical to SEQ ID NO: 214448

SEQ ID NO: 609363 - RNA, 64 nt, Homo Sapiens; identical to SEQ ID NO: 214449

SEQ ID NO: 609364 - RNA, 64 nt, Homo Sapiens; identical to SEQ ID NO: 214534

SEQ ID NO: 609365 - RNA, 64 nt, Homo Sapiens; identical to SEQ ID NO: 214535

SEQ ID NO: 609366 - RNA, 64 nt, Homo Sapiens; identical to SEQ ID NO: 281120

SEQ ID NO: 609367 - RNA, 64 nt, Homo Sapiens; identical to SEQ ID NO: 281120

SEQ ID NO: 609368 - RNA, 64 nt, Homo Sapiens; identical to SEQ ID NO: 281122

SEQ ID NO: 609369 - RNA, 64 nt, Homo Sapiens; identical to SEQ ID NO: 281123

SEQ ID NO: 609370 - RNA, 64 nt, Homo Sapiens; identical to SEQ ID NO: 281124

SEQ ID NO: 609371 - RNA, 64 nt, Homo Sapiens; identical to SEQ ID NO: 281125

SEQ ID NO: 609372 - RNA, 64 nt, Homo Sapiens; identical to SEQ ID NO: 281126

SEQ ID NO: 609373 - RNA, 64 nt, Homo Sapiens; identical to SEQ ID NO: 281127

SEQ ID NO: 609374 - RNA, 64 nt, Homo Sapiens; identical to SEQ ID NO: 281128

SEQ ID NO: 609375 - RNA, 64 nt, Homo Sapiens; identical to SEQ ID NO: 281129

SEQ ID NO: 609376 - RNA, 64 nt, Homo Sapiens; identical to SEQ ID NO: 281130

SEQ ID NO: 609377 - RNA, 64 nt, Homo Sapiens; identical to SEQ ID NO: 281131

SEQ ID NO: 609378 - RNA, 64 nt, Homo Sapiens; identical to SEQ ID NO: 81713

SEQ ID NO: 609379 - RNA, 64 nt, Homo Sapiens; identical to SEQ ID NO: 81714

SEQ ID NO: 609380 - RNA, 64 nt, Homo Sapiens; identical to SEQ ID NO: 81715

SEQ ID NO: 609381 - RNA, 64 nt, Homo Sapiens; identical to SEQ ID NO: 81716

SEQ ID NO: 609382 - RNA, 64 nt, Homo Sapiens; identical to SEQ ID NO: 81717

SEQ ID NO: 609383 - RNA, 64 nt, Homo Sapiens; identical to SEQ ID NO: 81718

SEQ ID NO: 609384 - RNA, 64 nt, Homo Sapiens
aaaaaaggcauugggauuuauaaugugcuguuuaaagucugaagcucggccaggugcgguggcu

SEQ ID NO: 609385 - RNA, 64 nt, Homo Sapiens
acuucauuucgauaaauaaguaaauaaauaaauaaagucugaagcuccacuggucacuccuuuu

SEQ ID NO: 609386 - RNA, 64 nt, Homo Sapiens
gaauaugggcaaaauauuucuuaugaaacugggaaagucugaagcaauuuagguaaaaaucaca

SEQ ID NO: 609387 - RNA, 64 nt, Homo Sapiens
gcaguauuuauagacuucuaucucuugauguggaaagucugaauucuucugcccugguccccuu

SEQ ID NO: 609388 - RNA, 64 nt, Homo Sapiens
ucuugauguaagugggaauuaaaaauuucccaguaagucugaagagaauuuagcagggacaggg

SEQ ID NO: 609389 - RNA, 64 nt, Homo Sapiens
aaauucaguagaaucuuuuggcaaaaaucaaaagaagucugacuuuauaaaaucuacuucauaa

SEQ ID NO: 609390 - RNA, 64 nt, Homo Sapiens
cagaucuacaaacuacagucacuauccuucugaaaagucugagaugguuuaaaucacauuugau

SEQ ID NO: 609391 - RNA, 64 nt, Homo Sapiens
agacuaaagagauauuucuuacauaaguuucagaaagucugauucuaucuacagccuaaguuac

SEQ ID NO: 609392 - RNA, 64 nt, Homo Sapiens
uugggccucugaccugggcccuagucugcugcugaagucugaacgacuuugguaaagucugacc

SEQ ID NO: 609393 - RNA, 58 nt, Homo Sapiens
cuagucugcugcugaagucucuuugguaaagucugaccacaugaaccucgaguucuga

SEQ ID NO: 609394 - RNA, 64 nt, Homo Sapiens
uguugucguuuacuaucuucaucucacccauuucaagucugagguaaaaaaauaauaaugauaa

SEQ ID NO: 609395 - RNA, 64 nt, Homo Sapiens
aauacaaaaacuaaguagacagauauuuguacugaagucugauacagaauuagaaaaaaaaaau

SEQ ID NO: 609396 - RNA, 64 nt, Homo Sapiens
ugggagucacuuuuaaucuguaauuuuaaaauacaagucugaauauuuauaguugauucuuaac

SEQ ID NO: 609397 - RNA, 64 nt, Homo Sapiens
uaaauaauauugaaagauuuuaaaauucauuugaaagucugauggcuuuuacaauaaaagauau

SEQ ID NO: 609398 - RNA, 64 nt, Homo Sapiens
aaguuggucacagccugcaaaugacuucauuuggaagucugauuguuucaguugccugacaaau

SEQ ID NO: 609399 - RNA, 64 nt, Homo Sapiens
gagcgaaugucugccaacuacccguucauuauauaagucugaacuugguaauauauggcuaaug

SEQ ID NO: 609400 - RNA, 64 nt, Homo Sapiens; identical to SEQ ID NO: 105714

SEQ ID NO: 609401 - RNA, 64 nt, Homo Sapiens; identical to SEQ ID NO: 105715

SEQ ID NO: 609402 - RNA, 64 nt, Homo Sapiens; identical to SEQ ID NO: 105716

SEQ ID NO: 609403 - RNA, 64 nt, Homo Sapiens; identical to SEQ ID NO: 105717

SEQ ID NO: 609404 - RNA, 64 nt, Homo Sapiens; identical to SEQ ID NO: 105718

SEQ ID NO: 609405 - RNA, 64 nt, Homo Sapiens; identical to SEQ ID NO: 105719

SEQ ID NO: 609406 - RNA, 64 nt, Homo Sapiens; identical to SEQ ID NO: 105720

SEQ ID NO: 609407 - RNA, 64 nt, Homo Sapiens; identical to SEQ ID NO: 105721

SEQ ID NO: 609408 - RNA, 64 nt, Homo Sapiens; identical to SEQ ID NO: 105722

SEQ ID NO: 609409 - RNA, 64 nt, Homo Sapiens; identical to SEQ ID NO: 105723

SEQ ID NO: 609410 - RNA, 64 nt, Homo Sapiens; identical to SEQ ID NO: 105724

SEQ ID NO: 609411 - RNA, 64 nt, Homo Sapiens; identical to SEQ ID NO: 105725

SEQ ID NO: 609412 - RNA, 64 nt, Homo Sapiens; identical to SEQ ID NO: 105726

SEQ ID NO: 609413 - RNA, 64 nt, Homo Sapiens; identical to SEQ ID NO: 105727

SEQ ID NO: 609414 - RNA, 64 nt, Homo Sapiens; identical to SEQ ID NO: 105728

SEQ ID NO: 609415 - RNA, 64 nt, Homo Sapiens; identical to SEQ ID NO: 105729

SEQ ID NO: 609416 - RNA, 64 nt, Homo Sapiens; identical to SEQ ID NO: 105730

SEQ ID NO: 609417 - RNA, 64 nt, Homo Sapiens; identical to SEQ ID NO: 105731

SEQ ID NO: 609418 - RNA, 64 nt, Homo Sapiens; identical to SEQ ID NO: 105732

SEQ ID NO: 609419 - RNA, 64 nt, Homo Sapiens; identical to SEQ ID NO: 105733

SEQ ID NO: 609420 - RNA, 64 nt, Homo Sapiens; identical to SEQ ID NO: 105734

SEQ ID NO: 609421 - RNA, 64 nt, Homo Sapiens; identical to SEQ ID NO: 105735

SEQ ID NO: 609422 - RNA, 64 nt, Homo Sapiens; identical to SEQ ID NO: 105736

SEQ ID NO: 609423 - RNA, 64 nt, Homo Sapiens; identical to SEQ ID NO: 105737

SEQ ID NO: 609424 - RNA, 64 nt, Homo Sapiens; identical to SEQ ID NO: 105738

SEQ ID NO: 609425 - RNA, 64 nt, Homo Sapiens; identical to SEQ ID NO: 105739

SEQ ID NO: 609426 - RNA, 64 nt, Homo Sapiens; identical to SEQ ID NO: 105740

SEQ ID NO: 609427 - RNA, 64 nt, Homo Sapiens; identical to SEQ ID NO: 105741

SEQ ID NO: 609428 - RNA, 64 nt, Homo Sapiens; identical to SEQ ID NO: 105742

SEQ ID NO: 609429 - RNA, 64 nt, Homo Sapiens; identical to SEQ ID NO: 105743

SEQ ID NO: 609430 - RNA, 64 nt, Homo Sapiens; identical to SEQ ID NO: 105744

SEQ ID NO: 609431 - RNA, 64 nt, Homo Sapiens; identical to SEQ ID NO: 105745

SEQ ID NO: 609432 - RNA, 64 nt, Homo Sapiens; identical to SEQ ID NO: 105746

SEQ ID NO: 609433 - RNA, 64 nt, Homo Sapiens; identical to SEQ ID NO: 105747

SEQ ID NO: 609434 - RNA, 64 nt, Homo Sapiens; identical to SEQ ID NO: 105748

SEQ ID NO: 609435 - RNA, 64 nt, Homo Sapiens; identical to SEQ ID NO: 105749

SEQ ID NO: 609436 - RNA, 64 nt, Homo Sapiens; identical to SEQ ID NO: 105750

SEQ ID NO: 609437 - RNA, 64 nt, Homo Sapiens; identical to SEQ ID NO: 105751

SEQ ID NO: 609438 - RNA, 64 nt, Homo Sapiens; identical to SEQ ID NO: 105752

SEQ ID NO: 609439 - RNA, 64 nt, Homo Sapiens; identical to SEQ ID NO: 105753

SEQ ID NO: 609440 - RNA, 64 nt, Homo Sapiens; identical to SEQ ID NO: 105754

SEQ ID NO: 609441 - RNA, 64 nt, Homo Sapiens; identical to SEQ ID NO: 105755

SEQ ID NO: 609442 - RNA, 64 nt, Homo Sapiens; identical to SEQ ID NO: 105756

SEQ ID NO: 609443 - RNA, 64 nt, Homo Sapiens; identical to SEQ ID NO: 105757

SEQ ID NO: 609444 - RNA, 64 nt, Homo Sapiens; identical to SEQ ID NO: 105758

SEQ ID NO: 609445 - RNA, 64 nt, Homo Sapiens; identical to SEQ ID NO: 105759

SEQ ID NO: 609446 - RNA, 64 nt, Homo Sapiens; identical to SEQ ID NO: 105760

SEQ ID NO: 609447 - RNA, 64 nt, Homo Sapiens; identical to SEQ ID NO: 105761

SEQ ID NO: 609448 - RNA, 64 nt, Homo Sapiens; identical to SEQ ID NO: 105762

SEQ ID NO: 609449 - RNA, 64 nt, Homo Sapiens; identical to SEQ ID NO: 105763

SEQ ID NO: 609450 - RNA, 64 nt, Homo Sapiens; identical to SEQ ID NO: 105764

SEQ ID NO: 609451 - RNA, 64 nt, Homo Sapiens; identical to SEQ ID NO: 105765

SEQ ID NO: 609452 - RNA, 64 nt, Homo Sapiens; identical to SEQ ID NO: 105766

SEQ ID NO: 609453 - RNA, 64 nt, Homo Sapiens; identical to SEQ ID NO: 105767

SEQ ID NO: 609454 - RNA, 64 nt, Homo Sapiens; identical to SEQ ID NO: 105768

SEQ ID NO: 609455 - RNA, 64 nt, Homo Sapiens; identical to SEQ ID NO: 105769

SEQ ID NO: 609456 - RNA, 64 nt, Homo Sapiens; identical to SEQ ID NO: 105770

SEQ ID NO: 609457 - RNA, 64 nt, Homo Sapiens; identical to SEQ ID NO: 105771

SEQ ID NO: 609458 - RNA, 64 nt, Homo Sapiens; identical to SEQ ID NO: 105772

SEQ ID NO: 609459 - RNA, 64 nt, Homo Sapiens; identical to SEQ ID NO: 105773

SEQ ID NO: 609460 - RNA, 64 nt, Homo Sapiens; identical to SEQ ID NO: 105774

SEQ ID NO: 609461 - RNA, 64 nt, Homo Sapiens; identical to SEQ ID NO: 105775

SEQ ID NO: 609462 - RNA, 64 nt, Homo Sapiens; identical to SEQ ID NO: 105776

SEQ ID NO: 609463 - RNA, 64 nt, Homo Sapiens; identical to SEQ ID NO: 105777

SEQ ID NO: 609464 - RNA, 64 nt, Homo Sapiens; identical to SEQ ID NO: 105778

SEQ ID NO: 609465 - RNA, 64 nt, Homo Sapiens; identical to SEQ ID NO: 105779

SEQ ID NO: 609466 - RNA, 64 nt, Homo Sapiens; identical to SEQ ID NO: 105780

SEQ ID NO: 609467 - RNA, 64 nt, Homo Sapiens; identical to SEQ ID NO: 105781

SEQ ID NO: 609468 - RNA, 64 nt, Homo Sapiens; identical to SEQ ID NO: 105782

SEQ ID NO: 609469 - RNA, 64 nt, Homo Sapiens; identical to SEQ ID NO: 105783

SEQ ID NO: 609470 - RNA, 64 nt, Homo Sapiens; identical to SEQ ID NO: 105784

SEQ ID NO: 609471 - RNA, 64 nt, Homo Sapiens; identical to SEQ ID NO: 105785

SEQ ID NO: 609472 - RNA, 64 nt, Homo Sapiens; identical to SEQ ID NO: 105786

SEQ ID NO: 609473 - RNA, 64 nt, Homo Sapiens; identical to SEQ ID NO: 105787

SEQ ID NO: 609474 - RNA, 64 nt, Homo Sapiens; identical to SEQ ID NO: 105788

SEQ ID NO: 609475 - RNA, 64 nt, Homo Sapiens; identical to SEQ ID NO: 105789

SEQ ID NO: 609476 - RNA, 60 nt, Homo Sapiens
cuuagguuccaagauuuuacuucaaauuacaccuucaaaacuggagcagcauauagccga

SEQ ID NO: 609477 - RNA, 60 nt, Homo Sapiens
aguuguuuuugaaauuuaacuuuuguuuguaccuucaauguguaaguacaugcauguuuu

SEQ ID NO: 609478 - RNA, 64 nt, Homo Sapiens; identical to SEQ ID NO: 354586

SEQ ID NO: 609479 - RNA, 64 nt, Homo Sapiens; identical to SEQ ID NO: 354587

SEQ ID NO: 609480 - RNA, 64 nt, Homo Sapiens; identical to SEQ ID NO: 354588

SEQ ID NO: 609481 - RNA, 64 nt, Homo Sapiens; identical to SEQ ID NO: 354589

SEQ ID NO: 609482 - RNA, 64 nt, Homo Sapiens; identical to SEQ ID NO: 354590

SEQ ID NO: 609483 - RNA, 64 nt, Homo Sapiens; identical to SEQ ID NO: 354591

SEQ ID NO: 609484 - RNA, 61 nt, Homo Sapiens; identical to SEQ ID NO: 354592

SEQ ID NO: 609485 - RNA, 64 nt, Homo Sapiens; identical to SEQ ID NO: 354593

SEQ ID NO: 609486 - RNA, 64 nt, Homo Sapiens; identical to SEQ ID NO: 354594

SEQ ID NO: 609487 - RNA, 64 nt, Homo Sapiens; identical to SEQ ID NO: 354595

SEQ ID NO: 609488 - RNA, 64 nt, Homo Sapiens; identical to SEQ ID NO: 354596

SEQ ID NO: 609489 - RNA, 64 nt, Homo Sapiens; identical to SEQ ID NO: 354597

SEQ ID NO: 609490 - RNA, 64 nt, Homo Sapiens; identical to SEQ ID NO: 354598

SEQ ID NO: 609491 - RNA, 64 nt, Homo Sapiens; identical to SEQ ID NO: 354599

SEQ ID NO: 609492 - RNA, 64 nt, Homo Sapiens; identical to SEQ ID NO: 354600

SEQ ID NO: 609493 - RNA, 64 nt, Homo Sapiens; identical to SEQ ID NO: 354601

SEQ ID NO: 609494 - RNA, 64 nt, Homo Sapiens; identical to SEQ ID NO: 354602

SEQ ID NO: 609495 - RNA, 64 nt, Homo Sapiens; identical to SEQ ID NO: 354603

SEQ ID NO: 609496 - RNA, 64 nt, Homo Sapiens; identical to SEQ ID NO: 354604

SEQ ID NO: 609497 - RNA, 64 nt, Homo Sapiens; identical to SEQ ID NO: 354605

SEQ ID NO: 609498 - RNA, 64 nt, Homo Sapiens; identical to SEQ ID NO: 354606

SEQ ID NO: 609499 - RNA, 64 nt, Homo Sapiens; identical to SEQ ID NO: 354607

SEQ ID NO: 609500 - RNA, 64 nt, Homo Sapiens; identical to SEQ ID NO: 354608

SEQ ID NO: 609501 - RNA, 64 nt, Homo Sapiens; identical to SEQ ID NO: 354609

SEQ ID NO: 609502 - RNA, 64 nt, Homo Sapiens; identical to SEQ ID NO: 354610

SEQ ID NO: 609503 - RNA, 64 nt, Homo Sapiens; identical to SEQ ID NO: 354611

SEQ ID NO: 609504 - RNA, 64 nt, Homo Sapiens; identical to SEQ ID NO: 354612

SEQ ID NO: 609505 - RNA, 64 nt, Homo Sapiens; identical to SEQ ID NO: 354613

SEQ ID NO: 609506 - RNA, 64 nt, Homo Sapiens; identical to SEQ ID NO: 354614

SEQ ID NO: 609507 - RNA, 64 nt, Homo Sapiens; identical to SEQ ID NO: 354615

SEQ ID NO: 609508 - RNA, 64 nt, Homo Sapiens; identical to SEQ ID NO: 354616

SEQ ID NO: 609509 - RNA, 64 nt, Homo Sapiens; identical to SEQ ID NO: 354617

SEQ ID NO: 609510 - RNA, 64 nt, Homo Sapiens; identical to SEQ ID NO: 354618

SEQ ID NO: 609511 - RNA, 64 nt, Homo Sapiens; identical to SEQ ID NO: 354619

SEQ ID NO: 609512 - RNA, 64 nt, Homo Sapiens; identical to SEQ ID NO: 354620

SEQ ID NO: 609513 - RNA, 64 nt, Homo Sapiens; identical to SEQ ID NO: 354621

SEQ ID NO: 609514 - RNA, 64 nt, Homo Sapiens; identical to SEQ ID NO: 354622

SEQ ID NO: 609515 - RNA, 64 nt, Homo Sapiens; identical to SEQ ID NO: 354623

SEQ ID NO: 609516 - RNA, 64 nt, Homo Sapiens; identical to SEQ ID NO: 354624

SEQ ID NO: 609517 - RNA, 64 nt, Homo Sapiens; identical to SEQ ID NO: 354625

SEQ ID NO: 609518 - RNA, 64 nt, Homo Sapiens; identical to SEQ ID NO: 106519

SEQ ID NO: 609519 - RNA, 64 nt, Homo Sapiens; identical to SEQ ID NO: 106520

SEQ ID NO: 609520 - RNA, 64 nt, Homo Sapiens; identical to SEQ ID NO: 106521

SEQ ID NO: 609521 - RNA, 64 nt, Homo Sapiens; identical to SEQ ID NO: 106522

SEQ ID NO: 609522 - RNA, 64 nt, Homo Sapiens; identical to SEQ ID NO: 106523

SEQ ID NO: 609523 - RNA, 64 nt, Homo Sapiens; identical to SEQ ID NO: 106524

SEQ ID NO: 609524 - RNA, 64 nt, Homo Sapiens; identical to SEQ ID NO: 106525

SEQ ID NO: 609525 - RNA, 64 nt, Homo Sapiens; identical to SEQ ID NO: 106526

SEQ ID NO: 609526 - RNA, 64 nt, Homo Sapiens; identical to SEQ ID NO: 106527

SEQ ID NO: 609527 - RNA, 64 nt, Homo Sapiens; identical to SEQ ID NO: 106528

SEQ ID NO: 609528 - RNA, 64 nt, Homo Sapiens; identical to SEQ ID NO: 106529

SEQ ID NO: 609529 - RNA, 64 nt, Homo Sapiens; identical to SEQ ID NO: 106530

SEQ ID NO: 609530 - RNA, 64 nt, Homo Sapiens; identical to SEQ ID NO: 106531

SEQ ID NO: 609531 - RNA, 64 nt, Homo Sapiens; identical to SEQ ID NO: 106532

SEQ ID NO: 609532 - RNA, 64 nt, Homo Sapiens; identical to SEQ ID NO: 106533

SEQ ID NO: 609533 - RNA, 64 nt, Homo Sapiens; identical to SEQ ID NO: 106534

SEQ ID NO: 609534 - RNA, 64 nt, Homo Sapiens; identical to SEQ ID NO: 106535

SEQ ID NO: 609535 - RNA, 64 nt, Homo Sapiens; identical to SEQ ID NO: 106536

SEQ ID NO: 609536 - RNA, 64 nt, Homo Sapiens; identical to SEQ ID NO: 106537

SEQ ID NO: 609537 - RNA, 64 nt, Homo Sapiens; identical to SEQ ID NO: 106538

SEQ ID NO: 609538 - RNA, 64 nt, Homo Sapiens; identical to SEQ ID NO: 106539

SEQ ID NO: 609539 - RNA, 64 nt, Homo Sapiens; identical to SEQ ID NO: 106540

SEQ ID NO: 609540 - RNA, 64 nt, Homo Sapiens; identical to SEQ ID NO: 106541

SEQ ID NO: 609541 - RNA, 64 nt, Homo Sapiens; identical to SEQ ID NO: 106542

SEQ ID NO: 609542 - RNA, 64 nt, Homo Sapiens; identical to SEQ ID NO: 106543

SEQ ID NO: 609543 - RNA, 64 nt, Homo Sapiens; identical to SEQ ID NO: 106544

SEQ ID NO: 609544 - RNA, 64 nt, Homo Sapiens; identical to SEQ ID NO: 106545

SEQ ID NO: 609545 - RNA, 64 nt, Homo Sapiens; identical to SEQ ID NO: 106546

SEQ ID NO: 609546 - RNA, 64 nt, Homo Sapiens; identical to SEQ ID NO: 106547

SEQ ID NO: 609547 - RNA, 64 nt, Homo Sapiens; identical to SEQ ID NO: 106548

SEQ ID NO: 609548 - RNA, 64 nt, Homo Sapiens; identical to SEQ ID NO: 106549

SEQ ID NO: 609549 - RNA, 64 nt, Homo Sapiens; identical to SEQ ID NO: 106550

SEQ ID NO: 609550 - RNA, 64 nt, Homo Sapiens; identical to SEQ ID NO: 106551

SEQ ID NO: 609551 - RNA, 64 nt, Homo Sapiens; identical to SEQ ID NO: 106552

SEQ ID NO: 609552 - RNA, 64 nt, Homo Sapiens; identical to SEQ ID NO: 106553

SEQ ID NO: 609553 - RNA, 64 nt, Homo Sapiens; identical to SEQ ID NO: 106554

SEQ ID NO: 609554 - RNA, 64 nt, Homo Sapiens; identical to SEQ ID NO: 106555

SEQ ID NO: 609555 - RNA, 64 nt, Homo Sapiens; identical to SEQ ID NO: 106556

SEQ ID NO: 609556 - RNA, 64 nt, Homo Sapiens; identical to SEQ ID NO: 106557

SEQ ID NO: 609557 - RNA, 64 nt, Homo Sapiens; identical to SEQ ID NO: 106558

SEQ ID NO: 609558 - RNA, 64 nt, Homo Sapiens; identical to SEQ ID NO: 106559

SEQ ID NO: 609559 - RNA, 64 nt, Homo Sapiens; identical to SEQ ID NO: 106560

SEQ ID NO: 609560 - RNA, 64 nt, Homo Sapiens; identical to SEQ ID NO: 106561

SEQ ID NO: 609561 - RNA, 64 nt, Homo Sapiens; identical to SEQ ID NO: 106562

SEQ ID NO: 609562 - RNA, 64 nt, Homo Sapiens; identical to SEQ ID NO: 106563

SEQ ID NO: 609563 - RNA, 64 nt, Homo Sapiens; identical to SEQ ID NO: 106564

SEQ ID NO: 609564 - RNA, 64 nt, Homo Sapiens; identical to SEQ ID NO: 106565

SEQ ID NO: 609565 - RNA, 64 nt, Homo Sapiens; identical to SEQ ID NO: 106566

SEQ ID NO: 609566 - RNA, 64 nt, Homo Sapiens; identical to SEQ ID NO: 106567

SEQ ID NO: 609567 - RNA, 64 nt, Homo Sapiens; identical to SEQ ID NO: 106568

SEQ ID NO: 609568 - RNA, 64 nt, Homo Sapiens; identical to SEQ ID NO: 106569

SEQ ID NO: 609569 - RNA, 64 nt, Homo Sapiens; identical to SEQ ID NO: 106570

SEQ ID NO: 609570 - RNA, 64 nt, Homo Sapiens; identical to SEQ ID NO: 106571

SEQ ID NO: 609571 - RNA, 64 nt, Homo Sapiens; identical to SEQ ID NO: 106572

SEQ ID NO: 609572 - RNA, 64 nt, Homo Sapiens; identical to SEQ ID NO: 106573

SEQ ID NO: 609573 - RNA, 64 nt, Homo Sapiens; identical to SEQ ID NO: 106574

SEQ ID NO: 609574 - RNA, 64 nt, Homo Sapiens; identical to SEQ ID NO: 106575

SEQ ID NO: 609575 - RNA, 64 nt, Homo Sapiens; identical to SEQ ID NO: 106576

SEQ ID NO: 609576 - RNA, 64 nt, Homo Sapiens; identical to SEQ ID NO: 106577

SEQ ID NO: 609577 - RNA, 64 nt, Homo Sapiens; identical to SEQ ID NO: 106578

SEQ ID NO: 609578 - RNA, 64 nt, Homo Sapiens; identical to SEQ ID NO: 106579

SEQ ID NO: 609579 - RNA, 64 nt, Homo Sapiens; identical to SEQ ID NO: 106580

SEQ ID NO: 609580 - RNA, 64 nt, Homo Sapiens; identical to SEQ ID NO: 106581

SEQ ID NO: 609581 - RNA, 64 nt, Homo Sapiens; identical to SEQ ID NO: 106582

SEQ ID NO: 609582 - RNA, 64 nt, Homo Sapiens; identical to SEQ ID NO: 106583

SEQ ID NO: 609583 - RNA, 64 nt, Homo Sapiens; identical to SEQ ID NO: 106584

SEQ ID NO: 609584 - RNA, 64 nt, Homo Sapiens; identical to SEQ ID NO: 106585

SEQ ID NO: 609585 - RNA, 64 nt, Homo Sapiens; identical to SEQ ID NO: 106586

SEQ ID NO: 609586 - RNA, 64 nt, Homo Sapiens; identical to SEQ ID NO: 106587

SEQ ID NO: 609587 - RNA, 64 nt, Homo Sapiens; identical to SEQ ID NO: 106588

SEQ ID NO: 609588 - RNA, 64 nt, Homo Sapiens; identical to SEQ ID NO: 106589

SEQ ID NO: 609589 - RNA, 64 nt, Homo Sapiens; identical to SEQ ID NO: 106590

SEQ ID NO: 609590 - RNA, 64 nt, Homo Sapiens; identical to SEQ ID NO: 106591

SEQ ID NO: 609591 - RNA, 64 nt, Homo Sapiens; identical to SEQ ID NO: 106592

SEQ ID NO: 609592 - RNA, 64 nt, Homo Sapiens; identical to SEQ ID NO: 106593

SEQ ID NO: 609593 - RNA, 64 nt, Homo Sapiens; identical to SEQ ID NO: 106594

SEQ ID NO: 609594 - RNA, 64 nt, Homo Sapiens; identical to SEQ ID NO: 106595

SEQ ID NO: 609595 - RNA, 64 nt, Homo Sapiens; identical to SEQ ID NO: 106596

SEQ ID NO: 609596 - RNA, 64 nt, Homo Sapiens; identical to SEQ ID NO: 106597

SEQ ID NO: 609597 - RNA, 64 nt, Homo Sapiens; identical to SEQ ID NO: 106598

SEQ ID NO: 609598 - RNA, 64 nt, Homo Sapiens; identical to SEQ ID NO: 106599

SEQ ID NO: 609599 - RNA, 64 nt, Homo Sapiens; identical to SEQ ID NO: 106600

SEQ ID NO: 609600 - RNA, 64 nt, Homo Sapiens; identical to SEQ ID NO: 106601

SEQ ID NO: 609601 - RNA, 64 nt, Homo Sapiens; identical to SEQ ID NO: 106602

SEQ ID NO: 609602 - RNA, 64 nt, Homo Sapiens; identical to SEQ ID NO: 106603

SEQ ID NO: 609603 - RNA, 64 nt, Homo Sapiens; identical to SEQ ID NO: 106604

SEQ ID NO: 609604 - RNA, 64 nt, Homo Sapiens; identical to SEQ ID NO: 106605

SEQ ID NO: 609605 - RNA, 64 nt, Homo Sapiens; identical to SEQ ID NO: 106606

SEQ ID NO: 609606 - RNA, 64 nt, Homo Sapiens; identical to SEQ ID NO: 106607

SEQ ID NO: 609607 - RNA, 64 nt, Homo Sapiens; identical to SEQ ID NO: 106608

SEQ ID NO: 609608 - RNA, 64 nt, Homo Sapiens; identical to SEQ ID NO: 106609

SEQ ID NO: 609609 - RNA, 64 nt, Homo Sapiens; identical to SEQ ID NO: 106610

SEQ ID NO: 609610 - RNA, 64 nt, Homo Sapiens; identical to SEQ ID NO: 106611

SEQ ID NO: 609611 - RNA, 64 nt, Homo Sapiens; identical to SEQ ID NO: 106612

SEQ ID NO: 609612 - RNA, 64 nt, Homo Sapiens
ccugcugaaguuucuuauuuaauuccagaguacuguccucuacucuaaggcauuacuuuuaagu

SEQ ID NO: 609613 - RNA, 64 nt, Homo Sapiens
uuuaacuagacuacacucuauugaguuuaauuuuguccucuaggauuuauuucuguuguccaaa

SEQ ID NO: 609614 - RNA, 64 nt, Homo Sapiens
uuaguugcaggggaaguuugggauauaccccaaaguccucuacccccucacuuuuauggcccuu

SEQ ID NO: 609615 - RNA, 64 nt, Homo Sapiens
guuacaugccugguuacaugggccuggacagcauguccucuaccugugacuucucauuuuccug

SEQ ID NO: 609616 - RNA, 64 nt, Homo Sapiens
uucauuuuccgcgcauccacuuguugcaguccaaguccucuagugcaacgccauagcaaauaua

SEQ ID NO: 609617 - RNA, 64 nt, Homo Sapiens
aaacacacuauaguauucccuuauuguagccaugguccucuagaugcaguuaaccaaauagggu

SEQ ID NO: 609618 - RNA, 64 nt, Homo Sapiens
cuugauuuauauuauaugugauuuaaaaaccaaaguccucuacagcuccaauuauauuuuuaac

SEQ ID NO: 609619 - RNA, 64 nt, Homo Sapiens
uuuagauuaugagcccugagaaaaauucuguaauguccucuagauuugaaaacucuuagaaaaa

SEQ ID NO: 609620 - RNA, 64 nt, Homo Sapiens
guuucauguacauucugugggggaaaaacaugcaguccucuaguuuugucuuacgcuucucuca

SEQ ID NO: 609621 - RNA, 64 nt, Homo Sapiens
uaggguagcuucugucagggugaagaccuacuuuguccucuacaguaaaccaacuaauauuuau

SEQ ID NO: 609622 - RNA, 64 nt, Homo Sapiens
gggacggguucaucugaguagggggugggauuguguccucuaaggucguggaguuggggggguu

SEQ ID NO: 609623 - RNA, 64 nt, Homo Sapiens
uugaaauccauaaguuaacacccguaguuacaguguccucuaaucuccaugugucuuaugagag

SEQ ID NO: 609624 - RNA, 64 nt, Homo Sapiens
acuuuugauaccaauuuuuauauaaagaaauuagguccucuauuuauuuuuuaaaacauggaau

SEQ ID NO: 609625 - RNA, 64 nt, Homo Sapiens
aggccauccaguccuucgagaugaagacccagcaguccucuacgguucacuugcccugacgagu

SEQ ID NO: 609626 - RNA, 64 nt, Homo Sapiens
ucauuguucaagguguaacaacauuuaauugcauguccucuaacgcuuugaaaccuuuagaggg

SEQ ID NO: 609627 - RNA, 64 nt, Homo Sapiens
ugaguuucuggcgccccugcccugaagcugcuguguccucuagucggcggaauucaccaguguu

SEQ ID NO: 609628 - RNA, 64 nt, Homo Sapiens
aucuaggugcucccacccaccauggcguuuuauaguccucuaaaaaaauuucaaacaaaguaaa

SEQ ID NO: 609629 - RNA, 64 nt, Homo Sapiens
ccagaguuuacuccaccugcagccuccgucaaccguccucuaaucaucccggggagggcccggg

SEQ ID NO: 609630 - RNA, 64 nt, Homo Sapiens
gguuaggaucuuggguaugucuuggaauuaacuuguccucuaacaaucuucaugggguauggcu

SEQ ID NO: 609631 - RNA, 64 nt, Homo Sapiens
uauccaugguggucuggucccugccuuuuaauccguccucuacgcuugggcuuuucuguuacca

SEQ ID NO: 609632 - RNA, 64 nt, Homo Sapiens
ggagccugggucagccucagcagccuauccccauguccucuaugccccuaauuugcuuccucau

SEQ ID NO: 609633 - RNA, 64 nt, Homo Sapiens
guacucaucggcaggcgcaugaguaucugugggaguccucuagagagaugagaagccaggaggc

SEQ ID NO: 609634 - RNA, 64 nt, Homo Sapiens
cacgggggagaguggcugugccuugagaguaggcguccucuaacuuaacagcagauccagaaga

SEQ ID NO: 609635 - RNA, 64 nt, Homo Sapiens
gcaaugaucucagggcucaggccauuggaagacuguccucuaugaaacgggcaaugcugugaga

SEQ ID NO: 609636 - RNA, 64 nt, Homo Sapiens
gccccucauuguuuuugauuguguaauggaugugguccucuaaacuggacucaguugcuuauuu

SEQ ID NO: 609637 - RNA, 64 nt, Homo Sapiens
uaaugagauaguagcauacauaugguuucuccagguccucuacugcuuggguuuuuguuaccuu

SEQ ID NO: 609638 - RNA, 64 nt, Homo Sapiens
gguaauaauguguguacuccuaaaucuuuaugcuguccucuaaagacaaacacaaacucucaga

SEQ ID NO: 609639 - RNA, 64 nt, Homo Sapiens
caguaauuuuuagaagcaagaagaaagccauuguguccucuacaauuaacaaaacuuaucucug

SEQ ID NO: 609640 - RNA, 64 nt, Homo Sapiens
aauaaauuuacuuucccuuuuucuaucaccuuauguccucuaccauuuucuccuuccucccuuc

SEQ ID NO: 609641 - RNA, 64 nt, Homo Sapiens
caggcagggugcuccuggugaagcugacccagugguccucuagguuggaguggggagaugcggg

SEQ ID NO: 609642 - RNA, 64 nt, Homo Sapiens
uaccacacuuaaaagaugguuuauauugaggccuguccucuacaacaaaagauaugaagaacua

SEQ ID NO: 609643 - RNA, 64 nt, Homo Sapiens
ucucuaucauauacuuauucgaaacaaaaccaguguccucuaagcacagggauguagauaaguu

SEQ ID NO: 609644 - RNA, 64 nt, Homo Sapiens
caaaaucauauuccacagauuauauuucauagaaguccucuauuaauauuuuuaagauuugaaa

SEQ ID NO: 609645 - RNA, 64 nt, Homo Sapiens
uguaauuuuccugcuacuuuaucauuuucaagauguccucuaggaauuuuuuuucuaguaauuu

SEQ ID NO: 609646 - RNA, 64 nt, Homo Sapiens
acacacuguacacauaagccaaaacugagcauaaguccucuagugaauguaggcuggcuuucag

SEQ ID NO: 609647 - RNA, 64 nt, Homo Sapiens
guaaaaaagaaaugaaaaucugcuggccagcuauguccucuaggaaaugacagacccaaccacc

SEQ ID NO: 609648 - RNA, 64 nt, Homo Sapiens
uuaugugguguuauaugaagguacugagucacaaguccucuagugcucuuguugguuugaagau

SEQ ID NO: 609649 - RNA, 64 nt, Homo Sapiens
auggauguauauuggagaagugugagacuuuauuguccucuaggguuauauuggaaaucaugac

SEQ ID NO: 609650 - RNA, 64 nt, Homo Sapiens
aggaugugaaaaacuagggacucuaaaggcuuuuguccucuaugaaaggguugaauugauggau

SEQ ID NO: 609651 - RNA, 64 nt, Homo Sapiens
uaauuuuagguacugaagaaacuguaauauugcuguccucuaauagaauugaugcaccauugcc

SEQ ID NO: 609652 - RNA, 64 nt, Homo Sapiens
uguguuccguuugaccagcacagaaauauuaaacguccucuauucaccgggcccuguguguguc

SEQ ID NO: 609653 - RNA, 64 nt, Homo Sapiens
aaggacccucaggacacccucucugcacccugugguccucuagaguagcuagcucugaggcccc

SEQ ID NO: 609654 - RNA, 63 nt, Homo Sapiens
ucucagaaaggccucuguagagccucaaguccaguccucuaucacuuuugcaugaauuaaagu

SEQ ID NO: 609655 - RNA, 64 nt, Homo Sapiens
gugcacuuguacaguuguagcugcgaguccagaaguccucuagagcauguguacuggcacugag

SEQ ID NO: 609656 - RNA, 64 nt, Homo Sapiens
aaaacagcaaaguugacuaaauuuuauauuucuuguccucuaaauauuuugauaauuucuggau

SEQ ID NO: 609657 - RNA, 64 nt, Homo Sapiens
ugaaucuuuuugagagaaccuuauauuuuauauaguccucuagcuacacuauugcauuguucag

SEQ ID NO: 609658 - RNA, 64 nt, Homo Sapiens
ucaugcuguccuugugauuacuguugaugccaguguccucuaacggugugcacggcuguggcag

SEQ ID NO: 609659 - RNA, 64 nt, Homo Sapiens
acucuguacuacccaacaacuguuauaucagacaguccucuauaguucuucuuuaaccacauuu

SEQ ID NO: 609660 - RNA, 64 nt, Homo Sapiens
ggaagaaauaguaggcuccgaguggagaaaugguguccucuaguuaaacgacuacagacuuagu

SEQ ID NO: 609661 - RNA, 64 nt, Homo Sapiens
aggcgcccggugcagauggccccgggcggcccagguccucuacugugaaggagcagggagcugc

SEQ ID NO: 609662 - RNA, 64 nt, Homo Sapiens
caucucuuccucacacccauuuagugggggauggguccucuagacuugaggggcuacccuggga

SEQ ID NO: 609663 - RNA, 64 nt, Homo Sapiens
ggaaaauuugggaguuuguuaaaauccuauacguguccucuauuucuauguguaacaucaaagc

SEQ ID NO: 609664 - RNA, 64 nt, Homo Sapiens
cacuugugauuccuauucgauugccuuccuucauguccucuacauggcuugguagcucugggau

SEQ ID NO: 609665 - RNA, 64 nt, Homo Sapiens
auccugcacugugagcagcagguugcauguuucaguccucuacccuuuaccaaguaagguguaa

SEQ ID NO: 609666 - RNA, 64 nt, Homo Sapiens
acugaaaccgaaacgaaaaaucaacaaacacucuguccucuaucccuccaaagaaugaaaauca

SEQ ID NO: 609667 - RNA, 64 nt, Homo Sapiens
gugucuccccuugguauaacugauuuccuuuuuaguccucuacugcuaaauaaguuaauuuugc

SEQ ID NO: 609668 - RNA, 64 nt, Homo Sapiens
uggccuggccggcaggcgucuucuuaacuccucuguccucuauauucagcauguuccuugucag

SEQ ID NO: 609669 - RNA, 64 nt, Homo Sapiens
auggauuccuuuuuaccgugucacauuuacuuugguccucuauguauuuaaauguuugaagugc

SEQ ID NO: 609670 - RNA, 64 nt, Homo Sapiens
gugcugccggaacucgggccuuuuuacgcgguucguccucuagugccuuuaacugcguuacuac

SEQ ID NO: 609671 - RNA, 64 nt, Homo Sapiens
uguuagcagcaaaauaugaaagaugagguggacaguccucuaagcccuauuuagggaagcuuuu

SEQ ID NO: 609672 - RNA, 64 nt, Homo Sapiens
caaugccuauacaacuaaauuuagugaaaacaguguccucuaacaaaguuguugaauauaaucc

SEQ ID NO: 609673 - RNA, 64 nt, Homo Sapiens
uucugucaaccugcaggaccgccuucccugaucuguccucuaacaaagccaccucuuccaggca

SEQ ID NO: 609674 - RNA, 64 nt, Homo Sapiens
ucugcauuucccuuccauucccaucacuagcacuguccucuaaugccccacccaguggggaagu

SEQ ID NO: 609675 - RNA, 64 nt, Homo Sapiens
uaggacucccucauuccuagucgugggcuuuuggguccucuaaccuaugagaucugaggaggcu

SEQ ID NO: 609676 - RNA, 64 nt, Homo Sapiens
aguugauugcuguauauuaauuccagauuucuuuguccucuaagcuguggcucaugcuacccaa

SEQ ID NO: 609677 - RNA, 64 nt, Homo Sapiens
guucugccuccccucuggucuccagaguuuuccuguccucuagaggcaagccaggccagggagc

SEQ ID NO: 609678 - RNA, 64 nt, Homo Sapiens
aacaacuaaacgauggaagagagagcgagcccggguccucuaaggcuccuuccuucuccccugg

SEQ ID NO: 609679 - RNA, 64 nt, Homo Sapiens
ccagaguuugcagccgaguagggacuccuccccuguccucuacgaaggaaaagauugcuauugu

SEQ ID NO: 609680 - RNA, 64 nt, Homo Sapiens
cuaguccucccccagccccuccagccaccaggguguccucuaggaugcagcugccagauccacu

SEQ ID NO: 609681 - RNA, 64 nt, Homo Sapiens
uuuccagggccccagccugauggggcugcccucaguccucuagaucaagaugcugacuauuagg

SEQ ID NO: 609682 - RNA, 64 nt, Homo Sapiens
uguggaauuuaacuuuucagagaaaauuuccaaaguccucuaccuuauuuggcuuuuaucugug

SEQ ID NO: 609683 - RNA, 64 nt, Homo Sapiens
uaaugcaauccuuaguccuacccugaaccuauguguccucuaagucaggcccugaucuagugca

SEQ ID NO: 609684 - RNA, 64 nt, Homo Sapiens
gcaaaaucugagugccacuacugggaagaagguaguccucuaaacacuuuuuggccagacuaca

SEQ ID NO: 609685 - RNA, 64 nt, Homo Sapiens
agcagcuggagauggccaaacgggccugagccacguccucuaggccaacccccugccccaggag

SEQ ID NO: 609686 - RNA, 64 nt, Homo Sapiens
gagguauugcgaguggacauuuggggagagaauuguccucuaaugguuuuuaaaauaaccuuuu

SEQ ID NO: 609687 - RNA, 64 nt, Homo Sapiens
gucgguaagcuagaggauuguaaauaucuuuuauguccucuagauaaaacacccgauuaacaga

SEQ ID NO: 609688 - RNA, 64 nt, Homo Sapiens
cuaaacucaggcgaccgugcugugugacaucauaguccucuacugcaugaagaaaagacucuac

SEQ ID NO: 609689 - RNA, 64 nt, Homo Sapiens
auuuuuauaagagaaauuucugcacuuugaaacuguccucuaagagaauaagcauuuccuguuc

SEQ ID NO: 609690 - RNA, 64 nt, Homo Sapiens
cacagcauuuuucuuuuugucucucuccaccccuguccucuagcuauuuuuguccuuuuuuucc

SEQ ID NO: 609691 - RNA, 64 nt, Homo Sapiens
ugccaggugcuucaccuguucuuuuuuauuuuauguccucuauaugcaauuauagaaacagcuc

SEQ ID NO: 609692 - RNA, 64 nt, Homo Sapiens
guugauuaauaugugaaaaggggaggcauuuacaguccucuaauuggauauuucuguauuacua

SEQ ID NO: 609693 - RNA, 64 nt, Homo Sapiens
cugccagcucacagcccccaugcaggugagcuguguccucuagggaacacuuucagagaccaug

SEQ ID NO: 609694 - RNA, 64 nt, Homo Sapiens
ugccccuaguucuuuguccugguggggugggagcguccucuagguugcuuccugcaccacaccu

SEQ ID NO: 609695 - RNA, 64 nt, Homo Sapiens
ucuauccuauccuaccaaauauuuauccuucucuguccucuauucucuuacucuccucucuccc

SEQ ID NO: 609696 - RNA, 64 nt, Homo Sapiens
cuccuuuacuaacauucauguuauggcaagaguuguccucuacauuggaaagcuaauccuaccu

SEQ ID NO: 609697 - RNA, 64 nt, Homo Sapiens
aggccuaagacaugugaggagcaacaucucgggaguccucuagcgggaucacuggcuggccuga

SEQ ID NO: 609698 - RNA, 64 nt, Homo Sapiens
ucagagucugaggauguuaacuuuggaacucgcaguccucuagaacagcuucagauuauggcuu

SEQ ID NO: 609699 - RNA, 64 nt, Homo Sapiens
auuuuuuuuuuuuguagaaaaugugaauuuuuugguccucuaauuuguuguugcccuguguacu

SEQ ID NO: 609700 - RNA, 64 nt, Homo Sapiens
uggguagacagggaggugcucaaccccagcucggguccucuagucugccuggcuaccaugcuuc

SEQ ID NO: 609701 - RNA, 64 nt, Homo Sapiens
uccaggaaacacagucuuuucuaugagacaaauaguccucuaguucaaguuugcuuaauaaaag

SEQ ID NO: 609702 - RNA, 64 nt, Homo Sapiens
ucaauuaacaucgugggucauacuuuugcaaacuguccucuacagggauuaagggcaaaucuau

SEQ ID NO: 609703 - RNA, 64 nt, Homo Sapiens
aauagguuaaacugaagcaauucugcauguacuaguccucuagaucauucccuguaguugacaa

SEQ ID NO: 609704 - RNA, 64 nt, Homo Sapiens
gccaggugcauuucaagugaagugugcugaugaaguccucuauaagguauuuauguucacauuu

SEQ ID NO: 609705 - RNA, 64 nt, Homo Sapiens
aaagcagggucugggcaggacucagcuccccagaguccucuaugaacuauggacggugcuccag

SEQ ID NO: 609706 - RNA, 64 nt, Homo Sapiens
gcagcucguuuuauugaaauucauaaucagggguguccucuagcucccacggucuccagagcag

SEQ ID NO: 609707 - RNA, 64 nt, Homo Sapiens
aaaugaagaacuaacaaaaaccaucauggaccagguccucuauaugaagugcaucuuuccaaga

SEQ ID NO: 609708 - RNA, 64 nt, Homo Sapiens
ugacuguauuuuucaguugccgauacagcuuuuuguccucuaacuguggaaacucuuuauguua

SEQ ID NO: 609709 - RNA, 64 nt, Homo Sapiens
agagccugagaccagguuuauuggggccuggccuguccucuaagucaaguuuaggaaaacaagg

SEQ ID NO: 609710 - RNA, 64 nt, Homo Sapiens
cuugucucggcuguaggaaucaacagaaggagacguccucuacauaaaagcuccaugugaaaag

SEQ ID NO: 609711 - RNA, 64 nt, Homo Sapiens
uuccugucucucuuccccuccucucucucuuccuguccucuaucucuuccccuccucuaucucu

SEQ ID NO: 609712 - RNA, 64 nt, Homo Sapiens
cagagggcugacccucucugcaaaacucuccccuguccucuagaccccacccuggguguaugug

SEQ ID NO: 609713 - RNA, 64 nt, Homo Sapiens
uucaucaccacuguagauuuugcugcaugugcagguccucuauuuuuaauugcuguuuucguug

SEQ ID NO: 609714 - RNA, 64 nt, Homo Sapiens
uuugaugaacccucaugcugcaccuucagagccaguccucuaguuuggaauaaaaauugcagag

SEQ ID NO: 609715 - RNA, 64 nt, Homo Sapiens
guguguaucucuccaauaaagcucugugggccaaguccucuaggacuccagucuguuaaugagg

SEQ ID NO: 609716 - RNA, 64 nt, Homo Sapiens
gccucgucucuaacugccgucguccugccucccuguccucuacugccgguagugucccuucucu

SEQ ID NO: 609717 - RNA, 64 nt, Homo Sapiens
ucagagccccgagucauuuccuacgugaccuuuaguccucuaccuucucuccaaggaguggggu

SEQ ID NO: 609718 - RNA, 64 nt, Homo Sapiens
ggugauacccucaccuugggcaauuuagcaggagguccucuacuaaacuggagcagaggaauug

SEQ ID NO: 609719 - RNA, 64 nt, Homo Sapiens
auggcuggggcggcgccccacaguguguauuccuguccucuauguuagagugcaucagaagcac

SEQ ID NO: 609720 - RNA, 64 nt, Homo Sapiens
aaauaccaaaggaacuuacgcaacacaccacugaguccucuaacuaaucauaugugcucagaca

SEQ ID NO: 609721 - RNA, 64 nt, Homo Sapiens
gcugagaugggaaugagccccuacacagaauggaguccucuagccuaaagauaucagcuguucc

SEQ ID NO: 609722 - RNA, 64 nt, Homo Sapiens
gaguccggcuucgggaaguggacccuccacgcucguccucuacaggggcugcccccacccgaaa

SEQ ID NO: 609723 - RNA, 64 nt, Homo Sapiens
ugggaucucaggaggcugcaugcagguuggcuggguccucuacucugugggucaagagccuggg

SEQ ID NO: 609724 - RNA, 64 nt, Homo Sapiens
ucaggaacacccccaugacagaggccuuaugaggguccucuacucugccccucucugggccuca

SEQ ID NO: 609725 - RNA, 64 nt, Homo Sapiens
gugugaauauaugaaaggagaaaaucuuccaacuguccucuagacaagaaaaaauaaaaguggg

SEQ ID NO: 609726 - RNA, 64 nt, Homo Sapiens
aagacauccggguacuacaucuacuuccuucugaguccucuacaccccacuuaagaccccuccu

SEQ ID NO: 609727 - RNA, 64 nt, Homo Sapiens
caguacccguugagauuuauccucagagcuccgaguccucuacuauagccaugagcuccaauua

SEQ ID NO: 609728 - RNA, 64 nt, Homo Sapiens
caucccugucucucccuuucacccuugcccuccaguccucuaccucuggccugccccuauuucu

SEQ ID NO: 609729 - RNA, 64 nt, Homo Sapiens
cucacugccuaggaggcuggccaagguguccaggguccucuagcccacucccugccuacacaca

SEQ ID NO: 609730 - RNA, 64 nt, Homo Sapiens
agugaccuaagcauaagugacaaguuugaggauaguccucuaagugaagaguucccugucaccu

SEQ ID NO: 609731 - RNA, 64 nt, Homo Sapiens
uuugggugggagggugggaaauuuggguuuuuaaguccucuaaacacacuugggcacggaaaug

SEQ ID NO: 609732 - RNA, 64 nt, Homo Sapiens
caugcuccuggccucucaagcaggaggagggaauguccucuaagccuaggggacacacagcuuc

SEQ ID NO: 609733 - RNA, 64 nt, Homo Sapiens
ucccaucuccugguucagccuagguguuucacugguccucuaugaaucccagcacuuauaaucc

SEQ ID NO: 609734 - RNA, 64 nt, Homo Sapiens
aaaaaacuuuuuuaaaaauuacauaaugagaccuguccucuaugauuucacgacaguccgggua

SEQ ID NO: 609735 - RNA, 64 nt, Homo Sapiens
uacauacauaguaucaauauuguuucaacuugauguccucuaagcuaucauccaguuacccaag

SEQ ID NO: 609736 - RNA, 64 nt, Homo Sapiens
uggcuauuccagcaccccaaccuguaauugccaaguccucuaagguacuaauuuguagcugcuc

SEQ ID NO: 609737 - RNA, 64 nt, Homo Sapiens
auaguacacaucagcauaugagaaucucugagagguccucuagaaaggagagaaaaagcaccuc

SEQ ID NO: 609738 - RNA, 64 nt, Homo Sapiens
uuccacagugacugggcccuguccagggcagugaguccucuacuuugcuccguggaggaagcug

SEQ ID NO: 609739 - RNA, 64 nt, Homo Sapiens
gguaugugaugccaacuuuuauauuucuugggcaguccucuacuuagcugaguucaaaaacuac

SEQ ID NO: 609740 - RNA, 64 nt, Homo Sapiens
uuguggccuucagaaaucaguuugacugugagacguccucuaguuuuccaagaaaugugaauua

SEQ ID NO: 609741 - RNA, 64 nt, Homo Sapiens; identical to SEQ ID NO: 526624

SEQ ID NO: 609742 - RNA, 64 nt, Homo Sapiens; identical to SEQ ID NO: 526625

SEQ ID NO: 609743 - RNA, 64 nt, Homo Sapiens; identical to SEQ ID NO: 526626

SEQ ID NO: 609744 - RNA, 64 nt, Homo Sapiens; identical to SEQ ID NO: 526627

SEQ ID NO: 609745 - RNA, 64 nt, Homo Sapiens; identical to SEQ ID NO: 526628

SEQ ID NO: 609746 - RNA, 64 nt, Homo Sapiens; identical to SEQ ID NO: 526629

SEQ ID NO: 609747 - RNA, 64 nt, Homo Sapiens; identical to SEQ ID NO: 526630

SEQ ID NO: 609748 - RNA, 64 nt, Homo Sapiens; identical to SEQ ID NO: 526631

SEQ ID NO: 609749 - RNA, 64 nt, Homo Sapiens; identical to SEQ ID NO: 526632

SEQ ID NO: 609750 - RNA, 64 nt, Homo Sapiens; identical to SEQ ID NO: 526633

SEQ ID NO: 609751 - RNA, 64 nt, Homo Sapiens; identical to SEQ ID NO: 526634

SEQ ID NO: 609752 - RNA, 64 nt, Homo Sapiens; identical to SEQ ID NO: 526635

SEQ ID NO: 609753 - RNA, 64 nt, Homo Sapiens; identical to SEQ ID NO: 526636

SEQ ID NO: 609754 - RNA, 64 nt, Homo Sapiens; identical to SEQ ID NO: 526637

SEQ ID NO: 609755 - RNA, 64 nt, Homo Sapiens; identical to SEQ ID NO: 526638

SEQ ID NO: 609756 - RNA, 64 nt, Homo Sapiens; identical to SEQ ID NO: 526639

SEQ ID NO: 609757 - RNA, 64 nt, Homo Sapiens; identical to SEQ ID NO: 526640

SEQ ID NO: 609758 - RNA, 64 nt, Homo Sapiens; identical to SEQ ID NO: 526641

SEQ ID NO: 609759 - RNA, 64 nt, Homo Sapiens; identical to SEQ ID NO: 526642

SEQ ID NO: 609760 - RNA, 64 nt, Homo Sapiens; identical to SEQ ID NO: 526643

SEQ ID NO: 609761 - RNA, 64 nt, Homo Sapiens; identical to SEQ ID NO: 526644

SEQ ID NO: 609762 - RNA, 64 nt, Homo Sapiens; identical to SEQ ID NO: 526645

SEQ ID NO: 609763 - RNA, 64 nt, Homo Sapiens; identical to SEQ ID NO: 526646

SEQ ID NO: 609764 - RNA, 64 nt, Homo Sapiens; identical to SEQ ID NO: 526647

SEQ ID NO: 609765 - RNA, 64 nt, Homo Sapiens; identical to SEQ ID NO: 526648

SEQ ID NO: 609766 - RNA, 64 nt, Homo Sapiens; identical to SEQ ID NO: 526649

SEQ ID NO: 609767 - RNA, 64 nt, Homo Sapiens; identical to SEQ ID NO: 526650

SEQ ID NO: 609768 - RNA, 64 nt, Homo Sapiens; identical to SEQ ID NO: 526651

SEQ ID NO: 609769 - RNA, 64 nt, Homo Sapiens; identical to SEQ ID NO: 526652

SEQ ID NO: 609770 - RNA, 64 nt, Homo Sapiens; identical to SEQ ID NO: 526653

SEQ ID NO: 609771 - RNA, 64 nt, Homo Sapiens; identical to SEQ ID NO: 526654

SEQ ID NO: 609772 - RNA, 64 nt, Homo Sapiens; identical to SEQ ID NO: 526655

SEQ ID NO: 609773 - RNA, 64 nt, Homo Sapiens; identical to SEQ ID NO: 526656

SEQ ID NO: 609774 - RNA, 64 nt, Homo Sapiens; identical to SEQ ID NO: 526657

SEQ ID NO: 609775 - RNA, 64 nt, Homo Sapiens; identical to SEQ ID NO: 526658

SEQ ID NO: 609776 - RNA, 64 nt, Homo Sapiens; identical to SEQ ID NO: 526659

SEQ ID NO: 609777 - RNA, 64 nt, Homo Sapiens; identical to SEQ ID NO: 526660

SEQ ID NO: 609778 - RNA, 64 nt, Homo Sapiens; identical to SEQ ID NO: 526661

SEQ ID NO: 609779 - RNA, 64 nt, Homo Sapiens; identical to SEQ ID NO: 526662

SEQ ID NO: 609780 - RNA, 64 nt, Homo Sapiens; identical to SEQ ID NO: 526663

SEQ ID NO: 609781 - RNA, 64 nt, Homo Sapiens; identical to SEQ ID NO: 526664

SEQ ID NO: 609782 - RNA, 64 nt, Homo Sapiens; identical to SEQ ID NO: 526665

SEQ ID NO: 609783 - RNA, 64 nt, Homo Sapiens; identical to SEQ ID NO: 526666

SEQ ID NO: 609784 - RNA, 64 nt, Homo Sapiens; identical to SEQ ID NO: 526667

SEQ ID NO: 609785 - RNA, 64 nt, Homo Sapiens; identical to SEQ ID NO: 526668

SEQ ID NO: 609786 - RNA, 64 nt, Homo Sapiens; identical to SEQ ID NO: 526669

SEQ ID NO: 609787 - RNA, 64 nt, Homo Sapiens; identical to SEQ ID NO: 526670

SEQ ID NO: 609788 - RNA, 64 nt, Homo Sapiens; identical to SEQ ID NO: 526671

SEQ ID NO: 609789 - RNA, 64 nt, Homo Sapiens; identical to SEQ ID NO: 526672

SEQ ID NO: 609790 - RNA, 64 nt, Homo Sapiens; identical to SEQ ID NO: 526673

SEQ ID NO: 609791 - RNA, 64 nt, Homo Sapiens; identical to SEQ ID NO: 526674

SEQ ID NO: 609792 - RNA, 64 nt, Homo Sapiens; identical to SEQ ID NO: 526675

SEQ ID NO: 609793 - RNA, 64 nt, Homo Sapiens; identical to SEQ ID NO: 526676

SEQ ID NO: 609794 - RNA, 64 nt, Homo Sapiens; identical to SEQ ID NO: 526677

SEQ ID NO: 609795 - RNA, 64 nt, Homo Sapiens; identical to SEQ ID NO: 526678

SEQ ID NO: 609796 - RNA, 64 nt, Homo Sapiens; identical to SEQ ID NO: 526679

SEQ ID NO: 609797 - RNA, 64 nt, Homo Sapiens; identical to SEQ ID NO: 526680

SEQ ID NO: 609798 - RNA, 64 nt, Homo Sapiens; identical to SEQ ID NO: 526681

SEQ ID NO: 609799 - RNA, 64 nt, Homo Sapiens; identical to SEQ ID NO: 526682

SEQ ID NO: 609800 - RNA, 64 nt, Homo Sapiens; identical to SEQ ID NO: 526683

SEQ ID NO: 609801 - RNA, 64 nt, Homo Sapiens; identical to SEQ ID NO: 526684

SEQ ID NO: 609802 - RNA, 64 nt, Homo Sapiens; identical to SEQ ID NO: 526685

SEQ ID NO: 609803 - RNA, 64 nt, Homo Sapiens; identical to SEQ ID NO: 526686

SEQ ID NO: 609804 - RNA, 64 nt, Homo Sapiens; identical to SEQ ID NO: 526687

SEQ ID NO: 609805 - RNA, 64 nt, Homo Sapiens; identical to SEQ ID NO: 526688

SEQ ID NO: 609806 - RNA, 64 nt, Homo Sapiens; identical to SEQ ID NO: 526689

SEQ ID NO: 609807 - RNA, 64 nt, Homo Sapiens; identical to SEQ ID NO: 526690

SEQ ID NO: 609808 - RNA, 64 nt, Homo Sapiens; identical to SEQ ID NO: 526691

SEQ ID NO: 609809 - RNA, 64 nt, Homo Sapiens; identical to SEQ ID NO: 526692

SEQ ID NO: 609810 - RNA, 64 nt, Homo Sapiens; identical to SEQ ID NO: 526693

SEQ ID NO: 609811 - RNA, 64 nt, Homo Sapiens; identical to SEQ ID NO: 526694

SEQ ID NO: 609812 - RNA, 64 nt, Homo Sapiens; identical to SEQ ID NO: 526695

SEQ ID NO: 609813 - RNA, 64 nt, Homo Sapiens; identical to SEQ ID NO: 526696

SEQ ID NO: 609814 - RNA, 64 nt, Homo Sapiens; identical to SEQ ID NO: 526697

SEQ ID NO: 609815 - RNA, 64 nt, Homo Sapiens; identical to SEQ ID NO: 526698

SEQ ID NO: 609816 - RNA, 64 nt, Homo Sapiens; identical to SEQ ID NO: 526699

SEQ ID NO: 609817 - RNA, 64 nt, Homo Sapiens; identical to SEQ ID NO: 526700

SEQ ID NO: 609818 - RNA, 64 nt, Homo Sapiens; identical to SEQ ID NO: 526701

SEQ ID NO: 609819 - RNA, 64 nt, Homo Sapiens; identical to SEQ ID NO: 526702

SEQ ID NO: 609820 - RNA, 64 nt, Homo Sapiens; identical to SEQ ID NO: 526703

SEQ ID NO: 609821 - RNA, 64 nt, Homo Sapiens; identical to SEQ ID NO: 526704

SEQ ID NO: 609822 - RNA, 64 nt, Homo Sapiens; identical to SEQ ID NO: 526705

SEQ ID NO: 609823 - RNA, 64 nt, Homo Sapiens; identical to SEQ ID NO: 526706

SEQ ID NO: 609824 - RNA, 64 nt, Homo Sapiens; identical to SEQ ID NO: 526707

SEQ ID NO: 609825 - RNA, 64 nt, Homo Sapiens; identical to SEQ ID NO: 526708

SEQ ID NO: 609826 - RNA, 64 nt, Homo Sapiens; identical to SEQ ID NO: 526709

SEQ ID NO: 609827 - RNA, 64 nt, Homo Sapiens; identical to SEQ ID NO: 526710

SEQ ID NO: 609828 - RNA, 64 nt, Homo Sapiens; identical to SEQ ID NO: 526711

SEQ ID NO: 609829 - RNA, 64 nt, Homo Sapiens; identical to SEQ ID NO: 526712

SEQ ID NO: 609830 - RNA, 64 nt, Homo Sapiens; identical to SEQ ID NO: 526713

SEQ ID NO: 609831 - RNA, 64 nt, Homo Sapiens; identical to SEQ ID NO: 526714

SEQ ID NO: 609832 - RNA, 64 nt, Homo Sapiens; identical to SEQ ID NO: 526715

SEQ ID NO: 609833 - RNA, 64 nt, Homo Sapiens; identical to SEQ ID NO: 526716

SEQ ID NO: 609834 - RNA, 64 nt, Homo Sapiens; identical to SEQ ID NO: 526717

SEQ ID NO: 609835 - RNA, 64 nt, Homo Sapiens; identical to SEQ ID NO: 526718

SEQ ID NO: 609836 - RNA, 64 nt, Homo Sapiens; identical to SEQ ID NO: 526719

SEQ ID NO: 609837 - RNA, 64 nt, Homo Sapiens; identical to SEQ ID NO: 526720

SEQ ID NO: 609838 - RNA, 64 nt, Homo Sapiens; identical to SEQ ID NO: 526721

SEQ ID NO: 609839 - RNA, 64 nt, Homo Sapiens; identical to SEQ ID NO: 526722

SEQ ID NO: 609840 - RNA, 64 nt, Homo Sapiens; identical to SEQ ID NO: 526723

SEQ ID NO: 609841 - RNA, 64 nt, Homo Sapiens; identical to SEQ ID NO: 526724

SEQ ID NO: 609842 - RNA, 64 nt, Homo Sapiens; identical to SEQ ID NO: 526725

SEQ ID NO: 609843 - RNA, 64 nt, Homo Sapiens; identical to SEQ ID NO: 526726

SEQ ID NO: 609844 - RNA, 64 nt, Homo Sapiens; identical to SEQ ID NO: 526727

SEQ ID NO: 609845 - RNA, 64 nt, Homo Sapiens; identical to SEQ ID NO: 526728

SEQ ID NO: 609846 - RNA, 64 nt, Homo Sapiens; identical to SEQ ID NO: 526729

SEQ ID NO: 609847 - RNA, 64 nt, Homo Sapiens; identical to SEQ ID NO: 526730

SEQ ID NO: 609848 - RNA, 64 nt, Homo Sapiens; identical to SEQ ID NO: 526731

SEQ ID NO: 609849 - RNA, 64 nt, Homo Sapiens; identical to SEQ ID NO: 526732

SEQ ID NO: 609850 - RNA, 64 nt, Homo Sapiens; identical to SEQ ID NO: 526733

SEQ ID NO: 609851 - RNA, 64 nt, Homo Sapiens; identical to SEQ ID NO: 526734

SEQ ID NO: 609852 - RNA, 64 nt, Homo Sapiens; identical to SEQ ID NO: 526735

SEQ ID NO: 609853 - RNA, 64 nt, Homo Sapiens; identical to SEQ ID NO: 526736

SEQ ID NO: 609854 - RNA, 64 nt, Homo Sapiens; identical to SEQ ID NO: 526737

SEQ ID NO: 609855 - RNA, 64 nt, Homo Sapiens; identical to SEQ ID NO: 526738

SEQ ID NO: 609856 - RNA, 64 nt, Homo Sapiens; identical to SEQ ID NO: 526739

SEQ ID NO: 609857 - RNA, 64 nt, Homo Sapiens; identical to SEQ ID NO: 526740

SEQ ID NO: 609858 - RNA, 64 nt, Homo Sapiens; identical to SEQ ID NO: 526741

SEQ ID NO: 609859 - RNA, 64 nt, Homo Sapiens; identical to SEQ ID NO: 526742

SEQ ID NO: 609860 - RNA, 64 nt, Homo Sapiens; identical to SEQ ID NO: 526743

SEQ ID NO: 609861 - RNA, 64 nt, Homo Sapiens; identical to SEQ ID NO: 526744

SEQ ID NO: 609862 - RNA, 64 nt, Homo Sapiens; identical to SEQ ID NO: 526745

SEQ ID NO: 609863 - RNA, 64 nt, Homo Sapiens; identical to SEQ ID NO: 526746

SEQ ID NO: 609864 - RNA, 64 nt, Homo Sapiens; identical to SEQ ID NO: 526747

SEQ ID NO: 609865 - RNA, 64 nt, Homo Sapiens; identical to SEQ ID NO: 526748

SEQ ID NO: 609866 - RNA, 64 nt, Homo Sapiens; identical to SEQ ID NO: 526749

SEQ ID NO: 609867 - RNA, 64 nt, Homo Sapiens; identical to SEQ ID NO: 526750

SEQ ID NO: 609868 - RNA, 64 nt, Homo Sapiens; identical to SEQ ID NO: 526751

SEQ ID NO: 609869 - RNA, 64 nt, Homo Sapiens; identical to SEQ ID NO: 526752

SEQ ID NO: 609870 - RNA, 64 nt, Homo Sapiens; identical to SEQ ID NO: 526753

SEQ ID NO: 609871 - RNA, 64 nt, Homo Sapiens; identical to SEQ ID NO: 526754

SEQ ID NO: 609872 - RNA, 64 nt, Homo Sapiens; identical to SEQ ID NO: 526755

SEQ ID NO: 609873 - RNA, 64 nt, Homo Sapiens; identical to SEQ ID NO: 526756

SEQ ID NO: 609874 - RNA, 64 nt, Homo Sapiens; identical to SEQ ID NO: 526757

SEQ ID NO: 609875 - RNA, 64 nt, Homo Sapiens; identical to SEQ ID NO: 526758

SEQ ID NO: 609876 - RNA, 64 nt, Homo Sapiens; identical to SEQ ID NO: 526759

SEQ ID NO: 609877 - RNA, 64 nt, Homo Sapiens; identical to SEQ ID NO: 526760

SEQ ID NO: 609878 - RNA, 64 nt, Homo Sapiens; identical to SEQ ID NO: 526761

SEQ ID NO: 609879 - RNA, 64 nt, Homo Sapiens; identical to SEQ ID NO: 526762

SEQ ID NO: 609880 - RNA, 64 nt, Homo Sapiens; identical to SEQ ID NO: 526763

SEQ ID NO: 609881 - RNA, 64 nt, Homo Sapiens; identical to SEQ ID NO: 526764

SEQ ID NO: 609882 - RNA, 64 nt, Homo Sapiens; identical to SEQ ID NO: 526765

SEQ ID NO: 609883 - RNA, 64 nt, Homo Sapiens; identical to SEQ ID NO: 526766

SEQ ID NO: 609884 - RNA, 64 nt, Homo Sapiens; identical to SEQ ID NO: 526767

SEQ ID NO: 609885 - RNA, 64 nt, Homo Sapiens; identical to SEQ ID NO: 526768

SEQ ID NO: 609886 - RNA, 64 nt, Homo Sapiens; identical to SEQ ID NO: 526769

SEQ ID NO: 609887 - RNA, 64 nt, Homo Sapiens; identical to SEQ ID NO: 526770

SEQ ID NO: 609888 - RNA, 64 nt, Homo Sapiens; identical to SEQ ID NO: 526771

SEQ ID NO: 609889 - RNA, 64 nt, Homo Sapiens; identical to SEQ ID NO: 526772

SEQ ID NO: 609890 - RNA, 64 nt, Homo Sapiens; identical to SEQ ID NO: 526773

SEQ ID NO: 609891 - RNA, 64 nt, Homo Sapiens; identical to SEQ ID NO: 526774

SEQ ID NO: 609892 - RNA, 64 nt, Homo Sapiens; identical to SEQ ID NO: 526775

SEQ ID NO: 609893 - RNA, 64 nt, Homo Sapiens; identical to SEQ ID NO: 526776

SEQ ID NO: 609894 - RNA, 64 nt, Homo Sapiens; identical to SEQ ID NO: 526777

SEQ ID NO: 609895 - RNA, 64 nt, Homo Sapiens; identical to SEQ ID NO: 526778

SEQ ID NO: 609896 - RNA, 64 nt, Homo Sapiens; identical to SEQ ID NO: 526779

SEQ ID NO: 609897 - RNA, 64 nt, Homo Sapiens; identical to SEQ ID NO: 526780

SEQ ID NO: 609898 - RNA, 64 nt, Homo Sapiens; identical to SEQ ID NO: 526781

SEQ ID NO: 609899 - RNA, 64 nt, Homo Sapiens; identical to SEQ ID NO: 526782

SEQ ID NO: 609900 - RNA, 64 nt, Homo Sapiens; identical to SEQ ID NO: 526783

SEQ ID NO: 609901 - RNA, 64 nt, Homo Sapiens; identical to SEQ ID NO: 526784

SEQ ID NO: 609902 - RNA, 64 nt, Homo Sapiens; identical to SEQ ID NO: 526785

SEQ ID NO: 609903 - RNA, 64 nt, Homo Sapiens; identical to SEQ ID NO: 526786

SEQ ID NO: 609904 - RNA, 64 nt, Homo Sapiens; identical to SEQ ID NO: 526787

SEQ ID NO: 609905 - RNA, 64 nt, Homo Sapiens; identical to SEQ ID NO: 526788

SEQ ID NO: 609906 - RNA, 64 nt, Homo Sapiens; identical to SEQ ID NO: 526789

SEQ ID NO: 609907 - RNA, 64 nt, Homo Sapiens; identical to SEQ ID NO: 526790

SEQ ID NO: 609908 - RNA, 64 nt, Homo Sapiens; identical to SEQ ID NO: 526791

SEQ ID NO: 609909 - RNA, 64 nt, Homo Sapiens; identical to SEQ ID NO: 526792

SEQ ID NO: 609910 - RNA, 64 nt, Homo Sapiens; identical to SEQ ID NO: 526793

SEQ ID NO: 609911 - RNA, 64 nt, Homo Sapiens; identical to SEQ ID NO: 526794

SEQ ID NO: 609912 - RNA, 64 nt, Homo Sapiens; identical to SEQ ID NO: 526795

SEQ ID NO: 609913 - RNA, 64 nt, Homo Sapiens; identical to SEQ ID NO: 526796

SEQ ID NO: 609914 - RNA, 64 nt, Homo Sapiens; identical to SEQ ID NO: 526797

SEQ ID NO: 609915 - RNA, 64 nt, Homo Sapiens; identical to SEQ ID NO: 526798

SEQ ID NO: 609916 - RNA, 64 nt, Homo Sapiens; identical to SEQ ID NO: 526799

SEQ ID NO: 609917 - RNA, 64 nt, Homo Sapiens; identical to SEQ ID NO: 526800

SEQ ID NO: 609918 - RNA, 64 nt, Homo Sapiens; identical to SEQ ID NO: 526801

SEQ ID NO: 609919 - RNA, 64 nt, Homo Sapiens; identical to SEQ ID NO: 526802

SEQ ID NO: 609920 - RNA, 64 nt, Homo Sapiens; identical to SEQ ID NO: 526803

SEQ ID NO: 609921 - RNA, 64 nt, Homo Sapiens; identical to SEQ ID NO: 526804

SEQ ID NO: 609922 - RNA, 64 nt, Homo Sapiens; identical to SEQ ID NO: 526805

SEQ ID NO: 609923 - RNA, 64 nt, Homo Sapiens; identical to SEQ ID NO: 526806

SEQ ID NO: 609924 - RNA, 64 nt, Homo Sapiens; identical to SEQ ID NO: 526807

SEQ ID NO: 609925 - RNA, 64 nt, Homo Sapiens; identical to SEQ ID NO: 526808

SEQ ID NO: 609926 - RNA, 64 nt, Homo Sapiens; identical to SEQ ID NO: 526809

SEQ ID NO: 609927 - RNA, 64 nt, Homo Sapiens; identical to SEQ ID NO: 526810

SEQ ID NO: 609928 - RNA, 64 nt, Homo Sapiens; identical to SEQ ID NO: 526811

SEQ ID NO: 609929 - RNA, 64 nt, Homo Sapiens; identical to SEQ ID NO: 526812

SEQ ID NO: 609930 - RNA, 64 nt, Homo Sapiens; identical to SEQ ID NO: 526813

SEQ ID NO: 609931 - RNA, 64 nt, Homo Sapiens; identical to SEQ ID NO: 526814

SEQ ID NO: 609932 - RNA, 64 nt, Homo Sapiens; identical to SEQ ID NO: 504627

SEQ ID NO: 609933 - RNA, 64 nt, Homo Sapiens; identical to SEQ ID NO: 504628

SEQ ID NO: 609934 - RNA, 64 nt, Homo Sapiens; identical to SEQ ID NO: 504629

SEQ ID NO: 609935 - RNA, 64 nt, Homo Sapiens; identical to SEQ ID NO: 504630

SEQ ID NO: 609936 - RNA, 64 nt, Homo Sapiens; identical to SEQ ID NO: 504631

SEQ ID NO: 609937 - RNA, 64 nt, Homo Sapiens; identical to SEQ ID NO: 504632

SEQ ID NO: 609938 - RNA, 64 nt, Homo Sapiens; identical to SEQ ID NO: 504633

SEQ ID NO: 609939 - RNA, 64 nt, Homo Sapiens; identical to SEQ ID NO: 504634

SEQ ID NO: 609940 - RNA, 64 nt, Homo Sapiens; identical to SEQ ID NO: 504635

SEQ ID NO: 609941 - RNA, 64 nt, Homo Sapiens; identical to SEQ ID NO: 504636

SEQ ID NO: 609942 - RNA, 64 nt, Homo Sapiens; identical to SEQ ID NO: 504637

SEQ ID NO: 609943 - RNA, 64 nt, Homo Sapiens; identical to SEQ ID NO: 504638

SEQ ID NO: 609944 - RNA, 64 nt, Homo Sapiens; identical to SEQ ID NO: 504639

SEQ ID NO: 609945 - RNA, 64 nt, Homo Sapiens; identical to SEQ ID NO: 504640

SEQ ID NO: 609946 - RNA, 64 nt, Homo Sapiens; identical to SEQ ID NO: 504641

SEQ ID NO: 609947 - RNA, 64 nt, Homo Sapiens; identical to SEQ ID NO: 504642

SEQ ID NO: 609948 - RNA, 64 nt, Homo Sapiens; identical to SEQ ID NO: 504643

SEQ ID NO: 609949 - RNA, 64 nt, Homo Sapiens; identical to SEQ ID NO: 504644

SEQ ID NO: 609950 - RNA, 64 nt, Homo Sapiens; identical to SEQ ID NO: 504645

SEQ ID NO: 609951 - RNA, 64 nt, Homo Sapiens; identical to SEQ ID NO: 504646

SEQ ID NO: 609952 - RNA, 64 nt, Homo Sapiens; identical to SEQ ID NO: 504647

SEQ ID NO: 609953 - RNA, 64 nt, Homo Sapiens; identical to SEQ ID NO: 504648

SEQ ID NO: 609954 - RNA, 64 nt, Homo Sapiens; identical to SEQ ID NO: 504649

SEQ ID NO: 609955 - RNA, 64 nt, Homo Sapiens; identical to SEQ ID NO: 504650

SEQ ID NO: 609956 - RNA, 64 nt, Homo Sapiens; identical to SEQ ID NO: 504651

SEQ ID NO: 609957 - RNA, 64 nt, Homo Sapiens; identical to SEQ ID NO: 504652

SEQ ID NO: 609958 - RNA, 64 nt, Homo Sapiens; identical to SEQ ID NO: 504653

SEQ ID NO: 609959 - RNA, 64 nt, Homo Sapiens; identical to SEQ ID NO: 504654

SEQ ID NO: 609960 - RNA, 64 nt, Homo Sapiens; identical to SEQ ID NO: 504655

SEQ ID NO: 609961 - RNA, 64 nt, Homo Sapiens; identical to SEQ ID NO: 504656

SEQ ID NO: 609962 - RNA, 64 nt, Homo Sapiens; identical to SEQ ID NO: 504657

SEQ ID NO: 609963 - RNA, 64 nt, Homo Sapiens; identical to SEQ ID NO: 504658

SEQ ID NO: 609964 - RNA, 64 nt, Homo Sapiens; identical to SEQ ID NO: 504659

SEQ ID NO: 609965 - RNA, 64 nt, Homo Sapiens; identical to SEQ ID NO: 504660

SEQ ID NO: 609966 - RNA, 64 nt, Homo Sapiens; identical to SEQ ID NO: 504661

SEQ ID NO: 609967 - RNA, 64 nt, Homo Sapiens; identical to SEQ ID NO: 504662

SEQ ID NO: 609968 - RNA, 64 nt, Homo Sapiens; identical to SEQ ID NO: 504663

SEQ ID NO: 609969 - RNA, 64 nt, Homo Sapiens; identical to SEQ ID NO: 504664

SEQ ID NO: 609970 - RNA, 64 nt, Homo Sapiens; identical to SEQ ID NO: 504665

SEQ ID NO: 609971 - RNA, 64 nt, Homo Sapiens; identical to SEQ ID NO: 504666

SEQ ID NO: 609972 - RNA, 64 nt, Homo Sapiens; identical to SEQ ID NO: 504667

SEQ ID NO: 609973 - RNA, 64 nt, Homo Sapiens; identical to SEQ ID NO: 504668

SEQ ID NO: 609974 - RNA, 64 nt, Homo Sapiens; identical to SEQ ID NO: 504669

SEQ ID NO: 609975 - RNA, 64 nt, Homo Sapiens; identical to SEQ ID NO: 504670

SEQ ID NO: 609976 - RNA, 64 nt, Homo Sapiens; identical to SEQ ID NO: 504671

SEQ ID NO: 609977 - RNA, 64 nt, Homo Sapiens; identical to SEQ ID NO: 504672

SEQ ID NO: 609978 - RNA, 64 nt, Homo Sapiens; identical to SEQ ID NO: 557304

SEQ ID NO: 609979 - RNA, 64 nt, Homo Sapiens; identical to SEQ ID NO: 557305

SEQ ID NO: 609980 - RNA, 64 nt, Homo Sapiens; identical to SEQ ID NO: 557306

SEQ ID NO: 609981 - RNA, 64 nt, Homo Sapiens; identical to SEQ ID NO: 557307

SEQ ID NO: 609982 - RNA, 64 nt, Homo Sapiens; identical to SEQ ID NO: 557308

SEQ ID NO: 609983 - RNA, 64 nt, Homo Sapiens; identical to SEQ ID NO: 557309

SEQ ID NO: 609984 - RNA, 64 nt, Homo Sapiens; identical to SEQ ID NO: 557310

SEQ ID NO: 609985 - RNA, 64 nt, Homo Sapiens; identical to SEQ ID NO: 557311

SEQ ID NO: 609986 - RNA, 64 nt, Homo Sapiens; identical to SEQ ID NO: 557312

SEQ ID NO: 609987 - RNA, 64 nt, Homo Sapiens; identical to SEQ ID NO: 557313

SEQ ID NO: 609988 - RNA, 64 nt, Homo Sapiens; identical to SEQ ID NO: 557314

SEQ ID NO: 609989 - RNA, 64 nt, Homo Sapiens; identical to SEQ ID NO: 557315

SEQ ID NO: 609990 - RNA, 64 nt, Homo Sapiens; identical to SEQ ID NO: 557316

SEQ ID NO: 609991 - RNA, 64 nt, Homo Sapiens; identical to SEQ ID NO: 557317

SEQ ID NO: 609992 - RNA, 64 nt, Homo Sapiens; identical to SEQ ID NO: 557318

SEQ ID NO: 609993 - RNA, 64 nt, Homo Sapiens; identical to SEQ ID NO: 557319

SEQ ID NO: 609994 - RNA, 64 nt, Homo Sapiens; identical to SEQ ID NO: 557320

SEQ ID NO: 609995 - RNA, 64 nt, Homo Sapiens; identical to SEQ ID NO: 557321

SEQ ID NO: 609996 - RNA, 64 nt, Homo Sapiens; identical to SEQ ID NO: 557322

SEQ ID NO: 609997 - RNA, 64 nt, Homo Sapiens; identical to SEQ ID NO: 557323

SEQ ID NO: 609998 - RNA, 64 nt, Homo Sapiens; identical to SEQ ID NO: 557324

SEQ ID NO: 609999 - RNA, 64 nt, Homo Sapiens; identical to SEQ ID NO: 557325

SEQ ID NO: 610000 - RNA, 64 nt, Homo Sapiens; identical to SEQ ID NO: 557326

SEQ ID NO: 610001 - RNA, 64 nt, Homo Sapiens; identical to SEQ ID NO: 557327

SEQ ID NO: 610002 - RNA, 64 nt, Homo Sapiens; identical to SEQ ID NO: 56362

SEQ ID NO: 610003 - RNA, 64 nt, Homo Sapiens; identical to SEQ ID NO: 56363

SEQ ID NO: 610004 - RNA, 64 nt, Homo Sapiens; identical to SEQ ID NO: 56364

SEQ ID NO: 610005 - RNA, 64 nt, Homo Sapiens; identical to SEQ ID NO: 56365

SEQ ID NO: 610006 - RNA, 64 nt, Homo Sapiens; identical to SEQ ID NO: 56366

SEQ ID NO: 610007 - RNA, 64 nt, Homo Sapiens; identical to SEQ ID NO: 56367

SEQ ID NO: 610008 - RNA, 64 nt, Homo Sapiens; identical to SEQ ID NO: 56368

SEQ ID NO: 610009 - RNA, 64 nt, Homo Sapiens; identical to SEQ ID NO: 56369

SEQ ID NO: 610010 - RNA, 64 nt, Homo Sapiens; identical to SEQ ID NO: 56370

SEQ ID NO: 610011 - RNA, 64 nt, Homo Sapiens; identical to SEQ ID NO: 56371

SEQ ID NO: 610012 - RNA, 64 nt, Homo Sapiens; identical to SEQ ID NO: 56372

SEQ ID NO: 610013 - RNA, 64 nt, Homo Sapiens; identical to SEQ ID NO: 56373

SEQ ID NO: 610014 - RNA, 64 nt, Homo Sapiens; identical to SEQ ID NO: 56374

SEQ ID NO: 610015 - RNA, 64 nt, Homo Sapiens; identical to SEQ ID NO: 56375

SEQ ID NO: 610016 - RNA, 64 nt, Homo Sapiens; identical to SEQ ID NO: 56376

SEQ ID NO: 610017 - RNA, 64 nt, Homo Sapiens; identical to SEQ ID NO: 56377

SEQ ID NO: 610018 - RNA, 64 nt, Homo Sapiens; identical to SEQ ID NO: 147194

SEQ ID NO: 610019 - RNA, 64 nt, Homo Sapiens; identical to SEQ ID NO: 147195

SEQ ID NO: 610020 - RNA, 64 nt, Homo Sapiens; identical to SEQ ID NO: 147196

SEQ ID NO: 610021 - RNA, 64 nt, Homo Sapiens; identical to SEQ ID NO: 147197

SEQ ID NO: 610022 - RNA, 64 nt, Homo Sapiens; identical to SEQ ID NO: 147198

SEQ ID NO: 610023 - RNA, 64 nt, Homo Sapiens; identical to SEQ ID NO: 147199

SEQ ID NO: 610024 - RNA, 64 nt, Homo Sapiens; identical to SEQ ID NO: 147200

SEQ ID NO: 610025 - RNA, 64 nt, Homo Sapiens; identical to SEQ ID NO: 147201

SEQ ID NO: 610026 - RNA, 64 nt, Homo Sapiens; identical to SEQ ID NO: 147202

SEQ ID NO: 610027 - RNA, 64 nt, Homo Sapiens; identical to SEQ ID NO: 147203

SEQ ID NO: 610028 - RNA, 64 nt, Homo Sapiens; identical to SEQ ID NO: 147204

SEQ ID NO: 610029 - RNA, 64 nt, Homo Sapiens; identical to SEQ ID NO: 147205

SEQ ID NO: 610030 - RNA, 64 nt, Homo Sapiens; identical to SEQ ID NO: 147206

SEQ ID NO: 610031 - RNA, 64 nt, Homo Sapiens; identical to SEQ ID NO: 147207

SEQ ID NO: 610032 - RNA, 64 nt, Homo Sapiens; identical to SEQ ID NO: 147208

SEQ ID NO: 610033 - RNA, 64 nt, Homo Sapiens; identical to SEQ ID NO: 147209

SEQ ID NO: 610034 - RNA, 64 nt, Homo Sapiens; identical to SEQ ID NO: 147210

SEQ ID NO: 610035 - RNA, 64 nt, Homo Sapiens; identical to SEQ ID NO: 147211

SEQ ID NO: 610036 - RNA, 64 nt, Homo Sapiens; identical to SEQ ID NO: 147212

SEQ ID NO: 610037 - RNA, 64 nt, Homo Sapiens; identical to SEQ ID NO: 147213

SEQ ID NO: 610038 - RNA, 64 nt, Homo Sapiens; identical to SEQ ID NO: 147214

SEQ ID NO: 610039 - RNA, 64 nt, Homo Sapiens; identical to SEQ ID NO: 147215

SEQ ID NO: 610040 - RNA, 64 nt, Homo Sapiens; identical to SEQ ID NO: 147216

SEQ ID NO: 610041 - RNA, 64 nt, Homo Sapiens; identical to SEQ ID NO: 147217

SEQ ID NO: 610042 - RNA, 64 nt, Homo Sapiens; identical to SEQ ID NO: 147218

SEQ ID NO: 610043 - RNA, 64 nt, Homo Sapiens; identical to SEQ ID NO: 147219

SEQ ID NO: 610044 - RNA, 64 nt, Homo Sapiens; identical to SEQ ID NO: 147220

SEQ ID NO: 610045 - RNA, 64 nt, Homo Sapiens; identical to SEQ ID NO: 147221

SEQ ID NO: 610046 - RNA, 64 nt, Homo Sapiens; identical to SEQ ID NO: 147222

SEQ ID NO: 610047 - RNA, 64 nt, Homo Sapiens; identical to SEQ ID NO: 147223

SEQ ID NO: 610048 - RNA, 64 nt, Homo Sapiens; identical to SEQ ID NO: 147224

SEQ ID NO: 610049 - RNA, 64 nt, Homo Sapiens; identical to SEQ ID NO: 147225

SEQ ID NO: 610050 - RNA, 64 nt, Homo Sapiens; identical to SEQ ID NO: 147226

SEQ ID NO: 610051 - RNA, 64 nt, Homo Sapiens; identical to SEQ ID NO: 147227

SEQ ID NO: 610052 - RNA, 64 nt, Homo Sapiens; identical to SEQ ID NO: 147228

SEQ ID NO: 610053 - RNA, 64 nt, Homo Sapiens; identical to SEQ ID NO: 147229

SEQ ID NO: 610054 - RNA, 64 nt, Homo Sapiens; identical to SEQ ID NO: 147230

SEQ ID NO: 610055 - RNA, 64 nt, Homo Sapiens; identical to SEQ ID NO: 147231

SEQ ID NO: 610056 - RNA, 64 nt, Homo Sapiens; identical to SEQ ID NO: 147232

SEQ ID NO: 610057 - RNA, 64 nt, Homo Sapiens; identical to SEQ ID NO: 147233

SEQ ID NO: 610058 - RNA, 64 nt, Homo Sapiens; identical to SEQ ID NO: 147234

SEQ ID NO: 610059 - RNA, 64 nt, Homo Sapiens; identical to SEQ ID NO: 147235

SEQ ID NO: 610060 - RNA, 64 nt, Homo Sapiens; identical to SEQ ID NO: 147236

SEQ ID NO: 610061 - RNA, 64 nt, Homo Sapiens; identical to SEQ ID NO: 147237

SEQ ID NO: 610062 - RNA, 64 nt, Homo Sapiens; identical to SEQ ID NO: 147238

SEQ ID NO: 610063 - RNA, 64 nt, Homo Sapiens; identical to SEQ ID NO: 147239

SEQ ID NO: 610064 - RNA, 64 nt, Homo Sapiens; identical to SEQ ID NO: 147240

SEQ ID NO: 610065 - RNA, 64 nt, Homo Sapiens; identical to SEQ ID NO: 147241

SEQ ID NO: 610066 - RNA, 64 nt, Homo Sapiens; identical to SEQ ID NO: 147242

SEQ ID NO: 610067 - RNA, 64 nt, Homo Sapiens; identical to SEQ ID NO: 147243

SEQ ID NO: 610068 - RNA, 64 nt, Homo Sapiens; identical to SEQ ID NO: 147244

SEQ ID NO: 610069 - RNA, 64 nt, Homo Sapiens; identical to SEQ ID NO: 147245

SEQ ID NO: 610070 - RNA, 64 nt, Homo Sapiens; identical to SEQ ID NO: 147246

SEQ ID NO: 610071 - RNA, 64 nt, Homo Sapiens; identical to SEQ ID NO: 147247

SEQ ID NO: 610072 - RNA, 64 nt, Homo Sapiens; identical to SEQ ID NO: 147248

SEQ ID NO: 610073 - RNA, 64 nt, Homo Sapiens; identical to SEQ ID NO: 147249

SEQ ID NO: 610074 - RNA, 64 nt, Homo Sapiens; identical to SEQ ID NO: 147250

SEQ ID NO: 610075 - RNA, 64 nt, Homo Sapiens; identical to SEQ ID NO: 147251

SEQ ID NO: 610076 - RNA, 64 nt, Homo Sapiens; identical to SEQ ID NO: 147252

SEQ ID NO: 610077 - RNA, 64 nt, Homo Sapiens; identical to SEQ ID NO: 147253

SEQ ID NO: 610078 - RNA, 64 nt, Homo Sapiens; identical to SEQ ID NO: 147254

SEQ ID NO: 610079 - RNA, 64 nt, Homo Sapiens; identical to SEQ ID NO: 147255

SEQ ID NO: 610080 - RNA, 64 nt, Homo Sapiens; identical to SEQ ID NO: 147256

SEQ ID NO: 610081 - RNA, 64 nt, Homo Sapiens; identical to SEQ ID NO: 147257

SEQ ID NO: 610082 - RNA, 64 nt, Homo Sapiens; identical to SEQ ID NO: 147258

SEQ ID NO: 610083 - RNA, 64 nt, Homo Sapiens; identical to SEQ ID NO: 147259

SEQ ID NO: 610084 - RNA, 64 nt, Homo Sapiens; identical to SEQ ID NO: 147260

SEQ ID NO: 610085 - RNA, 64 nt, Homo Sapiens; identical to SEQ ID NO: 147261

SEQ ID NO: 610086 - RNA, 64 nt, Homo Sapiens; identical to SEQ ID NO: 147262

SEQ ID NO: 610087 - RNA, 64 nt, Homo Sapiens; identical to SEQ ID NO: 147263

SEQ ID NO: 610088 - RNA, 64 nt, Homo Sapiens; identical to SEQ ID NO: 147264

SEQ ID NO: 610089 - RNA, 64 nt, Homo Sapiens; identical to SEQ ID NO: 147265

SEQ ID NO: 610090 - RNA, 64 nt, Homo Sapiens; identical to SEQ ID NO: 147266

SEQ ID NO: 610091 - RNA, 64 nt, Homo Sapiens
aacccagagggcugcauuuuggguugaguaauauggacaccauggaaguacaggaucugagucc

SEQ ID NO: 610092 - RNA, 64 nt, Homo Sapiens
caauagaaaccauucacacacuccguucaugcauggacaccagaagacgauucagaacacaaga

SEQ ID NO: 610093 - RNA, 64 nt, Homo Sapiens
cgaugcacucuggcaccaagcagagacucggccuggacaccaugccaggccucuaaccaucuga

SEQ ID NO: 610094 - RNA, 64 nt, Homo Sapiens
gagccugggagcacgcagagagcuccagcuguugggacaccaagacucccgugacucaucgagg

SEQ ID NO: 610095 - RNA, 64 nt, Homo Sapiens
aggcucaccggacccuggggcagagcugagcuugggacaccagcgggaacagggcaccccuucu

SEQ ID NO: 610096 - RNA, 64 nt, Homo Sapiens
gacuuccagaucaugguucucccuuccucccugaggacaccaaauuggaugagagcaaguuuga

SEQ ID NO: 610097 - RNA, 64 nt, Homo Sapiens
ccuugccugccguguccaggcgaauaaugcauauggacaccacagcugugaucuuugccccacc

SEQ ID NO: 610098 - RNA, 64 nt, Homo Sapiens
ccgugacagaggcagagggucagaugcauagggaggacaccaugggaagagggaaauucagaca

SEQ ID NO: 610099 - RNA, 64 nt, Homo Sapiens
cccaccaaguacgcagagacccccuugucguccuggacaccacaggggcaccugcaggcuggga

SEQ ID NO: 610100 - RNA, 64 nt, Homo Sapiens
gccugggccauggagcacucugagaucucaucgcggacaccacugcccacaccuccaucccguc

SEQ ID NO: 610101 - RNA, 64 nt, Homo Sapiens
agacacuaggaugggauggaagauggacaccaccggacaccaccauaauuugggaaggaaugga

SEQ ID NO: 610102 - RNA, 64 nt, Homo Sapiens
ggacaccaccagacacuaggaaggaauggaagauggacaccaccccuuacuuccauaauuuggg

SEQ ID NO: 610103 - RNA, 64 nt, Homo Sapiens
gaaccagaaggaggcugggcuggaaaagaaccaggccuggaaaaucaaaggugggaagagagcc

SEQ ID NO: 610104 - RNA, 64 nt, Homo Sapiens
gaaccaggccuggaaaagaaaaggugggaagagagccuggaaaagccucuucugucauuguuca

SEQ ID NO: 610105 - RNA, 64 nt, Homo Sapiens
uggcguuugucguuucuugcuuuaaauaaaaguggccuggaagccuguggggccgcugcuucug

SEQ ID NO: 610106 - RNA, 64 nt, Homo Sapiens
aggcagucuucuuagcaugguccaguaaaaucuugccuggaaagacacccuccgguuauguugc

SEQ ID NO: 610107 - RNA, 64 nt, Homo Sapiens
acggagugaccacugagaugcugggggucacugggccuggaagaccaucccagccucugaguuc

SEQ ID NO: 610108 - RNA, 64 nt, Homo Sapiens
aucacucuguggcagcucucccuggacuugcccugccuggaacagggugauuugcuggaaugga

SEQ ID NO: 610109 - RNA, 64 nt, Homo Sapiens
cugaguccuccuaugaaccuagucuccuuggagggccuggaacuuuaaaucaguuacaggccag

SEQ ID NO: 610110 - RNA, 64 nt, Homo Sapiens
guucacugucauugagcagccccucaucaucugugccuggaagaccaagucugagagcaacaga

SEQ ID NO: 610111 - RNA, 64 nt, Homo Sapiens
caucauggaugccauggauuaaaaaucaagagaagccuggaagaguuuggcuaaagguuggugu

SEQ ID NO: 610112 - RNA, 64 nt, Homo Sapiens
acccggcccacgcgugcugcugcagauguggggagccuggaaacaacacccggcccacgcgugc

SEQ ID NO: 610113 - RNA, 64 nt, Homo Sapiens; identical to SEQ ID NO: 610112

SEQ ID NO: 610114 - RNA, 64 nt, Homo Sapiens
acccggcccacgcgugcugccugugacguggggagccuggaaaccugcgaggcagaguuaagac

SEQ ID NO: 610115 - RNA, 64 nt, Homo Sapiens
guucuguaccucuuuguagccagguucuuaguuugccuggaauugccuguccuccaggcugggg

SEQ ID NO: 610116 - RNA, 64 nt, Homo Sapiens
uucccuccugccccaccaagcugcuguuuucccugccuggaacucuccaaccaccacacacucc

SEQ ID NO: 610117 - RNA, 64 nt, Homo Sapiens
gugucuggugcacauaauagacuguaucgccagugccuggaacauuuugucuguuuuaucuucu

SEQ ID NO: 610118 - RNA, 64 nt, Homo Sapiens
guguggacccagacguggagauguuccagacaaagccuggaaggaaucaggcaccagccacaua

SEQ ID NO: 610119 - RNA, 64 nt, Homo Sapiens
aauaucaaguaacaauaugaguuaaagcuuuggugccuggaaacagaauaugaauggauuaaau

SEQ ID NO: 610120 - RNA, 64 nt, Homo Sapiens
uauguuguucaaagaagccuauagcauccaaggggccuggaaguacugacccccuccuccagca

SEQ ID NO: 610121 - RNA, 64 nt, Homo Sapiens
guccucauccauguagcaccacuaauucuuccaugccuggaagaaaccuggggacuuaguuagg

SEQ ID NO: 610122 - RNA, 64 nt, Homo Sapiens
ucaguuguugcauguaauuuuugccuuuguuuaagccuggaacuuguaagaaaaugaaaauuua

SEQ ID NO: 610123 - RNA, 64 nt, Homo Sapiens
caggugugcccgucagcgggaaagcaggaucagugccuggaaggaguggcagagcaagaggggg

SEQ ID NO: 610124 - RNA, 64 nt, Homo Sapiens
aggcaauaagugggaaagguaucaugcuggacaagccuggaagggaaugcugagaccagaguuu

SEQ ID NO: 610125 - RNA, 64 nt, Homo Sapiens
agugugauuagaacacugauaccauuuggcuucggccuggaaauagugucauguuagcugaguc

SEQ ID NO: 610126 - RNA, 64 nt, Homo Sapiens
gccacgauggcugcugaauuggccucagggacaggccuggaaagaggccaggggaaacuggggg

SEQ ID NO: 610127 - RNA, 64 nt, Homo Sapiens
aguggcuaguucuugaaggacacauccaagggcagccuggaaccucccagcaccugacuccccc

SEQ ID NO: 610128 - RNA, 64 nt, Homo Sapiens
gugcauuuugcagaaacuuuuggguuagggcagggccuggaaaugcacuuagggaucucccagc

SEQ ID NO: 610129 - RNA, 64 nt, Homo Sapiens
gcagugagcccaugagccccaccacuacacuccagccuggaagacaccaugacacacagugagg

SEQ ID NO: 610130 - RNA, 64 nt, Homo Sapiens
auuccagcuuuauucacacaaaucaugucuguuggccuggaaauuggaaaaccaguuaaaccaa

SEQ ID NO: 610131 - RNA, 64 nt, Homo Sapiens
ugccuugggggcgguacucuguggagcugcuuaggccuggaaagguacaguauguagaagagga

SEQ ID NO: 610132 - RNA, 64 nt, Homo Sapiens
gcuguuuuagaguaugccugcuccccagcccccugccuggaacccucugagcaacuugcucuga

SEQ ID NO: 610133 - RNA, 64 nt, Homo Sapiens
aggucccaguccaucuccuggaggcggacagauggccuggaaaccucuggcuaaucgggccauc

SEQ ID NO: 610134 - RNA, 64 nt, Homo Sapiens
caagagacagcgacccaaagccgaaggacagguggccuggaaagaucccgcccaggucugggag

SEQ ID NO: 610135 - RNA, 55 nt, Homo Sapiens
uucuucccacagaucccugagucaugccuggaagcuuuguccccugcuucagaug

SEQ ID NO: 610136 - RNA, 64 nt, Homo Sapiens
uggguuagugcuauggugggagaguacauugaaggccuggaauuagcuuggggccagggaaggg

SEQ ID NO: 610137 - RNA, 64 nt, Homo Sapiens; identical to SEQ ID NO: 176114

SEQ ID NO: 610138 - RNA, 64 nt, Homo Sapiens; identical to SEQ ID NO: 176115

SEQ ID NO: 610139 - RNA, 64 nt, Homo Sapiens; identical to SEQ ID NO: 176116

SEQ ID NO: 610140 - RNA, 64 nt, Homo Sapiens; identical to SEQ ID NO: 176117

SEQ ID NO: 610141 - RNA, 64 nt, Homo Sapiens; identical to SEQ ID NO: 176118

SEQ ID NO: 610142 - RNA, 64 nt, Homo Sapiens; identical to SEQ ID NO: 176119

SEQ ID NO: 610143 - RNA, 64 nt, Homo Sapiens; identical to SEQ ID NO: 176120

SEQ ID NO: 610144 - RNA, 64 nt, Homo Sapiens; identical to SEQ ID NO: 176121

SEQ ID NO: 610145 - RNA, 64 nt, Homo Sapiens; identical to SEQ ID NO: 176122

SEQ ID NO: 610146 - RNA, 64 nt, Homo Sapiens; identical to SEQ ID NO: 176123

SEQ ID NO: 610147 - RNA, 64 nt, Homo Sapiens; identical to SEQ ID NO: 176124

SEQ ID NO: 610148 - RNA, 64 nt, Homo Sapiens; identical to SEQ ID NO: 176125

SEQ ID NO: 610149 - RNA, 64 nt, Homo Sapiens; identical to SEQ ID NO: 176126

SEQ ID NO: 610150 - RNA, 64 nt, Homo Sapiens; identical to SEQ ID NO: 176127

SEQ ID NO: 610151 - RNA, 64 nt, Homo Sapiens; identical to SEQ ID NO: 176128

SEQ ID NO: 610152 - RNA, 64 nt, Homo Sapiens; identical to SEQ ID NO: 176129

SEQ ID NO: 610153 - RNA, 64 nt, Homo Sapiens; identical to SEQ ID NO: 176130

SEQ ID NO: 610154 - RNA, 64 nt, Homo Sapiens; identical to SEQ ID NO: 176131

SEQ ID NO: 610155 - RNA, 64 nt, Homo Sapiens; identical to SEQ ID NO: 176132

SEQ ID NO: 610156 - RNA, 64 nt, Homo Sapiens; identical to SEQ ID NO: 176133

SEQ ID NO: 610157 - RNA, 64 nt, Homo Sapiens; identical to SEQ ID NO: 176134

SEQ ID NO: 610158 - RNA, 64 nt, Homo Sapiens; identical to SEQ ID NO: 176135

SEQ ID NO: 610159 - RNA, 64 nt, Homo Sapiens; identical to SEQ ID NO: 176136

SEQ ID NO: 610160 - RNA, 64 nt, Homo Sapiens; identical to SEQ ID NO: 176137

SEQ ID NO: 610161 - RNA, 64 nt, Homo Sapiens; identical to SEQ ID NO: 176138

SEQ ID NO: 610162 - RNA, 64 nt, Homo Sapiens; identical to SEQ ID NO: 176139

SEQ ID NO: 610163 - RNA, 64 nt, Homo Sapiens; identical to SEQ ID NO: 176140

SEQ ID NO: 610164 - RNA, 64 nt, Homo Sapiens; identical to SEQ ID NO: 176141

SEQ ID NO: 610165 - RNA, 64 nt, Homo Sapiens; identical to SEQ ID NO: 176142

SEQ ID NO: 610166 - RNA, 64 nt, Homo Sapiens; identical to SEQ ID NO: 176143

SEQ ID NO: 610167 - RNA, 64 nt, Homo Sapiens; identical to SEQ ID NO: 176144

SEQ ID NO: 610168 - RNA, 64 nt, Homo Sapiens; identical to SEQ ID NO: 176145

SEQ ID NO: 610169 - RNA, 64 nt, Homo Sapiens; identical to SEQ ID NO: 176146

SEQ ID NO: 610170 - RNA, 64 nt, Homo Sapiens; identical to SEQ ID NO: 176147

SEQ ID NO: 610171 - RNA, 64 nt, Homo Sapiens; identical to SEQ ID NO: 176148

SEQ ID NO: 610172 - RNA, 64 nt, Homo Sapiens; identical to SEQ ID NO: 176149

SEQ ID NO: 610173 - RNA, 64 nt, Homo Sapiens; identical to SEQ ID NO: 176150

SEQ ID NO: 610174 - RNA, 64 nt, Homo Sapiens; identical to SEQ ID NO: 176151

SEQ ID NO: 610175 - RNA, 64 nt, Homo Sapiens; identical to SEQ ID NO: 176152

SEQ ID NO: 610176 - RNA, 64 nt, Homo Sapiens; identical to SEQ ID NO: 176153

SEQ ID NO: 610177 - RNA, 64 nt, Homo Sapiens; identical to SEQ ID NO: 176154

SEQ ID NO: 610178 - RNA, 64 nt, Homo Sapiens; identical to SEQ ID NO: 176155

SEQ ID NO: 610179 - RNA, 64 nt, Homo Sapiens; identical to SEQ ID NO: 176156

SEQ ID NO: 610180 - RNA, 57 nt, Homo Sapiens; identical to SEQ ID NO: 176157

SEQ ID NO: 610181 - RNA, 64 nt, Homo Sapiens; identical to SEQ ID NO: 176158

SEQ ID NO: 610182 - RNA, 64 nt, Homo Sapiens; identical to SEQ ID NO: 176159

SEQ ID NO: 610183 - RNA, 64 nt, Homo Sapiens; identical to SEQ ID NO: 176160

SEQ ID NO: 610184 - RNA, 64 nt, Homo Sapiens; identical to SEQ ID NO: 176161

SEQ ID NO: 610185 - RNA, 64 nt, Homo Sapiens; identical to SEQ ID NO: 176162

SEQ ID NO: 610186 - RNA, 64 nt, Homo Sapiens; identical to SEQ ID NO: 176163

SEQ ID NO: 610187 - RNA, 64 nt, Homo Sapiens; identical to SEQ ID NO: 176164

SEQ ID NO: 610188 - RNA, 64 nt, Homo Sapiens; identical to SEQ ID NO: 176165

SEQ ID NO: 610189 - RNA, 64 nt, Homo Sapiens; identical to SEQ ID NO: 176166

SEQ ID NO: 610190 - RNA, 64 nt, Homo Sapiens; identical to SEQ ID NO: 176167

SEQ ID NO: 610191 - RNA, 64 nt, Homo Sapiens; identical to SEQ ID NO: 176168

SEQ ID NO: 610192 - RNA, 64 nt, Homo Sapiens; identical to SEQ ID NO: 176169

SEQ ID NO: 610193 - RNA, 64 nt, Homo Sapiens; identical to SEQ ID NO: 176170

SEQ ID NO: 610194 - RNA, 64 nt, Homo Sapiens; identical to SEQ ID NO: 176171

SEQ ID NO: 610195 - RNA, 64 nt, Homo Sapiens; identical to SEQ ID NO: 176172

SEQ ID NO: 610196 - RNA, 64 nt, Homo Sapiens; identical to SEQ ID NO: 176173

SEQ ID NO: 610197 - RNA, 64 nt, Homo Sapiens; identical to SEQ ID NO: 176174

SEQ ID NO: 610198 - RNA, 64 nt, Homo Sapiens; identical to SEQ ID NO: 176175

SEQ ID NO: 610199 - RNA, 64 nt, Homo Sapiens; identical to SEQ ID NO: 176176

SEQ ID NO: 610200 - RNA, 64 nt, Homo Sapiens; identical to SEQ ID NO: 176177

SEQ ID NO: 610201 - RNA, 64 nt, Homo Sapiens; identical to SEQ ID NO: 176178

SEQ ID NO: 610202 - RNA, 64 nt, Homo Sapiens; identical to SEQ ID NO: 176179

SEQ ID NO: 610203 - RNA, 64 nt, Homo Sapiens; identical to SEQ ID NO: 176180

SEQ ID NO: 610204 - RNA, 64 nt, Homo Sapiens; identical to SEQ ID NO: 176181

SEQ ID NO: 610205 - RNA, 64 nt, Homo Sapiens; identical to SEQ ID NO: 176182

SEQ ID NO: 610206 - RNA, 64 nt, Homo Sapiens; identical to SEQ ID NO: 176183

SEQ ID NO: 610207 - RNA, 64 nt, Homo Sapiens; identical to SEQ ID NO: 176184

SEQ ID NO: 610208 - RNA, 64 nt, Homo Sapiens; identical to SEQ ID NO: 176185

SEQ ID NO: 610209 - RNA, 64 nt, Homo Sapiens; identical to SEQ ID NO: 176186

SEQ ID NO: 610210 - RNA, 64 nt, Homo Sapiens; identical to SEQ ID NO: 176187

SEQ ID NO: 610211 - RNA, 64 nt, Homo Sapiens; identical to SEQ ID NO: 176188

SEQ ID NO: 610212 - RNA, 64 nt, Homo Sapiens; identical to SEQ ID NO: 176189

SEQ ID NO: 610213 - RNA, 64 nt, Homo Sapiens; identical to SEQ ID NO: 176190

SEQ ID NO: 610214 - RNA, 64 nt, Homo Sapiens; identical to SEQ ID NO: 176191

SEQ ID NO: 610215 - RNA, 64 nt, Homo Sapiens; identical to SEQ ID NO: 176192

SEQ ID NO: 610216 - RNA, 64 nt, Homo Sapiens; identical to SEQ ID NO: 176193

SEQ ID NO: 610217 - RNA, 53 nt, Homo Sapiens; identical to SEQ ID NO: 176194

SEQ ID NO: 610218 - RNA, 64 nt, Homo Sapiens; identical to SEQ ID NO: 176195

SEQ ID NO: 610219 - RNA, 64 nt, Homo Sapiens; identical to SEQ ID NO: 176196

SEQ ID NO: 610220 - RNA, 64 nt, Homo Sapiens; identical to SEQ ID NO: 176197

SEQ ID NO: 610221 - RNA, 64 nt, Homo Sapiens; identical to SEQ ID NO: 176198

SEQ ID NO: 610222 - RNA, 64 nt, Homo Sapiens; identical to SEQ ID NO: 176199

SEQ ID NO: 610223 - RNA, 64 nt, Homo Sapiens; identical to SEQ ID NO: 176200

SEQ ID NO: 610224 - RNA, 64 nt, Homo Sapiens; identical to SEQ ID NO: 176201

SEQ ID NO: 610225 - RNA, 64 nt, Homo Sapiens; identical to SEQ ID NO: 176202

SEQ ID NO: 610226 - RNA, 64 nt, Homo Sapiens; identical to SEQ ID NO: 176203

SEQ ID NO: 610227 - RNA, 64 nt, Homo Sapiens; identical to SEQ ID NO: 176204

SEQ ID NO: 610228 - RNA, 64 nt, Homo Sapiens; identical to SEQ ID NO: 176205

SEQ ID NO: 610229 - RNA, 64 nt, Homo Sapiens; identical to SEQ ID NO: 176206

SEQ ID NO: 610230 - RNA, 64 nt, Homo Sapiens; identical to SEQ ID NO: 176207

SEQ ID NO: 610231 - RNA, 64 nt, Homo Sapiens; identical to SEQ ID NO: 176208

SEQ ID NO: 610232 - RNA, 64 nt, Homo Sapiens; identical to SEQ ID NO: 176209

SEQ ID NO: 610233 - RNA, 64 nt, Homo Sapiens; identical to SEQ ID NO: 176210

SEQ ID NO: 610234 - RNA, 64 nt, Homo Sapiens; identical to SEQ ID NO: 176211

SEQ ID NO: 610235 - RNA, 64 nt, Homo Sapiens; identical to SEQ ID NO: 176212

SEQ ID NO: 610236 - RNA, 64 nt, Homo Sapiens; identical to SEQ ID NO: 176213

SEQ ID NO: 610237 - RNA, 64 nt, Homo Sapiens; identical to SEQ ID NO: 176214

SEQ ID NO: 610238 - RNA, 64 nt, Homo Sapiens; identical to SEQ ID NO: 176215

SEQ ID NO: 610239 - RNA, 64 nt, Homo Sapiens; identical to SEQ ID NO: 176216

SEQ ID NO: 610240 - RNA, 64 nt, Homo Sapiens; identical to SEQ ID NO: 176217

SEQ ID NO: 610241 - RNA, 64 nt, Homo Sapiens; identical to SEQ ID NO: 176218

SEQ ID NO: 610242 - RNA, 64 nt, Homo Sapiens; identical to SEQ ID NO: 176219

SEQ ID NO: 610243 - RNA, 64 nt, Homo Sapiens; identical to SEQ ID NO: 176220

SEQ ID NO: 610244 - RNA, 64 nt, Homo Sapiens; identical to SEQ ID NO: 176221

SEQ ID NO: 610245 - RNA, 64 nt, Homo Sapiens; identical to SEQ ID NO: 176222

SEQ ID NO: 610246 - RNA, 64 nt, Homo Sapiens; identical to SEQ ID NO: 176223

SEQ ID NO: 610247 - RNA, 64 nt, Homo Sapiens; identical to SEQ ID NO: 176224

SEQ ID NO: 610248 - RNA, 64 nt, Homo Sapiens; identical to SEQ ID NO: 176225

SEQ ID NO: 610249 - RNA, 64 nt, Homo Sapiens; identical to SEQ ID NO: 176226

SEQ ID NO: 610250 - RNA, 64 nt, Homo Sapiens; identical to SEQ ID NO: 176227

SEQ ID NO: 610251 - RNA, 64 nt, Homo Sapiens; identical to SEQ ID NO: 176228

SEQ ID NO: 610252 - RNA, 64 nt, Homo Sapiens; identical to SEQ ID NO: 176229

SEQ ID NO: 610253 - RNA, 64 nt, Homo Sapiens; identical to SEQ ID NO: 176230

SEQ ID NO: 610254 - RNA, 64 nt, Homo Sapiens; identical to SEQ ID NO: 176231

SEQ ID NO: 610255 - RNA, 64 nt, Homo Sapiens; identical to SEQ ID NO: 176232

SEQ ID NO: 610256 - RNA, 64 nt, Homo Sapiens; identical to SEQ ID NO: 176233

SEQ ID NO: 610257 - RNA, 64 nt, Homo Sapiens; identical to SEQ ID NO: 176234

SEQ ID NO: 610258 - RNA, 64 nt, Homo Sapiens; identical to SEQ ID NO: 176235

SEQ ID NO: 610259 - RNA, 64 nt, Homo Sapiens; identical to SEQ ID NO: 176236

SEQ ID NO: 610260 - RNA, 64 nt, Homo Sapiens; identical to SEQ ID NO: 176237

SEQ ID NO: 610261 - RNA, 64 nt, Homo Sapiens; identical to SEQ ID NO: 176238

SEQ ID NO: 610262 - RNA, 51 nt, Homo Sapiens; identical to SEQ ID NO: 176239

SEQ ID NO: 610263 - RNA, 64 nt, Homo Sapiens; identical to SEQ ID NO: 176240

SEQ ID NO: 610264 - RNA, 64 nt, Homo Sapiens; identical to SEQ ID NO: 176241

SEQ ID NO: 610265 - RNA, 64 nt, Homo Sapiens; identical to SEQ ID NO: 176242

SEQ ID NO: 610266 - RNA, 64 nt, Homo Sapiens; identical to SEQ ID NO: 176243

SEQ ID NO: 610267 - RNA, 64 nt, Homo Sapiens; identical to SEQ ID NO: 176244

SEQ ID NO: 610268 - RNA, 64 nt, Homo Sapiens; identical to SEQ ID NO: 176245

SEQ ID NO: 610269 - RNA, 64 nt, Homo Sapiens; identical to SEQ ID NO: 176246

SEQ ID NO: 610270 - RNA, 64 nt, Homo Sapiens; identical to SEQ ID NO: 176247

SEQ ID NO: 610271 - RNA, 64 nt, Homo Sapiens; identical to SEQ ID NO: 176248

SEQ ID NO: 610272 - RNA, 64 nt, Homo Sapiens; identical to SEQ ID NO: 176249

SEQ ID NO: 610273 - RNA, 64 nt, Homo Sapiens; identical to SEQ ID NO: 176250

SEQ ID NO: 610274 - RNA, 64 nt, Homo Sapiens; identical to SEQ ID NO: 176251

SEQ ID NO: 610275 - RNA, 64 nt, Homo Sapiens; identical to SEQ ID NO: 176252

SEQ ID NO: 610276 - RNA, 64 nt, Homo Sapiens; identical to SEQ ID NO: 176253

SEQ ID NO: 610277 - RNA, 64 nt, Homo Sapiens; identical to SEQ ID NO: 176254

SEQ ID NO: 610278 - RNA, 64 nt, Homo Sapiens; identical to SEQ ID NO: 176255

SEQ ID NO: 610279 - RNA, 64 nt, Homo Sapiens; identical to SEQ ID NO: 176256

SEQ ID NO: 610280 - RNA, 64 nt, Homo Sapiens; identical to SEQ ID NO: 176257

SEQ ID NO: 610281 - RNA, 64 nt, Homo Sapiens; identical to SEQ ID NO: 176258

SEQ ID NO: 610282 - RNA, 64 nt, Homo Sapiens; identical to SEQ ID NO: 176259

SEQ ID NO: 610283 - RNA, 64 nt, Homo Sapiens; identical to SEQ ID NO: 176260

SEQ ID NO: 610284 - RNA, 64 nt, Homo Sapiens; identical to SEQ ID NO: 176261

SEQ ID NO: 610285 - RNA, 64 nt, Homo Sapiens; identical to SEQ ID NO: 176262

SEQ ID NO: 610286 - RNA, 64 nt, Homo Sapiens; identical to SEQ ID NO: 176263

SEQ ID NO: 610287 - RNA, 64 nt, Homo Sapiens; identical to SEQ ID NO: 176264

SEQ ID NO: 610288 - RNA, 64 nt, Homo Sapiens; identical to SEQ ID NO: 176265

SEQ ID NO: 610289 - RNA, 64 nt, Homo Sapiens; identical to SEQ ID NO: 176266

SEQ ID NO: 610290 - RNA, 64 nt, Homo Sapiens; identical to SEQ ID NO: 176267

SEQ ID NO: 610291 - RNA, 64 nt, Homo Sapiens; identical to SEQ ID NO: 176268

SEQ ID NO: 610292 - RNA, 64 nt, Homo Sapiens; identical to SEQ ID NO: 176269

SEQ ID NO: 610293 - RNA, 53 nt, Homo Sapiens; identical to SEQ ID NO: 176270

SEQ ID NO: 610294 - RNA, 64 nt, Homo Sapiens; identical to SEQ ID NO: 176271

SEQ ID NO: 610295 - RNA, 64 nt, Homo Sapiens; identical to SEQ ID NO: 176272

SEQ ID NO: 610296 - RNA, 64 nt, Homo Sapiens
gguggcaaaggcacuuguccuguugcaaaggagcugaggucaagaguuagcaaaccacuccuuu

SEQ ID NO: 610297 - RNA, 64 nt, Homo Sapiens
ucacugcggacaucaagggccaacaugaaacaggugaggucaggggggaaaaauuauccccgga

SEQ ID NO: 610298 - RNA, 64 nt, Homo Sapiens
gguugguggggugucaucacgacacagggugggcugaggucagagcugagcuauaagaggggug

SEQ ID NO: 610299 - RNA, 64 nt, Homo Sapiens
cuugagcacugauguaaauuacuuagaucuucuuugaggucagaauucagcgaucacgguaggc

SEQ ID NO: 610300 - RNA, 64 nt, Homo Sapiens
ucagcagaauagcaaaaacuuugcucaggacauuugaggucaaauugaagacggaagacggaag

SEQ ID NO: 610301 - RNA, 64 nt, Homo Sapiens
guguccccucugcaugcccuuaaacauuggacagugaggucacaguccacccacccucucucug

SEQ ID NO: 610302 - RNA, 64 nt, Homo Sapiens
caguacucugggaagccaaggcaggcagaucacuugaggucaggaguucgagaccagccuggcc

SEQ ID NO: 610303 - RNA, 64 nt, Homo Sapiens
aguucaagaccagcccgggcgcgggcagaucgcuugaggucaggcagcacuuugggaggcugag

SEQ ID NO: 610304 - RNA, 64 nt, Homo Sapiens
aguucaagaccagccuggccucagguggaucaccugaggucaggcaguacuuugggaggccgag

SEQ ID NO: 610305 - RNA, 64 nt, Homo Sapiens
caugggggcucuuucgcugcagccuccaccgugcugaggucaggaggccgacguggcaguugug

SEQ ID NO: 610306 - RNA, 64 nt, Homo Sapiens
acuucacugaauuucuucaaaaccauugcagaagugaggucauccuugaaaaguggcagaaaaa

SEQ ID NO: 610307 - RNA, 64 nt, Homo Sapiens
agauugagaccuuccuggcuaggugggcaaaucaugaggucaggcccagcacuuugggaggccg

SEQ ID NO: 610308 - RNA, 64 nt, Homo Sapiens
aucagaagcuaagcugggugcuauuccaagauacugaggucauauacauaguauuccucaguau

SEQ ID NO: 610309 - RNA, 64 nt, Homo Sapiens
cagcacuuugggaggccaagguggguggaccacaugaggucaggaguuugagaucagccuggcc

SEQ ID NO: 610310 - RNA, 64 nt, Homo Sapiens
cccagcacuuugggaggccaagacgggcggaucaugaggucaagagaucaagaucauccuggcc

SEQ ID NO: 610311 - RNA, 64 nt, Homo Sapiens
caacacuuuaggagaccaaggcgggcagaucacuugaggucagaaguuugagaccagccaggcc

SEQ ID NO: 610312 - RNA, 64 nt, Homo Sapiens
cagcacucugggaggcugagacagguagaucauuugaggucaggaguucaaaaccaaccugguc

SEQ ID NO: 610313 - RNA, 64 nt, Homo Sapiens
agcccagcucuccagggggcgagguggaggccggugaggucagggauuuggccagagccuucag

SEQ ID NO: 610314 - RNA, 64 nt, Homo Sapiens
uguggauuuggccagagccuggguguucccuuccugaggucacacaggggcuuuggacuccuga

SEQ ID NO: 610315 - RNA, 64 nt, Homo Sapiens
cagcacuuugggaggcugaggcaggugaaucaccugaggucaggaguucaagaccagccuggcc

SEQ ID NO: 610316 - RNA, 64 nt, Homo Sapiens
cugauaaccuaagagcauuaagcucugaguccagugaggucauagcaguguaugcuccuugccc

SEQ ID NO: 610317 - RNA, 64 nt, Homo Sapiens
cagcacuuugggaguccaaggcaggcauaucauuugaggucaggaguuuaagaccagccuggcu

SEQ ID NO: 610318 - RNA, 64 nt, Homo Sapiens
ugcaugugaguaaacacaccugcgcagcccuggcugaggucacuaggcuggccagaggcaggac

SEQ ID NO: 610319 - RNA, 64 nt, Homo Sapiens
uuccagauuguaaauguaccaucuuaaacaacucugaggucaccaaacaguaguuauuugacug

SEQ ID NO: 610320 - RNA, 64 nt, Homo Sapiens
ucccagcacuuugggagguugcggguggaucacuugaggucaggaguucgagaccagccuggcc

SEQ ID NO: 610321 - RNA, 64 nt, Homo Sapiens
uuaauguuucacagcgaucugaaaacaaguauggugaggucacuuaaaauguguaucugaguga

SEQ ID NO: 610322 - RNA, 64 nt, Homo Sapiens
ccaccacuggaguggaugggggguggcggguggcugaggucacaggcaugcccgaguccugcaa

SEQ ID NO: 610323 - RNA, 64 nt, Homo Sapiens
aguucaagacuagccuggccgcggguggaucaccugaggucaggcagcacuuugggaggcaggg

SEQ ID NO: 610324 - RNA, 64 nt, Homo Sapiens
aguucaagaccagccuguccgugguaggaucaccugaggucaggcagcacuuugagaggcugag

SEQ ID NO: 610325 - RNA, 64 nt, Homo Sapiens
uggacagccagagcuuucuauguacuguuaaaauugaggucacauauuuucuuuuguauccugg

SEQ ID NO: 610326 - RNA, 64 nt, Homo Sapiens
gugauguacuuaaaggaauaauaaaugcauaauaugaggucaguggacgccauuuucuguuaua

SEQ ID NO: 610327 - RNA, 64 nt, Homo Sapiens
aguucgagaccagccuggccgugaaucacuugauugaggucaggacuuugggaggcugaggcgg

SEQ ID NO: 610328 - RNA, 64 nt, Homo Sapiens
aguucgagaccagccugaccgaggguggaucacuugaggucaggcagcacuuugcaaggccgag

SEQ ID NO: 610329 - RNA, 64 nt, Homo Sapiens
gggguggccccuaacccaccuuaauuagucaccaugaggucacuggaaacacagucguugcaga

SEQ ID NO: 610330 - RNA, 64 nt, Homo Sapiens
caucuccuugaugucugugagagggcaccucugcugaggucagauguccuacucuguaacccua

SEQ ID NO: 610331 - RNA, 64 nt, Homo Sapiens
auggggagcugcugccuuugauccuaccaggcccugaggucagggcugugggcuggguggcccc

SEQ ID NO: 610332 - RNA, 64 nt, Homo Sapiens
ucugaggccaguauccuccaacgucaggucucucugaggucaggcuccuagcagaucgugggga

SEQ ID NO: 610333 - RNA, 64 nt, Homo Sapiens
cagcacuuugggaggccaaggcugguggaucaccugaggucaggaguucgagaccagccuggcc

SEQ ID NO: 610334 - RNA, 64 nt, Homo Sapiens
cagcacuuugggaggcuuaggcggcuggaucaccugaggucaggaguucaagaccagccugguc

SEQ ID NO: 610335 - RNA, 64 nt, Homo Sapiens
uugaagacggaaaccggaaauugcucaggacauuugaggucaaaucagcagaauaacaaaaacu

SEQ ID NO: 610336 - RNA, 64 nt, Homo Sapiens
auucagccaucaugguaggcauuacggucuucuuugaggucaaaauucuugagcacugauauaa

SEQ ID NO: 610337 - RNA, 64 nt, Homo Sapiens
agcucgagaccagccuggccgcaggcggaucacuugaggucaggcagcacuuugggaggcugag

SEQ ID NO: 610338 - RNA, 64 nt, Homo Sapiens
agcucaagaccagccuggccgcgggcggaucacuugaggucaggcagcauuuugggaggccaag

SEQ ID NO: 610339 - RNA, 64 nt, Homo Sapiens
ggugugugagugggaggagagggcagagguccccugaggucaugcauuguaaucaucauagaag

SEQ ID NO: 610340 - RNA, 64 nt, Homo Sapiens
cccugaggguguuaguaccuaguggugaaacggaugaggucauuucuaagguguguugcccgug

SEQ ID NO: 610341 - RNA, 64 nt, Homo Sapiens
uuaagaauaaggggcccugaaugucaugaaggcuugaggucagccuacagauaacaggauuauu

SEQ ID NO: 610342 - RNA, 64 nt, Homo Sapiens
aucaccugauucaaggacuuugcuagcuagguuuugaggucaggcuucaguaacuguagucuug

SEQ ID NO: 610343 - RNA, 64 nt, Homo Sapiens
cuuggccacagugcucucagccagcacuaagggcugaggucaauaccgcagaccuuggggagga

SEQ ID NO: 610344 - RNA, 64 nt, Homo Sapiens
uccugacacagucccucagagauggcccuggcucugaggucacaucagcuagguuugggaggcc

SEQ ID NO: 610345 - RNA, 64 nt, Homo Sapiens
uacggcuguggccgugcaggacaggugaccucuaugaggucacccguuaggaccauccuccagg

SEQ ID NO: 610346 - RNA, 64 nt, Homo Sapiens
cugugcugugugaugggcagcugccgugccucucugaggucaggguauuccuguggagggaccu

SEQ ID NO: 610347 - RNA, 64 nt, Homo Sapiens
ccucaaauauggcauugcucaaaucugcuguguaugaggucacagggcccagcuguggcagggg

SEQ ID NO: 610348 - RNA, 64 nt, Homo Sapiens
cagcacuuugggaggccaaggcaggcagaucaccugaggucaggaguuugagaccagccuggcc

SEQ ID NO: 610349 - RNA, 64 nt, Homo Sapiens
aguucgagaccagccuggccgugguggcucacgcugaggucaggaaacugggcgguggccgggc

SEQ ID NO: 610350 - RNA, 64 nt, Homo Sapiens
agaucgagaccagccuggccgugggcagaucagcugaggucaggcagcacuuugggaggccgag

SEQ ID NO: 610351 - RNA, 64 nt, Homo Sapiens
uuugggccaagccucagcuagggcugcugccuggacgccugaggggcagcuuaucacagugcaa

SEQ ID NO: 610352 - RNA, 64 nt, Homo Sapiens
cagaagcagcgucccccguggggcccucucauacacgccugaggguggagugagcacgucugca

SEQ ID NO: 610353 - RNA, 64 nt, Homo Sapiens
guuuuuuggcuugcuuauguguaggugaacagucacgccugaaacuuugaggauaacuuuuuaa

SEQ ID NO: 610354 - RNA, 64 nt, Homo Sapiens
uuuuauaaugugucuaggcugggugcggugacucacgccugaaaucccagcacuuuggguggcu

SEQ ID NO: 610355 - RNA, 64 nt, Homo Sapiens
ugcgcccuugaggggccccagcgucugcagggugacgccugagacagcaccacugcugaggagu

SEQ ID NO: 610356 - RNA, 64 nt, Homo Sapiens
acacugcagugguuuuccugcagcucuccaacaaacgccugagucacaggccagagcugccuug

SEQ ID NO: 610357 - RNA, 64 nt, Homo Sapiens
guuuucccagcaacucacccucuuccaucuccaaacgccugaagcuuaaccaagagugagagga

SEQ ID NO: 610358 - RNA, 64 nt, Homo Sapiens
cugcgggccgcggggccgcgaaagggcgaagcucacgccugacuccaggcggaggcccuuucag

SEQ ID NO: 610359 - RNA, 64 nt, Homo Sapiens
caauuagacacuuuggaagauaggaauugguuucacgccugaggauggagcugggcuaaguaaa

SEQ ID NO: 610360 - RNA, 64 nt, Homo Sapiens
uuuggccacucaccuauguuauccacaugaacgcacgccugagaaauuaaaacuagaacuauag

SEQ ID NO: 610361 - RNA, 64 nt, Homo Sapiens
uugugaucugcccgccucgggaggcuggucuugaacgccugacccuguaaucccagcccuaugg

SEQ ID NO: 610362 - RNA, 64 nt, Homo Sapiens
gaucccaagaguuuuuauagaauccuaaaaaauaacgccugauguauagauuaguuagcaaauu

SEQ ID NO: 610363 - RNA, 64 nt, Homo Sapiens
aacugucuacuuuaucuucacaugcucagcugugacgccugaauaaagaguuaccuggaucagc

SEQ ID NO: 610364 - RNA, 64 nt, Homo Sapiens
cgucccagaaaccaaagggcaggcacggcagcaaacgccugagugcugcugccuucggugacua

SEQ ID NO: 610365 - RNA, 64 nt, Homo Sapiens
ucacagcuccuuccaagguucugggcccaccacgacgccugaagcgccacauagggugcagggc

SEQ ID NO: 610366 - RNA, 64 nt, Homo Sapiens
aaagaaccaggagaacaaccaaagcagcuuacagacgccugaacggagaaugaaguguuucaag

SEQ ID NO: 610367 - RNA, 64 nt, Homo Sapiens
aaguuauaccuuccucuuccucagagcaccucugacgccugaaggggaaaccccugaaaugcuc

SEQ ID NO: 610368 - RNA, 64 nt, Homo Sapiens
gacaguuccaucuuccuuuaagggucugcuggagacgccugaaaucaggaacacgggucuguag

SEQ ID NO: 610369 - RNA, 64 nt, Homo Sapiens
uaaagaggagaaggaaaacaugcugcucuggugcacgccugagcguccuccaucuuccaggaug

SEQ ID NO: 610370 - RNA, 64 nt, Homo Sapiens
gaggguuucaccauguuggccaggcuggucucgaacgccugaccucgugugauccgcccuccuc

SEQ ID NO: 610371 - RNA, 64 nt, Homo Sapiens
gcuuuaaacucagggacagagccaugcugggaagacgccugagcucacucggcacccugcaaaa

SEQ ID NO: 610372 - RNA, 64 nt, Homo Sapiens
cuacaauguccauuuuaauggccuggaaugcaaaacgccugaagaauacaaaggauggucugug

SEQ ID NO: 610373 - RNA, 64 nt, Homo Sapiens
uaacagcuuuuguacaucaacaucaagaaggaauacgccugagagagaucagaguauauagaug

SEQ ID NO: 610374 - RNA, 64 nt, Homo Sapiens
cgccuccccagacccacgaggauacucacacugcacgccugaggcucuccuaagcuccuucuuu

SEQ ID NO: 610375 - RNA, 64 nt, Homo Sapiens
uaugugcuuugucauuuucuaguucagggagugcacgccugaguuaccaccuguauagugggga

SEQ ID NO: 610376 - RNA, 64 nt, Homo Sapiens
cccagcccagcagcaugcuuuuguuugcugugccacgccugauggaggguugagucagucuguc

SEQ ID NO: 610377 - RNA, 64 nt, Homo Sapiens
uuggccuccauuucugucucuaaccauucaaaugacgccugauggugcugcucaggcccaugcu

SEQ ID NO: 610378 - RNA, 64 nt, Homo Sapiens
ucaugaucuacccgccucggcaggcuggucucgaacgccugacccaggguuucaccauguuggc

SEQ ID NO: 610379 - RNA, 64 nt, Homo Sapiens
cuccggggccacgcuucguuuggccccacugagcacgccugagccacucccaugcugguggccc

SEQ ID NO: 610380 - RNA, 64 nt, Homo Sapiens
ccaugguuuuggaguuccucucggguuaucucccacgccugaccuggaaccagcaagccccuuu

SEQ ID NO: 610381 - RNA, 64 nt, Homo Sapiens
cagcggcuggagcagcagacguuugccauuucucacgccugagggcaggcguuggagcagcuca

SEQ ID NO: 610382 - RNA, 59 nt, Homo Sapiens
aacccuuacaguaggagcccgagggucagacgccugaggacaggagguucaagauguga

SEQ ID NO: 610383 - RNA, 50 nt, Homo Sapiens
gcccugcuggcagagcgugaacgccugaugcaagaugggcaucggcagcg

SEQ ID NO: 610384 - RNA, 64 nt, Homo Sapiens
gccaggugaaaggccuggcggggaggaaagugaaacgccugaaucaaaagcaguuuucuaauuu

SEQ ID NO: 610385 - RNA, 64 nt, Homo Sapiens
uuugaaaacacuacacagggagguguggguccccacgccugauccuccuuaggccuggaggcca

SEQ ID NO: 610386 - RNA, 64 nt, Homo Sapiens
ucccaaguagcugggauuacaggugugcaccaccacgccugacuaauuuuguauuuuuaguaga

SEQ ID NO: 610387 - RNA, 64 nt, Homo Sapiens
ggguggcuacucugugccagagccuggggcucuaacgccugagcccagggaggccgaagcuaac

SEQ ID NO: 610388 - RNA, 52 nt, Homo Sapiens
uccuggagaaguacgcgugaggacgccugagccccagcgggagaccuguccu

SEQ ID NO: 610389 - RNA, 64 nt, Homo Sapiens
gauaagucccgucuuguuugugaguaccacagaaacgccugagagucacuuacccggccacugc

SEQ ID NO: 610390 - RNA, 64 nt, Homo Sapiens
ugccgagugccugcaauugcaggcgagcgccgccacgccugacugccucggccucccgaggugc

SEQ ID NO: 610391 - RNA, 64 nt, Homo Sapiens
ucccagcuacucaggaggcugggcgugguggcacacgccugaagaaaaauacaaaaaaucugcc

SEQ ID NO: 610392 - RNA, 64 nt, Homo Sapiens
aaaauuuuuauuuguuggccgggcaugguggcucacgccugaaaucccagcacuuugggaggcc

SEQ ID NO: 610393 - RNA, 64 nt, Homo Sapiens
augguucuaagcaugccccuccagagccuaucauacgccugauacagagaaccucucaauaaau

SEQ ID NO: 610394 - RNA, 64 nt, Homo Sapiens
agcgacucaggacugcucacgggucaggagggcaacgccugaagucagaccucccuauagguca

SEQ ID NO: 610395 - RNA, 64 nt, Homo Sapiens
ugugugccagggcaggcagugccccaggggcaccacgccugacucuccaucacccaggccuuga

SEQ ID NO: 610396 - RNA, 64 nt, Homo Sapiens
agucagcugggcauucaaagaagcuagacugagaacgccugagaagaaccagcuacgggaagag

SEQ ID NO: 610397 - RNA, 64 nt, Homo Sapiens
uuuguaaacagaaguauuaagcaaacugaaauguacgccugaauagcuuugggcacgguccagg

SEQ ID NO: 610398 - RNA, 64 nt, Homo Sapiens
auguguugcuacucugacauucuaagcuccaggcacgccugaagcaguauauuccagagucaga

SEQ ID NO: 610399 - RNA, 64 nt, Homo Sapiens
ucagaugauccacccaccuucagcauggucuugaacgccugacccaggguuucaccauguuggc

SEQ ID NO: 610400 - RNA, 64 nt, Homo Sapiens
gcgcugcuuccccgcggccgugggggcuccuccgacgccugaggggggaggcgcgagguccuuc

SEQ ID NO: 610401 - RNA, 64 nt, Homo Sapiens
ccccucuggaaacugcaggcuccagucccaccccacgccugacuggaagcaucuacccguucac

SEQ ID NO: 610402 - RNA, 64 nt, Homo Sapiens
gucauagcaggcuaagggugguuccuacacacccacgccugagggcaggucuaucaggcugcag

SEQ ID NO: 610403 - RNA, 64 nt, Homo Sapiens
cugcucugcgggggacgugccaacuacuaccaggacgccugaggcugcugcgcaucaacuucaa

SEQ ID NO: 610404 - RNA, 64 nt, Homo Sapiens
cgcaucaaggugcgcacaggaacuccuggaagaaacgccugaucacgucuaccugucugggauc

SEQ ID NO: 610405 - RNA, 64 nt, Homo Sapiens
gcauguggcaaagcucaccaucuucacuacaaacacgccugagaguggcacuggggaaacauaa

SEQ ID NO: 610406 - RNA, 64 nt, Homo Sapiens
cucuuucccauagucagaguugaauuugucaggcacgccugaaaugugcucauagccaaaacau

SEQ ID NO: 610407 - RNA, 64 nt, Homo Sapiens
uugaaguaaaaaauuuaaaaguuuucucccccagacgccugauauuccugaaaauaucggggag

SEQ ID NO: 610408 - RNA, 64 nt, Homo Sapiens
uuugguagcuaugccaucuuucaucccagugguaacgccugauuuuuucuugccuccccaguuu

SEQ ID NO: 610409 - RNA, 64 nt, Homo Sapiens
guggagagcacgaguuaguucagccuuggcuuccacgccugagcuggccuggccaggccuggca

SEQ ID NO: 610410 - RNA, 64 nt, Homo Sapiens
cgcccuugaaguauagccagcuccagccccaugccggcccuaccugcaauagugggcugacucc

SEQ ID NO: 610411 - RNA, 64 nt, Homo Sapiens
cucaggcauacucguuacaucuguauugaacuuucggcccuagaaaccaguggaguuauuucac

SEQ ID NO: 610412 - RNA, 64 nt, Homo Sapiens
aagugcugggauuacaggcgugagccaccgugcccggcccuaaaaugaaauuauuaauguuggu

SEQ ID NO: 610413 - RNA, 64 nt, Homo Sapiens
acagacaccgaugcagaccacucgauuucaugaccggcccuauugcacuauggaaguuaaagug

SEQ ID NO: 610414 - RNA, 64 nt, Homo Sapiens
gccucugcugcgccgccuguggugccuggucucccggcccuagcgcccgccaaaccuggugguc

SEQ ID NO: 610415 - RNA, 64 nt, Homo Sapiens
uaaagagcacuuuuuaaacuacauaauaaaagaucggcccuaagaaaagaaucuuaaaauagga

SEQ ID NO: 610416 - RNA, 64 nt, Homo Sapiens
caugcccgcuagcugugagguucauugcuacccucggcccuacuagcccucucuucccccuugu

SEQ ID NO: 610417 - RNA, 64 nt, Homo Sapiens
uuucugcaguugggagauguucagcuucaguccccggcccuauggccguucuuuuccacccugu

SEQ ID NO: 610418 - RNA, 64 nt, Homo Sapiens
cagaaacugcaugaaaaaucaugggccagagccucggcccuagcauugcacuuggccucaugcu

SEQ ID NO: 610419 - RNA, 64 nt, Homo Sapiens
ucagucugaguuacucgggauuugugggccuguccggcccuacucacuuucucucaugcuaccu

SEQ ID NO: 610420 - RNA, 64 nt, Homo Sapiens
cucugcaccuccuuaggcccugccucaccacucccggcccuagugucccuccaggccccaaccu

SEQ ID NO: 610421 - RNA, 64 nt, Homo Sapiens
guaugccugggaaagacagcaggagauuggugaccggcccuaauggugcaugaaaagcgaguga

SEQ ID NO: 610422 - RNA, 64 nt, Homo Sapiens
auccauaguucuaauccacaugagccacugcucccggcccuauuaagugcugggauugcaggca

SEQ ID NO: 610423 - RNA, 64 nt, Homo Sapiens
cugacccggaggaaaggaugaaaguggcccccugcggcccuagcggaugcugcagugaggcugu

SEQ ID NO: 610424 - RNA, 64 nt, Homo Sapiens
gccugcuacuccaucuggcugcccagcguggggucggcccuagaacacacagaagaugguggaa

SEQ ID NO: 610425 - RNA, 64 nt, Homo Sapiens
ggaggguguuuucacgaaugcuuccaggcugacccggcccuacugcccucuggccccgccccaa

SEQ ID NO: 610426 - RNA, 64 nt, Homo Sapiens
caggccuuacugccccuacucucccgugcggcaccggcccuagcgguguugcagggacccgcag

SEQ ID NO: 610427 - RNA, 64 nt, Homo Sapiens
agcgcccgcugggcugagccgggaguccccuccccggcccuaccuggggcucccuucaucucca

SEQ ID NO: 610428 - RNA, 64 nt, Homo Sapiens
cuaauucuucaguuuugaugcugauaccugcccccggcccuaccuuagcucuguggcauuauau

SEQ ID NO: 610429 - RNA, 64 nt, Homo Sapiens
aacuuaggcuuggccucuuucacaaauuaggccacggcccuaaauaggaauucccuggauugug

SEQ ID NO: 610430 - RNA, 64 nt, Homo Sapiens
ggucugaggggcaacugagucugcgggagaagagcggcccuaugcaugguguagaugcccugau

SEQ ID NO: 610431 - RNA, 63 nt, Homo Sapiens
ccagcgcucugccucaccgcgaggacgccgggccggcccuagcuauacggucggaccugguga

SEQ ID NO: 610432 - RNA, 64 nt, Homo Sapiens
acccaucaggaguuggagcaugacagggaccccccggcccuaacgucaaaacccaaggcagccu

SEQ ID NO: 610433 - RNA, 64 nt, Homo Sapiens
ugccggccgcccagacaccacagacgccaccuggcggcccuaagccacucccgccacacgcuca

SEQ ID NO: 610434 - RNA, 64 nt, Homo Sapiens
uuucugcugagagaaggugacuuaacgccuuuuccggcccuagcuccaggcguuuugaggcguc

SEQ ID NO: 610435 - RNA, 64 nt, Homo Sapiens
gaaagccuuagggaagcuggccugagaggggaagcggcccuaagggagugucuaagaacaaaag

SEQ ID NO: 610436 - RNA, 58 nt, Homo Sapiens
augcugagcccgagcacuaacccuccugcggcccuagcgacccucaggcuucuucccc

SEQ ID NO: 610437 - RNA, 64 nt, Homo Sapiens
gcugcagcgcgugcgcggugaaagaaggguuugccggcccuaacugugcucagggcugagucuu

SEQ ID NO: 610438 - RNA, 64 nt, Homo Sapiens
gcugcaggugcacaugaagaagcacacgggggagcggcccuacaagugugccuacugcgucaug

SEQ ID NO: 610439 - RNA, 64 nt, Homo Sapiens
aagugcugggauuacagguguuagccacugcgcccggcccuagagcucacuguuuucuaguuag

SEQ ID NO: 610440 - RNA, 64 nt, Homo Sapiens
cacaguagccaaacgaugaagugaauguucauggcggcccuauuaaacagaaagacgcuugugc

SEQ ID NO: 610441 - RNA, 50 nt, Homo Sapiens
ugucuccugaugccugagcacggcccuaucccgcuggcgcucagcaguaa

SEQ ID NO: 610442 - RNA, 64 nt, Homo Sapiens
cgccuccacccucuugcgccaaggacagugagggcggcccuagcgggcuggugcugccuggcgg

SEQ ID NO: 610443 - RNA, 64 nt, Homo Sapiens
uuauuuuggcgucacagcugccgccccgcccggccggcccuaacguacagcccccguccccgcc

SEQ ID NO: 610444 - RNA, 64 nt, Homo Sapiens
accccgcccccaccuuucgcuccugcccucugcccggcccuacugagauucccaaggagaaggc

SEQ ID NO: 610445 - RNA, 64 nt, Homo Sapiens; identical to SEQ ID NO: 264086

SEQ ID NO: 610446 - RNA, 64 nt, Homo Sapiens; identical to SEQ ID NO: 264087

SEQ ID NO: 610447 - RNA, 64 nt, Homo Sapiens; identical to SEQ ID NO: 264088

SEQ ID NO: 610448 - RNA, 64 nt, Homo Sapiens; identical to SEQ ID NO: 264089

SEQ ID NO: 610449 - RNA, 64 nt, Homo Sapiens; identical to SEQ ID NO: 264090

SEQ ID NO: 610450 - RNA, 64 nt, Homo Sapiens; identical to SEQ ID NO: 264091

SEQ ID NO: 610451 - RNA, 64 nt, Homo Sapiens; identical to SEQ ID NO: 264092

SEQ ID NO: 610452 - RNA, 64 nt, Homo Sapiens; identical to SEQ ID NO: 264093

SEQ ID NO: 610453 - RNA, 64 nt, Homo Sapiens; identical to SEQ ID NO: 264094

SEQ ID NO: 610454 - RNA, 64 nt, Homo Sapiens; identical to SEQ ID NO: 264095

SEQ ID NO: 610455 - RNA, 64 nt, Homo Sapiens; identical to SEQ ID NO: 38140

SEQ ID NO: 610456 - RNA, 64 nt, Homo Sapiens; identical to SEQ ID NO: 38141

SEQ ID NO: 610457 - RNA, 64 nt, Homo Sapiens; identical to SEQ ID NO: 38142

SEQ ID NO: 610458 - RNA, 64 nt, Homo Sapiens; identical to SEQ ID NO: 38143

SEQ ID NO: 610459 - RNA, 64 nt, Homo Sapiens; identical to SEQ ID NO: 38144

SEQ ID NO: 610460 - RNA, 64 nt, Homo Sapiens; identical to SEQ ID NO: 38145

SEQ ID NO: 610461 - RNA, 64 nt, Homo Sapiens; identical to SEQ ID NO: 38146

SEQ ID NO: 610462 - RNA, 64 nt, Homo Sapiens; identical to SEQ ID NO: 38147

SEQ ID NO: 610463 - RNA, 64 nt, Homo Sapiens; identical to SEQ ID NO: 38148

SEQ ID NO: 610464 - RNA, 64 nt, Homo Sapiens; identical to SEQ ID NO: 38149

SEQ ID NO: 610465 - RNA, 64 nt, Homo Sapiens; identical to SEQ ID NO: 38150

SEQ ID NO: 610466 - RNA, 64 nt, Homo Sapiens; identical to SEQ ID NO: 38151

SEQ ID NO: 610467 - RNA, 64 nt, Homo Sapiens; identical to SEQ ID NO: 38152

SEQ ID NO: 610468 - RNA, 64 nt, Homo Sapiens; identical to SEQ ID NO: 38153

SEQ ID NO: 610469 - RNA, 64 nt, Homo Sapiens; identical to SEQ ID NO: 38154

SEQ ID NO: 610470 - RNA, 64 nt, Homo Sapiens; identical to SEQ ID NO: 38155

SEQ ID NO: 610471 - RNA, 64 nt, Homo Sapiens; identical to SEQ ID NO: 38156

SEQ ID NO: 610472 - RNA, 64 nt, Homo Sapiens; identical to SEQ ID NO: 38157

SEQ ID NO: 610473 - RNA, 64 nt, Homo Sapiens; identical to SEQ ID NO: 38158

SEQ ID NO: 610474 - RNA, 64 nt, Homo Sapiens; identical to SEQ ID NO: 38159

SEQ ID NO: 610475 - RNA, 64 nt, Homo Sapiens; identical to SEQ ID NO: 38160

SEQ ID NO: 610476 - RNA, 64 nt, Homo Sapiens; identical to SEQ ID NO: 38161

SEQ ID NO: 610477 - RNA, 64 nt, Homo Sapiens; identical to SEQ ID NO: 98538

SEQ ID NO: 610478 - RNA, 64 nt, Homo Sapiens; identical to SEQ ID NO: 98539

SEQ ID NO: 610479 - RNA, 64 nt, Homo Sapiens; identical to SEQ ID NO: 98540

SEQ ID NO: 610480 - RNA, 64 nt, Homo Sapiens; identical to SEQ ID NO: 98541

SEQ ID NO: 610481 - RNA, 64 nt, Homo Sapiens; identical to SEQ ID NO: 98542

SEQ ID NO: 610482 - RNA, 64 nt, Homo Sapiens; identical to SEQ ID NO: 98543

SEQ ID NO: 610483 - RNA, 64 nt, Homo Sapiens; identical to SEQ ID NO: 98544

SEQ ID NO: 610484 - RNA, 64 nt, Homo Sapiens; identical to SEQ ID NO: 98545

SEQ ID NO: 610485 - RNA, 64 nt, Homo Sapiens; identical to SEQ ID NO: 98546

SEQ ID NO: 610486 - RNA, 64 nt, Homo Sapiens; identical to SEQ ID NO: 98547

SEQ ID NO: 610487 - RNA, 64 nt, Homo Sapiens; identical to SEQ ID NO: 98548

SEQ ID NO: 610488 - RNA, 64 nt, Homo Sapiens; identical to SEQ ID NO: 98549

SEQ ID NO: 610489 - RNA, 64 nt, Homo Sapiens; identical to SEQ ID NO: 98550

SEQ ID NO: 610490 - RNA, 64 nt, Homo Sapiens; identical to SEQ ID NO: 98551

SEQ ID NO: 610491 - RNA, 64 nt, Homo Sapiens; identical to SEQ ID NO: 98552

SEQ ID NO: 610492 - RNA, 64 nt, Homo Sapiens; identical to SEQ ID NO: 98553

SEQ ID NO: 610493 - RNA, 64 nt, Homo Sapiens; identical to SEQ ID NO: 98554

SEQ ID NO: 610494 - RNA, 64 nt, Homo Sapiens; identical to SEQ ID NO: 98555

SEQ ID NO: 610495 - RNA, 64 nt, Homo Sapiens; identical to SEQ ID NO: 98556

SEQ ID NO: 610496 - RNA, 64 nt, Homo Sapiens; identical to SEQ ID NO: 98557

SEQ ID NO: 610497 - RNA, 64 nt, Homo Sapiens; identical to SEQ ID NO: 98558

SEQ ID NO: 610498 - RNA, 64 nt, Homo Sapiens; identical to SEQ ID NO: 98559

SEQ ID NO: 610499 - RNA, 64 nt, Homo Sapiens; identical to SEQ ID NO: 98560

SEQ ID NO: 610500 - RNA, 64 nt, Homo Sapiens; identical to SEQ ID NO: 98561

SEQ ID NO: 610501 - RNA, 64 nt, Homo Sapiens; identical to SEQ ID NO: 98562

SEQ ID NO: 610502 - RNA, 64 nt, Homo Sapiens; identical to SEQ ID NO: 98563

SEQ ID NO: 610503 - RNA, 64 nt, Homo Sapiens; identical to SEQ ID NO: 98564

SEQ ID NO: 610504 - RNA, 64 nt, Homo Sapiens; identical to SEQ ID NO: 98565

SEQ ID NO: 610505 - RNA, 64 nt, Homo Sapiens; identical to SEQ ID NO: 98566

SEQ ID NO: 610506 - RNA, 64 nt, Homo Sapiens; identical to SEQ ID NO: 98567

SEQ ID NO: 610507 - RNA, 64 nt, Homo Sapiens; identical to SEQ ID NO: 98568

SEQ ID NO: 610508 - RNA, 64 nt, Homo Sapiens; identical to SEQ ID NO: 98569

SEQ ID NO: 610509 - RNA, 64 nt, Homo Sapiens; identical to SEQ ID NO: 98570

SEQ ID NO: 610510 - RNA, 64 nt, Homo Sapiens; identical to SEQ ID NO: 351843

SEQ ID NO: 610511 - RNA, 64 nt, Homo Sapiens; identical to SEQ ID NO: 351844

SEQ ID NO: 610512 - RNA, 64 nt, Homo Sapiens
ggauggagcuaagaguucagaggccaucaaggagagcagcaaguuuccauuuggcauuagccca

SEQ ID NO: 610513 - RNA, 64 nt, Homo Sapiens
uaaugucucacauggaaacagaaaacgcugggucagcagcaagcuguaguuuuuaaaaauguuu

SEQ ID NO: 610514 - RNA, 64 nt, Homo Sapiens
ugcuguucucaaccauucuuugaauuaauuugaaagcagcaauuacaucaauagauuuuuaggc

SEQ ID NO: 610515 - RNA, 64 nt, Homo Sapiens
uaaaaacguaugugaagccucccccugaaaagugagcagcaacgcuaucagaccaacaaaccuu

SEQ ID NO: 610516 - RNA, 64 nt, Homo Sapiens
aaggcuccguccugacugcccugugcccuggaaaagcagcaauagcauccgccccuuagagccc

SEQ ID NO: 610517 - RNA, 64 nt, Homo Sapiens
gcuggccuuguuagacagcacuugggccuuugccagcagcaagaggugaagcgaagccacucuu

SEQ ID NO: 610518 - RNA, 64 nt, Homo Sapiens
uuuaaaaagaagaagaagaaaaaaaacaagaacaagcagcaacagcuguuuuguuggggcuaua

SEQ ID NO: 610519 - RNA, 64 nt, Homo Sapiens
gguuuucauggguaggaaagcuuguccugaccccagcagcaaagagguggcaggucgcuaauga

SEQ ID NO: 610520 - RNA, 64 nt, Homo Sapiens
aggacgucuguucuuuguggauucugccacuaccagcagcaacccucuucagacugaagcagca

SEQ ID NO: 610521 - RNA, 64 nt, Homo Sapiens
cugccacuaccagcagcaacucucuucagacugaagcagcaauugaguacacccuggcaaggcu

SEQ ID NO: 610522 - RNA, 64 nt, Homo Sapiens
gcugccaugggauacagcacagccugugggcaccagcagcaaggagcugaauccgcccagugau

SEQ ID NO: 610523 - RNA, 64 nt, Homo Sapiens
ggacaugaugaaaaauacguaaagagccugagaaagcagcaagaagacacaaaugaagaagaac

SEQ ID NO: 610524 - RNA, 64 nt, Homo Sapiens
auagcaguuguauuguguaacaaguacugcucccagcagcaauuagggagaaaacuagucuaaa

SEQ ID NO: 610525 - RNA, 64 nt, Homo Sapiens
gcugcuuguaggacuguucaccaagggggauaccagcagcaagagagugcacccguuuagcccu

SEQ ID NO: 610526 - RNA, 64 nt, Homo Sapiens
guggugagcaucauuauaccagaccccacagggcagcagcaaaugaugaaccaucuacgggcau

SEQ ID NO: 610527 - RNA, 64 nt, Homo Sapiens
aauaucucuuucuguguucaaggaagaagaaaauagcagcaagaagaaaaguugcuuuucaaag

SEQ ID NO: 610528 - RNA, 64 nt, Homo Sapiens
gaacuuuuugcuuucugccaaauuuaaaaauuaaagcagcaaagcaccuaaauuuuuguaagaa

SEQ ID NO: 610529 - RNA, 64 nt, Homo Sapiens
ugggggucaggcuacaggugaaggaagcuuuggaagcagcaaggcacaaggcccagcccugggc

SEQ ID NO: 610530 - RNA, 64 nt, Homo Sapiens
cuucacccuuucagaugugaccucuuuuggacuaagcagcaaucuguucucuugcucaaauaau

SEQ ID NO: 610531 - RNA, 64 nt, Homo Sapiens
ucacaucuacucaacucugcuguugacaugcaaaagcagcaauagacaauaugcguguaaauga

SEQ ID NO: 610532 - RNA, 64 nt, Homo Sapiens; identical to SEQ ID NO: 100778

SEQ ID NO: 610533 - RNA, 64 nt, Homo Sapiens; identical to SEQ ID NO: 100779

SEQ ID NO: 610534 - RNA, 64 nt, Homo Sapiens; identical to SEQ ID NO: 100780

SEQ ID NO: 610535 - RNA, 64 nt, Homo Sapiens; identical to SEQ ID NO: 100781

SEQ ID NO: 610536 - RNA, 64 nt, Homo Sapiens; identical to SEQ ID NO: 100782

SEQ ID NO: 610537 - RNA, 64 nt, Homo Sapiens; identical to SEQ ID NO: 100783

SEQ ID NO: 610538 - RNA, 64 nt, Homo Sapiens; identical to SEQ ID NO: 100784

SEQ ID NO: 610539 - RNA, 64 nt, Homo Sapiens; identical to SEQ ID NO: 100785

SEQ ID NO: 610540 - RNA, 64 nt, Homo Sapiens; identical to SEQ ID NO: 100786

SEQ ID NO: 610541 - RNA, 64 nt, Homo Sapiens; identical to SEQ ID NO: 100787

SEQ ID NO: 610542 - RNA, 64 nt, Homo Sapiens; identical to SEQ ID NO: 100788

SEQ ID NO: 610543 - RNA, 64 nt, Homo Sapiens; identical to SEQ ID NO: 100789

SEQ ID NO: 610544 - RNA, 64 nt, Homo Sapiens; identical to SEQ ID NO: 100790

SEQ ID NO: 610545 - RNA, 62 nt, Homo Sapiens; identical to SEQ ID NO: 443387

SEQ ID NO: 610546 - RNA, 62 nt, Homo Sapiens; identical to SEQ ID NO: 443388

SEQ ID NO: 610547 - RNA, 62 nt, Homo Sapiens; identical to SEQ ID NO: 443389

SEQ ID NO: 610548 - RNA, 62 nt, Homo Sapiens; identical to SEQ ID NO: 443390

SEQ ID NO: 610549 - RNA, 62 nt, Homo Sapiens; identical to SEQ ID NO: 443391

SEQ ID NO: 610550 - RNA, 62 nt, Homo Sapiens; identical to SEQ ID NO: 443392

SEQ ID NO: 610551 - RNA, 62 nt, Homo Sapiens; identical to SEQ ID NO: 443393

SEQ ID NO: 610552 - RNA, 62 nt, Homo Sapiens; identical to SEQ ID NO: 443394

SEQ ID NO: 610553 - RNA, 62 nt, Homo Sapiens; identical to SEQ ID NO: 443395

SEQ ID NO: 610554 - RNA, 62 nt, Homo Sapiens; identical to SEQ ID NO: 443396

SEQ ID NO: 610555 - RNA, 62 nt, Homo Sapiens; identical to SEQ ID NO: 443397

SEQ ID NO: 610556 - RNA, 62 nt, Homo Sapiens; identical to SEQ ID NO: 443398

SEQ ID NO: 610557 - RNA, 62 nt, Homo Sapiens; identical to SEQ ID NO: 443399

SEQ ID NO: 610558 - RNA, 62 nt, Homo Sapiens; identical to SEQ ID NO: 443400

SEQ ID NO: 610559 - RNA, 62 nt, Homo Sapiens; identical to SEQ ID NO: 443401

SEQ ID NO: 610560 - RNA, 62 nt, Homo Sapiens; identical to SEQ ID NO: 443402

SEQ ID NO: 610561 - RNA, 62 nt, Homo Sapiens; identical to SEQ ID NO: 443403

SEQ ID NO: 610562 - RNA, 62 nt, Homo Sapiens; identical to SEQ ID NO: 443404

SEQ ID NO: 610563 - RNA, 62 nt, Homo Sapiens; identical to SEQ ID NO: 443405

SEQ ID NO: 610564 - RNA, 62 nt, Homo Sapiens; identical to SEQ ID NO: 443406

SEQ ID NO: 610565 - RNA, 62 nt, Homo Sapiens; identical to SEQ ID NO: 443407

SEQ ID NO: 610566 - RNA, 62 nt, Homo Sapiens; identical to SEQ ID NO: 443408

SEQ ID NO: 610567 - RNA, 64 nt, Homo Sapiens; identical to SEQ ID NO: 443409

SEQ ID NO: 610568 - RNA, 64 nt, Homo Sapiens; identical to SEQ ID NO: 443410

SEQ ID NO: 610569 - RNA, 64 nt, Homo Sapiens; identical to SEQ ID NO: 443411

SEQ ID NO: 610570 - RNA, 64 nt, Homo Sapiens; identical to SEQ ID NO: 443412

SEQ ID NO: 610571 - RNA, 64 nt, Homo Sapiens; identical to SEQ ID NO: 443413

SEQ ID NO: 610572 - RNA, 64 nt, Homo Sapiens; identical to SEQ ID NO: 443414

SEQ ID NO: 610573 - RNA, 64 nt, Homo Sapiens; identical to SEQ ID NO: 443415

SEQ ID NO: 610574 - RNA, 64 nt, Homo Sapiens; identical to SEQ ID NO: 443416

SEQ ID NO: 610575 - RNA, 64 nt, Homo Sapiens; identical to SEQ ID NO: 443417

SEQ ID NO: 610576 - RNA, 64 nt, Homo Sapiens; identical to SEQ ID NO: 443418

SEQ ID NO: 610577 - RNA, 64 nt, Homo Sapiens; identical to SEQ ID NO: 443419

SEQ ID NO: 610578 - RNA, 64 nt, Homo Sapiens; identical to SEQ ID NO: 443420

SEQ ID NO: 610579 - RNA, 64 nt, Homo Sapiens; identical to SEQ ID NO: 443421

SEQ ID NO: 610580 - RNA, 64 nt, Homo Sapiens; identical to SEQ ID NO: 443422

SEQ ID NO: 610581 - RNA, 64 nt, Homo Sapiens; identical to SEQ ID NO: 443423

SEQ ID NO: 610582 - RNA, 64 nt, Homo Sapiens; identical to SEQ ID NO: 443424

SEQ ID NO: 610583 - RNA, 64 nt, Homo Sapiens; identical to SEQ ID NO: 443425

SEQ ID NO: 610584 - RNA, 64 nt, Homo Sapiens; identical to SEQ ID NO: 443426

SEQ ID NO: 610585 - RNA, 64 nt, Homo Sapiens; identical to SEQ ID NO: 443427

SEQ ID NO: 610586 - RNA, 64 nt, Homo Sapiens; identical to SEQ ID NO: 443428

SEQ ID NO: 610587 - RNA, 64 nt, Homo Sapiens; identical to SEQ ID NO: 443429

SEQ ID NO: 610588 - RNA, 64 nt, Homo Sapiens; identical to SEQ ID NO: 443430

SEQ ID NO: 610589 - RNA, 64 nt, Homo Sapiens; identical to SEQ ID NO: 219184

SEQ ID NO: 610590 - RNA, 64 nt, Homo Sapiens; identical to SEQ ID NO: 219185

SEQ ID NO: 610591 - RNA, 64 nt, Homo Sapiens; identical to SEQ ID NO: 219186

SEQ ID NO: 610592 - RNA, 64 nt, Homo Sapiens; identical to SEQ ID NO: 219187

SEQ ID NO: 610593 - RNA, 64 nt, Homo Sapiens; identical to SEQ ID NO: 219188

SEQ ID NO: 610594 - RNA, 64 nt, Homo Sapiens; identical to SEQ ID NO: 219189

SEQ ID NO: 610595 - RNA, 64 nt, Homo Sapiens; identical to SEQ ID NO: 219190

SEQ ID NO: 610596 - RNA, 64 nt, Homo Sapiens; identical to SEQ ID NO: 219191

SEQ ID NO: 610597 - RNA, 64 nt, Homo Sapiens; identical to SEQ ID NO: 219192

SEQ ID NO: 610598 - RNA, 64 nt, Homo Sapiens; identical to SEQ ID NO: 219193

SEQ ID NO: 610599 - RNA, 64 nt, Homo Sapiens; identical to SEQ ID NO: 219194

SEQ ID NO: 610600 - RNA, 64 nt, Homo Sapiens; identical to SEQ ID NO: 219195

SEQ ID NO: 610601 - RNA, 64 nt, Homo Sapiens; identical to SEQ ID NO: 219196

SEQ ID NO: 610602 - RNA, 64 nt, Homo Sapiens; identical to SEQ ID NO: 219197

SEQ ID NO: 610603 - RNA, 64 nt, Homo Sapiens; identical to SEQ ID NO: 219198

SEQ ID NO: 610604 - RNA, 64 nt, Homo Sapiens; identical to SEQ ID NO: 219199

SEQ ID NO: 610605 - RNA, 64 nt, Homo Sapiens; identical to SEQ ID NO: 219200

SEQ ID NO: 610606 - RNA, 64 nt, Homo Sapiens; identical to SEQ ID NO: 219201

SEQ ID NO: 610607 - RNA, 64 nt, Homo Sapiens; identical to SEQ ID NO: 219202

SEQ ID NO: 610608 - RNA, 64 nt, Homo Sapiens; identical to SEQ ID NO: 219203

SEQ ID NO: 610609 - RNA, 64 nt, Homo Sapiens; identical to SEQ ID NO: 219204

SEQ ID NO: 610610 - RNA, 64 nt, Homo Sapiens; identical to SEQ ID NO: 219205

SEQ ID NO: 610611 - RNA, 64 nt, Homo Sapiens; identical to SEQ ID NO: 219206

SEQ ID NO: 610612 - RNA, 64 nt, Homo Sapiens; identical to SEQ ID NO: 219207

SEQ ID NO: 610613 - RNA, 64 nt, Homo Sapiens; identical to SEQ ID NO: 219208

SEQ ID NO: 610614 - RNA, 64 nt, Homo Sapiens; identical to SEQ ID NO: 219209

SEQ ID NO: 610615 - RNA, 64 nt, Homo Sapiens; identical to SEQ ID NO: 219210

SEQ ID NO: 610616 - RNA, 64 nt, Homo Sapiens; identical to SEQ ID NO: 219211

SEQ ID NO: 610617 - RNA, 64 nt, Homo Sapiens; identical to SEQ ID NO: 219212

SEQ ID NO: 610618 - RNA, 64 nt, Homo Sapiens; identical to SEQ ID NO: 219213

SEQ ID NO: 610619 - RNA, 64 nt, Homo Sapiens; identical to SEQ ID NO: 153946

SEQ ID NO: 610620 - RNA, 64 nt, Homo Sapiens; identical to SEQ ID NO: 153947

SEQ ID NO: 610621 - RNA, 64 nt, Homo Sapiens; identical to SEQ ID NO: 153948

SEQ ID NO: 610622 - RNA, 64 nt, Homo Sapiens; identical to SEQ ID NO: 153949

SEQ ID NO: 610623 - RNA, 64 nt, Homo Sapiens; identical to SEQ ID NO: 153950

SEQ ID NO: 610624 - RNA, 64 nt, Homo Sapiens; identical to SEQ ID NO: 153951

SEQ ID NO: 610625 - RNA, 64 nt, Homo Sapiens; identical to SEQ ID NO: 153952

SEQ ID NO: 610626 - RNA, 64 nt, Homo Sapiens; identical to SEQ ID NO: 153953

SEQ ID NO: 610627 - RNA, 64 nt, Homo Sapiens; identical to SEQ ID NO: 153954

SEQ ID NO: 610628 - RNA, 64 nt, Homo Sapiens; identical to SEQ ID NO: 153955

SEQ ID NO: 610629 - RNA, 64 nt, Homo Sapiens; identical to SEQ ID NO: 153956

SEQ ID NO: 610630 - RNA, 64 nt, Homo Sapiens; identical to SEQ ID NO: 153957

SEQ ID NO: 610631 - RNA, 64 nt, Homo Sapiens; identical to SEQ ID NO: 153958

SEQ ID NO: 610632 - RNA, 64 nt, Homo Sapiens; identical to SEQ ID NO: 153959

SEQ ID NO: 610633 - RNA, 64 nt, Homo Sapiens; identical to SEQ ID NO: 153960

SEQ ID NO: 610634 - RNA, 64 nt, Homo Sapiens; identical to SEQ ID NO: 153961

SEQ ID NO: 610635 - RNA, 64 nt, Homo Sapiens; identical to SEQ ID NO: 153962

SEQ ID NO: 610636 - RNA, 64 nt, Homo Sapiens; identical to SEQ ID NO: 153963

SEQ ID NO: 610637 - RNA, 64 nt, Homo Sapiens; identical to SEQ ID NO: 153964

SEQ ID NO: 610638 - RNA, 64 nt, Homo Sapiens; identical to SEQ ID NO: 153965

SEQ ID NO: 610639 - RNA, 64 nt, Homo Sapiens; identical to SEQ ID NO: 153966

SEQ ID NO: 610640 - RNA, 64 nt, Homo Sapiens; identical to SEQ ID NO: 153967

SEQ ID NO: 610641 - RNA, 64 nt, Homo Sapiens; identical to SEQ ID NO: 153968

SEQ ID NO: 610642 - RNA, 64 nt, Homo Sapiens; identical to SEQ ID NO: 153969

SEQ ID NO: 610643 - RNA, 64 nt, Homo Sapiens; identical to SEQ ID NO: 153970

SEQ ID NO: 610644 - RNA, 64 nt, Homo Sapiens; identical to SEQ ID NO: 153971

SEQ ID NO: 610645 - RNA, 64 nt, Homo Sapiens; identical to SEQ ID NO: 153972

SEQ ID NO: 610646 - RNA, 64 nt, Homo Sapiens; identical to SEQ ID NO: 153973

SEQ ID NO: 610647 - RNA, 64 nt, Homo Sapiens; identical to SEQ ID NO: 153974

SEQ ID NO: 610648 - RNA, 64 nt, Homo Sapiens; identical to SEQ ID NO: 153975

SEQ ID NO: 610649 - RNA, 64 nt, Homo Sapiens; identical to SEQ ID NO: 153976

SEQ ID NO: 610650 - RNA, 64 nt, Homo Sapiens; identical to SEQ ID NO: 153977

SEQ ID NO: 610651 - RNA, 64 nt, Homo Sapiens; identical to SEQ ID NO: 153978

SEQ ID NO: 610652 - RNA, 64 nt, Homo Sapiens; identical to SEQ ID NO: 153979

SEQ ID NO: 610653 - RNA, 64 nt, Homo Sapiens; identical to SEQ ID NO: 153980

SEQ ID NO: 610654 - RNA, 64 nt, Homo Sapiens; identical to SEQ ID NO: 153981

SEQ ID NO: 610655 - RNA, 64 nt, Homo Sapiens; identical to SEQ ID NO: 153982

SEQ ID NO: 610656 - RNA, 64 nt, Homo Sapiens; identical to SEQ ID NO: 153983

SEQ ID NO: 610657 - RNA, 64 nt, Homo Sapiens; identical to SEQ ID NO: 153984

SEQ ID NO: 610658 - RNA, 64 nt, Homo Sapiens; identical to SEQ ID NO: 153985

SEQ ID NO: 610659 - RNA, 64 nt, Homo Sapiens; identical to SEQ ID NO: 153986

SEQ ID NO: 610660 - RNA, 64 nt, Homo Sapiens; identical to SEQ ID NO: 153987

SEQ ID NO: 610661 - RNA, 64 nt, Homo Sapiens; identical to SEQ ID NO: 153988

SEQ ID NO: 610662 - RNA, 64 nt, Homo Sapiens; identical to SEQ ID NO: 153989

SEQ ID NO: 610663 - RNA, 64 nt, Homo Sapiens; identical to SEQ ID NO: 153990

SEQ ID NO: 610664 - RNA, 64 nt, Homo Sapiens; identical to SEQ ID NO: 153991

SEQ ID NO: 610665 - RNA, 64 nt, Homo Sapiens; identical to SEQ ID NO: 153992

SEQ ID NO: 610666 - RNA, 64 nt, Homo Sapiens; identical to SEQ ID NO: 153993

SEQ ID NO: 610667 - RNA, 64 nt, Homo Sapiens; identical to SEQ ID NO: 153994

SEQ ID NO: 610668 - RNA, 64 nt, Homo Sapiens; identical to SEQ ID NO: 153995

SEQ ID NO: 610669 - RNA, 64 nt, Homo Sapiens; identical to SEQ ID NO: 153996

SEQ ID NO: 610670 - RNA, 64 nt, Homo Sapiens; identical to SEQ ID NO: 153997

SEQ ID NO: 610671 - RNA, 64 nt, Homo Sapiens; identical to SEQ ID NO: 132231

SEQ ID NO: 610672 - RNA, 64 nt, Homo Sapiens; identical to SEQ ID NO: 132232

SEQ ID NO: 610673 - RNA, 64 nt, Homo Sapiens; identical to SEQ ID NO: 132233

SEQ ID NO: 610674 - RNA, 64 nt, Homo Sapiens; identical to SEQ ID NO: 132234

SEQ ID NO: 610675 - RNA, 64 nt, Homo Sapiens; identical to SEQ ID NO: 132235

SEQ ID NO: 610676 - RNA, 64 nt, Homo Sapiens; identical to SEQ ID NO: 132236

SEQ ID NO: 610677 - RNA, 64 nt, Homo Sapiens; identical to SEQ ID NO: 132237

SEQ ID NO: 610678 - RNA, 64 nt, Homo Sapiens; identical to SEQ ID NO: 132238

SEQ ID NO: 610679 - RNA, 64 nt, Homo Sapiens; identical to SEQ ID NO: 132239

SEQ ID NO: 610680 - RNA, 64 nt, Homo Sapiens; identical to SEQ ID NO: 132240

SEQ ID NO: 610681 - RNA, 64 nt, Homo Sapiens; identical to SEQ ID NO: 132241

SEQ ID NO: 610682 - RNA, 64 nt, Homo Sapiens; identical to SEQ ID NO: 132242

SEQ ID NO: 610683 - RNA, 64 nt, Homo Sapiens; identical to SEQ ID NO: 132243

SEQ ID NO: 610684 - RNA, 64 nt, Homo Sapiens; identical to SEQ ID NO: 132244

SEQ ID NO: 610685 - RNA, 64 nt, Homo Sapiens; identical to SEQ ID NO: 132245

SEQ ID NO: 610686 - RNA, 64 nt, Homo Sapiens; identical to SEQ ID NO: 132246

SEQ ID NO: 610687 - RNA, 64 nt, Homo Sapiens; identical to SEQ ID NO: 132247

SEQ ID NO: 610688 - RNA, 64 nt, Homo Sapiens; identical to SEQ ID NO: 132248

SEQ ID NO: 610689 - RNA, 64 nt, Homo Sapiens; identical to SEQ ID NO: 132249

SEQ ID NO: 610690 - RNA, 64 nt, Homo Sapiens; identical to SEQ ID NO: 132250

SEQ ID NO: 610691 - RNA, 64 nt, Homo Sapiens; identical to SEQ ID NO: 132251

SEQ ID NO: 610692 - RNA, 64 nt, Homo Sapiens; identical to SEQ ID NO: 132252

SEQ ID NO: 610693 - RNA, 64 nt, Homo Sapiens; identical to SEQ ID NO: 132253

SEQ ID NO: 610694 - RNA, 64 nt, Homo Sapiens; identical to SEQ ID NO: 132254

SEQ ID NO: 610695 - RNA, 64 nt, Homo Sapiens; identical to SEQ ID NO: 132255

SEQ ID NO: 610696 - RNA, 64 nt, Homo Sapiens; identical to SEQ ID NO: 132256

SEQ ID NO: 610697 - RNA, 64 nt, Homo Sapiens; identical to SEQ ID NO: 132257

SEQ ID NO: 610698 - RNA, 64 nt, Homo Sapiens; identical to SEQ ID NO: 132258

SEQ ID NO: 610699 - RNA, 64 nt, Homo Sapiens; identical to SEQ ID NO: 132259

SEQ ID NO: 610700 - RNA, 64 nt, Homo Sapiens; identical to SEQ ID NO: 132260

SEQ ID NO: 610701 - RNA, 64 nt, Homo Sapiens; identical to SEQ ID NO: 132261

SEQ ID NO: 610702 - RNA, 64 nt, Homo Sapiens; identical to SEQ ID NO: 132262

SEQ ID NO: 610703 - RNA, 64 nt, Homo Sapiens; identical to SEQ ID NO: 132263

SEQ ID NO: 610704 - RNA, 64 nt, Homo Sapiens; identical to SEQ ID NO: 132264

SEQ ID NO: 610705 - RNA, 64 nt, Homo Sapiens; identical to SEQ ID NO: 429192

SEQ ID NO: 610706 - RNA, 64 nt, Homo Sapiens; identical to SEQ ID NO: 429193

SEQ ID NO: 610707 - RNA, 64 nt, Homo Sapiens; identical to SEQ ID NO: 429194

SEQ ID NO: 610708 - RNA, 64 nt, Homo Sapiens; identical to SEQ ID NO: 429195

SEQ ID NO: 610709 - RNA, 64 nt, Homo Sapiens; identical to SEQ ID NO: 429196

SEQ ID NO: 610710 - RNA, 64 nt, Homo Sapiens; identical to SEQ ID NO: 429197

SEQ ID NO: 610711 - RNA, 64 nt, Homo Sapiens; identical to SEQ ID NO: 429198

SEQ ID NO: 610712 - RNA, 64 nt, Homo Sapiens; identical to SEQ ID NO: 429199

SEQ ID NO: 610713 - RNA, 64 nt, Homo Sapiens; identical to SEQ ID NO: 429200

SEQ ID NO: 610714 - RNA, 64 nt, Homo Sapiens; identical to SEQ ID NO: 429201

SEQ ID NO: 610715 - RNA, 64 nt, Homo Sapiens; identical to SEQ ID NO: 429202

SEQ ID NO: 610716 - RNA, 64 nt, Homo Sapiens; identical to SEQ ID NO: 429203

SEQ ID NO: 610717 - RNA, 64 nt, Homo Sapiens; identical to SEQ ID NO: 429204

SEQ ID NO: 610718 - RNA, 64 nt, Homo Sapiens; identical to SEQ ID NO: 429205

SEQ ID NO: 610719 - RNA, 64 nt, Homo Sapiens; identical to SEQ ID NO: 429206

SEQ ID NO: 610720 - RNA, 64 nt, Homo Sapiens; identical to SEQ ID NO: 429207

SEQ ID NO: 610721 - RNA, 64 nt, Homo Sapiens; identical to SEQ ID NO: 429208

SEQ ID NO: 610722 - RNA, 64 nt, Homo Sapiens; identical to SEQ ID NO: 112922

SEQ ID NO: 610723 - RNA, 64 nt, Homo Sapiens; identical to SEQ ID NO: 112923

SEQ ID NO: 610724 - RNA, 64 nt, Homo Sapiens; identical to SEQ ID NO: 112924

SEQ ID NO: 610725 - RNA, 64 nt, Homo Sapiens; identical to SEQ ID NO: 112925

SEQ ID NO: 610726 - RNA, 64 nt, Homo Sapiens; identical to SEQ ID NO: 112926

SEQ ID NO: 610727 - RNA, 64 nt, Homo Sapiens; identical to SEQ ID NO: 112927

SEQ ID NO: 610728 - RNA, 64 nt, Homo Sapiens; identical to SEQ ID NO: 112928

SEQ ID NO: 610729 - RNA, 64 nt, Homo Sapiens; identical to SEQ ID NO: 112929

SEQ ID NO: 610730 - RNA, 64 nt, Homo Sapiens; identical to SEQ ID NO: 112930

SEQ ID NO: 610731 - RNA, 64 nt, Homo Sapiens; identical to SEQ ID NO: 112931

SEQ ID NO: 610732 - RNA, 64 nt, Homo Sapiens; identical to SEQ ID NO: 112932

SEQ ID NO: 610733 - RNA, 64 nt, Homo Sapiens; identical to SEQ ID NO: 112933

SEQ ID NO: 610734 - RNA, 64 nt, Homo Sapiens; identical to SEQ ID NO: 112934

SEQ ID NO: 610735 - RNA, 64 nt, Homo Sapiens; identical to SEQ ID NO: 112935

SEQ ID NO: 610736 - RNA, 64 nt, Homo Sapiens; identical to SEQ ID NO: 112936

SEQ ID NO: 610737 - RNA, 64 nt, Homo Sapiens; identical to SEQ ID NO: 112937

SEQ ID NO: 610738 - RNA, 64 nt, Homo Sapiens; identical to SEQ ID NO: 112938

SEQ ID NO: 610739 - RNA, 64 nt, Homo Sapiens; identical to SEQ ID NO: 112939

SEQ ID NO: 610740 - RNA, 64 nt, Homo Sapiens; identical to SEQ ID NO: 112940

SEQ ID NO: 610741 - RNA, 64 nt, Homo Sapiens; identical to SEQ ID NO: 112941

SEQ ID NO: 610742 - RNA, 64 nt, Homo Sapiens; identical to SEQ ID NO: 112942

SEQ ID NO: 610743 - RNA, 64 nt, Homo Sapiens; identical to SEQ ID NO: 112943

SEQ ID NO: 610744 - RNA, 64 nt, Homo Sapiens; identical to SEQ ID NO: 112944

SEQ ID NO: 610745 - RNA, 64 nt, Homo Sapiens; identical to SEQ ID NO: 112945

SEQ ID NO: 610746 - RNA, 64 nt, Homo Sapiens; identical to SEQ ID NO: 112946

SEQ ID NO: 610747 - RNA, 64 nt, Homo Sapiens; identical to SEQ ID NO: 112947

SEQ ID NO: 610748 - RNA, 64 nt, Homo Sapiens; identical to SEQ ID NO: 112948

SEQ ID NO: 610749 - RNA, 64 nt, Homo Sapiens; identical to SEQ ID NO: 112949

SEQ ID NO: 610750 - RNA, 64 nt, Homo Sapiens; identical to SEQ ID NO: 112950

SEQ ID NO: 610751 - RNA, 64 nt, Homo Sapiens; identical to SEQ ID NO: 112951

SEQ ID NO: 610752 - RNA, 64 nt, Homo Sapiens; identical to SEQ ID NO: 112952

SEQ ID NO: 610753 - RNA, 64 nt, Homo Sapiens; identical to SEQ ID NO: 112953

SEQ ID NO: 610754 - RNA, 64 nt, Homo Sapiens; identical to SEQ ID NO: 112954

SEQ ID NO: 610755 - RNA, 50 nt, Homo Sapiens; identical to SEQ ID NO: 112955

SEQ ID NO: 610756 - RNA, 64 nt, Homo Sapiens; identical to SEQ ID NO: 112956

SEQ ID NO: 610757 - RNA, 64 nt, Homo Sapiens; identical to SEQ ID NO: 112957

SEQ ID NO: 610758 - RNA, 64 nt, Homo Sapiens; identical to SEQ ID NO: 112958

SEQ ID NO: 610759 - RNA, 64 nt, Homo Sapiens; identical to SEQ ID NO: 112959

SEQ ID NO: 610760 - RNA, 64 nt, Homo Sapiens; identical to SEQ ID NO: 112960

SEQ ID NO: 610761 - RNA, 64 nt, Homo Sapiens; identical to SEQ ID NO: 112961

SEQ ID NO: 610762 - RNA, 64 nt, Homo Sapiens; identical to SEQ ID NO: 218966

SEQ ID NO: 610763 - RNA, 64 nt, Homo Sapiens; identical to SEQ ID NO: 218967

SEQ ID NO: 610764 - RNA, 64 nt, Homo Sapiens; identical to SEQ ID NO: 218968

SEQ ID NO: 610765 - RNA, 64 nt, Homo Sapiens; identical to SEQ ID NO: 218969

SEQ ID NO: 610766 - RNA, 64 nt, Homo Sapiens; identical to SEQ ID NO: 218970

SEQ ID NO: 610767 - RNA, 64 nt, Homo Sapiens; identical to SEQ ID NO: 218971

SEQ ID NO: 610768 - RNA, 64 nt, Homo Sapiens; identical to SEQ ID NO: 218972

SEQ ID NO: 610769 - RNA, 64 nt, Homo Sapiens; identical to SEQ ID NO: 218973

SEQ ID NO: 610770 - RNA, 64 nt, Homo Sapiens; identical to SEQ ID NO: 218974

SEQ ID NO: 610771 - RNA, 64 nt, Homo Sapiens; identical to SEQ ID NO: 218975

SEQ ID NO: 610772 - RNA, 64 nt, Homo Sapiens; identical to SEQ ID NO: 218976

SEQ ID NO: 610773 - RNA, 64 nt, Homo Sapiens; identical to SEQ ID NO: 218977

SEQ ID NO: 610774 - RNA, 64 nt, Homo Sapiens; identical to SEQ ID NO: 218978

SEQ ID NO: 610775 - RNA, 64 nt, Homo Sapiens; identical to SEQ ID NO: 218979

SEQ ID NO: 610776 - RNA, 64 nt, Homo Sapiens; identical to SEQ ID NO: 218980

SEQ ID NO: 610777 - RNA, 64 nt, Homo Sapiens; identical to SEQ ID NO: 218981

SEQ ID NO: 610778 - RNA, 64 nt, Homo Sapiens; identical to SEQ ID NO: 218982

SEQ ID NO: 610779 - RNA, 64 nt, Homo Sapiens; identical to SEQ ID NO: 218983

SEQ ID NO: 610780 - RNA, 64 nt, Homo Sapiens; identical to SEQ ID NO: 218984

SEQ ID NO: 610781 - RNA, 64 nt, Homo Sapiens; identical to SEQ ID NO: 218985

SEQ ID NO: 610782 - RNA, 64 nt, Homo Sapiens; identical to SEQ ID NO: 218986

SEQ ID NO: 610783 - RNA, 64 nt, Homo Sapiens; identical to SEQ ID NO: 218987

SEQ ID NO: 610784 - RNA, 64 nt, Homo Sapiens; identical to SEQ ID NO: 218988

SEQ ID NO: 610785 - RNA, 64 nt, Homo Sapiens; identical to SEQ ID NO: 218989

SEQ ID NO: 610786 - RNA, 64 nt, Homo Sapiens; identical to SEQ ID NO: 218990

SEQ ID NO: 610787 - RNA, 64 nt, Homo Sapiens; identical to SEQ ID NO: 218991

SEQ ID NO: 610788 - RNA, 64 nt, Homo Sapiens; identical to SEQ ID NO: 218992

SEQ ID NO: 610789 - RNA, 64 nt, Homo Sapiens; identical to SEQ ID NO: 218993

SEQ ID NO: 610790 - RNA, 64 nt, Homo Sapiens; identical to SEQ ID NO: 218994

SEQ ID NO: 610791 - RNA, 64 nt, Homo Sapiens; identical to SEQ ID NO: 218995

SEQ ID NO: 610792 - RNA, 64 nt, Homo Sapiens; identical to SEQ ID NO: 218996

SEQ ID NO: 610793 - RNA, 64 nt, Homo Sapiens; identical to SEQ ID NO: 112922

SEQ ID NO: 610794 - RNA, 64 nt, Homo Sapiens; identical to SEQ ID NO: 112923

SEQ ID NO: 610795 - RNA, 64 nt, Homo Sapiens; identical to SEQ ID NO: 112924

SEQ ID NO: 610796 - RNA, 64 nt, Homo Sapiens; identical to SEQ ID NO: 112925

SEQ ID NO: 610797 - RNA, 64 nt, Homo Sapiens; identical to SEQ ID NO: 112926

SEQ ID NO: 610798 - RNA, 64 nt, Homo Sapiens; identical to SEQ ID NO: 112927

SEQ ID NO: 610799 - RNA, 64 nt, Homo Sapiens; identical to SEQ ID NO: 112928

SEQ ID NO: 610800 - RNA, 64 nt, Homo Sapiens; identical to SEQ ID NO: 112929

SEQ ID NO: 610801 - RNA, 64 nt, Homo Sapiens; identical to SEQ ID NO: 112930

SEQ ID NO: 610802 - RNA, 64 nt, Homo Sapiens; identical to SEQ ID NO: 112931

SEQ ID NO: 610803 - RNA, 64 nt, Homo Sapiens; identical to SEQ ID NO: 112932

SEQ ID NO: 610804 - RNA, 64 nt, Homo Sapiens; identical to SEQ ID NO: 112933

SEQ ID NO: 610805 - RNA, 64 nt, Homo Sapiens; identical to SEQ ID NO: 112934

SEQ ID NO: 610806 - RNA, 64 nt, Homo Sapiens; identical to SEQ ID NO: 112935

SEQ ID NO: 610807 - RNA, 64 nt, Homo Sapiens; identical to SEQ ID NO: 112936

SEQ ID NO: 610808 - RNA, 64 nt, Homo Sapiens; identical to SEQ ID NO: 112937

SEQ ID NO: 610809 - RNA, 64 nt, Homo Sapiens; identical to SEQ ID NO: 112938

SEQ ID NO: 610810 - RNA, 64 nt, Homo Sapiens; identical to SEQ ID NO: 112939

SEQ ID NO: 610811 - RNA, 64 nt, Homo Sapiens; identical to SEQ ID NO: 112940

SEQ ID NO: 610812 - RNA, 64 nt, Homo Sapiens; identical to SEQ ID NO: 112941

SEQ ID NO: 610813 - RNA, 64 nt, Homo Sapiens; identical to SEQ ID NO: 112942

SEQ ID NO: 610814 - RNA, 64 nt, Homo Sapiens; identical to SEQ ID NO: 112943

SEQ ID NO: 610815 - RNA, 64 nt, Homo Sapiens; identical to SEQ ID NO: 112944

SEQ ID NO: 610816 - RNA, 64 nt, Homo Sapiens; identical to SEQ ID NO: 112945

SEQ ID NO: 610817 - RNA, 64 nt, Homo Sapiens; identical to SEQ ID NO: 112946

SEQ ID NO: 610818 - RNA, 64 nt, Homo Sapiens; identical to SEQ ID NO: 112947

SEQ ID NO: 610819 - RNA, 64 nt, Homo Sapiens; identical to SEQ ID NO: 112948

SEQ ID NO: 610820 - RNA, 64 nt, Homo Sapiens; identical to SEQ ID NO: 112949

SEQ ID NO: 610821 - RNA, 64 nt, Homo Sapiens; identical to SEQ ID NO: 112950

SEQ ID NO: 610822 - RNA, 64 nt, Homo Sapiens; identical to SEQ ID NO: 112951

SEQ ID NO: 610823 - RNA, 64 nt, Homo Sapiens; identical to SEQ ID NO: 112952

SEQ ID NO: 610824 - RNA, 64 nt, Homo Sapiens; identical to SEQ ID NO: 112953

SEQ ID NO: 610825 - RNA, 64 nt, Homo Sapiens; identical to SEQ ID NO: 112954

SEQ ID NO: 610826 - RNA, 50 nt, Homo Sapiens; identical to SEQ ID NO: 112955

SEQ ID NO: 610827 - RNA, 64 nt, Homo Sapiens; identical to SEQ ID NO: 112956

SEQ ID NO: 610828 - RNA, 64 nt, Homo Sapiens; identical to SEQ ID NO: 112957

SEQ ID NO: 610829 - RNA, 64 nt, Homo Sapiens; identical to SEQ ID NO: 112958

SEQ ID NO: 610830 - RNA, 64 nt, Homo Sapiens; identical to SEQ ID NO: 112959

SEQ ID NO: 610831 - RNA, 64 nt, Homo Sapiens; identical to SEQ ID NO: 112960

SEQ ID NO: 610832 - RNA, 64 nt, Homo Sapiens; identical to SEQ ID NO: 112961

SEQ ID NO: 610833 - RNA, 64 nt, Homo Sapiens; identical to SEQ ID NO: 218966

SEQ ID NO: 610834 - RNA, 64 nt, Homo Sapiens; identical to SEQ ID NO: 218967

SEQ ID NO: 610835 - RNA, 64 nt, Homo Sapiens; identical to SEQ ID NO: 218968

SEQ ID NO: 610836 - RNA, 64 nt, Homo Sapiens; identical to SEQ ID NO: 218969

SEQ ID NO: 610837 - RNA, 64 nt, Homo Sapiens; identical to SEQ ID NO: 218970

SEQ ID NO: 610838 - RNA, 64 nt, Homo Sapiens; identical to SEQ ID NO: 218971

SEQ ID NO: 610839 - RNA, 64 nt, Homo Sapiens; identical to SEQ ID NO: 218972

SEQ ID NO: 610840 - RNA, 64 nt, Homo Sapiens; identical to SEQ ID NO: 218973

SEQ ID NO: 610841 - RNA, 64 nt, Homo Sapiens; identical to SEQ ID NO: 218974

SEQ ID NO: 610842 - RNA, 64 nt, Homo Sapiens; identical to SEQ ID NO: 218975

SEQ ID NO: 610843 - RNA, 64 nt, Homo Sapiens; identical to SEQ ID NO: 218976

SEQ ID NO: 610844 - RNA, 64 nt, Homo Sapiens; identical to SEQ ID NO: 218977

SEQ ID NO: 610845 - RNA, 64 nt, Homo Sapiens; identical to SEQ ID NO: 218978

SEQ ID NO: 610846 - RNA, 64 nt, Homo Sapiens; identical to SEQ ID NO: 218979

SEQ ID NO: 610847 - RNA, 64 nt, Homo Sapiens; identical to SEQ ID NO: 218980

SEQ ID NO: 610848 - RNA, 64 nt, Homo Sapiens; identical to SEQ ID NO: 218981

SEQ ID NO: 610849 - RNA, 64 nt, Homo Sapiens; identical to SEQ ID NO: 218982

SEQ ID NO: 610850 - RNA, 64 nt, Homo Sapiens; identical to SEQ ID NO: 218983

SEQ ID NO: 610851 - RNA, 64 nt, Homo Sapiens; identical to SEQ ID NO: 218984

SEQ ID NO: 610852 - RNA, 64 nt, Homo Sapiens; identical to SEQ ID NO: 218985

SEQ ID NO: 610853 - RNA, 64 nt, Homo Sapiens; identical to SEQ ID NO: 218986

SEQ ID NO: 610854 - RNA, 64 nt, Homo Sapiens; identical to SEQ ID NO: 218987

SEQ ID NO: 610855 - RNA, 64 nt, Homo Sapiens; identical to SEQ ID NO: 218988

SEQ ID NO: 610856 - RNA, 64 nt, Homo Sapiens; identical to SEQ ID NO: 218989

SEQ ID NO: 610857 - RNA, 64 nt, Homo Sapiens; identical to SEQ ID NO: 218990

SEQ ID NO: 610858 - RNA, 64 nt, Homo Sapiens; identical to SEQ ID NO: 218991

SEQ ID NO: 610859 - RNA, 64 nt, Homo Sapiens; identical to SEQ ID NO: 218992

SEQ ID NO: 610860 - RNA, 64 nt, Homo Sapiens; identical to SEQ ID NO: 218993

SEQ ID NO: 610861 - RNA, 64 nt, Homo Sapiens; identical to SEQ ID NO: 218994

SEQ ID NO: 610862 - RNA, 64 nt, Homo Sapiens; identical to SEQ ID NO: 218995

SEQ ID NO: 610863 - RNA, 64 nt, Homo Sapiens; identical to SEQ ID NO: 218996

SEQ ID NO: 610864 - RNA, 64 nt, Homo Sapiens; identical to SEQ ID NO: 237905

SEQ ID NO: 610865 - RNA, 64 nt, Homo Sapiens; identical to SEQ ID NO: 237906

SEQ ID NO: 610866 - RNA, 64 nt, Homo Sapiens; identical to SEQ ID NO: 60301

SEQ ID NO: 610867 - RNA, 64 nt, Homo Sapiens; identical to SEQ ID NO: 60302

SEQ ID NO: 610868 - RNA, 64 nt, Homo Sapiens; identical to SEQ ID NO: 60303

SEQ ID NO: 610869 - RNA, 64 nt, Homo Sapiens; identical to SEQ ID NO: 60304

SEQ ID NO: 610870 - RNA, 64 nt, Homo Sapiens; identical to SEQ ID NO: 60305

SEQ ID NO: 610871 - RNA, 64 nt, Homo Sapiens; identical to SEQ ID NO: 60306

SEQ ID NO: 610872 - RNA, 64 nt, Homo Sapiens; identical to SEQ ID NO: 60307

SEQ ID NO: 610873 - RNA, 64 nt, Homo Sapiens; identical to SEQ ID NO: 60308

SEQ ID NO: 610874 - RNA, 64 nt, Homo Sapiens; identical to SEQ ID NO: 60309

SEQ ID NO: 610875 - RNA, 64 nt, Homo Sapiens; identical to SEQ ID NO: 60310

SEQ ID NO: 610876 - RNA, 64 nt, Homo Sapiens; identical to SEQ ID NO: 130376

SEQ ID NO: 610877 - RNA, 64 nt, Homo Sapiens; identical to SEQ ID NO: 130377

SEQ ID NO: 610878 - RNA, 64 nt, Homo Sapiens; identical to SEQ ID NO: 130378

SEQ ID NO: 610879 - RNA, 64 nt, Homo Sapiens; identical to SEQ ID NO: 130379

SEQ ID NO: 610880 - RNA, 64 nt, Homo Sapiens
uuuaaaaaacaaaacgaaaguaagggccauccaaccauccaaccugaaugcauugguguuuaac

SEQ ID NO: 610881 - RNA, 64 nt, Homo Sapiens
auccaaccuuuaaaaaacaauguuuaacuaagggccauccaacccuaccauuugaaugcauugg

SEQ ID NO: 610882 - RNA, 64 nt, Homo Sapiens
agcugggaccacaggugugcuucucccaccucagccauccaaaugaccucucaggcucaagcga

SEQ ID NO: 610883 - RNA, 64 nt, Homo Sapiens
ucacccaguggauggaacauuggaagaaacucucccauccaacaaauugucacaugaccgguac

SEQ ID NO: 610884 - RNA, 64 nt, Homo Sapiens
cagugcuaugccuggaggcucaacacaaaacuucccauccaaacauucagaugaacugagcguc

SEQ ID NO: 610885 - RNA, 64 nt, Homo Sapiens
aucaagcuucucgcccacuccacggcucugagccccauccaagggcaagacuuggugcccagcu

SEQ ID NO: 610886 - RNA, 64 nt, Homo Sapiens
gauccgauaacuuaaaaacguagcucaucccuuaccauccaaggggcacucccuugguuggauu

SEQ ID NO: 610887 - RNA, 64 nt, Homo Sapiens
accacccaagacacaguacccagucaugguuuccccauccaacuauuaguuucauacuuugaaa

SEQ ID NO: 610888 - RNA, 64 nt, Homo Sapiens
aggugugaagggacugcuguuugcaaugggcuuaccauccaaauaucccaaaggcuuugaccag

SEQ ID NO: 610889 - RNA, 64 nt, Homo Sapiens
gaguucugcccaaauuccgauaucaccccuucccccauccaagcauccuucgauuagggaagug

SEQ ID NO: 610890 - RNA, 64 nt, Homo Sapiens
aagaccucuuguacuugguugcaaacucagaucucuagucuagucuagucuagucuagucuagu

SEQ ID NO: 610891 - RNA, 64 nt, Homo Sapiens
cucuuguacuugguugcaaacucagaucucuagucuagucuagucuagucuagucuagucaugu

SEQ ID NO: 610892 - RNA, 64 nt, Homo Sapiens
guacuugguugcaaacucagaucucuagucuagucuagucuagucuagucuagucaugugugac

SEQ ID NO: 610893 - RNA, 64 nt, Homo Sapiens
ugguugcaaacucagaucucuagucuagucuagucuagucuagucuagucaugugugacugugu

SEQ ID NO: 610894 - RNA, 64 nt, Homo Sapiens
gcaaacucagaucucuagucuagucuagucuagucuagucuagucaugugugacuguguacuga

SEQ ID NO: 610895 - RNA, 61 nt, Homo Sapiens
cgaagggcuuggaaggagacggggcaugggaggaccagagagcuguggcuuuuugggaggu

SEQ ID NO: 610896 - RNA, 61 nt, Homo Sapiens
caucuaaagcaaaaaaaaaaucccagugaugggaccagaagacaugugagcuucuuuuagg

SEQ ID NO: 610897 - RNA, 61 nt, Homo Sapiens
ggccagaugugugauucugugacuugucccaggaccagaauguaccuaagucagauccaua

SEQ ID NO: 610898 - RNA, 61 nt, Homo Sapiens
cagauccauagacgcauguugguaggucacuggaccagagcuugugaagcaggcaaccucu

SEQ ID NO: 610899 - RNA, 61 nt, Homo Sapiens
cugcacccggugagugaggaacccucuucauggaccagacucccugggagcagagagagaa

SEQ ID NO: 610900 - RNA, 61 nt, Homo Sapiens
ggcccaggccagcugggcgccaagcacuuauggaccagagugggucuggcuggcugguagc

SEQ ID NO: 610901 - RNA, 61 nt, Homo Sapiens
aaccuggccuggguugucucaugcuucccauggaccagagaucagggcaaaaagcauacgc

SEQ ID NO: 610902 - RNA, 61 nt, Homo Sapiens
cucagaugcucagaagaaagagcccugauuuggaccagaauucccggcuccugguccucac

SEQ ID NO: 610903 - RNA, 55 nt, Homo Sapiens; identical to SEQ ID NO: 199855

SEQ ID NO: 610904 - RNA, 61 nt, Homo Sapiens
caaaauaucaggaccagaauuuucuaccuaaggaccagaauuuuuuaucuagagaccagca

SEQ ID NO: 610905 - RNA, 61 nt, Homo Sapiens
ccaaagaccaagauauucugccaaaauaucaggaccagaauuuucuaccuaaggaccagaa

SEQ ID NO: 610906 - RNA, 61 nt, Homo Sapiens
caaaauaucaggaccagaauuuucuaccuaaggaccagaauuuuuugucuagagaccagca

SEQ ID NO: 610907 - RNA, 61 nt, Homo Sapiens
gauguccucucucagcuaucgauuggggguuggaccagaguagcccuuauuugugggguga

SEQ ID NO: 610908 - RNA, 61 nt, Homo Sapiens
agagaauuggagcuguacgaugaaaagcuuaggaccagaagacuuucagucucucugaaaa

SEQ ID NO: 610909 - RNA, 61 nt, Homo Sapiens
ucuuaauccuaucuauggauacauacaccguggaccagaggcuauugaaaaaguucagaaa

SEQ ID NO: 610910 - RNA, 61 nt, Homo Sapiens
ugacuagccuucauguaauuuuuucaguaagggaccagaagaauauaaacaggacuuguuu

SEQ ID NO: 610911 - RNA, 61 nt, Homo Sapiens
gcuacaccuuccagcaggugcaggagcacacggaccagauuuggaaguuccagcgccauga

SEQ ID NO: 610912 - RNA, 61 nt, Homo Sapiens
ucgagacgguggccgucagcguccacuuccaggaccagaaugacguggagcugaacaggcu

SEQ ID NO: 610913 - RNA, 61 nt, Homo Sapiens
aagaauccagauuuccuuaugguaaagagcaggaccagaggaaguugaggaaguggaggcu

SEQ ID NO: 610914 - RNA, 61 nt, Homo Sapiens
uucuaauuauauuuuaaaugaauuucaauguggaccagacaacaguuaugcuugcauuaau

SEQ ID NO: 610915 - RNA, 64 nt, Homo Sapiens; identical to SEQ ID NO: 298345

SEQ ID NO: 610916 - RNA, 64 nt, Homo Sapiens; identical to SEQ ID NO: 298346

SEQ ID NO: 610917 - RNA, 64 nt, Homo Sapiens; identical to SEQ ID NO: 298347

SEQ ID NO: 610918 - RNA, 64 nt, Homo Sapiens; identical to SEQ ID NO: 298348

SEQ ID NO: 610919 - RNA, 64 nt, Homo Sapiens; identical to SEQ ID NO: 298349

SEQ ID NO: 610920 - RNA, 64 nt, Homo Sapiens; identical to SEQ ID NO: 298350

SEQ ID NO: 610921 - RNA, 64 nt, Homo Sapiens; identical to SEQ ID NO: 298351

SEQ ID NO: 610922 - RNA, 64 nt, Homo Sapiens; identical to SEQ ID NO: 298352

SEQ ID NO: 610923 - RNA, 63 nt, Homo Sapiens
augagaguuccuuugcuuuaaccauuccuggaugccugcaaaguaaggaauaaugcaguuuuu

SEQ ID NO: 610924 - RNA, 63 nt, Homo Sapiens
uauaacuugaauaucugguacuaguuuuuucacgccugcaaucuuggagucuagguugccuug

SEQ ID NO: 610925 - RNA, 63 nt, Homo Sapiens
uuccccgaggcccacucggccuggccuuccucugccugcaagugagcagggaugggcugggga

SEQ ID NO: 610926 - RNA, 63 nt, Homo Sapiens
uuuccucugggcaggacucucuggccuucuguggccugcaaugccaggccaugugccccucug

SEQ ID NO: 610927 - RNA, 63 nt, Homo Sapiens
aaggaccuugcacugccuaccgagcucccucaugccugcaauuuaaauaccgagguguguucu

SEQ ID NO: 610928 - RNA, 63 nt, Homo Sapiens
cagcauauggaugcccuccccuuggagggcccagccugcaaaccccaucugauaccacacaug

SEQ ID NO: 610929 - RNA, 63 nt, Homo Sapiens
ugagccagugcuuuaauggcgguuugaaaauaugccugcaaucgauacuauccaguuacugcc

SEQ ID NO: 610930 - RNA, 60 nt, Homo Sapiens; identical to SEQ ID NO: 180829

SEQ ID NO: 610931 - RNA, 63 nt, Homo Sapiens
gcugccugcccacacagguuugcccguaaacacgccugcaaacacacgccugcaaacgcugcc

SEQ ID NO: 610932 - RNA, 63 nt, Homo Sapiens
gcugccugcccguaaacacgugccgguaaacacgccugcaaacacacgccugcaaacgcugcc

SEQ ID NO: 610933 - RNA, 63 nt, Homo Sapiens
gcugccugccgguaaacacgugcauguaaacacgccugcaaacgucucacauggugcuacgcc

SEQ ID NO: 610934 - RNA, 63 nt, Homo Sapiens
gccauuucuuguugugccccuuuccaagauacagccugcaagugguagcaagaagugauuaga

SEQ ID NO: 610935 - RNA, 63 nt, Homo Sapiens
cuucaguuuuacucugcugcaaaaugaaggcgggccugcaagccgacuacaccuacggaggcu

SEQ ID NO: 610936 - RNA, 63 nt, Homo Sapiens
gaaccaacagacccuaugcucucuguggguguggccugcaaaguugcuuuuagugcuggcccu

SEQ ID NO: 610937 - RNA, 63 nt, Homo Sapiens
agccuguagcauggcaaauccuggccuuccccagccugcaagggcuccagcccaaugccccag

SEQ ID NO: 610938 - RNA, 64 nt, Homo Sapiens
acaucacuuuuaagcuaauaaauauaagaauucuuuuggaaauuagagguggaaacacacugga

SEQ ID NO: 610939 - RNA, 64 nt, Homo Sapiens
uucagccaggaguaagaaaagaugguuagugauauuuggaaauaccuggauauuugcuagagga

SEQ ID NO: 610940 - RNA, 64 nt, Homo Sapiens
auuuuuauaccauaacuugaguguauugccaaaauuuggaaauccuucccaugccugaugaguu

SEQ ID NO: 610941 - RNA, 64 nt, Homo Sapiens
uagaaaaaucaucucaaacuagccaaaaggcaguuuuggaaacuacauugggggacguuauuuu

SEQ ID NO: 610942 - RNA, 64 nt, Homo Sapiens
uugacaucuaauuuaccaucaaguuguaaaauuauuuggaaaaauacagaacucguuuuauuug

SEQ ID NO: 610943 - RNA, 64 nt, Homo Sapiens
gugggguuuuuuuguuuguuuguuucuuuuguuuuuuggaaaauccgugucuuuaucuuuuuuu

SEQ ID NO: 610944 - RNA, 64 nt, Homo Sapiens
augcuaccuugcuguacauacuuauaaccuuguauuuggaaaugagaaauagguuuauauuuuc

SEQ ID NO: 610945 - RNA, 64 nt, Homo Sapiens
uaucaaauuuuuaaaauacaaguuugguaugugauuuggaaaagaugccuucuggaucuuaagc

SEQ ID NO: 610946 - RNA, 64 nt, Homo Sapiens
auauauauauacauauauauauauaauuugaauuuuuggaaacuuuagcugugcugucaacuuu

SEQ ID NO: 610947 - RNA, 64 nt, Homo Sapiens
uugaauuuuuggaaacuuuagcugugcugucaacuuuggaaaaaguaucccgguuuacuguguu

SEQ ID NO: 610948 - RNA, 64 nt, Homo Sapiens
uaaugagauacaauaaucauaucucuuuugacauuuuggaaauuuuuuuaauuuuacaaguaca

SEQ ID NO: 610949 - RNA, 64 nt, Homo Sapiens
ggaguccauuuuaacacuuaccgacuuuuuuugguuuggaaacauauuaccacgucuuaauagg

SEQ ID NO: 610950 - RNA, 64 nt, Homo Sapiens
aaaauuauuuaauuuccuuagaaaaauaacaccauuuggaaaaaaaaacugguguuaugaagaa

SEQ ID NO: 610951 - RNA, 64 nt, Homo Sapiens
gaauggaaaacuccauuguguguugcuggacuguuuuggaaauauuugguuaaauguguguuaa

SEQ ID NO: 610952 - RNA, 64 nt, Homo Sapiens
agucgucuuuuuuccccacuugagaacaaacggguuuggaaauuuuauaaaacugcuuuuuauc

SEQ ID NO: 610953 - RNA, 64 nt, Homo Sapiens
aaaaaacccagacaucagauugggagucuacaaauuuggaaaugggccgcaaaaaaucuuuucc

SEQ ID NO: 610954 - RNA, 64 nt, Homo Sapiens
aguuuggcaguuucucaaagaaugguacaaccaguuuggaaaaccacugaugguggggauguaa

SEQ ID NO: 610955 - RNA, 64 nt, Homo Sapiens
aaccuaacaguagagucaccuagggauggaaguauuuggaaaaagaacugccucacuaaauucu

SEQ ID NO: 610956 - RNA, 64 nt, Homo Sapiens
uaaaauuucaugguggauauuauuaagcuuaugauuuggaaacggucaaauuguuugcuuuugc

SEQ ID NO: 610957 - RNA, 64 nt, Homo Sapiens
auuuguuucauauguacauauaugauuagggcuuuuuggaaauaauuuaagggaucaguuauca

SEQ ID NO: 610958 - RNA, 64 nt, Homo Sapiens
uuaaaugcugcagauuugugguuuaauacuuuguuuuggaaaauccaauuacaucuuuguccac

SEQ ID NO: 610959 - RNA, 64 nt, Homo Sapiens
uagcacuugacuuuaugaaauuucauaggauuauuuuggaaauaaaccuucacaaccuucauga

SEQ ID NO: 610960 - RNA, 64 nt, Homo Sapiens
aaugauucucuaucucagguggggauuugaacuauuuggaaacaguggggaggccuguggaugg

SEQ ID NO: 610961 - RNA, 64 nt, Homo Sapiens
guuaagauaaacuguaauccugaaagacagguuuuuuggaaacucccaaauuucccaagacggc

SEQ ID NO: 610962 - RNA, 64 nt, Homo Sapiens
aauaaaccaagaauugauugugguuauuuuacuuuuuggaaaaguuuguguacuuuuaagacuu

SEQ ID NO: 610963 - RNA, 64 nt, Homo Sapiens
aaugcaaagaugaaggucugacuuuuuggguuuauuuggaaaggcuauuaaacaugcuguacau

SEQ ID NO: 610964 - RNA, 64 nt, Homo Sapiens
auauuauuaauuuuaaguccugucuuuacauccuuuuggaaaacuuguauuaccauggguuugg

SEQ ID NO: 610965 - RNA, 64 nt, Homo Sapiens
uuacauccuuuuggaaaacuuguauuaccauggguuuggaaaaaggacaacgaaaggcuuuuca

SEQ ID NO: 610966 - RNA, 64 nt, Homo Sapiens
auuccaaacucccauuugguaaaccaguugauuauuuggaaauguucacugccaaaauaguaag

SEQ ID NO: 610967 - RNA, 64 nt, Homo Sapiens
auaacuaaaugcgcuuuuaauuaaugauauaguguuuggaaaggaguagaacaugcagcauaag

SEQ ID NO: 610968 - RNA, 64 nt, Homo Sapiens
ugcuacccguugcugggggaggagucaugguuuauuuggaaaugucaguugcaaucaugguucu

SEQ ID NO: 610969 - RNA, 64 nt, Homo Sapiens
gcauaaggcuuaugacuuaaaaaaaaaaauucuuuuuggaaacacaagcauuucuuuaaggaug

SEQ ID NO: 610970 - RNA, 64 nt, Homo Sapiens
uaagcaguuucucuguuugcuugucauagcagcauuuggaaacucaaacaugcuuucauuuaca

SEQ ID NO: 610971 - RNA, 64 nt, Homo Sapiens
augugugaaccuuaagaaauccccauuuguggaauuuggaaacguguguugacuccugguggua

SEQ ID NO: 610972 - RNA, 64 nt, Homo Sapiens
gaaccuauauuugugcuugaagguguuuuugauauuuggaaacaguauaagccauuuggaguca

SEQ ID NO: 610973 - RNA, 64 nt, Homo Sapiens
cuuuugaacccucaaguuacuuuucuccugauuuuuuggaaaacacuuugcuucuuuggaaagg

SEQ ID NO: 610974 - RNA, 64 nt, Homo Sapiens
uuuucuccugauuuuuuggauaaaacuuugcuucuuuggaaagguauuucagaaaauuggaccu

SEQ ID NO: 610975 - RNA, 64 nt, Homo Sapiens
ugaacaugugaggucagauuugagccucucuacuuuuggaaaaaugguuugagaggcuagaaac

SEQ ID NO: 610976 - RNA, 64 nt, Homo Sapiens
uagguauuuuaguacaguaccaccacauauguuauuuggaaauaucugcagagacugugggcua

SEQ ID NO: 610977 - RNA, 64 nt, Homo Sapiens
uguauucauacuuaguuuuuuguguaugugcguguuuggaaaagauugggauuccauuguaagc

SEQ ID NO: 610978 - RNA, 64 nt, Homo Sapiens
acaguggagaugaggucaguagucuuggaagcuguuuggaaaaggaaagucagaaucagaagau

SEQ ID NO: 610979 - RNA, 64 nt, Homo Sapiens
cagaaucagaagauagucuuauuaaugccugcuuuuuggaaaguaugauuuuuugaaaguuaac

SEQ ID NO: 610980 - RNA, 64 nt, Homo Sapiens
agcaggucugaaaaagaggcuuccaagucaguccuuuggaaaccuacgccucccuagaagugcc

SEQ ID NO: 610981 - RNA, 64 nt, Homo Sapiens
gaguaaugaagaaauaauauaauuuucauuaaaauuuggaaacaguggauagcucaucccuagg

SEQ ID NO: 610982 - RNA, 64 nt, Homo Sapiens
aagaagugcucugaaaaaauugcuaacaauaauguuuggaaauaguagaaucccaccaggacuu

SEQ ID NO: 610983 - RNA, 64 nt, Homo Sapiens
ugggcugaaaaugaaggcccaagacugauguugauuuggaaacauuggaugcaggaagcuggga

SEQ ID NO: 610984 - RNA, 64 nt, Homo Sapiens
accauuagaaccagaccagcggaggauuuucuguuuuggaaaacuuuaaaugaaauaguagcga

SEQ ID NO: 610985 - RNA, 64 nt, Homo Sapiens
cuuuuaaguugccuugcuggguugagcuuauuucuuuggaaaccaauaauucugucaauaugga

SEQ ID NO: 610986 - RNA, 64 nt, Homo Sapiens
aguuuuaauguuuacaguuuauuuaauuccuuaauuuggaaagcaucuuagguuucuaaauauu

SEQ ID NO: 610987 - RNA, 64 nt, Homo Sapiens
gauuaagcaauauuucucaaucuugcagcuguguuuuggaaaguguuuuaaugaaaucuucaau

SEQ ID NO: 610988 - RNA, 64 nt, Homo Sapiens
uuuucuaauagacacagggacucccuccgugagcuuuggaaauguucccauaggggaaguuggc

SEQ ID NO: 610989 - RNA, 64 nt, Homo Sapiens
agauaaagugaaagaagaauuacuugaaagaggcuuuggaaaauuacucaggcacuucacaguu

SEQ ID NO: 610990 - RNA, 64 nt, Homo Sapiens
agcuuuuuaaaaaaaucuccccaguagagaaacauuuggaaaagacagaaaacuaaaaaggaag

SEQ ID NO: 610991 - RNA, 64 nt, Homo Sapiens
cuggcaugguggcucccgccuguaaucccaguacuuuggaaagccaagguaagaggauugcuug

SEQ ID NO: 610992 - RNA, 64 nt, Homo Sapiens
aaggagccuagagacagaaaugacagaucucugcuuuggaaaucacacgucuggcuucacagau

SEQ ID NO: 610993 - RNA, 64 nt, Homo Sapiens
gaugaaauguaaauacuguuuuuaacaacuaugauuuggaaaauaaaucaaugcuauaacuaug

SEQ ID NO: 610994 - RNA, 64 nt, Homo Sapiens
gaacuaguauuggauugaaugaauagucuuccauuuuggaaacguucauccacucucauauuua

SEQ ID NO: 610995 - RNA, 64 nt, Homo Sapiens
gcauuugaaugaagacuuugcaaaacacaccaaguuuggaaauacaauuguacauggaguuuug

SEQ ID NO: 610996 - RNA, 64 nt, Homo Sapiens
uguagacacugccucaacccuuuugagguuuugauuuggaaauagauuuaaaagaaaacaggcu

SEQ ID NO: 610997 - RNA, 64 nt, Homo Sapiens
ggcauuuaacugucucuuguuuuauuuuuaaguuuuuggaaaccuuuugacauaaaaugcugcc

SEQ ID NO: 610998 - RNA, 64 nt, Homo Sapiens
acugauaagggauuauuggaagucagucacagaauuuggaaauaaauucuagucucuccuuagc

SEQ ID NO: 610999 - RNA, 64 nt, Homo Sapiens
gaggaggugcuuuacacuguacuuuuugguguuuuuuggaaaaguuacauuuagaucuauucug

SEQ ID NO: 611000 - RNA, 64 nt, Homo Sapiens
agcaaggcaauguauauuaaaaguacauguuccuuuuggaaagaauaacaaaagcuagggugac

SEQ ID NO: 611001 - RNA, 64 nt, Homo Sapiens
augagauuauuuccuguguugacaugaagacaucuuuggaaaugugguagcaugucauugaugg

SEQ ID NO: 611002 - RNA, 64 nt, Homo Sapiens
auugccucugauacauaccuauucuaagaucugcuuuggaaauuuuaucuaacaaauugguuau

SEQ ID NO: 611003 - RNA, 64 nt, Homo Sapiens
aaaguucacuguacuuuuuuaaauuuguuuuuauuuuggaaauaauauggcacugccguaauuc

SEQ ID NO: 611004 - RNA, 64 nt, Homo Sapiens
ugccccuuauuuaaaaaaaaacuccacacugaucuuuggaaacuccuauaauuauuucuguagc

SEQ ID NO: 611005 - RNA, 64 nt, Homo Sapiens
gagagggggaaaaguagaucacuaaaaaggcaauuuuggaaaaauaaguuccuugauugaugaa

SEQ ID NO: 611006 - RNA, 64 nt, Homo Sapiens
caguagacucuaucgaggccuuugcacauuucacuuuggaaacaucuuggcauguugaauauua

SEQ ID NO: 611007 - RNA, 64 nt, Homo Sapiens
uggucaccuggugaaaaccccaugugucauguccuuuggaaaccuggaaagcauauguauauaa

SEQ ID NO: 611008 - RNA, 64 nt, Homo Sapiens
caguuuauaaacugauuuuuguuuuggugguuguuuuggaaaaacugauuugggggauuguuuu

SEQ ID NO: 611009 - RNA, 64 nt, Homo Sapiens
aguguuuugcuuuugucugaucagcauugugcuauuuggaaauauuuaggauugcuaucaauuu

SEQ ID NO: 611010 - RNA, 64 nt, Homo Sapiens
uuuauguauaauucuuucugucuuuguuuuuccuuuuggaaacuaagagaucagauuaaauauu

SEQ ID NO: 611011 - RNA, 64 nt, Homo Sapiens
cuucccuuuuaaagagaaaacuauuucaccuuuguuuggaaaucuacaaauauuucuguuuaag

SEQ ID NO: 611012 - RNA, 64 nt, Homo Sapiens
uauucaaacaauuugaauauuguacucugaaaguuuuggaaacgaggcaaacuuaacaaugacu

SEQ ID NO: 611013 - RNA, 64 nt, Homo Sapiens
auuaccauauagcuuaauauguuuauuaguucucuuuggaaaaaaacuaccacuguggucuuaa

SEQ ID NO: 611014 - RNA, 64 nt, Homo Sapiens
acaugagauuuuaggaauagaaauuugccggccauuuggaaagugaaaugccacuuaguucuca

SEQ ID NO: 611015 - RNA, 64 nt, Homo Sapiens
aaaucacuuuuuaaauuuucucucacugaugcccuuuggaaauuauuggaaauuucuggacuau

SEQ ID NO: 611016 - RNA, 64 nt, Homo Sapiens
uuuggaaauuauuggaaauuucuggacuauccucuuuggaaagagaaccaugaaaacaaugccu

SEQ ID NO: 611017 - RNA, 64 nt, Homo Sapiens
aacucaucacuggcuuagacaguccuggaugccauuuggaaaguaguggcccugcaagccuaaa

SEQ ID NO: 611018 - RNA, 64 nt, Homo Sapiens
uugauauggguuaaauuaugcauuuuguucagauuuuggaaauugguaugcauuauaaguuucu

SEQ ID NO: 611019 - RNA, 64 nt, Homo Sapiens
aaaagauuccugaauguaauuauaaggauuuggguuuggaaauggagggaggaauuuucauugc

SEQ ID NO: 611020 - RNA, 64 nt, Homo Sapiens
uaauacuuauuauaagcugcucccugucuauguauuuggaaaccuuuucacaaagggaauugcc

SEQ ID NO: 611021 - RNA, 64 nt, Homo Sapiens
aagaccugauuuaugaaauuuuguacuaaaaucauuuggaaaugauuguauuguaaacugaggc

SEQ ID NO: 611022 - RNA, 64 nt, Homo Sapiens
cuuacuaacaauuuuuauacagaaaaugagucauuuuggaaaugauucuuauguuuuuuuuuuu

SEQ ID NO: 611023 - RNA, 64 nt, Homo Sapiens
cccaugaagguaacuaacggaaaaaaaacaauaauuuggaaaaaugcauucacuugaaaaacua

SEQ ID NO: 611024 - RNA, 64 nt, Homo Sapiens
aguucauugaagauaaagcaccagauuuggggcauuuggaaagauuaaaaauaauaacuuauug

SEQ ID NO: 611025 - RNA, 64 nt, Homo Sapiens
uuaguauguaaguauaauucuaacuuaaaugauuuuuggaaauacacccugacagugacccuug

SEQ ID NO: 611026 - RNA, 64 nt, Homo Sapiens
agauuuuuuaauguuaggaacaaacugaaaucgcuuuggaaaucauuauugacauaucuaaaac

SEQ ID NO: 611027 - RNA, 64 nt, Homo Sapiens
uuuccauuguaucagccccuuucauaaacuuuuuuuuggaaaaaaccacuaaaauucuccaacu

SEQ ID NO: 611028 - RNA, 64 nt, Homo Sapiens
uuugauuaaaaaaaaauuuuaucacucacuuuauuuuggaaauugcaucuugggggauggggaa

SEQ ID NO: 611029 - RNA, 64 nt, Homo Sapiens
uuauugaaaccaauuucuacuucauacugauguuuuuggaaacagcaauuaaaguuuuucuucc

SEQ ID NO: 611030 - RNA, 64 nt, Homo Sapiens
ggaauuuagccucucuuuuauuguaaugugcucuuuuggaaaauaguugguuagcagggaagac

SEQ ID NO: 611031 - RNA, 64 nt, Homo Sapiens
gugaaaauuugaagcuaucucaguaaaaagcagcuuuggaaacugugaaugaucuuuagcuugu

SEQ ID NO: 611032 - RNA, 64 nt, Homo Sapiens
aguucugguaccucuguuuuacuuucuuaugcucuuuggaaacuuuuugcaaaauuuaagccug

SEQ ID NO: 611033 - RNA, 64 nt, Homo Sapiens
aaaccaaaacugaauaaagucuuugaggaaacauuuuggaaacuucacaugcauuccgcuugag

SEQ ID NO: 611034 - RNA, 64 nt, Homo Sapiens
acugaggcuugcagaauuaagguucaggggaaauuuuggaaaguugguuguauuuucauugaag

SEQ ID NO: 611035 - RNA, 64 nt, Homo Sapiens
uucuaaaaaccuucuuuuagaucuuccuugggccuuuggaaaaauaugugacaagugaauguaa

SEQ ID NO: 611036 - RNA, 64 nt, Homo Sapiens
guaaacugaccuauaacagaauaugugaaaugaauuuggaaauaaugcaagaaggcagaacuca

SEQ ID NO: 611037 - RNA, 64 nt, Homo Sapiens
gaaaauaauuuuacuauuucuuuuaaaaguauguuuuggaaaaucaaugauuuuaaugcauagc

SEQ ID NO: 611038 - RNA, 64 nt, Homo Sapiens
aucgaauauucaacaccaugaagauaaaucuuauuuuggaaaucuacugaccuuaauaccccaa

SEQ ID NO: 611039 - RNA, 64 nt, Homo Sapiens
uugagaaugccaaaccacauuuuuaucacacuucuuuggaaaucaaugccuuugcauagaaaau

SEQ ID NO: 611040 - RNA, 64 nt, Homo Sapiens
uacagaauuuugaguaauggugaaaauuguugucuuuggaaagcacaaaagaaaccuggaaagg

SEQ ID NO: 611041 - RNA, 64 nt, Homo Sapiens
ggugagcugcucgggcuucucuugguaugucuuguuuggaaaaguggauuucauucauuucuga

SEQ ID NO: 611042 - RNA, 64 nt, Homo Sapiens
ugauugaaauguucgcccaggggucuccagcaacuuuggaaaucucuuuguauuuuuacuugaa

SEQ ID NO: 611043 - RNA, 64 nt, Homo Sapiens
uuuauggucuccauuaaaauaauucaagcggguuuuuggaaaaauaaauggccuuaaguuuucu

SEQ ID NO: 611044 - RNA, 64 nt, Homo Sapiens
uauguagacaucuuuggagcugacugauacgagauuuggaaagccccacgacacacggagagac

SEQ ID NO: 611045 - RNA, 64 nt, Homo Sapiens
caguauggugugucaugucucaugucccguguguuuuggaaaagagaaggcaccaccucgcuuu

SEQ ID NO: 611046 - RNA, 64 nt, Homo Sapiens
gaagcuguagagugcugcccaacuuuuuuuuuuuuuuggaaauugcagucucacuggucgugua

SEQ ID NO: 611047 - RNA, 64 nt, Homo Sapiens
acccuuucaagacuuucuuugaggagacaaacucuuuggaaauaaguccaaggagcgcgggucg

SEQ ID NO: 611048 - RNA, 64 nt, Homo Sapiens
uagcuucaugcacacucugcauuuuauugguuuguuuggaaaauguuggccauugaauuauuca

SEQ ID NO: 611049 - RNA, 64 nt, Homo Sapiens
gccauugaauuauucauagauuuauuucaaauaguuuggaaauuguuguacuuuugaaaacaug

SEQ ID NO: 611050 - RNA, 64 nt, Homo Sapiens
auguuauuauuacuuuaaauauuauuuuaaauauuuuggaaauacugguauuuuugaauagaug

SEQ ID NO: 611051 - RNA, 64 nt, Homo Sapiens
uuauauuggagaaaaacccuaugaguguaaugaauuuggaaaaauauuuuuuucaacaacagcu

SEQ ID NO: 611052 - RNA, 64 nt, Homo Sapiens
gcagagguauauuuacauucagaguacacuuuucuuuggaaaaaauuacagguuuuuugaaaag

SEQ ID NO: 611053 - RNA, 64 nt, Homo Sapiens
ccauuagccauauauagcaaacucacuuugacauuuuggaaauaacauugugcugaggugcucc

SEQ ID NO: 611054 - RNA, 64 nt, Homo Sapiens
aauaagauaauugggagcugagcauaaaacauuauuuggaaaaauuaacuuugcuuuucuucau

SEQ ID NO: 611055 - RNA, 64 nt, Homo Sapiens
uuuuuuuucugcugccuuucccaaagugguuagguuuggaaaagagaugaugaugguaauauuu

SEQ ID NO: 611056 - RNA, 64 nt, Homo Sapiens
aucuuauuaguuaauuuguauauuuuauuaguauuuuggaaauagcauaucugagacugaagag

SEQ ID NO: 611057 - RNA, 64 nt, Homo Sapiens
ggacuuugugcagguaaccaauuacacagaaauuuuuggaaaugccauccaaaauuucugguga

SEQ ID NO: 611058 - RNA, 64 nt, Homo Sapiens
cuuuaauuauccuaauguuaacugucauguggcauuuggaaaauacagccugaauggacguagc

SEQ ID NO: 611059 - RNA, 64 nt, Homo Sapiens
aaccaaauuacuuaagaaauccacauuauugacuuuuggaaaccaagagcucaaaacacuacau

SEQ ID NO: 611060 - RNA, 64 nt, Homo Sapiens
uauuuuaugaccacaucuaauuauucagacaaaauuuggaaacuuuacuucuuucuaauccuag

SEQ ID NO: 611061 - RNA, 64 nt, Homo Sapiens
uuacaugaagcucaaguguuaaaauaugaaugacuuuggaaaauuggguccgacaguaaugauc

SEQ ID NO: 611062 - RNA, 64 nt, Homo Sapiens
uuagccaccugugcuuucugcacagaaaguaucuuuuggaaaguuggcucuaguaaccagagga

SEQ ID NO: 611063 - RNA, 64 nt, Homo Sapiens
agccuguaagcuuuuuauuagcuuuaucauuucuuuuggaaaauaaccuucuguaugacaucau

SEQ ID NO: 611064 - RNA, 64 nt, Homo Sapiens
auuaugcaaaucauuaaauaaaaaucauacaacuuuuggaaaguuaguucaacaugaacuaaaa

SEQ ID NO: 611065 - RNA, 64 nt, Homo Sapiens
aaguuaguucaacaugaacuaaaauggcaugcuauuuggaaauuuaguuugagauaaacuaaag

SEQ ID NO: 611066 - RNA, 64 nt, Homo Sapiens
ucaccacuggggucuuuggaagauaaucuuccucuuuggaaaugaauggaaaagcaaaaggccc

SEQ ID NO: 611067 - RNA, 64 nt, Homo Sapiens
ggaacuuauugcuuaucuuuagaaaauguucuaguuuggaaacagauucuugagauucagaagg

SEQ ID NO: 611068 - RNA, 64 nt, Homo Sapiens
ccaagauuucuggagcagauuguacagcugugacuuuggaaaacagaaaguaagacccucagaa

SEQ ID NO: 611069 - RNA, 64 nt, Homo Sapiens
auucaaagucacuaugaaaauuuuacucauguaguuuggaaaugcaacauuuuccuaucaugaa

SEQ ID NO: 611070 - RNA, 64 nt, Homo Sapiens
auguaaguuaaauauaucaagaaagaagagacuguuuggaaaaaugugguucaaguuuuaugcu

SEQ ID NO: 611071 - RNA, 64 nt, Homo Sapiens
auguaugucaauuauuuucaaaugucuaaauuccuuuggaaauaaaaauaucaguuuuacuuug

SEQ ID NO: 611072 - RNA, 64 nt, Homo Sapiens
gcuauaaaguuucuuugauguguuugucaaaacauuuggaaaaagucaaccucccaguuuaaag

SEQ ID NO: 611073 - RNA, 64 nt, Homo Sapiens
ccaucuucccuacucauuccuaugggaaugaugcuuuggaaauuauuagauauauccuauuccc

SEQ ID NO: 611074 - RNA, 64 nt, Homo Sapiens
ccguaaacauuuuuguuugcuucauuuauuuauguuuggaaacccccuacugccuaaacacuau

SEQ ID NO: 611075 - RNA, 64 nt, Homo Sapiens
cuccagguccucauguauuguauuuuuuuaagcuuuuggaaaagauaauuccauuuuuuauuuu

SEQ ID NO: 611076 - RNA, 64 nt, Homo Sapiens
aaaccuguucugucccaaauuguguucagggaccuuuggaaauagggcuguucauugucauugc

SEQ ID NO: 611077 - RNA, 64 nt, Homo Sapiens
agcgaauuaaccuaagacacuguuaaaaucuguguuuggaaaaucaaauuccuccauggccaag

SEQ ID NO: 611078 - RNA, 64 nt, Homo Sapiens
aaacacaaaugguaacauaucuaauaugcgugucuuuggaaauuacagguuuacacuaguugag

SEQ ID NO: 611079 - RNA, 64 nt, Homo Sapiens
uacaucuuauuugugaaaugaucgaauggauuuguuuggaaagcauauaguugugauaaugguc

SEQ ID NO: 611080 - RNA, 64 nt, Homo Sapiens
aguuggugaaaugcgcagccggauuccugggcccuuuggaaaagcacugucugggccccaucug

SEQ ID NO: 611081 - RNA, 64 nt, Homo Sapiens
cuagcaccugcuugcuacgcagcaaagggauagguuuggaaaccuaucauuuccuguccuuccu

SEQ ID NO: 611082 - RNA, 64 nt, Homo Sapiens
ugugcauacauaaccuucuugugcaccaugaguauuuggaaaguuaauccuuguuuuugucgug

SEQ ID NO: 611083 - RNA, 64 nt, Homo Sapiens
acccaaauaaaugagaagcuuugaauuguauacauuuggaaagucuuguuuuuauuuuucuacu

SEQ ID NO: 611084 - RNA, 64 nt, Homo Sapiens
ugacaagcauugcaucccaguuucucuuuguccuuuuggaaaaaggguugagccugugacuugg

SEQ ID NO: 611085 - RNA, 64 nt, Homo Sapiens
ugucuuuugaagccagcugugguaguacaauuucuuuggaaagggugguuuacacguuaauaga

SEQ ID NO: 611086 - RNA, 64 nt, Homo Sapiens
augugaaauccuuuuaauuuaccgggcaguacacuuuggaaagaguaacaugcgugugccagac

SEQ ID NO: 611087 - RNA, 64 nt, Homo Sapiens
aaugagcugagaaaagacagagcauaucuguguauuuggaaaaauaauuguaacguaauugcag

SEQ ID NO: 611088 - RNA, 64 nt, Homo Sapiens
ucuauuuggaccuguuucuaucucuaaaugaauuuuuggaaacauuaaugagguuuacauauuu

SEQ ID NO: 611089 - RNA, 64 nt, Homo Sapiens
uuuccugcagcauuagguauuaucuucauacacguuuggaaauguuagcucugccaccaauaug

SEQ ID NO: 611090 - RNA, 64 nt, Homo Sapiens
ucuuuccaccauucaggaggguucaagggaacuguuuggaaacugaguuguguauuuuguaaau

SEQ ID NO: 611091 - RNA, 64 nt, Homo Sapiens
cagauucauagucaugaaaauuugggaacccaauuuuggaaaacugaaacauuuagaaacugga

SEQ ID NO: 611092 - RNA, 64 nt, Homo Sapiens
uggcuggagagagcugaggaucauuaagauuuuauuuggaaaggauaaaggauuuaaaauauau

SEQ ID NO: 611093 - RNA, 64 nt, Homo Sapiens
aaagcauagagaugaauuguaccuggccauguacuuuggaaaagauauaugcaaaguaauucaa

SEQ ID NO: 611094 - RNA, 64 nt, Homo Sapiens
uucuuggcucuagauuuaucaaucugcauguauuuuuggaaauauaacauauauaggccaagga

SEQ ID NO: 611095 - RNA, 64 nt, Homo Sapiens
aaagggcccccuaacccucuuguggcuccaguuauuuggaaacuaugaucugcauccuuaggaa

SEQ ID NO: 611096 - RNA, 64 nt, Homo Sapiens
cauuaguuuuuuugaaaacucuugguuuuguuuuuuuggaaaugagugggccacuaagccacac

SEQ ID NO: 611097 - RNA, 64 nt, Homo Sapiens
aaaacaaagugcaauuguuuaguuucugccucuuuuuggaaaagcuuuuuacuuugaagaaauc

SEQ ID NO: 611098 - RNA, 64 nt, Homo Sapiens
cuagaaugggucccuggugcaauaugugccuagcuuuggaaagucuauuuuguauacucucuuu

SEQ ID NO: 611099 - RNA, 64 nt, Homo Sapiens
cugccuggagagaagaacuggugugaaauuuguauuuggaaaaggaaaagcccuuauuuggaaa

SEQ ID NO: 611100 - RNA, 64 nt, Homo Sapiens
gugaaauuuguauuuggaaaaagaaaagcccuuauuuggaaagucccauaaucaguaaccuauc

SEQ ID NO: 611101 - RNA, 64 nt, Homo Sapiens
aagcccuuggaagcaaguggacccuggaugucacuuuggaaacccguuuuccccaaccucuuac

SEQ ID NO: 611102 - RNA, 64 nt, Homo Sapiens
auucuaaacacaaaaaagggccugagcacacugcuuuggaaauugacacugagcaggagggagg

SEQ ID NO: 611103 - RNA, 64 nt, Homo Sapiens
gagugcuguuacacuuaaggaaaauuagugccauuuuggaaaugagaucuugugccauaaauac

SEQ ID NO: 611104 - RNA, 64 nt, Homo Sapiens
agauaauugauguaagaauccugacuuuuuuauauuuggaaacaucaaauaaaaauggaaaaaa

SEQ ID NO: 611105 - RNA, 64 nt, Homo Sapiens
caccugagaccacuucauaguggggugaccaagguuuggaaagcuguuuacccuuuggaaaccc

SEQ ID NO: 611106 - RNA, 64 nt, Homo Sapiens
cuggggugaccaagguuuggcugcuuguuuacccuuuggaaaccucacccauguugaaugccug

SEQ ID NO: 611107 - RNA, 64 nt, Homo Sapiens
aacaaauguaauuaauaacuuucucugugaaagcuuuggaaaaaucuuuuuuuuuuuuuuuggu

SEQ ID NO: 611108 - RNA, 64 nt, Homo Sapiens
uaauagauggggcauauaauaaagaagcuacuauuuuggaaaaugacauuuuacuauuugccaa

SEQ ID NO: 611109 - RNA, 64 nt, Homo Sapiens
uacuuuuuguacaaauugaaaaccaaagcuuguauuuggaaauuaguacauaaucaguucuacu

SEQ ID NO: 611110 - RNA, 64 nt, Homo Sapiens
uggauuugacaguacauaauuuuccuugaacaacuuuggaaaaagugcuagucaaguuguuguu

SEQ ID NO: 611111 - RNA, 64 nt, Homo Sapiens
uuuucuagaaacagaaaaucacuguauuaaauauuuuggaaagauuguucugaaagaagucugu

SEQ ID NO: 611112 - RNA, 64 nt, Homo Sapiens
aagacuaaguugaguuauacuucuugguucacauuuuggaaaucagagauuacagauuacaugg

SEQ ID NO: 611113 - RNA, 64 nt, Homo Sapiens
aacuuuaauuaggaucauauccucugacugaugguuuggaaaauuggacauuuguuccacccga

SEQ ID NO: 611114 - RNA, 64 nt, Homo Sapiens
auuacuuuugaaccauguauugugagggguuucuuuuggaaauaaauacuuaaauauuuguaau

SEQ ID NO: 611115 - RNA, 64 nt, Homo Sapiens
ucacagaguuucacccuuaaaggaggcagaaagauuuggaaaauaaauugacaagcuaggaaag

SEQ ID NO: 611116 - RNA, 64 nt, Homo Sapiens
guauauuuugagagagauauuuuugggacauuauuuuggaaacuuauuacaaaucuaaauuugg

SEQ ID NO: 611117 - RNA, 64 nt, Homo Sapiens
ggacauuauuuuggaaacuuauuacaaaucuaaauuuggaaaggagcuaguagcuuuaaggcca

SEQ ID NO: 611118 - RNA, 64 nt, Homo Sapiens
aguaacauugauauuucuuggaaaggaaaaaacauuuggaaaauggacuauacuaguaggagag

SEQ ID NO: 611119 - RNA, 64 nt, Homo Sapiens
cuucuugagugagguggccugcugucuggagguguuuggaaaggauggggcaugguggccucag

SEQ ID NO: 611120 - RNA, 64 nt, Homo Sapiens
uccucauuauguagaauggagugggccaaugcauuuuggaaaugaucagcaaaguaauaguaau

SEQ ID NO: 611121 - RNA, 64 nt, Homo Sapiens
guguuaccuauauuucuagcuuuugggaaaaaacuuuggaaaguaugcaccuuacugccuagau

SEQ ID NO: 611122 - RNA, 64 nt, Homo Sapiens
gaaauacuuuacuauugaguauggaaaacugaaauuuggaaaaaaaaguuugaugcauuuugag

SEQ ID NO: 611123 - RNA, 64 nt, Homo Sapiens
uaaaccagugaacaauauuuuagccugaugcucauuuggaaaaagagggcugcguauuuguaaa

SEQ ID NO: 611124 - RNA, 64 nt, Homo Sapiens
cuuuuuccccuccuuaauuuuccaaagauuuccuuuuggaaacguuauuugcaguaaaccgauc

SEQ ID NO: 611125 - RNA, 64 nt, Homo Sapiens
aagcaggacauggacaaggaugaucuaggaagacuuuggaaagaguaggaagacuuuggaaaga

SEQ ID NO: 611126 - RNA, 64 nt, Homo Sapiens
ugaucuaggaagacuuuggaaagaguaggaagacuuuggaaagacuuuuccaacccucaucacc

SEQ ID NO: 611127 - RNA, 64 nt, Homo Sapiens
gcccggcccagccccaggccagucagccgcagacuuuggaaagcccaacgaccauggagagaug

SEQ ID NO: 611128 - RNA, 64 nt, Homo Sapiens
auauuaaaaagaaguacauguucauuguagagaauuuggaaacuguagaagagaaucaagaaga

SEQ ID NO: 611129 - RNA, 64 nt, Homo Sapiens
gaucaaccacuguuccuucuaagugaccaucacauuuggaaaguaagaggcccucugggugaug

SEQ ID NO: 611130 - RNA, 64 nt, Homo Sapiens
cuagccaaggggauuucgugucacagccaggaaauuuggaaaucaguugccgaaccaggccgcc

SEQ ID NO: 611131 - RNA, 64 nt, Homo Sapiens
gggacccuccagccuggagaaucuggggacacacuuuggaaaguucuagaaaagccacaccugc

SEQ ID NO: 611132 - RNA, 64 nt, Homo Sapiens
cggccuuuugaccagaacgcgaagcagcaugcacuuuggaaaucugaacucugaccugugaaua

SEQ ID NO: 611133 - RNA, 64 nt, Homo Sapiens
cuuuauucgagggaaggaucaaugcuuauuaccauuuggaaaaacgaagaucagaagguaaaug

SEQ ID NO: 611134 - RNA, 64 nt, Homo Sapiens
cccuucugacacagugugugcacuucaggcaauuuuuggaaaauauaaaaaauuccaaauucug

SEQ ID NO: 611135 - RNA, 64 nt, Homo Sapiens
uuaugugaacuguuguccuugcuuuacaccaccauuuggaaaacuuaccaguuuuuagauguag

SEQ ID NO: 611136 - RNA, 64 nt, Homo Sapiens
guuuacaaaaauaagucuuuuugccuuaagucauuuuggaaauaaguaauacugcaucugacuc

SEQ ID NO: 611137 - RNA, 64 nt, Homo Sapiens
guaauguaacaaaacucucuagaugugguuacuauuuggaaaguuaacaugaaaauuaguagga

SEQ ID NO: 611138 - RNA, 64 nt, Homo Sapiens
auaugugaugaaauugagcuggagauuagaaaucuuuggaaaaccaguauugaagacuuuacaa

SEQ ID NO: 611139 - RNA, 64 nt, Homo Sapiens
gaagauccuuaucuauauucauuccuucauuacuuuuggaaaauucuuacuugugaauguuaaa

SEQ ID NO: 611140 - RNA, 64 nt, Homo Sapiens
uuggagcaaauccuuuaauacuaucucucauuguuuuggaaacaaggugugauuaugcuauacu

SEQ ID NO: 611141 - RNA, 64 nt, Homo Sapiens
uauaaccgcauuuugugcuuucaaauaacgcaguuuuggaaacccaauuuuuuucauggugaaa

SEQ ID NO: 611142 - RNA, 64 nt, Homo Sapiens
cuacuauugcguuucaauguguuauuugagguuuuuuggaaagccuuaugaaauguuucacuga

SEQ ID NO: 611143 - RNA, 64 nt, Homo Sapiens
agcccagggacuuaacgugcagccuccucuuggcuuuggaaaagcaaagcucgcuucuccaggg

SEQ ID NO: 611144 - RNA, 64 nt, Homo Sapiens
aguguuuuccaugugacccuugacuauagcagauuuuggaaaucuuauuccuauuuaauguuau

SEQ ID NO: 611145 - RNA, 64 nt, Homo Sapiens
ucuccugaaugcauccuuaaugauuccaggaugguuuggaaacuggccacuuaccaaacucagg

SEQ ID NO: 611146 - RNA, 64 nt, Homo Sapiens
ggguucagaacacuuuuuauauuaccguuaugucuuuggaaaucugcaauauuguaguucauau

SEQ ID NO: 611147 - RNA, 64 nt, Homo Sapiens
uggaagaugguuuuauucuuguaacaaugcaugcuuuggaaauuuuugaaauacuuaaugccaa

SEQ ID NO: 611148 - RNA, 64 nt, Homo Sapiens
guugguugagauaguugguuuagccaaaaacuuuuuuggaaacuugguuucuauacaugaauca

SEQ ID NO: 611149 - RNA, 64 nt, Homo Sapiens
guaucaccuuucccagauucaagccaggaaagcguuuggaaaacguuguuuuacaucuuuuggg

SEQ ID NO: 611150 - RNA, 64 nt, Homo Sapiens
aggcuucaauuagaauuauucuuaaaaaguaauuuuuggaaauggaaaugaaacauuaaaagaa

SEQ ID NO: 611151 - RNA, 64 nt, Homo Sapiens
aaacauuaaaagaacuuaaacccaauauauauuuuuuggaaauggacagcccuaugaaaaaaua

SEQ ID NO: 611152 - RNA, 64 nt, Homo Sapiens
ucuggcuuuuuuuuuucuuuuguuuugguuugguuuuggaaaacuaauuaauuagacuugugug

SEQ ID NO: 611153 - RNA, 64 nt, Homo Sapiens
agcaguugacucagagugcaagaagucuggccauuuuggaaagcaagguuuccuuucagcccug

SEQ ID NO: 611154 - RNA, 64 nt, Homo Sapiens
uggucacccagacuagacaccuucugugcucauguuuggaaagcugaaagggaaggacagcugu

SEQ ID NO: 611155 - RNA, 64 nt, Homo Sapiens
gcucacugagauagauacauaucugauugccuccuuuggaaaggcuaaucagaaacucaaaaga

SEQ ID NO: 611156 - RNA, 64 nt, Homo Sapiens
acugagaccugucucggauuuucuggguucacauuuuggaaaccaugaauggauucugggugga

SEQ ID NO: 611157 - RNA, 64 nt, Homo Sapiens
ugccucaaaauaauugagaucacauuucaggacauuuggaaaucaggucgauuugugguaacug

SEQ ID NO: 611158 - RNA, 64 nt, Homo Sapiens
uuauucucucuucucuuuguuucaacuggauuccuuuggaaaaccaaacuaguaucagaacaaa

SEQ ID NO: 611159 - RNA, 64 nt, Homo Sapiens
uguagcagaaaccaacaagaaccacuccuucauguuuggaaaauaauuucucuuguauuaucuc

SEQ ID NO: 611160 - RNA, 64 nt, Homo Sapiens
caggggcucuguggcaaaaagagucagacauuucuuuggaaaacagcgaacagccuuagagcuc

SEQ ID NO: 611161 - RNA, 64 nt, Homo Sapiens
ugcuugaaggaguagaugaaccagaaucugagaauuuggaaauaggucacagaaaaagccucca

SEQ ID NO: 611162 - RNA, 64 nt, Homo Sapiens
uuugugagaauaaauguuagaaaaguuaguuuauuuuggaaaccugccgugaaaggaaauucua

SEQ ID NO: 611163 - RNA, 64 nt, Homo Sapiens
cacggcaaucagaagaaaggagcugagaugagguuuuggaaaacccugacaccuuuaaaaagca

SEQ ID NO: 611164 - RNA, 64 nt, Homo Sapiens
aggagaaauagcuguauagaugaguuuuucauuauuuggaaauuuagggguagaaaauguuuuc

SEQ ID NO: 611165 - RNA, 64 nt, Homo Sapiens
uauuggaguuaaucuguauuauauuguaccuugauuuggaaaagcuguacuauuauuaauguuu

SEQ ID NO: 611166 - RNA, 64 nt, Homo Sapiens
gggaaggagccaccccaaaauuaaacuuggccaauuuggaaaggcauauaugcagugcuuuuuc

SEQ ID NO: 611167 - RNA, 64 nt, Homo Sapiens; identical to SEQ ID NO: 455202

SEQ ID NO: 611168 - RNA, 64 nt, Homo Sapiens; identical to SEQ ID NO: 455203

SEQ ID NO: 611169 - RNA, 64 nt, Homo Sapiens; identical to SEQ ID NO: 455204

SEQ ID NO: 611170 - RNA, 64 nt, Homo Sapiens; identical to SEQ ID NO: 455205

SEQ ID NO: 611171 - RNA, 64 nt, Homo Sapiens; identical to SEQ ID NO: 455206

SEQ ID NO: 611172 - RNA, 64 nt, Homo Sapiens; identical to SEQ ID NO: 455207

SEQ ID NO: 611173 - RNA, 64 nt, Homo Sapiens; identical to SEQ ID NO: 455208

SEQ ID NO: 611174 - RNA, 64 nt, Homo Sapiens; identical to SEQ ID NO: 455209

SEQ ID NO: 611175 - RNA, 64 nt, Homo Sapiens; identical to SEQ ID NO: 455210

SEQ ID NO: 611176 - RNA, 64 nt, Homo Sapiens; identical to SEQ ID NO: 455211

SEQ ID NO: 611177 - RNA, 64 nt, Homo Sapiens; identical to SEQ ID NO: 115857

SEQ ID NO: 611178 - RNA, 64 nt, Homo Sapiens; identical to SEQ ID NO: 115858

SEQ ID NO: 611179 - RNA, 64 nt, Homo Sapiens; identical to SEQ ID NO: 115859

SEQ ID NO: 611180 - RNA, 64 nt, Homo Sapiens; identical to SEQ ID NO: 115860

SEQ ID NO: 611181 - RNA, 64 nt, Homo Sapiens
uaaaaguuugggcagagggaaccaggcacguuaaagaagacagaaagcggacuaugcagagugc

SEQ ID NO: 611182 - RNA, 64 nt, Homo Sapiens
aguaaaaggaguugagagaaagaugggucaguucagaagacauacacaggagaaauuguaguga

SEQ ID NO: 611183 - RNA, 64 nt, Homo Sapiens
ucuucaucagaagcuuuaaucaaagaagaugagcagaagacaaucacuggcucccuguuaccag

SEQ ID NO: 611184 - RNA, 64 nt, Homo Sapiens
agauccaaagucaaagcaaccauacuucaccuagagaagacaguauuggcaaucaugacaccug

SEQ ID NO: 611185 - RNA, 64 nt, Homo Sapiens
cccuuuccccaccuuccuuauuguugaaagcagaagaagacagaggggacauacacuugcaucu

SEQ ID NO: 611186 - RNA, 64 nt, Homo Sapiens
auccgguuaagagucugugcaagaauaaucaaaaagaagacauuaacaaacccaaauuggugaa

SEQ ID NO: 611187 - RNA, 64 nt, Homo Sapiens
uauuuacauuuaaauagauugaaggacuccaacuagaagacagaugaguuggaaacaaaaacau

SEQ ID NO: 611188 - RNA, 64 nt, Homo Sapiens
uuauuuaaaacuugagcaggcaguacuuugagugagaagacaguacauaccuucucuguuguau

SEQ ID NO: 611189 - RNA, 64 nt, Homo Sapiens
gugaacuugaaguuugcgcaaaauguggaaagaaagaagacauuguuauuccgugaguguuucc

SEQ ID NO: 611190 - RNA, 64 nt, Homo Sapiens
aaagugaugaugauuuagauuuugauauugauuuagaagacacaggaggagaccaucaaaugaa

SEQ ID NO: 611191 - RNA, 64 nt, Homo Sapiens
ccaauagcacugaccuggugaucaaaaacacuugagaagacaucuauuggccaucucuggccaa

SEQ ID NO: 611192 - RNA, 64 nt, Homo Sapiens
aaaauggugacaaagcuguacagauagagauaauagaagacaaagagauuaaaaggaaauaaaa

SEQ ID NO: 611193 - RNA, 64 nt, Homo Sapiens
cucaguagguagacacaaacauaaagauuucccuagaagacauagagugggauuugauaacacu

SEQ ID NO: 611194 - RNA, 64 nt, Homo Sapiens
gcaacucuuucaugaagagcuuagcuaugaccuuagaagacaaagccuguuugucauggcugcc

SEQ ID NO: 611195 - RNA, 64 nt, Homo Sapiens
cuauucugagagucaucuguuuguauggucuuguagaagacaguccuguaagaucgagcaacca

SEQ ID NO: 611196 - RNA, 64 nt, Homo Sapiens
guauacauuuucaucugcaucaagcuuaugggggagaagacacuccuguuuuccaugaacauuu

SEQ ID NO: 611197 - RNA, 64 nt, Homo Sapiens
uuacaaaaucaagaugacaaaggaagaaaaauuaagaagacaacgaugaaaggcuucuauuugg

SEQ ID NO: 611198 - RNA, 64 nt, Homo Sapiens
gagacuguugcucaaccaucaggaaacaguugucagaagacaucauugguucuguguuuccuac

SEQ ID NO: 611199 - RNA, 64 nt, Homo Sapiens
agucgcauaggguuuuuuaaugcagaauuuugucagaagacaauggcgcugcauguuuuucuuu

SEQ ID NO: 611200 - RNA, 64 nt, Homo Sapiens
gcucucgagggcagcacugacaaauguguuccuaagaagacauucagacccagguguuaugcag

SEQ ID NO: 611201 - RNA, 64 nt, Homo Sapiens
gcugagcaaccacauauugcuacaaggcaaaucaagaagacaucaggaaaucagaugcacagga

SEQ ID NO: 611202 - RNA, 64 nt, Homo Sapiens
guguugccuuacccagaaugacugucuuuauugcagaagacaguacacacacacacacacucug

SEQ ID NO: 611203 - RNA, 64 nt, Homo Sapiens
guguugccuuaccagaaugaacagucuuuauugcagaagacaguacacacacacacacacacac

SEQ ID NO: 611204 - RNA, 64 nt, Homo Sapiens
guguugccuuauaggcgugaagagucuuuauugcagaagacaguacacacacauacacacacac

SEQ ID NO: 611205 - RNA, 64 nt, Homo Sapiens
guguugccuuacccagaaugacacacacuauuucagaagacaguacacacacacacacacacac

SEQ ID NO: 611206 - RNA, 64 nt, Homo Sapiens
gcuacagcaauggucagcuuggaaaccacagugaagaagacagcacugaugaccaaagagaaga

SEQ ID NO: 611207 - RNA, 64 nt, Homo Sapiens
accacagugaagaagacagcacugaugaccaaagagaagacacucauauuaagccuauuuauaa

SEQ ID NO: 611208 - RNA, 64 nt, Homo Sapiens
uccgguugagagaacagauuuccugauuggaaauagaagacauugcaaguaagucaagguuuua

SEQ ID NO: 611209 - RNA, 64 nt, Homo Sapiens
cagggaagugaaaggucccaucagaaacgcggccagaagacaagguguguggggggcgugccuc

SEQ ID NO: 611210 - RNA, 64 nt, Homo Sapiens
caaaauuugaugugcuacaacacauagcuuuaaaagaagacauuugugugcgugcgugugugcg

SEQ ID NO: 611211 - RNA, 64 nt, Homo Sapiens
gcauuuuacucagaagucauagcucacggaauauagaagacauggcauuccugcaagacugugc

SEQ ID NO: 611212 - RNA, 64 nt, Homo Sapiens
auugguguuuagauucuggaccaugugacuggggagaagacaaauacuccagcuuguggcauuc

SEQ ID NO: 611213 - RNA, 64 nt, Homo Sapiens
uucccugaguaaucaucaccgcugucacuucaaaagaagacaguuuacucuguccaucuuggua

SEQ ID NO: 611214 - RNA, 64 nt, Homo Sapiens
ggagcugcgagcaggugggcucuugaaaacggccucgggagacgggcacgauaccagggcagcc

SEQ ID NO: 611215 - RNA, 64 nt, Homo Sapiens
cuuccuucuguaacaccagaaggcuugggaagguucgggagaugcucccaggucucccugcuuc

SEQ ID NO: 611216 - RNA, 64 nt, Homo Sapiens; identical to SEQ ID NO: 45285

SEQ ID NO: 611217 - RNA, 64 nt, Homo Sapiens; identical to SEQ ID NO: 45286

SEQ ID NO: 611218 - RNA, 64 nt, Homo Sapiens; identical to SEQ ID NO: 45287

SEQ ID NO: 611219 - RNA, 64 nt, Homo Sapiens; identical to SEQ ID NO: 45288

SEQ ID NO: 611220 - RNA, 64 nt, Homo Sapiens; identical to SEQ ID NO: 45289

SEQ ID NO: 611221 - RNA, 64 nt, Homo Sapiens; identical to SEQ ID NO: 45290

SEQ ID NO: 611222 - RNA, 64 nt, Homo Sapiens; identical to SEQ ID NO: 45291

SEQ ID NO: 611223 - RNA, 64 nt, Homo Sapiens; identical to SEQ ID NO: 45292

SEQ ID NO: 611224 - RNA, 64 nt, Homo Sapiens; identical to SEQ ID NO: 45293

SEQ ID NO: 611225 - RNA, 64 nt, Homo Sapiens; identical to SEQ ID NO: 45294

SEQ ID NO: 611226 - RNA, 64 nt, Homo Sapiens; identical to SEQ ID NO: 45295

SEQ ID NO: 611227 - RNA, 64 nt, Homo Sapiens; identical to SEQ ID NO: 45296

SEQ ID NO: 611228 - RNA, 64 nt, Homo Sapiens; identical to SEQ ID NO: 45297

SEQ ID NO: 611229 - RNA, 64 nt, Homo Sapiens; identical to SEQ ID NO: 45298

SEQ ID NO: 611230 - RNA, 64 nt, Homo Sapiens; identical to SEQ ID NO: 45299

SEQ ID NO: 611231 - RNA, 64 nt, Homo Sapiens; identical to SEQ ID NO: 45300

SEQ ID NO: 611232 - RNA, 64 nt, Homo Sapiens; identical to SEQ ID NO: 45301

SEQ ID NO: 611233 - RNA, 64 nt, Homo Sapiens; identical to SEQ ID NO: 45302

SEQ ID NO: 611234 - RNA, 64 nt, Homo Sapiens; identical to SEQ ID NO: 45303

SEQ ID NO: 611235 - RNA, 64 nt, Homo Sapiens; identical to SEQ ID NO: 45304

SEQ ID NO: 611236 - RNA, 64 nt, Homo Sapiens; identical to SEQ ID NO: 45305

SEQ ID NO: 611237 - RNA, 64 nt, Homo Sapiens; identical to SEQ ID NO: 45306

SEQ ID NO: 611238 - RNA, 64 nt, Homo Sapiens; identical to SEQ ID NO: 45307

SEQ ID NO: 611239 - RNA, 64 nt, Homo Sapiens; identical to SEQ ID NO: 45308

SEQ ID NO: 611240 - RNA, 64 nt, Homo Sapiens; identical to SEQ ID NO: 45309

SEQ ID NO: 611241 - RNA, 64 nt, Homo Sapiens; identical to SEQ ID NO: 45310

SEQ ID NO: 611242 - RNA, 64 nt, Homo Sapiens; identical to SEQ ID NO: 45311

SEQ ID NO: 611243 - RNA, 64 nt, Homo Sapiens; identical to SEQ ID NO: 45312

SEQ ID NO: 611244 - RNA, 64 nt, Homo Sapiens; identical to SEQ ID NO: 45312

SEQ ID NO: 611245 - RNA, 64 nt, Homo Sapiens; identical to SEQ ID NO: 45314

SEQ ID NO: 611246 - RNA, 64 nt, Homo Sapiens; identical to SEQ ID NO: 45315

SEQ ID NO: 611247 - RNA, 64 nt, Homo Sapiens; identical to SEQ ID NO: 45316

SEQ ID NO: 611248 - RNA, 64 nt, Homo Sapiens; identical to SEQ ID NO: 45317

SEQ ID NO: 611249 - RNA, 64 nt, Homo Sapiens; identical to SEQ ID NO: 45318

SEQ ID NO: 611250 - RNA, 64 nt, Homo Sapiens; identical to SEQ ID NO: 45319

SEQ ID NO: 611251 - RNA, 64 nt, Homo Sapiens; identical to SEQ ID NO: 247936

SEQ ID NO: 611252 - RNA, 64 nt, Homo Sapiens; identical to SEQ ID NO: 247937

SEQ ID NO: 611253 - RNA, 64 nt, Homo Sapiens; identical to SEQ ID NO: 247938

SEQ ID NO: 611254 - RNA, 64 nt, Homo Sapiens; identical to SEQ ID NO: 247939

SEQ ID NO: 611255 - RNA, 64 nt, Homo Sapiens; identical to SEQ ID NO: 247940

SEQ ID NO: 611256 - RNA, 64 nt, Homo Sapiens; identical to SEQ ID NO: 247941

SEQ ID NO: 611257 - RNA, 64 nt, Homo Sapiens; identical to SEQ ID NO: 247942

SEQ ID NO: 611258 - RNA, 64 nt, Homo Sapiens; identical to SEQ ID NO: 247943

SEQ ID NO: 611259 - RNA, 64 nt, Homo Sapiens; identical to SEQ ID NO: 247944

SEQ ID NO: 611260 - RNA, 64 nt, Homo Sapiens; identical to SEQ ID NO: 247945

SEQ ID NO: 611261 - RNA, 64 nt, Homo Sapiens; identical to SEQ ID NO: 247946

SEQ ID NO: 611262 - RNA, 64 nt, Homo Sapiens; identical to SEQ ID NO: 247947

SEQ ID NO: 611263 - RNA, 64 nt, Homo Sapiens; identical to SEQ ID NO: 247948

SEQ ID NO: 611264 - RNA, 64 nt, Homo Sapiens; identical to SEQ ID NO: 247949

SEQ ID NO: 611265 - RNA, 64 nt, Homo Sapiens; identical to SEQ ID NO: 247950

SEQ ID NO: 611266 - RNA, 64 nt, Homo Sapiens; identical to SEQ ID NO: 247951

SEQ ID NO: 611267 - RNA, 64 nt, Homo Sapiens; identical to SEQ ID NO: 247952

SEQ ID NO: 611268 - RNA, 64 nt, Homo Sapiens; identical to SEQ ID NO: 247953

SEQ ID NO: 611269 - RNA, 64 nt, Homo Sapiens; identical to SEQ ID NO: 247954

SEQ ID NO: 611270 - RNA, 64 nt, Homo Sapiens; identical to SEQ ID NO: 247955

SEQ ID NO: 611271 - RNA, 64 nt, Homo Sapiens; identical to SEQ ID NO: 247956

SEQ ID NO: 611272 - RNA, 64 nt, Homo Sapiens; identical to SEQ ID NO: 247957

SEQ ID NO: 611273 - RNA, 64 nt, Homo Sapiens; identical to SEQ ID NO: 247958

SEQ ID NO: 611274 - RNA, 64 nt, Homo Sapiens; identical to SEQ ID NO: 247959

SEQ ID NO: 611275 - RNA, 64 nt, Homo Sapiens; identical to SEQ ID NO: 247960

SEQ ID NO: 611276 - RNA, 64 nt, Homo Sapiens; identical to SEQ ID NO: 247961

SEQ ID NO: 611277 - RNA, 64 nt, Homo Sapiens; identical to SEQ ID NO: 247962

SEQ ID NO: 611278 - RNA, 64 nt, Homo Sapiens; identical to SEQ ID NO: 247963

SEQ ID NO: 611279 - RNA, 64 nt, Homo Sapiens; identical to SEQ ID NO: 247964

SEQ ID NO: 611280 - RNA, 64 nt, Homo Sapiens; identical to SEQ ID NO: 247965

SEQ ID NO: 611281 - RNA, 64 nt, Homo Sapiens; identical to SEQ ID NO: 247966

SEQ ID NO: 611282 - RNA, 64 nt, Homo Sapiens; identical to SEQ ID NO: 247967

SEQ ID NO: 611283 - RNA, 64 nt, Homo Sapiens; identical to SEQ ID NO: 247968

SEQ ID NO: 611284 - RNA, 64 nt, Homo Sapiens; identical to SEQ ID NO: 247969

SEQ ID NO: 611285 - RNA, 64 nt, Homo Sapiens; identical to SEQ ID NO: 247970

SEQ ID NO: 611286 - RNA, 64 nt, Homo Sapiens; identical to SEQ ID NO: 247971

SEQ ID NO: 611287 - RNA, 64 nt, Homo Sapiens; identical to SEQ ID NO: 247972

SEQ ID NO: 611288 - RNA, 64 nt, Homo Sapiens; identical to SEQ ID NO: 247973

SEQ ID NO: 611289 - RNA, 64 nt, Homo Sapiens; identical to SEQ ID NO: 247974

SEQ ID NO: 611290 - RNA, 64 nt, Homo Sapiens; identical to SEQ ID NO: 247975

SEQ ID NO: 611291 - RNA, 64 nt, Homo Sapiens; identical to SEQ ID NO: 247976

SEQ ID NO: 611292 - RNA, 64 nt, Homo Sapiens; identical to SEQ ID NO: 247977

SEQ ID NO: 611293 - RNA, 64 nt, Homo Sapiens; identical to SEQ ID NO: 247978

SEQ ID NO: 611294 - RNA, 64 nt, Homo Sapiens; identical to SEQ ID NO: 580078

SEQ ID NO: 611295 - RNA, 64 nt, Homo Sapiens; identical to SEQ ID NO: 580079

SEQ ID NO: 611296 - RNA, 64 nt, Homo Sapiens; identical to SEQ ID NO: 580080

SEQ ID NO: 611297 - RNA, 64 nt, Homo Sapiens; identical to SEQ ID NO: 580081

SEQ ID NO: 611298 - RNA, 64 nt, Homo Sapiens; identical to SEQ ID NO: 580082

SEQ ID NO: 611299 - RNA, 64 nt, Homo Sapiens; identical to SEQ ID NO: 580083

SEQ ID NO: 611300 - RNA, 64 nt, Homo Sapiens; identical to SEQ ID NO: 580084

SEQ ID NO: 611301 - RNA, 64 nt, Homo Sapiens; identical to SEQ ID NO: 580085

SEQ ID NO: 611302 - RNA, 64 nt, Homo Sapiens; identical to SEQ ID NO: 580086

SEQ ID NO: 611303 - RNA, 64 nt, Homo Sapiens; identical to SEQ ID NO: 580087

SEQ ID NO: 611304 - RNA, 64 nt, Homo Sapiens; identical to SEQ ID NO: 580088

SEQ ID NO: 611305 - RNA, 64 nt, Homo Sapiens; identical to SEQ ID NO: 580089

SEQ ID NO: 611306 - RNA, 64 nt, Homo Sapiens; identical to SEQ ID NO: 580090

SEQ ID NO: 611307 - RNA, 64 nt, Homo Sapiens; identical to SEQ ID NO: 580091

SEQ ID NO: 611308 - RNA, 64 nt, Homo Sapiens; identical to SEQ ID NO: 374737

SEQ ID NO: 611309 - RNA, 64 nt, Homo Sapiens; identical to SEQ ID NO: 374738

SEQ ID NO: 611310 - RNA, 64 nt, Homo Sapiens; identical to SEQ ID NO: 374739

SEQ ID NO: 611311 - RNA, 64 nt, Homo Sapiens; identical to SEQ ID NO: 374740

SEQ ID NO: 611312 - RNA, 64 nt, Homo Sapiens; identical to SEQ ID NO: 374741

SEQ ID NO: 611313 - RNA, 64 nt, Homo Sapiens; identical to SEQ ID NO: 374742

SEQ ID NO: 611314 - RNA, 64 nt, Homo Sapiens; identical to SEQ ID NO: 374743

SEQ ID NO: 611315 - RNA, 64 nt, Homo Sapiens; identical to SEQ ID NO: 374744

SEQ ID NO: 611316 - RNA, 64 nt, Homo Sapiens; identical to SEQ ID NO: 374745

SEQ ID NO: 611317 - RNA, 64 nt, Homo Sapiens; identical to SEQ ID NO: 374746

SEQ ID NO: 611318 - RNA, 64 nt, Homo Sapiens; identical to SEQ ID NO: 374747

SEQ ID NO: 611319 - RNA, 64 nt, Homo Sapiens; identical to SEQ ID NO: 374748

SEQ ID NO: 611320 - RNA, 64 nt, Homo Sapiens; identical to SEQ ID NO: 374749

SEQ ID NO: 611321 - RNA, 64 nt, Homo Sapiens; identical to SEQ ID NO: 374750

SEQ ID NO: 611322 - RNA, 64 nt, Homo Sapiens; identical to SEQ ID NO: 374751

SEQ ID NO: 611323 - RNA, 64 nt, Homo Sapiens; identical to SEQ ID NO: 374752

SEQ ID NO: 611324 - RNA, 64 nt, Homo Sapiens; identical to SEQ ID NO: 374753

SEQ ID NO: 611325 - RNA, 64 nt, Homo Sapiens; identical to SEQ ID NO: 374754

SEQ ID NO: 611326 - RNA, 64 nt, Homo Sapiens; identical to SEQ ID NO: 374755

SEQ ID NO: 611327 - RNA, 64 nt, Homo Sapiens; identical to SEQ ID NO: 374756

SEQ ID NO: 611328 - RNA, 64 nt, Homo Sapiens; identical to SEQ ID NO: 374757

SEQ ID NO: 611329 - RNA, 64 nt, Homo Sapiens; identical to SEQ ID NO: 374758

SEQ ID NO: 611330 - RNA, 64 nt, Homo Sapiens; identical to SEQ ID NO: 374759

SEQ ID NO: 611331 - RNA, 64 nt, Homo Sapiens; identical to SEQ ID NO: 374760

SEQ ID NO: 611332 - RNA, 64 nt, Homo Sapiens; identical to SEQ ID NO: 374761

SEQ ID NO: 611333 - RNA, 64 nt, Homo Sapiens; identical to SEQ ID NO: 374762

SEQ ID NO: 611334 - RNA, 64 nt, Homo Sapiens; identical to SEQ ID NO: 374763

SEQ ID NO: 611335 - RNA, 64 nt, Homo Sapiens; identical to SEQ ID NO: 374764

SEQ ID NO: 611336 - RNA, 64 nt, Homo Sapiens; identical to SEQ ID NO: 374765

SEQ ID NO: 611337 - RNA, 64 nt, Homo Sapiens; identical to SEQ ID NO: 374766

SEQ ID NO: 611338 - RNA, 64 nt, Homo Sapiens; identical to SEQ ID NO: 374767

SEQ ID NO: 611339 - RNA, 64 nt, Homo Sapiens; identical to SEQ ID NO: 374768

SEQ ID NO: 611340 - RNA, 64 nt, Homo Sapiens; identical to SEQ ID NO: 374769

SEQ ID NO: 611341 - RNA, 64 nt, Homo Sapiens; identical to SEQ ID NO: 374770

SEQ ID NO: 611342 - RNA, 64 nt, Homo Sapiens; identical to SEQ ID NO: 374771

SEQ ID NO: 611343 - RNA, 64 nt, Homo Sapiens; identical to SEQ ID NO: 374772

SEQ ID NO: 611344 - RNA, 64 nt, Homo Sapiens; identical to SEQ ID NO: 374773

SEQ ID NO: 611345 - RNA, 64 nt, Homo Sapiens; identical to SEQ ID NO: 374774

SEQ ID NO: 611346 - RNA, 64 nt, Homo Sapiens; identical to SEQ ID NO: 374775

SEQ ID NO: 611347 - RNA, 64 nt, Homo Sapiens; identical to SEQ ID NO: 374776

SEQ ID NO: 611348 - RNA, 64 nt, Homo Sapiens; identical to SEQ ID NO: 374777

SEQ ID NO: 611349 - RNA, 64 nt, Homo Sapiens; identical to SEQ ID NO: 374778

SEQ ID NO: 611350 - RNA, 64 nt, Homo Sapiens; identical to SEQ ID NO: 374779

SEQ ID NO: 611351 - RNA, 64 nt, Homo Sapiens; identical to SEQ ID NO: 374780

SEQ ID NO: 611352 - RNA, 64 nt, Homo Sapiens; identical to SEQ ID NO: 374781

SEQ ID NO: 611353 - RNA, 64 nt, Homo Sapiens; identical to SEQ ID NO: 374782

SEQ ID NO: 611354 - RNA, 64 nt, Homo Sapiens; identical to SEQ ID NO: 374783

SEQ ID NO: 611355 - RNA, 64 nt, Homo Sapiens; identical to SEQ ID NO: 374784

SEQ ID NO: 611356 - RNA, 64 nt, Homo Sapiens; identical to SEQ ID NO: 374785

SEQ ID NO: 611357 - RNA, 64 nt, Homo Sapiens; identical to SEQ ID NO: 374786

SEQ ID NO: 611358 - RNA, 64 nt, Homo Sapiens; identical to SEQ ID NO: 374787

SEQ ID NO: 611359 - RNA, 64 nt, Homo Sapiens; identical to SEQ ID NO: 374788

SEQ ID NO: 611360 - RNA, 64 nt, Homo Sapiens; identical to SEQ ID NO: 374789

SEQ ID NO: 611361 - RNA, 64 nt, Homo Sapiens; identical to SEQ ID NO: 374790

SEQ ID NO: 611362 - RNA, 64 nt, Homo Sapiens; identical to SEQ ID NO: 374791

SEQ ID NO: 611363 - RNA, 64 nt, Homo Sapiens; identical to SEQ ID NO: 374792

SEQ ID NO: 611364 - RNA, 64 nt, Homo Sapiens; identical to SEQ ID NO: 374793

SEQ ID NO: 611365 - RNA, 64 nt, Homo Sapiens; identical to SEQ ID NO: 374794

SEQ ID NO: 611366 - RNA, 64 nt, Homo Sapiens; identical to SEQ ID NO: 374795

SEQ ID NO: 611367 - RNA, 64 nt, Homo Sapiens; identical to SEQ ID NO: 374796

SEQ ID NO: 611368 - RNA, 64 nt, Homo Sapiens; identical to SEQ ID NO: 374797

SEQ ID NO: 611369 - RNA, 64 nt, Homo Sapiens; identical to SEQ ID NO: 374798

SEQ ID NO: 611370 - RNA, 64 nt, Homo Sapiens; identical to SEQ ID NO: 374799

SEQ ID NO: 611371 - RNA, 64 nt, Homo Sapiens; identical to SEQ ID NO: 374800

SEQ ID NO: 611372 - RNA, 64 nt, Homo Sapiens; identical to SEQ ID NO: 374801

SEQ ID NO: 611373 - RNA, 64 nt, Homo Sapiens; identical to SEQ ID NO: 374802

SEQ ID NO: 611374 - RNA, 64 nt, Homo Sapiens; identical to SEQ ID NO: 374803

SEQ ID NO: 611375 - RNA, 64 nt, Homo Sapiens; identical to SEQ ID NO: 374804

SEQ ID NO: 611376 - RNA, 64 nt, Homo Sapiens; identical to SEQ ID NO: 374805

SEQ ID NO: 611377 - RNA, 64 nt, Homo Sapiens; identical to SEQ ID NO: 374806

SEQ ID NO: 611378 - RNA, 64 nt, Homo Sapiens; identical to SEQ ID NO: 374807

SEQ ID NO: 611379 - RNA, 64 nt, Homo Sapiens; identical to SEQ ID NO: 374808

SEQ ID NO: 611380 - RNA, 64 nt, Homo Sapiens; identical to SEQ ID NO: 374809

SEQ ID NO: 611381 - RNA, 64 nt, Homo Sapiens; identical to SEQ ID NO: 374810

SEQ ID NO: 611382 - RNA, 64 nt, Homo Sapiens; identical to SEQ ID NO: 374811

SEQ ID NO: 611383 - RNA, 64 nt, Homo Sapiens; identical to SEQ ID NO: 374812

SEQ ID NO: 611384 - RNA, 64 nt, Homo Sapiens; identical to SEQ ID NO: 374813

SEQ ID NO: 611385 - RNA, 64 nt, Homo Sapiens; identical to SEQ ID NO: 374814

SEQ ID NO: 611386 - RNA, 64 nt, Homo Sapiens; identical to SEQ ID NO: 374815

SEQ ID NO: 611387 - RNA, 64 nt, Homo Sapiens; identical to SEQ ID NO: 274946

SEQ ID NO: 611388 - RNA, 64 nt, Homo Sapiens; identical to SEQ ID NO: 274947

SEQ ID NO: 611389 - RNA, 64 nt, Homo Sapiens; identical to SEQ ID NO: 274948

SEQ ID NO: 611390 - RNA, 64 nt, Homo Sapiens; identical to SEQ ID NO: 274949

SEQ ID NO: 611391 - RNA, 64 nt, Homo Sapiens; identical to SEQ ID NO: 274950

SEQ ID NO: 611392 - RNA, 64 nt, Homo Sapiens; identical to SEQ ID NO: 274951

SEQ ID NO: 611393 - RNA, 64 nt, Homo Sapiens; identical to SEQ ID NO: 274952

SEQ ID NO: 611394 - RNA, 64 nt, Homo Sapiens; identical to SEQ ID NO: 274953

SEQ ID NO: 611395 - RNA, 64 nt, Homo Sapiens; identical to SEQ ID NO: 274954

SEQ ID NO: 611396 - RNA, 64 nt, Homo Sapiens; identical to SEQ ID NO: 274955

SEQ ID NO: 611397 - RNA, 64 nt, Homo Sapiens; identical to SEQ ID NO: 274956

SEQ ID NO: 611398 - RNA, 64 nt, Homo Sapiens; identical to SEQ ID NO: 274957

SEQ ID NO: 611399 - RNA, 64 nt, Homo Sapiens; identical to SEQ ID NO: 274958

SEQ ID NO: 611400 - RNA, 64 nt, Homo Sapiens; identical to SEQ ID NO: 274959

SEQ ID NO: 611401 - RNA, 64 nt, Homo Sapiens; identical to SEQ ID NO: 274960

SEQ ID NO: 611402 - RNA, 64 nt, Homo Sapiens; identical to SEQ ID NO: 274961

SEQ ID NO: 611403 - RNA, 64 nt, Homo Sapiens; identical to SEQ ID NO: 274962

SEQ ID NO: 611404 - RNA, 64 nt, Homo Sapiens; identical to SEQ ID NO: 274963

SEQ ID NO: 611405 - RNA, 64 nt, Homo Sapiens; identical to SEQ ID NO: 274964

SEQ ID NO: 611406 - RNA, 64 nt, Homo Sapiens; identical to SEQ ID NO: 274965

SEQ ID NO: 611407 - RNA, 64 nt, Homo Sapiens; identical to SEQ ID NO: 274966

SEQ ID NO: 611408 - RNA, 64 nt, Homo Sapiens; identical to SEQ ID NO: 274967

SEQ ID NO: 611409 - RNA, 64 nt, Homo Sapiens; identical to SEQ ID NO: 274968

SEQ ID NO: 611410 - RNA, 64 nt, Homo Sapiens; identical to SEQ ID NO: 274969

SEQ ID NO: 611411 - RNA, 64 nt, Homo Sapiens; identical to SEQ ID NO: 274970

SEQ ID NO: 611412 - RNA, 64 nt, Homo Sapiens; identical to SEQ ID NO: 274971

SEQ ID NO: 611413 - RNA, 64 nt, Homo Sapiens; identical to SEQ ID NO: 274972

SEQ ID NO: 611414 - RNA, 64 nt, Homo Sapiens; identical to SEQ ID NO: 274973

SEQ ID NO: 611415 - RNA, 64 nt, Homo Sapiens; identical to SEQ ID NO: 274974

SEQ ID NO: 611416 - RNA, 64 nt, Homo Sapiens; identical to SEQ ID NO: 274975

SEQ ID NO: 611417 - RNA, 64 nt, Homo Sapiens; identical to SEQ ID NO: 274976

SEQ ID NO: 611418 - RNA, 64 nt, Homo Sapiens; identical to SEQ ID NO: 274977

SEQ ID NO: 611419 - RNA, 64 nt, Homo Sapiens; identical to SEQ ID NO: 274978

SEQ ID NO: 611420 - RNA, 64 nt, Homo Sapiens; identical to SEQ ID NO: 274979

SEQ ID NO: 611421 - RNA, 64 nt, Homo Sapiens; identical to SEQ ID NO: 274980

SEQ ID NO: 611422 - RNA, 64 nt, Homo Sapiens; identical to SEQ ID NO: 274981

SEQ ID NO: 611423 - RNA, 59 nt, Homo Sapiens; identical to SEQ ID NO: 274982

SEQ ID NO: 611424 - RNA, 64 nt, Homo Sapiens
uucuuuggccagaaggaugauuuagaaucagaauuguagccaguuuggcugcaugaagguuuuc

SEQ ID NO: 611425 - RNA, 64 nt, Homo Sapiens
ccugucccuggccauccaugucauggcuuuuuuuuguagccagucuuagcauggugagcugagu

SEQ ID NO: 611426 - RNA, 64 nt, Homo Sapiens
uuugccuuuugcugcaauagccguacugccuauguguagccauccuugggcugucuguacagcu

SEQ ID NO: 611427 - RNA, 64 nt, Homo Sapiens
agccaugcaggacugguucaccaggcugcugggcuguagccaaugagguaacccaggggucagc

SEQ ID NO: 611428 - RNA, 64 nt, Homo Sapiens
gcuucagggcccaaguugggagaagugaccaaaguguagccaguuuucugaguucccgugugcu

SEQ ID NO: 611429 - RNA, 64 nt, Homo Sapiens
uucucuagcccuuggcucugcuggguuuccugacuguagccacaucucucccgcucccuaaggg

SEQ ID NO: 611430 - RNA, 64 nt, Homo Sapiens
uccccuaauggcuauuaguguccaauguaguaucuguagccaugugugugauuaaagacaacuu

SEQ ID NO: 611431 - RNA, 64 nt, Homo Sapiens
gaggcuucuacccuuaguacuacuauuaaaaaacuguagccaguguguuauuucuugacuuuug

SEQ ID NO: 611432 - RNA, 63 nt, Homo Sapiens
ccccuuguuccuccccauuagaccagguucucaagacacgaguggacuggguucucaagacac

SEQ ID NO: 611433 - RNA, 63 nt, Homo Sapiens
agguucucaagacacgagucgacuggguucucaagacacgacccagaggccugauucuguuug

SEQ ID NO: 611434 - RNA, 64 nt, Homo Sapiens; identical to SEQ ID NO: 340884

SEQ ID NO: 611435 - RNA, 64 nt, Homo Sapiens; identical to SEQ ID NO: 340885

SEQ ID NO: 611436 - RNA, 64 nt, Homo Sapiens
uguagaugugcugcagcgcugugccuucuaaauggcaugacauacauuuacagcccucagcaau

SEQ ID NO: 611437 - RNA, 64 nt, Homo Sapiens
ugucuuuggcagucugucauuaucauggagaacagcaugacagcuuuuuuaauauuagugccgu

SEQ ID NO: 611438 - RNA, 56 nt, Homo Sapiens
aacuuucauucacuucauagaacccagcaugacauaacagugcagggcaaaauauu

SEQ ID NO: 611439 - RNA, 64 nt, Homo Sapiens
ccugcugcccuuaggccacaugggagcaguccaugcaugacagccucuauccuacaaggccuau

SEQ ID NO: 611440 - RNA, 64 nt, Homo Sapiens; identical to SEQ ID NO: 395564

SEQ ID NO: 611441 - RNA, 64 nt, Homo Sapiens; identical to SEQ ID NO: 395565

SEQ ID NO: 611442 - RNA, 64 nt, Homo Sapiens; identical to SEQ ID NO: 395566

SEQ ID NO: 611443 - RNA, 64 nt, Homo Sapiens; identical to SEQ ID NO: 395567

SEQ ID NO: 611444 - RNA, 64 nt, Homo Sapiens; identical to SEQ ID NO: 395568

SEQ ID NO: 611445 - RNA, 64 nt, Homo Sapiens; identical to SEQ ID NO: 395569

SEQ ID NO: 611446 - RNA, 64 nt, Homo Sapiens; identical to SEQ ID NO: 395570

SEQ ID NO: 611447 - RNA, 64 nt, Homo Sapiens; identical to SEQ ID NO: 395571

SEQ ID NO: 611448 - RNA, 64 nt, Homo Sapiens; identical to SEQ ID NO: 395572

SEQ ID NO: 611449 - RNA, 64 nt, Homo Sapiens; identical to SEQ ID NO: 395573

SEQ ID NO: 611450 - RNA, 64 nt, Homo Sapiens; identical to SEQ ID NO: 395574

SEQ ID NO: 611451 - RNA, 64 nt, Homo Sapiens; identical to SEQ ID NO: 395575

SEQ ID NO: 611452 - RNA, 64 nt, Homo Sapiens; identical to SEQ ID NO: 395576

SEQ ID NO: 611453 - RNA, 64 nt, Homo Sapiens; identical to SEQ ID NO: 395577

SEQ ID NO: 611454 - RNA, 64 nt, Homo Sapiens; identical to SEQ ID NO: 395578

SEQ ID NO: 611455 - RNA, 64 nt, Homo Sapiens; identical to SEQ ID NO: 395579

SEQ ID NO: 611456 - RNA, 64 nt, Homo Sapiens; identical to SEQ ID NO: 395580

SEQ ID NO: 611457 - RNA, 64 nt, Homo Sapiens; identical to SEQ ID NO: 395581

SEQ ID NO: 611458 - RNA, 64 nt, Homo Sapiens; identical to SEQ ID NO: 395582

SEQ ID NO: 611459 - RNA, 64 nt, Homo Sapiens; identical to SEQ ID NO: 395583

SEQ ID NO: 611460 - RNA, 64 nt, Homo Sapiens; identical to SEQ ID NO: 395584

SEQ ID NO: 611461 - RNA, 64 nt, Homo Sapiens; identical to SEQ ID NO: 395585

SEQ ID NO: 611462 - RNA, 64 nt, Homo Sapiens; identical to SEQ ID NO: 395586

SEQ ID NO: 611463 - RNA, 64 nt, Homo Sapiens; identical to SEQ ID NO: 395587

SEQ ID NO: 611464 - RNA, 64 nt, Homo Sapiens; identical to SEQ ID NO: 395588

SEQ ID NO: 611465 - RNA, 64 nt, Homo Sapiens; identical to SEQ ID NO: 395589

SEQ ID NO: 611466 - RNA, 64 nt, Homo Sapiens; identical to SEQ ID NO: 395590

SEQ ID NO: 611467 - RNA, 64 nt, Homo Sapiens; identical to SEQ ID NO: 395591

SEQ ID NO: 611468 - RNA, 64 nt, Homo Sapiens; identical to SEQ ID NO: 395592

SEQ ID NO: 611469 - RNA, 64 nt, Homo Sapiens; identical to SEQ ID NO: 395593

SEQ ID NO: 611470 - RNA, 64 nt, Homo Sapiens; identical to SEQ ID NO: 395594

SEQ ID NO: 611471 - RNA, 64 nt, Homo Sapiens; identical to SEQ ID NO: 395595

SEQ ID NO: 611472 - RNA, 64 nt, Homo Sapiens; identical to SEQ ID NO: 395596

SEQ ID NO: 611473 - RNA, 64 nt, Homo Sapiens; identical to SEQ ID NO: 395597

SEQ ID NO: 611474 - RNA, 64 nt, Homo Sapiens; identical to SEQ ID NO: 395598

SEQ ID NO: 611475 - RNA, 64 nt, Homo Sapiens; identical to SEQ ID NO: 395599

SEQ ID NO: 611476 - RNA, 64 nt, Homo Sapiens; identical to SEQ ID NO: 395600

SEQ ID NO: 611477 - RNA, 64 nt, Homo Sapiens; identical to SEQ ID NO: 395601

SEQ ID NO: 611478 - RNA, 64 nt, Homo Sapiens; identical to SEQ ID NO: 395602

SEQ ID NO: 611479 - RNA, 64 nt, Homo Sapiens; identical to SEQ ID NO: 395603

SEQ ID NO: 611480 - RNA, 64 nt, Homo Sapiens; identical to SEQ ID NO: 143366

SEQ ID NO: 611481 - RNA, 64 nt, Homo Sapiens; identical to SEQ ID NO: 143367

SEQ ID NO: 611482 - RNA, 64 nt, Homo Sapiens; identical to SEQ ID NO: 143368

SEQ ID NO: 611483 - RNA, 64 nt, Homo Sapiens; identical to SEQ ID NO: 143369

SEQ ID NO: 611484 - RNA, 64 nt, Homo Sapiens
ucaggcagugcaguacucaguaagacagugcagugcucaguaaggcagugcaauacucaguaac

SEQ ID NO: 611485 - RNA, 64 nt, Homo Sapiens
uaaggcaguaugguacucaguaaagcaaugcaaugcucaguaacacagugcagugcucaauaag

SEQ ID NO: 611486 - RNA, 64 nt, Homo Sapiens
uaacacagugcagugcucaauaaggcagugcagugcucaguaaggcagugaauugcuuaguaac

SEQ ID NO: 611487 - RNA, 64 nt, Homo Sapiens
uaaggcagugaauugcuuaguaacacaguguagugcucaguaggacagcauaguacucaguaac

SEQ ID NO: 611488 - RNA, 64 nt, Homo Sapiens
uggagucagguuuucuauucuccccaaaggccugugcguccaaguggggcccuggugucagaac

SEQ ID NO: 611489 - RNA, 64 nt, Homo Sapiens
cuccuguccugccacgugucuccccaggccacagugcguccaguagggccaagccccgcugccu

SEQ ID NO: 611490 - RNA, 64 nt, Homo Sapiens; identical to SEQ ID NO: 284354

SEQ ID NO: 611491 - RNA, 64 nt, Homo Sapiens; identical to SEQ ID NO: 284355

SEQ ID NO: 611492 - RNA, 64 nt, Homo Sapiens; identical to SEQ ID NO: 284356

SEQ ID NO: 611493 - RNA, 64 nt, Homo Sapiens; identical to SEQ ID NO: 284357

SEQ ID NO: 611494 - RNA, 64 nt, Homo Sapiens; identical to SEQ ID NO: 284358

SEQ ID NO: 611495 - RNA, 64 nt, Homo Sapiens; identical to SEQ ID NO: 284359

SEQ ID NO: 611496 - RNA, 64 nt, Homo Sapiens; identical to SEQ ID NO: 284360

SEQ ID NO: 611497 - RNA, 64 nt, Homo Sapiens; identical to SEQ ID NO: 284361

SEQ ID NO: 611498 - RNA, 64 nt, Homo Sapiens; identical to SEQ ID NO: 284362

SEQ ID NO: 611499 - RNA, 64 nt, Homo Sapiens; identical to SEQ ID NO: 284363

SEQ ID NO: 611500 - RNA, 64 nt, Homo Sapiens; identical to SEQ ID NO: 284364

SEQ ID NO: 611501 - RNA, 64 nt, Homo Sapiens; identical to SEQ ID NO: 284365

SEQ ID NO: 611502 - RNA, 64 nt, Homo Sapiens; identical to SEQ ID NO: 284366

SEQ ID NO: 611503 - RNA, 64 nt, Homo Sapiens; identical to SEQ ID NO: 284367

SEQ ID NO: 611504 - RNA, 64 nt, Homo Sapiens; identical to SEQ ID NO: 284368

SEQ ID NO: 611505 - RNA, 64 nt, Homo Sapiens; identical to SEQ ID NO: 284369

SEQ ID NO: 611506 - RNA, 64 nt, Homo Sapiens; identical to SEQ ID NO: 284370

SEQ ID NO: 611507 - RNA, 64 nt, Homo Sapiens; identical to SEQ ID NO: 284371

SEQ ID NO: 611508 - RNA, 64 nt, Homo Sapiens; identical to SEQ ID NO: 284372

SEQ ID NO: 611509 - RNA, 64 nt, Homo Sapiens; identical to SEQ ID NO: 284373

SEQ ID NO: 611510 - RNA, 64 nt, Homo Sapiens; identical to SEQ ID NO: 284374

SEQ ID NO: 611511 - RNA, 59 nt, Homo Sapiens; identical to SEQ ID NO: 284375

SEQ ID NO: 611512 - RNA, 64 nt, Homo Sapiens; identical to SEQ ID NO: 284376

SEQ ID NO: 611513 - RNA, 64 nt, Homo Sapiens; identical to SEQ ID NO: 284377

SEQ ID NO: 611514 - RNA, 64 nt, Homo Sapiens; identical to SEQ ID NO: 284378

SEQ ID NO: 611515 - RNA, 64 nt, Homo Sapiens; identical to SEQ ID NO: 284379

SEQ ID NO: 611516 - RNA, 64 nt, Homo Sapiens; identical to SEQ ID NO: 219912

SEQ ID NO: 611517 - RNA, 64 nt, Homo Sapiens; identical to SEQ ID NO: 219913

SEQ ID NO: 611518 - RNA, 64 nt, Homo Sapiens; identical to SEQ ID NO: 219914

SEQ ID NO: 611519 - RNA, 64 nt, Homo Sapiens; identical to SEQ ID NO: 219915

SEQ ID NO: 611520 - RNA, 64 nt, Homo Sapiens; identical to SEQ ID NO: 219916

SEQ ID NO: 611521 - RNA, 64 nt, Homo Sapiens; identical to SEQ ID NO: 219917

SEQ ID NO: 611522 - RNA, 64 nt, Homo Sapiens; identical to SEQ ID NO: 219918

SEQ ID NO: 611523 - RNA, 64 nt, Homo Sapiens; identical to SEQ ID NO: 219919

SEQ ID NO: 611524 - RNA, 64 nt, Homo Sapiens; identical to SEQ ID NO: 219920

SEQ ID NO: 611525 - RNA, 64 nt, Homo Sapiens; identical to SEQ ID NO: 219921

SEQ ID NO: 611526 - RNA, 64 nt, Homo Sapiens; identical to SEQ ID NO: 219922

SEQ ID NO: 611527 - RNA, 64 nt, Homo Sapiens; identical to SEQ ID NO: 219923

SEQ ID NO: 611528 - RNA, 64 nt, Homo Sapiens; identical to SEQ ID NO: 219924

SEQ ID NO: 611529 - RNA, 64 nt, Homo Sapiens; identical to SEQ ID NO: 219925

SEQ ID NO: 611530 - RNA, 64 nt, Homo Sapiens; identical to SEQ ID NO: 219926

SEQ ID NO: 611531 - RNA, 64 nt, Homo Sapiens; identical to SEQ ID NO: 219927

SEQ ID NO: 611532 - RNA, 64 nt, Homo Sapiens; identical to SEQ ID NO: 219928

SEQ ID NO: 611533 - RNA, 64 nt, Homo Sapiens; identical to SEQ ID NO: 219929

SEQ ID NO: 611534 - RNA, 64 nt, Homo Sapiens; identical to SEQ ID NO: 219930

SEQ ID NO: 611535 - RNA, 64 nt, Homo Sapiens; identical to SEQ ID NO: 219931

SEQ ID NO: 611536 - RNA, 64 nt, Homo Sapiens; identical to SEQ ID NO: 219932

SEQ ID NO: 611537 - RNA, 64 nt, Homo Sapiens; identical to SEQ ID NO: 219933

SEQ ID NO: 611538 - RNA, 53 nt, Homo Sapiens; identical to SEQ ID NO: 168469

SEQ ID NO: 611539 - RNA, 64 nt, Homo Sapiens; identical to SEQ ID NO: 219935

SEQ ID NO: 611540 - RNA, 64 nt, Homo Sapiens; identical to SEQ ID NO: 219936

SEQ ID NO: 611541 - RNA, 64 nt, Homo Sapiens; identical to SEQ ID NO: 219937

SEQ ID NO: 611542 - RNA, 64 nt, Homo Sapiens; identical to SEQ ID NO: 219938

SEQ ID NO: 611543 - RNA, 64 nt, Homo Sapiens; identical to SEQ ID NO: 219939

SEQ ID NO: 611544 - RNA, 64 nt, Homo Sapiens; identical to SEQ ID NO: 219940

SEQ ID NO: 611545 - RNA, 64 nt, Homo Sapiens; identical to SEQ ID NO: 219941

SEQ ID NO: 611546 - RNA, 64 nt, Homo Sapiens; identical to SEQ ID NO: 219942

SEQ ID NO: 611547 - RNA, 64 nt, Homo Sapiens; identical to SEQ ID NO: 219943

SEQ ID NO: 611548 - RNA, 64 nt, Homo Sapiens; identical to SEQ ID NO: 219944

SEQ ID NO: 611549 - RNA, 64 nt, Homo Sapiens; identical to SEQ ID NO: 219945

SEQ ID NO: 611550 - RNA, 64 nt, Homo Sapiens; identical to SEQ ID NO: 219946

SEQ ID NO: 611551 - RNA, 64 nt, Homo Sapiens; identical to SEQ ID NO: 219947

SEQ ID NO: 611552 - RNA, 64 nt, Homo Sapiens; identical to SEQ ID NO: 219948

SEQ ID NO: 611553 - RNA, 64 nt, Homo Sapiens; identical to SEQ ID NO: 219949

SEQ ID NO: 611554 - RNA, 64 nt, Homo Sapiens; identical to SEQ ID NO: 219950

SEQ ID NO: 611555 - RNA, 64 nt, Homo Sapiens; identical to SEQ ID NO: 219951

SEQ ID NO: 611556 - RNA, 64 nt, Homo Sapiens; identical to SEQ ID NO: 219952

SEQ ID NO: 611557 - RNA, 64 nt, Homo Sapiens; identical to SEQ ID NO: 219953

SEQ ID NO: 611558 - RNA, 64 nt, Homo Sapiens; identical to SEQ ID NO: 219954

SEQ ID NO: 611559 - RNA, 64 nt, Homo Sapiens; identical to SEQ ID NO: 219955

SEQ ID NO: 611560 - RNA, 64 nt, Homo Sapiens; identical to SEQ ID NO: 219956

SEQ ID NO: 611561 - RNA, 64 nt, Homo Sapiens; identical to SEQ ID NO: 219957

SEQ ID NO: 611562 - RNA, 64 nt, Homo Sapiens; identical to SEQ ID NO: 219958

SEQ ID NO: 611563 - RNA, 64 nt, Homo Sapiens; identical to SEQ ID NO: 219959

SEQ ID NO: 611564 - RNA, 64 nt, Homo Sapiens; identical to SEQ ID NO: 219960

SEQ ID NO: 611565 - RNA, 64 nt, Homo Sapiens; identical to SEQ ID NO: 219961

SEQ ID NO: 611566 - RNA, 64 nt, Homo Sapiens; identical to SEQ ID NO: 219962

SEQ ID NO: 611567 - RNA, 64 nt, Homo Sapiens; identical to SEQ ID NO: 219963

SEQ ID NO: 611568 - RNA, 64 nt, Homo Sapiens; identical to SEQ ID NO: 219964

SEQ ID NO: 611569 - RNA, 64 nt, Homo Sapiens; identical to SEQ ID NO: 219965

SEQ ID NO: 611570 - RNA, 64 nt, Homo Sapiens; identical to SEQ ID NO: 219966

SEQ ID NO: 611571 - RNA, 64 nt, Homo Sapiens; identical to SEQ ID NO: 219967

SEQ ID NO: 611572 - RNA, 64 nt, Homo Sapiens; identical to SEQ ID NO: 219968

SEQ ID NO: 611573 - RNA, 64 nt, Homo Sapiens; identical to SEQ ID NO: 219969

SEQ ID NO: 611574 - RNA, 64 nt, Homo Sapiens; identical to SEQ ID NO: 219970

SEQ ID NO: 611575 - RNA, 64 nt, Homo Sapiens; identical to SEQ ID NO: 219971

SEQ ID NO: 611576 - RNA, 64 nt, Homo Sapiens; identical to SEQ ID NO: 74808

SEQ ID NO: 611577 - RNA, 64 nt, Homo Sapiens; identical to SEQ ID NO: 74809

SEQ ID NO: 611578 - RNA, 64 nt, Homo Sapiens; identical to SEQ ID NO: 74810

SEQ ID NO: 611579 - RNA, 64 nt, Homo Sapiens; identical to SEQ ID NO: 74811

SEQ ID NO: 611580 - RNA, 64 nt, Homo Sapiens; identical to SEQ ID NO: 74812

SEQ ID NO: 611581 - RNA, 64 nt, Homo Sapiens; identical to SEQ ID NO: 74813

SEQ ID NO: 611582 - RNA, 64 nt, Homo Sapiens; identical to SEQ ID NO: 74814

SEQ ID NO: 611583 - RNA, 64 nt, Homo Sapiens; identical to SEQ ID NO: 74815

SEQ ID NO: 611584 - RNA, 64 nt, Homo Sapiens; identical to SEQ ID NO: 74816

SEQ ID NO: 611585 - RNA, 64 nt, Homo Sapiens; identical to SEQ ID NO: 74817

SEQ ID NO: 611586 - RNA, 64 nt, Homo Sapiens; identical to SEQ ID NO: 74818

SEQ ID NO: 611587 - RNA, 64 nt, Homo Sapiens; identical to SEQ ID NO: 74819

SEQ ID NO: 611588 - RNA, 64 nt, Homo Sapiens; identical to SEQ ID NO: 74820

SEQ ID NO: 611589 - RNA, 64 nt, Homo Sapiens; identical to SEQ ID NO: 74821

SEQ ID NO: 611590 - RNA, 64 nt, Homo Sapiens; identical to SEQ ID NO: 74822

SEQ ID NO: 611591 - RNA, 64 nt, Homo Sapiens; identical to SEQ ID NO: 74823

SEQ ID NO: 611592 - RNA, 64 nt, Homo Sapiens; identical to SEQ ID NO: 74824

SEQ ID NO: 611593 - RNA, 64 nt, Homo Sapiens; identical to SEQ ID NO: 74825

SEQ ID NO: 611594 - RNA, 64 nt, Homo Sapiens; identical to SEQ ID NO: 74826

SEQ ID NO: 611595 - RNA, 64 nt, Homo Sapiens; identical to SEQ ID NO: 74827

SEQ ID NO: 611596 - RNA, 64 nt, Homo Sapiens; identical to SEQ ID NO: 74828

SEQ ID NO: 611597 - RNA, 64 nt, Homo Sapiens; identical to SEQ ID NO: 74829

SEQ ID NO: 611598 - RNA, 64 nt, Homo Sapiens; identical to SEQ ID NO: 74830

SEQ ID NO: 611599 - RNA, 64 nt, Homo Sapiens; identical to SEQ ID NO: 74831

SEQ ID NO: 611600 - RNA, 64 nt, Homo Sapiens; identical to SEQ ID NO: 74832

SEQ ID NO: 611601 - RNA, 64 nt, Homo Sapiens; identical to SEQ ID NO: 74833

SEQ ID NO: 611602 - RNA, 64 nt, Homo Sapiens; identical to SEQ ID NO: 74834

SEQ ID NO: 611603 - RNA, 64 nt, Homo Sapiens; identical to SEQ ID NO: 74835

SEQ ID NO: 611604 - RNA, 64 nt, Homo Sapiens; identical to SEQ ID NO: 74836

SEQ ID NO: 611605 - RNA, 64 nt, Homo Sapiens
uuuuuccuuucaacuuaguugacauacgugccuuaaaaaggaaaacuaguguugcuauugugca

SEQ ID NO: 611606 - RNA, 64 nt, Homo Sapiens
ggaaaacuaguguugcuauugugcauuuacuagaaaaaaggaauugguuguuuagggcacacug

SEQ ID NO: 611607 - RNA, 64 nt, Homo Sapiens
caauuugcacuguguucauauuaauccucuuuuaaaaaaggaaauauacagaagacaaacauug

SEQ ID NO: 611608 - RNA, 64 nt, Homo Sapiens
gcuugagugacagagcaagacuguaucucaaaggaaaaaggaaacuaggccaggcgugguggcu

SEQ ID NO: 611609 - RNA, 64 nt, Homo Sapiens
cagcaaugcugaauuuucuucuacuuggucaucaaaaaaggaguguaauagaagugaggggagc

SEQ ID NO: 611610 - RNA, 64 nt, Homo Sapiens
ccucccagcuuucuucuucuuuuuuuuuuucugaaaaaaggaaaaagcacacagcacacaauuu

SEQ ID NO: 611611 - RNA, 64 nt, Homo Sapiens
uguaaaaucccuuggucauuaaguacaaaaaauuaaaaaggaacuuguuaagggaccaagaauc

SEQ ID NO: 611612 - RNA, 64 nt, Homo Sapiens
guuagaaagguuuggguugacaugggcagacuucaaaaaggauaugcuugccucgcugauguug

SEQ ID NO: 611613 - RNA, 64 nt, Homo Sapiens
agguuuuuagcucauuugccuaaaaaaaaaagaaaaaaaggaaauuaacaaaaaaaaaaagcuu

SEQ ID NO: 611614 - RNA, 64 nt, Homo Sapiens
caaauccacgaguggaaaaguacucccuccuccaaaaaaggaaugcaagugguugcuccaggau

SEQ ID NO: 611615 - RNA, 64 nt, Homo Sapiens
accagaagcccugcugucugaaaaaggaaaaaaaaaaaaggaaacuuaaaaaaaaaaaaaaagg

SEQ ID NO: 611616 - RNA, 64 nt, Homo Sapiens
aaaaaaaaaggaaaaccagaaaaaaaaaaaaaggaaaaaggaaacucuaugcuuucuucuuaaa

SEQ ID NO: 611617 - RNA, 64 nt, Homo Sapiens
aaggaaaaaaaaaaaaggaaucuuaaaaaaaaaaaaaaaggaaaaaucaaccucuaugcuuucu

SEQ ID NO: 611618 - RNA, 64 nt, Homo Sapiens
agagauauuuuggguugaaaacaaaucacacaacaaaaaggagauucacauaguccauaucacc

SEQ ID NO: 611619 - RNA, 64 nt, Homo Sapiens
aagaagaggaagaagaccaaacguggacagaauuaaaaaggaccguaccuuggcuuggcucuug

SEQ ID NO: 611620 - RNA, 64 nt, Homo Sapiens
agagaggaagggagaagggaaaagcagaaaggaaaaaaaggaaggagaaaaaggagaaaaggga

SEQ ID NO: 611621 - RNA, 64 nt, Homo Sapiens
aaagggaaaagcagaaaggaaagagaaugaggagaaaaaggagaggucacauagguagauggua

SEQ ID NO: 611622 - RNA, 64 nt, Homo Sapiens
gcagcuugguagccuaguacagguuguuuuuuuaaaaaaggaaaagcaggaaggaggagugaau

SEQ ID NO: 611623 - RNA, 64 nt, Homo Sapiens
uccuuuuggaaaacuuguauuaccauggguuuggaaaaaggacaacgaaaggcuuuucauguaa

SEQ ID NO: 611624 - RNA, 64 nt, Homo Sapiens
ugagaaggauucuuuuucgaauauaaccagaggaaaaaaggauggagaaauaucuaggaaaggu

SEQ ID NO: 611625 - RNA, 64 nt, Homo Sapiens
ugagaaggauucuuuuucgaauauaaccagagaaaaaaaggauggagaaauaucuaggaaaggu

SEQ ID NO: 611626 - RNA, 64 nt, Homo Sapiens
ugaugauuaacaguaugucaccacuucauuuuuuaaaaaggaucacgucuaaugcccauuuucc

SEQ ID NO: 611627 - RNA, 64 nt, Homo Sapiens
guguuaaaaugcuucucccugaaaaagagaaaaaaaaaaggaaaaaaagaaaagaaaagugaaa

SEQ ID NO: 611628 - RNA, 64 nt, Homo Sapiens
agcuugauggugauuguauuguauuccuuuaaucaaaaaggaaacacaauauucuaaguaucuu

SEQ ID NO: 611629 - RNA, 64 nt, Homo Sapiens
aucuagagacauuuuuauuuaugaauauuuauacaaaaaggaauucugucaagaugacugcucu

SEQ ID NO: 611630 - RNA, 56 nt, Homo Sapiens
agaccgacgaggaugacuagacagcaaaaaaggaaaaguuaaacuaaaaaaaaaaa

SEQ ID NO: 611631 - RNA, 64 nt, Homo Sapiens
uccaaggcccugcuuuuuuucuuaaaaguacuuuaaaaaggaaauuuguuuguauuuuuuauuu

SEQ ID NO: 611632 - RNA, 64 nt, Homo Sapiens
uucuauagaaaucuauauauggugggagagaggaaaaaaggaaaacaauaccuugcagaggaaa

SEQ ID NO: 611633 - RNA, 64 nt, Homo Sapiens
uuaaaacaaaaaccacagagagcacccagaagagaaaaaggaauugaggauggagagaaguauc

SEQ ID NO: 611634 - RNA, 64 nt, Homo Sapiens
augguuuuugcucuacuuuaguuaauuacuuuugaaaaaggaucuguuaagugacugagaagau

SEQ ID NO: 611635 - RNA, 64 nt, Homo Sapiens
caagcuuuggcuuuuuccaucucaggaugggaagaaaaaggaaaucccuauacuucacacugaa

SEQ ID NO: 611636 - RNA, 64 nt, Homo Sapiens
guauaguuuaaagggaggaugcccugagcccagaaaaaaggacugagccuuaccaauaauaaga

SEQ ID NO: 611637 - RNA, 64 nt, Homo Sapiens
cuugcccaacggcauauggaguguccuuauugcuaaaaaggauuccgucuccuucaaagaaguu

SEQ ID NO: 611638 - RNA, 64 nt, Homo Sapiens
aagcuguuauaaauauauauuauauaaauauauuaaaaaggaaaauguuucagauguuuauuug

SEQ ID NO: 611639 - RNA, 64 nt, Homo Sapiens
aaaugcauacaccuguuuguuagauauuguuccuaaaaaggaaugcagagggcgguucuuuuuu

SEQ ID NO: 611640 - RNA, 64 nt, Homo Sapiens
uuguacucugugcauuggaucuacuuuuuguugaaaaaaggaauugggaguauuuuugauuuuu

SEQ ID NO: 611641 - RNA, 64 nt, Homo Sapiens
aaaaaaaaaacacgucaaaaagaaugaagauuggaaaaaggaaaaucggggcgggccaaccccg

SEQ ID NO: 611642 - RNA, 64 nt, Homo Sapiens
auucaugccccccaaagggugguauuaaaagaggaaaaaggacauaguagugguaguaaagaaa

SEQ ID NO: 611643 - RNA, 64 nt, Homo Sapiens
agaggaaaaaggacauaguagugguaguaaagaaaaaaaggagaucuaacaaaaacacuugaau

SEQ ID NO: 611644 - RNA, 64 nt, Homo Sapiens
agaaauggcaagagauaccuucaagaaguuaacaaaaaaggaauggauuucuuccaugguaaua

SEQ ID NO: 611645 - RNA, 64 nt, Homo Sapiens
agcauacaugcuuaugcaugaaacaauucugcaaaaaaaggaugaauuuccuccaucacccaga

SEQ ID NO: 611646 - RNA, 64 nt, Homo Sapiens
gaagaaaauaaagaaggcuaaaaaaaaaaaaaaaaaaaaggagaacagagugagacccugucuc

SEQ ID NO: 611647 - RNA, 52 nt, Homo Sapiens
uauacaaaggaacauaaagaaaaaaaaggaaucauccaagacuggacucuga

SEQ ID NO: 611648 - RNA, 64 nt, Homo Sapiens
gguuaaaaugacuguuuucucucucuauggaaauaaaaaggaaaaaaaaaaaggaaacuuuuuu

SEQ ID NO: 611649 - RNA, 64 nt, Homo Sapiens
guuuucucucucuauggaaauaaaaaggaaaaaaaaaaaggaaacuuuuuuuguuugcucuugc

SEQ ID NO: 611650 - RNA, 64 nt, Homo Sapiens
auccaaaagugcagcaggagaacucuuuucccugaaaaaggaaaaauauugaacucaaugauag

SEQ ID NO: 611651 - RNA, 64 nt, Homo Sapiens
auacggucaguuaugucaauguuucauggucaauaaaaaggaaguugcaaauugugauuuaagc

SEQ ID NO: 611652 - RNA, 64 nt, Homo Sapiens
uguaaugguguacacagucuuaaaaagcaaagggaaaaaggaugaaucaugguuucaugagcau

SEQ ID NO: 611653 - RNA, 64 nt, Homo Sapiens
ggaggaaccacgcugccaccggacacaugccuuaaaaaaggaggaaagcuuuacuacucuuaga

SEQ ID NO: 611654 - RNA, 64 nt, Homo Sapiens
caagauaaauggguauguaggggacaaaagggagaaaaaggaaggcacaaucucuuauacuagu

SEQ ID NO: 611655 - RNA, 64 nt, Homo Sapiens
uauacgaagagucaucaacuaggugcccauauggaaaaaggaaacauugauacuuuaaaagcca

SEQ ID NO: 611656 - RNA, 64 nt, Homo Sapiens
uuuuguauagaaagcacuacuccuguaaaaaaccaaaaaggacuuucgcuaauauuuuaaacag

SEQ ID NO: 611657 - RNA, 64 nt, Homo Sapiens
agagaccauuaaaagaggacguauggcacucauuaaaaaggaucccugcaggcauaucauuggc

SEQ ID NO: 611658 - RNA, 64 nt, Homo Sapiens
aauagcauccuuaagauuuaaaaaaaaaaaaaaaaaaaaggaaaaaaaagugauggaagccgua

SEQ ID NO: 611659 - RNA, 64 nt, Homo Sapiens
ucaucuugucuauuuuuucucuucauguuguaacaaaaaggaaaaaagaaaaaaaaaucccauc

SEQ ID NO: 611660 - RNA, 64 nt, Homo Sapiens
aucugaaaacuaauaccuggaaaaggauaaaaaaaaaaaggaauccgugacccacagagcuaga

SEQ ID NO: 611661 - RNA, 64 nt, Homo Sapiens
aaaugcucuuuucccuauaaccucuuuucucaccaaaaaggagauaaauuugaaaacagauaaa

SEQ ID NO: 611662 - RNA, 64 nt, Homo Sapiens
cuaggaccaucuaugugucuccccuccccuccacaaaaaggagaaagagugcauuaaaauguuu

SEQ ID NO: 611663 - RNA, 64 nt, Homo Sapiens
ccaguuaggauagaauguguuucuuucugguuaaaaaaaggaaaaaccaucuaagaaaauauau

SEQ ID NO: 611664 - RNA, 64 nt, Homo Sapiens
gagaugaauagaagaaagaaaauggaaagaaggaaaaaaggaggauagaaaaaggauggaagaa

SEQ ID NO: 611665 - RNA, 64 nt, Homo Sapiens
aaagaaaauggaaagaaggaaaaaaggaggauagaaaaaggauggaagaaagaagcauugaaaa

SEQ ID NO: 611666 - RNA, 64 nt, Homo Sapiens
uaaucuuaaaaauacaauuuuggcaaaggguaauaaaaaggaccagcuuucauaagaaauccca

SEQ ID NO: 611667 - RNA, 64 nt, Homo Sapiens
aaaaauucuaguauauuuuauuuauacacacagcaaaaaggagacuagcaguaaaagaugaagu

SEQ ID NO: 611668 - RNA, 64 nt, Homo Sapiens
aguagaauaacuuagcucagaauauuagagcucuaaaaaggaauacacuuuuggauuaggguac

SEQ ID NO: 611669 - RNA, 64 nt, Homo Sapiens
gguagacucacuuagcucagauauuagagcuuuuaaaaaggaaguaucuuuugguuaggggaca

SEQ ID NO: 611670 - RNA, 64 nt, Homo Sapiens
cuucaaggacuguuucagugugagucagaaugugaaaaaggaauaaaaaauacuguugggcuca

SEQ ID NO: 611671 - RNA, 64 nt, Homo Sapiens
agcacauguauugacaacaguuuuauaauuuaauaaaaaggaauacauugcaauccguaauuuu

SEQ ID NO: 611672 - RNA, 64 nt, Homo Sapiens
auaaaccaggauccauuuagguaccacuugauauaaaaaggauauccauaaugaauauuuuaua

SEQ ID NO: 611673 - RNA, 64 nt, Homo Sapiens
uuguuuaagaacuauuuuaaaguguuccagacccaaaaaggaaaaauaaaaaaaaaggaauauu

SEQ ID NO: 611674 - RNA, 64 nt, Homo Sapiens
uaaaguguuccagacccaaaaaggaaaaauaaaaaaaaaggaauauuuguacccaacagcuaga

SEQ ID NO: 611675 - RNA, 64 nt, Homo Sapiens
aagcacuuuuggacaaugcuaucccagcaggaaaaaaaaggauaauauaacuguuuuaaaacuc

SEQ ID NO: 611676 - RNA, 64 nt, Homo Sapiens
uguuuauuaacucuccuuuauucuauauggaaauaaaaaggaggcagucauguuagcaaaugac

SEQ ID NO: 611677 - RNA, 64 nt, Homo Sapiens
aaaacaguuugaacacaaagaaaggaaaaaaagaaaaaaggaaaaaaaagaaaaaaugaaaaaa

SEQ ID NO: 611678 - RNA, 64 nt, Homo Sapiens
aaaagaaaaaaggaaaaaaaagaaaaaaugaaaaaaaaaggaaacaguuugaaaucuuaaaaaa

SEQ ID NO: 611679 - RNA, 64 nt, Homo Sapiens
agaggaagacuggacaaaacuuuuuuaaauaaaaaaaaaggaaaacaauaguuuaagaaauuuu

SEQ ID NO: 611680 - RNA, 64 nt, Homo Sapiens
aaugucgucuacugcagucuauguuauaaaaaggaaaaaggaaggcauuucauugagaauuaug

SEQ ID NO: 611681 - RNA, 64 nt, Homo Sapiens
aaggaagaaugucgucuacuaauuaugauguuauaaaaaggaaaugccaaagcauuucauugag

SEQ ID NO: 611682 - RNA, 64 nt, Homo Sapiens
ugggaaaaauuuuaaaacuuugagcucuguagguaaaaaggaggcaaaagugcauuauuuaguu

SEQ ID NO: 611683 - RNA, 64 nt, Homo Sapiens
aaauaauugagaaaguguuccuuuuuauagaaaaaaaaaggaaaguugaaaaaauaucauuuga

SEQ ID NO: 611684 - RNA, 64 nt, Homo Sapiens
agguaaugaaucguaaccaaguaacgaaccguaaaaaaaggagcgagggccaaaacaggagcag

SEQ ID NO: 611685 - RNA, 64 nt, Homo Sapiens
auucagaaugauacaguauugaccugcaguauugaaaaaggagaggugugacaucagaguauuu

SEQ ID NO: 611686 - RNA, 64 nt, Homo Sapiens
gacuuuaaaauaccuucuugaucgaauuuaaaacaaaaaggagguuuugcaaacugcagcagaa

SEQ ID NO: 611687 - RNA, 64 nt, Homo Sapiens
acuauaugaugaggagaaacgccaucagacuggaaaaaaggaugagagggccaaggagguauga

SEQ ID NO: 611688 - RNA, 64 nt, Homo Sapiens
acuaaugcccagcauuccucaaggucagccagacaaaaaggaacuuaggucuugggcagaggag

SEQ ID NO: 611689 - RNA, 64 nt, Homo Sapiens
cugguugugauggagaagugacuuugcuuuaagaaaaaaggaggcaagguagggagagcgccca

SEQ ID NO: 611690 - RNA, 64 nt, Homo Sapiens
uagagaaggggaaacuccuugaauuucuagguuuaaaaaggaacuuuuaaauuccuuaauguua

SEQ ID NO: 611691 - RNA, 64 nt, Homo Sapiens
uuccuuaaacuucuuaguguuucugaaacuucuaaaaaaggauucaguuaauuuauaauguuua

SEQ ID NO: 611692 - RNA, 64 nt, Homo Sapiens
uucugaauaagaugauagacgagaauuuuuuuuaaaaaaggaauuuaaaggaaucuugugcaac

SEQ ID NO: 611693 - RNA, 64 nt, Homo Sapiens
aauagguguugccuauugcugugcuuauaaaaugaaaaaggaaauugaggacacuuuugcaaau

SEQ ID NO: 611694 - RNA, 64 nt, Homo Sapiens
auaaaagauauugaggucuucuuuuuuuuaaauuaaaaaggaaauuguaucuggggaaaaaaaa

SEQ ID NO: 611695 - RNA, 64 nt, Homo Sapiens
ugagauuucaccaaccccaguacuauaaaaccaaaaaaaggaauuccuguuucuaaacuuucgc

SEQ ID NO: 611696 - RNA, 64 nt, Homo Sapiens
aaaaaaaaaaucuccagacuuuuuauguugaacuaaaaaggauuaaauauuuuuuucuuucuca

SEQ ID NO: 611697 - RNA, 64 nt, Homo Sapiens
guuucuccauauauauauuauuauauugugcuauaaaaaggauuuggcaucuuucauucucauu

SEQ ID NO: 611698 - RNA, 64 nt, Homo Sapiens
ucccuuuguucucuguuuaaaaaaaucuaaaaagaaaaaggaaaaaaaaaaaagaacugcugug

SEQ ID NO: 611699 - RNA, 64 nt, Homo Sapiens
gaaauagaagcauuaaauauuuuuaucuauauccaaaaaggagcacauuuuuauauuuacaaaa

SEQ ID NO: 611700 - RNA, 64 nt, Homo Sapiens
accagagaacagcuccccuagacauggccucuggaaaaaggaaaucuuugguggccaaagauuu

SEQ ID NO: 611701 - RNA, 64 nt, Homo Sapiens
uagccucuauugcccagauuggagucagaggucaaaaaaggauuccaagugauggaacuccagg

SEQ ID NO: 611702 - RNA, 64 nt, Homo Sapiens
ugucucaggauagcacaggccaagguaggggaguaaaaaggaggucaggcaaaagggaggaguu

SEQ ID NO: 611703 - RNA, 64 nt, Homo Sapiens
acugcugauuuaccgauguauuuaauguaaguaaaaaaaggaaaaaaagaaaagggcauuggag

SEQ ID NO: 611704 - RNA, 64 nt, Homo Sapiens
ugaugcuuaaagagaaaagaaaaaaagagagaagaaaaaggagagaugaaaaaggaggaugagg

SEQ ID NO: 611705 - RNA, 64 nt, Homo Sapiens
aaaagaaaaaaagagagaagaaaaaggagagaugaaaaaggaggaugaggagaagaauuaccuu

SEQ ID NO: 611706 - RNA, 64 nt, Homo Sapiens
ugauuggggggaaaaacuggugaaaaagaaauauaaaaaggacccuaaaaagaauucugcaaaa

SEQ ID NO: 611707 - RNA, 64 nt, Homo Sapiens
uccuugaggauagggauagguaagguaaacuuguaaaaaggaugucacagaagucacuuuuuaa

SEQ ID NO: 611708 - RNA, 64 nt, Homo Sapiens
cuucaauuauuagcuuuguuaaacacauuuuagaaaaaaggaacuucauuugcaaauugcaaua

SEQ ID NO: 611709 - RNA, 64 nt, Homo Sapiens
aaggcacugcuccuauuuucugacacaguuuacaaaaaaggaaaaguccacucgcuuggauuuc

SEQ ID NO: 611710 - RNA, 64 nt, Homo Sapiens
ucuuucaggauuauuuuaauaucauuggggggagaaaaaggaugaggaaaaaugcagcuuucaa

SEQ ID NO: 611711 - RNA, 64 nt, Homo Sapiens
gaaaaaaaaagaaaaaauuucaaaauaaaacaaaaaaaaggaagugcuguaaaacaaaacaaaa

SEQ ID NO: 611712 - RNA, 64 nt, Homo Sapiens
uuuauuacccccccacuaugcccucauuuuuuuaaaaaaggaaaaaaaaaagaaacuggguucc

SEQ ID NO: 611713 - RNA, 64 nt, Homo Sapiens
aaaaauaaaaaaauaaauaaaaauaaaaaaaauaaaaaaggaaaaaaaaaaaagaagaaacaag

SEQ ID NO: 611714 - RNA, 64 nt, Homo Sapiens
aauguauugugucugugcagaaaaaaaaaaaaccaaaaaggauugcuuuacuccaagaggagag

SEQ ID NO: 611715 - RNA, 64 nt, Homo Sapiens
aacaacaaagaaggcagagccaggauauaacuagaaaaaggaugucuuuuuuuuuuuuuuuacu

SEQ ID NO: 611716 - RNA, 64 nt, Homo Sapiens
gccccaagaaggcuggggcuauuuaccaggguagaaaaaggagcuuaccucccaccuuuggucc

SEQ ID NO: 611717 - RNA, 64 nt, Homo Sapiens
uacucugucucccuauaaugcuggagcggcuacuaaaaaggauaaaauguaucacuuaaauguu

SEQ ID NO: 611718 - RNA, 64 nt, Homo Sapiens
guaguccuauugagaagacauuucgucucugagaaaaaaggauggaacuauggguucucuucgc

SEQ ID NO: 611719 - RNA, 64 nt, Homo Sapiens
uuaugcugguucucagcuguuuaaaaaaaaaaaaaaaaaggaauagaaacaguuucaaccagau

SEQ ID NO: 611720 - RNA, 64 nt, Homo Sapiens
acugcagugcccaaggaauuucugcucugguuagaaaaaggacucugcuucaguccacuucugc

SEQ ID NO: 611721 - RNA, 64 nt, Homo Sapiens
ggacucugcuucaguccacuucugcucugguuagaaaaaggacucugcuucaguccacaguaca

SEQ ID NO: 611722 - RNA, 64 nt, Homo Sapiens
aaauccuucccuagagcuaggugauacgcuguuuaaaaaggaaagcuccauccuaggcaacaga

SEQ ID NO: 611723 - RNA, 64 nt, Homo Sapiens
auaggagaagguggaaauggucaacagaaggaaaaaaaaggaaaugacagagugagacuccauc

SEQ ID NO: 611724 - RNA, 64 nt, Homo Sapiens
augcaaaaauuauguaauaguuagauguauaaugaaaaaggauauaucaguagaaugauuucau

SEQ ID NO: 611725 - RNA, 64 nt, Homo Sapiens
agccuaauguagaagguggugaccaggaggaucuaaaaaggacccugauagcauuugcuaacag

SEQ ID NO: 611726 - RNA, 64 nt, Homo Sapiens
acauaguccaucgaagaagacggaggacuuggggaaaaaggaccguaucggcaagcaguguaaa

SEQ ID NO: 611727 - RNA, 64 nt, Homo Sapiens
gggcccuaaguagcucagauugguccuauuuuuuaaaaaggaaaucuuuaacucuuaaauuguu

SEQ ID NO: 611728 - RNA, 64 nt, Homo Sapiens
aaacuuacugcaaaguuuguuuauacuuuugccuaaaaaggaaauuggaugggauacuguggca

SEQ ID NO: 611729 - RNA, 64 nt, Homo Sapiens
aguauaugccugaaaagguuuuggauucagaaagaaaaaggaugguuaguuuaaucagugauuc

SEQ ID NO: 611730 - RNA, 64 nt, Homo Sapiens
agccccaaucuucccgucuuuaugagagaaaaggaaaaaggaaucaaagguggaagaaaaaaaa

SEQ ID NO: 611731 - RNA, 64 nt, Homo Sapiens
ggaagaaaaaaaaagccaaauucuguuuacggugaaaaaggauuuuguuuuucacccaauuugg

SEQ ID NO: 611732 - RNA, 64 nt, Homo Sapiens
gguccauccauacaauggaguauuacacagccauaaaaaggaaugaagcagugauccccacuac

SEQ ID NO: 611733 - RNA, 64 nt, Homo Sapiens
gagcuagauucucucucucaaaaaaaaaaaaaaaaaaaaggaaagaaagaaagaaaagaaaaga

SEQ ID NO: 611734 - RNA, 64 nt, Homo Sapiens
ugaaugaacugugaaagcuccuguuuuuauuaucaaaaaggacacugucaagaaggcgcccccu

SEQ ID NO: 611735 - RNA, 64 nt, Homo Sapiens
cuuauuuuuuuccuaaaagauaauguuuauuuuuaaaaaggaaggaaggagcaagugaaguuuc

SEQ ID NO: 611736 - RNA, 64 nt, Homo Sapiens
uuuucaccuagccagucuugagucuucuccgugcaaaaaggauucacagaaauggaccaguucu

SEQ ID NO: 611737 - RNA, 64 nt, Homo Sapiens
auuucauauguucuaaaaugacuagcaaugguuuaaaaaggaagaagaguggaagugaagaagg

SEQ ID NO: 611738 - RNA, 64 nt, Homo Sapiens
cucaggcaaagggauccauaagcauaaaaaggaaaaaaaggaaaauuccugcugggucuuaaca

SEQ ID NO: 611739 - RNA, 64 nt, Homo Sapiens
aaaaggaaacucaggcaaaggucuuaacaagcauaaaaaggaaagggacguccauuccugcugg

SEQ ID NO: 611740 - RNA, 64 nt, Homo Sapiens
aaagauaaguuaggcagcuagacccugcguucuaaaaaaggauugcuugcaauguugguuuggc

SEQ ID NO: 611741 - RNA, 64 nt, Homo Sapiens
uugcuucucuuuuagaaauacuuguggggagagaaaaaaggaugguuugggcauauugguauag

SEQ ID NO: 611742 - RNA, 64 nt, Homo Sapiens
ggaggaaacagugaggcaggagugcaguucagggaaaaaggagaucaaacacaggagucgagag

SEQ ID NO: 611743 - RNA, 64 nt, Homo Sapiens
auguagcuuuuucccugaaaaggacucacaucauaaaaaggaccaugcuucgcaggaaguggga

SEQ ID NO: 611744 - RNA, 64 nt, Homo Sapiens; identical to SEQ ID NO: 96825

SEQ ID NO: 611745 - RNA, 64 nt, Homo Sapiens; identical to SEQ ID NO: 96826

SEQ ID NO: 611746 - RNA, 64 nt, Homo Sapiens; identical to SEQ ID NO: 96827

SEQ ID NO: 611747 - RNA, 64 nt, Homo Sapiens; identical to SEQ ID NO: 96828

SEQ ID NO: 611748 - RNA, 64 nt, Homo Sapiens; identical to SEQ ID NO: 96829

SEQ ID NO: 611749 - RNA, 64 nt, Homo Sapiens; identical to SEQ ID NO: 96830

SEQ ID NO: 611750 - RNA, 64 nt, Homo Sapiens; identical to SEQ ID NO: 96831

SEQ ID NO: 611751 - RNA, 64 nt, Homo Sapiens; identical to SEQ ID NO: 96832

SEQ ID NO: 611752 - RNA, 64 nt, Homo Sapiens; identical to SEQ ID NO: 96833

SEQ ID NO: 611753 - RNA, 64 nt, Homo Sapiens; identical to SEQ ID NO: 96834

SEQ ID NO: 611754 - RNA, 64 nt, Homo Sapiens; identical to SEQ ID NO: 96835

SEQ ID NO: 611755 - RNA, 64 nt, Homo Sapiens; identical to SEQ ID NO: 326924

SEQ ID NO: 611756 - RNA, 64 nt, Homo Sapiens; identical to SEQ ID NO: 326925

SEQ ID NO: 611757 - RNA, 64 nt, Homo Sapiens; identical to SEQ ID NO: 326926

SEQ ID NO: 611758 - RNA, 64 nt, Homo Sapiens; identical to SEQ ID NO: 326927

SEQ ID NO: 611759 - RNA, 64 nt, Homo Sapiens; identical to SEQ ID NO: 326928

SEQ ID NO: 611760 - RNA, 64 nt, Homo Sapiens; identical to SEQ ID NO: 326929

SEQ ID NO: 611761 - RNA, 64 nt, Homo Sapiens; identical to SEQ ID NO: 326930

SEQ ID NO: 611762 - RNA, 64 nt, Homo Sapiens; identical to SEQ ID NO: 326931

SEQ ID NO: 611763 - RNA, 64 nt, Homo Sapiens; identical to SEQ ID NO: 326932

SEQ ID NO: 611764 - RNA, 64 nt, Homo Sapiens; identical to SEQ ID NO: 326933

SEQ ID NO: 611765 - RNA, 64 nt, Homo Sapiens; identical to SEQ ID NO: 326934

SEQ ID NO: 611766 - RNA, 64 nt, Homo Sapiens; identical to SEQ ID NO: 326935

SEQ ID NO: 611767 - RNA, 64 nt, Homo Sapiens; identical to SEQ ID NO: 326936

SEQ ID NO: 611768 - RNA, 64 nt, Homo Sapiens; identical to SEQ ID NO: 326937

SEQ ID NO: 611769 - RNA, 64 nt, Homo Sapiens; identical to SEQ ID NO: 326938

SEQ ID NO: 611770 - RNA, 64 nt, Homo Sapiens; identical to SEQ ID NO: 326939

SEQ ID NO: 611771 - RNA, 64 nt, Homo Sapiens; identical to SEQ ID NO: 326940

SEQ ID NO: 611772 - RNA, 56 nt, Homo Sapiens; identical to SEQ ID NO: 326941

SEQ ID NO: 611773 - RNA, 64 nt, Homo Sapiens; identical to SEQ ID NO: 326942

SEQ ID NO: 611774 - RNA, 64 nt, Homo Sapiens; identical to SEQ ID NO: 326943

SEQ ID NO: 611775 - RNA, 64 nt, Homo Sapiens; identical to SEQ ID NO: 326944

SEQ ID NO: 611776 - RNA, 64 nt, Homo Sapiens; identical to SEQ ID NO: 326945

SEQ ID NO: 611777 - RNA, 64 nt, Homo Sapiens; identical to SEQ ID NO: 326946

SEQ ID NO: 611778 - RNA, 64 nt, Homo Sapiens; identical to SEQ ID NO: 326947

SEQ ID NO: 611779 - RNA, 64 nt, Homo Sapiens; identical to SEQ ID NO: 326948

SEQ ID NO: 611780 - RNA, 64 nt, Homo Sapiens; identical to SEQ ID NO: 326949

SEQ ID NO: 611781 - RNA, 64 nt, Homo Sapiens; identical to SEQ ID NO: 326950

SEQ ID NO: 611782 - RNA, 64 nt, Homo Sapiens; identical to SEQ ID NO: 326951

SEQ ID NO: 611783 - RNA, 64 nt, Homo Sapiens; identical to SEQ ID NO: 326952

SEQ ID NO: 611784 - RNA, 64 nt, Homo Sapiens; identical to SEQ ID NO: 326953

SEQ ID NO: 611785 - RNA, 64 nt, Homo Sapiens; identical to SEQ ID NO: 326954

SEQ ID NO: 611786 - RNA, 64 nt, Homo Sapiens; identical to SEQ ID NO: 326955

SEQ ID NO: 611787 - RNA, 64 nt, Homo Sapiens
gucuagagaaagugaucaccuaagguugaacagcauggcucagaugugauacugauugccacau

SEQ ID NO: 611788 - RNA, 64 nt, Homo Sapiens
gucuuguucaagagaaaguguaagguugaacaacauggcucagaugugauacugauucccacau

SEQ ID NO: 611789 - RNA, 64 nt, Homo Sapiens
ccagggugggaagcacggggagcaauggaaucagauggcucauucucuccuuccagcucuuuac

SEQ ID NO: 611790 - RNA, 64 nt, Homo Sapiens
aggguuugucucauggucagcucgccucucaaagauggcucaccaaucaccugccuguuuuuac

SEQ ID NO: 611791 - RNA, 64 nt, Homo Sapiens
agaucugucccuuccccgaggggagaacccacugauggcucauugagaaaacccuuuuacucug

SEQ ID NO: 611792 - RNA, 64 nt, Homo Sapiens
ugccuguacuuauugucucuauuuuucaggacaaauggcucaugccacagggauccccagaugg

SEQ ID NO: 611793 - RNA, 64 nt, Homo Sapiens
ggagucaggacuuggaagugggacacccccugggauggcucaaagcuccugugguccaguggcc

SEQ ID NO: 611794 - RNA, 64 nt, Homo Sapiens
cugcaugacagguacggcguccugcccuggcagcauggcucagacccaggcugggagcuggaua

SEQ ID NO: 611795 - RNA, 64 nt, Homo Sapiens
augcuagcaacaucacaucacuaucaagaaggaaauggcucaguuccccccaauguggagaagu

SEQ ID NO: 611796 - RNA, 64 nt, Homo Sapiens
uguagaaguagauguacaucuguggugaucaugaauggcucaugcgacagucccccaacuccua

SEQ ID NO: 611797 - RNA, 64 nt, Homo Sapiens
aggcuuggaccugguggagggugguaugagagggauggcucacgguggagggugcccagcagac

SEQ ID NO: 611798 - RNA, 64 nt, Homo Sapiens
aggcuuggaccugccguggauggaccggagagagauggcucauggagggacggcucacagggcu

SEQ ID NO: 611799 - RNA, 64 nt, Homo Sapiens
gcggugccugcccugggccgauggcucauggcucauggcucaggggcagcugggagacaggcuc

SEQ ID NO: 611800 - RNA, 64 nt, Homo Sapiens
gcucagggcggugccugccccaggcucauggcucauggcucaugagggcugggcagcugggaga

SEQ ID NO: 611801 - RNA, 64 nt, Homo Sapiens
gcucauggcucagggcggugugggagacaggcucauggcucaugugacuguagggcugggcagc

SEQ ID NO: 611802 - RNA, 64 nt, Homo Sapiens
ccuuauauugguuuugguuuggggcacuggaugucgcagcuacugcuaugguuucaggaggccu

SEQ ID NO: 611803 - RNA, 64 nt, Homo Sapiens
aaauggaaaucccagaucccugguccugccgacacgcagcuacugagaagaccaaaagaggugu

SEQ ID NO: 611804 - RNA, 64 nt, Homo Sapiens
cagaaucagauggaaaauuacugcccaugguggccgcagcuaauugcauuuggccuauguaauc

SEQ ID NO: 611805 - RNA, 64 nt, Homo Sapiens
ucggaggggaaaaggacaggugaucuggggaaaacgcagcuacaccuggagcaaggucucuucc

SEQ ID NO: 611806 - RNA, 64 nt, Homo Sapiens
aaauuagccaaguacaguggggcacaccuauagucgcagcuacuugggaggcuggggcaggaga

SEQ ID NO: 611807 - RNA, 64 nt, Homo Sapiens
guuuuccguguucguaacagaagggaggggaaagcgcagcuacugacaaguagaacacugcuac

SEQ ID NO: 611808 - RNA, 64 nt, Homo Sapiens
ccccuacuggauggcaccugagaugaucaacggccgcagcuaugaugagaagguggauguguuc

SEQ ID NO: 611809 - RNA, 64 nt, Homo Sapiens
aaauuagccgagcaugguggcgcaugccuguagucgcagcuacucgcgagguugaggcaggaga

SEQ ID NO: 611810 - RNA, 64 nt, Homo Sapiens
auacaaaaaauuagccgggcgugguggcuguagucgcagcuacucaggaggcugaggcgggaga

SEQ ID NO: 611811 - RNA, 64 nt, Homo Sapiens
gcugggccuaccuuccccaggccugcuccaguuccgcagcuagagccacuucugugccuccaca

SEQ ID NO: 611812 - RNA, 64 nt, Homo Sapiens
cacuuaaagaaaaaacgaguucuuucguucugugcgcagcuaaaaggggcgcccuacaucuccg

SEQ ID NO: 611813 - RNA, 64 nt, Homo Sapiens
agggaagcauuggaacuggaguugugcacagcaccgcagcuagugggccuggcugggggugcag

SEQ ID NO: 611814 - RNA, 64 nt, Homo Sapiens
aaauuuuauaggacuguucuuugcuguuguuggucgcagcuacauaagacuggacauuuaacuu

SEQ ID NO: 611815 - RNA, 64 nt, Homo Sapiens
cagaaggcugaggugggaggcuuaugccuguagucgcagcuacuaaaaaagcuggguauggugg

SEQ ID NO: 611816 - RNA, 64 nt, Homo Sapiens
cucccuguccccaccccagcgcagcagcccuccccgcagcuagcagcgagggcaccuugugauc

SEQ ID NO: 611817 - RNA, 64 nt, Homo Sapiens
caccagguacaaauuacugguauguuuuauaagccgcagcuacuguacacagccuaucugauau

SEQ ID NO: 611818 - RNA, 64 nt, Homo Sapiens
uauuauuuuguagaccugccuauuuagugcuacucgcagcuauucuauugaguaaacuacaaua

SEQ ID NO: 611819 - RNA, 64 nt, Homo Sapiens
uuuuguauuuuuaguagagacacacgccaccacacgcagcuaauugaguagcugggauuacagg

SEQ ID NO: 611820 - RNA, 64 nt, Homo Sapiens
cucagccuccaaugcauuggccugccccagaggucgcagcuaccggcuccacacagcagugucc

SEQ ID NO: 611821 - RNA, 64 nt, Homo Sapiens
ccccuuucuuccaaacuuuuccccaucgccccaccgcagcuacuccccaacuccaaccucucgg

SEQ ID NO: 611822 - RNA, 64 nt, Homo Sapiens
aauuaagauagaucgcguuagccaguuuuaccagcgcagcuaggcgcgauggcugucgccugua

SEQ ID NO: 611823 - RNA, 64 nt, Homo Sapiens
auccuucccccagacacuguucccaaccugucaucgcagcuaaucuguagguucucuuucuuug

SEQ ID NO: 611824 - RNA, 64 nt, Homo Sapiens
uuuuuguauuuuuaguagagcaccugccaccaugcgcagcuaauugaguagcugggacuacagg

SEQ ID NO: 611825 - RNA, 64 nt, Homo Sapiens
acugggggcaggauggcggagcuugggagaggggcgcagcuaagaagggcagggccaagaccgg

SEQ ID NO: 611826 - RNA, 64 nt, Homo Sapiens
uccgcaucuccccaccaccaccagggcacucacucgcagcuauagcccaggacagaaaaacugu

SEQ ID NO: 611827 - RNA, 64 nt, Homo Sapiens
accugcaaaacugcuagcguaaucucagcacauacgcagcuaggaaguuugucauaaaaucaac

SEQ ID NO: 611828 - RNA, 64 nt, Homo Sapiens
agccgccaaggcugcucgccuucuccguggcuuccgcagcuaccgucugcacggugagagggca

SEQ ID NO: 611829 - RNA, 64 nt, Homo Sapiens
cuuucauccuacaaauugggucauucauguccuacgcagcuaaaacagagcccaggagccaggg

SEQ ID NO: 611830 - RNA, 64 nt, Homo Sapiens
ccgggcauccaguggcagcugucaccaggcucuccgcagcuaucggaucuccacagcagcaaag

SEQ ID NO: 611831 - RNA, 64 nt, Homo Sapiens
aaaccauaucagcauccuuuugagauuuguggggggacacaacccugggagauacaauucaagu

SEQ ID NO: 611832 - RNA, 64 nt, Homo Sapiens
caccaagucccuaggcugcaggcuggaguggcugggacacaagauguuggccccuuucagccau

SEQ ID NO: 611833 - RNA, 64 nt, Homo Sapiens
uucuucaguccugagcccuaaagaaaaggugguaggacacaaaguauggaccaacaccuccuuc

SEQ ID NO: 611834 - RNA, 64 nt, Homo Sapiens
ggagaaaugggacauggauuauggucuuucccagggacacaaagaauuccucuaagaacagaga

SEQ ID NO: 611835 - RNA, 64 nt, Homo Sapiens
gagucaucaccacucccuaaucucaaguacccagggacacaaacacugcggaaggcggcagggu

SEQ ID NO: 611836 - RNA, 64 nt, Homo Sapiens
cauucauuaaagcugauugugugagagugaacugggacacaagcuagucuagcucacugcagcc

SEQ ID NO: 611837 - RNA, 64 nt, Homo Sapiens
uucagaucugccucacaccuucaaauucaugaaaggacacaaacacacauaagaauacacucug

SEQ ID NO: 611838 - RNA, 64 nt, Homo Sapiens
uucagaucugccaagaaccuucgaauucaugaaaggacacaaacacacguaagaaugcacucug

SEQ ID NO: 611839 - RNA, 64 nt, Homo Sapiens
uuuaaauuuaaaccauugagacuucagaagagcaggacacaaugcuguggacaggcaccaauuu

SEQ ID NO: 611840 - RNA, 64 nt, Homo Sapiens
ggaaucuggggguuucuucuggaacggggcgugaggacacaaggaggccucugggccacgccuc

SEQ ID NO: 611841 - RNA, 64 nt, Homo Sapiens; identical to SEQ ID NO: 589611

SEQ ID NO: 611842 - RNA, 64 nt, Homo Sapiens; identical to SEQ ID NO: 589612

SEQ ID NO: 611843 - RNA, 64 nt, Homo Sapiens; identical to SEQ ID NO: 589613

SEQ ID NO: 611844 - RNA, 64 nt, Homo Sapiens; identical to SEQ ID NO: 589614

SEQ ID NO: 611845 - RNA, 64 nt, Homo Sapiens; identical to SEQ ID NO: 589615

SEQ ID NO: 611846 - RNA, 64 nt, Homo Sapiens; identical to SEQ ID NO: 589616

SEQ ID NO: 611847 - RNA, 64 nt, Homo Sapiens; identical to SEQ ID NO: 589617

SEQ ID NO: 611848 - RNA, 64 nt, Homo Sapiens; identical to SEQ ID NO: 589618

SEQ ID NO: 611849 - RNA, 64 nt, Homo Sapiens; identical to SEQ ID NO: 589619

SEQ ID NO: 611850 - RNA, 64 nt, Homo Sapiens; identical to SEQ ID NO: 589620

SEQ ID NO: 611851 - RNA, 64 nt, Homo Sapiens; identical to SEQ ID NO: 589621

SEQ ID NO: 611852 - RNA, 64 nt, Homo Sapiens; identical to SEQ ID NO: 589622

SEQ ID NO: 611853 - RNA, 64 nt, Homo Sapiens; identical to SEQ ID NO: 589623

SEQ ID NO: 611854 - RNA, 64 nt, Homo Sapiens; identical to SEQ ID NO: 589624

SEQ ID NO: 611855 - RNA, 64 nt, Homo Sapiens; identical to SEQ ID NO: 589625

SEQ ID NO: 611856 - RNA, 64 nt, Homo Sapiens; identical to SEQ ID NO: 589626

SEQ ID NO: 611857 - RNA, 64 nt, Homo Sapiens; identical to SEQ ID NO: 589627

SEQ ID NO: 611858 - RNA, 64 nt, Homo Sapiens; identical to SEQ ID NO: 589628

SEQ ID NO: 611859 - RNA, 64 nt, Homo Sapiens; identical to SEQ ID NO: 589629

SEQ ID NO: 611860 - RNA, 64 nt, Homo Sapiens; identical to SEQ ID NO: 589630

SEQ ID NO: 611861 - RNA, 64 nt, Homo Sapiens; identical to SEQ ID NO: 589631

SEQ ID NO: 611862 - RNA, 64 nt, Homo Sapiens; identical to SEQ ID NO: 589632

SEQ ID NO: 611863 - RNA, 64 nt, Homo Sapiens; identical to SEQ ID NO: 589633

SEQ ID NO: 611864 - RNA, 64 nt, Homo Sapiens; identical to SEQ ID NO: 589634

SEQ ID NO: 611865 - RNA, 64 nt, Homo Sapiens; identical to SEQ ID NO: 589635

SEQ ID NO: 611866 - RNA, 64 nt, Homo Sapiens; identical to SEQ ID NO: 589636

SEQ ID NO: 611867 - RNA, 64 nt, Homo Sapiens; identical to SEQ ID NO: 589637

SEQ ID NO: 611868 - RNA, 64 nt, Homo Sapiens; identical to SEQ ID NO: 589638

SEQ ID NO: 611869 - RNA, 64 nt, Homo Sapiens; identical to SEQ ID NO: 589639

SEQ ID NO: 611870 - RNA, 64 nt, Homo Sapiens; identical to SEQ ID NO: 589640

SEQ ID NO: 611871 - RNA, 64 nt, Homo Sapiens; identical to SEQ ID NO: 589641

SEQ ID NO: 611872 - RNA, 64 nt, Homo Sapiens; identical to SEQ ID NO: 589642

SEQ ID NO: 611873 - RNA, 64 nt, Homo Sapiens; identical to SEQ ID NO: 589643

SEQ ID NO: 611874 - RNA, 64 nt, Homo Sapiens; identical to SEQ ID NO: 589644

SEQ ID NO: 611875 - RNA, 64 nt, Homo Sapiens; identical to SEQ ID NO: 589645

SEQ ID NO: 611876 - RNA, 64 nt, Homo Sapiens; identical to SEQ ID NO: 589646

SEQ ID NO: 611877 - RNA, 64 nt, Homo Sapiens; identical to SEQ ID NO: 589647

SEQ ID NO: 611878 - RNA, 64 nt, Homo Sapiens; identical to SEQ ID NO: 589648

SEQ ID NO: 611879 - RNA, 64 nt, Homo Sapiens; identical to SEQ ID NO: 589649

SEQ ID NO: 611880 - RNA, 64 nt, Homo Sapiens; identical to SEQ ID NO: 589650

SEQ ID NO: 611881 - RNA, 64 nt, Homo Sapiens; identical to SEQ ID NO: 589651

SEQ ID NO: 611882 - RNA, 64 nt, Homo Sapiens; identical to SEQ ID NO: 589652

SEQ ID NO: 611883 - RNA, 64 nt, Homo Sapiens; identical to SEQ ID NO: 589653

SEQ ID NO: 611884 - RNA, 64 nt, Homo Sapiens; identical to SEQ ID NO: 589654

SEQ ID NO: 611885 - RNA, 64 nt, Homo Sapiens; identical to SEQ ID NO: 589655

SEQ ID NO: 611886 - RNA, 64 nt, Homo Sapiens; identical to SEQ ID NO: 589656

SEQ ID NO: 611887 - RNA, 64 nt, Homo Sapiens; identical to SEQ ID NO: 589657

SEQ ID NO: 611888 - RNA, 64 nt, Homo Sapiens; identical to SEQ ID NO: 589658

SEQ ID NO: 611889 - RNA, 64 nt, Homo Sapiens; identical to SEQ ID NO: 589659

SEQ ID NO: 611890 - RNA, 64 nt, Homo Sapiens; identical to SEQ ID NO: 589660

SEQ ID NO: 611891 - RNA, 64 nt, Homo Sapiens; identical to SEQ ID NO: 589661

SEQ ID NO: 611892 - RNA, 64 nt, Homo Sapiens; identical to SEQ ID NO: 589662

SEQ ID NO: 611893 - RNA, 64 nt, Homo Sapiens; identical to SEQ ID NO: 589663

SEQ ID NO: 611894 - RNA, 64 nt, Homo Sapiens; identical to SEQ ID NO: 589664

SEQ ID NO: 611895 - RNA, 64 nt, Homo Sapiens; identical to SEQ ID NO: 589665

SEQ ID NO: 611896 - RNA, 64 nt, Homo Sapiens; identical to SEQ ID NO: 589666

SEQ ID NO: 611897 - RNA, 64 nt, Homo Sapiens; identical to SEQ ID NO: 589667

SEQ ID NO: 611898 - RNA, 64 nt, Homo Sapiens; identical to SEQ ID NO: 589668

SEQ ID NO: 611899 - RNA, 61 nt, Homo Sapiens; identical to SEQ ID NO: 448102

SEQ ID NO: 611900 - RNA, 64 nt, Homo Sapiens; identical to SEQ ID NO: 589670

SEQ ID NO: 611901 - RNA, 64 nt, Homo Sapiens; identical to SEQ ID NO: 589671

SEQ ID NO: 611902 - RNA, 64 nt, Homo Sapiens; identical to SEQ ID NO: 589672

SEQ ID NO: 611903 - RNA, 64 nt, Homo Sapiens; identical to SEQ ID NO: 589673

SEQ ID NO: 611904 - RNA, 64 nt, Homo Sapiens; identical to SEQ ID NO: 589674

SEQ ID NO: 611905 - RNA, 64 nt, Homo Sapiens; identical to SEQ ID NO: 589675

SEQ ID NO: 611906 - RNA, 64 nt, Homo Sapiens; identical to SEQ ID NO: 589676

SEQ ID NO: 611907 - RNA, 64 nt, Homo Sapiens; identical to SEQ ID NO: 589677

SEQ ID NO: 611908 - RNA, 64 nt, Homo Sapiens; identical to SEQ ID NO: 589678

SEQ ID NO: 611909 - RNA, 64 nt, Homo Sapiens; identical to SEQ ID NO: 589679

SEQ ID NO: 611910 - RNA, 64 nt, Homo Sapiens; identical to SEQ ID NO: 589680

SEQ ID NO: 611911 - RNA, 64 nt, Homo Sapiens; identical to SEQ ID NO: 589681

SEQ ID NO: 611912 - RNA, 64 nt, Homo Sapiens; identical to SEQ ID NO: 589682

SEQ ID NO: 611913 - RNA, 64 nt, Homo Sapiens; identical to SEQ ID NO: 589683

SEQ ID NO: 611914 - RNA, 64 nt, Homo Sapiens; identical to SEQ ID NO: 589684

SEQ ID NO: 611915 - RNA, 64 nt, Homo Sapiens; identical to SEQ ID NO: 589685

SEQ ID NO: 611916 - RNA, 64 nt, Homo Sapiens; identical to SEQ ID NO: 589686

SEQ ID NO: 611917 - RNA, 64 nt, Homo Sapiens; identical to SEQ ID NO: 589687

SEQ ID NO: 611918 - RNA, 64 nt, Homo Sapiens; identical to SEQ ID NO: 589688

SEQ ID NO: 611919 - RNA, 64 nt, Homo Sapiens; identical to SEQ ID NO: 589689

SEQ ID NO: 611920 - RNA, 64 nt, Homo Sapiens; identical to SEQ ID NO: 589690

SEQ ID NO: 611921 - RNA, 64 nt, Homo Sapiens; identical to SEQ ID NO: 589691

SEQ ID NO: 611922 - RNA, 64 nt, Homo Sapiens; identical to SEQ ID NO: 589692

SEQ ID NO: 611923 - RNA, 64 nt, Homo Sapiens; identical to SEQ ID NO: 589693

SEQ ID NO: 611924 - RNA, 64 nt, Homo Sapiens; identical to SEQ ID NO: 589694

SEQ ID NO: 611925 - RNA, 64 nt, Homo Sapiens; identical to SEQ ID NO: 589695

SEQ ID NO: 611926 - RNA, 64 nt, Homo Sapiens; identical to SEQ ID NO: 589696

SEQ ID NO: 611927 - RNA, 64 nt, Homo Sapiens; identical to SEQ ID NO: 589697

SEQ ID NO: 611928 - RNA, 64 nt, Homo Sapiens; identical to SEQ ID NO: 589698

SEQ ID NO: 611929 - RNA, 64 nt, Homo Sapiens; identical to SEQ ID NO: 589699

SEQ ID NO: 611930 - RNA, 64 nt, Homo Sapiens; identical to SEQ ID NO: 589700

SEQ ID NO: 611931 - RNA, 64 nt, Homo Sapiens; identical to SEQ ID NO: 589701

SEQ ID NO: 611932 - RNA, 64 nt, Homo Sapiens; identical to SEQ ID NO: 589702

SEQ ID NO: 611933 - RNA, 64 nt, Homo Sapiens; identical to SEQ ID NO: 589703

SEQ ID NO: 611934 - RNA, 64 nt, Homo Sapiens; identical to SEQ ID NO: 589704

SEQ ID NO: 611935 - RNA, 64 nt, Homo Sapiens; identical to SEQ ID NO: 589705

SEQ ID NO: 611936 - RNA, 64 nt, Homo Sapiens
uuguuuuuagaguccugaagucuggaggcuagacuuccugaaagcaagucaagaauauagagca

SEQ ID NO: 611937 - RNA, 64 nt, Homo Sapiens
uaauuaguauaacauuuacucugaauuugaagauuuccugaaacaaaguuuguacaagaagccc

SEQ ID NO: 611938 - RNA, 64 nt, Homo Sapiens
cuaggauccacggauaugagaccauuuuugucauuuccugaagucacacuggcguuuccagaag

SEQ ID NO: 611939 - RNA, 64 nt, Homo Sapiens
uguuccuggacuucauuuucaaugaugaaccaaauuccugaauuauuuauaauugugucuaaag

SEQ ID NO: 611940 - RNA, 64 nt, Homo Sapiens
aagccuuggagaccagcgcuaacagaugcaaaccuuccugaauaccccugcacagugccuguca

SEQ ID NO: 611941 - RNA, 64 nt, Homo Sapiens
cucugcauuuggagauucgugcuccaggcaccucuuccugaaguugugguggaugccagggcgu

SEQ ID NO: 611942 - RNA, 64 nt, Homo Sapiens
accuagaaauuucuaucugaaacuggcaauaguauuccugaaauggggagaauauucccuaagc

SEQ ID NO: 611943 - RNA, 64 nt, Homo Sapiens
uaaaaugaggggagaauauucaguauuuauauuauuccugaaaaacuugcuauauaguaguaug

SEQ ID NO: 611944 - RNA, 64 nt, Homo Sapiens
ugcaggcuaauuuguacagauacugguuguuccauuccugaauauaguucuucaaguaacaguu

SEQ ID NO: 611945 - RNA, 64 nt, Homo Sapiens
gaaaauagaauaugaucaauagggauuuuaugaauuccugaaagccauacaaaggugcuauccu

SEQ ID NO: 611946 - RNA, 64 nt, Homo Sapiens
cagcugaggccuugccuugaccagguucuccuauuuccugaacucuucugggguugcuccgggg

SEQ ID NO: 611947 - RNA, 64 nt, Homo Sapiens
accagcugcuggccgcgguggcccggucauugacuuccugaacaguuccaguaccgcccucggg

SEQ ID NO: 611948 - RNA, 64 nt, Homo Sapiens
ccaacucagguaaaagugccaucgcccugauagauuccugaauuccagccagugugggagaggu

SEQ ID NO: 611949 - RNA, 64 nt, Homo Sapiens
aaauaucagacuagugacaauaacaggcucaauauuccugaaugccuaucaagccaguacgugc

SEQ ID NO: 611950 - RNA, 64 nt, Homo Sapiens
aaacaguuaacuuucagaagagcugguuuccucauuccugaaagagccuuuccauaaggaaugu

SEQ ID NO: 611951 - RNA, 64 nt, Homo Sapiens
uuguaguugaaacacagaaaaugccacuuuucuguuccugaagaggcucuuuugugcauaauau

SEQ ID NO: 611952 - RNA, 64 nt, Homo Sapiens
uuguaguuccaaaaacccaucuaaauuucuugaguuccugaauuuugaacaggauuaccuggag

SEQ ID NO: 611953 - RNA, 64 nt, Homo Sapiens
gagaaaaagacugaauaaauaucucacguaaaccuuccugaaagauaaacguuuuccugaauuc

SEQ ID NO: 611954 - RNA, 64 nt, Homo Sapiens
uaucucacguaaaccuuccugaaagauaaacguuuuccugaauucagaaacuaguagcuaacau

SEQ ID NO: 611955 - RNA, 64 nt, Homo Sapiens
cuccuuaauagcagaaccuuaguaaugcccagucuuccugaaucagucaucccaguuuccugaa

SEQ ID NO: 611956 - RNA, 64 nt, Homo Sapiens
uaaugcccagucuuccugaaugagucaucccaguuuccugaaagaacacucagcagugcuauuu

SEQ ID NO: 611957 - RNA, 64 nt, Homo Sapiens
ccacuuaaccauuccaugcguuggcacuuaucuauuccugaaauuucuuuuaugugauuagcuc

SEQ ID NO: 611958 - RNA, 64 nt, Homo Sapiens
aaguguccccuuauacaguggagggaagucuuccuuccugaaggaaaauaaacugacacuuauu

SEQ ID NO: 611959 - RNA, 64 nt, Homo Sapiens
aaauaaauaguauuuuugagccuucaagauacaguuccugaauauucuaauuuaaauuguuaua

SEQ ID NO: 611960 - RNA, 64 nt, Homo Sapiens
uauuaaucauuauuucuucaguauaaaguuauucuuccugaaaaaguaagauauaccugggaaa

SEQ ID NO: 611961 - RNA, 64 nt, Homo Sapiens
ucgcauuagagcgagucacacuuuucccucgccuuuccugaaggugacuuuuccugaaggcuug

SEQ ID NO: 611962 - RNA, 64 nt, Homo Sapiens
cuugcuuuucccucgccuuucugccgcaugacuuuuccugaagggcaucuccagauuccagacc

SEQ ID NO: 611963 - RNA, 64 nt, Homo Sapiens
cggcaguguuguggauaagucaacucuugguucuuuccugaagauccaggaaaggggaaugaau

SEQ ID NO: 611964 - RNA, 64 nt, Homo Sapiens
gugaagggagcccuuuuaaauccuuccacuucccuuccugaauaggcaggaauugguuaauuuc

SEQ ID NO: 611965 - RNA, 64 nt, Homo Sapiens
uuacccaucccuuuucagauuaaucuuuuauccuuuccugaaguacaaagucuuaagagugucu

SEQ ID NO: 611966 - RNA, 64 nt, Homo Sapiens
accugcuaaaugccuguauuugaagucucuccccuuccugaagugaccuuuuaugaggcucuuu

SEQ ID NO: 611967 - RNA, 64 nt, Homo Sapiens
gcaaauuugcugaagugaccaaagcuuguacaaauuccugaaccagggcacuguccuuucagac

SEQ ID NO: 611968 - RNA, 64 nt, Homo Sapiens
gggaggagggcacuguccuugggaaaagcuaccuuuccugaaagauugcuucuuaccagacaug

SEQ ID NO: 611969 - RNA, 64 nt, Homo Sapiens
ccgccagagacagcucagguagaugcuguggcaguuccugaagcagcuuuacugcaaagugaaa

SEQ ID NO: 611970 - RNA, 64 nt, Homo Sapiens
gauguuaguuucugccacaacccuagugcccaucuuccugaaaguugggagggcugcaccuuug

SEQ ID NO: 611971 - RNA, 64 nt, Homo Sapiens
aaauagcuuagcggcaagaagccguugaggcgguuuccugaauuuccccaucugccacaggcca

SEQ ID NO: 611972 - RNA, 64 nt, Homo Sapiens
acaugcguguaccucacuuuacauaagaaauguauuccugaaaagcugcauuuaaaucaagucc

SEQ ID NO: 611973 - RNA, 64 nt, Homo Sapiens
ugaccaagcuuccaaagcucguuuggguguugccuuccugaaggauuuugguuccacaagcagu

SEQ ID NO: 611974 - RNA, 64 nt, Homo Sapiens
gcucuggucugcuccucagaauguuuacucucccuuccugaaccauguaguggcaaguguggcg

SEQ ID NO: 611975 - RNA, 64 nt, Homo Sapiens
uuaaaauugaacccuaucaugaaaugauaauuucuuccugaauuuacacauaauccuuauguua

SEQ ID NO: 611976 - RNA, 64 nt, Homo Sapiens
uugcaagcauuucuuguuacccaaaucuaaucuauuccugaaaauaugaugguuagcaaaguuu

SEQ ID NO: 611977 - RNA, 64 nt, Homo Sapiens
aggagauuuaauuguaaauaugaaagccaaaguauuccugaauggucaaauacagcaauaaagg

SEQ ID NO: 611978 - RNA, 64 nt, Homo Sapiens
caaauauuuuuuuaagggaacuauaaccuuaggauuccugaaaagaauuucaaaaaaaaaauaa

SEQ ID NO: 611979 - RNA, 64 nt, Homo Sapiens
aacuuggaaagauaacuagggcauuuuggagaguuuccugaaacccagccucccugaagccuuu

SEQ ID NO: 611980 - RNA, 64 nt, Homo Sapiens
accaguccccccacccucauauuucagacucccauuccugaagacugaugccugaguccuccca

SEQ ID NO: 611981 - RNA, 64 nt, Homo Sapiens
cucuauacuuguuuuaacauuuuuccccucacuguuccugaauguagacggaaacagaaauugc

SEQ ID NO: 611982 - RNA, 64 nt, Homo Sapiens
gggauuuagugcaaaaaguuuguuauuuauuuuguuccugaaauuucaguugugaauccuaugg

SEQ ID NO: 611983 - RNA, 64 nt, Homo Sapiens
uaauuaauugugcauuuaauaucaaucaucugauuuccugaaagucuguuaacuucccaccacc

SEQ ID NO: 611984 - RNA, 64 nt, Homo Sapiens
uuacucuucuacaauguggccggaucauuugucauuccugaauaggucuuucucucaaccugca

SEQ ID NO: 611985 - RNA, 64 nt, Homo Sapiens
uucuaagccuacagcaucuugauucauaguauaauuccugaaguaugcugaauggacuuuuuaa

SEQ ID NO: 611986 - RNA, 64 nt, Homo Sapiens
agauuuauugauuuggugaucaaaccugugcuauuuccugaauuucagcuaauggccaacugug

SEQ ID NO: 611987 - RNA, 64 nt, Homo Sapiens
cuccugagcgcccguucuugaguuuguuuacauuuuccugaacccaccccuuggauggguuccu

SEQ ID NO: 611988 - RNA, 64 nt, Homo Sapiens
acaggagcagaguacagucuguuagugacaguuauuccugaaauguggaaucggacagaggcag

SEQ ID NO: 611989 - RNA, 64 nt, Homo Sapiens
uccugaauuaccaacaucaacuucuuucucuccguuccugaaggaacuuuggggaaucaucuuc

SEQ ID NO: 611990 - RNA, 64 nt, Homo Sapiens
acuuuggggaaucaucuucauccguaguuacgcuuuccugaaccuucucagugguuuacaugcc

SEQ ID NO: 611991 - RNA, 64 nt, Homo Sapiens
ccagggccagagacaaggacuuaccaagaaugaguuccugaaacaccucaguggggaggcuucc

SEQ ID NO: 611992 - RNA, 64 nt, Homo Sapiens
gccaccaggcgcccaguguacccccguggaaccguuccugaaagggagccacacuggggccccc

SEQ ID NO: 611993 - RNA, 64 nt, Homo Sapiens
uugacaugccaguggguguggaacagaugccaucuuccugaaugugagguuuauggagccucca

SEQ ID NO: 611994 - RNA, 64 nt, Homo Sapiens
aucaacugugucuuaaggcuagcuacgggauuccuuccugaaaggcagauuucggaaauuggca

SEQ ID NO: 611995 - RNA, 64 nt, Homo Sapiens
ucucggaggcucgaggucuaagagaaacgcugaguuccugaagagccacagacaggguggguga

SEQ ID NO: 611996 - RNA, 64 nt, Homo Sapiens
ggaaagcucuccaacccaucuucuacagcacagcuuccugaacaggguauaaguaugcugagau

SEQ ID NO: 611997 - RNA, 64 nt, Homo Sapiens
cuguggcuacuuuugggaccuaagauaagugacuuuccugaaccuccaugaccuccucauaugu

SEQ ID NO: 611998 - RNA, 64 nt, Homo Sapiens
ucaggugccaucacugcucugccaugccuacucauuccugaauuacaucucacacacccagcuc

SEQ ID NO: 611999 - RNA, 64 nt, Homo Sapiens
ggaagcuguguguuggcgugacggguguuugauguuccugaaguggaacaugcagguauuuucu

SEQ ID NO: 612000 - RNA, 64 nt, Homo Sapiens
gauagccuacuaaugcuggccagccuuacuuuguuuccugaaguggaauuugagcugaauucca

SEQ ID NO: 612001 - RNA, 64 nt, Homo Sapiens
gagcagaaauuguucacuagacuucuucagaaccuuccugaaauuguuuauucugacggaguuc

SEQ ID NO: 612002 - RNA, 64 nt, Homo Sapiens
ugggauuuuuguugauaauuuuuagaagcaaauuuuccugaaaguuuugaguagaggugagacc

SEQ ID NO: 612003 - RNA, 64 nt, Homo Sapiens
aaagaggcaaaaauuaaaagcuuggagagauaguuuccugaauagaauuugaagcagucugaau

SEQ ID NO: 612004 - RNA, 64 nt, Homo Sapiens; identical to SEQ ID NO: 418746

SEQ ID NO: 612005 - RNA, 64 nt, Homo Sapiens; identical to SEQ ID NO: 418747

SEQ ID NO: 612006 - RNA, 64 nt, Homo Sapiens; identical to SEQ ID NO: 418748

SEQ ID NO: 612007 - RNA, 64 nt, Homo Sapiens; identical to SEQ ID NO: 418749

SEQ ID NO: 612008 - RNA, 64 nt, Homo Sapiens; identical to SEQ ID NO: 418750

SEQ ID NO: 612009 - RNA, 64 nt, Homo Sapiens; identical to SEQ ID NO: 418751

SEQ ID NO: 612010 - RNA, 64 nt, Homo Sapiens; identical to SEQ ID NO: 418752

SEQ ID NO: 612011 - RNA, 64 nt, Homo Sapiens; identical to SEQ ID NO: 418753

SEQ ID NO: 612012 - RNA, 64 nt, Homo Sapiens; identical to SEQ ID NO: 418754

SEQ ID NO: 612013 - RNA, 64 nt, Homo Sapiens; identical to SEQ ID NO: 418755

SEQ ID NO: 612014 - RNA, 64 nt, Homo Sapiens; identical to SEQ ID NO: 418756

SEQ ID NO: 612015 - RNA, 64 nt, Homo Sapiens; identical to SEQ ID NO: 418757

SEQ ID NO: 612016 - RNA, 64 nt, Homo Sapiens; identical to SEQ ID NO: 418758

SEQ ID NO: 612017 - RNA, 64 nt, Homo Sapiens; identical to SEQ ID NO: 418759

SEQ ID NO: 612018 - RNA, 64 nt, Homo Sapiens; identical to SEQ ID NO: 418760

SEQ ID NO: 612019 - RNA, 64 nt, Homo Sapiens; identical to SEQ ID NO: 418761

SEQ ID NO: 612020 - RNA, 64 nt, Homo Sapiens; identical to SEQ ID NO: 418762

SEQ ID NO: 612021 - RNA, 64 nt, Homo Sapiens; identical to SEQ ID NO: 418763

SEQ ID NO: 612022 - RNA, 64 nt, Homo Sapiens; identical to SEQ ID NO: 418764

SEQ ID NO: 612023 - RNA, 64 nt, Homo Sapiens; identical to SEQ ID NO: 418765

SEQ ID NO: 612024 - RNA, 64 nt, Homo Sapiens; identical to SEQ ID NO: 418766

SEQ ID NO: 612025 - RNA, 64 nt, Homo Sapiens; identical to SEQ ID NO: 418767

SEQ ID NO: 612026 - RNA, 64 nt, Homo Sapiens; identical to SEQ ID NO: 418768

SEQ ID NO: 612027 - RNA, 64 nt, Homo Sapiens; identical to SEQ ID NO: 418769

SEQ ID NO: 612028 - RNA, 64 nt, Homo Sapiens; identical to SEQ ID NO: 418770

SEQ ID NO: 612029 - RNA, 64 nt, Homo Sapiens; identical to SEQ ID NO: 418771

SEQ ID NO: 612030 - RNA, 64 nt, Homo Sapiens; identical to SEQ ID NO: 418772

SEQ ID NO: 612031 - RNA, 64 nt, Homo Sapiens; identical to SEQ ID NO: 418773

SEQ ID NO: 612032 - RNA, 64 nt, Homo Sapiens; identical to SEQ ID NO: 418774

SEQ ID NO: 612033 - RNA, 64 nt, Homo Sapiens; identical to SEQ ID NO: 418775

SEQ ID NO: 612034 - RNA, 64 nt, Homo Sapiens; identical to SEQ ID NO: 418776

SEQ ID NO: 612035 - RNA, 64 nt, Homo Sapiens; identical to SEQ ID NO: 418777

SEQ ID NO: 612036 - RNA, 64 nt, Homo Sapiens; identical to SEQ ID NO: 418778

SEQ ID NO: 612037 - RNA, 64 nt, Homo Sapiens; identical to SEQ ID NO: 418779

SEQ ID NO: 612038 - RNA, 64 nt, Homo Sapiens; identical to SEQ ID NO: 418780

SEQ ID NO: 612039 - RNA, 64 nt, Homo Sapiens; identical to SEQ ID NO: 418781

SEQ ID NO: 612040 - RNA, 64 nt, Homo Sapiens; identical to SEQ ID NO: 418782

SEQ ID NO: 612041 - RNA, 64 nt, Homo Sapiens; identical to SEQ ID NO: 418783

SEQ ID NO: 612042 - RNA, 64 nt, Homo Sapiens; identical to SEQ ID NO: 418784

SEQ ID NO: 612043 - RNA, 64 nt, Homo Sapiens; identical to SEQ ID NO: 418785

SEQ ID NO: 612044 - RNA, 64 nt, Homo Sapiens; identical to SEQ ID NO: 418786

SEQ ID NO: 612045 - RNA, 64 nt, Homo Sapiens; identical to SEQ ID NO: 418787

SEQ ID NO: 612046 - RNA, 64 nt, Homo Sapiens; identical to SEQ ID NO: 418788

SEQ ID NO: 612047 - RNA, 64 nt, Homo Sapiens; identical to SEQ ID NO: 418789

SEQ ID NO: 612048 - RNA, 64 nt, Homo Sapiens; identical to SEQ ID NO: 418790

SEQ ID NO: 612049 - RNA, 64 nt, Homo Sapiens; identical to SEQ ID NO: 418791

SEQ ID NO: 612050 - RNA, 64 nt, Homo Sapiens; identical to SEQ ID NO: 418792

SEQ ID NO: 612051 - RNA, 64 nt, Homo Sapiens; identical to SEQ ID NO: 418793

SEQ ID NO: 612052 - RNA, 64 nt, Homo Sapiens; identical to SEQ ID NO: 418794

SEQ ID NO: 612053 - RNA, 64 nt, Homo Sapiens; identical to SEQ ID NO: 418795

SEQ ID NO: 612054 - RNA, 64 nt, Homo Sapiens; identical to SEQ ID NO: 418796

SEQ ID NO: 612055 - RNA, 64 nt, Homo Sapiens; identical to SEQ ID NO: 418797

SEQ ID NO: 612056 - RNA, 64 nt, Homo Sapiens; identical to SEQ ID NO: 418798

SEQ ID NO: 612057 - RNA, 64 nt, Homo Sapiens; identical to SEQ ID NO: 418799

SEQ ID NO: 612058 - RNA, 64 nt, Homo Sapiens; identical to SEQ ID NO: 418800

SEQ ID NO: 612059 - RNA, 64 nt, Homo Sapiens; identical to SEQ ID NO: 102210

SEQ ID NO: 612060 - RNA, 64 nt, Homo Sapiens; identical to SEQ ID NO: 102211

SEQ ID NO: 612061 - RNA, 64 nt, Homo Sapiens; identical to SEQ ID NO: 102212

SEQ ID NO: 612062 - RNA, 64 nt, Homo Sapiens; identical to SEQ ID NO: 102213

SEQ ID NO: 612063 - RNA, 64 nt, Homo Sapiens; identical to SEQ ID NO: 102214

SEQ ID NO: 612064 - RNA, 64 nt, Homo Sapiens; identical to SEQ ID NO: 102215

SEQ ID NO: 612065 - RNA, 64 nt, Homo Sapiens; identical to SEQ ID NO: 102216

SEQ ID NO: 612066 - RNA, 64 nt, Homo Sapiens; identical to SEQ ID NO: 102217

SEQ ID NO: 612067 - RNA, 64 nt, Homo Sapiens; identical to SEQ ID NO: 102218

SEQ ID NO: 612068 - RNA, 64 nt, Homo Sapiens; identical to SEQ ID NO: 102219

SEQ ID NO: 612069 - RNA, 64 nt, Homo Sapiens; identical to SEQ ID NO: 102220

SEQ ID NO: 612070 - RNA, 64 nt, Homo Sapiens; identical to SEQ ID NO: 102221

SEQ ID NO: 612071 - RNA, 64 nt, Homo Sapiens; identical to SEQ ID NO: 102222

SEQ ID NO: 612072 - RNA, 64 nt, Homo Sapiens; identical to SEQ ID NO: 102223

SEQ ID NO: 612073 - RNA, 64 nt, Homo Sapiens; identical to SEQ ID NO: 102224

SEQ ID NO: 612074 - RNA, 64 nt, Homo Sapiens; identical to SEQ ID NO: 102225

SEQ ID NO: 612075 - RNA, 64 nt, Homo Sapiens; identical to SEQ ID NO: 102226

SEQ ID NO: 612076 - RNA, 64 nt, Homo Sapiens; identical to SEQ ID NO: 102227

SEQ ID NO: 612077 - RNA, 64 nt, Homo Sapiens; identical to SEQ ID NO: 102228

SEQ ID NO: 612078 - RNA, 64 nt, Homo Sapiens; identical to SEQ ID NO: 102229

SEQ ID NO: 612079 - RNA, 64 nt, Homo Sapiens; identical to SEQ ID NO: 102230

SEQ ID NO: 612080 - RNA, 64 nt, Homo Sapiens; identical to SEQ ID NO: 102231

SEQ ID NO: 612081 - RNA, 64 nt, Homo Sapiens; identical to SEQ ID NO: 102232

SEQ ID NO: 612082 - RNA, 64 nt, Homo Sapiens; identical to SEQ ID NO: 102233

SEQ ID NO: 612083 - RNA, 64 nt, Homo Sapiens; identical to SEQ ID NO: 102234

SEQ ID NO: 612084 - RNA, 64 nt, Homo Sapiens; identical to SEQ ID NO: 102235

SEQ ID NO: 612085 - RNA, 64 nt, Homo Sapiens; identical to SEQ ID NO: 102236

SEQ ID NO: 612086 - RNA, 64 nt, Homo Sapiens; identical to SEQ ID NO: 102237

SEQ ID NO: 612087 - RNA, 64 nt, Homo Sapiens; identical to SEQ ID NO: 102238

SEQ ID NO: 612088 - RNA, 64 nt, Homo Sapiens; identical to SEQ ID NO: 102239

SEQ ID NO: 612089 - RNA, 64 nt, Homo Sapiens; identical to SEQ ID NO: 102240

SEQ ID NO: 612090 - RNA, 64 nt, Homo Sapiens; identical to SEQ ID NO: 102241

SEQ ID NO: 612091 - RNA, 64 nt, Homo Sapiens; identical to SEQ ID NO: 102242

SEQ ID NO: 612092 - RNA, 64 nt, Homo Sapiens; identical to SEQ ID NO: 589102

SEQ ID NO: 612093 - RNA, 64 nt, Homo Sapiens; identical to SEQ ID NO: 589103

SEQ ID NO: 612094 - RNA, 64 nt, Homo Sapiens; identical to SEQ ID NO: 589104

SEQ ID NO: 612095 - RNA, 64 nt, Homo Sapiens; identical to SEQ ID NO: 589105

SEQ ID NO: 612096 - RNA, 64 nt, Homo Sapiens; identical to SEQ ID NO: 589106

SEQ ID NO: 612097 - RNA, 64 nt, Homo Sapiens; identical to SEQ ID NO: 589107

SEQ ID NO: 612098 - RNA, 64 nt, Homo Sapiens; identical to SEQ ID NO: 589108

SEQ ID NO: 612099 - RNA, 64 nt, Homo Sapiens; identical to SEQ ID NO: 589109

SEQ ID NO: 612100 - RNA, 64 nt, Homo Sapiens; identical to SEQ ID NO: 589110

SEQ ID NO: 612101 - RNA, 64 nt, Homo Sapiens; identical to SEQ ID NO: 589111

SEQ ID NO: 612102 - RNA, 64 nt, Homo Sapiens; identical to SEQ ID NO: 589112

SEQ ID NO: 612103 - RNA, 64 nt, Homo Sapiens; identical to SEQ ID NO: 589113

SEQ ID NO: 612104 - RNA, 64 nt, Homo Sapiens; identical to SEQ ID NO: 589114

SEQ ID NO: 612105 - RNA, 64 nt, Homo Sapiens; identical to SEQ ID NO: 589115

SEQ ID NO: 612106 - RNA, 64 nt, Homo Sapiens; identical to SEQ ID NO: 589116

SEQ ID NO: 612107 - RNA, 64 nt, Homo Sapiens; identical to SEQ ID NO: 589117

SEQ ID NO: 612108 - RNA, 64 nt, Homo Sapiens; identical to SEQ ID NO: 589118

SEQ ID NO: 612109 - RNA, 64 nt, Homo Sapiens; identical to SEQ ID NO: 589119

SEQ ID NO: 612110 - RNA, 64 nt, Homo Sapiens; identical to SEQ ID NO: 589120

SEQ ID NO: 612111 - RNA, 64 nt, Homo Sapiens; identical to SEQ ID NO: 537458

SEQ ID NO: 612112 - RNA, 64 nt, Homo Sapiens; identical to SEQ ID NO: 537459

SEQ ID NO: 612113 - RNA, 64 nt, Homo Sapiens; identical to SEQ ID NO: 537460

SEQ ID NO: 612114 - RNA, 64 nt, Homo Sapiens; identical to SEQ ID NO: 537461

SEQ ID NO: 612115 - RNA, 64 nt, Homo Sapiens; identical to SEQ ID NO: 537462

SEQ ID NO: 612116 - RNA, 64 nt, Homo Sapiens; identical to SEQ ID NO: 537463

SEQ ID NO: 612117 - RNA, 64 nt, Homo Sapiens; identical to SEQ ID NO: 537464

SEQ ID NO: 612118 - RNA, 64 nt, Homo Sapiens; identical to SEQ ID NO: 537465

SEQ ID NO: 612119 - RNA, 64 nt, Homo Sapiens; identical to SEQ ID NO: 537466

SEQ ID NO: 612120 - RNA, 64 nt, Homo Sapiens; identical to SEQ ID NO: 537467

SEQ ID NO: 612121 - RNA, 64 nt, Homo Sapiens; identical to SEQ ID NO: 537468

SEQ ID NO: 612122 - RNA, 64 nt, Homo Sapiens; identical to SEQ ID NO: 537469

SEQ ID NO: 612123 - RNA, 64 nt, Homo Sapiens; identical to SEQ ID NO: 537470

SEQ ID NO: 612124 - RNA, 64 nt, Homo Sapiens; identical to SEQ ID NO: 537471

SEQ ID NO: 612125 - RNA, 64 nt, Homo Sapiens; identical to SEQ ID NO: 22294

SEQ ID NO: 612126 - RNA, 64 nt, Homo Sapiens; identical to SEQ ID NO: 22295

SEQ ID NO: 612127 - RNA, 64 nt, Homo Sapiens; identical to SEQ ID NO: 22296

SEQ ID NO: 612128 - RNA, 64 nt, Homo Sapiens; identical to SEQ ID NO: 22297

SEQ ID NO: 612129 - RNA, 64 nt, Homo Sapiens; identical to SEQ ID NO: 22298

SEQ ID NO: 612130 - RNA, 64 nt, Homo Sapiens; identical to SEQ ID NO: 22299

SEQ ID NO: 612131 - RNA, 64 nt, Homo Sapiens; identical to SEQ ID NO: 22300

SEQ ID NO: 612132 - RNA, 64 nt, Homo Sapiens; identical to SEQ ID NO: 22301

SEQ ID NO: 612133 - RNA, 64 nt, Homo Sapiens; identical to SEQ ID NO: 22302

SEQ ID NO: 612134 - RNA, 64 nt, Homo Sapiens; identical to SEQ ID NO: 22303

SEQ ID NO: 612135 - RNA, 64 nt, Homo Sapiens; identical to SEQ ID NO: 22304

SEQ ID NO: 612136 - RNA, 64 nt, Homo Sapiens; identical to SEQ ID NO: 22305

SEQ ID NO: 612137 - RNA, 64 nt, Homo Sapiens; identical to SEQ ID NO: 22306

SEQ ID NO: 612138 - RNA, 64 nt, Homo Sapiens; identical to SEQ ID NO: 22307

SEQ ID NO: 612139 - RNA, 64 nt, Homo Sapiens; identical to SEQ ID NO: 22308

SEQ ID NO: 612140 - RNA, 64 nt, Homo Sapiens; identical to SEQ ID NO: 22309

SEQ ID NO: 612141 - RNA, 64 nt, Homo Sapiens; identical to SEQ ID NO: 22310

SEQ ID NO: 612142 - RNA, 64 nt, Homo Sapiens; identical to SEQ ID NO: 22311

SEQ ID NO: 612143 - RNA, 64 nt, Homo Sapiens; identical to SEQ ID NO: 22312

SEQ ID NO: 612144 - RNA, 64 nt, Homo Sapiens; identical to SEQ ID NO: 22313

SEQ ID NO: 612145 - RNA, 64 nt, Homo Sapiens; identical to SEQ ID NO: 22314

SEQ ID NO: 612146 - RNA, 64 nt, Homo Sapiens; identical to SEQ ID NO: 22315

SEQ ID NO: 612147 - RNA, 64 nt, Homo Sapiens; identical to SEQ ID NO: 22316

SEQ ID NO: 612148 - RNA, 64 nt, Homo Sapiens; identical to SEQ ID NO: 22317

SEQ ID NO: 612149 - RNA, 64 nt, Homo Sapiens; identical to SEQ ID NO: 22318

SEQ ID NO: 612150 - RNA, 64 nt, Homo Sapiens; identical to SEQ ID NO: 22319

SEQ ID NO: 612151 - RNA, 64 nt, Homo Sapiens; identical to SEQ ID NO: 22320

SEQ ID NO: 612152 - RNA, 64 nt, Homo Sapiens; identical to SEQ ID NO: 22321

SEQ ID NO: 612153 - RNA, 64 nt, Homo Sapiens; identical to SEQ ID NO: 22322

SEQ ID NO: 612154 - RNA, 64 nt, Homo Sapiens; identical to SEQ ID NO: 22323

SEQ ID NO: 612155 - RNA, 64 nt, Homo Sapiens; identical to SEQ ID NO: 22324

SEQ ID NO: 612156 - RNA, 64 nt, Homo Sapiens; identical to SEQ ID NO: 22325

SEQ ID NO: 612157 - RNA, 64 nt, Homo Sapiens; identical to SEQ ID NO: 22326

SEQ ID NO: 612158 - RNA, 64 nt, Homo Sapiens; identical to SEQ ID NO: 22327

SEQ ID NO: 612159 - RNA, 64 nt, Homo Sapiens; identical to SEQ ID NO: 22328

SEQ ID NO: 612160 - RNA, 64 nt, Homo Sapiens; identical to SEQ ID NO: 22329

SEQ ID NO: 612161 - RNA, 64 nt, Homo Sapiens; identical to SEQ ID NO: 22330

SEQ ID NO: 612162 - RNA, 64 nt, Homo Sapiens; identical to SEQ ID NO: 22331

SEQ ID NO: 612163 - RNA, 64 nt, Homo Sapiens; identical to SEQ ID NO: 22332

SEQ ID NO: 612164 - RNA, 64 nt, Homo Sapiens; identical to SEQ ID NO: 22333

SEQ ID NO: 612165 - RNA, 64 nt, Homo Sapiens; identical to SEQ ID NO: 22334

SEQ ID NO: 612166 - RNA, 64 nt, Homo Sapiens; identical to SEQ ID NO: 22335

SEQ ID NO: 612167 - RNA, 64 nt, Homo Sapiens; identical to SEQ ID NO: 22336

SEQ ID NO: 612168 - RNA, 64 nt, Homo Sapiens; identical to SEQ ID NO: 22337

SEQ ID NO: 612169 - RNA, 64 nt, Homo Sapiens; identical to SEQ ID NO: 22338

SEQ ID NO: 612170 - RNA, 64 nt, Homo Sapiens; identical to SEQ ID NO: 22339

SEQ ID NO: 612171 - RNA, 64 nt, Homo Sapiens; identical to SEQ ID NO: 22340

SEQ ID NO: 612172 - RNA, 64 nt, Homo Sapiens; identical to SEQ ID NO: 22341

SEQ ID NO: 612173 - RNA, 64 nt, Homo Sapiens; identical to SEQ ID NO: 22342

SEQ ID NO: 612174 - RNA, 64 nt, Homo Sapiens; identical to SEQ ID NO: 22343

SEQ ID NO: 612175 - RNA, 64 nt, Homo Sapiens; identical to SEQ ID NO: 22344

SEQ ID NO: 612176 - RNA, 64 nt, Homo Sapiens; identical to SEQ ID NO: 22345

SEQ ID NO: 612177 - RNA, 64 nt, Homo Sapiens; identical to SEQ ID NO: 22346

SEQ ID NO: 612178 - RNA, 64 nt, Homo Sapiens; identical to SEQ ID NO: 22347

SEQ ID NO: 612179 - RNA, 64 nt, Homo Sapiens; identical to SEQ ID NO: 22348

SEQ ID NO: 612180 - RNA, 64 nt, Homo Sapiens; identical to SEQ ID NO: 22349

SEQ ID NO: 612181 - RNA, 64 nt, Homo Sapiens; identical to SEQ ID NO: 22350

SEQ ID NO: 612182 - RNA, 64 nt, Homo Sapiens; identical to SEQ ID NO: 22351

SEQ ID NO: 612183 - RNA, 64 nt, Homo Sapiens; identical to SEQ ID NO: 22352

SEQ ID NO: 612184 - RNA, 64 nt, Homo Sapiens; identical to SEQ ID NO: 22353

SEQ ID NO: 612185 - RNA, 64 nt, Homo Sapiens; identical to SEQ ID NO: 22354

SEQ ID NO: 612186 - RNA, 64 nt, Homo Sapiens; identical to SEQ ID NO: 22355

SEQ ID NO: 612187 - RNA, 64 nt, Homo Sapiens; identical to SEQ ID NO: 22356

SEQ ID NO: 612188 - RNA, 64 nt, Homo Sapiens; identical to SEQ ID NO: 22357

SEQ ID NO: 612189 - RNA, 64 nt, Homo Sapiens; identical to SEQ ID NO: 22358

SEQ ID NO: 612190 - RNA, 64 nt, Homo Sapiens; identical to SEQ ID NO: 22359

SEQ ID NO: 612191 - RNA, 64 nt, Homo Sapiens; identical to SEQ ID NO: 22360

SEQ ID NO: 612192 - RNA, 64 nt, Homo Sapiens; identical to SEQ ID NO: 22361

SEQ ID NO: 612193 - RNA, 64 nt, Homo Sapiens; identical to SEQ ID NO: 22362

SEQ ID NO: 612194 - RNA, 64 nt, Homo Sapiens; identical to SEQ ID NO: 22363

SEQ ID NO: 612195 - RNA, 64 nt, Homo Sapiens; identical to SEQ ID NO: 22364

SEQ ID NO: 612196 - RNA, 64 nt, Homo Sapiens; identical to SEQ ID NO: 22365

SEQ ID NO: 612197 - RNA, 64 nt, Homo Sapiens; identical to SEQ ID NO: 22366

SEQ ID NO: 612198 - RNA, 64 nt, Homo Sapiens; identical to SEQ ID NO: 22367

SEQ ID NO: 612199 - RNA, 64 nt, Homo Sapiens; identical to SEQ ID NO: 22368

SEQ ID NO: 612200 - RNA, 64 nt, Homo Sapiens; identical to SEQ ID NO: 22369

SEQ ID NO: 612201 - RNA, 64 nt, Homo Sapiens; identical to SEQ ID NO: 22370

SEQ ID NO: 612202 - RNA, 64 nt, Homo Sapiens; identical to SEQ ID NO: 22371

SEQ ID NO: 612203 - RNA, 64 nt, Homo Sapiens; identical to SEQ ID NO: 22372

SEQ ID NO: 612204 - RNA, 64 nt, Homo Sapiens; identical to SEQ ID NO: 22373

SEQ ID NO: 612205 - RNA, 64 nt, Homo Sapiens; identical to SEQ ID NO: 22374

SEQ ID NO: 612206 - RNA, 64 nt, Homo Sapiens; identical to SEQ ID NO: 22375

SEQ ID NO: 612207 - RNA, 64 nt, Homo Sapiens; identical to SEQ ID NO: 22376

SEQ ID NO: 612208 - RNA, 64 nt, Homo Sapiens; identical to SEQ ID NO: 22377

SEQ ID NO: 612209 - RNA, 64 nt, Homo Sapiens; identical to SEQ ID NO: 22378

SEQ ID NO: 612210 - RNA, 64 nt, Homo Sapiens; identical to SEQ ID NO: 22379

SEQ ID NO: 612211 - RNA, 64 nt, Homo Sapiens; identical to SEQ ID NO: 22380

SEQ ID NO: 612212 - RNA, 64 nt, Homo Sapiens; identical to SEQ ID NO: 22381

SEQ ID NO: 612213 - RNA, 64 nt, Homo Sapiens; identical to SEQ ID NO: 22382

SEQ ID NO: 612214 - RNA, 64 nt, Homo Sapiens; identical to SEQ ID NO: 22383

SEQ ID NO: 612215 - RNA, 64 nt, Homo Sapiens; identical to SEQ ID NO: 22384

SEQ ID NO: 612216 - RNA, 64 nt, Homo Sapiens; identical to SEQ ID NO: 22385

SEQ ID NO: 612217 - RNA, 64 nt, Homo Sapiens; identical to SEQ ID NO: 22386

SEQ ID NO: 612218 - RNA, 64 nt, Homo Sapiens; identical to SEQ ID NO: 22387

SEQ ID NO: 612219 - RNA, 64 nt, Homo Sapiens; identical to SEQ ID NO: 22388

SEQ ID NO: 612220 - RNA, 64 nt, Homo Sapiens; identical to SEQ ID NO: 22389

SEQ ID NO: 612221 - RNA, 64 nt, Homo Sapiens; identical to SEQ ID NO: 22390

SEQ ID NO: 612222 - RNA, 64 nt, Homo Sapiens; identical to SEQ ID NO: 22391

SEQ ID NO: 612223 - RNA, 64 nt, Homo Sapiens
guuaauaaucauguuauguucugucaaguuaauaucugucaacaaaguuuauuuuuaauaguau

SEQ ID NO: 612224 - RNA, 64 nt, Homo Sapiens
uaauaucugucaacaguuaauauuuuuaauaguaucugucaaguaaugugagguaaaauaaguu

SEQ ID NO: 612225 - RNA, 64 nt, Homo Sapiens
uuuucuccucuuaaauguuacaaaacuacugucuucugucaaaguuaacaucaagcgcgcaguu

SEQ ID NO: 612226 - RNA, 64 nt, Homo Sapiens
accaugcccaugagauguuucccauuaggaauuuucugucaacuuccuuagucuguuaguuaaa

SEQ ID NO: 612227 - RNA, 64 nt, Homo Sapiens
uaguaugguaucaguuaauuccagucugagcuucucugucaacuucaguuucucucucaguuua

SEQ ID NO: 612228 - RNA, 64 nt, Homo Sapiens
ccuuuuauauucucuuuccauaaauacguugauuucugucaauaaaauuuuugugucuuaggau

SEQ ID NO: 612229 - RNA, 64 nt, Homo Sapiens
uacucuuauacccagaaaagaacauauuucagaaucugucaaacuuuuguguaucccacagauu

SEQ ID NO: 612230 - RNA, 64 nt, Homo Sapiens
ugcagcuauuugagggacuaagggauggagauauucugucaaaugaaucucuucaguauaccag

SEQ ID NO: 612231 - RNA, 64 nt, Homo Sapiens; identical to SEQ ID NO: 377221

SEQ ID NO: 612232 - RNA, 64 nt, Homo Sapiens; identical to SEQ ID NO: 377222

SEQ ID NO: 612233 - RNA, 64 nt, Homo Sapiens; identical to SEQ ID NO: 377223

SEQ ID NO: 612234 - RNA, 64 nt, Homo Sapiens; identical to SEQ ID NO: 377224

SEQ ID NO: 612235 - RNA, 64 nt, Homo Sapiens; identical to SEQ ID NO: 377225

SEQ ID NO: 612236 - RNA, 64 nt, Homo Sapiens; identical to SEQ ID NO: 377226

SEQ ID NO: 612237 - RNA, 64 nt, Homo Sapiens; identical to SEQ ID NO: 377227

SEQ ID NO: 612238 - RNA, 64 nt, Homo Sapiens; identical to SEQ ID NO: 377228

SEQ ID NO: 612239 - RNA, 64 nt, Homo Sapiens; identical to SEQ ID NO: 377229

SEQ ID NO: 612240 - RNA, 64 nt, Homo Sapiens; identical to SEQ ID NO: 377230

SEQ ID NO: 612241 - RNA, 64 nt, Homo Sapiens; identical to SEQ ID NO: 377231

SEQ ID NO: 612242 - RNA, 64 nt, Homo Sapiens; identical to SEQ ID NO: 377232

SEQ ID NO: 612243 - RNA, 64 nt, Homo Sapiens; identical to SEQ ID NO: 377233

SEQ ID NO: 612244 - RNA, 64 nt, Homo Sapiens; identical to SEQ ID NO: 377234

SEQ ID NO: 612245 - RNA, 64 nt, Homo Sapiens; identical to SEQ ID NO: 377235

SEQ ID NO: 612246 - RNA, 64 nt, Homo Sapiens; identical to SEQ ID NO: 377236

SEQ ID NO: 612247 - RNA, 64 nt, Homo Sapiens; identical to SEQ ID NO: 377237

SEQ ID NO: 612248 - RNA, 64 nt, Homo Sapiens; identical to SEQ ID NO: 377238

SEQ ID NO: 612249 - RNA, 64 nt, Homo Sapiens; identical to SEQ ID NO: 377239

SEQ ID NO: 612250 - RNA, 64 nt, Homo Sapiens; identical to SEQ ID NO: 377240

SEQ ID NO: 612251 - RNA, 64 nt, Homo Sapiens; identical to SEQ ID NO: 377241

SEQ ID NO: 612252 - RNA, 64 nt, Homo Sapiens; identical to SEQ ID NO: 377242

SEQ ID NO: 612253 - RNA, 64 nt, Homo Sapiens; identical to SEQ ID NO: 377243

SEQ ID NO: 612254 - RNA, 64 nt, Homo Sapiens; identical to SEQ ID NO: 377244

SEQ ID NO: 612255 - RNA, 64 nt, Homo Sapiens; identical to SEQ ID NO: 377245

SEQ ID NO: 612256 - RNA, 64 nt, Homo Sapiens; identical to SEQ ID NO: 377246

SEQ ID NO: 612257 - RNA, 64 nt, Homo Sapiens; identical to SEQ ID NO: 377247

SEQ ID NO: 612258 - RNA, 64 nt, Homo Sapiens; identical to SEQ ID NO: 377248

SEQ ID NO: 612259 - RNA, 64 nt, Homo Sapiens; identical to SEQ ID NO: 377249

SEQ ID NO: 612260 - RNA, 64 nt, Homo Sapiens; identical to SEQ ID NO: 377250

SEQ ID NO: 612261 - RNA, 64 nt, Homo Sapiens; identical to SEQ ID NO: 377251

SEQ ID NO: 612262 - RNA, 64 nt, Homo Sapiens; identical to SEQ ID NO: 377252

SEQ ID NO: 612263 - RNA, 64 nt, Homo Sapiens; identical to SEQ ID NO: 377253

SEQ ID NO: 612264 - RNA, 64 nt, Homo Sapiens; identical to SEQ ID NO: 377254

SEQ ID NO: 612265 - RNA, 64 nt, Homo Sapiens; identical to SEQ ID NO: 377255

SEQ ID NO: 612266 - RNA, 64 nt, Homo Sapiens; identical to SEQ ID NO: 377256

SEQ ID NO: 612267 - RNA, 64 nt, Homo Sapiens; identical to SEQ ID NO: 377257

SEQ ID NO: 612268 - RNA, 64 nt, Homo Sapiens; identical to SEQ ID NO: 377258

SEQ ID NO: 612269 - RNA, 64 nt, Homo Sapiens; identical to SEQ ID NO: 377259

SEQ ID NO: 612270 - RNA, 64 nt, Homo Sapiens; identical to SEQ ID NO: 377260

SEQ ID NO: 612271 - RNA, 64 nt, Homo Sapiens; identical to SEQ ID NO: 377261

SEQ ID NO: 612272 - RNA, 64 nt, Homo Sapiens; identical to SEQ ID NO: 377262

SEQ ID NO: 612273 - RNA, 64 nt, Homo Sapiens; identical to SEQ ID NO: 377263

SEQ ID NO: 612274 - RNA, 64 nt, Homo Sapiens; identical to SEQ ID NO: 377264

SEQ ID NO: 612275 - RNA, 64 nt, Homo Sapiens; identical to SEQ ID NO: 377265

SEQ ID NO: 612276 - RNA, 64 nt, Homo Sapiens; identical to SEQ ID NO: 377266

SEQ ID NO: 612277 - RNA, 64 nt, Homo Sapiens; identical to SEQ ID NO: 377267

SEQ ID NO: 612278 - RNA, 64 nt, Homo Sapiens; identical to SEQ ID NO: 377268

SEQ ID NO: 612279 - RNA, 64 nt, Homo Sapiens; identical to SEQ ID NO: 377269

SEQ ID NO: 612280 - RNA, 64 nt, Homo Sapiens; identical to SEQ ID NO: 377270

SEQ ID NO: 612281 - RNA, 64 nt, Homo Sapiens; identical to SEQ ID NO: 377271

SEQ ID NO: 612282 - RNA, 64 nt, Homo Sapiens; identical to SEQ ID NO: 377272

SEQ ID NO: 612283 - RNA, 64 nt, Homo Sapiens; identical to SEQ ID NO: 377273

SEQ ID NO: 612284 - RNA, 64 nt, Homo Sapiens; identical to SEQ ID NO: 377274

SEQ ID NO: 612285 - RNA, 64 nt, Homo Sapiens; identical to SEQ ID NO: 377275

SEQ ID NO: 612286 - RNA, 64 nt, Homo Sapiens; identical to SEQ ID NO: 377276

SEQ ID NO: 612287 - RNA, 64 nt, Homo Sapiens; identical to SEQ ID NO: 377277

SEQ ID NO: 612288 - RNA, 64 nt, Homo Sapiens; identical to SEQ ID NO: 377278

SEQ ID NO: 612289 - RNA, 64 nt, Homo Sapiens; identical to SEQ ID NO: 377279

SEQ ID NO: 612290 - RNA, 64 nt, Homo Sapiens; identical to SEQ ID NO: 377280

SEQ ID NO: 612291 - RNA, 64 nt, Homo Sapiens; identical to SEQ ID NO: 377281

SEQ ID NO: 612292 - RNA, 64 nt, Homo Sapiens; identical to SEQ ID NO: 377282

SEQ ID NO: 612293 - RNA, 64 nt, Homo Sapiens; identical to SEQ ID NO: 377283

SEQ ID NO: 612294 - RNA, 64 nt, Homo Sapiens; identical to SEQ ID NO: 377284

SEQ ID NO: 612295 - RNA, 64 nt, Homo Sapiens; identical to SEQ ID NO: 377285

SEQ ID NO: 612296 - RNA, 64 nt, Homo Sapiens; identical to SEQ ID NO: 377286

SEQ ID NO: 612297 - RNA, 64 nt, Homo Sapiens; identical to SEQ ID NO: 377287

SEQ ID NO: 612298 - RNA, 64 nt, Homo Sapiens; identical to SEQ ID NO: 377288

SEQ ID NO: 612299 - RNA, 64 nt, Homo Sapiens; identical to SEQ ID NO: 377289

SEQ ID NO: 612300 - RNA, 64 nt, Homo Sapiens; identical to SEQ ID NO: 377290

SEQ ID NO: 612301 - RNA, 64 nt, Homo Sapiens; identical to SEQ ID NO: 377291

SEQ ID NO: 612302 - RNA, 64 nt, Homo Sapiens; identical to SEQ ID NO: 377292

SEQ ID NO: 612303 - RNA, 64 nt, Homo Sapiens; identical to SEQ ID NO: 377293

SEQ ID NO: 612304 - RNA, 64 nt, Homo Sapiens; identical to SEQ ID NO: 377294

SEQ ID NO: 612305 - RNA, 64 nt, Homo Sapiens; identical to SEQ ID NO: 377295

SEQ ID NO: 612306 - RNA, 64 nt, Homo Sapiens; identical to SEQ ID NO: 377296

SEQ ID NO: 612307 - RNA, 64 nt, Homo Sapiens; identical to SEQ ID NO: 377297

SEQ ID NO: 612308 - RNA, 64 nt, Homo Sapiens; identical to SEQ ID NO: 377298

SEQ ID NO: 612309 - RNA, 64 nt, Homo Sapiens; identical to SEQ ID NO: 299149

SEQ ID NO: 612310 - RNA, 64 nt, Homo Sapiens; identical to SEQ ID NO: 299150

SEQ ID NO: 612311 - RNA, 64 nt, Homo Sapiens; identical to SEQ ID NO: 299151

SEQ ID NO: 612312 - RNA, 64 nt, Homo Sapiens; identical to SEQ ID NO: 299152

SEQ ID NO: 612313 - RNA, 64 nt, Homo Sapiens; identical to SEQ ID NO: 299153

SEQ ID NO: 612314 - RNA, 64 nt, Homo Sapiens; identical to SEQ ID NO: 299154

SEQ ID NO: 612315 - RNA, 64 nt, Homo Sapiens; identical to SEQ ID NO: 299155

SEQ ID NO: 612316 - RNA, 64 nt, Homo Sapiens; identical to SEQ ID NO: 299156

SEQ ID NO: 612317 - RNA, 64 nt, Homo Sapiens; identical to SEQ ID NO: 299157

SEQ ID NO: 612318 - RNA, 64 nt, Homo Sapiens; identical to SEQ ID NO: 299158

SEQ ID NO: 612319 - RNA, 64 nt, Homo Sapiens; identical to SEQ ID NO: 299159

SEQ ID NO: 612320 - RNA, 64 nt, Homo Sapiens; identical to SEQ ID NO: 299160

SEQ ID NO: 612321 - RNA, 64 nt, Homo Sapiens; identical to SEQ ID NO: 299161

SEQ ID NO: 612322 - RNA, 64 nt, Homo Sapiens; identical to SEQ ID NO: 299162

SEQ ID NO: 612323 - RNA, 64 nt, Homo Sapiens; identical to SEQ ID NO: 299163

SEQ ID NO: 612324 - RNA, 64 nt, Homo Sapiens; identical to SEQ ID NO: 299164

SEQ ID NO: 612325 - RNA, 64 nt, Homo Sapiens; identical to SEQ ID NO: 299165

SEQ ID NO: 612326 - RNA, 64 nt, Homo Sapiens; identical to SEQ ID NO: 299166

SEQ ID NO: 612327 - RNA, 64 nt, Homo Sapiens; identical to SEQ ID NO: 299167

SEQ ID NO: 612328 - RNA, 64 nt, Homo Sapiens; identical to SEQ ID NO: 299168

SEQ ID NO: 612329 - RNA, 64 nt, Homo Sapiens; identical to SEQ ID NO: 299169

SEQ ID NO: 612330 - RNA, 64 nt, Homo Sapiens; identical to SEQ ID NO: 299170

SEQ ID NO: 612331 - RNA, 64 nt, Homo Sapiens; identical to SEQ ID NO: 299171

SEQ ID NO: 612332 - RNA, 64 nt, Homo Sapiens; identical to SEQ ID NO: 299172

SEQ ID NO: 612333 - RNA, 64 nt, Homo Sapiens; identical to SEQ ID NO: 299173

SEQ ID NO: 612334 - RNA, 64 nt, Homo Sapiens; identical to SEQ ID NO: 299174

SEQ ID NO: 612335 - RNA, 64 nt, Homo Sapiens; identical to SEQ ID NO: 299175

SEQ ID NO: 612336 - RNA, 64 nt, Homo Sapiens; identical to SEQ ID NO: 299176

SEQ ID NO: 612337 - RNA, 64 nt, Homo Sapiens; identical to SEQ ID NO: 299177

SEQ ID NO: 612338 - RNA, 64 nt, Homo Sapiens; identical to SEQ ID NO: 299178

SEQ ID NO: 612339 - RNA, 64 nt, Homo Sapiens; identical to SEQ ID NO: 299179

SEQ ID NO: 612340 - RNA, 64 nt, Homo Sapiens; identical to SEQ ID NO: 299180

SEQ ID NO: 612341 - RNA, 64 nt, Homo Sapiens; identical to SEQ ID NO: 299181

SEQ ID NO: 612342 - RNA, 64 nt, Homo Sapiens; identical to SEQ ID NO: 299182

SEQ ID NO: 612343 - RNA, 64 nt, Homo Sapiens; identical to SEQ ID NO: 299183

SEQ ID NO: 612344 - RNA, 64 nt, Homo Sapiens; identical to SEQ ID NO: 299184

SEQ ID NO: 612345 - RNA, 64 nt, Homo Sapiens; identical to SEQ ID NO: 299185

SEQ ID NO: 612346 - RNA, 64 nt, Homo Sapiens; identical to SEQ ID NO: 299186

SEQ ID NO: 612347 - RNA, 64 nt, Homo Sapiens; identical to SEQ ID NO: 299187

SEQ ID NO: 612348 - RNA, 64 nt, Homo Sapiens; identical to SEQ ID NO: 299188

SEQ ID NO: 612349 - RNA, 64 nt, Homo Sapiens; identical to SEQ ID NO: 299189

SEQ ID NO: 612350 - RNA, 64 nt, Homo Sapiens; identical to SEQ ID NO: 299190

SEQ ID NO: 612351 - RNA, 64 nt, Homo Sapiens; identical to SEQ ID NO: 299191

SEQ ID NO: 612352 - RNA, 64 nt, Homo Sapiens; identical to SEQ ID NO: 299192

SEQ ID NO: 612353 - RNA, 64 nt, Homo Sapiens; identical to SEQ ID NO: 299193

SEQ ID NO: 612354 - RNA, 64 nt, Homo Sapiens; identical to SEQ ID NO: 299194

SEQ ID NO: 612355 - RNA, 64 nt, Homo Sapiens; identical to SEQ ID NO: 299195

SEQ ID NO: 612356 - RNA, 64 nt, Homo Sapiens; identical to SEQ ID NO: 299196

SEQ ID NO: 612357 - RNA, 64 nt, Homo Sapiens; identical to SEQ ID NO: 299197

SEQ ID NO: 612358 - RNA, 64 nt, Homo Sapiens; identical to SEQ ID NO: 299198

SEQ ID NO: 612359 - RNA, 64 nt, Homo Sapiens; identical to SEQ ID NO: 299199

SEQ ID NO: 612360 - RNA, 64 nt, Homo Sapiens; identical to SEQ ID NO: 299200

SEQ ID NO: 612361 - RNA, 64 nt, Homo Sapiens; identical to SEQ ID NO: 299201

SEQ ID NO: 612362 - RNA, 64 nt, Homo Sapiens; identical to SEQ ID NO: 299202

SEQ ID NO: 612363 - RNA, 64 nt, Homo Sapiens; identical to SEQ ID NO: 299203

SEQ ID NO: 612364 - RNA, 64 nt, Homo Sapiens; identical to SEQ ID NO: 299204

SEQ ID NO: 612365 - RNA, 64 nt, Homo Sapiens; identical to SEQ ID NO: 299205

SEQ ID NO: 612366 - RNA, 64 nt, Homo Sapiens; identical to SEQ ID NO: 299206

SEQ ID NO: 612367 - RNA, 64 nt, Homo Sapiens; identical to SEQ ID NO: 299207

SEQ ID NO: 612368 - RNA, 64 nt, Homo Sapiens; identical to SEQ ID NO: 299208

SEQ ID NO: 612369 - RNA, 64 nt, Homo Sapiens; identical to SEQ ID NO: 299209

SEQ ID NO: 612370 - RNA, 64 nt, Homo Sapiens; identical to SEQ ID NO: 257770

SEQ ID NO: 612371 - RNA, 64 nt, Homo Sapiens; identical to SEQ ID NO: 257771

SEQ ID NO: 612372 - RNA, 61 nt, Homo Sapiens; identical to SEQ ID NO: 257772

SEQ ID NO: 612373 - RNA, 64 nt, Homo Sapiens; identical to SEQ ID NO: 257773

SEQ ID NO: 612374 - RNA, 64 nt, Homo Sapiens; identical to SEQ ID NO: 257774

SEQ ID NO: 612375 - RNA, 64 nt, Homo Sapiens; identical to SEQ ID NO: 257775

SEQ ID NO: 612376 - RNA, 64 nt, Homo Sapiens
cucugguguaaaaaagaugacugaaccuugcaguucugugaauuuuuauaaaacauacaaaaac

SEQ ID NO: 612377 - RNA, 64 nt, Homo Sapiens
aaaacaaaacuuuccagccauuuuacugcagcagucugugaacuaaauuuguaaauauggcugc

SEQ ID NO: 612378 - RNA, 64 nt, Homo Sapiens
ucacaguggucuaccugcauucauaauuccaggaucugugaagagcacauaugugucagggcac

SEQ ID NO: 612379 - RNA, 64 nt, Homo Sapiens
ggacaccucaagaugaauaauaauucacaaaauuucugugaaaucaaauccaguuuuaagagga

SEQ ID NO: 612380 - RNA, 64 nt, Homo Sapiens
uuccuugguacaugagagaaucuauaugcuuuuuucugugaauucucuaacgacacacuauacu

SEQ ID NO: 612381 - RNA, 64 nt, Homo Sapiens
cagguguucagagccuccugagcucaccugaucaucugugaauucuguaaucacugcuacaauc

SEQ ID NO: 612382 - RNA, 64 nt, Homo Sapiens
cccuuggauguaacauacuaguuaguuaaugaauucugugaauucugugaagaguaaugugauu

SEQ ID NO: 612383 - RNA, 64 nt, Homo Sapiens
guaacauacuaguuaguuaaugaauucugugaauucugugaagaguaaugugauugaaaauaag

SEQ ID NO: 612384 - RNA, 64 nt, Homo Sapiens
cuucuacugaaucuauaaaaacugcaguuuuacaucugugaacuauggcuuaagggacaggauu

SEQ ID NO: 612385 - RNA, 64 nt, Homo Sapiens
ggaguuaacuggaauagcaguacacuagcaaguaucugugaauccuuagcacugacggguuaac

SEQ ID NO: 612386 - RNA, 64 nt, Homo Sapiens
agcuccuacacuuugaaaacacaccaagaguguaucugugaaaggauaaaacuuacagcccccu

SEQ ID NO: 612387 - RNA, 64 nt, Homo Sapiens
gucacaggacccaauuggagaaauguucaacaauucugugaaaguccuccacagaucucauagg

SEQ ID NO: 612388 - RNA, 64 nt, Homo Sapiens
gccuguuuuccacauguaaauucgugggguuacaucugugaauaugauuugaucacacggguuc

SEQ ID NO: 612389 - RNA, 64 nt, Homo Sapiens
caccagcuugcaauaugccacaugguucugacuuucugugaagggaugccaacaugguuuuguc

SEQ ID NO: 612390 - RNA, 64 nt, Homo Sapiens
gucauugugaggccaccaguccauucauuugaauucugugaaucuccaccuugccuaucuuugg

SEQ ID NO: 612391 - RNA, 64 nt, Homo Sapiens
uccucuuccccuacaucccuggcacugguuguuuucugugaaaacagcagugaacagguucagu

SEQ ID NO: 612392 - RNA, 64 nt, Homo Sapiens
ugggaugauaauaaugccuaccucgauguccuccucugugaaaccaagcuacuuaacuugguag

SEQ ID NO: 612393 - RNA, 64 nt, Homo Sapiens
uuguaauauggggaaguaggucucaccuaaacccucugugaaauuuuguaaacuuccaagucau

SEQ ID NO: 612394 - RNA, 64 nt, Homo Sapiens
gauccuacuacucuuccuuccaaaagaauaaaaaucugugaagaccaaauuuuaggaacagaau

SEQ ID NO: 612395 - RNA, 64 nt, Homo Sapiens
gaacugaagugaacgugaaugaagcugaaauccaucugugaauguucaagcagugcacccggug

SEQ ID NO: 612396 - RNA, 64 nt, Homo Sapiens
ccgccaacuccuauacccaucuucccuaggugaaucugugaaugguccuuucuggcagcaaucc

SEQ ID NO: 612397 - RNA, 64 nt, Homo Sapiens
gagauaaacuauaucuuggcuaguggcuacugugucugugaauguaaccaguacuucuuuaagc

SEQ ID NO: 612398 - RNA, 64 nt, Homo Sapiens
uaauaguggucaagauuccgaacuaggacuuuccucugugaagaggaugccucugaagaaauuu

SEQ ID NO: 612399 - RNA, 64 nt, Homo Sapiens
aggguuuggacuagaugaguggcuuucaggguguucugugaaucuccucaugaauacuuuaggg

SEQ ID NO: 612400 - RNA, 64 nt, Homo Sapiens
agaaugagacaaggcagcaggcugccauagaaauucugugaaccgcuaaugguuucaucugaaa

SEQ ID NO: 612401 - RNA, 64 nt, Homo Sapiens
ugcuguggcucuauuugcaacauuugugauaacaucugugaacaaaucacucucuuaucccauc

SEQ ID NO: 612402 - RNA, 64 nt, Homo Sapiens
gaacggcgaugaacaaauguaauuaauaacuuucucugugaaagcuuuggaaaaaucuuuuuuu

SEQ ID NO: 612403 - RNA, 64 nt, Homo Sapiens
auagauaaccaauuuucagacacauuuuuggauuucugugaaguugaauaaacauaaaagcuaa

SEQ ID NO: 612404 - RNA, 64 nt, Homo Sapiens
caagaaccuuaccuucaaggagcaagugaagaacucugugaaggauggaacuuucagauaucaa

SEQ ID NO: 612405 - RNA, 64 nt, Homo Sapiens
ggagucuacuaauuuaccugaaugguguuugcauucugugaaaugccucuccacguugcauaug

SEQ ID NO: 612406 - RNA, 64 nt, Homo Sapiens
ugugacgggucuaacagcccccggcuacucuuguucugugaaauguguauuuuagucucuguga

SEQ ID NO: 612407 - RNA, 64 nt, Homo Sapiens
gcuacucuuguucugugaaauguguauuuuagucucugugaagccuuuacucucuaggugccuu

SEQ ID NO: 612408 - RNA, 64 nt, Homo Sapiens
uacuaugaucuuguuugucaauaaaaagcagcuaucugugaaccagguaacuguguguuuugga

SEQ ID NO: 612409 - RNA, 64 nt, Homo Sapiens
ugcacuggaagcuucuggucuaucguaccaacgaucugugaaaaccaacguuuuaaccaaagcg

SEQ ID NO: 612410 - RNA, 64 nt, Homo Sapiens
caaguucaacagacuucacuuagugcgguauugcucugugaauugccgaaagugcuaaaauauu

SEQ ID NO: 612411 - RNA, 64 nt, Homo Sapiens
ggugagggcuggaaauccaaacucaccaccaugaucugugaaauaaagcccuuagcggugugaa

SEQ ID NO: 612412 - RNA, 64 nt, Homo Sapiens
aaguugucauuugaggucgcacuuggaaguuacaucugugaaguuucugucauucguccagauc

SEQ ID NO: 612413 - RNA, 64 nt, Homo Sapiens
guccuuuucccuccugccccaaaaagccacuaguucugugaauuaaaugccccaguuuccuuug

SEQ ID NO: 612414 - RNA, 64 nt, Homo Sapiens
aaauuucuaaaauuggaugugguaaaaauagggaucugugaaggugucuuauucuuaaagccau

SEQ ID NO: 612415 - RNA, 64 nt, Homo Sapiens
agcuuugggaaauuaaauugcuaaauuuguauucucugugaauuucacuggcaguuuugaacuu

SEQ ID NO: 612416 - RNA, 64 nt, Homo Sapiens
acuugguaaaaacccacaggugcugcugcuuauaucugugaagcacuagcuuauucuaggaaug

SEQ ID NO: 612417 - RNA, 64 nt, Homo Sapiens
aggccugucucuucccuggguucccugccuagggucugugaacgugaaugacuugaauuuuuua

SEQ ID NO: 612418 - RNA, 64 nt, Homo Sapiens
acuugaauuuuuuauucccuugccuuucaagacuucugugaaugggaacugucagaaauccuca

SEQ ID NO: 612419 - RNA, 64 nt, Homo Sapiens
uuucuagauaguuugggaacgggguugauggguuucugugaaacacauuuuccaagucuugggc

SEQ ID NO: 612420 - RNA, 64 nt, Homo Sapiens
ugugggagacaucacugcaucuguccccccagcuucugugaagggaagcuguggccucuuuuga

SEQ ID NO: 612421 - RNA, 64 nt, Homo Sapiens
acccugcaccccuaguccuugccccuugauuguuucugugaaacaugauuucugugaaaucgag

SEQ ID NO: 612422 - RNA, 64 nt, Homo Sapiens
cgaggccccuugauuguuuccccucuugaugauuucugugaaauccucuucuacccacaaggag

SEQ ID NO: 612423 - RNA, 64 nt, Homo Sapiens
gguacugcauucugaaucagaaucucgcaguguuucugugaauagauuuuuuuguaaauaugac

SEQ ID NO: 612424 - RNA, 64 nt, Homo Sapiens
guucaaauaguugacggaauuggguuucugaaugucugugaauuucagaggucucugcuagccu

SEQ ID NO: 612425 - RNA, 64 nt, Homo Sapiens
ccuuuccuaaaaaagaaacuucuuugccuuguucucugugaaguuuugcuguuguauuacuuau

SEQ ID NO: 612426 - RNA, 64 nt, Homo Sapiens
cugagaaaagacuaagauaacuuuuagauaauugucugugaaguagcauucacuuagccagggg

SEQ ID NO: 612427 - RNA, 64 nt, Homo Sapiens; identical to SEQ ID NO: 55732

SEQ ID NO: 612428 - RNA, 64 nt, Homo Sapiens; identical to SEQ ID NO: 55733

SEQ ID NO: 612429 - RNA, 64 nt, Homo Sapiens; identical to SEQ ID NO: 55734

SEQ ID NO: 612430 - RNA, 64 nt, Homo Sapiens; identical to SEQ ID NO: 55735

SEQ ID NO: 612431 - RNA, 64 nt, Homo Sapiens; identical to SEQ ID NO: 55736

SEQ ID NO: 612432 - RNA, 64 nt, Homo Sapiens; identical to SEQ ID NO: 55737

SEQ ID NO: 612433 - RNA, 64 nt, Homo Sapiens; identical to SEQ ID NO: 562946

SEQ ID NO: 612434 - RNA, 64 nt, Homo Sapiens; identical to SEQ ID NO: 562947

SEQ ID NO: 612435 - RNA, 64 nt, Homo Sapiens; identical to SEQ ID NO: 562948

SEQ ID NO: 612436 - RNA, 64 nt, Homo Sapiens; identical to SEQ ID NO: 562949

SEQ ID NO: 612437 - RNA, 64 nt, Homo Sapiens; identical to SEQ ID NO: 562950

SEQ ID NO: 612438 - RNA, 64 nt, Homo Sapiens; identical to SEQ ID NO: 562951

SEQ ID NO: 612439 - RNA, 64 nt, Homo Sapiens; identical to SEQ ID NO: 562952

SEQ ID NO: 612440 - RNA, 64 nt, Homo Sapiens; identical to SEQ ID NO: 562953

SEQ ID NO: 612441 - RNA, 64 nt, Homo Sapiens; identical to SEQ ID NO: 562954

SEQ ID NO: 612442 - RNA, 64 nt, Homo Sapiens; identical to SEQ ID NO: 562955

SEQ ID NO: 612443 - RNA, 64 nt, Homo Sapiens; identical to SEQ ID NO: 562956

SEQ ID NO: 612444 - RNA, 64 nt, Homo Sapiens; identical to SEQ ID NO: 562957

SEQ ID NO: 612445 - RNA, 64 nt, Homo Sapiens; identical to SEQ ID NO: 562958

SEQ ID NO: 612446 - RNA, 64 nt, Homo Sapiens; identical to SEQ ID NO: 562959

SEQ ID NO: 612447 - RNA, 64 nt, Homo Sapiens; identical to SEQ ID NO: 562960

SEQ ID NO: 612448 - RNA, 64 nt, Homo Sapiens; identical to SEQ ID NO: 562961

SEQ ID NO: 612449 - RNA, 64 nt, Homo Sapiens; identical to SEQ ID NO: 562962

SEQ ID NO: 612450 - RNA, 64 nt, Homo Sapiens; identical to SEQ ID NO: 562963

SEQ ID NO: 612451 - RNA, 64 nt, Homo Sapiens; identical to SEQ ID NO: 562964

SEQ ID NO: 612452 - RNA, 64 nt, Homo Sapiens; identical to SEQ ID NO: 562965

SEQ ID NO: 612453 - RNA, 64 nt, Homo Sapiens; identical to SEQ ID NO: 562966

SEQ ID NO: 612454 - RNA, 64 nt, Homo Sapiens; identical to SEQ ID NO: 562967

SEQ ID NO: 612455 - RNA, 64 nt, Homo Sapiens; identical to SEQ ID NO: 562968

SEQ ID NO: 612456 - RNA, 64 nt, Homo Sapiens; identical to SEQ ID NO: 562969

SEQ ID NO: 612457 - RNA, 64 nt, Homo Sapiens; identical to SEQ ID NO: 562970

SEQ ID NO: 612458 - RNA, 64 nt, Homo Sapiens; identical to SEQ ID NO: 562970

SEQ ID NO: 612459 - RNA, 64 nt, Homo Sapiens; identical to SEQ ID NO: 562972

SEQ ID NO: 612460 - RNA, 64 nt, Homo Sapiens; identical to SEQ ID NO: 562973

SEQ ID NO: 612461 - RNA, 64 nt, Homo Sapiens; identical to SEQ ID NO: 562974

SEQ ID NO: 612462 - RNA, 64 nt, Homo Sapiens; identical to SEQ ID NO: 562975

SEQ ID NO: 612463 - RNA, 64 nt, Homo Sapiens; identical to SEQ ID NO: 562976

SEQ ID NO: 612464 - RNA, 64 nt, Homo Sapiens; identical to SEQ ID NO: 562977

SEQ ID NO: 612465 - RNA, 64 nt, Homo Sapiens; identical to SEQ ID NO: 562978

SEQ ID NO: 612466 - RNA, 64 nt, Homo Sapiens; identical to SEQ ID NO: 562979

SEQ ID NO: 612467 - RNA, 64 nt, Homo Sapiens; identical to SEQ ID NO: 562980

SEQ ID NO: 612468 - RNA, 64 nt, Homo Sapiens; identical to SEQ ID NO: 313220

SEQ ID NO: 612469 - RNA, 64 nt, Homo Sapiens; identical to SEQ ID NO: 313221

SEQ ID NO: 612470 - RNA, 64 nt, Homo Sapiens; identical to SEQ ID NO: 313222

SEQ ID NO: 612471 - RNA, 64 nt, Homo Sapiens; identical to SEQ ID NO: 313223

SEQ ID NO: 612472 - RNA, 64 nt, Homo Sapiens; identical to SEQ ID NO: 313224

SEQ ID NO: 612473 - RNA, 64 nt, Homo Sapiens; identical to SEQ ID NO: 313225

SEQ ID NO: 612474 - RNA, 64 nt, Homo Sapiens; identical to SEQ ID NO: 313226

SEQ ID NO: 612475 - RNA, 64 nt, Homo Sapiens; identical to SEQ ID NO: 313227

SEQ ID NO: 612476 - RNA, 64 nt, Homo Sapiens; identical to SEQ ID NO: 313228

SEQ ID NO: 612477 - RNA, 64 nt, Homo Sapiens; identical to SEQ ID NO: 313229

SEQ ID NO: 612478 - RNA, 64 nt, Homo Sapiens; identical to SEQ ID NO: 313230

SEQ ID NO: 612479 - RNA, 64 nt, Homo Sapiens; identical to SEQ ID NO: 313231

SEQ ID NO: 612480 - RNA, 64 nt, Homo Sapiens; identical to SEQ ID NO: 313232

SEQ ID NO: 612481 - RNA, 64 nt, Homo Sapiens; identical to SEQ ID NO: 313233

SEQ ID NO: 612482 - RNA, 64 nt, Homo Sapiens; identical to SEQ ID NO: 313234

SEQ ID NO: 612483 - RNA, 64 nt, Homo Sapiens; identical to SEQ ID NO: 313235

SEQ ID NO: 612484 - RNA, 64 nt, Homo Sapiens; identical to SEQ ID NO: 313236

SEQ ID NO: 612485 - RNA, 64 nt, Homo Sapiens; identical to SEQ ID NO: 313237

SEQ ID NO: 612486 - RNA, 64 nt, Homo Sapiens; identical to SEQ ID NO: 313238

SEQ ID NO: 612487 - RNA, 64 nt, Homo Sapiens; identical to SEQ ID NO: 313239

SEQ ID NO: 612488 - RNA, 64 nt, Homo Sapiens; identical to SEQ ID NO: 313240

SEQ ID NO: 612489 - RNA, 64 nt, Homo Sapiens; identical to SEQ ID NO: 313241

SEQ ID NO: 612490 - RNA, 64 nt, Homo Sapiens; identical to SEQ ID NO: 313242

SEQ ID NO: 612491 - RNA, 64 nt, Homo Sapiens; identical to SEQ ID NO: 313243

SEQ ID NO: 612492 - RNA, 64 nt, Homo Sapiens; identical to SEQ ID NO: 313244

SEQ ID NO: 612493 - RNA, 64 nt, Homo Sapiens; identical to SEQ ID NO: 313245

SEQ ID NO: 612494 - RNA, 64 nt, Homo Sapiens; identical to SEQ ID NO: 313246

SEQ ID NO: 612495 - RNA, 64 nt, Homo Sapiens; identical to SEQ ID NO: 313247

SEQ ID NO: 612496 - RNA, 64 nt, Homo Sapiens; identical to SEQ ID NO: 313248

SEQ ID NO: 612497 - RNA, 64 nt, Homo Sapiens; identical to SEQ ID NO: 313249

SEQ ID NO: 612498 - RNA, 64 nt, Homo Sapiens; identical to SEQ ID NO: 313250

SEQ ID NO: 612499 - RNA, 64 nt, Homo Sapiens; identical to SEQ ID NO: 313251

SEQ ID NO: 612500 - RNA, 64 nt, Homo Sapiens; identical to SEQ ID NO: 313252

SEQ ID NO: 612501 - RNA, 64 nt, Homo Sapiens; identical to SEQ ID NO: 313253

SEQ ID NO: 612502 - RNA, 64 nt, Homo Sapiens; identical to SEQ ID NO: 313254

SEQ ID NO: 612503 - RNA, 64 nt, Homo Sapiens; identical to SEQ ID NO: 313255

SEQ ID NO: 612504 - RNA, 64 nt, Homo Sapiens; identical to SEQ ID NO: 313256

SEQ ID NO: 612505 - RNA, 64 nt, Homo Sapiens; identical to SEQ ID NO: 313257

SEQ ID NO: 612506 - RNA, 64 nt, Homo Sapiens; identical to SEQ ID NO: 313258

SEQ ID NO: 612507 - RNA, 64 nt, Homo Sapiens; identical to SEQ ID NO: 313259

SEQ ID NO: 612508 - RNA, 64 nt, Homo Sapiens; identical to SEQ ID NO: 313260

SEQ ID NO: 612509 - RNA, 64 nt, Homo Sapiens; identical to SEQ ID NO: 313261

SEQ ID NO: 612510 - RNA, 64 nt, Homo Sapiens; identical to SEQ ID NO: 313262

SEQ ID NO: 612511 - RNA, 64 nt, Homo Sapiens; identical to SEQ ID NO: 313263

SEQ ID NO: 612512 - RNA, 64 nt, Homo Sapiens; identical to SEQ ID NO: 313264

SEQ ID NO: 612513 - RNA, 64 nt, Homo Sapiens; identical to SEQ ID NO: 313265

SEQ ID NO: 612514 - RNA, 64 nt, Homo Sapiens; identical to SEQ ID NO: 411771

SEQ ID NO: 612515 - RNA, 64 nt, Homo Sapiens; identical to SEQ ID NO: 411772

SEQ ID NO: 612516 - RNA, 64 nt, Homo Sapiens; identical to SEQ ID NO: 411773

SEQ ID NO: 612517 - RNA, 64 nt, Homo Sapiens; identical to SEQ ID NO: 411774

SEQ ID NO: 612518 - RNA, 64 nt, Homo Sapiens; identical to SEQ ID NO: 411775

SEQ ID NO: 612519 - RNA, 64 nt, Homo Sapiens; identical to SEQ ID NO: 411776

SEQ ID NO: 612520 - RNA, 64 nt, Homo Sapiens; identical to SEQ ID NO: 411777

SEQ ID NO: 612521 - RNA, 64 nt, Homo Sapiens; identical to SEQ ID NO: 411778

SEQ ID NO: 612522 - RNA, 64 nt, Homo Sapiens; identical to SEQ ID NO: 411779

SEQ ID NO: 612523 - RNA, 64 nt, Homo Sapiens; identical to SEQ ID NO: 411780

SEQ ID NO: 612524 - RNA, 64 nt, Homo Sapiens; identical to SEQ ID NO: 411781

SEQ ID NO: 612525 - RNA, 64 nt, Homo Sapiens; identical to SEQ ID NO: 411782

SEQ ID NO: 612526 - RNA, 64 nt, Homo Sapiens; identical to SEQ ID NO: 411783

SEQ ID NO: 612527 - RNA, 64 nt, Homo Sapiens; identical to SEQ ID NO: 411784

SEQ ID NO: 612528 - RNA, 64 nt, Homo Sapiens; identical to SEQ ID NO: 411785

SEQ ID NO: 612529 - RNA, 64 nt, Homo Sapiens; identical to SEQ ID NO: 411786

SEQ ID NO: 612530 - RNA, 64 nt, Homo Sapiens; identical to SEQ ID NO: 411787

SEQ ID NO: 612531 - RNA, 64 nt, Homo Sapiens; identical to SEQ ID NO: 411788

SEQ ID NO: 612532 - RNA, 64 nt, Homo Sapiens; identical to SEQ ID NO: 411789

SEQ ID NO: 612533 - RNA, 64 nt, Homo Sapiens; identical to SEQ ID NO: 411790

SEQ ID NO: 612534 - RNA, 64 nt, Homo Sapiens; identical to SEQ ID NO: 411791

SEQ ID NO: 612535 - RNA, 64 nt, Homo Sapiens; identical to SEQ ID NO: 411792

SEQ ID NO: 612536 - RNA, 64 nt, Homo Sapiens; identical to SEQ ID NO: 411793

SEQ ID NO: 612537 - RNA, 64 nt, Homo Sapiens; identical to SEQ ID NO: 411794

SEQ ID NO: 612538 - RNA, 64 nt, Homo Sapiens; identical to SEQ ID NO: 411795

SEQ ID NO: 612539 - RNA, 64 nt, Homo Sapiens; identical to SEQ ID NO: 411796

SEQ ID NO: 612540 - RNA, 64 nt, Homo Sapiens; identical to SEQ ID NO: 411797

SEQ ID NO: 612541 - RNA, 64 nt, Homo Sapiens; identical to SEQ ID NO: 411798

SEQ ID NO: 612542 - RNA, 64 nt, Homo Sapiens; identical to SEQ ID NO: 411799

SEQ ID NO: 612543 - RNA, 64 nt, Homo Sapiens; identical to SEQ ID NO: 411800

SEQ ID NO: 612544 - RNA, 64 nt, Homo Sapiens; identical to SEQ ID NO: 411801

SEQ ID NO: 612545 - RNA, 64 nt, Homo Sapiens; identical to SEQ ID NO: 411802

SEQ ID NO: 612546 - RNA, 64 nt, Homo Sapiens; identical to SEQ ID NO: 411803

SEQ ID NO: 612547 - RNA, 64 nt, Homo Sapiens; identical to SEQ ID NO: 411804

SEQ ID NO: 612548 - RNA, 64 nt, Homo Sapiens; identical to SEQ ID NO: 411805

SEQ ID NO: 612549 - RNA, 64 nt, Homo Sapiens; identical to SEQ ID NO: 411806

SEQ ID NO: 612550 - RNA, 64 nt, Homo Sapiens; identical to SEQ ID NO: 411807

SEQ ID NO: 612551 - RNA, 64 nt, Homo Sapiens; identical to SEQ ID NO: 411808

SEQ ID NO: 612552 - RNA, 64 nt, Homo Sapiens; identical to SEQ ID NO: 411809

SEQ ID NO: 612553 - RNA, 64 nt, Homo Sapiens; identical to SEQ ID NO: 411810

SEQ ID NO: 612554 - RNA, 64 nt, Homo Sapiens; identical to SEQ ID NO: 411811

SEQ ID NO: 612555 - RNA, 64 nt, Homo Sapiens; identical to SEQ ID NO: 411812

SEQ ID NO: 612556 - RNA, 64 nt, Homo Sapiens; identical to SEQ ID NO: 411813

SEQ ID NO: 612557 - RNA, 64 nt, Homo Sapiens; identical to SEQ ID NO: 411814

SEQ ID NO: 612558 - RNA, 64 nt, Homo Sapiens; identical to SEQ ID NO: 411815

SEQ ID NO: 612559 - RNA, 64 nt, Homo Sapiens; identical to SEQ ID NO: 411816

SEQ ID NO: 612560 - RNA, 64 nt, Homo Sapiens; identical to SEQ ID NO: 411817

SEQ ID NO: 612561 - RNA, 64 nt, Homo Sapiens; identical to SEQ ID NO: 411818

SEQ ID NO: 612562 - RNA, 64 nt, Homo Sapiens; identical to SEQ ID NO: 411819

SEQ ID NO: 612563 - RNA, 64 nt, Homo Sapiens; identical to SEQ ID NO: 411820

SEQ ID NO: 612564 - RNA, 64 nt, Homo Sapiens; identical to SEQ ID NO: 411821

SEQ ID NO: 612565 - RNA, 64 nt, Homo Sapiens; identical to SEQ ID NO: 411822

SEQ ID NO: 612566 - RNA, 64 nt, Homo Sapiens; identical to SEQ ID NO: 411823

SEQ ID NO: 612567 - RNA, 64 nt, Homo Sapiens; identical to SEQ ID NO: 411824

SEQ ID NO: 612568 - RNA, 64 nt, Homo Sapiens; identical to SEQ ID NO: 411825

SEQ ID NO: 612569 - RNA, 64 nt, Homo Sapiens; identical to SEQ ID NO: 411826

SEQ ID NO: 612570 - RNA, 64 nt, Homo Sapiens; identical to SEQ ID NO: 411827

SEQ ID NO: 612571 - RNA, 64 nt, Homo Sapiens; identical to SEQ ID NO: 411828

SEQ ID NO: 612572 - RNA, 64 nt, Homo Sapiens; identical to SEQ ID NO: 411829

SEQ ID NO: 612573 - RNA, 64 nt, Homo Sapiens; identical to SEQ ID NO: 262967

SEQ ID NO: 612574 - RNA, 64 nt, Homo Sapiens; identical to SEQ ID NO: 262968

SEQ ID NO: 612575 - RNA, 64 nt, Homo Sapiens; identical to SEQ ID NO: 262969

SEQ ID NO: 612576 - RNA, 64 nt, Homo Sapiens; identical to SEQ ID NO: 262970

SEQ ID NO: 612577 - RNA, 64 nt, Homo Sapiens; identical to SEQ ID NO: 262971

SEQ ID NO: 612578 - RNA, 64 nt, Homo Sapiens; identical to SEQ ID NO: 262972

SEQ ID NO: 612579 - RNA, 64 nt, Homo Sapiens; identical to SEQ ID NO: 262973

SEQ ID NO: 612580 - RNA, 64 nt, Homo Sapiens; identical to SEQ ID NO: 262974

SEQ ID NO: 612581 - RNA, 64 nt, Homo Sapiens; identical to SEQ ID NO: 262975

SEQ ID NO: 612582 - RNA, 64 nt, Homo Sapiens; identical to SEQ ID NO: 262976

SEQ ID NO: 612583 - RNA, 64 nt, Homo Sapiens; identical to SEQ ID NO: 262977

SEQ ID NO: 612584 - RNA, 64 nt, Homo Sapiens; identical to SEQ ID NO: 262978

SEQ ID NO: 612585 - RNA, 64 nt, Homo Sapiens; identical to SEQ ID NO: 262979

SEQ ID NO: 612586 - RNA, 64 nt, Homo Sapiens; identical to SEQ ID NO: 262980

SEQ ID NO: 612587 - RNA, 64 nt, Homo Sapiens; identical to SEQ ID NO: 262981

SEQ ID NO: 612588 - RNA, 64 nt, Homo Sapiens; identical to SEQ ID NO: 262982

SEQ ID NO: 612589 - RNA, 64 nt, Homo Sapiens; identical to SEQ ID NO: 262983

SEQ ID NO: 612590 - RNA, 64 nt, Homo Sapiens; identical to SEQ ID NO: 262984

SEQ ID NO: 612591 - RNA, 64 nt, Homo Sapiens; identical to SEQ ID NO: 262985

SEQ ID NO: 612592 - RNA, 64 nt, Homo Sapiens; identical to SEQ ID NO: 262986

SEQ ID NO: 612593 - RNA, 64 nt, Homo Sapiens; identical to SEQ ID NO: 262987

SEQ ID NO: 612594 - RNA, 64 nt, Homo Sapiens; identical to SEQ ID NO: 262988

SEQ ID NO: 612595 - RNA, 64 nt, Homo Sapiens; identical to SEQ ID NO: 262989

SEQ ID NO: 612596 - RNA, 64 nt, Homo Sapiens; identical to SEQ ID NO: 262990

SEQ ID NO: 612597 - RNA, 64 nt, Homo Sapiens; identical to SEQ ID NO: 262991

SEQ ID NO: 612598 - RNA, 64 nt, Homo Sapiens; identical to SEQ ID NO: 262992

SEQ ID NO: 612599 - RNA, 64 nt, Homo Sapiens; identical to SEQ ID NO: 262993

SEQ ID NO: 612600 - RNA, 64 nt, Homo Sapiens; identical to SEQ ID NO: 262994

SEQ ID NO: 612601 - RNA, 64 nt, Homo Sapiens; identical to SEQ ID NO: 262995

SEQ ID NO: 612602 - RNA, 64 nt, Homo Sapiens; identical to SEQ ID NO: 262996

SEQ ID NO: 612603 - RNA, 64 nt, Homo Sapiens; identical to SEQ ID NO: 262997

SEQ ID NO: 612604 - RNA, 64 nt, Homo Sapiens; identical to SEQ ID NO: 262998

SEQ ID NO: 612605 - RNA, 64 nt, Homo Sapiens; identical to SEQ ID NO: 262999

SEQ ID NO: 612606 - RNA, 64 nt, Homo Sapiens; identical to SEQ ID NO: 263000

SEQ ID NO: 612607 - RNA, 64 nt, Homo Sapiens; identical to SEQ ID NO: 263001

SEQ ID NO: 612608 - RNA, 64 nt, Homo Sapiens; identical to SEQ ID NO: 263002

SEQ ID NO: 612609 - RNA, 64 nt, Homo Sapiens; identical to SEQ ID NO: 263003

SEQ ID NO: 612610 - RNA, 64 nt, Homo Sapiens; identical to SEQ ID NO: 263004

SEQ ID NO: 612611 - RNA, 64 nt, Homo Sapiens; identical to SEQ ID NO: 263005

SEQ ID NO: 612612 - RNA, 64 nt, Homo Sapiens; identical to SEQ ID NO: 263006

SEQ ID NO: 612613 - RNA, 64 nt, Homo Sapiens; identical to SEQ ID NO: 263007

SEQ ID NO: 612614 - RNA, 64 nt, Homo Sapiens; identical to SEQ ID NO: 263008

SEQ ID NO: 612615 - RNA, 64 nt, Homo Sapiens; identical to SEQ ID NO: 263009

SEQ ID NO: 612616 - RNA, 50 nt, Homo Sapiens; identical to SEQ ID NO: 263010

SEQ ID NO: 612617 - RNA, 64 nt, Homo Sapiens; identical to SEQ ID NO: 263011

SEQ ID NO: 612618 - RNA, 64 nt, Homo Sapiens; identical to SEQ ID NO: 263012

SEQ ID NO: 612619 - RNA, 64 nt, Homo Sapiens; identical to SEQ ID NO: 263013

SEQ ID NO: 612620 - RNA, 64 nt, Homo Sapiens; identical to SEQ ID NO: 263014

SEQ ID NO: 612621 - RNA, 64 nt, Homo Sapiens; identical to SEQ ID NO: 263015

SEQ ID NO: 612622 - RNA, 64 nt, Homo Sapiens; identical to SEQ ID NO: 263016

SEQ ID NO: 612623 - RNA, 64 nt, Homo Sapiens; identical to SEQ ID NO: 263017

SEQ ID NO: 612624 - RNA, 64 nt, Homo Sapiens; identical to SEQ ID NO: 263018

SEQ ID NO: 612625 - RNA, 64 nt, Homo Sapiens; identical to SEQ ID NO: 263019

SEQ ID NO: 612626 - RNA, 64 nt, Homo Sapiens; identical to SEQ ID NO: 263020

SEQ ID NO: 612627 - RNA, 64 nt, Homo Sapiens; identical to SEQ ID NO: 263021

SEQ ID NO: 612628 - RNA, 64 nt, Homo Sapiens; identical to SEQ ID NO: 263022

SEQ ID NO: 612629 - RNA, 64 nt, Homo Sapiens; identical to SEQ ID NO: 263023

SEQ ID NO: 612630 - RNA, 64 nt, Homo Sapiens; identical to SEQ ID NO: 263024

SEQ ID NO: 612631 - RNA, 64 nt, Homo Sapiens; identical to SEQ ID NO: 263025

SEQ ID NO: 612632 - RNA, 64 nt, Homo Sapiens; identical to SEQ ID NO: 263026

SEQ ID NO: 612633 - RNA, 64 nt, Homo Sapiens; identical to SEQ ID NO: 263027

SEQ ID NO: 612634 - RNA, 64 nt, Homo Sapiens; identical to SEQ ID NO: 263028

SEQ ID NO: 612635 - RNA, 64 nt, Homo Sapiens; identical to SEQ ID NO: 263029

SEQ ID NO: 612636 - RNA, 64 nt, Homo Sapiens; identical to SEQ ID NO: 263030

SEQ ID NO: 612637 - RNA, 64 nt, Homo Sapiens; identical to SEQ ID NO: 263031

SEQ ID NO: 612638 - RNA, 64 nt, Homo Sapiens; identical to SEQ ID NO: 263032

SEQ ID NO: 612639 - RNA, 64 nt, Homo Sapiens; identical to SEQ ID NO: 263033

SEQ ID NO: 612640 - RNA, 64 nt, Homo Sapiens; identical to SEQ ID NO: 263034

SEQ ID NO: 612641 - RNA, 64 nt, Homo Sapiens; identical to SEQ ID NO: 263035

SEQ ID NO: 612642 - RNA, 64 nt, Homo Sapiens; identical to SEQ ID NO: 263036

SEQ ID NO: 612643 - RNA, 64 nt, Homo Sapiens; identical to SEQ ID NO: 263037

SEQ ID NO: 612644 - RNA, 64 nt, Homo Sapiens; identical to SEQ ID NO: 263038

SEQ ID NO: 612645 - RNA, 64 nt, Homo Sapiens; identical to SEQ ID NO: 263039

SEQ ID NO: 612646 - RNA, 64 nt, Homo Sapiens; identical to SEQ ID NO: 263040

SEQ ID NO: 612647 - RNA, 64 nt, Homo Sapiens; identical to SEQ ID NO: 263041

SEQ ID NO: 612648 - RNA, 64 nt, Homo Sapiens; identical to SEQ ID NO: 263042

SEQ ID NO: 612649 - RNA, 64 nt, Homo Sapiens; identical to SEQ ID NO: 263043

SEQ ID NO: 612650 - RNA, 64 nt, Homo Sapiens; identical to SEQ ID NO: 263044

SEQ ID NO: 612651 - RNA, 64 nt, Homo Sapiens; identical to SEQ ID NO: 263045

SEQ ID NO: 612652 - RNA, 64 nt, Homo Sapiens; identical to SEQ ID NO: 263046

SEQ ID NO: 612653 - RNA, 64 nt, Homo Sapiens; identical to SEQ ID NO: 48734

SEQ ID NO: 612654 - RNA, 64 nt, Homo Sapiens; identical to SEQ ID NO: 48735

SEQ ID NO: 612655 - RNA, 64 nt, Homo Sapiens; identical to SEQ ID NO: 48736

SEQ ID NO: 612656 - RNA, 64 nt, Homo Sapiens; identical to SEQ ID NO: 48737

SEQ ID NO: 612657 - RNA, 64 nt, Homo Sapiens; identical to SEQ ID NO: 48738

SEQ ID NO: 612658 - RNA, 64 nt, Homo Sapiens; identical to SEQ ID NO: 48739

SEQ ID NO: 612659 - RNA, 64 nt, Homo Sapiens; identical to SEQ ID NO: 48740

SEQ ID NO: 612660 - RNA, 64 nt, Homo Sapiens; identical to SEQ ID NO: 48741

SEQ ID NO: 612661 - RNA, 64 nt, Homo Sapiens; identical to SEQ ID NO: 48742

SEQ ID NO: 612662 - RNA, 64 nt, Homo Sapiens; identical to SEQ ID NO: 48743

SEQ ID NO: 612663 - RNA, 64 nt, Homo Sapiens; identical to SEQ ID NO: 48744

SEQ ID NO: 612664 - RNA, 64 nt, Homo Sapiens; identical to SEQ ID NO: 48745

SEQ ID NO: 612665 - RNA, 64 nt, Homo Sapiens; identical to SEQ ID NO: 48746

SEQ ID NO: 612666 - RNA, 64 nt, Homo Sapiens; identical to SEQ ID NO: 48747

SEQ ID NO: 612667 - RNA, 64 nt, Homo Sapiens; identical to SEQ ID NO: 48748

SEQ ID NO: 612668 - RNA, 64 nt, Homo Sapiens
aguaugguuuccaccuaucucuaacaccacuauuaagguacaccaguguuaagguacauuaaua

SEQ ID NO: 612669 - RNA, 64 nt, Homo Sapiens
aucucuaacaccacuauuaagguacaccaguguuaagguacauuaauaacuacacaaaauuuua

SEQ ID NO: 612670 - RNA, 64 nt, Homo Sapiens
aguaauuauuaaaccaacuuaaugauucuuauguaagguacacuuuuuauuuuaauacauuggu

SEQ ID NO: 612671 - RNA, 64 nt, Homo Sapiens
uuaaaaaacccaaguauguccauguguuucuuauaagguacacuugaaacuagugaguguuugu

SEQ ID NO: 612672 - RNA, 64 nt, Homo Sapiens
auuuaucuugaacauuccgaguguaaaggaccauaagguacaucguuaucuugaacauucugac

SEQ ID NO: 612673 - RNA, 64 nt, Homo Sapiens
aguuaucuugaacauucugacuuucaaggaccauaagguacaucccuggaaguauugagucuuc

SEQ ID NO: 612674 - RNA, 64 nt, Homo Sapiens
gcccagaggaagugguagagaguagacacaauuaaagguacaaauuauuuaagcacuuaggcag

SEQ ID NO: 612675 - RNA, 64 nt, Homo Sapiens
uuguccuuuuaaagguugugccuauaaaaaaaggaagguacacgaauuuucaauguuuucccag

SEQ ID NO: 612676 - RNA, 64 nt, Homo Sapiens
ugauuuuuauuuuuuacaugcagaauguuaauguaagguacauuuaaucuuauucuguagucau

SEQ ID NO: 612677 - RNA, 64 nt, Homo Sapiens
aauggucaaacaccagucuaguuucuguuucuguaagguacaugaaaggcaugucuuaggaacu

SEQ ID NO: 612678 - RNA, 64 nt, Homo Sapiens
uauggaggaaagaagaaaauagcaguaagguuucaagguacagucggcacauuuucugcagguc

SEQ ID NO: 612679 - RNA, 64 nt, Homo Sapiens
aaaaauauauauauagauauaucuaaacauagaaaagguacaguguauuuguguaucuaaacau

SEQ ID NO: 612680 - RNA, 64 nt, Homo Sapiens; identical to SEQ ID NO: 368571

SEQ ID NO: 612681 - RNA, 64 nt, Homo Sapiens; identical to SEQ ID NO: 368572

SEQ ID NO: 612682 - RNA, 64 nt, Homo Sapiens; identical to SEQ ID NO: 368573

SEQ ID NO: 612683 - RNA, 64 nt, Homo Sapiens; identical to SEQ ID NO: 368574

SEQ ID NO: 612684 - RNA, 64 nt, Homo Sapiens; identical to SEQ ID NO: 368575

SEQ ID NO: 612685 - RNA, 64 nt, Homo Sapiens; identical to SEQ ID NO: 368576

SEQ ID NO: 612686 - RNA, 64 nt, Homo Sapiens; identical to SEQ ID NO: 368577

SEQ ID NO: 612687 - RNA, 64 nt, Homo Sapiens; identical to SEQ ID NO: 368578

SEQ ID NO: 612688 - RNA, 64 nt, Homo Sapiens; identical to SEQ ID NO: 368579

SEQ ID NO: 612689 - RNA, 64 nt, Homo Sapiens; identical to SEQ ID NO: 368580

SEQ ID NO: 612690 - RNA, 64 nt, Homo Sapiens; identical to SEQ ID NO: 368581

SEQ ID NO: 612691 - RNA, 64 nt, Homo Sapiens; identical to SEQ ID NO: 368582

SEQ ID NO: 612692 - RNA, 64 nt, Homo Sapiens; identical to SEQ ID NO: 368583

SEQ ID NO: 612693 - RNA, 64 nt, Homo Sapiens; identical to SEQ ID NO: 368584

SEQ ID NO: 612694 - RNA, 64 nt, Homo Sapiens; identical to SEQ ID NO: 368585

SEQ ID NO: 612695 - RNA, 64 nt, Homo Sapiens; identical to SEQ ID NO: 368586

SEQ ID NO: 612696 - RNA, 64 nt, Homo Sapiens; identical to SEQ ID NO: 368587

SEQ ID NO: 612697 - RNA, 64 nt, Homo Sapiens; identical to SEQ ID NO: 368588

SEQ ID NO: 612698 - RNA, 64 nt, Homo Sapiens; identical to SEQ ID NO: 368589

SEQ ID NO: 612699 - RNA, 64 nt, Homo Sapiens; identical to SEQ ID NO: 368590

SEQ ID NO: 612700 - RNA, 64 nt, Homo Sapiens; identical to SEQ ID NO: 368591

SEQ ID NO: 612701 - RNA, 64 nt, Homo Sapiens; identical to SEQ ID NO: 368592

SEQ ID NO: 612702 - RNA, 64 nt, Homo Sapiens; identical to SEQ ID NO: 368593

SEQ ID NO: 612703 - RNA, 64 nt, Homo Sapiens; identical to SEQ ID NO: 368594

SEQ ID NO: 612704 - RNA, 64 nt, Homo Sapiens; identical to SEQ ID NO: 368595

SEQ ID NO: 612705 - RNA, 64 nt, Homo Sapiens; identical to SEQ ID NO: 368596

SEQ ID NO: 612706 - RNA, 64 nt, Homo Sapiens; identical to SEQ ID NO: 368597

SEQ ID NO: 612707 - RNA, 64 nt, Homo Sapiens; identical to SEQ ID NO: 368598

SEQ ID NO: 612708 - RNA, 64 nt, Homo Sapiens; identical to SEQ ID NO: 368599

SEQ ID NO: 612709 - RNA, 64 nt, Homo Sapiens; identical to SEQ ID NO: 368600

SEQ ID NO: 612710 - RNA, 64 nt, Homo Sapiens; identical to SEQ ID NO: 368601

SEQ ID NO: 612711 - RNA, 64 nt, Homo Sapiens; identical to SEQ ID NO: 368602

SEQ ID NO: 612712 - RNA, 64 nt, Homo Sapiens; identical to SEQ ID NO: 368603

SEQ ID NO: 612713 - RNA, 64 nt, Homo Sapiens; identical to SEQ ID NO: 368604

SEQ ID NO: 612714 - RNA, 64 nt, Homo Sapiens; identical to SEQ ID NO: 368605

SEQ ID NO: 612715 - RNA, 64 nt, Homo Sapiens; identical to SEQ ID NO: 368606

SEQ ID NO: 612716 - RNA, 64 nt, Homo Sapiens; identical to SEQ ID NO: 368607

SEQ ID NO: 612717 - RNA, 64 nt, Homo Sapiens; identical to SEQ ID NO: 368608

SEQ ID NO: 612718 - RNA, 64 nt, Homo Sapiens; identical to SEQ ID NO: 368609

SEQ ID NO: 612719 - RNA, 64 nt, Homo Sapiens; identical to SEQ ID NO: 368610

SEQ ID NO: 612720 - RNA, 64 nt, Homo Sapiens; identical to SEQ ID NO: 368611

SEQ ID NO: 612721 - RNA, 64 nt, Homo Sapiens; identical to SEQ ID NO: 368612

SEQ ID NO: 612722 - RNA, 64 nt, Homo Sapiens; identical to SEQ ID NO: 368613

SEQ ID NO: 612723 - RNA, 64 nt, Homo Sapiens; identical to SEQ ID NO: 247598

SEQ ID NO: 612724 - RNA, 64 nt, Homo Sapiens; identical to SEQ ID NO: 247599

SEQ ID NO: 612725 - RNA, 64 nt, Homo Sapiens; identical to SEQ ID NO: 247600

SEQ ID NO: 612726 - RNA, 64 nt, Homo Sapiens; identical to SEQ ID NO: 247601

SEQ ID NO: 612727 - RNA, 64 nt, Homo Sapiens; identical to SEQ ID NO: 247602

SEQ ID NO: 612728 - RNA, 64 nt, Homo Sapiens; identical to SEQ ID NO: 247603

SEQ ID NO: 612729 - RNA, 64 nt, Homo Sapiens; identical to SEQ ID NO: 247604

SEQ ID NO: 612730 - RNA, 64 nt, Homo Sapiens; identical to SEQ ID NO: 247605

SEQ ID NO: 612731 - RNA, 64 nt, Homo Sapiens; identical to SEQ ID NO: 247606

SEQ ID NO: 612732 - RNA, 64 nt, Homo Sapiens; identical to SEQ ID NO: 247607

SEQ ID NO: 612733 - RNA, 64 nt, Homo Sapiens; identical to SEQ ID NO: 247608

SEQ ID NO: 612734 - RNA, 64 nt, Homo Sapiens; identical to SEQ ID NO: 247609

SEQ ID NO: 612735 - RNA, 64 nt, Homo Sapiens; identical to SEQ ID NO: 247610

SEQ ID NO: 612736 - RNA, 64 nt, Homo Sapiens; identical to SEQ ID NO: 247611

SEQ ID NO: 612737 - RNA, 64 nt, Homo Sapiens; identical to SEQ ID NO: 247612

SEQ ID NO: 612738 - RNA, 64 nt, Homo Sapiens; identical to SEQ ID NO: 247613

SEQ ID NO: 612739 - RNA, 64 nt, Homo Sapiens
uuacugauucuucuguaucgaccucagcaaaauaauccaugaaucagaggcuuuaaaauuuaaa

SEQ ID NO: 612740 - RNA, 64 nt, Homo Sapiens
uggucuucuauuaauacuuugauagaauaagcaaauccaugaaccaugaguuuugucucagcag

SEQ ID NO: 612741 - RNA, 64 nt, Homo Sapiens
cuuuccuguaaaagggguucaucuuaacaaagucauccaugaugagggaaaaaguggcauuuca

SEQ ID NO: 612742 - RNA, 64 nt, Homo Sapiens
gaugagggaaaaaguggcauuucauuuuuggggaauccaugagcuuccuuuauuucuggcucac

SEQ ID NO: 612743 - RNA, 64 nt, Homo Sapiens
ucagccucauuuggacuaaaaaaagaaagcagaaauccaugaacacauugcuucucggccuuuu

SEQ ID NO: 612744 - RNA, 64 nt, Homo Sapiens
cuucucggccuuuuggcuaagaucaaguguagaaauccaugaacacuaaaggacuucauugauu

SEQ ID NO: 612745 - RNA, 64 nt, Homo Sapiens; identical to SEQ ID NO: 239152

SEQ ID NO: 612746 - RNA, 64 nt, Homo Sapiens; identical to SEQ ID NO: 239153

SEQ ID NO: 612747 - RNA, 64 nt, Homo Sapiens; identical to SEQ ID NO: 239154

SEQ ID NO: 612748 - RNA, 64 nt, Homo Sapiens; identical to SEQ ID NO: 239155

SEQ ID NO: 612749 - RNA, 64 nt, Homo Sapiens; identical to SEQ ID NO: 239156

SEQ ID NO: 612750 - RNA, 64 nt, Homo Sapiens; identical to SEQ ID NO: 239157

SEQ ID NO: 612751 - RNA, 64 nt, Homo Sapiens; identical to SEQ ID NO: 239158

SEQ ID NO: 612752 - RNA, 64 nt, Homo Sapiens; identical to SEQ ID NO: 239159

SEQ ID NO: 612753 - RNA, 64 nt, Homo Sapiens; identical to SEQ ID NO: 239160

SEQ ID NO: 612754 - RNA, 64 nt, Homo Sapiens; identical to SEQ ID NO: 239161

SEQ ID NO: 612755 - RNA, 64 nt, Homo Sapiens; identical to SEQ ID NO: 239162

SEQ ID NO: 612756 - RNA, 64 nt, Homo Sapiens; identical to SEQ ID NO: 239163

SEQ ID NO: 612757 - RNA, 64 nt, Homo Sapiens; identical to SEQ ID NO: 239164

SEQ ID NO: 612758 - RNA, 64 nt, Homo Sapiens; identical to SEQ ID NO: 239165

SEQ ID NO: 612759 - RNA, 64 nt, Homo Sapiens; identical to SEQ ID NO: 239166

SEQ ID NO: 612760 - RNA, 64 nt, Homo Sapiens; identical to SEQ ID NO: 239167

SEQ ID NO: 612761 - RNA, 64 nt, Homo Sapiens; identical to SEQ ID NO: 239168

SEQ ID NO: 612762 - RNA, 64 nt, Homo Sapiens; identical to SEQ ID NO: 239169

SEQ ID NO: 612763 - RNA, 64 nt, Homo Sapiens; identical to SEQ ID NO: 239170

SEQ ID NO: 612764 - RNA, 64 nt, Homo Sapiens; identical to SEQ ID NO: 239171

SEQ ID NO: 612765 - RNA, 64 nt, Homo Sapiens; identical to SEQ ID NO: 239172

SEQ ID NO: 612766 - RNA, 64 nt, Homo Sapiens; identical to SEQ ID NO: 239173

SEQ ID NO: 612767 - RNA, 64 nt, Homo Sapiens; identical to SEQ ID NO: 239174

SEQ ID NO: 612768 - RNA, 64 nt, Homo Sapiens; identical to SEQ ID NO: 239175

SEQ ID NO: 612769 - RNA, 64 nt, Homo Sapiens; identical to SEQ ID NO: 239176

SEQ ID NO: 612770 - RNA, 64 nt, Homo Sapiens; identical to SEQ ID NO: 239177

SEQ ID NO: 612771 - RNA, 64 nt, Homo Sapiens; identical to SEQ ID NO: 239178

SEQ ID NO: 612772 - RNA, 64 nt, Homo Sapiens; identical to SEQ ID NO: 239179

SEQ ID NO: 612773 - RNA, 64 nt, Homo Sapiens; identical to SEQ ID NO: 239180

SEQ ID NO: 612774 - RNA, 64 nt, Homo Sapiens; identical to SEQ ID NO: 239181

SEQ ID NO: 612775 - RNA, 64 nt, Homo Sapiens; identical to SEQ ID NO: 239182

SEQ ID NO: 612776 - RNA, 64 nt, Homo Sapiens; identical to SEQ ID NO: 239183

SEQ ID NO: 612777 - RNA, 64 nt, Homo Sapiens; identical to SEQ ID NO: 239184

SEQ ID NO: 612778 - RNA, 64 nt, Homo Sapiens; identical to SEQ ID NO: 239185

SEQ ID NO: 612779 - RNA, 64 nt, Homo Sapiens; identical to SEQ ID NO: 239186

SEQ ID NO: 612780 - RNA, 64 nt, Homo Sapiens; identical to SEQ ID NO: 239187

SEQ ID NO: 612781 - RNA, 64 nt, Homo Sapiens; identical to SEQ ID NO: 239188

SEQ ID NO: 612782 - RNA, 64 nt, Homo Sapiens; identical to SEQ ID NO: 239189

SEQ ID NO: 612783 - RNA, 64 nt, Homo Sapiens; identical to SEQ ID NO: 239190

SEQ ID NO: 612784 - RNA, 64 nt, Homo Sapiens; identical to SEQ ID NO: 239191

SEQ ID NO: 612785 - RNA, 64 nt, Homo Sapiens; identical to SEQ ID NO: 239192

SEQ ID NO: 612786 - RNA, 64 nt, Homo Sapiens; identical to SEQ ID NO: 239193

SEQ ID NO: 612787 - RNA, 64 nt, Homo Sapiens; identical to SEQ ID NO: 239194

SEQ ID NO: 612788 - RNA, 64 nt, Homo Sapiens; identical to SEQ ID NO: 239195

SEQ ID NO: 612789 - RNA, 64 nt, Homo Sapiens; identical to SEQ ID NO: 239196

SEQ ID NO: 612790 - RNA, 64 nt, Homo Sapiens; identical to SEQ ID NO: 239197

SEQ ID NO: 612791 - RNA, 64 nt, Homo Sapiens; identical to SEQ ID NO: 239198

SEQ ID NO: 612792 - RNA, 64 nt, Homo Sapiens; identical to SEQ ID NO: 239199

SEQ ID NO: 612793 - RNA, 64 nt, Homo Sapiens; identical to SEQ ID NO: 239200

SEQ ID NO: 612794 - RNA, 64 nt, Homo Sapiens; identical to SEQ ID NO: 239201

SEQ ID NO: 612795 - RNA, 64 nt, Homo Sapiens; identical to SEQ ID NO: 239202

SEQ ID NO: 612796 - RNA, 64 nt, Homo Sapiens; identical to SEQ ID NO: 239203

SEQ ID NO: 612797 - RNA, 64 nt, Homo Sapiens; identical to SEQ ID NO: 239204

SEQ ID NO: 612798 - RNA, 64 nt, Homo Sapiens; identical to SEQ ID NO: 239205

SEQ ID NO: 612799 - RNA, 64 nt, Homo Sapiens; identical to SEQ ID NO: 239206

SEQ ID NO: 612800 - RNA, 64 nt, Homo Sapiens; identical to SEQ ID NO: 239207

SEQ ID NO: 612801 - RNA, 64 nt, Homo Sapiens; identical to SEQ ID NO: 255843

SEQ ID NO: 612802 - RNA, 64 nt, Homo Sapiens; identical to SEQ ID NO: 255844

SEQ ID NO: 612803 - RNA, 64 nt, Homo Sapiens; identical to SEQ ID NO: 255845

SEQ ID NO: 612804 - RNA, 64 nt, Homo Sapiens; identical to SEQ ID NO: 255846

SEQ ID NO: 612805 - RNA, 64 nt, Homo Sapiens; identical to SEQ ID NO: 255847

SEQ ID NO: 612806 - RNA, 64 nt, Homo Sapiens; identical to SEQ ID NO: 255848

SEQ ID NO: 612807 - RNA, 64 nt, Homo Sapiens; identical to SEQ ID NO: 255849

SEQ ID NO: 612808 - RNA, 64 nt, Homo Sapiens; identical to SEQ ID NO: 255850

SEQ ID NO: 612809 - RNA, 64 nt, Homo Sapiens; identical to SEQ ID NO: 255851

SEQ ID NO: 612810 - RNA, 64 nt, Homo Sapiens; identical to SEQ ID NO: 255852

SEQ ID NO: 612811 - RNA, 64 nt, Homo Sapiens; identical to SEQ ID NO: 344518

SEQ ID NO: 612812 - RNA, 64 nt, Homo Sapiens; identical to SEQ ID NO: 344519

SEQ ID NO: 612813 - RNA, 64 nt, Homo Sapiens; identical to SEQ ID NO: 344520

SEQ ID NO: 612814 - RNA, 64 nt, Homo Sapiens; identical to SEQ ID NO: 344521

SEQ ID NO: 612815 - RNA, 64 nt, Homo Sapiens; identical to SEQ ID NO: 344522

SEQ ID NO: 612816 - RNA, 64 nt, Homo Sapiens; identical to SEQ ID NO: 344523

SEQ ID NO: 612817 - RNA, 64 nt, Homo Sapiens; identical to SEQ ID NO: 344524

SEQ ID NO: 612818 - RNA, 64 nt, Homo Sapiens; identical to SEQ ID NO: 344525

SEQ ID NO: 612819 - RNA, 64 nt, Homo Sapiens; identical to SEQ ID NO: 344526

SEQ ID NO: 612820 - RNA, 64 nt, Homo Sapiens; identical to SEQ ID NO: 344527

SEQ ID NO: 612821 - RNA, 64 nt, Homo Sapiens; identical to SEQ ID NO: 344528

SEQ ID NO: 612822 - RNA, 64 nt, Homo Sapiens; identical to SEQ ID NO: 344529

SEQ ID NO: 612823 - RNA, 64 nt, Homo Sapiens; identical to SEQ ID NO: 344530

SEQ ID NO: 612824 - RNA, 64 nt, Homo Sapiens; identical to SEQ ID NO: 344531

SEQ ID NO: 612825 - RNA, 64 nt, Homo Sapiens; identical to SEQ ID NO: 344532

SEQ ID NO: 612826 - RNA, 64 nt, Homo Sapiens; identical to SEQ ID NO: 344533

SEQ ID NO: 612827 - RNA, 64 nt, Homo Sapiens; identical to SEQ ID NO: 344534

SEQ ID NO: 612828 - RNA, 64 nt, Homo Sapiens; identical to SEQ ID NO: 344535

SEQ ID NO: 612829 - RNA, 64 nt, Homo Sapiens; identical to SEQ ID NO: 344536

SEQ ID NO: 612830 - RNA, 64 nt, Homo Sapiens; identical to SEQ ID NO: 344537

SEQ ID NO: 612831 - RNA, 64 nt, Homo Sapiens; identical to SEQ ID NO: 344538

SEQ ID NO: 612832 - RNA, 64 nt, Homo Sapiens; identical to SEQ ID NO: 344539

SEQ ID NO: 612833 - RNA, 64 nt, Homo Sapiens; identical to SEQ ID NO: 344540

SEQ ID NO: 612834 - RNA, 64 nt, Homo Sapiens; identical to SEQ ID NO: 344541

SEQ ID NO: 612835 - RNA, 64 nt, Homo Sapiens; identical to SEQ ID NO: 344542

SEQ ID NO: 612836 - RNA, 64 nt, Homo Sapiens; identical to SEQ ID NO: 217273

SEQ ID NO: 612837 - RNA, 64 nt, Homo Sapiens; identical to SEQ ID NO: 217274

SEQ ID NO: 612838 - RNA, 64 nt, Homo Sapiens; identical to SEQ ID NO: 217275

SEQ ID NO: 612839 - RNA, 64 nt, Homo Sapiens; identical to SEQ ID NO: 217276

SEQ ID NO: 612840 - RNA, 64 nt, Homo Sapiens; identical to SEQ ID NO: 217277

SEQ ID NO: 612841 - RNA, 64 nt, Homo Sapiens; identical to SEQ ID NO: 217278

SEQ ID NO: 612842 - RNA, 64 nt, Homo Sapiens; identical to SEQ ID NO: 217279

SEQ ID NO: 612843 - RNA, 64 nt, Homo Sapiens; identical to SEQ ID NO: 217280

SEQ ID NO: 612844 - RNA, 64 nt, Homo Sapiens; identical to SEQ ID NO: 217281

SEQ ID NO: 612845 - RNA, 64 nt, Homo Sapiens; identical to SEQ ID NO: 217282

SEQ ID NO: 612846 - RNA, 64 nt, Homo Sapiens; identical to SEQ ID NO: 217283

SEQ ID NO: 612847 - RNA, 64 nt, Homo Sapiens; identical to SEQ ID NO: 217284

SEQ ID NO: 612848 - RNA, 64 nt, Homo Sapiens; identical to SEQ ID NO: 217285

SEQ ID NO: 612849 - RNA, 64 nt, Homo Sapiens; identical to SEQ ID NO: 217286

SEQ ID NO: 612850 - RNA, 64 nt, Homo Sapiens; identical to SEQ ID NO: 217287

SEQ ID NO: 612851 - RNA, 64 nt, Homo Sapiens; identical to SEQ ID NO: 217288

SEQ ID NO: 612852 - RNA, 64 nt, Homo Sapiens; identical to SEQ ID NO: 217289

SEQ ID NO: 612853 - RNA, 64 nt, Homo Sapiens; identical to SEQ ID NO: 217290

SEQ ID NO: 612854 - RNA, 64 nt, Homo Sapiens; identical to SEQ ID NO: 217291

SEQ ID NO: 612855 - RNA, 64 nt, Homo Sapiens; identical to SEQ ID NO: 217292

SEQ ID NO: 612856 - RNA, 64 nt, Homo Sapiens; identical to SEQ ID NO: 217293

SEQ ID NO: 612857 - RNA, 64 nt, Homo Sapiens; identical to SEQ ID NO: 217294

SEQ ID NO: 612858 - RNA, 64 nt, Homo Sapiens; identical to SEQ ID NO: 217295

SEQ ID NO: 612859 - RNA, 62 nt, Homo Sapiens
augcaggacuacccccuuaccauuuuaagaagguacuuuauacauuuauuuaauccuacuaa

SEQ ID NO: 612860 - RNA, 62 nt, Homo Sapiens
aguaugaaugauuagagaaaauuugagucaguguacuuuauagugugaauccugugagcuaa

SEQ ID NO: 612861 - RNA, 62 nt, Homo Sapiens
gcaacauucgccauacuagcuaagaaauaaagguacuuuacagaaacugucgcugaagcacu

SEQ ID NO: 612862 - RNA, 62 nt, Homo Sapiens
auuuauuucagaaauguugaaguucaccuuuuguacuuuacuacuagauguuuuucaaggua

SEQ ID NO: 612863 - RNA, 62 nt, Homo Sapiens
aagguaugguguucagaacuauauuauaccaaguacuuuauuuaucguuuucacaaaacuau

SEQ ID NO: 612864 - RNA, 62 nt, Homo Sapiens
uacagcaguccuuggcauuuguaugguaauuuguacuuuacaaauacuuugauauauuauaa

SEQ ID NO: 612865 - RNA, 62 nt, Homo Sapiens
uaacuguguuuagcucauuuaaaucaaaauguguacuuuaaucuaaaauguuuuaauaaucu

SEQ ID NO: 612866 - RNA, 62 nt, Homo Sapiens
uuuugguuuauuuauacuauauucugcauacaguacuuuaaaugccaauuacagugcaaucu

SEQ ID NO: 612867 - RNA, 62 nt, Homo Sapiens
cuaauugguugaauuuuuuuuuuaaguaaauaguacuuuaggccaaaauuuauaugaauauu

SEQ ID NO: 612868 - RNA, 62 nt, Homo Sapiens
ugcacgggugugcaugccugccauuucucuauguacuuuauaagcccacgggaauaucucca

SEQ ID NO: 612869 - RNA, 62 nt, Homo Sapiens
aagauugccaaaaacuguuauuguaauauauuguacuuuauuacaacuauuuuuugguuugg

SEQ ID NO: 612870 - RNA, 62 nt, Homo Sapiens
gagggauucugaugugcuaggcaugguucuaaguacuuuacuuguauuaucccauuuaauac

SEQ ID NO: 612871 - RNA, 62 nt, Homo Sapiens
guucuccugccugcauaaccauucauuagggaguacuuuacaagcaugaaggauauuagggu

SEQ ID NO: 612872 - RNA, 62 nt, Homo Sapiens
cauuucgcuauacucucuuccggccacucucuguacuuuaaacugggauuacuccccgugcc

SEQ ID NO: 612873 - RNA, 62 nt, Homo Sapiens
uaauuuauuauuauuauuuuuuuuuucucucuguacuuuauuuauaauucuaguugaugaau

SEQ ID NO: 612874 - RNA, 62 nt, Homo Sapiens
uugcaaagucuuccgggccuguauuauaggcaguacuuuaaaucgguccuuuuuaaucuggg

SEQ ID NO: 612875 - RNA, 62 nt, Homo Sapiens
aaguauuguaggcacgguggagugcuuuuuugguacuuuaacaaagaauguguuucaguauc

SEQ ID NO: 612876 - RNA, 62 nt, Homo Sapiens
aaaucuggaguuaguucauagguacaauucuuguacuuuagcaacaaaauauaauuauuuau

SEQ ID NO: 612877 - RNA, 62 nt, Homo Sapiens
cauacgcuugucuccugaauuaugcugauauuguacuuuagaaacuugauccuauuaauuua

SEQ ID NO: 612878 - RNA, 62 nt, Homo Sapiens
caugaaugcaacuauuuaaaagaaaaccaaauguacuuuagaagaauguacauuuucuuuuu

SEQ ID NO: 612879 - RNA, 62 nt, Homo Sapiens
auauuuauauauuguuuuauauucuucauaugguacuuuaccgauauauauuguauguguuu

SEQ ID NO: 612880 - RNA, 64 nt, Homo Sapiens; identical to SEQ ID NO: 526504

SEQ ID NO: 612881 - RNA, 64 nt, Homo Sapiens; identical to SEQ ID NO: 526505

SEQ ID NO: 612882 - RNA, 64 nt, Homo Sapiens; identical to SEQ ID NO: 526506

SEQ ID NO: 612883 - RNA, 64 nt, Homo Sapiens; identical to SEQ ID NO: 526507

SEQ ID NO: 612884 - RNA, 64 nt, Homo Sapiens; identical to SEQ ID NO: 526508

SEQ ID NO: 612885 - RNA, 64 nt, Homo Sapiens; identical to SEQ ID NO: 526509

SEQ ID NO: 612886 - RNA, 64 nt, Homo Sapiens; identical to SEQ ID NO: 526510

SEQ ID NO: 612887 - RNA, 64 nt, Homo Sapiens; identical to SEQ ID NO: 526511

SEQ ID NO: 612888 - RNA, 64 nt, Homo Sapiens; identical to SEQ ID NO: 526512

SEQ ID NO: 612889 - RNA, 64 nt, Homo Sapiens; identical to SEQ ID NO: 526513

SEQ ID NO: 612890 - RNA, 64 nt, Homo Sapiens; identical to SEQ ID NO: 526514

SEQ ID NO: 612891 - RNA, 64 nt, Homo Sapiens; identical to SEQ ID NO: 526515

SEQ ID NO: 612892 - RNA, 64 nt, Homo Sapiens; identical to SEQ ID NO: 526516

SEQ ID NO: 612893 - RNA, 64 nt, Homo Sapiens; identical to SEQ ID NO: 526517

SEQ ID NO: 612894 - RNA, 64 nt, Homo Sapiens; identical to SEQ ID NO: 526518

SEQ ID NO: 612895 - RNA, 64 nt, Homo Sapiens; identical to SEQ ID NO: 526519

SEQ ID NO: 612896 - RNA, 64 nt, Homo Sapiens; identical to SEQ ID NO: 526520

SEQ ID NO: 612897 - RNA, 64 nt, Homo Sapiens; identical to SEQ ID NO: 582350

SEQ ID NO: 612898 - RNA, 64 nt, Homo Sapiens; identical to SEQ ID NO: 582351

SEQ ID NO: 612899 - RNA, 64 nt, Homo Sapiens; identical to SEQ ID NO: 582352

SEQ ID NO: 612900 - RNA, 64 nt, Homo Sapiens; identical to SEQ ID NO: 582353

SEQ ID NO: 612901 - RNA, 64 nt, Homo Sapiens; identical to SEQ ID NO: 582354

SEQ ID NO: 612902 - RNA, 64 nt, Homo Sapiens; identical to SEQ ID NO: 582355

SEQ ID NO: 612903 - RNA, 64 nt, Homo Sapiens; identical to SEQ ID NO: 582356

SEQ ID NO: 612904 - RNA, 64 nt, Homo Sapiens; identical to SEQ ID NO: 582357

SEQ ID NO: 612905 - RNA, 64 nt, Homo Sapiens; identical to SEQ ID NO: 582358

SEQ ID NO: 612906 - RNA, 64 nt, Homo Sapiens; identical to SEQ ID NO: 582359

SEQ ID NO: 612907 - RNA, 64 nt, Homo Sapiens; identical to SEQ ID NO: 582360

SEQ ID NO: 612908 - RNA, 64 nt, Homo Sapiens; identical to SEQ ID NO: 582361

SEQ ID NO: 612909 - RNA, 64 nt, Homo Sapiens; identical to SEQ ID NO: 582362

SEQ ID NO: 612910 - RNA, 64 nt, Homo Sapiens; identical to SEQ ID NO: 582363

SEQ ID NO: 612911 - RNA, 64 nt, Homo Sapiens; identical to SEQ ID NO: 582364

SEQ ID NO: 612912 - RNA, 64 nt, Homo Sapiens; identical to SEQ ID NO: 582365

SEQ ID NO: 612913 - RNA, 64 nt, Homo Sapiens; identical to SEQ ID NO: 582366

SEQ ID NO: 612914 - RNA, 64 nt, Homo Sapiens; identical to SEQ ID NO: 582367

SEQ ID NO: 612915 - RNA, 64 nt, Homo Sapiens; identical to SEQ ID NO: 582368

SEQ ID NO: 612916 - RNA, 64 nt, Homo Sapiens; identical to SEQ ID NO: 582369

SEQ ID NO: 612917 - RNA, 64 nt, Homo Sapiens; identical to SEQ ID NO: 582370

SEQ ID NO: 612918 - RNA, 64 nt, Homo Sapiens; identical to SEQ ID NO: 582371

SEQ ID NO: 612919 - RNA, 64 nt, Homo Sapiens; identical to SEQ ID NO: 364294

SEQ ID NO: 612920 - RNA, 64 nt, Homo Sapiens; identical to SEQ ID NO: 364295

SEQ ID NO: 612921 - RNA, 64 nt, Homo Sapiens; identical to SEQ ID NO: 364296

SEQ ID NO: 612922 - RNA, 64 nt, Homo Sapiens; identical to SEQ ID NO: 364297

SEQ ID NO: 612923 - RNA, 64 nt, Homo Sapiens; identical to SEQ ID NO: 48789

SEQ ID NO: 612924 - RNA, 64 nt, Homo Sapiens; identical to SEQ ID NO: 48790

SEQ ID NO: 612925 - RNA, 64 nt, Homo Sapiens; identical to SEQ ID NO: 48791

SEQ ID NO: 612926 - RNA, 64 nt, Homo Sapiens; identical to SEQ ID NO: 48792

SEQ ID NO: 612927 - RNA, 64 nt, Homo Sapiens; identical to SEQ ID NO: 164139

SEQ ID NO: 612928 - RNA, 64 nt, Homo Sapiens; identical to SEQ ID NO: 164140

SEQ ID NO: 612929 - RNA, 64 nt, Homo Sapiens; identical to SEQ ID NO: 164141

SEQ ID NO: 612930 - RNA, 64 nt, Homo Sapiens; identical to SEQ ID NO: 164142

SEQ ID NO: 612931 - RNA, 64 nt, Homo Sapiens; identical to SEQ ID NO: 164143

SEQ ID NO: 612932 - RNA, 64 nt, Homo Sapiens; identical to SEQ ID NO: 164144

SEQ ID NO: 612933 - RNA, 64 nt, Homo Sapiens; identical to SEQ ID NO: 164145

SEQ ID NO: 612934 - RNA, 64 nt, Homo Sapiens; identical to SEQ ID NO: 164146

SEQ ID NO: 612935 - RNA, 64 nt, Homo Sapiens; identical to SEQ ID NO: 164147

SEQ ID NO: 612936 - RNA, 64 nt, Homo Sapiens; identical to SEQ ID NO: 164148

SEQ ID NO: 612937 - RNA, 64 nt, Homo Sapiens
ccuucauccuccccaccuaaugcauuuuugaaaccaaagguaccuagccucagagacagagaag

SEQ ID NO: 612938 - RNA, 64 nt, Homo Sapiens
uuauuaaagcaacauuugccacauguuuaagccgcaaagguauuagcaaugcuugcaucauuaa

SEQ ID NO: 612939 - RNA, 64 nt, Homo Sapiens
ucauguuuagguaauuaacuacuccauuuaagagcaaagguaacacugacaaaaugaucugacu

SEQ ID NO: 612940 - RNA, 64 nt, Homo Sapiens
cauaauuaaucuaauaaaggauauaauuaaauuacaaagguauauuccaaugcucccuuuaacc

SEQ ID NO: 612941 - RNA, 64 nt, Homo Sapiens
aauccauuaaaaccuuaaguuuuuugggugucugcaaagguaaaaaaauauuuauuuuauuuuu

SEQ ID NO: 612942 - RNA, 64 nt, Homo Sapiens
uggaauguauauacuuuugcgauuauggcuaaaucaaagguaacaaaaaaaagcauacauaugu

SEQ ID NO: 612943 - RNA, 64 nt, Homo Sapiens
aaggucaaggucauuucuuaaaaaaaaacaaacccaaagguaggaaacacguggucaugaauag

SEQ ID NO: 612944 - RNA, 64 nt, Homo Sapiens
aguacaauaagcguuaagggaauucaguccugggcaaagguauucaguauuacucucgagaggc

SEQ ID NO: 612945 - RNA, 64 nt, Homo Sapiens; identical to SEQ ID NO: 463735

SEQ ID NO: 612946 - RNA, 64 nt, Homo Sapiens; identical to SEQ ID NO: 463736

SEQ ID NO: 612947 - RNA, 64 nt, Homo Sapiens; identical to SEQ ID NO: 463737

SEQ ID NO: 612948 - RNA, 64 nt, Homo Sapiens; identical to SEQ ID NO: 463738

SEQ ID NO: 612949 - RNA, 64 nt, Homo Sapiens; identical to SEQ ID NO: 463739

SEQ ID NO: 612950 - RNA, 64 nt, Homo Sapiens; identical to SEQ ID NO: 463740

SEQ ID NO: 612951 - RNA, 64 nt, Homo Sapiens
acgcccggggcgcgccggcucagggaggcucggggccgcccaugcagacuuuuggccuggcgcg

SEQ ID NO: 612952 - RNA, 64 nt, Homo Sapiens
cgauucccugggcuccaggcucccccgcgcgggcgccgcccaccgccauacuaaacgaucgagg

SEQ ID NO: 612953 - RNA, 64 nt, Homo Sapiens
accuuggaggccuucccuggaugacucguuaccugccgcccaucuccagguggcgugagaggca

SEQ ID NO: 612954 - RNA, 64 nt, Homo Sapiens
ucccguuuccucuuuaacuguggucagaaggccagccgcccacuuccugguucaaacgggugcc

SEQ ID NO: 612955 - RNA, 64 nt, Homo Sapiens
ugaggagccagcggccaccugcggggagaccaccgccgcccagacuacugacggcaggggcugc

SEQ ID NO: 612956 - RNA, 64 nt, Homo Sapiens
ggagucacccugagggccccgggcaguugcccuggccgcccagugacgcccaccggcucccucc

SEQ ID NO: 612957 - RNA, 53 nt, Homo Sapiens
accaggagacggcuguguagcgggccgcccacgggcagcaggagggacaaugc

SEQ ID NO: 612958 - RNA, 64 nt, Homo Sapiens
cccagggaaagagccccaugccgcccccuaaggagccgcccagaccuagggcuggacucaggag

SEQ ID NO: 612959 - RNA, 64 nt, Homo Sapiens
ggagacgccccuccaacuggcgggugugaaggaagccgcccagggguccgggcuguccuuggcc

SEQ ID NO: 612960 - RNA, 64 nt, Homo Sapiens
cuccgggugacaccagccccgucuccagccuugagccgcccaugcugaugcgaccucggcugac

SEQ ID NO: 612961 - RNA, 64 nt, Homo Sapiens
ucuccuuggugaacaaggccucacggcaccgcuggccgcccacacgugcucaugaagcgcucca

SEQ ID NO: 612962 - RNA, 64 nt, Homo Sapiens
gcucaucuuuugcgccccgugaguccauguccgagccgcccauuagcgguacccggacaguuac

SEQ ID NO: 612963 - RNA, 64 nt, Homo Sapiens; identical to SEQ ID NO: 132800

SEQ ID NO: 612964 - RNA, 64 nt, Homo Sapiens; identical to SEQ ID NO: 132801

SEQ ID NO: 612965 - RNA, 64 nt, Homo Sapiens; identical to SEQ ID NO: 132802

SEQ ID NO: 612966 - RNA, 64 nt, Homo Sapiens; identical to SEQ ID NO: 132803

SEQ ID NO: 612967 - RNA, 64 nt, Homo Sapiens; identical to SEQ ID NO: 132804

SEQ ID NO: 612968 - RNA, 64 nt, Homo Sapiens; identical to SEQ ID NO: 132805

SEQ ID NO: 612969 - RNA, 64 nt, Homo Sapiens; identical to SEQ ID NO: 132806

SEQ ID NO: 612970 - RNA, 64 nt, Homo Sapiens; identical to SEQ ID NO: 132807

SEQ ID NO: 612971 - RNA, 64 nt, Homo Sapiens; identical to SEQ ID NO: 132808

SEQ ID NO: 612972 - RNA, 64 nt, Homo Sapiens; identical to SEQ ID NO: 132809

SEQ ID NO: 612973 - RNA, 64 nt, Homo Sapiens; identical to SEQ ID NO: 132810

SEQ ID NO: 612974 - RNA, 64 nt, Homo Sapiens; identical to SEQ ID NO: 132811

SEQ ID NO: 612975 - RNA, 64 nt, Homo Sapiens; identical to SEQ ID NO: 132812

SEQ ID NO: 612976 - RNA, 64 nt, Homo Sapiens; identical to SEQ ID NO: 132813

SEQ ID NO: 612977 - RNA, 64 nt, Homo Sapiens; identical to SEQ ID NO: 132814

SEQ ID NO: 612978 - RNA, 64 nt, Homo Sapiens; identical to SEQ ID NO: 132815

SEQ ID NO: 612979 - RNA, 64 nt, Homo Sapiens; identical to SEQ ID NO: 132816

SEQ ID NO: 612980 - RNA, 64 nt, Homo Sapiens; identical to SEQ ID NO: 132817

SEQ ID NO: 612981 - RNA, 64 nt, Homo Sapiens; identical to SEQ ID NO: 132818

SEQ ID NO: 612982 - RNA, 64 nt, Homo Sapiens; identical to SEQ ID NO: 132819

SEQ ID NO: 612983 - RNA, 64 nt, Homo Sapiens; identical to SEQ ID NO: 132820

SEQ ID NO: 612984 - RNA, 64 nt, Homo Sapiens; identical to SEQ ID NO: 132821

SEQ ID NO: 612985 - RNA, 64 nt, Homo Sapiens; identical to SEQ ID NO: 132822

SEQ ID NO: 612986 - RNA, 64 nt, Homo Sapiens; identical to SEQ ID NO: 132823

SEQ ID NO: 612987 - RNA, 64 nt, Homo Sapiens; identical to SEQ ID NO: 132824

SEQ ID NO: 612988 - RNA, 64 nt, Homo Sapiens; identical to SEQ ID NO: 132825

SEQ ID NO: 612989 - RNA, 64 nt, Homo Sapiens; identical to SEQ ID NO: 132826

SEQ ID NO: 612990 - RNA, 64 nt, Homo Sapiens; identical to SEQ ID NO: 132827

SEQ ID NO: 612991 - RNA, 64 nt, Homo Sapiens; identical to SEQ ID NO: 132828

SEQ ID NO: 612992 - RNA, 64 nt, Homo Sapiens; identical to SEQ ID NO: 132829

SEQ ID NO: 612993 - RNA, 64 nt, Homo Sapiens; identical to SEQ ID NO: 132830

SEQ ID NO: 612994 - RNA, 64 nt, Homo Sapiens; identical to SEQ ID NO: 132831

SEQ ID NO: 612995 - RNA, 64 nt, Homo Sapiens; identical to SEQ ID NO: 132832

SEQ ID NO: 612996 - RNA, 64 nt, Homo Sapiens; identical to SEQ ID NO: 132833

SEQ ID NO: 612997 - RNA, 64 nt, Homo Sapiens; identical to SEQ ID NO: 132834

SEQ ID NO: 612998 - RNA, 64 nt, Homo Sapiens; identical to SEQ ID NO: 132835

SEQ ID NO: 612999 - RNA, 64 nt, Homo Sapiens; identical to SEQ ID NO: 132836

SEQ ID NO: 613000 - RNA, 64 nt, Homo Sapiens; identical to SEQ ID NO: 132837

SEQ ID NO: 613001 - RNA, 64 nt, Homo Sapiens; identical to SEQ ID NO: 132838

SEQ ID NO: 613002 - RNA, 64 nt, Homo Sapiens; identical to SEQ ID NO: 132839

SEQ ID NO: 613003 - RNA, 64 nt, Homo Sapiens; identical to SEQ ID NO: 132840

SEQ ID NO: 613004 - RNA, 64 nt, Homo Sapiens; identical to SEQ ID NO: 132841

SEQ ID NO: 613005 - RNA, 64 nt, Homo Sapiens; identical to SEQ ID NO: 132842

SEQ ID NO: 613006 - RNA, 64 nt, Homo Sapiens; identical to SEQ ID NO: 132843

SEQ ID NO: 613007 - RNA, 64 nt, Homo Sapiens; identical to SEQ ID NO: 132844

SEQ ID NO: 613008 - RNA, 58 nt, Homo Sapiens; identical to SEQ ID NO: 132845

SEQ ID NO: 613009 - RNA, 64 nt, Homo Sapiens; identical to SEQ ID NO: 132846

SEQ ID NO: 613010 - RNA, 64 nt, Homo Sapiens; identical to SEQ ID NO: 132847

SEQ ID NO: 613011 - RNA, 64 nt, Homo Sapiens; identical to SEQ ID NO: 132848

SEQ ID NO: 613012 - RNA, 64 nt, Homo Sapiens; identical to SEQ ID NO: 132849

SEQ ID NO: 613013 - RNA, 64 nt, Homo Sapiens; identical to SEQ ID NO: 132850

SEQ ID NO: 613014 - RNA, 64 nt, Homo Sapiens; identical to SEQ ID NO: 132851

SEQ ID NO: 613015 - RNA, 64 nt, Homo Sapiens; identical to SEQ ID NO: 132852

SEQ ID NO: 613016 - RNA, 64 nt, Homo Sapiens; identical to SEQ ID NO: 132853

SEQ ID NO: 613017 - RNA, 64 nt, Homo Sapiens; identical to SEQ ID NO: 132854

SEQ ID NO: 613018 - RNA, 64 nt, Homo Sapiens; identical to SEQ ID NO: 132855

SEQ ID NO: 613019 - RNA, 64 nt, Homo Sapiens; identical to SEQ ID NO: 132856

SEQ ID NO: 613020 - RNA, 64 nt, Homo Sapiens; identical to SEQ ID NO: 132857

SEQ ID NO: 613021 - RNA, 64 nt, Homo Sapiens; identical to SEQ ID NO: 132858

SEQ ID NO: 613022 - RNA, 64 nt, Homo Sapiens; identical to SEQ ID NO: 132859

SEQ ID NO: 613023 - RNA, 64 nt, Homo Sapiens; identical to SEQ ID NO: 132860

SEQ ID NO: 613024 - RNA, 64 nt, Homo Sapiens; identical to SEQ ID NO: 132861

SEQ ID NO: 613025 - RNA, 64 nt, Homo Sapiens; identical to SEQ ID NO: 132862

SEQ ID NO: 613026 - RNA, 64 nt, Homo Sapiens; identical to SEQ ID NO: 132863

SEQ ID NO: 613027 - RNA, 64 nt, Homo Sapiens; identical to SEQ ID NO: 132864

SEQ ID NO: 613028 - RNA, 64 nt, Homo Sapiens; identical to SEQ ID NO: 132865

SEQ ID NO: 613029 - RNA, 64 nt, Homo Sapiens; identical to SEQ ID NO: 132866

SEQ ID NO: 613030 - RNA, 64 nt, Homo Sapiens; identical to SEQ ID NO: 132867

SEQ ID NO: 613031 - RNA, 64 nt, Homo Sapiens; identical to SEQ ID NO: 132868

SEQ ID NO: 613032 - RNA, 64 nt, Homo Sapiens; identical to SEQ ID NO: 132869

SEQ ID NO: 613033 - RNA, 64 nt, Homo Sapiens; identical to SEQ ID NO: 132870

SEQ ID NO: 613034 - RNA, 64 nt, Homo Sapiens; identical to SEQ ID NO: 132871

SEQ ID NO: 613035 - RNA, 64 nt, Homo Sapiens; identical to SEQ ID NO: 132872

SEQ ID NO: 613036 - RNA, 64 nt, Homo Sapiens; identical to SEQ ID NO: 132873

SEQ ID NO: 613037 - RNA, 64 nt, Homo Sapiens; identical to SEQ ID NO: 132874

SEQ ID NO: 613038 - RNA, 64 nt, Homo Sapiens; identical to SEQ ID NO: 132875

SEQ ID NO: 613039 - RNA, 64 nt, Homo Sapiens; identical to SEQ ID NO: 132876

SEQ ID NO: 613040 - RNA, 64 nt, Homo Sapiens; identical to SEQ ID NO: 132877

SEQ ID NO: 613041 - RNA, 64 nt, Homo Sapiens; identical to SEQ ID NO: 132878

SEQ ID NO: 613042 - RNA, 64 nt, Homo Sapiens; identical to SEQ ID NO: 132879

SEQ ID NO: 613043 - RNA, 64 nt, Homo Sapiens; identical to SEQ ID NO: 132880

SEQ ID NO: 613044 - RNA, 64 nt, Homo Sapiens; identical to SEQ ID NO: 132881

SEQ ID NO: 613045 - RNA, 64 nt, Homo Sapiens; identical to SEQ ID NO: 132882

SEQ ID NO: 613046 - RNA, 64 nt, Homo Sapiens; identical to SEQ ID NO: 132883

SEQ ID NO: 613047 - RNA, 64 nt, Homo Sapiens; identical to SEQ ID NO: 132884

SEQ ID NO: 613048 - RNA, 64 nt, Homo Sapiens; identical to SEQ ID NO: 132885

SEQ ID NO: 613049 - RNA, 64 nt, Homo Sapiens; identical to SEQ ID NO: 132886

SEQ ID NO: 613050 - RNA, 64 nt, Homo Sapiens; identical to SEQ ID NO: 132887

SEQ ID NO: 613051 - RNA, 64 nt, Homo Sapiens; identical to SEQ ID NO: 132888

SEQ ID NO: 613052 - RNA, 64 nt, Homo Sapiens; identical to SEQ ID NO: 132889

SEQ ID NO: 613053 - RNA, 64 nt, Homo Sapiens
ggcagggcagcacacggccagccccgcggccuggcgcuccgacugcccucugaggccuccggac

SEQ ID NO: 613054 - RNA, 64 nt, Homo Sapiens
gggguugcugcuuucccagugccaggagaacccccgcuccgagucagccugugugggucaugag

SEQ ID NO: 613055 - RNA, 64 nt, Homo Sapiens
ggcuuccucucucaggugcuugagcccagcacggcgcuccgacuagugcgcaggccagagugag

SEQ ID NO: 613056 - RNA, 64 nt, Homo Sapiens
aaaguauuaacuagcuaacagugaugggccaagacgcuccgagaacucuaccgggauugucugu

SEQ ID NO: 613057 - RNA, 64 nt, Homo Sapiens
uugacguggaaugcugugucugcuuuagcacgcacgcuccgaaugacuccuggugcuaggccau

SEQ ID NO: 613058 - RNA, 64 nt, Homo Sapiens
cucggcccugccccaaguagggguguccggcagccgcuccgagcgcgcgcgccuccgcgggggu

SEQ ID NO: 613059 - RNA, 64 nt, Homo Sapiens
gaccuggugcuggcugucugggaccgcagccugccgcuccgaacugagcccguaggcaaggugc

SEQ ID NO: 613060 - RNA, 64 nt, Homo Sapiens
ccagggugaucugcucaaagggaagagccggauccgcuccgacucagcaccuguaggaacuccc

SEQ ID NO: 613061 - RNA, 64 nt, Homo Sapiens
gcccaagaggcucucccgggggagcucuccagcccgcuccgaaacagagucgccgaagcucagg

SEQ ID NO: 613062 - RNA, 64 nt, Homo Sapiens
ccaauuccauuuauagaccaccuccagccagugacgcuccgaguugaggauguugaacaacaug

SEQ ID NO: 613063 - RNA, 64 nt, Homo Sapiens
gugggucuccgcccagcuccugccaguucacaaccgcuccgagccagaagccgcgcccaccgcc

SEQ ID NO: 613064 - RNA, 64 nt, Homo Sapiens
cccgggcccgggcccccgccccccggcggugccgcgcuccgaacggcgcccgcggcgcgacccu

SEQ ID NO: 613065 - RNA, 64 nt, Homo Sapiens
agacagcgucucauuggccagccgaguuauggagcgcuccgaccgggcgacucccuccccauug

SEQ ID NO: 613066 - RNA, 64 nt, Homo Sapiens
gccacacagauuugacuuucucagaaacuacgcccgcuccgagagagagauauugaacagauca

SEQ ID NO: 613067 - RNA, 64 nt, Homo Sapiens; identical to SEQ ID NO: 276789

SEQ ID NO: 613068 - RNA, 64 nt, Homo Sapiens; identical to SEQ ID NO: 276790

SEQ ID NO: 613069 - RNA, 64 nt, Homo Sapiens; identical to SEQ ID NO: 276791

SEQ ID NO: 613070 - RNA, 64 nt, Homo Sapiens; identical to SEQ ID NO: 276792

SEQ ID NO: 613071 - RNA, 64 nt, Homo Sapiens; identical to SEQ ID NO: 276793

SEQ ID NO: 613072 - RNA, 64 nt, Homo Sapiens; identical to SEQ ID NO: 276794

SEQ ID NO: 613073 - RNA, 64 nt, Homo Sapiens; identical to SEQ ID NO: 276795

SEQ ID NO: 613074 - RNA, 64 nt, Homo Sapiens; identical to SEQ ID NO: 276796

SEQ ID NO: 613075 - RNA, 64 nt, Homo Sapiens; identical to SEQ ID NO: 276797

SEQ ID NO: 613076 - RNA, 64 nt, Homo Sapiens; identical to SEQ ID NO: 276798

SEQ ID NO: 613077 - RNA, 64 nt, Homo Sapiens; identical to SEQ ID NO: 276799

SEQ ID NO: 613078 - RNA, 64 nt, Homo Sapiens; identical to SEQ ID NO: 276800

SEQ ID NO: 613079 - RNA, 64 nt, Homo Sapiens; identical to SEQ ID NO: 276801

SEQ ID NO: 613080 - RNA, 64 nt, Homo Sapiens; identical to SEQ ID NO: 276802

SEQ ID NO: 613081 - RNA, 64 nt, Homo Sapiens; identical to SEQ ID NO: 276803

SEQ ID NO: 613082 - RNA, 64 nt, Homo Sapiens; identical to SEQ ID NO: 276804

SEQ ID NO: 613083 - RNA, 64 nt, Homo Sapiens; identical to SEQ ID NO: 276805

SEQ ID NO: 613084 - RNA, 64 nt, Homo Sapiens; identical to SEQ ID NO: 276806

SEQ ID NO: 613085 - RNA, 64 nt, Homo Sapiens; identical to SEQ ID NO: 276807

SEQ ID NO: 613086 - RNA, 64 nt, Homo Sapiens; identical to SEQ ID NO: 276808

SEQ ID NO: 613087 - RNA, 64 nt, Homo Sapiens; identical to SEQ ID NO: 276809

SEQ ID NO: 613088 - RNA, 64 nt, Homo Sapiens; identical to SEQ ID NO: 276810

SEQ ID NO: 613089 - RNA, 64 nt, Homo Sapiens; identical to SEQ ID NO: 276811

SEQ ID NO: 613090 - RNA, 64 nt, Homo Sapiens; identical to SEQ ID NO: 276812

SEQ ID NO: 613091 - RNA, 64 nt, Homo Sapiens; identical to SEQ ID NO: 276813

SEQ ID NO: 613092 - RNA, 64 nt, Homo Sapiens; identical to SEQ ID NO: 276814

SEQ ID NO: 613093 - RNA, 64 nt, Homo Sapiens; identical to SEQ ID NO: 276815

SEQ ID NO: 613094 - RNA, 64 nt, Homo Sapiens; identical to SEQ ID NO: 276816

SEQ ID NO: 613095 - RNA, 64 nt, Homo Sapiens; identical to SEQ ID NO: 276817

SEQ ID NO: 613096 - RNA, 64 nt, Homo Sapiens; identical to SEQ ID NO: 276818

SEQ ID NO: 613097 - RNA, 64 nt, Homo Sapiens; identical to SEQ ID NO: 276819

SEQ ID NO: 613098 - RNA, 64 nt, Homo Sapiens; identical to SEQ ID NO: 276820

SEQ ID NO: 613099 - RNA, 64 nt, Homo Sapiens; identical to SEQ ID NO: 276821

SEQ ID NO: 613100 - RNA, 64 nt, Homo Sapiens; identical to SEQ ID NO: 276822

SEQ ID NO: 613101 - RNA, 64 nt, Homo Sapiens; identical to SEQ ID NO: 276823

SEQ ID NO: 613102 - RNA, 64 nt, Homo Sapiens; identical to SEQ ID NO: 276824

SEQ ID NO: 613103 - RNA, 64 nt, Homo Sapiens; identical to SEQ ID NO: 276825

SEQ ID NO: 613104 - RNA, 64 nt, Homo Sapiens; identical to SEQ ID NO: 276826

SEQ ID NO: 613105 - RNA, 64 nt, Homo Sapiens; identical to SEQ ID NO: 276827

SEQ ID NO: 613106 - RNA, 64 nt, Homo Sapiens; identical to SEQ ID NO: 276828

SEQ ID NO: 613107 - RNA, 64 nt, Homo Sapiens; identical to SEQ ID NO: 276829

SEQ ID NO: 613108 - RNA, 64 nt, Homo Sapiens; identical to SEQ ID NO: 276830

SEQ ID NO: 613109 - RNA, 64 nt, Homo Sapiens; identical to SEQ ID NO: 276831

SEQ ID NO: 613110 - RNA, 64 nt, Homo Sapiens; identical to SEQ ID NO: 276832

SEQ ID NO: 613111 - RNA, 64 nt, Homo Sapiens; identical to SEQ ID NO: 276833

SEQ ID NO: 613112 - RNA, 64 nt, Homo Sapiens; identical to SEQ ID NO: 276834

SEQ ID NO: 613113 - RNA, 64 nt, Homo Sapiens; identical to SEQ ID NO: 276835

SEQ ID NO: 613114 - RNA, 64 nt, Homo Sapiens; identical to SEQ ID NO: 276836

SEQ ID NO: 613115 - RNA, 64 nt, Homo Sapiens; identical to SEQ ID NO: 276837

SEQ ID NO: 613116 - RNA, 64 nt, Homo Sapiens; identical to SEQ ID NO: 276838

SEQ ID NO: 613117 - RNA, 64 nt, Homo Sapiens; identical to SEQ ID NO: 276839

SEQ ID NO: 613118 - RNA, 64 nt, Homo Sapiens; identical to SEQ ID NO: 276840

SEQ ID NO: 613119 - RNA, 64 nt, Homo Sapiens; identical to SEQ ID NO: 276841

SEQ ID NO: 613120 - RNA, 64 nt, Homo Sapiens; identical to SEQ ID NO: 276842

SEQ ID NO: 613121 - RNA, 64 nt, Homo Sapiens; identical to SEQ ID NO: 276843

SEQ ID NO: 613122 - RNA, 64 nt, Homo Sapiens; identical to SEQ ID NO: 276844

SEQ ID NO: 613123 - RNA, 64 nt, Homo Sapiens; identical to SEQ ID NO: 276845

SEQ ID NO: 613124 - RNA, 64 nt, Homo Sapiens; identical to SEQ ID NO: 276846

SEQ ID NO: 613125 - RNA, 64 nt, Homo Sapiens; identical to SEQ ID NO: 276847

SEQ ID NO: 613126 - RNA, 64 nt, Homo Sapiens; identical to SEQ ID NO: 276848

SEQ ID NO: 613127 - RNA, 64 nt, Homo Sapiens; identical to SEQ ID NO: 276849

SEQ ID NO: 613128 - RNA, 64 nt, Homo Sapiens; identical to SEQ ID NO: 276850

SEQ ID NO: 613129 - RNA, 64 nt, Homo Sapiens; identical to SEQ ID NO: 276851

SEQ ID NO: 613130 - RNA, 64 nt, Homo Sapiens; identical to SEQ ID NO: 276852

SEQ ID NO: 613131 - RNA, 64 nt, Homo Sapiens; identical to SEQ ID NO: 276853

SEQ ID NO: 613132 - RNA, 64 nt, Homo Sapiens; identical to SEQ ID NO: 276854

SEQ ID NO: 613133 - RNA, 64 nt, Homo Sapiens; identical to SEQ ID NO: 276855

SEQ ID NO: 613134 - RNA, 64 nt, Homo Sapiens; identical to SEQ ID NO: 276856

SEQ ID NO: 613135 - RNA, 64 nt, Homo Sapiens; identical to SEQ ID NO: 276857

SEQ ID NO: 613136 - RNA, 64 nt, Homo Sapiens; identical to SEQ ID NO: 502943

SEQ ID NO: 613137 - RNA, 64 nt, Homo Sapiens; identical to SEQ ID NO: 502944

SEQ ID NO: 613138 - RNA, 64 nt, Homo Sapiens; identical to SEQ ID NO: 502945

SEQ ID NO: 613139 - RNA, 64 nt, Homo Sapiens; identical to SEQ ID NO: 502946

SEQ ID NO: 613140 - RNA, 64 nt, Homo Sapiens; identical to SEQ ID NO: 502947

SEQ ID NO: 613141 - RNA, 64 nt, Homo Sapiens; identical to SEQ ID NO: 502948

SEQ ID NO: 613142 - RNA, 64 nt, Homo Sapiens; identical to SEQ ID NO: 502949

SEQ ID NO: 613143 - RNA, 64 nt, Homo Sapiens; identical to SEQ ID NO: 502950

SEQ ID NO: 613144 - RNA, 64 nt, Homo Sapiens; identical to SEQ ID NO: 502951

SEQ ID NO: 613145 - RNA, 64 nt, Homo Sapiens; identical to SEQ ID NO: 502952

SEQ ID NO: 613146 - RNA, 64 nt, Homo Sapiens; identical to SEQ ID NO: 502953

SEQ ID NO: 613147 - RNA, 64 nt, Homo Sapiens; identical to SEQ ID NO: 502954

SEQ ID NO: 613148 - RNA, 64 nt, Homo Sapiens; identical to SEQ ID NO: 502955

SEQ ID NO: 613149 - RNA, 64 nt, Homo Sapiens; identical to SEQ ID NO: 502956

SEQ ID NO: 613150 - RNA, 64 nt, Homo Sapiens; identical to SEQ ID NO: 502957

SEQ ID NO: 613151 - RNA, 64 nt, Homo Sapiens; identical to SEQ ID NO: 502958

SEQ ID NO: 613152 - RNA, 64 nt, Homo Sapiens; identical to SEQ ID NO: 502959

SEQ ID NO: 613153 - RNA, 64 nt, Homo Sapiens; identical to SEQ ID NO: 502960

SEQ ID NO: 613154 - RNA, 64 nt, Homo Sapiens; identical to SEQ ID NO: 502961

SEQ ID NO: 613155 - RNA, 64 nt, Homo Sapiens; identical to SEQ ID NO: 502962

SEQ ID NO: 613156 - RNA, 64 nt, Homo Sapiens; identical to SEQ ID NO: 502963

SEQ ID NO: 613157 - RNA, 64 nt, Homo Sapiens; identical to SEQ ID NO: 502964

SEQ ID NO: 613158 - RNA, 64 nt, Homo Sapiens; identical to SEQ ID NO: 502965

SEQ ID NO: 613159 - RNA, 64 nt, Homo Sapiens; identical to SEQ ID NO: 502966

SEQ ID NO: 613160 - RNA, 64 nt, Homo Sapiens; identical to SEQ ID NO: 502967

SEQ ID NO: 613161 - RNA, 64 nt, Homo Sapiens; identical to SEQ ID NO: 502968

SEQ ID NO: 613162 - RNA, 64 nt, Homo Sapiens; identical to SEQ ID NO: 502969

SEQ ID NO: 613163 - RNA, 64 nt, Homo Sapiens; identical to SEQ ID NO: 502970

SEQ ID NO: 613164 - RNA, 64 nt, Homo Sapiens; identical to SEQ ID NO: 502971

SEQ ID NO: 613165 - RNA, 64 nt, Homo Sapiens; identical to SEQ ID NO: 502972

SEQ ID NO: 613166 - RNA, 64 nt, Homo Sapiens; identical to SEQ ID NO: 502973

SEQ ID NO: 613167 - RNA, 64 nt, Homo Sapiens; identical to SEQ ID NO: 502974

SEQ ID NO: 613168 - RNA, 64 nt, Homo Sapiens; identical to SEQ ID NO: 502975

SEQ ID NO: 613169 - RNA, 64 nt, Homo Sapiens; identical to SEQ ID NO: 502976

SEQ ID NO: 613170 - RNA, 64 nt, Homo Sapiens; identical to SEQ ID NO: 502977

SEQ ID NO: 613171 - RNA, 64 nt, Homo Sapiens; identical to SEQ ID NO: 502978

SEQ ID NO: 613172 - RNA, 64 nt, Homo Sapiens; identical to SEQ ID NO: 502979

SEQ ID NO: 613173 - RNA, 64 nt, Homo Sapiens; identical to SEQ ID NO: 342144

SEQ ID NO: 613174 - RNA, 64 nt, Homo Sapiens; identical to SEQ ID NO: 342145

SEQ ID NO: 613175 - RNA, 64 nt, Homo Sapiens; identical to SEQ ID NO: 342146

SEQ ID NO: 613176 - RNA, 64 nt, Homo Sapiens; identical to SEQ ID NO: 342147

SEQ ID NO: 613177 - RNA, 64 nt, Homo Sapiens; identical to SEQ ID NO: 342148

SEQ ID NO: 613178 - RNA, 64 nt, Homo Sapiens; identical to SEQ ID NO: 342149

SEQ ID NO: 613179 - RNA, 64 nt, Homo Sapiens; identical to SEQ ID NO: 342150

SEQ ID NO: 613180 - RNA, 64 nt, Homo Sapiens; identical to SEQ ID NO: 342151

SEQ ID NO: 613181 - RNA, 64 nt, Homo Sapiens; identical to SEQ ID NO: 342152

SEQ ID NO: 613182 - RNA, 64 nt, Homo Sapiens; identical to SEQ ID NO: 342153

SEQ ID NO: 613183 - RNA, 64 nt, Homo Sapiens; identical to SEQ ID NO: 342154

SEQ ID NO: 613184 - RNA, 64 nt, Homo Sapiens; identical to SEQ ID NO: 342155

SEQ ID NO: 613185 - RNA, 64 nt, Homo Sapiens; identical to SEQ ID NO: 342156

SEQ ID NO: 613186 - RNA, 55 nt, Homo Sapiens; identical to SEQ ID NO: 342157

SEQ ID NO: 613187 - RNA, 64 nt, Homo Sapiens; identical to SEQ ID NO: 342158

SEQ ID NO: 613188 - RNA, 64 nt, Homo Sapiens; identical to SEQ ID NO: 342159

SEQ ID NO: 613189 - RNA, 64 nt, Homo Sapiens; identical to SEQ ID NO: 342160

SEQ ID NO: 613190 - RNA, 64 nt, Homo Sapiens; identical to SEQ ID NO: 342161

SEQ ID NO: 613191 - RNA, 64 nt, Homo Sapiens; identical to SEQ ID NO: 342162

SEQ ID NO: 613192 - RNA, 64 nt, Homo Sapiens; identical to SEQ ID NO: 342163

SEQ ID NO: 613193 - RNA, 64 nt, Homo Sapiens; identical to SEQ ID NO: 342164

SEQ ID NO: 613194 - RNA, 64 nt, Homo Sapiens; identical to SEQ ID NO: 342165

SEQ ID NO: 613195 - RNA, 64 nt, Homo Sapiens; identical to SEQ ID NO: 342166

SEQ ID NO: 613196 - RNA, 64 nt, Homo Sapiens; identical to SEQ ID NO: 342167

SEQ ID NO: 613197 - RNA, 64 nt, Homo Sapiens; identical to SEQ ID NO: 342168

SEQ ID NO: 613198 - RNA, 64 nt, Homo Sapiens; identical to SEQ ID NO: 342169

SEQ ID NO: 613199 - RNA, 64 nt, Homo Sapiens; identical to SEQ ID NO: 342170

SEQ ID NO: 613200 - RNA, 64 nt, Homo Sapiens; identical to SEQ ID NO: 342171

SEQ ID NO: 613201 - RNA, 64 nt, Homo Sapiens; identical to SEQ ID NO: 342172

SEQ ID NO: 613202 - RNA, 64 nt, Homo Sapiens; identical to SEQ ID NO: 342173

SEQ ID NO: 613203 - RNA, 64 nt, Homo Sapiens; identical to SEQ ID NO: 342174

SEQ ID NO: 613204 - RNA, 64 nt, Homo Sapiens; identical to SEQ ID NO: 342175

SEQ ID NO: 613205 - RNA, 64 nt, Homo Sapiens; identical to SEQ ID NO: 342176

SEQ ID NO: 613206 - RNA, 64 nt, Homo Sapiens; identical to SEQ ID NO: 342177

SEQ ID NO: 613207 - RNA, 64 nt, Homo Sapiens; identical to SEQ ID NO: 342178

SEQ ID NO: 613208 - RNA, 64 nt, Homo Sapiens; identical to SEQ ID NO: 342179

SEQ ID NO: 613209 - RNA, 64 nt, Homo Sapiens; identical to SEQ ID NO: 342180

SEQ ID NO: 613210 - RNA, 64 nt, Homo Sapiens; identical to SEQ ID NO: 342181

SEQ ID NO: 613211 - RNA, 64 nt, Homo Sapiens; identical to SEQ ID NO: 342182

SEQ ID NO: 613212 - RNA, 64 nt, Homo Sapiens; identical to SEQ ID NO: 342183

SEQ ID NO: 613213 - RNA, 64 nt, Homo Sapiens; identical to SEQ ID NO: 342184

SEQ ID NO: 613214 - RNA, 64 nt, Homo Sapiens; identical to SEQ ID NO: 342185

SEQ ID NO: 613215 - RNA, 64 nt, Homo Sapiens; identical to SEQ ID NO: 342186

SEQ ID NO: 613216 - RNA, 64 nt, Homo Sapiens; identical to SEQ ID NO: 342187

SEQ ID NO: 613217 - RNA, 64 nt, Homo Sapiens; identical to SEQ ID NO: 342188

SEQ ID NO: 613218 - RNA, 64 nt, Homo Sapiens; identical to SEQ ID NO: 342189

SEQ ID NO: 613219 - RNA, 64 nt, Homo Sapiens; identical to SEQ ID NO: 342190

SEQ ID NO: 613220 - RNA, 64 nt, Homo Sapiens; identical to SEQ ID NO: 342191

SEQ ID NO: 613221 - RNA, 64 nt, Homo Sapiens; identical to SEQ ID NO: 342192

SEQ ID NO: 613222 - RNA, 64 nt, Homo Sapiens; identical to SEQ ID NO: 342193

SEQ ID NO: 613223 - RNA, 64 nt, Homo Sapiens; identical to SEQ ID NO: 342194

SEQ ID NO: 613224 - RNA, 64 nt, Homo Sapiens; identical to SEQ ID NO: 342195

SEQ ID NO: 613225 - RNA, 64 nt, Homo Sapiens; identical to SEQ ID NO: 342196

SEQ ID NO: 613226 - RNA, 64 nt, Homo Sapiens; identical to SEQ ID NO: 342197

SEQ ID NO: 613227 - RNA, 64 nt, Homo Sapiens; identical to SEQ ID NO: 342198

SEQ ID NO: 613228 - RNA, 64 nt, Homo Sapiens; identical to SEQ ID NO: 342199

SEQ ID NO: 613229 - RNA, 64 nt, Homo Sapiens; identical to SEQ ID NO: 342200

SEQ ID NO: 613230 - RNA, 64 nt, Homo Sapiens; identical to SEQ ID NO: 342201

SEQ ID NO: 613231 - RNA, 64 nt, Homo Sapiens; identical to SEQ ID NO: 342202

SEQ ID NO: 613232 - RNA, 64 nt, Homo Sapiens; identical to SEQ ID NO: 342203

SEQ ID NO: 613233 - RNA, 64 nt, Homo Sapiens; identical to SEQ ID NO: 342204

SEQ ID NO: 613234 - RNA, 64 nt, Homo Sapiens; identical to SEQ ID NO: 342205

SEQ ID NO: 613235 - RNA, 64 nt, Homo Sapiens; identical to SEQ ID NO: 342206

SEQ ID NO: 613236 - RNA, 64 nt, Homo Sapiens; identical to SEQ ID NO: 342207

SEQ ID NO: 613237 - RNA, 64 nt, Homo Sapiens; identical to SEQ ID NO: 342208

SEQ ID NO: 613238 - RNA, 64 nt, Homo Sapiens; identical to SEQ ID NO: 342209

SEQ ID NO: 613239 - RNA, 64 nt, Homo Sapiens; identical to SEQ ID NO: 342210

SEQ ID NO: 613240 - RNA, 64 nt, Homo Sapiens; identical to SEQ ID NO: 342211

SEQ ID NO: 613241 - RNA, 64 nt, Homo Sapiens; identical to SEQ ID NO: 342212

SEQ ID NO: 613242 - RNA, 64 nt, Homo Sapiens; identical to SEQ ID NO: 342213

SEQ ID NO: 613243 - RNA, 64 nt, Homo Sapiens; identical to SEQ ID NO: 342214

SEQ ID NO: 613244 - RNA, 64 nt, Homo Sapiens; identical to SEQ ID NO: 342215

SEQ ID NO: 613245 - RNA, 64 nt, Homo Sapiens; identical to SEQ ID NO: 342216

SEQ ID NO: 613246 - RNA, 64 nt, Homo Sapiens; identical to SEQ ID NO: 342217

SEQ ID NO: 613247 - RNA, 64 nt, Homo Sapiens; identical to SEQ ID NO: 342218

SEQ ID NO: 613248 - RNA, 64 nt, Homo Sapiens; identical to SEQ ID NO: 342219

SEQ ID NO: 613249 - RNA, 64 nt, Homo Sapiens; identical to SEQ ID NO: 342220

SEQ ID NO: 613250 - RNA, 64 nt, Homo Sapiens; identical to SEQ ID NO: 342221

SEQ ID NO: 613251 - RNA, 64 nt, Homo Sapiens; identical to SEQ ID NO: 342222

SEQ ID NO: 613252 - RNA, 64 nt, Homo Sapiens; identical to SEQ ID NO: 342223

SEQ ID NO: 613253 - RNA, 64 nt, Homo Sapiens; identical to SEQ ID NO: 342224

SEQ ID NO: 613254 - RNA, 64 nt, Homo Sapiens; identical to SEQ ID NO: 342225

SEQ ID NO: 613255 - RNA, 64 nt, Homo Sapiens; identical to SEQ ID NO: 342226

SEQ ID NO: 613256 - RNA, 64 nt, Homo Sapiens; identical to SEQ ID NO: 342227

SEQ ID NO: 613257 - RNA, 64 nt, Homo Sapiens; identical to SEQ ID NO: 342228

SEQ ID NO: 613258 - RNA, 64 nt, Homo Sapiens; identical to SEQ ID NO: 342229

SEQ ID NO: 613259 - RNA, 64 nt, Homo Sapiens; identical to SEQ ID NO: 342230

SEQ ID NO: 613260 - RNA, 64 nt, Homo Sapiens; identical to SEQ ID NO: 342231

SEQ ID NO: 613261 - RNA, 64 nt, Homo Sapiens; identical to SEQ ID NO: 342232

SEQ ID NO: 613262 - RNA, 64 nt, Homo Sapiens; identical to SEQ ID NO: 342233

SEQ ID NO: 613263 - RNA, 64 nt, Homo Sapiens; identical to SEQ ID NO: 342234

SEQ ID NO: 613264 - RNA, 64 nt, Homo Sapiens; identical to SEQ ID NO: 342235

SEQ ID NO: 613265 - RNA, 64 nt, Homo Sapiens; identical to SEQ ID NO: 342236

SEQ ID NO: 613266 - RNA, 64 nt, Homo Sapiens; identical to SEQ ID NO: 342237

SEQ ID NO: 613267 - RNA, 64 nt, Homo Sapiens; identical to SEQ ID NO: 342238

SEQ ID NO: 613268 - RNA, 64 nt, Homo Sapiens; identical to SEQ ID NO: 342239

SEQ ID NO: 613269 - RNA, 64 nt, Homo Sapiens; identical to SEQ ID NO: 342240

SEQ ID NO: 613270 - RNA, 64 nt, Homo Sapiens; identical to SEQ ID NO: 342241

SEQ ID NO: 613271 - RNA, 64 nt, Homo Sapiens; identical to SEQ ID NO: 342242

SEQ ID NO: 613272 - RNA, 64 nt, Homo Sapiens; identical to SEQ ID NO: 342243

SEQ ID NO: 613273 - RNA, 64 nt, Homo Sapiens; identical to SEQ ID NO: 342244

SEQ ID NO: 613274 - RNA, 64 nt, Homo Sapiens; identical to SEQ ID NO: 342245

SEQ ID NO: 613275 - RNA, 64 nt, Homo Sapiens; identical to SEQ ID NO: 342246

SEQ ID NO: 613276 - RNA, 64 nt, Homo Sapiens; identical to SEQ ID NO: 342247

SEQ ID NO: 613277 - RNA, 62 nt, Homo Sapiens; identical to SEQ ID NO: 342248

SEQ ID NO: 613278 - RNA, 64 nt, Homo Sapiens; identical to SEQ ID NO: 342249

SEQ ID NO: 613279 - RNA, 64 nt, Homo Sapiens; identical to SEQ ID NO: 342250

SEQ ID NO: 613280 - RNA, 64 nt, Homo Sapiens; identical to SEQ ID NO: 342251

SEQ ID NO: 613281 - RNA, 64 nt, Homo Sapiens; identical to SEQ ID NO: 342252

SEQ ID NO: 613282 - RNA, 64 nt, Homo Sapiens; identical to SEQ ID NO: 342253

SEQ ID NO: 613283 - RNA, 64 nt, Homo Sapiens; identical to SEQ ID NO: 342254

SEQ ID NO: 613284 - RNA, 64 nt, Homo Sapiens; identical to SEQ ID NO: 342255

SEQ ID NO: 613285 - RNA, 64 nt, Homo Sapiens; identical to SEQ ID NO: 342256

SEQ ID NO: 613286 - RNA, 64 nt, Homo Sapiens; identical to SEQ ID NO: 342257

SEQ ID NO: 613287 - RNA, 64 nt, Homo Sapiens; identical to SEQ ID NO: 342258

SEQ ID NO: 613288 - RNA, 64 nt, Homo Sapiens; identical to SEQ ID NO: 342259

SEQ ID NO: 613289 - RNA, 64 nt, Homo Sapiens; identical to SEQ ID NO: 342260

SEQ ID NO: 613290 - RNA, 64 nt, Homo Sapiens; identical to SEQ ID NO: 342261

SEQ ID NO: 613291 - RNA, 64 nt, Homo Sapiens; identical to SEQ ID NO: 342262

SEQ ID NO: 613292 - RNA, 64 nt, Homo Sapiens; identical to SEQ ID NO: 342263

SEQ ID NO: 613293 - RNA, 64 nt, Homo Sapiens; identical to SEQ ID NO: 342264

SEQ ID NO: 613294 - RNA, 64 nt, Homo Sapiens; identical to SEQ ID NO: 342265

SEQ ID NO: 613295 - RNA, 64 nt, Homo Sapiens; identical to SEQ ID NO: 342266

SEQ ID NO: 613296 - RNA, 64 nt, Homo Sapiens; identical to SEQ ID NO: 342267

SEQ ID NO: 613297 - RNA, 64 nt, Homo Sapiens; identical to SEQ ID NO: 342268

SEQ ID NO: 613298 - RNA, 64 nt, Homo Sapiens; identical to SEQ ID NO: 342269

SEQ ID NO: 613299 - RNA, 64 nt, Homo Sapiens; identical to SEQ ID NO: 342270

SEQ ID NO: 613300 - RNA, 64 nt, Homo Sapiens; identical to SEQ ID NO: 342271

SEQ ID NO: 613301 - RNA, 64 nt, Homo Sapiens; identical to SEQ ID NO: 342272

SEQ ID NO: 613302 - RNA, 64 nt, Homo Sapiens; identical to SEQ ID NO: 342273

SEQ ID NO: 613303 - RNA, 64 nt, Homo Sapiens; identical to SEQ ID NO: 342274

SEQ ID NO: 613304 - RNA, 64 nt, Homo Sapiens; identical to SEQ ID NO: 342275

SEQ ID NO: 613305 - RNA, 64 nt, Homo Sapiens; identical to SEQ ID NO: 342276

SEQ ID NO: 613306 - RNA, 64 nt, Homo Sapiens; identical to SEQ ID NO: 342277

SEQ ID NO: 613307 - RNA, 64 nt, Homo Sapiens; identical to SEQ ID NO: 342278

SEQ ID NO: 613308 - RNA, 64 nt, Homo Sapiens; identical to SEQ ID NO: 342279

SEQ ID NO: 613309 - RNA, 64 nt, Homo Sapiens; identical to SEQ ID NO: 342280

SEQ ID NO: 613310 - RNA, 62 nt, Homo Sapiens; identical to SEQ ID NO: 342281

SEQ ID NO: 613311 - RNA, 64 nt, Homo Sapiens; identical to SEQ ID NO: 342282

SEQ ID NO: 613312 - RNA, 64 nt, Homo Sapiens; identical to SEQ ID NO: 342283

SEQ ID NO: 613313 - RNA, 64 nt, Homo Sapiens; identical to SEQ ID NO: 342284

SEQ ID NO: 613314 - RNA, 64 nt, Homo Sapiens; identical to SEQ ID NO: 342285

SEQ ID NO: 613315 - RNA, 64 nt, Homo Sapiens; identical to SEQ ID NO: 342286

SEQ ID NO: 613316 - RNA, 64 nt, Homo Sapiens; identical to SEQ ID NO: 342287

SEQ ID NO: 613317 - RNA, 64 nt, Homo Sapiens; identical to SEQ ID NO: 342288

SEQ ID NO: 613318 - RNA, 64 nt, Homo Sapiens; identical to SEQ ID NO: 342289

SEQ ID NO: 613319 - RNA, 64 nt, Homo Sapiens; identical to SEQ ID NO: 342290

SEQ ID NO: 613320 - RNA, 64 nt, Homo Sapiens; identical to SEQ ID NO: 342291

SEQ ID NO: 613321 - RNA, 64 nt, Homo Sapiens; identical to SEQ ID NO: 342292

SEQ ID NO: 613322 - RNA, 64 nt, Homo Sapiens; identical to SEQ ID NO: 342293

SEQ ID NO: 613323 - RNA, 64 nt, Homo Sapiens; identical to SEQ ID NO: 342294

SEQ ID NO: 613324 - RNA, 64 nt, Homo Sapiens; identical to SEQ ID NO: 342295

SEQ ID NO: 613325 - RNA, 64 nt, Homo Sapiens; identical to SEQ ID NO: 342296

SEQ ID NO: 613326 - RNA, 64 nt, Homo Sapiens; identical to SEQ ID NO: 342297

SEQ ID NO: 613327 - RNA, 64 nt, Homo Sapiens; identical to SEQ ID NO: 342298

SEQ ID NO: 613328 - RNA, 64 nt, Homo Sapiens; identical to SEQ ID NO: 342299

SEQ ID NO: 613329 - RNA, 64 nt, Homo Sapiens; identical to SEQ ID NO: 342300

SEQ ID NO: 613330 - RNA, 64 nt, Homo Sapiens; identical to SEQ ID NO: 342301

SEQ ID NO: 613331 - RNA, 64 nt, Homo Sapiens; identical to SEQ ID NO: 342302

SEQ ID NO: 613332 - RNA, 64 nt, Homo Sapiens; identical to SEQ ID NO: 342303

SEQ ID NO: 613333 - RNA, 64 nt, Homo Sapiens; identical to SEQ ID NO: 342304

SEQ ID NO: 613334 - RNA, 64 nt, Homo Sapiens; identical to SEQ ID NO: 342305

SEQ ID NO: 613335 - RNA, 64 nt, Homo Sapiens; identical to SEQ ID NO: 342306

SEQ ID NO: 613336 - RNA, 64 nt, Homo Sapiens; identical to SEQ ID NO: 342307

SEQ ID NO: 613337 - RNA, 64 nt, Homo Sapiens; identical to SEQ ID NO: 342308

SEQ ID NO: 613338 - RNA, 64 nt, Homo Sapiens; identical to SEQ ID NO: 342309

SEQ ID NO: 613339 - RNA, 64 nt, Homo Sapiens; identical to SEQ ID NO: 342310

SEQ ID NO: 613340 - RNA, 64 nt, Homo Sapiens; identical to SEQ ID NO: 342311

SEQ ID NO: 613341 - RNA, 64 nt, Homo Sapiens; identical to SEQ ID NO: 342312

SEQ ID NO: 613342 - RNA, 64 nt, Homo Sapiens; identical to SEQ ID NO: 342313

SEQ ID NO: 613343 - RNA, 64 nt, Homo Sapiens; identical to SEQ ID NO: 342314

SEQ ID NO: 613344 - RNA, 64 nt, Homo Sapiens; identical to SEQ ID NO: 342315

SEQ ID NO: 613345 - RNA, 64 nt, Homo Sapiens; identical to SEQ ID NO: 342316

SEQ ID NO: 613346 - RNA, 64 nt, Homo Sapiens; identical to SEQ ID NO: 342317

SEQ ID NO: 613347 - RNA, 64 nt, Homo Sapiens
uacacacaacacuaagugccuagacuuuaaauagaucuagcaauuggaaaguuaguaagccuaa

SEQ ID NO: 613348 - RNA, 64 nt, Homo Sapiens
ccaggaaagaauuuucucacccaaggaacauuugaucuagcagcagggaugagaggaaagcaga

SEQ ID NO: 613349 - RNA, 64 nt, Homo Sapiens
agguauaucucccagugcuacccacuaaugugucaucuagcauuugccaugcuggugcgcugca

SEQ ID NO: 613350 - RNA, 64 nt, Homo Sapiens
ggaccuugugguuuguggcuauuauaucacacuuaucuagcaaguaugcaaguuuuuuuucccc

SEQ ID NO: 613351 - RNA, 64 nt, Homo Sapiens; identical to SEQ ID NO: 212929

SEQ ID NO: 613352 - RNA, 64 nt, Homo Sapiens; identical to SEQ ID NO: 212930

SEQ ID NO: 613353 - RNA, 64 nt, Homo Sapiens; identical to SEQ ID NO: 212931

SEQ ID NO: 613354 - RNA, 64 nt, Homo Sapiens; identical to SEQ ID NO: 212932

SEQ ID NO: 613355 - RNA, 64 nt, Homo Sapiens; identical to SEQ ID NO: 212933

SEQ ID NO: 613356 - RNA, 64 nt, Homo Sapiens; identical to SEQ ID NO: 212934

SEQ ID NO: 613357 - RNA, 64 nt, Homo Sapiens; identical to SEQ ID NO: 212935

SEQ ID NO: 613358 - RNA, 64 nt, Homo Sapiens; identical to SEQ ID NO: 212936

SEQ ID NO: 613359 - RNA, 64 nt, Homo Sapiens; identical to SEQ ID NO: 212937

SEQ ID NO: 613360 - RNA, 64 nt, Homo Sapiens; identical to SEQ ID NO: 212938

SEQ ID NO: 613361 - RNA, 64 nt, Homo Sapiens; identical to SEQ ID NO: 212939

SEQ ID NO: 613362 - RNA, 64 nt, Homo Sapiens; identical to SEQ ID NO: 212940

SEQ ID NO: 613363 - RNA, 64 nt, Homo Sapiens; identical to SEQ ID NO: 212941

SEQ ID NO: 613364 - RNA, 64 nt, Homo Sapiens; identical to SEQ ID NO: 212942

SEQ ID NO: 613365 - RNA, 64 nt, Homo Sapiens; identical to SEQ ID NO: 212943

SEQ ID NO: 613366 - RNA, 64 nt, Homo Sapiens; identical to SEQ ID NO: 212944

SEQ ID NO: 613367 - RNA, 64 nt, Homo Sapiens; identical to SEQ ID NO: 212945

SEQ ID NO: 613368 - RNA, 64 nt, Homo Sapiens; identical to SEQ ID NO: 212946

SEQ ID NO: 613369 - RNA, 64 nt, Homo Sapiens; identical to SEQ ID NO: 212947

SEQ ID NO: 613370 - RNA, 64 nt, Homo Sapiens; identical to SEQ ID NO: 212948

SEQ ID NO: 613371 - RNA, 64 nt, Homo Sapiens; identical to SEQ ID NO: 212949

SEQ ID NO: 613372 - RNA, 64 nt, Homo Sapiens; identical to SEQ ID NO: 212950

SEQ ID NO: 613373 - RNA, 64 nt, Homo Sapiens; identical to SEQ ID NO: 212951

SEQ ID NO: 613374 - RNA, 64 nt, Homo Sapiens; identical to SEQ ID NO: 212952

SEQ ID NO: 613375 - RNA, 64 nt, Homo Sapiens; identical to SEQ ID NO: 212953

SEQ ID NO: 613376 - RNA, 64 nt, Homo Sapiens; identical to SEQ ID NO: 212954

SEQ ID NO: 613377 - RNA, 64 nt, Homo Sapiens; identical to SEQ ID NO: 212955

SEQ ID NO: 613378 - RNA, 64 nt, Homo Sapiens; identical to SEQ ID NO: 212956

SEQ ID NO: 613379 - RNA, 64 nt, Homo Sapiens; identical to SEQ ID NO: 212957

SEQ ID NO: 613380 - RNA, 64 nt, Homo Sapiens; identical to SEQ ID NO: 119910

SEQ ID NO: 613381 - RNA, 64 nt, Homo Sapiens; identical to SEQ ID NO: 119911

SEQ ID NO: 613382 - RNA, 64 nt, Homo Sapiens; identical to SEQ ID NO: 119912

SEQ ID NO: 613383 - RNA, 64 nt, Homo Sapiens; identical to SEQ ID NO: 119913

SEQ ID NO: 613384 - RNA, 64 nt, Homo Sapiens; identical to SEQ ID NO: 119914

SEQ ID NO: 613385 - RNA, 64 nt, Homo Sapiens; identical to SEQ ID NO: 119915

SEQ ID NO: 613386 - RNA, 64 nt, Homo Sapiens; identical to SEQ ID NO: 119916

SEQ ID NO: 613387 - RNA, 64 nt, Homo Sapiens; identical to SEQ ID NO: 119917

SEQ ID NO: 613388 - RNA, 64 nt, Homo Sapiens; identical to SEQ ID NO: 119918

SEQ ID NO: 613389 - RNA, 64 nt, Homo Sapiens; identical to SEQ ID NO: 119919

SEQ ID NO: 613390 - RNA, 64 nt, Homo Sapiens; identical to SEQ ID NO: 119920

SEQ ID NO: 613391 - RNA, 64 nt, Homo Sapiens; identical to SEQ ID NO: 119921

SEQ ID NO: 613392 - RNA, 64 nt, Homo Sapiens; identical to SEQ ID NO: 119922

SEQ ID NO: 613393 - RNA, 64 nt, Homo Sapiens; identical to SEQ ID NO: 119923

SEQ ID NO: 613394 - RNA, 64 nt, Homo Sapiens; identical to SEQ ID NO: 119924

SEQ ID NO: 613395 - RNA, 64 nt, Homo Sapiens; identical to SEQ ID NO: 119925

SEQ ID NO: 613396 - RNA, 64 nt, Homo Sapiens; identical to SEQ ID NO: 119926

SEQ ID NO: 613397 - RNA, 64 nt, Homo Sapiens; identical to SEQ ID NO: 119927

SEQ ID NO: 613398 - RNA, 64 nt, Homo Sapiens; identical to SEQ ID NO: 119928

SEQ ID NO: 613399 - RNA, 64 nt, Homo Sapiens; identical to SEQ ID NO: 119929

SEQ ID NO: 613400 - RNA, 64 nt, Homo Sapiens; identical to SEQ ID NO: 119930

SEQ ID NO: 613401 - RNA, 64 nt, Homo Sapiens; identical to SEQ ID NO: 119931

SEQ ID NO: 613402 - RNA, 64 nt, Homo Sapiens; identical to SEQ ID NO: 119932

SEQ ID NO: 613403 - RNA, 64 nt, Homo Sapiens; identical to SEQ ID NO: 119933

SEQ ID NO: 613404 - RNA, 64 nt, Homo Sapiens; identical to SEQ ID NO: 119934

SEQ ID NO: 613405 - RNA, 64 nt, Homo Sapiens; identical to SEQ ID NO: 119935

SEQ ID NO: 613406 - RNA, 64 nt, Homo Sapiens; identical to SEQ ID NO: 119936

SEQ ID NO: 613407 - RNA, 64 nt, Homo Sapiens; identical to SEQ ID NO: 119937

SEQ ID NO: 613408 - RNA, 64 nt, Homo Sapiens; identical to SEQ ID NO: 119938

SEQ ID NO: 613409 - RNA, 64 nt, Homo Sapiens; identical to SEQ ID NO: 119939

SEQ ID NO: 613410 - RNA, 64 nt, Homo Sapiens; identical to SEQ ID NO: 119940

SEQ ID NO: 613411 - RNA, 64 nt, Homo Sapiens; identical to SEQ ID NO: 119941

SEQ ID NO: 613412 - RNA, 64 nt, Homo Sapiens; identical to SEQ ID NO: 119942

SEQ ID NO: 613413 - RNA, 64 nt, Homo Sapiens; identical to SEQ ID NO: 119943

SEQ ID NO: 613414 - RNA, 64 nt, Homo Sapiens; identical to SEQ ID NO: 119944

SEQ ID NO: 613415 - RNA, 64 nt, Homo Sapiens; identical to SEQ ID NO: 119945

SEQ ID NO: 613416 - RNA, 64 nt, Homo Sapiens; identical to SEQ ID NO: 119946

SEQ ID NO: 613417 - RNA, 64 nt, Homo Sapiens; identical to SEQ ID NO: 119947

SEQ ID NO: 613418 - RNA, 64 nt, Homo Sapiens; identical to SEQ ID NO: 119948

SEQ ID NO: 613419 - RNA, 64 nt, Homo Sapiens; identical to SEQ ID NO: 119949

SEQ ID NO: 613420 - RNA, 64 nt, Homo Sapiens; identical to SEQ ID NO: 119950

SEQ ID NO: 613421 - RNA, 64 nt, Homo Sapiens; identical to SEQ ID NO: 119951

SEQ ID NO: 613422 - RNA, 64 nt, Homo Sapiens; identical to SEQ ID NO: 119952

SEQ ID NO: 613423 - RNA, 64 nt, Homo Sapiens; identical to SEQ ID NO: 119953

SEQ ID NO: 613424 - RNA, 64 nt, Homo Sapiens; identical to SEQ ID NO: 119954

SEQ ID NO: 613425 - RNA, 64 nt, Homo Sapiens; identical to SEQ ID NO: 119955

SEQ ID NO: 613426 - RNA, 64 nt, Homo Sapiens; identical to SEQ ID NO: 119956

SEQ ID NO: 613427 - RNA, 64 nt, Homo Sapiens; identical to SEQ ID NO: 119957

SEQ ID NO: 613428 - RNA, 64 nt, Homo Sapiens; identical to SEQ ID NO: 119958

SEQ ID NO: 613429 - RNA, 64 nt, Homo Sapiens; identical to SEQ ID NO: 119959

SEQ ID NO: 613430 - RNA, 64 nt, Homo Sapiens; identical to SEQ ID NO: 119960

SEQ ID NO: 613431 - RNA, 64 nt, Homo Sapiens; identical to SEQ ID NO: 119961

SEQ ID NO: 613432 - RNA, 58 nt, Homo Sapiens; identical to SEQ ID NO: 119962

SEQ ID NO: 613433 - RNA, 64 nt, Homo Sapiens; identical to SEQ ID NO: 119963

SEQ ID NO: 613434 - RNA, 64 nt, Homo Sapiens; identical to SEQ ID NO: 119964

SEQ ID NO: 613435 - RNA, 64 nt, Homo Sapiens; identical to SEQ ID NO: 119965

SEQ ID NO: 613436 - RNA, 64 nt, Homo Sapiens; identical to SEQ ID NO: 119966

SEQ ID NO: 613437 - RNA, 64 nt, Homo Sapiens; identical to SEQ ID NO: 119967

SEQ ID NO: 613438 - RNA, 64 nt, Homo Sapiens; identical to SEQ ID NO: 119968

SEQ ID NO: 613439 - RNA, 64 nt, Homo Sapiens; identical to SEQ ID NO: 119969

SEQ ID NO: 613440 - RNA, 64 nt, Homo Sapiens; identical to SEQ ID NO: 119970

SEQ ID NO: 613441 - RNA, 55 nt, Homo Sapiens; identical to SEQ ID NO: 119971

SEQ ID NO: 613442 - RNA, 64 nt, Homo Sapiens; identical to SEQ ID NO: 119972

SEQ ID NO: 613443 - RNA, 64 nt, Homo Sapiens; identical to SEQ ID NO: 119973

SEQ ID NO: 613444 - RNA, 64 nt, Homo Sapiens; identical to SEQ ID NO: 119974

SEQ ID NO: 613445 - RNA, 64 nt, Homo Sapiens; identical to SEQ ID NO: 119975

SEQ ID NO: 613446 - RNA, 64 nt, Homo Sapiens; identical to SEQ ID NO: 119976

SEQ ID NO: 613447 - RNA, 64 nt, Homo Sapiens; identical to SEQ ID NO: 119977

SEQ ID NO: 613448 - RNA, 64 nt, Homo Sapiens; identical to SEQ ID NO: 119978

SEQ ID NO: 613449 - RNA, 64 nt, Homo Sapiens; identical to SEQ ID NO: 119979

SEQ ID NO: 613450 - RNA, 64 nt, Homo Sapiens; identical to SEQ ID NO: 119980

SEQ ID NO: 613451 - RNA, 64 nt, Homo Sapiens; identical to SEQ ID NO: 119981

SEQ ID NO: 613452 - RNA, 64 nt, Homo Sapiens; identical to SEQ ID NO: 119982

SEQ ID NO: 613453 - RNA, 64 nt, Homo Sapiens; identical to SEQ ID NO: 119983

SEQ ID NO: 613454 - RNA, 64 nt, Homo Sapiens; identical to SEQ ID NO: 119984

SEQ ID NO: 613455 - RNA, 64 nt, Homo Sapiens; identical to SEQ ID NO: 119985

SEQ ID NO: 613456 - RNA, 64 nt, Homo Sapiens; identical to SEQ ID NO: 119986

SEQ ID NO: 613457 - RNA, 64 nt, Homo Sapiens; identical to SEQ ID NO: 119987

SEQ ID NO: 613458 - RNA, 55 nt, Homo Sapiens; identical to SEQ ID NO: 119988

SEQ ID NO: 613459 - RNA, 64 nt, Homo Sapiens; identical to SEQ ID NO: 119989

SEQ ID NO: 613460 - RNA, 64 nt, Homo Sapiens; identical to SEQ ID NO: 119990

SEQ ID NO: 613461 - RNA, 64 nt, Homo Sapiens; identical to SEQ ID NO: 119991

SEQ ID NO: 613462 - RNA, 64 nt, Homo Sapiens; identical to SEQ ID NO: 119992

SEQ ID NO: 613463 - RNA, 64 nt, Homo Sapiens; identical to SEQ ID NO: 119993

SEQ ID NO: 613464 - RNA, 64 nt, Homo Sapiens; identical to SEQ ID NO: 119994

SEQ ID NO: 613465 - RNA, 64 nt, Homo Sapiens; identical to SEQ ID NO: 119995

SEQ ID NO: 613466 - RNA, 64 nt, Homo Sapiens; identical to SEQ ID NO: 119996

SEQ ID NO: 613467 - RNA, 64 nt, Homo Sapiens; identical to SEQ ID NO: 119997

SEQ ID NO: 613468 - RNA, 64 nt, Homo Sapiens; identical to SEQ ID NO: 119998

SEQ ID NO: 613469 - RNA, 62 nt, Homo Sapiens; identical to SEQ ID NO: 119999

SEQ ID NO: 613470 - RNA, 64 nt, Homo Sapiens; identical to SEQ ID NO: 120000

SEQ ID NO: 613471 - RNA, 64 nt, Homo Sapiens; identical to SEQ ID NO: 120001

SEQ ID NO: 613472 - RNA, 64 nt, Homo Sapiens; identical to SEQ ID NO: 120002

SEQ ID NO: 613473 - RNA, 64 nt, Homo Sapiens; identical to SEQ ID NO: 120003

SEQ ID NO: 613474 - RNA, 64 nt, Homo Sapiens; identical to SEQ ID NO: 120004

SEQ ID NO: 613475 - RNA, 64 nt, Homo Sapiens; identical to SEQ ID NO: 120005

SEQ ID NO: 613476 - RNA, 64 nt, Homo Sapiens; identical to SEQ ID NO: 120006

SEQ ID NO: 613477 - RNA, 64 nt, Homo Sapiens; identical to SEQ ID NO: 120007

SEQ ID NO: 613478 - RNA, 64 nt, Homo Sapiens; identical to SEQ ID NO: 120008

SEQ ID NO: 613479 - RNA, 64 nt, Homo Sapiens; identical to SEQ ID NO: 166853

SEQ ID NO: 613480 - RNA, 64 nt, Homo Sapiens; identical to SEQ ID NO: 166854

SEQ ID NO: 613481 - RNA, 64 nt, Homo Sapiens; identical to SEQ ID NO: 166855

SEQ ID NO: 613482 - RNA, 64 nt, Homo Sapiens; identical to SEQ ID NO: 166856

SEQ ID NO: 613483 - RNA, 64 nt, Homo Sapiens; identical to SEQ ID NO: 166857

SEQ ID NO: 613484 - RNA, 64 nt, Homo Sapiens; identical to SEQ ID NO: 166858

SEQ ID NO: 613485 - RNA, 64 nt, Homo Sapiens; identical to SEQ ID NO: 166859

SEQ ID NO: 613486 - RNA, 64 nt, Homo Sapiens; identical to SEQ ID NO: 166860

SEQ ID NO: 613487 - RNA, 64 nt, Homo Sapiens; identical to SEQ ID NO: 166861

SEQ ID NO: 613488 - RNA, 64 nt, Homo Sapiens; identical to SEQ ID NO: 166862

SEQ ID NO: 613489 - RNA, 64 nt, Homo Sapiens; identical to SEQ ID NO: 166863

SEQ ID NO: 613490 - RNA, 64 nt, Homo Sapiens; identical to SEQ ID NO: 166864

SEQ ID NO: 613491 - RNA, 64 nt, Homo Sapiens; identical to SEQ ID NO: 166865

SEQ ID NO: 613492 - RNA, 64 nt, Homo Sapiens; identical to SEQ ID NO: 166866

SEQ ID NO: 613493 - RNA, 64 nt, Homo Sapiens; identical to SEQ ID NO: 166867

SEQ ID NO: 613494 - RNA, 64 nt, Homo Sapiens; identical to SEQ ID NO: 166868

SEQ ID NO: 613495 - RNA, 64 nt, Homo Sapiens; identical to SEQ ID NO: 166869

SEQ ID NO: 613496 - RNA, 64 nt, Homo Sapiens; identical to SEQ ID NO: 166870

SEQ ID NO: 613497 - RNA, 64 nt, Homo Sapiens; identical to SEQ ID NO: 166871

SEQ ID NO: 613498 - RNA, 64 nt, Homo Sapiens; identical to SEQ ID NO: 166872

SEQ ID NO: 613499 - RNA, 64 nt, Homo Sapiens; identical to SEQ ID NO: 166873

SEQ ID NO: 613500 - RNA, 64 nt, Homo Sapiens; identical to SEQ ID NO: 166874

SEQ ID NO: 613501 - RNA, 64 nt, Homo Sapiens; identical to SEQ ID NO: 166875

SEQ ID NO: 613502 - RNA, 64 nt, Homo Sapiens; identical to SEQ ID NO: 166876

SEQ ID NO: 613503 - RNA, 64 nt, Homo Sapiens; identical to SEQ ID NO: 166877

SEQ ID NO: 613504 - RNA, 64 nt, Homo Sapiens; identical to SEQ ID NO: 166878

SEQ ID NO: 613505 - RNA, 64 nt, Homo Sapiens; identical to SEQ ID NO: 166879

SEQ ID NO: 613506 - RNA, 64 nt, Homo Sapiens; identical to SEQ ID NO: 166880

SEQ ID NO: 613507 - RNA, 64 nt, Homo Sapiens; identical to SEQ ID NO: 166881

SEQ ID NO: 613508 - RNA, 64 nt, Homo Sapiens; identical to SEQ ID NO: 166882

SEQ ID NO: 613509 - RNA, 64 nt, Homo Sapiens; identical to SEQ ID NO: 166883

SEQ ID NO: 613510 - RNA, 64 nt, Homo Sapiens; identical to SEQ ID NO: 166884

SEQ ID NO: 613511 - RNA, 64 nt, Homo Sapiens; identical to SEQ ID NO: 166885

SEQ ID NO: 613512 - RNA, 64 nt, Homo Sapiens; identical to SEQ ID NO: 166886

SEQ ID NO: 613513 - RNA, 64 nt, Homo Sapiens; identical to SEQ ID NO: 166887

SEQ ID NO: 613514 - RNA, 64 nt, Homo Sapiens; identical to SEQ ID NO: 166888

SEQ ID NO: 613515 - RNA, 64 nt, Homo Sapiens; identical to SEQ ID NO: 227857

SEQ ID NO: 613516 - RNA, 64 nt, Homo Sapiens; identical to SEQ ID NO: 227858

SEQ ID NO: 613517 - RNA, 57 nt, Homo Sapiens; identical to SEQ ID NO: 227859

SEQ ID NO: 613518 - RNA, 64 nt, Homo Sapiens; identical to SEQ ID NO: 227860

SEQ ID NO: 613519 - RNA, 64 nt, Homo Sapiens; identical to SEQ ID NO: 227861

SEQ ID NO: 613520 - RNA, 64 nt, Homo Sapiens; identical to SEQ ID NO: 227862

SEQ ID NO: 613521 - RNA, 64 nt, Homo Sapiens; identical to SEQ ID NO: 227863

SEQ ID NO: 613522 - RNA, 64 nt, Homo Sapiens; identical to SEQ ID NO: 227864

SEQ ID NO: 613523 - RNA, 64 nt, Homo Sapiens; identical to SEQ ID NO: 227865

SEQ ID NO: 613524 - RNA, 64 nt, Homo Sapiens; identical to SEQ ID NO: 227866

SEQ ID NO: 613525 - RNA, 64 nt, Homo Sapiens; identical to SEQ ID NO: 227867

SEQ ID NO: 613526 - RNA, 64 nt, Homo Sapiens; identical to SEQ ID NO: 227868

SEQ ID NO: 613527 - RNA, 64 nt, Homo Sapiens; identical to SEQ ID NO: 227869

SEQ ID NO: 613528 - RNA, 64 nt, Homo Sapiens; identical to SEQ ID NO: 227870

SEQ ID NO: 613529 - RNA, 64 nt, Homo Sapiens; identical to SEQ ID NO: 227871

SEQ ID NO: 613530 - RNA, 64 nt, Homo Sapiens; identical to SEQ ID NO: 166853

SEQ ID NO: 613531 - RNA, 64 nt, Homo Sapiens; identical to SEQ ID NO: 166854

SEQ ID NO: 613532 - RNA, 64 nt, Homo Sapiens; identical to SEQ ID NO: 166855

SEQ ID NO: 613533 - RNA, 64 nt, Homo Sapiens; identical to SEQ ID NO: 166856

SEQ ID NO: 613534 - RNA, 64 nt, Homo Sapiens; identical to SEQ ID NO: 166857

SEQ ID NO: 613535 - RNA, 64 nt, Homo Sapiens; identical to SEQ ID NO: 166858

SEQ ID NO: 613536 - RNA, 64 nt, Homo Sapiens; identical to SEQ ID NO: 166859

SEQ ID NO: 613537 - RNA, 64 nt, Homo Sapiens; identical to SEQ ID NO: 166860

SEQ ID NO: 613538 - RNA, 64 nt, Homo Sapiens; identical to SEQ ID NO: 166861

SEQ ID NO: 613539 - RNA, 64 nt, Homo Sapiens; identical to SEQ ID NO: 166862

SEQ ID NO: 613540 - RNA, 64 nt, Homo Sapiens; identical to SEQ ID NO: 166863

SEQ ID NO: 613541 - RNA, 64 nt, Homo Sapiens; identical to SEQ ID NO: 166864

SEQ ID NO: 613542 - RNA, 64 nt, Homo Sapiens; identical to SEQ ID NO: 166865

SEQ ID NO: 613543 - RNA, 64 nt, Homo Sapiens; identical to SEQ ID NO: 166866

SEQ ID NO: 613544 - RNA, 64 nt, Homo Sapiens; identical to SEQ ID NO: 166867

SEQ ID NO: 613545 - RNA, 64 nt, Homo Sapiens; identical to SEQ ID NO: 166868

SEQ ID NO: 613546 - RNA, 64 nt, Homo Sapiens; identical to SEQ ID NO: 166869

SEQ ID NO: 613547 - RNA, 64 nt, Homo Sapiens; identical to SEQ ID NO: 166870

SEQ ID NO: 613548 - RNA, 64 nt, Homo Sapiens; identical to SEQ ID NO: 166871

SEQ ID NO: 613549 - RNA, 64 nt, Homo Sapiens; identical to SEQ ID NO: 166872

SEQ ID NO: 613550 - RNA, 64 nt, Homo Sapiens; identical to SEQ ID NO: 166873

SEQ ID NO: 613551 - RNA, 64 nt, Homo Sapiens; identical to SEQ ID NO: 166874

SEQ ID NO: 613552 - RNA, 64 nt, Homo Sapiens; identical to SEQ ID NO: 166875

SEQ ID NO: 613553 - RNA, 64 nt, Homo Sapiens; identical to SEQ ID NO: 166876

SEQ ID NO: 613554 - RNA, 64 nt, Homo Sapiens; identical to SEQ ID NO: 166877

SEQ ID NO: 613555 - RNA, 64 nt, Homo Sapiens; identical to SEQ ID NO: 166878

SEQ ID NO: 613556 - RNA, 64 nt, Homo Sapiens; identical to SEQ ID NO: 166879

SEQ ID NO: 613557 - RNA, 64 nt, Homo Sapiens; identical to SEQ ID NO: 166880

SEQ ID NO: 613558 - RNA, 64 nt, Homo Sapiens; identical to SEQ ID NO: 166881

SEQ ID NO: 613559 - RNA, 64 nt, Homo Sapiens; identical to SEQ ID NO: 166882

SEQ ID NO: 613560 - RNA, 64 nt, Homo Sapiens; identical to SEQ ID NO: 166883

SEQ ID NO: 613561 - RNA, 64 nt, Homo Sapiens; identical to SEQ ID NO: 166884

SEQ ID NO: 613562 - RNA, 64 nt, Homo Sapiens; identical to SEQ ID NO: 166885

SEQ ID NO: 613563 - RNA, 64 nt, Homo Sapiens; identical to SEQ ID NO: 166886

SEQ ID NO: 613564 - RNA, 64 nt, Homo Sapiens; identical to SEQ ID NO: 166887

SEQ ID NO: 613565 - RNA, 64 nt, Homo Sapiens; identical to SEQ ID NO: 166888

SEQ ID NO: 613566 - RNA, 64 nt, Homo Sapiens; identical to SEQ ID NO: 227857

SEQ ID NO: 613567 - RNA, 64 nt, Homo Sapiens; identical to SEQ ID NO: 227858

SEQ ID NO: 613568 - RNA, 57 nt, Homo Sapiens; identical to SEQ ID NO: 227859

SEQ ID NO: 613569 - RNA, 64 nt, Homo Sapiens; identical to SEQ ID NO: 227860

SEQ ID NO: 613570 - RNA, 64 nt, Homo Sapiens; identical to SEQ ID NO: 227861

SEQ ID NO: 613571 - RNA, 64 nt, Homo Sapiens; identical to SEQ ID NO: 227862

SEQ ID NO: 613572 - RNA, 64 nt, Homo Sapiens; identical to SEQ ID NO: 227863

SEQ ID NO: 613573 - RNA, 64 nt, Homo Sapiens; identical to SEQ ID NO: 227864

SEQ ID NO: 613574 - RNA, 64 nt, Homo Sapiens; identical to SEQ ID NO: 227865

SEQ ID NO: 613575 - RNA, 64 nt, Homo Sapiens; identical to SEQ ID NO: 227866

SEQ ID NO: 613576 - RNA, 64 nt, Homo Sapiens; identical to SEQ ID NO: 227867

SEQ ID NO: 613577 - RNA, 64 nt, Homo Sapiens; identical to SEQ ID NO: 227868

SEQ ID NO: 613578 - RNA, 64 nt, Homo Sapiens; identical to SEQ ID NO: 227869

SEQ ID NO: 613579 - RNA, 64 nt, Homo Sapiens; identical to SEQ ID NO: 227870

SEQ ID NO: 613580 - RNA, 64 nt, Homo Sapiens; identical to SEQ ID NO: 227871

SEQ ID NO: 613581 - RNA, 64 nt, Homo Sapiens
uuuuaauaaaguuuuauaacucacugacaaaacauauuucaauaguauaugaguaugagauuuc

SEQ ID NO: 613582 - RNA, 64 nt, Homo Sapiens
gcuugccauuaugaagaacagcuggguauaccauuauuucaaguaauaaaucugaauucuauua

SEQ ID NO: 613583 - RNA, 64 nt, Homo Sapiens
cccuuggcauaucagauugagcuaauggugauguuauuucaaucuaacagccaccaaucugaaa

SEQ ID NO: 613584 - RNA, 64 nt, Homo Sapiens
uuauuucaaucuaacagccaccaaucugaaauuguauuucaaauguugauucuguaguucuuua

SEQ ID NO: 613585 - RNA, 64 nt, Homo Sapiens
gauaagagcagagcucacacuuuuacaguugcaguauuucaaagucccuauccaggucacucca

SEQ ID NO: 613586 - RNA, 64 nt, Homo Sapiens
ggcuuugugcuaaaugugguuuuguguuuugcuguauuucaaaauuuuccuucuguuaaaggaa

SEQ ID NO: 613587 - RNA, 64 nt, Homo Sapiens
aagaccucuugacauuuaaauguaacugugcuauuauuucaauaaguggaaaggguauuagaag

SEQ ID NO: 613588 - RNA, 64 nt, Homo Sapiens
gcaguuguauuaguucucauuaggcuauuuuauuuauuucaaauuuuacuuuaaauuauuuaaa

SEQ ID NO: 613589 - RNA, 64 nt, Homo Sapiens
cuuacugaagaacaaauuauuaauauuggaugaguauuucaacagugugacuaauguuugaaau

SEQ ID NO: 613590 - RNA, 64 nt, Homo Sapiens
cuguaguuuuauagaaaguauuaaugcuuuuauguauuucaaaacuuucauauguuaaauggaa

SEQ ID NO: 613591 - RNA, 64 nt, Homo Sapiens
agccaugaaagugucuacgcuuuuguuuuuccauuauuucaauugggggaaaauauuaacuuug

SEQ ID NO: 613592 - RNA, 64 nt, Homo Sapiens
ugucuuaucccuuauuuauggagcuagacugacauauuucaaaccaaucucuucuguggucuuc

SEQ ID NO: 613593 - RNA, 64 nt, Homo Sapiens
augaaagaaaaacuugaaaugcuacuuaacuuacuauuucaaagggaaguauauuucuuuuuaa

SEQ ID NO: 613594 - RNA, 64 nt, Homo Sapiens
ugcacacaaaaaauaacuuauaguuagacuuuucuauuucaaguaaagcuuugaguuacuuguu

SEQ ID NO: 613595 - RNA, 64 nt, Homo Sapiens
aauguguauuaugugccuaaauucuccaguugauuauuucaacuaaaaaaaaaaaaaagccuac

SEQ ID NO: 613596 - RNA, 64 nt, Homo Sapiens
uguccagauguaggggaagaguaauaccaaagacuauuucaaaaguuucaaagcacaauaacua

SEQ ID NO: 613597 - RNA, 64 nt, Homo Sapiens
ucaaaauuacauauggacuuuggaagauugcuccuauuucaacaaauaguugcugcaagaauuu

SEQ ID NO: 613598 - RNA, 64 nt, Homo Sapiens
aacuagggugguaaccggaaaaaaauauugucaguauuucaagcuguguuccuuucuuaguuug

SEQ ID NO: 613599 - RNA, 64 nt, Homo Sapiens
uuaugcaugccaaauguaaggccaugaaaaucaguauuucaaauaacuuaaaaaaugcuuuacu

SEQ ID NO: 613600 - RNA, 64 nt, Homo Sapiens
ucuuacaaaguauuuuucccaaagauagcuuuacuauuucaaaaauugucaaauuaaugcaugc

SEQ ID NO: 613601 - RNA, 64 nt, Homo Sapiens
ggaaacuuuaauccaaagaauagguaggugguuuuauuucaaaguagaaauuuagcagucagau

SEQ ID NO: 613602 - RNA, 64 nt, Homo Sapiens
aaggucagaccuuuuauacuacucagcuuuuucguauuucaaauuuuucacguaucuuccaagu

SEQ ID NO: 613603 - RNA, 64 nt, Homo Sapiens
aaaacacuggauucauuucaucuugcaaauguuguauuucaaaccaguuucacauaaguuauuu

SEQ ID NO: 613604 - RNA, 64 nt, Homo Sapiens
auuuuuuauuuaauuauauuaugaauaaaauuguuauuucaauaguacccaaccaaagaugcuu

SEQ ID NO: 613605 - RNA, 64 nt, Homo Sapiens
ggauuguaugcacuugcaaacacaaauauaugcauauuucaaauuacacauauauauacacaua

SEQ ID NO: 613606 - RNA, 64 nt, Homo Sapiens
uauguguguacguguguauacaucuucugaaauauauuucaaaaguauguaaauuauauuuaua

SEQ ID NO: 613607 - RNA, 64 nt, Homo Sapiens
aggaacuugcaguauuauuuuuuguucuguuuuguauuucaauuaaaaagauuucucacagcuu

SEQ ID NO: 613608 - RNA, 64 nt, Homo Sapiens
aauuuguucuagugcuuucauuucagagagguuuuauuucaauuaggaucaaagauucaaaugg

SEQ ID NO: 613609 - RNA, 64 nt, Homo Sapiens
aagcaauuauguaaaguugugucaauguuucuaguauuucaaaguuuacaagccaaauacaugu

SEQ ID NO: 613610 - RNA, 64 nt, Homo Sapiens
aacuucaucuucacugcauagauguaaacaacuauauuucaacuuaaucauccuuaugaaaaca

SEQ ID NO: 613611 - RNA, 64 nt, Homo Sapiens
acuggaaaguaguuguguggcucugaauguuuuguauuucaaucgagaauccuuagucgauaga

SEQ ID NO: 613612 - RNA, 64 nt, Homo Sapiens
uuaguucauuuucuguguugacauuugcaauuaauauuucaauauuuuaugugcuuauauuggc

SEQ ID NO: 613613 - RNA, 64 nt, Homo Sapiens
auguuucacuggaauugaugaaagaggauucuaauauuucaagagacauuuuauuuucccuggu

SEQ ID NO: 613614 - RNA, 64 nt, Homo Sapiens
caucucaucaguuucuuguauuuucaucaucagauauuucaacuccaauuguuccucggcugga

SEQ ID NO: 613615 - RNA, 64 nt, Homo Sapiens
uaaaagugguuuuaaaguaauugugagucuuaaguauuucaaaaugaacuauuuuuauaacuuc

SEQ ID NO: 613616 - RNA, 64 nt, Homo Sapiens
aaagcuaaaauuuucagaagggaauggggaagcuuauuucaaucgcuagauauauuaacaugaa

SEQ ID NO: 613617 - RNA, 64 nt, Homo Sapiens
acauuuuagguauuucauauugaauuaugcuguauauuucaauuccaaguuuauuuauuuucca

SEQ ID NO: 613618 - RNA, 64 nt, Homo Sapiens
ucuaaauaccauuaaggcuugacugguuaauuccuauuucaaggauuuggauuuauucagguaa

SEQ ID NO: 613619 - RNA, 64 nt, Homo Sapiens
ucuaagauguuucugguucaagacugucauuuucuauuucaaccgaaaaguaagcauuuaaccc

SEQ ID NO: 613620 - RNA, 64 nt, Homo Sapiens
ugagauacacuuaguacaaaaaaugaaaaucugguauuucaaaauugcauuucuuguauaauag

SEQ ID NO: 613621 - RNA, 64 nt, Homo Sapiens
uucuauuaaaauauuuauauuucuaaauccgagguauuucaagguguaguauccuauuucaaag

SEQ ID NO: 613622 - RNA, 64 nt, Homo Sapiens
uucuaaauccgagguauuucaagguguaguauccuauuucaaaggagauauagcaguuuugcca

SEQ ID NO: 613623 - RNA, 64 nt, Homo Sapiens
agggcggagaggcugcacuugugagagaaaauacuauuucaagucauauucugcguaggaaaau

SEQ ID NO: 613624 - RNA, 64 nt, Homo Sapiens
cucaaacggcaacauuccucagaaaccaaagcuuuauuucaaaucucuuccuucccuggcuggu

SEQ ID NO: 613625 - RNA, 64 nt, Homo Sapiens
ucuuaauauuacauacaagaaaaugcaguuagguuauuucaauugacaauucugccuccucuuu

SEQ ID NO: 613626 - RNA, 64 nt, Homo Sapiens
guuuuugacaauuuuguuugaaauucauauaucuuauuucaaaggauagcauaauaucugcauu

SEQ ID NO: 613627 - RNA, 64 nt, Homo Sapiens
ucgauuucauucaugugauuaaaacaaguugccauauuucaaagccuugaacuaagacucaauu

SEQ ID NO: 613628 - RNA, 64 nt, Homo Sapiens
auagucaucuaagaaugaauaccugucugccauguauuucaaucuuagugagccaaaauuguuu

SEQ ID NO: 613629 - RNA, 64 nt, Homo Sapiens
aauauaucuaugucuauaucuuuugauaguuaauuauuucaacuuuuccugcugagcuccagua

SEQ ID NO: 613630 - RNA, 64 nt, Homo Sapiens
uguuuuggucacaucacuaugugaauagauggguuauuucaaccaccuaugaaacuauugauau

SEQ ID NO: 613631 - RNA, 64 nt, Homo Sapiens
auuuauugaaugauuacuauagauucacauaguuuauuucaacugucaaguagaggcaaugcaa

SEQ ID NO: 613632 - RNA, 64 nt, Homo Sapiens
uuucauauuuuuaagaaaacauucauugaucaaauauuucaaccucaauuuaucauuuaucagg

SEQ ID NO: 613633 - RNA, 64 nt, Homo Sapiens
acaaaaauguucaaguccuggcugaugguccaaauauuucaaaaauauucaguacaacagaaaa

SEQ ID NO: 613634 - RNA, 64 nt, Homo Sapiens
ugauuuauacucagaaucgacauucuuaaaaaguuauuucaagggauggcauaacuguaagagg

SEQ ID NO: 613635 - RNA, 64 nt, Homo Sapiens
aacuucaaagauaguuauugaccuuauaaauaaauauuucaaaauuuugauucggaagacuaag

SEQ ID NO: 613636 - RNA, 64 nt, Homo Sapiens
aagcacucuaaaauuuagaguauaaauugucuuauauuucaaauuagaaaaguucaaaugaagu

SEQ ID NO: 613637 - RNA, 64 nt, Homo Sapiens
auauucuucuuccuuuuccuaaaugaaauuauauuauuucaacuacuaaaacuucccgccaccc

SEQ ID NO: 613638 - RNA, 64 nt, Homo Sapiens
aacuauggucucuuucaaauaaauaguaguuuuauauuucaacacaaguugcuauaagcagucc

SEQ ID NO: 613639 - RNA, 64 nt, Homo Sapiens
agauuguauuucucugcuuucauuucaauuucauuauuucaaauugcuugucaaaauggcccaa

SEQ ID NO: 613640 - RNA, 64 nt, Homo Sapiens
caacuagcuguauucguauuaaaaugaagucucuuauuucaauuaccuaguguuguugggaacu

SEQ ID NO: 613641 - RNA, 64 nt, Homo Sapiens
uuggugguuuuuuuaaaaaaauauauuucaagcuuauuucaaaaagaugugugguauagauagu

SEQ ID NO: 613642 - RNA, 64 nt, Homo Sapiens
uuauuucaaaauuggugguuguauagauaguauauauuucaagcccuuacuuuuaagaugugug

SEQ ID NO: 613643 - RNA, 64 nt, Homo Sapiens
aaagaugauuuaaauaugaaucuuaugaguaaauuauuucaauuuuauuuuagacgguauaacu

SEQ ID NO: 613644 - RNA, 64 nt, Homo Sapiens
uaaauuauuucaauuuuauuuuagacgguauaacuauuucaauuugauuaauccacuauuauau

SEQ ID NO: 613645 - RNA, 64 nt, Homo Sapiens
caugccauacuuuuaggaagucugagaugauaaauauuucaaggucagugaagucuaucaauca

SEQ ID NO: 613646 - RNA, 64 nt, Homo Sapiens
guacacuguauuguaaaaauaaaaaguaaaauuauauuucaaauuuuaaaagccacuaagcaau

SEQ ID NO: 613647 - RNA, 64 nt, Homo Sapiens
auauaaugggauuuaaaaaaagugcuaucuuuucuauuucaaguuaauuacaaacaguuuugua

SEQ ID NO: 613648 - RNA, 64 nt, Homo Sapiens
uuuaugacaccuuuguuuuucucccucuguucaguauuucaaggaaaauuauggaugccagucu

SEQ ID NO: 613649 - RNA, 64 nt, Homo Sapiens
agagacauaaugacagcugauguuaaacuuuucauauuucaaauuagauucccuaggagguaua

SEQ ID NO: 613650 - RNA, 64 nt, Homo Sapiens
gagauauaccgugugaagcuauugucagcuucucuauuucaaaaugcaaucagcauauaacuau

SEQ ID NO: 613651 - RNA, 64 nt, Homo Sapiens
ccaaucuagaauauggaacucuaaucacuucuaguauuucaacuuccuagcagaaaugaacuug

SEQ ID NO: 613652 - RNA, 64 nt, Homo Sapiens
uaugaguuaaaaugucccuucuuccuagcgagcauauuucaacuguucuucauaaauguuuaug

SEQ ID NO: 613653 - RNA, 64 nt, Homo Sapiens
uccccaguccaaaacacagucauuucaccuggacuauuucaaucauuacacagguguccaaccu

SEQ ID NO: 613654 - RNA, 64 nt, Homo Sapiens
uaacugaagaaagagaaauugaauaauauaguucuauuucaacauguggguucacagauuuauu

SEQ ID NO: 613655 - RNA, 64 nt, Homo Sapiens
ucauugauaagcccuaaauuugucuccaccccuguauuucaagaaguuuguuuugcugccaacc

SEQ ID NO: 613656 - RNA, 64 nt, Homo Sapiens
uagucuagaccagcuagugcuagugauuuuuggauauuucaaaagguggcccacaaugagugag

SEQ ID NO: 613657 - RNA, 64 nt, Homo Sapiens
aaacauugcagguauuuuauuguuuguagcuggauauuucaaagagugucuagaauuguucucc

SEQ ID NO: 613658 - RNA, 64 nt, Homo Sapiens
uuuccauugaauauaugcuucauuaguccaaggcuauuucaaguguuaauacuaguuuucagaa

SEQ ID NO: 613659 - RNA, 64 nt, Homo Sapiens
auagguauuagagcacuaucacaucauugcuuaauauuucaaaacaugggcaaggccauucucu

SEQ ID NO: 613660 - RNA, 64 nt, Homo Sapiens
gguauauauaaaagguaaaaaauguuggccuggguauuucaaaguauggaugcaacuuauuaaa

SEQ ID NO: 613661 - RNA, 64 nt, Homo Sapiens
ucaugaauaagaauauuccggaagugauuucaaauauuucaaauguguauaguuucauuuauuu

SEQ ID NO: 613662 - RNA, 64 nt, Homo Sapiens
uauagaagaugacacagaaauuggaaccaacaaaacugcuaacaccuuguugacuguucugagu

SEQ ID NO: 613663 - RNA, 64 nt, Homo Sapiens
ugggauuuuuaggucagcccaggggagaaagauaacugcuaaaauuccccuguaccccauccuu

SEQ ID NO: 613664 - RNA, 64 nt, Homo Sapiens
cuuauauuuuauguguaucuuguuugaauaauuaacugcuaagucagggaguaacuuuaaacaa

SEQ ID NO: 613665 - RNA, 64 nt, Homo Sapiens
acuguaauguuucaaaacauaguucauagcguagacugcuaaauuaaauauuacaaauuuguuc

SEQ ID NO: 613666 - RNA, 64 nt, Homo Sapiens
guacuuauacauuuuaaaaugaguacuaauuuucacugcuaauaauucuguaaggacacaucaa

SEQ ID NO: 613667 - RNA, 64 nt, Homo Sapiens
gcuuuauuuucaccuuguguacaacauggcaaagacugcuaagauuaaaauccgucucccauuu

SEQ ID NO: 613668 - RNA, 64 nt, Homo Sapiens
ugauuugcuguaauauaaaacuuagaaguaaaccacugcuaauuaaucauuuuaaacuuucaaa

SEQ ID NO: 613669 - RNA, 64 nt, Homo Sapiens
accacugcuaauuaaucauuuuaaacuuucaaaaacugcuaaaacaggugccaugaaucaggua

SEQ ID NO: 613670 - RNA, 64 nt, Homo Sapiens
ccccucucccaaauuuuuaacugucuucguccucucccccgagccguuuggagauucaaaacuu

SEQ ID NO: 613671 - RNA, 64 nt, Homo Sapiens
cgcacccuccuuccucagggaaaaugggcccccgucccccgaccgucugcucugagcggacguu

SEQ ID NO: 613672 - RNA, 64 nt, Homo Sapiens
guuuaggcuggcccagcacaucccugcgcuagucucccccgagguggcccugcaagcugcuuua

SEQ ID NO: 613673 - RNA, 64 nt, Homo Sapiens
ucagcccuuccuaaacccagcccagcuucacaccucccccgacuaauaagaacguggccaccug

SEQ ID NO: 613674 - RNA, 64 nt, Homo Sapiens; identical to SEQ ID NO: 128948

SEQ ID NO: 613675 - RNA, 64 nt, Homo Sapiens; identical to SEQ ID NO: 128949

SEQ ID NO: 613676 - RNA, 64 nt, Homo Sapiens; identical to SEQ ID NO: 128950

SEQ ID NO: 613677 - RNA, 64 nt, Homo Sapiens; identical to SEQ ID NO: 128951

SEQ ID NO: 613678 - RNA, 64 nt, Homo Sapiens; identical to SEQ ID NO: 128952

SEQ ID NO: 613679 - RNA, 64 nt, Homo Sapiens; identical to SEQ ID NO: 128953

SEQ ID NO: 613680 - RNA, 64 nt, Homo Sapiens; identical to SEQ ID NO: 128954

SEQ ID NO: 613681 - RNA, 64 nt, Homo Sapiens; identical to SEQ ID NO: 128955

SEQ ID NO: 613682 - RNA, 64 nt, Homo Sapiens; identical to SEQ ID NO: 128956

SEQ ID NO: 613683 - RNA, 64 nt, Homo Sapiens; identical to SEQ ID NO: 128957

SEQ ID NO: 613684 - RNA, 64 nt, Homo Sapiens; identical to SEQ ID NO: 128958

SEQ ID NO: 613685 - RNA, 64 nt, Homo Sapiens; identical to SEQ ID NO: 128959

SEQ ID NO: 613686 - RNA, 64 nt, Homo Sapiens; identical to SEQ ID NO: 128960

SEQ ID NO: 613687 - RNA, 64 nt, Homo Sapiens; identical to SEQ ID NO: 128961

SEQ ID NO: 613688 - RNA, 64 nt, Homo Sapiens; identical to SEQ ID NO: 128962

SEQ ID NO: 613689 - RNA, 64 nt, Homo Sapiens; identical to SEQ ID NO: 128963

SEQ ID NO: 613690 - RNA, 64 nt, Homo Sapiens; identical to SEQ ID NO: 128964

SEQ ID NO: 613691 - RNA, 64 nt, Homo Sapiens; identical to SEQ ID NO: 128965

SEQ ID NO: 613692 - RNA, 64 nt, Homo Sapiens; identical to SEQ ID NO: 128966

SEQ ID NO: 613693 - RNA, 64 nt, Homo Sapiens; identical to SEQ ID NO: 128967

SEQ ID NO: 613694 - RNA, 64 nt, Homo Sapiens; identical to SEQ ID NO: 128968

SEQ ID NO: 613695 - RNA, 64 nt, Homo Sapiens; identical to SEQ ID NO: 128969

SEQ ID NO: 613696 - RNA, 64 nt, Homo Sapiens; identical to SEQ ID NO: 128970

SEQ ID NO: 613697 - RNA, 64 nt, Homo Sapiens; identical to SEQ ID NO: 128971

SEQ ID NO: 613698 - RNA, 64 nt, Homo Sapiens; identical to SEQ ID NO: 128972

SEQ ID NO: 613699 - RNA, 64 nt, Homo Sapiens; identical to SEQ ID NO: 128973

SEQ ID NO: 613700 - RNA, 64 nt, Homo Sapiens; identical to SEQ ID NO: 128974

SEQ ID NO: 613701 - RNA, 64 nt, Homo Sapiens; identical to SEQ ID NO: 128975

SEQ ID NO: 613702 - RNA, 64 nt, Homo Sapiens; identical to SEQ ID NO: 128976

SEQ ID NO: 613703 - RNA, 64 nt, Homo Sapiens; identical to SEQ ID NO: 128977

SEQ ID NO: 613704 - RNA, 64 nt, Homo Sapiens; identical to SEQ ID NO: 128978

SEQ ID NO: 613705 - RNA, 64 nt, Homo Sapiens; identical to SEQ ID NO: 128979

SEQ ID NO: 613706 - RNA, 64 nt, Homo Sapiens; identical to SEQ ID NO: 128980

SEQ ID NO: 613707 - RNA, 64 nt, Homo Sapiens; identical to SEQ ID NO: 128981

SEQ ID NO: 613708 - RNA, 64 nt, Homo Sapiens; identical to SEQ ID NO: 128982

SEQ ID NO: 613709 - RNA, 64 nt, Homo Sapiens; identical to SEQ ID NO: 128983

SEQ ID NO: 613710 - RNA, 64 nt, Homo Sapiens; identical to SEQ ID NO: 128984

SEQ ID NO: 613711 - RNA, 64 nt, Homo Sapiens; identical to SEQ ID NO: 128985

SEQ ID NO: 613712 - RNA, 64 nt, Homo Sapiens; identical to SEQ ID NO: 128986

SEQ ID NO: 613713 - RNA, 64 nt, Homo Sapiens; identical to SEQ ID NO: 128987

SEQ ID NO: 613714 - RNA, 64 nt, Homo Sapiens; identical to SEQ ID NO: 128988

SEQ ID NO: 613715 - RNA, 64 nt, Homo Sapiens; identical to SEQ ID NO: 128989

SEQ ID NO: 613716 - RNA, 64 nt, Homo Sapiens; identical to SEQ ID NO: 128990

SEQ ID NO: 613717 - RNA, 64 nt, Homo Sapiens; identical to SEQ ID NO: 128991

SEQ ID NO: 613718 - RNA, 64 nt, Homo Sapiens; identical to SEQ ID NO: 128992

SEQ ID NO: 613719 - RNA, 64 nt, Homo Sapiens; identical to SEQ ID NO: 128993

SEQ ID NO: 613720 - RNA, 64 nt, Homo Sapiens; identical to SEQ ID NO: 128994

SEQ ID NO: 613721 - RNA, 56 nt, Homo Sapiens; identical to SEQ ID NO: 128995

SEQ ID NO: 613722 - RNA, 64 nt, Homo Sapiens
cugcuuuuacuaacagauuuauugugaagaauaguugaucgacuuuagcuaucaagcacucacc

SEQ ID NO: 613723 - RNA, 64 nt, Homo Sapiens
gcuugagccugggagguggacugagaugggaggauugaucgaucagucccagcuacuuaggagg

SEQ ID NO: 613724 - RNA, 64 nt, Homo Sapiens
caaaguaauuuuuaauuuaaaguauuaacaucaauugaucgacauuccaaauucaagaagaagc

SEQ ID NO: 613725 - RNA, 64 nt, Homo Sapiens
auaagaaaaaugaguuucaaauuuaagauguuuauugaucgaagcaauugaaguaucauggauu

SEQ ID NO: 613726 - RNA, 64 nt, Homo Sapiens
cugaucacugacucuuggucgauggggaauguaauugaucgauccauguccaguaugaguggug

SEQ ID NO: 613727 - RNA, 64 nt, Homo Sapiens
uuucacauaaaacaauuauccuaaagguuaauaguugaucgaaacagaauaauagaaaaauucu

SEQ ID NO: 613728 - RNA, 64 nt, Homo Sapiens
uguaguuuagaguggaaaaguuuuugcacacauuuugaucgaacuauauucuaagcacacaaaa

SEQ ID NO: 613729 - RNA, 64 nt, Homo Sapiens
ugcauguuugaauuaaaagaaaguaauggaagaauugaucgaugaauuaagugagguggaauuc

SEQ ID NO: 613730 - RNA, 64 nt, Homo Sapiens
gucaaaauacaaagacauuuguucugccuuuccuuugaucgaggagucucacauggaaaaguga

SEQ ID NO: 613731 - RNA, 64 nt, Homo Sapiens
auauuuuuuaagagguucaauggauuccaaagcuuugaucgaggacucguuuccuaauuuuuac

SEQ ID NO: 613732 - RNA, 64 nt, Homo Sapiens
uuguuuuuuauuuuuuuaacaaggaaggaagaccuugaucgacagauaucacacagcuuugcag

SEQ ID NO: 613733 - RNA, 64 nt, Homo Sapiens
aaccucguugacaugcacaguuugcaaucuuauguugaucgauguuaaacgucacagcaguacu

SEQ ID NO: 613734 - RNA, 64 nt, Homo Sapiens
uauuagggguagcucuugauccauaagaagugguuugaucgauaaugagcaacuauaagcaaag

SEQ ID NO: 613735 - RNA, 64 nt, Homo Sapiens
aaauaaaauguccuaauaauauuuuacaauauuuuugaucgacccaccaaacuuaccauccuuu

SEQ ID NO: 613736 - RNA, 64 nt, Homo Sapiens
caugucguauugauagaaucaauuauuucuaaaguugaucgauuaauaucaagaagauucagaa

SEQ ID NO: 613737 - RNA, 64 nt, Homo Sapiens
gagaagauuagugcucggggucaccaugaugccuuugaucgaugcugcuccaguaacuacagug

SEQ ID NO: 613738 - RNA, 64 nt, Homo Sapiens
uuagauguucucagucaaguacucacugaacucauugaucgagugcugucugcuaaaucuccaa

SEQ ID NO: 613739 - RNA, 64 nt, Homo Sapiens
aguguacagccacagcaaggagcccgacacugauuugaucgauucugugacacaaaccccacca

SEQ ID NO: 613740 - RNA, 64 nt, Homo Sapiens
uccuaagaaaaaggcuugaauuuauguaaauacuuugaucgauugcuaauuuucaaaggcuucu

SEQ ID NO: 613741 - RNA, 64 nt, Homo Sapiens
caccugaauguucuauguaaguuggagggauaauuugaucgaauauagggaaaauaaguauuua

SEQ ID NO: 613742 - RNA, 64 nt, Homo Sapiens
ucagauaaaaugugcuuauguucugcuaugacguuugaucgaauccuaaccacagugagcucuu

SEQ ID NO: 613743 - RNA, 64 nt, Homo Sapiens
accacucaaaaggaaacuugaauaauuuauaauuuugaucgaguuucuuaaaagacccuggaga

SEQ ID NO: 613744 - RNA, 64 nt, Homo Sapiens
ugccaaauuuagauuuguguuaaauauccuuuaauugaucgacugaauuauuuugugaugcaaa

SEQ ID NO: 613745 - RNA, 64 nt, Homo Sapiens
uucugcgggcucccuccucuggcaggcuucccccuugaucgacuucuugguuuucucucuggau

SEQ ID NO: 613746 - RNA, 64 nt, Homo Sapiens
agaacucgggggcccccugcccgcacccggacacuugaucgauccccaccgacgcccccugcac

SEQ ID NO: 613747 - RNA, 64 nt, Homo Sapiens
gagcaggacagcccugcuccgccccucccaggguuugaucgauucuccgcugcaucucagcaaa

SEQ ID NO: 613748 - RNA, 64 nt, Homo Sapiens
caucaguucauguucuguauugaaauaggucugguugaucgaugucagucagucaguagaaccu

SEQ ID NO: 613749 - RNA, 64 nt, Homo Sapiens
ugaacccaagguacugacagcuuccucguggggauugaucgaaccucuuccuggcccaccuccu

SEQ ID NO: 613750 - RNA, 64 nt, Homo Sapiens
gaaaauagaucuaugagacuaagaauuuaagucuuugaucgaagugcaagugaccacaauguga

SEQ ID NO: 613751 - RNA, 63 nt, Homo Sapiens
gccugggucggguacuuuuuaauaaacuucuccauugaucgagugcauccuuagccuuggcaa

SEQ ID NO: 613752 - RNA, 64 nt, Homo Sapiens
gugugaauaaaugcuugcagcucuuagcucuuuuuugaucgaugaagcacuuuuuuauuaauau

SEQ ID NO: 613753 - RNA, 64 nt, Homo Sapiens
gaaaucuuuugccaacuaagguccuuuuuuuuuuuugaucgauuucccucacaaugcuuuuaaa

SEQ ID NO: 613754 - RNA, 64 nt, Homo Sapiens
caggcuuuuccagcaucacuacuuaugugaugacuugaucgaggauacagguuuucugacauua

SEQ ID NO: 613755 - RNA, 64 nt, Homo Sapiens
uauucucuuuuuucaagucaaucuaggaguuaguuugaucgagucugggucguugcaauuuugc

SEQ ID NO: 613756 - RNA, 60 nt, Homo Sapiens
accugcacuucugccaaggcggcugggcagaaccagaacacuggaaaagaaccagaagga

SEQ ID NO: 613757 - RNA, 60 nt, Homo Sapiens
aggcugggcagaaccagaacccuggaaaagaaccagaagggagccuggaaaagaaccagg

SEQ ID NO: 613758 - RNA, 60 nt, Homo Sapiens
aaauuuuuuucuuuugaagguuguaauuucaaccagaaguauaguguuguauauuguaaa

SEQ ID NO: 613759 - RNA, 60 nt, Homo Sapiens
guucuaguguagagucugaguccaaccagcaaccagaaaucucacuggcccacuggcaaa

SEQ ID NO: 613760 - RNA, 60 nt, Homo Sapiens
auuuaggauaauuucaucacuuuuaauucaaaccagaauaugugaauaagcagacagaaa

SEQ ID NO: 613761 - RNA, 60 nt, Homo Sapiens
guggggguuacccaaauagguucacagaagaaccagaaauaaaaccugccuuucuagacu

SEQ ID NO: 613762 - RNA, 60 nt, Homo Sapiens
gaauguguguguuugagcagcaaucuguccaaccagaaaacagguggugggaauaauuua

SEQ ID NO: 613763 - RNA, 60 nt, Homo Sapiens
ccuaaagaagaggaauuauaccguguuccuaaccagaaaucagggcacugagacacccgu

SEQ ID NO: 613764 - RNA, 60 nt, Homo Sapiens
gccaccucaaugcauugucacccagggcuuaaccagaaccgucagcagagauuucaguuu

SEQ ID NO: 613765 - RNA, 60 nt, Homo Sapiens
gccaccucaaugcauugucacccagggcuuaaccagaaccguuggcagagauuucaguuu

SEQ ID NO: 613766 - RNA, 60 nt, Homo Sapiens
cuuaaacauuauuauuaaaaagaacacauuaaccagaaagauucuuaauuguuaauuuga

SEQ ID NO: 613767 - RNA, 60 nt, Homo Sapiens
guuuauuagaugucauaugccacuacccuuaaccagaauucacccuaaauuucccagugg

SEQ ID NO: 613768 - RNA, 60 nt, Homo Sapiens
caguuuuccuugagauaccuuccaagagugaaccagaaugcaguucuugacuuuggacaa

SEQ ID NO: 613769 - RNA, 60 nt, Homo Sapiens
ggcuaaggcauacaguucuugacugguuggaaccagaacaaauuccccuguggccugcug

SEQ ID NO: 613770 - RNA, 60 nt, Homo Sapiens
ggaauaauguuacuuuggaucacagagacaaaccagaaaccauuaguagauuuuauaagc

SEQ ID NO: 613771 - RNA, 60 nt, Homo Sapiens
ccaaguggaucugcuggcaagaguugaggaaaccagaaggacacauacuagguugaaaga

SEQ ID NO: 613772 - RNA, 60 nt, Homo Sapiens
cuggcugcuucacucaggaaagggaacuaaaaccagaauacacuaagaaguuucuaguuu

SEQ ID NO: 613773 - RNA, 60 nt, Homo Sapiens
uaaaguucucuuucuuugagaaaacugaggaaccagaaugcuuagaguucauaaaauaau

SEQ ID NO: 613774 - RNA, 60 nt, Homo Sapiens
guuguauggauaugcgaaguugaaggugaaaaccagaauguaauuuauugaauacuguac

SEQ ID NO: 613775 - RNA, 60 nt, Homo Sapiens
agacaaggcagcaggcauacaaauucugugaaccagaaugucaucugaaagcugccauag

SEQ ID NO: 613776 - RNA, 60 nt, Homo Sapiens
gacuuuaaaauaagagaaaguaaaaaacuaaaccagaagaacagccaugaugaaacuuuu

SEQ ID NO: 613777 - RNA, 60 nt, Homo Sapiens
gagaauauguaugcgugaaggugaagaugcaaccagaaagugaauacuuggagaaacuag

SEQ ID NO: 613778 - RNA, 60 nt, Homo Sapiens
ccauguuuguuacuaggauuuaaucaaaguaaccagaaucccggccgagcauaagaaguu

SEQ ID NO: 613779 - RNA, 60 nt, Homo Sapiens
uugcaaugugcugauuuuauuauaacuuccaaccagaacuuuauugaaaaggcuacuauu

SEQ ID NO: 613780 - RNA, 60 nt, Homo Sapiens
aggcaaaucuccuuuguccauuuaccuggaaaccagaaugauuuugacauacaggagagc

SEQ ID NO: 613781 - RNA, 60 nt, Homo Sapiens
uuucuuuauuucugucucauaauugucaaaaaccagaauuaggucaaguucauaguuucu

SEQ ID NO: 613782 - RNA, 60 nt, Homo Sapiens
uccguagcucgcucuaugaaggccuggagaaaccagaauccaagaccuccauucacaacu

SEQ ID NO: 613783 - RNA, 60 nt, Homo Sapiens
cgccuccgggcccccccgcccccgucccccaaccagaacaacaacgccauagacagcggc

SEQ ID NO: 613784 - RNA, 64 nt, Homo Sapiens; identical to SEQ ID NO: 326924

SEQ ID NO: 613785 - RNA, 64 nt, Homo Sapiens; identical to SEQ ID NO: 326925

SEQ ID NO: 613786 - RNA, 64 nt, Homo Sapiens; identical to SEQ ID NO: 326926

SEQ ID NO: 613787 - RNA, 64 nt, Homo Sapiens; identical to SEQ ID NO: 326927

SEQ ID NO: 613788 - RNA, 64 nt, Homo Sapiens; identical to SEQ ID NO: 326928

SEQ ID NO: 613789 - RNA, 64 nt, Homo Sapiens; identical to SEQ ID NO: 326929

SEQ ID NO: 613790 - RNA, 64 nt, Homo Sapiens; identical to SEQ ID NO: 326930

SEQ ID NO: 613791 - RNA, 64 nt, Homo Sapiens; identical to SEQ ID NO: 326931

SEQ ID NO: 613792 - RNA, 64 nt, Homo Sapiens; identical to SEQ ID NO: 326932

SEQ ID NO: 613793 - RNA, 64 nt, Homo Sapiens; identical to SEQ ID NO: 326933

SEQ ID NO: 613794 - RNA, 64 nt, Homo Sapiens; identical to SEQ ID NO: 326934

SEQ ID NO: 613795 - RNA, 64 nt, Homo Sapiens; identical to SEQ ID NO: 326935

SEQ ID NO: 613796 - RNA, 64 nt, Homo Sapiens; identical to SEQ ID NO: 326936

SEQ ID NO: 613797 - RNA, 64 nt, Homo Sapiens; identical to SEQ ID NO: 326937

SEQ ID NO: 613798 - RNA, 64 nt, Homo Sapiens; identical to SEQ ID NO: 326938

SEQ ID NO: 613799 - RNA, 64 nt, Homo Sapiens; identical to SEQ ID NO: 326939

SEQ ID NO: 613800 - RNA, 64 nt, Homo Sapiens; identical to SEQ ID NO: 326940

SEQ ID NO: 613801 - RNA, 56 nt, Homo Sapiens; identical to SEQ ID NO: 326941

SEQ ID NO: 613802 - RNA, 64 nt, Homo Sapiens; identical to SEQ ID NO: 326942

SEQ ID NO: 613803 - RNA, 64 nt, Homo Sapiens; identical to SEQ ID NO: 326943

SEQ ID NO: 613804 - RNA, 64 nt, Homo Sapiens; identical to SEQ ID NO: 326944

SEQ ID NO: 613805 - RNA, 64 nt, Homo Sapiens; identical to SEQ ID NO: 326945

SEQ ID NO: 613806 - RNA, 64 nt, Homo Sapiens; identical to SEQ ID NO: 326946

SEQ ID NO: 613807 - RNA, 64 nt, Homo Sapiens; identical to SEQ ID NO: 326947

SEQ ID NO: 613808 - RNA, 64 nt, Homo Sapiens; identical to SEQ ID NO: 326948

SEQ ID NO: 613809 - RNA, 64 nt, Homo Sapiens; identical to SEQ ID NO: 326949

SEQ ID NO: 613810 - RNA, 64 nt, Homo Sapiens; identical to SEQ ID NO: 326950

SEQ ID NO: 613811 - RNA, 64 nt, Homo Sapiens; identical to SEQ ID NO: 326951

SEQ ID NO: 613812 - RNA, 64 nt, Homo Sapiens; identical to SEQ ID NO: 326952

SEQ ID NO: 613813 - RNA, 64 nt, Homo Sapiens; identical to SEQ ID NO: 326953

SEQ ID NO: 613814 - RNA, 64 nt, Homo Sapiens; identical to SEQ ID NO: 326954

SEQ ID NO: 613815 - RNA, 64 nt, Homo Sapiens; identical to SEQ ID NO: 326955

SEQ ID NO: 613816 - RNA, 64 nt, Homo Sapiens
augaaugaauaaaagucaauagauaucauuucaggugacuuaacaaugagcauuuaaaugcaac

SEQ ID NO: 613817 - RNA, 64 nt, Homo Sapiens
uaugugggauauugaguaucgaggcuguguugaagugacuuaucuuuggugugggaguugucau

SEQ ID NO: 613818 - RNA, 64 nt, Homo Sapiens
ggcuguuggcugucaucuugaacucuauuugaaugugacuuaaaucacaaguaacguguuuugu

SEQ ID NO: 613819 - RNA, 64 nt, Homo Sapiens
ccauucagcuguuuuaacacagaaauucaaaauagugacuuaacauggaagcuauuucucucuu

SEQ ID NO: 613820 - RNA, 64 nt, Homo Sapiens
cuuagagcaagcacaacaucaucuguuucccuaagugacuuaacaagccauuggauaauacuga

SEQ ID NO: 613821 - RNA, 64 nt, Homo Sapiens
guuugauggagagaaagcugaguccuaucuuacugugacuuaaaggcugugccugugacuccag

SEQ ID NO: 613822 - RNA, 64 nt, Homo Sapiens
gcugagggucuguggaacuccagcagcucugcacuggguagagcugggccuagagcucagucac

SEQ ID NO: 613823 - RNA, 64 nt, Homo Sapiens
agcucagucacaggccugggcuuccuggccugaguggguagacgcaggcggcagaggugcugga

SEQ ID NO: 613824 - RNA, 64 nt, Homo Sapiens
ucucagcggaaaauaagaagacacccuaugaaaguggguagaccuguacucacaaauugacugg

SEQ ID NO: 613825 - RNA, 64 nt, Homo Sapiens
gguuggguguucugccaacaucacauucugaaacuggguagaguccugcugaauacaugccauu

SEQ ID NO: 613826 - RNA, 64 nt, Homo Sapiens
cagcaaggggacagggcugggaacugcccagggcuggguagagggcugcagagcucuguugagg

SEQ ID NO: 613827 - RNA, 64 nt, Homo Sapiens
caccagguacgacgaccaggcucgacccccagccuggguagagcggccucugggggccccuccc

SEQ ID NO: 613828 - RNA, 64 nt, Homo Sapiens
acgcuuauggauguguguaccauugagaugagaauggguagauggaacggagaccaucaagcca

SEQ ID NO: 613829 - RNA, 64 nt, Homo Sapiens
aaccgugcaaaggaaacuggaaacuuuuccccgcuggguagagcauguugcugauacucuucug

SEQ ID NO: 613830 - RNA, 64 nt, Homo Sapiens
acuugagcccaggaauucaauugggaggcugagguggguagauuacccuuguaaucccagcacu

SEQ ID NO: 613831 - RNA, 64 nt, Homo Sapiens
uggccuuugccaacaaaguguaaauaaucuuacuuggguagagaguacuaaauugaauaacgag

SEQ ID NO: 613832 - RNA, 64 nt, Homo Sapiens
acaggauuuuaaaguuagaauauauuugaaugcauggguagaaaauaucauauuuuaaaacuau

SEQ ID NO: 613833 - RNA, 64 nt, Homo Sapiens
aauugagauuuugauacaccuaaggucacgcagcuggguagauauacagcugucacaagagucu

SEQ ID NO: 613834 - RNA, 64 nt, Homo Sapiens
gccgugauucuaaaggaaaaugugugcucuuuaguggguagaacaaauggaaauuugguuucag

SEQ ID NO: 613835 - RNA, 64 nt, Homo Sapiens
uagcuuuuaauuacauuucagagagguguaauuuuggguagaugcucauuacauuuuugaaagg

SEQ ID NO: 613836 - RNA, 64 nt, Homo Sapiens
agaagagcgaaacuccgucucaaaaaaaaauaaaaaugaagaggggaaaccagaauaaauuauc

SEQ ID NO: 613837 - RNA, 63 nt, Homo Sapiens
aggcugugagcuuguguuacaugguaauaaagccaaugaagagacaugucuguguaauucuga

SEQ ID NO: 613838 - RNA, 64 nt, Homo Sapiens
gggacccagugugcuucaguguuaagaguggggcaaugaagagugaaccccaaugaagagugau

SEQ ID NO: 613839 - RNA, 64 nt, Homo Sapiens
aguguuaagaguggggcaaugaagagugaaccccaaugaagagugaucccaacuuuggaaacua

SEQ ID NO: 613840 - RNA, 64 nt, Homo Sapiens
uugguauggaguuggcagacaggauguucaacuuaaugaagaaauacagcuaaggccuugccag

SEQ ID NO: 613841 - RNA, 64 nt, Homo Sapiens
uuucuggcuuuuaagccaauauaaugggcugcaaaaugaagacaccagaguguaugcauacaaa

SEQ ID NO: 613842 - RNA, 64 nt, Homo Sapiens
cauuuuauuccccucaauucucaauauauucaguaaugaagaauggugccaccacucaagcaac

SEQ ID NO: 613843 - RNA, 64 nt, Homo Sapiens
cgaaggaugaagacgaagaagcaagggaggaacaaaugaagaaccaucuuuguucaugaauagg

SEQ ID NO: 613844 - RNA, 64 nt, Homo Sapiens
aguaauuagaauauuuucaagagaagaaaagaaaaaugaagaaagagggaggaagaaagggaga

SEQ ID NO: 613845 - RNA, 64 nt, Homo Sapiens
gaauaaaagaaauaggaagcuaauucuugcaauaaaugaagaagcuaauuaguuuauaugagaa

SEQ ID NO: 613846 - RNA, 64 nt, Homo Sapiens
ugugaagacaucagauaggaaauagacucucaggaaugaagauucccuuucaagcauaagucca

SEQ ID NO: 613847 - RNA, 64 nt, Homo Sapiens
ugaauuauggaagaagaguagaauuuuauguuuaaaugaagaagcacccaggaggugggagggu

SEQ ID NO: 613848 - RNA, 64 nt, Homo Sapiens
uaaauaaggauggugauagagagguugaagaagaaaugaagaagcaugaaaguaauaauguggg

SEQ ID NO: 613849 - RNA, 64 nt, Homo Sapiens
uuuuccagcuagaaaauuuuauggcuaucgaagaaaugaagaagcacggaaguacucaugucgg

SEQ ID NO: 613850 - RNA, 64 nt, Homo Sapiens
aacaccugaaagccagcaauuuccugacacugagaaugaagaguaucacagguaagccuauggc

SEQ ID NO: 613851 - RNA, 64 nt, Homo Sapiens
uuccguggguuccccugggacaggaguuaauacaaaugaagaaaauucuucuuccaugccaugu

SEQ ID NO: 613852 - RNA, 64 nt, Homo Sapiens
aaaguacugugaccugagagucuaaaucaaaagaaaugaagaaaguccucccugcugauuuguu

SEQ ID NO: 613853 - RNA, 55 nt, Homo Sapiens
gcguagacuacauuuugugaggaucaaugaagacuaaauauaaaaaacauuuucu

SEQ ID NO: 613854 - RNA, 64 nt, Homo Sapiens
gauucugaaucaaggugauugugauuauagugacaaugaagaugaugcuauuaauacugcauaa

SEQ ID NO: 613855 - RNA, 64 nt, Homo Sapiens
aguucuuuguaacuagggacauuacuaauugaaaaaugaagacauggguaacuuuuauccacau

SEQ ID NO: 613856 - RNA, 64 nt, Homo Sapiens
uagcccucccaaaauguagaggacagccuggcacaaugaagaauacucaccccugcagugcaug

SEQ ID NO: 613857 - RNA, 64 nt, Homo Sapiens
aaaaggaaaguaguuauuccaguuggauuuucccaaugaagagguaaacucauucagaucauuc

SEQ ID NO: 613858 - RNA, 64 nt, Homo Sapiens
uugccuagaggagacuaauuuaaacuuucaaucaaaugaagagugacuaauaagaaaguuggca

SEQ ID NO: 613859 - RNA, 64 nt, Homo Sapiens
cagcagugucuguucuucauaacuugagcauucaaaugaagauuccccccacccugccccauga

SEQ ID NO: 613860 - RNA, 64 nt, Homo Sapiens
aaccuaaugcagaauugcuaaaaagguucugaauaaugaagauuaguugagguuguuaaaacag

SEQ ID NO: 613861 - RNA, 64 nt, Homo Sapiens
ggcaguugcugucugcaguuuacaauguauuguaaaugaagauuuuuuaaauucuaucuugcug

SEQ ID NO: 613862 - RNA, 64 nt, Homo Sapiens
ccucucauaccaaaggaugacuguauauuucuuaaaugaagagacuuucauucuuuaaauauua

SEQ ID NO: 613863 - RNA, 64 nt, Homo Sapiens
acuggacucuccguuaaucuugggcuggcugaagaaugaagaccgguccgagagggaagcuggc

SEQ ID NO: 613864 - RNA, 64 nt, Homo Sapiens
aaaaaaggaaaagaaguugcgagaggccaagucuaaugaagagaaauaugagauuucuacuucg

SEQ ID NO: 613865 - RNA, 64 nt, Homo Sapiens
gcaguugcccuggccaacgugacucagcgccucaaaugaagagacugguguggggaggagagag

SEQ ID NO: 613866 - RNA, 64 nt, Homo Sapiens
cuuggcugugguaaugcucuacugggcccuucagaaugaagacagucugccuuagagccugcua

SEQ ID NO: 613867 - RNA, 64 nt, Homo Sapiens
cugaaauacagacuuaaauacucucauuuaaaaaaaugaagacaauauaaaaucuaguccaguu

SEQ ID NO: 613868 - RNA, 64 nt, Homo Sapiens
aaaaacaaauuuguuugacucucuauaguugugaaaugaagaguauuauugggcuuauucucug

SEQ ID NO: 613869 - RNA, 64 nt, Homo Sapiens
ugacaaccuccuaugugcaugucuaaauagucacaaugaagaugaaaauaaggaugauggggac

SEQ ID NO: 613870 - RNA, 64 nt, Homo Sapiens
cagugacaggugcugccuguuuacucguaccaaaaaugaagacaagccccacacccaccucagc

SEQ ID NO: 613871 - RNA, 64 nt, Homo Sapiens
cagagcauucauaccaaagagaacucaugaauguaaugaagaugggaagauauuuaucaaauuc

SEQ ID NO: 613872 - RNA, 64 nt, Homo Sapiens
auucacaccagagagaaacccucugaaugugacgaaugaagaaaagguauuaguguuaaacucu

SEQ ID NO: 613873 - RNA, 64 nt, Homo Sapiens
caaaaccuuuauuccaugugaugcagaagguauuaaugaagagauguauaaacguuuucaggga

SEQ ID NO: 613874 - RNA, 64 nt, Homo Sapiens
uuucuagcaaaacauguuuuaugaaagguauacaaaugaagaauccacacucuaguuguuuucc

SEQ ID NO: 613875 - RNA, 64 nt, Homo Sapiens
ccaucagcaaagaauuucaacaccauaacccaggaaugaagauagauaagcaaaagaggauguu

SEQ ID NO: 613876 - RNA, 64 nt, Homo Sapiens
auuuuuuaugaggagugaacaaaaauaaccccaaaaugaagauuuuuuagaacagaaaacaaca

SEQ ID NO: 613877 - RNA, 64 nt, Homo Sapiens
aguaguauuuuguauauuuuuguaacaaaauauaaaugaagauauuuuaccaugaagagauugc

SEQ ID NO: 613878 - RNA, 64 nt, Homo Sapiens
gauugcacuuauccuugagaacagucuaaauauaaaugaagauauuuuaccaugaagagauugc

SEQ ID NO: 613879 - RNA, 64 nt, Homo Sapiens
ugcagaaaaaaaugaggccgaaaauuuagaggaaaaugaagagcccuucguugcccccuuagga

SEQ ID NO: 613880 - RNA, 64 nt, Homo Sapiens
gauuuugauuucagaaucaggagucagcucugacaaugaagaugaugaugaugaagaagauggg

SEQ ID NO: 613881 - RNA, 64 nt, Homo Sapiens
uacaggagcauuuaggccaugagaacgacaaaggaaugaagagcgacauacuggcauggagagu

SEQ ID NO: 613882 - RNA, 64 nt, Homo Sapiens
aacauuuauugaucuucuacggaugaauauaagcaaugaagaugcauuuuguauacagagaacc

SEQ ID NO: 613883 - RNA, 64 nt, Homo Sapiens
uuuagaaauuauuuuccuucaaguguucaagucuaaugaagaaugaagauaacauuuuaucacu

SEQ ID NO: 613884 - RNA, 64 nt, Homo Sapiens
auuauuuuccuucaaguguucaagucuaaugaagaaugaagauaacauuuuaucacuucugucc

SEQ ID NO: 613885 - RNA, 64 nt, Homo Sapiens
aguauuucugccuagaucuguuacuauacuuguaaaugaagaucauaguccugagugcaaguaa

SEQ ID NO: 613886 - RNA, 64 nt, Homo Sapiens
uuucagaacucugggaugauauaguuacuuaacuaaugaagacaaagagacugaaauaaauugu

SEQ ID NO: 613887 - RNA, 64 nt, Homo Sapiens
gaauuaaauuaaaaauguuguuuggaaaagaaacaaugaagacuuaucacuaugugaagaaagu

SEQ ID NO: 613888 - RNA, 64 nt, Homo Sapiens
gcaugccaucccaagauuauaucgauguaaucagaaugaagaccaaaaauuuuacagaaauugc

SEQ ID NO: 613889 - RNA, 64 nt, Homo Sapiens
gccaaucacgguuaaacacaaaguguuuuuauagaaugaagaaacagucuuuaacagaaaaaag

SEQ ID NO: 613890 - RNA, 64 nt, Homo Sapiens
uuuuacuguauaguaauucuggaaagagcaaauaaaugaagauuguuuuuauuugccugauaaa

SEQ ID NO: 613891 - RNA, 64 nt, Homo Sapiens
uagauggaagcaaaauuaaguugucuuuguagaaaaugaagagccuuucuuccagcaaaaaucc

SEQ ID NO: 613892 - RNA, 64 nt, Homo Sapiens
agauugucugugauuggacagacuaugaugagcgaaugaagaaguuggucaguauuguggcuga

SEQ ID NO: 613893 - RNA, 64 nt, Homo Sapiens; identical to SEQ ID NO: 72506

SEQ ID NO: 613894 - RNA, 64 nt, Homo Sapiens; identical to SEQ ID NO: 72507

SEQ ID NO: 613895 - RNA, 64 nt, Homo Sapiens; identical to SEQ ID NO: 72508

SEQ ID NO: 613896 - RNA, 64 nt, Homo Sapiens; identical to SEQ ID NO: 72509

SEQ ID NO: 613897 - RNA, 64 nt, Homo Sapiens; identical to SEQ ID NO: 72510

SEQ ID NO: 613898 - RNA, 64 nt, Homo Sapiens; identical to SEQ ID NO: 72511

SEQ ID NO: 613899 - RNA, 64 nt, Homo Sapiens; identical to SEQ ID NO: 72512

SEQ ID NO: 613900 - RNA, 64 nt, Homo Sapiens; identical to SEQ ID NO: 72513

SEQ ID NO: 613901 - RNA, 64 nt, Homo Sapiens; identical to SEQ ID NO: 72514

SEQ ID NO: 613902 - RNA, 64 nt, Homo Sapiens; identical to SEQ ID NO: 72515

SEQ ID NO: 613903 - RNA, 64 nt, Homo Sapiens; identical to SEQ ID NO: 72516

SEQ ID NO: 613904 - RNA, 64 nt, Homo Sapiens; identical to SEQ ID NO: 72517

SEQ ID NO: 613905 - RNA, 64 nt, Homo Sapiens; identical to SEQ ID NO: 72518

SEQ ID NO: 613906 - RNA, 64 nt, Homo Sapiens; identical to SEQ ID NO: 72519

SEQ ID NO: 613907 - RNA, 64 nt, Homo Sapiens; identical to SEQ ID NO: 72520

SEQ ID NO: 613908 - RNA, 64 nt, Homo Sapiens; identical to SEQ ID NO: 72521

SEQ ID NO: 613909 - RNA, 64 nt, Homo Sapiens; identical to SEQ ID NO: 72522

SEQ ID NO: 613910 - RNA, 64 nt, Homo Sapiens; identical to SEQ ID NO: 72523

SEQ ID NO: 613911 - RNA, 64 nt, Homo Sapiens; identical to SEQ ID NO: 72524

SEQ ID NO: 613912 - RNA, 64 nt, Homo Sapiens; identical to SEQ ID NO: 72525

SEQ ID NO: 613913 - RNA, 64 nt, Homo Sapiens; identical to SEQ ID NO: 72526

SEQ ID NO: 613914 - RNA, 64 nt, Homo Sapiens; identical to SEQ ID NO: 72527

SEQ ID NO: 613915 - RNA, 64 nt, Homo Sapiens; identical to SEQ ID NO: 72528

SEQ ID NO: 613916 - RNA, 64 nt, Homo Sapiens; identical to SEQ ID NO: 72529

SEQ ID NO: 613917 - RNA, 64 nt, Homo Sapiens; identical to SEQ ID NO: 72530

SEQ ID NO: 613918 - RNA, 64 nt, Homo Sapiens; identical to SEQ ID NO: 72531

SEQ ID NO: 613919 - RNA, 64 nt, Homo Sapiens; identical to SEQ ID NO: 72532

SEQ ID NO: 613920 - RNA, 64 nt, Homo Sapiens; identical to SEQ ID NO: 72533

SEQ ID NO: 613921 - RNA, 64 nt, Homo Sapiens; identical to SEQ ID NO: 72534

SEQ ID NO: 613922 - RNA, 64 nt, Homo Sapiens; identical to SEQ ID NO: 72535

SEQ ID NO: 613923 - RNA, 64 nt, Homo Sapiens; identical to SEQ ID NO: 72536

SEQ ID NO: 613924 - RNA, 64 nt, Homo Sapiens; identical to SEQ ID NO: 72537

SEQ ID NO: 613925 - RNA, 64 nt, Homo Sapiens; identical to SEQ ID NO: 72538

SEQ ID NO: 613926 - RNA, 64 nt, Homo Sapiens; identical to SEQ ID NO: 72539

SEQ ID NO: 613927 - RNA, 64 nt, Homo Sapiens; identical to SEQ ID NO: 72540

SEQ ID NO: 613928 - RNA, 64 nt, Homo Sapiens; identical to SEQ ID NO: 72541

SEQ ID NO: 613929 - RNA, 64 nt, Homo Sapiens; identical to SEQ ID NO: 72542

SEQ ID NO: 613930 - RNA, 64 nt, Homo Sapiens; identical to SEQ ID NO: 72543

SEQ ID NO: 613931 - RNA, 64 nt, Homo Sapiens; identical to SEQ ID NO: 72544

SEQ ID NO: 613932 - RNA, 64 nt, Homo Sapiens; identical to SEQ ID NO: 72545

SEQ ID NO: 613933 - RNA, 64 nt, Homo Sapiens; identical to SEQ ID NO: 72546

SEQ ID NO: 613934 - RNA, 64 nt, Homo Sapiens; identical to SEQ ID NO: 72547

SEQ ID NO: 613935 - RNA, 64 nt, Homo Sapiens; identical to SEQ ID NO: 72548

SEQ ID NO: 613936 - RNA, 64 nt, Homo Sapiens; identical to SEQ ID NO: 72549

SEQ ID NO: 613937 - RNA, 64 nt, Homo Sapiens; identical to SEQ ID NO: 72550

SEQ ID NO: 613938 - RNA, 64 nt, Homo Sapiens; identical to SEQ ID NO: 72551

SEQ ID NO: 613939 - RNA, 64 nt, Homo Sapiens; identical to SEQ ID NO: 72552

SEQ ID NO: 613940 - RNA, 64 nt, Homo Sapiens; identical to SEQ ID NO: 72553

SEQ ID NO: 613941 - RNA, 64 nt, Homo Sapiens; identical to SEQ ID NO: 72554

SEQ ID NO: 613942 - RNA, 64 nt, Homo Sapiens; identical to SEQ ID NO: 72555

SEQ ID NO: 613943 - RNA, 64 nt, Homo Sapiens; identical to SEQ ID NO: 72556

SEQ ID NO: 613944 - RNA, 64 nt, Homo Sapiens; identical to SEQ ID NO: 72557

SEQ ID NO: 613945 - RNA, 64 nt, Homo Sapiens; identical to SEQ ID NO: 72558

SEQ ID NO: 613946 - RNA, 64 nt, Homo Sapiens; identical to SEQ ID NO: 72559

SEQ ID NO: 613947 - RNA, 64 nt, Homo Sapiens; identical to SEQ ID NO: 72560

SEQ ID NO: 613948 - RNA, 64 nt, Homo Sapiens; identical to SEQ ID NO: 72561

SEQ ID NO: 613949 - RNA, 64 nt, Homo Sapiens; identical to SEQ ID NO: 72562

SEQ ID NO: 613950 - RNA, 64 nt, Homo Sapiens; identical to SEQ ID NO: 72563

SEQ ID NO: 613951 - RNA, 64 nt, Homo Sapiens; identical to SEQ ID NO: 72564

SEQ ID NO: 613952 - RNA, 64 nt, Homo Sapiens; identical to SEQ ID NO: 72565

SEQ ID NO: 613953 - RNA, 64 nt, Homo Sapiens; identical to SEQ ID NO: 72566

SEQ ID NO: 613954 - RNA, 64 nt, Homo Sapiens; identical to SEQ ID NO: 72567

SEQ ID NO: 613955 - RNA, 64 nt, Homo Sapiens; identical to SEQ ID NO: 72568

SEQ ID NO: 613956 - RNA, 64 nt, Homo Sapiens; identical to SEQ ID NO: 72569

SEQ ID NO: 613957 - RNA, 64 nt, Homo Sapiens; identical to SEQ ID NO: 72570

SEQ ID NO: 613958 - RNA, 64 nt, Homo Sapiens; identical to SEQ ID NO: 72571

SEQ ID NO: 613959 - RNA, 64 nt, Homo Sapiens; identical to SEQ ID NO: 72572

SEQ ID NO: 613960 - RNA, 64 nt, Homo Sapiens; identical to SEQ ID NO: 72573

SEQ ID NO: 613961 - RNA, 64 nt, Homo Sapiens; identical to SEQ ID NO: 72574

SEQ ID NO: 613962 - RNA, 64 nt, Homo Sapiens; identical to SEQ ID NO: 72575

SEQ ID NO: 613963 - RNA, 64 nt, Homo Sapiens; identical to SEQ ID NO: 72576

SEQ ID NO: 613964 - RNA, 64 nt, Homo Sapiens; identical to SEQ ID NO: 72577

SEQ ID NO: 613965 - RNA, 64 nt, Homo Sapiens; identical to SEQ ID NO: 72578

SEQ ID NO: 613966 - RNA, 64 nt, Homo Sapiens; identical to SEQ ID NO: 72579

SEQ ID NO: 613967 - RNA, 64 nt, Homo Sapiens; identical to SEQ ID NO: 72580

SEQ ID NO: 613968 - RNA, 64 nt, Homo Sapiens; identical to SEQ ID NO: 72581

SEQ ID NO: 613969 - RNA, 64 nt, Homo Sapiens; identical to SEQ ID NO: 72582

SEQ ID NO: 613970 - RNA, 64 nt, Homo Sapiens; identical to SEQ ID NO: 72583

SEQ ID NO: 613971 - RNA, 64 nt, Homo Sapiens; identical to SEQ ID NO: 72584

SEQ ID NO: 613972 - RNA, 64 nt, Homo Sapiens; identical to SEQ ID NO: 72585

SEQ ID NO: 613973 - RNA, 64 nt, Homo Sapiens; identical to SEQ ID NO: 72586

SEQ ID NO: 613974 - RNA, 64 nt, Homo Sapiens; identical to SEQ ID NO: 72587

SEQ ID NO: 613975 - RNA, 64 nt, Homo Sapiens; identical to SEQ ID NO: 72588

SEQ ID NO: 613976 - RNA, 64 nt, Homo Sapiens; identical to SEQ ID NO: 72589

SEQ ID NO: 613977 - RNA, 64 nt, Homo Sapiens; identical to SEQ ID NO: 72590

SEQ ID NO: 613978 - RNA, 64 nt, Homo Sapiens; identical to SEQ ID NO: 72591

SEQ ID NO: 613979 - RNA, 64 nt, Homo Sapiens; identical to SEQ ID NO: 72592

SEQ ID NO: 613980 - RNA, 64 nt, Homo Sapiens; identical to SEQ ID NO: 72593

SEQ ID NO: 613981 - RNA, 64 nt, Homo Sapiens; identical to SEQ ID NO: 72594

SEQ ID NO: 613982 - RNA, 64 nt, Homo Sapiens; identical to SEQ ID NO: 72595

SEQ ID NO: 613983 - RNA, 64 nt, Homo Sapiens; identical to SEQ ID NO: 72596

SEQ ID NO: 613984 - RNA, 64 nt, Homo Sapiens; identical to SEQ ID NO: 72597

SEQ ID NO: 613985 - RNA, 64 nt, Homo Sapiens; identical to SEQ ID NO: 72598

SEQ ID NO: 613986 - RNA, 64 nt, Homo Sapiens; identical to SEQ ID NO: 72599

SEQ ID NO: 613987 - RNA, 64 nt, Homo Sapiens; identical to SEQ ID NO: 72600

SEQ ID NO: 613988 - RNA, 64 nt, Homo Sapiens; identical to SEQ ID NO: 72601

SEQ ID NO: 613989 - RNA, 64 nt, Homo Sapiens
uugcuuucacaguagagucugauaagaauaagauuagacagauucagauuacacaaauguaagu

SEQ ID NO: 613990 - RNA, 64 nt, Homo Sapiens
acacaaauguaagugauaagaaagguagcuuaaauagacagauuaacauuuuaccccuacuccc

SEQ ID NO: 613991 - RNA, 64 nt, Homo Sapiens
uuuggcacuuuagaacaaauacguguuaauaaguuagacagaacuuauggaguuaugggucuag

SEQ ID NO: 613992 - RNA, 64 nt, Homo Sapiens
caguggagauagcuuucaaacauuaaugcuauacuagacagauauaauuaccauuuguugaaca

SEQ ID NO: 613993 - RNA, 64 nt, Homo Sapiens
ucugaaaaaacaucaagcauaguaauugucuggguagacagauuucagaauuuuuaaaaugcuu

SEQ ID NO: 613994 - RNA, 64 nt, Homo Sapiens
auuuuuagaagaacuguuguaaagccuuugagauuagacagacuagagcuacauuacugaaauu

SEQ ID NO: 613995 - RNA, 64 nt, Homo Sapiens
ggaccaggcagcccccauggcaguaaaagcagccuagacagaaccugcagcucuguggaaagag

SEQ ID NO: 613996 - RNA, 64 nt, Homo Sapiens
gcagugggccuguguggguuaugauucuagauccuagacagaggcugggucagcuguggauggg

SEQ ID NO: 613997 - RNA, 64 nt, Homo Sapiens; identical to SEQ ID NO: 193920

SEQ ID NO: 613998 - RNA, 64 nt, Homo Sapiens; identical to SEQ ID NO: 193921

SEQ ID NO: 613999 - RNA, 64 nt, Homo Sapiens; identical to SEQ ID NO: 193922

SEQ ID NO: 614000 - RNA, 64 nt, Homo Sapiens; identical to SEQ ID NO: 193923

SEQ ID NO: 614001 - RNA, 64 nt, Homo Sapiens; identical to SEQ ID NO: 193924

SEQ ID NO: 614002 - RNA, 64 nt, Homo Sapiens; identical to SEQ ID NO: 193925

SEQ ID NO: 614003 - RNA, 64 nt, Homo Sapiens; identical to SEQ ID NO: 193926

SEQ ID NO: 614004 - RNA, 64 nt, Homo Sapiens; identical to SEQ ID NO: 193927

SEQ ID NO: 614005 - RNA, 64 nt, Homo Sapiens; identical to SEQ ID NO: 193928

SEQ ID NO: 614006 - RNA, 64 nt, Homo Sapiens; identical to SEQ ID NO: 193929

SEQ ID NO: 614007 - RNA, 64 nt, Homo Sapiens; identical to SEQ ID NO: 193930

SEQ ID NO: 614008 - RNA, 64 nt, Homo Sapiens; identical to SEQ ID NO: 193931

SEQ ID NO: 614009 - RNA, 64 nt, Homo Sapiens; identical to SEQ ID NO: 193932

SEQ ID NO: 614010 - RNA, 64 nt, Homo Sapiens; identical to SEQ ID NO: 193933

SEQ ID NO: 614011 - RNA, 64 nt, Homo Sapiens; identical to SEQ ID NO: 193934

SEQ ID NO: 614012 - RNA, 64 nt, Homo Sapiens; identical to SEQ ID NO: 193935

SEQ ID NO: 614013 - RNA, 64 nt, Homo Sapiens; identical to SEQ ID NO: 193936

SEQ ID NO: 614014 - RNA, 64 nt, Homo Sapiens; identical to SEQ ID NO: 193937

SEQ ID NO: 614015 - RNA, 64 nt, Homo Sapiens; identical to SEQ ID NO: 193938

SEQ ID NO: 614016 - RNA, 64 nt, Homo Sapiens; identical to SEQ ID NO: 193939

SEQ ID NO: 614017 - RNA, 64 nt, Homo Sapiens; identical to SEQ ID NO: 193940

SEQ ID NO: 614018 - RNA, 64 nt, Homo Sapiens; identical to SEQ ID NO: 193941

SEQ ID NO: 614019 - RNA, 64 nt, Homo Sapiens; identical to SEQ ID NO: 193942

SEQ ID NO: 614020 - RNA, 64 nt, Homo Sapiens; identical to SEQ ID NO: 193943

SEQ ID NO: 614021 - RNA, 64 nt, Homo Sapiens; identical to SEQ ID NO: 193944

SEQ ID NO: 614022 - RNA, 64 nt, Homo Sapiens; identical to SEQ ID NO: 193945

SEQ ID NO: 614023 - RNA, 64 nt, Homo Sapiens; identical to SEQ ID NO: 193946

SEQ ID NO: 614024 - RNA, 64 nt, Homo Sapiens; identical to SEQ ID NO: 193947

SEQ ID NO: 614025 - RNA, 64 nt, Homo Sapiens; identical to SEQ ID NO: 193948

SEQ ID NO: 614026 - RNA, 64 nt, Homo Sapiens; identical to SEQ ID NO: 193949

SEQ ID NO: 614027 - RNA, 64 nt, Homo Sapiens; identical to SEQ ID NO: 193950

SEQ ID NO: 614028 - RNA, 64 nt, Homo Sapiens; identical to SEQ ID NO: 193951

SEQ ID NO: 614029 - RNA, 64 nt, Homo Sapiens; identical to SEQ ID NO: 193952

SEQ ID NO: 614030 - RNA, 64 nt, Homo Sapiens; identical to SEQ ID NO: 193953

SEQ ID NO: 614031 - RNA, 64 nt, Homo Sapiens; identical to SEQ ID NO: 193954

SEQ ID NO: 614032 - RNA, 64 nt, Homo Sapiens; identical to SEQ ID NO: 193955

SEQ ID NO: 614033 - RNA, 64 nt, Homo Sapiens; identical to SEQ ID NO: 193956

SEQ ID NO: 614034 - RNA, 64 nt, Homo Sapiens; identical to SEQ ID NO: 193957

SEQ ID NO: 614035 - RNA, 64 nt, Homo Sapiens; identical to SEQ ID NO: 193958

SEQ ID NO: 614036 - RNA, 64 nt, Homo Sapiens; identical to SEQ ID NO: 193959

SEQ ID NO: 614037 - RNA, 64 nt, Homo Sapiens; identical to SEQ ID NO: 193960

SEQ ID NO: 614038 - RNA, 54 nt, Homo Sapiens; identical to SEQ ID NO: 193961

SEQ ID NO: 614039 - RNA, 64 nt, Homo Sapiens; identical to SEQ ID NO: 193962

SEQ ID NO: 614040 - RNA, 64 nt, Homo Sapiens; identical to SEQ ID NO: 193963

SEQ ID NO: 614041 - RNA, 64 nt, Homo Sapiens; identical to SEQ ID NO: 193964

SEQ ID NO: 614042 - RNA, 64 nt, Homo Sapiens; identical to SEQ ID NO: 193965

SEQ ID NO: 614043 - RNA, 64 nt, Homo Sapiens
uguccaaacuuuuccauuuuagauuccuuuauagacacgucagccuaaaaaucagccuauucgg

SEQ ID NO: 614044 - RNA, 64 nt, Homo Sapiens
aaaaaucucauguguucaaauuaacauaaauauuacacgucaauacacuguacauggugguaau

SEQ ID NO: 614045 - RNA, 64 nt, Homo Sapiens
agaaaccuuaaaggauuugaauauuucaaauugcacacgucacuccagcaucucuguaaaauaa

SEQ ID NO: 614046 - RNA, 64 nt, Homo Sapiens
gucgcuuccaguuuuagaaacacacaccuucaauacacgucaaguccgucggaagcauuuggca

SEQ ID NO: 614047 - RNA, 64 nt, Homo Sapiens
uaugcgauuuaaaacaaacuggaaaggaaacuucacacgucaaaauccauagaagcgccuggac

SEQ ID NO: 614048 - RNA, 64 nt, Homo Sapiens
uacgauugagcaucuccaucuccaaaguguucucacacgucacauccaacaaauuuuaaacgaa

SEQ ID NO: 614049 - RNA, 64 nt, Homo Sapiens
ugcugcuuggugccucucugauacgaauacacugacacgucaaaguaaccuaauguggacacca

SEQ ID NO: 614050 - RNA, 64 nt, Homo Sapiens
ccuggaucugucacuaacuugcugcgugaccugaacacgucacuuuaccucucugugccucagu

SEQ ID NO: 614051 - RNA, 64 nt, Homo Sapiens
aguuagcagugaaauuguucggaaaaaaaaaaaaacacgucaaagagaaugaagauuggaaaaa

SEQ ID NO: 614052 - RNA, 64 nt, Homo Sapiens
uccuuuuuguauuuuuaaacacucacuaauguuaacacgucauuacucuuccacaccugccuau

SEQ ID NO: 614053 - RNA, 64 nt, Homo Sapiens
uacuugaaaacauuuggauugguaggauuuuguaacacgucaaccauuugaugcuucugaaaag

SEQ ID NO: 614054 - RNA, 64 nt, Homo Sapiens
acgugggaucagaaucuuccgauuguuuuuuggaacacgucaagugcuguuaccuuugugaccu

SEQ ID NO: 614055 - RNA, 64 nt, Homo Sapiens
ucgaugauuaaaauccuucaaguauuuguucaugacacgucaaccgguacccaggguugcuuca

SEQ ID NO: 614056 - RNA, 64 nt, Homo Sapiens
gaagaaaauaguggugcuuccaugaccaacacauacacgucauacuuauucauacuagcaugcu

SEQ ID NO: 614057 - RNA, 64 nt, Homo Sapiens
augugggaucagaaagaaaaugcucuaagcuuugacacgucaaaaaguguggauuccuacuucc

SEQ ID NO: 614058 - RNA, 64 nt, Homo Sapiens
guuaguuacuaguuauuacagcuguaaggauaaaacacgucauguggauucauuuugaauuggu

SEQ ID NO: 614059 - RNA, 64 nt, Homo Sapiens
caugccucacugacagaccagcauuuuuuuuuuaacacgucaauaaaaaaauaaucucccagaa

SEQ ID NO: 614060 - RNA, 64 nt, Homo Sapiens
ugcauuguuauuggagccugccacccacccccacacacgucaucuccuucucucucucccccca

SEQ ID NO: 614061 - RNA, 64 nt, Homo Sapiens
cucaaugccucagacuuucagccacgucgcgccaacacgucauaaggcacacuccaggaagacu

SEQ ID NO: 614062 - RNA, 64 nt, Homo Sapiens
uuauaugaccuuaaggacaauacugccacuacacacacgucauuggcacuucagcacauguggg

SEQ ID NO: 614063 - RNA, 64 nt, Homo Sapiens
guuuauuuuuguuccuuuguguuuggguuggaauacacgucauuaguugcauagauuucucauu

SEQ ID NO: 614064 - RNA, 56 nt, Homo Sapiens
gaccacaaguguauuuuuagucaucuacacgucaaauaucccaagacagauuaugc

SEQ ID NO: 614065 - RNA, 64 nt, Homo Sapiens
cucaagggcguaacucuggaagcacagcuugacuacacgucauuuuuaccaaugauuuucaggu

SEQ ID NO: 614066 - RNA, 64 nt, Homo Sapiens
ugagugguuccacugccuggauaacccuugaggaacacgucaguuacugucacgauggggcagg

SEQ ID NO: 614067 - RNA, 64 nt, Homo Sapiens
ucuuagcuaagcggaccagcucuaagacuacagcacacgucauuaguugaaugggcacagcaac

SEQ ID NO: 614068 - RNA, 64 nt, Homo Sapiens
guauugaugugauucaaaaucuucuauucacaguacacgucacauggccaaaaccuggccgucu

SEQ ID NO: 614069 - RNA, 64 nt, Homo Sapiens
gcuguuaagaaugugcccuacgcugcguuuuuauacacgucaaaggcauguguccucugcaggg

SEQ ID NO: 614070 - RNA, 64 nt, Homo Sapiens
agucacaggaugagacaggaggucagcacaagauacacgucacaaagaccuugcugauaaaaca

SEQ ID NO: 614071 - RNA, 64 nt, Homo Sapiens
guaauggccucguaaguacaggugaugguuuuggacacgucaggaauuccuaaaggcugaaaga

SEQ ID NO: 614072 - RNA, 64 nt, Homo Sapiens
ggaugagcaugcuucauuggauucauuuuauuuuacacgucaguauuguuuuaaaguuucuguc

SEQ ID NO: 614073 - RNA, 64 nt, Homo Sapiens
ggagggcugcguauuuguaacuugccauuuuaauacacgucauuagauuucaaacagugauaga

SEQ ID NO: 614074 - RNA, 64 nt, Homo Sapiens
acacuuccaccagccugcacuacucccucaaagcacacgucauguuucuucauccggcagccug

SEQ ID NO: 614075 - RNA, 64 nt, Homo Sapiens
gaggauggucuccacccaucuuucuauuuccaguacacgucacauuauuuuaccggugagauga

SEQ ID NO: 614076 - RNA, 64 nt, Homo Sapiens
gaaguugcucgcuucuguguugacuuagaucaagacacgucacgcauccuuucugggguaguac

SEQ ID NO: 614077 - RNA, 64 nt, Homo Sapiens
uccagggcagcuacacgugggcccuccuaggcucacacgucaaugaagagcauugccaucacug

SEQ ID NO: 614078 - RNA, 64 nt, Homo Sapiens
auucuuuucuguucuuggcauggcgggccgggcaacacgucaacggccugggcaggggcccgcu

SEQ ID NO: 614079 - RNA, 64 nt, Homo Sapiens
agcuggagcaaccaaaacugcuucugguuuaggcacacgucacgggugcgggagacccgggcac

SEQ ID NO: 614080 - RNA, 64 nt, Homo Sapiens
cgugagagcccaaucacugccuauaccccucaucacacgucacaaugucccgaauucccagccu

SEQ ID NO: 614081 - RNA, 64 nt, Homo Sapiens
ugaagggguaugucaggcggggaaggggccaaggacacgucauuguacccugagcguccccagg

SEQ ID NO: 614082 - RNA, 64 nt, Homo Sapiens
ucagaugagaggaagauggcucccugcuggaggaacacgucauagggcacccgcucucccuccc

SEQ ID NO: 614083 - RNA, 64 nt, Homo Sapiens
caacagcagugccucugcagcagcaaccccccgcacacgucagccgcucaauggcccggagggg

SEQ ID NO: 614084 - RNA, 64 nt, Homo Sapiens
guguaaggaaaaauaaaaguauuaggccccagcaacacgucauuuucuacuguuaugugagaac

SEQ ID NO: 614085 - RNA, 64 nt, Homo Sapiens
ugcaacacucgcuccucuucgcgaguggucuccuacacgucaccuucuuggacaucuugaccca

SEQ ID NO: 614086 - RNA, 64 nt, Homo Sapiens
gauagcaaaagaaagguacagaaugaauaugggaacacgucauuaagaaaaugaguuacacuga

SEQ ID NO: 614087 - RNA, 64 nt, Homo Sapiens
aaagccauaaaugacugugagauguaugagaaugacacgucacauuaguaagaagagaaaaauu

SEQ ID NO: 614088 - RNA, 64 nt, Homo Sapiens
agacaucagagaaucuauacuuugcuucacguucacacgucauugugaugauuguggcaaagcc

SEQ ID NO: 614089 - RNA, 64 nt, Homo Sapiens
aggaccuccugagguucgugucaacaccauggacacacgucaucugugaaaccaaacugcagcc

SEQ ID NO: 614090 - RNA, 64 nt, Homo Sapiens
agggcuuaguuaguaccuugccacucuacccccaacacgucacccgaguagaagcugggcaagg

SEQ ID NO: 614091 - RNA, 64 nt, Homo Sapiens
ggagcaguugacggcagggagugcuucauaucagacacgucaucgccaaguucaccaucacgga

SEQ ID NO: 614092 - RNA, 64 nt, Homo Sapiens
guccugguuucugaguaaagagaaugugugcaaaacacgucacacacacugugaaagugaaaag

SEQ ID NO: 614093 - RNA, 64 nt, Homo Sapiens
ccaucccucuccaccccuuccccccaaaagguuuucuuugcaagugcuuuuggaacuaagagcu

SEQ ID NO: 614094 - RNA, 64 nt, Homo Sapiens
gccagucccugaacauaucauugaaaguuaauuuucuuugcauuuuaaaauaucuggauuauga

SEQ ID NO: 614095 - RNA, 64 nt, Homo Sapiens
uauggaaacuugauauuaaaaacuagucugugguucuuugcaguuucuuguaaauuuauaaacc

SEQ ID NO: 614096 - RNA, 64 nt, Homo Sapiens
cugggcagguuuccugugucaguauucccccuccucuuugcauuaaucaagguauuugguagag

SEQ ID NO: 614097 - RNA, 64 nt, Homo Sapiens
ugagaggcacuguuaaaaauaauucuuuuacgugucuuugcauuaaauucuuuggcuaguuauu

SEQ ID NO: 614098 - RNA, 64 nt, Homo Sapiens
agaggggcauuacugucaccaugacaguuuguucucuuugcaagcagcucuucauguuacacua

SEQ ID NO: 614099 - RNA, 64 nt, Homo Sapiens
agcagagagauugaacuuugaggaggaagcagaaucuuugcaagaaagucagaccuguuucuug

SEQ ID NO: 614100 - RNA, 64 nt, Homo Sapiens
ccuguacaagcugauguuuuguauuuuguguuccucuuugcaugaucugucaaagugagauauu

SEQ ID NO: 614101 - RNA, 64 nt, Homo Sapiens
gacuagaugaaagguguccaugguuagaauuugaucuuugcaaacuguauauaauuguuauuuu

SEQ ID NO: 614102 - RNA, 64 nt, Homo Sapiens
aaaaaaaaaaaagaaaaucucauuagugaacuuaucuuugcagcugaguacuuaaauucuuuuu

SEQ ID NO: 614103 - RNA, 64 nt, Homo Sapiens
aagguugguuucgcuuuuuuaguuuuaaaauuaaucuuugcauguaaaagaacugacuuuugau

SEQ ID NO: 614104 - RNA, 64 nt, Homo Sapiens
ccauguguaauauaccuagcauaguaguaauuucucuuugcauguugagugcuaugcaaauaac

SEQ ID NO: 614105 - RNA, 64 nt, Homo Sapiens
auucacuagagguucccuuucuguuuucuuccagucuuugcagugguagguaacaucuuacauu

SEQ ID NO: 614106 - RNA, 64 nt, Homo Sapiens
ccugucccgugggcuguguuucuuguuguuuuucucuuugcaaagacauagcuaggaaagcgaa

SEQ ID NO: 614107 - RNA, 64 nt, Homo Sapiens
uauggugacguccuuuugcugugaauaaaggugcucuuugcagcaauccuggggguccuggucu

SEQ ID NO: 614108 - RNA, 64 nt, Homo Sapiens
cuggcuuuugccuggagcacuauuuguuuaguucucuuugcaggacaagaauucucucagggug

SEQ ID NO: 614109 - RNA, 64 nt, Homo Sapiens
auuaggcacaaagggauucccauaucccuccucuucuuugcauauuucccccucuaauuagcau

SEQ ID NO: 614110 - RNA, 64 nt, Homo Sapiens
cuaaaaacaucagacaauggggaccuaaucgacuucuuugcacaaggauuuggggggaucuuag

SEQ ID NO: 614111 - RNA, 64 nt, Homo Sapiens
uuaucaccuugugaaugucgcaaaacaaacuuguucuuugcagcucuaaauuuaaaaaggaaaa

SEQ ID NO: 614112 - RNA, 64 nt, Homo Sapiens
gcagcagcaccuccagacuggaaaaauauguuaaucuuugcaucauauuggacucuugaaggca

SEQ ID NO: 614113 - RNA, 64 nt, Homo Sapiens
ucccugaauccuacuugaacauuguauaaauuucucuuugcauauaauacauauuugugaauga

SEQ ID NO: 614114 - RNA, 64 nt, Homo Sapiens
acauauuuucuuuacuguaaucugguggucugucucuuugcagguuugccauagaacuaaauau

SEQ ID NO: 614115 - RNA, 64 nt, Homo Sapiens
aaaacagcuucuccacacaucagagaucauaacuucuuugcaagccaaugauggcaugacaauc

SEQ ID NO: 614116 - RNA, 64 nt, Homo Sapiens
cuggguggcuauggguacuuauccaccuccaucuucuuugcagcgccauguggcugccccauuu

SEQ ID NO: 614117 - RNA, 64 nt, Homo Sapiens
guggucccugcccucaucucgcgcccugggcucgucuuugcagacuaggagggggcucgcugcu

SEQ ID NO: 614118 - RNA, 64 nt, Homo Sapiens
ucagucuaagucucguauuuaauggcccuuucccucuuugcagucucaguuacuccauugguga

SEQ ID NO: 614119 - RNA, 64 nt, Homo Sapiens
uguaugguacugaaaaaucucuuauaguaggacuucuuugcauagcuuuguguguuuaacugag

SEQ ID NO: 614120 - RNA, 64 nt, Homo Sapiens
agaaggucacuacucacauuccaaacugucaccaucuuugcagccaacugucaccaucuuugca

SEQ ID NO: 614121 - RNA, 64 nt, Homo Sapiens
aaacugucaccaucuuugcacccaacugucaccaucuuugcaccgcucuaauuccauccaucua

SEQ ID NO: 614122 - RNA, 64 nt, Homo Sapiens
uaaggaggucucaugugcuguaggaguaaaaaagucuuugcauaaaacaguauuuauuuuuacu

SEQ ID NO: 614123 - RNA, 64 nt, Homo Sapiens
uuuuguuuuuuguuauugauauuaaacaguguaaucuuugcaagcguauauugaagauuauucu

SEQ ID NO: 614124 - RNA, 64 nt, Homo Sapiens
aauccaaauauuguuaagggugggugcugcuaauucuuugcaaaacauaauuaacacuuaaggu

SEQ ID NO: 614125 - RNA, 64 nt, Homo Sapiens
uuuucuuaaucauuuuuuaucuuaauacuguuauucuuugcacuuacuguaaaaugcaaaaaau

SEQ ID NO: 614126 - RNA, 64 nt, Homo Sapiens
uucauauuccaguggucaauguagauuucaaguugaaaggcagucccuuuaguugggggcuguc

SEQ ID NO: 614127 - RNA, 64 nt, Homo Sapiens
aagcgagguuucaugacacaaccuuucaugucgugaaaggcagagggugacugugugugaugug

SEQ ID NO: 614128 - RNA, 64 nt, Homo Sapiens
gggagagcgcugagaagacugcaucaggaaaggagaaaggcagaacagugcugaucgugucuca

SEQ ID NO: 614129 - RNA, 64 nt, Homo Sapiens
acuaacgugcggaaacauuugcuggaccgcgugugaaaggcagacugugcccccgcugaaccug

SEQ ID NO: 614130 - RNA, 64 nt, Homo Sapiens
agaauuacuugguggccucagucgcaauagcaaugaaaggcauagaauggucucaauuacuguu

SEQ ID NO: 614131 - RNA, 64 nt, Homo Sapiens
gggcuuuaaagagcgaaauggcuuauggggcccagaaaggcacuaaauggcccuacuguagaca

SEQ ID NO: 614132 - RNA, 63 nt, Homo Sapiens
caaugaguuuguacaaauaacuggggucaucgggaaaggcaaagaaacugaaggcagaguccu

SEQ ID NO: 614133 - RNA, 64 nt, Homo Sapiens
cauugucuuuccugaaugacuuucuaacugugcagaaaggcagaaaagucaucauauguauaug

SEQ ID NO: 614134 - RNA, 64 nt, Homo Sapiens
aaaugguuuuuuccucuggaaaacagauucaagggaaaggcacuaaaaggauguauguguauaa

SEQ ID NO: 614135 - RNA, 64 nt, Homo Sapiens
aggaaccugaguaugagaauagcaggcugaagaggaaaggcaggcccagaacaggauccccaga

SEQ ID NO: 614136 - RNA, 64 nt, Homo Sapiens
cauucaguggacagugggaaauuuauuaauauuugaaaggcauugcuuguaaauacuguaauau

SEQ ID NO: 614137 - RNA, 64 nt, Homo Sapiens
gcggcugcauuucauaccacuagcaccguuucaugaaaggcauggucuguagucagcaccacga

SEQ ID NO: 614138 - RNA, 64 nt, Homo Sapiens
aauugcuuuugcuccugaaaccugggaaucaauggaaaggcagggaaugugccucuucuguggc

SEQ ID NO: 614139 - RNA, 64 nt, Homo Sapiens
uuuccugacaagguauauuuguuuucuagugacagaaaggcaaaggaacaaguccuaguuguug

SEQ ID NO: 614140 - RNA, 64 nt, Homo Sapiens
cuguuggugauugcauggugucucggugcauggggaaaggcaaggucuucugagcucaucuuaa

SEQ ID NO: 614141 - RNA, 64 nt, Homo Sapiens
cacugcacuaauuggcaugucagccuccagcucagaaaggcauuugcucaugguuacaggcauc

SEQ ID NO: 614142 - RNA, 64 nt, Homo Sapiens
cauuugaaggagggagggggccuaacaaaauauugaaaggcaaaugacucuugacucuugccug

SEQ ID NO: 614143 - RNA, 64 nt, Homo Sapiens
agucauuuucaagacugaauggaacagugcuacugaaaggcaguacccacucagagaugcauuu

SEQ ID NO: 614144 - RNA, 64 nt, Homo Sapiens
acuugaggagaaaaccuuuacaauuuccuaugggugucagaaguacucucagcgaaaacugaug

SEQ ID NO: 614145 - RNA, 64 nt, Homo Sapiens
caaaugggcauuuauauaaacuugugauguuucuugucagaauucugaguacucugugaagaac

SEQ ID NO: 614146 - RNA, 64 nt, Homo Sapiens
agaaugggaaggagaccauuggguaacccucaagugucagaaguuguuucuaaaguaacuauac

SEQ ID NO: 614147 - RNA, 64 nt, Homo Sapiens
uccuguucuaauaaaugcacggcuuuaccuuuccugucagaaauaaaccaaggcucuaaaagau

SEQ ID NO: 614148 - RNA, 64 nt, Homo Sapiens
uggugaguuguuuugaacaguuguucuuuguuauugucagaaccacucaaaucucagccccaug

SEQ ID NO: 614149 - RNA, 64 nt, Homo Sapiens
uaguuaacauucaaaaaacucaguaacuccaaagugucagaaaaaauggaaaugggaagagcaa

SEQ ID NO: 614150 - RNA, 64 nt, Homo Sapiens
cuuaggaagcuuugccaguaggacuucacagagcugucagaagaagcauuggaaaaagccacuu

SEQ ID NO: 614151 - RNA, 64 nt, Homo Sapiens
cuugggaagguuugccagcaggacuuuacagagcugucagaagacucucuggagauagcuaccu

SEQ ID NO: 614152 - RNA, 64 nt, Homo Sapiens
ugggagugauuuugcaacugaguggauugagugcugucagaaaguggauugagugcugucagaa

SEQ ID NO: 614153 - RNA, 64 nt, Homo Sapiens
uggauugagugcugucagaaucuggauugagugcugucagaaagucaagugagcaaggguuucu

SEQ ID NO: 614154 - RNA, 64 nt, Homo Sapiens
aauuaggauucaugugguuucuaagauuuggacaugucagaauuuugugagucauggauggggc

SEQ ID NO: 614155 - RNA, 64 nt, Homo Sapiens
agugauuacugcuauuacuauauuuacuugcauaugucagaaugaugugauagacuaucucugu

SEQ ID NO: 614156 - RNA, 64 nt, Homo Sapiens
cacugaacaauuaagaaauugggcuggggaaacuugucagaaaggaauagcuaagagauaaauu

SEQ ID NO: 614157 - RNA, 64 nt, Homo Sapiens
caggacuaaguagcagagaaccccguaugaugauugucagaagaacuguaaggcagaugaucgu

SEQ ID NO: 614158 - RNA, 64 nt, Homo Sapiens
accuauauccagauuuucuuucugcugaagcuguugucagaaucuuccuuuggacaaaacauca

SEQ ID NO: 614159 - RNA, 64 nt, Homo Sapiens
agcaaaauacaggaaaagaacuauccaguauaaaugucagaagacagauuuccuaaacaaguaa

SEQ ID NO: 614160 - RNA, 64 nt, Homo Sapiens
guuaguguugugcuuugccuucuuuggcgaugaaugucagaaauugaaugccacaugcuuucau

SEQ ID NO: 614161 - RNA, 64 nt, Homo Sapiens
agugauuuaccuguccauuuccaacccaaaagccugucagaaagcauucuuuagagaaaaccac

SEQ ID NO: 614162 - RNA, 64 nt, Homo Sapiens
gagccauucucuccuccugaagucgauccuagagugucagaacacuguugaccuguaaggaagc

SEQ ID NO: 614163 - RNA, 64 nt, Homo Sapiens
gacacaggugguaauuuggauuccgcccucucuuugucagaaggauguucaaggaguguuacug

SEQ ID NO: 614164 - RNA, 64 nt, Homo Sapiens
uugucaggcagagauguuuaaauagcaaagcugcugucagaaguuguaguucaggcacagaaag

SEQ ID NO: 614165 - RNA, 64 nt, Homo Sapiens
ggaccuugguuuccuguucaagggaggcaaagcaugucagaaacaauaaggaaggaagggaggc

SEQ ID NO: 614166 - RNA, 64 nt, Homo Sapiens
aagggagacuguugcucaaccaucaggaaacaguugucagaagacaucauugguucuguguuuc

SEQ ID NO: 614167 - RNA, 64 nt, Homo Sapiens
agaaagucgcauaggguuuuuuaaugcagaauuuugucagaagacaauggcgcugcauguuuuu

SEQ ID NO: 614168 - RNA, 64 nt, Homo Sapiens
cccugaguucccccuggauauuuugcacagcucuugucagaaaggaugaagcaaaccuuugaau

SEQ ID NO: 614169 - RNA, 64 nt, Homo Sapiens
ucaaucucaacaaaauaauuccaagaagucaucaugucagaaaccacaagagaaagcaaacugc

SEQ ID NO: 614170 - RNA, 64 nt, Homo Sapiens
uacuccagaacaaccaccccagagaauuuauuugugucagaaaaccaauuggugugggagaauu

SEQ ID NO: 614171 - RNA, 64 nt, Homo Sapiens
gaauuauagaacacccaguucuuggagaaguuagugucagaauuacuuguggagucugcacuaa

SEQ ID NO: 614172 - RNA, 64 nt, Homo Sapiens
uuuuuaaauaauagucugauuagcagagaauuaaugucagaaccaugguuucagugaaacaauc

SEQ ID NO: 614173 - RNA, 64 nt, Homo Sapiens
gaagaguaaaucuacuuguuucgcugaugugauaugucagaacuucguaaagagguaccaacug

SEQ ID NO: 614174 - RNA, 64 nt, Homo Sapiens
aauauauguaacaggcucaaugucagaaauucuuugucagaacaugugcagugagcaauuuuug

SEQ ID NO: 614175 - RNA, 64 nt, Homo Sapiens
ucuuugucagaacaaauauagugagcaauuuuugugucagaaauucucugagauucugugugca

SEQ ID NO: 614176 - RNA, 64 nt, Homo Sapiens; identical to SEQ ID NO: 344312

SEQ ID NO: 614177 - RNA, 64 nt, Homo Sapiens; identical to SEQ ID NO: 344313

SEQ ID NO: 614178 - RNA, 64 nt, Homo Sapiens; identical to SEQ ID NO: 344314

SEQ ID NO: 614179 - RNA, 64 nt, Homo Sapiens; identical to SEQ ID NO: 344315

SEQ ID NO: 614180 - RNA, 64 nt, Homo Sapiens; identical to SEQ ID NO: 344316

SEQ ID NO: 614181 - RNA, 64 nt, Homo Sapiens; identical to SEQ ID NO: 344317

SEQ ID NO: 614182 - RNA, 64 nt, Homo Sapiens; identical to SEQ ID NO: 344318

SEQ ID NO: 614183 - RNA, 64 nt, Homo Sapiens; identical to SEQ ID NO: 344319

SEQ ID NO: 614184 - RNA, 64 nt, Homo Sapiens; identical to SEQ ID NO: 344320

SEQ ID NO: 614185 - RNA, 64 nt, Homo Sapiens; identical to SEQ ID NO: 344321

SEQ ID NO: 614186 - RNA, 64 nt, Homo Sapiens; identical to SEQ ID NO: 344322

SEQ ID NO: 614187 - RNA, 58 nt, Homo Sapiens; identical to SEQ ID NO: 344323

SEQ ID NO: 614188 - RNA, 64 nt, Homo Sapiens; identical to SEQ ID NO: 344324

SEQ ID NO: 614189 - RNA, 64 nt, Homo Sapiens
acccaaaacaagccugguaggacuguguaaaauguaaugcaacugagauaugggaacacuggca

SEQ ID NO: 614190 - RNA, 64 nt, Homo Sapiens
gaagugcuccccucugaaagcugggagguugguuuaaugcaauauuuggucaucaagggugcgu

SEQ ID NO: 614191 - RNA, 64 nt, Homo Sapiens
gacuuugucucaucagucuuccacccugugcagguaaugcaacucuaugcgccucacuagcuua

SEQ ID NO: 614192 - RNA, 64 nt, Homo Sapiens
augaggacuucuauugucuccaaauggaaauucuuaaugcaaucucugaguaaaauucuuaagc

SEQ ID NO: 614193 - RNA, 64 nt, Homo Sapiens
ugaguucccuaauauauucuuauauguagagcaauaaugcaaaagcuguucuauaugcaaacau

SEQ ID NO: 614194 - RNA, 64 nt, Homo Sapiens
accuuuuuguaauguaguaucaaaguuuuuuagguaaugcaaaauuuuacaaaucauuugugga

SEQ ID NO: 614195 - RNA, 64 nt, Homo Sapiens
ucauuagugauauuuuuucucuuuagagcauuuuuaaugcaacuagccccuauauuuuaaugua

SEQ ID NO: 614196 - RNA, 64 nt, Homo Sapiens
auguuuguauaaaaaaaaacaguguaaaccuuuuuaaugcaaauuuauuuuuuucauugcauau

SEQ ID NO: 614197 - RNA, 64 nt, Homo Sapiens
auggaacuaucacuuuauaagaaucauuuucuaguaaugcaaacaaauuauuuuuuacaaaaaa

SEQ ID NO: 614198 - RNA, 64 nt, Homo Sapiens
gacaaacuuuuauguuuacagggcacgucuguuguaaugcaaagcauauuuggcaagcaguuca

SEQ ID NO: 614199 - RNA, 64 nt, Homo Sapiens
auucaucaaggcaugauuuuuguuucacuacaaauaaugcaaacuguuuucaauaaaaagagga

SEQ ID NO: 614200 - RNA, 64 nt, Homo Sapiens
ccuacugaagauagguucucuauguauucaacaauaaugcaacuuuagaaguauuccacacugc

SEQ ID NO: 614201 - RNA, 64 nt, Homo Sapiens
uuuuaauuugucuuuauuuuauaauuuuaaauuuuaaugcaaaaaugccgaagaggaauauggu

SEQ ID NO: 614202 - RNA, 64 nt, Homo Sapiens
ugccacggaaaguuugggggcucugguuuuaccauaaugcaaugauacaaaauaggugaugaac

SEQ ID NO: 614203 - RNA, 65 nt, Homo Sapiens; identical to SEQ ID NO: 192314

SEQ ID NO: 614204 - RNA, 65 nt, Homo Sapiens; identical to SEQ ID NO: 192315

SEQ ID NO: 614205 - RNA, 65 nt, Homo Sapiens; identical to SEQ ID NO: 192316

SEQ ID NO: 614206 - RNA, 65 nt, Homo Sapiens; identical to SEQ ID NO: 192317

SEQ ID NO: 614207 - RNA, 65 nt, Homo Sapiens; identical to SEQ ID NO: 192346

SEQ ID NO: 614208 - RNA, 65 nt, Homo Sapiens; identical to SEQ ID NO: 192347

SEQ ID NO: 614209 - RNA, 65 nt, Homo Sapiens; identical to SEQ ID NO: 192359

SEQ ID NO: 614210 - RNA, 65 nt, Homo Sapiens; identical to SEQ ID NO: 192360

SEQ ID NO: 614211 - RNA, 65 nt, Homo Sapiens; identical to SEQ ID NO: 192372

SEQ ID NO: 614212 - RNA, 65 nt, Homo Sapiens; identical to SEQ ID NO: 192373

SEQ ID NO: 614213 - RNA, 65 nt, Homo Sapiens; identical to SEQ ID NO: 192406

SEQ ID NO: 614214 - RNA, 65 nt, Homo Sapiens; identical to SEQ ID NO: 192407

SEQ ID NO: 614215 - RNA, 65 nt, Homo Sapiens; identical to SEQ ID NO: 192416

SEQ ID NO: 614216 - RNA, 65 nt, Homo Sapiens; identical to SEQ ID NO: 192417

SEQ ID NO: 614217 - RNA, 65 nt, Homo Sapiens; identical to SEQ ID NO: 192438

SEQ ID NO: 614218 - RNA, 65 nt, Homo Sapiens; identical to SEQ ID NO: 192439

SEQ ID NO: 614219 - RNA, 65 nt, Homo Sapiens; identical to SEQ ID NO: 192440

SEQ ID NO: 614220 - RNA, 65 nt, Homo Sapiens; identical to SEQ ID NO: 192459

SEQ ID NO: 614221 - RNA, 65 nt, Homo Sapiens; identical to SEQ ID NO: 192460

SEQ ID NO: 614222 - RNA, 65 nt, Homo Sapiens; identical to SEQ ID NO: 192545

SEQ ID NO: 614223 - RNA, 65 nt, Homo Sapiens; identical to SEQ ID NO: 192546

SEQ ID NO: 614224 - RNA, 65 nt, Homo Sapiens; identical to SEQ ID NO: 192550

SEQ ID NO: 614225 - RNA, 65 nt, Homo Sapiens; identical to SEQ ID NO: 192551

SEQ ID NO: 614226 - RNA, 65 nt, Homo Sapiens; identical to SEQ ID NO: 192564

SEQ ID NO: 614227 - RNA, 65 nt, Homo Sapiens; identical to SEQ ID NO: 192565

SEQ ID NO: 614228 - RNA, 65 nt, Homo Sapiens; identical to SEQ ID NO: 192611

SEQ ID NO: 614229 - RNA, 65 nt, Homo Sapiens; identical to SEQ ID NO: 192612

SEQ ID NO: 614230 - RNA, 65 nt, Homo Sapiens; identical to SEQ ID NO: 192632

SEQ ID NO: 614231 - RNA, 65 nt, Homo Sapiens; identical to SEQ ID NO: 192633

SEQ ID NO: 614232 - RNA, 65 nt, Homo Sapiens; identical to SEQ ID NO: 192653

SEQ ID NO: 614233 - RNA, 65 nt, Homo Sapiens; identical to SEQ ID NO: 192654

SEQ ID NO: 614234 - RNA, 65 nt, Homo Sapiens; identical to SEQ ID NO: 192659

SEQ ID NO: 614235 - RNA, 65 nt, Homo Sapiens; identical to SEQ ID NO: 192660

SEQ ID NO: 614236 - RNA, 60 nt, Homo Sapiens
aaugcuguaugaauggaaaucauuuugcaauugagugacacuucauuguaauucacagug

SEQ ID NO: 614237 - RNA, 60 nt, Homo Sapiens
auuucuccagacaggaaagcuuuagaaaacuugagugaaauggagcaagcuugaaggagu

SEQ ID NO: 614238 - RNA, 60 nt, Homo Sapiens
aaaggccucgggcuuggcaaauggaagaacuugagugagaguucagucugcaguccucug

SEQ ID NO: 614239 - RNA, 60 nt, Homo Sapiens
cauucuuucauugacagcugacauaauucauugagugaaauauuuuaagccaaaaaaaaa

SEQ ID NO: 614240 - RNA, 60 nt, Homo Sapiens
ucagauggagauaaggauuccagauggcacuugagugaagaugagaauagauccuaugug

SEQ ID NO: 614241 - RNA, 60 nt, Homo Sapiens
ccacugacccccguugaccaggcugccuucuugagugaggugcugcggcggaccugccac

SEQ ID NO: 614242 - RNA, 60 nt, Homo Sapiens
caggcucuccccaucuccccugcuuugguguugagugaugagcugagucagggauaggga

SEQ ID NO: 614243 - RNA, 60 nt, Homo Sapiens
uuuaaugaaucuugcuuucuaauaaauaaauugagugauucugguugcauuccuauuucc

SEQ ID NO: 614244 - RNA, 60 nt, Homo Sapiens
uacuuacucauagugguuguuucucuggucuugagugacuguguccacaguucauuuuuu

SEQ ID NO: 614245 - RNA, 60 nt, Homo Sapiens
uguuuuuaauggcucaacugucugauguaauugagugaagguuugcacugagaaauuagc

SEQ ID NO: 614246 - RNA, 60 nt, Homo Sapiens
aauuuugagcuuaucugucuuauuuaugcuuugagugaaucaucuguugaggucuaaugc

SEQ ID NO: 614247 - RNA, 60 nt, Homo Sapiens
agcacuggaaacaguuucauggaguuuaaguugagugaacaucggccaugaaaauccauc

SEQ ID NO: 614248 - RNA, 60 nt, Homo Sapiens
ccuuuugagaugacauuauugucuccauaauugagugauagcuuuaaaaaaaagauuagu

SEQ ID NO: 614249 - RNA, 60 nt, Homo Sapiens
gacuaaacguuucgguagaaugcuucauacuugagugaugcuggauaagguauuguauuu

SEQ ID NO: 614250 - RNA, 60 nt, Homo Sapiens
uugaaaucauuccaguauauuugggaagaauugagugaaugagaaugcucuuccuuauuc

SEQ ID NO: 614251 - RNA, 60 nt, Homo Sapiens
gagccaugguugcaccacugcucuccaggcuugagugacagagcaagacuguaucucaaa

SEQ ID NO: 614252 - RNA, 60 nt, Homo Sapiens
uuuggguauaggguugaggggaaauaaguuuugagugagaaauaaacguuuuagcugaaa

SEQ ID NO: 614253 - RNA, 60 nt, Homo Sapiens
uugcacaauuuuuaugucuaguauguaugcuugagugaaugugcgaguaugaaugauuag

SEQ ID NO: 614254 - RNA, 60 nt, Homo Sapiens
ccugucuucugggcaauauuucuaaaauauuugagugacauugauguuuaagugaccucc

SEQ ID NO: 614255 - RNA, 60 nt, Homo Sapiens
aacaucucaaguacguaaauuaaguugucauugagugaaagguucacuuggaccuagugc

SEQ ID NO: 614256 - RNA, 60 nt, Homo Sapiens
cauagguuauauuucccaaaucuuuaauuauugagugaaagagcuauagaugaauugaua

SEQ ID NO: 614257 - RNA, 60 nt, Homo Sapiens
ccauuugacugagaccacauggugugccccuugagugaggcuaaucuuuagguuuuuccu

SEQ ID NO: 614258 - RNA, 60 nt, Homo Sapiens
cugaacuuguugcgacagaggguuaccugcuugagugauccaucauugugcguugugugc

SEQ ID NO: 614259 - RNA, 60 nt, Homo Sapiens
cccaaaaacuugcuuucucuagccuaggucuugagugaaccaggcacuugaccuggcugu

SEQ ID NO: 614260 - RNA, 60 nt, Homo Sapiens
cuaucagcacagccuuccuuaaaagcuggguugagugagguugccuccugcagaacuuug

SEQ ID NO: 614261 - RNA, 60 nt, Homo Sapiens
cugaaggcuggguuugaaaaggccauucaguugagugaggugggcccaggacccagucuu

SEQ ID NO: 614262 - RNA, 60 nt, Homo Sapiens
gcacugggagaucagggcaguaagaugacuuugagugauggcauuuccuugcacaaacag

SEQ ID NO: 614263 - RNA, 60 nt, Homo Sapiens
ucccaaucauguccuguuuuagacacauucuugagugaaaucuuacaaauucuucaauaa

SEQ ID NO: 614264 - RNA, 60 nt, Homo Sapiens
cagaaagcucuuuugaaaaggaggagaucauugagugaccucaaagaaguggauaagagg

SEQ ID NO: 614265 - RNA, 60 nt, Homo Sapiens
ggcaggaaagggccaucuccaguucuagauuugagugaauuuugugagccacauauuggg

SEQ ID NO: 614266 - RNA, 60 nt, Homo Sapiens
guaagggaaagaauaucuuaauuggaaugguugagugaggguuugcaguauucuccccug

SEQ ID NO: 614267 - RNA, 60 nt, Homo Sapiens
caaauuucaucuauuuuauuuaucaccaaauugagugauaugaacuauaguuuuuacuag

SEQ ID NO: 614268 - RNA, 60 nt, Homo Sapiens
aacaauugggcuaaugaagaggaguaggaauugagugauagguggaagaaaccaugggca

SEQ ID NO: 614269 - RNA, 60 nt, Homo Sapiens
gccuguuuaugaugacugaggguuuaccccuugagugaaucguauguuuggcucauuacu

SEQ ID NO: 614270 - RNA, 60 nt, Homo Sapiens
ggagggugaggcugccgauguguuuuaagcuugagugaaacauaucugugcagaacacgg

SEQ ID NO: 614271 - RNA, 60 nt, Homo Sapiens
ucuuaucugaaauuuugcuaaugcaugucuuugagugacuccauuugccuucgguccuca

SEQ ID NO: 614272 - RNA, 60 nt, Homo Sapiens
uggucagcuaacaagucuucugucuguguguugagugagcucagccagaccugcguugug

SEQ ID NO: 614273 - RNA, 60 nt, Homo Sapiens
guguauauauuuauauauaaauauaucuauuugagugaaaccuugugaacucuuuaauua

SEQ ID NO: 614274 - RNA, 60 nt, Homo Sapiens
auauucauucuuuaugcaaugaggguauuuuugagugaauuuuaacugcucugaacuaag

SEQ ID NO: 614275 - RNA, 60 nt, Homo Sapiens
uaacaguuugguuuuuaauggcugugguauuugagugaggcaacucuggggcauuuguua

SEQ ID NO: 614276 - RNA, 60 nt, Homo Sapiens
uuugucacuuagaauaauauguacuacuacuugagugagcgcuuuuggaaguuauaucaa

SEQ ID NO: 614277 - RNA, 60 nt, Homo Sapiens
auggaccaggaaggcauauguauuuugaacuugagugaaaagguugaaguuacagacuuu

SEQ ID NO: 614278 - RNA, 60 nt, Homo Sapiens
aaugaaggaaauuuuuuucugaauguagguuugagugaggggcaccucugcuuucccuua

SEQ ID NO: 614279 - RNA, 60 nt, Homo Sapiens
cccaaggagacccugccacaugcuggcccuuugagugagaaugcugcaucuuucuacaua

SEQ ID NO: 614280 - RNA, 60 nt, Homo Sapiens
uuaugccaguaauauaguguuguaugccuauugagugauuguggcaagaaaagcuacagc

SEQ ID NO: 614281 - RNA, 60 nt, Homo Sapiens
uaaaaaauaaauuaggcccaauccaagaaauugagugagaaggaaacacuuguuuuauuc

SEQ ID NO: 614282 - RNA, 60 nt, Homo Sapiens
caaccugcaaaccuuuaagagacuguccuuuugagugacuucaguccaauugccagagaa

SEQ ID NO: 614283 - RNA, 60 nt, Homo Sapiens
aucugacagaucauucuagauccaguguuguugagugaaacauguauagaagagaucuga

SEQ ID NO: 614284 - RNA, 60 nt, Homo Sapiens
uuaaauagagagguuuucggaaauucauaauugagugauacauuccucugaaagcaaaac

SEQ ID NO: 614285 - RNA, 60 nt, Homo Sapiens
ucuggaguuagacauagauuguuccaaacuuugagugauugaacauuguucgguucacac

SEQ ID NO: 614286 - RNA, 60 nt, Homo Sapiens
cccgucaugugcacuuggguccugguggaguugagugaugcacgaggaguugggagccug

SEQ ID NO: 614287 - RNA, 60 nt, Homo Sapiens
gagcuaacccuuaucuguaauuuuaaagaguugagugauaacuggauauucauauaaacu

SEQ ID NO: 614288 - RNA, 60 nt, Homo Sapiens
agggaaaaaaaucuacaguauagauauaacuugagugaguuauagauauaaagcuuuacu

SEQ ID NO: 614289 - RNA, 60 nt, Homo Sapiens
aauuacuacuagguaauaauaaugggagacuugagugauaauaggggauuuuaaaacucu

SEQ ID NO: 614290 - RNA, 60 nt, Homo Sapiens
auauuccuugauuuaaauuggcuuuugugauugagugaaacuuuauaaagcauaugguca

SEQ ID NO: 614291 - RNA, 60 nt, Homo Sapiens
aagggcgguauggaaggcaggcuguacugguugagugaauggaaaguuggggaguagaac

SEQ ID NO: 614292 - RNA, 60 nt, Homo Sapiens
aggaguaggugugaguugauaauguugaaguugagugaucaguacguggguuuauuacac

SEQ ID NO: 614293 - RNA, 60 nt, Homo Sapiens
agaauuuauugcugaaucaugcuccaguauuugagugauguuuuaaauauccuaugucug

SEQ ID NO: 614294 - RNA, 60 nt, Homo Sapiens
guuaaccucagugcucaacuauuugaacuguugagugauaaaggaaacaaauauaacugu

SEQ ID NO: 614295 - RNA, 60 nt, Homo Sapiens
cgugggauaggucccaugucaaaggaacuuuugagugaugacucugagaaguugaauugc

SEQ ID NO: 614296 - RNA, 60 nt, Homo Sapiens
cuaaucauguaaaguaagagugugugaaccuugagugauauuuuuuagcuauuuuuucca

SEQ ID NO: 614297 - RNA, 60 nt, Homo Sapiens
gacuuacaaagggaguguuucagguguuccuugagugacaagagacugauguauaaugga

SEQ ID NO: 614298 - RNA, 60 nt, Homo Sapiens
gggagauauaagccaaggaucauguagucauugagugagguuaauaaaauuaguuugcau

SEQ ID NO: 614299 - RNA, 60 nt, Homo Sapiens
cuggggcagagaggccugggacugagcagauugagugauguuccccugcagcagucgagg

SEQ ID NO: 614300 - RNA, 60 nt, Homo Sapiens
caggugaaauuuagagucauugcaaucaauuugagugacuuagaggcaauauuuucuacu

SEQ ID NO: 614301 - RNA, 60 nt, Homo Sapiens
cuguuuacauuuagaauaauaaaaaaagaguugagugaauacucugaaguuuucuacaac

SEQ ID NO: 614302 - RNA, 60 nt, Homo Sapiens
acuucuccgugaaccugcuguggucguccuuugagugacagcaggcgcacguugguuucu

SEQ ID NO: 614303 - RNA, 60 nt, Homo Sapiens
cuccaacuucauuugaugcugucgcuuacuuugagugaucucugcugaagguuguaagug

SEQ ID NO: 614304 - RNA, 60 nt, Homo Sapiens
ucucaagacuggaaaacaauagcauuugucuugagugaggaagugaagcccgcuguguuc

SEQ ID NO: 614305 - RNA, 60 nt, Homo Sapiens
agcacacaacacacacugaguaaauauuuguugagugaaauaaaaucaagaaacaaguaa

SEQ ID NO: 614306 - RNA, 60 nt, Homo Sapiens
agagaaaaagagguugauugaauugugccuuugagugaacccaguuuuuaaauaccgcug

SEQ ID NO: 614307 - RNA, 60 nt, Homo Sapiens
uauuuuguuaauuacaguguuuuugguucauugagugaagauucugccgggugggaucuu

SEQ ID NO: 614308 - RNA, 60 nt, Homo Sapiens
cguauuugaaguaacugagaauuuccauuguugagugaagguagcccucacuuucaugcc

SEQ ID NO: 614309 - RNA, 60 nt, Homo Sapiens
guuguuuaccaggcacugugccucaggcacuugagugacaaucacucauuucuauucauu

SEQ ID NO: 614310 - RNA, 60 nt, Homo Sapiens
auacagaagggguguuugagacaaugaugguugagugaaauuccuuauguaucaucuaau

SEQ ID NO: 614311 - RNA, 60 nt, Homo Sapiens
gggcagcagcgguggagucuuuuaaucaccuugagugacugguuagcucucaccuguagg

SEQ ID NO: 614312 - RNA, 60 nt, Homo Sapiens
auuuguaaaauuaugaauauuaaucuaauauugagugauuaaauauguuacuguauuaau

SEQ ID NO: 614313 - RNA, 60 nt, Homo Sapiens
aacauaaaauggcuugguaauuucuuugcauugagugagguuucuucagauuauguuuua

SEQ ID NO: 614314 - RNA, 60 nt, Homo Sapiens
gaugaauaccugugaggauauacucuuccauugagugaauuauuuuuguguguaguugau

SEQ ID NO: 614315 - RNA, 60 nt, Homo Sapiens
cuuuuggugagcucagcugaaccugucugauugagugagcuaauagucaaaaauguguuu

SEQ ID NO: 614316 - RNA, 60 nt, Homo Sapiens
caaucuuuguacaaugacuauaaaaauuuauugagugaaacaguguaacugcauuucuaa

SEQ ID NO: 614317 - RNA, 60 nt, Homo Sapiens
acuuuuuuuuaaugugcauuauuaaaaauauugagugaagcuaauugucaacuuuauuaa

SEQ ID NO: 614318 - RNA, 60 nt, Homo Sapiens
guuucucuccccuauggauuuugcuaaugguugagugauaccuaaaggccuuguugcauu

SEQ ID NO: 614319 - RNA, 60 nt, Homo Sapiens
gguuuccucuagaacugaauuccucuggaauugagugauggacuucacaacaacuagcca

SEQ ID NO: 614320 - RNA, 60 nt, Homo Sapiens
uuuuaagcuguaaaaagagagaaaacuuauuugagugauuauuuguuauuuguacaguuc

SEQ ID NO: 614321 - RNA, 60 nt, Homo Sapiens
cuucaaaggacccugacauugucuuaacacuugagugaauagacgcugcauuccagaaac

SEQ ID NO: 614322 - RNA, 58 nt, Homo Sapiens; identical to SEQ ID NO: 502655

SEQ ID NO: 614323 - RNA, 60 nt, Homo Sapiens
ggugguuaggagaaagacuuuguuguuguuuugagugaaucaacaggugcuagagaccac

SEQ ID NO: 614324 - RNA, 60 nt, Homo Sapiens
ucauugggauaaaugguccauagauaaaguuugagugagucagccugucaugauauguuu

SEQ ID NO: 614325 - RNA, 60 nt, Homo Sapiens
guuauuauuuguauuugaugguuuuaaaaauugagugaggaacauuaucaauauaccaau

SEQ ID NO: 614326 - RNA, 60 nt, Homo Sapiens
augcaaaaguuuaauuuuuauaauaguagcuugagugaauuuauaagacaguauguauag

SEQ ID NO: 614327 - RNA, 60 nt, Homo Sapiens
cuagugaaaccaaauagaaagucaaguucuuugagugauaguguuaaagcauuagccugu

SEQ ID NO: 614328 - RNA, 60 nt, Homo Sapiens
guauguauaaccuggugggucuuuacaugauugagugagacacaaauaaagaauucaauu

SEQ ID NO: 614329 - RNA, 60 nt, Homo Sapiens
ugcuaacagcaauuucauagaugaguggcuuugagugacaaggacuugauacccucugag

SEQ ID NO: 614330 - RNA, 60 nt, Homo Sapiens
agcccgggacaacagccaguugucccgucuuugagugacacagaacuggaaggagacauc

SEQ ID NO: 614331 - RNA, 60 nt, Homo Sapiens
augugcaucuggagguguugcggcagagguuugagugaacccucuuucaaagacaauaaa

SEQ ID NO: 614332 - RNA, 60 nt, Homo Sapiens
cauuuuauaaaugaggaaacggaggcuuaguugagugagcugaccaauaucacccagcca

SEQ ID NO: 614333 - RNA, 60 nt, Homo Sapiens
gaguuaucaugauggugcugauugcccaccuugagugagggguggauaaacuaccccugc

SEQ ID NO: 614334 - RNA, 60 nt, Homo Sapiens
uuugcugcgggaguuuggcuggccaggaacuugagugacauugaccucauggcaccucag

SEQ ID NO: 614335 - RNA, 60 nt, Homo Sapiens
aaaggcccuucuaacuuccagauuguaugcuugagugauggguccccagcccaagcccac

SEQ ID NO: 614336 - RNA, 60 nt, Homo Sapiens
agaggaagaguuucuauuaaaaucugucacuugagugaugucauucaaguccuauuuuag

SEQ ID NO: 614337 - RNA, 60 nt, Homo Sapiens
agcaaaaccaaauaaaguggagaugagugauugagugagguagauugcugucccguuaac

SEQ ID NO: 614338 - RNA, 60 nt, Homo Sapiens
uuggugaaagaaagcacaucggcuccugaguugagugauugaaauugcuggacuauuugu

SEQ ID NO: 614339 - RNA, 60 nt, Homo Sapiens
cuccugcgucagccucccgaccucccggguuugagugauuucggcucacugcaaccucug

SEQ ID NO: 614340 - RNA, 60 nt, Homo Sapiens
uucugaucuagauuugaaagugcaguaggcuugagugaaccaaaaccagugucaggccuu

SEQ ID NO: 614341 - RNA, 60 nt, Homo Sapiens
agcagacauguuuaagggucgccaaauggauugagugaugugguguggacggaaagggug

SEQ ID NO: 614342 - RNA, 60 nt, Homo Sapiens
acaucaggcacagaccuucagauucauauuuugagugaaucucaacuauuuaaucaucau

SEQ ID NO: 614343 - RNA, 60 nt, Homo Sapiens
auacaaaaaagaaugauguuuaaaauugcuuugagugauucauacagagauguauauaug

SEQ ID NO: 614344 - RNA, 60 nt, Homo Sapiens
gaagaggcuguuuguguuuaacuuauaauauugagugauccaugaaguagguuuucagag

SEQ ID NO: 614345 - RNA, 60 nt, Homo Sapiens
uagagaggcucuugugguuaacugauaauauugagugaugcaugagguagguguucagag

SEQ ID NO: 614346 - RNA, 60 nt, Homo Sapiens
gccgacuucccccuugcuguucucgugauauugagugagcgcuugugggaucugguuguu

SEQ ID NO: 614347 - RNA, 60 nt, Homo Sapiens
uaguauacuagggcaugauaugguauccuuuugagugagguauauacucaucucacaagu

SEQ ID NO: 614348 - RNA, 60 nt, Homo Sapiens
uuggagagaauccccuccagauaagagauuuugagugaaaaacauaaugauccugccauu

SEQ ID NO: 614349 - RNA, 60 nt, Homo Sapiens
uacuuugauagaacuaaggaaauagugguuuugagugaagggaaaggaaacccagaaaca

SEQ ID NO: 614350 - RNA, 60 nt, Homo Sapiens
auagaugggucuggcugagcugaacccauuuugagugacucgaggguuggguucaucuga

SEQ ID NO: 614351 - RNA, 60 nt, Homo Sapiens
ucuucaaugcuuccuccuugccugcugcuguugagugagagaaggugcugacaaagauga

SEQ ID NO: 614352 - RNA, 60 nt, Homo Sapiens
aggagaaaacaauauauaacgugauuauauuugagugaauucuccuguauauuggauuuu

SEQ ID NO: 614353 - RNA, 60 nt, Homo Sapiens
acucucuugauuuauguauuguuguugcauuugagugaauccaguucuuccaucggugua

SEQ ID NO: 614354 - RNA, 60 nt, Homo Sapiens
uguuagaugugcacugaacugugccuagucuugagugaauaaguaaacacuuauugucag

SEQ ID NO: 614355 - RNA, 60 nt, Homo Sapiens
uguuugcuuccuucuugccccuuguuaggcuugagugagguuugggggaaaacaggaaau

SEQ ID NO: 614356 - RNA, 60 nt, Homo Sapiens
cuguugaauguuucuaaaaagauccagcauuugagugacauaauuguaaaaauuuuuguu

SEQ ID NO: 614357 - RNA, 60 nt, Homo Sapiens
uaaguugggaaacagaaugggccagggagguugagugacugaagaccaaggguuggugca

SEQ ID NO: 614358 - RNA, 60 nt, Homo Sapiens
uucuuagucccucugcccucuguaaauguguugagugauauagcuaucagauguauugaa

SEQ ID NO: 614359 - RNA, 60 nt, Homo Sapiens
acucauagugugguuuuuaaauauaugcaguugagugaugauuggauacuauucaucaua

SEQ ID NO: 614360 - RNA, 60 nt, Homo Sapiens
gcugggaagugugaaaauauuuuaauauauuugagugauucuuuuaaagaaggauacauu

SEQ ID NO: 614361 - RNA, 60 nt, Homo Sapiens
uaauaacuguauuauagaaagaacuguguguugagugaaccagaagcacgaggcccuuga

SEQ ID NO: 614362 - RNA, 60 nt, Homo Sapiens
agacaguuuauuuaaaacuuuaucaguacuuugagugagauuuacauaccuucucuguug

SEQ ID NO: 614363 - RNA, 60 nt, Homo Sapiens
ugguaguggacuugggaaauuuaaaccaaguugagugaauuacaaucagguauuauguuu

SEQ ID NO: 614364 - RNA, 60 nt, Homo Sapiens
gcacuuuuuuuguacauaugauuugcucauuugagugaggucacuaauauuuugcaugua

SEQ ID NO: 614365 - RNA, 60 nt, Homo Sapiens
caauaguuacgaugaccagugcuuuagcauuugagugauuccugcgccaauugugagggc

SEQ ID NO: 614366 - RNA, 60 nt, Homo Sapiens
uuugaggcgucuuuuuuuuugucucaaaaguugagugaauugcugccuauugccauugcu

SEQ ID NO: 614367 - RNA, 60 nt, Homo Sapiens
cucccgccccagccuccugaccucccuggcuugagugaucccagcucacugcagccucga

SEQ ID NO: 614368 - RNA, 60 nt, Homo Sapiens
uggagaacggcugugauaaguagguuuugauugagugaaagcaugagcuuguucagagug

SEQ ID NO: 614369 - RNA, 60 nt, Homo Sapiens
auuuaaucacaaaucauuuuuuaugaaugauugagugaaaauaguguuuauaaagguuaa

SEQ ID NO: 614370 - RNA, 60 nt, Homo Sapiens
agucugaguuaauauucaagugaucagacuuugagugacaucaagaaaagaugauaucag

SEQ ID NO: 614371 - RNA, 60 nt, Homo Sapiens
ccaaaaucacagauauucaugaguuucuacuugagugagaaaacugggugaaggaauaga

SEQ ID NO: 614372 - RNA, 60 nt, Homo Sapiens
ucggcuuccaggucccaacccaggguuggguugagugagucccacaaagggcaagugggg

SEQ ID NO: 614373 - RNA, 60 nt, Homo Sapiens
ccucaacucacugcaaccuccgcucccgguuugagugauucucaugccucagccucccga

SEQ ID NO: 614374 - RNA, 60 nt, Homo Sapiens
ucucuuuaauguuuagcaugcuugucaaccuugagugagugucauuuuuaagaacaguug

SEQ ID NO: 614375 - RNA, 60 nt, Homo Sapiens
auuccuagccuucaaauuauuaaacacuccuugagugaaauaauuuugcauugcaaagug

SEQ ID NO: 614376 - RNA, 60 nt, Homo Sapiens
aauaagcacacacauuuucaauucucauguuugagugauuuuaaaauguuuuggugaaug

SEQ ID NO: 614377 - RNA, 60 nt, Homo Sapiens
cauccccuccuagcacaaggagugcccgccuugagugacaugcggcugcccacgcuccug

SEQ ID NO: 614378 - RNA, 60 nt, Homo Sapiens
uaauuuucuaaaaacacacacagaaaucgcuugagugaggaaaaguccacauggcagaga

SEQ ID NO: 614379 - RNA, 60 nt, Homo Sapiens
ucaucuauacuucaucuuacaucgucaugauugagugaucuuuacauuugauuccagagg

SEQ ID NO: 614380 - RNA, 60 nt, Homo Sapiens
ugcauaggauugccaaaacuagaggcagauuugagugagguuuccaggguucuuccugag

SEQ ID NO: 614381 - RNA, 60 nt, Homo Sapiens
aaacauuuacuaccuuguccuaauggauuuuugagugauaagcaauuuauuugaaacuuc

SEQ ID NO: 614382 - RNA, 60 nt, Homo Sapiens
ggagucggaaugugcuacccacagcccuuguugagugacgaucagcuccacccauggcca

SEQ ID NO: 614383 - RNA, 60 nt, Homo Sapiens
aaccuuuaacuuuggccugcucuucaaucauugagugaaauggaaauauugcuuaauuuu

SEQ ID NO: 614384 - RNA, 60 nt, Homo Sapiens
ccacagcugucagccuucaacuuccugguuuugagugacauuaugaggaagaagugauuc

SEQ ID NO: 614385 - RNA, 60 nt, Homo Sapiens
cuuauaggcccaaagaauuguucaauaaaauugagugagaacuuuuaaagucuuaaacuu

SEQ ID NO: 614386 - RNA, 60 nt, Homo Sapiens
ugccucucagucuuaggggaccuugguuuauugagugaaaaagauaacaucugucaucuu

SEQ ID NO: 614387 - RNA, 60 nt, Homo Sapiens
acucucuuuaugcgcaggaacaaacagcuguugagugagcugcuaugacuuugguagaga

SEQ ID NO: 614388 - RNA, 60 nt, Homo Sapiens
cgaggucaccccgacuuuucuaaaucuuguuugagugaagucauuuuuucauguguucau

SEQ ID NO: 614389 - RNA, 60 nt, Homo Sapiens
uacuuauuuauggaagauuacugcucuaauuugagugaaauaaaaguuauuagugcgagg

SEQ ID NO: 614390 - RNA, 60 nt, Homo Sapiens
gucaucuuucaaaagagaaaaauuggacacuugagugacuuuguuuuuaguuuuguuuuu

SEQ ID NO: 614391 - RNA, 60 nt, Homo Sapiens
auucuguacuucucaguuaagacuuguucuuugagugauguauuaaaugcugcuagaaaa

SEQ ID NO: 614392 - RNA, 60 nt, Homo Sapiens
uuuugugcaccaggcccggcugcguagcaguugagugaugcugguuagcuauuaaggugg

SEQ ID NO: 614393 - RNA, 60 nt, Homo Sapiens
caggaugauggaauuagaugcagucugucuuugagugagacuggucaccaucagaggagu

SEQ ID NO: 614394 - RNA, 60 nt, Homo Sapiens
accagcaauuucuuuuuccuuagauaaaucuugagugaaacaguagucaguacacuuuuc

SEQ ID NO: 614395 - RNA, 60 nt, Homo Sapiens
uaaugaauuaagaguggcuguauauauuuguugagugaaugggugcuccauauauauuca

SEQ ID NO: 614396 - RNA, 60 nt, Homo Sapiens
cagcacgcgacccaggugugagagaagaucuugagugaagccuuuucuauauuuauaaga

SEQ ID NO: 614397 - RNA, 60 nt, Homo Sapiens
guuaggccuugggggcugagagccaguggcuugagugaaucucaaauuaaccagguugug

SEQ ID NO: 614398 - RNA, 60 nt, Homo Sapiens
agaggacaaaccuugggucaccaccucuuuuugagugaacgggaggaauccguuuuugcu

SEQ ID NO: 614399 - RNA, 60 nt, Homo Sapiens
uuccuaaggucacccagcuggcaggagcgguugagugauugcagaugaggaaauccguag

SEQ ID NO: 614400 - RNA, 60 nt, Homo Sapiens
ucucauuuaugacuaaauuaaauaaaacaguugagugauccuguauuaccaagcuuaaga

SEQ ID NO: 614401 - RNA, 60 nt, Homo Sapiens
cucaucccaagcaaggagcccuccuccacguugagugaagagggaccaguccaccaccau

SEQ ID NO: 614402 - RNA, 60 nt, Homo Sapiens
cccuguuaguuuuguaaaaacugaagaauuuugagugaauuagaccuuuauuuuucuauc

SEQ ID NO: 614403 - RNA, 60 nt, Homo Sapiens
guucucugucgcugcuaaauuauucuucacuugagugaagcaaauauuuagcuuccaaau

SEQ ID NO: 614404 - RNA, 60 nt, Homo Sapiens
aauaguuuaccucauagaguuuggggagaauugagugaauuaaugugugugaggacacua

SEQ ID NO: 614405 - RNA, 60 nt, Homo Sapiens
gagaaugcugacacuuuuucagggcugugauugagugagggcauggguaaaaauauuucu

SEQ ID NO: 614406 - RNA, 60 nt, Homo Sapiens
uggaguugcacagaaucauggaauuuuguguugagugacauaauagguauggaaauauga

SEQ ID NO: 614407 - RNA, 60 nt, Homo Sapiens
gcauauucuuuuuaaacuauaaauaccauuuugagugagaaaguacuuuuaaacaagaaa

SEQ ID NO: 614408 - RNA, 60 nt, Homo Sapiens
aaaugccagucagugaugaucgcaucacaguugagugaaauggccuuccuguucagcugu

SEQ ID NO: 614409 - RNA, 60 nt, Homo Sapiens
cuuuuucaaacuguccaugggaaggcugaauugagugacuccccagaaugaagaugagaa

SEQ ID NO: 614410 - RNA, 60 nt, Homo Sapiens
cugggagaaccaaaaagagggauauccucuuugagugaagcugguguggaagagcuccuu

SEQ ID NO: 614411 - RNA, 60 nt, Homo Sapiens
gacaauuuuguaauuuaggaguggaagaaauugagugaauguuuauucucugccuaaaaa

SEQ ID NO: 614412 - RNA, 60 nt, Homo Sapiens
guucccaaguaggcauucuaauuguaucauuugagugaaugaagaauauagcagacguau

SEQ ID NO: 614413 - RNA, 60 nt, Homo Sapiens
uuuaguccauuuaugguugagauucaaacuuugagugacagguugauaccaagugcauaa

SEQ ID NO: 614414 - RNA, 60 nt, Homo Sapiens
ugcuugggugacuuggggguaguugccagcuugagugaugaggaugggagggaagguuaa

SEQ ID NO: 614415 - RNA, 60 nt, Homo Sapiens
uugccuucaguuaacaugggacuagagagguugagugaauuguaggcccaugggucccuu

SEQ ID NO: 614416 - RNA, 60 nt, Homo Sapiens
uauaacuaucauuaauucucuuuuggcauuuugagugaaauuacuuuguugaauuuuuuu

SEQ ID NO: 614417 - RNA, 60 nt, Homo Sapiens
cuucuccauccuggauccugccugcccguguugagugagaccgaggccugagccgcaaug

SEQ ID NO: 614418 - RNA, 60 nt, Homo Sapiens
gaaaaacuugauggaaguggaaugaugccauugagugagugcuuaagcaacuggauggau

SEQ ID NO: 614419 - RNA, 60 nt, Homo Sapiens
ucuuacaacauccacauaaguccacagacauugagugacugugugaagugacuuauuaaa

SEQ ID NO: 614420 - RNA, 60 nt, Homo Sapiens
uaggaagcuucaugguguugauguggccuuuugagugaaaaccccauuuuuauauacuga

SEQ ID NO: 614421 - RNA, 60 nt, Homo Sapiens
cuguggugugagguguucuggggacuugaguugagugacgggagcccucugaugugagga

SEQ ID NO: 614422 - RNA, 60 nt, Homo Sapiens
cuuaccauucaccucccaaagccaaggaacuugagugagcuuccuuggcaagccucccau

SEQ ID NO: 614423 - RNA, 60 nt, Homo Sapiens
uuuuuaucaauaaauauuuuuauacuuacauugagugauguguuuaacaacaaauuguga

SEQ ID NO: 614424 - RNA, 60 nt, Homo Sapiens
uguguaccugaaguacaguaucaggcuggcuugagugaaugaucugcauccaaggccuuc

SEQ ID NO: 614425 - RNA, 60 nt, Homo Sapiens
uaugcugaauaaacaguggaacuguagaauuugagugauccauggggaucccagcacauc

SEQ ID NO: 614426 - RNA, 60 nt, Homo Sapiens
uaucauaagaugagaauggaaacuaaauuuuugagugaaaaaauguguuuuggggugggu

SEQ ID NO: 614427 - RNA, 60 nt, Homo Sapiens
aacugaauugaaaccuauuauuuauaauacuugagugacuuucuguaaauccaguugcau

SEQ ID NO: 614428 - RNA, 60 nt, Homo Sapiens
ucccuuagugaauuuugucuucauuuccauuugagugaguuugcucucugguccaugaac

SEQ ID NO: 614429 - RNA, 60 nt, Homo Sapiens
ccuuaaaaagcacacaccacagauguuuuauugagugaaggcucaucagcagagagcaac

SEQ ID NO: 614430 - RNA, 60 nt, Homo Sapiens
uauccucaccagacauuccucugagcacaguugagugauugguguugugacuuauucguc

SEQ ID NO: 614431 - RNA, 60 nt, Homo Sapiens
uaaccuguguugcgcaaaugccgcauaaauuugagugauuguuaauguugucuuaaaauu

SEQ ID NO: 614432 - RNA, 60 nt, Homo Sapiens
uuuccucuagcuuuucuauuuuugauuguguugagugaaguuuggagauuuuucauacuu

SEQ ID NO: 614433 - RNA, 60 nt, Homo Sapiens
cacaauacuuaauguauuguuaucacaaaauugagugaaaaaguuuuuucaaaaauggag

SEQ ID NO: 614434 - RNA, 60 nt, Homo Sapiens
caguauugagccaugaauaaggucaaagacuugagugaccaaucauugaaauucauuugg

SEQ ID NO: 614435 - RNA, 60 nt, Homo Sapiens
agcucuguggcccugugucgguaccagauguugagugaccuggauuucaccucacccuuu

SEQ ID NO: 614436 - RNA, 60 nt, Homo Sapiens
ucuaaaauccuuaaaaauacucuaauagccuugagugaccaacuuuuuuuuuaaagcaca

SEQ ID NO: 614437 - RNA, 60 nt, Homo Sapiens
agaauuuugguaccuacaacaugcuugauuuugagugauuaaaaaaaaauaauuuggcug

SEQ ID NO: 614438 - RNA, 60 nt, Homo Sapiens
ccaccggcccccuccccccagacucuuuuuuugagugacagcuuucugggaugucacagu

SEQ ID NO: 614439 - RNA, 60 nt, Homo Sapiens
aauuugacauuguccaaaccuuuuucauuuuugagugauuaaaaaugaaauguccuuugu

SEQ ID NO: 614440 - RNA, 60 nt, Homo Sapiens
ccaggcuguaguaugaucauaauuuuuuguuugagugauuucuuuaaagagaacuagaag

SEQ ID NO: 614441 - RNA, 60 nt, Homo Sapiens
uauacauaacauuguuuuuguuaauaaaauuugagugaugagcgggcuauugugcugccu

SEQ ID NO: 614442 - RNA, 60 nt, Homo Sapiens
uauuugauauauuacuuuguaaguaggaguuugagugaauuuggugaugacacguuucuu

SEQ ID NO: 614443 - RNA, 60 nt, Homo Sapiens
uuaaccugcuauuaaauaguggggauuagauugagugaaauuucaaaugaauauuauuug

SEQ ID NO: 614444 - RNA, 60 nt, Homo Sapiens
uugauggauaaugagcuaaucaggugacacuugagugaguguuacauuucccaagagagu

SEQ ID NO: 614445 - RNA, 60 nt, Homo Sapiens
gaaauggggagucuagagccuggcucuuccuugagugaaaugugaggacaagaaugcaaa

SEQ ID NO: 614446 - RNA, 60 nt, Homo Sapiens
uggccuuugaacugaacuuagaaaggcuucuugagugaggaggcugucuggagguguuug

SEQ ID NO: 614447 - RNA, 60 nt, Homo Sapiens
gucugugcaggcccuguaguacaucuuucuuugagugaccccaaggaguagggcacaggg

SEQ ID NO: 614448 - RNA, 60 nt, Homo Sapiens
uacacagcuagaaggugccauggaguggcuuugagugaguuuucugggaguccauccagc

SEQ ID NO: 614449 - RNA, 60 nt, Homo Sapiens
accuccccagauggagcaugucaauaaacauugagugagcgucuuuucuguauucgcugu

SEQ ID NO: 614450 - RNA, 60 nt, Homo Sapiens
aaaauuuucuuaaaauauccacaauauuccuugagugagucagaaucuauagccgguuag

SEQ ID NO: 614451 - RNA, 60 nt, Homo Sapiens
ucagacagacaccucccucuggagaugcaguugagugacaaccuuguuacauuguagccu

SEQ ID NO: 614452 - RNA, 60 nt, Homo Sapiens
uuuuccucaaccgagagugaauuuauguaauugagugaaagucuacgaaucauaauugua

SEQ ID NO: 614453 - RNA, 60 nt, Homo Sapiens
ugggcccccuguucuuucuuucccauuaacuugagugaccugugugagagacagacagau

SEQ ID NO: 614454 - RNA, 60 nt, Homo Sapiens
cuguggcaggaggcaaagaguaggguguaauugagugaaggaauccuggguagagaccau

SEQ ID NO: 614455 - RNA, 60 nt, Homo Sapiens
cauucuggacuccugagaggcaguggccucuugagugaacaggggaggccaguagaugcc

SEQ ID NO: 614456 - RNA, 60 nt, Homo Sapiens
gauaucauugaugugcugucacacuauauauugagugacuuucugaacaaauuuauccag

SEQ ID NO: 614457 - RNA, 60 nt, Homo Sapiens
ccuuuugcacugaagauagagaccaccuuuuugagugacuugagcccaaaggcaagcgua

SEQ ID NO: 614458 - RNA, 60 nt, Homo Sapiens
ccaagacccggacagagcuucagaggaguguugagugacaccugaggaugcggcugcaca

SEQ ID NO: 614459 - RNA, 60 nt, Homo Sapiens
gagguggugugagggccaggcuagggacgcuugagugaggcaguccugggguccgagaug

SEQ ID NO: 614460 - RNA, 60 nt, Homo Sapiens
gguagauuuauuuccauuuguuauuugggcuugagugaaaugucuguauuuuauauuuga

SEQ ID NO: 614461 - RNA, 60 nt, Homo Sapiens
augcuggagaaugagagacccaugaacauguugagugagccuguuggaaccuuacccagc

SEQ ID NO: 614462 - RNA, 60 nt, Homo Sapiens
ugcaaacccagauauuguacuaaaacccaauugagugauuugacuauuagggcuuggucu

SEQ ID NO: 614463 - RNA, 60 nt, Homo Sapiens
cucuuggggccagcgugcgucccagccguguugagugaaggugcccacguccgcccagga

SEQ ID NO: 614464 - RNA, 60 nt, Homo Sapiens
aguaaguucuagccccacccucccgccuucuugagugauaccuauuacggaugaguucug

SEQ ID NO: 614465 - RNA, 60 nt, Homo Sapiens
uccucugcuuucucccugccuugauugagcuugagugauguggaauaaauuguccgucuc

SEQ ID NO: 614466 - RNA, 60 nt, Homo Sapiens
uguacuaugucugaacauagaaacucgggcuugagugagaagagcuugcacagccaacga

SEQ ID NO: 614467 - RNA, 60 nt, Homo Sapiens
guuaucuguauuuagcagaguauuuucaacuugagugaucugagcugaauuugaagacua

SEQ ID NO: 614468 - RNA, 60 nt, Homo Sapiens
ccauguccuuagcacaggggggccgccgguuugagugaggguuucugagcugcucugaau

SEQ ID NO: 614469 - RNA, 60 nt, Homo Sapiens
gagaucuucuuagcccagagagcaguggaguugagugaggaggcagauguccugucugug

SEQ ID NO: 614470 - RNA, 60 nt, Homo Sapiens
gacuccaagaugaagauguggucccugcccuugagugacagcccagggacuuaauguggc

SEQ ID NO: 614471 - RNA, 60 nt, Homo Sapiens
uuuauuuagcagcuaguaacgagacugcuuuugagugacagcuguguaagaaaaagccaa

SEQ ID NO: 614472 - RNA, 60 nt, Homo Sapiens
guaguauggauggguuuucuauguccaguuuugagugacucuuuggcucuaccccuagaa

SEQ ID NO: 614473 - RNA, 60 nt, Homo Sapiens
gcuucagggguuggaaguucucauuuuagcuugagugaugucccugaggaccagaacugc

SEQ ID NO: 614474 - RNA, 60 nt, Homo Sapiens
caucgccaagauuugcuguacugaaagcuguugagugacucugcggccuuugguuugugg

SEQ ID NO: 614475 - RNA, 60 nt, Homo Sapiens
cgggaccgugccauuguacugaaguggagguugagugagcggagaaucgcuugaaccugg

SEQ ID NO: 614476 - RNA, 60 nt, Homo Sapiens
aagagauaauaaauguuuuaauuuggcaguuugagugauugggaaaaggaaucuuaaacu

SEQ ID NO: 614477 - RNA, 60 nt, Homo Sapiens
gugggcugcgaggagaagcuguacuuuggcuugagugaguacagcaagucucugcagugg

SEQ ID NO: 614478 - RNA, 60 nt, Homo Sapiens
accaccguguugugcucaaagagacacuacuugagugaagauuucuucuuucccuguacc

SEQ ID NO: 614479 - RNA, 60 nt, Homo Sapiens
cauuuacauuuuucugguuuuuuuuuuuuuuugagugagguacgaguauuaccaaaugau

SEQ ID NO: 614480 - RNA, 60 nt, Homo Sapiens
agguuugguuucugacgaaauguaaaugauuugagugagucuuucugcacuaguuuuccu

SEQ ID NO: 614481 - RNA, 60 nt, Homo Sapiens
uaaaaugcaugacagacaagguaaugauauuugagugaauugauaaucuuuacugcaagu

SEQ ID NO: 614482 - RNA, 60 nt, Homo Sapiens
gucccaccgugaagugaauuacaguagacuuugagugaccccuuuuuggggaugagguuc

SEQ ID NO: 614483 - RNA, 60 nt, Homo Sapiens
agaauugcaaauagucucuaccaggaucuauugagugaaccacaugucuagcuuucaccu

SEQ ID NO: 614484 - RNA, 60 nt, Homo Sapiens
gcuggcuccaggggcggcuuuuguuggaaguugagugaagcccucccccuguccucagcg

SEQ ID NO: 614485 - RNA, 60 nt, Homo Sapiens
agagaggcucuuugugguuaacuuauaauauugagugaugcaugagguagguguucagaa

SEQ ID NO: 614486 - RNA, 60 nt, Homo Sapiens
auggacaagcaguaaugauauuuaaauauuuugagugagggggagugggucaaagaggaa

SEQ ID NO: 614487 - RNA, 60 nt, Homo Sapiens
uuggaaacccucuccucccuccuccacaccuugagugaugaccacaccaaucacuguauu

SEQ ID NO: 614488 - RNA, 60 nt, Homo Sapiens
cuuuuuuuaaauagagggauugacucggauuugagugaucauuagggcugaggucuguuu

SEQ ID NO: 614489 - RNA, 60 nt, Homo Sapiens
ggcccccacccaagccugcgucagcggaacuugagugaggggcguugugcaauuuguggc

SEQ ID NO: 614490 - RNA, 60 nt, Homo Sapiens
guuggaaggacucauauaugcauacauuccuugagugacuaugaaugacugccgggcagu

SEQ ID NO: 614491 - RNA, 60 nt, Homo Sapiens
ggugcuuuuuuguuuguguguguguguaauuugagugauuguaaauggcauugauguuug

SEQ ID NO: 614492 - RNA, 60 nt, Homo Sapiens
ugaaucaggacugaaugugaaagggaaguauugagugaggacauucccaaaaccaaagga

SEQ ID NO: 614493 - RNA, 60 nt, Homo Sapiens
uuuuggauccaccagaccaguaccagacauuugagugaaacuucuugacauccaccaaga

SEQ ID NO: 614494 - RNA, 60 nt, Homo Sapiens
guugggaagggggcucagaaauaggcaggauugagugacgacccuccccuucugguaguc

SEQ ID NO: 614495 - RNA, 60 nt, Homo Sapiens
gcugcuguaaacuauuuguggcugugcugcuugagugacgucucugucgugugggugcca

SEQ ID NO: 614496 - RNA, 60 nt, Homo Sapiens
ucaaauaauccagaaauauaccuaauaagauugagugaaaaauuugagucaaauaucuag

SEQ ID NO: 614497 - RNA, 60 nt, Homo Sapiens
guuuuaaaccccaggaacagagacuccuaguugagugauagcugggaaaguuuuacauug

SEQ ID NO: 614498 - RNA, 60 nt, Homo Sapiens
ucuuucagucaaucucuuccacucuaaggauugagugagcgcgagcuggggacucucuca

SEQ ID NO: 614499 - RNA, 60 nt, Homo Sapiens
aacagaagugaagaguuucagagcaucagauugagugaaaaguugucagauucuguauuu

SEQ ID NO: 614500 - RNA, 60 nt, Homo Sapiens
ggaguccccuaaugacuaaucugcacagccuugagugauuccugcugaaucugguacuuu

SEQ ID NO: 614501 - RNA, 60 nt, Homo Sapiens
gaauuuucauguggcuggguugcugggugguugagugaguugguguuuccaguuugaugu

SEQ ID NO: 614502 - RNA, 60 nt, Homo Sapiens
ggcuacaagggccugagaggcucgcucucuuugagugacugcgguuggccgguguuagaa

SEQ ID NO: 614503 - RNA, 60 nt, Homo Sapiens
uuaagguuuuccaaaucuucuccaacucaguugagugauuugugaauuugcugauguucu

SEQ ID NO: 614504 - RNA, 60 nt, Homo Sapiens
ggagagcacgguccuaaguccaggguggguuugagugaagaagugaguugggggagggca

SEQ ID NO: 614505 - RNA, 60 nt, Homo Sapiens
gugggacgguucguuugaauggaggagguguugagugagcaacacgcagaagcucgccua

SEQ ID NO: 614506 - RNA, 60 nt, Homo Sapiens
agcugggcuguuuucugucuuauuucucaguugagugagcaaggauacgaaaacagugug

SEQ ID NO: 614507 - RNA, 60 nt, Homo Sapiens
acaugugaugauuuucagaaccguaaguguuugagugauguggaaagcacuugauuguac

SEQ ID NO: 614508 - RNA, 60 nt, Homo Sapiens
ccuacucugaaaugcaaaacuucuauucuguugagugaaagaauaaaauguagacaaaau

SEQ ID NO: 614509 - RNA, 60 nt, Homo Sapiens
uauuuuuauuuccugggccucucauuggcuuugagugacauucuaguucugauucuguca

SEQ ID NO: 614510 - RNA, 60 nt, Homo Sapiens
cuucauuccucucccaugugacccuucccuuugagugaguugaaaacuuaucuuaaacug

SEQ ID NO: 614511 - RNA, 60 nt, Homo Sapiens
gguugguauuaucaacacuguaguuguauguugagugauugguaaaaauaugaaguguuu

SEQ ID NO: 614512 - RNA, 60 nt, Homo Sapiens
auuuugagguuuuuaauuuaacaucccauuuugagugaagcaacuuaaaugaacaagcuu

SEQ ID NO: 614513 - RNA, 60 nt, Homo Sapiens
uuucagggacaguagaaaguguuuuguuuuuugagugaaacaacuuauuaauaaaaaucc

SEQ ID NO: 614514 - RNA, 60 nt, Homo Sapiens
ucacuuuaauuuagaagauaggugagcaacuugagugaucccaaaccaaacuaacagugc

SEQ ID NO: 614515 - RNA, 60 nt, Homo Sapiens
gaaagucugucuguacugcagugggaauucuugagugaggucuuaccucuucuuuaaacc

SEQ ID NO: 614516 - RNA, 60 nt, Homo Sapiens
ugugagaacuuaguaaacaagaaaauacucuugagugaaaugcaauguauuucuuuugua

SEQ ID NO: 614517 - RNA, 60 nt, Homo Sapiens
cuuucagggucuuucaugaaguuccaauaguugagugaguuaaaagguuuguuucccaga

SEQ ID NO: 614518 - RNA, 60 nt, Homo Sapiens
uguaaaccauuaaugaaaacuuuuucacaguugagugaaauuaaaaucacuauaucucaa

SEQ ID NO: 614519 - RNA, 60 nt, Homo Sapiens
augaaaaaauucucuuaaaccacagcacuauugagugaaacauugaacucauaucuguaa

SEQ ID NO: 614520 - RNA, 60 nt, Homo Sapiens
ccuugaaaaaugaacugcccgguuauuugcuugagugagccaaugacuacauuggcuguu

SEQ ID NO: 614521 - RNA, 60 nt, Homo Sapiens
ugaaggcaaacagagccaagagacugaggcuugagugaaccagggggaaauggguaugag

SEQ ID NO: 614522 - RNA, 60 nt, Homo Sapiens
cauacauucuguuucuuuaacauucucucuuugagugauuuaaucguuaaucuuuaguug

SEQ ID NO: 614523 - RNA, 60 nt, Homo Sapiens
ccuccaauucugaccuuacaaaagugucccuugagugaggcagugaccacgcauugucac

SEQ ID NO: 614524 - RNA, 60 nt, Homo Sapiens
agauaacacaggucuauugaugguugagcuuugagugaaaagcugacucagucuguucac

SEQ ID NO: 614525 - RNA, 64 nt, Homo Sapiens
cgucaggcgggacucgugucccagagaggaaggggcugcugaggucugauggggcccuuccucc

SEQ ID NO: 614526 - RNA, 64 nt, Homo Sapiens
ugcguugcucccgugcugccugcgccagccccaggcugcugaggagcagaggccagaccagggc

SEQ ID NO: 614527 - RNA, 64 nt, Homo Sapiens
aggcgggcccugugcugggggugguagaaaggaugcugcugaggcagcuggaggagugggagua

SEQ ID NO: 614528 - RNA, 64 nt, Homo Sapiens
uuucugaaagaaguauggccaaaagcacuuuaaugcugcugacauuguuguuuuuauguucauu

SEQ ID NO: 614529 - RNA, 64 nt, Homo Sapiens
ccaguuacccauggaaugcagucuucuaccaggggcugcugacucuuaaagcccaguucuugcu

SEQ ID NO: 614530 - RNA, 64 nt, Homo Sapiens
ugaaguuaaguuuggaaagaaauauuccauguaugcugcugaaauaaaaacuuugaaaaguguc

SEQ ID NO: 614531 - RNA, 64 nt, Homo Sapiens
uugugaagacaguggaguucgagagcuuccaccagcugcugaguccuccugucucaguucuuca

SEQ ID NO: 614532 - RNA, 64 nt, Homo Sapiens
ugaagcaguggguucagcugacagggaauugauagcugcugagcguacauuuugugcuuuuaga

SEQ ID NO: 614533 - RNA, 64 nt, Homo Sapiens
aagacauacccgagacuggguaguccguuuucacgcugcugauacugguaccaauuuacuguau

SEQ ID NO: 614534 - RNA, 64 nt, Homo Sapiens
aagacguacccgagacuggguagucuguauuaaugcugcugauacuugcuucaagcaucuguau

SEQ ID NO: 614535 - RNA, 64 nt, Homo Sapiens
gggacuccucucaggugcacccgcuagcugugcugcugcugaccgacggggacgugcacauccg

SEQ ID NO: 614536 - RNA, 64 nt, Homo Sapiens
ugcugcggcuggagggugacucgcguaccgugcggcugcugaaggagcugcggcgggcccuggg

SEQ ID NO: 614537 - RNA, 64 nt, Homo Sapiens
gggcccguggugacggccacacggacuucguggcgcugcugacagggccgaggucgcaggcggu

SEQ ID NO: 614538 - RNA, 64 nt, Homo Sapiens
uccuugggccuccuggaacgccagggccucggcggcugcugaagggauucuauggcucagaggu

SEQ ID NO: 614539 - RNA, 64 nt, Homo Sapiens
auccuauuuagcauaugcaaccaggaccucuucagcugcugacauuuuacuaguccaaucaccc

SEQ ID NO: 614540 - RNA, 64 nt, Homo Sapiens
cgaaauauaaaacugagacugcaacuucaucccagcugcugaggaugcccugcggcucuggaaa

SEQ ID NO: 614541 - RNA, 64 nt, Homo Sapiens
gcucagcugcaaguugcuggaucagccuggaauggcugcugagaaaaccaggagguggaacuga

SEQ ID NO: 614542 - RNA, 64 nt, Homo Sapiens
aaaaggguuagagggugggguuggucagugugcagcugcugagcuucaacaaugaaccagaggc

SEQ ID NO: 614543 - RNA, 64 nt, Homo Sapiens
auuaaaauggaaguggauucuggauggccgggcugcugcugauguaggagcuggauuugggagc

SEQ ID NO: 614544 - RNA, 64 nt, Homo Sapiens
acguguaggagugagaagaaggaagaucuugagagcugcugagggaccuuggagagcucaggau

SEQ ID NO: 614545 - RNA, 64 nt, Homo Sapiens
aaccgaguucagaccgagcaaggccucguggacugcugcugagaaaugcugcugaagaggaggg

SEQ ID NO: 614546 - RNA, 64 nt, Homo Sapiens
aggagggaggccucguggacaugccccaacgaaugcugcugaagaaguaaaauuccaaggauau

SEQ ID NO: 614547 - RNA, 64 nt, Homo Sapiens
auuuacuuggugcccucauccaucuauuacaccagcugcugaggugcuaauguccauaucuagc

SEQ ID NO: 614548 - RNA, 64 nt, Homo Sapiens
ucuuugccugccacucaggguggcuuugggaagagcugcugagcucucaccucccuucccuccc

SEQ ID NO: 614549 - RNA, 64 nt, Homo Sapiens
aagcugugcuuugucauugaauccuaaguucuuagcugcugaugcaaguugucccccaaggcca

SEQ ID NO: 614550 - RNA, 64 nt, Homo Sapiens
aauuccauaacccucuguauugacugcaauguaagcugcugaggagacugguucuguuggucag

SEQ ID NO: 614551 - RNA, 64 nt, Homo Sapiens
ccccugacuuuuauuaaagagucuuaccagugacgcugcugacacagucguggagcgccaucau

SEQ ID NO: 614552 - RNA, 64 nt, Homo Sapiens
cgccacggagggcuggggauggccugggugaucugcugcugagacaccaagcccgaccgggcca

SEQ ID NO: 614553 - RNA, 64 nt, Homo Sapiens
aggccuugagggaaguagagcccacugagccccagcugcugagaggccuucugagaccaccuuc

SEQ ID NO: 614554 - RNA, 64 nt, Homo Sapiens
cugcagagggaaggggugggcagguguccucccugcugcugaccgucaagucagagcaccugga

SEQ ID NO: 614555 - RNA, 64 nt, Homo Sapiens; identical to SEQ ID NO: 394451

SEQ ID NO: 614556 - RNA, 64 nt, Homo Sapiens; identical to SEQ ID NO: 394452

SEQ ID NO: 614557 - RNA, 64 nt, Homo Sapiens; identical to SEQ ID NO: 394453

SEQ ID NO: 614558 - RNA, 64 nt, Homo Sapiens; identical to SEQ ID NO: 394454

SEQ ID NO: 614559 - RNA, 64 nt, Homo Sapiens; identical to SEQ ID NO: 394455

SEQ ID NO: 614560 - RNA, 64 nt, Homo Sapiens; identical to SEQ ID NO: 394456

SEQ ID NO: 614561 - RNA, 64 nt, Homo Sapiens; identical to SEQ ID NO: 394457

SEQ ID NO: 614562 - RNA, 64 nt, Homo Sapiens; identical to SEQ ID NO: 394458

SEQ ID NO: 614563 - RNA, 64 nt, Homo Sapiens; identical to SEQ ID NO: 394459

SEQ ID NO: 614564 - RNA, 64 nt, Homo Sapiens; identical to SEQ ID NO: 394460

SEQ ID NO: 614565 - RNA, 64 nt, Homo Sapiens; identical to SEQ ID NO: 394461

SEQ ID NO: 614566 - RNA, 64 nt, Homo Sapiens; identical to SEQ ID NO: 394462

SEQ ID NO: 614567 - RNA, 64 nt, Homo Sapiens; identical to SEQ ID NO: 394463

SEQ ID NO: 614568 - RNA, 64 nt, Homo Sapiens; identical to SEQ ID NO: 394464

SEQ ID NO: 614569 - RNA, 64 nt, Homo Sapiens; identical to SEQ ID NO: 394465

SEQ ID NO: 614570 - RNA, 64 nt, Homo Sapiens; identical to SEQ ID NO: 394466

SEQ ID NO: 614571 - RNA, 64 nt, Homo Sapiens; identical to SEQ ID NO: 394467

SEQ ID NO: 614572 - RNA, 64 nt, Homo Sapiens; identical to SEQ ID NO: 394468

SEQ ID NO: 614573 - RNA, 64 nt, Homo Sapiens; identical to SEQ ID NO: 394469

SEQ ID NO: 614574 - RNA, 64 nt, Homo Sapiens; identical to SEQ ID NO: 394470

SEQ ID NO: 614575 - RNA, 64 nt, Homo Sapiens; identical to SEQ ID NO: 394471

SEQ ID NO: 614576 - RNA, 64 nt, Homo Sapiens; identical to SEQ ID NO: 394472

SEQ ID NO: 614577 - RNA, 64 nt, Homo Sapiens; identical to SEQ ID NO: 394473

SEQ ID NO: 614578 - RNA, 64 nt, Homo Sapiens; identical to SEQ ID NO: 394474

SEQ ID NO: 614579 - RNA, 64 nt, Homo Sapiens; identical to SEQ ID NO: 394475

SEQ ID NO: 614580 - RNA, 64 nt, Homo Sapiens; identical to SEQ ID NO: 394476

SEQ ID NO: 614581 - RNA, 64 nt, Homo Sapiens; identical to SEQ ID NO: 394477

SEQ ID NO: 614582 - RNA, 64 nt, Homo Sapiens; identical to SEQ ID NO: 394478

SEQ ID NO: 614583 - RNA, 64 nt, Homo Sapiens; identical to SEQ ID NO: 394479

SEQ ID NO: 614584 - RNA, 64 nt, Homo Sapiens; identical to SEQ ID NO: 394480

SEQ ID NO: 614585 - RNA, 64 nt, Homo Sapiens; identical to SEQ ID NO: 394481

SEQ ID NO: 614586 - RNA, 64 nt, Homo Sapiens; identical to SEQ ID NO: 394482

SEQ ID NO: 614587 - RNA, 64 nt, Homo Sapiens; identical to SEQ ID NO: 394483

SEQ ID NO: 614588 - RNA, 64 nt, Homo Sapiens; identical to SEQ ID NO: 394484

SEQ ID NO: 614589 - RNA, 64 nt, Homo Sapiens; identical to SEQ ID NO: 394485

SEQ ID NO: 614590 - RNA, 64 nt, Homo Sapiens; identical to SEQ ID NO: 394486

SEQ ID NO: 614591 - RNA, 64 nt, Homo Sapiens; identical to SEQ ID NO: 394487

SEQ ID NO: 614592 - RNA, 64 nt, Homo Sapiens; identical to SEQ ID NO: 394488

SEQ ID NO: 614593 - RNA, 64 nt, Homo Sapiens; identical to SEQ ID NO: 394489

SEQ ID NO: 614594 - RNA, 64 nt, Homo Sapiens; identical to SEQ ID NO: 394490

SEQ ID NO: 614595 - RNA, 64 nt, Homo Sapiens
guaaguaugugaaugugcgcauuuugcauuccauaugaaaaaaaugccacgucuguuuaaauua

SEQ ID NO: 614596 - RNA, 64 nt, Homo Sapiens
acuaaaagguuuuauugaaauaaagccucuuaaaaugaaaaaucauauacuuuuaacaucacuu

SEQ ID NO: 614597 - RNA, 64 nt, Homo Sapiens
uuuaacaaauaaaaggcauuuaaguaaaacuaaaaugaaaaaaguaggccuucugacauugugu

SEQ ID NO: 614598 - RNA, 64 nt, Homo Sapiens
uauaaacacuaacauuuuccccuucuguaguuguaugaaaaaacaaauauuguuagcauaguag

SEQ ID NO: 614599 - RNA, 64 nt, Homo Sapiens
caugaaccugggcuaaugggagacuguagagaaaaugaaaaaagauccaccagaggacaucuug

SEQ ID NO: 614600 - RNA, 64 nt, Homo Sapiens
uguugcuacucccauggcaaagaaaaaaaaaagaaugaaaaaaagaaaaaaauuuggaaaaaaa

SEQ ID NO: 614601 - RNA, 64 nt, Homo Sapiens
augaguaagacacagugcccacccccaaguuaggaugaaaaaaguuccagagguuuuuaagaaa

SEQ ID NO: 614602 - RNA, 64 nt, Homo Sapiens
ucaacacacuucacaguacaggaaauaaaguaauaugaaaaacacccugcgugaacucaacggu

SEQ ID NO: 614603 - RNA, 64 nt, Homo Sapiens
uucuugaagaauuucucgcaaacucacaacccucaugaaaaauuaauccucaguuccacgagac

SEQ ID NO: 614604 - RNA, 64 nt, Homo Sapiens
uuaauuuuaauuuagcaaaagagccagucauuuuaugaaaaaucaaaauuauaagugauuuuaa

SEQ ID NO: 614605 - RNA, 64 nt, Homo Sapiens
uggccagucccugguguuuguaauguucuuuaauaugaaaaaguaguucuccaacucuaucaua

SEQ ID NO: 614606 - RNA, 64 nt, Homo Sapiens
uaaaacaagcugagcuuugguccacuaaaacaagaugaaaaauacaagagugacucuauaacuc

SEQ ID NO: 614607 - RNA, 64 nt, Homo Sapiens
acuugcuuugaaagccaaugggggaaaaaaauccaugaaaaaaaaaagauugauaaaguagaug

SEQ ID NO: 614608 - RNA, 64 nt, Homo Sapiens
cauugcagcaaaguucauugaggaaaauuguaccaugaaaaagcauuuugauuauuucauuucu

SEQ ID NO: 614609 - RNA, 64 nt, Homo Sapiens
uuugaaauuccauuuacaauguaguauguuuucaaugaaaaaccauaaaguaacauccaagugu

SEQ ID NO: 614610 - RNA, 64 nt, Homo Sapiens
acacugugcuaggcgcauucacaauguugcauuuaugaaaaacucucuggauucaucuaugucu

SEQ ID NO: 614611 - RNA, 64 nt, Homo Sapiens
ccaggaccuucuuucuuugguuuuugagcuuucuaugaaaaaccgauagcaucaaagguugaac

SEQ ID NO: 614612 - RNA, 64 nt, Homo Sapiens
aaggucuuuugccccauuucggagcggcucagucaugaaaaaagaucaacacauuagagguaca

SEQ ID NO: 614613 - RNA, 64 nt, Homo Sapiens
cugggugaccuggaucucugugggauuugcagagaugaaaaagaaagcacaaauuuuggugaau

SEQ ID NO: 614614 - RNA, 64 nt, Homo Sapiens
gaagcacaaauuuuggugaaagagaaggacuguuaugaaaaacauagagaagggggauaaagag

SEQ ID NO: 614615 - RNA, 64 nt, Homo Sapiens
cucagucaguaauugccaaaguugaucacuggcaaugaaaaauuaaaggaaucuccaguuuuca

SEQ ID NO: 614616 - RNA, 64 nt, Homo Sapiens
uccaugaggccaaacguuuuaugugguuuccacgaugaaaaacuucagauauuuuuucagaaau

SEQ ID NO: 614617 - RNA, 64 nt, Homo Sapiens
ugaugcccaagggagaaaugcaacuaguaacucaaugaaaaaguaaaguauuuauuauaguugu

SEQ ID NO: 614618 - RNA, 64 nt, Homo Sapiens
agaaaaagucugaagcucugagccagaagacaugaugaaaaaaguuccuucaacacccagaaug

SEQ ID NO: 614619 - RNA, 64 nt, Homo Sapiens
aaauccucuuguuggaaacagagauaauucuagaaugaaaaagauaucugaucaaguuaucaag

SEQ ID NO: 614620 - RNA, 64 nt, Homo Sapiens
cacuuguggcacacgauggggggugcuuuacauaaugaaaaaacacaaauucuuuuaauucaac

SEQ ID NO: 614621 - RNA, 64 nt, Homo Sapiens
uauauuuuucccuguuugccacauucaguacuuuaugaaaaaaacaaacagaugaaaaaaguua

SEQ ID NO: 614622 - RNA, 64 nt, Homo Sapiens
uuaacauucaguacuuuauguuuuuuacaaacagaugaaaaaagaacacacuuuugcacauaua

SEQ ID NO: 614623 - RNA, 64 nt, Homo Sapiens
gacuguguaccuugaauucuagaaaagucguuuaaugaaaaagauuguuuccugaaauaauuag

SEQ ID NO: 614624 - RNA, 64 nt, Homo Sapiens
uuauaagucaccugagaggcaaacuggucucuugaugaaaaaaaucaaguuauuuuuuauucua

SEQ ID NO: 614625 - RNA, 64 nt, Homo Sapiens
acagaauuauauuucuauuuaguuaaaauuguuaaugaaaaacagauaaaugugcccuggucua

SEQ ID NO: 614626 - RNA, 64 nt, Homo Sapiens
caaugucuacuguacugugggucauuuagaugagaugaaaaacuuaauuaaaucugaaguguca

SEQ ID NO: 614627 - RNA, 64 nt, Homo Sapiens
cugcuaauagaaauuauguuuucauguguuucacaugaaaaaguauauauauacaaaguuaaua

SEQ ID NO: 614628 - RNA, 64 nt, Homo Sapiens
gcuaguauguuguaaaaccugccaccugaauaaaaugaaaaaaaaaguguuuuuuugagacaga

SEQ ID NO: 614629 - RNA, 64 nt, Homo Sapiens
aaauuacugucaccacuaguuuuaauauaguacaaugaaaaaauaauauauauauauauaguac

SEQ ID NO: 614630 - RNA, 64 nt, Homo Sapiens
aaaaauaaaagaaacauaagauaaguaccucucaaugaaaaauguaaaaguaccuagaaauuca

SEQ ID NO: 614631 - RNA, 64 nt, Homo Sapiens
cacugguuaugaaauuguauuuuuuuaaguauuaaugaaaaaagagccauaagcauuccaggag

SEQ ID NO: 614632 - RNA, 64 nt, Homo Sapiens
uucaucgaaauugccugugugcacauauuuuuagaugaaaaaugaaacuaccuuacaauauuau

SEQ ID NO: 614633 - RNA, 64 nt, Homo Sapiens
ucuccagagcagacuucugacacuguccuugcagaugaaaaaaggaguuagucauggaauaaag

SEQ ID NO: 614634 - RNA, 64 nt, Homo Sapiens
cagcuuuuccaggguugcuguucuagaaaucaggaugaaaaauguucaguuguuuuuggaaaaa

SEQ ID NO: 614635 - RNA, 64 nt, Homo Sapiens
aggccaaaacaagaguucugacuugaaugcgcucaugaaaaauaggcaaagucauaaauucucc

SEQ ID NO: 614636 - RNA, 64 nt, Homo Sapiens
gccuggacugcacgcagugcugcugaagaaagauaugaaaaacccaaggauuucaucagcaauc

SEQ ID NO: 614637 - RNA, 64 nt, Homo Sapiens
ugcgcagcugggaaguucacuuuaaaaaacuaagaugaaaaaagagaaagaagagguauacuua

SEQ ID NO: 614638 - RNA, 64 nt, Homo Sapiens
gagcaaacaaaaaaaucgaaaaaucuuguuaacaaugaaaaaauggacucuugcauagaaaaaa

SEQ ID NO: 614639 - RNA, 64 nt, Homo Sapiens
acuucaguuaaaacuauaauuaugauuguccuauaugaaaaacagcucuuguaauacucauauu

SEQ ID NO: 614640 - RNA, 64 nt, Homo Sapiens
cagacuggagacuggagggucugaacugaaacucaugaaaaaccggucagugugcuggcuuaca

SEQ ID NO: 614641 - RNA, 64 nt, Homo Sapiens
uuuaaaagauauauauaucugaggaacuucaauuaugaaaaauugauuuuuuuguaaauauaaa

SEQ ID NO: 614642 - RNA, 64 nt, Homo Sapiens
aaugucagaauaaccgacaugaugugaguaucugaugaaaaaacggcaaaucacauguguuguu

SEQ ID NO: 614643 - RNA, 64 nt, Homo Sapiens
uaggagcaaucuaagcuguguuacuccaaaggacaugaaaaagcucaagaguaaaauuaaaauu

SEQ ID NO: 614644 - RNA, 64 nt, Homo Sapiens
ccucgcuggagaggcuccugucugauagcgguagaugaaaaauaaggucguuaugacuuuggca

SEQ ID NO: 614645 - RNA, 56 nt, Homo Sapiens
auuuauuauaucguacauaaguuaguaugaaaaacagacuaucaccuuuauugaga

SEQ ID NO: 614646 - RNA, 64 nt, Homo Sapiens
ucagaaucaaaauuaagaaaguuggacugaaaauaugaaaaaugcuuaacuauuguucucuucc

SEQ ID NO: 614647 - RNA, 64 nt, Homo Sapiens
cacaaguucaaucuguuuuucauguaaauuuuguaugaaaaaucaaugucaaguaccaaaaugu

SEQ ID NO: 614648 - RNA, 64 nt, Homo Sapiens
uugucuuuuuuucaagaugcuuuguuucuuucauaugaaaaaaaugcauuuuauaaauucagaa

SEQ ID NO: 614649 - RNA, 64 nt, Homo Sapiens
uaaucaucgggaagaacgucuaauaauuuuaagaaugaaaaauuaguacuuuuuaacaacaaaa

SEQ ID NO: 614650 - RNA, 64 nt, Homo Sapiens
ucacucaucuacauaaaggauuucaugaugacccaugaaaaauacccaaagaauuauagauauu

SEQ ID NO: 614651 - RNA, 64 nt, Homo Sapiens
ucguaucuuaacagugaacauggccacuaaguauaugaaaaaagcacagaagagagaaugcaaa

SEQ ID NO: 614652 - RNA, 64 nt, Homo Sapiens
aauacagucuuacaccaucaugccaguucuuggaaugaaaaagaaugacucagaaaaaagaagc

SEQ ID NO: 614653 - RNA, 64 nt, Homo Sapiens
acuuuccugcuuuccauuguaauuauuagagugaaugaaaaaccucucuagcuuaucccugcac

SEQ ID NO: 614654 - RNA, 64 nt, Homo Sapiens
auuuaagaggacagaagacuguaauauaaucagaaugaaaaauaccuccacagcucauuucuuu

SEQ ID NO: 614655 - RNA, 64 nt, Homo Sapiens
uuggguauccuguaauuuaguuguaacauagaaaaugaaaaaacaguuaaaaaaagugaaguag

SEQ ID NO: 614656 - RNA, 64 nt, Homo Sapiens
auuuaagaaauagucuauguaaagucacaaauuaaugaaaaaaauucgcaugaaaaugacagau

SEQ ID NO: 614657 - RNA, 64 nt, Homo Sapiens
auauuuucuaaaaagauaaaaaauauacauaacgaugaaaaauaauacaaauuuaaaaaccaau

SEQ ID NO: 614658 - RNA, 64 nt, Homo Sapiens
augaaguguagaucauuguauucagagauuguaaaugaaaaaaauauagaaacuauuuaguuuu

SEQ ID NO: 614659 - RNA, 64 nt, Homo Sapiens
cauuguaacacuugauggagugcuuguaaugaaaaugaaaaaauuuguccuacauucauucucc

SEQ ID NO: 614660 - RNA, 64 nt, Homo Sapiens
guacuuguuuauauuaauaucagcaagacuuagaaugaaaaaggcuggucaucaaaagacucga

SEQ ID NO: 614661 - RNA, 64 nt, Homo Sapiens
cagaccccuuggucaaugguguucuggcuuacuuaugaaaaaaucagagagaugaguggaguca

SEQ ID NO: 614662 - RNA, 64 nt, Homo Sapiens
augacuuccucugacagccacacaccgaaucuugaugaaaaaagagaagagcauuugccuuguu

SEQ ID NO: 614663 - RNA, 64 nt, Homo Sapiens
aauuccauauuuuagaagcuaugaaaguccuuuuaugaaaaaguuacugauugcuucucaguua

SEQ ID NO: 614664 - RNA, 64 nt, Homo Sapiens
aguuguuauaccauacugguuagugaauaauuacaugaaaaaaaagagucuguacaucuucaga

SEQ ID NO: 614665 - RNA, 64 nt, Homo Sapiens
uuuucaaaagaagaccuacaauuggccaacaaacaugaaaaaaugcucaguaucacuaaucauc

SEQ ID NO: 614666 - RNA, 64 nt, Homo Sapiens
gaaucaaucuaagugcccaacaacaguaaauucaaugaaaaaaaaugugguacauagauacgau

SEQ ID NO: 614667 - RNA, 64 nt, Homo Sapiens
aaauagaucuggugcacccgaacauuaggagaaaaugaaaaauauacaaccaaccguucgugag

SEQ ID NO: 614668 - RNA, 64 nt, Homo Sapiens
gcaagggucaaaacuagauuggaucuugguuugaaugaaaaaaagcauaaaauauucuugcaau

SEQ ID NO: 614669 - RNA, 64 nt, Homo Sapiens
augaucuacagugaucuuuaacauacucagaaauaugaaaaauguuugaauaugaucuuuaggg

SEQ ID NO: 614670 - RNA, 64 nt, Homo Sapiens
uuauccauuuccuaugcguuuuacuccucagagaaugaaaaaaacugcaucccaucacccaaag

SEQ ID NO: 614671 - RNA, 64 nt, Homo Sapiens
gaaaaugguuaccaguacagucaaaaaagagaaaaugaaaaaaauacaacuaaaaggaagaaac

SEQ ID NO: 614672 - RNA, 64 nt, Homo Sapiens
agaauuaugcacacaucuaaggcccccagcuacaaugaaaaagauauuaauugaccacuuccuu

SEQ ID NO: 614673 - RNA, 64 nt, Homo Sapiens
uaugugcuaguguugacuuuguauguauuuagauaugaaaaacuuugaaauaggaaguauccua

SEQ ID NO: 614674 - RNA, 64 nt, Homo Sapiens
caucaguagaaucuauuuuggucacuucuagucaaugaaaaauguaaacuuuuaggagagaaug

SEQ ID NO: 614675 - RNA, 64 nt, Homo Sapiens
auaugggaucccguguguguguguguguguuugaaugaaaaaugcuuauguauugacagaacac

SEQ ID NO: 614676 - RNA, 64 nt, Homo Sapiens
cccuuauauauuuucugaaaaugaaaacaguuacaugaaaaaaauuuccaaugaagaugucagc

SEQ ID NO: 614677 - RNA, 64 nt, Homo Sapiens
ugaaaaaaauuuccaaugaagaugucagcauuuuaugaaaaaccagaaguuauuagaugaaagc

SEQ ID NO: 614678 - RNA, 64 nt, Homo Sapiens
aaaaagcaaaccaaaagaaaccaugucuacaaaaaugaaaaaccgggcaacauagcaacacccc

SEQ ID NO: 614679 - RNA, 64 nt, Homo Sapiens
ccgcuauauugugauuugggaggggccauggaaaaugaaaaagugagaugacaaaacuaaguuc

SEQ ID NO: 614680 - RNA, 64 nt, Homo Sapiens
uguaugcuuugaaggcugcccagagcucagauauaugaaaaauuuccucuuguuccugcuuaug

SEQ ID NO: 614681 - RNA, 64 nt, Homo Sapiens
cgacauggcagaaguugaaaacuaaaaaguaaaaaugaaaaagaaucaauuuaguuaccuccca

SEQ ID NO: 614682 - RNA, 64 nt, Homo Sapiens
aaaguauaguuaaugguuucuuugccuuaaaauaaugaaaaagaccacugacuauuuuaucaaa

SEQ ID NO: 614683 - RNA, 64 nt, Homo Sapiens
agucacuuccucacauggaacuuuauagugugaaaugaaaaauucuguuuugccuuuucacgcc

SEQ ID NO: 614684 - RNA, 64 nt, Homo Sapiens
acauauauuuuuggaaaagcguuaauuguguggaaugaaaaaauagauuaaauuggagaaacgu

SEQ ID NO: 614685 - RNA, 64 nt, Homo Sapiens
cuuuccccuuuguguuuuggugucauuuuuuugaaugaaaaauauguguugugugacauucaaa

SEQ ID NO: 614686 - RNA, 64 nt, Homo Sapiens
uauuuguagauaggauaaucaccacagugauuagaugaaaaaauauuuaaauaacacaaaauug

SEQ ID NO: 614687 - RNA, 64 nt, Homo Sapiens
aucaaaaaacaauuagcauuguaugucacuacauaugaaaaaacguaucagugcuaaaugcucu

SEQ ID NO: 614688 - RNA, 64 nt, Homo Sapiens
aaaaugacuuuucaaauuaugaugcauuuuuauuaugaaaaaaucugaauugcaucagaucaug

SEQ ID NO: 614689 - RNA, 64 nt, Homo Sapiens
gaaggaaaaaagaauaagaaauugcaaugaaaaaaugaaaaaaacauaacucugguguguuaac

SEQ ID NO: 614690 - RNA, 64 nt, Homo Sapiens
gaaaaaaagaaggaaaaaagguguuaacauugcaaugaaaaaauaaaaaucacauaacucuggu

SEQ ID NO: 614691 - RNA, 64 nt, Homo Sapiens
uuuugguaugcgauacagacagcuaacuuuucuuaugaaaaauacauauuugcauguaaacaau

SEQ ID NO: 614692 - RNA, 64 nt, Homo Sapiens
uacagcuuacauuuccauuccauuauuacaagugaugaaaaacaaaaaauugcaaguaguaugc

SEQ ID NO: 614693 - RNA, 64 nt, Homo Sapiens
auacucaacaguaauuccacuguuaccugcacaaaugaaaaacaauguauuccacuguuauuac

SEQ ID NO: 614694 - RNA, 64 nt, Homo Sapiens
gcuacuccaaucugaaugauaaauauaguaacacaugaaaaaauguugacuggaaaggaaugga

SEQ ID NO: 614695 - RNA, 64 nt, Homo Sapiens
uuguagauaccauauccccuacaaacacauccaaaugaaaaauuuagauuuguacuuagcaaau

SEQ ID NO: 614696 - RNA, 64 nt, Homo Sapiens
agacuuggugugaccagccaacucguaucccaagaugaaaaauagucauaucagaucguuggca

SEQ ID NO: 614697 - RNA, 64 nt, Homo Sapiens
cuaaggugacucgaguguuuuaaaugacuugcagaugaaaaaaaauuuaaaugcuuuuuaucgc

SEQ ID NO: 614698 - RNA, 64 nt, Homo Sapiens
guucaaauucacguucuaguacugccugacaauuaugaaaaaauaacugcuuuauuuuuauaaa

SEQ ID NO: 614699 - RNA, 64 nt, Homo Sapiens
caaagaaaaaaauauucugagucaguaaaacuuaaugaaaaaaguucuuuuuuccaccuuuuug

SEQ ID NO: 614700 - RNA, 64 nt, Homo Sapiens
gacguagaaaaauguuuagaagcuguuuuaacaaaugaaaaaaaucugaaaauguauuuaacau

SEQ ID NO: 614701 - RNA, 64 nt, Homo Sapiens
uuaugggauuaaagaaagucaaaaaaaaaaaauuaugaaaaaagagagugagacucugucucaa

SEQ ID NO: 614702 - RNA, 64 nt, Homo Sapiens
gccaggugcaguggcucacgaugguauaaaaguuaugaaaaaagaaaaagguuauggguaacuu

SEQ ID NO: 614703 - RNA, 64 nt, Homo Sapiens
cuauaaguaguucaaagguuuauugcuuagccauaugaaaaauaagggaagauuuuuuagcaag

SEQ ID NO: 614704 - RNA, 64 nt, Homo Sapiens
gggaccagaaaccagaagaacaaucaagacugcaaugaaaaaaauggauacauuaggagcuuca

SEQ ID NO: 614705 - RNA, 64 nt, Homo Sapiens
aaggcaaaaacuagugggaacacucugaaaaugcaugaaaaacaaagagaggagggaaguugug

SEQ ID NO: 614706 - RNA, 64 nt, Homo Sapiens
gucuguucauaauugguaggagugguaaauaauuaugaaaaaugccuaaacccuuaugccacau

SEQ ID NO: 614707 - RNA, 64 nt, Homo Sapiens
uauaguuuugcccuuaagaagucaugauuaacuuaugaaaaaauuauuuggggacaggagugug

SEQ ID NO: 614708 - RNA, 64 nt, Homo Sapiens
aggauuuuuuuuuuuuuuuaagaaaaaccuauagaugaaaaauuacuaaugaaacuguguguac

SEQ ID NO: 614709 - RNA, 64 nt, Homo Sapiens
gccuaaguagauuuaggcaacggguaucauauccaugaaaaaugucauuuuaagacacuaauau

SEQ ID NO: 614710 - RNA, 64 nt, Homo Sapiens
uaaaauagguguugccuauugcugugcuuauaaaaugaaaaaggaaauugaggacacuuuugca

SEQ ID NO: 614711 - RNA, 64 nt, Homo Sapiens
gguauauuugguuuaguucuauaauguuguauauaugaaaaacacauauauucugcaaaguggu

SEQ ID NO: 614712 - RNA, 64 nt, Homo Sapiens
gucauugugacaucacagguuuuccuugauuguuaugaaaaaguaauuggcaagaaaaugguac

SEQ ID NO: 614713 - RNA, 64 nt, Homo Sapiens
ggaaaagcaggugcuuuuuaaauuuagaagcaagaugaaaaaaauauauuuuuuaaaagcugaa

SEQ ID NO: 614714 - RNA, 64 nt, Homo Sapiens
uguuauauuguguuugacuaugagaaguauagggaugaaaaagaagaauacuuuuuuuuuaagc

SEQ ID NO: 614715 - RNA, 64 nt, Homo Sapiens
gucuugaguuguggacccauuuuaaaaaucauccaugaaaaagugacuaauguguccaaucauu

SEQ ID NO: 614716 - RNA, 64 nt, Homo Sapiens
uaaaacacaggaaaggggaauucugugauggcaaaugaaaaaaauguuaacauuugguagacau

SEQ ID NO: 614717 - RNA, 64 nt, Homo Sapiens
uauuauuuuuuucuuaacagaaauauuuuuaaaaaugaaaaaguacucaaaagugagaagaguu

SEQ ID NO: 614718 - RNA, 64 nt, Homo Sapiens
cuccacauuuguucuuccuuccucaggguuagugaugaaaaaaaguaaauaucuuuuucauaug

SEQ ID NO: 614719 - RNA, 64 nt, Homo Sapiens
aguaaauaucuuuuucauauguccauuagaauguaugaaaaaaaucauuuuaacuaaaagcaaa

SEQ ID NO: 614720 - RNA, 64 nt, Homo Sapiens
uugaauauacauauauauaugaaagcucaucucuaugaaaaaauaccagccugggcaacauggu

SEQ ID NO: 614721 - RNA, 64 nt, Homo Sapiens
aaaauuuguguuuauuauaauuuaguguuguuaaaugaaaaauuaacauuuauauaccucauuc

SEQ ID NO: 614722 - RNA, 64 nt, Homo Sapiens
augcauaccuaaugaaguaugugaaaagaaaauuaugaaaaaauccuauucucuuaaaaaguau

SEQ ID NO: 614723 - RNA, 64 nt, Homo Sapiens
aacugcuagcuuuccuuucaugacacaaaagggcaugaaaaacugaugacaguuuucaauguag

SEQ ID NO: 614724 - RNA, 64 nt, Homo Sapiens
agaaacaauuuucuucuuccuuauuucacugaagaugaaaaaaagcuaauccaggguaccuuug

SEQ ID NO: 614725 - RNA, 64 nt, Homo Sapiens
ggcacuauaauuucuguaacacacuaacaaaagcaugaaaaauaggaaccacaccaaugcaaca

SEQ ID NO: 614726 - RNA, 64 nt, Homo Sapiens
agaauaaaaaguagcaguaacauaguuguacaauaugaaaaaaacgucgcuuaauaccuaauau

SEQ ID NO: 614727 - RNA, 64 nt, Homo Sapiens
aaaaugugccuguuuaaagcuuucacugcaacaaaugaaaaaacacuaaacugagugugacuau

SEQ ID NO: 614728 - RNA, 64 nt, Homo Sapiens
ucauuauguuuagaggucuaagaaauuuuuguagaugaaaaaaaugcaaauuuucuaguauaac

SEQ ID NO: 614729 - RNA, 64 nt, Homo Sapiens
ggaggugcuggugguauggcauauguagaauaacaugaaaaauuuauauaauauagaacuauga

SEQ ID NO: 614730 - RNA, 64 nt, Homo Sapiens
aaauugaaucuuuuacuuaccucuugcaaaaaaaaugaaaaaugaaaaaacaaauucaaaaccu

SEQ ID NO: 614731 - RNA, 64 nt, Homo Sapiens
aucuuuuacuuaccucuugcaaaaaaaaugaaaaaugaaaaaacaaauucaaaaccuauucaaa

SEQ ID NO: 614732 - RNA, 64 nt, Homo Sapiens
aagaauaacaaauagaagggccaagaaauucaccaugaaaaaacucuaaauauuuuucagugag

SEQ ID NO: 614733 - RNA, 64 nt, Homo Sapiens
cauccacucugcugccauucugugccuguuaugaaugaaaaaucuugucuccauauauacuauc

SEQ ID NO: 614734 - RNA, 64 nt, Homo Sapiens
auauuuuucaaauagauuuuugauucagcucauuaugaaaaacaucccaaacuuuaaaaugcga

SEQ ID NO: 614735 - RNA, 64 nt, Homo Sapiens
augaaauccuaugacaguaagcaaaaacagaaccaugaaaaaugauuggacauacaccuuuuca

SEQ ID NO: 614736 - RNA, 64 nt, Homo Sapiens
aaaggccuuuauucugccaagucauuucgaagacaugaaaaaacucacacuggagagaaacccu

SEQ ID NO: 614737 - RNA, 64 nt, Homo Sapiens
aaaggcuuuuauucucccacgucauuucaaagacaugaaaaaacucacacugcagagaaacccu

SEQ ID NO: 614738 - RNA, 64 nt, Homo Sapiens
aaagcuuucagucagagacaaaaucuucuugagcaugaaaaaauucauacuggagagaaaccau

SEQ ID NO: 614739 - RNA, 64 nt, Homo Sapiens
uauuguguaacauggauaguuaaaacaauguugaaugaaaaaaaucaaaauacaaaugaaacau

SEQ ID NO: 614740 - RNA, 64 nt, Homo Sapiens
agcaucauucuaauaccaaaaccugacaggcacaaugaaaaaagaaaacuucaggcugguacuc

SEQ ID NO: 614741 - RNA, 64 nt, Homo Sapiens
ucucaaaagaauacauacauguggcaauaagcauaugaaaaaaaugguuaauaucgcuaaucau

SEQ ID NO: 614742 - RNA, 64 nt, Homo Sapiens
cauguacacauacuccuugaaccuaaaauaaaacaugaaaaaaagcaaauuucacaccuuguaa

SEQ ID NO: 614743 - RNA, 64 nt, Homo Sapiens
uacaugaaucuuggccacaaugagaaaaauaaaaaugaaaaaagagcaggcauccauuuccaua

SEQ ID NO: 614744 - RNA, 64 nt, Homo Sapiens
ucaaucaauguaauucaguauuuuaacaaaaggaaugaaaaauuaucaucucaauagacaaagc

SEQ ID NO: 614745 - RNA, 64 nt, Homo Sapiens
guccacaggggaucugucaguuuggguccuccaaaugaaaaaugucaagacagaauuggacaug

SEQ ID NO: 614746 - RNA, 64 nt, Homo Sapiens
uuuuccauauaauauuauuuaaaaugcugagaaaaugaaaaaaucuaaauggugaaauauauac

SEQ ID NO: 614747 - RNA, 64 nt, Homo Sapiens
agaauauaauuugacuaucaagacuuuuagcauaaugaaaaacccucucucuauauauauaugu

SEQ ID NO: 614748 - RNA, 64 nt, Homo Sapiens
uuuaagccugcuguaguugaguugcagacagugcaugaaaaaguauuccgcugggaauugagcc

SEQ ID NO: 614749 - RNA, 64 nt, Homo Sapiens
aguuagacuacauaucuuuuggcacuaacaucucaugaaaaauuaugguuaauaaaauaucacc

SEQ ID NO: 614750 - RNA, 64 nt, Homo Sapiens
uauuagaaugcauguaaggucuucuuguguccugaugaaaaauaugugcuugaaaugagaaacu

SEQ ID NO: 614751 - RNA, 64 nt, Homo Sapiens
aacugaagaccuccacauuaaguggcuuuuuaacaugaaaaacacggcagcuguagcucccgag

SEQ ID NO: 614752 - RNA, 64 nt, Homo Sapiens
uguauuuuuuuuuugguugucuucagcugacaguaugaaaaaugaaacugcugaaaaagcugag

SEQ ID NO: 614753 - RNA, 64 nt, Homo Sapiens
uaugguuggucugaguaaguaacuuccugucuucaugaaaaaaguugacuuugaaucccaggua

SEQ ID NO: 614754 - RNA, 64 nt, Homo Sapiens
uggccuuacagggcucuaguuuacuuuccuugugaugaaaaacuauaaaaggcucuaauuaugg

SEQ ID NO: 614755 - RNA, 64 nt, Homo Sapiens
aauuuucucacugucauaaaauaggugagaugauaugaaaaacauaaacaauacggaaggggag

SEQ ID NO: 614756 - RNA, 64 nt, Homo Sapiens
ugcuauguuuuguuuuaagcuuggggguuauuuaaugaaaaacaucaucacuuuuugaauuucu

SEQ ID NO: 614757 - RNA, 64 nt, Homo Sapiens
acccaauauauauuuuuuggcacaggacagcccuaugaaaaaauucugucuaccuuuagccagg

SEQ ID NO: 614758 - RNA, 64 nt, Homo Sapiens
aaaccaaaauaugcucuugcuuuaccccuagucuaugaaaaaacuuuucuuaguagugcagacc

SEQ ID NO: 614759 - RNA, 64 nt, Homo Sapiens
uauuacauuucauuucugaauagcuuuugaauuuaugaaaaauuauuaacaaugaaaaauuggu

SEQ ID NO: 614760 - RNA, 64 nt, Homo Sapiens
gaauagcuuuugaauuuaugaaaaauuauuaacaaugaaaaauugguaauuuuauuaaguuaua

SEQ ID NO: 614761 - RNA, 64 nt, Homo Sapiens
uucugucugcacaacucuucuuuuuuuaauuacaaugaaaaauuuuguguuccaaggcaacugu

SEQ ID NO: 614762 - RNA, 64 nt, Homo Sapiens
aagccuaguuaucuccaguuguuuuaaggguguuaugaaaaauucuuaaaauauauaugaauuu

SEQ ID NO: 614763 - RNA, 64 nt, Homo Sapiens
aaacauauaauauaggaggagucugaauguagagaugaaaaauacagaauguaauggcuucucu

SEQ ID NO: 614764 - RNA, 64 nt, Homo Sapiens
cccaacuauugagcauguuuacuucuugcuucaaaugaaaaaauaccaucugaaaauucacaaa

SEQ ID NO: 614765 - RNA, 64 nt, Homo Sapiens
aacuaagauuacacagcuuuauuauugauucgauaugaaaaaucuaaaauauauuuuugacuaa

SEQ ID NO: 614766 - RNA, 64 nt, Homo Sapiens
guuuaaaaguauuuaguugaaucaaaaguguauagaauauuauauaccauaauacauggcuauc

SEQ ID NO: 614767 - RNA, 64 nt, Homo Sapiens
ugugguauucuggugaugggauaaucuauccugagaauauuaauuuauuccuaggcaacuauua

SEQ ID NO: 614768 - RNA, 64 nt, Homo Sapiens
uucauaaguuaauaaauaaguaauguugguauuagaauauuaucgcuaauuauuuuaaacacuu

SEQ ID NO: 614769 - RNA, 64 nt, Homo Sapiens
guaguuauucacaaaaauuguaaaagcuauuagugaauauuaagucaauaagagauuaggagcc

SEQ ID NO: 614770 - RNA, 64 nt, Homo Sapiens
uuauuaucaaggauguuuuacagggaaaucaaaagaauauuaucauacuuuaucuuucguaugc

SEQ ID NO: 614771 - RNA, 64 nt, Homo Sapiens
uguuaauucaauauaaaugaccuuugauuucauggaauauuaaaguugguuuaaaguccaauag

SEQ ID NO: 614772 - RNA, 64 nt, Homo Sapiens
ucugucucugaauuacuucacucuauuggucaaagaauauuaaaugugcacaguuucucgguau

SEQ ID NO: 614773 - RNA, 64 nt, Homo Sapiens
gacucucuagcugccugggcaaaugcuaagcaaugaauauuaagguccaggcccagcaaaacca

SEQ ID NO: 614774 - RNA, 64 nt, Homo Sapiens
gcugaugcuuauacaucuauucuauaacagugaugaauauuaacacaaaggaaauauggagaac

SEQ ID NO: 614775 - RNA, 64 nt, Homo Sapiens
cugaacuagaugaauuggccauaauuaugaauaggaauauuaaugaaccagaggacauacuagu

SEQ ID NO: 614776 - RNA, 64 nt, Homo Sapiens
gucuuaauacacucagguuugaacagauuauucugaauauuaaaauuuaauccauucuuaauau

SEQ ID NO: 614777 - RNA, 64 nt, Homo Sapiens
gaccuagguauagagaucugauaacuugaauucagaauauuaagaaaaugaaguaacugauuuu

SEQ ID NO: 614778 - RNA, 64 nt, Homo Sapiens
gaaggagaggagcugugggugaagcagcauacuugaauauuagaagaaggaaugaggaguuagg

SEQ ID NO: 614779 - RNA, 64 nt, Homo Sapiens
cccuacccuuuaacucagcauuauuguuuaauuagaauauuaaacauaguguagucaucuauua

SEQ ID NO: 614780 - RNA, 64 nt, Homo Sapiens
aaaauagcauuuaucuuauuuuagaaauaaguaugaauauuaauuaagacuauaugaagguaaa

SEQ ID NO: 614781 - RNA, 64 nt, Homo Sapiens
cuuucuaaacuaaauuuaggccauaguuuagaaagaauauuaacaaugcuauauauaguauaug

SEQ ID NO: 614782 - RNA, 64 nt, Homo Sapiens
aaguucauacauuugcgggcuuuggcagaauucagaauauuaaagaauucuaugagucaaucuu

SEQ ID NO: 614783 - RNA, 64 nt, Homo Sapiens
aagaguuucaugugaucacuaauuucuacaaaaugaauauuaucaagccaaaguguacgguaga

SEQ ID NO: 614784 - RNA, 64 nt, Homo Sapiens
acuugacagauagaguuaauaaaggcugccuacagaauauuaucaauucucaaaacaucauuuc

SEQ ID NO: 614785 - RNA, 64 nt, Homo Sapiens
aauggcuuauagagagagacuguaagagcauagagaauauuaauaguuucuaaauguuuuacau

SEQ ID NO: 614786 - RNA, 64 nt, Homo Sapiens
uaacccacugcugaaaaagauuuuuaaauuuacagaauauuauaucaaauuaaucuuucuauau

SEQ ID NO: 614787 - RNA, 64 nt, Homo Sapiens
gcuaaagguguaagacuucauuuuuccagaauuugaauauuaacucauuacuaacuucuuccac

SEQ ID NO: 614788 - RNA, 64 nt, Homo Sapiens
aaacauuuggaugagaacaauggcagaugguaaggaauauuauauuuuuggugaaccugacuug

SEQ ID NO: 614789 - RNA, 64 nt, Homo Sapiens
uaagaugaugugcccuguuaacaacaguuugagagaauauuauauagcuauaggcacaagaaaa

SEQ ID NO: 614790 - RNA, 64 nt, Homo Sapiens
cacuuaacccuuugugauaaugaugacacaaaaugaauauuaauggaggauauuccucggaaaa

SEQ ID NO: 614791 - RNA, 64 nt, Homo Sapiens
acauagaauacuauugguaugugugcaauuucaugaauauuaaauuauguuucgaaguccaguu

SEQ ID NO: 614792 - RNA, 64 nt, Homo Sapiens
gcagaaauaauuacugaaagugccagacacuaaggaauauuauuguuuauuauuuuaauacaua

SEQ ID NO: 614793 - RNA, 64 nt, Homo Sapiens
uuuauucaagacauugaaacuacuuugcacauaugaauauuaauguaacuuguaauuuaaaagu

SEQ ID NO: 614794 - RNA, 64 nt, Homo Sapiens
uuguaaauucugcaaguuuauuucugucugcucagaauauuaauuugcaaaaggauguauaaua

SEQ ID NO: 614795 - RNA, 64 nt, Homo Sapiens
gaugaauuuucauaagguggaaaauaagauaugagaauauuauucucuuuuaauguaauggaca

SEQ ID NO: 614796 - RNA, 64 nt, Homo Sapiens
ucuuuuacugcuaagcagccuggaaaggauaaaugaauauuagacuaagauuuguuuuccagga

SEQ ID NO: 614797 - RNA, 64 nt, Homo Sapiens
caugauacauccuauggguauuaaaaagccaauagaauauuaugaauaauuuuaugcuaauaaa

SEQ ID NO: 614798 - RNA, 64 nt, Homo Sapiens
aaucccacugugguauagauuccauaauaugcuugaauauuaugauauagccauuuaauaacau

SEQ ID NO: 614799 - RNA, 64 nt, Homo Sapiens
guuacuaugguuugugguacaacuucauucuauagaauauuaaguggaagugggugaauucuac

SEQ ID NO: 614800 - RNA, 64 nt, Homo Sapiens
acugcuuugcauggguuuucgggaagaaaggauagaauauuaaaugaauauuauagaagaaugg

SEQ ID NO: 614801 - RNA, 64 nt, Homo Sapiens
gaagaaugggggaagaaaggggucaccaaacggugaauauuauauuuuguggauuuguguaucc

SEQ ID NO: 614802 - RNA, 64 nt, Homo Sapiens; identical to SEQ ID NO: 210459

SEQ ID NO: 614803 - RNA, 64 nt, Homo Sapiens; identical to SEQ ID NO: 210460

SEQ ID NO: 614804 - RNA, 64 nt, Homo Sapiens; identical to SEQ ID NO: 210461

SEQ ID NO: 614805 - RNA, 64 nt, Homo Sapiens; identical to SEQ ID NO: 210462

SEQ ID NO: 614806 - RNA, 64 nt, Homo Sapiens; identical to SEQ ID NO: 210463

SEQ ID NO: 614807 - RNA, 64 nt, Homo Sapiens; identical to SEQ ID NO: 210464

SEQ ID NO: 614808 - RNA, 64 nt, Homo Sapiens; identical to SEQ ID NO: 210465

SEQ ID NO: 614809 - RNA, 64 nt, Homo Sapiens; identical to SEQ ID NO: 210466

SEQ ID NO: 614810 - RNA, 64 nt, Homo Sapiens; identical to SEQ ID NO: 210467

SEQ ID NO: 614811 - RNA, 64 nt, Homo Sapiens; identical to SEQ ID NO: 210468

SEQ ID NO: 614812 - RNA, 64 nt, Homo Sapiens; identical to SEQ ID NO: 210469

SEQ ID NO: 614813 - RNA, 64 nt, Homo Sapiens; identical to SEQ ID NO: 210470

SEQ ID NO: 614814 - RNA, 64 nt, Homo Sapiens; identical to SEQ ID NO: 210471

SEQ ID NO: 614815 - RNA, 64 nt, Homo Sapiens; identical to SEQ ID NO: 210472

SEQ ID NO: 614816 - RNA, 64 nt, Homo Sapiens; identical to SEQ ID NO: 210473

SEQ ID NO: 614817 - RNA, 64 nt, Homo Sapiens; identical to SEQ ID NO: 210474

SEQ ID NO: 614818 - RNA, 64 nt, Homo Sapiens; identical to SEQ ID NO: 210475

SEQ ID NO: 614819 - RNA, 64 nt, Homo Sapiens; identical to SEQ ID NO: 210476

SEQ ID NO: 614820 - RNA, 64 nt, Homo Sapiens; identical to SEQ ID NO: 210477

SEQ ID NO: 614821 - RNA, 64 nt, Homo Sapiens; identical to SEQ ID NO: 210478

SEQ ID NO: 614822 - RNA, 64 nt, Homo Sapiens; identical to SEQ ID NO: 210479

SEQ ID NO: 614823 - RNA, 64 nt, Homo Sapiens; identical to SEQ ID NO: 210480

SEQ ID NO: 614824 - RNA, 64 nt, Homo Sapiens; identical to SEQ ID NO: 210481

SEQ ID NO: 614825 - RNA, 64 nt, Homo Sapiens; identical to SEQ ID NO: 210482

SEQ ID NO: 614826 - RNA, 64 nt, Homo Sapiens; identical to SEQ ID NO: 210483

SEQ ID NO: 614827 - RNA, 64 nt, Homo Sapiens; identical to SEQ ID NO: 210484

SEQ ID NO: 614828 - RNA, 64 nt, Homo Sapiens; identical to SEQ ID NO: 210485

SEQ ID NO: 614829 - RNA, 64 nt, Homo Sapiens; identical to SEQ ID NO: 210486

SEQ ID NO: 614830 - RNA, 64 nt, Homo Sapiens; identical to SEQ ID NO: 210487

SEQ ID NO: 614831 - RNA, 64 nt, Homo Sapiens; identical to SEQ ID NO: 210488

SEQ ID NO: 614832 - RNA, 57 nt, Homo Sapiens; identical to SEQ ID NO: 210489

SEQ ID NO: 614833 - RNA, 64 nt, Homo Sapiens; identical to SEQ ID NO: 210490

SEQ ID NO: 614834 - RNA, 64 nt, Homo Sapiens; identical to SEQ ID NO: 210491

SEQ ID NO: 614835 - RNA, 64 nt, Homo Sapiens; identical to SEQ ID NO: 210492

SEQ ID NO: 614836 - RNA, 64 nt, Homo Sapiens; identical to SEQ ID NO: 210493

SEQ ID NO: 614837 - RNA, 64 nt, Homo Sapiens; identical to SEQ ID NO: 210494

SEQ ID NO: 614838 - RNA, 64 nt, Homo Sapiens; identical to SEQ ID NO: 210495

SEQ ID NO: 614839 - RNA, 64 nt, Homo Sapiens; identical to SEQ ID NO: 210496

SEQ ID NO: 614840 - RNA, 64 nt, Homo Sapiens; identical to SEQ ID NO: 210497

SEQ ID NO: 614841 - RNA, 64 nt, Homo Sapiens; identical to SEQ ID NO: 210498

SEQ ID NO: 614842 - RNA, 64 nt, Homo Sapiens; identical to SEQ ID NO: 210499

SEQ ID NO: 614843 - RNA, 64 nt, Homo Sapiens; identical to SEQ ID NO: 210500

SEQ ID NO: 614844 - RNA, 64 nt, Homo Sapiens; identical to SEQ ID NO: 210501

SEQ ID NO: 614845 - RNA, 64 nt, Homo Sapiens; identical to SEQ ID NO: 210502

SEQ ID NO: 614846 - RNA, 64 nt, Homo Sapiens; identical to SEQ ID NO: 210503

SEQ ID NO: 614847 - RNA, 64 nt, Homo Sapiens; identical to SEQ ID NO: 210504

SEQ ID NO: 614848 - RNA, 64 nt, Homo Sapiens; identical to SEQ ID NO: 210505

SEQ ID NO: 614849 - RNA, 64 nt, Homo Sapiens; identical to SEQ ID NO: 210506

SEQ ID NO: 614850 - RNA, 64 nt, Homo Sapiens; identical to SEQ ID NO: 210507

SEQ ID NO: 614851 - RNA, 64 nt, Homo Sapiens; identical to SEQ ID NO: 210508

SEQ ID NO: 614852 - RNA, 64 nt, Homo Sapiens; identical to SEQ ID NO: 210509

SEQ ID NO: 614853 - RNA, 64 nt, Homo Sapiens; identical to SEQ ID NO: 210510

SEQ ID NO: 614854 - RNA, 64 nt, Homo Sapiens; identical to SEQ ID NO: 210511

SEQ ID NO: 614855 - RNA, 64 nt, Homo Sapiens; identical to SEQ ID NO: 210512

SEQ ID NO: 614856 - RNA, 64 nt, Homo Sapiens; identical to SEQ ID NO: 210513

SEQ ID NO: 614857 - RNA, 64 nt, Homo Sapiens; identical to SEQ ID NO: 210514

SEQ ID NO: 614858 - RNA, 64 nt, Homo Sapiens; identical to SEQ ID NO: 210515

SEQ ID NO: 614859 - RNA, 64 nt, Homo Sapiens; identical to SEQ ID NO: 210516

SEQ ID NO: 614860 - RNA, 64 nt, Homo Sapiens; identical to SEQ ID NO: 210517

SEQ ID NO: 614861 - RNA, 64 nt, Homo Sapiens; identical to SEQ ID NO: 210518

SEQ ID NO: 614862 - RNA, 64 nt, Homo Sapiens; identical to SEQ ID NO: 210519

SEQ ID NO: 614863 - RNA, 64 nt, Homo Sapiens; identical to SEQ ID NO: 210520

SEQ ID NO: 614864 - RNA, 64 nt, Homo Sapiens; identical to SEQ ID NO: 210521

SEQ ID NO: 614865 - RNA, 64 nt, Homo Sapiens; identical to SEQ ID NO: 210522

SEQ ID NO: 614866 - RNA, 64 nt, Homo Sapiens; identical to SEQ ID NO: 210523

SEQ ID NO: 614867 - RNA, 64 nt, Homo Sapiens; identical to SEQ ID NO: 210524

SEQ ID NO: 614868 - RNA, 64 nt, Homo Sapiens; identical to SEQ ID NO: 210525

SEQ ID NO: 614869 - RNA, 64 nt, Homo Sapiens; identical to SEQ ID NO: 210526

SEQ ID NO: 614870 - RNA, 64 nt, Homo Sapiens; identical to SEQ ID NO: 210527

SEQ ID NO: 614871 - RNA, 64 nt, Homo Sapiens; identical to SEQ ID NO: 210528

SEQ ID NO: 614872 - RNA, 64 nt, Homo Sapiens; identical to SEQ ID NO: 210529

SEQ ID NO: 614873 - RNA, 64 nt, Homo Sapiens; identical to SEQ ID NO: 210530

SEQ ID NO: 614874 - RNA, 64 nt, Homo Sapiens; identical to SEQ ID NO: 210531

SEQ ID NO: 614875 - RNA, 64 nt, Homo Sapiens; identical to SEQ ID NO: 210532

SEQ ID NO: 614876 - RNA, 64 nt, Homo Sapiens; identical to SEQ ID NO: 210533

SEQ ID NO: 614877 - RNA, 64 nt, Homo Sapiens; identical to SEQ ID NO: 210534

SEQ ID NO: 614878 - RNA, 64 nt, Homo Sapiens; identical to SEQ ID NO: 210535

SEQ ID NO: 614879 - RNA, 64 nt, Homo Sapiens; identical to SEQ ID NO: 210536

SEQ ID NO: 614880 - RNA, 64 nt, Homo Sapiens; identical to SEQ ID NO: 210537

SEQ ID NO: 614881 - RNA, 64 nt, Homo Sapiens; identical to SEQ ID NO: 210538

SEQ ID NO: 614882 - RNA, 64 nt, Homo Sapiens; identical to SEQ ID NO: 210539

SEQ ID NO: 614883 - RNA, 64 nt, Homo Sapiens; identical to SEQ ID NO: 210540

SEQ ID NO: 614884 - RNA, 64 nt, Homo Sapiens; identical to SEQ ID NO: 210541

SEQ ID NO: 614885 - RNA, 64 nt, Homo Sapiens; identical to SEQ ID NO: 210542

SEQ ID NO: 614886 - RNA, 64 nt, Homo Sapiens; identical to SEQ ID NO: 210543

SEQ ID NO: 614887 - RNA, 64 nt, Homo Sapiens; identical to SEQ ID NO: 210544

SEQ ID NO: 614888 - RNA, 64 nt, Homo Sapiens; identical to SEQ ID NO: 210545

SEQ ID NO: 614889 - RNA, 64 nt, Homo Sapiens; identical to SEQ ID NO: 210546

SEQ ID NO: 614890 - RNA, 64 nt, Homo Sapiens; identical to SEQ ID NO: 210547

SEQ ID NO: 614891 - RNA, 64 nt, Homo Sapiens; identical to SEQ ID NO: 210548

SEQ ID NO: 614892 - RNA, 64 nt, Homo Sapiens; identical to SEQ ID NO: 210549

SEQ ID NO: 614893 - RNA, 64 nt, Homo Sapiens; identical to SEQ ID NO: 210550

SEQ ID NO: 614894 - RNA, 64 nt, Homo Sapiens; identical to SEQ ID NO: 210551

SEQ ID NO: 614895 - RNA, 64 nt, Homo Sapiens; identical to SEQ ID NO: 210552

SEQ ID NO: 614896 - RNA, 64 nt, Homo Sapiens; identical to SEQ ID NO: 210553

SEQ ID NO: 614897 - RNA, 64 nt, Homo Sapiens; identical to SEQ ID NO: 210554

SEQ ID NO: 614898 - RNA, 64 nt, Homo Sapiens; identical to SEQ ID NO: 210555

SEQ ID NO: 614899 - RNA, 64 nt, Homo Sapiens; identical to SEQ ID NO: 210556

SEQ ID NO: 614900 - RNA, 64 nt, Homo Sapiens; identical to SEQ ID NO: 210557

SEQ ID NO: 614901 - RNA, 64 nt, Homo Sapiens; identical to SEQ ID NO: 210558

SEQ ID NO: 614902 - RNA, 64 nt, Homo Sapiens; identical to SEQ ID NO: 210559

SEQ ID NO: 614903 - RNA, 64 nt, Homo Sapiens; identical to SEQ ID NO: 210560

SEQ ID NO: 614904 - RNA, 64 nt, Homo Sapiens; identical to SEQ ID NO: 210561

SEQ ID NO: 614905 - RNA, 64 nt, Homo Sapiens; identical to SEQ ID NO: 210562

SEQ ID NO: 614906 - RNA, 64 nt, Homo Sapiens; identical to SEQ ID NO: 210563

SEQ ID NO: 614907 - RNA, 64 nt, Homo Sapiens; identical to SEQ ID NO: 210564

SEQ ID NO: 614908 - RNA, 64 nt, Homo Sapiens; identical to SEQ ID NO: 210565

SEQ ID NO: 614909 - RNA, 64 nt, Homo Sapiens; identical to SEQ ID NO: 210566

SEQ ID NO: 614910 - RNA, 64 nt, Homo Sapiens; identical to SEQ ID NO: 210567

SEQ ID NO: 614911 - RNA, 64 nt, Homo Sapiens; identical to SEQ ID NO: 210568

SEQ ID NO: 614912 - RNA, 64 nt, Homo Sapiens; identical to SEQ ID NO: 210569

SEQ ID NO: 614913 - RNA, 64 nt, Homo Sapiens; identical to SEQ ID NO: 210570

SEQ ID NO: 614914 - RNA, 64 nt, Homo Sapiens; identical to SEQ ID NO: 210571

SEQ ID NO: 614915 - RNA, 64 nt, Homo Sapiens; identical to SEQ ID NO: 210572

SEQ ID NO: 614916 - RNA, 61 nt, Homo Sapiens; identical to SEQ ID NO: 210573

SEQ ID NO: 614917 - RNA, 64 nt, Homo Sapiens; identical to SEQ ID NO: 210574

SEQ ID NO: 614918 - RNA, 64 nt, Homo Sapiens; identical to SEQ ID NO: 210575

SEQ ID NO: 614919 - RNA, 64 nt, Homo Sapiens; identical to SEQ ID NO: 210576

SEQ ID NO: 614920 - RNA, 64 nt, Homo Sapiens; identical to SEQ ID NO: 210577

SEQ ID NO: 614921 - RNA, 64 nt, Homo Sapiens; identical to SEQ ID NO: 210578

SEQ ID NO: 614922 - RNA, 64 nt, Homo Sapiens; identical to SEQ ID NO: 210579

SEQ ID NO: 614923 - RNA, 64 nt, Homo Sapiens; identical to SEQ ID NO: 210580

SEQ ID NO: 614924 - RNA, 64 nt, Homo Sapiens; identical to SEQ ID NO: 210581

SEQ ID NO: 614925 - RNA, 64 nt, Homo Sapiens; identical to SEQ ID NO: 210582

SEQ ID NO: 614926 - RNA, 64 nt, Homo Sapiens; identical to SEQ ID NO: 210583

SEQ ID NO: 614927 - RNA, 64 nt, Homo Sapiens; identical to SEQ ID NO: 210584

SEQ ID NO: 614928 - RNA, 64 nt, Homo Sapiens; identical to SEQ ID NO: 210585

SEQ ID NO: 614929 - RNA, 64 nt, Homo Sapiens; identical to SEQ ID NO: 210586

SEQ ID NO: 614930 - RNA, 64 nt, Homo Sapiens; identical to SEQ ID NO: 210587

SEQ ID NO: 614931 - RNA, 64 nt, Homo Sapiens; identical to SEQ ID NO: 210588

SEQ ID NO: 614932 - RNA, 64 nt, Homo Sapiens; identical to SEQ ID NO: 210589

SEQ ID NO: 614933 - RNA, 64 nt, Homo Sapiens; identical to SEQ ID NO: 210590

SEQ ID NO: 614934 - RNA, 64 nt, Homo Sapiens; identical to SEQ ID NO: 210591

SEQ ID NO: 614935 - RNA, 64 nt, Homo Sapiens; identical to SEQ ID NO: 210592

SEQ ID NO: 614936 - RNA, 64 nt, Homo Sapiens; identical to SEQ ID NO: 210593

SEQ ID NO: 614937 - RNA, 64 nt, Homo Sapiens; identical to SEQ ID NO: 210594

SEQ ID NO: 614938 - RNA, 55 nt, Homo Sapiens; identical to SEQ ID NO: 210595

SEQ ID NO: 614939 - RNA, 64 nt, Homo Sapiens; identical to SEQ ID NO: 210596

SEQ ID NO: 614940 - RNA, 64 nt, Homo Sapiens; identical to SEQ ID NO: 210597

SEQ ID NO: 614941 - RNA, 64 nt, Homo Sapiens; identical to SEQ ID NO: 210598

SEQ ID NO: 614942 - RNA, 64 nt, Homo Sapiens; identical to SEQ ID NO: 210599

SEQ ID NO: 614943 - RNA, 64 nt, Homo Sapiens; identical to SEQ ID NO: 210600

SEQ ID NO: 614944 - RNA, 64 nt, Homo Sapiens; identical to SEQ ID NO: 210601

SEQ ID NO: 614945 - RNA, 64 nt, Homo Sapiens; identical to SEQ ID NO: 210602

SEQ ID NO: 614946 - RNA, 64 nt, Homo Sapiens; identical to SEQ ID NO: 210603

SEQ ID NO: 614947 - RNA, 64 nt, Homo Sapiens; identical to SEQ ID NO: 210604

SEQ ID NO: 614948 - RNA, 64 nt, Homo Sapiens; identical to SEQ ID NO: 210605

SEQ ID NO: 614949 - RNA, 64 nt, Homo Sapiens; identical to SEQ ID NO: 210606

SEQ ID NO: 614950 - RNA, 64 nt, Homo Sapiens; identical to SEQ ID NO: 210607

SEQ ID NO: 614951 - RNA, 64 nt, Homo Sapiens; identical to SEQ ID NO: 210608

SEQ ID NO: 614952 - RNA, 64 nt, Homo Sapiens; identical to SEQ ID NO: 210609

SEQ ID NO: 614953 - RNA, 64 nt, Homo Sapiens; identical to SEQ ID NO: 210610

SEQ ID NO: 614954 - RNA, 64 nt, Homo Sapiens; identical to SEQ ID NO: 210611

SEQ ID NO: 614955 - RNA, 64 nt, Homo Sapiens; identical to SEQ ID NO: 210612

SEQ ID NO: 614956 - RNA, 64 nt, Homo Sapiens; identical to SEQ ID NO: 210613

SEQ ID NO: 614957 - RNA, 64 nt, Homo Sapiens; identical to SEQ ID NO: 210614

SEQ ID NO: 614958 - RNA, 64 nt, Homo Sapiens; identical to SEQ ID NO: 210615

SEQ ID NO: 614959 - RNA, 64 nt, Homo Sapiens; identical to SEQ ID NO: 210616

SEQ ID NO: 614960 - RNA, 64 nt, Homo Sapiens; identical to SEQ ID NO: 210617

SEQ ID NO: 614961 - RNA, 64 nt, Homo Sapiens; identical to SEQ ID NO: 210618

SEQ ID NO: 614962 - RNA, 64 nt, Homo Sapiens; identical to SEQ ID NO: 210619

SEQ ID NO: 614963 - RNA, 64 nt, Homo Sapiens; identical to SEQ ID NO: 210620

SEQ ID NO: 614964 - RNA, 64 nt, Homo Sapiens; identical to SEQ ID NO: 210621

SEQ ID NO: 614965 - RNA, 64 nt, Homo Sapiens; identical to SEQ ID NO: 210622

SEQ ID NO: 614966 - RNA, 64 nt, Homo Sapiens; identical to SEQ ID NO: 210623

SEQ ID NO: 614967 - RNA, 64 nt, Homo Sapiens; identical to SEQ ID NO: 210624

SEQ ID NO: 614968 - RNA, 64 nt, Homo Sapiens; identical to SEQ ID NO: 210625

SEQ ID NO: 614969 - RNA, 64 nt, Homo Sapiens; identical to SEQ ID NO: 210626

SEQ ID NO: 614970 - RNA, 64 nt, Homo Sapiens; identical to SEQ ID NO: 210627

SEQ ID NO: 614971 - RNA, 64 nt, Homo Sapiens; identical to SEQ ID NO: 210628

SEQ ID NO: 614972 - RNA, 64 nt, Homo Sapiens; identical to SEQ ID NO: 210629

SEQ ID NO: 614973 - RNA, 64 nt, Homo Sapiens; identical to SEQ ID NO: 210630

SEQ ID NO: 614974 - RNA, 64 nt, Homo Sapiens; identical to SEQ ID NO: 210631

SEQ ID NO: 614975 - RNA, 64 nt, Homo Sapiens; identical to SEQ ID NO: 210632

SEQ ID NO: 614976 - RNA, 64 nt, Homo Sapiens; identical to SEQ ID NO: 210633

SEQ ID NO: 614977 - RNA, 63 nt, Homo Sapiens; identical to SEQ ID NO: 210634

SEQ ID NO: 614978 - RNA, 64 nt, Homo Sapiens; identical to SEQ ID NO: 210635

SEQ ID NO: 614979 - RNA, 64 nt, Homo Sapiens; identical to SEQ ID NO: 210636

SEQ ID NO: 614980 - RNA, 64 nt, Homo Sapiens; identical to SEQ ID NO: 210637

SEQ ID NO: 614981 - RNA, 64 nt, Homo Sapiens; identical to SEQ ID NO: 210638

SEQ ID NO: 614982 - RNA, 64 nt, Homo Sapiens; identical to SEQ ID NO: 210639

SEQ ID NO: 614983 - RNA, 64 nt, Homo Sapiens; identical to SEQ ID NO: 210640

SEQ ID NO: 614984 - RNA, 64 nt, Homo Sapiens; identical to SEQ ID NO: 210641

SEQ ID NO: 614985 - RNA, 64 nt, Homo Sapiens; identical to SEQ ID NO: 210642

SEQ ID NO: 614986 - RNA, 64 nt, Homo Sapiens; identical to SEQ ID NO: 210643

SEQ ID NO: 614987 - RNA, 64 nt, Homo Sapiens; identical to SEQ ID NO: 210644

SEQ ID NO: 614988 - RNA, 64 nt, Homo Sapiens; identical to SEQ ID NO: 210645

SEQ ID NO: 614989 - RNA, 64 nt, Homo Sapiens; identical to SEQ ID NO: 210646

SEQ ID NO: 614990 - RNA, 64 nt, Homo Sapiens; identical to SEQ ID NO: 210647

SEQ ID NO: 614991 - RNA, 64 nt, Homo Sapiens; identical to SEQ ID NO: 210648

SEQ ID NO: 614992 - RNA, 64 nt, Homo Sapiens; identical to SEQ ID NO: 210649

SEQ ID NO: 614993 - RNA, 64 nt, Homo Sapiens; identical to SEQ ID NO: 210650

SEQ ID NO: 614994 - RNA, 64 nt, Homo Sapiens; identical to SEQ ID NO: 210651

SEQ ID NO: 614995 - RNA, 64 nt, Homo Sapiens; identical to SEQ ID NO: 210652

SEQ ID NO: 614996 - RNA, 64 nt, Homo Sapiens; identical to SEQ ID NO: 210653

SEQ ID NO: 614997 - RNA, 64 nt, Homo Sapiens; identical to SEQ ID NO: 210654

SEQ ID NO: 614998 - RNA, 64 nt, Homo Sapiens; identical to SEQ ID NO: 210655

SEQ ID NO: 614999 - RNA, 64 nt, Homo Sapiens; identical to SEQ ID NO: 210656

SEQ ID NO: 615000 - RNA, 64 nt, Homo Sapiens; identical to SEQ ID NO: 210657

SEQ ID NO: 615001 - RNA, 64 nt, Homo Sapiens; identical to SEQ ID NO: 210658

SEQ ID NO: 615002 - RNA, 64 nt, Homo Sapiens; identical to SEQ ID NO: 210659

SEQ ID NO: 615003 - RNA, 64 nt, Homo Sapiens; identical to SEQ ID NO: 210660

SEQ ID NO: 615004 - RNA, 64 nt, Homo Sapiens; identical to SEQ ID NO: 210661

SEQ ID NO: 615005 - RNA, 64 nt, Homo Sapiens; identical to SEQ ID NO: 210662

SEQ ID NO: 615006 - RNA, 64 nt, Homo Sapiens; identical to SEQ ID NO: 210663

SEQ ID NO: 615007 - RNA, 64 nt, Homo Sapiens; identical to SEQ ID NO: 210664

SEQ ID NO: 615008 - RNA, 64 nt, Homo Sapiens; identical to SEQ ID NO: 210665

SEQ ID NO: 615009 - RNA, 64 nt, Homo Sapiens; identical to SEQ ID NO: 210666

SEQ ID NO: 615010 - RNA, 64 nt, Homo Sapiens; identical to SEQ ID NO: 210667

SEQ ID NO: 615011 - RNA, 64 nt, Homo Sapiens; identical to SEQ ID NO: 210668

SEQ ID NO: 615012 - RNA, 64 nt, Homo Sapiens; identical to SEQ ID NO: 210669

SEQ ID NO: 615013 - RNA, 62 nt, Homo Sapiens; identical to SEQ ID NO: 210670

SEQ ID NO: 615014 - RNA, 64 nt, Homo Sapiens; identical to SEQ ID NO: 210671

SEQ ID NO: 615015 - RNA, 64 nt, Homo Sapiens; identical to SEQ ID NO: 210672

SEQ ID NO: 615016 - RNA, 64 nt, Homo Sapiens; identical to SEQ ID NO: 210673

SEQ ID NO: 615017 - RNA, 64 nt, Homo Sapiens; identical to SEQ ID NO: 210674

SEQ ID NO: 615018 - RNA, 64 nt, Homo Sapiens; identical to SEQ ID NO: 210675

SEQ ID NO: 615019 - RNA, 64 nt, Homo Sapiens; identical to SEQ ID NO: 210676

SEQ ID NO: 615020 - RNA, 64 nt, Homo Sapiens; identical to SEQ ID NO: 210677

SEQ ID NO: 615021 - RNA, 64 nt, Homo Sapiens; identical to SEQ ID NO: 210678

SEQ ID NO: 615022 - RNA, 64 nt, Homo Sapiens; identical to SEQ ID NO: 210679

SEQ ID NO: 615023 - RNA, 64 nt, Homo Sapiens; identical to SEQ ID NO: 210680

SEQ ID NO: 615024 - RNA, 64 nt, Homo Sapiens; identical to SEQ ID NO: 210681

SEQ ID NO: 615025 - RNA, 64 nt, Homo Sapiens; identical to SEQ ID NO: 210682

SEQ ID NO: 615026 - RNA, 64 nt, Homo Sapiens; identical to SEQ ID NO: 210683

SEQ ID NO: 615027 - RNA, 64 nt, Homo Sapiens; identical to SEQ ID NO: 210684

SEQ ID NO: 615028 - RNA, 64 nt, Homo Sapiens; identical to SEQ ID NO: 210685

SEQ ID NO: 615029 - RNA, 64 nt, Homo Sapiens; identical to SEQ ID NO: 210686

SEQ ID NO: 615030 - RNA, 64 nt, Homo Sapiens; identical to SEQ ID NO: 210687

SEQ ID NO: 615031 - RNA, 64 nt, Homo Sapiens; identical to SEQ ID NO: 210688

SEQ ID NO: 615032 - RNA, 64 nt, Homo Sapiens; identical to SEQ ID NO: 210689

SEQ ID NO: 615033 - RNA, 64 nt, Homo Sapiens; identical to SEQ ID NO: 210690

SEQ ID NO: 615034 - RNA, 64 nt, Homo Sapiens; identical to SEQ ID NO: 210691

SEQ ID NO: 615035 - RNA, 64 nt, Homo Sapiens; identical to SEQ ID NO: 210692

SEQ ID NO: 615036 - RNA, 64 nt, Homo Sapiens; identical to SEQ ID NO: 210693

SEQ ID NO: 615037 - RNA, 64 nt, Homo Sapiens; identical to SEQ ID NO: 210694

SEQ ID NO: 615038 - RNA, 64 nt, Homo Sapiens; identical to SEQ ID NO: 210695

SEQ ID NO: 615039 - RNA, 64 nt, Homo Sapiens; identical to SEQ ID NO: 210696

SEQ ID NO: 615040 - RNA, 64 nt, Homo Sapiens; identical to SEQ ID NO: 210697

SEQ ID NO: 615041 - RNA, 64 nt, Homo Sapiens; identical to SEQ ID NO: 210698

SEQ ID NO: 615042 - RNA, 64 nt, Homo Sapiens; identical to SEQ ID NO: 210699

SEQ ID NO: 615043 - RNA, 64 nt, Homo Sapiens; identical to SEQ ID NO: 210700

SEQ ID NO: 615044 - RNA, 64 nt, Homo Sapiens; identical to SEQ ID NO: 210701

SEQ ID NO: 615045 - RNA, 64 nt, Homo Sapiens; identical to SEQ ID NO: 210702

SEQ ID NO: 615046 - RNA, 64 nt, Homo Sapiens; identical to SEQ ID NO: 210703

SEQ ID NO: 615047 - RNA, 64 nt, Homo Sapiens; identical to SEQ ID NO: 210704

SEQ ID NO: 615048 - RNA, 64 nt, Homo Sapiens; identical to SEQ ID NO: 210705

SEQ ID NO: 615049 - RNA, 64 nt, Homo Sapiens; identical to SEQ ID NO: 210706

SEQ ID NO: 615050 - RNA, 64 nt, Homo Sapiens; identical to SEQ ID NO: 210707

SEQ ID NO: 615051 - RNA, 64 nt, Homo Sapiens; identical to SEQ ID NO: 210708

SEQ ID NO: 615052 - RNA, 64 nt, Homo Sapiens; identical to SEQ ID NO: 210709

SEQ ID NO: 615053 - RNA, 64 nt, Homo Sapiens; identical to SEQ ID NO: 210710

SEQ ID NO: 615054 - RNA, 64 nt, Homo Sapiens; identical to SEQ ID NO: 210711

SEQ ID NO: 615055 - RNA, 64 nt, Homo Sapiens; identical to SEQ ID NO: 210712

SEQ ID NO: 615056 - RNA, 64 nt, Homo Sapiens; identical to SEQ ID NO: 210713

SEQ ID NO: 615057 - RNA, 64 nt, Homo Sapiens; identical to SEQ ID NO: 210714

SEQ ID NO: 615058 - RNA, 64 nt, Homo Sapiens; identical to SEQ ID NO: 210715

SEQ ID NO: 615059 - RNA, 64 nt, Homo Sapiens; identical to SEQ ID NO: 210716

SEQ ID NO: 615060 - RNA, 64 nt, Homo Sapiens; identical to SEQ ID NO: 210717

SEQ ID NO: 615061 - RNA, 64 nt, Homo Sapiens; identical to SEQ ID NO: 210718

SEQ ID NO: 615062 - RNA, 64 nt, Homo Sapiens; identical to SEQ ID NO: 210719

SEQ ID NO: 615063 - RNA, 64 nt, Homo Sapiens; identical to SEQ ID NO: 210720

SEQ ID NO: 615064 - RNA, 64 nt, Homo Sapiens; identical to SEQ ID NO: 210721

SEQ ID NO: 615065 - RNA, 64 nt, Homo Sapiens; identical to SEQ ID NO: 210722

SEQ ID NO: 615066 - RNA, 64 nt, Homo Sapiens; identical to SEQ ID NO: 210723

SEQ ID NO: 615067 - RNA, 64 nt, Homo Sapiens; identical to SEQ ID NO: 210724

SEQ ID NO: 615068 - RNA, 64 nt, Homo Sapiens; identical to SEQ ID NO: 210725

SEQ ID NO: 615069 - RNA, 64 nt, Homo Sapiens; identical to SEQ ID NO: 210726

SEQ ID NO: 615070 - RNA, 64 nt, Homo Sapiens; identical to SEQ ID NO: 210727

SEQ ID NO: 615071 - RNA, 64 nt, Homo Sapiens; identical to SEQ ID NO: 351043

SEQ ID NO: 615072 - RNA, 64 nt, Homo Sapiens; identical to SEQ ID NO: 351044

SEQ ID NO: 615073 - RNA, 64 nt, Homo Sapiens; identical to SEQ ID NO: 351045

SEQ ID NO: 615074 - RNA, 64 nt, Homo Sapiens; identical to SEQ ID NO: 351046

SEQ ID NO: 615075 - RNA, 64 nt, Homo Sapiens; identical to SEQ ID NO: 351047

SEQ ID NO: 615076 - RNA, 64 nt, Homo Sapiens; identical to SEQ ID NO: 351048

SEQ ID NO: 615077 - RNA, 64 nt, Homo Sapiens; identical to SEQ ID NO: 351049

SEQ ID NO: 615078 - RNA, 64 nt, Homo Sapiens; identical to SEQ ID NO: 351050

SEQ ID NO: 615079 - RNA, 64 nt, Homo Sapiens; identical to SEQ ID NO: 351051

SEQ ID NO: 615080 - RNA, 64 nt, Homo Sapiens; identical to SEQ ID NO: 351052

SEQ ID NO: 615081 - RNA, 64 nt, Homo Sapiens; identical to SEQ ID NO: 351053

SEQ ID NO: 615082 - RNA, 64 nt, Homo Sapiens; identical to SEQ ID NO: 351054

SEQ ID NO: 615083 - RNA, 64 nt, Homo Sapiens; identical to SEQ ID NO: 351055

SEQ ID NO: 615084 - RNA, 50 nt, Homo Sapiens; identical to SEQ ID NO: 351056

SEQ ID NO: 615085 - RNA, 64 nt, Homo Sapiens; identical to SEQ ID NO: 351057

SEQ ID NO: 615086 - RNA, 64 nt, Homo Sapiens; identical to SEQ ID NO: 351058

SEQ ID NO: 615087 - RNA, 64 nt, Homo Sapiens; identical to SEQ ID NO: 351059

SEQ ID NO: 615088 - RNA, 64 nt, Homo Sapiens; identical to SEQ ID NO: 351060

SEQ ID NO: 615089 - RNA, 64 nt, Homo Sapiens; identical to SEQ ID NO: 351061

SEQ ID NO: 615090 - RNA, 64 nt, Homo Sapiens; identical to SEQ ID NO: 351062

SEQ ID NO: 615091 - RNA, 64 nt, Homo Sapiens; identical to SEQ ID NO: 351063

SEQ ID NO: 615092 - RNA, 64 nt, Homo Sapiens; identical to SEQ ID NO: 351064

SEQ ID NO: 615093 - RNA, 64 nt, Homo Sapiens
uaagguacuucucccucagggacguagaacaauggaaugucagucagucucuguaguuaaaacu

SEQ ID NO: 615094 - RNA, 64 nt, Homo Sapiens; identical to SEQ ID NO: 615093

SEQ ID NO: 615095 - RNA, 64 nt, Homo Sapiens
cugcaguuuacaauuuuuguucuucuccuguaaagaaugucaaugguuaucaccuucaauaguu

SEQ ID NO: 615096 - RNA, 64 nt, Homo Sapiens
acuuuaucagcagggguaaauuaggaacuauuaggaaugucagguaggguuuuuuauuugcagu

SEQ ID NO: 615097 - RNA, 64 nt, Homo Sapiens
cuagccacagagucugagauaagccacagcauaagaaugucagcauauuuauuaggcuauuuca

SEQ ID NO: 615098 - RNA, 62 nt, Homo Sapiens
aaaaaaaggaauuagcuagauugagauagguuuagaaugucaaugugcuucugaaauauauu

SEQ ID NO: 615099 - RNA, 64 nt, Homo Sapiens
uaaaaaggaauuagcuagaagucugccauugacagaaugucaaaggcgauguuggcugauuugg

SEQ ID NO: 615100 - RNA, 64 nt, Homo Sapiens
aaugaagcagaauuuaaguugguaauauuaaggugaaugucauuuaagggaguuacaucuuuau

SEQ ID NO: 615101 - RNA, 64 nt, Homo Sapiens
accuuacuuuuccucauucuuaauaggugucuaagaaugucagggcaaaaguaugggcauuuuu

SEQ ID NO: 615102 - RNA, 64 nt, Homo Sapiens
agagauuuuuuaguacaggcagggaaugaaacaggaaugucaucuauuuucuaaaucauuuuua

SEQ ID NO: 615103 - RNA, 64 nt, Homo Sapiens
accaaauaacuucacagcuaugcucaguuccacagaaugucaggauucuauggacccaagucua

SEQ ID NO: 615104 - RNA, 64 nt, Homo Sapiens
aauuauucagauaauuaacacaaauaaccugggagaaugucauaagcccuccaaagauaccauu

SEQ ID NO: 615105 - RNA, 64 nt, Homo Sapiens
aggaccuuccuuuagcuguauguauucuuucaaugaaugucaguucguggguauuaggaaagcc

SEQ ID NO: 615106 - RNA, 64 nt, Homo Sapiens
auguguacaaacugcagugcaaucuacuguuggugaaugucaguguauuaucaggaaacauguc

SEQ ID NO: 615107 - RNA, 64 nt, Homo Sapiens
uauggauuaaaucacauacuggcauauuuaagcugaaugucaaucuggaaaauaaauugacugu

SEQ ID NO: 615108 - RNA, 64 nt, Homo Sapiens
cuggaaaauaaauugacuguggcauauuuaagcugaaugucaauuguggauuaaaucacauacu

SEQ ID NO: 615109 - RNA, 64 nt, Homo Sapiens
guauuaucaggaaacaugucaaucuacuguuggugaaugucaguauguguacaaacugcagugc

SEQ ID NO: 615110 - RNA, 64 nt, Homo Sapiens
aauguaggaaggccuuuagggugagaaacccuuugaaugucaggacaccagagaauucacacug

SEQ ID NO: 615111 - RNA, 64 nt, Homo Sapiens
aaugcagcaaggccuuuaagaaugagaaaccuaugaaugucaggaacacuauagaacucauacu

SEQ ID NO: 615112 - RNA, 64 nt, Homo Sapiens
agagccaaggaguagugaguuguagauaaaaaaagaaugucagcuuuggagacagucuggguuu

SEQ ID NO: 615113 - RNA, 64 nt, Homo Sapiens
cacaugaaauaccaaaugucacagcauuauuacugaaugucagucauuuccccuacuugaucug

SEQ ID NO: 615114 - RNA, 64 nt, Homo Sapiens
aauugauucuuagugacacagaagauugccuuacgcucgugagcgugagaagccauaagagaga

SEQ ID NO: 615115 - RNA, 64 nt, Homo Sapiens
gcacgguuuacgccacaaaagaauagaacucguagcucgugacuggcccugggacaaagaccca

SEQ ID NO: 615116 - RNA, 64 nt, Homo Sapiens
gagccuugccgcacugccuuguggguggcuuggcgcucgugauugcuuccugugaacgccuccc

SEQ ID NO: 615117 - RNA, 64 nt, Homo Sapiens
cuaauuguaaacuuucagguuacauagcucuuuggcucgugaacaugugcuuugcuucauucug

SEQ ID NO: 615118 - RNA, 64 nt, Homo Sapiens
acacucagugcccagcccaggacacccuucaugggcucgugagcucaacaucaagcugggguuu

SEQ ID NO: 615119 - RNA, 64 nt, Homo Sapiens
aaaaaugcuguugaaauaaagaaaacuaauguuagcucgugaaaguuaaaacaaaucacaaaag

SEQ ID NO: 615120 - RNA, 64 nt, Homo Sapiens
agcaccuuugaaauguacguggaaaacgucggcugcucgugagaaucaugugugacuuacguuc

SEQ ID NO: 615121 - RNA, 64 nt, Homo Sapiens
ugggaagaaguuuccgcuggggagagaagggagagcucgugagaugcgaguguuugggggccac

SEQ ID NO: 615122 - RNA, 64 nt, Homo Sapiens
ccgaguggacagcccagggugcagcucugcccgggcucgugaagccucagauguccccaaucca

SEQ ID NO: 615123 - RNA, 64 nt, Homo Sapiens
cauucuuucuggaccuuaaaugguagaggaaaaggcucgugagccauuuguuucuuuugcuggu

SEQ ID NO: 615124 - RNA, 64 nt, Homo Sapiens
ugugcucaagccaguuguggaaggccuggggggugcucgugauacugggggccggagggcaggc

SEQ ID NO: 615125 - RNA, 64 nt, Homo Sapiens
ggccaguuuugugcagcugaaaguuucgcugggugcucgugacuguccugccagagcauggaug

SEQ ID NO: 615126 - RNA, 64 nt, Homo Sapiens
aaaaaaagcagaaagaauuagaguucuaagcagugcucgugaaaaaguuugaucccaggaacuu

SEQ ID NO: 615127 - RNA, 64 nt, Homo Sapiens
aaggauacaccaaagcccuucuuccuggcccagcgcucgugacccuuggcucucaggaacucug

SEQ ID NO: 615128 - RNA, 64 nt, Homo Sapiens
ugugcccagccaggccuccagcacccccagugcagcucgugauuggaaacucaccaucggcagg

SEQ ID NO: 615129 - RNA, 64 nt, Homo Sapiens
agugccuucacacagaccccgcggcaguauugaagcucgugacaaguucucccauccugggacg

SEQ ID NO: 615130 - RNA, 64 nt, Homo Sapiens
cacccgcuccacccuuuuuaaaccccccagcccugcucgugagauugggcuggguagggacaga

SEQ ID NO: 615131 - RNA, 64 nt, Homo Sapiens
ggagauccagcccugccuggcagagagccgggcugcucgugagaaagagagcuucaaccucaag

SEQ ID NO: 615132 - RNA, 64 nt, Homo Sapiens
gccgugaucaagggaauguaacugcugaaaacuagcucgugauuggcauauaauggaguuaacg

SEQ ID NO: 615133 - RNA, 64 nt, Homo Sapiens
caccucccuccccuggggccgccaccccuucugggcucgugaugguggagcuaagguccaggcc

SEQ ID NO: 615134 - RNA, 64 nt, Homo Sapiens
uaaucacuccaguuugcuuucuagguccucaagugcucgugacacauaaucauuccauccaaug

SEQ ID NO: 615135 - RNA, 64 nt, Homo Sapiens
ccgagccucgccagacccccagggggccucugacgcucgugaccaccaccucccucaaaccuug

SEQ ID NO: 615136 - RNA, 64 nt, Homo Sapiens
gcugaagagggaagacccaaggcuggguggcguggcucgugaauccacuuagaauucuuggcuu

SEQ ID NO: 615137 - RNA, 64 nt, Homo Sapiens
aggaaaaucagaggagccacuuggcacaugugcugcucgugagcccagcacaagagccgugagc

SEQ ID NO: 615138 - RNA, 64 nt, Homo Sapiens
ugcccgccucggccucccaaucuugaucuccugagcucgugauccaccguauuagccaggaugg

SEQ ID NO: 615139 - RNA, 64 nt, Homo Sapiens
acaggaguuugugugcaacagaguccuguagcuagcucgugacuacauugaaacuugaguuugu

SEQ ID NO: 615140 - RNA, 64 nt, Homo Sapiens
ugccggcuucucaucgucagggagcccgcccagagcucgugacgagcaagugcuggguccccgc

SEQ ID NO: 615141 - RNA, 64 nt, Homo Sapiens
augaaucucuacacucacuggaguccugcauggggcucgugagggcuccaggcugacaccagca

SEQ ID NO: 615142 - RNA, 64 nt, Homo Sapiens
caaaaaagucaagaaccacauaaauuucaaaugggcucgugaccgauaguccauaauguucugc

SEQ ID NO: 615143 - RNA, 64 nt, Homo Sapiens
gauuuaaauugaagugacaaauuaagaaauuuucauaauggaaugaagaaauagucucccuuca

SEQ ID NO: 615144 - RNA, 64 nt, Homo Sapiens
uauacagcgaagagacaaucuguagcccagcuugauaauggaaccuaguuagcugucuguuguc

SEQ ID NO: 615145 - RNA, 64 nt, Homo Sapiens
aguaugguuuaauguguccaaaugaauuaacuacauaauggaaauggcaggcaggcacucaaga

SEQ ID NO: 615146 - RNA, 64 nt, Homo Sapiens
cggacaaaaaaaaucaaguguaugaauaaacuugauaauggaaauuauuaauaucaaauucacu

SEQ ID NO: 615147 - RNA, 64 nt, Homo Sapiens
accucuuccaacccuccauuagcucaauuuugagauaauggaaaauugacuggaaauucaaaac

SEQ ID NO: 615148 - RNA, 64 nt, Homo Sapiens
uuucaguauuuugagaauugccauauuaauuuuuauaauggaaaacuuaauaaauugcuacugu

SEQ ID NO: 615149 - RNA, 64 nt, Homo Sapiens
agaauauaaauuacaaacacaaauuagagaauccauaauggacuuaaauucucaauuucacuuc

SEQ ID NO: 615150 - RNA, 64 nt, Homo Sapiens
acagauuuuucaucauaucauuaauuuuauaaauauaauggaaaauuugcaaugacacaugaau

SEQ ID NO: 615151 - RNA, 64 nt, Homo Sapiens
uuuuuuuuuuagauaauguuguauaaauauguagauaauggauugugccuuaucugaguuuucg

SEQ ID NO: 615152 - RNA, 64 nt, Homo Sapiens
auucuuuuacauauuguuuagguguaaauuuguaauaauggauacauguacagaaagaauuuuu

SEQ ID NO: 615153 - RNA, 64 nt, Homo Sapiens
caggcuuuuggacuuuguauuaccuguauguuuuauaauggaucaugcauaauuucucaggaga

SEQ ID NO: 615154 - RNA, 64 nt, Homo Sapiens
augaguugggaaaagagguggcauuucugaucggauaauggaauacucucauuuauuuuaugac

SEQ ID NO: 615155 - RNA, 64 nt, Homo Sapiens
agaccuguacuaauauaugggcuaaaugugggaaauaauggacuaaaagaaagcaauuacuacu

SEQ ID NO: 615156 - RNA, 64 nt, Homo Sapiens
uaggcaugauucucuguacauaacacauaaugaaauaauggaucauauuagaaaaacuauugug

SEQ ID NO: 615157 - RNA, 64 nt, Homo Sapiens
ucacgacgccagugggugcuucaacauuagcaagauaauggaaauuaaugugacuuaggugcug

SEQ ID NO: 615158 - RNA, 64 nt, Homo Sapiens
uaacuccuaagcgguggggugugcuugguuguguauaauggagcuccuggugaguguuucuccu

SEQ ID NO: 615159 - RNA, 64 nt, Homo Sapiens
gugacugugaagccugcuguucccugaaaaucugauaauggagcaguggagguuuuuuucuuuc

SEQ ID NO: 615160 - RNA, 64 nt, Homo Sapiens
uccccauccuugcuaugccuuucuguccucuuuuauaauggauauaucuuuuuccugccauuau

SEQ ID NO: 615161 - RNA, 64 nt, Homo Sapiens; identical to SEQ ID NO: 264240

SEQ ID NO: 615162 - RNA, 64 nt, Homo Sapiens; identical to SEQ ID NO: 264241

SEQ ID NO: 615163 - RNA, 64 nt, Homo Sapiens; identical to SEQ ID NO: 264242

SEQ ID NO: 615164 - RNA, 64 nt, Homo Sapiens; identical to SEQ ID NO: 264243

SEQ ID NO: 615165 - RNA, 64 nt, Homo Sapiens; identical to SEQ ID NO: 264244

SEQ ID NO: 615166 - RNA, 64 nt, Homo Sapiens; identical to SEQ ID NO: 264245

SEQ ID NO: 615167 - RNA, 64 nt, Homo Sapiens; identical to SEQ ID NO: 264246

SEQ ID NO: 615168 - RNA, 64 nt, Homo Sapiens; identical to SEQ ID NO: 264247

SEQ ID NO: 615169 - RNA, 64 nt, Homo Sapiens; identical to SEQ ID NO: 264248

SEQ ID NO: 615170 - RNA, 64 nt, Homo Sapiens; identical to SEQ ID NO: 264249

SEQ ID NO: 615171 - RNA, 64 nt, Homo Sapiens; identical to SEQ ID NO: 264250

SEQ ID NO: 615172 - RNA, 64 nt, Homo Sapiens; identical to SEQ ID NO: 264251

SEQ ID NO: 615173 - RNA, 64 nt, Homo Sapiens; identical to SEQ ID NO: 264252

SEQ ID NO: 615174 - RNA, 64 nt, Homo Sapiens; identical to SEQ ID NO: 264253

SEQ ID NO: 615175 - RNA, 64 nt, Homo Sapiens; identical to SEQ ID NO: 264254

SEQ ID NO: 615176 - RNA, 64 nt, Homo Sapiens; identical to SEQ ID NO: 264255

SEQ ID NO: 615177 - RNA, 50 nt, Homo Sapiens; identical to SEQ ID NO: 264256

SEQ ID NO: 615178 - RNA, 64 nt, Homo Sapiens; identical to SEQ ID NO: 264257

SEQ ID NO: 615179 - RNA, 64 nt, Homo Sapiens; identical to SEQ ID NO: 264258

SEQ ID NO: 615180 - RNA, 64 nt, Homo Sapiens; identical to SEQ ID NO: 264259

SEQ ID NO: 615181 - RNA, 64 nt, Homo Sapiens; identical to SEQ ID NO: 264260

SEQ ID NO: 615182 - RNA, 64 nt, Homo Sapiens; identical to SEQ ID NO: 264261

SEQ ID NO: 615183 - RNA, 64 nt, Homo Sapiens; identical to SEQ ID NO: 264262

SEQ ID NO: 615184 - RNA, 64 nt, Homo Sapiens; identical to SEQ ID NO: 264263

SEQ ID NO: 615185 - RNA, 64 nt, Homo Sapiens; identical to SEQ ID NO: 264264

SEQ ID NO: 615186 - RNA, 64 nt, Homo Sapiens; identical to SEQ ID NO: 264265

SEQ ID NO: 615187 - RNA, 64 nt, Homo Sapiens; identical to SEQ ID NO: 264266

SEQ ID NO: 615188 - RNA, 64 nt, Homo Sapiens; identical to SEQ ID NO: 264267

SEQ ID NO: 615189 - RNA, 64 nt, Homo Sapiens; identical to SEQ ID NO: 264268

SEQ ID NO: 615190 - RNA, 64 nt, Homo Sapiens; identical to SEQ ID NO: 264269

SEQ ID NO: 615191 - RNA, 64 nt, Homo Sapiens; identical to SEQ ID NO: 264270

SEQ ID NO: 615192 - RNA, 64 nt, Homo Sapiens; identical to SEQ ID NO: 264271

SEQ ID NO: 615193 - RNA, 64 nt, Homo Sapiens; identical to SEQ ID NO: 264272

SEQ ID NO: 615194 - RNA, 64 nt, Homo Sapiens; identical to SEQ ID NO: 264273

SEQ ID NO: 615195 - RNA, 64 nt, Homo Sapiens; identical to SEQ ID NO: 112183

SEQ ID NO: 615196 - RNA, 64 nt, Homo Sapiens; identical to SEQ ID NO: 112184

SEQ ID NO: 615197 - RNA, 64 nt, Homo Sapiens; identical to SEQ ID NO: 112185

SEQ ID NO: 615198 - RNA, 64 nt, Homo Sapiens; identical to SEQ ID NO: 112186

SEQ ID NO: 615199 - RNA, 64 nt, Homo Sapiens; identical to SEQ ID NO: 112187

SEQ ID NO: 615200 - RNA, 64 nt, Homo Sapiens; identical to SEQ ID NO: 112188

SEQ ID NO: 615201 - RNA, 64 nt, Homo Sapiens; identical to SEQ ID NO: 112189

SEQ ID NO: 615202 - RNA, 64 nt, Homo Sapiens; identical to SEQ ID NO: 112190

SEQ ID NO: 615203 - RNA, 64 nt, Homo Sapiens; identical to SEQ ID NO: 112191

SEQ ID NO: 615204 - RNA, 64 nt, Homo Sapiens; identical to SEQ ID NO: 112192

SEQ ID NO: 615205 - RNA, 64 nt, Homo Sapiens; identical to SEQ ID NO: 112193

SEQ ID NO: 615206 - RNA, 64 nt, Homo Sapiens; identical to SEQ ID NO: 112194

SEQ ID NO: 615207 - RNA, 64 nt, Homo Sapiens; identical to SEQ ID NO: 112195

SEQ ID NO: 615208 - RNA, 64 nt, Homo Sapiens; identical to SEQ ID NO: 112196

SEQ ID NO: 615209 - RNA, 64 nt, Homo Sapiens; identical to SEQ ID NO: 112197

SEQ ID NO: 615210 - RNA, 64 nt, Homo Sapiens; identical to SEQ ID NO: 112198

SEQ ID NO: 615211 - RNA, 64 nt, Homo Sapiens; identical to SEQ ID NO: 112199

SEQ ID NO: 615212 - RNA, 64 nt, Homo Sapiens; identical to SEQ ID NO: 112200

SEQ ID NO: 615213 - RNA, 64 nt, Homo Sapiens; identical to SEQ ID NO: 112201

SEQ ID NO: 615214 - RNA, 64 nt, Homo Sapiens; identical to SEQ ID NO: 112202

SEQ ID NO: 615215 - RNA, 64 nt, Homo Sapiens; identical to SEQ ID NO: 112203

SEQ ID NO: 615216 - RNA, 64 nt, Homo Sapiens; identical to SEQ ID NO: 112204

SEQ ID NO: 615217 - RNA, 64 nt, Homo Sapiens; identical to SEQ ID NO: 112205

SEQ ID NO: 615218 - RNA, 64 nt, Homo Sapiens; identical to SEQ ID NO: 112206

SEQ ID NO: 615219 - RNA, 64 nt, Homo Sapiens; identical to SEQ ID NO: 112207

SEQ ID NO: 615220 - RNA, 64 nt, Homo Sapiens; identical to SEQ ID NO: 112208

SEQ ID NO: 615221 - RNA, 64 nt, Homo Sapiens; identical to SEQ ID NO: 112209

SEQ ID NO: 615222 - RNA, 64 nt, Homo Sapiens; identical to SEQ ID NO: 112210

SEQ ID NO: 615223 - RNA, 64 nt, Homo Sapiens; identical to SEQ ID NO: 112211

SEQ ID NO: 615224 - RNA, 64 nt, Homo Sapiens; identical to SEQ ID NO: 112212

SEQ ID NO: 615225 - RNA, 64 nt, Homo Sapiens; identical to SEQ ID NO: 112213

SEQ ID NO: 615226 - RNA, 64 nt, Homo Sapiens; identical to SEQ ID NO: 112214

SEQ ID NO: 615227 - RNA, 64 nt, Homo Sapiens; identical to SEQ ID NO: 112215

SEQ ID NO: 615228 - RNA, 64 nt, Homo Sapiens; identical to SEQ ID NO: 112216

SEQ ID NO: 615229 - RNA, 64 nt, Homo Sapiens; identical to SEQ ID NO: 112217

SEQ ID NO: 615230 - RNA, 64 nt, Homo Sapiens; identical to SEQ ID NO: 112218

SEQ ID NO: 615231 - RNA, 64 nt, Homo Sapiens; identical to SEQ ID NO: 112219

SEQ ID NO: 615232 - RNA, 64 nt, Homo Sapiens; identical to SEQ ID NO: 112220

SEQ ID NO: 615233 - RNA, 64 nt, Homo Sapiens; identical to SEQ ID NO: 112221

SEQ ID NO: 615234 - RNA, 64 nt, Homo Sapiens; identical to SEQ ID NO: 112222

SEQ ID NO: 615235 - RNA, 64 nt, Homo Sapiens; identical to SEQ ID NO: 112223

SEQ ID NO: 615236 - RNA, 64 nt, Homo Sapiens; identical to SEQ ID NO: 112224

SEQ ID NO: 615237 - RNA, 64 nt, Homo Sapiens; identical to SEQ ID NO: 112225

SEQ ID NO: 615238 - RNA, 64 nt, Homo Sapiens; identical to SEQ ID NO: 112226

SEQ ID NO: 615239 - RNA, 64 nt, Homo Sapiens; identical to SEQ ID NO: 112227

SEQ ID NO: 615240 - RNA, 64 nt, Homo Sapiens; identical to SEQ ID NO: 112228

SEQ ID NO: 615241 - RNA, 64 nt, Homo Sapiens; identical to SEQ ID NO: 112229

SEQ ID NO: 615242 - RNA, 64 nt, Homo Sapiens; identical to SEQ ID NO: 532503

SEQ ID NO: 615243 - RNA, 64 nt, Homo Sapiens; identical to SEQ ID NO: 532504

SEQ ID NO: 615244 - RNA, 64 nt, Homo Sapiens; identical to SEQ ID NO: 532505

SEQ ID NO: 615245 - RNA, 64 nt, Homo Sapiens; identical to SEQ ID NO: 532506

SEQ ID NO: 615246 - RNA, 64 nt, Homo Sapiens; identical to SEQ ID NO: 532507

SEQ ID NO: 615247 - RNA, 64 nt, Homo Sapiens; identical to SEQ ID NO: 532508

SEQ ID NO: 615248 - RNA, 64 nt, Homo Sapiens; identical to SEQ ID NO: 532509

SEQ ID NO: 615249 - RNA, 64 nt, Homo Sapiens; identical to SEQ ID NO: 532510

SEQ ID NO: 615250 - RNA, 64 nt, Homo Sapiens; identical to SEQ ID NO: 532511

SEQ ID NO: 615251 - RNA, 54 nt, Homo Sapiens; identical to SEQ ID NO: 532512

SEQ ID NO: 615252 - RNA, 61 nt, Homo Sapiens; identical to SEQ ID NO: 532513

SEQ ID NO: 615253 - RNA, 64 nt, Homo Sapiens; identical to SEQ ID NO: 532514

SEQ ID NO: 615254 - RNA, 64 nt, Homo Sapiens; identical to SEQ ID NO: 532515

SEQ ID NO: 615255 - RNA, 64 nt, Homo Sapiens; identical to SEQ ID NO: 532516

SEQ ID NO: 615256 - RNA, 64 nt, Homo Sapiens; identical to SEQ ID NO: 378074

SEQ ID NO: 615257 - RNA, 64 nt, Homo Sapiens; identical to SEQ ID NO: 378075

SEQ ID NO: 615258 - RNA, 64 nt, Homo Sapiens; identical to SEQ ID NO: 378076

SEQ ID NO: 615259 - RNA, 64 nt, Homo Sapiens; identical to SEQ ID NO: 378077

SEQ ID NO: 615260 - RNA, 64 nt, Homo Sapiens; identical to SEQ ID NO: 378078

SEQ ID NO: 615261 - RNA, 64 nt, Homo Sapiens; identical to SEQ ID NO: 378079

SEQ ID NO: 615262 - RNA, 64 nt, Homo Sapiens
auguuuuaauaaucuguauuucuuauaauuuuaacacuaugagcugccuguauaagaaaucaag

SEQ ID NO: 615263 - RNA, 64 nt, Homo Sapiens
aacucacccccuuauuuaaaugugugcuaugacccacuaugaccacagcaucugcauuuucuaa

SEQ ID NO: 615264 - RNA, 64 nt, Homo Sapiens
guuacccuguauuagaccgucuucucaaguucuccacuaugagacucaauuugaaguacuaaug

SEQ ID NO: 615265 - RNA, 64 nt, Homo Sapiens
gcugacagaagaguguuuucgcaaccucccagcucacuaugaacagcuaggucuuaaugcguag

SEQ ID NO: 615266 - RNA, 64 nt, Homo Sapiens; identical to SEQ ID NO: 166152

SEQ ID NO: 615267 - RNA, 64 nt, Homo Sapiens; identical to SEQ ID NO: 166153

SEQ ID NO: 615268 - RNA, 64 nt, Homo Sapiens; identical to SEQ ID NO: 166154

SEQ ID NO: 615269 - RNA, 64 nt, Homo Sapiens; identical to SEQ ID NO: 166155

SEQ ID NO: 615270 - RNA, 64 nt, Homo Sapiens; identical to SEQ ID NO: 166156

SEQ ID NO: 615271 - RNA, 64 nt, Homo Sapiens; identical to SEQ ID NO: 166157

SEQ ID NO: 615272 - RNA, 64 nt, Homo Sapiens; identical to SEQ ID NO: 166158

SEQ ID NO: 615273 - RNA, 64 nt, Homo Sapiens; identical to SEQ ID NO: 166159

SEQ ID NO: 615274 - RNA, 64 nt, Homo Sapiens; identical to SEQ ID NO: 166160

SEQ ID NO: 615275 - RNA, 61 nt, Homo Sapiens; identical to SEQ ID NO: 166161

SEQ ID NO: 615276 - RNA, 64 nt, Homo Sapiens; identical to SEQ ID NO: 166162

SEQ ID NO: 615277 - RNA, 64 nt, Homo Sapiens; identical to SEQ ID NO: 166163

SEQ ID NO: 615278 - RNA, 64 nt, Homo Sapiens; identical to SEQ ID NO: 166164

SEQ ID NO: 615279 - RNA, 64 nt, Homo Sapiens; identical to SEQ ID NO: 166165

SEQ ID NO: 615280 - RNA, 64 nt, Homo Sapiens; identical to SEQ ID NO: 166166

SEQ ID NO: 615281 - RNA, 64 nt, Homo Sapiens; identical to SEQ ID NO: 166167

SEQ ID NO: 615282 - RNA, 64 nt, Homo Sapiens; identical to SEQ ID NO: 166168

SEQ ID NO: 615283 - RNA, 53 nt, Homo Sapiens
ugucuuucuaggaauauuaguuagagacugauuaucucaugugagccaggaca

SEQ ID NO: 615284 - RNA, 64 nt, Homo Sapiens
gauuagauuggaucucccaaguuuuaauugaaaggagacugaacgaaaaccuuucugcuuucug

SEQ ID NO: 615285 - RNA, 64 nt, Homo Sapiens
cccuuaucucuucauauucucgaagggagagacugagacugacuuggagcuaagcucaggagcc

SEQ ID NO: 615286 - RNA, 64 nt, Homo Sapiens
cugacucccuuaucucuucaggagcccgaagggagagacugagauuccccuggagcuaagcuca

SEQ ID NO: 615287 - RNA, 64 nt, Homo Sapiens
uuggguugguugugaugagcugucucuuccucuggagacugaacgagaguaagacaugcucugc

SEQ ID NO: 615288 - RNA, 64 nt, Homo Sapiens
caggagaaucgcuugaaccuucccagcuacuugggagacugagggugguggcgggcaccuguaa

SEQ ID NO: 615289 - RNA, 64 nt, Homo Sapiens
ugggagaaucgcuugagacuucccagcuacucuggagacugagggugauggcacgugucuguaa

SEQ ID NO: 615290 - RNA, 64 nt, Homo Sapiens
uaauaauucucucuuuccucccaaggaaacaggagagacugaaucucauuucauuauguuucuu

SEQ ID NO: 615291 - RNA, 64 nt, Homo Sapiens
ugggugcacuggccaugcccggcccugcauguuggagacugagcuuucugcccugccccaccag

SEQ ID NO: 615292 - RNA, 62 nt, Homo Sapiens
cauguacccacucacagugaugccagcaagaagagacugauugaggauacugaagacuggcg

SEQ ID NO: 615293 - RNA, 64 nt, Homo Sapiens
uguuuuucacuuggaggauggugaacccuacugugagacugauuauuaugcccucuuugguacu

SEQ ID NO: 615294 - RNA, 64 nt, Homo Sapiens
gguuuacgggcugugaauggcacccccgaucccugagacugaggucucccagucccacuaccag

SEQ ID NO: 615295 - RNA, 64 nt, Homo Sapiens
gacacggcacaaaucucaauuggcagggguaccagagacugaaagcaugcccucaacucuugcu

SEQ ID NO: 615296 - RNA, 64 nt, Homo Sapiens
gggccacuggcugcuggggacuggggacugggcagagacugagccaggcaggaaggcagcagcc

SEQ ID NO: 615297 - RNA, 64 nt, Homo Sapiens
ucucugccucacccgcuucagcccagggccccuggagacugauccccucugaguccucugcccc

SEQ ID NO: 615298 - RNA, 64 nt, Homo Sapiens
acccuccuucuucuuccuaaagcccucugggucagagacugacaucuguuauaaauggagcuuc

SEQ ID NO: 615299 - RNA, 64 nt, Homo Sapiens
ugcguguucguauuuuuccaggaauucagguuuugagacugagaccugccgccuaagcuuuacu

SEQ ID NO: 615300 - RNA, 64 nt, Homo Sapiens
cgguaaaugggcgaaauccaggccaggagccucagagacugaagcagaacagaguaagacucau

SEQ ID NO: 615301 - RNA, 64 nt, Homo Sapiens
acaaccucgucaucauccccacuuuaaaccccaggagacugaaacucaaacaacccugggcaag

SEQ ID NO: 615302 - RNA, 64 nt, Homo Sapiens
aagaaucaaaggcagagaaguguugaggcaucuggagacugagauucuuggccugagcuaugcc

SEQ ID NO: 615303 - RNA, 64 nt, Homo Sapiens
accaguaguaccugcaggguggguggaguggggggagacugaggagcagcugcaagccucgcaa

SEQ ID NO: 615304 - RNA, 64 nt, Homo Sapiens
gcaugugauggcucaggcugcagggggagguuaggagacugauaccaagcccugucuuaaggcc

SEQ ID NO: 615305 - RNA, 64 nt, Homo Sapiens
cccugaccaauucaccugauagucaggcucgagggagacugaucauggggcugucccagccgua

SEQ ID NO: 615306 - RNA, 64 nt, Homo Sapiens
ucuggucaccuguucauucccucggagggggccagagacugagcaagcacagaggcuccccgga

SEQ ID NO: 615307 - RNA, 64 nt, Homo Sapiens
agaaugauagagagugaagcauugaaugaguauugagacugaggagacaaggccagagggugcg

SEQ ID NO: 615308 - RNA, 64 nt, Homo Sapiens
caacccacgaggaccaucgggggcagagucguuggagacugaagaggaagaggaggaggagaag

SEQ ID NO: 615309 - RNA, 64 nt, Homo Sapiens
cggaggguccagacuguccacucggggguggagugagacugacugcaagccccacccuccuuga

SEQ ID NO: 615310 - RNA, 64 nt, Homo Sapiens
cauucccucuaugucaagaguaaauagaggcacagagacugaugagaaacguucauaacaugaa

SEQ ID NO: 615311 - RNA, 64 nt, Homo Sapiens
cagagagggccacauaucgugugccagaggcugagagacugagagggaugacaggcuuagggga

SEQ ID NO: 615312 - RNA, 64 nt, Homo Sapiens; identical to SEQ ID NO: 415214

SEQ ID NO: 615313 - RNA, 64 nt, Homo Sapiens; identical to SEQ ID NO: 415215

SEQ ID NO: 615314 - RNA, 64 nt, Homo Sapiens; identical to SEQ ID NO: 415216

SEQ ID NO: 615315 - RNA, 64 nt, Homo Sapiens; identical to SEQ ID NO: 415217

SEQ ID NO: 615316 - RNA, 64 nt, Homo Sapiens; identical to SEQ ID NO: 415218

SEQ ID NO: 615317 - RNA, 64 nt, Homo Sapiens; identical to SEQ ID NO: 415219

SEQ ID NO: 615318 - RNA, 64 nt, Homo Sapiens; identical to SEQ ID NO: 415220

SEQ ID NO: 615319 - RNA, 64 nt, Homo Sapiens; identical to SEQ ID NO: 415221

SEQ ID NO: 615320 - RNA, 55 nt, Homo Sapiens; identical to SEQ ID NO: 415222

SEQ ID NO: 615321 - RNA, 64 nt, Homo Sapiens; identical to SEQ ID NO: 415223

SEQ ID NO: 615322 - RNA, 64 nt, Homo Sapiens; identical to SEQ ID NO: 415224

SEQ ID NO: 615323 - RNA, 64 nt, Homo Sapiens; identical to SEQ ID NO: 415225

SEQ ID NO: 615324 - RNA, 64 nt, Homo Sapiens; identical to SEQ ID NO: 415226

SEQ ID NO: 615325 - RNA, 64 nt, Homo Sapiens; identical to SEQ ID NO: 415227

SEQ ID NO: 615326 - RNA, 64 nt, Homo Sapiens; identical to SEQ ID NO: 415228

SEQ ID NO: 615327 - RNA, 50 nt, Homo Sapiens; identical to SEQ ID NO: 415229

SEQ ID NO: 615328 - RNA, 64 nt, Homo Sapiens; identical to SEQ ID NO: 415230

SEQ ID NO: 615329 - RNA, 64 nt, Homo Sapiens; identical to SEQ ID NO: 415231

SEQ ID NO: 615330 - RNA, 64 nt, Homo Sapiens; identical to SEQ ID NO: 415232

SEQ ID NO: 615331 - RNA, 64 nt, Homo Sapiens; identical to SEQ ID NO: 415233

SEQ ID NO: 615332 - RNA, 64 nt, Homo Sapiens; identical to SEQ ID NO: 415234

SEQ ID NO: 615333 - RNA, 64 nt, Homo Sapiens; identical to SEQ ID NO: 415235

SEQ ID NO: 615334 - RNA, 64 nt, Homo Sapiens; identical to SEQ ID NO: 415236

SEQ ID NO: 615335 - RNA, 64 nt, Homo Sapiens; identical to SEQ ID NO: 415237

SEQ ID NO: 615336 - RNA, 64 nt, Homo Sapiens; identical to SEQ ID NO: 415238

SEQ ID NO: 615337 - RNA, 64 nt, Homo Sapiens; identical to SEQ ID NO: 415239

SEQ ID NO: 615338 - RNA, 64 nt, Homo Sapiens; identical to SEQ ID NO: 415240

SEQ ID NO: 615339 - RNA, 64 nt, Homo Sapiens; identical to SEQ ID NO: 415241

SEQ ID NO: 615340 - RNA, 64 nt, Homo Sapiens; identical to SEQ ID NO: 415242

SEQ ID NO: 615341 - RNA, 64 nt, Homo Sapiens; identical to SEQ ID NO: 415243

SEQ ID NO: 615342 - RNA, 64 nt, Homo Sapiens; identical to SEQ ID NO: 415244

SEQ ID NO: 615343 - RNA, 64 nt, Homo Sapiens; identical to SEQ ID NO: 415245

SEQ ID NO: 615344 - RNA, 64 nt, Homo Sapiens; identical to SEQ ID NO: 415246

SEQ ID NO: 615345 - RNA, 64 nt, Homo Sapiens; identical to SEQ ID NO: 415247

SEQ ID NO: 615346 - RNA, 64 nt, Homo Sapiens; identical to SEQ ID NO: 415248

SEQ ID NO: 615347 - RNA, 64 nt, Homo Sapiens; identical to SEQ ID NO: 415249

SEQ ID NO: 615348 - RNA, 64 nt, Homo Sapiens; identical to SEQ ID NO: 415250

SEQ ID NO: 615349 - RNA, 64 nt, Homo Sapiens; identical to SEQ ID NO: 415251

SEQ ID NO: 615350 - RNA, 64 nt, Homo Sapiens; identical to SEQ ID NO: 415252

SEQ ID NO: 615351 - RNA, 64 nt, Homo Sapiens; identical to SEQ ID NO: 415253

SEQ ID NO: 615352 - RNA, 64 nt, Homo Sapiens; identical to SEQ ID NO: 415254

SEQ ID NO: 615353 - RNA, 64 nt, Homo Sapiens; identical to SEQ ID NO: 415255

SEQ ID NO: 615354 - RNA, 64 nt, Homo Sapiens; identical to SEQ ID NO: 415256

SEQ ID NO: 615355 - RNA, 64 nt, Homo Sapiens
uaauuaugagacuguauauaugggugugauaaagaggaaugacuggcagcaguggacuaagugc

SEQ ID NO: 615356 - RNA, 64 nt, Homo Sapiens
cauauauuggggaaaaucaugcugagaugagaagaggaaugagcaacucuggguucacacacaa

SEQ ID NO: 615357 - RNA, 64 nt, Homo Sapiens
gcacugguuguauuuuagccuuauuagucugauuaggaaugauguaccuuaaaagacauucugu

SEQ ID NO: 615358 - RNA, 64 nt, Homo Sapiens
uggggcagaucuuaucuuugagaaguagauuucuaggaaugaagagacaaagaacaggugccau

SEQ ID NO: 615359 - RNA, 64 nt, Homo Sapiens
cugguucugcacucucagcauacagcccaugagaaggaaugagguggucaagccccauuugguc

SEQ ID NO: 615360 - RNA, 64 nt, Homo Sapiens
cuuuuuuuccuaaaucaagaauuuggaaggaugaaggaaugaauauugaguuguacuguaccuu

SEQ ID NO: 615361 - RNA, 64 nt, Homo Sapiens
caaaugcccaaaaccaagaaccagucacagaaggaggaaugacuuuugaucucuuccaaccugc

SEQ ID NO: 615362 - RNA, 64 nt, Homo Sapiens
cuggacagauggcggaagcacuuugcagaggcguaggaaugaggaguaguuagcauccaagaga

SEQ ID NO: 615363 - RNA, 64 nt, Homo Sapiens
uuaaacuuggcuuagugaagaagagagaugccaaaggaaugaaccaacccuucacauaaaggag

SEQ ID NO: 615364 - RNA, 64 nt, Homo Sapiens
aagcaacaucucagcaucucuuaaaguugccugcaggaaugaagcaugacauaccuguugaggg

SEQ ID NO: 615365 - RNA, 64 nt, Homo Sapiens
guuucagaauucacuggagauaacaaggaaaggcaggaaugaggaaggcugagggaaagaaucc

SEQ ID NO: 615366 - RNA, 64 nt, Homo Sapiens
uuauaugcaguaaacccaacuauuacauguacuaaggaaugagagcauuguaguaaauugauca

SEQ ID NO: 615367 - RNA, 64 nt, Homo Sapiens
agagcucugaaucgagaaucgaaaagaggcagggaggaaugaagaauccacucucuaugugugg

SEQ ID NO: 615368 - RNA, 64 nt, Homo Sapiens
ugugauuugcuguaucauuuccagauaccaagugaggaaugaggccagggcucccugagugugu

SEQ ID NO: 615369 - RNA, 64 nt, Homo Sapiens
agagcauugauguggugaacccuuguuugaugagaggaaugagcauugaaacugacaaaauugc

SEQ ID NO: 615370 - RNA, 64 nt, Homo Sapiens
gcagcccguaaggugaauucaaaaagaauuuagaaggaaugaaaacuuuuuaucauuaggaaac

SEQ ID NO: 615371 - RNA, 64 nt, Homo Sapiens
agauuucuccauuagagaagguauuuauaaaaauaggaaugaggagagcuagaaaaccuggagu

SEQ ID NO: 615372 - RNA, 64 nt, Homo Sapiens
aaauucauacaucuauggugaccacuuuugacaaaggaaugaagaacauacacuggggaaaaga

SEQ ID NO: 615373 - RNA, 64 nt, Homo Sapiens
ucaccaggcuucuucugccucccuugguaacccaaggaaugauggaaucaacacaacauaguau

SEQ ID NO: 615374 - RNA, 64 nt, Homo Sapiens
uucuacccuccccaagaaaaagggccuucaaggcaggaaugagaaagcaaagccaaucucucau

SEQ ID NO: 615375 - RNA, 64 nt, Homo Sapiens
aaauuuauaacaccugcuuuaugcucucuagcacaggaaugaauugacuucagagauguguucc

SEQ ID NO: 615376 - RNA, 64 nt, Homo Sapiens
aaaauaucuuuuagggggcuaauauaagaugaaaaggaaugauauaguaaaaugaaaauugaga

SEQ ID NO: 615377 - RNA, 64 nt, Homo Sapiens
agagaguuugccuuauacaaugaacagaggccuuaggaaugaauaaccauguaaacauuaggaa

SEQ ID NO: 615378 - RNA, 64 nt, Homo Sapiens
agaggccuuaggaaugaauaaccauguaaacauuaggaaugaacggugcccuucagaguagaga

SEQ ID NO: 615379 - RNA, 64 nt, Homo Sapiens
uuuguuguugaacaauuaguagauccaccuugagaggaaugaacagaacacaaggaaugauuca

SEQ ID NO: 615380 - RNA, 64 nt, Homo Sapiens
caagauccaccuugagaggaaggaagagaacacaaggaaugauuuaccuuuuuuauucagaacg

SEQ ID NO: 615381 - RNA, 64 nt, Homo Sapiens
uacuuaaucuuuucaguuuuccaguuuacgucucaggaaugaaguguagucuaugguugacaau

SEQ ID NO: 615382 - RNA, 64 nt, Homo Sapiens
ccuuuucucauggccuaagaaauaaggaucaauaaggaaugauuugaauguaauuuugugaaug

SEQ ID NO: 615383 - RNA, 64 nt, Homo Sapiens
auauacauguuaagaagauuuauggaaacuuuauaggaaugaaauauugucauugcaagcuucu

SEQ ID NO: 615384 - RNA, 64 nt, Homo Sapiens
cguuauguuucuaagcugaaucucuagcaauaaaaggaaugaacaaaaucuucaggaaugacau

SEQ ID NO: 615385 - RNA, 64 nt, Homo Sapiens
uucucuagcaauaaaaggaauuuauaaaaucuucaggaaugacauuccuucauauuugccuuug

SEQ ID NO: 615386 - RNA, 64 nt, Homo Sapiens
ccagcccucuggggcauugugggagaugccugccaggaaugagcaagcucuguugcucgggagc

SEQ ID NO: 615387 - RNA, 64 nt, Homo Sapiens
acauauguugugaauuuuccuugguucuuuuuaaaggaaugauaauaaaguuacuugcuuuagg

SEQ ID NO: 615388 - RNA, 64 nt, Homo Sapiens
gauaaaacacaggucaccaauuuucucauuucaccccauuuaccuuguauagaggauuguucau

SEQ ID NO: 615389 - RNA, 64 nt, Homo Sapiens
gcauguagauagcauuuauuucugugcccuuaaacccauuuagaaaauaacuacaaaguaaaaa

SEQ ID NO: 615390 - RNA, 64 nt, Homo Sapiens
cugugcuucuucccaucuccugugaucccccucucccauuuauucccuugaaggugcccuugua

SEQ ID NO: 615391 - RNA, 64 nt, Homo Sapiens
uauucuuccaaauauuuggaacacucuuagaauucccauuuaauaaaccauaugagaaaacccu

SEQ ID NO: 615392 - RNA, 64 nt, Homo Sapiens
guuuggccagcuaugccaaugcacauuuugcuuucccauuuauuggcuuagaauaaaagaugua

SEQ ID NO: 615393 - RNA, 64 nt, Homo Sapiens
ggagccagcaauccuguucaugcaaaaagaaggccccauuuaguucccuggaucucugaauaua

SEQ ID NO: 615394 - RNA, 64 nt, Homo Sapiens
gccaagucugaagaaucagagcugcuccuggaaacccauuuagaauccuuucagugacaggacu

SEQ ID NO: 615395 - RNA, 64 nt, Homo Sapiens
acuggcuugaccaggacaaacgaaguucuccaaacccauuuauugucaaucccaggaaaauaug

SEQ ID NO: 615396 - RNA, 64 nt, Homo Sapiens; identical to SEQ ID NO: 357989

SEQ ID NO: 615397 - RNA, 64 nt, Homo Sapiens; identical to SEQ ID NO: 357990

SEQ ID NO: 615398 - RNA, 64 nt, Homo Sapiens; identical to SEQ ID NO: 357991

SEQ ID NO: 615399 - RNA, 64 nt, Homo Sapiens; identical to SEQ ID NO: 357992

SEQ ID NO: 615400 - RNA, 64 nt, Homo Sapiens; identical to SEQ ID NO: 357993

SEQ ID NO: 615401 - RNA, 64 nt, Homo Sapiens; identical to SEQ ID NO: 357994

SEQ ID NO: 615402 - RNA, 64 nt, Homo Sapiens; identical to SEQ ID NO: 357995

SEQ ID NO: 615403 - RNA, 64 nt, Homo Sapiens; identical to SEQ ID NO: 357996

SEQ ID NO: 615404 - RNA, 64 nt, Homo Sapiens; identical to SEQ ID NO: 357997

SEQ ID NO: 615405 - RNA, 64 nt, Homo Sapiens; identical to SEQ ID NO: 357998

SEQ ID NO: 615406 - RNA, 64 nt, Homo Sapiens; identical to SEQ ID NO: 357999

SEQ ID NO: 615407 - RNA, 64 nt, Homo Sapiens; identical to SEQ ID NO: 358000

SEQ ID NO: 615408 - RNA, 64 nt, Homo Sapiens; identical to SEQ ID NO: 358001

SEQ ID NO: 615409 - RNA, 64 nt, Homo Sapiens; identical to SEQ ID NO: 358002

SEQ ID NO: 615410 - RNA, 64 nt, Homo Sapiens; identical to SEQ ID NO: 358003

SEQ ID NO: 615411 - RNA, 64 nt, Homo Sapiens; identical to SEQ ID NO: 358004

SEQ ID NO: 615412 - RNA, 64 nt, Homo Sapiens; identical to SEQ ID NO: 358005

SEQ ID NO: 615413 - RNA, 64 nt, Homo Sapiens; identical to SEQ ID NO: 358006

SEQ ID NO: 615414 - RNA, 64 nt, Homo Sapiens; identical to SEQ ID NO: 358007

SEQ ID NO: 615415 - RNA, 64 nt, Homo Sapiens; identical to SEQ ID NO: 358008

SEQ ID NO: 615416 - RNA, 64 nt, Homo Sapiens; identical to SEQ ID NO: 358009

SEQ ID NO: 615417 - RNA, 64 nt, Homo Sapiens; identical to SEQ ID NO: 358010

SEQ ID NO: 615418 - RNA, 64 nt, Homo Sapiens; identical to SEQ ID NO: 358011

SEQ ID NO: 615419 - RNA, 64 nt, Homo Sapiens; identical to SEQ ID NO: 358012

SEQ ID NO: 615420 - RNA, 64 nt, Homo Sapiens; identical to SEQ ID NO: 358013

SEQ ID NO: 615421 - RNA, 64 nt, Homo Sapiens; identical to SEQ ID NO: 358014

SEQ ID NO: 615422 - RNA, 64 nt, Homo Sapiens; identical to SEQ ID NO: 358015

SEQ ID NO: 615423 - RNA, 64 nt, Homo Sapiens; identical to SEQ ID NO: 358016

SEQ ID NO: 615424 - RNA, 64 nt, Homo Sapiens; identical to SEQ ID NO: 358017

SEQ ID NO: 615425 - RNA, 64 nt, Homo Sapiens; identical to SEQ ID NO: 358018

SEQ ID NO: 615426 - RNA, 64 nt, Homo Sapiens; identical to SEQ ID NO: 358019

SEQ ID NO: 615427 - RNA, 64 nt, Homo Sapiens; identical to SEQ ID NO: 358020

SEQ ID NO: 615428 - RNA, 64 nt, Homo Sapiens; identical to SEQ ID NO: 358021

SEQ ID NO: 615429 - RNA, 64 nt, Homo Sapiens; identical to SEQ ID NO: 358022

SEQ ID NO: 615430 - RNA, 64 nt, Homo Sapiens; identical to SEQ ID NO: 358023

SEQ ID NO: 615431 - RNA, 64 nt, Homo Sapiens; identical to SEQ ID NO: 358024

SEQ ID NO: 615432 - RNA, 64 nt, Homo Sapiens; identical to SEQ ID NO: 358025

SEQ ID NO: 615433 - RNA, 64 nt, Homo Sapiens; identical to SEQ ID NO: 358026

SEQ ID NO: 615434 - RNA, 64 nt, Homo Sapiens; identical to SEQ ID NO: 358027

SEQ ID NO: 615435 - RNA, 64 nt, Homo Sapiens; identical to SEQ ID NO: 358028

SEQ ID NO: 615436 - RNA, 64 nt, Homo Sapiens; identical to SEQ ID NO: 358029

SEQ ID NO: 615437 - RNA, 64 nt, Homo Sapiens; identical to SEQ ID NO: 358030

SEQ ID NO: 615438 - RNA, 64 nt, Homo Sapiens; identical to SEQ ID NO: 358031

SEQ ID NO: 615439 - RNA, 64 nt, Homo Sapiens; identical to SEQ ID NO: 358032

SEQ ID NO: 615440 - RNA, 64 nt, Homo Sapiens; identical to SEQ ID NO: 358033

SEQ ID NO: 615441 - RNA, 64 nt, Homo Sapiens; identical to SEQ ID NO: 358034

SEQ ID NO: 615442 - RNA, 64 nt, Homo Sapiens; identical to SEQ ID NO: 358035

SEQ ID NO: 615443 - RNA, 64 nt, Homo Sapiens; identical to SEQ ID NO: 358036

SEQ ID NO: 615444 - RNA, 64 nt, Homo Sapiens; identical to SEQ ID NO: 358037

SEQ ID NO: 615445 - RNA, 64 nt, Homo Sapiens; identical to SEQ ID NO: 358038

SEQ ID NO: 615446 - RNA, 64 nt, Homo Sapiens; identical to SEQ ID NO: 358039

SEQ ID NO: 615447 - RNA, 64 nt, Homo Sapiens; identical to SEQ ID NO: 358040

SEQ ID NO: 615448 - RNA, 64 nt, Homo Sapiens; identical to SEQ ID NO: 358041

SEQ ID NO: 615449 - RNA, 64 nt, Homo Sapiens; identical to SEQ ID NO: 358042

SEQ ID NO: 615450 - RNA, 64 nt, Homo Sapiens; identical to SEQ ID NO: 358043

SEQ ID NO: 615451 - RNA, 64 nt, Homo Sapiens; identical to SEQ ID NO: 358044

SEQ ID NO: 615452 - RNA, 64 nt, Homo Sapiens; identical to SEQ ID NO: 358045

SEQ ID NO: 615453 - RNA, 64 nt, Homo Sapiens; identical to SEQ ID NO: 358046

SEQ ID NO: 615454 - RNA, 64 nt, Homo Sapiens; identical to SEQ ID NO: 358047

SEQ ID NO: 615455 - RNA, 64 nt, Homo Sapiens; identical to SEQ ID NO: 358048

SEQ ID NO: 615456 - RNA, 64 nt, Homo Sapiens; identical to SEQ ID NO: 358049

SEQ ID NO: 615457 - RNA, 64 nt, Homo Sapiens; identical to SEQ ID NO: 358050

SEQ ID NO: 615458 - RNA, 64 nt, Homo Sapiens; identical to SEQ ID NO: 358051

SEQ ID NO: 615459 - RNA, 64 nt, Homo Sapiens; identical to SEQ ID NO: 358052

SEQ ID NO: 615460 - RNA, 64 nt, Homo Sapiens; identical to SEQ ID NO: 358053

SEQ ID NO: 615461 - RNA, 64 nt, Homo Sapiens; identical to SEQ ID NO: 358054

SEQ ID NO: 615462 - RNA, 64 nt, Homo Sapiens; identical to SEQ ID NO: 358055

SEQ ID NO: 615463 - RNA, 64 nt, Homo Sapiens; identical to SEQ ID NO: 358056

SEQ ID NO: 615464 - RNA, 64 nt, Homo Sapiens; identical to SEQ ID NO: 358057

SEQ ID NO: 615465 - RNA, 64 nt, Homo Sapiens; identical to SEQ ID NO: 358058

SEQ ID NO: 615466 - RNA, 64 nt, Homo Sapiens; identical to SEQ ID NO: 358059

SEQ ID NO: 615467 - RNA, 64 nt, Homo Sapiens; identical to SEQ ID NO: 358060

SEQ ID NO: 615468 - RNA, 64 nt, Homo Sapiens; identical to SEQ ID NO: 358061

SEQ ID NO: 615469 - RNA, 64 nt, Homo Sapiens
ucagguuccuaagacuucaguccuggucugcucaggaauugaagauguaaggaauugaagauag

SEQ ID NO: 615470 - RNA, 64 nt, Homo Sapiens
ucaguccuggucugcucaggaauugaagauguaaggaauugaagauaggagagauaccuugaaa

SEQ ID NO: 615471 - RNA, 64 nt, Homo Sapiens
uuugggaugccugagacuccgagacuaucagaagggaauugacccaccccagucuagcaccacc

SEQ ID NO: 615472 - RNA, 64 nt, Homo Sapiens
ugugcagucuaagguuuaaucugaccaagaaauuggaauugaaaacaggaggugacuagggagg

SEQ ID NO: 615473 - RNA, 64 nt, Homo Sapiens
agagacgauaaacauugaaugcugagguucuaaaggaauugaaauuaauaaauguauguguggg

SEQ ID NO: 615474 - RNA, 64 nt, Homo Sapiens
ggaaaugguuucuaaauggcaagaauguuucacuggaauugaugaaagaggauucuaauauuuc

SEQ ID NO: 615475 - RNA, 64 nt, Homo Sapiens
ucuguaaugucuguccuuucccccacuuuuacugggaauugauaguccagcuuccuugggcagu

SEQ ID NO: 615476 - RNA, 64 nt, Homo Sapiens
caaucccucauccucuuagaagcaccugugaaugggaauugagccaacuguuauagaaaauugg

SEQ ID NO: 615477 - RNA, 64 nt, Homo Sapiens
acugcccggggcagcugccagagaagcaucggagggaauugaggucugcucggccgucuucacu

SEQ ID NO: 615478 - RNA, 64 nt, Homo Sapiens
agaaaagugggccagugugggaaugcggcaagaaggaauugacuucgacugugaccugugggga

SEQ ID NO: 615479 - RNA, 64 nt, Homo Sapiens
guaagaguggaauaaaguuagacagaauuacugaggaauugagugauagauuuuagaggcagca

SEQ ID NO: 615480 - RNA, 64 nt, Homo Sapiens
uucugcuugggaacacagaaaucugugcccucguggaauugacgugugaacaaacagacaaaaa

SEQ ID NO: 615481 - RNA, 62 nt, Homo Sapiens
aguggggcucccagucugaaagaucuaggaggaacugggaucaaagcuacaaagucccacgu

SEQ ID NO: 615482 - RNA, 62 nt, Homo Sapiens
uaucacccucaaucuagugauccaagucagaaaacugggaguuaucgcuacucuguuucaua

SEQ ID NO: 615483 - RNA, 62 nt, Homo Sapiens
uauggaggaguucucuuaauaucagcaaggugaacugggacauucuucuuucucagaagaag

SEQ ID NO: 615484 - RNA, 62 nt, Homo Sapiens
accuacugcagguccagagacuucuguuuuacaacugggaaacagcuuguguacuaaaguaa

SEQ ID NO: 615485 - RNA, 62 nt, Homo Sapiens
ggguggcucccuuuguuguuugcauuuuaaggaacugggagugaggcucagagaaguugagg

SEQ ID NO: 615486 - RNA, 62 nt, Homo Sapiens
cgaggccaccugccucucugagggaucuaaacaacugggagggaggggaccgcucccccuuu

SEQ ID NO: 615487 - RNA, 62 nt, Homo Sapiens
gcuagugguggcuucuccagccuuuuucagggaacugggaacuuaggggacugagcugggga

SEQ ID NO: 615488 - RNA, 62 nt, Homo Sapiens
cuaggccaguacuacugcucucaaaagagauuaacugggauuaagugagaugacgcauguaa

SEQ ID NO: 615489 - RNA, 62 nt, Homo Sapiens
ggauguugacuuuguucugcugcagccugauaaacugggaccacugugugguuaguaaugca

SEQ ID NO: 615490 - RNA, 62 nt, Homo Sapiens
guggggcagcugcaggacauguagagaaaccaaacugggaaaucuuacaaggaguugaaaag

SEQ ID NO: 615491 - RNA, 62 nt, Homo Sapiens
gccucagcauauacucuucuagaccaagugacaacugggagacacgggcaccaggaccccua

SEQ ID NO: 615492 - RNA, 62 nt, Homo Sapiens
gguacuuucgccuccaaggaaguuugcccauuaacugggagaccaggugaggcccuuucucc

SEQ ID NO: 615493 - RNA, 62 nt, Homo Sapiens
uuggauucccacuuaaggguuuuggcaaauuuaacugggaguuagagaauagagucuaugcc

SEQ ID NO: 615494 - RNA, 62 nt, Homo Sapiens
auccuguggggggcuugugguggagagcaugaaacugggagcauaggcugcccaccuaaugg

SEQ ID NO: 615495 - RNA, 62 nt, Homo Sapiens
uccccuuuagcugucuucuauccccagcuccuaacugggacucugugucuaugcagggggcc

SEQ ID NO: 615496 - RNA, 62 nt, Homo Sapiens
auucacgcugagcccaaguccccacacuggaaaacugggaaauggccagcugugugucccag

SEQ ID NO: 615497 - RNA, 62 nt, Homo Sapiens
uuccauggcgacagcuagaugaguguuugaauaacugggacuguagcccguccaaguugaca

SEQ ID NO: 615498 - RNA, 62 nt, Homo Sapiens
ucaaucgauccucccaccucugccucccaaguaacugggacuauagcaugccaccacaccca

SEQ ID NO: 615499 - RNA, 62 nt, Homo Sapiens
ucaauugauccucccacuucugccucccaaguaacugggacuauagcaugccaccacaccca

SEQ ID NO: 615500 - RNA, 62 nt, Homo Sapiens
gucugagugaaaggauggccacaaucuugaguaacugggaaaguuugacuucguuccugaau

SEQ ID NO: 615501 - RNA, 62 nt, Homo Sapiens
gugugaaaacuauuuaagauguccugcucacaaacugggaaacacacagcugagaagccggc

SEQ ID NO: 615502 - RNA, 64 nt, Homo Sapiens; identical to SEQ ID NO: 571472

SEQ ID NO: 615503 - RNA, 64 nt, Homo Sapiens; identical to SEQ ID NO: 571473

SEQ ID NO: 615504 - RNA, 64 nt, Homo Sapiens; identical to SEQ ID NO: 571474

SEQ ID NO: 615505 - RNA, 64 nt, Homo Sapiens; identical to SEQ ID NO: 571475

SEQ ID NO: 615506 - RNA, 64 nt, Homo Sapiens; identical to SEQ ID NO: 571476

SEQ ID NO: 615507 - RNA, 64 nt, Homo Sapiens; identical to SEQ ID NO: 571477

SEQ ID NO: 615508 - RNA, 64 nt, Homo Sapiens; identical to SEQ ID NO: 571478

SEQ ID NO: 615509 - RNA, 64 nt, Homo Sapiens; identical to SEQ ID NO: 571479

SEQ ID NO: 615510 - RNA, 64 nt, Homo Sapiens; identical to SEQ ID NO: 571480

SEQ ID NO: 615511 - RNA, 64 nt, Homo Sapiens; identical to SEQ ID NO: 571481

SEQ ID NO: 615512 - RNA, 64 nt, Homo Sapiens; identical to SEQ ID NO: 571482

SEQ ID NO: 615513 - RNA, 64 nt, Homo Sapiens; identical to SEQ ID NO: 571483

SEQ ID NO: 615514 - RNA, 64 nt, Homo Sapiens; identical to SEQ ID NO: 571484

SEQ ID NO: 615515 - RNA, 64 nt, Homo Sapiens; identical to SEQ ID NO: 571485

SEQ ID NO: 615516 - RNA, 64 nt, Homo Sapiens; identical to SEQ ID NO: 571486

SEQ ID NO: 615517 - RNA, 64 nt, Homo Sapiens; identical to SEQ ID NO: 571487

SEQ ID NO: 615518 - RNA, 64 nt, Homo Sapiens; identical to SEQ ID NO: 571488

SEQ ID NO: 615519 - RNA, 64 nt, Homo Sapiens; identical to SEQ ID NO: 571489

SEQ ID NO: 615520 - RNA, 64 nt, Homo Sapiens; identical to SEQ ID NO: 571490

SEQ ID NO: 615521 - RNA, 64 nt, Homo Sapiens; identical to SEQ ID NO: 571491

SEQ ID NO: 615522 - RNA, 64 nt, Homo Sapiens; identical to SEQ ID NO: 571492

SEQ ID NO: 615523 - RNA, 64 nt, Homo Sapiens; identical to SEQ ID NO: 571493

SEQ ID NO: 615524 - RNA, 64 nt, Homo Sapiens; identical to SEQ ID NO: 571494

SEQ ID NO: 615525 - RNA, 64 nt, Homo Sapiens; identical to SEQ ID NO: 571495

SEQ ID NO: 615526 - RNA, 64 nt, Homo Sapiens; identical to SEQ ID NO: 571496

SEQ ID NO: 615527 - RNA, 64 nt, Homo Sapiens; identical to SEQ ID NO: 571497

SEQ ID NO: 615528 - RNA, 64 nt, Homo Sapiens; identical to SEQ ID NO: 571498

SEQ ID NO: 615529 - RNA, 64 nt, Homo Sapiens; identical to SEQ ID NO: 571499

SEQ ID NO: 615530 - RNA, 64 nt, Homo Sapiens; identical to SEQ ID NO: 571500

SEQ ID NO: 615531 - RNA, 64 nt, Homo Sapiens; identical to SEQ ID NO: 571501

SEQ ID NO: 615532 - RNA, 60 nt, Homo Sapiens; identical to SEQ ID NO: 571502

SEQ ID NO: 615533 - RNA, 64 nt, Homo Sapiens; identical to SEQ ID NO: 571503

SEQ ID NO: 615534 - RNA, 64 nt, Homo Sapiens; identical to SEQ ID NO: 571504

SEQ ID NO: 615535 - RNA, 64 nt, Homo Sapiens; identical to SEQ ID NO: 571505

SEQ ID NO: 615536 - RNA, 64 nt, Homo Sapiens; identical to SEQ ID NO: 571506

SEQ ID NO: 615537 - RNA, 64 nt, Homo Sapiens; identical to SEQ ID NO: 571507

SEQ ID NO: 615538 - RNA, 64 nt, Homo Sapiens; identical to SEQ ID NO: 571508

SEQ ID NO: 615539 - RNA, 63 nt, Homo Sapiens; identical to SEQ ID NO: 87681

SEQ ID NO: 615540 - RNA, 63 nt, Homo Sapiens; identical to SEQ ID NO: 87682

SEQ ID NO: 615541 - RNA, 63 nt, Homo Sapiens; identical to SEQ ID NO: 87683

SEQ ID NO: 615542 - RNA, 63 nt, Homo Sapiens; identical to SEQ ID NO: 87684

SEQ ID NO: 615543 - RNA, 63 nt, Homo Sapiens; identical to SEQ ID NO: 87685

SEQ ID NO: 615544 - RNA, 63 nt, Homo Sapiens; identical to SEQ ID NO: 87686

SEQ ID NO: 615545 - RNA, 63 nt, Homo Sapiens; identical to SEQ ID NO: 87687

SEQ ID NO: 615546 - RNA, 63 nt, Homo Sapiens; identical to SEQ ID NO: 87688

SEQ ID NO: 615547 - RNA, 63 nt, Homo Sapiens; identical to SEQ ID NO: 87689

SEQ ID NO: 615548 - RNA, 63 nt, Homo Sapiens; identical to SEQ ID NO: 87690

SEQ ID NO: 615549 - RNA, 63 nt, Homo Sapiens; identical to SEQ ID NO: 87691

SEQ ID NO: 615550 - RNA, 63 nt, Homo Sapiens; identical to SEQ ID NO: 87692

SEQ ID NO: 615551 - RNA, 63 nt, Homo Sapiens; identical to SEQ ID NO: 87693

SEQ ID NO: 615552 - RNA, 63 nt, Homo Sapiens; identical to SEQ ID NO: 87694

SEQ ID NO: 615553 - RNA, 63 nt, Homo Sapiens; identical to SEQ ID NO: 87695

SEQ ID NO: 615554 - RNA, 63 nt, Homo Sapiens; identical to SEQ ID NO: 87696

SEQ ID NO: 615555 - RNA, 63 nt, Homo Sapiens; identical to SEQ ID NO: 87697

SEQ ID NO: 615556 - RNA, 63 nt, Homo Sapiens; identical to SEQ ID NO: 87698

SEQ ID NO: 615557 - RNA, 63 nt, Homo Sapiens; identical to SEQ ID NO: 87699

SEQ ID NO: 615558 - RNA, 63 nt, Homo Sapiens; identical to SEQ ID NO: 87700

SEQ ID NO: 615559 - RNA, 63 nt, Homo Sapiens; identical to SEQ ID NO: 87701

SEQ ID NO: 615560 - RNA, 63 nt, Homo Sapiens; identical to SEQ ID NO: 87702

SEQ ID NO: 615561 - RNA, 63 nt, Homo Sapiens; identical to SEQ ID NO: 87703

SEQ ID NO: 615562 - RNA, 63 nt, Homo Sapiens; identical to SEQ ID NO: 87702

SEQ ID NO: 615563 - RNA, 63 nt, Homo Sapiens; identical to SEQ ID NO: 87703

SEQ ID NO: 615564 - RNA, 61 nt, Homo Sapiens
guugaggccuuggggucacuccuuuuuugcaugugcaaaugugcuggucacccuucaacgc

SEQ ID NO: 615565 - RNA, 61 nt, Homo Sapiens
aacagaugacuugugaaccccacaguguggaugugcaaaugaaaauugaaggaaagaauau

SEQ ID NO: 615566 - RNA, 61 nt, Homo Sapiens
ucugaugcacuggacugaauuuuuaccucaaugugcaaaggcugaucagccugaacuuucu

SEQ ID NO: 615567 - RNA, 61 nt, Homo Sapiens
ugaauaaucaaagugauuuuucagaauuaugugugcaaaaaauuaaugugcauucauauau

SEQ ID NO: 615568 - RNA, 61 nt, Homo Sapiens
gcucaggugcuccccuccaccaugggcaggcugugcaaaaagccacuggcuuuucucagca

SEQ ID NO: 615569 - RNA, 61 nt, Homo Sapiens
agcacuuugccuaaaagaaaggacugacaagugugcaaaauguuuacaaucuuuugugaaa

SEQ ID NO: 615570 - RNA, 61 nt, Homo Sapiens
uugauauguucaacuggagacacuauuuaucugugcaaauccuugauacugcucaucauuc

SEQ ID NO: 615571 - RNA, 61 nt, Homo Sapiens
ugggucaggaacagagccaacaggaugaacgugugcaaaagccuuggacuuggcugugauc

SEQ ID NO: 615572 - RNA, 61 nt, Homo Sapiens
agcaagguuggccucuggauggugaacgggcugugcaaaaaagcccugcuucuucccuugu

SEQ ID NO: 615573 - RNA, 61 nt, Homo Sapiens
cucuauaucauuuuucaauauaaaauguauuugugcaaauucuagucaauacuacuuuaug

SEQ ID NO: 615574 - RNA, 61 nt, Homo Sapiens
aaauggcucugugaaaucagaagugcaaaggugugcaaacuuguaucugaagaccuaccag

SEQ ID NO: 615575 - RNA, 61 nt, Homo Sapiens
ucagggcugccacuaaccuguagaacaccccugugcaaauuuuaaaaaggaacccuuuucc

SEQ ID NO: 615576 - RNA, 61 nt, Homo Sapiens
aagucagcagauauuuauugaguuccuguggugugcaaagcauuaugauaggcaccguggg

SEQ ID NO: 615577 - RNA, 61 nt, Homo Sapiens
ucuauccacauccaacugauggcaccauugaugugcaaauaaugagauucccuaucuccuu

SEQ ID NO: 615578 - RNA, 61 nt, Homo Sapiens
guguugcagggagguguuaagaagagaacucugugcaaacagugauggaaggcuguugucu

SEQ ID NO: 615579 - RNA, 61 nt, Homo Sapiens
gcucgucuaucaccaggaucgcuuuguacuuugugcaaaagggucuggcugucccuugcug

SEQ ID NO: 615580 - RNA, 61 nt, Homo Sapiens
ggaaagugguaggauuuuuuuuuuuuaauccugugcaaaggaaaagaggugcuuuguggga

SEQ ID NO: 615581 - RNA, 61 nt, Homo Sapiens
cauuaaucuuaacacagaacaugagguuaugugugcaaauugagucuuuuaggacagauuc

SEQ ID NO: 615582 - RNA, 61 nt, Homo Sapiens
gauacagugauuucauauuggaaucauuauuugugcaaagggacagacagaucacuuagau

SEQ ID NO: 615583 - RNA, 61 nt, Homo Sapiens
gagaguguauagacugacucuaaguuaauaaugugcaaaauaucuuaaacaucccuccccu

SEQ ID NO: 615584 - RNA, 61 nt, Homo Sapiens
ugcagggaaauaaccuccuguguccugaaucugugcaaaugggcuccgcaguguuggguuu

SEQ ID NO: 615585 - RNA, 61 nt, Homo Sapiens
cccucagggagccccccugccccuccuggucugugcaaacuccuuggggcuaccccuuggc

SEQ ID NO: 615586 - RNA, 61 nt, Homo Sapiens
gcugccuugcuguucuugaaccagugggaacugugcaaaggucaucuccagccuccccacc

SEQ ID NO: 615587 - RNA, 61 nt, Homo Sapiens
caucuguuuggggagcacacgaacauuagccugugcaaaacgucucuaaggaaaaccagca

SEQ ID NO: 615588 - RNA, 61 nt, Homo Sapiens
ccaccccucacacugcagccuggaggugaaaugugcaaaacgaauauugagaaugagggcc

SEQ ID NO: 615589 - RNA, 61 nt, Homo Sapiens
aggcucuagcaacaugaucauugaugacgugugugcaaagcagcuuguugacugcugucug

SEQ ID NO: 615590 - RNA, 61 nt, Homo Sapiens
caaaaccuucguccuuuuaacgagagccuuuugugcaaagcccccuagggggagaagaagc

SEQ ID NO: 615591 - RNA, 61 nt, Homo Sapiens
cugcaagaaauugcugccuugccucuagcacugugcaaacuucuuuugugucucucugguu

SEQ ID NO: 615592 - RNA, 61 nt, Homo Sapiens
ugacaauauacaagcuuuuauaaaguaauaaugugcaaaucggaaagcuuacuguuuuuga

SEQ ID NO: 615593 - RNA, 61 nt, Homo Sapiens
aaaauauggggagacuuggguuggcaagauuugugcaaaauuuaugagcccugaggaguua

SEQ ID NO: 615594 - RNA, 61 nt, Homo Sapiens
gcaucuaagcaucuguuaacuuaggaaaacaugugcaaaaacaugaagaaaaaaauauauu

SEQ ID NO: 615595 - RNA, 61 nt, Homo Sapiens
aaaauucuucucaggcaacacuuuaccaggcugugcaaaguuauuuuucuguccagaagag

SEQ ID NO: 615596 - RNA, 61 nt, Homo Sapiens
augacaauuauuugaauguauuagaauaaaaugugcaaauaaaaaugagaaauuauauuua

SEQ ID NO: 615597 - RNA, 61 nt, Homo Sapiens
uuuugaaaauagagcaauacguguaagacacugugcaaauuuucucaaucuuuuagcacau

SEQ ID NO: 615598 - RNA, 61 nt, Homo Sapiens
uuuuaucauucuaaauggugcucuuucauagugugcaaacauguggcaacauucugucagc

SEQ ID NO: 615599 - RNA, 61 nt, Homo Sapiens
ugugugacuggagcucuaggggcugggugugugugcaaauccucugugugucucugacccu

SEQ ID NO: 615600 - RNA, 61 nt, Homo Sapiens
augaaaagccccuucacuucugcacaggcacugugcaaacauuuguuuaacugugaguggc

SEQ ID NO: 615601 - RNA, 61 nt, Homo Sapiens
aauuauuucugcuaccuucucauccagacacugugcaaauauauucauugaacugcugcua

SEQ ID NO: 615602 - RNA, 61 nt, Homo Sapiens
aacuucuccuuuugaccaguguuuauauuuuugugcaaaugugcuggucucauccucccca

SEQ ID NO: 615603 - RNA, 61 nt, Homo Sapiens
ggugcagaaauucuauaaacucacugacuuaugugcaaacuauuggaugccaguuuuguaa

SEQ ID NO: 615604 - RNA, 61 nt, Homo Sapiens
gcuuagcuaaguuaucgagcuaggcuuagacugugcaaaggagacugaaagcauuccaaau

SEQ ID NO: 615605 - RNA, 61 nt, Homo Sapiens
auaaauuuuuugaccuauuuaacuuuuuaauugugcaaaggaucacuaucaauuuuaagga

SEQ ID NO: 615606 - RNA, 61 nt, Homo Sapiens
gcacaaccccaaucacacacagaggcagaugugugcaaaaaauaaauaggucagugggcag

SEQ ID NO: 615607 - RNA, 61 nt, Homo Sapiens
aauggggcugaggccccugugaaccccuggcugugcaaauaaaaacugcuguuuguggcag

SEQ ID NO: 615608 - RNA, 61 nt, Homo Sapiens
augggacuuagaggguuucucacugcagcagugugcaaacuuuccaguccucugcacugua

SEQ ID NO: 615609 - RNA, 61 nt, Homo Sapiens
augggcagaaaagaaagugcuuuccauauugugugcaaaggcuccccagauaccuccuaua

SEQ ID NO: 615610 - RNA, 61 nt, Homo Sapiens
uguaaucucauggacuagagccuccugucagugugcaaagcguaggcuaagaaggaaggac

SEQ ID NO: 615611 - RNA, 61 nt, Homo Sapiens
agaauauauuuaaaaaaaagauuauuuuacaugugcaaaucacuuucuuucauaagugugc

SEQ ID NO: 615612 - RNA, 61 nt, Homo Sapiens
ucguaaaaggacaaaaaauuuggcagucuuaugugcaaagacugccuaggaaaacauuuua

SEQ ID NO: 615613 - RNA, 61 nt, Homo Sapiens
aguuagagcuggcagcugaagauguuuuaagugugcaaacaggcuucuugugcaauaauau

SEQ ID NO: 615614 - RNA, 61 nt, Homo Sapiens
uaugcuacaaggucucuuuaaugaagcacagugugcaaaggauucuaaguaguauuacccu

SEQ ID NO: 615615 - RNA, 61 nt, Homo Sapiens
ggacaaauuuuaauaaucagcaagacugguuugugcaaagcguugagucaucagguauuua

SEQ ID NO: 615616 - RNA, 61 nt, Homo Sapiens
caaugggucuuggugggugggagguggggcaugugcaaagcaagcaaggaacauuuggggu

SEQ ID NO: 615617 - RNA, 61 nt, Homo Sapiens
uuugguaauucauuuuuuuuuaagaucauuaugugcaaaacaccaaguuuuaaaaauaacu

SEQ ID NO: 615618 - RNA, 61 nt, Homo Sapiens
gaaggcuaaaaaauuaccucuuuuuaaauuaugugcaaaauaauucuggcuaacuguaaaa

SEQ ID NO: 615619 - RNA, 61 nt, Homo Sapiens
cccccauuuuugugccacuugcuuggggggaugugcaaacccacccugccccuuggauggg

SEQ ID NO: 615620 - RNA, 61 nt, Homo Sapiens
gagcauuuauguagacauuguaaauaaauuuugugcaaaaaggacuggaaaaaugaacugu

SEQ ID NO: 615621 - RNA, 61 nt, Homo Sapiens
agcaaaacuucagaacuaguucugcaucuacugugcaaagaucaugauuaacugucaagac

SEQ ID NO: 615622 - RNA, 61 nt, Homo Sapiens
cuuuucuugguggugcaaagugguauaacugugugcaaauaggagguuugagguccaaauu

SEQ ID NO: 615623 - RNA, 61 nt, Homo Sapiens
agccucuaggcuagcggcugcauucguggucugugcaaacacuucgugguucuauauauca

SEQ ID NO: 615624 - RNA, 61 nt, Homo Sapiens
acacuucgugguucuauauaucagcagcaagugugcaaaauaaaggaccuguuaacucaga

SEQ ID NO: 615625 - RNA, 61 nt, Homo Sapiens
ugccuguguaauuuuaaaaaauuaauagagcugugcaaacccuguuauuuuuguaaaaaaa

SEQ ID NO: 615626 - RNA, 61 nt, Homo Sapiens
aggaaaaauuaugcaucuagcacauuuaaacugugcaaauaugaaaauuuuucgaggauua

SEQ ID NO: 615627 - RNA, 61 nt, Homo Sapiens
ggcauguauuaucacaucaagcaugcaauaaugugcaaauuuugcauuuaguuuuauggca

SEQ ID NO: 615628 - RNA, 61 nt, Homo Sapiens
gccugcauuguguauuaaacaccagguaauaugugcaaaaccgagggcuccaguaacaccu

SEQ ID NO: 615629 - RNA, 61 nt, Homo Sapiens
cuucucggagucucauauuuugugggacuccugugcaaacauauguuauuaaaauuuuuuu

SEQ ID NO: 615630 - RNA, 61 nt, Homo Sapiens
cuucuuggagucucauauuucguggaacuccugugcaaacauauauuauuaaauuuuuuuu

SEQ ID NO: 615631 - RNA, 61 nt, Homo Sapiens
ugaguaaaaggguuccuguucacucugacucugugcaaauuguauuacaguagaccgcuga

SEQ ID NO: 615632 - RNA, 61 nt, Homo Sapiens
aaaaaaaaaaaaaaaaaaguucguuaaaaacugugcaaauucaaaaauuuauuuggcucuu

SEQ ID NO: 615633 - RNA, 61 nt, Homo Sapiens
auuuuuauagauuugaccuaucugacuuaagugugcaaaaucuaauuuaguucucagcucu

SEQ ID NO: 615634 - RNA, 61 nt, Homo Sapiens
cccuggaacgcaauuaaauaugaauguguaaugugcaaaaguuuuuaaacaaugauuaaau

SEQ ID NO: 615635 - RNA, 61 nt, Homo Sapiens
cugacuacuaaggccuuguuguugaucauuaugugcaaagaauuguucuuuucuugguaau

SEQ ID NO: 615636 - RNA, 61 nt, Homo Sapiens
ucaugggacuuuaaaaagaaacaagcauguuugugcaaauuaaaaauguuuaauuuaugca

SEQ ID NO: 615637 - RNA, 61 nt, Homo Sapiens
agcgauugaguugggcuuuaagaagcguagaugugcaaacaauagcuggaccuaaguucuc

SEQ ID NO: 615638 - RNA, 61 nt, Homo Sapiens
augaaagagcucgguaaagcucuuuuguuccugugcaaauagggagcgggaguccguguuc

SEQ ID NO: 615639 - RNA, 61 nt, Homo Sapiens
cugguauuucuuacaugauuaauuaauuuauugugcaaaugugguaccagggaagagggag

SEQ ID NO: 615640 - RNA, 61 nt, Homo Sapiens
aucaaguucacauguuccaagaacuuuuaugugugcaaaggcaaauuaaaagcagcuuugu

SEQ ID NO: 615641 - RNA, 61 nt, Homo Sapiens
gaacauuguaacuacaccaaauagggauaguugugcaaaguacccaauggcuaccuagacu

SEQ ID NO: 615642 - RNA, 61 nt, Homo Sapiens
uuuuuggauugacaguaacucuuuuuauugaugugcaaaaaguuccuaaguucuuagauau

SEQ ID NO: 615643 - RNA, 61 nt, Homo Sapiens
cuguauuccaaggccugugaucauuuguccaugugcaaacgacucugagcugcuaggaacc

SEQ ID NO: 615644 - RNA, 61 nt, Homo Sapiens
uaccacauucuguccccaaagggagagguucugugcaaaacuuucuaagcuguuucuugau

SEQ ID NO: 615645 - RNA, 61 nt, Homo Sapiens
aaacuuucuuuacccagugcugguuuguuugugugcaaaccguugagccuugcuggacaag

SEQ ID NO: 615646 - RNA, 61 nt, Homo Sapiens
cccaaguccauucccacuguaggccgaugccugugcaaaggacgcagugccauaucagaga

SEQ ID NO: 615647 - RNA, 61 nt, Homo Sapiens
acauacaaagaaaaguagugguauuuugguaugugcaaauauuuccauauguuagccauuu

SEQ ID NO: 615648 - RNA, 61 nt, Homo Sapiens
cuuacccaaugaaagcaaaguuuuuaugugcugugcaaauggucuucauguggucugacaa

SEQ ID NO: 615649 - RNA, 61 nt, Homo Sapiens
acugggcugauuugaccuccgacucauugguugugcaaaugccaugugcagccuuuccuga

SEQ ID NO: 615650 - RNA, 61 nt, Homo Sapiens
acaccaagaggguguugugaugaggugccggugugcaaagggaacuuuaguuuuuccacug

SEQ ID NO: 615651 - RNA, 61 nt, Homo Sapiens
ugucaucacauuucaggccccaagcaaucucugugcaaagcaucagaaagaccugcuuccc

SEQ ID NO: 615652 - RNA, 61 nt, Homo Sapiens
gagugaauggcuugacguacuugcaguuaacugugcaaaauuggcuggcugccucuguucc

SEQ ID NO: 615653 - RNA, 61 nt, Homo Sapiens
caaaucaaggaccaacuuaaacguuaauuuuugugcaaaaacaaaccugaaaaauaugcuu

SEQ ID NO: 615654 - RNA, 61 nt, Homo Sapiens
aauuccagugguccauggaaugcuugaaaaaugugcaaaacagcguuuaagacuguaauga

SEQ ID NO: 615655 - RNA, 61 nt, Homo Sapiens
gaagucuucaaguucaugucacugagaagcuugugcaaagcagccaccuuggaccauaauu

SEQ ID NO: 615656 - RNA, 61 nt, Homo Sapiens
gccccucuugauguaagcaacuguccauccuugugcaaagauugaugguagagaguuugac

SEQ ID NO: 615657 - RNA, 61 nt, Homo Sapiens
ccagugaggguggggugggacugaagcguugugugcaaauccagcuuccauccccucccca

SEQ ID NO: 615658 - RNA, 61 nt, Homo Sapiens
cuggcuuuaccaaauugaaugaaaaggagcuugugcaaaaaaauuuaaaaauggaugucaa

SEQ ID NO: 615659 - RNA, 61 nt, Homo Sapiens
gggaaaaaaaaagaagaaaaaccuguuuccgugugcaaaagcacacauauguaugucugug

SEQ ID NO: 615660 - RNA, 61 nt, Homo Sapiens
ucaaaguuuacguaaugaaaauuauagcgugugugcaaacucuugaggguugauuaugcug

SEQ ID NO: 615661 - RNA, 61 nt, Homo Sapiens
ucccucuauuaaccccaccccaucaggcacgugugcaaaccucuugacuuuaccccacauu

SEQ ID NO: 615662 - RNA, 61 nt, Homo Sapiens
guucucagagcugaauguuuauaucuuuugcugugcaaaagaaacauguaaaauguuguuc

SEQ ID NO: 615663 - RNA, 61 nt, Homo Sapiens
ucaacucaaaacgcauccaauacucacacuaugugcaaaaaaaagaaugagguuggaccuu

SEQ ID NO: 615664 - RNA, 61 nt, Homo Sapiens
aaaauaaacauuuaaaaugaacuguuaaaauugugcaaaauuuccacagcaaaauuacucu

SEQ ID NO: 615665 - RNA, 61 nt, Homo Sapiens
auugguauuaaagaaugcugguaugucaaauugugcaaaauuugaaaugcuaaacuuggcu

SEQ ID NO: 615666 - RNA, 61 nt, Homo Sapiens
gaagacaaaauguuuucuuccucaccagaauugugcaaauguguccagugcaaccacacac

SEQ ID NO: 615667 - RNA, 61 nt, Homo Sapiens
augaagugaaaaacugaauuaaauuuuaaaaugugcaaagauauuucuaaacauucuaauc

SEQ ID NO: 615668 - RNA, 61 nt, Homo Sapiens
caggcuugugcuuuauacccuggucuuacuuugugcaaaagggcuaacauuuaggagaagu

SEQ ID NO: 615669 - RNA, 61 nt, Homo Sapiens
guguaagcuuagauuuucuggauccaaaugcugugcaaacagggacucauucacauuucaa

SEQ ID NO: 615670 - RNA, 61 nt, Homo Sapiens
uauacccacaccagcacuaguaaggaugaccugugcaaaaucucccugcaaguguaaauau

SEQ ID NO: 615671 - RNA, 61 nt, Homo Sapiens
acugaguaaccacugggaaaacuguuuuuugugugcaaaauuuuaaguggcagguauugua

SEQ ID NO: 615672 - RNA, 61 nt, Homo Sapiens
aguuuuuuaaaaauuauacaaaaauuuuaccugugcaaaaucaggguaaaauuugaaacaa

SEQ ID NO: 615673 - RNA, 61 nt, Homo Sapiens
aaugcuaaucaggguucuccgagaccgacuuugugcaaagcaucaacaaauauauuuauug

SEQ ID NO: 615674 - RNA, 61 nt, Homo Sapiens
gccuuucugacucuugaguaaagcucaguuuugugcaaaucgcuuaacaaaugagcauucc

SEQ ID NO: 615675 - RNA, 61 nt, Homo Sapiens
ccccguggccagggguggagcacagucagccugugcaaaggaugagccaggacgguccccc

SEQ ID NO: 615676 - RNA, 61 nt, Homo Sapiens
ucauuuacauguaacuucugacauuucacucugugcaaauaaagaacaugaggauaccugu

SEQ ID NO: 615677 - RNA, 61 nt, Homo Sapiens
cuuccuucacucacccagcaggucaguuuucugugcaaacaaaccuguuuaggauucuucc

SEQ ID NO: 615678 - RNA, 61 nt, Homo Sapiens
uucacuaaaaaacuugguuauuccauggaguugugcaaagcuauggcuuccuuggugcaau

SEQ ID NO: 615679 - RNA, 61 nt, Homo Sapiens
acagaugaaaguugcaaugaucuagcaguugugugcaaaggcaaggcuugcuuuuccuguc

SEQ ID NO: 615680 - RNA, 61 nt, Homo Sapiens
gcauugccagcggcgaauaccugagcaacugugugcaaaucauagaccguggcuauaacca

SEQ ID NO: 615681 - RNA, 61 nt, Homo Sapiens
accucaaaagacagauaaaaggaugcagagcugugcaaauuguuccucaaaugaagcagug

SEQ ID NO: 615682 - RNA, 61 nt, Homo Sapiens
aacauuuuccaauuaucuggucuuuuccuguugugcaaaaaugacucauugcuccgaaugu

SEQ ID NO: 615683 - RNA, 61 nt, Homo Sapiens
uauuuaugggcugguaaacucauuguacauaugugcaaaacugcuacugaguggggagcuu

SEQ ID NO: 615684 - RNA, 61 nt, Homo Sapiens
ccuccucauccuugucugaggaguaaaugccugugcaaagcggguggcccgccauccccug

SEQ ID NO: 615685 - RNA, 61 nt, Homo Sapiens
aaaagaaugauuucagaaaugcagcuaugugugugcaaaauuuuccaguguucaguaaaua

SEQ ID NO: 615686 - RNA, 61 nt, Homo Sapiens
ccaaauauuaauuguaagucuaccugaaaauugugcaaaugcuuauaaugguuguuuuuga

SEQ ID NO: 615687 - RNA, 61 nt, Homo Sapiens
uauaaacugauuaacuugucacaacugauaaugugcaaagauuuauaucuugggauuuuuc

SEQ ID NO: 615688 - RNA, 61 nt, Homo Sapiens
guuuuucccaguuauuuaauuucuauuugguugugcaaaauauaaguucaggauauuucuu

SEQ ID NO: 615689 - RNA, 61 nt, Homo Sapiens
gauccauccuguuuuuccuuuucugacaccaugugcaaacuugugagcaccuuuccugaaa

SEQ ID NO: 615690 - RNA, 61 nt, Homo Sapiens
ccuacaauaaagccaucuacugauguaaaauugugcaaacaugaaaacuucuuguauuucc

SEQ ID NO: 615691 - RNA, 61 nt, Homo Sapiens
uaccccuuugcacagauaguaucuggauaaaugugcaaaaguauugugcuuuuuagaacaa

SEQ ID NO: 615692 - RNA, 61 nt, Homo Sapiens
ggacaugcaggugaauauuuauucaacaagaugugcaaaccuaacagaaacucaacucuaa

SEQ ID NO: 615693 - RNA, 61 nt, Homo Sapiens
uuauuuucuuuuaucugggcaauugagagugugugcaaagcaaguuugccugcaaguaaag

SEQ ID NO: 615694 - RNA, 61 nt, Homo Sapiens
ggauaauuuaauuuacgugcgggggaauaauugugcaaagauauguuauaaauuaguuuug

SEQ ID NO: 615695 - RNA, 61 nt, Homo Sapiens
uaaaacaaauaacaagagauaaguuuuccucugugcaaauuauuuaauuguuuagaauauu

SEQ ID NO: 615696 - RNA, 61 nt, Homo Sapiens
cuuccucagacaugccacucguccguucaccugugcaaaggauggccugccugccuucccu

SEQ ID NO: 615697 - RNA, 61 nt, Homo Sapiens
ccuauugggguuaaguuuguaaguguuuaauugugcaaauugccacccuguguaccuccuc

SEQ ID NO: 615698 - RNA, 61 nt, Homo Sapiens
aauaugcuguuuacauuuauuuucuucagccugugcaaaacaaagcaauggaaaaggaaac

SEQ ID NO: 615699 - RNA, 61 nt, Homo Sapiens
uuuaauuacauacacagugaauugaaaccauugugcaaaauggauuacacauguauacaaa

SEQ ID NO: 615700 - RNA, 61 nt, Homo Sapiens
aggaaaaaauacggaggauaaccacuauuuuugugcaaauaauaugaaagugaaguaaaag

SEQ ID NO: 615701 - RNA, 61 nt, Homo Sapiens
aggagaugcuuauagaugauaguuguacauaugugcaaaaaaaaauccacuugcaauggua

SEQ ID NO: 615702 - RNA, 61 nt, Homo Sapiens
ggaggcacaaacucugcacgggggaacugugugugcaaaggugagcugggggcgagaaagg

SEQ ID NO: 615703 - RNA, 61 nt, Homo Sapiens
aucggacgggacaggguggagcggggaggccugugcaaagugggaaagagcugccgguggc

SEQ ID NO: 615704 - RNA, 61 nt, Homo Sapiens
ggggaggguauuucuggaaaguggaccagcaugugcaaaaauauggaacugagcacgggug

SEQ ID NO: 615705 - RNA, 61 nt, Homo Sapiens
ugcacuguugaacuaaguaacuguguaaaucugugcaaagguacguauguuuaucuuacuc

SEQ ID NO: 615706 - RNA, 61 nt, Homo Sapiens
aucuuggcuuaauuuaauguauuaaucuguuugugcaaacauaauaccaccauuuaaaaau

SEQ ID NO: 615707 - RNA, 61 nt, Homo Sapiens
uguuaaauuuauuuuuccuauuauauguuggugugcaaaaacuuuuaucuucucugcagug

SEQ ID NO: 615708 - RNA, 61 nt, Homo Sapiens
uggagaaaucuacugaauuggaaauuagauuugugcaaacaaaauuagugaaccaaaaaua

SEQ ID NO: 615709 - RNA, 61 nt, Homo Sapiens
gacuauuuguucuauaauacguuuuucuucaugugcaaagucagaguugcucuucaccagu

SEQ ID NO: 615710 - RNA, 61 nt, Homo Sapiens
ugauacucuuuucugcauuaccagagaaaugugugcaaaaaagcuccagagagugucaaac

SEQ ID NO: 615711 - RNA, 61 nt, Homo Sapiens
cuuagugaugaaagccugucgagcuguguuuugugcaaaaauaauuuauuuacgauaucua

SEQ ID NO: 615712 - RNA, 61 nt, Homo Sapiens
cuguaggaaacugaaugguuauggaaugaacugugcaaaauauuucccuaaaaguaucucc

SEQ ID NO: 615713 - RNA, 61 nt, Homo Sapiens
uggacauaauaguucacuuaguggacgaguaugugcaaacaccuucaggugaucacacaca

SEQ ID NO: 615714 - RNA, 61 nt, Homo Sapiens
auuauauauaaauauauuuaucuaaauuucaugugcaaauaaaguaaaucugcaaauuccu

SEQ ID NO: 615715 - RNA, 61 nt, Homo Sapiens
aaucaugcaaugcagccaagggauugccauaugugcaaacaauuauguucaaguuauuuca

SEQ ID NO: 615716 - RNA, 61 nt, Homo Sapiens
acuuugcagauuaaaaaaaaguugggagacuugugcaaagggaagggaaaacuccaaacca

SEQ ID NO: 615717 - RNA, 61 nt, Homo Sapiens
aacaguccuaacugguauagauuauauagguugugcaaauuuauaucugcuucaguggaga

SEQ ID NO: 615718 - RNA, 61 nt, Homo Sapiens
auaaaugcgcauuuggaaaauuguauguaucugugcaaauagcuuuuaaaaugggaauaau

SEQ ID NO: 615719 - RNA, 61 nt, Homo Sapiens
ccaaaauucaugguuaaauuagaacuuacuaugugcaaauauagaagcacggguccacaga

SEQ ID NO: 615720 - RNA, 61 nt, Homo Sapiens
gcucacacacgaaauggcuaaaaguuacaagugugcaaauuaugacugcgugagccuuaga

SEQ ID NO: 615721 - RNA, 61 nt, Homo Sapiens
acaauacugcuuucucagguucuuaacagccugugcaaacucccugacuagauggucuguc

SEQ ID NO: 615722 - RNA, 61 nt, Homo Sapiens
ugggagccaggaugagugucgggcucucgugugugcaaaaggucagaugugacugcugcug

SEQ ID NO: 615723 - RNA, 61 nt, Homo Sapiens
cauucaaaauggggcagggcaagggugggagugugcaaagcccugaucuggaguuaccuga

SEQ ID NO: 615724 - RNA, 61 nt, Homo Sapiens
auggauacauggcuguucgugacauucuuuaugugcaaauuugugauuucaaaaauguccu

SEQ ID NO: 615725 - RNA, 61 nt, Homo Sapiens
uggguugaacugaacaagaggaugggggaauugugcaaauacguuguuaguagaaggucaa

SEQ ID NO: 615726 - RNA, 61 nt, Homo Sapiens
aucugaucuuuguuuuguauuuuugugcuaaugugcaaacauguacagaagaaauagaaua

SEQ ID NO: 615727 - RNA, 61 nt, Homo Sapiens
aauuauuuuuagcaaaauguugccuuugucuugugcaaacauguagaauaugcucuuuaau

SEQ ID NO: 615728 - RNA, 61 nt, Homo Sapiens
caagaaaugggaggcuucaccuuaaaaacagugugcaaauggcagcuagagguuuugauag

SEQ ID NO: 615729 - RNA, 61 nt, Homo Sapiens
gccagaauguuuccuguggaaauaugcaaccugugcaaaauaaaaugaguuaccucaugcc

SEQ ID NO: 615730 - RNA, 61 nt, Homo Sapiens
auguuuacauacugguuuacaauguuauuuaugugcaaauugucaaaauguaaauuaaaua

SEQ ID NO: 615731 - RNA, 61 nt, Homo Sapiens
ggggugcuaaaacuuuaaaaaaaaucucuacugugcaaauaucauuauucacucagacuuc

SEQ ID NO: 615732 - RNA, 61 nt, Homo Sapiens
aaugagcccggaacgcaggcccccaugucucugugcaaagccucccugcuucccucugcug

SEQ ID NO: 615733 - RNA, 61 nt, Homo Sapiens
acaagccagagaucucccacaccuccagagaugugcaaacagcugggaggaaaagccuggg

SEQ ID NO: 615734 - RNA, 61 nt, Homo Sapiens
aacacagauaguaguaaaaagauucaccuugugugcaaagagaucucuuauugaguuggga

SEQ ID NO: 615735 - RNA, 61 nt, Homo Sapiens
aaggagacuuuauggagaguuagcacaaagaugugcaaagauuacaaguagcuaauuauuu

SEQ ID NO: 615736 - RNA, 61 nt, Homo Sapiens
caggucugugugugcaaucugggcaggagugugugcaaacaaccaccguggguacauuguu

SEQ ID NO: 615737 - RNA, 61 nt, Homo Sapiens
auagguaaauauuuuucuuuaaaaagaaaauugugcaaagcagacgccgucucaaaaaaaa

SEQ ID NO: 615738 - RNA, 61 nt, Homo Sapiens
uuuuuccucuaauguauaaugagggaauguuugugcaaaauuauaagacuacuggcuuugu

SEQ ID NO: 615739 - RNA, 61 nt, Homo Sapiens
gcguccauuuuuucauauuaacuagcugcuaugugcaaacaaacagaacaggagguaucaa

SEQ ID NO: 615740 - RNA, 61 nt, Homo Sapiens
auaauuuaaauauguuaauuaaguaaucugaugugcaaauugagcucugacacaucugaaa

SEQ ID NO: 615741 - RNA, 61 nt, Homo Sapiens
cauuuuuguuacaaaccuguuugugaggaacugugcaaagacuuuagcuauuaauggggca

SEQ ID NO: 615742 - RNA, 61 nt, Homo Sapiens
guaguaccacguguagcauuuuugaucaaacugugcaaacagacucaaaguagaucguuau

SEQ ID NO: 615743 - RNA, 61 nt, Homo Sapiens
uaccaaauuuguguccugugaauugacaacaugugcaaaaacaggccugcuuuuugcuuau

SEQ ID NO: 615744 - RNA, 61 nt, Homo Sapiens
cauaguaaaguucguuuuuuaaaagaaaagcugugcaaauuugaaucuuaaaaggaagaag

SEQ ID NO: 615745 - RNA, 61 nt, Homo Sapiens
augcccuucugcacaggagacagccaugcacugugcaaagccaauuacauaguaccgauaa

SEQ ID NO: 615746 - RNA, 61 nt, Homo Sapiens
agugagucaccccuuugauccuuuuguuuccugugcaaacaaugccaacacuuccuuuugc

SEQ ID NO: 615747 - RNA, 61 nt, Homo Sapiens
aaauguaaauauuuucuugagccaucccuuuugugcaaaacucucgcuuuggaaaaagacg

SEQ ID NO: 615748 - RNA, 61 nt, Homo Sapiens
uuuaguaucagaaaauacgaaauccaacuucugugcaaaauacaugcaauuagccuuuuga

SEQ ID NO: 615749 - RNA, 61 nt, Homo Sapiens
auggcuucagagguggaagacagaucacaugugugcaaauuuggcagcuuuagcccuccuc

SEQ ID NO: 615750 - RNA, 61 nt, Homo Sapiens
aaaaugcuucauuugccacacagagacugcaugugcaaaguacagucuccucguguaucuc

SEQ ID NO: 615751 - RNA, 61 nt, Homo Sapiens
uaaaucagaggcuucuacaaugagccugguuugugcaaaauccauaggcguuuuguucaua

SEQ ID NO: 615752 - RNA, 61 nt, Homo Sapiens
uuauuugaguuuuuuacuguuuauggaauauugugcaaauguuuuuuguauauaaauguau

SEQ ID NO: 615753 - RNA, 61 nt, Homo Sapiens
cagcagacagccauggcucuucccagcagccugugcaaauucugaugauggccccaccccc

SEQ ID NO: 615754 - RNA, 61 nt, Homo Sapiens
gaguuacugauacagauucauuuaaggcuugugugcaaauuuugucucaaucuuuuuuccc

SEQ ID NO: 615755 - RNA, 61 nt, Homo Sapiens
cuaggaauuagcuguauaguuaaguuaugccugugcaaagaagaggcucaaaugcuguccc

SEQ ID NO: 615756 - RNA, 61 nt, Homo Sapiens
gccccagggguuggcccaugcuuucccuaacugugcaaaaaugguuugggauaggcugggu

SEQ ID NO: 615757 - RNA, 61 nt, Homo Sapiens
aagaaaacuucuuguagccucacauuccccuugugcaaagagcucuuuuggaccuacauac

SEQ ID NO: 615758 - RNA, 61 nt, Homo Sapiens
agaccuuuucuuuuuuuuuuuuuuuuuaaugugugcaaaagcccaaagguuccuaagccug

SEQ ID NO: 615759 - RNA, 61 nt, Homo Sapiens
acaagcugaguguucauguuccauggugggcugugcaaauaaacuccuuuuagaccugcag

SEQ ID NO: 615760 - RNA, 61 nt, Homo Sapiens
auuucuauauguaaauaaaagauauaaugauugugcaaauuuauauuccuagugucuuccu

SEQ ID NO: 615761 - RNA, 61 nt, Homo Sapiens
gcccaguccagagacaaaacaucuguacuccugugcaaaauaucugcacccucuggagggc

SEQ ID NO: 615762 - RNA, 61 nt, Homo Sapiens
gaagcaugugguggcucucauuggcauucuuugugcaaaaaacucaauuuuauguuuccuu

SEQ ID NO: 615763 - RNA, 61 nt, Homo Sapiens
aauguaagaggaaaaaaaguaauggagcaugugugcaaaaaaaaccuugggaagauguauc

SEQ ID NO: 615764 - RNA, 61 nt, Homo Sapiens
cugaugaugaccccacccccucccagcagccugugcaaauucagcagacagccauggcucu

SEQ ID NO: 615765 - RNA, 61 nt, Homo Sapiens
aacuuugauaaaauagaaauauuacaccaacugugcaaaugaaagaaauguuaguaucuca

SEQ ID NO: 615766 - RNA, 61 nt, Homo Sapiens
cccuucagcacaggaccugggccacaaaagaugugcaaaugcccacauuuuccugagagaa

SEQ ID NO: 615767 - RNA, 61 nt, Homo Sapiens
gaaaacaaauuuugaaaaauugaaggguuuaugugcaaaguuucauuuguuaucuacauuu

SEQ ID NO: 615768 - RNA, 61 nt, Homo Sapiens
uuucauuccauaacagucuucuccaaggaguugugcaaacucauguagcggacuuuaacug

SEQ ID NO: 615769 - RNA, 61 nt, Homo Sapiens
uaucuuggccuuggccgugucacauucuaacugugcaaaauauuguggcugguuucuugaa

SEQ ID NO: 615770 - RNA, 61 nt, Homo Sapiens
gguucccuagcaaaguauuugggugucugcgugugcaaacgauaaugggagcauguggaug

SEQ ID NO: 615771 - RNA, 61 nt, Homo Sapiens
cuguaugugcauuaaaaauccccuucuagccugugcaaaccacuggggcucuccugaggcc

SEQ ID NO: 615772 - RNA, 61 nt, Homo Sapiens
guguuucagccguauagugguuagauaaucuugugcaaaaucucgauuuaaacuccagcau

SEQ ID NO: 615773 - RNA, 61 nt, Homo Sapiens
ucuccacacccuagagcuuuucucuaaauauugugcaaaguuuuugcuaguuuuaucuucu

SEQ ID NO: 615774 - RNA, 61 nt, Homo Sapiens
uaauuuuauuuuguacaauguuuuuuuuaaaugugcaaauacuguauucaagugaaaaaaa

SEQ ID NO: 615775 - RNA, 61 nt, Homo Sapiens
uacagaggguaggaauggguauaccucuaacugugcaaagcagagugaaauucaauucaua

SEQ ID NO: 615776 - RNA, 61 nt, Homo Sapiens
gucaacacccacaggagagaauaaaauuaccugugcaaagguguauugugguguguguaac

SEQ ID NO: 615777 - RNA, 61 nt, Homo Sapiens
gccuuauauuuugauguaaagauuaaaagaaugugcaaaacagucagaaauuuuuauugcc

SEQ ID NO: 615778 - RNA, 61 nt, Homo Sapiens
aaaaaaaaaaauuuauguguauauguaagacugugcaaaaaauucauagaccuugacugga

SEQ ID NO: 615779 - RNA, 61 nt, Homo Sapiens
gucgauucagcgaaacuuaaauauagcacguugugcaaacuacuugguuuugacccacaga

SEQ ID NO: 615780 - RNA, 61 nt, Homo Sapiens
guuucauguauaucucauugagggccuacugugugcaaaguaaaggaacucacauuuauug

SEQ ID NO: 615781 - RNA, 61 nt, Homo Sapiens
gcaaaacugacuacauuuuucaaauaccaacugugcaaauuguccuuacugcugugaagaa

SEQ ID NO: 615782 - RNA, 61 nt, Homo Sapiens
auugaagguagaaguuuucuuccugugaaucugugcaaaacaguagcauuuuuuuucccuc

SEQ ID NO: 615783 - RNA, 61 nt, Homo Sapiens
caaccagaaguacacauuuacaauagauagaugugcaaaagaccuuuuuguagccaaacaa

SEQ ID NO: 615784 - RNA, 61 nt, Homo Sapiens
auauuuaaacuuacagauggaaauugcccaaugugcaaauuguuaaguaccacacuuuaca

SEQ ID NO: 615785 - RNA, 61 nt, Homo Sapiens
uuauucuuuaaaauugaacuccaacccugauugugcaaacugauuaaagaauggaugguac

SEQ ID NO: 615786 - RNA, 61 nt, Homo Sapiens
cugcacugaaaggaccugcauagacuaugucugugcaaagugccugagugucugcuuucac

SEQ ID NO: 615787 - RNA, 61 nt, Homo Sapiens
aaggauuucagauuauagucuaugugagauaugugcaaacauguacauauuuccccuagaa

SEQ ID NO: 615788 - RNA, 61 nt, Homo Sapiens
auugaaaagcucucugaugagcaccuccuuuugugcaaaguuaauuuuuucucgacaauaa

SEQ ID NO: 615789 - RNA, 61 nt, Homo Sapiens
accugggccagcggcugagcuguacauaccgugugcaaaguguauaugaaguuauuuauuc

SEQ ID NO: 615790 - RNA, 61 nt, Homo Sapiens
cagcugaccuccggucaccugcuuccccuucugugcaaauaaaccaggcuguuaucugggg

SEQ ID NO: 615791 - RNA, 61 nt, Homo Sapiens
gcaguccaugaaaaccagaaagugagcucgaugugcaaaacgugcuaggacagcucuaaac

SEQ ID NO: 615792 - RNA, 61 nt, Homo Sapiens
ucuguuagucagugauucuuaaaacagucauugugcaaaaugcaucuucauugagggaaag

SEQ ID NO: 615793 - RNA, 61 nt, Homo Sapiens
cagcacguaauguguaaguucagcuggggcaugugcaaaggagaaaagaaaaagggcauuc

SEQ ID NO: 615794 - RNA, 61 nt, Homo Sapiens
cccuggggcuccuucuagcugagggaggaguugugcaaaggggggaagagcauuccaggga

SEQ ID NO: 615795 - RNA, 61 nt, Homo Sapiens
ggaaaacagagcgucuuuuuaaauacauuuuugugcaaaauuguacuuugggaagucacag

SEQ ID NO: 615796 - RNA, 61 nt, Homo Sapiens
caaaagcaacacuccugaguuguaugauuucugugcaaaaaaggaagugugaaguuuugug

SEQ ID NO: 615797 - RNA, 61 nt, Homo Sapiens
cacagaccuuuugcaaagaguggguacgaagugugcaaaguauuuauuguuuucaucuauu

SEQ ID NO: 615798 - RNA, 61 nt, Homo Sapiens
acaugcuguuuuaccuuccaagaauaggacaugugcaaaaacuaggcuuccagaucgugag

SEQ ID NO: 615799 - RNA, 61 nt, Homo Sapiens
uuuucuccagacagaaaugcaaagaucaaacugugcaaauauuaaaaaaaugcacaugcug

SEQ ID NO: 615800 - RNA, 61 nt, Homo Sapiens
ccuccauuacggagaguuuccuauguuucacugugcaaauauaucugcuauucuccauacu

SEQ ID NO: 615801 - RNA, 61 nt, Homo Sapiens
uuuucauugugaucagauuaaaauuacuauuugugcaaaacaaauuccacaccacauguac

SEQ ID NO: 615802 - RNA, 61 nt, Homo Sapiens
uguauguguaaaacaaucuguuuuggcuuuaugugcaaaaucuguuauagcuuuaaaauau

SEQ ID NO: 615803 - RNA, 61 nt, Homo Sapiens
ugcaguguucguccccuauucauuaacagugugugcaaaugcaaccccaggacacauuauu

SEQ ID NO: 615804 - RNA, 61 nt, Homo Sapiens
aaacuauugucucgcuccuuguucagaaaaaugugcaaaggaucauuaaauuuuucucaua

SEQ ID NO: 615805 - RNA, 61 nt, Homo Sapiens
ucaguuucuucucagcaacauuuucugcuguugugcaaaguguacccgcgacuaacuagac

SEQ ID NO: 615806 - RNA, 61 nt, Homo Sapiens
uuuuuuaaggcaguauuaagacaaagagaaaugugcaaauagcaaaaagaagccaugugua

SEQ ID NO: 615807 - RNA, 61 nt, Homo Sapiens
caggcagaucuccugcccuccucacagcugcugugcaaacuccugcagccuggacucggca

SEQ ID NO: 615808 - RNA, 61 nt, Homo Sapiens
ccucuuaugagggaccaauucauuugcaaaaugugcaaagauugacauccaauucaaacug

SEQ ID NO: 615809 - RNA, 61 nt, Homo Sapiens
aauuccagaggggagaagaagcuacaauugcugugcaaagaggaggagcuuaguaaguggu

SEQ ID NO: 615810 - RNA, 61 nt, Homo Sapiens
aauuggaaggauguggugugcuagccuguguugugcaaaagcucucugcccauuacagcuu

SEQ ID NO: 615811 - RNA, 61 nt, Homo Sapiens
aaugcuuaguaaguacacagcagaaaauccuugugcaaauaacagcaaaguuaaccugaca

SEQ ID NO: 615812 - RNA, 61 nt, Homo Sapiens
auagucaaauguacuguaaagugaaaagggaugugcaaaaaaauaaaaaaaaacaacaaaa

SEQ ID NO: 615813 - RNA, 61 nt, Homo Sapiens
aacaggaugcucauagcuuaauaauaaaagcugugcaaaggccaugaaugaaugaauuuuc

SEQ ID NO: 615814 - RNA, 61 nt, Homo Sapiens
cuaacguauuaucuuuuucaaaccagauuuaugugcaaagguuaaacauguaacuguuacu

SEQ ID NO: 615815 - RNA, 61 nt, Homo Sapiens
caucacuggaugaagauucuccugugcuagaugugcaaaugcaagcuaguggcuucaaaau

SEQ ID NO: 615816 - RNA, 61 nt, Homo Sapiens
aguaagcaagauuuaacuguuugauuauaacugugcaaauacagaaaaaaagaaggcuggc

SEQ ID NO: 615817 - RNA, 61 nt, Homo Sapiens
auaacaaagcaguuacgaagccuacagauuuugugcaaaauaaaauacaaacaaggugaau

SEQ ID NO: 615818 - RNA, 61 nt, Homo Sapiens
gugacuuuugggcccggggccaugcccgggcugugcaaagcuggccagggccuccuguagg

SEQ ID NO: 615819 - RNA, 61 nt, Homo Sapiens
cagggaauguguuccacagagagggacagcaugugcaaaggcugagcaccaacacauagug

SEQ ID NO: 615820 - RNA, 61 nt, Homo Sapiens
aggugcuuguugugugaaaguucuguagaugugugcaaauuuaacgaaaugaaauuguaug

SEQ ID NO: 615821 - RNA, 61 nt, Homo Sapiens
auggacaauccaagaagaaauugguauacuuugugcaaaucugccauaagcucaaggcugu

SEQ ID NO: 615822 - RNA, 61 nt, Homo Sapiens
gacugaaacucaaacaacccugggcaaguaaugugcaaaagauggcaggguggggauuuga

SEQ ID NO: 615823 - RNA, 61 nt, Homo Sapiens
acuccucugcagggagcgccaucugugugcgugugcaaauaugacucaauucacguaaaga

SEQ ID NO: 615824 - RNA, 61 nt, Homo Sapiens
auuucauuguuucuguuacuaacauuaaaagugugcaaauuguauaaaauuagguacuucg

SEQ ID NO: 615825 - RNA, 61 nt, Homo Sapiens
auuuuuaccuggaaauuccaugaccaauacaugugcaaaagaaaaugauggguugaauuua

SEQ ID NO: 615826 - RNA, 61 nt, Homo Sapiens
gacggugguguguguucucuaggggcacacgugugcaaagaaugagccccccgggccggac

SEQ ID NO: 615827 - RNA, 61 nt, Homo Sapiens
auacuguugcuaugauguaaaagccuuaaauugugcaaaacgcugacuaaagaaccagcca

SEQ ID NO: 615828 - RNA, 61 nt, Homo Sapiens
ccuauaaaagugauauuccuaaacaaacaucugugcaaaacucucaguagaaaggaacaga

SEQ ID NO: 615829 - RNA, 61 nt, Homo Sapiens
aauuuuuaaaaaucaaaauccucuaaaauuaugugcaaaucuuuuaaccaauagauauucu

SEQ ID NO: 615830 - RNA, 61 nt, Homo Sapiens
caacaguauuugccuuaagacguccagcccaugugcaaaguuagguaaagaguuccaaguu

SEQ ID NO: 615831 - RNA, 61 nt, Homo Sapiens
uuuaucguacuuuuuaaauauaagucugauuugugcaaauucagcauacugacucaauucu

SEQ ID NO: 615832 - RNA, 61 nt, Homo Sapiens
cacaagcacgcaaguauuaauacccauccauugugcaaaacguauccaaggcaaacucuaa

SEQ ID NO: 615833 - RNA, 61 nt, Homo Sapiens
ugaggagcgacacacacaccuguaggcauccugugcaaacacuuugucauuaucaagagag

SEQ ID NO: 615834 - RNA, 61 nt, Homo Sapiens
aguguagucauuauuguuguauugggugaugugugcaaaacugcagaagcucacugccuau

SEQ ID NO: 615835 - RNA, 61 nt, Homo Sapiens
gauacuaccauccaaaucuaucuagauaucuugugcaaauauuuuauugauuacaagggcu

SEQ ID NO: 615836 - RNA, 61 nt, Homo Sapiens
uuaacuuaaaaacaacuguuaauguucuaguugugcaaagcaguuugccuguggauaagau

SEQ ID NO: 615837 - RNA, 61 nt, Homo Sapiens
uacacaauggacccucaauaaauggccuauaugugcaaagaaagaauguguagcaaaugaa

SEQ ID NO: 615838 - RNA, 61 nt, Homo Sapiens
gaaauuucuguaccuucaaccugguguuaggugugcaaaguccguguccuaccuccgucuu

SEQ ID NO: 615839 - RNA, 61 nt, Homo Sapiens
gucaggagaaaaccaccuucauaaacugcucugugcaaagaggaauaaaacauuuuuucca

SEQ ID NO: 615840 - RNA, 61 nt, Homo Sapiens
caaaacaggacaucuuauggccugcuuuacaugugcaaagaagcuaaagaaaaggaauaag

SEQ ID NO: 615841 - RNA, 61 nt, Homo Sapiens
aaggaccugaauucuguuuacuucuucuggcugugcaaaagcacacucaagugaaugacua

SEQ ID NO: 615842 - RNA, 61 nt, Homo Sapiens
ggaccugagucaaugcgcaaaaugcagcuugugugcaaaagcagugggcuccuggcagaag

SEQ ID NO: 615843 - RNA, 61 nt, Homo Sapiens
gggaauacuucaugcaaagaaaaaaguaacaugugcaaaagcuccccguccagcuuugaca

SEQ ID NO: 615844 - RNA, 61 nt, Homo Sapiens
cucgagucaccaccacagugcuaucaggccaugugcaaaccuucagagugacuauguauga

SEQ ID NO: 615845 - RNA, 61 nt, Homo Sapiens
cuuggacauacuucugcuauuuugauuacccugugcaaaacaaaugucugaagccaguuag

SEQ ID NO: 615846 - RNA, 61 nt, Homo Sapiens
uugacauuaacagcugaauguggcauuugagugugcaaaccguuagaugccccgaucccac

SEQ ID NO: 615847 - RNA, 61 nt, Homo Sapiens
gcucucggggucuuuccucagggaagcgcgcugugcaaagcagagcaguguuucggacgcu

SEQ ID NO: 615848 - RNA, 61 nt, Homo Sapiens
agguuuuagaacucugcaguagugguggaccugugcaaagguccuagaaauccuggguaga

SEQ ID NO: 615849 - RNA, 61 nt, Homo Sapiens
uaaauaaauauuucucuuacaagcucguucuugugcaaaauugguugaauuuguucaguau

SEQ ID NO: 615850 - RNA, 61 nt, Homo Sapiens
ccuagacucacuucauggauaccagagucccugugcaaacagugggcacaaaagaaggggc

SEQ ID NO: 615851 - RNA, 61 nt, Homo Sapiens
cuuuuacugguugcauggaacugucaaaugaugugcaaaacuuaguguuuuuuuauuucua

SEQ ID NO: 615852 - RNA, 61 nt, Homo Sapiens
agauaaggaaugaauauaaaaaggaguuucaugugcaaagguagaggugauuaaaaccaac

SEQ ID NO: 615853 - RNA, 61 nt, Homo Sapiens
auaccuuggaccauauaggcaaaaacuacugugugcaaauuugauccacaauauaaaaacc

SEQ ID NO: 615854 - RNA, 61 nt, Homo Sapiens
uaggucuucccaguugucucuauuuaaugcaugugcaaaguuugccaacucaaaauaacau

SEQ ID NO: 615855 - RNA, 61 nt, Homo Sapiens
uuuucauugaaaaauaaaauaauuuuucuaaugugcaaacugcccaccccugacccuuacu

SEQ ID NO: 615856 - RNA, 61 nt, Homo Sapiens
uaaaugaauggcaauagauuuuauacguuuuugugcaaaaaaagaaaagcuggugacauau

SEQ ID NO: 615857 - RNA, 61 nt, Homo Sapiens
cccuccccaaacccacccauauccaauggauugugcaaauccccucaugugacaugaaccc

SEQ ID NO: 615858 - RNA, 61 nt, Homo Sapiens
caaaucuaguuauguauuggccuaaauuauuugugcaaaauuugaaauguuuuuuauuuaa

SEQ ID NO: 615859 - RNA, 61 nt, Homo Sapiens
cacuuaggaauguguaaaugguaaagucugaugugcaaacguuuuaccauaguuagagcca

SEQ ID NO: 615860 - RNA, 61 nt, Homo Sapiens
aacaauacauuccacaaagccauuuucuuuuugugcaaaccugacauguucaaauauauuc

SEQ ID NO: 615861 - RNA, 61 nt, Homo Sapiens
aguuaauagauuuuuucagacuugucaagccugugcaaaaaaauuaaaauggaugccuuga

SEQ ID NO: 615862 - RNA, 61 nt, Homo Sapiens
uggguuaggcauuaauguuucuaucugauuuugugcaaaagcuucaaauuaaaacagcugc

SEQ ID NO: 615863 - RNA, 61 nt, Homo Sapiens
uugcauaguugcacuacaagaagaauguaguugugcaaaucuaugcaaaacugaugguggc

SEQ ID NO: 615864 - RNA, 61 nt, Homo Sapiens
cagguuugcauccagcugugugauauucugcugugcaaauccaugcaaaacugacuguggu

SEQ ID NO: 615865 - RNA, 61 nt, Homo Sapiens
agaugcuguugugaagcuaaugucacaauuaugugcaaaggugugcuuccugcuguaugug

SEQ ID NO: 615866 - RNA, 61 nt, Homo Sapiens
cuuuuaggcauuuaaauuguuucuguuacucugugcaaaauaacuuugagauuggacaaga

SEQ ID NO: 615867 - RNA, 61 nt, Homo Sapiens
gcaaaaagccuuuacagaagcuaaaaucacuugugcaaauuacaacaacuuacuaaaccag

SEQ ID NO: 615868 - RNA, 61 nt, Homo Sapiens
uuuguauaauucuguguuauacaugugaugcugugcaaaaccauauagcauaugugucauu

SEQ ID NO: 615869 - RNA, 61 nt, Homo Sapiens
gauaugggcaccacgaaauaaauuccauauaugugcaaacaauuuaaaauuuucaaaauga

SEQ ID NO: 615870 - RNA, 61 nt, Homo Sapiens
auaucaccuaugcagccuuggcuuugugaaaugugcaaaugaucaguuauuguacaugauu

SEQ ID NO: 615871 - RNA, 61 nt, Homo Sapiens
ccaccaaaaugcuccuauccagaugcaagucugugcaaaacugaugucacauucugacaca

SEQ ID NO: 615872 - RNA, 61 nt, Homo Sapiens
uuuuuuauuauugcauuuuagaucucuccauugugcaaauuaauugauuacacucuccaga

SEQ ID NO: 615873 - RNA, 61 nt, Homo Sapiens
ucucuagaguuuaguccuuagcuaguuaaggugugcaaagaacuugucacacggaccucgg

SEQ ID NO: 615874 - RNA, 61 nt, Homo Sapiens
agucguauacucaaaugaugauaaaccuacaugugcaaaggcucacguuuaagauugucaa

SEQ ID NO: 615875 - RNA, 61 nt, Homo Sapiens
cuguacauucucuuucuaguuuaguaaaagaugugcaaaggccagagagggccgaaaauga

SEQ ID NO: 615876 - RNA, 61 nt, Homo Sapiens
ccuccauuaucagccagaagugcaacauguaugugcaaaagcuaaaauggcuuaacaucau

SEQ ID NO: 615877 - RNA, 61 nt, Homo Sapiens
caguaauucaacuuaaaauaguagaaauguuugugcaaauuuuguuuuuuaaaacaauucu

SEQ ID NO: 615878 - RNA, 61 nt, Homo Sapiens
gugaaauauuauuuuauuauuagucagacucugugcaaauugguaauaugccucugcccuu

SEQ ID NO: 615879 - RNA, 61 nt, Homo Sapiens
acaggcaagacaacaaagcccagagccuaaaugugcaaauuacuauuuuauaaacaaacua

SEQ ID NO: 615880 - RNA, 61 nt, Homo Sapiens
uugaacaaagaggaaaucauaauucuucauuugugcaaaauuguuuccugcaguaaagaaa

SEQ ID NO: 615881 - RNA, 61 nt, Homo Sapiens
aggaaggucugggaaugacccuaugaaggguugugcaaaaccguugcagucacucgguuau

SEQ ID NO: 615882 - RNA, 61 nt, Homo Sapiens
aaauucuaagugaaugcgcgucaacuuuaguugugcaaaagagcuauuuuucugaucuuau

SEQ ID NO: 615883 - RNA, 61 nt, Homo Sapiens
auugauuacuccuugcagagggcaguggcagugugcaaagaccuggugggugaggggcagg

SEQ ID NO: 615884 - RNA, 61 nt, Homo Sapiens
uuccaucaugucaaggucacaggcauccaugugugcaaaccaucugccccagcugccucca

SEQ ID NO: 615885 - RNA, 61 nt, Homo Sapiens
guuaauuuaauuuuuaaaugcuuuauccauuugugcaaagguaaacgcagauuguaucuuu

SEQ ID NO: 615886 - RNA, 61 nt, Homo Sapiens
uauucaccuuuuguuuaugaauggaaagcuuugugcaaaauauacauauaagcagaguaag

SEQ ID NO: 615887 - RNA, 61 nt, Homo Sapiens
gaaagaaacagaagucaggcagaggcgugucugugcaaacuggaggacuccuuccaacuuc

SEQ ID NO: 615888 - RNA, 61 nt, Homo Sapiens
gcacugguucgggagcccccaucagccuccuugugcaaacugggcccccaugccacagucu

SEQ ID NO: 615889 - RNA, 61 nt, Homo Sapiens
uuuuuagaucuggccuuuucuuaacaaaaucugugcaaaagaugcagguggaugucccuag

SEQ ID NO: 615890 - RNA, 61 nt, Homo Sapiens
uauauaucccuguuaaaaacugggaugaagaugugcaaagucacagaauguaauggaaguc

SEQ ID NO: 615891 - RNA, 61 nt, Homo Sapiens
cuucgaccugcugauccuuggauccugaaucugugcaaacaguaacgugugcgcacgcgca

SEQ ID NO: 615892 - RNA, 61 nt, Homo Sapiens
cuguucccuacaaugggaaaugucacaagaaugugcaaaaauaaaaaucugaggaaaaaac

SEQ ID NO: 615893 - RNA, 61 nt, Homo Sapiens
uuacacacaugcacacacauaugcacacacaugugcaaacauagccacuuuuuugucaaga

SEQ ID NO: 615894 - RNA, 61 nt, Homo Sapiens
cuugagaaucaaucaauaaaaaagaguuuucugugcaaaauuuacugcuguucuagccccc

SEQ ID NO: 615895 - RNA, 61 nt, Homo Sapiens
cuccauagcugugccuaggagguaugggcacugugcaaagauuuucauuauuaauuuuuag

SEQ ID NO: 615896 - RNA, 61 nt, Homo Sapiens
auuuagagcauagacuuuauuuguuuacaaaugugcaaauucaucuuuggucaucuaagau

SEQ ID NO: 615897 - RNA, 61 nt, Homo Sapiens
cgauauguugcuuaggcauauucaguggccuugugcaaauauguuacuaauauccaugaca

SEQ ID NO: 615898 - RNA, 61 nt, Homo Sapiens
gaccacacucccaaagaaucgucaagucaggugugcaaauuugugcugaccgucagauugu

SEQ ID NO: 615899 - RNA, 61 nt, Homo Sapiens
uaaaauggacagaauugcagcuaguuuuuccugugcaaaaaacuguuugaaucuugucuca

SEQ ID NO: 615900 - RNA, 61 nt, Homo Sapiens
uacauuuucuucuggccuaaaugaauauuuaugugcaaacauaggcaacuguuaaaggcug

SEQ ID NO: 615901 - RNA, 61 nt, Homo Sapiens
guagcacuugugcaucugaguugaaugaagcugugcaaacccacccuuuaaaccauuccac

SEQ ID NO: 615902 - RNA, 61 nt, Homo Sapiens
uauguugaagccuuuguaaauugucagaugcugugcaaauguuauuauuuuaaacauuaug

SEQ ID NO: 615903 - RNA, 61 nt, Homo Sapiens
gugggagacagagcuggaccccuugaagcucugugcaaaagcccugacuucuggaggcuuc

SEQ ID NO: 615904 - RNA, 61 nt, Homo Sapiens
aaaacguguguaucaaguauagcauuuucuuugugcaaauaaaaauucuggcuccaaaaau

SEQ ID NO: 615905 - RNA, 61 nt, Homo Sapiens
cugcuagagucauuuugaaguaaaacaaauuugugcaaacagucuucagaagaccucgcuu

SEQ ID NO: 615906 - RNA, 61 nt, Homo Sapiens
uuagcaauuuguaggaaacuggcuucucccuugugcaaagcuccaugcacuaguacaugua

SEQ ID NO: 615907 - RNA, 61 nt, Homo Sapiens
aaguauacuugacuuuucaacuuggcaagugugugcaaaucagugguugaauccugugaga

SEQ ID NO: 615908 - RNA, 61 nt, Homo Sapiens
ugacaagauggagaaagcaagaucaugaaggugugcaaaugauucuuacggcauggacaag

SEQ ID NO: 615909 - RNA, 61 nt, Homo Sapiens
ucagccuggauuucuggucuuugguuauuucugugcaaacaaaaggugugccuggcagcca

SEQ ID NO: 615910 - RNA, 61 nt, Homo Sapiens
cagacuguuccuuuaccaauauguaaaagaaugugcaaaauuaguaaaaauauacccaaaa

SEQ ID NO: 615911 - RNA, 61 nt, Homo Sapiens
ggaacggugaucuucuugaaugauguuucagugugcaaaaacuauagagccugucagcacc

SEQ ID NO: 615912 - RNA, 61 nt, Homo Sapiens
caaaauguuuggauguaauguuaaagcgcaaugugcaaaauuuaaaauaaagaauauuuau

SEQ ID NO: 615913 - RNA, 61 nt, Homo Sapiens
gccugguuguaauuuguaaccauuuucuauuugugcaaacucuguaaauauguguuuaaac

SEQ ID NO: 615914 - RNA, 61 nt, Homo Sapiens
uguuugucuuuuauaaugucuucagucugagugugcaaagucaauuuguaauauuuugcaa

SEQ ID NO: 615915 - RNA, 61 nt, Homo Sapiens
cuggugcuccaguuccaguuccacgaaacacugugcaaagccucgggccacauggguccac

SEQ ID NO: 615916 - RNA, 61 nt, Homo Sapiens
uuggacaagcagacacacucgccuugcugccugugcaaauguuugggagcacaccugcuuu

SEQ ID NO: 615917 - RNA, 61 nt, Homo Sapiens
guaaacuuaggaaacauuugugucugugcauugugcaaaaaaccauacauugucccaaaag

SEQ ID NO: 615918 - RNA, 61 nt, Homo Sapiens
ugagcuccggcuccgaccccuaggagagaccugugcaaauccagaagcucagggugcauag

SEQ ID NO: 615919 - RNA, 61 nt, Homo Sapiens
auucuuacggcaugggcgaggaucaugaaggugugcaaaugugacaagauggagaaagcaa

SEQ ID NO: 615920 - RNA, 61 nt, Homo Sapiens
auagauaguucugccucuuuaguggaaacuuugugcaaagagcaucaccuccuccucuugc

SEQ ID NO: 615921 - RNA, 61 nt, Homo Sapiens
ggcagugaguuucgugaagcgguuuuuacuuugugcaaaaaccacagacagaagcuguggu

SEQ ID NO: 615922 - RNA, 61 nt, Homo Sapiens
auucuuaaggcauggacgaggaucacgaaggugugcaaaugugacaagauggagaaagcaa

SEQ ID NO: 615923 - RNA, 61 nt, Homo Sapiens
aaaaaaaaaaaaaaaguuugucuuguuucuaugugcaaaaaugauacuguacacauggaug

SEQ ID NO: 615924 - RNA, 61 nt, Homo Sapiens
ugaacaauaaaucauuucaacucagcacgcgugugcaaaagcaggcuggaccugcccuguc

SEQ ID NO: 615925 - RNA, 61 nt, Homo Sapiens
auaccacaaagccaagacguuccaugguauuugugcaaaagagaugaagacuucucaauau

SEQ ID NO: 615926 - RNA, 61 nt, Homo Sapiens
gguaauuccagcuaaugggagagaauguaaaugugcaaagguacauauuaagcuuagggau

SEQ ID NO: 615927 - RNA, 61 nt, Homo Sapiens
acugaaaguauggucgggugucagauauaaaugugcaaaugccuucuugcuguccugucgg

SEQ ID NO: 615928 - RNA, 61 nt, Homo Sapiens
cagacccuguaguccaguggugcugcccuguugugcaaacugcuccuuuuucucguguuuu

SEQ ID NO: 615929 - RNA, 61 nt, Homo Sapiens
cugugguaucuuuuauaaaaccucuugcuugugugcaaaaguuccuaaaaggaaacacaag

SEQ ID NO: 615930 - RNA, 61 nt, Homo Sapiens
ucaguucuacggaucaucaacaagauuuccuugugcaaaauauuugacuauucuguaucuu

SEQ ID NO: 615931 - RNA, 61 nt, Homo Sapiens
cugacugaaugccaggagcugaacauuaauaugugcaaagauuggcucuccaacaagaagg

SEQ ID NO: 615932 - RNA, 61 nt, Homo Sapiens
ggaaaggagggguuuuuacacguuugugacgugugcaaauggcccagcccugugugugaau

SEQ ID NO: 615933 - RNA, 61 nt, Homo Sapiens
gagauuucuagccaggcauugaccuuuucacugugcaaagguuauuuuauucuuguaaugu

SEQ ID NO: 615934 - RNA, 61 nt, Homo Sapiens
guuuaaaaauuagauguguuauaaauuaaugugugcaaauuauauuuuguauauaugugau

SEQ ID NO: 615935 - RNA, 61 nt, Homo Sapiens
guuguccugcauauaaaaguuaauucugucaugugcaaaugguccuccaguuuguauuuau

SEQ ID NO: 615936 - RNA, 61 nt, Homo Sapiens
aguauguacaggcugagacaaucauucagaaugugcaaagcgggacgacuuucuuuaacau

SEQ ID NO: 615937 - RNA, 61 nt, Homo Sapiens
auccuguacaucuaaguaaugggggaaaaccugugcaaauuaauucacauacaugguucag

SEQ ID NO: 615938 - RNA, 61 nt, Homo Sapiens
cuccccacgaagguaucucugugucuuacucugugcaaagacgcggcaaaacccagugccc

SEQ ID NO: 615939 - RNA, 61 nt, Homo Sapiens
cagucaaugggggaccgcccgugucuaagcaugugcaaaggagaggagggagaugagguca

SEQ ID NO: 615940 - RNA, 61 nt, Homo Sapiens
cacuagggagaaacccuaucaauguaagcaaugugcaaaagccuuuauuucuuccacuucu

SEQ ID NO: 615941 - RNA, 61 nt, Homo Sapiens
ggaucacuugaggucaggaguuugagaccagugugcaaaacauagcaagaccucaucucag

SEQ ID NO: 615942 - RNA, 61 nt, Homo Sapiens
caggguaggacaggcaagaccagauacccaaugugcaaagugaaaacacugggcucccugu

SEQ ID NO: 615943 - RNA, 61 nt, Homo Sapiens
guucaacaucagggaauuuauauugaaaaauugugcaaauauaauaaauuuggaaaaacaa

SEQ ID NO: 615944 - RNA, 61 nt, Homo Sapiens
gugugcacgcgugugagugugcaugugugugugugcaaagguccagccaccccguccucca

SEQ ID NO: 615945 - RNA, 61 nt, Homo Sapiens
gggaguggggcaggcagugguugguggguggugugcaaagggaaugaagagcguccugggc

SEQ ID NO: 615946 - RNA, 61 nt, Homo Sapiens
gcagggaugagacaauauugugcccugggucugugcaaacguugggaccagaauccacuau

SEQ ID NO: 615947 - RNA, 61 nt, Homo Sapiens
cuucuccuuauucaccggggaggcugugucuugugcaaacaagucauagaaacuugauggg

SEQ ID NO: 615948 - RNA, 61 nt, Homo Sapiens
ccuacuacucaggguugaugagaagauuaaaugugcaaaaccugcuugacugugcccacaa

SEQ ID NO: 615949 - RNA, 61 nt, Homo Sapiens
uacugcagagcggucuuaacaauguaaagaaugugcaaauguccucagacaagaugcacac

SEQ ID NO: 615950 - RNA, 59 nt, Homo Sapiens
uggcuauuacaaauaaaccucugaagauuugugugcaaauuauggcugaaugauauucc

SEQ ID NO: 615951 - RNA, 61 nt, Homo Sapiens
ucuguggauaccauuucauuugcaggagaaaugugcaaaccgugcccggccgacgcgccuu

SEQ ID NO: 615952 - RNA, 61 nt, Homo Sapiens
ggugugggucacagacaucaaggggagggagugugcaaauauuuuauuagggauuuucaaa

SEQ ID NO: 615953 - RNA, 61 nt, Homo Sapiens
ggaauagugccguggaggugaaguguuugcuugugcaaaagaauugagagccgcucucugu

SEQ ID NO: 615954 - RNA, 61 nt, Homo Sapiens
ucauggagccuuuugggguauuacucugaguugugcaaagcgaagacucaauugguucaua

SEQ ID NO: 615955 - RNA, 61 nt, Homo Sapiens
ccucccgugcuucccuuuggguuccauccucugugcaaaaucagcucucaggguugacucu

SEQ ID NO: 615956 - RNA, 61 nt, Homo Sapiens
ugggggugacaccacagagacuggaaugaaaugugcaaacacagacaugacaacacacaca

SEQ ID NO: 615957 - RNA, 61 nt, Homo Sapiens
uguggaaaacuguucuugggacugucucaacugugcaaaaaacaaaagauggaguguuuac

SEQ ID NO: 615958 - RNA, 61 nt, Homo Sapiens
auagaggaugauguaauuaaaaaauggucagugugcaaagaaaagaacugcuugcauuucu

SEQ ID NO: 615959 - RNA, 61 nt, Homo Sapiens
augguuacacauuucaguaacucauagcugcugugcaaauugguagaccuuauaagaaggc

SEQ ID NO: 615960 - RNA, 61 nt, Homo Sapiens
acuucuauuucaacuuugaauuuccucuuccugugcaaauuccucuagucaagugugauau

SEQ ID NO: 615961 - RNA, 61 nt, Homo Sapiens
augauguggggcuaagaaaaauaauuguccaugugcaaagaugugggcaagaauggccucu

SEQ ID NO: 615962 - RNA, 61 nt, Homo Sapiens
ucuugagaacuucaacauccucuaaauauucugugcaaauaacaaaacuccucuaaguacu

SEQ ID NO: 615963 - RNA, 61 nt, Homo Sapiens
uuucucaaauauggaaaagauuuuauuuuauugugcaaacaccugcuuucuuccuuucucu

SEQ ID NO: 615964 - RNA, 61 nt, Homo Sapiens
uacuuccuuuaaaugucccaccaguuaguggugugcaaacuaaaaagaaugagagaaaagc

SEQ ID NO: 615965 - RNA, 61 nt, Homo Sapiens
cucuuugcuguuucucugggggacaugagacugugcaaagcagggacagauagcuuuccaa

SEQ ID NO: 615966 - RNA, 61 nt, Homo Sapiens
caguugugagccauucuauuauuaaaguauaugugcaaaaagauuuuacccaagccuaagu

SEQ ID NO: 615967 - RNA, 61 nt, Homo Sapiens
aauguaauguauauuguauugaaauuuacagugugcaaaaguauuuuaccuuugcauaagu

SEQ ID NO: 615968 - RNA, 61 nt, Homo Sapiens
cacccaacuauugguuguaucaguuuguguaugugcaaaugucaaauaaucuuuugcuuua

SEQ ID NO: 615969 - RNA, 61 nt, Homo Sapiens
uagcuagaaaguggagaagcucacuguucacugugcaaagccccaguagucggauuccggg

SEQ ID NO: 615970 - RNA, 61 nt, Homo Sapiens
gaauuaggagagagguuaauugccauuugucugugcaaagaaaaaaaaauaauaaucccag

SEQ ID NO: 615971 - RNA, 61 nt, Homo Sapiens
aucaagauaauucuauaauuugaaaaauucuugugcaaaugugacacauuugaaaaguguu

SEQ ID NO: 615972 - RNA, 61 nt, Homo Sapiens
aagaaaaagaacuguugguuggggaaaugaaugugcaaaaaaguucacuuuuuuuguucua

SEQ ID NO: 615973 - RNA, 61 nt, Homo Sapiens
aaaaucgugguugaguuucaggaaggauuugugugcaaagggcuagggagugguggaagua

SEQ ID NO: 615974 - RNA, 61 nt, Homo Sapiens
ccgcuuccugagcguagggugcaguagugugugugcaaaauucagugaacucuguaugaau

SEQ ID NO: 615975 - RNA, 61 nt, Homo Sapiens
uggaaggucacucaggaacacccucccugccugugcaaagagaaaacaagcgccuuguuuc

SEQ ID NO: 615976 - RNA, 61 nt, Homo Sapiens
agcugaugagcuaaaacaaaaaacaaugguuugugcaaaaaucucauaauguuuuaauaaa

SEQ ID NO: 615977 - RNA, 61 nt, Homo Sapiens
cagguacccauuuuaggacccuacacucaaaugugcaaaauaaaauuucuaucauuuugcu

SEQ ID NO: 615978 - RNA, 61 nt, Homo Sapiens
uauauuuaaaacuugccuggaauguuaauauugugcaaacucuuauuuaugauguauauuu

SEQ ID NO: 615979 - RNA, 61 nt, Homo Sapiens
acgucacaguccugguuucuaaaagagaaugugugcaaaacagucacacacugugaaagug

SEQ ID NO: 615980 - RNA, 61 nt, Homo Sapiens
cuuggcuccgcuacuuguaaaagaaaauggaugugcaaaggcuaguuuuccuuggguucug

SEQ ID NO: 615981 - RNA, 61 nt, Homo Sapiens
uuagacuagcugaauuugucuuuaaaauauuugugcaaagcuauuaauauacacauuuugu

SEQ ID NO: 615982 - RNA, 59 nt, Homo Sapiens
gaaaaugcuuugaaaauugaaaaaauccuugugcaaauuuagauugggccaacuucuag

SEQ ID NO: 615983 - RNA, 61 nt, Homo Sapiens
guugcuuuuguuaugucaaguugaaagauuuugugcaaaauuaaauaaaugguguuuuggg

SEQ ID NO: 615984 - RNA, 61 nt, Homo Sapiens
gagacugaccuuucucaggaauauuuggagcugugcaaauguuaaaauuuaaagauuugau

SEQ ID NO: 615985 - RNA, 61 nt, Homo Sapiens
cuaacagauuuuccaucaacaaauauuguuaugugcaaaaguauugccuauguuguuuuac

SEQ ID NO: 615986 - RNA, 61 nt, Homo Sapiens
uauauagguguacuuugcuucucacaaugauugugcaaaaagucacguguaaauugaacuu

SEQ ID NO: 615987 - RNA, 61 nt, Homo Sapiens
ugaaguguaaauccucaccugggguucucugugugcaaagcuguccuuuugaagaacaguu

SEQ ID NO: 615988 - RNA, 61 nt, Homo Sapiens
cagacgcccacccaccgcuagccguuguuccugugcaaaguagugugcuaugcacccaccc

SEQ ID NO: 615989 - RNA, 61 nt, Homo Sapiens
gguguuuugccagccugaaccuguacgguucugugcaaagaaauggacugugcagcgaaau

SEQ ID NO: 615990 - RNA, 61 nt, Homo Sapiens
gcuuuacuucagaaugguuuaguauugucagugugcaaaagggccucgcugaugucugaua

SEQ ID NO: 615991 - RNA, 61 nt, Homo Sapiens
cuaaguuccuuuuagcaauuugucaaugugcugugcaaaugucucugcuaagcaccauagu

SEQ ID NO: 615992 - RNA, 61 nt, Homo Sapiens
cacucagagaugcauuuggaaugcacacucaugugcaaaccaagagauagagagugaguac

SEQ ID NO: 615993 - RNA, 61 nt, Homo Sapiens
gguuaacguccaaaacgcuucaguuucugaaugugcaaaauagcacugccuauuugguauc

SEQ ID NO: 615994 - RNA, 61 nt, Homo Sapiens
ugaauuaauuucaaauaggagggucacuuguugugcaaaagugccgcuggaauuggcuugu

SEQ ID NO: 615995 - RNA, 61 nt, Homo Sapiens
acuuuuuaugacaagccuaaaacugauugauugugcaaacuuaacaauuggaaaaugaaca

SEQ ID NO: 615996 - RNA, 61 nt, Homo Sapiens
cacuggauuauaaguucuauacagcaaaagaugugcaaaauaauuuaaaacuguuauuuuu

SEQ ID NO: 615997 - RNA, 61 nt, Homo Sapiens
uauuuacuaugcguguuucccuguguuugguugugcaaaugucccugcccccuggagggca

SEQ ID NO: 615998 - RNA, 61 nt, Homo Sapiens
gcaucuauaggaaacauuuucuugcaauaaaugugcaaacuauucugugguuagucaaugg

SEQ ID NO: 615999 - RNA, 61 nt, Homo Sapiens
ggaaccacaguggauaugcuagcauuuuagcugugcaaagggagguagugugggaaaagug

SEQ ID NO: 616000 - RNA, 59 nt, Homo Sapiens
uaaaauaaugauuguaaaauguuuuacaaguaauguaaaagcuaguaucauucuuacau

SEQ ID NO: 616001 - RNA, 59 nt, Homo Sapiens
uugacuuagcuauagcaguacaaugauuaguaauguaaaaauuaacacagaaauuaacc

SEQ ID NO: 616002 - RNA, 59 nt, Homo Sapiens
uuuacuuuuaccaaaaauucugugaacauguaauguaacuggcuuuugagggucuccca

SEQ ID NO: 616003 - RNA, 59 nt, Homo Sapiens
caacaaaaugugauuggucuaaaauauuuguaauguauauuaaaagguucaaaaauauu

SEQ ID NO: 616004 - RNA, 59 nt, Homo Sapiens
aucuauuuagugaucuguaaauaauugaaguaauguaacacuuaauguuuuaauauguc

SEQ ID NO: 616005 - RNA, 59 nt, Homo Sapiens
auauccuguacaaaacaagacuauugccaguaauguauacaaauugucuuuuuguguac

SEQ ID NO: 616006 - RNA, 59 nt, Homo Sapiens
gccucuuaauuuuaugcuuucucaucgaaguaauguacccuuuuuuucugaaacugaau

SEQ ID NO: 616007 - RNA, 59 nt, Homo Sapiens
caauuuuauuuuuuucugcaagaaaaaguguaauguaugaaauaaaccaaagucacuug

SEQ ID NO: 616008 - RNA, 59 nt, Homo Sapiens
uugucuagcuccaguuaucuguauuuuauguaauguaauugacaggauggcugcugcag

SEQ ID NO: 616009 - RNA, 59 nt, Homo Sapiens
uguggagaaguuugaaucaauguauaccuguaauguaaaugauuguacaauuguacauu

SEQ ID NO: 616010 - RNA, 59 nt, Homo Sapiens
acaugcaaugaugcacuuuaguaauuuuaguaauguauaugguaacaauuaugcacugu

SEQ ID NO: 616011 - RNA, 59 nt, Homo Sapiens
uacauauuuuuuauuuccaagguaucaggguaauguauaguuagauauauuuuggccua

SEQ ID NO: 616012 - RNA, 59 nt, Homo Sapiens
auaauuaaaaauuauuuauucuguaauaaguaauguaucggggaaaaugccaauuuuua

SEQ ID NO: 616013 - RNA, 59 nt, Homo Sapiens
auaccuaaauguuuauuaaagcacuuacuguaauguauuuuuaaguuuguaucuaaaua

SEQ ID NO: 616014 - RNA, 59 nt, Homo Sapiens
cuuuuuaaaucccuuuaguuuuauucuuuguaauguacugauagauguuacagggcuuc

SEQ ID NO: 616015 - RNA, 59 nt, Homo Sapiens
gaguagcuccaggugccacacuguuuuuaguaauguaguccauuauagauuucuuguuu

SEQ ID NO: 616016 - RNA, 59 nt, Homo Sapiens
uugaaaaggggcucuaaguugcugagaagguaauguaggcugugauucugcugggggcu

SEQ ID NO: 616017 - RNA, 59 nt, Homo Sapiens
auagauauaacuguacaaaaaguaaauuaguaauguacuucucaggauaaaguuugcua

SEQ ID NO: 616018 - RNA, 59 nt, Homo Sapiens
uuucucaucuaccaaaggauauguauuuuguaauguauuugugagcugucuucuguaua

SEQ ID NO: 616019 - RNA, 59 nt, Homo Sapiens
ucaccccacuggacuuaucucaaauuguaguaauguauucccuuucucuuaccuaucau

SEQ ID NO: 616020 - RNA, 59 nt, Homo Sapiens
auuuaaauggggaaagauaucuuggcagaguaauguaaaaguuuuaauuuuuuuuuuuu

SEQ ID NO: 616021 - RNA, 59 nt, Homo Sapiens
auucuggaaaaaauuuuguuuugauuuuuguaauguaaucaguguaguucauuuauuca

SEQ ID NO: 616022 - RNA, 59 nt, Homo Sapiens
caaaagaaauaugugaugaugaauacuaaguaauguauaacagauuucauagaagucgu

SEQ ID NO: 616023 - RNA, 59 nt, Homo Sapiens
ggguggaaaggccucaagcugucuguaauguaauguaaaaaagaaauauguuguuucuu

SEQ ID NO: 616024 - RNA, 59 nt, Homo Sapiens
guaaaggguggaaaggccucuucuugucuguaauguaauaauuuaaagaaauauguugu

SEQ ID NO: 616025 - RNA, 59 nt, Homo Sapiens
aguaugguucaagauuguugcaggaacaaguaauguauugagcuacaacaaaaggacuu

SEQ ID NO: 616026 - RNA, 59 nt, Homo Sapiens
ugcuaaugaucuucagauuuagcuuaaagguaauguauuggguuccauauuagcaacuc

SEQ ID NO: 616027 - RNA, 59 nt, Homo Sapiens
agacuuugacauuauuuaaacgagcauguguaauguaacuuuucucuuugaaucauaua

SEQ ID NO: 616028 - RNA, 59 nt, Homo Sapiens
auaauguuaguagcacugagacccccaugguaauguaacuuaauuauaagcuaugucac

SEQ ID NO: 616029 - RNA, 59 nt, Homo Sapiens
uagcuuaaguuuauuuuagcuacucaguaguaauguauucuauuaaucuacuaauauau

SEQ ID NO: 616030 - RNA, 59 nt, Homo Sapiens
ugguaagccgcacuagaaagguauacauaguaauguauauuuauuuacauacugaaguc

SEQ ID NO: 616031 - RNA, 59 nt, Homo Sapiens
uugauuaggggugaaauuuagaagucuuaguaauguaacuugaagauguuaaacaaaaa

SEQ ID NO: 616032 - RNA, 59 nt, Homo Sapiens
cuugacauguaaugaauggucaguuguacguaauguauuuauauguuaauuuguuaugu

SEQ ID NO: 616033 - RNA, 59 nt, Homo Sapiens
cagagaaaaguauauguaaugaugcuacaguaauguauuucuguauaacaaaugacucc

SEQ ID NO: 616034 - RNA, 59 nt, Homo Sapiens
gacaguacuauacaaauagaaugcaagcuguaauguaauuuuauauuuucuuauagcca

SEQ ID NO: 616035 - RNA, 59 nt, Homo Sapiens
guuugagccucauuuacaucaauagagguguaauguacugcauuucuucauuugguaac

SEQ ID NO: 616036 - RNA, 59 nt, Homo Sapiens
aagaggcgucuuguauuuucuucccauuuguaauguaucuuauuuauauaugaaguaag

SEQ ID NO: 616037 - RNA, 59 nt, Homo Sapiens
cucaaaguaaagccugagcaguguucucaguaauguauuugaaggaaaaauacccugau

SEQ ID NO: 616038 - RNA, 59 nt, Homo Sapiens
caugaagacacagucagacacuggacaauguaauguaugcaacugcaaacguuacaacu

SEQ ID NO: 616039 - RNA, 59 nt, Homo Sapiens
aaaaauauuaaaauuuauuucacuggaugguaauguaaccuuaaaagcaucauaauagg

SEQ ID NO: 616040 - RNA, 59 nt, Homo Sapiens
gagcuugugucugcaaauugauuuuguuuguaauguauuuugauagcaaaucaugcugc

SEQ ID NO: 616041 - RNA, 59 nt, Homo Sapiens
ugggaagaccacaucuuguuccuaaagguguaauguaugaauucauaucagagagagau

SEQ ID NO: 616042 - RNA, 59 nt, Homo Sapiens
ggaaauuaacuagugcugugacuguaacuguaauguaauauuguggguaaaauguuaga

SEQ ID NO: 616043 - RNA, 59 nt, Homo Sapiens
cagucagcugcaugguacugagcagcccuguaauguaucugaagaaagaggccuaggag

SEQ ID NO: 616044 - RNA, 59 nt, Homo Sapiens
uaaacuauuuauaucacacaguuuuuucuguaauguaaaauaguauacauugucuugau

SEQ ID NO: 616045 - RNA, 59 nt, Homo Sapiens
agcaauuuucauaauaaaagauguuggcuguaauguaacuauuaaaauacuguuuugga

SEQ ID NO: 616046 - RNA, 59 nt, Homo Sapiens
aacuccauguuauguuuuuaacaauauuuguaauguauuacuaccaccuaacccaacag

SEQ ID NO: 616047 - RNA, 59 nt, Homo Sapiens
agaggucuugaucuuuggaaugcaugccaguaauguauuuuacaguacauguuuauuau

SEQ ID NO: 616048 - RNA, 59 nt, Homo Sapiens
aguguacuaaacucuacgcucugguuaauguaauguacucuccuggacugaaugcagug

SEQ ID NO: 616049 - RNA, 59 nt, Homo Sapiens
uuauauuauuaaauguugauugauggcuuguaauguacugcacacaauauauguuaacu

SEQ ID NO: 616050 - RNA, 59 nt, Homo Sapiens
uggauuguuuauacuccaguguacauaguguaauguagcguguuuacauguguagccua

SEQ ID NO: 616051 - RNA, 59 nt, Homo Sapiens
caaaauugcuuuguauauuuggugauuuuguaauguaagugaauugauucuuauuucac

SEQ ID NO: 616052 - RNA, 59 nt, Homo Sapiens
gucuuuuuuggacuagcacugacugaacuguaauguaggggaaaguuucaugaugguau

SEQ ID NO: 616053 - RNA, 59 nt, Homo Sapiens
uauuucagcuacuguauuuccuuuuucuuguaauguaagcagcucagauaccaugugcu

SEQ ID NO: 616054 - RNA, 59 nt, Homo Sapiens
cuuucucaucuauauuuaaguaccuuuuuguaauguaguaucaaaguuuuuuagguaau

SEQ ID NO: 616055 - RNA, 59 nt, Homo Sapiens
gaugguuuuauaaucugauuguugcaaucguaauguacacacacucucacauguuuaga

SEQ ID NO: 616056 - RNA, 59 nt, Homo Sapiens
gauaaaagcaguaggagaaauuuuauauuguaauguagaauaaaaugcuggauugaaaa

SEQ ID NO: 616057 - RNA, 59 nt, Homo Sapiens
cuuugcugaccacuguuuguagcuuaaaaguaauguauggacaucuuccuuggacccaa

SEQ ID NO: 616058 - RNA, 59 nt, Homo Sapiens
cuauuauugaguagaggccuuuguuaagaguaauguaaaucuguuuauguagaaugauu

SEQ ID NO: 616059 - RNA, 59 nt, Homo Sapiens
caaacuccaguauuaaaaaucuuaaauauguaauguaacuccaucauucuguguagaag

SEQ ID NO: 616060 - RNA, 59 nt, Homo Sapiens
uaugcauuuauuagacaucuguuuaaaugguaauguagcauuuauuuugcuaaauugaa

SEQ ID NO: 616061 - RNA, 59 nt, Homo Sapiens
cugacuaauauuuuguuguaaaccauuaaguaauguaacgcauguaagaugcuuagggu

SEQ ID NO: 616062 - RNA, 59 nt, Homo Sapiens
uucuucaaacacucuuaaauuuuucuuaaguaauguaaaaauggaacugccaauuuuau

SEQ ID NO: 616063 - RNA, 59 nt, Homo Sapiens
ggcagaaaaagaaguugagcaauuucuauguaauguacagauacuagcauugcacauau

SEQ ID NO: 616064 - RNA, 59 nt, Homo Sapiens
gaaaauuuauuuauuugacaggauuuugaguaauguaggaauacaaaagguaaauuagc

SEQ ID NO: 616065 - RNA, 59 nt, Homo Sapiens
gcacguagcauuuacauuagguauuacaaguaauguaaagaugauuuaaguauacagga

SEQ ID NO: 616066 - RNA, 59 nt, Homo Sapiens
uuuuauuaauagaugguuuauuuacuaugguaauguauuaauuuauuuuugguguuguu

SEQ ID NO: 616067 - RNA, 59 nt, Homo Sapiens
gguguaagacuuuaagaagcgaacaaaaaguaauguauaucuguaauauauaaucaaau

SEQ ID NO: 616068 - RNA, 59 nt, Homo Sapiens
acuaauuacuaauauuuaugaauuguuuuguaauguaaguuuguuuaaauauaaucuau

SEQ ID NO: 616069 - RNA, 59 nt, Homo Sapiens
aauauaaagcacaaauauacgguucuaaaguaauguaaauuuauugaaagcuaaaaaua

SEQ ID NO: 616070 - RNA, 59 nt, Homo Sapiens
uaucaauuugucuucuuuuuaaaaaucgaguaauguauaauguaaaagaaaguaagcau

SEQ ID NO: 616071 - RNA, 59 nt, Homo Sapiens
caagaagauuauguguccuacaauaaacaguaauguaucuauauuccauccacuugaaa

SEQ ID NO: 616072 - RNA, 59 nt, Homo Sapiens
aagcaugauggugccuucuauguucucugguaauguaauaauugucuuuacuguauuuu

SEQ ID NO: 616073 - RNA, 59 nt, Homo Sapiens
aucauuucauuuaucauucaauaguggugguaauguaaaugguaggaauguuaauguaa

SEQ ID NO: 616074 - RNA, 59 nt, Homo Sapiens
aaguaaugaucucaaacuaugacagaaaaguaauguaaaauccauccaaucuauuauuu

SEQ ID NO: 616075 - RNA, 59 nt, Homo Sapiens
uaauuaauugagaguauuuuuuagugaguguaauguauaauguacguaugcaaaguuca

SEQ ID NO: 616076 - RNA, 59 nt, Homo Sapiens
uuuaggggauuuucggggaggggaaauagguaauguauggagcauuuucacuucuaaau

SEQ ID NO: 616077 - RNA, 59 nt, Homo Sapiens
guaaauuucuugucauauaguggcucuacguaauguagccuguauuaaugugaaauauu

SEQ ID NO: 616078 - RNA, 59 nt, Homo Sapiens
ugcaaauaauggaucaauuaugagauucuguaauguauuuuuguuuguuuuuuaucauc

SEQ ID NO: 616079 - RNA, 59 nt, Homo Sapiens
auauuagagaaaggacaggcuacaauuguguaauguacacacuucuuuucagguguagc

SEQ ID NO: 616080 - RNA, 59 nt, Homo Sapiens
cauuugagaaacuuacuuggggguucucaguaauguagcacagcauugugcuugggucu

SEQ ID NO: 616081 - RNA, 59 nt, Homo Sapiens
uaguaauuauuuaauuacugaagcaaguuguaauguacauuuucuugguaauuugauau

SEQ ID NO: 616082 - RNA, 59 nt, Homo Sapiens
auuugguauugcacaggugagucuccuugguaauguauauuauaauuugaugugcugug

SEQ ID NO: 616083 - RNA, 59 nt, Homo Sapiens
auuuuauauaauucugaaaucuacuuccuguaauguacauuaggauaaucuuuaugguu

SEQ ID NO: 616084 - RNA, 59 nt, Homo Sapiens
uagaaagguggguggauaaacucuuguaaguaauguaaaaaggcuaauauggaaccaaa

SEQ ID NO: 616085 - RNA, 59 nt, Homo Sapiens
ugcgcucuguaaagugauuauacuuuuaaguaauguaugauauggcuccaugaaggugc

SEQ ID NO: 616086 - RNA, 59 nt, Homo Sapiens
aggugcaucgacauuaacccacucauuuaguaauguaccuugaguuaaaaagccugaga

SEQ ID NO: 616087 - RNA, 59 nt, Homo Sapiens
uuuuuguauaaaguuugcuuucaauaacaguaauguauaauaaaaccauguaaaguuuu

SEQ ID NO: 616088 - RNA, 59 nt, Homo Sapiens
gaagacaaaaaauauugauagucacuagaguaauguauucuuaaccuuuguaagaacug

SEQ ID NO: 616089 - RNA, 59 nt, Homo Sapiens
aacuacggucauguucagcuucauugcauguaauguagaccuaguccaucagaucaugu

SEQ ID NO: 616090 - RNA, 59 nt, Homo Sapiens
acaaaaaacaaaaacaaaaaaaaaagaggguaauguacaaguuucuguauguauaaagu

SEQ ID NO: 616091 - RNA, 59 nt, Homo Sapiens
caaaaaaaaaagccagcuguacugcaugaguaauguagaggaaggauguauaaaguguu

SEQ ID NO: 616092 - RNA, 59 nt, Homo Sapiens
augauaacguuagagaaacuuauagcaggguaauguaaggauuucuuaaucuugauaaa

SEQ ID NO: 616093 - RNA, 59 nt, Homo Sapiens
acaccaacagaaaugauauauuaugaaauguaauguaaguauuuuuuguuacuauacaa

SEQ ID NO: 616094 - RNA, 59 nt, Homo Sapiens
auguggggugugcaugcagaaauaucuguguaauguagauuuggcauugaaacuugugc

SEQ ID NO: 616095 - RNA, 59 nt, Homo Sapiens
gugaauuuauccaaaacgccccaagucauguaauguauaggcuuuuuucuucguuguuc

SEQ ID NO: 616096 - RNA, 59 nt, Homo Sapiens
uacaucaaaaauggguaauuauaggcuauguaauguaaauacauuuuacauauggaaau

SEQ ID NO: 616097 - RNA, 59 nt, Homo Sapiens
gggcaagaaauuuguguucugcucccauuguaauguaagaggaaauguaaaaacuuaga

SEQ ID NO: 616098 - RNA, 59 nt, Homo Sapiens
ugacauuuauguuccuaagccuugcccuaguaauguacuuguugucuuacuugauauuu

SEQ ID NO: 616099 - RNA, 59 nt, Homo Sapiens
ccaccauuuuaauguacuguggcuuauuuguaauguaaacuaguauauuuaaacuuaca

SEQ ID NO: 616100 - RNA, 59 nt, Homo Sapiens
accguaauuuaugaauuuguaagcuuuauguaauguaacgccaauuuuaauaagaaacu

SEQ ID NO: 616101 - RNA, 59 nt, Homo Sapiens
accucaauuuuugacugacuuauaaaagaguaauguauuuauaaucagauaaggcuggu

SEQ ID NO: 616102 - RNA, 59 nt, Homo Sapiens
cagcaacugggcaugguggcucacugucuguaauguauuaccugaggcagaagaccacc

SEQ ID NO: 616103 - RNA, 59 nt, Homo Sapiens
ucuguuucauuuggaggauuuucuucuuuguaauguaaagaaauucaaaguuaucaaag

SEQ ID NO: 616104 - RNA, 59 nt, Homo Sapiens
aaguggaagaggccugcaucacaauugagguaauguagagcaacauguuaaagaaugau

SEQ ID NO: 616105 - RNA, 59 nt, Homo Sapiens
cacaaaacauguuuauaaaugaacaggauguaauguacauagaugacauuaagaaaauu

SEQ ID NO: 616106 - RNA, 59 nt, Homo Sapiens
uuuacaggaucauguaaaugcucaaagauguaauguaguucuuuguuccugcuuucucu

SEQ ID NO: 616107 - RNA, 59 nt, Homo Sapiens
ggagugacaugaaguuugaacacuaaacaguaauguaugagaauuacuacagauacaug

SEQ ID NO: 616108 - RNA, 59 nt, Homo Sapiens
auuucauagcauuuuaaauuuuuuagagaguaauguauaaaucauuggacaucaauuau

SEQ ID NO: 616109 - RNA, 59 nt, Homo Sapiens
cucucuuguagccuauucuuuaggauuguguaauguauuuguuuuguuuuauacagcag

SEQ ID NO: 616110 - RNA, 59 nt, Homo Sapiens
gcuuggaugauguuccugauuaugguaucguaauguaaaacuuguguucugagggucau

SEQ ID NO: 616111 - RNA, 59 nt, Homo Sapiens
ggagcucuuuucacuaggguaaagugagaguaauguaauaaggaagaacaaucacaaau

SEQ ID NO: 616112 - RNA, 59 nt, Homo Sapiens
ggaccccauguguggcuucuaaauaaaugguaauguauuugaguccauguuuauucugc

SEQ ID NO: 616113 - RNA, 59 nt, Homo Sapiens
uuacaaggauaauguauuuuauuauccuuguaauguauuguuaaaguauuuuaaaauac

SEQ ID NO: 616114 - RNA, 59 nt, Homo Sapiens
ugauacauuuauaucaaguuaaaacaacuguaauguacuguuuucuuuuucguccaacu

SEQ ID NO: 616115 - RNA, 59 nt, Homo Sapiens
aaacccucaaguguuuuuucuuuuauuguguaauguagaauaagaaguggaaauugccu

SEQ ID NO: 616116 - RNA, 59 nt, Homo Sapiens
caaaucagguaaaauagucaugauucuauguaauguaaaccagaaaaaauaaauguuca

SEQ ID NO: 616117 - RNA, 59 nt, Homo Sapiens
gcaauuucauacuuaggaacauacaaaagguaauguaaacucugccacuuuuuuguguu

SEQ ID NO: 616118 - RNA, 59 nt, Homo Sapiens
auguucaucuggaaguauuuuccuccaaaguaauguagcaugauuuuucaaggauuguu

SEQ ID NO: 616119 - RNA, 59 nt, Homo Sapiens
caaggccccagccaaccucucguugacauguaauguaagaagaugucaacucaugcuua

SEQ ID NO: 616120 - RNA, 59 nt, Homo Sapiens
ucacccuccucagcauuauucaugucucuguaauguaacugcauccuugauuucuugug

SEQ ID NO: 616121 - RNA, 59 nt, Homo Sapiens
caaaagugccuaagacaguaaugaaauaaguaauguauagguaaauauuuuuuucucaa

SEQ ID NO: 616122 - RNA, 59 nt, Homo Sapiens
cagacuuuguauaguucacuccccuccuuguaauguagauaaaagaggucacuggcuga

SEQ ID NO: 616123 - RNA, 59 nt, Homo Sapiens
ccuauccuuuguucucuacuguuuucuuuguaauguaugacuacgagagugauacuuug

SEQ ID NO: 616124 - RNA, 59 nt, Homo Sapiens
gugaucuggcaguuuaugcauucuucagaguaauguaauaauaccuaugugaugcugua

SEQ ID NO: 616125 - RNA, 59 nt, Homo Sapiens
gauuuuguaaauguucuugguguuugacuguaauguaacuaucucaccuaaugguugua

SEQ ID NO: 616126 - RNA, 59 nt, Homo Sapiens
aauuaacucuuuguuucccuucauaaaauguaauguacauuguaaucuuuuaaaagaaa

SEQ ID NO: 616127 - RNA, 59 nt, Homo Sapiens
uauguauguauuuguaaaugcuacuguauguaauguauugagucugccucccagacugg

SEQ ID NO: 616128 - RNA, 59 nt, Homo Sapiens
guauaaacucaagccuuuuuuauguuauaguaauguaacacacauuugauauucucuua

SEQ ID NO: 616129 - RNA, 59 nt, Homo Sapiens
uaugcaguaugccuuacuuaagcaugcauguaauguauggaauuaucuuuuguuuagaa

SEQ ID NO: 616130 - RNA, 59 nt, Homo Sapiens
acugacacugccauuuuuccgagauauauguaauguacauuaaacacuaaaaagaaaga

SEQ ID NO: 616131 - RNA, 59 nt, Homo Sapiens
guguaguugaaacagucaaacuuauuuuuguaauguauguuauugugugaugcaguuuu

SEQ ID NO: 616132 - RNA, 59 nt, Homo Sapiens
ccuggagagcagcuguaccuaacaauacuguaauguacauuaacauuacagccucucaa

SEQ ID NO: 616133 - RNA, 59 nt, Homo Sapiens
uuaacacacuaaucuucaguuggaugaauguaauguauaacuauguuuucagcaacaau

SEQ ID NO: 616134 - RNA, 59 nt, Homo Sapiens
aaguaggcuggauaaauggugcuuaaaugguaauguacuccacuucuuccuauuggaag

SEQ ID NO: 616135 - RNA, 59 nt, Homo Sapiens
auguuuuuaaaguaauuuuuuaaaauaugguaauguauuaaacuuauuuuuauaguuau

SEQ ID NO: 616136 - RNA, 59 nt, Homo Sapiens
auucuucuaauccaauguagaaauuguacguaauguauuuaaaucaacgcaaauguaug

SEQ ID NO: 616137 - RNA, 59 nt, Homo Sapiens
uugguuaaaaaauuuuguuuuuuaauuacguaauguaaaagcccaacaaacacuuuaug

SEQ ID NO: 616138 - RNA, 59 nt, Homo Sapiens
gcccgugcuuggagaaccauagccuaaggguaauguacagcccccgcaagggaaugguc

SEQ ID NO: 616139 - RNA, 59 nt, Homo Sapiens
uguuguuaauaagaaugguuggucauucuguaauguaaaagguuuuucagcuaccucug

SEQ ID NO: 616140 - RNA, 59 nt, Homo Sapiens
uuagugugaauuuaaaaauuauuuuaaucguaauguauucgggugguugaagauaauuc

SEQ ID NO: 616141 - RNA, 59 nt, Homo Sapiens
cuuuguacugagacaaauuuuuuucaauaguaauguagccuuuucuucaugcugguauu

SEQ ID NO: 616142 - RNA, 59 nt, Homo Sapiens
auugcucuuguuuauugcuucuauguaguguaauguauagauguauuuuuuguuaaaua

SEQ ID NO: 616143 - RNA, 59 nt, Homo Sapiens
uagcaaaguacauaagaaucuaucacuaaguaauguauccuucagaauguguugguuua

SEQ ID NO: 616144 - RNA, 59 nt, Homo Sapiens
gagagccaaugucagauaaaguaagcauaguaauguagcaggaacuacaauagaagaca

SEQ ID NO: 616145 - RNA, 59 nt, Homo Sapiens
aaggucuuaagagaaaagucacauuacaaguaauguaauggcucuaccauucauucuuc

SEQ ID NO: 616146 - RNA, 59 nt, Homo Sapiens
acuguagcaguguguucugggcaguaucuguaauguaugaaauagagucuggaauaggu

SEQ ID NO: 616147 - RNA, 59 nt, Homo Sapiens
gaaagcaaaggauaacgaauucagaauuaguaauguaaaaucuugauacccuaaucuug

SEQ ID NO: 616148 - RNA, 59 nt, Homo Sapiens
gacauuuauaguacuaggcaggcaauacuguaauguaaaguugagugccuggacccaaa

SEQ ID NO: 616149 - RNA, 59 nt, Homo Sapiens
guaacaaaggagcuucuugugagccauauguaauguacugucuauuuuauucuacauaa

SEQ ID NO: 616150 - RNA, 59 nt, Homo Sapiens
gaaaucuuauaagugaauaggucauuucaguaauguacucuuaguuuggguacaaaaau

SEQ ID NO: 616151 - RNA, 59 nt, Homo Sapiens
auuguguauauauuauacaaugagcacauguaauguauuaaaggcuacuuacuauuguu

SEQ ID NO: 616152 - RNA, 59 nt, Homo Sapiens
uuauauuuuagcauggucugccucaaauaguaauguauuuuucugcauucacuuggaua

SEQ ID NO: 616153 - RNA, 59 nt, Homo Sapiens
uauuaguauuuuacucuagugguguaauuguaauguagaacaguugugugguaguguga

SEQ ID NO: 616154 - RNA, 59 nt, Homo Sapiens
uauggcuggauuuuuuugcuaagaaaaaaguaauguacagaguugaauguuuauuauua

SEQ ID NO: 616155 - RNA, 59 nt, Homo Sapiens
uuucuguuuaauuacaguacuuucaugugguaauguaauacaguugugauauuuggugg

SEQ ID NO: 616156 - RNA, 59 nt, Homo Sapiens
caccuaacugcauuuguuuuucuuuugggguaauguacacagcuuuaauagccaugggu

SEQ ID NO: 616157 - RNA, 59 nt, Homo Sapiens
uuuacauagaauuaagaguuucuuaucuaguaauguagauacauuucugaguaccauua

SEQ ID NO: 616158 - RNA, 59 nt, Homo Sapiens
acauuucuaaucuauuauuccacuguuuuguaauguaguauguacagauaguuauaggc

SEQ ID NO: 616159 - RNA, 59 nt, Homo Sapiens
agacuaaauaucauuccuucgaauucagaguaauguaaauuaauaauaauuccaacaag

SEQ ID NO: 616160 - RNA, 59 nt, Homo Sapiens
auauucuuuucuugcuuucuauguucuauguaauguaaaaauuugaucgaaucaccuga

SEQ ID NO: 616161 - RNA, 59 nt, Homo Sapiens
uuccugaugcuugacuaauuuuaauagcuguaauguagcaaaagauguaucuuuguaua

SEQ ID NO: 616162 - RNA, 59 nt, Homo Sapiens
ugugguuuuuauuuugaacgauguccacaguaauguauucgcuguaggucucuucuugc

SEQ ID NO: 616163 - RNA, 59 nt, Homo Sapiens
aguucacggaagaagcacaagcugaccuuguaauguauggcuguaacccggcaucgagu

SEQ ID NO: 616164 - RNA, 59 nt, Homo Sapiens
uaguuuucaaauuauaucuuuaauauauaguaauguaacauauucaguauuaauguaua

SEQ ID NO: 616165 - RNA, 59 nt, Homo Sapiens
ugaaaagggaauuguaaauggacugcaauguaauguacacuguaauuugaauacaauua

SEQ ID NO: 616166 - RNA, 59 nt, Homo Sapiens
ggucauuuuaagaaucuggaaugcuugcuguaauguauauggcuuuacucaagcagauc

SEQ ID NO: 616167 - RNA, 59 nt, Homo Sapiens
aauacauaauugcauuugcucuguuuauuguaauguauucuaaauuaaugcagaaccau

SEQ ID NO: 616168 - RNA, 59 nt, Homo Sapiens
ucucuguauguucaguuaacaaauuauuuguaauguauuuuuuuagaaaucuuaaaauu

SEQ ID NO: 616169 - RNA, 59 nt, Homo Sapiens
aaauacauuuaaaacauuaaaauaauuuuguaauguaucaaugauaugcuuguaacuaa

SEQ ID NO: 616170 - RNA, 59 nt, Homo Sapiens
uaaagccugaaugaugagccauagauccaguaauguacauaucuaaaggugagagcugc

SEQ ID NO: 616171 - RNA, 59 nt, Homo Sapiens
uuuugauuuguaacaaauauaaagaaacuguaauguauacgauuuggauaugccaucug

SEQ ID NO: 616172 - RNA, 59 nt, Homo Sapiens
ggaaacccuuuuggaauuagcaaugucauguaauguaaauucuucuaauguguaucuca

SEQ ID NO: 616173 - RNA, 59 nt, Homo Sapiens
guuuguauauaaugaaauuuguacauuguguaauguaauuuucuuaguguuuuuaaccu

SEQ ID NO: 616174 - RNA, 59 nt, Homo Sapiens
ggaucuaauauauaauauucaauacaauuguaauguagaaauauaagaauuuagaaaaa

SEQ ID NO: 616175 - RNA, 59 nt, Homo Sapiens
uuccaguugcaccucaguauguuaaacagguaauguaagaaguucucugaaaugucagc

SEQ ID NO: 616176 - RNA, 59 nt, Homo Sapiens
uagacuuacuuauucuuugaggaaaaaagguaauguaggagcucauuguucucuagagc

SEQ ID NO: 616177 - RNA, 59 nt, Homo Sapiens
aaaugaccauuugccaaccuggcugugagguaauguauguaaagcaccgagucaggugc

SEQ ID NO: 616178 - RNA, 59 nt, Homo Sapiens
acucauagagaaaacuguuacuuucugacguaauguaauucaggaagacagacgcugca

SEQ ID NO: 616179 - RNA, 59 nt, Homo Sapiens
aucucuguaguuccucaaauuggcaucugguaauguacauugugagguagacugauaau

SEQ ID NO: 616180 - RNA, 59 nt, Homo Sapiens
ucuacuggugggagacugugggaugcccaguaauguauguagccacugcccccuccccu

SEQ ID NO: 616181 - RNA, 59 nt, Homo Sapiens
uaacuuuuagcaaaggaggguggagugguguaauguauccuuauuuauuaaucucuugc

SEQ ID NO: 616182 - RNA, 55 nt, Homo Sapiens
ggaagacuuggaguuuacaaguacaguaauguaaacucucacaggaagaaaguaa

SEQ ID NO: 616183 - RNA, 59 nt, Homo Sapiens
ucuaggguccagucauaucccuugaaacuguaauguaaauacaugguugguugucucuu

SEQ ID NO: 616184 - RNA, 59 nt, Homo Sapiens
uugagaagucaguccaaggaauguuggcuguaauguaugcauggucuguuccuaguuac

SEQ ID NO: 616185 - RNA, 59 nt, Homo Sapiens
aauguuucauacagcuauuagcccgcacaguaauguagagaaugggcaugaauggagau

SEQ ID NO: 616186 - RNA, 59 nt, Homo Sapiens
aauaaucccagcccagucaagauguaucaguaauguauccauaugcuuauaaaagaagu

SEQ ID NO: 616187 - RNA, 59 nt, Homo Sapiens
gcauuauugacugcuggugugaugcuacuguaauguaauaaauuauuaaguuguugcaa

SEQ ID NO: 616188 - RNA, 59 nt, Homo Sapiens
gaaagaucagugcugauuuuaaucagacuguaauguaccaacuagauacagacagggcc

SEQ ID NO: 616189 - RNA, 59 nt, Homo Sapiens
ucugcaauggauuuuuuuuuaaugcagaaguaauguauacucuaguauucugguguuuu

SEQ ID NO: 616190 - RNA, 59 nt, Homo Sapiens
aguaucaauauacuuuugggucugaaaacguaauguagcuaacuuacugaacugaacuu

SEQ ID NO: 616191 - RNA, 59 nt, Homo Sapiens
aaauuauuaaguuguugcaagaugcuacuguaauguaaugcauuauugacugcuggugu

SEQ ID NO: 616192 - RNA, 59 nt, Homo Sapiens
uucucccaauaguaauuguugcaaugaguguaauguauuaguauuauucaugguuccaa

SEQ ID NO: 616193 - RNA, 59 nt, Homo Sapiens
gaucaguuauauauauauauuggucauuuguaauguaaaaagcaacacagucacugcug

SEQ ID NO: 616194 - RNA, 59 nt, Homo Sapiens
auucauaaaaauuuggaagucugcccucuguaauguagcaaccuuaaaauagcuacacu

SEQ ID NO: 616195 - RNA, 59 nt, Homo Sapiens
aggaaaaacuggaaauccccggaaacuuuguaauguaaauauuguuggcuucuuguguu

SEQ ID NO: 616196 - RNA, 59 nt, Homo Sapiens
cucugcugcaaaugcucagcccugcuguuguaauguaaaagcugccacagacacuacau

SEQ ID NO: 616197 - RNA, 59 nt, Homo Sapiens
uaaaauugcucuuuuguaacuuuaucuuaguaauguaaagauucaguaaauugaugagu

SEQ ID NO: 616198 - RNA, 59 nt, Homo Sapiens
uugcugguaagcucauccauauuucucauguaauguauuccucuagccuacauuagcau

SEQ ID NO: 616199 - RNA, 59 nt, Homo Sapiens
uguggacuagugcauauuucuaguuuucaguaauguaagacaggauaauaucuccugca

SEQ ID NO: 616200 - RNA, 59 nt, Homo Sapiens
aagcaccucaggcacauaacauuaaucuaguaauguaauucucugcacauccagcuggu

SEQ ID NO: 616201 - RNA, 59 nt, Homo Sapiens
augguggaagauaauguacuacugaagauguaauguagcuuuccacuggagucugggau

SEQ ID NO: 616202 - RNA, 59 nt, Homo Sapiens
uuuuuuccccuucaguuuuaauguuauguguaauguauuuaaacccuuauuuaaauaaa

SEQ ID NO: 616203 - RNA, 59 nt, Homo Sapiens
ccuccuccucacccuaucacccauggaucguaauguaaaauucuuuuaccaugucaaga

SEQ ID NO: 616204 - RNA, 59 nt, Homo Sapiens
uauuuuuuuaaacaaaauuucacaguucuguaauguaggcacuuuuauuuucauuguga

SEQ ID NO: 616205 - RNA, 59 nt, Homo Sapiens
uuuuauuuucauugugauuuauauauaagguaauguaggguuauauuugggagugacug

SEQ ID NO: 616206 - RNA, 59 nt, Homo Sapiens
uuuuaccuuauuuaucuguauuugacaaaguaauguaaucaaacaugguuuuccuuuac

SEQ ID NO: 616207 - RNA, 59 nt, Homo Sapiens
auauggggucugggcuccaguuuguacauguaauguauuaggagcuggcugaaagccac

SEQ ID NO: 616208 - RNA, 59 nt, Homo Sapiens
aauacauccguucaugugcuagaagcuguguaauguauuagaggaauaggucagauaga

SEQ ID NO: 616209 - RNA, 59 nt, Homo Sapiens
ggccuuuuagugaguaaggcuuuuccuuuguaauguauuuuuuuuuauaaauagacuua

SEQ ID NO: 616210 - RNA, 59 nt, Homo Sapiens
gaaauaacaauguaguucucgaguucuuuguaauguaagugggaaaaacaguaugggaa

SEQ ID NO: 616211 - RNA, 59 nt, Homo Sapiens
agaaaaucugauagaccagcuguugaucuguaauguaauauucaucugaacuggaccag

SEQ ID NO: 616212 - RNA, 59 nt, Homo Sapiens
ugagcaguguuaaaaucuccuauuaauguguaauguaccugucagugccuccuuuauua

SEQ ID NO: 616213 - RNA, 59 nt, Homo Sapiens
aacauuucagggaggagucugccaccaguguaauguaucaauaaacuucaugcaagcau

SEQ ID NO: 616214 - RNA, 59 nt, Homo Sapiens
uucuagucugcuuuuuuuguuuaauucuuguaauguaagcaauaaauauggagugucag

SEQ ID NO: 616215 - RNA, 59 nt, Homo Sapiens
auguacuauugacaugggcaauaauguguguaauguauaggaaagaaaaugacauuuaa

SEQ ID NO: 616216 - RNA, 59 nt, Homo Sapiens
aaaacucucuuuuguuaccauuggaaaguguaauguaacuaggaagaugugguuacuau

SEQ ID NO: 616217 - RNA, 59 nt, Homo Sapiens
aaaaggugcauuaggcuguaaauuauaaaguaauguauuaaguugaauggugguuuuua

SEQ ID NO: 616218 - RNA, 59 nt, Homo Sapiens
augauccaguaucacaguauuguguacagguaauguaucauuaauaacaguaguaguua

SEQ ID NO: 616219 - RNA, 59 nt, Homo Sapiens
uauaaauuuauccaaguacuugagaugauguaauguauuuauuugaagguauauaaaaa

SEQ ID NO: 616220 - RNA, 59 nt, Homo Sapiens
cauucaugauugcccauauuuuuugccugguaauguauugagaauggcuuuuauaggua

SEQ ID NO: 616221 - RNA, 59 nt, Homo Sapiens
ccuacucuaucagagaaaaauuauaguuaguaauguacauuuuuagacuuucuuaucac

SEQ ID NO: 616222 - RNA, 59 nt, Homo Sapiens
uucucccuuuguaaagacuuaucuaagcaguaauguacuuaugcagauagaugugugaa

SEQ ID NO: 616223 - RNA, 59 nt, Homo Sapiens
aucuacaguuugguuuuucuuuaaguauuguaauguacauaccagagagauaaugcaga

SEQ ID NO: 616224 - RNA, 59 nt, Homo Sapiens
ugugguuuuuaguaaaauaguuguaaaauguaauguauagagaucagauaguugcuguu

SEQ ID NO: 616225 - RNA, 59 nt, Homo Sapiens
uaacuuuuagaaucuaaauaaaaucagagguaauguauuuuggcagcuuguuuagguga

SEQ ID NO: 616226 - RNA, 59 nt, Homo Sapiens
agcaucaaauuauugggaccagaaaccaaguaauguauaauguggcuuuuguugaguua

SEQ ID NO: 616227 - RNA, 59 nt, Homo Sapiens
gauggacugcggguuuggauaccacugcuguaauguaacccucuuuguuuagaugagga

SEQ ID NO: 616228 - RNA, 59 nt, Homo Sapiens
uggauuguacaaauuacugccugugaauuguaauguaguguuagagcuaguguauguua

SEQ ID NO: 616229 - RNA, 59 nt, Homo Sapiens
auuuccuucuagcuuccuacaaugaacucguaauguaaccaauuuuccagauauuauau

SEQ ID NO: 616230 - RNA, 59 nt, Homo Sapiens
uauaagcgauuccccucaacauuaaaaauguaauguaaugucagagaaacuuuaugcau

SEQ ID NO: 616231 - RNA, 59 nt, Homo Sapiens
ugugcuuccaaguuggggggacaaaaacgguaauguaaacuuugaaaauaaaggacuuc

SEQ ID NO: 616232 - RNA, 59 nt, Homo Sapiens
caccuuucauaaguuguuaucuagucaauguaauguauauuguauugaaauuuacagug

SEQ ID NO: 616233 - RNA, 59 nt, Homo Sapiens
gugucgucagccugggagccuuccccaguguaauguagcuuucucucuuaccuucugga

SEQ ID NO: 616234 - RNA, 59 nt, Homo Sapiens
cuaucucucuuuacauuuugcacacaucaguaauguauuugccugaacuugaauuaauc

SEQ ID NO: 616235 - RNA, 59 nt, Homo Sapiens
ugacaaaauaucugauaauccagggaagaguaauguaaucugauccaccuaagcacauu

SEQ ID NO: 616236 - RNA, 57 nt, Homo Sapiens
uacagcuggugccugguaaaauggcauguguaauguaugugaugcagauuaaaggag

SEQ ID NO: 616237 - RNA, 59 nt, Homo Sapiens
ccaagacagugcccaugaaugggacaccuguaauguaacccacacagcgguuugcagag

SEQ ID NO: 616238 - RNA, 59 nt, Homo Sapiens
cuucucuguaggaugcaaaacauccaguuguaauguauaagcaugcacuucauacuagc

SEQ ID NO: 616239 - RNA, 59 nt, Homo Sapiens
ggcauuuuagaauuacuagcugaaaaauuguaauguaccaacagaaauauuauuguaag

SEQ ID NO: 616240 - RNA, 59 nt, Homo Sapiens
cccaccaauacaaaccaguuacagcaacuguaauguaacauaaaaagggcaucuugaag

SEQ ID NO: 616241 - RNA, 59 nt, Homo Sapiens
uccuauugauuaacuuagacauagauuuuguaauguauaacuugauauuuaauuuauga

SEQ ID NO: 616242 - RNA, 59 nt, Homo Sapiens
ucuccaggugcuuauauugaucuggaauuguaauguaaaaagcaaugcaaacuuaggcg

SEQ ID NO: 616243 - RNA, 59 nt, Homo Sapiens
aucuuucuuaaguaguaaaaaugacagugguaauguagauguuuuuauaacauacuaug

SEQ ID NO: 616244 - RNA, 59 nt, Homo Sapiens
uagauaauuaaccaagguagaaugaccuuguaauguaacugcucuugggcaauauucuc

SEQ ID NO: 616245 - RNA, 59 nt, Homo Sapiens
aguguuuuauggcauauucauuuucugcuguaauguaggacuacugaguaucucuuuug

SEQ ID NO: 616246 - RNA, 59 nt, Homo Sapiens
uagaucagugucugcucuuuuuuauacauguaauguacugaggauugauaauuuagaug

SEQ ID NO: 616247 - RNA, 59 nt, Homo Sapiens
agacauaugagcaagaaaaacaucaguauguaauguaaauugccaagcugccuagcaua

SEQ ID NO: 616248 - RNA, 59 nt, Homo Sapiens
cuugaaaaauguuauaacuuaaguguauuguaauguauauuuauguuuucacagucacc

SEQ ID NO: 616249 - RNA, 59 nt, Homo Sapiens; identical to SEQ ID NO: 616241

SEQ ID NO: 616250 - RNA, 64 nt, Homo Sapiens
cuaccaguguaaccuaccaguacaacugugaauccuaggcaaggcaaaaaugcacuuccacuga

SEQ ID NO: 616251 - RNA, 64 nt, Homo Sapiens
accugggagcuugguagaaaugcagaaucuuagccuaggcaacauagggagaccucaucucugc

SEQ ID NO: 616252 - RNA, 64 nt, Homo Sapiens
agaaaacccaaggagugaagggacaggauuuugccuaggcaaaaaucuaagacucgugcccucc

SEQ ID NO: 616253 - RNA, 64 nt, Homo Sapiens
uucaaucaaaugaaacguuauccuauuggauagacuaggcaauucaucagcucaccugaaauca

SEQ ID NO: 616254 - RNA, 64 nt, Homo Sapiens
uucaucaggcuguggugggcggggguguuggccacuaggcaaugguaugggcagggcuucaccu

SEQ ID NO: 616255 - RNA, 64 nt, Homo Sapiens
uuuuuuuuuugagauggagucucacucuugucaccuaggcaagagugcaauggcacaaucucag

SEQ ID NO: 616256 - RNA, 64 nt, Homo Sapiens
gugggggcugggaguagaggauguuccugcuucucuaggcaaggucccgucauagcaauuauau

SEQ ID NO: 616257 - RNA, 64 nt, Homo Sapiens
gcagugagcugagauggcaccacugcacuccggccuaggcaacgagagcaaaacuccaauacaa

SEQ ID NO: 616258 - RNA, 64 nt, Homo Sapiens
cccaagaaaagaggccaaagcaagagcagauucccuaggcaagagcagcagcacaacuaggaaa

SEQ ID NO: 616259 - RNA, 64 nt, Homo Sapiens
auacagugucugacuauaaccuuguuccaaaaaccuaggcaaagaguauauguaggagguggga

SEQ ID NO: 616260 - RNA, 64 nt, Homo Sapiens
gcuguuauguccagaaauugugugugcaagaaaacuaggcaauguacucuuccgauguuugugu

SEQ ID NO: 616261 - RNA, 64 nt, Homo Sapiens
uaccugagugucugcagcacccuccacuucucuccuaggcaaugagacccaguggcuagaaauu

SEQ ID NO: 616262 - RNA, 64 nt, Homo Sapiens
uacacccuguucauuguuacaguguggagaaaaacuaggcaaacacaaugcuugauuugaaaac

SEQ ID NO: 616263 - RNA, 64 nt, Homo Sapiens
acacugauguaggaagcacggcguuaaaguuguacuaggcaaacagguccuuauuuacaaggcu

SEQ ID NO: 616264 - RNA, 64 nt, Homo Sapiens
uagccaagagccuuuuguuuaacccuaucuaauacuaggcaaagguucauguuaguuucuucaa

SEQ ID NO: 616265 - RNA, 64 nt, Homo Sapiens
ggagugggggcaggcaucuaccagcugagugaagcuaggcaaaucuccauguggcuuaagccuu

SEQ ID NO: 616266 - RNA, 64 nt, Homo Sapiens
caaauaacuguuagaagguaucaauguuaauaaacuaggcaaaauaucagaacuuggguugauu

SEQ ID NO: 616267 - RNA, 64 nt, Homo Sapiens
cccccuuggaagcugucaaagaauauuguuauuccuaggcaaaccauaugaaaaagcuucuuau

SEQ ID NO: 616268 - RNA, 64 nt, Homo Sapiens
ccccugaagggcauaccuaagggauuuaaccauucuaggcaacauagccuccuuuaagcugaau

SEQ ID NO: 616269 - RNA, 64 nt, Homo Sapiens
auuaauaaucuauccugagauaccauucuuauuccuaggcaacuaaauuucuaucauugccaca

SEQ ID NO: 616270 - RNA, 64 nt, Homo Sapiens
ucuggccaggccccccuuuuuuucuuugggauugcuaggcaagguggguucccauuuauccugc

SEQ ID NO: 616271 - RNA, 53 nt, Homo Sapiens
cuacuucaaugcacagaaccgugcuaggcaaggcugaugcuggccaggaguga

SEQ ID NO: 616272 - RNA, 64 nt, Homo Sapiens
aauauuuccuguuaaaagaaucacugccaugacacuaggcaaaaggugaaaccguauacuacuu

SEQ ID NO: 616273 - RNA, 64 nt, Homo Sapiens
ccgucagcuucuucauaacguuuucaaggaaauucuaggcaaucauuccugucaccaaagaacu

SEQ ID NO: 616274 - RNA, 64 nt, Homo Sapiens
agaagugaccugaaguuucugugcaacacucacacuaggcaaugccauuucaaugcauuacuaa

SEQ ID NO: 616275 - RNA, 64 nt, Homo Sapiens
cuaggacugguuuggggacgggugggaaugaccccuaggcaaggggaugagaccgcaggaggaa

SEQ ID NO: 616276 - RNA, 64 nt, Homo Sapiens
aaucuacugugguuuuacuaauaauucugagucacuaggcaaucaucaacacacacaaaaugga

SEQ ID NO: 616277 - RNA, 64 nt, Homo Sapiens
agagugaaacuccaucucaacauugcacuccagccuaggcaacagcagugagccaagaucgugc

SEQ ID NO: 616278 - RNA, 62 nt, Homo Sapiens
caauacaucgguccaaggauugugaacuucuacuaggcaaagccgaaauugaccagagauaa

SEQ ID NO: 616279 - RNA, 64 nt, Homo Sapiens
gagcaagacuccgucucaaacacugcacuccagccuaggcaacagcagugagcugagauggcgc

SEQ ID NO: 616280 - RNA, 64 nt, Homo Sapiens
gagcaagacuccgucucaaacucugcacuccagccuaggcaacauucuuugagacagggucuuu

SEQ ID NO: 616281 - RNA, 64 nt, Homo Sapiens
auucauuauuuuauuaauauugcccuaaguacaacuaggcaagugauugccaccuaaaucagaa

SEQ ID NO: 616282 - RNA, 64 nt, Homo Sapiens
ugcuccuuuugaguugcuuuugcguuucucaugccuaggcaaguguaauagaaauuauguagcu

SEQ ID NO: 616283 - RNA, 64 nt, Homo Sapiens
guguggucauguuugucaagcaguuaguaaaauucuaggcaaguugacuauuacaacaaaguuc

SEQ ID NO: 616284 - RNA, 64 nt, Homo Sapiens
aucagccaauaaguauguuauauuuuuggcauuucuaggcaaguuauaagaguuguauaaaaga

SEQ ID NO: 616285 - RNA, 64 nt, Homo Sapiens
uagggagacccuaucccuacaguucaagaucagccuaggcaacagaggauugcuugagcccagg

SEQ ID NO: 616286 - RNA, 64 nt, Homo Sapiens
ugaaacuauaacugaucuaauuccggaucuuuggcuaggcaaaaucuucucucucugcauagga

SEQ ID NO: 616287 - RNA, 64 nt, Homo Sapiens
aacuaaggaaggaauccccugguaagggaguauucuaggcaagggaagggugagggagaauaag

SEQ ID NO: 616288 - RNA, 64 nt, Homo Sapiens
uauggguacguauaaaaagcaagaauucuguuuccuaggcaaacauugcaacucagggcuaaag

SEQ ID NO: 616289 - RNA, 64 nt, Homo Sapiens
gcagugagccauaaucgugccacugcaguccagccuaggcaacagagugagacuuugucucaaa

SEQ ID NO: 616290 - RNA, 64 nt, Homo Sapiens
uuaaaauuuuuugagaguguuaaaaaaaauuuuacuaggcaaaauguuugaaguauguucagua

SEQ ID NO: 616291 - RNA, 64 nt, Homo Sapiens
guggauugcuugagccuaggaguucgagaccagccuaggcaacauggagaaaccccgucucuau

SEQ ID NO: 616292 - RNA, 64 nt, Homo Sapiens
aauauauaaucaaaugauucauuuuucuguuagacuaggcaaauuguucaaaaauaaccuuuuu

SEQ ID NO: 616293 - RNA, 64 nt, Homo Sapiens
gaugcagucaccagcaugagaagcaguccagagucuaggcaauuuuuacaaccugaguucaagu

SEQ ID NO: 616294 - RNA, 64 nt, Homo Sapiens
auuacguaaguuucccaauuaauucucuccacaccuaggcaauacaagaacugacagcuugagg

SEQ ID NO: 616295 - RNA, 64 nt, Homo Sapiens
cacaaggaggcgaggcuaugcguucgaggccaaccuaggcaaaauuggaaaaaaaaaaaaaaau

SEQ ID NO: 616296 - RNA, 64 nt, Homo Sapiens
gaaguacuuaaacuuccacaagagugaauuugaccuaggcaaguuuguucaaaagguagauccu

SEQ ID NO: 616297 - RNA, 64 nt, Homo Sapiens
gaagauugcuugagcccaggaguuugagaccaaucuaggcaauguagugagacccugucucuaa

SEQ ID NO: 616298 - RNA, 64 nt, Homo Sapiens
gguuauauuuuuuaaaauaaugaauuuucuaucucuaggcaacaugucuuuauuauucaagcug

SEQ ID NO: 616299 - RNA, 64 nt, Homo Sapiens
caacuguguuugccagaaacaucauucaugugaacuaggcaaguuaccuuuuuuccccccuucu

SEQ ID NO: 616300 - RNA, 64 nt, Homo Sapiens
cacuugaaagagcguguguacauguauuuuuuuucuaggcaaacauugaaugcaaacguguauu

SEQ ID NO: 616301 - RNA, 64 nt, Homo Sapiens
gguuuuggggucauauauaaggacuaaagccaagcuaggcaaaacaaugacagcaccguuuuuu

SEQ ID NO: 616302 - RNA, 64 nt, Homo Sapiens
gaguccagauuuuaguaaguaggguaggaaaguccuaggcaauguuucuuggcauuauuugcug

SEQ ID NO: 616303 - RNA, 64 nt, Homo Sapiens
agagcaaaacucugccucaacauugcacuccagccuaggcaauaguggugagcugagaugacgc

SEQ ID NO: 616304 - RNA, 64 nt, Homo Sapiens
cugaagaccgcagugagucaaaccaaagagggagcuaggcaaagaucuuacguggagacagguc

SEQ ID NO: 616305 - RNA, 64 nt, Homo Sapiens
acaccgaaugacucaguccaagcuaaagaaccuucuaggcaagucuuacuccugugagucccag

SEQ ID NO: 616306 - RNA, 64 nt, Homo Sapiens
uggacuaccucauucaguaagaugcagcaaauaucuaggcaauguauuugugaaucaguaacca

SEQ ID NO: 616307 - RNA, 64 nt, Homo Sapiens
aggaccuggcaucaugguggccccucuuauuccucuaggcaagcaccguagcagggccccuggg

SEQ ID NO: 616308 - RNA, 64 nt, Homo Sapiens
ggauuagggggucuggauaggaagaguggggcugcuaggcaagucaggaucugagccaucgagg

SEQ ID NO: 616309 - RNA, 64 nt, Homo Sapiens
acacuuggcaaguuaaauguucuuccucuugcuucuaggcaaccgccugccagagucgucuugc

SEQ ID NO: 616310 - RNA, 64 nt, Homo Sapiens
acuucucuuuuccuauugcuuuaugaaucuaucacuaggcaaaagaauguaagaccugaaagag

SEQ ID NO: 616311 - RNA, 64 nt, Homo Sapiens
aauggcacuuguuaauuauuauccuaguucaaugcuaggcaaaucauauuuugcagcuaucaug

SEQ ID NO: 616312 - RNA, 64 nt, Homo Sapiens
auauauaaagaauauuuccccaaacuucaggauacuaggcaagauuggaauugagaaggguaga

SEQ ID NO: 616313 - RNA, 64 nt, Homo Sapiens
uggugaaauccugucuuuacaguucgagaucagccuaggcaacaguggaucacuugaguucagg

SEQ ID NO: 616314 - RNA, 64 nt, Homo Sapiens
aaaauagaaaaaagugugaaaggggaacugugggcuaggcaaacgcuaucuaaccagaauacau

SEQ ID NO: 616315 - RNA, 64 nt, Homo Sapiens
guagcagggggggaaaugcauuuauagaucauuucuaggcaaaauugugaagcuaaugaccaac

SEQ ID NO: 616316 - RNA, 64 nt, Homo Sapiens
gcuaucaaucauuaaggucauuacucucaaccaccuaggcaaugaagaauauaccauuucaaau

SEQ ID NO: 616317 - RNA, 64 nt, Homo Sapiens
uugaacuuaaauuauauucuauauguguaucuuccuaggcaaaagcuguaauuuccagagagac

SEQ ID NO: 616318 - RNA, 64 nt, Homo Sapiens
gaaaacucccagugguucaaacauccugaucauccuaggcaaacauugacaaauacugcucuga

SEQ ID NO: 616319 - RNA, 64 nt, Homo Sapiens
uugcguuaaaucuuuugagaguguaaaugccgggcuaggcaauugcaguuaauacauacagggg

SEQ ID NO: 616320 - RNA, 53 nt, Homo Sapiens
agcacuucuugggagccugacaccuaggcaaaacaugcucuuccuugcauacg

SEQ ID NO: 616321 - RNA, 64 nt, Homo Sapiens
ggacauggaaacugucacguccagccagcgagcucuaggcaaaacaggaaugcugucagaccag

SEQ ID NO: 616322 - RNA, 64 nt, Homo Sapiens
gagcaagacucugucucaaacacuacacuccagccuaggcaacagcaaugagccgagaucacac

SEQ ID NO: 616323 - RNA, 64 nt, Homo Sapiens
aacuuuugcuuauaacuacauauacaauuguucccuaggcaaccuuuauuucuguuaaacugaa

SEQ ID NO: 616324 - RNA, 64 nt, Homo Sapiens
uugcaagacuccaucucuacaguuugagaccagccuaggcaacagaggaucgcuugagcccaga

SEQ ID NO: 616325 - RNA, 64 nt, Homo Sapiens
acauguaaaaaauguaaaauggagaccaauugcacuaggcaaguguauauuuuguauuuuauau

SEQ ID NO: 616326 - RNA, 64 nt, Homo Sapiens
gaggaucacuugaguccaggaguuugaaaccuaccuaggcaacauggugaaaccuugucucuac

SEQ ID NO: 616327 - RNA, 64 nt, Homo Sapiens
uaaaccaaggacuaugaauacuaaauguuaaguucuaggcaauuauacggggacucagaaggac

SEQ ID NO: 616328 - RNA, 64 nt, Homo Sapiens
gaggaucacuugagccuaugaguucaagaccagccuaggcaauguagugacaccucauuucuau

SEQ ID NO: 616329 - RNA, 64 nt, Homo Sapiens
cacaaaaacaggcagucaucuuuaagggcuaugccuaggcaaacuacuaacaugcauugugaga

SEQ ID NO: 616330 - RNA, 64 nt, Homo Sapiens
uccacucaacaccagaucaacucagaauuucauucuaggcaaguacacuuacaaaugagaauuu

SEQ ID NO: 616331 - RNA, 64 nt, Homo Sapiens
cuccaacacaguugauguguuuuaguuauaugugcuaggcaaauugcagugcagaugagcacca

SEQ ID NO: 616332 - RNA, 64 nt, Homo Sapiens
aaaaacaaacauuguaagaaggcccauuacauaucuaggcaacuucaguguucauauagcaccu

SEQ ID NO: 616333 - RNA, 64 nt, Homo Sapiens
gccaaaauagcugaaauggagguucaaaagucaccuaggcaacuuuugcuguucuggauaauga

SEQ ID NO: 616334 - RNA, 64 nt, Homo Sapiens
uguucaccagguacgcaaggaaucaucccaguuccuaggcaacugaacagcaugugcagaucuu

SEQ ID NO: 616335 - RNA, 64 nt, Homo Sapiens
gacuguaugauuccauuuauaugaaauauacauacuaggcaaauccauggagauggaacauaga

SEQ ID NO: 616336 - RNA, 64 nt, Homo Sapiens
aucgugucuaguccagcccugucugggcccugugcuaggcaauaacucuugcagcccugaagga

SEQ ID NO: 616337 - RNA, 64 nt, Homo Sapiens
ugccacuccccacccccagccucugccggcuccccuaggcaaccccuuucuccccaggagcggg

SEQ ID NO: 616338 - RNA, 64 nt, Homo Sapiens
cuaaauugggaagcaaguaguugaaauuaacuugcuaggcaaccagaugacaccuuuuguuaug

SEQ ID NO: 616339 - RNA, 64 nt, Homo Sapiens
aagugaaaauuuggaauuuuggugcucaaaguuucuaggcaaagcacauuguguaaaggucucu

SEQ ID NO: 616340 - RNA, 64 nt, Homo Sapiens
guuucauauuucuuaucaccacaguaaguuccuacuaggcaaaaugagagggcaguguuuccuu

SEQ ID NO: 616341 - RNA, 64 nt, Homo Sapiens
gcagugagcugagaucacaccacugcacuucauccuaggcaacagagcgagacucugucucccc

SEQ ID NO: 616342 - RNA, 64 nt, Homo Sapiens
ccuuuuuuuuuuuuuuuugaccuucuuguuccagcuaggcaaugagcugcuauagauagcacug

SEQ ID NO: 616343 - RNA, 64 nt, Homo Sapiens
cuucaaaagaugcacuuuagauauugcaguuuuacuaggcaaauuguuaaguguuuuguauaug

SEQ ID NO: 616344 - RNA, 64 nt, Homo Sapiens
cauugacauuucuccaaucagauauucgugcuaccuaggcaauccuggaugcugagaauggucu

SEQ ID NO: 616345 - RNA, 64 nt, Homo Sapiens
cccagguugcagacauggugagaaaaauuuggggcuaggcaagcgcuggagcuuggcgccugcc

SEQ ID NO: 616346 - RNA, 64 nt, Homo Sapiens
gagcaagacccugucucuuacacugcacuccagccuaggcaacacaggugagccaugaucgugu

SEQ ID NO: 616347 - RNA, 64 nt, Homo Sapiens
uaguauucaugacuauggauguuccccacuguaucuaggcaacacugcauuucacuuucccggu

SEQ ID NO: 616348 - RNA, 64 nt, Homo Sapiens
cgaagcucugagucauucagcccuggggacaccccuaggcaacgauuccgacagcgccauccag

SEQ ID NO: 616349 - RNA, 64 nt, Homo Sapiens
gggggguugguugguugguugguuuugucggaaccuaggcaaaugaccauauuagugaaucugu

SEQ ID NO: 616350 - RNA, 64 nt, Homo Sapiens
uuuuuuaguuuauaauguuuaauaacuguccagacuaggcaaauuuuuaguauaaauuugagac

SEQ ID NO: 616351 - RNA, 64 nt, Homo Sapiens
agcaccccagguacuccaggagacauuuauaguacuaggcaaacaaggcaauacuguaauguaa

SEQ ID NO: 616352 - RNA, 64 nt, Homo Sapiens
ggaaaacugcugugugugguugcaucucaaggggcuaggcaaggugugcucucgcuaucaagaa

SEQ ID NO: 616353 - RNA, 64 nt, Homo Sapiens
caacucauauguuaagaccaugauguucuucaaacuaggcaaaauuaaaaccacuaaaauagau

SEQ ID NO: 616354 - RNA, 64 nt, Homo Sapiens
gaggauuacuugaggccagaaguuugagacuagccuaggcaauauaaugagacccugucucuac

SEQ ID NO: 616355 - RNA, 64 nt, Homo Sapiens
auccauucuucaagacuuaggugccacauuauaacuaggcaauuaguggauuaauacagcaaga

SEQ ID NO: 616356 - RNA, 64 nt, Homo Sapiens
ugggggaugacuuagguuaaugcuccugacaggucuaggcaaccuuuguaucuucauaaggcca

SEQ ID NO: 616357 - RNA, 64 nt, Homo Sapiens
cguaugaaucggauuaacuguuguccuguacuuacuaggcaaaauguauucuuuauggaaaaug

SEQ ID NO: 616358 - RNA, 64 nt, Homo Sapiens
aaugcagcaguugcgauaaaaagcuguugagguccuaggcaauuacauuucccagacuuucaug

SEQ ID NO: 616359 - RNA, 64 nt, Homo Sapiens
agucagauucacagaaaaaaaaggacauuucuaccuaggcaaucguaucacugaggccaccgaa

SEQ ID NO: 616360 - RNA, 64 nt, Homo Sapiens
uaaggaaagugauccaaaauugauuccuucuuuucuaggcaauaauucauuuugaaaaacacaa

SEQ ID NO: 616361 - RNA, 64 nt, Homo Sapiens
uuuuuguuugugaauaguaccaacacagacacuccuaggcaaagauguauugcauaagcuaaag

SEQ ID NO: 616362 - RNA, 64 nt, Homo Sapiens
agugguuauacucugcaaauaaauuagcuuuugucuaggcaacuuuaaguuuuugauuuuguag

SEQ ID NO: 616363 - RNA, 64 nt, Homo Sapiens
aaauuuaagcuccucacuuuguggugaguuccugcuaggcaaccugagagguagcaagucuagg

SEQ ID NO: 616364 - RNA, 64 nt, Homo Sapiens
ugucgaagaaggaaggcgaagaaucaaguaaucucuaggcaaaugccuucaaguuuuccaguuc

SEQ ID NO: 616365 - RNA, 51 nt, Homo Sapiens
gggcuuugcucuuucagugagcuaggcaaucaagucucacagauugcugcc

SEQ ID NO: 616366 - RNA, 64 nt, Homo Sapiens
augaaauguguuuuccccuguguacuaacacauucuaggcaaaauucaaacuuauagugguaaa

SEQ ID NO: 616367 - RNA, 64 nt, Homo Sapiens
cugagcccccugcagcucccaucuccagcuauuccuaggcaaagagccucauggcuaaggcagc

SEQ ID NO: 616368 - RNA, 64 nt, Homo Sapiens
cccugcaucccuugccucaggcaucauucucugccuaggcaaggaugccuagaugccucggaga

SEQ ID NO: 616369 - RNA, 64 nt, Homo Sapiens
cugcuuucuaagcaguuguacacuacagucaucacuaggcaauuuacauuucaguuaaaaggca

SEQ ID NO: 616370 - RNA, 64 nt, Homo Sapiens
uuacaagugaccuaaugggagggagccuguuuugcuaggcaaaggauggcaagccuuaugucuu

SEQ ID NO: 616371 - RNA, 64 nt, Homo Sapiens
uauuuuuauacuuuuauuuucacuaguuuugcuucuaggcaaaaagcaaaauaaacuuuucauc

SEQ ID NO: 616372 - RNA, 64 nt, Homo Sapiens
uuauuggauccugaaaccaaucaauuacuuagaacuaggcaaagaugaaaguauagccaacuau

SEQ ID NO: 616373 - RNA, 64 nt, Homo Sapiens
cgagcaaaacuuccucucaacauugcauuccagccuaggcaacagcagugagucgagaucaugc

SEQ ID NO: 616374 - RNA, 64 nt, Homo Sapiens
uagugagacccugucucuacaguucaagacuagccuaggcaacagaggaucacuugagcccagg

SEQ ID NO: 616375 - RNA, 64 nt, Homo Sapiens
ugggaacugauguagaaggcaggauuuagcccuucuaggcaaaagaaaagcucaguuggguuuc

SEQ ID NO: 616376 - RNA, 64 nt, Homo Sapiens
aaaaccccaaacuauaaaaacucuggaagauaaccuaggcaauaccauucuggacauaggaacg

SEQ ID NO: 616377 - RNA, 64 nt, Homo Sapiens
cacuguucagggggcugguggccgucuccacucccuaggcaaguucucugaggcagaagggggu

SEQ ID NO: 616378 - RNA, 64 nt, Homo Sapiens
cuggauggccuugugaacuugagcucaguguaugcuaggcaacaauucucccgcuccagacccu

SEQ ID NO: 616379 - RNA, 64 nt, Homo Sapiens
uugcguuaaaucuuuugagaauguaaaugccgggcuaggcaauugcaguuaauacauacagagg

SEQ ID NO: 616380 - RNA, 64 nt, Homo Sapiens
ggucaagccaugcuuugugaccuaaagucaggaacuaggcaagucagagaggggaagugauugg

SEQ ID NO: 616381 - RNA, 64 nt, Homo Sapiens
acuggccugauugcagaguaaggcagagaagccccuaggcaaaggaaagucuugguuacuuaag

SEQ ID NO: 616382 - RNA, 64 nt, Homo Sapiens
aaaccauugucuuuguuuucauaaauauuauauacuaggcaaagaugucuucugucauuucuua

SEQ ID NO: 616383 - RNA, 64 nt, Homo Sapiens
gagugauacgcuguuuaaaacucugugcuccauccuaggcaacagcagugagcuaugagggugc

SEQ ID NO: 616384 - RNA, 64 nt, Homo Sapiens
gaggaucacuugaggccaggagucugagacaagccuaggcaacaaaacaagacucugucucuac

SEQ ID NO: 616385 - RNA, 64 nt, Homo Sapiens
ggccucucccucucagugugaggcuucacccaugcuaggcaagcccagggcacagaugccggga

SEQ ID NO: 616386 - RNA, 64 nt, Homo Sapiens
agaaauuuucuuucuuucuacuuaaagguuuuuacuaggcaaggauccuagccgugaguuggaa

SEQ ID NO: 616387 - RNA, 64 nt, Homo Sapiens
cuuuauaaaguugcaguacccgcugcuucuugaucuaggcaaacauagaugaggugugugugug

SEQ ID NO: 616388 - RNA, 64 nt, Homo Sapiens
gagggagacucugucucauuuacugcacuccagccuaggcaacaggggggagccuagauugcgc

SEQ ID NO: 616389 - RNA, 64 nt, Homo Sapiens
cuuugguuuuccuucagacauuauuaugucuguacuaggcaacuaauucagacuguccugguug

SEQ ID NO: 616390 - RNA, 64 nt, Homo Sapiens
uagaccuaaaaccauaaaaacccuagaagaaaaccuaggcaauaccauucaggacauaggcaug

SEQ ID NO: 616391 - RNA, 64 nt, Homo Sapiens
gaggaucgcuugaggccaggaguuugagacuagccuaggcaacacagugaggccuuaucucaac

SEQ ID NO: 616392 - RNA, 64 nt, Homo Sapiens
gaggaucgcuuaagcccaggaauucgaaaucagccuaggcaacauaguaagaccucaucucuac

SEQ ID NO: 616393 - RNA, 64 nt, Homo Sapiens
uuacagcuugugaggccaggaguuugagaccauccuaggcaacauaaugagacaccgucucuaa

SEQ ID NO: 616394 - RNA, 64 nt, Homo Sapiens
ccuuucucucagugcucgccuucccccagaaucccuaggcaaccacugaguaguuuucacugua

SEQ ID NO: 616395 - RNA, 64 nt, Homo Sapiens
gcggcccucugcagccaagagcgccuguggacgccuaggcaagaccuccgcgagccccaucguc

SEQ ID NO: 616396 - RNA, 64 nt, Homo Sapiens
gaaguauaaacuauuuuauaucagguuucuacugcuaggcaauugaagccgaaauuccuagaaa

SEQ ID NO: 616397 - RNA, 64 nt, Homo Sapiens
gagacucugucucaaaaaaacacugcacuccagccuaggcaacagcagugaaccaagaucacac

SEQ ID NO: 616398 - RNA, 64 nt, Homo Sapiens
auguaauugcuauauuuuguuuuguuuuuccuuacuaggcaaaguuaaaauguuccaugcuuug

SEQ ID NO: 616399 - RNA, 64 nt, Homo Sapiens
uuaacgauggggauacauucuuagaaaugugucacuaggcaauucugucauuguguaaacauua

SEQ ID NO: 616400 - RNA, 64 nt, Homo Sapiens
gugguggggcaagaucgcaccauugcacccgagccuaggcaacaagagugaaauuccgucucaa

SEQ ID NO: 616401 - RNA, 64 nt, Homo Sapiens
uaauuauccuuaaaaaaguuucuccauuuuugcucuaggcaaauaauaucaaacuuccugcaua

SEQ ID NO: 616402 - RNA, 64 nt, Homo Sapiens
caaauucugcaguggaauggagaggaaaauacuucuaggcaagcagcuagacuggugaauuggg

SEQ ID NO: 616403 - RNA, 64 nt, Homo Sapiens
ugacucugcaagcagacaccucgaggcagguguucuaggcaaagggaugggcaugagcgaaggc

SEQ ID NO: 616404 - RNA, 64 nt, Homo Sapiens
gaggaucacuugagcccaggaguucgagaccagccuaggcaacauagcaagacccugucuguac

SEQ ID NO: 616405 - RNA, 64 nt, Homo Sapiens
gcaucuuugauaaacuucucagugaaaauguuggcuaggcaaguucaguuaaaauauaguagaa

SEQ ID NO: 616406 - RNA, 64 nt, Homo Sapiens
ggucggggccccaguuaagcugugccccaccacccuaggcaaugaggggcaggaaagggguaca

SEQ ID NO: 616407 - RNA, 64 nt, Homo Sapiens
cugccggaugugaaauccaggcgucagcuguuuccuaggcaagggcaggaaaguggucuccagc

SEQ ID NO: 616408 - RNA, 64 nt, Homo Sapiens
gagaguggguucaaaagacuguccugucucuauucuaggcaagagaaugggggacauaaagccu

SEQ ID NO: 616409 - RNA, 64 nt, Homo Sapiens
ccacugaagaacaaguguucuaauuacacuggaccuaggcaaaauuaaaacauguuuugauaag

SEQ ID NO: 616410 - RNA, 64 nt, Homo Sapiens
agaagugaggagaaaccugcuccuuccaauauaacuaggcaaaagcugcucccagauuacuccu

SEQ ID NO: 616411 - RNA, 64 nt, Homo Sapiens
gccauacuuuucacaauuaauguagccaguucagcuaggcaaaacuuuaaauuacuuuuuggau

SEQ ID NO: 616412 - RNA, 64 nt, Homo Sapiens
uuucucauguaauguuuagggaguuuauucuaaccuaggcaaacggcaugcuaucacaagaaag

SEQ ID NO: 616413 - RNA, 64 nt, Homo Sapiens
cagugagaacucaucucuguguucaagggccaaccuaggcaacaaggacugauugaguccgggu

SEQ ID NO: 616414 - RNA, 64 nt, Homo Sapiens
uuaaauugccagaaaacaaaugaugaggcaacuacagucagauuuauagccagccaucuaucac

SEQ ID NO: 616415 - RNA, 64 nt, Homo Sapiens
ucucaaauuacaauuccaaagagccgccacucaacagucagaugaacccaacagucagaugaga

SEQ ID NO: 616416 - RNA, 64 nt, Homo Sapiens
aaagagccgccacucaacagucagaugaacccaacagucagaugagagaaaugaacccuacuug

SEQ ID NO: 616417 - RNA, 64 nt, Homo Sapiens
ggggagggagggacaaacacucccaaucauccaccagucagacugaauguguagcuggcgagga

SEQ ID NO: 616418 - RNA, 64 nt, Homo Sapiens
uucugccuccaguuggagcuuucagcuguuaaaacagucagaaacuauugauucuucccuuuag

SEQ ID NO: 616419 - RNA, 64 nt, Homo Sapiens
agcccuacaaauguaaagaaugugaaaagucuuucagucagagcucaagucuuagucgacauaa

SEQ ID NO: 616420 - RNA, 64 nt, Homo Sapiens
aagccuuugauugugauguaugggaaaagaacuccagucagagagcacaucuaguucaacauca

SEQ ID NO: 616421 - RNA, 64 nt, Homo Sapiens
auauagcacuagcaaagcauuauuauaagcauugcagucagauggaggcccaggauccccaaaa

SEQ ID NO: 616422 - RNA, 64 nt, Homo Sapiens
aaugcauucuguacuacaucucuauuccagaagacagucagaaucuuucauccuuuccaauuuu

SEQ ID NO: 616423 - RNA, 64 nt, Homo Sapiens
ggugugcugguaaaguauuuucugagaaaugcugcagucagaagcuuuucaccugagccuuucu

SEQ ID NO: 616424 - RNA, 64 nt, Homo Sapiens
uguucacuaaugacucaaguccucagcccagacucagucagacaacaaaaugcagagccagguc

SEQ ID NO: 616425 - RNA, 64 nt, Homo Sapiens
ucccaagggacccucaaggaccucgagguuacugcagucagaugccaucucauccccugugggg

SEQ ID NO: 616426 - RNA, 64 nt, Homo Sapiens
cuugauguaaaucccauguuaauuuauuaaauuucagucagaaggucagcauuuacaugacaga

SEQ ID NO: 616427 - RNA, 64 nt, Homo Sapiens
uuugugcuaagggcccugguugacugaguggccccagucagaugagaggcaaguccuaagcuuc

SEQ ID NO: 616428 - RNA, 64 nt, Homo Sapiens
aaguccccuccugggcugucuucaucauacuccgcagucagacugggcugguaguaagcugccg

SEQ ID NO: 616429 - RNA, 64 nt, Homo Sapiens
auuuuucuugcugccuuuuucacccaagauucagcagucagauguuuacugcacaccuauuacc

SEQ ID NO: 616430 - RNA, 64 nt, Homo Sapiens
ggauuucuuuggaugcugaaugcagugauguuaucagucagauucuuuccuuggcucaguugug

SEQ ID NO: 616431 - RNA, 64 nt, Homo Sapiens
aaucucaaaacugcuaguggugcaccaaccaccacagucagaauucuccugcgguuaccagccc

SEQ ID NO: 616432 - RNA, 64 nt, Homo Sapiens
uuaggaaacacccucuagggccuuuuguggcauccagucagaagaggacuugggccccagcagg

SEQ ID NO: 616433 - RNA, 64 nt, Homo Sapiens; identical to SEQ ID NO: 492451

SEQ ID NO: 616434 - RNA, 64 nt, Homo Sapiens; identical to SEQ ID NO: 492452

SEQ ID NO: 616435 - RNA, 64 nt, Homo Sapiens; identical to SEQ ID NO: 492453

SEQ ID NO: 616436 - RNA, 64 nt, Homo Sapiens; identical to SEQ ID NO: 492454

SEQ ID NO: 616437 - RNA, 64 nt, Homo Sapiens; identical to SEQ ID NO: 492455

SEQ ID NO: 616438 - RNA, 64 nt, Homo Sapiens; identical to SEQ ID NO: 492456

SEQ ID NO: 616439 - RNA, 64 nt, Homo Sapiens; identical to SEQ ID NO: 492457

SEQ ID NO: 616440 - RNA, 64 nt, Homo Sapiens; identical to SEQ ID NO: 492458

SEQ ID NO: 616441 - RNA, 64 nt, Homo Sapiens; identical to SEQ ID NO: 492459

SEQ ID NO: 616442 - RNA, 64 nt, Homo Sapiens; identical to SEQ ID NO: 492460

SEQ ID NO: 616443 - RNA, 64 nt, Homo Sapiens; identical to SEQ ID NO: 492461

SEQ ID NO: 616444 - RNA, 64 nt, Homo Sapiens; identical to SEQ ID NO: 492462

SEQ ID NO: 616445 - RNA, 64 nt, Homo Sapiens; identical to SEQ ID NO: 492463

SEQ ID NO: 616446 - RNA, 64 nt, Homo Sapiens; identical to SEQ ID NO: 492464

SEQ ID NO: 616447 - RNA, 64 nt, Homo Sapiens; identical to SEQ ID NO: 492465

SEQ ID NO: 616448 - RNA, 64 nt, Homo Sapiens; identical to SEQ ID NO: 492466

SEQ ID NO: 616449 - RNA, 64 nt, Homo Sapiens; identical to SEQ ID NO: 492467

SEQ ID NO: 616450 - RNA, 64 nt, Homo Sapiens; identical to SEQ ID NO: 492468

SEQ ID NO: 616451 - RNA, 64 nt, Homo Sapiens; identical to SEQ ID NO: 561089

SEQ ID NO: 616452 - RNA, 64 nt, Homo Sapiens; identical to SEQ ID NO: 561090

SEQ ID NO: 616453 - RNA, 64 nt, Homo Sapiens; identical to SEQ ID NO: 561091

SEQ ID NO: 616454 - RNA, 64 nt, Homo Sapiens; identical to SEQ ID NO: 561092

SEQ ID NO: 616455 - RNA, 64 nt, Homo Sapiens; identical to SEQ ID NO: 561093

SEQ ID NO: 616456 - RNA, 64 nt, Homo Sapiens; identical to SEQ ID NO: 561094

SEQ ID NO: 616457 - RNA, 64 nt, Homo Sapiens; identical to SEQ ID NO: 561095

SEQ ID NO: 616458 - RNA, 64 nt, Homo Sapiens; identical to SEQ ID NO: 561096

SEQ ID NO: 616459 - RNA, 64 nt, Homo Sapiens; identical to SEQ ID NO: 561097

SEQ ID NO: 616460 - RNA, 64 nt, Homo Sapiens; identical to SEQ ID NO: 561098

SEQ ID NO: 616461 - RNA, 64 nt, Homo Sapiens; identical to SEQ ID NO: 561099

SEQ ID NO: 616462 - RNA, 64 nt, Homo Sapiens; identical to SEQ ID NO: 561100

SEQ ID NO: 616463 - RNA, 64 nt, Homo Sapiens; identical to SEQ ID NO: 561101

SEQ ID NO: 616464 - RNA, 64 nt, Homo Sapiens; identical to SEQ ID NO: 561102

SEQ ID NO: 616465 - RNA, 64 nt, Homo Sapiens; identical to SEQ ID NO: 561103

SEQ ID NO: 616466 - RNA, 64 nt, Homo Sapiens; identical to SEQ ID NO: 561104

SEQ ID NO: 616467 - RNA, 64 nt, Homo Sapiens; identical to SEQ ID NO: 561105

SEQ ID NO: 616468 - RNA, 64 nt, Homo Sapiens; identical to SEQ ID NO: 561106

SEQ ID NO: 616469 - RNA, 64 nt, Homo Sapiens; identical to SEQ ID NO: 561107

SEQ ID NO: 616470 - RNA, 64 nt, Homo Sapiens; identical to SEQ ID NO: 561108

SEQ ID NO: 616471 - RNA, 64 nt, Homo Sapiens; identical to SEQ ID NO: 561109

SEQ ID NO: 616472 - RNA, 64 nt, Homo Sapiens; identical to SEQ ID NO: 561110

SEQ ID NO: 616473 - RNA, 64 nt, Homo Sapiens; identical to SEQ ID NO: 561111

SEQ ID NO: 616474 - RNA, 64 nt, Homo Sapiens; identical to SEQ ID NO: 561112

SEQ ID NO: 616475 - RNA, 64 nt, Homo Sapiens; identical to SEQ ID NO: 561113

SEQ ID NO: 616476 - RNA, 64 nt, Homo Sapiens; identical to SEQ ID NO: 561114

SEQ ID NO: 616477 - RNA, 64 nt, Homo Sapiens; identical to SEQ ID NO: 561115

SEQ ID NO: 616478 - RNA, 64 nt, Homo Sapiens; identical to SEQ ID NO: 561116

SEQ ID NO: 616479 - RNA, 64 nt, Homo Sapiens; identical to SEQ ID NO: 561117

SEQ ID NO: 616480 - RNA, 64 nt, Homo Sapiens; identical to SEQ ID NO: 561118

SEQ ID NO: 616481 - RNA, 64 nt, Homo Sapiens; identical to SEQ ID NO: 561119

SEQ ID NO: 616482 - RNA, 64 nt, Homo Sapiens; identical to SEQ ID NO: 561120

SEQ ID NO: 616483 - RNA, 64 nt, Homo Sapiens; identical to SEQ ID NO: 561121

SEQ ID NO: 616484 - RNA, 64 nt, Homo Sapiens; identical to SEQ ID NO: 561122

SEQ ID NO: 616485 - RNA, 64 nt, Homo Sapiens; identical to SEQ ID NO: 561123

SEQ ID NO: 616486 - RNA, 64 nt, Homo Sapiens; identical to SEQ ID NO: 561124

SEQ ID NO: 616487 - RNA, 64 nt, Homo Sapiens; identical to SEQ ID NO: 561125

SEQ ID NO: 616488 - RNA, 64 nt, Homo Sapiens; identical to SEQ ID NO: 561126

SEQ ID NO: 616489 - RNA, 64 nt, Homo Sapiens; identical to SEQ ID NO: 561127

SEQ ID NO: 616490 - RNA, 64 nt, Homo Sapiens; identical to SEQ ID NO: 561128

SEQ ID NO: 616491 - RNA, 64 nt, Homo Sapiens; identical to SEQ ID NO: 561129

SEQ ID NO: 616492 - RNA, 64 nt, Homo Sapiens; identical to SEQ ID NO: 561130

SEQ ID NO: 616493 - RNA, 64 nt, Homo Sapiens; identical to SEQ ID NO: 561131

SEQ ID NO: 616494 - RNA, 64 nt, Homo Sapiens; identical to SEQ ID NO: 561132

SEQ ID NO: 616495 - RNA, 64 nt, Homo Sapiens; identical to SEQ ID NO: 561133

SEQ ID NO: 616496 - RNA, 64 nt, Homo Sapiens; identical to SEQ ID NO: 561134

SEQ ID NO: 616497 - RNA, 64 nt, Homo Sapiens; identical to SEQ ID NO: 561135

SEQ ID NO: 616498 - RNA, 64 nt, Homo Sapiens; identical to SEQ ID NO: 561136

SEQ ID NO: 616499 - RNA, 64 nt, Homo Sapiens; identical to SEQ ID NO: 561137

SEQ ID NO: 616500 - RNA, 64 nt, Homo Sapiens; identical to SEQ ID NO: 561138

SEQ ID NO: 616501 - RNA, 64 nt, Homo Sapiens; identical to SEQ ID NO: 561139

SEQ ID NO: 616502 - RNA, 64 nt, Homo Sapiens; identical to SEQ ID NO: 561140

SEQ ID NO: 616503 - RNA, 64 nt, Homo Sapiens; identical to SEQ ID NO: 561141

SEQ ID NO: 616504 - RNA, 64 nt, Homo Sapiens; identical to SEQ ID NO: 561142

SEQ ID NO: 616505 - RNA, 64 nt, Homo Sapiens; identical to SEQ ID NO: 561143

SEQ ID NO: 616506 - RNA, 64 nt, Homo Sapiens; identical to SEQ ID NO: 561144

SEQ ID NO: 616507 - RNA, 64 nt, Homo Sapiens; identical to SEQ ID NO: 561145

SEQ ID NO: 616508 - RNA, 64 nt, Homo Sapiens; identical to SEQ ID NO: 561146

SEQ ID NO: 616509 - RNA, 64 nt, Homo Sapiens; identical to SEQ ID NO: 561147

SEQ ID NO: 616510 - RNA, 64 nt, Homo Sapiens; identical to SEQ ID NO: 561148

SEQ ID NO: 616511 - RNA, 64 nt, Homo Sapiens; identical to SEQ ID NO: 561149

SEQ ID NO: 616512 - RNA, 64 nt, Homo Sapiens; identical to SEQ ID NO: 561150

SEQ ID NO: 616513 - RNA, 64 nt, Homo Sapiens; identical to SEQ ID NO: 561151

SEQ ID NO: 616514 - RNA, 64 nt, Homo Sapiens; identical to SEQ ID NO: 561152

SEQ ID NO: 616515 - RNA, 64 nt, Homo Sapiens; identical to SEQ ID NO: 561153

SEQ ID NO: 616516 - RNA, 64 nt, Homo Sapiens; identical to SEQ ID NO: 561154

SEQ ID NO: 616517 - RNA, 64 nt, Homo Sapiens; identical to SEQ ID NO: 561155

SEQ ID NO: 616518 - RNA, 64 nt, Homo Sapiens; identical to SEQ ID NO: 561156

SEQ ID NO: 616519 - RNA, 64 nt, Homo Sapiens; identical to SEQ ID NO: 561157

SEQ ID NO: 616520 - RNA, 64 nt, Homo Sapiens; identical to SEQ ID NO: 561158

SEQ ID NO: 616521 - RNA, 64 nt, Homo Sapiens; identical to SEQ ID NO: 561159

SEQ ID NO: 616522 - RNA, 64 nt, Homo Sapiens; identical to SEQ ID NO: 561160

SEQ ID NO: 616523 - RNA, 64 nt, Homo Sapiens; identical to SEQ ID NO: 561161

SEQ ID NO: 616524 - RNA, 64 nt, Homo Sapiens; identical to SEQ ID NO: 561162

SEQ ID NO: 616525 - RNA, 64 nt, Homo Sapiens; identical to SEQ ID NO: 561163

SEQ ID NO: 616526 - RNA, 64 nt, Homo Sapiens; identical to SEQ ID NO: 561164

SEQ ID NO: 616527 - RNA, 64 nt, Homo Sapiens; identical to SEQ ID NO: 561165

SEQ ID NO: 616528 - RNA, 64 nt, Homo Sapiens; identical to SEQ ID NO: 561166

SEQ ID NO: 616529 - RNA, 64 nt, Homo Sapiens; identical to SEQ ID NO: 561167

SEQ ID NO: 616530 - RNA, 64 nt, Homo Sapiens; identical to SEQ ID NO: 561168

SEQ ID NO: 616531 - RNA, 64 nt, Homo Sapiens; identical to SEQ ID NO: 561169

SEQ ID NO: 616532 - RNA, 64 nt, Homo Sapiens; identical to SEQ ID NO: 561170

SEQ ID NO: 616533 - RNA, 64 nt, Homo Sapiens; identical to SEQ ID NO: 561171

SEQ ID NO: 616534 - RNA, 64 nt, Homo Sapiens; identical to SEQ ID NO: 561172

SEQ ID NO: 616535 - RNA, 64 nt, Homo Sapiens; identical to SEQ ID NO: 561173

SEQ ID NO: 616536 - RNA, 64 nt, Homo Sapiens; identical to SEQ ID NO: 561174

SEQ ID NO: 616537 - RNA, 64 nt, Homo Sapiens; identical to SEQ ID NO: 561175

SEQ ID NO: 616538 - RNA, 64 nt, Homo Sapiens; identical to SEQ ID NO: 561176

SEQ ID NO: 616539 - RNA, 64 nt, Homo Sapiens; identical to SEQ ID NO: 561177

SEQ ID NO: 616540 - RNA, 64 nt, Homo Sapiens; identical to SEQ ID NO: 561178

SEQ ID NO: 616541 - RNA, 64 nt, Homo Sapiens; identical to SEQ ID NO: 561179

SEQ ID NO: 616542 - RNA, 64 nt, Homo Sapiens; identical to SEQ ID NO: 561180

SEQ ID NO: 616543 - RNA, 64 nt, Homo Sapiens; identical to SEQ ID NO: 561181

SEQ ID NO: 616544 - RNA, 64 nt, Homo Sapiens; identical to SEQ ID NO: 561182

SEQ ID NO: 616545 - RNA, 64 nt, Homo Sapiens; identical to SEQ ID NO: 561183

SEQ ID NO: 616546 - RNA, 64 nt, Homo Sapiens; identical to SEQ ID NO: 561184

SEQ ID NO: 616547 - RNA, 64 nt, Homo Sapiens; identical to SEQ ID NO: 561185

SEQ ID NO: 616548 - RNA, 64 nt, Homo Sapiens; identical to SEQ ID NO: 561186

SEQ ID NO: 616549 - RNA, 64 nt, Homo Sapiens; identical to SEQ ID NO: 561187

SEQ ID NO: 616550 - RNA, 64 nt, Homo Sapiens; identical to SEQ ID NO: 561188

SEQ ID NO: 616551 - RNA, 64 nt, Homo Sapiens; identical to SEQ ID NO: 561189

SEQ ID NO: 616552 - RNA, 64 nt, Homo Sapiens; identical to SEQ ID NO: 561190

SEQ ID NO: 616553 - RNA, 64 nt, Homo Sapiens; identical to SEQ ID NO: 561191

SEQ ID NO: 616554 - RNA, 64 nt, Homo Sapiens; identical to SEQ ID NO: 561192

SEQ ID NO: 616555 - RNA, 64 nt, Homo Sapiens; identical to SEQ ID NO: 561193

SEQ ID NO: 616556 - RNA, 64 nt, Homo Sapiens; identical to SEQ ID NO: 561194

SEQ ID NO: 616557 - RNA, 64 nt, Homo Sapiens; identical to SEQ ID NO: 561195

SEQ ID NO: 616558 - RNA, 64 nt, Homo Sapiens; identical to SEQ ID NO: 561196

SEQ ID NO: 616559 - RNA, 64 nt, Homo Sapiens; identical to SEQ ID NO: 561197

SEQ ID NO: 616560 - RNA, 64 nt, Homo Sapiens; identical to SEQ ID NO: 561198

SEQ ID NO: 616561 - RNA, 64 nt, Homo Sapiens; identical to SEQ ID NO: 561199

SEQ ID NO: 616562 - RNA, 64 nt, Homo Sapiens
cuacucuacuucaccuaacccaggggcaauuuggcacucagauucacucagauuugugcccauu

SEQ ID NO: 616563 - RNA, 64 nt, Homo Sapiens
ugugcccauucaggggcaaucggugcauuuguaacacucagauuaauuugguuacagugugcua

SEQ ID NO: 616564 - RNA, 64 nt, Homo Sapiens
gacaggcuugucugccagcuggaugaggucgucacacucagaagcccccgccugugucaggugu

SEQ ID NO: 616565 - RNA, 64 nt, Homo Sapiens
ccucacugugcugggggcuucagaccacaagccacacucagagguuaacaacucuaacccagga

SEQ ID NO: 616566 - RNA, 64 nt, Homo Sapiens
gaggggccccugggauuccccagcagacgccgaccacucagacgagaaagacaugguauuuguu

SEQ ID NO: 616567 - RNA, 64 nt, Homo Sapiens
ucacacuucuuuucucccaucccgguugcaaucucacucagacaucacaguaccaccccagggg

SEQ ID NO: 616568 - RNA, 64 nt, Homo Sapiens
gauuuuguggggugggaguggggagcaggaauugcacucagacaugacauuucaauucaucucu

SEQ ID NO: 616569 - RNA, 64 nt, Homo Sapiens
ccccugcccuuucccuucaguuguuuuuccccuccacucagaaaaagcagccagauuuccaaug

SEQ ID NO: 616570 - RNA, 64 nt, Homo Sapiens
agcaaggcugauauuagcuugcagaagaucccuucacucagagauucucugaccccaaggagug

SEQ ID NO: 616571 - RNA, 64 nt, Homo Sapiens
uuuggaggaaaucagagaagugucaauggaccgucacucagacugagacuugaguuauuacaga

SEQ ID NO: 616572 - RNA, 64 nt, Homo Sapiens
gccagucagaggauaauauauauauucucaucagcacucagaguagucagugaagagaguagau

SEQ ID NO: 616573 - RNA, 64 nt, Homo Sapiens
uccagagucuagcguagugcgccgaccuugaccucacucagaagccaacaggggcuccaugcca

SEQ ID NO: 616574 - RNA, 64 nt, Homo Sapiens
agucugugacuuaguggacagagggauuccuaaucacucagagcggcagagcacagcgggguga

SEQ ID NO: 616575 - RNA, 64 nt, Homo Sapiens; identical to SEQ ID NO: 438956

SEQ ID NO: 616576 - RNA, 64 nt, Homo Sapiens; identical to SEQ ID NO: 438957

SEQ ID NO: 616577 - RNA, 64 nt, Homo Sapiens; identical to SEQ ID NO: 438958

SEQ ID NO: 616578 - RNA, 64 nt, Homo Sapiens; identical to SEQ ID NO: 438959

SEQ ID NO: 616579 - RNA, 64 nt, Homo Sapiens; identical to SEQ ID NO: 438960

SEQ ID NO: 616580 - RNA, 64 nt, Homo Sapiens; identical to SEQ ID NO: 438961

SEQ ID NO: 616581 - RNA, 64 nt, Homo Sapiens; identical to SEQ ID NO: 438962

SEQ ID NO: 616582 - RNA, 64 nt, Homo Sapiens; identical to SEQ ID NO: 438963

SEQ ID NO: 616583 - RNA, 64 nt, Homo Sapiens; identical to SEQ ID NO: 438964

SEQ ID NO: 616584 - RNA, 64 nt, Homo Sapiens; identical to SEQ ID NO: 438965

SEQ ID NO: 616585 - RNA, 64 nt, Homo Sapiens; identical to SEQ ID NO: 438966

SEQ ID NO: 616586 - RNA, 64 nt, Homo Sapiens; identical to SEQ ID NO: 438967

SEQ ID NO: 616587 - RNA, 64 nt, Homo Sapiens; identical to SEQ ID NO: 438968

SEQ ID NO: 616588 - RNA, 64 nt, Homo Sapiens; identical to SEQ ID NO: 438969

SEQ ID NO: 616589 - RNA, 64 nt, Homo Sapiens; identical to SEQ ID NO: 438970

SEQ ID NO: 616590 - RNA, 64 nt, Homo Sapiens; identical to SEQ ID NO: 438971

SEQ ID NO: 616591 - RNA, 64 nt, Homo Sapiens; identical to SEQ ID NO: 262953

SEQ ID NO: 616592 - RNA, 64 nt, Homo Sapiens; identical to SEQ ID NO: 262954

SEQ ID NO: 616593 - RNA, 64 nt, Homo Sapiens; identical to SEQ ID NO: 262955

SEQ ID NO: 616594 - RNA, 64 nt, Homo Sapiens; identical to SEQ ID NO: 262956

SEQ ID NO: 616595 - RNA, 64 nt, Homo Sapiens; identical to SEQ ID NO: 262957

SEQ ID NO: 616596 - RNA, 64 nt, Homo Sapiens; identical to SEQ ID NO: 262958

SEQ ID NO: 616597 - RNA, 64 nt, Homo Sapiens; identical to SEQ ID NO: 262959

SEQ ID NO: 616598 - RNA, 64 nt, Homo Sapiens; identical to SEQ ID NO: 262960

SEQ ID NO: 616599 - RNA, 64 nt, Homo Sapiens; identical to SEQ ID NO: 262961

SEQ ID NO: 616600 - RNA, 64 nt, Homo Sapiens; identical to SEQ ID NO: 262962

SEQ ID NO: 616601 - RNA, 64 nt, Homo Sapiens; identical to SEQ ID NO: 262963

SEQ ID NO: 616602 - RNA, 64 nt, Homo Sapiens; identical to SEQ ID NO: 262964

SEQ ID NO: 616603 - RNA, 64 nt, Homo Sapiens; identical to SEQ ID NO: 262965

SEQ ID NO: 616604 - RNA, 57 nt, Homo Sapiens; identical to SEQ ID NO: 262966

SEQ ID NO: 616605 - RNA, 64 nt, Homo Sapiens; identical to SEQ ID NO: 131383

SEQ ID NO: 616606 - RNA, 64 nt, Homo Sapiens; identical to SEQ ID NO: 131384

SEQ ID NO: 616607 - RNA, 64 nt, Homo Sapiens; identical to SEQ ID NO: 131385

SEQ ID NO: 616608 - RNA, 64 nt, Homo Sapiens; identical to SEQ ID NO: 131386

SEQ ID NO: 616609 - RNA, 64 nt, Homo Sapiens; identical to SEQ ID NO: 131387

SEQ ID NO: 616610 - RNA, 64 nt, Homo Sapiens; identical to SEQ ID NO: 131388

SEQ ID NO: 616611 - RNA, 64 nt, Homo Sapiens
auuauuugcaaauaccauggaugauaugcugcuucuguuuaacagugaugcaacauuauguggc

SEQ ID NO: 616612 - RNA, 64 nt, Homo Sapiens
gcauuuugcauuccauaugaaaaaaaugccacgucuguuuaaauuauuugauguagguuugggu

SEQ ID NO: 616613 - RNA, 64 nt, Homo Sapiens
auauuucaucuguucuauagggaagccauuuugucuguuuaaaauuucaguuuaauuuugcuuu

SEQ ID NO: 616614 - RNA, 64 nt, Homo Sapiens
uuugaacaguucuugucaauccgaauuguugauucuguuuaaaugaccaauacuuuuugaaauu

SEQ ID NO: 616615 - RNA, 64 nt, Homo Sapiens
ggcuuucacagacuggggaauuuucuaggugacccuguuuaauauggauuuauaaacuuguuuu

SEQ ID NO: 616616 - RNA, 64 nt, Homo Sapiens
gauuacugguccuacagccagauggagagcaugccuguuuaagguacugaacuucauccuguua

SEQ ID NO: 616617 - RNA, 64 nt, Homo Sapiens
gaauauuaaagggcuuggagugcuugugccucaacuguuuaaguaaaaaaugcaguuuuauuau

SEQ ID NO: 616618 - RNA, 64 nt, Homo Sapiens
caguaggcuuaauguguucuagucuugaaauguucuguuuaaauuccuucccuuucuguguagc

SEQ ID NO: 616619 - RNA, 64 nt, Homo Sapiens
acacuuguacagccgaguucuucccgcauuacugcuguuuaauagaacgugauuagucaucgcc

SEQ ID NO: 616620 - RNA, 64 nt, Homo Sapiens
agcccucucuaaauucacugucaucauuuaguaucuguuuaauuuuucaguccaaagagaggaa

SEQ ID NO: 616621 - RNA, 64 nt, Homo Sapiens
cuuugaauaucugcaaucuuaaaucaauuuaucacuguuuaaaguuuuuuuuuuuauauguauu

SEQ ID NO: 616622 - RNA, 64 nt, Homo Sapiens
cccuaagaaugucagaauuaacuccagguccauucuguuuaaauugauuauuuuucuccuggaa

SEQ ID NO: 616623 - RNA, 64 nt, Homo Sapiens
cugucuugggggauguagagaauguugggauuaccuguuuaaauucucugguuucugaauuuaa

SEQ ID NO: 616624 - RNA, 64 nt, Homo Sapiens
gaaaagaauuauaagaguuaucaacuugauuugucuguuuaauuuaguauuuuaacacuugucu

SEQ ID NO: 616625 - RNA, 64 nt, Homo Sapiens
gugcaauagguuccaauaugcauuuauuagacaucuguuuaaaugguaauguagcauuuauuuu

SEQ ID NO: 616626 - RNA, 64 nt, Homo Sapiens
guguggaggugaucacgaagauacauguguuugacuguuuaauuugaaaguuuacauuuuuuau

SEQ ID NO: 616627 - RNA, 64 nt, Homo Sapiens
acaaaaauuguuuauaucuuggaaaaaaaacuuucuguuuaaaaaaaauaaacaagugaauguu

SEQ ID NO: 616628 - RNA, 64 nt, Homo Sapiens
gucuguuuccauuugaauuucuuauuguaaaaaucuguuuaaauccauuuauauuauuuuacag

SEQ ID NO: 616629 - RNA, 64 nt, Homo Sapiens
cagcuguuuacaggauguguucaaucauaacaugcuguuuaaagcuuaagggaccacccuuugg

SEQ ID NO: 616630 - RNA, 64 nt, Homo Sapiens
cccaaagugacaucuucucauauggaacaccuuucuguuuaauuacugagauuucaagucguac

SEQ ID NO: 616631 - RNA, 64 nt, Homo Sapiens
auuuaaacaucugagccaaaaaagucuuuccaaacuguuuaaguaaacgaaauacacacagaaa

SEQ ID NO: 616632 - RNA, 64 nt, Homo Sapiens
cgcaucuucagaaaacuuccucaguauuuugcugcuguuuaauguuuuuagcaauagaauuguu

SEQ ID NO: 616633 - RNA, 64 nt, Homo Sapiens
aggccaugacucuuuaggugaaggauuaagaaagcuguuuaagaaaccaaaggauauuuccaga

SEQ ID NO: 616634 - RNA, 64 nt, Homo Sapiens
ugaacacacuacaucguagguuaacuguauacaucuguuuaauuuagagacuacacuaauuauu

SEQ ID NO: 616635 - RNA, 64 nt, Homo Sapiens
uguaaaguauaacuucagccacauuuuuagaacacuguuuaacauuuuugcaaaaccuucuugu

SEQ ID NO: 616636 - RNA, 64 nt, Homo Sapiens
acuaauuguuaacuauucauggaacagcaaacgccuguuuaauaaagaacuuugaccaaggcua

SEQ ID NO: 616637 - RNA, 64 nt, Homo Sapiens
aaugaaaaguagauauagauauugugaaaauaggcuguuuaacaaacagauuggaauaaagccu

SEQ ID NO: 616638 - RNA, 64 nt, Homo Sapiens
uuaaagaucugaagugugaguagaauguauucagcuguuuaacauguaguuuagauauucaaaa

SEQ ID NO: 616639 - RNA, 64 nt, Homo Sapiens
augacaaucaaaccaaaucaucaguuaucaaugucuguuuaauugugugacuaucugacuguug

SEQ ID NO: 616640 - RNA, 64 nt, Homo Sapiens
ucauucuucugguauuuguaaugaagugaauccacuguuuaaucagauccauaaucuuuaacag

SEQ ID NO: 616641 - RNA, 64 nt, Homo Sapiens
uggaacuuugugugugucugcauaaaacuauggccuguuuaagaguaaugacaacauauucuuu

SEQ ID NO: 616642 - RNA, 64 nt, Homo Sapiens
cccugcuucuguuuuuggucuugauaauauuuuucuguuuaaaucuacaauuuaugcaguuucu

SEQ ID NO: 616643 - RNA, 64 nt, Homo Sapiens
uguuuucagucuuauuuacgcuuaaguucagcaacuguuuaaccggaguccuuuuugucaugcc

SEQ ID NO: 616644 - RNA, 64 nt, Homo Sapiens
uuucaccccacucuguacaguugggcacugcacccuguuuaacacuggaccugguucuuagccc

SEQ ID NO: 616645 - RNA, 64 nt, Homo Sapiens
uacucaaguauuuaaauuuagagagaaugccgcucuguuuaaagcaauguguaaagaugaguuu

SEQ ID NO: 616646 - RNA, 64 nt, Homo Sapiens
ucacauuaaaguuuauuauguauuuaaugauacacuguuuaauugacaguuuugcauaguuugu

SEQ ID NO: 616647 - RNA, 64 nt, Homo Sapiens
gccuuuucauuacuuuguuaagaagaaaugccagcuguuuaaucacaccuaccccuggaaaaga

SEQ ID NO: 616648 - RNA, 64 nt, Homo Sapiens
uagaauucugguuagcuaauugaacuuuugugaccuguuuaaaaacaaaucaaauuuauugaac

SEQ ID NO: 616649 - RNA, 64 nt, Homo Sapiens
cacucugaugauaccaugguuaccccauugagcucuguuuaaauaaauauuguccuuucaugua

SEQ ID NO: 616650 - RNA, 64 nt, Homo Sapiens
gauggcccacaacuggguccacauguaaugagcccuguuuaauaacgaaggggugggggagagc

SEQ ID NO: 616651 - RNA, 64 nt, Homo Sapiens
uuuaacaagccagcuggcuuaugcugguucucagcuguuuaaaaaaaaaaaaaaaaaggaauag

SEQ ID NO: 616652 - RNA, 64 nt, Homo Sapiens
agacugugaucugggaacuuuuugcuguacaaaucuguuuaaaaaaaaaaaaaaguaacucauu

SEQ ID NO: 616653 - RNA, 64 nt, Homo Sapiens
aauugagcucaucaaaaauaaguaauaguauugacuguuuaaaaaaugugagaaaaauauaucc

SEQ ID NO: 616654 - RNA, 64 nt, Homo Sapiens
cuaaauuuuguuuucauguaaaugaagaauaggccuguuuaauguucccuacaagcauggagaa

SEQ ID NO: 616655 - RNA, 64 nt, Homo Sapiens
augugaggagccuaagucauauaggaaauccucacuguuuaaccacuucuaugucuagucuucc

SEQ ID NO: 616656 - RNA, 64 nt, Homo Sapiens
aguugguucacccuggcuuuaggaagguaggcaucuguuuaauucuuuggucuaagaguucuaa

SEQ ID NO: 616657 - RNA, 64 nt, Homo Sapiens; identical to SEQ ID NO: 127122

SEQ ID NO: 616658 - RNA, 64 nt, Homo Sapiens; identical to SEQ ID NO: 127123

SEQ ID NO: 616659 - RNA, 64 nt, Homo Sapiens; identical to SEQ ID NO: 127124

SEQ ID NO: 616660 - RNA, 64 nt, Homo Sapiens; identical to SEQ ID NO: 127125

SEQ ID NO: 616661 - RNA, 64 nt, Homo Sapiens; identical to SEQ ID NO: 127126

SEQ ID NO: 616662 - RNA, 64 nt, Homo Sapiens; identical to SEQ ID NO: 127127

SEQ ID NO: 616663 - RNA, 64 nt, Homo Sapiens; identical to SEQ ID NO: 127128

SEQ ID NO: 616664 - RNA, 64 nt, Homo Sapiens; identical to SEQ ID NO: 127129

SEQ ID NO: 616665 - RNA, 64 nt, Homo Sapiens; identical to SEQ ID NO: 127130

SEQ ID NO: 616666 - RNA, 64 nt, Homo Sapiens; identical to SEQ ID NO: 127131

SEQ ID NO: 616667 - RNA, 64 nt, Homo Sapiens; identical to SEQ ID NO: 127132

SEQ ID NO: 616668 - RNA, 64 nt, Homo Sapiens; identical to SEQ ID NO: 127133

SEQ ID NO: 616669 - RNA, 64 nt, Homo Sapiens; identical to SEQ ID NO: 127134

SEQ ID NO: 616670 - RNA, 64 nt, Homo Sapiens; identical to SEQ ID NO: 127135

SEQ ID NO: 616671 - RNA, 64 nt, Homo Sapiens; identical to SEQ ID NO: 127136

SEQ ID NO: 616672 - RNA, 64 nt, Homo Sapiens; identical to SEQ ID NO: 127137

SEQ ID NO: 616673 - RNA, 64 nt, Homo Sapiens; identical to SEQ ID NO: 127138

SEQ ID NO: 616674 - RNA, 64 nt, Homo Sapiens; identical to SEQ ID NO: 127139

SEQ ID NO: 616675 - RNA, 64 nt, Homo Sapiens; identical to SEQ ID NO: 127140

SEQ ID NO: 616676 - RNA, 64 nt, Homo Sapiens; identical to SEQ ID NO: 127141

SEQ ID NO: 616677 - RNA, 64 nt, Homo Sapiens; identical to SEQ ID NO: 127142

SEQ ID NO: 616678 - RNA, 64 nt, Homo Sapiens; identical to SEQ ID NO: 127143

SEQ ID NO: 616679 - RNA, 64 nt, Homo Sapiens; identical to SEQ ID NO: 127144

SEQ ID NO: 616680 - RNA, 64 nt, Homo Sapiens; identical to SEQ ID NO: 127145

SEQ ID NO: 616681 - RNA, 64 nt, Homo Sapiens; identical to SEQ ID NO: 127146

SEQ ID NO: 616682 - RNA, 64 nt, Homo Sapiens; identical to SEQ ID NO: 127147

SEQ ID NO: 616683 - RNA, 64 nt, Homo Sapiens; identical to SEQ ID NO: 127148

SEQ ID NO: 616684 - RNA, 64 nt, Homo Sapiens; identical to SEQ ID NO: 127149

SEQ ID NO: 616685 - RNA, 64 nt, Homo Sapiens; identical to SEQ ID NO: 127150

SEQ ID NO: 616686 - RNA, 64 nt, Homo Sapiens; identical to SEQ ID NO: 127151

SEQ ID NO: 616687 - RNA, 64 nt, Homo Sapiens; identical to SEQ ID NO: 127152

SEQ ID NO: 616688 - RNA, 64 nt, Homo Sapiens; identical to SEQ ID NO: 127153

SEQ ID NO: 616689 - RNA, 64 nt, Homo Sapiens; identical to SEQ ID NO: 127154

SEQ ID NO: 616690 - RNA, 64 nt, Homo Sapiens; identical to SEQ ID NO: 127155

SEQ ID NO: 616691 - RNA, 64 nt, Homo Sapiens; identical to SEQ ID NO: 127156

SEQ ID NO: 616692 - RNA, 64 nt, Homo Sapiens; identical to SEQ ID NO: 127157

SEQ ID NO: 616693 - RNA, 64 nt, Homo Sapiens; identical to SEQ ID NO: 127158

SEQ ID NO: 616694 - RNA, 64 nt, Homo Sapiens; identical to SEQ ID NO: 127159

SEQ ID NO: 616695 - RNA, 64 nt, Homo Sapiens; identical to SEQ ID NO: 127160

SEQ ID NO: 616696 - RNA, 64 nt, Homo Sapiens; identical to SEQ ID NO: 127161

SEQ ID NO: 616697 - RNA, 64 nt, Homo Sapiens; identical to SEQ ID NO: 127162

SEQ ID NO: 616698 - RNA, 64 nt, Homo Sapiens; identical to SEQ ID NO: 127163

SEQ ID NO: 616699 - RNA, 64 nt, Homo Sapiens; identical to SEQ ID NO: 127164

SEQ ID NO: 616700 - RNA, 64 nt, Homo Sapiens; identical to SEQ ID NO: 127165

SEQ ID NO: 616701 - RNA, 64 nt, Homo Sapiens; identical to SEQ ID NO: 127166

SEQ ID NO: 616702 - RNA, 64 nt, Homo Sapiens; identical to SEQ ID NO: 127167

SEQ ID NO: 616703 - RNA, 64 nt, Homo Sapiens; identical to SEQ ID NO: 127168

SEQ ID NO: 616704 - RNA, 64 nt, Homo Sapiens; identical to SEQ ID NO: 127169

SEQ ID NO: 616705 - RNA, 64 nt, Homo Sapiens; identical to SEQ ID NO: 127170

SEQ ID NO: 616706 - RNA, 64 nt, Homo Sapiens; identical to SEQ ID NO: 127171

SEQ ID NO: 616707 - RNA, 64 nt, Homo Sapiens; identical to SEQ ID NO: 127172

SEQ ID NO: 616708 - RNA, 64 nt, Homo Sapiens; identical to SEQ ID NO: 127173

SEQ ID NO: 616709 - RNA, 64 nt, Homo Sapiens; identical to SEQ ID NO: 127174

SEQ ID NO: 616710 - RNA, 64 nt, Homo Sapiens; identical to SEQ ID NO: 127175

SEQ ID NO: 616711 - RNA, 64 nt, Homo Sapiens; identical to SEQ ID NO: 127176

SEQ ID NO: 616712 - RNA, 64 nt, Homo Sapiens; identical to SEQ ID NO: 127177

SEQ ID NO: 616713 - RNA, 64 nt, Homo Sapiens; identical to SEQ ID NO: 127178

SEQ ID NO: 616714 - RNA, 64 nt, Homo Sapiens; identical to SEQ ID NO: 127179

SEQ ID NO: 616715 - RNA, 64 nt, Homo Sapiens; identical to SEQ ID NO: 127180

SEQ ID NO: 616716 - RNA, 64 nt, Homo Sapiens; identical to SEQ ID NO: 127181

SEQ ID NO: 616717 - RNA, 64 nt, Homo Sapiens; identical to SEQ ID NO: 127182

SEQ ID NO: 616718 - RNA, 64 nt, Homo Sapiens; identical to SEQ ID NO: 127183

SEQ ID NO: 616719 - RNA, 64 nt, Homo Sapiens; identical to SEQ ID NO: 127184

SEQ ID NO: 616720 - RNA, 64 nt, Homo Sapiens; identical to SEQ ID NO: 127185

SEQ ID NO: 616721 - RNA, 64 nt, Homo Sapiens; identical to SEQ ID NO: 127186

SEQ ID NO: 616722 - RNA, 64 nt, Homo Sapiens; identical to SEQ ID NO: 127187

SEQ ID NO: 616723 - RNA, 64 nt, Homo Sapiens; identical to SEQ ID NO: 127188

SEQ ID NO: 616724 - RNA, 64 nt, Homo Sapiens; identical to SEQ ID NO: 127189

SEQ ID NO: 616725 - RNA, 64 nt, Homo Sapiens; identical to SEQ ID NO: 127190

SEQ ID NO: 616726 - RNA, 64 nt, Homo Sapiens; identical to SEQ ID NO: 127191

SEQ ID NO: 616727 - RNA, 64 nt, Homo Sapiens; identical to SEQ ID NO: 127192

SEQ ID NO: 616728 - RNA, 64 nt, Homo Sapiens; identical to SEQ ID NO: 127193

SEQ ID NO: 616729 - RNA, 64 nt, Homo Sapiens; identical to SEQ ID NO: 127194

SEQ ID NO: 616730 - RNA, 64 nt, Homo Sapiens; identical to SEQ ID NO: 127195

SEQ ID NO: 616731 - RNA, 64 nt, Homo Sapiens; identical to SEQ ID NO: 127196

SEQ ID NO: 616732 - RNA, 64 nt, Homo Sapiens; identical to SEQ ID NO: 127197

SEQ ID NO: 616733 - RNA, 64 nt, Homo Sapiens; identical to SEQ ID NO: 127198

SEQ ID NO: 616734 - RNA, 64 nt, Homo Sapiens; identical to SEQ ID NO: 127199

SEQ ID NO: 616735 - RNA, 64 nt, Homo Sapiens; identical to SEQ ID NO: 127200

SEQ ID NO: 616736 - RNA, 64 nt, Homo Sapiens; identical to SEQ ID NO: 127201

SEQ ID NO: 616737 - RNA, 64 nt, Homo Sapiens; identical to SEQ ID NO: 127202

SEQ ID NO: 616738 - RNA, 64 nt, Homo Sapiens; identical to SEQ ID NO: 127203

SEQ ID NO: 616739 - RNA, 64 nt, Homo Sapiens; identical to SEQ ID NO: 127204

SEQ ID NO: 616740 - RNA, 64 nt, Homo Sapiens; identical to SEQ ID NO: 127205

SEQ ID NO: 616741 - RNA, 64 nt, Homo Sapiens; identical to SEQ ID NO: 127206

SEQ ID NO: 616742 - RNA, 64 nt, Homo Sapiens; identical to SEQ ID NO: 127207

SEQ ID NO: 616743 - RNA, 64 nt, Homo Sapiens; identical to SEQ ID NO: 127208

SEQ ID NO: 616744 - RNA, 64 nt, Homo Sapiens; identical to SEQ ID NO: 127209

SEQ ID NO: 616745 - RNA, 64 nt, Homo Sapiens; identical to SEQ ID NO: 127210

SEQ ID NO: 616746 - RNA, 64 nt, Homo Sapiens; identical to SEQ ID NO: 127211

SEQ ID NO: 616747 - RNA, 64 nt, Homo Sapiens; identical to SEQ ID NO: 127212

SEQ ID NO: 616748 - RNA, 64 nt, Homo Sapiens; identical to SEQ ID NO: 127213

SEQ ID NO: 616749 - RNA, 64 nt, Homo Sapiens; identical to SEQ ID NO: 127214

SEQ ID NO: 616750 - RNA, 64 nt, Homo Sapiens; identical to SEQ ID NO: 127215

SEQ ID NO: 616751 - RNA, 64 nt, Homo Sapiens; identical to SEQ ID NO: 127216

SEQ ID NO: 616752 - RNA, 64 nt, Homo Sapiens; identical to SEQ ID NO: 127217

SEQ ID NO: 616753 - RNA, 64 nt, Homo Sapiens; identical to SEQ ID NO: 127218

SEQ ID NO: 616754 - RNA, 64 nt, Homo Sapiens; identical to SEQ ID NO: 127219

SEQ ID NO: 616755 - RNA, 64 nt, Homo Sapiens; identical to SEQ ID NO: 127220

SEQ ID NO: 616756 - RNA, 64 nt, Homo Sapiens; identical to SEQ ID NO: 127221

SEQ ID NO: 616757 - RNA, 64 nt, Homo Sapiens; identical to SEQ ID NO: 127222

SEQ ID NO: 616758 - RNA, 64 nt, Homo Sapiens; identical to SEQ ID NO: 127223

SEQ ID NO: 616759 - RNA, 64 nt, Homo Sapiens; identical to SEQ ID NO: 127224

SEQ ID NO: 616760 - RNA, 64 nt, Homo Sapiens; identical to SEQ ID NO: 127225

SEQ ID NO: 616761 - RNA, 64 nt, Homo Sapiens; identical to SEQ ID NO: 127226

SEQ ID NO: 616762 - RNA, 64 nt, Homo Sapiens; identical to SEQ ID NO: 127227

SEQ ID NO: 616763 - RNA, 64 nt, Homo Sapiens; identical to SEQ ID NO: 127228

SEQ ID NO: 616764 - RNA, 64 nt, Homo Sapiens; identical to SEQ ID NO: 127229

SEQ ID NO: 616765 - RNA, 64 nt, Homo Sapiens; identical to SEQ ID NO: 127230

SEQ ID NO: 616766 - RNA, 64 nt, Homo Sapiens; identical to SEQ ID NO: 127231

SEQ ID NO: 616767 - RNA, 64 nt, Homo Sapiens; identical to SEQ ID NO: 127232

SEQ ID NO: 616768 - RNA, 64 nt, Homo Sapiens; identical to SEQ ID NO: 127233

SEQ ID NO: 616769 - RNA, 64 nt, Homo Sapiens; identical to SEQ ID NO: 127234

SEQ ID NO: 616770 - RNA, 64 nt, Homo Sapiens; identical to SEQ ID NO: 127235

SEQ ID NO: 616771 - RNA, 64 nt, Homo Sapiens; identical to SEQ ID NO: 127236

SEQ ID NO: 616772 - RNA, 64 nt, Homo Sapiens; identical to SEQ ID NO: 127237

SEQ ID NO: 616773 - RNA, 64 nt, Homo Sapiens; identical to SEQ ID NO: 127238

SEQ ID NO: 616774 - RNA, 64 nt, Homo Sapiens; identical to SEQ ID NO: 127239

SEQ ID NO: 616775 - RNA, 64 nt, Homo Sapiens; identical to SEQ ID NO: 127240

SEQ ID NO: 616776 - RNA, 64 nt, Homo Sapiens; identical to SEQ ID NO: 127241

SEQ ID NO: 616777 - RNA, 64 nt, Homo Sapiens; identical to SEQ ID NO: 127242

SEQ ID NO: 616778 - RNA, 64 nt, Homo Sapiens; identical to SEQ ID NO: 127243

SEQ ID NO: 616779 - RNA, 64 nt, Homo Sapiens; identical to SEQ ID NO: 127244

SEQ ID NO: 616780 - RNA, 64 nt, Homo Sapiens; identical to SEQ ID NO: 127245

SEQ ID NO: 616781 - RNA, 64 nt, Homo Sapiens; identical to SEQ ID NO: 127246

SEQ ID NO: 616782 - RNA, 64 nt, Homo Sapiens; identical to SEQ ID NO: 127247

SEQ ID NO: 616783 - RNA, 64 nt, Homo Sapiens; identical to SEQ ID NO: 127248

SEQ ID NO: 616784 - RNA, 64 nt, Homo Sapiens; identical to SEQ ID NO: 127249

SEQ ID NO: 616785 - RNA, 64 nt, Homo Sapiens; identical to SEQ ID NO: 127250

SEQ ID NO: 616786 - RNA, 64 nt, Homo Sapiens; identical to SEQ ID NO: 127251

SEQ ID NO: 616787 - RNA, 64 nt, Homo Sapiens; identical to SEQ ID NO: 127252

SEQ ID NO: 616788 - RNA, 64 nt, Homo Sapiens; identical to SEQ ID NO: 127253

SEQ ID NO: 616789 - RNA, 64 nt, Homo Sapiens; identical to SEQ ID NO: 127254

SEQ ID NO: 616790 - RNA, 64 nt, Homo Sapiens; identical to SEQ ID NO: 127255

SEQ ID NO: 616791 - RNA, 64 nt, Homo Sapiens; identical to SEQ ID NO: 127256

SEQ ID NO: 616792 - RNA, 64 nt, Homo Sapiens; identical to SEQ ID NO: 127257

SEQ ID NO: 616793 - RNA, 64 nt, Homo Sapiens; identical to SEQ ID NO: 127258

SEQ ID NO: 616794 - RNA, 64 nt, Homo Sapiens; identical to SEQ ID NO: 127259

SEQ ID NO: 616795 - RNA, 64 nt, Homo Sapiens; identical to SEQ ID NO: 127260

SEQ ID NO: 616796 - RNA, 64 nt, Homo Sapiens; identical to SEQ ID NO: 127261

SEQ ID NO: 616797 - RNA, 64 nt, Homo Sapiens; identical to SEQ ID NO: 127262

SEQ ID NO: 616798 - RNA, 64 nt, Homo Sapiens; identical to SEQ ID NO: 127263

SEQ ID NO: 616799 - RNA, 64 nt, Homo Sapiens; identical to SEQ ID NO: 127264

SEQ ID NO: 616800 - RNA, 64 nt, Homo Sapiens; identical to SEQ ID NO: 127265

SEQ ID NO: 616801 - RNA, 64 nt, Homo Sapiens; identical to SEQ ID NO: 127266

SEQ ID NO: 616802 - RNA, 64 nt, Homo Sapiens; identical to SEQ ID NO: 127267

SEQ ID NO: 616803 - RNA, 64 nt, Homo Sapiens; identical to SEQ ID NO: 127268

SEQ ID NO: 616804 - RNA, 64 nt, Homo Sapiens; identical to SEQ ID NO: 127269

SEQ ID NO: 616805 - RNA, 64 nt, Homo Sapiens; identical to SEQ ID NO: 127270

SEQ ID NO: 616806 - RNA, 64 nt, Homo Sapiens; identical to SEQ ID NO: 127271

SEQ ID NO: 616807 - RNA, 64 nt, Homo Sapiens; identical to SEQ ID NO: 127272

SEQ ID NO: 616808 - RNA, 64 nt, Homo Sapiens; identical to SEQ ID NO: 127273

SEQ ID NO: 616809 - RNA, 64 nt, Homo Sapiens; identical to SEQ ID NO: 127274

SEQ ID NO: 616810 - RNA, 64 nt, Homo Sapiens; identical to SEQ ID NO: 127275

SEQ ID NO: 616811 - RNA, 64 nt, Homo Sapiens; identical to SEQ ID NO: 127276

SEQ ID NO: 616812 - RNA, 64 nt, Homo Sapiens; identical to SEQ ID NO: 127277

SEQ ID NO: 616813 - RNA, 64 nt, Homo Sapiens; identical to SEQ ID NO: 127278

SEQ ID NO: 616814 - RNA, 64 nt, Homo Sapiens; identical to SEQ ID NO: 127279

SEQ ID NO: 616815 - RNA, 64 nt, Homo Sapiens; identical to SEQ ID NO: 127280

SEQ ID NO: 616816 - RNA, 64 nt, Homo Sapiens; identical to SEQ ID NO: 127281

SEQ ID NO: 616817 - RNA, 64 nt, Homo Sapiens; identical to SEQ ID NO: 127282

SEQ ID NO: 616818 - RNA, 64 nt, Homo Sapiens; identical to SEQ ID NO: 127283

SEQ ID NO: 616819 - RNA, 64 nt, Homo Sapiens; identical to SEQ ID NO: 127284

SEQ ID NO: 616820 - RNA, 64 nt, Homo Sapiens; identical to SEQ ID NO: 127285

SEQ ID NO: 616821 - RNA, 64 nt, Homo Sapiens; identical to SEQ ID NO: 127286

SEQ ID NO: 616822 - RNA, 64 nt, Homo Sapiens; identical to SEQ ID NO: 127287

SEQ ID NO: 616823 - RNA, 64 nt, Homo Sapiens; identical to SEQ ID NO: 127288

SEQ ID NO: 616824 - RNA, 64 nt, Homo Sapiens; identical to SEQ ID NO: 127289

SEQ ID NO: 616825 - RNA, 64 nt, Homo Sapiens; identical to SEQ ID NO: 127290

SEQ ID NO: 616826 - RNA, 64 nt, Homo Sapiens; identical to SEQ ID NO: 127291

SEQ ID NO: 616827 - RNA, 64 nt, Homo Sapiens; identical to SEQ ID NO: 127292

SEQ ID NO: 616828 - RNA, 64 nt, Homo Sapiens; identical to SEQ ID NO: 127293

SEQ ID NO: 616829 - RNA, 64 nt, Homo Sapiens; identical to SEQ ID NO: 127294

SEQ ID NO: 616830 - RNA, 64 nt, Homo Sapiens; identical to SEQ ID NO: 127295

SEQ ID NO: 616831 - RNA, 64 nt, Homo Sapiens; identical to SEQ ID NO: 127296

SEQ ID NO: 616832 - RNA, 64 nt, Homo Sapiens; identical to SEQ ID NO: 127297

SEQ ID NO: 616833 - RNA, 64 nt, Homo Sapiens; identical to SEQ ID NO: 127298

SEQ ID NO: 616834 - RNA, 64 nt, Homo Sapiens; identical to SEQ ID NO: 127299

SEQ ID NO: 616835 - RNA, 64 nt, Homo Sapiens; identical to SEQ ID NO: 127300

SEQ ID NO: 616836 - RNA, 64 nt, Homo Sapiens; identical to SEQ ID NO: 127301

SEQ ID NO: 616837 - RNA, 64 nt, Homo Sapiens; identical to SEQ ID NO: 127302

SEQ ID NO: 616838 - RNA, 64 nt, Homo Sapiens; identical to SEQ ID NO: 127303

SEQ ID NO: 616839 - RNA, 64 nt, Homo Sapiens; identical to SEQ ID NO: 127304

SEQ ID NO: 616840 - RNA, 64 nt, Homo Sapiens; identical to SEQ ID NO: 127305

SEQ ID NO: 616841 - RNA, 64 nt, Homo Sapiens; identical to SEQ ID NO: 127306

SEQ ID NO: 616842 - RNA, 64 nt, Homo Sapiens; identical to SEQ ID NO: 127307

SEQ ID NO: 616843 - RNA, 64 nt, Homo Sapiens; identical to SEQ ID NO: 127308

SEQ ID NO: 616844 - RNA, 64 nt, Homo Sapiens; identical to SEQ ID NO: 127309

SEQ ID NO: 616845 - RNA, 64 nt, Homo Sapiens; identical to SEQ ID NO: 127310

SEQ ID NO: 616846 - RNA, 64 nt, Homo Sapiens; identical to SEQ ID NO: 127311

SEQ ID NO: 616847 - RNA, 64 nt, Homo Sapiens; identical to SEQ ID NO: 127312

SEQ ID NO: 616848 - RNA, 64 nt, Homo Sapiens; identical to SEQ ID NO: 127313

SEQ ID NO: 616849 - RNA, 64 nt, Homo Sapiens; identical to SEQ ID NO: 127314

SEQ ID NO: 616850 - RNA, 64 nt, Homo Sapiens; identical to SEQ ID NO: 127315

SEQ ID NO: 616851 - RNA, 64 nt, Homo Sapiens; identical to SEQ ID NO: 127316

SEQ ID NO: 616852 - RNA, 64 nt, Homo Sapiens; identical to SEQ ID NO: 127317

SEQ ID NO: 616853 - RNA, 64 nt, Homo Sapiens; identical to SEQ ID NO: 127318

SEQ ID NO: 616854 - RNA, 64 nt, Homo Sapiens; identical to SEQ ID NO: 127319

SEQ ID NO: 616855 - RNA, 64 nt, Homo Sapiens; identical to SEQ ID NO: 127320

SEQ ID NO: 616856 - RNA, 64 nt, Homo Sapiens; identical to SEQ ID NO: 127321

SEQ ID NO: 616857 - RNA, 64 nt, Homo Sapiens; identical to SEQ ID NO: 127322

SEQ ID NO: 616858 - RNA, 64 nt, Homo Sapiens; identical to SEQ ID NO: 127323

SEQ ID NO: 616859 - RNA, 64 nt, Homo Sapiens; identical to SEQ ID NO: 127324

SEQ ID NO: 616860 - RNA, 64 nt, Homo Sapiens; identical to SEQ ID NO: 127325

SEQ ID NO: 616861 - RNA, 64 nt, Homo Sapiens; identical to SEQ ID NO: 127326

SEQ ID NO: 616862 - RNA, 64 nt, Homo Sapiens; identical to SEQ ID NO: 127327

SEQ ID NO: 616863 - RNA, 63 nt, Homo Sapiens; identical to SEQ ID NO: 127328

SEQ ID NO: 616864 - RNA, 64 nt, Homo Sapiens; identical to SEQ ID NO: 127329

SEQ ID NO: 616865 - RNA, 64 nt, Homo Sapiens; identical to SEQ ID NO: 127330

SEQ ID NO: 616866 - RNA, 64 nt, Homo Sapiens; identical to SEQ ID NO: 127331

SEQ ID NO: 616867 - RNA, 64 nt, Homo Sapiens; identical to SEQ ID NO: 127332

SEQ ID NO: 616868 - RNA, 64 nt, Homo Sapiens; identical to SEQ ID NO: 127333

SEQ ID NO: 616869 - RNA, 64 nt, Homo Sapiens; identical to SEQ ID NO: 127334

SEQ ID NO: 616870 - RNA, 64 nt, Homo Sapiens; identical to SEQ ID NO: 127335

SEQ ID NO: 616871 - RNA, 64 nt, Homo Sapiens; identical to SEQ ID NO: 127336

SEQ ID NO: 616872 - RNA, 64 nt, Homo Sapiens; identical to SEQ ID NO: 127337

SEQ ID NO: 616873 - RNA, 64 nt, Homo Sapiens; identical to SEQ ID NO: 127338

SEQ ID NO: 616874 - RNA, 64 nt, Homo Sapiens; identical to SEQ ID NO: 127339

SEQ ID NO: 616875 - RNA, 64 nt, Homo Sapiens; identical to SEQ ID NO: 127340

SEQ ID NO: 616876 - RNA, 64 nt, Homo Sapiens; identical to SEQ ID NO: 127341

SEQ ID NO: 616877 - RNA, 64 nt, Homo Sapiens; identical to SEQ ID NO: 127342

SEQ ID NO: 616878 - RNA, 64 nt, Homo Sapiens; identical to SEQ ID NO: 127343

SEQ ID NO: 616879 - RNA, 64 nt, Homo Sapiens; identical to SEQ ID NO: 127344

SEQ ID NO: 616880 - RNA, 64 nt, Homo Sapiens; identical to SEQ ID NO: 127345

SEQ ID NO: 616881 - RNA, 64 nt, Homo Sapiens; identical to SEQ ID NO: 127346

SEQ ID NO: 616882 - RNA, 64 nt, Homo Sapiens; identical to SEQ ID NO: 127347

SEQ ID NO: 616883 - RNA, 64 nt, Homo Sapiens; identical to SEQ ID NO: 127348

SEQ ID NO: 616884 - RNA, 64 nt, Homo Sapiens; identical to SEQ ID NO: 127349

SEQ ID NO: 616885 - RNA, 64 nt, Homo Sapiens; identical to SEQ ID NO: 127350

SEQ ID NO: 616886 - RNA, 64 nt, Homo Sapiens; identical to SEQ ID NO: 127351

SEQ ID NO: 616887 - RNA, 64 nt, Homo Sapiens; identical to SEQ ID NO: 127352

SEQ ID NO: 616888 - RNA, 64 nt, Homo Sapiens; identical to SEQ ID NO: 127353

SEQ ID NO: 616889 - RNA, 64 nt, Homo Sapiens; identical to SEQ ID NO: 127354

SEQ ID NO: 616890 - RNA, 64 nt, Homo Sapiens; identical to SEQ ID NO: 127355

SEQ ID NO: 616891 - RNA, 64 nt, Homo Sapiens; identical to SEQ ID NO: 127356

SEQ ID NO: 616892 - RNA, 64 nt, Homo Sapiens; identical to SEQ ID NO: 127357

SEQ ID NO: 616893 - RNA, 64 nt, Homo Sapiens; identical to SEQ ID NO: 127358

SEQ ID NO: 616894 - RNA, 64 nt, Homo Sapiens; identical to SEQ ID NO: 127359

SEQ ID NO: 616895 - RNA, 64 nt, Homo Sapiens; identical to SEQ ID NO: 127360

SEQ ID NO: 616896 - RNA, 64 nt, Homo Sapiens; identical to SEQ ID NO: 127361

SEQ ID NO: 616897 - RNA, 64 nt, Homo Sapiens; identical to SEQ ID NO: 127362

SEQ ID NO: 616898 - RNA, 64 nt, Homo Sapiens; identical to SEQ ID NO: 127363

SEQ ID NO: 616899 - RNA, 64 nt, Homo Sapiens; identical to SEQ ID NO: 127364

SEQ ID NO: 616900 - RNA, 64 nt, Homo Sapiens; identical to SEQ ID NO: 127365

SEQ ID NO: 616901 - RNA, 64 nt, Homo Sapiens; identical to SEQ ID NO: 127366

SEQ ID NO: 616902 - RNA, 64 nt, Homo Sapiens; identical to SEQ ID NO: 127367

SEQ ID NO: 616903 - RNA, 64 nt, Homo Sapiens; identical to SEQ ID NO: 127368

SEQ ID NO: 616904 - RNA, 64 nt, Homo Sapiens; identical to SEQ ID NO: 127369

SEQ ID NO: 616905 - RNA, 64 nt, Homo Sapiens; identical to SEQ ID NO: 127370

SEQ ID NO: 616906 - RNA, 64 nt, Homo Sapiens; identical to SEQ ID NO: 318834

SEQ ID NO: 616907 - RNA, 64 nt, Homo Sapiens; identical to SEQ ID NO: 318835

SEQ ID NO: 616908 - RNA, 62 nt, Homo Sapiens; identical to SEQ ID NO: 318836

SEQ ID NO: 616909 - RNA, 64 nt, Homo Sapiens; identical to SEQ ID NO: 318837

SEQ ID NO: 616910 - RNA, 64 nt, Homo Sapiens; identical to SEQ ID NO: 318838

SEQ ID NO: 616911 - RNA, 64 nt, Homo Sapiens; identical to SEQ ID NO: 318839

SEQ ID NO: 616912 - RNA, 64 nt, Homo Sapiens; identical to SEQ ID NO: 318840

SEQ ID NO: 616913 - RNA, 64 nt, Homo Sapiens; identical to SEQ ID NO: 318841

SEQ ID NO: 616914 - RNA, 64 nt, Homo Sapiens; identical to SEQ ID NO: 318842

SEQ ID NO: 616915 - RNA, 64 nt, Homo Sapiens; identical to SEQ ID NO: 318843

SEQ ID NO: 616916 - RNA, 64 nt, Homo Sapiens; identical to SEQ ID NO: 318844

SEQ ID NO: 616917 - RNA, 64 nt, Homo Sapiens; identical to SEQ ID NO: 318845

SEQ ID NO: 616918 - RNA, 64 nt, Homo Sapiens; identical to SEQ ID NO: 318846

SEQ ID NO: 616919 - RNA, 64 nt, Homo Sapiens; identical to SEQ ID NO: 318847

SEQ ID NO: 616920 - RNA, 64 nt, Homo Sapiens; identical to SEQ ID NO: 318848

SEQ ID NO: 616921 - RNA, 64 nt, Homo Sapiens; identical to SEQ ID NO: 318849

SEQ ID NO: 616922 - RNA, 64 nt, Homo Sapiens; identical to SEQ ID NO: 318850

SEQ ID NO: 616923 - RNA, 64 nt, Homo Sapiens; identical to SEQ ID NO: 318851

SEQ ID NO: 616924 - RNA, 64 nt, Homo Sapiens; identical to SEQ ID NO: 318852

SEQ ID NO: 616925 - RNA, 64 nt, Homo Sapiens; identical to SEQ ID NO: 318853

SEQ ID NO: 616926 - RNA, 64 nt, Homo Sapiens; identical to SEQ ID NO: 318854

SEQ ID NO: 616927 - RNA, 64 nt, Homo Sapiens; identical to SEQ ID NO: 318855

SEQ ID NO: 616928 - RNA, 64 nt, Homo Sapiens; identical to SEQ ID NO: 318856

SEQ ID NO: 616929 - RNA, 64 nt, Homo Sapiens; identical to SEQ ID NO: 318857

SEQ ID NO: 616930 - RNA, 64 nt, Homo Sapiens; identical to SEQ ID NO: 318858

SEQ ID NO: 616931 - RNA, 64 nt, Homo Sapiens; identical to SEQ ID NO: 318859

SEQ ID NO: 616932 - RNA, 64 nt, Homo Sapiens; identical to SEQ ID NO: 318860

SEQ ID NO: 616933 - RNA, 64 nt, Homo Sapiens; identical to SEQ ID NO: 318861

SEQ ID NO: 616934 - RNA, 64 nt, Homo Sapiens; identical to SEQ ID NO: 318862

SEQ ID NO: 616935 - RNA, 64 nt, Homo Sapiens; identical to SEQ ID NO: 318863

SEQ ID NO: 616936 - RNA, 64 nt, Homo Sapiens; identical to SEQ ID NO: 318864

SEQ ID NO: 616937 - RNA, 64 nt, Homo Sapiens; identical to SEQ ID NO: 318865

SEQ ID NO: 616938 - RNA, 64 nt, Homo Sapiens; identical to SEQ ID NO: 318866

SEQ ID NO: 616939 - RNA, 64 nt, Homo Sapiens; identical to SEQ ID NO: 318867

SEQ ID NO: 616940 - RNA, 64 nt, Homo Sapiens; identical to SEQ ID NO: 318868

SEQ ID NO: 616941 - RNA, 64 nt, Homo Sapiens; identical to SEQ ID NO: 318869

SEQ ID NO: 616942 - RNA, 64 nt, Homo Sapiens; identical to SEQ ID NO: 318870

SEQ ID NO: 616943 - RNA, 64 nt, Homo Sapiens; identical to SEQ ID NO: 318871

SEQ ID NO: 616944 - RNA, 64 nt, Homo Sapiens; identical to SEQ ID NO: 318872

SEQ ID NO: 616945 - RNA, 64 nt, Homo Sapiens; identical to SEQ ID NO: 318873

SEQ ID NO: 616946 - RNA, 64 nt, Homo Sapiens; identical to SEQ ID NO: 318874

SEQ ID NO: 616947 - RNA, 64 nt, Homo Sapiens; identical to SEQ ID NO: 318875

SEQ ID NO: 616948 - RNA, 64 nt, Homo Sapiens; identical to SEQ ID NO: 318876

SEQ ID NO: 616949 - RNA, 64 nt, Homo Sapiens; identical to SEQ ID NO: 318877

SEQ ID NO: 616950 - RNA, 64 nt, Homo Sapiens; identical to SEQ ID NO: 318878

SEQ ID NO: 616951 - RNA, 64 nt, Homo Sapiens; identical to SEQ ID NO: 318879

SEQ ID NO: 616952 - RNA, 64 nt, Homo Sapiens; identical to SEQ ID NO: 318880

SEQ ID NO: 616953 - RNA, 64 nt, Homo Sapiens; identical to SEQ ID NO: 318881

SEQ ID NO: 616954 - RNA, 64 nt, Homo Sapiens; identical to SEQ ID NO: 318882

SEQ ID NO: 616955 - RNA, 64 nt, Homo Sapiens; identical to SEQ ID NO: 318883

SEQ ID NO: 616956 - RNA, 64 nt, Homo Sapiens; identical to SEQ ID NO: 318884

SEQ ID NO: 616957 - RNA, 64 nt, Homo Sapiens; identical to SEQ ID NO: 318885

SEQ ID NO: 616958 - RNA, 64 nt, Homo Sapiens; identical to SEQ ID NO: 318886

SEQ ID NO: 616959 - RNA, 64 nt, Homo Sapiens; identical to SEQ ID NO: 318887

SEQ ID NO: 616960 - RNA, 64 nt, Homo Sapiens; identical to SEQ ID NO: 318888

SEQ ID NO: 616961 - RNA, 64 nt, Homo Sapiens; identical to SEQ ID NO: 318889

SEQ ID NO: 616962 - RNA, 64 nt, Homo Sapiens; identical to SEQ ID NO: 318890

SEQ ID NO: 616963 - RNA, 64 nt, Homo Sapiens; identical to SEQ ID NO: 318891

SEQ ID NO: 616964 - RNA, 64 nt, Homo Sapiens; identical to SEQ ID NO: 318892

SEQ ID NO: 616965 - RNA, 64 nt, Homo Sapiens; identical to SEQ ID NO: 318893

SEQ ID NO: 616966 - RNA, 64 nt, Homo Sapiens; identical to SEQ ID NO: 318894

SEQ ID NO: 616967 - RNA, 64 nt, Homo Sapiens; identical to SEQ ID NO: 318895

SEQ ID NO: 616968 - RNA, 64 nt, Homo Sapiens; identical to SEQ ID NO: 318896

SEQ ID NO: 616969 - RNA, 64 nt, Homo Sapiens; identical to SEQ ID NO: 318897

SEQ ID NO: 616970 - RNA, 64 nt, Homo Sapiens; identical to SEQ ID NO: 318898

SEQ ID NO: 616971 - RNA, 64 nt, Homo Sapiens; identical to SEQ ID NO: 318899

SEQ ID NO: 616972 - RNA, 64 nt, Homo Sapiens; identical to SEQ ID NO: 318900

SEQ ID NO: 616973 - RNA, 64 nt, Homo Sapiens; identical to SEQ ID NO: 318901

SEQ ID NO: 616974 - RNA, 64 nt, Homo Sapiens; identical to SEQ ID NO: 318902

SEQ ID NO: 616975 - RNA, 64 nt, Homo Sapiens; identical to SEQ ID NO: 318903

SEQ ID NO: 616976 - RNA, 64 nt, Homo Sapiens; identical to SEQ ID NO: 318904

SEQ ID NO: 616977 - RNA, 64 nt, Homo Sapiens; identical to SEQ ID NO: 318905

SEQ ID NO: 616978 - RNA, 64 nt, Homo Sapiens; identical to SEQ ID NO: 318906

SEQ ID NO: 616979 - RNA, 64 nt, Homo Sapiens; identical to SEQ ID NO: 318907

SEQ ID NO: 616980 - RNA, 64 nt, Homo Sapiens; identical to SEQ ID NO: 318908

SEQ ID NO: 616981 - RNA, 64 nt, Homo Sapiens; identical to SEQ ID NO: 318909

SEQ ID NO: 616982 - RNA, 64 nt, Homo Sapiens; identical to SEQ ID NO: 318910

SEQ ID NO: 616983 - RNA, 64 nt, Homo Sapiens; identical to SEQ ID NO: 318911

SEQ ID NO: 616984 - RNA, 64 nt, Homo Sapiens; identical to SEQ ID NO: 318912

SEQ ID NO: 616985 - RNA, 64 nt, Homo Sapiens; identical to SEQ ID NO: 318913

SEQ ID NO: 616986 - RNA, 64 nt, Homo Sapiens; identical to SEQ ID NO: 318914

SEQ ID NO: 616987 - RNA, 64 nt, Homo Sapiens; identical to SEQ ID NO: 318915

SEQ ID NO: 616988 - RNA, 64 nt, Homo Sapiens; identical to SEQ ID NO: 318916

SEQ ID NO: 616989 - RNA, 58 nt, Homo Sapiens; identical to SEQ ID NO: 318917

SEQ ID NO: 616990 - RNA, 64 nt, Homo Sapiens; identical to SEQ ID NO: 318918

SEQ ID NO: 616991 - RNA, 64 nt, Homo Sapiens; identical to SEQ ID NO: 318919

SEQ ID NO: 616992 - RNA, 64 nt, Homo Sapiens; identical to SEQ ID NO: 318920

SEQ ID NO: 616993 - RNA, 64 nt, Homo Sapiens
uaaaaaacccucgacccgaagcgaagcgcugagauucuuccaucuuuucuccccauaucccaag

SEQ ID NO: 616994 - RNA, 64 nt, Homo Sapiens
aacuacuauugugaucuauuagaacagccuuuuuuucuuccauagucuguaaauaaauaauuuu

SEQ ID NO: 616995 - RNA, 64 nt, Homo Sapiens
auccaguggggaaaaaaagguuaacaguaaaaauuucuuccacguaauucaauuucucacaaua

SEQ ID NO: 616996 - RNA, 64 nt, Homo Sapiens
uuuugacauaaugaguaaugcagacauuuacauguucuuccagcuucaaucaguagaccugauu

SEQ ID NO: 616997 - RNA, 64 nt, Homo Sapiens
cacagcaguggaaggcugcacacaggcacauuccuucuuccacaguggggcaccaaggauucug

SEQ ID NO: 616998 - RNA, 64 nt, Homo Sapiens
uucaacugcugcugccaaaauugguuuucuaaaauucuuccaguagagacuaaaagaagauuca

SEQ ID NO: 616999 - RNA, 64 nt, Homo Sapiens
uacuuaaauuuucuguguggccaaaaaaguuuauuucuuccacgaauuaacuuguuuucuucau

SEQ ID NO: 617000 - RNA, 64 nt, Homo Sapiens
guuuuugaaaaauaaucaaauuaagugauuauauuucuuccacuuagguaauuaacugcuuguu

SEQ ID NO: 617001 - RNA, 64 nt, Homo Sapiens
gaaacaggagagacugaauuucauuucauuauguuucuuccaagggaacuuuaguaaguucuuc

SEQ ID NO: 617002 - RNA, 64 nt, Homo Sapiens
ggugaacagagcaucugacaagucaggccccagguucuuccaugucauggaaccagcugccugc

SEQ ID NO: 617003 - RNA, 64 nt, Homo Sapiens
cccuaggcugugggcacuguaagcaagguaugcuuucuuccagcuagaggcuacagcacuuuac

SEQ ID NO: 617004 - RNA, 64 nt, Homo Sapiens
uuugccuggggccuagcccuuugccuggucugcuuucuuccaagaaugcccguuaccugguucc

SEQ ID NO: 617005 - RNA, 64 nt, Homo Sapiens
gaaauaaaguuaguuucuaucauucaguaccugcuucuuccagauggcgaaguugcugcuccgg

SEQ ID NO: 617006 - RNA, 64 nt, Homo Sapiens
gggccccuggcagcagcuggccuaggacugggccuucuuccaggaccggcacccggugggaccu

SEQ ID NO: 617007 - RNA, 64 nt, Homo Sapiens
auaccuucaagaaguuaacaaaaaaggaauggauuucuuccaugguaauagccaauacuuacuu

SEQ ID NO: 617008 - RNA, 64 nt, Homo Sapiens
aauuuguccugagucuggagggguuaguucagaguucuuccacuguauguuugaagagaugacc

SEQ ID NO: 617009 - RNA, 64 nt, Homo Sapiens
cuuaaauguaaguauuacaugacaugcauucuguuucuuccagaguucugucugccacacgaaa

SEQ ID NO: 617010 - RNA, 64 nt, Homo Sapiens
uuguuggaagagaauguuuauacaaaaaaugaaauucuuccaacagcagagaaacucuaaaaag

SEQ ID NO: 617011 - RNA, 64 nt, Homo Sapiens
aggaaaauuuaauucugucccuggccagcuauuguucuuccacuucguuuucugcugucccaag

SEQ ID NO: 617012 - RNA, 64 nt, Homo Sapiens
auauuuguacccucaguggagcccuucuggucuuuucuuccacuucugcagaauuuccucuagc

SEQ ID NO: 617013 - RNA, 64 nt, Homo Sapiens
cucagaggcaacaaguauuacaguugcuuguauauucuuccagagaucucugucuauacaagca

SEQ ID NO: 617014 - RNA, 64 nt, Homo Sapiens
uguauuaaggagaaauaaugaacuaucuucuugauucuuccauugagaaaagcauaugaauccu

SEQ ID NO: 617015 - RNA, 64 nt, Homo Sapiens
ugcauguguguccuugucuuuuauuuucuuuucuuucuuccaagguggugguaaaugcuauuca

SEQ ID NO: 617016 - RNA, 64 nt, Homo Sapiens
uuuugcacucuacauaaaauugucagcucucauauucuuccaggaaauaaaaagcugcucucac

SEQ ID NO: 617017 - RNA, 64 nt, Homo Sapiens
ugggaugauguuuaccagcccaaaaccagucauguucuuccaaaagcuucucuuugauagaauu

SEQ ID NO: 617018 - RNA, 64 nt, Homo Sapiens
cagagacaugguggucugcacaagccuggacaaguucuuccauauugaugguggagcaaccccu

SEQ ID NO: 617019 - RNA, 64 nt, Homo Sapiens
aaaauaaacacugaggcccuauguuuuaauuuuuuucuuccagcuugcucauggcauacuuuuc

SEQ ID NO: 617020 - RNA, 64 nt, Homo Sapiens
acauguaugugcugcuuauuuuauguugaauauuuucuuccacacuguuuuuauguugacugcu

SEQ ID NO: 617021 - RNA, 64 nt, Homo Sapiens
uuuuucaugacugaagggaguuuuauguuauuauuucuuccauaguuuuguuuugguuuauuuu

SEQ ID NO: 617022 - RNA, 64 nt, Homo Sapiens
ugcaugaugagauacaacuucugaaugcugcacauucuuccaaaaugauccuuagcacaaucua

SEQ ID NO: 617023 - RNA, 64 nt, Homo Sapiens
cuccuggguuucauguucugugacauccugcuucuucuuccaaaugcaguucauugcagacacc

SEQ ID NO: 617024 - RNA, 64 nt, Homo Sapiens
gugcugagaggcgagcuccuugaagaaggggcuguucuuccaggaggccuuauuuugaacugcc

SEQ ID NO: 617025 - RNA, 64 nt, Homo Sapiens
cuaucuuaauauaguguggaauuuuauuguauuauucuuccauucuuaauacuguaccacauuc

SEQ ID NO: 617026 - RNA, 64 nt, Homo Sapiens
ugcagguuuagaaaaaugguuuucauauucaccauucuuccaccucauugaauugcaugcugua

SEQ ID NO: 617027 - RNA, 64 nt, Homo Sapiens
acaaaauugauaaucauauagcgaaggcauauuuuucuuccaagcucaagucaggauugugacu

SEQ ID NO: 617028 - RNA, 64 nt, Homo Sapiens
gcuagcucaucugugggaccaggacgcccauaauuucuuccauuagcucuuccagugggcaaag

SEQ ID NO: 617029 - RNA, 64 nt, Homo Sapiens
gaaugccagcaaucaggcagcuuccaucuaagauuucuuccaggauuucuccccaccacggaac

SEQ ID NO: 617030 - RNA, 64 nt, Homo Sapiens
uggguguguguguauuuggguguguaaauguugguucuuccacuacuggauuuuguaaucuagg

SEQ ID NO: 617031 - RNA, 64 nt, Homo Sapiens
uuaaaugucuacuuaguuaauuaguuagcugauauucuuccacaauuaauauauucaauuuccc

SEQ ID NO: 617032 - RNA, 64 nt, Homo Sapiens
uuuccagcugucaaauccaaccuucuuccaucccuucuuccaucgggaaguguuagcuuccuuu

SEQ ID NO: 617033 - RNA, 64 nt, Homo Sapiens
ccuucuuccaucuuuccagcuuagcuuccuuuccuucuuccaucccaguuugaugugggaagug

SEQ ID NO: 617034 - RNA, 64 nt, Homo Sapiens
uagggaguugaaacuaucaacuguaaagcuccuuuucuuccacuuuaauuuaaaaguucauguc

SEQ ID NO: 617035 - RNA, 64 nt, Homo Sapiens
gagagaaaauguucaucugugcagaggaugcauuuucuuccauuaauucuggaaaaaacguuca

SEQ ID NO: 617036 - RNA, 64 nt, Homo Sapiens
ucuguacucacaaaagagaaucucauuuucuucuuucuuccauucccuuaaauucugaguacug

SEQ ID NO: 617037 - RNA, 64 nt, Homo Sapiens
ggaaaacugcauuuucucuuccaaaaaggaaagguucuuccaggcgagaaaccuguggucuaga

SEQ ID NO: 617038 - RNA, 64 nt, Homo Sapiens
guccagagacauuguuaauagaauuaacagucuguucuuccagacaauguuaauauugcuuuau

SEQ ID NO: 617039 - RNA, 64 nt, Homo Sapiens
ugggacuuguccacaagaaucguuuuuuuggcaauucuuccacgugaaagccugcaggacuggu

SEQ ID NO: 617040 - RNA, 64 nt, Homo Sapiens
acuaugaaugcaagcaauguggcaaagcuuucacuucuuccaguucuuuucaauaucaugaaag

SEQ ID NO: 617041 - RNA, 64 nt, Homo Sapiens
ccuaucaauguaagcaaugugcaaaagccuuuauuucuuccacuucuuuucaauaucaugaaag

SEQ ID NO: 617042 - RNA, 64 nt, Homo Sapiens
guuuucuuuugggggccuuccccuuuuacuccuuuucuuccagagaucaagagcuucucuugca

SEQ ID NO: 617043 - RNA, 64 nt, Homo Sapiens
uuuucuuccagagaucaagagcuucucuugcaucuucuuccacugggcucuggauuaaucaauu

SEQ ID NO: 617044 - RNA, 64 nt, Homo Sapiens
ccucuaccucuggccugccccuauuucugaaagcuucuuccagucccugaucuggcucauuccc

SEQ ID NO: 617045 - RNA, 64 nt, Homo Sapiens
ucccaaguucuccuucagaaccuaguugcuuuuauucuuccagcuaccacuugggcacuucaca

SEQ ID NO: 617046 - RNA, 64 nt, Homo Sapiens; identical to SEQ ID NO: 492153

SEQ ID NO: 617047 - RNA, 64 nt, Homo Sapiens; identical to SEQ ID NO: 492154

SEQ ID NO: 617048 - RNA, 64 nt, Homo Sapiens; identical to SEQ ID NO: 492155

SEQ ID NO: 617049 - RNA, 64 nt, Homo Sapiens; identical to SEQ ID NO: 492156

SEQ ID NO: 617050 - RNA, 64 nt, Homo Sapiens; identical to SEQ ID NO: 492157

SEQ ID NO: 617051 - RNA, 64 nt, Homo Sapiens; identical to SEQ ID NO: 492158

SEQ ID NO: 617052 - RNA, 64 nt, Homo Sapiens; identical to SEQ ID NO: 492159

SEQ ID NO: 617053 - RNA, 64 nt, Homo Sapiens; identical to SEQ ID NO: 492160

SEQ ID NO: 617054 - RNA, 64 nt, Homo Sapiens; identical to SEQ ID NO: 492161

SEQ ID NO: 617055 - RNA, 64 nt, Homo Sapiens; identical to SEQ ID NO: 492162

SEQ ID NO: 617056 - RNA, 64 nt, Homo Sapiens; identical to SEQ ID NO: 492163

SEQ ID NO: 617057 - RNA, 64 nt, Homo Sapiens; identical to SEQ ID NO: 492164

SEQ ID NO: 617058 - RNA, 64 nt, Homo Sapiens; identical to SEQ ID NO: 492165

SEQ ID NO: 617059 - RNA, 64 nt, Homo Sapiens; identical to SEQ ID NO: 492166

SEQ ID NO: 617060 - RNA, 64 nt, Homo Sapiens; identical to SEQ ID NO: 492167

SEQ ID NO: 617061 - RNA, 64 nt, Homo Sapiens; identical to SEQ ID NO: 492168

SEQ ID NO: 617062 - RNA, 64 nt, Homo Sapiens; identical to SEQ ID NO: 492169

SEQ ID NO: 617063 - RNA, 64 nt, Homo Sapiens; identical to SEQ ID NO: 492170

SEQ ID NO: 617064 - RNA, 64 nt, Homo Sapiens; identical to SEQ ID NO: 492171

SEQ ID NO: 617065 - RNA, 64 nt, Homo Sapiens; identical to SEQ ID NO: 492172

SEQ ID NO: 617066 - RNA, 64 nt, Homo Sapiens; identical to SEQ ID NO: 492173

SEQ ID NO: 617067 - RNA, 64 nt, Homo Sapiens; identical to SEQ ID NO: 492174

SEQ ID NO: 617068 - RNA, 64 nt, Homo Sapiens; identical to SEQ ID NO: 492175

SEQ ID NO: 617069 - RNA, 64 nt, Homo Sapiens; identical to SEQ ID NO: 492176

SEQ ID NO: 617070 - RNA, 64 nt, Homo Sapiens; identical to SEQ ID NO: 492177

SEQ ID NO: 617071 - RNA, 64 nt, Homo Sapiens; identical to SEQ ID NO: 492178

SEQ ID NO: 617072 - RNA, 64 nt, Homo Sapiens; identical to SEQ ID NO: 492179

SEQ ID NO: 617073 - RNA, 64 nt, Homo Sapiens; identical to SEQ ID NO: 492180

SEQ ID NO: 617074 - RNA, 64 nt, Homo Sapiens; identical to SEQ ID NO: 492181

SEQ ID NO: 617075 - RNA, 64 nt, Homo Sapiens; identical to SEQ ID NO: 492182

SEQ ID NO: 617076 - RNA, 64 nt, Homo Sapiens; identical to SEQ ID NO: 492183

SEQ ID NO: 617077 - RNA, 64 nt, Homo Sapiens; identical to SEQ ID NO: 492184

SEQ ID NO: 617078 - RNA, 64 nt, Homo Sapiens; identical to SEQ ID NO: 492185

SEQ ID NO: 617079 - RNA, 64 nt, Homo Sapiens; identical to SEQ ID NO: 492186

SEQ ID NO: 617080 - RNA, 64 nt, Homo Sapiens; identical to SEQ ID NO: 492187

SEQ ID NO: 617081 - RNA, 64 nt, Homo Sapiens; identical to SEQ ID NO: 492188

SEQ ID NO: 617082 - RNA, 64 nt, Homo Sapiens; identical to SEQ ID NO: 492189

SEQ ID NO: 617083 - RNA, 64 nt, Homo Sapiens; identical to SEQ ID NO: 492190

SEQ ID NO: 617084 - RNA, 64 nt, Homo Sapiens; identical to SEQ ID NO: 492191

SEQ ID NO: 617085 - RNA, 64 nt, Homo Sapiens; identical to SEQ ID NO: 492192

SEQ ID NO: 617086 - RNA, 64 nt, Homo Sapiens; identical to SEQ ID NO: 492193

SEQ ID NO: 617087 - RNA, 64 nt, Homo Sapiens; identical to SEQ ID NO: 492194

SEQ ID NO: 617088 - RNA, 64 nt, Homo Sapiens; identical to SEQ ID NO: 492195

SEQ ID NO: 617089 - RNA, 64 nt, Homo Sapiens; identical to SEQ ID NO: 492196

SEQ ID NO: 617090 - RNA, 64 nt, Homo Sapiens; identical to SEQ ID NO: 492197

SEQ ID NO: 617091 - RNA, 64 nt, Homo Sapiens; identical to SEQ ID NO: 492198

SEQ ID NO: 617092 - RNA, 64 nt, Homo Sapiens; identical to SEQ ID NO: 492199

SEQ ID NO: 617093 - RNA, 64 nt, Homo Sapiens; identical to SEQ ID NO: 492200

SEQ ID NO: 617094 - RNA, 64 nt, Homo Sapiens; identical to SEQ ID NO: 492201

SEQ ID NO: 617095 - RNA, 64 nt, Homo Sapiens; identical to SEQ ID NO: 492202

SEQ ID NO: 617096 - RNA, 64 nt, Homo Sapiens; identical to SEQ ID NO: 492203

SEQ ID NO: 617097 - RNA, 64 nt, Homo Sapiens; identical to SEQ ID NO: 492204

SEQ ID NO: 617098 - RNA, 64 nt, Homo Sapiens; identical to SEQ ID NO: 492205

SEQ ID NO: 617099 - RNA, 64 nt, Homo Sapiens; identical to SEQ ID NO: 492206

SEQ ID NO: 617100 - RNA, 64 nt, Homo Sapiens; identical to SEQ ID NO: 492207

SEQ ID NO: 617101 - RNA, 64 nt, Homo Sapiens; identical to SEQ ID NO: 492208

SEQ ID NO: 617102 - RNA, 64 nt, Homo Sapiens; identical to SEQ ID NO: 492209

SEQ ID NO: 617103 - RNA, 64 nt, Homo Sapiens; identical to SEQ ID NO: 492210

SEQ ID NO: 617104 - RNA, 64 nt, Homo Sapiens; identical to SEQ ID NO: 80933

SEQ ID NO: 617105 - RNA, 64 nt, Homo Sapiens; identical to SEQ ID NO: 80934

SEQ ID NO: 617106 - RNA, 64 nt, Homo Sapiens; identical to SEQ ID NO: 80935

SEQ ID NO: 617107 - RNA, 64 nt, Homo Sapiens; identical to SEQ ID NO: 80936

SEQ ID NO: 617108 - RNA, 64 nt, Homo Sapiens; identical to SEQ ID NO: 80937

SEQ ID NO: 617109 - RNA, 64 nt, Homo Sapiens; identical to SEQ ID NO: 80938

SEQ ID NO: 617110 - RNA, 64 nt, Homo Sapiens; identical to SEQ ID NO: 80939

SEQ ID NO: 617111 - RNA, 64 nt, Homo Sapiens; identical to SEQ ID NO: 80940

SEQ ID NO: 617112 - RNA, 64 nt, Homo Sapiens; identical to SEQ ID NO: 80941

SEQ ID NO: 617113 - RNA, 64 nt, Homo Sapiens; identical to SEQ ID NO: 80942

SEQ ID NO: 617114 - RNA, 64 nt, Homo Sapiens; identical to SEQ ID NO: 80943

SEQ ID NO: 617115 - RNA, 64 nt, Homo Sapiens; identical to SEQ ID NO: 80944

SEQ ID NO: 617116 - RNA, 64 nt, Homo Sapiens; identical to SEQ ID NO: 80945

SEQ ID NO: 617117 - RNA, 64 nt, Homo Sapiens; identical to SEQ ID NO: 80946

SEQ ID NO: 617118 - RNA, 64 nt, Homo Sapiens; identical to SEQ ID NO: 80947

SEQ ID NO: 617119 - RNA, 64 nt, Homo Sapiens; identical to SEQ ID NO: 80948

SEQ ID NO: 617120 - RNA, 64 nt, Homo Sapiens; identical to SEQ ID NO: 80949

SEQ ID NO: 617121 - RNA, 64 nt, Homo Sapiens; identical to SEQ ID NO: 80950

SEQ ID NO: 617122 - RNA, 64 nt, Homo Sapiens; identical to SEQ ID NO: 80951

SEQ ID NO: 617123 - RNA, 64 nt, Homo Sapiens; identical to SEQ ID NO: 80952

SEQ ID NO: 617124 - RNA, 64 nt, Homo Sapiens; identical to SEQ ID NO: 80953

SEQ ID NO: 617125 - RNA, 64 nt, Homo Sapiens; identical to SEQ ID NO: 80954

SEQ ID NO: 617126 - RNA, 63 nt, Homo Sapiens; identical to SEQ ID NO: 80955

SEQ ID NO: 617127 - RNA, 64 nt, Homo Sapiens; identical to SEQ ID NO: 80956

SEQ ID NO: 617128 - RNA, 64 nt, Homo Sapiens; identical to SEQ ID NO: 80957

SEQ ID NO: 617129 - RNA, 64 nt, Homo Sapiens; identical to SEQ ID NO: 80958

SEQ ID NO: 617130 - RNA, 64 nt, Homo Sapiens; identical to SEQ ID NO: 80959

SEQ ID NO: 617131 - RNA, 64 nt, Homo Sapiens; identical to SEQ ID NO: 80960

SEQ ID NO: 617132 - RNA, 64 nt, Homo Sapiens; identical to SEQ ID NO: 80961

SEQ ID NO: 617133 - RNA, 64 nt, Homo Sapiens; identical to SEQ ID NO: 80962

SEQ ID NO: 617134 - RNA, 64 nt, Homo Sapiens; identical to SEQ ID NO: 80963

SEQ ID NO: 617135 - RNA, 64 nt, Homo Sapiens; identical to SEQ ID NO: 80964

SEQ ID NO: 617136 - RNA, 64 nt, Homo Sapiens; identical to SEQ ID NO: 80965

SEQ ID NO: 617137 - RNA, 64 nt, Homo Sapiens; identical to SEQ ID NO: 80966

SEQ ID NO: 617138 - RNA, 64 nt, Homo Sapiens; identical to SEQ ID NO: 80967

SEQ ID NO: 617139 - RNA, 64 nt, Homo Sapiens; identical to SEQ ID NO: 80968

SEQ ID NO: 617140 - RNA, 64 nt, Homo Sapiens; identical to SEQ ID NO: 80969

SEQ ID NO: 617141 - RNA, 64 nt, Homo Sapiens; identical to SEQ ID NO: 80970

SEQ ID NO: 617142 - RNA, 64 nt, Homo Sapiens; identical to SEQ ID NO: 80971

SEQ ID NO: 617143 - RNA, 64 nt, Homo Sapiens; identical to SEQ ID NO: 80972

SEQ ID NO: 617144 - RNA, 64 nt, Homo Sapiens; identical to SEQ ID NO: 80973

SEQ ID NO: 617145 - RNA, 64 nt, Homo Sapiens; identical to SEQ ID NO: 80974

SEQ ID NO: 617146 - RNA, 64 nt, Homo Sapiens; identical to SEQ ID NO: 80975

SEQ ID NO: 617147 - RNA, 64 nt, Homo Sapiens; identical to SEQ ID NO: 80976

SEQ ID NO: 617148 - RNA, 64 nt, Homo Sapiens; identical to SEQ ID NO: 80977

SEQ ID NO: 617149 - RNA, 64 nt, Homo Sapiens; identical to SEQ ID NO: 80978

SEQ ID NO: 617150 - RNA, 64 nt, Homo Sapiens; identical to SEQ ID NO: 80979

SEQ ID NO: 617151 - RNA, 64 nt, Homo Sapiens; identical to SEQ ID NO: 80980

SEQ ID NO: 617152 - RNA, 64 nt, Homo Sapiens; identical to SEQ ID NO: 80981

SEQ ID NO: 617153 - RNA, 64 nt, Homo Sapiens; identical to SEQ ID NO: 80982

SEQ ID NO: 617154 - RNA, 64 nt, Homo Sapiens; identical to SEQ ID NO: 80983

SEQ ID NO: 617155 - RNA, 64 nt, Homo Sapiens; identical to SEQ ID NO: 80984

SEQ ID NO: 617156 - RNA, 64 nt, Homo Sapiens; identical to SEQ ID NO: 80985

SEQ ID NO: 617157 - RNA, 64 nt, Homo Sapiens; identical to SEQ ID NO: 80986

SEQ ID NO: 617158 - RNA, 64 nt, Homo Sapiens; identical to SEQ ID NO: 80987

SEQ ID NO: 617159 - RNA, 64 nt, Homo Sapiens; identical to SEQ ID NO: 80988

SEQ ID NO: 617160 - RNA, 64 nt, Homo Sapiens; identical to SEQ ID NO: 80989

SEQ ID NO: 617161 - RNA, 64 nt, Homo Sapiens; identical to SEQ ID NO: 80990

SEQ ID NO: 617162 - RNA, 64 nt, Homo Sapiens; identical to SEQ ID NO: 80991

SEQ ID NO: 617163 - RNA, 64 nt, Homo Sapiens; identical to SEQ ID NO: 80992

SEQ ID NO: 617164 - RNA, 64 nt, Homo Sapiens; identical to SEQ ID NO: 80993

SEQ ID NO: 617165 - RNA, 64 nt, Homo Sapiens; identical to SEQ ID NO: 80994

SEQ ID NO: 617166 - RNA, 64 nt, Homo Sapiens; identical to SEQ ID NO: 80995

SEQ ID NO: 617167 - RNA, 64 nt, Homo Sapiens; identical to SEQ ID NO: 80996

SEQ ID NO: 617168 - RNA, 64 nt, Homo Sapiens; identical to SEQ ID NO: 80997

SEQ ID NO: 617169 - RNA, 64 nt, Homo Sapiens; identical to SEQ ID NO: 80998

SEQ ID NO: 617170 - RNA, 64 nt, Homo Sapiens; identical to SEQ ID NO: 80999

SEQ ID NO: 617171 - RNA, 64 nt, Homo Sapiens; identical to SEQ ID NO: 81000

SEQ ID NO: 617172 - RNA, 64 nt, Homo Sapiens; identical to SEQ ID NO: 81001

SEQ ID NO: 617173 - RNA, 64 nt, Homo Sapiens; identical to SEQ ID NO: 81002

SEQ ID NO: 617174 - RNA, 64 nt, Homo Sapiens; identical to SEQ ID NO: 81003

SEQ ID NO: 617175 - RNA, 64 nt, Homo Sapiens; identical to SEQ ID NO: 81004

SEQ ID NO: 617176 - RNA, 64 nt, Homo Sapiens; identical to SEQ ID NO: 81005

SEQ ID NO: 617177 - RNA, 64 nt, Homo Sapiens; identical to SEQ ID NO: 81006

SEQ ID NO: 617178 - RNA, 64 nt, Homo Sapiens; identical to SEQ ID NO: 81007

SEQ ID NO: 617179 - RNA, 64 nt, Homo Sapiens; identical to SEQ ID NO: 81008

SEQ ID NO: 617180 - RNA, 64 nt, Homo Sapiens; identical to SEQ ID NO: 81009

SEQ ID NO: 617181 - RNA, 64 nt, Homo Sapiens; identical to SEQ ID NO: 81010

SEQ ID NO: 617182 - RNA, 64 nt, Homo Sapiens; identical to SEQ ID NO: 81011

SEQ ID NO: 617183 - RNA, 64 nt, Homo Sapiens; identical to SEQ ID NO: 81012

SEQ ID NO: 617184 - RNA, 64 nt, Homo Sapiens; identical to SEQ ID NO: 81013

SEQ ID NO: 617185 - RNA, 64 nt, Homo Sapiens; identical to SEQ ID NO: 81014

SEQ ID NO: 617186 - RNA, 64 nt, Homo Sapiens; identical to SEQ ID NO: 81015

SEQ ID NO: 617187 - RNA, 64 nt, Homo Sapiens; identical to SEQ ID NO: 81016

SEQ ID NO: 617188 - RNA, 64 nt, Homo Sapiens; identical to SEQ ID NO: 81017

SEQ ID NO: 617189 - RNA, 64 nt, Homo Sapiens; identical to SEQ ID NO: 81018

SEQ ID NO: 617190 - RNA, 64 nt, Homo Sapiens; identical to SEQ ID NO: 81019

SEQ ID NO: 617191 - RNA, 64 nt, Homo Sapiens; identical to SEQ ID NO: 81020

SEQ ID NO: 617192 - RNA, 64 nt, Homo Sapiens; identical to SEQ ID NO: 81021

SEQ ID NO: 617193 - RNA, 64 nt, Homo Sapiens; identical to SEQ ID NO: 81022

SEQ ID NO: 617194 - RNA, 64 nt, Homo Sapiens; identical to SEQ ID NO: 81023

SEQ ID NO: 617195 - RNA, 64 nt, Homo Sapiens; identical to SEQ ID NO: 81024

SEQ ID NO: 617196 - RNA, 64 nt, Homo Sapiens; identical to SEQ ID NO: 81025

SEQ ID NO: 617197 - RNA, 64 nt, Homo Sapiens; identical to SEQ ID NO: 81026

SEQ ID NO: 617198 - RNA, 64 nt, Homo Sapiens; identical to SEQ ID NO: 81027

SEQ ID NO: 617199 - RNA, 64 nt, Homo Sapiens; identical to SEQ ID NO: 81028

SEQ ID NO: 617200 - RNA, 64 nt, Homo Sapiens; identical to SEQ ID NO: 81029

SEQ ID NO: 617201 - RNA, 64 nt, Homo Sapiens; identical to SEQ ID NO: 81030

SEQ ID NO: 617202 - RNA, 64 nt, Homo Sapiens; identical to SEQ ID NO: 81031

SEQ ID NO: 617203 - RNA, 64 nt, Homo Sapiens; identical to SEQ ID NO: 81032

SEQ ID NO: 617204 - RNA, 64 nt, Homo Sapiens; identical to SEQ ID NO: 81033

SEQ ID NO: 617205 - RNA, 64 nt, Homo Sapiens; identical to SEQ ID NO: 81034

SEQ ID NO: 617206 - RNA, 64 nt, Homo Sapiens; identical to SEQ ID NO: 81035

SEQ ID NO: 617207 - RNA, 64 nt, Homo Sapiens; identical to SEQ ID NO: 81036

SEQ ID NO: 617208 - RNA, 64 nt, Homo Sapiens; identical to SEQ ID NO: 81037

SEQ ID NO: 617209 - RNA, 64 nt, Homo Sapiens; identical to SEQ ID NO: 81038

SEQ ID NO: 617210 - RNA, 64 nt, Homo Sapiens; identical to SEQ ID NO: 81039

SEQ ID NO: 617211 - RNA, 64 nt, Homo Sapiens; identical to SEQ ID NO: 81040

SEQ ID NO: 617212 - RNA, 64 nt, Homo Sapiens; identical to SEQ ID NO: 81041

SEQ ID NO: 617213 - RNA, 64 nt, Homo Sapiens; identical to SEQ ID NO: 81042

SEQ ID NO: 617214 - RNA, 64 nt, Homo Sapiens; identical to SEQ ID NO: 358626

SEQ ID NO: 617215 - RNA, 64 nt, Homo Sapiens; identical to SEQ ID NO: 358627

SEQ ID NO: 617216 - RNA, 64 nt, Homo Sapiens; identical to SEQ ID NO: 358628

SEQ ID NO: 617217 - RNA, 64 nt, Homo Sapiens; identical to SEQ ID NO: 358629

SEQ ID NO: 617218 - RNA, 64 nt, Homo Sapiens; identical to SEQ ID NO: 290755

SEQ ID NO: 617219 - RNA, 64 nt, Homo Sapiens; identical to SEQ ID NO: 290756

SEQ ID NO: 617220 - RNA, 64 nt, Homo Sapiens; identical to SEQ ID NO: 21574

SEQ ID NO: 617221 - RNA, 64 nt, Homo Sapiens; identical to SEQ ID NO: 21575

SEQ ID NO: 617222 - RNA, 64 nt, Homo Sapiens; identical to SEQ ID NO: 21576

SEQ ID NO: 617223 - RNA, 64 nt, Homo Sapiens; identical to SEQ ID NO: 21577

SEQ ID NO: 617224 - RNA, 64 nt, Homo Sapiens; identical to SEQ ID NO: 21578

SEQ ID NO: 617225 - RNA, 64 nt, Homo Sapiens; identical to SEQ ID NO: 21579

SEQ ID NO: 617226 - RNA, 64 nt, Homo Sapiens; identical to SEQ ID NO: 21580

SEQ ID NO: 617227 - RNA, 64 nt, Homo Sapiens; identical to SEQ ID NO: 21581

SEQ ID NO: 617228 - RNA, 64 nt, Homo Sapiens; identical to SEQ ID NO: 21582

SEQ ID NO: 617229 - RNA, 64 nt, Homo Sapiens; identical to SEQ ID NO: 21583

SEQ ID NO: 617230 - RNA, 64 nt, Homo Sapiens; identical to SEQ ID NO: 21584

SEQ ID NO: 617231 - RNA, 64 nt, Homo Sapiens; identical to SEQ ID NO: 21585

SEQ ID NO: 617232 - RNA, 64 nt, Homo Sapiens; identical to SEQ ID NO: 21586

SEQ ID NO: 617233 - RNA, 64 nt, Homo Sapiens; identical to SEQ ID NO: 21587

SEQ ID NO: 617234 - RNA, 64 nt, Homo Sapiens; identical to SEQ ID NO: 21588

SEQ ID NO: 617235 - RNA, 64 nt, Homo Sapiens; identical to SEQ ID NO: 21589

SEQ ID NO: 617236 - RNA, 64 nt, Homo Sapiens; identical to SEQ ID NO: 21590

SEQ ID NO: 617237 - RNA, 64 nt, Homo Sapiens; identical to SEQ ID NO: 21591

SEQ ID NO: 617238 - RNA, 64 nt, Homo Sapiens; identical to SEQ ID NO: 21592

SEQ ID NO: 617239 - RNA, 64 nt, Homo Sapiens; identical to SEQ ID NO: 21593

SEQ ID NO: 617240 - RNA, 64 nt, Homo Sapiens; identical to SEQ ID NO: 21594

SEQ ID NO: 617241 - RNA, 64 nt, Homo Sapiens; identical to SEQ ID NO: 21595

SEQ ID NO: 617242 - RNA, 64 nt, Homo Sapiens; identical to SEQ ID NO: 21596

SEQ ID NO: 617243 - RNA, 64 nt, Homo Sapiens; identical to SEQ ID NO: 21597

SEQ ID NO: 617244 - RNA, 64 nt, Homo Sapiens; identical to SEQ ID NO: 21598

SEQ ID NO: 617245 - RNA, 64 nt, Homo Sapiens; identical to SEQ ID NO: 21599

SEQ ID NO: 617246 - RNA, 64 nt, Homo Sapiens; identical to SEQ ID NO: 21600

SEQ ID NO: 617247 - RNA, 64 nt, Homo Sapiens; identical to SEQ ID NO: 21601

SEQ ID NO: 617248 - RNA, 64 nt, Homo Sapiens; identical to SEQ ID NO: 21602

SEQ ID NO: 617249 - RNA, 64 nt, Homo Sapiens; identical to SEQ ID NO: 21603

SEQ ID NO: 617250 - RNA, 64 nt, Homo Sapiens; identical to SEQ ID NO: 21604

SEQ ID NO: 617251 - RNA, 64 nt, Homo Sapiens; identical to SEQ ID NO: 21605

SEQ ID NO: 617252 - RNA, 64 nt, Homo Sapiens; identical to SEQ ID NO: 21606

SEQ ID NO: 617253 - RNA, 64 nt, Homo Sapiens; identical to SEQ ID NO: 21607

SEQ ID NO: 617254 - RNA, 64 nt, Homo Sapiens; identical to SEQ ID NO: 21608

SEQ ID NO: 617255 - RNA, 64 nt, Homo Sapiens; identical to SEQ ID NO: 21609

SEQ ID NO: 617256 - RNA, 64 nt, Homo Sapiens; identical to SEQ ID NO: 21610

SEQ ID NO: 617257 - RNA, 64 nt, Homo Sapiens; identical to SEQ ID NO: 21611

SEQ ID NO: 617258 - RNA, 64 nt, Homo Sapiens; identical to SEQ ID NO: 21612

SEQ ID NO: 617259 - RNA, 64 nt, Homo Sapiens; identical to SEQ ID NO: 21613

SEQ ID NO: 617260 - RNA, 64 nt, Homo Sapiens; identical to SEQ ID NO: 21614

SEQ ID NO: 617261 - RNA, 64 nt, Homo Sapiens; identical to SEQ ID NO: 21615

SEQ ID NO: 617262 - RNA, 64 nt, Homo Sapiens; identical to SEQ ID NO: 21616

SEQ ID NO: 617263 - RNA, 64 nt, Homo Sapiens; identical to SEQ ID NO: 21617

SEQ ID NO: 617264 - RNA, 64 nt, Homo Sapiens; identical to SEQ ID NO: 21618

SEQ ID NO: 617265 - RNA, 64 nt, Homo Sapiens; identical to SEQ ID NO: 21619

SEQ ID NO: 617266 - RNA, 64 nt, Homo Sapiens; identical to SEQ ID NO: 21620

SEQ ID NO: 617267 - RNA, 64 nt, Homo Sapiens; identical to SEQ ID NO: 21621

SEQ ID NO: 617268 - RNA, 64 nt, Homo Sapiens; identical to SEQ ID NO: 21622

SEQ ID NO: 617269 - RNA, 64 nt, Homo Sapiens; identical to SEQ ID NO: 21623

SEQ ID NO: 617270 - RNA, 64 nt, Homo Sapiens; identical to SEQ ID NO: 21624

SEQ ID NO: 617271 - RNA, 64 nt, Homo Sapiens; identical to SEQ ID NO: 21625

SEQ ID NO: 617272 - RNA, 64 nt, Homo Sapiens; identical to SEQ ID NO: 21626

SEQ ID NO: 617273 - RNA, 64 nt, Homo Sapiens; identical to SEQ ID NO: 21627

SEQ ID NO: 617274 - RNA, 64 nt, Homo Sapiens; identical to SEQ ID NO: 21628

SEQ ID NO: 617275 - RNA, 64 nt, Homo Sapiens; identical to SEQ ID NO: 21629

SEQ ID NO: 617276 - RNA, 64 nt, Homo Sapiens; identical to SEQ ID NO: 21630

SEQ ID NO: 617277 - RNA, 57 nt, Homo Sapiens; identical to SEQ ID NO: 21631

SEQ ID NO: 617278 - RNA, 64 nt, Homo Sapiens; identical to SEQ ID NO: 21632

SEQ ID NO: 617279 - RNA, 64 nt, Homo Sapiens; identical to SEQ ID NO: 21633

SEQ ID NO: 617280 - RNA, 64 nt, Homo Sapiens; identical to SEQ ID NO: 21634

SEQ ID NO: 617281 - RNA, 64 nt, Homo Sapiens; identical to SEQ ID NO: 21635

SEQ ID NO: 617282 - RNA, 64 nt, Homo Sapiens; identical to SEQ ID NO: 21636

SEQ ID NO: 617283 - RNA, 64 nt, Homo Sapiens; identical to SEQ ID NO: 21637

SEQ ID NO: 617284 - RNA, 64 nt, Homo Sapiens; identical to SEQ ID NO: 21638

SEQ ID NO: 617285 - RNA, 64 nt, Homo Sapiens; identical to SEQ ID NO: 21639

SEQ ID NO: 617286 - RNA, 64 nt, Homo Sapiens; identical to SEQ ID NO: 21640

SEQ ID NO: 617287 - RNA, 64 nt, Homo Sapiens; identical to SEQ ID NO: 21641

SEQ ID NO: 617288 - RNA, 64 nt, Homo Sapiens; identical to SEQ ID NO: 21642

SEQ ID NO: 617289 - RNA, 64 nt, Homo Sapiens; identical to SEQ ID NO: 21643

SEQ ID NO: 617290 - RNA, 64 nt, Homo Sapiens; identical to SEQ ID NO: 21644

SEQ ID NO: 617291 - RNA, 64 nt, Homo Sapiens; identical to SEQ ID NO: 21645

SEQ ID NO: 617292 - RNA, 64 nt, Homo Sapiens; identical to SEQ ID NO: 21646

SEQ ID NO: 617293 - RNA, 64 nt, Homo Sapiens; identical to SEQ ID NO: 21647

SEQ ID NO: 617294 - RNA, 64 nt, Homo Sapiens; identical to SEQ ID NO: 21648

SEQ ID NO: 617295 - RNA, 64 nt, Homo Sapiens; identical to SEQ ID NO: 21649

SEQ ID NO: 617296 - RNA, 64 nt, Homo Sapiens; identical to SEQ ID NO: 21650

SEQ ID NO: 617297 - RNA, 64 nt, Homo Sapiens; identical to SEQ ID NO: 21651

SEQ ID NO: 617298 - RNA, 64 nt, Homo Sapiens; identical to SEQ ID NO: 21652

SEQ ID NO: 617299 - RNA, 64 nt, Homo Sapiens; identical to SEQ ID NO: 21653

SEQ ID NO: 617300 - RNA, 64 nt, Homo Sapiens; identical to SEQ ID NO: 21654

SEQ ID NO: 617301 - RNA, 64 nt, Homo Sapiens; identical to SEQ ID NO: 21655

SEQ ID NO: 617302 - RNA, 64 nt, Homo Sapiens; identical to SEQ ID NO: 21656

SEQ ID NO: 617303 - RNA, 64 nt, Homo Sapiens; identical to SEQ ID NO: 21657

SEQ ID NO: 617304 - RNA, 64 nt, Homo Sapiens; identical to SEQ ID NO: 21658

SEQ ID NO: 617305 - RNA, 64 nt, Homo Sapiens; identical to SEQ ID NO: 21659

SEQ ID NO: 617306 - RNA, 64 nt, Homo Sapiens; identical to SEQ ID NO: 21660

SEQ ID NO: 617307 - RNA, 64 nt, Homo Sapiens; identical to SEQ ID NO: 21661

SEQ ID NO: 617308 - RNA, 64 nt, Homo Sapiens; identical to SEQ ID NO: 21662

SEQ ID NO: 617309 - RNA, 64 nt, Homo Sapiens; identical to SEQ ID NO: 21663

SEQ ID NO: 617310 - RNA, 64 nt, Homo Sapiens; identical to SEQ ID NO: 21664

SEQ ID NO: 617311 - RNA, 64 nt, Homo Sapiens; identical to SEQ ID NO: 21665

SEQ ID NO: 617312 - RNA, 64 nt, Homo Sapiens; identical to SEQ ID NO: 21666

SEQ ID NO: 617313 - RNA, 64 nt, Homo Sapiens; identical to SEQ ID NO: 21667

SEQ ID NO: 617314 - RNA, 64 nt, Homo Sapiens; identical to SEQ ID NO: 21668

SEQ ID NO: 617315 - RNA, 64 nt, Homo Sapiens; identical to SEQ ID NO: 21669

SEQ ID NO: 617316 - RNA, 64 nt, Homo Sapiens; identical to SEQ ID NO: 21670

SEQ ID NO: 617317 - RNA, 64 nt, Homo Sapiens; identical to SEQ ID NO: 21671

SEQ ID NO: 617318 - RNA, 64 nt, Homo Sapiens; identical to SEQ ID NO: 21672

SEQ ID NO: 617319 - RNA, 64 nt, Homo Sapiens; identical to SEQ ID NO: 21673

SEQ ID NO: 617320 - RNA, 64 nt, Homo Sapiens; identical to SEQ ID NO: 21674

SEQ ID NO: 617321 - RNA, 64 nt, Homo Sapiens; identical to SEQ ID NO: 21675

SEQ ID NO: 617322 - RNA, 64 nt, Homo Sapiens; identical to SEQ ID NO: 21676

SEQ ID NO: 617323 - RNA, 64 nt, Homo Sapiens; identical to SEQ ID NO: 21677

SEQ ID NO: 617324 - RNA, 64 nt, Homo Sapiens; identical to SEQ ID NO: 21678

SEQ ID NO: 617325 - RNA, 64 nt, Homo Sapiens; identical to SEQ ID NO: 21679

SEQ ID NO: 617326 - RNA, 64 nt, Homo Sapiens; identical to SEQ ID NO: 21680

SEQ ID NO: 617327 - RNA, 64 nt, Homo Sapiens; identical to SEQ ID NO: 21681

SEQ ID NO: 617328 - RNA, 64 nt, Homo Sapiens; identical to SEQ ID NO: 21682

SEQ ID NO: 617329 - RNA, 57 nt, Homo Sapiens
accuuuggaacuugggaguucucauuguaacccuaacaugugagaauaaaaugucuu

SEQ ID NO: 617330 - RNA, 57 nt, Homo Sapiens
ucgugaggccagcucccggggccccuguaacccuacucuccucucucccuggaccuc

SEQ ID NO: 617331 - RNA, 57 nt, Homo Sapiens
ccugccuccucccucccagcugcacuuuaacccuagaagguggggaccuggggggag

SEQ ID NO: 617332 - RNA, 57 nt, Homo Sapiens
cuguauuguuucacuccguauguaacauaacccuaaauaaauuauuucguauuugag

SEQ ID NO: 617333 - RNA, 57 nt, Homo Sapiens
aaagguugcaccucauuuaaugaagcuuaacccuauguagaaagucucuuucggggg

SEQ ID NO: 617334 - RNA, 57 nt, Homo Sapiens
guguauaaagcuuuauucuuuagcccuuaacccuaaggcucagggaaauacccuaug

SEQ ID NO: 617335 - RNA, 57 nt, Homo Sapiens
uaaaaagacauguuugcauugagaaauuaacccuaaaggguuuucaauaggguguag

SEQ ID NO: 617336 - RNA, 57 nt, Homo Sapiens
ccaugcaccuuacaauuucugaacaguuaacccuauagaagcaugcuuuauaugagu

SEQ ID NO: 617337 - RNA, 57 nt, Homo Sapiens
cucugggcuugcccuuugccuggucucuaacccuaauggguaacgaccgcuugucuu

SEQ ID NO: 617338 - RNA, 57 nt, Homo Sapiens
cuaauuguccacauacguggauuucucuaacccuaucgcccaucucaaaucacaagg

SEQ ID NO: 617339 - RNA, 57 nt, Homo Sapiens
uauuauauacuguauuuucuucuaaauuaacccuaauguuuaaaaacucacuuuccc

SEQ ID NO: 617340 - RNA, 57 nt, Homo Sapiens
cacugaaaaauauuccaagcuucauauuaacccuaccugucaacguaacgauuucau

SEQ ID NO: 617341 - RNA, 57 nt, Homo Sapiens
auuauuuaaccauuguucuauuuggcauaacccuauuuaauggugcuuagagcugaa

SEQ ID NO: 617342 - RNA, 57 nt, Homo Sapiens
uuuugcucaacauuaaauugugcuuccuaacccuaaaucuguccagaguaggaacau

SEQ ID NO: 617343 - RNA, 57 nt, Homo Sapiens
uguuaaauagauuaagacacaguaaguuaacccuacauguuauaaagauggcgacug

SEQ ID NO: 617344 - RNA, 57 nt, Homo Sapiens
cuaaccaguuaccacacaucuaugauauaacccuaacacacacagaaaagcauacau

SEQ ID NO: 617345 - RNA, 57 nt, Homo Sapiens
caggaaaggauugauaacuaauaaggcuaacccuaccaaguaaguguuuuccggcug

SEQ ID NO: 617346 - RNA, 57 nt, Homo Sapiens
accuagauguuguccaccugaguauauuaacccuaaacuuuguacaguauaugaaac

SEQ ID NO: 617347 - RNA, 57 nt, Homo Sapiens
uugccugaggcccuuaugucuggcccguaacccuaguccacucaacucuuggggcag

SEQ ID NO: 617348 - RNA, 57 nt, Homo Sapiens
uaaaaauucagucugauaacguggaaauaacccuagacuuuuucacuguagaauaau

SEQ ID NO: 617349 - RNA, 57 nt, Homo Sapiens
uauggcagcucuuuaauguauccuagcuaacccuagaaggaugguaccauugcucuu

SEQ ID NO: 617350 - RNA, 57 nt, Homo Sapiens
guuucauagucuuugucuaacugcuaguaacccuaccgaguuuuauauaugaguggg

SEQ ID NO: 617351 - RNA, 57 nt, Homo Sapiens
aucccaucuagauaauuuauagaaauauaacccuaauuggacaugugguacaggauc

SEQ ID NO: 617352 - RNA, 57 nt, Homo Sapiens
cccugcgugcugguuccuucagaccccuaacccuacuaaccagcaggcucaucucac

SEQ ID NO: 617353 - RNA, 57 nt, Homo Sapiens
cacuauucaauaaguaguagaugauuguaacccuacaaaacucugggguguaaacaa

SEQ ID NO: 617354 - RNA, 57 nt, Homo Sapiens
aagagccuuccuauuccccuugaucccuaacccuacaggguuuuuauuguuguuguu

SEQ ID NO: 617355 - RNA, 57 nt, Homo Sapiens
aauugacacaaaucucauauuagugaguaacccuaaguugguggaaccaaaccaccu

SEQ ID NO: 617356 - RNA, 57 nt, Homo Sapiens
acuauauguccuuaguucuuggaggaguaacccuacaggaaauaguuugcagauaau

SEQ ID NO: 617357 - RNA, 57 nt, Homo Sapiens
auucuuagucaaggaauaauguccacauaacccuagagucaggauguuaacagaaaa

SEQ ID NO: 617358 - RNA, 57 nt, Homo Sapiens
gaaaggacaacuggguuccgcuuuccuuaacccuacacccuuuagcuggaugcuguc

SEQ ID NO: 617359 - RNA, 57 nt, Homo Sapiens
cucggaauucccugaagcaaggaacauuaacccuacauuagaagagguagagaaaau

SEQ ID NO: 617360 - RNA, 57 nt, Homo Sapiens
uaagaguaaaugagaaauauuaaagcuuaacccuaggauuaaguaggugaguuuaau

SEQ ID NO: 617361 - RNA, 57 nt, Homo Sapiens
cucaauggaggggucuggggccagaaguaacccuaggcagguauccccccaaagacc

SEQ ID NO: 617362 - RNA, 57 nt, Homo Sapiens
uuccucuucagucugugguacuccuccuaacccuaaacccucuaugcucaggggcug

SEQ ID NO: 617363 - RNA, 57 nt, Homo Sapiens
aucaugaggaauggaagaauaugaggauaacccuaaauauaacuagaguagaucuga

SEQ ID NO: 617364 - RNA, 57 nt, Homo Sapiens
caaaaugcagugacggaguuuuuaauauaacccuaaggcuuuggggccacaaaauaa

SEQ ID NO: 617365 - RNA, 57 nt, Homo Sapiens
auacccacauguauugagcucugguguuaacccuaaaacccccacaacccaucacuu

SEQ ID NO: 617366 - RNA, 57 nt, Homo Sapiens
ugaugagaggcucgcugcuugguucccuaacccuaauuuuccugagaaucgaaccuu

SEQ ID NO: 617367 - RNA, 57 nt, Homo Sapiens
cccagaccccaggcuggacagaagggauaacccuacagagaugggaaggcacaggga

SEQ ID NO: 617368 - RNA, 57 nt, Homo Sapiens
accauggauucgagguauuauacuguauaacccuacaaaauacauagaaguauuauu

SEQ ID NO: 617369 - RNA, 57 nt, Homo Sapiens
accugaggugggcuggggcugcuccccuaacccuacuuugcuuccgccacucagcca

SEQ ID NO: 617370 - RNA, 50 nt, Homo Sapiens; identical to SEQ ID NO: 270908

SEQ ID NO: 617371 - RNA, 57 nt, Homo Sapiens
uggugccuguuggugguguucuugucuuaacccuagauagaaucuaaugaacucaga

SEQ ID NO: 617372 - RNA, 57 nt, Homo Sapiens
gccucccaugcaucuguacucuuuaccuaacccuacgucuucaacuuuagugcuccc

SEQ ID NO: 617373 - RNA, 57 nt, Homo Sapiens
aggaauagaaacaaauuuuuaugagcauaacccuauauaaagacaaaaugaauuucu

SEQ ID NO: 617374 - RNA, 57 nt, Homo Sapiens
agugucucaaaaauauuuuacuaacuguaacccuaaaauugaugucuuuugguuuau

SEQ ID NO: 617375 - RNA, 57 nt, Homo Sapiens
gguauuugaugcuuucuguggacaauguaacccuaaacacaucauguauuuuaaaug

SEQ ID NO: 617376 - RNA, 57 nt, Homo Sapiens
cgcuuuaugucauuacccauccauggauaacccuaccuucuaugggccaaacaaagg

SEQ ID NO: 617377 - RNA, 57 nt, Homo Sapiens
gaaguugcuaacuuaaaaaauucccaguaacccuaagcuuuuucauaauuacucuac

SEQ ID NO: 617378 - RNA, 57 nt, Homo Sapiens
uuuuauaguugccauaucaauuugugguaacccuacaaguauucuauaauuucaaac

SEQ ID NO: 617379 - RNA, 57 nt, Homo Sapiens
uauacuuuaaaauaauguuauuaaaaauaacccuagagaauauaaaaguauaaaaca

SEQ ID NO: 617380 - RNA, 57 nt, Homo Sapiens
gggcaccucugcugaggucauacucuguaacccuagaguaagcacaggcuucugucc

SEQ ID NO: 617381 - RNA, 57 nt, Homo Sapiens
cugcgauuuggcaggaaauaaggcgauuaacccuauguguccacaagccucaagccu

SEQ ID NO: 617382 - RNA, 57 nt, Homo Sapiens
acuauucuaauguuuaauuacauaugguaacccuaaggccuggggagaaaagcuuuu

SEQ ID NO: 617383 - RNA, 57 nt, Homo Sapiens
gugaaauaacuuaagauaucgcauuuuuaacccuacaguuaagggauuuuaaauugu

SEQ ID NO: 617384 - RNA, 57 nt, Homo Sapiens
acuuguugcuuugcugaaaacuaugguuaacccuauauaggugugggaaauuuuugu

SEQ ID NO: 617385 - RNA, 57 nt, Homo Sapiens
uucuaaaaucacugucaacaauaaaucuaacccuaguuguaucccuccuuucaguau

SEQ ID NO: 617386 - RNA, 57 nt, Homo Sapiens
uaaaaauuguccaaucuggugaaugucuaacccuaaaguuuaaaaauuucugccucc

SEQ ID NO: 617387 - RNA, 57 nt, Homo Sapiens
aagcugaucaccgucuaguugggaaaguaacccuacaggguuuguagggacaugauc

SEQ ID NO: 617388 - RNA, 57 nt, Homo Sapiens
uuucuaaucauuguuauugguacauucuaacccuacauguguuguauagucucagag

SEQ ID NO: 617389 - RNA, 57 nt, Homo Sapiens
gcugcucuaaaaaaugaaguuuuucuguaacccuaaacucuguacuuuuugcucaau

SEQ ID NO: 617390 - RNA, 57 nt, Homo Sapiens
ccaggcggaccucacccuuccaugcucuaacccuaguucaguguuuccuggggggac

SEQ ID NO: 617391 - RNA, 57 nt, Homo Sapiens
ccugcacagcuugguuagaccuagauuuaacccuaagguaagaugcugggguauaga

SEQ ID NO: 617392 - RNA, 57 nt, Homo Sapiens
caucacaugcucaaugacucugcacucuaacccuagggggcuaacgaccacaggguc

SEQ ID NO: 617393 - RNA, 57 nt, Homo Sapiens
uuaccuagcuaauuauuuaaugcauuuuaacccuauugauuauuuaagacuaaaagu

SEQ ID NO: 617394 - RNA, 57 nt, Homo Sapiens
aauguuugaaauaguucaaacugcagcuaacccuagucaaaacuauuuuuguaaaag

SEQ ID NO: 617395 - RNA, 57 nt, Homo Sapiens
uaagagaauuauauauuucuaacuauauaacccuaggaauuuagacaaccugaaauu

SEQ ID NO: 617396 - RNA, 57 nt, Homo Sapiens
ucaacugauaguagguuuauugggauguaacccuaugauaaguugagaaacaucucu

SEQ ID NO: 617397 - RNA, 57 nt, Homo Sapiens
aucagaaaagguguuuguuagaaucccuaacccuacuguaaugaaugacguuuuaag

SEQ ID NO: 617398 - RNA, 57 nt, Homo Sapiens
ucuauuuaucuuauaucguagaucugauaacccuaucuaaaagaaagucacacgcua

SEQ ID NO: 617399 - RNA, 57 nt, Homo Sapiens
ugacauuuugcguuuuaauauuucucuuaacccuauucucagggaagauggaauuua

SEQ ID NO: 617400 - RNA, 57 nt, Homo Sapiens
gauucaagaucagauucuaguguucaguaacccuaugugaaucagaugucuccugga

SEQ ID NO: 617401 - RNA, 57 nt, Homo Sapiens
auuacuucagguagcuacacguaauuauaacccuacaauucauauucccaccaugau

SEQ ID NO: 617402 - RNA, 57 nt, Homo Sapiens
gaugcaagucauaugggggauuacccauaacccuaauucuccaaagugaaugaacuc

SEQ ID NO: 617403 - RNA, 57 nt, Homo Sapiens
ggugaaugcugcuuguucucucaccccuaacccuaguaguuccuccacuaacuuucu

SEQ ID NO: 617404 - RNA, 57 nt, Homo Sapiens
ggaagggauuggaggcggcagaaccauuaacccuacacaagaacacuccagcccaaa

SEQ ID NO: 617405 - RNA, 57 nt, Homo Sapiens
ccagcaccacaaagccccccaggauucuaacccuaacaucaaagguagggccaauua

SEQ ID NO: 617406 - RNA, 57 nt, Homo Sapiens
uuaauaaaagaguuaacaucacaauguuaacccuaaagagaaaucaaugaagcaagu

SEQ ID NO: 617407 - RNA, 57 nt, Homo Sapiens
gcuggggcuggcaccacgcacagugccuaacccuagaaaagccaugucuucagccgc

SEQ ID NO: 617408 - RNA, 57 nt, Homo Sapiens
aaccugucugucuccguggaugcauccuaacccuaaggaaaauuccccaggcuguga

SEQ ID NO: 617409 - RNA, 57 nt, Homo Sapiens
ugggcugggcaugguggcucacgccuguaacccuagcacuuuaggaaaucgaggcga

SEQ ID NO: 617410 - RNA, 57 nt, Homo Sapiens
guccccuggcccucuguccccucuuaauaacccuagucacagucuccgcagauucuu

SEQ ID NO: 617411 - RNA, 57 nt, Homo Sapiens
gugcuucaguuugaaaauguaaaauucuaacccuaaaguaggguugguugaaauuuc

SEQ ID NO: 617412 - RNA, 57 nt, Homo Sapiens
aaaaaagagaaggggguuuguaguacuuaacccuauuuauuuccguauauuuuaguu

SEQ ID NO: 617413 - RNA, 57 nt, Homo Sapiens
cuucagaucuggaaaccggcucaguauuaacccuaccuuugguuguccugcccuacc

SEQ ID NO: 617414 - RNA, 57 nt, Homo Sapiens
cuuaagaauaagaccugagauuaacacuaacccuagaauagaaauguaauagggaga

SEQ ID NO: 617415 - RNA, 57 nt, Homo Sapiens
aaaggaauggagcagagccuguaccccuaacccuaacagcuaaaucaaggaccucag

SEQ ID NO: 617416 - RNA, 57 nt, Homo Sapiens
cccuccccgcagugggaagugaauccuuaacccuaaaauuuuaaggccacggccuug

SEQ ID NO: 617417 - RNA, 57 nt, Homo Sapiens
ucauaaaugggauuugggguagacacauaacccuaauugguaaugucugggaauccg

SEQ ID NO: 617418 - RNA, 57 nt, Homo Sapiens
gauggugggauuuuuauccacagggcuuaacccuauggaugaaaaacuguggcccaa

SEQ ID NO: 617419 - RNA, 57 nt, Homo Sapiens
agacuauuaggugcaauuucaagguucuaacccuauacuguaguauucuuuggggug

SEQ ID NO: 617420 - RNA, 57 nt, Homo Sapiens
uauggaaaaagguuucagccaaaggccuaacccuauucaacaccagaaaguuuacac

SEQ ID NO: 617421 - RNA, 57 nt, Homo Sapiens
gggguuaguucccacccuuuuugauuguaacccuauuugaucugaaauaacauuaau

SEQ ID NO: 617422 - RNA, 57 nt, Homo Sapiens
guggcauauuugcuucuaauguuccccuaacccuacaugcauguuuuaugugcacuc

SEQ ID NO: 617423 - RNA, 57 nt, Homo Sapiens
agaaagaaagaaaaagaaaacugcagauaacccuauacauuaauacugguaucucga

SEQ ID NO: 617424 - RNA, 57 nt, Homo Sapiens
auucccaauuccugggucaaggugaauuaacccuauguuggagcacuggaaaccguu

SEQ ID NO: 617425 - RNA, 57 nt, Homo Sapiens
ccuuuaagauauccaucuuuuucuuuuuaacccuaaucuuucacuugaaagauuuua

SEQ ID NO: 617426 - RNA, 57 nt, Homo Sapiens
uccaacucauuuauacuuuuacugaucuaacccuaaauucaguaagaaucaugucuu

SEQ ID NO: 617427 - RNA, 57 nt, Homo Sapiens
cuuugugugugggcugagugcuggccuuaacccuaggcguggaagagaaaaugugag

SEQ ID NO: 617428 - RNA, 57 nt, Homo Sapiens
cacuacuuuuuuaauuuuuuauuuuuuuaacccuacccuuaacccaugaacacuauu

SEQ ID NO: 617429 - RNA, 57 nt, Homo Sapiens
agucauucaguauucuuuucauuucauuaacccuauaccuaaauggcuauguagaac

SEQ ID NO: 617430 - RNA, 57 nt, Homo Sapiens
uaggcuggucgcaguggcuuacacuuguaacccuagaacuugggaggcugagguggg

SEQ ID NO: 617431 - RNA, 57 nt, Homo Sapiens
aaacgauuuaauuuauucuaauuagauuaacccuauuaaucuauggauuggguauca

SEQ ID NO: 617432 - RNA, 57 nt, Homo Sapiens
uuaaaaaauaacacaauuucuugccuguaacccuagcacuuugggaggccgaggcag

SEQ ID NO: 617433 - RNA, 57 nt, Homo Sapiens
ugauuuguaacaagccuccuuuuaaaguaacccuacaaaaccacuggaaaguuuaug

SEQ ID NO: 617434 - RNA, 57 nt, Homo Sapiens
gcccacccccuguuaacugccuauuuauaacccuaggauccuccuuauggagaacua

SEQ ID NO: 617435 - RNA, 57 nt, Homo Sapiens
accucauugauccacugaccaaauccuuaacccuagcgauggcuugggagauggggg

SEQ ID NO: 617436 - RNA, 57 nt, Homo Sapiens
acuuugggaggcugaggcggaugccuguaacccuagcagggcugggcgcgguggcuc

SEQ ID NO: 617437 - RNA, 64 nt, Homo Sapiens; identical to SEQ ID NO: 107849

SEQ ID NO: 617438 - RNA, 64 nt, Homo Sapiens; identical to SEQ ID NO: 107850

SEQ ID NO: 617439 - RNA, 64 nt, Homo Sapiens; identical to SEQ ID NO: 107851

SEQ ID NO: 617440 - RNA, 64 nt, Homo Sapiens; identical to SEQ ID NO: 107852

SEQ ID NO: 617441 - RNA, 64 nt, Homo Sapiens; identical to SEQ ID NO: 107853

SEQ ID NO: 617442 - RNA, 64 nt, Homo Sapiens; identical to SEQ ID NO: 107854

SEQ ID NO: 617443 - RNA, 64 nt, Homo Sapiens; identical to SEQ ID NO: 107855

SEQ ID NO: 617444 - RNA, 64 nt, Homo Sapiens; identical to SEQ ID NO: 107856

SEQ ID NO: 617445 - RNA, 64 nt, Homo Sapiens; identical to SEQ ID NO: 107857

SEQ ID NO: 617446 - RNA, 64 nt, Homo Sapiens; identical to SEQ ID NO: 107858

SEQ ID NO: 617447 - RNA, 64 nt, Homo Sapiens; identical to SEQ ID NO: 107859

SEQ ID NO: 617448 - RNA, 64 nt, Homo Sapiens; identical to SEQ ID NO: 107860

SEQ ID NO: 617449 - RNA, 64 nt, Homo Sapiens; identical to SEQ ID NO: 107861

SEQ ID NO: 617450 - RNA, 64 nt, Homo Sapiens; identical to SEQ ID NO: 107862

SEQ ID NO: 617451 - RNA, 64 nt, Homo Sapiens; identical to SEQ ID NO: 107863

SEQ ID NO: 617452 - RNA, 63 nt, Homo Sapiens; identical to SEQ ID NO: 107864

SEQ ID NO: 617453 - RNA, 64 nt, Homo Sapiens; identical to SEQ ID NO: 107865

SEQ ID NO: 617454 - RNA, 64 nt, Homo Sapiens; identical to SEQ ID NO: 107866

SEQ ID NO: 617455 - RNA, 64 nt, Homo Sapiens; identical to SEQ ID NO: 107867

SEQ ID NO: 617456 - RNA, 64 nt, Homo Sapiens; identical to SEQ ID NO: 107868

SEQ ID NO: 617457 - RNA, 64 nt, Homo Sapiens; identical to SEQ ID NO: 107869

SEQ ID NO: 617458 - RNA, 64 nt, Homo Sapiens; identical to SEQ ID NO: 107870

SEQ ID NO: 617459 - RNA, 64 nt, Homo Sapiens; identical to SEQ ID NO: 107871

SEQ ID NO: 617460 - RNA, 64 nt, Homo Sapiens; identical to SEQ ID NO: 107872

SEQ ID NO: 617461 - RNA, 64 nt, Homo Sapiens; identical to SEQ ID NO: 107873

SEQ ID NO: 617462 - RNA, 64 nt, Homo Sapiens; identical to SEQ ID NO: 107874

SEQ ID NO: 617463 - RNA, 64 nt, Homo Sapiens; identical to SEQ ID NO: 107875

SEQ ID NO: 617464 - RNA, 64 nt, Homo Sapiens; identical to SEQ ID NO: 107876

SEQ ID NO: 617465 - RNA, 64 nt, Homo Sapiens; identical to SEQ ID NO: 107877

SEQ ID NO: 617466 - RNA, 64 nt, Homo Sapiens; identical to SEQ ID NO: 107878

SEQ ID NO: 617467 - RNA, 64 nt, Homo Sapiens; identical to SEQ ID NO: 107879

SEQ ID NO: 617468 - RNA, 64 nt, Homo Sapiens; identical to SEQ ID NO: 107880

SEQ ID NO: 617469 - RNA, 64 nt, Homo Sapiens; identical to SEQ ID NO: 107881

SEQ ID NO: 617470 - RNA, 64 nt, Homo Sapiens; identical to SEQ ID NO: 107882

SEQ ID NO: 617471 - RNA, 64 nt, Homo Sapiens; identical to SEQ ID NO: 107883

SEQ ID NO: 617472 - RNA, 64 nt, Homo Sapiens; identical to SEQ ID NO: 107884

SEQ ID NO: 617473 - RNA, 64 nt, Homo Sapiens; identical to SEQ ID NO: 107885

SEQ ID NO: 617474 - RNA, 64 nt, Homo Sapiens; identical to SEQ ID NO: 107886

SEQ ID NO: 617475 - RNA, 64 nt, Homo Sapiens; identical to SEQ ID NO: 107887

SEQ ID NO: 617476 - RNA, 64 nt, Homo Sapiens; identical to SEQ ID NO: 107888

SEQ ID NO: 617477 - RNA, 64 nt, Homo Sapiens; identical to SEQ ID NO: 107889

SEQ ID NO: 617478 - RNA, 64 nt, Homo Sapiens; identical to SEQ ID NO: 107890

SEQ ID NO: 617479 - RNA, 64 nt, Homo Sapiens; identical to SEQ ID NO: 107891

SEQ ID NO: 617480 - RNA, 64 nt, Homo Sapiens; identical to SEQ ID NO: 107892

SEQ ID NO: 617481 - RNA, 64 nt, Homo Sapiens; identical to SEQ ID NO: 107893

SEQ ID NO: 617482 - RNA, 64 nt, Homo Sapiens; identical to SEQ ID NO: 107894

SEQ ID NO: 617483 - RNA, 64 nt, Homo Sapiens; identical to SEQ ID NO: 107895

SEQ ID NO: 617484 - RNA, 64 nt, Homo Sapiens; identical to SEQ ID NO: 107896

SEQ ID NO: 617485 - RNA, 64 nt, Homo Sapiens; identical to SEQ ID NO: 107897

SEQ ID NO: 617486 - RNA, 64 nt, Homo Sapiens; identical to SEQ ID NO: 107898

SEQ ID NO: 617487 - RNA, 64 nt, Homo Sapiens; identical to SEQ ID NO: 107899

SEQ ID NO: 617488 - RNA, 64 nt, Homo Sapiens; identical to SEQ ID NO: 107900

SEQ ID NO: 617489 - RNA, 64 nt, Homo Sapiens; identical to SEQ ID NO: 107901

SEQ ID NO: 617490 - RNA, 64 nt, Homo Sapiens; identical to SEQ ID NO: 107902

SEQ ID NO: 617491 - RNA, 64 nt, Homo Sapiens; identical to SEQ ID NO: 107903

SEQ ID NO: 617492 - RNA, 64 nt, Homo Sapiens; identical to SEQ ID NO: 107904

SEQ ID NO: 617493 - RNA, 64 nt, Homo Sapiens; identical to SEQ ID NO: 107905

SEQ ID NO: 617494 - RNA, 64 nt, Homo Sapiens; identical to SEQ ID NO: 107906

SEQ ID NO: 617495 - RNA, 64 nt, Homo Sapiens; identical to SEQ ID NO: 107907

SEQ ID NO: 617496 - RNA, 64 nt, Homo Sapiens; identical to SEQ ID NO: 107908

SEQ ID NO: 617497 - RNA, 64 nt, Homo Sapiens; identical to SEQ ID NO: 107909

SEQ ID NO: 617498 - RNA, 64 nt, Homo Sapiens; identical to SEQ ID NO: 107910

SEQ ID NO: 617499 - RNA, 64 nt, Homo Sapiens; identical to SEQ ID NO: 107911

SEQ ID NO: 617500 - RNA, 64 nt, Homo Sapiens; identical to SEQ ID NO: 107912

SEQ ID NO: 617501 - RNA, 64 nt, Homo Sapiens; identical to SEQ ID NO: 107913

SEQ ID NO: 617502 - RNA, 64 nt, Homo Sapiens; identical to SEQ ID NO: 107914

SEQ ID NO: 617503 - RNA, 64 nt, Homo Sapiens; identical to SEQ ID NO: 107915

SEQ ID NO: 617504 - RNA, 64 nt, Homo Sapiens; identical to SEQ ID NO: 107916

SEQ ID NO: 617505 - RNA, 64 nt, Homo Sapiens; identical to SEQ ID NO: 107917

SEQ ID NO: 617506 - RNA, 64 nt, Homo Sapiens; identical to SEQ ID NO: 107918

SEQ ID NO: 617507 - RNA, 64 nt, Homo Sapiens; identical to SEQ ID NO: 107919

SEQ ID NO: 617508 - RNA, 64 nt, Homo Sapiens; identical to SEQ ID NO: 107920

SEQ ID NO: 617509 - RNA, 64 nt, Homo Sapiens; identical to SEQ ID NO: 107921

SEQ ID NO: 617510 - RNA, 64 nt, Homo Sapiens; identical to SEQ ID NO: 107922

SEQ ID NO: 617511 - RNA, 64 nt, Homo Sapiens; identical to SEQ ID NO: 107923

SEQ ID NO: 617512 - RNA, 64 nt, Homo Sapiens; identical to SEQ ID NO: 107924

SEQ ID NO: 617513 - RNA, 64 nt, Homo Sapiens; identical to SEQ ID NO: 107925

SEQ ID NO: 617514 - RNA, 64 nt, Homo Sapiens; identical to SEQ ID NO: 107926

SEQ ID NO: 617515 - RNA, 64 nt, Homo Sapiens; identical to SEQ ID NO: 107927

SEQ ID NO: 617516 - RNA, 64 nt, Homo Sapiens; identical to SEQ ID NO: 107928

SEQ ID NO: 617517 - RNA, 64 nt, Homo Sapiens; identical to SEQ ID NO: 107929

SEQ ID NO: 617518 - RNA, 64 nt, Homo Sapiens; identical to SEQ ID NO: 107930

SEQ ID NO: 617519 - RNA, 64 nt, Homo Sapiens; identical to SEQ ID NO: 107931

SEQ ID NO: 617520 - RNA, 64 nt, Homo Sapiens; identical to SEQ ID NO: 107932

SEQ ID NO: 617521 - RNA, 64 nt, Homo Sapiens; identical to SEQ ID NO: 107933

SEQ ID NO: 617522 - RNA, 64 nt, Homo Sapiens; identical to SEQ ID NO: 48048

SEQ ID NO: 617523 - RNA, 64 nt, Homo Sapiens; identical to SEQ ID NO: 48049

SEQ ID NO: 617524 - RNA, 64 nt, Homo Sapiens; identical to SEQ ID NO: 48050

SEQ ID NO: 617525 - RNA, 64 nt, Homo Sapiens; identical to SEQ ID NO: 48051

SEQ ID NO: 617526 - RNA, 64 nt, Homo Sapiens; identical to SEQ ID NO: 48052

SEQ ID NO: 617527 - RNA, 64 nt, Homo Sapiens; identical to SEQ ID NO: 48053

SEQ ID NO: 617528 - RNA, 64 nt, Homo Sapiens; identical to SEQ ID NO: 48054

SEQ ID NO: 617529 - RNA, 64 nt, Homo Sapiens; identical to SEQ ID NO: 48055

SEQ ID NO: 617530 - RNA, 64 nt, Homo Sapiens; identical to SEQ ID NO: 48056

SEQ ID NO: 617531 - RNA, 64 nt, Homo Sapiens; identical to SEQ ID NO: 48057

SEQ ID NO: 617532 - RNA, 64 nt, Homo Sapiens; identical to SEQ ID NO: 48058

SEQ ID NO: 617533 - RNA, 64 nt, Homo Sapiens; identical to SEQ ID NO: 48059

SEQ ID NO: 617534 - RNA, 64 nt, Homo Sapiens; identical to SEQ ID NO: 48060

SEQ ID NO: 617535 - RNA, 64 nt, Homo Sapiens; identical to SEQ ID NO: 48061

SEQ ID NO: 617536 - RNA, 64 nt, Homo Sapiens; identical to SEQ ID NO: 48062

SEQ ID NO: 617537 - RNA, 64 nt, Homo Sapiens; identical to SEQ ID NO: 48063

SEQ ID NO: 617538 - RNA, 64 nt, Homo Sapiens; identical to SEQ ID NO: 48064

SEQ ID NO: 617539 - RNA, 64 nt, Homo Sapiens; identical to SEQ ID NO: 48065

SEQ ID NO: 617540 - RNA, 64 nt, Homo Sapiens; identical to SEQ ID NO: 48066

SEQ ID NO: 617541 - RNA, 64 nt, Homo Sapiens; identical to SEQ ID NO: 48067

SEQ ID NO: 617542 - RNA, 64 nt, Homo Sapiens; identical to SEQ ID NO: 48068

SEQ ID NO: 617543 - RNA, 64 nt, Homo Sapiens; identical to SEQ ID NO: 48069

SEQ ID NO: 617544 - RNA, 64 nt, Homo Sapiens; identical to SEQ ID NO: 48070

SEQ ID NO: 617545 - RNA, 64 nt, Homo Sapiens; identical to SEQ ID NO: 48071

SEQ ID NO: 617546 - RNA, 64 nt, Homo Sapiens; identical to SEQ ID NO: 48072

SEQ ID NO: 617547 - RNA, 64 nt, Homo Sapiens; identical to SEQ ID NO: 48073

SEQ ID NO: 617548 - RNA, 64 nt, Homo Sapiens; identical to SEQ ID NO: 48074

SEQ ID NO: 617549 - RNA, 64 nt, Homo Sapiens; identical to SEQ ID NO: 48075

SEQ ID NO: 617550 - RNA, 64 nt, Homo Sapiens; identical to SEQ ID NO: 48076

SEQ ID NO: 617551 - RNA, 64 nt, Homo Sapiens; identical to SEQ ID NO: 48077

SEQ ID NO: 617552 - RNA, 64 nt, Homo Sapiens; identical to SEQ ID NO: 48078

SEQ ID NO: 617553 - RNA, 64 nt, Homo Sapiens; identical to SEQ ID NO: 48079

SEQ ID NO: 617554 - RNA, 64 nt, Homo Sapiens; identical to SEQ ID NO: 48080

SEQ ID NO: 617555 - RNA, 64 nt, Homo Sapiens; identical to SEQ ID NO: 48081

SEQ ID NO: 617556 - RNA, 64 nt, Homo Sapiens; identical to SEQ ID NO: 48082

SEQ ID NO: 617557 - RNA, 64 nt, Homo Sapiens; identical to SEQ ID NO: 48083

SEQ ID NO: 617558 - RNA, 64 nt, Homo Sapiens; identical to SEQ ID NO: 48084

SEQ ID NO: 617559 - RNA, 64 nt, Homo Sapiens; identical to SEQ ID NO: 48085

SEQ ID NO: 617560 - RNA, 64 nt, Homo Sapiens; identical to SEQ ID NO: 48086

SEQ ID NO: 617561 - RNA, 64 nt, Homo Sapiens; identical to SEQ ID NO: 48087

SEQ ID NO: 617562 - RNA, 64 nt, Homo Sapiens; identical to SEQ ID NO: 48088

SEQ ID NO: 617563 - RNA, 64 nt, Homo Sapiens; identical to SEQ ID NO: 48089

SEQ ID NO: 617564 - RNA, 64 nt, Homo Sapiens; identical to SEQ ID NO: 48090

SEQ ID NO: 617565 - RNA, 64 nt, Homo Sapiens; identical to SEQ ID NO: 48091

SEQ ID NO: 617566 - RNA, 64 nt, Homo Sapiens; identical to SEQ ID NO: 48092

SEQ ID NO: 617567 - RNA, 64 nt, Homo Sapiens; identical to SEQ ID NO: 48093

SEQ ID NO: 617568 - RNA, 64 nt, Homo Sapiens; identical to SEQ ID NO: 48094

SEQ ID NO: 617569 - RNA, 64 nt, Homo Sapiens; identical to SEQ ID NO: 48095

SEQ ID NO: 617570 - RNA, 64 nt, Homo Sapiens; identical to SEQ ID NO: 48096

SEQ ID NO: 617571 - RNA, 64 nt, Homo Sapiens; identical to SEQ ID NO: 48097

SEQ ID NO: 617572 - RNA, 64 nt, Homo Sapiens; identical to SEQ ID NO: 48098

SEQ ID NO: 617573 - RNA, 64 nt, Homo Sapiens; identical to SEQ ID NO: 48099

SEQ ID NO: 617574 - RNA, 64 nt, Homo Sapiens; identical to SEQ ID NO: 48100

SEQ ID NO: 617575 - RNA, 64 nt, Homo Sapiens; identical to SEQ ID NO: 48101

SEQ ID NO: 617576 - RNA, 64 nt, Homo Sapiens; identical to SEQ ID NO: 48102

SEQ ID NO: 617577 - RNA, 64 nt, Homo Sapiens; identical to SEQ ID NO: 48103

SEQ ID NO: 617578 - RNA, 64 nt, Homo Sapiens; identical to SEQ ID NO: 48104

SEQ ID NO: 617579 - RNA, 64 nt, Homo Sapiens; identical to SEQ ID NO: 48105

SEQ ID NO: 617580 - RNA, 64 nt, Homo Sapiens; identical to SEQ ID NO: 48106

SEQ ID NO: 617581 - RNA, 64 nt, Homo Sapiens; identical to SEQ ID NO: 48107

SEQ ID NO: 617582 - RNA, 64 nt, Homo Sapiens; identical to SEQ ID NO: 48108

SEQ ID NO: 617583 - RNA, 64 nt, Homo Sapiens; identical to SEQ ID NO: 48109

SEQ ID NO: 617584 - RNA, 64 nt, Homo Sapiens; identical to SEQ ID NO: 48110

SEQ ID NO: 617585 - RNA, 64 nt, Homo Sapiens; identical to SEQ ID NO: 48111

SEQ ID NO: 617586 - RNA, 64 nt, Homo Sapiens; identical to SEQ ID NO: 48112

SEQ ID NO: 617587 - RNA, 64 nt, Homo Sapiens; identical to SEQ ID NO: 48113

SEQ ID NO: 617588 - RNA, 64 nt, Homo Sapiens; identical to SEQ ID NO: 48114

SEQ ID NO: 617589 - RNA, 64 nt, Homo Sapiens; identical to SEQ ID NO: 48115

SEQ ID NO: 617590 - RNA, 64 nt, Homo Sapiens; identical to SEQ ID NO: 48116

SEQ ID NO: 617591 - RNA, 64 nt, Homo Sapiens; identical to SEQ ID NO: 48117

SEQ ID NO: 617592 - RNA, 64 nt, Homo Sapiens; identical to SEQ ID NO: 48118

SEQ ID NO: 617593 - RNA, 64 nt, Homo Sapiens; identical to SEQ ID NO: 48119

SEQ ID NO: 617594 - RNA, 64 nt, Homo Sapiens; identical to SEQ ID NO: 48120

SEQ ID NO: 617595 - RNA, 64 nt, Homo Sapiens; identical to SEQ ID NO: 48121

SEQ ID NO: 617596 - RNA, 64 nt, Homo Sapiens; identical to SEQ ID NO: 48122

SEQ ID NO: 617597 - RNA, 64 nt, Homo Sapiens; identical to SEQ ID NO: 48123

SEQ ID NO: 617598 - RNA, 64 nt, Homo Sapiens; identical to SEQ ID NO: 48124

SEQ ID NO: 617599 - RNA, 64 nt, Homo Sapiens; identical to SEQ ID NO: 48125

SEQ ID NO: 617600 - RNA, 64 nt, Homo Sapiens; identical to SEQ ID NO: 48126

SEQ ID NO: 617601 - RNA, 64 nt, Homo Sapiens; identical to SEQ ID NO: 48127

SEQ ID NO: 617602 - RNA, 64 nt, Homo Sapiens; identical to SEQ ID NO: 48128

SEQ ID NO: 617603 - RNA, 64 nt, Homo Sapiens; identical to SEQ ID NO: 48129

SEQ ID NO: 617604 - RNA, 64 nt, Homo Sapiens; identical to SEQ ID NO: 48130

SEQ ID NO: 617605 - RNA, 64 nt, Homo Sapiens; identical to SEQ ID NO: 48131

SEQ ID NO: 617606 - RNA, 59 nt, Homo Sapiens; identical to SEQ ID NO: 48132

SEQ ID NO: 617607 - RNA, 64 nt, Homo Sapiens; identical to SEQ ID NO: 48133

SEQ ID NO: 617608 - RNA, 64 nt, Homo Sapiens; identical to SEQ ID NO: 48134

SEQ ID NO: 617609 - RNA, 64 nt, Homo Sapiens; identical to SEQ ID NO: 48135

SEQ ID NO: 617610 - RNA, 64 nt, Homo Sapiens; identical to SEQ ID NO: 48136

SEQ ID NO: 617611 - RNA, 64 nt, Homo Sapiens; identical to SEQ ID NO: 48137

SEQ ID NO: 617612 - RNA, 64 nt, Homo Sapiens; identical to SEQ ID NO: 48138

SEQ ID NO: 617613 - RNA, 64 nt, Homo Sapiens; identical to SEQ ID NO: 48139

SEQ ID NO: 617614 - RNA, 64 nt, Homo Sapiens; identical to SEQ ID NO: 48140

SEQ ID NO: 617615 - RNA, 64 nt, Homo Sapiens; identical to SEQ ID NO: 48141

SEQ ID NO: 617616 - RNA, 64 nt, Homo Sapiens; identical to SEQ ID NO: 48142

SEQ ID NO: 617617 - RNA, 64 nt, Homo Sapiens; identical to SEQ ID NO: 48143

SEQ ID NO: 617618 - RNA, 64 nt, Homo Sapiens; identical to SEQ ID NO: 48144

SEQ ID NO: 617619 - RNA, 64 nt, Homo Sapiens; identical to SEQ ID NO: 48145

SEQ ID NO: 617620 - RNA, 64 nt, Homo Sapiens; identical to SEQ ID NO: 48146

SEQ ID NO: 617621 - RNA, 64 nt, Homo Sapiens; identical to SEQ ID NO: 48147

SEQ ID NO: 617622 - RNA, 64 nt, Homo Sapiens; identical to SEQ ID NO: 48148

SEQ ID NO: 617623 - RNA, 64 nt, Homo Sapiens; identical to SEQ ID NO: 48149

SEQ ID NO: 617624 - RNA, 64 nt, Homo Sapiens; identical to SEQ ID NO: 48150

SEQ ID NO: 617625 - RNA, 64 nt, Homo Sapiens; identical to SEQ ID NO: 48151

SEQ ID NO: 617626 - RNA, 64 nt, Homo Sapiens; identical to SEQ ID NO: 48152

SEQ ID NO: 617627 - RNA, 64 nt, Homo Sapiens; identical to SEQ ID NO: 48153

SEQ ID NO: 617628 - RNA, 64 nt, Homo Sapiens; identical to SEQ ID NO: 48154

SEQ ID NO: 617629 - RNA, 64 nt, Homo Sapiens; identical to SEQ ID NO: 48155

SEQ ID NO: 617630 - RNA, 64 nt, Homo Sapiens; identical to SEQ ID NO: 48156

SEQ ID NO: 617631 - RNA, 64 nt, Homo Sapiens; identical to SEQ ID NO: 48157

SEQ ID NO: 617632 - RNA, 64 nt, Homo Sapiens; identical to SEQ ID NO: 48158

SEQ ID NO: 617633 - RNA, 64 nt, Homo Sapiens; identical to SEQ ID NO: 48159

SEQ ID NO: 617634 - RNA, 64 nt, Homo Sapiens; identical to SEQ ID NO: 48160

SEQ ID NO: 617635 - RNA, 64 nt, Homo Sapiens; identical to SEQ ID NO: 48161

SEQ ID NO: 617636 - RNA, 64 nt, Homo Sapiens; identical to SEQ ID NO: 48162

SEQ ID NO: 617637 - RNA, 64 nt, Homo Sapiens; identical to SEQ ID NO: 48163

SEQ ID NO: 617638 - RNA, 64 nt, Homo Sapiens; identical to SEQ ID NO: 48164

SEQ ID NO: 617639 - RNA, 64 nt, Homo Sapiens; identical to SEQ ID NO: 48165

SEQ ID NO: 617640 - RNA, 64 nt, Homo Sapiens; identical to SEQ ID NO: 48166

SEQ ID NO: 617641 - RNA, 64 nt, Homo Sapiens; identical to SEQ ID NO: 48167

SEQ ID NO: 617642 - RNA, 64 nt, Homo Sapiens; identical to SEQ ID NO: 48168

SEQ ID NO: 617643 - RNA, 64 nt, Homo Sapiens; identical to SEQ ID NO: 48169

SEQ ID NO: 617644 - RNA, 64 nt, Homo Sapiens; identical to SEQ ID NO: 48170

SEQ ID NO: 617645 - RNA, 64 nt, Homo Sapiens; identical to SEQ ID NO: 48171

SEQ ID NO: 617646 - RNA, 64 nt, Homo Sapiens; identical to SEQ ID NO: 48172

SEQ ID NO: 617647 - RNA, 64 nt, Homo Sapiens; identical to SEQ ID NO: 48173

SEQ ID NO: 617648 - RNA, 64 nt, Homo Sapiens; identical to SEQ ID NO: 48174

SEQ ID NO: 617649 - RNA, 64 nt, Homo Sapiens; identical to SEQ ID NO: 48175

SEQ ID NO: 617650 - RNA, 64 nt, Homo Sapiens; identical to SEQ ID NO: 48176

SEQ ID NO: 617651 - RNA, 64 nt, Homo Sapiens; identical to SEQ ID NO: 48177

SEQ ID NO: 617652 - RNA, 64 nt, Homo Sapiens; identical to SEQ ID NO: 48178

SEQ ID NO: 617653 - RNA, 64 nt, Homo Sapiens; identical to SEQ ID NO: 48179

SEQ ID NO: 617654 - RNA, 64 nt, Homo Sapiens; identical to SEQ ID NO: 48180

SEQ ID NO: 617655 - RNA, 64 nt, Homo Sapiens; identical to SEQ ID NO: 48181

SEQ ID NO: 617656 - RNA, 64 nt, Homo Sapiens; identical to SEQ ID NO: 48182

SEQ ID NO: 617657 - RNA, 64 nt, Homo Sapiens; identical to SEQ ID NO: 48183

SEQ ID NO: 617658 - RNA, 64 nt, Homo Sapiens; identical to SEQ ID NO: 48184

SEQ ID NO: 617659 - RNA, 64 nt, Homo Sapiens; identical to SEQ ID NO: 48185

SEQ ID NO: 617660 - RNA, 64 nt, Homo Sapiens; identical to SEQ ID NO: 48186

SEQ ID NO: 617661 - RNA, 64 nt, Homo Sapiens; identical to SEQ ID NO: 48187

SEQ ID NO: 617662 - RNA, 64 nt, Homo Sapiens; identical to SEQ ID NO: 48188

SEQ ID NO: 617663 - RNA, 64 nt, Homo Sapiens; identical to SEQ ID NO: 48189

SEQ ID NO: 617664 - RNA, 64 nt, Homo Sapiens; identical to SEQ ID NO: 48190

SEQ ID NO: 617665 - RNA, 64 nt, Homo Sapiens; identical to SEQ ID NO: 48191

SEQ ID NO: 617666 - RNA, 64 nt, Homo Sapiens; identical to SEQ ID NO: 48192

SEQ ID NO: 617667 - RNA, 64 nt, Homo Sapiens; identical to SEQ ID NO: 48193

SEQ ID NO: 617668 - RNA, 64 nt, Homo Sapiens; identical to SEQ ID NO: 48194

SEQ ID NO: 617669 - RNA, 64 nt, Homo Sapiens; identical to SEQ ID NO: 48195

SEQ ID NO: 617670 - RNA, 64 nt, Homo Sapiens; identical to SEQ ID NO: 48196

SEQ ID NO: 617671 - RNA, 64 nt, Homo Sapiens; identical to SEQ ID NO: 48197

SEQ ID NO: 617672 - RNA, 64 nt, Homo Sapiens; identical to SEQ ID NO: 48198

SEQ ID NO: 617673 - RNA, 64 nt, Homo Sapiens; identical to SEQ ID NO: 48199

SEQ ID NO: 617674 - RNA, 64 nt, Homo Sapiens; identical to SEQ ID NO: 48200

SEQ ID NO: 617675 - RNA, 64 nt, Homo Sapiens; identical to SEQ ID NO: 48201

SEQ ID NO: 617676 - RNA, 64 nt, Homo Sapiens; identical to SEQ ID NO: 48202

SEQ ID NO: 617677 - RNA, 64 nt, Homo Sapiens; identical to SEQ ID NO: 48203

SEQ ID NO: 617678 - RNA, 64 nt, Homo Sapiens; identical to SEQ ID NO: 48204

SEQ ID NO: 617679 - RNA, 64 nt, Homo Sapiens; identical to SEQ ID NO: 48205

SEQ ID NO: 617680 - RNA, 64 nt, Homo Sapiens; identical to SEQ ID NO: 48206

SEQ ID NO: 617681 - RNA, 64 nt, Homo Sapiens; identical to SEQ ID NO: 48207

SEQ ID NO: 617682 - RNA, 64 nt, Homo Sapiens; identical to SEQ ID NO: 48208

SEQ ID NO: 617683 - RNA, 64 nt, Homo Sapiens; identical to SEQ ID NO: 48209

SEQ ID NO: 617684 - RNA, 64 nt, Homo Sapiens; identical to SEQ ID NO: 48210

SEQ ID NO: 617685 - RNA, 64 nt, Homo Sapiens; identical to SEQ ID NO: 48211

SEQ ID NO: 617686 - RNA, 64 nt, Homo Sapiens; identical to SEQ ID NO: 48212

SEQ ID NO: 617687 - RNA, 64 nt, Homo Sapiens; identical to SEQ ID NO: 48213

SEQ ID NO: 617688 - RNA, 64 nt, Homo Sapiens; identical to SEQ ID NO: 48214

SEQ ID NO: 617689 - RNA, 64 nt, Homo Sapiens; identical to SEQ ID NO: 48215

SEQ ID NO: 617690 - RNA, 64 nt, Homo Sapiens; identical to SEQ ID NO: 48216

SEQ ID NO: 617691 - RNA, 64 nt, Homo Sapiens; identical to SEQ ID NO: 48217

SEQ ID NO: 617692 - RNA, 64 nt, Homo Sapiens; identical to SEQ ID NO: 48218

SEQ ID NO: 617693 - RNA, 64 nt, Homo Sapiens; identical to SEQ ID NO: 48219

SEQ ID NO: 617694 - RNA, 64 nt, Homo Sapiens; identical to SEQ ID NO: 48220

SEQ ID NO: 617695 - RNA, 64 nt, Homo Sapiens; identical to SEQ ID NO: 48221

SEQ ID NO: 617696 - RNA, 64 nt, Homo Sapiens; identical to SEQ ID NO: 48222

SEQ ID NO: 617697 - RNA, 64 nt, Homo Sapiens; identical to SEQ ID NO: 48223

SEQ ID NO: 617698 - RNA, 64 nt, Homo Sapiens; identical to SEQ ID NO: 48224

SEQ ID NO: 617699 - RNA, 64 nt, Homo Sapiens; identical to SEQ ID NO: 48225

SEQ ID NO: 617700 - RNA, 64 nt, Homo Sapiens; identical to SEQ ID NO: 48226

SEQ ID NO: 617701 - RNA, 64 nt, Homo Sapiens; identical to SEQ ID NO: 48227

SEQ ID NO: 617702 - RNA, 64 nt, Homo Sapiens; identical to SEQ ID NO: 48228

SEQ ID NO: 617703 - RNA, 64 nt, Homo Sapiens; identical to SEQ ID NO: 48229

SEQ ID NO: 617704 - RNA, 64 nt, Homo Sapiens; identical to SEQ ID NO: 48230

SEQ ID NO: 617705 - RNA, 64 nt, Homo Sapiens; identical to SEQ ID NO: 48231

SEQ ID NO: 617706 - RNA, 64 nt, Homo Sapiens; identical to SEQ ID NO: 48232

SEQ ID NO: 617707 - RNA, 64 nt, Homo Sapiens; identical to SEQ ID NO: 48233

SEQ ID NO: 617708 - RNA, 64 nt, Homo Sapiens; identical to SEQ ID NO: 48234

SEQ ID NO: 617709 - RNA, 64 nt, Homo Sapiens; identical to SEQ ID NO: 48235

SEQ ID NO: 617710 - RNA, 64 nt, Homo Sapiens; identical to SEQ ID NO: 48236

SEQ ID NO: 617711 - RNA, 64 nt, Homo Sapiens; identical to SEQ ID NO: 48237

SEQ ID NO: 617712 - RNA, 64 nt, Homo Sapiens; identical to SEQ ID NO: 48238

SEQ ID NO: 617713 - RNA, 64 nt, Homo Sapiens; identical to SEQ ID NO: 48239

SEQ ID NO: 617714 - RNA, 64 nt, Homo Sapiens; identical to SEQ ID NO: 48240

SEQ ID NO: 617715 - RNA, 64 nt, Homo Sapiens; identical to SEQ ID NO: 48241

SEQ ID NO: 617716 - RNA, 64 nt, Homo Sapiens; identical to SEQ ID NO: 48242

SEQ ID NO: 617717 - RNA, 64 nt, Homo Sapiens; identical to SEQ ID NO: 48243

SEQ ID NO: 617718 - RNA, 64 nt, Homo Sapiens; identical to SEQ ID NO: 48244

SEQ ID NO: 617719 - RNA, 64 nt, Homo Sapiens; identical to SEQ ID NO: 48245

SEQ ID NO: 617720 - RNA, 64 nt, Homo Sapiens; identical to SEQ ID NO: 48246

SEQ ID NO: 617721 - RNA, 64 nt, Homo Sapiens; identical to SEQ ID NO: 48247

SEQ ID NO: 617722 - RNA, 64 nt, Homo Sapiens; identical to SEQ ID NO: 48248

SEQ ID NO: 617723 - RNA, 64 nt, Homo Sapiens; identical to SEQ ID NO: 48249

SEQ ID NO: 617724 - RNA, 64 nt, Homo Sapiens; identical to SEQ ID NO: 48250

SEQ ID NO: 617725 - RNA, 64 nt, Homo Sapiens; identical to SEQ ID NO: 48251

SEQ ID NO: 617726 - RNA, 64 nt, Homo Sapiens; identical to SEQ ID NO: 48252

SEQ ID NO: 617727 - RNA, 64 nt, Homo Sapiens; identical to SEQ ID NO: 48253

SEQ ID NO: 617728 - RNA, 64 nt, Homo Sapiens; identical to SEQ ID NO: 48254

SEQ ID NO: 617729 - RNA, 64 nt, Homo Sapiens; identical to SEQ ID NO: 48255

SEQ ID NO: 617730 - RNA, 64 nt, Homo Sapiens; identical to SEQ ID NO: 48256

SEQ ID NO: 617731 - RNA, 64 nt, Homo Sapiens; identical to SEQ ID NO: 48257

SEQ ID NO: 617732 - RNA, 64 nt, Homo Sapiens; identical to SEQ ID NO: 48258

SEQ ID NO: 617733 - RNA, 64 nt, Homo Sapiens; identical to SEQ ID NO: 48259

SEQ ID NO: 617734 - RNA, 64 nt, Homo Sapiens; identical to SEQ ID NO: 48260

SEQ ID NO: 617735 - RNA, 64 nt, Homo Sapiens; identical to SEQ ID NO: 48261

SEQ ID NO: 617736 - RNA, 64 nt, Homo Sapiens; identical to SEQ ID NO: 48262

SEQ ID NO: 617737 - RNA, 64 nt, Homo Sapiens; identical to SEQ ID NO: 48263

SEQ ID NO: 617738 - RNA, 64 nt, Homo Sapiens; identical to SEQ ID NO: 48264

SEQ ID NO: 617739 - RNA, 64 nt, Homo Sapiens; identical to SEQ ID NO: 48265

SEQ ID NO: 617740 - RNA, 64 nt, Homo Sapiens; identical to SEQ ID NO: 48266

SEQ ID NO: 617741 - RNA, 64 nt, Homo Sapiens; identical to SEQ ID NO: 48267

SEQ ID NO: 617742 - RNA, 64 nt, Homo Sapiens; identical to SEQ ID NO: 48268

SEQ ID NO: 617743 - RNA, 64 nt, Homo Sapiens; identical to SEQ ID NO: 48269

SEQ ID NO: 617744 - RNA, 64 nt, Homo Sapiens; identical to SEQ ID NO: 48270

SEQ ID NO: 617745 - RNA, 64 nt, Homo Sapiens; identical to SEQ ID NO: 48271

SEQ ID NO: 617746 - RNA, 64 nt, Homo Sapiens; identical to SEQ ID NO: 48272

SEQ ID NO: 617747 - RNA, 64 nt, Homo Sapiens; identical to SEQ ID NO: 48273

SEQ ID NO: 617748 - RNA, 64 nt, Homo Sapiens; identical to SEQ ID NO: 48274

SEQ ID NO: 617749 - RNA, 64 nt, Homo Sapiens; identical to SEQ ID NO: 48275

SEQ ID NO: 617750 - RNA, 64 nt, Homo Sapiens; identical to SEQ ID NO: 48276

SEQ ID NO: 617751 - RNA, 64 nt, Homo Sapiens; identical to SEQ ID NO: 48277

SEQ ID NO: 617752 - RNA, 64 nt, Homo Sapiens; identical to SEQ ID NO: 48278

SEQ ID NO: 617753 - RNA, 64 nt, Homo Sapiens; identical to SEQ ID NO: 48279

SEQ ID NO: 617754 - RNA, 64 nt, Homo Sapiens; identical to SEQ ID NO: 48280

SEQ ID NO: 617755 - RNA, 64 nt, Homo Sapiens; identical to SEQ ID NO: 48281

SEQ ID NO: 617756 - RNA, 64 nt, Homo Sapiens; identical to SEQ ID NO: 48282

SEQ ID NO: 617757 - RNA, 64 nt, Homo Sapiens; identical to SEQ ID NO: 48283

SEQ ID NO: 617758 - RNA, 64 nt, Homo Sapiens; identical to SEQ ID NO: 48284

SEQ ID NO: 617759 - RNA, 64 nt, Homo Sapiens; identical to SEQ ID NO: 48285

SEQ ID NO: 617760 - RNA, 64 nt, Homo Sapiens; identical to SEQ ID NO: 48286

SEQ ID NO: 617761 - RNA, 64 nt, Homo Sapiens; identical to SEQ ID NO: 48287

SEQ ID NO: 617762 - RNA, 64 nt, Homo Sapiens; identical to SEQ ID NO: 48288

SEQ ID NO: 617763 - RNA, 64 nt, Homo Sapiens; identical to SEQ ID NO: 48289

SEQ ID NO: 617764 - RNA, 64 nt, Homo Sapiens; identical to SEQ ID NO: 48290

SEQ ID NO: 617765 - RNA, 64 nt, Homo Sapiens; identical to SEQ ID NO: 48291

SEQ ID NO: 617766 - RNA, 64 nt, Homo Sapiens; identical to SEQ ID NO: 48292

SEQ ID NO: 617767 - RNA, 64 nt, Homo Sapiens; identical to SEQ ID NO: 48293

SEQ ID NO: 617768 - RNA, 64 nt, Homo Sapiens; identical to SEQ ID NO: 48294

SEQ ID NO: 617769 - RNA, 64 nt, Homo Sapiens; identical to SEQ ID NO: 48295

SEQ ID NO: 617770 - RNA, 64 nt, Homo Sapiens; identical to SEQ ID NO: 48296

SEQ ID NO: 617771 - RNA, 64 nt, Homo Sapiens; identical to SEQ ID NO: 48297

SEQ ID NO: 617772 - RNA, 64 nt, Homo Sapiens; identical to SEQ ID NO: 48298

SEQ ID NO: 617773 - RNA, 64 nt, Homo Sapiens; identical to SEQ ID NO: 48299

SEQ ID NO: 617774 - RNA, 64 nt, Homo Sapiens; identical to SEQ ID NO: 48300

SEQ ID NO: 617775 - RNA, 64 nt, Homo Sapiens; identical to SEQ ID NO: 48301

SEQ ID NO: 617776 - RNA, 64 nt, Homo Sapiens; identical to SEQ ID NO: 48302

SEQ ID NO: 617777 - RNA, 64 nt, Homo Sapiens; identical to SEQ ID NO: 411857

SEQ ID NO: 617778 - RNA, 64 nt, Homo Sapiens; identical to SEQ ID NO: 411858

SEQ ID NO: 617779 - RNA, 64 nt, Homo Sapiens; identical to SEQ ID NO: 411859

SEQ ID NO: 617780 - RNA, 64 nt, Homo Sapiens; identical to SEQ ID NO: 411860

SEQ ID NO: 617781 - RNA, 64 nt, Homo Sapiens; identical to SEQ ID NO: 411861

SEQ ID NO: 617782 - RNA, 64 nt, Homo Sapiens; identical to SEQ ID NO: 411862

SEQ ID NO: 617783 - RNA, 64 nt, Homo Sapiens; identical to SEQ ID NO: 411863

SEQ ID NO: 617784 - RNA, 64 nt, Homo Sapiens; identical to SEQ ID NO: 411864

SEQ ID NO: 617785 - RNA, 64 nt, Homo Sapiens; identical to SEQ ID NO: 364238

SEQ ID NO: 617786 - RNA, 64 nt, Homo Sapiens; identical to SEQ ID NO: 364239

SEQ ID NO: 617787 - RNA, 64 nt, Homo Sapiens; identical to SEQ ID NO: 364240

SEQ ID NO: 617788 - RNA, 64 nt, Homo Sapiens; identical to SEQ ID NO: 364241

SEQ ID NO: 617789 - RNA, 64 nt, Homo Sapiens; identical to SEQ ID NO: 364242

SEQ ID NO: 617790 - RNA, 64 nt, Homo Sapiens; identical to SEQ ID NO: 364243

SEQ ID NO: 617791 - RNA, 64 nt, Homo Sapiens; identical to SEQ ID NO: 364244

SEQ ID NO: 617792 - RNA, 64 nt, Homo Sapiens; identical to SEQ ID NO: 364245

SEQ ID NO: 617793 - RNA, 64 nt, Homo Sapiens; identical to SEQ ID NO: 364246

SEQ ID NO: 617794 - RNA, 64 nt, Homo Sapiens; identical to SEQ ID NO: 364247

SEQ ID NO: 617795 - RNA, 64 nt, Homo Sapiens; identical to SEQ ID NO: 364248

SEQ ID NO: 617796 - RNA, 64 nt, Homo Sapiens; identical to SEQ ID NO: 364249

SEQ ID NO: 617797 - RNA, 64 nt, Homo Sapiens; identical to SEQ ID NO: 364250

SEQ ID NO: 617798 - RNA, 64 nt, Homo Sapiens; identical to SEQ ID NO: 364251

SEQ ID NO: 617799 - RNA, 64 nt, Homo Sapiens; identical to SEQ ID NO: 364252

SEQ ID NO: 617800 - RNA, 64 nt, Homo Sapiens; identical to SEQ ID NO: 364253

SEQ ID NO: 617801 - RNA, 64 nt, Homo Sapiens
agucaauauguuggaggcaugcuaagaauaaacaacuaaauaacuguauuagaaaaaaaagaaa

SEQ ID NO: 617802 - RNA, 64 nt, Homo Sapiens
aacuaaauaacuguauuagaaaaaaaagaaacuuacuaaauaucauaaucugaugauauguggu

SEQ ID NO: 617803 - RNA, 64 nt, Homo Sapiens
uauuacucuugugacauuuuuuugguuaucaacaacuaaauauaaauuacuuuggaaaaaguaa

SEQ ID NO: 617804 - RNA, 64 nt, Homo Sapiens
agauccaugcagcuagaacacacuugcuuccacuacuaaauauacaggguauguccuaacaugg

SEQ ID NO: 617805 - RNA, 64 nt, Homo Sapiens
uuugguuaaacauuucuaaaaauaaacuaccaauacuaaauaguaagaaaccuaacuuuaguag

SEQ ID NO: 617806 - RNA, 64 nt, Homo Sapiens
ucuauuacuagacauuuauguaacaucuugcuguacuaaauacagcagaaaaucuacucuuuag

SEQ ID NO: 617807 - RNA, 64 nt, Homo Sapiens
gcacauaagauaauuugcuaaaaugcuaaucuuuacuaaauagugagcuaaauuagaauuucua

SEQ ID NO: 617808 - RNA, 64 nt, Homo Sapiens
ugguaacugaagcaauaggcgguguaacuuguaaacuaaauauuuaguuaaugaugauaacaau

SEQ ID NO: 617809 - RNA, 64 nt, Homo Sapiens
uuuuaauauuucugaauuuuaugguaaauauaaaacuaaauaugaaaauuggagacuuauaauc

SEQ ID NO: 617810 - RNA, 64 nt, Homo Sapiens
guaaagaggguuuuuaaaauaacuuauucuugaaacuaaauauauucaaauaagauuauuuaca

SEQ ID NO: 617811 - RNA, 64 nt, Homo Sapiens
agaaaaguuacagauaagaauuauggcugaauauacuaaauaacuugaagcacuaauuccaaaa

SEQ ID NO: 617812 - RNA, 64 nt, Homo Sapiens
uuugauuaacuaguguuaaacaaaaaauagguuuacuaaauauguuaaucuauucuuuuaacau

SEQ ID NO: 617813 - RNA, 64 nt, Homo Sapiens
cuguaguguuaagcaaagucuccucuugcuugauacuaaauaaacuuuugaaagaaauuuugug

SEQ ID NO: 617814 - RNA, 64 nt, Homo Sapiens
auuauuuuacuaucagugauuuuuaaaauaagaaacuaaauaaaauauguugaaaugcuaccuu

SEQ ID NO: 617815 - RNA, 64 nt, Homo Sapiens
uaacaagcuguguuuuccuacuggaauguuaaacacuaaauauaaugcuaagauacugccugca

SEQ ID NO: 617816 - RNA, 64 nt, Homo Sapiens
uucgaauuguucaauuguguuauuguauuauaugacuaaauaaccuuuaagucuuuggcaaugu

SEQ ID NO: 617817 - RNA, 64 nt, Homo Sapiens
auuccuucuaaggcaaauuggaguaauguaaaagacuaaauaucuaauuccaacaaggaauuca

SEQ ID NO: 617818 - RNA, 64 nt, Homo Sapiens
cacuaauggugccaguggaacguuuaugaaaacaacuaaauauuaugagucuucaucacagcau

SEQ ID NO: 617819 - RNA, 64 nt, Homo Sapiens
aaauauuugagccauuacugaauuaauuuaucagacuaaauagaguauaguuauuuuaagugcc

SEQ ID NO: 617820 - RNA, 64 nt, Homo Sapiens
auugcuuuaguaugcuggcuuguacauaguaggcacuaaauacauguuuguugguugauuguuu

SEQ ID NO: 617821 - RNA, 64 nt, Homo Sapiens
uuagugcucuuaacuuguuaccauuguaauauuaacuaaauaaacagauguauuaugcuguugc

SEQ ID NO: 617822 - RNA, 64 nt, Homo Sapiens
aaaagauccaggggacauaaccucccuucuucuaacuaaauauaguuuuaagaccuaaucccca

SEQ ID NO: 617823 - RNA, 64 nt, Homo Sapiens
uugggggaaacggggggaggacuuuuaaaacagcacuaaauaacagacugcauuguggccccag

SEQ ID NO: 617824 - RNA, 64 nt, Homo Sapiens
uugugguucuacauuccuggugaaugaugaauguugcugucaaagggcugcccccuaccuuaua

SEQ ID NO: 617825 - RNA, 64 nt, Homo Sapiens
guuaacauccuaaugugguagguauuagguaaugugcugucaugagaaaaauugagacuuccaa

SEQ ID NO: 617826 - RNA, 64 nt, Homo Sapiens
uaugauaugguaaaaguuacaaaaaacuuguaaaugcugucaacuacaagugugguagggacuu

SEQ ID NO: 617827 - RNA, 64 nt, Homo Sapiens
agaaugaauaauaauuauccgcugauuacacaguugcugucauacccuucacaguguuucgaca

SEQ ID NO: 617828 - RNA, 64 nt, Homo Sapiens
caucugguugaauggcuuuucuuagugugguauuugcugucacauaguuuuuccugggugaguc

SEQ ID NO: 617829 - RNA, 64 nt, Homo Sapiens
uguuuacaugucaagaggaaaagcuguaagaaaaugcugucacagacccaucccuguggcaucg

SEQ ID NO: 617830 - RNA, 64 nt, Homo Sapiens
cacaagggcacgugaagucacaagcaccugcaugugcugucacguaccugcccaaggaugcugu

SEQ ID NO: 617831 - RNA, 64 nt, Homo Sapiens
caccugcaugugcugucacguaccugcccaaggaugcugucaagucaggcgccgcacuuccuuu

SEQ ID NO: 617832 - RNA, 64 nt, Homo Sapiens
aagugggagugauuuugcaagaaaguggauugagugcugucagauucuggauugagugcuguca

SEQ ID NO: 617833 - RNA, 64 nt, Homo Sapiens
aaguggauugagugcugucaucuucuggauugagugcugucagaggcucaagugagcaaggguu

SEQ ID NO: 617834 - RNA, 64 nt, Homo Sapiens
agcuggcugugggcugagauccuggcuggggcccugcugucaaccucuccuccaggcccugccu

SEQ ID NO: 617835 - RNA, 64 nt, Homo Sapiens
uguccaugccccaguucuaagcccuguggccaggugcugucacacagcaaaggggacuuugcag

SEQ ID NO: 617836 - RNA, 64 nt, Homo Sapiens
cucugcugaauauauaagcaggacggccgccuucugcugucagaauuugcaaucaagggugacu

SEQ ID NO: 617837 - RNA, 64 nt, Homo Sapiens
cuccgaaugacuccuggugcuaggccaugcuggcugcugucacugagcgggacucaggccaaga

SEQ ID NO: 617838 - RNA, 64 nt, Homo Sapiens
accaggccgugaggcuggagaaacuggcaguuauugcugucaaaagccuguucucucaacugcu

SEQ ID NO: 617839 - RNA, 64 nt, Homo Sapiens
gcaguuauugcugucaaaagccuguucucucaacugcugucaauaaaauuaaagauacagauuu

SEQ ID NO: 617840 - RNA, 64 nt, Homo Sapiens
aaggaggggccaccuuguaaagcccaguaagaacugcugucauggagggaaacaguguuaccag

SEQ ID NO: 617841 - RNA, 64 nt, Homo Sapiens
uauuuacagcacaucacuguuuucucagagaaccugcugucaaacuauaaaucaggguuuuaau

SEQ ID NO: 617842 - RNA, 64 nt, Homo Sapiens
ugccugcccugccuccgucccaaccaugggcugcugcugucacucccucuccacuucagugcau

SEQ ID NO: 617843 - RNA, 64 nt, Homo Sapiens
gcucuuauggagcccuggaguuguugggcaaggaugcugucauuuuuugaaccaaaagacaaac

SEQ ID NO: 617844 - RNA, 64 nt, Homo Sapiens
uuuaucucauccuaacaccugucuuggaacugguugcugucaggggggaaaacugcugugugug

SEQ ID NO: 617845 - RNA, 64 nt, Homo Sapiens
ccuuugaagccuggcaagcacuaccuaucaagaaugcugucacacagcaccauccaagaaacua

SEQ ID NO: 617846 - RNA, 64 nt, Homo Sapiens
acagcugaacugaauauaaauguucacaaauuaaugcugucaaaggaaugaguaaagcagaaaa

SEQ ID NO: 617847 - RNA, 64 nt, Homo Sapiens
uuguuuuuguauauaagacugcuuccaccugaaaugcugucauaaguacuggggggguggggga

SEQ ID NO: 617848 - RNA, 64 nt, Homo Sapiens
cuuuguaugaugaaaagaauguguuaugaaucggugcugucagcccugcugucagaccuucuuc

SEQ ID NO: 617849 - RNA, 64 nt, Homo Sapiens
aaaagaauguguuaugaaucggugcugucagcccugcugucagaccuucuuccacagcaaauga

SEQ ID NO: 617850 - RNA, 64 nt, Homo Sapiens
ucuugacagaaaaaaaucaguugacuuaacccuuugcugucaaaagaguuggcguuuccuguuc

SEQ ID NO: 617851 - RNA, 64 nt, Homo Sapiens
uguagucaauguucgguuccucaaaaggucuugcugcugucagguguuaugcacuccauccauc

SEQ ID NO: 617852 - RNA, 64 nt, Homo Sapiens
caccugggcuucacggcauccuugcagccaccucugcugucacugcucgaagcagcagucucuc

SEQ ID NO: 617853 - RNA, 64 nt, Homo Sapiens
gggggccacucagcagcgcuggggcaggugccucugcugucagcuccacccgacaggcagacga

SEQ ID NO: 617854 - RNA, 64 nt, Homo Sapiens
ccacagaaagaaauguaggugugaaguauuaggcugcugucagggagaggauggcagauggagg

SEQ ID NO: 617855 - RNA, 64 nt, Homo Sapiens
gugacuaacuuugaaagaacacccaucauguggcugcugucacccuugaccagccgugguggug

SEQ ID NO: 617856 - RNA, 64 nt, Homo Sapiens
gguaccggaugcagaccccagggagaggagaggcugcugucacuccccaaacaagcgccaccgu

SEQ ID NO: 617857 - RNA, 64 nt, Homo Sapiens
cccagcuuggagugccacgugcccacguccugggugcugucaugauccaccgccacacuggccg

SEQ ID NO: 617858 - RNA, 64 nt, Homo Sapiens
uucauuucagugaaucuggugaccuccaucugcuugcugucauaacccgacacggacuuauuuu

SEQ ID NO: 617859 - RNA, 64 nt, Homo Sapiens
ccaaauaaaaaugcacucaucucuguagaacaucugcugucaaaggccagccugucguuagggc

SEQ ID NO: 617860 - RNA, 64 nt, Homo Sapiens
auggaaagagcgauuggagcuuggcgggcaugugagugcacaagagaaggcgaacauuucaugu

SEQ ID NO: 617861 - RNA, 64 nt, Homo Sapiens
caugacaaaauguagacaaguucuaacacugaaaagugcacacgcugacuggaaaaucuuguca

SEQ ID NO: 617862 - RNA, 64 nt, Homo Sapiens
auaaugauaaaacaccucacaccucacucuuuauagugcacaaaaugaaugaggucugggcuag

SEQ ID NO: 617863 - RNA, 64 nt, Homo Sapiens
auuaugggcuggaaagcauuuguuauaaaccuauagugcacauuuuaacugcccccuaaauuac

SEQ ID NO: 617864 - RNA, 64 nt, Homo Sapiens
gcacacugcacacaugcacaacacagcacacacaagugcacagaugcacacaggugcacagacc

SEQ ID NO: 617865 - RNA, 64 nt, Homo Sapiens
ccacacacagcacuaacacauauacacauacacaagugcacagacacguguagcucacacacag

SEQ ID NO: 617866 - RNA, 64 nt, Homo Sapiens
ccuacgugcccacuggcacagcaguguuuguuagagugcacaucccuuauggcaaagagcuccc

SEQ ID NO: 617867 - RNA, 64 nt, Homo Sapiens; identical to SEQ ID NO: 504627

SEQ ID NO: 617868 - RNA, 64 nt, Homo Sapiens; identical to SEQ ID NO: 504628

SEQ ID NO: 617869 - RNA, 64 nt, Homo Sapiens; identical to SEQ ID NO: 504629

SEQ ID NO: 617870 - RNA, 64 nt, Homo Sapiens; identical to SEQ ID NO: 504630

SEQ ID NO: 617871 - RNA, 64 nt, Homo Sapiens; identical to SEQ ID NO: 504631

SEQ ID NO: 617872 - RNA, 64 nt, Homo Sapiens; identical to SEQ ID NO: 504632

SEQ ID NO: 617873 - RNA, 64 nt, Homo Sapiens; identical to SEQ ID NO: 504633

SEQ ID NO: 617874 - RNA, 64 nt, Homo Sapiens; identical to SEQ ID NO: 504634

SEQ ID NO: 617875 - RNA, 64 nt, Homo Sapiens; identical to SEQ ID NO: 504635

SEQ ID NO: 617876 - RNA, 64 nt, Homo Sapiens; identical to SEQ ID NO: 504636

SEQ ID NO: 617877 - RNA, 64 nt, Homo Sapiens; identical to SEQ ID NO: 504637

SEQ ID NO: 617878 - RNA, 64 nt, Homo Sapiens; identical to SEQ ID NO: 504638

SEQ ID NO: 617879 - RNA, 64 nt, Homo Sapiens; identical to SEQ ID NO: 504639

SEQ ID NO: 617880 - RNA, 64 nt, Homo Sapiens; identical to SEQ ID NO: 504640

SEQ ID NO: 617881 - RNA, 64 nt, Homo Sapiens; identical to SEQ ID NO: 504641

SEQ ID NO: 617882 - RNA, 64 nt, Homo Sapiens; identical to SEQ ID NO: 504642

SEQ ID NO: 617883 - RNA, 64 nt, Homo Sapiens; identical to SEQ ID NO: 504643

SEQ ID NO: 617884 - RNA, 64 nt, Homo Sapiens; identical to SEQ ID NO: 504644

SEQ ID NO: 617885 - RNA, 64 nt, Homo Sapiens; identical to SEQ ID NO: 504645

SEQ ID NO: 617886 - RNA, 64 nt, Homo Sapiens; identical to SEQ ID NO: 504646

SEQ ID NO: 617887 - RNA, 64 nt, Homo Sapiens; identical to SEQ ID NO: 504647

SEQ ID NO: 617888 - RNA, 64 nt, Homo Sapiens; identical to SEQ ID NO: 504648

SEQ ID NO: 617889 - RNA, 64 nt, Homo Sapiens; identical to SEQ ID NO: 504649

SEQ ID NO: 617890 - RNA, 64 nt, Homo Sapiens; identical to SEQ ID NO: 504650

SEQ ID NO: 617891 - RNA, 64 nt, Homo Sapiens; identical to SEQ ID NO: 504651

SEQ ID NO: 617892 - RNA, 64 nt, Homo Sapiens; identical to SEQ ID NO: 504652

SEQ ID NO: 617893 - RNA, 64 nt, Homo Sapiens; identical to SEQ ID NO: 504653

SEQ ID NO: 617894 - RNA, 64 nt, Homo Sapiens; identical to SEQ ID NO: 504654

SEQ ID NO: 617895 - RNA, 64 nt, Homo Sapiens; identical to SEQ ID NO: 504655

SEQ ID NO: 617896 - RNA, 64 nt, Homo Sapiens; identical to SEQ ID NO: 504656

SEQ ID NO: 617897 - RNA, 64 nt, Homo Sapiens; identical to SEQ ID NO: 504657

SEQ ID NO: 617898 - RNA, 64 nt, Homo Sapiens; identical to SEQ ID NO: 504658

SEQ ID NO: 617899 - RNA, 64 nt, Homo Sapiens; identical to SEQ ID NO: 504659

SEQ ID NO: 617900 - RNA, 64 nt, Homo Sapiens; identical to SEQ ID NO: 504660

SEQ ID NO: 617901 - RNA, 64 nt, Homo Sapiens; identical to SEQ ID NO: 504661

SEQ ID NO: 617902 - RNA, 64 nt, Homo Sapiens; identical to SEQ ID NO: 504662

SEQ ID NO: 617903 - RNA, 64 nt, Homo Sapiens; identical to SEQ ID NO: 504663

SEQ ID NO: 617904 - RNA, 64 nt, Homo Sapiens; identical to SEQ ID NO: 504664

SEQ ID NO: 617905 - RNA, 64 nt, Homo Sapiens; identical to SEQ ID NO: 504665

SEQ ID NO: 617906 - RNA, 64 nt, Homo Sapiens; identical to SEQ ID NO: 504666

SEQ ID NO: 617907 - RNA, 64 nt, Homo Sapiens; identical to SEQ ID NO: 504667

SEQ ID NO: 617908 - RNA, 64 nt, Homo Sapiens; identical to SEQ ID NO: 504668

SEQ ID NO: 617909 - RNA, 64 nt, Homo Sapiens; identical to SEQ ID NO: 504669

SEQ ID NO: 617910 - RNA, 64 nt, Homo Sapiens; identical to SEQ ID NO: 504670

SEQ ID NO: 617911 - RNA, 64 nt, Homo Sapiens; identical to SEQ ID NO: 504671

SEQ ID NO: 617912 - RNA, 64 nt, Homo Sapiens; identical to SEQ ID NO: 504672

SEQ ID NO: 617913 - RNA, 64 nt, Homo Sapiens; identical to SEQ ID NO: 216073

SEQ ID NO: 617914 - RNA, 64 nt, Homo Sapiens; identical to SEQ ID NO: 216074

SEQ ID NO: 617915 - RNA, 64 nt, Homo Sapiens; identical to SEQ ID NO: 216075

SEQ ID NO: 617916 - RNA, 64 nt, Homo Sapiens; identical to SEQ ID NO: 216076

SEQ ID NO: 617917 - RNA, 64 nt, Homo Sapiens; identical to SEQ ID NO: 216077

SEQ ID NO: 617918 - RNA, 64 nt, Homo Sapiens; identical to SEQ ID NO: 216078

SEQ ID NO: 617919 - RNA, 64 nt, Homo Sapiens; identical to SEQ ID NO: 216079

SEQ ID NO: 617920 - RNA, 64 nt, Homo Sapiens; identical to SEQ ID NO: 216080

SEQ ID NO: 617921 - RNA, 64 nt, Homo Sapiens; identical to SEQ ID NO: 216081

SEQ ID NO: 617922 - RNA, 64 nt, Homo Sapiens; identical to SEQ ID NO: 216082

SEQ ID NO: 617923 - RNA, 64 nt, Homo Sapiens; identical to SEQ ID NO: 216083

SEQ ID NO: 617924 - RNA, 64 nt, Homo Sapiens; identical to SEQ ID NO: 216084

SEQ ID NO: 617925 - RNA, 64 nt, Homo Sapiens; identical to SEQ ID NO: 216085

SEQ ID NO: 617926 - RNA, 64 nt, Homo Sapiens; identical to SEQ ID NO: 216086

SEQ ID NO: 617927 - RNA, 64 nt, Homo Sapiens; identical to SEQ ID NO: 216087

SEQ ID NO: 617928 - RNA, 64 nt, Homo Sapiens; identical to SEQ ID NO: 216088

SEQ ID NO: 617929 - RNA, 64 nt, Homo Sapiens; identical to SEQ ID NO: 216089

SEQ ID NO: 617930 - RNA, 64 nt, Homo Sapiens; identical to SEQ ID NO: 216090

SEQ ID NO: 617931 - RNA, 64 nt, Homo Sapiens; identical to SEQ ID NO: 216091

SEQ ID NO: 617932 - RNA, 64 nt, Homo Sapiens; identical to SEQ ID NO: 216092

SEQ ID NO: 617933 - RNA, 64 nt, Homo Sapiens; identical to SEQ ID NO: 216093

SEQ ID NO: 617934 - RNA, 64 nt, Homo Sapiens; identical to SEQ ID NO: 216094

SEQ ID NO: 617935 - RNA, 64 nt, Homo Sapiens; identical to SEQ ID NO: 216095

SEQ ID NO: 617936 - RNA, 64 nt, Homo Sapiens; identical to SEQ ID NO: 216096

SEQ ID NO: 617937 - RNA, 64 nt, Homo Sapiens; identical to SEQ ID NO: 216097

SEQ ID NO: 617938 - RNA, 64 nt, Homo Sapiens; identical to SEQ ID NO: 216098

SEQ ID NO: 617939 - RNA, 64 nt, Homo Sapiens; identical to SEQ ID NO: 216099

SEQ ID NO: 617940 - RNA, 64 nt, Homo Sapiens; identical to SEQ ID NO: 216100

SEQ ID NO: 617941 - RNA, 64 nt, Homo Sapiens; identical to SEQ ID NO: 216101

SEQ ID NO: 617942 - RNA, 64 nt, Homo Sapiens; identical to SEQ ID NO: 216102

SEQ ID NO: 617943 - RNA, 64 nt, Homo Sapiens; identical to SEQ ID NO: 216103

SEQ ID NO: 617944 - RNA, 64 nt, Homo Sapiens; identical to SEQ ID NO: 216104

SEQ ID NO: 617945 - RNA, 64 nt, Homo Sapiens; identical to SEQ ID NO: 216105

SEQ ID NO: 617946 - RNA, 64 nt, Homo Sapiens; identical to SEQ ID NO: 216106

SEQ ID NO: 617947 - RNA, 64 nt, Homo Sapiens; identical to SEQ ID NO: 216107

SEQ ID NO: 617948 - RNA, 64 nt, Homo Sapiens; identical to SEQ ID NO: 216108

SEQ ID NO: 617949 - RNA, 64 nt, Homo Sapiens; identical to SEQ ID NO: 216109

SEQ ID NO: 617950 - RNA, 64 nt, Homo Sapiens; identical to SEQ ID NO: 216110

SEQ ID NO: 617951 - RNA, 64 nt, Homo Sapiens; identical to SEQ ID NO: 216111

SEQ ID NO: 617952 - RNA, 64 nt, Homo Sapiens; identical to SEQ ID NO: 216112

SEQ ID NO: 617953 - RNA, 64 nt, Homo Sapiens; identical to SEQ ID NO: 216113

SEQ ID NO: 617954 - RNA, 64 nt, Homo Sapiens; identical to SEQ ID NO: 216114

SEQ ID NO: 617955 - RNA, 64 nt, Homo Sapiens; identical to SEQ ID NO: 216115

SEQ ID NO: 617956 - RNA, 64 nt, Homo Sapiens; identical to SEQ ID NO: 216116

SEQ ID NO: 617957 - RNA, 64 nt, Homo Sapiens; identical to SEQ ID NO: 216117

SEQ ID NO: 617958 - RNA, 64 nt, Homo Sapiens; identical to SEQ ID NO: 216118

SEQ ID NO: 617959 - RNA, 64 nt, Homo Sapiens; identical to SEQ ID NO: 216119

SEQ ID NO: 617960 - RNA, 64 nt, Homo Sapiens; identical to SEQ ID NO: 216120

SEQ ID NO: 617961 - RNA, 64 nt, Homo Sapiens; identical to SEQ ID NO: 216121

SEQ ID NO: 617962 - RNA, 64 nt, Homo Sapiens; identical to SEQ ID NO: 216121

SEQ ID NO: 617963 - RNA, 64 nt, Homo Sapiens; identical to SEQ ID NO: 216123

SEQ ID NO: 617964 - RNA, 64 nt, Homo Sapiens; identical to SEQ ID NO: 216124

SEQ ID NO: 617965 - RNA, 64 nt, Homo Sapiens; identical to SEQ ID NO: 216125

SEQ ID NO: 617966 - RNA, 64 nt, Homo Sapiens; identical to SEQ ID NO: 216126

SEQ ID NO: 617967 - RNA, 64 nt, Homo Sapiens; identical to SEQ ID NO: 216127

SEQ ID NO: 617968 - RNA, 64 nt, Homo Sapiens; identical to SEQ ID NO: 216128

SEQ ID NO: 617969 - RNA, 64 nt, Homo Sapiens; identical to SEQ ID NO: 216129

SEQ ID NO: 617970 - RNA, 64 nt, Homo Sapiens; identical to SEQ ID NO: 216130

SEQ ID NO: 617971 - RNA, 64 nt, Homo Sapiens; identical to SEQ ID NO: 216131

SEQ ID NO: 617972 - RNA, 64 nt, Homo Sapiens; identical to SEQ ID NO: 216132

SEQ ID NO: 617973 - RNA, 64 nt, Homo Sapiens; identical to SEQ ID NO: 216133

SEQ ID NO: 617974 - RNA, 64 nt, Homo Sapiens; identical to SEQ ID NO: 216134

SEQ ID NO: 617975 - RNA, 64 nt, Homo Sapiens; identical to SEQ ID NO: 216135

SEQ ID NO: 617976 - RNA, 64 nt, Homo Sapiens; identical to SEQ ID NO: 216136

SEQ ID NO: 617977 - RNA, 64 nt, Homo Sapiens; identical to SEQ ID NO: 216137

SEQ ID NO: 617978 - RNA, 64 nt, Homo Sapiens; identical to SEQ ID NO: 216138

SEQ ID NO: 617979 - RNA, 64 nt, Homo Sapiens; identical to SEQ ID NO: 216139

SEQ ID NO: 617980 - RNA, 64 nt, Homo Sapiens; identical to SEQ ID NO: 216140

SEQ ID NO: 617981 - RNA, 64 nt, Homo Sapiens; identical to SEQ ID NO: 216141

SEQ ID NO: 617982 - RNA, 64 nt, Homo Sapiens; identical to SEQ ID NO: 216142

SEQ ID NO: 617983 - RNA, 64 nt, Homo Sapiens; identical to SEQ ID NO: 216143

SEQ ID NO: 617984 - RNA, 64 nt, Homo Sapiens
agaccagccuggccaauaugaugaaaccccgucucuacuaaaaauacaaaauuagucggguaug

SEQ ID NO: 617985 - RNA, 64 nt, Homo Sapiens
agaccagccuggccaacauggugaaaccccgucucuacuaaaaauacaaaaaguagccaggcgu

SEQ ID NO: 617986 - RNA, 64 nt, Homo Sapiens
agaacauccuggcuaacacggugaaacuccaucucuacuaaaaauacaaaaaauuggccgggcg

SEQ ID NO: 617987 - RNA, 64 nt, Homo Sapiens
agaucauccuggccaacauggugacaccccgucucuacuaaaaauacaaaaauuacccaggcau

SEQ ID NO: 617988 - RNA, 64 nt, Homo Sapiens
aaccacccugggcaacauggugaaacccccgucucuacuaaaauacaaaaaaauuagccaggca

SEQ ID NO: 617989 - RNA, 64 nt, Homo Sapiens
acugccaggugacgcccucgcugcuccuaccuggcuacuaaacaucgacuucgguucacuucac

SEQ ID NO: 617990 - RNA, 64 nt, Homo Sapiens
uacaaaaaaaauuagccagcgugaaacccugucucuacuaaaaaagaccauccuggcuaacaug

SEQ ID NO: 617991 - RNA, 64 nt, Homo Sapiens
aaauacaaaaaaauuagccagugaaaccccgucucuacuaaaaaagaccauccuggcgaacacg

SEQ ID NO: 617992 - RNA, 64 nt, Homo Sapiens
uacaaaaauuagccuggcaugcgaaaccccaucucuacuaaaaaagaccagccugaccaacaug

SEQ ID NO: 617993 - RNA, 64 nt, Homo Sapiens
acaaaaaauuauccaggcauaugaaacuccgucucuacuaaaauagaucagucugggcaacacg

SEQ ID NO: 617994 - RNA, 64 nt, Homo Sapiens
uacagaauuagucaggcguggagaaaccccgucucuacuaaaaaagaccagccugaccaacacg

SEQ ID NO: 617995 - RNA, 64 nt, Homo Sapiens
uaagaaaaauuagcugggcgcugaaaccccgucucuacuaaaaaagaucaaccuggccaacaua

SEQ ID NO: 617996 - RNA, 64 nt, Homo Sapiens
uacaaaaauuagccaggcgugcaaaaccccgucucuacuaaaagagaccaaccuggucagcaug

SEQ ID NO: 617997 - RNA, 64 nt, Homo Sapiens
auuaaggaaugcugaugaacaauuuugcuaucgacuacuaaaugagagauuuucagaccccugg

SEQ ID NO: 617998 - RNA, 64 nt, Homo Sapiens
agaccagccuggccaacauggcaaaaccacaucucuacuaaaaauaaaaaaauuagcugggugu

SEQ ID NO: 617999 - RNA, 64 nt, Homo Sapiens
cucacuggcugaaggaggaaauuuuagaaggaagcuacuaaaagaucuaauuugaaaaacuaca

SEQ ID NO: 618000 - RNA, 64 nt, Homo Sapiens
uacaaaaauuagccaggugugugaaacccugucucuacuaaaaaagaccagccuggccaacaug

SEQ ID NO: 618001 - RNA, 64 nt, Homo Sapiens
uacaaaaaauuagccaggcggugaaaccccgucucuacuaaaaaagaccauccuggcuaacaug

SEQ ID NO: 618002 - RNA, 64 nt, Homo Sapiens
agaccagccugacuaacauggugaaaucccgucucuacuaaaaauacaaaaaaaaaaaaaaaaa

SEQ ID NO: 618003 - RNA, 64 nt, Homo Sapiens
agaccauccuggccaacauggugaaauccugccucuacuaaaaauacaaaaaaaaaaaaaaauu

SEQ ID NO: 618004 - RNA, 64 nt, Homo Sapiens
agaucagccuggccaacauggugaaaccccaucucuacuaaaaauacaaaaauuagccggacgc

SEQ ID NO: 618005 - RNA, 64 nt, Homo Sapiens
agaucauccuggccaacauggugaaacccugucucuacuaaaaauacaaaaaugagcugggcau

SEQ ID NO: 618006 - RNA, 64 nt, Homo Sapiens
uacaaaaauauuagccgggcgagaaaccccgucucuacuaaaaaagaccagccugaccaacaug

SEQ ID NO: 618007 - RNA, 64 nt, Homo Sapiens
uacaaaaauuagcugggugugugagaccccaacucuacuaaaaaagaucacccuggcccacaug

SEQ ID NO: 618008 - RNA, 64 nt, Homo Sapiens
auagcaggggacuuuggcacccuuugaauugugccuacuaaauugccuuugaauaugcagacaa

SEQ ID NO: 618009 - RNA, 64 nt, Homo Sapiens
gaaggcccugggcucugauuggaagcacacucuacuacuaaagguaaaguaaaccucuucccgu

SEQ ID NO: 618010 - RNA, 64 nt, Homo Sapiens
agaccauccuggcuaacacggugaaaccccgucucuacuaaaaauacaaaaaaaauuagucgga

SEQ ID NO: 618011 - RNA, 64 nt, Homo Sapiens
aauaugauuuuaugugaagugccauuucuuuauucuacuaaagagagacagcagaaauaaagau

SEQ ID NO: 618012 - RNA, 64 nt, Homo Sapiens
ugagaccagccuggccaacauggcaaaaccaucucuacuaaaaauagaaaaauuagccaggcac

SEQ ID NO: 618013 - RNA, 64 nt, Homo Sapiens
aggaguuucagaccaauauggugaaaccccaucucuacuaaaauuacaaaaaaaauuauccagg

SEQ ID NO: 618014 - RNA, 64 nt, Homo Sapiens
gucuugguaauugcaauuuaacuaggugcgguggcuacuaaaguucgaaggcacgauaugcgug

SEQ ID NO: 618015 - RNA, 64 nt, Homo Sapiens
uaaaucuucuauuauuauguacuaugauuuauuccuacuaaaacauaaauuagucaauuugggg

SEQ ID NO: 618016 - RNA, 64 nt, Homo Sapiens
uguaccauuuuuuaaauuguucacaauucauuuucuacuaaauggauguugcuagugcaguguu

SEQ ID NO: 618017 - RNA, 64 nt, Homo Sapiens
uacaaaaauuagcugggcgugugaaaccccaucucuacuaaaaaagggcagccugaccaacaua

SEQ ID NO: 618018 - RNA, 64 nt, Homo Sapiens
uacaaaaauuagccaggcgugugaaaccuugucucuacuaaaaaagaccagccuggccaacaug

SEQ ID NO: 618019 - RNA, 64 nt, Homo Sapiens
uacaaaaguagccgggcguggagaaacccuaucucuacuaaaaaagaccagccugaccaacacg

SEQ ID NO: 618020 - RNA, 64 nt, Homo Sapiens
uacaaaaauuagccgggcaugugaaaccccgucucuacuaaaaaagacuagccuggccaacaug

SEQ ID NO: 618021 - RNA, 64 nt, Homo Sapiens
ucaaaaacaaaauuagccgggcaagaccucaucucuacuaaaauagaccaggcugggcaucaua

SEQ ID NO: 618022 - RNA, 64 nt, Homo Sapiens
uaccaaaaauuagccgagcgugaaacccccaucucuacuaaaaagaccagccuguccaacaugg

SEQ ID NO: 618023 - RNA, 64 nt, Homo Sapiens
uacaaaaauuagcugggcaugugaaaccccgucucuacuaaaaaagaccauccuggccaacaug

SEQ ID NO: 618024 - RNA, 64 nt, Homo Sapiens
uacaaaaauucacagggugugcaaaaucccaucucuacuaaaaaagaccagccuggccaacaug

SEQ ID NO: 618025 - RNA, 64 nt, Homo Sapiens
uagaaaaaucagcugggugugugaaaccccaucucuacuaaaaaagaccauccugaccaacgug

SEQ ID NO: 618026 - RNA, 64 nt, Homo Sapiens
agaccagccuggucaagauggugaaaccccaucucuacuaaaauuacaaaaauuagccgggugu

SEQ ID NO: 618027 - RNA, 64 nt, Homo Sapiens
aaaccagccuggccaacauggugaaaccccaucucuacuaaaaaaacaaaacuagcugggggug

SEQ ID NO: 618028 - RNA, 64 nt, Homo Sapiens
auacagaaauuagcuggguggcaaaaccccgucucuacuaaaaaagaccagccuggccaacaug

SEQ ID NO: 618029 - RNA, 64 nt, Homo Sapiens
uacaaaaauuagcuuggcaugcgaaaccccaucucuacuaaaaaagaccagccugaccaacaug

SEQ ID NO: 618030 - RNA, 64 nt, Homo Sapiens
uacaaaaugagcugggcguggagaaaccccaucucuacuaaaaaagaccagccugacuaacaug

SEQ ID NO: 618031 - RNA, 64 nt, Homo Sapiens
acaaaaaauuagcugggugugugaaaccccgucucuacuaaaauagaccauccuggccaacaug

SEQ ID NO: 618032 - RNA, 64 nt, Homo Sapiens
agaccagucuggccaacauggggaaaccccgucucuacuaaaaauacaaaaauuagccgggcau

SEQ ID NO: 618033 - RNA, 64 nt, Homo Sapiens
agaccagccuggccaauguggugaaaccccaucucuacuaaaaauacaaaaauuagcugggcgu

SEQ ID NO: 618034 - RNA, 64 nt, Homo Sapiens
agaccagccuggccaacacggugaaaccccgccucuacuaaaaauacaaaaaauagccgggugu

SEQ ID NO: 618035 - RNA, 64 nt, Homo Sapiens
agaccagccuggucaacguggugaaacgccguuucuacuaaaaauaugaaaauuaguugggugu

SEQ ID NO: 618036 - RNA, 64 nt, Homo Sapiens
ugaagugucuccccaacacuagcaaaucuagguccuacuaaauacaaaucucuggguggaugau

SEQ ID NO: 618037 - RNA, 64 nt, Homo Sapiens
gaccagccugacaaaacauagugaaaccccgucucuacuaaaaauacaaaaauuagcugggcgu

SEQ ID NO: 618038 - RNA, 64 nt, Homo Sapiens
ugcaaaaauuaccugggcaugugaaaccccaucucuacuaaacaagaccagccuggccaacaug

SEQ ID NO: 618039 - RNA, 64 nt, Homo Sapiens
acaaaaaaauagggcugggcgugaaacgcugucucuacuaaaauagaccagccuggccaacgug

SEQ ID NO: 618040 - RNA, 64 nt, Homo Sapiens
uuuuaagaaaacauguggccuuuuauuaauaacacuacuaaauuuugguuccuccauagaauua

SEQ ID NO: 618041 - RNA, 64 nt, Homo Sapiens
agaccauccuggccaacauggugaaacccugucucuacuaaaaauacaaaaauagcugggcaug

SEQ ID NO: 618042 - RNA, 64 nt, Homo Sapiens
agaccagccuggguaauauggcaagagcccaacucuacuaaaaauacaaaaagaaaagaaaaca

SEQ ID NO: 618043 - RNA, 64 nt, Homo Sapiens
aaaaaaauagacaaaaauuagugaaaccccgucucuacuaaaaaagaccagacuggccaacaug

SEQ ID NO: 618044 - RNA, 64 nt, Homo Sapiens
uacaaaaaauuagccgggcggugaaaccccgucucuacuaaaaaagacccuccuggcuaacacc

SEQ ID NO: 618045 - RNA, 64 nt, Homo Sapiens
aaaauacaaaaauuagccgggugaaaccccaucucuacuaaaaaagaccagccuggccaacacg

SEQ ID NO: 618046 - RNA, 64 nt, Homo Sapiens
aaaaaaaaaaauuagucggggugaaaccccaucucuacuaaaaaagaccagccuggccaacaug

SEQ ID NO: 618047 - RNA, 64 nt, Homo Sapiens
uuagcggggugugguggcgggugaaacccugucucuacuaaauaaaaccagccugaccaacaug

SEQ ID NO: 618048 - RNA, 64 nt, Homo Sapiens
uauagaauuagccaggcauggugaaacccuaucucuacuaaaaaagaucagccugaccaacaug

SEQ ID NO: 618049 - RNA, 64 nt, Homo Sapiens
uauaaaaaauuagcugggcagugaaaccccaucgcuacuaaaaaagaccagccuggccaacaug

SEQ ID NO: 618050 - RNA, 64 nt, Homo Sapiens
uacaaaaaaaaaaaaaaaacgugaaaccccgucucuacuaaaaaagaccaucauugcuaacaug

SEQ ID NO: 618051 - RNA, 64 nt, Homo Sapiens
uacaaaauuagccaggcguggagaaacccugucucuacuaaaaaagaccagccugaccaacaug

SEQ ID NO: 618052 - RNA, 64 nt, Homo Sapiens
aaacauacuccuaaaaacauuuuccgggauuuuacuacuaaaauuggacauuuaagcgaaguaa

SEQ ID NO: 618053 - RNA, 64 nt, Homo Sapiens
agaccagccuggccaacauggcgaaaccccaucucuacuaaaaauacaaaaauuagccgggcgu

SEQ ID NO: 618054 - RNA, 64 nt, Homo Sapiens
agaccagccuggccaauauggugaaaccccaucucuacuaaaaauauaaaaaucagcaaaaaaa

SEQ ID NO: 618055 - RNA, 64 nt, Homo Sapiens
gcugccaagggguuaaaauugggaaccuaaguugcuacuaaaucauaguucaaaaccuaauaau

SEQ ID NO: 618056 - RNA, 64 nt, Homo Sapiens
acacagcucuugggaguacaguucucuacguucucuacuaaaucuuaauaaaugcuugacauag

SEQ ID NO: 618057 - RNA, 64 nt, Homo Sapiens
agacccuccuggccaacauggugaaaccccgucucuacuaaaauacaaaaaauuagcugggcau

SEQ ID NO: 618058 - RNA, 64 nt, Homo Sapiens
agaccacccugaccaacuuggugaaaucccaucucuacuaaaaauacaaaaauuagcugggugc

SEQ ID NO: 618059 - RNA, 64 nt, Homo Sapiens
agaccauccugucuaacacggugaaaccccaucucuacuaaaaauacaaaaaaauuagucggac

SEQ ID NO: 618060 - RNA, 64 nt, Homo Sapiens
agaccagccuggccaacauggugaaaccccaucucuacuaaaaauacaaaaauuagcuaggcgg

SEQ ID NO: 618061 - RNA, 64 nt, Homo Sapiens
auacaaaaauuagccaggcagugaaaccccaucucuacuaaaaaagaccagccuggccaacaug

SEQ ID NO: 618062 - RNA, 64 nt, Homo Sapiens
acauaaauuagccgggugugugagaccuccgucucuacuaaaaugaccagccuggccaacauga

SEQ ID NO: 618063 - RNA, 64 nt, Homo Sapiens
aaaaauuagccaggcauggugugaaaccccaucucuacuaaaacagaccacccuggccaacaug

SEQ ID NO: 618064 - RNA, 64 nt, Homo Sapiens
uacagaaauuagccgggcaugugaaaccccaucucuacuaaaaaagaccagccuggccaacaua

SEQ ID NO: 618065 - RNA, 64 nt, Homo Sapiens
uacaaaaauuagccgggcauaugaaacccuaucucuacuaaaaaagaccauccuggccaacaug

SEQ ID NO: 618066 - RNA, 64 nt, Homo Sapiens
uacaaaaaccaaaaaaaauugugaaaccccaucucuacuaaaaaagaccauccuggcuaacacg

SEQ ID NO: 618067 - RNA, 64 nt, Homo Sapiens
uacaaaaguuagccgggggggugaaaccccaucucuacuaaaaaagagcacccuggcuaacaug

SEQ ID NO: 618068 - RNA, 64 nt, Homo Sapiens
uauaaaauauuagccaggcggugaaaccccaucucuacuaaaaaagaccguccuggcuaacacg

SEQ ID NO: 618069 - RNA, 64 nt, Homo Sapiens
ccugucagguggucugcaaagaugauaaccuugacuacuaaaaacgucuccauggcggggguaa

SEQ ID NO: 618070 - RNA, 64 nt, Homo Sapiens
agaccagucuggccaacauagcaaaacccugucucuacuaaaaauacaaaaauuaucugggcau

SEQ ID NO: 618071 - RNA, 64 nt, Homo Sapiens
uacaaaaauuagcugggcgugugaaaccccaucucuacuaaaaaagaccagccuggccaacaug

SEQ ID NO: 618072 - RNA, 64 nt, Homo Sapiens
acaaaaauuagccgggcguggcaaaaccucaucucuacuaaaaugaacuggccuggccaacaua

SEQ ID NO: 618073 - RNA, 64 nt, Homo Sapiens
uauaaaaauuagcugggugugugaaaccccgucucuacuaaaaaagaccauccuggccaacaug

SEQ ID NO: 618074 - RNA, 64 nt, Homo Sapiens
uaugaaaauuagcugggcuugcaaaaccccgucucuacuaaaaaagaccagccuggccaacaag

SEQ ID NO: 618075 - RNA, 64 nt, Homo Sapiens
uacaagaaacuagccagauggugaaaccucgugucuacuaaaaacagccuggccaaccaacaug

SEQ ID NO: 618076 - RNA, 64 nt, Homo Sapiens
uacaaaaauuagccaggacugcgaaaccccgucucuacuaaaaaagaccagccuggccaacaug

SEQ ID NO: 618077 - RNA, 64 nt, Homo Sapiens
ugugccaguaaucccagcuacuugggaggcugaggcgcgagaaucgcuugaacccuggagaugg

SEQ ID NO: 618078 - RNA, 64 nt, Homo Sapiens
ccgaccacggcgaagcaauagagggggugcuggagcgcgagaggcuggcugauugugaccgaaa

SEQ ID NO: 618079 - RNA, 64 nt, Homo Sapiens
uuuuucuuaggaaagaaaaaccuccugaauauuugcgcgagacucuuaaagugaugauuucaaa

SEQ ID NO: 618080 - RNA, 64 nt, Homo Sapiens
guauccccaacugggacuuccaggcguaccuggugcgcgagagcgaaaaaccacaaagaaacac

SEQ ID NO: 618081 - RNA, 64 nt, Homo Sapiens
gaucaagacccaaguuuugagaaagagagagagagcgcgagagauucuagagacaauggagaga

SEQ ID NO: 618082 - RNA, 64 nt, Homo Sapiens
uagguccucccacaccugcccccuaauaaagugggcgcgagaggaggcugcuguguguuuccug

SEQ ID NO: 618083 - RNA, 64 nt, Homo Sapiens
agaagugaauacccccaggaggacauuuugagcagcgcgagaguugauucaggcuggacagccu

SEQ ID NO: 618084 - RNA, 64 nt, Homo Sapiens
cgcuggaggcccggugugguuccgccucggcgaggcgcgagacaggcgcugcugcucacgugga

SEQ ID NO: 618085 - RNA, 64 nt, Homo Sapiens
uguauguggugugcacauguggccagaggugugugcgcgagaccgacacugugaucccugugcu

SEQ ID NO: 618086 - RNA, 64 nt, Homo Sapiens
ucucgcguggagggcugucguuugaacucucccagcgcgagagacccugccccgcccccuuccu

SEQ ID NO: 618087 - RNA, 64 nt, Homo Sapiens
uggguguacagguggguuugggagagaggagcaugcgcgagagagucuccgagugugugcgacg

SEQ ID NO: 618088 - RNA, 64 nt, Homo Sapiens
cccguuccguaggcaauaacgugcguccgccucagcgcgagauuaggaguucaaacaaugguga

SEQ ID NO: 618089 - RNA, 64 nt, Homo Sapiens
cccugcagccacgcaccucccggugagaagcagagcgcgagagggagcccuccguaacugccca

SEQ ID NO: 618090 - RNA, 64 nt, Homo Sapiens
ggcuuccccagccugcggccgcaagcaaaaccaagcgcgagaugcagcuagcacccuucauauc

SEQ ID NO: 618091 - RNA, 59 nt, Homo Sapiens
acccccuccacggccuggacagaaugcagcggagcuaggcacgugcccacuugggaugc

SEQ ID NO: 618092 - RNA, 59 nt, Homo Sapiens
accgcagcagccacuauaaaauauagucucggagcuacaguccuuccucacccccucca

SEQ ID NO: 618093 - RNA, 59 nt, Homo Sapiens
ucccugcccucacacccuguagugaucuccggagcuagugccccaacucggaguccucc

SEQ ID NO: 618094 - RNA, 59 nt, Homo Sapiens
gcacuagccugacuuuuaagagaggccaccggagcuaggacugucaaggccucauuugc

SEQ ID NO: 618095 - RNA, 59 nt, Homo Sapiens
uuauauaaauauagauauaauuuuauuuucggagcuaagaugguguuauuuaagggugg

SEQ ID NO: 618096 - RNA, 59 nt, Homo Sapiens
gaauugugagucugccccucaggggaauucggagcuagaggacauggaaaauaaagcca

SEQ ID NO: 618097 - RNA, 59 nt, Homo Sapiens
uaaacaaaaccuuugggugguaaugacuacggagcuaaaguuggggugacaaggauggg

SEQ ID NO: 618098 - RNA, 59 nt, Homo Sapiens
gcauccucucuccaggucugcucccuuaccggagcuaggauaagguagcaugagugaca

SEQ ID NO: 618099 - RNA, 59 nt, Homo Sapiens
acuuuggguacugcggacagagcucaucacggagcuacgguguggcugggcuacaucau

SEQ ID NO: 618100 - RNA, 59 nt, Homo Sapiens
cauaugugcagaagguuacugaggaaauucggagcuauauuuugcaccagacgaacagu

SEQ ID NO: 618101 - RNA, 59 nt, Homo Sapiens
ggaggaccgagggguugggggccuucuaccggagcuacaccacgcagcugaccaugaac

SEQ ID NO: 618102 - RNA, 59 nt, Homo Sapiens
agaagacaaggcauguagggggaguucagcggagcuagcgaacaugaaagaaauaaaca

SEQ ID NO: 618103 - RNA, 59 nt, Homo Sapiens
aagugcccuugcaagagccuuuaacuuggcggagcuaaggagaucuuauucuaccaugg

SEQ ID NO: 618104 - RNA, 59 nt, Homo Sapiens
ugcagccggaggguccuaagaauggcucccggagcuaacugagggcccagccuuuuuuc

SEQ ID NO: 618105 - RNA, 59 nt, Homo Sapiens
ugaaacuucugcucuugcuaccucugacucggagcuacuugcucucugaggcagccgcg

SEQ ID NO: 618106 - RNA, 59 nt, Homo Sapiens
aagcucuggaaauccucaccaaagcccuccggagcuaccaguuagggaucggcagggac

SEQ ID NO: 618107 - RNA, 59 nt, Homo Sapiens
ucggcccagccccagccugccggagcccacggagcuaccucuaccuccacuccugccac

SEQ ID NO: 618108 - RNA, 59 nt, Homo Sapiens
gagaggacugggccugauggaaguuaacccggagcuaagucacccagagcacaggagcu

SEQ ID NO: 618109 - RNA, 59 nt, Homo Sapiens
agaugguguccucggauaaugaucugccccggagcuagggcagcaacaugaggaccaaa

SEQ ID NO: 618110 - RNA, 59 nt, Homo Sapiens
agggcuggagggaagggcacaggggcgcccggagcuaagauguggugcuuuucuugguu

SEQ ID NO: 618111 - RNA, 59 nt, Homo Sapiens
aggcgcgagcagagaacgugcccacccugcggagcuagggugccugcgaggccaaguug

SEQ ID NO: 618112 - RNA, 59 nt, Homo Sapiens
ugagacagcuccagcuucgcagcccuucccggagcuacagggggauccucuagcauggg

SEQ ID NO: 618113 - RNA, 59 nt, Homo Sapiens
gacagccugggccucuaacagcuuuuguccggagcuagacuucguguccuuucaguugg

SEQ ID NO: 618114 - RNA, 59 nt, Homo Sapiens
uaaagauuuuggaauaaauauguuugcugcggagcuauuacggaccuugugauuuguac

SEQ ID NO: 618115 - RNA, 59 nt, Homo Sapiens
gagcggauguggugggcugguggccucgccggagcuaggcaugccgcuuggagaagggg

SEQ ID NO: 618116 - RNA, 59 nt, Homo Sapiens
acaagagcuucugggaagguaagcggcaucggagcuagaucacguuucacaauuagugg

SEQ ID NO: 618117 - RNA, 59 nt, Homo Sapiens
uuuuguuuuuaacaaauccccuccuuaaacggagcuauaagguggccaaaucugagaac

SEQ ID NO: 618118 - RNA, 59 nt, Homo Sapiens
gucugcugcccuccaucccgacauggacccggagcuaacacuggccccuagaaucagcc

SEQ ID NO: 618119 - RNA, 59 nt, Homo Sapiens
ggucacauugauaguugauuuacuuguggcggagcuaaugccuggauccugucgaucuu

SEQ ID NO: 618120 - RNA, 59 nt, Homo Sapiens
ucacguuucacaauuaguggaagcggcaucggagcuagaacaagagcuucugggaaggu

SEQ ID NO: 618121 - RNA, 59 nt, Homo Sapiens
ucagccuucaggccugagcaagugcagggcggagcuaccagcccaggcucagauguugg

SEQ ID NO: 618122 - RNA, 59 nt, Homo Sapiens
uuuugcagggcucaguacgacaggaccugcggagcuacgacccaccucgcucccagccc

SEQ ID NO: 618123 - RNA, 59 nt, Homo Sapiens
guguucagcucggcugugacuccaggugucggagcuaagcugucauucucuagaacaca

SEQ ID NO: 618124 - RNA, 59 nt, Homo Sapiens
ggggcauuuucuucccuaaaguuccccgccggagcuacaccuuugcugaccguuuuggg

SEQ ID NO: 618125 - RNA, 59 nt, Homo Sapiens
gcuggagcucugcccaggugcccccgaugcggagcuaggagcucaucccucccuccaag

SEQ ID NO: 618126 - RNA, 64 nt, Homo Sapiens; identical to SEQ ID NO: 310683

SEQ ID NO: 618127 - RNA, 64 nt, Homo Sapiens; identical to SEQ ID NO: 310684

SEQ ID NO: 618128 - RNA, 64 nt, Homo Sapiens
cccaggaggcauuccacacaggcacugccccaggacaacacaacaaggacagucacaacaagga

SEQ ID NO: 618129 - RNA, 64 nt, Homo Sapiens
caacaaggacagucacaacaaggacaacaaggacacaacacaacacacaacaaggacagucaca

SEQ ID NO: 618130 - RNA, 64 nt, Homo Sapiens
aggacagucacaacaaggacaacaaggacacaacacaacacacaacaaggacagucacaacaag

SEQ ID NO: 618131 - RNA, 64 nt, Homo Sapiens
cgcugcuguaucucccugugcaccaaccagaugaacaacacacacaagugcugucuaccaucaa

SEQ ID NO: 618132 - RNA, 64 nt, Homo Sapiens
uucacccaccgccuccuggcaaggagaagccucaacaacacaacaacaauaucagcggauucgg

SEQ ID NO: 618133 - RNA, 64 nt, Homo Sapiens
auugguugacaaauugaagcgaaacugguggacaacaacacagcaucaaguuaaugaaaaugga

SEQ ID NO: 618134 - RNA, 64 nt, Homo Sapiens
acccuaucucaagaacuugugaggaagcacugaaacaacacaaaauguguguuuuccgcagcgg

SEQ ID NO: 618135 - RNA, 64 nt, Homo Sapiens
cccaugauucaauuaccucccccgggucccucccacaacacaugggaauucugagagauaccau

SEQ ID NO: 618136 - RNA, 64 nt, Homo Sapiens
acugccaaguuaguauuguuagagauuucauuuuacaacacaaaaauaagccugugucaaagau

SEQ ID NO: 618137 - RNA, 64 nt, Homo Sapiens
ccaugccaggagagaacccacgcacaugcacaccacaacacacaacacaccucaccucacacca

SEQ ID NO: 618138 - RNA, 64 nt, Homo Sapiens
aggagagaacccacgcacaugcacaccacaacacacaacacaccucaccucacaccacagcaca

SEQ ID NO: 618139 - RNA, 64 nt, Homo Sapiens
ccacaucucaccacaccacagcacaccucaccacacaacacaccacaccccacaccgcacugca

SEQ ID NO: 618140 - RNA, 64 nt, Homo Sapiens
uuuguuuugucuaaaguguggcaagacauagugcacaacacagggacaaaggcagguuuccugc

SEQ ID NO: 618141 - RNA, 64 nt, Homo Sapiens
ugguacagauucauguuucugauuuaaaaaaacaacaacacaggauugaauuaaguagaguaau

SEQ ID NO: 618142 - RNA, 64 nt, Homo Sapiens
caccuuuucugugaacaggcuaauacagugcuggacaacacauugcaagugacuagacucgcgc

SEQ ID NO: 618143 - RNA, 64 nt, Homo Sapiens
acaauugcccuuuaccuagggaccccaaaugaccacaacacagucacaucucaguauauguagg

SEQ ID NO: 618144 - RNA, 64 nt, Homo Sapiens; identical to SEQ ID NO: 364007

SEQ ID NO: 618145 - RNA, 64 nt, Homo Sapiens; identical to SEQ ID NO: 364008

SEQ ID NO: 618146 - RNA, 64 nt, Homo Sapiens; identical to SEQ ID NO: 364009

SEQ ID NO: 618147 - RNA, 64 nt, Homo Sapiens; identical to SEQ ID NO: 364010

SEQ ID NO: 618148 - RNA, 64 nt, Homo Sapiens; identical to SEQ ID NO: 364011

SEQ ID NO: 618149 - RNA, 64 nt, Homo Sapiens; identical to SEQ ID NO: 364012

SEQ ID NO: 618150 - RNA, 64 nt, Homo Sapiens; identical to SEQ ID NO: 364013

SEQ ID NO: 618151 - RNA, 64 nt, Homo Sapiens; identical to SEQ ID NO: 364014

SEQ ID NO: 618152 - RNA, 64 nt, Homo Sapiens; identical to SEQ ID NO: 364015

SEQ ID NO: 618153 - RNA, 64 nt, Homo Sapiens; identical to SEQ ID NO: 364016

SEQ ID NO: 618154 - RNA, 64 nt, Homo Sapiens; identical to SEQ ID NO: 364017

SEQ ID NO: 618155 - RNA, 64 nt, Homo Sapiens; identical to SEQ ID NO: 364018

SEQ ID NO: 618156 - RNA, 64 nt, Homo Sapiens; identical to SEQ ID NO: 364019

SEQ ID NO: 618157 - RNA, 64 nt, Homo Sapiens; identical to SEQ ID NO: 364020

SEQ ID NO: 618158 - RNA, 64 nt, Homo Sapiens; identical to SEQ ID NO: 364021

SEQ ID NO: 618159 - RNA, 64 nt, Homo Sapiens; identical to SEQ ID NO: 364022

SEQ ID NO: 618160 - RNA, 64 nt, Homo Sapiens; identical to SEQ ID NO: 364023

SEQ ID NO: 618161 - RNA, 64 nt, Homo Sapiens; identical to SEQ ID NO: 364024

SEQ ID NO: 618162 - RNA, 64 nt, Homo Sapiens; identical to SEQ ID NO: 364025

SEQ ID NO: 618163 - RNA, 64 nt, Homo Sapiens; identical to SEQ ID NO: 364026

SEQ ID NO: 618164 - RNA, 64 nt, Homo Sapiens; identical to SEQ ID NO: 364027

SEQ ID NO: 618165 - RNA, 64 nt, Homo Sapiens; identical to SEQ ID NO: 364028

SEQ ID NO: 618166 - RNA, 64 nt, Homo Sapiens; identical to SEQ ID NO: 364029

SEQ ID NO: 618167 - RNA, 64 nt, Homo Sapiens; identical to SEQ ID NO: 364030

SEQ ID NO: 618168 - RNA, 64 nt, Homo Sapiens; identical to SEQ ID NO: 364031

SEQ ID NO: 618169 - RNA, 64 nt, Homo Sapiens; identical to SEQ ID NO: 364032

SEQ ID NO: 618170 - RNA, 64 nt, Homo Sapiens; identical to SEQ ID NO: 364033

SEQ ID NO: 618171 - RNA, 64 nt, Homo Sapiens; identical to SEQ ID NO: 364034

SEQ ID NO: 618172 - RNA, 64 nt, Homo Sapiens; identical to SEQ ID NO: 364035

SEQ ID NO: 618173 - RNA, 64 nt, Homo Sapiens; identical to SEQ ID NO: 364036

SEQ ID NO: 618174 - RNA, 64 nt, Homo Sapiens; identical to SEQ ID NO: 364037

SEQ ID NO: 618175 - RNA, 64 nt, Homo Sapiens; identical to SEQ ID NO: 364038

SEQ ID NO: 618176 - RNA, 64 nt, Homo Sapiens; identical to SEQ ID NO: 364039

SEQ ID NO: 618177 - RNA, 64 nt, Homo Sapiens; identical to SEQ ID NO: 364040

SEQ ID NO: 618178 - RNA, 64 nt, Homo Sapiens; identical to SEQ ID NO: 364041

SEQ ID NO: 618179 - RNA, 64 nt, Homo Sapiens; identical to SEQ ID NO: 364042

SEQ ID NO: 618180 - RNA, 64 nt, Homo Sapiens; identical to SEQ ID NO: 364043

SEQ ID NO: 618181 - RNA, 64 nt, Homo Sapiens; identical to SEQ ID NO: 364044

SEQ ID NO: 618182 - RNA, 64 nt, Homo Sapiens; identical to SEQ ID NO: 364045

SEQ ID NO: 618183 - RNA, 64 nt, Homo Sapiens; identical to SEQ ID NO: 364046

SEQ ID NO: 618184 - RNA, 64 nt, Homo Sapiens; identical to SEQ ID NO: 364047

SEQ ID NO: 618185 - RNA, 64 nt, Homo Sapiens; identical to SEQ ID NO: 364048

SEQ ID NO: 618186 - RNA, 64 nt, Homo Sapiens; identical to SEQ ID NO: 364049

SEQ ID NO: 618187 - RNA, 64 nt, Homo Sapiens; identical to SEQ ID NO: 364050

SEQ ID NO: 618188 - RNA, 64 nt, Homo Sapiens; identical to SEQ ID NO: 364051

SEQ ID NO: 618189 - RNA, 64 nt, Homo Sapiens; identical to SEQ ID NO: 364052

SEQ ID NO: 618190 - RNA, 64 nt, Homo Sapiens; identical to SEQ ID NO: 364053

SEQ ID NO: 618191 - RNA, 64 nt, Homo Sapiens; identical to SEQ ID NO: 364054

SEQ ID NO: 618192 - RNA, 64 nt, Homo Sapiens; identical to SEQ ID NO: 364055

SEQ ID NO: 618193 - RNA, 64 nt, Homo Sapiens; identical to SEQ ID NO: 364056

SEQ ID NO: 618194 - RNA, 64 nt, Homo Sapiens; identical to SEQ ID NO: 364057

SEQ ID NO: 618195 - RNA, 64 nt, Homo Sapiens; identical to SEQ ID NO: 364058

SEQ ID NO: 618196 - RNA, 64 nt, Homo Sapiens; identical to SEQ ID NO: 364059

SEQ ID NO: 618197 - RNA, 64 nt, Homo Sapiens; identical to SEQ ID NO: 364060

SEQ ID NO: 618198 - RNA, 64 nt, Homo Sapiens; identical to SEQ ID NO: 364061

SEQ ID NO: 618199 - RNA, 64 nt, Homo Sapiens; identical to SEQ ID NO: 364062

SEQ ID NO: 618200 - RNA, 64 nt, Homo Sapiens; identical to SEQ ID NO: 364063

SEQ ID NO: 618201 - RNA, 64 nt, Homo Sapiens; identical to SEQ ID NO: 364064

SEQ ID NO: 618202 - RNA, 64 nt, Homo Sapiens; identical to SEQ ID NO: 364065

SEQ ID NO: 618203 - RNA, 64 nt, Homo Sapiens; identical to SEQ ID NO: 364066

SEQ ID NO: 618204 - RNA, 64 nt, Homo Sapiens; identical to SEQ ID NO: 364067

SEQ ID NO: 618205 - RNA, 64 nt, Homo Sapiens; identical to SEQ ID NO: 364068

SEQ ID NO: 618206 - RNA, 64 nt, Homo Sapiens; identical to SEQ ID NO: 364069

SEQ ID NO: 618207 - RNA, 64 nt, Homo Sapiens; identical to SEQ ID NO: 364070

SEQ ID NO: 618208 - RNA, 64 nt, Homo Sapiens; identical to SEQ ID NO: 364071

SEQ ID NO: 618209 - RNA, 64 nt, Homo Sapiens; identical to SEQ ID NO: 364072

SEQ ID NO: 618210 - RNA, 64 nt, Homo Sapiens; identical to SEQ ID NO: 364073

SEQ ID NO: 618211 - RNA, 64 nt, Homo Sapiens; identical to SEQ ID NO: 364074

SEQ ID NO: 618212 - RNA, 64 nt, Homo Sapiens; identical to SEQ ID NO: 364075

SEQ ID NO: 618213 - RNA, 64 nt, Homo Sapiens; identical to SEQ ID NO: 364076

SEQ ID NO: 618214 - RNA, 64 nt, Homo Sapiens; identical to SEQ ID NO: 364077

SEQ ID NO: 618215 - RNA, 64 nt, Homo Sapiens; identical to SEQ ID NO: 364078

SEQ ID NO: 618216 - RNA, 64 nt, Homo Sapiens; identical to SEQ ID NO: 364079

SEQ ID NO: 618217 - RNA, 64 nt, Homo Sapiens; identical to SEQ ID NO: 364080

SEQ ID NO: 618218 - RNA, 64 nt, Homo Sapiens; identical to SEQ ID NO: 364081

SEQ ID NO: 618219 - RNA, 64 nt, Homo Sapiens; identical to SEQ ID NO: 364082

SEQ ID NO: 618220 - RNA, 64 nt, Homo Sapiens; identical to SEQ ID NO: 364083

SEQ ID NO: 618221 - RNA, 64 nt, Homo Sapiens; identical to SEQ ID NO: 364084

SEQ ID NO: 618222 - RNA, 64 nt, Homo Sapiens; identical to SEQ ID NO: 364085

SEQ ID NO: 618223 - RNA, 64 nt, Homo Sapiens; identical to SEQ ID NO: 364086

SEQ ID NO: 618224 - RNA, 64 nt, Homo Sapiens; identical to SEQ ID NO: 364087

SEQ ID NO: 618225 - RNA, 64 nt, Homo Sapiens; identical to SEQ ID NO: 364088

SEQ ID NO: 618226 - RNA, 64 nt, Homo Sapiens; identical to SEQ ID NO: 364089

SEQ ID NO: 618227 - RNA, 64 nt, Homo Sapiens; identical to SEQ ID NO: 364090

SEQ ID NO: 618228 - RNA, 64 nt, Homo Sapiens; identical to SEQ ID NO: 364091

SEQ ID NO: 618229 - RNA, 64 nt, Homo Sapiens; identical to SEQ ID NO: 364092

SEQ ID NO: 618230 - RNA, 64 nt, Homo Sapiens; identical to SEQ ID NO: 364093

SEQ ID NO: 618231 - RNA, 64 nt, Homo Sapiens; identical to SEQ ID NO: 364094

SEQ ID NO: 618232 - RNA, 64 nt, Homo Sapiens; identical to SEQ ID NO: 364095

SEQ ID NO: 618233 - RNA, 64 nt, Homo Sapiens; identical to SEQ ID NO: 364096

SEQ ID NO: 618234 - RNA, 64 nt, Homo Sapiens; identical to SEQ ID NO: 364097

SEQ ID NO: 618235 - RNA, 64 nt, Homo Sapiens; identical to SEQ ID NO: 364098

SEQ ID NO: 618236 - RNA, 64 nt, Homo Sapiens; identical to SEQ ID NO: 364099

SEQ ID NO: 618237 - RNA, 64 nt, Homo Sapiens; identical to SEQ ID NO: 364100

SEQ ID NO: 618238 - RNA, 64 nt, Homo Sapiens; identical to SEQ ID NO: 364101

SEQ ID NO: 618239 - RNA, 64 nt, Homo Sapiens; identical to SEQ ID NO: 364102

SEQ ID NO: 618240 - RNA, 64 nt, Homo Sapiens; identical to SEQ ID NO: 364103

SEQ ID NO: 618241 - RNA, 64 nt, Homo Sapiens; identical to SEQ ID NO: 364104

SEQ ID NO: 618242 - RNA, 64 nt, Homo Sapiens; identical to SEQ ID NO: 364105

SEQ ID NO: 618243 - RNA, 64 nt, Homo Sapiens; identical to SEQ ID NO: 364106

SEQ ID NO: 618244 - RNA, 64 nt, Homo Sapiens; identical to SEQ ID NO: 364107

SEQ ID NO: 618245 - RNA, 64 nt, Homo Sapiens; identical to SEQ ID NO: 364108

SEQ ID NO: 618246 - RNA, 64 nt, Homo Sapiens; identical to SEQ ID NO: 364109

SEQ ID NO: 618247 - RNA, 64 nt, Homo Sapiens; identical to SEQ ID NO: 364110

SEQ ID NO: 618248 - RNA, 64 nt, Homo Sapiens; identical to SEQ ID NO: 364111

SEQ ID NO: 618249 - RNA, 64 nt, Homo Sapiens; identical to SEQ ID NO: 364112

SEQ ID NO: 618250 - RNA, 64 nt, Homo Sapiens; identical to SEQ ID NO: 616993

SEQ ID NO: 618251 - RNA, 64 nt, Homo Sapiens; identical to SEQ ID NO: 616994

SEQ ID NO: 618252 - RNA, 64 nt, Homo Sapiens; identical to SEQ ID NO: 616995

SEQ ID NO: 618253 - RNA, 64 nt, Homo Sapiens; identical to SEQ ID NO: 616996

SEQ ID NO: 618254 - RNA, 64 nt, Homo Sapiens; identical to SEQ ID NO: 616997

SEQ ID NO: 618255 - RNA, 64 nt, Homo Sapiens; identical to SEQ ID NO: 616998

SEQ ID NO: 618256 - RNA, 64 nt, Homo Sapiens; identical to SEQ ID NO: 616999

SEQ ID NO: 618257 - RNA, 64 nt, Homo Sapiens; identical to SEQ ID NO: 617000

SEQ ID NO: 618258 - RNA, 64 nt, Homo Sapiens; identical to SEQ ID NO: 617001

SEQ ID NO: 618259 - RNA, 64 nt, Homo Sapiens; identical to SEQ ID NO: 617002

SEQ ID NO: 618260 - RNA, 64 nt, Homo Sapiens; identical to SEQ ID NO: 617003

SEQ ID NO: 618261 - RNA, 64 nt, Homo Sapiens; identical to SEQ ID NO: 617004

SEQ ID NO: 618262 - RNA, 64 nt, Homo Sapiens; identical to SEQ ID NO: 617005

SEQ ID NO: 618263 - RNA, 64 nt, Homo Sapiens; identical to SEQ ID NO: 617006

SEQ ID NO: 618264 - RNA, 64 nt, Homo Sapiens; identical to SEQ ID NO: 617007

SEQ ID NO: 618265 - RNA, 64 nt, Homo Sapiens; identical to SEQ ID NO: 617008

SEQ ID NO: 618266 - RNA, 64 nt, Homo Sapiens; identical to SEQ ID NO: 617009

SEQ ID NO: 618267 - RNA, 64 nt, Homo Sapiens; identical to SEQ ID NO: 617010

SEQ ID NO: 618268 - RNA, 64 nt, Homo Sapiens; identical to SEQ ID NO: 617011

SEQ ID NO: 618269 - RNA, 64 nt, Homo Sapiens; identical to SEQ ID NO: 617012

SEQ ID NO: 618270 - RNA, 64 nt, Homo Sapiens; identical to SEQ ID NO: 617013

SEQ ID NO: 618271 - RNA, 64 nt, Homo Sapiens; identical to SEQ ID NO: 617014

SEQ ID NO: 618272 - RNA, 64 nt, Homo Sapiens; identical to SEQ ID NO: 617015

SEQ ID NO: 618273 - RNA, 64 nt, Homo Sapiens; identical to SEQ ID NO: 617016

SEQ ID NO: 618274 - RNA, 64 nt, Homo Sapiens; identical to SEQ ID NO: 617017

SEQ ID NO: 618275 - RNA, 64 nt, Homo Sapiens; identical to SEQ ID NO: 617018

SEQ ID NO: 618276 - RNA, 64 nt, Homo Sapiens; identical to SEQ ID NO: 617019

SEQ ID NO: 618277 - RNA, 64 nt, Homo Sapiens; identical to SEQ ID NO: 617020

SEQ ID NO: 618278 - RNA, 64 nt, Homo Sapiens; identical to SEQ ID NO: 617021

SEQ ID NO: 618279 - RNA, 64 nt, Homo Sapiens; identical to SEQ ID NO: 617022

SEQ ID NO: 618280 - RNA, 64 nt, Homo Sapiens; identical to SEQ ID NO: 617023

SEQ ID NO: 618281 - RNA, 64 nt, Homo Sapiens; identical to SEQ ID NO: 617024

SEQ ID NO: 618282 - RNA, 64 nt, Homo Sapiens; identical to SEQ ID NO: 617025

SEQ ID NO: 618283 - RNA, 64 nt, Homo Sapiens; identical to SEQ ID NO: 617026

SEQ ID NO: 618284 - RNA, 64 nt, Homo Sapiens; identical to SEQ ID NO: 617027

SEQ ID NO: 618285 - RNA, 64 nt, Homo Sapiens; identical to SEQ ID NO: 617028

SEQ ID NO: 618286 - RNA, 64 nt, Homo Sapiens; identical to SEQ ID NO: 617029

SEQ ID NO: 618287 - RNA, 64 nt, Homo Sapiens; identical to SEQ ID NO: 617030

SEQ ID NO: 618288 - RNA, 64 nt, Homo Sapiens; identical to SEQ ID NO: 617031

SEQ ID NO: 618289 - RNA, 64 nt, Homo Sapiens; identical to SEQ ID NO: 617032

SEQ ID NO: 618290 - RNA, 64 nt, Homo Sapiens; identical to SEQ ID NO: 617033

SEQ ID NO: 618291 - RNA, 64 nt, Homo Sapiens; identical to SEQ ID NO: 617034

SEQ ID NO: 618292 - RNA, 64 nt, Homo Sapiens; identical to SEQ ID NO: 617035

SEQ ID NO: 618293 - RNA, 64 nt, Homo Sapiens; identical to SEQ ID NO: 617036

SEQ ID NO: 618294 - RNA, 64 nt, Homo Sapiens; identical to SEQ ID NO: 617037

SEQ ID NO: 618295 - RNA, 64 nt, Homo Sapiens; identical to SEQ ID NO: 617038

SEQ ID NO: 618296 - RNA, 64 nt, Homo Sapiens; identical to SEQ ID NO: 617039

SEQ ID NO: 618297 - RNA, 64 nt, Homo Sapiens; identical to SEQ ID NO: 617040

SEQ ID NO: 618298 - RNA, 64 nt, Homo Sapiens; identical to SEQ ID NO: 617041

SEQ ID NO: 618299 - RNA, 64 nt, Homo Sapiens; identical to SEQ ID NO: 617042

SEQ ID NO: 618300 - RNA, 64 nt, Homo Sapiens; identical to SEQ ID NO: 617043

SEQ ID NO: 618301 - RNA, 64 nt, Homo Sapiens; identical to SEQ ID NO: 617044

SEQ ID NO: 618302 - RNA, 64 nt, Homo Sapiens; identical to SEQ ID NO: 617045

SEQ ID NO: 618303 - RNA, 64 nt, Homo Sapiens; identical to SEQ ID NO: 210768

SEQ ID NO: 618304 - RNA, 64 nt, Homo Sapiens; identical to SEQ ID NO: 210769

SEQ ID NO: 618305 - RNA, 64 nt, Homo Sapiens; identical to SEQ ID NO: 210770

SEQ ID NO: 618306 - RNA, 64 nt, Homo Sapiens; identical to SEQ ID NO: 210771

SEQ ID NO: 618307 - RNA, 64 nt, Homo Sapiens; identical to SEQ ID NO: 210772

SEQ ID NO: 618308 - RNA, 64 nt, Homo Sapiens; identical to SEQ ID NO: 210773

SEQ ID NO: 618309 - RNA, 64 nt, Homo Sapiens; identical to SEQ ID NO: 210774

SEQ ID NO: 618310 - RNA, 64 nt, Homo Sapiens; identical to SEQ ID NO: 210775

SEQ ID NO: 618311 - RNA, 64 nt, Homo Sapiens; identical to SEQ ID NO: 210776

SEQ ID NO: 618312 - RNA, 64 nt, Homo Sapiens; identical to SEQ ID NO: 210777

SEQ ID NO: 618313 - RNA, 64 nt, Homo Sapiens; identical to SEQ ID NO: 210778

SEQ ID NO: 618314 - RNA, 64 nt, Homo Sapiens; identical to SEQ ID NO: 210779

SEQ ID NO: 618315 - RNA, 64 nt, Homo Sapiens; identical to SEQ ID NO: 210780

SEQ ID NO: 618316 - RNA, 64 nt, Homo Sapiens; identical to SEQ ID NO: 210781

SEQ ID NO: 618317 - RNA, 64 nt, Homo Sapiens; identical to SEQ ID NO: 210782

SEQ ID NO: 618318 - RNA, 64 nt, Homo Sapiens; identical to SEQ ID NO: 210783

SEQ ID NO: 618319 - RNA, 64 nt, Homo Sapiens; identical to SEQ ID NO: 210784

SEQ ID NO: 618320 - RNA, 64 nt, Homo Sapiens; identical to SEQ ID NO: 210785

SEQ ID NO: 618321 - RNA, 64 nt, Homo Sapiens; identical to SEQ ID NO: 210786

SEQ ID NO: 618322 - RNA, 64 nt, Homo Sapiens; identical to SEQ ID NO: 210787

SEQ ID NO: 618323 - RNA, 64 nt, Homo Sapiens; identical to SEQ ID NO: 210788

SEQ ID NO: 618324 - RNA, 64 nt, Homo Sapiens; identical to SEQ ID NO: 210789

SEQ ID NO: 618325 - RNA, 64 nt, Homo Sapiens; identical to SEQ ID NO: 210790

SEQ ID NO: 618326 - RNA, 64 nt, Homo Sapiens; identical to SEQ ID NO: 210791

SEQ ID NO: 618327 - RNA, 64 nt, Homo Sapiens; identical to SEQ ID NO: 210792

SEQ ID NO: 618328 - RNA, 64 nt, Homo Sapiens; identical to SEQ ID NO: 210793

SEQ ID NO: 618329 - RNA, 64 nt, Homo Sapiens; identical to SEQ ID NO: 210794

SEQ ID NO: 618330 - RNA, 64 nt, Homo Sapiens; identical to SEQ ID NO: 210795

SEQ ID NO: 618331 - RNA, 64 nt, Homo Sapiens; identical to SEQ ID NO: 210796

SEQ ID NO: 618332 - RNA, 64 nt, Homo Sapiens; identical to SEQ ID NO: 210797

SEQ ID NO: 618333 - RNA, 64 nt, Homo Sapiens; identical to SEQ ID NO: 210798

SEQ ID NO: 618334 - RNA, 64 nt, Homo Sapiens; identical to SEQ ID NO: 210799

SEQ ID NO: 618335 - RNA, 64 nt, Homo Sapiens; identical to SEQ ID NO: 210800

SEQ ID NO: 618336 - RNA, 64 nt, Homo Sapiens; identical to SEQ ID NO: 210801

SEQ ID NO: 618337 - RNA, 64 nt, Homo Sapiens; identical to SEQ ID NO: 210802

SEQ ID NO: 618338 - RNA, 64 nt, Homo Sapiens; identical to SEQ ID NO: 210803

SEQ ID NO: 618339 - RNA, 64 nt, Homo Sapiens; identical to SEQ ID NO: 210804

SEQ ID NO: 618340 - RNA, 64 nt, Homo Sapiens; identical to SEQ ID NO: 210805

SEQ ID NO: 618341 - RNA, 64 nt, Homo Sapiens; identical to SEQ ID NO: 210806

SEQ ID NO: 618342 - RNA, 64 nt, Homo Sapiens; identical to SEQ ID NO: 210807

SEQ ID NO: 618343 - RNA, 64 nt, Homo Sapiens; identical to SEQ ID NO: 210808

SEQ ID NO: 618344 - RNA, 64 nt, Homo Sapiens; identical to SEQ ID NO: 210809

SEQ ID NO: 618345 - RNA, 63 nt, Homo Sapiens
gggccuuugguggccacccuggugaggacaccugucccccagggcaggcaccuucucuuuucc

SEQ ID NO: 618346 - RNA, 63 nt, Homo Sapiens
ccuuucaaugcccagcccugacaccugcccuuugucccccaggccuaggaucagggaccagag

SEQ ID NO: 618347 - RNA, 63 nt, Homo Sapiens
acugcacaguucacuuuauuuaacaauuuucaugucccccaccucauguuuucaccuuuucug

SEQ ID NO: 618348 - RNA, 63 nt, Homo Sapiens
ugggaccugaggacuggaugguagaauacuggggucccccagcucuuagcaggaugcaggcua

SEQ ID NO: 618349 - RNA, 63 nt, Homo Sapiens
ggcagugccucugccagucacugucaucguugugucccccacaacuguccucuugcuagcucg

SEQ ID NO: 618350 - RNA, 63 nt, Homo Sapiens
ucugccagugggggauguuucuggaggcagcuggucccccacaccgcguccugcugagccugc

SEQ ID NO: 618351 - RNA, 63 nt, Homo Sapiens
ucuguaugucaccaggauggcuuaggugacaaugucccccauaaugagagggggcuuggccuu

SEQ ID NO: 618352 - RNA, 63 nt, Homo Sapiens
aucccccacuugccugaagcagcccaugagaccgucccccagcccuccugaagauagccagag

SEQ ID NO: 618353 - RNA, 63 nt, Homo Sapiens
cucucuugggcuuucuuacaccugugggaucuggucccccagcuacuuuuucgccucccaggg

SEQ ID NO: 618354 - RNA, 63 nt, Homo Sapiens
augugcccugugcgggcaguagacaggguagcugucccccaaagcaggugaggauggugcacc

SEQ ID NO: 618355 - RNA, 63 nt, Homo Sapiens
cacugcucuccagccugggaggcacagcaaacugucccccaaaaaaaaaaaagaguccuuacc

SEQ ID NO: 618356 - RNA, 63 nt, Homo Sapiens
acuaaagguggccacaaauucuuugacacucaagucccccaagaccuaaggguuuuaucuccu

SEQ ID NO: 618357 - RNA, 63 nt, Homo Sapiens
aagcacuugccuguucauucgcugggaagaauggucccccagcccagcagcccccuccuccug

SEQ ID NO: 618358 - RNA, 63 nt, Homo Sapiens
gugguggucagcacggaagcagggacaagaccagucccccagcguauuauucccccagcucuc

SEQ ID NO: 618359 - RNA, 63 nt, Homo Sapiens
cugaaaacugaccaaggccucaauaaccuugaggucccccauacccagggagccgcugaugua

SEQ ID NO: 618360 - RNA, 63 nt, Homo Sapiens
acccaggaaugggaaucuggguccuccuccgcugucccccaacauauucugugauugauuuug

SEQ ID NO: 618361 - RNA, 63 nt, Homo Sapiens
cuccacagucuuccuugccuggggugcaugcaugucccccacccuggcuguguaggggaggaa

SEQ ID NO: 618362 - RNA, 63 nt, Homo Sapiens
guagaaagaaccaggguguccccgggacaggccgucccccaccccauccuguagaaguccauu

SEQ ID NO: 618363 - RNA, 63 nt, Homo Sapiens
agaaguccauuccccuuuucccuccugugcucugucccccaaggagucauggaacucagggua

SEQ ID NO: 618364 - RNA, 63 nt, Homo Sapiens
aggcacauggcccaggcagcugucaauucucaugucccccacauggcccaaggugggcaucuu

SEQ ID NO: 618365 - RNA, 63 nt, Homo Sapiens
agguuagaagacauacagaaacagggcuggugugucccccauagucugcaugcugugccggaa

SEQ ID NO: 618366 - RNA, 63 nt, Homo Sapiens
acacugugaccucaucuuaacacuggguuuagggucccccaauuuuuugguagggccaccacu

SEQ ID NO: 618367 - RNA, 63 nt, Homo Sapiens
cgggaauacagugccaugauggggccuugcugugucccccaggcccccuuuuuuuuuugagac

SEQ ID NO: 618368 - RNA, 63 nt, Homo Sapiens
aucgggggccugcaaaucuaccuccccgucccugucccccagccucaucauccacccgcugcc

SEQ ID NO: 618369 - RNA, 63 nt, Homo Sapiens
cucucacccaccagcuccacgggagggggaccugucccccacuagaggcccccaguggggaca

SEQ ID NO: 618370 - RNA, 59 nt, Homo Sapiens
guccccaagauccuccuuagaaucccacagucccccagacccuccuuagaaugccacag

SEQ ID NO: 618371 - RNA, 63 nt, Homo Sapiens
cacagucccccagacccuccuuagaaugccacagucccccaacccuccacagagcccccagac

SEQ ID NO: 618372 - RNA, 63 nt, Homo Sapiens
uggagcugccugccuugccccgugggaauccaggucccccaggccugcuguggaggccccagc

SEQ ID NO: 618373 - RNA, 63 nt, Homo Sapiens
ucucagcccccaaggcugccggcggaggugggugucccccaggguugggccgcggcugccagg

SEQ ID NO: 618374 - RNA, 63 nt, Homo Sapiens
gcucaggccagaaguccagcugcugccaggcaugucccccagggccacugggcacuaugaguc

SEQ ID NO: 618375 - RNA, 63 nt, Homo Sapiens
aggcaugucccccagggccacugggcacuaugagucccccaccucucccacuacuggccccuc

SEQ ID NO: 618376 - RNA, 63 nt, Homo Sapiens
cccuacaucagaaugcauccuugaugcugcgcggucccccacuuggacuccagcgguggcuuc

SEQ ID NO: 618377 - RNA, 63 nt, Homo Sapiens
cccuacaucagaacgcauccuugaugcugcgccgucccccacuagaaauuuucagugcaaguc

SEQ ID NO: 618378 - RNA, 63 nt, Homo Sapiens
aagggugccagaugccugggucucccaagaggggucccccaacucaccguucccgggacaggc

SEQ ID NO: 618379 - RNA, 63 nt, Homo Sapiens
uguguguucuucucugagcagcuccuccccggagucccccagcacagucccaggagaugacag

SEQ ID NO: 618380 - RNA, 64 nt, Homo Sapiens; identical to SEQ ID NO: 212912

SEQ ID NO: 618381 - RNA, 64 nt, Homo Sapiens; identical to SEQ ID NO: 212913

SEQ ID NO: 618382 - RNA, 64 nt, Homo Sapiens; identical to SEQ ID NO: 212914

SEQ ID NO: 618383 - RNA, 64 nt, Homo Sapiens; identical to SEQ ID NO: 212915

SEQ ID NO: 618384 - RNA, 64 nt, Homo Sapiens; identical to SEQ ID NO: 212916

SEQ ID NO: 618385 - RNA, 64 nt, Homo Sapiens; identical to SEQ ID NO: 212917

SEQ ID NO: 618386 - RNA, 64 nt, Homo Sapiens; identical to SEQ ID NO: 212918

SEQ ID NO: 618387 - RNA, 60 nt, Homo Sapiens
gacuagagggugguggagguaaggccuuccagagcccauggcuucaggagagggucucuc

SEQ ID NO: 618388 - RNA, 60 nt, Homo Sapiens
agcuuuaacaugguucaggcccuuggugugagagcccagggggaggacagcuugucugcu

SEQ ID NO: 618389 - RNA, 60 nt, Homo Sapiens
cccaugcccaccaguguuggcaccugccacagagcccacacaucaguguuuccgucugcu

SEQ ID NO: 618390 - RNA, 60 nt, Homo Sapiens
uccgcccugggcaggagcccuguuccccagagagcccaccggaagacacauucccuuccc

SEQ ID NO: 618391 - RNA, 60 nt, Homo Sapiens
cugcuggaacagccaaggacuccggcucacagagcccagaucugugcugccugguuugca

SEQ ID NO: 618392 - RNA, 60 nt, Homo Sapiens
ccccacgucuuacagucgccugagcaauggagagcccagcucccagacaggagccagggu

SEQ ID NO: 618393 - RNA, 60 nt, Homo Sapiens
agcagcccuggcccuguaagcuugguagaaagagcccagaguuuugaacuuccuuuccca

SEQ ID NO: 618394 - RNA, 60 nt, Homo Sapiens
gggccggccggguuccugguuccccaccggagagcccagggccuuauuucugccggggcc

SEQ ID NO: 618395 - RNA, 60 nt, Homo Sapiens
agucagugcuggugguuggagugauucuucagagcccagguuuauauaaaaaguguuucu

SEQ ID NO: 618396 - RNA, 60 nt, Homo Sapiens
acaccacaaagagcagcaccagaacagaccagagcccaccucccaggcccagcaccgagc

SEQ ID NO: 618397 - RNA, 60 nt, Homo Sapiens
cauugaaguggagcccggcacaggggucauagagcccagugaggucggggauuuugaguu

SEQ ID NO: 618398 - RNA, 60 nt, Homo Sapiens
gccagcucccagccacauggcgcaugaaggagagcccagucucccuccaggaaaggccug

SEQ ID NO: 618399 - RNA, 60 nt, Homo Sapiens
ugaccagaggggagguggauggcacuuuccagagcccagguucuuauggcauuucccagg

SEQ ID NO: 618400 - RNA, 60 nt, Homo Sapiens
ugcccacugcccgugcagccuccuucagccagagcccagagcauagacaggaguguagga

SEQ ID NO: 618401 - RNA, 60 nt, Homo Sapiens
cugaguugaagaaccuauugaugguuucccagagcccacaguguuccguacccacugcug

SEQ ID NO: 618402 - RNA, 60 nt, Homo Sapiens
gaaguguuccguacccacugaccccagggcagagcccagaacucccauuugcucucagug

SEQ ID NO: 618403 - RNA, 60 nt, Homo Sapiens
cugcaagaccuggcugagccagaucucagcagagcccauugauagcaaaugugucugguu

SEQ ID NO: 618404 - RNA, 60 nt, Homo Sapiens
gucaggaguucguucaguaaucaucagcucagagcccagguaacaccuucuggagccagc

SEQ ID NO: 618405 - RNA, 60 nt, Homo Sapiens
auccaucucugucaucaucucaggacccucagagcccagcuggauguccuucgaaggaac

SEQ ID NO: 618406 - RNA, 60 nt, Homo Sapiens
aucucagaggccccuggauggccaggaaccagagcccaucugcuccuacccaugcuacag

SEQ ID NO: 618407 - RNA, 60 nt, Homo Sapiens
aaauccugagugucaguuugcauuguaaugagagcccaucuguuccuguuaaauguauag

SEQ ID NO: 618408 - RNA, 60 nt, Homo Sapiens
cuacagugggugguuuugguguaacauccaagagcccauuuaccuugaccacgcuguaca

SEQ ID NO: 618409 - RNA, 60 nt, Homo Sapiens
ugcacugugugaugaugggaaaggggcugcagagcccagggcugcggcugcaauggaggc

SEQ ID NO: 618410 - RNA, 60 nt, Homo Sapiens
ccagugcagucccggcuguggagagcaauaagagcccagcuaucagugccccccagagua

SEQ ID NO: 618411 - RNA, 60 nt, Homo Sapiens
ccccuccacgggggucccaggugaccgggcagagcccaacguauauacccugcaccagca

SEQ ID NO: 618412 - RNA, 60 nt, Homo Sapiens
cuggccucaucugcaccaugccagacugccagagcccaggcucccugcacauggcacuac

SEQ ID NO: 618413 - RNA, 60 nt, Homo Sapiens
ugggcacagagaaggguggacaucugcuggagagcccagguuggagaaaccaaccagaua

SEQ ID NO: 618414 - RNA, 60 nt, Homo Sapiens
aagaacugcugucaugaaggcaguguuaccagagcccaguuugaagggcaaggagggaaa

SEQ ID NO: 618415 - RNA, 60 nt, Homo Sapiens
caaaauguuaacacaaagcuaagauucaucagagcccacccuauucuaaggaaccacaau

SEQ ID NO: 618416 - RNA, 60 nt, Homo Sapiens
cucugguaaagcauccuguggagggagaggagagcccagucauuugcuuagaugguguuu

SEQ ID NO: 618417 - RNA, 60 nt, Homo Sapiens
uccucaguuccuguggauagguaagaguccagagcccacccucacucucaggacuauucu

SEQ ID NO: 618418 - RNA, 60 nt, Homo Sapiens
gggaugagaggagagagcaacucucccacuagagcccagaccuaaacagggcacauagau

SEQ ID NO: 618419 - RNA, 60 nt, Homo Sapiens
aauggaggcugcaggaggcuggcccagccaagagcccaugugaggcccuaacaaauuuca

SEQ ID NO: 618420 - RNA, 60 nt, Homo Sapiens
cccaagccuggcaccaagcccugacuuuccagagcccaguccuugaaguagcagccuugg

SEQ ID NO: 618421 - RNA, 60 nt, Homo Sapiens
uagugcuaagagggaaggcccagguuugagagagcccagaggggcagagcccagagccuu

SEQ ID NO: 618422 - RNA, 60 nt, Homo Sapiens
aggcccagguuugagagagcccagaggggcagagcccagagccuuguuuggcccugaucu

SEQ ID NO: 618423 - RNA, 60 nt, Homo Sapiens
ccccaucggcccuguccccuggagugugucagagcccaggggagaaugcagcccaccagg

SEQ ID NO: 618424 - RNA, 60 nt, Homo Sapiens
ugaucuacccgugccugggccccuccccucagagcccaugguaacgaaccccuagaaagg

SEQ ID NO: 618425 - RNA, 60 nt, Homo Sapiens
cccagaagcagucccugacccccagcuuucagagcccagccaccagcuuggggcuggaug

SEQ ID NO: 618426 - RNA, 60 nt, Homo Sapiens
cacagaagugauaaaggaauccaaaguugaagagcccaggaaacgggaaacuguauccau

SEQ ID NO: 618427 - RNA, 60 nt, Homo Sapiens
caaccagucuggggccauucagccagggacagagcccacagagcccauacaccugucucc

SEQ ID NO: 618428 - RNA, 60 nt, Homo Sapiens
uggggccauucagccagggacagagcccacagagcccauacaccugucucccaccagcgg

SEQ ID NO: 618429 - RNA, 64 nt, Homo Sapiens
cacacuuaaugacuggaaaaaucagucuuacuaggcauaaaaguuuuaggaaaagaugucuugc

SEQ ID NO: 618430 - RNA, 64 nt, Homo Sapiens
cuuccucuugccccagaaguguauucauuaaaaagcauaaaaguuaaaguagaauaauuucaug

SEQ ID NO: 618431 - RNA, 64 nt, Homo Sapiens
uauaggauuacaaaggaaucucauguuuuuaaaugcauaaaauacuaugaaugccuucuuaaaa

SEQ ID NO: 618432 - RNA, 64 nt, Homo Sapiens
caagcacuuuggaagaauuauaaaguaaagaaaugcauaaaagacacauauuuuuauauuaugu

SEQ ID NO: 618433 - RNA, 64 nt, Homo Sapiens
uaugcaagugguuuuuauaauauuuuuaaaacuugcauaaaaguacuuuagggagaaaacuuug

SEQ ID NO: 618434 - RNA, 64 nt, Homo Sapiens
gaauaggcugcccauauaaguucaagccuuguaagcauaaaagagaaagugcaguaccgucauc

SEQ ID NO: 618435 - RNA, 64 nt, Homo Sapiens
gauauuuuaguuuguauuauaauggauaaagcuagcauaaaauuaaauuggaauaugaaaaacu

SEQ ID NO: 618436 - RNA, 64 nt, Homo Sapiens
uuuaauguaccuuaccucauagauaauauucuaggcauaaaacaauauggauaagaaugcaggu

SEQ ID NO: 618437 - RNA, 64 nt, Homo Sapiens
uacucuugacaugauuguucggaaaacugcauuugcauaaaaacagguagugccagcagaguag

SEQ ID NO: 618438 - RNA, 64 nt, Homo Sapiens
aaaucaacacuuuauaguuaaagaugugcagagggcauaaaagccugacugguguucuaccugc

SEQ ID NO: 618439 - RNA, 64 nt, Homo Sapiens
cuaauuauugccuuuguuguuguauuacaaaucugcauaaaauaccucauuucaaaucaaaucu

SEQ ID NO: 618440 - RNA, 64 nt, Homo Sapiens
aggccgugugaagagcagcaaagcuuuccagaaggcauaaaaggaaacuugaauaaaggaagau

SEQ ID NO: 618441 - RNA, 64 nt, Homo Sapiens
aaaaguuggcuaaaaauuuuauguauuuuucuaggcauaaaaauacauuaguccuaaacguccc

SEQ ID NO: 618442 - RNA, 64 nt, Homo Sapiens
agcaugaagucuguuaaagcgaauacaucagcuggcauaaaagguuaagcauaucuucugaacu

SEQ ID NO: 618443 - RNA, 64 nt, Homo Sapiens; identical to SEQ ID NO: 204896

SEQ ID NO: 618444 - RNA, 64 nt, Homo Sapiens; identical to SEQ ID NO: 204897

SEQ ID NO: 618445 - RNA, 64 nt, Homo Sapiens; identical to SEQ ID NO: 204898

SEQ ID NO: 618446 - RNA, 64 nt, Homo Sapiens; identical to SEQ ID NO: 204899

SEQ ID NO: 618447 - RNA, 64 nt, Homo Sapiens; identical to SEQ ID NO: 204900

SEQ ID NO: 618448 - RNA, 64 nt, Homo Sapiens; identical to SEQ ID NO: 204901

SEQ ID NO: 618449 - RNA, 64 nt, Homo Sapiens; identical to SEQ ID NO: 204902

SEQ ID NO: 618450 - RNA, 64 nt, Homo Sapiens; identical to SEQ ID NO: 204903

SEQ ID NO: 618451 - RNA, 64 nt, Homo Sapiens; identical to SEQ ID NO: 204904

SEQ ID NO: 618452 - RNA, 64 nt, Homo Sapiens; identical to SEQ ID NO: 204905

SEQ ID NO: 618453 - RNA, 64 nt, Homo Sapiens; identical to SEQ ID NO: 204906

SEQ ID NO: 618454 - RNA, 64 nt, Homo Sapiens; identical to SEQ ID NO: 204907

SEQ ID NO: 618455 - RNA, 64 nt, Homo Sapiens; identical to SEQ ID NO: 204908

SEQ ID NO: 618456 - RNA, 64 nt, Homo Sapiens; identical to SEQ ID NO: 204909

SEQ ID NO: 618457 - RNA, 64 nt, Homo Sapiens; identical to SEQ ID NO: 204910

SEQ ID NO: 618458 - RNA, 64 nt, Homo Sapiens; identical to SEQ ID NO: 204911

SEQ ID NO: 618459 - RNA, 64 nt, Homo Sapiens; identical to SEQ ID NO: 204912

SEQ ID NO: 618460 - RNA, 64 nt, Homo Sapiens; identical to SEQ ID NO: 511888

SEQ ID NO: 618461 - RNA, 64 nt, Homo Sapiens; identical to SEQ ID NO: 511889

SEQ ID NO: 618462 - RNA, 64 nt, Homo Sapiens; identical to SEQ ID NO: 511890

SEQ ID NO: 618463 - RNA, 64 nt, Homo Sapiens; identical to SEQ ID NO: 511891

SEQ ID NO: 618464 - RNA, 64 nt, Homo Sapiens; identical to SEQ ID NO: 511892

SEQ ID NO: 618465 - RNA, 64 nt, Homo Sapiens; identical to SEQ ID NO: 511893

SEQ ID NO: 618466 - RNA, 64 nt, Homo Sapiens; identical to SEQ ID NO: 511894

SEQ ID NO: 618467 - RNA, 64 nt, Homo Sapiens; identical to SEQ ID NO: 511895

SEQ ID NO: 618468 - RNA, 64 nt, Homo Sapiens; identical to SEQ ID NO: 511896

SEQ ID NO: 618469 - RNA, 64 nt, Homo Sapiens; identical to SEQ ID NO: 511897

SEQ ID NO: 618470 - RNA, 64 nt, Homo Sapiens; identical to SEQ ID NO: 511898

SEQ ID NO: 618471 - RNA, 64 nt, Homo Sapiens; identical to SEQ ID NO: 511899

SEQ ID NO: 618472 - RNA, 64 nt, Homo Sapiens; identical to SEQ ID NO: 511900

SEQ ID NO: 618473 - RNA, 64 nt, Homo Sapiens; identical to SEQ ID NO: 511901

SEQ ID NO: 618474 - RNA, 64 nt, Homo Sapiens; identical to SEQ ID NO: 511902

SEQ ID NO: 618475 - RNA, 64 nt, Homo Sapiens; identical to SEQ ID NO: 175087

SEQ ID NO: 618476 - RNA, 64 nt, Homo Sapiens; identical to SEQ ID NO: 175088

SEQ ID NO: 618477 - RNA, 64 nt, Homo Sapiens; identical to SEQ ID NO: 175089

SEQ ID NO: 618478 - RNA, 64 nt, Homo Sapiens; identical to SEQ ID NO: 175090

SEQ ID NO: 618479 - RNA, 64 nt, Homo Sapiens; identical to SEQ ID NO: 175091

SEQ ID NO: 618480 - RNA, 64 nt, Homo Sapiens; identical to SEQ ID NO: 175092

SEQ ID NO: 618481 - RNA, 64 nt, Homo Sapiens; identical to SEQ ID NO: 175093

SEQ ID NO: 618482 - RNA, 64 nt, Homo Sapiens; identical to SEQ ID NO: 175094

SEQ ID NO: 618483 - RNA, 64 nt, Homo Sapiens; identical to SEQ ID NO: 175095

SEQ ID NO: 618484 - RNA, 64 nt, Homo Sapiens; identical to SEQ ID NO: 175096

SEQ ID NO: 618485 - RNA, 64 nt, Homo Sapiens; identical to SEQ ID NO: 175097

SEQ ID NO: 618486 - RNA, 64 nt, Homo Sapiens; identical to SEQ ID NO: 175098

SEQ ID NO: 618487 - RNA, 64 nt, Homo Sapiens; identical to SEQ ID NO: 175099

SEQ ID NO: 618488 - RNA, 64 nt, Homo Sapiens; identical to SEQ ID NO: 175100

SEQ ID NO: 618489 - RNA, 64 nt, Homo Sapiens; identical to SEQ ID NO: 175101

SEQ ID NO: 618490 - RNA, 64 nt, Homo Sapiens; identical to SEQ ID NO: 175102

SEQ ID NO: 618491 - RNA, 64 nt, Homo Sapiens; identical to SEQ ID NO: 175103

SEQ ID NO: 618492 - RNA, 64 nt, Homo Sapiens; identical to SEQ ID NO: 175104

SEQ ID NO: 618493 - RNA, 64 nt, Homo Sapiens; identical to SEQ ID NO: 175105

SEQ ID NO: 618494 - RNA, 64 nt, Homo Sapiens; identical to SEQ ID NO: 175106

SEQ ID NO: 618495 - RNA, 64 nt, Homo Sapiens; identical to SEQ ID NO: 175107

SEQ ID NO: 618496 - RNA, 64 nt, Homo Sapiens
uggacgugaccguaucccucugccacaccccaggcccugcgaggggcuaucgagaggagcucac

SEQ ID NO: 618497 - RNA, 64 nt, Homo Sapiens
cguagccaaggugggcugagcccuggcaggaugacccugcgaaggggcccugguccuuccaggc

SEQ ID NO: 618498 - RNA, 64 nt, Homo Sapiens
cuuuuguuguaccaaauagggcuccccaccccaccccugcgacaagugcucuucuagaacaggu

SEQ ID NO: 618499 - RNA, 64 nt, Homo Sapiens
cggcagaggccuccguggugcagcuguggaccugcccugcgaaugcagucguggugaaaccggu

SEQ ID NO: 618500 - RNA, 64 nt, Homo Sapiens
ugcauagcuggaaguucaaucacuugaaauugugcccugcgaguuugccuacagaugguuucca

SEQ ID NO: 618501 - RNA, 64 nt, Homo Sapiens
cgcacacagcugagcacuuagcugggcccucuuucccugcgagagagaugaccagggaugcugg

SEQ ID NO: 618502 - RNA, 64 nt, Homo Sapiens
aggaggacuggucagucacaagagcuucaaccugcccugcgagcccucucugcaccugcucaag

SEQ ID NO: 618503 - RNA, 64 nt, Homo Sapiens
ucuggugguccuuaggggaguggccccuccugagcccugcgagcagcguccuuuuccucuuccc

SEQ ID NO: 618504 - RNA, 64 nt, Homo Sapiens
acuugagauuuagugucugucggaagcagagguucccugcgaaggaaugaggcuggacagaugg

SEQ ID NO: 618505 - RNA, 64 nt, Homo Sapiens
gugaccuuaggaucacucaaguagacccuucacucccugcgagaaauuaggaugaauaacuacc

SEQ ID NO: 618506 - RNA, 64 nt, Homo Sapiens
gaucacacacguauacacaacauuacugaaagaacccugcgaaucaaaacaacccccacacaga

SEQ ID NO: 618507 - RNA, 64 nt, Homo Sapiens
guucaugggguguucguguuccgccucccagcaucccugcgagcgcagacugggagcucccggu

SEQ ID NO: 618508 - RNA, 54 nt, Homo Sapiens
cacucuuuggaccagcagcggugacccugcgaccaugacagcauauuaaaguga

SEQ ID NO: 618509 - RNA, 64 nt, Homo Sapiens
ugcccaccucagccucccaaucucaaucuccugacccugcgauccaccauguuggccaggaugg

SEQ ID NO: 618510 - RNA, 64 nt, Homo Sapiens
aaugagguuucaguacaaaaggaaccaugggugacccugcgauauccacugucauuuuccaucc

SEQ ID NO: 618511 - RNA, 64 nt, Homo Sapiens
ggcagacccacauggccugggcucugaaugcccacccugcgacgguggguucugcaucagcaaa

SEQ ID NO: 618512 - RNA, 64 nt, Homo Sapiens
uugccugugucugaagugguaugcuucuuccuuacccugcgauugucccaaguuggaaauauuc

SEQ ID NO: 618513 - RNA, 64 nt, Homo Sapiens
agcaaggcucgcagcaagagggugcugugcccaacccugcgacuuguacagaaugguaacuaag

SEQ ID NO: 618514 - RNA, 64 nt, Homo Sapiens
gcccuggcacccuggcgugggugcccgccaaacgcccugcgaccgcucagaagcacaaaugcug

SEQ ID NO: 618515 - RNA, 64 nt, Homo Sapiens
ggaggaggagggagguaucuggugugagcguugccccugcgacauuugggaccacacagguggg

SEQ ID NO: 618516 - RNA, 64 nt, Homo Sapiens
gacaacccaaacucuccagacaucaccaacuguccccugcgaggagaaaucacuccugggggag

SEQ ID NO: 618517 - RNA, 64 nt, Homo Sapiens
agguggacagggccuacccagguggaggggaccacccugcgaucagguguuugcgacagggguu

SEQ ID NO: 618518 - RNA, 64 nt, Homo Sapiens
gagggccuggagggggugcugcgggaccagcuggcccugcgagccuuggaggaggcggugagcg

SEQ ID NO: 618519 - RNA, 64 nt, Homo Sapiens
guaccaugagaaauaucagaaacuacaagggauacccugcgaaaacuccucugucaguuucagc

SEQ ID NO: 618520 - RNA, 64 nt, Homo Sapiens
ugauugcuuuccaguuuaaugaaagcuuaaaugucccugcgaacccacaaucucugccagcaga

SEQ ID NO: 618521 - RNA, 64 nt, Homo Sapiens
ugcugaguggcucguguuucacagugggcggcuucccugcgacggaggcaggaccaggcauuua

SEQ ID NO: 618522 - RNA, 64 nt, Homo Sapiens
ucccacuccuuucuuagucucugggccuggaccucccugcgauugauccauccaccuauuagcc

SEQ ID NO: 618523 - RNA, 64 nt, Homo Sapiens
gaaaaggcuuggaguccucgcccagaucucucuccccugcgagcccuuuuuauuugagaaggaa

SEQ ID NO: 618524 - RNA, 64 nt, Homo Sapiens
gcacagaucuugcagcccagaaccaagucagccucccugcgacugcccaggcacacugcccacc

SEQ ID NO: 618525 - RNA, 64 nt, Homo Sapiens
cagaguuaagaccugugacgacaguuuccaaaaccccugcgaggcauucccacaaagugaagga

SEQ ID NO: 618526 - RNA, 57 nt, Homo Sapiens
gguaccgugagcgccugggaugcggggcccugcgacugaggguggcagccccuauag

SEQ ID NO: 618527 - RNA, 64 nt, Homo Sapiens
ugccucccgcuggcccaggucuccucuccagucccccugcgacucccuguuuccugggcuaguc

SEQ ID NO: 618528 - RNA, 51 nt, Homo Sapiens
aauagaguugaagcagccucgcccugcgagccacagauccaugcagaauga

SEQ ID NO: 618529 - RNA, 64 nt, Homo Sapiens
cuugcagccccugcagacgagagucaggccagcacccugcgaccagcuucuccacugaugcaca

SEQ ID NO: 618530 - RNA, 64 nt, Homo Sapiens
cacauauugugcagcuguugguuuucauguagugcccugcgauggaaauuagauauauuucaug

SEQ ID NO: 618531 - RNA, 64 nt, Homo Sapiens
cggaguaccccguguucgugaggacccgcugcagcccugcgacaagcccacaaacacaagaagc

SEQ ID NO: 618532 - RNA, 64 nt, Homo Sapiens
gccgagcgugcaacccggagccgccuugggcccucccugcgacagccggacccgccuccgcauc

SEQ ID NO: 618533 - RNA, 64 nt, Homo Sapiens
ucucacugugauuccucuccugcccuggcccuggcccugcgauccuguccgggccuggguuucc

SEQ ID NO: 618534 - RNA, 64 nt, Homo Sapiens
caaaugagacaaugacauaauugcagggacuuuucccugcgaaaaagagggagugaggagagga

SEQ ID NO: 618535 - RNA, 64 nt, Homo Sapiens
gcccugccccccgucaccgaugugaggccugcuccccugcgacccagugaacacuguccgccgc

SEQ ID NO: 618536 - RNA, 64 nt, Homo Sapiens
caggccagagccacagcugggagaccugcacugucccugcgaaauacuaagaacaccuagggug

SEQ ID NO: 618537 - RNA, 64 nt, Homo Sapiens
ggcagcuuugcagaagcccagauggaccuggugccccugcgaggucugucgccuggugcagccu

SEQ ID NO: 618538 - RNA, 64 nt, Homo Sapiens
ggacgugcccagcugucccccucaccccguguuucccugcgagugcagggccccuuccugcugu

SEQ ID NO: 618539 - RNA, 64 nt, Homo Sapiens
uggcucucaggggccagugagauagacagugcugcccugcgaagcaaccucauggucauggaca

SEQ ID NO: 618540 - RNA, 64 nt, Homo Sapiens
accucgggucucugccagaggaagacuuaagcaucccugcgaccucacauucuagacagagaug

SEQ ID NO: 618541 - RNA, 64 nt, Homo Sapiens
cauccagcagcgcuaagguggacaugggauuccucccugcgaugcgugucuuucccacgcagag

SEQ ID NO: 618542 - RNA, 64 nt, Homo Sapiens
augcuggauaaaugccuugauuacuuuaauuaagcccugcgagacucccuugaucuuuuugguu

SEQ ID NO: 618543 - RNA, 64 nt, Homo Sapiens
aaaaggcauuauguaucuguguaugccacauagccccugcgaaguuugagaugcaacagagaac

SEQ ID NO: 618544 - RNA, 64 nt, Homo Sapiens
cuccacccuuuccccuucuugaggugggcacccacccugcgauuuuaagaugcagaguggaggg

SEQ ID NO: 618545 - RNA, 64 nt, Homo Sapiens
gccugggugggagagcugggcugcccugaggcugcccugcgaugagcaggagcagugguggcgc

SEQ ID NO: 618546 - RNA, 64 nt, Homo Sapiens
ggucccgugucacuguuuacguggguccagugugcccugcgaugguugugcgcuuaacgugagg

SEQ ID NO: 618547 - RNA, 64 nt, Homo Sapiens
agcaguaugagcucuugugaggaugcugccgccacccugcgacggagcggcgccccggacugcc

SEQ ID NO: 618548 - RNA, 64 nt, Homo Sapiens
gggacugaggacuggcagagcugccggcgccggacccugcgacaaccggggucccccaggacag

SEQ ID NO: 618549 - RNA, 64 nt, Homo Sapiens
caucagacgccacccagcccaagccuagcgcccucccugcgaagagcccgugccgugugacucg

SEQ ID NO: 618550 - RNA, 64 nt, Homo Sapiens
ccuggagcguagggcccagccagcccugaugacacccugcgagaccugggugucagugagaucu

SEQ ID NO: 618551 - RNA, 63 nt, Homo Sapiens
augacccgggcgcaaccugggacugcccccggacccugcgaugccaaggucggccgcuacuag

SEQ ID NO: 618552 - RNA, 64 nt, Homo Sapiens
aggccccgagagggcgagacgcgcauccgcgauucccugcgacccccgggagcuggaggcgcau

SEQ ID NO: 618553 - RNA, 64 nt, Homo Sapiens
aggggagaauucuuggggcuaggcgguggcuucucccugcgagggcgucuaagaugagggggcc

SEQ ID NO: 618554 - RNA, 64 nt, Homo Sapiens
ggggcgaucaaguccagagcaaaccacguggugucccugcgaauugcgggccaccaaguucugg

SEQ ID NO: 618555 - RNA, 64 nt, Homo Sapiens
ccguccgcggggcuguggcugcugcugugcaugucccugcgaugggagucuugucucccagccu

SEQ ID NO: 618556 - RNA, 64 nt, Homo Sapiens
cacaucagugucucguuuacaucucacacagugacccugcgaggcaaggguuugcccaguuugc

SEQ ID NO: 618557 - RNA, 64 nt, Homo Sapiens
aggcaaaaaaguggaauuaaccacaugccaucuucccugcgaucaaggcuucaggaagggccag

SEQ ID NO: 618558 - RNA, 64 nt, Homo Sapiens
uaaguacugcuuccauucauggaaagccugguagcccugcgagugcucugcgugugguccguau

SEQ ID NO: 618559 - RNA, 64 nt, Homo Sapiens
gugccuggaguucccacgugugcccucggggggccccugcgagguccugggcuucugggccacc

SEQ ID NO: 618560 - RNA, 64 nt, Homo Sapiens
gcacaucgacauacccagggcaagcaacagcagacccugcgaaucggacuucagauacguuaag

SEQ ID NO: 618561 - RNA, 64 nt, Homo Sapiens
gugcuuucucaggaaccuuucaagcggccagaaccccugcgaaucacacaugaccuuugcggga

SEQ ID NO: 618562 - RNA, 64 nt, Homo Sapiens
augucggcuuccaagugaugcccuccugccacuccccugcgauuuauaagggaauuuuaauuuu

SEQ ID NO: 618563 - RNA, 64 nt, Homo Sapiens
ucccugcccugccgccacauccacaaucauggagcccugcgacccaugugcccucaaagcuguc

SEQ ID NO: 618564 - RNA, 64 nt, Homo Sapiens
uacccgcccugccgccacauccacaaucauggagcccugcgacccaugugcccuugaagcugcc

SEQ ID NO: 618565 - RNA, 64 nt, Homo Sapiens
cacacaugaccuuugcgggacaagcggccagaaccccugcgaauguacuuucucaggaaccuuu

SEQ ID NO: 618566 - RNA, 64 nt, Homo Sapiens
ccuagcugaacuaugguuuguaauaaguauuccccccugcgacacauauacagugcuuagcacu

SEQ ID NO: 618567 - RNA, 64 nt, Homo Sapiens
guguccccuguccccaccuguccagaaugcccugcccugcgagucccucaccuguacccacacc

SEQ ID NO: 618568 - RNA, 64 nt, Homo Sapiens
cccguggugucaccgggacuccaggcacccgcuccccugcgaccaugccaggcacgcugggagg

SEQ ID NO: 618569 - RNA, 64 nt, Homo Sapiens; identical to SEQ ID NO: 234150

SEQ ID NO: 618570 - RNA, 64 nt, Homo Sapiens; identical to SEQ ID NO: 234151

SEQ ID NO: 618571 - RNA, 64 nt, Homo Sapiens; identical to SEQ ID NO: 265005

SEQ ID NO: 618572 - RNA, 64 nt, Homo Sapiens; identical to SEQ ID NO: 265006

SEQ ID NO: 618573 - RNA, 64 nt, Homo Sapiens; identical to SEQ ID NO: 265007

SEQ ID NO: 618574 - RNA, 64 nt, Homo Sapiens; identical to SEQ ID NO: 265008

SEQ ID NO: 618575 - RNA, 64 nt, Homo Sapiens; identical to SEQ ID NO: 265009

SEQ ID NO: 618576 - RNA, 64 nt, Homo Sapiens; identical to SEQ ID NO: 265010

SEQ ID NO: 618577 - RNA, 64 nt, Homo Sapiens; identical to SEQ ID NO: 265011

SEQ ID NO: 618578 - RNA, 64 nt, Homo Sapiens; identical to SEQ ID NO: 265012

SEQ ID NO: 618579 - RNA, 64 nt, Homo Sapiens; identical to SEQ ID NO: 265013

SEQ ID NO: 618580 - RNA, 64 nt, Homo Sapiens; identical to SEQ ID NO: 265014

SEQ ID NO: 618581 - RNA, 64 nt, Homo Sapiens; identical to SEQ ID NO: 265015

SEQ ID NO: 618582 - RNA, 64 nt, Homo Sapiens; identical to SEQ ID NO: 265016

SEQ ID NO: 618583 - RNA, 64 nt, Homo Sapiens; identical to SEQ ID NO: 265017

SEQ ID NO: 618584 - RNA, 64 nt, Homo Sapiens; identical to SEQ ID NO: 265018

SEQ ID NO: 618585 - RNA, 64 nt, Homo Sapiens; identical to SEQ ID NO: 265019

SEQ ID NO: 618586 - RNA, 64 nt, Homo Sapiens; identical to SEQ ID NO: 265020

SEQ ID NO: 618587 - RNA, 64 nt, Homo Sapiens; identical to SEQ ID NO: 265021

SEQ ID NO: 618588 - RNA, 64 nt, Homo Sapiens; identical to SEQ ID NO: 265022

SEQ ID NO: 618589 - RNA, 64 nt, Homo Sapiens; identical to SEQ ID NO: 265023

SEQ ID NO: 618590 - RNA, 64 nt, Homo Sapiens; identical to SEQ ID NO: 265024

SEQ ID NO: 618591 - RNA, 64 nt, Homo Sapiens; identical to SEQ ID NO: 265025

SEQ ID NO: 618592 - RNA, 64 nt, Homo Sapiens; identical to SEQ ID NO: 265026

SEQ ID NO: 618593 - RNA, 64 nt, Homo Sapiens; identical to SEQ ID NO: 265027

SEQ ID NO: 618594 - RNA, 64 nt, Homo Sapiens; identical to SEQ ID NO: 265028

SEQ ID NO: 618595 - RNA, 64 nt, Homo Sapiens; identical to SEQ ID NO: 265029

SEQ ID NO: 618596 - RNA, 64 nt, Homo Sapiens; identical to SEQ ID NO: 265030

SEQ ID NO: 618597 - RNA, 64 nt, Homo Sapiens; identical to SEQ ID NO: 265031

SEQ ID NO: 618598 - RNA, 64 nt, Homo Sapiens; identical to SEQ ID NO: 265032

SEQ ID NO: 618599 - RNA, 64 nt, Homo Sapiens; identical to SEQ ID NO: 265033

SEQ ID NO: 618600 - RNA, 64 nt, Homo Sapiens; identical to SEQ ID NO: 265034

SEQ ID NO: 618601 - RNA, 64 nt, Homo Sapiens; identical to SEQ ID NO: 239110

SEQ ID NO: 618602 - RNA, 64 nt, Homo Sapiens; identical to SEQ ID NO: 239111

SEQ ID NO: 618603 - RNA, 64 nt, Homo Sapiens; identical to SEQ ID NO: 239112

SEQ ID NO: 618604 - RNA, 64 nt, Homo Sapiens; identical to SEQ ID NO: 239113

SEQ ID NO: 618605 - RNA, 64 nt, Homo Sapiens; identical to SEQ ID NO: 239114

SEQ ID NO: 618606 - RNA, 64 nt, Homo Sapiens; identical to SEQ ID NO: 239115

SEQ ID NO: 618607 - RNA, 64 nt, Homo Sapiens; identical to SEQ ID NO: 239116

SEQ ID NO: 618608 - RNA, 64 nt, Homo Sapiens; identical to SEQ ID NO: 239117

SEQ ID NO: 618609 - RNA, 64 nt, Homo Sapiens; identical to SEQ ID NO: 239118

SEQ ID NO: 618610 - RNA, 64 nt, Homo Sapiens; identical to SEQ ID NO: 239119

SEQ ID NO: 618611 - RNA, 54 nt, Homo Sapiens; identical to SEQ ID NO: 239120

SEQ ID NO: 618612 - RNA, 64 nt, Homo Sapiens; identical to SEQ ID NO: 239121

SEQ ID NO: 618613 - RNA, 64 nt, Homo Sapiens; identical to SEQ ID NO: 239122

SEQ ID NO: 618614 - RNA, 64 nt, Homo Sapiens; identical to SEQ ID NO: 239123

SEQ ID NO: 618615 - RNA, 64 nt, Homo Sapiens; identical to SEQ ID NO: 239124

SEQ ID NO: 618616 - RNA, 64 nt, Homo Sapiens; identical to SEQ ID NO: 239125

SEQ ID NO: 618617 - RNA, 64 nt, Homo Sapiens; identical to SEQ ID NO: 239126

SEQ ID NO: 618618 - RNA, 64 nt, Homo Sapiens; identical to SEQ ID NO: 239127

SEQ ID NO: 618619 - RNA, 64 nt, Homo Sapiens; identical to SEQ ID NO: 239128

SEQ ID NO: 618620 - RNA, 64 nt, Homo Sapiens; identical to SEQ ID NO: 239129

SEQ ID NO: 618621 - RNA, 64 nt, Homo Sapiens; identical to SEQ ID NO: 239130

SEQ ID NO: 618622 - RNA, 64 nt, Homo Sapiens; identical to SEQ ID NO: 239131

SEQ ID NO: 618623 - RNA, 64 nt, Homo Sapiens; identical to SEQ ID NO: 239132

SEQ ID NO: 618624 - RNA, 64 nt, Homo Sapiens; identical to SEQ ID NO: 239133

SEQ ID NO: 618625 - RNA, 64 nt, Homo Sapiens; identical to SEQ ID NO: 239134

SEQ ID NO: 618626 - RNA, 64 nt, Homo Sapiens; identical to SEQ ID NO: 239135

SEQ ID NO: 618627 - RNA, 64 nt, Homo Sapiens; identical to SEQ ID NO: 239136

SEQ ID NO: 618628 - RNA, 64 nt, Homo Sapiens; identical to SEQ ID NO: 239137

SEQ ID NO: 618629 - RNA, 64 nt, Homo Sapiens; identical to SEQ ID NO: 239138

SEQ ID NO: 618630 - RNA, 64 nt, Homo Sapiens; identical to SEQ ID NO: 239139

SEQ ID NO: 618631 - RNA, 64 nt, Homo Sapiens; identical to SEQ ID NO: 239140

SEQ ID NO: 618632 - RNA, 64 nt, Homo Sapiens; identical to SEQ ID NO: 239141

SEQ ID NO: 618633 - RNA, 64 nt, Homo Sapiens; identical to SEQ ID NO: 239142

SEQ ID NO: 618634 - RNA, 64 nt, Homo Sapiens; identical to SEQ ID NO: 239143

SEQ ID NO: 618635 - RNA, 64 nt, Homo Sapiens; identical to SEQ ID NO: 239144

SEQ ID NO: 618636 - RNA, 64 nt, Homo Sapiens; identical to SEQ ID NO: 239145

SEQ ID NO: 618637 - RNA, 64 nt, Homo Sapiens; identical to SEQ ID NO: 239146

SEQ ID NO: 618638 - RNA, 64 nt, Homo Sapiens; identical to SEQ ID NO: 239147

SEQ ID NO: 618639 - RNA, 64 nt, Homo Sapiens; identical to SEQ ID NO: 239148

SEQ ID NO: 618640 - RNA, 64 nt, Homo Sapiens; identical to SEQ ID NO: 239149

SEQ ID NO: 618641 - RNA, 64 nt, Homo Sapiens; identical to SEQ ID NO: 239150

SEQ ID NO: 618642 - RNA, 64 nt, Homo Sapiens; identical to SEQ ID NO: 239151

SEQ ID NO: 618643 - RNA, 64 nt, Homo Sapiens
ucauguuugagaauuuuuuuuguuuauaggaaaguaaugguaguaauuuucuauaaugguaaga

SEQ ID NO: 618644 - RNA, 64 nt, Homo Sapiens
auguuuauaggaaaguaauguuggaaauuuucuauaaugguaagaccuucugauuuugacauaa

SEQ ID NO: 618645 - RNA, 64 nt, Homo Sapiens
guugugaauuuucuuucuuaaaaauuguaaaacauaaugguacccaaguuuuaaacuuagaugu

SEQ ID NO: 618646 - RNA, 64 nt, Homo Sapiens
ccucuaguuuauuuauuugcucaucuuuaucaccuaaugguaguuuguuuucuuugguagagua

SEQ ID NO: 618647 - RNA, 64 nt, Homo Sapiens
ugucauggugcaauuugucuuuggaaaauucagauaaugguaauuuaguguauaugugauuuuc

SEQ ID NO: 618648 - RNA, 64 nt, Homo Sapiens
aaaaaaguugguauuuuauaagcacagacaauucuaaugguaacuuuuguagucuuaugaauag

SEQ ID NO: 618649 - RNA, 64 nt, Homo Sapiens
uggucuagaaguuuucguuuuguagccucugcauuaaugguaaaauccuuauagacugaaagaa

SEQ ID NO: 618650 - RNA, 64 nt, Homo Sapiens
cacaucuaauuuauaggguuuaaaacagggcuaauaaugguaauccaagcuuacuuuccaucua

SEQ ID NO: 618651 - RNA, 64 nt, Homo Sapiens
uaauuuuuguuuauugaauuuguaacuaaauaccuaaugguauuuuacauaggcuaaaaaacua

SEQ ID NO: 618652 - RNA, 64 nt, Homo Sapiens
cauuuuuauucugggauucgacaauugaguuuacuaaugguaaauguaaaaaaaauauauauaa

SEQ ID NO: 618653 - RNA, 64 nt, Homo Sapiens
cuaaacuuaauauuuuuauacuuuuuuaaaugaauaaugguagcaaaaacagccuucuagcaca

SEQ ID NO: 618654 - RNA, 64 nt, Homo Sapiens
cuggaaucccagauaugguuacucugcauguuuuuaaugguaaaaaaagaagaaaaucuucuuu

SEQ ID NO: 618655 - RNA, 64 nt, Homo Sapiens
ucacauucacagaaacauuggcagaacccaguuuuaaugguacagaggaguaguuuauaguguu

SEQ ID NO: 618656 - RNA, 64 nt, Homo Sapiens
ugaaacuuguuggguagaaugaaaauuaaagccauaaugguagaagauggcauacugauuauaa

SEQ ID NO: 618657 - RNA, 62 nt, Homo Sapiens
agauauuuugggcauguggguaguagagugauauggagcaagggcagagaaagggacaauga

SEQ ID NO: 618658 - RNA, 62 nt, Homo Sapiens
gugguagguacuuuuugugagagaucagaaaaauggagcaaaucuguuuccuguaccaguag

SEQ ID NO: 618659 - RNA, 62 nt, Homo Sapiens
cgugcugggcauggggccugcucacagacagcauggagcagggaugggcugucugugcccau

SEQ ID NO: 618660 - RNA, 62 nt, Homo Sapiens
aguggagggagacccagcauagccaggccaguauggagcaccucacgcacagcucucagaag

SEQ ID NO: 618661 - RNA, 62 nt, Homo Sapiens
cggugacccagagcagggacguccaggucugcauggagcacugcagcaggccaggccuuccu

SEQ ID NO: 618662 - RNA, 62 nt, Homo Sapiens
ggcacccuauggggcuaugaccaccagggaccauggagcaguaggcccagugcucuuccugc

SEQ ID NO: 618663 - RNA, 62 nt, Homo Sapiens
uuguuauaucugauuuucaucacaaucuuuauauggagcagcacuuuuuuaaaaguaggaac

SEQ ID NO: 618664 - RNA, 62 nt, Homo Sapiens
aaauuugggccuccaguauaaggaauaauuacauggagcaugcauuuuuuacacuaucauug

SEQ ID NO: 618665 - RNA, 62 nt, Homo Sapiens
gucaaauaugagcugauggacuagagguauggauggagcaagcacguggaauggaacagugg

SEQ ID NO: 618666 - RNA, 62 nt, Homo Sapiens
gugccuggccaagauucuuugggauuacaggcauggagcaccccucggccucccaaagugcu

SEQ ID NO: 618667 - RNA, 62 nt, Homo Sapiens
uccgggaugaggcccuggcagaggugaaggacauggagcagcugcuggcccuugggaaggag

SEQ ID NO: 618668 - RNA, 62 nt, Homo Sapiens
ucuccguccugcccaccuucuuaagaggcgagauggagcaggcccaucugccucugcccuuu

SEQ ID NO: 618669 - RNA, 62 nt, Homo Sapiens
gaacugugcuguuggaaaaugagagcgaucacauggagcaguaauggagcaaagaccagcca

SEQ ID NO: 618670 - RNA, 62 nt, Homo Sapiens
uuggaaaaugagagcgaucacauggagcaguaauggagcaaagaccagccaucccaguugag

SEQ ID NO: 618671 - RNA, 64 nt, Homo Sapiens; identical to SEQ ID NO: 612668

SEQ ID NO: 618672 - RNA, 64 nt, Homo Sapiens; identical to SEQ ID NO: 612669

SEQ ID NO: 618673 - RNA, 64 nt, Homo Sapiens; identical to SEQ ID NO: 612670

SEQ ID NO: 618674 - RNA, 64 nt, Homo Sapiens; identical to SEQ ID NO: 612671

SEQ ID NO: 618675 - RNA, 64 nt, Homo Sapiens; identical to SEQ ID NO: 612672

SEQ ID NO: 618676 - RNA, 64 nt, Homo Sapiens; identical to SEQ ID NO: 612673

SEQ ID NO: 618677 - RNA, 64 nt, Homo Sapiens; identical to SEQ ID NO: 612674

SEQ ID NO: 618678 - RNA, 64 nt, Homo Sapiens; identical to SEQ ID NO: 612675

SEQ ID NO: 618679 - RNA, 64 nt, Homo Sapiens; identical to SEQ ID NO: 612676

SEQ ID NO: 618680 - RNA, 64 nt, Homo Sapiens; identical to SEQ ID NO: 612677

SEQ ID NO: 618681 - RNA, 64 nt, Homo Sapiens; identical to SEQ ID NO: 612678

SEQ ID NO: 618682 - RNA, 64 nt, Homo Sapiens; identical to SEQ ID NO: 612679

SEQ ID NO: 618683 - RNA, 64 nt, Homo Sapiens; identical to SEQ ID NO: 307734

SEQ ID NO: 618684 - RNA, 64 nt, Homo Sapiens; identical to SEQ ID NO: 307735

SEQ ID NO: 618685 - RNA, 64 nt, Homo Sapiens; identical to SEQ ID NO: 307736

SEQ ID NO: 618686 - RNA, 64 nt, Homo Sapiens; identical to SEQ ID NO: 307737

SEQ ID NO: 618687 - RNA, 64 nt, Homo Sapiens; identical to SEQ ID NO: 307738

SEQ ID NO: 618688 - RNA, 64 nt, Homo Sapiens; identical to SEQ ID NO: 307739

SEQ ID NO: 618689 - RNA, 64 nt, Homo Sapiens; identical to SEQ ID NO: 307740

SEQ ID NO: 618690 - RNA, 64 nt, Homo Sapiens; identical to SEQ ID NO: 307741

SEQ ID NO: 618691 - RNA, 59 nt, Homo Sapiens; identical to SEQ ID NO: 307742

SEQ ID NO: 618692 - RNA, 64 nt, Homo Sapiens; identical to SEQ ID NO: 307743

SEQ ID NO: 618693 - RNA, 64 nt, Homo Sapiens; identical to SEQ ID NO: 307744

SEQ ID NO: 618694 - RNA, 64 nt, Homo Sapiens; identical to SEQ ID NO: 307745

SEQ ID NO: 618695 - RNA, 64 nt, Homo Sapiens; identical to SEQ ID NO: 307746

SEQ ID NO: 618696 - RNA, 64 nt, Homo Sapiens; identical to SEQ ID NO: 307747

SEQ ID NO: 618697 - RNA, 64 nt, Homo Sapiens; identical to SEQ ID NO: 307748

SEQ ID NO: 618698 - RNA, 64 nt, Homo Sapiens; identical to SEQ ID NO: 307749

SEQ ID NO: 618699 - RNA, 64 nt, Homo Sapiens; identical to SEQ ID NO: 307750

SEQ ID NO: 618700 - RNA, 64 nt, Homo Sapiens; identical to SEQ ID NO: 307751

SEQ ID NO: 618701 - RNA, 64 nt, Homo Sapiens; identical to SEQ ID NO: 307752

SEQ ID NO: 618702 - RNA, 64 nt, Homo Sapiens; identical to SEQ ID NO: 307753

SEQ ID NO: 618703 - RNA, 64 nt, Homo Sapiens; identical to SEQ ID NO: 307754

SEQ ID NO: 618704 - RNA, 64 nt, Homo Sapiens; identical to SEQ ID NO: 307755

SEQ ID NO: 618705 - RNA, 64 nt, Homo Sapiens; identical to SEQ ID NO: 307756

SEQ ID NO: 618706 - RNA, 64 nt, Homo Sapiens; identical to SEQ ID NO: 307757

SEQ ID NO: 618707 - RNA, 64 nt, Homo Sapiens; identical to SEQ ID NO: 307758

SEQ ID NO: 618708 - RNA, 64 nt, Homo Sapiens; identical to SEQ ID NO: 307759

SEQ ID NO: 618709 - RNA, 64 nt, Homo Sapiens; identical to SEQ ID NO: 307760

SEQ ID NO: 618710 - RNA, 64 nt, Homo Sapiens; identical to SEQ ID NO: 307761

SEQ ID NO: 618711 - RNA, 64 nt, Homo Sapiens; identical to SEQ ID NO: 307762

SEQ ID NO: 618712 - RNA, 64 nt, Homo Sapiens; identical to SEQ ID NO: 307763

SEQ ID NO: 618713 - RNA, 64 nt, Homo Sapiens; identical to SEQ ID NO: 307764

SEQ ID NO: 618714 - RNA, 64 nt, Homo Sapiens; identical to SEQ ID NO: 307765

SEQ ID NO: 618715 - RNA, 64 nt, Homo Sapiens; identical to SEQ ID NO: 307766

SEQ ID NO: 618716 - RNA, 64 nt, Homo Sapiens; identical to SEQ ID NO: 307767

SEQ ID NO: 618717 - RNA, 64 nt, Homo Sapiens; identical to SEQ ID NO: 307768

SEQ ID NO: 618718 - RNA, 64 nt, Homo Sapiens; identical to SEQ ID NO: 307769

SEQ ID NO: 618719 - RNA, 64 nt, Homo Sapiens; identical to SEQ ID NO: 307770

SEQ ID NO: 618720 - RNA, 64 nt, Homo Sapiens; identical to SEQ ID NO: 307771

SEQ ID NO: 618721 - RNA, 64 nt, Homo Sapiens; identical to SEQ ID NO: 307772

SEQ ID NO: 618722 - RNA, 64 nt, Homo Sapiens; identical to SEQ ID NO: 307773

SEQ ID NO: 618723 - RNA, 64 nt, Homo Sapiens; identical to SEQ ID NO: 307774

SEQ ID NO: 618724 - RNA, 64 nt, Homo Sapiens; identical to SEQ ID NO: 307775

SEQ ID NO: 618725 - RNA, 64 nt, Homo Sapiens; identical to SEQ ID NO: 307776

SEQ ID NO: 618726 - RNA, 64 nt, Homo Sapiens; identical to SEQ ID NO: 307777

SEQ ID NO: 618727 - RNA, 64 nt, Homo Sapiens; identical to SEQ ID NO: 307778

SEQ ID NO: 618728 - RNA, 64 nt, Homo Sapiens; identical to SEQ ID NO: 307779

SEQ ID NO: 618729 - RNA, 64 nt, Homo Sapiens; identical to SEQ ID NO: 307780

SEQ ID NO: 618730 - RNA, 64 nt, Homo Sapiens; identical to SEQ ID NO: 307781

SEQ ID NO: 618731 - RNA, 64 nt, Homo Sapiens; identical to SEQ ID NO: 307782

SEQ ID NO: 618732 - RNA, 64 nt, Homo Sapiens; identical to SEQ ID NO: 307783

SEQ ID NO: 618733 - RNA, 64 nt, Homo Sapiens; identical to SEQ ID NO: 307784

SEQ ID NO: 618734 - RNA, 64 nt, Homo Sapiens; identical to SEQ ID NO: 307785

SEQ ID NO: 618735 - RNA, 64 nt, Homo Sapiens; identical to SEQ ID NO: 307786

SEQ ID NO: 618736 - RNA, 64 nt, Homo Sapiens; identical to SEQ ID NO: 307787

SEQ ID NO: 618737 - RNA, 64 nt, Homo Sapiens; identical to SEQ ID NO: 307788

SEQ ID NO: 618738 - RNA, 64 nt, Homo Sapiens; identical to SEQ ID NO: 307789

SEQ ID NO: 618739 - RNA, 64 nt, Homo Sapiens; identical to SEQ ID NO: 307790

SEQ ID NO: 618740 - RNA, 64 nt, Homo Sapiens; identical to SEQ ID NO: 307791

SEQ ID NO: 618741 - RNA, 64 nt, Homo Sapiens; identical to SEQ ID NO: 307792

SEQ ID NO: 618742 - RNA, 64 nt, Homo Sapiens; identical to SEQ ID NO: 307793

SEQ ID NO: 618743 - RNA, 64 nt, Homo Sapiens; identical to SEQ ID NO: 307794

SEQ ID NO: 618744 - RNA, 64 nt, Homo Sapiens; identical to SEQ ID NO: 307795

SEQ ID NO: 618745 - RNA, 64 nt, Homo Sapiens; identical to SEQ ID NO: 307796

SEQ ID NO: 618746 - RNA, 62 nt, Homo Sapiens; identical to SEQ ID NO: 307797

SEQ ID NO: 618747 - RNA, 64 nt, Homo Sapiens; identical to SEQ ID NO: 307798

SEQ ID NO: 618748 - RNA, 64 nt, Homo Sapiens; identical to SEQ ID NO: 307799

SEQ ID NO: 618749 - RNA, 64 nt, Homo Sapiens; identical to SEQ ID NO: 307800

SEQ ID NO: 618750 - RNA, 64 nt, Homo Sapiens; identical to SEQ ID NO: 307801

SEQ ID NO: 618751 - RNA, 64 nt, Homo Sapiens; identical to SEQ ID NO: 307802

SEQ ID NO: 618752 - RNA, 64 nt, Homo Sapiens; identical to SEQ ID NO: 307803

SEQ ID NO: 618753 - RNA, 64 nt, Homo Sapiens; identical to SEQ ID NO: 307804

SEQ ID NO: 618754 - RNA, 64 nt, Homo Sapiens; identical to SEQ ID NO: 307805

SEQ ID NO: 618755 - RNA, 64 nt, Homo Sapiens; identical to SEQ ID NO: 307806

SEQ ID NO: 618756 - RNA, 64 nt, Homo Sapiens; identical to SEQ ID NO: 307807

SEQ ID NO: 618757 - RNA, 64 nt, Homo Sapiens; identical to SEQ ID NO: 307808

SEQ ID NO: 618758 - RNA, 64 nt, Homo Sapiens; identical to SEQ ID NO: 307809

SEQ ID NO: 618759 - RNA, 64 nt, Homo Sapiens; identical to SEQ ID NO: 357989

SEQ ID NO: 618760 - RNA, 64 nt, Homo Sapiens; identical to SEQ ID NO: 357990

SEQ ID NO: 618761 - RNA, 64 nt, Homo Sapiens; identical to SEQ ID NO: 357991

SEQ ID NO: 618762 - RNA, 64 nt, Homo Sapiens; identical to SEQ ID NO: 357992

SEQ ID NO: 618763 - RNA, 64 nt, Homo Sapiens; identical to SEQ ID NO: 357993

SEQ ID NO: 618764 - RNA, 64 nt, Homo Sapiens; identical to SEQ ID NO: 357994

SEQ ID NO: 618765 - RNA, 64 nt, Homo Sapiens; identical to SEQ ID NO: 357995

SEQ ID NO: 618766 - RNA, 64 nt, Homo Sapiens; identical to SEQ ID NO: 357996

SEQ ID NO: 618767 - RNA, 64 nt, Homo Sapiens; identical to SEQ ID NO: 357997

SEQ ID NO: 618768 - RNA, 64 nt, Homo Sapiens; identical to SEQ ID NO: 357998

SEQ ID NO: 618769 - RNA, 64 nt, Homo Sapiens; identical to SEQ ID NO: 357999

SEQ ID NO: 618770 - RNA, 64 nt, Homo Sapiens; identical to SEQ ID NO: 358000

SEQ ID NO: 618771 - RNA, 64 nt, Homo Sapiens; identical to SEQ ID NO: 358001

SEQ ID NO: 618772 - RNA, 64 nt, Homo Sapiens; identical to SEQ ID NO: 358002

SEQ ID NO: 618773 - RNA, 64 nt, Homo Sapiens; identical to SEQ ID NO: 358003

SEQ ID NO: 618774 - RNA, 64 nt, Homo Sapiens; identical to SEQ ID NO: 358004

SEQ ID NO: 618775 - RNA, 64 nt, Homo Sapiens; identical to SEQ ID NO: 358005

SEQ ID NO: 618776 - RNA, 64 nt, Homo Sapiens; identical to SEQ ID NO: 358006

SEQ ID NO: 618777 - RNA, 64 nt, Homo Sapiens; identical to SEQ ID NO: 358007

SEQ ID NO: 618778 - RNA, 64 nt, Homo Sapiens; identical to SEQ ID NO: 358008

SEQ ID NO: 618779 - RNA, 64 nt, Homo Sapiens; identical to SEQ ID NO: 358009

SEQ ID NO: 618780 - RNA, 64 nt, Homo Sapiens; identical to SEQ ID NO: 358010

SEQ ID NO: 618781 - RNA, 64 nt, Homo Sapiens; identical to SEQ ID NO: 358011

SEQ ID NO: 618782 - RNA, 64 nt, Homo Sapiens; identical to SEQ ID NO: 358012

SEQ ID NO: 618783 - RNA, 64 nt, Homo Sapiens; identical to SEQ ID NO: 358013

SEQ ID NO: 618784 - RNA, 64 nt, Homo Sapiens; identical to SEQ ID NO: 358014

SEQ ID NO: 618785 - RNA, 64 nt, Homo Sapiens; identical to SEQ ID NO: 358015

SEQ ID NO: 618786 - RNA, 64 nt, Homo Sapiens; identical to SEQ ID NO: 358016

SEQ ID NO: 618787 - RNA, 64 nt, Homo Sapiens; identical to SEQ ID NO: 358017

SEQ ID NO: 618788 - RNA, 64 nt, Homo Sapiens; identical to SEQ ID NO: 358018

SEQ ID NO: 618789 - RNA, 64 nt, Homo Sapiens; identical to SEQ ID NO: 358019

SEQ ID NO: 618790 - RNA, 64 nt, Homo Sapiens; identical to SEQ ID NO: 358020

SEQ ID NO: 618791 - RNA, 64 nt, Homo Sapiens; identical to SEQ ID NO: 358021

SEQ ID NO: 618792 - RNA, 64 nt, Homo Sapiens; identical to SEQ ID NO: 358022

SEQ ID NO: 618793 - RNA, 64 nt, Homo Sapiens; identical to SEQ ID NO: 358023

SEQ ID NO: 618794 - RNA, 64 nt, Homo Sapiens; identical to SEQ ID NO: 358024

SEQ ID NO: 618795 - RNA, 64 nt, Homo Sapiens; identical to SEQ ID NO: 358025

SEQ ID NO: 618796 - RNA, 64 nt, Homo Sapiens; identical to SEQ ID NO: 358026

SEQ ID NO: 618797 - RNA, 64 nt, Homo Sapiens; identical to SEQ ID NO: 358027

SEQ ID NO: 618798 - RNA, 64 nt, Homo Sapiens; identical to SEQ ID NO: 358028

SEQ ID NO: 618799 - RNA, 64 nt, Homo Sapiens; identical to SEQ ID NO: 358029

SEQ ID NO: 618800 - RNA, 64 nt, Homo Sapiens; identical to SEQ ID NO: 358030

SEQ ID NO: 618801 - RNA, 64 nt, Homo Sapiens; identical to SEQ ID NO: 358031

SEQ ID NO: 618802 - RNA, 64 nt, Homo Sapiens; identical to SEQ ID NO: 358032

SEQ ID NO: 618803 - RNA, 64 nt, Homo Sapiens; identical to SEQ ID NO: 358033

SEQ ID NO: 618804 - RNA, 64 nt, Homo Sapiens; identical to SEQ ID NO: 358034

SEQ ID NO: 618805 - RNA, 64 nt, Homo Sapiens; identical to SEQ ID NO: 358035

SEQ ID NO: 618806 - RNA, 64 nt, Homo Sapiens; identical to SEQ ID NO: 358036

SEQ ID NO: 618807 - RNA, 64 nt, Homo Sapiens; identical to SEQ ID NO: 358037

SEQ ID NO: 618808 - RNA, 64 nt, Homo Sapiens; identical to SEQ ID NO: 358038

SEQ ID NO: 618809 - RNA, 64 nt, Homo Sapiens; identical to SEQ ID NO: 358039

SEQ ID NO: 618810 - RNA, 64 nt, Homo Sapiens; identical to SEQ ID NO: 358040

SEQ ID NO: 618811 - RNA, 64 nt, Homo Sapiens; identical to SEQ ID NO: 358041

SEQ ID NO: 618812 - RNA, 64 nt, Homo Sapiens; identical to SEQ ID NO: 358042

SEQ ID NO: 618813 - RNA, 64 nt, Homo Sapiens; identical to SEQ ID NO: 358043

SEQ ID NO: 618814 - RNA, 64 nt, Homo Sapiens; identical to SEQ ID NO: 358044

SEQ ID NO: 618815 - RNA, 64 nt, Homo Sapiens; identical to SEQ ID NO: 358045

SEQ ID NO: 618816 - RNA, 64 nt, Homo Sapiens; identical to SEQ ID NO: 358046

SEQ ID NO: 618817 - RNA, 64 nt, Homo Sapiens; identical to SEQ ID NO: 358047

SEQ ID NO: 618818 - RNA, 64 nt, Homo Sapiens; identical to SEQ ID NO: 358048

SEQ ID NO: 618819 - RNA, 64 nt, Homo Sapiens; identical to SEQ ID NO: 358049

SEQ ID NO: 618820 - RNA, 64 nt, Homo Sapiens; identical to SEQ ID NO: 358050

SEQ ID NO: 618821 - RNA, 64 nt, Homo Sapiens; identical to SEQ ID NO: 358051

SEQ ID NO: 618822 - RNA, 64 nt, Homo Sapiens; identical to SEQ ID NO: 358052

SEQ ID NO: 618823 - RNA, 64 nt, Homo Sapiens; identical to SEQ ID NO: 358053

SEQ ID NO: 618824 - RNA, 64 nt, Homo Sapiens; identical to SEQ ID NO: 358054

SEQ ID NO: 618825 - RNA, 64 nt, Homo Sapiens; identical to SEQ ID NO: 358055

SEQ ID NO: 618826 - RNA, 64 nt, Homo Sapiens; identical to SEQ ID NO: 358056

SEQ ID NO: 618827 - RNA, 64 nt, Homo Sapiens; identical to SEQ ID NO: 358057

SEQ ID NO: 618828 - RNA, 64 nt, Homo Sapiens; identical to SEQ ID NO: 358058

SEQ ID NO: 618829 - RNA, 64 nt, Homo Sapiens; identical to SEQ ID NO: 358059

SEQ ID NO: 618830 - RNA, 64 nt, Homo Sapiens; identical to SEQ ID NO: 358060

SEQ ID NO: 618831 - RNA, 64 nt, Homo Sapiens; identical to SEQ ID NO: 358061

SEQ ID NO: 618832 - RNA, 64 nt, Homo Sapiens; identical to SEQ ID NO: 75323

SEQ ID NO: 618833 - RNA, 64 nt, Homo Sapiens; identical to SEQ ID NO: 75324

SEQ ID NO: 618834 - RNA, 64 nt, Homo Sapiens; identical to SEQ ID NO: 75325

SEQ ID NO: 618835 - RNA, 64 nt, Homo Sapiens; identical to SEQ ID NO: 75326

SEQ ID NO: 618836 - RNA, 64 nt, Homo Sapiens; identical to SEQ ID NO: 75327

SEQ ID NO: 618837 - RNA, 64 nt, Homo Sapiens; identical to SEQ ID NO: 75328

SEQ ID NO: 618838 - RNA, 64 nt, Homo Sapiens; identical to SEQ ID NO: 75329

SEQ ID NO: 618839 - RNA, 64 nt, Homo Sapiens; identical to SEQ ID NO: 75330

SEQ ID NO: 618840 - RNA, 64 nt, Homo Sapiens; identical to SEQ ID NO: 75331

SEQ ID NO: 618841 - RNA, 64 nt, Homo Sapiens; identical to SEQ ID NO: 75332

SEQ ID NO: 618842 - RNA, 64 nt, Homo Sapiens; identical to SEQ ID NO: 75333

SEQ ID NO: 618843 - RNA, 64 nt, Homo Sapiens; identical to SEQ ID NO: 75334

SEQ ID NO: 618844 - RNA, 64 nt, Homo Sapiens; identical to SEQ ID NO: 75335

SEQ ID NO: 618845 - RNA, 64 nt, Homo Sapiens; identical to SEQ ID NO: 75336

SEQ ID NO: 618846 - RNA, 64 nt, Homo Sapiens; identical to SEQ ID NO: 75337

SEQ ID NO: 618847 - RNA, 64 nt, Homo Sapiens; identical to SEQ ID NO: 75338

SEQ ID NO: 618848 - RNA, 64 nt, Homo Sapiens; identical to SEQ ID NO: 75339

SEQ ID NO: 618849 - RNA, 64 nt, Homo Sapiens; identical to SEQ ID NO: 75340

SEQ ID NO: 618850 - RNA, 64 nt, Homo Sapiens; identical to SEQ ID NO: 75341

SEQ ID NO: 618851 - RNA, 64 nt, Homo Sapiens; identical to SEQ ID NO: 75342

SEQ ID NO: 618852 - RNA, 64 nt, Homo Sapiens; identical to SEQ ID NO: 75343

SEQ ID NO: 618853 - RNA, 64 nt, Homo Sapiens; identical to SEQ ID NO: 75344

SEQ ID NO: 618854 - RNA, 64 nt, Homo Sapiens
auuauacauccuuuaauuaaaaacuauauauguaacuucuuagauauuagcaaaugucucugcu

SEQ ID NO: 618855 - RNA, 64 nt, Homo Sapiens
aaucuaaaugcuggcucaaauuuauuccccagcuacuucuuauaccacuauucuuuuaauguuu

SEQ ID NO: 618856 - RNA, 64 nt, Homo Sapiens
agacuacauuugaaauccaaacuuggaguauauaacuucuuauugagcccaacugcuuuuuuuu

SEQ ID NO: 618857 - RNA, 64 nt, Homo Sapiens
gagacccagccgcgucucacacagguggaauugcacuucuuaacaaaaaggaacuuuauaaaag

SEQ ID NO: 618858 - RNA, 64 nt, Homo Sapiens
uuguggcaagaaaaaaugaggggaggcaaaagacacuucuuacaggaggccucagaaucauggu

SEQ ID NO: 618859 - RNA, 64 nt, Homo Sapiens
uggcagcaagagaaaaugaggggaggugaaaggcacuucuuacaggaggccucagaaucauggc

SEQ ID NO: 618860 - RNA, 64 nt, Homo Sapiens
gaaguuugaaaucaguaaaaaguaaauugcauggacuucuuaaaugcuuuugggucuucuccaa

SEQ ID NO: 618861 - RNA, 64 nt, Homo Sapiens
auuguagcagaaaauuccaauggguaaguuaagcacuucuuaacgagcagucgaagugguagua

SEQ ID NO: 618862 - RNA, 64 nt, Homo Sapiens
gggaauaaucugacuucguuggcaguuggccuuaacuucuuaaucauugauccaggaauauuuc

SEQ ID NO: 618863 - RNA, 64 nt, Homo Sapiens
acuacaauguaaaaccucaauaaaagugcgcuguacuucuuaauguuuauuaaaagauguauuu

SEQ ID NO: 618864 - RNA, 64 nt, Homo Sapiens
augaguguaugucugaaccuguaauucuuaaaagacuucuuaaucuucuagaagaaaaaucucc

SEQ ID NO: 618865 - RNA, 64 nt, Homo Sapiens
uuggauaaaauugaaccaacuucaagaaugcagcacuucuuaaucuuuagcucuuucuugggag

SEQ ID NO: 618866 - RNA, 64 nt, Homo Sapiens
accuccgauuggaacgcgccucuguggaucucugacuucuuauuuggucuccaauugcaugguc

SEQ ID NO: 618867 - RNA, 64 nt, Homo Sapiens
accacguuguuggccuccauugggauguuaaaccacuucuuauugaaugccagaugggaugaga

SEQ ID NO: 618868 - RNA, 64 nt, Homo Sapiens
gagccuucacugguucugcaucacccgccccuggacuucuuaguuguuucucuagcgcugagcu

SEQ ID NO: 618869 - RNA, 64 nt, Homo Sapiens
ugcguaauuuaauggggucuguaaauacuggugcacuucuuacgacuuuuuugagacaugggau

SEQ ID NO: 618870 - RNA, 64 nt, Homo Sapiens
cucagugcuagcuuauuuguauuuuuccucuuucacuucuuauggaggagaguguuuaacugag

SEQ ID NO: 618871 - RNA, 64 nt, Homo Sapiens
guccugacacaccuuuugggaaaugcugauuuaaacuucuuaacuggcaacaguuggaacagua

SEQ ID NO: 618872 - RNA, 64 nt, Homo Sapiens; identical to SEQ ID NO: 52870

SEQ ID NO: 618873 - RNA, 64 nt, Homo Sapiens; identical to SEQ ID NO: 52871

SEQ ID NO: 618874 - RNA, 64 nt, Homo Sapiens; identical to SEQ ID NO: 52872

SEQ ID NO: 618875 - RNA, 64 nt, Homo Sapiens; identical to SEQ ID NO: 52873

SEQ ID NO: 618876 - RNA, 64 nt, Homo Sapiens; identical to SEQ ID NO: 52874

SEQ ID NO: 618877 - RNA, 64 nt, Homo Sapiens; identical to SEQ ID NO: 83782

SEQ ID NO: 618878 - RNA, 64 nt, Homo Sapiens; identical to SEQ ID NO: 83783

SEQ ID NO: 618879 - RNA, 64 nt, Homo Sapiens; identical to SEQ ID NO: 83784

SEQ ID NO: 618880 - RNA, 64 nt, Homo Sapiens; identical to SEQ ID NO: 83785

SEQ ID NO: 618881 - RNA, 64 nt, Homo Sapiens; identical to SEQ ID NO: 83786

SEQ ID NO: 618882 - RNA, 64 nt, Homo Sapiens; identical to SEQ ID NO: 83787

SEQ ID NO: 618883 - RNA, 64 nt, Homo Sapiens; identical to SEQ ID NO: 83788

SEQ ID NO: 618884 - RNA, 64 nt, Homo Sapiens; identical to SEQ ID NO: 83789

SEQ ID NO: 618885 - RNA, 64 nt, Homo Sapiens; identical to SEQ ID NO: 83790

SEQ ID NO: 618886 - RNA, 64 nt, Homo Sapiens; identical to SEQ ID NO: 83791

SEQ ID NO: 618887 - RNA, 64 nt, Homo Sapiens; identical to SEQ ID NO: 83792

SEQ ID NO: 618888 - RNA, 64 nt, Homo Sapiens; identical to SEQ ID NO: 83793

SEQ ID NO: 618889 - RNA, 64 nt, Homo Sapiens; identical to SEQ ID NO: 83794

SEQ ID NO: 618890 - RNA, 64 nt, Homo Sapiens; identical to SEQ ID NO: 83795

SEQ ID NO: 618891 - RNA, 64 nt, Homo Sapiens; identical to SEQ ID NO: 83796

SEQ ID NO: 618892 - RNA, 64 nt, Homo Sapiens; identical to SEQ ID NO: 83797

SEQ ID NO: 618893 - RNA, 64 nt, Homo Sapiens; identical to SEQ ID NO: 83798

SEQ ID NO: 618894 - RNA, 64 nt, Homo Sapiens; identical to SEQ ID NO: 83799

SEQ ID NO: 618895 - RNA, 64 nt, Homo Sapiens; identical to SEQ ID NO: 83800

SEQ ID NO: 618896 - RNA, 64 nt, Homo Sapiens; identical to SEQ ID NO: 83801

SEQ ID NO: 618897 - RNA, 64 nt, Homo Sapiens; identical to SEQ ID NO: 83802

SEQ ID NO: 618898 - RNA, 64 nt, Homo Sapiens; identical to SEQ ID NO: 83803

SEQ ID NO: 618899 - RNA, 64 nt, Homo Sapiens; identical to SEQ ID NO: 83804

SEQ ID NO: 618900 - RNA, 64 nt, Homo Sapiens; identical to SEQ ID NO: 83805

SEQ ID NO: 618901 - RNA, 64 nt, Homo Sapiens; identical to SEQ ID NO: 83806

SEQ ID NO: 618902 - RNA, 64 nt, Homo Sapiens; identical to SEQ ID NO: 83807

SEQ ID NO: 618903 - RNA, 64 nt, Homo Sapiens; identical to SEQ ID NO: 83808

SEQ ID NO: 618904 - RNA, 64 nt, Homo Sapiens; identical to SEQ ID NO: 83809

SEQ ID NO: 618905 - RNA, 64 nt, Homo Sapiens; identical to SEQ ID NO: 83810

SEQ ID NO: 618906 - RNA, 64 nt, Homo Sapiens; identical to SEQ ID NO: 83811

SEQ ID NO: 618907 - RNA, 64 nt, Homo Sapiens; identical to SEQ ID NO: 83812

SEQ ID NO: 618908 - RNA, 64 nt, Homo Sapiens; identical to SEQ ID NO: 83813

SEQ ID NO: 618909 - RNA, 64 nt, Homo Sapiens; identical to SEQ ID NO: 282954

SEQ ID NO: 618910 - RNA, 64 nt, Homo Sapiens; identical to SEQ ID NO: 282955

SEQ ID NO: 618911 - RNA, 64 nt, Homo Sapiens; identical to SEQ ID NO: 282956

SEQ ID NO: 618912 - RNA, 64 nt, Homo Sapiens; identical to SEQ ID NO: 282957

SEQ ID NO: 618913 - RNA, 64 nt, Homo Sapiens
cugggaaagucugaaggaauuuagguaaaaaucacauuaugaaauugagcuuugcagguucaau

SEQ ID NO: 618914 - RNA, 64 nt, Homo Sapiens
aaugcuuccagucacaaaaaagugcuuaauucaccauuaugagagauugacuuuauuuuuuuau

SEQ ID NO: 618915 - RNA, 64 nt, Homo Sapiens
guuguugagacuaggauuuuguuugguauuuuugcauuaugacaauuuccccacaagaucugaa

SEQ ID NO: 618916 - RNA, 64 nt, Homo Sapiens
gaaaagcauaaaacaaaaaugagcuauacuuuaacauuaugagaaauuuugaaaucguauauau

SEQ ID NO: 618917 - RNA, 55 nt, Homo Sapiens
auuuuauucccaucaauugagaaaccauuaugaagaagagaguccauauuucaau

SEQ ID NO: 618918 - RNA, 64 nt, Homo Sapiens
gaaagcaucacuugggauuaauauggggaugcagcauuaugaugugggucaaggaauuaaguua

SEQ ID NO: 618919 - RNA, 64 nt, Homo Sapiens
uuuucccaauaaaccagguacuaauuguaguuuucauuaugaaguuuguaaguuguggaaaaag

SEQ ID NO: 618920 - RNA, 64 nt, Homo Sapiens
uuuuaccauuucgacuuacaugcaucggauaggucauuaugauuucugaauagcauauauauga

SEQ ID NO: 618921 - RNA, 64 nt, Homo Sapiens
uaaaagcugugguauguuagaaggcaucuaugggcauuaugagcguuuugaauggcauuucauu

SEQ ID NO: 618922 - RNA, 64 nt, Homo Sapiens
acagcagaacauuugcuggcggggcuaaggcauccauuaugaaucccccucccuaauugcagug

SEQ ID NO: 618923 - RNA, 64 nt, Homo Sapiens
cuaccauauuuaaaaauaucucaagguuucuguucauuaugaaacaucaauauguuuucuacca

SEQ ID NO: 618924 - RNA, 64 nt, Homo Sapiens
gaauuuacccucauauucuuuaaaaaacuuaaagcauuaugaauguagagaaauucaccagagc

SEQ ID NO: 618925 - RNA, 64 nt, Homo Sapiens; identical to SEQ ID NO: 23238

SEQ ID NO: 618926 - RNA, 64 nt, Homo Sapiens; identical to SEQ ID NO: 23239

SEQ ID NO: 618927 - RNA, 64 nt, Homo Sapiens; identical to SEQ ID NO: 23240

SEQ ID NO: 618928 - RNA, 64 nt, Homo Sapiens; identical to SEQ ID NO: 23241

SEQ ID NO: 618929 - RNA, 64 nt, Homo Sapiens; identical to SEQ ID NO: 123292

SEQ ID NO: 618930 - RNA, 64 nt, Homo Sapiens; identical to SEQ ID NO: 123293

SEQ ID NO: 618931 - RNA, 64 nt, Homo Sapiens; identical to SEQ ID NO: 123294

SEQ ID NO: 618932 - RNA, 64 nt, Homo Sapiens; identical to SEQ ID NO: 123295

SEQ ID NO: 618933 - RNA, 64 nt, Homo Sapiens; identical to SEQ ID NO: 123296

SEQ ID NO: 618934 - RNA, 64 nt, Homo Sapiens; identical to SEQ ID NO: 123297

SEQ ID NO: 618935 - RNA, 64 nt, Homo Sapiens; identical to SEQ ID NO: 123298

SEQ ID NO: 618936 - RNA, 64 nt, Homo Sapiens; identical to SEQ ID NO: 123299

SEQ ID NO: 618937 - RNA, 64 nt, Homo Sapiens; identical to SEQ ID NO: 123300

SEQ ID NO: 618938 - RNA, 64 nt, Homo Sapiens; identical to SEQ ID NO: 123301

SEQ ID NO: 618939 - RNA, 64 nt, Homo Sapiens; identical to SEQ ID NO: 123302

SEQ ID NO: 618940 - RNA, 64 nt, Homo Sapiens; identical to SEQ ID NO: 123303

SEQ ID NO: 618941 - RNA, 64 nt, Homo Sapiens; identical to SEQ ID NO: 123304

SEQ ID NO: 618942 - RNA, 64 nt, Homo Sapiens; identical to SEQ ID NO: 123305

SEQ ID NO: 618943 - RNA, 64 nt, Homo Sapiens; identical to SEQ ID NO: 123306

SEQ ID NO: 618944 - RNA, 64 nt, Homo Sapiens; identical to SEQ ID NO: 123307

SEQ ID NO: 618945 - RNA, 64 nt, Homo Sapiens
uguagcaaagcuuuuuaggagagcuuaauugugugaguagaauaacaacuugcauacuuugaug

SEQ ID NO: 618946 - RNA, 64 nt, Homo Sapiens
cccuuuggaucauuuuauuauuaugugaacaagugaguagaaaccaggaaugauggggucuggu

SEQ ID NO: 618947 - RNA, 64 nt, Homo Sapiens
aggaguacacagaauagaauuuagacugucccuugaguagaauccacugauuuucuguggcucc

SEQ ID NO: 618948 - RNA, 64 nt, Homo Sapiens
aacuguacuaaucccuuuccccagauuguaucaugaguagaaucagguucacguggugcuucaa

SEQ ID NO: 618949 - RNA, 64 nt, Homo Sapiens
uguggccagggguugggagaacuuuacaaacauuaggaccuaacacugucucaucgcugaaaua

SEQ ID NO: 618950 - RNA, 64 nt, Homo Sapiens
aagguccugugugacccucucugcaucuguccccaggaccuaugcucccugcucacccccuucu

SEQ ID NO: 618951 - RNA, 64 nt, Homo Sapiens
uucccugugggccagggaugcucggucccagaggaggaccuagugacaucaugggacaggucaa

SEQ ID NO: 618952 - RNA, 64 nt, Homo Sapiens
agcugcccuccuggugcagggccgaggggacacaaggaccuaccuggaagcagcugacaugcug

SEQ ID NO: 618953 - RNA, 64 nt, Homo Sapiens
uggcugggaugguggaauuagugaaggaaaaaccugagccuaucuuauguuacaaggugaucaa

SEQ ID NO: 618954 - RNA, 64 nt, Homo Sapiens
ugggguagaggcacugcccaauagcaggcgucuuugagccuagcagcaagaucaggagcuccug

SEQ ID NO: 618955 - RNA, 64 nt, Homo Sapiens; identical to SEQ ID NO: 270360

SEQ ID NO: 618956 - RNA, 64 nt, Homo Sapiens; identical to SEQ ID NO: 270361

SEQ ID NO: 618957 - RNA, 64 nt, Homo Sapiens; identical to SEQ ID NO: 270362

SEQ ID NO: 618958 - RNA, 64 nt, Homo Sapiens; identical to SEQ ID NO: 270363

SEQ ID NO: 618959 - RNA, 64 nt, Homo Sapiens; identical to SEQ ID NO: 270364

SEQ ID NO: 618960 - RNA, 64 nt, Homo Sapiens; identical to SEQ ID NO: 270365

SEQ ID NO: 618961 - RNA, 64 nt, Homo Sapiens; identical to SEQ ID NO: 175633

SEQ ID NO: 618962 - RNA, 64 nt, Homo Sapiens; identical to SEQ ID NO: 175634

SEQ ID NO: 618963 - RNA, 64 nt, Homo Sapiens; identical to SEQ ID NO: 175635

SEQ ID NO: 618964 - RNA, 64 nt, Homo Sapiens; identical to SEQ ID NO: 175636

SEQ ID NO: 618965 - RNA, 64 nt, Homo Sapiens; identical to SEQ ID NO: 175637

SEQ ID NO: 618966 - RNA, 64 nt, Homo Sapiens; identical to SEQ ID NO: 175638

SEQ ID NO: 618967 - RNA, 64 nt, Homo Sapiens; identical to SEQ ID NO: 175639

SEQ ID NO: 618968 - RNA, 64 nt, Homo Sapiens; identical to SEQ ID NO: 175640

SEQ ID NO: 618969 - RNA, 64 nt, Homo Sapiens; identical to SEQ ID NO: 175641

SEQ ID NO: 618970 - RNA, 64 nt, Homo Sapiens; identical to SEQ ID NO: 175642

SEQ ID NO: 618971 - RNA, 64 nt, Homo Sapiens; identical to SEQ ID NO: 175643

SEQ ID NO: 618972 - RNA, 64 nt, Homo Sapiens; identical to SEQ ID NO: 175644

SEQ ID NO: 618973 - RNA, 64 nt, Homo Sapiens; identical to SEQ ID NO: 175645

SEQ ID NO: 618974 - RNA, 64 nt, Homo Sapiens; identical to SEQ ID NO: 175646

SEQ ID NO: 618975 - RNA, 64 nt, Homo Sapiens; identical to SEQ ID NO: 175647

SEQ ID NO: 618976 - RNA, 64 nt, Homo Sapiens; identical to SEQ ID NO: 175648

SEQ ID NO: 618977 - RNA, 64 nt, Homo Sapiens; identical to SEQ ID NO: 175649

SEQ ID NO: 618978 - RNA, 64 nt, Homo Sapiens; identical to SEQ ID NO: 175650

SEQ ID NO: 618979 - RNA, 64 nt, Homo Sapiens; identical to SEQ ID NO: 175651

SEQ ID NO: 618980 - RNA, 64 nt, Homo Sapiens; identical to SEQ ID NO: 175652

SEQ ID NO: 618981 - RNA, 64 nt, Homo Sapiens; identical to SEQ ID NO: 175653

SEQ ID NO: 618982 - RNA, 64 nt, Homo Sapiens; identical to SEQ ID NO: 175654

SEQ ID NO: 618983 - RNA, 64 nt, Homo Sapiens; identical to SEQ ID NO: 175655

SEQ ID NO: 618984 - RNA, 64 nt, Homo Sapiens; identical to SEQ ID NO: 175656

SEQ ID NO: 618985 - RNA, 64 nt, Homo Sapiens; identical to SEQ ID NO: 175657

SEQ ID NO: 618986 - RNA, 64 nt, Homo Sapiens; identical to SEQ ID NO: 175658

SEQ ID NO: 618987 - RNA, 64 nt, Homo Sapiens; identical to SEQ ID NO: 175659

SEQ ID NO: 618988 - RNA, 64 nt, Homo Sapiens; identical to SEQ ID NO: 175660

SEQ ID NO: 618989 - RNA, 64 nt, Homo Sapiens; identical to SEQ ID NO: 175661

SEQ ID NO: 618990 - RNA, 64 nt, Homo Sapiens; identical to SEQ ID NO: 175662

SEQ ID NO: 618991 - RNA, 64 nt, Homo Sapiens; identical to SEQ ID NO: 175663

SEQ ID NO: 618992 - RNA, 64 nt, Homo Sapiens; identical to SEQ ID NO: 175664

SEQ ID NO: 618993 - RNA, 64 nt, Homo Sapiens; identical to SEQ ID NO: 175665

SEQ ID NO: 618994 - RNA, 64 nt, Homo Sapiens; identical to SEQ ID NO: 175666

SEQ ID NO: 618995 - RNA, 64 nt, Homo Sapiens; identical to SEQ ID NO: 175667

SEQ ID NO: 618996 - RNA, 64 nt, Homo Sapiens; identical to SEQ ID NO: 175668

SEQ ID NO: 618997 - RNA, 64 nt, Homo Sapiens; identical to SEQ ID NO: 175669

SEQ ID NO: 618998 - RNA, 64 nt, Homo Sapiens; identical to SEQ ID NO: 175670

SEQ ID NO: 618999 - RNA, 64 nt, Homo Sapiens; identical to SEQ ID NO: 175671

SEQ ID NO: 619000 - RNA, 64 nt, Homo Sapiens; identical to SEQ ID NO: 175672

SEQ ID NO: 619001 - RNA, 64 nt, Homo Sapiens; identical to SEQ ID NO: 175673

SEQ ID NO: 619002 - RNA, 64 nt, Homo Sapiens; identical to SEQ ID NO: 175674

SEQ ID NO: 619003 - RNA, 64 nt, Homo Sapiens; identical to SEQ ID NO: 175675

SEQ ID NO: 619004 - RNA, 64 nt, Homo Sapiens; identical to SEQ ID NO: 175676

SEQ ID NO: 619005 - RNA, 64 nt, Homo Sapiens; identical to SEQ ID NO: 175677

SEQ ID NO: 619006 - RNA, 64 nt, Homo Sapiens; identical to SEQ ID NO: 175678

SEQ ID NO: 619007 - RNA, 64 nt, Homo Sapiens; identical to SEQ ID NO: 175679

SEQ ID NO: 619008 - RNA, 64 nt, Homo Sapiens; identical to SEQ ID NO: 175680

SEQ ID NO: 619009 - RNA, 64 nt, Homo Sapiens; identical to SEQ ID NO: 175681

SEQ ID NO: 619010 - RNA, 64 nt, Homo Sapiens; identical to SEQ ID NO: 175682

SEQ ID NO: 619011 - RNA, 64 nt, Homo Sapiens; identical to SEQ ID NO: 175683

SEQ ID NO: 619012 - RNA, 64 nt, Homo Sapiens; identical to SEQ ID NO: 175684

SEQ ID NO: 619013 - RNA, 64 nt, Homo Sapiens; identical to SEQ ID NO: 175685

SEQ ID NO: 619014 - RNA, 64 nt, Homo Sapiens; identical to SEQ ID NO: 175686

SEQ ID NO: 619015 - RNA, 64 nt, Homo Sapiens; identical to SEQ ID NO: 175687

SEQ ID NO: 619016 - RNA, 64 nt, Homo Sapiens; identical to SEQ ID NO: 175688

SEQ ID NO: 619017 - RNA, 64 nt, Homo Sapiens; identical to SEQ ID NO: 175689

SEQ ID NO: 619018 - RNA, 64 nt, Homo Sapiens; identical to SEQ ID NO: 175690

SEQ ID NO: 619019 - RNA, 64 nt, Homo Sapiens; identical to SEQ ID NO: 175691

SEQ ID NO: 619020 - RNA, 64 nt, Homo Sapiens; identical to SEQ ID NO: 175692

SEQ ID NO: 619021 - RNA, 64 nt, Homo Sapiens; identical to SEQ ID NO: 175693

SEQ ID NO: 619022 - RNA, 64 nt, Homo Sapiens; identical to SEQ ID NO: 175694

SEQ ID NO: 619023 - RNA, 64 nt, Homo Sapiens; identical to SEQ ID NO: 175695

SEQ ID NO: 619024 - RNA, 64 nt, Homo Sapiens; identical to SEQ ID NO: 175696

SEQ ID NO: 619025 - RNA, 64 nt, Homo Sapiens; identical to SEQ ID NO: 175697

SEQ ID NO: 619026 - RNA, 64 nt, Homo Sapiens; identical to SEQ ID NO: 175698

SEQ ID NO: 619027 - RNA, 64 nt, Homo Sapiens; identical to SEQ ID NO: 175699

SEQ ID NO: 619028 - RNA, 64 nt, Homo Sapiens; identical to SEQ ID NO: 175700

SEQ ID NO: 619029 - RNA, 64 nt, Homo Sapiens; identical to SEQ ID NO: 175701

SEQ ID NO: 619030 - RNA, 64 nt, Homo Sapiens; identical to SEQ ID NO: 175702

SEQ ID NO: 619031 - RNA, 64 nt, Homo Sapiens; identical to SEQ ID NO: 175703

SEQ ID NO: 619032 - RNA, 64 nt, Homo Sapiens; identical to SEQ ID NO: 175704

SEQ ID NO: 619033 - RNA, 64 nt, Homo Sapiens; identical to SEQ ID NO: 175705

SEQ ID NO: 619034 - RNA, 64 nt, Homo Sapiens; identical to SEQ ID NO: 175706

SEQ ID NO: 619035 - RNA, 64 nt, Homo Sapiens; identical to SEQ ID NO: 175707

SEQ ID NO: 619036 - RNA, 64 nt, Homo Sapiens; identical to SEQ ID NO: 175708

SEQ ID NO: 619037 - RNA, 64 nt, Homo Sapiens; identical to SEQ ID NO: 175709

SEQ ID NO: 619038 - RNA, 64 nt, Homo Sapiens; identical to SEQ ID NO: 175710

SEQ ID NO: 619039 - RNA, 64 nt, Homo Sapiens; identical to SEQ ID NO: 175711

SEQ ID NO: 619040 - RNA, 64 nt, Homo Sapiens; identical to SEQ ID NO: 175712

SEQ ID NO: 619041 - RNA, 64 nt, Homo Sapiens; identical to SEQ ID NO: 175713

SEQ ID NO: 619042 - RNA, 64 nt, Homo Sapiens; identical to SEQ ID NO: 175714

SEQ ID NO: 619043 - RNA, 64 nt, Homo Sapiens; identical to SEQ ID NO: 175715

SEQ ID NO: 619044 - RNA, 64 nt, Homo Sapiens; identical to SEQ ID NO: 175716

SEQ ID NO: 619045 - RNA, 64 nt, Homo Sapiens; identical to SEQ ID NO: 175717

SEQ ID NO: 619046 - RNA, 64 nt, Homo Sapiens; identical to SEQ ID NO: 175718

SEQ ID NO: 619047 - RNA, 64 nt, Homo Sapiens; identical to SEQ ID NO: 175719

SEQ ID NO: 619048 - RNA, 64 nt, Homo Sapiens; identical to SEQ ID NO: 175720

SEQ ID NO: 619049 - RNA, 64 nt, Homo Sapiens; identical to SEQ ID NO: 175721

SEQ ID NO: 619050 - RNA, 64 nt, Homo Sapiens; identical to SEQ ID NO: 175722

SEQ ID NO: 619051 - RNA, 64 nt, Homo Sapiens; identical to SEQ ID NO: 175723

SEQ ID NO: 619052 - RNA, 64 nt, Homo Sapiens; identical to SEQ ID NO: 175724

SEQ ID NO: 619053 - RNA, 64 nt, Homo Sapiens; identical to SEQ ID NO: 175725

SEQ ID NO: 619054 - RNA, 64 nt, Homo Sapiens; identical to SEQ ID NO: 175726

SEQ ID NO: 619055 - RNA, 64 nt, Homo Sapiens; identical to SEQ ID NO: 175727

SEQ ID NO: 619056 - RNA, 64 nt, Homo Sapiens; identical to SEQ ID NO: 143712

SEQ ID NO: 619057 - RNA, 64 nt, Homo Sapiens; identical to SEQ ID NO: 143713

SEQ ID NO: 619058 - RNA, 64 nt, Homo Sapiens; identical to SEQ ID NO: 143714

SEQ ID NO: 619059 - RNA, 64 nt, Homo Sapiens; identical to SEQ ID NO: 143715

SEQ ID NO: 619060 - RNA, 64 nt, Homo Sapiens; identical to SEQ ID NO: 143716

SEQ ID NO: 619061 - RNA, 64 nt, Homo Sapiens; identical to SEQ ID NO: 143717

SEQ ID NO: 619062 - RNA, 64 nt, Homo Sapiens; identical to SEQ ID NO: 143718

SEQ ID NO: 619063 - RNA, 64 nt, Homo Sapiens; identical to SEQ ID NO: 143719

SEQ ID NO: 619064 - RNA, 64 nt, Homo Sapiens; identical to SEQ ID NO: 143720

SEQ ID NO: 619065 - RNA, 64 nt, Homo Sapiens; identical to SEQ ID NO: 143721

SEQ ID NO: 619066 - RNA, 64 nt, Homo Sapiens; identical to SEQ ID NO: 143722

SEQ ID NO: 619067 - RNA, 64 nt, Homo Sapiens; identical to SEQ ID NO: 143723

SEQ ID NO: 619068 - RNA, 64 nt, Homo Sapiens; identical to SEQ ID NO: 143724

SEQ ID NO: 619069 - RNA, 64 nt, Homo Sapiens; identical to SEQ ID NO: 143725

SEQ ID NO: 619070 - RNA, 64 nt, Homo Sapiens; identical to SEQ ID NO: 143726

SEQ ID NO: 619071 - RNA, 64 nt, Homo Sapiens; identical to SEQ ID NO: 143727

SEQ ID NO: 619072 - RNA, 64 nt, Homo Sapiens; identical to SEQ ID NO: 143728

SEQ ID NO: 619073 - RNA, 64 nt, Homo Sapiens; identical to SEQ ID NO: 143729

SEQ ID NO: 619074 - RNA, 64 nt, Homo Sapiens; identical to SEQ ID NO: 143730

SEQ ID NO: 619075 - RNA, 64 nt, Homo Sapiens; identical to SEQ ID NO: 143731

SEQ ID NO: 619076 - RNA, 64 nt, Homo Sapiens; identical to SEQ ID NO: 143732

SEQ ID NO: 619077 - RNA, 64 nt, Homo Sapiens; identical to SEQ ID NO: 143733

SEQ ID NO: 619078 - RNA, 64 nt, Homo Sapiens; identical to SEQ ID NO: 143734

SEQ ID NO: 619079 - RNA, 64 nt, Homo Sapiens; identical to SEQ ID NO: 143735

SEQ ID NO: 619080 - RNA, 64 nt, Homo Sapiens; identical to SEQ ID NO: 143736

SEQ ID NO: 619081 - RNA, 64 nt, Homo Sapiens; identical to SEQ ID NO: 143737

SEQ ID NO: 619082 - RNA, 64 nt, Homo Sapiens; identical to SEQ ID NO: 143738

SEQ ID NO: 619083 - RNA, 64 nt, Homo Sapiens; identical to SEQ ID NO: 143739

SEQ ID NO: 619084 - RNA, 64 nt, Homo Sapiens; identical to SEQ ID NO: 143740

SEQ ID NO: 619085 - RNA, 64 nt, Homo Sapiens; identical to SEQ ID NO: 143741

SEQ ID NO: 619086 - RNA, 64 nt, Homo Sapiens; identical to SEQ ID NO: 143742

SEQ ID NO: 619087 - RNA, 64 nt, Homo Sapiens; identical to SEQ ID NO: 143743

SEQ ID NO: 619088 - RNA, 64 nt, Homo Sapiens; identical to SEQ ID NO: 143744

SEQ ID NO: 619089 - RNA, 64 nt, Homo Sapiens; identical to SEQ ID NO: 143745

SEQ ID NO: 619090 - RNA, 64 nt, Homo Sapiens; identical to SEQ ID NO: 143746

SEQ ID NO: 619091 - RNA, 64 nt, Homo Sapiens; identical to SEQ ID NO: 143747

SEQ ID NO: 619092 - RNA, 64 nt, Homo Sapiens; identical to SEQ ID NO: 143748

SEQ ID NO: 619093 - RNA, 64 nt, Homo Sapiens; identical to SEQ ID NO: 143749

SEQ ID NO: 619094 - RNA, 64 nt, Homo Sapiens; identical to SEQ ID NO: 143750

SEQ ID NO: 619095 - RNA, 64 nt, Homo Sapiens; identical to SEQ ID NO: 143751

SEQ ID NO: 619096 - RNA, 64 nt, Homo Sapiens; identical to SEQ ID NO: 143752

SEQ ID NO: 619097 - RNA, 64 nt, Homo Sapiens; identical to SEQ ID NO: 143753

SEQ ID NO: 619098 - RNA, 64 nt, Homo Sapiens; identical to SEQ ID NO: 143754

SEQ ID NO: 619099 - RNA, 64 nt, Homo Sapiens; identical to SEQ ID NO: 143755

SEQ ID NO: 619100 - RNA, 64 nt, Homo Sapiens; identical to SEQ ID NO: 143756

SEQ ID NO: 619101 - RNA, 64 nt, Homo Sapiens; identical to SEQ ID NO: 143757

SEQ ID NO: 619102 - RNA, 64 nt, Homo Sapiens; identical to SEQ ID NO: 143758

SEQ ID NO: 619103 - RNA, 64 nt, Homo Sapiens; identical to SEQ ID NO: 143759

SEQ ID NO: 619104 - RNA, 64 nt, Homo Sapiens; identical to SEQ ID NO: 143760

SEQ ID NO: 619105 - RNA, 64 nt, Homo Sapiens; identical to SEQ ID NO: 143761

SEQ ID NO: 619106 - RNA, 64 nt, Homo Sapiens; identical to SEQ ID NO: 143762

SEQ ID NO: 619107 - RNA, 64 nt, Homo Sapiens; identical to SEQ ID NO: 143763

SEQ ID NO: 619108 - RNA, 64 nt, Homo Sapiens; identical to SEQ ID NO: 143764

SEQ ID NO: 619109 - RNA, 64 nt, Homo Sapiens; identical to SEQ ID NO: 143765

SEQ ID NO: 619110 - RNA, 64 nt, Homo Sapiens; identical to SEQ ID NO: 143766

SEQ ID NO: 619111 - RNA, 64 nt, Homo Sapiens; identical to SEQ ID NO: 143767

SEQ ID NO: 619112 - RNA, 64 nt, Homo Sapiens; identical to SEQ ID NO: 143768

SEQ ID NO: 619113 - RNA, 64 nt, Homo Sapiens; identical to SEQ ID NO: 143769

SEQ ID NO: 619114 - RNA, 64 nt, Homo Sapiens; identical to SEQ ID NO: 143770

SEQ ID NO: 619115 - RNA, 64 nt, Homo Sapiens; identical to SEQ ID NO: 143771

SEQ ID NO: 619116 - RNA, 64 nt, Homo Sapiens; identical to SEQ ID NO: 143772

SEQ ID NO: 619117 - RNA, 64 nt, Homo Sapiens; identical to SEQ ID NO: 143773

SEQ ID NO: 619118 - RNA, 64 nt, Homo Sapiens; identical to SEQ ID NO: 143774

SEQ ID NO: 619119 - RNA, 64 nt, Homo Sapiens; identical to SEQ ID NO: 143775

SEQ ID NO: 619120 - RNA, 64 nt, Homo Sapiens; identical to SEQ ID NO: 143776

SEQ ID NO: 619121 - RNA, 64 nt, Homo Sapiens; identical to SEQ ID NO: 143777

SEQ ID NO: 619122 - RNA, 64 nt, Homo Sapiens; identical to SEQ ID NO: 143778

SEQ ID NO: 619123 - RNA, 64 nt, Homo Sapiens; identical to SEQ ID NO: 143779

SEQ ID NO: 619124 - RNA, 64 nt, Homo Sapiens; identical to SEQ ID NO: 143780

SEQ ID NO: 619125 - RNA, 64 nt, Homo Sapiens; identical to SEQ ID NO: 143781

SEQ ID NO: 619126 - RNA, 64 nt, Homo Sapiens; identical to SEQ ID NO: 143782

SEQ ID NO: 619127 - RNA, 64 nt, Homo Sapiens; identical to SEQ ID NO: 143783

SEQ ID NO: 619128 - RNA, 64 nt, Homo Sapiens; identical to SEQ ID NO: 143784

SEQ ID NO: 619129 - RNA, 64 nt, Homo Sapiens; identical to SEQ ID NO: 143785

SEQ ID NO: 619130 - RNA, 64 nt, Homo Sapiens; identical to SEQ ID NO: 143786

SEQ ID NO: 619131 - RNA, 64 nt, Homo Sapiens; identical to SEQ ID NO: 143787

SEQ ID NO: 619132 - RNA, 64 nt, Homo Sapiens; identical to SEQ ID NO: 143788

SEQ ID NO: 619133 - RNA, 64 nt, Homo Sapiens; identical to SEQ ID NO: 143789

SEQ ID NO: 619134 - RNA, 57 nt, Homo Sapiens; identical to SEQ ID NO: 143790

SEQ ID NO: 619135 - RNA, 64 nt, Homo Sapiens; identical to SEQ ID NO: 143791

SEQ ID NO: 619136 - RNA, 64 nt, Homo Sapiens; identical to SEQ ID NO: 143792

SEQ ID NO: 619137 - RNA, 64 nt, Homo Sapiens; identical to SEQ ID NO: 143793

SEQ ID NO: 619138 - RNA, 64 nt, Homo Sapiens; identical to SEQ ID NO: 143794

SEQ ID NO: 619139 - RNA, 64 nt, Homo Sapiens; identical to SEQ ID NO: 143795

SEQ ID NO: 619140 - RNA, 64 nt, Homo Sapiens; identical to SEQ ID NO: 143796

SEQ ID NO: 619141 - RNA, 64 nt, Homo Sapiens; identical to SEQ ID NO: 143797

SEQ ID NO: 619142 - RNA, 64 nt, Homo Sapiens; identical to SEQ ID NO: 143798

SEQ ID NO: 619143 - RNA, 64 nt, Homo Sapiens; identical to SEQ ID NO: 143799

SEQ ID NO: 619144 - RNA, 64 nt, Homo Sapiens; identical to SEQ ID NO: 143800

SEQ ID NO: 619145 - RNA, 64 nt, Homo Sapiens; identical to SEQ ID NO: 143801

SEQ ID NO: 619146 - RNA, 64 nt, Homo Sapiens; identical to SEQ ID NO: 143802

SEQ ID NO: 619147 - RNA, 64 nt, Homo Sapiens; identical to SEQ ID NO: 143803

SEQ ID NO: 619148 - RNA, 64 nt, Homo Sapiens; identical to SEQ ID NO: 143804

SEQ ID NO: 619149 - RNA, 64 nt, Homo Sapiens; identical to SEQ ID NO: 143805

SEQ ID NO: 619150 - RNA, 64 nt, Homo Sapiens; identical to SEQ ID NO: 143806

SEQ ID NO: 619151 - RNA, 64 nt, Homo Sapiens; identical to SEQ ID NO: 143807

SEQ ID NO: 619152 - RNA, 64 nt, Homo Sapiens; identical to SEQ ID NO: 143808

SEQ ID NO: 619153 - RNA, 64 nt, Homo Sapiens; identical to SEQ ID NO: 143809

SEQ ID NO: 619154 - RNA, 64 nt, Homo Sapiens; identical to SEQ ID NO: 143810

SEQ ID NO: 619155 - RNA, 64 nt, Homo Sapiens; identical to SEQ ID NO: 143811

SEQ ID NO: 619156 - RNA, 64 nt, Homo Sapiens; identical to SEQ ID NO: 143812

SEQ ID NO: 619157 - RNA, 64 nt, Homo Sapiens; identical to SEQ ID NO: 125404

SEQ ID NO: 619158 - RNA, 64 nt, Homo Sapiens; identical to SEQ ID NO: 125405

SEQ ID NO: 619159 - RNA, 64 nt, Homo Sapiens; identical to SEQ ID NO: 125406

SEQ ID NO: 619160 - RNA, 64 nt, Homo Sapiens; identical to SEQ ID NO: 125407

SEQ ID NO: 619161 - RNA, 64 nt, Homo Sapiens; identical to SEQ ID NO: 125408

SEQ ID NO: 619162 - RNA, 57 nt, Homo Sapiens; identical to SEQ ID NO: 125409

SEQ ID NO: 619163 - RNA, 64 nt, Homo Sapiens; identical to SEQ ID NO: 125410

SEQ ID NO: 619164 - RNA, 64 nt, Homo Sapiens; identical to SEQ ID NO: 125411

SEQ ID NO: 619165 - RNA, 64 nt, Homo Sapiens; identical to SEQ ID NO: 125412

SEQ ID NO: 619166 - RNA, 64 nt, Homo Sapiens; identical to SEQ ID NO: 125413

SEQ ID NO: 619167 - RNA, 64 nt, Homo Sapiens; identical to SEQ ID NO: 125414

SEQ ID NO: 619168 - RNA, 64 nt, Homo Sapiens; identical to SEQ ID NO: 125415

SEQ ID NO: 619169 - RNA, 64 nt, Homo Sapiens; identical to SEQ ID NO: 125416

SEQ ID NO: 619170 - RNA, 63 nt, Homo Sapiens; identical to SEQ ID NO: 125417

SEQ ID NO: 619171 - RNA, 64 nt, Homo Sapiens; identical to SEQ ID NO: 125418

SEQ ID NO: 619172 - RNA, 64 nt, Homo Sapiens; identical to SEQ ID NO: 125419

SEQ ID NO: 619173 - RNA, 64 nt, Homo Sapiens; identical to SEQ ID NO: 125420

SEQ ID NO: 619174 - RNA, 64 nt, Homo Sapiens; identical to SEQ ID NO: 125421

SEQ ID NO: 619175 - RNA, 53 nt, Homo Sapiens; identical to SEQ ID NO: 125422

SEQ ID NO: 619176 - RNA, 64 nt, Homo Sapiens; identical to SEQ ID NO: 125423

SEQ ID NO: 619177 - RNA, 64 nt, Homo Sapiens; identical to SEQ ID NO: 125424

SEQ ID NO: 619178 - RNA, 64 nt, Homo Sapiens; identical to SEQ ID NO: 125425

SEQ ID NO: 619179 - RNA, 64 nt, Homo Sapiens; identical to SEQ ID NO: 125426

SEQ ID NO: 619180 - RNA, 64 nt, Homo Sapiens; identical to SEQ ID NO: 125427

SEQ ID NO: 619181 - RNA, 64 nt, Homo Sapiens; identical to SEQ ID NO: 125428

SEQ ID NO: 619182 - RNA, 64 nt, Homo Sapiens; identical to SEQ ID NO: 125429

SEQ ID NO: 619183 - RNA, 56 nt, Homo Sapiens; identical to SEQ ID NO: 125430

SEQ ID NO: 619184 - RNA, 64 nt, Homo Sapiens; identical to SEQ ID NO: 125431

SEQ ID NO: 619185 - RNA, 60 nt, Homo Sapiens; identical to SEQ ID NO: 125432

SEQ ID NO: 619186 - RNA, 64 nt, Homo Sapiens; identical to SEQ ID NO: 125433

SEQ ID NO: 619187 - RNA, 64 nt, Homo Sapiens; identical to SEQ ID NO: 125434

SEQ ID NO: 619188 - RNA, 64 nt, Homo Sapiens; identical to SEQ ID NO: 125435

SEQ ID NO: 619189 - RNA, 64 nt, Homo Sapiens; identical to SEQ ID NO: 125436

SEQ ID NO: 619190 - RNA, 60 nt, Homo Sapiens; identical to SEQ ID NO: 125437

SEQ ID NO: 619191 - RNA, 64 nt, Homo Sapiens; identical to SEQ ID NO: 125438

SEQ ID NO: 619192 - RNA, 64 nt, Homo Sapiens; identical to SEQ ID NO: 125439

SEQ ID NO: 619193 - RNA, 64 nt, Homo Sapiens; identical to SEQ ID NO: 125440

SEQ ID NO: 619194 - RNA, 64 nt, Homo Sapiens; identical to SEQ ID NO: 125441

SEQ ID NO: 619195 - RNA, 64 nt, Homo Sapiens; identical to SEQ ID NO: 125442

SEQ ID NO: 619196 - RNA, 64 nt, Homo Sapiens; identical to SEQ ID NO: 125443

SEQ ID NO: 619197 - RNA, 64 nt, Homo Sapiens; identical to SEQ ID NO: 125444

SEQ ID NO: 619198 - RNA, 64 nt, Homo Sapiens; identical to SEQ ID NO: 125445

SEQ ID NO: 619199 - RNA, 64 nt, Homo Sapiens; identical to SEQ ID NO: 125446

SEQ ID NO: 619200 - RNA, 64 nt, Homo Sapiens; identical to SEQ ID NO: 125447

SEQ ID NO: 619201 - RNA, 64 nt, Homo Sapiens; identical to SEQ ID NO: 125448

SEQ ID NO: 619202 - RNA, 64 nt, Homo Sapiens; identical to SEQ ID NO: 125449

SEQ ID NO: 619203 - RNA, 64 nt, Homo Sapiens; identical to SEQ ID NO: 125450

SEQ ID NO: 619204 - RNA, 64 nt, Homo Sapiens; identical to SEQ ID NO: 125451

SEQ ID NO: 619205 - RNA, 64 nt, Homo Sapiens; identical to SEQ ID NO: 125452

SEQ ID NO: 619206 - RNA, 64 nt, Homo Sapiens; identical to SEQ ID NO: 125453

SEQ ID NO: 619207 - RNA, 64 nt, Homo Sapiens; identical to SEQ ID NO: 125454

SEQ ID NO: 619208 - RNA, 64 nt, Homo Sapiens; identical to SEQ ID NO: 125455

SEQ ID NO: 619209 - RNA, 64 nt, Homo Sapiens; identical to SEQ ID NO: 125456

SEQ ID NO: 619210 - RNA, 64 nt, Homo Sapiens; identical to SEQ ID NO: 125457

SEQ ID NO: 619211 - RNA, 64 nt, Homo Sapiens; identical to SEQ ID NO: 125458

SEQ ID NO: 619212 - RNA, 64 nt, Homo Sapiens; identical to SEQ ID NO: 125459

SEQ ID NO: 619213 - RNA, 64 nt, Homo Sapiens; identical to SEQ ID NO: 125460

SEQ ID NO: 619214 - RNA, 59 nt, Homo Sapiens; identical to SEQ ID NO: 125461

SEQ ID NO: 619215 - RNA, 64 nt, Homo Sapiens; identical to SEQ ID NO: 125462

SEQ ID NO: 619216 - RNA, 64 nt, Homo Sapiens; identical to SEQ ID NO: 125463

SEQ ID NO: 619217 - RNA, 64 nt, Homo Sapiens; identical to SEQ ID NO: 125464

SEQ ID NO: 619218 - RNA, 64 nt, Homo Sapiens; identical to SEQ ID NO: 125465

SEQ ID NO: 619219 - RNA, 64 nt, Homo Sapiens; identical to SEQ ID NO: 125466

SEQ ID NO: 619220 - RNA, 64 nt, Homo Sapiens; identical to SEQ ID NO: 125467

SEQ ID NO: 619221 - RNA, 64 nt, Homo Sapiens; identical to SEQ ID NO: 125468

SEQ ID NO: 619222 - RNA, 64 nt, Homo Sapiens; identical to SEQ ID NO: 125469

SEQ ID NO: 619223 - RNA, 64 nt, Homo Sapiens; identical to SEQ ID NO: 125470

SEQ ID NO: 619224 - RNA, 64 nt, Homo Sapiens; identical to SEQ ID NO: 125471

SEQ ID NO: 619225 - RNA, 64 nt, Homo Sapiens; identical to SEQ ID NO: 125472

SEQ ID NO: 619226 - RNA, 64 nt, Homo Sapiens; identical to SEQ ID NO: 125473

SEQ ID NO: 619227 - RNA, 64 nt, Homo Sapiens; identical to SEQ ID NO: 125474

SEQ ID NO: 619228 - RNA, 55 nt, Homo Sapiens; identical to SEQ ID NO: 125475

SEQ ID NO: 619229 - RNA, 64 nt, Homo Sapiens; identical to SEQ ID NO: 125476

SEQ ID NO: 619230 - RNA, 64 nt, Homo Sapiens; identical to SEQ ID NO: 125477

SEQ ID NO: 619231 - RNA, 64 nt, Homo Sapiens; identical to SEQ ID NO: 125478

SEQ ID NO: 619232 - RNA, 64 nt, Homo Sapiens; identical to SEQ ID NO: 125479

SEQ ID NO: 619233 - RNA, 64 nt, Homo Sapiens; identical to SEQ ID NO: 125480

SEQ ID NO: 619234 - RNA, 64 nt, Homo Sapiens; identical to SEQ ID NO: 125481

SEQ ID NO: 619235 - RNA, 64 nt, Homo Sapiens; identical to SEQ ID NO: 125482

SEQ ID NO: 619236 - RNA, 64 nt, Homo Sapiens; identical to SEQ ID NO: 125483

SEQ ID NO: 619237 - RNA, 64 nt, Homo Sapiens; identical to SEQ ID NO: 125484

SEQ ID NO: 619238 - RNA, 64 nt, Homo Sapiens; identical to SEQ ID NO: 125485

SEQ ID NO: 619239 - RNA, 64 nt, Homo Sapiens; identical to SEQ ID NO: 125486

SEQ ID NO: 619240 - RNA, 64 nt, Homo Sapiens; identical to SEQ ID NO: 125487

SEQ ID NO: 619241 - RNA, 64 nt, Homo Sapiens; identical to SEQ ID NO: 125488

SEQ ID NO: 619242 - RNA, 64 nt, Homo Sapiens; identical to SEQ ID NO: 125489

SEQ ID NO: 619243 - RNA, 64 nt, Homo Sapiens; identical to SEQ ID NO: 125490

SEQ ID NO: 619244 - RNA, 64 nt, Homo Sapiens; identical to SEQ ID NO: 125491

SEQ ID NO: 619245 - RNA, 64 nt, Homo Sapiens; identical to SEQ ID NO: 125492

SEQ ID NO: 619246 - RNA, 64 nt, Homo Sapiens; identical to SEQ ID NO: 125493

SEQ ID NO: 619247 - RNA, 64 nt, Homo Sapiens; identical to SEQ ID NO: 125494

SEQ ID NO: 619248 - RNA, 64 nt, Homo Sapiens; identical to SEQ ID NO: 125495

SEQ ID NO: 619249 - RNA, 64 nt, Homo Sapiens; identical to SEQ ID NO: 125496

SEQ ID NO: 619250 - RNA, 64 nt, Homo Sapiens; identical to SEQ ID NO: 143712

SEQ ID NO: 619251 - RNA, 64 nt, Homo Sapiens; identical to SEQ ID NO: 143713

SEQ ID NO: 619252 - RNA, 64 nt, Homo Sapiens; identical to SEQ ID NO: 143714

SEQ ID NO: 619253 - RNA, 64 nt, Homo Sapiens; identical to SEQ ID NO: 143715

SEQ ID NO: 619254 - RNA, 64 nt, Homo Sapiens; identical to SEQ ID NO: 143716

SEQ ID NO: 619255 - RNA, 64 nt, Homo Sapiens; identical to SEQ ID NO: 143717

SEQ ID NO: 619256 - RNA, 64 nt, Homo Sapiens; identical to SEQ ID NO: 143718

SEQ ID NO: 619257 - RNA, 64 nt, Homo Sapiens; identical to SEQ ID NO: 143719

SEQ ID NO: 619258 - RNA, 64 nt, Homo Sapiens; identical to SEQ ID NO: 143720

SEQ ID NO: 619259 - RNA, 64 nt, Homo Sapiens; identical to SEQ ID NO: 143721

SEQ ID NO: 619260 - RNA, 64 nt, Homo Sapiens; identical to SEQ ID NO: 143722

SEQ ID NO: 619261 - RNA, 64 nt, Homo Sapiens; identical to SEQ ID NO: 143723

SEQ ID NO: 619262 - RNA, 64 nt, Homo Sapiens; identical to SEQ ID NO: 143724

SEQ ID NO: 619263 - RNA, 64 nt, Homo Sapiens; identical to SEQ ID NO: 143725

SEQ ID NO: 619264 - RNA, 64 nt, Homo Sapiens; identical to SEQ ID NO: 143726

SEQ ID NO: 619265 - RNA, 64 nt, Homo Sapiens; identical to SEQ ID NO: 143727

SEQ ID NO: 619266 - RNA, 64 nt, Homo Sapiens; identical to SEQ ID NO: 143728

SEQ ID NO: 619267 - RNA, 64 nt, Homo Sapiens; identical to SEQ ID NO: 143729

SEQ ID NO: 619268 - RNA, 64 nt, Homo Sapiens; identical to SEQ ID NO: 143730

SEQ ID NO: 619269 - RNA, 64 nt, Homo Sapiens; identical to SEQ ID NO: 143731

SEQ ID NO: 619270 - RNA, 64 nt, Homo Sapiens; identical to SEQ ID NO: 143732

SEQ ID NO: 619271 - RNA, 64 nt, Homo Sapiens; identical to SEQ ID NO: 143733

SEQ ID NO: 619272 - RNA, 64 nt, Homo Sapiens; identical to SEQ ID NO: 143734

SEQ ID NO: 619273 - RNA, 64 nt, Homo Sapiens; identical to SEQ ID NO: 143735

SEQ ID NO: 619274 - RNA, 64 nt, Homo Sapiens; identical to SEQ ID NO: 143736

SEQ ID NO: 619275 - RNA, 64 nt, Homo Sapiens; identical to SEQ ID NO: 143737

SEQ ID NO: 619276 - RNA, 64 nt, Homo Sapiens; identical to SEQ ID NO: 143738

SEQ ID NO: 619277 - RNA, 64 nt, Homo Sapiens; identical to SEQ ID NO: 143739

SEQ ID NO: 619278 - RNA, 64 nt, Homo Sapiens; identical to SEQ ID NO: 143740

SEQ ID NO: 619279 - RNA, 64 nt, Homo Sapiens; identical to SEQ ID NO: 143741

SEQ ID NO: 619280 - RNA, 64 nt, Homo Sapiens; identical to SEQ ID NO: 143742

SEQ ID NO: 619281 - RNA, 64 nt, Homo Sapiens; identical to SEQ ID NO: 143743

SEQ ID NO: 619282 - RNA, 64 nt, Homo Sapiens; identical to SEQ ID NO: 143744

SEQ ID NO: 619283 - RNA, 64 nt, Homo Sapiens; identical to SEQ ID NO: 143745

SEQ ID NO: 619284 - RNA, 64 nt, Homo Sapiens; identical to SEQ ID NO: 143746

SEQ ID NO: 619285 - RNA, 64 nt, Homo Sapiens; identical to SEQ ID NO: 143747

SEQ ID NO: 619286 - RNA, 64 nt, Homo Sapiens; identical to SEQ ID NO: 143748

SEQ ID NO: 619287 - RNA, 64 nt, Homo Sapiens; identical to SEQ ID NO: 143749

SEQ ID NO: 619288 - RNA, 64 nt, Homo Sapiens; identical to SEQ ID NO: 143750

SEQ ID NO: 619289 - RNA, 64 nt, Homo Sapiens; identical to SEQ ID NO: 143751

SEQ ID NO: 619290 - RNA, 64 nt, Homo Sapiens; identical to SEQ ID NO: 143752

SEQ ID NO: 619291 - RNA, 64 nt, Homo Sapiens; identical to SEQ ID NO: 143753

SEQ ID NO: 619292 - RNA, 64 nt, Homo Sapiens; identical to SEQ ID NO: 143754

SEQ ID NO: 619293 - RNA, 64 nt, Homo Sapiens; identical to SEQ ID NO: 143755

SEQ ID NO: 619294 - RNA, 64 nt, Homo Sapiens; identical to SEQ ID NO: 143756

SEQ ID NO: 619295 - RNA, 64 nt, Homo Sapiens; identical to SEQ ID NO: 143757

SEQ ID NO: 619296 - RNA, 64 nt, Homo Sapiens; identical to SEQ ID NO: 143758

SEQ ID NO: 619297 - RNA, 64 nt, Homo Sapiens; identical to SEQ ID NO: 143759

SEQ ID NO: 619298 - RNA, 64 nt, Homo Sapiens; identical to SEQ ID NO: 143760

SEQ ID NO: 619299 - RNA, 64 nt, Homo Sapiens; identical to SEQ ID NO: 143761

SEQ ID NO: 619300 - RNA, 64 nt, Homo Sapiens; identical to SEQ ID NO: 143762

SEQ ID NO: 619301 - RNA, 64 nt, Homo Sapiens; identical to SEQ ID NO: 143763

SEQ ID NO: 619302 - RNA, 64 nt, Homo Sapiens; identical to SEQ ID NO: 143764

SEQ ID NO: 619303 - RNA, 64 nt, Homo Sapiens; identical to SEQ ID NO: 143765

SEQ ID NO: 619304 - RNA, 64 nt, Homo Sapiens; identical to SEQ ID NO: 143766

SEQ ID NO: 619305 - RNA, 64 nt, Homo Sapiens; identical to SEQ ID NO: 143767

SEQ ID NO: 619306 - RNA, 64 nt, Homo Sapiens; identical to SEQ ID NO: 143768

SEQ ID NO: 619307 - RNA, 64 nt, Homo Sapiens; identical to SEQ ID NO: 143769

SEQ ID NO: 619308 - RNA, 64 nt, Homo Sapiens; identical to SEQ ID NO: 143770

SEQ ID NO: 619309 - RNA, 64 nt, Homo Sapiens; identical to SEQ ID NO: 143771

SEQ ID NO: 619310 - RNA, 64 nt, Homo Sapiens; identical to SEQ ID NO: 143772

SEQ ID NO: 619311 - RNA, 64 nt, Homo Sapiens; identical to SEQ ID NO: 143773

SEQ ID NO: 619312 - RNA, 64 nt, Homo Sapiens; identical to SEQ ID NO: 143774

SEQ ID NO: 619313 - RNA, 64 nt, Homo Sapiens; identical to SEQ ID NO: 143775

SEQ ID NO: 619314 - RNA, 64 nt, Homo Sapiens; identical to SEQ ID NO: 143776

SEQ ID NO: 619315 - RNA, 64 nt, Homo Sapiens; identical to SEQ ID NO: 143777

SEQ ID NO: 619316 - RNA, 64 nt, Homo Sapiens; identical to SEQ ID NO: 143778

SEQ ID NO: 619317 - RNA, 64 nt, Homo Sapiens; identical to SEQ ID NO: 143779

SEQ ID NO: 619318 - RNA, 64 nt, Homo Sapiens; identical to SEQ ID NO: 143780

SEQ ID NO: 619319 - RNA, 64 nt, Homo Sapiens; identical to SEQ ID NO: 143781

SEQ ID NO: 619320 - RNA, 64 nt, Homo Sapiens; identical to SEQ ID NO: 143782

SEQ ID NO: 619321 - RNA, 64 nt, Homo Sapiens; identical to SEQ ID NO: 143783

SEQ ID NO: 619322 - RNA, 64 nt, Homo Sapiens; identical to SEQ ID NO: 143784

SEQ ID NO: 619323 - RNA, 64 nt, Homo Sapiens; identical to SEQ ID NO: 143785

SEQ ID NO: 619324 - RNA, 64 nt, Homo Sapiens; identical to SEQ ID NO: 143786

SEQ ID NO: 619325 - RNA, 64 nt, Homo Sapiens; identical to SEQ ID NO: 143787

SEQ ID NO: 619326 - RNA, 64 nt, Homo Sapiens; identical to SEQ ID NO: 143788

SEQ ID NO: 619327 - RNA, 64 nt, Homo Sapiens; identical to SEQ ID NO: 143789

SEQ ID NO: 619328 - RNA, 57 nt, Homo Sapiens; identical to SEQ ID NO: 143790

SEQ ID NO: 619329 - RNA, 64 nt, Homo Sapiens; identical to SEQ ID NO: 143791

SEQ ID NO: 619330 - RNA, 64 nt, Homo Sapiens; identical to SEQ ID NO: 143792

SEQ ID NO: 619331 - RNA, 64 nt, Homo Sapiens; identical to SEQ ID NO: 143793

SEQ ID NO: 619332 - RNA, 64 nt, Homo Sapiens; identical to SEQ ID NO: 143794

SEQ ID NO: 619333 - RNA, 64 nt, Homo Sapiens; identical to SEQ ID NO: 143795

SEQ ID NO: 619334 - RNA, 64 nt, Homo Sapiens; identical to SEQ ID NO: 143796

SEQ ID NO: 619335 - RNA, 64 nt, Homo Sapiens; identical to SEQ ID NO: 143797

SEQ ID NO: 619336 - RNA, 64 nt, Homo Sapiens; identical to SEQ ID NO: 143798

SEQ ID NO: 619337 - RNA, 64 nt, Homo Sapiens; identical to SEQ ID NO: 143799

SEQ ID NO: 619338 - RNA, 64 nt, Homo Sapiens; identical to SEQ ID NO: 143800

SEQ ID NO: 619339 - RNA, 64 nt, Homo Sapiens; identical to SEQ ID NO: 143801

SEQ ID NO: 619340 - RNA, 64 nt, Homo Sapiens; identical to SEQ ID NO: 143802

SEQ ID NO: 619341 - RNA, 64 nt, Homo Sapiens; identical to SEQ ID NO: 143803

SEQ ID NO: 619342 - RNA, 64 nt, Homo Sapiens; identical to SEQ ID NO: 143804

SEQ ID NO: 619343 - RNA, 64 nt, Homo Sapiens; identical to SEQ ID NO: 143805

SEQ ID NO: 619344 - RNA, 64 nt, Homo Sapiens; identical to SEQ ID NO: 143806

SEQ ID NO: 619345 - RNA, 64 nt, Homo Sapiens; identical to SEQ ID NO: 143807

SEQ ID NO: 619346 - RNA, 64 nt, Homo Sapiens; identical to SEQ ID NO: 143808

SEQ ID NO: 619347 - RNA, 64 nt, Homo Sapiens; identical to SEQ ID NO: 143809

SEQ ID NO: 619348 - RNA, 64 nt, Homo Sapiens; identical to SEQ ID NO: 143810

SEQ ID NO: 619349 - RNA, 64 nt, Homo Sapiens; identical to SEQ ID NO: 143811

SEQ ID NO: 619350 - RNA, 64 nt, Homo Sapiens; identical to SEQ ID NO: 143812

SEQ ID NO: 619351 - RNA, 64 nt, Homo Sapiens; identical to SEQ ID NO: 125404

SEQ ID NO: 619352 - RNA, 64 nt, Homo Sapiens; identical to SEQ ID NO: 125405

SEQ ID NO: 619353 - RNA, 64 nt, Homo Sapiens; identical to SEQ ID NO: 125406

SEQ ID NO: 619354 - RNA, 64 nt, Homo Sapiens; identical to SEQ ID NO: 125407

SEQ ID NO: 619355 - RNA, 64 nt, Homo Sapiens; identical to SEQ ID NO: 125408

SEQ ID NO: 619356 - RNA, 57 nt, Homo Sapiens; identical to SEQ ID NO: 125409

SEQ ID NO: 619357 - RNA, 64 nt, Homo Sapiens; identical to SEQ ID NO: 125410

SEQ ID NO: 619358 - RNA, 64 nt, Homo Sapiens; identical to SEQ ID NO: 125411

SEQ ID NO: 619359 - RNA, 64 nt, Homo Sapiens; identical to SEQ ID NO: 125412

SEQ ID NO: 619360 - RNA, 64 nt, Homo Sapiens; identical to SEQ ID NO: 125413

SEQ ID NO: 619361 - RNA, 64 nt, Homo Sapiens; identical to SEQ ID NO: 125414

SEQ ID NO: 619362 - RNA, 64 nt, Homo Sapiens; identical to SEQ ID NO: 125415

SEQ ID NO: 619363 - RNA, 64 nt, Homo Sapiens; identical to SEQ ID NO: 125416

SEQ ID NO: 619364 - RNA, 63 nt, Homo Sapiens; identical to SEQ ID NO: 125417

SEQ ID NO: 619365 - RNA, 64 nt, Homo Sapiens; identical to SEQ ID NO: 125418

SEQ ID NO: 619366 - RNA, 64 nt, Homo Sapiens; identical to SEQ ID NO: 125419

SEQ ID NO: 619367 - RNA, 64 nt, Homo Sapiens; identical to SEQ ID NO: 125420

SEQ ID NO: 619368 - RNA, 64 nt, Homo Sapiens; identical to SEQ ID NO: 125421

SEQ ID NO: 619369 - RNA, 53 nt, Homo Sapiens; identical to SEQ ID NO: 125422

SEQ ID NO: 619370 - RNA, 64 nt, Homo Sapiens; identical to SEQ ID NO: 125423

SEQ ID NO: 619371 - RNA, 64 nt, Homo Sapiens; identical to SEQ ID NO: 125424

SEQ ID NO: 619372 - RNA, 64 nt, Homo Sapiens; identical to SEQ ID NO: 125425

SEQ ID NO: 619373 - RNA, 64 nt, Homo Sapiens; identical to SEQ ID NO: 125426

SEQ ID NO: 619374 - RNA, 64 nt, Homo Sapiens; identical to SEQ ID NO: 125427

SEQ ID NO: 619375 - RNA, 64 nt, Homo Sapiens; identical to SEQ ID NO: 125428

SEQ ID NO: 619376 - RNA, 64 nt, Homo Sapiens; identical to SEQ ID NO: 125429

SEQ ID NO: 619377 - RNA, 56 nt, Homo Sapiens; identical to SEQ ID NO: 125430

SEQ ID NO: 619378 - RNA, 64 nt, Homo Sapiens; identical to SEQ ID NO: 125431

SEQ ID NO: 619379 - RNA, 60 nt, Homo Sapiens; identical to SEQ ID NO: 125432

SEQ ID NO: 619380 - RNA, 64 nt, Homo Sapiens; identical to SEQ ID NO: 125433

SEQ ID NO: 619381 - RNA, 64 nt, Homo Sapiens; identical to SEQ ID NO: 125434

SEQ ID NO: 619382 - RNA, 64 nt, Homo Sapiens; identical to SEQ ID NO: 125435

SEQ ID NO: 619383 - RNA, 64 nt, Homo Sapiens; identical to SEQ ID NO: 125436

SEQ ID NO: 619384 - RNA, 60 nt, Homo Sapiens; identical to SEQ ID NO: 125437

SEQ ID NO: 619385 - RNA, 64 nt, Homo Sapiens; identical to SEQ ID NO: 125438

SEQ ID NO: 619386 - RNA, 64 nt, Homo Sapiens; identical to SEQ ID NO: 125439

SEQ ID NO: 619387 - RNA, 64 nt, Homo Sapiens; identical to SEQ ID NO: 125440

SEQ ID NO: 619388 - RNA, 64 nt, Homo Sapiens; identical to SEQ ID NO: 125441

SEQ ID NO: 619389 - RNA, 64 nt, Homo Sapiens; identical to SEQ ID NO: 125442

SEQ ID NO: 619390 - RNA, 64 nt, Homo Sapiens; identical to SEQ ID NO: 125443

SEQ ID NO: 619391 - RNA, 64 nt, Homo Sapiens; identical to SEQ ID NO: 125444

SEQ ID NO: 619392 - RNA, 64 nt, Homo Sapiens; identical to SEQ ID NO: 125445

SEQ ID NO: 619393 - RNA, 64 nt, Homo Sapiens; identical to SEQ ID NO: 125446

SEQ ID NO: 619394 - RNA, 64 nt, Homo Sapiens; identical to SEQ ID NO: 125447

SEQ ID NO: 619395 - RNA, 64 nt, Homo Sapiens; identical to SEQ ID NO: 125448

SEQ ID NO: 619396 - RNA, 64 nt, Homo Sapiens; identical to SEQ ID NO: 125449

SEQ ID NO: 619397 - RNA, 64 nt, Homo Sapiens; identical to SEQ ID NO: 125450

SEQ ID NO: 619398 - RNA, 64 nt, Homo Sapiens; identical to SEQ ID NO: 125451

SEQ ID NO: 619399 - RNA, 64 nt, Homo Sapiens; identical to SEQ ID NO: 125452

SEQ ID NO: 619400 - RNA, 64 nt, Homo Sapiens; identical to SEQ ID NO: 125453

SEQ ID NO: 619401 - RNA, 64 nt, Homo Sapiens; identical to SEQ ID NO: 125454

SEQ ID NO: 619402 - RNA, 64 nt, Homo Sapiens; identical to SEQ ID NO: 125455

SEQ ID NO: 619403 - RNA, 64 nt, Homo Sapiens; identical to SEQ ID NO: 125456

SEQ ID NO: 619404 - RNA, 64 nt, Homo Sapiens; identical to SEQ ID NO: 125457

SEQ ID NO: 619405 - RNA, 64 nt, Homo Sapiens; identical to SEQ ID NO: 125458

SEQ ID NO: 619406 - RNA, 64 nt, Homo Sapiens; identical to SEQ ID NO: 125459

SEQ ID NO: 619407 - RNA, 64 nt, Homo Sapiens; identical to SEQ ID NO: 125460

SEQ ID NO: 619408 - RNA, 59 nt, Homo Sapiens; identical to SEQ ID NO: 125461

SEQ ID NO: 619409 - RNA, 64 nt, Homo Sapiens; identical to SEQ ID NO: 125462

SEQ ID NO: 619410 - RNA, 64 nt, Homo Sapiens; identical to SEQ ID NO: 125463

SEQ ID NO: 619411 - RNA, 64 nt, Homo Sapiens; identical to SEQ ID NO: 125464

SEQ ID NO: 619412 - RNA, 64 nt, Homo Sapiens; identical to SEQ ID NO: 125465

SEQ ID NO: 619413 - RNA, 64 nt, Homo Sapiens; identical to SEQ ID NO: 125466

SEQ ID NO: 619414 - RNA, 64 nt, Homo Sapiens; identical to SEQ ID NO: 125467

SEQ ID NO: 619415 - RNA, 64 nt, Homo Sapiens; identical to SEQ ID NO: 125468

SEQ ID NO: 619416 - RNA, 64 nt, Homo Sapiens; identical to SEQ ID NO: 125469

SEQ ID NO: 619417 - RNA, 64 nt, Homo Sapiens; identical to SEQ ID NO: 125470

SEQ ID NO: 619418 - RNA, 64 nt, Homo Sapiens; identical to SEQ ID NO: 125471

SEQ ID NO: 619419 - RNA, 64 nt, Homo Sapiens; identical to SEQ ID NO: 125472

SEQ ID NO: 619420 - RNA, 64 nt, Homo Sapiens; identical to SEQ ID NO: 125473

SEQ ID NO: 619421 - RNA, 64 nt, Homo Sapiens; identical to SEQ ID NO: 125474

SEQ ID NO: 619422 - RNA, 55 nt, Homo Sapiens; identical to SEQ ID NO: 125475

SEQ ID NO: 619423 - RNA, 64 nt, Homo Sapiens; identical to SEQ ID NO: 125476

SEQ ID NO: 619424 - RNA, 64 nt, Homo Sapiens; identical to SEQ ID NO: 125477

SEQ ID NO: 619425 - RNA, 64 nt, Homo Sapiens; identical to SEQ ID NO: 125478

SEQ ID NO: 619426 - RNA, 64 nt, Homo Sapiens; identical to SEQ ID NO: 125479

SEQ ID NO: 619427 - RNA, 64 nt, Homo Sapiens; identical to SEQ ID NO: 125480

SEQ ID NO: 619428 - RNA, 64 nt, Homo Sapiens; identical to SEQ ID NO: 125481

SEQ ID NO: 619429 - RNA, 64 nt, Homo Sapiens; identical to SEQ ID NO: 125482

SEQ ID NO: 619430 - RNA, 64 nt, Homo Sapiens; identical to SEQ ID NO: 125483

SEQ ID NO: 619431 - RNA, 64 nt, Homo Sapiens; identical to SEQ ID NO: 125484

SEQ ID NO: 619432 - RNA, 64 nt, Homo Sapiens; identical to SEQ ID NO: 125485

SEQ ID NO: 619433 - RNA, 64 nt, Homo Sapiens; identical to SEQ ID NO: 125486

SEQ ID NO: 619434 - RNA, 64 nt, Homo Sapiens; identical to SEQ ID NO: 125487

SEQ ID NO: 619435 - RNA, 64 nt, Homo Sapiens; identical to SEQ ID NO: 125488

SEQ ID NO: 619436 - RNA, 64 nt, Homo Sapiens; identical to SEQ ID NO: 125489

SEQ ID NO: 619437 - RNA, 64 nt, Homo Sapiens; identical to SEQ ID NO: 125490

SEQ ID NO: 619438 - RNA, 64 nt, Homo Sapiens; identical to SEQ ID NO: 125491

SEQ ID NO: 619439 - RNA, 64 nt, Homo Sapiens; identical to SEQ ID NO: 125492

SEQ ID NO: 619440 - RNA, 64 nt, Homo Sapiens; identical to SEQ ID NO: 125493

SEQ ID NO: 619441 - RNA, 64 nt, Homo Sapiens; identical to SEQ ID NO: 125494

SEQ ID NO: 619442 - RNA, 64 nt, Homo Sapiens; identical to SEQ ID NO: 125495

SEQ ID NO: 619443 - RNA, 64 nt, Homo Sapiens; identical to SEQ ID NO: 125496

SEQ ID NO: 619444 - RNA, 64 nt, Homo Sapiens; identical to SEQ ID NO: 117710

SEQ ID NO: 619445 - RNA, 64 nt, Homo Sapiens; identical to SEQ ID NO: 117711

SEQ ID NO: 619446 - RNA, 64 nt, Homo Sapiens; identical to SEQ ID NO: 117712

SEQ ID NO: 619447 - RNA, 64 nt, Homo Sapiens; identical to SEQ ID NO: 117713

SEQ ID NO: 619448 - RNA, 64 nt, Homo Sapiens; identical to SEQ ID NO: 117714

SEQ ID NO: 619449 - RNA, 64 nt, Homo Sapiens; identical to SEQ ID NO: 117715

SEQ ID NO: 619450 - RNA, 64 nt, Homo Sapiens; identical to SEQ ID NO: 117716

SEQ ID NO: 619451 - RNA, 64 nt, Homo Sapiens; identical to SEQ ID NO: 117717

SEQ ID NO: 619452 - RNA, 64 nt, Homo Sapiens; identical to SEQ ID NO: 117718

SEQ ID NO: 619453 - RNA, 64 nt, Homo Sapiens; identical to SEQ ID NO: 117719

SEQ ID NO: 619454 - RNA, 64 nt, Homo Sapiens; identical to SEQ ID NO: 117720

SEQ ID NO: 619455 - RNA, 64 nt, Homo Sapiens; identical to SEQ ID NO: 117721

SEQ ID NO: 619456 - RNA, 64 nt, Homo Sapiens; identical to SEQ ID NO: 117722

SEQ ID NO: 619457 - RNA, 64 nt, Homo Sapiens; identical to SEQ ID NO: 117723

SEQ ID NO: 619458 - RNA, 64 nt, Homo Sapiens; identical to SEQ ID NO: 117724

SEQ ID NO: 619459 - RNA, 64 nt, Homo Sapiens; identical to SEQ ID NO: 117725

SEQ ID NO: 619460 - RNA, 64 nt, Homo Sapiens; identical to SEQ ID NO: 117726

SEQ ID NO: 619461 - RNA, 64 nt, Homo Sapiens; identical to SEQ ID NO: 117727

SEQ ID NO: 619462 - RNA, 64 nt, Homo Sapiens; identical to SEQ ID NO: 117728

SEQ ID NO: 619463 - RNA, 64 nt, Homo Sapiens; identical to SEQ ID NO: 117729

SEQ ID NO: 619464 - RNA, 64 nt, Homo Sapiens; identical to SEQ ID NO: 117730

SEQ ID NO: 619465 - RNA, 64 nt, Homo Sapiens; identical to SEQ ID NO: 117731

SEQ ID NO: 619466 - RNA, 64 nt, Homo Sapiens; identical to SEQ ID NO: 117732

SEQ ID NO: 619467 - RNA, 64 nt, Homo Sapiens; identical to SEQ ID NO: 117733

SEQ ID NO: 619468 - RNA, 64 nt, Homo Sapiens; identical to SEQ ID NO: 117734

SEQ ID NO: 619469 - RNA, 64 nt, Homo Sapiens; identical to SEQ ID NO: 117735

SEQ ID NO: 619470 - RNA, 64 nt, Homo Sapiens; identical to SEQ ID NO: 117736

SEQ ID NO: 619471 - RNA, 64 nt, Homo Sapiens; identical to SEQ ID NO: 117737

SEQ ID NO: 619472 - RNA, 64 nt, Homo Sapiens; identical to SEQ ID NO: 117738

SEQ ID NO: 619473 - RNA, 64 nt, Homo Sapiens; identical to SEQ ID NO: 117739

SEQ ID NO: 619474 - RNA, 64 nt, Homo Sapiens; identical to SEQ ID NO: 117740

SEQ ID NO: 619475 - RNA, 64 nt, Homo Sapiens; identical to SEQ ID NO: 117741

SEQ ID NO: 619476 - RNA, 64 nt, Homo Sapiens; identical to SEQ ID NO: 117742

SEQ ID NO: 619477 - RNA, 64 nt, Homo Sapiens; identical to SEQ ID NO: 117743

SEQ ID NO: 619478 - RNA, 64 nt, Homo Sapiens; identical to SEQ ID NO: 117744

SEQ ID NO: 619479 - RNA, 64 nt, Homo Sapiens; identical to SEQ ID NO: 117745

SEQ ID NO: 619480 - RNA, 64 nt, Homo Sapiens; identical to SEQ ID NO: 117746

SEQ ID NO: 619481 - RNA, 64 nt, Homo Sapiens; identical to SEQ ID NO: 117747

SEQ ID NO: 619482 - RNA, 64 nt, Homo Sapiens; identical to SEQ ID NO: 117748

SEQ ID NO: 619483 - RNA, 64 nt, Homo Sapiens; identical to SEQ ID NO: 117749

SEQ ID NO: 619484 - RNA, 64 nt, Homo Sapiens; identical to SEQ ID NO: 117750

SEQ ID NO: 619485 - RNA, 64 nt, Homo Sapiens; identical to SEQ ID NO: 117751

SEQ ID NO: 619486 - RNA, 64 nt, Homo Sapiens; identical to SEQ ID NO: 117752

SEQ ID NO: 619487 - RNA, 64 nt, Homo Sapiens; identical to SEQ ID NO: 117753

SEQ ID NO: 619488 - RNA, 64 nt, Homo Sapiens; identical to SEQ ID NO: 117754

SEQ ID NO: 619489 - RNA, 64 nt, Homo Sapiens; identical to SEQ ID NO: 117755

SEQ ID NO: 619490 - RNA, 64 nt, Homo Sapiens; identical to SEQ ID NO: 117756

SEQ ID NO: 619491 - RNA, 64 nt, Homo Sapiens; identical to SEQ ID NO: 117757

SEQ ID NO: 619492 - RNA, 64 nt, Homo Sapiens; identical to SEQ ID NO: 117758

SEQ ID NO: 619493 - RNA, 64 nt, Homo Sapiens; identical to SEQ ID NO: 117759

SEQ ID NO: 619494 - RNA, 64 nt, Homo Sapiens; identical to SEQ ID NO: 117760

SEQ ID NO: 619495 - RNA, 64 nt, Homo Sapiens; identical to SEQ ID NO: 117761

SEQ ID NO: 619496 - RNA, 64 nt, Homo Sapiens; identical to SEQ ID NO: 117762

SEQ ID NO: 619497 - RNA, 64 nt, Homo Sapiens; identical to SEQ ID NO: 117763

SEQ ID NO: 619498 - RNA, 64 nt, Homo Sapiens; identical to SEQ ID NO: 117764

SEQ ID NO: 619499 - RNA, 64 nt, Homo Sapiens; identical to SEQ ID NO: 117765

SEQ ID NO: 619500 - RNA, 64 nt, Homo Sapiens; identical to SEQ ID NO: 117766

SEQ ID NO: 619501 - RNA, 64 nt, Homo Sapiens; identical to SEQ ID NO: 117767

SEQ ID NO: 619502 - RNA, 64 nt, Homo Sapiens; identical to SEQ ID NO: 117768

SEQ ID NO: 619503 - RNA, 64 nt, Homo Sapiens; identical to SEQ ID NO: 117769

SEQ ID NO: 619504 - RNA, 64 nt, Homo Sapiens; identical to SEQ ID NO: 117770

SEQ ID NO: 619505 - RNA, 64 nt, Homo Sapiens; identical to SEQ ID NO: 117771

SEQ ID NO: 619506 - RNA, 64 nt, Homo Sapiens; identical to SEQ ID NO: 117772

SEQ ID NO: 619507 - RNA, 64 nt, Homo Sapiens; identical to SEQ ID NO: 117773

SEQ ID NO: 619508 - RNA, 64 nt, Homo Sapiens; identical to SEQ ID NO: 117774

SEQ ID NO: 619509 - RNA, 64 nt, Homo Sapiens; identical to SEQ ID NO: 117775

SEQ ID NO: 619510 - RNA, 64 nt, Homo Sapiens; identical to SEQ ID NO: 117776

SEQ ID NO: 619511 - RNA, 64 nt, Homo Sapiens; identical to SEQ ID NO: 117777

SEQ ID NO: 619512 - RNA, 64 nt, Homo Sapiens; identical to SEQ ID NO: 117778

SEQ ID NO: 619513 - RNA, 64 nt, Homo Sapiens; identical to SEQ ID NO: 117779

SEQ ID NO: 619514 - RNA, 64 nt, Homo Sapiens; identical to SEQ ID NO: 117780

SEQ ID NO: 619515 - RNA, 64 nt, Homo Sapiens; identical to SEQ ID NO: 117781

SEQ ID NO: 619516 - RNA, 64 nt, Homo Sapiens; identical to SEQ ID NO: 117782

SEQ ID NO: 619517 - RNA, 64 nt, Homo Sapiens; identical to SEQ ID NO: 117783

SEQ ID NO: 619518 - RNA, 64 nt, Homo Sapiens; identical to SEQ ID NO: 117784

SEQ ID NO: 619519 - RNA, 64 nt, Homo Sapiens; identical to SEQ ID NO: 117785

SEQ ID NO: 619520 - RNA, 64 nt, Homo Sapiens; identical to SEQ ID NO: 117786

SEQ ID NO: 619521 - RNA, 59 nt, Homo Sapiens; identical to SEQ ID NO: 58889

SEQ ID NO: 619522 - RNA, 64 nt, Homo Sapiens; identical to SEQ ID NO: 117788

SEQ ID NO: 619523 - RNA, 64 nt, Homo Sapiens; identical to SEQ ID NO: 117789

SEQ ID NO: 619524 - RNA, 64 nt, Homo Sapiens; identical to SEQ ID NO: 117790

SEQ ID NO: 619525 - RNA, 64 nt, Homo Sapiens; identical to SEQ ID NO: 117791

SEQ ID NO: 619526 - RNA, 64 nt, Homo Sapiens; identical to SEQ ID NO: 117792

SEQ ID NO: 619527 - RNA, 64 nt, Homo Sapiens; identical to SEQ ID NO: 117793

SEQ ID NO: 619528 - RNA, 64 nt, Homo Sapiens; identical to SEQ ID NO: 117794

SEQ ID NO: 619529 - RNA, 64 nt, Homo Sapiens; identical to SEQ ID NO: 117795

SEQ ID NO: 619530 - RNA, 64 nt, Homo Sapiens; identical to SEQ ID NO: 117796

SEQ ID NO: 619531 - RNA, 64 nt, Homo Sapiens; identical to SEQ ID NO: 117797

SEQ ID NO: 619532 - RNA, 64 nt, Homo Sapiens; identical to SEQ ID NO: 117798

SEQ ID NO: 619533 - RNA, 64 nt, Homo Sapiens; identical to SEQ ID NO: 117799

SEQ ID NO: 619534 - RNA, 64 nt, Homo Sapiens; identical to SEQ ID NO: 117800

SEQ ID NO: 619535 - RNA, 64 nt, Homo Sapiens; identical to SEQ ID NO: 117801

SEQ ID NO: 619536 - RNA, 64 nt, Homo Sapiens; identical to SEQ ID NO: 117802

SEQ ID NO: 619537 - RNA, 64 nt, Homo Sapiens; identical to SEQ ID NO: 117803

SEQ ID NO: 619538 - RNA, 64 nt, Homo Sapiens; identical to SEQ ID NO: 117804

SEQ ID NO: 619539 - RNA, 64 nt, Homo Sapiens; identical to SEQ ID NO: 117805

SEQ ID NO: 619540 - RNA, 64 nt, Homo Sapiens; identical to SEQ ID NO: 117806

SEQ ID NO: 619541 - RNA, 64 nt, Homo Sapiens; identical to SEQ ID NO: 117807

SEQ ID NO: 619542 - RNA, 64 nt, Homo Sapiens; identical to SEQ ID NO: 117808

SEQ ID NO: 619543 - RNA, 64 nt, Homo Sapiens; identical to SEQ ID NO: 117809

SEQ ID NO: 619544 - RNA, 64 nt, Homo Sapiens; identical to SEQ ID NO: 117810

SEQ ID NO: 619545 - RNA, 64 nt, Homo Sapiens; identical to SEQ ID NO: 117811

SEQ ID NO: 619546 - RNA, 64 nt, Homo Sapiens; identical to SEQ ID NO: 117812

SEQ ID NO: 619547 - RNA, 64 nt, Homo Sapiens; identical to SEQ ID NO: 117813

SEQ ID NO: 619548 - RNA, 64 nt, Homo Sapiens; identical to SEQ ID NO: 117814

SEQ ID NO: 619549 - RNA, 64 nt, Homo Sapiens; identical to SEQ ID NO: 117815

SEQ ID NO: 619550 - RNA, 64 nt, Homo Sapiens; identical to SEQ ID NO: 117816

SEQ ID NO: 619551 - RNA, 64 nt, Homo Sapiens; identical to SEQ ID NO: 117817

SEQ ID NO: 619552 - RNA, 64 nt, Homo Sapiens; identical to SEQ ID NO: 117818

SEQ ID NO: 619553 - RNA, 64 nt, Homo Sapiens; identical to SEQ ID NO: 117819

SEQ ID NO: 619554 - RNA, 64 nt, Homo Sapiens; identical to SEQ ID NO: 117820

SEQ ID NO: 619555 - RNA, 64 nt, Homo Sapiens; identical to SEQ ID NO: 117821

SEQ ID NO: 619556 - RNA, 64 nt, Homo Sapiens; identical to SEQ ID NO: 117822

SEQ ID NO: 619557 - RNA, 64 nt, Homo Sapiens; identical to SEQ ID NO: 117823

SEQ ID NO: 619558 - RNA, 64 nt, Homo Sapiens; identical to SEQ ID NO: 145091

SEQ ID NO: 619559 - RNA, 64 nt, Homo Sapiens; identical to SEQ ID NO: 145092

SEQ ID NO: 619560 - RNA, 64 nt, Homo Sapiens; identical to SEQ ID NO: 145093

SEQ ID NO: 619561 - RNA, 64 nt, Homo Sapiens; identical to SEQ ID NO: 145094

SEQ ID NO: 619562 - RNA, 64 nt, Homo Sapiens; identical to SEQ ID NO: 145095

SEQ ID NO: 619563 - RNA, 64 nt, Homo Sapiens; identical to SEQ ID NO: 145096

SEQ ID NO: 619564 - RNA, 64 nt, Homo Sapiens; identical to SEQ ID NO: 145097

SEQ ID NO: 619565 - RNA, 64 nt, Homo Sapiens; identical to SEQ ID NO: 145098

SEQ ID NO: 619566 - RNA, 64 nt, Homo Sapiens; identical to SEQ ID NO: 145099

SEQ ID NO: 619567 - RNA, 64 nt, Homo Sapiens; identical to SEQ ID NO: 145100

SEQ ID NO: 619568 - RNA, 64 nt, Homo Sapiens; identical to SEQ ID NO: 145101

SEQ ID NO: 619569 - RNA, 64 nt, Homo Sapiens; identical to SEQ ID NO: 145102

SEQ ID NO: 619570 - RNA, 64 nt, Homo Sapiens; identical to SEQ ID NO: 145103

SEQ ID NO: 619571 - RNA, 64 nt, Homo Sapiens; identical to SEQ ID NO: 145104

SEQ ID NO: 619572 - RNA, 64 nt, Homo Sapiens; identical to SEQ ID NO: 145105

SEQ ID NO: 619573 - RNA, 64 nt, Homo Sapiens; identical to SEQ ID NO: 145106

SEQ ID NO: 619574 - RNA, 64 nt, Homo Sapiens; identical to SEQ ID NO: 145107

SEQ ID NO: 619575 - RNA, 64 nt, Homo Sapiens; identical to SEQ ID NO: 145108

SEQ ID NO: 619576 - RNA, 64 nt, Homo Sapiens; identical to SEQ ID NO: 145109

SEQ ID NO: 619577 - RNA, 64 nt, Homo Sapiens; identical to SEQ ID NO: 145110

SEQ ID NO: 619578 - RNA, 64 nt, Homo Sapiens; identical to SEQ ID NO: 145111

SEQ ID NO: 619579 - RNA, 64 nt, Homo Sapiens; identical to SEQ ID NO: 145112

SEQ ID NO: 619580 - RNA, 64 nt, Homo Sapiens; identical to SEQ ID NO: 145113

SEQ ID NO: 619581 - RNA, 64 nt, Homo Sapiens; identical to SEQ ID NO: 145114

SEQ ID NO: 619582 - RNA, 64 nt, Homo Sapiens; identical to SEQ ID NO: 145115

SEQ ID NO: 619583 - RNA, 64 nt, Homo Sapiens; identical to SEQ ID NO: 145116

SEQ ID NO: 619584 - RNA, 64 nt, Homo Sapiens; identical to SEQ ID NO: 145117

SEQ ID NO: 619585 - RNA, 64 nt, Homo Sapiens; identical to SEQ ID NO: 145118

SEQ ID NO: 619586 - RNA, 64 nt, Homo Sapiens; identical to SEQ ID NO: 145119

SEQ ID NO: 619587 - RNA, 64 nt, Homo Sapiens; identical to SEQ ID NO: 145120

SEQ ID NO: 619588 - RNA, 64 nt, Homo Sapiens; identical to SEQ ID NO: 145121

SEQ ID NO: 619589 - RNA, 64 nt, Homo Sapiens; identical to SEQ ID NO: 145122

SEQ ID NO: 619590 - RNA, 64 nt, Homo Sapiens; identical to SEQ ID NO: 145123

SEQ ID NO: 619591 - RNA, 64 nt, Homo Sapiens; identical to SEQ ID NO: 145124

SEQ ID NO: 619592 - RNA, 64 nt, Homo Sapiens; identical to SEQ ID NO: 145125

SEQ ID NO: 619593 - RNA, 64 nt, Homo Sapiens; identical to SEQ ID NO: 145126

SEQ ID NO: 619594 - RNA, 64 nt, Homo Sapiens; identical to SEQ ID NO: 44417

SEQ ID NO: 619595 - RNA, 64 nt, Homo Sapiens; identical to SEQ ID NO: 44418

SEQ ID NO: 619596 - RNA, 64 nt, Homo Sapiens; identical to SEQ ID NO: 44419

SEQ ID NO: 619597 - RNA, 64 nt, Homo Sapiens; identical to SEQ ID NO: 44420

SEQ ID NO: 619598 - RNA, 62 nt, Homo Sapiens; identical to SEQ ID NO: 44421

SEQ ID NO: 619599 - RNA, 64 nt, Homo Sapiens; identical to SEQ ID NO: 44422

SEQ ID NO: 619600 - RNA, 64 nt, Homo Sapiens; identical to SEQ ID NO: 44423

SEQ ID NO: 619601 - RNA, 64 nt, Homo Sapiens; identical to SEQ ID NO: 44424

SEQ ID NO: 619602 - RNA, 64 nt, Homo Sapiens; identical to SEQ ID NO: 145359

SEQ ID NO: 619603 - RNA, 64 nt, Homo Sapiens; identical to SEQ ID NO: 145360

SEQ ID NO: 619604 - RNA, 64 nt, Homo Sapiens; identical to SEQ ID NO: 145361

SEQ ID NO: 619605 - RNA, 64 nt, Homo Sapiens; identical to SEQ ID NO: 145362

SEQ ID NO: 619606 - RNA, 64 nt, Homo Sapiens; identical to SEQ ID NO: 145363

SEQ ID NO: 619607 - RNA, 64 nt, Homo Sapiens; identical to SEQ ID NO: 145364

SEQ ID NO: 619608 - RNA, 64 nt, Homo Sapiens; identical to SEQ ID NO: 145365

SEQ ID NO: 619609 - RNA, 64 nt, Homo Sapiens; identical to SEQ ID NO: 145366

SEQ ID NO: 619610 - RNA, 64 nt, Homo Sapiens; identical to SEQ ID NO: 145367

SEQ ID NO: 619611 - RNA, 64 nt, Homo Sapiens; identical to SEQ ID NO: 145368

SEQ ID NO: 619612 - RNA, 64 nt, Homo Sapiens; identical to SEQ ID NO: 145369

SEQ ID NO: 619613 - RNA, 64 nt, Homo Sapiens; identical to SEQ ID NO: 145370

SEQ ID NO: 619614 - RNA, 64 nt, Homo Sapiens; identical to SEQ ID NO: 145371

SEQ ID NO: 619615 - RNA, 64 nt, Homo Sapiens; identical to SEQ ID NO: 145372

SEQ ID NO: 619616 - RNA, 64 nt, Homo Sapiens; identical to SEQ ID NO: 145373

SEQ ID NO: 619617 - RNA, 64 nt, Homo Sapiens; identical to SEQ ID NO: 145374

SEQ ID NO: 619618 - RNA, 64 nt, Homo Sapiens; identical to SEQ ID NO: 145375

SEQ ID NO: 619619 - RNA, 64 nt, Homo Sapiens; identical to SEQ ID NO: 145376

SEQ ID NO: 619620 - RNA, 64 nt, Homo Sapiens; identical to SEQ ID NO: 145377

SEQ ID NO: 619621 - RNA, 64 nt, Homo Sapiens; identical to SEQ ID NO: 145378

SEQ ID NO: 619622 - RNA, 64 nt, Homo Sapiens; identical to SEQ ID NO: 145379

SEQ ID NO: 619623 - RNA, 64 nt, Homo Sapiens; identical to SEQ ID NO: 145380

SEQ ID NO: 619624 - RNA, 64 nt, Homo Sapiens; identical to SEQ ID NO: 145381

SEQ ID NO: 619625 - RNA, 64 nt, Homo Sapiens; identical to SEQ ID NO: 145382

SEQ ID NO: 619626 - RNA, 64 nt, Homo Sapiens; identical to SEQ ID NO: 145383

SEQ ID NO: 619627 - RNA, 64 nt, Homo Sapiens; identical to SEQ ID NO: 145384

SEQ ID NO: 619628 - RNA, 64 nt, Homo Sapiens; identical to SEQ ID NO: 145385

SEQ ID NO: 619629 - RNA, 64 nt, Homo Sapiens; identical to SEQ ID NO: 145386

SEQ ID NO: 619630 - RNA, 64 nt, Homo Sapiens; identical to SEQ ID NO: 145387

SEQ ID NO: 619631 - RNA, 64 nt, Homo Sapiens; identical to SEQ ID NO: 145388

SEQ ID NO: 619632 - RNA, 64 nt, Homo Sapiens; identical to SEQ ID NO: 145389

SEQ ID NO: 619633 - RNA, 64 nt, Homo Sapiens; identical to SEQ ID NO: 145390

SEQ ID NO: 619634 - RNA, 64 nt, Homo Sapiens; identical to SEQ ID NO: 145391

SEQ ID NO: 619635 - RNA, 64 nt, Homo Sapiens; identical to SEQ ID NO: 145392

SEQ ID NO: 619636 - RNA, 64 nt, Homo Sapiens; identical to SEQ ID NO: 145393

SEQ ID NO: 619637 - RNA, 64 nt, Homo Sapiens; identical to SEQ ID NO: 145394

SEQ ID NO: 619638 - RNA, 64 nt, Homo Sapiens; identical to SEQ ID NO: 145395

SEQ ID NO: 619639 - RNA, 64 nt, Homo Sapiens; identical to SEQ ID NO: 145396

SEQ ID NO: 619640 - RNA, 64 nt, Homo Sapiens; identical to SEQ ID NO: 145397

SEQ ID NO: 619641 - RNA, 64 nt, Homo Sapiens; identical to SEQ ID NO: 145398

SEQ ID NO: 619642 - RNA, 64 nt, Homo Sapiens; identical to SEQ ID NO: 145399

SEQ ID NO: 619643 - RNA, 64 nt, Homo Sapiens
gacucagaggggaagaggguugggaauuccucuuugcacccagaguuauucugcacaaaacuuu

SEQ ID NO: 619644 - RNA, 64 nt, Homo Sapiens
gaccaugugcucuccacaccgucucuggcagcucugcacccagguccccagcugccucaacucu

SEQ ID NO: 619645 - RNA, 64 nt, Homo Sapiens
cgcuggugccauggcgaagcggcgacagccagcgugcacccagaaugagcagcuccugcccugu

SEQ ID NO: 619646 - RNA, 64 nt, Homo Sapiens
cugcuugaucccaccugggauggaacgcugcagcugcacccacccuggagcuugagcucuugcc

SEQ ID NO: 619647 - RNA, 64 nt, Homo Sapiens
gagaacuuuucugucuuacaagaggauuguaaaaugcacccaucagugcucuguaaaacacacc

SEQ ID NO: 619648 - RNA, 64 nt, Homo Sapiens
ucagcgcucuguagcuagcaauagguuuguaaaaugcacccaucagcacucuguaaaacgcacc

SEQ ID NO: 619649 - RNA, 64 nt, Homo Sapiens
ccuguggccagauuguggccgacugccagucucaugcacccagacaggcagcggagcccuacua

SEQ ID NO: 619650 - RNA, 64 nt, Homo Sapiens
uggcagccaggcagcggagcucacaacucagguaugcacccaugcugaaaguuccuuugguugc

SEQ ID NO: 619651 - RNA, 64 nt, Homo Sapiens
cucccaaguagcuggaauuacaggcacauaccacugcacccagcuaauuuuuguauuuuuagua

SEQ ID NO: 619652 - RNA, 64 nt, Homo Sapiens
caaaugguguuuucuuaugcaggacugaucgauuugcacccaccuuucugcacauaaguuaugg

SEQ ID NO: 619653 - RNA, 64 nt, Homo Sapiens
gacccccucccuuggggcgaccucugccucccagugcacccaauccccgcaagcaaaccugccc

SEQ ID NO: 619654 - RNA, 64 nt, Homo Sapiens
gggagcagugaggcaggacagaaaugcugccggcugcacccagagcugcuccucuccgcagcca

SEQ ID NO: 619655 - RNA, 64 nt, Homo Sapiens; identical to SEQ ID NO: 257739

SEQ ID NO: 619656 - RNA, 64 nt, Homo Sapiens; identical to SEQ ID NO: 257740

SEQ ID NO: 619657 - RNA, 64 nt, Homo Sapiens; identical to SEQ ID NO: 257741

SEQ ID NO: 619658 - RNA, 64 nt, Homo Sapiens; identical to SEQ ID NO: 257742

SEQ ID NO: 619659 - RNA, 64 nt, Homo Sapiens; identical to SEQ ID NO: 257743

SEQ ID NO: 619660 - RNA, 64 nt, Homo Sapiens
gcugggccgagggaggagcugguuuggcauaggaccuaaccagugaagcuagaggcuacagcca

SEQ ID NO: 619661 - RNA, 64 nt, Homo Sapiens
guuuuuagccagggaaaacugagccccaggaaaaccuaaccacugggcaggcagaauuuguuug

SEQ ID NO: 619662 - RNA, 64 nt, Homo Sapiens
ggaguucccugggcuucuggcaccuguuucuaggccuaaccauuaguacuuacugugcagggaa

SEQ ID NO: 619663 - RNA, 64 nt, Homo Sapiens
aaacuccuuuuaaccaagcuuagcuucucaaaggccuaaccaagccuuggcaccgccagauccu

SEQ ID NO: 619664 - RNA, 64 nt, Homo Sapiens
ugagccgagaucaugccacugcacuccagccugggcgacggagugagacuccaucucaaaaaaa

SEQ ID NO: 619665 - RNA, 64 nt, Homo Sapiens
gagacuccgucucgaaaaaauugucugcuuguuugcgacggagcuaugcucugcucaguguugu

SEQ ID NO: 619666 - RNA, 64 nt, Homo Sapiens
gaaaaaagaaguguccgagagaacuugacaaguugcgacggagaacacagagagacagacuuga

SEQ ID NO: 619667 - RNA, 64 nt, Homo Sapiens
gaaaggaaaauuaguuguguauuucacgacgaaagcgacggaccaaaagaaauuuccugcccca

SEQ ID NO: 619668 - RNA, 64 nt, Homo Sapiens
ugauccgggacugcaauaacaauguccagaguaugcgacggacagaggaacuaaucuaccugag

SEQ ID NO: 619669 - RNA, 64 nt, Homo Sapiens
gaguggcucguguuucacagugggcggcuucccugcgacggaggcaggaccaggcauuuagcua

SEQ ID NO: 619670 - RNA, 64 nt, Homo Sapiens
gagacucugucucaaaacaagcacuccagccugggcgacggagcugagcugagauugcgccacu

SEQ ID NO: 619671 - RNA, 64 nt, Homo Sapiens
guguguguguugaaaguaaaaggagggcaguucugcgacggacucuguaaucagagaguauuua

SEQ ID NO: 619672 - RNA, 64 nt, Homo Sapiens
acugcaccugccuccagccgcacugugugaaucggcgacggagcacagcuugucucuugccugc

SEQ ID NO: 619673 - RNA, 64 nt, Homo Sapiens
cggaaagacucuuuucuccucgccaaauugcgaggcgacggaaaaaugugaaucccggcggaca

SEQ ID NO: 619674 - RNA, 64 nt, Homo Sapiens
guaugagcucuugugaggaugcugccgccacccugcgacggagcggcgccccggacugccugac

SEQ ID NO: 619675 - RNA, 64 nt, Homo Sapiens
uggacggucccggcucagaccgucuguacucagagcgacggaugcccccugggacccucacugc

SEQ ID NO: 619676 - RNA, 64 nt, Homo Sapiens
caaggacaagacgaguccgagcccuucuagaugggcgacggaggggugucgcggggagccuggu

SEQ ID NO: 619677 - RNA, 64 nt, Homo Sapiens
gagacucccucucaaaaaaaguacuccagccugggcgacggaguugagccgagaucucaccacu

SEQ ID NO: 619678 - RNA, 64 nt, Homo Sapiens
gagccugugagggagguggcggguccccacuguggcgacggagagcugacaguagcccagggcu

SEQ ID NO: 619679 - RNA, 64 nt, Homo Sapiens
gcagggcccacccugcggugaggccgcagcccccgcgacggagggcagggggcucggaggacuc

SEQ ID NO: 619680 - RNA, 64 nt, Homo Sapiens; identical to SEQ ID NO: 169421

SEQ ID NO: 619681 - RNA, 64 nt, Homo Sapiens; identical to SEQ ID NO: 169422

SEQ ID NO: 619682 - RNA, 64 nt, Homo Sapiens; identical to SEQ ID NO: 169423

SEQ ID NO: 619683 - RNA, 64 nt, Homo Sapiens; identical to SEQ ID NO: 169424

SEQ ID NO: 619684 - RNA, 64 nt, Homo Sapiens; identical to SEQ ID NO: 169425

SEQ ID NO: 619685 - RNA, 64 nt, Homo Sapiens; identical to SEQ ID NO: 169426

SEQ ID NO: 619686 - RNA, 64 nt, Homo Sapiens; identical to SEQ ID NO: 169427

SEQ ID NO: 619687 - RNA, 64 nt, Homo Sapiens; identical to SEQ ID NO: 169428

SEQ ID NO: 619688 - RNA, 64 nt, Homo Sapiens; identical to SEQ ID NO: 169429

SEQ ID NO: 619689 - RNA, 64 nt, Homo Sapiens; identical to SEQ ID NO: 169430

SEQ ID NO: 619690 - RNA, 64 nt, Homo Sapiens; identical to SEQ ID NO: 169431

SEQ ID NO: 619691 - RNA, 64 nt, Homo Sapiens; identical to SEQ ID NO: 169432

SEQ ID NO: 619692 - RNA, 64 nt, Homo Sapiens; identical to SEQ ID NO: 169433

SEQ ID NO: 619693 - RNA, 64 nt, Homo Sapiens; identical to SEQ ID NO: 169434

SEQ ID NO: 619694 - RNA, 64 nt, Homo Sapiens; identical to SEQ ID NO: 169435

SEQ ID NO: 619695 - RNA, 64 nt, Homo Sapiens; identical to SEQ ID NO: 169436

SEQ ID NO: 619696 - RNA, 64 nt, Homo Sapiens; identical to SEQ ID NO: 169437

SEQ ID NO: 619697 - RNA, 64 nt, Homo Sapiens; identical to SEQ ID NO: 169438

SEQ ID NO: 619698 - RNA, 64 nt, Homo Sapiens; identical to SEQ ID NO: 169439

SEQ ID NO: 619699 - RNA, 64 nt, Homo Sapiens; identical to SEQ ID NO: 169440

SEQ ID NO: 619700 - RNA, 64 nt, Homo Sapiens; identical to SEQ ID NO: 169441

SEQ ID NO: 619701 - RNA, 64 nt, Homo Sapiens; identical to SEQ ID NO: 169442

SEQ ID NO: 619702 - RNA, 64 nt, Homo Sapiens; identical to SEQ ID NO: 169443

SEQ ID NO: 619703 - RNA, 64 nt, Homo Sapiens; identical to SEQ ID NO: 169442

SEQ ID NO: 619704 - RNA, 64 nt, Homo Sapiens; identical to SEQ ID NO: 169443

SEQ ID NO: 619705 - RNA, 64 nt, Homo Sapiens; identical to SEQ ID NO: 522710

SEQ ID NO: 619706 - RNA, 64 nt, Homo Sapiens; identical to SEQ ID NO: 522711

SEQ ID NO: 619707 - RNA, 64 nt, Homo Sapiens; identical to SEQ ID NO: 522712

SEQ ID NO: 619708 - RNA, 64 nt, Homo Sapiens; identical to SEQ ID NO: 522713

SEQ ID NO: 619709 - RNA, 64 nt, Homo Sapiens; identical to SEQ ID NO: 522714

SEQ ID NO: 619710 - RNA, 64 nt, Homo Sapiens; identical to SEQ ID NO: 522715

SEQ ID NO: 619711 - RNA, 64 nt, Homo Sapiens; identical to SEQ ID NO: 522716

SEQ ID NO: 619712 - RNA, 64 nt, Homo Sapiens; identical to SEQ ID NO: 522717

SEQ ID NO: 619713 - RNA, 64 nt, Homo Sapiens; identical to SEQ ID NO: 522718

SEQ ID NO: 619714 - RNA, 64 nt, Homo Sapiens; identical to SEQ ID NO: 522719

SEQ ID NO: 619715 - RNA, 64 nt, Homo Sapiens; identical to SEQ ID NO: 522720

SEQ ID NO: 619716 - RNA, 64 nt, Homo Sapiens; identical to SEQ ID NO: 522721

SEQ ID NO: 619717 - RNA, 64 nt, Homo Sapiens; identical to SEQ ID NO: 522722

SEQ ID NO: 619718 - RNA, 64 nt, Homo Sapiens; identical to SEQ ID NO: 522723

SEQ ID NO: 619719 - RNA, 64 nt, Homo Sapiens; identical to SEQ ID NO: 522724

SEQ ID NO: 619720 - RNA, 64 nt, Homo Sapiens; identical to SEQ ID NO: 522725

SEQ ID NO: 619721 - RNA, 64 nt, Homo Sapiens
aucuugcugagugucucuugaucaucaucauugucgucgucauccuugcugagucaucaucauc

SEQ ID NO: 619722 - RNA, 64 nt, Homo Sapiens
aucuugcugagucaucaucaaucaucaucauugucgucgucaucacacacacaucaucauuauc

SEQ ID NO: 619723 - RNA, 64 nt, Homo Sapiens; identical to SEQ ID NO: 167088

SEQ ID NO: 619724 - RNA, 64 nt, Homo Sapiens; identical to SEQ ID NO: 167089

SEQ ID NO: 619725 - RNA, 64 nt, Homo Sapiens; identical to SEQ ID NO: 167090

SEQ ID NO: 619726 - RNA, 64 nt, Homo Sapiens; identical to SEQ ID NO: 167091

SEQ ID NO: 619727 - RNA, 64 nt, Homo Sapiens; identical to SEQ ID NO: 167092

SEQ ID NO: 619728 - RNA, 64 nt, Homo Sapiens; identical to SEQ ID NO: 167093

SEQ ID NO: 619729 - RNA, 64 nt, Homo Sapiens; identical to SEQ ID NO: 167094

SEQ ID NO: 619730 - RNA, 64 nt, Homo Sapiens; identical to SEQ ID NO: 167095

SEQ ID NO: 619731 - RNA, 64 nt, Homo Sapiens; identical to SEQ ID NO: 167096

SEQ ID NO: 619732 - RNA, 64 nt, Homo Sapiens; identical to SEQ ID NO: 167097

SEQ ID NO: 619733 - RNA, 64 nt, Homo Sapiens; identical to SEQ ID NO: 167098

SEQ ID NO: 619734 - RNA, 64 nt, Homo Sapiens; identical to SEQ ID NO: 167099

SEQ ID NO: 619735 - RNA, 64 nt, Homo Sapiens; identical to SEQ ID NO: 167100

SEQ ID NO: 619736 - RNA, 64 nt, Homo Sapiens; identical to SEQ ID NO: 167101

SEQ ID NO: 619737 - RNA, 64 nt, Homo Sapiens; identical to SEQ ID NO: 167102

SEQ ID NO: 619738 - RNA, 64 nt, Homo Sapiens; identical to SEQ ID NO: 167103

SEQ ID NO: 619739 - RNA, 64 nt, Homo Sapiens; identical to SEQ ID NO: 167104

SEQ ID NO: 619740 - RNA, 64 nt, Homo Sapiens; identical to SEQ ID NO: 167105

SEQ ID NO: 619741 - RNA, 64 nt, Homo Sapiens; identical to SEQ ID NO: 167106

SEQ ID NO: 619742 - RNA, 64 nt, Homo Sapiens; identical to SEQ ID NO: 167107

SEQ ID NO: 619743 - RNA, 64 nt, Homo Sapiens; identical to SEQ ID NO: 167108

SEQ ID NO: 619744 - RNA, 64 nt, Homo Sapiens; identical to SEQ ID NO: 167109

SEQ ID NO: 619745 - RNA, 64 nt, Homo Sapiens; identical to SEQ ID NO: 167110

SEQ ID NO: 619746 - RNA, 64 nt, Homo Sapiens; identical to SEQ ID NO: 167111

SEQ ID NO: 619747 - RNA, 64 nt, Homo Sapiens; identical to SEQ ID NO: 167112

SEQ ID NO: 619748 - RNA, 64 nt, Homo Sapiens; identical to SEQ ID NO: 167113

SEQ ID NO: 619749 - RNA, 64 nt, Homo Sapiens; identical to SEQ ID NO: 167114

SEQ ID NO: 619750 - RNA, 64 nt, Homo Sapiens; identical to SEQ ID NO: 167115

SEQ ID NO: 619751 - RNA, 64 nt, Homo Sapiens; identical to SEQ ID NO: 167116

SEQ ID NO: 619752 - RNA, 64 nt, Homo Sapiens; identical to SEQ ID NO: 167117

SEQ ID NO: 619753 - RNA, 64 nt, Homo Sapiens; identical to SEQ ID NO: 167118

SEQ ID NO: 619754 - RNA, 64 nt, Homo Sapiens; identical to SEQ ID NO: 167119

SEQ ID NO: 619755 - RNA, 64 nt, Homo Sapiens; identical to SEQ ID NO: 167120

SEQ ID NO: 619756 - RNA, 64 nt, Homo Sapiens; identical to SEQ ID NO: 167121

SEQ ID NO: 619757 - RNA, 64 nt, Homo Sapiens; identical to SEQ ID NO: 167122

SEQ ID NO: 619758 - RNA, 64 nt, Homo Sapiens; identical to SEQ ID NO: 167123

SEQ ID NO: 619759 - RNA, 64 nt, Homo Sapiens; identical to SEQ ID NO: 167124

SEQ ID NO: 619760 - RNA, 64 nt, Homo Sapiens; identical to SEQ ID NO: 167125

SEQ ID NO: 619761 - RNA, 64 nt, Homo Sapiens; identical to SEQ ID NO: 167126

SEQ ID NO: 619762 - RNA, 64 nt, Homo Sapiens; identical to SEQ ID NO: 167127

SEQ ID NO: 619763 - RNA, 64 nt, Homo Sapiens; identical to SEQ ID NO: 167128

SEQ ID NO: 619764 - RNA, 64 nt, Homo Sapiens; identical to SEQ ID NO: 167129

SEQ ID NO: 619765 - RNA, 64 nt, Homo Sapiens; identical to SEQ ID NO: 167130

SEQ ID NO: 619766 - RNA, 64 nt, Homo Sapiens; identical to SEQ ID NO: 167131

SEQ ID NO: 619767 - RNA, 64 nt, Homo Sapiens; identical to SEQ ID NO: 167132

SEQ ID NO: 619768 - RNA, 64 nt, Homo Sapiens; identical to SEQ ID NO: 167133

SEQ ID NO: 619769 - RNA, 64 nt, Homo Sapiens; identical to SEQ ID NO: 167134

SEQ ID NO: 619770 - RNA, 64 nt, Homo Sapiens; identical to SEQ ID NO: 167135

SEQ ID NO: 619771 - RNA, 64 nt, Homo Sapiens; identical to SEQ ID NO: 167136

SEQ ID NO: 619772 - RNA, 64 nt, Homo Sapiens; identical to SEQ ID NO: 167137

SEQ ID NO: 619773 - RNA, 64 nt, Homo Sapiens; identical to SEQ ID NO: 167138

SEQ ID NO: 619774 - RNA, 64 nt, Homo Sapiens; identical to SEQ ID NO: 167139

SEQ ID NO: 619775 - RNA, 64 nt, Homo Sapiens; identical to SEQ ID NO: 167140

SEQ ID NO: 619776 - RNA, 64 nt, Homo Sapiens; identical to SEQ ID NO: 167141

SEQ ID NO: 619777 - RNA, 64 nt, Homo Sapiens; identical to SEQ ID NO: 167142

SEQ ID NO: 619778 - RNA, 64 nt, Homo Sapiens; identical to SEQ ID NO: 167143

SEQ ID NO: 619779 - RNA, 64 nt, Homo Sapiens; identical to SEQ ID NO: 167144

SEQ ID NO: 619780 - RNA, 64 nt, Homo Sapiens; identical to SEQ ID NO: 167145

SEQ ID NO: 619781 - RNA, 64 nt, Homo Sapiens; identical to SEQ ID NO: 167146

SEQ ID NO: 619782 - RNA, 64 nt, Homo Sapiens; identical to SEQ ID NO: 167147

SEQ ID NO: 619783 - RNA, 64 nt, Homo Sapiens; identical to SEQ ID NO: 167148

SEQ ID NO: 619784 - RNA, 64 nt, Homo Sapiens; identical to SEQ ID NO: 167149

SEQ ID NO: 619785 - RNA, 64 nt, Homo Sapiens; identical to SEQ ID NO: 167150

SEQ ID NO: 619786 - RNA, 64 nt, Homo Sapiens; identical to SEQ ID NO: 167151

SEQ ID NO: 619787 - RNA, 64 nt, Homo Sapiens; identical to SEQ ID NO: 167152

SEQ ID NO: 619788 - RNA, 64 nt, Homo Sapiens; identical to SEQ ID NO: 167153

SEQ ID NO: 619789 - RNA, 64 nt, Homo Sapiens; identical to SEQ ID NO: 167154

SEQ ID NO: 619790 - RNA, 64 nt, Homo Sapiens; identical to SEQ ID NO: 167155

SEQ ID NO: 619791 - RNA, 64 nt, Homo Sapiens; identical to SEQ ID NO: 167156

SEQ ID NO: 619792 - RNA, 64 nt, Homo Sapiens; identical to SEQ ID NO: 167157

SEQ ID NO: 619793 - RNA, 64 nt, Homo Sapiens; identical to SEQ ID NO: 167158

SEQ ID NO: 619794 - RNA, 64 nt, Homo Sapiens; identical to SEQ ID NO: 167159

SEQ ID NO: 619795 - RNA, 64 nt, Homo Sapiens; identical to SEQ ID NO: 167160

SEQ ID NO: 619796 - RNA, 64 nt, Homo Sapiens; identical to SEQ ID NO: 167161

SEQ ID NO: 619797 - RNA, 64 nt, Homo Sapiens; identical to SEQ ID NO: 167162

SEQ ID NO: 619798 - RNA, 64 nt, Homo Sapiens; identical to SEQ ID NO: 167163

SEQ ID NO: 619799 - RNA, 64 nt, Homo Sapiens; identical to SEQ ID NO: 167164

SEQ ID NO: 619800 - RNA, 64 nt, Homo Sapiens; identical to SEQ ID NO: 167165

SEQ ID NO: 619801 - RNA, 64 nt, Homo Sapiens; identical to SEQ ID NO: 167166

SEQ ID NO: 619802 - RNA, 64 nt, Homo Sapiens; identical to SEQ ID NO: 167167

SEQ ID NO: 619803 - RNA, 64 nt, Homo Sapiens; identical to SEQ ID NO: 167168

SEQ ID NO: 619804 - RNA, 64 nt, Homo Sapiens
ggggauccugucuuccuccccaccccaccccacucuuacccaauuucugggcucuggauccuca

SEQ ID NO: 619805 - RNA, 64 nt, Homo Sapiens
cugccucucuguggucuccauccugacucuugaacuuacccacaauaagaauaaauucugccuc

SEQ ID NO: 619806 - RNA, 64 nt, Homo Sapiens
aacaaggaggcacguuuggccucugucagauucacuuacccacaaccuucaagaacaugccaac

SEQ ID NO: 619807 - RNA, 64 nt, Homo Sapiens
accacuccuccaggagagcuaggaccgguugcagcuuacccagaaacaugucacuccacagcag

SEQ ID NO: 619808 - RNA, 64 nt, Homo Sapiens
augagauugaauuguuuugcagacaguguguugccuuacccagacugacugucuuuauugcaga

SEQ ID NO: 619809 - RNA, 64 nt, Homo Sapiens
augagugcuaggauuacaggagacaguguguugccuuacccagacacacacacacuauuucaga

SEQ ID NO: 619810 - RNA, 64 nt, Homo Sapiens; identical to SEQ ID NO: 209724

SEQ ID NO: 619811 - RNA, 64 nt, Homo Sapiens; identical to SEQ ID NO: 209725

SEQ ID NO: 619812 - RNA, 64 nt, Homo Sapiens; identical to SEQ ID NO: 209726

SEQ ID NO: 619813 - RNA, 64 nt, Homo Sapiens; identical to SEQ ID NO: 209727

SEQ ID NO: 619814 - RNA, 64 nt, Homo Sapiens; identical to SEQ ID NO: 209728

SEQ ID NO: 619815 - RNA, 64 nt, Homo Sapiens; identical to SEQ ID NO: 209729

SEQ ID NO: 619816 - RNA, 64 nt, Homo Sapiens; identical to SEQ ID NO: 209730

SEQ ID NO: 619817 - RNA, 64 nt, Homo Sapiens; identical to SEQ ID NO: 209731

SEQ ID NO: 619818 - RNA, 64 nt, Homo Sapiens; identical to SEQ ID NO: 209732

SEQ ID NO: 619819 - RNA, 64 nt, Homo Sapiens; identical to SEQ ID NO: 209733

SEQ ID NO: 619820 - RNA, 63 nt, Homo Sapiens; identical to SEQ ID NO: 209734

SEQ ID NO: 619821 - RNA, 64 nt, Homo Sapiens; identical to SEQ ID NO: 209735

SEQ ID NO: 619822 - RNA, 64 nt, Homo Sapiens; identical to SEQ ID NO: 209736

SEQ ID NO: 619823 - RNA, 64 nt, Homo Sapiens; identical to SEQ ID NO: 209737

SEQ ID NO: 619824 - RNA, 64 nt, Homo Sapiens; identical to SEQ ID NO: 209738

SEQ ID NO: 619825 - RNA, 64 nt, Homo Sapiens; identical to SEQ ID NO: 209739

SEQ ID NO: 619826 - RNA, 64 nt, Homo Sapiens; identical to SEQ ID NO: 209740

SEQ ID NO: 619827 - RNA, 64 nt, Homo Sapiens; identical to SEQ ID NO: 209741

SEQ ID NO: 619828 - RNA, 64 nt, Homo Sapiens; identical to SEQ ID NO: 209742

SEQ ID NO: 619829 - RNA, 64 nt, Homo Sapiens; identical to SEQ ID NO: 209743

SEQ ID NO: 619830 - RNA, 64 nt, Homo Sapiens; identical to SEQ ID NO: 209744

SEQ ID NO: 619831 - RNA, 64 nt, Homo Sapiens; identical to SEQ ID NO: 209745

SEQ ID NO: 619832 - RNA, 64 nt, Homo Sapiens; identical to SEQ ID NO: 209746

SEQ ID NO: 619833 - RNA, 64 nt, Homo Sapiens; identical to SEQ ID NO: 209747

SEQ ID NO: 619834 - RNA, 64 nt, Homo Sapiens; identical to SEQ ID NO: 209748

SEQ ID NO: 619835 - RNA, 64 nt, Homo Sapiens; identical to SEQ ID NO: 209749

SEQ ID NO: 619836 - RNA, 64 nt, Homo Sapiens; identical to SEQ ID NO: 209750

SEQ ID NO: 619837 - RNA, 64 nt, Homo Sapiens; identical to SEQ ID NO: 209751

SEQ ID NO: 619838 - RNA, 64 nt, Homo Sapiens; identical to SEQ ID NO: 209752

SEQ ID NO: 619839 - RNA, 64 nt, Homo Sapiens; identical to SEQ ID NO: 209753

SEQ ID NO: 619840 - RNA, 64 nt, Homo Sapiens; identical to SEQ ID NO: 209754

SEQ ID NO: 619841 - RNA, 64 nt, Homo Sapiens; identical to SEQ ID NO: 209755

SEQ ID NO: 619842 - RNA, 64 nt, Homo Sapiens; identical to SEQ ID NO: 209756

SEQ ID NO: 619843 - RNA, 64 nt, Homo Sapiens; identical to SEQ ID NO: 209757

SEQ ID NO: 619844 - RNA, 64 nt, Homo Sapiens; identical to SEQ ID NO: 209758

SEQ ID NO: 619845 - RNA, 64 nt, Homo Sapiens; identical to SEQ ID NO: 209759

SEQ ID NO: 619846 - RNA, 64 nt, Homo Sapiens; identical to SEQ ID NO: 209760

SEQ ID NO: 619847 - RNA, 64 nt, Homo Sapiens; identical to SEQ ID NO: 209761

SEQ ID NO: 619848 - RNA, 64 nt, Homo Sapiens; identical to SEQ ID NO: 209762

SEQ ID NO: 619849 - RNA, 64 nt, Homo Sapiens; identical to SEQ ID NO: 209763

SEQ ID NO: 619850 - RNA, 64 nt, Homo Sapiens; identical to SEQ ID NO: 209764

SEQ ID NO: 619851 - RNA, 64 nt, Homo Sapiens; identical to SEQ ID NO: 209765

SEQ ID NO: 619852 - RNA, 64 nt, Homo Sapiens; identical to SEQ ID NO: 209766

SEQ ID NO: 619853 - RNA, 64 nt, Homo Sapiens; identical to SEQ ID NO: 209767

SEQ ID NO: 619854 - RNA, 64 nt, Homo Sapiens; identical to SEQ ID NO: 209768

SEQ ID NO: 619855 - RNA, 64 nt, Homo Sapiens; identical to SEQ ID NO: 209769

SEQ ID NO: 619856 - RNA, 64 nt, Homo Sapiens; identical to SEQ ID NO: 209770

SEQ ID NO: 619857 - RNA, 64 nt, Homo Sapiens; identical to SEQ ID NO: 209771

SEQ ID NO: 619858 - RNA, 64 nt, Homo Sapiens; identical to SEQ ID NO: 209772

SEQ ID NO: 619859 - RNA, 64 nt, Homo Sapiens; identical to SEQ ID NO: 209773

SEQ ID NO: 619860 - RNA, 64 nt, Homo Sapiens; identical to SEQ ID NO: 209774

SEQ ID NO: 619861 - RNA, 64 nt, Homo Sapiens; identical to SEQ ID NO: 209775

SEQ ID NO: 619862 - RNA, 64 nt, Homo Sapiens; identical to SEQ ID NO: 209776

SEQ ID NO: 619863 - RNA, 64 nt, Homo Sapiens; identical to SEQ ID NO: 209777

SEQ ID NO: 619864 - RNA, 64 nt, Homo Sapiens; identical to SEQ ID NO: 209778

SEQ ID NO: 619865 - RNA, 64 nt, Homo Sapiens; identical to SEQ ID NO: 209779

SEQ ID NO: 619866 - RNA, 64 nt, Homo Sapiens; identical to SEQ ID NO: 209780

SEQ ID NO: 619867 - RNA, 64 nt, Homo Sapiens; identical to SEQ ID NO: 209781

SEQ ID NO: 619868 - RNA, 64 nt, Homo Sapiens; identical to SEQ ID NO: 209782

SEQ ID NO: 619869 - RNA, 64 nt, Homo Sapiens; identical to SEQ ID NO: 209783

SEQ ID NO: 619870 - RNA, 64 nt, Homo Sapiens; identical to SEQ ID NO: 209784

SEQ ID NO: 619871 - RNA, 64 nt, Homo Sapiens; identical to SEQ ID NO: 209785

SEQ ID NO: 619872 - RNA, 64 nt, Homo Sapiens; identical to SEQ ID NO: 209786

SEQ ID NO: 619873 - RNA, 64 nt, Homo Sapiens; identical to SEQ ID NO: 209787

SEQ ID NO: 619874 - RNA, 64 nt, Homo Sapiens; identical to SEQ ID NO: 209788

SEQ ID NO: 619875 - RNA, 64 nt, Homo Sapiens; identical to SEQ ID NO: 209789

SEQ ID NO: 619876 - RNA, 64 nt, Homo Sapiens; identical to SEQ ID NO: 209790

SEQ ID NO: 619877 - RNA, 64 nt, Homo Sapiens; identical to SEQ ID NO: 209791

SEQ ID NO: 619878 - RNA, 64 nt, Homo Sapiens; identical to SEQ ID NO: 209792

SEQ ID NO: 619879 - RNA, 64 nt, Homo Sapiens; identical to SEQ ID NO: 209793

SEQ ID NO: 619880 - RNA, 64 nt, Homo Sapiens; identical to SEQ ID NO: 209794

SEQ ID NO: 619881 - RNA, 64 nt, Homo Sapiens; identical to SEQ ID NO: 209795

SEQ ID NO: 619882 - RNA, 64 nt, Homo Sapiens; identical to SEQ ID NO: 209796

SEQ ID NO: 619883 - RNA, 64 nt, Homo Sapiens; identical to SEQ ID NO: 209797

SEQ ID NO: 619884 - RNA, 64 nt, Homo Sapiens; identical to SEQ ID NO: 209798

SEQ ID NO: 619885 - RNA, 64 nt, Homo Sapiens; identical to SEQ ID NO: 209799

SEQ ID NO: 619886 - RNA, 64 nt, Homo Sapiens; identical to SEQ ID NO: 209800

SEQ ID NO: 619887 - RNA, 64 nt, Homo Sapiens; identical to SEQ ID NO: 209801

SEQ ID NO: 619888 - RNA, 64 nt, Homo Sapiens; identical to SEQ ID NO: 209802

SEQ ID NO: 619889 - RNA, 64 nt, Homo Sapiens; identical to SEQ ID NO: 209803

SEQ ID NO: 619890 - RNA, 64 nt, Homo Sapiens; identical to SEQ ID NO: 209804

SEQ ID NO: 619891 - RNA, 64 nt, Homo Sapiens; identical to SEQ ID NO: 209805

SEQ ID NO: 619892 - RNA, 64 nt, Homo Sapiens; identical to SEQ ID NO: 209806

SEQ ID NO: 619893 - RNA, 64 nt, Homo Sapiens; identical to SEQ ID NO: 209807

SEQ ID NO: 619894 - RNA, 64 nt, Homo Sapiens; identical to SEQ ID NO: 209808

SEQ ID NO: 619895 - RNA, 64 nt, Homo Sapiens; identical to SEQ ID NO: 209809

SEQ ID NO: 619896 - RNA, 64 nt, Homo Sapiens; identical to SEQ ID NO: 209810

SEQ ID NO: 619897 - RNA, 64 nt, Homo Sapiens; identical to SEQ ID NO: 209811

SEQ ID NO: 619898 - RNA, 64 nt, Homo Sapiens; identical to SEQ ID NO: 209812

SEQ ID NO: 619899 - RNA, 64 nt, Homo Sapiens; identical to SEQ ID NO: 209813

SEQ ID NO: 619900 - RNA, 64 nt, Homo Sapiens; identical to SEQ ID NO: 209814

SEQ ID NO: 619901 - RNA, 64 nt, Homo Sapiens; identical to SEQ ID NO: 508730

SEQ ID NO: 619902 - RNA, 64 nt, Homo Sapiens; identical to SEQ ID NO: 508731

SEQ ID NO: 619903 - RNA, 64 nt, Homo Sapiens; identical to SEQ ID NO: 508732

SEQ ID NO: 619904 - RNA, 64 nt, Homo Sapiens; identical to SEQ ID NO: 508733

SEQ ID NO: 619905 - RNA, 64 nt, Homo Sapiens; identical to SEQ ID NO: 508734

SEQ ID NO: 619906 - RNA, 64 nt, Homo Sapiens; identical to SEQ ID NO: 508735

SEQ ID NO: 619907 - RNA, 64 nt, Homo Sapiens
uggagcgggaccacuaugugggcugucucauucaucuguggauagugaaaucccugagggcagg

SEQ ID NO: 619908 - RNA, 64 nt, Homo Sapiens
gcugcugucacuagccccucgucugugcacucucucuguggaagcugggugccagagcuucuag

SEQ ID NO: 619909 - RNA, 64 nt, Homo Sapiens
auauacuaagugcgacuuuguuugcuucuuucuuucuguggaggaagggcccucuuggcuugau

SEQ ID NO: 619910 - RNA, 64 nt, Homo Sapiens
augggagcucuuguuguggaugacauugacugugucuguggaaaccuccugaauacaagcugac

SEQ ID NO: 619911 - RNA, 64 nt, Homo Sapiens
guuuucaguuucuuguugguaaauguucuccccuucuguggauuaucagguauaugacugguaa

SEQ ID NO: 619912 - RNA, 64 nt, Homo Sapiens
gaagugcuagacugaaggacuucuaaauggagcuucuguggaauccugaaugggaugucauagc

SEQ ID NO: 619913 - RNA, 64 nt, Homo Sapiens
aaaaugauccccaagugugaacaaaagaugcucuucuguggaccacugcaugagcuuuuauacu

SEQ ID NO: 619914 - RNA, 64 nt, Homo Sapiens
cuccucuuuuagcugaugaacuuauucuguagauucuguggaacaagccuaucagcuucagaau

SEQ ID NO: 619915 - RNA, 64 nt, Homo Sapiens
cuuuaaaccugugugcuaauuauuugccuuggauucuguggauuaaugaacucugaggcagaaa

SEQ ID NO: 619916 - RNA, 64 nt, Homo Sapiens
agguauugugcuaccagcuauugaaaaaguaccuucuguggacagcucacuugaggacuuuguu

SEQ ID NO: 619917 - RNA, 64 nt, Homo Sapiens
cccacccggguagcaggcugcugggcaguucugcucuguggaggggcgggcaccagcgccacuu

SEQ ID NO: 619918 - RNA, 64 nt, Homo Sapiens
ggggugggggagggucuuauuuuaucuuaucuuuucuguggaucagaaaaaacagaagccaaac

SEQ ID NO: 619919 - RNA, 64 nt, Homo Sapiens
uagccacccugagcagaacuuugugaugcuucauucuguggaauuuugugcuugcuacuguaua

SEQ ID NO: 619920 - RNA, 64 nt, Homo Sapiens
uauuguaaaugguggaugacaaaagaaaaucugcucuguggaaagaaagaacugucucuaccag

SEQ ID NO: 619921 - RNA, 64 nt, Homo Sapiens
uuuuuagcucuuuaaaaucuuggacuccgugacaucuguggaaucaaccaggcuguuauucccc

SEQ ID NO: 619922 - RNA, 64 nt, Homo Sapiens
ugguggcagcagggaaccccgaagcugugacuccucuguggacagaacuuguggcugggccaug

SEQ ID NO: 619923 - RNA, 64 nt, Homo Sapiens
agcagcggcagugacaccugaacucaaaguguggucuguggaccauguaugaccagagccuugc

SEQ ID NO: 619924 - RNA, 64 nt, Homo Sapiens
aagccaacucagugccccagccaccuucuccucaucuguggagcgguccucagguaucuaccuc

SEQ ID NO: 619925 - RNA, 64 nt, Homo Sapiens
aaggaaaguaguccaggcugucccugaaacugagucuguggacacuguggaaagcuuugaacaa

SEQ ID NO: 619926 - RNA, 64 nt, Homo Sapiens
agauuaaacuucaccuacaaacuccuuaauaugaucuguggagaauguacacaguuuaaacaca

SEQ ID NO: 619927 - RNA, 64 nt, Homo Sapiens
uacuuuagugagagcugacuagccaccuucucacucuguggaagacucaccaaagggacuuggg

SEQ ID NO: 619928 - RNA, 64 nt, Homo Sapiens
ccucagucacucugcuguugcuugcugcguccugucuguggagucagccgucucauucucucgu

SEQ ID NO: 619929 - RNA, 64 nt, Homo Sapiens
gaacgccacccagccgcccgagcaacauggugcaucuguggauaauauccaacagugaggguua

SEQ ID NO: 619930 - RNA, 64 nt, Homo Sapiens
cagggucugagccuugccuggucacccagacagcucuguggaggagcgacugggagaugggucg

SEQ ID NO: 619931 - RNA, 64 nt, Homo Sapiens
uguuuucucuuugugaagcucaggucacuuuaccucuguggaccagucgccacguggccugggg

SEQ ID NO: 619932 - RNA, 64 nt, Homo Sapiens
agaggaaccaucgcaggauggaugcggcaggugcucuguggaugagcaccccuugccggugaag

SEQ ID NO: 619933 - RNA, 64 nt, Homo Sapiens
cucauggguacagagaaaugagaugagagagaacucuguggauauccaaagacuuguuucagaa

SEQ ID NO: 619934 - RNA, 64 nt, Homo Sapiens
uuacuuuugguaacuaaggcucuccuuucuaaaaucuguggaaaaguggggcucacugaaccuc

SEQ ID NO: 619935 - RNA, 64 nt, Homo Sapiens; identical to SEQ ID NO: 55166

SEQ ID NO: 619936 - RNA, 64 nt, Homo Sapiens; identical to SEQ ID NO: 55167

SEQ ID NO: 619937 - RNA, 64 nt, Homo Sapiens; identical to SEQ ID NO: 55168

SEQ ID NO: 619938 - RNA, 64 nt, Homo Sapiens; identical to SEQ ID NO: 55169

SEQ ID NO: 619939 - RNA, 64 nt, Homo Sapiens; identical to SEQ ID NO: 55170

SEQ ID NO: 619940 - RNA, 64 nt, Homo Sapiens; identical to SEQ ID NO: 55171

SEQ ID NO: 619941 - RNA, 64 nt, Homo Sapiens; identical to SEQ ID NO: 55172

SEQ ID NO: 619942 - RNA, 64 nt, Homo Sapiens; identical to SEQ ID NO: 55173

SEQ ID NO: 619943 - RNA, 64 nt, Homo Sapiens; identical to SEQ ID NO: 55174

SEQ ID NO: 619944 - RNA, 64 nt, Homo Sapiens; identical to SEQ ID NO: 55175

SEQ ID NO: 619945 - RNA, 64 nt, Homo Sapiens; identical to SEQ ID NO: 55176

SEQ ID NO: 619946 - RNA, 64 nt, Homo Sapiens; identical to SEQ ID NO: 55177

SEQ ID NO: 619947 - RNA, 64 nt, Homo Sapiens; identical to SEQ ID NO: 220048

SEQ ID NO: 619948 - RNA, 64 nt, Homo Sapiens; identical to SEQ ID NO: 220049

SEQ ID NO: 619949 - RNA, 64 nt, Homo Sapiens; identical to SEQ ID NO: 220050

SEQ ID NO: 619950 - RNA, 64 nt, Homo Sapiens; identical to SEQ ID NO: 220051

SEQ ID NO: 619951 - RNA, 64 nt, Homo Sapiens; identical to SEQ ID NO: 220052

SEQ ID NO: 619952 - RNA, 64 nt, Homo Sapiens; identical to SEQ ID NO: 220053

SEQ ID NO: 619953 - RNA, 64 nt, Homo Sapiens; identical to SEQ ID NO: 220054

SEQ ID NO: 619954 - RNA, 64 nt, Homo Sapiens; identical to SEQ ID NO: 220055

SEQ ID NO: 619955 - RNA, 64 nt, Homo Sapiens
uuguaaaggccauucauuuguuucaaagaauuguggguggaaguggucagaguuacucaucccu

SEQ ID NO: 619956 - RNA, 64 nt, Homo Sapiens
uggggcccuggcaucacacaauaaaguaaaacuuggguggaaccagggaaacuugggaauagcu

SEQ ID NO: 619957 - RNA, 64 nt, Homo Sapiens
guuucacuagauuuggaaagaagaaagaggauaaggguggaaaggcugagcagaaagguacucu

SEQ ID NO: 619958 - RNA, 64 nt, Homo Sapiens
auccacugguuccagcugacaguggccguccuacggguggaagcacugaccguauccagaaguu

SEQ ID NO: 619959 - RNA, 64 nt, Homo Sapiens
ugaauaugaauauuguggagucuguccagauaccggguggaagacugguuuugaucaguuuaag

SEQ ID NO: 619960 - RNA, 64 nt, Homo Sapiens
uuuuggacaauaaagaaucuaaaauggguggggaggguggaagaaaugguggacuguaucucuc

SEQ ID NO: 619961 - RNA, 64 nt, Homo Sapiens
ggggugcuugggugaucucugcuucauuagucauggguggaagaaaaaccacaccccccgcacc

SEQ ID NO: 619962 - RNA, 64 nt, Homo Sapiens
uaaauuggggguuuaaacauuaaguaggagcuugggguggaagagggacagccggcugggccac

SEQ ID NO: 619963 - RNA, 64 nt, Homo Sapiens
gaacccagagccacccgcuaugagcacaggccggggguggaaggcccaguagagcugcccuucc

SEQ ID NO: 619964 - RNA, 64 nt, Homo Sapiens
ugggaauucauaugaucugccagagccucuccagggguggaauacauguccuggacuaagccaa

SEQ ID NO: 619965 - RNA, 64 nt, Homo Sapiens
gcacuggcuucagcaggcgucuuuggucacugccggguggaauacuguccccauucucauggcc

SEQ ID NO: 619966 - RNA, 64 nt, Homo Sapiens
gggucuccucuccccagccaccugcaggguugugggguggaacacagaaggugggcuagggccu

SEQ ID NO: 619967 - RNA, 64 nt, Homo Sapiens
agcuugccucuuugagaaacucaccagccgggcaggguggaaggucugcaugucgggcuuaagg

SEQ ID NO: 619968 - RNA, 64 nt, Homo Sapiens
aucccagugaguaaauuauuuagagaaggggccaggguggaacaagggcaauugucagucuuuu

SEQ ID NO: 619969 - RNA, 64 nt, Homo Sapiens
agcagggcucuggagggauuaaucccaaggcuggggguggaaggccugggaccgcggugggugg

SEQ ID NO: 619970 - RNA, 64 nt, Homo Sapiens
ccaaggcuggggguggaaggccugggaccgcgguggguggaaucccaggaggucuucagaguuu

SEQ ID NO: 619971 - RNA, 59 nt, Homo Sapiens; identical to SEQ ID NO: 76155

SEQ ID NO: 619972 - RNA, 64 nt, Homo Sapiens; identical to SEQ ID NO: 76156

SEQ ID NO: 619973 - RNA, 64 nt, Homo Sapiens; identical to SEQ ID NO: 76157

SEQ ID NO: 619974 - RNA, 64 nt, Homo Sapiens; identical to SEQ ID NO: 76158

SEQ ID NO: 619975 - RNA, 64 nt, Homo Sapiens; identical to SEQ ID NO: 76159

SEQ ID NO: 619976 - RNA, 64 nt, Homo Sapiens; identical to SEQ ID NO: 76160

SEQ ID NO: 619977 - RNA, 64 nt, Homo Sapiens; identical to SEQ ID NO: 76161

SEQ ID NO: 619978 - RNA, 64 nt, Homo Sapiens; identical to SEQ ID NO: 76162

SEQ ID NO: 619979 - RNA, 64 nt, Homo Sapiens; identical to SEQ ID NO: 76163

SEQ ID NO: 619980 - RNA, 64 nt, Homo Sapiens; identical to SEQ ID NO: 76164

SEQ ID NO: 619981 - RNA, 64 nt, Homo Sapiens; identical to SEQ ID NO: 76165

SEQ ID NO: 619982 - RNA, 64 nt, Homo Sapiens; identical to SEQ ID NO: 76166

SEQ ID NO: 619983 - RNA, 64 nt, Homo Sapiens; identical to SEQ ID NO: 76167

SEQ ID NO: 619984 - RNA, 64 nt, Homo Sapiens; identical to SEQ ID NO: 76168

SEQ ID NO: 619985 - RNA, 64 nt, Homo Sapiens; identical to SEQ ID NO: 76169

SEQ ID NO: 619986 - RNA, 58 nt, Homo Sapiens; identical to SEQ ID NO: 76170

SEQ ID NO: 619987 - RNA, 64 nt, Homo Sapiens; identical to SEQ ID NO: 76171

SEQ ID NO: 619988 - RNA, 64 nt, Homo Sapiens; identical to SEQ ID NO: 76172

SEQ ID NO: 619989 - RNA, 64 nt, Homo Sapiens; identical to SEQ ID NO: 76173

SEQ ID NO: 619990 - RNA, 64 nt, Homo Sapiens; identical to SEQ ID NO: 76174

SEQ ID NO: 619991 - RNA, 64 nt, Homo Sapiens; identical to SEQ ID NO: 76175

SEQ ID NO: 619992 - RNA, 52 nt, Homo Sapiens; identical to SEQ ID NO: 76176

SEQ ID NO: 619993 - RNA, 64 nt, Homo Sapiens; identical to SEQ ID NO: 76177

SEQ ID NO: 619994 - RNA, 64 nt, Homo Sapiens; identical to SEQ ID NO: 76178

SEQ ID NO: 619995 - RNA, 64 nt, Homo Sapiens; identical to SEQ ID NO: 76179

SEQ ID NO: 619996 - RNA, 64 nt, Homo Sapiens; identical to SEQ ID NO: 76180

SEQ ID NO: 619997 - RNA, 64 nt, Homo Sapiens; identical to SEQ ID NO: 76181

SEQ ID NO: 619998 - RNA, 64 nt, Homo Sapiens; identical to SEQ ID NO: 76182

SEQ ID NO: 619999 - RNA, 64 nt, Homo Sapiens; identical to SEQ ID NO: 76183

SEQ ID NO: 620000 - RNA, 64 nt, Homo Sapiens; identical to SEQ ID NO: 76184

SEQ ID NO: 620001 - RNA, 64 nt, Homo Sapiens; identical to SEQ ID NO: 76185

SEQ ID NO: 620002 - RNA, 64 nt, Homo Sapiens; identical to SEQ ID NO: 76186

SEQ ID NO: 620003 - RNA, 64 nt, Homo Sapiens; identical to SEQ ID NO: 76187

SEQ ID NO: 620004 - RNA, 64 nt, Homo Sapiens; identical to SEQ ID NO: 76188

SEQ ID NO: 620005 - RNA, 64 nt, Homo Sapiens; identical to SEQ ID NO: 76189

SEQ ID NO: 620006 - RNA, 64 nt, Homo Sapiens; identical to SEQ ID NO: 76190

SEQ ID NO: 620007 - RNA, 64 nt, Homo Sapiens; identical to SEQ ID NO: 76191

SEQ ID NO: 620008 - RNA, 64 nt, Homo Sapiens; identical to SEQ ID NO: 76192

SEQ ID NO: 620009 - RNA, 64 nt, Homo Sapiens; identical to SEQ ID NO: 76193

SEQ ID NO: 620010 - RNA, 64 nt, Homo Sapiens; identical to SEQ ID NO: 76194

SEQ ID NO: 620011 - RNA, 64 nt, Homo Sapiens; identical to SEQ ID NO: 76195

SEQ ID NO: 620012 - RNA, 64 nt, Homo Sapiens; identical to SEQ ID NO: 76196

SEQ ID NO: 620013 - RNA, 64 nt, Homo Sapiens; identical to SEQ ID NO: 76197

SEQ ID NO: 620014 - RNA, 64 nt, Homo Sapiens; identical to SEQ ID NO: 76198

SEQ ID NO: 620015 - RNA, 64 nt, Homo Sapiens; identical to SEQ ID NO: 76199

SEQ ID NO: 620016 - RNA, 64 nt, Homo Sapiens; identical to SEQ ID NO: 76200

SEQ ID NO: 620017 - RNA, 64 nt, Homo Sapiens; identical to SEQ ID NO: 76201

SEQ ID NO: 620018 - RNA, 64 nt, Homo Sapiens; identical to SEQ ID NO: 76202

SEQ ID NO: 620019 - RNA, 64 nt, Homo Sapiens; identical to SEQ ID NO: 76203

SEQ ID NO: 620020 - RNA, 64 nt, Homo Sapiens; identical to SEQ ID NO: 76204

SEQ ID NO: 620021 - RNA, 64 nt, Homo Sapiens; identical to SEQ ID NO: 76205

SEQ ID NO: 620022 - RNA, 64 nt, Homo Sapiens; identical to SEQ ID NO: 76206

SEQ ID NO: 620023 - RNA, 64 nt, Homo Sapiens; identical to SEQ ID NO: 76207

SEQ ID NO: 620024 - RNA, 64 nt, Homo Sapiens; identical to SEQ ID NO: 76208

SEQ ID NO: 620025 - RNA, 64 nt, Homo Sapiens; identical to SEQ ID NO: 76209

SEQ ID NO: 620026 - RNA, 64 nt, Homo Sapiens; identical to SEQ ID NO: 76210

SEQ ID NO: 620027 - RNA, 64 nt, Homo Sapiens; identical to SEQ ID NO: 76211

SEQ ID NO: 620028 - RNA, 64 nt, Homo Sapiens; identical to SEQ ID NO: 76212

SEQ ID NO: 620029 - RNA, 64 nt, Homo Sapiens; identical to SEQ ID NO: 76213

SEQ ID NO: 620030 - RNA, 64 nt, Homo Sapiens; identical to SEQ ID NO: 76214

SEQ ID NO: 620031 - RNA, 64 nt, Homo Sapiens; identical to SEQ ID NO: 76215

SEQ ID NO: 620032 - RNA, 64 nt, Homo Sapiens; identical to SEQ ID NO: 76216

SEQ ID NO: 620033 - RNA, 64 nt, Homo Sapiens; identical to SEQ ID NO: 76217

SEQ ID NO: 620034 - RNA, 64 nt, Homo Sapiens; identical to SEQ ID NO: 76218

SEQ ID NO: 620035 - RNA, 64 nt, Homo Sapiens; identical to SEQ ID NO: 76219

SEQ ID NO: 620036 - RNA, 64 nt, Homo Sapiens; identical to SEQ ID NO: 440860

SEQ ID NO: 620037 - RNA, 64 nt, Homo Sapiens; identical to SEQ ID NO: 440861

SEQ ID NO: 620038 - RNA, 64 nt, Homo Sapiens; identical to SEQ ID NO: 440862

SEQ ID NO: 620039 - RNA, 64 nt, Homo Sapiens; identical to SEQ ID NO: 440863

SEQ ID NO: 620040 - RNA, 64 nt, Homo Sapiens; identical to SEQ ID NO: 440864

SEQ ID NO: 620041 - RNA, 64 nt, Homo Sapiens; identical to SEQ ID NO: 440865

SEQ ID NO: 620042 - RNA, 64 nt, Homo Sapiens; identical to SEQ ID NO: 440866

SEQ ID NO: 620043 - RNA, 64 nt, Homo Sapiens; identical to SEQ ID NO: 440867

SEQ ID NO: 620044 - RNA, 64 nt, Homo Sapiens; identical to SEQ ID NO: 440868

SEQ ID NO: 620045 - RNA, 64 nt, Homo Sapiens; identical to SEQ ID NO: 440869

SEQ ID NO: 620046 - RNA, 64 nt, Homo Sapiens; identical to SEQ ID NO: 440870

SEQ ID NO: 620047 - RNA, 64 nt, Homo Sapiens; identical to SEQ ID NO: 440871

SEQ ID NO: 620048 - RNA, 64 nt, Homo Sapiens; identical to SEQ ID NO: 440872

SEQ ID NO: 620049 - RNA, 64 nt, Homo Sapiens; identical to SEQ ID NO: 440873

SEQ ID NO: 620050 - RNA, 64 nt, Homo Sapiens; identical to SEQ ID NO: 440874

SEQ ID NO: 620051 - RNA, 64 nt, Homo Sapiens; identical to SEQ ID NO: 440875

SEQ ID NO: 620052 - RNA, 64 nt, Homo Sapiens; identical to SEQ ID NO: 440876

SEQ ID NO: 620053 - RNA, 64 nt, Homo Sapiens; identical to SEQ ID NO: 440877

SEQ ID NO: 620054 - RNA, 64 nt, Homo Sapiens; identical to SEQ ID NO: 440878

SEQ ID NO: 620055 - RNA, 64 nt, Homo Sapiens; identical to SEQ ID NO: 440879

SEQ ID NO: 620056 - RNA, 64 nt, Homo Sapiens; identical to SEQ ID NO: 440880

SEQ ID NO: 620057 - RNA, 64 nt, Homo Sapiens; identical to SEQ ID NO: 440881

SEQ ID NO: 620058 - RNA, 64 nt, Homo Sapiens; identical to SEQ ID NO: 440882

SEQ ID NO: 620059 - RNA, 64 nt, Homo Sapiens; identical to SEQ ID NO: 440883

SEQ ID NO: 620060 - RNA, 64 nt, Homo Sapiens; identical to SEQ ID NO: 440884

SEQ ID NO: 620061 - RNA, 64 nt, Homo Sapiens; identical to SEQ ID NO: 440885

SEQ ID NO: 620062 - RNA, 64 nt, Homo Sapiens; identical to SEQ ID NO: 440886

SEQ ID NO: 620063 - RNA, 64 nt, Homo Sapiens; identical to SEQ ID NO: 440887

SEQ ID NO: 620064 - RNA, 64 nt, Homo Sapiens; identical to SEQ ID NO: 440888

SEQ ID NO: 620065 - RNA, 64 nt, Homo Sapiens; identical to SEQ ID NO: 440889

SEQ ID NO: 620066 - RNA, 64 nt, Homo Sapiens; identical to SEQ ID NO: 440890

SEQ ID NO: 620067 - RNA, 64 nt, Homo Sapiens; identical to SEQ ID NO: 440891

SEQ ID NO: 620068 - RNA, 64 nt, Homo Sapiens; identical to SEQ ID NO: 440892

SEQ ID NO: 620069 - RNA, 64 nt, Homo Sapiens; identical to SEQ ID NO: 440893

SEQ ID NO: 620070 - RNA, 64 nt, Homo Sapiens; identical to SEQ ID NO: 440894

SEQ ID NO: 620071 - RNA, 64 nt, Homo Sapiens; identical to SEQ ID NO: 440895

SEQ ID NO: 620072 - RNA, 64 nt, Homo Sapiens; identical to SEQ ID NO: 440896

SEQ ID NO: 620073 - RNA, 64 nt, Homo Sapiens; identical to SEQ ID NO: 440897

SEQ ID NO: 620074 - RNA, 64 nt, Homo Sapiens; identical to SEQ ID NO: 440898

SEQ ID NO: 620075 - RNA, 64 nt, Homo Sapiens; identical to SEQ ID NO: 440899

SEQ ID NO: 620076 - RNA, 64 nt, Homo Sapiens; identical to SEQ ID NO: 440900

SEQ ID NO: 620077 - RNA, 64 nt, Homo Sapiens; identical to SEQ ID NO: 440901

SEQ ID NO: 620078 - RNA, 64 nt, Homo Sapiens; identical to SEQ ID NO: 440902

SEQ ID NO: 620079 - RNA, 62 nt, Homo Sapiens; identical to SEQ ID NO: 440903

SEQ ID NO: 620080 - RNA, 64 nt, Homo Sapiens; identical to SEQ ID NO: 440904

SEQ ID NO: 620081 - RNA, 64 nt, Homo Sapiens; identical to SEQ ID NO: 440905

SEQ ID NO: 620082 - RNA, 64 nt, Homo Sapiens; identical to SEQ ID NO: 440906

SEQ ID NO: 620083 - RNA, 64 nt, Homo Sapiens; identical to SEQ ID NO: 101343

SEQ ID NO: 620084 - RNA, 64 nt, Homo Sapiens; identical to SEQ ID NO: 101344

SEQ ID NO: 620085 - RNA, 64 nt, Homo Sapiens; identical to SEQ ID NO: 101382

SEQ ID NO: 620086 - RNA, 64 nt, Homo Sapiens; identical to SEQ ID NO: 101383

SEQ ID NO: 620087 - RNA, 64 nt, Homo Sapiens; identical to SEQ ID NO: 101390

SEQ ID NO: 620088 - RNA, 64 nt, Homo Sapiens; identical to SEQ ID NO: 101391

SEQ ID NO: 620089 - RNA, 64 nt, Homo Sapiens; identical to SEQ ID NO: 101422

SEQ ID NO: 620090 - RNA, 64 nt, Homo Sapiens; identical to SEQ ID NO: 101423

SEQ ID NO: 620091 - RNA, 64 nt, Homo Sapiens; identical to SEQ ID NO: 101457

SEQ ID NO: 620092 - RNA, 64 nt, Homo Sapiens; identical to SEQ ID NO: 101458

SEQ ID NO: 620093 - RNA, 64 nt, Homo Sapiens; identical to SEQ ID NO: 101473

SEQ ID NO: 620094 - RNA, 64 nt, Homo Sapiens; identical to SEQ ID NO: 101474

SEQ ID NO: 620095 - RNA, 64 nt, Homo Sapiens; identical to SEQ ID NO: 101503

SEQ ID NO: 620096 - RNA, 64 nt, Homo Sapiens; identical to SEQ ID NO: 101504

SEQ ID NO: 620097 - RNA, 64 nt, Homo Sapiens; identical to SEQ ID NO: 101509

SEQ ID NO: 620098 - RNA, 64 nt, Homo Sapiens; identical to SEQ ID NO: 101510

SEQ ID NO: 620099 - RNA, 64 nt, Homo Sapiens; identical to SEQ ID NO: 101540

SEQ ID NO: 620100 - RNA, 64 nt, Homo Sapiens; identical to SEQ ID NO: 101541

SEQ ID NO: 620101 - RNA, 64 nt, Homo Sapiens; identical to SEQ ID NO: 101569

SEQ ID NO: 620102 - RNA, 64 nt, Homo Sapiens; identical to SEQ ID NO: 101570

SEQ ID NO: 620103 - RNA, 64 nt, Homo Sapiens; identical to SEQ ID NO: 101580

SEQ ID NO: 620104 - RNA, 64 nt, Homo Sapiens; identical to SEQ ID NO: 101581

SEQ ID NO: 620105 - RNA, 64 nt, Homo Sapiens; identical to SEQ ID NO: 101592

SEQ ID NO: 620106 - RNA, 64 nt, Homo Sapiens; identical to SEQ ID NO: 101593

SEQ ID NO: 620107 - RNA, 64 nt, Homo Sapiens; identical to SEQ ID NO: 101595

SEQ ID NO: 620108 - RNA, 64 nt, Homo Sapiens; identical to SEQ ID NO: 101596

SEQ ID NO: 620109 - RNA, 64 nt, Homo Sapiens; identical to SEQ ID NO: 101648

SEQ ID NO: 620110 - RNA, 64 nt, Homo Sapiens; identical to SEQ ID NO: 101649

SEQ ID NO: 620111 - RNA, 64 nt, Homo Sapiens; identical to SEQ ID NO: 101668

SEQ ID NO: 620112 - RNA, 64 nt, Homo Sapiens; identical to SEQ ID NO: 101669

SEQ ID NO: 620113 - RNA, 64 nt, Homo Sapiens; identical to SEQ ID NO: 101691

SEQ ID NO: 620114 - RNA, 64 nt, Homo Sapiens; identical to SEQ ID NO: 101692

SEQ ID NO: 620115 - RNA, 64 nt, Homo Sapiens; identical to SEQ ID NO: 101693

SEQ ID NO: 620116 - RNA, 64 nt, Homo Sapiens; identical to SEQ ID NO: 101724

SEQ ID NO: 620117 - RNA, 64 nt, Homo Sapiens; identical to SEQ ID NO: 101725

SEQ ID NO: 620118 - RNA, 64 nt, Homo Sapiens; identical to SEQ ID NO: 101749

SEQ ID NO: 620119 - RNA, 64 nt, Homo Sapiens; identical to SEQ ID NO: 101750

SEQ ID NO: 620120 - RNA, 64 nt, Homo Sapiens; identical to SEQ ID NO: 101751

SEQ ID NO: 620121 - RNA, 64 nt, Homo Sapiens; identical to SEQ ID NO: 101752

SEQ ID NO: 620122 - RNA, 64 nt, Homo Sapiens; identical to SEQ ID NO: 101753

SEQ ID NO: 620123 - RNA, 64 nt, Homo Sapiens; identical to SEQ ID NO: 101795

SEQ ID NO: 620124 - RNA, 64 nt, Homo Sapiens; identical to SEQ ID NO: 101796

SEQ ID NO: 620125 - RNA, 64 nt, Homo Sapiens; identical to SEQ ID NO: 101797

SEQ ID NO: 620126 - RNA, 64 nt, Homo Sapiens; identical to SEQ ID NO: 101808

SEQ ID NO: 620127 - RNA, 64 nt, Homo Sapiens; identical to SEQ ID NO: 101809

SEQ ID NO: 620128 - RNA, 64 nt, Homo Sapiens; identical to SEQ ID NO: 101829

SEQ ID NO: 620129 - RNA, 64 nt, Homo Sapiens; identical to SEQ ID NO: 101830

SEQ ID NO: 620130 - RNA, 63 nt, Homo Sapiens; identical to SEQ ID NO: 98265

SEQ ID NO: 620131 - RNA, 64 nt, Homo Sapiens; identical to SEQ ID NO: 98266

SEQ ID NO: 620132 - RNA, 64 nt, Homo Sapiens; identical to SEQ ID NO: 98267

SEQ ID NO: 620133 - RNA, 64 nt, Homo Sapiens; identical to SEQ ID NO: 98268

SEQ ID NO: 620134 - RNA, 64 nt, Homo Sapiens; identical to SEQ ID NO: 98269

SEQ ID NO: 620135 - RNA, 64 nt, Homo Sapiens; identical to SEQ ID NO: 98270

SEQ ID NO: 620136 - RNA, 64 nt, Homo Sapiens; identical to SEQ ID NO: 98271

SEQ ID NO: 620137 - RNA, 64 nt, Homo Sapiens; identical to SEQ ID NO: 98272

SEQ ID NO: 620138 - RNA, 64 nt, Homo Sapiens; identical to SEQ ID NO: 98273

SEQ ID NO: 620139 - RNA, 64 nt, Homo Sapiens; identical to SEQ ID NO: 98274

SEQ ID NO: 620140 - RNA, 64 nt, Homo Sapiens; identical to SEQ ID NO: 98275

SEQ ID NO: 620141 - RNA, 64 nt, Homo Sapiens; identical to SEQ ID NO: 98276

SEQ ID NO: 620142 - RNA, 64 nt, Homo Sapiens; identical to SEQ ID NO: 98277

SEQ ID NO: 620143 - RNA, 64 nt, Homo Sapiens; identical to SEQ ID NO: 98278

SEQ ID NO: 620144 - RNA, 64 nt, Homo Sapiens; identical to SEQ ID NO: 98279

SEQ ID NO: 620145 - RNA, 64 nt, Homo Sapiens; identical to SEQ ID NO: 98280

SEQ ID NO: 620146 - RNA, 64 nt, Homo Sapiens; identical to SEQ ID NO: 98281

SEQ ID NO: 620147 - RNA, 64 nt, Homo Sapiens; identical to SEQ ID NO: 98282

SEQ ID NO: 620148 - RNA, 64 nt, Homo Sapiens; identical to SEQ ID NO: 98283

SEQ ID NO: 620149 - RNA, 64 nt, Homo Sapiens; identical to SEQ ID NO: 98284

SEQ ID NO: 620150 - RNA, 64 nt, Homo Sapiens; identical to SEQ ID NO: 98285

SEQ ID NO: 620151 - RNA, 64 nt, Homo Sapiens; identical to SEQ ID NO: 98286

SEQ ID NO: 620152 - RNA, 64 nt, Homo Sapiens; identical to SEQ ID NO: 98287

SEQ ID NO: 620153 - RNA, 64 nt, Homo Sapiens; identical to SEQ ID NO: 98288

SEQ ID NO: 620154 - RNA, 64 nt, Homo Sapiens; identical to SEQ ID NO: 98289

SEQ ID NO: 620155 - RNA, 64 nt, Homo Sapiens; identical to SEQ ID NO: 98290

SEQ ID NO: 620156 - RNA, 64 nt, Homo Sapiens; identical to SEQ ID NO: 98291

SEQ ID NO: 620157 - RNA, 64 nt, Homo Sapiens; identical to SEQ ID NO: 98292

SEQ ID NO: 620158 - RNA, 64 nt, Homo Sapiens; identical to SEQ ID NO: 98293

SEQ ID NO: 620159 - RNA, 64 nt, Homo Sapiens; identical to SEQ ID NO: 98294

SEQ ID NO: 620160 - RNA, 64 nt, Homo Sapiens; identical to SEQ ID NO: 98295

SEQ ID NO: 620161 - RNA, 64 nt, Homo Sapiens; identical to SEQ ID NO: 98296

SEQ ID NO: 620162 - RNA, 64 nt, Homo Sapiens; identical to SEQ ID NO: 98297

SEQ ID NO: 620163 - RNA, 64 nt, Homo Sapiens; identical to SEQ ID NO: 98298

SEQ ID NO: 620164 - RNA, 64 nt, Homo Sapiens; identical to SEQ ID NO: 98299

SEQ ID NO: 620165 - RNA, 64 nt, Homo Sapiens; identical to SEQ ID NO: 98300

SEQ ID NO: 620166 - RNA, 64 nt, Homo Sapiens; identical to SEQ ID NO: 98301

SEQ ID NO: 620167 - RNA, 64 nt, Homo Sapiens; identical to SEQ ID NO: 98302

SEQ ID NO: 620168 - RNA, 63 nt, Homo Sapiens
ggaggaggaugccacgcacuuccucucucggagcccucagacaucuccagugugccagacaaa

SEQ ID NO: 620169 - RNA, 63 nt, Homo Sapiens
ugugggcaaaggcagggccacuuuugaagucuucccucagauuuccauuguguggccuggugg

SEQ ID NO: 620170 - RNA, 63 nt, Homo Sapiens
auuucccuccaaacugcugaugcugagccagcacccucagaugcagaccuucaucugggaacg

SEQ ID NO: 620171 - RNA, 63 nt, Homo Sapiens
gcaaagaggugaacauaaagugucuccuuuucccccucagagguucuuuccuugugaucugaa

SEQ ID NO: 620172 - RNA, 63 nt, Homo Sapiens
gaaagggcggaaguuauuauaaaaccaacaauacccucagacuuguaagccacugcuuauaau

SEQ ID NO: 620173 - RNA, 63 nt, Homo Sapiens
gaaacagcaggaggagggauagcaccucaguuucccucagaggucagccuagaaauucugacc

SEQ ID NO: 620174 - RNA, 63 nt, Homo Sapiens
caggacccaggacccugcugccugaccaauaaacccucagacccacaugacaucugccugggc

SEQ ID NO: 620175 - RNA, 63 nt, Homo Sapiens
cagcucuuggaggagaugagggggcaggacaggcccucagaagucccucauuacccaaggcaa

SEQ ID NO: 620176 - RNA, 63 nt, Homo Sapiens
cagggccagggaugcagaaggugagcccugcagcccucagaaugcugggaauguggaggcucu

SEQ ID NO: 620177 - RNA, 63 nt, Homo Sapiens
gggugugugggugcgucuagccauucugagugacccucagagucccagccuacagaacaaugg

SEQ ID NO: 620178 - RNA, 63 nt, Homo Sapiens
agacccaauuuuuuaagcccccagacuccuuagcccucagagccggcagcccccuacccucag

SEQ ID NO: 620179 - RNA, 63 nt, Homo Sapiens
gacuccuuagcccucagagccggcagcccccuacccucagacaaggaacucucuccucucuuu

SEQ ID NO: 620180 - RNA, 63 nt, Homo Sapiens
agccuggggcucccugagucagggcugugucuccccucagacuggggcucccugaggacgggg

SEQ ID NO: 620181 - RNA, 63 nt, Homo Sapiens
aaguggggcucccucaggacagcguugugucuccccucagacugcggcucccugaggacgggg

SEQ ID NO: 620182 - RNA, 63 nt, Homo Sapiens
agacugcggcucccugaggacggggcugugucucccucagacuggggcucccugaagaaaggg

SEQ ID NO: 620183 - RNA, 63 nt, Homo Sapiens
agacuggggcucccugaagaaagggcugcuucucccucagacuggagcucccugaagaugggg

SEQ ID NO: 620184 - RNA, 63 nt, Homo Sapiens
agacuggagcucccugaagauggggcugugucccccucagacuggggcugccugaggaugagg

SEQ ID NO: 620185 - RNA, 63 nt, Homo Sapiens
aauguuucaucuccaacccucugccaguuuggccccucagagcuugguggcucaagacuguua

SEQ ID NO: 620186 - RNA, 63 nt, Homo Sapiens
ugagugagugguggcggggcugcuccuucccaccccucagaacagcucugauccucguuaaua

SEQ ID NO: 620187 - RNA, 63 nt, Homo Sapiens
aaaaaaaaggaaacagccucacuuuuuugugcucccucagaauugcuugcuaugucuguuaau

SEQ ID NO: 620188 - RNA, 63 nt, Homo Sapiens
guuguuguuguuguuguuguuuuaauugggcaacccucagaacugaagagguucagagaacuu

SEQ ID NO: 620189 - RNA, 63 nt, Homo Sapiens
caacaagaaacuucucccucacccccuccuuuacccucagauuuggagaugguaaccaaagga

SEQ ID NO: 620190 - RNA, 63 nt, Homo Sapiens
ugcccaucuggagacugcaggcucccuuccuuacccucagagagugcuuaugguggguguuuu

SEQ ID NO: 620191 - RNA, 63 nt, Homo Sapiens
uuucacugccgucucgucuuccccuuccccucucccucagaguaacuucgcucaggagggccu

SEQ ID NO: 620192 - RNA, 63 nt, Homo Sapiens
uuggguugcaccccaacaaauuaaaucuggguucccucagacaaucccuuucuuggugacgac

SEQ ID NO: 620193 - RNA, 63 nt, Homo Sapiens
ggaggcagagauuggagugauacauugugggaacccucagaagauaggaaaaaagcauggaau

SEQ ID NO: 620194 - RNA, 63 nt, Homo Sapiens
cagaagauaggaaaaaagcauggaauagauucucccucagaguuccaguaguugccaacccug

SEQ ID NO: 620195 - RNA, 63 nt, Homo Sapiens
gcccccugccccgcaggccucuggugccugagccccucagacaucagugccagccccugcugg

SEQ ID NO: 620196 - RNA, 63 nt, Homo Sapiens
ccuuggggcaugacccagugccacuguggaagucccucagaggaaaaagggcagcccuccuua

SEQ ID NO: 620197 - RNA, 63 nt, Homo Sapiens
uguaacuaauuugugguaaaguaguugauucagcccucagaagaaaacuuuuguuuagagccc

SEQ ID NO: 620198 - RNA, 63 nt, Homo Sapiens
gaaaucuccuaacaaaagaacuaagaggcccagcccucagaaacccuucagugcuacauuuug

SEQ ID NO: 620199 - RNA, 63 nt, Homo Sapiens
gcugucuggcacccagugucuagaaagaaaauccccucagaagccuguuccugaggccucauu

SEQ ID NO: 620200 - RNA, 63 nt, Homo Sapiens
ugcacucugggugucuccugggagugagugagccccucagaccgcuuucugccucugguaaca

SEQ ID NO: 620201 - RNA, 63 nt, Homo Sapiens
aucucuccacgguagcacuuaccgggagccucccccucagaugcaguucuuggugacuguccc

SEQ ID NO: 620202 - RNA, 63 nt, Homo Sapiens
aauccgauucacguagggaagguguggccucagcccucagaacuucauccaguuuguucuccg

SEQ ID NO: 620203 - RNA, 63 nt, Homo Sapiens
caaggguaggggacaagauguaggcuccagcuccccucagaccuccucaucucaugagcuucu

SEQ ID NO: 620204 - RNA, 63 nt, Homo Sapiens
uauucagagaacuauacuacccucacagugaggcccucagaccugccacagggcagagcaggu

SEQ ID NO: 620205 - RNA, 63 nt, Homo Sapiens
gguagugcccacacuauuuuucccgccuccccucccucagaaacuuucagaugcauugacucu

SEQ ID NO: 620206 - RNA, 63 nt, Homo Sapiens
uggccagagcaccggccucccuugucaggaagacccucagaugccgugucacagcuguguccc

SEQ ID NO: 620207 - RNA, 63 nt, Homo Sapiens
acauucauacacaagccuuuucacacagcacuccccucagacacccucagagaguucacacug

SEQ ID NO: 620208 - RNA, 63 nt, Homo Sapiens
acaagccuuuucacacagcacuccccucagacacccucagagaguucacacugaugggaaaug

SEQ ID NO: 620209 - RNA, 63 nt, Homo Sapiens
cagcgguccaaugccaccuacccagccccuccucccucagaccccagacccagagguccaggu

SEQ ID NO: 620210 - RNA, 63 nt, Homo Sapiens
cagagguccaggcccccaaccccaaccccuccucccucagacucagacccagggguccaggcc

SEQ ID NO: 620211 - RNA, 63 nt, Homo Sapiens
caggaguccagccccuccuccccagccccuccucccucagaccagacccaggaguccagaccc

SEQ ID NO: 620212 - RNA, 63 nt, Homo Sapiens
caggaguccagaccccccaguccagccccuccucccucagaccuccucccucagacccaggag

SEQ ID NO: 620213 - RNA, 63 nt, Homo Sapiens; identical to SEQ ID NO: 620211

SEQ ID NO: 620214 - RNA, 63 nt, Homo Sapiens
caggaguccagaccccccagcccagccccuccucccucagaccucaaaccaaggguacagauc

SEQ ID NO: 620215 - RNA, 63 nt, Homo Sapiens
caggaguccaggccccagcccccagccccuccucccucagacccagacccgggaguccaggcc

SEQ ID NO: 620216 - RNA, 63 nt, Homo Sapiens
cgggaguccaggcccccagccccagccccuccucccucagacccagacccaggaguccaggcc

SEQ ID NO: 620217 - RNA, 63 nt, Homo Sapiens
caggaguccaggcccccagccccagccccuccucccucagacccaggacccaggaguccaggc

SEQ ID NO: 620218 - RNA, 63 nt, Homo Sapiens
caggacuccaggcccccagccccaguaccuccucccucagacccagacccaggauucccgggc

SEQ ID NO: 620219 - RNA, 63 nt, Homo Sapiens
caggauucccgggccccaguuccagcuccuccucccucagacccagauccaggagucuagucc

SEQ ID NO: 620220 - RNA, 63 nt, Homo Sapiens
caguuugguuucuagcaugaagacagagccccacccucagaugcacaugagcuggcgggauug

SEQ ID NO: 620221 - RNA, 63 nt, Homo Sapiens
augcugucuucguacugggaaagggauuuucagcccucagaaucgcuccaccuugcagcucuc

SEQ ID NO: 620222 - RNA, 63 nt, Homo Sapiens
cccagaggcagucccagccugguggagggcagucccucagaauucugagcccaggccugcagg

SEQ ID NO: 620223 - RNA, 63 nt, Homo Sapiens
ccucaggacccaacagguggcuuguccuucucucccucagaaggcccuccccuuccucccauc

SEQ ID NO: 620224 - RNA, 64 nt, Homo Sapiens; identical to SEQ ID NO: 111894

SEQ ID NO: 620225 - RNA, 64 nt, Homo Sapiens; identical to SEQ ID NO: 111895

SEQ ID NO: 620226 - RNA, 64 nt, Homo Sapiens; identical to SEQ ID NO: 111896

SEQ ID NO: 620227 - RNA, 64 nt, Homo Sapiens; identical to SEQ ID NO: 111897

SEQ ID NO: 620228 - RNA, 64 nt, Homo Sapiens; identical to SEQ ID NO: 111898

SEQ ID NO: 620229 - RNA, 64 nt, Homo Sapiens; identical to SEQ ID NO: 111899

SEQ ID NO: 620230 - RNA, 64 nt, Homo Sapiens; identical to SEQ ID NO: 111900

SEQ ID NO: 620231 - RNA, 64 nt, Homo Sapiens; identical to SEQ ID NO: 111901

SEQ ID NO: 620232 - RNA, 64 nt, Homo Sapiens; identical to SEQ ID NO: 111902

SEQ ID NO: 620233 - RNA, 64 nt, Homo Sapiens; identical to SEQ ID NO: 111903

SEQ ID NO: 620234 - RNA, 64 nt, Homo Sapiens; identical to SEQ ID NO: 111904

SEQ ID NO: 620235 - RNA, 64 nt, Homo Sapiens; identical to SEQ ID NO: 111905

SEQ ID NO: 620236 - RNA, 64 nt, Homo Sapiens; identical to SEQ ID NO: 111906

SEQ ID NO: 620237 - RNA, 64 nt, Homo Sapiens; identical to SEQ ID NO: 111907

SEQ ID NO: 620238 - RNA, 64 nt, Homo Sapiens; identical to SEQ ID NO: 111908

SEQ ID NO: 620239 - RNA, 64 nt, Homo Sapiens; identical to SEQ ID NO: 111909

SEQ ID NO: 620240 - RNA, 64 nt, Homo Sapiens; identical to SEQ ID NO: 111910

SEQ ID NO: 620241 - RNA, 64 nt, Homo Sapiens; identical to SEQ ID NO: 111911

SEQ ID NO: 620242 - RNA, 64 nt, Homo Sapiens; identical to SEQ ID NO: 111912

SEQ ID NO: 620243 - RNA, 64 nt, Homo Sapiens; identical to SEQ ID NO: 111913

SEQ ID NO: 620244 - RNA, 64 nt, Homo Sapiens; identical to SEQ ID NO: 111914

SEQ ID NO: 620245 - RNA, 64 nt, Homo Sapiens; identical to SEQ ID NO: 111915

SEQ ID NO: 620246 - RNA, 64 nt, Homo Sapiens; identical to SEQ ID NO: 111916

SEQ ID NO: 620247 - RNA, 64 nt, Homo Sapiens; identical to SEQ ID NO: 111917

SEQ ID NO: 620248 - RNA, 64 nt, Homo Sapiens; identical to SEQ ID NO: 111918

SEQ ID NO: 620249 - RNA, 64 nt, Homo Sapiens; identical to SEQ ID NO: 111919

SEQ ID NO: 620250 - RNA, 64 nt, Homo Sapiens; identical to SEQ ID NO: 111920

SEQ ID NO: 620251 - RNA, 64 nt, Homo Sapiens; identical to SEQ ID NO: 111921

SEQ ID NO: 620252 - RNA, 64 nt, Homo Sapiens; identical to SEQ ID NO: 111922

SEQ ID NO: 620253 - RNA, 64 nt, Homo Sapiens; identical to SEQ ID NO: 111923

SEQ ID NO: 620254 - RNA, 64 nt, Homo Sapiens; identical to SEQ ID NO: 111924

SEQ ID NO: 620255 - RNA, 64 nt, Homo Sapiens; identical to SEQ ID NO: 111925

SEQ ID NO: 620256 - RNA, 64 nt, Homo Sapiens; identical to SEQ ID NO: 111926

SEQ ID NO: 620257 - RNA, 64 nt, Homo Sapiens; identical to SEQ ID NO: 111927

SEQ ID NO: 620258 - RNA, 63 nt, Homo Sapiens; identical to SEQ ID NO: 620168

SEQ ID NO: 620259 - RNA, 63 nt, Homo Sapiens; identical to SEQ ID NO: 620169

SEQ ID NO: 620260 - RNA, 63 nt, Homo Sapiens; identical to SEQ ID NO: 620170

SEQ ID NO: 620261 - RNA, 63 nt, Homo Sapiens; identical to SEQ ID NO: 620171

SEQ ID NO: 620262 - RNA, 63 nt, Homo Sapiens; identical to SEQ ID NO: 620172

SEQ ID NO: 620263 - RNA, 63 nt, Homo Sapiens; identical to SEQ ID NO: 620173

SEQ ID NO: 620264 - RNA, 63 nt, Homo Sapiens; identical to SEQ ID NO: 620174

SEQ ID NO: 620265 - RNA, 63 nt, Homo Sapiens; identical to SEQ ID NO: 620175

SEQ ID NO: 620266 - RNA, 63 nt, Homo Sapiens; identical to SEQ ID NO: 620176

SEQ ID NO: 620267 - RNA, 63 nt, Homo Sapiens; identical to SEQ ID NO: 620177

SEQ ID NO: 620268 - RNA, 63 nt, Homo Sapiens; identical to SEQ ID NO: 620178

SEQ ID NO: 620269 - RNA, 63 nt, Homo Sapiens; identical to SEQ ID NO: 620179

SEQ ID NO: 620270 - RNA, 63 nt, Homo Sapiens; identical to SEQ ID NO: 620180

SEQ ID NO: 620271 - RNA, 63 nt, Homo Sapiens; identical to SEQ ID NO: 620181

SEQ ID NO: 620272 - RNA, 63 nt, Homo Sapiens; identical to SEQ ID NO: 620182

SEQ ID NO: 620273 - RNA, 63 nt, Homo Sapiens; identical to SEQ ID NO: 620183

SEQ ID NO: 620274 - RNA, 63 nt, Homo Sapiens; identical to SEQ ID NO: 620184

SEQ ID NO: 620275 - RNA, 63 nt, Homo Sapiens; identical to SEQ ID NO: 620185

SEQ ID NO: 620276 - RNA, 63 nt, Homo Sapiens; identical to SEQ ID NO: 620186

SEQ ID NO: 620277 - RNA, 63 nt, Homo Sapiens; identical to SEQ ID NO: 620187

SEQ ID NO: 620278 - RNA, 63 nt, Homo Sapiens; identical to SEQ ID NO: 620188

SEQ ID NO: 620279 - RNA, 63 nt, Homo Sapiens; identical to SEQ ID NO: 620189

SEQ ID NO: 620280 - RNA, 63 nt, Homo Sapiens; identical to SEQ ID NO: 620190

SEQ ID NO: 620281 - RNA, 63 nt, Homo Sapiens; identical to SEQ ID NO: 620191

SEQ ID NO: 620282 - RNA, 63 nt, Homo Sapiens; identical to SEQ ID NO: 620192

SEQ ID NO: 620283 - RNA, 63 nt, Homo Sapiens; identical to SEQ ID NO: 620193

SEQ ID NO: 620284 - RNA, 63 nt, Homo Sapiens; identical to SEQ ID NO: 620194

SEQ ID NO: 620285 - RNA, 63 nt, Homo Sapiens; identical to SEQ ID NO: 620195

SEQ ID NO: 620286 - RNA, 63 nt, Homo Sapiens; identical to SEQ ID NO: 620196

SEQ ID NO: 620287 - RNA, 63 nt, Homo Sapiens; identical to SEQ ID NO: 620197

SEQ ID NO: 620288 - RNA, 63 nt, Homo Sapiens; identical to SEQ ID NO: 620198

SEQ ID NO: 620289 - RNA, 63 nt, Homo Sapiens; identical to SEQ ID NO: 620199

SEQ ID NO: 620290 - RNA, 63 nt, Homo Sapiens; identical to SEQ ID NO: 620200

SEQ ID NO: 620291 - RNA, 63 nt, Homo Sapiens; identical to SEQ ID NO: 620201

SEQ ID NO: 620292 - RNA, 63 nt, Homo Sapiens; identical to SEQ ID NO: 620202

SEQ ID NO: 620293 - RNA, 63 nt, Homo Sapiens; identical to SEQ ID NO: 620203

SEQ ID NO: 620294 - RNA, 63 nt, Homo Sapiens; identical to SEQ ID NO: 620204

SEQ ID NO: 620295 - RNA, 63 nt, Homo Sapiens; identical to SEQ ID NO: 620205

SEQ ID NO: 620296 - RNA, 63 nt, Homo Sapiens; identical to SEQ ID NO: 620206

SEQ ID NO: 620297 - RNA, 63 nt, Homo Sapiens; identical to SEQ ID NO: 620207

SEQ ID NO: 620298 - RNA, 63 nt, Homo Sapiens; identical to SEQ ID NO: 620208

SEQ ID NO: 620299 - RNA, 63 nt, Homo Sapiens; identical to SEQ ID NO: 620209

SEQ ID NO: 620300 - RNA, 63 nt, Homo Sapiens; identical to SEQ ID NO: 620210

SEQ ID NO: 620301 - RNA, 63 nt, Homo Sapiens; identical to SEQ ID NO: 620211

SEQ ID NO: 620302 - RNA, 63 nt, Homo Sapiens; identical to SEQ ID NO: 620212

SEQ ID NO: 620303 - RNA, 63 nt, Homo Sapiens; identical to SEQ ID NO: 620211

SEQ ID NO: 620304 - RNA, 63 nt, Homo Sapiens; identical to SEQ ID NO: 620214

SEQ ID NO: 620305 - RNA, 63 nt, Homo Sapiens; identical to SEQ ID NO: 620215

SEQ ID NO: 620306 - RNA, 63 nt, Homo Sapiens; identical to SEQ ID NO: 620216

SEQ ID NO: 620307 - RNA, 63 nt, Homo Sapiens; identical to SEQ ID NO: 620217

SEQ ID NO: 620308 - RNA, 63 nt, Homo Sapiens; identical to SEQ ID NO: 620218

SEQ ID NO: 620309 - RNA, 63 nt, Homo Sapiens; identical to SEQ ID NO: 620219

SEQ ID NO: 620310 - RNA, 63 nt, Homo Sapiens; identical to SEQ ID NO: 620220

SEQ ID NO: 620311 - RNA, 63 nt, Homo Sapiens; identical to SEQ ID NO: 620221

SEQ ID NO: 620312 - RNA, 63 nt, Homo Sapiens; identical to SEQ ID NO: 620222

SEQ ID NO: 620313 - RNA, 63 nt, Homo Sapiens; identical to SEQ ID NO: 620223

SEQ ID NO: 620314 - RNA, 64 nt, Homo Sapiens; identical to SEQ ID NO: 87480

SEQ ID NO: 620315 - RNA, 64 nt, Homo Sapiens; identical to SEQ ID NO: 87481

SEQ ID NO: 620316 - RNA, 64 nt, Homo Sapiens; identical to SEQ ID NO: 87482

SEQ ID NO: 620317 - RNA, 64 nt, Homo Sapiens; identical to SEQ ID NO: 87483

SEQ ID NO: 620318 - RNA, 64 nt, Homo Sapiens; identical to SEQ ID NO: 87484

SEQ ID NO: 620319 - RNA, 64 nt, Homo Sapiens; identical to SEQ ID NO: 87485

SEQ ID NO: 620320 - RNA, 64 nt, Homo Sapiens; identical to SEQ ID NO: 87486

SEQ ID NO: 620321 - RNA, 64 nt, Homo Sapiens; identical to SEQ ID NO: 87487

SEQ ID NO: 620322 - RNA, 64 nt, Homo Sapiens; identical to SEQ ID NO: 87488

SEQ ID NO: 620323 - RNA, 64 nt, Homo Sapiens; identical to SEQ ID NO: 87489

SEQ ID NO: 620324 - RNA, 64 nt, Homo Sapiens; identical to SEQ ID NO: 87490

SEQ ID NO: 620325 - RNA, 64 nt, Homo Sapiens; identical to SEQ ID NO: 87491

SEQ ID NO: 620326 - RNA, 64 nt, Homo Sapiens; identical to SEQ ID NO: 87492

SEQ ID NO: 620327 - RNA, 64 nt, Homo Sapiens; identical to SEQ ID NO: 87493

SEQ ID NO: 620328 - RNA, 64 nt, Homo Sapiens; identical to SEQ ID NO: 87494

SEQ ID NO: 620329 - RNA, 64 nt, Homo Sapiens; identical to SEQ ID NO: 87495

SEQ ID NO: 620330 - RNA, 64 nt, Homo Sapiens; identical to SEQ ID NO: 87496

SEQ ID NO: 620331 - RNA, 64 nt, Homo Sapiens; identical to SEQ ID NO: 87497

SEQ ID NO: 620332 - RNA, 64 nt, Homo Sapiens; identical to SEQ ID NO: 87498

SEQ ID NO: 620333 - RNA, 64 nt, Homo Sapiens; identical to SEQ ID NO: 87499

SEQ ID NO: 620334 - RNA, 64 nt, Homo Sapiens; identical to SEQ ID NO: 87500

SEQ ID NO: 620335 - RNA, 64 nt, Homo Sapiens; identical to SEQ ID NO: 87501

SEQ ID NO: 620336 - RNA, 64 nt, Homo Sapiens; identical to SEQ ID NO: 87502

SEQ ID NO: 620337 - RNA, 64 nt, Homo Sapiens; identical to SEQ ID NO: 87503

SEQ ID NO: 620338 - RNA, 64 nt, Homo Sapiens; identical to SEQ ID NO: 87504

SEQ ID NO: 620339 - RNA, 64 nt, Homo Sapiens; identical to SEQ ID NO: 87505

SEQ ID NO: 620340 - RNA, 64 nt, Homo Sapiens; identical to SEQ ID NO: 87506

SEQ ID NO: 620341 - RNA, 64 nt, Homo Sapiens; identical to SEQ ID NO: 87507

SEQ ID NO: 620342 - RNA, 64 nt, Homo Sapiens; identical to SEQ ID NO: 87508

SEQ ID NO: 620343 - RNA, 64 nt, Homo Sapiens; identical to SEQ ID NO: 87509

SEQ ID NO: 620344 - RNA, 64 nt, Homo Sapiens; identical to SEQ ID NO: 87510

SEQ ID NO: 620345 - RNA, 64 nt, Homo Sapiens; identical to SEQ ID NO: 87511

SEQ ID NO: 620346 - RNA, 64 nt, Homo Sapiens; identical to SEQ ID NO: 87512

SEQ ID NO: 620347 - RNA, 64 nt, Homo Sapiens; identical to SEQ ID NO: 87513

SEQ ID NO: 620348 - RNA, 64 nt, Homo Sapiens; identical to SEQ ID NO: 87514

SEQ ID NO: 620349 - RNA, 64 nt, Homo Sapiens; identical to SEQ ID NO: 87515

SEQ ID NO: 620350 - RNA, 64 nt, Homo Sapiens; identical to SEQ ID NO: 87516

SEQ ID NO: 620351 - RNA, 64 nt, Homo Sapiens; identical to SEQ ID NO: 87517

SEQ ID NO: 620352 - RNA, 64 nt, Homo Sapiens; identical to SEQ ID NO: 87518

SEQ ID NO: 620353 - RNA, 64 nt, Homo Sapiens; identical to SEQ ID NO: 87519

SEQ ID NO: 620354 - RNA, 64 nt, Homo Sapiens; identical to SEQ ID NO: 87520

SEQ ID NO: 620355 - RNA, 64 nt, Homo Sapiens; identical to SEQ ID NO: 87521

SEQ ID NO: 620356 - RNA, 64 nt, Homo Sapiens; identical to SEQ ID NO: 87522

SEQ ID NO: 620357 - RNA, 64 nt, Homo Sapiens; identical to SEQ ID NO: 87523

SEQ ID NO: 620358 - RNA, 64 nt, Homo Sapiens; identical to SEQ ID NO: 87524

SEQ ID NO: 620359 - RNA, 64 nt, Homo Sapiens; identical to SEQ ID NO: 87525

SEQ ID NO: 620360 - RNA, 64 nt, Homo Sapiens; identical to SEQ ID NO: 87526

SEQ ID NO: 620361 - RNA, 64 nt, Homo Sapiens; identical to SEQ ID NO: 87527

SEQ ID NO: 620362 - RNA, 64 nt, Homo Sapiens; identical to SEQ ID NO: 87528

SEQ ID NO: 620363 - RNA, 64 nt, Homo Sapiens; identical to SEQ ID NO: 87529

SEQ ID NO: 620364 - RNA, 64 nt, Homo Sapiens; identical to SEQ ID NO: 87530

SEQ ID NO: 620365 - RNA, 64 nt, Homo Sapiens; identical to SEQ ID NO: 87531

SEQ ID NO: 620366 - RNA, 64 nt, Homo Sapiens; identical to SEQ ID NO: 87532

SEQ ID NO: 620367 - RNA, 64 nt, Homo Sapiens; identical to SEQ ID NO: 87533

SEQ ID NO: 620368 - RNA, 64 nt, Homo Sapiens; identical to SEQ ID NO: 87534

SEQ ID NO: 620369 - RNA, 64 nt, Homo Sapiens; identical to SEQ ID NO: 87535

SEQ ID NO: 620370 - RNA, 64 nt, Homo Sapiens; identical to SEQ ID NO: 87536

SEQ ID NO: 620371 - RNA, 64 nt, Homo Sapiens; identical to SEQ ID NO: 381884

SEQ ID NO: 620372 - RNA, 64 nt, Homo Sapiens; identical to SEQ ID NO: 381885

SEQ ID NO: 620373 - RNA, 64 nt, Homo Sapiens; identical to SEQ ID NO: 381886

SEQ ID NO: 620374 - RNA, 64 nt, Homo Sapiens; identical to SEQ ID NO: 381887

SEQ ID NO: 620375 - RNA, 64 nt, Homo Sapiens; identical to SEQ ID NO: 381888

SEQ ID NO: 620376 - RNA, 64 nt, Homo Sapiens; identical to SEQ ID NO: 381889

SEQ ID NO: 620377 - RNA, 64 nt, Homo Sapiens; identical to SEQ ID NO: 381890

SEQ ID NO: 620378 - RNA, 64 nt, Homo Sapiens; identical to SEQ ID NO: 381891

SEQ ID NO: 620379 - RNA, 59 nt, Homo Sapiens; identical to SEQ ID NO: 381892

SEQ ID NO: 620380 - RNA, 64 nt, Homo Sapiens; identical to SEQ ID NO: 381893

SEQ ID NO: 620381 - RNA, 64 nt, Homo Sapiens; identical to SEQ ID NO: 381894

SEQ ID NO: 620382 - RNA, 64 nt, Homo Sapiens; identical to SEQ ID NO: 381895

SEQ ID NO: 620383 - RNA, 64 nt, Homo Sapiens; identical to SEQ ID NO: 381896

SEQ ID NO: 620384 - RNA, 64 nt, Homo Sapiens; identical to SEQ ID NO: 381897

SEQ ID NO: 620385 - RNA, 64 nt, Homo Sapiens; identical to SEQ ID NO: 381898

SEQ ID NO: 620386 - RNA, 64 nt, Homo Sapiens; identical to SEQ ID NO: 381899

SEQ ID NO: 620387 - RNA, 64 nt, Homo Sapiens; identical to SEQ ID NO: 381900

SEQ ID NO: 620388 - RNA, 64 nt, Homo Sapiens; identical to SEQ ID NO: 381901

SEQ ID NO: 620389 - RNA, 64 nt, Homo Sapiens; identical to SEQ ID NO: 381902

SEQ ID NO: 620390 - RNA, 64 nt, Homo Sapiens; identical to SEQ ID NO: 381903

SEQ ID NO: 620391 - RNA, 64 nt, Homo Sapiens; identical to SEQ ID NO: 381904

SEQ ID NO: 620392 - RNA, 64 nt, Homo Sapiens; identical to SEQ ID NO: 381905

SEQ ID NO: 620393 - RNA, 64 nt, Homo Sapiens; identical to SEQ ID NO: 381906

SEQ ID NO: 620394 - RNA, 64 nt, Homo Sapiens; identical to SEQ ID NO: 381907

SEQ ID NO: 620395 - RNA, 64 nt, Homo Sapiens; identical to SEQ ID NO: 381908

SEQ ID NO: 620396 - RNA, 64 nt, Homo Sapiens; identical to SEQ ID NO: 381909

SEQ ID NO: 620397 - RNA, 64 nt, Homo Sapiens; identical to SEQ ID NO: 381910

SEQ ID NO: 620398 - RNA, 64 nt, Homo Sapiens; identical to SEQ ID NO: 381911

SEQ ID NO: 620399 - RNA, 64 nt, Homo Sapiens; identical to SEQ ID NO: 381912

SEQ ID NO: 620400 - RNA, 64 nt, Homo Sapiens; identical to SEQ ID NO: 381913

SEQ ID NO: 620401 - RNA, 64 nt, Homo Sapiens; identical to SEQ ID NO: 381914

SEQ ID NO: 620402 - RNA, 64 nt, Homo Sapiens; identical to SEQ ID NO: 381915

SEQ ID NO: 620403 - RNA, 64 nt, Homo Sapiens; identical to SEQ ID NO: 381916

SEQ ID NO: 620404 - RNA, 64 nt, Homo Sapiens; identical to SEQ ID NO: 381917

SEQ ID NO: 620405 - RNA, 64 nt, Homo Sapiens; identical to SEQ ID NO: 381918

SEQ ID NO: 620406 - RNA, 64 nt, Homo Sapiens; identical to SEQ ID NO: 381919

SEQ ID NO: 620407 - RNA, 64 nt, Homo Sapiens; identical to SEQ ID NO: 381920

SEQ ID NO: 620408 - RNA, 64 nt, Homo Sapiens; identical to SEQ ID NO: 381921

SEQ ID NO: 620409 - RNA, 64 nt, Homo Sapiens; identical to SEQ ID NO: 381922

SEQ ID NO: 620410 - RNA, 64 nt, Homo Sapiens; identical to SEQ ID NO: 381923

SEQ ID NO: 620411 - RNA, 64 nt, Homo Sapiens; identical to SEQ ID NO: 381924

SEQ ID NO: 620412 - RNA, 64 nt, Homo Sapiens; identical to SEQ ID NO: 381925

SEQ ID NO: 620413 - RNA, 64 nt, Homo Sapiens; identical to SEQ ID NO: 381926

SEQ ID NO: 620414 - RNA, 64 nt, Homo Sapiens; identical to SEQ ID NO: 381927

SEQ ID NO: 620415 - RNA, 64 nt, Homo Sapiens; identical to SEQ ID NO: 381928

SEQ ID NO: 620416 - RNA, 64 nt, Homo Sapiens; identical to SEQ ID NO: 60878

SEQ ID NO: 620417 - RNA, 64 nt, Homo Sapiens; identical to SEQ ID NO: 60879

SEQ ID NO: 620418 - RNA, 64 nt, Homo Sapiens; identical to SEQ ID NO: 60880

SEQ ID NO: 620419 - RNA, 64 nt, Homo Sapiens; identical to SEQ ID NO: 60881

SEQ ID NO: 620420 - RNA, 64 nt, Homo Sapiens; identical to SEQ ID NO: 60882

SEQ ID NO: 620421 - RNA, 64 nt, Homo Sapiens; identical to SEQ ID NO: 60883

SEQ ID NO: 620422 - RNA, 64 nt, Homo Sapiens; identical to SEQ ID NO: 60884

SEQ ID NO: 620423 - RNA, 64 nt, Homo Sapiens; identical to SEQ ID NO: 60885

SEQ ID NO: 620424 - RNA, 64 nt, Homo Sapiens; identical to SEQ ID NO: 60886

SEQ ID NO: 620425 - RNA, 64 nt, Homo Sapiens; identical to SEQ ID NO: 60887

SEQ ID NO: 620426 - RNA, 64 nt, Homo Sapiens; identical to SEQ ID NO: 60888

SEQ ID NO: 620427 - RNA, 64 nt, Homo Sapiens; identical to SEQ ID NO: 60889

SEQ ID NO: 620428 - RNA, 64 nt, Homo Sapiens; identical to SEQ ID NO: 60890

SEQ ID NO: 620429 - RNA, 64 nt, Homo Sapiens; identical to SEQ ID NO: 60891

SEQ ID NO: 620430 - RNA, 64 nt, Homo Sapiens; identical to SEQ ID NO: 60892

SEQ ID NO: 620431 - RNA, 64 nt, Homo Sapiens; identical to SEQ ID NO: 60893

SEQ ID NO: 620432 - RNA, 64 nt, Homo Sapiens; identical to SEQ ID NO: 60894

SEQ ID NO: 620433 - RNA, 64 nt, Homo Sapiens; identical to SEQ ID NO: 60895

SEQ ID NO: 620434 - RNA, 64 nt, Homo Sapiens; identical to SEQ ID NO: 60896

SEQ ID NO: 620435 - RNA, 64 nt, Homo Sapiens; identical to SEQ ID NO: 60897

SEQ ID NO: 620436 - RNA, 64 nt, Homo Sapiens; identical to SEQ ID NO: 60898

SEQ ID NO: 620437 - RNA, 64 nt, Homo Sapiens; identical to SEQ ID NO: 60899

SEQ ID NO: 620438 - RNA, 64 nt, Homo Sapiens; identical to SEQ ID NO: 60900

SEQ ID NO: 620439 - RNA, 64 nt, Homo Sapiens; identical to SEQ ID NO: 60901

SEQ ID NO: 620440 - RNA, 64 nt, Homo Sapiens; identical to SEQ ID NO: 60902

SEQ ID NO: 620441 - RNA, 64 nt, Homo Sapiens; identical to SEQ ID NO: 60903

SEQ ID NO: 620442 - RNA, 64 nt, Homo Sapiens; identical to SEQ ID NO: 60904

SEQ ID NO: 620443 - RNA, 64 nt, Homo Sapiens; identical to SEQ ID NO: 60905

SEQ ID NO: 620444 - RNA, 64 nt, Homo Sapiens; identical to SEQ ID NO: 60906

SEQ ID NO: 620445 - RNA, 64 nt, Homo Sapiens; identical to SEQ ID NO: 60907

SEQ ID NO: 620446 - RNA, 64 nt, Homo Sapiens; identical to SEQ ID NO: 60908

SEQ ID NO: 620447 - RNA, 64 nt, Homo Sapiens; identical to SEQ ID NO: 60909

SEQ ID NO: 620448 - RNA, 64 nt, Homo Sapiens; identical to SEQ ID NO: 60910

SEQ ID NO: 620449 - RNA, 64 nt, Homo Sapiens; identical to SEQ ID NO: 60911

SEQ ID NO: 620450 - RNA, 64 nt, Homo Sapiens; identical to SEQ ID NO: 60912

SEQ ID NO: 620451 - RNA, 64 nt, Homo Sapiens; identical to SEQ ID NO: 60913

SEQ ID NO: 620452 - RNA, 64 nt, Homo Sapiens; identical to SEQ ID NO: 60914

SEQ ID NO: 620453 - RNA, 64 nt, Homo Sapiens; identical to SEQ ID NO: 60915

SEQ ID NO: 620454 - RNA, 64 nt, Homo Sapiens; identical to SEQ ID NO: 60916

SEQ ID NO: 620455 - RNA, 64 nt, Homo Sapiens; identical to SEQ ID NO: 60917

SEQ ID NO: 620456 - RNA, 64 nt, Homo Sapiens; identical to SEQ ID NO: 60918

SEQ ID NO: 620457 - RNA, 64 nt, Homo Sapiens; identical to SEQ ID NO: 60919

SEQ ID NO: 620458 - RNA, 64 nt, Homo Sapiens; identical to SEQ ID NO: 60920

SEQ ID NO: 620459 - RNA, 64 nt, Homo Sapiens; identical to SEQ ID NO: 60921

SEQ ID NO: 620460 - RNA, 64 nt, Homo Sapiens; identical to SEQ ID NO: 60922

SEQ ID NO: 620461 - RNA, 64 nt, Homo Sapiens; identical to SEQ ID NO: 60923

SEQ ID NO: 620462 - RNA, 64 nt, Homo Sapiens; identical to SEQ ID NO: 60924

SEQ ID NO: 620463 - RNA, 64 nt, Homo Sapiens; identical to SEQ ID NO: 60925

SEQ ID NO: 620464 - RNA, 64 nt, Homo Sapiens; identical to SEQ ID NO: 60926

SEQ ID NO: 620465 - RNA, 64 nt, Homo Sapiens; identical to SEQ ID NO: 60927

SEQ ID NO: 620466 - RNA, 64 nt, Homo Sapiens; identical to SEQ ID NO: 60928

SEQ ID NO: 620467 - RNA, 64 nt, Homo Sapiens; identical to SEQ ID NO: 60929

SEQ ID NO: 620468 - RNA, 64 nt, Homo Sapiens; identical to SEQ ID NO: 60930

SEQ ID NO: 620469 - RNA, 64 nt, Homo Sapiens; identical to SEQ ID NO: 60931

SEQ ID NO: 620470 - RNA, 64 nt, Homo Sapiens; identical to SEQ ID NO: 60932

SEQ ID NO: 620471 - RNA, 64 nt, Homo Sapiens; identical to SEQ ID NO: 60933

SEQ ID NO: 620472 - RNA, 64 nt, Homo Sapiens; identical to SEQ ID NO: 550527

SEQ ID NO: 620473 - RNA, 64 nt, Homo Sapiens; identical to SEQ ID NO: 550528

SEQ ID NO: 620474 - RNA, 64 nt, Homo Sapiens; identical to SEQ ID NO: 550529

SEQ ID NO: 620475 - RNA, 64 nt, Homo Sapiens; identical to SEQ ID NO: 550530

SEQ ID NO: 620476 - RNA, 64 nt, Homo Sapiens; identical to SEQ ID NO: 550531

SEQ ID NO: 620477 - RNA, 64 nt, Homo Sapiens; identical to SEQ ID NO: 550532

SEQ ID NO: 620478 - RNA, 64 nt, Homo Sapiens; identical to SEQ ID NO: 550533

SEQ ID NO: 620479 - RNA, 64 nt, Homo Sapiens; identical to SEQ ID NO: 550534

SEQ ID NO: 620480 - RNA, 64 nt, Homo Sapiens; identical to SEQ ID NO: 550535

SEQ ID NO: 620481 - RNA, 64 nt, Homo Sapiens; identical to SEQ ID NO: 550536

SEQ ID NO: 620482 - RNA, 64 nt, Homo Sapiens; identical to SEQ ID NO: 550537

SEQ ID NO: 620483 - RNA, 64 nt, Homo Sapiens; identical to SEQ ID NO: 550538

SEQ ID NO: 620484 - RNA, 64 nt, Homo Sapiens; identical to SEQ ID NO: 550539

SEQ ID NO: 620485 - RNA, 64 nt, Homo Sapiens; identical to SEQ ID NO: 550540

SEQ ID NO: 620486 - RNA, 64 nt, Homo Sapiens; identical to SEQ ID NO: 550541

SEQ ID NO: 620487 - RNA, 64 nt, Homo Sapiens; identical to SEQ ID NO: 550542

SEQ ID NO: 620488 - RNA, 64 nt, Homo Sapiens; identical to SEQ ID NO: 550543

SEQ ID NO: 620489 - RNA, 64 nt, Homo Sapiens; identical to SEQ ID NO: 550544

SEQ ID NO: 620490 - RNA, 64 nt, Homo Sapiens; identical to SEQ ID NO: 550545

SEQ ID NO: 620491 - RNA, 64 nt, Homo Sapiens; identical to SEQ ID NO: 550546

SEQ ID NO: 620492 - RNA, 64 nt, Homo Sapiens; identical to SEQ ID NO: 550547

SEQ ID NO: 620493 - RNA, 64 nt, Homo Sapiens; identical to SEQ ID NO: 550548

SEQ ID NO: 620494 - RNA, 64 nt, Homo Sapiens; identical to SEQ ID NO: 550549

SEQ ID NO: 620495 - RNA, 64 nt, Homo Sapiens; identical to SEQ ID NO: 550550

SEQ ID NO: 620496 - RNA, 64 nt, Homo Sapiens; identical to SEQ ID NO: 550551

SEQ ID NO: 620497 - RNA, 64 nt, Homo Sapiens; identical to SEQ ID NO: 550552

SEQ ID NO: 620498 - RNA, 64 nt, Homo Sapiens; identical to SEQ ID NO: 550553

SEQ ID NO: 620499 - RNA, 64 nt, Homo Sapiens; identical to SEQ ID NO: 550554

SEQ ID NO: 620500 - RNA, 64 nt, Homo Sapiens; identical to SEQ ID NO: 550555

SEQ ID NO: 620501 - RNA, 64 nt, Homo Sapiens; identical to SEQ ID NO: 550556

SEQ ID NO: 620502 - RNA, 64 nt, Homo Sapiens; identical to SEQ ID NO: 550557

SEQ ID NO: 620503 - RNA, 64 nt, Homo Sapiens; identical to SEQ ID NO: 550558

SEQ ID NO: 620504 - RNA, 64 nt, Homo Sapiens; identical to SEQ ID NO: 550559

SEQ ID NO: 620505 - RNA, 64 nt, Homo Sapiens; identical to SEQ ID NO: 550560

SEQ ID NO: 620506 - RNA, 64 nt, Homo Sapiens; identical to SEQ ID NO: 550561

SEQ ID NO: 620507 - RNA, 64 nt, Homo Sapiens; identical to SEQ ID NO: 550562

SEQ ID NO: 620508 - RNA, 64 nt, Homo Sapiens; identical to SEQ ID NO: 550563

SEQ ID NO: 620509 - RNA, 64 nt, Homo Sapiens; identical to SEQ ID NO: 550564

SEQ ID NO: 620510 - RNA, 64 nt, Homo Sapiens; identical to SEQ ID NO: 550565

SEQ ID NO: 620511 - RNA, 64 nt, Homo Sapiens; identical to SEQ ID NO: 550566

SEQ ID NO: 620512 - RNA, 64 nt, Homo Sapiens; identical to SEQ ID NO: 550567

SEQ ID NO: 620513 - RNA, 64 nt, Homo Sapiens; identical to SEQ ID NO: 550568

SEQ ID NO: 620514 - RNA, 64 nt, Homo Sapiens; identical to SEQ ID NO: 550569

SEQ ID NO: 620515 - RNA, 64 nt, Homo Sapiens; identical to SEQ ID NO: 550570

SEQ ID NO: 620516 - RNA, 64 nt, Homo Sapiens; identical to SEQ ID NO: 550571

SEQ ID NO: 620517 - RNA, 64 nt, Homo Sapiens; identical to SEQ ID NO: 550572

SEQ ID NO: 620518 - RNA, 64 nt, Homo Sapiens
cuagagugacucagacacaccacaguaacaacucucgcugcaauuuuauuuuaauuugagaaau

SEQ ID NO: 620519 - RNA, 64 nt, Homo Sapiens
ccccagagcgagcuuccccugcugaaagugcagcucgcugcagggcuccccacaguccaaauaa

SEQ ID NO: 620520 - RNA, 64 nt, Homo Sapiens
ccccaccucccagguucaagggcaugaucucagcucgcugcaaccagccaggcuggagugcagu

SEQ ID NO: 620521 - RNA, 64 nt, Homo Sapiens
uguuccccaucaguacucaauucccuggugcuguucgcugcaguccuacugagcauccuccagc

SEQ ID NO: 620522 - RNA, 64 nt, Homo Sapiens
ucgucggucgguuugccgucagagauggcgcaucucgcugcaucccccgagaguacaccgguug

SEQ ID NO: 620523 - RNA, 64 nt, Homo Sapiens
ucgccaggcuggagugcaguggcgcagucucggcucgcugcaaccucugacucccugguucaaa

SEQ ID NO: 620524 - RNA, 64 nt, Homo Sapiens
agauguguucugagcuggaugccggguuccagaaucgcugcacaguuccaacaggacagcgccu

SEQ ID NO: 620525 - RNA, 64 nt, Homo Sapiens
aggaugugugaaaaucuuuuccagggaaauggguucgcugcagagguaaggauguguuccugua

SEQ ID NO: 620526 - RNA, 64 nt, Homo Sapiens
gccaggccuuggguuuccccagcacagccuccugucgcugcaugcgacguguugggauuuuugg

SEQ ID NO: 620527 - RNA, 64 nt, Homo Sapiens
cuguugauagcaagugaauuaaaggccagcaaauucgcugcaacuguuucuagggaaaugaaag

SEQ ID NO: 620528 - RNA, 64 nt, Homo Sapiens
ucuucuagguugggugggugacguagacgacuacucgcugcacgggggcugccuggucacgcgc

SEQ ID NO: 620529 - RNA, 64 nt, Homo Sapiens
agacaccaguuaaguggcguucaugggggcucuuucgcugcagccuccaccgugcugaggucag

SEQ ID NO: 620530 - RNA, 64 nt, Homo Sapiens
uuuguuuuuaugugugaaaccgugcaaagaauaaucgcugcaguuuauauuaugcagagaugug

SEQ ID NO: 620531 - RNA, 64 nt, Homo Sapiens
gagcaccacggccagaaguaauaugggcgggcagucgcugcaggugauguagugaccaagugca

SEQ ID NO: 620532 - RNA, 64 nt, Homo Sapiens
gaagagccauggaugcuuuccacaaaaugucaccucgcugcacuaaaggaugaugaauccuaau

SEQ ID NO: 620533 - RNA, 64 nt, Homo Sapiens
uccuguuuaguuccaagggauauuuuucuuuuugucgcugcacugaaucguggugguuuuauuu

SEQ ID NO: 620534 - RNA, 55 nt, Homo Sapiens
aguauaccagcuccaagugagccucucgcugcaguaacaguuccgccgugaccca

SEQ ID NO: 620535 - RNA, 64 nt, Homo Sapiens
ggaaagaacaaccuuaaaacagaaacuugauucaucgcugcaaaauuccccaauggacuccaga

SEQ ID NO: 620536 - RNA, 64 nt, Homo Sapiens
uuaggaagguuuuuuuaaacggcuuuuuguaacuucgcugcaggaagcagguuuguuucuuuuu

SEQ ID NO: 620537 - RNA, 64 nt, Homo Sapiens
acacucuuguguauauuuccaaauuuuuguacagucgcugcacauauuugaaaucauauauuaa

SEQ ID NO: 620538 - RNA, 64 nt, Homo Sapiens
uuuuguuuugaaaaaauaaacagauuaaccugccucgcugcagugagagcaugggacaaguccg

SEQ ID NO: 620539 - RNA, 64 nt, Homo Sapiens
cauuugcucgcaguauccuagaaucuuugugcucucgcugcaguucccuuuggguuccauguuu

SEQ ID NO: 620540 - RNA, 64 nt, Homo Sapiens
gccugaugcaggccggcucccaguggggcaggccucgcugcagaaugcccaguaguacugcggc

SEQ ID NO: 620541 - RNA, 64 nt, Homo Sapiens
agcuuucuuucaucuuuauagcagucuugucgaaucgcugcagcgaugcaaguuucagcaaagg

SEQ ID NO: 620542 - RNA, 64 nt, Homo Sapiens
ccugcagcucaacgagacccccgcaggguggagaucgcugcaucaacaaguaccugacgcgcgc

SEQ ID NO: 620543 - RNA, 64 nt, Homo Sapiens
uggcagagcauucagugccacgguuuaggugaagucgcugcauaugugacugucaugagauccu

SEQ ID NO: 620544 - RNA, 64 nt, Homo Sapiens
guaaucacaauagauaaaagugcaaaagcagaaaucgcugcaagaugaugcuugagaugguuuu

SEQ ID NO: 620545 - RNA, 60 nt, Homo Sapiens
agugccagaagagacaguagucugcauacaucgcugcaggccacagagcagcuuggguug

SEQ ID NO: 620546 - RNA, 64 nt, Homo Sapiens
ugaaucccgcuggagagcaaacacgaacuucuguucgcugcaaaaugguuagaaagaaacagcu

SEQ ID NO: 620547 - RNA, 64 nt, Homo Sapiens
cucccuuucagagccugcuccccgcccucucugcucgcugcauugugguguucucuucucaagg

SEQ ID NO: 620548 - RNA, 64 nt, Homo Sapiens
cacagccacgaagaacaugcuggagggcccaaugucgcugcaaaccaccuuugaccccaaggcc

SEQ ID NO: 620549 - RNA, 64 nt, Homo Sapiens
cguggccgcagaggcugcagguggguuccgguccucgcugcaccacguugcucagguucccccu

SEQ ID NO: 620550 - RNA, 64 nt, Homo Sapiens
ccccuggcaaacaaauugaagugccaaacagcacucgcugcaggguauuuuuagagucauagcu

SEQ ID NO: 620551 - RNA, 64 nt, Homo Sapiens
uggcauuucuaggaaaacugugaccugugacaaaucgcugcauuuuuaaugucaagauguguuu

SEQ ID NO: 620552 - RNA, 64 nt, Homo Sapiens
gcuugcuguggguccgucagcgcccacauuggcuucgcugcagcccaggcaucucccuaccagc

SEQ ID NO: 620553 - RNA, 64 nt, Homo Sapiens
uucaaggcugguggcugggagcaguggguggcucucgcugcagcaaggggucccaaaggccaag

SEQ ID NO: 620554 - RNA, 64 nt, Homo Sapiens
cccgcccccgugggucucugguccccaggcgcccucgcugcagcaugcucuccgccguguucgu

SEQ ID NO: 620555 - RNA, 64 nt, Homo Sapiens
agaagcaccuggacuucuagggauuccuccuuagucgcugcaugcagaauucuaugacacucua

SEQ ID NO: 620556 - RNA, 64 nt, Homo Sapiens
uagcacugggcccaaauauucuuuguaaagaaaaucgcugcagcaaaaacuguuacuguguuua

SEQ ID NO: 620557 - RNA, 64 nt, Homo Sapiens
cgacaugcauuuacucucugccgugggucugcagucgcugcaaccuacccucucucugccucag

SEQ ID NO: 620558 - RNA, 64 nt, Homo Sapiens
augugccaccccugugggcagcaagaagcugggaucgcugcagccauguuuucccggccaugcc

SEQ ID NO: 620559 - RNA, 64 nt, Homo Sapiens
aacuguuguaugccuggugcuuuuucucuuagggucgcugcauagcugaagagggcuggguuuu

SEQ ID NO: 620560 - RNA, 64 nt, Homo Sapiens
uuauuucacaagaggagugucugaccaaaugucaucgcugcauuacugaaggaaagaacaucag

SEQ ID NO: 620561 - RNA, 64 nt, Homo Sapiens
agucccaggugaaccacaccauccugcaguacuaucgcugcauggccagcgagcuuguccgugu

SEQ ID NO: 620562 - RNA, 64 nt, Homo Sapiens
cuucaccuccuggguucaagggcacuaucucagcucgcugcaaccgcccaggcuggagugcaau

SEQ ID NO: 620563 - RNA, 64 nt, Homo Sapiens
cagcugucuggacaaacagagagaaacuggaaugucgcugcauuugcaggagaaugagcgggug

SEQ ID NO: 620564 - RNA, 64 nt, Homo Sapiens
uccaggccauguggcuguucccacggcccaguccucgcugcaguaaccccugggggcucugacc

SEQ ID NO: 620565 - RNA, 64 nt, Homo Sapiens
aaucccagcacuuugggaggcccaggcagaaggaucgcugcagcccaggaguucgagacuagcc

SEQ ID NO: 620566 - RNA, 64 nt, Homo Sapiens
caagucuagaugacagagcauaugacgaugccacucgcugcauuagauugagccugcagugagc

SEQ ID NO: 620567 - RNA, 64 nt, Homo Sapiens
cccaucuaccacaucuucauuucccugcccgaggucgcugcagcggagcccgguguucaguggu

SEQ ID NO: 620568 - RNA, 64 nt, Homo Sapiens
ugccaugugagucccaggagcgggcccccgcccaucgcugcagcccagaggccacaccccaggc

SEQ ID NO: 620569 - RNA, 64 nt, Homo Sapiens
cacaccuguauuugauucucagccaggggagcacucgcugcacuggugggaggcgguugggaaa

SEQ ID NO: 620570 - RNA, 64 nt, Homo Sapiens
auccugaggugccgccauuggcgguucugcugcuucgcugcagggauaagguggagcuaccgaa

SEQ ID NO: 620571 - RNA, 64 nt, Homo Sapiens
ucucggagggcugguguucaccaaguuucccuccucgcugcaacccaaugacaccuguauuguu

SEQ ID NO: 620572 - RNA, 64 nt, Homo Sapiens
caggagcugggccugaggcuuaggagagcugccuucgcugcaggaaaucagggauuaucccuua

SEQ ID NO: 620573 - RNA, 64 nt, Homo Sapiens
guuguaguucugggcccucgggcaucucuaucuuucgcugcagagaaugugacacauuuucaag

SEQ ID NO: 620574 - RNA, 64 nt, Homo Sapiens
ucacgggaaacaagccugagcuguucugggaucuucgcugcagucuguccgcccacugcccuug

SEQ ID NO: 620575 - RNA, 64 nt, Homo Sapiens
agccagccuccggccucuguauugccauuaaacaucgcugcacccaugggcuugguuuauacga

SEQ ID NO: 620576 - RNA, 64 nt, Homo Sapiens
cgcccgagccccgcuccucggacccaacccggugucgcugcaccuagucugucgcgggcgcagg

SEQ ID NO: 620577 - RNA, 64 nt, Homo Sapiens
gcaugguggacaguaaugcuagcaccuggucuguucgcugcagggcccauaggcaucacucuuc

SEQ ID NO: 620578 - RNA, 64 nt, Homo Sapiens
cagcacugauuccgaccaggggugagaucggcuuucgcugcaccgcugaacacccugcggagcg

SEQ ID NO: 620579 - RNA, 64 nt, Homo Sapiens
gucagccaaagcuggccccuugucuaacuagucuucgcugcagcugccucccaguucuuccaag

SEQ ID NO: 620580 - RNA, 64 nt, Homo Sapiens
gccgggcccagcgcgcccuggcccucccaccggcucgcugcagaaccgccugggccacagcuag

SEQ ID NO: 620581 - RNA, 64 nt, Homo Sapiens
auuaaguuacaauuaucuucgaaaaauggauguuucgcugcaggcugugcaagaaaagaacaag

SEQ ID NO: 620582 - RNA, 64 nt, Homo Sapiens
uggccugagcauccagaccuuccugccagcuggaucgcugcacaggggagugagacaggcuggg

SEQ ID NO: 620583 - RNA, 64 nt, Homo Sapiens
ugggguucccugcuuuuuggaaacuggggaauacucgcugcagcugcauccacaaguuaguagc

SEQ ID NO: 620584 - RNA, 64 nt, Homo Sapiens
aauacuccgcaagagaggccgcccucccagucccucgcugcacaaacaucugagaaccuccucg

SEQ ID NO: 620585 - RNA, 64 nt, Homo Sapiens
cucagggacugagccccaagacgccucuguaaccucgcugcagcuucaguaguaaacugggucc

SEQ ID NO: 620586 - RNA, 64 nt, Homo Sapiens
cacccaggcuggagugcaguggcaugaucucaggucgcugcaaccucugccuccaggguucaag

SEQ ID NO: 620587 - RNA, 64 nt, Homo Sapiens
cucugccuccuggguucaagggcacaaucucagcucgcugcaaccguccaggcuggagugcagu

SEQ ID NO: 620588 - RNA, 64 nt, Homo Sapiens
ccugguuuuauugcuccuucuuaagccaggaccuucgcugcaaacguguaaccagcgggguaag

SEQ ID NO: 620589 - RNA, 64 nt, Homo Sapiens
gcugucccuugcccagggcacuugcauuccagccucgcugcauuugcucucucgauuccccuuu

SEQ ID NO: 620590 - RNA, 64 nt, Homo Sapiens
caccaagaacagggcccaggggagucaggccuauucgcugcacuuccugccaaacuuugccccc

SEQ ID NO: 620591 - RNA, 64 nt, Homo Sapiens
ccuccaugaccuaccucuauccacccugcagcccucgcugcagugcucuuugaguaucaccgau

SEQ ID NO: 620592 - RNA, 64 nt, Homo Sapiens
aucugauaccagacauccacgagcaaaacugcugucgcugcaguugccaggccucugcucugaa

SEQ ID NO: 620593 - RNA, 64 nt, Homo Sapiens
cacaucucuggcucuccaggaggcccuucggggcucgcugcacaggcugcuuccugccuaaagc

SEQ ID NO: 620594 - RNA, 64 nt, Homo Sapiens
uaccccucccauugcaaagcugucucugggacccucgcugcaccuuuccuuuaaagaggauuuc

SEQ ID NO: 620595 - RNA, 64 nt, Homo Sapiens
uguuuguuuuguuuuguuuuuuugagacggugucucgcugcaucacccaggcuggagugcagug

SEQ ID NO: 620596 - RNA, 64 nt, Homo Sapiens
cucugacucccugguucaaaggcgcagucucggcucgcugcaacucgccaggcuggagugcagu

SEQ ID NO: 620597 - RNA, 64 nt, Homo Sapiens
ccagccugggcgacaagagcgcaguaagcugagaucgcugcacugaaccugggagguggagguu

SEQ ID NO: 620598 - RNA, 64 nt, Homo Sapiens
cucauguauuauuauuauuuuugagauggaguuuugcucuuaaugauauuauuauuauuugaga

SEQ ID NO: 620599 - RNA, 64 nt, Homo Sapiens
cuuaaugauauuauuauuauuugagacagaguuuugcucuuauugcccaggcuggagugcagug

SEQ ID NO: 620600 - RNA, 64 nt, Homo Sapiens
aaucuugguuugguacaguuuuuuuguaccauauugcucuuaaaaaauugucugucugcucuua

SEQ ID NO: 620601 - RNA, 64 nt, Homo Sapiens
uuuguaccauauugcucuuaccaaauugucugucugcucuuauuuguugaaugccugucccagu

SEQ ID NO: 620602 - RNA, 64 nt, Homo Sapiens
cugucuggcauuacaauugcauugauacaugcauugcucuuauucucuuugccucucaauuguc

SEQ ID NO: 620603 - RNA, 64 nt, Homo Sapiens
gauuuacagacugaugccagcacuuuuguuauuaugcucuuaauucaugaaaaccugaagaguu

SEQ ID NO: 620604 - RNA, 64 nt, Homo Sapiens
cgaguggauggauagucugcuuguuuuuaguuuuugcucuuaacaaacacugcugcagucagca

SEQ ID NO: 620605 - RNA, 64 nt, Homo Sapiens
cauaacaaauacucagcaaaugugaaacuuuauuugcucuuacuucaaaauuaguccaaaaugu

SEQ ID NO: 620606 - RNA, 64 nt, Homo Sapiens
uucuguugaacaccccucuuagggauguuucuuuugcucuuauuuccugcaucuuuccuuaagg

SEQ ID NO: 620607 - RNA, 64 nt, Homo Sapiens
uggguuucuaugauugaccuugagguuuacuccuugcucuuacaacauuucuaaggauuuuuaa

SEQ ID NO: 620608 - RNA, 64 nt, Homo Sapiens
uucucggcuuuuuaaugacuuuucuuaaauguugugcucuuauggcaaucggcuuaaaauuccc

SEQ ID NO: 620609 - RNA, 64 nt, Homo Sapiens
auuuugaaaugggcucuugaaucuacauacuaaaugcucuuaucccagaaacugugcauuccag

SEQ ID NO: 620610 - RNA, 64 nt, Homo Sapiens
ugaaguaaauugauauaaccaaaggccugaauuaugcucuuauguguuuuuguuauuaaaugga

SEQ ID NO: 620611 - RNA, 64 nt, Homo Sapiens
aguuuuuaauaaguugauauugaauuauagacagugcucuuaauugauuggguuugaaagauuu

SEQ ID NO: 620612 - RNA, 64 nt, Homo Sapiens
guuuuuaaggaugguugugagccuggccgugguuugcucuuaauuuacaggugugagccaccau

SEQ ID NO: 620613 - RNA, 64 nt, Homo Sapiens
guuuucuuuguuuuguuuuguucucuaaaagguuugcucuuaauaaaagaaaucuuaaguagaa

SEQ ID NO: 620614 - RNA, 64 nt, Homo Sapiens
cuggugagaagaaccuuacuucuguuaucccaagugcucuuauuuuugggugaggggacccuac

SEQ ID NO: 620615 - RNA, 64 nt, Homo Sapiens
ugggcaagggugcuuuccuuaaacuuaguucauaugcucuuacuaccuccuacuaccaccacac

SEQ ID NO: 620616 - RNA, 64 nt, Homo Sapiens; identical to SEQ ID NO: 164072

SEQ ID NO: 620617 - RNA, 64 nt, Homo Sapiens; identical to SEQ ID NO: 164073

SEQ ID NO: 620618 - RNA, 64 nt, Homo Sapiens; identical to SEQ ID NO: 164074

SEQ ID NO: 620619 - RNA, 64 nt, Homo Sapiens; identical to SEQ ID NO: 164075

SEQ ID NO: 620620 - RNA, 64 nt, Homo Sapiens; identical to SEQ ID NO: 164076

SEQ ID NO: 620621 - RNA, 64 nt, Homo Sapiens; identical to SEQ ID NO: 164077

SEQ ID NO: 620622 - RNA, 64 nt, Homo Sapiens; identical to SEQ ID NO: 164078

SEQ ID NO: 620623 - RNA, 64 nt, Homo Sapiens; identical to SEQ ID NO: 164079

SEQ ID NO: 620624 - RNA, 64 nt, Homo Sapiens; identical to SEQ ID NO: 164080

SEQ ID NO: 620625 - RNA, 64 nt, Homo Sapiens; identical to SEQ ID NO: 164081

SEQ ID NO: 620626 - RNA, 64 nt, Homo Sapiens; identical to SEQ ID NO: 164082

SEQ ID NO: 620627 - RNA, 64 nt, Homo Sapiens; identical to SEQ ID NO: 164083

SEQ ID NO: 620628 - RNA, 64 nt, Homo Sapiens; identical to SEQ ID NO: 164084

SEQ ID NO: 620629 - RNA, 64 nt, Homo Sapiens; identical to SEQ ID NO: 164085

SEQ ID NO: 620630 - RNA, 64 nt, Homo Sapiens; identical to SEQ ID NO: 164080

SEQ ID NO: 620631 - RNA, 64 nt, Homo Sapiens; identical to SEQ ID NO: 164081

SEQ ID NO: 620632 - RNA, 64 nt, Homo Sapiens; identical to SEQ ID NO: 164088

SEQ ID NO: 620633 - RNA, 64 nt, Homo Sapiens; identical to SEQ ID NO: 164089

SEQ ID NO: 620634 - RNA, 64 nt, Homo Sapiens; identical to SEQ ID NO: 164090

SEQ ID NO: 620635 - RNA, 64 nt, Homo Sapiens; identical to SEQ ID NO: 164091

SEQ ID NO: 620636 - RNA, 64 nt, Homo Sapiens; identical to SEQ ID NO: 164092

SEQ ID NO: 620637 - RNA, 64 nt, Homo Sapiens; identical to SEQ ID NO: 164093

SEQ ID NO: 620638 - RNA, 64 nt, Homo Sapiens; identical to SEQ ID NO: 164094

SEQ ID NO: 620639 - RNA, 64 nt, Homo Sapiens; identical to SEQ ID NO: 164095

SEQ ID NO: 620640 - RNA, 64 nt, Homo Sapiens; identical to SEQ ID NO: 164096

SEQ ID NO: 620641 - RNA, 64 nt, Homo Sapiens; identical to SEQ ID NO: 164097

SEQ ID NO: 620642 - RNA, 64 nt, Homo Sapiens; identical to SEQ ID NO: 164098

SEQ ID NO: 620643 - RNA, 64 nt, Homo Sapiens; identical to SEQ ID NO: 164099

SEQ ID NO: 620644 - RNA, 64 nt, Homo Sapiens; identical to SEQ ID NO: 164100

SEQ ID NO: 620645 - RNA, 64 nt, Homo Sapiens; identical to SEQ ID NO: 164101

SEQ ID NO: 620646 - RNA, 64 nt, Homo Sapiens; identical to SEQ ID NO: 247936

SEQ ID NO: 620647 - RNA, 64 nt, Homo Sapiens; identical to SEQ ID NO: 247937

SEQ ID NO: 620648 - RNA, 64 nt, Homo Sapiens; identical to SEQ ID NO: 247938

SEQ ID NO: 620649 - RNA, 64 nt, Homo Sapiens; identical to SEQ ID NO: 247939

SEQ ID NO: 620650 - RNA, 64 nt, Homo Sapiens; identical to SEQ ID NO: 247940

SEQ ID NO: 620651 - RNA, 64 nt, Homo Sapiens; identical to SEQ ID NO: 247941

SEQ ID NO: 620652 - RNA, 64 nt, Homo Sapiens; identical to SEQ ID NO: 247942

SEQ ID NO: 620653 - RNA, 64 nt, Homo Sapiens; identical to SEQ ID NO: 247943

SEQ ID NO: 620654 - RNA, 64 nt, Homo Sapiens; identical to SEQ ID NO: 247944

SEQ ID NO: 620655 - RNA, 64 nt, Homo Sapiens; identical to SEQ ID NO: 247945

SEQ ID NO: 620656 - RNA, 64 nt, Homo Sapiens; identical to SEQ ID NO: 247946

SEQ ID NO: 620657 - RNA, 64 nt, Homo Sapiens; identical to SEQ ID NO: 247947

SEQ ID NO: 620658 - RNA, 64 nt, Homo Sapiens; identical to SEQ ID NO: 247948

SEQ ID NO: 620659 - RNA, 64 nt, Homo Sapiens; identical to SEQ ID NO: 247949

SEQ ID NO: 620660 - RNA, 64 nt, Homo Sapiens; identical to SEQ ID NO: 247950

SEQ ID NO: 620661 - RNA, 64 nt, Homo Sapiens; identical to SEQ ID NO: 247951

SEQ ID NO: 620662 - RNA, 64 nt, Homo Sapiens; identical to SEQ ID NO: 247952

SEQ ID NO: 620663 - RNA, 64 nt, Homo Sapiens; identical to SEQ ID NO: 247953

SEQ ID NO: 620664 - RNA, 64 nt, Homo Sapiens; identical to SEQ ID NO: 247954

SEQ ID NO: 620665 - RNA, 64 nt, Homo Sapiens; identical to SEQ ID NO: 247955

SEQ ID NO: 620666 - RNA, 64 nt, Homo Sapiens; identical to SEQ ID NO: 247956

SEQ ID NO: 620667 - RNA, 64 nt, Homo Sapiens; identical to SEQ ID NO: 247957

SEQ ID NO: 620668 - RNA, 64 nt, Homo Sapiens; identical to SEQ ID NO: 247958

SEQ ID NO: 620669 - RNA, 64 nt, Homo Sapiens; identical to SEQ ID NO: 247959

SEQ ID NO: 620670 - RNA, 64 nt, Homo Sapiens; identical to SEQ ID NO: 247960

SEQ ID NO: 620671 - RNA, 64 nt, Homo Sapiens; identical to SEQ ID NO: 247961

SEQ ID NO: 620672 - RNA, 64 nt, Homo Sapiens; identical to SEQ ID NO: 247962

SEQ ID NO: 620673 - RNA, 64 nt, Homo Sapiens; identical to SEQ ID NO: 247963

SEQ ID NO: 620674 - RNA, 64 nt, Homo Sapiens; identical to SEQ ID NO: 247964

SEQ ID NO: 620675 - RNA, 64 nt, Homo Sapiens; identical to SEQ ID NO: 247965

SEQ ID NO: 620676 - RNA, 64 nt, Homo Sapiens; identical to SEQ ID NO: 247966

SEQ ID NO: 620677 - RNA, 64 nt, Homo Sapiens; identical to SEQ ID NO: 247967

SEQ ID NO: 620678 - RNA, 64 nt, Homo Sapiens; identical to SEQ ID NO: 247968

SEQ ID NO: 620679 - RNA, 64 nt, Homo Sapiens; identical to SEQ ID NO: 247969

SEQ ID NO: 620680 - RNA, 64 nt, Homo Sapiens; identical to SEQ ID NO: 247970

SEQ ID NO: 620681 - RNA, 64 nt, Homo Sapiens; identical to SEQ ID NO: 247971

SEQ ID NO: 620682 - RNA, 64 nt, Homo Sapiens; identical to SEQ ID NO: 247972

SEQ ID NO: 620683 - RNA, 64 nt, Homo Sapiens; identical to SEQ ID NO: 247973

SEQ ID NO: 620684 - RNA, 64 nt, Homo Sapiens; identical to SEQ ID NO: 247974

SEQ ID NO: 620685 - RNA, 64 nt, Homo Sapiens; identical to SEQ ID NO: 247975

SEQ ID NO: 620686 - RNA, 64 nt, Homo Sapiens; identical to SEQ ID NO: 247976

SEQ ID NO: 620687 - RNA, 64 nt, Homo Sapiens; identical to SEQ ID NO: 247977

SEQ ID NO: 620688 - RNA, 64 nt, Homo Sapiens; identical to SEQ ID NO: 247978

SEQ ID NO: 620689 - RNA, 64 nt, Homo Sapiens; identical to SEQ ID NO: 365331

SEQ ID NO: 620690 - RNA, 64 nt, Homo Sapiens; identical to SEQ ID NO: 365332

SEQ ID NO: 620691 - RNA, 64 nt, Homo Sapiens; identical to SEQ ID NO: 365333

SEQ ID NO: 620692 - RNA, 64 nt, Homo Sapiens; identical to SEQ ID NO: 365334

SEQ ID NO: 620693 - RNA, 64 nt, Homo Sapiens; identical to SEQ ID NO: 365335

SEQ ID NO: 620694 - RNA, 64 nt, Homo Sapiens; identical to SEQ ID NO: 365336

SEQ ID NO: 620695 - RNA, 64 nt, Homo Sapiens; identical to SEQ ID NO: 365337

SEQ ID NO: 620696 - RNA, 64 nt, Homo Sapiens; identical to SEQ ID NO: 365338

SEQ ID NO: 620697 - RNA, 64 nt, Homo Sapiens; identical to SEQ ID NO: 365339

SEQ ID NO: 620698 - RNA, 64 nt, Homo Sapiens; identical to SEQ ID NO: 365340

SEQ ID NO: 620699 - RNA, 64 nt, Homo Sapiens; identical to SEQ ID NO: 365341

SEQ ID NO: 620700 - RNA, 64 nt, Homo Sapiens; identical to SEQ ID NO: 365342

SEQ ID NO: 620701 - RNA, 64 nt, Homo Sapiens; identical to SEQ ID NO: 365343

SEQ ID NO: 620702 - RNA, 64 nt, Homo Sapiens; identical to SEQ ID NO: 365344

SEQ ID NO: 620703 - RNA, 64 nt, Homo Sapiens; identical to SEQ ID NO: 365345

SEQ ID NO: 620704 - RNA, 64 nt, Homo Sapiens; identical to SEQ ID NO: 365346

SEQ ID NO: 620705 - RNA, 64 nt, Homo Sapiens; identical to SEQ ID NO: 365347

SEQ ID NO: 620706 - RNA, 64 nt, Homo Sapiens; identical to SEQ ID NO: 365348

SEQ ID NO: 620707 - RNA, 64 nt, Homo Sapiens; identical to SEQ ID NO: 365349

SEQ ID NO: 620708 - RNA, 64 nt, Homo Sapiens; identical to SEQ ID NO: 365350

SEQ ID NO: 620709 - RNA, 64 nt, Homo Sapiens; identical to SEQ ID NO: 365351

SEQ ID NO: 620710 - RNA, 64 nt, Homo Sapiens; identical to SEQ ID NO: 365352

SEQ ID NO: 620711 - RNA, 64 nt, Homo Sapiens; identical to SEQ ID NO: 365353

SEQ ID NO: 620712 - RNA, 64 nt, Homo Sapiens; identical to SEQ ID NO: 365354

SEQ ID NO: 620713 - RNA, 64 nt, Homo Sapiens; identical to SEQ ID NO: 365355

SEQ ID NO: 620714 - RNA, 64 nt, Homo Sapiens; identical to SEQ ID NO: 365356

SEQ ID NO: 620715 - RNA, 64 nt, Homo Sapiens; identical to SEQ ID NO: 365357

SEQ ID NO: 620716 - RNA, 64 nt, Homo Sapiens; identical to SEQ ID NO: 365358

SEQ ID NO: 620717 - RNA, 64 nt, Homo Sapiens; identical to SEQ ID NO: 365359

SEQ ID NO: 620718 - RNA, 64 nt, Homo Sapiens; identical to SEQ ID NO: 365360

SEQ ID NO: 620719 - RNA, 64 nt, Homo Sapiens; identical to SEQ ID NO: 365361

SEQ ID NO: 620720 - RNA, 63 nt, Homo Sapiens; identical to SEQ ID NO: 365362

SEQ ID NO: 620721 - RNA, 64 nt, Homo Sapiens; identical to SEQ ID NO: 365363

SEQ ID NO: 620722 - RNA, 64 nt, Homo Sapiens; identical to SEQ ID NO: 365364

SEQ ID NO: 620723 - RNA, 64 nt, Homo Sapiens; identical to SEQ ID NO: 365365

SEQ ID NO: 620724 - RNA, 64 nt, Homo Sapiens; identical to SEQ ID NO: 365366

SEQ ID NO: 620725 - RNA, 64 nt, Homo Sapiens; identical to SEQ ID NO: 365367

SEQ ID NO: 620726 - RNA, 64 nt, Homo Sapiens; identical to SEQ ID NO: 365368

SEQ ID NO: 620727 - RNA, 64 nt, Homo Sapiens; identical to SEQ ID NO: 365369

SEQ ID NO: 620728 - RNA, 64 nt, Homo Sapiens; identical to SEQ ID NO: 365370

SEQ ID NO: 620729 - RNA, 64 nt, Homo Sapiens; identical to SEQ ID NO: 365371

SEQ ID NO: 620730 - RNA, 64 nt, Homo Sapiens; identical to SEQ ID NO: 365372

SEQ ID NO: 620731 - RNA, 64 nt, Homo Sapiens; identical to SEQ ID NO: 365373

SEQ ID NO: 620732 - RNA, 64 nt, Homo Sapiens; identical to SEQ ID NO: 365374

SEQ ID NO: 620733 - RNA, 64 nt, Homo Sapiens; identical to SEQ ID NO: 365375

SEQ ID NO: 620734 - RNA, 64 nt, Homo Sapiens; identical to SEQ ID NO: 365376

SEQ ID NO: 620735 - RNA, 64 nt, Homo Sapiens; identical to SEQ ID NO: 365377

SEQ ID NO: 620736 - RNA, 64 nt, Homo Sapiens; identical to SEQ ID NO: 365378

SEQ ID NO: 620737 - RNA, 64 nt, Homo Sapiens; identical to SEQ ID NO: 365379

SEQ ID NO: 620738 - RNA, 64 nt, Homo Sapiens; identical to SEQ ID NO: 365380

SEQ ID NO: 620739 - RNA, 64 nt, Homo Sapiens; identical to SEQ ID NO: 365381

SEQ ID NO: 620740 - RNA, 64 nt, Homo Sapiens; identical to SEQ ID NO: 365382

SEQ ID NO: 620741 - RNA, 64 nt, Homo Sapiens; identical to SEQ ID NO: 365383

SEQ ID NO: 620742 - RNA, 64 nt, Homo Sapiens; identical to SEQ ID NO: 365384

SEQ ID NO: 620743 - RNA, 64 nt, Homo Sapiens; identical to SEQ ID NO: 365385

SEQ ID NO: 620744 - RNA, 64 nt, Homo Sapiens; identical to SEQ ID NO: 365386

SEQ ID NO: 620745 - RNA, 64 nt, Homo Sapiens; identical to SEQ ID NO: 365387

SEQ ID NO: 620746 - RNA, 64 nt, Homo Sapiens; identical to SEQ ID NO: 365388

SEQ ID NO: 620747 - RNA, 64 nt, Homo Sapiens; identical to SEQ ID NO: 365389

SEQ ID NO: 620748 - RNA, 64 nt, Homo Sapiens; identical to SEQ ID NO: 365390

SEQ ID NO: 620749 - RNA, 64 nt, Homo Sapiens; identical to SEQ ID NO: 365391

SEQ ID NO: 620750 - RNA, 64 nt, Homo Sapiens; identical to SEQ ID NO: 365392

SEQ ID NO: 620751 - RNA, 64 nt, Homo Sapiens; identical to SEQ ID NO: 365393

SEQ ID NO: 620752 - RNA, 64 nt, Homo Sapiens; identical to SEQ ID NO: 365394

SEQ ID NO: 620753 - RNA, 64 nt, Homo Sapiens; identical to SEQ ID NO: 365395

SEQ ID NO: 620754 - RNA, 64 nt, Homo Sapiens; identical to SEQ ID NO: 365396

SEQ ID NO: 620755 - RNA, 64 nt, Homo Sapiens; identical to SEQ ID NO: 365397

SEQ ID NO: 620756 - RNA, 64 nt, Homo Sapiens; identical to SEQ ID NO: 365398

SEQ ID NO: 620757 - RNA, 64 nt, Homo Sapiens; identical to SEQ ID NO: 365399

SEQ ID NO: 620758 - RNA, 64 nt, Homo Sapiens; identical to SEQ ID NO: 365400

SEQ ID NO: 620759 - RNA, 64 nt, Homo Sapiens; identical to SEQ ID NO: 365401

SEQ ID NO: 620760 - RNA, 64 nt, Homo Sapiens; identical to SEQ ID NO: 365402

SEQ ID NO: 620761 - RNA, 64 nt, Homo Sapiens; identical to SEQ ID NO: 365403

SEQ ID NO: 620762 - RNA, 64 nt, Homo Sapiens; identical to SEQ ID NO: 365404

SEQ ID NO: 620763 - RNA, 64 nt, Homo Sapiens; identical to SEQ ID NO: 365405

SEQ ID NO: 620764 - RNA, 64 nt, Homo Sapiens; identical to SEQ ID NO: 365406

SEQ ID NO: 620765 - RNA, 64 nt, Homo Sapiens; identical to SEQ ID NO: 365407

SEQ ID NO: 620766 - RNA, 64 nt, Homo Sapiens; identical to SEQ ID NO: 365408

SEQ ID NO: 620767 - RNA, 64 nt, Homo Sapiens; identical to SEQ ID NO: 365409

SEQ ID NO: 620768 - RNA, 64 nt, Homo Sapiens; identical to SEQ ID NO: 365410

SEQ ID NO: 620769 - RNA, 64 nt, Homo Sapiens; identical to SEQ ID NO: 365411

SEQ ID NO: 620770 - RNA, 64 nt, Homo Sapiens; identical to SEQ ID NO: 365412

SEQ ID NO: 620771 - RNA, 64 nt, Homo Sapiens; identical to SEQ ID NO: 365413

SEQ ID NO: 620772 - RNA, 64 nt, Homo Sapiens; identical to SEQ ID NO: 365414

SEQ ID NO: 620773 - RNA, 64 nt, Homo Sapiens; identical to SEQ ID NO: 365415

SEQ ID NO: 620774 - RNA, 64 nt, Homo Sapiens; identical to SEQ ID NO: 365416

SEQ ID NO: 620775 - RNA, 64 nt, Homo Sapiens; identical to SEQ ID NO: 365417

SEQ ID NO: 620776 - RNA, 64 nt, Homo Sapiens; identical to SEQ ID NO: 365418

SEQ ID NO: 620777 - RNA, 63 nt, Homo Sapiens
cccagaugcgcuuuaauuuuuuuuaauauguuuugaucacagaacuucuagaauaacccagau

SEQ ID NO: 620778 - RNA, 63 nt, Homo Sapiens
ccagaugcucuuucauauucuuuuaauacaucuugaucacagcugggggaaaaaaagcuuuuu

SEQ ID NO: 620779 - RNA, 63 nt, Homo Sapiens
ggccccucagagccaggugcuggccagaugccuugaucacagccuccauggccaggggccugu

SEQ ID NO: 620780 - RNA, 63 nt, Homo Sapiens
guggcucuggggccaaccgaccacaggugucacugaucacaggugucaccguaguggcuacca

SEQ ID NO: 620781 - RNA, 63 nt, Homo Sapiens
guauaagcuacuuagaacuuuuuuuaaaaaacaugaucacacuauaccugaaggcuggucgac

SEQ ID NO: 620782 - RNA, 63 nt, Homo Sapiens
agccgaagcaccagugcccaguaccugagguauugaucacagccccccaucaaaaugccacug

SEQ ID NO: 620783 - RNA, 63 nt, Homo Sapiens
augcuggaaagagcaaaagaauaucauuggcccugaucacauagaugcugcgccgccuagcaa

SEQ ID NO: 620784 - RNA, 63 nt, Homo Sapiens
aucaaaaugcagaaaauguguggugcacuaagaugaucacacagcauuaaaacuaaaaaaaaa

SEQ ID NO: 620785 - RNA, 63 nt, Homo Sapiens
ucauuuacauaacagugauaaaagcuuuaaguuugaucacauccaauuaaucacauuuuuuaa

SEQ ID NO: 620786 - RNA, 63 nt, Homo Sapiens
uugaguccaggaguucaaggcugcagugaguugugaucacaccauugcaguccagccagguug

SEQ ID NO: 620787 - RNA, 63 nt, Homo Sapiens; identical to SEQ ID NO: 450730

SEQ ID NO: 620788 - RNA, 63 nt, Homo Sapiens; identical to SEQ ID NO: 450731

SEQ ID NO: 620789 - RNA, 63 nt, Homo Sapiens; identical to SEQ ID NO: 450732

SEQ ID NO: 620790 - RNA, 63 nt, Homo Sapiens; identical to SEQ ID NO: 450733

SEQ ID NO: 620791 - RNA, 63 nt, Homo Sapiens; identical to SEQ ID NO: 450734

SEQ ID NO: 620792 - RNA, 63 nt, Homo Sapiens; identical to SEQ ID NO: 450735

SEQ ID NO: 620793 - RNA, 63 nt, Homo Sapiens; identical to SEQ ID NO: 450736

SEQ ID NO: 620794 - RNA, 63 nt, Homo Sapiens; identical to SEQ ID NO: 450737

SEQ ID NO: 620795 - RNA, 63 nt, Homo Sapiens; identical to SEQ ID NO: 450738

SEQ ID NO: 620796 - RNA, 63 nt, Homo Sapiens; identical to SEQ ID NO: 450739

SEQ ID NO: 620797 - RNA, 63 nt, Homo Sapiens; identical to SEQ ID NO: 450740

SEQ ID NO: 620798 - RNA, 63 nt, Homo Sapiens; identical to SEQ ID NO: 450741

SEQ ID NO: 620799 - RNA, 63 nt, Homo Sapiens; identical to SEQ ID NO: 450742

SEQ ID NO: 620800 - RNA, 63 nt, Homo Sapiens; identical to SEQ ID NO: 450743

SEQ ID NO: 620801 - RNA, 63 nt, Homo Sapiens; identical to SEQ ID NO: 450744

SEQ ID NO: 620802 - RNA, 63 nt, Homo Sapiens; identical to SEQ ID NO: 450745

SEQ ID NO: 620803 - RNA, 63 nt, Homo Sapiens; identical to SEQ ID NO: 450746

SEQ ID NO: 620804 - RNA, 63 nt, Homo Sapiens; identical to SEQ ID NO: 450747

SEQ ID NO: 620805 - RNA, 63 nt, Homo Sapiens; identical to SEQ ID NO: 450748

SEQ ID NO: 620806 - RNA, 63 nt, Homo Sapiens; identical to SEQ ID NO: 450749

SEQ ID NO: 620807 - RNA, 63 nt, Homo Sapiens; identical to SEQ ID NO: 450750

SEQ ID NO: 620808 - RNA, 63 nt, Homo Sapiens; identical to SEQ ID NO: 450751

SEQ ID NO: 620809 - RNA, 63 nt, Homo Sapiens; identical to SEQ ID NO: 450752

SEQ ID NO: 620810 - RNA, 63 nt, Homo Sapiens; identical to SEQ ID NO: 450753

SEQ ID NO: 620811 - RNA, 63 nt, Homo Sapiens; identical to SEQ ID NO: 450754

SEQ ID NO: 620812 - RNA, 63 nt, Homo Sapiens; identical to SEQ ID NO: 450755

SEQ ID NO: 620813 - RNA, 63 nt, Homo Sapiens; identical to SEQ ID NO: 450756

SEQ ID NO: 620814 - RNA, 63 nt, Homo Sapiens; identical to SEQ ID NO: 450757

SEQ ID NO: 620815 - RNA, 63 nt, Homo Sapiens; identical to SEQ ID NO: 450758

SEQ ID NO: 620816 - RNA, 63 nt, Homo Sapiens; identical to SEQ ID NO: 450759

SEQ ID NO: 620817 - RNA, 63 nt, Homo Sapiens; identical to SEQ ID NO: 450760

SEQ ID NO: 620818 - RNA, 63 nt, Homo Sapiens; identical to SEQ ID NO: 450761

SEQ ID NO: 620819 - RNA, 63 nt, Homo Sapiens; identical to SEQ ID NO: 450762

SEQ ID NO: 620820 - RNA, 63 nt, Homo Sapiens; identical to SEQ ID NO: 450763

SEQ ID NO: 620821 - RNA, 63 nt, Homo Sapiens; identical to SEQ ID NO: 450764

SEQ ID NO: 620822 - RNA, 63 nt, Homo Sapiens; identical to SEQ ID NO: 450765

SEQ ID NO: 620823 - RNA, 63 nt, Homo Sapiens; identical to SEQ ID NO: 450766

SEQ ID NO: 620824 - RNA, 63 nt, Homo Sapiens; identical to SEQ ID NO: 450765

SEQ ID NO: 620825 - RNA, 63 nt, Homo Sapiens; identical to SEQ ID NO: 450766

SEQ ID NO: 620826 - RNA, 63 nt, Homo Sapiens; identical to SEQ ID NO: 450769

SEQ ID NO: 620827 - RNA, 63 nt, Homo Sapiens; identical to SEQ ID NO: 450770

SEQ ID NO: 620828 - RNA, 63 nt, Homo Sapiens; identical to SEQ ID NO: 450771

SEQ ID NO: 620829 - RNA, 63 nt, Homo Sapiens; identical to SEQ ID NO: 450772

SEQ ID NO: 620830 - RNA, 63 nt, Homo Sapiens; identical to SEQ ID NO: 450773

SEQ ID NO: 620831 - RNA, 63 nt, Homo Sapiens; identical to SEQ ID NO: 450774

SEQ ID NO: 620832 - RNA, 63 nt, Homo Sapiens; identical to SEQ ID NO: 450775

SEQ ID NO: 620833 - RNA, 63 nt, Homo Sapiens; identical to SEQ ID NO: 450776

SEQ ID NO: 620834 - RNA, 63 nt, Homo Sapiens; identical to SEQ ID NO: 450777

SEQ ID NO: 620835 - RNA, 63 nt, Homo Sapiens; identical to SEQ ID NO: 450778

SEQ ID NO: 620836 - RNA, 63 nt, Homo Sapiens; identical to SEQ ID NO: 450779

SEQ ID NO: 620837 - RNA, 63 nt, Homo Sapiens; identical to SEQ ID NO: 450780

SEQ ID NO: 620838 - RNA, 63 nt, Homo Sapiens; identical to SEQ ID NO: 450781

SEQ ID NO: 620839 - RNA, 63 nt, Homo Sapiens; identical to SEQ ID NO: 450782

SEQ ID NO: 620840 - RNA, 63 nt, Homo Sapiens; identical to SEQ ID NO: 450783

SEQ ID NO: 620841 - RNA, 63 nt, Homo Sapiens; identical to SEQ ID NO: 450784

SEQ ID NO: 620842 - RNA, 63 nt, Homo Sapiens; identical to SEQ ID NO: 450785

SEQ ID NO: 620843 - RNA, 63 nt, Homo Sapiens; identical to SEQ ID NO: 450786

SEQ ID NO: 620844 - RNA, 63 nt, Homo Sapiens; identical to SEQ ID NO: 450787

SEQ ID NO: 620845 - RNA, 63 nt, Homo Sapiens; identical to SEQ ID NO: 450788

SEQ ID NO: 620846 - RNA, 63 nt, Homo Sapiens; identical to SEQ ID NO: 450789

SEQ ID NO: 620847 - RNA, 63 nt, Homo Sapiens; identical to SEQ ID NO: 450790

SEQ ID NO: 620848 - RNA, 63 nt, Homo Sapiens; identical to SEQ ID NO: 450791

SEQ ID NO: 620849 - RNA, 63 nt, Homo Sapiens; identical to SEQ ID NO: 450792

SEQ ID NO: 620850 - RNA, 63 nt, Homo Sapiens; identical to SEQ ID NO: 450793

SEQ ID NO: 620851 - RNA, 63 nt, Homo Sapiens; identical to SEQ ID NO: 450794

SEQ ID NO: 620852 - RNA, 63 nt, Homo Sapiens; identical to SEQ ID NO: 450795

SEQ ID NO: 620853 - RNA, 63 nt, Homo Sapiens; identical to SEQ ID NO: 450796

SEQ ID NO: 620854 - RNA, 63 nt, Homo Sapiens; identical to SEQ ID NO: 450797

SEQ ID NO: 620855 - RNA, 63 nt, Homo Sapiens; identical to SEQ ID NO: 450798

SEQ ID NO: 620856 - RNA, 63 nt, Homo Sapiens; identical to SEQ ID NO: 450799

SEQ ID NO: 620857 - RNA, 63 nt, Homo Sapiens; identical to SEQ ID NO: 450800

SEQ ID NO: 620858 - RNA, 63 nt, Homo Sapiens; identical to SEQ ID NO: 450801

SEQ ID NO: 620859 - RNA, 63 nt, Homo Sapiens; identical to SEQ ID NO: 450802

SEQ ID NO: 620860 - RNA, 63 nt, Homo Sapiens; identical to SEQ ID NO: 450803

SEQ ID NO: 620861 - RNA, 63 nt, Homo Sapiens; identical to SEQ ID NO: 450804

SEQ ID NO: 620862 - RNA, 63 nt, Homo Sapiens; identical to SEQ ID NO: 450805

SEQ ID NO: 620863 - RNA, 63 nt, Homo Sapiens; identical to SEQ ID NO: 450806

SEQ ID NO: 620864 - RNA, 63 nt, Homo Sapiens; identical to SEQ ID NO: 450807

SEQ ID NO: 620865 - RNA, 63 nt, Homo Sapiens; identical to SEQ ID NO: 450808

SEQ ID NO: 620866 - RNA, 63 nt, Homo Sapiens; identical to SEQ ID NO: 450809

SEQ ID NO: 620867 - RNA, 63 nt, Homo Sapiens; identical to SEQ ID NO: 450810

SEQ ID NO: 620868 - RNA, 63 nt, Homo Sapiens; identical to SEQ ID NO: 450811

SEQ ID NO: 620869 - RNA, 63 nt, Homo Sapiens; identical to SEQ ID NO: 450812

SEQ ID NO: 620870 - RNA, 63 nt, Homo Sapiens; identical to SEQ ID NO: 450813

SEQ ID NO: 620871 - RNA, 63 nt, Homo Sapiens; identical to SEQ ID NO: 450814

SEQ ID NO: 620872 - RNA, 63 nt, Homo Sapiens; identical to SEQ ID NO: 450815

SEQ ID NO: 620873 - RNA, 63 nt, Homo Sapiens; identical to SEQ ID NO: 450816

SEQ ID NO: 620874 - RNA, 63 nt, Homo Sapiens; identical to SEQ ID NO: 450817

SEQ ID NO: 620875 - RNA, 63 nt, Homo Sapiens; identical to SEQ ID NO: 450818

SEQ ID NO: 620876 - RNA, 63 nt, Homo Sapiens; identical to SEQ ID NO: 450819

SEQ ID NO: 620877 - RNA, 63 nt, Homo Sapiens; identical to SEQ ID NO: 450820

SEQ ID NO: 620878 - RNA, 63 nt, Homo Sapiens; identical to SEQ ID NO: 450821

SEQ ID NO: 620879 - RNA, 63 nt, Homo Sapiens; identical to SEQ ID NO: 450822

SEQ ID NO: 620880 - RNA, 63 nt, Homo Sapiens; identical to SEQ ID NO: 450823

SEQ ID NO: 620881 - RNA, 63 nt, Homo Sapiens; identical to SEQ ID NO: 450824

SEQ ID NO: 620882 - RNA, 63 nt, Homo Sapiens; identical to SEQ ID NO: 450825

SEQ ID NO: 620883 - RNA, 63 nt, Homo Sapiens; identical to SEQ ID NO: 450826

SEQ ID NO: 620884 - RNA, 63 nt, Homo Sapiens; identical to SEQ ID NO: 450827

SEQ ID NO: 620885 - RNA, 63 nt, Homo Sapiens; identical to SEQ ID NO: 450828

SEQ ID NO: 620886 - RNA, 63 nt, Homo Sapiens; identical to SEQ ID NO: 450829

SEQ ID NO: 620887 - RNA, 63 nt, Homo Sapiens; identical to SEQ ID NO: 450830

SEQ ID NO: 620888 - RNA, 63 nt, Homo Sapiens; identical to SEQ ID NO: 450831

SEQ ID NO: 620889 - RNA, 63 nt, Homo Sapiens; identical to SEQ ID NO: 450832

SEQ ID NO: 620890 - RNA, 63 nt, Homo Sapiens; identical to SEQ ID NO: 450833

SEQ ID NO: 620891 - RNA, 63 nt, Homo Sapiens; identical to SEQ ID NO: 450834

SEQ ID NO: 620892 - RNA, 63 nt, Homo Sapiens; identical to SEQ ID NO: 450835

SEQ ID NO: 620893 - RNA, 63 nt, Homo Sapiens; identical to SEQ ID NO: 450836

SEQ ID NO: 620894 - RNA, 63 nt, Homo Sapiens; identical to SEQ ID NO: 450837

SEQ ID NO: 620895 - RNA, 63 nt, Homo Sapiens; identical to SEQ ID NO: 450838

SEQ ID NO: 620896 - RNA, 63 nt, Homo Sapiens; identical to SEQ ID NO: 450839

SEQ ID NO: 620897 - RNA, 63 nt, Homo Sapiens; identical to SEQ ID NO: 450840

SEQ ID NO: 620898 - RNA, 63 nt, Homo Sapiens; identical to SEQ ID NO: 450841

SEQ ID NO: 620899 - RNA, 63 nt, Homo Sapiens; identical to SEQ ID NO: 450842

SEQ ID NO: 620900 - RNA, 63 nt, Homo Sapiens; identical to SEQ ID NO: 450843

SEQ ID NO: 620901 - RNA, 63 nt, Homo Sapiens; identical to SEQ ID NO: 450844

SEQ ID NO: 620902 - RNA, 63 nt, Homo Sapiens; identical to SEQ ID NO: 450845

SEQ ID NO: 620903 - RNA, 63 nt, Homo Sapiens; identical to SEQ ID NO: 450846

SEQ ID NO: 620904 - RNA, 63 nt, Homo Sapiens; identical to SEQ ID NO: 450847

SEQ ID NO: 620905 - RNA, 63 nt, Homo Sapiens; identical to SEQ ID NO: 450848

SEQ ID NO: 620906 - RNA, 63 nt, Homo Sapiens; identical to SEQ ID NO: 450849

SEQ ID NO: 620907 - RNA, 63 nt, Homo Sapiens; identical to SEQ ID NO: 450850

SEQ ID NO: 620908 - RNA, 63 nt, Homo Sapiens; identical to SEQ ID NO: 450851

SEQ ID NO: 620909 - RNA, 63 nt, Homo Sapiens; identical to SEQ ID NO: 450852

SEQ ID NO: 620910 - RNA, 51 nt, Homo Sapiens; identical to SEQ ID NO: 250138

SEQ ID NO: 620911 - RNA, 63 nt, Homo Sapiens; identical to SEQ ID NO: 450854

SEQ ID NO: 620912 - RNA, 63 nt, Homo Sapiens; identical to SEQ ID NO: 450855

SEQ ID NO: 620913 - RNA, 63 nt, Homo Sapiens; identical to SEQ ID NO: 450856

SEQ ID NO: 620914 - RNA, 63 nt, Homo Sapiens; identical to SEQ ID NO: 450857

SEQ ID NO: 620915 - RNA, 63 nt, Homo Sapiens; identical to SEQ ID NO: 450858

SEQ ID NO: 620916 - RNA, 63 nt, Homo Sapiens; identical to SEQ ID NO: 450859

SEQ ID NO: 620917 - RNA, 63 nt, Homo Sapiens; identical to SEQ ID NO: 450860

SEQ ID NO: 620918 - RNA, 63 nt, Homo Sapiens; identical to SEQ ID NO: 450861

SEQ ID NO: 620919 - RNA, 63 nt, Homo Sapiens; identical to SEQ ID NO: 450862

SEQ ID NO: 620920 - RNA, 63 nt, Homo Sapiens; identical to SEQ ID NO: 450863

SEQ ID NO: 620921 - RNA, 63 nt, Homo Sapiens; identical to SEQ ID NO: 450864

SEQ ID NO: 620922 - RNA, 63 nt, Homo Sapiens; identical to SEQ ID NO: 450865

SEQ ID NO: 620923 - RNA, 63 nt, Homo Sapiens; identical to SEQ ID NO: 450866

SEQ ID NO: 620924 - RNA, 64 nt, Homo Sapiens; identical to SEQ ID NO: 126265

SEQ ID NO: 620925 - RNA, 64 nt, Homo Sapiens; identical to SEQ ID NO: 126266

SEQ ID NO: 620926 - RNA, 64 nt, Homo Sapiens; identical to SEQ ID NO: 126267

SEQ ID NO: 620927 - RNA, 64 nt, Homo Sapiens; identical to SEQ ID NO: 126268

SEQ ID NO: 620928 - RNA, 64 nt, Homo Sapiens; identical to SEQ ID NO: 126269

SEQ ID NO: 620929 - RNA, 64 nt, Homo Sapiens; identical to SEQ ID NO: 126270

SEQ ID NO: 620930 - RNA, 64 nt, Homo Sapiens; identical to SEQ ID NO: 126271

SEQ ID NO: 620931 - RNA, 64 nt, Homo Sapiens; identical to SEQ ID NO: 126272

SEQ ID NO: 620932 - RNA, 64 nt, Homo Sapiens; identical to SEQ ID NO: 126273

SEQ ID NO: 620933 - RNA, 64 nt, Homo Sapiens; identical to SEQ ID NO: 126274

SEQ ID NO: 620934 - RNA, 64 nt, Homo Sapiens; identical to SEQ ID NO: 126275

SEQ ID NO: 620935 - RNA, 64 nt, Homo Sapiens; identical to SEQ ID NO: 126276

SEQ ID NO: 620936 - RNA, 64 nt, Homo Sapiens; identical to SEQ ID NO: 126277

SEQ ID NO: 620937 - RNA, 64 nt, Homo Sapiens; identical to SEQ ID NO: 126278

SEQ ID NO: 620938 - RNA, 64 nt, Homo Sapiens; identical to SEQ ID NO: 126279

SEQ ID NO: 620939 - RNA, 64 nt, Homo Sapiens; identical to SEQ ID NO: 126280

SEQ ID NO: 620940 - RNA, 63 nt, Homo Sapiens
cgugugcuagaagguucgaugccucuggaaugcaugugauacucaucuccauuuuguuuccuu

SEQ ID NO: 620941 - RNA, 63 nt, Homo Sapiens
aggacggugggaagccugagagagagugaaauuaugugauacacugaaaugacuuuuguuuuu

SEQ ID NO: 620942 - RNA, 63 nt, Homo Sapiens
ugugagaguugagcucauuuucuaguuggaagaaugugauauuuguuguguugguaguuuacc

SEQ ID NO: 620943 - RNA, 63 nt, Homo Sapiens
uauuuuuguuacguacuguuucuuugauaauugaugugauaaggaaaaaaguccuauuuuuau

SEQ ID NO: 620944 - RNA, 63 nt, Homo Sapiens
uuaagaaagugaacaguugcaacuauuuugcuuaugugauagauguuuugaaaaauguaguug

SEQ ID NO: 620945 - RNA, 63 nt, Homo Sapiens
cuugaguccagaaguuugagaucagccugggcaaugugauaaaaccccaucucuacaaaaagc

SEQ ID NO: 620946 - RNA, 51 nt, Homo Sapiens
aaaguacacaaguggaauaaaaugugauacaacauauacucacuauggaau

SEQ ID NO: 620947 - RNA, 63 nt, Homo Sapiens
auucucaaauaugaaaugggaccuaauaccaguaugugauaaauguugauguuuucuguguac

SEQ ID NO: 620948 - RNA, 63 nt, Homo Sapiens
acuuagcacaugugugcuugaggguggcugggaaugugauauacagcacccugauccuaacag

SEQ ID NO: 620949 - RNA, 63 nt, Homo Sapiens
ugucuugucuccacucugugaaacccacaggggaugugauaaacagggcuauuagggguauca

SEQ ID NO: 620950 - RNA, 63 nt, Homo Sapiens
ccaagaaagagcuuuaguuucuuggcaagaauaaugugauauuaguaaguaaaggucuuaaaa

SEQ ID NO: 620951 - RNA, 63 nt, Homo Sapiens
aaauaugaaggagagguuggggacacgcacccuaugugauaccaaguuuuauugucaagacag

SEQ ID NO: 620952 - RNA, 63 nt, Homo Sapiens
guuaucuuuuuuauuguguuguguuaugccuacaugugauauaaauuaauauuuauauucauu

SEQ ID NO: 620953 - RNA, 63 nt, Homo Sapiens
ugggggagugagcacugggucagcacaaggaggaugugauauggagagcuuagccccuggagg

SEQ ID NO: 620954 - RNA, 50 nt, Homo Sapiens
uaggcuuucauuccaguuugaugugauauuacaaaaaaccccgauuuuag

SEQ ID NO: 620955 - RNA, 63 nt, Homo Sapiens
uucaauugguuaaaugguuuuguauuuaucaacaugugauacaggcccuagggccugcuucua

SEQ ID NO: 620956 - RNA, 63 nt, Homo Sapiens
ggaauagugucaaugacacaaacauaaaacuuuaugugauauauccagugcaguauaaauugu

SEQ ID NO: 620957 - RNA, 63 nt, Homo Sapiens
auccaauuuuuauuauuuuagucuuuaauaaauaugugauaaauuuaugaacuauaaaugauu

SEQ ID NO: 620958 - RNA, 63 nt, Homo Sapiens
gccauaugucacuuaaggaugcaccagcuaacaaugugauacggagcgcaccagaauaagagc

SEQ ID NO: 620959 - RNA, 63 nt, Homo Sapiens
caguuguacaaagaaaaugcugccaguuuuuacaugugauaguuuaauugcauuuuaauuaau

SEQ ID NO: 620960 - RNA, 63 nt, Homo Sapiens
uuaaaauuauuuucaacuacaguacuaaugcucaugugauaauuucuagaucaauuuuuauaa

SEQ ID NO: 620961 - RNA, 51 nt, Homo Sapiens
agugacaugcugugcucaguuaugugauacaagauauucaccgauguuuaa

SEQ ID NO: 620962 - RNA, 63 nt, Homo Sapiens
aaaauaucuggguuuuucuuaugcaaaaaacuaaugugauauggauaagcauaaugaaaauag

SEQ ID NO: 620963 - RNA, 63 nt, Homo Sapiens
gccucuucaaucagauuguauuaauugaagaauaugugauacaccaacuggucuaagcagcau

SEQ ID NO: 620964 - RNA, 63 nt, Homo Sapiens
gaucagaacagcagagguucagucaaaacagagaugugauaagcuggcaacaacaaagccaac

SEQ ID NO: 620965 - RNA, 63 nt, Homo Sapiens
uacaaagcaauuggcccauugggcuuaagucauaugugauauuuuuuccuguuugcacucuga

SEQ ID NO: 620966 - RNA, 63 nt, Homo Sapiens
gauugccacauuaagguugacaguucacugcccaugugauacuaagccagacaccuaauucuu

SEQ ID NO: 620967 - RNA, 63 nt, Homo Sapiens
gauucccacauuaagguugacaguucacuacucaugugauacuaauccagacaccuaauucuu

SEQ ID NO: 620968 - RNA, 63 nt, Homo Sapiens
cuaaacaaccuuugcucugauaggagugugggaaugugauaacaauucuuguuuuguggguau

SEQ ID NO: 620969 - RNA, 62 nt, Homo Sapiens
ugacuuuugcuuuaaacugcgucuugaaaaagaugugauauuaaccugaaucaucuuuguga

SEQ ID NO: 620970 - RNA, 63 nt, Homo Sapiens
gccuguuugcaaagucacagauggugguuaggaaugugauacuccauaugauuucuagcugcc

SEQ ID NO: 620971 - RNA, 63 nt, Homo Sapiens
gcauauauaaaacaaaacaaacaaccugccacaaugugauauguguaauaucauuucauaaaa

SEQ ID NO: 620972 - RNA, 63 nt, Homo Sapiens
gauaaugugcuugagucccuauaaucuauagacaugugauagcaaaagaaacaaacaaaagcc

SEQ ID NO: 620973 - RNA, 63 nt, Homo Sapiens
uuuuaaaguugaaaagcaucccaguuaaacuagaugugauaguuaaaccagaugaaagcauga

SEQ ID NO: 620974 - RNA, 63 nt, Homo Sapiens
ggucugcaguagacacaauuggcugagcaggauaugugauacugugugguugguguggaguuu

SEQ ID NO: 620975 - RNA, 63 nt, Homo Sapiens
gucacagccuccucaaaggguugugaaaaucaaaugugauaauuuguggaaagcccuuagcag

SEQ ID NO: 620976 - RNA, 63 nt, Homo Sapiens
auugucuucauguacauuuggaacuaacacgugaugugauauauuccuaaacuaugaaaccuu

SEQ ID NO: 620977 - RNA, 63 nt, Homo Sapiens
guucaucaaugaaugaaugaauggcuaagcaaaaugugauauguaccuaacgaaguauccuuc

SEQ ID NO: 620978 - RNA, 63 nt, Homo Sapiens
uuggauggcuuaagcaccucagcauuccuuacuaugugauaaaauacauauagaauauaagau

SEQ ID NO: 620979 - RNA, 63 nt, Homo Sapiens
uugccugguuuguuaaaauuuauauucagguauaugugauauucucauggcuuggaguuaccu

SEQ ID NO: 620980 - RNA, 63 nt, Homo Sapiens
uuaagcuuauucuuuuucuugagagguuugguaaugugauauuggaaucucuuaaaacauaau

SEQ ID NO: 620981 - RNA, 63 nt, Homo Sapiens
aguagcauguugcugccagauauucacuuuacuaugugauagauccugccuuuguaguucugg

SEQ ID NO: 620982 - RNA, 63 nt, Homo Sapiens
uacaaaaugcagaacaguuucuucauauucaggaugugauauuauaguacaguuguauuuguc

SEQ ID NO: 620983 - RNA, 63 nt, Homo Sapiens
uuaggaagcugaauuauuagaacuauuaauuccaugugauacauuuaagguaaauuggucagg

SEQ ID NO: 620984 - RNA, 63 nt, Homo Sapiens
uucuuaugccauguuaauuugaaaauaucugaaaugugauaagaacaaaaacuuguuacuaaa

SEQ ID NO: 620985 - RNA, 63 nt, Homo Sapiens
uuuaagccacuggaaaaaccaugaacuguacacaugugauacaugaggcuggcagguacagag

SEQ ID NO: 620986 - RNA, 63 nt, Homo Sapiens
aaauuguagaaaccucuucuggcugguggguaaaugugauagugcauauauggcagaggugau

SEQ ID NO: 620987 - RNA, 63 nt, Homo Sapiens
ucuuuugugacuggcuucuuuauaucuggaaucaugugauaucaaccuacucuggacauuuca

SEQ ID NO: 620988 - RNA, 63 nt, Homo Sapiens
ugauuauuacuucuguuucuuacuauaaaaaucaugugauaacgcacaucauauucuauuguu

SEQ ID NO: 620989 - RNA, 63 nt, Homo Sapiens
augauaugcauuuauuuaaauaagauucacuauaugugauagugcaucuaaguaauaauuuuu

SEQ ID NO: 620990 - RNA, 63 nt, Homo Sapiens
gaucuugugguauauaugcaauuuauuuuuaauaugugauaauaauuaccuaacaaacagugu

SEQ ID NO: 620991 - RNA, 63 nt, Homo Sapiens
cuggguagucauggauuucugcuggacauuugaaugugauaaacaauccagcauuacuuagga

SEQ ID NO: 620992 - RNA, 63 nt, Homo Sapiens
aaguuauuuguuucagaaaauuauucuuuuuuuaugugauaaaucauaugauuuaagugcaug

SEQ ID NO: 620993 - RNA, 63 nt, Homo Sapiens
ugaacucuugugauuucacaagauucucuacuuaugugauaggaggguauggccaguuauuca

SEQ ID NO: 620994 - RNA, 63 nt, Homo Sapiens
gguucguauuuuaaaaaucuugcacaaauuguaaugugauacugugaaacaaauugaaaacau

SEQ ID NO: 620995 - RNA, 63 nt, Homo Sapiens
ugcugugcuaaauaucaaucaagccauguauaaaugugauaugauuggcaauauguguuuacu

SEQ ID NO: 620996 - RNA, 63 nt, Homo Sapiens
cacacugauaaauuauuaagauuaagauuauuuaugugauaaaugaaaucuccuaccaaucca

SEQ ID NO: 620997 - RNA, 63 nt, Homo Sapiens
uggcagggagagggaacgguccaugaaaucuuuaugugauauaaggauuuuaaguuugggcca

SEQ ID NO: 620998 - RNA, 63 nt, Homo Sapiens
auauuuauaucuugcauccuauaucaugucaauaugugauauagaaaagagauacgugaauuu

SEQ ID NO: 620999 - RNA, 63 nt, Homo Sapiens
aauuuucaacucagaagcacucaaaaaugcaaaaugugauaaugggcacuuguuuaaaagaau

SEQ ID NO: 621000 - RNA, 63 nt, Homo Sapiens
ucuauggcacuguuuuuuaucacaaauauguauaugugauauugauauauaacuauauauauu

SEQ ID NO: 621001 - RNA, 63 nt, Homo Sapiens
gccaagcuucguggaggaauguaggugacaucaaugugauaaagucuguguucugaguuguca

SEQ ID NO: 621002 - RNA, 63 nt, Homo Sapiens
uuccucaaggccaccuggccaggagcuucucugaugugauauccacuuuuuuuuuuuuugaga

SEQ ID NO: 621003 - RNA, 63 nt, Homo Sapiens
augugggagaaccuuacaaggcucuaaaaugagaugugauauggcuugaaaugggaggagaca

SEQ ID NO: 621004 - RNA, 63 nt, Homo Sapiens
augcuuuauuaauguuuucaaaagguauuauacaugugauacauuuuuuaagcuucaguugcu

SEQ ID NO: 621005 - RNA, 63 nt, Homo Sapiens
uacaaaugcuguaauauaaagcauaucaaguuuaugugauacguaucauugcaagagaauuug

SEQ ID NO: 621006 - RNA, 54 nt, Homo Sapiens
gauaaaguuaucuaacaaauacagaugugauagaaaguaauacuuugcuuguaa

SEQ ID NO: 621007 - RNA, 63 nt, Homo Sapiens
agggaguuugcaauaaauuacaagcgcacuagcaugugauauuaacauuccugagugaauucg

SEQ ID NO: 621008 - RNA, 63 nt, Homo Sapiens
gacaugauuucccaccugccucucuauagacaaaugugauaaucccacugcuaaccuuauaua

SEQ ID NO: 621009 - RNA, 63 nt, Homo Sapiens
gguacuauggcauauaugcaaaccagcaccaucaugugauaauaccaacaguauucaagaagc

SEQ ID NO: 621010 - RNA, 63 nt, Homo Sapiens
agcaaauuagaacauucuguauguagcaacuacaugugauaaauuaaaucauguuuuccuaaa

SEQ ID NO: 621011 - RNA, 63 nt, Homo Sapiens
gguggcauuauauaugauuacaguucugaauucaugugauaauuuuauuaaauauucagguaa

SEQ ID NO: 621012 - RNA, 63 nt, Homo Sapiens
ugugcaugcauuauauauuuggauaaagaauaaaugugauagcuacuuuaaaaauggcuuuaa

SEQ ID NO: 621013 - RNA, 63 nt, Homo Sapiens
gauggagauagugguccucaugaucuccguaugaugugauauuuugguugggagcaucuugua

SEQ ID NO: 621014 - RNA, 63 nt, Homo Sapiens
gguuuguagauucccuuagacuuugacuccuaaaugugauacuggaaugcugaagaauuaaca

SEQ ID NO: 621015 - RNA, 63 nt, Homo Sapiens
cagaagagaucauuguuuuuuguaucucauuugaugugauaccaagauugccuaguacaccuu

SEQ ID NO: 621016 - RNA, 50 nt, Homo Sapiens
cauagcuuccaugagaacagaugugauaccacauugacaaugaguuuuaa

SEQ ID NO: 621017 - RNA, 63 nt, Homo Sapiens
accugguugugaaaaaagacugauguuugaaauaugugauaguccuguugcuuccagccacug

SEQ ID NO: 621018 - RNA, 63 nt, Homo Sapiens
cugagcauuccuaaauaucugcuuagaaauaucaugugauaaagagggaccuucuuaauacac

SEQ ID NO: 621019 - RNA, 63 nt, Homo Sapiens
ugucuuaaauaauuuaaccauaaauuuucugucaugugauacuggaauaugggauacuuuuca

SEQ ID NO: 621020 - RNA, 63 nt, Homo Sapiens
cuuuaauuucaggaauugaauggguuugcuagaaugugauauuugaagcaucacauaaaaaug

SEQ ID NO: 621021 - RNA, 63 nt, Homo Sapiens
ucaagugggcuauuaaaaucuaacguugaguaaaugugauagugaugagaaaggaauuuugug

SEQ ID NO: 621022 - RNA, 63 nt, Homo Sapiens
cagaaguaaaaucugaugguucuaaaucaaucaaugugauaguucauuuuuaacucuuagaag

SEQ ID NO: 621023 - RNA, 63 nt, Homo Sapiens
aggacuaaaacuuuaaacuagaguugaugcuuaaugugauagagacaucucuaaaguauuuug

SEQ ID NO: 621024 - RNA, 63 nt, Homo Sapiens
aaaagaagcaugaauaauuuucuugccaccaucaugugauauguagacaagcauguucucucg

SEQ ID NO: 621025 - RNA, 63 nt, Homo Sapiens
aauuaagauuacuuuuguauguugucuuuuaguaugugauacuaauauuuuucagaaguuaua

SEQ ID NO: 621026 - RNA, 63 nt, Homo Sapiens
ucugagacugaaugcgggagcauaucuguccugaugugauaugucuucuggaaugaauacccu

SEQ ID NO: 621027 - RNA, 63 nt, Homo Sapiens
uaaauuauagaaaaagaaaauguugaaucaacaaugugauacgacugacaauauaaaggguuu

SEQ ID NO: 621028 - RNA, 63 nt, Homo Sapiens
uuuccccucuugaagaggcaacacuaaaacaauaugugauauaugacaauuuuuccuuuuucu

SEQ ID NO: 621029 - RNA, 63 nt, Homo Sapiens
agcagcuuaacaggcagggaccauccugucgugaugugauaggucaaaagagaaaaauaaugu

SEQ ID NO: 621030 - RNA, 63 nt, Homo Sapiens
augcauguaaauacauaacuaaaucaaauacacaugugauaauauacuaauguuuguuucuau

SEQ ID NO: 621031 - RNA, 63 nt, Homo Sapiens
gaugcauuuguaauacucuuucgcugacuuucuaugugauauaccugcuugucuaguuuguau

SEQ ID NO: 621032 - RNA, 63 nt, Homo Sapiens
gaguuucagaggcugaucucacagaaggugucuaugugauaaugggugcagaauugauaccag

SEQ ID NO: 621033 - RNA, 63 nt, Homo Sapiens
gaaaguaaaaagaacaacacuuguuaugagggcaugugauauuuucacaucuuaauuaagcuc

SEQ ID NO: 621034 - RNA, 63 nt, Homo Sapiens
cugaucauguuuaugagaaacuggcaaagcagaaugugauauccuaggagguaaugaccauga

SEQ ID NO: 621035 - RNA, 63 nt, Homo Sapiens
aaaacuuaaauaugguguuaaaaauggaaauauaugugauauuugcauuauuaaaccccuuug

SEQ ID NO: 621036 - RNA, 63 nt, Homo Sapiens
gacacauuuaucauauucauucacacauauuauaugugauagcuguccaacauccugucuggg

SEQ ID NO: 621037 - RNA, 63 nt, Homo Sapiens
uaaacuagguuuguauuguacaugagguacuucaugugauauguuuuggauuuagucauauug

SEQ ID NO: 621038 - RNA, 63 nt, Homo Sapiens
uaauuuuuaaaaauuacauucuucugauguaacaugugauacauacaaaagaauauaguuuaa

SEQ ID NO: 621039 - RNA, 63 nt, Homo Sapiens
cagugccccaacuuguacugcgccugaauagucaugugauaauuuacugaagaaaucuagugu

SEQ ID NO: 621040 - RNA, 63 nt, Homo Sapiens
guccuggguagacacggaaagaugccucugagcaugugauaaaacgacugaaaaaguucaucu

SEQ ID NO: 621041 - RNA, 63 nt, Homo Sapiens
uauauaucauauauaugauaauauaugauauauaugugauauaaucugcugucuaaaugauau

SEQ ID NO: 621042 - RNA, 63 nt, Homo Sapiens
cacaaacccuuugaaaauagaaaaugugguaaaaugugauacgcagugugguaaaauuggggu

SEQ ID NO: 621043 - RNA, 63 nt, Homo Sapiens
uuuauguuuuuauaauuaaaaagaauuaaauugaugugauaauugcaguauguauaaacuuau

SEQ ID NO: 621044 - RNA, 63 nt, Homo Sapiens
agauuauucagaacaaaauaaauagaaggggaaaugugauagaacucgaguugaagguuugug

SEQ ID NO: 621045 - RNA, 63 nt, Homo Sapiens
agugguacuugaacuugguauuaaggcagcugcaugugauaaauaucuuagaaaaccuguugg

SEQ ID NO: 621046 - RNA, 63 nt, Homo Sapiens
acuuuaaauguauaaaacuuacuggaucacaaaaugugauaaaccaauauucugauaauuggc

SEQ ID NO: 621047 - RNA, 63 nt, Homo Sapiens
ucuagaacaaaauuauucauaucauaugaguugaugugauacuuuacuuuuggguucaccuag

SEQ ID NO: 621048 - RNA, 63 nt, Homo Sapiens
gccgugaauguauucuacugaaaagaauaguagaugugauaguauagaaggaauggccaguuc

SEQ ID NO: 621049 - RNA, 63 nt, Homo Sapiens
cugaauggaaauaaauagauaccuauccugaagaugugauacaacacccuucacacuguuauc

SEQ ID NO: 621050 - RNA, 63 nt, Homo Sapiens
auagaauacugauuggauaguagagacuuugguaugugauaccaagacaagacugucauauug

SEQ ID NO: 621051 - RNA, 63 nt, Homo Sapiens
acaagaccagagaaauuggaguaaaugggucugaugugauauguaccuuaggguuuugccauu

SEQ ID NO: 621052 - RNA, 63 nt, Homo Sapiens
uucuauuaaauccaguauuuggauuuguuuacaaugugauauuuuuuaagcucauggaucaau

SEQ ID NO: 621053 - RNA, 63 nt, Homo Sapiens
auuuccuacaaacuuuaaaugcuguuuuuauagaugugauaugaggcaacacaagcacagaca

SEQ ID NO: 621054 - RNA, 63 nt, Homo Sapiens
aaucauggggaacagauguguuccacccaacaaaugugauaagugaucaugcagccagagcca

SEQ ID NO: 621055 - RNA, 63 nt, Homo Sapiens
aucauggggcacagauauguucccacccaacaaaugugauaagugauugugcagccagagcca

SEQ ID NO: 621056 - RNA, 63 nt, Homo Sapiens
aaauacuuccucugcuuguauuuugcgaugaagaugugauacaucuuuaaaugaaaauauacc

SEQ ID NO: 621057 - RNA, 63 nt, Homo Sapiens
ugaggcuaguguuugcauuccugguuauauguaaugugauaaauuagcuaugaaugguaaaag

SEQ ID NO: 621058 - RNA, 63 nt, Homo Sapiens
gggaaaagggaguaaaagguguauuuuugucguaugugauagaauauuuugcugcacaugcau

SEQ ID NO: 621059 - RNA, 63 nt, Homo Sapiens
gaaauaucuguggugagauugcugagucaggugaugugauaucauaagcuuucuuggaacggg

SEQ ID NO: 621060 - RNA, 63 nt, Homo Sapiens
uugugcuuggaauaugacuuaaguaucuccuaaaugugauacagaagaacaucucaucccaua

SEQ ID NO: 621061 - RNA, 63 nt, Homo Sapiens
uagcuucuauaauuaugcaggucuccccuaggaaugugauagacacaggaaaucauugcuaug

SEQ ID NO: 621062 - RNA, 63 nt, Homo Sapiens
cuuugaaccuugaauuuugguguugaaaauuaaaugugauaacgagaagaagaaggugauaag

SEQ ID NO: 621063 - RNA, 63 nt, Homo Sapiens
uggucuuuuccuguuaacaaauaauggauguggaugugauagguaggggcaugagaaaagcac

SEQ ID NO: 621064 - RNA, 63 nt, Homo Sapiens
ggguuauuuacucagugugugcaauuuaaggcuaugugauagaugcaguauugcaacaggggu

SEQ ID NO: 621065 - RNA, 63 nt, Homo Sapiens
guagccagccaggaccuuacuuuugcacuauugaugugauacuuagacagaagccaguauaca

SEQ ID NO: 621066 - RNA, 63 nt, Homo Sapiens
auuuaaaauugaugugaguuuccaccaugcuuuaugugauaguaugaagcaaaauuucuuuuc

SEQ ID NO: 621067 - RNA, 63 nt, Homo Sapiens
auuuucuggauuuacagaaccuuauugaaucuuaugugauauguaauuugauuucuuuaauuc

SEQ ID NO: 621068 - RNA, 63 nt, Homo Sapiens
uccacacuuacauccucagagguucuugacaagaugugauaauaaaccucuucuguaaugcca

SEQ ID NO: 621069 - RNA, 63 nt, Homo Sapiens
uaaaagugugauuaaucaaauuccaaacuaaaaaugugauagauauauugauaagcaaacuau

SEQ ID NO: 621070 - RNA, 63 nt, Homo Sapiens
auuaauuugagaaugaaacucugggccaaucaaaugugauaaaaugucuuuuuguguaaugga

SEQ ID NO: 621071 - RNA, 63 nt, Homo Sapiens
gcucuuugcucauucuagggccaguggaggaaaaugugauaaggccagagcuugugugcuggg

SEQ ID NO: 621072 - RNA, 63 nt, Homo Sapiens
augggagacauccauuuaagaucaacuguuuacaugugauacaucgaaaacuguuuacuucaa

SEQ ID NO: 621073 - RNA, 63 nt, Homo Sapiens
uuuuaacuagguaucuuauggugagauggugggaugugauaaccaagauguaaguauuacauu

SEQ ID NO: 621074 - RNA, 63 nt, Homo Sapiens
gaaacuaauucagcaggcugaaggaaaugguucaugugauaaugugggcugguauccucuaga

SEQ ID NO: 621075 - RNA, 63 nt, Homo Sapiens
ccugcuccgcuucauguccccuccugaguagucaugugauaauaaacucucauguuauuguuc

SEQ ID NO: 621076 - RNA, 63 nt, Homo Sapiens
cuccaugaugcuguguguuuuggaacaaucugaaugugauauggaaaaaacauaugaaucaga

SEQ ID NO: 621077 - RNA, 63 nt, Homo Sapiens
ugacuaucuugaacaagagaucuuugcagcuuaaugugauauaauuauuaaguuguacugaau

SEQ ID NO: 621078 - RNA, 63 nt, Homo Sapiens
auauugcuaaaauauuuuagagcugugguacaaaugugauaaugaaaacagaguauuucuggc

SEQ ID NO: 621079 - RNA, 63 nt, Homo Sapiens
uuuuuauaauaaauauuuuuuauguacagagaaaugugauaauuuguguuuuugucuuuaugc

SEQ ID NO: 621080 - RNA, 63 nt, Homo Sapiens
auagcacaaguggcuggugaugaauauuuucaaaugugauaaauuugaaguaaauaauacgag

SEQ ID NO: 621081 - RNA, 63 nt, Homo Sapiens
aucucagccuccagaguagcugggacuacaggcaugugauaugaugcucggcugauuuuuguu

SEQ ID NO: 621082 - RNA, 63 nt, Homo Sapiens
uuuacuguaacgaaaccaagaaacuuguuuagaaugugauaggcagcuaaaacuguuaugccc

SEQ ID NO: 621083 - RNA, 63 nt, Homo Sapiens
agaggcuauagcugggaacccgacugugaaaguaugugauaucugaacacauacuagaaagcu

SEQ ID NO: 621084 - RNA, 63 nt, Homo Sapiens
uauagauaacagauuaguaguuacaugguaauuaugugauauaaaauauucauauauuaucaa

SEQ ID NO: 621085 - RNA, 63 nt, Homo Sapiens
cuuaguuaucauuaauguaguuccucauugaacaugugauaaucuaauaccugugaaaacuga

SEQ ID NO: 621086 - RNA, 63 nt, Homo Sapiens
uaauuuaaaucuguaaauaauugcuuuauugugaugugauacagaacaaaguguucguuuuug

SEQ ID NO: 621087 - RNA, 63 nt, Homo Sapiens
cuguuaaucaaaauugcauuuuacaauuuaauaaugugauauuuccuaugucuacagcauacc

SEQ ID NO: 621088 - RNA, 63 nt, Homo Sapiens
cuauuacuauauuuacuugcauaugucagaaugaugugauagacuaucucugucacuaugcug

SEQ ID NO: 621089 - RNA, 63 nt, Homo Sapiens
guguaaagccucuucuguuuagacauuuaucacaugugauauuauuuuaaggcugugaauggu

SEQ ID NO: 621090 - RNA, 63 nt, Homo Sapiens
aaggacacuauggaaaugucuuuuauaagcugaaugugauaauuucacugcacuuggcauuau

SEQ ID NO: 621091 - RNA, 63 nt, Homo Sapiens
gagguuccaguaaucugagccuuguagaaugggaugugauaacaggaaacauucagugaaaaa

SEQ ID NO: 621092 - RNA, 63 nt, Homo Sapiens
uuuuaaaguuaaaacuggauaaauguagcuuuuaugugauaugaauacacauuaucacugaaa

SEQ ID NO: 621093 - RNA, 63 nt, Homo Sapiens
aacagcuucuccaauacagcguuagcauuuucaaugugauauagaccugcaaacgcuucaguu

SEQ ID NO: 621094 - RNA, 63 nt, Homo Sapiens
gcuaguucccaaagugauugugauuaucuuuagaugugauauaaaggcuaagcaauaaauguu

SEQ ID NO: 621095 - RNA, 63 nt, Homo Sapiens
agcuucaguauguuuccucauuuuuaaucccaaaugugauaguuuccuauuuauuuuuauuau

SEQ ID NO: 621096 - RNA, 63 nt, Homo Sapiens
acaccugcugagaaaacaugccucugccaaaggaugugauauauaaguguacauaugugcugu

SEQ ID NO: 621097 - RNA, 63 nt, Homo Sapiens
aaauggaguauuaauuuuuaauauuuucaccauaugugauaacaaaggaucuuucaugaaugu

SEQ ID NO: 621098 - RNA, 63 nt, Homo Sapiens
ugagcacacuacggaucuggaaaauacuggaaaaugugauacuuagaauacuuuggcugcuaa

SEQ ID NO: 621099 - RNA, 63 nt, Homo Sapiens
aaugagugggaaauacauugugccuuucucuagaugugauacguuauaccaaaaucuuuguag

SEQ ID NO: 621100 - RNA, 63 nt, Homo Sapiens
agcuugugaagucauucuaaagcuagaggaaguaugugauauacacauggacuaaggcucagg

SEQ ID NO: 621101 - RNA, 63 nt, Homo Sapiens
augaguaccuuuacauuguguaaauuauuuuuuaugugauaucauuuauuuauuuuuaaaauu

SEQ ID NO: 621102 - RNA, 63 nt, Homo Sapiens
agucugggggggaguugggguauguauuuguaaaugugauagacuguauguaauguauuuaug

SEQ ID NO: 621103 - RNA, 63 nt, Homo Sapiens
auuugcuugaugguugucucuuccaucguauagaugugauauauuuaaaaaugucuauuaaua

SEQ ID NO: 621104 - RNA, 63 nt, Homo Sapiens
acuucugguugccuauugauuauugaccugaaaaugugauagagagauauaaggugauauugc

SEQ ID NO: 621105 - RNA, 63 nt, Homo Sapiens
ucuagauccauauauagguuagauauacaucacaugugauauauaccacauauauaugcauuu

SEQ ID NO: 621106 - RNA, 63 nt, Homo Sapiens
cugauacuuguuuuauacauaaauuuuuuuuagaugugauaaagcuaaacuuggccaaagugu

SEQ ID NO: 621107 - RNA, 63 nt, Homo Sapiens
ugacauuaaauuuggcuauaaaagauggacuacaugugauacuccuauggacguuaauugaaa

SEQ ID NO: 621108 - RNA, 63 nt, Homo Sapiens
gaaguucaaaagacuuauauauguauaagugguaugugauauaaaucguguguuucauaugca

SEQ ID NO: 621109 - RNA, 63 nt, Homo Sapiens
guuguucccauucuucuuugugagacagagagaaugugauauagagaaaucuggcuggcuaca

SEQ ID NO: 621110 - RNA, 63 nt, Homo Sapiens
agcaauauucuuuugaaaaaagugccaguccuuaugugauaaacuaagaagcccauugaauau

SEQ ID NO: 621111 - RNA, 63 nt, Homo Sapiens
agaucaguuuaguuguauaguugucaaaguuauaugugauaucaaugaagaaauauuuguagc

SEQ ID NO: 621112 - RNA, 63 nt, Homo Sapiens
auggaaagccaauaaaccuguucgagauaugacaugugauaaguuuuguuucuauuuaauguu

SEQ ID NO: 621113 - RNA, 63 nt, Homo Sapiens
aaucguguguuucauaugcaauguacaagugguaugugauauagaaguucauaggacuuacau

SEQ ID NO: 621114 - RNA, 63 nt, Homo Sapiens
gaguaaacuaaaacuauuuuauuuucuucuagcaugugauaauucaguguuuucucaugcaaa

SEQ ID NO: 621115 - RNA, 63 nt, Homo Sapiens
uaugcuuaauacuaauucaccucgcguuuacauaugugauagucccuauauuggagaggauaa

SEQ ID NO: 621116 - RNA, 63 nt, Homo Sapiens
auacauaacacauaucgauuuuuuaaugagauaaugugauauuuaugccgcuagauacaugcu

SEQ ID NO: 621117 - RNA, 63 nt, Homo Sapiens
ucuaguuuaaccaguccccuuagcagcggcuggaugugauauguacuauuucccuuuaguuuu

SEQ ID NO: 621118 - RNA, 63 nt, Homo Sapiens
ucaauuuguacaauaaauuaaugccaacucaucaugugauaauucccaugccuggagaagcua

SEQ ID NO: 621119 - RNA, 63 nt, Homo Sapiens
gaagucauauuuacaaaacuaacacaugagagaaugugauagucaagaaaagguggguaugga

SEQ ID NO: 621120 - RNA, 63 nt, Homo Sapiens
gaaaucaacuugcuuaucaaugagcaucacagaaugugauaagaacacuugcaaccuaccugu

SEQ ID NO: 621121 - RNA, 63 nt, Homo Sapiens
gacucagacuaacauacaggacaguccagcuggaugugauaaagauuuuaucaccucauaugg

SEQ ID NO: 621122 - RNA, 63 nt, Homo Sapiens
caaaaaugucaaucaaauauuaaaaaauaguuaaugugauagaaaaaccuuacauauuuuuuu

SEQ ID NO: 621123 - RNA, 63 nt, Homo Sapiens
uucucccaagaugaccuccagccuauuaaguagaugugauauuauucucugauggccugacag

SEQ ID NO: 621124 - RNA, 63 nt, Homo Sapiens
acucuagaggugacucagucaggacugacaguaaugugauaauugccuucauuuucaacccag

SEQ ID NO: 621125 - RNA, 63 nt, Homo Sapiens
ugauacauaagagauguauauguuuugggguauaugugauaauuugauacauucagauagugu

SEQ ID NO: 621126 - RNA, 63 nt, Homo Sapiens
acuaugugaaaaauuauauuugugcauaauaaaaugugauaacuuuuuacaacagaaugugau

SEQ ID NO: 621127 - RNA, 63 nt, Homo Sapiens
gaaaguugagaagaacacgaagcacagacccugaugugauaaaacauuuugugguuucucuga

SEQ ID NO: 621128 - RNA, 63 nt, Homo Sapiens
aaauuauccguuguuuuugcauaugcccaguugaugugauaaaauuuucauugucuugccaua

SEQ ID NO: 621129 - RNA, 63 nt, Homo Sapiens
ucucaaagccuacauucaggaucucccucuaggaugugauagaucuggucccucuccuugaac

SEQ ID NO: 621130 - RNA, 63 nt, Homo Sapiens
aaugacuauuuugcuuacuauugugucuaugauaugugauacaaagcaaauauuuucuaaaua

SEQ ID NO: 621131 - RNA, 63 nt, Homo Sapiens
uccucaccaguaauaugucuccuugcuucuuugaugugauaguuuugagaugggugagaaucu

SEQ ID NO: 621132 - RNA, 63 nt, Homo Sapiens
gucucuuugagaaguaugugcccuaucucauggaugugauaguggaaggaauuguggauggaa

SEQ ID NO: 621133 - RNA, 63 nt, Homo Sapiens
ccaguggaaacuuuuacuccuccucauccgcagaugugauagaacugaaguaucuaggaauuc

SEQ ID NO: 621134 - RNA, 63 nt, Homo Sapiens
aguauuuaaacaauauuuagagcaaguguccucaugugauaaacagagcacaguccaaagaua

SEQ ID NO: 621135 - RNA, 63 nt, Homo Sapiens
gauuuugcuuucuguggaauaacauauuacuggaugugauacaaaaacguaucuucagaacuu

SEQ ID NO: 621136 - RNA, 63 nt, Homo Sapiens
aagacuuuaaaaguuacacaaaauuugcuaacaaugugauauacaugauaguguuaaaaaaca

SEQ ID NO: 621137 - RNA, 63 nt, Homo Sapiens
guaauuuucauaacagauguucaucuuacaaauaugugauaugugaagaugaguuacuccuug

SEQ ID NO: 621138 - RNA, 63 nt, Homo Sapiens
caaaaaaucacaguuuuucauuuaacacaauguaugugauagugucauuauauuuaccuguuu

SEQ ID NO: 621139 - RNA, 63 nt, Homo Sapiens
ucuaagagugucuaugacuucugucauaguuagaugugauaaucugcagacuuaacguguuuu

SEQ ID NO: 621140 - RNA, 63 nt, Homo Sapiens
uauggaaaucaagauuaugucuucuuuaaguacaugugauaacaccauauaggcauugauuaa

SEQ ID NO: 621141 - RNA, 63 nt, Homo Sapiens
uaaucccguagcauagcaccuuuuguauaaacaaugugauauugcuucugcacauccaaaaau

SEQ ID NO: 621142 - RNA, 63 nt, Homo Sapiens
uauaaaaccuuuaagaggauucauggugaauauaugugauaacaucuuuauacuuugaaaaau

SEQ ID NO: 621143 - RNA, 63 nt, Homo Sapiens
auguguuuaaacagaaagaagggaaaagguacuaugugauaugguacugaaauuuugauccca

SEQ ID NO: 621144 - RNA, 63 nt, Homo Sapiens
uuagauguuuucuugcuguuccuugucucuuuuaugugauauuuuaacaacuuuugagagugu

SEQ ID NO: 621145 - RNA, 63 nt, Homo Sapiens
gucuuugucuuucaugcugcucugccuagugugaugugauauaguguaauccuguaaacacug

SEQ ID NO: 621146 - RNA, 63 nt, Homo Sapiens
uuucuuauaauuggacccuuaggacuuugaauaaugugauauuagauucuccucuaauucugu

SEQ ID NO: 621147 - RNA, 63 nt, Homo Sapiens
ugcugcaaaugagggguuaccccuuuuaugaggaugugauaguaggcaucuuacaaauuuugc

SEQ ID NO: 621148 - RNA, 63 nt, Homo Sapiens
uaaagauauuuuugaauuguugaacauaugucuaugugauagcuuguucuuuuaugacuacaa

SEQ ID NO: 621149 - RNA, 63 nt, Homo Sapiens
uuccuuauucacuuacauuacaaaucuaagaccaugugauaagcaugacuggagagguuuaau

SEQ ID NO: 621150 - RNA, 63 nt, Homo Sapiens
uacuaaauucuacuacuggguuauaauuaaaucaugugauauuccacguuuggauaugcucau

SEQ ID NO: 621151 - RNA, 63 nt, Homo Sapiens
caccaaguuacuugcuuugcuuuccucucuaugaugugauaauacaguaaaagcuuucuuacc

SEQ ID NO: 621152 - RNA, 63 nt, Homo Sapiens
uaagaaguaauuauaauuaggaauaggcuauggaugugauacuugguauuuuuuaagauaaac

SEQ ID NO: 621153 - RNA, 63 nt, Homo Sapiens
acuaagugaaaaucugagaaagaguuaauugcaaugugauaguggguagaaaggagagaaaaa

SEQ ID NO: 621154 - RNA, 63 nt, Homo Sapiens
gcauguauccuugauagcaucacaucauacagaaugugauaagaauggcacuuuaccucugug

SEQ ID NO: 621155 - RNA, 63 nt, Homo Sapiens
agcaauauauauauggauuucuauaaucacucgaugugauacaguauaaauaugcuaugguuu

SEQ ID NO: 621156 - RNA, 63 nt, Homo Sapiens
cuuaaaaaucacucuucaugcuucccugguccuaugugauaacagaguuagagacuugagucu

SEQ ID NO: 621157 - RNA, 63 nt, Homo Sapiens
aacauccaguguaaaaaggaagugguccucaggaugugauagagggagacuugcugguggguu

SEQ ID NO: 621158 - RNA, 63 nt, Homo Sapiens
uuguacaucuuacuguauuugcauccuaucacuaugugauauuaaagaaaaaaacuaaucuug

SEQ ID NO: 621159 - RNA, 63 nt, Homo Sapiens
gauguuugaagcuaaucugcucucagugaagauaugugauauggccagcaucccucuucugcu

SEQ ID NO: 621160 - RNA, 63 nt, Homo Sapiens
ugucaaguuacucaaaguuacuguaguguauuuaugugauauggacaaaaauaaacuaaguac

SEQ ID NO: 621161 - RNA, 63 nt, Homo Sapiens
agaggaagaaaggauuuuucauaaaggccagcuaugugauauuuuuuucuuagcuggcaugcc

SEQ ID NO: 621162 - RNA, 63 nt, Homo Sapiens
gauggcugaagaggggaagcuuggaaauaaagaaugugauagaugguugguggggcaggucau

SEQ ID NO: 621163 - RNA, 63 nt, Homo Sapiens
uuuuuuaguuguuaucaaauuguaaaaucaguaaugugauauuuuauauucugaaacauuucu

SEQ ID NO: 621164 - RNA, 63 nt, Homo Sapiens
gaaugauucacugaagaugaaaagauaggacggaugugauaugaaaaaaacccaaacauuuug

SEQ ID NO: 621165 - RNA, 63 nt, Homo Sapiens
cucuccaucuuauauguauucuaaccaggaaaaaugugauagcacauggguagccuaggcagu

SEQ ID NO: 621166 - RNA, 63 nt, Homo Sapiens
uauaggucacaauuuuuuaaggauaaugagcuaaugugauaucgacacuugagugaguuugau

SEQ ID NO: 621167 - RNA, 63 nt, Homo Sapiens
ggcagauugcagugcaaccuuuggauuaucauuaugugauacuuacuuaagaaauuaauucag

SEQ ID NO: 621168 - RNA, 63 nt, Homo Sapiens
augaucguauucuauaaauauaauauauauuguaugugauaauuccauauguacguguguaua

SEQ ID NO: 621169 - RNA, 63 nt, Homo Sapiens
aacaggaucuaagacuggauuaaauucacaaaaaugugauauagcuauaaauggaauuuugug

SEQ ID NO: 621170 - RNA, 63 nt, Homo Sapiens
agcuguuucaucauugucuuguaagauaaggaaaugugauaauagccauuucauguuccaguu

SEQ ID NO: 621171 - RNA, 63 nt, Homo Sapiens
aggaucccaugagaacauuauacuggaaguuacaugugauacccagcuaaagaauacauauca

SEQ ID NO: 621172 - RNA, 63 nt, Homo Sapiens
guuuauuuacuuucgguucugugguguaaacaaaugugauaauuuaauaugaagaacuagaua

SEQ ID NO: 621173 - RNA, 63 nt, Homo Sapiens
uuuacuuucuucaccaagugcaauagauuacugaugugauauucuguugcuuuacaguuacag

SEQ ID NO: 621174 - RNA, 63 nt, Homo Sapiens
ucuugauauaucaucucagaaacuuuccugaauaugugauaauauauggaaaaugauuuauag

SEQ ID NO: 621175 - RNA, 63 nt, Homo Sapiens
accaggcgagagggcacccucccuuccucccccaugugauaaauggguccagggcugaucaaa

SEQ ID NO: 621176 - RNA, 63 nt, Homo Sapiens
ggaaaaauucuuuccugcccaaauauuacaguuaugugauaaaaucacuuaugcugagcaacc

SEQ ID NO: 621177 - RNA, 63 nt, Homo Sapiens
aauaggggagggaggcugcuauuuacccacagaaugugauagugaagcaggcuuggaggguua

SEQ ID NO: 621178 - RNA, 63 nt, Homo Sapiens
ccccucucucucccaaucaguggaggcacugggaugugauaugugcuuuaaauuggaagacgc

SEQ ID NO: 621179 - RNA, 63 nt, Homo Sapiens
aguacauauuuuaaauuguuuuguaaguguuaaaugugauaaaaaacaguuccauuuucucuc

SEQ ID NO: 621180 - RNA, 63 nt, Homo Sapiens
uuggagggaagguaaaguagggguuaguuucaaaugugauauuaauugcuuucucaaaaguuu

SEQ ID NO: 621181 - RNA, 63 nt, Homo Sapiens
acauuaccaugauuuauuguaauggaguagaguaugugauaguaucugcuucaagaccuauag

SEQ ID NO: 621182 - RNA, 63 nt, Homo Sapiens
ugcaaguacaguauguugcuguccuuggauaaaaugugauauacuugauagaaugacuuugag

SEQ ID NO: 621183 - RNA, 63 nt, Homo Sapiens
aauuaaugugugcaaauuguauauuuuguauauaugugauauagcuuuuauuuccguuuaaac

SEQ ID NO: 621184 - RNA, 63 nt, Homo Sapiens
agagauuacuaugaauguuagcuguucccuucaaugugauaucuaaaauuuguuugcucguau

SEQ ID NO: 621185 - RNA, 63 nt, Homo Sapiens
aaagauggaguuucuaagguccgguguucuaagaugugauauucuaagacuuacucuaagauc

SEQ ID NO: 621186 - RNA, 63 nt, Homo Sapiens
cuuuuuuauauuuuuaagacuagauuuugagccaugugauaguuuuaccucauauuaaauaua

SEQ ID NO: 621187 - RNA, 63 nt, Homo Sapiens
gacagucacagcacugcacuguggugcggcuucaugugauaugacaguggaugcuaaggugag

SEQ ID NO: 621188 - RNA, 63 nt, Homo Sapiens
gagaugacacuuuggaguuuccauaucugagugaugugauauucagcaugaauugagucucau

SEQ ID NO: 621189 - RNA, 63 nt, Homo Sapiens
cuuguuugauaaaaaaguaaguagcuauuuuuuaugugauaauuuauauacuaccguagcacu

SEQ ID NO: 621190 - RNA, 63 nt, Homo Sapiens
uguggcaaagccuuuaacugagaaauccuacaaaugugauaaacaagauaauucauacuggag

SEQ ID NO: 621191 - RNA, 63 nt, Homo Sapiens
guuuuaaaugguugucacacagaaaugugaagaaugugauaaaucauaguguugagaaauccu

SEQ ID NO: 621192 - RNA, 63 nt, Homo Sapiens
ggcuuuacaugguugucacaagaaauguaaagaaugugauaaauuauacuggugagaaauucu

SEQ ID NO: 621193 - RNA, 63 nt, Homo Sapiens
gacuucaacuguuccucacaacaaaugcgaagaaugugauaaaucauacuggagagaaacccu

SEQ ID NO: 621194 - RNA, 63 nt, Homo Sapiens
aacauaguagaguacucucuauagaugaauaaaaugugauagucaaaugcugucucuugugaa

SEQ ID NO: 621195 - RNA, 63 nt, Homo Sapiens
ucauguuuucaagaacgucaaaauguauauauuaugugauaaauuucaagugacaagcaaagu

SEQ ID NO: 621196 - RNA, 63 nt, Homo Sapiens
gagaagaaacaggaaacuugguagccccagcagaugugauauagaagaagccaccuuggacau

SEQ ID NO: 621197 - RNA, 63 nt, Homo Sapiens
ucagaccaaugccuuccacuauggccagaaugaaugugauagugcaucauguccaauguccag

SEQ ID NO: 621198 - RNA, 63 nt, Homo Sapiens
gauuuuccgcaggccaaaguuuauaauaauuauaugugauagagaauccauacuaaagagcau

SEQ ID NO: 621199 - RNA, 63 nt, Homo Sapiens
ucagaacugaagaguaaaucccaacugucgcugaugugauauguuuuauuucguaaagaggua

SEQ ID NO: 621200 - RNA, 63 nt, Homo Sapiens
guugacauccuccagaauggcaagucuugcuaaaugugauacuauuccuccauuucgccagca

SEQ ID NO: 621201 - RNA, 63 nt, Homo Sapiens
agagggcuggaauuuaaaccucuuaaaggggguaugugauaaugcugugacuagaaccauaaa

SEQ ID NO: 621202 - RNA, 63 nt, Homo Sapiens
gugcaacaagucauuguagauucaauuauuuuaaugugauagaauguuguauggaaauuauag

SEQ ID NO: 621203 - RNA, 63 nt, Homo Sapiens
gcgauggacaauuaugauagcuuauguagcugaaugugauacaugccgaaugccacacguaaa

SEQ ID NO: 621204 - RNA, 63 nt, Homo Sapiens
caccacuugguuuuauuuuucuaagugcaugugaugugauagaguguguggggcucugugucc

SEQ ID NO: 621205 - RNA, 63 nt, Homo Sapiens
ugcguuaacugcacaaauugucaccucaggaccaugugauaauucagcugaggaggauguaug

SEQ ID NO: 621206 - RNA, 63 nt, Homo Sapiens
uaacauuuugaagaauuccuuuuguguuuuaaaaugugauauauauauauauaaaauuccuag

SEQ ID NO: 621207 - RNA, 63 nt, Homo Sapiens
cuacaaacuuuuauaaauguuuuaaagaaguccaugugauaauuguaaaggugaugaauuuac

SEQ ID NO: 621208 - RNA, 63 nt, Homo Sapiens
acccagugucugucucccacgacaggccaagggaugugauaguguuguugggaggggguagaa

SEQ ID NO: 621209 - RNA, 63 nt, Homo Sapiens
uaaaauuuaacucaaaauguauaacggacuuaaaugugauacauaaaacuagauaacuuugaa

SEQ ID NO: 621210 - RNA, 63 nt, Homo Sapiens
gugaauguacauguauauacaagcugauggaguaugugauaaagaauuaccaucucagaaguc

SEQ ID NO: 621211 - RNA, 63 nt, Homo Sapiens
acauacguugacauuaugcaaguugggagugaaaugugauagcuuaaaauuaaaauauucugc

SEQ ID NO: 621212 - RNA, 63 nt, Homo Sapiens
guacugugguuauguuguuuauuguuuuuuaagaugugauaugaaaauauaacuucuugauuu

SEQ ID NO: 621213 - RNA, 63 nt, Homo Sapiens
uucauaaagugagggaucccuacucuuuuauacaugugauaauaaaucuuugaauuuuaauuu

SEQ ID NO: 621214 - RNA, 63 nt, Homo Sapiens
uucuaaauuaugaacauuaguaauaaauauuauaugugauaaauaauuuugcaaauaaacuau

SEQ ID NO: 621215 - RNA, 63 nt, Homo Sapiens
ucauauuuuagaaauggcuucaaaugacaaagaaugugauagcugaguaaaaacaaaaaaaaa

SEQ ID NO: 621216 - RNA, 63 nt, Homo Sapiens
caauccuacacuacagauuucaguuuuuagaaaaugugauaauaauauugauauuuaguuucu

SEQ ID NO: 621217 - RNA, 62 nt, Homo Sapiens
uauuuaaaauuuuuuugccaauggugccaaguaaugugaaugcuaauacugcuuaagaaaau

SEQ ID NO: 621218 - RNA, 62 nt, Homo Sapiens
guucucuucuguuacugauauguaaguguggcaaugugaacugaagcugaugggcugagaac

SEQ ID NO: 621219 - RNA, 62 nt, Homo Sapiens
ggccagagccaagaaacacuuucagaaaaacaaaugugaaggggagagacaggggccgcccu

SEQ ID NO: 621220 - RNA, 62 nt, Homo Sapiens
uaauaugcuaaccugaugcacugcugaaagaaaaugugaauuuuucguaauaauugcauuuu

SEQ ID NO: 621221 - RNA, 62 nt, Homo Sapiens
auuccugcaaagcuugcuuuggggaguuggauaaugugaaaauuuuaaguaccuaggggaga

SEQ ID NO: 621222 - RNA, 62 nt, Homo Sapiens
aaguuuauguaguacuuaauguacaugauaugaaugugaagcauaaaauuaaauaaaauuuu

SEQ ID NO: 621223 - RNA, 62 nt, Homo Sapiens
acuccugauguuuuuucuacaaaaguccauaaaaugugaaaacuggagaagaucuuagaggu

SEQ ID NO: 621224 - RNA, 62 nt, Homo Sapiens
cggcuugugaaaaguuguuaaacaacaugcuaaaugugaaaugucaacccucacucuaaacu

SEQ ID NO: 621225 - RNA, 62 nt, Homo Sapiens
aagggaacauaauuuguuuaggcucccacauaaaugugaaucuggccaacaacuuugguuca

SEQ ID NO: 621226 - RNA, 62 nt, Homo Sapiens
cuguuauuauacuuaaucuucuaaacuaaacuaaugugaacaguagggaagcaagggcccaa

SEQ ID NO: 621227 - RNA, 62 nt, Homo Sapiens
uuucauuaccuccuacuugccauucacccaucaaugugaaagucagggucacagcuggucug

SEQ ID NO: 621228 - RNA, 62 nt, Homo Sapiens
uacuuucuuccuugccuaugcagggcaaacaaaaugugaaauucugcccucagcugagcuga

SEQ ID NO: 621229 - RNA, 62 nt, Homo Sapiens
gcuguauuccuaaacaaauuguuuccuaaacaaaugugaaaaugugaacagugcugaaaggu

SEQ ID NO: 621230 - RNA, 62 nt, Homo Sapiens
ccuaaacaaauuguuuccuaaacaaaugugaaaaugugaacagugcugaaagguuuugugaa

SEQ ID NO: 621231 - RNA, 62 nt, Homo Sapiens
aaaguucauuauuuauuuuaccuuuuacugacaaugugaaacucgaagaaaauguucucuuu

SEQ ID NO: 621232 - RNA, 62 nt, Homo Sapiens
guuaacauauguucggacugcuucccuucaccaaugugaacaacuuuuuuucccaaacagug

SEQ ID NO: 621233 - RNA, 62 nt, Homo Sapiens
guguaaaguuuaacacgguuugacaguaaauaaaugugaauuuuuucaaguaguuaacaugu

SEQ ID NO: 621234 - RNA, 62 nt, Homo Sapiens
auuagaguaccaacuuaauguuuuucucgaagaaugugaaaauaauuagaccuguuaaauua

SEQ ID NO: 621235 - RNA, 62 nt, Homo Sapiens
guuuuguuuuguuuuucucuuucacucagccaaaugugaaaguugugaauuuaggaaaauca

SEQ ID NO: 621236 - RNA, 62 nt, Homo Sapiens
gcaauuugaaauauauucugguuguuuuucuaaaugugaagacuuaccaaaugaauuuuaga

SEQ ID NO: 621237 - RNA, 62 nt, Homo Sapiens
acuuuccaggaagaaaagagggcaaagggaacaaugugaaaagaagcagaaaaucauaaaag

SEQ ID NO: 621238 - RNA, 62 nt, Homo Sapiens
auuauaauuaguuccucauuagcauuuugcuaaaugugaaugaugauccuaggcauuugcug

SEQ ID NO: 621239 - RNA, 62 nt, Homo Sapiens
ggguaacuagggaagauaauauuaaggaagacaaugugaaaagaaaaaugagccuggcaaga

SEQ ID NO: 621240 - RNA, 62 nt, Homo Sapiens
aagcugaggauccucacaggagcagacagagaaaugugaagggugggguuuuauguguggga

SEQ ID NO: 621241 - RNA, 62 nt, Homo Sapiens
gagacuugccuuuuaaggaucgaaaguacgccaaugugaauuuccauuauuuucaauggaag

SEQ ID NO: 621242 - RNA, 62 nt, Homo Sapiens
gcuuuggaaauuuaauguuaguugaaauguaaaaugugaaaacuuuagaucauuuguaguaa

SEQ ID NO: 621243 - RNA, 62 nt, Homo Sapiens
gguuucuauauuuugagauguuuuuuccuuacaaugugaacucaucgugaucuuggaaauca

SEQ ID NO: 621244 - RNA, 62 nt, Homo Sapiens
uaguuuaaaaaauuauaaaugaaucuaaucaaaaugugaauaguagucaaaaggauaauuua

SEQ ID NO: 621245 - RNA, 62 nt, Homo Sapiens
uugaauugaaugucuauaaggucuaaagguagaaugugaauauugccacagaguucauugcu

SEQ ID NO: 621246 - RNA, 62 nt, Homo Sapiens
ggauacaguuuguuuuuagauguccuuuguccaaugugaacauuuauucauauuguuuugau

SEQ ID NO: 621247 - RNA, 62 nt, Homo Sapiens
uuuggugccuuacuuuuaucuuaauuuuugccaaugugaaaauuaaggauaaaucagaguua

SEQ ID NO: 621248 - RNA, 62 nt, Homo Sapiens
aauuuuggguuaaagguuuuggcugcuguaagaaugugaauuugaauguauuuugaauugua

SEQ ID NO: 621249 - RNA, 62 nt, Homo Sapiens
uuugcugguuaaccuuuaucauuuaucuuuguaaugugaacaugcuucagaguguaccuuuu

SEQ ID NO: 621250 - RNA, 62 nt, Homo Sapiens
aauucccuuuuucuaaggcacagagcugguaaaaugugaaguaauagugaaccuaacaguca

SEQ ID NO: 621251 - RNA, 62 nt, Homo Sapiens
ccggauguugaaacaaccacaggucaagaaggaaugugaaucuguuguuuuauaagaguuua

SEQ ID NO: 621252 - RNA, 62 nt, Homo Sapiens
uaggaggaucuagggacagaaggaaagugaaaaaugugaaaauacaaaauacccaagauuua

SEQ ID NO: 621253 - RNA, 62 nt, Homo Sapiens
cagcuucagcaguguugaacuguguguuuaaaaaugugaauuacuguuauuguauacuguaa

SEQ ID NO: 621254 - RNA, 62 nt, Homo Sapiens
cggcgucggcgcggggccagugaagaagugugaaugugaaggaugcaguguugcgguggcac

SEQ ID NO: 621255 - RNA, 62 nt, Homo Sapiens
ggucugauuggcugcuuaaacauuuuuuuagaaaugugaagacucuggugcuuuaguuaggu

SEQ ID NO: 621256 - RNA, 62 nt, Homo Sapiens
uggaauauuaccugugucauuugguaccuggaaaugugaaucgugccauuuagagggaacuc

SEQ ID NO: 621257 - RNA, 62 nt, Homo Sapiens
aacuucuugucuuuuuuucuggggaggucuguaaugugaaacaguauuaggcuuuggggugg

SEQ ID NO: 621258 - RNA, 61 nt, Homo Sapiens
uaaauacuguaccuuuauugugcauuauuuugaaugugaagcgugaugcucaggcuugaaa

SEQ ID NO: 621259 - RNA, 62 nt, Homo Sapiens
cuacuaccacgaccuccccaccacauccacucaaugugaacucaccuucccugacucagaac

SEQ ID NO: 621260 - RNA, 62 nt, Homo Sapiens
ggagaggccgagcagcagccagugauuuugugaaugugaaguacugcuuguuuugcacaaga

SEQ ID NO: 621261 - RNA, 62 nt, Homo Sapiens
auauuugaaaacucaaugaaucuaaguauaagaaugugaagauuugggguuacuucuuuguu

SEQ ID NO: 621262 - RNA, 62 nt, Homo Sapiens
acaugccaguuuuuaaaauguuggggguuuucaaugugaaacuccaccagccccucacaggc

SEQ ID NO: 621263 - RNA, 62 nt, Homo Sapiens
acccauauauacaacaaaguuuuaaacaccuaaaugugaauaagaaacauagacucccaagu

SEQ ID NO: 621264 - RNA, 62 nt, Homo Sapiens
uuaagucuucacuuucugugagguauaauuuuaaugugaaaagagauauaaaaguaggaaac

SEQ ID NO: 621265 - RNA, 62 nt, Homo Sapiens
ucucccguauuucauuucugaggucucuguguaaugugaagcaauaaccaggugugagcuac

SEQ ID NO: 621266 - RNA, 62 nt, Homo Sapiens
cugucauuacagacaacagguuggagaaagggaaugugaaaguuaauuuggauccuuugggu

SEQ ID NO: 621267 - RNA, 62 nt, Homo Sapiens
agauaaaaagugaacuaucucuccagcuauagaaugugaaugucuaaaugggauuuugaguu

SEQ ID NO: 621268 - RNA, 62 nt, Homo Sapiens
aacuuguuuuauaaaaagcauaguuuuucuaaaaugugaauagccauuuccuguccuggaau

SEQ ID NO: 621269 - RNA, 62 nt, Homo Sapiens
aggaccuggucaguuugaaacugcuaguucaaaaugugaauuaauugauuugcugaauuuuu

SEQ ID NO: 621270 - RNA, 62 nt, Homo Sapiens
ugccuaguaagcacuuugucaaauucugugugaaugugaacuauuagauaauagaugggguc

SEQ ID NO: 621271 - RNA, 62 nt, Homo Sapiens
uaaucauuuggacaacucaaugggaauagcuuaaugugaagaugugugaggcaaacuaugca

SEQ ID NO: 621272 - RNA, 62 nt, Homo Sapiens
uugucuaaguacuguaauccucuuuuaaaguaaaugugaaccuuugcauuaaaauauagaag

SEQ ID NO: 621273 - RNA, 62 nt, Homo Sapiens
gucauagguguucaaaagcgagaucauauucuaaugugaaauuuccccuccacuugcugcca

SEQ ID NO: 621274 - RNA, 62 nt, Homo Sapiens
acuaaugugucucaggcucaaugacgugguaaaaugugaaaaugggggaaaauuauuuugac

SEQ ID NO: 621275 - RNA, 62 nt, Homo Sapiens
caaagauuauagucauuguaacuguaaagugcaaugugaaauaauaauucuacagaaauaaa

SEQ ID NO: 621276 - RNA, 62 nt, Homo Sapiens
cuauguucugggaaaauccagcuguuuucaauaaugugaauguuuuaggaaaagugaaucuu

SEQ ID NO: 621277 - RNA, 62 nt, Homo Sapiens
uuuggaaaguuauaaagguggaccauuuacuuaaugugaaguucuucucaaguuucaagcaa

SEQ ID NO: 621278 - RNA, 62 nt, Homo Sapiens
aaaaauuuuggaacaauuagauuuuguaaaguaaugugaauuuuuucaguauuuuaaauaaa

SEQ ID NO: 621279 - RNA, 62 nt, Homo Sapiens
agcugccauuggugggaaucuggaaucugacaaaugugaauguucccugugaguaaugcuua

SEQ ID NO: 621280 - RNA, 62 nt, Homo Sapiens
uaagaugaacuaaacaaacauugaaucagagaaaugugaagacacacugguccugcagcuua

SEQ ID NO: 621281 - RNA, 62 nt, Homo Sapiens
gcagcuacugacugaauaaccacuuuuaaaggaaugugaaauuuaaauaauagacauacaga

SEQ ID NO: 621282 - RNA, 62 nt, Homo Sapiens
gggcccccaucggagcccugcaaauuccgagaaaugugaaacuugguggggucagggaggaa

SEQ ID NO: 621283 - RNA, 62 nt, Homo Sapiens
auaggaauccuuuuuuuuuuuuuuaaagacuaaaugugaaaaaauaaucacuacuuaagcua

SEQ ID NO: 621284 - RNA, 62 nt, Homo Sapiens
cugacucuuugcucuaauuuuggaaaaaaagaaaugugaagggucaacuccaacguaugugg

SEQ ID NO: 621285 - RNA, 62 nt, Homo Sapiens
auuacguuguuucuuauagauuuuuuaaaaaaaaugugaaauuuuuccacacuauguguguu

SEQ ID NO: 621286 - RNA, 62 nt, Homo Sapiens
uuucaaaaauuaaagaccuacaucacaggguuaaugugaagaaagcuuuauuuuucaaauga

SEQ ID NO: 621287 - RNA, 62 nt, Homo Sapiens
caugaauuuguaaugucuugagcucuauuaugaaugugaagccuuccccuuauccucccugu

SEQ ID NO: 621288 - RNA, 62 nt, Homo Sapiens
ugcuugccaguacugccaaagcacugcugugaaaugugaaguacuuuguuuuuuuauuuuua

SEQ ID NO: 621289 - RNA, 62 nt, Homo Sapiens
aagaugcagguuuaagaaguuaauauuuauaaaaugugaaagacacaguuacuaggauaacu

SEQ ID NO: 621290 - RNA, 62 nt, Homo Sapiens
aaguugaaaugcaaaaauacuaauuagagaauaaugugaauaaaaugggaaucuucuuggua

SEQ ID NO: 621291 - RNA, 62 nt, Homo Sapiens
guguucuaaguggaaggagaguuacugaagggaaugugaauuuuuaccguuuguacuuaaga

SEQ ID NO: 621292 - RNA, 62 nt, Homo Sapiens
uucuggcagugugggauggaugaaugaaguggaaugugaacuuugggcaaguuaagugggac

SEQ ID NO: 621293 - RNA, 62 nt, Homo Sapiens
uagugaacuuauuuucaguagacauagaaaacaaugugaauauuuaaggucugugacuauag

SEQ ID NO: 621294 - RNA, 62 nt, Homo Sapiens
guuauuauuaacauuuauuuauuauuuuucuaaaugugaaagcaauacauaauuuagggaaa

SEQ ID NO: 621295 - RNA, 62 nt, Homo Sapiens
aacuugcguucuguuaauggugccgaaauaacaaugugaaccugagacuggccugcaugaau

SEQ ID NO: 621296 - RNA, 62 nt, Homo Sapiens
uggagccuuuacagaagcaucacauuuaaaccaaugugaauucaaaaaagagaaggaaacuu

SEQ ID NO: 621297 - RNA, 62 nt, Homo Sapiens
acccuccccugcaaguuuguagcucaaguuguaaugugaaagucauauuuuauuuguggcau

SEQ ID NO: 621298 - RNA, 62 nt, Homo Sapiens
ugaaaaguccaucuugcugauuugaugauugaaaugugaaagugaaguggaaggaaugaaug

SEQ ID NO: 621299 - RNA, 62 nt, Homo Sapiens
guaggucaaaucaaauuaaagaugauuuuuuuaaugugaauaaaguuauguucugauaguuu

SEQ ID NO: 621300 - RNA, 62 nt, Homo Sapiens
acauguugcuuuguauaaaaaucuuauuuauaaaugugaagcuuuuugaugccaucaaaacu

SEQ ID NO: 621301 - RNA, 62 nt, Homo Sapiens
cagacuucguggguuuuguuuuuaagcaaaacaaugugaaaacauuuaaguuugaaauguug

SEQ ID NO: 621302 - RNA, 62 nt, Homo Sapiens
aggaguccugggucccuggccuccaaagcuggaaugugaacgcaugccacgguggucugacc

SEQ ID NO: 621303 - RNA, 62 nt, Homo Sapiens
guucugcccaguuucugagcaucuucugucagaaugugaaaaauuuuuuagacuuaaguuuu

SEQ ID NO: 621304 - RNA, 55 nt, Homo Sapiens; identical to SEQ ID NO: 450960

SEQ ID NO: 621305 - RNA, 62 nt, Homo Sapiens
auaaggcacguuuucacacacuuauuuucaaaaaugugaaauggaaaaaaaaguauggaggc

SEQ ID NO: 621306 - RNA, 62 nt, Homo Sapiens
ugccagugacugcugcgcugcaaucccaccauaaugugaauaaggggcaggccuuuuugagc

SEQ ID NO: 621307 - RNA, 62 nt, Homo Sapiens
cagagucuauuuuucuaaauagcccuggggugaaugugaaucuccuugcugucaucccacau

SEQ ID NO: 621308 - RNA, 62 nt, Homo Sapiens
uuuuacagaaucagacagauguucacauaaagaaugugaaauugaauuucuuucagcuuuuu

SEQ ID NO: 621309 - RNA, 62 nt, Homo Sapiens
uguccuccuaggauaagguugagguuagacgcaaugugaaaccaagauuaagaggccaggaa

SEQ ID NO: 621310 - RNA, 62 nt, Homo Sapiens
ccuguaaguguacauguagugaacugacauaaaaugugaaagcaaguuguacauuuguguau

SEQ ID NO: 621311 - RNA, 62 nt, Homo Sapiens
uuaaauaaaauuuaugugccccugauugugucaaugugaaagaccuuuucucagaaugguuu

SEQ ID NO: 621312 - RNA, 62 nt, Homo Sapiens
ugagcagccagaaaucuauugcuuuccagugcaaugugaauucaacuugccuugaugucuga

SEQ ID NO: 621313 - RNA, 62 nt, Homo Sapiens
guauuuacauaaacgugcaaaaugagaccagcaaugugaacuuuuccuucuaaacaaggaca

SEQ ID NO: 621314 - RNA, 62 nt, Homo Sapiens
uuuucuaacugccucguaggcagauuuguuaaaaugugaacgcaaauuucuugugguuugua

SEQ ID NO: 621315 - RNA, 62 nt, Homo Sapiens
gcuuugcuuuucacgugauugcagguucacuaaaugugaacacccccccccccccaugaaau

SEQ ID NO: 621316 - RNA, 62 nt, Homo Sapiens
gaugugcucccaccacaugcucucuucuguaaaaugugaaaaaccucucugagccucaguug

SEQ ID NO: 621317 - RNA, 62 nt, Homo Sapiens
gagaaguauuuacauuggaguguuucugugauaaugugaaaugagugguuaguaaacugcac

SEQ ID NO: 621318 - RNA, 62 nt, Homo Sapiens
ucuuuggagauucucuugagagaagauggaaaaaugugaagaaguuugucaauccuuguuuu

SEQ ID NO: 621319 - RNA, 62 nt, Homo Sapiens
aggauuaacauauuguaaauugcgguaucaacaaugugaauaaaaaacaaauuguguuuuau

SEQ ID NO: 621320 - RNA, 62 nt, Homo Sapiens
ggggaauggaggaauggaaaacaaggguugugaaugugaaagugagagaaaaggaauguugc

SEQ ID NO: 621321 - RNA, 62 nt, Homo Sapiens
gugacuauuuacauguauacuuagaaauagaaaaugugaagaccugccuuuuacuagcuacu

SEQ ID NO: 621322 - RNA, 62 nt, Homo Sapiens
aucuucucaugcaauuauuuaaguuguaaauaaaugugaaacgggauagguccuugggucaa

SEQ ID NO: 621323 - RNA, 62 nt, Homo Sapiens
ugcugcguuuuguuuucuuuguuccucgggaaaaugugaaugcuguagagaucaucuuuaca

SEQ ID NO: 621324 - RNA, 62 nt, Homo Sapiens
ugaaaucgauaauaccacagugugguuggggaaaugugaaagcaaccugauggcauuaauuc

SEQ ID NO: 621325 - RNA, 62 nt, Homo Sapiens
gguucccauaccaugaaugcaaaguaauuuuaaaugugaacaacucuauuuuuaaagaucac

SEQ ID NO: 621326 - RNA, 62 nt, Homo Sapiens
gucaaagacaugucagugcuuacuaaaaauaaaaugugaaauagcacugacaaaggauaugg

SEQ ID NO: 621327 - RNA, 62 nt, Homo Sapiens
uccacuaauuuugcaugcguauuuauaagaaaaaugugaauuuggugguuuuauucuaucgg

SEQ ID NO: 621328 - RNA, 62 nt, Homo Sapiens
aaagaaauaauugaccaaguaaguuugcauaaaaugugaauacuaaauguguccccaguugc

SEQ ID NO: 621329 - RNA, 62 nt, Homo Sapiens
auuuaaacacauuugaaacauacaaaaauagaaaugugaaagcauuuggugaaagccaaagc

SEQ ID NO: 621330 - RNA, 62 nt, Homo Sapiens
caggaagacuuccagcuuucucuuuguucuucaaugugaaacugagaccaagucucucuaag

SEQ ID NO: 621331 - RNA, 62 nt, Homo Sapiens
ucucuuuuuaauggagauugaaaagggagaauaaugugaauaucacggcuuauauuauuaaa

SEQ ID NO: 621332 - RNA, 62 nt, Homo Sapiens
ucaucaucccaggggagaacuacauugggauaaaugugaagaaggcuuuuaagguaggucau

SEQ ID NO: 621333 - RNA, 62 nt, Homo Sapiens
uuuuuacagacaacaucgaguaauggcuuguaaaugugaauuuugccagaggugguuuuuga

SEQ ID NO: 621334 - RNA, 62 nt, Homo Sapiens
caauuugugggaacaggaggggagaggaaacaaaugugaaguuguggacucuacccaggcag

SEQ ID NO: 621335 - RNA, 62 nt, Homo Sapiens
cuuugagaaucucauacaucugugaaaaagauaaugugaaauaaacaguaaaaaaaaaaagu

SEQ ID NO: 621336 - RNA, 62 nt, Homo Sapiens
uacaggauuugaacucagaucugucugauaggaaugugaaagcacggacucuuacugcuaac

SEQ ID NO: 621337 - RNA, 62 nt, Homo Sapiens
augaaaccucuguggcucuuucgaaacgugaaaaugugaagaaagcuacuaacuuagcugua

SEQ ID NO: 621338 - RNA, 62 nt, Homo Sapiens
ggagcugauggcucacugggcucuuggaggggaaugugaagaaaccaaggagucacuuuuuc

SEQ ID NO: 621339 - RNA, 62 nt, Homo Sapiens
uauugugguagcauguucaaaauccaacaaguaaugugaauuuuagauguaaauaucugcca

SEQ ID NO: 621340 - RNA, 62 nt, Homo Sapiens
uuugguaccuuaauuugacuguccucgcagagaaugugaacauguguguguguuguguuaau

SEQ ID NO: 621341 - RNA, 62 nt, Homo Sapiens
aagguaacuuauuucucuucugcacagagcauaaugugaaguuuuauaccuacuuuuaaaau

SEQ ID NO: 621342 - RNA, 62 nt, Homo Sapiens
caggaggguuuuuaaaaaguguuuaaaugucaaaugugaauuggugaugggugauggagggu

SEQ ID NO: 621343 - RNA, 62 nt, Homo Sapiens
cucuacuccucaugacaugaagaaaaagacugaaugugaagggaguuucuguacuguaagcu

SEQ ID NO: 621344 - RNA, 62 nt, Homo Sapiens
guuugagugcuucagauacauuuuucagauacaaugugaagacauugaagauaugugguccu

SEQ ID NO: 621345 - RNA, 62 nt, Homo Sapiens
auuguacuccuuccuuggagcugaaugcaaggaaugugaauucugaggaauuaagguagaau

SEQ ID NO: 621346 - RNA, 62 nt, Homo Sapiens
uguuuugauuuuuuuugcuacugugcaaguuuaaugugaauaaaaucuuuguggaaugauga

SEQ ID NO: 621347 - RNA, 62 nt, Homo Sapiens
ccucuuccuccccaccccacugcccccaccuuaaugugaauuugacugaugaaugaagagcg

SEQ ID NO: 621348 - RNA, 62 nt, Homo Sapiens
auggcaagaauguucuaguaaauguguaccaaaaugugaauuacuuuguacgauuacagucu

SEQ ID NO: 621349 - RNA, 62 nt, Homo Sapiens
uuucccauagggcauuaguucucagauuuuggaaugugaaauaaucaccuaggaaguugguu

SEQ ID NO: 621350 - RNA, 62 nt, Homo Sapiens
aauaccuuuuuuugcaucuuuuuucaaaguuuaaugugaacuuuuagaaaagugauuaaugu

SEQ ID NO: 621351 - RNA, 62 nt, Homo Sapiens
uucaaccuacuuucauacugaagaugcagcaaaaugugaaugggaaaagagauggccugaga

SEQ ID NO: 621352 - RNA, 62 nt, Homo Sapiens
aguucucuuaucuuugaucguauauuucucauaaugugaaauaugaugagauucacuuaggg

SEQ ID NO: 621353 - RNA, 62 nt, Homo Sapiens
cagccauuuuuuuaguuaguaaaaauccuauuaaugugaaccagccaggaauaacaguguua

SEQ ID NO: 621354 - RNA, 62 nt, Homo Sapiens
uggcaauuugucuuuuaagucuuaaccuugcuaaugugaauacugggaaagugauuuuuucu

SEQ ID NO: 621355 - RNA, 62 nt, Homo Sapiens
agaaaaguaugugauuuuuaccuuuuuuaacaaaugugaaaaagucaguuuuagaaauuucg

SEQ ID NO: 621356 - RNA, 62 nt, Homo Sapiens
ugaaacuaauaauuugauccuuaaauuccuacaaugugaaacuguuaaaaaaaaaaaaaauc

SEQ ID NO: 621357 - RNA, 62 nt, Homo Sapiens
uguaauuuuuaaaaaggcuaaguaacuguuaaaaugugaaauuauuugcuuaaaugcuggaa

SEQ ID NO: 621358 - RNA, 62 nt, Homo Sapiens
acccuuccuacggggaaucuggacccacuaugaaugugaauacuccaggaagaugucuuugu

SEQ ID NO: 621359 - RNA, 62 nt, Homo Sapiens
uaauugauguuugcaaugugaauuaugcaauuaaugugaaaaacuaauagaucaccuuagaa

SEQ ID NO: 621360 - RNA, 62 nt, Homo Sapiens
acaauuuaguccucauuauuaaaggaaaagaaaaugugaaacuguuacaugauuuuuuaaaa

SEQ ID NO: 621361 - RNA, 62 nt, Homo Sapiens
auacugaucuuauaucuguuuauguuugugugaaugugaaugcagucuuucuaaagugugug

SEQ ID NO: 621362 - RNA, 62 nt, Homo Sapiens
gucuaaauaucuguucauaagugguuuuacaaaaugugaaauuggaauuggagauuguagac

SEQ ID NO: 621363 - RNA, 62 nt, Homo Sapiens
cugaugacaugguauaggagacucauuuggaaaaugugaacaggacagaucaaggcacuuca

SEQ ID NO: 621364 - RNA, 62 nt, Homo Sapiens
augugucuguaagauuguccuauuaaguucucaaugugaaaaugacauuguauguaucuauu

SEQ ID NO: 621365 - RNA, 62 nt, Homo Sapiens
cuauuauggguagccuuuuuaaauucauugaaaaugugaauuucuauuugaugauaaacuau

SEQ ID NO: 621366 - RNA, 62 nt, Homo Sapiens
acaaaaccaaggaguacauugagugcaaugagaaugugaaacguaagaauccugaggaccug

SEQ ID NO: 621367 - RNA, 62 nt, Homo Sapiens
gaaagugcuugcugugaugugugaaacccuacaaugugaaagcucaguuggcuuugugaagu

SEQ ID NO: 621368 - RNA, 62 nt, Homo Sapiens
uuuguaaauaguccaugaugaggaauacuuauaaugugaaggaaggagggaaaaaccauaaa

SEQ ID NO: 621369 - RNA, 62 nt, Homo Sapiens
auuugauuuucuacauuuaaagacacaaaucaaaugugaaggagcacauuuuauaauuugga

SEQ ID NO: 621370 - RNA, 62 nt, Homo Sapiens
agggaguauuacuuuuaugucuucugagaggcaaugugaaagcaaaauaugugaauuugcug

SEQ ID NO: 621371 - RNA, 62 nt, Homo Sapiens
uuacauuuuauuaacacuugauuuuacugcacaaugugaaguuagucagaaaccauggauuu

SEQ ID NO: 621372 - RNA, 62 nt, Homo Sapiens
augaauugagcuccuggcccucauccuauggaaaugugaagguaaagggaacaaauaauguu

SEQ ID NO: 621373 - RNA, 62 nt, Homo Sapiens
gccacaucuuaccuguaaaggaguagaaaccaaaugugaauagcccaaaaguaaucgcucug

SEQ ID NO: 621374 - RNA, 62 nt, Homo Sapiens
ucaucacucaagaugccucccuuaugagaucuaaugugaaaaagcugaagacaaccaagagg

SEQ ID NO: 621375 - RNA, 62 nt, Homo Sapiens
gugaaguggcuauccuaaacagcacugauuaaaaugugaauaaauugcuuuagcuucugguc

SEQ ID NO: 621376 - RNA, 62 nt, Homo Sapiens
guuuuccucauguucaguuaaucacuuaucaaaaugugaacuuaagccugccgccaaaauaa

SEQ ID NO: 621377 - RNA, 62 nt, Homo Sapiens
cuuauaucccugaauucugaucugcacuuuugaaugugaaagguuuguuaauguugggauuc

SEQ ID NO: 621378 - RNA, 62 nt, Homo Sapiens
uaaccauaucugacaaaauuguaacaacugaaaaugugaaagacggcuuuggagacaaucaa

SEQ ID NO: 621379 - RNA, 62 nt, Homo Sapiens
caagucugagcacaaaaagaauguagagacugaaugugaaguuaugauucuaaucaagcugu

SEQ ID NO: 621380 - RNA, 62 nt, Homo Sapiens
uacaaagugcaguagacuucuuuuuauuugagaaugugaaaggcacacuuuauaaccuuaag

SEQ ID NO: 621381 - RNA, 62 nt, Homo Sapiens
agcuuugaguguuccuucguccucuguaguaaaaugugaaaaauaaauaugucuaucaaaua

SEQ ID NO: 621382 - RNA, 62 nt, Homo Sapiens
cccaaguuuagaugugcauugaguuggaugaaaaugugaaaggaaaaaaaauaagaaagaaa

SEQ ID NO: 621383 - RNA, 62 nt, Homo Sapiens
ccggcagcggccgaccuagguugggaaggagaaaugugaaacaaccuccugcuucucccacc

SEQ ID NO: 621384 - RNA, 62 nt, Homo Sapiens
caaguuaauuauuucaaaaugaaaaugcauggaaugugaacaacccagggcuuaaccugcua

SEQ ID NO: 621385 - RNA, 62 nt, Homo Sapiens
auacagacaggcaaacauuuauaauugcaaugaaugugaauucuaauuuaugagaaaaugua

SEQ ID NO: 621386 - RNA, 62 nt, Homo Sapiens
aagaaaagagccgcuugaauaaaauggauaauaaugugaaggacuuguacccgaucauaaua

SEQ ID NO: 621387 - RNA, 62 nt, Homo Sapiens
ucauacauguuauuaguuguacuucuaaauuuaaugugaauuaguccuaaucuuuacuaucc

SEQ ID NO: 621388 - RNA, 62 nt, Homo Sapiens
uuucauuuggaaucacagaaaucgggaaagaaaaugugaagagggaucugcugcugcauuaa

SEQ ID NO: 621389 - RNA, 62 nt, Homo Sapiens
ccaaagacuacguuuugcagacugcugaagcaaaugugaaugaaauauaagguuuuaauuau

SEQ ID NO: 621390 - RNA, 62 nt, Homo Sapiens
augauaaaguugugaaauaagugucuuuuuagaaugugaaugucagcugugucccccagucc

SEQ ID NO: 621391 - RNA, 62 nt, Homo Sapiens
aaauuauuuuggauuuuguacaaaaaucugaaaaugugaauaugcugaacaccuuguggaag

SEQ ID NO: 621392 - RNA, 62 nt, Homo Sapiens
ugcuuuuacauuugggcuuaagauguuugauaaaugugaauaccauaggugccacaucuaug

SEQ ID NO: 621393 - RNA, 62 nt, Homo Sapiens
ucuuuccuaucauggaaucuuaguaaagcuggaaugugaagcaaagggagugcuuugugauc

SEQ ID NO: 621394 - RNA, 62 nt, Homo Sapiens
ugagaaaauuuauacuguagagaaacccuggaaaugugaagaacguggcaaaguucuuuacc

SEQ ID NO: 621395 - RNA, 62 nt, Homo Sapiens
uaagagaauucauaccggagagaaacuguacaaaugugaagaauauggcaaagccugugaau

SEQ ID NO: 621396 - RNA, 62 nt, Homo Sapiens
agauaauucauucuggggaaaaaaaugcuacaaaugugaaaaacguggcagagccuucagac

SEQ ID NO: 621397 - RNA, 62 nt, Homo Sapiens
aaugagaacucauacuggaggaaagucuuacaaaugugaagaauguggcagucuuuaaaucu

SEQ ID NO: 621398 - RNA, 62 nt, Homo Sapiens
uucugccagcgcauguguccuuucaaggggaaaaugugaagcugaacccccuccagacaccc

SEQ ID NO: 621399 - RNA, 62 nt, Homo Sapiens
gcacaauauggccuaaacugccauaguuuuagaaugugaaaaaaaugcauguuuacuuaccu

SEQ ID NO: 621400 - RNA, 62 nt, Homo Sapiens
cucccucuccuuaccacgggucagaccuaaagaaugugaacacuuuuuuuuuuuuuucuggg

SEQ ID NO: 621401 - RNA, 62 nt, Homo Sapiens
uuagauuuuugaggauuaugugacuaguaauaaaugugaaauaaauuuucaaaaaaguugac

SEQ ID NO: 621402 - RNA, 55 nt, Homo Sapiens; identical to SEQ ID NO: 451058

SEQ ID NO: 621403 - RNA, 62 nt, Homo Sapiens
cuuauuuucauuuccaaacaacuacuaugauaaaugugaagaagauucuguuuuuuugugac

SEQ ID NO: 621404 - RNA, 62 nt, Homo Sapiens
uagagccagaaguaacuuugucccaguccuacaaugugaaaagagugaauaguugccucuuu

SEQ ID NO: 621405 - RNA, 62 nt, Homo Sapiens
uaugcacacacacacagauaaugcuuccagugaaugugaacuucuuuucccuguggcacuga

SEQ ID NO: 621406 - RNA, 62 nt, Homo Sapiens
cauucguuagucuacauguuucuaaacauauaaaugugaauuuaaucaauuccuuucauagu

SEQ ID NO: 621407 - RNA, 62 nt, Homo Sapiens
auuguaagacuuuugagaauauacuugauuaaaaugugaaagaagggauuguuaacuuauug

SEQ ID NO: 621408 - RNA, 62 nt, Homo Sapiens
auauaauguuaauuuauugacuaguuugaaauaaugugaaguguuuuuuauaucagauuaau

SEQ ID NO: 621409 - RNA, 62 nt, Homo Sapiens
uacgggguugauucugaccauaggaaguaugcaaugugaaucacuauuuacagagaaaccua

SEQ ID NO: 621410 - RNA, 62 nt, Homo Sapiens
uucacuuuuggcgacuagaaacaauuccaguaaaugugaaucucgacaaaucgaggacugaa

SEQ ID NO: 621411 - RNA, 62 nt, Homo Sapiens
aacgagcgaacaacugagcccaagccggugagaaugugaaacaguuucucaaaggaaagaau

SEQ ID NO: 621412 - RNA, 62 nt, Homo Sapiens
ucuugcacaaaagugaucguuuucuuccaaacaaugugaauuuaaaaggucacacaaaagaa

SEQ ID NO: 621413 - RNA, 62 nt, Homo Sapiens
gggaaugugugaaaauaauuggauuuuuaaacaaugugaauaaagaggcuuguguuuugauu

SEQ ID NO: 621414 - RNA, 62 nt, Homo Sapiens
ggauacaguguaaaccagauccauauaaggugaaugugaaaugggagucuucugagggugau

SEQ ID NO: 621415 - RNA, 62 nt, Homo Sapiens
uagaaaaauugcauuggaauagauuuuauuuaaaugugaaccaucaacaaccuacaacaaga

SEQ ID NO: 621416 - RNA, 62 nt, Homo Sapiens
uguacaauuaacugaagaauugauaauaacugaaugugaaacaucaauaaagaccacuuaau

SEQ ID NO: 621417 - RNA, 62 nt, Homo Sapiens
ucccuggccagccuuuccacauuuuucuacucaaugugaauauuuguauucaaaugacgauu

SEQ ID NO: 621418 - RNA, 62 nt, Homo Sapiens
auucuaccacccuuaaaguuauccaacagacaaaugugaacuacuugucaaauagauccuga

SEQ ID NO: 621419 - RNA, 62 nt, Homo Sapiens
gcugauuugauggagcuacugacauuuucaauaaugugaacuaaauuuguaccuaugugaca

SEQ ID NO: 621420 - RNA, 62 nt, Homo Sapiens
uauauuccaggucaaaauuucccauaguuauaaaugugaaauaguucucucacaccaagggc

SEQ ID NO: 621421 - RNA, 62 nt, Homo Sapiens
guauuguaacuauuuuaaggaccaaugguuaaaaugugaauauaaauuuaaaaugcagagag

SEQ ID NO: 621422 - RNA, 62 nt, Homo Sapiens
gauuucuggccuugaggacgaauuauuucaugaaugugaauaguacaaaaaagcuuaucaua

SEQ ID NO: 621423 - RNA, 62 nt, Homo Sapiens
agugaaaaagacuucgcagcuuucacaucccaaaugugaagaucuuauuuuucuguaaaaua

SEQ ID NO: 621424 - RNA, 62 nt, Homo Sapiens
aaaauugaaauggaaaauguaacuuugggcauaaugugaacucauccacugaugaacaugca

SEQ ID NO: 621425 - RNA, 62 nt, Homo Sapiens
uguguguggugucaaaguuuugcgggagguucaaugugaagcgugauaugucugagacugaa

SEQ ID NO: 621426 - RNA, 62 nt, Homo Sapiens
agugucauacuuuugugauuauaauuaauaagaaugugaauaugcaaugggauacuuauuaa

SEQ ID NO: 621427 - RNA, 62 nt, Homo Sapiens
acauaagagucuuaaaagaauaauacccauuuaaugugaaaaggaugaaaauaaugggagua

SEQ ID NO: 621428 - RNA, 62 nt, Homo Sapiens
auuuuuugucucucuccugagacuucuauuuuaaugugaagaguacgcucuaugcauaguau

SEQ ID NO: 621429 - RNA, 62 nt, Homo Sapiens
uguuguacuauacguauaacccuaaaauuaaaaaugugaaacaucuuauacuuaguaugagu

SEQ ID NO: 621430 - RNA, 62 nt, Homo Sapiens
uggaaacaacuucuaguauuaccaggaaggaaaaugugaacaaauacaacucuuuuuuuuaa

SEQ ID NO: 621431 - RNA, 62 nt, Homo Sapiens
uugauguaauaacugcuaaucuggauccucuaaaugugaauugaauuuucuaagacaguccu

SEQ ID NO: 621432 - RNA, 62 nt, Homo Sapiens
uauucugacauuccuaaaauugaccaaaauacaaugugaauucuuaaaaaggcucagguuuu

SEQ ID NO: 621433 - RNA, 62 nt, Homo Sapiens
cggguucuguaguauuuguaacucaaccaaacaaugugaaaacagaauugaaaaagauaaac

SEQ ID NO: 621434 - RNA, 62 nt, Homo Sapiens
cccaaacuuuucuuuuuggccugaaacauuaaaaugugaauuaauuugaguuguucaggcua

SEQ ID NO: 621435 - RNA, 62 nt, Homo Sapiens
gaagaauggaucccaaaaacuagguauuuuagaaugugaauuaugugaagacucugcuaaua

SEQ ID NO: 621436 - RNA, 62 nt, Homo Sapiens
aauaaaauacagcaaauacuucaaauaggcuaaaugugaacacaaaugaaguaguguuaacc

SEQ ID NO: 621437 - RNA, 62 nt, Homo Sapiens
guuuaauaacaugaguccccuucuucaucuauaaugugaaggacgcuuuacuaagccucggc

SEQ ID NO: 621438 - RNA, 62 nt, Homo Sapiens
uccacucuuuuauuauguuguuugugcauaccaaugugaaaaacuguagcuuauauucuuua

SEQ ID NO: 621439 - RNA, 62 nt, Homo Sapiens
uugcaagagaaugauuuccaguaugauauggaaaugugaaguaaguaauagcguaaaguaaa

SEQ ID NO: 621440 - RNA, 62 nt, Homo Sapiens
accagguaauaauuauuuugagacacaaaccgaaugugaaauuugccugggaguagagauaa

SEQ ID NO: 621441 - RNA, 62 nt, Homo Sapiens
caagugcagcucaauacuaguauuuugcuaagaaugugaauuugugugugugcucaggcaau

SEQ ID NO: 621442 - RNA, 62 nt, Homo Sapiens
agcuggaauuuuuuauucuuaacggacgagauaaugugaacuagguggaguggaugccucag

SEQ ID NO: 621443 - RNA, 62 nt, Homo Sapiens
aauucuauaggaacauaugauauuagccagguaaugugaauaaaaaaccccaaacuguugau

SEQ ID NO: 621444 - RNA, 62 nt, Homo Sapiens
gaaggguugucacauuauaaaaucuuuaggaaaaugugaacuggaaaacgcuucggucaguu

SEQ ID NO: 621445 - RNA, 62 nt, Homo Sapiens
auaguuaagcaauuucaaaaaugcuccaaagaaaugugaaaggaccuuuugucacagcacuu

SEQ ID NO: 621446 - RNA, 62 nt, Homo Sapiens
uaaugcggcccccuuccccagagcuuaccucgaaugugaaaucccuacuucuuauaaugcag

SEQ ID NO: 621447 - RNA, 62 nt, Homo Sapiens
auggaugauuuaagugucucacuaaagcaugaaaugugaauuuuuauuguuguacauacgau

SEQ ID NO: 621448 - RNA, 62 nt, Homo Sapiens
caaauaaagggcuguuucuacagguaacauuaaaugugaacucaacacuuccagagucuuua

SEQ ID NO: 621449 - RNA, 62 nt, Homo Sapiens
acaccacuaaagaaacgaucagacagaucuggaaugugaagcguuauagaagauaacuggcc

SEQ ID NO: 621450 - RNA, 62 nt, Homo Sapiens
ucuugauuaaaaguuauguaauaaccaaaugcaaugugaaauauuuuacuggacucuauuuu

SEQ ID NO: 621451 - RNA, 62 nt, Homo Sapiens; identical to SEQ ID NO: 621449

SEQ ID NO: 621452 - RNA, 62 nt, Homo Sapiens; identical to SEQ ID NO: 621450

SEQ ID NO: 621453 - RNA, 62 nt, Homo Sapiens
cagaugugagcuucuauuuguuuagaagcauaaaugugaauuauauacaguuugaauuuugc

SEQ ID NO: 621454 - RNA, 62 nt, Homo Sapiens
cugaaaagcgaauagcaguguuuucagaaacaaaugugaaagcagucaaauuaaguagauac

SEQ ID NO: 621455 - RNA, 62 nt, Homo Sapiens
caccaggagacggccacagacacacacugcuaaaugugaagauggaacuaaacuggaaauua

SEQ ID NO: 621456 - RNA, 62 nt, Homo Sapiens
guuauaaagaaauacacuaaggagagguaguaaaugugaaccuuguugcaguguauaaggug

SEQ ID NO: 621457 - RNA, 62 nt, Homo Sapiens
uacuguuacuaaaagcuuuauaugaaauuauuaaugugaaguuuuucauuuauaauucaagg

SEQ ID NO: 621458 - RNA, 62 nt, Homo Sapiens
agaggguuuugaaauguuuuucaaauaugugaaaugugaaacugcugucuuuuauauuaaag

SEQ ID NO: 621459 - RNA, 62 nt, Homo Sapiens
uaauccaguauuuggaaaguaauccaguuugaaaugugaagauguauuccggcagaauagug

SEQ ID NO: 621460 - RNA, 62 nt, Homo Sapiens
auauaguggcucuacguaauguagccuguauuaaugugaaauauuuaccagaauauucaaua

SEQ ID NO: 621461 - RNA, 62 nt, Homo Sapiens
uuggggucugcuccuaccccaccccauuuaacaaugugaagugacugaggcuggggugccuc

SEQ ID NO: 621462 - RNA, 62 nt, Homo Sapiens
ugugaagcauucaaaucaaagcuaaaagccuaaaugugaaaugcuaaugacaagccugagaa

SEQ ID NO: 621463 - RNA, 62 nt, Homo Sapiens
cugccucacaggugaagauuaaagagacaacgaaugugaaucaugcuugcagguuugagggc

SEQ ID NO: 621464 - RNA, 62 nt, Homo Sapiens
agccacuuugcagaauauguaaagaaaaauauaaugugaauuuuuuauggaacucaguauua

SEQ ID NO: 621465 - RNA, 62 nt, Homo Sapiens
auauuugaaguauuaauuuugauaaucaucuuaaugugaaaguaggaaagauuuacacaaua

SEQ ID NO: 621466 - RNA, 62 nt, Homo Sapiens
auuuggguuucaaauguuaaauccaaaaacaaaaugugaaccacauacucauucccaaagca

SEQ ID NO: 621467 - RNA, 62 nt, Homo Sapiens
cuggauuuuaauuggcauguucauuaggugccaaugugaagucuuuggucauucugcugugu

SEQ ID NO: 621468 - RNA, 62 nt, Homo Sapiens
ccaguuucuugggcaagucagaauggcaauuaaaugugaaacuuauuuuuuauggauacucu

SEQ ID NO: 621469 - RNA, 62 nt, Homo Sapiens
ugaaggucaauaaauuauuauuuuuuuuucacaaugugaaacuuuuguaaaacuguuauuuu

SEQ ID NO: 621470 - RNA, 62 nt, Homo Sapiens
ugccauguugccuuuucucuucuuucaugugaaaugugaagcccaggcccaguuaaugcuag

SEQ ID NO: 621471 - RNA, 62 nt, Homo Sapiens
gauugauauauuguuguuagauucuauauaagaaugugaaaaguauuucauuagauucucug

SEQ ID NO: 621472 - RNA, 62 nt, Homo Sapiens
cauaaaauauauuaaaacuuuuuaaaaaguauaaugugaaaaauaucaaacguuuaacuuua

SEQ ID NO: 621473 - RNA, 62 nt, Homo Sapiens
ucugucgauucaucuccaauuccuucucuuggaaugugaagauuucagucuaggaaagauuu

SEQ ID NO: 621474 - RNA, 62 nt, Homo Sapiens
acugggugcuagacaagaagccacagaagaaaaaugugaaagggugaauaaguuauaaauuc

SEQ ID NO: 621475 - RNA, 62 nt, Homo Sapiens
aauaagguaaaguauaucauugcuauuacuucaaugugaauaaacauagaacugugauauuu

SEQ ID NO: 621476 - RNA, 62 nt, Homo Sapiens
uugucucuaaauauuuuuuauauuuugcuauuaaugugaaaguauuauuaacaugaauauau

SEQ ID NO: 621477 - RNA, 62 nt, Homo Sapiens
guguuucaaagguauguaguagcguuuauuugaaugugaauacugugccuggcuagaaaaca

SEQ ID NO: 621478 - RNA, 62 nt, Homo Sapiens
uuuaacaggaauaggauagcuagacauuuuuaaaugugaagcuuguacaagcacauaugaug

SEQ ID NO: 621479 - RNA, 62 nt, Homo Sapiens
gaauuucaaaacaggaucuauaaaucgaauguaaugugaauggaaaaaaaaaggcauucuag

SEQ ID NO: 621480 - RNA, 62 nt, Homo Sapiens
gaguuuuggcuuguucuaaagucauuaugaugaaugugaaaaugcugcuacuuuaaagugug

SEQ ID NO: 621481 - RNA, 62 nt, Homo Sapiens
aaagugggguccuucggggccaaagccagugaaaugugaaggcugagcccuggggacuguuc

SEQ ID NO: 621482 - RNA, 62 nt, Homo Sapiens
auuauuuaaaugcuuuuaaauuuaauauuuccaaugugaaaggcgaucaugucaguuggccc

SEQ ID NO: 621483 - RNA, 62 nt, Homo Sapiens
aauuaacugaauuugcucugacagacugaaauaaugugaaugaugauuuuguugacaugacu

SEQ ID NO: 621484 - RNA, 62 nt, Homo Sapiens
uugccaagcuguccgugagaugcuuuuccaagaaugugaaucuuuuaacccucgcauuccuc

SEQ ID NO: 621485 - RNA, 62 nt, Homo Sapiens
caacucuuugguuaauaguaagacuuaucuggaaugugaacauucugaaugcuuuuccacgu

SEQ ID NO: 621486 - RNA, 62 nt, Homo Sapiens
auaauaucuuuaauauaacuaauucaauaaaaaaugugaacaaaugauuuugcuacauuugg

SEQ ID NO: 621487 - RNA, 62 nt, Homo Sapiens
aaauguguucuccuauuccuuggacuuaguauaaugugaaaaccccagagccugggcucugc

SEQ ID NO: 621488 - RNA, 62 nt, Homo Sapiens
auugcaucugcauuuuccaauuguaaaaggcgaaugugaaauuuuauguaacauuugcuagc

SEQ ID NO: 621489 - RNA, 62 nt, Homo Sapiens
uucuuuuuauuugggagauugggauccagggcaaugugaauucugugcguuuguaugugucu

SEQ ID NO: 621490 - RNA, 62 nt, Homo Sapiens
uaauuuuauuuguacugacaccuauuaugcaaaaugugaauucugauccaucaggaucaguc

SEQ ID NO: 621491 - RNA, 62 nt, Homo Sapiens
uuuuuuuuuaccgggauuauggcccaggagccaaugugaacuuccggcggggccugucccug

SEQ ID NO: 621492 - RNA, 62 nt, Homo Sapiens
aaaucuucaaaaucaguagaucugagugauggaaugugaagcacuugagagaaaaacuuaga

SEQ ID NO: 621493 - RNA, 62 nt, Homo Sapiens
auacugagaaaaaguccugucaguucagaaaaaaugugaagucuacuuuaguauuccuguaa

SEQ ID NO: 621494 - RNA, 62 nt, Homo Sapiens
gagagccacuaggaggccugcaguuauuuuugaaugugaaaaugcauuugcguucaucuugu

SEQ ID NO: 621495 - RNA, 62 nt, Homo Sapiens
caucuugugguuauucuggguuguggaaggaaaaugugaaugaaaguagugcuggaugcaau

SEQ ID NO: 621496 - RNA, 62 nt, Homo Sapiens
caaaaaagaugcaguuuuccuuuguauugggaaaugugaaaauaaaauugucaacucuuuca

SEQ ID NO: 621497 - RNA, 62 nt, Homo Sapiens
cucuccuccaccccaggcuuagaggacagaaaaaugugaagagacgccccacccacccucag

SEQ ID NO: 621498 - RNA, 62 nt, Homo Sapiens
uagacucacacaguugccugaagcaguuggggaaugugaaagucucacugaguuaguucuua

SEQ ID NO: 621499 - RNA, 62 nt, Homo Sapiens
ugacccuuuauauuuguucuaaaauaagucaaaaugugaaaauaauauuaaaucuaagauau

SEQ ID NO: 621500 - RNA, 62 nt, Homo Sapiens
gaagaaucuaauaggaugcugguuguguauuaaaugugaaauugcauagauaaagguagaug

SEQ ID NO: 621501 - RNA, 62 nt, Homo Sapiens
aaacagcugucaaaucucaaggugaagaucuaaaugugaacaguuuacuaaugcacuacuga

SEQ ID NO: 621502 - RNA, 62 nt, Homo Sapiens
acaugacuuuugcauccauuguauuaucagaaaaugugaagaagaaaaaaaugccauguuuu

SEQ ID NO: 621503 - RNA, 62 nt, Homo Sapiens
gggccugugauuuccugucaguguccucagcuaaugugaacaguguuggucugcugguuaga

SEQ ID NO: 621504 - RNA, 62 nt, Homo Sapiens
cuuuucuuuagucccaaccacuaguuuuaacaaaugugaauuauugaaaugugaagggacaa

SEQ ID NO: 621505 - RNA, 62 nt, Homo Sapiens
aaccacuaguuuuaacaaaugugaauuauugaaaugugaagggacaaaaagaaucauacauu

SEQ ID NO: 621506 - RNA, 62 nt, Homo Sapiens
auuuucugugagcacacuaaaagcgaaaaauaaaugugaauaaaauguacaaauuuguugug

SEQ ID NO: 621507 - RNA, 62 nt, Homo Sapiens
ccugaaauuccguaaguacauagucaaaacacaaugugaagaauuuguuuaaaaacauccug

SEQ ID NO: 621508 - RNA, 62 nt, Homo Sapiens
ugaguuccucauuuguugguaaaaagaaaaagaaugugaaaaugucucuuuuuuucuuggcu

SEQ ID NO: 621509 - RNA, 62 nt, Homo Sapiens
ugacuucaccugaggcaucacagagacaaaagaaugugaagcuacuuaacaaaguaaggcaa

SEQ ID NO: 621510 - RNA, 62 nt, Homo Sapiens
aauauuuuguguugaucauuauuuccauucuuaaugugaaaaaaaguaauuauuuauacuua

SEQ ID NO: 621511 - RNA, 62 nt, Homo Sapiens
augucuuuaagaaaaagaaaucaaucugcagaaaugugaagauuugcaagcaguguaaacug

SEQ ID NO: 621512 - RNA, 62 nt, Homo Sapiens
caguuaaacucauugucuguuuggaagaccagaaugugaagacaaguaguagaagaaaauga

SEQ ID NO: 621513 - RNA, 62 nt, Homo Sapiens
cuucccuuucugcuuguguuaaguauguguaaaaugugaagugaaugaaacacucaguuguu

SEQ ID NO: 621514 - RNA, 62 nt, Homo Sapiens
cgugguagccgacugugaggaaaagcagagggaaugugaaagaaaauaagagaauccacggg

SEQ ID NO: 621515 - RNA, 62 nt, Homo Sapiens
cucugcucaccuugguuuccgcacaccuucgcaaugugaacaggucaggagucccucccguc

SEQ ID NO: 621516 - RNA, 62 nt, Homo Sapiens
ugaacuggagugccucugcucccucgacccugaaugugaacugguagucuuagcagggggag

SEQ ID NO: 621517 - RNA, 62 nt, Homo Sapiens
ccugagauggagcugaacauaaguuaugcacaaaugugaacacccugucagccuuucaauaa

SEQ ID NO: 621518 - RNA, 62 nt, Homo Sapiens
ggcaaugaucucuuauugagaggaggcagggaaaugugaaauauagcagugugcaugcaggc

SEQ ID NO: 621519 - RNA, 62 nt, Homo Sapiens
augaacuaguaugugacaauuuuaaagggaugaaugugaauuuauugaaaguuucaaugugg

SEQ ID NO: 621520 - RNA, 62 nt, Homo Sapiens
cagggaacuggggaaggcuguagaauugaaucaaugugaacuugggcaggucuagugagcug

SEQ ID NO: 621521 - RNA, 62 nt, Homo Sapiens
gagcaaucagaauugugcuucugagauacugaaaugugaaaauuccuauuuucgaugaaguu

SEQ ID NO: 621522 - RNA, 62 nt, Homo Sapiens
agccucuugcccuguaccuucuaauggacuaaaaugugaaacugguugggcucugccaaaga

SEQ ID NO: 621523 - RNA, 62 nt, Homo Sapiens
agcaccaucaaaauauaauguaagcuuuugagaaugugaaauacguuuuguguagaucuuua

SEQ ID NO: 621524 - RNA, 62 nt, Homo Sapiens
ugagugaagcucccuucagggugaaugaagcuaaugugaauguugaaugacugacccaaaau

SEQ ID NO: 621525 - RNA, 62 nt, Homo Sapiens
aagcuaaugugaaugugaguugacugacccaaaaugugaauguuugacacacaguuguugaa

SEQ ID NO: 621526 - RNA, 62 nt, Homo Sapiens
uuaaaugaccugcaucaaguagacacugugcuaaugugaauucuguauuaucaauuucucau

SEQ ID NO: 621527 - RNA, 62 nt, Homo Sapiens
cuggcccagcuugcuggaaagaaaaguaaauuaaugugaaacucauuuucuguauuauauau

SEQ ID NO: 621528 - RNA, 62 nt, Homo Sapiens
uguaauaaaauggaaaugaaauuucaggaaauaaugugaacaaaacaaaagguucuaagaug

SEQ ID NO: 621529 - RNA, 62 nt, Homo Sapiens
guaacuguccguaguaucagaacuuucacuauaaugugaaauaauaaugccuuuguaaccac

SEQ ID NO: 621530 - RNA, 62 nt, Homo Sapiens
acgugauacuucgcaggcgugaauauaaacucaaugugaaucuggaaaacuggugacaguga

SEQ ID NO: 621531 - RNA, 62 nt, Homo Sapiens
uuguaaccucaagauuaggauaucagugucucaaugugaagauuuauuaaaguaugugugug

SEQ ID NO: 621532 - RNA, 62 nt, Homo Sapiens
uuagcaaaaccaugaaugguaguuggaaauaaaaugugaaaacggcaucuuguuacugcaau

SEQ ID NO: 621533 - RNA, 62 nt, Homo Sapiens
gaauauaacaauucagcuuaaaaauauuuauuaaugugaaugaaucuacaauuucuucuuua

SEQ ID NO: 621534 - RNA, 62 nt, Homo Sapiens
ucaaagaauuaaguucuagucacuuuuuaaaaaaugugaaaguguuuaugaucccagcaaua

SEQ ID NO: 621535 - RNA, 62 nt, Homo Sapiens
uaaucaacacuauugaacugucauugcacaacaaugugaauagauuucaaagaccacugucu

SEQ ID NO: 621536 - RNA, 62 nt, Homo Sapiens
aaagguguuugcguuauuagugcuacucagcaaaugugaauaaaugaagaaaacacuguaau

SEQ ID NO: 621537 - RNA, 62 nt, Homo Sapiens
aucuuuugugucuauauugagauaauuuuucaaaugugaauuagaguucuauucuucaggua

SEQ ID NO: 621538 - RNA, 62 nt, Homo Sapiens
aacauuauuuuuucaaagcaaaaauguuuuaaaaugugaaaauccuuuugcaaaagcagacu

SEQ ID NO: 621539 - RNA, 62 nt, Homo Sapiens
ccaugccuuacauuuacacagagucagauuucaaugugaaacuaagaaagagauuguguuug

SEQ ID NO: 621540 - RNA, 62 nt, Homo Sapiens
cacgcgcuagaaaucgcaguccccagagauagaaugugaagaagagccuguuugucuugcuu

SEQ ID NO: 621541 - RNA, 62 nt, Homo Sapiens
uugauaucuccaugaugauaguugaauguugcaaugugaaaaaucugcuguuaacugcaacc

SEQ ID NO: 621542 - RNA, 62 nt, Homo Sapiens
gaaaacuugaaaaaguauaagcauuuguuaaaaaugugaauuucuugaaugaauuucacauu

SEQ ID NO: 621543 - RNA, 62 nt, Homo Sapiens
auauaauuuacuucuuauaaauugaagucuuaaaugugaaaccaagaaauguaaucaagcag

SEQ ID NO: 621544 - RNA, 62 nt, Homo Sapiens
auguuccuaagacccuugucccagauacucuaaaugugaauguaugagcugggggagucaac

SEQ ID NO: 621545 - RNA, 62 nt, Homo Sapiens
cacuuuuagaacuaugaguacuacuuuuguuaaaugugaaaaacccucacagaaagucaucg

SEQ ID NO: 621546 - RNA, 62 nt, Homo Sapiens
acucucagagaccuuaaaaagaaguuuacugcaaugugaauaauuuaaucucugguugccaa

SEQ ID NO: 621547 - RNA, 62 nt, Homo Sapiens
cauaggaaaauucauacuggagagaaacuacaaaugugaagaauguguuaaagccuuuaaca

SEQ ID NO: 621548 - RNA, 62 nt, Homo Sapiens
uugagaaaauucguacuggagagaauccuacaaaugugaaaaauguggcaaauccuuuaacu

SEQ ID NO: 621549 - RNA, 62 nt, Homo Sapiens
uaagaaaauucauacuggaaagaaacccuacaaaugugaagucuguggcaaagcuuuuaacu

SEQ ID NO: 621550 - RNA, 62 nt, Homo Sapiens
aagacaguuuauacuuugagagaaacccugcaaaugugaauaauguggcaauacuuuaaacc

SEQ ID NO: 621551 - RNA, 62 nt, Homo Sapiens
uaacauaaaucauacuggugaaaaauccuagaaaugugaaaaauaucacaaagccuuuaaau

SEQ ID NO: 621552 - RNA, 62 nt, Homo Sapiens
uaagaaaauuuacacuagagagaaagccuacaaaugugaagaauguggcaaagccuuuaacc

SEQ ID NO: 621553 - RNA, 62 nt, Homo Sapiens
uaagauaauucauagcggagagaaaccccacaaaugugaagaauguggcagagcuuuuaacc

SEQ ID NO: 621554 - RNA, 62 nt, Homo Sapiens
uaagauaauucacaguggagaaaaacccuacaaaugugaagaauguggcaaagcuuuuaacc

SEQ ID NO: 621555 - RNA, 62 nt, Homo Sapiens
uaagaaaauucauaguaaagagaaacccuacaaaugugaacaguguggcaaggucuuuaaga

SEQ ID NO: 621556 - RNA, 62 nt, Homo Sapiens
caagaagauucauacuagagagaaacccuacaaaugugaagaauguggcauaucuuuuaacc

SEQ ID NO: 621557 - RNA, 62 nt, Homo Sapiens
uaagaugauucacacuugaaugaaacccuacaaaugugaacgauguggcaguuguuuuaacu

SEQ ID NO: 621558 - RNA, 62 nt, Homo Sapiens
uaagaaaauucaaacuggagagaaacucuacaaaugugaagaauguggcaaagcuuuuaacc

SEQ ID NO: 621559 - RNA, 62 nt, Homo Sapiens
accuaaaauucaugcaggagagaaacaccacaaaugugaaaaauuugguaaauucuuuaaca

SEQ ID NO: 621560 - RNA, 51 nt, Homo Sapiens; identical to SEQ ID NO: 451216

SEQ ID NO: 621561 - RNA, 62 nt, Homo Sapiens
uuuguauuuuauuuuucaaaauaaaagcuuucaaugugaagcauucugguaguuacauguuu

SEQ ID NO: 621562 - RNA, 62 nt, Homo Sapiens
cugcuaguuuuuaugagaaguauauuauauuaaaugugaauuuuuuaaauuuugcuucuuau

SEQ ID NO: 621563 - RNA, 62 nt, Homo Sapiens
uggcugugacuguggccgccacggccacccggaaugugaagggcgcuccgggcucugagccc

SEQ ID NO: 621564 - RNA, 62 nt, Homo Sapiens
guggaggagacugcccuguccugagccuggaaaaugugaaacugucuccugcaaccugcugg

SEQ ID NO: 621565 - RNA, 62 nt, Homo Sapiens
ccauacuagagagaagcccuacaaauguaaagaaugugaaaagucuuucagucagagcucaa

SEQ ID NO: 621566 - RNA, 62 nt, Homo Sapiens
uaaaagaauacacacuagagaaaaaccuuacaaaugugaagcaucugauaaauccugugaag

SEQ ID NO: 621567 - RNA, 62 nt, Homo Sapiens
ucacaugggaauaaaauuccauugcugcaaugaaugugaaaaagccaucagucaaagaaacu

SEQ ID NO: 621568 - RNA, 62 nt, Homo Sapiens
uaaaaggaaaacagaaaaaggaaaaguaggcaaaugugaaaauaguuucaauauaucuuaug

SEQ ID NO: 621569 - RNA, 62 nt, Homo Sapiens
aguaaauaauuguaucuuuccauagcuuuucaaaugugaaaucauuuuuggaagcuuggauc

SEQ ID NO: 621570 - RNA, 62 nt, Homo Sapiens
cuguuugagaaugaugcuacucugaucuaaugaaugugaacauguagauguuuuguguguau

SEQ ID NO: 621571 - RNA, 62 nt, Homo Sapiens
cacacuuguauauacauucuugagaacacugcaaugugaaaaucacguuugcuauuuauaaa

SEQ ID NO: 621572 - RNA, 62 nt, Homo Sapiens
auaauuccacagccucuucuaacaaugccuacaaugugaauuccucccaaccucugggaucc

SEQ ID NO: 621573 - RNA, 62 nt, Homo Sapiens
ucauuuccauuucuaagcagcaagaugaacacaaugugaauagauucauuuuaucgagaugc

SEQ ID NO: 621574 - RNA, 62 nt, Homo Sapiens
aaaaaaagaaauuugauuuucauccaaucucaaaugugaaaauacccccucaauaucaugau

SEQ ID NO: 621575 - RNA, 62 nt, Homo Sapiens
uguucuuacauuauggcuccagucgaguuuucaaugugaauugguauaugaacaaauuuucu

SEQ ID NO: 621576 - RNA, 62 nt, Homo Sapiens
gcggcuggacuuggagguagcuuuccaaagccaaugugaacaaggugcccagaaugaggcug

SEQ ID NO: 621577 - RNA, 62 nt, Homo Sapiens
auguggcaaugcuuguaacuagaaacccugcaaaugugaagauaagacaauucauauuugag

SEQ ID NO: 621578 - RNA, 62 nt, Homo Sapiens
auguggcaaagcuuuuaaccagaaacccuacaaaugugaagauaagagaauucauacuggag

SEQ ID NO: 621579 - RNA, 62 nt, Homo Sapiens
aaauuauucaugcucucauaauuagauggaaaaaugugaaaaauuauuuucuccaaauaaaa

SEQ ID NO: 621580 - RNA, 62 nt, Homo Sapiens
uaaaaucuaaauaaaggaaucauaaaaaacuaaaugugaauauauaaagucuuaaaugugug

SEQ ID NO: 621581 - RNA, 62 nt, Homo Sapiens
uaaguaauuacugaacuuuauugugacagaauaaugugaaguauagguagcacauuuaucau

SEQ ID NO: 621582 - RNA, 62 nt, Homo Sapiens
caaauauuucuucguguuggucuuuaugcuguaaugugaaagagcugucaaagcuuaggugg

SEQ ID NO: 621583 - RNA, 62 nt, Homo Sapiens
guuaauguagaaauguuuguuagaugacgaugaaugugaaggaugugugaaugccauaucug

SEQ ID NO: 621584 - RNA, 62 nt, Homo Sapiens
acuucuuuaaaaacuccuucuaagcauauuaaaaugugaaauuuugcguacucucucucucu

SEQ ID NO: 621585 - RNA, 62 nt, Homo Sapiens
gaaaacacugacuuuguuuuuauaaguuauuaaaugugaaauugaucugcaucagcuuauuu

SEQ ID NO: 621586 - RNA, 62 nt, Homo Sapiens
aaaacauuuguaaggcugcaacauaauauuaaaaugugaauaaauaaauguucugauaaaau

SEQ ID NO: 621587 - RNA, 62 nt, Homo Sapiens
uacccaaucaagaauagacccuucacacaggaaaugugaacaauuguuauauaugaacacuc

SEQ ID NO: 621588 - RNA, 62 nt, Homo Sapiens
uuccuccucaccagaaaucccugggcuuccacaaugugaacucacucauugucagguguccg

SEQ ID NO: 621589 - RNA, 62 nt, Homo Sapiens
cuucagugauauacuuguucguucauuucuaaaaugugaagcuuuaggaccaaauuguuaga

SEQ ID NO: 621590 - RNA, 62 nt, Homo Sapiens
uuuaaugaaagguggaaaauaauuuaacuuacaaugugaaaauacaaugugaaauguacaau

SEQ ID NO: 621591 - RNA, 62 nt, Homo Sapiens
ggaaaauaauuuaacuuacaaugugaaaauacaaugugaaauguacaauaaaucauauuuau

SEQ ID NO: 621592 - RNA, 62 nt, Homo Sapiens
ugagauuaaaguuagucuuaaaauguaaauaaaaugugaaacguguccucagagacugugcc

SEQ ID NO: 621593 - RNA, 62 nt, Homo Sapiens
cccgaggcgcagcaauaauaaggcagcuguugaaugugaagggucccuuuggaaaauuaacc

SEQ ID NO: 621594 - RNA, 62 nt, Homo Sapiens
auaugccacuaauaaaaugaaucuaaacauugaaugugaauggcccucagaaaaucaucuag

SEQ ID NO: 621595 - RNA, 62 nt, Homo Sapiens
ucauauacuauugauccuuuggcacuuaaauaaaugugaaauccuccaggaauuuuccugug

SEQ ID NO: 621596 - RNA, 62 nt, Homo Sapiens
aaaauguguuuacuucagaacggcacuacauaaaugugaaaaguuguugaucuugaaauauc

SEQ ID NO: 621597 - RNA, 62 nt, Homo Sapiens
ugacuuuaaugaaucuuugguguggaaugaaaaaugugaacuucuuacucauagugugguuu

SEQ ID NO: 621598 - RNA, 62 nt, Homo Sapiens
cuuuauuauagagacauuugaaaauauccauuaaugugaauaucaccugaauucagucuguu

SEQ ID NO: 621599 - RNA, 62 nt, Homo Sapiens
cuucaucucuuacuugauagacuuacuaauaaaaugugaagacuagaccaauugucaugcuu

SEQ ID NO: 621600 - RNA, 62 nt, Homo Sapiens
aguaucugagauauacaaaucucccuguaggaaaugugaaagaaaagcacaacaaaacuagg

SEQ ID NO: 621601 - RNA, 62 nt, Homo Sapiens
aguaacacuuuguacauaacaaauacucagcaaaugugaaacuuuauuugcucuuacuucaa

SEQ ID NO: 621602 - RNA, 62 nt, Homo Sapiens
uuuaugaauaauaugcagagaugcauauuaggaaugugaagccagaaugggucaguuguagc

SEQ ID NO: 621603 - RNA, 62 nt, Homo Sapiens
ucugaauaaccugcgugucuaaaaccacgugaaaugugaaugauuauuggcaauauuaccuu

SEQ ID NO: 621604 - RNA, 62 nt, Homo Sapiens
gagaaguucccauuauuauuucuguucuuacaaaugugaaacggaagcucauagaggugaga

SEQ ID NO: 621605 - RNA, 62 nt, Homo Sapiens
ccaaaguggauuuauccugcaauauaaaacaaaaugugaaaagaaaacacuugaauugacgc

SEQ ID NO: 621606 - RNA, 62 nt, Homo Sapiens
uauaaaauaaauauaugcuauaaaauguuauaaaugugaaguuuuauuggcgguauacaaag

SEQ ID NO: 621607 - RNA, 62 nt, Homo Sapiens
uucugaaucccuauuccagguggcaccuccacaaugugaauuggccaggcucucccgagucg

SEQ ID NO: 621608 - RNA, 62 nt, Homo Sapiens
guaauguuuuuacagcaacaaaauuuuuuaaaaaugugaaauguauuauuuuuacuguuaaa

SEQ ID NO: 621609 - RNA, 62 nt, Homo Sapiens
cccaguggaucauguuggaaaugaauuuauagaaugugaagaacuggugaauuacagaccug

SEQ ID NO: 621610 - RNA, 62 nt, Homo Sapiens
gcagcuguggguuuuaccacaaauaaauuggaaaugugaaucacagcuucagaaagagcuca

SEQ ID NO: 621611 - RNA, 62 nt, Homo Sapiens
aaaauuuaauucugacuuuuaugguuucuaucaaugugaaauggaaaguguaaauguuuuuc

SEQ ID NO: 621612 - RNA, 62 nt, Homo Sapiens
caucuuuccuugcaauauuuucuuucugauucaaugugaaucacaguccuacuccgauguua

SEQ ID NO: 621613 - RNA, 62 nt, Homo Sapiens
uuuuuguagcuaaauuguaaccuagaguauaaaaugugaauguagcaucuauguuacacucu

SEQ ID NO: 621614 - RNA, 62 nt, Homo Sapiens
aaaaaccaccauuuauaauauccaccuaucuuaaugugaauuuuugcaaaauuggauuaaau

SEQ ID NO: 621615 - RNA, 62 nt, Homo Sapiens
ugcauuguaguuuaaccauaauguguuggacaaaugugaagacaaugguguuuuucuuguaa

SEQ ID NO: 621616 - RNA, 62 nt, Homo Sapiens
gguaaaggucgaucuugauaaaauauggaacaaaugugaacuuaagccuauuguuuaaugca

SEQ ID NO: 621617 - RNA, 62 nt, Homo Sapiens
uuauuuauaauagcaauaaagacagaugccuuaaugugaagcaaaucuuuuucauagguaau

SEQ ID NO: 621618 - RNA, 62 nt, Homo Sapiens
gaaucaaguaauucugcuuauagagguccagcaaugugaaaacggaaaauuuacaagcaacc

SEQ ID NO: 621619 - RNA, 62 nt, Homo Sapiens
acugauaggcuuuuaagcuugauuuaaauuugaaugugaaauaauuuacugguauacuaagu

SEQ ID NO: 621620 - RNA, 62 nt, Homo Sapiens
uugguugacugauguucaugaauccugcccaaaaugugaagcuaaaaaauuuauacuuaaaa

SEQ ID NO: 621621 - RNA, 62 nt, Homo Sapiens
agaaucacguaguaaauguauacugcaccaaaaaugugaaaagggugaagcuuugaaauaaa

SEQ ID NO: 621622 - RNA, 62 nt, Homo Sapiens
ucucacuagaauugguauggugggaauuuaagaaugugaacuggagaaaugcaguugcugac

SEQ ID NO: 621623 - RNA, 62 nt, Homo Sapiens
cauuuaaaaaugauaauagcggcaguuuuaaaaaugugaaaaaaauacauccaaaaggguaa

SEQ ID NO: 621624 - RNA, 62 nt, Homo Sapiens
auuugccagacagagaucagaauugaaccgucaaugugaaauaaagaguucuccuuguacuu

SEQ ID NO: 621625 - RNA, 62 nt, Homo Sapiens
auguaaacaucauaaauaguaaauaaugauucaaugugaauuuuaaaaugcaaauauugcua

SEQ ID NO: 621626 - RNA, 62 nt, Homo Sapiens
uauguaccuuuugauagauccacauaaaaagaaaugugaaguuuucuuuuacuaucuuuuca

SEQ ID NO: 621627 - RNA, 62 nt, Homo Sapiens
uugucuuuuucugcccaucugucuacuaauaaaaugugaaauaaaauaccuguauugcuacu

SEQ ID NO: 621628 - RNA, 62 nt, Homo Sapiens
cugccuucaaggacuguuucagugugagucagaaugugaaaaaggaauaaaaaauacuguug

SEQ ID NO: 621629 - RNA, 62 nt, Homo Sapiens
cucaaaaaaaauaaaauaaaaagucaauuuagaaugugaaauucugaccaccuuuuggcuuu

SEQ ID NO: 621630 - RNA, 62 nt, Homo Sapiens
gacauuuuuccguuugcuuuuguuccaaugucaaugugaacguccacaugaaaccuacacac

SEQ ID NO: 621631 - RNA, 62 nt, Homo Sapiens
gguuguaguugaaaauuuuauaaaauaccguuaaugugaaguuuuucuuuagucacagaagu

SEQ ID NO: 621632 - RNA, 62 nt, Homo Sapiens
agagcaagcaaaucuuuuuaaaaaauaguaugaaugugaauacuagaaaagauuuaaaaaau

SEQ ID NO: 621633 - RNA, 62 nt, Homo Sapiens
aagacugccaaggagcagauuuucucccuggaaaugugaaaacugaaccuauaacucugaua

SEQ ID NO: 621634 - RNA, 62 nt, Homo Sapiens
cgagccacggcagcccccuguaucuggauuguaaugugaaucuuuaggguaauuccuccagu

SEQ ID NO: 621635 - RNA, 62 nt, Homo Sapiens
caaacaggauuaacugugaagacuaauuuauaaaugugaaccuaagaaaacuccaccucuga

SEQ ID NO: 621636 - RNA, 62 nt, Homo Sapiens
cugugggagggaaggacaaggguucccuuggaaaugugaagggucuuggccucaucccucag

SEQ ID NO: 621637 - RNA, 62 nt, Homo Sapiens
guuggacaaauuuugaguuuuuaucauuaggaaaugugaaacaaacugugcaagcuuucuuu

SEQ ID NO: 621638 - RNA, 62 nt, Homo Sapiens
gucauaauagcuuucccaucaugacauguucgaaugugaaagcaccaaauuuacacaacaaa

SEQ ID NO: 621639 - RNA, 62 nt, Homo Sapiens
cauauuuagauuuuauauaccaaaaucuggaaaaugugaaagucuguccuuaauuuuuugag

SEQ ID NO: 621640 - RNA, 62 nt, Homo Sapiens
aacuuauuuaauuuauggcaugggggaaaaaaaaugugaacuacuaacuguaacuuaagugc

SEQ ID NO: 621641 - RNA, 62 nt, Homo Sapiens
uauuuguguuuguuuugucuacaaacauaggaaaugugaaaauuuaugaaguaaaguuaaaa

SEQ ID NO: 621642 - RNA, 62 nt, Homo Sapiens
uugaaaauuacuacuuaaucuaaaaucaaguuaaugugaauuaugacucacaaaacugauuu

SEQ ID NO: 621643 - RNA, 62 nt, Homo Sapiens
uauaccaaauaaaguuucuacuauauaccaaaaaugugaagugcauuaagaaaauaaaauuu

SEQ ID NO: 621644 - RNA, 62 nt, Homo Sapiens
auuuauauauugcacauucuuguuaauuuuuuaaugugaauauuacugcauaugaggcuuuc

SEQ ID NO: 621645 - RNA, 62 nt, Homo Sapiens
aggcucaccuaaggaaacugguuuugauacugaaugugaacaaaaauaauaaaugucagcug

SEQ ID NO: 621646 - RNA, 62 nt, Homo Sapiens
gugcauuacacuauucuuauaacaaagacaguaaugugaagagcuguuagaaaaacagaauu

SEQ ID NO: 621647 - RNA, 62 nt, Homo Sapiens
cugaaugauagagauauuuuaaacuugaacauaaugugaaggcuuucccugcagugucuuug

SEQ ID NO: 621648 - RNA, 62 nt, Homo Sapiens
cgagacauuauaucuucucuguauucuuugcaaaugugaaagggggaugaggguuagccaua

SEQ ID NO: 621649 - RNA, 62 nt, Homo Sapiens
acuagaaauaaaaacccacagauucuauggucaaugugaaggcagguuuggaagccacaggc

SEQ ID NO: 621650 - RNA, 62 nt, Homo Sapiens
cagagguuucggauucgugaauucccaguaggaaugugaagcugacugcgggcugggggggc

SEQ ID NO: 621651 - RNA, 62 nt, Homo Sapiens
augucccuuuuaaccaugguuugguuuaauaaaaugugaauaugacagcaauuuucuaauau

SEQ ID NO: 621652 - RNA, 62 nt, Homo Sapiens
gucaucuuguacuuacaccuuuuuuuuaaaaaaaugugaaauuauauucccaugaaggauuc

SEQ ID NO: 621653 - RNA, 62 nt, Homo Sapiens
aucaaagucagggcaagaaacugcuccucagcaaugugaagaaugagauuaagcuucaauca

SEQ ID NO: 621654 - RNA, 62 nt, Homo Sapiens
cucaguggccgcuccuucuugugcugcaacuaaaugugaaagggcccacuuccagggcccag

SEQ ID NO: 621655 - RNA, 62 nt, Homo Sapiens
ccuuuuaauuuuuaauccaucacuuuggaaagaaugugaaaugugccagacaccgggcagua

SEQ ID NO: 621656 - RNA, 62 nt, Homo Sapiens
uguuuaauguuacaguguuguacaguuuacagaaugugaagaaugcagccaaugcauuuucu

SEQ ID NO: 621657 - RNA, 62 nt, Homo Sapiens
ucuaccaaauaguagagcaucugugacaagccaaugugaauugccagcagaacugaagugug

SEQ ID NO: 621658 - RNA, 62 nt, Homo Sapiens
uacauuugacauagaaugaauguauuguagacaaugugaaaacacaguaauguuauuaucua

SEQ ID NO: 621659 - RNA, 62 nt, Homo Sapiens
ugaugacuucuggcacgcggacaacgucuacaaaugugaagaaaagccugucuuccgcuaga

SEQ ID NO: 621660 - RNA, 62 nt, Homo Sapiens
ugaacaguagggcauuacauuugugugaauuaaaugugaacuucuguauuacguugcggcgu

SEQ ID NO: 621661 - RNA, 62 nt, Homo Sapiens
ugaccucaucuagcuaugaauucugggaagucaaugugaaaaacauugcugcauucaugcaa

SEQ ID NO: 621662 - RNA, 62 nt, Homo Sapiens
cuguaaauuugcauaacuggauguacuuagauaaugugaaauaaacauuaaagacaaggucu

SEQ ID NO: 621663 - RNA, 62 nt, Homo Sapiens
ugauuuuguuauacuugacuuaacuuuauugcaaugugaauuaauugcacugcuaaguagga

SEQ ID NO: 621664 - RNA, 62 nt, Homo Sapiens
aggaacuacugaggaucagaguaauccaagcaaaugugaaucauuuuaccuuugacaaaggu

SEQ ID NO: 621665 - RNA, 62 nt, Homo Sapiens
agucaauagucuucccauccaaacuauaagagaaugugaauuucuucaacaucauacuuaaa

SEQ ID NO: 621666 - RNA, 62 nt, Homo Sapiens
auugaucuuuuccacaaguauuaaacugccaaaaugugaauaugcaaagccuuucugaaucu

SEQ ID NO: 621667 - RNA, 62 nt, Homo Sapiens
cugcagaacuuuguucuguuuucugccacaaaaaugugaauaguucagagugaaaaccuuuu

SEQ ID NO: 621668 - RNA, 62 nt, Homo Sapiens
gggaacaaaccucacuugagcugugccuagacaaugugaauuccuguguugcuaacagaagu

SEQ ID NO: 621669 - RNA, 62 nt, Homo Sapiens
cauuucuggaacauggauuuguguucaccuuaaaugugaaaauaaauccuauuuucuaugga

SEQ ID NO: 621670 - RNA, 62 nt, Homo Sapiens
ucauguuugagugauuuuaaaauguuuuggugaaugugaaaacuaaaguuugugucaugaga

SEQ ID NO: 621671 - RNA, 62 nt, Homo Sapiens
cuacguuuaaauaucuuugaaaguuuguauuaaaugugaauuuuaagaaauaauauuuauau

SEQ ID NO: 621672 - RNA, 62 nt, Homo Sapiens
ccagucuaucaucaaccuugaguauucuacacaaugugaauucaagugccugauuaauugag

SEQ ID NO: 621673 - RNA, 62 nt, Homo Sapiens
uuucaaagugacuucuaugaagcuuuuuuuuuaaugugaaauuuucagaauguuguuuuuuu

SEQ ID NO: 621674 - RNA, 62 nt, Homo Sapiens
gggguaugugagauguuuugacacaggcaugcaaugugaaauacguguaucauggagaauga

SEQ ID NO: 621675 - RNA, 62 nt, Homo Sapiens
ucuugcccacaggccuguggcaaaaggauaaaaaugugaacgaaguuuaacauucugacuug

SEQ ID NO: 621676 - RNA, 62 nt, Homo Sapiens
caaauauuugcacuguauuaaauuuaaauguuaaugugaaaugguuuaaauuuuacaugcug

SEQ ID NO: 621677 - RNA, 62 nt, Homo Sapiens
uguaauuauaaaauauauuggcuuuuguuuucaaugugaaagauacauuaaauggacacaua

SEQ ID NO: 621678 - RNA, 62 nt, Homo Sapiens
ccuccuuucaguauuuuucacuuguugccccaaaugugaaagcauuucauuccuuuaagagg

SEQ ID NO: 621679 - RNA, 62 nt, Homo Sapiens
gccugaaaucaaacuugauuuaacucaguaagaaugugaauuauuuguucuacuuggguggu

SEQ ID NO: 621680 - RNA, 62 nt, Homo Sapiens
guguggucuguuacuuuaauguuucuguuuuuaaugugaaggccaagcaggcccugggaugg

SEQ ID NO: 621681 - RNA, 62 nt, Homo Sapiens
ggaaaaggcaauaauuuucuaagacccgugugaaugugaagaaaagcaguauguuacugguu

SEQ ID NO: 621682 - RNA, 62 nt, Homo Sapiens
auuuuuuuuuaaauaaaaaaguuuacagaucaaaugugaaauaaauaugaauggaguggucc

SEQ ID NO: 621683 - RNA, 62 nt, Homo Sapiens
aagaacaagaaauggauguaagccuggcccauaaugugaacauaaguaaucacuaaugcuca

SEQ ID NO: 621684 - RNA, 62 nt, Homo Sapiens
cugggguaagagaaaaaaagcacaucacaacaaaugugaaagccuucauuauuacacguucc

SEQ ID NO: 621685 - RNA, 62 nt, Homo Sapiens
uaugauuuuuaagagauuuauguucuacuuaaaaugugaauuguacuucugagcugccuuaa

SEQ ID NO: 621686 - RNA, 62 nt, Homo Sapiens
cugugcacuugccuuguugcugaaguuccaauaaugugaaaaccaaaguagagguuuuuuuc

SEQ ID NO: 621687 - RNA, 62 nt, Homo Sapiens
caugccguucuucuguguaauauuaagaacugaaugugaaguuuauagcuagccugggugua

SEQ ID NO: 621688 - RNA, 62 nt, Homo Sapiens
cagagguugaauuuuuuaaaugcccuguccuaaaugugaagagaaaggacaagacacuguua

SEQ ID NO: 621689 - RNA, 62 nt, Homo Sapiens
ugguccaggagaaggccaaucaucucccagauaaugugaaaaauuuuguauuguuucaauug

SEQ ID NO: 621690 - RNA, 62 nt, Homo Sapiens
uuuguuaauuguucacuugugaaauaauugauaaugugaauucuucuaacagaauucaacca

SEQ ID NO: 621691 - RNA, 62 nt, Homo Sapiens
uacuugucugaaccccgugggacuuacaaugaaaugugaaauaaaaauguuuucuuacccuu

SEQ ID NO: 621692 - RNA, 62 nt, Homo Sapiens
auaugugaauuuuuuucaaacuguagucguuuaaugugaauuaaugcccauauuguaucuau

SEQ ID NO: 621693 - RNA, 62 nt, Homo Sapiens
uucaugaaguuuuaaacuucccuccgcuccuuaaugugaaacuaugagacgagagagagaag

SEQ ID NO: 621694 - RNA, 62 nt, Homo Sapiens
gcuuuuauauucuaauaguuuuugucuuaaaaaaugugaaauaaguaauuuagaagauauua

SEQ ID NO: 621695 - RNA, 62 nt, Homo Sapiens
aggccuucaccuugacucuuaguuucugccacaaugugaagacaucuuccugaaaggauguu

SEQ ID NO: 621696 - RNA, 62 nt, Homo Sapiens
gacacuguauugcuguauacguugcgacugaaaaugugaaacccaaaccuaguuucccauga

SEQ ID NO: 621697 - RNA, 62 nt, Homo Sapiens
acacuuuguguggaaaaaccuaaaucuauagaaaugugaaauggauguagcuuguuaguagu

SEQ ID NO: 621698 - RNA, 62 nt, Homo Sapiens
ucuauguuuucaguauuauguacacuucuuaaaaugugaaaaaguauuauugagucuuuuca

SEQ ID NO: 621699 - RNA, 62 nt, Homo Sapiens
guauuauuuuaaaaaguggcgugauugaagcaaaugugaauccuccugcaaugaauguuuau

SEQ ID NO: 621700 - RNA, 62 nt, Homo Sapiens
ugcugccaaauguuauguagaacucaguguucaaugugaaaugaacaaaacugugcuguuac

SEQ ID NO: 621701 - RNA, 62 nt, Homo Sapiens
auuuuuuuguggugauaaaaguguaucucuauaaugugaaauuacuuagauucacaaugguu

SEQ ID NO: 621702 - RNA, 62 nt, Homo Sapiens
uguuuuucuauuaaaaagcaaucaagaaagauaaugugaaaaagaaaggaauuuagagguag

SEQ ID NO: 621703 - RNA, 62 nt, Homo Sapiens
gggauguaauccggauggccgcuucuguacuuaaugugaaauauuuagauaccuuuuugaac

SEQ ID NO: 621704 - RNA, 62 nt, Homo Sapiens
auucaagagcaaucuuugcuaaggaguaagugaaugugaagaguaccaacuacaacaauucu

SEQ ID NO: 621705 - RNA, 62 nt, Homo Sapiens
ccuaauacugucaccuugggggugagaauuccaaugugaauuugcagggggagugggggaca

SEQ ID NO: 621706 - RNA, 62 nt, Homo Sapiens
cacauuauuuauagaaaauguacaguugugugaaugugaaauaaauguccucaacucccuuc

SEQ ID NO: 621707 - RNA, 62 nt, Homo Sapiens
uugcucugaggguuaaaugaaaauaaaaagaaaaugugaaacagcaccacagguacuugaca

SEQ ID NO: 621708 - RNA, 62 nt, Homo Sapiens
gcugugagcuccuugggggcaggcccucaauaaaugugaacugcugcugccgccucugccgu

SEQ ID NO: 621709 - RNA, 62 nt, Homo Sapiens
auaaauauaauugggauuuuaaaaacaugagaaaugugaacugugauggggugggcagggcu

SEQ ID NO: 621710 - RNA, 62 nt, Homo Sapiens
uuucuacugagcaaaauaccaucuaaaaggagaaugugaauaguuguauuuugaaaugaugu

SEQ ID NO: 621711 - RNA, 62 nt, Homo Sapiens
ugagccaauagugauuuguuugcauaucaccuaaugugaaaagugcucaucugugaacucua

SEQ ID NO: 621712 - RNA, 62 nt, Homo Sapiens
aaugaaacccuauggagaauuuaucccuuuacaaugugaauagucaucuccuaauuuguuuc

SEQ ID NO: 621713 - RNA, 62 nt, Homo Sapiens
caaguucuaaggaagaaaagagucuccuuucgaaugugaagaaguaaauuuagaggaaauca

SEQ ID NO: 621714 - RNA, 62 nt, Homo Sapiens
uaaauuguuauuuucgcacaaugggaaucucuaaugugaaaauguauucuaugaaaauaauu

SEQ ID NO: 621715 - RNA, 62 nt, Homo Sapiens
aagugagaagacauaaccaagacauggaaauaaaugugaaagcuggagccgaagagucaaag

SEQ ID NO: 621716 - RNA, 62 nt, Homo Sapiens
cuccgugugugcaugugacugugcuggguuggaaugugaacaauaaagaggaauguccaagu

SEQ ID NO: 621717 - RNA, 62 nt, Homo Sapiens
uuugccuaucuuuaaacauuaggguuuuuuuuaaugugaauuguuacucuaaauagaaauau

SEQ ID NO: 621718 - RNA, 62 nt, Homo Sapiens
cagauaguuguuuucauacaggggauuuguucaaugugaaaugaaaauacuguaaauacguu

SEQ ID NO: 621719 - RNA, 62 nt, Homo Sapiens
cuggcacacugcucuuaagauucaguuaauucaaugugaacaaaucuaaaagaauuuuacca

SEQ ID NO: 621720 - RNA, 62 nt, Homo Sapiens
aauuguauuacucuacuucuccaaguuuuucuaaugugaagauacaguuugucuuugcuuuu

SEQ ID NO: 621721 - RNA, 62 nt, Homo Sapiens
aaguauuuaacauguucaacuaguuuguaaacaaugugaauaauguguuuuccagguggaua

SEQ ID NO: 621722 - RNA, 62 nt, Homo Sapiens
gaggaacaaguggguaucuccacugugggcuuaaugugaauaucuggagcccgggagagcca

SEQ ID NO: 621723 - RNA, 62 nt, Homo Sapiens
auuaauauuaucgcaguauuaagcuucguacaaaugugaaguuauaugugaaaacauucugu

SEQ ID NO: 621724 - RNA, 62 nt, Homo Sapiens
aaauggugucuggaagaaaguaucagugagcaaaugugaaggauucgauccucuuaaggcau

SEQ ID NO: 621725 - RNA, 62 nt, Homo Sapiens
uuguuuaaagcuuaggcacacaaucuaaauaaaaugugaauucaauuuuguauaguuuauuu

SEQ ID NO: 621726 - RNA, 62 nt, Homo Sapiens
cuuacgaauguacaacacaaguuuuugcagucaaugugaauuuauguuuuuguugcauuuau

SEQ ID NO: 621727 - RNA, 62 nt, Homo Sapiens
cccugugcugcuuguagacauaugaaauguaaaaugugaacuccaucugauacuccauugcc

SEQ ID NO: 621728 - RNA, 62 nt, Homo Sapiens
cauagacuuauuuuuaaauuuuuuuuaaaaucaaugugaaaauguaauucaaacaugcuaua

SEQ ID NO: 621729 - RNA, 62 nt, Homo Sapiens
ucagagaagugacacagaguucguuauuucugaaugugaagcauucuugagaguuguaucug

SEQ ID NO: 621730 - RNA, 62 nt, Homo Sapiens
guuuguuaauauugcuguaaccuguaauucuuaaugugaauaucuguguucccuuagauacu

SEQ ID NO: 621731 - RNA, 62 nt, Homo Sapiens
cagaauugcaagacugggugucuuucugagaaaaugugaaacaacauaccauuauagucucu

SEQ ID NO: 621732 - RNA, 62 nt, Homo Sapiens
uuuauuguacauucagugaguccuguuauuuaaaugugaacagguugaaaauguugacccua

SEQ ID NO: 621733 - RNA, 62 nt, Homo Sapiens
ucauguuuuuucaaaucuguguuauuguaaucaaugugaauaacguuacaaucauuuuuagg

SEQ ID NO: 621734 - RNA, 62 nt, Homo Sapiens
aaauuacauagauggguguuugcaggggagaaaaugugaauuaaacucucaagggaagguga

SEQ ID NO: 621735 - RNA, 62 nt, Homo Sapiens
cugugaagaguggacagucuuggaguugaauaaaugugaaggugaugauaaauuuguuacuu

SEQ ID NO: 621736 - RNA, 62 nt, Homo Sapiens
aguuuuucuugguuuauggaaauaucuauauuaaugugaaaauaauuaauuuagaauuguga

SEQ ID NO: 621737 - RNA, 62 nt, Homo Sapiens
cuuucucuuucucucuucccucagaaacuagaaaugugaaugaggauuauuauaaaaggggg

SEQ ID NO: 621738 - RNA, 62 nt, Homo Sapiens
uaaaccaucuuggcuugugcuuuauucaaacuaaugugaaacaauaaauuuaaauauuauuu

SEQ ID NO: 621739 - RNA, 62 nt, Homo Sapiens
ucacuuuuuggauugcaucuccccaaaaacuaaaugugaaaucccuaccauuucuagccucu

SEQ ID NO: 621740 - RNA, 62 nt, Homo Sapiens
guuuacaaucuacucaccaggcucauaccuacaaugugaacauacaguaugcccuuauuagc

SEQ ID NO: 621741 - RNA, 62 nt, Homo Sapiens
ucauccucagcagcaucgaggaagggccgaggaaugugaagccagaucucgggacucagauu

SEQ ID NO: 621742 - RNA, 62 nt, Homo Sapiens
aagcuggguagccuauugggguugagagggaaaaugugaaaucucagaauuuaucucccuua

SEQ ID NO: 621743 - RNA, 62 nt, Homo Sapiens
acaaguauugaaauaauuacuaauuaaucacaaaugugaaguuaugcaugauguaaaaaaua

SEQ ID NO: 621744 - RNA, 62 nt, Homo Sapiens
ucuagauguguaauuacauggaaaauacuagcaaugugaaugcuuuuguaguaaccaucuug

SEQ ID NO: 621745 - RNA, 62 nt, Homo Sapiens
aaauauuucaguagaaauuacuugcaaaaugaaaugugaauuguaaaacuuggccuaaacaa

SEQ ID NO: 621746 - RNA, 62 nt, Homo Sapiens
cauuaacaguuuguccuuaggaugcaaaugaaaaugugaauacauaccuuguuguacuguug

SEQ ID NO: 621747 - RNA, 62 nt, Homo Sapiens
uaaucauaagccuuaauaagauuuuucuaagaaaugugaaauagaacaauuuucaucuaauu

SEQ ID NO: 621748 - RNA, 62 nt, Homo Sapiens
agcuaguuuacaggcuuacugugauuuaagcaaaugugaaaagugaaaccuuaauuuuauca

SEQ ID NO: 621749 - RNA, 62 nt, Homo Sapiens
acucucaccauuuggauccuguguggagagggaaugugaaauuuacaucauuucuuuuuggg

SEQ ID NO: 621750 - RNA, 62 nt, Homo Sapiens
uuuguuacaaaucuucugaaaaaaaacaaaacaaugugaaacauuaaaauuaaaaggcauua

SEQ ID NO: 621751 - RNA, 62 nt, Homo Sapiens
gguuuccugaaacuggguuaauucuuuauagaaaugugaacacugaauuuauuuuaaaaaau

SEQ ID NO: 621752 - RNA, 62 nt, Homo Sapiens
cuggugucuccugcccacccuggucccagguaaaugugaauggagacagguaugagaggcug

SEQ ID NO: 621753 - RNA, 62 nt, Homo Sapiens
auugcacagacugaauggcuuuacauguuucuaaugugaauuaggcaugugaagcagugggu

SEQ ID NO: 621754 - RNA, 62 nt, Homo Sapiens
ugggaccuuuccuccaucccccacguaucaggaaugugaaugauugcggccccucaccuugu

SEQ ID NO: 621755 - RNA, 62 nt, Homo Sapiens
cauaccauugguugacguuuauuagacaacuuaaugugaaauaacccaccaccacaaagcaa

SEQ ID NO: 621756 - RNA, 62 nt, Homo Sapiens
uucccaauuacaggauuauauaggacaggaaaaaugugaaaugcuucucccaccucugagau

SEQ ID NO: 621757 - RNA, 62 nt, Homo Sapiens
ugggaguccacaaagacauaccuauugaacaaaaugugaaacaccagaauaggagauuaugg

SEQ ID NO: 621758 - RNA, 62 nt, Homo Sapiens
aaacaaaaaaaauuuguauggggguuuuuaugaaugugaagcuauuugucauuuacaguauu

SEQ ID NO: 621759 - RNA, 62 nt, Homo Sapiens
cauguggaagggacauuaauuccuggaaucaaaaugugaauuagggcuuaugguacauggcu

SEQ ID NO: 621760 - RNA, 62 nt, Homo Sapiens
uacaacgcauauuuaucucucacaaccuuguaaaugugaaagucuuuaauaguguugagugg

SEQ ID NO: 621761 - RNA, 62 nt, Homo Sapiens
uggccucagacaggcuggccgcuccacacagaaaugugaacugacuuugcacacagccucag

SEQ ID NO: 621762 - RNA, 62 nt, Homo Sapiens
agacccuaccccaccacgaucaccucugccucaaugugaaucgaaggagaaggaaggagacu

SEQ ID NO: 621763 - RNA, 62 nt, Homo Sapiens
uacaacucguauuuaucucucacaaccuuguaaaugugaaagucuuuaauaguguugagugg

SEQ ID NO: 621764 - RNA, 62 nt, Homo Sapiens
caaagcuugucugguucucugguaguauuuucaaugugaaucuuucucacauacuguacaca

SEQ ID NO: 621765 - RNA, 62 nt, Homo Sapiens
aaguuuuuuacuuccacagauuaucagugcuuaaugugaacugugggcccagucauuggguu

SEQ ID NO: 621766 - RNA, 55 nt, Homo Sapiens; identical to SEQ ID NO: 451422

SEQ ID NO: 621767 - RNA, 62 nt, Homo Sapiens
cauauuuuguauccuaaaauauuauugccuaaaaugugaaagauccaaggaauaguucagua

SEQ ID NO: 621768 - RNA, 62 nt, Homo Sapiens
cauuguuuguagugcuauccuuaaggucuuggaaugugaacauccuuucugagaaguuagug

SEQ ID NO: 621769 - RNA, 62 nt, Homo Sapiens
uucuuucuaaaaauuuagaacaugacaaaaugaaugugaauauagaagagccacgugaaacc

SEQ ID NO: 621770 - RNA, 62 nt, Homo Sapiens
uguaccccuucauuuuaaaauauacuauauuaaaugugaauuuuguauuauugauuguauug

SEQ ID NO: 621771 - RNA, 62 nt, Homo Sapiens
guuucuuaaagcucugaacauugaaauaauguaaugugaagugaauagcugcauaagacauu

SEQ ID NO: 621772 - RNA, 62 nt, Homo Sapiens
acuaauuuaaauuacuaucauaaacacauaucaaugugaaggggcauaccuaaggacuaauu

SEQ ID NO: 621773 - RNA, 62 nt, Homo Sapiens
uuuuauuuguauuaguaauacaaaucuguauaaaugugaaauguaaauacauuauugaaaag

SEQ ID NO: 621774 - RNA, 62 nt, Homo Sapiens
aucgacugacugcuuguugcgucuugaguacaaaugugaauggaguuuugcccaggccugcu

SEQ ID NO: 621775 - RNA, 62 nt, Homo Sapiens
acuacacccagcagaguccccaggcgguucugaaugugaagcagguaacuaugcaaagcauc

SEQ ID NO: 621776 - RNA, 62 nt, Homo Sapiens
augcucucccagcaaagcuggugagcuagucaaaugugaaaaguuagaagagagacagggga

SEQ ID NO: 621777 - RNA, 62 nt, Homo Sapiens
cucuucccguuccugcuuaccuucuuguucugaaugugaaaguuuuaguuacucaaaagccc

SEQ ID NO: 621778 - RNA, 62 nt, Homo Sapiens
cagagaaauaacuuguaaauuuguguggugggaaugugaaagacauuauauuaaaaaaaaag

SEQ ID NO: 621779 - RNA, 62 nt, Homo Sapiens
cccaggccgcagggggcaagucuagguuugugaaugugaagcgaaaccuuuuuuaaacuauu

SEQ ID NO: 621780 - RNA, 62 nt, Homo Sapiens
ugagcuguuugaccagucacuugaaaguguuaaaugugaacuaauaguguaauuaaaaauaa

SEQ ID NO: 621781 - RNA, 62 nt, Homo Sapiens
acaagagaaugcugucaauauugguguacuguaaugugaaucuaugcuggugaaaacaauuu

SEQ ID NO: 621782 - RNA, 62 nt, Homo Sapiens
aggguacucuaguuuuauguagaugauuucagaaugugaaggcugguuugccugucagucau

SEQ ID NO: 621783 - RNA, 62 nt, Homo Sapiens
cagggaauaggaaaugagggcacuuacacauuaaugugaauuaguaauugugguauagaaau

SEQ ID NO: 621784 - RNA, 62 nt, Homo Sapiens
auauuucagugagguauauuuuaauacugaucaaugugaacuuuucuaaauacucuauuguc

SEQ ID NO: 621785 - RNA, 62 nt, Homo Sapiens
gugauaacugccucguuuaaauggucacaagaaaugugaagagagagcuagggcagacaugc

SEQ ID NO: 621786 - RNA, 62 nt, Homo Sapiens
uauuauuuggcuagaaauugcuguuuuuaauaaaugugaauuuuuuaaaaauaaagauuuuu

SEQ ID NO: 621787 - RNA, 62 nt, Homo Sapiens
aaaauuuucuacagagaguuaauuaucaccaaaaugugaaugguacauacaaaaccuggcau

SEQ ID NO: 621788 - RNA, 62 nt, Homo Sapiens
uaauuguaaaagauuaguugaaaaacuguaugaaugugaagaucacaugcuuagucauuuuu

SEQ ID NO: 621789 - RNA, 62 nt, Homo Sapiens
acuucaaguaacaugcuuagcuuucccuccuuaaugugaaaaaucaagggcuuacugacaua

SEQ ID NO: 621790 - RNA, 62 nt, Homo Sapiens
acugcaucaacccgacauuccuuucuuauaccaaugugaaauuuccagaucaucuguaaacc

SEQ ID NO: 621791 - RNA, 62 nt, Homo Sapiens
aaaauuauugaagcgauuucuauguggaaauaaaugugaaaaauaacuaugauauuuuggua

SEQ ID NO: 621792 - RNA, 62 nt, Homo Sapiens
auaagcauaggagguucuguuauuaaagaaacaaugugaaauaauguggaaauuaauacuga

SEQ ID NO: 621793 - RNA, 62 nt, Homo Sapiens
cagucgggaagcuuuccagcuuccagcccuugaaugugaagugucauuggcaugucuggcag

SEQ ID NO: 621794 - RNA, 62 nt, Homo Sapiens
ucuggcaaacguuucucaaaucugcuucauccaaugugaaguucaucuugcagcauuuacua

SEQ ID NO: 621795 - RNA, 62 nt, Homo Sapiens
gaaauuaaaacuuucuucauuaaacaauguuuaaugugaaaauuucuguuagcugauugugg

SEQ ID NO: 621796 - RNA, 62 nt, Homo Sapiens
cuguuaguguugacuaaagauugacuagcugaaaugugaauuuuaaauauuuauaugcuuug

SEQ ID NO: 621797 - RNA, 62 nt, Homo Sapiens
aacuacugaaaacacuuggucagagaaaaaaaaaugugaauaguggugcauauuaaaauaag

SEQ ID NO: 621798 - RNA, 62 nt, Homo Sapiens
cuuacucaacuugcuuuuuuauauagugucugaaugugaagucauuuuuugaagcuuucuac

SEQ ID NO: 621799 - RNA, 62 nt, Homo Sapiens
uauauucucaaguuuauuuuucuggccuuagaaaugugaaguaaagaauaaguauucuugca

SEQ ID NO: 621800 - RNA, 62 nt, Homo Sapiens
uggccaaaagucggaaaaugaacaaucugacaaaugugaagcauugccugagaacugcaaug

SEQ ID NO: 621801 - RNA, 62 nt, Homo Sapiens
auuuagugaauacaguaaagaauacaacauuuaaugugaaacuaucuucugauuucaaaggu

SEQ ID NO: 621802 - RNA, 62 nt, Homo Sapiens
ucaguauguuuacuauugcuugaucugagcaaaaugugaacuaucacuguucuauaggcuua

SEQ ID NO: 621803 - RNA, 62 nt, Homo Sapiens
guaucacucuaaaaaacauuguuuauuuuuguaaugugaaaagugaccuuuucuucauuuug

SEQ ID NO: 621804 - RNA, 62 nt, Homo Sapiens
ccaugauauuacugugcacuaagugguuagugaaugugaaggcuggcucugggugagucagu

SEQ ID NO: 621805 - RNA, 62 nt, Homo Sapiens
auguaaucagacuaacaguuauacuuggugauaaugugaaugaauuagacacuuuagaggau

SEQ ID NO: 621806 - RNA, 62 nt, Homo Sapiens
aaucaguauguuuuuagauuuacauucggaagaaugugaaucaauauuauacuaauauguug

SEQ ID NO: 621807 - RNA, 62 nt, Homo Sapiens
auccguuuucauuguucacuacuaggauauugaaugugaaacuuuaacauagguuuuuaaag

SEQ ID NO: 621808 - RNA, 62 nt, Homo Sapiens
gauuguacacauuuuuuucaaugaaguacaauaaugugaacugcauguguaaacagcaucac

SEQ ID NO: 621809 - RNA, 62 nt, Homo Sapiens
gccaagaacuguauuuacugugguuguggacaaaugugaaaguaacuuuaugcuuaaauaaa

SEQ ID NO: 621810 - RNA, 62 nt, Homo Sapiens
uaggauagugugauguguaacaaacaaccucaaaugugaaugccuugauuuuauuuuuaugg

SEQ ID NO: 621811 - RNA, 62 nt, Homo Sapiens
ugugagaucuguaauuuuuuuuuuuuguagaaaaugugaauuuuuugguccucuaauuuguu

SEQ ID NO: 621812 - RNA, 62 nt, Homo Sapiens
ggaguguuauguuuugccacuauuauuuucagaaugugaagauuuuacucuuggcuuaauuu

SEQ ID NO: 621813 - RNA, 62 nt, Homo Sapiens
augaauucuuuaggguagaaauuuauuuagcaaaugugaauucuuuugagaaaguaugaagu

SEQ ID NO: 621814 - RNA, 62 nt, Homo Sapiens
aaauagcaaaacaacaaaaaagcaaaccuuaaaaugugaagaaagugugaauuuuaguuuug

SEQ ID NO: 621815 - RNA, 62 nt, Homo Sapiens
ugaaugcauauguaugugugguuacuuuuuauaaugugaaauaaugaauaaugaauuuacuc

SEQ ID NO: 621816 - RNA, 62 nt, Homo Sapiens
ucguaucuuuaaggagcauuagauauuugggaaaugugaaguuugccaagaggucucccagg

SEQ ID NO: 621817 - RNA, 62 nt, Homo Sapiens
aaaggguguugcauuuuuacuuuucagauguuaaugugaaagagagugguuuuuguuuuuuc

SEQ ID NO: 621818 - RNA, 62 nt, Homo Sapiens
gcuuagaauacugcaaaggauaugugaucgucaaugugaauauugcagcaagcacuacaaug

SEQ ID NO: 621819 - RNA, 62 nt, Homo Sapiens
uguagcuguaaaacgcugucaauaguuuguuuaaugugaacucggcgaccgcccuccgcgaa

SEQ ID NO: 621820 - RNA, 62 nt, Homo Sapiens
uuccacaaaauauccaacuucagcugacaaaaaaugugaaauuuuuuuggguaacaaucccg

SEQ ID NO: 621821 - RNA, 62 nt, Homo Sapiens
uuuuugcuuauucauugaauauaguaaugauaaaugugaacaagccagaaagcaaaaaaaca

SEQ ID NO: 621822 - RNA, 62 nt, Homo Sapiens
cagugacucuagggccaaaguagauuaguuuaaaugugaauuaauguaaucaaaaugaaaua

SEQ ID NO: 621823 - RNA, 52 nt, Homo Sapiens; identical to SEQ ID NO: 451479

SEQ ID NO: 621824 - RNA, 62 nt, Homo Sapiens
cuucccagaaauuucaaugcuaaacuguuuuaaaugugaauucuuacuaaauccagauuuuu

SEQ ID NO: 621825 - RNA, 62 nt, Homo Sapiens
guuaacccucuaaacuuuccaacaacaugcuaaaugugaaauuggcuugugaaaaguuguua

SEQ ID NO: 621826 - RNA, 62 nt, Homo Sapiens
aucuuaaauuuagcuugucuauacaauuuucaaaugugaacauaucacuagcagagaguaug

SEQ ID NO: 621827 - RNA, 62 nt, Homo Sapiens
gagcuuuacuuucaaaaugugguacguuggaaaaugugaaaaaaggcauguaggaaaauauu

SEQ ID NO: 621828 - RNA, 62 nt, Homo Sapiens
aacaacagcaacaagaccagaaaaaccacuuaaaugugaagggggaggagggaggaaagaug

SEQ ID NO: 621829 - RNA, 62 nt, Homo Sapiens
uuaccagcaguuccagccaacuaggaggaaaaaaugugaauccccauuccccuacuccugag

SEQ ID NO: 621830 - RNA, 62 nt, Homo Sapiens
ugcauguucagauguuuacuuauuccacacugaaugugaaaucgcgaaccuaugacacuucu

SEQ ID NO: 621831 - RNA, 62 nt, Homo Sapiens
gcugccuaaccacucaagaguuuuacacaucuaaugugaacuagagauuuagguuuaauuaa

SEQ ID NO: 621832 - RNA, 62 nt, Homo Sapiens
uucuaucauguaccguuagcuuuaaacuuuuaaaugugaaaucaccacacccagccuccauc

SEQ ID NO: 621833 - RNA, 62 nt, Homo Sapiens
uccugucucccaccucagcagcccagaaaccaaaugugaacuaccccuccugccccacuuug

SEQ ID NO: 621834 - RNA, 62 nt, Homo Sapiens
cugaguaagguugcucucaguguacuaagauaaaugugaaguuauuaaaucuuuuuuaaugc

SEQ ID NO: 621835 - RNA, 62 nt, Homo Sapiens
cuacaguuuccaggugaggcgacagcguccacaaugugaaucuaauggugcucacuuuagca

SEQ ID NO: 621836 - RNA, 62 nt, Homo Sapiens
aauaagagcuuuuuuguuucuuggguuuuuaaaaugugaaucugcaaugaucauaaaaauua

SEQ ID NO: 621837 - RNA, 62 nt, Homo Sapiens
aaaugugaaucugcaaugaucauaaaaauuaaaaugugaaugucaacaauaaaaagcaagac

SEQ ID NO: 621838 - RNA, 62 nt, Homo Sapiens
aucuggaggagaggauaauuuccacuguguggaaugugaauaguuaaaugaaaaguuauggu

SEQ ID NO: 621839 - RNA, 62 nt, Homo Sapiens
cuccuccucucaguauucucuccaaagauugaaaugugaagccccagccccacccucugccc

SEQ ID NO: 621840 - RNA, 62 nt, Homo Sapiens
ccuuaaacucuuguucaguucacauuaauugaaaugugaacuugccugucguuugcaacuuc

SEQ ID NO: 621841 - RNA, 62 nt, Homo Sapiens
cgguucaugaaaagcuaugaaacagcaugcuaaaugugaaaugucaacccucacuaaacuuu

SEQ ID NO: 621842 - RNA, 62 nt, Homo Sapiens
gaauuguauuucaguuuugaagauuuaaaaaaaaugugaaaauaaauauauauuaguauccu

SEQ ID NO: 621843 - RNA, 62 nt, Homo Sapiens
guagacugccauuauguguggucuucccauuaaaugugaacauuuuaauauguaugcauuca

SEQ ID NO: 621844 - RNA, 62 nt, Homo Sapiens
cacuccugcuuuccuaaggaugaaacagugauaaugugaacucaaaugagguuuccugggua

SEQ ID NO: 621845 - RNA, 62 nt, Homo Sapiens
auguugcagaagaccagaucauuuuuauacagaaugugaaauacugauacaguuauucuuuu

SEQ ID NO: 621846 - RNA, 62 nt, Homo Sapiens
uccauccagacauuugcaaacgucaggagaaaaaugugaauuauuuauccagaugcauguca

SEQ ID NO: 621847 - RNA, 62 nt, Homo Sapiens
uuauugcuuucauuccuuaccccccucaagcaaaugugaaaaguauacugaccuaagauucu

SEQ ID NO: 621848 - RNA, 62 nt, Homo Sapiens
gcuuugugcugauaucagaacagcagaaauuaaaugugaaauguuucugaugacuuauguuc

SEQ ID NO: 621849 - RNA, 62 nt, Homo Sapiens
gccccaggccagagccacccaaugaacagugcaaugugaaggaaggcaggagccugcagggg

SEQ ID NO: 621850 - RNA, 62 nt, Homo Sapiens
aaugcugauguccucaccacaugcggagaacaaaugugaagggaguaggauauugggucagu

SEQ ID NO: 621851 - RNA, 62 nt, Homo Sapiens
aaacugagcccuuuguuuaaaaaacaauuccaaaugugaaacuagaaugagagggaagagau

SEQ ID NO: 621852 - RNA, 62 nt, Homo Sapiens
auuuauaucauagcagaagaaauaggauuaucaaugugaacugcuuagcauggugccuggua

SEQ ID NO: 621853 - RNA, 62 nt, Homo Sapiens
gcuugucgguucaaagaggaaagaugaauuucaaugugaaaacacguuuuguugagggcugu

SEQ ID NO: 621854 - RNA, 62 nt, Homo Sapiens
aguauggacucaugagcuauuguugguugcuaaaugugaaucacgcgggagugagugugccc

SEQ ID NO: 621855 - RNA, 62 nt, Homo Sapiens
uggauuaaacuuaaucuaaaaggaacuuaaauaaugugaaacacuuuuaacucuugaaauau

SEQ ID NO: 621856 - RNA, 62 nt, Homo Sapiens
caugggcugacugagacaauaacaagaacacaaaugugaaauaagcaacagaggaccaaugc

SEQ ID NO: 621857 - RNA, 62 nt, Homo Sapiens
uacuuggagaaacugaggccugcuaaagaucaaaugugaaaggucucugcagguuagaaguc

SEQ ID NO: 621858 - RNA, 62 nt, Homo Sapiens
uuauuuuuguuaaaacaggauauguagaauggaaugugaaaacauuuuggaaauguccucau

SEQ ID NO: 621859 - RNA, 62 nt, Homo Sapiens
aaauuauagucagccauaaacuauacuaucaaaaugugaauaaauagguacaguaaugaaaa

SEQ ID NO: 621860 - RNA, 62 nt, Homo Sapiens
ugaagauuuauuucuuuuaaacugcaacaaaaaaugugaaaaaaccaacuaguuaccuuugg

SEQ ID NO: 621861 - RNA, 62 nt, Homo Sapiens
aagcuauguguccaggguauaguuuguucacuaaugugaaauagaacuuuauaaaaaucuug

SEQ ID NO: 621862 - RNA, 62 nt, Homo Sapiens
acaguuuuccugcaaaauuaaaugagauuaauaaugugaaauauuuauaggaaaguuauauu

SEQ ID NO: 621863 - RNA, 62 nt, Homo Sapiens
ugugggugcagugggcccaaggccuccuucacaaugugaagccugccuguuccccuucuccc

SEQ ID NO: 621864 - RNA, 62 nt, Homo Sapiens
cagacugcauuuuaaaauugaaauuguucauuaaugugaauacccuugucaaaaauuaguug

SEQ ID NO: 621865 - RNA, 62 nt, Homo Sapiens
uauuuauuugugaauaaacugaggcucugccuaaugugaauuagacacuuugaggcaagcag

SEQ ID NO: 621866 - RNA, 62 nt, Homo Sapiens
uuacagggcauuccaagugauucuuaucaggaaaugugaaaaacacuccuguacauaaucgg

SEQ ID NO: 621867 - RNA, 62 nt, Homo Sapiens
gaggcguucguaugugacccacagauggcgucaaugugaacaccucucuuugugcugaauuu

SEQ ID NO: 621868 - RNA, 62 nt, Homo Sapiens
uccaggaaagagagauucccuggaaaauugaaaaugugaauccuagggggaaauuggggauu

SEQ ID NO: 621869 - RNA, 62 nt, Homo Sapiens
acagguguacaguuaucguuguacuuuuguacaaugugaauuuuguuaauaaauuauaaggu

SEQ ID NO: 621870 - RNA, 62 nt, Homo Sapiens
caccauuaauuaguugggguggaguuuacuguaaugugaaauuuucacauuugaauuuuuua

SEQ ID NO: 621871 - RNA, 62 nt, Homo Sapiens
uugaauacuugaaucaugcaggccaauauuauaaugugaaaagguaucuacucuauuuacac

SEQ ID NO: 621872 - RNA, 62 nt, Homo Sapiens
guuugucaaugauuugucagagaaccuguugaaaugugaauuaagaagcuaagaaaauauuu

SEQ ID NO: 621873 - RNA, 62 nt, Homo Sapiens
caagcacagugccugcauguauuuauccaauaaaugugaaauucuguccaguuuuguggugg

SEQ ID NO: 621874 - RNA, 62 nt, Homo Sapiens
aauccauacuagagaaacacuauagauguaaaaaugugaaaaguuuuauucaaaauaucaaa

SEQ ID NO: 621875 - RNA, 62 nt, Homo Sapiens
uuuugcuguauauuugugauagcacuuucuacaaugugaacuuuauuaaauacaaaacuucc

SEQ ID NO: 621876 - RNA, 62 nt, Homo Sapiens
gaccguuugcuauauuccuuuuucuaugaaauaaugugaaugauaauaaaacagcuuugacu

SEQ ID NO: 621877 - RNA, 62 nt, Homo Sapiens
cucaaggucacuagaaaugggccagcugggucaaugugaagccccaaauuugcccagauuca

SEQ ID NO: 621878 - RNA, 62 nt, Homo Sapiens
aauuuaaaccuuggaucuucaaaaaauaaaauaaugugaagcaaaaccaacuaaaaagugau

SEQ ID NO: 621879 - RNA, 62 nt, Homo Sapiens
ugaggaucuugauuuggaucucuuuuuauuuaaaugugaauuucaacuuuugacaaucaaag

SEQ ID NO: 621880 - RNA, 62 nt, Homo Sapiens
uuuucuagaagcacuauuuacacaaauaugcaaaugugaaauaaccgaucuauaacgugaag

SEQ ID NO: 621881 - RNA, 62 nt, Homo Sapiens
uuccuggcuuccaugugacuuuuucagguuggaaugugaaggggcgagggguucggagugua

SEQ ID NO: 621882 - RNA, 62 nt, Homo Sapiens
cugacgaacugaaaagcuaaggauuucguguaaaugugaacauuuggaaauccuagccaagg

SEQ ID NO: 621883 - RNA, 62 nt, Homo Sapiens
ccggcggacacgccaaauugcgucgcuguugaaaugugaauccgaguccaacagagaaagga

SEQ ID NO: 621884 - RNA, 62 nt, Homo Sapiens
aacuuauuucccaguguaaagggaaugaacauaaugugaagaagcucacaccuguaccugau

SEQ ID NO: 621885 - RNA, 62 nt, Homo Sapiens
aaccgaaaacugggggcaaguauuuuuggaauaaugugaaucaaugacagagccuucaaaaa

SEQ ID NO: 621886 - RNA, 62 nt, Homo Sapiens
guaugcagaauguuguuggugaaagcauggggaaugugaaggguugacuucuucccgaccca

SEQ ID NO: 621887 - RNA, 62 nt, Homo Sapiens
uauauagucuuugcagagguagcguguacguuaaugugaaugccgccagaggccugaagcug

SEQ ID NO: 621888 - RNA, 62 nt, Homo Sapiens
caucacagcugggaagacaugacgacgaugacaaugugaaacaugcuccaaccucccggggg

SEQ ID NO: 621889 - RNA, 62 nt, Homo Sapiens
gcuggguagaagcuguuuuaauuccccuguugaaugugaaaaagguaguaguauuccugggu

SEQ ID NO: 621890 - RNA, 60 nt, Homo Sapiens; identical to SEQ ID NO: 451546

SEQ ID NO: 621891 - RNA, 62 nt, Homo Sapiens
ggcugcauauccaugggcgggcagcauaagagaaugugaagcccuucagugagacgagacga

SEQ ID NO: 621892 - RNA, 62 nt, Homo Sapiens
ggcccaucacucggcuguggagaacaaagaccaaugugaagacacuacagaggauucugucu

SEQ ID NO: 621893 - RNA, 62 nt, Homo Sapiens
ucuaauucuaaggaauaugagcuuuauguaauaaugugaaucaugguuuuucuuaguagauu

SEQ ID NO: 621894 - RNA, 62 nt, Homo Sapiens
ugcagaagagcuugaaugggacgugcagcgagaaugugaaggauggagcagguagcucaucu

SEQ ID NO: 621895 - RNA, 62 nt, Homo Sapiens
uuauaucaucuugucaaauugcuucaguuguaaaugugaaaaaugggcuggggaaaggaggu

SEQ ID NO: 621896 - RNA, 62 nt, Homo Sapiens
auuuaaucccaggaaagaggcaucaaagcuagaaugugaauauaacuuuuguggaccaauac

SEQ ID NO: 621897 - RNA, 62 nt, Homo Sapiens
agauuucaagagagcucaagcuuucagaagucaaugugaaaauuccuuccuaggcuguccca

SEQ ID NO: 621898 - RNA, 62 nt, Homo Sapiens
gaaucccacgcuucucuuuggaaacaauaugcaaugugaagcggucguguugugaguuuagu

SEQ ID NO: 621899 - RNA, 62 nt, Homo Sapiens
ucuuguuuuccuuuuuagaaguuuuuuuccuuaaugugaaaguaauuugaccaaguuauaau

SEQ ID NO: 621900 - RNA, 62 nt, Homo Sapiens
cacuuccugagcaccugcuacaugccaggcaaaaugugaaauuugcaugcuaugaggcuaaa

SEQ ID NO: 621901 - RNA, 62 nt, Homo Sapiens
uuuaaaagauuuuuuuauuguuaucaauaauaaaugugaacuauuuaaagaaaagaaugucu

SEQ ID NO: 621902 - RNA, 62 nt, Homo Sapiens
gcccuugacaggugggggcuggcuggggccuuaaugugaaaagacaguggcaggcagcugga

SEQ ID NO: 621903 - RNA, 62 nt, Homo Sapiens
uugagacggacuuugacaaaacacgaaaugguaaugugaagcuaagagcagagagugaccaa

SEQ ID NO: 621904 - RNA, 62 nt, Homo Sapiens
ucuuugucacuguccuguauagaaaugcacgaaaugugaaguaugaaagaaaaugugaccaa

SEQ ID NO: 621905 - RNA, 62 nt, Homo Sapiens
ucuuugucacuccauuuuguagaaaugcacaaaaugugaaaaaacugcugaaaggugaccaa

SEQ ID NO: 621906 - RNA, 62 nt, Homo Sapiens
uuaagaaggaaacuugacuucuauuuagauuuaaugugaaauaguagugguauggauauaac

SEQ ID NO: 621907 - RNA, 62 nt, Homo Sapiens
ucuggaaauuuucuuugggguuuaaggaaaauaaugugaaauuuacuagagcaagauggguu

SEQ ID NO: 621908 - RNA, 62 nt, Homo Sapiens
auuuuuuucauuucauuuuuagauuuuauuuuaaugugaauuugucuucuaugccacccuac

SEQ ID NO: 621909 - RNA, 62 nt, Homo Sapiens
aaaaaaaaaaagauaccugaaggauuacagugaaugugaaaacgugacauugacaucaaaca

SEQ ID NO: 621910 - RNA, 62 nt, Homo Sapiens
gaguuagauacuauuuuacuccaaaguccuacaaugugaaaauuccuagaccugguugucag

SEQ ID NO: 621911 - RNA, 62 nt, Homo Sapiens
guuaauacuaguugugaccuaacaauacucauaaugugaaguaugaaucgcuucucuuuuga

SEQ ID NO: 621912 - RNA, 62 nt, Homo Sapiens
aaaggaagaaaaucaaggaaaagucacuuuugaaugugaacacuuaaagaaacaaaguccaa

SEQ ID NO: 621913 - RNA, 62 nt, Homo Sapiens
uuuggaagccuugaguucaguagaguuuucaaaaugugaaucggagaacccuccuaaaucca

SEQ ID NO: 621914 - RNA, 62 nt, Homo Sapiens
caaaggcuucuggcucugcuuuccuuggauuaaaugugaaagcugauugguuuucuuucuuu

SEQ ID NO: 621915 - RNA, 62 nt, Homo Sapiens
uaggaaauaaaaugugccccagacugaaaaugaaugugaaacacagcagaagccucucuccu

SEQ ID NO: 621916 - RNA, 62 nt, Homo Sapiens
cuccccuccccaucuguguuauucgcauguuuaaugugaacucaggaaaaaaaaaaaaagaa

SEQ ID NO: 621917 - RNA, 62 nt, Homo Sapiens
caauagucaauuacauaauggugucccauggcaaugugaaucauaucacagaaucagaccau

SEQ ID NO: 621918 - RNA, 62 nt, Homo Sapiens
uuaccacuucuuuuuauggcuugaacuucauaaaugugaagauauauauauauauauauaac

SEQ ID NO: 621919 - RNA, 62 nt, Homo Sapiens
aaaucucauauauauaguuugaguagguagaaaaugugaaauuagcaacagcucacaugacu

SEQ ID NO: 621920 - RNA, 62 nt, Homo Sapiens
uuucuugcuucuccuuuuuagauacauaaagcaaugugaaagcauaacuaaugcauagaaaa

SEQ ID NO: 621921 - RNA, 62 nt, Homo Sapiens
aguaaaaaugaaauaacugguuguuugcugaaaaugugaaauaacccuguuugcaccucgau

SEQ ID NO: 621922 - RNA, 62 nt, Homo Sapiens
aaacccuguuugcaccucgaaguuaauauauuaaugugaaauauuuauuugacaaaaaaucc

SEQ ID NO: 621923 - RNA, 62 nt, Homo Sapiens
aacaugauuucuugccgggcggugggguggggaaugugaauaagugaaagugacucucaggu

SEQ ID NO: 621924 - RNA, 62 nt, Homo Sapiens
uccaggccgagaggaugcuguaagcuuuugauaaugugaagcccagagguuuacaaguuuuc

SEQ ID NO: 621925 - RNA, 62 nt, Homo Sapiens
guauugaaaaagaucgcgaauaaaaaucaacaaaugugaaagcccagaaaaauauauucgua

SEQ ID NO: 621926 - RNA, 62 nt, Homo Sapiens
ggaaauuaaaccauucaugaauaaacuuuaaaaaugugaaguguccuuuuccuuuucacaau

SEQ ID NO: 621927 - RNA, 62 nt, Homo Sapiens
ucuuaaguuguuuaugcuuuaucagacuggcuaaugugaaagcauaauauuaugaaguuuau

SEQ ID NO: 621928 - RNA, 62 nt, Homo Sapiens
uauaaggcagggaagguucauuuguaaguaguaaugugaacugaauugcauuaagagugugu

SEQ ID NO: 621929 - RNA, 62 nt, Homo Sapiens
auuugaagaaagacugcauuguaauugagaggaaugugaaggugcauucaugggugcccuug

SEQ ID NO: 621930 - RNA, 62 nt, Homo Sapiens
uuuuauaacaguuuaccacuaugcuugauuauaaugugaaaggcggaauucugaguguguua

SEQ ID NO: 621931 - RNA, 62 nt, Homo Sapiens
uuuuaaaucaguguauaaucuagaugguaaaaaaugugaaauugggauuagggaccaaccaa

SEQ ID NO: 621932 - RNA, 62 nt, Homo Sapiens
aauuauguuucaucaaugugcagaauaaucacaaugugaauuaucaaauucuccucaaugcc

SEQ ID NO: 621933 - RNA, 62 nt, Homo Sapiens
cgucaauaacuucauuugcgggaacgauuuccaaugugaagaguugauuuaugcugggcagu

SEQ ID NO: 621934 - RNA, 62 nt, Homo Sapiens
uggacuucaugcaaguuggcaaccauuuuuaaaaugugaagaggcauauauguucaaauuca

SEQ ID NO: 621935 - RNA, 62 nt, Homo Sapiens
agugaugguuuuugaaauaaaugcaguuuaaaaaugugaaguuacaguucuguaaugcaagg

SEQ ID NO: 621936 - RNA, 62 nt, Homo Sapiens
caaaaacuuguauguuaacuguuuuuauuauuaaugugaaagaaaguauacuaaguaaguua

SEQ ID NO: 621937 - RNA, 62 nt, Homo Sapiens
ucuugaauccuguuacaaauuauuacaauaucaaugugaauaaaauguacuguuuuagaaug

SEQ ID NO: 621938 - RNA, 62 nt, Homo Sapiens
auuuuauguucaauccauauacuauagaucaaaaugugaaacaucgagcuguuaauuuuuag

SEQ ID NO: 621939 - RNA, 62 nt, Homo Sapiens
aucaguguugucuauaaauacuuucauuauggaaugugaaaugcucagaaaagaugcugacu

SEQ ID NO: 621940 - RNA, 62 nt, Homo Sapiens
aaaacaaaaauauaauggcuagugauggaauuaaugugaaaugcacaaaauaugcauauaaa

SEQ ID NO: 621941 - RNA, 62 nt, Homo Sapiens
uaaacucuaauuaauuccaaaaauaguuuauaaaugugaacuaauugaacuuauccuaaaac

SEQ ID NO: 621942 - RNA, 62 nt, Homo Sapiens
accccccacccaggggaccugcuccgugagauaaugugaaauacgacuguggaccaaacgca

SEQ ID NO: 621943 - RNA, 62 nt, Homo Sapiens
uuuuaaucugcugccauauuguagcucaauacaaugugaauuuguuuuucguuuugggguuu

SEQ ID NO: 621944 - RNA, 62 nt, Homo Sapiens
uguaagaauguacccuggaucaaaacacuauaaaugugaaaacuacaaggaagguuuuccau

SEQ ID NO: 621945 - RNA, 62 nt, Homo Sapiens
uaacuacuguaaggagaggagcggcguuggcaaaugugaaccaugagaauaucagugauacu

SEQ ID NO: 621946 - RNA, 62 nt, Homo Sapiens
uaaaaguaaucauacuggugagaaauucuaaaaaugugaagacuauggcaaagucuuuaaau

SEQ ID NO: 621947 - RNA, 62 nt, Homo Sapiens
uaagauaauuaaugcuggagagaaacccuacaaaugugaagaauguggcaaagauuucuauu

SEQ ID NO: 621948 - RNA, 62 nt, Homo Sapiens
uaaaauaauucauaaaggagauaaauuauacaaaugugaagaauguggcaaagcuuuuaaca

SEQ ID NO: 621949 - RNA, 62 nt, Homo Sapiens
uaagauaauuuauacuggagagaagcccuacaaaugugaaaaauguggcaaaccuuuuaacc

SEQ ID NO: 621950 - RNA, 62 nt, Homo Sapiens
uuagauaauucaugcuggagagaaacccuacaaaugugaaaaauguggcaaagcuuuuaacc

SEQ ID NO: 621951 - RNA, 62 nt, Homo Sapiens
uaagauaacucauacuggagaaaaaucuuacaaaugugaagaauguggcaaagccuuuaucc

SEQ ID NO: 621952 - RNA, 62 nt, Homo Sapiens
caaaauaauucauacaggagagaaacccuacaaaugugaagaaugugacaaagccuuuaacc

SEQ ID NO: 621953 - RNA, 62 nt, Homo Sapiens
aaacauaauucauaauggagaaaaacccuacaaaugugaagaaugugucaaagcuuuuaacu

SEQ ID NO: 621954 - RNA, 62 nt, Homo Sapiens
cauaagggaauucauaauagagaaacccuacaaaugugaagaacguggccuggcuuuuaaca

SEQ ID NO: 621955 - RNA, 62 nt, Homo Sapiens
uaaagaaaaucauucugcugaaaaauccuagaaaugugaagaaugugaaaaagccuuuaaau

SEQ ID NO: 621956 - RNA, 62 nt, Homo Sapiens
ucauucugcugaaaaauccuagaaaugugaagaaugugaaaaagccuuuaaaugauugucac

SEQ ID NO: 621957 - RNA, 62 nt, Homo Sapiens
aucggggaauuuaugcugguaggaaacuuucaaaugugaagaauauuggcaggucuauucuc

SEQ ID NO: 621958 - RNA, 62 nt, Homo Sapiens
gaaacucaaucaauguuauugugaaaacugggaaugugaauguaauauauguagaaaaacau

SEQ ID NO: 621959 - RNA, 62 nt, Homo Sapiens
ucucugguuguuagcagcaaagaauucucacaaaugugaauaugggcgcacauuugccucau

SEQ ID NO: 621960 - RNA, 62 nt, Homo Sapiens
gacacagacugcgaccagaacagaaauaugaaaaugugaaugacagcgucccccgugugugg

SEQ ID NO: 621961 - RNA, 62 nt, Homo Sapiens
uacccccaaguccucucacuccuccagccuggaaugugaagugacuccccaaccccuuuggc

SEQ ID NO: 621962 - RNA, 62 nt, Homo Sapiens
auaaucucauccccccacccgacuucuuuugaaaugugaacguccuuccuugacugucuagc

SEQ ID NO: 621963 - RNA, 62 nt, Homo Sapiens
cucagagggcuuuucugaggauuaaauaaauaaaugugaagcacuuagaacugauggccagc

SEQ ID NO: 621964 - RNA, 62 nt, Homo Sapiens
ucauagacuucauacuggagagaaaccuuacaaaugugaagcaugugacaaaguuuucaguc

SEQ ID NO: 621965 - RNA, 62 nt, Homo Sapiens
cagaggcggccccucccacggcucccaauaaaaaugugaaaaccaacccccgaacgugagca

SEQ ID NO: 621966 - RNA, 62 nt, Homo Sapiens
acagauuauuuuuauagugauuuuugcagcuaaaugugaaggcaacugucuuaagucccuuc

SEQ ID NO: 621967 - RNA, 62 nt, Homo Sapiens
aaguaacauugacuguaagaccucuguagggcaaugugaaaaucaugauugcuacagaagca

SEQ ID NO: 621968 - RNA, 62 nt, Homo Sapiens
acaugcacaggccugcuugugaaucaggacugaaugugaaagggaaguauugagugaggaca

SEQ ID NO: 621969 - RNA, 62 nt, Homo Sapiens
ggggcacccccuuuucuugccagaaaggauugaaugugaacgccaacagggaaggcucuguc

SEQ ID NO: 621970 - RNA, 62 nt, Homo Sapiens
cacuuuuuuuuuuuuuuuaaguagcucaauacaaugugaacuguaaauccugccaccauguu

SEQ ID NO: 621971 - RNA, 58 nt, Homo Sapiens; identical to SEQ ID NO: 451627

SEQ ID NO: 621972 - RNA, 62 nt, Homo Sapiens
aacagacaaaaaaucugugcgcgacaccccacaaugugaacaaggggaaauguauuuaugca

SEQ ID NO: 621973 - RNA, 62 nt, Homo Sapiens
uugcaauaaagcaagucauagaucaccacaauaaugugaauaauauugcaggcuccacucca

SEQ ID NO: 621974 - RNA, 62 nt, Homo Sapiens
augugauaaaguuuuaaaugagaaauccuagaaaugugaagaaaacauaaaucauaguguug

SEQ ID NO: 621975 - RNA, 62 nt, Homo Sapiens
augugacaaagccuuuaaauagaaauccuagaaaugugaagauaaaagaaaucauaugaaug

SEQ ID NO: 621976 - RNA, 62 nt, Homo Sapiens
auguggcaagccuuuuagcuggaaacccuacaaaugugaagauaagggaauuuauacaggag

SEQ ID NO: 621977 - RNA, 62 nt, Homo Sapiens
acguggcaaagcuuuucauuaaaagcccuacaaaugugaaaaaaaagaauucauacuggagg

SEQ ID NO: 621978 - RNA, 51 nt, Homo Sapiens; identical to SEQ ID NO: 250138

SEQ ID NO: 621979 - RNA, 62 nt, Homo Sapiens
aaauugaauuuaauguugaauuugcaaacauuaaugugaaauauguaagaauugaugaugua

SEQ ID NO: 621980 - RNA, 62 nt, Homo Sapiens
ugcgcgucucugcuaaaccaagugccuugugcaaugugaaugucuggccucugugccccagc

SEQ ID NO: 621981 - RNA, 62 nt, Homo Sapiens
uuaauucuccccuaacauccaaaauuaccaaaaaugugaaaagcacacauuauaaaaauuca

SEQ ID NO: 621982 - RNA, 62 nt, Homo Sapiens
guuguuagauguucucaguguuugugauaaagaaugugaacacgucuuuuccgacuucaguu

SEQ ID NO: 621983 - RNA, 62 nt, Homo Sapiens
aggaccagcgcaaugaaugcucagggcguuugaaugugaauuguauccuguuagcuccauuc

SEQ ID NO: 621984 - RNA, 62 nt, Homo Sapiens
uuaucuuaugagacucuguuauguacccucgaaaugugaaugguauucucaguaguuccgau

SEQ ID NO: 621985 - RNA, 62 nt, Homo Sapiens
auaauuccuauggacacucccuuuuccugauuaaugugaaaagauggggccuggaaaggcaa

SEQ ID NO: 621986 - RNA, 62 nt, Homo Sapiens
uggggugagggaucacugcccagacaggcuaaaaugugaacguuuuuuuuguuuguuuugag

SEQ ID NO: 621987 - RNA, 62 nt, Homo Sapiens
guccagugguagaauuugaggagucauguagaaaugugaagauuuagguucugugaacuugc

SEQ ID NO: 621988 - RNA, 62 nt, Homo Sapiens
uccccaucuugguggccugcuucccucccgugaaugugaagugccucccggagggccccagu

SEQ ID NO: 621989 - RNA, 51 nt, Homo Sapiens; identical to SEQ ID NO: 451645

SEQ ID NO: 621990 - RNA, 62 nt, Homo Sapiens
cugugacaaaguugucagucagaaaucuuacaaaugugaagaucauagucuucauacugcag

SEQ ID NO: 621991 - RNA, 62 nt, Homo Sapiens
uugaaaucuuauugugcauccuauugcguuucaaugugaacugagguuuuuuggaaagccua

SEQ ID NO: 621992 - RNA, 62 nt, Homo Sapiens
acagagugaucagaagagugaauccuaaaaugaaugugaacacagaagugauuuggaagaga

SEQ ID NO: 621993 - RNA, 62 nt, Homo Sapiens
uggcaaguaaccacuguuccguuuuggccguaaaugugaauuaugucgacacuguagccaca

SEQ ID NO: 621994 - RNA, 62 nt, Homo Sapiens
gaggcucuguuuaaaauguccaggaauuaauaaaugugaagagaagccucccucauuccucc

SEQ ID NO: 621995 - RNA, 62 nt, Homo Sapiens
aucucgcuguggacgccuguaaauuacugagaaaugugaaacgugcaaucuugaaacugagg

SEQ ID NO: 621996 - RNA, 62 nt, Homo Sapiens
cgguuggcgaucucccgacagcuggauccggcaaugugaagcuuuuguuuggguuuccccgc

SEQ ID NO: 621997 - RNA, 62 nt, Homo Sapiens
uugucuuuaauuucugucagaaugcuauugaaaaugugaauugcaugacuuguagcauauuc

SEQ ID NO: 621998 - RNA, 62 nt, Homo Sapiens
agaaauguaaagacugaauugaauuuuaagcuaaugugaaaucagagaauguuguaauaagu

SEQ ID NO: 621999 - RNA, 62 nt, Homo Sapiens
cccuccuugagcucaucagaaagguuuuaugaaaugugaaccauuuugggaaaagcugauca

SEQ ID NO: 622000 - RNA, 62 nt, Homo Sapiens
aaaauauuuccugacuugaguguuccuuuuuaaaugugaauuuuuauuucuuuuuaauuauu

SEQ ID NO: 622001 - RNA, 62 nt, Homo Sapiens
aaaauggaaaaaaacauaaaaagcagaauuuuaaugugaagacauuuuuugcuauaaucauu

SEQ ID NO: 622002 - RNA, 62 nt, Homo Sapiens
gggcauucacagaguagcugugaguucuugguaaugugaaaaaggccuuguuuuucagaaau

SEQ ID NO: 622003 - RNA, 62 nt, Homo Sapiens
agguccagcccagaucugagaggaacccuggaaaugugaagucucuguugguuugggagaga

SEQ ID NO: 622004 - RNA, 62 nt, Homo Sapiens
ggugcugggagccccuagaaguuccaaaagagaaugugaagcagaucaaggaaacuucuguu

SEQ ID NO: 622005 - RNA, 62 nt, Homo Sapiens
uuuuuugucuguuuauuuacgcuuuuauuggaaaugugaauaaguaaagaauuacuuguguu

SEQ ID NO: 622006 - RNA, 62 nt, Homo Sapiens
acauuagcaauaaguuaaacguggggagggaaaaugugaaacuugggacaagcuuuacaugg

SEQ ID NO: 622007 - RNA, 62 nt, Homo Sapiens
aagccucccaggcacccgcuuccuuagaggugaaugugaauggaaauuccucuuuuagccuc

SEQ ID NO: 622008 - RNA, 62 nt, Homo Sapiens
aaagccaagcaucacuugcaagaaaagaaaugaaugugaaagcugauaugccuucacucaga

SEQ ID NO: 622009 - RNA, 62 nt, Homo Sapiens
aacguguuaaauaaaugucaaaggauuuguacaaugugaaauccagugaauaaagagaaucu

SEQ ID NO: 622010 - RNA, 62 nt, Homo Sapiens
cccucgacaucuugaauugcucuucaaccggaaaugugaagacgcugcccucuggagaaccu

SEQ ID NO: 622011 - RNA, 62 nt, Homo Sapiens
auggcacugaccggugcuuuuuuuauccuuacaaugugaauacgccuuuuuggccugugaug

SEQ ID NO: 622012 - RNA, 62 nt, Homo Sapiens
cccaagagcagagucugggcgcaaggcuggguaaugugaaggcaguggccucgugguuauua

SEQ ID NO: 622013 - RNA, 62 nt, Homo Sapiens
acuggccagucugggaaaccuuugaucugauuaaugugaaggcuucucagaaacagacugaa

SEQ ID NO: 622014 - RNA, 62 nt, Homo Sapiens
ggcauugggagaagcagucucaauggcaaagaaaugugaaaaggcaaagggauccauaugug

SEQ ID NO: 622015 - RNA, 62 nt, Homo Sapiens
accaauaagcuggugacucaacacgguaacuaaaugugaaaauucagaaccuucucugacag

SEQ ID NO: 622016 - RNA, 62 nt, Homo Sapiens
uguggaaauaauuucccagcgaaucccuauacaaugugaauauugaaaauaucacaaguuca

SEQ ID NO: 622017 - RNA, 62 nt, Homo Sapiens
guaaguauccuuaaaaacaaucagacugaucuaaugugaaauuuuuuuugucagcuuaucaa

SEQ ID NO: 622018 - RNA, 62 nt, Homo Sapiens
gccugcacucuuccugugggcccacccucugaaaugugaaaacccgccccaccccaccccac

SEQ ID NO: 622019 - RNA, 62 nt, Homo Sapiens
cugcugcaacuuggagaaccucccugcccugaaaugugaaccaagcacacuuugguuccuuc

SEQ ID NO: 622020 - RNA, 62 nt, Homo Sapiens
aaaucaagugcaccuacaccaacugcucucaaaaugugaacugacuuuuuuuuuuuuuuuuu

SEQ ID NO: 622021 - RNA, 62 nt, Homo Sapiens
acagugagaaaagaaaggcuaaacacuauguaaaugugaauggaaacuuggaaauacucguu

SEQ ID NO: 622022 - RNA, 62 nt, Homo Sapiens
guacuagugaacaccguccucgaucuguacgaaaugugaaauguuuagggacaucuccaugc

SEQ ID NO: 622023 - RNA, 62 nt, Homo Sapiens
cauggagguaucucccgaaucauacaaaauuaaaugugaagaccguuuaugcauaccuucau

SEQ ID NO: 622024 - RNA, 62 nt, Homo Sapiens
uauauucggucuuugaaacugacaaucuuugaaaugugaauacuguaacaauauguuuucuu

SEQ ID NO: 622025 - RNA, 62 nt, Homo Sapiens
uuuuguaguauguauuuuucucuguuuucuauaaugugaaacugggggaauuuuuguuuuuu

SEQ ID NO: 622026 - RNA, 62 nt, Homo Sapiens
aacuuguugaaacuguggcucaguugcuucaaaaugugaauuaacagcaguauuacuauaag

SEQ ID NO: 622027 - RNA, 62 nt, Homo Sapiens
aauuuaagucuuugaucgaagcaagugaccacaaugugaaaguggaucaugcuaugucuguu

SEQ ID NO: 622028 - RNA, 62 nt, Homo Sapiens
cacaagcucuuucuggauacgcacggagugugaaugugaagauucuuuacauuuucaugaag

SEQ ID NO: 622029 - RNA, 62 nt, Homo Sapiens
cgaggaaaugucuuuagagcauccaaggaaauaaugugaauguacuucugggcaauuuuugu

SEQ ID NO: 622030 - RNA, 62 nt, Homo Sapiens
aacuuaugaauaaaaggaaaagguauacuuacaaugugaagucguguccuccuuauuuaaaa

SEQ ID NO: 622031 - RNA, 62 nt, Homo Sapiens
gauccagaaauaagugcugugguuauaauuugaaugugaacuuucuugagaaaaagauaaag

SEQ ID NO: 622032 - RNA, 62 nt, Homo Sapiens
ugugggcaggauacuuuuccaccauguauguuaaugugaaucauagagauugauauuaaugu

SEQ ID NO: 622033 - RNA, 62 nt, Homo Sapiens
gaaguauguuuagucagcaugcucaggaaauaaaugugaauugcccuugagaccugcuucua

SEQ ID NO: 622034 - RNA, 62 nt, Homo Sapiens
guugcuccagaugagucagugaguggugaaugaaugugaaggccuagggcauuacuguauac

SEQ ID NO: 622035 - RNA, 62 nt, Homo Sapiens
gcugggacgugaccugugcugagggcugugagaaugugaaacaacagugugaaaauuggcug

SEQ ID NO: 622036 - RNA, 62 nt, Homo Sapiens
agaauggaguuguuggggcaggacaugcacacaaugugaaacagacaaaaugcauuacaccu

SEQ ID NO: 622037 - RNA, 62 nt, Homo Sapiens
gaaccucuuaagaaguccucagaaccagaagcaaugugaacucucagcgcugguccuggugg

SEQ ID NO: 622038 - RNA, 62 nt, Homo Sapiens
gccacccuccucgcugccauucucugggcuggaaugugaagccucagucacucuaaaugaag

SEQ ID NO: 622039 - RNA, 62 nt, Homo Sapiens
accuggugucuuguaguauaauaaagagaagcaaugugaagcuuguaaagaaacuguugaaa

SEQ ID NO: 622040 - RNA, 62 nt, Homo Sapiens
aaacauugcugaaaaccuaaggcaguuggacuaaugugaaaaggcugguuggauuuuggggu

SEQ ID NO: 622041 - RNA, 62 nt, Homo Sapiens
auaaaugagauaauccacaguuuuuuuuauccaaugugaauuuacacacagaggggaaccga

SEQ ID NO: 622042 - RNA, 62 nt, Homo Sapiens
guuggggggacucuggcugaugugagauauuuaaugugaaugcuuuuguauggcguuuuuau

SEQ ID NO: 622043 - RNA, 62 nt, Homo Sapiens
gucucucccgagggauggcuuuagucuugaugaaugugaaccaugucggaauuguuagguag

SEQ ID NO: 622044 - RNA, 62 nt, Homo Sapiens
guauuguggucauuuugaugauauguguguaaaaugugaauaauccaauuggugucuguacu

SEQ ID NO: 622045 - RNA, 62 nt, Homo Sapiens
aaauguggcauuagaguagaaauaucuuuggaaaugugaaagaccccauagugaaauauuug

SEQ ID NO: 622046 - RNA, 62 nt, Homo Sapiens
aauaagaugguguguauguaagaaauuuguaaaaugugaagagcuaucuacacuaaguucgu

SEQ ID NO: 622047 - RNA, 62 nt, Homo Sapiens
gggggacuaugagaucaaaauauuuuuauuauaaugugaagacauugucuuuucacucuauc

SEQ ID NO: 622048 - RNA, 62 nt, Homo Sapiens
auuuuaagucuuucuuuggucaacuuuuuuuuaaugugaaaaguuagguaagacacuuuuuu

SEQ ID NO: 622049 - RNA, 62 nt, Homo Sapiens
uucacaccagcaggugucuggacgaaaacaucaaugugaauaagggccaagugcaguccugu

SEQ ID NO: 622050 - RNA, 62 nt, Homo Sapiens
uuuaaauaagagagaaaugaugccguuuuuuaaaugugaagcagacuauaauucucagcucu

SEQ ID NO: 622051 - RNA, 62 nt, Homo Sapiens
ggcuuuguagcaagaugagcaaugcuguuggaaaugugaagucaccaguggccuuaccccug

SEQ ID NO: 622052 - RNA, 62 nt, Homo Sapiens
cccagcaccccauucuuguauacacauggcaaaaugugaagaaacuccuuucaucucagcag

SEQ ID NO: 622053 - RNA, 62 nt, Homo Sapiens
auuauuaugcaaaaaugaauguuuuuucaaaaaaugugaaauguauuuuauuuucuuuauuu

SEQ ID NO: 622054 - RNA, 62 nt, Homo Sapiens
cuugauuaaggacuacagaauugggcccuuagaaugugaaaaaaaaaaguaauuaaaaagac

SEQ ID NO: 622055 - RNA, 62 nt, Homo Sapiens
uuuuucacauuuaagcaggaaugcaauauaaaaaugugaaucucuuaauucucagccaugug

SEQ ID NO: 622056 - RNA, 62 nt, Homo Sapiens
aagaaggcagggcaguuaaccuuuuuggugccaaugugaaauguaaaugauuuuauguuuuu

SEQ ID NO: 622057 - RNA, 62 nt, Homo Sapiens
cagaaaugacuuggccucauuuuggauuucauaaugugaaguauucaugauuuugaacuggu

SEQ ID NO: 622058 - RNA, 62 nt, Homo Sapiens
ccauggcaguaauggggcaaacaauaaaaugcaaugugaaaugauuugaugauuugggaaau

SEQ ID NO: 622059 - RNA, 62 nt, Homo Sapiens
aggcuguauucagcaaggcgcuaacuugcuuaaaugugaauuacuaacuucuaaaacuguac

SEQ ID NO: 622060 - RNA, 62 nt, Homo Sapiens
cuacaagagcagaggauuaagguuuuuuuagaaaugugaaacaacauagcaguaaaauacau

SEQ ID NO: 622061 - RNA, 62 nt, Homo Sapiens
acaguugcuuuggauucucuaagaugaauccaaaugugaaagaugcauguuacugccaaaac

SEQ ID NO: 622062 - RNA, 62 nt, Homo Sapiens
uccagagcaucuugaacaggaauauuaagauaaaugugaaucugcaauggcugaaaagaguu

SEQ ID NO: 622063 - RNA, 62 nt, Homo Sapiens
ggugaaacuggugcugacuuaguuuuaccgugaaugugaaaauuagcgugcgguuucccauc

SEQ ID NO: 622064 - RNA, 62 nt, Homo Sapiens
ccaguauuuguuuaguauuuucgucugucuguaaugugaauuguguggcauccauguugguu

SEQ ID NO: 622065 - RNA, 62 nt, Homo Sapiens
cugguuuuaugaaaccaaagcucuuaaauuauaaugugaaacacuguauuugacaaaggaaa

SEQ ID NO: 622066 - RNA, 62 nt, Homo Sapiens
gacacaagacucucagguauagaaaagagcaaaaugugaaaaugcuuuuuuucuuccuauuc

SEQ ID NO: 622067 - RNA, 62 nt, Homo Sapiens
ugaaguggaaauauugucacccucacugcaguaaugugaaagcgaccugcccuauuuucuau

SEQ ID NO: 622068 - RNA, 62 nt, Homo Sapiens
caguuguguaugauugcauugugauuauuuccaaugugaaaaccuaaaccuauugauuccuc

SEQ ID NO: 622069 - RNA, 62 nt, Homo Sapiens
gaccacauuugauucaacuguagcauacaucuaaugugaaaauuugacugcuugaaaaagau

SEQ ID NO: 622070 - RNA, 62 nt, Homo Sapiens
agaaaauacuaaaauaaaaauuuuugauuaaaaaugugaacaaucuuuuuaugacuaauagu

SEQ ID NO: 622071 - RNA, 62 nt, Homo Sapiens
cucucgcugcugcuagguuugccccugacugcaaugugaaaccauauuacagccaguuuggg

SEQ ID NO: 622072 - RNA, 62 nt, Homo Sapiens
uaaaaagaauucuuccaaaagcacaucaaagaaaugugaaauauuuuuuuaaaaauugagug

SEQ ID NO: 622073 - RNA, 62 nt, Homo Sapiens
agugccugaggaccuuugcugugacuuuggguaaugugaaucggaaacaacucuauuaucug

SEQ ID NO: 622074 - RNA, 62 nt, Homo Sapiens
auuugacugugagacguccuuucuuuccaagaaaugugaauuacacaacugauaccuguucu

SEQ ID NO: 622075 - RNA, 62 nt, Homo Sapiens
cuuacuuacuuuuuguacauaauuuaaccuaaaaugugaacuaguuauucuugaucagauag

SEQ ID NO: 622076 - RNA, 62 nt, Homo Sapiens
cggguuaaagugaugaugauaaaugaauuaaaaaugugaaaugauaaccuaaaauaauuuag

SEQ ID NO: 622077 - RNA, 62 nt, Homo Sapiens
caacuuuuccccagggcuuucaaggcuuauuaaaugugaaccgcccuugcaaagcagcuggc

SEQ ID NO: 622078 - RNA, 62 nt, Homo Sapiens
ccaucuuuuaugacugcaaccuuucuaaaaugaaugugaauguuuuuacaucuacguuguug

SEQ ID NO: 622079 - RNA, 62 nt, Homo Sapiens
gucuucauucaauguuaaacacuugaaacauaaaugugaaauuuuagccuucuaauuaguuc

SEQ ID NO: 622080 - RNA, 62 nt, Homo Sapiens
agcaguaaaacugaugacauuauucauuuagaaaugugaaugaguuacagcaguggaauaag

SEQ ID NO: 622081 - RNA, 62 nt, Homo Sapiens
augagcaguaaaauagaugauaaguacuuagaaaugugaaaaggauaauaacagcaguggaa

SEQ ID NO: 622082 - RNA, 62 nt, Homo Sapiens
augcuuuauuuagcuguauggcacuguaaugaaaugugaaaaacuuuuccucacuuuguugu

SEQ ID NO: 622083 - RNA, 62 nt, Homo Sapiens
uuagcgugcgguuucccaucaguuuuacugugaaugugaaaaggugaaacuguugcugacuu

SEQ ID NO: 622084 - RNA, 62 nt, Homo Sapiens
caguauugugagaucaauuucugaccauaugaaaugugaaaaguauauguuucuguuacaau

SEQ ID NO: 622085 - RNA, 62 nt, Homo Sapiens
cuuaauuugagacuuuuuuauaaugguuucguaaugugaaaucaaauacuaauuuaaacucu

SEQ ID NO: 622086 - RNA, 62 nt, Homo Sapiens
gucccggcucugucuucauucacucacguggaaaugugaacuaacaauccuucgcuuuuccu

SEQ ID NO: 622087 - RNA, 64 nt, Homo Sapiens
agccuggccaacauggugaaaccugaggucaggaauucaagaccaaagcugaggcagguggauc

SEQ ID NO: 622088 - RNA, 64 nt, Homo Sapiens
aacaaagcauuccucaagauuuuuugaauuauuaauucaagaucccccaucuucccccaccccc

SEQ ID NO: 622089 - RNA, 64 nt, Homo Sapiens
uagaaaaauaaaauguuucauauuucuaugacaaauucaagagcgaaaguaacaaucuauggcu

SEQ ID NO: 622090 - RNA, 64 nt, Homo Sapiens
gaaaaauauaauguugauaaugcaaugcuucauuauucaagaauuuugaacaaagcucaaagua

SEQ ID NO: 622091 - RNA, 64 nt, Homo Sapiens
ugacagucaaaagauccuucccacauaaauuuuaauucaagaaaaauguaucugcauauguuuu

SEQ ID NO: 622092 - RNA, 64 nt, Homo Sapiens
uauuuuuuuaauuucugaagcaucacauaaagaaauucaagaaggacaaguuuuaguuaaaacu

SEQ ID NO: 622093 - RNA, 64 nt, Homo Sapiens
uugcaggauacacaauuuuuacuaacaaagacuaauucaagaagaacuuauaguauaaaaaugu

SEQ ID NO: 622094 - RNA, 64 nt, Homo Sapiens
agauuugagugggaacacaguuauaggagcuacaauucaagaugccucccacaacacgugggaa

SEQ ID NO: 622095 - RNA, 64 nt, Homo Sapiens
aguacagcagaaagaaaagaaguggaacauaagcauucaagauuaauauuugauucucuaucuc

SEQ ID NO: 622096 - RNA, 64 nt, Homo Sapiens
uaaaacugacauaaaauuuuaugauaauaacaugauucaagaaaugugauguagauuuuugaga

SEQ ID NO: 622097 - RNA, 64 nt, Homo Sapiens
ugauuuuuuuucauuaaaguauuuccuuuuuuuaauucaagaaaaguuuaccuuucuuaugcuu

SEQ ID NO: 622098 - RNA, 64 nt, Homo Sapiens
aaaccagcagauaguaaaccugguucaaaguacaauucaagaaacugaguauuuaugggcauug

SEQ ID NO: 622099 - RNA, 64 nt, Homo Sapiens
acuauaaaauacuuaaagaucuuguuuauggaagauucaagaaaauagucuugucaccuuagag

SEQ ID NO: 622100 - RNA, 64 nt, Homo Sapiens
ugagauagauagaagccaaauuuuucacauugauauucaagaaucuuuaaagcccaaauaauca

SEQ ID NO: 622101 - RNA, 64 nt, Homo Sapiens
guaagaaguacugauuauguugaaauaaaaauaaauucaagaaagaaauauucauuaaaaccau

SEQ ID NO: 622102 - RNA, 64 nt, Homo Sapiens
aacuucuguaaccuaugcauggagcaggaggacuauucaagauauauaucaaagucagggauga

SEQ ID NO: 622103 - RNA, 64 nt, Homo Sapiens
cugauaggauucaaacagauuuuaacacggccugauucaagacuaagaguaguuucuuacacag

SEQ ID NO: 622104 - RNA, 64 nt, Homo Sapiens
agccuggccaacauggugaaacuugaggucaggaauucaagaccgaggcugaggcagguggcuc

SEQ ID NO: 622105 - RNA, 64 nt, Homo Sapiens
ucggagguuaagauuaugaaauuuuagaaucucuauucaagaugauguucacuccaaauacacu

SEQ ID NO: 622106 - RNA, 64 nt, Homo Sapiens
accuuuucugcucuuucaaauaacucuaaugaauauucaagauauuuuagccuuuuaaaaaguu

SEQ ID NO: 622107 - RNA, 64 nt, Homo Sapiens
agcagacucguaaaaucuuggggcaccuauugagauucaagacaaaauccuucccaaaucauaa

SEQ ID NO: 622108 - RNA, 64 nt, Homo Sapiens
gaaaauauaacaaguucuuuucacagucaugcacauucaagagacaauggcaaaauacaguaug

SEQ ID NO: 622109 - RNA, 64 nt, Homo Sapiens
caguccuuaaugcugaaaacacagagaauggguaauucaagaggccuuucuuuuaaaauagacu

SEQ ID NO: 622110 - RNA, 64 nt, Homo Sapiens
aaucuguguacugaacauaguagauugacaucuaauucaagauuacaacaucuguuacauucua

SEQ ID NO: 622111 - RNA, 64 nt, Homo Sapiens
ccaaaaacccaaaaaugcuuuaaccacaguauaaauaauagauuauacacaucaucuuaauaac

SEQ ID NO: 622112 - RNA, 64 nt, Homo Sapiens
aaagaauauguuuuguugcagcugauuccaguuuauaauagaucccuaguaaaaagcuuugauu

SEQ ID NO: 622113 - RNA, 64 nt, Homo Sapiens
ucgucugcgauuuuaucuguuaaccaaauaaaacauaauagaauuuccuaaugagauauaucuu

SEQ ID NO: 622114 - RNA, 64 nt, Homo Sapiens
gguuuuacuacccaaaucuaaauagauacuuuugauaauagauaacugcucuuuuacuaagaca

SEQ ID NO: 622115 - RNA, 64 nt, Homo Sapiens
uagcugacccuaaauucauuuuucaugcuuaaaaauaauagaacaaauaauaauacuauuuuug

SEQ ID NO: 622116 - RNA, 64 nt, Homo Sapiens
ucccugguaguaguggucucauucacaaaaaagaauaauagauguaacuggagucacuuugcag

SEQ ID NO: 622117 - RNA, 64 nt, Homo Sapiens
aaguucuucucagagauguuuagcauauucugaaauaauagagucagaaauuguaaauaucuug

SEQ ID NO: 622118 - RNA, 64 nt, Homo Sapiens
uaugacagucuucaagucaauuacagguuuuaugauaauagaacuccuccaugcuggcaaugcg

SEQ ID NO: 622119 - RNA, 64 nt, Homo Sapiens
uguuaguauuguauuaaacaaauguugcauagagauaauagaacauugcuuguaaauaauucag

SEQ ID NO: 622120 - RNA, 64 nt, Homo Sapiens
cuuccagaaagucuuugagggaggaccuauacccauaauagaauuauggcacucauuucugaca

SEQ ID NO: 622121 - RNA, 64 nt, Homo Sapiens
acucauaaauauacccuccuggcaugacuccuauauaauagauuaacucuucuuauucauucua

SEQ ID NO: 622122 - RNA, 64 nt, Homo Sapiens
acuuuuucuugucuuuaagaaaaucaguagagauauaauagauaguacaacuuaauuguuuuaa

SEQ ID NO: 622123 - RNA, 64 nt, Homo Sapiens
agcucguuaccaagugugaaugaagcaauaugucauaauagaguagccacugguugcauaauaa

SEQ ID NO: 622124 - RNA, 64 nt, Homo Sapiens
aauaugucauaauagaguagccacugguugcauaauaauagagaccuaaauucucaaauaggga

SEQ ID NO: 622125 - RNA, 64 nt, Homo Sapiens
uacaauucguuggauuuuugagacaacaguacauauaauagagguuuauauuuuuuuuucuuug

SEQ ID NO: 622126 - RNA, 64 nt, Homo Sapiens
gcuggaauuuaaaccuguauaaaggggguaugugauaauagaggugacuagaaccauaaaucuu

SEQ ID NO: 622127 - RNA, 64 nt, Homo Sapiens
gaaguaacuggugauauaucucaaauuguaauuaauaauagauugugaauaaugauuuggggau

SEQ ID NO: 622128 - RNA, 64 nt, Homo Sapiens
uaagagagaugagcacuucuaaguugaguauauuauaauagauuaguacuggauuauucaggcu

SEQ ID NO: 622129 - RNA, 64 nt, Homo Sapiens; identical to SEQ ID NO: 615355

SEQ ID NO: 622130 - RNA, 64 nt, Homo Sapiens; identical to SEQ ID NO: 615356

SEQ ID NO: 622131 - RNA, 64 nt, Homo Sapiens; identical to SEQ ID NO: 615357

SEQ ID NO: 622132 - RNA, 64 nt, Homo Sapiens; identical to SEQ ID NO: 615358

SEQ ID NO: 622133 - RNA, 64 nt, Homo Sapiens; identical to SEQ ID NO: 615359

SEQ ID NO: 622134 - RNA, 64 nt, Homo Sapiens; identical to SEQ ID NO: 615360

SEQ ID NO: 622135 - RNA, 64 nt, Homo Sapiens; identical to SEQ ID NO: 615361

SEQ ID NO: 622136 - RNA, 64 nt, Homo Sapiens; identical to SEQ ID NO: 615362

SEQ ID NO: 622137 - RNA, 64 nt, Homo Sapiens; identical to SEQ ID NO: 615363

SEQ ID NO: 622138 - RNA, 64 nt, Homo Sapiens; identical to SEQ ID NO: 615364

SEQ ID NO: 622139 - RNA, 64 nt, Homo Sapiens; identical to SEQ ID NO: 615365

SEQ ID NO: 622140 - RNA, 64 nt, Homo Sapiens; identical to SEQ ID NO: 615366

SEQ ID NO: 622141 - RNA, 64 nt, Homo Sapiens; identical to SEQ ID NO: 615367

SEQ ID NO: 622142 - RNA, 64 nt, Homo Sapiens; identical to SEQ ID NO: 615368

SEQ ID NO: 622143 - RNA, 64 nt, Homo Sapiens; identical to SEQ ID NO: 615369

SEQ ID NO: 622144 - RNA, 64 nt, Homo Sapiens; identical to SEQ ID NO: 615370

SEQ ID NO: 622145 - RNA, 64 nt, Homo Sapiens; identical to SEQ ID NO: 615371

SEQ ID NO: 622146 - RNA, 64 nt, Homo Sapiens; identical to SEQ ID NO: 615372

SEQ ID NO: 622147 - RNA, 64 nt, Homo Sapiens; identical to SEQ ID NO: 615373

SEQ ID NO: 622148 - RNA, 64 nt, Homo Sapiens; identical to SEQ ID NO: 615374

SEQ ID NO: 622149 - RNA, 64 nt, Homo Sapiens; identical to SEQ ID NO: 615375

SEQ ID NO: 622150 - RNA, 64 nt, Homo Sapiens; identical to SEQ ID NO: 615376

SEQ ID NO: 622151 - RNA, 64 nt, Homo Sapiens; identical to SEQ ID NO: 615377

SEQ ID NO: 622152 - RNA, 64 nt, Homo Sapiens; identical to SEQ ID NO: 615378

SEQ ID NO: 622153 - RNA, 64 nt, Homo Sapiens; identical to SEQ ID NO: 615379

SEQ ID NO: 622154 - RNA, 64 nt, Homo Sapiens; identical to SEQ ID NO: 615380

SEQ ID NO: 622155 - RNA, 64 nt, Homo Sapiens; identical to SEQ ID NO: 615381

SEQ ID NO: 622156 - RNA, 64 nt, Homo Sapiens; identical to SEQ ID NO: 615382

SEQ ID NO: 622157 - RNA, 64 nt, Homo Sapiens; identical to SEQ ID NO: 615383

SEQ ID NO: 622158 - RNA, 64 nt, Homo Sapiens; identical to SEQ ID NO: 615384

SEQ ID NO: 622159 - RNA, 64 nt, Homo Sapiens; identical to SEQ ID NO: 615385

SEQ ID NO: 622160 - RNA, 64 nt, Homo Sapiens; identical to SEQ ID NO: 615386

SEQ ID NO: 622161 - RNA, 64 nt, Homo Sapiens; identical to SEQ ID NO: 615387

SEQ ID NO: 622162 - RNA, 51 nt, Homo Sapiens
ggguggagacggacguguagcccuggcgaggccagccggcggcagcacagc

SEQ ID NO: 622163 - RNA, 64 nt, Homo Sapiens
agcguuucugguuuuggguguacagucuugugugccuggcgagaagaauauuuucuauuuuuuu

SEQ ID NO: 622164 - RNA, 64 nt, Homo Sapiens
ugcagugagccaagauugcaccauugcacuccagccuggcgacagagcaagacucugucucaaa

SEQ ID NO: 622165 - RNA, 64 nt, Homo Sapiens
ugcagugagccaagaucgugccacugcacuccagccuggcgacacagugagacucugucucaaa

SEQ ID NO: 622166 - RNA, 64 nt, Homo Sapiens
gccgcccucccuuggccgcccuacuccccaguuuccuggcgaugagccauuuauugugucucac

SEQ ID NO: 622167 - RNA, 64 nt, Homo Sapiens
cccagagccccaggaaaaugggagugagaagaugccuggcgagguuuuggccaggaggacguga

SEQ ID NO: 622168 - RNA, 64 nt, Homo Sapiens
cauagcucugugugagccagcaauaccgcugcccccuggcgacagggcagaccaaugaugccag

SEQ ID NO: 622169 - RNA, 64 nt, Homo Sapiens
uuguuugugauaguuggguucuccuggguggcgcccuggcgaacaggccaaccggcaccacgga

SEQ ID NO: 622170 - RNA, 64 nt, Homo Sapiens
acggugaaaccccgucucuagagaucgagaccauccuggcgaacugggcggaucacaaggucag

SEQ ID NO: 622171 - RNA, 64 nt, Homo Sapiens
guuucacucaucauggaugcgcugggcugggucaccuggcgagguaguaggccuuccuuccucc

SEQ ID NO: 622172 - RNA, 64 nt, Homo Sapiens
ucacuuuaacuuucugaaccuaccagucaggaacccuggcgauacaaauucagccuccaucacu

SEQ ID NO: 622173 - RNA, 64 nt, Homo Sapiens
guugagaccuuuuucuuuuaagaugaauguaaacccuggcgacagaauguaacuccugguguga

SEQ ID NO: 622174 - RNA, 64 nt, Homo Sapiens
uugggaacaaguguaauuuccuucccuccuuuaaccuggcgaugagcguccuuuaaaccacugu

SEQ ID NO: 622175 - RNA, 64 nt, Homo Sapiens
guccugccaaggggcgccaggagcagagccagggccuggcgagcuggcguggagcccacaggau

SEQ ID NO: 622176 - RNA, 64 nt, Homo Sapiens
cccgcagucccugcaugaccauuggcccugcuggccuggcgaugugggcauccugggguucuua

SEQ ID NO: 622177 - RNA, 64 nt, Homo Sapiens
cuucugugagugaagaggaauguguucuagcuguccuggcgagacuccccuucaugcccuagcc

SEQ ID NO: 622178 - RNA, 64 nt, Homo Sapiens
cucaccugcccagccauggcugccucccuuccucccuggcgaucgagccaggagucgcggcccc

SEQ ID NO: 622179 - RNA, 64 nt, Homo Sapiens
gagcgagacuugguuucaaaccacuacacuccagccuggcgacaugcaguguggugagaucaug

SEQ ID NO: 622180 - RNA, 64 nt, Homo Sapiens
accgcacacaccccucccaccgaggccaggggccccuggcgagacacuggugugugccgggcgc

SEQ ID NO: 622181 - RNA, 64 nt, Homo Sapiens
ugcagugagccgagaucacgccacugcacuccagccuggcgacagagcgagacucccucucaaa

SEQ ID NO: 622182 - RNA, 64 nt, Homo Sapiens
ccaggagacccagcuggaaaugguaaagcugcguccuggcgauuccuugacccucagccaagau

SEQ ID NO: 622183 - RNA, 64 nt, Homo Sapiens
uauuuauuagagcugugagagcuugggggacacaccuggcgagcaagcucgcuuuuuaaaaaug

SEQ ID NO: 622184 - RNA, 64 nt, Homo Sapiens
auuuuaaugcuggcuacaccaugccugcauggguccuggcgauuacugccucauucagagauag

SEQ ID NO: 622185 - RNA, 64 nt, Homo Sapiens
accccuacccuucuauugcgcuaaagcugguuauccuggcgaacuacccuuaaugcuugagaac

SEQ ID NO: 622186 - RNA, 64 nt, Homo Sapiens
gagcgagacgccgucucaaaccacugcacuccagccuggcgacaugcagugagacgagaucgcg

SEQ ID NO: 622187 - RNA, 64 nt, Homo Sapiens
gagcgagacuccgucucaaaccauugcacucaagccuggcgacaugcagugagcugagaucacg

SEQ ID NO: 622188 - RNA, 64 nt, Homo Sapiens
ucucuuuggaaauagcaugacagucaucuccccuccuggcgaguauccaucuccugguguucug

SEQ ID NO: 622189 - RNA, 64 nt, Homo Sapiens
cugacuccuaaaccaaaagugcuuuaaaaaccagccuggcgaggacagcccuggacccacucca

SEQ ID NO: 622190 - RNA, 64 nt, Homo Sapiens
ugggacuuaaaaggcccaagcacugaaaauggaaccuggcgaaagcagaggaggagaaugaaga

SEQ ID NO: 622191 - RNA, 64 nt, Homo Sapiens
agagugagacuccaccucaagcccggcacuccagccuggcgacagaucacaccacuguacucca

SEQ ID NO: 622192 - RNA, 64 nt, Homo Sapiens
cugguugggggcaggaucauccacugggccagcgccuggcgauaccagcugccagggccugggg

SEQ ID NO: 622193 - RNA, 64 nt, Homo Sapiens
aucagguaagaggggaacagcugcuguacaucguccuggcgagugacaaugugacagaagccug

SEQ ID NO: 622194 - RNA, 64 nt, Homo Sapiens
agagcucaggugaggaccggcaccagcuccuuccccuggcgaucccucccugaggaguacuuca

SEQ ID NO: 622195 - RNA, 64 nt, Homo Sapiens
uugcccucaagguuuuuugcuuuucuccugugcaccuggcgaggcugaaggcgagggguggagg

SEQ ID NO: 622196 - RNA, 64 nt, Homo Sapiens
uacagugagccgagaucauaccacugcacuccagccuggcgacagagcaagacuccaucucaaa

SEQ ID NO: 622197 - RNA, 64 nt, Homo Sapiens
guggcccuguaaaagcuuucgugggcgaggaaagccuggcgagcgcccaggacguggguucagc

SEQ ID NO: 622198 - RNA, 64 nt, Homo Sapiens
cugccagcagugggugggcaggauucccauccguccuggcgaucagguucaucuccagguuucg

SEQ ID NO: 622199 - RNA, 64 nt, Homo Sapiens
ucuuggcguggcagccucuuccaccgccagagcuccuggcgacagcacuagcugggccuggugg

SEQ ID NO: 622200 - RNA, 64 nt, Homo Sapiens
gagcugggacugaagcuuucguucuccguccuucccuggcgaggccucuguacauuucccugug

SEQ ID NO: 622201 - RNA, 64 nt, Homo Sapiens
ggugagauaggggcagauaggagcugcaggggugccuggcgagccucugguuuuccucugcucc

SEQ ID NO: 622202 - RNA, 64 nt, Homo Sapiens
cccugguggagcagaugggucccuacaucaaccuccuggcgaugcguacccucgccagaggccc

SEQ ID NO: 622203 - RNA, 64 nt, Homo Sapiens
ugcauucacaagcacaucugauccuggaccaggcccuggcgagacugcuguuguaacacccuug

SEQ ID NO: 622204 - RNA, 64 nt, Homo Sapiens
uccauucagccaucacauauucagggcugaaaugccuggcgaacgggcaggcucuuguccaguu

SEQ ID NO: 622205 - RNA, 64 nt, Homo Sapiens
acgcugcccgccgagcggacccaaggcgccuggaccuggcgagguggugcccccuccuccccgg

SEQ ID NO: 622206 - RNA, 64 nt, Homo Sapiens
gccccugccuuuuagacccguccagugcccuaggccuggcgacucucugugcuccuccuacccu

SEQ ID NO: 622207 - RNA, 64 nt, Homo Sapiens
ugacgcgugucccccacucaccuuccccggagacccuggcgaccgccgggcgcugacaccagac

SEQ ID NO: 622208 - RNA, 64 nt, Homo Sapiens
aggagaaggugugagcaugagccuauuggacacaccuggcgacguauaccaggugucccacccc

SEQ ID NO: 622209 - RNA, 64 nt, Homo Sapiens
gagagagacuccaucucaaaccacugcacuccagccuggcgacaugcagugagcugagaucaca

SEQ ID NO: 622210 - RNA, 64 nt, Homo Sapiens
gcagugagccaagaucgcaccacugcacuccagcccuggcgacagagugagacuccaucucaaa

SEQ ID NO: 622211 - RNA, 64 nt, Homo Sapiens
uggggcccagggcagcaugacucuguccugcaugccuggcgagcauuucugacucaucugccag

SEQ ID NO: 622212 - RNA, 64 nt, Homo Sapiens
aggcuucuuggauggacaguuggcccacugcagcccuggcgagcggcugacgccaagaaugaag

SEQ ID NO: 622213 - RNA, 64 nt, Homo Sapiens
ugcagugagccaagguuccaccacugcacuccagccuggcgacagagcaaggcuccacucaaaa

SEQ ID NO: 622214 - RNA, 64 nt, Homo Sapiens
gguggaucaccugaggucaggaguuagaggccagccuggcgaaaccccaucucuacuaaaaaua

SEQ ID NO: 622215 - RNA, 64 nt, Homo Sapiens
ugggcagaucacgaggucaagagaucgagaccauccuggcgaacauggugaaaccccaucucua

SEQ ID NO: 622216 - RNA, 64 nt, Homo Sapiens
cacugaagcuggacaagagccucaauaaggacacccuggcgaggaagcuggcagugcucacccc

SEQ ID NO: 622217 - RNA, 64 nt, Homo Sapiens
ggagcaggggcaggcgaaccuccaccacuuccacccuggcgaguagaaagcccuuucccagccc

SEQ ID NO: 622218 - RNA, 64 nt, Homo Sapiens
ugucaugugguugguggugagaagcaaggccuugccuggcgaguugggacgcaaaggagggagg

SEQ ID NO: 622219 - RNA, 64 nt, Homo Sapiens
aacaguuuguuaacacaggccaugagccacuguaccuggcgaaacaaugugcuaggauuacagg

SEQ ID NO: 622220 - RNA, 64 nt, Homo Sapiens
ccccuucaggccuccuuacuccaucuuccagaccccuggcgaccaccgccccucucaguggcuc

SEQ ID NO: 622221 - RNA, 64 nt, Homo Sapiens
cgguggacuuuuccucuggacaaaaugacagcauccuggcgacuccacaguggagcugagcgcc

SEQ ID NO: 622222 - RNA, 64 nt, Homo Sapiens
gggagggaagggguguucugccgcccaaaucuuuccuggcgaagccuggaaccaccugggucgg

SEQ ID NO: 622223 - RNA, 64 nt, Homo Sapiens
ccgguuccucuguguccucuagggcagggccaguccuggcgaccgugccaaaccgccccucagc

SEQ ID NO: 622224 - RNA, 64 nt, Homo Sapiens
cggguggaucacgaggucaggagaucgagaccauccuggcgaacauggugagaccccaucucua

SEQ ID NO: 622225 - RNA, 64 nt, Homo Sapiens
gggcgaccucaauggugcgugcauccccgagcacccuggcgaccucgugcagaccgaggccuuc

SEQ ID NO: 622226 - RNA, 64 nt, Homo Sapiens
agccaccugaaagucacugucucuccugcaugcaccuggcgagaaggaaagggaugcauugaca

SEQ ID NO: 622227 - RNA, 64 nt, Homo Sapiens
ccaucuaggggcacaggcccccacggccgggcccccuggcgacaacuuccaucauuccagagaa

SEQ ID NO: 622228 - RNA, 64 nt, Homo Sapiens
cuuccgcuugauuuugcacaaucccggcgauacuccuggcgauacugacuagaaagucagggag

SEQ ID NO: 622229 - RNA, 64 nt, Homo Sapiens
gauuagucgagacugguccucaccugcuccggcuccuggcgaccacuaccccugcgucccggcc

SEQ ID NO: 622230 - RNA, 64 nt, Homo Sapiens
uucagugagccaagaucgcaccacugcucuccagccuggcgacagagggagacuccaucucaaa

SEQ ID NO: 622231 - RNA, 64 nt, Homo Sapiens
uuaaaaaaacaacucauucccacauucuucagucccuggcgaccaccauauuuuuaagucauua

SEQ ID NO: 622232 - RNA, 64 nt, Homo Sapiens
gagcaagacuccaucuaaaaacucugcacuccagccuggcgacauuuuuuuuuugaugagucuc

SEQ ID NO: 622233 - RNA, 64 nt, Homo Sapiens
uaaacugagagcuuaucuuccuguugaauuucacccuggcgaugaucuccacccuaaaauaguu

SEQ ID NO: 622234 - RNA, 64 nt, Homo Sapiens
ugcagugagccgagauugcaccacugcauuccagccuggcgacagagugagacuccaucucaaa

SEQ ID NO: 622235 - RNA, 64 nt, Homo Sapiens
cuugaguccuggaguuggagaacagccuggaaagccuggcgauaccccaucucuauuuagaaac

SEQ ID NO: 622236 - RNA, 64 nt, Homo Sapiens
ucgccucugaaugaugcuucuuucuguguuggagccuggcgaaguuguguuuucaagcccucua

SEQ ID NO: 622237 - RNA, 64 nt, Homo Sapiens
acugcccauuccauucacccgggugggaggccauccuggcgaccccucaccaggucucugagcu

SEQ ID NO: 622238 - RNA, 64 nt, Homo Sapiens
ucugccccugcaguggguguuacgggcggugugcccuggcgagcaagcuuugauucuugguucu

SEQ ID NO: 622239 - RNA, 64 nt, Homo Sapiens
ucagggugccaggaagaucucgucggagccuguuccuggcgagaguaagagccaccgggcuggg

SEQ ID NO: 622240 - RNA, 64 nt, Homo Sapiens
gggcugagcccccaagugaaaacgagcagaaggcccuggcgacuaggaccuuggagggaggaac

SEQ ID NO: 622241 - RNA, 64 nt, Homo Sapiens
gcaggucagaggaagugaagucugcagguccagcccuggcgagguuuaugagucccuguccucu

SEQ ID NO: 622242 - RNA, 64 nt, Homo Sapiens; identical to SEQ ID NO: 552517

SEQ ID NO: 622243 - RNA, 64 nt, Homo Sapiens; identical to SEQ ID NO: 552518

SEQ ID NO: 622244 - RNA, 64 nt, Homo Sapiens; identical to SEQ ID NO: 552519

SEQ ID NO: 622245 - RNA, 64 nt, Homo Sapiens; identical to SEQ ID NO: 552520

SEQ ID NO: 622246 - RNA, 64 nt, Homo Sapiens; identical to SEQ ID NO: 552521

SEQ ID NO: 622247 - RNA, 64 nt, Homo Sapiens; identical to SEQ ID NO: 552522

SEQ ID NO: 622248 - RNA, 64 nt, Homo Sapiens; identical to SEQ ID NO: 552523

SEQ ID NO: 622249 - RNA, 64 nt, Homo Sapiens; identical to SEQ ID NO: 552524

SEQ ID NO: 622250 - RNA, 64 nt, Homo Sapiens; identical to SEQ ID NO: 552525

SEQ ID NO: 622251 - RNA, 64 nt, Homo Sapiens; identical to SEQ ID NO: 552526

SEQ ID NO: 622252 - RNA, 64 nt, Homo Sapiens; identical to SEQ ID NO: 552527

SEQ ID NO: 622253 - RNA, 64 nt, Homo Sapiens; identical to SEQ ID NO: 552528

SEQ ID NO: 622254 - RNA, 64 nt, Homo Sapiens; identical to SEQ ID NO: 552529

SEQ ID NO: 622255 - RNA, 64 nt, Homo Sapiens; identical to SEQ ID NO: 552530

SEQ ID NO: 622256 - RNA, 64 nt, Homo Sapiens; identical to SEQ ID NO: 552531

SEQ ID NO: 622257 - RNA, 64 nt, Homo Sapiens; identical to SEQ ID NO: 552532

SEQ ID NO: 622258 - RNA, 64 nt, Homo Sapiens; identical to SEQ ID NO: 552533

SEQ ID NO: 622259 - RNA, 64 nt, Homo Sapiens; identical to SEQ ID NO: 552534

SEQ ID NO: 622260 - RNA, 64 nt, Homo Sapiens; identical to SEQ ID NO: 552535

SEQ ID NO: 622261 - RNA, 64 nt, Homo Sapiens; identical to SEQ ID NO: 552536

SEQ ID NO: 622262 - RNA, 64 nt, Homo Sapiens; identical to SEQ ID NO: 552537

SEQ ID NO: 622263 - RNA, 64 nt, Homo Sapiens; identical to SEQ ID NO: 552538

SEQ ID NO: 622264 - RNA, 64 nt, Homo Sapiens; identical to SEQ ID NO: 552539

SEQ ID NO: 622265 - RNA, 64 nt, Homo Sapiens; identical to SEQ ID NO: 552540

SEQ ID NO: 622266 - RNA, 64 nt, Homo Sapiens; identical to SEQ ID NO: 552541

SEQ ID NO: 622267 - RNA, 64 nt, Homo Sapiens
ccucuucuggaaaaugaagaaauucaacuaguagauuccugaggucccccuagcuuaaaaaaaa

SEQ ID NO: 622268 - RNA, 64 nt, Homo Sapiens
auccucucuugcccucccucaauuccccuguaacauuccugaagcuguucccacucccagaugg

SEQ ID NO: 622269 - RNA, 64 nt, Homo Sapiens
uaccuagaaauuucuaucugcaacuggcaauaguauuccugaaaaggggagaauauucccuaag

SEQ ID NO: 622270 - RNA, 64 nt, Homo Sapiens
auaaaaugaggggagaauaugcaguauuuauauuauuccugaaacacuugcuauauaguaguau

SEQ ID NO: 622271 - RNA, 64 nt, Homo Sapiens
augcaggcuaauuuguacaguuacugguuguuccauuccugaauuuaguucuucaaguaacagu

SEQ ID NO: 622272 - RNA, 64 nt, Homo Sapiens
ggaaaauagaauaugaucaauagggauuuuaugaauuccugaaacccauacaaaggugcuaucc

SEQ ID NO: 622273 - RNA, 64 nt, Homo Sapiens
gaaauaucagacuagugacacuaacaggcucaauauuccugaauuccuaucaagccaguacgug

SEQ ID NO: 622274 - RNA, 64 nt, Homo Sapiens
gaaacaguuaacuuucagaauagcugguuuccucauuccugaaaaagccuuuccauaaggaaug

SEQ ID NO: 622275 - RNA, 64 nt, Homo Sapiens
uuucaauuaggaaaaguaaaaguauucaagauagauuccugauugagguucacaguuguauucc

SEQ ID NO: 622276 - RNA, 64 nt, Homo Sapiens
uaagaugugagguucacaguaaaaauauuggucaauuccugacauuuagaggcauuacuuuuuu

SEQ ID NO: 622277 - RNA, 64 nt, Homo Sapiens
uuuguaauuccuaauccuucccccacugcuucccauuccugaguugaguuacuguuuuguuccu

SEQ ID NO: 622278 - RNA, 64 nt, Homo Sapiens
uacuguuuuguuccuccccauuaauccuuauaggauuccugaguuauaguuucuuaaagaauca

SEQ ID NO: 622279 - RNA, 64 nt, Homo Sapiens
auuuccuuagauuuccagguuccaaauuuugcucauuccugauuuacaacaaauauucauguau

SEQ ID NO: 622280 - RNA, 64 nt, Homo Sapiens
aaaucauuauuaucugcaauuaauuuuaacacauauuccugaugaauaaauauaaauacacagg

SEQ ID NO: 622281 - RNA, 64 nt, Homo Sapiens
uagcuaguuagagacucgccugggaaauugcuccauuccugaguaaacagauauuuucgcccac

SEQ ID NO: 622282 - RNA, 64 nt, Homo Sapiens
acuuagggagugugccuugggcgggccauuucacauuccugacccucacuuuucucaucuguaa

SEQ ID NO: 622283 - RNA, 64 nt, Homo Sapiens
aaggagauuuaauuguaaauaugaaagccaaaguauuccugaauggucaaauacagcaauaaag

SEQ ID NO: 622284 - RNA, 64 nt, Homo Sapiens
gcaaauauuuuuuuaagggaacuauaaccuuaggauuccugaaaagaauuucaaaaaaaaaaua

SEQ ID NO: 622285 - RNA, 64 nt, Homo Sapiens
cuuacucuucuacaauguggccggaucauuugucauuccugaauaggucuuucucucaaccugc

SEQ ID NO: 622286 - RNA, 64 nt, Homo Sapiens
uuucuaagccuacagcaucuugauucauaguauaauuccugaaguaugcugaauggacuuuuua

SEQ ID NO: 622287 - RNA, 64 nt, Homo Sapiens
ucucagugaggcuaucuuccuuuuccccaguaacauuccugaauuuacuguuaucuuauuguag

SEQ ID NO: 622288 - RNA, 64 nt, Homo Sapiens
acuguuaucuuauuguaguacuugcaugacauggauuccugauaucugaugagagguucauucu

SEQ ID NO: 622289 - RNA, 64 nt, Homo Sapiens
cguaggccagugugucucugaaacggauccagcaauuccugagccaagaggaacuugaccccca

SEQ ID NO: 622290 - RNA, 64 nt, Homo Sapiens
ggauggccagagaugcuggacuugccuaaaauauauuccugagauuuccuccuggccuuuccug

SEQ ID NO: 622291 - RNA, 64 nt, Homo Sapiens
guagaaacuucuugcacuuauaaaaauguaugcaauuccugaguuauuuucuguugaggaaaga

SEQ ID NO: 622292 - RNA, 64 nt, Homo Sapiens
ugcuuccagaaaaccuuauuccagaguugguggaauuccugaggucuuuuuaagguuguaagua

SEQ ID NO: 622293 - RNA, 64 nt, Homo Sapiens
gccacauuaaauacccgugcaggcgcggagaagcaaccggcacccccuuccggccugaaagccc

SEQ ID NO: 622294 - RNA, 64 nt, Homo Sapiens
ugaguuuggauaguccggccagugcacagaugauaaccggcacauucauucuucuuaaauuauc

SEQ ID NO: 622295 - RNA, 64 nt, Homo Sapiens
acggacuccuggguggcgccggcuccagcaggccaaccggcaccggccgucccaaaccucgcag

SEQ ID NO: 622296 - RNA, 64 nt, Homo Sapiens
agcuaggcagucaccggcccaugucccuuacaggaaccggcagcucgccauuuacucagaaaaa

SEQ ID NO: 622297 - RNA, 64 nt, Homo Sapiens
gauagaauuucucugccagugcaguaagaguugaaaccggcaguuacacuaaguaaguggaggg

SEQ ID NO: 622298 - RNA, 64 nt, Homo Sapiens
guuuagaguugggauauacaaauacauauaaccaaaccggcagcaacccggugguuaacgauuu

SEQ ID NO: 622299 - RNA, 64 nt, Homo Sapiens
gggcccagugcaugguggccagaggugucacccaaaccggcaggugcgauuuuguuaacccagc

SEQ ID NO: 622300 - RNA, 64 nt, Homo Sapiens
cuguaacugcccuuuuaaauuuuaauggcugcaaaaccggcaacccuuuuccauaaaguguaau

SEQ ID NO: 622301 - RNA, 64 nt, Homo Sapiens
caguagcugaaccagcagaccuaccugcagugggaaccggcagcaucccagccaggguuugcug

SEQ ID NO: 622302 - RNA, 64 nt, Homo Sapiens
ccggucacuggcacuccagaagacagcgugccggaaccggcagcucucaccuuucugugacuug

SEQ ID NO: 622303 - RNA, 64 nt, Homo Sapiens
guuauagauacagccucuagagaucuaugcuuuaaaccggcaagauuuaauuuuuuuggacuca

SEQ ID NO: 622304 - RNA, 64 nt, Homo Sapiens
auugacacagcugcgaagugcccaggaagaggagaaccggcagcugcuggcugaaguucaggcc

SEQ ID NO: 622305 - RNA, 64 nt, Homo Sapiens
gguugcaccgcggcgcuucccagcaccaacauguaaccggcauguuuccagcagaagacaaaaa

SEQ ID NO: 622306 - RNA, 64 nt, Homo Sapiens
ugcacgaguacauggagaugccaagaacgacaugaaccggcaccacagcuggaguuggccacgg

SEQ ID NO: 622307 - RNA, 64 nt, Homo Sapiens
cuacaggaacccuggcugguuaugcauugaugucaaccggcagguugaugauuuugcauaaaau

SEQ ID NO: 622308 - RNA, 64 nt, Homo Sapiens
uguacauaagacaaagcuacugccuucuagagacaaccggcagugaccucacugaagacaaaaa

SEQ ID NO: 622309 - RNA, 64 nt, Homo Sapiens
ucuguuuugaauuuuuuuaauuaauagaaagaccaaccggcaaacuuucagaugaaugcuuacu

SEQ ID NO: 622310 - RNA, 64 nt, Homo Sapiens
cccucugggcagacugucaucacaugcaugcauaaaccggcaugugugccaaugcacacgagug

SEQ ID NO: 622311 - RNA, 64 nt, Homo Sapiens
uaugacauauguaauacacaucuguguacacagaaaccggcaccugccagacagagcugguucu

SEQ ID NO: 622312 - RNA, 64 nt, Homo Sapiens
uguccucgcccaggagggcuucccugucagcaauaaccggcauccguuuuggaaccugcgucug

SEQ ID NO: 622313 - RNA, 64 nt, Homo Sapiens
aggucgggagcacagccgcuccccaaacccagcaaaccggcagagagccgguuucccagcagcc

SEQ ID NO: 622314 - RNA, 64 nt, Homo Sapiens
ucuccgguuagaaauguuaccuuuuucuugcuaaaaccggcaaucucccuuuuaggugaagccc

SEQ ID NO: 622315 - RNA, 64 nt, Homo Sapiens
guauuccaaagacgacaauugcacagaccccuuaaaccggcauucggaggcacagagggcagga

SEQ ID NO: 622316 - RNA, 64 nt, Homo Sapiens
uuccuuuccuuuaggccguccgcgggucccugugaaccggcacaauuuuacccuugagcuuagc

SEQ ID NO: 622317 - RNA, 64 nt, Homo Sapiens
uaaccuuagagcuuggacagucugagcuguagguaaccggcauauuauuccauaucuuuguuuu

SEQ ID NO: 622318 - RNA, 59 nt, Homo Sapiens
cuuucaggagcagagcagcguuaguguagguagacaauuccucccuauucuguuauuuc

SEQ ID NO: 622319 - RNA, 59 nt, Homo Sapiens
ucuugcaacuugggggaaagaaaauguggguagacaauuaugaaaggaacauuugaaag

SEQ ID NO: 622320 - RNA, 59 nt, Homo Sapiens
cuucaguuuuucuugaggggcaugagaagguagacaacauauugugguggugauuuucu

SEQ ID NO: 622321 - RNA, 59 nt, Homo Sapiens
gguauaugaaauauacacauuacauaucuguagacaauugugcuuuagguagguguuau

SEQ ID NO: 622322 - RNA, 64 nt, Homo Sapiens
agcucacaucaaaauagaccagccauuugcacauaguuaccagucacucuguuucugaaaccaa

SEQ ID NO: 622323 - RNA, 64 nt, Homo Sapiens
aaaagugucagugaaauguaggucuauauggaaaaguuaccauuaggaaaauauggccauacug

SEQ ID NO: 622324 - RNA, 64 nt, Homo Sapiens
uuaagguuuuuggccugaauagcaggaaagauggaguuaccaguuacugaaauagggaaggaug

SEQ ID NO: 622325 - RNA, 64 nt, Homo Sapiens
caguacuuugcuuugauugaaggcuguagagcugaguuaccaaaauuucuauuucaaaggaaac

SEQ ID NO: 622326 - RNA, 64 nt, Homo Sapiens
uugaggcugaacauaauuucauuaucccucaaaaaguuaccaccacaucagaaaaaauaaaaaa

SEQ ID NO: 622327 - RNA, 64 nt, Homo Sapiens
cauguucuucagauuacaugggauuguaguugggaguuaccauguaacucaaacauaauuaaca

SEQ ID NO: 622328 - RNA, 64 nt, Homo Sapiens
ugggaaugcagcacaguggcccucugcaauacacaguuaccagacaagagccccuaagucccag

SEQ ID NO: 622329 - RNA, 64 nt, Homo Sapiens
ucaccugaucagaauguauugcguaaagcugacaaguuaccaguagggaagagacugguuacua

SEQ ID NO: 622330 - RNA, 64 nt, Homo Sapiens; identical to SEQ ID NO: 86375

SEQ ID NO: 622331 - RNA, 64 nt, Homo Sapiens; identical to SEQ ID NO: 86376

SEQ ID NO: 622332 - RNA, 64 nt, Homo Sapiens; identical to SEQ ID NO: 86377

SEQ ID NO: 622333 - RNA, 64 nt, Homo Sapiens; identical to SEQ ID NO: 86378

SEQ ID NO: 622334 - RNA, 64 nt, Homo Sapiens; identical to SEQ ID NO: 86379

SEQ ID NO: 622335 - RNA, 64 nt, Homo Sapiens; identical to SEQ ID NO: 86380

SEQ ID NO: 622336 - RNA, 64 nt, Homo Sapiens; identical to SEQ ID NO: 86381

SEQ ID NO: 622337 - RNA, 64 nt, Homo Sapiens; identical to SEQ ID NO: 86382

SEQ ID NO: 622338 - RNA, 64 nt, Homo Sapiens; identical to SEQ ID NO: 410642

SEQ ID NO: 622339 - RNA, 64 nt, Homo Sapiens; identical to SEQ ID NO: 410643

SEQ ID NO: 622340 - RNA, 64 nt, Homo Sapiens; identical to SEQ ID NO: 410644

SEQ ID NO: 622341 - RNA, 64 nt, Homo Sapiens; identical to SEQ ID NO: 410645

SEQ ID NO: 622342 - RNA, 64 nt, Homo Sapiens; identical to SEQ ID NO: 410646

SEQ ID NO: 622343 - RNA, 64 nt, Homo Sapiens; identical to SEQ ID NO: 410647

SEQ ID NO: 622344 - RNA, 64 nt, Homo Sapiens; identical to SEQ ID NO: 410648

SEQ ID NO: 622345 - RNA, 64 nt, Homo Sapiens; identical to SEQ ID NO: 410649

SEQ ID NO: 622346 - RNA, 64 nt, Homo Sapiens; identical to SEQ ID NO: 410650

SEQ ID NO: 622347 - RNA, 64 nt, Homo Sapiens; identical to SEQ ID NO: 410651

SEQ ID NO: 622348 - RNA, 64 nt, Homo Sapiens; identical to SEQ ID NO: 410652

SEQ ID NO: 622349 - RNA, 64 nt, Homo Sapiens; identical to SEQ ID NO: 410653

SEQ ID NO: 622350 - RNA, 64 nt, Homo Sapiens; identical to SEQ ID NO: 410654

SEQ ID NO: 622351 - RNA, 64 nt, Homo Sapiens; identical to SEQ ID NO: 410655

SEQ ID NO: 622352 - RNA, 64 nt, Homo Sapiens; identical to SEQ ID NO: 410656

SEQ ID NO: 622353 - RNA, 64 nt, Homo Sapiens; identical to SEQ ID NO: 410657

SEQ ID NO: 622354 - RNA, 64 nt, Homo Sapiens; identical to SEQ ID NO: 410658

SEQ ID NO: 622355 - RNA, 64 nt, Homo Sapiens; identical to SEQ ID NO: 410659

SEQ ID NO: 622356 - RNA, 64 nt, Homo Sapiens; identical to SEQ ID NO: 410660

SEQ ID NO: 622357 - RNA, 64 nt, Homo Sapiens; identical to SEQ ID NO: 410661

SEQ ID NO: 622358 - RNA, 64 nt, Homo Sapiens; identical to SEQ ID NO: 410662

SEQ ID NO: 622359 - RNA, 64 nt, Homo Sapiens; identical to SEQ ID NO: 410663

SEQ ID NO: 622360 - RNA, 64 nt, Homo Sapiens; identical to SEQ ID NO: 410664

SEQ ID NO: 622361 - RNA, 64 nt, Homo Sapiens; identical to SEQ ID NO: 410665

SEQ ID NO: 622362 - RNA, 64 nt, Homo Sapiens; identical to SEQ ID NO: 410666

SEQ ID NO: 622363 - RNA, 64 nt, Homo Sapiens; identical to SEQ ID NO: 410667

SEQ ID NO: 622364 - RNA, 64 nt, Homo Sapiens; identical to SEQ ID NO: 410668

SEQ ID NO: 622365 - RNA, 64 nt, Homo Sapiens; identical to SEQ ID NO: 410669

SEQ ID NO: 622366 - RNA, 64 nt, Homo Sapiens; identical to SEQ ID NO: 410670

SEQ ID NO: 622367 - RNA, 64 nt, Homo Sapiens; identical to SEQ ID NO: 410671

SEQ ID NO: 622368 - RNA, 64 nt, Homo Sapiens; identical to SEQ ID NO: 410672

SEQ ID NO: 622369 - RNA, 64 nt, Homo Sapiens; identical to SEQ ID NO: 410673

SEQ ID NO: 622370 - RNA, 64 nt, Homo Sapiens; identical to SEQ ID NO: 410674

SEQ ID NO: 622371 - RNA, 64 nt, Homo Sapiens; identical to SEQ ID NO: 410675

SEQ ID NO: 622372 - RNA, 64 nt, Homo Sapiens; identical to SEQ ID NO: 410676

SEQ ID NO: 622373 - RNA, 64 nt, Homo Sapiens; identical to SEQ ID NO: 410677

SEQ ID NO: 622374 - RNA, 64 nt, Homo Sapiens; identical to SEQ ID NO: 375724

SEQ ID NO: 622375 - RNA, 64 nt, Homo Sapiens; identical to SEQ ID NO: 375725

SEQ ID NO: 622376 - RNA, 59 nt, Homo Sapiens; identical to SEQ ID NO: 375726

SEQ ID NO: 622377 - RNA, 64 nt, Homo Sapiens; identical to SEQ ID NO: 375727

SEQ ID NO: 622378 - RNA, 64 nt, Homo Sapiens; identical to SEQ ID NO: 375728

SEQ ID NO: 622379 - RNA, 64 nt, Homo Sapiens; identical to SEQ ID NO: 375729

SEQ ID NO: 622380 - RNA, 64 nt, Homo Sapiens; identical to SEQ ID NO: 375730

SEQ ID NO: 622381 - RNA, 64 nt, Homo Sapiens; identical to SEQ ID NO: 375731

SEQ ID NO: 622382 - RNA, 64 nt, Homo Sapiens; identical to SEQ ID NO: 375732

SEQ ID NO: 622383 - RNA, 64 nt, Homo Sapiens; identical to SEQ ID NO: 375733

SEQ ID NO: 622384 - RNA, 64 nt, Homo Sapiens; identical to SEQ ID NO: 375734

SEQ ID NO: 622385 - RNA, 64 nt, Homo Sapiens; identical to SEQ ID NO: 375735

SEQ ID NO: 622386 - RNA, 64 nt, Homo Sapiens; identical to SEQ ID NO: 375736

SEQ ID NO: 622387 - RNA, 64 nt, Homo Sapiens; identical to SEQ ID NO: 375737

SEQ ID NO: 622388 - RNA, 64 nt, Homo Sapiens; identical to SEQ ID NO: 375738

SEQ ID NO: 622389 - RNA, 64 nt, Homo Sapiens; identical to SEQ ID NO: 375739

SEQ ID NO: 622390 - RNA, 64 nt, Homo Sapiens; identical to SEQ ID NO: 562765

SEQ ID NO: 622391 - RNA, 64 nt, Homo Sapiens; identical to SEQ ID NO: 562766

SEQ ID NO: 622392 - RNA, 64 nt, Homo Sapiens; identical to SEQ ID NO: 562767

SEQ ID NO: 622393 - RNA, 64 nt, Homo Sapiens; identical to SEQ ID NO: 562768

SEQ ID NO: 622394 - RNA, 64 nt, Homo Sapiens; identical to SEQ ID NO: 562769

SEQ ID NO: 622395 - RNA, 64 nt, Homo Sapiens; identical to SEQ ID NO: 562770

SEQ ID NO: 622396 - RNA, 64 nt, Homo Sapiens; identical to SEQ ID NO: 562771

SEQ ID NO: 622397 - RNA, 64 nt, Homo Sapiens; identical to SEQ ID NO: 562772

SEQ ID NO: 622398 - RNA, 64 nt, Homo Sapiens; identical to SEQ ID NO: 562773

SEQ ID NO: 622399 - RNA, 64 nt, Homo Sapiens; identical to SEQ ID NO: 562774

SEQ ID NO: 622400 - RNA, 64 nt, Homo Sapiens; identical to SEQ ID NO: 562775

SEQ ID NO: 622401 - RNA, 64 nt, Homo Sapiens; identical to SEQ ID NO: 562776

SEQ ID NO: 622402 - RNA, 64 nt, Homo Sapiens; identical to SEQ ID NO: 562777

SEQ ID NO: 622403 - RNA, 64 nt, Homo Sapiens; identical to SEQ ID NO: 562778

SEQ ID NO: 622404 - RNA, 64 nt, Homo Sapiens; identical to SEQ ID NO: 562779

SEQ ID NO: 622405 - RNA, 64 nt, Homo Sapiens; identical to SEQ ID NO: 562780

SEQ ID NO: 622406 - RNA, 64 nt, Homo Sapiens; identical to SEQ ID NO: 562781

SEQ ID NO: 622407 - RNA, 64 nt, Homo Sapiens; identical to SEQ ID NO: 562782

SEQ ID NO: 622408 - RNA, 64 nt, Homo Sapiens; identical to SEQ ID NO: 562783

SEQ ID NO: 622409 - RNA, 64 nt, Homo Sapiens; identical to SEQ ID NO: 562784

SEQ ID NO: 622410 - RNA, 64 nt, Homo Sapiens; identical to SEQ ID NO: 562785

SEQ ID NO: 622411 - RNA, 64 nt, Homo Sapiens; identical to SEQ ID NO: 562786

SEQ ID NO: 622412 - RNA, 64 nt, Homo Sapiens; identical to SEQ ID NO: 562787

SEQ ID NO: 622413 - RNA, 64 nt, Homo Sapiens; identical to SEQ ID NO: 562788

SEQ ID NO: 622414 - RNA, 64 nt, Homo Sapiens; identical to SEQ ID NO: 562789

SEQ ID NO: 622415 - RNA, 64 nt, Homo Sapiens; identical to SEQ ID NO: 562790

SEQ ID NO: 622416 - RNA, 64 nt, Homo Sapiens; identical to SEQ ID NO: 562791

SEQ ID NO: 622417 - RNA, 64 nt, Homo Sapiens; identical to SEQ ID NO: 562792

SEQ ID NO: 622418 - RNA, 64 nt, Homo Sapiens; identical to SEQ ID NO: 562793

SEQ ID NO: 622419 - RNA, 64 nt, Homo Sapiens; identical to SEQ ID NO: 562794

SEQ ID NO: 622420 - RNA, 64 nt, Homo Sapiens; identical to SEQ ID NO: 562795

SEQ ID NO: 622421 - RNA, 64 nt, Homo Sapiens; identical to SEQ ID NO: 562796

SEQ ID NO: 622422 - RNA, 64 nt, Homo Sapiens; identical to SEQ ID NO: 562797

SEQ ID NO: 622423 - RNA, 64 nt, Homo Sapiens; identical to SEQ ID NO: 562798

SEQ ID NO: 622424 - RNA, 64 nt, Homo Sapiens; identical to SEQ ID NO: 562799

SEQ ID NO: 622425 - RNA, 64 nt, Homo Sapiens; identical to SEQ ID NO: 562800

SEQ ID NO: 622426 - RNA, 64 nt, Homo Sapiens; identical to SEQ ID NO: 562801

SEQ ID NO: 622427 - RNA, 64 nt, Homo Sapiens; identical to SEQ ID NO: 562802

SEQ ID NO: 622428 - RNA, 64 nt, Homo Sapiens; identical to SEQ ID NO: 562803

SEQ ID NO: 622429 - RNA, 64 nt, Homo Sapiens; identical to SEQ ID NO: 562804

SEQ ID NO: 622430 - RNA, 64 nt, Homo Sapiens; identical to SEQ ID NO: 562805

SEQ ID NO: 622431 - RNA, 64 nt, Homo Sapiens; identical to SEQ ID NO: 562806

SEQ ID NO: 622432 - RNA, 64 nt, Homo Sapiens; identical to SEQ ID NO: 562807

SEQ ID NO: 622433 - RNA, 64 nt, Homo Sapiens; identical to SEQ ID NO: 562808

SEQ ID NO: 622434 - RNA, 64 nt, Homo Sapiens; identical to SEQ ID NO: 562809

SEQ ID NO: 622435 - RNA, 64 nt, Homo Sapiens; identical to SEQ ID NO: 562810

SEQ ID NO: 622436 - RNA, 64 nt, Homo Sapiens; identical to SEQ ID NO: 562811

SEQ ID NO: 622437 - RNA, 64 nt, Homo Sapiens; identical to SEQ ID NO: 562812

SEQ ID NO: 622438 - RNA, 64 nt, Homo Sapiens; identical to SEQ ID NO: 562813

SEQ ID NO: 622439 - RNA, 64 nt, Homo Sapiens; identical to SEQ ID NO: 562814

SEQ ID NO: 622440 - RNA, 64 nt, Homo Sapiens; identical to SEQ ID NO: 562815

SEQ ID NO: 622441 - RNA, 64 nt, Homo Sapiens; identical to SEQ ID NO: 562816

SEQ ID NO: 622442 - RNA, 64 nt, Homo Sapiens; identical to SEQ ID NO: 562817

SEQ ID NO: 622443 - RNA, 64 nt, Homo Sapiens; identical to SEQ ID NO: 562818

SEQ ID NO: 622444 - RNA, 64 nt, Homo Sapiens; identical to SEQ ID NO: 562819

SEQ ID NO: 622445 - RNA, 64 nt, Homo Sapiens; identical to SEQ ID NO: 562820

SEQ ID NO: 622446 - RNA, 64 nt, Homo Sapiens; identical to SEQ ID NO: 562821

SEQ ID NO: 622447 - RNA, 64 nt, Homo Sapiens; identical to SEQ ID NO: 562822

SEQ ID NO: 622448 - RNA, 64 nt, Homo Sapiens; identical to SEQ ID NO: 562823

SEQ ID NO: 622449 - RNA, 64 nt, Homo Sapiens; identical to SEQ ID NO: 562824

SEQ ID NO: 622450 - RNA, 64 nt, Homo Sapiens; identical to SEQ ID NO: 562825

SEQ ID NO: 622451 - RNA, 64 nt, Homo Sapiens; identical to SEQ ID NO: 562826

SEQ ID NO: 622452 - RNA, 64 nt, Homo Sapiens; identical to SEQ ID NO: 562827

SEQ ID NO: 622453 - RNA, 64 nt, Homo Sapiens; identical to SEQ ID NO: 562828

SEQ ID NO: 622454 - RNA, 64 nt, Homo Sapiens; identical to SEQ ID NO: 562829

SEQ ID NO: 622455 - RNA, 64 nt, Homo Sapiens; identical to SEQ ID NO: 562830

SEQ ID NO: 622456 - RNA, 64 nt, Homo Sapiens; identical to SEQ ID NO: 562831

SEQ ID NO: 622457 - RNA, 64 nt, Homo Sapiens; identical to SEQ ID NO: 562832

SEQ ID NO: 622458 - RNA, 64 nt, Homo Sapiens; identical to SEQ ID NO: 562833

SEQ ID NO: 622459 - RNA, 64 nt, Homo Sapiens; identical to SEQ ID NO: 562834

SEQ ID NO: 622460 - RNA, 64 nt, Homo Sapiens; identical to SEQ ID NO: 562835

SEQ ID NO: 622461 - RNA, 64 nt, Homo Sapiens; identical to SEQ ID NO: 562836

SEQ ID NO: 622462 - RNA, 64 nt, Homo Sapiens; identical to SEQ ID NO: 562837

SEQ ID NO: 622463 - RNA, 64 nt, Homo Sapiens; identical to SEQ ID NO: 562838

SEQ ID NO: 622464 - RNA, 64 nt, Homo Sapiens
acuuaggaagcuuugccaguuggacuucacagagcugucagaagcagcauuggaaaaagccacu

SEQ ID NO: 622465 - RNA, 64 nt, Homo Sapiens
acuugggaagguuugccagcuggacuuuacagagcugucagaagacucucuggagauagcuacc

SEQ ID NO: 622466 - RNA, 64 nt, Homo Sapiens
gugggagugauuuugcaacuaaguggauugagugcugucagaaacuggauugagugcugucaga

SEQ ID NO: 622467 - RNA, 64 nt, Homo Sapiens
guggauugagugcugucagauucuggauugagugcugucagaaacucaagugagcaaggguuuc

SEQ ID NO: 622468 - RNA, 64 nt, Homo Sapiens
ucuugcagauacuguguucauggaggguggauggcugucagagcguuguaaagugaaguaagau

SEQ ID NO: 622469 - RNA, 64 nt, Homo Sapiens
agccccggggggcagcagguccugcccugucaggcugucagacagcacgggggcagcgugcagc

SEQ ID NO: 622470 - RNA, 64 nt, Homo Sapiens
auacugcccuucucucugccugccucaccuccagcugucagagggugagcagggcccuggaggc

SEQ ID NO: 622471 - RNA, 64 nt, Homo Sapiens
cccccagcccagccugcucugcggcccccugcggcugucagagagcggugagaccuggagcgag

SEQ ID NO: 622472 - RNA, 64 nt, Homo Sapiens
agaugggacguuuuauuugugugcucucccuugacugucagauugaaguaagagcaguucucuc

SEQ ID NO: 622473 - RNA, 64 nt, Homo Sapiens
agcagagcuuccauuaguguagaccuguagccaccugucagaagguggguggcauauuggggac

SEQ ID NO: 622474 - RNA, 64 nt, Homo Sapiens
aagaggauuccuucaccacaguuucaccuuuacgcugucagacaacuuccugccacagaagaag

SEQ ID NO: 622475 - RNA, 64 nt, Homo Sapiens
cgucuuccguguucucagagguucuuuucagugucugucagaacuuggcauacuuucuccauag

SEQ ID NO: 622476 - RNA, 64 nt, Homo Sapiens
uguuugauuuuagcguuuccaacgggucccggaacugucagacacguggcccgaggggcugugg

SEQ ID NO: 622477 - RNA, 64 nt, Homo Sapiens
uggugacaagugccaaaggccaggagcucagggccugucagacccacaaaggucuugguucucc

SEQ ID NO: 622478 - RNA, 64 nt, Homo Sapiens; identical to SEQ ID NO: 165852

SEQ ID NO: 622479 - RNA, 64 nt, Homo Sapiens; identical to SEQ ID NO: 165853

SEQ ID NO: 622480 - RNA, 64 nt, Homo Sapiens; identical to SEQ ID NO: 165854

SEQ ID NO: 622481 - RNA, 64 nt, Homo Sapiens; identical to SEQ ID NO: 165855

SEQ ID NO: 622482 - RNA, 64 nt, Homo Sapiens; identical to SEQ ID NO: 165856

SEQ ID NO: 622483 - RNA, 64 nt, Homo Sapiens; identical to SEQ ID NO: 165857

SEQ ID NO: 622484 - RNA, 64 nt, Homo Sapiens; identical to SEQ ID NO: 458986

SEQ ID NO: 622485 - RNA, 64 nt, Homo Sapiens; identical to SEQ ID NO: 458987

SEQ ID NO: 622486 - RNA, 64 nt, Homo Sapiens; identical to SEQ ID NO: 458988

SEQ ID NO: 622487 - RNA, 64 nt, Homo Sapiens; identical to SEQ ID NO: 458989

SEQ ID NO: 622488 - RNA, 64 nt, Homo Sapiens; identical to SEQ ID NO: 458990

SEQ ID NO: 622489 - RNA, 64 nt, Homo Sapiens; identical to SEQ ID NO: 458991

SEQ ID NO: 622490 - RNA, 64 nt, Homo Sapiens; identical to SEQ ID NO: 458992

SEQ ID NO: 622491 - RNA, 64 nt, Homo Sapiens; identical to SEQ ID NO: 458993

SEQ ID NO: 622492 - RNA, 64 nt, Homo Sapiens; identical to SEQ ID NO: 458994

SEQ ID NO: 622493 - RNA, 64 nt, Homo Sapiens; identical to SEQ ID NO: 458995

SEQ ID NO: 622494 - RNA, 64 nt, Homo Sapiens; identical to SEQ ID NO: 458996

SEQ ID NO: 622495 - RNA, 64 nt, Homo Sapiens; identical to SEQ ID NO: 458997

SEQ ID NO: 622496 - RNA, 64 nt, Homo Sapiens; identical to SEQ ID NO: 458998

SEQ ID NO: 622497 - RNA, 64 nt, Homo Sapiens; identical to SEQ ID NO: 458999

SEQ ID NO: 622498 - RNA, 64 nt, Homo Sapiens; identical to SEQ ID NO: 459000

SEQ ID NO: 622499 - RNA, 64 nt, Homo Sapiens; identical to SEQ ID NO: 459001

SEQ ID NO: 622500 - RNA, 64 nt, Homo Sapiens; identical to SEQ ID NO: 459002

SEQ ID NO: 622501 - RNA, 64 nt, Homo Sapiens; identical to SEQ ID NO: 459003

SEQ ID NO: 622502 - RNA, 64 nt, Homo Sapiens; identical to SEQ ID NO: 459004

SEQ ID NO: 622503 - RNA, 64 nt, Homo Sapiens; identical to SEQ ID NO: 459005

SEQ ID NO: 622504 - RNA, 64 nt, Homo Sapiens; identical to SEQ ID NO: 459006

SEQ ID NO: 622505 - RNA, 64 nt, Homo Sapiens; identical to SEQ ID NO: 459007

SEQ ID NO: 622506 - RNA, 64 nt, Homo Sapiens; identical to SEQ ID NO: 459008

SEQ ID NO: 622507 - RNA, 64 nt, Homo Sapiens; identical to SEQ ID NO: 459009

SEQ ID NO: 622508 - RNA, 64 nt, Homo Sapiens; identical to SEQ ID NO: 459010

SEQ ID NO: 622509 - RNA, 64 nt, Homo Sapiens; identical to SEQ ID NO: 459011

SEQ ID NO: 622510 - RNA, 64 nt, Homo Sapiens; identical to SEQ ID NO: 459012

SEQ ID NO: 622511 - RNA, 64 nt, Homo Sapiens; identical to SEQ ID NO: 459013

SEQ ID NO: 622512 - RNA, 64 nt, Homo Sapiens; identical to SEQ ID NO: 459014

SEQ ID NO: 622513 - RNA, 64 nt, Homo Sapiens; identical to SEQ ID NO: 459015

SEQ ID NO: 622514 - RNA, 64 nt, Homo Sapiens; identical to SEQ ID NO: 459016

SEQ ID NO: 622515 - RNA, 64 nt, Homo Sapiens; identical to SEQ ID NO: 459017

SEQ ID NO: 622516 - RNA, 64 nt, Homo Sapiens; identical to SEQ ID NO: 459018

SEQ ID NO: 622517 - RNA, 64 nt, Homo Sapiens; identical to SEQ ID NO: 459019

SEQ ID NO: 622518 - RNA, 64 nt, Homo Sapiens; identical to SEQ ID NO: 459020

SEQ ID NO: 622519 - RNA, 64 nt, Homo Sapiens; identical to SEQ ID NO: 459021

SEQ ID NO: 622520 - RNA, 64 nt, Homo Sapiens; identical to SEQ ID NO: 459022

SEQ ID NO: 622521 - RNA, 64 nt, Homo Sapiens; identical to SEQ ID NO: 459023

SEQ ID NO: 622522 - RNA, 64 nt, Homo Sapiens; identical to SEQ ID NO: 459024

SEQ ID NO: 622523 - RNA, 64 nt, Homo Sapiens; identical to SEQ ID NO: 459025

SEQ ID NO: 622524 - RNA, 64 nt, Homo Sapiens; identical to SEQ ID NO: 459026

SEQ ID NO: 622525 - RNA, 64 nt, Homo Sapiens; identical to SEQ ID NO: 459027

SEQ ID NO: 622526 - RNA, 64 nt, Homo Sapiens; identical to SEQ ID NO: 459028

SEQ ID NO: 622527 - RNA, 64 nt, Homo Sapiens; identical to SEQ ID NO: 459029

SEQ ID NO: 622528 - RNA, 64 nt, Homo Sapiens; identical to SEQ ID NO: 459030

SEQ ID NO: 622529 - RNA, 64 nt, Homo Sapiens; identical to SEQ ID NO: 459031

SEQ ID NO: 622530 - RNA, 64 nt, Homo Sapiens; identical to SEQ ID NO: 459032

SEQ ID NO: 622531 - RNA, 64 nt, Homo Sapiens; identical to SEQ ID NO: 459033

SEQ ID NO: 622532 - RNA, 64 nt, Homo Sapiens; identical to SEQ ID NO: 459034

SEQ ID NO: 622533 - RNA, 64 nt, Homo Sapiens; identical to SEQ ID NO: 459035

SEQ ID NO: 622534 - RNA, 63 nt, Homo Sapiens
cccaucacgcagacaggaaggguguuugcgcacucugaucaacuggaaccucuguaucaugcg

SEQ ID NO: 622535 - RNA, 63 nt, Homo Sapiens
aggaugguagcuggaauaccuuccuucuuaaaaucugaucauggcagggauaugcagggcacu

SEQ ID NO: 622536 - RNA, 63 nt, Homo Sapiens
acugaugcagucccuagggaauagaauggugcuucugaucaccugugacaugaacaguuucuu

SEQ ID NO: 622537 - RNA, 63 nt, Homo Sapiens
uggagagggcugaagcuguugcugggggccgauucugaucaagacacauggcuugaaaaugga

SEQ ID NO: 622538 - RNA, 63 nt, Homo Sapiens
cuacagagucugagaagauaucaucaugcugaaucugaucauacuguuuuuuaaaaguuuaag

SEQ ID NO: 622539 - RNA, 63 nt, Homo Sapiens
caacccucaucaccaugcuuccccuagaaggguucugaucaccggagggcagccccaaaggcc

SEQ ID NO: 622540 - RNA, 63 nt, Homo Sapiens
gugcacucaguuccuguauacuguguguuuuguucugaucaagggguagggaaccuuuccaga

SEQ ID NO: 622541 - RNA, 63 nt, Homo Sapiens
cugccagucgguucccacggagccauuuuuagcucugaucagcaugggaaugugccucggccu

SEQ ID NO: 622542 - RNA, 63 nt, Homo Sapiens
cccccacucuauacuagggacuggaucucagccucugaucaguuucacaaaguuuguucccua

SEQ ID NO: 622543 - RNA, 63 nt, Homo Sapiens
cagacugcugcaaagcuuuugccugcaagagaaucugaucaauuugaagucccuguuugggaa

SEQ ID NO: 622544 - RNA, 63 nt, Homo Sapiens
uacaguucccuuuuuaaaaauauccuuccaugaucugaucaugaggucggggaggaguggagc

SEQ ID NO: 622545 - RNA, 63 nt, Homo Sapiens
accacccagcugguuccagcauugugugaauguucugaucacuuuuacucccuuauagaaaga

SEQ ID NO: 622546 - RNA, 63 nt, Homo Sapiens
uuuuucacccccugacauucuuuaucauguuacucugaucaugcucacacugcagccaagguu

SEQ ID NO: 622547 - RNA, 63 nt, Homo Sapiens
uuaaaaaucuggguaaacuauuaugagggagauucugaucauaucuaaggaaagaguugaucc

SEQ ID NO: 622548 - RNA, 63 nt, Homo Sapiens
uugcacgccuccccccucacgaaaucauaggguucugaucacagucuuuaauuucaggaauca

SEQ ID NO: 622549 - RNA, 63 nt, Homo Sapiens
gaggauggugagauaaauagcucaagguggacuucugaucauuagaacuaggaguaaguccau

SEQ ID NO: 622550 - RNA, 63 nt, Homo Sapiens
gacacauauccauacacagggggcuggcacaaaucugaucagaacuuuaaagauagacuuuag

SEQ ID NO: 622551 - RNA, 63 nt, Homo Sapiens
uaaccauggcuucccucagcugaaauuauaccuucugaucaaauaggcaaugcuggaaggaaa

SEQ ID NO: 622552 - RNA, 63 nt, Homo Sapiens
uacuacaucaaccaaaagaggguaguuuagaacucugaucaggcaaagaaaaauuugguaggc

SEQ ID NO: 622553 - RNA, 63 nt, Homo Sapiens
auauguuugagcauaguagcggcuauccugggcucugaucaugcauauaacuuuuaacucuuu

SEQ ID NO: 622554 - RNA, 63 nt, Homo Sapiens
uccaguugauugucauauccaacaaccccucccucugaucauuucaauggccuggucaacauc

SEQ ID NO: 622555 - RNA, 63 nt, Homo Sapiens
uuaucaaggagauaauucuagucauguccuauaucugaucaagacuguuggacucuauucagu

SEQ ID NO: 622556 - RNA, 63 nt, Homo Sapiens
caguucugucauuguaaucuaauauuuuuacauucugaucauuaauuaaugcaguuuugcaca

SEQ ID NO: 622557 - RNA, 63 nt, Homo Sapiens
ucccucuccacuaguggugaaugcaugugucugucugaucagcaucacugcacacggaggucu

SEQ ID NO: 622558 - RNA, 63 nt, Homo Sapiens
cuguugagguaaaguuugcacagucaucugacuucugaucaagcauuagauuuuaacuuguuu

SEQ ID NO: 622559 - RNA, 63 nt, Homo Sapiens
aaauguuugcuuauuucccuacuaaaauuuguaucugaucaaagcacauaagaauauaaauaa

SEQ ID NO: 622560 - RNA, 63 nt, Homo Sapiens
uuuagaaauacauagacauugucuuuuaugaauucugaucauauuuagucauuuugaccaaau

SEQ ID NO: 622561 - RNA, 63 nt, Homo Sapiens
cguacacugacuuuggggccuggguguugggguucugaucagaauuuggcgggaugauauguu

SEQ ID NO: 622562 - RNA, 63 nt, Homo Sapiens
aaagaaugauuuugugaauucugugauuuuucuucugaucaguuucaaucuguaauaaaugcc

SEQ ID NO: 622563 - RNA, 63 nt, Homo Sapiens
ccaccauccuggaccaugugugccagagccauuucugaucacacaucucagcaaaaugggcac

SEQ ID NO: 622564 - RNA, 63 nt, Homo Sapiens
aaaaccuauaaaggguugaguauaucuaagaccucugaucauuucuacauggaccuauguaua

SEQ ID NO: 622565 - RNA, 63 nt, Homo Sapiens
cugauacuuuuuuuuuuuuuucacugcucacuuucugaucacuaauucuggcuucacuacugc

SEQ ID NO: 622566 - RNA, 63 nt, Homo Sapiens
uccuuacauuuugcaacacugcuaccacucaguucugaucaaaaacuugaaaaacacuucugu

SEQ ID NO: 622567 - RNA, 63 nt, Homo Sapiens
ugugcuuuaggaaauuauugaaucauggauuuuucugaucaaugaagggugugaaggcugaac

SEQ ID NO: 622568 - RNA, 63 nt, Homo Sapiens
gguuucuuaauaugguuguauacgguuguauuuucugaucauuuggauuauaaauuucuuuca

SEQ ID NO: 622569 - RNA, 63 nt, Homo Sapiens
aagaaccaggcuuagauuuuccaaauaagcacaucugaucaaaugguggggguguauuagcag

SEQ ID NO: 622570 - RNA, 63 nt, Homo Sapiens
ccccuucucucccaccccauagggaggcccuuuucugaucaugaaggcaggcgcacgaggucc

SEQ ID NO: 622571 - RNA, 63 nt, Homo Sapiens
ggucucccucagaagccccuuccuccacagacuucugaucaucucccucuucuccccuccuuu

SEQ ID NO: 622572 - RNA, 63 nt, Homo Sapiens
aaucaugcaacguguugggggaaguucugccuuucugaucaaucuuuuggguucacguggaaa

SEQ ID NO: 622573 - RNA, 63 nt, Homo Sapiens
uuaccuagguugccaaagguaauuuaggaagggucugaucauuuagaugagaguucuuugggg

SEQ ID NO: 622574 - RNA, 63 nt, Homo Sapiens
cauucaaaaaaaagaacuuugaaagagaaucuuucugaucaccuuagaaauggcaguaagccc

SEQ ID NO: 622575 - RNA, 63 nt, Homo Sapiens
acccaccaggccuuaccuaguguuucccaucccucugaucacauagcacuuguaugugauuua

SEQ ID NO: 622576 - RNA, 63 nt, Homo Sapiens
uaacauuaaauuuaugaguauuuuacucugaauucugaucaccagauaauucauuuuucugau

SEQ ID NO: 622577 - RNA, 63 nt, Homo Sapiens
agaaaauuucugacugauagaguagaugccuguucugaucaagauaacguguauaaaaaauca

SEQ ID NO: 622578 - RNA, 63 nt, Homo Sapiens
ggaagaaaugcaucacuagggguugauucccaaucugaucaacugauaaugggugagagagca

SEQ ID NO: 622579 - RNA, 63 nt, Homo Sapiens
gugccccaugccccauuacaggcucacacccagucugaucaggcugaguuuuguauguaucua

SEQ ID NO: 622580 - RNA, 63 nt, Homo Sapiens
ggaauaugugaagauguuuuuaugaagucucuuucugaucacgaacaauagcuugcgcucuac

SEQ ID NO: 622581 - RNA, 63 nt, Homo Sapiens
agaaggaugggacuauuacauccacaugauaccucugaucaaguauuuuugacauuuacugug

SEQ ID NO: 622582 - RNA, 63 nt, Homo Sapiens
uuaacacauuguuauuucuguaggagcaacuucucugaucaaaauuacuuuucuggguaugug

SEQ ID NO: 622583 - RNA, 63 nt, Homo Sapiens
uauauacuguauucuagccagaauaauuuuagaucugaucagguaguagcuaaaauuagaaaa

SEQ ID NO: 622584 - RNA, 63 nt, Homo Sapiens
uccagagaugagcuguuucuuuuuaccuccucuucugaucacugucgcucuccuucgauucca

SEQ ID NO: 622585 - RNA, 63 nt, Homo Sapiens
ccuggguccaucaguuugucaaugagagcuuugucugaucagugcaggugcccacauucugcu

SEQ ID NO: 622586 - RNA, 63 nt, Homo Sapiens
aaaaucaaacucuuaauauaaaauacuaauguuucugaucaauggguuuugauacuuauguug

SEQ ID NO: 622587 - RNA, 63 nt, Homo Sapiens
gguccagaggggagauagguuaaauucugugguucugaucauuccuuuugauuugauaaguua

SEQ ID NO: 622588 - RNA, 63 nt, Homo Sapiens
gaagaccuguaacacuaaguuguccuucauguaucugaucaauuggcauuuuauguccuucug

SEQ ID NO: 622589 - RNA, 63 nt, Homo Sapiens
ccuaacuugcugggugaucagaaacacauugguucugaucacuaaacagccuauuuacaagug

SEQ ID NO: 622590 - RNA, 63 nt, Homo Sapiens
aaauauuggcuacugguguaacaucauaccauuucugaucaugccagcucaaccuuugugcug

SEQ ID NO: 622591 - RNA, 63 nt, Homo Sapiens
aauuauauguaaaauaauauacuguuauuucucucugaucauuauaaauuuacguucucagca

SEQ ID NO: 622592 - RNA, 63 nt, Homo Sapiens
gucuuuucagcacuuugagccgguuguacaaucucugaucaguguuaauauuaagcaaggugc

SEQ ID NO: 622593 - RNA, 63 nt, Homo Sapiens
uacucugcuguggucaugccaagcaauauguucucugaucauauauauauauauauaccauaa

SEQ ID NO: 622594 - RNA, 63 nt, Homo Sapiens
uuuuccauaggcauuaaagugcugaaugcucagucugaucaacaagugggcaccugcacuacc

SEQ ID NO: 622595 - RNA, 63 nt, Homo Sapiens
uguuuuauaaaagcucuagauaaaacuuucuuuucugaucaugaaucaaguaucugugguuuc

SEQ ID NO: 622596 - RNA, 63 nt, Homo Sapiens
uucaacagaauuuauauguuguaauaggaauuaucugaucaauuacacucuuauauauaauuu

SEQ ID NO: 622597 - RNA, 63 nt, Homo Sapiens
cgcaggacccaaacacucagggaaaggaggcccucugaucacaaaaccggggaaccccaacug

SEQ ID NO: 622598 - RNA, 63 nt, Homo Sapiens
cagaauugagaaagaucucuauucuuuaccguuucugaucacauagagugcuuccuccuaacc

SEQ ID NO: 622599 - RNA, 63 nt, Homo Sapiens
aaguuugagugcuaugcaaaguugagauuaucuucugaucaggaaaauccacucuuuuauuau

SEQ ID NO: 622600 - RNA, 63 nt, Homo Sapiens
guugcaaaaaauugcuacuuugacacuuggauuucugaucaguguauauauuuaaguuuuaag

SEQ ID NO: 622601 - RNA, 63 nt, Homo Sapiens
gacucucaaccaacuucagaucuaugacauuauucugaucacuggcuccaucauacauauuca

SEQ ID NO: 622602 - RNA, 63 nt, Homo Sapiens
acucagcaugacgacugaguagacuuguuuacaucugaucaaagcacugggcuuguccaggcu

SEQ ID NO: 622603 - RNA, 63 nt, Homo Sapiens
uaaaccacccauuucagaguuuugugguaaucgucugaucauauacugaagaagcuuuugaag

SEQ ID NO: 622604 - RNA, 63 nt, Homo Sapiens
aauuuuauguuuuaauuuauucaggacucugagucugaucaugaacucaaguaaaugcuucag

SEQ ID NO: 622605 - RNA, 63 nt, Homo Sapiens
cuuccuccugaggcaccucuuggccccaggagaucugaucacacaaaggacacagaaaaaaaa

SEQ ID NO: 622606 - RNA, 63 nt, Homo Sapiens
gguguacacuaacauuucccaucuugccacauuucugaucagacuuggcacuuuuucgugugg

SEQ ID NO: 622607 - RNA, 63 nt, Homo Sapiens
gcaguuuucucucaaauaugcuggcucaauccuucugaucauuccuaauuuuuuaugcuaaaa

SEQ ID NO: 622608 - RNA, 63 nt, Homo Sapiens
gcucuuuuuaagcccuggcaaacuucuguuuaaucugaucacgccacaucccuccacuucucc

SEQ ID NO: 622609 - RNA, 63 nt, Homo Sapiens
aaacagucuacacagucucacguagaccaaaauucugaucauuuuccaggcuguugcaugaag

SEQ ID NO: 622610 - RNA, 63 nt, Homo Sapiens
ggggacccagacugccuucaucucugauggcagucugaucacuguggccacugugcgagccgu

SEQ ID NO: 622611 - RNA, 63 nt, Homo Sapiens
uccucaagcaacacuccuagggccuggcuucugucugaucaaggcaccacacaacccagaaag

SEQ ID NO: 622612 - RNA, 63 nt, Homo Sapiens
uuuuuaaguggcacggucuuuuucugcuugaaaucugaucacaccccccagccauugcccucc

SEQ ID NO: 622613 - RNA, 63 nt, Homo Sapiens
uucaccguaguaacacauaaaguaaaugcuaccucugaucaaagcaccuugaauggaaggucc

SEQ ID NO: 622614 - RNA, 63 nt, Homo Sapiens
ugccccaugagugggauagaaaagugcagcuccucugaucaucucugaguuacucgggaggga

SEQ ID NO: 622615 - RNA, 63 nt, Homo Sapiens
ggugcgcauugauguacauauuccuggggguuuucugaucacuucaguucccacuugcuuggg

SEQ ID NO: 622616 - RNA, 63 nt, Homo Sapiens
gaacaccuuaggaagaaaguauuuaggagguggucugaucauacuguaauggguaaaagccac

SEQ ID NO: 622617 - RNA, 63 nt, Homo Sapiens
gucuauuuugcauaaaauguagcucaaaugcuaucugaucaaacauguugacuauuugcaacg

SEQ ID NO: 622618 - RNA, 63 nt, Homo Sapiens
gugaacuugcccuucaauaggagacucagcuuaucugaucaagucaagucucuuccagagugc

SEQ ID NO: 622619 - RNA, 63 nt, Homo Sapiens
cuauggucccaguaaaaguagggcuauguauuaucugaucaguuuauaacuguccagaagugu

SEQ ID NO: 622620 - RNA, 63 nt, Homo Sapiens
uguuuguggauuuaauuaaauuauuacuuuguaucugaucagcucaauauuuucugugauaau

SEQ ID NO: 622621 - RNA, 63 nt, Homo Sapiens
uucuuguuauuuccaaauagcaagauuuaauaaucugaucaaguaagguaaaaaugagguuuc

SEQ ID NO: 622622 - RNA, 63 nt, Homo Sapiens
ugccaaagaaucuaggaaaucauagaauaguauucugaucagucaggaguuucuauagcgaga

SEQ ID NO: 622623 - RNA, 63 nt, Homo Sapiens
aguugacaccagcuaaggcugcuuaaaauaaguucugaucauuauauaagaagggaaaugccu

SEQ ID NO: 622624 - RNA, 63 nt, Homo Sapiens
guugagaucagugacugcuggauagucucccagucugaucaaugaagcauucgauuaguuuuu

SEQ ID NO: 622625 - RNA, 63 nt, Homo Sapiens
uuuaauuuuggccacuuguagguaucagugugaucugaucaacacucugguuaccuuggucag

SEQ ID NO: 622626 - RNA, 63 nt, Homo Sapiens
guuucccuuaccugaucgacauauuuuccuuuaucugaucaacccaucaaucauguggauuuc

SEQ ID NO: 622627 - RNA, 63 nt, Homo Sapiens
ugacauaauaguccaccucccauuacuuugauaucugaucaaauguauagacuuggcuuuguu

SEQ ID NO: 622628 - RNA, 63 nt, Homo Sapiens
cuugaauaaggaaaugacaauuuuuuccacuuaucugaucagaacaaauguuuauuaagcauc

SEQ ID NO: 622629 - RNA, 63 nt, Homo Sapiens
caccuggccaggauuugguuguuuaaauauaaaucugaucaccccccugcuuagaacccuucu

SEQ ID NO: 622630 - RNA, 63 nt, Homo Sapiens
uuuuaauccccuuuaaugaugcagugguuuuuaucugaucaggaacuugucaugauuuccuuu

SEQ ID NO: 622631 - RNA, 63 nt, Homo Sapiens
ggucugugcccucacagcacgcagguguuguguucugaucacuuugucaggaugggagaggcc

SEQ ID NO: 622632 - RNA, 63 nt, Homo Sapiens
ugguuuuacagcuaccacccaccaagacuuuugucugaucaaguaacuuuaacuuuugaaaag

SEQ ID NO: 622633 - RNA, 63 nt, Homo Sapiens
cuacaguguacuuuaaguaggcugagauaagugucugaucaaggaccugcuuaaacaaguacu

SEQ ID NO: 622634 - RNA, 63 nt, Homo Sapiens
aucgggagcaaaucucugacugcucuggggccaucugaucaccagggcacucugagauagcac

SEQ ID NO: 622635 - RNA, 63 nt, Homo Sapiens
gaauugcaauuuuaagaccagaaaaauuugaagucugaucagagauuuacaacuguucauuau

SEQ ID NO: 622636 - RNA, 63 nt, Homo Sapiens
ucguauguuaguuucacuugucuacuuuauaugucugaucaauuuggauaccauuuuguccag

SEQ ID NO: 622637 - RNA, 63 nt, Homo Sapiens
cgagggagagaccuuuccacugcagagagucucucugaucaagacaccgcagugauggagaag

SEQ ID NO: 622638 - RNA, 63 nt, Homo Sapiens
uaaauaaugcuggaauacucaaguguauuuuacucugaucaaagcucaguuuguagugauggg

SEQ ID NO: 622639 - RNA, 63 nt, Homo Sapiens
aacuucagauucuaagagugaagucauugcauaucugaucaauauuaucaucacagcagaaaa

SEQ ID NO: 622640 - RNA, 63 nt, Homo Sapiens
uccuguguuugaguuggaaugucauuguaccccucugaucauuuuaguauauugcgguuaugu

SEQ ID NO: 622641 - RNA, 63 nt, Homo Sapiens
gcuguggcaucacgaaacauccccucccuggugucugaucaggccacaucaugaccaaaggaa

SEQ ID NO: 622642 - RNA, 63 nt, Homo Sapiens
cagguuaagacaaaggguugacuggccuauuuaucugaucaagaacaugucagcaaugucucu

SEQ ID NO: 622643 - RNA, 63 nt, Homo Sapiens
ggugcagguuuuggguuuggcauuauucauguuucugaucaauucuaugcaacucucauaguu

SEQ ID NO: 622644 - RNA, 63 nt, Homo Sapiens
uagaggcugaaugacaaugccaaacacuccaccucugaucagaaccaugcaguguuaacacuu

SEQ ID NO: 622645 - RNA, 63 nt, Homo Sapiens
accuuggccgugauucccaaauggugacucuuuucugaucagccuggggaggagguugaugua

SEQ ID NO: 622646 - RNA, 63 nt, Homo Sapiens
uugggcuucaagucucucucgagguccaacagcucugaucauuuuguauguaaagauaccucu

SEQ ID NO: 622647 - RNA, 63 nt, Homo Sapiens
aaacugauuguaaagcuuuuuuuugcucuauuuucugaucauguaaagaaaacaauauugaaa

SEQ ID NO: 622648 - RNA, 63 nt, Homo Sapiens
gauauucuuaaaucagcaguggugugguaguaaucugaucacacuguagaugaucggccugcu

SEQ ID NO: 622649 - RNA, 63 nt, Homo Sapiens
gcuuuuccaccaaaagccugaaucugucaauccucugaucaaauaucugagugccaccacugg

SEQ ID NO: 622650 - RNA, 63 nt, Homo Sapiens
acuucucuccaagggcaggcuguuaggccccuuucugaucaggaggcuucuuuaugaauuaaa

SEQ ID NO: 622651 - RNA, 63 nt, Homo Sapiens
ucacagggagaaacuugccucugaaagcuauuuucugaucaagaaaaggcccacuuuuuaaaa

SEQ ID NO: 622652 - RNA, 63 nt, Homo Sapiens
cagacacagacaagcuucauuuaaauuauuucaucugaucauuaucauuuauaacuuuauugu

SEQ ID NO: 622653 - RNA, 63 nt, Homo Sapiens
caauucaagugacacauuaaugauaaacucagaucugaucaagaguccggauuucuaacaguc

SEQ ID NO: 622654 - RNA, 63 nt, Homo Sapiens
cuacucaagcuccucuggccgcggaacaauuccucugaucauguuugguuuucuucuuccuua

SEQ ID NO: 622655 - RNA, 63 nt, Homo Sapiens
gccuuucaacccaacaaggguucuggguuaucuucugaucauggaagucaacuggguggccuu

SEQ ID NO: 622656 - RNA, 63 nt, Homo Sapiens
auuuaacuaaaggguaguuguuaggaauuaagaucugaucagaaauauuucugcuucaagccu

SEQ ID NO: 622657 - RNA, 63 nt, Homo Sapiens
auuuuuuuauaccaguuuugcugucuuuuuuccucugaucaguuuuuaucuguaaugguuugu

SEQ ID NO: 622658 - RNA, 63 nt, Homo Sapiens
caucauggacucgcccagcuaccccagccccaaucugaucagauccugauguuuaagaccuga

SEQ ID NO: 622659 - RNA, 63 nt, Homo Sapiens
guugguggaaaaacguaagggaggagugggaggucugaucauugggcucugaagcucaaguca

SEQ ID NO: 622660 - RNA, 63 nt, Homo Sapiens
gguccugaaauuuucaucuucacauugaaagcuucugaucaacuauaauaaaguagagcaaca

SEQ ID NO: 622661 - RNA, 63 nt, Homo Sapiens
gccuuauuggaaagcaguccgauguguuugcuuucugaucaagcuugaugggauucuggacag

SEQ ID NO: 622662 - RNA, 63 nt, Homo Sapiens
uuaauauugguguucaagacuauaucuaauuccucugaucacuuugagaaacaaacuuuuauu

SEQ ID NO: 622663 - RNA, 63 nt, Homo Sapiens
auaaaauuuggccaauuuuuacagaagaaauucucugaucauuuaguucugucuauuuagaaa

SEQ ID NO: 622664 - RNA, 63 nt, Homo Sapiens
ggaggggcuuugugauaacuacucccagcuucuucugaucauuucaaaauuaagucgauuuuu

SEQ ID NO: 622665 - RNA, 63 nt, Homo Sapiens
gugagaagaggaggucuacccaggagccucgggucugaucaagggagaggccaggcgcagcuc

SEQ ID NO: 622666 - RNA, 63 nt, Homo Sapiens
ccuuuucccccgucuuuucugaaaaauuguaaaucugaucauaucaacauguaugaacuuaaa

SEQ ID NO: 622667 - RNA, 63 nt, Homo Sapiens
aaacuaugggaaagcugaucuauaaagaggcauucugaucaauucauuuguaggaaacuggga

SEQ ID NO: 622668 - RNA, 63 nt, Homo Sapiens
ucuguuggucagucagguguuugcucagcccugucugaucaccugugcugcucugucccuaac

SEQ ID NO: 622669 - RNA, 63 nt, Homo Sapiens
acuuguuuauaaaaaacaaaacaauaaaaagagucugaucagagcccagggcccugucugucu

SEQ ID NO: 622670 - RNA, 63 nt, Homo Sapiens
ugucccccuuuuaaaaauaauuauuuuugcuauucugaucauuaauccauuuuccccacucuu

SEQ ID NO: 622671 - RNA, 63 nt, Homo Sapiens
uuguuuuuaguaugaaaauggagaaaucaaggcucugaucauuuguacguguaguuucuagug

SEQ ID NO: 622672 - RNA, 63 nt, Homo Sapiens
acauuguaagccuguagcuugccaauagacuugucugaucauaauuggcagugccaguuucua

SEQ ID NO: 622673 - RNA, 63 nt, Homo Sapiens
cuguucucuuuguuuuaaagacacuuuaccuacucugaucacuuauuauauuucuggaauuuc

SEQ ID NO: 622674 - RNA, 63 nt, Homo Sapiens
uucuuuuuugguuuuuugguuuuuuuuuuuuccucugaucacauucuucaaagacggaguauu

SEQ ID NO: 622675 - RNA, 63 nt, Homo Sapiens
auuuuauauuuacauugagaauuucaacuagcuucugaucaauuuuuaauaaaaaauuuucaa

SEQ ID NO: 622676 - RNA, 63 nt, Homo Sapiens
ugaaagaauuuccuguugagauauaaaggcccaucugaucacuggauugggcugagcagagaa

SEQ ID NO: 622677 - RNA, 63 nt, Homo Sapiens
aggcaucugcaugggucuucuuuuacuggacugucugaucaggguggagggaaggugagaggu

SEQ ID NO: 622678 - RNA, 63 nt, Homo Sapiens
cuaacucaacuguugccgucucaucuucucucaucugaucacuucauguuuuguuuuuguuac

SEQ ID NO: 622679 - RNA, 63 nt, Homo Sapiens
ggacccccggggcugcagccuccucuuucugucucugaucagagccgacaccagacgugauua

SEQ ID NO: 622680 - RNA, 63 nt, Homo Sapiens
uguuacaaacuaaauuccauguaguggcuuaucucugaucagcgcccucaguuuuccuacaga

SEQ ID NO: 622681 - RNA, 63 nt, Homo Sapiens
uaauuuguauguagcaguguugaaaaguuguggucugaucagugcuuauucuguuuuaaacau

SEQ ID NO: 622682 - RNA, 63 nt, Homo Sapiens
gaagcagauagcuucaguccggaaagcuaggccucugaucauaauucuagcucaugguugcua

SEQ ID NO: 622683 - RNA, 63 nt, Homo Sapiens
uaugcaucccccaaggaugacuugcuuggcccuucugaucaugagaaaaccauggucucucug

SEQ ID NO: 622684 - RNA, 63 nt, Homo Sapiens
auaugaccauuuaaccucagcuuuuuuuauuauucugaucauguguuuuaacauuuuugcuau

SEQ ID NO: 622685 - RNA, 63 nt, Homo Sapiens
guucacaaaaauuauguuaggauuuggguuguaucugaucauggaugaaugugcuagaugaau

SEQ ID NO: 622686 - RNA, 63 nt, Homo Sapiens
ugggauuugcugaggcauuuuaagaaacacugaucugaucauucuguaaccuuucaugugugu

SEQ ID NO: 622687 - RNA, 63 nt, Homo Sapiens
aaagcucacgucguauuucuuuucauggagucuucugaucaaaucauauuaccaccgcucuca

SEQ ID NO: 622688 - RNA, 63 nt, Homo Sapiens
uuuuuuuacuuccuccuccuuuuuaacuguuucucugaucaaauuacuuauuuucauauugua

SEQ ID NO: 622689 - RNA, 63 nt, Homo Sapiens
uguggugugaggacuucucacccauuguuuccaucugaucagcgcaccgggaaacucugcuuc

SEQ ID NO: 622690 - RNA, 63 nt, Homo Sapiens
auggcaggggacagaaugugcugcauuuucuuaucugaucacaaguugauugaagugaguugg

SEQ ID NO: 622691 - RNA, 63 nt, Homo Sapiens
ugaugcaugcuggaaaaagacacgcuuuucauuucugaucaguuguacuucauccuauaucag

SEQ ID NO: 622692 - RNA, 63 nt, Homo Sapiens
uaggaagguaugcagugugagaacugaaguauuucugaucacucucagacuguccuccgugau

SEQ ID NO: 622693 - RNA, 63 nt, Homo Sapiens
ucagagugagugggaaguuucacaacggauugaucugaucaaucccuucaaggagcugaaggc

SEQ ID NO: 622694 - RNA, 63 nt, Homo Sapiens
cauuuuguucaacuuauacaaaacaagccagcaucugaucaaaaguauuacauaaaauauuuu

SEQ ID NO: 622695 - RNA, 63 nt, Homo Sapiens
gcaaauuucagccaauuuuguagcuaagauuguucugaucagcucaaaaagauuuggcuuagu

SEQ ID NO: 622696 - RNA, 63 nt, Homo Sapiens
aauuuguuguaauuuuaugucucaucagcuggcucugaucaugccucuuggaugcguuauuuu

SEQ ID NO: 622697 - RNA, 63 nt, Homo Sapiens
auuuguuuagugcuacauuuacugaagguuuauucugaucauauuguauucaaaauuaaugaa

SEQ ID NO: 622698 - RNA, 63 nt, Homo Sapiens
uagucccuucauucuguagaugcuuugcagauaucugaucagacuguaggacuaagcuaaguc

SEQ ID NO: 622699 - RNA, 63 nt, Homo Sapiens
ugugacuaaggucaaggaaaaagcauugaauguucugaucagaaaacccagaguuuauguaga

SEQ ID NO: 622700 - RNA, 63 nt, Homo Sapiens
ugugguccuccuccccagaacucagaacccaagucugaucaggagaaaaacaucacacaaauu

SEQ ID NO: 622701 - RNA, 63 nt, Homo Sapiens
auggauguaggagagcuucuuuucuaacuaccaucugaucagacaaggaaugaagcaaugacu

SEQ ID NO: 622702 - RNA, 63 nt, Homo Sapiens
uugcgaguuuugaugaguuuuccgagaaacuuuucugaucaguuaaaguauuuuuucuagucu

SEQ ID NO: 622703 - RNA, 63 nt, Homo Sapiens
uuauuggugacuuacuggacauuuucuuucuuuucugaucagguuuuuauguaggugaguuau

SEQ ID NO: 622704 - RNA, 63 nt, Homo Sapiens
uacuuuaaaaaaugacuccuguagccuguggaaucugaucagucagcaagauccuguccaaga

SEQ ID NO: 622705 - RNA, 63 nt, Homo Sapiens
guuccgagaggcauagaaggaugcucagacucaucugaucaaauaaaagaguuagaugggaug

SEQ ID NO: 622706 - RNA, 63 nt, Homo Sapiens
cauuuuggaggcuuuguuauaguuagagauaauucugaucaauugcaaaauagaagaagagga

SEQ ID NO: 622707 - RNA, 63 nt, Homo Sapiens
acuuuucugcuaccugguuuuuguguuguuuucucugaucacaccgugugcuccaguguuuuc

SEQ ID NO: 622708 - RNA, 63 nt, Homo Sapiens
uccuuugugccuccacagccacagccuggcagcucugaucaggaaagugaggaacagcaacaa

SEQ ID NO: 622709 - RNA, 63 nt, Homo Sapiens
acaauacauuucugguaagauggaaucacuaccucugaucacauaucaggcuaacgauagaga

SEQ ID NO: 622710 - RNA, 63 nt, Homo Sapiens
acagaaucaugaucuuccagguuccccccaguuucugaucauguugauuuguagcuguggauc

SEQ ID NO: 622711 - RNA, 63 nt, Homo Sapiens
guucugugcccuucaguggauggaacgugagugucugaucaucucucuuggaaguuuucugaa

SEQ ID NO: 622712 - RNA, 63 nt, Homo Sapiens
cgagggaggagaagggaccugccuugugacaucucugaucagguuggggugccccagcaccca

SEQ ID NO: 622713 - RNA, 63 nt, Homo Sapiens
ugugcgccuacaggagugagcacuaaggugugcucugaucauccacugugccaugugccaggu

SEQ ID NO: 622714 - RNA, 63 nt, Homo Sapiens
uagauaguggugcagugcuuuaacauacauucaucugaucagcauuaauuuggggaauuuuuu

SEQ ID NO: 622715 - RNA, 63 nt, Homo Sapiens
uuccuggcaagcucuuucacaacccuacauauuucugaucaugugcugccuuuuacugcugaa

SEQ ID NO: 622716 - RNA, 63 nt, Homo Sapiens
uguucucagcacauaugggaacuaugaggagccucugaucaaauuggcuacaaucuuggagcu

SEQ ID NO: 622717 - RNA, 63 nt, Homo Sapiens
augggaaucuuuggacucagcccaacaccgcccucugaucaccggccaagggugucccacauu

SEQ ID NO: 622718 - RNA, 63 nt, Homo Sapiens
ggcaauuagaacuggaagaagcaacagaugugaucugaucauacaggcuuuuuaggaagcucu

SEQ ID NO: 622719 - RNA, 63 nt, Homo Sapiens
ccaaguagcaugacugaucuguguucaagucuuucugaucaccuaaaauuauucacuugguaa

SEQ ID NO: 622720 - RNA, 63 nt, Homo Sapiens
gcuaugagauggacagauaaccuagcuuccuggucugaucagucugaugcaaaagggucuuuu

SEQ ID NO: 622721 - RNA, 63 nt, Homo Sapiens
uaaagaaaauuaagguguccuuuuuuguuccauucugaucaacaacggaguacauuuuuaaaa

SEQ ID NO: 622722 - RNA, 63 nt, Homo Sapiens
aggagagaggugagggggggaugacuugcggguucugaucaggccccuggguggggaaggggc

SEQ ID NO: 622723 - RNA, 63 nt, Homo Sapiens
guugguguugccucacuccucugagcucuucuuucugaucaagcccugcuuaaaguuaaauaa

SEQ ID NO: 622724 - RNA, 63 nt, Homo Sapiens
ccauggagcuuguguucucagaaucugaugcuuucugaucaacaaaacugagcaaggaagauc

SEQ ID NO: 622725 - RNA, 63 nt, Homo Sapiens
gaagaugccacaccuggccuccacacuugcucuucugaucagucugucuggauugaguccuac

SEQ ID NO: 622726 - RNA, 58 nt, Homo Sapiens
uuccuccaacuccugguucauguguggcucugaucaguauauacuccccuggaaauaa

SEQ ID NO: 622727 - RNA, 63 nt, Homo Sapiens
ucagcguaaagcaguguguuguagaaauagcuaucugaucacuuuuuuaaguucuucugaacu

SEQ ID NO: 622728 - RNA, 63 nt, Homo Sapiens
cagaagcagcccugcccagcggcugggaaggucucugaucacauggcguaaggccucacuccc

SEQ ID NO: 622729 - RNA, 63 nt, Homo Sapiens
uccccacuguggaaacaggagucaugaggcagcucugaucacuccugugcuggcacugugcca

SEQ ID NO: 622730 - RNA, 63 nt, Homo Sapiens
gggugggggagagaggaaagaacacauuuugauucugaucaugcuucuccuuuagaugcuaga

SEQ ID NO: 622731 - RNA, 63 nt, Homo Sapiens
aggcugcccaagggugcugucggaggcuguggaucugaucacccgugccucaucccagaaaca

SEQ ID NO: 622732 - RNA, 63 nt, Homo Sapiens
cuuucagccccagggcccggugagauggagcucucugaucaccagccagugggaaagggaacc

SEQ ID NO: 622733 - RNA, 63 nt, Homo Sapiens
aacaauuaccaggaacuagcuucucccuccaggucugaucauaggaggggagggggcgccuug

SEQ ID NO: 622734 - RNA, 63 nt, Homo Sapiens
ccacuggcaggacaauucacugcaggucccauuucugaucaccgauaacugguccucauacca

SEQ ID NO: 622735 - RNA, 63 nt, Homo Sapiens
ucuacauguaugaacuuaacuaaaaaugguaaaucugaucauacuuuuuuucccucuuccccc

SEQ ID NO: 622736 - RNA, 63 nt, Homo Sapiens
gcaggggccagccagggacacacuuucuguggcucugaucagcaggggguccccaaaguggcc

SEQ ID NO: 622737 - RNA, 63 nt, Homo Sapiens
uaucuuuccaagugccaggcacgggcuuccuuuucugaucaaacauaccauuuuuuauauuuc

SEQ ID NO: 622738 - RNA, 63 nt, Homo Sapiens
gauuuugcauuuuguccaaaaucaugugcuucuucugaucaauuuugguuguuccagaauuuc

SEQ ID NO: 622739 - RNA, 63 nt, Homo Sapiens
aagaaccuccuggcugggacugcccaacucuguucugaucagugggugggugagguaggguuu

SEQ ID NO: 622740 - RNA, 63 nt, Homo Sapiens
guaggaauuacaauugcaugcaguaguauuagaucugaucaagauauaaaaagucuggauugu

SEQ ID NO: 622741 - RNA, 63 nt, Homo Sapiens
uuuccaggguccuccggaccccaccuuccacacucugaucacagccccccuaccuuuugcccu

SEQ ID NO: 622742 - RNA, 63 nt, Homo Sapiens
uggcaaagguggggaggggggaagaugaugcauucugaucauuauaaagaauacuuuucaggg

SEQ ID NO: 622743 - RNA, 63 nt, Homo Sapiens
guacguccauaaagccaguauuuaauuucacuuucugaucacgucucacgcauauccaugagc

SEQ ID NO: 622744 - RNA, 63 nt, Homo Sapiens
guguggggugguucaagagcuagucuuccauguucugaucacuccuuaugauaaagccgccuu

SEQ ID NO: 622745 - RNA, 63 nt, Homo Sapiens
uccccugucuacucauccagaaacauagucagcucugaucacaagggugaaagaagaaaccuu

SEQ ID NO: 622746 - RNA, 63 nt, Homo Sapiens
cuuccucagaaaaccuuuuucauuccauuuucuucugaucauacuuuagaucucuuucaagca

SEQ ID NO: 622747 - RNA, 63 nt, Homo Sapiens
uggcaagaaagggagauuucucucaucuugcauucugaucaauaaagggcuguuugguuagca

SEQ ID NO: 622748 - RNA, 63 nt, Homo Sapiens
uggauccccacgugagcaacccugagccugcucucugaucagcacagccacucaccuuuuccu

SEQ ID NO: 622749 - RNA, 63 nt, Homo Sapiens
aauacugugaaauaaagaaugauuucuaagacuucugaucaaauuuguaaccagaugaaucau

SEQ ID NO: 622750 - RNA, 63 nt, Homo Sapiens
gcaaccucugugcuuuuauauaaccaguuugguucugaucauuaaaggaugcauuucggcuuu

SEQ ID NO: 622751 - RNA, 63 nt, Homo Sapiens
uuuaugcuaccugucaccaacagcugaaaccagucugaucaauaauuugugaagcuuaugaua

SEQ ID NO: 622752 - RNA, 63 nt, Homo Sapiens
ccaagucccgcccggaggaguuugagcugugggucugaucaccggcuucuccagggggcaccc

SEQ ID NO: 622753 - RNA, 63 nt, Homo Sapiens
agcaaagcugacguuuugauccagccaccuccuucugaucagcccugaaggcauaaaccacau

SEQ ID NO: 622754 - RNA, 63 nt, Homo Sapiens
gugagggagagauggaagaaacaaggccaacucucugaucaggggugcgguguggaugcaccu

SEQ ID NO: 622755 - RNA, 63 nt, Homo Sapiens
ucccguagauggcgagcaccuugcaggcagccuucugaucaguacugcucuccuagggccugg

SEQ ID NO: 622756 - RNA, 63 nt, Homo Sapiens
ccacggcccuugccacugucuccuggcccucucucugaucaugccagguuugcaccagccucg

SEQ ID NO: 622757 - RNA, 63 nt, Homo Sapiens
aagauuauuuuacguugaguccauuuuuaauguucugaucaccugacagggcaccccaaaccc

SEQ ID NO: 622758 - RNA, 63 nt, Homo Sapiens
cuguauuaaaaauguuaguaugaugugaauugaucugaucagagcaagcccagguugaccuug

SEQ ID NO: 622759 - RNA, 63 nt, Homo Sapiens
aaucagcagacagaauuaccgccgauaaaugcaucugaucagaaggaaggagagacauuagga

SEQ ID NO: 622760 - RNA, 63 nt, Homo Sapiens
accuaacccccccauaucuguucaaccucaguaucugaucaggcuccucagccuccaccaucc

SEQ ID NO: 622761 - RNA, 63 nt, Homo Sapiens
gcauuuccgaagaucagauauuuugcuuaaaggucugaucauauaggaaauauaugcagaaca

SEQ ID NO: 622762 - RNA, 63 nt, Homo Sapiens
guucuaguauuauuuuguaacaaauagcagacaucugaucauuuuauccauaaauauucuuua

SEQ ID NO: 622763 - RNA, 63 nt, Homo Sapiens
uuggggagucuuaugaaucauuccagccaacucucugaucacaaagaauacugugccccuuuc

SEQ ID NO: 622764 - RNA, 63 nt, Homo Sapiens
caguaugauugguaaaugggaaauauaauugauucugaucacucuuggucagcuucucuuucu

SEQ ID NO: 622765 - RNA, 63 nt, Homo Sapiens
cuuccucagcgucaccuccuucauugagccuucucugaucacuccaucccucuccuaccccuc

SEQ ID NO: 622766 - RNA, 63 nt, Homo Sapiens
aaaaaauaaagcugauugucaugugauuaaauaucugaucaacagguaugaauauaacuuaaa

SEQ ID NO: 622767 - RNA, 63 nt, Homo Sapiens
cuccauucacaacuucauggccacgcccgaguuucugaucaaugacuacacccacaacauccc

SEQ ID NO: 622768 - RNA, 63 nt, Homo Sapiens
gcuacagauugagaugaauuugcaaaccauauaucugaucaauuuggaauauauaaaguguac

SEQ ID NO: 622769 - RNA, 63 nt, Homo Sapiens
auuagggguagagugagguagcugggaccaaacucugaucagucucuucuugcccuuggccca

SEQ ID NO: 622770 - RNA, 63 nt, Homo Sapiens
gaaauaaaagcuauauaagauuuacugcauucuucugaucacuguuaguuaguguagauucca

SEQ ID NO: 622771 - RNA, 63 nt, Homo Sapiens
gguucagaauuggaaguacagucaaagcaggaaucugaucagaugcagaggaguaagucuugu

SEQ ID NO: 622772 - RNA, 63 nt, Homo Sapiens
gcuugucugaaaauaucaccuuuuguggauuuaucugaucaccaaauaauaaauauuaagaag

SEQ ID NO: 622773 - RNA, 61 nt, Homo Sapiens
gggaagcuggcccaggucagguccgcaaaggcuucugaagaagaggaagggcgaguagggg

SEQ ID NO: 622774 - RNA, 61 nt, Homo Sapiens
ucaugacuucuccuuuccagaguuuuggguccuucugaauuaaugguccuuuucgaacacc

SEQ ID NO: 622775 - RNA, 61 nt, Homo Sapiens
ccccacaccuggaggcuggagccaggggccacuucugaacugcaccagcaccaggcccacc

SEQ ID NO: 622776 - RNA, 61 nt, Homo Sapiens
gacggacagcguguggcaguguuuaaaugcucuucugaaggcugauacgacagcucucugu

SEQ ID NO: 622777 - RNA, 61 nt, Homo Sapiens
agagaguuugagccuuugcuggucacauugccuucugaagaggagggaguauuagauuaua

SEQ ID NO: 622778 - RNA, 61 nt, Homo Sapiens
aaaaagaccaaacauuugagauugucacagccuucugaaguuacucauuauaagucaagca

SEQ ID NO: 622779 - RNA, 61 nt, Homo Sapiens
ucaucacuccuuccuaguucuacuguucaagcuucugaaauaaacaggacuugaucacaag

SEQ ID NO: 622780 - RNA, 61 nt, Homo Sapiens
ggugcugaaccucgggaacgagcuauccuagcuucugaauccagguuaggauuauacuuga

SEQ ID NO: 622781 - RNA, 61 nt, Homo Sapiens
cuaacauguaauugcagauaacuuugacuuucuucugaauauuuuaucuuuccuuggcuuu

SEQ ID NO: 622782 - RNA, 61 nt, Homo Sapiens
aguuaauguaagaauacuuuaaaucucuaagcuucugaaguguuagagguagagauggucu

SEQ ID NO: 622783 - RNA, 61 nt, Homo Sapiens
aaacccaagucaguuauuagauuuaaaucaccuucugaaaugcugcuauagggcugguauc

SEQ ID NO: 622784 - RNA, 61 nt, Homo Sapiens
ugcauuugugcaacuucaaacauauugggugcuucugaauuccugaugauuggauuuaagc

SEQ ID NO: 622785 - RNA, 61 nt, Homo Sapiens
ccuagauguuaguguuguggauguccuuggucuucugaagauucagguccuccucuccggg

SEQ ID NO: 622786 - RNA, 61 nt, Homo Sapiens
cuugcucugccuuugaguuguuccgugaucacuucugaauaagcaguuugccuuuauaaaa

SEQ ID NO: 622787 - RNA, 61 nt, Homo Sapiens
auuaugauaguuuuuaagguuucaauucaaucuucugaacggcauaaguccuauuuuagcc

SEQ ID NO: 622788 - RNA, 61 nt, Homo Sapiens
uucugggacccagaugaguucuucacuagcccuucugaaccccuugcuccauaauuggucu

SEQ ID NO: 622789 - RNA, 61 nt, Homo Sapiens
agaggaaaaagaaaaacauuuccucuuauaacuucugaaguaauuuguaaaaaagauuugu

SEQ ID NO: 622790 - RNA, 61 nt, Homo Sapiens
ugauucguguuuguacuuuauuuuuuugugccuucugaaaggaucuaaaacaaaaauauuu

SEQ ID NO: 622791 - RNA, 61 nt, Homo Sapiens
gcgagggaggggagguggccgucgaguugaccuucugaacaugagugucaacuccaggacu

SEQ ID NO: 622792 - RNA, 61 nt, Homo Sapiens
uuuuuccuuaacguuugaagucaguuuaaaacuucugaagugcugucuuuuuacauuuuac

SEQ ID NO: 622793 - RNA, 61 nt, Homo Sapiens
ccuuugucuaaucauuggauuuauugugucacuucugaaguuucacagaaaugaaugaauu

SEQ ID NO: 622794 - RNA, 61 nt, Homo Sapiens
agacuaauuuuuaagaauuacaaagcucauucuucugaaucuaauaucacuaacuccuaga

SEQ ID NO: 622795 - RNA, 61 nt, Homo Sapiens
ccugagaucuaguggauaccuaaaauaacuacuucugaacucuucuuaaacucugaguuua

SEQ ID NO: 622796 - RNA, 61 nt, Homo Sapiens
ucaaacaguaaugcaaaagucuuguggugcccuucugaaauacuuugaaagacucuggugc

SEQ ID NO: 622797 - RNA, 61 nt, Homo Sapiens
ggaaaagucaaaguguugcugccugucucaucuucugaagauuguaacaaugaugaccccg

SEQ ID NO: 622798 - RNA, 61 nt, Homo Sapiens
aagcaauuagcaaaucauguccggggggucucuucugaauauuaaccaaagaagcuguacu

SEQ ID NO: 622799 - RNA, 61 nt, Homo Sapiens
uuuccgaauccucccaguugugccuucugaccuucugaagccccccggaacccucuaccaa

SEQ ID NO: 622800 - RNA, 61 nt, Homo Sapiens
agcugugggugguggggggcuguuuucuuaacuucugaaagagaauuguucuuuuuccugu

SEQ ID NO: 622801 - RNA, 61 nt, Homo Sapiens
uggcgcugccccuggcagccgugguccuaaucuucugaacuaucccucuggggcuguucac

SEQ ID NO: 622802 - RNA, 61 nt, Homo Sapiens
agcaaacugaauaaacuacaaugcacacuuucuucugaauucaauucuuugaucucaugca

SEQ ID NO: 622803 - RNA, 61 nt, Homo Sapiens
acaaaugaaugcuuauugcucauacaauuuucuucugaauauguuaacuauaaacacacug

SEQ ID NO: 622804 - RNA, 61 nt, Homo Sapiens
cugaaauucaguuaguuacuuuucucuuuuacuucugaauuugguccagggauccuccucc

SEQ ID NO: 622805 - RNA, 61 nt, Homo Sapiens
ucuugauuucuuauauggcauuuuguguguucuucugaaaccaaggucuucacuguauaua

SEQ ID NO: 622806 - RNA, 61 nt, Homo Sapiens
uaucagcuacugauccagcccuccagccccacuucugaaagugccccuuucugcccuccug

SEQ ID NO: 622807 - RNA, 61 nt, Homo Sapiens
gaugcuuucucacugucaucaagacgugucccuucugaacucaaaggaggcucagagaaga

SEQ ID NO: 622808 - RNA, 61 nt, Homo Sapiens
caaagaggauucaguuuccauccgaaacagccuucugaauaaagccugccaacagugaccu

SEQ ID NO: 622809 - RNA, 61 nt, Homo Sapiens
uaccaccagcccuggcuggaucuguggcuuucuucugaacugaaaucugguuuucaaggcc

SEQ ID NO: 622810 - RNA, 61 nt, Homo Sapiens
gugccagcuauuucauuaggcucccagugcccuucugaaaagccacuauucucaguuacac

SEQ ID NO: 622811 - RNA, 61 nt, Homo Sapiens
aaugacaaagcagguuaccugaaaugacucccuucugaaugaauggaugcauacccuuccu

SEQ ID NO: 622812 - RNA, 61 nt, Homo Sapiens
ucaggccuucauuccagagcucaaggcagagcuucugaauugccccuuccugguucuuauc

SEQ ID NO: 622813 - RNA, 61 nt, Homo Sapiens
uuuuuggaaacuuagaaaaguucuuugaacacuucugaaaguuaaaauuguucaagaaaau

SEQ ID NO: 622814 - RNA, 61 nt, Homo Sapiens
aaucuugccaagauagacaaccauuauggugcuucugaauauggugcaaaaggauuggccc

SEQ ID NO: 622815 - RNA, 61 nt, Homo Sapiens
ccacuucacccacuccacuucccagcugccucuucugaaauuucucaaaauauaccucuug

SEQ ID NO: 622816 - RNA, 61 nt, Homo Sapiens
gccacaccugugcuacacuuugacagcugcucuucugaauugucugugcccucagaugugu

SEQ ID NO: 622817 - RNA, 61 nt, Homo Sapiens
aucagagauuaaauauuguuucucaaagugccuucugaagcaacccuaaggcccuucaaga

SEQ ID NO: 622818 - RNA, 61 nt, Homo Sapiens
aguuggaccugguuaaucauccuuaaagacucuucugaacuguguuuuuugacaaucacuu

SEQ ID NO: 622819 - RNA, 61 nt, Homo Sapiens
acaguuuaaaaacacuuuuuuuuucagagugcuucugaaguuaaccaccccuagaucugag

SEQ ID NO: 622820 - RNA, 61 nt, Homo Sapiens
aauuuguuuuaaaguaaguuacuuagauaaucuucugaaauauauguugcuuguuugugac

SEQ ID NO: 622821 - RNA, 61 nt, Homo Sapiens
ugcagaaaacaauuucuaaagaguguuguagcuucugaagguccaucugaaagguuacaag

SEQ ID NO: 622822 - RNA, 61 nt, Homo Sapiens
caaaauuccucauaaggcauguggaaugauacuucugaaauaaauauaugaugcugagucu

SEQ ID NO: 622823 - RNA, 61 nt, Homo Sapiens
uauggucacacuauauacuacuaauucucuucuucugaaauagcuauccuuuuaaauuaug

SEQ ID NO: 622824 - RNA, 61 nt, Homo Sapiens
cccugcagcccuuugccaagaaaaugaaucacuucugaagucaaacuccucuccuggauca

SEQ ID NO: 622825 - RNA, 61 nt, Homo Sapiens
auuuccauuauagcaauguuagugccaccaccuucugaacacaguggggagggcugugaag

SEQ ID NO: 622826 - RNA, 61 nt, Homo Sapiens
caaggcuggcauauuaacaccugccuucuggcuucugaaagugagauuuguauaugggcug

SEQ ID NO: 622827 - RNA, 61 nt, Homo Sapiens
cucgguuugguagacuuggacaucucucuggcuucugaagagccugaagcuggccuggacc

SEQ ID NO: 622828 - RNA, 61 nt, Homo Sapiens
auuuuuauuggaagaguauuaacuggugccucuucugaaacacaccaacccauauuccucu

SEQ ID NO: 622829 - RNA, 61 nt, Homo Sapiens
ggcugaguagccucagaaggguuuaggcgaccuucugaaacucacagaagucacgugaugg

SEQ ID NO: 622830 - RNA, 61 nt, Homo Sapiens
accaaguccugcuacuguagaguggaaaugacuucugaauagcgguuuuaggacaggucug

SEQ ID NO: 622831 - RNA, 61 nt, Homo Sapiens
cuuguacuugccuacuguaauauggauuucacuucugaacaguuuacagcacaauauuuau

SEQ ID NO: 622832 - RNA, 61 nt, Homo Sapiens
uaaaaccuuugacuugagucugcugguaaagcuucugaauauugaguuugcugagaaauaa

SEQ ID NO: 622833 - RNA, 61 nt, Homo Sapiens
uggguucaauuuaaaauaggagaggcuuucucuucugaaagauccauuuuaggucuuuuuc

SEQ ID NO: 622834 - RNA, 61 nt, Homo Sapiens
gacuacaaagaaaagcagaugccaaaauacucuucugaaaacagcaacccagguaagacuu

SEQ ID NO: 622835 - RNA, 61 nt, Homo Sapiens
gcuguugguaggagugaaaaccaguauaauucuucugaaaaacauuuaucagaaacuuaaa

SEQ ID NO: 622836 - RNA, 61 nt, Homo Sapiens
ugugucuacaacagggccacauauuaaauuacuucugaauggugaauucaucuuacaaaau

SEQ ID NO: 622837 - RNA, 61 nt, Homo Sapiens
agcugaaaccuaaggcaacauuuccgaagaccuucugaagaucucagauaaagugaccagg

SEQ ID NO: 622838 - RNA, 61 nt, Homo Sapiens
gagcauauauugcauuuaaagaaagauaaagcuucugaaauacuacugcaauugcuucccu

SEQ ID NO: 622839 - RNA, 61 nt, Homo Sapiens
uuuuugaggcaucuaauauuuacauauuugccuucugaacuuuguuuugaccuguauccuu

SEQ ID NO: 622840 - RNA, 61 nt, Homo Sapiens
uuuucucuacuuccugucugcaugcccaaggcuucugaagcagccaaugucgaugcaacaa

SEQ ID NO: 622841 - RNA, 61 nt, Homo Sapiens
agcuacacuacaaaaacaaauuuugucuguacuucugaaaagaauuuuguuguuucucagc

SEQ ID NO: 622842 - RNA, 61 nt, Homo Sapiens
ucuccuggcaagagaaaaagacuuaacuagacuucugaacuugaacaguuucagguuauau

SEQ ID NO: 622843 - RNA, 61 nt, Homo Sapiens
aacauaaauacagcaagaaaauguguuugggcuucugaagaguugucugcuuaccuuaaca

SEQ ID NO: 622844 - RNA, 61 nt, Homo Sapiens
uuccucuuuaggguaaccauaauauuacugccuucugaaacgucugacuauuccaggaucc

SEQ ID NO: 622845 - RNA, 54 nt, Homo Sapiens
aguauccugcuucugauaugagcccuucugaaaaaugaacgacacacauguuag

SEQ ID NO: 622846 - RNA, 61 nt, Homo Sapiens
cuaggcggagguuuccaaauuuuccauacaucuucugaaaauuugccugggcauugaggca

SEQ ID NO: 622847 - RNA, 61 nt, Homo Sapiens
gcugguguuuuuacaacuagacagauaccaacuucugaaaaaaaauaagcugcaauuuugu

SEQ ID NO: 622848 - RNA, 61 nt, Homo Sapiens
cugaguuuugaaaauauauuaaaguaucagucuucugaauucucaagcaaaggaauuucug

SEQ ID NO: 622849 - RNA, 61 nt, Homo Sapiens
ugaaguucagccauuuuguaucagguuuagucuucugaagauauauuggcauguuuagaug

SEQ ID NO: 622850 - RNA, 61 nt, Homo Sapiens
auauuuugagauagguuuagcauuaaaugugcuucugaaauggaauuagcuagaauaugac

SEQ ID NO: 622851 - RNA, 61 nt, Homo Sapiens
caucaaaguagaagagccccuuaaaaauauucuucugaacugaaauaguuuucucaaccau

SEQ ID NO: 622852 - RNA, 61 nt, Homo Sapiens
uuuuccagggauaggcagguuggauuaggagcuucugaauccucaucuccucccuggauuc

SEQ ID NO: 622853 - RNA, 61 nt, Homo Sapiens
uauaggugauugccugaaugcucaugaagcacuucugaaaaaggggaaagaaauccaucug

SEQ ID NO: 622854 - RNA, 61 nt, Homo Sapiens
ugugucugccaagcgccuaugcugguccaugcuucugaaccagaauccaugccuguguaau

SEQ ID NO: 622855 - RNA, 61 nt, Homo Sapiens
ugagacuuucccuuuuugcuacuuccaucuacuucugaaugucuacuguacccugauuauu

SEQ ID NO: 622856 - RNA, 61 nt, Homo Sapiens
gcaccuuacuuuuuggaaacucaauuauauacuucugaaugguauuuuccuuuauguuaau

SEQ ID NO: 622857 - RNA, 61 nt, Homo Sapiens
cacaccccaucaauuaucuuaaguaaucccucuucugaaucgaagucugaggcucaaagaa

SEQ ID NO: 622858 - RNA, 61 nt, Homo Sapiens
aaggauuuaauuaaggccacuacugaagugccuucugaaucgacuuugaagcacugaaagu

SEQ ID NO: 622859 - RNA, 61 nt, Homo Sapiens
cagguuaaaaacuaacuugucagauuuugcacuucugaauuuggaaauauuuuuauuuuua

SEQ ID NO: 622860 - RNA, 61 nt, Homo Sapiens
uaacucaaacuuuugaccaauuacaggguagcuucugaaauguuucggaguuugguaaagu

SEQ ID NO: 622861 - RNA, 61 nt, Homo Sapiens
uuccugcccgggagucuguaccccuuggggacuucugaaccgaccagguucaugucuguuu

SEQ ID NO: 622862 - RNA, 61 nt, Homo Sapiens
caugaguguuuucucuuucuuaauuugugaacuucugaagguuauauuauuaaagggcuuu

SEQ ID NO: 622863 - RNA, 61 nt, Homo Sapiens
uuccccugugcuuuuaccaguagcaugaccccuucugaagccauccguagaaaguacuuug

SEQ ID NO: 622864 - RNA, 61 nt, Homo Sapiens
agaagucauaguugaccacagacauguuauucuucugaaagagccacauuuugguuuuauu

SEQ ID NO: 622865 - RNA, 61 nt, Homo Sapiens
aaguauuugguagcugaauaaggggucagaacuucugaaaccagagaucuguaaucaucuc

SEQ ID NO: 622866 - RNA, 61 nt, Homo Sapiens
agaaaugcagguucccaggucccacccuggacuucugaagggguguggcaucuguguuucu

SEQ ID NO: 622867 - RNA, 61 nt, Homo Sapiens
aaugaggacaacaggauaauaucuuugaugacuucugaaaguuaugcuucccuucauguua

SEQ ID NO: 622868 - RNA, 61 nt, Homo Sapiens
auaaccaauauguggaaauggacacagggaucuucugaaguugcuuugaaucaaaaggcag

SEQ ID NO: 622869 - RNA, 61 nt, Homo Sapiens
ucauagguaggagggcuuagauuuuaaggcacuucugaaagucaaucccuggacaaggcag

SEQ ID NO: 622870 - RNA, 61 nt, Homo Sapiens
uggaauccugaaagggcacuuaauuuguaaacuucugaagacugagaacuuuuuugaggcc

SEQ ID NO: 622871 - RNA, 61 nt, Homo Sapiens
ucugguuuauacauccccacucaugagcauacuucugaaggaaaacuuuacaaaaagagcc

SEQ ID NO: 622872 - RNA, 61 nt, Homo Sapiens
uuucuugccuuauuaagacauaauuuucucccuucugaaaugagugagggaaguucauaag

SEQ ID NO: 622873 - RNA, 61 nt, Homo Sapiens
uuaauaaugacuuaagggucaagauuuuuuucuucugaaaauuauguucugaguuaggcag

SEQ ID NO: 622874 - RNA, 61 nt, Homo Sapiens
caggcagugcucucuaacaggaccaucacagcuucugaacugagccggagagagagaaugg

SEQ ID NO: 622875 - RNA, 61 nt, Homo Sapiens
ucacacuacccuggucccugauugcaaggagcuucugaagcaagggugaauccuucccaca

SEQ ID NO: 622876 - RNA, 61 nt, Homo Sapiens
gagagcagcccaaccaauccccaauccuuuucuucugaaacugagcaggaaggguaaggaa

SEQ ID NO: 622877 - RNA, 61 nt, Homo Sapiens
gcacccuucacuggcauccucaaucauuaaccuucugaaagcucacaguacacauuaguau

SEQ ID NO: 622878 - RNA, 61 nt, Homo Sapiens
gugaaacaauuauuuauuugcugaaagagcucuucugaacuguguccuuuuaauuuuugcu

SEQ ID NO: 622879 - RNA, 61 nt, Homo Sapiens
ugguuuggaguugagauaucagucucggaaacuucugaaaaaugcuaauaauuacccaagg

SEQ ID NO: 622880 - RNA, 61 nt, Homo Sapiens
augaucacuugggcaguauaagaaaauguagcuucugaauauuggccaccucuaugcugca

SEQ ID NO: 622881 - RNA, 61 nt, Homo Sapiens
agcacuuaaaaaugauuaguuugcgcauauucuucugaaaugucacaauaacuuagaaaca

SEQ ID NO: 622882 - RNA, 61 nt, Homo Sapiens
uuuuggagcuuguuuuugccauauguucuaacuucugaaacgaggucagaugacauaauga

SEQ ID NO: 622883 - RNA, 61 nt, Homo Sapiens
uaaaaaguuauacaaugccaaccauuuauaacuucugaauuuuugauaauuaagcacccau

SEQ ID NO: 622884 - RNA, 61 nt, Homo Sapiens
agggcugugccuuccguuucaagguguuuugcuucugaaaggcaaauagaagccgaguguu

SEQ ID NO: 622885 - RNA, 61 nt, Homo Sapiens
ucugguuccugcccagugacggcaccuuucccuucugaaagaugcccuuggcguugccuau

SEQ ID NO: 622886 - RNA, 61 nt, Homo Sapiens
cucuagggagaagccgguucgagcugugcuccuucugaaggugaaaaucaaggugucagca

SEQ ID NO: 622887 - RNA, 61 nt, Homo Sapiens
gucacuggcaccauaugcaaaagcugaugaccuucugaaguauacugcggagacucuggcc

SEQ ID NO: 622888 - RNA, 61 nt, Homo Sapiens
cccauucauuagaccacuugccuccacuuugcuucugaagggggcagagguucaacccaca

SEQ ID NO: 622889 - RNA, 61 nt, Homo Sapiens
aaugaucugaaaaaaguuuccaaggcauugacuucugaaaacauguugcgcuuugcaucag

SEQ ID NO: 622890 - RNA, 61 nt, Homo Sapiens
acugggggugucuccuaagaguugcugucugcuucugaaucaccuaggauuuagggcugca

SEQ ID NO: 622891 - RNA, 61 nt, Homo Sapiens
uauuuacauuuugcuaaccuagcacuuuuuccuucugaaaaacaaaucugauggcuccugc

SEQ ID NO: 622892 - RNA, 61 nt, Homo Sapiens
aaugacugaaugucaagauguguuugucacgcuucugaaccaauaauauauaccaacagau

SEQ ID NO: 622893 - RNA, 61 nt, Homo Sapiens
gagaccguccacaucucugcggagaauaaagcuucugaagagugaggugugccccucccag

SEQ ID NO: 622894 - RNA, 61 nt, Homo Sapiens
cugggaggugugaacccagguaccagcccaccuucugaagcccagagggacauggcaaugu

SEQ ID NO: 622895 - RNA, 61 nt, Homo Sapiens
uauuuuaaccagcccacccaugccauguguacuucugaaaagcgugguuuauagacugggg

SEQ ID NO: 622896 - RNA, 61 nt, Homo Sapiens
cuccaaagggaaauuucagugcaccugccaucuucugaaaauuuagagcauagaagaagcg

SEQ ID NO: 622897 - RNA, 61 nt, Homo Sapiens
uucauaaauguucagcuucacugagugugggcuucugaaacaagguaggguuugaggauuc

SEQ ID NO: 622898 - RNA, 61 nt, Homo Sapiens
gaaauauuguucauuacucacaagcacacaccuucugaauaauuugcguauuaauuauggg

SEQ ID NO: 622899 - RNA, 61 nt, Homo Sapiens
uggacuuaccugggaccugcggagaugggggcuucugaagacauccugggcuuuucccaga

SEQ ID NO: 622900 - RNA, 61 nt, Homo Sapiens
aacauugccucugggugucauguggaccagacuucugaauagagaauauuuauaacuuuug

SEQ ID NO: 622901 - RNA, 61 nt, Homo Sapiens
uaggauuuuguaacacgucaaccauuugaugcuucugaaaaguacuuucaacuugcgaagg

SEQ ID NO: 622902 - RNA, 61 nt, Homo Sapiens
uuuguuagcaauaacugaccuucaguuuacccuucugaaggagcagggacucagcacagaa

SEQ ID NO: 622903 - RNA, 61 nt, Homo Sapiens
gucucuccagauagcacuacgauguauuccgcuucugaacaggaucccaugccagugugga

SEQ ID NO: 622904 - RNA, 61 nt, Homo Sapiens
ugaaaugaagagaaauagccagcaggugauucuucugaauccuuuagugugaugguuuccc

SEQ ID NO: 622905 - RNA, 61 nt, Homo Sapiens
uguuuagauuguauuaacuaucuucuuuggacuucugaagagaccacucaauccauccaug

SEQ ID NO: 622906 - RNA, 61 nt, Homo Sapiens
gucuuuugguaauaguggcagguauuuauuccuucugaauauauaccccauuauaggaaua

SEQ ID NO: 622907 - RNA, 61 nt, Homo Sapiens
cuuccuaagaaaaggaaucuugcccuugaaucuucugaaguaccuagcacagugucuucaa

SEQ ID NO: 622908 - RNA, 61 nt, Homo Sapiens
aauguuugugaaacaccuuuggagaggugcacuucugaaugcugccucugccguaaauccu

SEQ ID NO: 622909 - RNA, 61 nt, Homo Sapiens
auagaagcuuuuuuuuuuaaaaaauguauugcuucugaacuuuuuucugccacugcucccu

SEQ ID NO: 622910 - RNA, 61 nt, Homo Sapiens
uuuguucaaacauaauaccaucuuuuugcuucuucugaacuuuagaucuccauaacacaug

SEQ ID NO: 622911 - RNA, 61 nt, Homo Sapiens
ugcuuaaacuuuuuucagucagggugaugaucuucugaagcucuuggaugucauuugaucg

SEQ ID NO: 622912 - RNA, 61 nt, Homo Sapiens
uagacucuauaguacccucucuauucacuagcuucugaaaagggaggaguauuuuuaguuu

SEQ ID NO: 622913 - RNA, 61 nt, Homo Sapiens
gagaaaacuccgaagaggugugagcaggauucuucugaaugacugucuggaugguucauua

SEQ ID NO: 622914 - RNA, 61 nt, Homo Sapiens
ucuugaaacaucccaggucccucuccuaggucuucugaauggaauuugcagaugcaagcuc

SEQ ID NO: 622915 - RNA, 61 nt, Homo Sapiens
cuuuagacaguaacaguuugcuguacacguucuucugaaagcccucgucucugcagggugu

SEQ ID NO: 622916 - RNA, 61 nt, Homo Sapiens
ggcccuccuguggacuagcacuuugccauuucuucugaaccauucauggacacuagacucc

SEQ ID NO: 622917 - RNA, 61 nt, Homo Sapiens
auaagcauuuaucaauugauugucaguauuccuucugaacaugcacuaucuuuauuuugua

SEQ ID NO: 622918 - RNA, 61 nt, Homo Sapiens
ugccaccaugccaaagcuauauuuacugaagcuucugaacaagagaugucauagccugaag

SEQ ID NO: 622919 - RNA, 61 nt, Homo Sapiens
acuguagaauuggaacuagaaguuagacgugcuucugaaugccacuguccucugucaaucu

SEQ ID NO: 622920 - RNA, 61 nt, Homo Sapiens
acguucuauguaaaagaaaaaauagcuuuuccuucugaaccacuuaaaagugcuugauaua

SEQ ID NO: 622921 - RNA, 61 nt, Homo Sapiens
aaauccuugcuaaauguacucauuuuguuuucuucugaaaauggaauacaaaauguacuga

SEQ ID NO: 622922 - RNA, 61 nt, Homo Sapiens
uacuucccuaagucacuuucgaacacauuuccuucugaacuagauaauaugagggagaagg

SEQ ID NO: 622923 - RNA, 61 nt, Homo Sapiens
auauuucaaaauauguguguuauuuauacaucuucugaaauuuauauuuguauguaaauua

SEQ ID NO: 622924 - RNA, 61 nt, Homo Sapiens
gucugagacagaucuacaaauugauacuauccuucugaaaauuacuugguuuaaaucacau

SEQ ID NO: 622925 - RNA, 61 nt, Homo Sapiens
cauuguaaagaaauaaaaaucuuuguaaucucuucugaaauuucuuuaaguauauuaaucu

SEQ ID NO: 622926 - RNA, 61 nt, Homo Sapiens
gaacauaauuauaucuagguaaaaaacuuuacuucugaaagauauuguuuuuacuauguuu

SEQ ID NO: 622927 - RNA, 61 nt, Homo Sapiens
uguuuaaaaauuggaaggaauuugaucucagcuucugaaaacugcauuuuauugacugggg

SEQ ID NO: 622928 - RNA, 61 nt, Homo Sapiens
uguaccuuuauaaaucaauucaugcuguuaccuucugaaacgccuauaggaagacuagucu

SEQ ID NO: 622929 - RNA, 61 nt, Homo Sapiens
uauuaaagcuaaaacugcaccagcauuucuacuucugaaguuaaacuuaaauaagugugug

SEQ ID NO: 622930 - RNA, 61 nt, Homo Sapiens
cucgucugugugcaucucacgcccgacguggcuucugaaacgugcauucaaccucaaacuu

SEQ ID NO: 622931 - RNA, 61 nt, Homo Sapiens
aaauauuguuuauacaguuuguauaggcugacuucugaauaauugguaucuauuauuuuca

SEQ ID NO: 622932 - RNA, 61 nt, Homo Sapiens
aaagccauauaugggggacaugcuaaaauggcuucugaaugaaauacgacagcagagaaag

SEQ ID NO: 622933 - RNA, 61 nt, Homo Sapiens
uccugaccucagaugaucuaccagccucggccuucugaagugcugggauucaggugugagc

SEQ ID NO: 622934 - RNA, 60 nt, Homo Sapiens
ccaagaaugaggcaaacugaauugagucaacuucugaagauaaaaccugaagaaguuacu

SEQ ID NO: 622935 - RNA, 55 nt, Homo Sapiens
uucaaaaaauauuuuuaugaugcagcuucugaacauuuggacagacuugauuugu

SEQ ID NO: 622936 - RNA, 61 nt, Homo Sapiens
gaaguacaaaaagccuuuagccuugaggugccuucugaaauuaaccaaauuucauccauau

SEQ ID NO: 622937 - RNA, 61 nt, Homo Sapiens
acagagccucgggacaucaaaaacagcagaacuucugaaaccucugggucaucucucacac

SEQ ID NO: 622938 - RNA, 61 nt, Homo Sapiens
agaagcaaaaaacgaaagaguucuguucagacuucugaagagcagccuguggcuacaaauc

SEQ ID NO: 622939 - RNA, 61 nt, Homo Sapiens
cuagcugagauuagugguggauuuucucccacuucugaaauguucauuuauacugguugca

SEQ ID NO: 622940 - RNA, 61 nt, Homo Sapiens
uuuucuucgacaaaaaaauaauaaaacguuucuucugaaaagcugaacguuucuguauaag

SEQ ID NO: 622941 - RNA, 61 nt, Homo Sapiens
aggccuuaaugaucaaaucucacccuuucugcuucugaaguaugaaaaucuagucuuuuua

SEQ ID NO: 622942 - RNA, 61 nt, Homo Sapiens
auuuuucuaccacccuguuacaucauaacaacuucugaaacacacaccagcccugaguucu

SEQ ID NO: 622943 - RNA, 61 nt, Homo Sapiens
ggaaucuagccgggaguagcagaggcccugucuucugaagucucaggcuuagaaguuacca

SEQ ID NO: 622944 - RNA, 61 nt, Homo Sapiens
cuuccaccagcauccugagaagaaaugauuacuucugaaaaacauccuuuuuuccagccuc

SEQ ID NO: 622945 - RNA, 61 nt, Homo Sapiens
uggacuccugggaacauggacggagagggggcuucugaacuccgcgaagccgccaacccac

SEQ ID NO: 622946 - RNA, 61 nt, Homo Sapiens
accaggacugcuuucuuuggaucauaggagccuucugaaugaaugacugcagacugguggg

SEQ ID NO: 622947 - RNA, 61 nt, Homo Sapiens
caggaugaauuuucugcagcucacugcauggcuucugaaagugccaagagagauguaugug

SEQ ID NO: 622948 - RNA, 61 nt, Homo Sapiens
uuuucuauaccugucuccuucucuguuucuccuucugaaagugcugcaugccuggucuuuc

SEQ ID NO: 622949 - RNA, 61 nt, Homo Sapiens
agaaggugccugaucuuccucagucucggcucuucugaaaucugccaucucgcuaaaucau

SEQ ID NO: 622950 - RNA, 61 nt, Homo Sapiens
uuuguccaccucugauuacaaguuuaaggaacuucugaagaccaaucuucuuuuuuaaacc

SEQ ID NO: 622951 - RNA, 61 nt, Homo Sapiens
uccaguuggacagucugggaaaagcugcuuucuucugaaggauggggacccugagacuacu

SEQ ID NO: 622952 - RNA, 61 nt, Homo Sapiens
uucaguuuuggagcaagucccuaucaugcugcuucugaaaaagaguugaauaucucuuucc

SEQ ID NO: 622953 - RNA, 61 nt, Homo Sapiens
uaucucuuaauccucuuaagagguagugcugcuucugaaguuaaaugccaaauaaucuucc

SEQ ID NO: 622954 - RNA, 61 nt, Homo Sapiens
aaaauuuggauuuccuuuuaagugaugaugacuucugaaacuaauugguuugggagggggc

SEQ ID NO: 622955 - RNA, 61 nt, Homo Sapiens
cuuuaguggguuuuaaauaguuuuucugacccuucugaaaaauaacuacauaagugcuucu

SEQ ID NO: 622956 - RNA, 61 nt, Homo Sapiens
uauuuauucacuuccccauuacgauguaaaucuucugaacugccuuuuuuuuaaaaagaag

SEQ ID NO: 622957 - RNA, 61 nt, Homo Sapiens
cuagaccuguaaaacuucacugcaguggccacuucugaaucucuguaagguuuauuuaucu

SEQ ID NO: 622958 - RNA, 61 nt, Homo Sapiens
uuguauaauggggccuguuacacaugacacucuucugaauugacuguauuucagugagcug

SEQ ID NO: 622959 - RNA, 61 nt, Homo Sapiens
aguaccugguugaguggggaggagggggcaucuucugaacagccugccucugcccagcucc

SEQ ID NO: 622960 - RNA, 61 nt, Homo Sapiens
aagaaacagcugagaggcacuauggauuagucuucugaagugaaggaaauauagaugucac

SEQ ID NO: 622961 - RNA, 61 nt, Homo Sapiens
cagcuccucacagaggccugguuugcucagucuucugaacuccagggaccagcccuggugg

SEQ ID NO: 622962 - RNA, 61 nt, Homo Sapiens
accucggucucgucaguaaggacuucacuuucuucugaacuggggcuugugaaagcuggcc

SEQ ID NO: 622963 - RNA, 61 nt, Homo Sapiens
auuuuaaccugugucuuacuuccucagcugccuucugaaccuacuugucaaggugaauuua

SEQ ID NO: 622964 - RNA, 61 nt, Homo Sapiens
gauaaaggccuuaacuuuaaacaucuuucaucuucugaaagcugcccaacuuaaauccuca

SEQ ID NO: 622965 - RNA, 61 nt, Homo Sapiens
uuaucaaucugaucugcagccagguuauuuacuucugaagcauuggaguuaucgauugcca

SEQ ID NO: 622966 - RNA, 61 nt, Homo Sapiens
cuggaacuggaguuggcaauaccuaguucugcuucugaaacuggaguaucauucuuuacau

SEQ ID NO: 622967 - RNA, 61 nt, Homo Sapiens
ucaaauuagugccucggaaacagcccucccacuucugaaguaaauaacuugccuuacauau

SEQ ID NO: 622968 - RNA, 61 nt, Homo Sapiens
acaauauuaaagagacuuaggugugugugaacuucugaaaguuguucugaucuguguguga

SEQ ID NO: 622969 - RNA, 61 nt, Homo Sapiens
gaauguggauacagcgccacggaaucuucaacuucugaaguccccacuuauucuccucuuu

SEQ ID NO: 622970 - RNA, 61 nt, Homo Sapiens
ucccagugucuucagguuucauccccuuggccuucugaauaugcccaacaggauaagcugg

SEQ ID NO: 622971 - RNA, 61 nt, Homo Sapiens
acuccacuguacacuuauagauaucauguagcuucugaaaagggaaccauggugucaauac

SEQ ID NO: 622972 - RNA, 61 nt, Homo Sapiens
aacuguguaaaaacaguaguuaacuuuuaaacuucugaauaaggggaaaaugcccacauuu

SEQ ID NO: 622973 - RNA, 61 nt, Homo Sapiens
ccccuccucaauuucuuggcaggggguggggcuucugaagaugugugccugggaggcugcc

SEQ ID NO: 622974 - RNA, 61 nt, Homo Sapiens
aggaugugcacacaugggcccuggccccccucuucugaaacuccugcuggccccuuuuccu

SEQ ID NO: 622975 - RNA, 61 nt, Homo Sapiens
uuggacauuuuaaacacuuaacaccugacaacuucugaauaggaguggggaggugguaaga

SEQ ID NO: 622976 - RNA, 61 nt, Homo Sapiens
gcacaaggccaagaacuccugccugucggcacuucugaaagugcguaaguaccuccuugau

SEQ ID NO: 622977 - RNA, 61 nt, Homo Sapiens
aaaaaauguugcuuuuuaaauaagcaagacccuucugaaaugaagaauucagaaaaccacu

SEQ ID NO: 622978 - RNA, 61 nt, Homo Sapiens
aagacaugucaauauucuuuuuauaguuauucuucugaacucauaaaagcaaaucaacacu

SEQ ID NO: 622979 - RNA, 61 nt, Homo Sapiens
aacucuguauuguagauuauuaagucaacugcuucugaaauuguuuuuuuucucaacuagu

SEQ ID NO: 622980 - RNA, 61 nt, Homo Sapiens
aucuaacaaaggaaaauauauagaauuguuucuucugaauaaaaaacuuauuaagguuaaa

SEQ ID NO: 622981 - RNA, 61 nt, Homo Sapiens
guugccuucagaacuaguuuguugggaacgccuucugaacacugugcauugcucaaaagcu

SEQ ID NO: 622982 - RNA, 61 nt, Homo Sapiens
uucaauuuuuuucauugaagcucaggaauuucuucugaauggcccaugucacaaacccuau

SEQ ID NO: 622983 - RNA, 61 nt, Homo Sapiens
cuacuagcagcaccagccuuaaauuuguguucuucugaaugauuguaauguaaggggcaag

SEQ ID NO: 622984 - RNA, 61 nt, Homo Sapiens
cagacccuuggcuucacacaauguuucuguucuucugaaaauuuacaguuuugauugggua

SEQ ID NO: 622985 - RNA, 61 nt, Homo Sapiens
uggauagugccagaacacuuggccucaacaccuucugaacggcuuucuccagagaccuaau

SEQ ID NO: 622986 - RNA, 56 nt, Homo Sapiens
accaaagcugaaauuuaaugguguuucuucugaagauucauguagaaguuauauga

SEQ ID NO: 622987 - RNA, 61 nt, Homo Sapiens
gucucaauggcuucaggcuauugcuacaaaucuucugaagguuuuuccuuaacgcuagaga

SEQ ID NO: 622988 - RNA, 61 nt, Homo Sapiens
uugccaucuucccuccgugguuucuugugggcuucugaaagauuaacacuauguguucagu

SEQ ID NO: 622989 - RNA, 61 nt, Homo Sapiens
cuaagaaugccaaagggaccuacagacuuagcuucugaacuuuuucagucaucccaguuug

SEQ ID NO: 622990 - RNA, 61 nt, Homo Sapiens
uucuuguucagauuaagaguugccaaaauaccuucugaacuacacugcauuguugugccga

SEQ ID NO: 622991 - RNA, 61 nt, Homo Sapiens
uuuuuaugguguagauugaaauaauaguacacuucugaauuuuuauauaaaaugugguugg

SEQ ID NO: 622992 - RNA, 61 nt, Homo Sapiens
gugugagccacugcacccagccuacuucacucuucugaauuauucugauuuauuuucaaca

SEQ ID NO: 622993 - RNA, 61 nt, Homo Sapiens
acagucucugauuucaacacuaacauuccaucuucugaaauucugagauucuaacauccuu

SEQ ID NO: 622994 - RNA, 61 nt, Homo Sapiens
ggcauaagccuuuuauggcccucuugcagaucuucugaacuaugcacauuugugcuuuuuu

SEQ ID NO: 622995 - RNA, 61 nt, Homo Sapiens
uguaggcuuuauuuuaagcaguaauggguuacuucugaaacaucacuuguuugcuuaauuc

SEQ ID NO: 622996 - RNA, 61 nt, Homo Sapiens
uuugagauuguaggccaacuguauuuucaagcuucugaacuuaggcaaaauauucaucgca

SEQ ID NO: 622997 - RNA, 61 nt, Homo Sapiens
ggcccucugcagcccauccuuuccuuccguccuucugaaaccacauaccccaggcccaagc

SEQ ID NO: 622998 - RNA, 61 nt, Homo Sapiens
caaggcagucgccagggcuucuuguccccaccuucugaaccuucuucaaacaguaguacaa

SEQ ID NO: 622999 - RNA, 61 nt, Homo Sapiens
caaaagugguagggaaauuguucccucuccacuucugaaaguaugaugauguauuaaggau

SEQ ID NO: 623000 - RNA, 61 nt, Homo Sapiens
uuaaucaugaauggaaaucggaaguaguaugcuucugaaacucuuuccagggaaacaucuc

SEQ ID NO: 623001 - RNA, 61 nt, Homo Sapiens
cuucuaguuuaauaauacauacaugauuuuucuucugaaugucucuucucccugcaucacu

SEQ ID NO: 623002 - RNA, 61 nt, Homo Sapiens
ggagggggaagugucugccuuuauguccuuucuucugaaauaaaaguaaaagcauuucugg

SEQ ID NO: 623003 - RNA, 61 nt, Homo Sapiens
ugccuaaagauagaauggcuucucuguuuuucuucugaaauacaaccagaaacaauguguc

SEQ ID NO: 623004 - RNA, 61 nt, Homo Sapiens
uugaaguauuuugcuggaauaaguucaaauucuucugaacucaaacugaggaauuucaccu

SEQ ID NO: 623005 - RNA, 61 nt, Homo Sapiens
auagccagucaagcauagaauugcauccauucuucugaaauagguacugugccuaauuuuu

SEQ ID NO: 623006 - RNA, 61 nt, Homo Sapiens
uugaaauggcugcagauagaucccgcagucccuucugaaaggaacuguguagccagcaggg

SEQ ID NO: 623007 - RNA, 61 nt, Homo Sapiens
ggcacaaaccuguguuuauaccugugcuugccuucugaagugauaacauuaguguauuucu

SEQ ID NO: 623008 - RNA, 61 nt, Homo Sapiens
acugcauggaugucccaggaaugcugguggccuucugaaucuccgagauucagacauagcc

SEQ ID NO: 623009 - RNA, 61 nt, Homo Sapiens
cacacugaugacaucaguugacccuuuauuucuucugaaauagggaaagggagaauggugu

SEQ ID NO: 623010 - RNA, 61 nt, Homo Sapiens
ugcugcagcucccuccucagagaacaucccgcuucugaagcgaucguguugguauuuucag

SEQ ID NO: 623011 - RNA, 61 nt, Homo Sapiens
aucauaggaagaguagacauaaacauaaauucuucugaagaacugcuagcaaaaucugagg

SEQ ID NO: 623012 - RNA, 61 nt, Homo Sapiens
auauugcuaccauuguauaaaucucccggcacuucugaaaugcaaaguauccaucuugucu

SEQ ID NO: 623013 - RNA, 61 nt, Homo Sapiens
ucaugcccacagaagucaucgaccaaccagucuucugaaggaaggaucuuccaaaacagag

SEQ ID NO: 623014 - RNA, 61 nt, Homo Sapiens
aucucagaggacuggcauuggagacguacaacuucugaaagugagaauggaaaacgcagaa

SEQ ID NO: 623015 - RNA, 61 nt, Homo Sapiens
gcccacugaaaauugccuguauggcaaccagcuucugaaaaaauaaauugugcucuuuguc

SEQ ID NO: 623016 - RNA, 61 nt, Homo Sapiens
agccccaucauuuggugaacaaaauguuucucuucugaacaauucaacuugcacugaccau

SEQ ID NO: 623017 - RNA, 61 nt, Homo Sapiens
augcugaauuagaagugaacaguaaugggcucuucugaaggauugacagcuuucuagagcc

SEQ ID NO: 623018 - RNA, 61 nt, Homo Sapiens
uccugcagaaauauaacuguccuucuaaaaccuucugaaugaccacaagauugucugaagg

SEQ ID NO: 623019 - RNA, 61 nt, Homo Sapiens
uaaguuuugagaaauacgaggcagacagugucuucugaaugucuaaagauuucaaauagug

SEQ ID NO: 623020 - RNA, 61 nt, Homo Sapiens
ucuuauuauacauguuaacauuccuuucucucuucugaaauuugucugaauauuucuucug

SEQ ID NO: 623021 - RNA, 61 nt, Homo Sapiens
ggcucagguccagcugguuccucucuggcgccuucugaacccgucucagcagguccacagc

SEQ ID NO: 623022 - RNA, 61 nt, Homo Sapiens
aguguugcaagcuggcuggauccaaccaucucuucugaaauaaugcauccaaaggguugau

SEQ ID NO: 623023 - RNA, 61 nt, Homo Sapiens
cgccacgaccccccuggacgucuguaagacccuucugaacacucaggagaacguggcccuc

SEQ ID NO: 623024 - RNA, 61 nt, Homo Sapiens
uucuguuuuguggaucucuuuccuagauuagcuucugaaaucauuauuagcuauaucauuu

SEQ ID NO: 623025 - RNA, 61 nt, Homo Sapiens
caauccacuguuagaauaccuaugguuagggcuucugaacuaaaauaauggaaaauuuuaa

SEQ ID NO: 623026 - RNA, 61 nt, Homo Sapiens
cugucgaugagacuguuuauuaccagauucacuucugaauuggccagaggaaaucugaaug

SEQ ID NO: 623027 - RNA, 61 nt, Homo Sapiens
acucagccuaauuaaaggauaauggugcuuucuucugaaaggguucccuucaauaacaaug

SEQ ID NO: 623028 - RNA, 61 nt, Homo Sapiens
uugcugucugucaugagugccuucccugaggcuucugaaggcgcaugggcugagaacaccu

SEQ ID NO: 623029 - RNA, 61 nt, Homo Sapiens
uugcauuuuauuaccauuucucaccaagaugcuucugaaaaaauuaagcaguucuacucga

SEQ ID NO: 623030 - RNA, 61 nt, Homo Sapiens
agagaccggacaagagccugcucucuggacccuucugaagccacuuucuccugguguuuuu

SEQ ID NO: 623031 - RNA, 61 nt, Homo Sapiens
gaaacaaauaaucacauugagacccauagaucuucugaaauacacguguggcgggcagugg

SEQ ID NO: 623032 - RNA, 61 nt, Homo Sapiens
caucucuacaggcucaaaacgaaagcuccgucuucugaauucauggcccagggaggcgggu

SEQ ID NO: 623033 - RNA, 61 nt, Homo Sapiens
uguauagacucugcuguggauuuuacugugacuucugaagcccacugaaucuacacacaga

SEQ ID NO: 623034 - RNA, 61 nt, Homo Sapiens
cccuggauacgcagaccgagcuacacaaaugcuucugaaugugcccuucuuuccaaaacag

SEQ ID NO: 623035 - RNA, 61 nt, Homo Sapiens
uguuuugucuuccuaaucuaauucucugcuacuucugaaucuuuccaagaaaaugugcagu

SEQ ID NO: 623036 - RNA, 61 nt, Homo Sapiens
acuuacuuguaauauauaauauuaauauucacuucugaagguuuuaugguucucuuaagga

SEQ ID NO: 623037 - RNA, 61 nt, Homo Sapiens
cugagcccauuucuggggggauguuauuuuccuucugaaguauucuucuuaaaaguuucua

SEQ ID NO: 623038 - RNA, 61 nt, Homo Sapiens
cuguauaguacacugguuugcauuguuucugcuucugaaauaacuugagcaggcuguucag

SEQ ID NO: 623039 - RNA, 61 nt, Homo Sapiens
aaaaaaagagugaagauagugagaacauuggcuucugaaaaggaaugaagcugcagauuua

SEQ ID NO: 623040 - RNA, 61 nt, Homo Sapiens
aaauugguguauuagacuauuuaucuuugaucuucugaauggauugcugucauggacacgg

SEQ ID NO: 623041 - RNA, 61 nt, Homo Sapiens
ucaucgacgccugugacagggagaaaggauacuucugaacaaggagccuccaagcaaauca

SEQ ID NO: 623042 - RNA, 61 nt, Homo Sapiens
uuggauuagcuuaaucaccaaguccugucaacuucugaaaugaaucucaaauuucuucccu

SEQ ID NO: 623043 - RNA, 61 nt, Homo Sapiens
cugaaaugaaaucccauuggauuguacuucucuucugaaaagugugcuuuuugacccuacu

SEQ ID NO: 623044 - RNA, 61 nt, Homo Sapiens
aggcucaacuucucuuccaaaaaucuucuggcuucugaacucuuccucugccucucuuuaa

SEQ ID NO: 623045 - RNA, 61 nt, Homo Sapiens
aguggaguggccauaggcaaguuacuuaacacuucugaaccuccuuuugucuuucauaaaa

SEQ ID NO: 623046 - RNA, 61 nt, Homo Sapiens
guaucuucagacucacagagugaauucagcucuucugaaucaagacccacccagucucuuu

SEQ ID NO: 623047 - RNA, 61 nt, Homo Sapiens
uuuuggcagguuucugugccuuuauuucccucuucugaaaaaaagucuguguuuucauagu

SEQ ID NO: 623048 - RNA, 61 nt, Homo Sapiens
agccugggguuccccuggcauuggccccagccuucugaaagccggcgcugcagccagaggc

SEQ ID NO: 623049 - RNA, 61 nt, Homo Sapiens
cguagcccacgcccucucuggguggcagggccuucugaaggaaacuugcaggcgagcccaa

SEQ ID NO: 623050 - RNA, 59 nt, Homo Sapiens
acagaauuaaacguguugccacaccugccggcuucugaacucuguccuuggcuuccugc

SEQ ID NO: 623051 - RNA, 61 nt, Homo Sapiens
acuguucuaauaaaugaucuugucucaauggcuucugaaugccuuccuuucugcugccuga

SEQ ID NO: 623052 - RNA, 61 nt, Homo Sapiens
uaaguugcagacaucaugaauauucuugaaccuucugaaaaucacuguaaauacacauucu

SEQ ID NO: 623053 - RNA, 61 nt, Homo Sapiens
agguccagggagggauuuagauuugaacugccuucugaaagcugccuucuaccuacagugc

SEQ ID NO: 623054 - RNA, 61 nt, Homo Sapiens
gugacccccaaguccuauccgaauuauuugccuucugaaauacauguagcuucuucugaaa

SEQ ID NO: 623055 - RNA, 61 nt, Homo Sapiens
aauuauuugccuucugaaauacauguagcuucuucugaaaguacuacccauagaaaacuug

SEQ ID NO: 623056 - RNA, 61 nt, Homo Sapiens
gggaguuccugagauacaacaagacaaggggcuucugaaaucugcugccuguuggggucgg

SEQ ID NO: 623057 - RNA, 61 nt, Homo Sapiens
gcagcuguuaguuuacucuucagguccaccccuucugaaaaugguucccugacaaggguac

SEQ ID NO: 623058 - RNA, 61 nt, Homo Sapiens
aacugccucugcacacacaugaggcaaggagcuucugaagaggcucgagcagccuugggaa

SEQ ID NO: 623059 - RNA, 61 nt, Homo Sapiens
uagaaacaaucuauaguuauugaaaggaccucuucugaagccacaacauuuuaauacagau

SEQ ID NO: 623060 - RNA, 61 nt, Homo Sapiens
cuuagaauggccucuuuguaucuaucagugacuucugaaucuguuauuuggaauuuuaagu

SEQ ID NO: 623061 - RNA, 61 nt, Homo Sapiens
uaggaaguuggagcucuugcgauccccaucccuucugaaaguaugugacaacccucaucuu

SEQ ID NO: 623062 - RNA, 61 nt, Homo Sapiens
uuuggacagguuagaguugggugccaugacucuucugaauggcagcgaugguauucgaucu

SEQ ID NO: 623063 - RNA, 61 nt, Homo Sapiens
gcggggccaauaaugaugcccucugucucugcuucugaacaauggcuccgccucucugagc

SEQ ID NO: 623064 - RNA, 61 nt, Homo Sapiens
ucaccaaacugaggccagaguugcugggagucuucugaacccauccaagaaauacuuuuua

SEQ ID NO: 623065 - RNA, 61 nt, Homo Sapiens
cucaaaugaguggaggccucggucccugaaucuucugaaauucccccucccuaagcuccag

SEQ ID NO: 623066 - RNA, 61 nt, Homo Sapiens
cauauguagagauuucagccgcuccuguuaccuucugaaucgugcguucuggggcugugcu

SEQ ID NO: 623067 - RNA, 61 nt, Homo Sapiens
auuccuuguccgccaacccaccgugauucaucuucugaagcugggagugaaacugggucag

SEQ ID NO: 623068 - RNA, 61 nt, Homo Sapiens
uuguaagaaauguuugucauaugcgugaugucuucugaaauauucuuauaaccuuaaugac

SEQ ID NO: 623069 - RNA, 61 nt, Homo Sapiens
uccauuuauccuauuuugaucuuuuucaagucuucugaaaggaaguagacaguauuacacc

SEQ ID NO: 623070 - RNA, 61 nt, Homo Sapiens
auguuuuucauuucccguguguuuccauuuccuucugaaauucugauuuuauccauuuuuu

SEQ ID NO: 623071 - RNA, 61 nt, Homo Sapiens
augaccucugcaaacagaaucuuggauauuucuucugaaggauuauuugcacagacuuaaa

SEQ ID NO: 623072 - RNA, 61 nt, Homo Sapiens
uccauuguccacacacacacaaccagauaaucuucugaaaguguaacucagaugaugccuc

SEQ ID NO: 623073 - RNA, 61 nt, Homo Sapiens
cccugcucucuccuguugcucugggauugcacuucugaaugaaguagcagcucauaagcuu

SEQ ID NO: 623074 - RNA, 61 nt, Homo Sapiens
agccaaucucucauuuagaccuggcuucuuucuucugaacaaaguaggguucaaaaugcag

SEQ ID NO: 623075 - RNA, 61 nt, Homo Sapiens
aguuagugaguggaguugcccaagucuggggcuucugaaaugaccugguauuuuuauguuc

SEQ ID NO: 623076 - RNA, 57 nt, Homo Sapiens
uuuuguccuuggagacugcacuugugucuucugaaguucccuuucuucagaaauuaa

SEQ ID NO: 623077 - RNA, 61 nt, Homo Sapiens
cacgagccgugaguaggcagcgaccccuuggcuucugaagagaggacacugcuaagggucu

SEQ ID NO: 623078 - RNA, 61 nt, Homo Sapiens
agacuuucuucucauccaguaccaccuuauucuucugaaaacacugagaaaaagaaugaga

SEQ ID NO: 623079 - RNA, 61 nt, Homo Sapiens
aucagauuaaauuaugcuucucuugaggugccuucugaaucaggaaaacggcacaacacaa

SEQ ID NO: 623080 - RNA, 61 nt, Homo Sapiens
aagagucguucccucuguuuguuuuaguugucuucugaaaacuuuuuugucuuguuuuucu

SEQ ID NO: 623081 - RNA, 61 nt, Homo Sapiens
guaauaccaaaugccuaaaauguagaccgaacuucugaagagauguuuuuaaaguuucuuu

SEQ ID NO: 623082 - RNA, 61 nt, Homo Sapiens
aaaucacugugacucaaggaccaacguaauacuucugaaccugacuaaaacaucucuggug

SEQ ID NO: 623083 - RNA, 61 nt, Homo Sapiens
uaauaaaaaauuuuaggagacaauaguauugcuucugaaaggugugguuguugauaccuug

SEQ ID NO: 623084 - RNA, 61 nt, Homo Sapiens
acucuuguugcgaucgcuaauaccacauucacuucugaaacuaucuucacaggugugauca

SEQ ID NO: 623085 - RNA, 61 nt, Homo Sapiens
aacagcaccagcacagcauguauuuucuucucuucugaaaguucuggcuuguagaccccuc

SEQ ID NO: 623086 - RNA, 61 nt, Homo Sapiens
uguuuguuuacucuuucuuugaaaacaucaccuucugaaauuugucuuuuagcucucucag

SEQ ID NO: 623087 - RNA, 61 nt, Homo Sapiens
caggccuaugaagugcauagggaguguaugucuucugaaugguuuuauuguucuuguaauc

SEQ ID NO: 623088 - RNA, 61 nt, Homo Sapiens
ggaguauguacaauucuucugggaagccagccuucugaacuuuuugguacuaaauccuuau

SEQ ID NO: 623089 - RNA, 61 nt, Homo Sapiens
ugcugcugagugacugcaugaugagauacaacuucugaaugcugcacauucuuccaaaaug

SEQ ID NO: 623090 - RNA, 61 nt, Homo Sapiens
uggucucccagcaccuggcccagguaacagccuucugaaagcagagccaaggagcugcuuc

SEQ ID NO: 623091 - RNA, 61 nt, Homo Sapiens
auucuuguuaacuauaugugaaacauuuuuucuucugaagauucuuaaaaauugaaugugg

SEQ ID NO: 623092 - RNA, 61 nt, Homo Sapiens
agaaaacugcucuguuuccccuuuaguaacacuucugaagaggaaaaacuucaauagccaa

SEQ ID NO: 623093 - RNA, 61 nt, Homo Sapiens
uccauuuuggaaaaugauuaggcccgccaaacuucugaacuuuggaagcuggggauguuua

SEQ ID NO: 623094 - RNA, 61 nt, Homo Sapiens
gcaagggccuaagagaaaagccagccaagugcuucugaauaaagaucccucucugggucuc

SEQ ID NO: 623095 - RNA, 61 nt, Homo Sapiens
aagccaggcugagugagccacagaccaccugcuucugaacucaagcugcguuuauuaaugc

SEQ ID NO: 623096 - RNA, 61 nt, Homo Sapiens
uucuaaauccuaggaagaaacgcuuggagugcuucugaauauacagaaguuccauuuaagg

SEQ ID NO: 623097 - RNA, 61 nt, Homo Sapiens
auaaaagcagauaccuuuaaguuuguguagacuucugaauaagaugauagacgagaauuuu

SEQ ID NO: 623098 - RNA, 61 nt, Homo Sapiens
aaauguuacaauuauacuagcaagaguauuucuucugaaaaauauaagucuccagagcaca

SEQ ID NO: 623099 - RNA, 61 nt, Homo Sapiens
ugcugaucauuugaggaauaccucuguccugcuucugaaugccagagaugucaucagagcu

SEQ ID NO: 623100 - RNA, 61 nt, Homo Sapiens
ccaacguggaggaaagggagcucgggccacucuucugaaggcagggccagauaaggaacag

SEQ ID NO: 623101 - RNA, 61 nt, Homo Sapiens
cauuuguuauugaaggaaagugcuccugaaccuucugaacguuuugagaaaaacuaaauca

SEQ ID NO: 623102 - RNA, 61 nt, Homo Sapiens
acaaaacaaaugugcuaugcauaaggguuggcuucugaacucuuguacacauuuuaauaaa

SEQ ID NO: 623103 - RNA, 61 nt, Homo Sapiens
uuagaauuggaauuacuuccaacuggcagaacuucugaagucccaaggaaggccacuucuc

SEQ ID NO: 623104 - RNA, 61 nt, Homo Sapiens
gguuuaauagagaaaugcugaaucaugcagucuucugaaaaaaaaaaagucacuuuuggcu

SEQ ID NO: 623105 - RNA, 61 nt, Homo Sapiens
cagaaacuaucccagaucucgcuggugaacacuucugaauucagcuaauacaugcaaugug

SEQ ID NO: 623106 - RNA, 61 nt, Homo Sapiens
ccuuacauuuauaacaucauuuuauaauguucuucugaaagggauuaugaggucuugaguu

SEQ ID NO: 623107 - RNA, 61 nt, Homo Sapiens
ggaauucugcagcuaacccugccuccguuggcuucugaacuuuaaucccugucuggacuga

SEQ ID NO: 623108 - RNA, 61 nt, Homo Sapiens
guuugaaagcaaaaacaaaccacugucucugcuucugaaacgggaaucaguaacucuuugc

SEQ ID NO: 623109 - RNA, 61 nt, Homo Sapiens
uaaacaugguuaaaauaaaacuuuugugguucuucugaaucuuaauauuucaaagccaggu

SEQ ID NO: 623110 - RNA, 61 nt, Homo Sapiens
ucucacaagagcagaggccugaagauucuuucuucugaaagccaagcaccacaaggaaaaa

SEQ ID NO: 623111 - RNA, 61 nt, Homo Sapiens
ugaaaauaaggaauugcuuauaaaccagccacuucugaauacaauauguagcugauuuaau

SEQ ID NO: 623112 - RNA, 59 nt, Homo Sapiens
uauugauguuacccaguuuuaauaaaagaaucuucugaaggauggguccuccuaccuac

SEQ ID NO: 623113 - RNA, 61 nt, Homo Sapiens
acugugucuacaguuuauccauauaacuucucuucugaaaacugaggaguguccucuguuc

SEQ ID NO: 623114 - RNA, 61 nt, Homo Sapiens
acagacuguuccaccguugugcauauuguugcuucugaaccacaaacuguauaaauggaug

SEQ ID NO: 623115 - RNA, 61 nt, Homo Sapiens
aacaucucccuuccggggcugcccucaagagcuucugaaaaacuaaugacucugcugccuu

SEQ ID NO: 623116 - RNA, 61 nt, Homo Sapiens
aguagguucauguguuuucuuagguaaaguucuucugaaagaauuuucuauuuuuaaaaaa

SEQ ID NO: 623117 - RNA, 61 nt, Homo Sapiens
auacuaaguuccauguauuuuuguuacaaaucuucugaaaaaaaacaaaacaaugugaaac

SEQ ID NO: 623118 - RNA, 61 nt, Homo Sapiens
ccauaucuucuggcuaaccauauucaagauucuucugaaacuuggaggauguaaagaaucc

SEQ ID NO: 623119 - RNA, 61 nt, Homo Sapiens
auguccuuccccucacuugugugaguggccccuucugaaucucuccagcagccagaggcac

SEQ ID NO: 623120 - RNA, 61 nt, Homo Sapiens
uucuccaaacgcucgguuccuuugaagauuucuucugaacgugugugcgcacgcugggcgg

SEQ ID NO: 623121 - RNA, 61 nt, Homo Sapiens
cccaagagcucaaaagcagaaauggccaggccuucugaaaacuuaaguccagaauugucac

SEQ ID NO: 623122 - RNA, 61 nt, Homo Sapiens
uuguggccuccuuggauucuucugacuuuggcuucugaaaggaaggccuagauccagcccu

SEQ ID NO: 623123 - RNA, 61 nt, Homo Sapiens
cuaaaaggcgcuucauguccaguguguggcccuucugaaacuuauggucaucucucccacu

SEQ ID NO: 623124 - RNA, 61 nt, Homo Sapiens
gucauuugguacuggcuaccuggagccuuaucuucugaaggguuuuaaagaauggccaauu

SEQ ID NO: 623125 - RNA, 61 nt, Homo Sapiens
gacaguauagcugcccuugcgcccaggagagcuucugaaaggcucgugggcacuuuccaca

SEQ ID NO: 623126 - RNA, 61 nt, Homo Sapiens
cugcuacuugauuucuuucuacccaggacugcuucugaauggagagacuuuaucaggauga

SEQ ID NO: 623127 - RNA, 61 nt, Homo Sapiens
cugcuacuuaauuccuuucuaacccaggacgcuucugaaugggagagaccucaucaggaug

SEQ ID NO: 623128 - RNA, 61 nt, Homo Sapiens
guaaaugaacuuaaaaauagccuaaaggagacuucugaauuauuugcuuaauauauaucua

SEQ ID NO: 623129 - RNA, 61 nt, Homo Sapiens
uaauccuuaaaacaaacuucuuacaugaggacuucugaaauuuuauucaugccugauuugu

SEQ ID NO: 623130 - RNA, 61 nt, Homo Sapiens
uucaagagcauccuauaguggaaaaagguaucuucugaaugguauacaaaaauaaaaagug

SEQ ID NO: 623131 - RNA, 61 nt, Homo Sapiens
agagcuggcucccuggggugggagccggggacuucugaaauuggguguuggcuggguaagg

SEQ ID NO: 623132 - RNA, 61 nt, Homo Sapiens
uggguuucaugccugcccccguacuuaagcacuucugaacuauaguugaguaaucaccuca

SEQ ID NO: 623133 - RNA, 61 nt, Homo Sapiens
cagggcucuugaacagacaacuuccgagggccuucugaagaagaguuggugaagguugucu

SEQ ID NO: 623134 - RNA, 61 nt, Homo Sapiens
auguuuuuuuccucugugaucagauuaaucucuucugaauggcacaaagaacguugaaguu

SEQ ID NO: 623135 - RNA, 61 nt, Homo Sapiens
ucucuuauuugcgugcacugacacuucuugacuucugaaugauuuuugcagucuuaaaauu

SEQ ID NO: 623136 - RNA, 61 nt, Homo Sapiens
ugaucaagagcauggagaauuauuauccaaucuucugaacuacuuagcaaaauuagcaaua

SEQ ID NO: 623137 - RNA, 61 nt, Homo Sapiens
ucaaggcaagaaccucuuuacaaggauaugucuucugaagaucucucaacccagggacacc

SEQ ID NO: 623138 - RNA, 61 nt, Homo Sapiens
agaccuacuugaacagggcauauuuuuuagacuucugaacaucaguauguucgaggguacu

SEQ ID NO: 623139 - RNA, 61 nt, Homo Sapiens
aaggaauaugacauacagugcuggccacaaccuucugaaggcccaugcccuggcuuggcau

SEQ ID NO: 623140 - RNA, 61 nt, Homo Sapiens
ucuucuuccagcucguuagcagcauuagcaccuucugaauuccacccucucagaagaaucc

SEQ ID NO: 623141 - RNA, 61 nt, Homo Sapiens
ggcuuucauuuggucagcacuagaacaguaucuucugaagacaaaacugaaugcuauagcu

SEQ ID NO: 623142 - RNA, 61 nt, Homo Sapiens
agcaaagcuuccuguguuucgaaaaugguaacuucugaaacgcugcaugagacaucuuucu

SEQ ID NO: 623143 - RNA, 61 nt, Homo Sapiens
caaauugguugguuuugacuuauuuuugcugcuucugaauauccucccagcccauaaccag

SEQ ID NO: 623144 - RNA, 61 nt, Homo Sapiens
uggagccugaauacauuuucggaaagucucucuucugaaccgugaauuuugucuccugcuu

SEQ ID NO: 623145 - RNA, 61 nt, Homo Sapiens
uggaaaggggaaguuggcaggauuagaggaacuucugaacuuuggucuucuuuucauuuuu

SEQ ID NO: 623146 - RNA, 61 nt, Homo Sapiens
uucuguaucugagcacaucaaccauuuuccucuucugaaaaguuuuuuucuaauggaauga

SEQ ID NO: 623147 - RNA, 61 nt, Homo Sapiens
auaaauguguuugaaaugcauaucugcaccacuucugaauacuucgguguaaucuaagcgu

SEQ ID NO: 623148 - RNA, 61 nt, Homo Sapiens
guagauuuccacaaaucagacacauuauuuucuucugaacuuggcaauauaaccuaauaag

SEQ ID NO: 623149 - RNA, 61 nt, Homo Sapiens
ggagcaucuuuggacucucuguuuuuaaaaccuucugaaccaugacuuggagccggcagag

SEQ ID NO: 623150 - RNA, 61 nt, Homo Sapiens
cagcaauccagguaagacuuacuaaaagucucuucugaaaagacuacaaagaaaaacagau

SEQ ID NO: 623151 - RNA, 50 nt, Homo Sapiens
uuggcccugagcuccauucucuucugaacuccaagaaaaagaggaaguaa

SEQ ID NO: 623152 - RNA, 61 nt, Homo Sapiens
auuauuaaauaagugaauacugagauagcuucuucugaacuugaauuacuucuuguacagc

SEQ ID NO: 623153 - RNA, 61 nt, Homo Sapiens
aaccaauccaggaacugcuuccugaauugugcuucugaauuugggauguagauagaaagca

SEQ ID NO: 623154 - RNA, 61 nt, Homo Sapiens
agaaaggaccgaagcugcugcaacaaagccgcuucugaagaugugcaaauuacaggcaaga

SEQ ID NO: 623155 - RNA, 61 nt, Homo Sapiens
aucaaagacuaauuugugauaucuucuuaugcuucugaauauggaaaacaugaaaacagca

SEQ ID NO: 623156 - RNA, 61 nt, Homo Sapiens
aaacuacuaccuaggagaauagcucauuuuccuucugaaaggacccucauaugaccugcac

SEQ ID NO: 623157 - RNA, 61 nt, Homo Sapiens
uuguagggaccuugcccugccccuaaacacacuucugaaggggaggcugucagacuguucc

SEQ ID NO: 623158 - RNA, 61 nt, Homo Sapiens
ucagaacauucagcucuggauucccccucuucuucugaagaggcggaggggauccagccac

SEQ ID NO: 623159 - RNA, 61 nt, Homo Sapiens
cuaguucucuuuuauucuuguaaauauuacucuucugaaugcucuuagaagcuaacccacu

SEQ ID NO: 623160 - RNA, 61 nt, Homo Sapiens
cugaagcccgaugacaucuuaguccucgaugcuucugaaccagcacagagggccggccacc

SEQ ID NO: 623161 - RNA, 61 nt, Homo Sapiens
caaaccuuucuggacggcagaaaaggaagugcuucugaaaauuuaguaaaagaaagugagg

SEQ ID NO: 623162 - RNA, 61 nt, Homo Sapiens
gggugaccaaaugacgagcccucgccucuuucuucugaagaguacucuauaaaucuagugg

SEQ ID NO: 623163 - RNA, 61 nt, Homo Sapiens
guuccccauccccaguaguuuacauuccugacuucugaauacagcacagcugagcccccug

SEQ ID NO: 623164 - RNA, 61 nt, Homo Sapiens
uaaauaugcaauaaaguguuuacaggaugcccuucugaaggguaguccuuuguaaagcugu

SEQ ID NO: 623165 - RNA, 61 nt, Homo Sapiens
agauacuuacugacuccacuccugacuucugcuucugaaaaaaugaaguagguguuuuccc

SEQ ID NO: 623166 - RNA, 61 nt, Homo Sapiens
augaaaucauuuucacaaaauaagcagcuugcuucugaaaugcugucuuucccaguagcua

SEQ ID NO: 623167 - RNA, 61 nt, Homo Sapiens
cugucauuccacuucauggaagagacggagccuucugaaaugagaucuacccugaaaaucu

SEQ ID NO: 623168 - RNA, 61 nt, Homo Sapiens
ugccacgagcccauaauugaagagucaaagucuucugaagcugcacccucuuuacuucagu

SEQ ID NO: 623169 - RNA, 61 nt, Homo Sapiens
aaacuauuuugaaaguucucuccaucuuucucuucugaagugucuguuuaacucuucaugu

SEQ ID NO: 623170 - RNA, 61 nt, Homo Sapiens
cucgggggacaugggccucugacucaguucccuucugaacaagggccuggccaccucauag

SEQ ID NO: 623171 - RNA, 61 nt, Homo Sapiens
ucuguacugggagugaagaggauaucuggggcuucugaagggagcccuaccauuacauccu

SEQ ID NO: 623172 - RNA, 61 nt, Homo Sapiens
auuuucaaggcgggugggaugacauggagaacuucugaagacuaaagguuuuguccuguag

SEQ ID NO: 623173 - RNA, 61 nt, Homo Sapiens
ucuacaccaauaacugcugcggaaucuguaccuucugaaccaaugaauuauuucuguaguu

SEQ ID NO: 623174 - RNA, 61 nt, Homo Sapiens
agcccauugcuggcccgccaacaccucagaccuucugaagcccaggacgucaggcugacca

SEQ ID NO: 623175 - RNA, 61 nt, Homo Sapiens
guucugaugaaaacugacugucucugggccacuucugaaggcaguuuccucaggcaaggcc

SEQ ID NO: 623176 - RNA, 61 nt, Homo Sapiens
uuaacgugaucaucaccacucauguacuacacuucugaaacagacaaauuguuaagaguau

SEQ ID NO: 623177 - RNA, 61 nt, Homo Sapiens
ucugcaauaggaaauguuucgauaaaaagaacuucugaaucgaaaccagaaugaucuucag

SEQ ID NO: 623178 - RNA, 61 nt, Homo Sapiens
ugcagcaguggcuuagaaagauagucagcuacuucugaaacgccggaguaucuauuucuac

SEQ ID NO: 623179 - RNA, 61 nt, Homo Sapiens
uaauuuuuauuuuugaagcuuaaauguguuucuucugaaagcuguuaaagauguauuuaug

SEQ ID NO: 623180 - RNA, 61 nt, Homo Sapiens
ugaauuucuacaguuuaacauagcacagggccuucugaaaaucgcacuugucaaagacgac

SEQ ID NO: 623181 - RNA, 61 nt, Homo Sapiens
ugggggcucagccaggugcugugacaccccccuucugaaugaagccuucugaccugggcug

SEQ ID NO: 623182 - RNA, 61 nt, Homo Sapiens
ugaugccugugaacugaacucugacaacagacuucugaaauagacccacaagaggcaguuc

SEQ ID NO: 623183 - RNA, 61 nt, Homo Sapiens
uuucugcccaguucuacccccucaugugcuucuucugaauacugaaugugacuguuugaaa

SEQ ID NO: 623184 - RNA, 61 nt, Homo Sapiens
agagggaaugcuagguugauagggcugguggcuucugaauuugguauuugaacuaggaguc

SEQ ID NO: 623185 - RNA, 61 nt, Homo Sapiens
auguucucugguaacacguagaguucagacccuucugaacucuguugauaauaccacacca

SEQ ID NO: 623186 - RNA, 61 nt, Homo Sapiens
gcaucuuccucccuccuuuaauuaauggaaucuucugaauuuucccugaauguuuaaagau

SEQ ID NO: 623187 - RNA, 61 nt, Homo Sapiens
ucugaaaugcgcccgccuggcggacagcucccuucugaagcagagaagccuccauggucac

SEQ ID NO: 623188 - RNA, 61 nt, Homo Sapiens
gaagggaaaaaaaccaccccagaagaacuuacuucugaaauuguaacagauacacuacagu

SEQ ID NO: 623189 - RNA, 61 nt, Homo Sapiens
aaugccgauuuuauccaugguggcaucaugccuucugaauaccacuuggggaguuucuucc

SEQ ID NO: 623190 - RNA, 61 nt, Homo Sapiens
gccuggcgggaaauguagucuccgccaccggcuucugaacaaaagacucuuuucuccucuc

SEQ ID NO: 623191 - RNA, 61 nt, Homo Sapiens
ccguagcggguuaugaggaaucacgucuuagcuucugaacagccuggccuggcucuggaag

SEQ ID NO: 623192 - RNA, 61 nt, Homo Sapiens
cuauauuuaucugagugaguagcuuccauuacuucugaaaaauuagauuuuugugaugaag

SEQ ID NO: 623193 - RNA, 61 nt, Homo Sapiens
gucagaauauguaauuauuucuuuugguguccuucugaaggauugaaacauaaaauuguag

SEQ ID NO: 623194 - RNA, 61 nt, Homo Sapiens
cuuuccuuuaugaacucccaaugggaaagagcuucugaacuguuuuccauuugggggcccc

SEQ ID NO: 623195 - RNA, 61 nt, Homo Sapiens
uaaaaagagagcaugagguuauuguacaugacuucugaaauuucccaaguuucacaaugug

SEQ ID NO: 623196 - RNA, 61 nt, Homo Sapiens
gauuuuagaugauaaggcuacaauucagaaucuucugaaccaucuauguaaugaaugggga

SEQ ID NO: 623197 - RNA, 61 nt, Homo Sapiens
gcuuuagaacaaacccuuuuugaucuuaaugcuucugaaaacuaggucugacucuggggau

SEQ ID NO: 623198 - RNA, 61 nt, Homo Sapiens
gcaaaugucuccucccucccaugcuccuuggcuucugaaggcugaagcuccuuuggcuggg

SEQ ID NO: 623199 - RNA, 61 nt, Homo Sapiens
gaagugccuucauccaggacaggaaguagcacuucugaaacaggaaguggucuggcuggaa

SEQ ID NO: 623200 - RNA, 61 nt, Homo Sapiens
augcuuacugugguauuuggaauguauguaucuucugaacccuacaucaaguugaaaaggu

SEQ ID NO: 623201 - RNA, 61 nt, Homo Sapiens
uuugaacaguuuaauaaacugguucugcucucuucugaaucucaugccuuuggcaccuugg

SEQ ID NO: 623202 - RNA, 61 nt, Homo Sapiens
uagggagggauuucacucuucuucccagguucuucugaagcacccacacaaaaugcacacu

SEQ ID NO: 623203 - RNA, 61 nt, Homo Sapiens
aagaggaucuggagaaccucauccagcuccccuucugaaucagcugggaugacuggcuuug

SEQ ID NO: 623204 - RNA, 61 nt, Homo Sapiens
aggaaggggcucuguucccuguauuguccuccuucugaagccccuuggcucugccuuggcc

SEQ ID NO: 623205 - RNA, 61 nt, Homo Sapiens
cuaagccgaguaagaagacauacaaaagccucuucugaaggaaaagacaguguaguccugc

SEQ ID NO: 623206 - RNA, 61 nt, Homo Sapiens
cuuuugaacguaugugcucuuauaaaguggacuucugaaaaaugaauguaaaagacacugg

SEQ ID NO: 623207 - RNA, 61 nt, Homo Sapiens
cccacacaugguccucacucauaucugucaccuucugaagccuagaucuuguuaacccauc

SEQ ID NO: 623208 - RNA, 61 nt, Homo Sapiens
cgaaacugacaguauuaaggguaggauguugcuucugaaucacuguugaguucugauugug

SEQ ID NO: 623209 - RNA, 61 nt, Homo Sapiens
ccugcgccucacccucagacuggugaccaggcuucugaaagccauucuggaucaguuggcu

SEQ ID NO: 623210 - RNA, 61 nt, Homo Sapiens
ugacuuuuuuugugugaauaaagauaugaaacuucugaaucucaagaacugugguguguuu

SEQ ID NO: 623211 - RNA, 61 nt, Homo Sapiens
ggcaauuggaggcgguaguguuguguguuagcuucugaauucaggguacgaacuggagggc

SEQ ID NO: 623212 - RNA, 61 nt, Homo Sapiens
uuuuguauaguuugcaaauuauauuuauuuucuucugaaacggaagaugagauuguaggug

SEQ ID NO: 623213 - RNA, 61 nt, Homo Sapiens
aguagagcaggaaaaguaaagaaaguugccacuucugaaugcaaaaacuuaaauucauuca

SEQ ID NO: 623214 - RNA, 61 nt, Homo Sapiens
cugucacguguagacauggguugauuuguaccuucugaaucguaagcuuccugggugaagg

SEQ ID NO: 623215 - RNA, 61 nt, Homo Sapiens
caguagauguugaacuuauccugcucauacacuucugaauauuucaggggucaaguccuuc

SEQ ID NO: 623216 - RNA, 61 nt, Homo Sapiens
guagaaauagcuaucugaucauuuuuaaguucuucugaacuucuuuugucuuuaaaaccug

SEQ ID NO: 623217 - RNA, 61 nt, Homo Sapiens
aauauucagucacaagucauuccuuuuugcccuucugaaacgauucccuauucacauugaa

SEQ ID NO: 623218 - RNA, 61 nt, Homo Sapiens
ccaguaccuauaacugggcuauccuaacaaucuucugaacuuuaaaacuagccaaauuaga

SEQ ID NO: 623219 - RNA, 61 nt, Homo Sapiens
uaucaguguuuugccguuaauacaaaaauaacuucugaauuguaaauaaacauauuuuuuu

SEQ ID NO: 623220 - RNA, 61 nt, Homo Sapiens
guagauaacugcuuuuugacucucugcuuuucuucugaaauuugauauauaaccgugauug

SEQ ID NO: 623221 - RNA, 61 nt, Homo Sapiens
uaccguuaauaaggcaacuugggaucugauucuucugaagaacgucugucuacauugaauu

SEQ ID NO: 623222 - RNA, 61 nt, Homo Sapiens
ugugauuuaaaggaauuguacagaaacagugcuucugaauuaugucaucuuuuucaccauu

SEQ ID NO: 623223 - RNA, 61 nt, Homo Sapiens
aggaaaagagagaaggaagagacccugauggcuucugaaaccuccacaccuuggcuuuuau

SEQ ID NO: 623224 - RNA, 61 nt, Homo Sapiens
cuucacagagagcaggcaggagccacagauacuucugaaccggcccucuucaggcuuuggc

SEQ ID NO: 623225 - RNA, 61 nt, Homo Sapiens
ggucagggccauggcugacauugccuguuggcuucugaagugcacuaugaacagagaacau

SEQ ID NO: 623226 - RNA, 61 nt, Homo Sapiens
aaagaauggagcccacuaauauuauauuuuucuucugaaauaaauauaaagucaagacuaa

SEQ ID NO: 623227 - RNA, 61 nt, Homo Sapiens
caaagacccagaggccagagcaaaguaggaccuucugaagauucacuacugguguauccuu

SEQ ID NO: 623228 - RNA, 61 nt, Homo Sapiens
uguaucgugccaaaguuguaucacuguuaaacuucugaagacauaaccaguugagucuuau

SEQ ID NO: 623229 - RNA, 61 nt, Homo Sapiens
cuuguagaaaauaguuuuccagacacuuagccuucugaagugcucaucucuugcuuaaaug

SEQ ID NO: 623230 - RNA, 61 nt, Homo Sapiens
aauuuagagauguuuucuacauauuucugcucuucugaacaacuucugcuacccacuaaau

SEQ ID NO: 623231 - RNA, 61 nt, Homo Sapiens
uuaugauauuuguacuucauaaaaaucaaaccuucugaaaacaguuuuuuuaugguacucg

SEQ ID NO: 623232 - RNA, 61 nt, Homo Sapiens
aaacacuuacaaaauuucuuacuaucugauacuucugaaaguaauuaaaagagggauuauc

SEQ ID NO: 623233 - RNA, 61 nt, Homo Sapiens
ccuuuccagaguguuggaucgcauaaacuggcuucugaaucgugucuagaauuaaguaugg

SEQ ID NO: 623234 - RNA, 61 nt, Homo Sapiens
guaauacauaucacaaaaagucaacaccuuucuucugaacuggugaaacgguacgaugguc

SEQ ID NO: 623235 - RNA, 61 nt, Homo Sapiens
cauucaggauucuguuccuuagguuuuuuuccuucugaaguguuucacgagagcccgggag

SEQ ID NO: 623236 - RNA, 61 nt, Homo Sapiens
aagcagguguggggccuccuucugggcuuuucuucugaauuuagaggauuucuagaacgug

SEQ ID NO: 623237 - RNA, 61 nt, Homo Sapiens
gagacacugauuuuuaaauaucaaaauuucccuucugaagucguucagauguguuccuuaa

SEQ ID NO: 623238 - RNA, 61 nt, Homo Sapiens
ugaugcgcaugggcaaggccagcgcccggggcuucugaaccgagcgggguguuucauuuuu

SEQ ID NO: 623239 - RNA, 61 nt, Homo Sapiens
ccagagguacaaggaggagcugguacuauuccuucugaaacuauuccaaucaaugggaaaa

SEQ ID NO: 623240 - RNA, 61 nt, Homo Sapiens
uacuuagauuacuaaauauauauuucaucuacuucugaaguugauagucuucccccccccc

SEQ ID NO: 623241 - RNA, 61 nt, Homo Sapiens
auggggcuguuacuuuuaaagucaaaauuuucuucugaaggcucauuuugguauuugaucu

SEQ ID NO: 623242 - RNA, 61 nt, Homo Sapiens
cagcaaagccauucuuaagagucgugagguccuucugaauguaaaacuggagcccaggaga

SEQ ID NO: 623243 - RNA, 61 nt, Homo Sapiens
gugguuggcagcuccaagccuuuaaaccuggcuucugaaacgauggcaucagagcccugga

SEQ ID NO: 623244 - RNA, 61 nt, Homo Sapiens
auuugcaccucaucaugccccagaaauaauccuucugaagcaaagcaccacgaaugagguu

SEQ ID NO: 623245 - RNA, 61 nt, Homo Sapiens
ugaucuuccauuaccuucacaucccgggguccuucugaacugaccuugaccucugaucucu

SEQ ID NO: 623246 - RNA, 61 nt, Homo Sapiens
agcacccccauccccuuggcccuuccucaugcuucugaaguggacauauucagccuuggcg

SEQ ID NO: 623247 - RNA, 61 nt, Homo Sapiens
gucucuauuuuuaaaaaagaaaaagaaccgacuucugaaucgcagcuccacucaugacuaa

SEQ ID NO: 623248 - RNA, 61 nt, Homo Sapiens
ucucucuccaucgggccucgggacccuuucucuucugaaucugcuucccugcaguuuagau

SEQ ID NO: 623249 - RNA, 61 nt, Homo Sapiens
agcacgacuaagagccuucugagcccagcgacuucugaagggccccuugcaaaguaauagg

SEQ ID NO: 623250 - RNA, 61 nt, Homo Sapiens
cuccaguugagacacaagucacaaauccaggcuucugaaacuucggaccaaccagcuucaa

SEQ ID NO: 623251 - RNA, 61 nt, Homo Sapiens
guucuagacgccccucccaagcguuccuggccuucugaacuccauacagccucuacagccg

SEQ ID NO: 623252 - RNA, 61 nt, Homo Sapiens
cuucccacugaagggacacagagguccaguccuucugaagggcuaggaucggguucuggca

SEQ ID NO: 623253 - RNA, 61 nt, Homo Sapiens
ccucagacucuccccaauagcggaagucgaucuucugaaggauggccaaucugcuccggcc

SEQ ID NO: 623254 - RNA, 61 nt, Homo Sapiens
uugcaaaaaucaauuauuuaucaugaguauacuucugaaaugaucuguuucaucaaucuau

SEQ ID NO: 623255 - RNA, 61 nt, Homo Sapiens
ccaaacuccagccgcugccagccagccuucgcuucugaaaaagccuucccugugugccaac

SEQ ID NO: 623256 - RNA, 61 nt, Homo Sapiens
augacugcguccuccucugcucggggggaggcuucugaaagaaaucgaagaugucaugggg

SEQ ID NO: 623257 - RNA, 61 nt, Homo Sapiens
ucccccuggagucucacucccgggauucccgcuucugaaacaacacccuucugauggaagg

SEQ ID NO: 623258 - RNA, 61 nt, Homo Sapiens
ccccuucucacguuucaggcguuucucugugcuucugaaacagcagcuucaggggcagucc

SEQ ID NO: 623259 - RNA, 56 nt, Homo Sapiens
agaucuucccucuuugcccgaaaaaucuucugaauaauauauuucagguuaacuag

SEQ ID NO: 623260 - RNA, 61 nt, Homo Sapiens
uguguucucccacuguaccagugacaaacuccuucugaacccuugcucacugugugaccaa

SEQ ID NO: 623261 - RNA, 61 nt, Homo Sapiens
cacaaaagaguucauacugguguuccagcuccuucugaauaaacauucugaagccuucggu

SEQ ID NO: 623262 - RNA, 61 nt, Homo Sapiens
uuaaaaaguccagauaggagauuuccuuaaacuucugaaaguucuaucauucgugcuauuu

SEQ ID NO: 623263 - RNA, 61 nt, Homo Sapiens
uuacaucaguuuuauuuuaaaguuuaauauacuucugaaguauuucucucccaaaucacua

SEQ ID NO: 623264 - RNA, 61 nt, Homo Sapiens
agccacaaauuuaugaaacaugugggauagccuucugaaaaccagaguagaaaacuaugaa

SEQ ID NO: 623265 - RNA, 61 nt, Homo Sapiens
guaacaacaagagcugauacccugucauguucuucugaauauucucuguccuuguuuccug

SEQ ID NO: 623266 - RNA, 61 nt, Homo Sapiens
uuuucucaucuucucuaaccugagauggagucuucugaaaauuuuguuuguuuuguuuuuu

SEQ ID NO: 623267 - RNA, 61 nt, Homo Sapiens
gcuucucugucggucuuguauauuaaaggaccuucugaagggacaccuucaguucuguucc

SEQ ID NO: 623268 - RNA, 61 nt, Homo Sapiens
ugguaaaggacuuggccagagcaagcuaagccuucugaagaucuauccuucugcugaaacu

SEQ ID NO: 623269 - RNA, 61 nt, Homo Sapiens
ggagcagaaagagaagguuuuuaaggaggggcuucugaauacuugggagauacggaacgga

SEQ ID NO: 623270 - RNA, 61 nt, Homo Sapiens
gccuccuggccucagggcaugcccugccuaccuucugaaauguuuaccccauugaccaaac

SEQ ID NO: 623271 - RNA, 61 nt, Homo Sapiens
uuugaaaucucugcaucacucauuggaagugcuucugaagagagcugcucuguguucaguu

SEQ ID NO: 623272 - RNA, 61 nt, Homo Sapiens
agcacgucuaagagccuuaugagcccagcgacuucugaagggccccuugcaaaguaauagg

SEQ ID NO: 623273 - RNA, 61 nt, Homo Sapiens
gugccuacuaugugcgagacauugggaggggcuucugaauuauucuggauaucgucauuuu

SEQ ID NO: 623274 - RNA, 61 nt, Homo Sapiens
cccacaaagcaucaaaagacucacucacaaacuucugaacacaaacuccauggaugaaagc

SEQ ID NO: 623275 - RNA, 61 nt, Homo Sapiens
ugcucagugaggaaaucucuuccaauuucugcuucugaaugauucaauguugggagcaaua

SEQ ID NO: 623276 - RNA, 61 nt, Homo Sapiens
uggaguugagggaaggagcuguauuguggcacuucugaauuccccguuuuguuccauauug

SEQ ID NO: 623277 - RNA, 61 nt, Homo Sapiens
gaguuuuuaaacuaucaauggcauuucaagucuucugaaacagcauggcuguaugugcgug

SEQ ID NO: 623278 - RNA, 61 nt, Homo Sapiens
ugguagagcaauaaugcuuuuuaaaaauaaacuucugaaaacccaaggccagguacugcau

SEQ ID NO: 623279 - RNA, 61 nt, Homo Sapiens
guauaucuuaagcauuuggaauuuuuuuuaucuucugaaaucauauaaaaagaaugucauu

SEQ ID NO: 623280 - RNA, 61 nt, Homo Sapiens
gggggauggcuuaacuguaccuguuuggaugcuucugaauagaaauaaaguggguuuuccc

SEQ ID NO: 623281 - RNA, 61 nt, Homo Sapiens
gcugaacauguggagggagggaacacgggagcuucugaagacgucuccauaaaaggcccag

SEQ ID NO: 623282 - RNA, 61 nt, Homo Sapiens
cccuccuugggccggguuguaaacccacucccuucugaagcugucugcucuagucauccag

SEQ ID NO: 623283 - RNA, 61 nt, Homo Sapiens
gaauacaucagcuggcauaaguuaagcauaucuucugaacuaauuaauuauccuuaaaaaa

SEQ ID NO: 623284 - RNA, 61 nt, Homo Sapiens
uugggagagggcugaacucuccaugccucuccuucugaaccuuccacccacccagcucugc

SEQ ID NO: 623285 - RNA, 61 nt, Homo Sapiens
auguguuugggaguugugaauuuauuaaaaacuucugaaugagguuuuuauaaugaaguug

SEQ ID NO: 623286 - RNA, 61 nt, Homo Sapiens
acgugcugcagagccaccuuccccuucccaacuucugaagcaccugugcccagcuuugguc

SEQ ID NO: 623287 - RNA, 61 nt, Homo Sapiens
gcaaggagcaaacacugaaacaguagaugugcuucugaaccagccuuggguuccaaccagg

SEQ ID NO: 623288 - RNA, 61 nt, Homo Sapiens
cucugggccugcgcuaauugcccugaggucccuucugaaccuuuuauuguaaccagaauca

SEQ ID NO: 623289 - RNA, 61 nt, Homo Sapiens
uguggucagcaucuguacaaaaagguggcuccuucugaaugugguagaggccgagcccagc

SEQ ID NO: 623290 - RNA, 61 nt, Homo Sapiens
ucucagggacagaugaggcuucccccuguggcuucugaaaagcgccucugcccucucccag

SEQ ID NO: 623291 - RNA, 61 nt, Homo Sapiens
caacaucuguuacauucuaaguguguucaggcuucugaagguaaagggacacuggauccag

SEQ ID NO: 623292 - RNA, 61 nt, Homo Sapiens
gaggucaucaaccgaugguccucacaagccucuucugaagauggaaggccuuuugcccguu

SEQ ID NO: 623293 - RNA, 61 nt, Homo Sapiens
cgccuggcaucucucugccgcagcauuuccccuucugaaccguccagugacugcuuucaau

SEQ ID NO: 623294 - RNA, 61 nt, Homo Sapiens
gaagcauauuuguggcgaagaaugaaaaugucuucugaaguaaugaggcugauagugaaga

SEQ ID NO: 623295 - RNA, 61 nt, Homo Sapiens
aucucaaaaagcccacccaauuucggucagucuucugaagaacaguccuuauucagaaacu

SEQ ID NO: 623296 - RNA, 61 nt, Homo Sapiens
cuguuauuagaauaaguuugccauagggugccuucugaauaacuucacugucaccuguguc

SEQ ID NO: 623297 - RNA, 61 nt, Homo Sapiens
ugccacuuccaguagacaugcacagaucucacuucugaaugccuuucuauuucaguucauu

SEQ ID NO: 623298 - RNA, 61 nt, Homo Sapiens
aauggggcccuguagcugcaccagaacgcuccuucugaagauccaggggacgauggaauac

SEQ ID NO: 623299 - RNA, 61 nt, Homo Sapiens
gaugacuuaaugucgaauauaacaggcuucucuucugaaauuucaaaccuuuccuacuuca

SEQ ID NO: 623300 - RNA, 61 nt, Homo Sapiens
guguccauccugaccugcgguccugucuguccuucugaagucuaagggcagcccuccaugg

SEQ ID NO: 623301 - RNA, 61 nt, Homo Sapiens
ggcgucaauaaagaccuggaaggauguugugcuucugaagccccacuggguguuacugcag

SEQ ID NO: 623302 - RNA, 61 nt, Homo Sapiens
gggggaggcaguguggaauauucaguagggacuucugaaauugccucaguguccuucucau

SEQ ID NO: 623303 - RNA, 61 nt, Homo Sapiens
ugugacaguguccagccggucaccuccaguucuucugaaagcauguaauaugaucaggacc

SEQ ID NO: 623304 - RNA, 61 nt, Homo Sapiens
gcuuuggccuuccucagugaugcaggaacugcuucugaaagcaggcuguggauuacgucac

SEQ ID NO: 623305 - RNA, 61 nt, Homo Sapiens
gugcuuucuccauuuauuuaugcuaguguagcuucugaaagugcuugauggaauuuuuucc

SEQ ID NO: 623306 - RNA, 61 nt, Homo Sapiens
guaauucauuuaauugcaaaaaagugggagacuucugaacaagcacaguauuuuuguauga

SEQ ID NO: 623307 - RNA, 61 nt, Homo Sapiens
auggaaacuguuaguccagaagguggauuaucuucugaagauuucccaggaacaaaucaaa

SEQ ID NO: 623308 - RNA, 61 nt, Homo Sapiens
guuuggccuaggccuaaagagugugucgugacuucugaagacgugaccggggcccacaucu

SEQ ID NO: 623309 - RNA, 61 nt, Homo Sapiens
ccuaucagguccagagggugggaaaccuugacuucugaauucccggcaucuaccccacuca

SEQ ID NO: 623310 - RNA, 61 nt, Homo Sapiens
accucauccuuccucacaggugcauguccuccuucugaagggugacaaugcagcacuggca

SEQ ID NO: 623311 - RNA, 61 nt, Homo Sapiens
auuuaauuugucuuuaaggacagucauuuggcuucugaauguuugaaacgauuuuaaaaaa

SEQ ID NO: 623312 - RNA, 61 nt, Homo Sapiens
caggggugaggaguggggagaaaccagaaugcuucugaaacucccaccuguugcucugagc

SEQ ID NO: 623313 - RNA, 61 nt, Homo Sapiens
uauuuuuuuucaugaaaaugucaacaugguucuucugaaucuaucacagugaaaaguucua

SEQ ID NO: 623314 - RNA, 61 nt, Homo Sapiens
uauuuucccucaccagucuaggcaugacuggcuucugaaaaauuccagcacaccuccucga

SEQ ID NO: 623315 - RNA, 61 nt, Homo Sapiens
gauauauucuaugcauagauguaaugcuaaccuucugaauauauuuugaauacauuuauau

SEQ ID NO: 623316 - RNA, 61 nt, Homo Sapiens
auaauaaaauuuccccuaaucuuuucugaaucuucugaaaccaaauguaacuauguuuuau

SEQ ID NO: 623317 - RNA, 61 nt, Homo Sapiens
uuguuuucuuggcuaguaauaguaguagauacuucugaaauaaauguucucucaagauccu

SEQ ID NO: 623318 - RNA, 61 nt, Homo Sapiens
uguggaugacccuuagaauccauucucuggucuucugaaauaccaagggcagaugucaccu

SEQ ID NO: 623319 - RNA, 61 nt, Homo Sapiens
augauguucagauuuuccagugaaaaauacccuucugaacaaaacauguacuuacucuccg

SEQ ID NO: 623320 - RNA, 61 nt, Homo Sapiens
ugcugguggcuaacggcuugugcuugaaagucuucugaagucugaugugaauugagcuauc

SEQ ID NO: 623321 - RNA, 61 nt, Homo Sapiens
uugguucuggcccccgcuuuuucuaacaugucuucugaaugcuuccuuuuucccugcacac

SEQ ID NO: 623322 - RNA, 61 nt, Homo Sapiens
uccauaucauaguugcuuucuuuaauuguuccuucugaauaaacaguuuauuuaagauacu

SEQ ID NO: 623323 - RNA, 61 nt, Homo Sapiens
ucagccaaggacacuugauaagcagcugacacuucugaaacgguguuuccaacgucaugga

SEQ ID NO: 623324 - RNA, 61 nt, Homo Sapiens
gaaaguguauuauaaaaaaaauuuuuuuucacuucugaaggacgcuucaguauuuuaugca

SEQ ID NO: 623325 - RNA, 61 nt, Homo Sapiens
aacaaaaaaauugagaggcuuugccucccaucuucugaaaauuaauugugaaccuaccaug

SEQ ID NO: 623326 - RNA, 61 nt, Homo Sapiens
uuugguucaaauguguuuuggccuggcuugucuucugaacgaacauguugccaaaauggug

SEQ ID NO: 623327 - RNA, 61 nt, Homo Sapiens
gaaauuuacuugacacaguacucaauccauucuucugaaguaagggggauuaaagcuacac

SEQ ID NO: 623328 - RNA, 61 nt, Homo Sapiens
gcaagucucucagacucuugaaagaacucuccuucugaauggccuggcuuuuagcagccau

SEQ ID NO: 623329 - RNA, 61 nt, Homo Sapiens
cuuuuugucauguagcuauuguagcuuaauccuucugaaguaaacacuaguauaguguugu

SEQ ID NO: 623330 - RNA, 61 nt, Homo Sapiens
uggaacaccauucuucagagugucauguggucuucugaaaauugaguagagaaauuaugug

SEQ ID NO: 623331 - RNA, 61 nt, Homo Sapiens
ucuuaaaguucugaaguucucaacuuaagaacuucugaagucuucguuacuugagcuucag

SEQ ID NO: 623332 - RNA, 61 nt, Homo Sapiens
gacaguaaaccuguccauuauuuuacugguucuucugaauuugcugcuuggauagaaauau

SEQ ID NO: 623333 - RNA, 61 nt, Homo Sapiens
aaaucugucuugaaaauaugauuucaauugacuucugaaguuacuuagaacaugagcaagg

SEQ ID NO: 623334 - RNA, 61 nt, Homo Sapiens
aaaccccacuuauggguguauauuuuuuauucuucugaauugggaauagaaaaaaauuguu

SEQ ID NO: 623335 - RNA, 61 nt, Homo Sapiens
cagauaugagucaccagacagucagaaagcacuucugaaagacugauagucaguuugcugu

SEQ ID NO: 623336 - RNA, 61 nt, Homo Sapiens
ugccuuggugugagaaggaggaauccagcggcuucugaaagaaguggcacagccccagucg

SEQ ID NO: 623337 - RNA, 54 nt, Homo Sapiens
gcugcuccauguuuccaccaaguucuucugaaguggaagucugcaucaaaguaa

SEQ ID NO: 623338 - RNA, 57 nt, Homo Sapiens
agaagcugcuguggugcugacgggacccuucugaaguucgggacgcggcggcugcag

SEQ ID NO: 623339 - RNA, 61 nt, Homo Sapiens
gauauacuugucuuaagauauuaaugaaacacuucugaacacugauaggaaguguccacau

SEQ ID NO: 623340 - RNA, 62 nt, Homo Sapiens
cgggaagcuggcccaggucagguccgcaaaggcuucugaagaagaggaagggcgaguagggg

SEQ ID NO: 623341 - RNA, 62 nt, Homo Sapiens
aucaugacuucuccuuuccagaguuuuggguccuucugaauuaaugguccuuuucgaacacc

SEQ ID NO: 623342 - RNA, 62 nt, Homo Sapiens
cccccacaccuggaggcuggagccaggggccacuucugaacugcaccagcaccaggcccacc

SEQ ID NO: 623343 - RNA, 62 nt, Homo Sapiens
agacggacagcguguggcaguguuuaaaugcucuucugaaggcugauacgacagcucucugu

SEQ ID NO: 623344 - RNA, 62 nt, Homo Sapiens
uagagaguuugagccuuugcuggucacauugccuucugaagaggagggaguauuagauuaua

SEQ ID NO: 623345 - RNA, 62 nt, Homo Sapiens
uaaaaagaccaaacauuugagauugucacagccuucugaaguuacucauuauaagucaagca

SEQ ID NO: 623346 - RNA, 62 nt, Homo Sapiens
uucaucacuccuuccuaguucuacuguucaagcuucugaaauaaacaggacuugaucacaag

SEQ ID NO: 623347 - RNA, 62 nt, Homo Sapiens
gggugcugaaccucgggaacgagcuauccuagcuucugaauccagguuaggauuauacuuga

SEQ ID NO: 623348 - RNA, 62 nt, Homo Sapiens
ucuaacauguaauugcagauaacuuugacuuucuucugaauauuuuaucuuuccuuggcuuu

SEQ ID NO: 623349 - RNA, 62 nt, Homo Sapiens
caguuaauguaagaauacuuuaaaucucuaagcuucugaaguguuagagguagagauggucu

SEQ ID NO: 623350 - RNA, 62 nt, Homo Sapiens
aaaacccaagucaguuauuagauuuaaaucaccuucugaaaugcugcuauagggcugguauc

SEQ ID NO: 623351 - RNA, 62 nt, Homo Sapiens
augcauuugugcaacuucaaacauauugggugcuucugaauuccugaugauuggauuuaagc

SEQ ID NO: 623352 - RNA, 62 nt, Homo Sapiens
uccuagauguuaguguuguggauguccuuggucuucugaagauucagguccuccucuccggg

SEQ ID NO: 623353 - RNA, 62 nt, Homo Sapiens
ucuugcucugccuuugaguuguuccgugaucacuucugaauaagcaguuugccuuuauaaaa

SEQ ID NO: 623354 - RNA, 62 nt, Homo Sapiens
uauuaugauaguuuuuaagguuucaauucaaucuucugaacggcauaaguccuauuuuagcc

SEQ ID NO: 623355 - RNA, 62 nt, Homo Sapiens
cuucugggacccagaugaguucuucacuagcccuucugaaccccuugcuccauaauuggucu

SEQ ID NO: 623356 - RNA, 62 nt, Homo Sapiens
cagaggaaaaagaaaaacauuuccucuuauaacuucugaaguaauuuguaaaaaagauuugu

SEQ ID NO: 623357 - RNA, 62 nt, Homo Sapiens
gugauucguguuuguacuuuauuuuuuugugccuucugaaaggaucuaaaacaaaaauauuu

SEQ ID NO: 623358 - RNA, 62 nt, Homo Sapiens
ggcgagggaggggagguggccgucgaguugaccuucugaacaugagugucaacuccaggacu

SEQ ID NO: 623359 - RNA, 62 nt, Homo Sapiens
cuuuuuccuuaacguuugaagucaguuuaaaacuucugaagugcugucuuuuuacauuuuac

SEQ ID NO: 623360 - RNA, 62 nt, Homo Sapiens
accuuugucuaaucauuggauuuauugugucacuucugaaguuucacagaaaugaaugaauu

SEQ ID NO: 623361 - RNA, 62 nt, Homo Sapiens
gagacuaauuuuuaagaauuacaaagcucauucuucugaaucuaauaucacuaacuccuaga

SEQ ID NO: 623362 - RNA, 62 nt, Homo Sapiens
ccugagaucuaguggauaccauaaaauaacuacuucugaacuucuucuuaaacucugaguuu

SEQ ID NO: 623363 - RNA, 62 nt, Homo Sapiens
ucaaacaguaaugcaaaaguccuuguggugcccuucugaaaugacuuugaaagacucuggug

SEQ ID NO: 623364 - RNA, 62 nt, Homo Sapiens
ggaaaagucaaaguguugcuggccugucucaucuucugaagauuuguaacaaugaugacccc

SEQ ID NO: 623365 - RNA, 62 nt, Homo Sapiens
aagcaauuagcaaaucauguuccggggggucucuucugaauacuuaaccaaagaagcuguac

SEQ ID NO: 623366 - RNA, 62 nt, Homo Sapiens
uuuccgaauccucccaguugaugccuucugaccuucugaagcucccccggaacccucuacca

SEQ ID NO: 623367 - RNA, 62 nt, Homo Sapiens
agcugugggugguggggggcuuguuuucuuaacuucugaaagcagaauuguucuuuuuccug

SEQ ID NO: 623368 - RNA, 62 nt, Homo Sapiens
uggcgcugccccuggcagcccgugguccuaaucuucugaacucaucccucuggggcuguuca

SEQ ID NO: 623369 - RNA, 62 nt, Homo Sapiens
agcaaacugaauaaacuacaaaugcacacuuucuucugaauuucaauucuuugaucucaugc

SEQ ID NO: 623370 - RNA, 62 nt, Homo Sapiens
acaaaugaaugcuuauugcugcauacaauuuucuucugaauaauguuaacuauaaacacacu

SEQ ID NO: 623371 - RNA, 62 nt, Homo Sapiens
cugaaauucaguuaguuacucuuucucuuuuacuucugaauucugguccagggauccuccuc

SEQ ID NO: 623372 - RNA, 62 nt, Homo Sapiens
ucuugauuucuuauauggcaauuuuguguguucuucugaaacccaaggucuucacuguauau

SEQ ID NO: 623373 - RNA, 62 nt, Homo Sapiens
uaucagcuacugauccagccgcuccagccccacuucugaaagcugccccuuucugcccuccu

SEQ ID NO: 623374 - RNA, 62 nt, Homo Sapiens
gaugcuuucucacugucaucaaagacgugucccuucugaacuacaaaggaggcucagagaag

SEQ ID NO: 623375 - RNA, 62 nt, Homo Sapiens
caaagaggauucaguuuccauuccgaaacagccuucugaauagaagccugccaacagugacc

SEQ ID NO: 623376 - RNA, 62 nt, Homo Sapiens
uaccaccagcccuggcuggacucuguggcuuucuucugaacuugaaaucugguuuucaaggc

SEQ ID NO: 623377 - RNA, 62 nt, Homo Sapiens
gugccagcuauuucauuaggccucccagugcccuucugaaaaagccacuauucucaguuaca

SEQ ID NO: 623378 - RNA, 62 nt, Homo Sapiens
aaugacaaagcagguuaccuugaaaugacucccuucugaaugaaauggaugcauacccuucc

SEQ ID NO: 623379 - RNA, 62 nt, Homo Sapiens
ucaggccuucauuccagagccucaaggcagagcuucugaauuugccccuuccugguucuuau

SEQ ID NO: 623380 - RNA, 62 nt, Homo Sapiens
uuuuuggaaacuuagaaaaguuucuuugaacacuucugaaagauuaaaauuguucaagaaaa

SEQ ID NO: 623381 - RNA, 62 nt, Homo Sapiens
aaucuugccaagauagacaacccauuauggugcuucugaauacuggugcaaaaggauuggcc

SEQ ID NO: 623382 - RNA, 62 nt, Homo Sapiens
ccacuucacccacuccacuugcccagcugccucuucugaaaucuucucaaaauauaccucuu

SEQ ID NO: 623383 - RNA, 62 nt, Homo Sapiens
gccacaccugugcuacacuuuugacagcugcucuucugaauuggucugugcccucagaugug

SEQ ID NO: 623384 - RNA, 62 nt, Homo Sapiens
aucagagauuaaauauuguuaucucaaagugccuucugaagccaacccuaaggcccuucaag

SEQ ID NO: 623385 - RNA, 62 nt, Homo Sapiens
aguuggaccugguuaaucauuccuuaaagacucuucugaacuaguguuuuuugacaaucacu

SEQ ID NO: 623386 - RNA, 62 nt, Homo Sapiens
acaguuuaaaaacacuuuuuguuuucagagugcuucugaagucuaaccaccccuagaucuga

SEQ ID NO: 623387 - RNA, 62 nt, Homo Sapiens
aauuuguuuuaaaguaaguucacuuagauaaucuucugaaauuauauguugcuuguuuguga

SEQ ID NO: 623388 - RNA, 62 nt, Homo Sapiens
ugcagaaaacaauuucuaaaggaguguuguagcuucugaagguuccaucugaaagguuacaa

SEQ ID NO: 623389 - RNA, 62 nt, Homo Sapiens
caaaauuccucauaaggcauuguggaaugauacuucugaaauuaaauauaugaugcugaguc

SEQ ID NO: 623390 - RNA, 62 nt, Homo Sapiens
uauggucacacuauauacuagcuaauucucuucuucugaaauuagcuauccuuuuaaauuau

SEQ ID NO: 623391 - RNA, 62 nt, Homo Sapiens
cccugcagcccuuugccaagaaaaaugaaucacuucugaaguccaaacuccucuccuggauc

SEQ ID NO: 623392 - RNA, 62 nt, Homo Sapiens
cauuuccauuauagcaauguuagugccaccaccuucugaacacaguggggagggcugugaag

SEQ ID NO: 623393 - RNA, 62 nt, Homo Sapiens
gcaaggcuggcauauuaacaccugccuucuggcuucugaaagugagauuuguauaugggcug

SEQ ID NO: 623394 - RNA, 62 nt, Homo Sapiens
acucgguuugguagacuuggacaucucucuggcuucugaagagccugaagcuggccuggacc

SEQ ID NO: 623395 - RNA, 62 nt, Homo Sapiens
cauuuuuauuggaagaguauuaacuggugccucuucugaaacacaccaacccauauuccucu

SEQ ID NO: 623396 - RNA, 62 nt, Homo Sapiens
aggcugaguagccucagaaggguuuaggcgaccuucugaaacucacagaagucacgugaugg

SEQ ID NO: 623397 - RNA, 62 nt, Homo Sapiens
caccaaguccugcuacuguagaguggaaaugacuucugaauagcgguuuuaggacaggucug

SEQ ID NO: 623398 - RNA, 62 nt, Homo Sapiens
ccuuguacuugccuacuguaauauggauuucacuucugaacaguuuacagcacaauauuuau

SEQ ID NO: 623399 - RNA, 62 nt, Homo Sapiens
uuaaaaccuuugacuugagucugcugguaaagcuucugaauauugaguuugcugagaaauaa

SEQ ID NO: 623400 - RNA, 62 nt, Homo Sapiens
cuggguucaauuuaaaauaggagaggcuuucucuucugaaagauccauuuuaggucuuuuuc

SEQ ID NO: 623401 - RNA, 62 nt, Homo Sapiens
ugacuacaaagaaaagcagaugccaaaauacucuucugaaaacagcaacccagguaagacuu

SEQ ID NO: 623402 - RNA, 62 nt, Homo Sapiens
cgcuguugguaggagugaaaaccaguauaauucuucugaaaaacauuuaucagaaacuuaaa

SEQ ID NO: 623403 - RNA, 62 nt, Homo Sapiens
cugugucuacaacagggccacauauuaaauuacuucugaauggugaauucaucuuacaaaau

SEQ ID NO: 623404 - RNA, 62 nt, Homo Sapiens
uagcugaaaccuaaggcaacauuuccgaagaccuucugaagaucucagauaaagugaccagg

SEQ ID NO: 623405 - RNA, 62 nt, Homo Sapiens
ugagcauauauugcauuuaaagaaagauaaagcuucugaaauacuacugcaauugcuucccu

SEQ ID NO: 623406 - RNA, 62 nt, Homo Sapiens
auuuuugaggcaucuaauauuuacauauuugccuucugaacuuuguuuugaccuguauccuu

SEQ ID NO: 623407 - RNA, 62 nt, Homo Sapiens
auuuucucuacuuccugucugcaugcccaaggcuucugaagcagccaaugucgaugcaacaa

SEQ ID NO: 623408 - RNA, 62 nt, Homo Sapiens
uagcuacacuacaaaaacaaauuuugucuguacuucugaaaagaauuuuguuguuucucagc

SEQ ID NO: 623409 - RNA, 62 nt, Homo Sapiens
uucuccuggcaagagaaaaagacuuaacuagacuucugaacuugaacaguuucagguuauau

SEQ ID NO: 623410 - RNA, 62 nt, Homo Sapiens
caacauaaauacagcaagaaaauguguuugggcuucugaagaguugucugcuuaccuuaaca

SEQ ID NO: 623411 - RNA, 62 nt, Homo Sapiens
uuccucuuuaggguaaccaucaauauuacugccuucugaaacugucugacuauuccaggauc

SEQ ID NO: 623412 - RNA, 54 nt, Homo Sapiens; identical to SEQ ID NO: 622845

SEQ ID NO: 623413 - RNA, 62 nt, Homo Sapiens
cuaggcggagguuuccaaauauuuccauacaucuucugaaaaguuugccugggcauugaggc

SEQ ID NO: 623414 - RNA, 62 nt, Homo Sapiens
gcugguguuuuuacaacuaguacagauaccaacuucugaaaagaaaauaagcugcaauuuug

SEQ ID NO: 623415 - RNA, 62 nt, Homo Sapiens
cugaguuuugaaaauauauugaaaguaucagucuucugaauuacucaagcaaaggaauuucu

SEQ ID NO: 623416 - RNA, 62 nt, Homo Sapiens
ugaaguucagccauuuuguagucagguuuagucuucugaagauuauauuggcauguuuagau

SEQ ID NO: 623417 - RNA, 62 nt, Homo Sapiens
auauuuugagauagguuuagccauuaaaugugcuucugaaauaggaauuagcuagaauauga

SEQ ID NO: 623418 - RNA, 62 nt, Homo Sapiens
caucaaaguagaagagccccuuuaaaaauauucuucugaacuggaaauaguuuucucaacca

SEQ ID NO: 623419 - RNA, 62 nt, Homo Sapiens
uuuuccagggauaggcaggucuggauuaggagcuucugaaucgcucaucuccucccuggauu

SEQ ID NO: 623420 - RNA, 62 nt, Homo Sapiens
uauaggugauugccugaauggcucaugaagcacuucugaaaagaggggaaagaaauccaucu

SEQ ID NO: 623421 - RNA, 62 nt, Homo Sapiens
ugugucugccaagcgccuauugcugguccaugcuucugaacccagaauccaugccuguguaa

SEQ ID NO: 623422 - RNA, 62 nt, Homo Sapiens
ugagacuuucccuuuuugcuuacuuccaucuacuucugaauguucuacuguacccugauuau

SEQ ID NO: 623423 - RNA, 62 nt, Homo Sapiens
gcaccuuacuuuuuggaaacuucaauuauauacuucugaaugaguauuuuccuuuauguuaa

SEQ ID NO: 623424 - RNA, 62 nt, Homo Sapiens
cacaccccaucaauuaucuuaaaguaaucccucuucugaaucagaagucugaggcucaaaga

SEQ ID NO: 623425 - RNA, 62 nt, Homo Sapiens
aaggauuuaauuaaggccacuuacugaagugccuucugaaucugacuuugaagcacugaaag

SEQ ID NO: 623426 - RNA, 62 nt, Homo Sapiens
cagguuaaaaacuaacuuguacagauuuugcacuucugaauuauggaaauauuuuuauuuuu

SEQ ID NO: 623427 - RNA, 62 nt, Homo Sapiens
uaacucaaacuuuugaccaauuuacaggguagcuucugaaauaguuucggaguuugguaaag

SEQ ID NO: 623428 - RNA, 62 nt, Homo Sapiens
uuccugcccgggagucuguauccccuuggggacuucugaaccagaccagguucaugucuguu

SEQ ID NO: 623429 - RNA, 62 nt, Homo Sapiens
caugaguguuuucucuuucuuuaauuugugaacuucugaagguuuauauuauuaaagggcuu

SEQ ID NO: 623430 - RNA, 62 nt, Homo Sapiens
guuccccugugcuuuuaccaguagcaugaccccuucugaagccauccguagaaaguacuuug

SEQ ID NO: 623431 - RNA, 62 nt, Homo Sapiens
uagaagucauaguugaccacagacauguuauucuucugaaagagccacauuuugguuuuauu

SEQ ID NO: 623432 - RNA, 62 nt, Homo Sapiens
uaaguauuugguagcugaauaaggggucagaacuucugaaaccagagaucuguaaucaucuc

SEQ ID NO: 623433 - RNA, 62 nt, Homo Sapiens
cagaaaugcagguucccaggucccacccuggacuucugaagggguguggcaucuguguuucu

SEQ ID NO: 623434 - RNA, 62 nt, Homo Sapiens
aaaugaggacaacaggauaauaucuuugaugacuucugaaaguuaugcuucccuucauguua

SEQ ID NO: 623435 - RNA, 62 nt, Homo Sapiens
aauaaccaauauguggaaauggacacagggaucuucugaaguugcuuugaaucaaaaggcag

SEQ ID NO: 623436 - RNA, 62 nt, Homo Sapiens
uucauagguaggagggcuuagauuuuaaggcacuucugaaagucaaucccuggacaaggcag

SEQ ID NO: 623437 - RNA, 62 nt, Homo Sapiens
cuggaauccugaaagggcacuuaauuuguaaacuucugaagacugagaacuuuuuugaggcc

SEQ ID NO: 623438 - RNA, 62 nt, Homo Sapiens
cucugguuuauacauccccacucaugagcauacuucugaaggaaaacuuuacaaaaagagcc

SEQ ID NO: 623439 - RNA, 62 nt, Homo Sapiens
uuuucuugccuuauuaagacauaauuuucucccuucugaaaugagugagggaaguucauaag

SEQ ID NO: 623440 - RNA, 62 nt, Homo Sapiens
uuuaauaaugacuuaagggucaagauuuuuuucuucugaaaauuauguucugaguuaggcag

SEQ ID NO: 623441 - RNA, 62 nt, Homo Sapiens
gcaggcagugcucucuaacaggaccaucacagcuucugaacugagccggagagagagaaugg

SEQ ID NO: 623442 - RNA, 62 nt, Homo Sapiens
gucacacuacccuggucccugauugcaaggagcuucugaagcaagggugaauccuucccaca

SEQ ID NO: 623443 - RNA, 62 nt, Homo Sapiens
ggagagcagcccaaccaauccccaauccuuuucuucugaaacugagcaggaaggguaaggaa

SEQ ID NO: 623444 - RNA, 62 nt, Homo Sapiens
ugcacccuucacuggcauccucaaucauuaaccuucugaaagcucacaguacacauuaguau

SEQ ID NO: 623445 - RNA, 62 nt, Homo Sapiens
ugugaaacaauuauuuauuugcugaaagagcucuucugaacuguguccuuuuaauuuuugcu

SEQ ID NO: 623446 - RNA, 62 nt, Homo Sapiens
uugguuuggaguugagauaucagucucggaaacuucugaaaaaugcuaauaauuacccaagg

SEQ ID NO: 623447 - RNA, 62 nt, Homo Sapiens
caugaucacuugggcaguauaagaaaauguagcuucugaauauuggccaccucuaugcugca

SEQ ID NO: 623448 - RNA, 62 nt, Homo Sapiens
agcacuuaaaaaugauuaguauugcgcauauucuucugaaauagucacaauaacuuagaaac

SEQ ID NO: 623449 - RNA, 62 nt, Homo Sapiens
uuuuggagcuuguuuuugccaauauguucuaacuucugaaacagaggucagaugacauaaug

SEQ ID NO: 623450 - RNA, 62 nt, Homo Sapiens
uaaaaaguuauacaaugccauaccauuuauaacuucugaauuauuugauaauuaagcaccca

SEQ ID NO: 623451 - RNA, 62 nt, Homo Sapiens
agggcugugccuuccguuucuaagguguuuugcuucugaaagagcaaauagaagccgagugu

SEQ ID NO: 623452 - RNA, 62 nt, Homo Sapiens
ucugguuccugcccagugacuggcaccuuucccuucugaaagcaugcccuuggcguugccua

SEQ ID NO: 623453 - RNA, 62 nt, Homo Sapiens
cucuagggagaagccgguucagagcugugcuccuucugaaggaugaaaaucaaggugucagc

SEQ ID NO: 623454 - RNA, 62 nt, Homo Sapiens
gucacuggcaccauaugcaacaagcugaugaccuucugaagugauacugcggagacucuggc

SEQ ID NO: 623455 - RNA, 62 nt, Homo Sapiens
cccauucauuagaccacuugaccuccacuuugcuucugaaggugggcagagguucaacccac

SEQ ID NO: 623456 - RNA, 62 nt, Homo Sapiens
aaugaucugaaaaaaguuucgcaaggcauugacuucugaaaagcauguugcgcuuugcauca

SEQ ID NO: 623457 - RNA, 62 nt, Homo Sapiens
acugggggugucuccuaagaaguugcugucugcuucugaaucgaccuaggauuuagggcugc

SEQ ID NO: 623458 - RNA, 62 nt, Homo Sapiens
uauuuacauuuugcuaaccucagcacuuuuuccuucugaaaauacaaaucugauggcuccug

SEQ ID NO: 623459 - RNA, 62 nt, Homo Sapiens
aaugacugaaugucaagauguuguuugucacgcuucugaaccuaauaauauauaccaacaga

SEQ ID NO: 623460 - RNA, 62 nt, Homo Sapiens
gagaccguccacaucucugcgggagaauaaagcuucugaagaggugaggugugccccuccca

SEQ ID NO: 623461 - RNA, 62 nt, Homo Sapiens
cugggaggugugaacccagguuaccagcccaccuucugaagcuccagagggacauggcaaug

SEQ ID NO: 623462 - RNA, 62 nt, Homo Sapiens
uauuuuaaccagcccacccagugccauguguacuucugaaaaugcgugguuuauagacuggg

SEQ ID NO: 623463 - RNA, 62 nt, Homo Sapiens
cuccaaagggaaauuucaguggcaccugccaucuucugaaaauuuuagagcauagaagaagc

SEQ ID NO: 623464 - RNA, 62 nt, Homo Sapiens
uucauaaauguucagcuucaccugagugugggcuucugaaacaaagguaggguuugaggauu

SEQ ID NO: 623465 - RNA, 62 nt, Homo Sapiens
gaaauauuguucauuacucagcaagcacacaccuucugaauauauuugcguauuaauuaugg

SEQ ID NO: 623466 - RNA, 62 nt, Homo Sapiens
uggacuuaccugggaccugcaggagaugggggcuucugaagaccauccugggcuuuucccag

SEQ ID NO: 623467 - RNA, 62 nt, Homo Sapiens
gaacauugccucugggugucauguggaccagacuucugaauagagaauauuuauaacuuuug

SEQ ID NO: 623468 - RNA, 62 nt, Homo Sapiens
guaggauuuuguaacacgucaaccauuugaugcuucugaaaaguacuuucaacuugcgaagg

SEQ ID NO: 623469 - RNA, 62 nt, Homo Sapiens
cuuuguuagcaauaacugaccuucaguuuacccuucugaaggagcagggacucagcacagaa

SEQ ID NO: 623470 - RNA, 62 nt, Homo Sapiens
agucucuccagauagcacuacgauguauuccgcuucugaacaggaucccaugccagugugga

SEQ ID NO: 623471 - RNA, 62 nt, Homo Sapiens
uugaaaugaagagaaauagccagcaggugauucuucugaauccuuuagugugaugguuuccc

SEQ ID NO: 623472 - RNA, 62 nt, Homo Sapiens
guguuuagauuguauuaacuaucuucuuuggacuucugaagagaccacucaauccauccaug

SEQ ID NO: 623473 - RNA, 62 nt, Homo Sapiens
agucuuuugguaauaguggcagguauuuauuccuucugaauauauaccccauuauaggaaua

SEQ ID NO: 623474 - RNA, 62 nt, Homo Sapiens
acuuccuaagaaaaggaaucuugcccuugaaucuucugaaguaccuagcacagugucuucaa

SEQ ID NO: 623475 - RNA, 62 nt, Homo Sapiens
caauguuugugaaacaccuuuggagaggugcacuucugaaugcugccucugccguaaauccu

SEQ ID NO: 623476 - RNA, 62 nt, Homo Sapiens
aauagaagcuuuuuuuuuuaaaaaauguauugcuucugaacuuuuuucugccacugcucccu

SEQ ID NO: 623477 - RNA, 62 nt, Homo Sapiens
uuuuguucaaacauaauaccaucuuuuugcuucuucugaacuuuagaucuccauaacacaug

SEQ ID NO: 623478 - RNA, 62 nt, Homo Sapiens
gugcuuaaacuuuuuucagucagggugaugaucuucugaagcucuuggaugucauuugaucg

SEQ ID NO: 623479 - RNA, 62 nt, Homo Sapiens
guagacucuauaguacccucucuauucacuagcuucugaaaagggaggaguauuuuuaguuu

SEQ ID NO: 623480 - RNA, 62 nt, Homo Sapiens
ugagaaaacuccgaagaggugugagcaggauucuucugaaugacugucuggaugguucauua

SEQ ID NO: 623481 - RNA, 62 nt, Homo Sapiens
ucuugaaacaucccagguccccucuccuaggucuucugaaugagaauuugcagaugcaagcu

SEQ ID NO: 623482 - RNA, 62 nt, Homo Sapiens
cuuuagacaguaacaguuugucuguacacguucuucugaaagacccucgucucugcagggug

SEQ ID NO: 623483 - RNA, 62 nt, Homo Sapiens
ggcccuccuguggacuagcaccuuugccauuucuucugaaccgauucauggacacuagacuc

SEQ ID NO: 623484 - RNA, 62 nt, Homo Sapiens
auaagcauuuaucaauugauaugucaguauuccuucugaacauugcacuaucuuuauuuugu

SEQ ID NO: 623485 - RNA, 62 nt, Homo Sapiens
ugccaccaugccaaagcuaugauuuacugaagcuucugaacauagagaugucauagccugaa

SEQ ID NO: 623486 - RNA, 62 nt, Homo Sapiens
acuguagaauuggaacuagauaguuagacgugcuucugaauguccacuguccucugucaauc

SEQ ID NO: 623487 - RNA, 62 nt, Homo Sapiens
acguucuauguaaaagaaaaaaauagcuuuuccuucugaaccuacuuaaaagugcuugauau

SEQ ID NO: 623488 - RNA, 62 nt, Homo Sapiens
aaauccuugcuaaauguacuacauuuuguuuucuucugaaaaauggaauacaaaauguacug

SEQ ID NO: 623489 - RNA, 62 nt, Homo Sapiens
uacuucccuaagucacuuucggaacacauuuccuucugaacuaagauaauaugagggagaag

SEQ ID NO: 623490 - RNA, 62 nt, Homo Sapiens
auauuucaaaauauguguguauauuuauacaucuucugaaauauuauauuuguauguaaauu

SEQ ID NO: 623491 - RNA, 62 nt, Homo Sapiens
gucugagacagaucuacaaauuugauacuauccuucugaaaaguuacuugguuuaaaucaca

SEQ ID NO: 623492 - RNA, 62 nt, Homo Sapiens
cauuguaaagaaauaaaaauucuuuguaaucucuucugaaauauucuuuaaguauauuaauc

SEQ ID NO: 623493 - RNA, 62 nt, Homo Sapiens
gaacauaauuauaucuagguuaaaaaacuuuacuucugaaagcauauuguuuuuacuauguu

SEQ ID NO: 623494 - RNA, 62 nt, Homo Sapiens
uguuuaaaaauuggaaggaaguuugaucucagcuucugaaaaccugcauuuuauugacuggg

SEQ ID NO: 623495 - RNA, 62 nt, Homo Sapiens
uguaccuuuauaaaucaauuucaugcuguuaccuucugaaacugccuauaggaagacuaguc

SEQ ID NO: 623496 - RNA, 62 nt, Homo Sapiens
uauuaaagcuaaaacugcacgcagcauuucuacuucugaaguuuaaacuuaaauaagugugu

SEQ ID NO: 623497 - RNA, 62 nt, Homo Sapiens
ccucgucugugugcaucucacgcccgacguggcuucugaaacgugcauucaaccucaaacuu

SEQ ID NO: 623498 - RNA, 62 nt, Homo Sapiens
aaaauauuguuuauacaguuuguauaggcugacuucugaauaauugguaucuauuauuuuca

SEQ ID NO: 623499 - RNA, 62 nt, Homo Sapiens
aaaagccauauaugggggacaugcuaaaauggcuucugaaugaaauacgacagcagagaaag

SEQ ID NO: 623500 - RNA, 62 nt, Homo Sapiens
cuccugaccucagaugaucuaccagccucggccuucugaagugcugggauucaggugugagc

SEQ ID NO: 623501 - RNA, 60 nt, Homo Sapiens; identical to SEQ ID NO: 622934

SEQ ID NO: 623502 - RNA, 55 nt, Homo Sapiens; identical to SEQ ID NO: 622935

SEQ ID NO: 623503 - RNA, 62 nt, Homo Sapiens
agaaguacaaaaagccuuuagccuugaggugccuucugaaauuaaccaaauuucauccauau

SEQ ID NO: 623504 - RNA, 62 nt, Homo Sapiens
cacagagccucgggacaucaaaaacagcagaacuucugaaaccucugggucaucucucacac

SEQ ID NO: 623505 - RNA, 62 nt, Homo Sapiens
uagaagcaaaaaacgaaagaguucuguucagacuucugaagagcagccuguggcuacaaauc

SEQ ID NO: 623506 - RNA, 62 nt, Homo Sapiens
ucuagcugagauuagugguggauuuucucccacuucugaaauguucauuuauacugguugca

SEQ ID NO: 623507 - RNA, 62 nt, Homo Sapiens
uuuuucuucgacaaaaaaauaauaaaacguuucuucugaaaagcugaacguuucuguauaag

SEQ ID NO: 623508 - RNA, 62 nt, Homo Sapiens
gaggccuuaaugaucaaaucucacccuuucugcuucugaaguaugaaaaucuagucuuuuua

SEQ ID NO: 623509 - RNA, 62 nt, Homo Sapiens
gauuuuucuaccacccuguuacaucauaacaacuucugaaacacacaccagcccugaguucu

SEQ ID NO: 623510 - RNA, 62 nt, Homo Sapiens
aggaaucuagccgggaguagcagaggcccugucuucugaagucucaggcuuagaaguuacca

SEQ ID NO: 623511 - RNA, 62 nt, Homo Sapiens
gcuuccaccagcauccugagaagaaaugauuacuucugaaaaacauccuuuuuuccagccuc

SEQ ID NO: 623512 - RNA, 62 nt, Homo Sapiens
uggacuccugggaacauggaccggagagggggcuucugaacuaccgcgaagccgccaaccca

SEQ ID NO: 623513 - RNA, 62 nt, Homo Sapiens
accaggacugcuuucuuugggaucauaggagccuucugaauguaaugacugcagacuggugg

SEQ ID NO: 623514 - RNA, 62 nt, Homo Sapiens
caggaugaauuuucugcagcgucacugcauggcuucugaaagcugccaagagagauguaugu

SEQ ID NO: 623515 - RNA, 62 nt, Homo Sapiens
uuuucuauaccugucuccuuccucuguuucuccuucugaaaggugcugcaugccuggucuuu

SEQ ID NO: 623516 - RNA, 62 nt, Homo Sapiens
agaaggugccugaucuuccuucagucucggcucuucugaaauucugccaucucgcuaaauca

SEQ ID NO: 623517 - RNA, 62 nt, Homo Sapiens
uuuguccaccucugauuacacaguuuaaggaacuucugaagacccaaucuucuuuuuuaaac

SEQ ID NO: 623518 - RNA, 62 nt, Homo Sapiens
uccaguuggacagucugggauaaagcugcuuucuucugaaggcauggggacccugagacuac

SEQ ID NO: 623519 - RNA, 62 nt, Homo Sapiens
uucaguuuuggagcaaguccccuaucaugcugcuucugaaaacagaguugaauaucucuuuc

SEQ ID NO: 623520 - RNA, 62 nt, Homo Sapiens
uaucucuuaauccucuuaagcagguagugcugcuucugaaguuuaaaugccaaauaaucuuc

SEQ ID NO: 623521 - RNA, 62 nt, Homo Sapiens
aaaauuuggauuuccuuuuacagugaugaugacuucugaaacguaauugguuugggaggggg

SEQ ID NO: 623522 - RNA, 62 nt, Homo Sapiens
ucuuuaguggguuuuaaauaguuuuucugacccuucugaaaaauaacuacauaagugcuucu

SEQ ID NO: 623523 - RNA, 62 nt, Homo Sapiens
guauuuauucacuuccccauuacgauguaaaucuucugaacugccuuuuuuuuaaaaagaag

SEQ ID NO: 623524 - RNA, 62 nt, Homo Sapiens
acuagaccuguaaaacuucacugcaguggccacuucugaaucucuguaagguuuauuuaucu

SEQ ID NO: 623525 - RNA, 62 nt, Homo Sapiens
auuguauaauggggccuguuacacaugacacucuucugaauugacuguauuucagugagcug

SEQ ID NO: 623526 - RNA, 62 nt, Homo Sapiens
caguaccugguugaguggggaggagggggcaucuucugaacagccugccucugcccagcucc

SEQ ID NO: 623527 - RNA, 62 nt, Homo Sapiens
uaagaaacagcugagaggcacuauggauuagucuucugaagugaaggaaauauagaugucac

SEQ ID NO: 623528 - RNA, 62 nt, Homo Sapiens
ccagcuccucacagaggccugguuugcucagucuucugaacuccagggaccagcccuggugg

SEQ ID NO: 623529 - RNA, 62 nt, Homo Sapiens
caccucggucucgucaguaaggacuucacuuucuucugaacuggggcuugugaaagcuggcc

SEQ ID NO: 623530 - RNA, 62 nt, Homo Sapiens
gauuuuaaccugugucuuacuuccucagcugccuucugaaccuacuugucaaggugaauuua

SEQ ID NO: 623531 - RNA, 62 nt, Homo Sapiens
agauaaaggccuuaacuuuaaacaucuuucaucuucugaaagcugcccaacuuaaauccuca

SEQ ID NO: 623532 - RNA, 62 nt, Homo Sapiens
guuaucaaucugaucugcagccagguuauuuacuucugaagcauuggaguuaucgauugcca

SEQ ID NO: 623533 - RNA, 62 nt, Homo Sapiens
ccuggaacuggaguuggcaauaccuaguucugcuucugaaacuggaguaucauucuuuacau

SEQ ID NO: 623534 - RNA, 62 nt, Homo Sapiens
ucaaauuagugccucggaaaucagcccucccacuucugaaguuaaauaacuugccuuacaua

SEQ ID NO: 623535 - RNA, 62 nt, Homo Sapiens
acaauauuaaagagacuuagagugugugugaacuucugaaagcuuguucugaucugugugug

SEQ ID NO: 623536 - RNA, 62 nt, Homo Sapiens
gaauguggauacagcgccacuggaaucuucaacuucugaaguuccccacuuauucuccucuu

SEQ ID NO: 623537 - RNA, 62 nt, Homo Sapiens
ucccagugucuucagguuucgauccccuuggccuucugaauauugcccaacaggauaagcug

SEQ ID NO: 623538 - RNA, 62 nt, Homo Sapiens
acuccacuguacacuuauagcauaucauguagcuucugaaaaugggaaccauggugucaaua

SEQ ID NO: 623539 - RNA, 62 nt, Homo Sapiens
aacuguguaaaaacaguaguuuaacuuuuaaacuucugaauacaggggaaaaugcccacauu

SEQ ID NO: 623540 - RNA, 62 nt, Homo Sapiens
ccccuccucaauuucuuggccaggggguggggcuucugaagacugugugccugggaggcugc

SEQ ID NO: 623541 - RNA, 62 nt, Homo Sapiens
aggaugugcacacaugggccucuggccccccucuucugaaacguccugcuggccccuuuucc

SEQ ID NO: 623542 - RNA, 62 nt, Homo Sapiens
uuggacauuuuaaacacuuaaacaccugacaacuucugaauagggaguggggaggugguaag

SEQ ID NO: 623543 - RNA, 62 nt, Homo Sapiens
gcacaaggccaagaacuccuugccugucggcacuucugaaagcugcguaaguaccuccuuga

SEQ ID NO: 623544 - RNA, 62 nt, Homo Sapiens
aaaaaauguugcuuuuuaaauuaagcaagacccuucugaaauagaagaauucagaaaaccac

SEQ ID NO: 623545 - RNA, 62 nt, Homo Sapiens
aagacaugucaauauucuuuuuuauaguuauucuucugaacugcauaaaagcaaaucaacac

SEQ ID NO: 623546 - RNA, 62 nt, Homo Sapiens
aacucuguauuguagauuauuuaagucaacugcuucugaaauuuguuuuuuuucucaacuag

SEQ ID NO: 623547 - RNA, 62 nt, Homo Sapiens
aucuaacaaaggaaaauauaauagaauuguuucuucugaauacaaaaacuuauuaagguuaa

SEQ ID NO: 623548 - RNA, 62 nt, Homo Sapiens
guugccuucagaacuaguuuuguugggaacgccuucugaacagcugugcauugcucaaaagc

SEQ ID NO: 623549 - RNA, 62 nt, Homo Sapiens
uucaauuuuuuucauugaagucucaggaauuucuucugaaugggcccaugucacaaacccua

SEQ ID NO: 623550 - RNA, 62 nt, Homo Sapiens
cuacuagcagcaccagccuugaaauuuguguucuucugaaugcauuguaauguaaggggcaa

SEQ ID NO: 623551 - RNA, 62 nt, Homo Sapiens
cagacccuuggcuucacacaaauguuucuguucuucugaaaauuuuacaguuuugauugggu

SEQ ID NO: 623552 - RNA, 62 nt, Homo Sapiens
uggauagugccagaacacuuuggccucaacaccuucugaacgagcuuucuccagagaccuaa

SEQ ID NO: 623553 - RNA, 56 nt, Homo Sapiens; identical to SEQ ID NO: 622986

SEQ ID NO: 623554 - RNA, 62 nt, Homo Sapiens
gucucaauggcuucaggcuaauugcuacaaaucuucugaaggauuuuuccuuaacgcuagag

SEQ ID NO: 623555 - RNA, 62 nt, Homo Sapiens
uugccaucuucccuccgugguuuucuugugggcuucugaaagaauuaacacuauguguucag

SEQ ID NO: 623556 - RNA, 62 nt, Homo Sapiens
cuaagaaugccaaagggaccguacagacuuagcuucugaacuuuuuucagucaucccaguuu

SEQ ID NO: 623557 - RNA, 62 nt, Homo Sapiens
auucuuguucagauuaagaguugccaaaauaccuucugaacuacacugcauuguugugccga

SEQ ID NO: 623558 - RNA, 62 nt, Homo Sapiens
auuuuuaugguguagauugaaauaauaguacacuucugaauuuuuauauaaaaugugguugg

SEQ ID NO: 623559 - RNA, 62 nt, Homo Sapiens
ggugugagccacugcacccagccuacuucacucuucugaauuauucugauuuauuuucaaca

SEQ ID NO: 623560 - RNA, 62 nt, Homo Sapiens
aacagucucugauuucaacacuaacauuccaucuucugaaauucugagauucuaacauccuu

SEQ ID NO: 623561 - RNA, 62 nt, Homo Sapiens
gggcauaagccuuuuauggcccucuugcagaucuucugaacuaugcacauuugugcuuuuuu

SEQ ID NO: 623562 - RNA, 62 nt, Homo Sapiens
auguaggcuuuauuuuaagcaguaauggguuacuucugaaacaucacuuguuugcuuaauuc

SEQ ID NO: 623563 - RNA, 62 nt, Homo Sapiens
auuugagauuguaggccaacuguauuuucaagcuucugaacuuaggcaaaauauucaucgca

SEQ ID NO: 623564 - RNA, 62 nt, Homo Sapiens
gggcccucugcagcccauccuuuccuuccguccuucugaaaccacauaccccaggcccaagc

SEQ ID NO: 623565 - RNA, 62 nt, Homo Sapiens
ccaaggcagucgccagggcuucuuguccccaccuucugaaccuucuucaaacaguaguacaa

SEQ ID NO: 623566 - RNA, 62 nt, Homo Sapiens
acaaaagugguagggaaauuguucccucuccacuucugaaaguaugaugauguauuaaggau

SEQ ID NO: 623567 - RNA, 62 nt, Homo Sapiens
uuuaaucaugaauggaaaucggaaguaguaugcuucugaaacucuuuccagggaaacaucuc

SEQ ID NO: 623568 - RNA, 62 nt, Homo Sapiens
acuucuaguuuaauaauacauacaugauuuuucuucugaaugucucuucucccugcaucacu

SEQ ID NO: 623569 - RNA, 62 nt, Homo Sapiens
gggagggggaagugucugccuuuauguccuuucuucugaaauaaaaguaaaagcauuucugg

SEQ ID NO: 623570 - RNA, 62 nt, Homo Sapiens
cugccuaaagauagaauggcuucucuguuuuucuucugaaauacaaccagaaacaauguguc

SEQ ID NO: 623571 - RNA, 62 nt, Homo Sapiens
auugaaguauuuugcuggaauaaguucaaauucuucugaacucaaacugaggaauuucaccu

SEQ ID NO: 623572 - RNA, 62 nt, Homo Sapiens
cauagccagucaagcauagaauugcauccauucuucugaaauagguacugugccuaauuuuu

SEQ ID NO: 623573 - RNA, 62 nt, Homo Sapiens
auugaaauggcugcagauagaucccgcagucccuucugaaaggaacuguguagccagcaggg

SEQ ID NO: 623574 - RNA, 62 nt, Homo Sapiens
ggcacaaaccuguguuuauauccugugcuugccuucugaaguagauaacauuaguguauuuc

SEQ ID NO: 623575 - RNA, 62 nt, Homo Sapiens
acugcauggaugucccaggacaugcugguggccuucugaaucuuccgagauucagacauagc

SEQ ID NO: 623576 - RNA, 62 nt, Homo Sapiens
cacacugaugacaucaguuguacccuuuauuucuucugaaaugagggaaagggagaauggug

SEQ ID NO: 623577 - RNA, 62 nt, Homo Sapiens
ugcugcagcucccuccucaggagaacaucccgcuucugaagcggaucguguugguauuuuca

SEQ ID NO: 623578 - RNA, 62 nt, Homo Sapiens
aucauaggaagaguagacaugaaacauaaauucuucugaagaaacugcuagcaaaaucugag

SEQ ID NO: 623579 - RNA, 62 nt, Homo Sapiens
auauugcuaccauuguauaauaucucccggcacuucugaaauggcaaaguauccaucuuguc

SEQ ID NO: 623580 - RNA, 62 nt, Homo Sapiens
ucaugcccacagaagucaucggaccaaccagucuucugaaggcaaggaucuuccaaaacaga

SEQ ID NO: 623581 - RNA, 62 nt, Homo Sapiens
aucucagaggacuggcauugagagacguacaacuucugaaaggugagaauggaaaacgcaga

SEQ ID NO: 623582 - RNA, 62 nt, Homo Sapiens
gcccacugaaaauugccugucauggcaaccagcuucugaaaagaauaaauugugcucuuugu

SEQ ID NO: 623583 - RNA, 62 nt, Homo Sapiens
agccccaucauuuggugaacuaaaauguuucucuucugaacauauucaacuugcacugacca

SEQ ID NO: 623584 - RNA, 62 nt, Homo Sapiens
augcugaauuagaagugaaccaguaaugggcucuucugaaggcauugacagcuuucuagagc

SEQ ID NO: 623585 - RNA, 62 nt, Homo Sapiens
uccugcagaaauauaacugugccuucuaaaaccuucugaauggaccacaagauugucugaag

SEQ ID NO: 623586 - RNA, 62 nt, Homo Sapiens
uaaguuuugagaaauacgagggcagacagugucuucugaaugcucuaaagauuucaaauagu

SEQ ID NO: 623587 - RNA, 62 nt, Homo Sapiens
ucuuauuauacauguuaacaguuccuuucucucuucugaaauauugucugaauauuucuucu

SEQ ID NO: 623588 - RNA, 62 nt, Homo Sapiens
aggcucagguccagcugguuccucucuggcgccuucugaacccgucucagcagguccacagc

SEQ ID NO: 623589 - RNA, 62 nt, Homo Sapiens
caguguugcaagcuggcuggauccaaccaucucuucugaaauaaugcauccaaaggguugau

SEQ ID NO: 623590 - RNA, 62 nt, Homo Sapiens
ccgccacgaccccccuggacgucuguaagacccuucugaacacucaggagaacguggcccuc

SEQ ID NO: 623591 - RNA, 62 nt, Homo Sapiens
auucuguuuuguggaucucuuuccuagauuagcuucugaaaucauuauuagcuauaucauuu

SEQ ID NO: 623592 - RNA, 62 nt, Homo Sapiens
acaauccacuguuagaauaccuaugguuagggcuucugaacuaaaauaauggaaaauuuuaa

SEQ ID NO: 623593 - RNA, 62 nt, Homo Sapiens
ccugucgaugagacuguuuauuaccagauucacuucugaauuggccagaggaaaucugaaug

SEQ ID NO: 623594 - RNA, 62 nt, Homo Sapiens
acucagccuaauuaaaggaugaauggugcuuucuucugaaagcgguucccuucaauaacaau

SEQ ID NO: 623595 - RNA, 62 nt, Homo Sapiens
uugcugucugucaugagugcucuucccugaggcuucugaagggcgcaugggcugagaacacc

SEQ ID NO: 623596 - RNA, 62 nt, Homo Sapiens
uugcauuuuauuaccauuucaucaccaagaugcuucugaaaaaaauuaagcaguucuacucg

SEQ ID NO: 623597 - RNA, 62 nt, Homo Sapiens
agagaccggacaagagccugucucucuggacccuucugaagcucacuuucuccugguguuuu

SEQ ID NO: 623598 - RNA, 62 nt, Homo Sapiens
gaaacaaauaaucacauugaggacccauagaucuucugaaaugacacguguggcgggcagug

SEQ ID NO: 623599 - RNA, 62 nt, Homo Sapiens
caucucuacaggcucaaaacugaaagcuccgucuucugaauuucauggcccagggaggcggg

SEQ ID NO: 623600 - RNA, 62 nt, Homo Sapiens
uguauagacucugcuguggaauuuuacugugacuucugaagcuccacugaaucuacacacag

SEQ ID NO: 623601 - RNA, 62 nt, Homo Sapiens
cccuggauacgcagaccgaggcuacacaaaugcuucugaauggugcccuucuuuccaaaaca

SEQ ID NO: 623602 - RNA, 62 nt, Homo Sapiens
uguuuugucuuccuaaucuauauucucugcuacuucugaaucuuuuccaagaaaaugugcag

SEQ ID NO: 623603 - RNA, 62 nt, Homo Sapiens
acuuacuuguaauauauaauaauuaauauucacuucugaaggauuuuaugguucucuuaagg

SEQ ID NO: 623604 - RNA, 62 nt, Homo Sapiens
cugagcccauuucuggggggaauguuauuuuccuucugaagugauucuucuuaaaaguuucu

SEQ ID NO: 623605 - RNA, 62 nt, Homo Sapiens
cuguauaguacacugguuuggcauuguuucugcuucugaaauaaacuugagcaggcuguuca

SEQ ID NO: 623606 - RNA, 62 nt, Homo Sapiens
aaaaaaagagugaagauaguagagaacauuggcuucugaaaauggaaugaagcugcagauuu

SEQ ID NO: 623607 - RNA, 62 nt, Homo Sapiens
gaaauugguguauuagacuauuuaucuuugaucuucugaauggauugcugucauggacacgg

SEQ ID NO: 623608 - RNA, 62 nt, Homo Sapiens
cucaucgacgccugugacagggagaaaggauacuucugaacaaggagccuccaagcaaauca

SEQ ID NO: 623609 - RNA, 62 nt, Homo Sapiens
guuggauuagcuuaaucaccaaguccugucaacuucugaaaugaaucucaaauuucuucccu

SEQ ID NO: 623610 - RNA, 62 nt, Homo Sapiens
acugaaaugaaaucccauuggauuguacuucucuucugaaaagugugcuuuuugacccuacu

SEQ ID NO: 623611 - RNA, 62 nt, Homo Sapiens
gaggcucaacuucucuuccaaaaaucuucuggcuucugaacucuuccucugccucucuuuaa

SEQ ID NO: 623612 - RNA, 62 nt, Homo Sapiens
uaguggaguggccauaggcaaguuacuuaacacuucugaaccuccuuuugucuuucauaaaa

SEQ ID NO: 623613 - RNA, 62 nt, Homo Sapiens
uguaucuucagacucacagagugaauucagcucuucugaaucaagacccacccagucucuuu

SEQ ID NO: 623614 - RNA, 62 nt, Homo Sapiens
auuuuggcagguuucugugccuuuauuucccucuucugaaaaaaagucuguguuuucauagu

SEQ ID NO: 623615 - RNA, 62 nt, Homo Sapiens
gagccugggguuccccuggcauuggccccagccuucugaaagccggcgcugcagccagaggc

SEQ ID NO: 623616 - RNA, 62 nt, Homo Sapiens
ccguagcccacgcccucucuggguggcagggccuucugaaggaaacuugcaggcgagcccaa

SEQ ID NO: 623617 - RNA, 60 nt, Homo Sapiens
cacagaauuaaacguguugccacaccugccggcuucugaacucuguccuuggcuuccugc

SEQ ID NO: 623618 - RNA, 62 nt, Homo Sapiens
acuguucuaauaaaugaucuaugucucaauggcuucugaaugaccuuccuuucugcugccug

SEQ ID NO: 623619 - RNA, 62 nt, Homo Sapiens
uaaguugcagacaucaugaauuauucuugaaccuucugaaaacucacuguaaauacacauuc

SEQ ID NO: 623620 - RNA, 62 nt, Homo Sapiens
agguccagggagggauuuagcauuugaacugccuucugaaagucugccuucuaccuacagug

SEQ ID NO: 623621 - RNA, 62 nt, Homo Sapiens
gugacccccaaguccuauccagaauuauuugccuucugaaaugacauguagcuucuucugaa

SEQ ID NO: 623622 - RNA, 62 nt, Homo Sapiens
aauuauuugccuucugaaaugacauguagcuucuucugaaagauacuacccauagaaaacuu

SEQ ID NO: 623623 - RNA, 62 nt, Homo Sapiens
gggaguuccugagauacaacgaagacaaggggcuucugaaauucugcugccuguuggggucg

SEQ ID NO: 623624 - RNA, 62 nt, Homo Sapiens
gcagcuguuaguuuacucuuccagguccaccccuucugaaaauugguucccugacaagggua

SEQ ID NO: 623625 - RNA, 62 nt, Homo Sapiens
aacugccucugcacacacauagaggcaaggagcuucugaagauggcucgagcagccuuggga

SEQ ID NO: 623626 - RNA, 62 nt, Homo Sapiens
uagaaacaaucuauaguuauuugaaaggaccucuucugaagcacacaacauuuuaauacaga

SEQ ID NO: 623627 - RNA, 62 nt, Homo Sapiens
cuuagaauggccucuuuguauucuaucagugacuucugaaucauguuauuuggaauuuuaag

SEQ ID NO: 623628 - RNA, 62 nt, Homo Sapiens
uaggaaguuggagcucuugcugauccccaucccuucugaaaguuaugugacaacccucaucu

SEQ ID NO: 623629 - RNA, 62 nt, Homo Sapiens
uuuggacagguuagaguuggugugccaugacucuucugaaugagcagcgaugguauucgauc

SEQ ID NO: 623630 - RNA, 62 nt, Homo Sapiens
gcggggccaauaaugaugccccucugucucugcuucugaacacauggcuccgccucucugag

SEQ ID NO: 623631 - RNA, 62 nt, Homo Sapiens
ucaccaaacugaggccagagauugcugggagucuucugaaccucauccaagaaauacuuuuu

SEQ ID NO: 623632 - RNA, 62 nt, Homo Sapiens
cucaaaugaguggaggccucgggucccugaaucuucugaaaucucccccucccuaagcucca

SEQ ID NO: 623633 - RNA, 62 nt, Homo Sapiens
cauauguagagauuucagccugcuccuguuaccuucugaaucagugcguucuggggcugugc

SEQ ID NO: 623634 - RNA, 62 nt, Homo Sapiens
cauuccuuguccgccaacccaccgugauucaucuucugaagcugggagugaaacugggucag

SEQ ID NO: 623635 - RNA, 62 nt, Homo Sapiens
cuuguaagaaauguuugucauaugcgugaugucuucugaaauauucuuauaaccuuaaugac

SEQ ID NO: 623636 - RNA, 62 nt, Homo Sapiens
guccauuuauccuauuuugaucuuuuucaagucuucugaaaggaaguagacaguauuacacc

SEQ ID NO: 623637 - RNA, 62 nt, Homo Sapiens
aauguuuuucauuucccguguguuuccauuuccuucugaaauucugauuuuauccauuuuuu

SEQ ID NO: 623638 - RNA, 62 nt, Homo Sapiens
aaugaccucugcaaacagaaucuuggauauuucuucugaaggauuauuugcacagacuuaaa

SEQ ID NO: 623639 - RNA, 62 nt, Homo Sapiens
auccauuguccacacacacacaaccagauaaucuucugaaaguguaacucagaugaugccuc

SEQ ID NO: 623640 - RNA, 62 nt, Homo Sapiens
gcccugcucucuccuguugcucugggauugcacuucugaaugaaguagcagcucauaagcuu

SEQ ID NO: 623641 - RNA, 62 nt, Homo Sapiens
aagccaaucucucauuuagaccuggcuucuuucuucugaacaaaguaggguucaaaaugcag

SEQ ID NO: 623642 - RNA, 62 nt, Homo Sapiens
aaguuagugaguggaguugcccaagucuggggcuucugaaaugaccugguauuuuuauguuc

SEQ ID NO: 623643 - RNA, 57 nt, Homo Sapiens; identical to SEQ ID NO: 623076

SEQ ID NO: 623644 - RNA, 62 nt, Homo Sapiens
cacgagccgugaguaggcagucgaccccuuggcuucugaagaggaggacacugcuaaggguc

SEQ ID NO: 623645 - RNA, 62 nt, Homo Sapiens
agacuuucuucucauccaguaaccaccuuauucuucugaaaagcacugagaaaaagaaugag

SEQ ID NO: 623646 - RNA, 62 nt, Homo Sapiens
aucagauuaaauuaugcuucaucuugaggugccuucugaaucgaggaaaacggcacaacaca

SEQ ID NO: 623647 - RNA, 62 nt, Homo Sapiens
aagagucguucccucuguuuuguuuuaguugucuucugaaaaccuuuuuugucuuguuuuuc

SEQ ID NO: 623648 - RNA, 62 nt, Homo Sapiens
guaauaccaaaugccuaaaauuguagaccgaacuucugaagaagauguuuuuaaaguuucuu

SEQ ID NO: 623649 - RNA, 62 nt, Homo Sapiens
aaaucacugugacucaaggagccaacguaauacuucugaaccuugacuaaaacaucucuggu

SEQ ID NO: 623650 - RNA, 62 nt, Homo Sapiens
uaauaaaaaauuuuaggagagcaauaguauugcuucugaaagagugugguuguugauaccuu

SEQ ID NO: 623651 - RNA, 62 nt, Homo Sapiens
acucuuguugcgaucgcuaaauaccacauucacuucugaaaccuaucuucacaggugugauc

SEQ ID NO: 623652 - RNA, 62 nt, Homo Sapiens
aaacagcaccagcacagcauguauuuucuucucuucugaaaguucuggcuuguagaccccuc

SEQ ID NO: 623653 - RNA, 62 nt, Homo Sapiens
cuguuuguuuacucuuucuuugaaaacaucaccuucugaaauuugucuuuuagcucucucag

SEQ ID NO: 623654 - RNA, 62 nt, Homo Sapiens
gcaggccuaugaagugcauagggaguguaugucuucugaaugguuuuauuguucuuguaauc

SEQ ID NO: 623655 - RNA, 62 nt, Homo Sapiens
aggaguauguacaauucuucugggaagccagccuucugaacuuuuugguacuaaauccuuau

SEQ ID NO: 623656 - RNA, 62 nt, Homo Sapiens
augcugcugagugacugcaugaugagauacaacuucugaaugcugcacauucuuccaaaaug

SEQ ID NO: 623657 - RNA, 62 nt, Homo Sapiens
cuggucucccagcaccuggcccagguaacagccuucugaaagcagagccaaggagcugcuuc

SEQ ID NO: 623658 - RNA, 62 nt, Homo Sapiens
cauucuuguuaacuauaugugaaacauuuuuucuucugaagauucuuaaaaauugaaugugg

SEQ ID NO: 623659 - RNA, 62 nt, Homo Sapiens
aagaaaacugcucuguuuccccuuuaguaacacuucugaagaggaaaaacuucaauagccaa

SEQ ID NO: 623660 - RNA, 62 nt, Homo Sapiens
uuccauuuuggaaaaugauuaggcccgccaaacuucugaacuuuggaagcuggggauguuua

SEQ ID NO: 623661 - RNA, 62 nt, Homo Sapiens
agcaagggccuaagagaaaagccagccaagugcuucugaauaaagaucccucucugggucuc

SEQ ID NO: 623662 - RNA, 62 nt, Homo Sapiens
gaagccaggcugagugagccacagaccaccugcuucugaacucaagcugcguuuauuaaugc

SEQ ID NO: 623663 - RNA, 62 nt, Homo Sapiens
uuucuaaauccuaggaagaaacgcuuggagugcuucugaauauacagaaguuccauuuaagg

SEQ ID NO: 623664 - RNA, 62 nt, Homo Sapiens
cauaaaagcagauaccuuuaaguuuguguagacuucugaauaagaugauagacgagaauuuu

SEQ ID NO: 623665 - RNA, 62 nt, Homo Sapiens
aaauguuacaauuauacuagacaagaguauuucuucugaaaaaauauaagucuccagagcac

SEQ ID NO: 623666 - RNA, 62 nt, Homo Sapiens
ugcugaucauuugaggaauauccucuguccugcuucugaaugcccagagaugucaucagagc

SEQ ID NO: 623667 - RNA, 62 nt, Homo Sapiens
ccaacguggaggaaagggaggcucgggccacucuucugaaggccagggccagauaaggaaca

SEQ ID NO: 623668 - RNA, 62 nt, Homo Sapiens
cauuuguuauugaaggaaagaugcuccugaaccuucugaacgauuuugagaaaaacuaaauc

SEQ ID NO: 623669 - RNA, 62 nt, Homo Sapiens
acaaaacaaaugugcuaugcaauaaggguuggcuucugaacuucuuguacacauuuuaauaa

SEQ ID NO: 623670 - RNA, 62 nt, Homo Sapiens
uuagaauuggaauuacuucccaacuggcagaacuucugaagugcccaaggaaggccacuucu

SEQ ID NO: 623671 - RNA, 62 nt, Homo Sapiens
gguuuaauagagaaaugcuguaaucaugcagucuucugaaaaaaaaaaaagucacuuuuggc

SEQ ID NO: 623672 - RNA, 62 nt, Homo Sapiens
cagaaacuaucccagaucucggcuggugaacacuucugaauuccagcuaauacaugcaaugu

SEQ ID NO: 623673 - RNA, 62 nt, Homo Sapiens
ccuuacauuuauaacaucauuuuuauaauguucuucugaaagaggauuaugaggucuugagu

SEQ ID NO: 623674 - RNA, 62 nt, Homo Sapiens
ggaauucugcagcuaacccuagccuccguuggcuucugaacuguuaaucccugucuggacug

SEQ ID NO: 623675 - RNA, 62 nt, Homo Sapiens
cguuugaaagcaaaaacaaaccacugucucugcuucugaaacgggaaucaguaacucuuugc

SEQ ID NO: 623676 - RNA, 62 nt, Homo Sapiens
guaaacaugguuaaaauaaaacuuuugugguucuucugaaucuuaauauuucaaagccaggu

SEQ ID NO: 623677 - RNA, 62 nt, Homo Sapiens
cucucacaagagcagaggccugaagauucuuucuucugaaagccaagcaccacaaggaaaaa

SEQ ID NO: 623678 - RNA, 62 nt, Homo Sapiens
cugaaaauaaggaauugcuuauaaaccagccacuucugaauacaauauguagcugauuuaau

SEQ ID NO: 623679 - RNA, 60 nt, Homo Sapiens
uuauugauguuacccaguuuuaauaaaagaaucuucugaaggauggguccuccuaccuac

SEQ ID NO: 623680 - RNA, 62 nt, Homo Sapiens
aacugugucuacaguuuauccauauaacuucucuucugaaaacugaggaguguccucuguuc

SEQ ID NO: 623681 - RNA, 62 nt, Homo Sapiens
cacagacuguuccaccguugugcauauuguugcuucugaaccacaaacuguauaaauggaug

SEQ ID NO: 623682 - RNA, 62 nt, Homo Sapiens
gaacaucucccuuccggggcugcccucaagagcuucugaaaaacuaaugacucugcugccuu

SEQ ID NO: 623683 - RNA, 62 nt, Homo Sapiens
aaguagguucauguguuuucuuagguaaaguucuucugaaagaauuuucuauuuuuaaaaaa

SEQ ID NO: 623684 - RNA, 62 nt, Homo Sapiens
uauacuaaguuccauguauuuuuguuacaaaucuucugaaaaaaaacaaaacaaugugaaac

SEQ ID NO: 623685 - RNA, 62 nt, Homo Sapiens
accauaucuucuggcuaaccauauucaagauucuucugaaacuuggaggauguaaagaaucc

SEQ ID NO: 623686 - RNA, 62 nt, Homo Sapiens
cauguccuuccccucacuugugugaguggccccuucugaaucucuccagcagccagaggcac

SEQ ID NO: 623687 - RNA, 62 nt, Homo Sapiens
uuucuccaaacgcucgguuccuuugaagauuucuucugaacgugugugcgcacgcugggcgg

SEQ ID NO: 623688 - RNA, 62 nt, Homo Sapiens
ucccaagagcucaaaagcagaaauggccaggccuucugaaaacuuaaguccagaauugucac

SEQ ID NO: 623689 - RNA, 62 nt, Homo Sapiens
guuguggccuccuuggauucuucugacuuuggcuucugaaaggaaggccuagauccagcccu

SEQ ID NO: 623690 - RNA, 62 nt, Homo Sapiens
acuaaaaggcgcuucauguccaguguguggcccuucugaaacuuauggucaucucucccacu

SEQ ID NO: 623691 - RNA, 62 nt, Homo Sapiens
agucauuugguacuggcuaccuggagccuuaucuucugaaggguuuuaaagaauggccaauu

SEQ ID NO: 623692 - RNA, 62 nt, Homo Sapiens
gacaguauagcugcccuugcagcccaggagagcuucugaaagggcucgugggcacuuuccac

SEQ ID NO: 623693 - RNA, 62 nt, Homo Sapiens
cugcuacuugauuucuuucuaacccaggacugcuucugaaugggagagacuuuaucaggaug

SEQ ID NO: 623694 - RNA, 62 nt, Homo Sapiens
cugcuacuuaauuccuuucugaacccaggacgcuucugaauggggagagaccucaucaggau

SEQ ID NO: 623695 - RNA, 62 nt, Homo Sapiens
guaaaugaacuuaaaaauagaccuaaaggagacuucugaauucauuugcuuaauauauaucu

SEQ ID NO: 623696 - RNA, 62 nt, Homo Sapiens
uaauccuuaaaacaaacuucuuuacaugaggacuucugaaaucuuuauucaugccugauuug

SEQ ID NO: 623697 - RNA, 62 nt, Homo Sapiens
uucaagagcauccuauagugggaaaaagguaucuucugaaugaguauacaaaaauaaaaagu

SEQ ID NO: 623698 - RNA, 62 nt, Homo Sapiens
agagcuggcucccugggguggggagccggggacuucugaaauuuggguguuggcuggguaag

SEQ ID NO: 623699 - RNA, 62 nt, Homo Sapiens
uggguuucaugccugcccccaguacuuaagcacuucugaacucauaguugaguaaucaccuc

SEQ ID NO: 623700 - RNA, 62 nt, Homo Sapiens
cagggcucuugaacagacaaucuuccgagggccuucugaagaaagaguuggugaagguuguc

SEQ ID NO: 623701 - RNA, 62 nt, Homo Sapiens
auguuuuuuuccucugugauucagauuaaucucuucugaaugagcacaaagaacguugaagu

SEQ ID NO: 623702 - RNA, 62 nt, Homo Sapiens
ucucuuauuugcgugcacuguacacuucuugacuucugaaugaauuuuugcagucuuaaaau

SEQ ID NO: 623703 - RNA, 62 nt, Homo Sapiens
ugaucaagagcauggagaauauauuauccaaucuucugaacuaacuuagcaaaauuagcaau

SEQ ID NO: 623704 - RNA, 62 nt, Homo Sapiens
ucaaggcaagaaccucuuuaccaaggauaugucuucugaagacucucucaacccagggacac

SEQ ID NO: 623705 - RNA, 62 nt, Homo Sapiens
aagaccuacuugaacagggcauauuuuuuagacuucugaacaucaguauguucgaggguacu

SEQ ID NO: 623706 - RNA, 62 nt, Homo Sapiens
caaggaauaugacauacagugcuggccacaaccuucugaaggcccaugcccuggcuuggcau

SEQ ID NO: 623707 - RNA, 62 nt, Homo Sapiens
cucuucuuccagcucguuagcagcauuagcaccuucugaauuccacccucucagaagaaucc

SEQ ID NO: 623708 - RNA, 62 nt, Homo Sapiens
aggcuuucauuuggucagcacuagaacaguaucuucugaagacaaaacugaaugcuauagcu

SEQ ID NO: 623709 - RNA, 62 nt, Homo Sapiens
agcaaagcuuccuguguuucugaaaaugguaacuucugaaacggcugcaugagacaucuuuc

SEQ ID NO: 623710 - RNA, 62 nt, Homo Sapiens
caaauugguugguuuugacuguauuuuugcugcuucugaauacuccucccagcccauaacca

SEQ ID NO: 623711 - RNA, 62 nt, Homo Sapiens
uggagccugaauacauuuucuggaaagucucucuucugaaccagugaauuuugucuccugcu

SEQ ID NO: 623712 - RNA, 62 nt, Homo Sapiens
uggaaaggggaaguuggcagugauuagaggaacuucugaacuuuuggucuucuuuucauuuu

SEQ ID NO: 623713 - RNA, 62 nt, Homo Sapiens
uucuguaucugagcacaucaaaccauuuuccucuucugaaaauguuuuuuucuaauggaaug

SEQ ID NO: 623714 - RNA, 62 nt, Homo Sapiens
auaaauguguuugaaaugcauuaucugcaccacuucugaauaucuucgguguaaucuaagcg

SEQ ID NO: 623715 - RNA, 62 nt, Homo Sapiens
gguagauuuccacaaaucagacacauuauuuucuucugaacuuggcaauauaaccuaauaag

SEQ ID NO: 623716 - RNA, 62 nt, Homo Sapiens
gggagcaucuuuggacucucuguuuuuaaaaccuucugaaccaugacuuggagccggcagag

SEQ ID NO: 623717 - RNA, 62 nt, Homo Sapiens
cagcaauccagguaagacuuuacuaaaagucucuucugaaaaugacuacaaagaaaaacaga

SEQ ID NO: 623718 - RNA, 50 nt, Homo Sapiens; identical to SEQ ID NO: 623151

SEQ ID NO: 623719 - RNA, 62 nt, Homo Sapiens
auuauuaaauaagugaauaccugagauagcuucuucugaacucugaauuacuucuuguacag

SEQ ID NO: 623720 - RNA, 62 nt, Homo Sapiens
aaccaauccaggaacugcuuaccugaauugugcuucugaauugugggauguagauagaaagc

SEQ ID NO: 623721 - RNA, 62 nt, Homo Sapiens
agaaaggaccgaagcugcugacaacaaagccgcuucugaagaaugugcaaauuacaggcaag

SEQ ID NO: 623722 - RNA, 62 nt, Homo Sapiens
aucaaagacuaauuugugauaaucuucuuaugcuucugaauaauggaaaacaugaaaacagc

SEQ ID NO: 623723 - RNA, 62 nt, Homo Sapiens
aaacuacuaccuaggagaaucagcucauuuuccuucugaaagagacccucauaugaccugca

SEQ ID NO: 623724 - RNA, 62 nt, Homo Sapiens
uuguagggaccuugcccugcccccuaaacacacuucugaaggaggaggcugucagacuguuc

SEQ ID NO: 623725 - RNA, 62 nt, Homo Sapiens
ucagaacauucagcucuggacuucccccucuucuucugaagagggcggaggggauccagcca

SEQ ID NO: 623726 - RNA, 62 nt, Homo Sapiens
cuaguucucuuuuauucuuguuaaauauuacucuucugaaugccucuuagaagcuaacccac

SEQ ID NO: 623727 - RNA, 62 nt, Homo Sapiens
cugaagcccgaugacaucuucaguccucgaugcuucugaaccgagcacagagggccggccac

SEQ ID NO: 623728 - RNA, 62 nt, Homo Sapiens
caaaccuuucuggacggcaggaaaaggaagugcuucugaaaauuuuaguaaaagaaagugag

SEQ ID NO: 623729 - RNA, 62 nt, Homo Sapiens
agggugaccaaaugacgagcccucgccucuuucuucugaagaguacucuauaaaucuagugg

SEQ ID NO: 623730 - RNA, 62 nt, Homo Sapiens
uguuccccauccccaguaguuuacauuccugacuucugaauacagcacagcugagcccccug

SEQ ID NO: 623731 - RNA, 62 nt, Homo Sapiens
uuaaauaugcaauaaaguguuuacaggaugcccuucugaaggguaguccuuuguaaagcugu

SEQ ID NO: 623732 - RNA, 62 nt, Homo Sapiens
gagauacuuacugacuccacuccugacuucugcuucugaaaaaaugaaguagguguuuuccc

SEQ ID NO: 623733 - RNA, 62 nt, Homo Sapiens
uaugaaaucauuuucacaaaauaagcagcuugcuucugaaaugcugucuuucccaguagcua

SEQ ID NO: 623734 - RNA, 62 nt, Homo Sapiens
ccugucauuccacuucauggaagagacggagccuucugaaaugagaucuacccugaaaaucu

SEQ ID NO: 623735 - RNA, 62 nt, Homo Sapiens
cugccacgagcccauaauugaagagucaaagucuucugaagcugcacccucuuuacuucagu

SEQ ID NO: 623736 - RNA, 62 nt, Homo Sapiens
aaacuauuuugaaaguucucuuccaucuuucucuucugaaguagucuguuuaacucuucaug

SEQ ID NO: 623737 - RNA, 62 nt, Homo Sapiens
cucgggggacaugggccucuggacucaguucccuucugaacacagggccuggccaccucaua

SEQ ID NO: 623738 - RNA, 62 nt, Homo Sapiens
ucuguacugggagugaagagugauaucuggggcuucugaaggugagcccuaccauuacaucc

SEQ ID NO: 623739 - RNA, 62 nt, Homo Sapiens
auuuucaaggcgggugggauggacauggagaacuucugaagagcuaaagguuuuguccugua

SEQ ID NO: 623740 - RNA, 62 nt, Homo Sapiens
ucuacaccaauaacugcugcuggaaucuguaccuucugaaccaaaugaauuauuucuguagu

SEQ ID NO: 623741 - RNA, 62 nt, Homo Sapiens
agcccauugcuggcccgccaaacaccucagaccuucugaagcgccaggacgucaggcugacc

SEQ ID NO: 623742 - RNA, 62 nt, Homo Sapiens
guucugaugaaaacugacugcucucugggccacuucugaaggacaguuuccucaggcaaggc

SEQ ID NO: 623743 - RNA, 62 nt, Homo Sapiens
uuaacgugaucaucaccacuucauguacuacacuucugaaacuagacaaauuguuaagagua

SEQ ID NO: 623744 - RNA, 62 nt, Homo Sapiens
ucugcaauaggaaauguuucggauaaaaagaacuucugaaucagaaaccagaaugaucuuca

SEQ ID NO: 623745 - RNA, 62 nt, Homo Sapiens
ugcagcaguggcuuagaaagcauagucagcuacuucugaaacggccggaguaucuauuucua

SEQ ID NO: 623746 - RNA, 62 nt, Homo Sapiens
auaauuuuuauuuuugaagcuuaaauguguuucuucugaaagcuguuaaagauguauuuaug

SEQ ID NO: 623747 - RNA, 62 nt, Homo Sapiens
gugaauuucuacaguuuaacauagcacagggccuucugaaaaucgcacuugucaaagacgac

SEQ ID NO: 623748 - RNA, 62 nt, Homo Sapiens
augggggcucagccaggugcugugacaccccccuucugaaugaagccuucugaccugggcug

SEQ ID NO: 623749 - RNA, 62 nt, Homo Sapiens
uugaugccugugaacugaacucugacaacagacuucugaaauagacccacaagaggcaguuc

SEQ ID NO: 623750 - RNA, 62 nt, Homo Sapiens
guuucugcccaguucuacccccucaugugcuucuucugaauacugaaugugacuguuugaaa

SEQ ID NO: 623751 - RNA, 62 nt, Homo Sapiens
aagagggaaugcuagguugauagggcugguggcuucugaauuugguauuugaacuaggaguc

SEQ ID NO: 623752 - RNA, 62 nt, Homo Sapiens
uauguucucugguaacacguagaguucagacccuucugaacucuguugauaauaccacacca

SEQ ID NO: 623753 - RNA, 62 nt, Homo Sapiens
agcaucuuccucccuccuuuaauuaauggaaucuucugaauuuucccugaauguuuaaagau

SEQ ID NO: 623754 - RNA, 62 nt, Homo Sapiens
gucugaaaugcgcccgccuggcggacagcucccuucugaagcagagaagccuccauggucac

SEQ ID NO: 623755 - RNA, 62 nt, Homo Sapiens
gaagggaaaaaaaccaccccuagaagaacuuacuucugaaauauguaacagauacacuacag

SEQ ID NO: 623756 - RNA, 62 nt, Homo Sapiens
aaugccgauuuuauccauggcuggcaucaugccuucugaauacccacuuggggaguuucuuc

SEQ ID NO: 623757 - RNA, 62 nt, Homo Sapiens
gccuggcgggaaauguaguccuccgccaccggcuucugaacagaaagacucuuuucuccucu

SEQ ID NO: 623758 - RNA, 62 nt, Homo Sapiens
ccguagcggguuaugaggaagucacgucuuagcuucugaacaugccuggccuggcucuggaa

SEQ ID NO: 623759 - RNA, 62 nt, Homo Sapiens
cuauauuuaucugagugagugagcuuccauuacuucugaaaauauuagauuuuugugaugaa

SEQ ID NO: 623760 - RNA, 62 nt, Homo Sapiens
gucagaauauguaauuauuugcuuuugguguccuucugaagggauugaaacauaaaauugua

SEQ ID NO: 623761 - RNA, 62 nt, Homo Sapiens
cuuuccuuuaugaacucccacaugggaaagagcuucugaacuuguuuuccauuugggggccc

SEQ ID NO: 623762 - RNA, 62 nt, Homo Sapiens
uaaaaagagagcaugagguugauuguacaugacuucugaaauuuucccaaguuucacaaugu

SEQ ID NO: 623763 - RNA, 62 nt, Homo Sapiens
ggauuuuagaugauaaggcuacaauucagaaucuucugaaccaucuauguaaugaaugggga

SEQ ID NO: 623764 - RNA, 62 nt, Homo Sapiens
ugcuuuagaacaaacccuuuuugaucuuaaugcuucugaaaacuaggucugacucuggggau

SEQ ID NO: 623765 - RNA, 62 nt, Homo Sapiens
ggcaaaugucuccucccucccaugcuccuuggcuucugaaggcugaagcuccuuuggcuggg

SEQ ID NO: 623766 - RNA, 62 nt, Homo Sapiens
ggaagugccuucauccaggacaggaaguagcacuucugaaacaggaaguggucuggcuggaa

SEQ ID NO: 623767 - RNA, 62 nt, Homo Sapiens
aaugcuuacugugguauuuggaauguauguaucuucugaacccuacaucaaguugaaaaggu

SEQ ID NO: 623768 - RNA, 62 nt, Homo Sapiens
auuugaacaguuuaauaaacugguucugcucucuucugaaucucaugccuuuggcaccuugg

SEQ ID NO: 623769 - RNA, 62 nt, Homo Sapiens
auagggagggauuucacucuucuucccagguucuucugaagcacccacacaaaaugcacacu

SEQ ID NO: 623770 - RNA, 62 nt, Homo Sapiens
aaagaggaucuggagaaccucauccagcuccccuucugaaucagcugggaugacuggcuuug

SEQ ID NO: 623771 - RNA, 62 nt, Homo Sapiens
caggaaggggcucuguucccuguauuguccuccuucugaagccccuuggcucugccuuggcc

SEQ ID NO: 623772 - RNA, 62 nt, Homo Sapiens
acuaagccgaguaagaagacauacaaaagccucuucugaaggaaaagacaguguaguccugc

SEQ ID NO: 623773 - RNA, 62 nt, Homo Sapiens
gcuuuugaacguaugugcucuuauaaaguggacuucugaaaaaugaauguaaaagacacugg

SEQ ID NO: 623774 - RNA, 62 nt, Homo Sapiens
ccccacacaugguccucacucauaucugucaccuucugaagccuagaucuuguuaacccauc

SEQ ID NO: 623775 - RNA, 62 nt, Homo Sapiens
ucgaaacugacaguauuaaggguaggauguugcuucugaaucacuguugaguucugauugug

SEQ ID NO: 623776 - RNA, 62 nt, Homo Sapiens
cccugcgccucacccucagacuggugaccaggcuucugaaagccauucuggaucaguuggcu

SEQ ID NO: 623777 - RNA, 62 nt, Homo Sapiens
gugacuuuuuuugugugaauaaagauaugaaacuucugaaucucaagaacugugguguguuu

SEQ ID NO: 623778 - RNA, 62 nt, Homo Sapiens
ggcaauuggaggcgguagugcuuguguguuagcuucugaauuucaggguacgaacuggaggg

SEQ ID NO: 623779 - RNA, 62 nt, Homo Sapiens
uuuuguauaguuugcaaauugauauuuauuuucuucugaaacuggaagaugagauuguaggu

SEQ ID NO: 623780 - RNA, 62 nt, Homo Sapiens
aguagagcaggaaaaguaaaagaaaguugccacuucugaauggcaaaaacuuaaauucauuc

SEQ ID NO: 623781 - RNA, 62 nt, Homo Sapiens
cugucacguguagacaugggguugauuuguaccuucugaaucuguaagcuuccugggugaag

SEQ ID NO: 623782 - RNA, 62 nt, Homo Sapiens
caguagauguugaacuuaucccugcucauacacuucugaauacuuucaggggucaaguccuu

SEQ ID NO: 623783 - RNA, 62 nt, Homo Sapiens
guagaaauagcuaucugaucgauuuuuaaguucuucugaacuuucuuuugucuuuaaaaccu

SEQ ID NO: 623784 - RNA, 62 nt, Homo Sapiens
aauauucagucacaagucauauccuuuuugcccuucugaaacggauucccuauucacauuga

SEQ ID NO: 623785 - RNA, 62 nt, Homo Sapiens
ccaguaccuauaacugggcuaauccuaacaaucuucugaacucuuaaaacuagccaaauuag

SEQ ID NO: 623786 - RNA, 62 nt, Homo Sapiens
uaucaguguuuugccguuaauuacaaaaauaacuucugaauuaguaaauaaacauauuuuuu

SEQ ID NO: 623787 - RNA, 62 nt, Homo Sapiens
guagauaacugcuuuuugacgucucugcuuuucuucugaaauauugauauauaaccgugauu

SEQ ID NO: 623788 - RNA, 62 nt, Homo Sapiens
uaccguuaauaaggcaacuuugggaucugauucuucugaagagacgucugucuacauugaau

SEQ ID NO: 623789 - RNA, 62 nt, Homo Sapiens
ugugauuuaaaggaauuguaucagaaacagugcuucugaauuuaugucaucuuuuucaccau

SEQ ID NO: 623790 - RNA, 62 nt, Homo Sapiens
aggaaaagagagaaggaagaugacccugauggcuucugaaacccuccacaccuuggcuuuua

SEQ ID NO: 623791 - RNA, 62 nt, Homo Sapiens
cuucacagagagcaggcaggcagccacagauacuucugaaccaggcccucuucaggcuuugg

SEQ ID NO: 623792 - RNA, 62 nt, Homo Sapiens
ggucagggccauggcugacauuugccuguuggcuucugaaguggcacuaugaacagagaaca

SEQ ID NO: 623793 - RNA, 62 nt, Homo Sapiens
aaaagaauggagcccacuaauauuauauuuuucuucugaaauaaauauaaagucaagacuaa

SEQ ID NO: 623794 - RNA, 62 nt, Homo Sapiens
ccaaagacccagaggccagagcaaaguaggaccuucugaagauucacuacugguguauccuu

SEQ ID NO: 623795 - RNA, 62 nt, Homo Sapiens
cuguaucgugccaaaguuguaucacuguuaaacuucugaagacauaaccaguugagucuuau

SEQ ID NO: 623796 - RNA, 62 nt, Homo Sapiens
ccuuguagaaaauaguuuuccagacacuuagccuucugaagugcucaucucuugcuuaaaug

SEQ ID NO: 623797 - RNA, 62 nt, Homo Sapiens
aaauuuagagauguuuucuacauauuucugcucuucugaacaacuucugcuacccacuaaau

SEQ ID NO: 623798 - RNA, 62 nt, Homo Sapiens
uuaugauauuuguacuucaugaaaaaucaaaccuucugaaaaucaguuuuuuuaugguacuc

SEQ ID NO: 623799 - RNA, 62 nt, Homo Sapiens
aaacacuuacaaaauuucuucacuaucugauacuucugaaagauaauuaaaagagggauuau

SEQ ID NO: 623800 - RNA, 62 nt, Homo Sapiens
ccuuuccagaguguuggaucggcauaaacuggcuucugaaucugugucuagaauuaaguaug

SEQ ID NO: 623801 - RNA, 62 nt, Homo Sapiens
guaauacauaucacaaaaagcucaacaccuuucuucugaacuaggugaaacgguacgauggu

SEQ ID NO: 623802 - RNA, 62 nt, Homo Sapiens
ccauucaggauucuguuccuuagguuuuuuuccuucugaaguguuucacgagagcccgggag

SEQ ID NO: 623803 - RNA, 62 nt, Homo Sapiens
caagcagguguggggccuccuucugggcuuuucuucugaauuuagaggauuucuagaacgug

SEQ ID NO: 623804 - RNA, 62 nt, Homo Sapiens
agagacacugauuuuuaaauaucaaaauuucccuucugaagucguucagauguguuccuuaa

SEQ ID NO: 623805 - RNA, 62 nt, Homo Sapiens
gugaugcgcaugggcaaggccagcgcccggggcuucugaaccgagcgggguguuucauuuuu

SEQ ID NO: 623806 - RNA, 62 nt, Homo Sapiens
accagagguacaaggaggagcugguacuauuccuucugaaacuauuccaaucaaugggaaaa

SEQ ID NO: 623807 - RNA, 62 nt, Homo Sapiens
auacuuagauuacuaaauauauauuucaucuacuucugaaguugauagucuucccccccccc

SEQ ID NO: 623808 - RNA, 62 nt, Homo Sapiens
cauggggcuguuacuuuuaaagucaaaauuuucuucugaaggcucauuuugguauuugaucu

SEQ ID NO: 623809 - RNA, 62 nt, Homo Sapiens
ucagcaaagccauucuuaagagucgugagguccuucugaauguaaaacuggagcccaggaga

SEQ ID NO: 623810 - RNA, 62 nt, Homo Sapiens
ggugguuggcagcuccaagccuuuaaaccuggcuucugaaacgauggcaucagagcccugga

SEQ ID NO: 623811 - RNA, 62 nt, Homo Sapiens
aauuugcaccucaucaugccccagaaauaauccuucugaagcaaagcaccacgaaugagguu

SEQ ID NO: 623812 - RNA, 62 nt, Homo Sapiens
uugaucuuccauuaccuucacaucccgggguccuucugaacugaccuugaccucugaucucu

SEQ ID NO: 623813 - RNA, 62 nt, Homo Sapiens
uagcacccccauccccuuggcccuuccucaugcuucugaaguggacauauucagccuuggcg

SEQ ID NO: 623814 - RNA, 62 nt, Homo Sapiens
cgucucuauuuuuaaaaaagaaaaagaaccgacuucugaaucgcagcuccacucaugacuaa

SEQ ID NO: 623815 - RNA, 62 nt, Homo Sapiens
aucucucuccaucgggccucgggacccuuucucuucugaaucugcuucccugcaguuuagau

SEQ ID NO: 623816 - RNA, 62 nt, Homo Sapiens
aagcacgacuaagagccuucugagcccagcgacuucugaagggccccuugcaaaguaauagg

SEQ ID NO: 623817 - RNA, 62 nt, Homo Sapiens
ccuccaguugagacacaagucacaaauccaggcuucugaaacuucggaccaaccagcuucaa

SEQ ID NO: 623818 - RNA, 62 nt, Homo Sapiens
gguucuagacgccccucccaagcguuccuggccuucugaacuccauacagccucuacagccg

SEQ ID NO: 623819 - RNA, 62 nt, Homo Sapiens
gcuucccacugaagggacacagagguccaguccuucugaagggcuaggaucggguucuggca

SEQ ID NO: 623820 - RNA, 62 nt, Homo Sapiens
uccucagacucuccccaauagcggaagucgaucuucugaaggauggccaaucugcuccggcc

SEQ ID NO: 623821 - RNA, 62 nt, Homo Sapiens
uuugcaaaaaucaauuauuuaucaugaguauacuucugaaaugaucuguuucaucaaucuau

SEQ ID NO: 623822 - RNA, 62 nt, Homo Sapiens
ccaaacuccagccgcugccacgccagccuucgcuucugaaaacagccuucccugugugccaa

SEQ ID NO: 623823 - RNA, 62 nt, Homo Sapiens
augacugcguccuccucugcgucggggggaggcuucugaaaggaaaucgaagaugucauggg

SEQ ID NO: 623824 - RNA, 62 nt, Homo Sapiens
ucccccuggagucucacuccgcgggauucccgcuucugaaaccaacacccuucugauggaag

SEQ ID NO: 623825 - RNA, 62 nt, Homo Sapiens
ccccuucucacguuucaggccguuucucugugcuucugaaacaagcagcuucaggggcaguc

SEQ ID NO: 623826 - RNA, 56 nt, Homo Sapiens; identical to SEQ ID NO: 623259

SEQ ID NO: 623827 - RNA, 62 nt, Homo Sapiens
uguguucucccacuguaccaagugacaaacuccuucugaaccucuugcucacugugugacca

SEQ ID NO: 623828 - RNA, 62 nt, Homo Sapiens
cacaaaagaguucauacugguuguuccagcuccuucugaauacaacauucugaagccuucgg

SEQ ID NO: 623829 - RNA, 62 nt, Homo Sapiens
uuaaaaaguccagauaggaguauuuccuuaaacuucugaaagauucuaucauucgugcuauu

SEQ ID NO: 623830 - RNA, 62 nt, Homo Sapiens
uuacaucaguuuuauuuuaaaaguuuaauauacuucugaaguaauuucucucccaaaucacu

SEQ ID NO: 623831 - RNA, 62 nt, Homo Sapiens
agccacaaauuuaugaaacaaugugggauagccuucugaaaauccagaguagaaaacuauga

SEQ ID NO: 623832 - RNA, 62 nt, Homo Sapiens
guaacaacaagagcugauacgccugucauguucuucugaauauuucucuguccuuguuuccu

SEQ ID NO: 623833 - RNA, 62 nt, Homo Sapiens
uuuucucaucuucucuaaccuugagauggagucuucugaaaaguuuuguuuguuuuguuuuu

SEQ ID NO: 623834 - RNA, 62 nt, Homo Sapiens
gcuucucugucggucuuguacuauuaaaggaccuucugaaggugacaccuucaguucuguuc

SEQ ID NO: 623835 - RNA, 62 nt, Homo Sapiens
ugguaaaggacuuggccagaugcaagcuaagccuucugaagagucuauccuucugcugaaac

SEQ ID NO: 623836 - RNA, 62 nt, Homo Sapiens
gggagcagaaagagaagguuuuuaaggaggggcuucugaauacuugggagauacggaacgga

SEQ ID NO: 623837 - RNA, 62 nt, Homo Sapiens
ggccuccuggccucagggcaugcccugccuaccuucugaaauguuuaccccauugaccaaac

SEQ ID NO: 623838 - RNA, 62 nt, Homo Sapiens
uuuugaaaucucugcaucacucauuggaagugcuucugaagagagcugcucuguguucaguu

SEQ ID NO: 623839 - RNA, 62 nt, Homo Sapiens
aagcacgucuaagagccuuaugagcccagcgacuucugaagggccccuugcaaaguaauagg

SEQ ID NO: 623840 - RNA, 62 nt, Homo Sapiens
ggugccuacuaugugcgagacauugggaggggcuucugaauuauucuggauaucgucauuuu

SEQ ID NO: 623841 - RNA, 62 nt, Homo Sapiens
acccacaaagcaucaaaagacucacucacaaacuucugaacacaaacuccauggaugaaagc

SEQ ID NO: 623842 - RNA, 62 nt, Homo Sapiens
cugcucagugaggaaaucucuuccaauuucugcuucugaaugauucaauguugggagcaaua

SEQ ID NO: 623843 - RNA, 62 nt, Homo Sapiens
cuggaguugagggaaggagcuguauuguggcacuucugaauuccccguuuuguuccauauug

SEQ ID NO: 623844 - RNA, 62 nt, Homo Sapiens
agaguuuuuaaacuaucaauggcauuucaagucuucugaaacagcauggcuguaugugcgug

SEQ ID NO: 623845 - RNA, 62 nt, Homo Sapiens
augguagagcaauaaugcuuuuuaaaaauaaacuucugaaaacccaaggccagguacugcau

SEQ ID NO: 623846 - RNA, 62 nt, Homo Sapiens
uguauaucuuaagcauuuggaauuuuuuuuaucuucugaaaucauauaaaaagaaugucauu

SEQ ID NO: 623847 - RNA, 62 nt, Homo Sapiens
ugggggauggcuuaacuguaccuguuuggaugcuucugaauagaaauaaaguggguuuuccc

SEQ ID NO: 623848 - RNA, 62 nt, Homo Sapiens
gcugaacauguggagggaggggaacacgggagcuucugaagaacgucuccauaaaaggccca

SEQ ID NO: 623849 - RNA, 62 nt, Homo Sapiens
cccuccuugggccggguugugaaacccacucccuucugaagcgugucugcucuagucaucca

SEQ ID NO: 623850 - RNA, 62 nt, Homo Sapiens
gaauacaucagcuggcauaaaguuaagcauaucuucugaacuaaauuaauuauccuuaaaaa

SEQ ID NO: 623851 - RNA, 62 nt, Homo Sapiens
uugggagagggcugaacucucccaugccucuccuucugaaccauuccacccacccagcucug

SEQ ID NO: 623852 - RNA, 62 nt, Homo Sapiens
auguguuugggaguugugaaguuuauuaaaaacuucugaaugaagguuuuuauaaugaaguu

SEQ ID NO: 623853 - RNA, 62 nt, Homo Sapiens
acgugcugcagagccaccuucccccuucccaacuucugaagcgaccugugcccagcuuuggu

SEQ ID NO: 623854 - RNA, 62 nt, Homo Sapiens
gcaaggagcaaacacugaaagcaguagaugugcuucugaaccaagccuuggguuccaaccag

SEQ ID NO: 623855 - RNA, 62 nt, Homo Sapiens
cucugggccugcgcuaauugacccugaggucccuucugaaccuuuuuauuguaaccagaauc

SEQ ID NO: 623856 - RNA, 62 nt, Homo Sapiens
uguggucagcaucuguacaacaaagguggcuccuucugaauguugguagaggccgagcccag

SEQ ID NO: 623857 - RNA, 62 nt, Homo Sapiens
ucucagggacagaugaggcugucccccuguggcuucugaaaaugcgccucugcccucuccca

SEQ ID NO: 623858 - RNA, 62 nt, Homo Sapiens
acaacaucuguuacauucuaaguguguucaggcuucugaagguaaagggacacuggauccag

SEQ ID NO: 623859 - RNA, 62 nt, Homo Sapiens
ggaggucaucaaccgaugguccucacaagccucuucugaagauggaaggccuuuugcccguu

SEQ ID NO: 623860 - RNA, 62 nt, Homo Sapiens
ccgccuggcaucucucugccgcagcauuuccccuucugaaccguccagugacugcuuucaau

SEQ ID NO: 623861 - RNA, 62 nt, Homo Sapiens
gaagcauauuuguggcgaagaaaugaaaaugucuucugaaguuaaugaggcugauagugaag

SEQ ID NO: 623862 - RNA, 62 nt, Homo Sapiens
aucucaaaaagcccacccaauuuucggucagucuucugaagaaacaguccuuauucagaaac

SEQ ID NO: 623863 - RNA, 62 nt, Homo Sapiens
cuguuauuagaauaaguuugcccauagggugccuucugaauaaacuucacugucaccugugu

SEQ ID NO: 623864 - RNA, 62 nt, Homo Sapiens
ugccacuuccaguagacaugucacagaucucacuucugaauggccuuucuauuucaguucau

SEQ ID NO: 623865 - RNA, 62 nt, Homo Sapiens
aauggggcccuguagcugcacccagaacgcuccuucugaagauuccaggggacgauggaaua

SEQ ID NO: 623866 - RNA, 62 nt, Homo Sapiens
gaugacuuaaugucgaauauaaacaggcuucucuucugaaauuuucaaaccuuuccuacuuc

SEQ ID NO: 623867 - RNA, 62 nt, Homo Sapiens
guguccauccugaccugcggguccugucuguccuucugaaguccuaagggcagcccuccaug

SEQ ID NO: 623868 - RNA, 62 nt, Homo Sapiens
uggcgucaauaaagaccuggaaggauguugugcuucugaagccccacuggguguuacugcag

SEQ ID NO: 623869 - RNA, 62 nt, Homo Sapiens
gggggaggcaguguggaauauuucaguagggacuucugaaaugugccucaguguccuucuca

SEQ ID NO: 623870 - RNA, 62 nt, Homo Sapiens
ugugacaguguccagccgguccaccuccaguucuucugaaagucauguaauaugaucaggac

SEQ ID NO: 623871 - RNA, 62 nt, Homo Sapiens
gcuuuggccuuccucagugacugcaggaacugcuucugaaagccaggcuguggauuacguca

SEQ ID NO: 623872 - RNA, 62 nt, Homo Sapiens
gugcuuucuccauuuauuuacugcuaguguagcuucugaaagaugcuugauggaauuuuuuc

SEQ ID NO: 623873 - RNA, 62 nt, Homo Sapiens
guaauucauuuaauugcaaaaaaagugggagacuucugaacauagcacaguauuuuuguaug

SEQ ID NO: 623874 - RNA, 62 nt, Homo Sapiens
auggaaacuguuaguccagaaagguggauuaucuucugaagacuuucccaggaacaaaucaa

SEQ ID NO: 623875 - RNA, 62 nt, Homo Sapiens
guuuggccuaggccuaaagaugugugucgugacuucugaagagcgugaccggggcccacauc

SEQ ID NO: 623876 - RNA, 62 nt, Homo Sapiens
ccuaucagguccagagggugaggaaaccuugacuucugaauuccccggcaucuaccccacuc

SEQ ID NO: 623877 - RNA, 62 nt, Homo Sapiens
accucauccuuccucacaggaugcauguccuccuucugaaggggugacaaugcagcacuggc

SEQ ID NO: 623878 - RNA, 62 nt, Homo Sapiens
cauuuaauuugucuuuaaggacagucauuuggcuucugaauguuugaaacgauuuuaaaaaa

SEQ ID NO: 623879 - RNA, 62 nt, Homo Sapiens
gcaggggugaggaguggggagaaaccagaaugcuucugaaacucccaccuguugcucugagc

SEQ ID NO: 623880 - RNA, 62 nt, Homo Sapiens
cuauuuuuuuucaugaaaaugucaacaugguucuucugaaucuaucacagugaaaaguucua

SEQ ID NO: 623881 - RNA, 62 nt, Homo Sapiens
guauuuucccucaccagucuaggcaugacuggcuucugaaaaauuccagcacaccuccucga

SEQ ID NO: 623882 - RNA, 62 nt, Homo Sapiens
ggauauauucuaugcauagauguaaugcuaaccuucugaauauauuuugaauacauuuauau

SEQ ID NO: 623883 - RNA, 62 nt, Homo Sapiens
aauaauaaaauuuccccuaaucuuuucugaaucuucugaaaccaaauguaacuauguuuuau

SEQ ID NO: 623884 - RNA, 62 nt, Homo Sapiens
uuuguuuucuuggcuaguaauaguaguagauacuucugaaauaaauguucucucaagauccu

SEQ ID NO: 623885 - RNA, 62 nt, Homo Sapiens
uuguggaugacccuuagaauccauucucuggucuucugaaauaccaagggcagaugucaccu

SEQ ID NO: 623886 - RNA, 62 nt, Homo Sapiens
caugauguucagauuuuccagugaaaaauacccuucugaacaaaacauguacuuacucuccg

SEQ ID NO: 623887 - RNA, 62 nt, Homo Sapiens
uugcugguggcuaacggcuugugcuugaaagucuucugaagucugaugugaauugagcuauc

SEQ ID NO: 623888 - RNA, 62 nt, Homo Sapiens
cuugguucuggcccccgcuuuuucuaacaugucuucugaaugcuuccuuuuucccugcacac

SEQ ID NO: 623889 - RNA, 62 nt, Homo Sapiens
auccauaucauaguugcuuucuuuaauuguuccuucugaauaaacaguuuauuuaagauacu

SEQ ID NO: 623890 - RNA, 62 nt, Homo Sapiens
ucagccaaggacacuugauaaagcagcugacacuucugaaacggguguuuccaacgucaugg

SEQ ID NO: 623891 - RNA, 62 nt, Homo Sapiens
gaaaguguauuauaaaaaaaaauuuuuuuucacuucugaagguacgcuucaguauuuuaugc

SEQ ID NO: 623892 - RNA, 62 nt, Homo Sapiens
aacaaaaaaauugagaggcuguugccucccaucuucugaaaauuuaauugugaaccuaccau

SEQ ID NO: 623893 - RNA, 62 nt, Homo Sapiens
uuugguucaaauguguuuugggccuggcuugucuucugaacgaaacauguugccaaaauggu

SEQ ID NO: 623894 - RNA, 62 nt, Homo Sapiens
gaaauuuacuugacacaguaccucaauccauucuucugaagucaagggggauuaaagcuaca

SEQ ID NO: 623895 - RNA, 62 nt, Homo Sapiens
gcaagucucucagacucuuguaaagaacucuccuucugaaugcgccuggcuuuuagcagcca

SEQ ID NO: 623896 - RNA, 62 nt, Homo Sapiens
cuuuuugucauguagcuauuuguagcuuaauccuucugaaguaaaacacuaguauaguguug

SEQ ID NO: 623897 - RNA, 62 nt, Homo Sapiens
uggaacaccauucuucagaggugucauguggucuucugaaaauuugaguagagaaauuaugu

SEQ ID NO: 623898 - RNA, 62 nt, Homo Sapiens
ucuuaaaguucugaaguucugcaacuuaagaacuucugaaguacuucguuacuugagcuuca

SEQ ID NO: 623899 - RNA, 62 nt, Homo Sapiens
gacaguaaaccuguccauuauuuuuacugguucuucugaauugugcugcuuggauagaaaua

SEQ ID NO: 623900 - RNA, 62 nt, Homo Sapiens
aaaucugucuugaaaauauggauuucaauugacuucugaaguauacuuagaacaugagcaag

SEQ ID NO: 623901 - RNA, 62 nt, Homo Sapiens
aaaccccacuuauggguguauuauuuuuuauucuucugaauuugggaauagaaaaaaauugu

SEQ ID NO: 623902 - RNA, 62 nt, Homo Sapiens
cagauaugagucaccagacaugucagaaagcacuucugaaaguacugauagucaguuugcug

SEQ ID NO: 623903 - RNA, 62 nt, Homo Sapiens
ugccuuggugugagaaggagggaauccagcggcuucugaaaggaaguggcacagccccaguc

SEQ ID NO: 623904 - RNA, 54 nt, Homo Sapiens; identical to SEQ ID NO: 623337

SEQ ID NO: 623905 - RNA, 57 nt, Homo Sapiens; identical to SEQ ID NO: 623338

SEQ ID NO: 623906 - RNA, 62 nt, Homo Sapiens
ugauauacuugucuuaagauauuaaugaaacacuucugaacacugauaggaaguguccacau

SEQ ID NO: 623907 - RNA, 63 nt, Homo Sapiens
uccagggaggccccagcaaccacaccaucuucuugcugugagaggucucaccccgggcuaccu

SEQ ID NO: 623908 - RNA, 63 nt, Homo Sapiens
agaacucuuccagaaccaucaccuuugggaaccugcugugagagugcugagguaccagaagug

SEQ ID NO: 623909 - RNA, 63 nt, Homo Sapiens
ugauacuuguacucccccuaccccuuugucaacugcugugaaugcuguaugguguguguucuc

SEQ ID NO: 623910 - RNA, 63 nt, Homo Sapiens
auuguguucuucguaaagacugaggcaagcaagugcugugaaauaacaucaucuuagucccuu

SEQ ID NO: 623911 - RNA, 63 nt, Homo Sapiens
ccgccggacucuuuucugcagcacacgccugugugcugugagccccccacucugccgugcuca

SEQ ID NO: 623912 - RNA, 63 nt, Homo Sapiens
uugucuuauuuaaaauuggaaugugagacauguugcugugaccuguuuuucuuucucauucac

SEQ ID NO: 623913 - RNA, 63 nt, Homo Sapiens
cuguucaacuuguaucaacuccucuuuucuaauugcugugaaauggcaacuguugauaaauua

SEQ ID NO: 623914 - RNA, 63 nt, Homo Sapiens
aauaacaauugacauuccuugagcaaaauauacugcugugaauuugcaaacaagaaaucugag

SEQ ID NO: 623915 - RNA, 63 nt, Homo Sapiens
ugaacuuggaaagaaaugcccaucuaugucccuugcugugagcaagaagucaaaguaaaacuu

SEQ ID NO: 623916 - RNA, 63 nt, Homo Sapiens
ucacguuuuauagaugagguaaaaagucuugugugcugugaguuauaaugcuuuugccuuuuu

SEQ ID NO: 623917 - RNA, 63 nt, Homo Sapiens
ggcaggccagucauguguuaaguugcgcuucuuugcugugaugugggugggggaggaagagua

SEQ ID NO: 623918 - RNA, 63 nt, Homo Sapiens
uggccccuauguuguguucuggacugaggccuuugcugugaacugcaguguuucauacgaacc

SEQ ID NO: 623919 - RNA, 63 nt, Homo Sapiens
cgcugcaugcuucaauccugaacgucacugacuugcugugaccauccaaauaauuuuccuguc

SEQ ID NO: 623920 - RNA, 63 nt, Homo Sapiens
uagggcuacagacagucaugugugacuucucucugcugugaaaacucccagagucucuuuagg

SEQ ID NO: 623921 - RNA, 63 nt, Homo Sapiens
aggcgcagucucacucugucgcccgggcuggagugcugugagcuguccguggugcugaauuca

SEQ ID NO: 623922 - RNA, 63 nt, Homo Sapiens
aggacagcuugagccgggccccugggcuuggccugcugugauuccacuacaccuggcugaggu

SEQ ID NO: 623923 - RNA, 63 nt, Homo Sapiens
aaaaagacuaaccugcccacccacuccuuauauugcugugagauugccccuaucuugugcucu

SEQ ID NO: 623924 - RNA, 63 nt, Homo Sapiens
caggggaacgcccgagacccccaccucucacuuugcugugagcccgggaaccccagagaccac

SEQ ID NO: 623925 - RNA, 63 nt, Homo Sapiens
acaccccagccuuaagucucuuggagaagcuggugcugugagccagaggaugucagcugccaa

SEQ ID NO: 623926 - RNA, 63 nt, Homo Sapiens
aagaaguagagaagcuauuaucaauuaaaagcaugcugugaugugacuccuggaagugacgua

SEQ ID NO: 623927 - RNA, 63 nt, Homo Sapiens
gccguuuggagggagggugggcacagcugggccugcugugaccacugggagggaagaggagag

SEQ ID NO: 623928 - RNA, 63 nt, Homo Sapiens
agaaauuaaccaggaagauguuuccaccaagccugcugugagucaauugagggaguguuuggg

SEQ ID NO: 623929 - RNA, 63 nt, Homo Sapiens
ggcuggggugggcagggaagggaagccgggggcugcugugagggaucuuggagcuucccugua

SEQ ID NO: 623930 - RNA, 63 nt, Homo Sapiens
gcgccagugacagucagggaaggugccucuggaugcugugaagagucuacagagaagauucuu

SEQ ID NO: 623931 - RNA, 63 nt, Homo Sapiens
auaccccauuuaggucagcacuugauucguuguugcugugaaauauguccaugggacaaaaga

SEQ ID NO: 623932 - RNA, 63 nt, Homo Sapiens
cguaguaauaaauucucagaucccgcccguugcugcugugaucaaugagucuggcgccgcccu

SEQ ID NO: 623933 - RNA, 63 nt, Homo Sapiens
uugcgguaggccuggaucugcuauacaaaacugugcugugaccauccuguuuucugcaacauu

SEQ ID NO: 623934 - RNA, 63 nt, Homo Sapiens
cggcacauacaccccagccgauuuauaugguacugcugugacgaacugcguucaaaucaacgu

SEQ ID NO: 623935 - RNA, 63 nt, Homo Sapiens
gacuuugaaagacucuggugaaaaugcaauuguugcugugagugggcuaccaaggcugggaaa

SEQ ID NO: 623936 - RNA, 63 nt, Homo Sapiens
uguuucaauaaaggggccccgucucaaauacugugcugugaguuccgccggccaacacugucu

SEQ ID NO: 623937 - RNA, 63 nt, Homo Sapiens
cuguccuguacauugugggaccaggucacccuuugcugugaggugcacuacugacaugugggg

SEQ ID NO: 623938 - RNA, 63 nt, Homo Sapiens
gccaccugcguccucgucaagugucagcacggaugcugugacucgaagaguccccuuccuugc

SEQ ID NO: 623939 - RNA, 63 nt, Homo Sapiens
cuaaaacugccauauaaagaaccuucucaauuuugcugugaaccaggguagggaaaucuccau

SEQ ID NO: 623940 - RNA, 63 nt, Homo Sapiens
ucagagacaagccuggaaggcuuaaaacaguguugcugugacuucauccaauuaaacauacug

SEQ ID NO: 623941 - RNA, 63 nt, Homo Sapiens
uucuuuacugauuucucuauucuugacucugagugcugugaauaucuuuuuuaguuaacccuu

SEQ ID NO: 623942 - RNA, 63 nt, Homo Sapiens
gaaauguaucccucguuuaucauaaucuuucuuugcugugacugucugcagcacggaaaagca

SEQ ID NO: 623943 - RNA, 63 nt, Homo Sapiens
ugcaugauggauucuaggcugcuuuucccagagugcugugacuguggagcgaggguaguagga

SEQ ID NO: 623944 - RNA, 63 nt, Homo Sapiens
ccuaccagggcuuucuuggcgcucacccauggcugcugugacuaagucaggaaaagccuuuca

SEQ ID NO: 623945 - RNA, 63 nt, Homo Sapiens
auuuauaauguuaguagaaaaucaaguggcaugugcugugacccauuucaaaguuuggauugu

SEQ ID NO: 623946 - RNA, 63 nt, Homo Sapiens
acuauguuguacagaucuucguuagcaagacccugcugugauucauguaugcuaaauuuguga

SEQ ID NO: 623947 - RNA, 63 nt, Homo Sapiens
aauggaaaauauggugcaggacugaaauaaaugugcugugaggagaaccgacauaacagaauu

SEQ ID NO: 623948 - RNA, 63 nt, Homo Sapiens
uuucaugucaccuacauauguuugugaaacaguugcugugaacaauccgguguguuaagguga

SEQ ID NO: 623949 - RNA, 63 nt, Homo Sapiens
ugcuauauguagucucguugugugagcucgugcugcugugaccgcagugcuuucagucuucca

SEQ ID NO: 623950 - RNA, 63 nt, Homo Sapiens
cucuuaaaacaaggaguguaguuucauguucucugcugugaaaaaagucuauaaccugaaaau

SEQ ID NO: 623951 - RNA, 63 nt, Homo Sapiens
aacaacaacaaaaaauaaaucccaucaacaaaaugcugugaacaauacgacaguguuccaaau

SEQ ID NO: 623952 - RNA, 63 nt, Homo Sapiens
gagaaguuugccccaauuaauggccguggcagaugcugugauugaacacugcucgcuacaagc

SEQ ID NO: 623953 - RNA, 63 nt, Homo Sapiens
cccaugacaccugcaaaauaaacuuccguccagugcugugauguugguccauggcuacacugc

SEQ ID NO: 623954 - RNA, 63 nt, Homo Sapiens
uuccaaccucagcccaucugacugcagagacaaugcugugagucuaaacuuuuugacgggaac

SEQ ID NO: 623955 - RNA, 63 nt, Homo Sapiens
augaaaauaaaaauggagaggaaaaaaaaauucugcugugaagccucucagauuccccuugug

SEQ ID NO: 623956 - RNA, 63 nt, Homo Sapiens
cuaacagucauugagaggugguaauaccaugggugcugugacacuugauccuguuagcaggug

SEQ ID NO: 623957 - RNA, 63 nt, Homo Sapiens
ugcacacccuccaaccuggguaggcagcucugcugcugugaucguuccugcccuuccugaguc

SEQ ID NO: 623958 - RNA, 63 nt, Homo Sapiens
cuuggcagaugcuagauaaagcacccagcacagugcugugaacaccauguuucugucucccca

SEQ ID NO: 623959 - RNA, 63 nt, Homo Sapiens
cuccacagagccacauucuguggcugaggccaaugcugugaaguuuuucuccagugcaagccc

SEQ ID NO: 623960 - RNA, 63 nt, Homo Sapiens
cugaaagacuugaaaagccucuccugaaguugcugcugugaauccuccaaaccuggccugagc

SEQ ID NO: 623961 - RNA, 63 nt, Homo Sapiens
gguaugccaccaacacugcugugcuuugcuagaugcugugacagaauucauacuagaauucag

SEQ ID NO: 623962 - RNA, 63 nt, Homo Sapiens
guuuuggaaagccaguuuuacagaguacagcuaugcugugacucaauuuugugauuauuagua

SEQ ID NO: 623963 - RNA, 63 nt, Homo Sapiens
acaggcaugagccaccaugccgggcucccaaagugcugugauucaggggugauccacccgccu

SEQ ID NO: 623964 - RNA, 63 nt, Homo Sapiens
ugaacugcagcuauagaaugaauguuuacuuucugcugugaacuugugaggugagagaaaacu

SEQ ID NO: 623965 - RNA, 63 nt, Homo Sapiens
ugcagaagaaaggcuuguuuauauaauaaccagugcugugaaaagauuuuauaaggaaaacaa

SEQ ID NO: 623966 - RNA, 63 nt, Homo Sapiens
ccagauacuuugcacugaaguugucucuaaaauugcugugacuaauuacuagauugcacuagc

SEQ ID NO: 623967 - RNA, 63 nt, Homo Sapiens
ugagggaaucugaaauguuucugcuuauugaugugcugugauaaaagucagucuauguacaua

SEQ ID NO: 623968 - RNA, 63 nt, Homo Sapiens
cauuuugucucuagcuucuagggaaacugugcuugcugugaucuagcguuccuuauucuuuga

SEQ ID NO: 623969 - RNA, 63 nt, Homo Sapiens
uuguacugcaugaucaacuuagaagauuuugacugcugugacucuuuuuguguugcaucaaac

SEQ ID NO: 623970 - RNA, 63 nt, Homo Sapiens
cagcggaaccacuuguacaagaacuucccugugugcugugagcgugaaucugcuuacucacua

SEQ ID NO: 623971 - RNA, 63 nt, Homo Sapiens
aggauaugugcaaccuccauugcccucggucgcugcugugaugcauucuugugacuggcaggc

SEQ ID NO: 623972 - RNA, 63 nt, Homo Sapiens
uacaagcaaacuaaauagccuuuuuuuaagccaugcugugaccccuucauagaucuuuuuucu

SEQ ID NO: 623973 - RNA, 63 nt, Homo Sapiens
cccacagaucaaucucugcagaugacagggaggugcugugagaagugcaccaggcagcuuucu

SEQ ID NO: 623974 - RNA, 63 nt, Homo Sapiens
ggaaccugggcuguggcucucugucguuuguggugcugugauggugucuacuguuagaauagc

SEQ ID NO: 623975 - RNA, 63 nt, Homo Sapiens
ccgggggccccaccuucccacggguucccacgcugcugugacugcccugccucuacgacaaaa

SEQ ID NO: 623976 - RNA, 63 nt, Homo Sapiens
auuauucugauauuuaagagagccaauuuuaacugcugugaaaauguuuccagugcaagagaa

SEQ ID NO: 623977 - RNA, 63 nt, Homo Sapiens
aaauuaaaaauguauuucaaacuauucuuacugugcugugaauuuauaucuucuucugcaaga

SEQ ID NO: 623978 - RNA, 63 nt, Homo Sapiens
ccaccuuccaccaugguucugggcgccugauuuugcugugacucccagacccagccacuguuu

SEQ ID NO: 623979 - RNA, 63 nt, Homo Sapiens
ugcuggacuucugccuuuguuggccugaugugcugcugugaugcugguccuucaucuuaggug

SEQ ID NO: 623980 - RNA, 63 nt, Homo Sapiens
uaaugaggaaguugagguaaugcuuaacauuguugcugugagaauuuacugcccuauguuucc

SEQ ID NO: 623981 - RNA, 63 nt, Homo Sapiens
gaccagaaaugcuugccaguacugccaaagcacugcugugaaaugugaaguacuuuguuuuuu

SEQ ID NO: 623982 - RNA, 63 nt, Homo Sapiens
accucuuccaggcccugaaacaaaaaauacauuugcugugaagauugaaaaugaacaaaguua

SEQ ID NO: 623983 - RNA, 63 nt, Homo Sapiens
aaugagccacgcuucugcauucuucuuagaaacugcugugaaaaacaauuuauguuugcaggg

SEQ ID NO: 623984 - RNA, 63 nt, Homo Sapiens
uguacaggaagcuugcaaauuuucuguacaaugugcugugaaaaaucugaugacuuuaauuuu

SEQ ID NO: 623985 - RNA, 63 nt, Homo Sapiens
aucuuuugaacccaggaguucagggucauagcaugcugugauugugccuacgaauagccacug

SEQ ID NO: 623986 - RNA, 63 nt, Homo Sapiens
ugugccuaauagaagguugagaccagcagagacugcugugaguuucucccggcuccgaggcug

SEQ ID NO: 623987 - RNA, 63 nt, Homo Sapiens
uuuacuuguauauaagccuucucauuugccaugugcugugaucuuacaaguuagauguuacua

SEQ ID NO: 623988 - RNA, 55 nt, Homo Sapiens
uugaagauuuugcuugcuaggacggugcugugacugaaaggacccaggagucugg

SEQ ID NO: 623989 - RNA, 63 nt, Homo Sapiens
guaaaaauauugaauggaacuucuauaugaggaugcugugaucuaaaaauuaaaucucagugg

SEQ ID NO: 623990 - RNA, 63 nt, Homo Sapiens
acaaggcugauuuuaggcagcauguguucacugugcugugauuucaucuacugucucccagaa

SEQ ID NO: 623991 - RNA, 63 nt, Homo Sapiens
ccauccucucugaucugugagaaacagcuaagcugcugugacuucccuuuaggacaauguugu

SEQ ID NO: 623992 - RNA, 63 nt, Homo Sapiens
ggcggccagagccuggggccuccagccugggacugcugugaugggguaucacggugauggucc

SEQ ID NO: 623993 - RNA, 63 nt, Homo Sapiens
cuucauuuuuaaauugugaauggaaucacaaguugcugugauauuaauuuugcuauaaaugug

SEQ ID NO: 623994 - RNA, 63 nt, Homo Sapiens
guaaaaguguacuuuccauuauaucuauauaagugcugugacucaaggguaaaauauauauau

SEQ ID NO: 623995 - RNA, 63 nt, Homo Sapiens
ucuuacuaaaaugaguuuuacacauuaaaauuuugcugugaacauucaguuucaaacucuucu

SEQ ID NO: 623996 - RNA, 63 nt, Homo Sapiens
gaaacaagaagguuauugcaggguuuuguuucuugcugugacugagggguuuucuguuuguuu

SEQ ID NO: 623997 - RNA, 63 nt, Homo Sapiens
agguaaggaagauauuaauuuggaagaugcaauugcugugacauccuguugaucaauuuuuuu

SEQ ID NO: 623998 - RNA, 63 nt, Homo Sapiens
accucaguggcucccucagaaguccccgaucgcugcugugagcagaagaaugaaggacaugcc

SEQ ID NO: 623999 - RNA, 63 nt, Homo Sapiens
uuauacauguugggguuugcccuggcuaccacuugcugugaccugaggggucccacagcuuuu

SEQ ID NO: 624000 - RNA, 63 nt, Homo Sapiens
caugaaauuaaaacagaccuguuaaauaauguaugcugugagaucucuguccagcaccucuug

SEQ ID NO: 624001 - RNA, 63 nt, Homo Sapiens
ugccuuucccugcaguccuucccagggcaaugcugcugugauguggucugggaagccacccac

SEQ ID NO: 624002 - RNA, 63 nt, Homo Sapiens
cuaguguugauuuugcucucaaaugggcacuucugcugugaugaauuuuuaccggauuugcug

SEQ ID NO: 624003 - RNA, 63 nt, Homo Sapiens
gcauauguugugacugucguaguuuuuuuaucuugcugugagaugcaucucugcguauuuuca

SEQ ID NO: 624004 - RNA, 63 nt, Homo Sapiens
guauagcaccaccccagguccucuuuugccugcugcugugaagccaccaggcugucagcugac

SEQ ID NO: 624005 - RNA, 63 nt, Homo Sapiens
uucaaauuuuuagccagguaggaaauuaacuagugcugugauuaacuguaacuguaauguaau

SEQ ID NO: 624006 - RNA, 63 nt, Homo Sapiens
agucuuuagguucauuaaaauuauguacucaucugcugugaaauccuuauuccaguaacauuu

SEQ ID NO: 624007 - RNA, 63 nt, Homo Sapiens
aauccuuguuauaucuauuuagcugaccaaguuugcugugaaauaaaacuaggcuacagguau

SEQ ID NO: 624008 - RNA, 63 nt, Homo Sapiens
cgagaucgugccacugcacugggaggcagagguugcugugagccaggagaaucgcuugaaucu

SEQ ID NO: 624009 - RNA, 63 nt, Homo Sapiens
gcagcuugcuucucucuacacaaaagggagcaaugcugugaauucucuucagaagauaauuuu

SEQ ID NO: 624010 - RNA, 63 nt, Homo Sapiens
caccuaugacaggacguggguaccucgcaugguugcugugagguucauuguaauacucaugcc

SEQ ID NO: 624011 - RNA, 63 nt, Homo Sapiens
agaaauaaauuauuuauacaaaugcauauaugaugcugugaacuuguuuccauagccuuuuau

SEQ ID NO: 624012 - RNA, 63 nt, Homo Sapiens
ggccagcucucggcagccccgaaaacaguggucugcugugaaaauggcccaccauucucacug

SEQ ID NO: 624013 - RNA, 63 nt, Homo Sapiens
gagaugcgcacagguuggggccgucacagugucugcugugauuaccaucuggguccccugugg

SEQ ID NO: 624014 - RNA, 63 nt, Homo Sapiens
cuuuaaagaugccuagugaaaagccuacuaaagugcugugagauugggguuuagaacauuuua

SEQ ID NO: 624015 - RNA, 63 nt, Homo Sapiens
agggcucccacagcugguucccaggccagugagugcugugagaauacaguagcacaaguccuu

SEQ ID NO: 624016 - RNA, 63 nt, Homo Sapiens
cauuguugguucugaacuuuuacaguucaggccugcugugaaucuuugaugaagcuuuaaggu

SEQ ID NO: 624017 - RNA, 63 nt, Homo Sapiens
caguuacucuggugauaguuuucaccuuuauucugcugugaaacaaucaaaucaaagccuugu

SEQ ID NO: 624018 - RNA, 63 nt, Homo Sapiens
gagcuggcuguugcuggacuacaugcuggccacugcugugaccacgacacugcuggggcagcu

SEQ ID NO: 624019 - RNA, 63 nt, Homo Sapiens
uaaaaaaaaugcccccuccuucugcaggagcucugcugugauucauuccaauaaagguacaau

SEQ ID NO: 624020 - RNA, 63 nt, Homo Sapiens
auggauucaagggaaaccuacauuaaggaaaauugcugugaauuaugaaaacaccaaguuuga

SEQ ID NO: 624021 - RNA, 63 nt, Homo Sapiens
ccaguugccuuuuaucccaaaguuguuguaaccugcugugauacgaugcuucaagagaaaaug

SEQ ID NO: 624022 - RNA, 63 nt, Homo Sapiens
gauuuuuuuucccccuuuccccacuuccuugacugcugugaugugaauuaaagauaaauacgu

SEQ ID NO: 624023 - RNA, 63 nt, Homo Sapiens
ucaaggauguuuuccucaguuguuuccuguaagugcugugaccuuuucuggaauccaccuguu

SEQ ID NO: 624024 - RNA, 63 nt, Homo Sapiens
cugaguacgauucaguauguuccuguggaugucugcugugacuaauauaaauuucuugcagaa

SEQ ID NO: 624025 - RNA, 63 nt, Homo Sapiens
ugugucugcagggagccagggcugcggcacaugugcugugaaacuggcacccaccuggcgugc

SEQ ID NO: 624026 - RNA, 63 nt, Homo Sapiens
aaaaaagaugaauacaaacguuuuugcagguucugcugugaaaugugguuugauuuuuuuggu

SEQ ID NO: 624027 - RNA, 63 nt, Homo Sapiens
aaugagauacuguauuaucagaccaggaggcauugcugugaaagauaauuuccuauucuaaaa

SEQ ID NO: 624028 - RNA, 63 nt, Homo Sapiens
aguaaauaaauuuuaugggcgggugccaaauacugcugugaaucuauuuguauaguauccaug

SEQ ID NO: 624029 - RNA, 63 nt, Homo Sapiens
ugcucugugcucacaccucggcugcaugcacccugcugugacggaggcuaguguggaagaggu

SEQ ID NO: 624030 - RNA, 63 nt, Homo Sapiens
ugcccaagauuugacacuggaggccuugggcugugcugugaccuuuuacagcuuaagagagua

SEQ ID NO: 624031 - RNA, 63 nt, Homo Sapiens
caagaucaugccacuccacuaggagguggcgguugcugugagccacaagaaucauuugaaccu

SEQ ID NO: 624032 - RNA, 63 nt, Homo Sapiens
gugacacugcccuccagccucgaggcugcagugugcugugauuaucacuugagcccaggaggu

SEQ ID NO: 624033 - RNA, 63 nt, Homo Sapiens
ucuaaaccugugcuguuauuacauugcuucugcugcugugauuguuuuuucugugcugucugu

SEQ ID NO: 624034 - RNA, 63 nt, Homo Sapiens
uugauagcuuuuauuuucuaaucuuccuuauguugcugugauagaggagcauguccacugagu

SEQ ID NO: 624035 - RNA, 63 nt, Homo Sapiens
uuccuacuguggcccagcugaaaggaaagugcuugcugugauggugugaaacccuacaaugug

SEQ ID NO: 624036 - RNA, 63 nt, Homo Sapiens
uggccuaccugccugccccagccugcaggcagcugcugugagcgagucgcuggagaugagcuc

SEQ ID NO: 624037 - RNA, 63 nt, Homo Sapiens
auaccuugagcacgacgaagugggcuguggcccugcugugaucaguuuuuugagucuugagcu

SEQ ID NO: 624038 - RNA, 63 nt, Homo Sapiens
agcagggcgagagugcccagggugugaggaccaugcugugagccagguaaggcggaggcugcu

SEQ ID NO: 624039 - RNA, 63 nt, Homo Sapiens
acuguauuaauuuugguuuauguuuaagaacugugcugugaucuuuagauuguaugccacuuu

SEQ ID NO: 624040 - RNA, 63 nt, Homo Sapiens
gccauuggaagacuguccucagaaaacgggcaaugcugugagacauggcaagaaggaaauggc

SEQ ID NO: 624041 - RNA, 63 nt, Homo Sapiens
ugcacugaaaaaaauccucaccuuguucauuuuugcugugaaauacaacaauuuuaaugauuc

SEQ ID NO: 624042 - RNA, 63 nt, Homo Sapiens
guguccccuuacugagcgcauugaggccgaagcugcugugacucccagaucgcucccuuggcu

SEQ ID NO: 624043 - RNA, 63 nt, Homo Sapiens
ucaccacucuuuccugaugccgccucccuccuuugcugugacaaugugcauguucuuagccac

SEQ ID NO: 624044 - RNA, 63 nt, Homo Sapiens
auuuucugccaaagaccaugaaaguauuuuuugugcugugaacuaauauuugguauuucuuuu

SEQ ID NO: 624045 - RNA, 63 nt, Homo Sapiens
ggaucacauuuguugugguggggucuuuagaccugcugugaaauuaugcuuuguugccucuga

SEQ ID NO: 624046 - RNA, 63 nt, Homo Sapiens
uauucagugcauuauaagaacugaauuauguuaugcugugaauuuauaugguauguaacaaau

SEQ ID NO: 624047 - RNA, 63 nt, Homo Sapiens
augcuaaguucuaggcuggaaauaagggcaaaaugcugugaaagaagaggaaauguuuacuuc

SEQ ID NO: 624048 - RNA, 63 nt, Homo Sapiens
guguaucuucuuugucccaauuaaacaguugcuugcugugauguaaucuuaaaauaucuuugu

SEQ ID NO: 624049 - RNA, 63 nt, Homo Sapiens
gccuuauuuuguuggugcuuugcauuuugauauugcugugagccuugcaugacaucaugaggc

SEQ ID NO: 624050 - RNA, 63 nt, Homo Sapiens
acauagauauauaagugaucucaguuucuuguuugcugugauacuaauguguuguuuuaacuu

SEQ ID NO: 624051 - RNA, 63 nt, Homo Sapiens
aggaagucacagaaacaugucucaauucccaugugcugugacuguagacugucuuaccauaga

SEQ ID NO: 624052 - RNA, 63 nt, Homo Sapiens
acacauuuacuguccaauuuaaaacuuuggaauugcugugauuaaagugaucaaaaugccaaa

SEQ ID NO: 624053 - RNA, 63 nt, Homo Sapiens
gaugagaccucagcucagccucagggcccagggugcugugaccgguggccaccugcaccagcg

SEQ ID NO: 624054 - RNA, 63 nt, Homo Sapiens
gcucugagaauuuguguugguaaacguucuugcugcugugacuuuauucaccuauuuuuauaa

SEQ ID NO: 624055 - RNA, 63 nt, Homo Sapiens
aggauuucaugcaguggucuuugaccacgucucugcugugaauccucacucccucugugugug

SEQ ID NO: 624056 - RNA, 63 nt, Homo Sapiens
cuuaaaaaaaaaaaaaaaaaacuuugcuuggauugcugugauuugauaccuacucagugaggu

SEQ ID NO: 624057 - RNA, 63 nt, Homo Sapiens
agcguguguacacauaaacccauuuuaucugcuugcugugaccaguuugugaaaugaugaggg

SEQ ID NO: 624058 - RNA, 63 nt, Homo Sapiens
uauugauguauuacauuauuugucuuauuuagaugcugugaaugauaugguucugaguuauag

SEQ ID NO: 624059 - RNA, 63 nt, Homo Sapiens
gcagaauguaaaauugguaaaugggauggcaaaugcugugaauugguggcuuuaaguguagag

SEQ ID NO: 624060 - RNA, 63 nt, Homo Sapiens
uuuggaauucaguauuaucauagucaucuguuaugcugugaaauugauuaggguaguauauua

SEQ ID NO: 624061 - RNA, 63 nt, Homo Sapiens
ucucuguguggaaugccuugccuuuauuuauugugcugugaucuuguguggcaaaugagaaau

SEQ ID NO: 624062 - RNA, 63 nt, Homo Sapiens
ucacauccucucaccaugcgcagggacugcucaugcugugacguuaucugacaaugggacaac

SEQ ID NO: 624063 - RNA, 63 nt, Homo Sapiens
uuuuagucccagacugaauuuuuauuuuuuuucugcugugacgaaaaaagcaaauuauuuuuu

SEQ ID NO: 624064 - RNA, 63 nt, Homo Sapiens
cuggggacgacauggcaggcgaguagccgccgcugcugugagccugccaccaaaccaccagca

SEQ ID NO: 624065 - RNA, 63 nt, Homo Sapiens
uuauuaaaucuaguugucacuuuauuuuggaccugcugugaucucgacaggaaacgugccaca

SEQ ID NO: 624066 - RNA, 63 nt, Homo Sapiens
cacaauaacuuuacauuccuagcuuuacagucuugcugugaauucucugguguucauuaaagu

SEQ ID NO: 624067 - RNA, 63 nt, Homo Sapiens
cgagaagaacugggcgacucccagucccaccugugcugugacagucccacguggcuaugacag

SEQ ID NO: 624068 - RNA, 63 nt, Homo Sapiens
uagccuggaggggcuugaguggaugggagcugaugcugugauuuugagcugugguuacaugca

SEQ ID NO: 624069 - RNA, 63 nt, Homo Sapiens
ucucuucauuauucucugcuauauauaaaacggugcugugagggaggggaaaagcauuuuuca

SEQ ID NO: 624070 - RNA, 63 nt, Homo Sapiens
auuucauuuugggguacagcaggguguuuuaagugcugugacuucagcuaaugaucuuuucuu

SEQ ID NO: 624071 - RNA, 63 nt, Homo Sapiens
gcaaaccaauggugauccucuauuuugugaugaugcugugacaauaaguuugaaccuuuuuuu

SEQ ID NO: 624072 - RNA, 63 nt, Homo Sapiens
ccacggaacguugucaagagguagugagauuguugcugugagcaaggcucugggagagucacc

SEQ ID NO: 624073 - RNA, 63 nt, Homo Sapiens
accucauguuccacccgccacggccucccaaagugcugugauuaccggugugagccacugcgc

SEQ ID NO: 624074 - RNA, 63 nt, Homo Sapiens
aaaauguuauauuaauggaguuauugcuauuuuugcugugauaaugguauuaugcaagaccau

SEQ ID NO: 624075 - RNA, 63 nt, Homo Sapiens
caagcuggaguuuuuaaucuggacucucuggcuugcugugaccccuaaggcaaugcuucucuu

SEQ ID NO: 624076 - RNA, 63 nt, Homo Sapiens
cugguauuccacauccaauauggauuucuagaaugcugugauuaaaggagccagccaggugua

SEQ ID NO: 624077 - RNA, 63 nt, Homo Sapiens
gaguuaaguaagauuagagugagugugcucuguugcugugaugcugucagccacagcuuccug

SEQ ID NO: 624078 - RNA, 63 nt, Homo Sapiens
ugcaaccgacugacguuacuguaguuccuagaaugcugugagggcgggggguucagaucaaca

SEQ ID NO: 624079 - RNA, 63 nt, Homo Sapiens
accauucaagcccaggaguuccagccugaaguaugcugugaucaugccugugaauaaccacug

SEQ ID NO: 624080 - RNA, 63 nt, Homo Sapiens
guauugcgggauucagagauguacaguacacucugcugugaugcucuuaucauuuaaaguggu

SEQ ID NO: 624081 - RNA, 63 nt, Homo Sapiens
gguuuugcaagccuuuucauaaucauguuuucuugcugugauacacugaccagcccaaaucau

SEQ ID NO: 624082 - RNA, 63 nt, Homo Sapiens
uuuuaauaaaaagcaaaagguguucucuaggcaugcugugacacuuuaugcagccauauaaac

SEQ ID NO: 624083 - RNA, 63 nt, Homo Sapiens
uaggugaauuuucaauuuaaauuuaaacauaagugcugugacuaugagcaacagaggguccuu

SEQ ID NO: 624084 - RNA, 63 nt, Homo Sapiens
guggauucuucccacacagauuggaaaugaaacugcugugaauuauauuuuauagaaccauca

SEQ ID NO: 624085 - RNA, 63 nt, Homo Sapiens
ggcacagagcccuuuccgcagagggucagaugcugcugugagaacaccgaaugacucagucca

SEQ ID NO: 624086 - RNA, 63 nt, Homo Sapiens
uaaaauaucuaauuauauuuaggaagucaaaaaugcugugauuaccaaaaacuccuuuucccu

SEQ ID NO: 624087 - RNA, 63 nt, Homo Sapiens
aagaaaaguugaauaagaguaucuauaaacagcugcugugaaguucauucuuggcucccuacu

SEQ ID NO: 624088 - RNA, 63 nt, Homo Sapiens
aacgaguaacuccaaguacagcaggcuggucccugcugugauuugacauggaaauagaugcag

SEQ ID NO: 624089 - RNA, 63 nt, Homo Sapiens
accgcucuccucugacuuggggagggucugugcugcugugagagacuggauucaacuugcuug

SEQ ID NO: 624090 - RNA, 63 nt, Homo Sapiens
ucccugccaaggccauugccgugccauguguuuugcugugaugaaagauagcuguaugcucaa

SEQ ID NO: 624091 - RNA, 63 nt, Homo Sapiens
gcugagucugguucccuagggcucuguguuggcugcugugaggacagugaacucaggcagcug

SEQ ID NO: 624092 - RNA, 63 nt, Homo Sapiens
ccaagucccuugugaccacucuuguccccccugugcugugagcaaggccacccucuccagccc

SEQ ID NO: 624093 - RNA, 63 nt, Homo Sapiens
ccccauagugaguaucccuccucugugugcucaugcugugaaucccccccauucuaccacuuc

SEQ ID NO: 624094 - RNA, 63 nt, Homo Sapiens
auacguauucucuuuugucucuucauuuauaacugcugugaauuguacauuucuguguuuuuu

SEQ ID NO: 624095 - RNA, 63 nt, Homo Sapiens
aacaggcuuuaggcaaguggaaaauucaaaaugugcugugaaaggacaaucucaggcugaaau

SEQ ID NO: 624096 - RNA, 63 nt, Homo Sapiens
agaccacccugccccaccugccccuucccccuuugcugugacacuucuucaucucaccccccc

SEQ ID NO: 624097 - RNA, 63 nt, Homo Sapiens
uauuaccuguucugcuucaccaggagaucaugcugcugugauacugaguuuucuaaacagcau

SEQ ID NO: 624098 - RNA, 63 nt, Homo Sapiens
uguggcacggggccuaugugucucugucgcgucugcugugaagcacaugaugcucuauuuauu

SEQ ID NO: 624099 - RNA, 63 nt, Homo Sapiens
gcagcuauaguugaacaagcagucuuuaaaaacugcugugaaacacaggccaucagggaaaac

SEQ ID NO: 624100 - RNA, 63 nt, Homo Sapiens
gcuucagcaccuccagguugguucuggguguccugcugugagggguagaacgggaggcugcug

SEQ ID NO: 624101 - RNA, 63 nt, Homo Sapiens
cacuuuccuucaggcucugugaauacuucaaccugcugugauuuggggccguuuguacucugc

SEQ ID NO: 624102 - RNA, 63 nt, Homo Sapiens
gagcuuguauauacuucacucacuuuucuuuauugcugugaauagucugugugcacaaugggc

SEQ ID NO: 624103 - RNA, 63 nt, Homo Sapiens
cauguggaguuguugggcgagagguguucucugugcugugaauucaguggggagcuguagcgg

SEQ ID NO: 624104 - RNA, 63 nt, Homo Sapiens
uuuugguguguuucuguugauuucuuuuuuguaugcugugauaaaagagaaaugaaaagugcc

SEQ ID NO: 624105 - RNA, 63 nt, Homo Sapiens
uagacugccaguugucuagugacaucugaugcuugcugugaacuuuuaagauccccgaauccu

SEQ ID NO: 624106 - RNA, 63 nt, Homo Sapiens
aauaacaaaaucacuguaccuuccucucaauuuugcugugaaccugaaauggcuuuaaauuaa

SEQ ID NO: 624107 - RNA, 63 nt, Homo Sapiens
ucucuucuguguuuagguauucucugccacucuugcugugaaauugaagugcauguagaaaaa

SEQ ID NO: 624108 - RNA, 63 nt, Homo Sapiens
auguuugcaguauagguuccuggcuacuguuuaugcugugauuucacucugucuaucaugggc

SEQ ID NO: 624109 - RNA, 63 nt, Homo Sapiens
uaauuugucauuuuugauguaaaauauaaucacugcugugauaaauaaacuaucuauugauca

SEQ ID NO: 624110 - RNA, 63 nt, Homo Sapiens
acuucucucagugugagaggcuggagcuucuguugcugugaauagauaccuucacggccgcug

SEQ ID NO: 624111 - RNA, 50 nt, Homo Sapiens
auucuccuuugagauuucagugcugugagaaaauggcaaccuuaauguag

SEQ ID NO: 624112 - RNA, 63 nt, Homo Sapiens
augaggaggagaugucuguuuucaacuguucuaugcugugacguaaaauaggucuuuguuauu

SEQ ID NO: 624113 - RNA, 63 nt, Homo Sapiens
uacucuuccuccccuucucuuuuaacuagcaaaugcugugaauagaggacugaaaaaacaaau

SEQ ID NO: 624114 - RNA, 63 nt, Homo Sapiens
cacugaaaaugugcugggguacuuucucugaucugcugugaucacauacucaaaagcuguuac

SEQ ID NO: 624115 - RNA, 63 nt, Homo Sapiens
ugacuuauaugagguuccaggcugcaaacccagugcugugagggaggagaaaaaauguagcug

SEQ ID NO: 624116 - RNA, 63 nt, Homo Sapiens
auggacaauuacauaguaccacuaauaucauagugcugugaugcugacugauagacucugagc

SEQ ID NO: 624117 - RNA, 63 nt, Homo Sapiens
auuguaucuagcaguuauauguugaaacaaugcugcugugaacuuuguuuauuuguuuuugcu

SEQ ID NO: 624118 - RNA, 63 nt, Homo Sapiens
acaggugugagccacugcaccgaccucccaaagugcugugauuaccucaugauccacccgccu

SEQ ID NO: 624119 - RNA, 63 nt, Homo Sapiens
auaggccagagccauuguuccacccucccaaaaugcugugauuucaaacucccgaucucaagc

SEQ ID NO: 624120 - RNA, 63 nt, Homo Sapiens
gaguguccuuucccaucuguacuggagcaaagcugcugugagaucgcaguguugggcuuggug

SEQ ID NO: 624121 - RNA, 63 nt, Homo Sapiens
uuaaaacugcucuaaaaaaauuccucuccauuuugcugugaacaugugggaaaucucuguacc

SEQ ID NO: 624122 - RNA, 63 nt, Homo Sapiens
aacaacuuaaaaguaagaagcuggguccaggaaugcugugaggaguaaccacugaccugugag

SEQ ID NO: 624123 - RNA, 63 nt, Homo Sapiens
cagcgaguggcacacagcaugccucauguguccugcugugaugaugcacagcagcacauaugu

SEQ ID NO: 624124 - RNA, 63 nt, Homo Sapiens
aauugaaguguuguugcuauggugacguccuuuugcugugaauaaaggugcucuuugcagcaa

SEQ ID NO: 624125 - RNA, 63 nt, Homo Sapiens
ggccugggcugccgacaccugggccagagccccugcugugauuggugcucccugggccucccg

SEQ ID NO: 624126 - RNA, 63 nt, Homo Sapiens
cccacacacacaguuuuugucuaaugaaaauguugcugugauuauuuauaauugguaguauuu

SEQ ID NO: 624127 - RNA, 63 nt, Homo Sapiens
acuguauguuauuggcacguguuguuuacauuuugcugugacauuuaaaaauauuucuuuaaa

SEQ ID NO: 624128 - RNA, 63 nt, Homo Sapiens
accuguuaucccuacgcuucccagagagaacaaugcugugagagaguuuagcauugugucacu

SEQ ID NO: 624129 - RNA, 63 nt, Homo Sapiens
ugguuauuacccuguguaccuugucccucauuuugcugugacacccugaaaaagcugaccaca

SEQ ID NO: 624130 - RNA, 63 nt, Homo Sapiens
aaagauaggcaggggcucuuggaagacguuccgugcugugaccuccgagcccuccugguggga

SEQ ID NO: 624131 - RNA, 63 nt, Homo Sapiens
aggccugagcgcugcccugcaccuccgcagaccugcugugaugacuugccauuaaaagcauug

SEQ ID NO: 624132 - RNA, 63 nt, Homo Sapiens
gugugcacgcaugaccguguggguggcggcguuugcugugaaccacgcucaggccacacagag

SEQ ID NO: 624133 - RNA, 63 nt, Homo Sapiens
agccacacaagccuuauguucucaucucaaaaaugcugugacagcuuuuuggcugcuuuaacc

SEQ ID NO: 624134 - RNA, 63 nt, Homo Sapiens
cucuuguauucgguguccauucaguaucaguauugcugugauauuuugggugccauauugugc

SEQ ID NO: 624135 - RNA, 63 nt, Homo Sapiens
guuugccacagccucugccuggaaccuggcucgugcugugaccagaagggaaaggcggcuguu

SEQ ID NO: 624136 - RNA, 63 nt, Homo Sapiens
ccugcucaguaaagcacuugcaaccgucuguuaugcugugacacauggccccucccccugcca

SEQ ID NO: 624137 - RNA, 63 nt, Homo Sapiens
cuuugcacaggagccuguuucuaaagaaacccaugcugugaaauagagacuuuucuacugauc

SEQ ID NO: 624138 - RNA, 63 nt, Homo Sapiens
aacuacuccacguguuuuuccauccaaucacacugcugugauucagggaucuuucuucuaaga

SEQ ID NO: 624139 - RNA, 63 nt, Homo Sapiens
uuuuucagugagcguggugacugcagagguuagugcugugaaaagcugggcuaaauauucuuu

SEQ ID NO: 624140 - RNA, 63 nt, Homo Sapiens
ucucccagggcagaggggcgagggagaggcuuuugcugugagaguagccgucacgugucucuu

SEQ ID NO: 624141 - RNA, 63 nt, Homo Sapiens
uccucuuggacuugagggcauugugaaaagcuuugcugugauuuaaaaaugccagcaauuuua

SEQ ID NO: 624142 - RNA, 63 nt, Homo Sapiens
aaacauacuucuuguguaaaaauagaagauuccugcugugaauaacuugaaaaaaaaaaaaga

SEQ ID NO: 624143 - RNA, 63 nt, Homo Sapiens
ggagaaagggagagaaaacuaucuuggaauauuugcugugaaggagaagguacugaaauaaug

SEQ ID NO: 624144 - RNA, 63 nt, Homo Sapiens
auuuaaauguguuagauggaauguuugcaauuaugcugugagaucgugggaaccaauauguac

SEQ ID NO: 624145 - RNA, 63 nt, Homo Sapiens
acugucaaagaguaucuggccacauguucugugugcugugacggcaccauuauguuuacuaau

SEQ ID NO: 624146 - RNA, 63 nt, Homo Sapiens
ccagcagggucgccucccucaacgacgauuugcugcugugaacugacuaguuuguuggacuua

SEQ ID NO: 624147 - RNA, 63 nt, Homo Sapiens
augucuuccucucggacccuguucccgguggugugcugugaaguagugguguuuccuccuagg

SEQ ID NO: 624148 - RNA, 63 nt, Homo Sapiens
auagugggugugacaauggaaaacaccccuuccugcugugaggauuguuaaaaacuagacucu

SEQ ID NO: 624149 - RNA, 63 nt, Homo Sapiens
cugaaauagugaacuuuucucccccaccuuuuuugcugugaaaaucuauuggguuccccccuc

SEQ ID NO: 624150 - RNA, 63 nt, Homo Sapiens
uaaacuuagggugcugagaugagcaguaguggcugcugugauguuugguagcccuaacugucu

SEQ ID NO: 624151 - RNA, 63 nt, Homo Sapiens
ccucucucucaaaauaaacuaaccuauucauauugcugugaaugcuuuaucuuggagauagaa

SEQ ID NO: 624152 - RNA, 63 nt, Homo Sapiens
caaacagugguccuaaaauacgaggucuucacuugcugugaaugacguauccccagucaggga

SEQ ID NO: 624153 - RNA, 63 nt, Homo Sapiens
cggugcaccuggugacccuggguggaggggacuugcugugaagucuuccucgcccucugcccu

SEQ ID NO: 624154 - RNA, 63 nt, Homo Sapiens
cacaacucaauuauuucggcaucuuuucaccuaugcugugauuuguuuuuuuuuuuucuucuc

SEQ ID NO: 624155 - RNA, 63 nt, Homo Sapiens
auuuaauuuuuuaauuuuaauuuuuaauuuuuuugcugugaaggucaagcugaaauuuaccau

SEQ ID NO: 624156 - RNA, 63 nt, Homo Sapiens
agauggucguaggggagcguguggggcauaaagugcugugaacuuuuccaucuuguuguuuua

SEQ ID NO: 624157 - RNA, 63 nt, Homo Sapiens
caaaauaugguacaugcuggauaguaguuauguugcugugaaaacuguagggucaaagccuua

SEQ ID NO: 624158 - RNA, 63 nt, Homo Sapiens
aaauaaaaccaaguucuugacauuggucuguuuugcugugaauauuggaaaugcuuaggaucu

SEQ ID NO: 624159 - RNA, 63 nt, Homo Sapiens
uuuugcuucuaggauauaguauguuguauaugaugcugugauugcccuggaguuccugccaug

SEQ ID NO: 624160 - RNA, 63 nt, Homo Sapiens
gggaugagugacuuuauugauuugagcagcauaugcugugauuggcugcccugcaaauuuguu

SEQ ID NO: 624161 - RNA, 63 nt, Homo Sapiens
cacugagcugacgcacauuuccacguguaucucugcugugacaaagcugcugugcuuccccgu

SEQ ID NO: 624162 - RNA, 63 nt, Homo Sapiens
auuugucuuccucaccagccugcuuccuuuagcugcugugagaccccugacuuaucccaagca

SEQ ID NO: 624163 - RNA, 63 nt, Homo Sapiens
uugauuaaacuugagcugugugcaccuucccgcugcugugagguuuaugggaagacagaguga

SEQ ID NO: 624164 - RNA, 63 nt, Homo Sapiens
uagucuauggauuuauuccaaacaauuuaugcaugcugugacuaaaugagcaguuaagauaua

SEQ ID NO: 624165 - RNA, 63 nt, Homo Sapiens
ugcugcgcucuaguaacugcuauguugguuuuuugcugugaagaauuuggaccauucagauuu

SEQ ID NO: 624166 - RNA, 63 nt, Homo Sapiens
ugagaucgccccacugcuuuaggagacggagguugcugugagcuggcaggaugguuugagcac

SEQ ID NO: 624167 - RNA, 63 nt, Homo Sapiens
aagaacucccuaccugugagauuuaaaguuucuugcugugaaaaauaaaacaugacuuuguuu

SEQ ID NO: 624168 - RNA, 63 nt, Homo Sapiens
aggcuacaaaggccaggcuguaccgacguugcaugcugugagguuagcuagcauuagcauaau

SEQ ID NO: 624169 - RNA, 63 nt, Homo Sapiens
gauugcccuagccaauucacuuacagaaaguagugcugugauuaucacugaacuacuaaaguu

SEQ ID NO: 624170 - RNA, 63 nt, Homo Sapiens
aacaaauaccaacugugcaauucaaguccuuacugcugugaagcacaaguuucacgauucuca

SEQ ID NO: 624171 - RNA, 63 nt, Homo Sapiens
guccuuaugggugcaagagacucgcccagucuaugcugugaguucaguccagagaugcuggcc

SEQ ID NO: 624172 - RNA, 63 nt, Homo Sapiens
uugucccuugccuuccugccggccaugcaagggugcugugauuuggcuccaggcuccucauga

SEQ ID NO: 624173 - RNA, 63 nt, Homo Sapiens
cucagccauaaaaaggaaugaaguacugacacaugcugugacaucagugaacccugaaaacau

SEQ ID NO: 624174 - RNA, 63 nt, Homo Sapiens
uuaaggacaauuuacagcaaaugaaauuuaugaugcugugacaagaaauuuaaagaaucaaaa

SEQ ID NO: 624175 - RNA, 63 nt, Homo Sapiens
cucugaaaaggccugggagcagaauggcuggccugcugugagcaggagaggagauucuaagaa

SEQ ID NO: 624176 - RNA, 63 nt, Homo Sapiens
auuaccuuugcuccucuccugugauucccaccaugcugugacccucagcugucucccuuugcu

SEQ ID NO: 624177 - RNA, 63 nt, Homo Sapiens
cuuagccuccugagcaucugggacuacagccauugcugugaauuacgugagggaaagauauug

SEQ ID NO: 624178 - RNA, 63 nt, Homo Sapiens
cugcauucugcgagucugugcucauuaacaaugugcugugaccaugugacucagcaauccugc

SEQ ID NO: 624179 - RNA, 63 nt, Homo Sapiens
gggcccaggcauggucuugugucuuaagacagcugcugugaccaaagggagaauggagauaac

SEQ ID NO: 624180 - RNA, 63 nt, Homo Sapiens
ggcggcugcuguuuccacacguggacucggaucugcugugacaccgucagcccgacagucucu

SEQ ID NO: 624181 - RNA, 63 nt, Homo Sapiens
uggggucuucucuguggcugguagacaccaagcugcugugacugaccacgguaccacgggcug

SEQ ID NO: 624182 - RNA, 63 nt, Homo Sapiens
ugucacugcccccuccccagccuguguccacagugcugugaucccgagggaaguccuccaguc

SEQ ID NO: 624183 - RNA, 63 nt, Homo Sapiens
ucuuaggcccggccacuucugcuaccuuugcgcugcugugagccucacccugggccccugggc

SEQ ID NO: 624184 - RNA, 63 nt, Homo Sapiens
ggugugcccauacagacauuccccggagccggcugcugugaacucgcccccguguggauaguc

SEQ ID NO: 624185 - RNA, 63 nt, Homo Sapiens
gccaugcuguccagcacgggggccgcuggugcuugcugugagacugagcugggcucugagugu

SEQ ID NO: 624186 - RNA, 63 nt, Homo Sapiens
aaugacagauguggggccucugugggaagggacugcugugaaggcuuccccuucccucuagca

SEQ ID NO: 624187 - RNA, 63 nt, Homo Sapiens
cccagcuucccuuuccacagcaauuaaaaagcaugcugugaugacuuaaugaaauguuaaagc

SEQ ID NO: 624188 - RNA, 63 nt, Homo Sapiens
gagagacagagaacucugggagaagaguccaucugcugugaagguaaauuaacagccaccuau

SEQ ID NO: 624189 - RNA, 63 nt, Homo Sapiens
cucaaaugagccaaagguuaacuaccuaccaagugcugugagguauaaaauggggauaauagc

SEQ ID NO: 624190 - RNA, 63 nt, Homo Sapiens
gaggccuccuucgguccaggccccucacagaggugcugugagcgacuucccaggagcaccagu

SEQ ID NO: 624191 - RNA, 63 nt, Homo Sapiens
uuacuucugaugguagagaaccaauaaguuuauugcugugaaauucaaguaugucuguuguaa

SEQ ID NO: 624192 - RNA, 63 nt, Homo Sapiens
agccaaugugaauuucuacccagaacugaagugugcugugacauaugcguuucauguagccag

SEQ ID NO: 624193 - RNA, 63 nt, Homo Sapiens
cuguccagaugugccucuuugucacacguuccgugcugugaagcgggacccacggggaccaag

SEQ ID NO: 624194 - RNA, 63 nt, Homo Sapiens
uugugccaaaggucacuuuucuuuccugccuucugcugugagcccugagauccuccucccagc

SEQ ID NO: 624195 - RNA, 63 nt, Homo Sapiens
ugacucauauccccuauuuaacagggucucuagugcugugaaaaaaaaaaugcugaacauugc

SEQ ID NO: 624196 - RNA, 63 nt, Homo Sapiens
augucccacuuuuuuaaccacuccgcacaucagugcugugaaggcaaccucaccauguauuuu

SEQ ID NO: 624197 - RNA, 63 nt, Homo Sapiens
uaaugucauacaaaaaauguauuuguuuuuuugugcugugagaauugauguuuguagauuaau

SEQ ID NO: 624198 - RNA, 63 nt, Homo Sapiens
uccuugcuuuucauggaaacacaguaaccuguaugcugugauuccuguucacuacuguguaaa

SEQ ID NO: 624199 - RNA, 63 nt, Homo Sapiens
cugcagaugucuaacacauaagccaggacauucugcugugagugacuuauuguacccaacucu

SEQ ID NO: 624200 - RNA, 63 nt, Homo Sapiens
gagucccagaauugcugacagcagaggcuuugcugcugugaaucccaccugccaccagccugc

SEQ ID NO: 624201 - RNA, 63 nt, Homo Sapiens
cagaaccagaccccgagccacucgcuuccucugugcugugacaacauuggugccaggggagau

SEQ ID NO: 624202 - RNA, 63 nt, Homo Sapiens
cacgucucccucauauacacagacccaggauuaugcugugagccugcaggcuuuggaaguggc

SEQ ID NO: 624203 - RNA, 63 nt, Homo Sapiens
cccacccucugguccuucugaccccacuuaugcugcugugaauuuuuuuuuuaaaugauucca

SEQ ID NO: 624204 - RNA, 63 nt, Homo Sapiens
uugaauuccuccacuuucuuauauagccucagaugcugugaugucugaccuuguggauauuug

SEQ ID NO: 624205 - RNA, 63 nt, Homo Sapiens
ccggcccugccuguagauacgccccgcugucugugcugugagagucgccgcucgcuggggggg

SEQ ID NO: 624206 - RNA, 63 nt, Homo Sapiens
uuugcagaguuuuaaguuguucugucugaacucugcugugaucccaugaugugacccugaugg

SEQ ID NO: 624207 - RNA, 63 nt, Homo Sapiens
aacuaaggugcuaaaucugcgaucaucgucauuugcugugaacugaaauuaaaacuauucaug

SEQ ID NO: 624208 - RNA, 63 nt, Homo Sapiens
gagaaguauguaguaccucgguauuaacagaccugcugugaugcaguuacacuuucacguauu

SEQ ID NO: 624209 - RNA, 63 nt, Homo Sapiens
ccuggaggcagagcuugcagugaggcaggagaaugcugugaacgucccagcuacucaggaggc

SEQ ID NO: 624210 - RNA, 63 nt, Homo Sapiens
aggucagcaggaacccuuuucauagcaguacuuugcugugagcacauauucaauucuugcuaa

SEQ ID NO: 624211 - RNA, 63 nt, Homo Sapiens
aaaauccuggauggcugaccggagauuuugauuugcugugauguacaauuaguuugaaaaauu

SEQ ID NO: 624212 - RNA, 63 nt, Homo Sapiens
aaucuaaaaucaaccaggcuccaagcaugauuuugcugugacauucugccaggccucgagcau

SEQ ID NO: 624213 - RNA, 63 nt, Homo Sapiens
auucuaagaucaaccagguuagcaugaugauuuugcugugacaugccaggccccaagcaucug

SEQ ID NO: 624214 - RNA, 63 nt, Homo Sapiens
auaaugcccccuuuccccuuugaauggguugauugcugugaaagauuucauuaauggaucuug

SEQ ID NO: 624215 - RNA, 59 nt, Homo Sapiens
cugcugucucuaaccaccaaaggugguuaugcugugacgagggcacacugacagccuag

SEQ ID NO: 624216 - RNA, 63 nt, Homo Sapiens
agcucagcuccaaacacaggagcugaaagaagcugcugugagggaacacuauuccuauaagau

SEQ ID NO: 624217 - RNA, 63 nt, Homo Sapiens
aauccaauauacucagaaugcuaaaguaaauucugcugugacuaauuuguagaacucaucuaa

SEQ ID NO: 624218 - RNA, 63 nt, Homo Sapiens
uguguucgagccacuacacuagguguucaaggcugcugugagcuggaaggaccgcuuaagccc

SEQ ID NO: 624219 - RNA, 63 nt, Homo Sapiens
uccuuguacugucuuaaguugcuguguuuucugugcugugaugcugcagaauagauuuaaguc

SEQ ID NO: 624220 - RNA, 63 nt, Homo Sapiens
ccauagguacuagacaaccaaaguuauugcuacugcugugaggcuucucccuuuuaucccaau

SEQ ID NO: 624221 - RNA, 63 nt, Homo Sapiens
caucaugugggucuuuuguuuuaagccuaccucugcugugaccggugaacaggauuguuacuu

SEQ ID NO: 624222 - RNA, 63 nt, Homo Sapiens
uucuguuguacuuuaauuauuguuuugccuuguugcugugaccucccuaagacacugaagaua

SEQ ID NO: 624223 - RNA, 63 nt, Homo Sapiens
aaaaagucaucuguucauuaggagaacucaaguugcugugacuuuucucauccaaaagacuca

SEQ ID NO: 624224 - RNA, 63 nt, Homo Sapiens
aaauaucuguacuucuucgaucuucaccuuuugugcugugauucuucaguuucuaaaccagca

SEQ ID NO: 624225 - RNA, 63 nt, Homo Sapiens
aauccuauuuauauuauuuuucaguccugugaaugcugugaaaagauuuauuccuuugaggcc

SEQ ID NO: 624226 - RNA, 63 nt, Homo Sapiens
guguguguguguguguauauauauauauaugcaugcugugaaacuugacuacacaacauaaau

SEQ ID NO: 624227 - RNA, 63 nt, Homo Sapiens
ccuggccccuugcuguucccaagugcacgaugcugcugugacugaggaguggaugaugcucgu

SEQ ID NO: 624228 - RNA, 63 nt, Homo Sapiens
caucgagaggucuggaugguuuuauagcaacuuugcugugauuccguuuguaucuguaaauau

SEQ ID NO: 624229 - RNA, 63 nt, Homo Sapiens
aaggauccucaccacccaaaggguggugggcacugcugugaccaccccagcugcagagucagu

SEQ ID NO: 624230 - RNA, 63 nt, Homo Sapiens
gcuuuaggcaccaucuguucccaucgcgccugcugcugugacccguuuuggaaaacuggugug

SEQ ID NO: 624231 - RNA, 63 nt, Homo Sapiens
gucaugagaaugcaacaggagcaaaccaaguguugcugugacauugauucagauguuuggcaa

SEQ ID NO: 624232 - RNA, 59 nt, Homo Sapiens
aggggcuggcggccgccugagaccugagcugcugugaaagccccugcacaaucagccag

SEQ ID NO: 624233 - RNA, 63 nt, Homo Sapiens
ucucggccuugggaaggaaggcagugccugcucugcugugagccgccaggaacccuccuccug

SEQ ID NO: 624234 - RNA, 63 nt, Homo Sapiens
gaucauuucaugaggaucuuuccuuugacugggugcugugaggacacaccugggucugugccu

SEQ ID NO: 624235 - RNA, 63 nt, Homo Sapiens
caagcaggcugcauuuuagcuauggaagugaccugcugugacacugugcucucuucugugggc

SEQ ID NO: 624236 - RNA, 63 nt, Homo Sapiens
gaggaaugauccuagugguaggucagaagaagaugcugugaacaccaggacuuuaaucuuaug

SEQ ID NO: 624237 - RNA, 63 nt, Homo Sapiens
auuugcuacugucauuuccucuaguaucacuuuugcugugaugauguguucuuguguauuaua

SEQ ID NO: 624238 - RNA, 63 nt, Homo Sapiens
aggcugugcccauguggggcgcguguugaggggugcugugagaucccacaagcccaccgcugu

SEQ ID NO: 624239 - RNA, 63 nt, Homo Sapiens
cgaagcucucccugccccgcaccgggcgaucccugcugugagcgaagccccauccccccugcc

SEQ ID NO: 624240 - RNA, 63 nt, Homo Sapiens
cuggccccugcccagggcuucccuaacgcgcuuugcugugagcgacgaaaacucacgcccuug

SEQ ID NO: 624241 - RNA, 63 nt, Homo Sapiens
uugacuugacucccaacccuccuaacccugaaaugcugugagcugcugcagacagcuuaucuc

SEQ ID NO: 624242 - RNA, 63 nt, Homo Sapiens
aagugaacacauugugucacaauauuuuaccacugcugugaacaaaucaguugcgcguucuga

SEQ ID NO: 624243 - RNA, 63 nt, Homo Sapiens
caugccauagacaagguugauucugcaaaaaguugcugugacuccuuaaacuuugggguugcu

SEQ ID NO: 624244 - RNA, 63 nt, Homo Sapiens
uccugggcuuucaggcuugaugggcaccccgugugcugugaucggggggccuuccuuuccucc

SEQ ID NO: 624245 - RNA, 63 nt, Homo Sapiens
uugaugcuggccagggaagcauucgacucuggaugcugugagcggagggucuugucugcugug

SEQ ID NO: 624246 - RNA, 63 nt, Homo Sapiens
cgacucuggaugcugugagcggagggucuugucugcugugauuuuccccggguugguggccau

SEQ ID NO: 624247 - RNA, 63 nt, Homo Sapiens
cccccuuaccucccccagugagaggaggcugccugcugugauacugugaacugggacagaagc

SEQ ID NO: 624248 - RNA, 63 nt, Homo Sapiens
ugacuggaagggagcagagguagauuugaacucugcugugaagcuaugaaacacacaggguuc

SEQ ID NO: 624249 - RNA, 63 nt, Homo Sapiens
uucuguggcucauggccucuuguggccaccaggugcugugagugcaaagggugcauuucaggg

SEQ ID NO: 624250 - RNA, 63 nt, Homo Sapiens
aacgugaugacaacaagcaauuuuucaaaaauuugcugugaaccaagaaugauuggugcuuau

SEQ ID NO: 624251 - RNA, 63 nt, Homo Sapiens
uuguauucccuuucaccuccgccucuggaagucugcugugaauuucuaccugcuuggccuggg

SEQ ID NO: 624252 - RNA, 63 nt, Homo Sapiens
cgagucacacucaagggaacuuucuccugccugugcugugacucugugaauugaaauguucgu

SEQ ID NO: 624253 - RNA, 63 nt, Homo Sapiens
acucuggccauggugacugggcacagcaccggcugcugugaagaccagcuggccugcugcucu

SEQ ID NO: 624254 - RNA, 63 nt, Homo Sapiens
gacauggucagauuuccagcucccccuacucccugcugugaaacaaucccucucccugugaga

SEQ ID NO: 624255 - RNA, 63 nt, Homo Sapiens
uccuuucccucugcccugccauuccuauuacaaugcugugaaaaaaguucugcuucuuaggug

SEQ ID NO: 624256 - RNA, 63 nt, Homo Sapiens
cauagugagagcagugguggagcaauagaagauugcugugacaccaggcugcuuacugucuuu

SEQ ID NO: 624257 - RNA, 63 nt, Homo Sapiens
acuucaggagucacugauucagcacuaauuuccugcugugaaaacucaucuuucauuuuugcc

SEQ ID NO: 624258 - RNA, 63 nt, Homo Sapiens
aauuugcuguaaagcuuuggacauacacuuagcugcugugagccacuaauaacauugggcuaa

SEQ ID NO: 624259 - RNA, 63 nt, Homo Sapiens
uagcugcuuccuggacgugcgcgcccaggccagugcugugagcaggcggggaggaggcugccg

SEQ ID NO: 624260 - RNA, 63 nt, Homo Sapiens
uguaaaauggacacacaauccuccuccagggacugcugugaaaucaagaaaucggaaaauacu

SEQ ID NO: 624261 - RNA, 63 nt, Homo Sapiens
cgccccaccuugcagcuaaaugugauccugccuugcugugaaauuucuguaccuucaaccugg

SEQ ID NO: 624262 - RNA, 63 nt, Homo Sapiens
gcacuccccacccugcucccuucccagagggauugcugugaaauuuuuuugguggcaaauaaa

SEQ ID NO: 624263 - RNA, 63 nt, Homo Sapiens
ggcucuucauccucuucaaaaaauuugcaugucugcugugaauuuucaucuaguuccccaauc

SEQ ID NO: 624264 - RNA, 63 nt, Homo Sapiens
agaauuuucacugguugccugcaucuuuggcucugcugugaucugauuggaggagggacaguu

SEQ ID NO: 624265 - RNA, 63 nt, Homo Sapiens
uguaaauacauaaaaaauauacaaauuuuuggcugcugugaagauguaauuuuaucuuuuaac

SEQ ID NO: 624266 - RNA, 63 nt, Homo Sapiens
ugggcuucacuggagaaauggacuuacugcaaaugcugugauguuucuuagaggaacuucaua

SEQ ID NO: 624267 - RNA, 63 nt, Homo Sapiens
gcauccaguagaggacuggcguuggagucacacugcugugaaaucacguugcaguccagcgca

SEQ ID NO: 624268 - RNA, 63 nt, Homo Sapiens
gcucaauuuccugauuguaguagagguuaagauugcugugagcuuuaucagauaagagaccga

SEQ ID NO: 624269 - RNA, 63 nt, Homo Sapiens
uguauauccccaguugucagcagacccggacaaugcugugagagaagcauuggggcacaaaua

SEQ ID NO: 624270 - RNA, 63 nt, Homo Sapiens
ggagucgccacagauguacccacuagcccagguugcugugagucagcggaagcucccguuaug

SEQ ID NO: 624271 - RNA, 63 nt, Homo Sapiens
gaacggcgucacuucucagacacugaagaacucugcugugaagcaaaacacucaaaccuuuaa

SEQ ID NO: 624272 - RNA, 63 nt, Homo Sapiens
uacauaaaaaaguguuuacccugaaauucaggaugcugugauacacugaaaggaaaaauguac

SEQ ID NO: 624273 - RNA, 63 nt, Homo Sapiens
ccggcggaccaggacugcagccagacccagccaugcugugauagcagcaggugaccuccccuu

SEQ ID NO: 624274 - RNA, 63 nt, Homo Sapiens
auuuguguacaagucuguauuuacaaauaaagcugcugugaacguuguuuuaguuuugggaua

SEQ ID NO: 624275 - RNA, 63 nt, Homo Sapiens
auacucuguauucuuuauggguuguaaacugaaugcugugauauuaaacaugaaugaagauag

SEQ ID NO: 624276 - RNA, 63 nt, Homo Sapiens
ggggugagggacaucccuaaaaagaaacuuuggugcugugaaaaucucagauacuauuuuugc

SEQ ID NO: 624277 - RNA, 63 nt, Homo Sapiens
ggcccucccgggucaugacagcugucugcugcuugcugugaauggagagggucugaagccugu

SEQ ID NO: 624278 - RNA, 63 nt, Homo Sapiens
uauaugaggaauuuacuacuagguuaauuuucuugcugugauaauuuagucuuuaaauuuuuu

SEQ ID NO: 624279 - RNA, 63 nt, Homo Sapiens
ugagaguggguaaaucagggcuuccccuuagagugcugugagacaagaacuccucccacccaa

SEQ ID NO: 624280 - RNA, 63 nt, Homo Sapiens
uuccuggaguugacagaaacuacucucauaugaugcugugauucagugggcagcaggucugag

SEQ ID NO: 624281 - RNA, 63 nt, Homo Sapiens
guuuuagagaaggaaauucaaaauggacaccucugcugugaauagaggugaaacaggcaagug

SEQ ID NO: 624282 - RNA, 63 nt, Homo Sapiens
uacuuaaggcagugauacugccacauuagguugugcugugaauuugaauuacucuucaugggc

SEQ ID NO: 624283 - RNA, 63 nt, Homo Sapiens
ggugugaaauagaagccaacagaacagagugagugcugugaacugggugaguggaugaaaugg

SEQ ID NO: 624284 - RNA, 63 nt, Homo Sapiens
gacuaguaauggcuaccacgcauggggaaggagugcugugauucuggcguaaguggcccacau

SEQ ID NO: 624285 - RNA, 63 nt, Homo Sapiens
ugggagaacugcuguguaccgaucugaggucacugcugugagcgugcggcccuugcugcugga

SEQ ID NO: 624286 - RNA, 63 nt, Homo Sapiens
gaauaacaagggucagauuugaguucuccuuacugcugugauguguguuuacuuagaugugaa

SEQ ID NO: 624287 - RNA, 63 nt, Homo Sapiens
uuuguuuccagguuugguuauuaugaauaaaguugcugugaauacuuacguguaagucuuuuu

SEQ ID NO: 624288 - RNA, 63 nt, Homo Sapiens
cacuaacaugcuauauaaaauguuaaagucugaugcugugaaagcaaucuagugcuauauuuc

SEQ ID NO: 624289 - RNA, 63 nt, Homo Sapiens
auaagcauccaccccaaauguugguuguauuuaugcugugauaaaaauaggugagagaucaua

SEQ ID NO: 624290 - RNA, 63 nt, Homo Sapiens
gcugacagugaccaagacacuaacaaaggcuccugcugugacaugucuguuagggaggcacuc

SEQ ID NO: 624291 - RNA, 63 nt, Homo Sapiens
cauuagugaauauuuaguuguuuucauaaacgaugcugugaugaagacucauguacauauuua

SEQ ID NO: 624292 - RNA, 63 nt, Homo Sapiens
uuuucauugauauaaauacuuguacuguacuucugcugugagauucccuagugucaaaauuaa

SEQ ID NO: 624293 - RNA, 63 nt, Homo Sapiens
acaaaacaauguucuugguuuuaauguuccaguugcugugaaauagaacuccuacaaucaaaa

SEQ ID NO: 624294 - RNA, 63 nt, Homo Sapiens
guggagagaugagaagaauauaugcagcaaaggugcugugagcccaguuccaacggcuguguu

SEQ ID NO: 624295 - RNA, 63 nt, Homo Sapiens
gcgcugcucuggguggguuagcaaccccagggcugcugugauaggaagucccuguuguucucc

SEQ ID NO: 624296 - RNA, 63 nt, Homo Sapiens
auuggaucagugugaguccugaagcacuuucagugcugugagaacgacauccacuuuggguuu

SEQ ID NO: 624297 - RNA, 63 nt, Homo Sapiens
ugacugcaucaugcaugcacguauuugguaacuugcugugaaaucuaaaacagcacuaucgag

SEQ ID NO: 624298 - RNA, 63 nt, Homo Sapiens
uggagaacaguuucaucagguauuuaggaugacugcugugaaaucacagaccucugcuuggag

SEQ ID NO: 624299 - RNA, 63 nt, Homo Sapiens
uguccuuuggauauucugugucgucaugcuccaugcugugagguaagugaagggaaauaaacc

SEQ ID NO: 624300 - RNA, 63 nt, Homo Sapiens
uaaaguaugucauuuaugcuuuaaugucagugcugcugugaaccacauuuuguguagacaauu

SEQ ID NO: 624301 - RNA, 63 nt, Homo Sapiens
cuguuuuaaguccauaccuugcuuucgcagaaaugcugugauucauagauggagaguuugagg

SEQ ID NO: 624302 - RNA, 63 nt, Homo Sapiens
ugcugagaacagaagcauuauuugaguccugcaugcugugaaauuuuucuucuguuguaucca

SEQ ID NO: 624303 - RNA, 63 nt, Homo Sapiens
aaugaauuuccuuuaccuuucuggaacacaagcugcugugaaccaaacugauaucaagugauu

SEQ ID NO: 624304 - RNA, 63 nt, Homo Sapiens
caucuuuuuuaaaaacaaauaaaugaauaaagcugcugugacacacacacaaaaggaauuuaa

SEQ ID NO: 624305 - RNA, 63 nt, Homo Sapiens
cuuccuuccccaccagggaggacaacaucuucaugcugugauugaagcauccauucagaacac

SEQ ID NO: 624306 - RNA, 63 nt, Homo Sapiens
ucaguuucccucuguauacaaggaucagauucuugcugugacccaagaacuccugaaaucaua

SEQ ID NO: 624307 - RNA, 63 nt, Homo Sapiens
agggagcagacagugagcaaacgccagcagggcugcugugaauuuguguaaggauugagggac

SEQ ID NO: 624308 - RNA, 56 nt, Homo Sapiens
gaaagagaguccagaaguaauucagaugcugugaaccagauuuccuuuucuuuguu

SEQ ID NO: 624309 - RNA, 63 nt, Homo Sapiens
ugcaccagagcacgcacaggagccugggcgcgcugcugugaaacguccugaccugugaucaca

SEQ ID NO: 624310 - RNA, 63 nt, Homo Sapiens
gaaguaacuacaguuagggcccucuuccuucccugcugugaaacucuccacagcugccucuuc

SEQ ID NO: 624311 - RNA, 63 nt, Homo Sapiens
acuuugccuuguagcuuuuuuuuucaguucuuaugcugugaccugagccaccgugcccggcua

SEQ ID NO: 624312 - RNA, 63 nt, Homo Sapiens
uuagauuacaaaugaauauuggcuggugggacaugcugugaauacauuuagaagauuacuuug

SEQ ID NO: 624313 - RNA, 63 nt, Homo Sapiens
guauugcaguccaaggcaucgaacugaagacacugcugugacagcauuauacacaguagagaa

SEQ ID NO: 624314 - RNA, 63 nt, Homo Sapiens
uuucugcccugccuaaggaauccuaacgugaagugcugugauggguucccacucuuucguggu

SEQ ID NO: 624315 - RNA, 63 nt, Homo Sapiens
ugaaaucuuucccacaucuccaguuaugaaaaaugcugugacuaaaugaccauuguuuauaaa

SEQ ID NO: 624316 - RNA, 63 nt, Homo Sapiens
auucauguacagguuuuuaugcccuaauaaagcugcugugaacagaguuguuuucaguuuuuu

SEQ ID NO: 624317 - RNA, 63 nt, Homo Sapiens
ugggcaaaucauuccaggucugcugaggauuugugcugugauugcccgagccgauggcgccug

SEQ ID NO: 624318 - RNA, 63 nt, Homo Sapiens
ccuuaggcacuaaagcagaggucuacuaagugaugcugugauaaaggggaagauaagauuucu

SEQ ID NO: 624319 - RNA, 63 nt, Homo Sapiens
cuuguccuccucggcccugccccacuucagggcugcugugagauggaauuccaggaaagaacu

SEQ ID NO: 624320 - RNA, 63 nt, Homo Sapiens
aaggcagcgugccgagccagcaagaggaaggggugcugugaggcuugcccaggagcaagugag

SEQ ID NO: 624321 - RNA, 63 nt, Homo Sapiens
gcagggacaggucuugggucuuugucaucuuggugcugugagagguaggagggcagccugccc

SEQ ID NO: 624322 - RNA, 63 nt, Homo Sapiens
uuuagaauuuuauuucccugauucaguuuuugcugcugugaaacagcucugaugaacacuaaa

SEQ ID NO: 624323 - RNA, 63 nt, Homo Sapiens
ccacuaacuuucucacuaagugagaaugagaacugcugugauagggagagugaaggagggaua

SEQ ID NO: 624324 - RNA, 63 nt, Homo Sapiens
acaaaaccccucacuuccucugagagggccaaaugcugugagucugaaguaugugccuggugu

SEQ ID NO: 624325 - RNA, 63 nt, Homo Sapiens
caggcauuaaauaaaaccgaggguuguugauuuugcugugacaguacacuaaaucaauacuau

SEQ ID NO: 624326 - RNA, 63 nt, Homo Sapiens
ugcauuucacuuuguggucaggccgugucuuugugcugugacugcaucaccuuuauggagugu

SEQ ID NO: 624327 - RNA, 63 nt, Homo Sapiens
accccugccaaaacuacccuuucccccauggggugcugugaaacucaaggagaugacugugga

SEQ ID NO: 624328 - RNA, 63 nt, Homo Sapiens
uuggacaggcccagucuucucccaucauugcccugcugugacuccaaagaaaggagcuucuug

SEQ ID NO: 624329 - RNA, 63 nt, Homo Sapiens
uaaauggaccacaacucuggggugucguuuuugugcugugacuuccuaauuauugcuaaagaa

SEQ ID NO: 624330 - RNA, 63 nt, Homo Sapiens
ccagcaugcaggaaggaguuuggagagaguguuugcugugauccauugaaagcuccacauuaa

SEQ ID NO: 624331 - RNA, 63 nt, Homo Sapiens
aagagggauaaaccuuuggaggggucaugaugcugcugugaagauaaaaguagaauauaaaag

SEQ ID NO: 624332 - RNA, 63 nt, Homo Sapiens
cuuuguguguugcaucaaacagaagauucugacugcugugacuuuguaccgcaugaucaacuu

SEQ ID NO: 624333 - RNA, 63 nt, Homo Sapiens
guucacuaauacuuuccuuuucaaugucaagacugcugugaggcccauccaguguacuuugca

SEQ ID NO: 624334 - RNA, 63 nt, Homo Sapiens
uugcacaaaguauauccuaugcaauuucugauuugcugugaaaucagaaagcagguauacacu

SEQ ID NO: 624335 - RNA, 63 nt, Homo Sapiens
guccuguauucaauuuuguaaaacucguugaagugcugugauuaauguauacguguuagggua

SEQ ID NO: 624336 - RNA, 63 nt, Homo Sapiens
agccuuccaugguagagauuaagucuccgcaggugcugugaaggcucugacacgucccuugca

SEQ ID NO: 624337 - RNA, 63 nt, Homo Sapiens
uaagcccaauuaauuccuguagcauuugacccuugcugugaauggagaaaugcuuagaaauuc

SEQ ID NO: 624338 - RNA, 63 nt, Homo Sapiens
uauuaaagaguuagccauaugauacuaaacagaugcugugauucucuuagcauucaaacugca

SEQ ID NO: 624339 - RNA, 63 nt, Homo Sapiens
auuccgagcuguucccugggagggggcuuccaaugcugugagauggccuugcagagcucaaga

SEQ ID NO: 624340 - RNA, 63 nt, Homo Sapiens
guugcuuuuuuuuuuccuuuuuugggcuugaugugcugugaauguguagaagguguaaacuau

SEQ ID NO: 624341 - RNA, 58 nt, Homo Sapiens
uguuuggcucccaucuauaccuuccaaaugcugugaccuacaggcucugacccaguga

SEQ ID NO: 624342 - RNA, 63 nt, Homo Sapiens
augaaagcauuagacuuuuacuuugcauuugauugcugugaaguccauuucauuuuugcuuua

SEQ ID NO: 624343 - RNA, 63 nt, Homo Sapiens
gcaggaagugggaguguuucauuguuagcuaauugcugugacucaggaagugggaguguuuuu

SEQ ID NO: 624344 - RNA, 63 nt, Homo Sapiens
uuagugguguugcagcugucuacuggcugcaugugcugugaauaucccaaggaacuggcugug

SEQ ID NO: 624345 - RNA, 63 nt, Homo Sapiens
cccuggcaacccagcaccggggaagccgucagcugcugugacaauaaaaccugccccgugucu

SEQ ID NO: 624346 - RNA, 63 nt, Homo Sapiens
aaaucccuccccacguggggaugagaaccuuccugcugugaugugacaccuucggggacauug

SEQ ID NO: 624347 - RNA, 63 nt, Homo Sapiens
uuugugcaaccagggcccacggcgccccuccugugcugugacgugugugucguggcuggcccc

SEQ ID NO: 624348 - RNA, 63 nt, Homo Sapiens
cgccuaccgcccuggccgugucugucuggugugugcugugaaccccugcacccaaccccacau

SEQ ID NO: 624349 - RNA, 63 nt, Homo Sapiens
ccugcagacgucugguggcagcgucuacuccauugcugugacaaaucaccacauugucugugg

SEQ ID NO: 624350 - RNA, 63 nt, Homo Sapiens
guggccuugagguuggugugcacaggcacuggcugcugugagugggggggcauggggcaguuu

SEQ ID NO: 624351 - RNA, 63 nt, Homo Sapiens
agacgguuucugauuuuuccacuauuuaaauaaugcugugaugaauaucuuuaaaaucuucug

SEQ ID NO: 624352 - RNA, 63 nt, Homo Sapiens
cacgaggcccuugaggaaugaugaugcacauucugcugugaggaggcccagaaaaggccaacc

SEQ ID NO: 624353 - RNA, 63 nt, Homo Sapiens
ugggucuccauccuccaugggggcucagccaggugcugugacaccccccuucugaaugaagcc

SEQ ID NO: 624354 - RNA, 63 nt, Homo Sapiens
agaagaggccgaggagugaggcagcagccucuaugcugugauuuccacaccggguccgugcag

SEQ ID NO: 624355 - RNA, 63 nt, Homo Sapiens
cugcagcuccaaggaacauugccucucuggaucugcugugaccaggguguggcugacaccugg

SEQ ID NO: 624356 - RNA, 63 nt, Homo Sapiens
acuggauggcaagaaugcugcugaugguggaacugcugugaccuuaggacuggcuccacaggg

SEQ ID NO: 624357 - RNA, 63 nt, Homo Sapiens
auccuguugauaguaguuuguuuuuguggugggugcugugaagaguaaacauuacucagugga

SEQ ID NO: 624358 - RNA, 63 nt, Homo Sapiens
aaaaugcucaacccuguguccugggccugggccugcugugacugaccuacaguggacuuucuc

SEQ ID NO: 624359 - RNA, 63 nt, Homo Sapiens
agguaggaggaucgcuugagccuggguagaggcugcugugagcugaaauggcgccacugcacu

SEQ ID NO: 624360 - RNA, 63 nt, Homo Sapiens
agacugaucucaaaucugaacugcagcuuucgcugcugugaguuggggauaugauagucagcu

SEQ ID NO: 624361 - RNA, 63 nt, Homo Sapiens
auccacacaggaugccggagagacagccccuugugcugugagcagagcaggcaguggcucugg

SEQ ID NO: 624362 - RNA, 63 nt, Homo Sapiens
gcagggugccugaccugugugccggcugcucacugcugugaccagcagccgagcccuuggccc

SEQ ID NO: 624363 - RNA, 63 nt, Homo Sapiens
ccggugccucggucacucugggggcaguuuagaugcugugaaauuaaaccuguucuaagugua

SEQ ID NO: 624364 - RNA, 63 nt, Homo Sapiens
ggccccugacgugcagccacacacagaaaaggcugcugugaacauuuuaugcuucgacuuuuu

SEQ ID NO: 624365 - RNA, 63 nt, Homo Sapiens
gugggaacaacugggccugggauggggcuucacugcugugacuuccuccugccaggggauuug

SEQ ID NO: 624366 - RNA, 63 nt, Homo Sapiens
gggcggcugcaccuggcugucaccugggugugcugcugugagggguccuugcguggcccccau

SEQ ID NO: 624367 - RNA, 63 nt, Homo Sapiens
uugagagcugagaaaaaccucucacgggcccugugcugugaugggcccagaggacugggguga

SEQ ID NO: 624368 - RNA, 63 nt, Homo Sapiens
augaauuuggggguguacugcugacauuccagcugcugugaucugugaaaucugcaaaaagag

SEQ ID NO: 624369 - RNA, 63 nt, Homo Sapiens
aguggugcccauuguagcauuccucuuuaauauugcugugaacauuaaauaaguguuguuuuc

SEQ ID NO: 624370 - RNA, 63 nt, Homo Sapiens
aaaagaggaaucccuccuccuucuggucagaauugcugugaggccauuccugauuugacaggu

SEQ ID NO: 624371 - RNA, 63 nt, Homo Sapiens
auauccagugucccucugcccucacucacugguugcugugaugcuccucagggcaccagagga

SEQ ID NO: 624372 - RNA, 63 nt, Homo Sapiens
aucauuuugaacuuguguaaaaaauuuagaagaugcugugaaucauuuuuuugacucuuggcc

SEQ ID NO: 624373 - RNA, 63 nt, Homo Sapiens
auuccuccguuagcuuucccucccgugccacggugcugugaguggcucugaagccaagggccg

SEQ ID NO: 624374 - RNA, 63 nt, Homo Sapiens
agcuagaugacaccaagacaaaaacaggcuguuugcugugagguccaggcuucaggccugaac

SEQ ID NO: 624375 - RNA, 63 nt, Homo Sapiens
caugauaggauuaacauaaugauggauacuuaaugcugugaaauuugcagacugauuucauug

SEQ ID NO: 624376 - RNA, 63 nt, Homo Sapiens
cccaagguuuugauggaguuacacacugggagaugcugugagcgaacuuagaugugaaaaucu

SEQ ID NO: 624377 - RNA, 63 nt, Homo Sapiens
aaccuuaaggguguguggauaauaccgucagagugcugugaaagucauuugcaaaacacacau

SEQ ID NO: 624378 - RNA, 63 nt, Homo Sapiens
uugucucuaagauauauaccccccacuuaaaggugcugugagcaccgguuggccaugagaucu

SEQ ID NO: 624379 - RNA, 63 nt, Homo Sapiens
acucugguacgaaucucaucgggcaguggaggcugcugugaaacucgccgucccucccagguc

SEQ ID NO: 624380 - RNA, 63 nt, Homo Sapiens
aaaaccugccauuguggccccugggguuggggcugcugugagggagagccgucuucagcuggg

SEQ ID NO: 624381 - RNA, 63 nt, Homo Sapiens
gucauccaugcccucccaggacccuccacucacugcugugagugcgccucaccagaaccaguu

SEQ ID NO: 624382 - RNA, 63 nt, Homo Sapiens
ggguaaaggguauuuuaacuuagggguaguuccugcugugagugguuacagcugauccucggg

SEQ ID NO: 624383 - RNA, 63 nt, Homo Sapiens
cagcaacccucaguacauacuaaguaugcucagugcugugaaaguggauuacaccaaauuaag

SEQ ID NO: 624384 - RNA, 63 nt, Homo Sapiens
uuuggaaguuuuaacuucaaugaaguaauuauuugcugugaaagaaacaaacauugaauuacu

SEQ ID NO: 624385 - RNA, 63 nt, Homo Sapiens
guccaaccuaaccaguccccaguuccccagcccugcugugacuuccauuuccaucguccuuuc

SEQ ID NO: 624386 - RNA, 63 nt, Homo Sapiens
aacuaacaagacugguccaguacccuucaaccaugcugugaucggugcaagucaagaacucuu

SEQ ID NO: 624387 - RNA, 63 nt, Homo Sapiens
ggaacugggccugcagccuuccucuucugggacugcugugaggcagaggaaugauggagaauc

SEQ ID NO: 624388 - RNA, 63 nt, Homo Sapiens
uuuucuuucacugauaccacugaauggaacuggugcugugacuccugcugcuggggauuuaug

SEQ ID NO: 624389 - RNA, 63 nt, Homo Sapiens
cucaugggacaccuuucccacagccuccucgauugcugugagcagaggccacucggaguuagg

SEQ ID NO: 624390 - RNA, 63 nt, Homo Sapiens
agugagccuucagugggugcaaggcgccauacuugcugugagagagcugaguagaguguuggu

SEQ ID NO: 624391 - RNA, 63 nt, Homo Sapiens
cugcucauuaaacugauuccaggagauuggauuugcugugacuagauacagauggagcaaaug

SEQ ID NO: 624392 - RNA, 63 nt, Homo Sapiens
cuucgccccaucucccaaauaagugggcccuugugcugugaggaagaccaaagccucagggaa

SEQ ID NO: 624393 - RNA, 63 nt, Homo Sapiens
cuguuccuguuuguguguuugaauagucugaaaugcugugacuuuuuuugugugaauaaagau

SEQ ID NO: 624394 - RNA, 63 nt, Homo Sapiens
gcugccugcacacuguagacgucccagggccugugcugugaucaccugccuuuggaccacauu

SEQ ID NO: 624395 - RNA, 63 nt, Homo Sapiens
cccuugcccggggcagaggcagaagcccacauaugcugugacgcuggccaccuuuucucagcu

SEQ ID NO: 624396 - RNA, 63 nt, Homo Sapiens
gcaucgcugugugaggacggcacggccagcgccugcugugagugggucucccaagacuaggcc

SEQ ID NO: 624397 - RNA, 63 nt, Homo Sapiens
ggguugccugaauuugugggguaccaucucuucugcugugacuccaaccccagcccacacauu

SEQ ID NO: 624398 - RNA, 63 nt, Homo Sapiens
uuuaccugauuaacauuccuuucgccaaacgacugcugugaauaaucuuagacagcaaacucu

SEQ ID NO: 624399 - RNA, 63 nt, Homo Sapiens
acaggcucagguccgacccuguaguagccagucugcugugaccaaauaagggccuggagcuga

SEQ ID NO: 624400 - RNA, 63 nt, Homo Sapiens
gagccaccagggggugauuuccccaggcuuuuuugcugugaggcgugccugccaccucuuugc

SEQ ID NO: 624401 - RNA, 63 nt, Homo Sapiens
accuccaggaagagccacuuguuccaaguugguugcugugacaaauuccuuaagccaaauggu

SEQ ID NO: 624402 - RNA, 63 nt, Homo Sapiens
gccgguagagccucugcccuugugauuccggguugcugugacaccacggggcauuaucuuguc

SEQ ID NO: 624403 - RNA, 63 nt, Homo Sapiens
guccaguggucccagcucccgucuuggcaggggugcugugaaugaagagcccaggacccaagc

SEQ ID NO: 624404 - RNA, 55 nt, Homo Sapiens
acaccacuuccuuauuacguaucucugcugugaacgugccuccucuugcugcuaa

SEQ ID NO: 624405 - RNA, 63 nt, Homo Sapiens
uccuggcagguguugguaauuagcgggucacccugcugugaagugaaccuaggccagcuugcu

SEQ ID NO: 624406 - RNA, 63 nt, Homo Sapiens
gugucaaguguguaagggccucacccuccaggcugcugugagaugggcgagccccucggcccc

SEQ ID NO: 624407 - RNA, 63 nt, Homo Sapiens
ucacuuugaggggguaggaguuuuuucuuuaacugcugugaacaggaaaaauguaggaauuua

SEQ ID NO: 624408 - RNA, 63 nt, Homo Sapiens
uuuuaaguugcaauauguuuaacuaaaccaagaugcugugauuauugcguuaaaaaaaaaauu

SEQ ID NO: 624409 - RNA, 63 nt, Homo Sapiens
cauaguuuacuuuuguucaaaugucuugcugaaugcugugacuuguucacucuuccgugucug

SEQ ID NO: 624410 - RNA, 63 nt, Homo Sapiens
guguggaugcgugugaacgcgagaguggaccugugcugugagugggaguguucccgugccugg

SEQ ID NO: 624411 - RNA, 63 nt, Homo Sapiens
accucuccuuuggccccuaaagaaccaaacugcugcugugauaggcccugggcauuucugcug

SEQ ID NO: 624412 - RNA, 63 nt, Homo Sapiens
auccaggagcccuugagaagaugaacucauccuugcugugagcuucaguaccauggauuugaa

SEQ ID NO: 624413 - RNA, 63 nt, Homo Sapiens
guucaggcccugggaggcucugggggugagcccugcugugagacagagcuaagcauacaggcu

SEQ ID NO: 624414 - RNA, 63 nt, Homo Sapiens
ggcagacaaugcauggcugagaacucuccuuauugcugugaagagucugucgugcaccgauga

SEQ ID NO: 624415 - RNA, 63 nt, Homo Sapiens
auguacgcacuaaaaaaaaugugugcuugcugcugcugugagugaaccauugcuuaagauaaa

SEQ ID NO: 624416 - RNA, 63 nt, Homo Sapiens
uuuucaagcagcaucuucugguuuaaacuuguuugcugugaacaauugucgaaaagagucuuc

SEQ ID NO: 624417 - RNA, 63 nt, Homo Sapiens
uggggccuccuuccauugcacacacauguuuccugcugugagcgaucccuccuuugugggucg

SEQ ID NO: 624418 - RNA, 63 nt, Homo Sapiens
aguguccugggccuuccgagcagccgcaguuggugcugugagaaagaaaaaaaaaaaagguga

SEQ ID NO: 624419 - RNA, 63 nt, Homo Sapiens
uaaacagaaaucacgaauucucuagacacauccugcugugauggucauuccuaaccugggauu

SEQ ID NO: 624420 - RNA, 63 nt, Homo Sapiens
ucucugugggugauuuaauuucuuugccacgugugcugugacuaguccccuaaacauacuaug

SEQ ID NO: 624421 - RNA, 63 nt, Homo Sapiens
cggggaggccauggcaugccccgggcguucgcuugcugugaauuccuguccucguguccccga

SEQ ID NO: 624422 - RNA, 63 nt, Homo Sapiens
ucagcccuuaccuguuugccagccgugaccaccugcugugaggcccgaccacccacccagaau

SEQ ID NO: 624423 - RNA, 63 nt, Homo Sapiens
gugcgugugaacggcuuuggguccugcugguuuugcugugagcugcaguguucugugggucug

SEQ ID NO: 624424 - RNA, 63 nt, Homo Sapiens
ucccugcccaaaucugucuccuagaaucuuaugugcugugaauaauaggccuucacugccccu

SEQ ID NO: 624425 - RNA, 63 nt, Homo Sapiens
gagucuagauucaaagguucuagguuucaaagaugcugugagucuuugguucuaaggaccuga

SEQ ID NO: 624426 - RNA, 63 nt, Homo Sapiens
aacaaauggcaugugacuuuguaaguguagaauugcugugagguauggggcuaggggcgucag

SEQ ID NO: 624427 - RNA, 63 nt, Homo Sapiens
caggagaauggcuugaacccaggagguggagguugcugugagccaagaucgcaccauugcacu

SEQ ID NO: 624428 - RNA, 63 nt, Homo Sapiens
cguugggccgcucugauuucaggcagcaggggcugcugugaugccguccugcuggagugauuu

SEQ ID NO: 624429 - RNA, 63 nt, Homo Sapiens
cugcuaaaagcgaauguagucaggccccuuucaugcugugagaccuccuggaacacuggcauc

SEQ ID NO: 624430 - RNA, 63 nt, Homo Sapiens
gaaguagguauaagaaguccuaucucauagggaugcugugagcauuaaauaaagguacacaug

SEQ ID NO: 624431 - RNA, 63 nt, Homo Sapiens
gagagcagaucugaccacuugccagccccugucugcugugaauuaccauuuccuuuguccuuc

SEQ ID NO: 624432 - RNA, 63 nt, Homo Sapiens
cggacgccagauggcugcgcgcuuugucagcagugcugugagaaguucuccccuggggugggg

SEQ ID NO: 624433 - RNA, 63 nt, Homo Sapiens
agaccaagucucacucugucacccacgcuggagugcugugaugcgaucucggcucucugcaac

SEQ ID NO: 624434 - RNA, 63 nt, Homo Sapiens
gagucuugcucugucacccaggcuggagugcagugcugugaucuuggcucacugcaagcuccg

SEQ ID NO: 624435 - RNA, 63 nt, Homo Sapiens
acaagauuucccaaagaagaaaggccuuauauaugcugugaauguguuuuugcuuguuaguuu

SEQ ID NO: 624436 - RNA, 63 nt, Homo Sapiens
agagcccauauuucaccuugaggagggugcugcugcugugacagccugcaguguuuugaaaca

SEQ ID NO: 624437 - RNA, 63 nt, Homo Sapiens
ccagcugaggcccacccaggccaggcagggagcugcugugagucuccugaggccggaccccgc

SEQ ID NO: 624438 - RNA, 63 nt, Homo Sapiens
ccgccccugcccccucucccgccaggccaugcuugcugugacuucccuggugcuggggacugu

SEQ ID NO: 624439 - RNA, 63 nt, Homo Sapiens
auacucuguuuauuaaagaccacuagaagccggugcugugaaaaccuuguccuuccuggaagc

SEQ ID NO: 624440 - RNA, 63 nt, Homo Sapiens
ugacaccacgccacugcacugggagguggagguugcugugagccacgagauucacuugaaccu

SEQ ID NO: 624441 - RNA, 63 nt, Homo Sapiens
cccgcaaccuccuccccaccuuugacacgagucugcugugaacuggagccuguuaccuccgca

SEQ ID NO: 624442 - RNA, 63 nt, Homo Sapiens
aucuuuccaugacauuaaauucauauaauaauaugcugugagcuuuuuuucuguccagguugu

SEQ ID NO: 624443 - RNA, 63 nt, Homo Sapiens
caacucucuaguuacuugauaaaaagcuaauauugcugugauuaaaagaaguacagauuuuuu

SEQ ID NO: 624444 - RNA, 63 nt, Homo Sapiens
acaggcuuaagccacagcgcuggcuucccaaagugcugugauuaccucaugcucugcccagcu

SEQ ID NO: 624445 - RNA, 63 nt, Homo Sapiens
ccccucuucuacccacaaggccaauauuuggggugcugugauaugcagaggggugaacaggcc

SEQ ID NO: 624446 - RNA, 63 nt, Homo Sapiens
ccgcgaccuaggaaccgugggccccuuuggggcugcugugacuccucggauucccagguuccu

SEQ ID NO: 624447 - RNA, 63 nt, Homo Sapiens
cacaggcaaauuugauguuacuauuaaaauguaugcugugauagauagccugauaaacucauc

SEQ ID NO: 624448 - RNA, 63 nt, Homo Sapiens
ucuacauacagcuuuugcuucuauaaauaaagaugcugugaaauguuuuccugguuuuaagug

SEQ ID NO: 624449 - RNA, 63 nt, Homo Sapiens
cuccagugaccccagagacuuguccuaggugucugcugugaacagugaugccaccuccaagcu

SEQ ID NO: 624450 - RNA, 63 nt, Homo Sapiens
ccaauuuuguguuuuucuuucaaaaccacugcaugcugugaucugacaugaaacagcaggcua

SEQ ID NO: 624451 - RNA, 63 nt, Homo Sapiens
ggcaagaaucucaugagacaacuaugaacuugcugcugugauaaguguuugguacaaggaucu

SEQ ID NO: 624452 - RNA, 63 nt, Homo Sapiens
gaaucaugagccugcuggaagcccagccccuacugcugugaacccuggggccugacugcucag

SEQ ID NO: 624453 - RNA, 63 nt, Homo Sapiens
cuuuugauggcuauguuuuggagagagcaaucuugcugugaaacaguguggauguaaauuuua

SEQ ID NO: 624454 - RNA, 63 nt, Homo Sapiens
ccuuuuuucucuacauuuuuaauuuauuaaacuugcugugaaaacacuuugauuuucuaagag

SEQ ID NO: 624455 - RNA, 63 nt, Homo Sapiens
ugcauaccgugaauuuauaguuaaggaucccuuugcugugaggguagaaaaccucaccaacug

SEQ ID NO: 624456 - RNA, 63 nt, Homo Sapiens
aaugaucagccaccuuaccuucuacuggguaccugcugugagucugccuaugccagaaggauu

SEQ ID NO: 624457 - RNA, 63 nt, Homo Sapiens
ugcagagccuggccugcucuugugggcugugguugcugugacaguuucguuuucugaaucuuu

SEQ ID NO: 624458 - RNA, 63 nt, Homo Sapiens
caccaggguuuggggaaaucaccaucccgcggaugcugugaccucccuucuacggagaugcag

SEQ ID NO: 624459 - RNA, 63 nt, Homo Sapiens
gcaggcacugguuuuguugccccagggcugcuuugcugugaugaugauugcauuucaacacau

SEQ ID NO: 624460 - RNA, 63 nt, Homo Sapiens
aacauuccguaguuuagaaguagacguugccaaugcugugacucaaggccacggcucuacuaa

SEQ ID NO: 624461 - RNA, 63 nt, Homo Sapiens
guuugcgugucggcucuugcgguggaguccuguugcugugagggagugcuggccgcaggcagc

SEQ ID NO: 624462 - RNA, 63 nt, Homo Sapiens
ccacugccacugccucagaaguuccaguguagcugcugugagcauccccacaugugcacugug

SEQ ID NO: 624463 - RNA, 63 nt, Homo Sapiens
gugauggugccugaugcggucgaaucacuuuucugcugugaggcccagagcuaagacagacug

SEQ ID NO: 624464 - RNA, 63 nt, Homo Sapiens
cuggaacugcgggagccccaaaagaccuggggcugcugugaagaaaacucaucuggaguucuc

SEQ ID NO: 624465 - RNA, 63 nt, Homo Sapiens
auagaaaucuuggucagggcgugguguguucugugcugugacuauacacuuucccacguugag

SEQ ID NO: 624466 - RNA, 63 nt, Homo Sapiens
ugaaugaaggagaggcuccugccaagucuguguugcugugaaaccuguguauuguuuaagcuc

SEQ ID NO: 624467 - RNA, 63 nt, Homo Sapiens
ggcaacacagauauggaacauguggcuaguggcugcugugacguucaggacccaguagccaca

SEQ ID NO: 624468 - RNA, 63 nt, Homo Sapiens
aaugcauccagauuguuuucuagaucuucauauugcugugauuucacaucauuuuuuauaggg

SEQ ID NO: 624469 - RNA, 63 nt, Homo Sapiens
aaugcucugugccagaaacacacucacccccuuugcugugaggcuccugagccuguggguccc

SEQ ID NO: 624470 - RNA, 63 nt, Homo Sapiens
aagcccccuuuugugugaauggaguccagaggcugcugugaccaaugggauggggaaccugcc

SEQ ID NO: 624471 - RNA, 63 nt, Homo Sapiens
agaguucuuuauaaagccugugaacuacagcugugcugugaagggaacauuuuuuguuuaaag

SEQ ID NO: 624472 - RNA, 63 nt, Homo Sapiens
gagauaguuaaauacaugcuuacuggaugagguugcugugauucugcucccaggugugcaucu

SEQ ID NO: 624473 - RNA, 63 nt, Homo Sapiens
agaaccauaaaucuuaaaggguuacagagagcuugcugugacucuuugccuaauccaaugagu

SEQ ID NO: 624474 - RNA, 63 nt, Homo Sapiens
uuauuuuuagaauuauaaauuaugcuuucucucugcugugaaaaauauguacauaucuaggua

SEQ ID NO: 624475 - RNA, 63 nt, Homo Sapiens
auuuuaugugacugcuuuuuugccucacaauuaugcugugaauuuuacaaaaauuuauuuucu

SEQ ID NO: 624476 - RNA, 63 nt, Homo Sapiens
uuccacaucagaacucccuucaaacacaaagauugcugugaaaacgaaaauguguagacgcac

SEQ ID NO: 624477 - RNA, 63 nt, Homo Sapiens
agaaauguacccagauguauagccacuaucaaaugcugugaaggcauuuuguaagcacuuugg

SEQ ID NO: 624478 - RNA, 63 nt, Homo Sapiens
gaccuuaacauuuauauuuuaugugccauauuuugcugugagugcauuuaauaaauaauucua

SEQ ID NO: 624479 - RNA, 63 nt, Homo Sapiens
aaaaagaaagauuuuauaccucugauuuagcaaugcugugaauggagggaaacugugaaugcu

SEQ ID NO: 624480 - RNA, 63 nt, Homo Sapiens
gauuacagauuugaacauguaacuuuguuacugugcugugaaagguaguccuguuuuccuaau

SEQ ID NO: 624481 - RNA, 63 nt, Homo Sapiens
gaagggcugccuuauuuuaguuaggaauaagugugcugugagggacuaggaguccuguugaaa

SEQ ID NO: 624482 - RNA, 63 nt, Homo Sapiens
guuuugacagagcacuuuauccagcugaaaaccugcugugagaaaaguagccaucuccuuguu

SEQ ID NO: 624483 - RNA, 63 nt, Homo Sapiens
aguccucuuggacacagguucgcuucagaauuuugcugugaaccaggacauuccuucuaugag

SEQ ID NO: 624484 - RNA, 63 nt, Homo Sapiens
caggaauaaaaugugucuguuaaugagaguagcugcugugaaaauauguagucccauuggugc

SEQ ID NO: 624485 - RNA, 63 nt, Homo Sapiens
ucaguggcaggggguauuucaguauuauacaacugcugugaccagacuuguauacuggcugaa

SEQ ID NO: 624486 - RNA, 63 nt, Homo Sapiens
agccuacugaguagcuuucauuuacugaucaucugcugugacuguggcccugucuggagguuc

SEQ ID NO: 624487 - RNA, 63 nt, Homo Sapiens
gaugggggagggggauuguuucagcuucucuggugcugugaugccccaggagaguccuaaucu

SEQ ID NO: 624488 - RNA, 63 nt, Homo Sapiens
aagggcuuggguucugaggaagcagauguuucaugcugugaggccuugcaccaggugggggcc

SEQ ID NO: 624489 - RNA, 63 nt, Homo Sapiens
uacagccagcauugccccucugugccccauuccugcugugagcagggccguccgggcuuccug

SEQ ID NO: 624490 - RNA, 63 nt, Homo Sapiens
agcccugcccaaccugauucugaugacugcggaugcugugacggacccaaggggcaaauaggg

SEQ ID NO: 624491 - RNA, 63 nt, Homo Sapiens
ugagcuggugccugccuugcauuuuccuucuggugcugugaagaccauaggcuggcaggcagc

SEQ ID NO: 624492 - RNA, 63 nt, Homo Sapiens
gagacugauccucucuguguaaauucugcccggugcugugaaggcuggacgguggaggaccug

SEQ ID NO: 624493 - RNA, 63 nt, Homo Sapiens
uggaagcuucugauauuugaucgucagcucuccugcugugaugccuucaggagguggagcucg

SEQ ID NO: 624494 - RNA, 63 nt, Homo Sapiens
aggaaacuccugugaccacaauaucacacacauugcugugaaccgacaguggaugcugggucc

SEQ ID NO: 624495 - RNA, 63 nt, Homo Sapiens
aucauuucauccaaaugccaacuuuucuuaagaugcugugagauuuugguuggguugacacua

SEQ ID NO: 624496 - RNA, 63 nt, Homo Sapiens
cgagggaucucaggaguuggaggucuugaagugugcugugaacggcccaggccuucuagcagg

SEQ ID NO: 624497 - RNA, 63 nt, Homo Sapiens
cugccaacauuuagcuuugguccccuccacaccugcugugaucccagggaauucccagugacc

SEQ ID NO: 624498 - RNA, 63 nt, Homo Sapiens
gggugaggguagggggagcagugauucucagggugcugugaugccucccacacaguuggaccc

SEQ ID NO: 624499 - RNA, 63 nt, Homo Sapiens
gcggagggaagugauguuuggacugcugggaaaugcugugaaucacggaaacaaccaucuggg

SEQ ID NO: 624500 - RNA, 63 nt, Homo Sapiens
uucuccugcaggagagacauuugacccuggggaugcugugaauggacagggccagauuucaug

SEQ ID NO: 624501 - RNA, 63 nt, Homo Sapiens
augccuccuccugcccuccgaccuucuugggacugcugugaaccccgcagcacgccucucccc

SEQ ID NO: 624502 - RNA, 63 nt, Homo Sapiens
caggaaggccagggagguccgcucaguuugcacugcugugaagcuggucccguccccugcagg

SEQ ID NO: 624503 - RNA, 63 nt, Homo Sapiens
aaaugaacauaaaugcucgcccauccagacagcugcugugagcccaucugugaaauuaauuuu

SEQ ID NO: 624504 - RNA, 63 nt, Homo Sapiens
uucuaaggggcccagggccaaaaggggacuggcugcugugauccauggggcuucuugugcccu

SEQ ID NO: 624505 - RNA, 63 nt, Homo Sapiens
ggagaaauuagccugggccuucucucccugcuuugcugugaagaggggugaaucuccuuccuu

SEQ ID NO: 624506 - RNA, 63 nt, Homo Sapiens
ggcaguguucuugggggugggccacguggccgcugcugugacaugucaugcccagcuuggagu

SEQ ID NO: 624507 - RNA, 63 nt, Homo Sapiens
ccucugaaguacgcuggagcuguguuguacaggugcugugagaccuacccuauucagaauuaa

SEQ ID NO: 624508 - RNA, 63 nt, Homo Sapiens
aacguaaaaagcugugccaaaaaaaaagcaaaaugcugugauaaaccaaacagggaaggggga

SEQ ID NO: 624509 - RNA, 63 nt, Homo Sapiens
guguuuaacugaguuagaauguugaaacugacuugcugugacuuaugugcagcuuuccaguug

SEQ ID NO: 624510 - RNA, 63 nt, Homo Sapiens
ucugugccugaccuugaggagucuugugugcauugcugugaauuagcucacuuggugauaugu

SEQ ID NO: 624511 - RNA, 63 nt, Homo Sapiens
ugcauuuuccuaauaugccuuuacugauccguuugcugugaacccuauguuauuuccaugugu

SEQ ID NO: 624512 - RNA, 63 nt, Homo Sapiens
acuguuauccuauuuagauggccaugaagaggaugcugugaaauucccaacaaacauugaugc

SEQ ID NO: 624513 - RNA, 63 nt, Homo Sapiens
aauauuauuugucuuuccugcccccuaucuguuugcugugauagugcaaagaagcacaggaaa

SEQ ID NO: 624514 - RNA, 63 nt, Homo Sapiens
gggagugaagugugaggacccuuuucccccgcuugcugugaaagcacagauucauugacuaca

SEQ ID NO: 624515 - RNA, 63 nt, Homo Sapiens
cacccagguggccgccucugggcccaaggcacaugcugugagcuuccugugagcccaggcucu

SEQ ID NO: 624516 - RNA, 63 nt, Homo Sapiens
gccgaggaguccucgguagaccaccuugaugucugcugugacaucagaggugccaccaccaaa

SEQ ID NO: 624517 - RNA, 63 nt, Homo Sapiens
agaagcugcgggcuucgguguggagggguggagugcugugaucucgacaacuuacuuucaaag

SEQ ID NO: 624518 - RNA, 63 nt, Homo Sapiens
cacagucgggaagguuuaaucacuggacauuuuugcugugaacucugagcuagugcuccuaaa

SEQ ID NO: 624519 - RNA, 63 nt, Homo Sapiens
agcaagccacuguagugagguaaggaugaacucugcugugaagacaaaaaggguauaagggaa

SEQ ID NO: 624520 - RNA, 63 nt, Homo Sapiens
ccaguagaaaauaugucccaagcccuagaaagcugcugugaucaacauuggaagauuauugag

SEQ ID NO: 624521 - RNA, 63 nt, Homo Sapiens
gugaauuauuuauucaugggcugcucaucaaauugcugugauaaaaugaaguugucucuacuu

SEQ ID NO: 624522 - RNA, 63 nt, Homo Sapiens
gggagugguugguaaaaucaugagaacucuuauugcugugaaaugagaaaauucuucucaucu

SEQ ID NO: 624523 - RNA, 63 nt, Homo Sapiens
aguuguaauauuaauuggccacucucucauauaugcugugagacagcuuucauucacuuuauu

SEQ ID NO: 624524 - RNA, 63 nt, Homo Sapiens
ugcaauagguauuuucuuggaaaucuuccaucuugcugugauuauuuuguaaaacauuuuggg

SEQ ID NO: 624525 - RNA, 63 nt, Homo Sapiens
ucucccucuccuugcuggcuccucucucucugcugcugugacaagccuauuugggacagcauu

SEQ ID NO: 624526 - RNA, 63 nt, Homo Sapiens
gugauggcgaaagaggguaacccagcuuuucauugcugugacaaauugucaccugcuucucug

SEQ ID NO: 624527 - RNA, 63 nt, Homo Sapiens
aagggacugaauugcugacagggggugccugagugcugugaccagacucgugugcggguggau

SEQ ID NO: 624528 - RNA, 63 nt, Homo Sapiens
cugacuucucucuuaaaaaguacagagagccugugcugugaacccccuucaaugggaaaaagc

SEQ ID NO: 624529 - RNA, 63 nt, Homo Sapiens
ugcuuucccucggaauguuuggcccucggugccugcugugaacgcauccacacaauuccagug

SEQ ID NO: 624530 - RNA, 63 nt, Homo Sapiens
cuuuauaucauuuucuauguguuuucuugaugaugcugugaaccuccgcgacacgggggaacu

SEQ ID NO: 624531 - RNA, 63 nt, Homo Sapiens
uaggcaauacaguuguuaaauguaacuauguuaugcugugaagcuguuuacucaguuacuccc

SEQ ID NO: 624532 - RNA, 64 nt, Homo Sapiens; identical to SEQ ID NO: 195747

SEQ ID NO: 624533 - RNA, 64 nt, Homo Sapiens; identical to SEQ ID NO: 195748

SEQ ID NO: 624534 - RNA, 64 nt, Homo Sapiens; identical to SEQ ID NO: 195749

SEQ ID NO: 624535 - RNA, 64 nt, Homo Sapiens; identical to SEQ ID NO: 195750

SEQ ID NO: 624536 - RNA, 64 nt, Homo Sapiens; identical to SEQ ID NO: 195751

SEQ ID NO: 624537 - RNA, 64 nt, Homo Sapiens; identical to SEQ ID NO: 195752

SEQ ID NO: 624538 - RNA, 64 nt, Homo Sapiens; identical to SEQ ID NO: 520094

SEQ ID NO: 624539 - RNA, 64 nt, Homo Sapiens; identical to SEQ ID NO: 520095

SEQ ID NO: 624540 - RNA, 64 nt, Homo Sapiens; identical to SEQ ID NO: 520096

SEQ ID NO: 624541 - RNA, 64 nt, Homo Sapiens; identical to SEQ ID NO: 520097

SEQ ID NO: 624542 - RNA, 64 nt, Homo Sapiens; identical to SEQ ID NO: 520098

SEQ ID NO: 624543 - RNA, 64 nt, Homo Sapiens; identical to SEQ ID NO: 520099

SEQ ID NO: 624544 - RNA, 64 nt, Homo Sapiens; identical to SEQ ID NO: 520100

SEQ ID NO: 624545 - RNA, 64 nt, Homo Sapiens; identical to SEQ ID NO: 520101

SEQ ID NO: 624546 - RNA, 64 nt, Homo Sapiens; identical to SEQ ID NO: 520102

SEQ ID NO: 624547 - RNA, 64 nt, Homo Sapiens; identical to SEQ ID NO: 520103

SEQ ID NO: 624548 - RNA, 64 nt, Homo Sapiens; identical to SEQ ID NO: 520104

SEQ ID NO: 624549 - RNA, 64 nt, Homo Sapiens; identical to SEQ ID NO: 520105

SEQ ID NO: 624550 - RNA, 64 nt, Homo Sapiens; identical to SEQ ID NO: 520106

SEQ ID NO: 624551 - RNA, 64 nt, Homo Sapiens; identical to SEQ ID NO: 520107

SEQ ID NO: 624552 - RNA, 64 nt, Homo Sapiens; identical to SEQ ID NO: 520108

SEQ ID NO: 624553 - RNA, 64 nt, Homo Sapiens; identical to SEQ ID NO: 520109

SEQ ID NO: 624554 - RNA, 64 nt, Homo Sapiens; identical to SEQ ID NO: 520110

SEQ ID NO: 624555 - RNA, 64 nt, Homo Sapiens; identical to SEQ ID NO: 520111

SEQ ID NO: 624556 - RNA, 64 nt, Homo Sapiens; identical to SEQ ID NO: 520112

SEQ ID NO: 624557 - RNA, 64 nt, Homo Sapiens
acuugguguagggggagaggggaaaggggucuggcccaucgaggggccccuucugccagggccu

SEQ ID NO: 624558 - RNA, 64 nt, Homo Sapiens
uuuuuuuguuuuuuggcucuuucaaagguaauggcccaucgaugagcauuuuuaacauacucca

SEQ ID NO: 624559 - RNA, 64 nt, Homo Sapiens
gacuguuuccccuacaucuuuugagccacagucgcccaucgaauaagcaaauuuguuuuugaga

SEQ ID NO: 624560 - RNA, 64 nt, Homo Sapiens
cagagauuuuagcauugccuuggcauaacaagggcccaucgauucccuacuaaugagaggcagg

SEQ ID NO: 624561 - RNA, 64 nt, Homo Sapiens
uauaaugaugacucuuggcaaggugguauuuuaacccaucgaucgcuuuuacaaugaguuccuu

SEQ ID NO: 624562 - RNA, 64 nt, Homo Sapiens
uaaaugaagccucuuuggggugaagccuggacaucccaucgaaugaaaggacacuaguacagcg

SEQ ID NO: 624563 - RNA, 64 nt, Homo Sapiens
uucacugaacauuggcuuucccacagcacucagucccaucgacgaugcaugucucacucacccu

SEQ ID NO: 624564 - RNA, 64 nt, Homo Sapiens
ucuguccuggggacguggagcagcgugcccgcugcccaucgacgggaaaagcuugggcggugcc

SEQ ID NO: 624565 - RNA, 64 nt, Homo Sapiens
ugccaagaagggcuauggaaaggcaccaugacugcccaucgagagcuaugugcccuacauggca

SEQ ID NO: 624566 - RNA, 64 nt, Homo Sapiens
ccaguaagugucuccucccugcggagacaagccccccaucgauccaaugcugagaaugagagcg

SEQ ID NO: 624567 - RNA, 64 nt, Homo Sapiens
ugccacgugggugucacguggcccuugccauccucccaucgaugcaggccugcagucucauccu

SEQ ID NO: 624568 - RNA, 64 nt, Homo Sapiens
cgacuggucgcacucgcagcugcuggacuugggccccaucgacgcgcucaacuucuucugugag

SEQ ID NO: 624569 - RNA, 64 nt, Homo Sapiens
uugaaucucaugccacugcaagucccagcugagucccaucgaugugcacccggugagugaggac

SEQ ID NO: 624570 - RNA, 64 nt, Homo Sapiens
ugaaauuaaacagauuagaaagucccagaaugaccccaucgagaugacaguggcaacugaaaac

SEQ ID NO: 624571 - RNA, 64 nt, Homo Sapiens
agcaagcccagccccagggcccccgcaagcuggucccaucgaccucacagccaccuccccaccu

SEQ ID NO: 624572 - RNA, 64 nt, Homo Sapiens
ucaaugucaucacucaauauugcgaagcacaugccccaucgagccuacugggcagagcagcaga

SEQ ID NO: 624573 - RNA, 64 nt, Homo Sapiens
uaaacaggcuucuggcaguagcuuugguuccuaucccaucgaaauuccccaaagcccugggcca

SEQ ID NO: 624574 - RNA, 64 nt, Homo Sapiens
uauuuuugauaauuuuucauacaauuaguauagacccaucgauauaauguaaauauaaacaguc

SEQ ID NO: 624575 - RNA, 64 nt, Homo Sapiens
ucuagggggacucuggaccgggcucaggccuuuucccaucgacgguacugagccugcggugcau

SEQ ID NO: 624576 - RNA, 64 nt, Homo Sapiens
uagaaauggcuguugcguauauuuuacugcgggucccaucgacuagacuaaucaucuucuuagc

SEQ ID NO: 624577 - RNA, 64 nt, Homo Sapiens
agggagggcagacggaggccgcuggaucaggccccccaucgaggcaguggcgcucccugucaga

SEQ ID NO: 624578 - RNA, 64 nt, Homo Sapiens
gauuucaccuguuuacuuaggguaucuacccagacccaucgauucugaguucgggagaugauuu

SEQ ID NO: 624579 - RNA, 64 nt, Homo Sapiens
aaggagcgccgcccccugcuccacagcgcccagucccaucgaccacccaagggcugaggagugc

SEQ ID NO: 624580 - RNA, 64 nt, Homo Sapiens
ugaaccuuguauaauuaacuuucaguuaugauuucccaucgacauuuucuuugcccuguuugua

SEQ ID NO: 624581 - RNA, 64 nt, Homo Sapiens
cggguccaguacccaaccuuugucccggcacaggcccaucgagcucagccugaguggacagcag

SEQ ID NO: 624582 - RNA, 64 nt, Homo Sapiens
ggguuccaggaccuggaacaaucagugagugggucccaucgacagaauaacuuuuucaagcaau

SEQ ID NO: 624583 - RNA, 64 nt, Homo Sapiens
gaaaggggauagaaagcuccuuccucuauguccucccaucgagaucuguucuggggauggagcu

SEQ ID NO: 624584 - RNA, 64 nt, Homo Sapiens
ugggcccugcccacacaacaaaggacccucugaccccaucgaccccugcaugaaaauaaccucc

SEQ ID NO: 624585 - RNA, 64 nt, Homo Sapiens
ccagccaccccuucccuguggccuuucuccuccacccaucgaaagggcaccguggguguaagau

SEQ ID NO: 624586 - RNA, 64 nt, Homo Sapiens
gccagggguuaggucugcaggcccgucugcgguccccaucgagcaucaaggggacgcugugugu

SEQ ID NO: 624587 - RNA, 64 nt, Homo Sapiens
ugaaggaucacuggguugcacagauccagagauccccaucgaacacaacuccagaaggucauuc

SEQ ID NO: 624588 - RNA, 64 nt, Homo Sapiens
cucuggggcugaucacuuagguuugucagugucccccaucgacuuggcaccaacuuugugauug

SEQ ID NO: 624589 - RNA, 64 nt, Homo Sapiens
aggaggcccgucagccauggguggcugucuccgccccaucgaggugggacccucgggagacccc

SEQ ID NO: 624590 - RNA, 64 nt, Homo Sapiens
cccaggcccaacucugcuagcuucccagaccacccccaucgagugcggagagagugggagugcu

SEQ ID NO: 624591 - RNA, 64 nt, Homo Sapiens
aggccccucgggggcagcacagccuucugcccgccccaucgaggccccggccagcgcccacccc

SEQ ID NO: 624592 - RNA, 64 nt, Homo Sapiens
cccaugcaacccacgcucgggcgccccggcccgucccaucgaggucgcccccgccccacccauc

SEQ ID NO: 624593 - RNA, 64 nt, Homo Sapiens
ugcccaaauauauugaaugugaaagauguauauagauguauauaacagagauaauauauauaua

SEQ ID NO: 624594 - RNA, 64 nt, Homo Sapiens
gauguauauaugcccaaauauauauauauagaaagauguauauagaagaaagaaacagagauaa

SEQ ID NO: 624595 - RNA, 64 nt, Homo Sapiens
ucugugugucagguacagcuuuuucauuguucuggauguauaagucuguucugauggcacugag

SEQ ID NO: 624596 - RNA, 64 nt, Homo Sapiens
cagugugaaauaucuucuaaguaaauuuugcccagauguauaccacaauguugggcauugaggu

SEQ ID NO: 624597 - RNA, 64 nt, Homo Sapiens
auuugggcuuagugguuacaaauauguguaaguggauguauauguacuuaaacuggcuuuguau

SEQ ID NO: 624598 - RNA, 64 nt, Homo Sapiens
uauauauguauguguguauguguguguauauauagauguauauauauacacacacagagauaua

SEQ ID NO: 624599 - RNA, 64 nt, Homo Sapiens
acauuuuacauguaaauagcacuggucauauacugauguauaugguuaucuggguuauaucuau

SEQ ID NO: 624600 - RNA, 64 nt, Homo Sapiens
caguuaaauggcuauaggugggaaguaggauuuagauguauagaaaaguaagaaaaucuuacuu

SEQ ID NO: 624601 - RNA, 64 nt, Homo Sapiens
uggugcccuucugaugcuaaggccaccaacuguagauguauauagucuggcaaugacuuguauu

SEQ ID NO: 624602 - RNA, 64 nt, Homo Sapiens
auaucuccgguuuauaaaacugcuguugauugaagauguauauaaaagcaguggaggugggggu

SEQ ID NO: 624603 - RNA, 64 nt, Homo Sapiens
auauaugcccacacaugcacauguauaugugugugauguauacuauguguguauauagugugug

SEQ ID NO: 624604 - RNA, 64 nt, Homo Sapiens
ugugugauguauacuauauauguauauagugugugauguauauguaucacauauacuauaugug

SEQ ID NO: 624605 - RNA, 64 nt, Homo Sapiens
auacauaucacauauacuauuauaguguaugugugauguauacuguauauacacauauagugua

SEQ ID NO: 624606 - RNA, 64 nt, Homo Sapiens
guuucaugugaguuuuuaccguuaggaugauuaagauguauauaggacaaaauguuaagucuuu

SEQ ID NO: 624607 - RNA, 64 nt, Homo Sapiens
aaaggggcuaguauaucaguaggauauacuaugggauguauauauaucauugcuguuagagaaa

SEQ ID NO: 624608 - RNA, 64 nt, Homo Sapiens
auuuaggaagcaauggaauucgcuucuucauguagauguauauuaauugucaucggacaaugac

SEQ ID NO: 624609 - RNA, 64 nt, Homo Sapiens
agaaugggaaagccagcagauaagagaugguucagauguauaacuacaugacaauuuguaauca

SEQ ID NO: 624610 - RNA, 64 nt, Homo Sapiens
agauuuaaagaugucuaugucuucuauuuuuauauaauuucauguucuaugaggaauuuaguac

SEQ ID NO: 624611 - RNA, 64 nt, Homo Sapiens
gcaaaacuagaaaucuuuuaaugacaauuuucauuaauuucaggguuaucauuuuugagaaauc

SEQ ID NO: 624612 - RNA, 64 nt, Homo Sapiens
ccucuagagcaauucaguccaagaaaauuucuacuaauuucagagggccaaaaagagaaaagaa

SEQ ID NO: 624613 - RNA, 64 nt, Homo Sapiens
agagaucagcaaauaaauauuuuaauuuccucuguaauuucaacaguacuaaagaaagcaaacu

SEQ ID NO: 624614 - RNA, 64 nt, Homo Sapiens
ccccuguuuguucuguaacuaguugcucucauuuuaauuucacuggccaccaucaucuuugcau

SEQ ID NO: 624615 - RNA, 64 nt, Homo Sapiens
uauuccaugccugcccaauucaucuguuacuguuuaauuucaauucuucuggugagaauuagaa

SEQ ID NO: 624616 - RNA, 64 nt, Homo Sapiens
ccauaaucacaaauggcucuuuuguguaauuguuuaauuucaccugaauaucauaaugcuuaaa

SEQ ID NO: 624617 - RNA, 64 nt, Homo Sapiens
uaaaaaugauugaaauuuaucuugccauaucucauaauuucaugcacaaguugacugagcuaau

SEQ ID NO: 624618 - RNA, 64 nt, Homo Sapiens
ucaagugcaauauaacaauguaaccaaaucuagauaauuucaaaguugucauuaauuuaguaag

SEQ ID NO: 624619 - RNA, 64 nt, Homo Sapiens
cauaagugcaauguaaauaaauauguaaaagagauaauuucaaguaaaauaagguaagaaguaa

SEQ ID NO: 624620 - RNA, 64 nt, Homo Sapiens
auauugguacauuuuauagguaauccaucauuuuuaauuucaagugacaucugagaacacagaa

SEQ ID NO: 624621 - RNA, 64 nt, Homo Sapiens
caguccagacgcacugaucuuugcaaaggagacuuaauuucaaaucuguaauuaccauacauaa

SEQ ID NO: 624622 - RNA, 64 nt, Homo Sapiens
uaugaacuacaguggagcuacacucauugaaauguaauuucaguucuaaaaagauguaauaauc

SEQ ID NO: 624623 - RNA, 64 nt, Homo Sapiens
uuaauuugggaauuuguuguguugaaauggcauuuaauuucaaccuaaauacugacugcuggac

SEQ ID NO: 624624 - RNA, 64 nt, Homo Sapiens
cuacuaaauauauauuaugcaagucaggaaucauuaauuucaaaauuuaaagccaugcuaaaau

SEQ ID NO: 624625 - RNA, 64 nt, Homo Sapiens
ggaauauugaaagguuuuaauaauucauauuuauuaauuucaaggaaguuuugugcauuaaucu

SEQ ID NO: 624626 - RNA, 64 nt, Homo Sapiens
ugcuuuuuuauaucuaaaaacuguguauguacuuuaauuucaaaaaaagagaauuagaaguuaa

SEQ ID NO: 624627 - RNA, 64 nt, Homo Sapiens
uuccuugauuuagaaauauguauauuuaaguauauaauuucagccauguauauuuugaccagag

SEQ ID NO: 624628 - RNA, 64 nt, Homo Sapiens
gaaauaaacuccauugcuuuuaucuaauuuaaaauaauuucacuuaugggagcuuaauauauca

SEQ ID NO: 624629 - RNA, 64 nt, Homo Sapiens
gaauuggaauaugauuucucaaaaauuaauuugauaauuucauguaugaugugcauauaugcua

SEQ ID NO: 624630 - RNA, 64 nt, Homo Sapiens
uucaguaaaaugaagcagucuuaagagugacuaauaauuucaaagugauuuuucgucuauucuu

SEQ ID NO: 624631 - RNA, 64 nt, Homo Sapiens
gaguccuagucauauuaaacaugagagauacucuuaauuucaguaguacaguauggaauaguua

SEQ ID NO: 624632 - RNA, 64 nt, Homo Sapiens
auaauaagugcccaaugaaaaaaucuauuaugguuaauuucauuucuugcuuugccaccuaagc

SEQ ID NO: 624633 - RNA, 64 nt, Homo Sapiens
agaaauucugcaagcuuuucacaguaauuuuaaguaauuucagaguuuuuguaaguuuaugcau

SEQ ID NO: 624634 - RNA, 64 nt, Homo Sapiens
aaaagauuaugaucucagaaacaguuuucugcuuuaauuucauguugaagucugauuuuccugg

SEQ ID NO: 624635 - RNA, 64 nt, Homo Sapiens
uuagauuuuauaaugcaaagauucagauccaaaauaauuucauaccccauuuuuucacagaauu

SEQ ID NO: 624636 - RNA, 64 nt, Homo Sapiens
gguuuuuauguguaagaagugaaagaaacuuugcuaauuucaaguucgaauuacaguugugaga

SEQ ID NO: 624637 - RNA, 64 nt, Homo Sapiens
ugacagugcauguauuuauuccuuucuguucaacuaauuucacggguuaaaaaguagagaaccu

SEQ ID NO: 624638 - RNA, 64 nt, Homo Sapiens
gauuuaguuauacauaccuucaauguuauuuuuauaauuucaugacacccucucacagacguac

SEQ ID NO: 624639 - RNA, 64 nt, Homo Sapiens
acugcaucauuguucagcuaucauugcuugcacguaauuucauuuacugugacacuugcuucuu

SEQ ID NO: 624640 - RNA, 64 nt, Homo Sapiens
cuucaguuaauuacuuugaacacuaccuuugcuguaauuucauuugagauuuucuaaggguaga

SEQ ID NO: 624641 - RNA, 64 nt, Homo Sapiens
aaauaucuuaauuuuucauuagauucauaucauuuaauuucacauauucaacaccuuuaaaugu

SEQ ID NO: 624642 - RNA, 64 nt, Homo Sapiens
gacuaccagccuguguuuuugucuuuaaaucucuuaauuucauuccucugcaaaaaaaaaaaaa

SEQ ID NO: 624643 - RNA, 64 nt, Homo Sapiens
caccgauuucaaaaccagauuguaaucaggaaaguaauuucaucaacugacuugaaauaaugcu

SEQ ID NO: 624644 - RNA, 64 nt, Homo Sapiens
cccguuuugcuuuugagucauguaaugcagccaauaauuucaaacaagccaauucucuuaacuc

SEQ ID NO: 624645 - RNA, 64 nt, Homo Sapiens
agacuaguuuuaguuuaaaaauauuccugagguguaauuucauuaaauagaaaauuucaccucc

SEQ ID NO: 624646 - RNA, 64 nt, Homo Sapiens
gauuaaaaauucacuuuagaggagccagugaauuuaauuucagaauaauucuuauccagacaug

SEQ ID NO: 624647 - RNA, 64 nt, Homo Sapiens
uuaauuaauuauaggaaagaauuguacagguccauaauuucauuauccauccauaucuauugaa

SEQ ID NO: 624648 - RNA, 64 nt, Homo Sapiens
uucuuggccaaagccaaaagcuggcuguucucaauaauuucauucagcaauaucuuaugaaagu

SEQ ID NO: 624649 - RNA, 64 nt, Homo Sapiens
augauguuaccauggcuguguaggcuacauaaaguaauuucacuuuuuauaaacacuauauacu

SEQ ID NO: 624650 - RNA, 64 nt, Homo Sapiens
caucugcauuuuuauugaacuaaguacauuuuaauaauuucagagugauacaguuuguuacuuu

SEQ ID NO: 624651 - RNA, 64 nt, Homo Sapiens
ucauuuauuugcucauuaauccuuuucagaggaauaauuucaagcauaauacguaugaguuuua

SEQ ID NO: 624652 - RNA, 64 nt, Homo Sapiens
uucaggugauaaggauuuuuuuaggacuaugugguaauuucacccuuuucaaagcuauuuauuu

SEQ ID NO: 624653 - RNA, 64 nt, Homo Sapiens
uaaaguuuggcugguagaauaaacuaccucaacuuaauuucauucuguucauaguagagcaaau

SEQ ID NO: 624654 - RNA, 64 nt, Homo Sapiens
aaauucauuuuauaaaaauaguguuuuuuuuuuuuaauuucaguucauugacucuauaacugca

SEQ ID NO: 624655 - RNA, 64 nt, Homo Sapiens
uuucuggcuuuggucuguucuguguuuaacgaguuaauuucauuauuguuaccagcucaauaaa

SEQ ID NO: 624656 - RNA, 64 nt, Homo Sapiens
uaguguccuaggauccuuuggacuuugcaucaaguaauuucagaagcucugauggcaucaaacg

SEQ ID NO: 624657 - RNA, 64 nt, Homo Sapiens
cuuaguccucaccucuuccuugucuuuuagaucuuaauuucaugcugauuacaaaaauccaguu

SEQ ID NO: 624658 - RNA, 64 nt, Homo Sapiens
ugucuuugucacaaaauuucauuuuucucauaguuaauuucaucucuccgguaagauuuuauug

SEQ ID NO: 624659 - RNA, 64 nt, Homo Sapiens
uucuuacaccccaaaaucugaucuuacugaaaguuaauuucacacuuauugggguauaaugaaa

SEQ ID NO: 624660 - RNA, 64 nt, Homo Sapiens
cuugacagaauccuuacaaaccuuucacaucaguuaauuucauugucauuagguacaauucacu

SEQ ID NO: 624661 - RNA, 64 nt, Homo Sapiens
cauuuuuaauuccucuuggugucaaauuuuuaaguaauuucaugcacacaggagaaaaugcaau

SEQ ID NO: 624662 - RNA, 64 nt, Homo Sapiens
cauguguuuggaguuaaaauguguuuuucaguuauaauuucaauuuuuaaauuucuuggugcuu

SEQ ID NO: 624663 - RNA, 64 nt, Homo Sapiens
gcuaucuaucuuuaucaaauggaaugaaacuagauaauuucaagaaacugaguaggacaaaggg

SEQ ID NO: 624664 - RNA, 64 nt, Homo Sapiens
ucuuguuagauuuguuaccaguaaaauauuacuguaauuucauauacacagucuauacaaugaa

SEQ ID NO: 624665 - RNA, 64 nt, Homo Sapiens
aacacaucuauguuucucuuauuaaaaguaaccuuaauuucauuggaauuuaagaauaaauaga

SEQ ID NO: 624666 - RNA, 64 nt, Homo Sapiens
acugguaauauaaucuaaaucaagauuaccaaaauaauuucagagguugaugugguaaccuuua

SEQ ID NO: 624667 - RNA, 64 nt, Homo Sapiens
aagugagggaucccaaaaaauuuuauacaugugauaauuucauauuugaauuuuaauuuuacuc

SEQ ID NO: 624668 - RNA, 64 nt, Homo Sapiens
acaucuucauauugauuauucuuuagcauugauuuaauuucagaauuuuauaaacacagccuuu

SEQ ID NO: 624669 - RNA, 64 nt, Homo Sapiens; identical to SEQ ID NO: 337391

SEQ ID NO: 624670 - RNA, 64 nt, Homo Sapiens; identical to SEQ ID NO: 337392

SEQ ID NO: 624671 - RNA, 64 nt, Homo Sapiens; identical to SEQ ID NO: 337393

SEQ ID NO: 624672 - RNA, 64 nt, Homo Sapiens; identical to SEQ ID NO: 337394

SEQ ID NO: 624673 - RNA, 64 nt, Homo Sapiens; identical to SEQ ID NO: 337395

SEQ ID NO: 624674 - RNA, 64 nt, Homo Sapiens; identical to SEQ ID NO: 337396

SEQ ID NO: 624675 - RNA, 64 nt, Homo Sapiens; identical to SEQ ID NO: 337397

SEQ ID NO: 624676 - RNA, 64 nt, Homo Sapiens; identical to SEQ ID NO: 337398

SEQ ID NO: 624677 - RNA, 64 nt, Homo Sapiens; identical to SEQ ID NO: 337399

SEQ ID NO: 624678 - RNA, 64 nt, Homo Sapiens; identical to SEQ ID NO: 337400

SEQ ID NO: 624679 - RNA, 64 nt, Homo Sapiens; identical to SEQ ID NO: 337401

SEQ ID NO: 624680 - RNA, 64 nt, Homo Sapiens; identical to SEQ ID NO: 337402

SEQ ID NO: 624681 - RNA, 64 nt, Homo Sapiens; identical to SEQ ID NO: 337403

SEQ ID NO: 624682 - RNA, 64 nt, Homo Sapiens; identical to SEQ ID NO: 337404

SEQ ID NO: 624683 - RNA, 64 nt, Homo Sapiens; identical to SEQ ID NO: 337405

SEQ ID NO: 624684 - RNA, 64 nt, Homo Sapiens; identical to SEQ ID NO: 337406

SEQ ID NO: 624685 - RNA, 64 nt, Homo Sapiens; identical to SEQ ID NO: 337407

SEQ ID NO: 624686 - RNA, 64 nt, Homo Sapiens; identical to SEQ ID NO: 337408

SEQ ID NO: 624687 - RNA, 64 nt, Homo Sapiens; identical to SEQ ID NO: 337409

SEQ ID NO: 624688 - RNA, 64 nt, Homo Sapiens; identical to SEQ ID NO: 337410

SEQ ID NO: 624689 - RNA, 64 nt, Homo Sapiens; identical to SEQ ID NO: 337411

SEQ ID NO: 624690 - RNA, 64 nt, Homo Sapiens; identical to SEQ ID NO: 337412

SEQ ID NO: 624691 - RNA, 64 nt, Homo Sapiens; identical to SEQ ID NO: 337413

SEQ ID NO: 624692 - RNA, 64 nt, Homo Sapiens; identical to SEQ ID NO: 337414

SEQ ID NO: 624693 - RNA, 64 nt, Homo Sapiens; identical to SEQ ID NO: 337415

SEQ ID NO: 624694 - RNA, 64 nt, Homo Sapiens; identical to SEQ ID NO: 337416

SEQ ID NO: 624695 - RNA, 64 nt, Homo Sapiens; identical to SEQ ID NO: 337417

SEQ ID NO: 624696 - RNA, 64 nt, Homo Sapiens
cuccugccacgccuuccaucccagaagcuccgccggcgaccagaaaaugugaccggaugcgcuc

SEQ ID NO: 624697 - RNA, 64 nt, Homo Sapiens
uggcugcugcaggagcugguucugccuucuugacggcgaccaggucucuccuucccagccaauu

SEQ ID NO: 624698 - RNA, 64 nt, Homo Sapiens
cugcagcagguguacaagcugaggcagagguguaccugcggaaggcuucgccaaugaggaggag

SEQ ID NO: 624699 - RNA, 64 nt, Homo Sapiens
acagucaaggucacgggcguaacaucaaugucuuccugcggaacucagcgaccuggucucccag

SEQ ID NO: 624700 - RNA, 64 nt, Homo Sapiens
gagcuggagaaucugacagggcagaggcugaacaccugcggaagagguggagcagcagcuacaa

SEQ ID NO: 624701 - RNA, 64 nt, Homo Sapiens
gagcuggagaaucuggcagggcagaggcugaacaccugcggaagagguggaacagcagcuacaa

SEQ ID NO: 624702 - RNA, 64 nt, Homo Sapiens
ccuggugaggcccugccauaaccaggcgcccagcccugcggaggaggccggggcucccaggaag

SEQ ID NO: 624703 - RNA, 64 nt, Homo Sapiens
ggugggagcagcggagggggacgccccacggggcccugcggagccugaagccggagagcaggcg

SEQ ID NO: 624704 - RNA, 64 nt, Homo Sapiens; identical to SEQ ID NO: 87480

SEQ ID NO: 624705 - RNA, 64 nt, Homo Sapiens; identical to SEQ ID NO: 87481

SEQ ID NO: 624706 - RNA, 64 nt, Homo Sapiens; identical to SEQ ID NO: 87482

SEQ ID NO: 624707 - RNA, 64 nt, Homo Sapiens; identical to SEQ ID NO: 87483

SEQ ID NO: 624708 - RNA, 64 nt, Homo Sapiens; identical to SEQ ID NO: 87484

SEQ ID NO: 624709 - RNA, 64 nt, Homo Sapiens; identical to SEQ ID NO: 87485

SEQ ID NO: 624710 - RNA, 64 nt, Homo Sapiens; identical to SEQ ID NO: 87486

SEQ ID NO: 624711 - RNA, 64 nt, Homo Sapiens; identical to SEQ ID NO: 87487

SEQ ID NO: 624712 - RNA, 64 nt, Homo Sapiens; identical to SEQ ID NO: 87488

SEQ ID NO: 624713 - RNA, 64 nt, Homo Sapiens; identical to SEQ ID NO: 87489

SEQ ID NO: 624714 - RNA, 64 nt, Homo Sapiens; identical to SEQ ID NO: 87490

SEQ ID NO: 624715 - RNA, 64 nt, Homo Sapiens; identical to SEQ ID NO: 87491

SEQ ID NO: 624716 - RNA, 64 nt, Homo Sapiens; identical to SEQ ID NO: 87492

SEQ ID NO: 624717 - RNA, 64 nt, Homo Sapiens; identical to SEQ ID NO: 87493

SEQ ID NO: 624718 - RNA, 64 nt, Homo Sapiens; identical to SEQ ID NO: 87494

SEQ ID NO: 624719 - RNA, 64 nt, Homo Sapiens; identical to SEQ ID NO: 87495

SEQ ID NO: 624720 - RNA, 64 nt, Homo Sapiens; identical to SEQ ID NO: 87496

SEQ ID NO: 624721 - RNA, 64 nt, Homo Sapiens; identical to SEQ ID NO: 87497

SEQ ID NO: 624722 - RNA, 64 nt, Homo Sapiens; identical to SEQ ID NO: 87498

SEQ ID NO: 624723 - RNA, 64 nt, Homo Sapiens; identical to SEQ ID NO: 87499

SEQ ID NO: 624724 - RNA, 64 nt, Homo Sapiens; identical to SEQ ID NO: 87500

SEQ ID NO: 624725 - RNA, 64 nt, Homo Sapiens; identical to SEQ ID NO: 87501

SEQ ID NO: 624726 - RNA, 64 nt, Homo Sapiens; identical to SEQ ID NO: 87502

SEQ ID NO: 624727 - RNA, 64 nt, Homo Sapiens; identical to SEQ ID NO: 87503

SEQ ID NO: 624728 - RNA, 64 nt, Homo Sapiens; identical to SEQ ID NO: 87504

SEQ ID NO: 624729 - RNA, 64 nt, Homo Sapiens; identical to SEQ ID NO: 87505

SEQ ID NO: 624730 - RNA, 64 nt, Homo Sapiens; identical to SEQ ID NO: 87506

SEQ ID NO: 624731 - RNA, 64 nt, Homo Sapiens; identical to SEQ ID NO: 87507

SEQ ID NO: 624732 - RNA, 64 nt, Homo Sapiens; identical to SEQ ID NO: 87508

SEQ ID NO: 624733 - RNA, 64 nt, Homo Sapiens; identical to SEQ ID NO: 87509

SEQ ID NO: 624734 - RNA, 64 nt, Homo Sapiens; identical to SEQ ID NO: 87510

SEQ ID NO: 624735 - RNA, 64 nt, Homo Sapiens; identical to SEQ ID NO: 87511

SEQ ID NO: 624736 - RNA, 64 nt, Homo Sapiens; identical to SEQ ID NO: 87512

SEQ ID NO: 624737 - RNA, 64 nt, Homo Sapiens; identical to SEQ ID NO: 87513

SEQ ID NO: 624738 - RNA, 64 nt, Homo Sapiens; identical to SEQ ID NO: 87514

SEQ ID NO: 624739 - RNA, 64 nt, Homo Sapiens; identical to SEQ ID NO: 87515

SEQ ID NO: 624740 - RNA, 64 nt, Homo Sapiens; identical to SEQ ID NO: 87516

SEQ ID NO: 624741 - RNA, 64 nt, Homo Sapiens; identical to SEQ ID NO: 87517

SEQ ID NO: 624742 - RNA, 64 nt, Homo Sapiens; identical to SEQ ID NO: 87518

SEQ ID NO: 624743 - RNA, 64 nt, Homo Sapiens; identical to SEQ ID NO: 87519

SEQ ID NO: 624744 - RNA, 64 nt, Homo Sapiens; identical to SEQ ID NO: 87520

SEQ ID NO: 624745 - RNA, 64 nt, Homo Sapiens; identical to SEQ ID NO: 87521

SEQ ID NO: 624746 - RNA, 64 nt, Homo Sapiens; identical to SEQ ID NO: 87522

SEQ ID NO: 624747 - RNA, 64 nt, Homo Sapiens; identical to SEQ ID NO: 87523

SEQ ID NO: 624748 - RNA, 64 nt, Homo Sapiens; identical to SEQ ID NO: 87524

SEQ ID NO: 624749 - RNA, 64 nt, Homo Sapiens; identical to SEQ ID NO: 87525

SEQ ID NO: 624750 - RNA, 64 nt, Homo Sapiens; identical to SEQ ID NO: 87526

SEQ ID NO: 624751 - RNA, 64 nt, Homo Sapiens; identical to SEQ ID NO: 87527

SEQ ID NO: 624752 - RNA, 64 nt, Homo Sapiens; identical to SEQ ID NO: 87528

SEQ ID NO: 624753 - RNA, 64 nt, Homo Sapiens; identical to SEQ ID NO: 87529

SEQ ID NO: 624754 - RNA, 64 nt, Homo Sapiens; identical to SEQ ID NO: 87530

SEQ ID NO: 624755 - RNA, 64 nt, Homo Sapiens; identical to SEQ ID NO: 87531

SEQ ID NO: 624756 - RNA, 64 nt, Homo Sapiens; identical to SEQ ID NO: 87532

SEQ ID NO: 624757 - RNA, 64 nt, Homo Sapiens; identical to SEQ ID NO: 87533

SEQ ID NO: 624758 - RNA, 64 nt, Homo Sapiens; identical to SEQ ID NO: 87534

SEQ ID NO: 624759 - RNA, 64 nt, Homo Sapiens; identical to SEQ ID NO: 87535

SEQ ID NO: 624760 - RNA, 64 nt, Homo Sapiens; identical to SEQ ID NO: 87536

SEQ ID NO: 624761 - RNA, 65 nt, Homo Sapiens
aauuggcccuuuggcucuugcccuuggcucccuugggcagacagcaggcuuaggccauugauauc

SEQ ID NO: 624762 - RNA, 65 nt, Homo Sapiens
agggucugaacugccuccauccuagggcaaccuggggcagacaggccuggugggggguggggaaa

SEQ ID NO: 624763 - RNA, 65 nt, Homo Sapiens
agucgaggcugguaagggaccuucagggagagcugggcagacaggugggagauggagguagggcu

SEQ ID NO: 624764 - RNA, 65 nt, Homo Sapiens
gugagaaagacaucugaggaaaauggaagaccuaaggcagacaggaaggaagcacaaaagacaag

SEQ ID NO: 624765 - RNA, 65 nt, Homo Sapiens
aaccccaggcagaccgauaaaaagaccuccagauaggcagacagacagauggaccaccaaccugg

SEQ ID NO: 624766 - RNA, 65 nt, Homo Sapiens
acagacuccuaaccaaccagauggacugccagacaggcagacaucagccacauggaauccugaca

SEQ ID NO: 624767 - RNA, 65 nt, Homo Sapiens
gggacuugaaguuguuacuaccuuuuugaaguguaggcagacacaaugggcgagcgugcaccauc

SEQ ID NO: 624768 - RNA, 65 nt, Homo Sapiens
gaucugagaaucuuuauugagauuuuguaucugcaggcagacacguaaaacugcguuaaaggcuc

SEQ ID NO: 624769 - RNA, 65 nt, Homo Sapiens
ccccaaaaggugacuuaauuaauaaagggcauuugggcagacacacuguguuggaccaacaaagu

SEQ ID NO: 624770 - RNA, 65 nt, Homo Sapiens
ggggccugaaaagaggggcugcccuccugcgccaaggcagacacaagcugcgggcugugcggucc

SEQ ID NO: 624771 - RNA, 65 nt, Homo Sapiens
aguaaagaugagcaaacauuuggaauuuacaugugggcagacauugggauaacaacuuucaucac

SEQ ID NO: 624772 - RNA, 65 nt, Homo Sapiens
uaaguucugaucauuauauaagaagggaaaugccuggcagacaccauguaaguuauaagugucug

SEQ ID NO: 624773 - RNA, 65 nt, Homo Sapiens
gccgagugacuuucuuaguccuaacaagggucuguggcagacauuuaaugaauuaagaacacauu

SEQ ID NO: 624774 - RNA, 65 nt, Homo Sapiens
gccgagugacuuucuaacaucuaacaagggucuguggcagacauuuaaugaauuaagaacacauu

SEQ ID NO: 624775 - RNA, 65 nt, Homo Sapiens
acaagguucugcccuuauggagcucacacuccaguggcagacaaacagaccauaaauaaggaaac

SEQ ID NO: 624776 - RNA, 65 nt, Homo Sapiens
ucucaagaccagagacccaacagcagugaucucagggcagacagcccuccacuccagcucugaga

SEQ ID NO: 624777 - RNA, 65 nt, Homo Sapiens
ccgaggaugcgauuuaaaaugcuggacagaaaaggggcagacacacguuauugggccaccugaca

SEQ ID NO: 624778 - RNA, 65 nt, Homo Sapiens
ccaaccuugggcuauuugaguuauuccuggaggucggcagacaugccugggcacggugacugcgg

SEQ ID NO: 624779 - RNA, 65 nt, Homo Sapiens
gacacagagauggaauagaaaagaugagaggcagaggcagacaggcgcuggacagaggggcaggg

SEQ ID NO: 624780 - RNA, 65 nt, Homo Sapiens
acagaggggcaggggagugccaagguuguccuggaggcagacagcccagcugagccuccuuaccu

SEQ ID NO: 624781 - RNA, 65 nt, Homo Sapiens
aauguguggcucagugccuggacaaaugaugccauggcagacaguagacagaacaacacuucccu

SEQ ID NO: 624782 - RNA, 65 nt, Homo Sapiens
gcaaagggugaaauccgcauugauggccucaauguggcagacaucggccuccaugaccugcgcuc

SEQ ID NO: 624783 - RNA, 65 nt, Homo Sapiens
guacucugggucaagagaccagggaugcaggguuaggcagacagguccccagaguccucacccug

SEQ ID NO: 624784 - RNA, 65 nt, Homo Sapiens
aaaacccaaaccaaaaacgcaaaccaaagcaggcaggcagacagcugcugggggaaauccugggg

SEQ ID NO: 624785 - RNA, 65 nt, Homo Sapiens
aagcacgaaucaugauucugcuuucuguuagcuuaggcagacauugggccuucaccuacaaguuu

SEQ ID NO: 624786 - RNA, 65 nt, Homo Sapiens
ugccauuugaaucagggucuccaguuucuagaaaaggcagacacugguugggaccaaagucucca

SEQ ID NO: 624787 - RNA, 65 nt, Homo Sapiens
cuucucagacuugggaccugggugccugggauccuggcagacagagguuguguccagacagccag

SEQ ID NO: 624788 - RNA, 65 nt, Homo Sapiens
gcucaggaagccggccugcagcaggagcagaggaaggcagacacccacaagaagaugacugaguu

SEQ ID NO: 624789 - RNA, 65 nt, Homo Sapiens
ugccaucccaaauacuugggcagcagcucagcaugggcagacaugggggcuguggauucuuccag

SEQ ID NO: 624790 - RNA, 65 nt, Homo Sapiens
cuaggaacugagcccaaggaaauagcgggguugcaggcagacauugagcugcgagacaaugggaa

SEQ ID NO: 624791 - RNA, 55 nt, Homo Sapiens; identical to SEQ ID NO: 113265

SEQ ID NO: 624792 - RNA, 64 nt, Homo Sapiens; identical to SEQ ID NO: 113266

SEQ ID NO: 624793 - RNA, 64 nt, Homo Sapiens; identical to SEQ ID NO: 113267

SEQ ID NO: 624794 - RNA, 64 nt, Homo Sapiens; identical to SEQ ID NO: 113268

SEQ ID NO: 624795 - RNA, 64 nt, Homo Sapiens; identical to SEQ ID NO: 113269

SEQ ID NO: 624796 - RNA, 64 nt, Homo Sapiens; identical to SEQ ID NO: 113270

SEQ ID NO: 624797 - RNA, 64 nt, Homo Sapiens; identical to SEQ ID NO: 113271

SEQ ID NO: 624798 - RNA, 64 nt, Homo Sapiens; identical to SEQ ID NO: 113272

SEQ ID NO: 624799 - RNA, 64 nt, Homo Sapiens; identical to SEQ ID NO: 113273

SEQ ID NO: 624800 - RNA, 64 nt, Homo Sapiens; identical to SEQ ID NO: 113274

SEQ ID NO: 624801 - RNA, 64 nt, Homo Sapiens; identical to SEQ ID NO: 113275

SEQ ID NO: 624802 - RNA, 64 nt, Homo Sapiens; identical to SEQ ID NO: 113276

SEQ ID NO: 624803 - RNA, 64 nt, Homo Sapiens; identical to SEQ ID NO: 113277

SEQ ID NO: 624804 - RNA, 64 nt, Homo Sapiens; identical to SEQ ID NO: 113278

SEQ ID NO: 624805 - RNA, 64 nt, Homo Sapiens; identical to SEQ ID NO: 111894

SEQ ID NO: 624806 - RNA, 64 nt, Homo Sapiens; identical to SEQ ID NO: 111895

SEQ ID NO: 624807 - RNA, 64 nt, Homo Sapiens; identical to SEQ ID NO: 111896

SEQ ID NO: 624808 - RNA, 64 nt, Homo Sapiens; identical to SEQ ID NO: 111897

SEQ ID NO: 624809 - RNA, 64 nt, Homo Sapiens; identical to SEQ ID NO: 111898

SEQ ID NO: 624810 - RNA, 64 nt, Homo Sapiens; identical to SEQ ID NO: 111899

SEQ ID NO: 624811 - RNA, 64 nt, Homo Sapiens; identical to SEQ ID NO: 111900

SEQ ID NO: 624812 - RNA, 64 nt, Homo Sapiens; identical to SEQ ID NO: 111901

SEQ ID NO: 624813 - RNA, 64 nt, Homo Sapiens; identical to SEQ ID NO: 111902

SEQ ID NO: 624814 - RNA, 64 nt, Homo Sapiens; identical to SEQ ID NO: 111903

SEQ ID NO: 624815 - RNA, 64 nt, Homo Sapiens; identical to SEQ ID NO: 111904

SEQ ID NO: 624816 - RNA, 64 nt, Homo Sapiens; identical to SEQ ID NO: 111905

SEQ ID NO: 624817 - RNA, 64 nt, Homo Sapiens; identical to SEQ ID NO: 111906

SEQ ID NO: 624818 - RNA, 64 nt, Homo Sapiens; identical to SEQ ID NO: 111907

SEQ ID NO: 624819 - RNA, 64 nt, Homo Sapiens; identical to SEQ ID NO: 111908

SEQ ID NO: 624820 - RNA, 64 nt, Homo Sapiens; identical to SEQ ID NO: 111909

SEQ ID NO: 624821 - RNA, 64 nt, Homo Sapiens; identical to SEQ ID NO: 111910

SEQ ID NO: 624822 - RNA, 64 nt, Homo Sapiens; identical to SEQ ID NO: 111911

SEQ ID NO: 624823 - RNA, 64 nt, Homo Sapiens; identical to SEQ ID NO: 111912

SEQ ID NO: 624824 - RNA, 64 nt, Homo Sapiens; identical to SEQ ID NO: 111913

SEQ ID NO: 624825 - RNA, 64 nt, Homo Sapiens; identical to SEQ ID NO: 111914

SEQ ID NO: 624826 - RNA, 64 nt, Homo Sapiens; identical to SEQ ID NO: 111915

SEQ ID NO: 624827 - RNA, 64 nt, Homo Sapiens; identical to SEQ ID NO: 111916

SEQ ID NO: 624828 - RNA, 64 nt, Homo Sapiens; identical to SEQ ID NO: 111917

SEQ ID NO: 624829 - RNA, 64 nt, Homo Sapiens; identical to SEQ ID NO: 111918

SEQ ID NO: 624830 - RNA, 64 nt, Homo Sapiens; identical to SEQ ID NO: 111919

SEQ ID NO: 624831 - RNA, 64 nt, Homo Sapiens; identical to SEQ ID NO: 111920

SEQ ID NO: 624832 - RNA, 64 nt, Homo Sapiens; identical to SEQ ID NO: 111921

SEQ ID NO: 624833 - RNA, 64 nt, Homo Sapiens; identical to SEQ ID NO: 111922

SEQ ID NO: 624834 - RNA, 64 nt, Homo Sapiens; identical to SEQ ID NO: 111923

SEQ ID NO: 624835 - RNA, 64 nt, Homo Sapiens; identical to SEQ ID NO: 111924

SEQ ID NO: 624836 - RNA, 64 nt, Homo Sapiens; identical to SEQ ID NO: 111925

SEQ ID NO: 624837 - RNA, 64 nt, Homo Sapiens; identical to SEQ ID NO: 111926

SEQ ID NO: 624838 - RNA, 64 nt, Homo Sapiens; identical to SEQ ID NO: 111927

SEQ ID NO: 624839 - RNA, 64 nt, Homo Sapiens
acauuauuugauuuaaauaaugcaaaguucuucauaucaucacauaaaauucaugugguuucua

SEQ ID NO: 624840 - RNA, 64 nt, Homo Sapiens
uucuuaaaauaauauacaugaagaauguaaaauauaucaucaaguauagccugaguaaaguuaa

SEQ ID NO: 624841 - RNA, 64 nt, Homo Sapiens
uaugagcaugucuccucuuuucaguggguaacaguaucaucauauuccuuuauaguuacuaagu

SEQ ID NO: 624842 - RNA, 64 nt, Homo Sapiens
agguugaagacaauuagugaaaguaauguuauaguaucaucauauucccuuuugcuaucugucc

SEQ ID NO: 624843 - RNA, 64 nt, Homo Sapiens
guuguggaaaaguguucuagcaacagcauauacuuaucaucauugccuuuccacuacucuacua

SEQ ID NO: 624844 - RNA, 64 nt, Homo Sapiens
gcuuuggauuaauauuggauauuacuguuuuuauuaucaucaacauuauuauuaguggauuucu

SEQ ID NO: 624845 - RNA, 64 nt, Homo Sapiens
gcuacaauaauuccaacuaagugaacuucucaauuaucaucauacuuacuuaccuuauauuaac

SEQ ID NO: 624846 - RNA, 64 nt, Homo Sapiens
uuaucaagcuggucaagguagaaauacugauauguaucaucaccuuuuccagauacaaacuugc

SEQ ID NO: 624847 - RNA, 64 nt, Homo Sapiens
cagcugccaguuuugaauaaugaauaucauauuguaucaucaaugcugauauuuaacugaguug

SEQ ID NO: 624848 - RNA, 64 nt, Homo Sapiens
cucccuucugucauuuucauugauuuaauuuguguaucaucaauaaaauuguauguuaaugcug

SEQ ID NO: 624849 - RNA, 64 nt, Homo Sapiens
caaguugcuuggcagcacaacuaucuuugcaaaaaaaaguaaagaaaaaguaaaugaugguuua

SEQ ID NO: 624850 - RNA, 64 nt, Homo Sapiens
gcagcacaacuaucuuugcaaaaaaaaguaaagaaaaaguaaaugaugguuuaaaaaauacaca

SEQ ID NO: 624851 - RNA, 64 nt, Homo Sapiens
aguuuuaguuaagauuuucacacauuaauaucaaaaaaguaaguuuaguauuuguuucuccaug

SEQ ID NO: 624852 - RNA, 64 nt, Homo Sapiens
uuuugaccauagggagauaauuuuuuuauaauacaaaaguaaccacuuggaauuuuaaagauaa

SEQ ID NO: 624853 - RNA, 64 nt, Homo Sapiens
aauaaguggaauuauguaucuuuucuaaaguuaaaaaaguaaaauauuuuauuaugaguuauua

SEQ ID NO: 624854 - RNA, 64 nt, Homo Sapiens
aggaagaugacaguauuuuuuucaaguuaucauaaaaaguaauucagaugacauuugagaagua

SEQ ID NO: 624855 - RNA, 64 nt, Homo Sapiens
accaguuaguuuugccguggaucagaugguuuauaaaaguaauaaccauaaagcaaaaaauaau

SEQ ID NO: 624856 - RNA, 64 nt, Homo Sapiens
gauauauuccaagccgccugacgaucuaauuguaaaaaguaaagcauacaaauacuagaagaaa

SEQ ID NO: 624857 - RNA, 64 nt, Homo Sapiens
ggcagugacuaugggcgcacaaaaaaaaaaaaaaaaaaguaauucagagcgagacuccgucuca

SEQ ID NO: 624858 - RNA, 64 nt, Homo Sapiens
ggcagugauuggccaggcgcgauguucucuguucaaaaguaauucgccuccucuaauuacauau

SEQ ID NO: 624859 - RNA, 64 nt, Homo Sapiens
acuaaggaaagguuaaaaacuucuucaguucauuaaaaguaacuggccuuugaugcuuuaauuc

SEQ ID NO: 624860 - RNA, 64 nt, Homo Sapiens
aguauccuaaagauuguauuaucguuauuguacaaaaaguaaaggaauaaaaaauuccuuucau

SEQ ID NO: 624861 - RNA, 64 nt, Homo Sapiens
gcucagaccuaugaacguaaaagggaagagguuaaaaaguaaguagaaagggaagaaaggggag

SEQ ID NO: 624862 - RNA, 64 nt, Homo Sapiens
uuuuagcaaccccaguauuccaaaaaaaaaaaaaaaaaguaaucuuaagguacacugcauuuug

SEQ ID NO: 624863 - RNA, 64 nt, Homo Sapiens
uauggaugaaagcaaucugagagauuugaauagaaaaaguaaucaaguuaaaaccugcaaagcu

SEQ ID NO: 624864 - RNA, 64 nt, Homo Sapiens
ucuuuguucaguugacuuacuguuucuuaccuuaaaaaguaauuguagauggaaaucaguugug

SEQ ID NO: 624865 - RNA, 64 nt, Homo Sapiens
acaaagcuaguugccauauuucuauuuuauuuuaaaaaguaaacaugcggcugggcgugguggc

SEQ ID NO: 624866 - RNA, 64 nt, Homo Sapiens
cugggcaacaagagcaaaaaucccucucaaaaaaaaaaguaaacaugggcacugauuguuuuaa

SEQ ID NO: 624867 - RNA, 64 nt, Homo Sapiens
ugaaccagauauuuugccauuaucauuguuuaauaaaaguaaucccugcuggucauaggaaaac

SEQ ID NO: 624868 - RNA, 64 nt, Homo Sapiens
uucagccugagcaacacgagcaaaacuccgucucaaaaguaaauaaaaauaaucaccuggaguu

SEQ ID NO: 624869 - RNA, 64 nt, Homo Sapiens
ugguagaacagaacaagcaaaagauuaagaguucaaaaguaaaugcaaccaauuuaacauguag

SEQ ID NO: 624870 - RNA, 64 nt, Homo Sapiens
ccuuucacaugugcuuuauuagacucugggagagaaaaguaaccaagugcuucagaacagguuu

SEQ ID NO: 624871 - RNA, 64 nt, Homo Sapiens
uuuuaaaauugucaagaguuauucuguuuguuuaaaaaguaagaaaccucuguaagcaauagau

SEQ ID NO: 624872 - RNA, 64 nt, Homo Sapiens
agagguuuggagucugguuacuaauuacuccaauaaaaguaacuuuuaaaaacaccuuuagagc

SEQ ID NO: 624873 - RNA, 64 nt, Homo Sapiens
augagguguagcagauugcacacuguuuaaggaaaaaaguaauuaugucuguugaugaaauagu

SEQ ID NO: 624874 - RNA, 64 nt, Homo Sapiens
cccuaugaggaauguggaaaaccuguuuguauuaaaaaguaaauuguauggcaauguuaacuga

SEQ ID NO: 624875 - RNA, 64 nt, Homo Sapiens
agauguguauggcaauguuaggaaaagcacucccaaaaguaaugcgugacuaccagagauuucu

SEQ ID NO: 624876 - RNA, 64 nt, Homo Sapiens
aacaacaacaaaauaaagcuaaugagccacagcaaaaaguaaagaaaaaccugggcaccuaagc

SEQ ID NO: 624877 - RNA, 64 nt, Homo Sapiens
ucuccuggccaucccuucauccugaauagcuuggaaaaguaacaugucucugacauaaggagug

SEQ ID NO: 624878 - RNA, 64 nt, Homo Sapiens
uugucacauuauuuauuaaaaauccaauaaucagaaaaguaauuccauaauuuugcauacugaa

SEQ ID NO: 624879 - RNA, 64 nt, Homo Sapiens
auaaauacguauuacaaacauuuuucaaucaucaaaaaguaauuccuaguaaaaccuuguucua

SEQ ID NO: 624880 - RNA, 64 nt, Homo Sapiens
aaaacccacauuuccuauccuuccccuaugauugaaaaguaaacaguccugccucguacucccc

SEQ ID NO: 624881 - RNA, 64 nt, Homo Sapiens
gguugucaccuaugagacccggagaagaaacaagaaaaguaacuccuugaugauucacuguugg

SEQ ID NO: 624882 - RNA, 64 nt, Homo Sapiens
uuaauucaccacauacuuauaagcaaaacauuauaaaaguaauugcaauaacaaacauuaauga

SEQ ID NO: 624883 - RNA, 64 nt, Homo Sapiens
gagcagucauuugcaaaugcguuagagcuagaauaaaaguaauuuuaauaaaaugcaauuucau

SEQ ID NO: 624884 - RNA, 64 nt, Homo Sapiens
ugguuaucaacaacuaaauauaaauuacuuuggaaaaaguaaggcugucuugcaaaaugauccc

SEQ ID NO: 624885 - RNA, 64 nt, Homo Sapiens
ccugaaauuucuaaugccuugaaaagcauauuacaaaaguaaugcuaccuuuugggaaacaaac

SEQ ID NO: 624886 - RNA, 64 nt, Homo Sapiens
agaaaaccaaugaaaagugaauauuuaagaggagaaaaguaacuaacauaauucaaauauuuaa

SEQ ID NO: 624887 - RNA, 64 nt, Homo Sapiens
aauggugauaugcaaucgaagcugcgggccuuccaaaaguaaaaggagcacacuggggaagcag

SEQ ID NO: 624888 - RNA, 64 nt, Homo Sapiens
uccaaaauguuagcaaaacaauuuuucaauuaggaaaaguaaaaguauucaagauagauuccug

SEQ ID NO: 624889 - RNA, 64 nt, Homo Sapiens
ucaaaauuuaaaauacuagacucgacuuuauuccaaaaguaacuagcuugguauggcaugaaaa

SEQ ID NO: 624890 - RNA, 64 nt, Homo Sapiens
ucugguucaagacugucauuuucuauuucaaccgaaaaguaagcauuuaacccggugaauaaau

SEQ ID NO: 624891 - RNA, 64 nt, Homo Sapiens
uacuauaaaaagccaggaccauguuagaauuaggaaaaguaaccagcauuacugcaccucuugu

SEQ ID NO: 624892 - RNA, 64 nt, Homo Sapiens
uuuauuuuauuuagugccaaauguauuccauuuuaaaaguaagccagagugagucaaggcauau

SEQ ID NO: 624893 - RNA, 64 nt, Homo Sapiens
auaaaacccaaucauaguaagugauuaacuagcaaaaaguaaagcuauuuauagcaaauuucua

SEQ ID NO: 624894 - RNA, 64 nt, Homo Sapiens
cuaauuauucaguuauucaugacaauauuuuuuuaaaaguaagaaauucugaguugucuucuug

SEQ ID NO: 624895 - RNA, 64 nt, Homo Sapiens
ccuacaaguguaaauugaaaaaucuuuauauuaaaaaaguaaacuguuaugaagcugcuaugua

SEQ ID NO: 624896 - RNA, 64 nt, Homo Sapiens
uauauuaaaauuuugaccugagcuauguguuggcaaaaguaauuaaaggagcaaagaaugcaua

SEQ ID NO: 624897 - RNA, 64 nt, Homo Sapiens
guguggcuauaagccugagcugaagauuaccuacaaaaguaacaggauuuuaaaccauaaaacu

SEQ ID NO: 624898 - RNA, 64 nt, Homo Sapiens
auuaaacagucuugaucucuuggauuucccucaaaaaaguaacuaugguacaggcaaaugugac

SEQ ID NO: 624899 - RNA, 64 nt, Homo Sapiens
auauauucuaucguauucauacaucugcaguuuaaaaaguaaauggccaacgguccaagggauu

SEQ ID NO: 624900 - RNA, 64 nt, Homo Sapiens
uuuaaaaagcagaguucauguacugucauugucuaaaaguaacuguccauucuggguccuagau

SEQ ID NO: 624901 - RNA, 64 nt, Homo Sapiens
uagucuugcacauuuuuucauuucuuacuugucuaaaaguaaaaaaaaauaucagccugucucc

SEQ ID NO: 624902 - RNA, 64 nt, Homo Sapiens
uuuccuguuaccugauccuucuacaggauuuuuaaaaaguaagagaguuucagagaagccgauc

SEQ ID NO: 624903 - RNA, 64 nt, Homo Sapiens
caagagugaaacuccaucuccaaaaaaaaaaagaaaaaguaacaaaaggaaauuauuuguuuuu

SEQ ID NO: 624904 - RNA, 64 nt, Homo Sapiens
gagcuuucuagaauauuugccuaauugggaauuaaaaaguaaaauaauaggccaggcauggugg

SEQ ID NO: 624905 - RNA, 64 nt, Homo Sapiens
gggugccacagcgagacccuaguuaagagaaaaaaaaaguaaaaacaaauugugggucaaagua

SEQ ID NO: 624906 - RNA, 64 nt, Homo Sapiens
aaauuguaaccuaccaacuaacuuacaugcuuauaaaaguaaaggagaauaacuggccgggcac

SEQ ID NO: 624907 - RNA, 64 nt, Homo Sapiens
auauuacuuuacacaguaagaugugaaauucacaaaaaguaaaccaaacaaaacgaaugaaaaa

SEQ ID NO: 624908 - RNA, 64 nt, Homo Sapiens
uaccagccauuuaggugcuuucucuggcaucuauaaaaguaaauucuagugccugccaagugau

SEQ ID NO: 624909 - RNA, 64 nt, Homo Sapiens
uggauaccauuuuguccagaugcaaaaacauuccaaaaguaauguguuuaguagagagagacuc

SEQ ID NO: 624910 - RNA, 64 nt, Homo Sapiens
auaaaauuucucaggcagaguccuggauauaggaaaaaguaauuuaugaaguaaacuucaguug

SEQ ID NO: 624911 - RNA, 64 nt, Homo Sapiens
ccuuuaaccucacuagcuucugaagcaaagaaggaaaaguaauaauuugguggugggaaguagc

SEQ ID NO: 624912 - RNA, 64 nt, Homo Sapiens
uucuccaauucuuuuuuuuuuuagcugcugauuuaaaaguaaagaaaggaaaaguuuucuucau

SEQ ID NO: 624913 - RNA, 64 nt, Homo Sapiens
ggugaugagggcaauucuguuuuuucugacaagaaaaaguaaaaguuccagagaugcauacacu

SEQ ID NO: 624914 - RNA, 64 nt, Homo Sapiens
acuuuaaguuugauguguuuuauuuuaauguucaaaaaguaaacuucuguauuuaccugacauu

SEQ ID NO: 624915 - RNA, 64 nt, Homo Sapiens
uacauauggcuggauuuuuuuuauuauuaaagaaaaaaguaaugcccaguucagaguugaaugu

SEQ ID NO: 624916 - RNA, 64 nt, Homo Sapiens
auaacuauguuuugagauauauuuauauaacuuaaaaaguaaaacuauauugaaaauguauauu

SEQ ID NO: 624917 - RNA, 64 nt, Homo Sapiens
cuucguucuuuaucagccucuuauuuuaaugaaaaaaaguaaaaaugcaauaguagaaagcuac

SEQ ID NO: 624918 - RNA, 60 nt, Homo Sapiens
aucuaaagagcuuguggccaagaguuuacuaaaaguaaccaagaaugccaggaugaauga

SEQ ID NO: 624919 - RNA, 64 nt, Homo Sapiens
aaaccaauaccuggugaaucgcacgaauuacucaaaaaguaagcucucaaaacauaggcugaaa

SEQ ID NO: 624920 - RNA, 64 nt, Homo Sapiens
gugguuuuuccauuacuuucuaauggguuggugcaaaaguaauuugauuguuaaaacuuguuug

SEQ ID NO: 624921 - RNA, 64 nt, Homo Sapiens
uaguuacauucuuaaacaauuuaugaaauaccucaaaaguaauuuuuaaaauacccaacaugua

SEQ ID NO: 624922 - RNA, 64 nt, Homo Sapiens
uuaggauuagaauauagcuaccuccacaccccaaaaaaguaagucaauauagcaagacuccacc

SEQ ID NO: 624923 - RNA, 64 nt, Homo Sapiens
acauuugaauauuguguauuucauacuauucuuuaaaaguaaucuuauguccuuuccuacaugu

SEQ ID NO: 624924 - RNA, 64 nt, Homo Sapiens
uuauugacuuuuguaacuuacuaauagggauguuaaaaguaacaaaaccaagucaaacuuggug

SEQ ID NO: 624925 - RNA, 64 nt, Homo Sapiens
aaguucuuguaagguaaauaaacuuuuuuuauucaaaaguaacaagaaaaaaaucacaaaaaca

SEQ ID NO: 624926 - RNA, 64 nt, Homo Sapiens
cauggcaaaaaauaaaauaagauggacaaaaaaaaaaaguaaaauuuaagauuaaagguacacu

SEQ ID NO: 624927 - RNA, 64 nt, Homo Sapiens
caugaaauugggagauuuuaaguugauuaaagcaaaaaguaaacuuaccagcaacuuaacuuuu

SEQ ID NO: 624928 - RNA, 64 nt, Homo Sapiens
auuuaccagcaacuuaacuuaucaaaauauggguaaaaguaaauuugguaaacaguauuauaaa

SEQ ID NO: 624929 - RNA, 64 nt, Homo Sapiens
cugucuuuccuaaaguguuuaacauuuuauaccuaaaaguaauuuauagaauuugcaaauucag

SEQ ID NO: 624930 - RNA, 64 nt, Homo Sapiens
aaauuguaccuuucuaaugaaggcucugccaguaaaaaguaaugcauauuuuguauuucacuca

SEQ ID NO: 624931 - RNA, 64 nt, Homo Sapiens
uacuuuugacaacgccucaaacuuuucuaaccauaaaaguaauuauacuggugagaaauccuag

SEQ ID NO: 624932 - RNA, 64 nt, Homo Sapiens
aguuauacuagaauauauuuuuuccagaugcaguaaaaguaaaauauuuaauccauaauuaagu

SEQ ID NO: 624933 - RNA, 64 nt, Homo Sapiens
agagaaagagagagagagagaaagaaaaagaaagaaaaguaagaaagaaaaaagaaaaagaaag

SEQ ID NO: 624934 - RNA, 64 nt, Homo Sapiens
aaagaaaaguaagaaagaaaaaagaaaaagaaagaaaaguaagaaagaaaaaaagaaaaagaaa

SEQ ID NO: 624935 - RNA, 64 nt, Homo Sapiens
ccguuuauccaaaaagguacauguuuuuguauuaaaaaguaaacagggaucagugacuguauuc

SEQ ID NO: 624936 - RNA, 64 nt, Homo Sapiens
cacauccaguuacauuacuguguucuuucuaaugaaaaguaaagguuuuauauagagaaacuug

SEQ ID NO: 624937 - RNA, 64 nt, Homo Sapiens
auuucucuuuaauugauguuuuguuuuaaaaguuaaaaguaauucuuggcguggugguucacgc

SEQ ID NO: 624938 - RNA, 62 nt, Homo Sapiens
aguauguaaugcuaagggcuaauaguaaggauugaaaaguaaaauuccuagcucaaacugug

SEQ ID NO: 624939 - RNA, 64 nt, Homo Sapiens
aauaagaugcaucacuaagcggguguuacuguccaaaaguaaagccaauaaaaauaccaucuga

SEQ ID NO: 624940 - RNA, 64 nt, Homo Sapiens
gaaaugaggaacuuucgaacauguaauuucugauaaaaguaagagaauccauuuagauuaaugu

SEQ ID NO: 624941 - RNA, 64 nt, Homo Sapiens
uaggugucacgcuguuuuuuaguguguagcccagaaaaguaaaaguccuagagauuacauaaau

SEQ ID NO: 624942 - RNA, 64 nt, Homo Sapiens; identical to SEQ ID NO: 105402

SEQ ID NO: 624943 - RNA, 64 nt, Homo Sapiens; identical to SEQ ID NO: 105403

SEQ ID NO: 624944 - RNA, 64 nt, Homo Sapiens; identical to SEQ ID NO: 24478

SEQ ID NO: 624945 - RNA, 64 nt, Homo Sapiens; identical to SEQ ID NO: 24479

SEQ ID NO: 624946 - RNA, 64 nt, Homo Sapiens; identical to SEQ ID NO: 24480

SEQ ID NO: 624947 - RNA, 64 nt, Homo Sapiens; identical to SEQ ID NO: 24481

SEQ ID NO: 624948 - RNA, 64 nt, Homo Sapiens; identical to SEQ ID NO: 24482

SEQ ID NO: 624949 - RNA, 64 nt, Homo Sapiens; identical to SEQ ID NO: 24483

SEQ ID NO: 624950 - RNA, 64 nt, Homo Sapiens; identical to SEQ ID NO: 24484

SEQ ID NO: 624951 - RNA, 64 nt, Homo Sapiens; identical to SEQ ID NO: 24485

SEQ ID NO: 624952 - RNA, 64 nt, Homo Sapiens; identical to SEQ ID NO: 24486

SEQ ID NO: 624953 - RNA, 64 nt, Homo Sapiens; identical to SEQ ID NO: 24487

SEQ ID NO: 624954 - RNA, 64 nt, Homo Sapiens; identical to SEQ ID NO: 24488

SEQ ID NO: 624955 - RNA, 64 nt, Homo Sapiens; identical to SEQ ID NO: 24489

SEQ ID NO: 624956 - RNA, 64 nt, Homo Sapiens; identical to SEQ ID NO: 24490

SEQ ID NO: 624957 - RNA, 64 nt, Homo Sapiens; identical to SEQ ID NO: 24491

SEQ ID NO: 624958 - RNA, 64 nt, Homo Sapiens; identical to SEQ ID NO: 24492

SEQ ID NO: 624959 - RNA, 64 nt, Homo Sapiens; identical to SEQ ID NO: 24493

SEQ ID NO: 624960 - RNA, 64 nt, Homo Sapiens; identical to SEQ ID NO: 24494

SEQ ID NO: 624961 - RNA, 64 nt, Homo Sapiens; identical to SEQ ID NO: 24495

SEQ ID NO: 624962 - RNA, 64 nt, Homo Sapiens; identical to SEQ ID NO: 24496

SEQ ID NO: 624963 - RNA, 64 nt, Homo Sapiens; identical to SEQ ID NO: 24497

SEQ ID NO: 624964 - RNA, 64 nt, Homo Sapiens; identical to SEQ ID NO: 24498

SEQ ID NO: 624965 - RNA, 64 nt, Homo Sapiens; identical to SEQ ID NO: 24499

SEQ ID NO: 624966 - RNA, 64 nt, Homo Sapiens; identical to SEQ ID NO: 24500

SEQ ID NO: 624967 - RNA, 64 nt, Homo Sapiens; identical to SEQ ID NO: 24501

SEQ ID NO: 624968 - RNA, 64 nt, Homo Sapiens; identical to SEQ ID NO: 24502

SEQ ID NO: 624969 - RNA, 64 nt, Homo Sapiens; identical to SEQ ID NO: 24503

SEQ ID NO: 624970 - RNA, 64 nt, Homo Sapiens; identical to SEQ ID NO: 24504

SEQ ID NO: 624971 - RNA, 64 nt, Homo Sapiens; identical to SEQ ID NO: 24505

SEQ ID NO: 624972 - RNA, 64 nt, Homo Sapiens; identical to SEQ ID NO: 24506

SEQ ID NO: 624973 - RNA, 64 nt, Homo Sapiens; identical to SEQ ID NO: 24507

SEQ ID NO: 624974 - RNA, 64 nt, Homo Sapiens; identical to SEQ ID NO: 24508

SEQ ID NO: 624975 - RNA, 64 nt, Homo Sapiens; identical to SEQ ID NO: 24509

SEQ ID NO: 624976 - RNA, 64 nt, Homo Sapiens; identical to SEQ ID NO: 24510

SEQ ID NO: 624977 - RNA, 64 nt, Homo Sapiens; identical to SEQ ID NO: 24511

SEQ ID NO: 624978 - RNA, 64 nt, Homo Sapiens; identical to SEQ ID NO: 24512

SEQ ID NO: 624979 - RNA, 64 nt, Homo Sapiens; identical to SEQ ID NO: 24513

SEQ ID NO: 624980 - RNA, 64 nt, Homo Sapiens; identical to SEQ ID NO: 24514

SEQ ID NO: 624981 - RNA, 64 nt, Homo Sapiens; identical to SEQ ID NO: 24515

SEQ ID NO: 624982 - RNA, 64 nt, Homo Sapiens; identical to SEQ ID NO: 24516

SEQ ID NO: 624983 - RNA, 64 nt, Homo Sapiens; identical to SEQ ID NO: 24517

SEQ ID NO: 624984 - RNA, 64 nt, Homo Sapiens; identical to SEQ ID NO: 24518

SEQ ID NO: 624985 - RNA, 64 nt, Homo Sapiens; identical to SEQ ID NO: 24519

SEQ ID NO: 624986 - RNA, 64 nt, Homo Sapiens; identical to SEQ ID NO: 24520

SEQ ID NO: 624987 - RNA, 64 nt, Homo Sapiens; identical to SEQ ID NO: 24521

SEQ ID NO: 624988 - RNA, 64 nt, Homo Sapiens; identical to SEQ ID NO: 24522

SEQ ID NO: 624989 - RNA, 64 nt, Homo Sapiens; identical to SEQ ID NO: 24523

SEQ ID NO: 624990 - RNA, 64 nt, Homo Sapiens; identical to SEQ ID NO: 24524

SEQ ID NO: 624991 - RNA, 64 nt, Homo Sapiens; identical to SEQ ID NO: 24525

SEQ ID NO: 624992 - RNA, 64 nt, Homo Sapiens; identical to SEQ ID NO: 24526

SEQ ID NO: 624993 - RNA, 64 nt, Homo Sapiens; identical to SEQ ID NO: 24527

SEQ ID NO: 624994 - RNA, 64 nt, Homo Sapiens; identical to SEQ ID NO: 24528

SEQ ID NO: 624995 - RNA, 64 nt, Homo Sapiens; identical to SEQ ID NO: 24529

SEQ ID NO: 624996 - RNA, 64 nt, Homo Sapiens; identical to SEQ ID NO: 24530

SEQ ID NO: 624997 - RNA, 64 nt, Homo Sapiens; identical to SEQ ID NO: 24531

SEQ ID NO: 624998 - RNA, 64 nt, Homo Sapiens; identical to SEQ ID NO: 24532

SEQ ID NO: 624999 - RNA, 64 nt, Homo Sapiens; identical to SEQ ID NO: 24533

SEQ ID NO: 625000 - RNA, 64 nt, Homo Sapiens; identical to SEQ ID NO: 24534

SEQ ID NO: 625001 - RNA, 64 nt, Homo Sapiens; identical to SEQ ID NO: 24535

SEQ ID NO: 625002 - RNA, 64 nt, Homo Sapiens; identical to SEQ ID NO: 24536

SEQ ID NO: 625003 - RNA, 64 nt, Homo Sapiens; identical to SEQ ID NO: 24537

SEQ ID NO: 625004 - RNA, 64 nt, Homo Sapiens; identical to SEQ ID NO: 24538

SEQ ID NO: 625005 - RNA, 64 nt, Homo Sapiens; identical to SEQ ID NO: 24539

SEQ ID NO: 625006 - RNA, 64 nt, Homo Sapiens; identical to SEQ ID NO: 24540

SEQ ID NO: 625007 - RNA, 64 nt, Homo Sapiens; identical to SEQ ID NO: 24541

SEQ ID NO: 625008 - RNA, 64 nt, Homo Sapiens; identical to SEQ ID NO: 24542

SEQ ID NO: 625009 - RNA, 64 nt, Homo Sapiens; identical to SEQ ID NO: 24543

SEQ ID NO: 625010 - RNA, 64 nt, Homo Sapiens; identical to SEQ ID NO: 24544

SEQ ID NO: 625011 - RNA, 64 nt, Homo Sapiens; identical to SEQ ID NO: 24545

SEQ ID NO: 625012 - RNA, 64 nt, Homo Sapiens; identical to SEQ ID NO: 24546

SEQ ID NO: 625013 - RNA, 64 nt, Homo Sapiens; identical to SEQ ID NO: 24547

SEQ ID NO: 625014 - RNA, 64 nt, Homo Sapiens; identical to SEQ ID NO: 24548

SEQ ID NO: 625015 - RNA, 64 nt, Homo Sapiens; identical to SEQ ID NO: 24549

SEQ ID NO: 625016 - RNA, 64 nt, Homo Sapiens; identical to SEQ ID NO: 24550

SEQ ID NO: 625017 - RNA, 64 nt, Homo Sapiens; identical to SEQ ID NO: 24551

SEQ ID NO: 625018 - RNA, 64 nt, Homo Sapiens; identical to SEQ ID NO: 24552

SEQ ID NO: 625019 - RNA, 64 nt, Homo Sapiens; identical to SEQ ID NO: 24553

SEQ ID NO: 625020 - RNA, 64 nt, Homo Sapiens; identical to SEQ ID NO: 128083

SEQ ID NO: 625021 - RNA, 64 nt, Homo Sapiens; identical to SEQ ID NO: 128084

SEQ ID NO: 625022 - RNA, 64 nt, Homo Sapiens; identical to SEQ ID NO: 128085

SEQ ID NO: 625023 - RNA, 64 nt, Homo Sapiens; identical to SEQ ID NO: 128086

SEQ ID NO: 625024 - RNA, 64 nt, Homo Sapiens; identical to SEQ ID NO: 128087

SEQ ID NO: 625025 - RNA, 64 nt, Homo Sapiens; identical to SEQ ID NO: 128088

SEQ ID NO: 625026 - RNA, 64 nt, Homo Sapiens; identical to SEQ ID NO: 128089

SEQ ID NO: 625027 - RNA, 64 nt, Homo Sapiens; identical to SEQ ID NO: 128090

SEQ ID NO: 625028 - RNA, 64 nt, Homo Sapiens; identical to SEQ ID NO: 128091

SEQ ID NO: 625029 - RNA, 64 nt, Homo Sapiens; identical to SEQ ID NO: 128092

SEQ ID NO: 625030 - RNA, 64 nt, Homo Sapiens; identical to SEQ ID NO: 128093

SEQ ID NO: 625031 - RNA, 64 nt, Homo Sapiens; identical to SEQ ID NO: 128094

SEQ ID NO: 625032 - RNA, 64 nt, Homo Sapiens; identical to SEQ ID NO: 128095

SEQ ID NO: 625033 - RNA, 64 nt, Homo Sapiens; identical to SEQ ID NO: 128096

SEQ ID NO: 625034 - RNA, 64 nt, Homo Sapiens; identical to SEQ ID NO: 128097

SEQ ID NO: 625035 - RNA, 64 nt, Homo Sapiens; identical to SEQ ID NO: 128098

SEQ ID NO: 625036 - RNA, 64 nt, Homo Sapiens; identical to SEQ ID NO: 128099

SEQ ID NO: 625037 - RNA, 64 nt, Homo Sapiens; identical to SEQ ID NO: 128100

SEQ ID NO: 625038 - RNA, 64 nt, Homo Sapiens; identical to SEQ ID NO: 128101

SEQ ID NO: 625039 - RNA, 64 nt, Homo Sapiens; identical to SEQ ID NO: 128102

SEQ ID NO: 625040 - RNA, 64 nt, Homo Sapiens; identical to SEQ ID NO: 128103

SEQ ID NO: 625041 - RNA, 64 nt, Homo Sapiens; identical to SEQ ID NO: 128104

SEQ ID NO: 625042 - RNA, 64 nt, Homo Sapiens; identical to SEQ ID NO: 128105

SEQ ID NO: 625043 - RNA, 64 nt, Homo Sapiens; identical to SEQ ID NO: 128106

SEQ ID NO: 625044 - RNA, 64 nt, Homo Sapiens; identical to SEQ ID NO: 128107

SEQ ID NO: 625045 - RNA, 64 nt, Homo Sapiens; identical to SEQ ID NO: 128108

SEQ ID NO: 625046 - RNA, 64 nt, Homo Sapiens; identical to SEQ ID NO: 128109

SEQ ID NO: 625047 - RNA, 64 nt, Homo Sapiens; identical to SEQ ID NO: 128110

SEQ ID NO: 625048 - RNA, 64 nt, Homo Sapiens; identical to SEQ ID NO: 128111

SEQ ID NO: 625049 - RNA, 64 nt, Homo Sapiens; identical to SEQ ID NO: 128112

SEQ ID NO: 625050 - RNA, 64 nt, Homo Sapiens; identical to SEQ ID NO: 128113

SEQ ID NO: 625051 - RNA, 64 nt, Homo Sapiens; identical to SEQ ID NO: 128114

SEQ ID NO: 625052 - RNA, 64 nt, Homo Sapiens; identical to SEQ ID NO: 128115

SEQ ID NO: 625053 - RNA, 64 nt, Homo Sapiens; identical to SEQ ID NO: 128116

SEQ ID NO: 625054 - RNA, 64 nt, Homo Sapiens; identical to SEQ ID NO: 128117

SEQ ID NO: 625055 - RNA, 64 nt, Homo Sapiens; identical to SEQ ID NO: 128118

SEQ ID NO: 625056 - RNA, 64 nt, Homo Sapiens; identical to SEQ ID NO: 128119

SEQ ID NO: 625057 - RNA, 64 nt, Homo Sapiens; identical to SEQ ID NO: 128120

SEQ ID NO: 625058 - RNA, 64 nt, Homo Sapiens; identical to SEQ ID NO: 128121

SEQ ID NO: 625059 - RNA, 64 nt, Homo Sapiens
aggcugaaguccucacccucucuuaaagcggcaccaacgugagagagacaggcagacagacaga

SEQ ID NO: 625060 - RNA, 64 nt, Homo Sapiens
acuagacuuuaugaaauuaacagauaaaguucuucaacgugaugucaucuugugccuuucaugu

SEQ ID NO: 625061 - RNA, 64 nt, Homo Sapiens
ccuuuucacagauugaaagguaucaagaagugaucaacgugacccaagggcacccaugagcucc

SEQ ID NO: 625062 - RNA, 64 nt, Homo Sapiens
agacuccgucucuaccaaaagagacuagccugggcaacgugauguggcuugaacucaggaguuc

SEQ ID NO: 625063 - RNA, 64 nt, Homo Sapiens
aaccuuccuugcuuacacaucccauaacucaggucaacgugacccucccaccuaucaccccuca

SEQ ID NO: 625064 - RNA, 64 nt, Homo Sapiens
ucucucaggggucuaggaggugguuuauugcuggcaacgugaauaugccccacugaggugcugu

SEQ ID NO: 625065 - RNA, 64 nt, Homo Sapiens
ucuugaugugagcacuggagcuuuuuuuuuuuuacaacgugacaggaagaggagggagagggug

SEQ ID NO: 625066 - RNA, 64 nt, Homo Sapiens
cuucuuuuuguguggggucaugggcuccaaaagccaacgugaacaauuaaaaauguauugagca

SEQ ID NO: 625067 - RNA, 64 nt, Homo Sapiens
auuuccuuuuccauuuucaauuaucagagguggacaacgugaagacuccaguuaagacaggauc

SEQ ID NO: 625068 - RNA, 64 nt, Homo Sapiens
agaaaugauggggaggaaaaucugucuccaaaggcaacgugaaagcgagcugccuacaaauuac

SEQ ID NO: 625069 - RNA, 64 nt, Homo Sapiens
cuggaagaggagaaaaugugcucuucuaucuccacaacgugagcccccccacacccacagcuug

SEQ ID NO: 625070 - RNA, 64 nt, Homo Sapiens
acuauuaaaaauuuuaacguaaauauuggcauuucaacgugaucuacuuaauccaauauaucca

SEQ ID NO: 625071 - RNA, 64 nt, Homo Sapiens
auucuuucacauguaaacacucuuugacguaaaucaacgugaugaagauaaacaaauaugaugu

SEQ ID NO: 625072 - RNA, 64 nt, Homo Sapiens
ggaaaccccagcggcagaugggccugugugcacccaacgugaugcuaugcaugucugaccgacg

SEQ ID NO: 625073 - RNA, 64 nt, Homo Sapiens
aaggcauauagagauguugucauaacuaggucuucaacgugaaaauuaauuuuuauuguaucau

SEQ ID NO: 625074 - RNA, 64 nt, Homo Sapiens
gaagaauguuuguuuauauagauuuuuuuuuaaucaacgugaauacacagggaaauggaucauu

SEQ ID NO: 625075 - RNA, 64 nt, Homo Sapiens
gacaccuuuguauguuccuuccuucagcccaugucaacgugacacuguccuuccccuuccuggu

SEQ ID NO: 625076 - RNA, 64 nt, Homo Sapiens
ucgcucugcucggggagccugggcagagcagcagcaacgugagggucgcugugguggugguuuc

SEQ ID NO: 625077 - RNA, 64 nt, Homo Sapiens
cugggugguggcugccacuagcccaggaacaugacaacgugaccacaccacacaugccuccaac

SEQ ID NO: 625078 - RNA, 64 nt, Homo Sapiens
ucucagccgugcaggccuuugcaguugcccuggccaacgugacucagcgccucaaaugaagaga

SEQ ID NO: 625079 - RNA, 64 nt, Homo Sapiens
uuacagccuacagaaugcucauauuuuuauuuuacaacgugauccuacaaaaaauuuuauugua

SEQ ID NO: 625080 - RNA, 64 nt, Homo Sapiens
aucuucacaaaguugucuuuucacuguguuuugucaacgugaaauuaaauuguaguuauaagca

SEQ ID NO: 625081 - RNA, 64 nt, Homo Sapiens
uuuuuacucaaacagaaacacugagcaaaacaaacaacgugagagaacucugggggauauuccc

SEQ ID NO: 625082 - RNA, 64 nt, Homo Sapiens
uggcacaaacuucagacucuaggcugaccauauacaacgugagagaaugaaacuauagaucaaa

SEQ ID NO: 625083 - RNA, 64 nt, Homo Sapiens
agccuuuauccagcaguauuuuaaguggggaaugcaacgugaggccaacugaacaauucccccc

SEQ ID NO: 625084 - RNA, 64 nt, Homo Sapiens
gagauucacagcaacugaucaaagggaguccagucaacgugagcaagcgugauuaugaugagga

SEQ ID NO: 625085 - RNA, 64 nt, Homo Sapiens
gaaggcaaaggaagcugucucggguguuucugaacaacgugacucaugaggggcuuuggcuacc

SEQ ID NO: 625086 - RNA, 64 nt, Homo Sapiens
gaaggaccagccccuugaccgacgaggcagaccacaacgugaaagcugcuagcccagaccugug

SEQ ID NO: 625087 - RNA, 64 nt, Homo Sapiens
uugauuacaucagcgucuccuaacauagauugaucaacgugauggccugccaggaacucuguga

SEQ ID NO: 625088 - RNA, 64 nt, Homo Sapiens
cuguuuuuuguguguguuucaucaucuccccuggcaacgugacuauuaucuaguccccagauug

SEQ ID NO: 625089 - RNA, 64 nt, Homo Sapiens
ugugcagaauccuugcugggguuucuacaguccccaacgugaacaguauuaagcaagaggugga

SEQ ID NO: 625090 - RNA, 64 nt, Homo Sapiens
ccugccugcucggacgccuuaacccagccaaaaccaacgugagcaugaaaaaaauauuuuaaaa

SEQ ID NO: 625091 - RNA, 64 nt, Homo Sapiens
gaaagcuacugcccccuaguaucuuccuggaugccaacgugaagugccuuccggccccagaagg

SEQ ID NO: 625092 - RNA, 64 nt, Homo Sapiens
gacucaacgcagaagaauggacgaaaugaccauccaacgugauuaaggauaggaaucgguaguu

SEQ ID NO: 625093 - RNA, 64 nt, Homo Sapiens
uugggugaauucugcagguuuuaugggcuugucacaacgugaagggcuggaauguauauuacca

SEQ ID NO: 625094 - RNA, 64 nt, Homo Sapiens
agauguccucuuaagaaaaugaugcaucaggaagcaacgugauggaggacuugggggaaaagga

SEQ ID NO: 625095 - RNA, 64 nt, Homo Sapiens
uuccuccaaggcauccucuaccuagcuaggucaccaacgugaagaaguuaugccacugccacuu

SEQ ID NO: 625096 - RNA, 64 nt, Homo Sapiens
gugggaggggacaaacauucuggcaaucgcauuucaacgugagccuaaucuuauacuguuacag

SEQ ID NO: 625097 - RNA, 64 nt, Homo Sapiens
acaacaagcaacauuuaucuaaauuugcugugaacaacgugaugauuggugcuuauuuuuucaa

SEQ ID NO: 625098 - RNA, 51 nt, Homo Sapiens
aaacucccucuucgucaugaccaacgugauccucaccaugaaccagacaca

SEQ ID NO: 625099 - RNA, 64 nt, Homo Sapiens
agugccauuuuuagaauaaccuuucauuuuauaccaacgugaaaaaaaauuucaucuuaaagca

SEQ ID NO: 625100 - RNA, 64 nt, Homo Sapiens
guugaauaguugcaucagaggcugcugucuaguucaacgugagauuguuuacauauuggcuaug

SEQ ID NO: 625101 - RNA, 51 nt, Homo Sapiens
uuuuuuacuagguauuuugaccaacgugauuuagcugaugagccaucuuga

SEQ ID NO: 625102 - RNA, 64 nt, Homo Sapiens
auuucaaguccuguuuauaagucuagucauucugcaacgugacauaucccccaaaaugaaguua

SEQ ID NO: 625103 - RNA, 64 nt, Homo Sapiens
ggcagcaacgccgucaaugugacgccuccauuggcaacgugacgcccuccaggauguauaugca

SEQ ID NO: 625104 - RNA, 64 nt, Homo Sapiens
gaaagagagaagccagccacuucagugccuucaacaacgugagaaaggacaggacccucaggaa

SEQ ID NO: 625105 - RNA, 64 nt, Homo Sapiens
guagacgcugucaguaacccccggugcuguuuuacaacgugagggacagccuugucacaccucc

SEQ ID NO: 625106 - RNA, 64 nt, Homo Sapiens
uagcagcagucacuaaauuggaaacaaaagguugcaacgugacaaaaaaaauuguguaguauuu

SEQ ID NO: 625107 - RNA, 64 nt, Homo Sapiens
accucaugucugcuucaagggcauccuucucuaacaacgugacuccugccuggguucaaacucu

SEQ ID NO: 625108 - RNA, 64 nt, Homo Sapiens
cuucuccuaguacaaccaaacagauaaccagaugcaacgugaagaucuagacuggacccugguu

SEQ ID NO: 625109 - RNA, 64 nt, Homo Sapiens
guuuguagacuuuagaguucuuuaauucuuggcacaacgugacuguugagcuaacaccaaauag

SEQ ID NO: 625110 - RNA, 64 nt, Homo Sapiens
cugauguggcucaguuuccgaccaccuaugcuaucaacgugagcauuucugcauuguuuguauc

SEQ ID NO: 625111 - RNA, 64 nt, Homo Sapiens
cggggaaugaccacccagaggucagccucgcucucaacgugaccugagcuagggagguggugca

SEQ ID NO: 625112 - RNA, 64 nt, Homo Sapiens
uaugcucaaggaccuggaaacccaugcuucgagacaacgugacuuuaaugggaggguggguggg

SEQ ID NO: 625113 - RNA, 64 nt, Homo Sapiens
acaggcuaugggaaggcugccaagcucgcugaggcaacgugagacucagggagccccacagccc

SEQ ID NO: 625114 - RNA, 64 nt, Homo Sapiens
uuggaucucuuguacgcagauugcagagggaggucaacgugaguucucccaacaccagcuggug

SEQ ID NO: 625115 - RNA, 64 nt, Homo Sapiens
aguuagcuuuguaagaaacagucaaacuguuuuccaacgugacauuuuauauucccaccaggaa

SEQ ID NO: 625116 - RNA, 64 nt, Homo Sapiens
uuccagguucuggggagaacaaugauccacgggucaacgugaucacauuuccuucuauccuucu

SEQ ID NO: 625117 - RNA, 64 nt, Homo Sapiens
gucagaggcugauucuuguagaauuaacagcccucaacgugaugagcuaugauaacacuaugaa

SEQ ID NO: 625118 - RNA, 64 nt, Homo Sapiens
aauauuugauuuuguucuagccaacuuuucaacccaacgugaugucaauaagaugcaaaaucuu

SEQ ID NO: 625119 - RNA, 64 nt, Homo Sapiens
guguuuuguuuuguuuuuuuucuuaaaacaacagcaacgugaucuuggcugucugucauguguu

SEQ ID NO: 625120 - RNA, 54 nt, Homo Sapiens
caggcucucgaagcucauaaaauucaacgugaggaagcaagugacaaggacgcc

SEQ ID NO: 625121 - RNA, 64 nt, Homo Sapiens
uaacgcaaauggcuuccucuagagaaaggcucagcaacgugaaaacuucagauuguucaacaug

SEQ ID NO: 625122 - RNA, 64 nt, Homo Sapiens
auacugguacuugauagccuauguaacagcugaccaacgugaagguugugaacuggugggccgu

SEQ ID NO: 625123 - RNA, 64 nt, Homo Sapiens
ggagcugaggacucucacgauaugcaaguucauccaacgugaagauaccauaagcuuuuucucu

SEQ ID NO: 625124 - RNA, 64 nt, Homo Sapiens
gucuuugcaaugccaacauaagggagaucuuggccaacgugaaauaaaauuacucauucaaaac

SEQ ID NO: 625125 - RNA, 64 nt, Homo Sapiens
ccuccccaccucccacugcuuccugcaagggcaccaguuguaugagaaaguuggccuuuggacu

SEQ ID NO: 625126 - RNA, 64 nt, Homo Sapiens
uuuuuuuuuuccaaacuacuuuuugucacugugacaguuguaaauaaaguuugaaaaugcuuuc

SEQ ID NO: 625127 - RNA, 64 nt, Homo Sapiens
uuaaaaguuugccuguagagcaaaauaaaacagucaguuguagucauuaauccuugaggcccaa

SEQ ID NO: 625128 - RNA, 64 nt, Homo Sapiens
uguguugcccaggcuggauugcaguggcuauucgcaguuguaaucauagcacacugcagccucg

SEQ ID NO: 625129 - RNA, 64 nt, Homo Sapiens
uuuuaaagcccuucugaugaccaugcccggcuggcaguuguauuaggauuacagguaugagcca

SEQ ID NO: 625130 - RNA, 64 nt, Homo Sapiens
uuuuuuuuuuuuuuuuuuuugcgucagcgccaggcaguuguauugccaaugaaaucauuucugg

SEQ ID NO: 625131 - RNA, 64 nt, Homo Sapiens
ugggcucaugaagauauugcaucaugagcugcagcaguuguacucuuuuuugaugaccuaaaaa

SEQ ID NO: 625132 - RNA, 64 nt, Homo Sapiens
ugauugugccuaugcaugaugaaugaaugaauuucaguuguacauugccuaaaucauaacuuga

SEQ ID NO: 625133 - RNA, 64 nt, Homo Sapiens
auacccagcuaaagaauacauaucagaauauauccaguuguaaauagccauacccaguuguacu

SEQ ID NO: 625134 - RNA, 64 nt, Homo Sapiens
uaucagaauauauccaguuguaaauagccauacccaguuguacuacaaugagcuuuuuaaaauc

SEQ ID NO: 625135 - RNA, 64 nt, Homo Sapiens
uccauuuuuaaagcuucuuacuggugaaacagcccaguuguaguaggugccagucagucaaggc

SEQ ID NO: 625136 - RNA, 64 nt, Homo Sapiens
uuacaggauauuccuagguaaaugaaggagccuucaguuguaaauuucaauuaccccaaaaugu

SEQ ID NO: 625137 - RNA, 64 nt, Homo Sapiens
uaauccauagaugugcuccuucugggaguaguuuugucuauauugucugucuauauuuaagguu

SEQ ID NO: 625138 - RNA, 64 nt, Homo Sapiens
uaagguuucugggaguaguuaaauuaauaaagucugucuauauucuauuuuuggcuuccuacau

SEQ ID NO: 625139 - RNA, 64 nt, Homo Sapiens
uaagaaucaccaggccaguguuucuggguuugcuugucuauauguuugucuauauuuuuugccu

SEQ ID NO: 625140 - RNA, 64 nt, Homo Sapiens
ggccaguguuucuggguuugcuugucuauauguuugucuauauuuuuugccuauacauuuuucc

SEQ ID NO: 625141 - RNA, 64 nt, Homo Sapiens
gauagcucuuaaaggagugaugaauuaucuuuugugucuauauugguagauaauuuuucaaaug

SEQ ID NO: 625142 - RNA, 64 nt, Homo Sapiens
auauggucaaguacagcucuuuguaauucugcuuugucuauaaguaacguuuuuguuacaugca

SEQ ID NO: 625143 - RNA, 64 nt, Homo Sapiens
caaccugaagacuugugaaaguugucuauagcuaugucuauaaaguucuguaugaaacugagau

SEQ ID NO: 625144 - RNA, 64 nt, Homo Sapiens
uaugucuauaaacaaccugaugaaacugagauguugucuauagcaugauugaaugaguucugua

SEQ ID NO: 625145 - RNA, 64 nt, Homo Sapiens
gggaaaagaauuuccuuuucccccuuuuuuguguugucuauaggaauuaacuugggauuguuuu

SEQ ID NO: 625146 - RNA, 64 nt, Homo Sapiens
uguuaauuuauaggcacauuugugguaauuuauaugucuauagaguaaguauaagagauaauuc

SEQ ID NO: 625147 - RNA, 64 nt, Homo Sapiens
uaucuaucgaucaucuuucucuucuacacauuuaugucuauagaaaaucgcuguaugguauggu

SEQ ID NO: 625148 - RNA, 64 nt, Homo Sapiens
guccugagugcaaguaauuauuuucagagccccaugucuauauauggcguuuccuucuguuugg

SEQ ID NO: 625149 - RNA, 64 nt, Homo Sapiens
cccccagaggugaaugagguauucuauaaguuagugucuauaauugugaaaguacaaacuucuu

SEQ ID NO: 625150 - RNA, 64 nt, Homo Sapiens
uuuccucauguaucuuugcacucuugugcuaguaugucuauagugugaauacauucauaaauuu

SEQ ID NO: 625151 - RNA, 64 nt, Homo Sapiens; identical to SEQ ID NO: 175895

SEQ ID NO: 625152 - RNA, 64 nt, Homo Sapiens; identical to SEQ ID NO: 175896

SEQ ID NO: 625153 - RNA, 64 nt, Homo Sapiens; identical to SEQ ID NO: 175897

SEQ ID NO: 625154 - RNA, 64 nt, Homo Sapiens; identical to SEQ ID NO: 175898

SEQ ID NO: 625155 - RNA, 64 nt, Homo Sapiens; identical to SEQ ID NO: 175899

SEQ ID NO: 625156 - RNA, 64 nt, Homo Sapiens; identical to SEQ ID NO: 175900

SEQ ID NO: 625157 - RNA, 64 nt, Homo Sapiens; identical to SEQ ID NO: 175901

SEQ ID NO: 625158 - RNA, 64 nt, Homo Sapiens; identical to SEQ ID NO: 175902

SEQ ID NO: 625159 - RNA, 64 nt, Homo Sapiens; identical to SEQ ID NO: 175903

SEQ ID NO: 625160 - RNA, 64 nt, Homo Sapiens; identical to SEQ ID NO: 175904

SEQ ID NO: 625161 - RNA, 64 nt, Homo Sapiens; identical to SEQ ID NO: 175905

SEQ ID NO: 625162 - RNA, 64 nt, Homo Sapiens; identical to SEQ ID NO: 175906

SEQ ID NO: 625163 - RNA, 64 nt, Homo Sapiens; identical to SEQ ID NO: 175907

SEQ ID NO: 625164 - RNA, 64 nt, Homo Sapiens; identical to SEQ ID NO: 175908

SEQ ID NO: 625165 - RNA, 64 nt, Homo Sapiens; identical to SEQ ID NO: 175909

SEQ ID NO: 625166 - RNA, 64 nt, Homo Sapiens; identical to SEQ ID NO: 175910

SEQ ID NO: 625167 - RNA, 64 nt, Homo Sapiens; identical to SEQ ID NO: 175911

SEQ ID NO: 625168 - RNA, 64 nt, Homo Sapiens; identical to SEQ ID NO: 175912

SEQ ID NO: 625169 - RNA, 64 nt, Homo Sapiens; identical to SEQ ID NO: 175913

SEQ ID NO: 625170 - RNA, 64 nt, Homo Sapiens; identical to SEQ ID NO: 175914

SEQ ID NO: 625171 - RNA, 64 nt, Homo Sapiens; identical to SEQ ID NO: 175915

SEQ ID NO: 625172 - RNA, 64 nt, Homo Sapiens; identical to SEQ ID NO: 175916

SEQ ID NO: 625173 - RNA, 64 nt, Homo Sapiens; identical to SEQ ID NO: 175917

SEQ ID NO: 625174 - RNA, 64 nt, Homo Sapiens; identical to SEQ ID NO: 175918

SEQ ID NO: 625175 - RNA, 64 nt, Homo Sapiens; identical to SEQ ID NO: 175919

SEQ ID NO: 625176 - RNA, 64 nt, Homo Sapiens; identical to SEQ ID NO: 175920

SEQ ID NO: 625177 - RNA, 64 nt, Homo Sapiens; identical to SEQ ID NO: 175921

SEQ ID NO: 625178 - RNA, 64 nt, Homo Sapiens; identical to SEQ ID NO: 175922

SEQ ID NO: 625179 - RNA, 64 nt, Homo Sapiens; identical to SEQ ID NO: 175923

SEQ ID NO: 625180 - RNA, 64 nt, Homo Sapiens; identical to SEQ ID NO: 175924

SEQ ID NO: 625181 - RNA, 64 nt, Homo Sapiens; identical to SEQ ID NO: 175925

SEQ ID NO: 625182 - RNA, 64 nt, Homo Sapiens; identical to SEQ ID NO: 175926

SEQ ID NO: 625183 - RNA, 64 nt, Homo Sapiens; identical to SEQ ID NO: 175927

SEQ ID NO: 625184 - RNA, 64 nt, Homo Sapiens; identical to SEQ ID NO: 175928

SEQ ID NO: 625185 - RNA, 64 nt, Homo Sapiens; identical to SEQ ID NO: 175929

SEQ ID NO: 625186 - RNA, 64 nt, Homo Sapiens; identical to SEQ ID NO: 175930

SEQ ID NO: 625187 - RNA, 64 nt, Homo Sapiens; identical to SEQ ID NO: 175931

SEQ ID NO: 625188 - RNA, 64 nt, Homo Sapiens; identical to SEQ ID NO: 175932

SEQ ID NO: 625189 - RNA, 64 nt, Homo Sapiens; identical to SEQ ID NO: 175933

SEQ ID NO: 625190 - RNA, 64 nt, Homo Sapiens; identical to SEQ ID NO: 175934

SEQ ID NO: 625191 - RNA, 64 nt, Homo Sapiens; identical to SEQ ID NO: 175935

SEQ ID NO: 625192 - RNA, 64 nt, Homo Sapiens; identical to SEQ ID NO: 175936

SEQ ID NO: 625193 - RNA, 64 nt, Homo Sapiens; identical to SEQ ID NO: 175937

SEQ ID NO: 625194 - RNA, 64 nt, Homo Sapiens; identical to SEQ ID NO: 175938

SEQ ID NO: 625195 - RNA, 64 nt, Homo Sapiens; identical to SEQ ID NO: 175939

SEQ ID NO: 625196 - RNA, 64 nt, Homo Sapiens; identical to SEQ ID NO: 175940

SEQ ID NO: 625197 - RNA, 64 nt, Homo Sapiens; identical to SEQ ID NO: 175941

SEQ ID NO: 625198 - RNA, 64 nt, Homo Sapiens; identical to SEQ ID NO: 175942

SEQ ID NO: 625199 - RNA, 64 nt, Homo Sapiens; identical to SEQ ID NO: 175943

SEQ ID NO: 625200 - RNA, 64 nt, Homo Sapiens; identical to SEQ ID NO: 175944

SEQ ID NO: 625201 - RNA, 64 nt, Homo Sapiens; identical to SEQ ID NO: 175945

SEQ ID NO: 625202 - RNA, 64 nt, Homo Sapiens; identical to SEQ ID NO: 175946

SEQ ID NO: 625203 - RNA, 64 nt, Homo Sapiens; identical to SEQ ID NO: 175947

SEQ ID NO: 625204 - RNA, 64 nt, Homo Sapiens; identical to SEQ ID NO: 175948

SEQ ID NO: 625205 - RNA, 64 nt, Homo Sapiens; identical to SEQ ID NO: 175949

SEQ ID NO: 625206 - RNA, 64 nt, Homo Sapiens; identical to SEQ ID NO: 175950

SEQ ID NO: 625207 - RNA, 64 nt, Homo Sapiens; identical to SEQ ID NO: 175951

SEQ ID NO: 625208 - RNA, 64 nt, Homo Sapiens; identical to SEQ ID NO: 175952

SEQ ID NO: 625209 - RNA, 64 nt, Homo Sapiens; identical to SEQ ID NO: 175953

SEQ ID NO: 625210 - RNA, 62 nt, Homo Sapiens; identical to SEQ ID NO: 175954

SEQ ID NO: 625211 - RNA, 64 nt, Homo Sapiens; identical to SEQ ID NO: 175955

SEQ ID NO: 625212 - RNA, 64 nt, Homo Sapiens; identical to SEQ ID NO: 175956

SEQ ID NO: 625213 - RNA, 64 nt, Homo Sapiens; identical to SEQ ID NO: 175957

SEQ ID NO: 625214 - RNA, 64 nt, Homo Sapiens; identical to SEQ ID NO: 175958

SEQ ID NO: 625215 - RNA, 64 nt, Homo Sapiens; identical to SEQ ID NO: 175959

SEQ ID NO: 625216 - RNA, 64 nt, Homo Sapiens; identical to SEQ ID NO: 175960

SEQ ID NO: 625217 - RNA, 64 nt, Homo Sapiens; identical to SEQ ID NO: 175961

SEQ ID NO: 625218 - RNA, 64 nt, Homo Sapiens; identical to SEQ ID NO: 175962

SEQ ID NO: 625219 - RNA, 64 nt, Homo Sapiens; identical to SEQ ID NO: 175963

SEQ ID NO: 625220 - RNA, 64 nt, Homo Sapiens; identical to SEQ ID NO: 175964

SEQ ID NO: 625221 - RNA, 64 nt, Homo Sapiens; identical to SEQ ID NO: 175965

SEQ ID NO: 625222 - RNA, 64 nt, Homo Sapiens; identical to SEQ ID NO: 175966

SEQ ID NO: 625223 - RNA, 64 nt, Homo Sapiens; identical to SEQ ID NO: 175967

SEQ ID NO: 625224 - RNA, 64 nt, Homo Sapiens; identical to SEQ ID NO: 175968

SEQ ID NO: 625225 - RNA, 64 nt, Homo Sapiens; identical to SEQ ID NO: 175969

SEQ ID NO: 625226 - RNA, 64 nt, Homo Sapiens; identical to SEQ ID NO: 175970

SEQ ID NO: 625227 - RNA, 64 nt, Homo Sapiens; identical to SEQ ID NO: 175971

SEQ ID NO: 625228 - RNA, 64 nt, Homo Sapiens; identical to SEQ ID NO: 175972

SEQ ID NO: 625229 - RNA, 64 nt, Homo Sapiens; identical to SEQ ID NO: 175973

SEQ ID NO: 625230 - RNA, 64 nt, Homo Sapiens; identical to SEQ ID NO: 175974

SEQ ID NO: 625231 - RNA, 64 nt, Homo Sapiens; identical to SEQ ID NO: 175975

SEQ ID NO: 625232 - RNA, 64 nt, Homo Sapiens; identical to SEQ ID NO: 175976

SEQ ID NO: 625233 - RNA, 64 nt, Homo Sapiens; identical to SEQ ID NO: 175977

SEQ ID NO: 625234 - RNA, 64 nt, Homo Sapiens; identical to SEQ ID NO: 175978

SEQ ID NO: 625235 - RNA, 64 nt, Homo Sapiens; identical to SEQ ID NO: 175979

SEQ ID NO: 625236 - RNA, 64 nt, Homo Sapiens; identical to SEQ ID NO: 175980

SEQ ID NO: 625237 - RNA, 64 nt, Homo Sapiens; identical to SEQ ID NO: 175981

SEQ ID NO: 625238 - RNA, 64 nt, Homo Sapiens; identical to SEQ ID NO: 175982

SEQ ID NO: 625239 - RNA, 64 nt, Homo Sapiens; identical to SEQ ID NO: 175983

SEQ ID NO: 625240 - RNA, 64 nt, Homo Sapiens; identical to SEQ ID NO: 175984

SEQ ID NO: 625241 - RNA, 64 nt, Homo Sapiens; identical to SEQ ID NO: 175985

SEQ ID NO: 625242 - RNA, 64 nt, Homo Sapiens; identical to SEQ ID NO: 175986

SEQ ID NO: 625243 - RNA, 64 nt, Homo Sapiens; identical to SEQ ID NO: 175987

SEQ ID NO: 625244 - RNA, 64 nt, Homo Sapiens; identical to SEQ ID NO: 175988

SEQ ID NO: 625245 - RNA, 64 nt, Homo Sapiens; identical to SEQ ID NO: 175989

SEQ ID NO: 625246 - RNA, 64 nt, Homo Sapiens; identical to SEQ ID NO: 175990

SEQ ID NO: 625247 - RNA, 64 nt, Homo Sapiens; identical to SEQ ID NO: 175991

SEQ ID NO: 625248 - RNA, 64 nt, Homo Sapiens; identical to SEQ ID NO: 175992

SEQ ID NO: 625249 - RNA, 64 nt, Homo Sapiens; identical to SEQ ID NO: 175993

SEQ ID NO: 625250 - RNA, 64 nt, Homo Sapiens; identical to SEQ ID NO: 175994

SEQ ID NO: 625251 - RNA, 64 nt, Homo Sapiens; identical to SEQ ID NO: 175995

SEQ ID NO: 625252 - RNA, 64 nt, Homo Sapiens; identical to SEQ ID NO: 175996

SEQ ID NO: 625253 - RNA, 64 nt, Homo Sapiens; identical to SEQ ID NO: 175997

SEQ ID NO: 625254 - RNA, 62 nt, Homo Sapiens; identical to SEQ ID NO: 175998

SEQ ID NO: 625255 - RNA, 64 nt, Homo Sapiens; identical to SEQ ID NO: 175999

SEQ ID NO: 625256 - RNA, 64 nt, Homo Sapiens; identical to SEQ ID NO: 176000

SEQ ID NO: 625257 - RNA, 64 nt, Homo Sapiens; identical to SEQ ID NO: 176001

SEQ ID NO: 625258 - RNA, 64 nt, Homo Sapiens; identical to SEQ ID NO: 176002

SEQ ID NO: 625259 - RNA, 64 nt, Homo Sapiens; identical to SEQ ID NO: 176003

SEQ ID NO: 625260 - RNA, 64 nt, Homo Sapiens; identical to SEQ ID NO: 176004

SEQ ID NO: 625261 - RNA, 64 nt, Homo Sapiens; identical to SEQ ID NO: 176005

SEQ ID NO: 625262 - RNA, 64 nt, Homo Sapiens; identical to SEQ ID NO: 176006

SEQ ID NO: 625263 - RNA, 64 nt, Homo Sapiens; identical to SEQ ID NO: 176007

SEQ ID NO: 625264 - RNA, 64 nt, Homo Sapiens; identical to SEQ ID NO: 176008

SEQ ID NO: 625265 - RNA, 64 nt, Homo Sapiens; identical to SEQ ID NO: 176009

SEQ ID NO: 625266 - RNA, 64 nt, Homo Sapiens; identical to SEQ ID NO: 176010

SEQ ID NO: 625267 - RNA, 64 nt, Homo Sapiens; identical to SEQ ID NO: 176011

SEQ ID NO: 625268 - RNA, 64 nt, Homo Sapiens; identical to SEQ ID NO: 176012

SEQ ID NO: 625269 - RNA, 64 nt, Homo Sapiens; identical to SEQ ID NO: 176013

SEQ ID NO: 625270 - RNA, 64 nt, Homo Sapiens; identical to SEQ ID NO: 176014

SEQ ID NO: 625271 - RNA, 64 nt, Homo Sapiens; identical to SEQ ID NO: 176015

SEQ ID NO: 625272 - RNA, 64 nt, Homo Sapiens; identical to SEQ ID NO: 176016

SEQ ID NO: 625273 - RNA, 64 nt, Homo Sapiens; identical to SEQ ID NO: 176017

SEQ ID NO: 625274 - RNA, 64 nt, Homo Sapiens; identical to SEQ ID NO: 176018

SEQ ID NO: 625275 - RNA, 64 nt, Homo Sapiens; identical to SEQ ID NO: 176019

SEQ ID NO: 625276 - RNA, 64 nt, Homo Sapiens; identical to SEQ ID NO: 176020

SEQ ID NO: 625277 - RNA, 64 nt, Homo Sapiens; identical to SEQ ID NO: 176021

SEQ ID NO: 625278 - RNA, 64 nt, Homo Sapiens; identical to SEQ ID NO: 176022

SEQ ID NO: 625279 - RNA, 64 nt, Homo Sapiens; identical to SEQ ID NO: 176023

SEQ ID NO: 625280 - RNA, 64 nt, Homo Sapiens; identical to SEQ ID NO: 176024

SEQ ID NO: 625281 - RNA, 64 nt, Homo Sapiens; identical to SEQ ID NO: 176025

SEQ ID NO: 625282 - RNA, 64 nt, Homo Sapiens; identical to SEQ ID NO: 176026

SEQ ID NO: 625283 - RNA, 64 nt, Homo Sapiens; identical to SEQ ID NO: 176027

SEQ ID NO: 625284 - RNA, 64 nt, Homo Sapiens; identical to SEQ ID NO: 176028

SEQ ID NO: 625285 - RNA, 64 nt, Homo Sapiens; identical to SEQ ID NO: 176029

SEQ ID NO: 625286 - RNA, 59 nt, Homo Sapiens; identical to SEQ ID NO: 176030

SEQ ID NO: 625287 - RNA, 56 nt, Homo Sapiens; identical to SEQ ID NO: 176031

SEQ ID NO: 625288 - RNA, 64 nt, Homo Sapiens; identical to SEQ ID NO: 176032

SEQ ID NO: 625289 - RNA, 64 nt, Homo Sapiens; identical to SEQ ID NO: 176033

SEQ ID NO: 625290 - RNA, 64 nt, Homo Sapiens; identical to SEQ ID NO: 176034

SEQ ID NO: 625291 - RNA, 64 nt, Homo Sapiens; identical to SEQ ID NO: 176035

SEQ ID NO: 625292 - RNA, 64 nt, Homo Sapiens; identical to SEQ ID NO: 176036

SEQ ID NO: 625293 - RNA, 64 nt, Homo Sapiens; identical to SEQ ID NO: 176037

SEQ ID NO: 625294 - RNA, 64 nt, Homo Sapiens; identical to SEQ ID NO: 176038

SEQ ID NO: 625295 - RNA, 64 nt, Homo Sapiens; identical to SEQ ID NO: 176039

SEQ ID NO: 625296 - RNA, 64 nt, Homo Sapiens; identical to SEQ ID NO: 176040

SEQ ID NO: 625297 - RNA, 64 nt, Homo Sapiens; identical to SEQ ID NO: 176041

SEQ ID NO: 625298 - RNA, 64 nt, Homo Sapiens; identical to SEQ ID NO: 176042

SEQ ID NO: 625299 - RNA, 64 nt, Homo Sapiens; identical to SEQ ID NO: 176043

SEQ ID NO: 625300 - RNA, 64 nt, Homo Sapiens; identical to SEQ ID NO: 176044

SEQ ID NO: 625301 - RNA, 64 nt, Homo Sapiens; identical to SEQ ID NO: 176045

SEQ ID NO: 625302 - RNA, 64 nt, Homo Sapiens; identical to SEQ ID NO: 176046

SEQ ID NO: 625303 - RNA, 64 nt, Homo Sapiens; identical to SEQ ID NO: 176047

SEQ ID NO: 625304 - RNA, 64 nt, Homo Sapiens; identical to SEQ ID NO: 176048

SEQ ID NO: 625305 - RNA, 64 nt, Homo Sapiens; identical to SEQ ID NO: 176049

SEQ ID NO: 625306 - RNA, 64 nt, Homo Sapiens; identical to SEQ ID NO: 176050

SEQ ID NO: 625307 - RNA, 64 nt, Homo Sapiens; identical to SEQ ID NO: 176051

SEQ ID NO: 625308 - RNA, 64 nt, Homo Sapiens; identical to SEQ ID NO: 176052

SEQ ID NO: 625309 - RNA, 64 nt, Homo Sapiens; identical to SEQ ID NO: 176053

SEQ ID NO: 625310 - RNA, 64 nt, Homo Sapiens; identical to SEQ ID NO: 176054

SEQ ID NO: 625311 - RNA, 64 nt, Homo Sapiens; identical to SEQ ID NO: 176055

SEQ ID NO: 625312 - RNA, 64 nt, Homo Sapiens; identical to SEQ ID NO: 176056

SEQ ID NO: 625313 - RNA, 64 nt, Homo Sapiens; identical to SEQ ID NO: 176057

SEQ ID NO: 625314 - RNA, 64 nt, Homo Sapiens; identical to SEQ ID NO: 176058

SEQ ID NO: 625315 - RNA, 64 nt, Homo Sapiens; identical to SEQ ID NO: 176059

SEQ ID NO: 625316 - RNA, 64 nt, Homo Sapiens; identical to SEQ ID NO: 176060

SEQ ID NO: 625317 - RNA, 64 nt, Homo Sapiens; identical to SEQ ID NO: 176061

SEQ ID NO: 625318 - RNA, 64 nt, Homo Sapiens; identical to SEQ ID NO: 176062

SEQ ID NO: 625319 - RNA, 64 nt, Homo Sapiens; identical to SEQ ID NO: 176063

SEQ ID NO: 625320 - RNA, 64 nt, Homo Sapiens; identical to SEQ ID NO: 176064

SEQ ID NO: 625321 - RNA, 64 nt, Homo Sapiens; identical to SEQ ID NO: 176065

SEQ ID NO: 625322 - RNA, 64 nt, Homo Sapiens; identical to SEQ ID NO: 176066

SEQ ID NO: 625323 - RNA, 64 nt, Homo Sapiens; identical to SEQ ID NO: 176067

SEQ ID NO: 625324 - RNA, 64 nt, Homo Sapiens; identical to SEQ ID NO: 176068

SEQ ID NO: 625325 - RNA, 64 nt, Homo Sapiens; identical to SEQ ID NO: 176069

SEQ ID NO: 625326 - RNA, 64 nt, Homo Sapiens; identical to SEQ ID NO: 176070

SEQ ID NO: 625327 - RNA, 64 nt, Homo Sapiens; identical to SEQ ID NO: 176071

SEQ ID NO: 625328 - RNA, 64 nt, Homo Sapiens; identical to SEQ ID NO: 176072

SEQ ID NO: 625329 - RNA, 64 nt, Homo Sapiens; identical to SEQ ID NO: 176073

SEQ ID NO: 625330 - RNA, 64 nt, Homo Sapiens; identical to SEQ ID NO: 176074

SEQ ID NO: 625331 - RNA, 64 nt, Homo Sapiens; identical to SEQ ID NO: 176075

SEQ ID NO: 625332 - RNA, 64 nt, Homo Sapiens; identical to SEQ ID NO: 176076

SEQ ID NO: 625333 - RNA, 64 nt, Homo Sapiens; identical to SEQ ID NO: 176077

SEQ ID NO: 625334 - RNA, 64 nt, Homo Sapiens; identical to SEQ ID NO: 176078

SEQ ID NO: 625335 - RNA, 64 nt, Homo Sapiens; identical to SEQ ID NO: 176079

SEQ ID NO: 625336 - RNA, 64 nt, Homo Sapiens; identical to SEQ ID NO: 176080

SEQ ID NO: 625337 - RNA, 64 nt, Homo Sapiens; identical to SEQ ID NO: 176081

SEQ ID NO: 625338 - RNA, 64 nt, Homo Sapiens; identical to SEQ ID NO: 176082

SEQ ID NO: 625339 - RNA, 64 nt, Homo Sapiens; identical to SEQ ID NO: 176083

SEQ ID NO: 625340 - RNA, 64 nt, Homo Sapiens; identical to SEQ ID NO: 176084

SEQ ID NO: 625341 - RNA, 64 nt, Homo Sapiens; identical to SEQ ID NO: 176085

SEQ ID NO: 625342 - RNA, 64 nt, Homo Sapiens; identical to SEQ ID NO: 176086

SEQ ID NO: 625343 - RNA, 64 nt, Homo Sapiens; identical to SEQ ID NO: 176087

SEQ ID NO: 625344 - RNA, 64 nt, Homo Sapiens; identical to SEQ ID NO: 176088

SEQ ID NO: 625345 - RNA, 62 nt, Homo Sapiens; identical to SEQ ID NO: 176089

SEQ ID NO: 625346 - RNA, 64 nt, Homo Sapiens; identical to SEQ ID NO: 176090

SEQ ID NO: 625347 - RNA, 64 nt, Homo Sapiens; identical to SEQ ID NO: 176091

SEQ ID NO: 625348 - RNA, 64 nt, Homo Sapiens; identical to SEQ ID NO: 176092

SEQ ID NO: 625349 - RNA, 64 nt, Homo Sapiens; identical to SEQ ID NO: 176093

SEQ ID NO: 625350 - RNA, 64 nt, Homo Sapiens; identical to SEQ ID NO: 176094

SEQ ID NO: 625351 - RNA, 63 nt, Homo Sapiens; identical to SEQ ID NO: 176095

SEQ ID NO: 625352 - RNA, 64 nt, Homo Sapiens; identical to SEQ ID NO: 176096

SEQ ID NO: 625353 - RNA, 64 nt, Homo Sapiens; identical to SEQ ID NO: 176097

SEQ ID NO: 625354 - RNA, 64 nt, Homo Sapiens; identical to SEQ ID NO: 175895

SEQ ID NO: 625355 - RNA, 64 nt, Homo Sapiens; identical to SEQ ID NO: 175896

SEQ ID NO: 625356 - RNA, 64 nt, Homo Sapiens; identical to SEQ ID NO: 175897

SEQ ID NO: 625357 - RNA, 64 nt, Homo Sapiens; identical to SEQ ID NO: 175898

SEQ ID NO: 625358 - RNA, 64 nt, Homo Sapiens; identical to SEQ ID NO: 175899

SEQ ID NO: 625359 - RNA, 64 nt, Homo Sapiens; identical to SEQ ID NO: 175900

SEQ ID NO: 625360 - RNA, 64 nt, Homo Sapiens; identical to SEQ ID NO: 175901

SEQ ID NO: 625361 - RNA, 64 nt, Homo Sapiens; identical to SEQ ID NO: 175902

SEQ ID NO: 625362 - RNA, 64 nt, Homo Sapiens; identical to SEQ ID NO: 175903

SEQ ID NO: 625363 - RNA, 64 nt, Homo Sapiens; identical to SEQ ID NO: 175904

SEQ ID NO: 625364 - RNA, 64 nt, Homo Sapiens; identical to SEQ ID NO: 175905

SEQ ID NO: 625365 - RNA, 64 nt, Homo Sapiens; identical to SEQ ID NO: 175906

SEQ ID NO: 625366 - RNA, 64 nt, Homo Sapiens; identical to SEQ ID NO: 175907

SEQ ID NO: 625367 - RNA, 64 nt, Homo Sapiens; identical to SEQ ID NO: 175908

SEQ ID NO: 625368 - RNA, 64 nt, Homo Sapiens; identical to SEQ ID NO: 175909

SEQ ID NO: 625369 - RNA, 64 nt, Homo Sapiens; identical to SEQ ID NO: 175910

SEQ ID NO: 625370 - RNA, 64 nt, Homo Sapiens; identical to SEQ ID NO: 175911

SEQ ID NO: 625371 - RNA, 64 nt, Homo Sapiens; identical to SEQ ID NO: 175912

SEQ ID NO: 625372 - RNA, 64 nt, Homo Sapiens; identical to SEQ ID NO: 175913

SEQ ID NO: 625373 - RNA, 64 nt, Homo Sapiens; identical to SEQ ID NO: 175914

SEQ ID NO: 625374 - RNA, 64 nt, Homo Sapiens; identical to SEQ ID NO: 175915

SEQ ID NO: 625375 - RNA, 64 nt, Homo Sapiens; identical to SEQ ID NO: 175916

SEQ ID NO: 625376 - RNA, 64 nt, Homo Sapiens; identical to SEQ ID NO: 175917

SEQ ID NO: 625377 - RNA, 64 nt, Homo Sapiens; identical to SEQ ID NO: 175918

SEQ ID NO: 625378 - RNA, 64 nt, Homo Sapiens; identical to SEQ ID NO: 175919

SEQ ID NO: 625379 - RNA, 64 nt, Homo Sapiens; identical to SEQ ID NO: 175920

SEQ ID NO: 625380 - RNA, 64 nt, Homo Sapiens; identical to SEQ ID NO: 175921

SEQ ID NO: 625381 - RNA, 64 nt, Homo Sapiens; identical to SEQ ID NO: 175922

SEQ ID NO: 625382 - RNA, 64 nt, Homo Sapiens; identical to SEQ ID NO: 175923

SEQ ID NO: 625383 - RNA, 64 nt, Homo Sapiens; identical to SEQ ID NO: 175924

SEQ ID NO: 625384 - RNA, 64 nt, Homo Sapiens; identical to SEQ ID NO: 175925

SEQ ID NO: 625385 - RNA, 64 nt, Homo Sapiens; identical to SEQ ID NO: 175926

SEQ ID NO: 625386 - RNA, 64 nt, Homo Sapiens; identical to SEQ ID NO: 175927

SEQ ID NO: 625387 - RNA, 64 nt, Homo Sapiens; identical to SEQ ID NO: 175928

SEQ ID NO: 625388 - RNA, 64 nt, Homo Sapiens; identical to SEQ ID NO: 175929

SEQ ID NO: 625389 - RNA, 64 nt, Homo Sapiens; identical to SEQ ID NO: 175930

SEQ ID NO: 625390 - RNA, 64 nt, Homo Sapiens; identical to SEQ ID NO: 175931

SEQ ID NO: 625391 - RNA, 64 nt, Homo Sapiens; identical to SEQ ID NO: 175932

SEQ ID NO: 625392 - RNA, 64 nt, Homo Sapiens; identical to SEQ ID NO: 175933

SEQ ID NO: 625393 - RNA, 64 nt, Homo Sapiens; identical to SEQ ID NO: 175934

SEQ ID NO: 625394 - RNA, 64 nt, Homo Sapiens; identical to SEQ ID NO: 175935

SEQ ID NO: 625395 - RNA, 64 nt, Homo Sapiens; identical to SEQ ID NO: 175936

SEQ ID NO: 625396 - RNA, 64 nt, Homo Sapiens; identical to SEQ ID NO: 175937

SEQ ID NO: 625397 - RNA, 64 nt, Homo Sapiens; identical to SEQ ID NO: 175938

SEQ ID NO: 625398 - RNA, 64 nt, Homo Sapiens; identical to SEQ ID NO: 175939

SEQ ID NO: 625399 - RNA, 64 nt, Homo Sapiens; identical to SEQ ID NO: 175940

SEQ ID NO: 625400 - RNA, 64 nt, Homo Sapiens; identical to SEQ ID NO: 175941

SEQ ID NO: 625401 - RNA, 64 nt, Homo Sapiens; identical to SEQ ID NO: 175942

SEQ ID NO: 625402 - RNA, 64 nt, Homo Sapiens; identical to SEQ ID NO: 175943

SEQ ID NO: 625403 - RNA, 64 nt, Homo Sapiens; identical to SEQ ID NO: 175944

SEQ ID NO: 625404 - RNA, 64 nt, Homo Sapiens; identical to SEQ ID NO: 175945

SEQ ID NO: 625405 - RNA, 64 nt, Homo Sapiens; identical to SEQ ID NO: 175946

SEQ ID NO: 625406 - RNA, 64 nt, Homo Sapiens; identical to SEQ ID NO: 175947

SEQ ID NO: 625407 - RNA, 64 nt, Homo Sapiens; identical to SEQ ID NO: 175948

SEQ ID NO: 625408 - RNA, 64 nt, Homo Sapiens; identical to SEQ ID NO: 175949

SEQ ID NO: 625409 - RNA, 64 nt, Homo Sapiens; identical to SEQ ID NO: 175950

SEQ ID NO: 625410 - RNA, 64 nt, Homo Sapiens; identical to SEQ ID NO: 175951

SEQ ID NO: 625411 - RNA, 64 nt, Homo Sapiens; identical to SEQ ID NO: 175952

SEQ ID NO: 625412 - RNA, 64 nt, Homo Sapiens; identical to SEQ ID NO: 175953

SEQ ID NO: 625413 - RNA, 62 nt, Homo Sapiens; identical to SEQ ID NO: 175954

SEQ ID NO: 625414 - RNA, 64 nt, Homo Sapiens; identical to SEQ ID NO: 175955

SEQ ID NO: 625415 - RNA, 64 nt, Homo Sapiens; identical to SEQ ID NO: 175956

SEQ ID NO: 625416 - RNA, 64 nt, Homo Sapiens; identical to SEQ ID NO: 175957

SEQ ID NO: 625417 - RNA, 64 nt, Homo Sapiens; identical to SEQ ID NO: 175958

SEQ ID NO: 625418 - RNA, 64 nt, Homo Sapiens; identical to SEQ ID NO: 175959

SEQ ID NO: 625419 - RNA, 64 nt, Homo Sapiens; identical to SEQ ID NO: 175960

SEQ ID NO: 625420 - RNA, 64 nt, Homo Sapiens; identical to SEQ ID NO: 175961

SEQ ID NO: 625421 - RNA, 64 nt, Homo Sapiens; identical to SEQ ID NO: 175962

SEQ ID NO: 625422 - RNA, 64 nt, Homo Sapiens; identical to SEQ ID NO: 175963

SEQ ID NO: 625423 - RNA, 64 nt, Homo Sapiens; identical to SEQ ID NO: 175964

SEQ ID NO: 625424 - RNA, 64 nt, Homo Sapiens; identical to SEQ ID NO: 175965

SEQ ID NO: 625425 - RNA, 64 nt, Homo Sapiens; identical to SEQ ID NO: 175966

SEQ ID NO: 625426 - RNA, 64 nt, Homo Sapiens; identical to SEQ ID NO: 175967

SEQ ID NO: 625427 - RNA, 64 nt, Homo Sapiens; identical to SEQ ID NO: 175968

SEQ ID NO: 625428 - RNA, 64 nt, Homo Sapiens; identical to SEQ ID NO: 175969

SEQ ID NO: 625429 - RNA, 64 nt, Homo Sapiens; identical to SEQ ID NO: 175970

SEQ ID NO: 625430 - RNA, 64 nt, Homo Sapiens; identical to SEQ ID NO: 175971

SEQ ID NO: 625431 - RNA, 64 nt, Homo Sapiens; identical to SEQ ID NO: 175972

SEQ ID NO: 625432 - RNA, 64 nt, Homo Sapiens; identical to SEQ ID NO: 175973

SEQ ID NO: 625433 - RNA, 64 nt, Homo Sapiens; identical to SEQ ID NO: 175974

SEQ ID NO: 625434 - RNA, 64 nt, Homo Sapiens; identical to SEQ ID NO: 175975

SEQ ID NO: 625435 - RNA, 64 nt, Homo Sapiens; identical to SEQ ID NO: 175976

SEQ ID NO: 625436 - RNA, 64 nt, Homo Sapiens; identical to SEQ ID NO: 175977

SEQ ID NO: 625437 - RNA, 64 nt, Homo Sapiens; identical to SEQ ID NO: 175978

SEQ ID NO: 625438 - RNA, 64 nt, Homo Sapiens; identical to SEQ ID NO: 175979

SEQ ID NO: 625439 - RNA, 64 nt, Homo Sapiens; identical to SEQ ID NO: 175980

SEQ ID NO: 625440 - RNA, 64 nt, Homo Sapiens; identical to SEQ ID NO: 175981

SEQ ID NO: 625441 - RNA, 64 nt, Homo Sapiens; identical to SEQ ID NO: 175982

SEQ ID NO: 625442 - RNA, 64 nt, Homo Sapiens; identical to SEQ ID NO: 175983

SEQ ID NO: 625443 - RNA, 64 nt, Homo Sapiens; identical to SEQ ID NO: 175984

SEQ ID NO: 625444 - RNA, 64 nt, Homo Sapiens; identical to SEQ ID NO: 175985

SEQ ID NO: 625445 - RNA, 64 nt, Homo Sapiens; identical to SEQ ID NO: 175986

SEQ ID NO: 625446 - RNA, 64 nt, Homo Sapiens; identical to SEQ ID NO: 175987

SEQ ID NO: 625447 - RNA, 64 nt, Homo Sapiens; identical to SEQ ID NO: 175988

SEQ ID NO: 625448 - RNA, 64 nt, Homo Sapiens; identical to SEQ ID NO: 175989

SEQ ID NO: 625449 - RNA, 64 nt, Homo Sapiens; identical to SEQ ID NO: 175990

SEQ ID NO: 625450 - RNA, 64 nt, Homo Sapiens; identical to SEQ ID NO: 175991

SEQ ID NO: 625451 - RNA, 64 nt, Homo Sapiens; identical to SEQ ID NO: 175992

SEQ ID NO: 625452 - RNA, 64 nt, Homo Sapiens; identical to SEQ ID NO: 175993

SEQ ID NO: 625453 - RNA, 64 nt, Homo Sapiens; identical to SEQ ID NO: 175994

SEQ ID NO: 625454 - RNA, 64 nt, Homo Sapiens; identical to SEQ ID NO: 175995

SEQ ID NO: 625455 - RNA, 64 nt, Homo Sapiens; identical to SEQ ID NO: 175996

SEQ ID NO: 625456 - RNA, 64 nt, Homo Sapiens; identical to SEQ ID NO: 175997

SEQ ID NO: 625457 - RNA, 62 nt, Homo Sapiens; identical to SEQ ID NO: 175998

SEQ ID NO: 625458 - RNA, 64 nt, Homo Sapiens; identical to SEQ ID NO: 175999

SEQ ID NO: 625459 - RNA, 64 nt, Homo Sapiens; identical to SEQ ID NO: 176000

SEQ ID NO: 625460 - RNA, 64 nt, Homo Sapiens; identical to SEQ ID NO: 176001

SEQ ID NO: 625461 - RNA, 64 nt, Homo Sapiens; identical to SEQ ID NO: 176002

SEQ ID NO: 625462 - RNA, 64 nt, Homo Sapiens; identical to SEQ ID NO: 176003

SEQ ID NO: 625463 - RNA, 64 nt, Homo Sapiens; identical to SEQ ID NO: 176004

SEQ ID NO: 625464 - RNA, 64 nt, Homo Sapiens; identical to SEQ ID NO: 176005

SEQ ID NO: 625465 - RNA, 64 nt, Homo Sapiens; identical to SEQ ID NO: 176006

SEQ ID NO: 625466 - RNA, 64 nt, Homo Sapiens; identical to SEQ ID NO: 176007

SEQ ID NO: 625467 - RNA, 64 nt, Homo Sapiens; identical to SEQ ID NO: 176008

SEQ ID NO: 625468 - RNA, 64 nt, Homo Sapiens; identical to SEQ ID NO: 176009

SEQ ID NO: 625469 - RNA, 64 nt, Homo Sapiens; identical to SEQ ID NO: 176010

SEQ ID NO: 625470 - RNA, 64 nt, Homo Sapiens; identical to SEQ ID NO: 176011

SEQ ID NO: 625471 - RNA, 64 nt, Homo Sapiens; identical to SEQ ID NO: 176012

SEQ ID NO: 625472 - RNA, 64 nt, Homo Sapiens; identical to SEQ ID NO: 176013

SEQ ID NO: 625473 - RNA, 64 nt, Homo Sapiens; identical to SEQ ID NO: 176014

SEQ ID NO: 625474 - RNA, 64 nt, Homo Sapiens; identical to SEQ ID NO: 176015

SEQ ID NO: 625475 - RNA, 64 nt, Homo Sapiens; identical to SEQ ID NO: 176016

SEQ ID NO: 625476 - RNA, 64 nt, Homo Sapiens; identical to SEQ ID NO: 176017

SEQ ID NO: 625477 - RNA, 64 nt, Homo Sapiens; identical to SEQ ID NO: 176018

SEQ ID NO: 625478 - RNA, 64 nt, Homo Sapiens; identical to SEQ ID NO: 176019

SEQ ID NO: 625479 - RNA, 64 nt, Homo Sapiens; identical to SEQ ID NO: 176020

SEQ ID NO: 625480 - RNA, 64 nt, Homo Sapiens; identical to SEQ ID NO: 176021

SEQ ID NO: 625481 - RNA, 64 nt, Homo Sapiens; identical to SEQ ID NO: 176022

SEQ ID NO: 625482 - RNA, 64 nt, Homo Sapiens; identical to SEQ ID NO: 176023

SEQ ID NO: 625483 - RNA, 64 nt, Homo Sapiens; identical to SEQ ID NO: 176024

SEQ ID NO: 625484 - RNA, 64 nt, Homo Sapiens; identical to SEQ ID NO: 176025

SEQ ID NO: 625485 - RNA, 64 nt, Homo Sapiens; identical to SEQ ID NO: 176026

SEQ ID NO: 625486 - RNA, 64 nt, Homo Sapiens; identical to SEQ ID NO: 176027

SEQ ID NO: 625487 - RNA, 64 nt, Homo Sapiens; identical to SEQ ID NO: 176028

SEQ ID NO: 625488 - RNA, 64 nt, Homo Sapiens; identical to SEQ ID NO: 176029

SEQ ID NO: 625489 - RNA, 59 nt, Homo Sapiens; identical to SEQ ID NO: 176030

SEQ ID NO: 625490 - RNA, 56 nt, Homo Sapiens; identical to SEQ ID NO: 176031

SEQ ID NO: 625491 - RNA, 64 nt, Homo Sapiens; identical to SEQ ID NO: 176032

SEQ ID NO: 625492 - RNA, 64 nt, Homo Sapiens; identical to SEQ ID NO: 176033

SEQ ID NO: 625493 - RNA, 64 nt, Homo Sapiens; identical to SEQ ID NO: 176034

SEQ ID NO: 625494 - RNA, 64 nt, Homo Sapiens; identical to SEQ ID NO: 176035

SEQ ID NO: 625495 - RNA, 64 nt, Homo Sapiens; identical to SEQ ID NO: 176036

SEQ ID NO: 625496 - RNA, 64 nt, Homo Sapiens; identical to SEQ ID NO: 176037

SEQ ID NO: 625497 - RNA, 64 nt, Homo Sapiens; identical to SEQ ID NO: 176038

SEQ ID NO: 625498 - RNA, 64 nt, Homo Sapiens; identical to SEQ ID NO: 176039

SEQ ID NO: 625499 - RNA, 64 nt, Homo Sapiens; identical to SEQ ID NO: 176040

SEQ ID NO: 625500 - RNA, 64 nt, Homo Sapiens; identical to SEQ ID NO: 176041

SEQ ID NO: 625501 - RNA, 64 nt, Homo Sapiens; identical to SEQ ID NO: 176042

SEQ ID NO: 625502 - RNA, 64 nt, Homo Sapiens; identical to SEQ ID NO: 176043

SEQ ID NO: 625503 - RNA, 64 nt, Homo Sapiens; identical to SEQ ID NO: 176044

SEQ ID NO: 625504 - RNA, 64 nt, Homo Sapiens; identical to SEQ ID NO: 176045

SEQ ID NO: 625505 - RNA, 64 nt, Homo Sapiens; identical to SEQ ID NO: 176046

SEQ ID NO: 625506 - RNA, 64 nt, Homo Sapiens; identical to SEQ ID NO: 176047

SEQ ID NO: 625507 - RNA, 64 nt, Homo Sapiens; identical to SEQ ID NO: 176048

SEQ ID NO: 625508 - RNA, 64 nt, Homo Sapiens; identical to SEQ ID NO: 176049

SEQ ID NO: 625509 - RNA, 64 nt, Homo Sapiens; identical to SEQ ID NO: 176050

SEQ ID NO: 625510 - RNA, 64 nt, Homo Sapiens; identical to SEQ ID NO: 176051

SEQ ID NO: 625511 - RNA, 64 nt, Homo Sapiens; identical to SEQ ID NO: 176052

SEQ ID NO: 625512 - RNA, 64 nt, Homo Sapiens; identical to SEQ ID NO: 176053

SEQ ID NO: 625513 - RNA, 64 nt, Homo Sapiens; identical to SEQ ID NO: 176054

SEQ ID NO: 625514 - RNA, 64 nt, Homo Sapiens; identical to SEQ ID NO: 176055

SEQ ID NO: 625515 - RNA, 64 nt, Homo Sapiens; identical to SEQ ID NO: 176056

SEQ ID NO: 625516 - RNA, 64 nt, Homo Sapiens; identical to SEQ ID NO: 176057

SEQ ID NO: 625517 - RNA, 64 nt, Homo Sapiens; identical to SEQ ID NO: 176058

SEQ ID NO: 625518 - RNA, 64 nt, Homo Sapiens; identical to SEQ ID NO: 176059

SEQ ID NO: 625519 - RNA, 64 nt, Homo Sapiens; identical to SEQ ID NO: 176060

SEQ ID NO: 625520 - RNA, 64 nt, Homo Sapiens; identical to SEQ ID NO: 176061

SEQ ID NO: 625521 - RNA, 64 nt, Homo Sapiens; identical to SEQ ID NO: 176062

SEQ ID NO: 625522 - RNA, 64 nt, Homo Sapiens; identical to SEQ ID NO: 176063

SEQ ID NO: 625523 - RNA, 64 nt, Homo Sapiens; identical to SEQ ID NO: 176064

SEQ ID NO: 625524 - RNA, 64 nt, Homo Sapiens; identical to SEQ ID NO: 176065

SEQ ID NO: 625525 - RNA, 64 nt, Homo Sapiens; identical to SEQ ID NO: 176066

SEQ ID NO: 625526 - RNA, 64 nt, Homo Sapiens; identical to SEQ ID NO: 176067

SEQ ID NO: 625527 - RNA, 64 nt, Homo Sapiens; identical to SEQ ID NO: 176068

SEQ ID NO: 625528 - RNA, 64 nt, Homo Sapiens; identical to SEQ ID NO: 176069

SEQ ID NO: 625529 - RNA, 64 nt, Homo Sapiens; identical to SEQ ID NO: 176070

SEQ ID NO: 625530 - RNA, 64 nt, Homo Sapiens; identical to SEQ ID NO: 176071

SEQ ID NO: 625531 - RNA, 64 nt, Homo Sapiens; identical to SEQ ID NO: 176072

SEQ ID NO: 625532 - RNA, 64 nt, Homo Sapiens; identical to SEQ ID NO: 176073

SEQ ID NO: 625533 - RNA, 64 nt, Homo Sapiens; identical to SEQ ID NO: 176074

SEQ ID NO: 625534 - RNA, 64 nt, Homo Sapiens; identical to SEQ ID NO: 176075

SEQ ID NO: 625535 - RNA, 64 nt, Homo Sapiens; identical to SEQ ID NO: 176076

SEQ ID NO: 625536 - RNA, 64 nt, Homo Sapiens; identical to SEQ ID NO: 176077

SEQ ID NO: 625537 - RNA, 64 nt, Homo Sapiens; identical to SEQ ID NO: 176078

SEQ ID NO: 625538 - RNA, 64 nt, Homo Sapiens; identical to SEQ ID NO: 176079

SEQ ID NO: 625539 - RNA, 64 nt, Homo Sapiens; identical to SEQ ID NO: 176080

SEQ ID NO: 625540 - RNA, 64 nt, Homo Sapiens; identical to SEQ ID NO: 176081

SEQ ID NO: 625541 - RNA, 64 nt, Homo Sapiens; identical to SEQ ID NO: 176082

SEQ ID NO: 625542 - RNA, 64 nt, Homo Sapiens; identical to SEQ ID NO: 176083

SEQ ID NO: 625543 - RNA, 64 nt, Homo Sapiens; identical to SEQ ID NO: 176084

SEQ ID NO: 625544 - RNA, 64 nt, Homo Sapiens; identical to SEQ ID NO: 176085

SEQ ID NO: 625545 - RNA, 64 nt, Homo Sapiens; identical to SEQ ID NO: 176086

SEQ ID NO: 625546 - RNA, 64 nt, Homo Sapiens; identical to SEQ ID NO: 176087

SEQ ID NO: 625547 - RNA, 64 nt, Homo Sapiens; identical to SEQ ID NO: 176088

SEQ ID NO: 625548 - RNA, 62 nt, Homo Sapiens; identical to SEQ ID NO: 176089

SEQ ID NO: 625549 - RNA, 64 nt, Homo Sapiens; identical to SEQ ID NO: 176090

SEQ ID NO: 625550 - RNA, 64 nt, Homo Sapiens; identical to SEQ ID NO: 176091

SEQ ID NO: 625551 - RNA, 64 nt, Homo Sapiens; identical to SEQ ID NO: 176092

SEQ ID NO: 625552 - RNA, 64 nt, Homo Sapiens; identical to SEQ ID NO: 176093

SEQ ID NO: 625553 - RNA, 64 nt, Homo Sapiens; identical to SEQ ID NO: 176094

SEQ ID NO: 625554 - RNA, 63 nt, Homo Sapiens; identical to SEQ ID NO: 176095

SEQ ID NO: 625555 - RNA, 64 nt, Homo Sapiens; identical to SEQ ID NO: 176096

SEQ ID NO: 625556 - RNA, 64 nt, Homo Sapiens; identical to SEQ ID NO: 176097

SEQ ID NO: 625557 - RNA, 64 nt, Homo Sapiens; identical to SEQ ID NO: 433812

SEQ ID NO: 625558 - RNA, 64 nt, Homo Sapiens; identical to SEQ ID NO: 433813

SEQ ID NO: 625559 - RNA, 64 nt, Homo Sapiens; identical to SEQ ID NO: 433814

SEQ ID NO: 625560 - RNA, 64 nt, Homo Sapiens; identical to SEQ ID NO: 433815

SEQ ID NO: 625561 - RNA, 64 nt, Homo Sapiens; identical to SEQ ID NO: 433816

SEQ ID NO: 625562 - RNA, 64 nt, Homo Sapiens; identical to SEQ ID NO: 433817

SEQ ID NO: 625563 - RNA, 64 nt, Homo Sapiens; identical to SEQ ID NO: 433818

SEQ ID NO: 625564 - RNA, 64 nt, Homo Sapiens; identical to SEQ ID NO: 433819

SEQ ID NO: 625565 - RNA, 64 nt, Homo Sapiens; identical to SEQ ID NO: 433820

SEQ ID NO: 625566 - RNA, 64 nt, Homo Sapiens; identical to SEQ ID NO: 433821

SEQ ID NO: 625567 - RNA, 64 nt, Homo Sapiens; identical to SEQ ID NO: 433822

SEQ ID NO: 625568 - RNA, 64 nt, Homo Sapiens; identical to SEQ ID NO: 433823

SEQ ID NO: 625569 - RNA, 64 nt, Homo Sapiens; identical to SEQ ID NO: 433824

SEQ ID NO: 625570 - RNA, 64 nt, Homo Sapiens; identical to SEQ ID NO: 433825

SEQ ID NO: 625571 - RNA, 64 nt, Homo Sapiens; identical to SEQ ID NO: 433826

SEQ ID NO: 625572 - RNA, 64 nt, Homo Sapiens; identical to SEQ ID NO: 433827

SEQ ID NO: 625573 - RNA, 64 nt, Homo Sapiens; identical to SEQ ID NO: 433828

SEQ ID NO: 625574 - RNA, 64 nt, Homo Sapiens; identical to SEQ ID NO: 433829

SEQ ID NO: 625575 - RNA, 64 nt, Homo Sapiens; identical to SEQ ID NO: 433830

SEQ ID NO: 625576 - RNA, 64 nt, Homo Sapiens; identical to SEQ ID NO: 433831

SEQ ID NO: 625577 - RNA, 64 nt, Homo Sapiens; identical to SEQ ID NO: 433832

SEQ ID NO: 625578 - RNA, 64 nt, Homo Sapiens; identical to SEQ ID NO: 433833

SEQ ID NO: 625579 - RNA, 64 nt, Homo Sapiens; identical to SEQ ID NO: 433834

SEQ ID NO: 625580 - RNA, 64 nt, Homo Sapiens; identical to SEQ ID NO: 433835

SEQ ID NO: 625581 - RNA, 64 nt, Homo Sapiens; identical to SEQ ID NO: 433836

SEQ ID NO: 625582 - RNA, 64 nt, Homo Sapiens; identical to SEQ ID NO: 433837

SEQ ID NO: 625583 - RNA, 64 nt, Homo Sapiens; identical to SEQ ID NO: 433838

SEQ ID NO: 625584 - RNA, 64 nt, Homo Sapiens; identical to SEQ ID NO: 433839

SEQ ID NO: 625585 - RNA, 64 nt, Homo Sapiens; identical to SEQ ID NO: 433840

SEQ ID NO: 625586 - RNA, 64 nt, Homo Sapiens; identical to SEQ ID NO: 433841

SEQ ID NO: 625587 - RNA, 64 nt, Homo Sapiens; identical to SEQ ID NO: 433842

SEQ ID NO: 625588 - RNA, 64 nt, Homo Sapiens; identical to SEQ ID NO: 433843

SEQ ID NO: 625589 - RNA, 64 nt, Homo Sapiens; identical to SEQ ID NO: 433844

SEQ ID NO: 625590 - RNA, 64 nt, Homo Sapiens; identical to SEQ ID NO: 433845

SEQ ID NO: 625591 - RNA, 64 nt, Homo Sapiens; identical to SEQ ID NO: 433846

SEQ ID NO: 625592 - RNA, 64 nt, Homo Sapiens; identical to SEQ ID NO: 433847

SEQ ID NO: 625593 - RNA, 64 nt, Homo Sapiens; identical to SEQ ID NO: 433848

SEQ ID NO: 625594 - RNA, 64 nt, Homo Sapiens; identical to SEQ ID NO: 433849

SEQ ID NO: 625595 - RNA, 64 nt, Homo Sapiens; identical to SEQ ID NO: 433850

SEQ ID NO: 625596 - RNA, 64 nt, Homo Sapiens; identical to SEQ ID NO: 433851

SEQ ID NO: 625597 - RNA, 64 nt, Homo Sapiens; identical to SEQ ID NO: 433852

SEQ ID NO: 625598 - RNA, 64 nt, Homo Sapiens; identical to SEQ ID NO: 433853

SEQ ID NO: 625599 - RNA, 64 nt, Homo Sapiens; identical to SEQ ID NO: 433854

SEQ ID NO: 625600 - RNA, 64 nt, Homo Sapiens; identical to SEQ ID NO: 433855

SEQ ID NO: 625601 - RNA, 64 nt, Homo Sapiens; identical to SEQ ID NO: 433856

SEQ ID NO: 625602 - RNA, 64 nt, Homo Sapiens; identical to SEQ ID NO: 433857

SEQ ID NO: 625603 - RNA, 64 nt, Homo Sapiens; identical to SEQ ID NO: 433858

SEQ ID NO: 625604 - RNA, 64 nt, Homo Sapiens; identical to SEQ ID NO: 433859

SEQ ID NO: 625605 - RNA, 64 nt, Homo Sapiens; identical to SEQ ID NO: 433860

SEQ ID NO: 625606 - RNA, 64 nt, Homo Sapiens; identical to SEQ ID NO: 106142

SEQ ID NO: 625607 - RNA, 64 nt, Homo Sapiens; identical to SEQ ID NO: 106143

SEQ ID NO: 625608 - RNA, 55 nt, Homo Sapiens; identical to SEQ ID NO: 106144

SEQ ID NO: 625609 - RNA, 64 nt, Homo Sapiens; identical to SEQ ID NO: 106145

SEQ ID NO: 625610 - RNA, 64 nt, Homo Sapiens; identical to SEQ ID NO: 106146

SEQ ID NO: 625611 - RNA, 64 nt, Homo Sapiens; identical to SEQ ID NO: 106147

SEQ ID NO: 625612 - RNA, 64 nt, Homo Sapiens; identical to SEQ ID NO: 106148

SEQ ID NO: 625613 - RNA, 64 nt, Homo Sapiens; identical to SEQ ID NO: 106149

SEQ ID NO: 625614 - RNA, 64 nt, Homo Sapiens; identical to SEQ ID NO: 106150

SEQ ID NO: 625615 - RNA, 64 nt, Homo Sapiens; identical to SEQ ID NO: 106151

SEQ ID NO: 625616 - RNA, 64 nt, Homo Sapiens; identical to SEQ ID NO: 106152

SEQ ID NO: 625617 - RNA, 64 nt, Homo Sapiens; identical to SEQ ID NO: 106153

SEQ ID NO: 625618 - RNA, 64 nt, Homo Sapiens; identical to SEQ ID NO: 106154

SEQ ID NO: 625619 - RNA, 64 nt, Homo Sapiens; identical to SEQ ID NO: 106155

SEQ ID NO: 625620 - RNA, 64 nt, Homo Sapiens; identical to SEQ ID NO: 106156

SEQ ID NO: 625621 - RNA, 64 nt, Homo Sapiens; identical to SEQ ID NO: 106157

SEQ ID NO: 625622 - RNA, 64 nt, Homo Sapiens; identical to SEQ ID NO: 106158

SEQ ID NO: 625623 - RNA, 64 nt, Homo Sapiens; identical to SEQ ID NO: 106159

SEQ ID NO: 625624 - RNA, 64 nt, Homo Sapiens; identical to SEQ ID NO: 106160

SEQ ID NO: 625625 - RNA, 64 nt, Homo Sapiens; identical to SEQ ID NO: 106161

SEQ ID NO: 625626 - RNA, 64 nt, Homo Sapiens; identical to SEQ ID NO: 106162

SEQ ID NO: 625627 - RNA, 64 nt, Homo Sapiens; identical to SEQ ID NO: 106163

SEQ ID NO: 625628 - RNA, 64 nt, Homo Sapiens
ccccagaaauaguaaacuugcagcugccccuaaugcagcauauuuuucuuaccaaaggagucuu

SEQ ID NO: 625629 - RNA, 64 nt, Homo Sapiens
cagagcuuucaagaacacacaaugcaaagugagcgcagcauagcuguuaacaaacauacaacuu

SEQ ID NO: 625630 - RNA, 64 nt, Homo Sapiens
gccucugaaagacuauccauaguggacauuguuggcagcauaaaggccuuuuuuggcuuuagac

SEQ ID NO: 625631 - RNA, 64 nt, Homo Sapiens
acacugacagaaucuucaucuagauauucgaguagcagcauaucuucucuuuuagugucauuac

SEQ ID NO: 625632 - RNA, 64 nt, Homo Sapiens
uuuuuaagugaaaaguaaccuuucaggcauuucagcagcauacauugacaaucuaggguauaua

SEQ ID NO: 625633 - RNA, 64 nt, Homo Sapiens
agcuggagcauuuccuucccuuuccagugaaggagcagcauagugaaauccuggcaccccucac

SEQ ID NO: 625634 - RNA, 64 nt, Homo Sapiens
cauuuguuaaguuggagcuugcacauuuaaaccagcagcauacguuccagaagagcaucucaag

SEQ ID NO: 625635 - RNA, 64 nt, Homo Sapiens
ucuuuuuugaagaguuuuucuugugcuugcuucggcagcauauauacugaaauuagaaaaagaa

SEQ ID NO: 625636 - RNA, 64 nt, Homo Sapiens
ugcggcuggaggagaagaucacagagccauucuugguggugagccuagacucugagccugggau

SEQ ID NO: 625637 - RNA, 64 nt, Homo Sapiens
gaacacaaccuuaggaccuugggccccaaaagcugguggugaaaugaggaggagccaauuuaag

SEQ ID NO: 625638 - RNA, 64 nt, Homo Sapiens
cugaagccucuacuugaugagagacagaguuuuggguggugauagugaugugcugguggucauu

SEQ ID NO: 625639 - RNA, 64 nt, Homo Sapiens
gcugcagcugaaaguaguuccccaggcugcccucgguggugaggacuggaugcuagacugcuga

SEQ ID NO: 625640 - RNA, 64 nt, Homo Sapiens
aaaucucaaucggacaccagucaugggacucaaugguggugaagagucucucgccugugcuguc

SEQ ID NO: 625641 - RNA, 64 nt, Homo Sapiens
uugggaagauguuucccugcucccugcacccggugguggugaugggucucagggcgcaaacaca

SEQ ID NO: 625642 - RNA, 64 nt, Homo Sapiens
gcgccuacugggcauccggccugugcugggcauggguggugacauuggcagaaauggccacugg

SEQ ID NO: 625643 - RNA, 64 nt, Homo Sapiens
augacauccauccaucuguggugaaccaagugaagguggugacuucuggugacauaguaauaaa

SEQ ID NO: 625644 - RNA, 64 nt, Homo Sapiens
agaauucugauuuauugagauugaauuaugccaccacguuuauguaaaaaugaagguggcaccg

SEQ ID NO: 625645 - RNA, 64 nt, Homo Sapiens
ucuaucacaguuagaaggaaaugauagucaaauacacguuuagauuaaaacuaguuuaaaaaau

SEQ ID NO: 625646 - RNA, 64 nt, Homo Sapiens
aauggagaacaaagccauguggguacuguaaacacacguuuaucuuuuggcccaaugccauaca

SEQ ID NO: 625647 - RNA, 64 nt, Homo Sapiens
caagucucaaaagucauccuccuacucagugauucacguuuagugguuuauauuauuaagguuu

SEQ ID NO: 625648 - RNA, 64 nt, Homo Sapiens
uaucuaggaaacuaagucuaaaauuuuauguagacacguuuauugaagaaaaaauauauauaua

SEQ ID NO: 625649 - RNA, 64 nt, Homo Sapiens
uagcuuauuuaaauucuaagauuuaaaauuuuaacacguuuagagcaaaacaaaucagguccug

SEQ ID NO: 625650 - RNA, 64 nt, Homo Sapiens
acuuuguuuuggaaaauuuaauuacaucuuuguccacguuuaaucccuuuuugugacauuacca

SEQ ID NO: 625651 - RNA, 64 nt, Homo Sapiens
uaaaguguguaaaaccuagucuagaacuuagguucacguuuauggcuggccuguuaacugauaa

SEQ ID NO: 625652 - RNA, 64 nt, Homo Sapiens
uagcauucagucauauaacaucugguuaucaaugcacguuuacacaauaaauacuugaguggag

SEQ ID NO: 625653 - RNA, 64 nt, Homo Sapiens
aaaugcaaaaaccauggcauuagcguaaaaaggacacguuuauaguaugaaagcuggaacaugg

SEQ ID NO: 625654 - RNA, 64 nt, Homo Sapiens
gguucacucugcacccugaugaacccgacuugcccacguuuaggcaguauauacuuccuuucua

SEQ ID NO: 625655 - RNA, 64 nt, Homo Sapiens
agagaauucacacucaacaagacacuaccagcaccacguuuacagaggaugaaaacacuucaca

SEQ ID NO: 625656 - RNA, 64 nt, Homo Sapiens
ucagguaaucauuuuaauaaaguucugcaaaauacacguuuaucuuacauucagaaauguggca

SEQ ID NO: 625657 - RNA, 64 nt, Homo Sapiens
cuuguuacuucgcuguguuuguuguuuuuguggucacguuuauugagaaauggggcuuaauuaa

SEQ ID NO: 625658 - RNA, 64 nt, Homo Sapiens
auuuacccagaaugucagauuccuuucccuuuagcacguuuaaaguucuguguauuuaauugua

SEQ ID NO: 625659 - RNA, 64 nt, Homo Sapiens
uuuuaauuauuacaaguugcuccauccuuuuuuucacguuuacaaaauaaguagggacuuuuau

SEQ ID NO: 625660 - RNA, 64 nt, Homo Sapiens
acccuuacaggugggccuucucacacugugaauccacguuuacaaagugaaaacgcucagaauu

SEQ ID NO: 625661 - RNA, 64 nt, Homo Sapiens
ggaaaguguucuccuggguucuccagcaugaaaacacguuuacaaacccaagucaaaaccuugg

SEQ ID NO: 625662 - RNA, 64 nt, Homo Sapiens
aacuguuuuuuuuuuuuuuuuuggguuccuuuuucacguuuagucccaacuccuuccucuuugc

SEQ ID NO: 625663 - RNA, 64 nt, Homo Sapiens
acuuuugccuucguaauguuaaccguuucaggaccacguuuauagcuucaggaccuggcuacgu

SEQ ID NO: 625664 - RNA, 64 nt, Homo Sapiens
guuggugugagauaucaggaaugucucaugauaucacguuuaccauuuacaccaucugcaacca

SEQ ID NO: 625665 - RNA, 64 nt, Homo Sapiens
ucacagcagagccaagucuggccacccucccuggcacguuuauuuuugucaccccccucccccu

SEQ ID NO: 625666 - RNA, 64 nt, Homo Sapiens
ggaaggugugccccagaggaguguuggccccagccacguuuacacuucccuuggcucuggggcc

SEQ ID NO: 625667 - RNA, 64 nt, Homo Sapiens
aaugauuucaaaaugauauugccuauaaaggaaacacguuuagaguaaauuuaauagauaaagu

SEQ ID NO: 625668 - RNA, 64 nt, Homo Sapiens
cccagcacuuugggaggcaggacauggugucucacacguuuaauuacauaagagaaagaggcca

SEQ ID NO: 625669 - RNA, 64 nt, Homo Sapiens
aacuucuuaaagcacucuguuuuuuuuucuuuuacacguuuaaaaccguaaugcacuaagcuuu

SEQ ID NO: 625670 - RNA, 64 nt, Homo Sapiens
gagaauguuccgauuuuccaugaucuaagcaggccacguuuaaaauaacaucaaggcaagcgua

SEQ ID NO: 625671 - RNA, 64 nt, Homo Sapiens
ccuaucagcauguuugugauuuucacuuaauaaacacguuuauguuuuauuuuuaaaggauacg

SEQ ID NO: 625672 - RNA, 64 nt, Homo Sapiens
aaccuuauuuucuuuuguaagagcugggagcaaacacguuuaugagugugucggaaucccgugc

SEQ ID NO: 625673 - RNA, 64 nt, Homo Sapiens
uucagcaccuaacaauccuguaugcuuuugagaucacguuuagugcuauguccuagucuagaau

SEQ ID NO: 625674 - RNA, 64 nt, Homo Sapiens
cggugacaugagcugugcccugccaucccacuggcacguuuacacucuguguacugccccguga

SEQ ID NO: 625675 - RNA, 64 nt, Homo Sapiens
uguuuugagcuaugcuucaaaugugugggagcugcacguuuacaaggaaagaagaaaaaaauua

SEQ ID NO: 625676 - RNA, 64 nt, Homo Sapiens
gcgauggcaccuccgucccauuucuucuauuccccacguuuaaaucucugcaccuccuggcaag

SEQ ID NO: 625677 - RNA, 64 nt, Homo Sapiens
auauuaagacaugcugauggcggacuucaggggacacguuuagucagcacccagcaucaaagga

SEQ ID NO: 625678 - RNA, 64 nt, Homo Sapiens
gagcauaaggcugucuuggagcucuccucugguucacguuuacaaaaucagacauaccucugug

SEQ ID NO: 625679 - RNA, 64 nt, Homo Sapiens
cugcuagaaccucauaccuguucuaguucaucuccacguuuauuuuaccaagagauccucuguc

SEQ ID NO: 625680 - RNA, 64 nt, Homo Sapiens
cacuuuggcuguucaguaaggccaauguuaacaacacguuuagaggaggaaaaguucaaccuca

SEQ ID NO: 625681 - RNA, 64 nt, Homo Sapiens
uuaucagaaaugauaaaauccaguuaccacauaucacguuuauaaaauccuuaauuaaaugagu

SEQ ID NO: 625682 - RNA, 64 nt, Homo Sapiens
cccccugcagcuuguagccagccggggcgaguggcacguuuauuuaacuuuuaguaaagucaag

SEQ ID NO: 625683 - RNA, 64 nt, Homo Sapiens
auuucagaggaaauaucuugguaacuucuaaggucacguuuacuagcugagagugcccuagaca

SEQ ID NO: 625684 - RNA, 64 nt, Homo Sapiens
uaagaagauggaguagauaucagauaaaacaauucacguuuaauauguaaauguaccaauuaug

SEQ ID NO: 625685 - RNA, 64 nt, Homo Sapiens
cugccccacuuuuguauucaagaaguacacuguucacguuuagcacuucuauauaaacacuugu

SEQ ID NO: 625686 - RNA, 64 nt, Homo Sapiens
aucacuuuuagugaaauaaagucuacaagacauucacguuuaacuuugacuggcucuuuaaaua

SEQ ID NO: 625687 - RNA, 64 nt, Homo Sapiens
guuauuguauuuaauuuucuuucaaugugagaaccacguuuacuccuaguuauuugagccuggu

SEQ ID NO: 625688 - RNA, 64 nt, Homo Sapiens
cucaaaugaugauaaaccuacaugugcaaaggcucacguuuaagauugucaagccagcagucua

SEQ ID NO: 625689 - RNA, 64 nt, Homo Sapiens
uaguagaagauggagcaacaaaccuguggagucacacguuuaugacaaugacaacaacauuacu

SEQ ID NO: 625690 - RNA, 64 nt, Homo Sapiens
cgacuugaguuuugaaccccacccaacaacuaaccacguuuacaggcuuuuuuggaaacugagg

SEQ ID NO: 625691 - RNA, 64 nt, Homo Sapiens
gaaaauauuuauuuuguuauaaauaauuuuauagcacguuuacucuagugcuagcuaauuugua

SEQ ID NO: 625692 - RNA, 64 nt, Homo Sapiens
aguagggcguguauuccaguuccugagugccaagcacguuuauaguuacauauucuagagaucg

SEQ ID NO: 625693 - RNA, 64 nt, Homo Sapiens
cagggugggcugcccccaccgcacgaguguguugcacguuuacaggguccaguacccaaccuuc

SEQ ID NO: 625694 - RNA, 64 nt, Homo Sapiens
auggggagaaagaugguuaaaauacauaauaauccacguuuaaaaggagcgcacuuguggcuga

SEQ ID NO: 625695 - RNA, 64 nt, Homo Sapiens
uguaagcacuggcuuuuauaagagcagcagccaacacguuuagcagacacugcgcguggagaag

SEQ ID NO: 625696 - RNA, 64 nt, Homo Sapiens
ucucucggaagccaccgugugguucuuucacaggcacguuuauuuugcugaaauaaaaaguuuu

SEQ ID NO: 625697 - RNA, 64 nt, Homo Sapiens
gugucugagggagcugcuggccacagugaacacccacguuuauuccugccugcuccggccagga

SEQ ID NO: 625698 - RNA, 64 nt, Homo Sapiens
augacaacuuagggggcuugagccaugaaauacucacguuuaagucaguaaggauacacauguu

SEQ ID NO: 625699 - RNA, 64 nt, Homo Sapiens
ugccuuuggaaaucggauguacuguucucuuguucacguuuagugguguuuugcuguuuuguuu

SEQ ID NO: 625700 - RNA, 64 nt, Homo Sapiens
ugcuuugugauggauaaaaggcauuaaauaaaaccacguuuacauuuugaagugggguaggaug

SEQ ID NO: 625701 - RNA, 64 nt, Homo Sapiens
aagccggcuuuccucuauuuugguuuauuuuugccacguuuaacacaaaugguaaacuccucca

SEQ ID NO: 625702 - RNA, 64 nt, Homo Sapiens
augauaguagucacauacacuacacacacugugccacguuuaaaaagaaaaaaaacaauucucg

SEQ ID NO: 625703 - RNA, 64 nt, Homo Sapiens
gcucuugggcucuuguuauacagucauauggcuacacguuuauguaaaguuugcaaaaguuugg

SEQ ID NO: 625704 - RNA, 64 nt, Homo Sapiens
auacguuuaaaauccauucuacaggaaugcuuagcacguuuaccucaagauccaucgaccuuaa

SEQ ID NO: 625705 - RNA, 64 nt, Homo Sapiens
caccuuggagcccacucaccgcuguggaaaaugucacguuuaguguuguauuauaguauauuuc

SEQ ID NO: 625706 - RNA, 64 nt, Homo Sapiens
gagcuucuagcauugauuaauauaggauauugaccacguuuauguuuaaauuucauuuuguuca

SEQ ID NO: 625707 - RNA, 65 nt, Homo Sapiens; identical to SEQ ID NO: 65698

SEQ ID NO: 625708 - RNA, 65 nt, Homo Sapiens; identical to SEQ ID NO: 65699

SEQ ID NO: 625709 - RNA, 65 nt, Homo Sapiens; identical to SEQ ID NO: 65706

SEQ ID NO: 625710 - RNA, 65 nt, Homo Sapiens; identical to SEQ ID NO: 65707

SEQ ID NO: 625711 - RNA, 65 nt, Homo Sapiens; identical to SEQ ID NO: 65720

SEQ ID NO: 625712 - RNA, 65 nt, Homo Sapiens; identical to SEQ ID NO: 65721

SEQ ID NO: 625713 - RNA, 65 nt, Homo Sapiens; identical to SEQ ID NO: 65744

SEQ ID NO: 625714 - RNA, 65 nt, Homo Sapiens; identical to SEQ ID NO: 65745

SEQ ID NO: 625715 - RNA, 65 nt, Homo Sapiens; identical to SEQ ID NO: 65788

SEQ ID NO: 625716 - RNA, 65 nt, Homo Sapiens; identical to SEQ ID NO: 65789

SEQ ID NO: 625717 - RNA, 65 nt, Homo Sapiens; identical to SEQ ID NO: 65808

SEQ ID NO: 625718 - RNA, 65 nt, Homo Sapiens; identical to SEQ ID NO: 65809

SEQ ID NO: 625719 - RNA, 65 nt, Homo Sapiens; identical to SEQ ID NO: 65810

SEQ ID NO: 625720 - RNA, 65 nt, Homo Sapiens; identical to SEQ ID NO: 65811

SEQ ID NO: 625721 - RNA, 65 nt, Homo Sapiens; identical to SEQ ID NO: 65827

SEQ ID NO: 625722 - RNA, 65 nt, Homo Sapiens; identical to SEQ ID NO: 65828

SEQ ID NO: 625723 - RNA, 65 nt, Homo Sapiens; identical to SEQ ID NO: 65831

SEQ ID NO: 625724 - RNA, 56 nt, Homo Sapiens; identical to SEQ ID NO: 61369

SEQ ID NO: 625725 - RNA, 65 nt, Homo Sapiens; identical to SEQ ID NO: 65853

SEQ ID NO: 625726 - RNA, 65 nt, Homo Sapiens; identical to SEQ ID NO: 65854

SEQ ID NO: 625727 - RNA, 65 nt, Homo Sapiens; identical to SEQ ID NO: 65891

SEQ ID NO: 625728 - RNA, 65 nt, Homo Sapiens; identical to SEQ ID NO: 65892

SEQ ID NO: 625729 - RNA, 65 nt, Homo Sapiens; identical to SEQ ID NO: 65896

SEQ ID NO: 625730 - RNA, 65 nt, Homo Sapiens; identical to SEQ ID NO: 65897

SEQ ID NO: 625731 - RNA, 64 nt, Homo Sapiens; identical to SEQ ID NO: 193740

SEQ ID NO: 625732 - RNA, 64 nt, Homo Sapiens; identical to SEQ ID NO: 193741

SEQ ID NO: 625733 - RNA, 64 nt, Homo Sapiens; identical to SEQ ID NO: 193742

SEQ ID NO: 625734 - RNA, 64 nt, Homo Sapiens; identical to SEQ ID NO: 193743

SEQ ID NO: 625735 - RNA, 64 nt, Homo Sapiens; identical to SEQ ID NO: 193744

SEQ ID NO: 625736 - RNA, 64 nt, Homo Sapiens; identical to SEQ ID NO: 193745

SEQ ID NO: 625737 - RNA, 64 nt, Homo Sapiens; identical to SEQ ID NO: 114759

SEQ ID NO: 625738 - RNA, 64 nt, Homo Sapiens; identical to SEQ ID NO: 114760

SEQ ID NO: 625739 - RNA, 64 nt, Homo Sapiens; identical to SEQ ID NO: 114761

SEQ ID NO: 625740 - RNA, 64 nt, Homo Sapiens; identical to SEQ ID NO: 114762

SEQ ID NO: 625741 - RNA, 64 nt, Homo Sapiens; identical to SEQ ID NO: 114763

SEQ ID NO: 625742 - RNA, 64 nt, Homo Sapiens; identical to SEQ ID NO: 114764

SEQ ID NO: 625743 - RNA, 64 nt, Homo Sapiens; identical to SEQ ID NO: 114765

SEQ ID NO: 625744 - RNA, 64 nt, Homo Sapiens; identical to SEQ ID NO: 114766

SEQ ID NO: 625745 - RNA, 64 nt, Homo Sapiens; identical to SEQ ID NO: 114767

SEQ ID NO: 625746 - RNA, 64 nt, Homo Sapiens; identical to SEQ ID NO: 114768

SEQ ID NO: 625747 - RNA, 64 nt, Homo Sapiens; identical to SEQ ID NO: 114769

SEQ ID NO: 625748 - RNA, 64 nt, Homo Sapiens; identical to SEQ ID NO: 114770

SEQ ID NO: 625749 - RNA, 64 nt, Homo Sapiens; identical to SEQ ID NO: 114771

SEQ ID NO: 625750 - RNA, 64 nt, Homo Sapiens; identical to SEQ ID NO: 114772

SEQ ID NO: 625751 - RNA, 64 nt, Homo Sapiens; identical to SEQ ID NO: 114773

SEQ ID NO: 625752 - RNA, 64 nt, Homo Sapiens; identical to SEQ ID NO: 114774

SEQ ID NO: 625753 - RNA, 64 nt, Homo Sapiens; identical to SEQ ID NO: 114775

SEQ ID NO: 625754 - RNA, 64 nt, Homo Sapiens; identical to SEQ ID NO: 114776

SEQ ID NO: 625755 - RNA, 64 nt, Homo Sapiens; identical to SEQ ID NO: 114777

SEQ ID NO: 625756 - RNA, 64 nt, Homo Sapiens; identical to SEQ ID NO: 114778

SEQ ID NO: 625757 - RNA, 64 nt, Homo Sapiens; identical to SEQ ID NO: 114779

SEQ ID NO: 625758 - RNA, 64 nt, Homo Sapiens; identical to SEQ ID NO: 114780

SEQ ID NO: 625759 - RNA, 64 nt, Homo Sapiens; identical to SEQ ID NO: 114781

SEQ ID NO: 625760 - RNA, 64 nt, Homo Sapiens; identical to SEQ ID NO: 114782

SEQ ID NO: 625761 - RNA, 64 nt, Homo Sapiens; identical to SEQ ID NO: 114783

SEQ ID NO: 625762 - RNA, 64 nt, Homo Sapiens; identical to SEQ ID NO: 114784

SEQ ID NO: 625763 - RNA, 64 nt, Homo Sapiens; identical to SEQ ID NO: 114785

SEQ ID NO: 625764 - RNA, 64 nt, Homo Sapiens; identical to SEQ ID NO: 114786

SEQ ID NO: 625765 - RNA, 64 nt, Homo Sapiens; identical to SEQ ID NO: 114787

SEQ ID NO: 625766 - RNA, 64 nt, Homo Sapiens; identical to SEQ ID NO: 114788

SEQ ID NO: 625767 - RNA, 64 nt, Homo Sapiens; identical to SEQ ID NO: 114789

SEQ ID NO: 625768 - RNA, 64 nt, Homo Sapiens; identical to SEQ ID NO: 114790

SEQ ID NO: 625769 - RNA, 64 nt, Homo Sapiens; identical to SEQ ID NO: 114791

SEQ ID NO: 625770 - RNA, 64 nt, Homo Sapiens; identical to SEQ ID NO: 114792

SEQ ID NO: 625771 - RNA, 64 nt, Homo Sapiens; identical to SEQ ID NO: 114793

SEQ ID NO: 625772 - RNA, 64 nt, Homo Sapiens; identical to SEQ ID NO: 114794

SEQ ID NO: 625773 - RNA, 64 nt, Homo Sapiens; identical to SEQ ID NO: 114795

SEQ ID NO: 625774 - RNA, 64 nt, Homo Sapiens; identical to SEQ ID NO: 114796

SEQ ID NO: 625775 - RNA, 64 nt, Homo Sapiens; identical to SEQ ID NO: 114797

SEQ ID NO: 625776 - RNA, 64 nt, Homo Sapiens; identical to SEQ ID NO: 114798

SEQ ID NO: 625777 - RNA, 64 nt, Homo Sapiens; identical to SEQ ID NO: 114799

SEQ ID NO: 625778 - RNA, 64 nt, Homo Sapiens; identical to SEQ ID NO: 114800

SEQ ID NO: 625779 - RNA, 64 nt, Homo Sapiens; identical to SEQ ID NO: 114801

SEQ ID NO: 625780 - RNA, 64 nt, Homo Sapiens; identical to SEQ ID NO: 114802

SEQ ID NO: 625781 - RNA, 64 nt, Homo Sapiens; identical to SEQ ID NO: 114803

SEQ ID NO: 625782 - RNA, 64 nt, Homo Sapiens; identical to SEQ ID NO: 114804

SEQ ID NO: 625783 - RNA, 64 nt, Homo Sapiens; identical to SEQ ID NO: 114805

SEQ ID NO: 625784 - RNA, 64 nt, Homo Sapiens; identical to SEQ ID NO: 114806

SEQ ID NO: 625785 - RNA, 64 nt, Homo Sapiens; identical to SEQ ID NO: 114807

SEQ ID NO: 625786 - RNA, 64 nt, Homo Sapiens; identical to SEQ ID NO: 167852

SEQ ID NO: 625787 - RNA, 64 nt, Homo Sapiens; identical to SEQ ID NO: 167853

SEQ ID NO: 625788 - RNA, 64 nt, Homo Sapiens; identical to SEQ ID NO: 70884

SEQ ID NO: 625789 - RNA, 64 nt, Homo Sapiens; identical to SEQ ID NO: 70885

SEQ ID NO: 625790 - RNA, 64 nt, Homo Sapiens; identical to SEQ ID NO: 70886

SEQ ID NO: 625791 - RNA, 64 nt, Homo Sapiens; identical to SEQ ID NO: 70887

SEQ ID NO: 625792 - RNA, 64 nt, Homo Sapiens; identical to SEQ ID NO: 70888

SEQ ID NO: 625793 - RNA, 64 nt, Homo Sapiens; identical to SEQ ID NO: 70889

SEQ ID NO: 625794 - RNA, 64 nt, Homo Sapiens; identical to SEQ ID NO: 474161

SEQ ID NO: 625795 - RNA, 64 nt, Homo Sapiens; identical to SEQ ID NO: 474162

SEQ ID NO: 625796 - RNA, 64 nt, Homo Sapiens; identical to SEQ ID NO: 474163

SEQ ID NO: 625797 - RNA, 64 nt, Homo Sapiens; identical to SEQ ID NO: 474164

SEQ ID NO: 625798 - RNA, 64 nt, Homo Sapiens; identical to SEQ ID NO: 474165

SEQ ID NO: 625799 - RNA, 64 nt, Homo Sapiens; identical to SEQ ID NO: 474166

SEQ ID NO: 625800 - RNA, 64 nt, Homo Sapiens; identical to SEQ ID NO: 474167

SEQ ID NO: 625801 - RNA, 64 nt, Homo Sapiens; identical to SEQ ID NO: 474168

SEQ ID NO: 625802 - RNA, 64 nt, Homo Sapiens; identical to SEQ ID NO: 474169

SEQ ID NO: 625803 - RNA, 64 nt, Homo Sapiens; identical to SEQ ID NO: 474170

SEQ ID NO: 625804 - RNA, 64 nt, Homo Sapiens; identical to SEQ ID NO: 474171

SEQ ID NO: 625805 - RNA, 64 nt, Homo Sapiens; identical to SEQ ID NO: 474172

SEQ ID NO: 625806 - RNA, 64 nt, Homo Sapiens; identical to SEQ ID NO: 474173

SEQ ID NO: 625807 - RNA, 64 nt, Homo Sapiens; identical to SEQ ID NO: 474174

SEQ ID NO: 625808 - RNA, 64 nt, Homo Sapiens; identical to SEQ ID NO: 474175

SEQ ID NO: 625809 - RNA, 64 nt, Homo Sapiens; identical to SEQ ID NO: 474176

SEQ ID NO: 625810 - RNA, 64 nt, Homo Sapiens; identical to SEQ ID NO: 474177

SEQ ID NO: 625811 - RNA, 64 nt, Homo Sapiens; identical to SEQ ID NO: 474178

SEQ ID NO: 625812 - RNA, 64 nt, Homo Sapiens; identical to SEQ ID NO: 474179

SEQ ID NO: 625813 - RNA, 64 nt, Homo Sapiens; identical to SEQ ID NO: 474180

SEQ ID NO: 625814 - RNA, 64 nt, Homo Sapiens; identical to SEQ ID NO: 474181

SEQ ID NO: 625815 - RNA, 64 nt, Homo Sapiens; identical to SEQ ID NO: 474182

SEQ ID NO: 625816 - RNA, 64 nt, Homo Sapiens; identical to SEQ ID NO: 474183

SEQ ID NO: 625817 - RNA, 64 nt, Homo Sapiens; identical to SEQ ID NO: 474184

SEQ ID NO: 625818 - RNA, 64 nt, Homo Sapiens; identical to SEQ ID NO: 474185

SEQ ID NO: 625819 - RNA, 64 nt, Homo Sapiens; identical to SEQ ID NO: 474186

SEQ ID NO: 625820 - RNA, 64 nt, Homo Sapiens
caggaaccacauuuucaauccuccuucacugucuuccuaccauguucagcccagacuccugcca

SEQ ID NO: 625821 - RNA, 64 nt, Homo Sapiens
ucaaaucagaccagcacugauuaauuaacccugcuccuaccaaucuuuuuuaaagcaguugaag

SEQ ID NO: 625822 - RNA, 64 nt, Homo Sapiens
uaagauuaagauuauuuaugugauaaaugaaaucuccuaccaauccauccagccuuuaccaggg

SEQ ID NO: 625823 - RNA, 64 nt, Homo Sapiens
aaauuuagcugggcaugguggugcacaucuguaguccuaccaacuugggaggcugaggcaggag

SEQ ID NO: 625824 - RNA, 64 nt, Homo Sapiens
uccgccuuugucccauucugccccuguacauguuuccuaccaagcauguuucacauuuuccuau

SEQ ID NO: 625825 - RNA, 64 nt, Homo Sapiens
uuguuuuguuuucuuguacuuaaaccugcuugcuuccuaccacagauucuuuauuuucccaaac

SEQ ID NO: 625826 - RNA, 64 nt, Homo Sapiens
uuauuagcugcuugaaaaauaauuaaauauuauguccuaccaacaaauaauuagguccccaacg

SEQ ID NO: 625827 - RNA, 64 nt, Homo Sapiens
cuaaucaagaaaagaauuacacaguauuacaguguccuaccacuaugcauggaaacauggagga

SEQ ID NO: 625828 - RNA, 64 nt, Homo Sapiens
gccucuccacagcccgugauccccugcuucuggcuccuaccacuggacagucauuguggauaga

SEQ ID NO: 625829 - RNA, 64 nt, Homo Sapiens
aaugugugcccuaucuuuucucccaccuccuuccuccuaccacccagcccuauccauucucucc

SEQ ID NO: 625830 - RNA, 64 nt, Homo Sapiens
uggccaaggcguuggcagaccggucaucgagaguuccuaccaggcaugucuuggcagugccagg

SEQ ID NO: 625831 - RNA, 64 nt, Homo Sapiens
uggagaggauguucaacaccuagugccuaugugcuccuaccagaucaggugauggcacugggca

SEQ ID NO: 625832 - RNA, 64 nt, Homo Sapiens
ggcucaaagaggccgagaaacccaguucuccugggccaaggaucccuucuggcaaagcugcugc

SEQ ID NO: 625833 - RNA, 64 nt, Homo Sapiens
cacacgcccuccuggcugggccucaggaggaacagccaaggagaagaauggcccaaggaacuag

SEQ ID NO: 625834 - RNA, 64 nt, Homo Sapiens
caaacugcacaagcuuguaauuccccuccugugagccaaggagguccugaggcuuuccacaaug

SEQ ID NO: 625835 - RNA, 64 nt, Homo Sapiens
uggcccauuggucauucacuguaaucacgucugagccaaggagcauuaauuaggaaaaccaaua

SEQ ID NO: 625836 - RNA, 64 nt, Homo Sapiens
aagcuggcugcuuccaggagucuaaaauuaaaaugccaaggauagcauggaaguuuaaauuuuc

SEQ ID NO: 625837 - RNA, 64 nt, Homo Sapiens
cguauucagggacccaugcucguauugggguucugccaaggaccauguguaaggaagggccuuc

SEQ ID NO: 625838 - RNA, 64 nt, Homo Sapiens
guccuuccucuccccuuuugacaccuauucccaggccaaggagacuccuaugguucccauaggc

SEQ ID NO: 625839 - RNA, 64 nt, Homo Sapiens
acaaacauaauugcauguuugaauaaguacaguagccaaggaauguuuuuagaauauuucgucu

SEQ ID NO: 625840 - RNA, 64 nt, Homo Sapiens
ggcuccuaugccuccuggcuucugaguggguuuggccaaggaguguccuggccagagaucagag

SEQ ID NO: 625841 - RNA, 64 nt, Homo Sapiens
uccagguugccagucccugcacucuuccuuucuggccaaggaugaugucaguucugcugcuacu

SEQ ID NO: 625842 - RNA, 64 nt, Homo Sapiens
aucuguguucaaagaugaagaccccucauuaaaagccaaggacguucuuaagauuggaacugac

SEQ ID NO: 625843 - RNA, 64 nt, Homo Sapiens
guggcucaagccuguaaccccagcacuuugggaggccaaggagggaggaucacaaggucaggag

SEQ ID NO: 625844 - RNA, 64 nt, Homo Sapiens
agggacaguugcuuuucagcaugggcccaggaaugccaaggagacaucuaugcacgaccuuggg

SEQ ID NO: 625845 - RNA, 64 nt, Homo Sapiens
gcauggcugugaggauggggugaacucacgcacagccaaggacuccaaaaucacaacagcauua

SEQ ID NO: 625846 - RNA, 64 nt, Homo Sapiens
uagaauuacuaauacaaggguuuuccccccauaagccaaggaggcagcaauuuaaaacuaggac

SEQ ID NO: 625847 - RNA, 64 nt, Homo Sapiens
auuugaugcauucagauucugcgaagaaaucacagccaaggaagaaacagagaaaacugggguc

SEQ ID NO: 625848 - RNA, 64 nt, Homo Sapiens
gaugugacguuggaacugcuuucucaccauuccagccaaggagacagcucacgacagugccacc

SEQ ID NO: 625849 - RNA, 64 nt, Homo Sapiens
gcucacgacagugccaccuucauggggcagaauugccaaggacacagaccaggcgcacguggcu

SEQ ID NO: 625850 - RNA, 64 nt, Homo Sapiens
uguccuguccaccagcgccaacagccguggggaagccaaggagacccaagggguccaggaggug

SEQ ID NO: 625851 - RNA, 64 nt, Homo Sapiens
ccgucugccagggcgccggccacaauccugcagggccaaggacuggacuccaggcaagucccug

SEQ ID NO: 625852 - RNA, 59 nt, Homo Sapiens
agaagaaacgcagggagugauguggccgggccaaggacaggcagggagggaggccaggc

SEQ ID NO: 625853 - RNA, 64 nt, Homo Sapiens
gggcggccggggcaggcuuagggcacaguuaggggccaaggagagggaaggccagggccccugu

SEQ ID NO: 625854 - RNA, 63 nt, Homo Sapiens
ggcuccucugugacaaaacauagcuucaagcaugacuguuaauauuuauuuuaaaacaagggc

SEQ ID NO: 625855 - RNA, 63 nt, Homo Sapiens
cacuacuaaacucuaccaaguccauaagugcaggacuguuacuauuaaugaguauuuccuuuc

SEQ ID NO: 625856 - RNA, 63 nt, Homo Sapiens
cagguuccaagccuagaggcuggucgcuccuccgacuguuaucugcucagacagaagggacug

SEQ ID NO: 625857 - RNA, 63 nt, Homo Sapiens
ccgguuccaagccuagaggacagucgugccucugacuguuauccucagacacagaagggacug

SEQ ID NO: 625858 - RNA, 63 nt, Homo Sapiens
uguuuuaagacuuccacacaccaaggcuacaaugacuguuaaccuggaggaagucucugguau

SEQ ID NO: 625859 - RNA, 63 nt, Homo Sapiens
auaaauuaagcauaaaauauguaaccaggaaaagacuguuaacauuacauuuaugcaaauuaa

SEQ ID NO: 625860 - RNA, 64 nt, Homo Sapiens; identical to SEQ ID NO: 84809

SEQ ID NO: 625861 - RNA, 64 nt, Homo Sapiens; identical to SEQ ID NO: 84810

SEQ ID NO: 625862 - RNA, 64 nt, Homo Sapiens; identical to SEQ ID NO: 84811

SEQ ID NO: 625863 - RNA, 64 nt, Homo Sapiens; identical to SEQ ID NO: 84812

SEQ ID NO: 625864 - RNA, 64 nt, Homo Sapiens; identical to SEQ ID NO: 557328

SEQ ID NO: 625865 - RNA, 64 nt, Homo Sapiens; identical to SEQ ID NO: 557329

SEQ ID NO: 625866 - RNA, 64 nt, Homo Sapiens; identical to SEQ ID NO: 557330

SEQ ID NO: 625867 - RNA, 64 nt, Homo Sapiens; identical to SEQ ID NO: 557331

SEQ ID NO: 625868 - RNA, 64 nt, Homo Sapiens; identical to SEQ ID NO: 557332

SEQ ID NO: 625869 - RNA, 64 nt, Homo Sapiens; identical to SEQ ID NO: 557333

SEQ ID NO: 625870 - RNA, 64 nt, Homo Sapiens; identical to SEQ ID NO: 557334

SEQ ID NO: 625871 - RNA, 64 nt, Homo Sapiens; identical to SEQ ID NO: 557335

SEQ ID NO: 625872 - RNA, 64 nt, Homo Sapiens; identical to SEQ ID NO: 557336

SEQ ID NO: 625873 - RNA, 64 nt, Homo Sapiens; identical to SEQ ID NO: 557337

SEQ ID NO: 625874 - RNA, 64 nt, Homo Sapiens; identical to SEQ ID NO: 557338

SEQ ID NO: 625875 - RNA, 64 nt, Homo Sapiens; identical to SEQ ID NO: 557339

SEQ ID NO: 625876 - RNA, 64 nt, Homo Sapiens; identical to SEQ ID NO: 557340

SEQ ID NO: 625877 - RNA, 64 nt, Homo Sapiens; identical to SEQ ID NO: 557341

SEQ ID NO: 625878 - RNA, 64 nt, Homo Sapiens; identical to SEQ ID NO: 557342

SEQ ID NO: 625879 - RNA, 64 nt, Homo Sapiens; identical to SEQ ID NO: 557343

SEQ ID NO: 625880 - RNA, 64 nt, Homo Sapiens; identical to SEQ ID NO: 557344

SEQ ID NO: 625881 - RNA, 64 nt, Homo Sapiens; identical to SEQ ID NO: 557345

SEQ ID NO: 625882 - RNA, 64 nt, Homo Sapiens; identical to SEQ ID NO: 557346

SEQ ID NO: 625883 - RNA, 64 nt, Homo Sapiens; identical to SEQ ID NO: 557347

SEQ ID NO: 625884 - RNA, 64 nt, Homo Sapiens; identical to SEQ ID NO: 557348

SEQ ID NO: 625885 - RNA, 64 nt, Homo Sapiens; identical to SEQ ID NO: 557349

SEQ ID NO: 625886 - RNA, 64 nt, Homo Sapiens; identical to SEQ ID NO: 557350

SEQ ID NO: 625887 - RNA, 64 nt, Homo Sapiens; identical to SEQ ID NO: 557351

SEQ ID NO: 625888 - RNA, 64 nt, Homo Sapiens; identical to SEQ ID NO: 557352

SEQ ID NO: 625889 - RNA, 64 nt, Homo Sapiens; identical to SEQ ID NO: 557353

SEQ ID NO: 625890 - RNA, 64 nt, Homo Sapiens; identical to SEQ ID NO: 557354

SEQ ID NO: 625891 - RNA, 64 nt, Homo Sapiens; identical to SEQ ID NO: 557355

SEQ ID NO: 625892 - RNA, 64 nt, Homo Sapiens; identical to SEQ ID NO: 236779

SEQ ID NO: 625893 - RNA, 64 nt, Homo Sapiens; identical to SEQ ID NO: 236780

SEQ ID NO: 625894 - RNA, 64 nt, Homo Sapiens; identical to SEQ ID NO: 236781

SEQ ID NO: 625895 - RNA, 64 nt, Homo Sapiens; identical to SEQ ID NO: 236782

SEQ ID NO: 625896 - RNA, 64 nt, Homo Sapiens; identical to SEQ ID NO: 236783

SEQ ID NO: 625897 - RNA, 64 nt, Homo Sapiens; identical to SEQ ID NO: 236784

SEQ ID NO: 625898 - RNA, 64 nt, Homo Sapiens; identical to SEQ ID NO: 236785

SEQ ID NO: 625899 - RNA, 64 nt, Homo Sapiens; identical to SEQ ID NO: 236786

SEQ ID NO: 625900 - RNA, 64 nt, Homo Sapiens; identical to SEQ ID NO: 236787

SEQ ID NO: 625901 - RNA, 64 nt, Homo Sapiens; identical to SEQ ID NO: 236788

SEQ ID NO: 625902 - RNA, 64 nt, Homo Sapiens; identical to SEQ ID NO: 236789

SEQ ID NO: 625903 - RNA, 64 nt, Homo Sapiens; identical to SEQ ID NO: 236790

SEQ ID NO: 625904 - RNA, 64 nt, Homo Sapiens
cugggagauacaauucaaguucugucccacaacacgugggaauuuucaauuaccucccccuggg

SEQ ID NO: 625905 - RNA, 64 nt, Homo Sapiens
cugguagauacaauuucaagucucucccacaacacgugggaauuuucaauuaccuccccuuggg

SEQ ID NO: 625906 - RNA, 64 nt, Homo Sapiens; identical to SEQ ID NO: 193898

SEQ ID NO: 625907 - RNA, 64 nt, Homo Sapiens; identical to SEQ ID NO: 193899

SEQ ID NO: 625908 - RNA, 64 nt, Homo Sapiens; identical to SEQ ID NO: 193900

SEQ ID NO: 625909 - RNA, 64 nt, Homo Sapiens; identical to SEQ ID NO: 193901

SEQ ID NO: 625910 - RNA, 64 nt, Homo Sapiens; identical to SEQ ID NO: 193902

SEQ ID NO: 625911 - RNA, 64 nt, Homo Sapiens; identical to SEQ ID NO: 193903

SEQ ID NO: 625912 - RNA, 64 nt, Homo Sapiens; identical to SEQ ID NO: 193904

SEQ ID NO: 625913 - RNA, 64 nt, Homo Sapiens; identical to SEQ ID NO: 193905

SEQ ID NO: 625914 - RNA, 64 nt, Homo Sapiens; identical to SEQ ID NO: 193906

SEQ ID NO: 625915 - RNA, 64 nt, Homo Sapiens; identical to SEQ ID NO: 193907

SEQ ID NO: 625916 - RNA, 64 nt, Homo Sapiens; identical to SEQ ID NO: 193908

SEQ ID NO: 625917 - RNA, 64 nt, Homo Sapiens; identical to SEQ ID NO: 193909

SEQ ID NO: 625918 - RNA, 64 nt, Homo Sapiens; identical to SEQ ID NO: 193910

SEQ ID NO: 625919 - RNA, 64 nt, Homo Sapiens; identical to SEQ ID NO: 193911

SEQ ID NO: 625920 - RNA, 64 nt, Homo Sapiens; identical to SEQ ID NO: 193912

SEQ ID NO: 625921 - RNA, 64 nt, Homo Sapiens; identical to SEQ ID NO: 193913

SEQ ID NO: 625922 - RNA, 64 nt, Homo Sapiens; identical to SEQ ID NO: 193914

SEQ ID NO: 625923 - RNA, 64 nt, Homo Sapiens; identical to SEQ ID NO: 193915

SEQ ID NO: 625924 - RNA, 64 nt, Homo Sapiens; identical to SEQ ID NO: 193916

SEQ ID NO: 625925 - RNA, 64 nt, Homo Sapiens; identical to SEQ ID NO: 193917

SEQ ID NO: 625926 - RNA, 64 nt, Homo Sapiens; identical to SEQ ID NO: 193918

SEQ ID NO: 625927 - RNA, 64 nt, Homo Sapiens; identical to SEQ ID NO: 193919

SEQ ID NO: 625928 - RNA, 64 nt, Homo Sapiens; identical to SEQ ID NO: 266922

SEQ ID NO: 625929 - RNA, 64 nt, Homo Sapiens; identical to SEQ ID NO: 266923

SEQ ID NO: 625930 - RNA, 64 nt, Homo Sapiens; identical to SEQ ID NO: 266924

SEQ ID NO: 625931 - RNA, 64 nt, Homo Sapiens; identical to SEQ ID NO: 266925

SEQ ID NO: 625932 - RNA, 64 nt, Homo Sapiens; identical to SEQ ID NO: 266926

SEQ ID NO: 625933 - RNA, 64 nt, Homo Sapiens; identical to SEQ ID NO: 266927

SEQ ID NO: 625934 - RNA, 64 nt, Homo Sapiens; identical to SEQ ID NO: 266928

SEQ ID NO: 625935 - RNA, 64 nt, Homo Sapiens; identical to SEQ ID NO: 266929

SEQ ID NO: 625936 - RNA, 64 nt, Homo Sapiens; identical to SEQ ID NO: 266930

SEQ ID NO: 625937 - RNA, 64 nt, Homo Sapiens; identical to SEQ ID NO: 266931

SEQ ID NO: 625938 - RNA, 64 nt, Homo Sapiens; identical to SEQ ID NO: 266932

SEQ ID NO: 625939 - RNA, 64 nt, Homo Sapiens; identical to SEQ ID NO: 266933

SEQ ID NO: 625940 - RNA, 64 nt, Homo Sapiens; identical to SEQ ID NO: 266934

SEQ ID NO: 625941 - RNA, 64 nt, Homo Sapiens; identical to SEQ ID NO: 266935

SEQ ID NO: 625942 - RNA, 64 nt, Homo Sapiens; identical to SEQ ID NO: 266936

SEQ ID NO: 625943 - RNA, 64 nt, Homo Sapiens; identical to SEQ ID NO: 266937

SEQ ID NO: 625944 - RNA, 64 nt, Homo Sapiens; identical to SEQ ID NO: 266938

SEQ ID NO: 625945 - RNA, 64 nt, Homo Sapiens; identical to SEQ ID NO: 266939

SEQ ID NO: 625946 - RNA, 64 nt, Homo Sapiens; identical to SEQ ID NO: 266940

SEQ ID NO: 625947 - RNA, 64 nt, Homo Sapiens; identical to SEQ ID NO: 266941

SEQ ID NO: 625948 - RNA, 64 nt, Homo Sapiens; identical to SEQ ID NO: 266942

SEQ ID NO: 625949 - RNA, 64 nt, Homo Sapiens; identical to SEQ ID NO: 266943

SEQ ID NO: 625950 - RNA, 64 nt, Homo Sapiens; identical to SEQ ID NO: 266944

SEQ ID NO: 625951 - RNA, 64 nt, Homo Sapiens; identical to SEQ ID NO: 266945

SEQ ID NO: 625952 - RNA, 64 nt, Homo Sapiens; identical to SEQ ID NO: 266946

SEQ ID NO: 625953 - RNA, 64 nt, Homo Sapiens; identical to SEQ ID NO: 266947

SEQ ID NO: 625954 - RNA, 64 nt, Homo Sapiens; identical to SEQ ID NO: 266948

SEQ ID NO: 625955 - RNA, 64 nt, Homo Sapiens; identical to SEQ ID NO: 266949

SEQ ID NO: 625956 - RNA, 64 nt, Homo Sapiens; identical to SEQ ID NO: 266950

SEQ ID NO: 625957 - RNA, 64 nt, Homo Sapiens; identical to SEQ ID NO: 266951

SEQ ID NO: 625958 - RNA, 64 nt, Homo Sapiens; identical to SEQ ID NO: 266952

SEQ ID NO: 625959 - RNA, 64 nt, Homo Sapiens; identical to SEQ ID NO: 266953

SEQ ID NO: 625960 - RNA, 64 nt, Homo Sapiens; identical to SEQ ID NO: 266954

SEQ ID NO: 625961 - RNA, 64 nt, Homo Sapiens; identical to SEQ ID NO: 266955

SEQ ID NO: 625962 - RNA, 64 nt, Homo Sapiens; identical to SEQ ID NO: 266956

SEQ ID NO: 625963 - RNA, 64 nt, Homo Sapiens; identical to SEQ ID NO: 266957

SEQ ID NO: 625964 - RNA, 64 nt, Homo Sapiens; identical to SEQ ID NO: 266958

SEQ ID NO: 625965 - RNA, 63 nt, Homo Sapiens; identical to SEQ ID NO: 266959

SEQ ID NO: 625966 - RNA, 64 nt, Homo Sapiens; identical to SEQ ID NO: 266960

SEQ ID NO: 625967 - RNA, 64 nt, Homo Sapiens; identical to SEQ ID NO: 266961

SEQ ID NO: 625968 - RNA, 64 nt, Homo Sapiens; identical to SEQ ID NO: 266962

SEQ ID NO: 625969 - RNA, 64 nt, Homo Sapiens; identical to SEQ ID NO: 266963

SEQ ID NO: 625970 - RNA, 64 nt, Homo Sapiens; identical to SEQ ID NO: 266964

SEQ ID NO: 625971 - RNA, 64 nt, Homo Sapiens; identical to SEQ ID NO: 266965

SEQ ID NO: 625972 - RNA, 64 nt, Homo Sapiens; identical to SEQ ID NO: 266966

SEQ ID NO: 625973 - RNA, 64 nt, Homo Sapiens; identical to SEQ ID NO: 266967

SEQ ID NO: 625974 - RNA, 64 nt, Homo Sapiens; identical to SEQ ID NO: 266968

SEQ ID NO: 625975 - RNA, 64 nt, Homo Sapiens; identical to SEQ ID NO: 266969

SEQ ID NO: 625976 - RNA, 64 nt, Homo Sapiens; identical to SEQ ID NO: 266970

SEQ ID NO: 625977 - RNA, 64 nt, Homo Sapiens; identical to SEQ ID NO: 266971

SEQ ID NO: 625978 - RNA, 64 nt, Homo Sapiens; identical to SEQ ID NO: 266972

SEQ ID NO: 625979 - RNA, 64 nt, Homo Sapiens; identical to SEQ ID NO: 266973

SEQ ID NO: 625980 - RNA, 64 nt, Homo Sapiens; identical to SEQ ID NO: 266974

SEQ ID NO: 625981 - RNA, 64 nt, Homo Sapiens; identical to SEQ ID NO: 266975

SEQ ID NO: 625982 - RNA, 64 nt, Homo Sapiens; identical to SEQ ID NO: 266976

SEQ ID NO: 625983 - RNA, 64 nt, Homo Sapiens; identical to SEQ ID NO: 266977

SEQ ID NO: 625984 - RNA, 64 nt, Homo Sapiens; identical to SEQ ID NO: 266978

SEQ ID NO: 625985 - RNA, 64 nt, Homo Sapiens; identical to SEQ ID NO: 266979

SEQ ID NO: 625986 - RNA, 64 nt, Homo Sapiens; identical to SEQ ID NO: 266980

SEQ ID NO: 625987 - RNA, 64 nt, Homo Sapiens; identical to SEQ ID NO: 266981

SEQ ID NO: 625988 - RNA, 64 nt, Homo Sapiens; identical to SEQ ID NO: 266982

SEQ ID NO: 625989 - RNA, 64 nt, Homo Sapiens; identical to SEQ ID NO: 266983

SEQ ID NO: 625990 - RNA, 64 nt, Homo Sapiens; identical to SEQ ID NO: 279869

SEQ ID NO: 625991 - RNA, 64 nt, Homo Sapiens; identical to SEQ ID NO: 279870

SEQ ID NO: 625992 - RNA, 64 nt, Homo Sapiens; identical to SEQ ID NO: 279871

SEQ ID NO: 625993 - RNA, 64 nt, Homo Sapiens; identical to SEQ ID NO: 279871

SEQ ID NO: 625994 - RNA, 64 nt, Homo Sapiens; identical to SEQ ID NO: 279873

SEQ ID NO: 625995 - RNA, 64 nt, Homo Sapiens; identical to SEQ ID NO: 279874

SEQ ID NO: 625996 - RNA, 64 nt, Homo Sapiens; identical to SEQ ID NO: 279875

SEQ ID NO: 625997 - RNA, 64 nt, Homo Sapiens; identical to SEQ ID NO: 279876

SEQ ID NO: 625998 - RNA, 64 nt, Homo Sapiens; identical to SEQ ID NO: 279877

SEQ ID NO: 625999 - RNA, 64 nt, Homo Sapiens; identical to SEQ ID NO: 279878

SEQ ID NO: 626000 - RNA, 64 nt, Homo Sapiens; identical to SEQ ID NO: 279879

SEQ ID NO: 626001 - RNA, 64 nt, Homo Sapiens; identical to SEQ ID NO: 279880

SEQ ID NO: 626002 - RNA, 64 nt, Homo Sapiens; identical to SEQ ID NO: 279881

SEQ ID NO: 626003 - RNA, 64 nt, Homo Sapiens; identical to SEQ ID NO: 279882

SEQ ID NO: 626004 - RNA, 64 nt, Homo Sapiens; identical to SEQ ID NO: 279883

SEQ ID NO: 626005 - RNA, 64 nt, Homo Sapiens; identical to SEQ ID NO: 279884

SEQ ID NO: 626006 - RNA, 64 nt, Homo Sapiens; identical to SEQ ID NO: 279885

SEQ ID NO: 626007 - RNA, 64 nt, Homo Sapiens; identical to SEQ ID NO: 279886

SEQ ID NO: 626008 - RNA, 64 nt, Homo Sapiens; identical to SEQ ID NO: 279887

SEQ ID NO: 626009 - RNA, 64 nt, Homo Sapiens; identical to SEQ ID NO: 279888

SEQ ID NO: 626010 - RNA, 64 nt, Homo Sapiens; identical to SEQ ID NO: 279889

SEQ ID NO: 626011 - RNA, 64 nt, Homo Sapiens; identical to SEQ ID NO: 279890

SEQ ID NO: 626012 - RNA, 64 nt, Homo Sapiens; identical to SEQ ID NO: 279891

SEQ ID NO: 626013 - RNA, 64 nt, Homo Sapiens; identical to SEQ ID NO: 279892

SEQ ID NO: 626014 - RNA, 64 nt, Homo Sapiens; identical to SEQ ID NO: 279893

SEQ ID NO: 626015 - RNA, 64 nt, Homo Sapiens; identical to SEQ ID NO: 279894

SEQ ID NO: 626016 - RNA, 64 nt, Homo Sapiens; identical to SEQ ID NO: 279895

SEQ ID NO: 626017 - RNA, 64 nt, Homo Sapiens; identical to SEQ ID NO: 279896

SEQ ID NO: 626018 - RNA, 64 nt, Homo Sapiens; identical to SEQ ID NO: 279897

SEQ ID NO: 626019 - RNA, 64 nt, Homo Sapiens; identical to SEQ ID NO: 279898

SEQ ID NO: 626020 - RNA, 64 nt, Homo Sapiens; identical to SEQ ID NO: 279898

SEQ ID NO: 626021 - RNA, 64 nt, Homo Sapiens; identical to SEQ ID NO: 189094

SEQ ID NO: 626022 - RNA, 64 nt, Homo Sapiens; identical to SEQ ID NO: 189095

SEQ ID NO: 626023 - RNA, 64 nt, Homo Sapiens; identical to SEQ ID NO: 189096

SEQ ID NO: 626024 - RNA, 64 nt, Homo Sapiens; identical to SEQ ID NO: 189097

SEQ ID NO: 626025 - RNA, 64 nt, Homo Sapiens; identical to SEQ ID NO: 189098

SEQ ID NO: 626026 - RNA, 64 nt, Homo Sapiens; identical to SEQ ID NO: 189099

SEQ ID NO: 626027 - RNA, 64 nt, Homo Sapiens; identical to SEQ ID NO: 189100

SEQ ID NO: 626028 - RNA, 64 nt, Homo Sapiens; identical to SEQ ID NO: 189101

SEQ ID NO: 626029 - RNA, 64 nt, Homo Sapiens; identical to SEQ ID NO: 189102

SEQ ID NO: 626030 - RNA, 64 nt, Homo Sapiens; identical to SEQ ID NO: 189103

SEQ ID NO: 626031 - RNA, 64 nt, Homo Sapiens; identical to SEQ ID NO: 189104

SEQ ID NO: 626032 - RNA, 64 nt, Homo Sapiens; identical to SEQ ID NO: 189105

SEQ ID NO: 626033 - RNA, 64 nt, Homo Sapiens; identical to SEQ ID NO: 189106

SEQ ID NO: 626034 - RNA, 64 nt, Homo Sapiens; identical to SEQ ID NO: 189107

SEQ ID NO: 626035 - RNA, 64 nt, Homo Sapiens; identical to SEQ ID NO: 189108

SEQ ID NO: 626036 - RNA, 64 nt, Homo Sapiens; identical to SEQ ID NO: 189109

SEQ ID NO: 626037 - RNA, 64 nt, Homo Sapiens; identical to SEQ ID NO: 189110

SEQ ID NO: 626038 - RNA, 64 nt, Homo Sapiens; identical to SEQ ID NO: 189111

SEQ ID NO: 626039 - RNA, 64 nt, Homo Sapiens; identical to SEQ ID NO: 189112

SEQ ID NO: 626040 - RNA, 64 nt, Homo Sapiens; identical to SEQ ID NO: 189113

SEQ ID NO: 626041 - RNA, 64 nt, Homo Sapiens; identical to SEQ ID NO: 189114

SEQ ID NO: 626042 - RNA, 64 nt, Homo Sapiens; identical to SEQ ID NO: 189115

SEQ ID NO: 626043 - RNA, 64 nt, Homo Sapiens; identical to SEQ ID NO: 189116

SEQ ID NO: 626044 - RNA, 64 nt, Homo Sapiens; identical to SEQ ID NO: 189117

SEQ ID NO: 626045 - RNA, 64 nt, Homo Sapiens; identical to SEQ ID NO: 189118

SEQ ID NO: 626046 - RNA, 64 nt, Homo Sapiens; identical to SEQ ID NO: 189119

SEQ ID NO: 626047 - RNA, 64 nt, Homo Sapiens
aacaggaaaaagaaucaccuauaaccucaccauccauagacagacacuguuaaaauuuuggcau

SEQ ID NO: 626048 - RNA, 64 nt, Homo Sapiens
ggaucauaaacauuuuucuaaauccugaaaaaugcauagacauauuuuagugccuguauuucac

SEQ ID NO: 626049 - RNA, 64 nt, Homo Sapiens; identical to SEQ ID NO: 129470

SEQ ID NO: 626050 - RNA, 64 nt, Homo Sapiens; identical to SEQ ID NO: 129471

SEQ ID NO: 626051 - RNA, 64 nt, Homo Sapiens; identical to SEQ ID NO: 129472

SEQ ID NO: 626052 - RNA, 64 nt, Homo Sapiens; identical to SEQ ID NO: 129473

SEQ ID NO: 626053 - RNA, 64 nt, Homo Sapiens; identical to SEQ ID NO: 129474

SEQ ID NO: 626054 - RNA, 64 nt, Homo Sapiens; identical to SEQ ID NO: 129475

SEQ ID NO: 626055 - RNA, 64 nt, Homo Sapiens; identical to SEQ ID NO: 129476

SEQ ID NO: 626056 - RNA, 64 nt, Homo Sapiens; identical to SEQ ID NO: 129477

SEQ ID NO: 626057 - RNA, 64 nt, Homo Sapiens; identical to SEQ ID NO: 129478

SEQ ID NO: 626058 - RNA, 64 nt, Homo Sapiens; identical to SEQ ID NO: 129479

SEQ ID NO: 626059 - RNA, 64 nt, Homo Sapiens; identical to SEQ ID NO: 243458

SEQ ID NO: 626060 - RNA, 64 nt, Homo Sapiens; identical to SEQ ID NO: 243459

SEQ ID NO: 626061 - RNA, 64 nt, Homo Sapiens; identical to SEQ ID NO: 243460

SEQ ID NO: 626062 - RNA, 64 nt, Homo Sapiens; identical to SEQ ID NO: 243461

SEQ ID NO: 626063 - RNA, 64 nt, Homo Sapiens; identical to SEQ ID NO: 243462

SEQ ID NO: 626064 - RNA, 64 nt, Homo Sapiens; identical to SEQ ID NO: 357461

SEQ ID NO: 626065 - RNA, 64 nt, Homo Sapiens; identical to SEQ ID NO: 357462

SEQ ID NO: 626066 - RNA, 64 nt, Homo Sapiens; identical to SEQ ID NO: 357463

SEQ ID NO: 626067 - RNA, 64 nt, Homo Sapiens; identical to SEQ ID NO: 357464

SEQ ID NO: 626068 - RNA, 64 nt, Homo Sapiens; identical to SEQ ID NO: 357465

SEQ ID NO: 626069 - RNA, 64 nt, Homo Sapiens; identical to SEQ ID NO: 357466

SEQ ID NO: 626070 - RNA, 64 nt, Homo Sapiens; identical to SEQ ID NO: 357467

SEQ ID NO: 626071 - RNA, 64 nt, Homo Sapiens; identical to SEQ ID NO: 357468

SEQ ID NO: 626072 - RNA, 64 nt, Homo Sapiens; identical to SEQ ID NO: 357469

SEQ ID NO: 626073 - RNA, 64 nt, Homo Sapiens; identical to SEQ ID NO: 357470

SEQ ID NO: 626074 - RNA, 64 nt, Homo Sapiens; identical to SEQ ID NO: 357471

SEQ ID NO: 626075 - RNA, 64 nt, Homo Sapiens; identical to SEQ ID NO: 357472

SEQ ID NO: 626076 - RNA, 64 nt, Homo Sapiens; identical to SEQ ID NO: 357473

SEQ ID NO: 626077 - RNA, 64 nt, Homo Sapiens; identical to SEQ ID NO: 357474

SEQ ID NO: 626078 - RNA, 64 nt, Homo Sapiens; identical to SEQ ID NO: 357475

SEQ ID NO: 626079 - RNA, 64 nt, Homo Sapiens; identical to SEQ ID NO: 357476

SEQ ID NO: 626080 - RNA, 64 nt, Homo Sapiens; identical to SEQ ID NO: 357477

SEQ ID NO: 626081 - RNA, 64 nt, Homo Sapiens; identical to SEQ ID NO: 357478

SEQ ID NO: 626082 - RNA, 64 nt, Homo Sapiens; identical to SEQ ID NO: 357479

SEQ ID NO: 626083 - RNA, 64 nt, Homo Sapiens; identical to SEQ ID NO: 357480

SEQ ID NO: 626084 - RNA, 64 nt, Homo Sapiens; identical to SEQ ID NO: 357481

SEQ ID NO: 626085 - RNA, 64 nt, Homo Sapiens; identical to SEQ ID NO: 357482

SEQ ID NO: 626086 - RNA, 64 nt, Homo Sapiens; identical to SEQ ID NO: 357483

SEQ ID NO: 626087 - RNA, 64 nt, Homo Sapiens; identical to SEQ ID NO: 357484

SEQ ID NO: 626088 - RNA, 64 nt, Homo Sapiens; identical to SEQ ID NO: 357485

SEQ ID NO: 626089 - RNA, 64 nt, Homo Sapiens; identical to SEQ ID NO: 357486

SEQ ID NO: 626090 - RNA, 64 nt, Homo Sapiens; identical to SEQ ID NO: 357487

SEQ ID NO: 626091 - RNA, 64 nt, Homo Sapiens; identical to SEQ ID NO: 357488

SEQ ID NO: 626092 - RNA, 64 nt, Homo Sapiens; identical to SEQ ID NO: 357489

SEQ ID NO: 626093 - RNA, 64 nt, Homo Sapiens; identical to SEQ ID NO: 357490

SEQ ID NO: 626094 - RNA, 64 nt, Homo Sapiens; identical to SEQ ID NO: 357491

SEQ ID NO: 626095 - RNA, 64 nt, Homo Sapiens; identical to SEQ ID NO: 357492

SEQ ID NO: 626096 - RNA, 64 nt, Homo Sapiens; identical to SEQ ID NO: 357493

SEQ ID NO: 626097 - RNA, 64 nt, Homo Sapiens; identical to SEQ ID NO: 357494

SEQ ID NO: 626098 - RNA, 64 nt, Homo Sapiens; identical to SEQ ID NO: 357495

SEQ ID NO: 626099 - RNA, 64 nt, Homo Sapiens; identical to SEQ ID NO: 357496

SEQ ID NO: 626100 - RNA, 64 nt, Homo Sapiens; identical to SEQ ID NO: 357497

SEQ ID NO: 626101 - RNA, 64 nt, Homo Sapiens; identical to SEQ ID NO: 357498

SEQ ID NO: 626102 - RNA, 64 nt, Homo Sapiens; identical to SEQ ID NO: 357499

SEQ ID NO: 626103 - RNA, 64 nt, Homo Sapiens; identical to SEQ ID NO: 357500

SEQ ID NO: 626104 - RNA, 64 nt, Homo Sapiens; identical to SEQ ID NO: 357501

SEQ ID NO: 626105 - RNA, 64 nt, Homo Sapiens; identical to SEQ ID NO: 357502

SEQ ID NO: 626106 - RNA, 64 nt, Homo Sapiens; identical to SEQ ID NO: 357503

SEQ ID NO: 626107 - RNA, 64 nt, Homo Sapiens; identical to SEQ ID NO: 357504

SEQ ID NO: 626108 - RNA, 64 nt, Homo Sapiens; identical to SEQ ID NO: 357505

SEQ ID NO: 626109 - RNA, 64 nt, Homo Sapiens; identical to SEQ ID NO: 357506

SEQ ID NO: 626110 - RNA, 64 nt, Homo Sapiens; identical to SEQ ID NO: 357507

SEQ ID NO: 626111 - RNA, 64 nt, Homo Sapiens; identical to SEQ ID NO: 357508

SEQ ID NO: 626112 - RNA, 64 nt, Homo Sapiens; identical to SEQ ID NO: 357509

SEQ ID NO: 626113 - RNA, 64 nt, Homo Sapiens; identical to SEQ ID NO: 357510

SEQ ID NO: 626114 - RNA, 64 nt, Homo Sapiens; identical to SEQ ID NO: 357511

SEQ ID NO: 626115 - RNA, 64 nt, Homo Sapiens; identical to SEQ ID NO: 357512

SEQ ID NO: 626116 - RNA, 64 nt, Homo Sapiens; identical to SEQ ID NO: 357513

SEQ ID NO: 626117 - RNA, 64 nt, Homo Sapiens; identical to SEQ ID NO: 357514

SEQ ID NO: 626118 - RNA, 64 nt, Homo Sapiens; identical to SEQ ID NO: 357515

SEQ ID NO: 626119 - RNA, 64 nt, Homo Sapiens; identical to SEQ ID NO: 357516

SEQ ID NO: 626120 - RNA, 64 nt, Homo Sapiens; identical to SEQ ID NO: 357517

SEQ ID NO: 626121 - RNA, 64 nt, Homo Sapiens; identical to SEQ ID NO: 357518

SEQ ID NO: 626122 - RNA, 64 nt, Homo Sapiens; identical to SEQ ID NO: 357519

SEQ ID NO: 626123 - RNA, 64 nt, Homo Sapiens; identical to SEQ ID NO: 357520

SEQ ID NO: 626124 - RNA, 64 nt, Homo Sapiens; identical to SEQ ID NO: 357521

SEQ ID NO: 626125 - RNA, 64 nt, Homo Sapiens; identical to SEQ ID NO: 357522

SEQ ID NO: 626126 - RNA, 64 nt, Homo Sapiens; identical to SEQ ID NO: 357523

SEQ ID NO: 626127 - RNA, 64 nt, Homo Sapiens; identical to SEQ ID NO: 357524

SEQ ID NO: 626128 - RNA, 64 nt, Homo Sapiens; identical to SEQ ID NO: 357525

SEQ ID NO: 626129 - RNA, 64 nt, Homo Sapiens; identical to SEQ ID NO: 357526

SEQ ID NO: 626130 - RNA, 64 nt, Homo Sapiens; identical to SEQ ID NO: 357527

SEQ ID NO: 626131 - RNA, 64 nt, Homo Sapiens; identical to SEQ ID NO: 357528

SEQ ID NO: 626132 - RNA, 64 nt, Homo Sapiens; identical to SEQ ID NO: 357529

SEQ ID NO: 626133 - RNA, 64 nt, Homo Sapiens; identical to SEQ ID NO: 357530

SEQ ID NO: 626134 - RNA, 64 nt, Homo Sapiens; identical to SEQ ID NO: 357531

SEQ ID NO: 626135 - RNA, 64 nt, Homo Sapiens; identical to SEQ ID NO: 357532

SEQ ID NO: 626136 - RNA, 64 nt, Homo Sapiens; identical to SEQ ID NO: 357533

SEQ ID NO: 626137 - RNA, 64 nt, Homo Sapiens; identical to SEQ ID NO: 357534

SEQ ID NO: 626138 - RNA, 64 nt, Homo Sapiens; identical to SEQ ID NO: 357535

SEQ ID NO: 626139 - RNA, 64 nt, Homo Sapiens; identical to SEQ ID NO: 357536

SEQ ID NO: 626140 - RNA, 64 nt, Homo Sapiens; identical to SEQ ID NO: 357537

SEQ ID NO: 626141 - RNA, 64 nt, Homo Sapiens; identical to SEQ ID NO: 357538

SEQ ID NO: 626142 - RNA, 64 nt, Homo Sapiens; identical to SEQ ID NO: 357539

SEQ ID NO: 626143 - RNA, 64 nt, Homo Sapiens; identical to SEQ ID NO: 357540

SEQ ID NO: 626144 - RNA, 64 nt, Homo Sapiens; identical to SEQ ID NO: 357541

SEQ ID NO: 626145 - RNA, 64 nt, Homo Sapiens; identical to SEQ ID NO: 357542

SEQ ID NO: 626146 - RNA, 64 nt, Homo Sapiens; identical to SEQ ID NO: 357543

SEQ ID NO: 626147 - RNA, 64 nt, Homo Sapiens; identical to SEQ ID NO: 357544

SEQ ID NO: 626148 - RNA, 64 nt, Homo Sapiens; identical to SEQ ID NO: 357545

SEQ ID NO: 626149 - RNA, 64 nt, Homo Sapiens; identical to SEQ ID NO: 357546

SEQ ID NO: 626150 - RNA, 64 nt, Homo Sapiens; identical to SEQ ID NO: 357547

SEQ ID NO: 626151 - RNA, 64 nt, Homo Sapiens; identical to SEQ ID NO: 357548

SEQ ID NO: 626152 - RNA, 64 nt, Homo Sapiens; identical to SEQ ID NO: 357549

SEQ ID NO: 626153 - RNA, 64 nt, Homo Sapiens; identical to SEQ ID NO: 357550

SEQ ID NO: 626154 - RNA, 64 nt, Homo Sapiens; identical to SEQ ID NO: 357551

SEQ ID NO: 626155 - RNA, 64 nt, Homo Sapiens; identical to SEQ ID NO: 357552

SEQ ID NO: 626156 - RNA, 64 nt, Homo Sapiens; identical to SEQ ID NO: 357553

SEQ ID NO: 626157 - RNA, 64 nt, Homo Sapiens; identical to SEQ ID NO: 357554

SEQ ID NO: 626158 - RNA, 64 nt, Homo Sapiens; identical to SEQ ID NO: 357555

SEQ ID NO: 626159 - RNA, 64 nt, Homo Sapiens; identical to SEQ ID NO: 357556

SEQ ID NO: 626160 - RNA, 64 nt, Homo Sapiens; identical to SEQ ID NO: 357557

SEQ ID NO: 626161 - RNA, 64 nt, Homo Sapiens; identical to SEQ ID NO: 357558

SEQ ID NO: 626162 - RNA, 64 nt, Homo Sapiens; identical to SEQ ID NO: 357559

SEQ ID NO: 626163 - RNA, 64 nt, Homo Sapiens; identical to SEQ ID NO: 357560

SEQ ID NO: 626164 - RNA, 64 nt, Homo Sapiens; identical to SEQ ID NO: 357561

SEQ ID NO: 626165 - RNA, 64 nt, Homo Sapiens; identical to SEQ ID NO: 357562

SEQ ID NO: 626166 - RNA, 64 nt, Homo Sapiens; identical to SEQ ID NO: 357563

SEQ ID NO: 626167 - RNA, 64 nt, Homo Sapiens; identical to SEQ ID NO: 357564

SEQ ID NO: 626168 - RNA, 64 nt, Homo Sapiens; identical to SEQ ID NO: 357565

SEQ ID NO: 626169 - RNA, 64 nt, Homo Sapiens; identical to SEQ ID NO: 357566

SEQ ID NO: 626170 - RNA, 64 nt, Homo Sapiens; identical to SEQ ID NO: 357567

SEQ ID NO: 626171 - RNA, 64 nt, Homo Sapiens; identical to SEQ ID NO: 357568

SEQ ID NO: 626172 - RNA, 64 nt, Homo Sapiens; identical to SEQ ID NO: 357569

SEQ ID NO: 626173 - RNA, 64 nt, Homo Sapiens; identical to SEQ ID NO: 357570

SEQ ID NO: 626174 - RNA, 64 nt, Homo Sapiens; identical to SEQ ID NO: 357571

SEQ ID NO: 626175 - RNA, 64 nt, Homo Sapiens; identical to SEQ ID NO: 357572

SEQ ID NO: 626176 - RNA, 64 nt, Homo Sapiens; identical to SEQ ID NO: 357573

SEQ ID NO: 626177 - RNA, 64 nt, Homo Sapiens; identical to SEQ ID NO: 357574

SEQ ID NO: 626178 - RNA, 64 nt, Homo Sapiens; identical to SEQ ID NO: 357575

SEQ ID NO: 626179 - RNA, 64 nt, Homo Sapiens; identical to SEQ ID NO: 357576

SEQ ID NO: 626180 - RNA, 64 nt, Homo Sapiens; identical to SEQ ID NO: 357577

SEQ ID NO: 626181 - RNA, 64 nt, Homo Sapiens; identical to SEQ ID NO: 357578

SEQ ID NO: 626182 - RNA, 64 nt, Homo Sapiens; identical to SEQ ID NO: 357579

SEQ ID NO: 626183 - RNA, 64 nt, Homo Sapiens; identical to SEQ ID NO: 357580

SEQ ID NO: 626184 - RNA, 64 nt, Homo Sapiens; identical to SEQ ID NO: 357581

SEQ ID NO: 626185 - RNA, 64 nt, Homo Sapiens; identical to SEQ ID NO: 357582

SEQ ID NO: 626186 - RNA, 64 nt, Homo Sapiens; identical to SEQ ID NO: 357583

SEQ ID NO: 626187 - RNA, 64 nt, Homo Sapiens; identical to SEQ ID NO: 357584

SEQ ID NO: 626188 - RNA, 64 nt, Homo Sapiens; identical to SEQ ID NO: 357585

SEQ ID NO: 626189 - RNA, 64 nt, Homo Sapiens; identical to SEQ ID NO: 357586

SEQ ID NO: 626190 - RNA, 64 nt, Homo Sapiens; identical to SEQ ID NO: 357587

SEQ ID NO: 626191 - RNA, 64 nt, Homo Sapiens; identical to SEQ ID NO: 357588

SEQ ID NO: 626192 - RNA, 64 nt, Homo Sapiens; identical to SEQ ID NO: 357589

SEQ ID NO: 626193 - RNA, 64 nt, Homo Sapiens; identical to SEQ ID NO: 357590

SEQ ID NO: 626194 - RNA, 64 nt, Homo Sapiens; identical to SEQ ID NO: 357591

SEQ ID NO: 626195 - RNA, 64 nt, Homo Sapiens; identical to SEQ ID NO: 357592

SEQ ID NO: 626196 - RNA, 64 nt, Homo Sapiens; identical to SEQ ID NO: 357593

SEQ ID NO: 626197 - RNA, 64 nt, Homo Sapiens; identical to SEQ ID NO: 357594

SEQ ID NO: 626198 - RNA, 64 nt, Homo Sapiens; identical to SEQ ID NO: 357595

SEQ ID NO: 626199 - RNA, 64 nt, Homo Sapiens; identical to SEQ ID NO: 357596

SEQ ID NO: 626200 - RNA, 64 nt, Homo Sapiens; identical to SEQ ID NO: 357597

SEQ ID NO: 626201 - RNA, 64 nt, Homo Sapiens; identical to SEQ ID NO: 357598

SEQ ID NO: 626202 - RNA, 64 nt, Homo Sapiens; identical to SEQ ID NO: 357599

SEQ ID NO: 626203 - RNA, 64 nt, Homo Sapiens; identical to SEQ ID NO: 357600

SEQ ID NO: 626204 - RNA, 64 nt, Homo Sapiens; identical to SEQ ID NO: 357601

SEQ ID NO: 626205 - RNA, 64 nt, Homo Sapiens; identical to SEQ ID NO: 357602

SEQ ID NO: 626206 - RNA, 64 nt, Homo Sapiens; identical to SEQ ID NO: 357603

SEQ ID NO: 626207 - RNA, 64 nt, Homo Sapiens; identical to SEQ ID NO: 357604

SEQ ID NO: 626208 - RNA, 64 nt, Homo Sapiens; identical to SEQ ID NO: 357605

SEQ ID NO: 626209 - RNA, 64 nt, Homo Sapiens; identical to SEQ ID NO: 357606

SEQ ID NO: 626210 - RNA, 64 nt, Homo Sapiens; identical to SEQ ID NO: 357607

SEQ ID NO: 626211 - RNA, 64 nt, Homo Sapiens; identical to SEQ ID NO: 357608

SEQ ID NO: 626212 - RNA, 64 nt, Homo Sapiens; identical to SEQ ID NO: 357609

SEQ ID NO: 626213 - RNA, 64 nt, Homo Sapiens; identical to SEQ ID NO: 357610

SEQ ID NO: 626214 - RNA, 64 nt, Homo Sapiens; identical to SEQ ID NO: 357611

SEQ ID NO: 626215 - RNA, 64 nt, Homo Sapiens; identical to SEQ ID NO: 357612

SEQ ID NO: 626216 - RNA, 64 nt, Homo Sapiens; identical to SEQ ID NO: 357613

SEQ ID NO: 626217 - RNA, 64 nt, Homo Sapiens; identical to SEQ ID NO: 357614

SEQ ID NO: 626218 - RNA, 64 nt, Homo Sapiens; identical to SEQ ID NO: 357615

SEQ ID NO: 626219 - RNA, 64 nt, Homo Sapiens; identical to SEQ ID NO: 357616

SEQ ID NO: 626220 - RNA, 64 nt, Homo Sapiens; identical to SEQ ID NO: 357617

SEQ ID NO: 626221 - RNA, 64 nt, Homo Sapiens; identical to SEQ ID NO: 357618

SEQ ID NO: 626222 - RNA, 64 nt, Homo Sapiens; identical to SEQ ID NO: 357619

SEQ ID NO: 626223 - RNA, 64 nt, Homo Sapiens; identical to SEQ ID NO: 175850

SEQ ID NO: 626224 - RNA, 64 nt, Homo Sapiens; identical to SEQ ID NO: 175851

SEQ ID NO: 626225 - RNA, 64 nt, Homo Sapiens; identical to SEQ ID NO: 175852

SEQ ID NO: 626226 - RNA, 64 nt, Homo Sapiens; identical to SEQ ID NO: 175853

SEQ ID NO: 626227 - RNA, 64 nt, Homo Sapiens; identical to SEQ ID NO: 175854

SEQ ID NO: 626228 - RNA, 64 nt, Homo Sapiens; identical to SEQ ID NO: 175855

SEQ ID NO: 626229 - RNA, 64 nt, Homo Sapiens; identical to SEQ ID NO: 175856

SEQ ID NO: 626230 - RNA, 64 nt, Homo Sapiens; identical to SEQ ID NO: 175857

SEQ ID NO: 626231 - RNA, 64 nt, Homo Sapiens; identical to SEQ ID NO: 175858

SEQ ID NO: 626232 - RNA, 64 nt, Homo Sapiens; identical to SEQ ID NO: 175859

SEQ ID NO: 626233 - RNA, 64 nt, Homo Sapiens; identical to SEQ ID NO: 175860

SEQ ID NO: 626234 - RNA, 64 nt, Homo Sapiens; identical to SEQ ID NO: 175861

SEQ ID NO: 626235 - RNA, 64 nt, Homo Sapiens; identical to SEQ ID NO: 175862

SEQ ID NO: 626236 - RNA, 64 nt, Homo Sapiens; identical to SEQ ID NO: 175863

SEQ ID NO: 626237 - RNA, 64 nt, Homo Sapiens
ugauauuguugucuguggcauauucuuuguauggcgaauuuaauaaauuauauuaaugugucuc

SEQ ID NO: 626238 - RNA, 64 nt, Homo Sapiens
aaaauaugggaaaggcacaauuuaaaauaaaacacgaauuuaauugauaauguugcuguaauuu

SEQ ID NO: 626239 - RNA, 64 nt, Homo Sapiens
uuaguuuuuuucauacccuuaacgaaggaaguaucgaauuuacacagaaagucuauuucuuuga

SEQ ID NO: 626240 - RNA, 64 nt, Homo Sapiens
gcuuuuuccaggacaauucuagcugaggagaggucgaauuuacuaguuucuaugaagagcaagu

SEQ ID NO: 626241 - RNA, 64 nt, Homo Sapiens
ccggguccagcugcgucagcccugcuccgugaggcgaauuuacaugaacacagugccuggacuc

SEQ ID NO: 626242 - RNA, 64 nt, Homo Sapiens
ugauuuuucucuuccuuuuuauucacucuucccacgaauuuaaauguuuaaguuauauucauca

SEQ ID NO: 626243 - RNA, 64 nt, Homo Sapiens
accucagcauugcaucguaucaucauuuucgcuacgaauuuauuuuucaacaauaagcuuuaac

SEQ ID NO: 626244 - RNA, 64 nt, Homo Sapiens
ugugaugucuuuguauauaucauagauguacacacgaauuuaaagcaguuacuguuguacauug

SEQ ID NO: 626245 - RNA, 64 nt, Homo Sapiens
ucaugcauuggucuuagaggacuagacauaguaccgaauuuaguugacguagcgaguuagugag

SEQ ID NO: 626246 - RNA, 64 nt, Homo Sapiens
uaaaccgguucguauauauuuuucuucgcuguuacgaauuuacagcagcauuuguacauguaaa

SEQ ID NO: 626247 - RNA, 64 nt, Homo Sapiens
gaggaagaagggauaauagacacaucaaaugccccgaauuuagucacaccaucuuaaaugacag

SEQ ID NO: 626248 - RNA, 64 nt, Homo Sapiens
uuuugugcuggguggacauuugugguuucauuagcgaauuuauucugaggugacuuccuaacua

SEQ ID NO: 626249 - RNA, 64 nt, Homo Sapiens
uacaagcuuuaaaaccaguuauguugaaaauacacgaauuuagaacuucaugaucacuaaauag

SEQ ID NO: 626250 - RNA, 64 nt, Homo Sapiens
guaguucaccgcuggucaguguuaguugugucuucgaauuuauuccaggccuuccuaaguuuuu

SEQ ID NO: 626251 - RNA, 64 nt, Homo Sapiens
aaauuacaaacuuuaggaacuuuuccagauguaucgaauuuaauuugacauugaugucacucuu

SEQ ID NO: 626252 - RNA, 55 nt, Homo Sapiens
gagauucucugagugccugacaaaacgaauuuaaguaccagccaaguacacacga

SEQ ID NO: 626253 - RNA, 64 nt, Homo Sapiens
cucuuccuauaaacuaaaauaacauuacaguuuccgaauuuagcaugggacauagucaguguuu

SEQ ID NO: 626254 - RNA, 64 nt, Homo Sapiens
gaacccuauuugaauugcaguuaagaggagaugccgaauuuaaugaguaaacaacccagcccag

SEQ ID NO: 626255 - RNA, 64 nt, Homo Sapiens
accucagcccuaucuccauuccacccuuuuggagcgaauuuagagggcucaaagacgcacucuu

SEQ ID NO: 626256 - RNA, 64 nt, Homo Sapiens
accauagucccaagaauucagcuacaugaugacucgaauuuaaauuuagauuaaucaaaugguc

SEQ ID NO: 626257 - RNA, 64 nt, Homo Sapiens
gaaagccacagaggugcaacguggcuguaggacucgaauuuacagggauugcagcguucucgaa

SEQ ID NO: 626258 - RNA, 64 nt, Homo Sapiens
cuacaacugguaacaaugaccaccacuauuccagcgaauuuaugcguuccaagucuuaaugcca

SEQ ID NO: 626259 - RNA, 64 nt, Homo Sapiens
ugucagacaguuaguguaggaguuuuuuguaacacgaauuuaaccaaaaauaaaucuuaaaguu

SEQ ID NO: 626260 - RNA, 64 nt, Homo Sapiens
ucuucauuuuuuuccccauugugauguuugguaacgaauuuaaaauguaguuuuaaauaaaguu

SEQ ID NO: 626261 - RNA, 64 nt, Homo Sapiens
cuggagcccguucccgugcguguuaguuuggacacgaauuuagucuaaaaagcugucugguugu

SEQ ID NO: 626262 - RNA, 64 nt, Homo Sapiens
gaaauagaaaaguuguaacugggccaaaauguuucgaauuuauauuaacguuuauaguugaauu

SEQ ID NO: 626263 - RNA, 64 nt, Homo Sapiens
acaaaaaggagggacuuuaaacugcagcagaaaucgaauuuaaagcacagcaaacauuuugcaa

SEQ ID NO: 626264 - RNA, 64 nt, Homo Sapiens
aguucccuuaaaaagaaacauuaaaagcaagagccgaauuuagaucaggggcauuuuggugcug

SEQ ID NO: 626265 - RNA, 64 nt, Homo Sapiens
uccacuguuucuuuccuucucugucuucuuagcucgaauuuaaauugcacaauuauuuucaggu

SEQ ID NO: 626266 - RNA, 64 nt, Homo Sapiens
ccccacuacucaauacuaccucugaauguuacaacgaauuuacagucuaguacuuauuacaugc

SEQ ID NO: 626267 - RNA, 64 nt, Homo Sapiens
aguugaguuagguuuuuccccaucuccuguagagcgaauuuacauauuguauuggguaaguguu

SEQ ID NO: 626268 - RNA, 64 nt, Homo Sapiens
auaaguucauauauuugaaauaagauccuggaaacgaauuuaaauggugucaaacugcagagca

SEQ ID NO: 626269 - RNA, 64 nt, Homo Sapiens
uuuuuuauaacauagugcaacuauuggcauguaacgaauuuaaacauaauucuugaauucucua

SEQ ID NO: 626270 - RNA, 64 nt, Homo Sapiens
aaacuuuugacaaaacuuagacugucgaauguugcgaauuuauugcgggggcgagggagggcga

SEQ ID NO: 626271 - RNA, 64 nt, Homo Sapiens
gguaccaaagcucucuuuggccgauucccuaauucgaauuuauuuaauucuacaucuaaaaaaa

SEQ ID NO: 626272 - RNA, 64 nt, Homo Sapiens
uuccuuucccucauucugcauucaauuauaagaucgaauuuaauaacucaucaaguguuggacu

SEQ ID NO: 626273 - RNA, 64 nt, Homo Sapiens
ugcuggucauuuucuggagaccucaagucaugcccgaauuuagauauccccaaagcuuuugggu

SEQ ID NO: 626274 - RNA, 64 nt, Homo Sapiens
aaaggaagccuaccuuauguugaaauacagaauacgaauuuaauuucuaaaauugagaaauauc

SEQ ID NO: 626275 - RNA, 64 nt, Homo Sapiens
uaaugagacuggauuuuuguuucagauuuuaauccgaauuuagcuggcaacuccauaaaaacau

SEQ ID NO: 626276 - RNA, 64 nt, Homo Sapiens
auuguuuaucuuggucuuuuugccauuuucucugcgaauuuaguaguuuccuuggcccagucug

SEQ ID NO: 626277 - RNA, 64 nt, Homo Sapiens
uucuauguuuaagguuuugguuguugguaguagccgaauuuaacuggcacuuuauuuuacuucu

SEQ ID NO: 626278 - RNA, 64 nt, Homo Sapiens
aagcuaaugacaauuuugagaugaaaauauuuaacgaauuuaaaaagaaaccauuuuuaaugag

SEQ ID NO: 626279 - RNA, 64 nt, Homo Sapiens
uguauuccuaacuguuuuguucuacacugguugccgaauuuacugaguagcucguccucacugg

SEQ ID NO: 626280 - RNA, 64 nt, Homo Sapiens
cucagaagcaucgcuccucuaucacaggaucccacgaauuuaggacuccccaacucccucguua

SEQ ID NO: 626281 - RNA, 64 nt, Homo Sapiens
ggcuuagggaaguccaguaaagaaaccuauuuuccgaauuuauuugaucaugaacuccuuuuuu

SEQ ID NO: 626282 - RNA, 64 nt, Homo Sapiens
ccaagaaucuacaaugacauggaagauaugggagcgaauuuauuuaaaagaagaaacaaagagg

SEQ ID NO: 626283 - RNA, 64 nt, Homo Sapiens
ucuaaaaaugcuccuacuuucuaaaauauaccagcgaauuuaaauuuaaaugaaaauguguaau

SEQ ID NO: 626284 - RNA, 64 nt, Homo Sapiens
cuuuaaaagaagaaacauggagaagaugugggagcgaauuuauugcaggaauccacaaugacuu

SEQ ID NO: 626285 - RNA, 64 nt, Homo Sapiens; identical to SEQ ID NO: 218812

SEQ ID NO: 626286 - RNA, 64 nt, Homo Sapiens; identical to SEQ ID NO: 218813

SEQ ID NO: 626287 - RNA, 64 nt, Homo Sapiens; identical to SEQ ID NO: 218814

SEQ ID NO: 626288 - RNA, 64 nt, Homo Sapiens; identical to SEQ ID NO: 218815

SEQ ID NO: 626289 - RNA, 64 nt, Homo Sapiens; identical to SEQ ID NO: 218816

SEQ ID NO: 626290 - RNA, 64 nt, Homo Sapiens; identical to SEQ ID NO: 218817

SEQ ID NO: 626291 - RNA, 64 nt, Homo Sapiens; identical to SEQ ID NO: 218818

SEQ ID NO: 626292 - RNA, 64 nt, Homo Sapiens; identical to SEQ ID NO: 218819

SEQ ID NO: 626293 - RNA, 64 nt, Homo Sapiens; identical to SEQ ID NO: 218820

SEQ ID NO: 626294 - RNA, 64 nt, Homo Sapiens; identical to SEQ ID NO: 218821

SEQ ID NO: 626295 - RNA, 64 nt, Homo Sapiens; identical to SEQ ID NO: 218822

SEQ ID NO: 626296 - RNA, 64 nt, Homo Sapiens; identical to SEQ ID NO: 218823

SEQ ID NO: 626297 - RNA, 64 nt, Homo Sapiens; identical to SEQ ID NO: 218824

SEQ ID NO: 626298 - RNA, 64 nt, Homo Sapiens; identical to SEQ ID NO: 218825

SEQ ID NO: 626299 - RNA, 64 nt, Homo Sapiens; identical to SEQ ID NO: 218826

SEQ ID NO: 626300 - RNA, 64 nt, Homo Sapiens; identical to SEQ ID NO: 218827

SEQ ID NO: 626301 - RNA, 64 nt, Homo Sapiens; identical to SEQ ID NO: 218828

SEQ ID NO: 626302 - RNA, 64 nt, Homo Sapiens; identical to SEQ ID NO: 218829

SEQ ID NO: 626303 - RNA, 64 nt, Homo Sapiens; identical to SEQ ID NO: 218830

SEQ ID NO: 626304 - RNA, 64 nt, Homo Sapiens; identical to SEQ ID NO: 218831

SEQ ID NO: 626305 - RNA, 64 nt, Homo Sapiens; identical to SEQ ID NO: 218832

SEQ ID NO: 626306 - RNA, 64 nt, Homo Sapiens; identical to SEQ ID NO: 218833

SEQ ID NO: 626307 - RNA, 64 nt, Homo Sapiens; identical to SEQ ID NO: 218834

SEQ ID NO: 626308 - RNA, 64 nt, Homo Sapiens; identical to SEQ ID NO: 218835

SEQ ID NO: 626309 - RNA, 64 nt, Homo Sapiens; identical to SEQ ID NO: 218836

SEQ ID NO: 626310 - RNA, 64 nt, Homo Sapiens; identical to SEQ ID NO: 86125

SEQ ID NO: 626311 - RNA, 64 nt, Homo Sapiens; identical to SEQ ID NO: 86126

SEQ ID NO: 626312 - RNA, 64 nt, Homo Sapiens; identical to SEQ ID NO: 86127

SEQ ID NO: 626313 - RNA, 64 nt, Homo Sapiens; identical to SEQ ID NO: 86128

SEQ ID NO: 626314 - RNA, 58 nt, Homo Sapiens; identical to SEQ ID NO: 86129

SEQ ID NO: 626315 - RNA, 64 nt, Homo Sapiens; identical to SEQ ID NO: 86130

SEQ ID NO: 626316 - RNA, 64 nt, Homo Sapiens; identical to SEQ ID NO: 86131

SEQ ID NO: 626317 - RNA, 64 nt, Homo Sapiens; identical to SEQ ID NO: 86132

SEQ ID NO: 626318 - RNA, 64 nt, Homo Sapiens; identical to SEQ ID NO: 86133

SEQ ID NO: 626319 - RNA, 64 nt, Homo Sapiens; identical to SEQ ID NO: 86134

SEQ ID NO: 626320 - RNA, 64 nt, Homo Sapiens; identical to SEQ ID NO: 86135

SEQ ID NO: 626321 - RNA, 64 nt, Homo Sapiens; identical to SEQ ID NO: 86136

SEQ ID NO: 626322 - RNA, 64 nt, Homo Sapiens; identical to SEQ ID NO: 86137

SEQ ID NO: 626323 - RNA, 64 nt, Homo Sapiens; identical to SEQ ID NO: 86138

SEQ ID NO: 626324 - RNA, 64 nt, Homo Sapiens; identical to SEQ ID NO: 86139

SEQ ID NO: 626325 - RNA, 64 nt, Homo Sapiens; identical to SEQ ID NO: 86140

SEQ ID NO: 626326 - RNA, 64 nt, Homo Sapiens; identical to SEQ ID NO: 86141

SEQ ID NO: 626327 - RNA, 64 nt, Homo Sapiens; identical to SEQ ID NO: 86142

SEQ ID NO: 626328 - RNA, 64 nt, Homo Sapiens; identical to SEQ ID NO: 86143

SEQ ID NO: 626329 - RNA, 64 nt, Homo Sapiens; identical to SEQ ID NO: 86144

SEQ ID NO: 626330 - RNA, 64 nt, Homo Sapiens; identical to SEQ ID NO: 86145

SEQ ID NO: 626331 - RNA, 64 nt, Homo Sapiens; identical to SEQ ID NO: 86146

SEQ ID NO: 626332 - RNA, 64 nt, Homo Sapiens; identical to SEQ ID NO: 86147

SEQ ID NO: 626333 - RNA, 64 nt, Homo Sapiens; identical to SEQ ID NO: 86148

SEQ ID NO: 626334 - RNA, 64 nt, Homo Sapiens; identical to SEQ ID NO: 86149

SEQ ID NO: 626335 - RNA, 64 nt, Homo Sapiens; identical to SEQ ID NO: 86150

SEQ ID NO: 626336 - RNA, 64 nt, Homo Sapiens; identical to SEQ ID NO: 86151

SEQ ID NO: 626337 - RNA, 64 nt, Homo Sapiens; identical to SEQ ID NO: 86152

SEQ ID NO: 626338 - RNA, 64 nt, Homo Sapiens; identical to SEQ ID NO: 86153

SEQ ID NO: 626339 - RNA, 64 nt, Homo Sapiens; identical to SEQ ID NO: 86154

SEQ ID NO: 626340 - RNA, 64 nt, Homo Sapiens; identical to SEQ ID NO: 86155

SEQ ID NO: 626341 - RNA, 64 nt, Homo Sapiens; identical to SEQ ID NO: 86156

SEQ ID NO: 626342 - RNA, 64 nt, Homo Sapiens; identical to SEQ ID NO: 86157

SEQ ID NO: 626343 - RNA, 64 nt, Homo Sapiens; identical to SEQ ID NO: 86158

SEQ ID NO: 626344 - RNA, 64 nt, Homo Sapiens; identical to SEQ ID NO: 86159

SEQ ID NO: 626345 - RNA, 64 nt, Homo Sapiens; identical to SEQ ID NO: 86160

SEQ ID NO: 626346 - RNA, 64 nt, Homo Sapiens; identical to SEQ ID NO: 86161

SEQ ID NO: 626347 - RNA, 64 nt, Homo Sapiens; identical to SEQ ID NO: 86162

SEQ ID NO: 626348 - RNA, 64 nt, Homo Sapiens; identical to SEQ ID NO: 86163

SEQ ID NO: 626349 - RNA, 60 nt, Homo Sapiens; identical to SEQ ID NO: 86164

SEQ ID NO: 626350 - RNA, 64 nt, Homo Sapiens; identical to SEQ ID NO: 86165

SEQ ID NO: 626351 - RNA, 64 nt, Homo Sapiens; identical to SEQ ID NO: 86166

SEQ ID NO: 626352 - RNA, 64 nt, Homo Sapiens; identical to SEQ ID NO: 86167

SEQ ID NO: 626353 - RNA, 64 nt, Homo Sapiens; identical to SEQ ID NO: 86168

SEQ ID NO: 626354 - RNA, 64 nt, Homo Sapiens; identical to SEQ ID NO: 86169

SEQ ID NO: 626355 - RNA, 64 nt, Homo Sapiens; identical to SEQ ID NO: 86170

SEQ ID NO: 626356 - RNA, 64 nt, Homo Sapiens; identical to SEQ ID NO: 86171

SEQ ID NO: 626357 - RNA, 64 nt, Homo Sapiens; identical to SEQ ID NO: 86172

SEQ ID NO: 626358 - RNA, 64 nt, Homo Sapiens; identical to SEQ ID NO: 86173

SEQ ID NO: 626359 - RNA, 64 nt, Homo Sapiens; identical to SEQ ID NO: 86174

SEQ ID NO: 626360 - RNA, 64 nt, Homo Sapiens; identical to SEQ ID NO: 86175

SEQ ID NO: 626361 - RNA, 64 nt, Homo Sapiens; identical to SEQ ID NO: 86176

SEQ ID NO: 626362 - RNA, 64 nt, Homo Sapiens; identical to SEQ ID NO: 86177

SEQ ID NO: 626363 - RNA, 64 nt, Homo Sapiens; identical to SEQ ID NO: 86178

SEQ ID NO: 626364 - RNA, 64 nt, Homo Sapiens; identical to SEQ ID NO: 86179

SEQ ID NO: 626365 - RNA, 64 nt, Homo Sapiens; identical to SEQ ID NO: 86180

SEQ ID NO: 626366 - RNA, 64 nt, Homo Sapiens; identical to SEQ ID NO: 86181

SEQ ID NO: 626367 - RNA, 64 nt, Homo Sapiens; identical to SEQ ID NO: 86182

SEQ ID NO: 626368 - RNA, 64 nt, Homo Sapiens; identical to SEQ ID NO: 86183

SEQ ID NO: 626369 - RNA, 64 nt, Homo Sapiens; identical to SEQ ID NO: 86184

SEQ ID NO: 626370 - RNA, 64 nt, Homo Sapiens; identical to SEQ ID NO: 86185

SEQ ID NO: 626371 - RNA, 64 nt, Homo Sapiens; identical to SEQ ID NO: 86186

SEQ ID NO: 626372 - RNA, 64 nt, Homo Sapiens; identical to SEQ ID NO: 432758

SEQ ID NO: 626373 - RNA, 64 nt, Homo Sapiens; identical to SEQ ID NO: 432759

SEQ ID NO: 626374 - RNA, 64 nt, Homo Sapiens; identical to SEQ ID NO: 432760

SEQ ID NO: 626375 - RNA, 64 nt, Homo Sapiens; identical to SEQ ID NO: 432761

SEQ ID NO: 626376 - RNA, 64 nt, Homo Sapiens; identical to SEQ ID NO: 166002

SEQ ID NO: 626377 - RNA, 64 nt, Homo Sapiens; identical to SEQ ID NO: 166003

SEQ ID NO: 626378 - RNA, 64 nt, Homo Sapiens; identical to SEQ ID NO: 166004

SEQ ID NO: 626379 - RNA, 64 nt, Homo Sapiens; identical to SEQ ID NO: 166005

SEQ ID NO: 626380 - RNA, 64 nt, Homo Sapiens; identical to SEQ ID NO: 166006

SEQ ID NO: 626381 - RNA, 64 nt, Homo Sapiens; identical to SEQ ID NO: 166007

SEQ ID NO: 626382 - RNA, 64 nt, Homo Sapiens; identical to SEQ ID NO: 166008

SEQ ID NO: 626383 - RNA, 64 nt, Homo Sapiens; identical to SEQ ID NO: 166009

SEQ ID NO: 626384 - RNA, 64 nt, Homo Sapiens; identical to SEQ ID NO: 166010

SEQ ID NO: 626385 - RNA, 60 nt, Homo Sapiens; identical to SEQ ID NO: 166011

SEQ ID NO: 626386 - RNA, 64 nt, Homo Sapiens; identical to SEQ ID NO: 166012

SEQ ID NO: 626387 - RNA, 64 nt, Homo Sapiens; identical to SEQ ID NO: 154391

SEQ ID NO: 626388 - RNA, 64 nt, Homo Sapiens; identical to SEQ ID NO: 154392

SEQ ID NO: 626389 - RNA, 64 nt, Homo Sapiens; identical to SEQ ID NO: 154393

SEQ ID NO: 626390 - RNA, 64 nt, Homo Sapiens; identical to SEQ ID NO: 154394

SEQ ID NO: 626391 - RNA, 64 nt, Homo Sapiens; identical to SEQ ID NO: 154395

SEQ ID NO: 626392 - RNA, 64 nt, Homo Sapiens; identical to SEQ ID NO: 154396

SEQ ID NO: 626393 - RNA, 64 nt, Homo Sapiens; identical to SEQ ID NO: 154397

SEQ ID NO: 626394 - RNA, 64 nt, Homo Sapiens; identical to SEQ ID NO: 154398

SEQ ID NO: 626395 - RNA, 64 nt, Homo Sapiens; identical to SEQ ID NO: 154399

SEQ ID NO: 626396 - RNA, 64 nt, Homo Sapiens; identical to SEQ ID NO: 154400

SEQ ID NO: 626397 - RNA, 64 nt, Homo Sapiens; identical to SEQ ID NO: 154401

SEQ ID NO: 626398 - RNA, 64 nt, Homo Sapiens; identical to SEQ ID NO: 154402

SEQ ID NO: 626399 - RNA, 64 nt, Homo Sapiens; identical to SEQ ID NO: 154403

SEQ ID NO: 626400 - RNA, 64 nt, Homo Sapiens
acuauauagccgagcuguucuuccuuccuauggaagucggaaacauggucagaacacgaucugg

SEQ ID NO: 626401 - RNA, 64 nt, Homo Sapiens
agaacaucacuuuuaaccuugcuuuggcgaagggagucggaaagcugagucucuauggacgggg

SEQ ID NO: 626402 - RNA, 64 nt, Homo Sapiens
gcugagaacaaaaucaccuauucacugcuuaugcagucggaagcuccagaagaacaaagagccc

SEQ ID NO: 626403 - RNA, 64 nt, Homo Sapiens
auugccuguugauauauuaauaguguuccucaaaagucggaacaggugcuuuuggaagcagugu

SEQ ID NO: 626404 - RNA, 64 nt, Homo Sapiens
caagaucagauccuggaggacgcucgcacuggucagucggaagggacccaagagaagcagaagu

SEQ ID NO: 626405 - RNA, 64 nt, Homo Sapiens
gugaaugacaggaaugaucuauuaccaggugacuagucggaaacuacacagacgugcacugguc

SEQ ID NO: 626406 - RNA, 64 nt, Homo Sapiens
caucuuggguucuucucaauuugacauacuugggagucggaaugacuggaugggggauggguag

SEQ ID NO: 626407 - RNA, 64 nt, Homo Sapiens
cagcuggaagugccuuguugccucugcccuuugaagucggaacaauuccuagcaccugucggaa

SEQ ID NO: 626408 - RNA, 64 nt, Homo Sapiens
accaccugaucacaacuuucaaaaaaaaaaaaaaagucggaaaagaaugaaggguucugcugcu

SEQ ID NO: 626409 - RNA, 64 nt, Homo Sapiens
uauucuagggaaaugcuuuaaauggucaggcuccagucggaauuuuuuuaagaaaaaaguaguu

SEQ ID NO: 626410 - RNA, 64 nt, Homo Sapiens
acugaguugauucugaccagacuugaugguuuuaagucggaaccgauaaauuuuaaaaaggaga

SEQ ID NO: 626411 - RNA, 64 nt, Homo Sapiens
ucccggggacgacgcugacucccagacgcagcugagucggaagcgucugauuuuggccccgcag

SEQ ID NO: 626412 - RNA, 64 nt, Homo Sapiens
gcuuggaagagcuggggagaagccccagcaggggagucggaagaagucuauuuuaguguuagga

SEQ ID NO: 626413 - RNA, 64 nt, Homo Sapiens
gcagauaacaaugcagcaaggacaagacaaaccaagucggaacauggcucuuucgucacccuug

SEQ ID NO: 626414 - RNA, 64 nt, Homo Sapiens
ccuggcccacuuaaacaagguuacaaaaaaucagagucggaagcagccaaauaggucaaccuaa

SEQ ID NO: 626415 - RNA, 64 nt, Homo Sapiens
cugaucagaguuauccacuguauuuauaaggaagagucggaaaaaacaaugaccuuaguuuuuu

SEQ ID NO: 626416 - RNA, 64 nt, Homo Sapiens
cguguuuauauacuauuuccuuugauguccuauaagucggaaaagaaaggggcaaagagaaccu

SEQ ID NO: 626417 - RNA, 64 nt, Homo Sapiens
gcgucuuuaagagacucacuucucugcaccggacagucggaaaagaggggccgauccggggccc

SEQ ID NO: 626418 - RNA, 64 nt, Homo Sapiens
acuaguggcaauagugaugaaaacagggcacaggagucggaaggcuuggguuccaauaaaggag

SEQ ID NO: 626419 - RNA, 64 nt, Homo Sapiens
gauucuggcuauugggggagcagggcaagggaccagucggaagggggggggguucccagauauu

SEQ ID NO: 626420 - RNA, 64 nt, Homo Sapiens
cagaguguuguaaaaggacaccuucacugaagcaagucggaaaguacaaugaaaauaaauauuu

SEQ ID NO: 626421 - RNA, 64 nt, Homo Sapiens
acaaauucuguucauuggaaaggguuuuaaacggagucggaaccugaguagauuuccaaauuuu

SEQ ID NO: 626422 - RNA, 64 nt, Homo Sapiens
uguagugagccaagaucacgcgcuugaaccaggcagucggaacuggaggcugaggcaggagaau

SEQ ID NO: 626423 - RNA, 64 nt, Homo Sapiens
ugcuaccccguugugggaauuguugagugacgggagucggaaugcacccauggccaacagcccu

SEQ ID NO: 626424 - RNA, 64 nt, Homo Sapiens
augagcuucccagagacagaagagacuggagcaaagucggaaacacagagaagcacggcuuccc

SEQ ID NO: 626425 - RNA, 64 nt, Homo Sapiens
aaccuuucuagguaaaccgcuugccuucaucuugagucggaauauauuuaaauaaauuguguua

SEQ ID NO: 626426 - RNA, 64 nt, Homo Sapiens
ccuucccauaagcuauagacccgaggaaacucagagucggaacggagaaagguggacuggaagg

SEQ ID NO: 626427 - RNA, 64 nt, Homo Sapiens
gcacacggggugcgucuccccucuagggcaguggagucggaaggaacucauaauagacuuccca

SEQ ID NO: 626428 - RNA, 64 nt, Homo Sapiens
cagauuucacaucuuuggauucaucuuuccugugagucggaauugaagucuuccccaaaaauau

SEQ ID NO: 626429 - RNA, 64 nt, Homo Sapiens
aggggucaguuuugucuccauuuccugaugggugagucggaauuccaaccuucuggccagaggu

SEQ ID NO: 626430 - RNA, 64 nt, Homo Sapiens
ugagaaugaggguaauccugugaagcuggccaaaagucggaaaaaaugaacaaucugacaaaug

SEQ ID NO: 626431 - RNA, 64 nt, Homo Sapiens
ugauucuccuaaacuguauaguaaccugcuaaccagucggaaagagcuaccacccaauggagau

SEQ ID NO: 626432 - RNA, 64 nt, Homo Sapiens
gccuacaggccuuggucuuggcuuguccucacccagucggaacucccuaccacuuucaggagag

SEQ ID NO: 626433 - RNA, 64 nt, Homo Sapiens
uaaacuguauagcacuuugucacgguuccugcagagucggaaucccagacccgauccauucagu

SEQ ID NO: 626434 - RNA, 64 nt, Homo Sapiens
caaacuuuugacguccugauuauuuccuauagcuagucggaauguaauaaaaagagaaaaaaac

SEQ ID NO: 626435 - RNA, 64 nt, Homo Sapiens
aaaaggccaccuaggcaauggaagcccucaaagaagucggaaugucauagucuugaaaugaaag

SEQ ID NO: 626436 - RNA, 64 nt, Homo Sapiens
ccgccuucaggccgcucccccgagauucuggggcagucggaagaugugggcccugggugggagc

SEQ ID NO: 626437 - RNA, 64 nt, Homo Sapiens
cucaaaguucauauuguguggcugaucugaagucagucggaauuuguaaacaggguagcaaaca
